(12) United States Patent
Botes et al.

(10) Patent No.: US 9,220,742 B1
(45) Date of Patent: Dec. 29, 2015

(54) MUTANT POLYPEPTIDES AND USES THEREOF

(71) Applicant: INVISTA North America S.a.r.l., Wilmington, DE (US)

(72) Inventors: Adriana Botes, Rosedale East-Cleveland (GB); Nadia Kadi, Marton (GB); Mihai Luchian Azoitei, Chapel Hill, NC (US); Yih-En A Ban, Seattle, WA (US); Daniela Grabs-Röthlisberger, Seattle, WA (US); Alexander Pisarchik, Bothell, WA (US); Alexandre Zanghellini, Seattle, WA (US); Eric Althoff, Seattle, WA (US)

(73) Assignee: INVISTA NORTH AMERICA S.A.R.L., Wilmington, DE (US)

( * ) Notice: Subject to any disclaimer, the term of this patent is extended or adjusted under 35 U.S.C. 154(b) by 0 days.

(21) Appl. No.: 14/800,961

(22) Filed: Jul. 16, 2015

Related U.S. Application Data

(60) Provisional application No. 62/126,279, filed on Feb. 27, 2015.

(51) Int. Cl.
*A61K 38/51* (2006.01)
*C12N 9/90* (2006.01)
*A61K 38/00* (2006.01)

(52) U.S. Cl.
CPC ...................................... *A61K 38/00* (2013.01)

(58) Field of Classification Search
CPC ................................... C12N 9/90; A61K 38/00
USPC ............... 424/94.5; 435/233, 252.3; 536/23.2
See application file for complete search history.

(56) References Cited

U.S. PATENT DOCUMENTS 8,703,455 B2    4/2014  Marliere
8,895,278 B2 *  11/2014 Marliere ....................... 435/167

FOREIGN PATENT DOCUMENTS

WO   WO 2014/100726 A2   6/2014
WO   WO 2014/184345 A1   11/2014
WO   WO 2015/000981 A2   1/2015

* cited by examiner

*Primary Examiner* — Tekchand Saidha
(74) *Attorney, Agent, or Firm* — Finnegan, Henderson, Farabow, Garrett & Dunner, L.L.P.

(57) ABSTRACT

The present disclosure provides novel polypeptides with 3-buten-2-ol dehydratase activity, polypeptides with catalytic activity in the conversion of 3-methyl-3-buten-2-ol to isoprene, and crystal structure data for one of such polypeptides. Methods of making and using the polypeptides and their related crystal structure data are also provided.

12 Claims, 17 Drawing Sheets
(6 of 17 Drawing Sheet(s) Filed in Color)

FIGURE 12
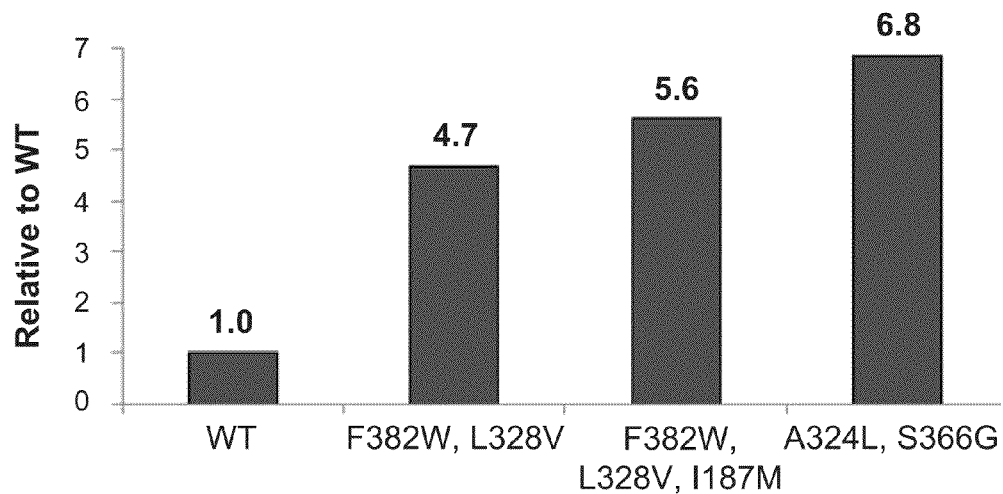
Fig. 12A
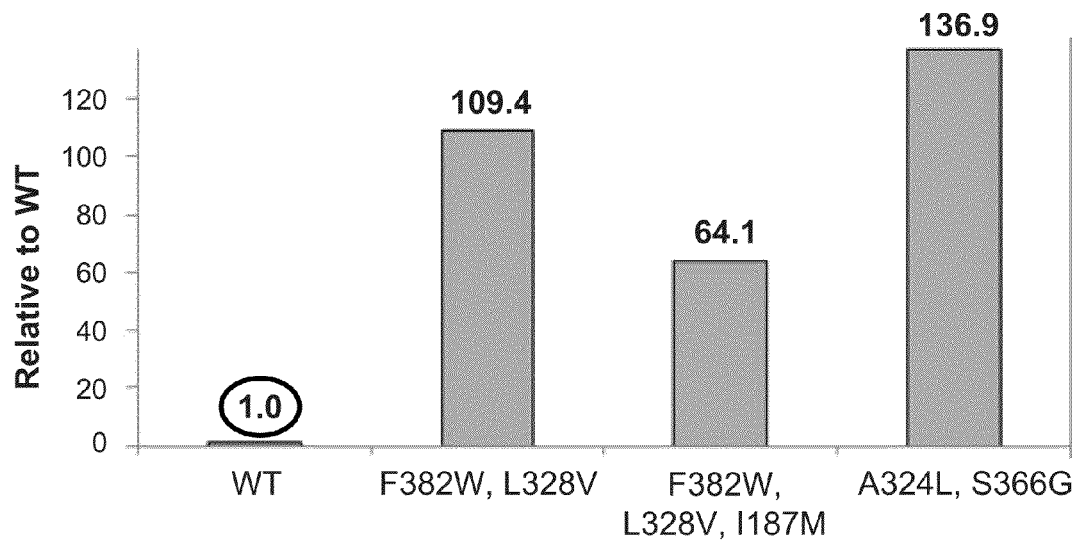
Fig. 12B

FIGURE 17
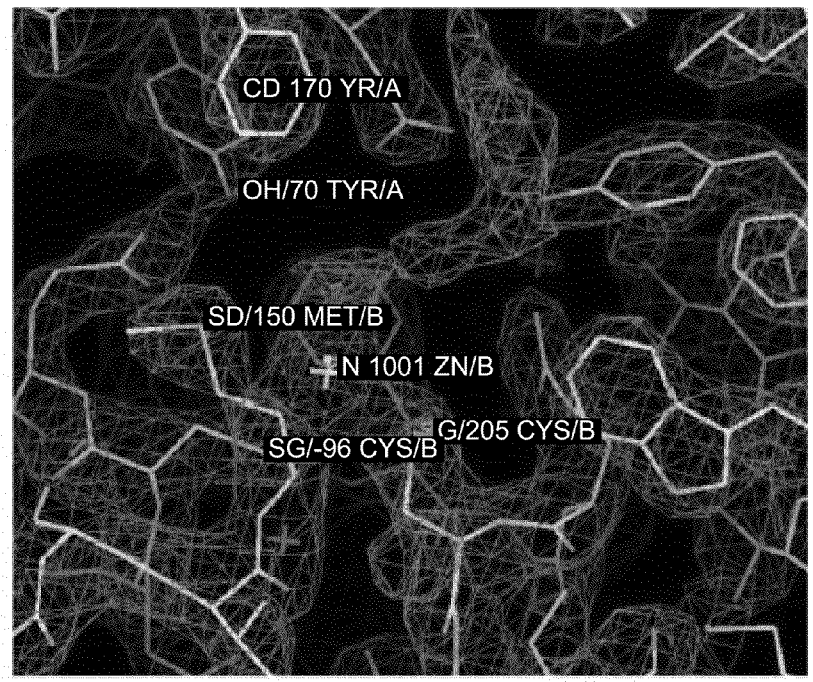
FIG. 17A
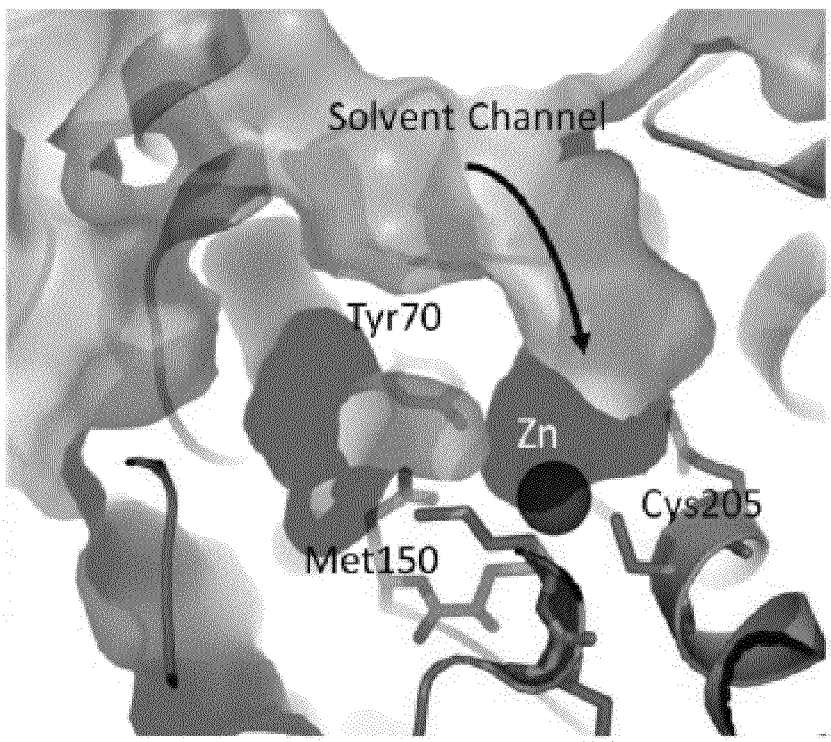
FIG. 17B

MUTANT POLYPEPTIDES AND USES THEREOF

CROSS-REFERENCE TO RELATED APPLICATIONS

This application claims the benefit of U.S. Provisional Application No. 62/126,279, filed on Feb. 27, 2015, the contents of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Jul. 15, 2015, is named 12444.0235-00_SL.txt and is 1,439,337 bytes in size.

FIELD

The present disclosure provides novel polypeptides with catalytic activity in the conversion of 3-buten-2-ol to butadiene, polypeptides with catalytic activity in the conversion of 3-methyl-3-buten-2-ol to isoprene, and crystal structure data for one of such polypeptides. Methods of making and using the polypeptides and their related crystal structure data are also provided.

BACKGROUND 1,3-Butadiene (hereinafter butadiene) is an important monomer for the production of synthetic rubbers including styrene-butadiene-rubber (SBR), polybutadiene (PB), styrene-butadiene latex (SBL), acrylonitrile-butadiene-styrene resins (ABS), nitrile rubber, and adiponitrile, which is used in the manufacture of Nylon-66 (White, Chemico-Biological Interactions, 2007, 166, 10-14). Butadiene is typically produced as a co-product from the steam cracking process, distilled to a crude butadiene stream, and purified via extractive distillation (White, Chemico-Biological Interactions, 2007, 166, 10-14). Industrially, 95% of global butadiene production is undertaken via the steam cracking process using petrochemical-based feedstocks such as naphtha. Butadiene has also been prepared, among other methods, by dehydrogenation of n-butane and n-butene (Houdry process) and oxidative dehydrogenation of n-butene (Oxo-D or O—X-D process) (White, Chemico-Biological Interactions, 2007, 166, 10-14). These methods are associated with high cost of production and low process yield (White, Chemico-Biological Interactions, 2007, 166, 10-14).

Isoprene is an important monomer for the production of specialty elastomers including motor mounts/fittings, surgical gloves, rubber bands, golf balls and shoes. Styrene-isoprene-styrene block copolymers form a key component of hot-melt pressure-sensitive adhesive formulations and cis-poly-isoprene is utilised in the manufacture of tires (Whited et al., *Industrial Biotechnology*, 2010, 6(3), 152-163). Manufacturers of rubber goods depend on either imported natural rubber from the Brazilian rubber tree or petroleum-based synthetic rubber polymers (Whited et al., 2010, supra).

Given a reliance on petrochemical feedstocks and energy intensive catalytic steps, biotechnology offers an alternative approach to butadiene and isoprene synthesis via biocatalysis. Biocatalysis is the use of biological catalysts, such as enzymes, to perform biochemical transformations of organic compounds. Accordingly, there is a need for sustainable methods for producing butadiene and isoprene, wherein the methods are biocatalyst-based Wang et al, Biotechnology & Bioengineering, 2012, 109(10), 2437-2459). Both bioderived feedstocks and petrochemical feedstocks are viable starting materials for the biocatalysis processes.

SUMMARY

This disclosure provides novel, recombinant, polypeptides that can catalyze the dehydration of 3-buten-2-ol to 1,3-butadiene and that of 3-methyl-3-buten-2-ol into isoprene. These novel polypeptides have numerous industrial applications in polymer biosynthesis. To improve on their catalytic activity, one of these polypeptides was crystalized and the respective crystal structure data is disclosed herein. Such crystal structure data can be used for modeling new and improved artificially-created enzymes with desired LDH activity.

Linalool dehydratase (EC 4.2.1.127; LDH) is a unique bi-functional enzyme which naturally catalyzes the dehydration of linalool to myrcene and the isomerization of linalool to geraniol. LDH can also catalyze the conversion of 3-methyl-3-buten-2-ol into isoprene. See PCT/US2013/045430, published as WO/2013/188546 and US Patent Publication No. 20150037860 herein incorporated by reference in their entireties. Isoprene can also be synthesized by other methods. See US Patent Publication Nos. 20150037860 and 20130217081, herein incorporated by reference in their entireties.

It has been discovered that LDH from *Castellaniilla defragrans* (cdLD) is also able to convert 3-buten-2-ol to 1,3-butadiene, albeit in low yields. Provided herein are novel polypeptides with advantageous properties in industrial synthesis of 1,3-butadiene, relative to those of wild-type cdLD. These polypeptides exhibit improved 3-buten-2-ol dehydratase activity and also show improved activity in the catalysis of the conversion of 3-methyl-3-buten-2-ol into isoprene.

This disclosure also unveils the crystal structure of apo cdLD, elucidated by X-ray crystallography. Crystals of purified apo cdLD were obtained and the tri-dimensional structure of this enzyme elucidated for the first time, and independently confirmed. The elucidation of this crystal structure data allows for a better understanding of cdLD's enzymatic activity and the intelligent design of numerous improvements of the same, as well as the development of a variety of substrates and inhibitors.

Some embodiments provide a polypeptide comprising an amino acid sequence with at least 90% amino acid sequence homology to SEQ ID NO:1, wherein said amino acid sequence comprises at least one, preferably one to five, mutations at the following X positions of SEQ ID NO:1

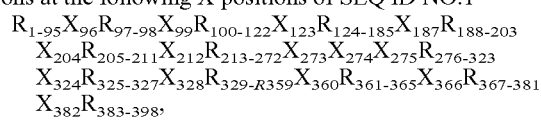

wherein:

$X_{96}$ is mutated to a different amino acid selected from L and equivalent amino acids;

$X_{99}$ is mutated to a different amino acid selected from L and equivalent amino acids;

$X_{123}$ is mutated to a different amino acid selected from I and equivalent amino acids;

$X_{187}$ is mutated to a different amino acid selected from M and equivalent amino acids;

$X_{204}$ is mutated to a different amino acid selected from I and equivalent amino acids;

$X_{212}$ is mutated to a different amino acid selected from F, Y, and equivalent amino acids;

$X_{273}$ is mutated to a different amino acid selected from C and equivalent amino acids;

$X_{274}$ is mutated to a different amino acid selected from F and equivalent amino acids;

$X_{275}$ is mutated to a different amino acid selected from I and equivalent amino acids;

$X_{324}$ is mutated to a different amino acid selected from L, E, and equivalent amino acids;

$X_{328}$ is mutated to a different amino acid selected from V and equivalent amino acids;

$X_{360}$ is mutated to a different amino acid selected from Y and equivalent amino acids;

$X_{356}$ is mutated to a different amino acid selected from V,C,G, and equivalent amino acids;

$X_{382}$ is mutated to a different amino acid selected from W and equivalent amino acids; and each R is the same as the corresponding amino acid in SEQ ID NO:1. In another embodiment, the homology to SEQ ID NO:1 is at least 91, at least 92, at least 93, at least 94, at least 95, at least 96, at least 97, at least 98, or at least 99%.

In another embodiment, the polypeptide of the previous paragraph is such that said amino acid sequence has at least 91% amino acid sequence homology to SEQ ID NO:1, preferably at least 92% amino acid sequence homology to SEQ ID NO:1, preferably at least 93% amino acid sequence homology to SEQ ID NO:1, preferably at least 94% amino acid sequence homology to SEQ ID NO:1, preferably at least 95% amino acid sequence homology to SEQ ID NO:, preferably at least 96% amino acid sequence homology to SEQ ID NO:1, preferably at least 97% amino acid sequence homology to SEQ ID NO:1, preferably at least 98% amino acid sequence homology to SEQ ID NO:1, or preferably at least 99% amino acid sequence homology to SEQ ID NO:1.

Another embodiment provides for the polypeptide according to the two previous paragraphs, wherein said amino acid sequence comprises one of the specified mutations at one of the following specified positions of SEQ ID NO:1

$R_{1-95}X_{96}R_{97-98}X_{99}R_{100-122}X_{123}R_{124-185}X_{187}R_{188-203}$
$X_{204}R_{205-211}X_{212}R_{213-272}X_{273}X_{274}X_{275}R_{276-323}$
$X_{324}R_{325-327}X_{328}R_{329-R359}X_{360}R_{361-365}X_{366}R_{367-381}$
$X_{382}R_{383-398}$, wherein:

$X_{96}$ is mutated to a different amino acid selected from L and equivalent amino acids;

$X_{99}$ is mutated to a different amino acid selected from L and equivalent amino acids;

$X_{123}$ is mutated to a different amino acid selected from I and equivalent amino acids;

$X_{187}$ is mutated to a different amino acid selected from M and equivalent amino acids;

$X_{204}$ is mutated to a different amino acid selected from I and equivalent amino acids;

$X_{212}$ is mutated to a different amino acid selected from F, Y, and equivalent amino acids;

$X_{273}$ is mutated to a different amino acid selected from C and equivalent amino acids;

$X_{274}$ is mutated to a different amino acid selected from F and equivalent amino acids;

$X_{275}$ is mutated to a different amino acid selected from I and equivalent amino acids;

$X_{324}$ is mutated to a different amino acid selected from L, E, and equivalent amino acids;

$X_{328}$ is mutated to a different amino acid selected from V and equivalent amino acids;

$X_{360}$ is mutated to a different amino acid selected from Y and equivalent amino acids;

$X_{366}$ is mutated to a different amino acid selected from VCG, and equivalent amino acids;

$X_{382}$ is mutated to a different amino acid selected from W and equivalent amino acids; and each R is the same as the corresponding amino acid in SEQ ID NO:1 These listed positions are hereafter referred to as the specified positions and these listed mutations are hereafter referred to as the specified mutations.

In another embodiment, the polypeptide according to the previous paragraphs of this SUMMARY is such that said amino acid sequence comprises two of the specified mutations at two of the specified positions.

In another embodiment, the polypeptide according to the previous paragraphs of this SUMMARY is such that said amino acid sequence comprises three of the specified mutations at three of the specified positions.

In another embodiment, the polypeptide according to the previous paragraphs of this SUMMARY is such that said amino acid sequence comprises four of the specified mutations at four of the specified positions.

In another embodiment, the polypeptide according to the previous paragraphs of this SUMMARY is such that said amino acid sequence comprises five of the specified mutations at five of the specified positions.

In another embodiment, the polypeptide according to the previous paragraphs of this SUMMARY is such that X96 is mutated to a different amino acid selected from L and equivalent amino acids.

In another embodiment, the polypeptide according to the previous paragraphs of this SUMMARY is such that X99 is mutated to a different amino acid selected from L and equivalent amino acids.

In another embodiment, the polypeptide according to the previous paragraphs of this SUMMARY is such that X123 is mutated to a different amino acid selected from I and equivalent amino acids.

In another embodiment, the polypeptide according to the previous paragraphs of this SUMMARY is such that X187 is mutated to a different amino acid selected from M and equivalent amino acids.

In another embodiment, the polypeptide according to the previous paragraphs of this SUMMARY is such that X204 is mutated to a different amino acid selected from 1 and equivalent amino acids.

In another embodiment, the polypeptide according to the previous paragraphs of this SUMMARY is such that X212 is mutated to a different amino acid selected from F, Y, and equivalent amino acids.

In another embodiment, the polypeptide according to the previous paragraphs of this SUMMARY is such that X273 is mutated to a different amino acid selected from C and equivalent amino acids.

In another embodiment, the polypeptide according to the previous paragraphs of this SUMMARY is such that X274 is mutated to a different amino acid selected from F and equivalent amino acids.

In another embodiment, the polypeptide according to the previous paragraphs of this SUMMARY is such that X275 is mutated to a different amino acid selected from 1 and equivalent amino acids.

In another embodiment, the polypeptide according to the previous paragraphs of this SUMMARY is such that X324 is mutated to a different amino acid selected from L, E, and equivalent amino acids.

In another embodiment, the polypeptide according to the previous paragraphs of this SUMMARY is such that X328 is mutated to a different amino acid selected from V and equivalent amino acids.

In another embodiment, the polypeptide according to the previous paragraphs of this SUMMARY is such that X360 is mutated to a different amino acid selected from Y and equivalent amino acids.

In another embodiment, the polypeptide according to the previous paragraphs of this SUMMARY is such that X366 is mutated to a different amino acid selected from V,C,G, and equivalent amino acids.

In another embodiment, the polypeptide according to the previous paragraphs of this SUMMARY is such that X382 is mutated to a different amino acid selected from W and equivalent amino acids.

In another embodiment, the polypeptide according to the previous paragraphs of this SUMMARY is such that it comprises the following four mutations: V123I, V204I, M274F, and V275I; preferably comprising only those four mutations.

In another embodiment, the polypeptide according to the previous paragraphs of this SUMMARY is such that it comprises the following five mutations: V123I, V204I, M274F, V275I, and F382W; preferably comprising only those five mutations.

In another embodiment, the polypeptide according to the previous paragraphs of this SUMMARY is such that it comprises the following two mutations: V275I and F382W; preferably comprising only those two mutations.

In another embodiment, the polypeptide according to the previous paragraphs of this SUMMARY is such that it comprises the following four mutations: A324L, V275I, V123I, and V204I; preferably comprising only those four mutations.

In another embodiment, the polypeptide according to the previous paragraphs of this SUMMARY is such that it comprises the following two mutations: A324L and S366G; preferably comprising only those two mutations.

In another embodiment, the polypeptide according to the previous paragraphs of this SUMMARY is such that it comprises the following two mutations: M274F and F96L; preferably comprising only those two mutations.

In another embodiment, the polypeptide according to the previous paragraphs of this SUMMARY is such that it comprises the following two mutations: M274F and Y99L; preferably comprising only those two mutations.

In another embodiment, the polypeptide according to the previous paragraphs of this SUMMARY is such that it comprises the following two mutations: F382W and L212Y; preferably comprising only those two mutations.

In another embodiment, the polypeptide according to the previous paragraphs of this SUMMARY is such that it comprises the following two mutations: F382W and A273C.

In another embodiment, the polypeptide according to the previous paragraphs of this SUMMARY is such that it comprises the following two mutations: F382W and L328V; preferably comprising only those two mutations.

In another embodiment, the polypeptide according to the previous paragraphs of this SUMMARY is such that it comprises the following two mutations: F382W, L328V, and I187M; preferably comprising only those three mutations.

In another embodiment, the polypeptide according to the previous paragraphs of this SUMMARY is such that it comprises the following three mutations: V204I, M274F, and V275I; preferably comprising only those three mutations.

In another embodiment, the polypeptide according to the previous paragraphs of this SUMMARY is such that it comprises the following three mutations: V123I, M274F, and V275I; preferably comprising only those three mutations.

In another embodiment, the polypeptide according to the previous paragraphs of this SUMMARY is such that it comprises the following three mutations: V123I, V204I, and V275I; preferably comprising only those three mutations.

In another embodiment, the polypeptide according to the previous paragraphs of this SUMMARY is such that it comprises the following three mutations: V123I, V204I, and M274F; preferably comprising only those three mutations.

In another embodiment, the polypeptide according to the previous paragraphs of this SUMMARY is such that it comprises the following three mutations: M274F, V275I, and A324L; preferably comprising only those three mutations.

In another embodiment, the polypeptide according to the previous paragraphs of this SUMMARY is such that it comprises the following three mutations: M274F, V275I, and F382W; preferably comprising only those three mutations.

In another embodiment, the polypeptide according to the previous paragraphs of this SUMMARY is such that it comprises the following four mutations: M274F, V275I, R360Y, and F382W.

In another embodiment, the polypeptide according to the previous paragraphs of this SUMMARY is such that it comprises the following two mutations: V275I and A324L; preferably comprising only those two mutations.

In another embodiment, the polypeptide according to the previous paragraphs of this SUMMARY is such that it comprises the following two mutations: R360Y and F382W; preferably comprising only those two mutations.

In another embodiment, the polypeptide according to the previous paragraphs of this SUMMARY is such that it comprises a C-terminal His-tag.

In another embodiment, the polypeptide according to the previous paragraphs of this SUMMARY is such that it lacks a periplasmic tag.

In another embodiment, the polypeptide according to the previous paragraphs of this SUMMARY is such that the polypeptide has an activity in the catalysis of the dehydration of 3-buten-2-ol to 1,3-butadiene and/or in the catalysis of the dehydration of 3-methyl-3-buten-2-ol to isoprene that is at least 80% of that of a polypeptide consisting of SEQ ID NO:1, 4, 5, 7, or 8, increased about 1.5 fold or greater when compared to that of a polypeptide consisting of SEQ ID NO: 1, 4, 5, 7, or 8, preferably about 2 fold or greater when compared to that of a polypeptide consisting of SEQ ID NO: 1, 4, 5, 7, or 8, preferably about 2.5 fold or greater when compared to that of a polypeptide consisting of SEQ ID NO: 1, 4, 5, 7, or 8, preferably about 3 fold or greater when compared to that of a polypeptide consisting of SEQ ID NO:1, 4, 5, 7, or 8, preferably about 3.5 fold or greater when compared to that of a polypeptide consisting of SEQ ID NO: 1, 4, 5, 7, or 8, preferably about 4 fold or greater when compared to that of a polypeptide consisting of SEQ ID NO: 1, 4, 5, 7, or 8, preferably about 4.5 fold or greater when compared to that of a polypeptide consisting of SEQ ID NO: 1, 4, 5, 7, or 8, or preferably about 5 fold or greater when compared to that of a polypeptide consisting of SEQ ID NO: 1, 4, 5, 7, or 8, and wherein said activity is observed in at least one activity assay. In a further embodiment, said specific activity is measured with purified protein and is observed in at least one specific activity assay. In a further embodiment, said activity in the catalysis of the dehydration of 3-buten-2-ol to 1,3-butadiene and/or in the catalysis of the dehydration of 3-methyl-3-buten-2-ol to isoprene is observed in at least one type of non-bacterial cells. In a further embodiment, said activity in the catalysis of the dehydration of 3-buten-2-ol to 1,3-butadiene and/or in the catalysis of the dehydration of 3-methyl-3-buten-2-ol to isoprene is observed in at least one type of bacteria. In a further embodiment, said activity in the catalysis of the dehydration of 3-buten-2-ol to 1,3-butadiene and/or in the catalysis of the dehydration of 3-methyl-3-buten-2-ol to isoprene is observed in more than one type of bacteria. In a further embodiment, the bacteria are a strain of *E. Coli*. In a further embodiment, the bacteria are Origami2 (DE3) or BL21 (DE3).

Also provided are embodiments for a derivative of any one of the polypeptides according to the previous paragraphs of this SUMMARY.

Also provided are embodiments for a polynucleotide comprising, consisting of, or consisting essentially of a nucleic acid encoding any one of the polypeptides or derivatives according the previous paragraphs of this SUMMARY, preferably codon-optimized. In a further embodiment, the polynucleotide is either a DNA molecule or an RNA molecule. In a further embodiment, the polynucleotide further comprises a promoter operably linked to the nucleic acid sequence encoding the polypeptide or derivative.

Also provided are embodiments for a recombinant expression vector comprising a DNA molecule as described in any of the previous nucleotide-related paragraphs.

Also provided are embodiments for a host cell which is transformed or transduced with a DNA molecule as described in any of the previous nucleotide-related paragraphs or with a recombinant expression vector according the previous paragraph. In one further embodiment, the cell is such that the DNA molecule or the recombinant expression vector is integrated into a chromosome of the cell.

Also provided are embodiments for an organism, preferably a microorganism, comprising a heterologous DNA molecule encoding a polypeptide according to any one of the previous polypeptide-related paragraphs of this SUMMARY. In a further embodiment, the microorganism is a bacterium or a fungus. In a further embodiment, the microorganism is an *E. Coli* bacterium or a *Castellanillia defragrans* bacterium Also provided are embodiments for a transgenic animal or plant comprising a heterologous DNA molecule encoding a polypeptide according to any one of the previous polypeptide-related paragraphs of this SUMMARY.

Also provided are embodiments for a vector comprising a DNA molecule according to any one of the previous DNA molecule-related paragraphs of this SUMMARY.

Certain embodiments provide for a method of producing a polypeptide according to any one of the polypeptide-related paragraphs of this SUMMARY, the method comprising:
  (i) preparing an expression construct which comprises a polynucleotide according to any one of the polynucleotide-related paragraphs of this SUMMARY, with a sequence encoding the polypeptide according to any one of the polypeptide-related paragraphs of this SUMMARY operably linked to one or more regulatory nucleotide sequences; (ii) transfecting or transforming a suitable host cell with the expression construct; (iii) expressing the recombinant polypeptide in said host cell; and (iv) isolating or purifying the recombinant polypeptide from said host cell or using the resultant host cell as is or as a cell extract.

Another embodiment provides a method of making a polypeptide with at least 80% activity, or improved activity, in the catalysis of the dehydration of 3-buten-2-ol to 1,3-butadiene and/or in the catalysis of the dehydration of 3-methyl-3-buten-2-ol to isoprene relative to that of a polypeptide consisting of SEQ ID NO: 1, 4, 5, 7, or 8, the method comprising preparing a polypeptide according to any one of the polypeptide-related paragraphs of this SUMMARY.

Also provided as embodiments are compositions comprising one or more polypeptides according to any one of the previous paragraphs of this SUMMARY. In a further embodiment, the composition in addition comprises the polypeptide of SEQ ID NO: 1, 4, 5, 7, or 8. In a further embodiment any of these compositions comprises one or more, preferably more than one in some embodiments, polypeptides according to any one of the polypeptide-related paragraphs of this SUMMARY with at least 80% activity, or improved activity, in the catalysis of the dehydration of 3-buten-2-ol to butadiene and/or in the catalysis of the dehydration of 3-methyl-3-buten-2-ol to isoprene, relative to that of a polypeptide consisting of SEQ ID NO: 1, 4, 5, 7, or 8. In some of these embodiments, the reference polypeptide lacks a periplasmic tag. In some of these embodiments, the reference polypeptide has a His-tag. In some of these embodiments, the reference polypeptide lacks a periplasmic tag and has a His-tag. Also provided are embodiments for these compositions further comprising 3-buten-2-ol and/or 3-methyl-3-buten-2-ol. In other embodiments, these compositions further comprise 1,3-butadiene and/or isoprene.

Also provided, in another embodiment, is a composition that comprises a rubber product polymerized from 1,3-butadiene produced in the presence of a polypeptide according to any one of the polypeptide-related paragraphs of this SUMMARY. Also provided, in related embodiment, is a composition that (further) comprises a rubber product polymerized from isoprene produced in the presence of a polypeptide according to any one of the polypeptide-related paragraphs of this SUMMARY.

Also provided, in another embodiment, is a composition comprising a copolymer polymerized from 1,3-butadiene produced in the presence of a polypeptide according to any one of the polypeptide-related paragraphs of this SUMMARY. Also provided, in related embodiment, is a composition that (further) comprises a copolymer product polymerized from isoprene produced in the presence of a polypeptide according to any one of the polypeptide-related paragraphs of this SUMMARY Also provided, in another embodiment, is a composition comprising a plastic product polymerized from 1,3-butadiene produced in the presence of a polypeptide according to any one of the polypeptide-related paragraphs of this SUMMARY. Also provided, in related embodiment, is a composition that (further) comprises a plastic product polymerized from isoprene produced in the presence of a polypeptide according to any one of the polypeptide-related paragraphs of this SUMMARY.

Also provided, in another embodiment, is an antibody capable of binding to a polypeptide according to any one of the polypeptide-related paragraphs of this SUMMARY.

Another embodiment provides for a fusion protein comprising a polypeptide according to any one of the polypeptide-related paragraphs of this SUMMARY.

Another embodiment provides for a complex comprising a polypeptide according to any one of the polypeptide-related paragraphs of this SUMMARY, said complex optionally further comprising 3-buten-2-ol. Another embodiment provides for a complex comprising a polypeptide according to any one of the polypeptide-related paragraphs of this SUMMARY, said complex optionally further comprising 3-methyl-3-buten-2-ol.

Another embodiment provides for a composition comprising 3-buten-2-ol and a means for producing 1,3-butadiene.

Another embodiment provides for composition comprising a substrate and a means for enzymatically producing 1,3-butadiene from said substrate.

Another embodiment provides for method of producing 1,3-butadiene comprising:

a step for enzymatically converting 3-buten-2-ol to 1,3-butadiene; and measuring and/or harvesting the 1,3-butadiene thereby produced.

Another embodiment provides for a container and a means for producing 1,3-butadiene.

Another embodiment provides for method of designing a polypeptide with at least 80% activity, or improved activity, in the catalysis of the dehydration of 3-buten-2-ol to 1,3-butadiene relative to that of a polypeptide consisting of SEQ ID NO: 1, 4, 5, 7, or 8, the method comprising mutating a means for enzymatically converting 3-buten-2-ol to 1,3-butadiene.

Another embodiment provides for a composition comprising 3-methyl-3-buten-2-ol and a means for producing isoprene.

Another embodiment provides for composition comprising a substrate and a means for enzymatically producing isoprene from said substrate.

Another embodiment provides for method of producing isoprene comprising:

a step for enzymatically converting 3-methyl-3-buten-2-ol to isoprene; and measuring and/or harvesting the isoprene thereby produced.

Another embodiment provides for a container and a means for producing isoprene.

Another embodiment provides for method of designing a polypeptide with at least 80% activity, or improved activity, in the catalysis of the dehydration of 3-methyl-3-buten-2-ol to isoprene relative to that of a polypeptide consisting of SEQ ID NO:1, 4, 5, 7, or 8, the method comprising mutating a means for enzymatically converting 3-methyl-3-buten-2-ol to isoprene.

Another embodiment provides for a crystal having the coordinates set forth in Appendix I in space group P2(1) with cell parameters a=133.18 Å, b=110.83 Å, c=162.20 Å, which is produced from a polypeptide consisting of the amino acid sequence of SEQ ID NO:5 with up to 2% variation in any cell dimension. In another embodiment, the same crystal is expected to be produced from a polypeptide consisting of the amino acid sequence of SEQ ID NO:8 (SEQ ID NO:5 without the His-Tag).

Another embodiment provides for a crystal having the coordinates set forth in Appendix I in space group P2(1) with cell parameters a=133.18 Å, b=110.83 Å, c=162.20 Å, which is produced from a polypeptide consisting of the amino acid sequence of SEQ ID NO:5. In another embodiment, the same crystal is expected to be produced from a polypeptide consisting of the amino acid sequence of SEQ ID NO:8 (SEQ ID NO:5 without the His-Tag).

Another embodiment provides for a crystal according to the crystals described in the previous paragraphs, which diffracts x-rays for determination of atomic co-ordinates of the crystal to a resolution of between 48.16 Å and 2.54 Å.

Another embodiment provides for a crystal according to the crystals described in the previous paragraph, which comprises an active site comprising one or more residues selected from those of the following table, labeled according to SEQ ID NO:1 according to the coordinates of Appendix 1:

| Position | Residue Type | Chain |
|---|---|---|
| 65 | ASP | C |
| 66 | PHE | C |
| 71 | TYR | C |
| 89 | VAL | A |
| 91 | LYS | A |
| 92 | TYR | A |
| 96 | PHE | A |
| 151 | MET | A |
| 155 | HIS | A |
| 197 | CYS | A |
| 198 | GLU | A |
| 203 | PHE | A |
| 205 | GLN | A |
| 206 | CYS | A |
| 209 | VAL | A |
| 266 | TYR | A |
| 267 | THR | A |
| 270 | TRP | A |
| 319 | VAL | A |
| 321 | LEU | A |
| 325 | PHE | A |
| 367 | LEU | A |
| 368 | LEU | A |
| 372 | LEU | A |

Another embodiment provides for a crystal according to any one of the crystals described in the previous paragraphs, which comprises a disulfide bridge between residues Cys74 and Cys127 of a polypeptide of SEQ ID NO:5. Another embodiment provides for a crystal according to any one of the crystals described in the previous paragraphs, which comprises a disulfide bridge between residues Cys74 and Cys127 of a polypeptide of SEQ ID NO:8, wherein the residue numbers are with relation to SEQ ID NO:1.

Another embodiment provides for a co-crystal comprising the crystal as according to any one of the crystals described in the previous paragraphs bound to a substrate, such as linalool, 3-buten-2-ol, or 3-methyl-3-buten-2-ol.

Another embodiment provides for a method of identifying a substrate or an inhibitor of a LDH, comprising any one or more of the steps of: (a) obtaining a crystal, or the coordinates of a crystal, of a polypeptide comprising SEQ ID NO:5 or 8, wherein the crystal is in space group P2(1), with unit cell dimensions of about a=133.18 Å, about b=110.83 Å, about c=162.20 Å; (b) obtaining or determining the three-dimensional structure of said polypeptide using the crystal of (a) by an X-ray diffraction method; (c) displaying the three dimensional structure of said complex on a performing computer by inputting said crystal structure data of said polypeptide, wherein the performing computer comprises a computer program to generate said three dimensional structure and to identify a substrate or an inhibitor; and (d) selecting a substrate or an inhibitor of the active site of the polypeptide. In some related embodiments, the substrate is chosen from linalool, 3-buten-2-ol, and 3-methyl-3-buten-2-ol.

Another embodiment provides for a method for designing a LDH substrate or an inhibitor, the method comprising any one or more of the steps of: (a) obtaining a crystal, or the coordinates of a crystal, in space group P2(1) with cell parameters a=133.18 Å, b=110.83 Å, c=162.20 Å, of a complex consisting of a polypeptide of SEQ ID NO:5 or 8 bound to a substrate or an inhibitor at its binding location; (b) obtaining or determining the three dimensional structure of the complex using the crystal obtained in (a) by an X-ray diffraction method to obtain the atomic coordinates of the structure; (c) providing on a computer the atomic coordinates of the three dimensional structure of the complex; and (d) utilizing a program operated by the computer to design a chemical compound predicted to bind to the polypeptide of SEQ ID NO:5 or 8 at the substrate or inhibitor's binding location and either act as a substrate or inhibit LDH, based on said three dimensional structure. In a related embodiment, the designing involves de novo rational drug design and/or computational protein design. In a related embodiment, the designing involves utilizing docking software and screening one or more databases for molecules that fit the substrate binding location on the polypeptide of SEQ ID NO:5 or 8. In some related embodiments, the substrate is chosen from linalool, 3-buten-2-ol, and 3-methyl-3-buten-2-ol. In some related embodiments, the rational drug design and/or computational protein design is based on the interactions between one or more of residues of the predictive active site of the polypeptide of SEQ ID NO:5 or 8 and linalool, 3-buten-2-ol, or 3-methyl-3-buten-2-ol. In some embodiments, one or more of the following residues (numbered with relation to SEQ ID NO:1) is part of the active site:

| Position | Residue | Type Chain |
|----------|---------|------------|
| 65 | ASP | C |
| 66 | PHE | C |
| 71 | TYR | C |
| 89 | VAL | A |
| 91 | LYS | A |
| 92 | TYR | A |
| 96 | PHE | A |
| 151 | MET | A |
| 155 | HIS | A |
| 197 | CYS | A |
| 198 | GLU | A |
| 203 | PHE | A |
| 205 | GLN | A |
| 206 | CYS | A |
| 209 | VAL | A |
| 266 | TYR | A |
| 267 | THR | A |
| 270 | TRP | A |
| 319 | VAL | A |
| 321 | LEU | A |
| 325 | PHE | A |
| 367 | LEU | A |
| 368 | LEU | A |
| 372 | LEU | A |

Another embodiment provides for a method according to any one of the methods described in the previous crystal-related methods, further comprising any one or more of: (e) synthesizing or obtaining the compound; and (f) evaluating the compound for its ability to perform one or more of (1) binding the polypeptide of SEQ ID NO:5 or 8, (2) competing with linalool, 3-buten-2-ol, or 3-methyl-3-buten-2-ol for binding the polypeptide of SEQ ID NO:5 or 8, (3) inhibiting LDH, or (4) being dehydrated by the polypeptide of SEQ ID NO:5 or 8.

Another embodiment provides for a method of preparing the crystal of the polypeptide of SEQ ID NO:5 or 8 according to any one of the previous paragraphs, which comprises: (a) providing a solution having said polypeptide, in a suitable buffer such as Tris about pH8 about 20 mM, NaCl about 150 mM, Glycerol about 5%; (b) mixing the solution with a crystallization solution comprising P8000 about 10%, Ethylene Glycol about 20%, Na-l-glutamate about 0.02M, dl-alanine about 0.02M, glycine about 0.02M, dl-lysine HCl about 0.02M, dl-serine about 0.02M; and (c) incubating the mixture under conditions to promote and for a time sufficient to produce the crystal of the polypeptide of SEQ ID NO:5 or 8.

Another embodiment provides for a method of preparing the co-crystal according to the previous co-crystal-related paragraphs of this SUMMARY, which comprises the steps of: (a) providing a solution having said polypeptide, in a suitable buffer such as Tris about pH8 about 20 mM, NaCl about 150 mM, Glycerol about 5%; (b) mixing the solution with a crystallization solution comprising P8000 about 10%, Ethylene Glycol about 20%, Na-glutamate about 0.02M, dl-alanine about 0.02M, glycine about 0.02M, dl-lysine HCl about 0.02M, dl-serine about 0.02M; and (c) incubating the mixture under conditions to promote and for a time sufficient to produce the co-crystal of said polypeptide bound to said substrate, such as linalool, 3-buten-2-ol, or 3-methyl-3-buten-2-ol.

Another embodiment provides for a method of identifying a compound that binds the polypeptide of SEQ ID NO:5 or 8, comprising: (a) obtaining a crystal comprising a protein consisting of SEQ ID NO:5 or 8, in space group P2(1) with cell parameters a=133.18 Å, b=110.83 Å, c=162.20 Å; (b) determining the three-dimensional structure of said polypeptide by X-ray diffraction to obtain the atomic coordinates of Appendix I; (c) contacting the polypeptide structure defined by the atomic coordinates of Appendix I, or a subset thereof with a test compound; and (d) detecting an interaction between the compound and the atomic coordinates, wherein an energetically favored interaction between the test compound and the atomic coordinates is indicative of a compound that binds said polypeptide.

Another embodiment provides for a crystal as defined in any one of the previous crystal-related paragraphs, wherein the atomic coordinates define one or more regions as set forth in Table 3.

Another embodiment provides for a polypeptide according to any one of the previous polypeptide-related paragraphs of this SUMMARY, wherein the polypeptide has an activity in the catalysis of the dehydration of 3-methyl-3-buten-2-ol to isoprene that is at least 80% of that of a polypeptide consisting of SEQ ID NO:1, 4, 5, 7, or 8, increased about 1.5 fold or greater when compared to that of a polypeptide consisting of SEQ ID NO: SEQ ID NO:1, 4, 5, 7, or 8, preferably about 2 fold or greater when compared to that of a polypeptide consisting of SEQ ID NO: SEQ ID NO:1, 4, 5, 7, or 8, preferably about 2.5 fold or greater when compared to that of a polypeptide consisting of SEQ ID NO: SEQ ID NO:1, 4, 5, 7, or 8, preferably about 3 fold or greater when compared to that of a polypeptide consisting of SEQ ID NO: SEQ ID NO:1, 4, 5, 7, or 8, preferably about 3.5 fold or greater when compared to that of a polypeptide consisting of SEQ ID NO: SEQ ID NO:1, 4, 5, 7, or 8, preferably about 4 fold or greater when compared to that of a polypeptide consisting of SEQ ID NO: SEQ ID NO:1, 4, 5, 7, or 8, preferably about 4.5 fold or greater when compared to that of a polypeptide consisting of SEQ ID NO: SEQ ID NO:1, 4, 5, 7, or 8, or preferably about 5 fold or greater when compared to that of a polypeptide consisting of SEQ ID NO: SEQ ID NO:1, 4, 5, 7, or 8, or preferably about 15 fold or greater when compared to that of a polypeptide consisting of SEQ ID NO: 1, 4, 5, 7, or 8, and wherein said activity is observed in at least one activity assay or preferably about 55 fold or greater when compared to that of a polypeptide consisting of 1, 4, 5, 7, or 8, preferably about 30 fold or greater when compared to that of a polypeptide consisting of 1, 4, 5, 7, or 8, and wherein said activity is observed in at least one activity assay. In some related embodiments, said activity in the catalysis of the dehydration of 3-methyl-3-buten-2-ol to isoprene is observed in at least one type of non-bacterial cells. In some other related embodiments, said activity in the catalysis of the dehydration of 3-methyl-3-buten-2-ol to isoprene is observed in at least one type of bacteria. In some other related embodiments, said activity in the catalysis of the dehydration of 3-methyl-3-buten-2-ol to isoprene is observed in more than one type of bacteria. In some related embodiments, the bacteria are a strain of E. Coli. In some related embodiments, the bacteria are Origami2(DE3) or BL21 (DE3).

Another embodiment provides for composition comprising 3-methyl-3-buten-2-ol and a means for producing isoprene.

Another embodiment provides for a composition comprising a substrate and a means for enzymatically producing isoprene from said substrate.

Another embodiment provides for a method of producing isoprene comprising:
  a step for enzymatically converting 3-methyl-3-buten-2-ol to isoprene; and measuring and/or harvesting the isoprene thereby produced.

Another embodiment provides for an apparatus comprising a container and a means for producing isoprene.

Another embodiment provides for a method of designing a polypeptide with at least 80% activity, or improved activity, in the catalysis of the dehydration of 3-methyl-3-buten-2-ol to isoprene relative to that of a polypeptide consisting of SEQ ID NO:1, 4, 5, 7, or 8, the method comprising mutating a means for enzymatically converting 3-methyl-3-buten-2-ol to isoprene.

Another embodiment provides for a polypeptide comprising any one or more of the sequences for each of the mutants identified in Appendix 3. Another embodiment provides for a polypeptide comprising any one or more of the sequences for each of the mutants identified in Table 9.

Another embodiment provides for a method for making an enzyme that has improved activity in the catalysis of the dehydration of 3-buten-2-ol to 1,3-butadiene and/or in the catalysis of the conversion of 3-methyl-3-buten-2-ol into isoprene comprising: identifying reactive amino acid functional groups and functional group geometry to catalyze said reaction, thereby constructing an active site; constructing a set of amino acid rotamers from a structural library, where the rotamers incorporate said functional groups and said functional group geometry; computationally identifying an active site placement in a set of candidate protein backbone scaffolds by a hashing algorithm, where the set of amino acid rotamers comprising said active site placement is positioned on a candidate protein backbone so that the active site satisfies protein stereochemistry and maintains catalytic geometry; computationally selecting an amino acid sequence to accommodate the identified scaffold and the placed active site, thereby identifying a putative enzyme; producing the putative enzyme and confirming activity in the catalysis of the dehydration of 3-buten-2-ol to 1,3-butadiene and/or in the catalysis of the conversion of 3-methyl-3-buten-2-ol into isoprene. In one embodiment, this method is executed according to one or more of the techniques for computational design of enzymes disclosed in U.S. Pat. No. 8,340,951.

Other objects, features and advantages of the disclosed methods, systems and compositions will become apparent from the following detailed description. It should be understood, however, that the detailed description and the specific examples, while indicating specific embodiments, are given by way of illustration only, since various changes and modifications within the spirit and scope of the inventions provided herein will become apparent to those skilled in the art from this detailed description.

BRIEF DESCRIPTION OF DRAWINGS

Those of skill in the art will understand that the drawings, described below, are for illustrative purposes only. The drawings are not intended to limit the scope of the present teachings in any way.

The patent or application file contains at least one drawing executed in color. Copies of this patent or patent application publication with color drawing(s) will be provided by the United States Patent and Trademark Office upon request and payment of the necessary fee.

FIG. 1A: pentameric symmetry arrangement observed in the crystal structure FIG. 1B: cdLD monomer with secondary structure highlighted. Alpha helixes are in red, beta strands in yellow and loops in green. cdLD adopts a α/α(6) barrel fold. The innermost helixes of the barrel lining are labeled.

FIG. 12: FIG. 12A, Butadiene production from 3-buten-2-ol (10 mM); and FIG. 12B, Isoprene production from 3-methyl-3-buten-2-ol (10 mM), by certain purified mutants.

FIG. 17: FIG. 17A, electron density associated with the putative active site of cdLD. Blue mesh is the 2Fo-Fc map at 1.5 sigma and in green is the Fo-Fc map at 3.0 sigma; FIG. 17B: cutaway ribbon and surface representation of the putative active site. The modeled zinc atom is a dark gray sphere and all amino acids within 6 Å of the zinc are displayed as stick structures. A black arrow indicates the position and direction of the narrow solvent-accessible channel.

DETAILED DESCRIPTION

Figure 1:
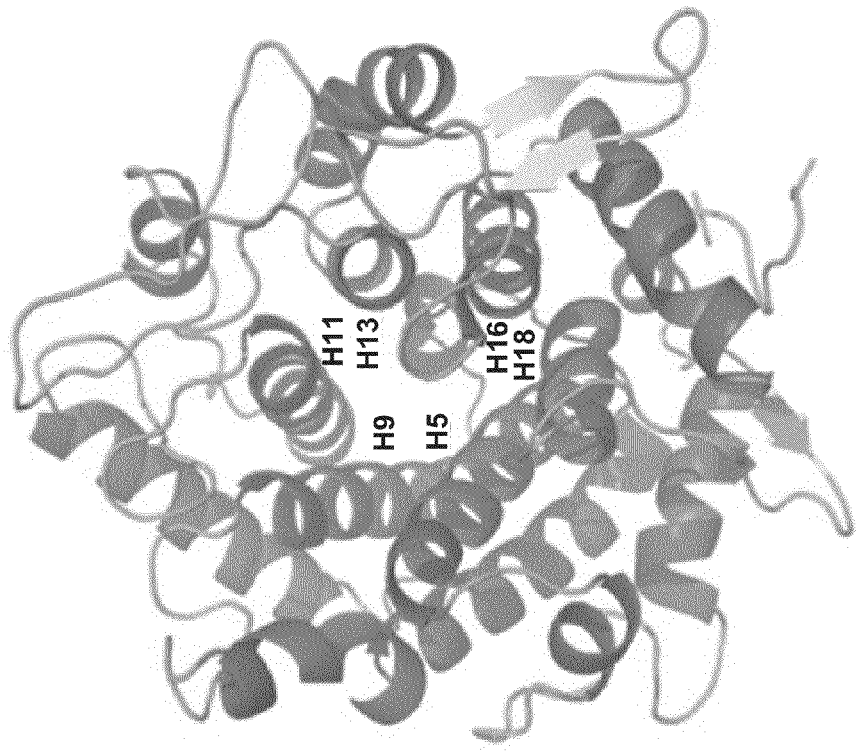
FIG. 1: Overview of cdLD structural architecture, based on the high-resolution structure obtained by X-ray crystallography.
Figure 1:
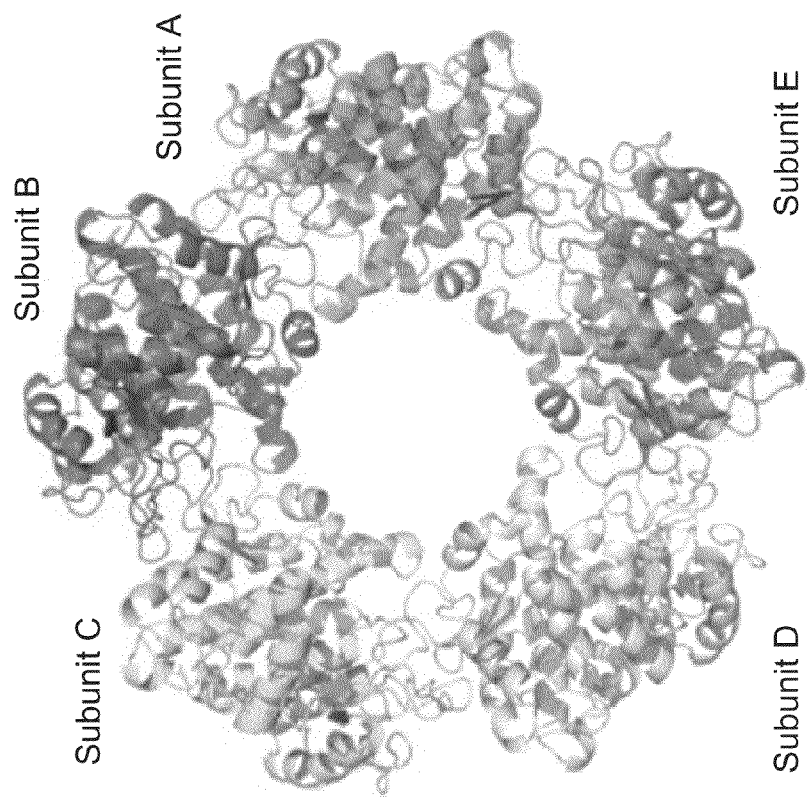

All references referred to are incorporated herein by reference in their entireties, Unless specifically defined otherwise, all technical and scientific terms used herein have the same meaning as commonly understood by one of ordinary skill in the art to which this disclosure belongs. Unless mentioned otherwise, the techniques employed or contemplated herein are standard methodologies well known to one of ordinary skill in the art. The practice of the present disclosure will employ, unless otherwise indicated, conventional techniques of microbiology, tissue culture, molecular biology, chemistry, biochemistry and recombinant DNA technology, which are within the skill of the art. The materials, methods and examples are illustrative only and not limiting. The following is presented by way of illustration and is not intended to limit the scope of the disclosure.

Many modifications and other embodiments of the disclosures set forth herein will come to mind to one skilled in the art to which these disclosures pertain having the benefit of the teachings presented in the foregoing descriptions and the associated drawings. Therefore, it is to be understood that the disclosures are not to be limited to the specific embodiments disclosed and that modifications and other embodiments are intended to be included within the scope of the appended claims. Although specific terms are employed herein, they are used in a generic and descriptive sense only and not for purposes of limitation.

Units, prefixes and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. The terms defined below are more fully defined by reference to the specification as a whole.

In the present description and claims, the conventional one-letter and three-letter codes for amino acid residues are used. For ease of reference, the polypeptides described herein are described by use of the following nomenclature: Original amino acid(s):position(s):substituted amino acid(s) (e.g., A324L, where A is replaced with L at amino acid position 324). All the numbering is with reference to the numbering of wild-type polypeptide of SEQ ID NO:1

In the present description and claims, the activity of the claimed polypeptide is measured relative to that of the polypeptide of SEQ ID NO: NO:1, 4, 5, 7, or 8, unless otherwise specified. The numbering of the mutations of each disclosed polypeptide is determined relative to that of the protein of SEQ ID NO:1 (full length cdLD with two Methionines). The homology of the polypeptide to the wild-type cdLD of SEQ ID NO:1 is determined without taking into account the presence or lack of a periplasmic tag, the presence of one or two initial Methionines, and the presence or lack of a poly-His tag.

In some embodiments, numbers expressing quantities of ingredients, properties such as molecular weight, reaction conditions and results, and so forth, used to describe and claim certain embodiments of the present disclosure are to be understood as being modified in some instances by the term "about." In some embodiments, the term "about" is used to indicate that a value includes the standard deviation of the mean for the device or method being employed to determine the value. In some embodiments, the numerical parameters set forth in the specification (into which the claims are incorporated in their entirety) are approximations that can vary depending upon the desired properties sought to be obtained by a particular embodiment. In some embodiments, the numerical parameters should be construed in light of the number of reported significant digits and by applying ordinary rounding techniques. Notwithstanding that the numerical ranges and parameters setting forth the broad scope of some embodiments of the present disclosure are approximations, the numerical values set forth in the specific examples are reported as precisely as practicable. The numerical values presented in some embodiments of the present disclosure may contain certain errors necessarily resulting from the standard deviation found in their respective testing measurements. The recitation of ranges of values herein is merely intended to serve as a shorthand method of referring individually to each separate value falling within the range. Unless otherwise indicated herein, each individual value is incorporated into the specification as if it were individually recited herein.

As used herein, the term "butadiene," having the molecular formula $C_4H_6$ and a molecular mass of 54.09 g/mol (IUPAC name Buta-1,3-diene), is used interchangeably with 1,3-butadiene, biethylene, erythrene, divinyl, vinylethylene. Butadiene is a colorless, non-corrosive liquefied gas with a mild aromatic or gasoline-like odor. Butadiene is both explosive and flammable because of its low flash point.

The term "conservatively modified variants" applies to both amino acid and nucleic acid sequences. With respect to particular nucleic acid sequences, conservatively modified variants refer to those nucleic acids that encode identical or conservatively modified variants of the amino acid sequences. Because of the degeneracy of the genetic code, a large number of functionally identical nucleic acids encode any given protein. For instance, the codons GCA, GCC, CCG and CCU all encode the amino acid alanine. Thus, at every position where an alanine is specified by a codon, the codon can be altered to any of the corresponding codons described without altering the encoded polypeptide. Such nucleic acid variations are "silent variations" and represent one species of conservatively modified variation. Every nucleic acid sequence herein that encodes a polypeptide also describes every possible silent variation of the nucleic acid. One of ordinary skill will recognize that each codon in a nucleic acid (except AUG, which is ordinarily the only codon for methionine; one exception is *Micrococcus rubens*, for which GTG is the methionine codon (Ishizuka, et al., (1993) J. Gen. Microbiol. 139:425-32) can be modified to yield a functionally identical molecule. Accordingly, each silent variation of a nucleic acid, which encodes a polypeptide of the present disclosure, is implicit in each described polypeptide sequence and incorporated herein by reference.

As to amino acid sequences, one of skill will recognize that individual substitutions, deletions or additions to a nucleic acid, peptide, polypeptide or protein sequence which alters, adds, or deletes a single amino acid or a small percentage of amino acids in the encoded sequence is a "conservatively modified variant" when the alteration results in the substitution of an amino acid with a chemically similar amino acid. Thus, any number of amino acid residues can be so altered. Conservatively modified variants typically provide equivalent biological activity as the unmodified polypeptide sequence from which they are derived. Conservative substitution tables providing functionally similar amino acids, also referred herein as "equivalent amino acids" are well known in the art.

The terms "comprise," "have" and "include" are open-ended linking verbs. Any forms or tenses of one or more of these verbs, such as "comprises," "comprising," "has," "having," "includes" and "including," are also open-ended. For example, any method that "comprises," "has" or "includes" one or more steps is not limited to possessing only those one or more steps and can also cover other unlisted steps. Similarly, any composition that "comprises," "has" or "includes" one or more features is not limited to possessing only those one or more features and can cover other unlisted features. All methods described herein can be performed in any suitable order unless otherwise indicated herein or otherwise clearly contradicted by context. The use of any and all examples, or exemplary language (e.g. "such as") provided with respect to certain embodiments herein is intended merely to better illuminate the present disclosure and does not pose a limitation on the scope of the present disclosure otherwise claimed. No language in the specification should be construed as indicating any non-claimed element as essential to the practice of the present disclosure.

As used herein, "consisting essentially of" means the inclusion of additional sequences to an object polynucleotide or polypeptide where the additional sequences do not materially affect the basic function of the claimed polynucleotide or polypeptide sequences.

"Codon optimization" is the process of modifying a nucleotide sequence in a manner that improves its expression, G/C content, RNA secondary structure, and translation in eukaryotic cells, without altering the amino acid sequence it encodes. Altered codon usage is often employed to alter translational efficiency and/or to optimize the coding sequence for expression in a desired host or to optimize the codon usage in a heterologous sequence for expression in a particular host. Codon usage in the coding regions of the polynucleotides of the present disclosure can be analyzed statistically using commercially available software packages such as "Codon Preference" available from the University of Wisconsin Genetics Computer Group, See, Devereaux, et al., (1984) Nucleic Acids Res. 12:387-395) or MacVector 4.1 (Eastman Kodak Co., New Haven, Conn.). Thus, the present disclosure provides a codon usage frequency characteristic of the coding region of at least one of the polynucleotides of the present disclosure. The number of polynucleotides (3 nucleotides per amino acid) that can be used to determine a codon usage frequency can be any integer from 3 to the number of polynucleotides of the present disclosure as provided herein. Optionally, the polynucleotides will be full-length sequences. An exemplary number of sequences for statistical analysis can be at least 1, 5, 10, 20, 50 or 100.

The term "crystal" means a structure (such as a three dimensional (3D) solid aggregate) in which the plane faces intersect at definite angles and in which there is a regular structure (such as internal structure) of the constituent chemical species. The term "crystal" refers in particular to a solid physical crystal form such as an experimentally-prepared crystal. Optionally, the crystal of cdLD may comprise one or more molecules which bind to cdLD's active site, or otherwise soaked into the crystal or cocrystallised with cdLD.

The term "derived" encompasses the terms "originated from", "obtained" or "obtainable from", and "isolated from".

"Equivalent amino acids" can be determined either on the basis of their structural homology with the amino acids for which they are substituted or on the results of comparative tests of biological activity between the various variants likely to be generated. As a non-limiting example, the list below summarizes possible substitutions often likely to be carried out without resulting in a significant modification of the biological activity of the corresponding variant:

1) Alanine (A), Serine (S), Threonine (T), Valine (V), Glycine (G), and Proline (P);
2) Aspartic acid (D), Glutamic acid (E);
3) Asparagine (N), Glutamine (Q);
4) Arginine (R), Lysine (K), Histidine (H);
5) Isoleucine (I), Leucine (L), Methionine (M), Valine (V) and
6) Phenylalanine (F), Tyrosine (Y), Tryptophan (W).

See also, Creighton, Proteins, W.H. Freeman and Co. (1984).

In making such changes/substitutions, the hydropathic index of amino acids may also be considered. The importance of the hydropathic amino acid index in conferring interactive biologic function on a protein is generally understood in the art (Kyte and Doolittle, (1982) J Mol Biol. 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

In specific embodiments, the substitution is an alanine for the native amino acid at the recited position(s). Also encompassed are the nucleic acid sequence(s) encoding the variant protein or polypeptide, "Endogenous" with reference to a polynucleotide or protein refers to a polynucleotide or protein that occurs naturally in the host cell, As used herein, "expression" refers to the process by which a polypeptide is produced based on the nucleic acid sequence of a gene. The process includes both transcription and translation.

An "expression vector" as used herein means a DNA construct comprising a DNA sequence which is operably linked to a suitable control sequence capable of effecting expression of the DNA in a suitable host. Such control sequences may include a promoter to effect transcription, an optional operator sequence to control transcription, a sequence encoding suitable ribosome binding sites on the mRNA, enhancers and sequences which control termination of transcription and translation, Examples of routinely used "expression systems" include recombinant baculovirus, lentivirus, protozoa (e.g., eukaryotic parasite *Leishmania tarentolae*), microbial expression systems, including yeast-based (e.g. *Pichia Pastoris, Saccharomyces cerevisiae, Yaerobia lipolytica, Hansenula polymorpha, Aspergillus* and *Trichoderma Fungi*) and bacterial-based (e.g. *E. Coli, Pseudomonas fluorescens, Lactobacillus, Lactococcus, Bacillus megaterium, Bacillus Subtilis, Brevibacillus, Corynebacterium glutamicum*), Chinese hamster ovary (CHO) cells, CHOK1SVNSO (Lonza), BHK (baby hamster kidney), PerC.6 or Per.C6 (e.g., Percivia, Crucell), different lines of HEK 293, Expi293F™ cells (Life Technologies), GenScript's YeastHIGH™ Technology (GenScript), human neuronal precursor cell line AGE1.HN (Probiogen) and other mammalian cells, plants (e.g., corn, alfalfa, and tobacco), insect cells, avian eggs, algae, and transgenic animals (e.g., mice, rats, goats, sheep, pigs, cows). The advantages and disadvantages of these various systems have been reviewed in the literature and are known to one of ordinary skill in the art.

A "gene" refers to a DNA segment that is involved in producing a polypeptide and includes regions preceding and following the coding regions as well as intervening sequences (introns) between individual coding segments (exons).

"Host strain" or "host cell" means a suitable host for an expression vector or DNA construct comprising a polynucleotide encoding a polypeptide according to the disclosure. Specifically, host strains may be bacterial cells, mammalian cells, insect cells, and other cloning or "expression systems." In an embodiment of the disclosure, "host cell" means both the cells and protoplasts created from the cells of a microbial strain. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

"Heterologous" with reference to a polynucleotide or protein refers to a polynucleotide or protein/polypeptide that does not naturally occur in a host cell. In some embodiments, the protein is a commercially important industrial protein. It is intended that the term encompass proteins that are encoded by naturally occurring genes, mutated genes, and/or synthetic genes.

A polynucleotide or a polypeptide having a certain percent (e.g., at least 90%, 91%, 92%, 93%, 94%, 95%, 96%, 97%, 98%, or 99%) of sequence identity with another sequence means that, when aligned, that percentage of bases or amino acid residues are the same in comparing the two sequences. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution and this process results in "sequence homology" of, e.g. at least 90%, 91%, 92%, 93%, 94%, 95%, 96%, 97%, 98%, or 99%. Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, (1988) Computer Applic. Biol. Sci. 4:11-17, e.g., as implemented in the program PC/GENE (Intelligenetics, Mountain View, Calif., USA). This alignment and the percent homology or identity can be determined using any suitable software program known in the art, for example those described in CURRENT PROTOCOLS IN MOLECULAR BIOLOGY (F, M. Ausubel et al. (eds) 1987, Supplement 30, section 7.7.18). Such programs may include the GCG Pileup program, FASTA (Pearson et al. (1988) Proc. Natl, Acad. Sci USA 85:2444-2448), and BLAST (BLAST Manual, Altschul et al., Nat'l Cent. Biotechnol. Inf., Natl Lib. Med. (NCIB NLM NIH), Bethesda, Md., and Altschul et al., (1997) NAR 25:3389-3402). Another alignment program is ALIGN Plus (Scientific and Educational Software, Pa.), using default parameters. Another sequence software program that finds use is the TFASTA Data Searching Program available in the Sequence Software Package Version 6.0 (Genetics Computer Group, University of Wisconsin, Madison, Wis.).

"Introduced" in the context of inserting a nucleic acid sequence into a cell, means "transfection", or "transformation" or "transduction" and includes reference to the incorporation of a nucleic acid sequence into a eukaryotic or prokaryotic cell wherein the nucleic acid sequence may be incorporated into the genome of the cell (e.g., chromosome, plasmid, plastid, or mitochondrial DNA), converted into an autonomous replicon, or transiently expressed (e.g., transfected mRNA).

As used herein, "nucleotide sequence" or "nucleic acid sequence" refers to an oligonucleotide sequence or polynucleotide sequence and variants, homologues, fragments and derivatives thereof. The nucleotide sequence may be of genomic, synthetic or recombinant origin and may be double-stranded or single-stranded, whether representing the sense or anti-sense strand. As used herein, the term "nucleotide sequence" includes genomic DNA, cDNA, synthetic DNA, and RNA.

The term "nucleic acid" encompasses DNA, cDNA, RNA, heteroduplexes, and synthetic molecules capable of encoding a polypeptide. RNA includes mRNA, RNA, RNAi, siRNA, cRNA and autocatalytic RNA. Nucleic acids may be single stranded or double stranded, and may be chemical modifications. The terms "nucleic acid" and "polynucleotide" are used interchangeably. Because the genetic code is degenerate, more than one codon may be used to encode a particular amino acid, and the present compositions and methods encompass nucleotide sequences which encode a particular amino acid sequence. A nucleic acid comprises a nucleotide sequence which typically includes nucleotides that comprise an A, G, C, T or U base. However, nucleotide sequences may include other bases such as, without limitation inosine, methylycytosine, methylinosine, methyladenosine and/or thiouridine, although without limitation thereto.

One skilled in the art will recognize that nucleic acid sequences encompassed by the disclosure are also defined by the ability to hybridize under stringent hybridization conditions with nucleic acid sequences encoding the exemplified polypeptides. A nucleic acid is hybridizable to another nucleic acid sequence when a single stranded form of the nucleic acid can anneal to the other nucleic acid under appropriate conditions of temperature and solution ionic strength. Hybridization and washing conditions are well known in the art (Sambrook, et al. (Molecular cloning: a laboratory manual, Cold Spring Harbor Laboratory; 4th edition, 2012). Hybridization under highly stringent conditions means that conditions related to temperature and ionic strength are selected in such a way that they allow hybridization to be maintained between two complementarity DNA fragments. On a purely illustrative basis, the highly stringent conditions of the hybridization step for the purpose of defining the polynucleotide fragments described above are advantageously as follows.

DNA-DNA or DNA-RNA hybridization is carried out in two steps: (1) prehybridization at 42° C. for three hours in phosphate buffer (20 mM, pH 7.5) containing 5×SSC (1×SSC corresponds to a solution of 0.15 M NaCl+0.015 M sodium citrate), 50% formamide, 7% sodium dodecyl sulfate (SDS), 10×Denhardt's, 5% dextran sulfate and 1% salmon sperm DNA; (2) primary hybridization for 20 hours at a temperature depending on the length of the probe (i.e.: 42° C. for a probe>100 nucleotides in length) followed by two 20-minute washings at 20° C. in 2×SSC+2% SDS, one 20-minute washing at 20° C. in 0.1×SSC+0.1% SDS. The last washing is carried out in 0.1×SSC+0.1% SDS for 30 minutes at 60° C. for a probe>100 nucleotides in length. The highly stringent hybridization conditions described above for a polynucleotide of defined size can be adapted by a person skilled in the art for longer or shorter oligonucleotides, according to the procedures described in Sambrook, et al. (Molecular cloning: a laboratory manual, Cold Spring Harbor Laboratory; 3rd edition, 2001).

Stringent conditions may also be achieved with the addition of destabilizing agents such as formamide.

The term "operably linked" and its variants refer to chemical fusion or bonding or association of sufficient stability to withstand conditions encountered in the nucleotide incorporation methods utilized, between a combination of different compounds, molecules or other entities such as, but not limited to: between a mutant polymerase and a reporter moiety (e.g., fluorescent dye or nanoparticle); between a nucleotide and a reporter moiety (e.g., fluorescent dye); or between a promoter and a coding sequence, if it controls the transcription of the sequence.

A "promoter" is a regulatory sequence that is involved in binding RNA polymerase to initiate transcription of a gene. The promoter may be an inducible promoter or a constitutive promoter. An exemplary promoter used herein is a T7 promoter, which is an inducible promoter.

A "periplasmic tag" or "periplasmic leader sequence" is a sequence of amino acids which, when attached to/present at the N-terminus of a protein/peptide, directs the protein/peptide to the bacterial periplasm, where the sequence is often removed by a signal peptidase. Protein/peptide secretion into the periplasm can increase the stability of recombinantly-expressed proteins/peptides. An example of a periplasmic tag disclosed herein is provided as SEQ ID NO:3.

"Recombinant" when used in reference to a cell, nucleic acid, protein or vector, indicates that the cell, nucleic acid, protein or vector, has been modified by the introduction of a "heterologous nucleic acid" or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all.

A "signal sequence" or "signal peptide" means a sequence of amino acids bound to the N-terminal portion of a protein, which facilitates the secretion of the mature form of the protein outside the cell. The definition of a signal sequence is a functional one. The mature form of the extracellular protein lacks the signal sequence which is cleaved off during the secretion process.

"Selective marker" refers to a gene capable of expression in a host that allows for ease of selection of those hosts containing an introduced nucleic acid or vector. Examples of selectable markers include but are not limited to antimicrobials (e.g., hygromycin, bleomycin, or chloramphenicol) and/or genes that confer a metabolic advantage, such as a nutritional advantage on the host cell.

A structure that "substantially conforms" to a given set of atomic coordinates is a structure wherein at least about 50% of such structure has an RMSD of less than about 1.5 ANG for the backbone atoms in secondary structure elements in each domain, and more preferably, less than about 1.3 ANG for the backbone atoms in secondary structure elements in each domain, and, in increasing preference, less than about 1.0 ANG, less than about 0.7 ANG, less than about 0.5 ANG, and most preferably, less than about 0.3 ANG for the backbone atoms in secondary structure elements in each domain. In a more preferred embodiment, a structure that substantially conforms to a given set of atomic coordinates is a structure wherein at least about 75% of such structure has the recited RMSD value, and more preferably, at least about 90% of such structure has the recited RMSD value, and most preferably, about 100% of such structure has the recited RMSD value.

In an even more preferred embodiment, the above definition of "substantially conforms" can be extended to include atoms of amino acid side chains. As used herein, the phrase "common amino acid side chains" refers to amino acid side chains that are common to both the structure which substantially conforms to a given set of atomic coordinates and the structure that is actually represented by such atomic coordinates.

"Under transcriptional control" is a term well understood in the art that indicates that transcription of a polynucleotide sequence, usually a DNA sequence, depends on its being operably linked to an element which contributes to the initiation of, or promotes transcription.

"Under translational control" is a term well understood in the art that indicates a regulatory process that occurs after mRNA has been formed.

As used herein, "transformed cell" includes cells that have been transformed or transduced by use of recombinant DNA techniques. Transformation typically occurs by insertion of one or more nucleotide sequences into a cell. The inserted nucleotide sequence may be a "heterologous nucleotide sequence," i.e., is a sequence that is not natural to the cell that is to be transformed, such as a fusion protein.

As used herein, "transformed", "stably transformed", "transduced," and "transgenic" used in reference to a cell means the cell has a non-native (e.g., heterologous) nucleic acid sequence integrated into its genome or as an episomal plasmid that is maintained through multiple generations.

"Variants" refer to both polypeptides and nucleic acids. The term "variant" may be used interchangeably with the term "mutant." Variants include insertions, substitutions, transversions, truncations, and/or inversions at one or more locations in the amino acid or nucleotide sequence, respectively, of a parent sequence. Variant nucleic acids can include sequences that are complementary to sequences that are capable of hybridizing to the nucleotide sequences presented herein. For example, a variant sequence is complementary to sequences capable of hybridizing under stringent conditions (e.g., 50° C. and 0.2.XSSC (1×SSC=0.15 M NaCl, 0.015 M sodium citrate, pH 7.0)) to the nucleotide sequences presented herein. More particularly, the term variant encompasses sequences that are complementary to sequences that are capable of hybridizing under highly stringent conditions (e.g., 65° C. and 0.1×SSC) to the nucleotide sequences presented herein.

The term "vector", as used herein, is intended to refer to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the claimed embodiments are intended to include such other forms of expression vectors, such as viral vectors (e.g., replication defective retroviruses, adenoviruses and adeno-associated viruses), which serve equivalent functions. Vectors also include cloning vectors, shuttle vectors, plasmids, phage particles, cassettes and the like.

Reference will now be made in detail to various disclosed embodiments.

Disclosed herein is the discovery that cdLD is capable of catalyzing the dehydration of 3-buten-2-ol to 1,3-butadiene. The positive results obtained for cdLD for the catalysis of this reaction along with the relatively low catalytic proficiency exhibited by this wild-type (WT) enzyme led to several attempts to improve the activity of cdLD. A crystal structure, or homology model is a significant help for enzyme optimization. However, a delta-BLAST search on the database of protein sequences from the Protein Data Bank (PDB) revealed that cdLD does not have any detectable homology to any sequence for which a structural model is available. Accordingly, this disclosure also unveils the crystal structure of apo cdLD, elucidated herein by X-ray crystallography. Crystals of purified apo cdLD were obtained, the tri-dimensional structure of this enzyme elucidated for the first time, and the results independently confirmed. An apo structure of cdLD was then successfully refined at 2.54 Å with an R value of R=21.6% and $R_{free}$=26.9%. Details of this procedure can be found in the Examples section of this disclosure.

Figure 2:
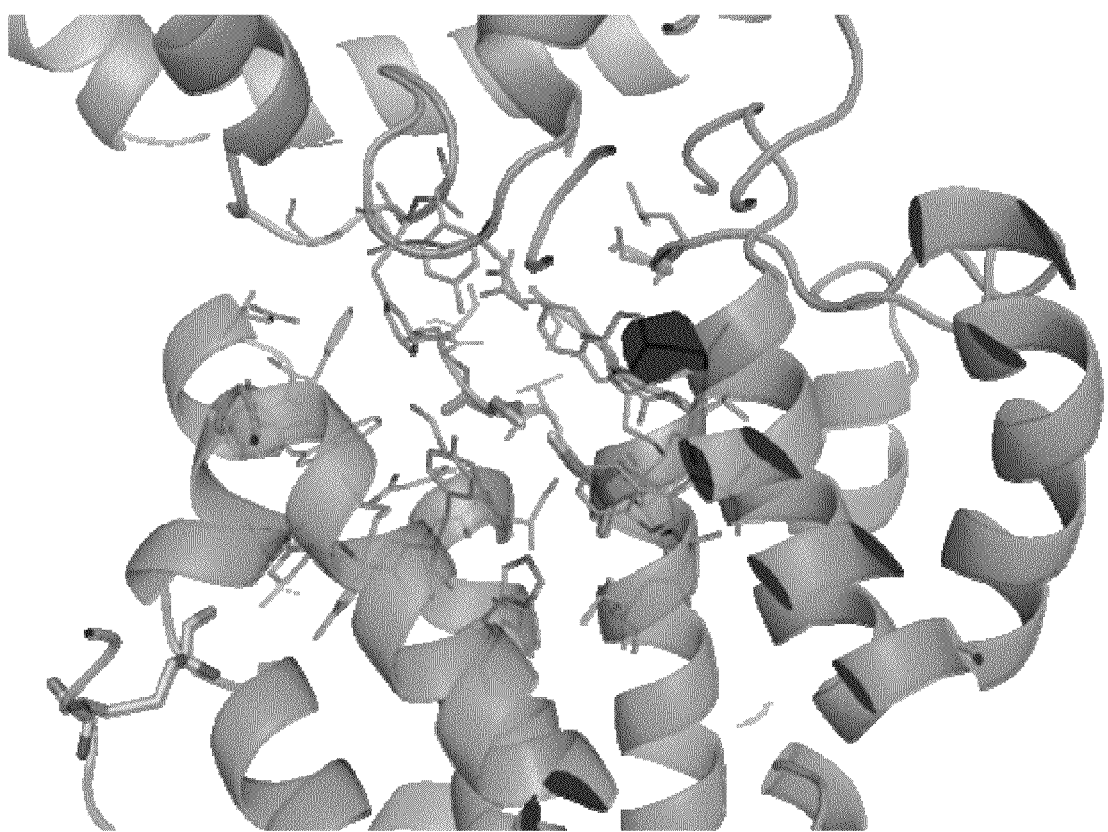
FIG. 2: Putative active site location at the interface between subunit A and subunit E. Green cartoon: chain A. Light brown: chain B. The side-chains lining the putative active site are in lined. Polar groups within the active site are colored in purple. Note the distal disulfide bridge (salmon sticks) on the left side of chain A. The view is oriented with the active site cavity entrance facing.

The present disclosure has elucidated several domains within cdLD, cdLD crystallized in $P_21$ space group. cdLD adopts a pentameric arrangement with 5-fold axial symmetry in the asymmetric unit (labeled chain A through E). Each monomer adopts α/α(6) barrel fold, a relatively unusual fold that can be seen in FIG. 1. Apparent and noteworthy in the crystal structure, one disulfide bond is formed between Cys74 and Cys127 of each subunit (crystal structure numbering). A structural homology search using the DALI program yields a variety of structural homologs. Structural alignment between the cdLD monomer and some of the DALI hits reveals that the enzymes that are structurally homologous to cdLD all have their active sites in the "top" of the barrel with the catalytic residues supported by the innermost helixes that line up the inside of the barrel (helixes 4, 7, 9, 11, 13, 14) and the loops connecting these helixes to the outermost helixes Thorn the barrel. Consistent with the other enzymes adopting a similar fold, cdLD presents a marked cleft in that same region whereas the rest of the subunit is tightly packed fully solvent exposed. Therefore, we hypothesized that the likely position of cdLD active site responsible for the observed catalytic activity is located in that region. Contrary to most of cdLD structural homologs, this putative active site is formed at the interface between subunits, for example, A and B in FIG. 1. Loop 62-77 (crystal structure numbering) from subunit B protrudes and closes the pocket formed by the top of the barrel of subunit A, see FIG. 2.

The elucidation of cdLD's crystal structure data allows for a better understanding of cdLD's enzymatic activity and the intelligent design of numerous improvements of the same, as well as the development of a variety of compounds that act either as substrates or inhibitors of cdLD or the polypeptides described herein.

In an embodiment, the disclosure has identified the catalytic residues of cdLD. Accordingly, the disclosure provides compounds that bind to the catalytic site of cdLD and which are identified using the structural data disclosed herein and/or any suitable method described herein. Candidate compounds identified using the structural data disclosed herein may be any suitable compound, including naturally occurring compounds, compounds designed de novo, library generated compounds, 3-butane-2-ol (3B2O) mimetics and analogs, and include organic compounds, new chemical entities, among others.

One skilled in the art may use one of several methods to screen entities (whether chemical or protein) for their ability to associate with cdLD or the polypeptides described herein. Specialized computer programs may also assist in the process of selecting entities. These include: GRID (Goodford, "A Computational Procedure for Determining Energetically Favorable Binding Sites on Biologically Important Macromolecules", J. Med. Chem., 28, pp. 849-857 (1985)). GRID is available from Oxford University, Oxford, UK; MOSS (Miranker et al., "Functionality. Maps of Binding Sites: A Multiple Copy Simultaneous Search Method." Proteins: Structure, Function and Genetics, 11, pp. 29-34 (1991)). MOSS is available from Molecular Simulations, San Diego, Calif.; AUTODOCK (Goodsell et al., "Automated Docking of Substrates to Proteins by Simulated Annealing", Proteins: Structure, Function, and Genetics, 8, pp. 195-202 (1990)). AUTODOCK is available from Scripps Research Institute, La Jolla, Calif.; & DOCK (Kuntz et al., "A Geometric Approach to Macromolecule-Ligand Interactions", J. Mol. Biol., 161, pp. 269-288 (1982)). DOCK is available from University of California, San Francisco, Calif.

In another embodiment, the disclosure relates to a method of synthesizing or obtaining a candidate compound designed or screened for binding to cdLD or one of the polypeptides disclosed herein and then determining the ability of the candidate compound to interact with any one of those proteins.

Figure 3:
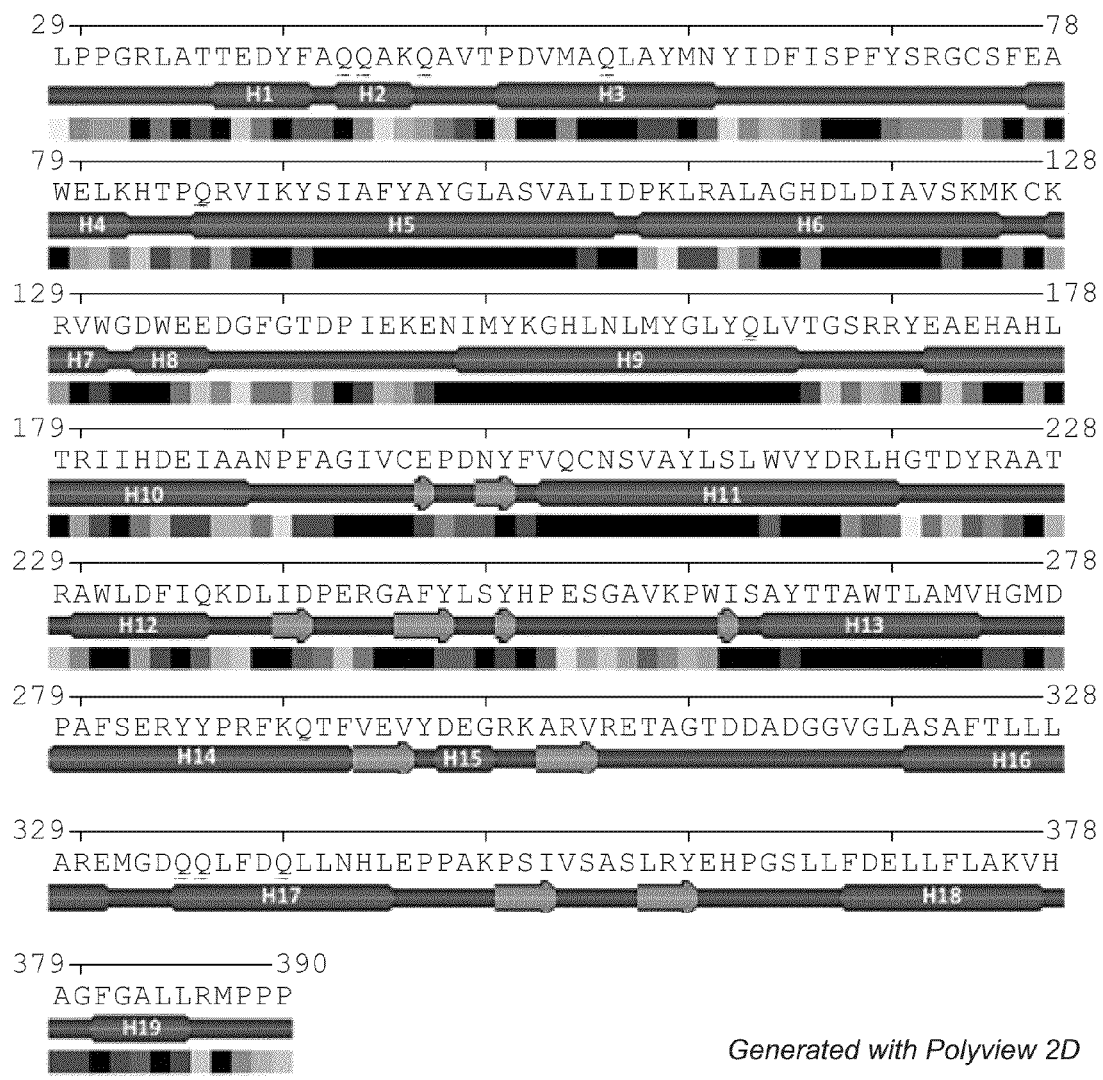
FIG. 3: Representation of cdLD's secondary structure (SEQ ID NO: 87) as assigned by the program DSSP and represented with Polyview. Helixes (α, 310 and π) are represented in red cylinders, strands with green arrows and loop in blue wire. Helices have been numbered consecutively from the N-terminal to the C-terminal.

In another embodiment, the disclosure relates to subsets of the atomic coordinates listed in Appendix I and subsets that conform substantially thereto. Preferred subsets define one or more regions of cdLD selected from those listed in Table 3 and FIG. 3.

The present invention also provides subsets of the atomic coordinates listed in Appendix I. The coordinates referred to herein include Cartesian coordinates derived from the mathematical equations related to the patterns obtained on diffraction of a monochromatic beam of X-ray by the atoms of a protein or protein complex in crystal form. The diffraction data are used to calculate an electron density map of the repeating units of the crystal. The electron density maps are then used to establish the positions of the individual atoms of the molecule or molecular complex. In an embodiment, there is provided a machine-readable data storage medium, comprising a data storage material encoded with machine readable data which, when used by a machine programmed with instructions for using said data, displays a graphical three-dimensional representation comprising cdLD or a polypeptide described herein.

It will be appreciated that a set of structure coordinates for a polypeptide is a relative set of points that define a shape in three dimensions. Thus, it is possible that an entirely different set of coordinates could define a similar or identical shape. Moreover, slight variations in the individual coordinates will have little effect on overall shape. Those sets of coordinates are also embodiments within the scope of this disclosure.

The variations in coordinates may be generated due to mathematical manipulations of the structure coordinates. For example, the structure coordinates set forth in Appendix I could be manipulated by crystallographic permutations of the structure coordinates, fractionalization of the structure coordinates, integer additions or subtractions to sets of the structure coordinates, inversion of the structure coordinates, or any combination thereof.

Alternatively, modification in the crystal structure due to mutations, additions, substitutions, and/or deletions of amino acids, or other changes in any of the components that make up the crystal could also account for variations in structure coordinates. Those variations are also embodiments within the scope of this disclosure.

In one embodiment, the structure coordinates set forth herein can also be used to aid in obtaining structural information about another crystallized molecule or molecular complex. This may be achieved by any of a number of well-known techniques, including molecular replacement. For example, a method is also provided for utilizing molecular replacement to obtain structural information about a protein whose structure is unknown comprising the steps of: generating an X-ray diffraction pattern of a crystal of the protein whose structure is unknown; generating a three-dimensional electron density map of the protein whose structure is unknown from the X-ray diffraction pattern by using at least a portion of the structure coordinates set forth herein as a molecular replacement model.

By using molecular replacement, all or part of the structure coordinates of cdLD provided by the present disclosure (and set forth in the attached figures) can be used to determine the structure of another crystallized molecule or molecular complex more quickly and efficiently than attempting an ab initio structure determination. One particular use includes use with other structurally similar proteins. Molecular replacement provides an accurate estimation of the phases for an unknown structure. Phases are a factor in equations used to solve crystal structures that cannot be determined directly. Obtaining accurate values for the phases, by methods other than molecular replacement, is a time-consuming process that involves iterative cycles of approximations and refinements and greatly hinders the solution of crystal structures. However, when the crystal structure of a protein containing at least a homologous portion has been solved, the phases from the known structure provide a satisfactory estimate of the phases for the unknown structure. Thus, this method involves generating a preliminary model of a molecule or molecular complex whose structure coordinates are unknown, by orienting and positioning the relevant portion of cdLD according to the enclosed figures within the unit cell of the crystal of the unknown molecule or molecular complex so as best to account for the observed X-ray diffraction pattern of the crystal of the molecule or molecular complex whose structure is unknown. Phases can then be calculated from this model and combined with the observed X-ray diffraction pattern amplitudes to generate an electron density map of the structure whose coordinates are unknown. This, in turn, can be subjected to any well-known model building and structure refinement techniques to provide a final, accurate structure of the unknown crystallized molecule or molecular complex (Lattman, "Use of the Rotation and Translation Functions", in Meth. Enzymol., 115, pp. 55-77 (1985); Rossmann, ed., "The Molecular Replacement Method", Int. Sci. Rev, Ser., No. 13, Gordon & Breach, New York (1972)).

The structure coordinates of cdLD as provided by the present disclosure are useful in solving the structure of polypeptides that have amino acid substitutions, additions and/or deletions as compared to naturally occurring cdLD. These polypeptides may optionally be crystallized in co-complex with a ligand, such as an inhibitor or substrate analogue. The crystal structures of a series of such complexes may then be solved by molecular replacement and compared with that of cdLD. Potential sites for modification within the various binding sites of the enzyme may thus be identified. This information provides an additional tool for determining the most efficient binding interactions such as, for example, increased hydrophobic interactions, between cdLD and a ligand. It is noted that the ligand may be the protein's natural ligand or may be a potential substrate or inhibitor of the protein.

In the present description and claims, newly disclosed polypeptides that have improved activity in the catalysis of the dehydration of 3-buten-2-ol to 1,3-butadiene and/or in the catalysis of 3-methyl-3-buten-2-ol to isoprene are disclosed and claimed. In some embodiments, said improvement can be observed in vivo. In other embodiments, said improvement can be observed in the purified polypeptide, in which case the improvement is referred to as an improvement in specific activity. In some embodiments, it is envisioned that the improved polypeptides would show said improved activity whether or not they have a periplasmic tag and/or a C-terminal poly-His tag. In other embodiments, it is also envisioned that the improved polypeptides would show said improved activity when compared to cdLD of SEQ ID NO:1, 4, 5, 7, or 8. It is to be understood that conservatively modified variants of the polypeptides specified herein also fall within the scope of this disclosure.

The following discusses the relationship between mutations that may be present in the polypeptides provided herein, and desirable alterations in properties (relative to those of the wild-type polypeptide of SEQ ID NO:1, 4, 5, 7, or 8).

Improved In Vivo Activity in the Catalysis of the Dehydration of 3-Buten-2-Ol to 1,3-Butadiene Some embodiments provide polypeptides with improved activity in the catalysis of the dehydration of 3-buten-2-ol to 1,3-butadiene, relative to the polypeptide of SEQ ID NO:1, 4, 5, 7, or 8. Improved activity in the catalysis of the dehydration of 3-buten-2-ol to 1,3-butadiene can be measured by any method known to one of ordinary skill in the art. In one embodiment, improved activity in the catalysis of the dehydration of 3-buten-2-ol to 1,3-butadiene of a polypeptide described herein refers to an increased activity in the catalysis of the dehydration of 3-buten-2-ol to 1,3-butadiene of a bacterial cell culture expressing said polypeptide, relative to a bacterial cell extract expressing a wild-type polypeptide of SEQ ID NO: 1, 4, 5, 7, or 8.

In some embodiments, the activity in the catalysis of the dehydration of 3-buten-2-ol to 1,3-butadiene is at least 80% of that of a polypeptide consisting of SEQ ID NO:1, 4, 5, 7, or 8, increased about 1.5 fold or greater when compared to that of a polypeptide consisting of SEQ ID NO: 1, 4, 5, 7, or 8, preferably about 2 fold or greater when compared to that of a polypeptide consisting of SEQ ID NO:1, 4, 5, 7, or 8, preferably about 2.5 fold or greater when compared to that of a polypeptide consisting of SEQ ID NO:1, 4, 5, 7, or 8, preferably about 3 fold or greater when compared to that of a polypeptide consisting of SEQ ID NO:1, 4, 7, or 8, preferably about 3.5 fold or greater when compared to that of a polypeptide consisting of SEQ ID NO:1, 4, 5, 7, or 8, preferably about 4 fold or greater when compared to that of a polypeptide consisting of SEQ ID NO: SEQ ID NO:1, 4, 5, 7, or 8, preferably about 4.5 fold or greater when compared to that of a polypeptide consisting of SEQ ID NO:1, 4, 5, 7, or 8, or preferably about 5 fold or greater when compared to that of a polypeptide consisting of SEQ ID NO:1, 4, 5, 7, or 8, and wherein said activity is observed in at least one activity assay.

In some embodiments, the increase in the catalysis of the dehydration of 3-buten-2-ol to 1,3-butadiene is observed in at least one type of non-bacterial cells expressing a polypeptide of SEQ ID NO: 1, 4, 5, 7, or 8. In some embodiments, the increased in the catalysis of the dehydration of 3-buten-2-ol to 1,3-butadiene is observed in at least one type of bacteria. In some embodiments, the increased in the catalysis of the dehydration of 3-buten-2-ol to 1,3-butadiene is observed in more than one type of bacteria. In some embodiments, the bacteria are a strain of E. Coli. In some embodiments, the bacteria are Origami2(DE3). In some embodiments, the bacteria are BL21 (DE3).

Improved Specific Activity in the Catalysis of the Dehydration of 3-Buten-2-Ol to 1,3-Butadiene Some embodiments provide polypeptides with improved specific activity in the catalysis of the dehydration of 3-buten-2-ol to 1,3-butadiene, relative to the polypeptide of SEQ ID NO:1, 4, 5, 7, or 8. Improved specific activity in the catalysis of the dehydration of 3-buten-2-ol to 1,3-butadiene can be measured by any method known to one of ordinary skill in the art. In one embodiment, improved specific activity in the catalysis of the dehydration of 3-buten-2-ol to 1,3-butadiene of a polypeptide described herein refers to an increased specific activity in the catalysis of the dehydration of 3-buten-2-ol to 1,3-butadiene of the purified polypeptide, relative to that of the purified polypeptide of SEQ ID NO:1, 4, 5, 7, or 8.

In some embodiments, the specific activity in the catalysis of the dehydration of 3-buten-2-ol to 1,3-butadiene is at least 80% of that of a polypeptide consisting of SEQ ID NO:1, 4, 5, 7, or 8, increased about 1.5 fold or greater when compared to that of a polypeptide consisting of SEQ ID NO:1, 4, 5, 7, or 8, preferably about 2 fold or greater when compared to that of a polypeptide consisting of SEQ ID NO:1, 4, 5, 7, or 8, preferably about 2.5 fold or greater when compared to that of a polypeptide consisting of SEQ ID NO:1, 4, 5, 7, or 8: preferably about 3 fold or greater when compared to that of a polypeptide consisting of SEQ ID NO:1, 4, 5, 7, or 8: preferably about 3.5 fold or greater when compared to that of a polypeptide consisting of SEQ ID NO:1, 4, 5, 7, or 8, preferably about 4 fold or greater when compared to that of a polypeptide consisting of SEQ ID NO:1, 4, 5, 7, or 8, preferably about 4.5 fold or greater when compared to that of a polypeptide consisting of SEQ ID NO:1, 4, 5, 7, or 8, or preferably about 5 fold or greater when compared to that of a polypeptide consisting of SEQ ID NO:1, 4, 5, 7, or 8: and wherein said activity is observed in at least one specific activity assay.

In some embodiments, the increase in the catalysis of the dehydration of 3-buten-2-ol to 1,3-butadiene is observed in polypeptides purified from at least one type of non-bacterial cells expressing a polypeptide of SEQ ID NO:1, 4, 5, 7, or 8. In some embodiments, the increased in the catalysis of the dehydration of 3-buten-2-ol to 1,3-butadiene is observed in polypeptides purified from at least one type of bacteria. In some embodiments, the increased in the catalysis of the dehydration of 3-buten-2-ol to 1,3-butadiene is observed in polypeptides purified from more than one type of bacteria. In some embodiments, the bacteria are a strain of E. Coli. In some embodiments, the bacteria are Origami2(DE3). In some embodiments, the bacteria are BL21 (DE3).

It will be understood that additional embodiments encompass polypeptides where it may be advantageous to introduce additional point-mutations (e.g., deletions, insertions, inversions, substitutions) in any of the polypeptides described herein.

Any of the polypeptides described herein may either contain or lack a N-terminal periplasmic tag. In some embodiments, the periplasmic tag (SEQ ID NO:3) is the sequence underlined in the protein of SEQ ID NO:1. In one embodiment, the polypeptide may contain a C-terminal tag. In some embodiments, the C-terminal tag is a poly-Histidine tag consisting of six Histidines (SEQ ID NO: 10), with or without additional amino acids, as in SEQ ID NO:4 and 5. In some embodiments, the polypeptide contains both a periplasmic tag and a C-terminal tag. In some embodiments, the polypeptide contains only a periplasmic tag. In some embodiments, the polypeptide contains a C-terminal tag. In any of these embodiments, the C-terminal tag can be a poly-Histidine tag. In some embodiments, the C-terminal tag is that of SEQ ID NO:6.

In one embodiment, the amino acid sequence of the polypeptide is that of any one of the polypeptides listed in the listing of sequences in the Examples section. In related embodiments, the polypeptide lacks the poly-His tag. In related embodiments, the polypeptide lacks the periplasmic tag. In related embodiments, the polypeptide lacks the periplasmic tag and the poly-His tag, which can be that of SEQ ID NO:6 or just HHHHHH (His6) (SEQ ID NO: 10).

Derivatives of the Polypeptides Disclosed Herein are Also Provided.

In one embodiment, derivative polypeptides are polypeptides that have been altered, for example by conjugation or complexing with other chemical moieties, by post-translational modification (e.g. phosphorylation, acetylation and the like), modification of glycosylation (e.g. adding, removing or altering glycosylation), and/or inclusion/substitution of additional amino acid sequences as would be understood in the art.

Additional amino acid sequences may include fusion partner amino acid sequences which create a fusion protein. By way of example, fusion partner amino acid sequences may assist in detection and/or purification of the isolated fusion protein. Non-limiting examples include metal-binding (e.g. poly-histidine) fusion partners, maltose binding protein (MBP), Protein A, glutathione S-transferase (GST), fluorescent protein sequences (e.g. GFP), epitope tags such as myc, FLAG, and haemagglutinin tags.

Other derivatives contemplated by the embodiments include, but are not limited to, modification to side chains, incorporation of unnatural amino acids and/or their derivatives during peptide, or protein synthesis and the use of crosslinkers and other methods which impose conformational constraints on the disclosed polypeptides and fragments thereof.

The embodiments also encompass nucleic acid molecules encoding relatives of the disclosed polypeptides. "Relatives" of the disclosed polypeptide-encoding nucleic acid sequences include those sequences that encode the polypeptides disclosed herein but that differ conservatively because of the degeneracy of the genetic code. Allelic polypeptides that later develop through culture can be identified with the use of well-known molecular biology techniques, such as polymerase chain reaction (PCR) and hybridization techniques as outlined below. Relative nucleic acid sequences also include synthetically derived nucleic acid sequences that have been generated, for example, by using site-directed mutagenesis but which still encode the polypeptides disclosed.

The skilled artisan will further appreciate that changes can be introduced by mutation of the nucleic acid sequences thereby leading to changes in the amino acid sequence of the encoded polypeptides, without altering the biological activity of the proteins. Thus, relative nucleic acid molecules can be created by introducing one or more nucleotide substitutions, nucleotide additions and/or nucleotide deletions into the corresponding nucleic acid sequence disclosed herein, such that one or more amino acid substitutions, amino acid additions or amino acid deletions are introduced into the encoded protein. Mutations can be introduced by standard techniques, such as site-directed mutagenesis and PCR-mediated mutagenesis. Such relative nucleic acid sequences are also encompassed by the present embodiments.

Alternatively, variant nucleic acid sequences can be made by introducing mutations randomly along all or part of the coding sequence, such as by saturation mutagenesis and the resultant mutants can be screened for ability to confer improved activity or increased specific activity in the catalysis of the dehydration of 3-buten-2-ol to 1,3-butadiene to identify mutants that retain the improved activity of the polypeptides described herein. Following mutagenesis, the encoded protein can be expressed recombinantly, and the activity of the protein can be determined using standard assay techniques, including those described herein.

Nucleic Acids

With the polypeptide disclosed herein and their amino acid sequence as disclosed herein, the skilled person may determine suitable polynucleotides that encode those polypeptides. Those having ordinary skill in the art will readily appreciate that due to the degeneracy of the genetic code, a multitude of nucleotide sequences encoding the polypeptides described herein exist. The sequence of the polynucleotide gene can be deduced from a polypeptide sequence through use of the genetic code. Computer programs such as "BackTranslate" (GCG™ Package, Acclerys, Inc. San Diego, Calif.) can be used to convert a peptide sequence to the corresponding nucleotide sequence encoding the peptide. Furthermore, synthetic variant polynucleotide sequences encoding the polypeptides as described herein can be designed so that they will be expressed in any cell type, prokaryotic or eukaryotic.

Accordingly, some embodiments relate to polynucleotides either comprising or consisting essentially of a nucleic acid sequence encoding a polypeptide as described above and elsewhere herein. In some embodiments, the nucleic acid sequence is a DNA sequence (e.g., a cDNA sequence). In other embodiments, the nucleic acid sequence is a RNA sequence. In some embodiments, the nucleic acid is a cDNA encoding any of the polypeptides described herein. The nucleotide sequences encoding the polypeptide may be prepared by any suitable technologies well known to those skilled in the art, including, but not limited to, recombinant DNA technology and chemical synthesis. Synthetic polynucleotides may be prepared using commercially available automated polynucleotide synthesizers.

One aspect pertains to isolated or recombinant nucleic acid molecules comprising nucleic acid sequences encoding the polypeptides described herein or biologically active portions thereof, as well as nucleic acid molecules sufficient for use as hybridization probes to identify nucleic acid molecules encoding proteins with regions of sequence homology to the polypeptides described herein. Nucleic acid molecules that are fragments of these nucleic acid sequences encoding polypeptides are also encompassed by the embodiments. By "fragment" is intended a portion of the nucleic acid sequence encoding a portion of a polypeptide. In some embodiments, a fragment of a nucleic acid sequence may encode a biologically active portion of a polypeptide or it may be a fragment that can be used as a hybridization probe or PCR primer using methods well known to one of ordinary skill in the art.

In some embodiments, the nucleic acid has been codon optimized for expression of any one of the polypeptides described herein.

In other embodiments, the nucleic acid is a probe, which may be a single or double-stranded oligonucleotide or polynucleotide, suitably labeled for the purpose of detecting complementary sequences of polynucleotides encoding the polypeptides described herein, such as in arrays, Northern, or Southern blotting. Methods for detecting labeled nucleic acids hybridized to an immobilized nucleic acid are well known to practitioners in the art. Such methods include autoradiography, chemiluminescent, fluorescent and colorimetric detection.

In some embodiments, the polynucleotide comprises a sequence encoding any one of the polypeptides described herein operably linked to a promoter sequence Constitutive or inducible promoters as known in the art are contemplated herein. The promoters may be either naturally occurring promoters, or hybrid promoters that combine elements of more than one promoter. Non-limiting examples of promoters include SV40, cytomegalovirus (CMV), and HIV-1 LTR promoters.

In some embodiments, the polynucleotide comprises a sequence encoding any one of the polypeptides described herein operably linked to a sequence encoding another protein, which can be a fusion protein or another protein separated by a linker. In some embodiments, the linker has a protease cleavage site, such as for Factor Xa or Thrombin, which allow the relevant protease to partially digest the fusion polypeptide described herein and thereby liberate the recombinant polypeptide therefrom. The liberated polypeptide can then be isolated from the fusion partner by, for example, subsequent chromatographic separation. In some embodiments, the polynucleotide comprises a sequence encoding any one of the polypeptides described herein operably linked to both a promoter and a fusion protein.

Some other embodiments provide genetic constructs in the form of, or comprising genetic components of, a plasmid, bacteriophage, a cosmid, a yeast or bacterial artificial chromosome, as are well understood in the art. Genetic constructs may be suitable for maintenance and propagation of the isolated nucleic acid in bacteria or other host cells, for manipulation by recombinant DNA technology and/or expression (expression vectors) of the nucleic acid or an encoded polypeptide as described herein.

Some other embodiments relate to recombinant expression vectors comprising a DNA sequence encoding one or more of the polypeptides described herein. In some embodiments, the expression vector comprises one or more of said DNA sequences operably linked to a promoter. Suitably, the expression vector comprises the nucleic acid encoding one of the polypeptides described herein operably linked to one or more additional sequences. In some embodiments, the expression vector may be either a self-replicating extra-chromosomal vector such as a plasmid, or a vector that integrates into a host genome. Non-limiting examples of viral expression vectors include adenovirus vectors, adeno-associated virus vectors, herpes viral vectors, retroviral vectors, lentiviral vectors, and the like. For example, adenovirus vectors can be first, second, third, and/or fourth generation adenoviral vectors or gutless adenoviral vectors. Adenovirus vectors can be generated to very high titers of infectious particles, infect a great variety of cells, efficiently transfer genes to cells that are not dividing, and are seldom integrated in the host genome, which avoids the risk of cellular transformation by insertional mutagenesis. The vector may further include sequences flanking the polynucleotide giving rise to RNA which comprise sequences homologous to eukaryotic genomic sequences or viral genomic sequences. This will allow the introduction of the polynucleotides described herein into the genome of a host cell.

An integrative cloning vector may integrate at random or at a predetermined target locus in the chromosome(s) of the host cell into which it is to be integrated.

Specific embodiments of expression vectors can be found elsewhere in this disclosure (see below).

Some other embodiments relate to host cells comprising a DNA molecule encoding a polypeptide as described herein. In some embodiments, these host cells can be described as expression systems. Suitable host cells for expression may be prokaryotic or eukaryotic. Without limitation, suitable host cells may be mammalian cells (e.g. HeLa, HEK293T, Jurkat cells), yeast cells (e.g. *Saccharomyces cerevisiae*), insect cells (e.g. Sf9, *Trichoplusia ni*) utilized with or without a baculovirus expression system, or bacterial cells, such as *E. coli* (Origami2(DE3), BL21 (DE3)), or a Vaccinia virus host. Introduction of genetic constructs into host cells (whether prokaryotic or eukaryotic) is well known in the art, as for example described in Current Protocols in Molecular Biology Eds. Ausubel et al., (John Wiley & Sons, Inc. current update Jul. 2, 2014).

A further embodiment relates to a transformed or transduced organism, such as an organism selected from plant and insect cells, bacteria, yeast, baculovirus, protozoa, nematodes, algae, and transgenic mammals (mice, rats, pigs, etc.). The transformed organism comprises a DNA molecule of the embodiments, an expression cassette comprising the DNA molecule or a vector comprising the expression cassette, which may be stably incorporated into the genome of the transformed organism.

Methods for Preparing the Polypeptides

The polypeptides described herein (inclusive of fragments and derivatives) may be prepared by any suitable procedure known to those of skill in the art. In some embodiments, the protein is a recombinant protein.

By way of example only, a recombinant polypeptide may be produced by a method including the steps of: (i) preparing an expression construct which comprises a nucleic acid expressing one or more of the polypeptides described herein, operably linked to one or more regulatory nucleotide sequences; (ii) transfecting or transforming a suitable host cell with the expression construct; (iii) expressing a recombinant polypeptide/protein in said host cell; and (iv) isolating the recombinant polypeptide/protein from said host cell or using the resultant host cell as is or as a cell extract.

Several methods for introducing mutations into genes, cDNA, and other polynucleotides are known in the art, including the use of proprietary library generation methods that are commercially available. The DNA sequence encoding a wild-type polypeptide of SEQ ID NO:1 (with or without one of the first of the two Met) may be isolated from any cell or microorganism producing the polypeptide in question, using various methods well known in the art. In one embodiment, the cDNA encoding the wild-type polypeptide of SEQ ID NO:1 (with or without one of the first two Met) is obtained from *Castellaniella defragrans* cells, cDNA libraries, or the like.

In one embodiment, the mutations are introduced into a wild-type polypeptide of SEQ ID NO:1 (or SEQ ID NO:1 without the periplasmic tag, or SEQ ID NO:4, or 5) using Site-Directed Mutagenesis. Once a wild-type polypeptide-encoding DNA sequence has been isolated, and desirable sites for mutation identified, mutations may be introduced using synthetic oligonucleotides. These oligonucleotides contain nucleotide sequences flanking the desired mutation sites; mutant nucleotides are inserted during oligonucleotide synthesis. In a specific method, a single-stranded gap of DNA, bridging the polypeptide-encoding sequence, is created in a vector carrying the gene encoding wild-type polypeptide of SEQ ID NO:1 (or SEQ ID NO:1 without the periplasmic tag, or SEQ ID NO:4, or 5). Then the synthetic nucleotide, bearing the desired mutation, is annealed to a homologous portion of the single-stranded DNA. The remaining gap is then filled in with DNA polymerase I (Klenow fragment) and the construct is ligated using T4 ligase.

Another embodiment for introducing mutations into wild-type polypeptide of SEQ ID NO:1 (or SEQ ID NO:1 without the periplasmic tag, or SEQ ID NO:4, or 5)-encoding DNA sequences involves the 3-step generation of a PCR fragment containing the desired mutation introduced by using a chemically synthesized DNA strand as one of the primers in the PCR reactions. From the PCR-generated fragment, a DNA fragment carrying the mutation may be isolated by cleavage with restriction endonucleases and reinserted into an expression plasmid.

Expression of the Polypeptides,

In one embodiment, the polypeptides are expressed according to the methods described in the Examples section of this disclosure. According to some other embodiments, a DNA sequence encoding the polypeptide produced by methods described above, or produced by any alternative methods known in the art, can be expressed, in enzyme form, using an expression vector, which typically includes control sequences encoding a promoter, operator, ribosome binding site, translation initiation signal, and, optionally, a repressor gene or various activator genes. For each combination of a promoter and a host cell, culture conditions are available which are conducive to the expression the DNA sequence encoding the desired polypeptide. After reaching the desired cell density or titre of the polypeptide the culture is stopped and the polypeptide is recovered using known procedures. Alternatively, the host cell is used directly (e.g., pellet, suspension), I.e., without isolation of the recombinant protein.

The recombinant expression vector carrying the DNA sequence encoding a polypeptide as described herein may be any vector, which may conveniently be subjected to recombinant DNA procedures, and the choice of vector will often depend on the host cell into which it is to be introduced. Thus, the vector may be an autonomously replicating vector, i.e., a vector that exists as an extrachromosomal entity, the replication of which is independent of chromosomal replication, e.g., a plasmid, a bacteriophage or an extrachromosomal element, minichromosome, or an artificial chromosome. Alternatively, the vector may be one which, when introduced into a host cell, is integrated into the host cell genome and replicated together with the chromosome(s) into which it has been integrated.

In the vector, the DNA sequence typically is operably connected to a suitable promoter sequence. The promoter may be any DNA sequence that shows transcriptional activity in the host cell of choice and may be derived from genes encoding proteins either homologous or heterologous to the host cell. Examples of suitable promoters for directing the transcription of the DNA sequence encoding a polypeptide as described herein, especially in a bacterial host, are the promoter of the lac operon of *E. coli*, the *Streptomyces coelicolor* agarase gene dagA promoters, the promoters of the *Castellaniella defragrans*, and others. For transcription in a fungal host, examples of useful promoters are those derived from the gene encoding *A. oryzae* TAKA amylase, *Rhizomucor miehei* aspartic proteinase, *A. niger* neutral LDH, *A. niger* acid stable LDH, *A. niger* glucoamylase, *Rhizomucor miehei* lipase, *A. oryzae* alkaline protease, *A. oryzae* triose phosphate isomerase or *A. nidulans* acetamidase. The promoters can be selected based on the desired outcome. The nucleic acids can be combined with constitutive, tissue-preferred, inducible, or other promoters for expression in the host cell or organism. The above list of promoters is not meant to be limiting. Any appropriate promoter can be used in the embodiments.

In some embodiments, the expression vector described may also comprise a suitable transcription terminator and, in eukaryotes, polyadenylation sequences operably connected to the DNA sequence encoding the polypeptide as described herein. Termination and polyadenylation sequences may suitably be derived from the same sources as the promoter or not.

In some embodiments, the vector may further comprise a DNA sequence enabling the vector to replicate in the host cell in question. Examples of such sequences are the origins of replication of plasmids pUC19, pACYC177, pUB110, pE194, pAMB1 and pIJ702. The above list of origins of replication is not meant to be limiting. Any appropriate origins of replication can be used in the embodiments In some embodiments, the vector may also comprise a selectable marker. Selectable marker genes are utilized for the selection of transformed cells or tissues, e.g., a gene the product of which complements a defect in the host cell, such as the dal genes from *B. subtilis* or *B. licheniformis*, or one which confers antibiotic resistance such as ampicillin, kanamycin, chloramphenicol or tetracyclin resistance. Furthermore, the vector may comprise *Aspergillus* selection markers such as amdS, argB, niaD and sC, a marker giving rise to hygromycin resistance, or the selection may be accomplished by co-transformation. The above list of selectable marker genes is not meant to be limiting. Any selectable marker gene can be used in the embodiments.

Appropriate culture mediums and conditions for the above-described host cells are known in the art. While intracellular expression may be advantageous in some respects, e.g., when using certain bacteria as host cells, it is often preferred that the expression is extracellular or periplasmic. In some embodiments, the *Castellanilla defragrans* LDHs mentioned herein comprise a pre-region/signal/leader sequence permitting secretion of the expressed protease into the culture medium or periplasm. If desirable, this pre-region may be replaced by a different preregion or signal sequence, conveniently accomplished by substitution of the DNA sequences encoding the respective preregions.

The procedures used to ligate the DNA construct encoding a disclosed polypeptide, the promoter, terminator and other dements, respectively, and to insert them into suitable vectors containing the information necessary for replication, are well known to persons skilled in the art (cf., for instance, Sambrook et al., Molecular Cloning: A Laboratory Manual, supra).

In one embodiment, the cells disclosed herein, either comprising a DNA construct or an expression vector as defined above, are advantageously used as host cells in the recombinant production of a polypeptide as described herein. The cell may be transformed with the DNA construct encoding the polypeptide as described herein, conveniently by integrating the DNA construct (in one or more copies) in the host chromosome. This integration is generally considered to be an advantage as the DNA sequence is more likely to be stably maintained in the cell. Integration of the DNA constructs into the host chromosome may be performed according to conventional methods, e.g., by homologous or heterologous recombination. Alternatively, the cell may be transformed with an expression vector as described above in connection with the different types of host cells.

In some embodiments, a cell as described herein may be a cell of a higher organism such as a mammal or an insect, a microbial cell, e.g., a bacterial or a fungal (including yeast) cell, or the like.

Without limitation, examples of suitable bacteria are *Castellaniella defragrans*, gram-positive bacteria such as *Bacillus subtilis, Bacillus licheniformis, Bacillus lentus, Bacillus brevis, Bacillus stearothermophilus, Bacillus alkalophilus, Bacillus amyloliquefaciens, Bacillus coagulans, Bacillus circulans, Bacillus lautus, Bacillus megaterium, Bacillus thuringiensis*, or *Streptomyces lividans* or *Streptomyces murinus*, or gram negative bacteria such as *E. coli*. In one embodiment, the transformation of the bacteria may, for instance, be effected by protoplast transformation or by using competent cells in a manner known per se.

In some other embodiments, a yeast organism may be selected from a species of *Saccharomyces* or *Schizosaccharomyces*, e.g., *Saccharomyces cerevisiae*. The filamentous fungus may advantageously belong to a species of *Aspergillus*, e.g., *Aspergillus oryzae* or *Aspergillus niger*Fungal cells may be transformed by a process involving protoplast formation and transformation of the protoplasts followed by regeneration of the cell wall in a manner known per se. Suitable procedure for transformation fungal host cells are well known in the art.

In yet a further set of embodiments, the present disclosure relates to a method of producing a polypeptide as described herein, which method comprises cultivating a host cell as described above under conditions conducive to the production of the polypeptide and recovering the polypeptide from the cells and/or culture medium. In some embodiments, the cells are cultured under aerobic conditions. In other embodiments, the cells are cultured under anerobic conditions.

The medium used to cultivate the cells may be any conventional medium suitable for growing the host cell in question and obtaining expression of the polypeptide as described herein. Suitable media are available from commercial suppliers or may be prepared according to published recipes (e.g., as described in catalogues of the American Type Culture Collection).

Purification of the Polypeptides

The polypeptide described herein and secreted from the host cells may conveniently be recovered from the culture medium by well-known procedures, in addition to those described in the Examples section of this disclosure, including separating the cells from the medium by centrifugation or filtration, and precipitating proteinaceous components of the medium by means of a salt such as ammonium sulphate, followed by the use of chromatographic procedures such as ion exchange chromatography, affinity chromatography, or the like.

For example, fermentation, separation, and concentration techniques are known in the art and conventional methods can be used in order to prepare the concentrated polypeptide-containing solution. After fermentation, a fermentation broth is obtained, and the microbial cells and various suspended solids, including residual raw fermentation materials, are removed by conventional separation techniques to obtain a polypeptide solution. Filtration, centrifugation, microfiltration, rotary vacuum drum filtration, followed by ultra-filtration, extraction or chromatography, or the like are generally used.

In some instances, it is desirable to concentrate the solution containing the polypeptide to optimize recovery, since the use of unconcentrated solutions requires increased incubation time to collect precipitates containing the purified polypeptide. The solution is concentrated using conventional techniques until the desired enzyme level is obtained. Concentration of the enzyme polypeptide containing solution may be achieved by any of the techniques discussed above. In one embodiment, rotary vacuum evaporation and/or ultrafiltration is used.

In one embodiment, a "precipitation agent" for purposes of purification is meant to be a compound effective to precipitate the polypeptide from the concentrated enzyme polypeptide solution in solid form, whatever its nature may be, i.e., crystalline, amorphous, or a blend of both Precipitation can be performed using, for example, a metal halide precipitation agent. Metal halide precipitation agents include: alkali metal chlorides, alkali metal bromides and blends of two or more of these metal halides. The metal halide may be selected from the group consisting of sodium chloride, potassium chloride, sodium bromide, potassium bromide and blends of two or more of these metal halides. Suitable metal halides include sodium chloride and potassium chloride, particularly sodium chloride, which can further be used as a preservative.

In one embodiment, a metal halide precipitation agent is used in an amount effective to precipitate the polypeptide. The selection of at least an effective amount and an optimum amount of metal halide effective to cause precipitation of the enzyme polypeptide, as well as the conditions of the precipitation for maximum recovery including incubation time, pH, temperature and concentration of polypeptide, will be readily apparent to one of ordinary skill in the art after routine testing.

In some embodiments, at least about 5% w/v (weight/volume) to about 25% w/v of metal halide is added to the concentrated enzyme polypeptide solution, and usually at least 8% w/v. In some embodiments, no more than about 25% w/v of metal halide is added to the concentrated enzyme polypeptide solution and usually no more than about 20% w/v. The optimal concentration of the metal halide precipitation agent will depend, among others, on the nature of the specific polypeptide and on its concentration in the concentrated polypeptide solution.

Another alternative embodiment to effect precipitation of the enzyme is to use of organic compounds, which can be added to the concentrated enzyme polypeptide solution. The organic compound precipitating agent can include: 4-hydroxybenzoic acid, alkali metal salts of 4-hydroxybenzoic acid, alkyl esters of 4-hydroxybenzoic acid, and blends of two or more of these organic compounds. The addition of the organic compound precipitation agents can take place prior to, simultaneously with or subsequent to the addition of the metal halide precipitation agent, and the addition of both precipitation agents, organic compound and metal halide, may be carried out sequentially or simultaneously.

In some embodiments, the organic compound precipitation agents are selected from the group consisting of alkali metal salts of 4-hydroxybenzoic acid, such as sodium or potassium salts, and linear or branched alkyl esters of 4-hydroxybenzoic acid, wherein the alkyl group contains from 1 to 12 carbon atoms, and blends of two or more of these organic compounds. In some embodiments, the organic compound precipitations agents can be for example linear or branched alkyl esters of 4-hydroxybenzoic acid, wherein the alkyl group contains from 1 to 10 carbon atoms, and blends of two or more of these organic compounds. In some embodiments, suitable organic compounds include linear alkyl esters of 4-hydroxybenzoic acid, wherein the alkyl group contains from 1 to 6 carbon atoms, and blends of two or more of these organic compounds. Methyl esters of 4-hydroxybenzoic acid, propyl ester of 4-hydroxybenzoic acid, butyl ester of 4-hydroxybenzoic acid, ethyl ester of 4-hydroxybenzoic acid and blends of two or more of these organic compounds can also be used. Additional organic compounds also include, but are not limited to, 4-hydroxybenzoic acid methyl ester (methyl PARABEN) and 4-hydroxybenzoic acid propyl ester (propyl PARABEN), which are also amylase preservative agents.

In some embodiments, addition of the organic compound precipitation agent provides the advantage of high flexibility of the precipitation conditions with respect to pH, temperature, polypeptide concentration, precipitation agent concentration, and time of incubation.

In some embodiments, the organic compound precipitation agent is used in an amount effective to improve precipitation of the enzyme polypeptide by means of the metal halide precipitation agent. The selection of at least an effective amount and an optimum amount of organic compound precipitation agent, as well as the conditions of the precipitation for maximum recovery including incubation time, pH, temperature and concentration of enzyme polypeptide, will be readily apparent to one of ordinary skill in the art, in light of the present disclosure, after routine testing.

In some embodiments, at least about 0.01% w/v of organic compound precipitation agent is added to the concentrated enzyme polypeptide solution and usually at least about 0.02% w/v. In some embodiments, no more than about 0.3% w/v of organic compound precipitation agent is added to the concentrated enzyme polypeptide solution and usually no more than about 0.2% w/v.

In some embodiments, the concentrated enzyme polypeptide solution, containing the metal halide precipitation agent and, in one aspect, the organic compound precipitation agent, is adjusted to a pH that necessarily will depend on the enzyme polypeptide to be purified. In some embodiments, the pH is adjusted to a level near the isoelectric point (pI) of the polypeptide. For example, the pH can be adjusted within a range of about 2.5 pH units below the pI to about 2.5 pH units above the pI.

The incubation time necessary to obtain a purified enzyme polypeptide precipitate depends on the nature of the specific enzyme polypeptide, the concentration of enzyme, and the specific precipitation agent(s) and its (their) concentration. In some embodiments, the time effective to precipitate the enzyme polypeptide is between about 1 to about 30 hours; usually it does not exceed about 25 hours. In the presence of the organic compound precipitation agent, the time of incubation can still be reduced to less than about 10 hours, and in most cases even about 6 hours.

In some embodiments, the temperature during incubation is between about 4° C. and about 50° C. In some embodiments, the method is carried out at a temperature between about 10° C. and about 45° C., and particularly between about 20° C. and about 40° C. The optimal temperature for inducing precipitation varies according to the solution conditions and the enzyme polypeptide or precipitation agent(s) used.

In some embodiments, the overall recovery of purified enzyme polypeptide precipitate, and the efficiency with which the process is conducted, is improved by agitating the solution comprising the enzyme polypeptide, the added metal halide and the added organic compound. In some embodiments, the agitation step is done both during addition of the metal halide and the organic compound, and during the subsequent incubation period. Suitable agitation methods include mechanical stirring or shaking, vigorous aeration, or any similar technique.

In some embodiments, after the incubation period, the purified enzyme polypeptide is then separated from the impurities and collected by conventional separation techniques, such as filtration, centrifugation, microfiltration, rotary vacuum filtration, ultrafiltration, press filtration, cross membrane microfiltration, cross flow membrane microfiltration or the like. Cross membrane microfiltration can be one method used. In some embodiments, further purification of the purified enzyme polypeptide precipitate can be obtained by washing the precipitate with water. For example, the purified enzyme polypeptide precipitate is washed with water containing the metal halide precipitation agent, for example, with water containing the metal halide and the organic compound precipitation agents.

Compositions

Some embodiments relate to compositions comprising one or more disclosed polypeptides alone or in combination, including in combination with wild type polypeptide of SEQ ID NO:1 (with or without one of the first two Met, with or without periplasmic tag, and with or without an additional poly-His C-terminal tag as described herein). In some embodiments, the composition comprises one or more polypeptide with improved activity in the catalysis of the dehydration of 3-buten-2-ol to 1,3-butadiene. In some embodiments, the composition comprises one or more polypeptide with improved increased specific activity in the catalysis of the dehydration of 3-buten-2-ol to 1,3-butadiene. In other embodiments, the composition comprises one or more polypeptides with improved activity and one or more polypeptides with increased specific activity in the catalysis of the dehydration of 3-buten-2-ol to 1,3-butadiene.

In some embodiments the composition may be composed of one or more disclosed polypeptides, from (1) commercial suppliers; (2) cloned genes expressing said polypeptides; (3) complex broth (such as that resulting from growth of a microbial strain or any other host cell in media, wherein the strains/host cells secrete the disclosed polypeptides into the media; (4) cell lysates of strains/host cells grown as in (3); and/or (5) any other host cell material expressing the disclosed polypeptide. Different disclosed polypeptides in a composition may be obtained from different sources.

In some embodiments, the composition comprises 3-buten-2-ol and one or more polypeptides described herein. In other embodiments, the composition further comprises a wild-type polypeptide of SEQ ID NO:1 (with or without one of the first two Met, with or without periplasmic tag, and with or without an additional poly-His C-terminal tag as described herein).

In some embodiments, the composition comprises 1,3-butadiene and one or more polypeptides described herein. In other embodiments, the composition further comprises a wild type polypeptide of SEQ ID NO:1 (with or without one of the first two Met, with or without periplasmic tag, and with or without an additional poly-His C-terminal tag as described herein).

In some embodiments, the composition comprises a rubber product polymerized from 1,3-butadiene produced in the presence of a polypeptide as described herein.

In some embodiments, the composition comprises a copolymer polymerized from 1,3-butadiene produced in the presence of a polypeptide as described herein.

In some embodiments, the composition comprises a plastic product polymerized from 1,3-butadiene produced in the presence of a polypeptide as described herein.

Antibodies capable of binding to a polypeptide of the embodiments, or to relatives or fragments thereof that encompass at least one of the improved mutations/alterations described herein, are also encompassed. Methods for producing antibodies are well known in the art (see, for example, Harlow and Lane, (1988) Antibodies: A Laboratory Manual, Cold Spring Harbor Laboratory, Cold Spring Harbor, N.Y) and more recent art-recognized manuals of antibody production.

Methods of Use

The polypeptides, nucleic acids, and compositions described herein may be used in many different applications. Some of those applications are described in the SUMMARY and/or the claims.

One embodiment relates to a method of producing 1,3-butadiene comprising dehydrating 3-buten-2-ol to 1,3-butadiene in the presence of a polypeptide as described herein.

Another embodiment relates to the use of a polypeptide as described herein in the preparation of a product, wherein the product is polymerized from 1,3-butadiene produced in the presence of the polypeptide. In one embodiment, the product is a rubber product. In one embodiment, the product is a copolymer. In another embodiment, the product is a plastic.

Another embodiment relates to a method of constructing a disclosed polypeptide, which method comprises (a) making alterations in the amino acid sequence each of which is an insertion, a deletion or a substitution of an amino acid residue at one or more positions of SEQ ID NO:1 (or SEQ ID NO:1 without the periplasmic tag, or SEQ ID NO:4, or 5), (b) preparing the polypeptide resulting from those alterations, (c) testing the 1,3-butadiene producing activity of the polypeptide, (d) optionally repeating steps a)-c) recursively; and (e) selecting a polypeptide having an improved 1,3-butadiene producing activity as compared to that of the wild-type polypeptide of SEQ ID NO:1 (or SEQ ID NO:1 without the periplasmic tag, or SEQ ID NO:4, or 5).

All of the claims in the claim listing are herein incorporated by reference into the specification in their entireties as additional embodiments.

EXAMPLES

All of the compositions and methods disclosed and claimed herein can be made and executed without undue experimentation in light of the present disclosure and the knowledge of one of ordinary skill in the art. In some cases, the compositions and methods of this disclosure have been described in terms of embodiments; however these embodiments are in no way intended to limit the scope of the claims, and it will be apparent to those of skill in the art that variations may be applied to the compositions and/or methods and in the steps or in the sequence of steps of the methods described herein without departing from the concept, spirit and scope of the invention. More specifically, it will be apparent that certain components which are both chemically and physiologically related may be substituted for the components described herein while the same or similar results would be achieved. All such similar substitutes and modifications apparent to those skilled in the art are deemed to be within the spirit, scope and concept of the invention as defined by the appended claims.

1. Enzymes

Four enzymes were tested for product formation for step b) of the following reaction: step a) isomerization and dehydration of the natural substrate linalool and step b) the dehydration of 3-buten-2-ol to 1,3-butadiene.

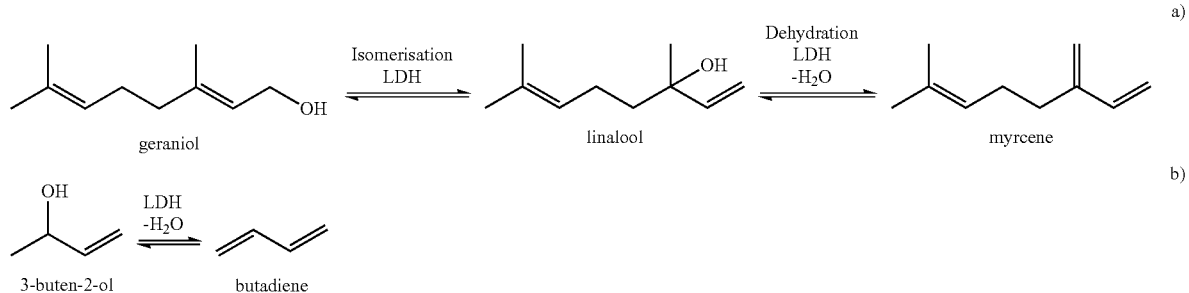

The four enzymes were: 1—Linalool dehydratase/isomerase from *Castellaniella defragrans*, EC 4.2.1.127 hereafter abbreviated cdLD, 2—Oleate hydratase from *Elizabethkingia meningoseptica* and *Streptococcus Pyogenes*, EC 4.2.1.53 hereafter abbreviated emOH and spOH, 3—Lycopene Hydratase from *Thiocapsa roseopersicina* and *Rubrivivax gelatinosus*, EC 4.2.1.131 hereafter abbreviated trLH and rgLH, and finally 4—Kievitone hydratase from *Fusarium Phaseoli*, EC 4.2.1.95 hereafter abbreviated fpKH. Only cdLD showed repeatable activity for step b).

The amino-acid sequence for *C. defragrans* linalool dehydratase (hereafter referred to as cdLD) is available in public databases (accession number gi302064203 in the protein NCBI databank) and was reported by Brodkorb et al., "Linalool dehydratase-isomerase, a bifunctional enzyme in the anaerobic degradation of monoterpenes", Journal of Biological Chemistry, Vol 285 (40), pp 30436-30442. The amino-acid sequence used herein is reproduced below. Note that, as described in Brodkorb et al., the sequence has the N-terminal signal MRFTLKTTAIVSAAALLAGFGPPPRAA (SEQ ID NO:3) which is a bacterial periplasmic routing signal. The protein used herein also has an extra Met residue relative to the cdLD described in the NCBI database as Genbank Accession E1XUJ2.1

>gi|302064203|emb|CBW30776.1| linalool
dehydratase-isomerase precursor [Castellaniella
defragrans] plus extra N-terminal methionine.
MMRFTLKTTAIVSAAALLAGFGPPPRAAELPPGRLATTEDYFAQQAKQAV

TPDVMAQLAYMNYIDFISPFYSRGCSFEAWELKHTPQRVIKYSIAFYAYG

LASVALIDPKLRALAGHDLDIAVSKMKCKRVWGDWEEDGFGTDPIEKENI

MYKGHLNLMYGLYQLVTGSRRYEAEHAHLTRIIHDEIAANPFAGIVCEPD

NYFVQCNSVAYLSLWVYDRLHGTDYRAATRAWLDFIQKDLIDPERGAFYL

SYHPESGAVKPWISAYTTAWTLAMVHGMDPAFSERYYPRFKQTFVEVYDE

GRKARVRETAGTDDADGGVGLASAFTLLLAREMGDQQLFDQLLNHLEPPA

KPSIVSASLRYEHPGSLLFDELLFLAKVHAGFGALLRMPPPAAKLAGK
SEQ1: WT cdLD amino-acid sequence (SEQ ID NO: 1); SEQ ID NO: 1
without the first of the two first Methionines is SEQ ID NO: 7.

The DNA sequence below (SEQ2) codes for the amino-acid sequence of Linalool dehydratase-isomerase listed above as SEQ1. It was codon-optimized for *E. coli* and subsequently cloned into the pARZ4 vector (a modified version of the pET29 vector). A C-terminal 6-HIS tag (SEQ ID NO: 10) is added to the sequence in the pARZ4 vector, after a GS (Gly-Ser) linker and is included (in lower case) in the sequence SEQ2 below. The total His-Tag is GSLEHHHHHH (SEQ ID NO:6).

>gi|302064203|emb|CBW30776.1| linalool
dehydratase-isomerase precursor [Castellaniella
defragrans]
atgATGCGTTTCACATTAAAGACCACCGCGATTGTTTCTGCCGCCGCGTT

ATTAGCGGGTTTTGGACCACCACCTCGTGCAGCAGAATTACCTCCCGGCC

GCCTTGCCACAACCGAAGATTATTTCGCACAACAAGCAAAACAAGCTGTA

ACCCCGGATGTTATGGCTCAACTCGCGTACATGAACTATATTGATTTCAT

TAGCCCCTTTTATTCACGTGGATGTTCATTCGAAGCATGGGAATTGAAAC

ACACTCCGCAGCGCGTGATTAAATACTCCATTGCATTCTATGCTTATGGC

TTGGCATCTGTAGCATTAATCGACCCTAAACTGCGCGCGCTCGCCGGCCA

CGACTTAGATATTGCAGTCTCAAAAATGAAATGTAAACGTGTATGGGGAG

ATTGGGAAGAAGATGGTTTTGGTACAGATCCGATTGAAAAAGAAACATT

ATGTATAAAGGACATCTGAACCTTATGTATGGTCTCTATCAACTTGTTAC

TGGATCGCGCCGTTACGAAGCTGAACACGCTCACCTCACCCGTATTATCC

ACGACGAAATTGCCGCCAACCCATTCGCCGGAATCGTTTGTGAACCAGAC

AACTATTTTGTACAATGCAACTCTGTGGCCTATTTAAGCCTTTGGGTCTA

CGATCGTTTACATGGAACTGACTACCGTGCCGCAACTCGTGCCTGGCTGG

ATTTTATTCAAAAAGATCTGATTGACCCCGAACGTGGAGCTTTCTATTTG

TCCTATCATCCCGAATCTGGTGCCGTCAAACCTTGGATCAGCGCATATAC

-continued

AACCGCTTGGACGTTAGCTATGGTGCATGGAATGGATCCTGCCTTTTCAG

AACGTTATTATCCTCGTTTTAAACAAACGTTCGTCGAAGTCTATGATGAA

GGCCGTAAAGCCCGCGTACGCGAAACTGCCGGAACCGACGACGCCGATGG

TGGTGTGGGTTTAGCCTCTGCGTTCACACTTTTATTAGCCCGCGAAATGG

GAGATCAACAACTCTTTGACCAACTGCTGAATCATTTAGAACCCCCTGCC

AAACCAAGCATCGTTTCTGCTAGCCTCCGGTACGAACACCCAGGCAGCCT

CTTATTCGACGAACTGTTATTTCTTGCCAAAGTACATGCCGGATTIGGTG

CTCTGTTACGTATGCCCCCTCCTGCCGCCAAATTAGCGGGCAAAGGTTCC ctcgagcaccaccaccaccaccactga
SEQ2: optimized DNA sequence coding for SEQ1. The sequence is
optimized for E coli expression. The start codon, GS linker and
His$_6$-tag (SEQ ID NO: 10) are in lower case.(SEQ ID NO: 2)

2. Protein Expression and Purification a. Expression and purification of peri-cdLD in BL21 cells in the presence of pKJE7, pGro7 and pTf16 chaperone plasmids.

Plasmids expressing chaperones were purchased from TaKaRa. They were pG-KJE8 (expresses chaperons dnaK-dnaJ-grpE groES-groEL), pGro7 (groES-groEL), pKJE7 (dnaK-dnaJ-grpE), pG-Tf2 (groES-groEL-tig) and pTf16 (tig)

Periplasmic cdLD mutants were expressed in BL21 cells with pGro7 plasmid and purified by His-tag affinity resin. Chemically competent BL21 cells carrying a pGro7 plasmid were transformed with pARZ4 vector harboring the desired cdLD. On day 1 of expression, 10 ml overnight culture of LB/KAN (50 ug/ml) with chloramphenicol (20 ug/ml) at 37° C. were started in the evening. On day 2, 500 ml LB/KAN with chloramphenicol (20 ug/ml) were inoculated with 10 ml overnight culture. The culture was grown to an OD600 nm 0.6-0.8 at 37° C. The cells were induced overnight with 500 ul 1M IPTG at 25° C. The 500 ml culture was centrifuged at 9,000×g, 20° C. for 5 minutes. The cells were resuspended in 6 ml 50 mM Tris-HCl pH9/150 mM NaCl and stored at −20° C.

6 ml cdLD pellet were lysed with spatula tips of lysozyme, DNase 1, and 600 ul 10× Bugbuster Protein Extraction Reagent for 25 minutes at room temperature. The lysed cells were centrifuged at 12,000×g for 25 minutes at 5° C. The supernatant was filtered with a 0.8 um/0.2 um membrane. The supernatant was loaded 3× on Ni-NTA column (bed volume 1.25 ml). The column was washed with 50 ml 50 mM Tris-HCl pH9/150 mM NaCl and 50 ml 50 mM Tris-HCl pH9/150 mM NaCl/20 mM Imidazole. The cdLD was eluted with 10 ml 50 mM Tris-HCl pH9/150 mM NaCl/250 mM Imidazole. 10 ml of cdLD elution were degased with argon for 30 minutes and 200 ul 100 mM DTT were added to the elution. 10 ml of elution were concentrated to ~2 mL in a Sartorius Vivaspin 15R Centrifugal Concentrator. 1.5 ml of concentrated cdLD were desalted with 2 ml degassed 80 mM Tris-HCl pH9 in Hi-Trap Desalting column. The 2 ml sample was overlayed with argon and stored at 4° C. cdLD was observed on a SDS gel with a molecular weight of ~40 kDa. The concentration of 2 ml desalted cdLD was ~1 mg/ml resulting in ~2 mg per 500 ml expression culture.

b. Expression and Purification of Cyto-cdLD in Origami 2 (DE3) Strain

Cytoplasmic cdLD was expressed in the Origami 2 (DE3) strain with the following genotype: Δ(ara-leu)7697 ΔlacX74 ΔphoA PvuII phoR araD139 ahpC galE galK rpsL F'[lac$^+$ lacI$^q$ pro] (DE3) gor522::Tn10 trxB pLysS (Cam$^R$, Str$^R$, Tet$^R$).

Chemically competent Origami 2 (DE3) cells carrying a pGro7 plasmid were transformed with pARZ4 (a proprietary pET24 derivative) harboring the desired cdLD. On day 1 of expression, 10 ml overnight cultures of LB/KAN (50 ug/ml) at 37° C. were started in the evening. On day 2, 500 ml LB/KAN were inoculated with 10 ml overnight culture. The culture was grown to an OD600 nm 0.6-0.8 at 37° C. The cells were induced overnight with 500 ul 1M IPTG at 25° C. The 500 ml culture was centrifuged at 9,000×g, 20° C. for 5 minutes. The cells were resuspended in 6 ml 50 mM Tris-HCl pH9/150mM NaCl and stored at −20° C.

6 ml of cdLD pellet were lysed with spatula tips of lysozyme, DNase 1, and 600 ul 10× Bugbuster Protein Extraction Reagent for 25 minutes at room temperature. The lysed cells was entrifuge at 12,000×g for 25 minutes at 5° C. The supernatant was filtered with a 0.8 um/0.2 um membrane. The supernatant was loaded 3× on Ni-NTA column (bed volume 1.25 ml). The column was washed with 50 ml 50 mM Tris-HCl pH9/150mM NaCl and 50 ml 50 mM Tris-HCl pH9/150mM NaCl/20 mM Imidazole. The cdLD was eluted with 10 ml 50 mM Tris-HCl pH9/150 mM NaCl/250 mM Imidazole. 10 ml of cdLD elution were degased with argon for 30 minutes and 200 ul 100 mM DTT were added to the elution. 10 ml of elution were concentrated to ~2mL in a Sartorius Vivaspin 15R Centrifugal Concentrator. 1.5 ml of concentrated cdLD were desalted with 2 ml degassed 80 mM Tris-HCl pH9 in Hi-Trap Desalting column. The 2 ml sample was overlayed with argon and stored at 4° C. cdLD was observed on a SDS gel with a molecular weight of ~40 kDa. The concentration of 2 ml desalted cdLD was ~1 mg/ml resulting in ~2 mg per 500 ml expression culture.

3. The 1 ml Butadiene Assay for Linalool Dehydration Reaction

Bacterial cells transformed with the appropriate constructs were picked from LB plates into 400 ul of LB media containing 25 μg/mL kanamycin in deep-well 96-well plates and incubated overnight at 37° C. with vigorous shaking. Next morning, 20 ul of this night culture was inoculated into 1 ml of LB media containing 25 μg/mL kanamycin of deep-well 96-well plates, shaken at 37° C. for several hours. When cell density reached appropriate level (OD of 0.6 at 600 nm), 0.5 ul of 1M IPTG were added to each well (final concentration 500 uM). Plates were incubated 24 h at 25° C. with vigorous shaking. Then, 900 ul of cell culture was transferred to a crimp vial along with 9 ul of 1.1M 3-buten-2-ol (final concentration of 11 mM), sealed and incubated at room temperature for 72 h. Following incubation samples were analyzed by Shimadzu GCMS-QP2010 Ultra with Agilent column HP PLOT/Q (0.32 mm, 15m length, 20 um diameter). The program was as follows: column was heated at 90° C. for 1 min, followed by a temperature increase at 40° C. per minute until it reached 200° C. Ion source was heated at 230° C., interface at 180° C., inlet at 250° C. 8 ul of the crimp vial headspace was injected in a split mode with split ration 2:1. Total He flow was at 9 ml/min, septum purge flow at 3 ml/min and column flow at 2 ml/min. Butadiene was detected at 2.26 min by monitoring ions with m/z 39, 50 and 54 in SIM mode. Butadiene from each sample was compared to the wild-type cdLD enzyme present on each plate. Relative activity was calculated as a ratio between the amounts of butadiene produced by a particular variant and the wild-type enzyme.

This is the assay for BL21 (DE3, which is the cell line for peri-cdLD, and for cyto-cdLD.

4. Assay for WT Linalool Dehydration Reaction (Conversion of Linalool to Myrcene)

Purified proteins were tested for their wild type linalool dehydratase activity. 100 µl of purified protein were transferred into an eppendorf tube along with 80 µl of degassed 80 mM Tris-HCl buffer (pH 9) as well as 20 µl of 100 mM linalool solution in DMSO. Negative control reactions were tubes without protein or without linalool (substrate). Tubes were shaken at room temperature for 1 h, followed by adding of 200 µl of ethylacetate. This mixture was vertexed and spinned down for 1 min in the tabletop centrifuge. The organic phase was transferred to GC vial and analysed by Shimadzu GCMS-QP2010 Ultra with Restek column Rxi-624Sil (0.32 mm, 60m length, 1.8 um diameter). The program was as follows: column was heated at 100 C for 1 min, followed by a temperature increase at 50 C per minute until it reached 2800. Injection temperature was 250 C. 8 ul of ethylacetate solution was injected in a splitless mode. Total He flow was at 58 ml/min and column flow at 1.86 ml/min. Myrcene was detected at 5.50 min, linalool at 6.17 and geraniol at 6.96 by monitoring ions with m/z 69, 71 and 93 in SIM mode.

5. Crystal Structure Determination

A delta-BLAST search on the database of protein sequences from the Protein Data Bank (PDB) revealed that cdLD did not have any detectable homology to any sequence for which a structural model was available. The crystal structure of cdLD was then obtained through two private contractors: Novalix, Illkirch-France and Emerald Bio, Bainbridge-WA. Both companies followed the same general approach.

The protein expressed from a construct having WT cdLD sequence (SEQ1) plus HIS-tag was crystalized. In the actual crystal structure obtained however, the periplasmic signal/tag is cleaved, the first fully resolved residue is L29 (peri-cdLD WT numbering) and the last resolved residue is P390 (i.e. the HIS-tag has no visible density. This is the sequence below (SEQ ID NO: 11):

LPPGRLATTEDYFAQQAKQAVTPDVMAQLAYMNYIDFISPFYSRGCSFEA

WELKHTPQRVIKYSIAFYAYGLASVALIDPKLRALAGHDLDIAVSKMKCKR

VWGDWEEDGFGTDPIEKENIMYKGHLNLMYGLYQLVTGSRRYEAEHAH

LTRIIHDEIAANPFAGIVCEPDNYFVQCNSVAYLSLWVYDRLHGTDYRAAT

RAWLDFIQKDLIDPERGAFYLSYHPESGAVKPWISAYTTAWTLAMVHGM

DPAFSERYYPRFKQTFVEVYDEGRKARVRETAGTDDADGGVGLASAFTL

LLAREMGDQQLFDQLLNHLEPPAKPSIVSASLRYEHPGSLLFDELLFLAKV

HAGFGALLRMPP

An additional three constructs with N-terminal and C-terminal deletions were also considered, but none yielded soluble protein in appreciable quantities: construct 1-deletion of residues Glu28-Thr36 and C-terminal cut at Arg387; construct 2-deletion of residues Glu28-Ile67; and construct 3-deletion of residues Glu28-Ile67 and C-terminal cut at Arg387 (all are with respect to the numbering of WT cdLD of SEQ1). Their sequences are as follows:

Del Glu28-Thr36 C-ter cut at Arg387 (SEQ ID NO: 12)
>gi|302064203|emb|CBW30776.1| linalool dehydratase-isomerase precursor [*Castellanilla defragrans*] SIGNAL SEQ

MMRFTLKTTAIVSAAALLAGFGPPPRAATEDYFAQQAKQAVTPDVMAQL

AYMNYIDFISPFYSRGCSFEAWELKHTPQRVIKYSIAFYAYGLASVALIDP

KLRALAGHDLDIAVSKMKCKRVWGDWEEDGFGTDPIEKENIMYKGHLNLM

YGLYQLVTGSRRYEAEHAHLTRIIHDEIAANPFAGIVCEPDNYFVQCNSVA

YLSLWVYDRLHGTDYRAATRAWLDFIQKDLIDPERGAFYLSYHPESGAVK

PWISAYTTAWTLAMVHGMDPAFSERYYPRFKQTFVEVYDEGRKARVRE

TAGTDDADGGVGLASAFTLLLAREMGDQQLFDQLLNHLEPPAKPSIVSAS

LRYEHPGSLLFDELLFLAKVHAGFGALLRGSLEHHHHHH

Del Glu28-Ileu67 (SEQ ID NO: 13)
>gi|302064203|emb|CBW30776.1| linalool dehydratase-isomerase precursor [*Castellaniella defragrans*] SIGNAL SEQ

MMRFTLKTTAIVSAAALLAGFGPPPRAASPFYSRGCSFEAWELKHTPQR

VIKYSIAFYAYGLASVALIDPKLRALAGHDLDIAVSKMKCKRVWGDWEED

GFGTDPIEKENIMYKGHLNLMYGLYQLVTGSRRYEAEHAHLTRILHDEIAA

NPFAGIVCEPDNYFVQCNSVAYLSLWVYDRLHGTDYRAATRAWLDFIQK

DLIDPERGAFYLSYHPESGAVKPWISAYTTAWTLAMVHGMDPAFSERYY

PRFKQTFVEVYDEGRKARVRETAGTDDADGGVGLASAFTLLLAREMGD

QQLFDQLLNHLEPPAKPSIVSASLRYEHPGSLLFDELLFLAKVHAGFGALL

RMPPPAAKLAGKGSLEHHHHHH

Del Glu28-Ileu67 C-ter cut at Arg387 (SEQ ID NO; 14)
>gi|302064203|emb|CBW30776.1| linalool dehydratase-isomerase precursor [*Castellanilla defragrans*] SIGNAL SEQ

MMRFTLKTTAIVSAAALLAGFGPPPRAASPFYSRGCSFEAWELKHTPQR

VIKYSIAFYAYGLASVALIDPKLRALAGHDLDIAVSKMKCKRVWGDWEED

GFGTDPIEKENIMYKGHLNLMYGLYQLVTGSRRYEAEHAHLTRIIHDEIAA

NPFAGIVCEPDNYFVQCNSVAYLSLWVYDRLHGTDYRAATRAWLDFIQK

DLIDPERGAFYLSYHPESGAVKPWISAYTTAVVTLAMVHGMDPAFSERYY

PRFKQTFVEVYDEGRKARVRETAGTDDADGGVGLASAFTLLLAREMGD

QQLFDQLLNHLEPPAKPSIVSASLRYEHPGSLLFDELLFLAKVHAGFGALL

RGSLEHHHHHH

AH the constructs contain the N-terminal periplasmic tag. Expression and Ni-NTA purification for the Novalix crystals were according to the following. Cultures of cdLD were done in bateria BL21 (DE3) in 1 L of Power Broth medium. Induction with IPTG was done at 18° C. overnight. After centrifugation, pellets were resuspended in 200 ml of lysis buffer (Tris pH8 20 mM, NaCl 500mM, Glycerol 10%, Imidazole pH8 10 mM, Chaps 1%, TCEP 1 mM) for 6 L culture and treated with ultrasound. After centrifugation at 53000 g, soluble extract was incubated with around 2 ml of Talon beads overnight. Column was washed with 5-column volume of lysis buffer and elution was performed in one step with elution buffer (Tris pH8 20 mM, NaCl 500 mM, Glycerol 10%, Imidazole pH8 250 mM Chaps 1mM TCEP 1 mM). Then, sample was applied on SEC column (Hiload 16/60 S75) pre-equilibrated with SEC buffer (Tris pH8 20 mM, NaCl 150 mM, Glycerol 5%). Average purification yield 2 mg of cdLD pure protein for 6 L culture. Protein was then concentrated up to 6 mg/ml in SEC buffer before crystallization assays. A total of 960 crystallization conditions were tested. Crystals of cdLD used for structure determination were obtained in Morpheus screen H2 condition (P8000 10%, Ethylene Glycol 20%, Na-l-glutamate 0.02M, dl-alanine 0.02M, glycine 0.02M, dl-lysine HCl 0.02M, dl-serine 0.02M) at 295° K. Crystals appears within few days and are very thin and delicate to handle. Thanks to ethylene glycol in the mother liquor, crystals can be fished and directly frozen in liquid nitrogen.

Conditions of expression and purification for the Emerald crystals were as follows. cdLD from the Arzeda-supplied plasmid was expressed as secreted protein in the periplasmic space. Fermentation conditions were: growth of *E. coli* cells harboring the pARZ_cdLD plasmid (expressing cdLD with the sequence in the table below, SEQ ID NO:9) at the 8 L scale in 1 L shake flasks of LB media, induced at OD ~0.600 with 1 mM IPTG and grown overnight at 25° C.

| Target protein | cdLD |
|---|---|
| AA sequence | MMRFTLKTTAIVSAAALLAGFGPPPRAAELPPGRLATTEDYFAQQAKQAVTPDVMA QLAYMNYIDFISPFYSRGCSFEAWELKHTPQRVIKYSIAFYAYGLASVALIDPKLRALAG HDLDIAVSKMKCKRVWGDWEEDGFGTDPIEKENIMYKGHLNLMYGLYQLVTGSRR YEAEHAHLTRIIHDEIAANPFAGIVCEPDNYFVQCNSVAYLSLWVYDRLHGTDYRAAT RAWLDFIQKDLIDPERGAFYLSYHPESGAVKPWISAYTTAWTLAMVHGMDPAFSER YYPRFKQTFVEVYDEGRKARVRETAGTDDADGVGLASAFTLLLAREMGDQQLFDQ LLNHLEPPAKPSIVSASLRYEHPGSLLFDELLFLAKVHAGFGALLRMPPPAAKLAGK<u>HH HHHH</u> |
| Color key | His tag in bold/underline, secretion signal in Bold |

*E. coli* paste was delivered on wet ice and cells were disrupted by mild osmotic shock to release periplasmic proteins. A detailed protocol for protein purification is provided below. Briefly, the protein was purified by Ni-IMAC chromatography using the C-terminal polyhistidine tag, followed by size exclusion chromatography. Purification yields were approximately 1 mg per liter of *E. coli* culture.

Starting with 8 L of *E. Coli* paste:

| Periplasmic Release | Mild Osmotic Shock Buffer (MOSB): 200 mM Tris/HCl pH 7.5, 20% (w/v) sucrose, one complete EDTA free protease inhibitor tablet (ice cold). |
|---|---|
| | 1. The sample pellets were resuspended in 800 mls (10% of the culture volume) of ice cold MOSB with 400 mgs of lysozyme added to the buffer just before use. The sample was gently shaken on ice for 20 minutes. |
| | 2. After 20 minutes 800 mls of ice cold diH₂O was added to the sample and gently shaken for another 20 minutes. |
| | 3. Samples were pelleted via centrifugation at 5,000 rpm for 30 minutes at 4° C. |
| | 4. Supernatant was removed, filtered through an 0.2 μm bottle top filter and purified via Ni-NTA affinity chromatography. |

Protein Purification: Purification Step 1

AH purification steps are carried out at 4° C. AKTA systems were flushed thoroughly with water then buffers before purification initiated.

| Chromatography Type | Ni 1 |
|---|---|
| Type of Column Used: | HiTrap Ni Chelting |
| Quantity of Columns Used | 1 × 5 ml |
| New or Regenerated | New |
| Buffer A | 50 mM Tris pH 9, 0.15M NaCl, 20 mM imidazole. Prepared Feb. 19, 2013. |
| Buffer B | 50 mM Tris pH 9, 0.15M NaCl, 250 mM imidazole. Prepared Feb. 19, 2013. |
| Wash Buffer | 50 mM Tris pH 9, 0.15M NaCl, Prepared Feb. 19, 2013. |
| Column Equilibration | 4 CVs A, 4 CVs B, 4 CVs A |
| AKTA System Used | BB-AKTA 2 |
| Load Volume and Flow Rate | 1.6 L, 1.5 ml/min |
| Wash Volume and Flow Rate | 50 ml, 2 ml/min |
| Elution Gradient, Flow Rate and Fraction Size | 0-60% B over 120 minutes, 1 ml/min, 5 ml fractions. |
| Comments | N/A |
| SDS-PAGE Analysis | 4-12% MOPS SDS-PAGE denatured at 95° C. for 5 minutes with 4X SDS loading dye containing 2-mercaptoetahanol. |

Protein Purification: Concentration Step 1 (Concentration Target: 15 mg/ml)

| Concentrator Type, MWCO, Spin Speed and Duration | Vivaspin 20 PES, 10 kDa MWCO, 5000-6500 RCF, 10-20minutes intervals. |
|---|---|
| Initial Concentration (Nanodrop-1000) and Volume | 0.3 mg/ml, 45 ml |
| Final Concentration (Nanodrop-1000) and Volume | 5.05 mg/ml, 2.2 ml |

Protein Purification: Purification Step 2

| Chromatography Type | SEC |
|---|---|
| Type of Column Used | Sephacryl 5-100 16/60 |
| Quantity of Columns Used | 1 × 120 ml |
| SEC Buffer | 10 mM Tris pH 9.0, 350 mM NaCl, 2 mM DTT. Prepared Feb. 20, 2013. |
| Column Equilibration | 100% SEC Buffer, 240 minutes at 0.5 mL/min |
| AKTA System Used | BB-AKTA 2 |
| Injection Volume and Flow Rate | 2.2 ml, 0.5 ml/min |
| Number of Injections | 1 × 2.2 ml |
| Fraction Size | 3 ml |
| Comments | N/A |
| SDS-PAGE Analysis | 4-12% MOPS SDS-PAGE denatured at 95° C. for 5 minutes with 4X SDS loading dye containing 2-mercaptoethanol. |
| SDS-PAGE Analysis Conditions | Reduced |
| Aliquot Number Volume, Concentration | 8 × 100 μl, 1 × 50 μl at 10.28 mg/ml |
| Final Yield of Protein | 8.74 mgs |
| Final Buffer | 10 mM Tris pH 9.0, 350 mM NaCl, 2 mM DTT. |

3) Crystal Growth and Handling:

Crystals for structure determination of cdLD were obtained by using the sitting drop vapor diffusion method with 400 nL of protein solution (cdLD at 9.06 mg/mL in 10 mM Tris pH 9.0, 350 mM NaCl, 2 mM DTT) mixed with 400 nL of crystallization solution above a reservoir of ~40 μL of crystallization solution. Suitable crystallization conditions for growth of crystals were found by testing 576 random sparse matrix conditions from a variety of commercially available crystallization screens. Small crystals were obtained from the commercial screen Morpheus (Molecular Dimensions, Newmarket UK). The Morpheus screen utilizes complex mixtures of precipitants, buffers and additives. A description of the screen can be found at: www.moleculardimensions.com/applications/upload/MD1-47%20Morpheus%C2%AE.pdf. Based on these initial crystallization hits, an optimization screen was created that utilized varying concentrations of the Morpheus buffers. The crystal from which data were obtained was grown from the following components;

39.55% (v/v) Morpheus "EDO_P8K", a mixture of ethylene glycol and PEG 8000

10% (v/v) Morpheus Amino Acids, a mixture of L-Na-Glutamate; Alanine (racemic); Glycine; Lysine HCl (racemic); Serine (racemic)

6.12% (v/v) 1.0 M MES and 3.88% (v/v) 1.0 M imidazole; pH 6.5

In addition, the crystallization drop that yielded the crystal used for data collection also contained 0.05% (v/v) of 3-buten-2-ol.

The crystallization solution was a "direct cryo", i.e., a solution that would undergo a glass-like transition to solid when rapidly cooled in liquid nitrogen, and thus no additional cryoprotectant was required in order to freeze the crystal for data collection. The crystal was transferred to a crystal mounting loop and flash-cooled by being plunged into liquid nitrogen. All crystal growth took place in a temperature-controlled room at 16° C.

X-ray diffraction data collection: Data were collected via remote access at the Advanced Photon Source in Argonne, Ill. on beamline 21-ID-D on Apr. 18, 2013 using a MarMosaic 300 CCD detector, Data were processed and scaled using XDS/XSCALE. Data collection, scaling and refinement statistics are summarized in the following table:

| Parameter | Overall (Highest shell) |
| --- | --- |
| Radiation source | APS 21-ID-D |
| Collection date | 18 Apr. 2013 |
| Δφ | 1.0° |
| Frames | 250 |
| Distance | 300 mm |
| wavelength | 0.93005 Å |
| Crystal ID | 244270a7, puck ID lab8-4 |
| Space Group | $P2_1$ |
| Unit cell | a = 88.70, b = 111.22, c = 120.42: |
|  | α = 90.0, β = 102.72, γ = 90.0 |
| Resolution | 2.60 Å (2.67 Å-2.60 Å) |
| I/σ | 16.17 (2.71) |
| Completeness | 99.8% (99.9%) |
| $R_{merge}$ | 7.4% (51.4%) |
| Reflections (unique) | 284619 (70173) |
| Multiplicity | 4.06 |
| Refinement statistics |  |
| $R_{cryst}$ | 17.20% |
| $R_{free}$ | 22.20% |
| rmsd bonds | 0.011 |
| rmsd angles | 1.430 |
| Mean B-factor | 28.64 |

Structure Determination of the Emerald crystals: The structure cdLD was solved by molecular replacement using the program Phaser as implemented in the CCP4 suite of programs with a protein model representing a preliminary structure of the same target created by Novalix as a search model. The initial MR solution was refined using Refmac5 The model of cdLD was then refined using alternating rounds of manual re-building in Coot with restrained refinement with Refmac5. The final R/Rfree for the model was 17.20%/22.20%.

Because no structural homolog is known for cdLD, phasing cannot be solved using molecular replacement; instead, either isomorphous replacement or MAD/SAD need to be used. For the Novalix crystals, isomorphous replacement was not successful, therefore Sel-met MAD was chosen for the Novalix crystals. In order to obtain Se-met labeled cdLD, cultures were performed in M9 medium supplemented with Se-met 80 mg/ml in B834 bacteria strain. A starter culture was done in LB medium and was used to inoculate M9 culture. Then induction with IPTG was done at 18° C. overnight. A protocol of purification similar to native cdLD was performed for Se-met labeled protein. Average purification yield around 2 mg of labeled cdLD for 12 L of M9 culture. Crystals used for MAD diffraction were obtained in the same condition of the native protein. Crystals of native and Se-met labeled protein belong to the same $P2_1$ space group but with 2 different cells. Se-met cdLD crystals diffract only to 3.7 Å resolution compared to 2.5 Å resolution for a crystal of native cdLD. After identification and refinement of Se atom positions, a first model of cdLD was built at 3.7 Å resolution with CCP4 suite software and SheIX. Phases were then expanded at 2.5 Å resolution by molecular replacement in a native dataset.

TABLE 1

| Synchrotron data CV32 Native protein | |
| --- | --- |
| Protein | cdLD native |
| Dataset | CV32 |
| X-ray source | Proxima 1 (SOLEIL) |
| Wavelength (Å) | 0.98011 |
| Detector distance | 439.7 mm |
| Oscillation | 0.2° |
| Exposure time | 0.2 second |

TABLE 2

| Crystallographic data | |
| --- | --- |
| Dataset | CV32 |
| Resolution | 48.16-2.54 |
| (last shell) (Å) | (2.69-2.54) |
| Space group | P2(1) |
| Unit cell | a = 133.18 Å |
|  | b = 110.83 Å |
|  | c = 162.20 Å |
|  | α = 90.00° |
|  | β = 107.157° |
|  | γ = 90.00° |
| Unique reflections | 154892 |
| Completeness (last shell) (%) | 99.0% (96.10%) |
| Redundancy | 3.4 |
| I/(I) (last shell) | 13.84 (2.08) |
| $R_{sym}$ (I) (last shell) (%) | 7.71% (58.60%) |
| B from <<Wilson plot>> | 48.08 Å$^2$ |

The crystal coordinates are provided in Appendix 1 for Novalix's crystal and Appendix 2 for Emerald's.

The statistics for the solved structure of the Novalix crystals are available in Tables 1 and 2

6. General Features of the High-Resolution 3D Model of Apo-cdLD

Part I: Novalix: cdLD adopts a pentameric arrangement with 5-fold axial symmetry in the asymmetric unit (labeled chain A through E). Each monomer adopts α/α(6) barrel fold, a relatively unseal fold that can be seen in FIG. 1. In the crystal structure, one disulfide bond is formed between Cys74 and Cys127 of each subunit (crystal structure numbering). A structural homology search using the DALI program yielded a variety of structural homologs, Structural alignment between the cdLD monomer and some of the DALI hits revealed that the enzymes that are structurally homologous to cdLD all have their active sites in the "top" of the barrel with the catalytic residues supported by the innermost helixes that line up the inside of the barrel (helixes 4, 7, 9, 11, 13, 14) and the loops connecting these helixes to the outermost helixes from the barrel. Consistent with the other enzymes adopting a similar fold, cdLD presents a marked cleft in that same region whereas the rest of the subunit is tightly packed fully solvent exposed. Therefore, it is hypothesized that the likely position of cdLD active site responsible for the observed catalytic activity is located in that region. Contrary to most of cdLD structural homologs, this putative active site is formed at the interface between subunits, for example, A and B in FIG. 1. Loop 62-77 (crystal structure numbering) from subunit B protrudes and doses the pocket formed by the top of the barrel of subunit A, see FIG. 2.

Below is the mapping in amino-acid residues (in WT peri-cdLD numbering) for each secondary structure elements. Secondary structure assignment was made using the DSSP software (note that 'helixes' here include α, 3₁₀ and π). Loop are not included because they are effectively all the remaining positions. See also FIG. 3.

TABLE 3

Residue number for each of the secondary structure elements (helixes H and strand S) of cdLD, based on the high-resolution crystal structure. Secondary structure assignments have been obtained with DSSP 2.2.1. Helix annotations include α, 310 and π helixes. Strands correspond to residue in the extended conformation, irrespective of whether they actually form β-stands.

| Helix | Start-End Residues (peri-cdLD [SEQ1] numbering) |
|---|---|
| H1 | 37-41 |
| H2 | 43-46 |
| H3 | 51-61 |
| H4 | 77-82 |
| H5 | 86-106 |
| H6 | 108-125 |
| H7 | 128-131 |
| H8 | 133-136 |
| H9 | 149-165 |
| H10 | 172-188 |
| H11 | 203-220 |
| H12 | 228-236 |
| H13 | 264-274 |
| H14 | 279-293 |
| S1 | 294-296 |
| H15 | 298-300 |
| S2 | 303-305 |
| H16 | 321-331 |
| H17 | 335-345 |
| S3 | 351-353 |
| S4 | 358-360 |
| H18 | 368-377 |
| H19 | 381-385 |

Part II: Emerald Crystals

Figure 16:
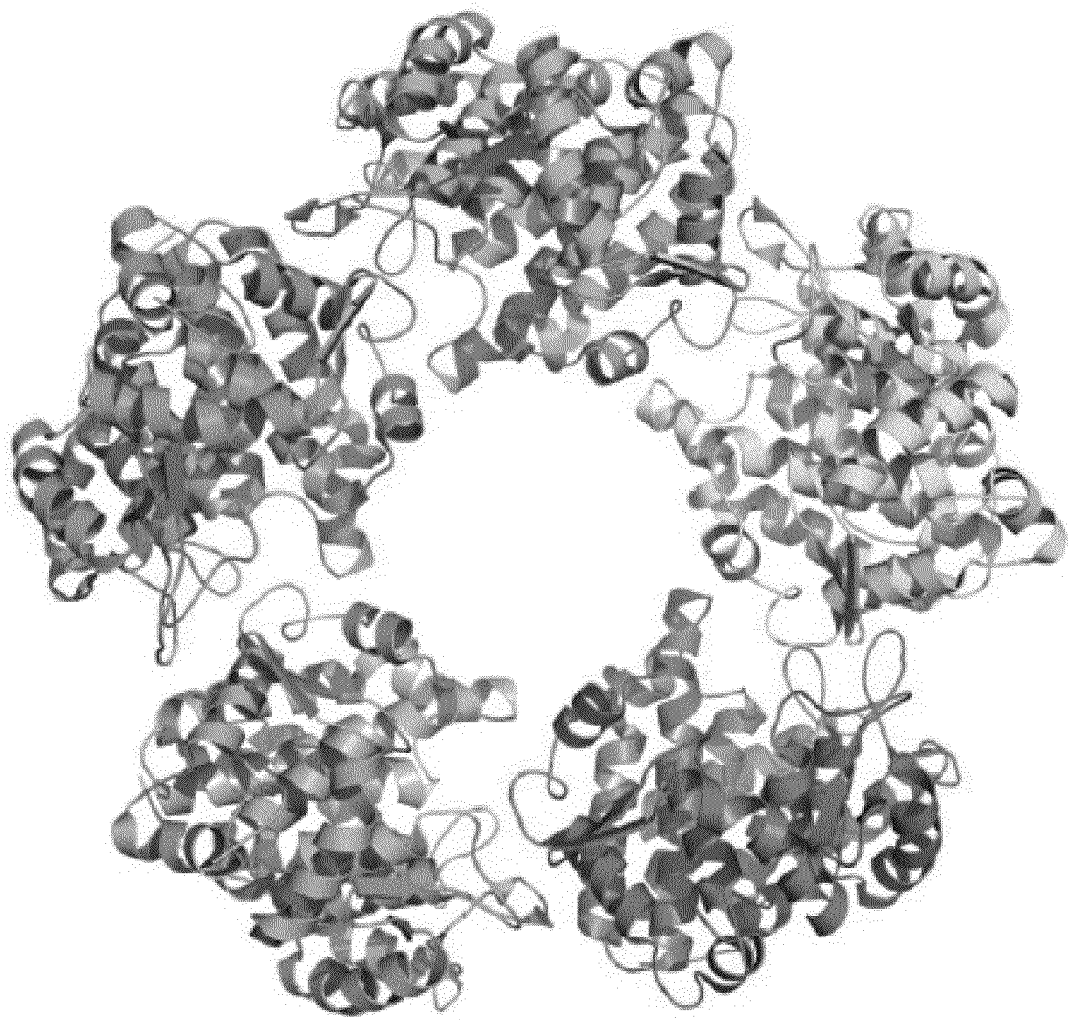
FIG. 16: Pentameric arrangement of cdLD protein monomers in the crystal asymmetric unit. Each polypeptide chain has a unique color.

The asymmetric unit of the cdLD crystal is a pentamer with 5-fold axial symmetry. Each individual subunit forms a head-to-tail interaction with a neighboring subunit where a loop around Tyr70 protrudes into a cavity at the center of the 6-alpha helix barrel of the cdLD monomer (top figure). At this interface is a narrow, >10 Å deep pocket that comprises the putative active site (FIG. 16).

During refinement of the Emerald crystal structure, a significant electron density feature was observed in all five subunits between residues Cys196 (wild-type cdLD; but Cys197 for wild-type cdLD with extra N-terminal amino acid) and Cys205 (wild-type cdLD; but Cys206 for wild-type cdLD with extra N-terminal amino acid). The shape of the electron density feature and the chemical coordination around the site were consistent with metal ion binding. The metal ion was presumed to be zinc, but the actual identity is unknown. No zinc or other divalent metals were present in the crystallization solution, however, a metal on could have carried over during purification or been present as a trace contaminant from glassware. Additional weak electron density features (green mesh in FIG. 17) were observed but not modeled. The observed electron density features were not consistent with 3-buten-2-ol or individual water molecules. One explanation is that 3-buten-2-ol and/or other crystallization components could have been present at low occupancy and/or in multiple conformations in the putative active site cleft, preventing clear electron density from appearing.

7. cdLD Active Site Mutants Based on Novalix Crystal Data

Based on visual analysis of the putative active site, a list of polar groups lining the active site pocket were selected for further mutagenesis to assess their impact on catalytic activity for WT reaction natively catalyzed by cdLD. The list of candidate active site residues, and the proposed mutations that are predicted to affect catalytic activity, can be found in Table 4 below.

TABLE 4

Putative catalytic residues, catalytic activity proposed knock-out mutations, and impact on protein expression (peri-cdLD or cyto-cdLD) and catalytic activity for the dehydration of linalool to myrcene.

| Mutant | Priplasmic cdLD in BL21 with PGro7 | | Cytoplasmic cdLD in Origami2(DE3) | |
|---|---|---|---|---|
| | Protein on PAGE | Activity with linalool | Protein on PAGE | Activity with linalool |
| Y99F | | | faint | |
| Y99A | + | | faint | some |
| Y92F | + | | + | YES |
| Y92A | faint | | + | some |
| Y71F | + | | + | |
| Y71A | + | | | |
| Y266F | faint | | + | some |
| Y266A | | | | |
| Q205L | | | | |
| Q205A | faint | | + | some |
| M151L | faint | some | + | YES |
| M151K | + | | + | |
| M151A | + | | + | some |
| H115D | | | | |
| H115A | + | | faint | some |
| E198Q | + | | + | |
| E198A | faint | | + | |
| D65N | | | + | |
| D65A | + | | + | |
| C206S | + | | + | |
| C206A | | | ND | |
| C197S | | | + | |
| C197A | + | | + | |
| WT peri | + | YES | + | YES |
| WT cyto | 5+ | YES | + | YES |

Each mutant was expressed and tested for its wild-type linalool dehydratase activity (Example 4). From these results, it was predicted that the following residues are candidates as catalytic residues: CYS197, CYS206, ASP65 and GLU198. They are the only residues for which cdLD was expressed and no catalytic activity towards the dehydration of linalool was observed.

8. cdLD Mutants with Improved Butadiene Production
a. Activity in Cell Cultures (i.e., In Vivo Activity)

Approximately 400 cdLD mutants and sequence homologs were screened for activity with 3B20 as a substrate. See Appendix 3 for sequences. All constructs were constructed in pARZ-cdLD plasmid. This plasmid is derived from PET-29a vector, where cdLD gene was cloned between restriction sites NdeI and XhoI. The expression vector contains T7 promoter, lac operator and N-terminal His tag. cdLD variants described herein were constructed at Gene9 Inc. (Cambridge, Mass.) with their proprietary methods. All genes were synthesized with the following overhangs: CTCTTCTTAACTTTAA-GAAGGAGATATACAT (upstream) and CTCGAGCAT-CATCATCATCATCACTGAGATCCGGCT-GCTAACAAAGCCCGGAAGA G (downstream) (SEQ ID NOS 15-16, respectively). Ten microliters of each cdLD variant was cut by EarI restriction enzyme (New England Biolabs) and purified by Qiagen QiaQuik PCR purification kit according to manufacturer's protocol. Next, all constructs were cloned in pARZ-4, which identical to pARZ-cdLD plasmid except that cdLD gene is replaced with a staffer fragment. pARZ-4 backbone was amplified with the following primers: GibsV4Rev (GTATATCTCCTTCTTAAAGTTA) and GibsV3for (TGAGATCCGGCTGCTAACAAAGC) (SEQ ID NOS 17-18, respectively). Each PCR amplification reaction contained 30 pmol of each primer and 100 ng of DNA template. Amplifications were carried out using Pfu Ultra II Hotstart DNA polymerase (Agilent, cat#600850-51). The PCR reaction (20 μL) was initially heated at 95° C. for 2.5 min followed by 30 cycles of denaturation at 94° C. for 15 sec., annealing at 55° C. for 15 sec. and extension at 72° C. for 5 min. Following amplification, PCR fragment was gel-purified by the QIAGEN® gel-band purification kit according to manufacturer's protocol. 1 ul of the amplified vector (approximately 0.05 pmoles) was mixed with 4 μl (aper. 0.3 pmoles) of cdLD variant and 5 μl of 2× Gibson Assembly mix (New England Biolabs, cat# M5510AA) and incubated 1 h at 50° C. Following incubation, each mix was diluted with sterile water (4-fold) and transformed in XL1 Blue competent cells (Agilent) according to manufacturer's protocol. Transformed cells were plated on LB plates containing 25 μg/mL kanamycin and incubated overnight at 37° C. Next morning colonies were tested for the presence of the insert by colony PCR. Colonies were picked and resuspended in 20 ul of sterile 0.9% sodium chloride solution. One ul of this solution was transferred to the PCR tube and amplified with Taq polymerase (New England Biolabs, cat# M0482S) and 30 pmoles of primers P1 (ATAGGCGCCAGCAACCGCAC) and P2 (GCAGCAGCCAACTCAGCTTC) (SEQ ID NOS 19-20, respectively). Each PCR reaction (20 μL) was initially heated at 95° C. for 2.5 min followed by 30 cycles of denaturation at 94° C. for 15 sec., annealing at 55° C. for 15 sec. and extension at 72° C. for 1 min. Amplification products were visualized by agarose electrophoresis. Clones with the correct inserts were inoculated into the culture tubes containing 5 ml of LB and 25 μg/mL kanamycin and incubated overnight at 37° C. Next morning constructs were purified by Qiagen miniprep kit and transformed into BL21 (DE3) competent cells (purchased from Invitrogen). These cells were plated on LB plates containing 25 μg/mL kanamycin and incubated overnight at 37° C.

Figure 4:
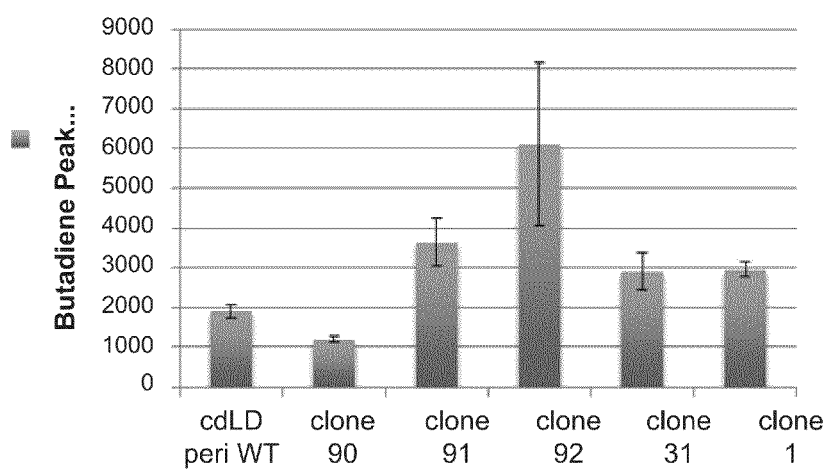
FIG. 4: Butadiene produced by selected periplasmic cdLD mutants obtained from stabilization design.

Each mutant was tested with the 1 ml butadiene assay (Example 3). Clones that produced butadiene at the levels comparable or higher than the wild type enzyme were regrown in several replicas and retested using the same 1 ml butadiene assay. The most interesting variants were retransformed into BL21 (DE3) cell to avoid potential influence of host somatic mutations and also retested in 1 ml butadiene assay. Some of the results are shown in FIG. 4. First, four clones showed a marked improvement in in vivo butadiene production over the WT peri-cdLD enzyme. These were clones 91 (V123I, V204I, M274F, V275I), 92 (V123I, V204I, M274F, V275I, F382W), clone 1 (A324L) and clone 31 (R360Y). Clone 90 (V123I, V204I, V275I) differed from clone 91 by only one mutation (M274F), yet did not show butadiene production improvement.

Figure 5:
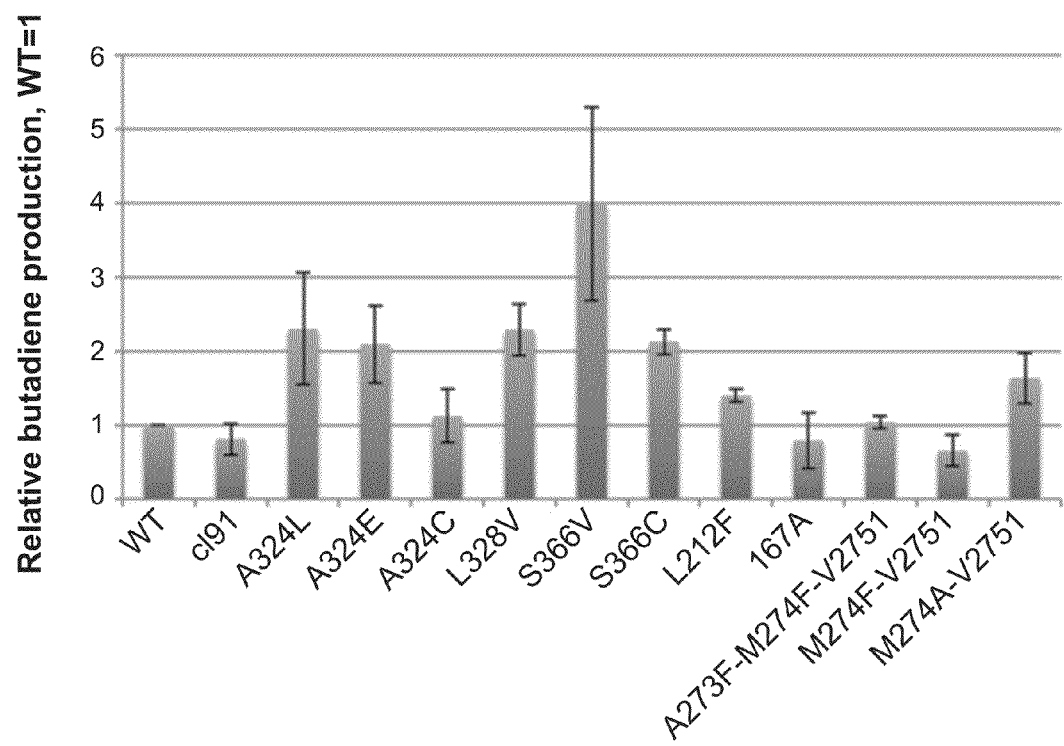
FIG. 5: Butadiene production by some mutants from the second set of site-saturation libraries.

An additional set of mutants was tested in the same assay. The results are show in FIG. 5. Mutant A324L, which was part of the above clone 1, is found again to have improved catalytic activity in this 1 mL butadiene assay. It was also found that the A324E mutation has similar activity. On the other hand, mutation A324C turned out to have no effect on butadiene production. Other mutants that had improved activity were: L328V, S366V, S366C and L212F. The highest improvement was achieved by mutant S366V.

Figure 6:
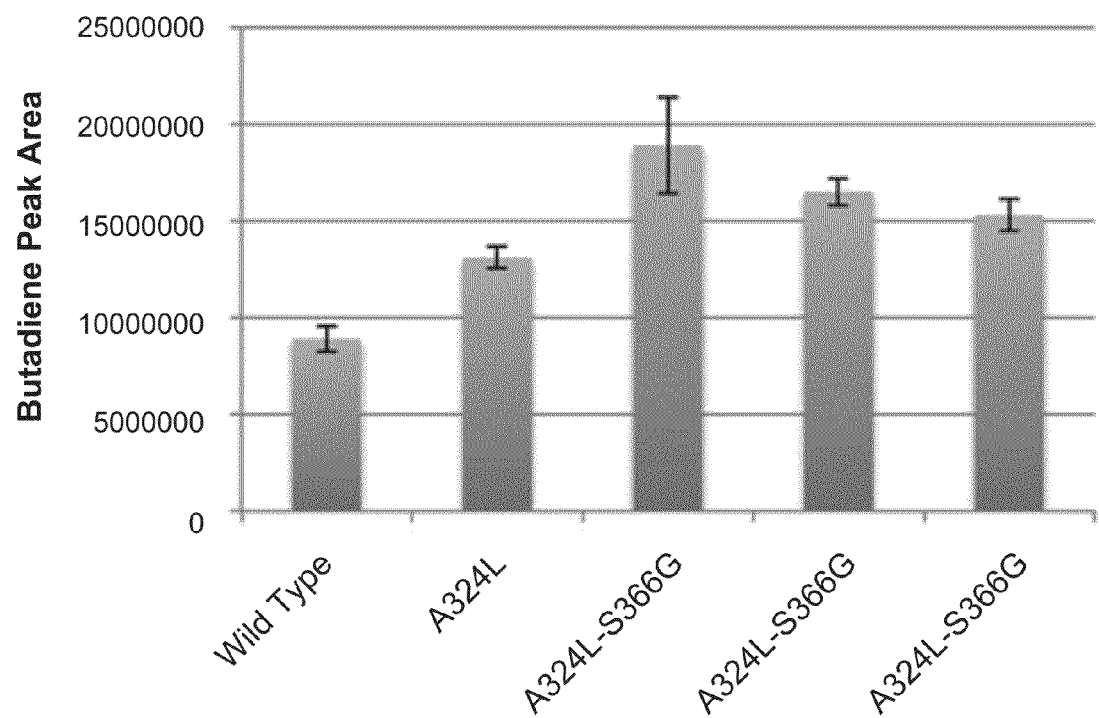
FIG. 6: Butadiene production by mutants built on top of A324L.
Figure 7:
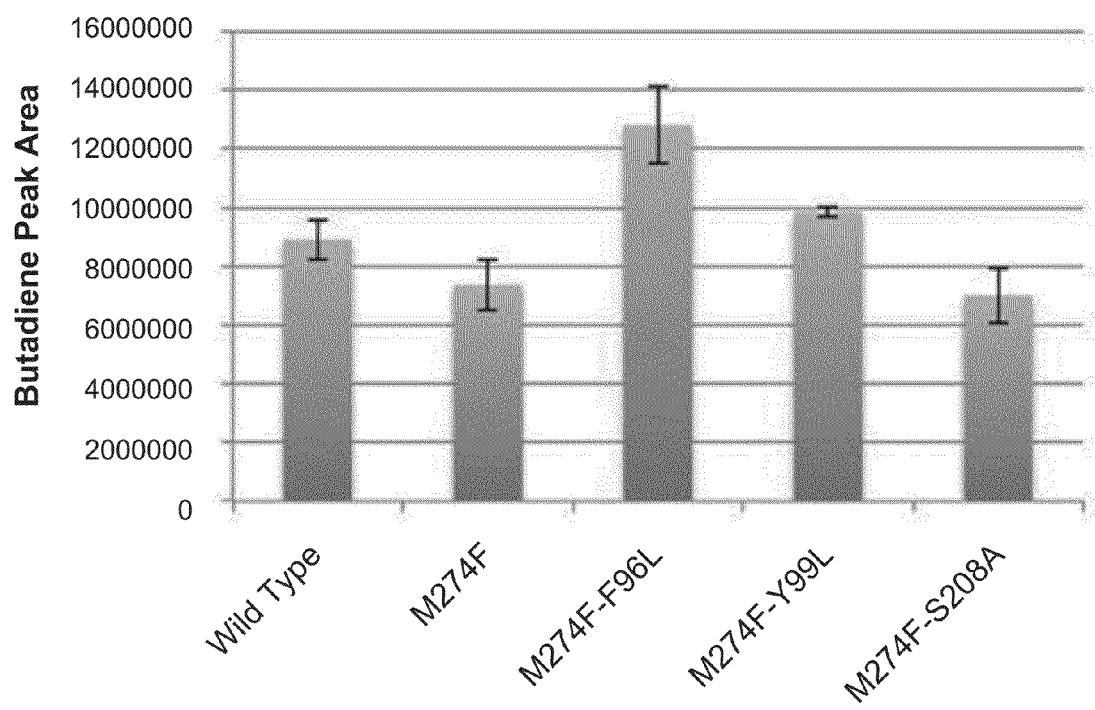
FIG. 7: Butadiene production by mutants built on top of M274F.
Figure 8:
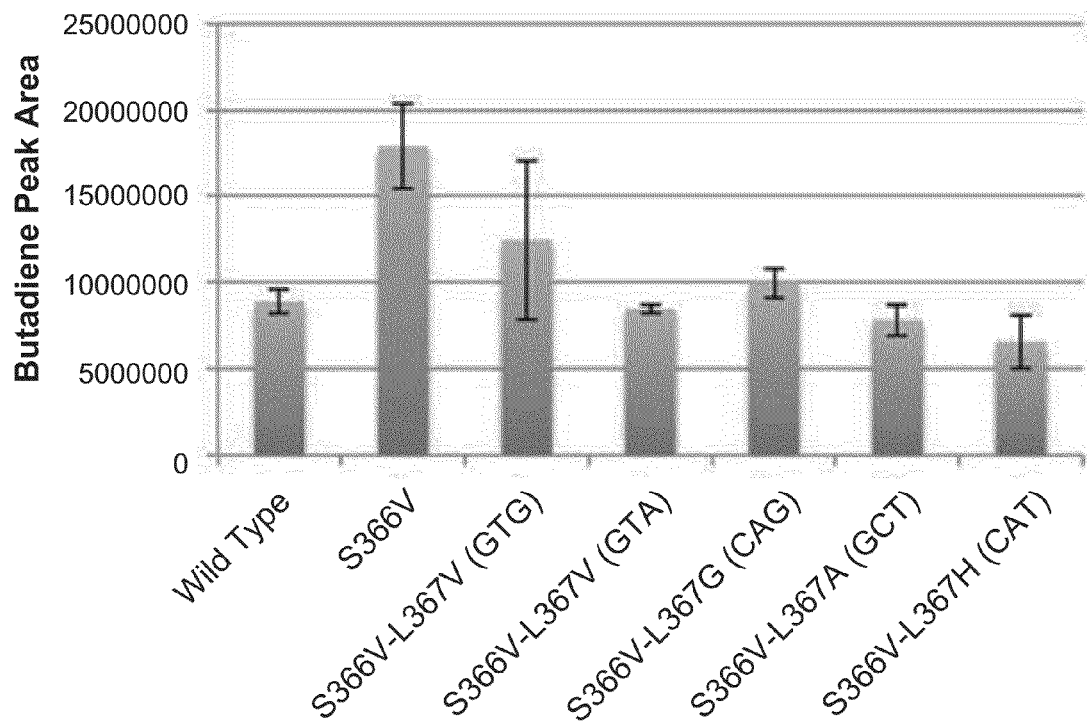
FIG. 8: Butadiene production by mutants built on top of S366V.
Figure 9:
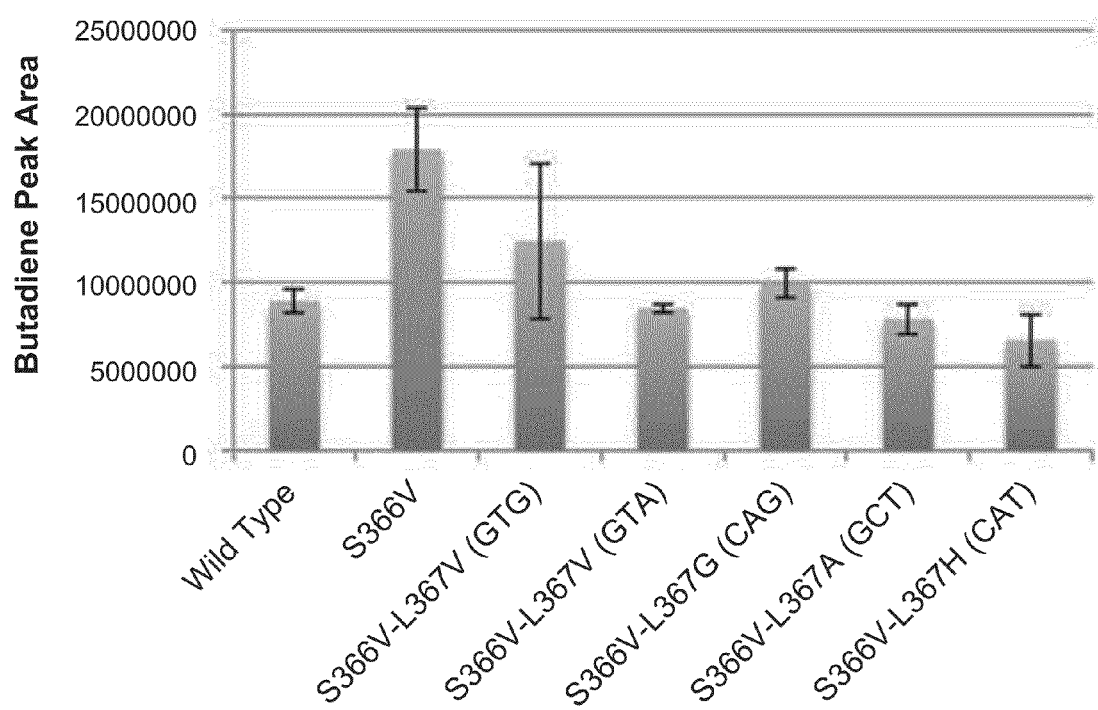
FIG. 9: Butadiene production by mutants built on top of V275I.
Figure 10:
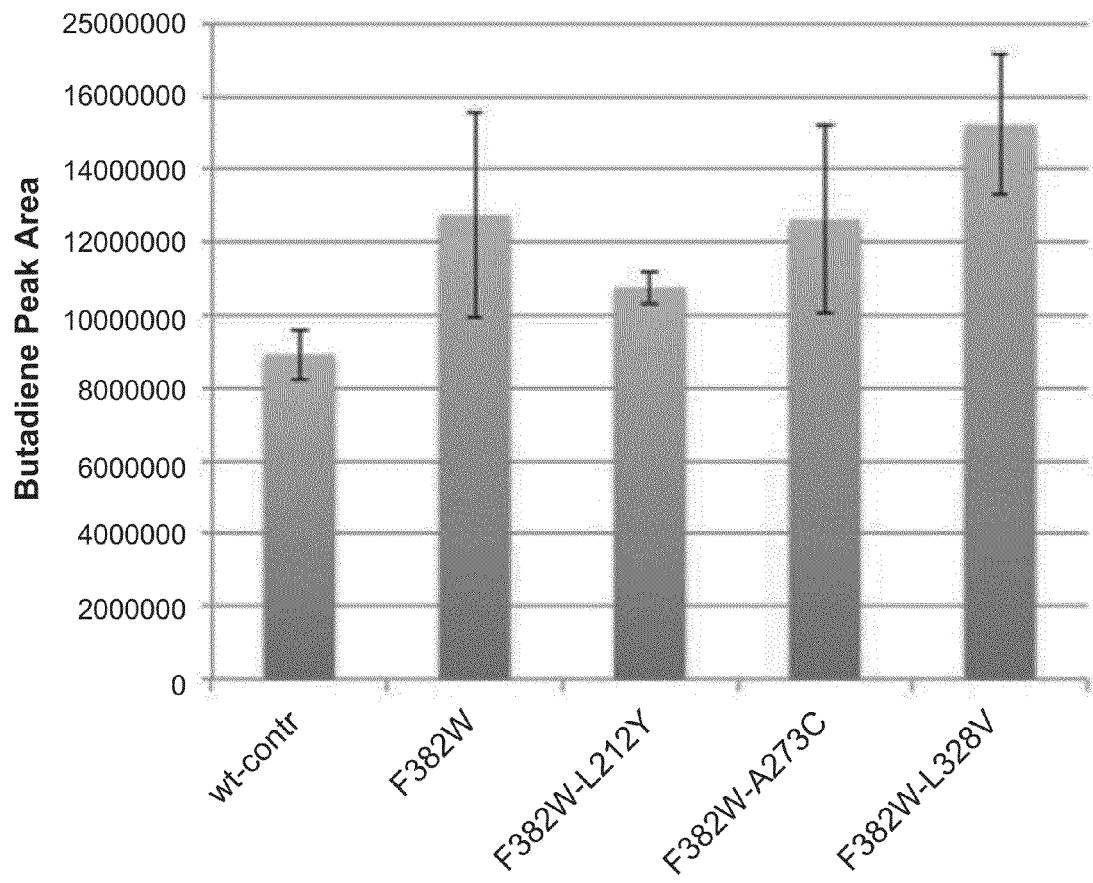
FIG. 10: Butadiene production by mutants built on top of F382W.

A number of additional mutations were introduced into each of these improved mutants to attempt to further augment their activity. The results are show in FIGS. 6-8. As can be seen in FIG. 6, three different clones with identical double mutations A324L and S366G showed improved butadiene production relative to their parent (A324L) and the wild type. The M274F mutant was a less efficient butadiene producer then the wild type. Addition of F96L (double mutant M274F and F96L) increased butadiene production (FIG. 7). Adding mutations to S366V (FIG. 8) and V275I (FIG. 9) did not improve butadiene production over the wild type level. Adding mutation L328V on top of F328W (double mutant F382W-L328V) seemed to improve butadiene production (FIG. 10).

b. Activity in Purified Samples

Figure 11:
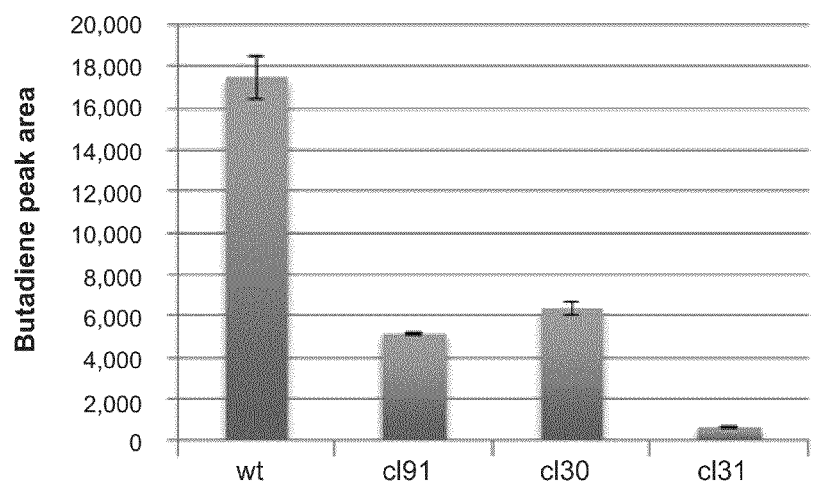
FIG. 11: Butadiene produced by certain purified periplasmic cdLD mutants.

Four variants of cdLD were purified with the standard His-tag purification procedure described in Example 2: WT, clone91, clone30 and clone31. Proteins were diluted to the same concentration. 250 μl of purified protein solution was transferred to a crimp vial along with 2.5 ul of 1.1M 3-buten-2-ol (final concentration of 11 mM), sealed and incubated at room temperature for 72 h. Following incubation samples were analyzed by Shimadzu GCMS-QP2010 Ultra with Agilent column HP PLOT/Q (0.32 mm, 15 m length, 20 um diameter) as described above for the 1 ml butadiene assay. Results are presented in FIG. 11. None of the variants showed an improvement in butadiene production when tested in this assay.

An alternative purification protocol was also used. From a fairly fresh LB plate containing the desired clone transformant, one colony (or small scratch) was picked to inoculate 10 to 50 mL of LB supplemented with the relevant antibiotic and the pre-culture was incubated overnight at 37° C., 230 rpm.

The following morning, prepare the TB auto-induce medium (Merck/Code product: 71491-5) by mixing 60 g TB/L supplemented with 10 mL Glycerol/L of TB and microwaved during 3+2 minutes at full power. Let the TB cool down under the hood before using it and splitting it in sterile flasks. Then, Spin down the pre-culture incubated overnight and discard the supernatant. Resuspend the preculture in 1 to 5 mL of freshly prepared TB medium and use it to inoculate 100 to 500 mL of TB dispensed in the sterile flasks, supplemented with the appropriate antibiotic. Incubate the flasks of inoculated flasks at 28-30° C. for at least 20 h, 230 rpm.

The main culture was centrifugated at least at 3000 g 20 min 4° C. and the pellets used immediately. The pellets were resuspended in 10 to 20 mL of Buffer A (=50 mM Tris+150 mM NaCl+40 mM Imidazole+5% Glycerol–pH 8.5).

The resuspended cells were then sonicated in ice for ≈5 min at 35-40% Amplitude with 5" ON and 15" OFF sonication pulse. The sonicated cells were centrifugated at least at 15500 g, 20 min at 4° C. The supernatant containing the soluble fraction of proteins was recovered and used for His-trap protein purification. The filtered soluble fraction of proteins obtained after extraction of proteins by sonication was used for His-tag protein purification. A 1 mL His-trap (GE Healthcare/Code product: 17-5319-01) column was equilibrated with 5-10 volumes column (VC) using Buffer A*. The soluble fraction of proteins was loaded onto the His-trap column manually using a syringe and 5-10 VC of Buffer A were used to wash the His-trap column. 5-10 VC of Buffer B were used to elute the His-tag protein directly to a 4 or 20 mL centrifugal filtration unit (VWR/Code product: 512-2850) with a relevant cut-off (5kD). The centrifugal unit was spinned at 3500 g/5° C. to a volume lower than 400 uL concentrate. Around 3 mL of Buffer C* was added to the concentrate and the centrifugal unit was again spinned at 3500 g/5° C. to a volume lower than 400 uL. This step was made to remove most of the imidazole used in Buffer B to elute the His-tag.

The concentrate was recovered and according to the working concentration (≈2 mg/mL), Buffer C was used to top-up to the desired volume. The concentration was checked using a Nanodrop spectrophotometer.

\* Buffer A=50 mM Tris+150 mM NaCl+40 mM Imidazole+5% (v/v) Glycerol–pH 8.5
\*\* Buffer B=Buffer A+400 mM Imidazole–pH8.5
\*\*\* Buffer C=Buffer A without Imidazole–pH8.5

The purified proteins were used for butadiene assay. A 1 mL reaction made of 2 mg/mL of each purified enzyme with 10 mM of 3-buten-2-ol or 3-methyl-3-buten-2-ol for the biosynthesis of 1,3-butadiene or isoprene respectively, was prepared in a 1.7 mL crimped glass vial. The vials were incubated at least 48 h at 30° C., 170 rpm. The butadiene and isoprene were analysed by head-space GC-MS using an authentic standard to set up a standard curve for quantification The results are shown in FIG. 12A. Mutants F382W/L328V; F382W/L328V/I187M; and A324L/S366G all showed improved activity in dehydration of 3-buten-2-ol to butadiene, relative to WT cdLD.

The same three mutants, purified the same way, were also tested for their ability to produce isoprene from 3-methyl-3-buten-2-ol.

A 1 mL reaction made of 2 mg/mL of each purified enzyme with 10 mM of 3-methyl-3-buten-2-ol for the biosynthesis of isoprene was prepared in a 1.7 mL crimped glass vial.

The vials were incubated at least 48 h at 30° C., 170 rpm. The isoprene was analyzed by head-space GC-MS using an authentic standard to set up a standard curve for quantification. The results are shown in FIG. 12B. Again, all mutants F382W/L328V; F382W/L328V/I187M; and A324L/S366G showed increase isoprene-production activity, relative to WT cdLD.

9. Further Characterization of the Activity of Clone 91 a. Study of the Effect of Individual Mutations in Clone 91

To analyze which of the mutations in clone 91 contribute to the increase in butadiene productions, each of the mutations was created individually in wild-type cdLD. Also, each mutation was individually removed from clone 91. The choice to focus on clone 91 was based on the fact that it was one of the clones that previously showed the highest level of activity. Mutagenesis was done by extension PCR. Mutations and corresponding primers are listed in Table 5 and FIG. 6. To create each mutant, two fragments were amplified. Left fragment was amplified by primers P1 (ATAGGCGCCAG-CAACCGCAC) (SEQ ID NO: 21) and the reverse primer shown in Table 5. The right fragment was amplified by the forward primer show in Table 6 and primer P2 (GCAG-CAGCCAACTCAGCTTC) (SEQ ID NO: 22). Each PCR amplification reaction contained 30 pmol of each primer and 100 ng of DNA template. Amplifications were carried out using Pfu Ultra H Hotstart DNA polymerase (Agilent, cat#600850-51). The PCR reaction (20 µL) was initially heated at 95° C. for 2.5 min followed by 30 cycles of denaturation at 94° C. for 15 sec., annealing at 55° C. for 15 sec. and extension at 72° C. for 1 min. Following amplification, PCR fragment was gel-purified by the QIAGEN® gel-band purification kit and mixed (50 ng of each fragment). These mixtures served as templates for the extension PCR by primers GibsV4ins-for (TTGTTTAACTTTAAGAAGGAGAT-TAC) and GibsV3ins-rev (GGCTTTGTTAGCAGCCG-GATCT) (SEQ ID NOS 23-24, respectively) to generate the full-length gene fragment. The PCR conditions were same as described above. The full-length DNA fragment was gel-purified by the QIAGEN® gel-band purification kit. Next 4 µl (appr. 0.3 pmoles) of the PCR fragment was mixed with 1 ul of the amplified cloning vector (approximately 0.05 pmoles) and 5 µl of 2× Gibson Assembly mix (New England Biolabs, cat# M5510AA) and incubated 1 h at 50° C. Following incubation, each mix was diluted with sterile water (4-fold) and transformed in XL1 Blue competent cells (Agilent) according to manufacturer's protocol. Transformed cells were plated on LB plates containing 50 µg/mL kanamycin and incubated overnight at 37° C. Next morning colonies were scraped from plate plasmid DNA was isolated using Qiagen Miniprep kit and transformed into BL21 (DE3) competent cells (Invitrogen). Transformations were plated on LB plates containing 25 µg/mL kanamycin and incubated overnight at 37° C. Resulting colonies were picked into 400 ul of LB media containing 50 µg/mL kanamycin in deep-well 96-well plates and used further in the 1 ml butadiene screen (see above). Clones that produced butadiene at the levels comparable or higher than the wild type enzyme were regrown in several replicas and retested using the same 1 ml butadiene assay (secondary screen).

TABLE 5

Sequences of the reverse primers (SEQ ID NOS 25-36, respectively, in order of appearance) used to create mutations to deconvolute clone 91

| Variant | Reverse primer | Reverse primer sequence |
|---|---|---|
| Removal of V123I from clone 91 | 123V-R | ACATTTCATTTTTGAGACTGCAATATCTAAGTCGTGG |
| Removal of V204I from clone 91 | 204V-R | AGAGTTGCATTGTACAAAATAGTTGTCTGGTTCACAAAC |

TABLE 5-continued

Sequences of the reverse primers (SEQ ID NOS 25-36, respectively, in order of appearance) used to create mutations to deconvolute clone 91

| Variant | Reverse primer | Reverse primer sequence |
|---|---|---|
| Removal of M274F from clone 91 | 274M-R | ATCCATTCCATGAATCATAGCTAACGTCCAAGCGGTTGT |
| Removal of V275I from clone 91 | 275I-R | GATCCATTCCATGCACGAAAGCTAACGTCCAAGCGGTTGT |
| M274F, V275I | 274F-275I-R | ATCCATTCCATGAATGAAAGCTAACGTCCAAGCGGTTGT |
| M274F | M274F-R | ATCCATTCCATGCACGAAAGCTAACGTCCAAGCGGTTGTA |
| V275I | V275I-R | GATCCATTCCATGAATCATAGCTAACGTCCAAGCGGTTGT |
| A324L | A324L-R | TAATAAAGTGTGAATAAAGAGGCTAAACCCACACCACC |
| R360Y | R360Y-R | GCCTGGGTGTTCGTAnGTAnGAGGCTAGCAGAAACGATGCTT |
| F382W | F382W-R | GTAACAGAGCACCCCATCCGGCATGTACTTTGGCAAG |
| V123I | V123I-R | ACATTTCATTTTTGAAATTGCAATATCTAAGTCGTGG |
| V204I | V204I-R | CAGAGTTGCATTGAATAAAATAGTTGTCTGGTTCACAAAC |

TABLE 6

Sequences of the forward primers (SEQ ID NOS 37-48, respectively, in order of appearance) used to create mutations to deconvolute clone 9.

| Variant | Forward primer | Forward primer sequence |
|---|---|---|
| Removal of V123I from clone 91 | 123V-F | TTAGATATTGCAGTCTCAAAAATGAAATGTAAACGTGTATG |
| Removal of V204I from clone 91 | 204V-F | GACAACTATTTTGTACAATGCAACTCTGTGGCCTATTT |
| Removal of M274F from clone 91 | 274M-F | TGGACGTTAGCTATGATTCATGGAATGGATCCTGCCTTTTC |
| Removal of V275I from clone 91 | 275I-F | TGGACGTTAGCTTTCGTGCATGGAATGGATCCTGCCTTTTC |
| M274F, V275I | 274F-275I-F | TGGACGTTAGCTTTCATTCATGGAATGGATCCTGCCTTTTC |
| M274F | M274F-F | GCTTGGACGTTAGCTTTCGTGCATGGAATGGATCCTGCCTT |
| V275I | V275I-F | ACGTTAGCTATGATTCATGGAATGGATCCTGCCTTTTC |
| A324L | A324L-F | GTGGGTTTAGCCTCTTTATTCACACTTTTATTAGCCCGCGAAA |
| R360Y | R360Y-F | GTTTCTGCTAGCCTCTACTACGAACACCCAGGCAGCCT |
| F382W | F382W-F | CAAAGTACATGCCGGATGGGGTGCTCTGTTACGTATGC |
| V123I | V123I-F | TTAGATATTGCAATTTCAAAAATGAAATGTAAACGTGTATG |
| V204I | V204I-F | GACAACTATTTATTCAATGCAACTCTGTGGCCTATTT |

A summary of the screening results are shown in Table 7. Several variants showed improved butadiene production. They had following combination of mutations: V123I/V204I/M274F; M274F/V275I/F382W; V275I/A324L; V275I; V123I; and V204I.

TABLE 7

Relative butadiene production by periplasmic variants of cdLD.

| Variant | Mutants | Relative Butadiene production (WT = 1) | Standard Deviation |
|---|---|---|---|
| 1 | V204I, M274F, V275I | 1.08 | 0.03 |
| 2 | V123I, M274F, V275I | 0.74 | |
| 3 | V123I, V204I, V275I | 0.89 | 0.17 |
| 4 | V123I, V204I, M274F | 1.265 | 0.01 |
| 5 | M274F, V275I | 0.45 | 0.11 |
| 6 | M274F, A324L | 0.55 | |
| 7 | M274F, R360Y | 0.67 | |
| 9 | M274F, V275I, A324L | 0.815 | 0.3 |
| 11 | M274F, V275I, F382W | 1.705 | 0.64 |
| 13 | M274F, A324L, F382W | 0.725 | 0.5 |
| 17 | M274F, V275I, R360Y, F382W | 0.905 | 0.42 |
| 21 | V275I, A324L | 1.66 | 0.34 |
| 23 | V275I, F382W | 0.84 | 0.07 |
| 24 | V275I, A324L, R360Y | 0.65 | 0.06 |
| 25 | V275I, A324, F382W | 0.635 | 0.25 |
| 31 | R360Y, F382W | 1.235 | 0.47 |
| 32 | M274F | 0.675 | 0.01 |
| 33 | V275I | 2.135 | 0.33 |
| 34 | A324L | 1.64 | 0.04 |
| 35 | R360Y | 1.925 | 0.02 |
| 36 | F382W | 0.72 | 0.1 |
| 37 | V123I | 1.925 | 0.6 |
| 38 | V204I | 1.55 | 0.07 |
| WT | WT cdLD | 1 | 0 |
| clone 91 | clone 91 | 1.425 | 0.15 | b. Combinatorial Mutagenesis

A number of mutants were created combining two or more of the improving mutations set forth in the previous sections. More specifically, several mutations were imposed on top of the following background mutants: A324L, S366V, A324L-S366G, M274-F96L, and F382W-L328V.

Figure 13:
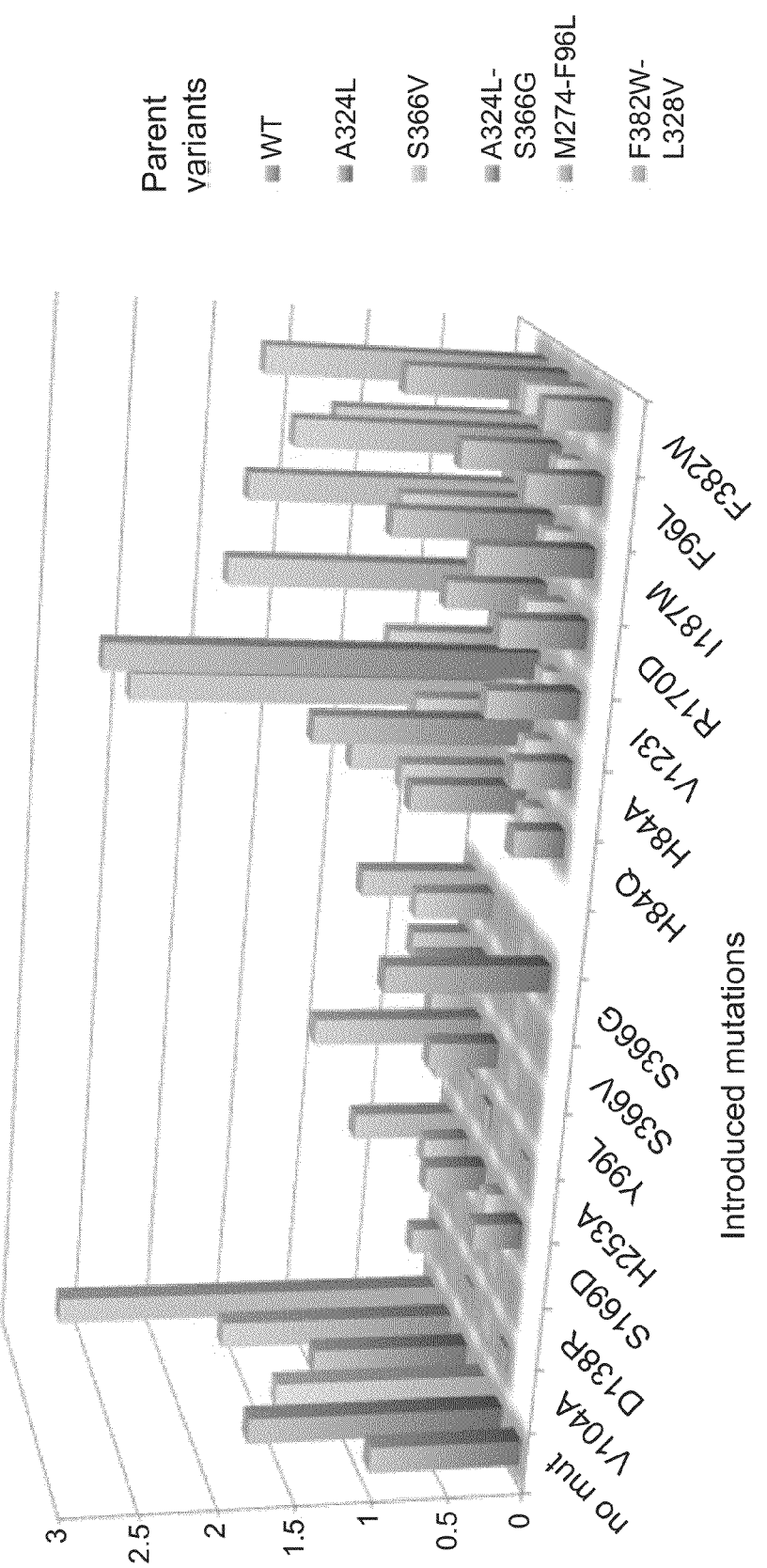
FIG. 13: Relative butadiene production by combinatorial mutants (1 ml assay).
Figure 14:
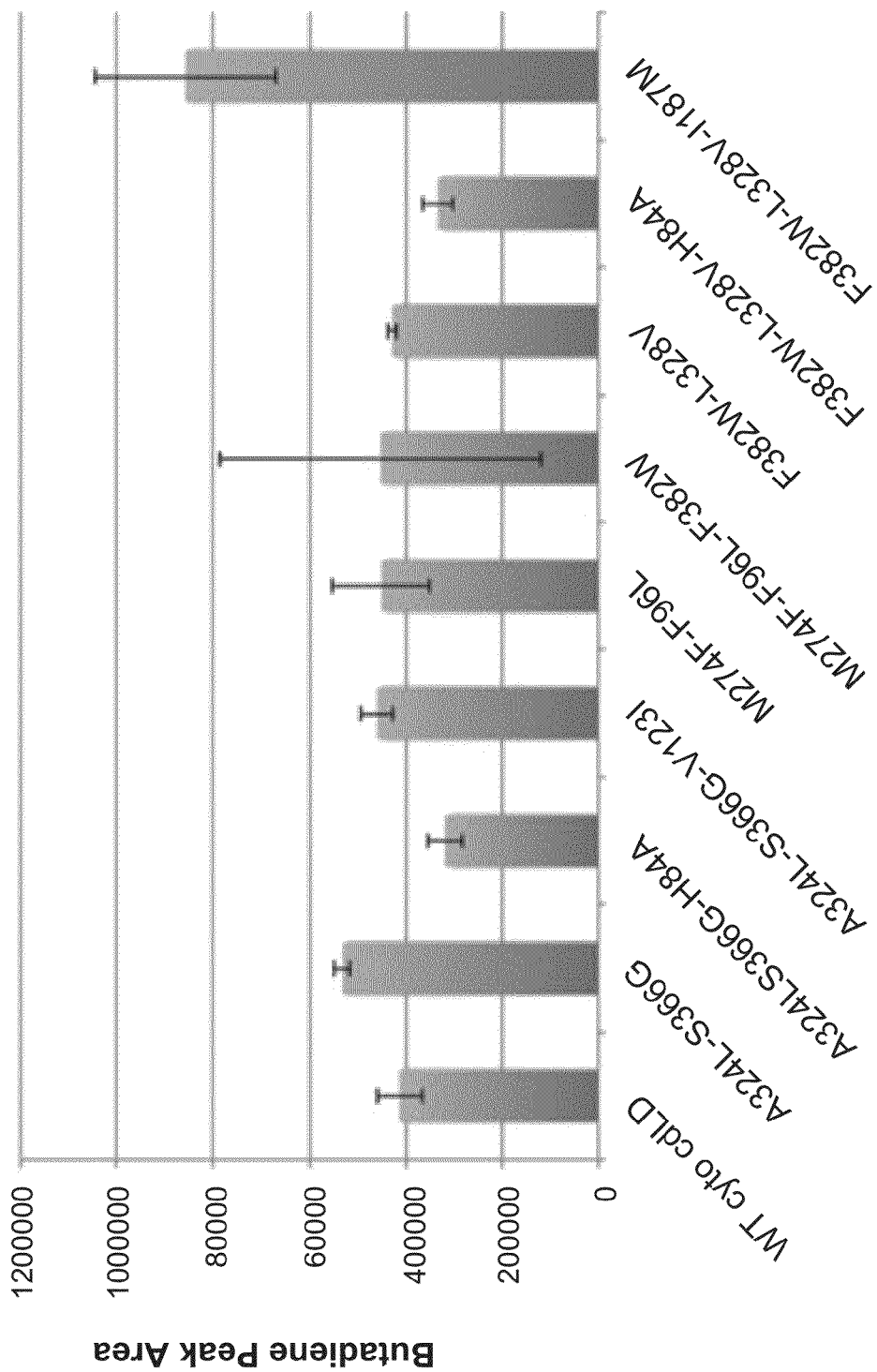
FIG. 14: Relative butadiene production by combinatorial mutants (1 ml assay).

Clones that produced butadiene at the levels comparable or higher than the wild type enzyme were regrown in several replicas and retested using the same 1 ml butadiene assay (secondary screen). Results of the assay of these clones are shown in FIG. 13. Addition of most tested mutations to A324L or S366V were not found to improve cdLD activity. Many of the variants showed no butadiene production. Therefore, it was assumed that these mutations have low combinatorial potential, Combining mutations together (A324L and S366V) generated a variant with no activity. At the same time adding mutations on top of combination of A324L and S366G generated several combinations that showed signs of improvement (addition of H84A and V123I). Adding mutations R170D F96L and F382W on top of combination of M274-F96L and mutation I187M on top of combination F382W-L328V also seemed to improve butadiene production in the 1 mL assay. These variants were retested in the secondary screen (FIG. 14) and only two variants appeared to exhibit higher butadiene production than wild type cdLD: combination of A324L, S366G and of F382W, L328V, I187M.

Figure 15:
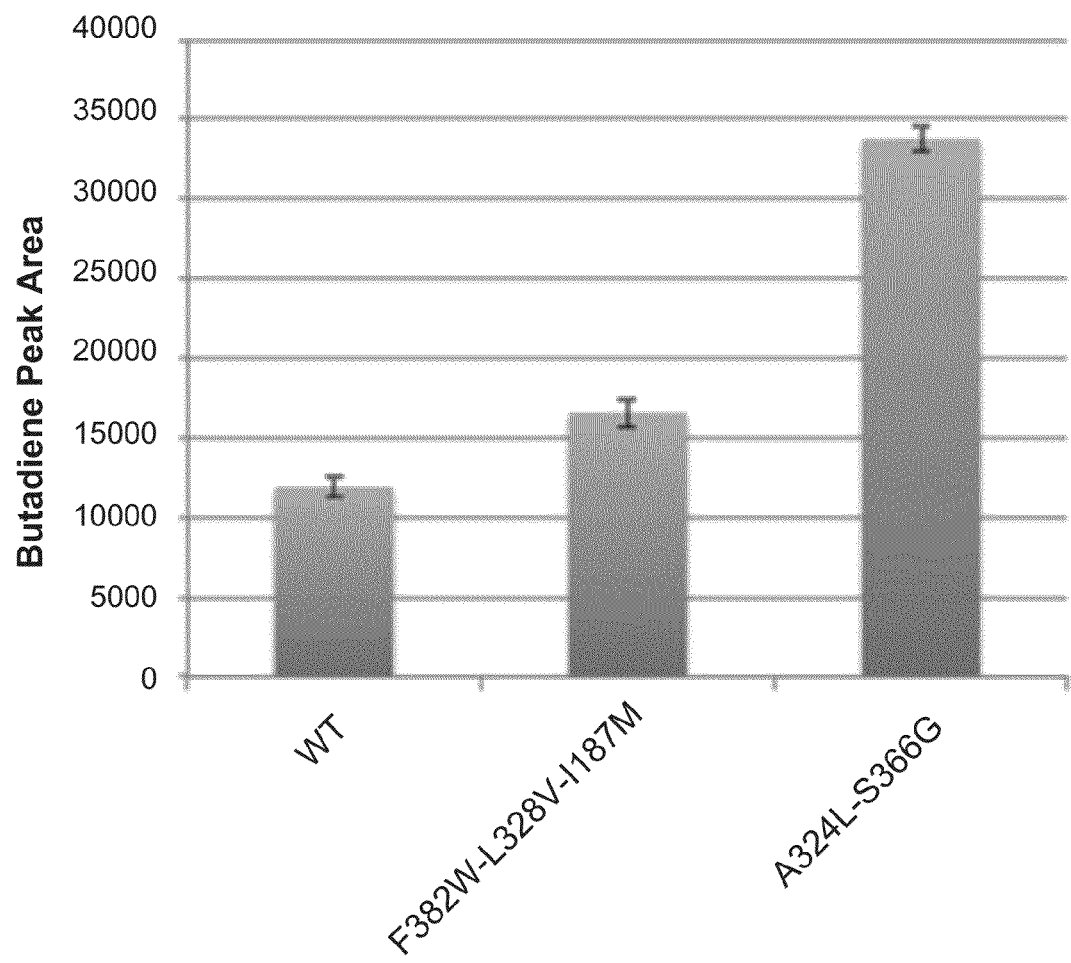
FIG. 15: Butadiene assay with purified cyto-cdLD mutants. Only two clones that showed significant improvement in specific activity over WT cdLD are shown.

Some of these mutants were purified as described in Example 2 and re-tested to establish whether their specific activity was higher than that of cdLD. Purified proteins were diluted to the same concentration. 250 ul of purified protein solution was transferred to a crimp vial along with 2.5 ul of 1.1M 3-buten-2-ol (final concentration of 11 mM), sealed and incubated at room temperature for 72 h. Following incubation samples were analyzed by Shimadzu GCMS-QP2010 Ultra with Agilent column HP PLOT/Q (0.32 mm, 15 m length, 20 um diameter) as before for the 1 ml butadiene assay. Results are presented in FIG. 15. Both variants (combination of A324L, S366G and of F382W, L328V, I187M) produce more butadiene then WT cdLD, with up to 3× the amount of butadiene produced for the A324L, S366G variant.

10. Sequences of the Polypeptides Described Herein.

TABLE 8

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
| Periplasmic cdLD | |
| Wild Type | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
| V123I, V204I, V275I, | ATGATGCGTTTCACATTAAAGACCACCGCGATTGTTTCTGCCGCCGCGTTATTAGCGG GTTTTGGACCACCACCTCGTGCAGCAGAATTACCTCCCGGCCGCCTTGCCACAACCG AAGATTATTTCGCACAACAAGCAAAACAAGCTGTAACCCCGGATGTTATGGCTCAACT CGCGTACATGAACTATATTGATTTCATTAGCCCCTTTTATTCACGTGGATGTTCATTCG AAGCATGGGAATTGAAACACACTCCGCAGCGCGTGATTAAATACTCCATTGCATTCTA TGCTTATGGCTTGGCATCTGTAGCATTAATCGACCCTAAACTGCGCGCGCTCGCCGG CCACGACTTAGATATTGCAATTTCAAAAATGAAATGTAAACGTGTATGGGGAGATTGG GAAGAAGATGGTTTTGGTACAGATCCGATTGAAAAAGAAAACATTATGTATAAAGGACA TCTGAACCTTATGTATGGTCTTTATCAACTTGTTACTGGATCGCGCCGTTACGAAGCTG AACACGCTCACCTCACCCGTATTATCCACGACGAAATTGCCGCCAACCCATTCGCCGG AATCGTTTGTGAACCAGACAACTATTTTATTCAATGCAACTCTGTGGCCTATTTAAGCC TTTGGGTCTACGATCGTTTACATGGAACTGACTACCGTGCCGCAACTCGTGCCTGGCT GGATTTTATTCAAAAAGATCTGATTGACCCCGAACGTGGAGCTTTCTATTTGTCCTATC ATCCCGAATCTGGTGCCGTCAAACCTTGGATCAGCGCATATACAACCGCTTGGACGTT AGCTATGATTCATGGAATGGATCCTGCCTTTTCAGAACGTTATTATCCTCGTTTTAAAC AAACGTTCGTCGAAGTCTATGATGAAGGCCGTAAAGCCCGCGTACGCGAAACTGCCG GAACCGACGACGCCGATGGTGGTGTGGGTTTAGCCTCTGCGTTCACACTTTTATTAGC CCGCGAAATGGGAGATCAACAACTCTTTGACCAACTGCTGAATCATTTAGAACCCCCT GCCAAACCAAGCATCGTTTCTGCTAGCCTCCGCTACGAACACCCAGGCAGCCTCTTAT TCGACGAACTGTTATTTCTTGCCAAAGTACATGCCGGATTTGGTGCTCTGTTACGTATG CCCCCTCCTGCCGCCAAATTAGCGGGCAAAGGCAGCCTCGAGCATCATCATCATCAT CACTGA |
| V123I, V204I, M274F, V275I, | ATGATGCGTTTCACATTAAAGACCACCGCGATTGTTTCTGCCGCCGCGTTATTAGCGG GTTTTGGACCACCACCTCGTGCAGCAGAATTACCTCCCGGCCGCCTTGCCACAACCG AAGATTATTTCGCACAACAAGCAAAACAAGCTGTAACCCCGGATGTTATGGCTCAACT CGCGTACATGAACTATATTGATTTCATTAGCCCCTTTTATTCACGTGGATGTTCATTCG AAGCATGGGAATTGAAACACACTCCGCAGCGCGTGATTAAATACTCCATTGCATTCTA TGCTTATGGCTTGGCATCTGTAGCATTAATCGACCCTAAACTGCGCGCGCTCGCCGG CCACGACTTAGATATTGCAATTTCAAAAATGAAATGTAAACGTGTATGGGGAGATTGG GAAGAAGATGGTTTTGGTACAGATCCGATTGAAAAAGAAAACATTATGTATAAAGGACA TCTGAACCTTATGTATGGTCTTTATCAACTTGTTACTGGATCGCGCCGTTACGAAGCTG AACACGCTCACCTCACCCGTATTATCCACGACGAAATTGCCGCCAACCCATTCGCCGG AATCGTTTGTGAACCAGACAACTATTTTATTCAATGCAACTCTGTGGCCTATTTAAGCC TTTGGGTCTACGATCGTTTACATGGAACTGACTACCGTGCCGCAACTCGTGCCTGGCT GGATTTTATTCAAAAAGATCTGATTGACCCCGAACGTGGAGCTTTCTATTTGTCCTATC ATCCCGAATCTGGTGCCGTCAAACCTTGGATCAGCGCATATACAACCGCTTGGACGTT AGCTTTCATTCATGGAATGGATCCTGCCTTTTCAGAACGTTATTATCCTCGTTTTAAACA AACGTTCGTCGAAGTCTATGATGAAGGCCGTAAAGCCCGCGTACGCGAAACTGCCGG AACCGACGACGCCGATGGTGGTGTGGGTTTAGCCTCTGCGTTCACACTTTTATTAGCC CGCGAAATGGGAGATCAACAACTCTTTGACCAACTGCTGAATCATTTAGAACCCCCTG CCAAACCAAGCATCGTTTCTGCTAGCCTCCGCTACGAACACCCAGGCAGCCTCTTATT CGACGAACTGTTATTTCTTGCCAAAGTACATGCCGGATTTGGTGCTCTGTTACGTATG CCCCCTCCTGCCGCCAAATTAGCGGGCAAAGGCAGCCTCGAGCATCATCATCATCAT CACTGA |
| V123I, V204I, M274F, V275I, A324L, F382W | ATGATGCGTTTCACATTAAAGACCACCGCGATTGTTTCTGCCGCCGCGTTATTAGCGG GTTTTGGACCACCACCTCGTGCAGGAGAATTACCTCCCGGCCGCCTTGCCACAACCG AAGATTATTTCGCACAACAAGGAAAACAAGCTGTAACCGCGGATGTTATGGCTCAACT CGCGTACATGAACTATATTGATTTCATTAGGCCCTTTTATTCACGTGGATGTTCATTCG AAGCATGGGAATTGAAACACACTCCGCAGCGCGTGATTAAATACTCCATTGCATTCTA TGCTTATGGCTTGGCATCTGTAGCATTAATCGACCCTAAACTGCGCGCGCTCGCCGG CCACGACTTAGATATTGCAATCTCAAAAATGAAATGTAAACGTGTATGGGGAGATTGG GAAGAAGATGGTTTTGGTAGAGATCCGATTGAAAAAGAAAACATTATGTATAAAGGACA TCTGAACCTTATGTATGGTCTTTATCAACTTGTTACTGGATCGCGCCGTTACGAAGCTG AACACGCTCACCTCACCCGTATTATCCACGACGAAATTGCCGCCAACCCATTCGCCGG AATCGTTTGTGAACCAGACAACTATTTTATTCAATGCAACTCTGTGGCCTATTTAAGCC TTTGGGTCTACGATCGTTTACATGGAACTGACTACCGTGCCGCAACTCGTGCCTGGCT GGATTTTATTCAAAAAGATCTGATTGACCCCGAACGTGGAGCTTTCTATTTGTCCTATC ATCCCGAATCTGGTGCCGTCAAACCTTGGATCAGCGCATATACAACCGCTTGGACGTT AGCTTTTATTCATGGAATGGATCCTGCCTTTTCAGAACGTTATTATCCTCGTTTTAAACA AACGTTCGTCGAAGTCTATGATGAAGGCCGTAAAGCCCGCGTACGCGAAACTGCCGG AACCGACGACGCCGATGGTGGTGTGGGTTTAGCCTCTTTGTCACACTTTTATTAGCC CGCGAAATGGGAGATCAACAACTCTTTGACCAACTGCTGAATCATTTAGAACCCCCTG CCAAACCAAGCATCGTTTCTGCTAGCCTCCGCTACGAACACCCAGGCAGCCTCTTATT CGACGAACTGTTATTTCTTGCCAAAGTACATGCCGGATGGGTGCTCTGTTACGTATG CCCCCTCCTGCCGCCAAATTAGCGGGCAAAGGCAGCCTCGAGCATCATCATCATCAT CACTGA |
| A324L | atgATGCGTTTCACATTAAAGACGACCGCGATTGTTGTGGCGCCGCGTTATTAGCGGG TTTTGGACCACCACCTCGTGCAGCAGAATTACCTCCCGGCCGCGTTGCGACAACCGA AGATTATTTCGCACAACAAGCAAAACAAGCTGTAACCCGGGATGTTATGGCTCAACTC GCGTACATGAACTATATTGATTTCATTAGCCCCTTTTATTCACGTGGATGTTCATTCGA |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
|  | AGCATGGGAATTGAAAGACACTCCGGAGCGCGTGATTAAATACTCCATTGCATTCTAT<br>GCTTATGGCTTGGCATCTGTAGCATTAATCGACCGTAAACTGCGCGGGCTCGCCGGC<br>CACGACTTAGATATTGGAGTCTCAAAAATGAAATGTAAAGGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTGACGCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTTTATTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| R360Y | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCTACTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| V204I,<br>M274F,<br>V275I, | ATGATGCGTTTCACATTAAAGACCACCGCGATTGTTTCTGCCGCCGCGTTATTAGCGG<br>GTTTTGGACCACCACCTCGTGCAGCAGAATTACCTCCCGGCCGCCTTGCCACAACCG<br>AAGATTATTTCGCACAACAAGCAAAACAAGCTGTAACCCCGGATGTTATGGCTCAACT<br>CGCGTACATGAACTATATTGATTTCATTAGCCCCTTTTATTCACGTGGATGTTCATTCG<br>AAGCATGGGAATTGAAACACACTCCGCAGCGCGTGATTAAATACTCCATTGCATTCTA<br>TGCTTATGGCTTGGCATCTGTAGCATTAATCGACCCTAAACTGCGCGCGCTCGCCGG<br>CCACGACTTAGATATTGCAGTCTCAAAAATGAAATGTAAACGTGTATGGGGAGATTGG<br>GAAGAAGATGGTTTTGGTACAGATCCGATTGAAAAGAAAACATTATGTATAAAGGACA<br>TCTGAACCTTATGTATGGTCTTTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTATTCAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTTTCATTCATGGAATGGATCCTGCCTTTTCAGAACGTTATTATCCTCGTTTTAAACA<br>AACGTTCGTCGAAGTCTATGATGAAGGCCGTAAAGCCCGCGTACGCGAAACTGCCG<br>AACCGACGACGCCGATGGTGGTGTGGGTTTAGCCTCTGCGTTCACACTTTTATTAGCC<br>CGCGAAATGGGAGATCAACAACTCTTTGACCAACTGCTGAATCATTTAGAACCCCCTG<br>CCAAACCAAGCATCGTTTCTGCTAGCCTCCGCTACGAACACCCAGGCAGCCTCTTATT<br>CGACGAACTGTTATTTCTTGCCAAAGTACATGCCGGATTTGGTGCTCTGTTACGTATG<br>CCCCCTCCTGCCGCCAAATTAGCGGGCAAAGGCAGCCTCGAGCATCATCATCATCAT<br>CACTGA |
| V123I,<br>M274F,<br>V275I, | ATGATGCGTTTCACATTAAAGACCACCGCGATTGTTTCTGCCGCCGCGTTATTAGCGG<br>GTTTTGGACCACCACCTCGTGCAGCAGAATTACCTCCCGGCCGCCTTGCCACAACCG<br>AAGATTATTTCGCACAACAAGCAAAACAAGCTGTAACCCCGGATGTTATGGCTCAACT<br>CGCGTACATGAACTATATTGATTTCATTAGCCCCTTTTATTCACGTGGATGTTCATTCG<br>AAGCATGGGAATTGAAACACACTCCGCAGCGCGTGATTAAATACTCCATTGCATTCTA<br>TGCTTATGGCTTGGCATCTGTAGCATTAATCGACCCTAAACTGCGCGCGCTCGCCGG<br>CCACGACTTAGATATTGCAATTTCAAAAATGAAATGTAAACGTGTATGGGGAGATTGG<br>GAAGAAGATGGTTTTGGTACAGATCCGATTGAAAAGAAAACATTATGTATAAAGGACA<br>TCTGAACCTTATGTATGGTCTTTATCAACTTGTTACTGGATCGCGCCGTTACGAAGCTG<br>AACACGCTCACCTCACCCGTATTATCCACGACGAAATTGCCGCCAACCCATTCGCCGG |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
| | AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTTTCATTCATGGAATGGATCCTGCCTTTTCAGAACGTTATTATCCTCGTTTTAAACA<br>AACGTTCGTCGAAGTCTATGATGAAGGCCGTAAAGCCCGCGTACGCGAAACTGCCGG<br>AACCGACGACGCCGATGGTGGTGTGGGTTTAGCCTCTGCGTTCACACTTTTATTAGCC<br>CGCGAAATGGGAGATCAACAACTCTTTGACCAACTGCTGAATCATTTAGAACCCCCTG<br>CCAAACCAAGCATCGTTTCTGCTAGCCTCCGCTACGAACACCCAGGCAGCCTCTTATT<br>CGACGAACTGTTATTTCTTGCCAAAGTACATGCCGGATTTGGTGCTCTGTTACGTATG<br>CCCCCTCCTGCCGCCAAATTAGCGGGCAAAGGCAGCCTCGAGCATCATCATCATCAT<br>CACTGA |
| V123I,<br>V204I,<br>V275I, | ATGATGCGTTTCACATTAAAGACCACCGCGATTGTTTCTGCCGCCGCGTTATTAGCGG<br>GTTTTGGACCACCACCTCGTGCAGCAGAATTACCTCCCGGCCGCCTTGCCACAACCG<br>AAGATTATTTCGCACAACAAGCAAAACAAGCTGTAACCCCGGATGTTATGGCTCAACT<br>CGCGTACATGAACTATATTGATTTCATTAGCCCCTTTTATTCACGTGGATGTTCATTCG<br>AAGCATGGGAATTGAAACACACTCCGCAGCGCGTGATTAAATACTCCATTGCATTCTA<br>TGCTTATGGCTTGGCATCTGTAGCATTAATCGACCCTAAACTGCGCGCGCTCGCCGG<br>CCACGACTTAGATATTGCAATTTCAAAAATGAAATGTAAACGTGTATGGGGAGATTGG<br>GAAGAAGATGGTTTTGGTACAGATCCGATTGAAAAAGAAAACATTATGTATAAAGGACA<br>TCTGAACCTTATGTATGGTCTTTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTATTCAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGATTCATGGAATGGATCCTGCCTTTTCAGAACGTTATTATCCTCGTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGCAGCCTCGAGCATCATCATCATCAT<br>CACTGA |
| V123I,<br>V204I,<br>M274F, | ATGATGCGTTTCACATTAAAGACCACCGCGATTGTTTCTGCCGCCGCGTTATTAGCGG<br>GTTTTGGACCACCACCTCGTGCAGCAGAATTACCTCCCGGCCGCCTTGCCACAACCG<br>AAGATTATTTCGCACAACAAGCAAAACAAGCTGTAACCCCGGATGTTATGGCTCAACT<br>CGCGTACATGAACTATATTGATTTCATTAGCCCCTTTTATTCACGTGGATGTTCATTCG<br>AAGCATGGGAATTGAAACACACTCCGCAGCGCGTGATTAAATACTCCATTGCATTCTA<br>TGCTTATGGCTTGGCATCTGTAGCATTAATCGACCCTAAACTGCGCGCGCTCGCCGG<br>CCACGACTTAGATATTGCAATTTCAAAAATGAAATGTAAACGTGTATGGGGAGATTGG<br>GAAGAAGATGGTTTTGGTACAGATCCGATTGAAAAAGAAAACATTATGTATAAAGGACA<br>TCTGAACCTTATGTATGGTCTTTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTATTCAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTTTCGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGCAGCCTCGAGCATCATCATCATCAT<br>CACTGA |
| M274F,<br>V275I,<br>F382W | ATGATGCGTTTCACATTAAAGACCACCGCGATTGTTTCTGCCGCCGCGTTATTAGCGG<br>GTTTTGGACCACCACCTCGTGCAGCAGAATTACCTCCCGGCCGCCTTGCCACAACCG<br>AAGATTATTTCGCACAACAAGCAAAACAAGCTGTAACCCCGGATGTTATGGCTCAACT<br>CGCGTACATGAACTATATTGATTTCATTAGCCCCTTTTATTCACGTGGATGTTCATTCG<br>AAGCATGGGAATTGAAACACACTCCGCAGCGCGTGATTAAATACTCCATTGCATTCTA<br>TGCTTATGGCTTGGCATCTGTAGCATTAATCGACCCTAAACTGCGCGCGCTCGCCGG<br>CCACGACTTAGATATTGCAGTCTCAAAAATGAAATGTAAACGTGTATGGGGAGATTGG<br>GAAGAAGATGGTTTTGGTACAGATCCGATTGAAAAAGAAAACATTATGTATAAAGGACA<br>TCTGAACCTTATGTATGGTCTTTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
|  | AGCTTTCATTCATGGAATGGATCCTGCCTTTTCAGAACGTTATTATCCTCGTTTTAAACA<br>AACGTTCGTCGAAGTCTATGATGAAGGCCGTAAAGCCCGCGTACGCGAAACTGCCGG<br>AACCGACGACGCCGATGGTGGTGTGGGTTTAGCCTCTGCGTTCACACTTTTATTAGCC<br>CGCGAAATGGGAGATCAACAACTCTTTGACCAACTGCTGAATCATTTAGAACCCCCTG<br>CCAAACCAAGCATCGTTTCTGCTAGCCTCCGCTACGAACACCCAGGCAGCCTCTTATT<br>CGACGAACTGTTATTTCTTGCCAAAGTACATGCCGGATGGGGTGCTCTGTTACGTATG<br>CCCCCTCCTGCCGCCAAATTAGCGGGCAAAGGCAGCCTCGAGCATCATCATCATCAT<br>CACTGA |
| V275I,<br>A324L | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGATTCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTTTATTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgaggaccaccaccaccactga |
| M274F | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTTTCGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| V275I | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGATTCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT |

TABLE 8-continued

Nucleotide sequences of the cdLD variants constructed and described
in the text (SEQ ID NOS 49-86, respectively, in order of appearance).
NUCLEOTIDE AND AMINO-ACID SEQUENCES OF THE CDLD
VARIANTS CONSTRUCTED

| Mutations | Nucleotide Sequence |
|---|---|
| | GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| A324L | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTTTATTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| R360Y | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCTACTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| F382W | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTGTACAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTGGGGTGCTCTGTTACGTAT<br>GCCCCCTCCTGCCGCCAAATTAGCGGGCAAAGGTTCCctcgagcaccaccaccaccactga |
| V123I | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
|  | GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAATTTCAAAAATGAAATGTAAACGTGTATGGGGAGATTGGGA<br>AGAAGATGGTTTTGGTACAGATCCGATTGAAAAAGAAAACATTATGTATAAAGGACATC<br>TGAACCTTATGTATGGTCTCTATCAACTTGTTACTGGATCGCGCCGTTACGAAGCTGAA<br>CACGCTCACCTCACCCGTATTATCCACGACGAAATTGCCGCCAACCCATTCGCCGGAA<br>TCGTTTGTGAACCAGACAACTATTTTGTACAATGCAACTCTGTGGCCTATTTAAGCCTT<br>TGGGTCTACGATCGTTTACATGGAACTGACTACCGTGCCGCAACTCGTGCCTGGCTG<br>GATTTTATTCAAAAAGATCTGATTGACCCCGAACGTGGAGCTTTCTATTTGTCCTATCA<br>TCCCGAATCTGGTGCCGTCAAACCTTGGATCAGCGCATATACAACCGCTTGGACGTTA<br>GCTATGGTGCATGGAATGGATCCTGCCTTTTCAGAACGTTATTATCCTCGTTTTAAACA<br>AACGTTCGTCGAAGTCTATGATGAAGGCCGTAAAGCCCGCGTACGCGAAACTGCCGG<br>AACCGACGACGCCGATGGTGGTGTGGGTTTAGCCTCTGCGTTCACACTTTTATTAGCC<br>CGCGAAATGGGAGATCAACAACTCTTTGACCAACTGCTGAATCATTTAGAACCCCCTG<br>CCAAACCAAGCATCGTTTCTGCTAGCCTCCGCTACGAACACCCAGGCAGCCTCTTATT<br>CGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| V204I | atgATGCGTTTCACATTAAAGACCACCGCGATTGTTTCTGCCGCCGCGTTATTAGCGGG<br>TTTTGGACCACCACCTCGTGCAGCAGAATTACCTCCCGGCCGCCTTGCCACAACCGA<br>AGATTATTTCGCACAACAAGCAAAACAAGCTGTAACCCCGGATGTTATGGCTCAACTC<br>GCGTACATGAACTATATTGATTTCATTAGCCCCTTTTATTCACGTGGATGTTCATTCGA<br>AGCATGGGAATTGAAACACACTCCGCAGCGCGTGATTAAATACTCCATTGCATTCTAT<br>GCTTATGGCTTGGCATCTGTAGCATTAATCGACCCTAAACTGCGCGCGCTCGCCGGC<br>CACGACTTAGATATTGCAGTCTCAAAAATGAAATGTAAACGTGTATGGGGAGATTGGG<br>AAGAAGATGGTTTTGGTACAGATCCGATTGAAAAAGAAAACATTATGTATAAAGGACAT<br>CTGAACCTTATGTATGGTCTCTATCAACTTGTTACTGGATCGCGCCGTTACGAAGCTG<br>AACACGCTCACCTCACCCGTATTATCCACGACGAAATTGCCGCCAACCCATTCGCCGG<br>AATCGTTTGTGAACCAGACAACTATTTTATTCAATGCAACTCTGTGGCCTATTTAAGCC<br>TTTGGGTCTACGATCGTTTACATGGAACTGACTACCGTGCCGCAACTCGTGCCTGGCT<br>GGATTTTATTCAAAAAGATCTGATTGACCCCGAACGTGGAGCTTTCTATTTGTCCTATC<br>ATCCCGAATCTGGTGCCGTCAAACCTTGGATCAGCGCATATACAACCGCTTGGACGTT<br>AGCTATGGTGCATGGAATGGATCCTGCCTTTTCAGAACGTTATTATCCTCGTTTTAAAC<br>AAACGTTCGTCGAAGTCTATGATGAAGGCCGTAAAGCCCGCGTACGCGAAACTGCCG<br>GAACCGACGACGCCGATGGTGGTGTGGGTTTAGCCTCTGCGTTCACACTTTTATTAGC<br>CCGCGAAATGGGAGATCAACAACTCTTTGACCAACTGCTGAATCATTTAGAACCCCCT<br>GCCAAACCAAGCATCGTTTCTGCTAGCCTCCGCTACGAACACCCAGGCAGCCTCTTAT<br>TCGACGAACTGTTATTTCTTGCCAAAGTACATGCCGGATTTGGTGCTCTGTTACGTATG<br>CCCCCTCCTGCCGCCAAATTAGCGGGCAAAGGTTCCctcgagcaccaccaccaccactga |
| Cytoplasmic cdLD |  |
| WT | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| A324L | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT |

TABLE 8-continued

Nucleotide sequences of the cdLD variants constructed and described
in the text (SEQ ID NOS 49-86, respectively, in order of appearance).
NUCLEOTIDE AND AMINO-ACID SEQUENCES OF THE CDLD
VARIANTS CONSTRUCTED

| Mutations | Nucleotide Sequence |
|---|---|
|  | TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTCTGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| V204I | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTATGGGGAGATTGGGAAGAAGATGGTTTTGGTACAGA<br>TCCGATTGAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTATTCAATGCAACTCTGTGGCCTATTTAAGCCTTTGGGTCTACGATCGTTTACAT<br>GGAACTGACTACCGTGCCGCAACTCGTGCCTGGCTGGATTTTATTCAAAAAGATCTGA<br>TTGACCCCGAACGTGGAGCTTTCTATTTGTCCTATCATCCCGAATCTGGTGCCGTCAA<br>ACCTTGGATCAGCGCATATACAACCGCTTGGACGTTAGCTATGGTGCATGGAATGGAT<br>CCTGCCTTTTCAGAACGTTATTATCCTCGTTTTAAACAAACGTTCGTCGAAGTCTATGA<br>TGAAGGCCGTAAAGCCCGCGTACGCGAAACTGCCGGAACCGACGACGCCGATGGTG<br>GTGTGGGTTTAGCCTCTGCGTTCACACTTTTATTAGCCCGCGAAATGGGAGATCAACA<br>ACTCTTTGACCAACTGCTGAATCATTTAGAACCCCTGCCAAACCAAGCATCGTTTCTG<br>CTAGCCTCCGCTACGAACACCCAGGCAGCCTCTTATTCGACGAACTGTTATTTCTTGC<br>CAAAGTACATGCCGGATTTGGTGCTCTGTTAGGTATGCCCCCTCCTGCCGCCAAATTA<br>GCGGGCAAAGGTTCCctcgagCACCACCACCACCACCACTGA |
| M274F | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTATGGGGAGATTGGGAAGAAGATGGTTTTGGTACAGA<br>TCCGATTGAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTTTCGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| V275I | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTATGGGGAGATTGGGAAGAAGATGGTTTTGGTACAGA<br>TCCGATTGAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGATTCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCAGCCTCTTATTCGACGAACTGTTATTTCTTG |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
| | CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| F382W | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATGGGGTGCTCTGTTACGTATGCCCCCTCCTGCCGCCAAAT<br>TAGCGGGCAAAGGTTCCctcgagCACCACCACCACCACCACTGA |
| S366V | ATGGCAGAATTACCTCCCGGCCGCCTTGCCACAACCGAAGATTATTTCGCACAACAAG<br>CAAAACAAGCTGTAACCCCGGAGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCGTGCTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| A324L-<br>S366G | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTCTGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCGGGTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| M274F-<br>F96L | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCACTTTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
|  | ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTTTCGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| M274F-<br>Y99L<br>(CTC) | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTCTTGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTTTCGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| M274F-<br>Y99L<br>(CTG) | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTCTGGGCTTGGCATCTGT<br>AGCATTAATCGACCCTAAACTGCGCGCGCTCGCCGGCCACGACTTAGATATTGCAGT<br>CTCAAAAATGAAATGTAAACGTGTATGGGGAGATTGGGAAGAAGATGGTTTTGGTACA<br>GATCCGATTGAAAAAGAAAACATTATGTATAAAGGACATCTGAACCTTATGTATGGTCT<br>CTATCAACTTGTTACTGGATCGCGCCGTTACGAAGCTGAACACGCTCACCTCACCCGT<br>ATTATCCACGACGAAATTGCCGCCAACCCATTCGCCGGAATCGTTTGTGAACCAGACA<br>ACTATTTTGTACAATGCAACTCTGTGGCCTATTTAAGCCTTTGGGTCTACGATCGTTTA<br>CATGGAACTGACTACCGTGCCGCAACTCGTGCCTGGCTGGATTTTATTCAAAAAGATC<br>TGATTGACCCCGAACGTGGAGCTTTCTATTTGTCCTATCATCCCGAATCTGGTGCCGT<br>CAAACCTTGGATCAGCGCATATACAACCGCTTGGACGTTAGCTTTCGTGCATGGAATG<br>GATCCTGCCTTTTCAGAACGTTATTATCCTCGTTTTAAACAAACGTTCGTCGAAGTCTA<br>TGATGAAGGCCGTAAAGCCCGCGTACGCGAAACTGCCGGAACCGACGACGCCGATG<br>GTGGTGTGGGTTTAGCCTCTGCGTTCACACTTTTATTAGCCCGCGAAATGGGAGATCA<br>ACAACTCTTTGACCAACTGCTGAATCATTTAGAACCCCTGCCAAACCAAGCATCGTTT<br>CTGCTAGCCTCCGCTACGAACACCCAGGCAGCCTCTTATTCGACGAACTGTTATTTCT<br>TGCCAAAGTACATGCCGGATTTGGTGCTCTGTTACGTATGCCCCCTCCTGCCGCCAAA<br>TTAGCGGGCAAAGGTTCCctcgagCACCACCACCACCACCACTGA |
| M274F-<br>Y99L<br>(TTG) | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTTGGGCTTGGCATCTGT<br>AGCATTAATCGACCCTAAACTGCGCGCGCTCGCCGGCCACGACTTAGATATTGCAGT<br>CTCAAAAATGAAATGTAAACGTGTATGGGGAGATTGGGAAGAAGATGGTTTTGGTACA<br>GATCCGATTGAAAAAGAAAACATTATGTATAAAGGACATCTGAACCTTATGTATGGTCT<br>CTATCAACTTGTTACTGGATCGCGCCGTTACGAAGCTGAACACGCTCACCTCACCCGT<br>ATTATCCACGACGAAATTGCCGCCAACCCATTCGCCGGAATCGTTTGTGAACCAGACA<br>ACTATTTTGTACAATGCAACTCTGTGGCCTATTTAAGCCTTTGGGTCTACGATCGTTTA<br>CATGGAACTGACTACCGTGCCGCAACTCGTGCCTGGCTGGATTTTATTCAAAAAGATC<br>TGATTGACCCCGAACGTGGAGCTTTCTATTTGTCCTATCATCCCGAATCTGGTGCCGT<br>CAAACCTTGGATCAGCGCATATACAACCGCTTGGACGTTAGCTTTCGTGCATGGAATG<br>GATCCTGCCTTTTCAGAACGTTATTATCCTCGTTTTAAACAAACGTTCGTCGAAGTCTA<br>TGATGAAGGCCGTAAAGCCCGCGTACGCGAAACTGCCGGAACCGACGACGCCGATG<br>GTGGTGTGGGTTTAGCCTCTGCGTTCACACTTTTATTAGCCCGCGAAATGGGAGATCA<br>ACAACTCTTTGACCAACTGCTGAATCATTTAGAACCCCTGCCAAACCAAGCATCGTTT |

TABLE 8-continued

Nucleotide sequences of the cdLD variants constructed and described
in the text (SEQ ID NOS 49-86, respectively, in order of appearance).
NUCLEOTIDE AND AMINO-ACID SEQUENCES OF THE CDLD
VARIANTS CONSTRUCTED

| Mutations | Nucleotide Sequence |
|---|---|
|  | CTGCTAGCCTCCGCTACGAACACCCAGGCAGCCTCTTATTCGACGAACTGTTATTTCT<br>TGCCAAAGTACATGCCGGATTTGGTGCTCTGTTACGTATGCCCCCTCCTGCCGCCAAA<br>TTAGCGGGCAAAGGTTCCctcgagCACCACCACCACCACCACTGA |
| S366V-<br>L367V<br>(GTG) | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCCTGCCAAACCAAGCATCGTTTCT<br>GCTAGCCTCCGCTACGAACACCCAGGCGTGGTGTTATTCGACGAACTGTTATTTCTTG<br>CCAAAGTACATGCCGGATTTGGTGCTCTGTTACGTATGCCCCCTCCTGCCGCCAAATT<br>AGCGGGCAAAGGTTCCctcgagCACCACCACCACCACCACTGA |
| F382W-<br>L212Y | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCTATTATAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATGGGGTGCTCTGTTACGTATGCCCCCTCCTGCCGCCAAATT<br>AGCGGGCAAAGGTTCCctcgagCACCACCACCACCACCACTGA |
| F382W<br>only | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGTAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATCTGAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTTTATTAGCCCGCGAAATGGGAGATCAAC<br>AACTCTTTGACCAACTGCTGAATCATTTAGAACCCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATGGGGTGCTCTGTTACGTATGCCCCCTCCTGCCGCCAAATT<br>AGCGGGCAAAGGTTCCctcgagCACCACCACCACCACCACTGA |
| F382W-<br>L328V | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA |

TABLE 8-continued

Nucleotide sequences of the cdLD variants constructed and described in the text (SEQ ID NOS 49-86, respectively, in order of appearance). NUCLEOTIDE AND AMINO-ACID SEQUENCES OF THE CDLD VARIANTS CONSTRUCTED

| Mutations | Nucleotide Sequence |
|---|---|
| | TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTGCGTTCACACTTGTGTTAGCCCGCGAAATGGGAGATCAA<br>CAACTCTTTGACCAACTGCTGAATCATTTAGAACCCCCTGCCAAACCAAGCATCGTTTC<br>TGCTAGCCTCCGCTACGAACACCCAGGCAGCCTCTTATTCGACGAACTGTTATTTCTT<br>GCCAAAGTACATGCCGGATGGGGTGCTCTGTTACGTATGCCCCCTCCTGCCGCCAAA<br>TTAGCGGGCAAAGGTTCCctcgagCACCACCACCACCACCACTGA |
| F382W-<br>L328V-<br>I187M | ATGGCAGAATTACCTCCCGGCCGCCTTGCCACAACCGAAGATTATTTCGCACAACAAG<br>CAAAACAAGCTGTTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATGGCCGCCAACCCATTCGCCGGAATCGTTTGTGAACCAGACAA<br>CTATTTTGTACAATGCAACTCTGTGGCCTATTTAAGCCTTTGGGTCTACGATCGTTTAC<br>ATGGAACTGACTACCGTGCCGCAACTCGTGCCTGGCTGGATTTTATTCAAAAAGATCT<br>GATTGACCCCGAACGTGGAGCTTTCTATTTGTCCTATCATCCCGAATCTGGTGCCGTC<br>AAACCTTGGATCAGCGCATATACAACCGCTTGGACGTTAGCTATGGTGCATGGAATGG<br>ATCCTGCCTTTTCAGAACGTTATTATCCTCGTTTTAAACAAACGTTCGTCGAAGTCTAT<br>GATGAAGGCCGTAAAGCCCGCGTACGCGAAACTGCCGGAACCGACGACGCCGATGG<br>TGGTGTGGGTTTAGCCTCTGCGTTCACACTTGTGTTAGCCCGCGAAATGGGAGATCAA<br>CAACTCTTTGACCAACTGCTGAATCATTTAGAACCCCCTGCCAAACCAAGCATCGTTTC<br>TGCTAGCCTCCGCTACGAACACCCAGGCAGCCTCTTATTCGACGAACTGTTATTTCTT<br>GCCAAAGTACATGCCGGATGGGGTGCTCTGTTACGTATGCCCCCTCCTGCCGCCAAA<br>TTAGCGGGCAAAGGTTCCctcgagCACCACCACCACCACCACTGA |
| M274F-<br>F96L-<br>F382W | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCACTTTATGCTTATGGCTTGGCATCTGTA<br>GCATTAATCGACCCTAAACTGCGCGCGCTCGCCGGCCACGACTTAGATATTGCAGTCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATCAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTTTCGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTAGCCTCTGCGTTCACACTTTTATTAGCCCGCGAAATGGGAGATCAAC<br>AACTCTTTGACCAACTGCTGAATCATTTAGAACCCCCTGCCAAACCAAGCATCGTTTCT<br>GCTAGCCTCCGCTACGAACACCCAGGCAGCCTCTTATTCGACGAACTGTTATTTCTTG<br>CCAAAGTACATGCCGGATGGGGTGCTCTGTTACGTATGCCCCCTCCTGCCGCCAAAT<br>TAGCGGGCAAAGGTTCCctcgagCACCACCACCACCACCACTGA |
| A324L-<br>S366G-<br>V123I | ATGGCAGAATTACCTCCCGGCCGCCTTGCCACAACCGAAGATTATTTCGCACAACAAG<br>CAAAACAAGCTGTAACCCCGGATGTTATGGCTCAACTCGCGTACATGAACTATATTGA<br>TTTCATTAGCCCCTTTTATTCACGTGGATGTTCATTCGAAGCATGGGAATTGAAACACA<br>CTCCGCAGCGCGTGATTAAATACTCCATTGCATTCTATGCTTATGGCTTGGCATCTGTA<br>GCATTAATCGACCCTAAACTGCGCGCGCTCGCCGGCCACGACTTAGATATTGCAATCT<br>CAAAAATGAAATGTAAACGTGTATGGGGAGATTGGGAAGAAGATGGTTTTGGTACAGA<br>TCCGATTGAAAAAGAAAACATTATGTATAAAGGACATCTGAACCTTATGTATGGTCTCT<br>ATGAACTTGTTACTGGATCGCGCCGTTACGAAGCTGAACACGCTCACCTCACCCGTAT<br>TATCCACGACGAAATTGCCGCCAACCCATTCGCCGGAATCGTTTGTGAACCAGACAAC<br>TATTTTGTACAATGCAACTCTGTGGCCTATTTAAGCCTTTGGGTCTACGATCGTTTACA<br>TGGAACTGACTACCGTGCCGCAACTCGTGCCTGGCTGGATTTTATTCAAAAAGATCTG<br>ATTGACCCCGAACGTGGAGCTTTCTATTTGTCCTATCATCCCGAATCTGGTGCCGTCA<br>AACCTTGGATCAGCGCATATACAACCGCTTGGACGTTAGCTATGGTGCATGGAATGGA<br>TCCTGCCTTTTCAGAACGTTATTATCCTCGTTTTAAACAAACGTTCGTCGAAGTCTATG<br>ATGAAGGCCGTAAAGCCCGCGTACGCGAAACTGCCGGAACCGACGACGCCGATGGT<br>GGTGTGGGTTTAGCCTCTCTGTTCACACTTTTATTAGCCCGCGAAATGGGAGATCAAC |

TABLE 8-continued

Nucleotide sequences of the cdLD variants constructed and described in the text (SEQ ID NOS 49-86, respectively, in order of appearance).
NUCLEOTIDE AND AMINO-ACID SEQUENCES OF THE CDLD VARIANTS CONSTRUCTED

| Mutations | Nucleotide Sequence |
|---|---|
| | AACTCTTTGACCAACTGCTGAATCATTTAGAACCCCCTGCCAAACCAAGCATCGTTTCT GCTAGCCTCCGCTACGAACACCCAGGCGGTCTCTTATTCGACGAACTGTTATTTCTTG CCAAAGTACATGCCGGATTTGGTGCTCTGTTACGTATGCCCCCTCCTGCCGCCAAATT AGCGGGCAAAGGTTCCctcgagCACCACCACCACCACCACTGA |

TABLE 9

Amino-acid sequences of the cdLD variants constructed and described in the text (SEQ ID NOS 4 and 88-123, respectively, in order of appearance)

| Mutations | Protein Sequence |
|---|---|
| Periplasmic cdLD | |
| Wild Type SEQ ID NO: 4 | MMRFTLKTTAIVSAAALLAGEGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAV SKMKCKRVWGDWEEDGFGTDPIEKENIMYKGHLNLMYGLYQLVTGSRRYEAEHAHLTRII HDEIAANPFAGIVCEPDNYFVQCNSVAYLSLWVYDRLHGTDYRAATRAWLDFIQKDLIDPE RGAFYLSYHPESGAVKPWISAYTTAWTLAMVHGMDPAFSERYYPRFKQTFVEVYDEGRK ARVRETAGTDDADGGVGLASAFTLLLAREMGDQQLFDQLLNHLEPPAKPSIVSASLRYEH PGSLLFDELLFLAKVHAGFGALLRMPPPAAKLAGKGSLEHHHHHH |
| V123I, V204I, V275I, | MMRFTLKTTAIVSAAALLAGFGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAI SKMKCKRVWGDWEEDGFGTDPIEKENIMYKGHLNLMYGLYQLVTGSRRYEAEHAHLTRII HDEIAANPFAGIVCEPDNYFIQCNSVAYLSLWVYDRLHGTDYRAATRAWLDFIQKDLIDPE RGAFYLSYHPESGAVKPWISAYTTAWTLAMIHGMDPAFSERYYPRFKQTFVEVYDEGRKA RVRETAGTDDADGGVGLASAFTLLLAREMGDQQLFDQLLNHLEPPAKPSIVSASLRYEHP GSLLFDELLFLAKVHAGFGALLRMPPPAAKLAGKGSLEHHHHHH |
| V123I, V204I, M274F, V275I, | MMRFTLKTTAIVSAAALLAGFGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAI SKMKCKRVWGDWEEDGFGTDPIEKENIMYKGHLNLMYGLYQLVTGSRRYEAEHAHLTRII HDEIAANPFAGIVCEPDNYFIQCNSVAYLSLWVYDRLHGTDYRAATRAWLDFIQKDLIDPE RGAFYLSYHPESGAVKPWISAYTTAWTLAFIHGMDPAFSERYYPRFKQTFVEVYDEGRKA RVRETAGTDDADGGVGLASAFTLLLAREMGDQQLFDQLLNHLEPPAKPSIVSASLRYEHP GSLLFDELLFLAKVHAGFGALLRMPPPAAKLAGKGSLEHHHHHH |
| V123I, V204I, M274F, V275I, A324L, F382W | MMRFTLKTTAIVSAAALLAGFGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAI SKMKCKRVWGDWEEDGFGTDPIEKENIMYKGHLNLMYGLYQLVTGSRRYEAEHAHLTRII HDEIAANPFAGIVCEPDNYFIQCNSVAYLSLWVYDRLHGTDYRAATRAWLDFIQKDLIDPE RGAFYLSYHPESGAVKPWISAYTTAWTLAFIHGMDPAFSERYYPRFKQTFVEVYDEGRKA RVRETAGTDDADGGVGLASLFTLLLAREMGDQQLFDQLLNHLEPPAKPSIVSASLRYEHP GSLLFDELLFLAKVHAGWGALLRMPPPAAKLAGKGSLEHHHHHH |
| A324L | MMRFTLKTTAIVSAAALLAGFGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAV SKMKCKRVWGDWEEDGFGTDPIEKENIMYKGHLNLMYGLYQLVTGSRRYEAEHAHLTRII HDEIAANPFAGIVCEPDNYFVQCNSVAYLSLWVYDRLHGTDYRAATRAWLDFIQKDLIDPE RGAFYLSYHPESGAVKPWISAYTTAWTLAMVHGMDPAFSERYYPRFKQTFVEVYDEGRK ARVRETAGTDDADGGVGLASLFTLLLAREMGDQQLFDQLLNHLEPPAKPSIVSASLRYEH PGSLLFDELLFLAKVHAGFGALLRMPPPAAKLAGKGSLEHHHHHH |
| R360Y | MMRFTLKTTAIVSAAALLAGFGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAV SKMKCKRVWGDWEEDGFGTDPIEKENIMYKGHLNLMYGLYQLVTGSRRYEAEHAHLTRII HDEIAANPFAGIVCEPDNYFVQCNSVAYLSLWVYDRLHGTDYRAATRAWLDFIQKDLIDPE RGAFYLSYHPESGAVKPWISAYTTAWTLAMVHGMDPAFSERYYPRFKQTFVEVYDEGRK ARVRETAGTDDADGGVGLASAFTLLLAREMGDQQLFDQLLNHLEPPAKPSIVSASLYYEH PGSLLFDELLFLAKVHAGFGALLRMPPPAAKLAGKGSLEHHHHHH |
| V204I, M274F, V275I, | MMRFTLKTTAIVSAAALLAGFGPPPRAAELPPGRLATTEDYFAQQAKQAVTPDVMAQLAY MNYIDFISPFYSRGCSFEAWELKHTPQRVIKYSIAFYAYGLASVALIDPKLRALAGHDLDIAV SKMKCKRVWGDWEEDGFGTDPIEKENIMYKGHLNLMYGLYQLVTGSRRYEAEHAHLTRII HDEIAANPFAGIVCEPDNYFIQCNSVAYLSLWVYDRLHGTDYRAATRAWLDFIQKDLIDPE RGAFYLSYHPESGAVKPWISAYTTAWTLAFIHGMDPAFSERYYPRFKQTFVEVYDEGRKA RVRETAGTDDADGGVGLASAFTLLLAREMGDQQLFDQLLNHLEPPAKPSIVSASLRYEHP GSLLFDELLFLAKVHAGFGALLRMPPPAAKLAGKGSLEHHHHHH |

TABLE 9-continued

Amino-acid sequences of the cdLD variants constructed and described in the text (SEQ ID NOS 4 and 88-123, respectively, in order of appearance)

| Mutations | Protein Sequence |
| --- | --- |
| V123I<br>M274F,<br>V275I, | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAI<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAFIHGMDPAFSERYYPRFKQTFVEVYDEGRKA<br>RVRETAGTDDADGGVGLASAFTLLLAREMGDQQLFDQLLNHLEPPAKPSIVSASLRYEHP<br>GSLLFDELLFLAKVHAGFGALLRMPPPAAKLAGKGSLEHHHHHH |
| V123I,<br>V204I,<br>V275I, | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAI<br>SKMKCKRVWGDWEEDGFGTDPIEKENIMYKGHLNLMYGLYQLVTGSRRYEAEHAHLTRII<br>HDEIAANPFAGIVCEPDNYFIQCNSVAYLSLWVYDRLHGTDYRAATRAWLDFIQKDLIDPE<br>RGAFYLSYHPESGAVKPWISAYTTAWTLAMIHGMDPAFSERYYPRFKQTFVEVYDEGRKA<br>RVRETAGTDDADGGVGLASAFTLLLAREMGDQQLFDQLLNHLEPPAKPSIVSASLRYEHP<br>GSLLFDELLFLAKVHAGFGALLRMPPPAAKLAGKGSLEHHHHHH |
| V123I,<br>V204I,<br>M274F, | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAI<br>SKMKCKRVWGDWEEDGFGTDPIEKENIMYKGHLNLMYGLYQLVTGSRRYEAEHAHLTRII<br>HDEIAANPFAGIVCEPDNYFIQCNSVAYLSLWVYDRLHGTDYRAATRAWLDFIQKDLIDPE<br>RGAFYLSYHPESGAVKPWISAYTTAWTLAFVHGMDPAFSERYYPRFKQTFVEVYDEGRK<br>ARVRETAGTDDADGGVGLASAFTLLLAREMGDQQLFDQLLNHLEPPAKPSIVSASLRYEH<br>PGSLLFDELLFLAKVHAGFGALLRMPPPAAKLAGKGSLEHHHHHH |
| M274F,<br>V275I,<br>F382W | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAFIHGMDPAFSERYYPRFKQTFVEVYDEGRKA<br>RVRETAGTDDADGGVGLASAFTLLLAREMGDQQLFDQLLNHLEPPAKPSIVSASLRYEHP<br>GSLLFDELLFLAKVHAGWGALLRMPPPAAKLAGKGSLEHHHHHH |
| V275I,<br>A324L | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAMIHGMDPAFSERYYPRFKQTFVEVYDEGRKA<br>RVRETAGTDDADGGVGLASLFTLLLAREMGDQQLFDQLLNHLEPPAKPSIVSASLRYEHP<br>GSLLFDELLFLAKVHAGFGALLRMPPPAAKLAGKGSLEHHHHHH |
| M274F | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAFVHGMDPAFSERYYPRFKQTFVEVYDEGRK<br>ARVRETAGTDDADGGVGLASAFTLLLAREMGDQQLFDQLLNHLEPPAKPSIVSASLRYEH<br>PGSLLFDELLFLAKVHAGFGALLRMPPPAAKLAGKGSLEHHHHHH |
| V275I | MMRFTLKTTAIVSAAALLAGFGPPPRAAELPPGRLATTEDYFAQQAKQAVTPDVMAQLAY<br>MNYIDFISPFYSRGCSFEAWELKHIPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAMIHGMDPAFSERYYPRFKQTFVEVYDEGRKA<br>RVRETAGTDDADGGVGLASAFTLLLAREMGDQQLFDQLLNHLEPPAKPSIVSASLRYEHP<br>GSLLFDELLFLAKVHAGFGALLRMPPPAAKLAGKGSLEHHHHHH |
| A324L | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAMVHGMDPAFSERYYPRFKQTFVEVYDEGRK<br>ARVRETAGTDDADGGVGLASLFTLLLAREMGDQQLFDQLLNHLEPPAKPSIVSASLRYEH<br>PGSLLFDELLFLAKVHAGFGALLRMPPPAAKLAGKGSLEHHHHHH |
| R360Y | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAMVHGMDPAFSERYYPRFKQTFVEVYDEGRK<br>ARVRETAGTDDADGGVGLASAFTLLLAREMGDQQLFDQLLNHLEPPAKPSIVSASLYYEH<br>PGSLLFDELLFLAKVHAGFGALLRMPPPAAKLAGKGSLEHHHHHH |

TABLE 9-continued

Amino-acid sequences of the cdLD variants constructed and described in the text (SEQ ID NOS 4 and 88-123, respectively, in order of appearance)

| Mutations | Protein Sequence |
|---|---|
| F382W | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAMVHGMDPAFSERYYPRFKQTFVEVYDEGRK<br>ARVRETAGTDDADGGVGLASAFTLLLAREMGDQQLFDQLLNHLEPPAKPSIVSASLRYEH<br>PGSLLFDELLFLAKVHAGWGALLRMPPPAAKLAGKGSLEHHHHHH |
| V123I | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAI<br>SKMKCKRVWGDWEEDGFGTDPIEKENIMYKGHLNLMYGLYQLVTGSRRYEAEHAHLTRII<br>HDEIAANPFAGIVCEPDNYFVQCNSVAYLSLWVYDRLHGTDYRAATRAWLDFIQKDLIDPE<br>RGAFYLSYHPESGAVKPWISAYTTAWTLAMVHGMDPAFSERYYPRFKQTFVEVYDEGRK<br>ARVRETAGTDDADGGVGLASAFTLLLAREMGDQQLFDQLLNHLEPPAKPSIVSASLRYEH<br>PGSLLFDELLFLAKVHAGFGALLRMPPPAAKLAGKGSLEHHHHHH |
| V204I | MMRFTLKTTAIVSAAALLAGFGPPPRAAELPPGRLATTEDYFAQQAKQAVTPDVMAQLAY<br>MNYIDFISPFYSRGCSFEAWELKHTPQRVIKYSIAFYAYGLASVALIDPKLRALAGHDLDIAV<br>SKMKCKRVWGDWEEDGFGTDPIEKENIMYKGHLNLMYGLYQLVTGSRRYEAEHAHLTRII<br>HDEIAANPFAGIVCEPDNYFIQCNSVAYLSLWVYDRLHGTDYRAATRAWLDFIQKDLIDPE<br>RGAFYLSYHPESGAVKPWISAYTTAWTLAMVHGMDPAFSERYYPRFKQTFVEVYDEGRK<br>ARVRETAGTDDADGGVGLASAFTLLLAREMGDQQLFDQLLNHLEPPAKPSIVSASLRYEH<br>PGSLLFDELLFLAKVHAGFGALLRMPPPAAKLAGKGSLEHHHHHH |
| Cytoplasmic cdLD SEQ ID NO: 5 | |
| WT | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| A324L | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASLFTLL<br>LAREMGDQQLFDQLLNHLEPPAKPSIVSASLRYEHPGSLLFDELLFLAKVHAGFGALLRMP<br>PPAAKLAGKGSLEHHHHHH |
| V204I | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFIQCNSV<br>AYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| M274F | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAFVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| V275I | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMIHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| F382W | MAELPPGRLATTEDYFAQQAKQAVTPDVMAQLAYMNYQFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTLL |

TABLE 9-continued

Amino-acid sequences of the cdLD variants constructed and described in the text (SEQ ID NOS 4 and 88-123, respectively, in order of appearance)

| Mutations | Protein Sequence |
|---|---|
| | LAREMGDQQLFDQLLNHLEPPAKPSIVSASLRYEHPGSLLFDELLFLAKVHAGWGALLRM<br>PPPAAKLAGKGSLEHHHHHH |
| S366V | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTLL<br>LAREMGDQQLFDQLLNHLEPPAKPSIVSASLRYEHPGVLLFDELLFLAKVHAGFGALLRMP<br>PPAAKLAGKGSLEHHHHHH |
| A324L-<br>S366G | MAELPPGRLATTEDYFAQQAKQAVTPDVMAQLAYMNYIDFISPFYSRGQSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASLFTLL<br>LAREMGDQQLFDQLLNHLEPPAKPSIVSASLRYEHPGGLLFDELLFLAKVHAGFGALLRMP<br>PPAAKLAGKGSLEHHHHHH |
| M274F-<br>F96L | MAELPPGRLATTEDYFAQQAKQAVTPDVMAQLAYMNYIDFISPFYSRGCSFEAWELKHTP<br>QRVIKYSIALYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAFVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| M274F-<br>Y99L<br>(CTC) | MAELPPGRLATTEDYFAQQAKQAVTPDVMAQLAYMNYIDFISPFYSRGCSFEAWELKHTP<br>QRVIKYSIAFYALGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAFVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| M274F-<br>Y99L<br>(CTG) | MAELPPGRLATTEDYFAQQAKQAVTPDVMAQLAYMNYIDFISPFYSRGCSFEAWELKHTP<br>QRVIKYSIAFYALGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAFVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| M274F-<br>Y99L<br>(TTG) | MAELPPGRLATTEDYFAQQAKQAVTPDVMAQLAYMNYIDFISPFYSRGCSFEAWELKHTP<br>QRVIKYSIAFYALGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAFVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGFGALLRMP<br>PPAAKLAGKGSLEHHHHHH |
| S366V-<br>L367V<br>(GTG) | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTLL<br>LAREMGDQQLFDQLLNHLEPPAKPSIVSASLRYEHPGVVLFDELLFLAKVHAGFGALLRMP<br>PPAAKLAGKGSLEHHHHHH |
| F382W-<br>L212Y | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYYSLWVYDRLHGTDYRAATRAWLDFIQKDLIDPERGAFYLSYHPESGAVKPWISAYTT<br>AWILAMVHGMDPAFSERYYPRFKQTFVEVYDEGRKARVRETAGTDDADGGVGLASAFT<br>LLLAREMGDQQLFDQLLNHLEPPAKPSIVSASLRYEHPGSLLFDELLFLAKVHAGWGALLR<br>MPPPAAKLAGKGSLEHHHHHH |
| F382W<br>only | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGWGALLRM<br>PPPAAKLAGKGSLEHHHHHH |

TABLE 9-continued

Amino-acid sequences of the cdLD variants constructed and described in the text (SEQ ID NOS 4 and 88-123, respectively, in order of appearance)

| Mutations | Protein Sequence |
|---|---|
| F382W-<br>L328V | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTL<br>VLAREMGDQQLFDQLLNHLEPPAKPSIVSASLRYEHPGSLLFDELLFLAKVHAGWGALLR<br>MPPPAAKLAGKGSLEHHHHHH |
| F382W-<br>L328V-<br>I187M | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEMAANPFAGIVCEPDNYFVQGNS<br>VAYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASAFTL<br>VLAREMGDQQLFDQLLNHLEPPAKPSIVSASLRYEHPGSLLFDELLFLAKVHAGWGALLR<br>MPPPAAKLAGKGSLEHHHHHH |
| M274F-<br>F96L-<br>F382W | MAELPPGRLATTEDYFAQQAKQAVTPDVMAQLAYMNYIDFISPFYSRGCSFEAWELKHTP<br>QRVIKYSIALYAYGLASVALIDPKLRALAGHDLDIAVSKMKCKRVWGDWEEDGFGTDPIEK<br>ENIMYKGHLNLMYGLYQLVTGSRRYEAEHAHLTRIIHDEIAANPFAGIVCEPDNYFVQCNS<br>VAYLSLWVYDRLHGTDYRAATRAWLDFIQKDLIDPERGAFYLSYHPESGAVKPWISAYTTA<br>WTLAFVHGMDPAFSERYYPRFKQTFVEVYDEGRKARVRETAGTDDADGGVGLASAFTLL<br>LAREMGDQQLFDQLLNHLEPPAKPSIVSASLRYEHPGSLLFDELLFLAKVHAGWGALLRM<br>PPPAAKLAGKGSLEHHHHHH |
| A324L-<br>S366G-<br>V123I | MAELPPGRLATTEDYFAQQAKQAVTPDVMAQLAYMNYIDFISPFYSRGCSFEAWELKHTP<br>QRVIKYSIAFYAYGLASVALIDPKLRALAGHDLDIAISKMKCKRVWGDWEEDGFGTDPIEKE<br>NIMYKGHLNLMYGLYQLVTGSRRYEAEHAHLTRIIHDEIAANPFAGIVCEPDNYFVQCNSV<br>AYLSLWVYDRLHGTDYRAATRAWLDFIQKDLIDPERGAFYLSYHPESGAVKPWISAYTTA<br>WTLAMVHGMDPAFSERYYPRFKQTFVEVYDEGRKARVRETAGTDDADGGVGLASLFTLL<br>LAREMGDQQLFDQLLNHLEPPAKPSIVSASLRYEHPGGLLFDELLFLAKVHAGFGALLRMP<br>PPAAKLAGKGSLEHHHHHH |

Appendix 1 (Novalix coordinates)
Appendix 2 (Emerald coordinates)
Appendix 3 (FASTA SEQUENCES OF MUTANTS TESTED) SEQ ID NOS 124-458, respectively, in order of appearance)

Appendix 1

```
         HEADER      ----                                         XX-XXX-9-   xxxx
COMPND      ----
REMARK   3
REMARK   3 REFINEMENT.
REMARK   3   PROGRAM     : REFMAC 5.5.0109
REMARK   3
REMARK   3   REFINEMENT TARGET : MAXIMUM LIKELIHOOD
REMARK   3
REMARK   3 DATA USED IN REFINEMENT.
REMARK   3   RESOLUTION RANGE HIGH (ANGSTROMS) :    2.54
REMARK   3   RESOLUTION RANGE LOW  (ANGSTROMS) :   48.16
REMARK   3   DATA CUTOFF            (SIGMA(F)) : NONE
REMARK   3   COMPLETENESS FOR RANGE        (%) :  100.00
REMARK   3   NUMBER OF REFLECTIONS             :  138585
REMARK   3
REMARK   3 FIT TO DATA USED IN REFINEMENT.
REMARK   3   CROSS-VALIDATION METHOD           : THROUGHOUT
REMARK   3   FREE R VALUE TEST SET SELECTION   : RANDOM
REMARK   3   R VALUE     (WORKING + TEST SET)  : 0.19568
REMARK   3   R VALUE            (WORKING SET)  : 0.19181
REMARK   3   FREE R VALUE                      : 0.26873
REMARK   3   FREE R VALUE TEST SET SIZE   (%)  : 5.0
REMARK   3   FREE R VALUE TEST SET COUNT       : 7294
REMARK   3
REMARK   3 FIT IN THE HIGHEST RESOLUTION BIN.
REMARK   3   TOTAL NUMBER OF BINS USED         :      20
REMARK   3   BIN RESOLUTION RANGE HIGH         :   2.538
REMARK   3   BIN RESOLUTION RANGE LOW          :   2.604
REMARK   3   REFLECTION IN BIN     (WORKING SET) :    9625
REMARK   3   BIN COMPLETENESS (WORKING+TEST) (%) :  100.00
REMARK   3   BIN R VALUE           (WORKING SET) :   0.267
REMARK   3   BIN FREE R VALUE SET COUNT          :     506
REMARK   3   BIN FREE R VALUE                    :   0.382
REMARK   3
REMARK   3 NUMBER OF NON-HYDROGEN ATOMS USED IN REFINEMENT.
REMARK   3   ALL ATOMS         :     29506
REMARK   3
REMARK   3 B VALUES.
REMARK   3   FROM WILSON PLOT           (A**2) : NULL
REMARK   3   MEAN B VALUE      (OVERALL, A**2) :  36.403
REMARK   3   OVERALL ANISOTROPIC B VALUE.
REMARK   3    B11 (A**2) :    -0.17
REMARK   3    B22 (A**2) :     0.27
REMARK   3    B33 (A**2) :    -0.53
REMARK   3    B12 (A**2) :     0.00
REMARK   3    B13 (A**2) :    -0.74
REMARK   3    B23 (A**2) :     0.00
REMARK   3
REMARK   3 ESTIMATED OVERALL COORDINATE ERROR.
REMARK   3   ESU BASED ON R VALUE                        (A):   0.593
REMARK   3   ESU BASED ON FREE R VALUE                   (A):   0.320
REMARK   3   ESU BASED ON MAXIMUM LIKELIHOOD             (A):   0.234
REMARK   3   ESU FOR B VALUES BASED ON MAXIMUM LIKELIHOOD (A**2):  10.702
REMARK   3
```

Appendix 1

```
REMARK   3 CORRELATION COEFFICIENTS.
REMARK   3   CORRELATION COEFFICIENT FO-FC      :  0.944
REMARK   3   CORRELATION COEFFICIENT FO-FC FREE :  0.892
REMARK   3
REMARK   3  RMS DEVIATIONS FROM IDEAL VALUES        COUNT    RMS    WEIGHT
REMARK   3   BOND LENGTHS REFINED ATOMS      (A): 29806 ; 0.025 ; 0.022
REMARK   3   BOND ANGLES REFINED ATOMS (DEGREES): 40546 ; 2.443 ; 1.951
REMARK   3   TORSION ANGLES, PERIOD 1  (DEGREES):  3610 ; 8.898 ; 5.000
REMARK   3   TORSION ANGLES, PERIOD 2  (DEGREES):  1430 ;35.553 ;23.077
REMARK   3   TORSION ANGLES, PERIOD 3  (DEGREES):  4636 ;21.021 ;15.000
REMARK   3   TORSION ANGLES, PERIOD 4  (DEGREES):   200 ;19.543 ;15.000
REMARK   3   CHIRAL-CENTER RESTRAINTS     (A**3):  4260 ; 0.186 ; 0.200
REMARK   3   GENERAL PLANES REFINED ATOMS    (A): 23280 ; 0.013 ; 0.021
REMARK   3
REMARK   3  ISOTROPIC THERMAL FACTOR RESTRAINTS.    COUNT    RMS    WEIGHT
REMARK   3   MAIN-CHAIN BOND REFINED ATOMS  (A**2): 18060 ; 1.046 ; 1.500
REMARK   3   MAIN-CHAIN ANGLE REFINED ATOMS (A**2): 28944 ; 1.962 ; 2.000
REMARK   3   SIDE-CHAIN BOND REFINED ATOMS  (A**2): 11746 ; 3.239 ; 3.000
REMARK   3   SIDE-CHAIN ANGLE REFINED ATOMS (A**2): 11602 ; 5.159 ; 4.500
REMARK   3
REMARK   3  NCS RESTRAINTS STATISTICS
REMARK   3   NUMBER OF NCS GROUPS : NULL
REMARK   3
REMARK   3  TWIN DETAILS
REMARK   3   NUMBER OF TWIN DOMAINS  : NULL
REMARK   3
REMARK   3
REMARK   3  TLS DETAILS
REMARK   3   NUMBER OF TLS GROUPS  : NULL
REMARK   3
REMARK   3
REMARK   3  BULK SOLVENT MODELLING.
REMARK   3   METHOD USED : MASK
REMARK   3   PARAMETERS FOR MASK CALCULATION
REMARK   3   VDW PROBE RADIUS   :   1.40
REMARK   3   ION PROBE RADIUS   :   0.80
REMARK   3   SHRINKAGE RADIUS   :   0.80
REMARK   3
REMARK   3  OTHER REFINEMENT REMARKS:
REMARK   3  U VALUES      : REFINED INDIVIDUALLY
REMARK   3
SSBOND   1 CYS A   74    CYS A  127
SSBOND   2 CYS B   74    CYS B  127
SSBOND   3 CYS C   74    CYS C  127
SSBOND   4 CYS D   74    CYS D  127
SSBOND   5 CYS E   74    CYS E  127
SSBOND   6 CYS F   74    CYS F  127
SSBOND   7 CYS G   74    CYS G  127
SSBOND   8 CYS H   74    CYS H  127
SSBOND   9 CYS I   74    CYS I  127
SSBOND  10 CYS J   74    CYS J  127
CRYST1  132.490  110.450  161.640  90.00 107.19  90.00 P 1 21 1
SCALE1     0.007548  0.000000  0.002335      0.00000
SCALE2     0.000000  0.009054  0.000000      0.00000
```

Appendix 1

```
SCALE3      0.000000  0.000000  0.006476    0.00000
ATOM    1   N    LEU A  29    35.547  21.882  48.368  1.00 49.95    A  N
ATOM    2   CA   LEU A  29    34.990  22.700  47.292  1.00 52.06    A  C
ATOM    3   CB   LEU A  29    34.809  21.807  46.066  1.00 52.73    A  C
ATOM    4   CG   LEU A  29    34.570  22.346  44.666  1.00 55.93    A  C
ATOM    5   CD1  LEU A  29    35.669  21.940  43.781  1.00 57.89    A  C
ATOM    6   CD2  LEU A  29    33.299  21.796  44.130  1.00 58.78    A  C
ATOM    7   C    LEU A  29    33.660  23.329  47.670  1.00 50.39    A  C
ATOM    8   O    LEU A  29    32.868  22.661  48.279  1.00 50.90    A  O
ATOM    9   N    PRO A  30    33.413  24.596  47.328  1.00 49.34    A  N
ATOM   10   CA   PRO A  30    32.110  25.206  47.546  1.00 47.83    A  C
ATOM   11   CB   PRO A  30    32.428  26.350  48.504  1.00 48.27    A  C
ATOM   12   CG   PRO A  30    33.705  26.704  48.211  1.00 47.79    A  C
ATOM   13   CD   PRO A  30    34.432  25.425  47.967  1.00 50.41    A  C
ATOM   14   C    PRO A  30    31.540  25.756  46.273  1.00 46.51    A  C
ATOM   15   O    PRO A  30    32.303  25.996  45.386  1.00 46.17    A  O
ATOM   16   N    PRO A  31    30.238  26.024  46.223  1.00 45.50    A  N
ATOM   17   CA   PRO A  31    29.507  26.216  44.973  1.00 43.85    A  C
ATOM   18   CB   PRO A  31    28.384  25.216  45.114  1.00 44.40    A  C
ATOM   19   CG   PRO A  31    28.787  24.277  46.184  1.00 43.84    A  C
ATOM   20   CD   PRO A  31    29.983  24.724  46.837  1.00 45.10    A  C
ATOM   21   C    PRO A  31    28.913  27.590  44.620  1.00 43.56    A  C
ATOM   22   O    PRO A  31    29.103  27.989  43.506  1.00 43.06    A  O
ATOM   23   N    GLY A  32    28.124  28.195  45.501  1.00 42.64    A  N
ATOM   24   CA   GLY A  32    27.751  29.610  45.578  1.00 39.71    A  C
ATOM   25   C    GLY A  32    27.753  30.099  47.039  1.00 38.08    A  C
ATOM   26   O    GLY A  32    27.086  31.031  47.422  1.00 36.27    A  O
ATOM   27   N    ARG A  33    28.546  29.419  47.842  1.00 36.62    A  N
ATOM   28   CA   ARG A  33    28.364  29.259  49.244  1.00 35.07    A  C
ATOM   29   CB   ARG A  33    28.378  27.785  49.569  1.00 33.35    A  C
ATOM   30   CG   ARG A  33    27.280  27.040  49.014  1.00 32.54    A  C
ATOM   31   CD   ARG A  33    26.290  26.692  50.054  1.00 35.49    A  C
ATOM   32   NE   ARG A  33    26.910  26.148  51.236  1.00 37.52    A  N
ATOM   33   CZ   ARG A  33    27.076  24.866  51.455  1.00 41.12    A  C
ATOM   34   NH1  ARG A  33    26.652  24.010  50.583  1.00 42.37    A  N
ATOM   35   NH2  ARG A  33    27.657  24.444  52.541  1.00 41.04    A  N
ATOM   36   C    ARG A  33    29.443  29.927  50.039  1.00 35.02    A  C
ATOM   37   O    ARG A  33    30.534  30.083  49.589  1.00 35.57    A  O
ATOM   38   N    LEU A  34    29.088  30.372  51.222  1.00 33.32    A  N
ATOM   39   CA   LEU A  34    30.027  30.929  52.161  1.00 31.06    A  C
ATOM   40   CB   LEU A  34    29.290  31.630  53.276  1.00 31.01    A  C
ATOM   41   CG   LEU A  34    28.298  32.672  52.825  1.00 32.21    A  C
ATOM   42   CD1  LEU A  34    27.531  33.255  53.915  1.00 31.63    A  C
ATOM   43   CD2  LEU A  34    28.974  33.712  52.108  1.00 31.32    A  C
ATOM   44   C    LEU A  34    31.024  29.958  52.716  1.00 29.99    A  C
ATOM   45   O    LEU A  34    32.148  30.276  52.833  1.00 29.83    A  O
ATOM   46   N    ALA A  35    30.595  28.773  53.075  1.00 29.15    A  N
ATOM   47   CA   ALA A  35    31.476  27.790  53.617  1.00 28.73    A  C
ATOM   48   CB   ALA A  35    31.451  27.864  55.047  1.00 28.39    A  C
ATOM   49   C    ALA A  35    31.033  26.445  53.160  1.00 29.46    A  C
ATOM   50   O    ALA A  35    29.936  26.289  52.818  1.00 29.43    A  O
ATOM   51   N    THR A  36    31.918  25.477  53.178  1.00 30.56    A  N
ATOM   52   CA   THR A  36    31.602  24.121  52.820  1.00 32.34    A  C
ATOM   53   CB   THR A  36    32.842  23.259  52.647  1.00 33.59    A  C
```

Appendix 1

```
ATOM   54  OG1 THR A  36      33.557  23.199  53.865  1.00 33.09      A  O
ATOM   55  CG2 THR A  36      33.729  23.795  51.622  1.00 32.03      A  C
ATOM   56  C   THR A  36      30.824  23.500  53.904  1.00 33.90      A  C
ATOM   57  O   THR A  36      30.888  23.933  54.991  1.00 34.85      A  O
ATOM   58  N   THR A  37      30.088  22.463  53.589  1.00 35.00      A  N
ATOM   59  CA  THR A  37      29.333  21.718  54.546  1.00 34.41      A  C
ATOM   60  CB  THR A  37      28.485  20.666  53.858  1.00 34.22      A  C
ATOM   61  OG1 THR A  37      27.513  21.301  53.055  1.00 36.58      A  O
ATOM   62  CG2 THR A  37      27.774  19.849  54.810  1.00 31.60      A  C
ATOM   63  C   THR A  37      30.282  21.087  55.496  1.00 35.06      A  C
ATOM   64  O   THR A  37      30.035  21.025  56.656  1.00 36.22      A  O
ATOM   65  N   GLU A  38      31.407  20.657  54.980  1.00 35.90      A  N
ATOM   66  CA  GLU A  38      32.379  19.958  55.754  1.00 36.71      A  C
ATOM   67  CB  GLU A  38      33.530  19.561  54.862  1.00 37.65      A  C
ATOM   68  CG  GLU A  38      34.731  19.082  55.587  1.00 43.64      A  C
ATOM   69  CD  GLU A  38      35.797  18.539  54.681  1.00 50.66      A  C
ATOM   70  OE1 GLU A  38      35.582  17.484  54.084  1.00 52.30      A  O
ATOM   71  OE2 GLU A  38      36.860  19.156  54.569  1.00 52.82      A  O
ATOM   72  C   GLU A  38      32.841  20.851  56.866  1.00 35.62      A  C
ATOM   73  O   GLU A  38      33.000  20.428  57.967  1.00 36.44      A  O
ATOM   74  N   ASP A  39      33.002  22.110  56.563  1.00 34.46      A  N
ATOM   75  CA  ASP A  39      33.332  23.091  57.543  1.00 33.87      A  C
ATOM   76  CB  ASP A  39      33.750  24.376  56.882  1.00 33.19      A  C
ATOM   77  CG  ASP A  39      35.139  24.324  56.355  1.00 38.69      A  C
ATOM   78  OD1 ASP A  39      35.871  23.358  56.579  1.00 40.82      A  O
ATOM   79  OD2 ASP A  39      35.521  25.277  55.702  1.00 42.97      A  O
ATOM   80  C   ASP A  39      32.302  23.332  58.620  1.00 33.35      A  C
ATOM   81  O   ASP A  39      32.672  23.526  59.722  1.00 34.24      A  O
ATOM   82  N   TYR A  40      31.015  23.334  58.320  1.00 32.43      A  N
ATOM   83  CA  TYR A  40      29.995  23.502  59.358  1.00 30.75      A  C
ATOM   84  CB  TYR A  40      28.622  23.746  58.750  1.00 30.17      A  C
ATOM   85  CG  TYR A  40      28.535  25.027  58.014  1.00 28.53      A  C
ATOM   86  CD1 TYR A  40      28.866  26.200  58.606  1.00 28.48      A  C
ATOM   87  CE1 TYR A  40      28.796  27.338  57.930  1.00 28.71      A  C
ATOM   88  CZ  TYR A  40      28.403  27.332  56.644  1.00 31.13      A  C
ATOM   89  OH  TYR A  40      28.354  28.514  55.995  1.00 30.98      A  O
ATOM   90  CE2 TYR A  40      28.081  26.190  56.045  1.00 24.50      A  C
ATOM   91  CD2 TYR A  40      28.146  25.059  56.715  1.00 27.20      A  C
ATOM   92  C   TYR A  40      29.921  22.396  60.375  1.00 29.89      A  C
ATOM   93  O   TYR A  40      29.842  22.638  61.530  1.00 28.77      A  O
ATOM   94  N   PHE A  41      29.956  21.167  59.914  1.00 30.02      A  N
ATOM   95  CA  PHE A  41      30.006  19.985  60.758  1.00 29.92      A  C
ATOM   96  CB  PHE A  41      29.693  18.723  59.966  1.00 29.04      A  C
ATOM   97  CG  PHE A  41      28.268  18.593  59.546  1.00 29.20      A  C
ATOM   98  CD1 PHE A  41      27.466  17.634  60.068  1.00 29.05      A  C
ATOM   99  CE1 PHE A  41      26.199  17.526  59.666  1.00 29.73      A  C
ATOM  100  CZ  PHE A  41      25.708  18.369  58.743  1.00 30.08      A  C
ATOM  101  CE2 PHE A  41      26.487  19.301  58.214  1.00 27.59      A  C
ATOM  102  CD2 PHE A  41      27.747  19.409  58.602  1.00 28.04      A  C
ATOM  103  C   PHE A  41      31.291  19.834  61.552  1.00 30.30      A  C
ATOM  104  O   PHE A  41      31.333  19.185  62.538  1.00 30.91      A  O
ATOM  105  N   ALA A  42      32.346  20.449  61.108  1.00 31.94      A  N
ATOM  106  CA  ALA A  42      33.583  20.352  61.815  1.00 33.74      A  C
ATOM  107  CB  ALA A  42      34.680  20.436  60.873  1.00 32.97      A  C
```

Appendix 1

```
ATOM    108  C    ALA A  42      33.755  21.395  62.899  1.00 35.38      A  C
ATOM    109  O    ALA A  42      34.725  21.391  63.595  1.00 36.37      A  O
ATOM    110  N    GLN A  43      32.808  22.293  63.050  1.00 35.41      A  N
ATOM    111  CA   GLN A  43      32.996  23.421  63.904  1.00 34.69      A  C
ATOM    112  CB   GLN A  43      31.734  24.269  63.877  1.00 33.20      A  C
ATOM    113  CG   GLN A  43      31.712  25.399  62.917  1.00 32.52      A  C
ATOM    114  CD   GLN A  43      30.326  25.903  62.629  1.00 32.33      A  C
ATOM    115  OE1  GLN A  43      29.452  25.143  62.340  1.00 31.16      A  O
ATOM    116  NE2  GLN A  43      30.139  27.176  62.692  1.00 26.66      A  N
ATOM    117  C    GLN A  43      33.250  22.970  65.311  1.00 34.94      A  C
ATOM    118  O    GLN A  43      34.080  23.487  65.977  1.00 34.85      A  O
ATOM    119  N    GLN A  44      32.502  22.011  65.784  1.00 35.64      A  N
ATOM    120  CA   GLN A  44      32.625  21.580  67.148  1.00 37.00      A  C
ATOM    121  CB   GLN A  44      31.523  20.581  67.435  1.00 36.78      A  C
ATOM    122  CG   GLN A  44      31.023  20.552  68.813  1.00 41.59      A  C
ATOM    123  CD   GLN A  44      29.779  19.744  68.943  1.00 50.57      A  C
ATOM    124  OE1  GLN A  44      28.967  19.684  68.034  1.00 55.20      A  O
ATOM    125  NE2  GLN A  44      29.606  19.119  70.079  1.00 49.93      A  N
ATOM    126  C    GLN A  44      33.965  20.969  67.477  1.00 36.49      A  C
ATOM    127  O    GLN A  44      34.572  21.330  68.424  1.00 35.11      A  O
ATOM    128  N    ALA A  45      34.439  20.058  66.658  1.00 37.40      A  N
ATOM    129  CA   ALA A  45      35.756  19.463  66.835  1.00 39.17      A  C
ATOM    130  CB   ALA A  45      35.941  18.411  65.849  1.00 38.84      A  C
ATOM    131  C    ALA A  45      36.910  20.458  66.749  1.00 40.17      A  C
ATOM    132  O    ALA A  45      37.877  20.345  67.458  1.00 40.44      A  O
ATOM    133  N    LYS A  46      36.790  21.397  65.826  1.00 40.78      A  N
ATOM    134  CA   LYS A  46      37.641  22.551  65.665  1.00 40.57      A  C
ATOM    135  CB   LYS A  46      37.411  23.193  64.313  1.00 41.18      A  C
ATOM    136  CG   LYS A  46      37.828  22.368  63.127  1.00 42.96      A  C
ATOM    137  CD   LYS A  46      38.058  23.231  61.929  1.00 45.46      A  C
ATOM    138  CE   LYS A  46      38.566  22.445  60.776  1.00 48.66      A  C
ATOM    139  NZ   LYS A  46      37.885  22.733  59.514  1.00 50.07      A  N
ATOM    140  C    LYS A  46      37.487  23.599  66.731  1.00 41.54      A  C
ATOM    141  O    LYS A  46      38.345  24.407  66.903  1.00 42.03      A  O
ATOM    142  N    GLN A  47      36.370  23.638  67.420  1.00 41.54      A  N
ATOM    143  CA   GLN A  47      36.278  24.523  68.541  1.00 41.24      A  C
ATOM    144  CB   GLN A  47      37.531  24.402  69.319  1.00 42.17      A  C
ATOM    145  CG   GLN A  47      37.340  24.545  70.734  1.00 46.59      A  C
ATOM    146  CD   GLN A  47      37.138  23.238  71.345  1.00 52.10      A  C
ATOM    147  OE1  GLN A  47      36.177  22.562  71.032  1.00 54.84      A  O
ATOM    148  NE2  GLN A  47      38.041  22.840  72.217  1.00 50.59      A  N
ATOM    149  C    GLN A  47      36.155  25.952  68.163  1.00 40.29      A  C
ATOM    150  O    GLN A  47      36.410  26.808  68.960  1.00 40.99      A  O
ATOM    151  N    ALA A  48      35.791  26.196  66.924  1.00 38.60      A  N
ATOM    152  CA   ALA A  48      35.639  27.517  66.405  1.00 37.03      A  C
ATOM    153  CB   ALA A  48      36.867  27.871  65.711  1.00 34.20      A  C
ATOM    154  C    ALA A  48      34.491  27.533  65.443  1.00 36.35      A  C
ATOM    155  O    ALA A  48      34.292  26.613  64.737  1.00 37.18      A  O
ATOM    156  N    VAL A  49      33.736  28.598  65.416  1.00 35.80      A  N
ATOM    157  CA   VAL A  49      32.778  28.800  64.368  1.00 35.12      A  C
ATOM    158  CB   VAL A  49      31.661  29.751  64.801  1.00 35.49      A  C
ATOM    159  CG1  VAL A  49      30.995  29.247  66.016  1.00 35.39      A  C
ATOM    160  CG2  VAL A  49      32.180  31.089  65.054  1.00 34.48      A  C
ATOM    161  C    VAL A  49      33.457  29.292  63.113  1.00 35.13      A  C
```

Appendix 1

| | | | | | | | | | | | |
|---|---|---|---|---|---|---|---|---|---|---|---|
| ATOM | 162 | O | VAL | A | 49 | 34.485 | 29.900 | 63.175 | 1.00 | 35.81 | A | O |
| ATOM | 163 | N | THR | A | 50 | 32.853 | 29.028 | 61.977 | 1.00 | 34.38 | A | N |
| ATOM | 164 | CA | THR | A | 50 | 33.373 | 29.431 | 60.701 | 1.00 | 34.19 | A | C |
| ATOM | 165 | CB | THR | A | 50 | 32.601 | 28.856 | 59.543 | 1.00 | 33.72 | A | C |
| ATOM | 166 | OG1 | THR | A | 50 | 31.326 | 29.446 | 59.521 | 1.00 | 34.22 | A | O |
| ATOM | 167 | CG2 | THR | A | 50 | 32.435 | 27.424 | 59.667 | 1.00 | 31.32 | A | C |
| ATOM | 168 | C | THR | A | 50 | 33.194 | 30.896 | 60.621 | 1.00 | 35.46 | A | C |
| ATOM | 169 | O | THR | A | 50 | 32.413 | 31.446 | 61.311 | 1.00 | 38.13 | A | O |
| ATOM | 170 | N | PRO | A | 51 | 33.912 | 31.535 | 59.749 | 1.00 | 34.72 | A | N |
| ATOM | 171 | CA | PRO | A | 51 | 33.907 | 32.971 | 59.662 | 1.00 | 34.59 | A | C |
| ATOM | 172 | CB | PRO | A | 51 | 34.933 | 33.224 | 58.573 | 1.00 | 35.21 | A | C |
| ATOM | 173 | CG | PRO | A | 51 | 35.818 | 32.138 | 58.696 | 1.00 | 35.31 | A | C |
| ATOM | 174 | CD | PRO | A | 51 | 35.021 | 30.968 | 59.003 | 1.00 | 34.13 | A | C |
| ATOM | 175 | C | PRO | A | 51 | 32.562 | 33.577 | 59.315 | 1.00 | 34.29 | A | C |
| ATOM | 176 | O | PRO | A | 51 | 32.288 | 34.640 | 59.770 | 1.00 | 35.13 | A | O |
| ATOM | 177 | N | ASP | A | 52 | 31.761 | 32.941 | 58.491 | 1.00 | 32.10 | A | N |
| ATOM | 178 | CA | ASP | A | 52 | 30.440 | 33.438 | 58.199 | 1.00 | 30.30 | A | C |
| ATOM | 179 | CB | ASP | A | 52 | 29.790 | 32.749 | 57.007 | 1.00 | 29.80 | A | C |
| ATOM | 180 | CG | ASP | A | 52 | 29.772 | 31.285 | 57.110 | 1.00 | 31.91 | A | C |
| ATOM | 181 | OD1 | ASP | A | 52 | 30.654 | 30.720 | 57.717 | 1.00 | 34.80 | A | O |
| ATOM | 182 | OD2 | ASP | A | 52 | 28.881 | 30.684 | 56.552 | 1.00 | 36.92 | A | O-1 |
| ATOM | 183 | C | ASP | A | 52 | 29.531 | 33.437 | 59.386 | 1.00 | 30.15 | A | C |
| ATOM | 184 | O | ASP | A | 52 | 28.747 | 34.310 | 59.550 | 1.00 | 30.76 | A | O |
| ATOM | 185 | N | VAL | A | 53 | 29.647 | 32.430 | 60.208 | 1.00 | 29.22 | A | N |
| ATOM | 186 | CA | VAL | A | 53 | 28.927 | 32.365 | 61.441 | 1.00 | 28.00 | A | C |
| ATOM | 187 | CB | VAL | A | 53 | 29.066 | 31.006 | 62.085 | 1.00 | 27.97 | A | C |
| ATOM | 188 | CG1 | VAL | A | 53 | 28.560 | 31.027 | 63.432 | 1.00 | 25.04 | A | C |
| ATOM | 189 | CG2 | VAL | A | 53 | 28.331 | 30.046 | 61.320 | 1.00 | 24.82 | A | C |
| ATOM | 190 | C | VAL | A | 53 | 29.341 | 33.462 | 62.385 | 1.00 | 28.14 | A | C |
| ATOM | 191 | O | VAL | A | 53 | 28.528 | 34.046 | 63.015 | 1.00 | 28.55 | A | O |
| ATOM | 192 | N | MET | A | 54 | 30.622 | 33.748 | 62.447 | 1.00 | 27.81 | A | N |
| ATOM | 193 | CA | MET | A | 54 | 31.101 | 34.831 | 63.231 | 1.00 | 27.06 | A | C |
| ATOM | 194 | CB | MET | A | 54 | 32.619 | 34.906 | 63.217 | 1.00 | 27.73 | A | C |
| ATOM | 195 | CG | MET | A | 54 | 33.209 | 35.911 | 64.152 | 1.00 | 31.56 | A | C |
| ATOM | 196 | SD | MET | A | 54 | 32.820 | 35.710 | 65.857 | 1.00 | 41.03 | A | S |
| ATOM | 197 | CE | MET | A | 54 | 34.317 | 35.082 | 66.470 | 1.00 | 45.40 | A | C |
| ATOM | 198 | C | MET | A | 54 | 30.500 | 36.065 | 62.673 | 1.00 | 25.19 | A | C |
| ATOM | 199 | O | MET | A | 54 | 30.119 | 36.914 | 63.394 | 1.00 | 24.72 | A | O |
| ATOM | 200 | N | ALA | A | 55 | 30.392 | 36.147 | 61.372 | 1.00 | 24.86 | A | N |
| ATOM | 201 | CA | ALA | A | 55 | 29.729 | 37.261 | 60.722 | 1.00 | 25.59 | A | C |
| ATOM | 202 | CB | ALA | A | 55 | 30.034 | 37.293 | 59.271 | 1.00 | 24.34 | A | C |
| ATOM | 203 | C | ALA | A | 55 | 28.233 | 37.440 | 60.983 | 1.00 | 25.46 | A | C |
| ATOM | 204 | O | ALA | A | 55 | 27.766 | 38.526 | 61.022 | 1.00 | 26.68 | A | O |
| ATOM | 205 | N | GLN | A | 56 | 27.493 | 36.365 | 61.101 | 1.00 | 24.53 | A | N |
| ATOM | 206 | CA | GLN | A | 56 | 26.124 | 36.411 | 61.528 | 1.00 | 23.11 | A | C |
| ATOM | 207 | CB | GLN | A | 56 | 25.428 | 35.061 | 61.329 | 1.00 | 25.05 | A | C |
| ATOM | 208 | CG | GLN | A | 56 | 24.083 | 34.899 | 61.985 | 1.00 | 23.56 | A | C |
| ATOM | 209 | CD | GLN | A | 56 | 23.008 | 35.670 | 61.340 | 1.00 | 23.13 | A | C |
| ATOM | 210 | OE1 | GLN | A | 56 | 23.126 | 36.073 | 60.234 | 1.00 | 26.87 | A | O |
| ATOM | 211 | NE2 | GLN | A | 56 | 21.969 | 35.897 | 62.038 | 1.00 | 26.30 | A | N |
| ATOM | 212 | C | GLN | A | 56 | 26.059 | 36.878 | 62.947 | 1.00 | 22.92 | A | C |
| ATOM | 213 | O | GLN | A | 56 | 25.218 | 37.607 | 63.319 | 1.00 | 22.81 | A | O |
| ATOM | 214 | N | LEU | A | 57 | 26.999 | 36.459 | 63.740 | 1.00 | 22.60 | A | N |
| ATOM | 215 | CA | LEU | A | 57 | 27.083 | 36.887 | 65.115 | 1.00 | 23.28 | A | C |

Appendix 1

```
ATOM    216  CB   LEU A  57      28.181  36.133  65.828  1.00 22.84      A  C
ATOM    217  CG   LEU A  57      27.940  35.131  66.915  1.00 25.37      A  C
ATOM    218  CD1  LEU A  57      26.538  34.718  66.957  1.00 30.12      A  C
ATOM    219  CD2  LEU A  57      28.805  33.970  66.791  1.00 19.68      A  C
ATOM    220  C    LEU A  57      27.323  38.360  65.189  1.00 22.88      A  C
ATOM    221  O    LEU A  57      26.864  39.001  66.051  1.00 21.97      A  O
ATOM    222  N    ALA A  58      28.111  38.878  64.291  1.00 23.78      A  N
ATOM    223  CA   ALA A  58      28.279  40.290  64.170  1.00 24.22      A  C
ATOM    224  CB   ALA A  58      29.421  40.586  63.345  1.00 22.00      A  C
ATOM    225  C    ALA A  58      27.032  41.028  63.715  1.00 24.88      A  C
ATOM    226  O    ALA A  58      26.727  42.034  64.250  1.00 24.79      A  O
ATOM    227  N    TYR A  59      26.280  40.493  62.777  1.00 26.86      A  N
ATOM    228  CA   TYR A  59      25.063  41.130  62.374  1.00 28.06      A  C
ATOM    229  CB   TYR A  59      24.315  40.352  61.285  1.00 27.58      A  C
ATOM    230  CG   TYR A  59      22.841  40.608  61.347  1.00 31.31      A  C
ATOM    231  CD1  TYR A  59      22.312  41.803  60.954  1.00 35.62      A  C
ATOM    232  CE1  TYR A  59      21.020  42.047  61.047  1.00 36.39      A  C
ATOM    233  CZ   TYR A  59      20.205  41.113  61.548  1.00 37.05      A  C
ATOM    234  OH   TYR A  59      18.873  41.353  61.659  1.00 32.81      A  O
ATOM    235  CE2  TYR A  59      20.703  39.938  61.954  1.00 32.66      A  C
ATOM    236  CD2  TYR A  59      21.992  39.691  61.854  1.00 30.91      A  C
ATOM    237  C    TYR A  59      24.223  41.205  63.618  1.00 29.22      A  C
ATOM    238  O    TYR A  59      23.586  42.194  63.883  1.00 32.56      A  O
ATOM    239  N    MET A  60      24.245  40.150  64.395  1.00 28.08      A  N
ATOM    240  CA   MET A  60      23.517  40.089  65.627  1.00 27.38      A  C
ATOM    241  CB   MET A  60      23.484  38.645  66.107  1.00 27.87      A  C
ATOM    242  CG   MET A  60      22.557  37.730  65.340  1.00 23.09      A  C
ATOM    243  SD   MET A  60      22.935  36.030  65.501  1.00 25.36      A  S
ATOM    244  CE   MET A  60      22.011  35.549  66.882  1.00 18.35      A  C
ATOM    245  C    MET A  60      23.952  41.060  66.733  1.00 28.71      A  C
ATOM    246  O    MET A  60      23.171  41.548  67.482  1.00 27.52      A  O
ATOM    247  N    ASN A  61      25.227  41.327  66.865  1.00 29.73      A  N
ATOM    248  CA   ASN A  61      25.677  42.062  68.022  1.00 28.95      A  C
ATOM    249  CB   ASN A  61      26.684  41.207  68.765  1.00 27.24      A  C
ATOM    250  CG   ASN A  61      26.074  40.037  69.405  1.00 31.20      A  C
ATOM    251  OD1  ASN A  61      25.590  40.124  70.486  1.00 35.93      A  O
ATOM    252  ND2  ASN A  61      26.116  38.925  68.758  1.00 31.28      A  N
ATOM    253  C    ASN A  61      26.278  43.430  67.829  1.00 29.20      A  C
ATOM    254  O    ASN A  61      26.257  44.220  68.702  1.00 27.64      A  O
ATOM    255  N    TYR A  62      26.874  43.659  66.686  1.00 30.23      A  N
ATOM    256  CA   TYR A  62      27.728  44.802  66.477  1.00 31.38      A  C
ATOM    257  CB   TYR A  62      28.565  44.531  65.234  1.00 31.14      A  C
ATOM    258  CG   TYR A  62      29.830  45.264  65.198  1.00 31.69      A  C
ATOM    259  CD1  TYR A  62      31.020  44.623  65.280  1.00 34.63      A  C
ATOM    260  CE1  TYR A  62      32.166  45.307  65.263  1.00 33.88      A  C
ATOM    261  CZ   TYR A  62      32.130  46.638  65.177  1.00 34.13      A  C
ATOM    262  OH   TYR A  62      33.256  47.338  65.154  1.00 31.65      A  O
ATOM    263  CE2  TYR A  62      30.969  47.282  65.103  1.00 33.01      A  C
ATOM    264  CD2  TYR A  62      29.840  46.604  65.109  1.00 32.71      A  C
ATOM    265  C    TYR A  62      27.188  46.214  66.408  1.00 31.38      A  C
ATOM    266  O    TYR A  62      27.656  47.055  67.093  1.00 31.71      A  O
ATOM    267  N    ILE A  63      26.255  46.511  65.539  1.00 32.53      A  N
ATOM    268  CA   ILE A  63      25.807  47.877  65.417  1.00 31.66      A  C
ATOM    269  CB   ILE A  63      25.208  48.196  64.071  1.00 30.89      A  C
```

Appendix 1

```
ATOM    270  CG1 ILE A   63      26.172  47.826  62.987  1.00  28.01      A    C
ATOM    271  CD1 ILE A   63      25.621  48.056  61.667  1.00  21.25      A    C
ATOM    272  CG2 ILE A   63      24.954  49.636  63.957  1.00  26.49      A    C
ATOM    273  C   ILE A   63      24.914  48.355  66.511  1.00  33.07      A    C
ATOM    274  O   ILE A   63      24.164  47.632  67.059  1.00  33.22      A    O
ATOM    275  N   ASP A   64      25.021  49.629  66.779  1.00  34.83      A    N
ATOM    276  CA  ASP A   64      24.557  50.224  67.985  1.00  36.62      A    C
ATOM    277  CB  ASP A   64      25.064  51.636  68.050  1.00  38.10      A    C
ATOM    278  CG  ASP A   64      26.060  51.848  69.123  1.00  42.28      A    C
ATOM    279  OD1 ASP A   64      26.501  50.898  69.747  1.00  49.29      A    O
ATOM    280  OD2 ASP A   64      26.433  52.989  69.326  1.00  45.02      A    O
ATOM    281  C   ASP A   64      23.089  50.235  68.336  1.00  36.70      A    C
ATOM    282  O   ASP A   64      22.754  50.071  69.451  1.00  37.25      A    O
ATOM    283  N   PHE A   65      22.164  50.515  67.485  1.00  35.21      A    N
ATOM    284  CA  PHE A   65      20.862  50.440  68.111  1.00  35.68      A    C
ATOM    285  CB  PHE A   65      20.209  51.806  68.168  1.00  35.31      A    C
ATOM    286  CG  PHE A   65      20.949  52.768  69.000  1.00  34.17      A    C
ATOM    287  CD1 PHE A   65      20.923  52.680  70.353  1.00  29.49      A    C
ATOM    288  CE1 PHE A   65      21.609  53.542  71.100  1.00  26.86      A    C
ATOM    289  CZ  PHE A   65      22.341  54.492  70.527  1.00  29.70      A    C
ATOM    290  CE2 PHE A   65      22.382  54.604  69.197  1.00  25.79      A    C
ATOM    291  CD2 PHE A   65      21.700  53.746  68.432  1.00  31.77      A    C
ATOM    292  C   PHE A   65      19.994  49.444  67.443  1.00  34.93      A    C
ATOM    293  O   PHE A   65      19.024  48.986  67.975  1.00  34.13      A    O
ATOM    294  N   ILE A   66      20.397  49.137  66.232  1.00  34.72      A    N
ATOM    295  CA  ILE A   66      19.616  48.387  65.311  1.00  33.38      A    C
ATOM    296  CB  ILE A   66      19.675  49.061  63.964  1.00  33.61      A    C
ATOM    297  CG1 ILE A   66      21.070  49.059  63.436  1.00  31.92      A    C
ATOM    298  CD1 ILE A   66      21.083  49.260  62.058  1.00  29.78      A    C
ATOM    299  CG2 ILE A   66      19.344  50.457  64.101  1.00  33.73      A    C
ATOM    300  C   ILE A   66      19.938  46.924  65.193  1.00  33.06      A    C
ATOM    301  O   ILE A   66      19.275  46.228  64.470  1.00  32.19      A    O
ATOM    302  N   SER A   67      20.961  46.467  65.894  1.00  31.95      A    N
ATOM    303  CA  SER A   67      21.249  45.053  65.987  1.00  31.77      A    C
ATOM    304  CB  SER A   67      22.711  44.773  66.327  1.00  31.82      A    C
ATOM    305  OG  SER A   67      23.106  45.237  67.562  1.00  31.04      A    O
ATOM    306  C   SER A   67      20.273  44.377  66.921  1.00  32.04      A    C
ATOM    307  O   SER A   67      19.788  44.992  67.804  1.00  31.27      A    O
ATOM    308  N   PRO A   68      19.936  43.129  66.677  1.00  32.26      A    N
ATOM    309  CA  PRO A   68      18.900  42.458  67.443  1.00  32.04      A    C
ATOM    310  CB  PRO A   68      18.743  41.132  66.723  1.00  30.06      A    C
ATOM    311  CG  PRO A   68      19.718  41.101  65.754  1.00  31.66      A    C
ATOM    312  CD  PRO A   68      20.139  42.440  65.418  1.00  32.58      A    C
ATOM    313  C   PRO A   68      19.198  42.256  68.910  1.00  32.06      A    C
ATOM    314  O   PRO A   68      18.353  42.420  69.748  1.00  32.23      A    O
ATOM    315  N   PHE A   69      20.420  41.906  69.204  1.00  30.06      A    N
ATOM    316  CA  PHE A   69      20.804  41.631  70.550  1.00  29.78      A    C
ATOM    317  CB  PHE A   69      21.546  40.332  70.643  1.00  29.69      A    C
ATOM    318  CG  PHE A   69      20.718  39.182  70.306  1.00  30.64      A    C
ATOM    319  CD1 PHE A   69      20.067  38.522  71.252  1.00  32.03      A    C
ATOM    320  CE1 PHE A   69      19.319  37.523  70.941  1.00  33.82      A    C
ATOM    321  CZ  PHE A   69      19.169  37.157  69.692  1.00  33.66      A    C
ATOM    322  CE2 PHE A   69      19.769  37.794  68.732  1.00  30.64      A    C
ATOM    323  CD2 PHE A   69      20.543  38.796  69.025  1.00  32.57      A    C
```

Appendix 1

```
ATOM    324  C   PHE A  69      21.570  42.727  71.200  1.00  30.51      A  C
ATOM    325  O   PHE A  69      22.369  42.471  72.013  1.00  31.92      A  O
ATOM    326  N   TYR A  70      21.345  43.952  70.790  1.00  29.85      A  N
ATOM    327  CA  TYR A  70      21.926  45.106  71.407  1.00  29.97      A  C
ATOM    328  CB  TYR A  70      21.616  46.303  70.548  1.00  29.72      A  C
ATOM    329  CG  TYR A  70      22.109  47.569  71.135  1.00  31.35      A  C
ATOM    330  CD1 TYR A  70      23.443  47.850  71.162  1.00  32.40      A  C
ATOM    331  CE1 TYR A  70      23.894  48.967  71.706  1.00  31.85      A  C
ATOM    332  CZ  TYR A  70      23.035  49.827  72.247  1.00  33.47      A  C
ATOM    333  OH  TYR A  70      23.513  50.955  72.768  1.00  36.40      A  O
ATOM    334  CE2 TYR A  70      21.707  49.586  72.246  1.00  32.22      A  C
ATOM    335  CD2 TYR A  70      21.249  48.470  71.692  1.00  29.97      A  C
ATOM    336  C   TYR A  70      21.501  45.392  72.834  1.00  31.01      A  C
ATOM    337  O   TYR A  70      22.292  45.706  73.679  1.00  31.90      A  O
ATOM    338  N   SER A  71      20.222  45.302  73.083  1.00  32.00      A  N
ATOM    339  CA  SER A  71      19.683  45.759  74.315  1.00  32.95      A  C
ATOM    340  CB  SER A  71      19.000  47.069  74.078  1.00  32.36      A  C
ATOM    341  OG  SER A  71      19.164  47.854  75.196  1.00  37.40      A  O
ATOM    342  C   SER A  71      18.694  44.805  74.893  1.00  33.36      A  C
ATOM    343  O   SER A  71      18.119  44.056  74.193  1.00  33.28      A  O
ATOM    344  N   ARG A  72      18.496  44.862  76.194  1.00  34.26      A  N
ATOM    345  CA  ARG A  72      17.504  44.056  76.862  1.00  35.00      A  C
ATOM    346  CB  ARG A  72      18.022  43.510  78.186  1.00  33.97      A  C
ATOM    347  CG  ARG A  72      18.048  44.476  79.297  1.00  40.20      A  C
ATOM    348  CD  ARG A  72      17.893  43.793  80.605  1.00  48.14      A  C
ATOM    349  NE  ARG A  72      18.205  42.403  80.444  1.00  51.68      A  N
ATOM    350  CZ  ARG A  72      19.120  41.755  81.126  1.00  55.60      A  C
ATOM    351  NH1 ARG A  72      19.826  42.367  82.053  1.00  54.44      A  N
ATOM    352  NH2 ARG A  72      19.326  40.477  80.855  1.00  57.90      A  N
ATOM    353  C   ARG A  72      16.161  44.756  76.989  1.00  35.65      A  C
ATOM    354  O   ARG A  72      15.206  44.215  77.474  1.00  35.77      A  O
ATOM    355  N   GLY A  73      16.089  45.951  76.467  1.00  36.82      A  N
ATOM    356  CA  GLY A  73      14.884  46.735  76.482  1.00  38.75      A  C
ATOM    357  C   GLY A  73      13.844  46.373  75.466  1.00  39.57      A  C
ATOM    358  O   GLY A  73      14.088  45.640  74.577  1.00  40.54      A  O
ATOM    359  N   CYS A  74      12.677  46.939  75.576  1.00  39.81      A  N
ATOM    360  CA  CYS A  74      11.664  46.627  74.625  1.00  40.78      A  C
ATOM    361  CB  CYS A  74      10.331  46.859  75.266  1.00  40.68      A  C
ATOM    362  SG  CYS A  74      10.002  45.647  76.449  1.00  47.70      A  S
ATOM    363  C   CYS A  74      11.765  47.421  73.358  1.00  40.00      A  C
ATOM    364  O   CYS A  74      10.877  48.111  72.987  1.00  41.30      A  O
ATOM    365  N   SER A  75      12.870  47.263  72.678  1.00  38.68      A  N
ATOM    366  CA  SER A  75      13.093  47.869  71.418  1.00  38.25      A  C
ATOM    367  CB  SER A  75      14.397  48.588  71.489  1.00  37.83      A  C
ATOM    368  OG  SER A  75      14.749  49.086  70.231  1.00  45.17      A  O
ATOM    369  C   SER A  75      13.150  46.793  70.360  1.00  37.73      A  C
ATOM    370  O   SER A  75      13.733  45.793  70.562  1.00  37.57      A  O
ATOM    371  N   PHE A  76      12.483  46.975  69.242  1.00  37.24      A  N
ATOM    372  CA  PHE A  76      12.455  45.957  68.220  1.00  36.16      A  C
ATOM    373  CB  PHE A  76      11.134  45.224  68.214  1.00  36.28      A  C
ATOM    374  CG  PHE A  76      10.910  44.424  69.430  1.00  34.37      A  C
ATOM    375  CD1 PHE A  76      11.238  43.119  69.474  1.00  30.16      A  C
ATOM    376  CE1 PHE A  76      11.060  42.430  70.581  1.00  26.54      A  C
ATOM    377  CZ  PHE A  76      10.567  43.017  71.648  1.00  30.58      A  C
```

Appendix 1

```
ATOM    378  CE2 PHE A  76      10.265  44.290  71.638  1.00 28.55      A    C
ATOM    379  CD2 PHE A  76      10.415  44.995  70.545  1.00 28.76      A    C
ATOM    380  C   PHE A  76      12.808  46.473  66.867  1.00 37.12      A    C
ATOM    381  O   PHE A  76      12.273  46.044  65.895  1.00 36.44      A    O
ATOM    382  N   GLU A  77      13.758  47.388  66.852  1.00 38.15      A    N
ATOM    383  CA  GLU A  77      14.198  48.128  65.695  1.00 39.67      A    C
ATOM    384  CB  GLU A  77      15.279  49.114  66.120  1.00 40.85      A    C
ATOM    385  CG  GLU A  77      15.231  50.465  65.459  1.00 48.62      A    C
ATOM    386  CD  GLU A  77      15.426  51.641  66.425  1.00 58.34      A    C
ATOM    387  OE1 GLU A  77      14.563  51.871  67.288  1.00 59.85      A    O
ATOM    388  OE2 GLU A  77      16.431  52.359  66.299  1.00 60.77      A    O-1
ATOM    389  C   GLU A  77      14.749  47.203  64.656  1.00 38.38      A    C
ATOM    390  O   GLU A  77      14.592  47.416  63.503  1.00 38.53      A    O
ATOM    391  N   ALA A  78      15.424  46.172  65.102  1.00 37.42      A    N
ATOM    392  CA  ALA A  78      16.080  45.250  64.225  1.00 35.76      A    C
ATOM    393  CB  ALA A  78      16.880  44.292  65.036  1.00 35.48      A    C
ATOM    394  C   ALA A  78      15.130  44.503  63.343  1.00 34.66      A    C
ATOM    395  O   ALA A  78      15.423  44.284  62.215  1.00 34.91      A    O
ATOM    396  N   TRP A  79      14.030  44.059  63.916  1.00 32.72      A    N
ATOM    397  CA  TRP A  79      12.916  43.425  63.246  1.00 31.31      A    C
ATOM    398  CB  TRP A  79      12.032  42.697  64.251  1.00 29.04      A    C
ATOM    399  CG  TRP A  79      12.675  41.558  64.906  1.00 24.97      A    C
ATOM    400  CD1 TRP A  79      12.577  40.284  64.574  1.00 22.04      A    C
ATOM    401  NE1 TRP A  79      13.293  39.514  65.399  1.00 20.75      A    N
ATOM    402  CE2 TRP A  79      13.892  40.316  66.312  1.00 21.83      A    C
ATOM    403  CD2 TRP A  79      13.516  41.609  66.026  1.00 23.15      A    C
ATOM    404  CE3 TRP A  79      13.998  42.637  66.816  1.00 19.37      A    C
ATOM    405  CZ3 TRP A  79      14.792  42.350  67.811  1.00 23.22      A    C
ATOM    406  CH2 TRP A  79      15.147  41.048  68.091  1.00 25.56      A    C
ATOM    407  CZ2 TRP A  79      14.709  40.017  67.350  1.00 21.94      A    C
ATOM    408  C   TRP A  79      12.084  44.293  62.314  1.00 31.97      A    C
ATOM    409  O   TRP A  79      11.604  43.824  61.338  1.00 31.26      A    O
ATOM    410  N   GLU A  80      11.889  45.546  62.673  1.00 34.24      A    N
ATOM    411  CA  GLU A  80      11.161  46.503  61.870  1.00 36.62      A    C
ATOM    412  CB  GLU A  80      11.130  47.852  62.574  1.00 36.44      A    C
ATOM    413  CG  GLU A  80      10.058  48.073  63.565  1.00 40.57      A    C
ATOM    414  CD  GLU A  80      10.402  49.126  64.571  1.00 48.55      A    C
ATOM    415  OE1 GLU A  80       9.926  49.063  65.697  1.00 47.27      A    O
ATOM    416  OE2 GLU A  80      11.166  50.021  64.252  1.00 55.43      A    O-1
ATOM    417  C   GLU A  80      11.867  46.704  60.562  1.00 36.96      A    C
ATOM    418  O   GLU A  80      11.255  46.767  59.535  1.00 37.14      A    O
ATOM    419  N   LEU A  81      13.178  46.816  60.626  1.00 37.09      A    N
ATOM    420  CA  LEU A  81      14.013  46.946  59.455  1.00 38.92      A    C
ATOM    421  CB  LEU A  81      15.443  47.186  59.880  1.00 37.98      A    C
ATOM    422  CG  LEU A  81      15.727  48.533  60.489  1.00 40.00      A    C
ATOM    423  CD1 LEU A  81      16.935  48.472  61.316  1.00 40.90      A    C
ATOM    424  CD2 LEU A  81      15.891  49.546  59.459  1.00 41.62      A    C
ATOM    425  C   LEU A  81      13.968  45.741  58.552  1.00 39.23      A    C
ATOM    426  O   LEU A  81      13.952  45.858  57.371  1.00 39.92      A    O
ATOM    427  N   LYS A  82      13.990  44.583  59.166  1.00 38.92      A    N
ATOM    428  CA  LYS A  82      13.841  43.302  58.544  1.00 38.89      A    C
ATOM    429  CB  LYS A  82      14.206  42.238  59.544  1.00 40.06      A    C
ATOM    430  CG  LYS A  82      15.149  41.236  59.033  1.00 43.48      A    C
ATOM    431  CD  LYS A  82      16.183  40.967  60.028  1.00 43.87      A    C
```

Appendix 1

```
ATOM    432  CE   LYS A  82      15.691  40.084  61.103  1.00 43.04      A  C
ATOM    433  NZ   LYS A  82      16.238  38.793  60.834  1.00 42.26      A  N
ATOM    434  C    LYS A  82      12.441  43.067  58.010  1.00 37.72      A  C
ATOM    435  O    LYS A  82      12.218  42.271  57.149  1.00 36.09      A  O
ATOM    436  N    HIS A  83      11.490  43.781  58.548  1.00 36.51      A  N
ATOM    437  CA   HIS A  83      10.155  43.573  58.138  1.00 37.40      A  C
ATOM    438  CB   HIS A  83      10.159  43.553  56.645  1.00 39.29      A  C
ATOM    439  CG   HIS A  83      10.407  44.892  56.052  1.00 45.60      A  C
ATOM    440  ND1  HIS A  83       9.498  45.912  56.145  1.00 51.01      A  N
ATOM    441  CE1  HIS A  83       9.990  46.985  55.564  1.00 53.90      A  C
ATOM    442  NE2  HIS A  83      11.193  46.702  55.121  1.00 52.35      A  N
ATOM    443  CD2  HIS A  83      11.479  45.400  55.414  1.00 49.30      A  C
ATOM    444  C    HIS A  83       9.472  42.348  58.702  1.00 35.79      A  C
ATOM    445  O    HIS A  83       8.609  41.784  58.095  1.00 35.13      A  O
ATOM    446  N    THR A  84       9.838  41.972  59.895  1.00 33.72      A  N
ATOM    447  CA   THR A  84       9.255  40.833  60.499  1.00 31.06      A  C
ATOM    448  CB   THR A  84      10.092  40.418  61.680  1.00 30.99      A  C
ATOM    449  OG1  THR A  84      11.413  40.201  61.234  1.00 32.63      A  O
ATOM    450  CG2  THR A  84       9.603  39.176  62.249  1.00 28.91      A  C
ATOM    451  C    THR A  84       7.891  41.220  60.941  1.00 28.62      A  C
ATOM    452  O    THR A  84       7.742  42.188  61.587  1.00 28.76      A  O
ATOM    453  N    PRO A  85       6.894  40.446  60.588  1.00 25.95      A  N
ATOM    454  CA   PRO A  85       5.571  40.646  61.129  1.00 24.41      A  C
ATOM    455  CB   PRO A  85       4.762  39.639  60.368  1.00 24.68      A  C
ATOM    456  CG   PRO A  85       5.463  39.378  59.260  1.00 22.51      A  C
ATOM    457  CD   PRO A  85       6.854  39.450  59.533  1.00 25.10      A  C
ATOM    458  C    PRO A  85       5.492  40.318  62.585  1.00 23.27      A  C
ATOM    459  O    PRO A  85       6.147  39.440  62.996  1.00 22.30      A  O
ATOM    460  N    GLN A  86       4.618  40.971  63.312  1.00 22.94      A  N
ATOM    461  CA   GLN A  86       4.573  40.933  64.745  1.00 23.37      A  C
ATOM    462  CB   GLN A  86       3.404  41.753  65.249  1.00 23.01      A  C
ATOM    463  CG   GLN A  86       3.186  41.731  66.729  1.00 24.92      A  C
ATOM    464  CD   GLN A  86       2.371  40.562  67.253  1.00 30.36      A  C
ATOM    465  OE1  GLN A  86       1.418  40.165  66.663  1.00 35.62      A  O
ATOM    466  NE2  GLN A  86       2.733  40.061  68.385  1.00 28.81      A  N
ATOM    467  C    GLN A  86       4.403  39.540  65.235  1.00 23.67      A  C
ATOM    468  O    GLN A  86       4.971  39.179  66.190  1.00 23.57      A  O
ATOM    469  N    ARG A  87       3.607  38.759  64.564  1.00 24.43      A  N
ATOM    470  CA   ARG A  87       3.343  37.433  64.982  1.00 24.20      A  C
ATOM    471  CB   ARG A  87       2.208  36.873  64.185  1.00 24.70      A  C
ATOM    472  CG   ARG A  87       0.919  37.071  64.815  1.00 25.19      A  C
ATOM    473  CD   ARG A  87      -0.125  36.911  63.828  1.00 28.76      A  C
ATOM    474  NE   ARG A  87      -1.275  37.708  64.146  1.00 33.39      A  N
ATOM    475  CZ   ARG A  87      -2.232  37.320  64.948  1.00 31.35      A  C
ATOM    476  NH1  ARG A  87      -2.176  36.167  65.508  1.00 30.58      A  N
ATOM    477  NH2  ARG A  87      -3.240  38.082  65.180  1.00 30.86      A  N
ATOM    478  C    ARG A  87       4.510  36.527  64.903  1.00 23.38      A  C
ATOM    479  O    ARG A  87       4.515  35.526  65.493  1.00 25.42      A  O
ATOM    480  N    VAL A  88       5.481  36.865  64.110  1.00 22.84      A  N
ATOM    481  CA   VAL A  88       6.593  36.005  63.895  1.00 21.59      A  C
ATOM    482  CB   VAL A  88       6.983  36.108  62.451  1.00 22.51      A  C
ATOM    483  CG1  VAL A  88       8.037  35.169  62.102  1.00 22.63      A  C
ATOM    484  CG2  VAL A  88       5.843  35.869  61.677  1.00 20.61      A  C
ATOM    485  C    VAL A  88       7.767  36.315  64.765  1.00 20.97      A  C
```

Appendix 1

```
ATOM    486  O    VAL A  88       8.690  35.611  64.794  1.00  22.40       A    O
ATOM    487  N    ILE A  89       7.719  37.383  65.495  1.00  20.24       A    N
ATOM    488  CA   ILE A  89       8.855  37.792  66.269  1.00  20.97       A    C
ATOM    489  CB   ILE A  89       8.618  39.127  66.893  1.00  21.31       A    C
ATOM    490  CG1  ILE A  89       8.986  40.223  65.937  1.00  17.23       A    C
ATOM    491  CD1  ILE A  89       8.114  41.359  65.997  1.00  13.19       A    C
ATOM    492  CG2  ILE A  89       9.447  39.268  68.056  1.00  22.99       A    C
ATOM    493  C    ILE A  89       9.306  36.794  67.331  1.00  21.69       A    C
ATOM    494  O    ILE A  89      10.462  36.618  67.527  1.00  21.65       A    O
ATOM    495  N    LYS A  90       8.374  36.124  67.971  1.00  22.28       A    N
ATOM    496  CA   LYS A  90       8.663  35.150  68.985  1.00  22.89       A    C
ATOM    497  CB   LYS A  90       7.392  34.672  69.647  1.00  21.43       A    C
ATOM    498  CG   LYS A  90       6.393  34.255  68.668  1.00  24.13       A    C
ATOM    499  CD   LYS A  90       5.321  33.464  69.260  1.00  23.03       A    C
ATOM    500  CE   LYS A  90       4.409  34.344  69.992  1.00  23.62       A    C
ATOM    501  NZ   LYS A  90       3.583  35.126  69.113  1.00  26.68       A    N
ATOM    502  C    LYS A  90       9.430  33.986  68.461  1.00  23.19       A    C
ATOM    503  O    LYS A  90      10.253  33.467  69.139  1.00  23.02       A    O
ATOM    504  N    TYR A  91       9.122  33.562  67.257  1.00  24.84       A    N
ATOM    505  CA   TYR A  91       9.914  32.582  66.556  1.00  25.70       A    C
ATOM    506  CB   TYR A  91       9.234  32.148  65.282  1.00  26.69       A    C
ATOM    507  CG   TYR A  91       7.837  31.765  65.505  1.00  30.35       A    C
ATOM    508  CD1  TYR A  91       7.541  30.643  66.193  1.00  36.14       A    C
ATOM    509  CE1  TYR A  91       6.295  30.296  66.433  1.00  36.21       A    C
ATOM    510  CZ   TYR A  91       5.309  31.068  65.985  1.00  37.81       A    C
ATOM    511  OH   TYR A  91       4.046  30.686  66.238  1.00  42.51       A    O
ATOM    512  CE2  TYR A  91       5.575  32.203  65.298  1.00  33.19       A    C
ATOM    513  CD2  TYR A  91       6.818  32.545  65.071  1.00  29.56       A    C
ATOM    514  C    TYR A  91      11.266  33.065  66.241  1.00  24.37       A    C
ATOM    515  O    TYR A  91      12.189  32.361  66.399  1.00  23.91       A    O
ATOM    516  N    SER A  92      11.386  34.297  65.816  1.00  24.07       A    N
ATOM    517  CA   SER A  92      12.680  34.795  65.447  1.00  24.66       A    C
ATOM    518  CB   SER A  92      12.536  36.213  64.940  1.00  24.49       A    C
ATOM    519  OG   SER A  92      13.721  36.779  64.468  1.00  23.94       A    O
ATOM    520  C    SER A  92      13.600  34.766  66.625  1.00  25.23       A    C
ATOM    521  O    SER A  92      14.681  34.300  66.516  1.00  25.57       A    O
ATOM    522  N    ILE A  93      13.138  35.243  67.757  1.00  24.40       A    N
ATOM    523  CA   ILE A  93      13.924  35.276  68.937  1.00  23.72       A    C
ATOM    524  CB   ILE A  93      13.168  35.969  70.068  1.00  23.81       A    C
ATOM    525  CG1  ILE A  93      12.816  37.397  69.738  1.00  19.96       A    C
ATOM    526  CD1  ILE A  93      12.066  38.093  70.790  1.00  12.14       A    C
ATOM    527  CG2  ILE A  93      13.992  36.041  71.239  1.00  25.39       A    C
ATOM    528  C    ILE A  93      14.280  33.894  69.402  1.00  23.74       A    C
ATOM    529  O    ILE A  93      15.369  33.631  69.778  1.00  23.70       A    O
ATOM    530  N    ALA A  94      13.320  33.013  69.420  1.00  23.31       A    N
ATOM    531  CA   ALA A  94      13.538  31.691  69.903  1.00  22.18       A    C
ATOM    532  CB   ALA A  94      12.280  30.991  69.934  1.00  20.75       A    C
ATOM    533  C    ALA A  94      14.531  30.912  69.092  1.00  24.26       A    C
ATOM    534  O    ALA A  94      15.341  30.243  69.634  1.00  22.74       A    O
ATOM    535  N    PHE A  95      14.448  30.973  67.781  1.00  26.06       A    N
ATOM    536  CA   PHE A  95      15.403  30.287  66.926  1.00  28.03       A    C
ATOM    537  CB   PHE A  95      14.946  30.183  65.471  1.00  28.80       A    C
ATOM    538  CG   PHE A  95      13.677  29.441  65.291  1.00  31.07       A    C
ATOM    539  CD1  PHE A  95      13.512  28.209  65.801  1.00  35.96       A    C
```

Appendix 1

```
ATOM    540  CE1  PHE A  95      12.338  27.553  65.643  1.00  35.53      A    C
ATOM    541  CZ   PHE A  95      11.346  28.120  64.987  1.00  30.81      A    C
ATOM    542  CE2  PHE A  95      11.504  29.313  64.458  1.00  30.08      A    C
ATOM    543  CD2  PHE A  95      12.650  29.982  64.606  1.00  32.07      A    C
ATOM    544  C    PHE A  95      16.819  30.811  67.031  1.00  28.21      A    C
ATOM    545  O    PHE A  95      17.742  30.068  66.881  1.00  29.00      A    O
ATOM    546  N    TYR A  96      16.971  32.105  67.245  1.00  27.44      A    N
ATOM    547  CA   TYR A  96      18.250  32.724  67.458  1.00  25.27      A    C
ATOM    548  CB   TYR A  96      18.081  34.214  67.643  1.00  24.94      A    C
ATOM    549  CG   TYR A  96      18.177  35.077  66.430  1.00  25.16      A    C
ATOM    550  CD1  TYR A  96      19.056  34.807  65.439  1.00  22.71      A    C
ATOM    551  CE1  TYR A  96      19.138  35.577  64.370  1.00  25.48      A    C
ATOM    552  CZ   TYR A  96      18.343  36.673  64.261  1.00  28.93      A    C
ATOM    553  OH   TYR A  96      18.408  37.477  63.160  1.00  23.12      A    O
ATOM    554  CE2  TYR A  96      17.464  36.963  65.240  1.00  25.87      A    C
ATOM    555  CD2  TYR A  96      17.387  36.182  66.302  1.00  24.36      A    C
ATOM    556  C    TYR A  96      18.818  32.167  68.716  1.00  25.04      A    C
ATOM    557  O    TYR A  96      19.952  31.872  68.798  1.00  25.03      A    O
ATOM    558  N    ALA A  97      17.981  32.028  69.709  1.00  24.62      A    N
ATOM    559  CA   ALA A  97      18.350  31.486  70.977  1.00  23.81      A    C
ATOM    560  CB   ALA A  97      17.223  31.642  71.959  1.00  21.98      A    C
ATOM    561  C    ALA A  97      18.803  30.051  70.923  1.00  22.94      A    C
ATOM    562  O    ALA A  97      19.694  29.698  71.611  1.00  23.46      A    O
ATOM    563  N    TYR A  98      18.163  29.211  70.148  1.00  21.67      A    N
ATOM    564  CA   TYR A  98      18.604  27.846  70.017  1.00  22.21      A    C
ATOM    565  CB   TYR A  98      17.549  27.004  69.343  1.00  21.02      A    C
ATOM    566  CG   TYR A  98      16.213  27.148  69.997  1.00  22.68      A    C
ATOM    567  CD1  TYR A  98      16.114  27.544  71.287  1.00  23.40      A    C
ATOM    568  CE1  TYR A  98      14.947  27.681  71.870  1.00  24.13      A    C
ATOM    569  CZ   TYR A  98      13.843  27.461  71.174  1.00  26.56      A    C
ATOM    570  OH   TYR A  98      12.657  27.606  71.758  1.00  24.94      A    O
ATOM    571  CE2  TYR A  98      13.901  27.072  69.902  1.00  23.94      A    C
ATOM    572  CD2  TYR A  98      15.061  26.922  69.318  1.00  23.20      A    C
ATOM    573  C    TYR A  98      19.955  27.728  69.358  1.00  22.52      A    C
ATOM    574  O    TYR A  98      20.756  26.908  69.710  1.00  24.81      A    O
ATOM    575  N    GLY A  99      20.176  28.566  68.379  1.00  21.73      A    N
ATOM    576  CA   GLY A  99      21.435  28.705  67.717  1.00  22.58      A    C
ATOM    577  C    GLY A  99      22.504  29.238  68.602  1.00  24.00      A    C
ATOM    578  O    GLY A  99      23.627  28.879  68.524  1.00  24.70      A    O
ATOM    579  N    LEU A 100      22.124  30.156  69.445  1.00  24.27      A    N
ATOM    580  CA   LEU A 100      23.035  30.689  70.409  1.00  24.48      A    C
ATOM    581  CB   LEU A 100      22.439  31.895  71.111  1.00  23.20      A    C
ATOM    582  CG   LEU A 100      22.563  33.155  70.278  1.00  23.16      A    C
ATOM    583  CD1  LEU A 100      21.723  34.236  70.806  1.00  22.52      A    C
ATOM    584  CD2  LEU A 100      23.944  33.573  70.156  1.00  17.93      A    C
ATOM    585  C    LEU A 100      23.484  29.639  71.360  1.00  24.11      A    C
ATOM    586  O    LEU A 100      24.606  29.569  71.655  1.00  24.09      A    O
ATOM    587  N    ALA A 101      22.612  28.766  71.779  1.00  24.78      A    N
ATOM    588  CA   ALA A 101      23.018  27.737  72.691  1.00  25.58      A    C
ATOM    589  CB   ALA A 101      21.850  26.964  73.168  1.00  24.98      A    C
ATOM    590  C    ALA A 101      24.087  26.812  72.148  1.00  25.76      A    C
ATOM    591  O    ALA A 101      24.960  26.434  72.865  1.00  25.58      A    O
ATOM    592  N    SER A 102      23.993  26.444  70.887  1.00  25.39      A    N
ATOM    593  CA   SER A 102      25.003  25.672  70.184  1.00  25.55      A    C
```

Appendix 1

```
ATOM    594  CB   SER A 102      24.476  25.160  68.883  1.00 25.52       A    C
ATOM    595  OG   SER A 102      23.457  24.251  69.082  1.00 26.53       A    O
ATOM    596  C    SER A 102      26.350  26.318  69.977  1.00 26.36       A    C
ATOM    597  O    SER A 102      27.327  25.670  69.959  1.00 27.02       A    O
ATOM    598  N    VAL A 103      26.366  27.609  69.786  1.00 27.36       A    N
ATOM    599  CA   VAL A 103      27.570  28.363  69.651  1.00 28.49       A    C
ATOM    600  CB   VAL A 103      27.261  29.821  69.383  1.00 28.82       A    C
ATOM    601  CG1  VAL A 103      28.476  30.663  69.462  1.00 25.52       A    C
ATOM    602  CG2  VAL A 103      26.582  29.983  68.084  1.00 27.86       A    C
ATOM    603  C    VAL A 103      28.304  28.244  70.923  1.00 30.18       A    C
ATOM    604  O    VAL A 103      29.473  28.098  70.937  1.00 32.77       A    O
ATOM    605  N    ALA A 104      27.585  28.289  72.011  1.00 31.28       A    N
ATOM    606  CA   ALA A 104      28.177  28.152  73.301  1.00 32.78       A    C
ATOM    607  CB   ALA A 104      27.151  28.303  74.321  1.00 32.37       A    C
ATOM    608  C    ALA A 104      28.814  26.824  73.465  1.00 34.11       A    C
ATOM    609  O    ALA A 104      29.877  26.718  74.003  1.00 35.63       A    O
ATOM    610  N    LEU A 105      28.115  25.794  73.059  1.00 34.78       A    N
ATOM    611  CA   LEU A 105      28.666  24.475  73.072  1.00 36.30       A    C
ATOM    612  CB   LEU A 105      27.563  23.468  72.834  1.00 35.99       A    C
ATOM    613  CG   LEU A 105      27.832  21.994  73.010  1.00 38.62       A    C
ATOM    614  CD1  LEU A 105      28.362  21.705  74.336  1.00 40.16       A    C
ATOM    615  CD2  LEU A 105      26.604  21.246  72.781  1.00 36.30       A    C
ATOM    616  C    LEU A 105      29.843  24.303  72.123  1.00 36.89       A    C
ATOM    617  O    LEU A 105      30.794  23.681  72.462  1.00 37.37       A    O
ATOM    618  N    ILE A 106      29.775  24.844  70.923  1.00 38.13       A    N
ATOM    619  CA   ILE A 106      30.912  24.776  70.027  1.00 38.74       A    C
ATOM    620  CB   ILE A 106      30.600  25.387  68.676  1.00 38.29       A    C
ATOM    621  CG1  ILE A 106      29.564  24.612  67.906  1.00 35.74       A    C
ATOM    622  CD1  ILE A 106      28.911  25.435  66.925  1.00 35.56       A    C
ATOM    623  CG2  ILE A 106      31.842  25.491  67.874  1.00 39.71       A    C
ATOM    624  C    ILE A 106      32.154  25.527  70.433  1.00 39.95       A    C
ATOM    625  O    ILE A 106      33.207  24.975  70.454  1.00 41.36       A    O
ATOM    626  N    ASP A 107      32.058  26.802  70.713  1.00 40.97       A    N
ATOM    627  CA   ASP A 107      33.258  27.503  71.083  1.00 41.64       A    C
ATOM    628  CB   ASP A 107      33.628  28.508  70.029  1.00 42.10       A    C
ATOM    629  CG   ASP A 107      34.669  29.430  70.502  1.00 45.90       A    C
ATOM    630  OD1  ASP A 107      35.131  29.191  71.588  1.00 50.01       A    O
ATOM    631  OD2  ASP A 107      34.980  30.388  69.817  1.00 52.30       A    O-1
ATOM    632  C    ASP A 107      33.194  28.224  72.391  1.00 40.85       A    C
ATOM    633  O    ASP A 107      32.557  29.214  72.525  1.00 41.18       A    O
ATOM    634  N    PRO A 108      33.960  27.729  73.325  1.00 40.51       A    N
ATOM    635  CA   PRO A 108      33.959  28.105  74.716  1.00 39.78       A    C
ATOM    636  CB   PRO A 108      35.026  27.200  75.261  1.00 39.74       A    C
ATOM    637  CG   PRO A 108      35.040  26.120  74.402  1.00 39.99       A    C
ATOM    638  CD   PRO A 108      34.906  26.655  73.093  1.00 40.35       A    C
ATOM    639  C    PRO A 108      34.352  29.535  74.923  1.00 39.33       A    C
ATOM    640  O    PRO A 108      34.061  30.135  75.921  1.00 38.65       A    O
ATOM    641  N    LYS A 109      35.086  30.054  73.969  1.00 39.71       A    N
ATOM    642  CA   LYS A 109      35.544  31.413  73.998  1.00 39.30       A    C
ATOM    643  CB   LYS A 109      36.666  31.619  73.012  1.00 39.41       A    C
ATOM    644  CG   LYS A 109      37.973  31.841  73.686  1.00 45.39       A    C
ATOM    645  CD   LYS A 109      39.192  31.646  72.786  1.00 52.86       A    C
ATOM    646  CE   LYS A 109      39.003  30.606  71.689  1.00 56.33       A    C
ATOM    647  NZ   LYS A 109      40.004  29.502  71.714  1.00 56.42       A    N
```

Appendix 1

```
ATOM    648  C   LYS A 109      34.401  32.339  73.762  1.00 37.86      A   C
ATOM    649  O   LYS A 109      34.469  33.491  74.057  1.00 39.08      A   O
ATOM    650  N   LEU A 110      33.347  31.807  73.186  1.00 35.17      A   N
ATOM    651  CA  LEU A 110      32.172  32.580  72.963  1.00 32.93      A   C
ATOM    652  CB  LEU A 110      31.686  32.427  71.528  1.00 32.47      A   C
ATOM    653  CG  LEU A 110      32.492  32.895  70.336  1.00 31.58      A   C
ATOM    654  CD1 LEU A 110      31.930  32.483  69.059  1.00 25.40      A   C
ATOM    655  CD2 LEU A 110      32.659  34.349  70.344  1.00 35.05      A   C
ATOM    656  C   LEU A 110      31.064  32.231  73.916  1.00 32.07      A   C
ATOM    657  O   LEU A 110      30.042  32.766  73.811  1.00 34.17      A   O
ATOM    658  N   ARG A 111      31.266  31.344  74.855  1.00 30.25      A   N
ATOM    659  CA  ARG A 111      30.198  30.930  75.744  1.00 30.32      A   C
ATOM    660  CB  ARG A 111      30.592  29.713  76.569  1.00 29.70      A   C
ATOM    661  CG  ARG A 111      29.533  29.217  77.476  1.00 26.88      A   C
ATOM    662  CD  ARG A 111      29.788  27.825  77.918  1.00 26.72      A   C
ATOM    663  NE  ARG A 111      28.745  27.289  78.769  1.00 29.70      A   N
ATOM    664  CZ  ARG A 111      28.730  26.064  79.239  1.00 30.54      A   C
ATOM    665  NH1 ARG A 111      29.687  25.257  78.927  1.00 31.59      A   N
ATOM    666  NH2 ARG A 111      27.761  25.648  79.992  1.00 27.98      A   N
ATOM    667  C   ARG A 111      29.616  32.037  76.613  1.00 30.18      A   C
ATOM    668  O   ARG A 111      28.477  32.008  76.953  1.00 31.35      A   O
ATOM    669  N   ALA A 112      30.436  32.976  77.021  1.00 29.85      A   N
ATOM    670  CA  ALA A 112      29.992  34.120  77.757  1.00 28.97      A   C
ATOM    671  CB  ALA A 112      31.153  34.856  78.285  1.00 27.19      A   C
ATOM    672  C   ALA A 112      29.106  35.045  76.980  1.00 29.50      A   C
ATOM    673  O   ALA A 112      28.162  35.554  77.489  1.00 29.31      A   O
ATOM    674  N   LEU A 113      29.469  35.301  75.749  1.00 28.80      A   N
ATOM    675  CA  LEU A 113      28.662  36.100  74.885  1.00 28.54      A   C
ATOM    676  CB  LEU A 113      29.433  36.482  73.641  1.00 29.13      A   C
ATOM    677  CG  LEU A 113      28.672  37.200  72.540  1.00 32.70      A   C
ATOM    678  CD1 LEU A 113      29.128  38.571  72.354  1.00 34.15      A   C
ATOM    679  CD2 LEU A 113      28.778  36.477  71.291  1.00 33.55      A   C
ATOM    680  C   LEU A 113      27.347  35.463  74.533  1.00 27.35      A   C
ATOM    681  O   LEU A 113      26.353  36.110  74.472  1.00 27.65      A   O
ATOM    682  N   ALA A 114      27.364  34.180  74.283  1.00 25.04      A   N
ATOM    683  CA  ALA A 114      26.178  33.479  73.914  1.00 24.92      A   C
ATOM    684  CB  ALA A 114      26.502  32.076  73.617  1.00 23.49      A   C
ATOM    685  C   ALA A 114      25.184  33.574  75.035  1.00 25.67      A   C
ATOM    686  O   ALA A 114      24.033  33.745  74.818  1.00 25.95      A   O
ATOM    687  N   GLY A 115      25.658  33.480  76.247  1.00 26.31      A   N
ATOM    688  CA  GLY A 115      24.846  33.698  77.396  1.00 26.43      A   C
ATOM    689  C   GLY A 115      24.308  35.085  77.533  1.00 26.99      A   C
ATOM    690  O   GLY A 115      23.201  35.251  77.927  1.00 28.27      A   O
ATOM    691  N   HIS A 116      25.112  36.080  77.228  1.00 26.29      A   N
ATOM    692  CA  HIS A 116      24.654  37.441  77.252  1.00 25.34      A   C
ATOM    693  CB  HIS A 116      25.826  38.412  77.094  1.00 25.58      A   C
ATOM    694  CG  HIS A 116      25.417  39.810  76.775  1.00 26.56      A   C
ATOM    695  ND1 HIS A 116      25.490  40.329  75.513  1.00 27.21      A   N
ATOM    696  CE1 HIS A 116      25.048  41.562  75.520  1.00 24.92      A   C
ATOM    697  NE2 HIS A 116      24.711  41.869  76.749  1.00 26.88      A   N
ATOM    698  CD2 HIS A 116      24.937  40.793  77.553  1.00 26.45      A   C
ATOM    699  C   HIS A 116      23.553  37.700  76.230  1.00 24.48      A   C
ATOM    700  O   HIS A 116      22.640  38.401  76.498  1.00 24.67      A   O
ATOM    701  N   ASP A 117      23.687  37.156  75.046  1.00 22.59      A   N
```

Appendix 1

```
ATOM    702  CA   ASP A 117      22.682  37.241  74.030  1.00 22.96           A    C
ATOM    703  CB   ASP A 117      23.213  36.727  72.728  1.00 22.66           A    C
ATOM    704  CG   ASP A 117      24.100  37.674  72.062  1.00 26.66           A    C
ATOM    705  OD1  ASP A 117      24.183  38.820  72.450  1.00 28.89           A    O
ATOM    706  OD2  ASP A 117      24.732  37.265  71.140  1.00 21.36           A    O-1
ATOM    707  C    ASP A 117      21.447  36.483  74.407  1.00 23.07           A    C
ATOM    708  O    ASP A 117      20.370  36.850  74.082  1.00 22.16           A    O
ATOM    709  N    LEU A 118      21.648  35.363  75.053  1.00 23.18           A    N
ATOM    710  CA   LEU A 118      20.570  34.535  75.516  1.00 24.32           A    C
ATOM    711  CB   LEU A 118      21.125  33.237  76.076  1.00 23.25           A    C
ATOM    712  CG   LEU A 118      20.820  31.855  75.514  1.00 22.59           A    C
ATOM    713  CD1  LEU A 118      19.897  31.862  74.398  1.00 17.79           A    C
ATOM    714  CD2  LEU A 118      22.036  31.043  75.184  1.00 16.95           A    C
ATOM    715  C    LEU A 118      19.709  35.249  76.541  1.00 24.43           A    C
ATOM    716  O    LEU A 118      18.545  35.110  76.558  1.00 23.44           A    O
ATOM    717  N    ASP A 119      20.342  36.000  77.411  1.00 25.67           A    N
ATOM    718  CA   ASP A 119      19.712  36.850  78.391  1.00 25.77           A    C
ATOM    719  CB   ASP A 119      20.773  37.327  79.370  1.00 26.70           A    C
ATOM    720  CG   ASP A 119      20.301  38.374  80.316  1.00 31.57           A    C
ATOM    721  OD1  ASP A 119      19.271  38.247  80.938  1.00 33.43           A    O
ATOM    722  OD2  ASP A 119      21.004  39.343  80.462  1.00 40.47           A    O-1
ATOM    723  C    ASP A 119      18.974  37.982  77.762  1.00 24.61           A    C
ATOM    724  O    ASP A 119      17.928  38.332  78.144  1.00 24.96           A    O
ATOM    725  N    ILE A 120      19.549  38.564  76.762  1.00 24.60           A    N
ATOM    726  CA   ILE A 120      18.828  39.522  75.989  1.00 24.06           A    C
ATOM    727  CB   ILE A 120      19.727  40.258  75.004  1.00 23.86           A    C
ATOM    728  CG1  ILE A 120      20.424  41.365  75.740  1.00 24.37           A    C
ATOM    729  CD1  ILE A 120      21.690  41.701  75.263  1.00 27.66           A    C
ATOM    730  CG2  ILE A 120      18.937  40.873  73.926  1.00 21.17           A    C
ATOM    731  C    ILE A 120      17.661  38.882  75.299  1.00 23.56           A    C
ATOM    732  O    ILE A 120      16.633  39.434  75.278  1.00 23.44           A    O
ATOM    733  N    ALA A 121      17.820  37.687  74.780  1.00 22.69           A    N
ATOM    734  CA   ALA A 121      16.751  37.009  74.105  1.00 22.70           A    C
ATOM    735  CB   ALA A 121      17.254  35.757  73.517  1.00 21.82           A    C
ATOM    736  C    ALA A 121      15.546  36.718  74.974  1.00 23.59           A    C
ATOM    737  O    ALA A 121      14.452  36.884  74.570  1.00 23.13           A    O
ATOM    738  N    VAL A 122      15.764  36.268  76.180  1.00 23.97           A    N
ATOM    739  CA   VAL A 122      14.699  36.093  77.119  1.00 25.66           A    C
ATOM    740  CB   VAL A 122      15.217  35.418  78.350  1.00 26.49           A    C
ATOM    741  CG1  VAL A 122      14.270  35.519  79.446  1.00 24.80           A    C
ATOM    742  CG2  VAL A 122      15.475  34.043  78.061  1.00 25.99           A    C
ATOM    743  C    VAL A 122      13.990  37.378  77.508  1.00 25.92           A    C
ATOM    744  O    VAL A 122      12.816  37.400  77.686  1.00 27.30           A    O
ATOM    745  N    SER A 123      14.718  38.443  77.666  1.00 24.32           A    N
ATOM    746  CA   SER A 123      14.140  39.676  78.057  1.00 24.79           A    C
ATOM    747  CB   SER A 123      15.274  40.651  78.297  1.00 23.78           A    C
ATOM    748  OG   SER A 123      14.846  41.848  78.857  1.00 27.19           A    O
ATOM    749  C    SER A 123      13.174  40.206  77.014  1.00 25.78           A    C
ATOM    750  O    SER A 123      12.129  40.693  77.317  1.00 25.45           A    O
ATOM    751  N    LYS A 124      13.576  40.123  75.771  1.00 25.31           A    N
ATOM    752  CA   LYS A 124      12.807  40.551  74.651  1.00 24.77           A    C
ATOM    753  CB   LYS A 124      13.678  40.621  73.406  1.00 26.45           A    C
ATOM    754  CG   LYS A 124      14.683  41.723  73.457  1.00 26.04           A    C
ATOM    755  CD   LYS A 124      15.059  42.216  72.147  1.00 21.74           A    C
```

Appendix 1

```
ATOM    756  CE  LYS A 124      16.216  43.052  72.253  1.00 23.60      A    C
ATOM    757  NZ  LYS A 124      15.882  44.421  72.286  1.00 23.04      A    N
ATOM    758  C   LYS A 124      11.567  39.735  74.457  1.00 25.28      A    C
ATOM    759  O   LYS A 124      10.567  40.210  74.037  1.00 23.97      A    O
ATOM    760  N   MET A 125      11.673  38.472  74.775  1.00 24.56      A    N
ATOM    761  CA  MET A 125      10.616  37.539  74.609  1.00 23.64      A    C
ATOM    762  CB  MET A 125      11.118  36.138  74.868  1.00 23.76      A    C
ATOM    763  CG  MET A 125      10.184  35.050  74.469  1.00 21.51      A    C
ATOM    764  SD  MET A 125      10.095  34.811  72.741  1.00 26.92      A    S
ATOM    765  CE  MET A 125       9.390  33.266  72.589  1.00 17.97      A    C
ATOM    766  C   MET A 125       9.449  37.899  75.467  1.00 24.50      A    C
ATOM    767  O   MET A 125       8.337  37.659  75.120  1.00 23.82      A    O
ATOM    768  N   LYS A 126       9.721  38.515  76.588  1.00 25.95      A    N
ATOM    769  CA  LYS A 126       8.691  38.824  77.533  1.00 27.11      A    C
ATOM    770  CB  LYS A 126       9.244  38.766  78.933  1.00 26.46      A    C
ATOM    771  CG  LYS A 126       9.408  37.419  79.474  1.00 28.81      A    C
ATOM    772  CD  LYS A 126      10.601  37.322  80.328  1.00 37.52      A    C
ATOM    773  CE  LYS A 126      10.541  38.283  81.447  1.00 42.44      A    C
ATOM    774  NZ  LYS A 126      10.244  37.622  82.710  1.00 47.21      A    N
ATOM    775  C   LYS A 126       8.008  40.136  77.269  1.00 27.83      A    C
ATOM    776  O   LYS A 126       7.050  40.447  77.887  1.00 26.84      A    O
ATOM    777  N   CYS A 127       8.511  40.880  76.315  1.00 28.44      A    N
ATOM    778  CA  CYS A 127       7.905  42.102  75.867  1.00 29.84      A    C
ATOM    779  CB  CYS A 127       8.822  42.826  74.918  1.00 30.57      A    C
ATOM    780  SG  CYS A 127      10.183  43.557  75.672  1.00 37.84      A    S
ATOM    781  C   CYS A 127       6.596  41.877  75.201  1.00 29.56      A    C
ATOM    782  O   CYS A 127       6.404  40.934  74.527  1.00 31.04      A    O
ATOM    783  N   LYS A 128       5.694  42.793  75.435  1.00 29.65      A    N
ATOM    784  CA  LYS A 128       4.343  42.746  74.971  1.00 28.46      A    C
ATOM    785  CB  LYS A 128       3.558  43.846  75.647  1.00 28.22      A    C
ATOM    786  CG  LYS A 128       2.200  44.020  75.164  1.00 32.87      A    C
ATOM    787  CD  LYS A 128       1.191  43.852  76.205  1.00 35.04      A    C
ATOM    788  CE  LYS A 128      -0.145  44.219  75.663  1.00 38.11      A    C
ATOM    789  NZ  LYS A 128      -0.914  45.095  76.545  1.00 36.68      A    N
ATOM    790  C   LYS A 128       4.221  42.822  73.476  1.00 27.80      A    C
ATOM    791  O   LYS A 128       3.291  42.350  72.927  1.00 26.46      A    O
ATOM    792  N   ARG A 129       5.182  43.421  72.821  1.00 26.77      A    N
ATOM    793  CA  ARG A 129       5.150  43.478  71.404  1.00 26.02      A    C
ATOM    794  CB  ARG A 129       6.368  44.236  70.916  1.00 26.60      A    C
ATOM    795  CG  ARG A 129       6.653  44.178  69.460  1.00 28.00      A    C
ATOM    796  CD  ARG A 129       5.724  45.019  68.676  1.00 34.20      A    C
ATOM    797  NE  ARG A 129       5.997  45.008  67.255  1.00 37.46      A    N
ATOM    798  CZ  ARG A 129       5.059  45.049  66.327  1.00 39.31      A    C
ATOM    799  NH1 ARG A 129       3.795  45.087  66.678  1.00 38.69      A    N
ATOM    800  NH2 ARG A 129       5.378  45.046  65.058  1.00 32.59      A    N
ATOM    801  C   ARG A 129       5.178  42.075  70.911  1.00 25.96      A    C
ATOM    802  O   ARG A 129       4.517  41.753  69.976  1.00 26.68      A    O
ATOM    803  N   VAL A 130       5.999  41.255  71.532  1.00 24.76      A    N
ATOM    804  CA  VAL A 130       6.106  39.861  71.200  1.00 23.45      A    C
ATOM    805  CB  VAL A 130       7.387  39.280  71.772  1.00 22.34      A    C
ATOM    806  CG1 VAL A 130       7.628  37.963  71.317  1.00 17.28      A    C
ATOM    807  CG2 VAL A 130       8.479  40.087  71.447  1.00 21.68      A    C
ATOM    808  C   VAL A 130       4.931  38.969  71.529  1.00 24.54      A    C
ATOM    809  O   VAL A 130       4.518  38.215  70.724  1.00 25.31      A    O
```

Appendix 1

```
ATOM    810  N    TRP A 131       4.409  39.040  72.724  1.00 24.82      A    N
ATOM    811  CA   TRP A 131       3.352  38.146  73.146  1.00 25.35      A    C
ATOM    812  CB   TRP A 131       3.609  37.659  74.574  1.00 25.28      A    C
ATOM    813  CG   TRP A 131       3.471  38.695  75.632  1.00 24.71      A    C
ATOM    814  CD1  TRP A 131       4.449  39.314  76.268  1.00 30.10      A    C
ATOM    815  NE1  TRP A 131       3.960  40.192  77.165  1.00 28.39      A    N
ATOM    816  CE2  TRP A 131       2.607  40.139  77.123  1.00 27.77      A    C
ATOM    817  CD2  TRP A 131       2.269  39.202  76.175  1.00 24.20      A    C
ATOM    818  CE3  TRP A 131       0.933  38.949  75.941  1.00 23.37      A    C
ATOM    819  CZ3  TRP A 131       0.032  39.606  76.624  1.00 24.20      A    C
ATOM    820  CH2  TRP A 131       0.384  40.535  77.564  1.00 28.42      A    C
ATOM    821  CZ2  TRP A 131       1.669  40.822  77.832  1.00 28.55      A    C
ATOM    822  C    TRP A 131       1.947  38.719  72.976  1.00 26.83      A    C
ATOM    823  O    TRP A 131       0.980  38.074  73.219  1.00 27.66      A    O
ATOM    824  N    GLY A 132       1.876  39.949  72.506  1.00 27.03      A    N
ATOM    825  CA   GLY A 132       0.705  40.794  72.494  1.00 26.84      A    C
ATOM    826  C    GLY A 132      -0.459  40.424  71.654  1.00 28.11      A    C
ATOM    827  O    GLY A 132      -1.533  40.834  71.886  1.00 29.14      A    O
ATOM    828  N    ASP A 133      -0.195  39.636  70.659  1.00 28.88      A    N
ATOM    829  CA   ASP A 133      -1.182  39.199  69.757  1.00 28.59      A    C
ATOM    830  CB   ASP A 133      -0.537  38.341  68.692  1.00 29.78      A    C
ATOM    831  CG   ASP A 133       0.425  37.354  69.257  1.00 33.39      A    C
ATOM    832  OD1  ASP A 133       1.423  37.734  69.801  1.00 30.82      A    O
ATOM    833  OD2  ASP A 133       0.174  36.176  69.169  1.00 36.36      A    O-1
ATOM    834  C    ASP A 133      -2.226  38.422  70.504  1.00 27.77      A    C
ATOM    835  O    ASP A 133      -3.335  38.404  70.068  1.00 26.59      A    O
ATOM    836  N    TRP A 134      -1.843  37.768  71.596  1.00 26.16      A    N
ATOM    837  CA   TRP A 134      -2.729  36.992  72.447  1.00 25.81      A    C
ATOM    838  CB   TRP A 134      -1.913  36.231  73.509  1.00 24.73      A    C
ATOM    839  CG   TRP A 134      -2.685  35.277  74.415  1.00 23.69      A    C
ATOM    840  CD1  TRP A 134      -3.098  35.508  75.664  1.00 25.27      A    C
ATOM    841  NE1  TRP A 134      -3.776  34.456  76.151  1.00 21.90      A    N
ATOM    842  CE2  TRP A 134      -3.787  33.481  75.211  1.00 18.15      A    C
ATOM    843  CD2  TRP A 134      -3.126  33.971  74.103  1.00 20.25      A    C
ATOM    844  CE3  TRP A 134      -3.014  33.168  72.998  1.00 12.25      A    C
ATOM    845  CZ3  TRP A 134      -3.554  31.969  73.037  1.00 16.82      A    C
ATOM    846  CH2  TRP A 134      -4.205  31.507  74.143  1.00 16.85      A    C
ATOM    847  CZ2  TRP A 134      -4.343  32.250  75.235  1.00 15.97      A    C
ATOM    848  C    TRP A 134      -3.786  37.827  73.114  1.00 26.75      A    C
ATOM    849  O    TRP A 134      -4.892  37.446  73.186  1.00 26.59      A    O
ATOM    850  N    GLU A 135      -3.435  38.975  73.631  1.00 28.41      A    N
ATOM    851  CA   GLU A 135      -4.428  39.870  74.144  1.00 30.78      A    C
ATOM    852  CB   GLU A 135      -3.774  41.021  74.873  1.00 32.57      A    C
ATOM    853  CG   GLU A 135      -4.693  41.793  75.739  1.00 37.42      A    C
ATOM    854  CD   GLU A 135      -4.000  42.857  76.480  1.00 42.10      A    C
ATOM    855  OE1  GLU A 135      -3.433  42.582  77.511  1.00 48.38      A    O
ATOM    856  OE2  GLU A 135      -3.997  43.984  76.049  1.00 46.34      A    O-1
ATOM    857  C    GLU A 135      -5.285  40.408  73.053  1.00 31.20      A    C
ATOM    858  O    GLU A 135      -6.472  40.477  73.177  1.00 30.59      A    O
ATOM    859  N    GLU A 136      -4.649  40.801  71.969  1.00 30.71      A    N
ATOM    860  CA   GLU A 136      -5.318  41.389  70.833  1.00 31.45      A    C
ATOM    861  CB   GLU A 136      -4.333  41.951  69.860  1.00 30.92      A    C
ATOM    862  CG   GLU A 136      -3.671  43.107  70.412  1.00 40.37      A    C
ATOM    863  CD   GLU A 136      -2.837  43.850  69.432  1.00 55.65      A    C
```

Appendix 1

```
ATOM    864  OE1 GLU A 136      -1.659  43.496  69.266  1.00 60.28      A    O
ATOM    865  OE2 GLU A 136      -3.340  44.821  68.843  1.00 59.78      A    O-1
ATOM    866  C   GLU A 136      -6.309  40.524  70.120  1.00 31.03      A    C
ATOM    867  O   GLU A 136      -7.300  41.009  69.686  1.00 33.09      A    O
ATOM    868  N   ASP A 137      -6.046  39.240  70.025  1.00 29.03      A    N
ATOM    869  CA  ASP A 137      -6.959  38.303  69.435  1.00 26.92      A    C
ATOM    870  CB  ASP A 137      -6.247  37.022  69.061  1.00 27.05      A    C
ATOM    871  CG  ASP A 137      -5.372  37.161  67.861  1.00 31.98      A    C
ATOM    872  OD1 ASP A 137      -5.362  38.212  67.244  1.00 33.19      A    O
ATOM    873  OD2 ASP A 137      -4.666  36.210  67.550  1.00 31.99      A    O-1
ATOM    874  C   ASP A 137      -8.127  38.015  70.366  1.00 26.67      A    C
ATOM    875  O   ASP A 137      -9.074  37.394  70.003  1.00 25.33      A    O
ATOM    876  N   GLY A 138      -8.062  38.517  71.574  1.00 27.23      A    N
ATOM    877  CA  GLY A 138      -9.099  38.306  72.541  1.00 27.13      A    C
ATOM    878  C   GLY A 138      -8.996  37.100  73.417  1.00 27.94      A    C
ATOM    879  O   GLY A 138      -9.901  36.792  74.113  1.00 28.89      A    O
ATOM    880  N   PHE A 139      -7.891  36.407  73.334  1.00 28.06      A    N
ATOM    881  CA  PHE A 139      -7.579  35.249  74.159  1.00 28.14      A    C
ATOM    882  CB  PHE A 139      -6.520  34.414  73.475  1.00 27.81      A    C
ATOM    883  CG  PHE A 139      -6.936  33.888  72.157  1.00 29.42      A    C
ATOM    884  CD1 PHE A 139      -8.036  33.110  72.039  1.00 30.44      A    C
ATOM    885  CE1 PHE A 139      -8.413  32.630  70.849  1.00 31.04      A    C
ATOM    886  CZ  PHE A 139      -7.705  32.917  69.775  1.00 32.28      A    C
ATOM    887  CE2 PHE A 139      -6.620  33.676  69.865  1.00 29.29      A    C
ATOM    888  CD2 PHE A 139      -6.235  34.164  71.035  1.00 27.92      A    C
ATOM    889  C   PHE A 139      -7.325  35.421  75.666  1.00 28.69      A    C
ATOM    890  O   PHE A 139      -7.635  34.568  76.433  1.00 28.63      A    O
ATOM    891  N   GLY A 140      -6.779  36.549  76.054  1.00 27.84      A    N
ATOM    892  CA  GLY A 140      -6.613  36.897  77.427  1.00 28.91      A    C
ATOM    893  C   GLY A 140      -5.530  37.912  77.661  1.00 30.34      A    C
ATOM    894  O   GLY A 140      -4.762  38.217  76.810  1.00 31.34      A    O
ATOM    895  N   THR A 141      -5.522  38.456  78.852  1.00 30.75      A    N
ATOM    896  CA  THR A 141      -4.536  39.405  79.302  1.00 30.71      A    C
ATOM    897  CB  THR A 141      -5.038  40.205  80.483  1.00 31.05      A    C
ATOM    898  OG1 THR A 141      -5.366  39.340  81.555  1.00 30.98      A    O
ATOM    899  CG2 THR A 141      -6.224  40.906  80.099  1.00 31.14      A    C
ATOM    900  C   THR A 141      -3.180  38.840  79.600  1.00 29.85      A    C
ATOM    901  O   THR A 141      -2.214  39.542  79.627  1.00 29.72      A    O
ATOM    902  N   ASP A 142      -3.134  37.554  79.836  1.00 29.55      A    N
ATOM    903  CA  ASP A 142      -1.923  36.912  80.244  1.00 31.21      A    C
ATOM    904  CB  ASP A 142      -2.141  36.337  81.632  1.00 31.39      A    C
ATOM    905  CG  ASP A 142      -0.890  36.012  82.321  1.00 35.23      A    C
ATOM    906  OD1 ASP A 142      -0.094  36.884  82.589  1.00 40.79      A    O
ATOM    907  OD2 ASP A 142      -0.692  34.876  82.634  1.00 43.05      A    O-1
ATOM    908  C   ASP A 142      -1.510  35.833  79.281  1.00 30.44      A    C
ATOM    909  O   ASP A 142      -2.223  34.913  79.032  1.00 32.01      A    O
ATOM    910  N   PRO A 143      -0.320  35.970  78.758  1.00 29.64      A    N
ATOM    911  CA  PRO A 143       0.304  35.024  77.854  1.00 28.86      A    C
ATOM    912  CB  PRO A 143       1.540  35.768  77.421  1.00 27.92      A    C
ATOM    913  CG  PRO A 143       1.841  36.635  78.511  1.00 29.02      A    C
ATOM    914  CD  PRO A 143       0.622  36.991  79.197  1.00 29.27      A    C
ATOM    915  C   PRO A 143       0.656  33.649  78.390  1.00 28.86      A    C
ATOM    916  O   PRO A 143       0.745  32.761  77.619  1.00 29.73      A    O
ATOM    917  N   ILE A 144       0.919  33.471  79.662  1.00 27.89      A    N
```

Appendix 1

```
ATOM    918  CA  ILE A 144     1.370  32.161  80.082  1.00  27.48      A  C
ATOM    919  CB  ILE A 144     2.712  32.202  80.781  1.00  27.60      A  C
ATOM    920  CG1 ILE A 144     2.538  32.719  82.180  1.00  25.00      A  C
ATOM    921  CD1 ILE A 144     3.694  32.784  82.865  1.00  22.53      A  C
ATOM    922  CG2 ILE A 144     3.703  32.981  79.989  1.00  26.35      A  C
ATOM    923  C   ILE A 144     0.414  31.334  80.898  1.00  27.73      A  C
ATOM    924  O   ILE A 144     0.637  30.192  81.121  1.00  25.93      A  O
ATOM    925  N   GLU A 145    -0.653  31.938  81.335  1.00  28.88      A  N
ATOM    926  CA  GLU A 145    -1.586  31.304  82.221  1.00  32.04      A  C
ATOM    927  CB  GLU A 145    -2.538  32.334  82.716  1.00  33.18      A  C
ATOM    928  CG  GLU A 145    -3.215  31.956  83.935  1.00  44.90      A  C
ATOM    929  CD  GLU A 145    -4.340  32.871  84.202  1.00  56.14      A  C
ATOM    930  OE1 GLU A 145    -4.602  33.671  83.308  1.00  60.66      A  O
ATOM    931  OE2 GLU A 145    -4.949  32.812  85.275  1.00  59.90      A  O-1
ATOM    932  C   GLU A 145    -2.351  30.113  81.712  1.00  32.10      A  C
ATOM    933  O   GLU A 145    -2.529  29.171  82.398  1.00  33.00      A  O
ATOM    934  N   LYS A 146    -2.839  30.174  80.502  1.00  32.74      A  N
ATOM    935  CA  LYS A 146    -3.569  29.082  79.930  1.00  31.77      A  C
ATOM    936  CB  LYS A 146    -5.010  29.478  79.847  1.00  32.66      A  C
ATOM    937  CG  LYS A 146    -5.956  28.591  80.469  1.00  37.61      A  C
ATOM    938  CD  LYS A 146    -7.219  29.291  80.508  1.00  41.69      A  C
ATOM    939  CE  LYS A 146    -7.144  30.483  79.621  1.00  46.75      A  C
ATOM    940  NZ  LYS A 146    -8.394  31.256  79.638  1.00  50.65      A  N
ATOM    941  C   LYS A 146    -3.096  28.947  78.553  1.00  29.56      A  C
ATOM    942  O   LYS A 146    -2.828  29.904  77.930  1.00  25.47      A  O
ATOM    943  N   GLU A 147    -2.988  27.734  78.080  1.00  29.57      A  N
ATOM    944  CA  GLU A 147    -2.884  27.453  76.676  1.00  29.39      A  C
ATOM    945  CB  GLU A 147    -4.155  27.840  75.967  1.00  28.74      A  C
ATOM    946  CG  GLU A 147    -5.311  27.037  76.427  1.00  34.96      A  C
ATOM    947  CD  GLU A 147    -6.647  27.744  76.326  1.00  42.61      A  C
ATOM    948  OE1 GLU A 147    -6.686  28.949  76.179  1.00  44.80      A  O
ATOM    949  OE2 GLU A 147    -7.678  27.087  76.399  1.00  44.61      A  O-1
ATOM    950  C   GLU A 147    -1.708  28.151  76.108  1.00  28.25      A  C
ATOM    951  O   GLU A 147    -0.758  28.331  76.778  1.00  28.60      A  O
ATOM    952  N   ASN A 148    -1.784  28.567  74.864  1.00  26.84      A  N
ATOM    953  CA  ASN A 148    -0.739  29.364  74.277  1.00  24.99      A  C
ATOM    954  CB  ASN A 148    -0.741  30.761  74.894  1.00  23.06      A  C
ATOM    955  CG  ASN A 148     0.012  31.778  74.080  1.00  22.40      A  C
ATOM    956  OD1 ASN A 148     0.164  31.635  72.931  1.00  20.84      A  O
ATOM    957  ND2 ASN A 148     0.472  32.803  74.705  1.00  13.34      A  N
ATOM    958  C   ASN A 148     0.640  28.730  74.350  1.00  25.86      A  C
ATOM    959  O   ASN A 148     1.577  29.389  74.641  1.00  25.10      A  O
ATOM    960  N   ILE A 149     0.777  27.454  74.069  1.00  25.12      A  N
ATOM    961  CA  ILE A 149     2.116  26.895  74.072  1.00  26.96      A  C
ATOM    962  CB  ILE A 149     2.284  25.357  74.374  1.00  27.49      A  C
ATOM    963  CG1 ILE A 149     1.124  24.544  73.874  1.00  26.11      A  C
ATOM    964  CD1 ILE A 149     1.270  24.201  72.515  1.00  22.52      A  C
ATOM    965  CG2 ILE A 149     2.644  25.111  75.822  1.00  23.16      A  C
ATOM    966  C   ILE A 149     2.962  27.286  72.893  1.00  27.96      A  C
ATOM    967  O   ILE A 149     4.102  27.005  72.881  1.00  29.64      A  O
ATOM    968  N   MET A 150     2.420  27.926  71.894  1.00  29.82      A  N
ATOM    969  CA  MET A 150     3.323  28.447  70.926  1.00  32.78      A  C
ATOM    970  CB  MET A 150     2.575  29.008  69.734  1.00  34.95      A  C
ATOM    971  CG  MET A 150     1.581  30.063  70.043  1.00  42.88      A  C
```

Appendix 1

```
ATOM    972  SD   MET A 150      0.833  30.730  68.571  1.00 62.08      A    S
ATOM    973  CE   MET A 150     -0.727  31.266  69.249  1.00 59.26      A    C
ATOM    974  C    MET A 150      4.221  29.501  71.537  1.00 31.35      A    C
ATOM    975  O    MET A 150      5.386  29.506  71.325  1.00 32.49      A    O
ATOM    976  N    TYR A 151      3.692  30.430  72.285  1.00 28.47      A    N
ATOM    977  CA   TYR A 151      4.581  31.315  72.970  1.00 26.44      A    C
ATOM    978  CB   TYR A 151      3.811  32.529  73.360  1.00 25.68      A    C
ATOM    979  CG   TYR A 151      4.569  33.452  74.170  1.00 22.19      A    C
ATOM    980  CD1  TYR A 151      5.555  34.200  73.627  1.00 24.55      A    C
ATOM    981  CE1  TYR A 151      6.243  35.051  74.375  1.00 26.32      A    C
ATOM    982  CZ   TYR A 151      5.957  35.149  75.669  1.00 23.04      A    C
ATOM    983  OH   TYR A 151      6.630  36.002  76.428  1.00 19.66      A    O
ATOM    984  CE2  TYR A 151      4.992  34.415  76.213  1.00 23.32      A    C
ATOM    985  CD2  TYR A 151      4.313  33.582  75.480  1.00 19.83      A    C
ATOM    986  C    TYR A 151      5.361  30.792  74.171  1.00 25.73      A    C
ATOM    987  O    TYR A 151      6.536  30.899  74.235  1.00 26.08      A    O
ATOM    988  N    LYS A 152      4.643  30.220  75.104  1.00 23.18      A    N
ATOM    989  CA   LYS A 152      5.162  29.739  76.339  1.00 22.08      A    C
ATOM    990  CB   LYS A 152      4.088  29.653  77.414  1.00 22.30      A    C
ATOM    991  CG   LYS A 152      3.233  28.469  77.473  1.00 20.54      A    C
ATOM    992  CD   LYS A 152      2.154  28.792  78.419  1.00 19.32      A    C
ATOM    993  CE   LYS A 152      1.232  27.707  78.671  1.00 15.26      A    C
ATOM    994  NZ   LYS A 152      0.293  28.189  79.608  1.00 21.12      A    N
ATOM    995  C    LYS A 152      6.089  28.565  76.319  1.00 22.29      A    C
ATOM    996  O    LYS A 152      6.852  28.427  77.199  1.00 24.08      A    O
ATOM    997  N    GLY A 153      5.983  27.688  75.353  1.00 21.07      A    N
ATOM    998  CA   GLY A 153      6.941  26.631  75.200  1.00 20.33      A    C
ATOM    999  C    GLY A 153      8.310  27.095  74.823  1.00 21.15      A    C
ATOM   1000  O    GLY A 153      9.290  26.653  75.317  1.00 21.28      A    O
ATOM   1001  N    HIS A 154      8.359  28.011  73.899  1.00 22.77      A    N
ATOM   1002  CA   HIS A 154      9.615  28.566  73.508  1.00 22.42      A    C
ATOM   1003  CB   HIS A 154      9.469  29.444  72.294  1.00 21.97      A    C
ATOM   1004  CG   HIS A 154      9.265  28.700  71.016  1.00 26.63      A    C
ATOM   1005  ND1  HIS A 154     10.263  28.004  70.397  1.00 25.97      A    N
ATOM   1006  CE1  HIS A 154      9.813  27.492  69.280  1.00 25.39      A    C
ATOM   1007  NE2  HIS A 154      8.556  27.823  69.156  1.00 29.16      A    N
ATOM   1008  CD2  HIS A 154      8.196  28.596  70.215  1.00 29.02      A    C
ATOM   1009  C    HIS A 154     10.237  29.313  74.637  1.00 21.96      A    C
ATOM   1010  O    HIS A 154     11.376  29.222  74.843  1.00 22.06      A    O
ATOM   1011  N    LEU A 155      9.446  30.049  75.379  1.00 21.63      A    N
ATOM   1012  CA   LEU A 155      9.944  30.776  76.502  1.00 20.94      A    C
ATOM   1013  CB   LEU A 155      8.858  31.677  77.084  1.00 20.25      A    C
ATOM   1014  CG   LEU A 155      9.270  32.594  78.213  1.00 20.03      A    C
ATOM   1015  CD1  LEU A 155     10.283  33.540  77.875  1.00 15.84      A    C
ATOM   1016  CD2  LEU A 155      8.167  33.273  78.766  1.00 15.31      A    C
ATOM   1017  C    LEU A 155     10.513  29.850  77.545  1.00 20.12      A    C
ATOM   1018  O    LEU A 155     11.537  30.089  78.056  1.00 17.68      A    O
ATOM   1019  N    ASN A 156      9.842  28.766  77.816  1.00 20.17      A    N
ATOM   1020  CA   ASN A 156     10.355  27.735  78.654  1.00 21.84      A    C
ATOM   1021  CB   ASN A 156      9.272  26.764  79.011  1.00 22.92      A    C
ATOM   1022  CG   ASN A 156      9.426  26.260  80.370  1.00 25.84      A    C
ATOM   1023  OD1  ASN A 156      9.670  27.001  81.257  1.00 28.58      A    O
ATOM   1024  ND2  ASN A 156      9.327  24.992  80.534  1.00 23.70      A    N
ATOM   1025  C    ASN A 156     11.603  27.019  78.168  1.00 22.68      A    C
```

Appendix 1

```
ATOM   1026  O    ASN A 156      12.432  26.692  78.939  1.00  24.09      A    O
ATOM   1027  N    LEU A 157      11.742  26.786  76.887  1.00  22.16      A    N
ATOM   1028  CA   LEU A 157      12.969  26.256  76.387  1.00  21.46      A    C
ATOM   1029  CB   LEU A 157      12.811  25.825  74.934  1.00  21.67      A    C
ATOM   1030  CG   LEU A 157      13.909  25.001  74.307  1.00  21.65      A    C
ATOM   1031  CD1  LEU A 157      14.376  24.010  75.231  1.00  20.56      A    C
ATOM   1032  CD2  LEU A 157      13.510  24.347  73.067  1.00  20.32      A    C
ATOM   1033  C    LEU A 157      14.096  27.232  76.590  1.00  21.01      A    C
ATOM   1034  O    LEU A 157      15.119  26.869  77.058  1.00  21.25      A    O
ATOM   1035  N    MET A 158      13.848  28.488  76.298  1.00  20.14      A    N
ATOM   1036  CA   MET A 158      14.795  29.566  76.474  1.00  19.35      A    C
ATOM   1037  CB   MET A 158      14.318  30.840  75.805  1.00  18.30      A    C
ATOM   1038  CG   MET A 158      14.062  30.727  74.394  1.00  17.42      A    C
ATOM   1039  SD   MET A 158      13.064  32.038  73.801  1.00  28.98      A    S
ATOM   1040  CE   MET A 158      14.172  33.361  73.808  1.00  26.29      A    C
ATOM   1041  C    MET A 158      15.219  29.838  77.896  1.00  18.35      A    C
ATOM   1042  O    MET A 158      16.319  30.121  78.115  1.00  18.02      A    O
ATOM   1043  N    TYR A 159      14.336  29.737  78.855  1.00  19.40      A    N
ATOM   1044  CA   TYR A 159      14.701  29.967  80.230  1.00  19.33      A    C
ATOM   1045  CB   TYR A 159      13.495  29.763  81.104  1.00  18.93      A    C
ATOM   1046  CG   TYR A 159      12.579  30.885  81.335  1.00  15.66      A    C
ATOM   1047  CD1  TYR A 159      12.980  32.163  81.268  1.00  17.44      A    C
ATOM   1048  CE1  TYR A 159      12.110  33.165  81.523  1.00  17.24      A    C
ATOM   1049  CZ   TYR A 159      10.838  32.872  81.857  1.00  17.24      A    C
ATOM   1050  OH   TYR A 159       9.937  33.832  82.096  1.00  18.38      A    O
ATOM   1051  CE2  TYR A 159      10.444  31.607  81.914  1.00  17.53      A    C
ATOM   1052  CD2  TYR A 159      11.291  30.640  81.669  1.00  18.54      A    C
ATOM   1053  C    TYR A 159      15.732  28.948  80.663  1.00  19.67      A    C
ATOM   1054  O    TYR A 159      16.669  29.242  81.319  1.00  19.44      A    O
ATOM   1055  N    GLY A 160      15.480  27.716  80.328  1.00  20.60      A    N
ATOM   1056  CA   GLY A 160      16.370  26.628  80.552  1.00  21.42      A    C
ATOM   1057  C    GLY A 160      17.666  26.584  79.830  1.00  23.46      A    C
ATOM   1058  O    GLY A 160      18.647  26.194  80.366  1.00  24.97      A    O
ATOM   1059  N    LEU A 161      17.629  26.927  78.574  1.00  23.64      A    N
ATOM   1060  CA   LEU A 161      18.783  27.019  77.784  1.00  23.71      A    C
ATOM   1061  CB   LEU A 161      18.391  27.257  76.368  1.00  25.08      A    C
ATOM   1062  CG   LEU A 161      18.585  26.096  75.446  1.00  25.47      A    C
ATOM   1063  CD1  LEU A 161      18.669  24.851  76.179  1.00  31.23      A    C
ATOM   1064  CD2  LEU A 161      17.515  26.052  74.530  1.00  25.17      A    C
ATOM   1065  C    LEU A 161      19.694  28.095  78.276  1.00  25.27      A    C
ATOM   1066  O    LEU A 161      20.873  27.946  78.218  1.00  25.54      A    O
ATOM   1067  N    TYR A 162      19.146  29.198  78.738  1.00  26.22      A    N
ATOM   1068  CA   TYR A 162      19.946  30.255  79.298  1.00  26.32      A    C
ATOM   1069  CB   TYR A 162      19.096  31.485  79.596  1.00  26.25      A    C
ATOM   1070  CG   TYR A 162      19.730  32.496  80.519  1.00  26.65      A    C
ATOM   1071  CD1  TYR A 162      20.615  33.400  80.043  1.00  25.08      A    C
ATOM   1072  CE1  TYR A 162      21.179  34.269  80.829  1.00  24.39      A    C
ATOM   1073  CZ   TYR A 162      20.889  34.280  82.116  1.00  27.79      A    C
ATOM   1074  OH   TYR A 162      21.479  35.188  82.881  1.00  30.19      A    O
ATOM   1075  CE2  TYR A 162      20.014  33.414  82.643  1.00  26.44      A    C
ATOM   1076  CD2  TYR A 162      19.437  32.534  81.858  1.00  26.67      A    C
ATOM   1077  C    TYR A 162      20.623  29.809  80.542  1.00  25.95      A    C
ATOM   1078  O    TYR A 162      21.747  30.080  80.744  1.00  26.15      A    O
ATOM   1079  N    GLN A 163      19.895  29.140  81.392  1.00  26.39      A    N
```

Appendix 1

```
ATOM   1080  CA   GLN A 163      20.449  28.703  82.623  1.00 28.09      A    C
ATOM   1081  CB   GLN A 163      19.375  28.166  83.525  1.00 27.54      A    C
ATOM   1082  CG   GLN A 163      19.865  27.715  84.834  1.00 27.99      A    C
ATOM   1083  CD   GLN A 163      18.869  27.872  85.924  1.00 30.49      A    C
ATOM   1084  OE1  GLN A 163      17.898  28.535  85.773  1.00 32.16      A    O
ATOM   1085  NE2  GLN A 163      19.116  27.274  87.020  1.00 23.07      A    N
ATOM   1086  C    GLN A 163      21.551  27.702  82.398  1.00 31.24      A    C
ATOM   1087  O    GLN A 163      22.544  27.715  83.072  1.00 32.48      A    O
ATOM   1088  N    LEU A 164      21.371  26.816  81.444  1.00 32.26      A    N
ATOM   1089  CA   LEU A 164      22.360  25.825  81.159  1.00 31.69      A    C
ATOM   1090  CB   LEU A 164      21.812  24.917  80.096  1.00 32.19      A    C
ATOM   1091  CG   LEU A 164      21.596  23.432  80.225  1.00 31.29      A    C
ATOM   1092  CD1  LEU A 164      21.395  23.019  81.592  1.00 28.31      A    C
ATOM   1093  CD2  LEU A 164      20.418  23.108  79.442  1.00 29.89      A    C
ATOM   1094  C    LEU A 164      23.644  26.411  80.662  1.00 32.49      A    C
ATOM   1095  O    LEU A 164      24.692  25.982  81.031  1.00 32.34      A    O
ATOM   1096  N    VAL A 165      23.546  27.339  79.741  1.00 32.55      A    N
ATOM   1097  CA   VAL A 165      24.697  28.025  79.196  1.00 30.34      A    C
ATOM   1098  CB   VAL A 165      24.253  28.810  77.984  1.00 29.62      A    C
ATOM   1099  CG1  VAL A 165      25.307  29.658  77.465  1.00 27.69      A    C
ATOM   1100  CG2  VAL A 165      23.758  27.916  76.958  1.00 26.28      A    C
ATOM   1101  C    VAL A 165      25.447  28.919  80.179  1.00 31.18      A    C
ATOM   1102  O    VAL A 165      26.632  28.881  80.298  1.00 31.06      A    O
ATOM   1103  N    THR A 166      24.718  29.731  80.884  1.00 30.72      A    N
ATOM   1104  CA   THR A 166      25.256  30.475  81.963  1.00 32.06      A    C
ATOM   1105  CB   THR A 166      24.651  31.845  82.009  1.00 32.19      A    C
ATOM   1106  OG1  THR A 166      23.524  31.836  82.870  1.00 30.04      A    O
ATOM   1107  CG2  THR A 166      24.236  32.249  80.669  1.00 31.27      A    C
ATOM   1108  C    THR A 166      24.939  29.769  83.255  1.00 33.99      A    C
ATOM   1109  O    THR A 166      24.042  28.979  83.375  1.00 35.97      A    O
ATOM   1110  N    GLY A 167      25.652  30.064  84.282  1.00 34.17      A    N
ATOM   1111  CA   GLY A 167      25.268  29.396  85.480  1.00 34.08      A    C
ATOM   1112  C    GLY A 167      23.990  29.919  86.049  1.00 33.97      A    C
ATOM   1113  O    GLY A 167      23.544  29.396  87.004  1.00 34.39      A    O
ATOM   1114  N    SER A 168      23.429  30.961  85.473  1.00 33.71      A    N
ATOM   1115  CA   SER A 168      22.568  31.881  86.176  1.00 33.30      A    C
ATOM   1116  CB   SER A 168      22.467  33.181  85.436  1.00 32.60      A    C
ATOM   1117  OG   SER A 168      21.524  33.987  86.069  1.00 32.21      A    O
ATOM   1118  C    SER A 168      21.193  31.457  86.607  1.00 34.18      A    C
ATOM   1119  O    SER A 168      20.499  30.842  85.889  1.00 34.88      A    O
ATOM   1120  N    ARG A 169      20.809  31.867  87.800  1.00 34.18      A    N
ATOM   1121  CA   ARG A 169      19.538  31.538  88.397  1.00 33.75      A    C
ATOM   1122  CB   ARG A 169      19.725  31.073  89.813  1.00 35.34      A    C
ATOM   1123  CG   ARG A 169      20.587  29.905  89.932  1.00 37.64      A    C
ATOM   1124  CD   ARG A 169      20.577  29.394  91.315  1.00 44.64      A    C
ATOM   1125  NE   ARG A 169      19.976  28.092  91.341  1.00 48.70      A    N
ATOM   1126  CZ   ARG A 169      20.619  26.992  91.037  1.00 51.85      A    C
ATOM   1127  NH1  ARG A 169      21.883  27.061  90.716  1.00 56.56      A    N
ATOM   1128  NH2  ARG A 169      20.007  25.831  91.065  1.00 50.57      A    N
ATOM   1129  C    ARG A 169      18.547  32.670  88.342  1.00 32.43      A    C
ATOM   1130  O    ARG A 169      17.522  32.634  88.929  1.00 30.59      A    O
ATOM   1131  N    ARG A 170      18.850  33.627  87.515  1.00 31.88      A    N
ATOM   1132  CA   ARG A 170      18.079  34.811  87.335  1.00 31.82      A    C
ATOM   1133  CB   ARG A 170      18.852  35.681  86.378  1.00 32.31      A    C
```

Appendix 1

```
ATOM   1134  CG   ARG A 170      18.129  36.829  85.873  1.00 36.52      A    C
ATOM   1135  CD   ARG A 170      18.777  37.316  84.664  1.00 44.81      A    C
ATOM   1136  NE   ARG A 170      18.649  38.749  84.502  1.00 48.63      A    N
ATOM   1137  CZ   ARG A 170      19.656  39.522  84.175  1.00 52.59      A    C
ATOM   1138  NH1  ARG A 170      20.832  39.003  83.975  1.00 54.99      A    N
ATOM   1139  NH2  ARG A 170      19.495  40.802  84.044  1.00 54.52      A    N
ATOM   1140  C    ARG A 170      16.640  34.632  86.856  1.00 31.73      A    C
ATOM   1141  O    ARG A 170      15.774  35.387  87.215  1.00 31.13      A    O
ATOM   1142  N    TYR A 171      16.376  33.652  86.018  1.00 30.45      A    N
ATOM   1143  CA   TYR A 171      15.023  33.432  85.588  1.00 29.57      A    C
ATOM   1144  CB   TYR A 171      14.927  33.354  84.091  1.00 29.48      A    C
ATOM   1145  CG   TYR A 171      15.361  34.574  83.393  1.00 26.53      A    C
ATOM   1146  CD1  TYR A 171      14.675  35.738  83.519  1.00 19.43      A    C
ATOM   1147  CE1  TYR A 171      15.072  36.824  82.883  1.00 20.73      A    C
ATOM   1148  CZ   TYR A 171      16.173  36.773  82.106  1.00 26.40      A    C
ATOM   1149  OH   TYR A 171      16.588  37.871  81.457  1.00 27.92      A    O
ATOM   1150  CE2  TYR A 171      16.866  35.622  81.968  1.00 24.47      A    C
ATOM   1151  CD2  TYR A 171      16.459  34.548  82.600  1.00 23.86      A    C
ATOM   1152  C    TYR A 171      14.482  32.183  86.159  1.00 29.42      A    C
ATOM   1153  O    TYR A 171      13.476  31.725  85.764  1.00 29.40      A    O
ATOM   1154  N    GLU A 172      15.187  31.638  87.107  1.00 29.35      A    N
ATOM   1155  CA   GLU A 172      14.896  30.342  87.633  1.00 29.95      A    C
ATOM   1156  CB   GLU A 172      15.995  29.914  88.570  1.00 30.16      A    C
ATOM   1157  CG   GLU A 172      15.761  28.578  89.146  1.00 34.55      A    C
ATOM   1158  CD   GLU A 172      16.925  27.993  89.863  1.00 41.42      A    C
ATOM   1159  OE1  GLU A 172      17.943  27.707  89.244  1.00 40.36      A    O
ATOM   1160  OE2  GLU A 172      16.804  27.759  91.053  1.00 47.24      A    O-1
ATOM   1161  C    GLU A 172      13.557  30.221  88.302  1.00 29.37      A    C
ATOM   1162  O    GLU A 172      12.919  29.227  88.186  1.00 30.13      A    O
ATOM   1163  N    ALA A 173      13.145  31.229  89.033  1.00 28.82      A    N
ATOM   1164  CA   ALA A 173      11.829  31.242  89.614  1.00 29.08      A    C
ATOM   1165  CB   ALA A 173      11.713  32.319  90.608  1.00 25.96      A    C
ATOM   1166  C    ALA A 173      10.694  31.301  88.600  1.00 29.71      A    C
ATOM   1167  O    ALA A 173       9.701  30.684  88.792  1.00 29.67      A    O
ATOM   1168  N    GLU A 174      10.857  32.084  87.550  1.00 29.67      A    N
ATOM   1169  CA   GLU A 174       9.974  32.087  86.395  1.00 29.16      A    C
ATOM   1170  CB   GLU A 174      10.331  33.217  85.455  1.00 29.58      A    C
ATOM   1171  CG   GLU A 174      10.186  34.575  86.014  1.00 35.53      A    C
ATOM   1172  CD   GLU A 174      11.023  35.546  85.281  1.00 43.23      A    C
ATOM   1173  OE1  GLU A 174      11.588  35.165  84.293  1.00 49.82      A    O
ATOM   1174  OE2  GLU A 174      11.138  36.686  85.666  1.00 46.99      A    O-1
ATOM   1175  C    GLU A 174       9.991  30.788  85.633  1.00 27.71      A    C
ATOM   1176  O    GLU A 174       8.987  30.329  85.215  1.00 27.17      A    O
ATOM   1177  N    HIS A 175      11.154  30.202  85.470  1.00 25.22      A    N
ATOM   1178  CA   HIS A 175      11.282  28.974  84.774  1.00 24.31      A    C
ATOM   1179  CB   HIS A 175      12.757  28.640  84.756  1.00 25.02      A    C
ATOM   1180  CG   HIS A 175      13.133  27.504  83.872  1.00 27.84      A    C
ATOM   1181  ND1  HIS A 175      14.332  26.866  83.969  1.00 31.63      A    N
ATOM   1182  CE1  HIS A 175      14.394  25.900  83.089  1.00 29.34      A    C
ATOM   1183  NE2  HIS A 175      13.266  25.884  82.432  1.00 26.52      A    N
ATOM   1184  CD2  HIS A 175      12.471  26.886  82.888  1.00 28.05      A    C
ATOM   1185  C    HIS A 175      10.503  27.880  85.446  1.00 23.27      A    C
ATOM   1186  O    HIS A 175       9.770  27.191  84.820  1.00 23.48      A    O
ATOM   1187  N    ALA A 176      10.653  27.751  86.738  1.00 22.15      A    N
```

Appendix 1

```
ATOM   1188  CA   ALA A 176       9.946  26.776  87.508  1.00 21.07      A    C
ATOM   1189  CB   ALA A 176      10.454  26.792  88.862  1.00 20.94      A    C
ATOM   1190  C    ALA A 176       8.470  26.966  87.534  1.00 20.90      A    C
ATOM   1191  O    ALA A 176       7.748  26.033  87.530  1.00 20.31      A    O
ATOM   1192  N    HIS A 177       8.037  28.202  87.619  1.00 21.02      A    N
ATOM   1193  CA   HIS A 177       6.636  28.523  87.622  1.00 23.68      A    C
ATOM   1194  CB   HIS A 177       6.443  29.993  87.905  1.00 23.95      A    C
ATOM   1195  CG   HIS A 177       5.031  30.451  87.791  1.00 29.99      A    C
ATOM   1196  ND1  HIS A 177       4.576  31.202  86.743  1.00 36.80      A    N
ATOM   1197  CE1  HIS A 177       3.307  31.480  86.915  1.00 37.77      A    C
ATOM   1198  NE2  HIS A 177       2.918  30.927  88.037  1.00 34.58      A    N
ATOM   1199  CD2  HIS A 177       3.976  30.282  88.605  1.00 36.36      A    C
ATOM   1200  C    HIS A 177       5.894  28.178  86.356  1.00 23.93      A    C
ATOM   1201  O    HIS A 177       4.839  27.636  86.438  1.00 24.72      A    O
ATOM   1202  N    LEU A 178       6.460  28.506  85.210  1.00 22.18      A    N
ATOM   1203  CA   LEU A 178       5.989  28.111  83.903  1.00 22.18      A    C
ATOM   1204  CB   LEU A 178       6.727  28.878  82.818  1.00 22.49      A    C
ATOM   1205  CG   LEU A 178       6.386  28.663  81.366  1.00 22.86      A    C
ATOM   1206  CD1  LEU A 178       5.008  29.046  81.151  1.00 21.77      A    C
ATOM   1207  CD2  LEU A 178       7.233  29.493  80.570  1.00 21.47      A    C
ATOM   1208  C    LEU A 178       6.055  26.627  83.632  1.00 22.97      A    C
ATOM   1209  O    LEU A 178       5.178  26.074  83.027  1.00 21.58      A    O
ATOM   1210  N    THR A 179       7.116  25.995  84.086  1.00 22.52      A    N
ATOM   1211  CA   THR A 179       7.282  24.570  83.963  1.00 23.04      A    C
ATOM   1212  CB   THR A 179       8.653  24.130  84.454  1.00 22.81      A    C
ATOM   1213  OG1  THR A 179       9.586  24.440  83.470  1.00 24.13      A    O
ATOM   1214  CG2  THR A 179       8.748  22.690  84.637  1.00 16.70      A    C
ATOM   1215  C    THR A 179       6.191  23.851  84.711  1.00 24.04      A    C
ATOM   1216  O    THR A 179       5.736  22.857  84.304  1.00 25.12      A    O
ATOM   1217  N    ARG A 180       5.810  24.359  85.842  1.00 24.66      A    N
ATOM   1218  CA   ARG A 180       4.701  23.819  86.576  1.00 25.63      A    C
ATOM   1219  CB   ARG A 180       4.769  24.196  88.054  1.00 26.98      A    C
ATOM   1220  CG   ARG A 180       5.848  23.444  88.729  1.00 28.88      A    C
ATOM   1221  CD   ARG A 180       5.816  23.522  90.177  1.00 37.03      A    C
ATOM   1222  NE   ARG A 180       6.265  24.815  90.607  1.00 46.64      A    N
ATOM   1223  CZ   ARG A 180       7.479  25.094  91.037  1.00 47.10      A    C
ATOM   1224  NH1  ARG A 180       8.383  24.152  91.101  1.00 48.05      A    N
ATOM   1225  NH2  ARG A 180       7.780  26.322  91.378  1.00 40.84      A    N
ATOM   1226  C    ARG A 180       3.345  23.997  85.944  1.00 25.04      A    C
ATOM   1227  O    ARG A 180       2.526  23.182  86.077  1.00 26.29      A    O
ATOM   1228  N    ILE A 181       3.125  25.095  85.270  1.00 25.71      A    N
ATOM   1229  CA   ILE A 181       1.927  25.290  84.515  1.00 23.85      A    C
ATOM   1230  CB   ILE A 181       1.833  26.660  83.986  1.00 24.60      A    C
ATOM   1231  CG1  ILE A 181       1.458  27.602  85.082  1.00 22.98      A    C
ATOM   1232  CD1  ILE A 181       2.072  28.858  84.896  1.00 26.36      A    C
ATOM   1233  CG2  ILE A 181       0.816  26.707  82.918  1.00 19.55      A    C
ATOM   1234  C    ILE A 181       1.809  24.385  83.344  1.00 23.07      A    C
ATOM   1235  O    ILE A 181       0.764  24.005  83.003  1.00 24.16      A    O
ATOM   1236  N    ILE A 182       2.898  24.128  82.672  1.00 22.67      A    N
ATOM   1237  CA   ILE A 182       2.890  23.256  81.543  1.00 20.83      A    C
ATOM   1238  CB   ILE A 182       4.222  23.332  80.800  1.00 20.28      A    C
ATOM   1239  CG1  ILE A 182       4.273  24.623  80.019  1.00 19.76      A    C
ATOM   1240  CD1  ILE A 182       5.592  25.007  79.570  1.00 14.86      A    C
ATOM   1241  CG2  ILE A 182       4.436  22.185  79.898  1.00 16.18      A    C
```

Appendix 1

```
ATOM   1242  C   ILE A 182      2.534  21.889  81.995  1.00 21.97      A   C
ATOM   1243  O   ILE A 182      1.730  21.257  81.422  1.00 21.46      A   O
ATOM   1244  N   HIS A 183      3.120  21.461  83.083  1.00 25.15      A   N
ATOM   1245  CA  HIS A 183      2.927  20.130  83.586  1.00 26.60      A   C
ATOM   1246  CB  HIS A 183      3.824  19.860  84.794  1.00 26.48      A   C
ATOM   1247  CG  HIS A 183      3.358  18.715  85.644  1.00 32.20      A   C
ATOM   1248  ND1 HIS A 183      3.738  17.417  85.416  1.00 30.64      A   N
ATOM   1249  CE1 HIS A 183      3.155  16.634  86.291  1.00 30.64      A   C
ATOM   1250  NE2 HIS A 183      2.416  17.374  87.082  1.00 32.55      A   N
ATOM   1251  CD2 HIS A 183      2.529  18.675  86.707  1.00 28.35      A   C
ATOM   1252  C   HIS A 183      1.497  19.883  83.943  1.00 26.64      A   C
ATOM   1253  O   HIS A 183      1.007  18.832  83.702  1.00 28.39      A   O
ATOM   1254  N   ASP A 184      0.864  20.851  84.565  1.00 27.28      A   N
ATOM   1255  CA  ASP A 184     -0.525  20.780  84.928  1.00 28.05      A   C
ATOM   1256  CB  ASP A 184     -0.934  21.983  85.743  1.00 28.07      A   C
ATOM   1257  CG  ASP A 184     -0.485  21.930  87.128  1.00 30.23      A   C
ATOM   1258  OD1 ASP A 184     -0.088  20.893  87.610  1.00 32.50      A   O
ATOM   1259  OD2 ASP A 184     -0.517  22.959  87.761  1.00 34.63      A   O-1
ATOM   1260  C   ASP A 184     -1.446  20.745  83.763  1.00 28.21      A   C
ATOM   1261  O   ASP A 184     -2.389  20.038  83.769  1.00 28.29      A   O
ATOM   1262  N   GLU A 185     -1.190  21.561  82.771  1.00 27.94      A   N
ATOM   1263  CA  GLU A 185     -2.054  21.623  81.628  1.00 27.38      A   C
ATOM   1264  CB  GLU A 185     -1.652  22.758  80.724  1.00 27.48      A   C
ATOM   1265  CG  GLU A 185     -2.130  24.057  81.187  1.00 30.82      A   C
ATOM   1266  CD  GLU A 185     -1.915  25.135  80.194  1.00 37.60      A   C
ATOM   1267  OE1 GLU A 185     -0.839  25.680  80.097  1.00 29.51      A   O
ATOM   1268  OE2 GLU A 185     -2.847  25.469  79.489  1.00 45.82      A   O-1
ATOM   1269  C   GLU A 185     -2.103  20.313  80.892  1.00 25.97      A   C
ATOM   1270  O   GLU A 185     -3.141  19.892  80.486  1.00 25.21      A   O
ATOM   1271  N   ILE A 186     -0.957  19.685  80.772  1.00 23.73      A   N
ATOM   1272  CA  ILE A 186     -0.820  18.381  80.232  1.00 23.19      A   C
ATOM   1273  CB  ILE A 186      0.618  17.962  80.238  1.00 23.02      A   C
ATOM   1274  CG1 ILE A 186      1.447  18.864  79.381  1.00 21.17      A   C
ATOM   1275  CD1 ILE A 186      2.829  18.608  79.503  1.00 19.20      A   C
ATOM   1276  CG2 ILE A 186      0.755  16.622  79.712  1.00 15.57      A   C
ATOM   1277  C   ILE A 186     -1.537  17.349  81.035  1.00 25.70      A   C
ATOM   1278  O   ILE A 186     -2.156  16.499  80.484  1.00 28.82      A   O
ATOM   1279  N   ALA A 187     -1.452  17.399  82.341  1.00 25.58      A   N
ATOM   1280  CA  ALA A 187     -2.129  16.446  83.172  1.00 26.34      A   C
ATOM   1281  CB  ALA A 187     -1.680  16.595  84.552  1.00 25.73      A   C
ATOM   1282  C   ALA A 187     -3.627  16.513  83.102  1.00 26.26      A   C
ATOM   1283  O   ALA A 187     -4.302  15.533  83.115  1.00 27.68      A   O
ATOM   1284  N   ALA A 188     -4.126  17.719  83.085  1.00 26.37      A   N
ATOM   1285  CA  ALA A 188     -5.522  18.010  83.029  1.00 28.71      A   C
ATOM   1286  CB  ALA A 188     -5.761  19.432  83.349  1.00 25.10      A   C
ATOM   1287  C   ALA A 188     -6.217  17.594  81.753  1.00 29.49      A   C
ATOM   1288  O   ALA A 188     -7.386  17.343  81.779  1.00 32.11      A   O
ATOM   1289  N   ASN A 189     -5.490  17.561  80.647  1.00 28.03      A   N
ATOM   1290  CA  ASN A 189     -6.033  17.233  79.356  1.00 29.23      A   C
ATOM   1291  CB  ASN A 189     -5.273  17.896  78.223  1.00 28.15      A   C
ATOM   1292  CG  ASN A 189     -5.439  19.340  78.188  1.00 28.50      A   C
ATOM   1293  OD1 ASN A 189     -6.457  19.848  78.514  1.00 34.45      A   O
ATOM   1294  ND2 ASN A 189     -4.431  20.020  77.805  1.00 24.72      A   N
ATOM   1295  C   ASN A 189     -6.159  15.764  79.066  1.00 31.35      A   C
```

Appendix 1

```
ATOM   1296  O    ASN A 189      -5.380  14.977  79.515  1.00 31.41      A    O
ATOM   1297  N    PRO A 190      -7.220  15.393  78.388  1.00 32.09      A    N
ATOM   1298  CA   PRO A 190      -7.416  14.065  77.856  1.00 33.14      A    C
ATOM   1299  CB   PRO A 190      -8.857  14.090  77.448  1.00 32.46      A    C
ATOM   1300  CG   PRO A 190      -9.127  15.431  77.182  1.00 34.25      A    C
ATOM   1301  CD   PRO A 190      -8.378  16.228  78.116  1.00 33.08      A    C
ATOM   1302  C    PRO A 190      -6.527  13.701  76.687  1.00 35.01      A    C
ATOM   1303  O    PRO A 190      -6.247  12.558  76.468  1.00 35.77      A    O
ATOM   1304  N    PHE A 191      -6.208  14.660  75.856  1.00 34.30      A    N
ATOM   1305  CA   PHE A 191      -5.326  14.412  74.765  1.00 32.53      A    C
ATOM   1306  CB   PHE A 191      -5.549  15.382  73.615  1.00 30.97      A    C
ATOM   1307  CG   PHE A 191      -5.684  16.766  74.028  1.00 27.13      A    C
ATOM   1308  CD1  PHE A 191      -4.630  17.584  74.027  1.00 27.78      A    C
ATOM   1309  CE1  PHE A 191      -4.767  18.818  74.419  1.00 23.56      A    C
ATOM   1310  CZ   PHE A 191      -5.928  19.258  74.795  1.00 22.89      A    C
ATOM   1311  CE2  PHE A 191      -6.963  18.472  74.817  1.00 23.34      A    C
ATOM   1312  CD2  PHE A 191      -6.857  17.246  74.434  1.00 25.14      A    C
ATOM   1313  C    PHE A 191      -3.872  14.215  75.055  1.00 33.27      A    C
ATOM   1314  O    PHE A 191      -3.274  13.374  74.461  1.00 35.67      A    O
ATOM   1315  N    ALA A 192      -3.266  14.987  75.925  1.00 30.45      A    N
ATOM   1316  CA   ALA A 192      -1.819  14.874  75.946  1.00 30.97      A    C
ATOM   1317  CB   ALA A 192      -1.412  13.574  75.299  1.00 26.99      A    C
ATOM   1318  C    ALA A 192      -1.143  15.946  75.182  1.00 29.71      A    C
ATOM   1319  O    ALA A 192      -0.770  15.744  74.080  1.00 31.61      A    O
ATOM   1320  N    GLY A 193      -0.953  17.082  75.792  1.00 28.86      A    N
ATOM   1321  CA   GLY A 193      -0.307  18.154  75.130  1.00 27.07      A    C
ATOM   1322  C    GLY A 193      -1.111  19.313  75.511  1.00 26.42      A    C
ATOM   1323  O    GLY A 193      -1.868  19.231  76.400  1.00 26.59      A    O
ATOM   1324  N    ILE A 194      -0.893  20.407  74.839  1.00 26.45      A    N
ATOM   1325  CA   ILE A 194      -1.540  21.618  75.173  1.00 26.59      A    C
ATOM   1326  CB   ILE A 194      -0.662  22.491  76.081  1.00 25.98      A    C
ATOM   1327  CG1  ILE A 194      -0.409  21.779  77.381  1.00 27.00      A    C
ATOM   1328  CD1  ILE A 194       0.875  22.034  77.938  1.00 28.55      A    C
ATOM   1329  CG2  ILE A 194      -1.333  23.739  76.408  1.00 22.91      A    C
ATOM   1330  C    ILE A 194      -1.861  22.306  73.899  1.00 27.64      A    C
ATOM   1331  O    ILE A 194      -1.121  22.292  72.998  1.00 26.07      A    O
ATOM   1332  N    VAL A 195      -3.025  22.896  73.828  1.00 29.29      A    N
ATOM   1333  CA   VAL A 195      -3.414  23.664  72.679  1.00 30.91      A    C
ATOM   1334  CB   VAL A 195      -4.901  23.756  72.569  1.00 31.19      A    C
ATOM   1335  CG1  VAL A 195      -5.478  22.417  72.535  1.00 27.57      A    C
ATOM   1336  CG2  VAL A 195      -5.445  24.549  73.646  1.00 31.06      A    C
ATOM   1337  C    VAL A 195      -2.792  25.028  72.616  1.00 33.05      A    C
ATOM   1338  O    VAL A 195      -2.475  25.582  73.617  1.00 33.38      A    O
ATOM   1339  N    CYS A 196      -2.499  25.514  71.431  1.00 34.89      A    N
ATOM   1340  CA   CYS A 196      -2.084  26.878  71.270  1.00 35.68      A    C
ATOM   1341  CB   CYS A 196      -1.416  27.024  69.922  1.00 35.38      A    C
ATOM   1342  SG   CYS A 196       0.091  26.200  69.771  1.00 40.36      A    S
ATOM   1343  C    CYS A 196      -3.183  27.908  71.424  1.00 36.20      A    C
ATOM   1344  O    CYS A 196      -3.109  28.775  72.205  1.00 36.69      A    O
ATOM   1345  N    GLU A 197      -4.214  27.782  70.637  1.00 38.01      A    N
ATOM   1346  CA   GLU A 197      -5.305  28.700  70.608  1.00 39.08      A    C
ATOM   1347  CB   GLU A 197      -5.573  29.157  69.186  1.00 39.43      A    C
ATOM   1348  CG   GLU A 197      -4.929  30.448  68.778  1.00 42.33      A    C
ATOM   1349  CD   GLU A 197      -3.759  30.311  67.835  1.00 46.81      A    C
```

Appendix 1

```
ATOM   1350  OE1 GLU A 197      -3.370  29.204  67.456  1.00 40.19      A    O
ATOM   1351  OE2 GLU A 197      -3.206  31.351  67.483  1.00 49.06      A    O-1
ATOM   1352  C   GLU A 197      -6.339  27.741  70.985  1.00 39.19      A    C
ATOM   1353  O   GLU A 197      -6.177  26.585  70.791  1.00 39.55      A    O
ATOM   1354  N   PRO A 198      -7.429  28.176  71.526  1.00 39.61      A    N
ATOM   1355  CA  PRO A 198      -8.365  27.185  72.000  1.00 40.08      A    C
ATOM   1356  CB  PRO A 198      -9.500  28.028  72.512  1.00 39.28      A    C
ATOM   1357  CG  PRO A 198      -8.904  29.281  72.854  1.00 42.13      A    C
ATOM   1358  CD  PRO A 198      -7.653  29.483  72.122  1.00 40.39      A    C
ATOM   1359  C   PRO A 198      -8.822  26.304  70.858  1.00 40.57      A    C
ATOM   1360  O   PRO A 198      -9.223  26.755  69.824  1.00 41.60      A    O
ATOM   1361  N   ASP A 199      -8.700  25.016  71.073  1.00 40.12      A    N
ATOM   1362  CA  ASP A 199      -9.057  23.998  70.125  1.00 39.42      A    C
ATOM   1363  CB  ASP A 199     -10.515  24.095  69.741  1.00 40.68      A    C
ATOM   1364  CG  ASP A 199     -11.029  22.829  69.125  1.00 46.89      A    C
ATOM   1365  OD1 ASP A 199     -10.898  21.764  69.729  1.00 49.29      A    O
ATOM   1366  OD2 ASP A 199     -11.590  22.886  68.033  1.00 53.30      A    O-1
ATOM   1367  C   ASP A 199      -8.209  23.885  68.890  1.00 37.06      A    C
ATOM   1368  O   ASP A 199      -8.644  23.369  67.912  1.00 36.00      A    O
ATOM   1369  N   ASN A 200      -6.994  24.357  68.957  1.00 34.92      A    N
ATOM   1370  CA  ASN A 200      -6.047  24.170  67.902  1.00 32.78      A    C
ATOM   1371  CB  ASN A 200      -5.557  25.527  67.459  1.00 33.05      A    C
ATOM   1372  CG  ASN A 200      -6.371  26.140  66.381  1.00 33.14      A    C
ATOM   1373  OD1 ASN A 200      -7.417  25.706  66.040  1.00 36.66      A    O
ATOM   1374  ND2 ASN A 200      -5.873  27.194  65.856  1.00 36.20      A    N
ATOM   1375  C   ASN A 200      -4.863  23.450  68.465  1.00 31.12      A    C
ATOM   1376  O   ASN A 200      -4.245  23.970  69.304  1.00 31.77      A    O
ATOM   1377  N   TYR A 201      -4.528  22.268  68.003  1.00 30.08      A    N
ATOM   1378  CA  TYR A 201      -3.387  21.554  68.546  1.00 29.91      A    C
ATOM   1379  CB  TYR A 201      -3.794  20.149  68.962  1.00 28.29      A    C
ATOM   1380  CG  TYR A 201      -2.768  19.304  69.650  1.00 25.90      A    C
ATOM   1381  CD1 TYR A 201      -2.745  19.205  71.007  1.00 24.51      A    C
ATOM   1382  CE1 TYR A 201      -1.849  18.415  71.629  1.00 24.80      A    C
ATOM   1383  CZ  TYR A 201      -0.954  17.719  70.908  1.00 25.17      A    C
ATOM   1384  OH  TYR A 201      -0.071  16.946  71.544  1.00 26.04      A    O
ATOM   1385  CE2 TYR A 201      -0.961  17.792  69.569  1.00 17.49      A    C
ATOM   1386  CD2 TYR A 201      -1.863  18.562  68.946  1.00 19.92      A    C
ATOM   1387  C   TYR A 201      -2.313  21.481  67.520  1.00 30.12      A    C
ATOM   1388  O   TYR A 201      -2.562  21.117  66.447  1.00 32.52      A    O
ATOM   1389  N   PHE A 202      -1.103  21.833  67.860  1.00 28.79      A    N
ATOM   1390  CA  PHE A 202      -0.028  21.788  66.926  1.00 28.62      A    C
ATOM   1391  CB  PHE A 202       0.496  23.184  66.664  1.00 27.84      A    C
ATOM   1392  CG  PHE A 202      -0.417  24.008  65.844  1.00 27.70      A    C
ATOM   1393  CD1 PHE A 202      -0.424  23.891  64.501  1.00 23.98      A    C
ATOM   1394  CE1 PHE A 202      -1.236  24.617  63.760  1.00 24.58      A    C
ATOM   1395  CZ  PHE A 202      -2.076  25.469  64.336  1.00 27.57      A    C
ATOM   1396  CE2 PHE A 202      -2.106  25.595  65.667  1.00 26.88      A    C
ATOM   1397  CD2 PHE A 202      -1.283  24.875  66.420  1.00 25.14      A    C
ATOM   1398  C   PHE A 202       1.038  20.912  67.445  1.00 23.62      A    C
ATOM   1399  O   PHE A 202       1.463  21.056  68.509  1.00 31.75      A    O
ATOM   1400  N   VAL A 203       1.432  19.958  66.660  1.00 27.98      A    N
ATOM   1401  CA  VAL A 203       2.454  19.041  67.024  1.00 27.84      A    C
ATOM   1402  CB  VAL A 203       2.435  17.821  66.130  1.00 28.80      A    C
ATOM   1403  CG1 VAL A 203       3.150  18.040  64.894  1.00 29.16      A    C
```

Appendix 1

```
ATOM   1404  CG2 VAL A 203      2.985  16.699  66.818  1.00 29.85      A  C
ATOM   1405  C   VAL A 203      3.817  19.658  67.176  1.00 28.61      A  C
ATOM   1406  O   VAL A 203      4.564  19.252  67.989  1.00 28.31      A  O
ATOM   1407  N   GLN A 204      4.153  20.614  66.343  1.00 28.73      A  N
ATOM   1408  CA  GLN A 204      5.411  21.311  66.458  1.00 29.03      A  C
ATOM   1409  CB  GLN A 204      5.677  22.172  65.237  1.00 28.52      A  C
ATOM   1410  CG  GLN A 204      4.789  23.351  65.110  1.00 26.11      A  C
ATOM   1411  CD  GLN A 204      3.603  23.074  64.270  1.00 24.92      A  C
ATOM   1412  OE1 GLN A 204      3.037  22.042  64.331  1.00 24.85      A  O
ATOM   1413  NE2 GLN A 204      3.242  23.997  63.479  1.00 22.08      A  N
ATOM   1414  C   GLN A 204      5.538  22.138  67.700  1.00 29.47      A  C
ATOM   1415  O   GLN A 204      6.571  22.210  68.273  1.00 29.80      A  O
ATOM   1416  N   CYS A 205      4.480  22.802  68.089  1.00 29.65      A  N
ATOM   1417  CA  CYS A 205      4.501  23.648  69.242  1.00 30.88      A  C
ATOM   1418  CB  CYS A 205      3.195  24.451  69.340  1.00 31.62      A  C
ATOM   1419  SG  CYS A 205      2.614  25.579  68.009  1.00 39.64      A  S
ATOM   1420  C   CYS A 205      4.740  22.838  70.504  1.00 30.18      A  C
ATOM   1421  O   CYS A 205      5.505  23.215  71.328  1.00 30.87      A  O
ATOM   1422  N   ASN A 206      4.064  21.708  70.598  1.00 29.79      A  N
ATOM   1423  CA  ASN A 206      4.104  20.769  71.692  1.00 28.35      A  C
ATOM   1424  CB  ASN A 206      3.037  19.685  71.522  1.00 28.51      A  C
ATOM   1425  CG  ASN A 206      1.713  20.041  72.146  1.00 29.31      A  C
ATOM   1426  OD1 ASN A 206      1.430  19.655  73.232  1.00 31.63      A  O
ATOM   1427  ND2 ASN A 206      0.897  20.730  71.433  1.00 25.17      A  N
ATOM   1428  C   ASN A 206      5.476  20.171  71.834  1.00 27.32      A  C
ATOM   1429  O   ASN A 206      5.906  19.861  72.889  1.00 28.52      A  O
ATOM   1430  N   SER A 207      6.184  20.124  70.741  1.00 25.05      A  N
ATOM   1431  CA  SER A 207      7.531  19.641  70.667  1.00 25.34      A  C
ATOM   1432  CB  SER A 207      7.990  20.106  69.313  1.00 26.60      A  C
ATOM   1433  OG  SER A 207      8.304  19.080  68.454  1.00 32.95      A  O
ATOM   1434  C   SER A 207      8.479  20.376  71.549  1.00 24.35      A  C
ATOM   1435  O   SER A 207      9.207  19.803  72.304  1.00 23.09      A  O
ATOM   1436  N   VAL A 208      8.432  21.683  71.422  1.00 22.86      A  N
ATOM   1437  CA  VAL A 208      9.209  22.615  72.172  1.00 22.84      A  C
ATOM   1438  CB  VAL A 208      8.976  24.016  71.629  1.00 22.67      A  C
ATOM   1439  CG1 VAL A 208      9.878  24.984  72.220  1.00 23.19      A  C
ATOM   1440  CG2 VAL A 208      9.198  24.016  70.235  1.00 24.18      A  C
ATOM   1441  C   VAL A 208      8.893  22.550  73.629  1.00 22.78      A  C
ATOM   1442  O   VAL A 208      9.749  22.573  74.427  1.00 21.47      A  O
ATOM   1443  N   ALA A 209      7.638  22.439  73.959  1.00 23.74      A  N
ATOM   1444  CA  ALA A 209      7.239  22.298  75.328  1.00 24.19      A  C
ATOM   1445  CB  ALA A 209      5.779  22.445  75.457  1.00 22.24      A  C
ATOM   1446  C   ALA A 209      7.710  21.037  76.002  1.00 24.48      A  C
ATOM   1447  O   ALA A 209      8.086  21.062  77.123  1.00 26.14      A  O
ATOM   1448  N   TYR A 210      7.669  19.918  75.333  1.00 23.14      A  N
ATOM   1449  CA  TYR A 210      8.191  18.712  75.910  1.00 21.69      A  C
ATOM   1450  CB  TYR A 210      7.665  17.482  75.183  1.00 18.95      A  C
ATOM   1451  CG  TYR A 210      6.227  17.131  75.518  1.00 17.45      A  C
ATOM   1452  CD1 TYR A 210      5.934  16.219  76.471  1.00 15.84      A  C
ATOM   1453  CE1 TYR A 210      4.689  15.913  76.760  1.00 14.85      A  C
ATOM   1454  CZ  TYR A 210      3.680  16.513  76.117  1.00 18.59      A  C
ATOM   1455  OH  TYR A 210      2.441  16.157  76.437  1.00 20.72      A  O
ATOM   1456  CE2 TYR A 210      3.925  17.414  75.157  1.00 14.28      A  C
ATOM   1457  CD2 TYR A 210      5.174  17.709  74.856  1.00 11.77      A  C
```

Appendix 1

```
ATOM   1458  C   TYR A 210       9.709  18.749  76.120  1.00 22.36      A    C
ATOM   1459  O   TYR A 210      10.201  18.271  77.080  1.00 22.17      A    O
ATOM   1460  N   LEU A 211      10.423  19.340  75.183  1.00 22.55      A    N
ATOM   1461  CA  LEU A 211      11.852  19.511  75.230  1.00 21.20      A    C
ATOM   1462  CB  LEU A 211      12.377  20.055  73.909  1.00 20.74      A    C
ATOM   1463  CG  LEU A 211      13.879  20.026  73.735  1.00 19.94      A    C
ATOM   1464  CD1 LEU A 211      14.328  18.693  73.640  1.00 23.09      A    C
ATOM   1465  CD2 LEU A 211      14.321  20.725  72.580  1.00 18.96      A    C
ATOM   1466  C   LEU A 211      12.250  20.397  76.357  1.00 22.02      A    C
ATOM   1467  O   LEU A 211      13.245  20.206  76.989  1.00 22.02      A    O
ATOM   1468  N   SER A 212      11.434  21.386  76.596  1.00 20.88      A    N
ATOM   1469  CA  SER A 212      11.649  22.279  77.688  1.00 20.67      A    C
ATOM   1470  CB  SER A 212      10.744  23.476  77.588  1.00 19.52      A    C
ATOM   1471  OG  SER A 212       9.600  23.363  78.338  1.00 20.06      A    O
ATOM   1472  C   SER A 212      11.594  21.582  79.029  1.00 21.79      A    C
ATOM   1473  O   SER A 212      12.306  21.911  79.897  1.00 23.35      A    O
ATOM   1474  N   LEU A 213      10.754  20.593  79.162  1.00 22.03      A    N
ATOM   1475  CA  LEU A 213      10.668  19.791  80.337  1.00 24.36      A    C
ATOM   1476  CB  LEU A 213       9.516  18.839  80.187  1.00 22.93      A    C
ATOM   1477  CG  LEU A 213       8.200  19.077  80.866  1.00 22.82      A    C
ATOM   1478  CD1 LEU A 213       7.914  20.466  81.125  1.00 19.07      A    C
ATOM   1479  CD2 LEU A 213       7.146  18.458  80.108  1.00 21.49      A    C
ATOM   1480  C   LEU A 213      11.928  19.013  80.620  1.00 26.45      A    C
ATOM   1481  O   LEU A 213      12.321  18.924  81.748  1.00 27.93      A    O
ATOM   1482  N   TRP A 214      12.543  18.467  79.581  1.00 25.71      A    N
ATOM   1483  CA  TRP A 214      13.788  17.753  79.656  1.00 24.60      A    C
ATOM   1484  CB  TRP A 214      14.169  17.119  78.316  1.00 23.04      A    C
ATOM   1485  CG  TRP A 214      13.352  15.958  77.898  1.00 25.55      A    C
ATOM   1486  CD1 TRP A 214      12.086  15.995  77.527  1.00 27.88      A    C
ATOM   1487  NE1 TRP A 214      11.646  14.777  77.205  1.00 28.39      A    N
ATOM   1488  CE2 TRP A 214      12.659  13.888  77.334  1.00 24.90      A    C
ATOM   1489  CD2 TRP A 214      13.757  14.593  77.774  1.00 25.37      A    C
ATOM   1490  CE3 TRP A 214      14.943  13.904  77.990  1.00 22.24      A    C
ATOM   1491  CZ3 TRP A 214      14.966  12.587  77.777  1.00 25.08      A    C
ATOM   1492  CH2 TRP A 214      13.853  11.912  77.336  1.00 24.91      A    C
ATOM   1493  CZ2 TRP A 214      12.688  12.543  77.125  1.00 21.94      A    C
ATOM   1494  C   TRP A 214      14.897  18.639  80.093  1.00 25.41      A    C
ATOM   1495  O   TRP A 214      15.763  18.228  80.765  1.00 27.13      A    O
ATOM   1496  N   VAL A 215      14.919  19.857  79.626  1.00 26.39      A    N
ATOM   1497  CA  VAL A 215      15.950  20.765  80.044  1.00 27.32      A    C
ATOM   1498  CB  VAL A 215      16.005  22.027  79.225  1.00 26.63      A    C
ATOM   1499  CG1 VAL A 215      17.069  22.884  79.705  1.00 27.44      A    C
ATOM   1500  CG2 VAL A 215      16.225  21.719  77.847  1.00 25.62      A    C
ATOM   1501  C   VAL A 215      15.802  21.084  81.489  1.00 28.59      A    C
ATOM   1502  O   VAL A 215      16.755  21.164  82.187  1.00 28.79      A    O
ATOM   1503  N   TYR A 216      14.580  21.264  81.927  1.00 29.48      A    N
ATOM   1504  CA  TYR A 216      14.308  21.546  83.303  1.00 29.90      A    C
ATOM   1505  CB  TYR A 216      12.820  21.811  83.528  1.00 28.75      A    C
ATOM   1506  CG  TYR A 216      12.529  22.301  84.899  1.00 27.19      A    C
ATOM   1507  CD1 TYR A 216      12.613  23.625  85.209  1.00 27.85      A    C
ATOM   1508  CE1 TYR A 216      12.392  24.064  86.451  1.00 23.18      A    C
ATOM   1509  CZ  TYR A 216      12.094  23.182  87.408  1.00 21.53      A    C
ATOM   1510  OH  TYR A 216      11.856  23.578  88.652  1.00 19.87      A    O
ATOM   1511  CE2 TYR A 216      12.024  21.872  87.130  1.00 23.67      A    C
```

Appendix 1

```
ATOM   1512  CD2 TYR A 216      12.240  21.440  85.896  1.00 26.61      A    C
ATOM   1513  C   TYR A 216      14.753  20.398  84.153  1.00 30.26      A    C
ATOM   1514  O   TYR A 216      15.350  20.576  85.170  1.00 31.45      A    O
ATOM   1515  N   ASP A 217      14.469  19.211  83.696  1.00 29.66      A    N
ATOM   1516  CA  ASP A 217      14.866  18.019  84.391  1.00 30.38      A    C
ATOM   1517  CB  ASP A 217      14.277  16.821  83.704  1.00 29.62      A    C
ATOM   1518  CG  ASP A 217      12.894  16.598  84.074  1.00 28.93      A    C
ATOM   1519  OD1 ASP A 217      12.336  17.360  84.813  1.00 21.84      A    O
ATOM   1520  OD2 ASP A 217      12.356  15.639  83.623  1.00 33.90      A    O-1
ATOM   1521  C   ASP A 217      16.362  17.879  84.493  1.00 31.18      A    C
ATOM   1522  O   ASP A 217      16.866  17.430  85.465  1.00 32.23      A    O
ATOM   1523  N   ARG A 218      17.078  18.257  83.467  1.00 31.11      A    N
ATOM   1524  CA  ARG A 218      18.505  18.259  83.535  1.00 33.60      A    C
ATOM   1525  CB  ARG A 218      19.087  18.456  82.159  1.00 33.69      A    C
ATOM   1526  CG  ARG A 218      20.396  19.096  82.176  1.00 37.66      A    C
ATOM   1527  CD  ARG A 218      21.495  18.138  82.458  1.00 41.05      A    C
ATOM   1528  NE  ARG A 218      22.603  18.398  81.561  1.00 48.14      A    N
ATOM   1529  CZ  ARG A 218      23.642  19.152  81.842  1.00 47.07      A    C
ATOM   1530  NH1 ARG A 218      23.774  19.707  83.019  1.00 45.89      A    N
ATOM   1531  NH2 ARG A 218      24.552  19.333  80.941  1.00 47.25      A    N
ATOM   1532  C   ARG A 218      19.063  19.264  84.527  1.00 33.49      A    C
ATOM   1533  O   ARG A 218      20.026  19.024  85.200  1.00 34.75      A    O
ATOM   1534  N   LEU A 219      18.462  20.421  84.577  1.00 33.11      A    N
ATOM   1535  CA  LEU A 219      18.813  21.398  85.545  1.00 32.38      A    C
ATOM   1536  CB  LEU A 219      18.252  22.750  85.193  1.00 30.78      A    C
ATOM   1537  CG  LEU A 219      18.856  23.408  83.979  1.00 27.90      A    C
ATOM   1538  CD1 LEU A 219      17.986  24.477  83.548  1.00 24.91      A    C
ATOM   1539  CD2 LEU A 219      20.190  23.933  84.252  1.00 20.86      A    C
ATOM   1540  C   LEU A 219      18.493  21.022  86.965  1.00 33.86      A    C
ATOM   1541  O   LEU A 219      19.190  21.404  87.849  1.00 34.81      A    O
ATOM   1542  N   HIS A 220      17.417  20.312  87.192  1.00 33.51      A    N
ATOM   1543  CA  HIS A 220      16.932  20.154  88.522  1.00 33.58      A    C
ATOM   1544  CB  HIS A 220      15.632  20.917  88.657  1.00 33.79      A    C
ATOM   1545  CG  HIS A 220      15.788  22.385  88.503  1.00 34.64      A    C
ATOM   1546  ND1 HIS A 220      16.317  23.177  89.482  1.00 34.28      A    N
ATOM   1547  CE1 HIS A 220      16.340  24.420  89.072  1.00 36.35      A    C
ATOM   1548  NE2 HIS A 220      15.830  24.464  87.865  1.00 38.91      A    N
ATOM   1549  CD2 HIS A 220      15.476  23.205  87.487  1.00 37.04      A    C
ATOM   1550  C   HIS A 220      16.774  18.765  89.076  1.00 34.64      A    C
ATOM   1551  O   HIS A 220      16.476  18.615  90.222  1.00 36.19      A    O
ATOM   1552  N   GLY A 221      16.960  17.739  88.289  1.00 34.52      A    N
ATOM   1553  CA  GLY A 221      16.870  16.415  88.839  1.00 35.49      A    C
ATOM   1554  C   GLY A 221      15.472  15.903  88.999  1.00 36.70      A    C
ATOM   1555  O   GLY A 221      15.243  14.907  89.616  1.00 35.74      A    O
ATOM   1556  N   THR A 222      14.545  16.597  88.380  1.00 36.51      A    N
ATOM   1557  CA  THR A 222      13.152  16.244  88.343  1.00 36.06      A    C
ATOM   1558  CB  THR A 222      12.357  17.470  88.165  1.00 36.60      A    C
ATOM   1559  OG1 THR A 222      13.057  18.311  87.291  1.00 36.46      A    O
ATOM   1560  CG2 THR A 222      12.300  18.190  89.415  1.00 33.98      A    C
ATOM   1561  C   THR A 222      12.831  15.221  87.266  1.00 36.30      A    C
ATOM   1562  O   THR A 222      13.682  14.847  86.530  1.00 35.33      A    O
ATOM   1563  N   ASP A 223      11.582  14.782  87.206  1.00 37.05      A    N
ATOM   1564  CA  ASP A 223      11.098  13.789  86.250  1.00 37.39      A    C
ATOM   1565  CB  ASP A 223      10.804  12.459  86.916  1.00 37.62      A    C
```

Appendix 1

```
ATOM   1566  CG   ASP A 223      10.818  11.318  85.949  1.00 40.13          A    C
ATOM   1567  OD1  ASP A 223      11.504  11.415  84.966  1.00 42.89          A    O
ATOM   1568  OD2  ASP A 223      10.138  10.313  86.138  1.00 42.24          A    O-1
ATOM   1569  C    ASP A 223       9.882  14.254  85.490  1.00 36.43          A    C
ATOM   1570  O    ASP A 223       8.950  13.543  85.281  1.00 36.83          A    O
ATOM   1571  N    TYR A 224       9.936  15.464  85.036  1.00 35.38          A    N
ATOM   1572  CA   TYR A 224       8.863  15.999  84.276  1.00 35.96          A    C
ATOM   1573  CB   TYR A 224       8.974  17.498  84.199  1.00 36.10          A    C
ATOM   1574  CG   TYR A 224       8.546  18.204  85.438  1.00 36.94          A    C
ATOM   1575  CD1  TYR A 224       7.239  18.238  85.825  1.00 37.97          A    C
ATOM   1576  CE1  TYR A 224       6.862  18.890  86.931  1.00 33.16          A    C
ATOM   1577  CZ   TYR A 224       7.793  19.513  87.661  1.00 34.56          A    C
ATOM   1578  OH   TYR A 224       7.468  20.169  88.780  1.00 34.50          A    O
ATOM   1579  CE2  TYR A 224       9.077  19.497  87.301  1.00 37.08          A    C
ATOM   1580  CD2  TYR A 224       9.447  18.863  86.208  1.00 37.49          A    C
ATOM   1581  C    TYR A 224       8.632  15.352  82.894  1.00 36.11          A    C
ATOM   1582  O    TYR A 224       7.608  15.572  82.324  1.00 36.37          A    O
ATOM   1583  N    ARG A 225       9.491  14.468  82.413  1.00 35.41          A    N
ATOM   1584  CA   ARG A 225       9.186  13.770  81.184  1.00 36.59          A    C
ATOM   1585  CB   ARG A 225      10.443  13.227  80.603  1.00 37.47          A    C
ATOM   1586  CG   ARG A 225      11.640  14.018  81.022  1.00 36.36          A    C
ATOM   1587  CD   ARG A 225      12.907  13.193  81.157  1.00 33.92          A    C
ATOM   1588  NE   ARG A 225      13.430  13.332  82.492  1.00 36.11          A    N
ATOM   1589  CZ   ARG A 225      14.235  12.482  83.082  1.00 34.01          A    C
ATOM   1590  NH1  ARG A 225      14.658  11.433  82.467  1.00 31.74          A    N
ATOM   1591  NH2  ARG A 225      14.606  12.694  84.297  1.00 32.77          A    N
ATOM   1592  C    ARG A 225       8.120  12.665  81.296  1.00 37.59          A    C
ATOM   1593  O    ARG A 225       8.258  11.649  81.938  1.00 36.57          A    O
ATOM   1594  N    ALA A 226       7.007  13.052  80.673  1.00 39.12          A    N
ATOM   1595  CA   ALA A 226       5.745  12.415  80.386  1.00 37.07          A    C
ATOM   1596  CB   ALA A 226       4.666  13.275  80.889  1.00 35.88          A    C
ATOM   1597  C    ALA A 226       5.712  12.434  78.878  1.00 36.59          A    C
ATOM   1598  O    ALA A 226       4.683  12.430  78.237  1.00 34.65          A    O
ATOM   1599  N    ALA A 227       6.889  12.557  78.323  1.00 35.38          A    N
ATOM   1600  CA   ALA A 227       7.060  12.632  76.923  1.00 36.27          A    C
ATOM   1601  CB   ALA A 227       8.482  12.955  76.623  1.00 32.97          A    C
ATOM   1602  C    ALA A 227       6.648  11.352  76.288  1.00 37.06          A    C
ATOM   1603  O    ALA A 227       6.051  11.342  75.279  1.00 37.67          A    O
ATOM   1604  N    THR A 228       7.063  10.271  76.901  1.00 39.32          A    N
ATOM   1605  CA   THR A 228       6.973   8.958  76.342  1.00 42.11          A    C
ATOM   1606  CB   THR A 228       7.543   7.928  77.224  1.00 42.87          A    C
ATOM   1607  OG1  THR A 228       8.801   7.514  76.684  1.00 47.97          A    O
ATOM   1608  CG2  THR A 228       6.578   6.739  77.280  1.00 40.23          A    C
ATOM   1609  C    THR A 228       5.598   8.597  76.356  1.00 43.56          A    C
ATOM   1610  O    THR A 228       5.138   7.765  75.612  1.00 43.27          A    O
ATOM   1611  N    ARG A 229       4.972   9.256  77.273  1.00 44.82          A    N
ATOM   1612  CA   ARG A 229       3.746   8.814  77.756  1.00 44.74          A    C
ATOM   1613  CB   ARG A 229       3.324   9.632  78.930  1.00 44.93          A    C
ATOM   1614  CG   ARG A 229       4.094   9.277  80.114  1.00 50.87          A    C
ATOM   1615  CD   ARG A 229       3.584  10.047  81.292  1.00 63.78          A    C
ATOM   1616  NE   ARG A 229       2.448   9.410  81.942  1.00 69.31          A    N
ATOM   1617  CZ   ARG A 229       2.318   8.097  82.108  1.00 72.17          A    C
ATOM   1618  NH1  ARG A 229       3.251   7.277  81.668  1.00 72.06          A    N
ATOM   1619  NH2  ARG A 229       1.252   7.602  82.716  1.00 71.18          A    N
```

Appendix 1

```
ATOM   1620  C    ARG A 229       3.032   9.158  76.554  1.00 41.75      A    C
ATOM   1621  O    ARG A 229       3.569   9.002  75.485  1.00 40.27      A    O
ATOM   1622  N    ALA A 230       1.793   9.517  76.666  1.00 40.13      A    N
ATOM   1623  CA   ALA A 230       1.062   9.334  75.472  1.00 39.26      A    C
ATOM   1624  CB   ALA A 230      -0.432   9.518  75.614  1.00 39.31      A    C
ATOM   1625  C    ALA A 230       1.647  10.190  74.444  1.00 36.46      A    C
ATOM   1626  O    ALA A 230       1.513   9.878  73.303  1.00 38.31      A    O
ATOM   1627  N    TRP A 231       2.369  11.227  74.791  1.00 32.24      A    N
ATOM   1628  CA   TRP A 231       2.586  12.187  73.762  1.00 29.73      A    C
ATOM   1629  CB   TRP A 231       3.472  13.324  74.227  1.00 29.23      A    C
ATOM   1630  CG   TRP A 231       3.495  14.403  73.232  1.00 27.37      A    C
ATOM   1631  CD1  TRP A 231       2.477  15.146  72.891  1.00 28.76      A    C
ATOM   1632  NE1  TRP A 231       2.807  16.006  71.934  1.00 25.75      A    N
ATOM   1633  CE2  TRP A 231       4.098  15.813  71.605  1.00 19.94      A    C
ATOM   1634  CD2  TRP A 231       4.565  14.807  72.413  1.00 21.24      A    C
ATOM   1635  CE3  TRP A 231       5.866  14.409  72.278  1.00 21.64      A    C
ATOM   1636  CZ3  TRP A 231       6.626  15.030  71.373  1.00 17.27      A    C
ATOM   1637  CH2  TRP A 231       6.136  16.034  70.597  1.00 15.75      A    C
ATOM   1638  CZ2  TRP A 231       4.873  16.443  70.697  1.00 17.04      A    C
ATOM   1639  C    TRP A 231       3.231  11.613  72.549  1.00 29.69      A    C
ATOM   1640  O    TRP A 231       2.735  11.791  71.502  1.00 28.87      A    O
ATOM   1641  N    LEU A 232       4.327  10.911  72.682  1.00 30.20      A    N
ATOM   1642  CA   LEU A 232       4.950  10.323  71.539  1.00 31.18      A    C
ATOM   1643  CB   LEU A 232       6.255   9.706  71.916  1.00 30.14      A    C
ATOM   1644  CG   LEU A 232       7.547  10.374  71.554  1.00 28.75      A    C
ATOM   1645  CD1  LEU A 232       7.348  11.765  71.433  1.00 28.38      A    C
ATOM   1646  CD2  LEU A 232       8.496  10.125  72.581  1.00 23.36      A    C
ATOM   1647  C    LEU A 232       4.057   9.296  70.939  1.00 32.99      A    C
ATOM   1648  O    LEU A 232       3.992   9.166  69.763  1.00 35.76      A    O
ATOM   1649  N    ASP A 233       3.400   8.535  71.781  1.00 33.79      A    N
ATOM   1650  CA   ASP A 233       2.385   7.595  71.389  1.00 35.15      A    C
ATOM   1651  CB   ASP A 233       2.020   6.721  72.575  1.00 37.04      A    C
ATOM   1652  CG   ASP A 233       3.169   5.927  73.082  1.00 43.79      A    C
ATOM   1653  OD1  ASP A 233       4.218   5.879  72.431  1.00 50.73      A    O
ATOM   1654  OD2  ASP A 233       3.034   5.351  74.150  1.00 48.47      A    O-1
ATOM   1655  C    ASP A 233       1.130   8.212  70.820  1.00 33.14      A    C
ATOM   1656  O    ASP A 233       0.568   7.720  69.901  1.00 33.30      A    O
ATOM   1657  N    PHE A 234       0.669   9.271  71.427  1.00 32.45      A    N
ATOM   1658  CA   PHE A 234      -0.520   9.956  70.990  1.00 33.71      A    C
ATOM   1659  CB   PHE A 234      -0.870  11.006  72.023  1.00 33.42      A    C
ATOM   1660  CG   PHE A 234      -1.836  12.009  71.563  1.00 35.52      A    C
ATOM   1661  CD1  PHE A 234      -3.152  11.724  71.501  1.00 37.30      A    C
ATOM   1662  CE1  PHE A 234      -4.020  12.645  71.081  1.00 41.33      A    C
ATOM   1663  CZ   PHE A 234      -3.595  13.856  70.749  1.00 38.51      A    C
ATOM   1664  CE2  PHE A 234      -2.310  14.154  70.823  1.00 36.59      A    C
ATOM   1665  CD2  PHE A 234      -1.435  13.252  71.238  1.00 32.70      A    C
ATOM   1666  C    PHE A 234      -0.399  10.580  69.620  1.00 34.85      A    C
ATOM   1667  O    PHE A 234      -1.317  10.598  68.853  1.00 35.49      A    O
ATOM   1668  N    ILE A 235       0.743  11.153  69.341  1.00 35.64      A    N
ATOM   1669  CA   ILE A 235       0.951  11.769  68.078  1.00 36.88      A    C
ATOM   1670  CB   ILE A 235       2.079  12.795  68.084  1.00 36.96      A    C
ATOM   1671  CG1  ILE A 235       3.435  12.160  68.240  1.00 34.43      A    C
ATOM   1672  CD1  ILE A 235       4.503  13.115  68.307  1.00 27.42      A    C
ATOM   1673  CG2  ILE A 235       1.880  13.734  69.186  1.00 36.02      A    C
```

Appendix 1

```
ATOM   1674  C   ILE A 235       1.025  10.724  67.006  1.00 38.45      A    C
ATOM   1675  O   ILE A 235       0.731  10.951  65.872  1.00 38.65      A    O
ATOM   1676  N   GLN A 236       1.421   9.543  67.394  1.00 39.97      A    N
ATOM   1677  CA  GLN A 236       1.527   8.469  66.444  1.00 41.85      A    C
ATOM   1678  CB  GLN A 236       2.504   7.414  66.890  1.00 40.78      A    C
ATOM   1679  CG  GLN A 236       3.805   7.622  66.246  1.00 40.88      A    C
ATOM   1680  CD  GLN A 236       4.884   6.789  66.776  1.00 39.15      A    C
ATOM   1681  OE1 GLN A 236       4.917   6.516  67.931  1.00 43.83      A    O
ATOM   1682  NE2 GLN A 236       5.805   6.417  65.939  1.00 33.49      A    N
ATOM   1683  C   GLN A 236       0.207   7.905  66.011  1.00 44.44      A    C
ATOM   1684  O   GLN A 236       0.133   7.266  65.025  1.00 46.02      A    O
ATOM   1685  N   LYS A 237      -0.836   8.199  66.757  1.00 47.17      A    N
ATOM   1686  CA  LYS A 237      -2.164   7.739  66.470  1.00 49.59      A    C
ATOM   1687  CB  LYS A 237      -2.992   7.812  67.732  1.00 50.45      A    C
ATOM   1688  CG  LYS A 237      -3.394   6.516  68.326  1.00 52.68      A    C
ATOM   1689  CD  LYS A 237      -2.859   6.381  69.705  1.00 57.66      A    C
ATOM   1690  CE  LYS A 237      -1.686   5.429  69.727  1.00 61.52      A    C
ATOM   1691  NZ  LYS A 237      -1.486   4.834  71.055  1.00 63.05      A    N
ATOM   1692  C   LYS A 237      -2.817   8.662  65.510  1.00 50.65      A    C
ATOM   1693  O   LYS A 237      -3.642   9.422  65.903  1.00 52.25      A    O
ATOM   1694  N   ASP A 238      -2.399   8.631  64.264  1.00 51.05      A    N
ATOM   1695  CA  ASP A 238      -3.011   9.408  63.202  1.00 51.60      A    C
ATOM   1696  CB  ASP A 238      -4.410   8.902  62.899  1.00 53.61      A    C
ATOM   1697  CG  ASP A 238      -5.409   9.454  63.842  1.00 58.25      A    C
ATOM   1698  OD1 ASP A 238      -4.949  10.257  64.661  1.00 62.42      A    O
ATOM   1699  OD2 ASP A 238      -6.604   9.098  63.775  1.00 58.36      A    O-1
ATOM   1700  C   ASP A 238      -3.061  10.905  63.366  1.00 49.71      A    C
ATOM   1701  O   ASP A 238      -4.009  11.527  62.995  1.00 49.70      A    O
ATOM   1702  N   LEU A 239      -2.013  11.484  63.891  1.00 48.25      A    N
ATOM   1703  CA  LEU A 239      -1.707  12.861  63.672  1.00 46.24      A    C
ATOM   1704  CB  LEU A 239      -1.177  13.480  64.952  1.00 45.20      A    C
ATOM   1705  CG  LEU A 239      -1.746  14.785  65.494  1.00 45.55      A    C
ATOM   1706  CD1 LEU A 239      -3.146  14.960  65.148  1.00 49.26      A    C
ATOM   1707  CD2 LEU A 239      -1.561  14.960  66.940  1.00 40.28      A    C
ATOM   1708  C   LEU A 239      -0.630  12.718  62.634  1.00 44.84      A    C
ATOM   1709  O   LEU A 239      -0.236  13.632  61.994  1.00 44.88      A    O
ATOM   1710  N   ILE A 240      -0.203  11.493  62.460  1.00 43.61      A    N
ATOM   1711  CA  ILE A 240       0.836  11.132  61.525  1.00 43.40      A    C
ATOM   1712  CB  ILE A 240       2.054  10.600  62.280  1.00 42.48      A    C
ATOM   1713  CG1 ILE A 240       3.306  10.795  61.455  1.00 41.85      A    C
ATOM   1714  CD1 ILE A 240       4.496  10.247  62.020  1.00 43.10      A    C
ATOM   1715  CG2 ILE A 240       1.878   9.189  62.624  1.00 41.96      A    C
ATOM   1716  C   ILE A 240       0.369  10.107  60.483  1.00 43.13      A    C
ATOM   1717  O   ILE A 240      -0.432   9.276  60.769  1.00 42.98      A    O
ATOM   1718  N   ASP A 241       0.873  10.196  59.269  1.00 43.33      A    N
ATOM   1719  CA  ASP A 241       0.711   9.148  58.288  1.00 43.36      A    C
ATOM   1720  CB  ASP A 241       0.471   9.777  56.932  1.00 43.84      A    C
ATOM   1721  CG  ASP A 241       0.275   8.786  55.844  1.00 47.10      A    C
ATOM   1722  OD1 ASP A 241       0.904   7.746  55.860  1.00 48.65      A    O
ATOM   1723  OD2 ASP A 241      -0.493   9.069  54.934  1.00 49.54      A    O-1
ATOM   1724  C   ASP A 241       2.031   8.464  58.307  1.00 42.94      A    C
ATOM   1725  O   ASP A 241       2.976   8.998  57.838  1.00 42.72      A    O
ATOM   1726  N   PRO A 242       2.084   7.298  58.910  1.00 42.06      A    N
ATOM   1727  CA  PRO A 242       3.306   6.561  59.174  1.00 42.13      A    C
```

Appendix 1

```
ATOM   1728  CB  PRO A 242       2.821   5.392  60.000  1.00 42.16       A    C
ATOM   1729  CG  PRO A 242       1.613   5.802  60.509  1.00 42.07       A    C
ATOM   1730  CD  PRO A 242       0.957   6.637  59.534  1.00 41.83       A    C
ATOM   1731  C   PRO A 242       4.010   6.089  57.955  1.00 41.37       A    C
ATOM   1732  O   PRO A 242       5.191   5.973  57.990  1.00 42.10       A    O
ATOM   1733  N   GLU A 243       3.283   5.744  56.918  1.00 40.76       A    N
ATOM   1734  CA  GLU A 243       3.885   5.441  55.646  1.00 42.34       A    C
ATOM   1735  CB  GLU A 243       2.910   4.711  54.726  1.00 43.49       A    C
ATOM   1736  CG  GLU A 243       2.494   3.309  55.198  1.00 51.87       A    C
ATOM   1737  CD  GLU A 243       3.596   2.231  55.148  1.00 59.46       A    C
ATOM   1738  OE1 GLU A 243       3.969   1.794  54.051  1.00 59.26       A    O
ATOM   1739  OE2 GLU A 243       4.065   1.781  56.206  1.00 61.39       A    O-1
ATOM   1740  C   GLU A 243       4.493   6.645  54.973  1.00 40.97       A    C
ATOM   1741  O   GLU A 243       5.528   6.570  54.412  1.00 41.79       A    O
ATOM   1742  N   ARG A 244       3.839   7.777  55.047  1.00 39.37       A    N
ATOM   1743  CA  ARG A 244       4.423   8.987  54.534  1.00 37.23       A    C
ATOM   1744  CB  ARG A 244       3.339   9.944  54.077  1.00 37.09       A    C
ATOM   1745  CG  ARG A 244       2.567   9.394  52.940  1.00 36.33       A    C
ATOM   1746  CD  ARG A 244       1.734  10.405  52.242  1.00 37.74       A    C
ATOM   1747  NE  ARG A 244       0.517  10.690  52.965  1.00 39.29       A    N
ATOM   1748  CZ  ARG A 244      -0.439  11.465  52.508  1.00 42.03       A    C
ATOM   1749  NH1 ARG A 244      -0.318  12.003  51.334  1.00 44.24       A    N
ATOM   1750  NH2 ARG A 244      -1.511  11.697  53.216  1.00 40.83       A    N
ATOM   1751  C   ARG A 244       5.493   9.650  55.401  1.00 35.13       A    C
ATOM   1752  O   ARG A 244       6.248  10.450  54.930  1.00 34.25       A    O
ATOM   1753  N   GLY A 245       5.577   9.242  56.646  1.00 32.68       A    N
ATOM   1754  CA  GLY A 245       6.385   9.903  57.634  1.00 29.75       A    C
ATOM   1755  C   GLY A 245       5.988  11.326  57.842  1.00 28.43       A    C
ATOM   1756  O   GLY A 245       6.824  12.153  57.932  1.00 28.63       A    O
ATOM   1757  N   ALA A 246       4.706  11.613  57.873  1.00 26.28       A    N
ATOM   1758  CA  ALA A 246       4.284  12.979  57.904  1.00 26.17       A    C
ATOM   1759  CB  ALA A 246       3.990  13.433  56.556  1.00 25.36       A    C
ATOM   1760  C   ALA A 246       3.131  13.284  58.804  1.00 27.61       A    C
ATOM   1761  O   ALA A 246       2.194  12.551  58.866  1.00 29.45       A    O
ATOM   1762  N   PHE A 247       3.221  14.413  59.476  1.00 27.49       A    N
ATOM   1763  CA  PHE A 247       2.187  14.916  60.341  1.00 25.85       A    C
ATOM   1764  CB  PHE A 247       2.784  15.752  61.466  1.00 25.72       A    C
ATOM   1765  CG  PHE A 247       3.489  14.968  62.507  1.00 21.69       A    C
ATOM   1766  CD1 PHE A 247       2.809  14.321  63.456  1.00 21.56       A    C
ATOM   1767  CE1 PHE A 247       3.451  13.640  64.380  1.00 24.33       A    C
ATOM   1768  CZ  PHE A 247       4.776  13.591  64.383  1.00 22.84       A    C
ATOM   1769  CE2 PHE A 247       5.460  14.228  63.463  1.00 21.25       A    C
ATOM   1770  CD2 PHE A 247       4.840  14.920  62.545  1.00 18.60       A    C
ATOM   1771  C   PHE A 247       1.146  15.723  59.603  1.00 26.73       A    C
ATOM   1772  O   PHE A 247       1.433  16.480  58.724  1.00 26.14       A    O
ATOM   1773  N   TYR A 248      -0.088  15.536  60.003  1.00 26.52       A    N
ATOM   1774  CA  TYR A 248      -1.163  16.371  59.566  1.00 28.27       A    C
ATOM   1775  CB  TYR A 248      -2.519  15.762  59.854  1.00 28.53       A    C
ATOM   1776  CG  TYR A 248      -2.713  14.565  59.026  1.00 32.33       A    C
ATOM   1777  CD1 TYR A 248      -3.013  14.670  57.710  1.00 35.28       A    C
ATOM   1778  CE1 TYR A 248      -3.116  13.610  56.967  1.00 38.47       A    C
ATOM   1779  CZ  TYR A 248      -2.926  12.398  57.517  1.00 40.30       A    C
ATOM   1780  OH  TYR A 248      -3.022  11.278  56.788  1.00 43.85       A    O
ATOM   1781  CE2 TYR A 248      -2.618  12.273  58.807  1.00 38.75       A    C
```

Appendix 1

```
ATOM   1782  CD2 TYR A 248      -2.520  13.333  59.545  1.00 32.98      A    C
ATOM   1783  C   TYR A 248      -1.007  17.680  60.242  1.00 28.33      A    C
ATOM   1784  O   TYR A 248      -0.366  17.779  61.236  1.00 27.84      A    O
ATOM   1785  N   LEU A 249      -1.592  18.689  59.648  1.00 29.23      A    N
ATOM   1786  CA  LEU A 249      -1.378  20.055  60.002  1.00 29.53      A    C
ATOM   1787  CB  LEU A 249      -2.142  20.898  59.006  1.00 28.61      A    C
ATOM   1788  CG  LEU A 249      -1.867  22.346  58.679  1.00 33.24      A    C
ATOM   1789  CD1 LEU A 249      -0.594  22.542  57.970  1.00 30.83      A    C
ATOM   1790  CD2 LEU A 249      -2.980  22.816  57.844  1.00 33.58      A    C
ATOM   1791  C   LEU A 249      -1.796  20.411  61.408  1.00 30.09      A    C
ATOM   1792  O   LEU A 249      -1.110  21.124  62.066  1.00 30.53      A    O
ATOM   1793  N   SER A 250      -2.933  19.943  61.847  1.00 28.51      A    N
ATOM   1794  CA  SER A 250      -3.375  20.299  63.145  1.00 29.43      A    C
ATOM   1795  CB  SER A 250      -3.931  21.706  63.156  1.00 28.58      A    C
ATOM   1796  OG  SER A 250      -4.470  22.060  61.935  1.00 31.32      A    O
ATOM   1797  C   SER A 250      -4.379  19.333  63.669  1.00 29.40      A    C
ATOM   1798  O   SER A 250      -4.913  18.576  62.933  1.00 30.66      A    O
ATOM   1799  N   TYR A 251      -4.631  19.387  64.957  1.00 28.92      A    N
ATOM   1800  CA  TYR A 251      -5.625  18.577  65.598  1.00 30.65      A    C
ATOM   1801  CB  TYR A 251      -4.958  17.674  66.611  1.00 31.53      A    C
ATOM   1802  CG  TYR A 251      -5.897  16.971  67.505  1.00 36.19      A    C
ATOM   1803  CD1 TYR A 251      -7.034  16.398  67.010  1.00 41.93      A    C
ATOM   1804  CE1 TYR A 251      -7.888  15.759  67.823  1.00 44.01      A    C
ATOM   1805  CZ  TYR A 251      -7.617  15.683  69.157  1.00 44.40      A    C
ATOM   1806  OH  TYR A 251      -8.470  15.028  69.992  1.00 47.35      A    O
ATOM   1807  CE2 TYR A 251      -6.508  16.248  69.661  1.00 40.05      A    C
ATOM   1808  CD2 TYR A 251      -5.660  16.885  68.846  1.00 38.98      A    C
ATOM   1809  C   TYR A 251      -6.547  19.512  66.297  1.00 30.42      A    C
ATOM   1810  O   TYR A 251      -6.108  20.490  66.777  1.00 29.46      A    O
ATOM   1811  N   HIS A 252      -7.825  19.221  66.355  1.00 31.88      A    N
ATOM   1812  CA  HIS A 252      -8.740  20.106  67.045  1.00 33.15      A    C
ATOM   1813  CB  HIS A 252      -9.533  20.863  66.021  1.00 30.45      A    C
ATOM   1814  CG  HIS A 252      -8.660  21.573  65.069  1.00 32.85      A    C
ATOM   1815  ND1 HIS A 252      -8.218  21.003  63.908  1.00 33.94      A    N
ATOM   1816  CE1 HIS A 252      -7.388  21.824  63.316  1.00 31.08      A    C
ATOM   1817  NE2 HIS A 252      -7.274  22.900  64.053  1.00 34.82      A    N
ATOM   1818  CD2 HIS A 252      -8.045  22.762  65.163  1.00 34.55      A    C
ATOM   1819  C   HIS A 252      -9.633  19.390  67.992  1.00 35.61      A    C
ATOM   1820  O   HIS A 252     -10.632  18.899  67.614  1.00 37.13      A    O
ATOM   1821  N   PRO A 253      -9.271  19.367  69.247  1.00 37.35      A    N
ATOM   1822  CA  PRO A 253      -9.815  18.440  70.218  1.00 38.43      A    C
ATOM   1823  CB  PRO A 253      -9.016  18.784  71.453  1.00 38.38      A    C
ATOM   1824  CG  PRO A 253      -7.884  19.432  70.994  1.00 37.59      A    C
ATOM   1825  CD  PRO A 253      -8.264  20.212  69.862  1.00 37.19      A    C
ATOM   1826  C   PRO A 253     -11.302  18.533  70.517  1.00 39.49      A    C
ATOM   1827  O   PRO A 253     -11.936  17.539  70.674  1.00 39.67      A    O
ATOM   1828  N   GLU A 254     -11.840  19.721  70.619  1.00 42.00      A    N
ATOM   1829  CA  GLU A 254     -13.242  19.887  70.910  1.00 45.61      A    C
ATOM   1830  CB  GLU A 254     -13.595  21.341  71.158  1.00 45.70      A    C
ATOM   1831  CG  GLU A 254     -14.782  21.803  70.401  1.00 50.66      A    C
ATOM   1832  CD  GLU A 254     -16.098  21.780  71.152  1.00 58.03      A    C
ATOM   1833  OE1 GLU A 254     -16.397  20.839  71.891  1.00 59.19      A    O
ATOM   1834  OE2 GLU A 254     -16.880  22.705  70.949  1.00 60.94      A    O-1
ATOM   1835  C   GLU A 254     -14.122  19.360  69.837  1.00 46.42      A    C
```

Appendix 1

```
ATOM   1836  O    GLU A 254     -15.164  18.820  70.076  1.00 46.95      A  O
ATOM   1837  N    SER A 255     -13.655  19.521  68.633  1.00 48.04      A  N
ATOM   1838  CA   SER A 255     -14.477  19.649  67.484  1.00 47.85      A  C
ATOM   1839  CB   SER A 255     -14.262  20.995  66.807  1.00 48.56      A  C
ATOM   1840  OG   SER A 255     -12.927  21.148  66.408  1.00 44.29      A  O
ATOM   1841  C    SER A 255     -13.950  18.663  66.585  1.00 47.78      A  C
ATOM   1842  O    SER A 255     -13.300  19.021  65.626  1.00 48.36      A  O
ATOM   1843  N    GLY A 256     -14.219  17.410  66.896  1.00 46.01      A  N
ATOM   1844  CA   GLY A 256     -13.781  16.333  66.074  1.00 43.44      A  C
ATOM   1845  C    GLY A 256     -12.292  16.283  66.012  1.00 42.95      A  C
ATOM   1846  O    GLY A 256     -11.659  16.180  67.002  1.00 42.84      A  O
ATOM   1847  N    ALA A 257     -11.743  16.417  64.827  1.00 40.80      A  N
ATOM   1848  CA   ALA A 257     -10.386  16.095  64.613  1.00 39.57      A  C
ATOM   1849  CB   ALA A 257     -10.301  14.685  64.311  1.00 40.25      A  C
ATOM   1850  C    ALA A 257      -9.833  16.911  63.494  1.00 38.64      A  C
ATOM   1851  O    ALA A 257     -10.544  17.704  62.961  1.00 40.01      A  O
ATOM   1852  N    VAL A 258      -8.525  16.834  63.323  1.00 35.02      A  N
ATOM   1853  CA   VAL A 258      -7.682  16.475  62.176  1.00 32.26      A  C
ATOM   1854  CB   VAL A 258      -7.214  15.066  62.231  1.00 32.53      A  C
ATOM   1855  CG1  VAL A 258      -5.848  14.994  61.737  1.00 29.61      A  C
ATOM   1856  CG2  VAL A 258      -7.245  14.613  63.588  1.00 33.15      A  C
ATOM   1857  C    VAL A 258      -7.653  17.001  60.730  1.00 30.49      A  C
ATOM   1858  O    VAL A 258      -8.075  16.358  59.858  1.00 29.41      A  O
ATOM   1859  N    LYS A 259      -7.051  18.138  60.490  1.00 29.70      A  N
ATOM   1860  CA   LYS A 259      -6.953  18.671  59.159  1.00 28.78      A  C
ATOM   1861  CB   LYS A 259      -6.243  20.002  59.187  1.00 28.52      A  C
ATOM   1862  CG   LYS A 259      -7.106  21.096  59.668  1.00 27.37      A  C
ATOM   1863  CD   LYS A 259      -6.570  22.454  59.454  1.00 22.55      A  C
ATOM   1864  CE   LYS A 259      -7.334  23.428  60.300  1.00 22.26      A  C
ATOM   1865  NZ   LYS A 259      -6.908  24.807  60.210  1.00 16.45      A  N
ATOM   1866  C    LYS A 259      -6.214  17.692  58.303  1.00 29.27      A  C
ATOM   1867  O    LYS A 259      -5.340  17.058  58.751  1.00 30.69      A  O
ATOM   1868  N    PRO A 260      -6.585  17.550  57.052  1.00 28.95      A  N
ATOM   1869  CA   PRO A 260      -6.195  16.391  56.290  1.00 28.09      A  C
ATOM   1870  CB   PRO A 260      -7.456  16.062  55.542  1.00 28.42      A  C
ATOM   1871  CG   PRO A 260      -8.092  17.302  55.399  1.00 28.70      A  C
ATOM   1872  CD   PRO A 260      -7.911  17.992  56.634  1.00 27.35      A  C
ATOM   1873  C    PRO A 260      -5.072  16.624  55.354  1.00 28.11      A  C
ATOM   1874  O    PRO A 260      -4.832  15.846  54.493  1.00 28.99      A  O
ATOM   1875  N    TRP A 261      -4.359  17.689  55.547  1.00 26.67      A  N
ATOM   1876  CA   TRP A 261      -3.213  17.944  54.742  1.00 26.46      A  C
ATOM   1877  CB   TRP A 261      -3.219  19.406  54.354  1.00 26.67      A  C
ATOM   1878  CG   TRP A 261      -4.383  19.793  53.540  1.00 24.50      A  C
ATOM   1879  CD1  TRP A 261      -4.540  19.578  52.246  1.00 23.85      A  C
ATOM   1880  NE1  TRP A 261      -5.713  20.042  51.823  1.00 24.32      A  N
ATOM   1881  CE2  TRP A 261      -6.370  20.591  52.869  1.00 22.80      A  C
ATOM   1882  CD2  TRP A 261      -5.553  20.452  53.974  1.00 24.04      A  C
ATOM   1883  CE3  TRP A 261      -5.993  20.936  55.188  1.00 22.34      A  C
ATOM   1884  CZ3  TRP A 261      -7.206  21.526  55.240  1.00 21.43      A  C
ATOM   1885  CH2  TRP A 261      -7.991  21.650  54.120  1.00 21.74      A  C
ATOM   1886  CZ2  TRP A 261      -7.594  21.178  52.929  1.00 17.55      A  C
ATOM   1887  C    TRP A 261      -1.993  17.597  55.565  1.00 26.41      A  C
ATOM   1888  O    TRP A 261      -1.960  17.920  56.697  1.00 25.47      A  O
ATOM   1889  N    ILE A 262      -1.040  16.876  55.004  1.00 26.56      A  N
```

Appendix 1

```
ATOM   1890  CA   ILE A 262     0.257  16.702  55.627  1.00  27.06      A  C
ATOM   1891  CB   ILE A 262     0.925  15.346  55.335  1.00  26.45      A  C
ATOM   1892  CG1  ILE A 262     1.291  15.206  53.883  1.00  28.39      A  C
ATOM   1893  CD1  ILE A 262     2.205  14.152  53.634  1.00  26.65      A  C
ATOM   1894  CG2  ILE A 262     0.039  14.266  55.687  1.00  25.83      A  C
ATOM   1895  C    ILE A 262     1.174  17.900  55.378  1.00  28.01      A  C
ATOM   1896  O    ILE A 262     1.057  18.534  54.403  1.00  29.58      A  O
ATOM   1897  N    SER A 263     2.047  18.237  56.298  1.00  28.35      A  N
ATOM   1898  CA   SER A 263     2.853  19.411  56.139  1.00  27.23      A  C
ATOM   1899  CB   SER A 263     2.437  20.420  57.182  1.00  27.61      A  C
ATOM   1900  OG   SER A 263     3.444  21.321  57.425  1.00  27.96      A  O
ATOM   1901  C    SER A 263     4.295  19.074  56.299  1.00  26.97      A  C
ATOM   1902  O    SER A 263     4.643  18.452  57.231  1.00  28.19      A  O
ATOM   1903  N    ALA A 264     5.127  19.431  55.353  1.00  24.98      A  N
ATOM   1904  CA   ALA A 264     6.537  19.238  55.485  1.00  25.05      A  C
ATOM   1905  CB   ALA A 264     7.199  19.459  54.195  1.00  25.14      A  C
ATOM   1906  C    ALA A 264     7.243  20.034  56.560  1.00  24.27      A  C
ATOM   1907  O    ALA A 264     8.037  19.486  57.242  1.00  23.67      A  O
ATOM   1908  N    TYR A 265     6.988  21.320  56.683  1.00  24.46      A  N
ATOM   1909  CA   TYR A 265     7.642  22.133  57.706  1.00  24.18      A  C
ATOM   1910  CB   TYR A 265     7.446  23.626  57.493  1.00  23.49      A  C
ATOM   1911  CG   TYR A 265     6.403  24.250  58.361  1.00  23.82      A  C
ATOM   1912  CD1  TYR A 265     6.709  24.782  59.583  1.00  23.10      A  C
ATOM   1913  CE1  TYR A 265     5.765  25.305  60.345  1.00  23.36      A  C
ATOM   1914  CZ   TYR A 265     4.494  25.358  59.892  1.00  27.13      A  C
ATOM   1915  OH   TYR A 265     3.514  25.914  60.613  1.00  26.66      A  O
ATOM   1916  CE2  TYR A 265     4.175  24.866  58.707  1.00  24.08      A  C
ATOM   1917  CD2  TYR A 265     5.115  24.316  57.953  1.00  25.49      A  C
ATOM   1918  C    TYR A 265     7.275  21.730  59.106  1.00  24.17      A  C
ATOM   1919  O    TYR A 265     8.045  21.805  59.991  1.00  23.97      A  O
ATOM   1920  N    THR A 266     6.048  21.332  59.276  1.00  23.46      A  N
ATOM   1921  CA   THR A 266     5.590  20.913  60.539  1.00  25.46      A  C
ATOM   1922  CB   THR A 266     4.158  20.610  60.428  1.00  25.33      A  C
ATOM   1923  OG1  THR A 266     3.447  21.814  60.264  1.00  25.95      A  O
ATOM   1924  CG2  THR A 266     3.689  19.929  61.633  1.00  26.08      A  C
ATOM   1925  C    THR A 266     6.304  19.677  60.976  1.00  26.32      A  C
ATOM   1926  O    THR A 266     6.658  19.539  62.098  1.00  26.10      A  O
ATOM   1927  N    THR A 267     6.430  18.747  60.057  1.00  26.21      A  N
ATOM   1928  CA   THR A 267     7.142  17.516  60.265  1.00  24.84      A  C
ATOM   1929  CB   THR A 267     6.903  16.575  59.105  1.00  25.19      A  C
ATOM   1930  OG1  THR A 267     5.526  16.547  58.804  1.00  26.03      A  O
ATOM   1931  CG2  THR A 267     7.306  15.250  59.438  1.00  21.39      A  C
ATOM   1932  C    THR A 267     8.619  17.673  60.465  1.00  24.54      A  C
ATOM   1933  O    THR A 267     9.155  17.102  61.316  1.00  25.13      A  O
ATOM   1934  N    ALA A 268     9.279  18.464  59.677  1.00  23.70      A  N
ATOM   1935  CA   ALA A 268    10.686  18.552  59.825  1.00  23.63      A  C
ATOM   1936  CB   ALA A 268    11.234  19.392  58.751  1.00  23.11      A  C
ATOM   1937  C    ALA A 268    11.078  19.100  61.167  1.00  25.96      A  C
ATOM   1938  O    ALA A 268    11.987  18.628  61.771  1.00  27.66      A  O
ATOM   1939  N    TRP A 269    10.369  20.116  61.616  1.00  26.12      A  N
ATOM   1940  CA   TRP A 269    10.588  20.752  62.879  1.00  25.73      A  C
ATOM   1941  CB   TRP A 269     9.748  22.028  62.897  1.00  27.68      A  C
ATOM   1942  CG   TRP A 269     9.595  22.684  64.198  1.00  31.02      A  C
ATOM   1943  CD1  TRP A 269    10.051  22.241  65.364  1.00  34.90      A  C
```

Appendix 1

```
ATOM   1944  NE1 TRP A 269       9.733  23.080  66.357  1.00 37.43      A   N
ATOM   1945  CE2 TRP A 269       9.050  24.128  65.835  1.00 35.56      A   C
ATOM   1946  CD2 TRP A 269       8.950  23.913  64.468  1.00 34.19      A   C
ATOM   1947  CE3 TRP A 269       8.280  24.850  63.692  1.00 34.21      A   C
ATOM   1948  CZ3 TRP A 269       7.764  25.923  64.302  1.00 32.70      A   C
ATOM   1949  CH2 TRP A 269       7.885  26.104  65.667  1.00 34.27      A   C
ATOM   1950  CZ2 TRP A 269       8.516  25.214  66.445  1.00 31.07      A   C
ATOM   1951  C   TRP A 269      10.341  19.878  64.104  1.00 25.74      A   C
ATOM   1952  O   TRP A 269      11.092  19.903  65.032  1.00 24.48      A   O
ATOM   1953  N   THR A 270       9.251  19.140  64.093  1.00 25.49      A   N
ATOM   1954  CA  THR A 270       8.879  18.201  65.131  1.00 25.08      A   C
ATOM   1955  CB  THR A 270       7.479  17.651  64.866  1.00 26.31      A   C
ATOM   1956  OG1 THR A 270       6.629  18.721  64.579  1.00 23.48      A   O
ATOM   1957  CG2 THR A 270       6.925  16.933  66.020  1.00 25.94      A   C
ATOM   1958  C   THR A 270       9.811  17.041  65.262  1.00 26.10      A   C
ATOM   1959  O   THR A 270      10.138  16.647  66.327  1.00 26.44      A   O
ATOM   1960  N   LEU A 271      10.198  16.494  64.143  1.00 25.36      A   N
ATOM   1961  CA  LEU A 271      11.120  15.415  64.093  1.00 25.93      A   C
ATOM   1962  CB  LEU A 271      11.191  14.861  62.683  1.00 27.34      A   C
ATOM   1963  CG  LEU A 271      10.072  13.956  62.191  1.00 28.31      A   C
ATOM   1964  CD1 LEU A 271      10.400  13.285  60.959  1.00 29.74      A   C
ATOM   1965  CD2 LEU A 271       9.713  12.991  63.161  1.00 28.19      A   C
ATOM   1966  C   LEU A 271      12.471  15.807  64.592  1.00 26.35      A   C
ATOM   1967  O   LEU A 271      13.138  15.033  65.204  1.00 24.47      A   O
ATOM   1968  N   ALA A 272      12.883  17.014  64.291  1.00 27.29      A   N
ATOM   1969  CA  ALA A 272      14.154  17.526  64.744  1.00 27.75      A   C
ATOM   1970  CB  ALA A 272      14.432  18.779  64.099  1.00 28.35      A   C
ATOM   1971  C   ALA A 272      14.281  17.701  66.215  1.00 28.52      A   C
ATOM   1972  O   ALA A 272      15.287  17.429  66.786  1.00 28.93      A   O
ATOM   1973  N   MET A 273      13.263  18.230  66.823  1.00 28.56      A   N
ATOM   1974  CA  MET A 273      13.174  18.250  68.240  1.00 29.69      A   C
ATOM   1975  CB  MET A 273      12.105  19.224  68.628  1.00 31.55      A   C
ATOM   1976  CG  MET A 273      12.419  20.596  68.184  1.00 35.37      A   C
ATOM   1977  SD  MET A 273      11.840  21.806  69.319  1.00 50.21      A   S
ATOM   1978  CE  MET A 273      12.987  23.102  69.097  1.00 46.43      A   C
ATOM   1979  C   MET A 273      13.016  16.907  68.950  1.00 29.35      A   C
ATOM   1980  O   MET A 273      13.604  16.699  69.967  1.00 29.45      A   O
ATOM   1981  N   VAL A 274      12.220  16.011  68.400  1.00 28.78      A   N
ATOM   1982  CA  VAL A 274      11.959  14.716  69.006  1.00 26.98      A   C
ATOM   1983  CB  VAL A 274      10.853  13.955  68.300  1.00 26.64      A   C
ATOM   1984  CG1 VAL A 274      10.708  12.614  68.859  1.00 24.18      A   C
ATOM   1985  CG2 VAL A 274       9.605  14.640  68.459  1.00 21.87      A   C
ATOM   1986  C   VAL A 274      13.210  13.893  69.093  1.00 27.99      A   C
ATOM   1987  O   VAL A 274      13.439  13.206  70.023  1.00 27.23      A   O
ATOM   1988  N   HIS A 275      14.061  14.074  68.127  1.00 29.25      A   N
ATOM   1989  CA  HIS A 275      15.277  13.348  68.005  1.00 30.38      A   C
ATOM   1990  CB  HIS A 275      15.978  13.776  66.742  1.00 30.48      A   C
ATOM   1991  CG  HIS A 275      17.208  12.995  66.448  1.00 30.89      A   C
ATOM   1992  ND1 HIS A 275      18.457  13.452  66.755  1.00 31.42      A   N
ATOM   1993  CE1 HIS A 275      19.344  12.558  66.398  1.00 31.83      A   C
ATOM   1994  NE2 HIS A 275      18.715  11.540  65.870  1.00 29.89      A   N
ATOM   1995  CD2 HIS A 275      17.378  11.784  65.894  1.00 30.24      A   C
ATOM   1996  C   HIS A 275      16.162  13.614  69.162  1.00 30.74      A   C
ATOM   1997  O   HIS A 275      17.062  12.879  69.414  1.00 31.95      A   O
```

Appendix 1

```
ATOM   1998  N   GLY A 276      15.942  14.746  69.793  1.00 30.86      A  N
ATOM   1999  CA  GLY A 276      16.485  15.097  71.078  1.00 29.87      A  C
ATOM   2000  C   GLY A 276      16.004  14.267  72.228  1.00 30.35      A  C
ATOM   2001  O   GLY A 276      16.724  14.036  73.145  1.00 30.19      A  O
ATOM   2002  N   MET A 277      14.752  13.868  72.185  1.00 30.07      A  N
ATOM   2003  CA  MET A 277      14.191  13.109  73.258  1.00 30.87      A  C
ATOM   2004  CB  MET A 277      12.835  13.674  73.638  1.00 30.76      A  C
ATOM   2005  CG  MET A 277      12.803  15.145  73.605  1.00 32.96      A  C
ATOM   2006  SD  MET A 277      11.283  15.939  74.003  1.00 39.83      A  S
ATOM   2007  CE  MET A 277      10.665  16.343  72.434  1.00 29.97      A  C
ATOM   2008  C   MET A 277      14.121  11.644  72.961  1.00 30.62      A  C
ATOM   2009  O   MET A 277      14.531  10.845  73.729  1.00 32.07      A  O
ATOM   2010  N   ASP A 278      13.596  11.290  71.823  1.00 30.92      A  N
ATOM   2011  CA  ASP A 278      13.642   9.929  71.400  1.00 29.98      A  C
ATOM   2012  CB  ASP A 278      12.238   9.365  71.373  1.00 31.21      A  C
ATOM   2013  CG  ASP A 278      12.207   7.900  71.151  1.00 34.90      A  C
ATOM   2014  OD1 ASP A 278      13.217   7.247  71.341  1.00 40.59      A  O
ATOM   2015  OD2 ASP A 278      11.158   7.399  70.796  1.00 38.93      A  O-1
ATOM   2016  C   ASP A 278      14.254   9.867  70.037  1.00 28.59      A  C
ATOM   2017  O   ASP A 278      13.604  10.025  69.072  1.00 28.26      A  O
ATOM   2018  N   PRO A 279      15.518   9.567  69.965  1.00 26.87      A  N
ATOM   2019  CA  PRO A 279      16.200   9.521  68.701  1.00 26.86      A  C
ATOM   2020  CB  PRO A 279      17.589   9.102  69.103  1.00 27.16      A  C
ATOM   2021  CG  PRO A 279      17.665   9.326  70.484  1.00 24.70      A  C
ATOM   2022  CD  PRO A 279      16.401   9.188  71.052  1.00 26.24      A  C
ATOM   2023  C   PRO A 279      15.583   8.499  67.802  1.00 27.89      A  C
ATOM   2024  O   PRO A 279      15.536   8.675  66.633  1.00 28.36      A  O
ATOM   2025  N   ALA A 280      15.105   7.424  68.371  1.00 29.02      A  N
ATOM   2026  CA  ALA A 280      14.560   6.344  67.601  1.00 30.66      A  C
ATOM   2027  CB  ALA A 280      14.280   5.173  68.466  1.00 29.69      A  C
ATOM   2028  C   ALA A 280      13.342   6.726  66.845  1.00 30.19      A  C
ATOM   2029  O   ALA A 280      13.147   6.281  65.776  1.00 30.92      A  O
ATOM   2030  N   PHE A 281      12.506   7.542  67.427  1.00 31.10      A  N
ATOM   2031  CA  PHE A 281      11.291   7.925  66.783  1.00 31.45      A  C
ATOM   2032  CB  PHE A 281      10.556   8.785  67.770  1.00 30.82      A  C
ATOM   2033  CG  PHE A 281       9.280   9.342  67.292  1.00 30.36      A  C
ATOM   2034  CD1 PHE A 281       8.112   8.926  67.827  1.00 27.39      A  C
ATOM   2035  CE1 PHE A 281       6.963   9.452  67.432  1.00 30.28      A  C
ATOM   2036  CZ  PHE A 281       6.951  10.408  66.516  1.00 25.12      A  C
ATOM   2037  CE2 PHE A 281       8.098  10.844  65.984  1.00 26.15      A  C
ATOM   2038  CD2 PHE A 281       9.248  10.327  66.372  1.00 21.93      A  C
ATOM   2039  C   PHE A 281      11.536   8.675  65.510  1.00 32.68      A  C
ATOM   2040  O   PHE A 281      10.980   8.367  64.519  1.00 34.90      A  O
ATOM   2041  N   SER A 282      12.400   9.650  65.538  1.00 32.47      A  N
ATOM   2042  CA  SER A 282      12.736  10.410  64.369  1.00 33.95      A  C
ATOM   2043  CB  SER A 282      13.550  11.615  64.761  1.00 33.82      A  C
ATOM   2044  OG  SER A 282      12.699  12.601  65.220  1.00 34.18      A  O
ATOM   2045  C   SER A 282      13.435   9.587  63.314  1.00 35.40      A  C
ATOM   2046  O   SER A 282      13.242   9.778  62.142  1.00 35.77      A  O
ATOM   2047  N   GLU A 283      14.268   8.678  63.774  1.00 35.22      A  N
ATOM   2048  CA  GLU A 283      15.059   7.824  62.934  1.00 34.91      A  C
ATOM   2049  CB  GLU A 283      16.076   7.009  63.744  1.00 34.87      A  C
ATOM   2050  CG  GLU A 283      17.467   7.612  63.782  1.00 35.44      A  C
ATOM   2051  CD  GLU A 283      18.231   7.419  65.078  1.00 42.74      A  C
```

Appendix 1

```
ATOM   2052  OE1 GLU A 283      18.046   6.435  65.777  1.00 45.88           A  O
ATOM   2053  OE2 GLU A 283      19.071   8.240  65.392  1.00 41.10           A  O-1
ATOM   2054  C   GLU A 283      14.123   6.983  62.142  1.00 34.38           A  C
ATOM   2055  O   GLU A 283      14.393   6.648  61.031  1.00 35.47           A  O
ATOM   2056  N   ARG A 284      13.015   6.641  62.745  1.00 33.20           A  N
ATOM   2057  CA  ARG A 284      12.015   5.865  62.086  1.00 33.19           A  C
ATOM   2058  CB  ARG A 284      10.980   5.490  63.096  1.00 33.13           A  C
ATOM   2059  CG  ARG A 284      10.193   4.345  62.693  1.00 36.12           A  C
ATOM   2060  CD  ARG A 284       9.012   4.180  63.523  1.00 43.95           A  C
ATOM   2061  NE  ARG A 284       7.931   3.774  62.679  1.00 45.77           A  N
ATOM   2062  CZ  ARG A 284       7.156   2.745  62.909  1.00 52.89           A  C
ATOM   2063  NH1 ARG A 284       7.344   2.002  63.973  1.00 53.68           A  N
ATOM   2064  NH2 ARG A 284       6.195   2.457  62.056  1.00 56.79           A  N
ATOM   2065  C   ARG A 284      11.307   6.497  60.914  1.00 33.42           A  C
ATOM   2066  O   ARG A 284      11.088   5.870  59.929  1.00 34.08           A  O
ATOM   2067  N   TYR A 285      10.892   7.731  61.037  1.00 33.18           A  N
ATOM   2068  CA  TYR A 285      10.140   8.363  59.993  1.00 31.10           A  C
ATOM   2069  CB  TYR A 285       9.135   9.297  60.627  1.00 30.46           A  C
ATOM   2070  CG  TYR A 285       8.161   8.567  61.441  1.00 29.72           A  C
ATOM   2071  CD1 TYR A 285       7.214   7.810  60.856  1.00 28.85           A  C
ATOM   2072  CE1 TYR A 285       6.354   7.123  61.574  1.00 27.09           A  C
ATOM   2073  CZ  TYR A 285       6.423   7.173  62.885  1.00 29.22           A  C
ATOM   2074  OH  TYR A 285       5.522   6.459  63.564  1.00 35.16           A  O
ATOM   2075  CE2 TYR A 285       7.341   7.918  63.516  1.00 24.91           A  C
ATOM   2076  CD2 TYR A 285       8.207   8.598  62.800  1.00 30.25           A  C
ATOM   2077  C   TYR A 285      10.957   9.106  58.976  1.00 31.32           A  C
ATOM   2078  O   TYR A 285      10.461   9.441  57.965  1.00 32.23           A  O
ATOM   2079  N   TYR A 286      12.220   9.346  59.244  1.00 31.64           A  N
ATOM   2080  CA  TYR A 286      12.982  10.294  58.466  1.00 31.24           A  C
ATOM   2081  CB  TYR A 286      14.362  10.498  59.092  1.00 30.49           A  C
ATOM   2082  CG  TYR A 286      15.270  11.486  58.407  1.00 28.19           A  C
ATOM   2083  CD1 TYR A 286      14.869  12.753  58.158  1.00 26.21           A  C
ATOM   2084  CE1 TYR A 286      15.670  13.620  57.559  1.00 25.42           A  C
ATOM   2085  CZ  TYR A 286      16.899  13.254  57.192  1.00 27.14           A  C
ATOM   2086  OH  TYR A 286      17.694  14.150  56.592  1.00 23.85           A  O
ATOM   2087  CE2 TYR A 286      17.321  12.007  57.426  1.00 26.91           A  C
ATOM   2088  CD2 TYR A 286      16.515  11.139  58.022  1.00 25.81           A  C
ATOM   2089  C   TYR A 286      13.144   9.964  57.019  1.00 31.99           A  C
ATOM   2090  O   TYR A 286      12.954  10.805  56.198  1.00 32.38           A  O
ATOM   2091  N   PRO A 287      13.492   8.739  56.688  1.00 33.18           A  N
ATOM   2092  CA  PRO A 287      13.657   8.370  55.299  1.00 32.41           A  C
ATOM   2093  CB  PRO A 287      14.127   6.949  55.392  1.00 31.12           A  C
ATOM   2094  CG  PRO A 287      14.590   6.794  56.663  1.00 32.29           A  C
ATOM   2095  CD  PRO A 287      13.868   7.626  57.550  1.00 33.55           A  C
ATOM   2096  C   PRO A 287      12.376   8.458  54.495  1.00 32.81           A  C
ATOM   2097  O   PRO A 287      12.432   8.796  53.356  1.00 33.57           A  O
ATOM   2098  N   ARG A 288      11.247   8.123  55.075  1.00 31.74           A  N
ATOM   2099  CA  ARG A 288       9.970   8.304  54.426  1.00 32.67           A  C
ATOM   2100  CB  ARG A 288       8.873   7.677  55.229  1.00 34.04           A  C
ATOM   2101  CG  ARG A 288       8.660   6.272  55.002  1.00 40.08           A  C
ATOM   2102  CD  ARG A 288       8.545   5.616  56.342  1.00 52.26           A  C
ATOM   2103  NE  ARG A 288       8.802   4.193  56.251  1.00 63.31           A  N
ATOM   2104  CZ  ARG A 288       8.306   3.278  57.071  1.00 70.48           A  C
ATOM   2105  NH1 ARG A 288       7.506   3.613  58.067  1.00 72.17           A  N
```

Appendix 1

```
ATOM   2106  NH2 ARG A 288       8.620   2.010  56.891  1.00 72.65      A  N
ATOM   2107  C   ARG A 288       9.611   9.743  54.183  1.00 31.67      A  C
ATOM   2108  O   ARG A 288       8.988  10.059  53.205  1.00 31.51      A  O
ATOM   2109  N   PHE A 289       9.978  10.593  55.130  1.00 29.32      A  N
ATOM   2110  CA  PHE A 289       9.687  11.986  55.092  1.00 27.66      A  C
ATOM   2111  CB  PHE A 289      10.275  12.663  56.323  1.00 27.70      A  C
ATOM   2112  CG  PHE A 289      10.477  14.132  56.173  1.00 27.50      A  C
ATOM   2113  CD1 PHE A 289       9.470  14.999  56.430  1.00 27.20      A  C
ATOM   2114  CE1 PHE A 289       9.652  16.308  56.281  1.00 29.01      A  C
ATOM   2115  CZ  PHE A 289      10.822  16.771  55.862  1.00 27.13      A  C
ATOM   2116  CE2 PHE A 289      11.832  15.930  55.598  1.00 27.82      A  C
ATOM   2117  CD2 PHE A 289      11.668  14.636  55.759  1.00 24.08      A  C
ATOM   2118  C   PHE A 289      10.361  12.509  53.906  1.00 27.26      A  C
ATOM   2119  O   PHE A 289       9.878  13.334  53.200  1.00 26.37      A  O
ATOM   2120  N   LYS A 290      11.547  12.030  53.731  1.00 28.03      A  N
ATOM   2121  CA  LYS A 290      12.354  12.429  52.648  1.00 28.52      A  C
ATOM   2122  CB  LYS A 290      13.753  11.956  52.907  1.00 26.94      A  C
ATOM   2123  CG  LYS A 290      14.669  13.055  53.080  1.00 29.67      A  C
ATOM   2124  CD  LYS A 290      15.718  12.796  54.046  1.00 34.10      A  C
ATOM   2125  CE  LYS A 290      16.432  11.561  53.744  1.00 38.59      A  C
ATOM   2126  NZ  LYS A 290      17.865  11.736  53.742  1.00 40.49      A  N
ATOM   2127  C   LYS A 290      11.826  11.997  51.300  1.00 28.81      A  C
ATOM   2128  O   LYS A 290      11.797  12.763  50.407  1.00 29.02      A  O
ATOM   2129  N   GLN A 291      11.364  10.780  51.155  1.00 29.61      A  N
ATOM   2130  CA  GLN A 291      10.757  10.395  49.912  1.00 32.65      A  C
ATOM   2131  CB  GLN A 291      10.477   8.893  49.860  1.00 33.21      A  C
ATOM   2132  CG  GLN A 291       9.291   8.504  49.031  1.00 41.04      A  C
ATOM   2133  CD  GLN A 291       9.511   7.351  48.058  1.00 52.22      A  C
ATOM   2134  OE1 GLN A 291       9.581   6.196  48.456  1.00 54.21      A  O
ATOM   2135  NE2 GLN A 291       9.542   7.660  46.767  1.00 51.44      A  N
ATOM   2136  C   GLN A 291       9.518  11.214  49.688  1.00 31.74      A  C
ATOM   2137  O   GLN A 291       9.228  11.600  48.615  1.00 31.63      A  O
ATOM   2138  N   THR A 292       8.779  11.480  50.723  1.00 31.39      A  N
ATOM   2139  CA  THR A 292       7.566  12.201  50.542  1.00 31.52      A  C
ATOM   2140  CB  THR A 292       6.733  12.175  51.805  1.00 32.16      A  C
ATOM   2141  OG1 THR A 292       6.690  10.851  52.307  1.00 31.72      A  O
ATOM   2142  CG2 THR A 292       5.381  12.587  51.509  1.00 31.77      A  C
ATOM   2143  C   THR A 292       7.687  13.619  50.050  1.00 31.29      A  C
ATOM   2144  O   THR A 292       6.937  14.032  49.215  1.00 32.38      A  O
ATOM   2145  N   PHE A 293       8.604  14.381  50.600  1.00 30.78      A  N
ATOM   2146  CA  PHE A 293       8.618  15.808  50.349  1.00 30.08      A  C
ATOM   2147  CB  PHE A 293       8.550  16.540  51.666  1.00 30.45      A  C
ATOM   2148  CG  PHE A 293       7.273  16.410  52.381  1.00 27.92      A  C
ATOM   2149  CD1 PHE A 293       6.139  16.926  51.879  1.00 25.76      A  C
ATOM   2150  CE1 PHE A 293       5.011  16.854  52.563  1.00 29.55      A  C
ATOM   2151  CZ  PHE A 293       4.992  16.284  53.762  1.00 31.90      A  C
ATOM   2152  CE2 PHE A 293       6.106  15.781  54.280  1.00 31.42      A  C
ATOM   2153  CD2 PHE A 293       7.235  15.846  53.600  1.00 29.44      A  C
ATOM   2154  C   PHE A 293       9.763  16.404  49.599  1.00 29.52      A  C
ATOM   2155  O   PHE A 293       9.640  17.460  49.059  1.00 29.27      A  O
ATOM   2156  N   VAL A 294      10.902  15.743  49.594  1.00 28.85      A  N
ATOM   2157  CA  VAL A 294      12.113  16.335  49.093  1.00 30.28      A  C
ATOM   2158  CB  VAL A 294      13.290  15.794  49.849  1.00 30.31      A  C
ATOM   2159  CG1 VAL A 294      14.554  16.299  49.317  1.00 26.11      A  C
```

Appendix 1

| ATOM | 2160 | CG2 | VAL | A | 294 | 13.170 | 16.089 | 51.260 | 1.00 | 29.84 | A | C |
|---|---|---|---|---|---|---|---|---|---|---|---|---|
| ATOM | 2161 | C | VAL | A | 294 | 12.370 | 16.026 | 47.659 | 1.00 | 31.99 | A | C |
| ATOM | 2162 | O | VAL | A | 294 | 12.414 | 14.911 | 47.293 | 1.00 | 33.57 | A | O |
| ATOM | 2163 | N | GLU | A | 295 | 12.565 | 17.038 | 46.850 | 1.00 | 32.58 | A | N |
| ATOM | 2164 | CA | GLU | A | 295 | 12.905 | 16.837 | 45.474 | 1.00 | 33.67 | A | C |
| ATOM | 2165 | CB | GLU | A | 295 | 12.007 | 17.734 | 44.654 | 1.00 | 34.86 | A | C |
| ATOM | 2166 | CG | GLU | A | 295 | 12.229 | 17.732 | 43.199 | 1.00 | 37.58 | A | C |
| ATOM | 2167 | CD | GLU | A | 295 | 11.735 | 18.968 | 42.569 | 1.00 | 39.62 | A | C |
| ATOM | 2168 | OE1 | GLU | A | 295 | 10.982 | 19.663 | 43.197 | 1.00 | 39.34 | A | O |
| ATOM | 2169 | OE2 | GLU | A | 295 | 12.097 | 19.252 | 41.452 | 1.00 | 41.47 | A | O-1 |
| ATOM | 2170 | C | GLU | A | 295 | 14.336 | 17.210 | 45.227 | 1.00 | 33.32 | A | C |
| ATOM | 2171 | O | GLU | A | 295 | 14.678 | 18.350 | 45.230 | 1.00 | 33.34 | A | O |
| ATOM | 2172 | N | VAL | A | 296 | 15.184 | 16.234 | 44.989 | 1.00 | 33.78 | A | N |
| ATOM | 2173 | CA | VAL | A | 296 | 16.555 | 16.503 | 44.596 | 1.00 | 33.61 | A | C |
| ATOM | 2174 | CB | VAL | A | 296 | 17.429 | 15.282 | 44.742 | 1.00 | 32.91 | A | C |
| ATOM | 2175 | CG1 | VAL | A | 296 | 18.727 | 15.550 | 44.186 | 1.00 | 29.67 | A | C |
| ATOM | 2176 | CG2 | VAL | A | 296 | 17.584 | 14.946 | 46.170 | 1.00 | 31.23 | A | C |
| ATOM | 2177 | C | VAL | A | 296 | 16.632 | 17.024 | 43.187 | 1.00 | 35.08 | A | C |
| ATOM | 2178 | O | VAL | A | 296 | 15.899 | 16.614 | 42.358 | 1.00 | 35.36 | A | O |
| ATOM | 2179 | N | TYR | A | 297 | 17.480 | 17.980 | 42.910 | 1.00 | 37.18 | A | N |
| ATOM | 2180 | CA | TYR | A | 297 | 17.558 | 18.393 | 41.538 | 1.00 | 39.54 | A | C |
| ATOM | 2181 | CB | TYR | A | 297 | 16.574 | 19.512 | 41.158 | 1.00 | 38.28 | A | C |
| ATOM | 2182 | CG | TYR | A | 297 | 16.743 | 20.841 | 41.806 | 1.00 | 38.27 | A | C |
| ATOM | 2183 | CD1 | TYR | A | 297 | 17.159 | 21.910 | 41.083 | 1.00 | 33.84 | A | C |
| ATOM | 2184 | CE1 | TYR | A | 297 | 17.330 | 23.088 | 41.648 | 1.00 | 33.63 | A | C |
| ATOM | 2185 | CZ | TYR | A | 297 | 17.048 | 23.256 | 42.933 | 1.00 | 36.77 | A | C |
| ATOM | 2186 | OH | TYR | A | 297 | 17.236 | 24.469 | 43.459 | 1.00 | 36.52 | A | O |
| ATOM | 2187 | CE2 | TYR | A | 297 | 16.625 | 22.240 | 43.680 | 1.00 | 35.15 | A | C |
| ATOM | 2188 | CD2 | TYR | A | 297 | 16.464 | 21.038 | 43.124 | 1.00 | 38.07 | A | C |
| ATOM | 2189 | C | TYR | A | 297 | 18.936 | 18.404 | 40.879 | 1.00 | 42.35 | A | C |
| ATOM | 2190 | O | TYR | A | 297 | 19.503 | 17.360 | 40.705 | 1.00 | 45.97 | A | O |
| ATOM | 2191 | N | ASP | A | 298 | 19.449 | 19.539 | 40.454 | 1.00 | 43.27 | A | N |
| ATOM | 2192 | CA | ASP | A | 298 | 20.708 | 19.629 | 39.715 | 1.00 | 45.00 | A | C |
| ATOM | 2193 | CB | ASP | A | 298 | 21.529 | 20.690 | 40.379 | 1.00 | 45.08 | A | C |
| ATOM | 2194 | CG | ASP | A | 298 | 21.941 | 21.734 | 39.474 | 1.00 | 46.96 | A | C |
| ATOM | 2195 | OD1 | ASP | A | 298 | 21.440 | 21.758 | 38.370 | 1.00 | 49.81 | A | O |
| ATOM | 2196 | OD2 | ASP | A | 298 | 22.779 | 22.535 | 39.868 | 1.00 | 48.62 | A | O |
| ATOM | 2197 | C | ASP | A | 298 | 21.607 | 18.398 | 39.657 | 1.00 | 46.16 | A | C |
| ATOM | 2198 | O | ASP | A | 298 | 22.652 | 18.406 | 40.238 | 1.00 | 46.36 | A | O |
| ATOM | 2199 | N | GLU | A | 299 | 21.115 | 17.288 | 39.155 | 1.00 | 47.13 | A | N |
| ATOM | 2200 | CA | GLU | A | 299 | 21.869 | 16.050 | 39.213 | 1.00 | 49.41 | A | C |
| ATOM | 2201 | CB | GLU | A | 299 | 22.855 | 15.798 | 38.090 | 1.00 | 51.45 | A | C |
| ATOM | 2202 | CG | GLU | A | 299 | 22.914 | 14.285 | 37.665 | 1.00 | 58.23 | A | C |
| ATOM | 2203 | CD | GLU | A | 299 | 23.861 | 13.369 | 38.494 | 1.00 | 65.69 | A | C |
| ATOM | 2204 | OE1 | GLU | A | 299 | 25.080 | 13.600 | 38.568 | 1.00 | 64.44 | A | O |
| ATOM | 2205 | OE2 | GLU | A | 299 | 23.385 | 12.364 | 39.039 | 1.00 | 69.01 | A | O |
| ATOM | 2206 | C | GLU | A | 299 | 22.505 | 15.931 | 40.548 | 1.00 | 47.95 | A | C |
| ATOM | 2207 | O | GLU | A | 299 | 23.700 | 15.822 | 40.666 | 1.00 | 49.22 | A | O |
| ATOM | 2208 | N | GLY | A | 300 | 21.694 | 16.044 | 41.562 | 1.00 | 45.55 | A | N |
| ATOM | 2209 | CA | GLY | A | 300 | 22.094 | 15.775 | 42.905 | 1.00 | 42.95 | A | C |
| ATOM | 2210 | C | GLY | A | 300 | 22.734 | 16.870 | 43.687 | 1.00 | 40.85 | A | C |
| ATOM | 2211 | O | GLY | A | 300 | 22.958 | 16.709 | 44.830 | 1.00 | 40.47 | A | O |
| ATOM | 2212 | N | ARG | A | 301 | 23.059 | 17.973 | 43.069 | 1.00 | 40.45 | A | N |
| ATOM | 2213 | CA | ARG | A | 301 | 23.607 | 19.121 | 43.772 | 1.00 | 39.96 | A | C |

Appendix 1

```
ATOM   2214  CB  ARG A 301      24.210  20.127  42.813  1.00 39.70      A   C
ATOM   2215  CG  ARG A 301      25.222  19.554  41.904  1.00 40.29      A   C
ATOM   2216  CD  ARG A 301      25.983  20.602  41.178  1.00 42.02      A   C
ATOM   2217  NE  ARG A 301      25.352  21.051  39.959  1.00 41.52      A   N
ATOM   2218  CZ  ARG A 301      25.379  20.398  38.817  1.00 42.48      A   C
ATOM   2219  NH1 ARG A 301      25.974  19.238  38.735  1.00 42.48      A   N
ATOM   2220  NH2 ARG A 301      24.782  20.901  37.765  1.00 40.72      A   N
ATOM   2221  C   ARG A 301      22.625  19.787  44.714  1.00 39.08      A   C
ATOM   2222  O   ARG A 301      22.995  20.306  45.739  1.00 38.30      A   O
ATOM   2223  N   LYS A 302      21.364  19.747  44.332  1.00 36.48      A   N
ATOM   2224  CA  LYS A 302      20.357  20.501  45.006  1.00 34.84      A   C
ATOM   2225  CB  LYS A 302      20.028  21.728  44.194  1.00 34.67      A   C
ATOM   2226  CG  LYS A 302      21.134  22.728  44.120  1.00 34.39      A   C
ATOM   2227  CD  LYS A 302      20.942  23.589  42.934  1.00 34.64      A   C
ATOM   2228  CE  LYS A 302      21.909  24.689  42.858  1.00 35.37      A   C
ATOM   2229  NZ  LYS A 302      21.363  25.725  42.039  1.00 34.44      A   N
ATOM   2230  C   LYS A 302      19.094  19.764  45.418  1.00 34.23      A   C
ATOM   2231  O   LYS A 302      18.811  18.697  44.970  1.00 32.65      A   O
ATOM   2232  N   ALA A 303      18.373  20.387  46.328  1.00 33.59      A   N
ATOM   2233  CA  ALA A 303      17.160  19.884  46.900  1.00 32.77      A   C
ATOM   2234  CB  ALA A 303      17.480  19.114  48.114  1.00 32.32      A   C
ATOM   2235  C   ALA A 303      16.285  21.055  47.253  1.00 30.92      A   C
ATOM   2236  O   ALA A 303      16.770  22.100  47.532  1.00 30.11      A   O
ATOM   2237  N   ARG A 304      14.984  20.860  47.218  1.00 29.90      A   N
ATOM   2238  CA  ARG A 304      14.013  21.834  47.664  1.00 29.16      A   C
ATOM   2239  CB  ARG A 304      13.562  22.784  46.551  1.00 28.21      A   C
ATOM   2240  CG  ARG A 304      13.339  22.167  45.241  1.00 27.21      A   C
ATOM   2241  CD  ARG A 304      12.730  23.065  44.272  1.00 32.72      A   C
ATOM   2242  NE  ARG A 304      12.669  22.371  43.020  1.00 36.91      A   N
ATOM   2243  CZ  ARG A 304      13.275  22.732  41.911  1.00 36.12      A   C
ATOM   2244  NH1 ARG A 304      13.980  23.817  41.855  1.00 34.18      A   N
ATOM   2245  NH2 ARG A 304      13.173  21.988  40.858  1.00 35.18      A   N
ATOM   2246  C   ARG A 304      12.896  20.986  48.197  1.00 28.04      A   C
ATOM   2247  O   ARG A 304      12.885  19.846  47.931  1.00 29.54      A   O
ATOM   2248  N   VAL A 305      11.985  21.532  48.979  1.00 27.65      A   N
ATOM   2249  CA  VAL A 305      11.008  20.737  49.707  1.00 25.89      A   C
ATOM   2250  CB  VAL A 305      11.294  20.824  51.203  1.00 25.54      A   C
ATOM   2251  CG1 VAL A 305      10.441  19.942  51.953  1.00 22.16      A   C
ATOM   2252  CG2 VAL A 305      12.697  20.489  51.468  1.00 23.18      A   C
ATOM   2253  C   VAL A 305       9.553  21.098  49.446  1.00 26.67      A   C
ATOM   2254  O   VAL A 305       9.184  22.219  49.559  1.00 27.15      A   O
ATOM   2255  N   ARG A 306       8.727  20.131  49.118  1.00 26.32      A   N
ATOM   2256  CA  ARG A 306       7.317  20.378  48.967  1.00 26.91      A   C
ATOM   2257  CB  ARG A 306       6.661  19.269  48.159  1.00 26.33      A   C
ATOM   2258  CG  ARG A 306       7.062  19.246  46.728  1.00 28.40      A   C
ATOM   2259  CD  ARG A 306       6.539  18.058  45.929  1.00 34.07      A   C
ATOM   2260  NE  ARG A 306       6.902  16.751  46.450  1.00 28.80      A   N
ATOM   2261  CZ  ARG A 306       8.007  16.108  46.133  1.00 31.91      A   C
ATOM   2262  NH1 ARG A 306       8.864  16.648  45.312  1.00 31.39      A   N
ATOM   2263  NH2 ARG A 306       8.272  14.950  46.659  1.00 28.87      A   N
ATOM   2264  C   ARG A 306       6.682  20.519  50.320  1.00 27.44      A   C
ATOM   2265  O   ARG A 306       6.991  19.810  51.205  1.00 27.94      A   O
ATOM   2266  N   GLU A 307       5.871  21.533  50.499  1.00 28.13      A   N
ATOM   2267  CA  GLU A 307       5.161  21.759  51.733  1.00 28.08      A   C
```

Appendix 1

```
ATOM   2268  CB   GLU A 307       4.605  23.162  51.789  1.00  27.68      A   C
ATOM   2269  CG   GLU A 307       3.636  23.436  52.887  1.00  29.40      A   C
ATOM   2270  CD   GLU A 307       4.139  23.230  54.296  1.00  29.78      A   C
ATOM   2271  OE1  GLU A 307       5.279  23.457  54.607  1.00  29.20      A   O
ATOM   2272  OE2  GLU A 307       3.340  22.831  55.103  1.00  34.09      A   O
ATOM   2273  C    GLU A 307       4.109  20.734  51.997  1.00  28.22      A   C
ATOM   2274  O    GLU A 307       3.864  20.337  53.087  1.00  29.01      A   O
ATOM   2275  N    THR A 308       3.490  20.277  50.950  1.00  29.67      A   N
ATOM   2276  CA   THR A 308       2.436  19.334  51.108  1.00  30.34      A   C
ATOM   2277  CB   THR A 308       1.162  20.042  51.489  1.00  28.87      A   C
ATOM   2278  OG1  THR A 308       0.182  19.102  51.875  1.00  29.10      A   O
ATOM   2279  CG2  THR A 308       0.673  20.839  50.409  1.00  26.30      A   C
ATOM   2280  C    THR A 308       2.340  18.317  49.972  1.00  32.00      A   C
ATOM   2281  O    THR A 308       3.075  18.364  49.059  1.00  31.98      A   O
ATOM   2282  N    ALA A 309       1.465  17.350  50.115  1.00  34.37      A   N
ATOM   2283  CA   ALA A 309       1.282  16.213  49.214  1.00  35.49      A   C
ATOM   2284  CB   ALA A 309       0.557  15.145  49.891  1.00  34.01      A   C
ATOM   2285  C    ALA A 309       0.769  16.368  47.799  1.00  36.80      A   C
ATOM   2286  O    ALA A 309       1.132  15.630  46.926  1.00  38.03      A   O
ATOM   2287  N    GLY A 310      -0.110  17.288  47.533  1.00  35.83      A   N
ATOM   2288  CA   GLY A 310      -0.778  17.195  46.275  1.00  35.59      A   C
ATOM   2289  C    GLY A 310      -0.165  17.888  45.099  1.00  35.76      A   C
ATOM   2290  O    GLY A 310      -0.810  18.055  44.116  1.00  35.68      A   O
ATOM   2291  N    THR A 311       1.071  18.324  45.215  1.00  34.31      A   N
ATOM   2292  CA   THR A 311       1.598  19.409  44.432  1.00  33.27      A   C
ATOM   2293  CB   THR A 311       1.529  20.718  45.210  1.00  32.79      A   C
ATOM   2294  OG1  THR A 311       2.161  21.733  44.476  1.00  31.29      A   O
ATOM   2295  CG2  THR A 311       2.220  20.604  46.488  1.00  27.98      A   C
ATOM   2296  C    THR A 311       2.996  19.119  44.002  1.00  34.85      A   C
ATOM   2297  O    THR A 311       3.554  18.181  44.443  1.00  34.88      A   O
ATOM   2298  N    ASP A 312       3.539  19.928  43.118  1.00  36.51      A   N
ATOM   2299  CA   ASP A 312       4.908  19.803  42.696  1.00  38.54      A   C
ATOM   2300  CB   ASP A 312       4.969  19.795  41.200  1.00  39.65      A   C
ATOM   2301  CG   ASP A 312       4.693  18.501  40.647  1.00  43.23      A   C
ATOM   2302  OD1  ASP A 312       5.376  17.571  41.002  1.00  50.55      A   O
ATOM   2303  OD2  ASP A 312       3.790  18.398  39.853  1.00  47.00      A   O-1
ATOM   2304  C    ASP A 312       5.698  20.971  43.171  1.00  38.93      A   C
ATOM   2305  O    ASP A 312       6.891  20.969  43.133  1.00  37.68      A   O
ATOM   2306  N    ASP A 313       4.982  21.974  43.616  1.00  39.44      A   N
ATOM   2307  CA   ASP A 313       5.546  23.230  44.026  1.00  40.33      A   C
ATOM   2308  CB   ASP A 313       4.425  24.242  44.208  1.00  40.39      A   C
ATOM   2309  CG   ASP A 313       3.673  24.539  42.912  1.00  44.26      A   C
ATOM   2310  OD1  ASP A 313       4.209  25.189  42.016  1.00  47.84      A   O
ATOM   2311  OD2  ASP A 313       2.513  24.158  42.777  1.00  46.59      A   O-1
ATOM   2312  C    ASP A 313       6.363  23.076  45.285  1.00  39.74      A   C
ATOM   2313  O    ASP A 313       6.132  22.225  46.067  1.00  40.04      A   O
ATOM   2314  N    ALA A 314       7.335  23.927  45.483  1.00  39.08      A   N
ATOM   2315  CA   ALA A 314       8.137  23.862  46.669  1.00  37.82      A   C
ATOM   2316  CB   ALA A 314       9.575  23.866  46.327  1.00  37.47      A   C
ATOM   2317  C    ALA A 314       7.833  25.005  47.562  1.00  37.19      A   C
ATOM   2318  O    ALA A 314       7.498  26.049  47.125  1.00  37.46      A   O
ATOM   2319  N    ASP A 315       7.932  24.780  48.844  1.00  36.88      A   N
ATOM   2320  CA   ASP A 315       7.780  25.821  49.828  1.00  35.29      A   C
ATOM   2321  CB   ASP A 315       8.984  26.716  49.830  1.00  35.77      A   C
```

Appendix 1

```
ATOM   2322  CG  ASP A 315      10.185  26.018  50.318  1.00 38.29      A  C
ATOM   2323  OD1 ASP A 315      11.016  25.675  49.514  1.00 39.42      A  O
ATOM   2324  OD2 ASP A 315      10.286  25.781  51.500  1.00 38.72      A  O
ATOM   2325  C   ASP A 315       6.540  26.623  49.783  1.00 33.13      A  C
ATOM   2326  O   ASP A 315       6.590  27.797  49.846  1.00 33.41      A  O
ATOM   2327  N   GLY A 316       5.414  25.958  49.730  1.00 31.37      A  N
ATOM   2328  CA  GLY A 316       4.149  26.607  49.819  1.00 30.45      A  C
ATOM   2329  C   GLY A 316       3.807  26.792  51.250  1.00 30.53      A  C
ATOM   2330  O   GLY A 316       4.639  26.649  52.094  1.00 30.45      A  O
ATOM   2331  N   GLY A 317       2.581  27.154  51.531  1.00 30.30      A  N
ATOM   2332  CA  GLY A 317       2.203  27.496  52.880  1.00 30.43      A  C
ATOM   2333  C   GLY A 317       2.990  28.633  53.481  1.00 29.64      A  C
ATOM   2334  O   GLY A 317       3.101  29.670  52.902  1.00 29.63      A  O
ATOM   2335  N   VAL A 318       3.556  28.406  54.645  1.00 28.05      A  N
ATOM   2336  CA  VAL A 318       4.391  29.381  55.274  1.00 26.12      A  C
ATOM   2337  CB  VAL A 318       4.553  29.144  56.759  1.00 27.38      A  C
ATOM   2338  CG1 VAL A 318       3.260  29.330  57.434  1.00 26.22      A  C
ATOM   2339  CG2 VAL A 318       5.140  27.810  57.043  1.00 25.46      A  C
ATOM   2340  C   VAL A 318       5.703  29.503  54.578  1.00 26.40      A  C
ATOM   2341  O   VAL A 318       6.400  30.439  54.763  1.00 24.26      A  O
ATOM   2342  N   GLY A 319       6.020  28.567  53.719  1.00 26.01      A  N
ATOM   2343  CA  GLY A 319       7.232  28.646  52.957  1.00 25.85      A  C
ATOM   2344  C   GLY A 319       8.483  28.339  53.699  1.00 25.11      A  C
ATOM   2345  O   GLY A 319       9.523  28.785  53.362  1.00 25.73      A  O
ATOM   2346  N   LEU A 320       8.351  27.559  54.728  1.00 24.46      A  N
ATOM   2347  CA  LEU A 320       9.458  27.262  55.541  1.00 23.96      A  C
ATOM   2348  CB  LEU A 320       9.152  27.678  56.957  1.00 24.48      A  C
ATOM   2349  CG  LEU A 320       9.071  29.166  57.175  1.00 26.85      A  C
ATOM   2350  CD1 LEU A 320       8.810  29.433  58.571  1.00 23.84      A  C
ATOM   2351  CD2 LEU A 320      10.284  29.856  56.710  1.00 23.78      A  C
ATOM   2352  C   LEU A 320       9.934  25.849  55.473  1.00 22.67      A  C
ATOM   2353  O   LEU A 320      10.802  25.502  56.172  1.00 22.71      A  O
ATOM   2354  N   ALA A 321       9.384  25.046  54.609  1.00 22.91      A  N
ATOM   2355  CA  ALA A 321       9.769  23.660  54.541  1.00 23.64      A  C
ATOM   2356  CB  ALA A 321       8.861  22.929  53.628  1.00 24.34      A  C
ATOM   2357  C   ALA A 321      11.205  23.328  54.197  1.00 24.05      A  C
ATOM   2358  O   ALA A 321      11.747  22.472  54.797  1.00 25.42      A  O
ATOM   2359  N   SER A 322      11.817  23.963  53.230  1.00 22.84      A  N
ATOM   2360  CA  SER A 322      13.207  23.709  52.978  1.00 22.75      A  C
ATOM   2361  CB  SER A 322      13.653  24.435  51.726  1.00 22.31      A  C
ATOM   2362  OG  SER A 322      13.048  23.944  50.599  1.00 22.33      A  O
ATOM   2363  C   SER A 322      14.133  24.099  54.118  1.00 23.52      A  C
ATOM   2364  O   SER A 322      15.019  23.385  54.468  1.00 24.09      A  O
ATOM   2365  N   ALA A 323      13.926  25.257  54.686  1.00 23.30      A  N
ATOM   2366  CA  ALA A 323      14.689  25.701  55.804  1.00 23.22      A  C
ATOM   2367  CB  ALA A 323      14.389  27.096  56.081  1.00 23.41      A  C
ATOM   2368  C   ALA A 323      14.518  24.848  57.052  1.00 24.26      A  C
ATOM   2369  O   ALA A 323      15.442  24.640  57.776  1.00 23.84      A  O
ATOM   2370  N   PHE A 324      13.323  24.370  57.329  1.00 23.79      A  N
ATOM   2371  CA  PHE A 324      13.177  23.453  58.420  1.00 24.82      A  C
ATOM   2372  CB  PHE A 324      11.734  23.305  58.867  1.00 24.68      A  C
ATOM   2373  CG  PHE A 324      11.292  24.351  59.827  1.00 27.79      A  C
ATOM   2374  CD1 PHE A 324      11.744  24.383  61.090  1.00 29.50      A  C
ATOM   2375  CE1 PHE A 324      11.333  25.361  61.933  1.00 33.40      A  C
```

Appendix 1

```
ATOM   2376  CZ   PHE A 324      10.473  26.279  61.527  1.00 29.35      A  C
ATOM   2377  CE2  PHE A 324      10.015  26.254  60.299  1.00 32.10      A  C
ATOM   2378  CD2  PHE A 324      10.415  25.316  59.449  1.00 31.68      A  C
ATOM   2379  C    PHE A 324      13.860  22.131  58.178  1.00 25.29      A  C
ATOM   2380  O    PHE A 324      14.387  21.548  59.068  1.00 24.38      A  O
ATOM   2381  N    THR A 325      13.822  21.689  56.945  1.00 25.03      A  N
ATOM   2382  CA   THR A 325      14.439  20.470  56.511  1.00 24.91      A  C
ATOM   2383  CB   THR A 325      14.025  20.172  55.129  1.00 24.95      A  C
ATOM   2384  OG1  THR A 325      12.633  20.304  55.073  1.00 28.50      A  O
ATOM   2385  CG2  THR A 325      14.310  18.825  54.784  1.00 26.22      A  C
ATOM   2386  C    THR A 325      15.927  20.526  56.647  1.00 24.80      A  C
ATOM   2387  O    THR A 325      16.540  19.583  57.022  1.00 25.80      A  O
ATOM   2388  N    LEU A 326      16.489  21.672  56.372  1.00 23.38      A  N
ATOM   2389  CA   LEU A 326      17.854  21.915  56.585  1.00 23.43      A  C
ATOM   2390  CB   LEU A 326      18.159  23.303  56.098  1.00 23.21      A  C
ATOM   2391  CG   LEU A 326      19.556  23.855  56.191  1.00 23.95      A  C
ATOM   2392  CD1  LEU A 326      20.483  23.254  55.217  1.00 22.19      A  C
ATOM   2393  CD2  LEU A 326      19.511  25.309  56.073  1.00 19.93      A  C
ATOM   2394  C    LEU A 326      18.208  21.762  58.056  1.00 25.64      A  C
ATOM   2395  O    LEU A 326      19.252  21.287  58.368  1.00 26.69      A  O
ATOM   2396  N    LEU A 327      17.340  22.174  58.958  1.00 25.94      A  N
ATOM   2397  CA   LEU A 327      17.517  21.895  60.354  1.00 26.44      A  C
ATOM   2398  CB   LEU A 327      16.497  22.642  61.196  1.00 27.51      A  C
ATOM   2399  CG   LEU A 327      16.432  22.465  62.705  1.00 28.47      A  C
ATOM   2400  CD1  LEU A 327      17.701  22.673  63.344  1.00 27.82      A  C
ATOM   2401  CD2  LEU A 327      15.451  23.351  63.315  1.00 28.61      A  C
ATOM   2402  C    LEU A 327      17.459  20.454  60.678  1.00 27.05      A  C
ATOM   2403  O    LEU A 327      18.301  19.985  61.354  1.00 28.09      A  O
ATOM   2404  N    LEU A 328      16.478  19.747  60.158  1.00 27.15      A  N
ATOM   2405  CA   LEU A 328      16.307  18.340  60.381  1.00 25.57      A  C
ATOM   2406  CB   LEU A 328      15.057  17.872  59.674  1.00 25.17      A  C
ATOM   2407  CG   LEU A 328      14.611  16.438  59.904  1.00 24.76      A  C
ATOM   2408  CD1  LEU A 328      14.574  16.073  61.296  1.00 22.05      A  C
ATOM   2409  CD2  LEU A 328      13.346  16.107  59.278  1.00 18.89      A  C
ATOM   2410  C    LEU A 328      17.479  17.546  59.880  1.00 26.27      A  C
ATOM   2411  O    LEU A 328      17.939  16.656  60.535  1.00 25.31      A  O
ATOM   2412  N    ALA A 329      17.981  17.896  58.722  1.00 26.46      A  N
ATOM   2413  CA   ALA A 329      19.107  17.224  58.162  1.00 27.96      A  C
ATOM   2414  CB   ALA A 329      19.379  17.712  56.783  1.00 28.95      A  C
ATOM   2415  C    ALA A 329      20.325  17.353  59.004  1.00 28.86      A  C
ATOM   2416  O    ALA A 329      21.048  16.425  59.149  1.00 30.35      A  O
ATOM   2417  N    ARG A 330      20.561  18.512  59.553  1.00 29.04      A  N
ATOM   2418  CA   ARG A 330      21.614  18.705  60.502  1.00 28.48      A  C
ATOM   2419  CB   ARG A 330      21.809  20.191  60.750  1.00 29.91      A  C
ATOM   2420  CG   ARG A 330      22.931  20.589  61.624  1.00 28.61      A  C
ATOM   2421  CD   ARG A 330      24.135  20.878  60.827  1.00 31.08      A  C
ATOM   2422  NE   ARG A 330      25.059  21.732  61.515  1.00 30.56      A  N
ATOM   2423  CZ   ARG A 330      26.059  21.298  62.236  1.00 30.01      A  C
ATOM   2424  NH1  ARG A 330      26.275  20.034  62.395  1.00 30.59      A  N
ATOM   2425  NH2  ARG A 330      26.823  22.133  62.824  1.00 30.39      A  N
ATOM   2426  C    ARG A 330      21.447  17.960  61.802  1.00 29.78      A  C
ATOM   2427  O    ARG A 330      22.388  17.409  62.273  1.00 29.94      A  O
ATOM   2428  N    GLU A 331      20.271  17.946  62.390  1.00 30.14      A  N
ATOM   2429  CA   GLU A 331      20.082  17.249  63.633  1.00 31.12      A  C
```

Appendix 1

```
ATOM   2430  CB   GLU A 331      18.664  17.455  64.150  1.00  31.45      A    C
ATOM   2431  CG   GLU A 331      18.233  16.504  65.215  1.00  31.89      A    C
ATOM   2432  CD   GLU A 331      18.695  16.898  66.590  1.00  38.07      A    C
ATOM   2433  OE1  GLU A 331      18.714  18.084  66.834  1.00  37.72      A    O
ATOM   2434  OE2  GLU A 331      19.040  16.048  67.422  1.00  39.08      A    O-1
ATOM   2435  C    GLU A 331      20.346  15.784  63.433  1.00  32.66      A    C
ATOM   2436  O    GLU A 331      20.917  15.117  64.274  1.00  32.90      A    O
ATOM   2437  N    MET A 332      19.937  15.325  62.264  1.00  33.35      A    N
ATOM   2438  CA   MET A 332      20.005  13.954  61.828  1.00  33.76      A    C
ATOM   2439  CB   MET A 332      18.910  13.723  60.791  1.00  33.13      A    C
ATOM   2440  CG   MET A 332      18.049  12.515  61.006  1.00  36.98      A    C
ATOM   2441  SD   MET A 332      16.818  12.618  62.259  1.00  37.37      A    S
ATOM   2442  CE   MET A 332      17.617  13.676  63.330  1.00  39.18      A    C
ATOM   2443  C    MET A 332      21.365  13.501  61.291  1.00  33.73      A    C
ATOM   2444  O    MET A 332      21.581  12.360  61.071  1.00  32.86      A    O
ATOM   2445  N    GLY A 333      22.275  14.420  61.103  1.00  34.03      A    N
ATOM   2446  CA   GLY A 333      23.569  14.120  60.593  1.00  34.46      A    C
ATOM   2447  C    GLY A 333      23.617  13.837  59.126  1.00  35.47      A    C
ATOM   2448  O    GLY A 333      24.548  13.278  58.664  1.00  36.36      A    O
ATOM   2449  N    ASP A 334      22.623  14.241  58.380  1.00  35.35      A    N
ATOM   2450  CA   ASP A 334      22.582  13.950  56.975  1.00  33.96      A    C
ATOM   2451  CB   ASP A 334      21.124  13.874  56.584  1.00  33.59      A    C
ATOM   2452  CG   ASP A 334      20.912  13.455  55.196  1.00  35.88      A    C
ATOM   2453  OD1  ASP A 334      21.844  13.398  54.449  1.00  37.63      A    O
ATOM   2454  OD2  ASP A 334      19.790  13.204  54.822  1.00  39.11      A    O-1
ATOM   2455  C    ASP A 334      23.267  15.036  56.194  1.00  33.74      A    C
ATOM   2456  O    ASP A 334      22.644  15.954  55.780  1.00  35.23      A    O
ATOM   2457  N    GLN A 335      24.558  14.904  55.979  1.00  31.91      A    N
ATOM   2458  CA   GLN A 335      25.355  15.910  55.310  1.00  30.90      A    C
ATOM   2459  CB   GLN A 335      26.833  15.613  55.436  1.00  29.80      A    C
ATOM   2460  CG   GLN A 335      27.377  15.920  56.766  1.00  32.57      A    C
ATOM   2461  CD   GLN A 335      28.823  15.571  56.944  1.00  38.40      A    C
ATOM   2462  OE1  GLN A 335      29.186  14.950  57.908  1.00  38.50      A    O
ATOM   2463  NE2  GLN A 335      29.649  15.990  56.035  1.00  31.30      A    N
ATOM   2464  C    GLN A 335      25.007  16.192  53.886  1.00  30.51      A    C
ATOM   2465  O    GLN A 335      25.153  17.284  53.451  1.00  28.51      A    O
ATOM   2466  N    GLN A 336      24.621  15.188  53.133  1.00  31.11      A    N
ATOM   2467  CA   GLN A 336      24.272  15.383  51.751  1.00  32.37      A    C
ATOM   2468  CB   GLN A 336      24.243  14.045  51.034  1.00  32.30      A    C
ATOM   2469  CG   GLN A 336      23.652  14.061  49.679  1.00  37.51      A    C
ATOM   2470  CD   GLN A 336      23.612  12.698  49.008  1.00  43.57      A    C
ATOM   2471  OE1  GLN A 336      22.832  11.839  49.360  1.00  39.39      A    O
ATOM   2472  NE2  GLN A 336      24.464  12.515  48.019  1.00  44.33      A    N
ATOM   2473  C    GLN A 336      23.015  16.197  51.524  1.00  31.16      A    C
ATOM   2474  O    GLN A 336      22.996  17.069  50.717  1.00  32.00      A    O
ATOM   2475  N    LEU A 337      21.976  15.915  52.270  1.00  29.07      A    N
ATOM   2476  CA   LEU A 337      20.808  16.738  52.246  1.00  28.40      A    C
ATOM   2477  CB   LEU A 337      19.731  16.133  53.105  1.00  27.34      A    C
ATOM   2478  CG   LEU A 337      18.357  15.999  52.520  1.00  25.21      A    C
ATOM   2479  CD1  LEU A 337      17.377  16.087  53.575  1.00  26.16      A    C
ATOM   2480  CD2  LEU A 337      18.075  16.948  51.457  1.00  19.31      A    C
ATOM   2481  C    LEU A 337      21.112  18.121  52.736  1.00  28.51      A    C
ATOM   2482  O    LEU A 337      20.643  19.069  52.191  1.00  30.77      A    O
ATOM   2483  N    PHE A 338      21.913  18.243  53.757  1.00  26.54      A    N
```

Appendix 1

```
ATOM   2484  CA   PHE A 338      22.206  19.526  54.230  1.00 25.72      A   C
ATOM   2485  CB   PHE A 338      23.097  19.401  55.440  1.00 25.64      A   C
ATOM   2486  CG   PHE A 338      23.513  20.691  56.018  1.00 25.30      A   C
ATOM   2487  CD1  PHE A 338      22.881  21.193  57.096  1.00 24.17      A   C
ATOM   2488  CE1  PHE A 338      23.239  22.349  57.605  1.00 26.49      A   C
ATOM   2489  CZ   PHE A 338      24.251  23.038  57.064  1.00 26.01      A   C
ATOM   2490  CE2  PHE A 338      24.896  22.563  56.003  1.00 27.95      A   C
ATOM   2491  CD2  PHE A 338      24.537  21.404  55.480  1.00 25.17      A   C
ATOM   2492  C    PHE A 338      22.872  20.329  53.164  1.00 26.45      A   C
ATOM   2493  O    PHE A 338      22.558  21.455  52.980  1.00 27.30      A   O
ATOM   2494  N    ASP A 339      23.828  19.750  52.482  1.00 28.41      A   N
ATOM   2495  CA   ASP A 339      24.551  20.429  51.447  1.00 27.12      A   C
ATOM   2496  CB   ASP A 339      25.721  19.563  51.007  1.00 27.17      A   C
ATOM   2497  CG   ASP A 339      26.723  20.295  50.185  1.00 30.83      A   C
ATOM   2498  OD1  ASP A 339      27.500  21.064  50.714  1.00 33.11      A   O
ATOM   2499  OD2  ASP A 339      26.745  20.082  48.993  1.00 36.56      A   O-1
ATOM   2500  C    ASP A 339      23.687  20.805  50.285  1.00 26.58      A   C
ATOM   2501  O    ASP A 339      23.769  21.876  49.805  1.00 26.69      A   O
ATOM   2502  N    GLN A 340      22.857  19.894  49.848  1.00 24.98      A   N
ATOM   2503  CA   GLN A 340      21.933  20.140  48.763  1.00 25.49      A   C
ATOM   2504  CB   GLN A 340      21.205  18.858  48.369  1.00 25.45      A   C
ATOM   2505  CG   GLN A 340      22.006  17.865  47.662  1.00 20.48      A   C
ATOM   2506  CD   GLN A 340      21.318  16.558  47.569  1.00 28.67      A   C
ATOM   2507  OE1  GLN A 340      20.509  16.229  48.377  1.00 31.77      A   O
ATOM   2508  NE2  GLN A 340      21.654  15.794  46.579  1.00 26.54      A   N
ATOM   2509  C    GLN A 340      20.893  21.181  49.063  1.00 26.58      A   C
ATOM   2510  O    GLN A 340      20.529  21.947  48.227  1.00 26.09      A   O
ATOM   2511  N    LEU A 341      20.370  21.142  50.265  1.00 27.17      A   N
ATOM   2512  CA   LEU A 341      19.431  22.115  50.737  1.00 27.42      A   C
ATOM   2513  CB   LEU A 341      18.901  21.652  52.089  1.00 27.65      A   C
ATOM   2514  CG   LEU A 341      17.458  21.275  52.334  1.00 28.63      A   C
ATOM   2515  CD1  LEU A 341      16.732  21.126  51.118  1.00 27.58      A   C
ATOM   2516  CD2  LEU A 341      17.323  20.101  53.150  1.00 26.10      A   C
ATOM   2517  C    LEU A 341      20.041  23.511  50.846  1.00 26.81      A   C
ATOM   2518  O    LEU A 341      19.439  24.476  50.502  1.00 24.90      A   O
ATOM   2519  N    LEU A 342      21.247  23.601  51.359  1.00 25.56      A   N
ATOM   2520  CA   LEU A 342      21.949  24.853  51.412  1.00 26.31      A   C
ATOM   2521  CB   LEU A 342      23.150  24.776  52.330  1.00 25.52      A   C
ATOM   2522  CG   LEU A 342      23.663  26.053  52.966  1.00 23.27      A   C
ATOM   2523  CD1  LEU A 342      22.632  26.944  53.492  1.00 22.80      A   C
ATOM   2524  CD2  LEU A 342      24.673  25.804  53.934  1.00 12.59      A   C
ATOM   2525  C    LEU A 342      22.286  25.430  50.052  1.00 27.31      A   C
ATOM   2526  O    LEU A 342      22.333  26.608  49.869  1.00 28.30      A   O
ATOM   2527  N    ASN A 343      22.561  24.576  49.106  1.00 28.07      A   N
ATOM   2528  CA   ASN A 343      22.829  25.001  47.762  1.00 27.88      A   C
ATOM   2529  CB   ASN A 343      23.348  23.839  46.962  1.00 27.85      A   C
ATOM   2530  CG   ASN A 343      24.701  23.443  47.363  1.00 25.70      A   C
ATOM   2531  OD1  ASN A 343      25.364  24.154  48.036  1.00 24.84      A   O
ATOM   2532  ND2  ASN A 343      25.128  22.315  46.920  1.00 24.92      A   N
ATOM   2533  C    ASN A 343      21.627  25.627  47.111  1.00 28.09      A   C
ATOM   2534  O    ASN A 343      21.727  26.531  46.348  1.00 28.23      A   O
ATOM   2535  N    HIS A 344      20.475  25.073  47.394  1.00 28.90      A   N
ATOM   2536  CA   HIS A 344      19.255  25.676  46.969  1.00 29.29      A   C
ATOM   2537  CB   HIS A 344      18.132  24.684  47.174  1.00 29.33      A   C
```

Appendix 1

```
ATOM   2538  CG   HIS A 344      16.776  25.252  46.953  1.00 28.97           A    C
ATOM   2539  ND1  HIS A 344      16.341  25.672  45.730  1.00 28.89           A    N
ATOM   2540  CE1  HIS A 344      15.117  26.119  45.832  1.00 28.97           A    C
ATOM   2541  NE2  HIS A 344      14.745  26.019  47.083  1.00 32.66           A    N
ATOM   2542  CD2  HIS A 344      15.766  25.485  47.807  1.00 31.59           A    C
ATOM   2543  C    HIS A 344      18.933  27.002  47.640  1.00 29.57           A    C
ATOM   2544  O    HIS A 344      18.465  27.904  47.001  1.00 28.55           A    O
ATOM   2545  N    LEU A 345      19.225  27.117  48.930  1.00 29.67           A    N
ATOM   2546  CA   LEU A 345      18.823  28.259  49.733  1.00 29.10           A    C
ATOM   2547  CB   LEU A 345      18.476  27.802  51.138  1.00 28.16           A    C
ATOM   2548  CG   LEU A 345      17.286  26.915  51.447  1.00 26.09           A    C
ATOM   2549  CD1  LEU A 345      17.392  26.332  52.810  1.00 15.23           A    C
ATOM   2550  CD2  LEU A 345      16.043  27.642  51.305  1.00 21.47           A    C
ATOM   2551  C    LEU A 345      19.735  29.449  49.856  1.00 30.40           A    C
ATOM   2552  O    LEU A 345      19.280  30.533  49.781  1.00 30.40           A    O
ATOM   2553  N    GLU A 346      21.002  29.253  50.135  1.00 31.10           A    N
ATOM   2554  CA   GLU A 346      21.889  30.382  50.363  1.00 33.19           A    C
ATOM   2555  CB   GLU A 346      23.114  29.941  51.182  1.00 33.21           A    C
ATOM   2556  CG   GLU A 346      23.784  31.010  51.985  1.00 35.92           A    C
ATOM   2557  CD   GLU A 346      24.956  30.512  52.750  1.00 40.41           A    C
ATOM   2558  OE1  GLU A 346      25.721  29.736  52.208  1.00 42.88           A    O
ATOM   2559  OE2  GLU A 346      25.128  30.893  53.903  1.00 39.59           A    O-1
ATOM   2560  C    GLU A 346      22.254  31.286  49.158  1.00 33.60           A    C
ATOM   2561  O    GLU A 346      22.211  32.478  49.248  1.00 33.93           A    O
ATOM   2562  N    PRO A 347      22.585  30.718  48.021  1.00 33.45           A    N
ATOM   2563  CA   PRO A 347      23.002  31.509  46.868  1.00 33.05           A    C
ATOM   2564  CB   PRO A 347      23.393  30.437  45.880  1.00 34.00           A    C
ATOM   2565  CG   PRO A 347      23.779  29.337  46.706  1.00 33.22           A    C
ATOM   2566  CD   PRO A 347      22.804  29.302  47.762  1.00 33.36           A    C
ATOM   2567  C    PRO A 347      22.013  32.480  46.235  1.00 31.43           A    C
ATOM   2568  O    PRO A 347      22.399  33.541  45.899  1.00 32.08           A    O
ATOM   2569  N    PRO A 348      20.767  32.129  46.071  1.00 29.87           A    N
ATOM   2570  CA   PRO A 348      19.786  33.077  45.610  1.00 29.21           A    C
ATOM   2571  CB   PRO A 348      18.568  32.215  45.401  1.00 27.92           A    C
ATOM   2572  CG   PRO A 348      18.846  31.022  45.976  1.00 26.06           A    C
ATOM   2573  CD   PRO A 348      20.233  30.787  45.972  1.00 29.84           A    C
ATOM   2574  C    PRO A 348      19.562  34.218  46.589  1.00 29.98           A    C
ATOM   2575  O    PRO A 348      19.229  35.285  46.188  1.00 30.60           A    O
ATOM   2576  N    ALA A 349      19.804  33.979  47.855  1.00 28.66           A    N
ATOM   2577  CA   ALA A 349      19.614  34.961  48.891  1.00 30.32           A    C
ATOM   2578  CB   ALA A 349      19.506  34.326  50.199  1.00 29.77           A    C
ATOM   2579  C    ALA A 349      20.669  36.034  48.897  1.00 31.25           A    C
ATOM   2580  O    ALA A 349      20.549  36.994  49.579  1.00 31.66           A    O
ATOM   2581  N    LYS A 350      21.681  35.873  48.084  1.00 31.50           A    N
ATOM   2582  CA   LYS A 350      22.676  36.883  47.899  1.00 32.42           A    C
ATOM   2583  CB   LYS A 350      22.064  38.050  47.173  1.00 33.15           A    C
ATOM   2584  CG   LYS A 350      21.725  37.787  45.761  1.00 35.07           A    C
ATOM   2585  CD   LYS A 350      22.944  37.755  44.908  1.00 42.70           A    C
ATOM   2586  CE   LYS A 350      22.974  36.579  44.001  1.00 42.82           A    C
ATOM   2587  NZ   LYS A 350      23.584  36.898  42.743  1.00 41.82           A    N
ATOM   2588  C    LYS A 350      23.436  37.400  49.087  1.00 33.30           A    C
ATOM   2589  O    LYS A 350      23.485  38.572  49.297  1.00 33.77           A    O
ATOM   2590  N    PRO A 351      24.074  36.521  49.835  1.00 33.31           A    N
ATOM   2591  CA   PRO A 351      24.846  36.938  50.982  1.00 33.97           A    C
```

Appendix 1

```
ATOM   2592  CB  PRO A 351      25.290  35.619  51.545  1.00 33.65      A    C
ATOM   2593  CG  PRO A 351      25.306  34.776  50.500  1.00 32.03      A    C
ATOM   2594  CD  PRO A 351      24.166  35.076  49.702  1.00 32.81      A    C
ATOM   2595  C   PRO A 351      26.066  37.794  50.712  1.00 35.93      A    C
ATOM   2596  O   PRO A 351      26.802  37.554  49.807  1.00 36.87      A    O
ATOM   2597  N   SER A 352      26.271  38.809  51.524  1.00 37.31      A    N
ATOM   2598  CA  SER A 352      27.494  39.574  51.473  1.00 37.98      A    C
ATOM   2599  CB  SER A 352      27.307  40.873  50.709  1.00 38.54      A    C
ATOM   2600  OG  SER A 352      26.481  41.754  51.397  1.00 37.50      A    O
ATOM   2601  C   SER A 352      28.035  39.850  52.853  1.00 37.83      A    C
ATOM   2602  O   SER A 352      27.345  40.283  53.708  1.00 39.53      A    O
ATOM   2603  N   ILE A 353      29.299  39.603  53.060  1.00 36.82      A    N
ATOM   2604  CA  ILE A 353      29.885  39.966  54.298  1.00 36.38      A    C
ATOM   2605  CB  ILE A 353      30.898  38.928  54.700  1.00 36.49      A    C
ATOM   2606  CG1 ILE A 353      30.242  37.567  54.789  1.00 33.49      A    C
ATOM   2607  CD1 ILE A 353      31.073  36.530  55.355  1.00 25.63      A    C
ATOM   2608  CG2 ILE A 353      31.584  39.308  55.993  1.00 31.10      A    C
ATOM   2609  C   ILE A 353      30.594  41.269  54.045  1.00 37.73      A    C
ATOM   2610  O   ILE A 353      31.600  41.297  53.407  1.00 37.90      A    O
ATOM   2611  N   VAL A 354      30.067  42.361  54.541  1.00 38.18      A    N
ATOM   2612  CA  VAL A 354      30.631  43.607  54.146  1.00 39.11      A    C
ATOM   2613  CB  VAL A 354      29.587  44.577  53.715  1.00 39.60      A    C
ATOM   2614  CG1 VAL A 354      30.077  45.940  53.902  1.00 38.49      A    C
ATOM   2615  CG2 VAL A 354      29.287  44.345  52.295  1.00 37.75      A    C
ATOM   2616  C   VAL A 354      31.637  44.256  55.049  1.00 39.76      A    C
ATOM   2617  O   VAL A 354      32.677  44.645  54.574  1.00 41.97      A    O
ATOM   2618  N   SER A 355      31.392  44.356  56.332  1.00 37.97      A    N
ATOM   2619  CA  SER A 355      32.480  44.788  57.185  1.00 36.44      A    C
ATOM   2620  CB  SER A 355      32.290  46.209  57.648  1.00 36.65      A    C
ATOM   2621  OG  SER A 355      32.804  46.400  58.923  1.00 39.37      A    O
ATOM   2622  C   SER A 355      32.566  43.842  58.333  1.00 35.64      A    C
ATOM   2623  O   SER A 355      32.410  44.202  59.472  1.00 33.45      A    O
ATOM   2624  N   ALA A 356      32.794  42.599  57.937  1.00 35.39      A    N
ATOM   2625  CA  ALA A 356      32.791  41.408  58.754  1.00 35.30      A    C
ATOM   2626  CB  ALA A 356      33.843  41.462  59.759  1.00 35.30      A    C
ATOM   2627  C   ALA A 356      31.442  41.162  59.374  1.00 35.00      A    C
ATOM   2628  O   ALA A 356      31.326  40.589  60.425  1.00 34.98      A    O
ATOM   2629  N   SER A 357      30.418  41.609  58.681  1.00 34.30      A    N
ATOM   2630  CA  SER A 357      29.059  41.409  59.094  1.00 34.65      A    C
ATOM   2631  CB  SER A 357      28.461  42.722  59.490  1.00 34.47      A    C
ATOM   2632  OG  SER A 357      27.632  42.563  60.572  1.00 36.03      A    O
ATOM   2633  C   SER A 357      28.251  40.816  57.975  1.00 33.87      A    C
ATOM   2634  O   SER A 357      28.376  41.213  56.870  1.00 32.67      A    O
ATOM   2635  N   LEU A 358      27.399  39.867  58.293  1.00 32.58      A    N
ATOM   2636  CA  LEU A 358      26.633  39.160  57.295  1.00 32.01      A    C
ATOM   2637  CB  LEU A 358      26.554  37.692  57.656  1.00 30.77      A    C
ATOM   2638  CG  LEU A 358      25.705  36.849  56.752  1.00 27.84      A    C
ATOM   2639  CD1 LEU A 358      26.318  36.813  55.421  1.00 30.39      A    C
ATOM   2640  CD2 LEU A 358      25.523  35.534  57.263  1.00 19.90      A    C
ATOM   2641  C   LEU A 358      25.243  39.704  57.046  1.00 32.74      A    C
ATOM   2642  O   LEU A 358      24.531  39.977  57.956  1.00 31.75      A    O
ATOM   2643  N   ARG A 359      24.914  39.875  55.776  1.00 34.16      A    N
ATOM   2644  CA  ARG A 359      23.605  40.270  55.309  1.00 36.51      A    C
ATOM   2645  CB  ARG A 359      23.652  41.649  54.711  1.00 38.05      A    C
```

Appendix 1

```
ATOM   2646  CG   ARG A 359      23.930  42.742  55.663  1.00 45.78      A   C
ATOM   2647  CD   ARG A 359      22.810  42.937  56.662  1.00 55.77      A   C
ATOM   2648  NE   ARG A 359      23.076  44.080  57.514  1.00 59.39      A   N
ATOM   2649  CZ   ARG A 359      24.215  44.265  58.147  1.00 63.10      A   C
ATOM   2650  NH1  ARG A 359      25.166  43.383  58.032  1.00 63.93      A   N
ATOM   2651  NH2  ARG A 359      24.406  45.334  58.880  1.00 63.84      A   N
ATOM   2652  C    ARG A 359      23.177  39.378  54.191  1.00 36.40      A   C
ATOM   2653  O    ARG A 359      23.971  38.982  53.399  1.00 37.45      A   O
ATOM   2654  N    TYR A 360      21.905  39.093  54.101  1.00 35.55      A   N
ATOM   2655  CA   TYR A 360      21.395  38.574  52.877  1.00 36.28      A   C
ATOM   2656  CB   TYR A 360      20.539  37.355  53.133  1.00 35.90      A   C
ATOM   2657  CG   TYR A 360      21.308  36.191  53.677  1.00 32.91      A   C
ATOM   2658  CD1  TYR A 360      21.942  35.295  52.853  1.00 29.79      A   C
ATOM   2659  CE1  TYR A 360      22.634  34.271  53.364  1.00 28.17      A   C
ATOM   2660  CZ   TYR A 360      22.681  34.130  54.688  1.00 28.38      A   C
ATOM   2661  OH   TYR A 360      23.355  33.130  55.233  1.00 32.69      A   O
ATOM   2662  CE2  TYR A 360      22.068  34.984  55.502  1.00 23.77      A   C
ATOM   2663  CD2  TYR A 360      21.400  35.994  55.011  1.00 27.55      A   C
ATOM   2664  C    TYR A 360      20.609  39.661  52.181  1.00 36.63      A   C
ATOM   2665  O    TYR A 360      19.628  40.118  52.668  1.00 35.84      A   O
ATOM   2666  N    GLU A 361      21.090  40.120  51.049  1.00 39.63      A   N
ATOM   2667  CA   GLU A 361      20.299  40.948  50.190  1.00 42.95      A   C
ATOM   2668  CB   GLU A 361      21.105  41.393  48.991  1.00 43.94      A   C
ATOM   2669  CG   GLU A 361      20.413  42.386  48.097  1.00 52.55      A   C
ATOM   2670  CD   GLU A 361      21.353  43.283  47.273  1.00 60.51      A   C
ATOM   2671  OE1  GLU A 361      22.246  43.924  47.842  1.00 59.54      A   O
ATOM   2672  OE2  GLU A 361      21.167  43.374  46.046  1.00 63.16      A   O-1
ATOM   2673  C    GLU A 361      19.394  39.873  49.794  1.00 43.03      A   C
ATOM   2674  O    GLU A 361      19.809  38.757  49.698  1.00 44.95      A   O
ATOM   2675  N    HIS A 362      18.153  40.149  49.561  1.00 42.65      A   N
ATOM   2676  CA   HIS A 362      17.303  39.069  49.123  1.00 43.56      A   C
ATOM   2677  CB   HIS A 362      17.728  38.707  47.716  1.00 45.01      A   C
ATOM   2678  CG   HIS A 362      16.597  38.284  46.862  1.00 52.69      A   C
ATOM   2679  ND1  HIS A 362      15.620  39.156  46.462  1.00 61.92      A   N
ATOM   2680  CE1  HIS A 362      14.721  38.506  45.751  1.00 61.98      A   C
ATOM   2681  NE2  HIS A 362      15.071  37.238  45.701  1.00 62.54      A   N
ATOM   2682  CD2  HIS A 362      16.237  37.073  46.394  1.00 58.25      A   C
ATOM   2683  C    HIS A 362      17.012  37.749  49.907  1.00 41.26      A   C
ATOM   2684  O    HIS A 362      17.010  36.708  49.321  1.00 40.50      A   O
ATOM   2685  N    PRO A 363      16.669  37.795  51.181  1.00 39.91      A   N
ATOM   2686  CA   PRO A 363      16.257  36.588  51.872  1.00 38.39      A   C
ATOM   2687  CB   PRO A 363      15.974  37.095  53.270  1.00 37.79      A   C
ATOM   2688  CG   PRO A 363      15.668  38.418  53.106  1.00 37.89      A   C
ATOM   2689  CD   PRO A 363      16.590  38.915  52.108  1.00 39.96      A   C
ATOM   2690  C    PRO A 363      14.996  35.998  51.312  1.00 37.96      A   C
ATOM   2691  O    PRO A 363      14.127  36.700  50.904  1.00 38.63      A   O
ATOM   2692  N    GLY A 364      14.901  34.695  51.280  1.00 37.06      A   N
ATOM   2693  CA   GLY A 364      13.802  34.056  50.608  1.00 35.88      A   C
ATOM   2694  C    GLY A 364      12.568  33.675  51.361  1.00 36.38      A   C
ATOM   2695  O    GLY A 364      11.600  33.283  50.795  1.00 36.85      A   O
ATOM   2696  N    SER A 365      12.600  33.791  52.655  1.00 35.63      A   N
ATOM   2697  CA   SER A 365      11.470  33.449  53.426  1.00 34.33      A   C
ATOM   2698  CB   SER A 365      11.508  32.005  53.803  1.00 35.03      A   C
ATOM   2699  OG   SER A 365      12.517  31.770  54.716  1.00 36.19      A   O
```

Appendix 1

```
ATOM   2700  C    SER A 365      11.544  34.285  54.623  1.00 33.21           A  C
ATOM   2701  O    SER A 365      12.445  35.056  54.784  1.00 35.30           A  O
ATOM   2702  N    LEU A 366      10.527  34.143  55.425  1.00 31.15           A  N
ATOM   2703  CA   LEU A 366      10.490  34.564  56.776  1.00 29.83           A  C
ATOM   2704  CB   LEU A 366       9.095  34.290  57.307  1.00 27.78           A  C
ATOM   2705  CG   LEU A 366       8.197  35.487  57.572  1.00 32.31           A  C
ATOM   2706  CD1  LEU A 366       8.652  36.660  56.838  1.00 31.84           A  C
ATOM   2707  CD2  LEU A 366       6.792  35.230  57.242  1.00 35.92           A  C
ATOM   2708  C    LEU A 366      11.509  33.769  57.559  1.00 28.24           A  C
ATOM   2709  O    LEU A 366      11.741  32.626  57.275  1.00 25.96           A  O
ATOM   2710  N    LEU A 367      12.138  34.407  58.521  1.00 26.49           A  N
ATOM   2711  CA   LEU A 367      13.021  33.733  59.425  1.00 26.10           A  C
ATOM   2712  CB   LEU A 367      12.320  32.568  60.074  1.00 24.88           A  C
ATOM   2713  CG   LEU A 367      11.163  32.880  60.979  1.00 26.89           A  C
ATOM   2714  CD1  LEU A 367      10.491  31.664  61.397  1.00 24.76           A  C
ATOM   2715  CD2  LEU A 367      11.619  33.669  62.107  1.00 24.64           A  C
ATOM   2716  C    LEU A 367      14.241  33.209  58.778  1.00 26.20           A  C
ATOM   2717  O    LEU A 367      14.791  32.300  59.272  1.00 25.90           A  O
ATOM   2718  N    PHE A 368      14.623  33.759  57.649  1.00 25.76           A  N
ATOM   2719  CA   PHE A 368      15.694  33.237  56.870  1.00 25.59           A  C
ATOM   2720  CB   PHE A 368      15.642  33.914  55.528  1.00 27.09           A  C
ATOM   2721  CG   PHE A 368      16.632  33.416  54.576  1.00 27.96           A  C
ATOM   2722  CD1  PHE A 368      16.340  32.371  53.763  1.00 31.68           A  C
ATOM   2723  CE1  PHE A 368      17.246  31.905  52.906  1.00 29.75           A  C
ATOM   2724  CZ   PHE A 368      18.450  32.496  52.850  1.00 30.81           A  C
ATOM   2725  CE2  PHE A 368      18.738  33.530  53.651  1.00 26.98           A  C
ATOM   2726  CD2  PHE A 368      17.854  33.986  54.489  1.00 24.47           A  C
ATOM   2727  C    PHE A 368      17.103  33.267  57.433  1.00 25.44           A  C
ATOM   2728  O    PHE A 368      17.720  32.271  57.463  1.00 25.02           A  O
ATOM   2729  N    ASP A 369      17.597  34.388  57.904  1.00 25.15           A  N
ATOM   2730  CA   ASP A 369      18.869  34.387  58.578  1.00 26.67           A  C
ATOM   2731  CB   ASP A 369      19.498  35.790  58.694  1.00 26.02           A  C
ATOM   2732  CG   ASP A 369      18.938  36.624  59.807  1.00 31.33           A  C
ATOM   2733  OD1  ASP A 369      19.479  36.655  60.897  1.00 27.29           A  O
ATOM   2734  OD2  ASP A 369      17.952  37.303  59.567  1.00 37.51           A  O-1
ATOM   2735  C    ASP A 369      18.891  33.590  59.875  1.00 27.21           A  C
ATOM   2736  O    ASP A 369      19.856  32.965  60.181  1.00 27.74           A  O
ATOM   2737  N    GLU A 370      17.811  33.638  60.626  1.00 26.58           A  N
ATOM   2738  CA   GLU A 370      17.695  32.909  61.845  1.00 25.80           A  C
ATOM   2739  CB   GLU A 370      16.304  33.126  62.428  1.00 25.71           A  C
ATOM   2740  CG   GLU A 370      15.957  34.475  62.849  1.00 26.05           A  C
ATOM   2741  CD   GLU A 370      15.341  35.295  61.795  1.00 27.49           A  C
ATOM   2742  OE1  GLU A 370      15.625  35.123  60.640  1.00 27.29           A  O
ATOM   2743  OE2  GLU A 370      14.615  36.182  62.121  1.00 30.37           A  O-1
ATOM   2744  C    GLU A 370      17.780  31.440  61.596  1.00 24.82           A  C
ATOM   2745  O    GLU A 370      18.496  30.783  62.235  1.00 25.03           A  O
ATOM   2746  N    LEU A 371      17.013  30.917  60.679  1.00 23.57           A  N
ATOM   2747  CA   LEU A 371      17.083  29.510  60.402  1.00 23.19           A  C
ATOM   2748  CB   LEU A 371      15.904  29.041  59.587  1.00 23.29           A  C
ATOM   2749  CG   LEU A 371      14.677  28.716  60.389  1.00 22.10           A  C
ATOM   2750  CD1  LEU A 371      13.571  28.446  59.520  1.00 23.84           A  C
ATOM   2751  CD2  LEU A 371      14.880  27.601  61.243  1.00 24.37           A  C
ATOM   2752  C    LEU A 371      18.381  29.002  59.828  1.00 23.22           A  C
ATOM   2753  O    LEU A 371      18.820  27.975  60.200  1.00 24.27           A  O
```

Appendix 1

```
ATOM   2754  N    LEU A 372      18.993  29.726  58.924  1.00 22.86      A    N
ATOM   2755  CA   LEU A 372      20.291  29.371  58.437  1.00 22.90      A    C
ATOM   2756  CB   LEU A 372      20.625  30.167  57.196  1.00 22.33      A    C
ATOM   2757  CG   LEU A 372      20.347  29.479  55.868  1.00 23.78      A    C
ATOM   2758  CD1  LEU A 372      18.931  29.251  55.600  1.00 21.35      A    C
ATOM   2759  CD2  LEU A 372      20.908  30.233  54.760  1.00 22.97      A    C
ATOM   2760  C    LEU A 372      21.403  29.418  59.471  1.00 23.27      A    C
ATOM   2761  O    LEU A 372      22.272  28.613  59.449  1.00 24.06      A    O
ATOM   2762  N    PHE A 373      21.357  30.379  60.365  1.00 23.25      A    N
ATOM   2763  CA   PHE A 373      22.266  30.443  61.485  1.00 23.74      A    C
ATOM   2764  CB   PHE A 373      22.120  31.782  62.225  1.00 22.83      A    C
ATOM   2765  CG   PHE A 373      22.546  31.769  63.653  1.00 21.09      A    C
ATOM   2766  CD1  PHE A 373      23.855  31.779  64.002  1.00 17.60      A    C
ATOM   2767  CE1  PHE A 373      24.217  31.773  65.265  1.00 18.01      A    C
ATOM   2768  CZ   PHE A 373      23.319  31.777  66.224  1.00 19.66      A    C
ATOM   2769  CE2  PHE A 373      22.031  31.781  65.927  1.00 19.81      A    C
ATOM   2770  CD2  PHE A 373      21.635  31.785  64.654  1.00 22.24      A    C
ATOM   2771  C    PHE A 373      22.055  29.261  62.393  1.00 25.13      A    C
ATOM   2772  O    PHE A 373      22.980  28.583  62.729  1.00 26.20      A    O
ATOM   2773  N    LEU A 374      20.824  28.955  62.716  1.00 24.25      A    N
ATOM   2774  CA   LEU A 374      20.578  27.804  63.527  1.00 24.59      A    C
ATOM   2775  CB   LEU A 374      19.118  27.714  63.935  1.00 23.98      A    C
ATOM   2776  CG   LEU A 374      18.620  26.497  64.687  1.00 23.83      A    C
ATOM   2777  CD1  LEU A 374      19.461  26.075  65.802  1.00 24.10      A    C
ATOM   2778  CD2  LEU A 374      17.276  26.659  65.135  1.00 22.12      A    C
ATOM   2779  C    LEU A 374      21.045  26.535  62.856  1.00 24.37      A    C
ATOM   2780  O    LEU A 374      21.574  25.710  63.502  1.00 23.44      A    O
ATOM   2781  N    ALA A 375      20.831  26.382  61.571  1.00 24.06      A    N
ATOM   2782  CA   ALA A 375      21.305  25.223  60.842  1.00 25.44      A    C
ATOM   2783  CB   ALA A 375      20.624  25.118  59.524  1.00 24.06      A    C
ATOM   2784  C    ALA A 375      22.815  25.067  60.703  1.00 25.84      A    C
ATOM   2785  O    ALA A 375      23.328  24.015  60.828  1.00 26.27      A    O
ATOM   2786  N    LYS A 376      23.525  26.140  60.475  1.00 26.12      A    N
ATOM   2787  CA   LYS A 376      24.951  26.071  60.392  1.00 27.36      A    C
ATOM   2788  CB   LYS A 376      25.513  27.369  59.846  1.00 26.50      A    C
ATOM   2789  CG   LYS A 376      25.235  27.532  58.424  1.00 26.16      A    C
ATOM   2790  CD   LYS A 376      25.554  28.881  57.934  1.00 28.10      A    C
ATOM   2791  CE   LYS A 376      25.073  29.084  56.533  1.00 28.34      A    C
ATOM   2792  NZ   LYS A 376      25.320  30.417  56.030  1.00 27.41      A    N
ATOM   2793  C    LYS A 376      25.659  25.626  61.670  1.00 28.38      A    C
ATOM   2794  O    LYS A 376      26.642  24.942  61.596  1.00 30.30      A    O
ATOM   2795  N    VAL A 377      25.157  26.018  62.826  1.00 26.80      A    N
ATOM   2796  CA   VAL A 377      25.759  25.677  64.083  1.00 26.77      A    C
ATOM   2797  CB   VAL A 377      25.920  26.908  64.992  1.00 26.59      A    C
ATOM   2798  CG1  VAL A 377      26.617  28.008  64.297  1.00 25.14      A    C
ATOM   2799  CG2  VAL A 377      24.643  27.374  65.513  1.00 26.59      A    C
ATOM   2800  C    VAL A 377      25.121  24.575  64.885  1.00 27.93      A    C
ATOM   2801  O    VAL A 377      25.623  24.229  65.891  1.00 29.83      A    O
ATOM   2802  N    HIS A 378      24.030  24.004  64.460  1.00 28.57      A    N
ATOM   2803  CA   HIS A 378      23.248  23.224  65.377  1.00 29.18      A    C
ATOM   2804  CB   HIS A 378      21.908  22.921  64.763  1.00 30.06      A    C
ATOM   2805  CG   HIS A 378      20.997  22.129  65.633  1.00 31.58      A    C
ATOM   2806  ND1  HIS A 378      20.562  22.579  66.848  1.00 33.09      A    N
ATOM   2807  CE1  HIS A 378      19.778  21.682  67.394  1.00 29.43      A    C
```

Appendix 1

```
ATOM   2808  NE2 HIS A 378      19.651  20.685  66.550  1.00 35.59      A    N
ATOM   2809  CD2 HIS A 378      20.415  20.931  65.447  1.00 30.58      A    C
ATOM   2810  C   HIS A 378      23.907  21.969  65.805  1.00 29.87      A    C
ATOM   2811  O   HIS A 378      24.284  21.180  65.015  1.00 30.94      A    O
ATOM   2812  N   ALA A 379      24.044  21.782  67.099  1.00 29.63      A    N
ATOM   2813  CA  ALA A 379      24.805  20.689  67.625  1.00 28.61      A    C
ATOM   2814  CB  ALA A 379      25.523  21.135  68.810  1.00 27.65      A    C
ATOM   2815  C   ALA A 379      24.019  19.448  67.950  1.00 28.82      A    C
ATOM   2816  O   ALA A 379      24.582  18.463  68.320  1.00 28.68      A    O
ATOM   2817  N   GLY A 380      22.719  19.518  67.819  1.00 28.14      A    N
ATOM   2818  CA  GLY A 380      21.829  18.496  68.284  1.00 28.06      A    C
ATOM   2819  C   GLY A 380      21.174  18.876  69.574  1.00 28.78      A    C
ATOM   2820  O   GLY A 380      21.800  19.321  70.460  1.00 29.50      A    O
ATOM   2821  N   PHE A 381      19.889  18.669  69.668  1.00 28.79      A    N
ATOM   2822  CA  PHE A 381      19.163  18.922  70.872  1.00 30.41      A    C
ATOM   2823  CB  PHE A 381      17.692  18.796  70.596  1.00 30.78      A    C
ATOM   2824  CG  PHE A 381      17.163  19.938  69.881  1.00 30.52      A    C
ATOM   2825  CD1 PHE A 381      17.343  21.176  70.382  1.00 24.91      A    C
ATOM   2826  CE1 PHE A 381      16.896  22.215  69.731  1.00 29.26      A    C
ATOM   2827  CZ  PHE A 381      16.295  22.068  68.559  1.00 31.03      A    C
ATOM   2828  CE2 PHE A 381      16.123  20.872  68.033  1.00 29.13      A    C
ATOM   2829  CD2 PHE A 381      16.551  19.803  68.679  1.00 31.35      A    C
ATOM   2830  C   PHE A 381      19.578  18.067  72.040  1.00 31.86      A    C
ATOM   2831  O   PHE A 381      19.671  18.529  73.133  1.00 33.45      A    O
ATOM   2832  N   GLY A 382      19.869  16.813  71.786  1.00 32.76      A    N
ATOM   2833  CA  GLY A 382      20.358  15.932  72.810  1.00 32.41      A    C
ATOM   2834  C   GLY A 382      21.658  16.411  73.372  1.00 32.85      A    C
ATOM   2835  O   GLY A 382      21.896  16.295  74.526  1.00 33.30      A    O
ATOM   2836  N   ALA A 383      22.506  16.951  72.534  1.00 32.49      A    N
ATOM   2837  CA  ALA A 383      23.725  17.605  72.954  1.00 32.52      A    C
ATOM   2838  CB  ALA A 383      24.531  17.921  71.785  1.00 31.49      A    C
ATOM   2839  C   ALA A 383      23.512  18.853  73.777  1.00 32.79      A    C
ATOM   2840  O   ALA A 383      24.252  19.159  74.644  1.00 33.76      A    O
ATOM   2841  N   LEU A 384      22.518  19.615  73.421  1.00 33.08      A    N
ATOM   2842  CA  LEU A 384      22.206  20.815  74.114  1.00 31.82      A    C
ATOM   2843  CB  LEU A 384      21.108  21.552  73.408  1.00 30.57      A    C
ATOM   2844  CG  LEU A 384      21.398  22.794  72.607  1.00 28.81      A    C
ATOM   2845  CD1 LEU A 384      22.762  22.930  72.197  1.00 26.01      A    C
ATOM   2846  CD2 LEU A 384      20.500  22.865  71.478  1.00 26.85      A    C
ATOM   2847  C   LEU A 384      21.797  20.420  75.488  1.00 32.66      A    C
ATOM   2848  O   LEU A 384      22.095  21.093  76.429  1.00 33.26      A    O
ATOM   2849  N   LEU A 385      21.121  19.297  75.581  1.00 32.07      A    N
ATOM   2850  CA  LEU A 385      20.654  18.735  76.819  1.00 32.81      A    C
ATOM   2851  CB  LEU A 385      19.909  17.488  76.530  1.00 32.47      A    C
ATOM   2852  CG  LEU A 385      18.467  17.452  76.910  1.00 34.98      A    C
ATOM   2853  CD1 LEU A 385      17.842  18.649  76.447  1.00 36.97      A    C
ATOM   2854  CD2 LEU A 385      17.847  16.295  76.256  1.00 34.92      A    C
ATOM   2855  C   LEU A 385      21.750  18.370  77.766  1.00 34.31      A    C
ATOM   2856  O   LEU A 385      21.578  18.425  78.932  1.00 34.27      A    O
ATOM   2857  N   ARG A 386      22.875  17.950  77.230  1.00 35.99      A    N
ATOM   2858  CA  ARG A 386      23.952  17.339  77.971  1.00 37.74      A    C
ATOM   2859  CB  ARG A 386      24.413  16.071  77.275  1.00 37.63      A    C
ATOM   2860  CG  ARG A 386      23.404  14.995  77.328  1.00 40.07      A    C
ATOM   2861  CD  ARG A 386      23.888  13.691  76.838  1.00 44.63      A    C
```

Appendix 1

```
ATOM   2862  NE   ARG A 386      24.214  13.717  75.432  1.00 52.88      A    N
ATOM   2863  CZ   ARG A 386      23.385  13.354  74.471  1.00 55.59      A    C
ATOM   2864  NH1  ARG A 386      22.174  12.936  74.782  1.00 54.16      A    N
ATOM   2865  NH2  ARG A 386      23.771  13.409  73.209  1.00 51.55      A    N
ATOM   2866  C    ARG A 386      25.105  18.265  78.102  1.00 38.35      A    C
ATOM   2867  O    ARG A 386      26.192  17.854  78.310  1.00 39.02      A    O
ATOM   2868  N    MET A 387      24.858  19.535  77.972  1.00 38.96      A    N
ATOM   2869  CA   MET A 387      25.898  20.504  77.926  1.00 40.85      A    C
ATOM   2870  CB   MET A 387      25.258  21.831  77.562  1.00 40.11      A    C
ATOM   2871  CG   MET A 387      25.994  23.041  77.915  1.00 38.05      A    C
ATOM   2872  SD   MET A 387      25.108  24.376  77.263  1.00 41.11      A    S
ATOM   2873  CE   MET A 387      26.358  25.181  76.398  1.00 39.35      A    C
ATOM   2874  C    MET A 387      26.671  20.603  79.216  1.00 42.46      A    C
ATOM   2875  O    MET A 387      26.115  20.702  80.263  1.00 43.17      A    O
ATOM   2876  N    PRO A 388      27.976  20.528  79.117  1.00 44.13      A    N
ATOM   2877  CA   PRO A 388      28.879  20.726  80.233  1.00 45.36      A    C
ATOM   2878  CB   PRO A 388      30.228  20.831  79.544  1.00 45.94      A    C
ATOM   2879  CG   PRO A 388      29.950  20.791  78.113  1.00 47.18      A    C
ATOM   2880  CD   PRO A 388      28.713  20.072  77.953  1.00 44.23      A    C
ATOM   2881  C    PRO A 388      28.613  21.987  80.979  1.00 45.96      A    C
ATOM   2882  O    PRO A 388      28.212  22.935  80.401  1.00 46.10      A    O
ATOM   2883  N    PRO A 389      28.953  22.020  82.241  1.00 47.30      A    N
ATOM   2884  CA   PRO A 389      28.389  22.925  83.218  1.00 47.82      A    C
ATOM   2885  CB   PRO A 389      28.655  22.181  84.495  1.00 48.21      A    C
ATOM   2886  CG   PRO A 389      28.402  20.863  84.110  1.00 47.82      A    C
ATOM   2887  CD   PRO A 389      29.036  20.684  82.799  1.00 47.74      A    C
ATOM   2888  C    PRO A 389      28.855  24.360  83.346  1.00 48.19      A    C
ATOM   2889  O    PRO A 389      28.008  25.183  83.598  1.00 48.29      A    O
ATOM   2890  N    PRO A 390      30.111  24.691  83.218  1.00 48.27      A    N
ATOM   2891  CA   PRO A 390      30.423  26.093  83.424  1.00 49.20      A    C
ATOM   2892  CB   PRO A 390      31.691  26.309  82.627  1.00 49.12      A    C
ATOM   2893  CG   PRO A 390      31.979  25.066  81.964  1.00 50.63      A    C
ATOM   2894  CD   PRO A 390      30.851  24.143  82.093  1.00 49.34      A    C
ATOM   2895  C    PRO A 390      29.303  26.936  82.868  1.00 49.27      A    C
ATOM   2896  O    PRO A 390      28.500  27.422  83.639  1.00 48.81      A    O
ATOM   2897  N    LEU B  29       5.421  75.638  25.644  1.00 73.04      A    N
ATOM   2898  CA   LEU B  29       5.836  76.818  26.374  1.00 73.59      A    C
ATOM   2899  CB   LEU B  29       5.523  76.660  27.855  1.00 74.20      A    C
ATOM   2900  CG   LEU B  29       6.260  75.607  28.658  1.00 75.66      A    C
ATOM   2901  CD1  LEU B  29       7.593  76.129  29.140  1.00 76.28      A    C
ATOM   2902  CD2  LEU B  29       5.399  75.223  29.805  1.00 77.26      A    C
ATOM   2903  C    LEU B  29       7.303  77.128  26.193  1.00 72.85      A    C
ATOM   2904  O    LEU B  29       8.060  76.294  25.715  1.00 73.02      A    O
ATOM   2905  N    PRO B  30       7.673  78.343  26.587  1.00 71.70      A    N
ATOM   2906  CA   PRO B  30       9.033  78.829  26.513  1.00 70.22      A    C
ATOM   2907  CB   PRO B  30       8.942  79.834  25.377  1.00 70.95      A    C
ATOM   2908  CG   PRO B  30       7.651  80.383  25.500  1.00 70.52      A    C
ATOM   2909  CD   PRO B  30       6.763  79.269  25.909  1.00 71.81      A    C
ATOM   2910  C    PRO B  30       9.354  79.534  27.803  1.00 68.35      A    C
ATOM   2911  O    PRO B  30       8.461  80.010  28.464  1.00 68.07      A    O
ATOM   2912  N    PRO B  31      10.628  79.766  28.073  1.00 66.58      A    N
ATOM   2913  CA   PRO B  31      11.105  80.265  29.363  1.00 65.25      A    C
ATOM   2914  CB   PRO B  31      12.075  79.191  29.799  1.00 65.44      A    C
ATOM   2915  CG   PRO B  31      12.187  78.254  28.648  1.00 65.76      A    C
```

Appendix 1

```
ATOM   2916  CD   PRO B  31      10.963  78.363  27.884  1.00 66.06      A    C
ATOM   2917  C    PRO B  31      11.811  81.609  29.384  1.00 64.08      A    C
ATOM   2918  O    PRO B  31      12.743  81.756  30.136  1.00 63.81      A    O
ATOM   2919  N    GLY B  32      11.391  82.584  28.605  1.00 63.27      A    N
ATOM   2920  CA   GLY B  32      12.225  83.752  28.360  1.00 62.04      A    C
ATOM   2921  C    GLY B  32      12.884  83.701  26.994  1.00 60.39      A    C
ATOM   2922  O    GLY B  32      13.619  84.575  26.595  1.00 60.44      A    O
ATOM   2923  N    ARG B  33      12.558  82.651  26.273  1.00 58.10      A    N
ATOM   2924  CA   ARG B  33      12.792  82.534  24.871  1.00 54.57      A    C
ATOM   2925  CB   ARG B  33      12.801  81.074  24.531  1.00 53.54      A    C
ATOM   2926  CG   ARG B  33      13.960  80.383  25.086  1.00 51.01      A    C
ATOM   2927  CD   ARG B  33      14.891  80.115  24.002  1.00 44.64      A    C
ATOM   2928  NE   ARG B  33      14.162  79.547  22.915  1.00 40.03      A    N
ATOM   2929  CZ   ARG B  33      14.115  78.260  22.699  1.00 42.14      A    C
ATOM   2930  NH1  ARG B  33      14.774  77.454  23.482  1.00 39.69      A    N
ATOM   2931  NH2  ARG B  33      13.429  77.796  21.702  1.00 40.83      A    N
ATOM   2932  C    ARG B  33      11.720  83.228  24.079  1.00 53.56      A    C
ATOM   2933  O    ARG B  33      10.624  83.342  24.516  1.00 54.42      A    O
ATOM   2934  N    LEU B  34      12.055  83.719  22.911  1.00 52.22      A    N
ATOM   2935  CA   LEU B  34      11.095  84.254  21.971  1.00 51.12      A    C
ATOM   2936  CB   LEU B  34      11.823  84.944  20.831  1.00 50.50      A    C
ATOM   2937  CG   LEU B  34      12.068  86.440  20.868  1.00 48.67      A    C
ATOM   2938  CD1  LEU B  34      11.878  86.938  22.222  1.00 46.48      A    C
ATOM   2939  CD2  LEU B  34      13.435  86.743  20.389  1.00 47.59      A    C
ATOM   2940  C    LEU B  34      10.151  83.207  21.412  1.00 50.74      A    C
ATOM   2941  O    LEU B  34       8.996  83.453  21.194  1.00 50.78      A    O
ATOM   2942  N    ALA B  35      10.678  82.039  21.133  1.00 49.74      A    N
ATOM   2943  CA   ALA B  35       9.875  80.997  20.586  1.00 49.34      A    C
ATOM   2944  CB   ALA B  35       9.717  81.172  19.110  1.00 48.34      A    C
ATOM   2945  C    ALA B  35      10.407  79.629  20.928  1.00 49.11      A    C
ATOM   2946  O    ALA B  35      11.534  79.459  21.293  1.00 49.79      A    O
ATOM   2947  N    THR B  36       9.532  78.664  20.819  1.00 48.18      A    N
ATOM   2948  CA   THR B  36       9.785  77.315  21.201  1.00 47.37      A    C
ATOM   2949  CB   THR B  36       8.438  76.654  21.514  1.00 47.41      A    C
ATOM   2950  OG1  THR B  36       8.353  75.386  20.895  1.00 50.00      A    O
ATOM   2951  CG2  THR B  36       7.376  77.471  20.969  1.00 48.32      A    C
ATOM   2952  C    THR B  36      10.599  76.629  20.131  1.00 45.77      A    C
ATOM   2953  O    THR B  36      10.535  77.009  19.020  1.00 44.91      A    O
ATOM   2954  N    THR B  37      11.368  75.625  20.484  1.00 45.41      A    N
ATOM   2955  CA   THR B  37      12.196  74.909  19.562  1.00 45.75      A    C
ATOM   2956  CB   THR B  37      12.991  73.866  20.297  1.00 45.11      A    C
ATOM   2957  OG1  THR B  37      14.007  74.502  21.028  1.00 46.46      A    O
ATOM   2958  CG2  THR B  37      13.634  72.957  19.379  1.00 45.56      A    C
ATOM   2959  C    THR B  37      11.384  74.217  18.515  1.00 47.61      A    C
ATOM   2960  O    THR B  37      11.726  74.213  17.384  1.00 49.17      A    O
ATOM   2961  N    GLU B  38      10.287  73.619  18.900  1.00 49.68      B    N
ATOM   2962  CA   GLU B  38       9.425  72.968  17.953  1.00 51.02      B    C
ATOM   2963  CB   GLU B  38       8.275  72.229  18.641  1.00 51.52      B    C
ATOM   2964  CG   GLU B  38       6.954  72.858  18.441  1.00 56.56      B    C
ATOM   2965  CD   GLU B  38       5.815  71.911  18.572  1.00 64.92      B    C
ATOM   2966  OE1  GLU B  38       6.014  70.683  18.663  1.00 64.53      B    O
ATOM   2967  OE2  GLU B  38       4.687  72.409  18.577  1.00 65.87      B    O
ATOM   2968  C    GLU B  38       8.923  74.014  17.016  1.00 49.47      B    C
ATOM   2969  O    GLU B  38       8.792  73.779  15.855  1.00 49.61      B    O
```

Appendix 1

```
ATOM   2970  N    ASP B  39       8.675  75.191  17.534  1.00 48.42      B    N
ATOM   2971  CA   ASP B  39       8.232  76.270  16.698  1.00 48.08      B    C
ATOM   2972  CB   ASP B  39       7.720  77.426  17.549  1.00 48.60      B    C
ATOM   2973  CG   ASP B  39       6.223  77.508  17.570  1.00 50.94      B    C
ATOM   2974  OD1  ASP B  39       5.560  76.724  16.909  1.00 52.69      B    O
ATOM   2975  OD2  ASP B  39       5.679  78.368  18.236  1.00 56.08      B    O
ATOM   2976  C    ASP B  39       9.239  76.707  15.627  1.00 47.28      B    C
ATOM   2977  O    ASP B  39       8.817  76.979  14.526  1.00 48.07      B    O
ATOM   2978  N    TYR B  40      10.540  76.793  15.942  1.00 44.58      A    N
ATOM   2979  CA   TYR B  40      11.599  77.014  14.932  1.00 42.18      A    C
ATOM   2980  CB   TYR B  40      12.979  77.338  15.534  1.00 41.17      A    C
ATOM   2981  CG   TYR B  40      13.073  78.594  16.355  1.00 35.07      A    C
ATOM   2982  CD1  TYR B  40      12.887  79.821  15.801  1.00 33.26      A    C
ATOM   2983  CE1  TYR B  40      12.938  80.911  16.536  1.00 32.67      A    C
ATOM   2984  CZ   TYR B  40      13.210  80.805  17.851  1.00 33.32      A    C
ATOM   2985  OH   TYR B  40      13.266  81.919  18.605  1.00 34.48      A    O
ATOM   2986  CE2  TYR B  40      13.404  79.619  18.420  1.00 29.59      A    C
ATOM   2987  CD2  TYR B  40      13.344  78.535  17.687  1.00 30.35      A    C
ATOM   2988  C    TYR B  40      11.774  75.870  13.975  1.00 42.98      A    C
ATOM   2989  O    TYR B  40      11.902  76.059  12.807  1.00 42.88      A    O
ATOM   2990  N    PHE B  41      11.797  74.666  14.499  1.00 43.14      A    N
ATOM   2991  CA   PHE B  41      12.055  73.485  13.702  1.00 44.39      A    C
ATOM   2992  CB   PHE B  41      12.295  72.281  14.594  1.00 44.60      A    C
ATOM   2993  CG   PHE B  41      13.718  72.063  14.970  1.00 44.45      A    C
ATOM   2994  CD1  PHE B  41      14.429  71.047  14.435  1.00 43.23      A    C
ATOM   2995  CE1  PHE B  41      15.705  70.850  14.785  1.00 41.94      A    C
ATOM   2996  CZ   PHE B  41      16.284  71.644  15.655  1.00 39.29      A    C
ATOM   2997  CE2  PHE B  41      15.602  72.640  16.205  1.00 42.18      A    C
ATOM   2998  CD2  PHE B  41      14.331  72.850  15.882  1.00 43.71      A    C
ATOM   2999  C    PHE B  41      10.928  73.204  12.711  1.00 44.67      A    C
ATOM   3000  O    PHE B  41      11.074  72.442  11.792  1.00 43.59      A    O
ATOM   3001  N    ALA B  42       9.791  73.831  12.922  1.00 45.40      A    N
ATOM   3002  CA   ALA B  42       8.625  73.592  12.097  1.00 45.87      A    C
ATOM   3003  CB   ALA B  42       7.408  73.616  12.943  1.00 45.00      A    C
ATOM   3004  C    ALA B  42       8.441  74.548  10.967  1.00 45.84      A    C
ATOM   3005  O    ALA B  42       7.527  74.413  10.226  1.00 46.93      A    O
ATOM   3006  N    GLN B  43       9.297  75.538  10.854  1.00 46.11      A    N
ATOM   3007  CA   GLN B  43       9.072  76.644   9.961  1.00 45.43      A    C
ATOM   3008  CB   GLN B  43      10.197  77.673  10.109  1.00 45.23      A    C
ATOM   3009  CG   GLN B  43      10.015  78.709  11.182  1.00 43.57      A    C
ATOM   3010  CD   GLN B  43      11.223  79.590  11.393  1.00 42.49      A    C
ATOM   3011  OE1  GLN B  43      12.285  79.126  11.714  1.00 39.32      A    O
ATOM   3012  NE2  GLN B  43      11.041  80.866  11.255  1.00 39.24      A    N
ATOM   3013  C    GLN B  43       8.984  76.192   8.525  1.00 45.53      A    C
ATOM   3014  O    GLN B  43       8.197  76.686   7.782  1.00 45.45      A    O
ATOM   3015  N    GLN B  44       9.828  75.277   8.123  1.00 45.98      A    N
ATOM   3016  CA   GLN B  44       9.815  74.843   6.754  1.00 47.76      A    C
ATOM   3017  CB   GLN B  44      10.994  73.933   6.490  1.00 48.03      A    C
ATOM   3018  CG   GLN B  44      11.334  73.825   5.076  1.00 48.71      A    C
ATOM   3019  CD   GLN B  44      12.456  72.902   4.826  1.00 52.49      A    C
ATOM   3020  OE1  GLN B  44      13.231  72.593   5.718  1.00 51.71      A    O
ATOM   3021  NE2  GLN B  44      12.579  72.469   3.591  1.00 49.75      A    N
ATOM   3022  C    GLN B  44       8.528  74.147   6.368  1.00 48.50      A    C
ATOM   3023  O    GLN B  44       7.970  74.416   5.336  1.00 48.28      A    O
```

Appendix 1

```
ATOM   3024  N    ALA B   45       8.063  73.236   7.200  1.00 48.41      A   N
ATOM   3025  CA   ALA B   45       6.797  72.574   6.967  1.00 48.51      A   C
ATOM   3026  CB   ALA B   45       6.601  71.483   7.931  1.00 47.16      A   C
ATOM   3027  C    ALA B   45       5.624  73.537   6.994  1.00 48.97      A   C
ATOM   3028  O    ALA B   45       4.692  73.372   6.261  1.00 49.19      A   O
ATOM   3029  N    LYS B   46       5.676  74.526   7.869  1.00 48.61      A   N
ATOM   3030  CA   LYS B   46       4.715  75.606   7.888  1.00 49.25      A   C
ATOM   3031  CB   LYS B   46       4.782  76.366   9.197  1.00 49.16      A   C
ATOM   3032  CG   LYS B   46       4.123  75.670  10.326  1.00 49.61      A   C
ATOM   3033  CD   LYS B   46       3.837  76.564  11.484  1.00 46.90      A   C
ATOM   3034  CE   LYS B   46       3.583  75.736  12.700  1.00 48.58      A   C
ATOM   3035  NZ   LYS B   46       3.826  76.407  13.981  1.00 51.43      A   N
ATOM   3036  C    LYS B   46       4.896  76.578   6.729  1.00 50.07      A   C
ATOM   3037  O    LYS B   46       4.041  77.381   6.419  1.00 49.96      A   O
ATOM   3038  N    GLN B   47       6.049  76.529   6.106  1.00 50.15      A   N
ATOM   3039  CA   GLN B   47       6.304  77.400   5.006  1.00 49.65      A   C
ATOM   3040  CB   GLN B   47       5.355  77.072   3.886  1.00 49.24      A   C
ATOM   3041  CG   GLN B   47       5.973  77.190   2.555  1.00 52.73      A   C
ATOM   3042  CD   GLN B   47       5.874  75.954   1.758  1.00 57.87      A   C
ATOM   3043  OE1  GLN B   47       5.864  74.866   2.294  1.00 61.50      A   O
ATOM   3044  NE2  GLN B   47       5.790  76.102   0.461  1.00 56.18      A   N
ATOM   3045  C    GLN B   47       6.179  78.855   5.374  1.00 48.73      A   C
ATOM   3046  O    GLN B   47       5.717  79.626   4.589  1.00 48.78      A   O
ATOM   3047  N    ALA B   48       6.579  79.213   6.582  1.00 48.19      A   N
ATOM   3048  CA   ALA B   48       6.729  80.596   6.984  1.00 46.87      A   C
ATOM   3049  CB   ALA B   48       5.446  81.145   7.340  1.00 47.60      A   C
ATOM   3050  C    ALA B   48       7.677  80.741   8.147  1.00 46.95      A   C
ATOM   3051  O    ALA B   48       7.839  79.839   8.905  1.00 47.89      A   O
ATOM   3052  N    VAL B   49       8.284  81.894   8.311  1.00 45.50      A   N
ATOM   3053  CA   VAL B   49       9.100  82.113   9.483  1.00 44.58      A   C
ATOM   3054  CB   VAL B   49      10.276  82.996   9.193  1.00 44.17      A   C
ATOM   3055  CG1  VAL B   49      10.968  82.533   7.988  1.00 42.02      A   C
ATOM   3056  CG2  VAL B   49       9.852  84.414   9.055  1.00 44.08      A   C
ATOM   3057  C    VAL B   49       8.345  82.642  10.681  1.00 45.18      A   C
ATOM   3058  O    VAL B   49       7.302  83.231  10.550  1.00 45.75      A   O
ATOM   3059  N    THR B   50       8.914  82.424  11.848  1.00 45.19      A   N
ATOM   3060  CA   THR B   50       8.344  82.869  13.091  1.00 45.09      A   C
ATOM   3061  CB   THR B   50       9.104  82.298  14.314  1.00 45.34      A   C
ATOM   3062  OG1  THR B   50      10.372  82.910  14.416  1.00 45.64      A   O
ATOM   3063  CG2  THR B   50       9.313  80.855  14.209  1.00 42.89      A   C
ATOM   3064  C    THR B   50       8.454  84.362  13.112  1.00 45.07      A   C
ATOM   3065  O    THR B   50       9.280  84.891  12.460  1.00 45.56      A   O
ATOM   3066  N    PRO B   51       7.621  85.034  13.879  1.00 44.66      A   N
ATOM   3067  CA   PRO B   51       7.609  86.483  13.922  1.00 44.12      A   C
ATOM   3068  CB   PRO B   51       6.520  86.764  14.928  1.00 43.58      A   C
ATOM   3069  CG   PRO B   51       5.668  85.734  14.778  1.00 43.22      A   C
ATOM   3070  CD   PRO B   51       6.431  84.517  14.533  1.00 44.60      A   C
ATOM   3071  C    PRO B   51       8.920  86.979  14.438  1.00 43.73      A   C
ATOM   3072  O    PRO B   51       9.297  88.084  14.222  1.00 44.19      A   O
ATOM   3073  N    ASP B   52       9.608  86.098  15.121  1.00 42.49      A   N
ATOM   3074  CA   ASP B   52      10.930  86.288  15.617  1.00 41.49      A   C
ATOM   3075  CB   ASP B   52      11.261  84.876  16.024  1.00 42.76      A   C
ATOM   3076  CG   ASP B   52      11.961  84.823  17.222  1.00 45.15      A   C
ATOM   3077  OD1  ASP B   52      11.895  85.855  17.849  1.00 50.43      A   O
```

Appendix 1

```
ATOM   3078  OD2 ASP B  52      12.555  83.801  17.544  1.00 44.34      A    O-1
ATOM   3079  C   ASP B  52      11.984  86.540  14.569  1.00 39.66      A    C
ATOM   3080  O   ASP B  52      12.723  87.470  14.604  1.00 36.70      A    O
ATOM   3081  N   VAL B  53      12.030  85.621  13.649  1.00 38.52      A    N
ATOM   3082  CA  VAL B  53      12.899  85.642  12.529  1.00 37.62      A    C
ATOM   3083  CB  VAL B  53      12.735  84.388  11.810  1.00 36.70      A    C
ATOM   3084  CG1 VAL B  53      13.253  84.507  10.481  1.00 37.29      A    C
ATOM   3085  CG2 VAL B  53      13.390  83.338  12.559  1.00 34.82      A    C
ATOM   3086  C   VAL B  53      12.589  86.779  11.633  1.00 37.51      A    C
ATOM   3087  O   VAL B  53      13.457  87.405  11.125  1.00 39.52      A    O
ATOM   3088  N   MET B  54      11.316  87.033  11.457  1.00 36.45      A    N
ATOM   3089  CA  MET B  54      10.850  88.119  10.665  1.00 34.44      A    C
ATOM   3090  CB  MET B  54       9.343  88.063  10.556  1.00 34.66      B    C
ATOM   3091  CG  MET B  54       8.762  89.059   9.650  1.00 35.80      B    C
ATOM   3092  SD  MET B  54       9.139  88.755   7.976  1.00 42.44      B    S
ATOM   3093  CE  MET B  54       8.369  90.099   7.229  1.00 42.39      B    C
ATOM   3094  C   MET B  54      11.299  89.422  11.260  1.00 33.79      A    C
ATOM   3095  O   MET B  54      11.564  90.350  10.553  1.00 32.78      A    O
ATOM   3096  N   ALA B  55      11.350  89.496  12.574  1.00 32.32      A    N
ATOM   3097  CA  ALA B  55      11.869  90.651  13.242  1.00 33.03      A    C
ATOM   3098  CB  ALA B  55      11.543  90.621  14.679  1.00 34.02      A    C
ATOM   3099  C   ALA B  55      13.345  90.846  13.030  1.00 34.10      A    C
ATOM   3100  O   ALA B  55      13.817  91.945  12.931  1.00 35.41      A    O
ATOM   3101  N   GLN B  56      14.083  89.762  13.010  1.00 33.82      A    N
ATOM   3102  CA  GLN B  56      15.485  89.825  12.739  1.00 34.08      A    C
ATOM   3103  CB  GLN B  56      16.152  88.479  13.020  1.00 35.58      A    C
ATOM   3104  CG  GLN B  56      17.477  88.221  12.373  1.00 36.05      A    C
ATOM   3105  CD  GLN B  56      18.608  88.967  12.986  1.00 39.56      A    C
ATOM   3106  OE1 GLN B  56      18.471  89.571  14.011  1.00 40.16      A    O
ATOM   3107  NE2 GLN B  56      19.733  88.938  12.343  1.00 38.54      A    N
ATOM   3108  C   GLN B  56      15.711  90.311  11.341  1.00 33.43      A    C
ATOM   3109  O   GLN B  56      16.530  91.136  11.122  1.00 33.53      A    O
ATOM   3110  N   LEU B  57      14.920  89.839  10.408  1.00 32.37      A    N
ATOM   3111  CA  LEU B  57      15.023  90.255   9.028  1.00 32.68      A    C
ATOM   3112  CB  LEU B  57      14.009  89.508   8.168  1.00 33.12      A    C
ATOM   3113  CG  LEU B  57      14.301  88.349   7.216  1.00 36.89      A    C
ATOM   3114  CD1 LEU B  57      15.740  88.039   7.047  1.00 35.43      A    C
ATOM   3115  CD2 LEU B  57      13.538  87.101   7.518  1.00 33.57      A    C
ATOM   3116  C   LEU B  57      14.781  91.740   8.942  1.00 32.14      A    C
ATOM   3117  O   LEU B  57      15.295  92.404   8.092  1.00 31.52      A    O
ATOM   3118  N   ALA B  58      13.955  92.237   9.827  1.00 32.29      A    N
ATOM   3119  CA  ALA B  58      13.688  93.657   9.959  1.00 33.47      A    C
ATOM   3120  CB  ALA B  58      12.489  93.886  10.783  1.00 33.07      A    C
ATOM   3121  C   ALA B  58      14.846  94.518  10.427  1.00 33.23      A    C
ATOM   3122  O   ALA B  58      15.024  95.587   9.948  1.00 32.41      A    O
ATOM   3123  N   TYR B  59      15.616  94.026  11.373  1.00 33.55      A    N
ATOM   3124  CA  TYR B  59      16.851  94.637  11.765  1.00 33.46      A    C
ATOM   3125  CB  TYR B  59      17.485  93.889  12.921  1.00 34.10      A    C
ATOM   3126  CG  TYR B  59      18.949  94.147  13.001  1.00 33.76      A    C
ATOM   3127  CD1 TYR B  59      19.423  95.334  13.480  1.00 36.17      A    C
ATOM   3128  CE1 TYR B  59      20.743  95.579  13.527  1.00 36.16      A    C
ATOM   3129  CZ  TYR B  59      21.615  94.646  13.092  1.00 35.35      A    C
ATOM   3130  OH  TYR B  59      22.938  94.885  13.146  1.00 36.06      A    O
ATOM   3131  CE2 TYR B  59      21.171  93.472  12.627  1.00 35.54      A    C
```

Appendix I

```
ATOM   3132  CD2 TYR B  59      19.848  93.225  12.579  1.00 33.27     A    C
ATOM   3133  C   TYR B  59      17.816  94.627  10.610  1.00 33.73     A    C
ATOM   3134  O   TYR B  59      18.560  95.536  10.404  1.00 34.07     A    O
ATOM   3135  N   MET B  60      17.821  93.551   9.872  1.00 32.93     A    N
ATOM   3136  CA  MET B  60      18.625  93.488   8.720  1.00 33.48     A    C
ATOM   3137  CB  MET B  60      18.644  92.063   8.238  1.00 33.64     B    C
ATOM   3138  CG  MET B  60      19.150  91.141   9.298  1.00 32.18     B    C
ATOM   3139  SD  MET B  60      19.109  89.421   8.957  1.00 33.18     B    S
ATOM   3140  CE  MET B  60      19.908  89.358   7.445  1.00 31.47     B    C
ATOM   3141  C   MET B  60      18.194  94.491   7.666  1.00 35.15     A    C
ATOM   3142  O   MET B  60      19.000  95.074   7.017  1.00 35.53     A    O
ATOM   3143  N   ASN B  61      16.906  94.704   7.499  1.00 35.85     A    N
ATOM   3144  CA  ASN B  61      16.449  95.450   6.363  1.00 36.03     A    C
ATOM   3145  CB  ASN B  61      15.470  94.595   5.570  1.00 35.71     A    C
ATOM   3146  CG  ASN B  61      16.127  93.441   4.903  1.00 37.24     A    C
ATOM   3147  OD1 ASN B  61      16.751  93.592   3.886  1.00 37.04     A    O
ATOM   3148  ND2 ASN B  61      16.004  92.281   5.486  1.00 34.44     A    N
ATOM   3149  C   ASN B  61      15.848  96.804   6.527  1.00 36.04     A    C
ATOM   3150  O   ASN B  61      15.855  97.546   5.605  1.00 35.99     A    O
ATOM   3151  N   TYR B  62      15.213  97.072   7.645  1.00 36.10     A    N
ATOM   3152  CA  TYR B  62      14.299  98.206   7.719  1.00 36.89     A    C
ATOM   3153  CB  TYR B  62      13.312  97.962   8.869  1.00 36.22     A    C
ATOM   3154  CG  TYR B  62      12.055  98.766   8.839  1.00 35.38     A    C
ATOM   3155  CD1 TYR B  62      10.826  98.165   8.777  1.00 35.09     A    C
ATOM   3156  CE1 TYR B  62       9.713  98.885   8.748  1.00 36.24     A    C
ATOM   3157  CZ  TYR B  62       9.799 100.226   8.791  1.00 42.82     A    C
ATOM   3158  OH  TYR B  62       8.702 101.004   8.771  1.00 42.84     A    O
ATOM   3159  CE2 TYR B  62      10.998 100.834   8.865  1.00 41.30     A    C
ATOM   3160  CD2 TYR B  62      12.099 100.113   8.895  1.00 35.63     A    C
ATOM   3161  C   TYR B  62      14.798  99.657   7.736  1.00 37.06     A    C
ATOM   3162  O   TYR B  62      14.390 100.445   6.939  1.00 36.80     A    O
ATOM   3163  N   ILE B  63      15.658 100.028   8.661  1.00 38.42     A    N
ATOM   3164  CA  ILE B  63      16.085 101.406   8.785  1.00 38.92     A    C
ATOM   3165  CB  ILE B  63      16.759 101.688  10.110  1.00 38.52     A    C
ATOM   3166  CG1 ILE B  63      15.877 101.255  11.244  1.00 39.96     A    C
ATOM   3167  CD1 ILE B  63      16.591 101.212  12.513  1.00 40.22     A    C
ATOM   3168  CG2 ILE B  63      17.014 103.130  10.291  1.00 36.74     A    C
ATOM   3169  C   ILE B  63      16.977 101.855   7.680  1.00 39.80     A    C
ATOM   3170  O   ILE B  63      17.714 101.113   7.164  1.00 39.26     A    O
ATOM   3171  N   ASP B  64      16.892 103.118   7.345  1.00 42.29     A    N
ATOM   3172  CA  ASP B  64      17.390 103.623   6.103  1.00 43.76     A    C
ATOM   3173  CB  ASP B  64      16.907 105.030   5.890  1.00 44.50     A    C
ATOM   3174  CG  ASP B  64      15.870 105.125   4.839  1.00 48.54     A    C
ATOM   3175  OD1 ASP B  64      15.455 106.227   4.537  1.00 52.40     A    O
ATOM   3176  OD2 ASP B  64      15.467 104.112   4.307  1.00 53.25     A    O
ATOM   3177  C   ASP B  64      18.868 103.551   5.796  1.00 44.55     A    C
ATOM   3178  O   ASP B  64      19.213 103.207   4.682  1.00 46.83     A    O
ATOM   3179  N   PHE B  65      19.763 103.874   6.704  1.00 43.19     A    N
ATOM   3180  CA  PHE B  65      21.168 103.727   6.332  1.00 42.13     A    C
ATOM   3181  CB  PHE B  65      21.860 105.067   6.314  1.00 41.45     A    C
ATOM   3182  CG  PHE B  65      21.108 106.118   5.596  1.00 43.28     A    C
ATOM   3183  CD1 PHE B  65      21.047 106.137   4.236  1.00 44.87     A    C
ATOM   3184  CE1 PHE B  65      20.371 107.086   3.599  1.00 42.63     A    C
ATOM   3185  CZ  PHE B  65      19.759 108.025   4.287  1.00 43.74     A    C
```

Appendix 1

```
ATOM   3186  CE2 PHE B  65      19.807 108.030   5.622  1.00 42.83     A  C
ATOM   3187  CD2 PHE B  65      20.461 107.088   6.276  1.00 41.17     A  C
ATOM   3188  C   PHE B  65      21.960 102.773   7.171  1.00 40.92     A  C
ATOM   3189  O   PHE B  65      23.006 102.349   6.811  1.00 42.15     A  O
ATOM   3190  N   ILE B  66      21.445 102.461   8.320  1.00 39.13     A  N
ATOM   3191  CA  ILE B  66      22.203 101.780   9.313  1.00 37.20     A  C
ATOM   3192  CB  ILE B  66      21.996 102.501  10.619  1.00 38.23     A  C
ATOM   3193  CG1 ILE B  66      20.562 102.330  11.064  1.00 35.96     A  C
ATOM   3194  CD1 ILE B  66      20.239 103.055  12.196  1.00 32.04     A  C
ATOM   3195  CG2 ILE B  66      22.223 103.915  10.425  1.00 33.33     A  C
ATOM   3196  C   ILE B  66      21.906 100.299   9.457  1.00 36.63     A  C
ATOM   3197  O   ILE B  66      22.548  99.621  10.198  1.00 37.33     A  O
ATOM   3198  N   SER B  67      20.931  99.797   8.743  1.00 34.16     A  N
ATOM   3199  CA  SER B  67      20.777  98.377   8.606  1.00 32.65     A  C
ATOM   3200  CB  SER B  67      19.389  98.035   8.145  1.00 33.02     A  C
ATOM   3201  OG  SER B  67      19.075  98.790   7.042  1.00 33.44     A  O
ATOM   3202  C   SER B  67      21.787  97.774   7.658  1.00 31.52     A  C
ATOM   3203  O   SER B  67      22.172  98.384   6.705  1.00 30.58     A  O
ATOM   3204  N   PRO B  68      22.170  96.542   7.916  1.00 29.98     A  N
ATOM   3205  CA  PRO B  68      23.243  95.890   7.199  1.00 29.98     A  C
ATOM   3206  CB  PRO B  68      23.318  94.541   7.871  1.00 30.55     A  C
ATOM   3207  CG  PRO B  68      22.390  94.538   8.920  1.00 28.24     A  C
ATOM   3208  CD  PRO B  68      21.849  95.832   9.145  1.00 29.28     A  C
ATOM   3209  C   PRO B  68      22.980  95.734   5.717  1.00 30.64     A  C
ATOM   3210  O   PRO B  68      23.848  95.896   4.913  1.00 30.63     A  O
ATOM   3211  N   PHE B  69      21.752  95.459   5.370  1.00 30.45     A  N
ATOM   3212  CA  PHE B  69      21.373  95.136   4.027  1.00 30.87     A  C
ATOM   3213  CB  PHE B  69      20.638  93.836   4.026  1.00 30.02     A  C
ATOM   3214  CG  PHE B  69      21.489  92.704   4.386  1.00 32.99     A  C
ATOM   3215  CD1 PHE B  69      22.213  92.076   3.446  1.00 31.98     A  C
ATOM   3216  CE1 PHE B  69      22.974  91.097   3.762  1.00 32.20     A  C
ATOM   3217  CZ  PHE B  69      23.074  90.711   5.013  1.00 35.62     A  C
ATOM   3218  CE2 PHE B  69      22.393  91.315   5.977  1.00 34.89     A  C
ATOM   3219  CD2 PHE B  69      21.611  92.302   5.671  1.00 35.09     A  C
ATOM   3220  C   PHE B  69      20.638  96.214   3.284  1.00 32.10     A  C
ATOM   3221  O   PHE B  69      19.873  95.941   2.406  1.00 33.14     A  O
ATOM   3222  N   TYR B  70      20.857  97.438   3.702  1.00 31.28     A  N
ATOM   3223  CA  TYR B  70      20.310  98.597   3.067  1.00 32.51     A  C
ATOM   3224  CB  TYR B  70      20.625  99.814   3.924  1.00 33.26     A  C
ATOM   3225  CG  TYR B  70      20.118 101.060   3.336  1.00 35.99     A  C
ATOM   3226  CD1 TYR B  70      18.791 101.317   3.320  1.00 38.77     A  C
ATOM   3227  CE1 TYR B  70      18.324 102.412   2.769  1.00 41.73     A  C
ATOM   3228  CZ  TYR B  70      19.167 103.273   2.209  1.00 42.03     A  C
ATOM   3229  OH  TYR B  70      18.662 104.383   1.641  1.00 50.93     A  O
ATOM   3230  CE2 TYR B  70      20.482 103.048   2.200  1.00 38.68     A  C
ATOM   3231  CD2 TYR B  70      20.952 101.956   2.765  1.00 38.24     A  C
ATOM   3232  C   TYR B  70      20.812  98.855   1.680  1.00 33.04     A  C
ATOM   3233  O   TYR B  70      20.064  99.157   0.806  1.00 35.17     A  O
ATOM   3234  N   SER B  71      22.106  98.757   1.496  1.00 33.95     A  N
ATOM   3235  CA  SER B  71      22.777  99.240   0.313  1.00 34.85     A  C
ATOM   3236  CB  SER B  71      23.495 100.522   0.667  1.00 35.04     A  C
ATOM   3237  OG  SER B  71      23.902 101.220  -0.450  1.00 37.37     A  O
ATOM   3238  C   SER B  71      23.803  98.260  -0.162  1.00 34.55     A  C
ATOM   3239  O   SER B  71      24.294  97.490   0.585  1.00 34.92     A  O
```

Appendix 1

```
ATOM   3240  N    ARG B  72      24.129  98.294  -1.426  1.00 34.33     A    N
ATOM   3241  CA   ARG B  72      25.170  97.455  -1.947  1.00 34.75     A    C
ATOM   3242  CB   ARG B  72      24.783  96.885  -3.290  1.00 33.82     A    C
ATOM   3243  CG   ARG B  72      24.477  97.869  -4.297  1.00 37.20     A    C
ATOM   3244  CD   ARG B  72      24.781  97.305  -5.581  1.00 44.61     A    C
ATOM   3245  NE   ARG B  72      23.631  96.634  -6.110  1.00 50.32     A    N
ATOM   3246  CZ   ARG B  72      23.632  95.412  -6.598  1.00 51.43     A    C
ATOM   3247  NH1  ARG B  72      24.732  94.705  -6.622  1.00 49.89     A    N
ATOM   3248  NH2  ARG B  72      22.523  94.910  -7.076  1.00 51.94     A    N
ATOM   3249  C    ARG B  72      26.477  98.185  -2.020  1.00 34.86     A    C
ATOM   3250  O    ARG B  72      27.453  97.665  -2.471  1.00 34.11     A    O
ATOM   3251  N    GLY B  73      26.450  99.409  -1.546  1.00 35.24     A    N
ATOM   3252  CA   GLY B  73      27.596 100.268  -1.458  1.00 35.99     A    C
ATOM   3253  C    GLY B  73      28.565  99.799  -0.408  1.00 37.28     A    C
ATOM   3254  O    GLY B  73      28.247  99.025   0.440  1.00 37.02     A    O
ATOM   3255  N    CYS B  74      29.794 100.223  -0.502  1.00 37.55     A    N
ATOM   3256  CA   CYS B  74      30.714  99.679   0.428  1.00 38.04     A    C
ATOM   3257  CB   CYS B  74      32.066  99.223  -0.222  1.00 37.95     A    C
ATOM   3258  SG   CYS B  74      32.254  97.301  -0.403  1.00 42.32     A    S
ATOM   3259  C    CYS B  74      30.680 100.585   1.646  1.00 37.63     A    C
ATOM   3260  O    CYS B  74      31.525 101.393   1.871  1.00 39.65     A    O
ATOM   3261  N    SER B  75      29.586 100.419   2.379  1.00 36.21     A    N
ATOM   3262  CA   SER B  75      29.187 101.182   3.538  1.00 36.06     A    C
ATOM   3263  CB   SER B  75      27.936 101.942   3.162  1.00 35.79     A    C
ATOM   3264  OG   SER B  75      27.251 102.386   4.286  1.00 41.78     A    O
ATOM   3265  C    SER B  75      28.909 100.288   4.753  1.00 34.97     A    C
ATOM   3266  O    SER B  75      28.131  99.389   4.688  1.00 33.70     A    O
ATOM   3267  N    PHE B  76      29.565 100.546   5.870  1.00 34.03     A    N
ATOM   3268  CA   PHE B  76      29.644  99.596   6.969  1.00 33.82     A    C
ATOM   3269  CB   PHE B  76      31.032  99.013   7.049  1.00 33.23     A    C
ATOM   3270  CG   PHE B  76      31.391  98.293   5.841  1.00 32.59     A    C
ATOM   3271  CD1  PHE B  76      30.911  97.043   5.625  1.00 30.62     A    C
ATOM   3272  CE1  PHE B  76      31.184  96.405   4.507  1.00 33.88     A    C
ATOM   3273  CZ   PHE B  76      31.902  97.011   3.578  1.00 33.74     A    C
ATOM   3274  CE2  PHE B  76      32.367  98.246   3.779  1.00 32.19     A    C
ATOM   3275  CD2  PHE B  76      32.104  98.884   4.877  1.00 27.49     A    C
ATOM   3276  C    PHE B  76      29.137  99.974   8.331  1.00 35.18     A    C
ATOM   3277  O    PHE B  76      29.587  99.472   9.308  1.00 35.43     A    O
ATOM   3278  N    GLU B  77      28.159 100.847   8.338  1.00 35.77     A    N
ATOM   3279  CA   GLU B  77      27.611 101.496   9.486  1.00 36.79     A    C
ATOM   3280  CB   GLU B  77      26.598 102.502   9.030  1.00 37.12     A    C
ATOM   3281  CG   GLU B  77      27.036 103.289   7.868  1.00 44.12     A    C
ATOM   3282  CD   GLU B  77      26.721 104.740   8.045  1.00 53.73     A    C
ATOM   3283  OE1  GLU B  77      27.146 105.569   7.229  1.00 55.24     A    O
ATOM   3284  OE2  GLU B  77      26.049 105.055   9.025  1.00 55.05     A    O-1
ATOM   3285  C    GLU B  77      26.964 100.579  10.451  1.00 36.44     A    C
ATOM   3286  O    GLU B  77      26.906 100.845  11.606  1.00 37.86     A    O
ATOM   3287  N    ALA B  78      26.368  99.540   9.946  1.00 35.72     A    N
ATOM   3288  CA   ALA B  78      25.687  98.613  10.770  1.00 35.26     A    C
ATOM   3289  CB   ALA B  78      25.012  97.619   9.916  1.00 35.97     A    C
ATOM   3290  C    ALA B  78      26.668  97.944  11.665  1.00 34.62     A    C
ATOM   3291  O    ALA B  78      26.423  97.762  12.808  1.00 35.73     A    O
ATOM   3292  N    TRP B  79      27.772  97.543  11.092  1.00 34.13     A    N
ATOM   3293  CA   TRP B  79      28.884  96.970  11.788  1.00 35.45     A    C
```

Appendix 1

```
ATOM   3294  CB   TRP B  79      29.808  96.270  10.806  1.00 34.37      A    C
ATOM   3295  CG   TRP B  79      29.201  95.069  10.159  1.00 33.70      A    C
ATOM   3296  CD1  TRP B  79      29.279  93.811  10.579  1.00 30.57      A    C
ATOM   3297  NE1  TRP B  79      28.628  92.992   9.743  1.00 29.35      A    N
ATOM   3298  CE2  TRP B  79      28.090  93.733   8.742  1.00 27.47      A    C
ATOM   3299  CD2  TRP B  79      28.441  95.039   8.966  1.00 30.14      A    C
ATOM   3300  CE3  TRP B  79      28.013  96.003   8.069  1.00 28.01      A    C
ATOM   3301  CZ3  TRP B  79      27.290  95.624   7.024  1.00 25.45      A    C
ATOM   3302  CH2  TRP B  79      26.968  94.323   6.820  1.00 22.85      A    C
ATOM   3303  CZ2  TRP B  79      27.347  93.360   7.672  1.00 27.86      A    C
ATOM   3304  C    TRP B  79      29.613  97.926  12.720  1.00 36.58      A    C
ATOM   3305  O    TRP B  79      30.122  97.523  13.714  1.00 37.39      A    O
ATOM   3306  N    GLU B  80      29.684  99.196  12.367  1.00 37.96      A    N
ATOM   3307  CA   GLU B  80      30.334 100.196  13.188  1.00 39.02      A    C
ATOM   3308  CB   GLU B  80      30.350 101.535  12.476  1.00 40.04      A    C
ATOM   3309  CG   GLU B  80      31.388 101.675  11.382  1.00 47.66      A    C
ATOM   3310  CD   GLU B  80      31.130 102.835  10.410  1.00 57.48      A    C
ATOM   3311  OE1  GLU B  80      30.335 103.746  10.715  1.00 58.49      A    O
ATOM   3312  OE2  GLU B  80      31.738 102.830   9.326  1.00 59.20      A    O-1
ATOM   3313  C    GLU B  80      29.620 100.346  14.503  1.00 38.20      A    C
ATOM   3314  O    GLU B  80      30.228 100.417  15.539  1.00 36.08      A    O
ATOM   3315  N    LEU B  81      28.305 100.380  14.422  1.00 37.78      A    N
ATOM   3316  CA   LEU B  81      27.418 100.470  15.562  1.00 37.94      A    C
ATOM   3317  CB   LEU B  81      26.005 100.764  15.123  1.00 37.50      A    C
ATOM   3318  CG   LEU B  81      25.791 102.066  14.406  1.00 37.50      A    C
ATOM   3319  CD1  LEU B  81      24.568 102.003  13.603  1.00 38.79      A    C
ATOM   3320  CD2  LEU B  81      25.679 103.114  15.362  1.00 30.85      A    C
ATOM   3321  C    LEU B  81      27.428  99.246  16.430  1.00 38.50      A    C
ATOM   3322  O    LEU B  81      27.043  99.278  17.554  1.00 39.46      A    O
ATOM   3323  N    LYS B  82      27.835  98.143  15.865  1.00 38.82      A    N
ATOM   3324  CA   LYS B  82      27.884  96.925  16.587  1.00 38.98      A    C
ATOM   3325  CB   LYS B  82      27.513  95.806  15.670  1.00 40.29      A    C
ATOM   3326  CG   LYS B  82      26.097  95.660  15.449  1.00 42.03      A    C
ATOM   3327  CD   LYS B  82      25.806  94.255  15.146  1.00 45.28      A    C
ATOM   3328  CE   LYS B  82      26.096  93.916  13.726  1.00 44.56      A    C
ATOM   3329  NZ   LYS B  82      25.869  92.503  13.530  1.00 44.70      A    N
ATOM   3330  C    LYS B  82      29.237  96.637  17.130  1.00 38.55      A    C
ATOM   3331  O    LYS B  82      29.406  95.677  17.803  1.00 39.07      A    O
ATOM   3332  N    HIS B  83      30.207  97.462  16.826  1.00 37.48      A    N
ATOM   3333  CA   HIS B  83      31.578  97.260  17.276  1.00 38.16      A    C
ATOM   3334  CB   HIS B  83      31.721  97.464  18.780  1.00 38.47      A    C
ATOM   3335  CG   HIS B  83      30.925  98.602  19.315  1.00 45.66      A    C
ATOM   3336  ND1  HIS B  83      31.048  99.882  18.843  1.00 51.17      A    N
ATOM   3337  CE1  HIS B  83      30.206 100.670  19.474  1.00 51.38      A    C
ATOM   3338  NE2  HIS B  83      29.561  99.952  20.364  1.00 53.59      A    N
ATOM   3339  CD2  HIS B  83      29.987  98.654  20.283  1.00 51.18      A    C
ATOM   3340  C    HIS B  83      32.214  95.940  16.859  1.00 35.99      A    C
ATOM   3341  O    HIS B  83      32.924  95.335  17.632  1.00 35.20      A    O
ATOM   3342  N    THR B  84      31.939  95.542  15.627  1.00 32.12      A    N
ATOM   3343  CA   THR B  84      32.488  94.382  14.996  1.00 30.42      A    C
ATOM   3344  CB   THR B  84      31.658  94.031  13.763  1.00 31.90      A    C
ATOM   3345  OG1  THR B  84      30.322  93.833  14.161  1.00 36.79      A    O
ATOM   3346  CG2  THR B  84      32.098  92.810  13.109  1.00 27.66      A    C
ATOM   3347  C    THR B  84      33.857  94.710  14.546  1.00 28.43      A    C
```

Appendix 1

```
ATOM   3348  O    THR B  84      34.060  95.676  13.892  1.00  27.72       A  O
ATOM   3349  N    PRO B  85      34.801  93.878  14.888  1.00  26.15       A  N
ATOM   3350  CA   PRO B  85      36.155  94.094  14.443  1.00  25.53       A  C
ATOM   3351  CB   PRO B  85      36.929  93.082  15.246  1.00  25.06       A  C
ATOM   3352  CG   PRO B  85      36.129  92.825  16.329  1.00  24.58       A  C
ATOM   3353  CD   PRO B  85      34.770  92.821  15.878  1.00  26.05       A  C
ATOM   3354  C    PRO B  85      36.337  93.863  12.982  1.00  24.60       A  C
ATOM   3355  O    PRO B  85      35.706  93.057  12.416  1.00  23.05       A  O
ATOM   3356  N    GLN B  86      37.274  94.552  12.393  1.00  24.52       A  N
ATOM   3357  CA   GLN B  86      37.375  94.545  10.975  1.00  26.66       A  C
ATOM   3358  CB   GLN B  86      38.572  95.348  10.517  1.00  26.09       A  C
ATOM   3359  CG   GLN B  86      38.794  95.348   9.035  1.00  26.58       A  C
ATOM   3360  CD   GLN B  86      39.597  94.195   8.523  1.00  27.45       A  C
ATOM   3361  OE1  GLN B  86      40.593  93.854   9.065  1.00  29.67       A  O
ATOM   3362  NE2  GLN B  86      39.170  93.627   7.454  1.00  24.05       A  N
ATOM   3363  C    GLN B  86      37.550  93.152  10.508  1.00  27.75       A  C
ATOM   3364  O    GLN B  86      36.986  92.791   9.549  1.00  28.87       A  O
ATOM   3365  N    ARG B  87      38.346  92.372  11.194  1.00  27.63       A  N
ATOM   3366  CA   ARG B  87      38.698  91.071  10.735  1.00  26.95       A  C
ATOM   3367  CB   ARG B  87      39.813  90.510  11.580  1.00  26.77       A  C
ATOM   3368  CG   ARG B  87      41.146  90.890  11.100  1.00  27.66       A  C
ATOM   3369  CD   ARG B  87      42.182  90.421  11.989  1.00  28.64       A  C
ATOM   3370  NE   ARG B  87      43.330  91.284  11.928  1.00  31.09       A  N
ATOM   3371  CZ   ARG B  87      44.343  91.128  11.110  1.00  24.24       A  C
ATOM   3372  NH1  ARG B  87      44.361  90.165  10.262  1.00  21.07       A  N
ATOM   3373  NH2  ARG B  87      45.322  91.958  11.140  1.00  25.71       A  N
ATOM   3374  C    ARG B  87      37.529  90.139  10.714  1.00  28.00       A  C
ATOM   3375  O    ARG B  87      37.552  89.126  10.109  1.00  27.94       A  O
ATOM   3376  N    VAL B  88      36.501  90.496  11.425  1.00  27.18       A  N
ATOM   3377  CA   VAL B  88      35.393  89.633  11.611  1.00  27.50       A  C
ATOM   3378  CB   VAL B  88      35.070  89.664  13.097  1.00  28.77       A  C
ATOM   3379  CG1  VAL B  88      33.679  89.472  13.375  1.00  27.94       A  C
ATOM   3380  CG2  VAL B  88      35.839  88.665  13.764  1.00  30.74       A  C
ATOM   3381  C    VAL B  88      34.191  89.945  10.719  1.00  28.06       A  C
ATOM   3382  O    VAL B  88      33.266  89.234  10.710  1.00  28.80       A  O
ATOM   3383  N    ILE B  89      34.232  91.027   9.976  1.00  27.07       A  N
ATOM   3384  CA   ILE B  89      33.126  91.468   9.173  1.00  26.47       A  C
ATOM   3385  CB   ILE B  89      33.376  92.861   8.614  1.00  27.24       A  C
ATOM   3386  CG1  ILE B  89      33.254  93.892   9.708  1.00  27.01       A  C
ATOM   3387  CD1  ILE B  89      33.924  95.157   9.441  1.00  26.93       A  C
ATOM   3388  CG2  ILE B  89      32.398  93.200   7.575  1.00  23.69       A  C
ATOM   3389  C    ILE B  89      32.806  90.456   8.096  1.00  26.07       A  C
ATOM   3390  O    ILE B  89      31.712  90.332   7.688  1.00  29.41       A  O
ATOM   3391  N    LYS B  90      33.802  89.718   7.690  1.00  23.20       A  N
ATOM   3392  CA   LYS B  90      33.721  88.681   6.723  1.00  22.73       A  C
ATOM   3393  CB   LYS B  90      35.035  87.977   6.849  1.00  23.10       A  C
ATOM   3394  CG   LYS B  90      35.852  87.849   5.712  1.00  21.87       A  C
ATOM   3395  CD   LYS B  90      37.072  87.200   6.182  1.00  16.23       A  C
ATOM   3396  CE   LYS B  90      38.236  87.908   5.642  1.00  22.22       A  C
ATOM   3397  NZ   LYS B  90      38.816  88.831   6.562  1.00  19.37       A  N
ATOM   3398  C    LYS B  90      32.816  87.602   7.121  1.00  22.98       A  C
ATOM   3399  O    LYS B  90      32.051  87.148   6.371  1.00  24.93       A  O
ATOM   3400  N    TYR B  91      32.986  87.111   8.310  1.00  23.66       A  N
ATOM   3401  CA   TYR B  91      32.152  86.079   8.806  1.00  25.71       A  C
```

Appendix 1

```
ATOM   3402  CB   TYR B  91      32.748  85.490  10.044  1.00  26.64     A    C
ATOM   3403  CG   TYR B  91      34.187  85.229   9.888  1.00  32.89     A    C
ATOM   3404  CD1  TYR B  91      34.624  84.134   9.227  1.00  37.03     A    C
ATOM   3405  CE1  TYR B  91      35.930  83.899   9.079  1.00  38.69     A    C
ATOM   3406  CZ   TYR B  91      36.811  84.751   9.595  1.00  39.00     A    C
ATOM   3407  OH   TYR B  91      38.122  84.502   9.427  1.00  45.14     A    O
ATOM   3408  CE2  TYR B  91      36.407  85.840  10.253  1.00  35.59     A    C
ATOM   3409  CD2  TYR B  91      35.119  86.080  10.400  1.00  32.94     A    C
ATOM   3410  C    TYR B  91      30.756  86.497   9.028  1.00  25.67     A    C
ATOM   3411  O    TYR B  91      29.879  85.759   8.793  1.00  25.66     A    O
ATOM   3412  N    SER B  92      30.557  87.702   9.505  1.00  25.78     A    N
ATOM   3413  CA   SER B  92      29.230  88.210   9.750  1.00  24.79     A    C
ATOM   3414  CB   SER B  92      29.324  89.574  10.402  1.00  25.33     A    C
ATOM   3415  OG   SER B  92      28.166  90.327  10.272  1.00  23.01     A    O
ATOM   3416  C    SER B  92      28.400  88.293   8.500  1.00  24.11     A    C
ATOM   3417  O    SER B  92      27.283  87.892   8.511  1.00  22.26     A    O
ATOM   3418  N    ILE B  93      28.969  88.781   7.419  1.00  22.76     A    N
ATOM   3419  CA   ILE B  93      28.285  88.860   6.165  1.00  23.39     A    C
ATOM   3420  CB   ILE B  93      29.165  89.545   5.107  1.00  22.72     A    C
ATOM   3421  CG1  ILE B  93      29.288  91.016   5.358  1.00  22.54     A    C
ATOM   3422  CD1  ILE B  93      30.252  91.693   4.458  1.00  24.52     A    C
ATOM   3423  CG2  ILE B  93      28.583  89.444   3.814  1.00  21.52     A    C
ATOM   3424  C    ILE B  93      27.918  87.498   5.633  1.00  23.94     A    C
ATOM   3425  O    ILE B  93      26.841  87.300   5.156  1.00  25.10     A    O
ATOM   3426  N    ALA B  94      28.846  86.571   5.690  1.00  23.15     A    N
ATOM   3427  CA   ALA B  94      28.625  85.238   5.252  1.00  23.42     A    C
ATOM   3428  CB   ALA B  94      29.863  84.534   5.255  1.00  24.05     A    C
ATOM   3429  C    ALA B  94      27.609  84.478   6.027  1.00  23.60     A    C
ATOM   3430  O    ALA B  94      26.867  83.773   5.491  1.00  24.05     A    O
ATOM   3431  N    PHE B  95      27.608  84.584   7.320  1.00  25.35     A    N
ATOM   3432  CA   PHE B  95      26.620  83.916   8.130  1.00  26.90     A    C
ATOM   3433  CB   PHE B  95      27.021  83.848   9.595  1.00  27.17     A    C
ATOM   3434  CG   PHE B  95      28.244  83.053   9.828  1.00  30.08     A    C
ATOM   3435  CD1  PHE B  95      28.397  81.829   9.285  1.00  33.51     A    C
ATOM   3436  CE1  PHE B  95      29.509  81.136   9.490  1.00  37.21     A    C
ATOM   3437  CZ   PHE B  95      30.488  81.645  10.231  1.00  37.59     A    C
ATOM   3438  CE2  PHE B  95      30.355  82.835  10.776  1.00  35.97     A    C
ATOM   3439  CD2  PHE B  95      29.248  83.540  10.587  1.00  33.14     A    C
ATOM   3440  C    PHE B  95      25.224  84.433   7.911  1.00  27.46     A    C
ATOM   3441  O    PHE B  95      24.284  83.705   8.002  1.00  26.66     A    O
ATOM   3442  N    TYR B  96      25.114  85.711   7.636  1.00  27.30     A    N
ATOM   3443  CA   TYR B  96      23.871  86.291   7.265  1.00  28.35     A    C
ATOM   3444  CB   TYR B  96      24.047  87.776   7.092  1.00  28.04     A    C
ATOM   3445  CG   TYR B  96      23.898  88.635   8.307  1.00  27.51     A    C
ATOM   3446  CD1  TYR B  96      22.864  88.493   9.150  1.00  27.84     A    C
ATOM   3447  CE1  TYR B  96      22.746  89.270  10.216  1.00  26.77     A    C
ATOM   3448  CZ   TYR B  96      23.641  90.217  10.450  1.00  30.26     A    C
ATOM   3449  OH   TYR B  96      23.492  90.997  11.525  1.00  33.17     A    O
ATOM   3450  CE2  TYR B  96      24.673  90.389   9.637  1.00  31.06     A    C
ATOM   3451  CD2  TYR B  96      24.798  89.611   8.582  1.00  28.36     A    C
ATOM   3452  C    TYR B  96      23.415  85.697   5.959  1.00  29.21     A    C
ATOM   3453  O    TYR B  96      22.282  85.388   5.787  1.00  29.43     A    O
ATOM   3454  N    ALA B  97      24.329  85.561   5.029  1.00  29.85     A    N
ATOM   3455  CA   ALA B  97      24.043  85.030   3.728  1.00  29.49     A    C
```

Appendix 1

```
ATOM   3456  CB   ALA B  97      25.231  85.166   2.858  1.00 29.20      A    C
ATOM   3457  C    ALA B  97      23.582  83.602   3.761  1.00 29.76      A    C
ATOM   3458  O    ALA B  97      22.696  83.242   3.055  1.00 30.93      A    O
ATOM   3459  N    TYR B  98      24.202  82.787   4.585  1.00 30.31      A    N
ATOM   3460  CA   TYR B  98      23.832  81.399   4.763  1.00 29.59      A    C
ATOM   3461  CB   TYR B  98      24.869  80.673   5.591  1.00 29.01      A    C
ATOM   3462  CG   TYR B  98      26.271  80.762   5.072  1.00 29.28      A    C
ATOM   3463  CD1  TYR B  98      26.535  81.113   3.783  1.00 31.50      A    C
ATOM   3464  CE1  TYR B  98      27.810  81.189   3.333  1.00 30.91      A    C
ATOM   3465  CZ   TYR B  98      28.813  80.924   4.171  1.00 31.02      A    C
ATOM   3466  OH   TYR B  98      30.073  81.007   3.757  1.00 32.82      A    O
ATOM   3467  CE2  TYR B  98      28.576  80.566   5.427  1.00 30.26      A    C
ATOM   3468  CD2  TYR B  98      27.330  80.484   5.875  1.00 29.79      A    C
ATOM   3469  C    TYR B  98      22.454  81.205   5.344  1.00 30.47      A    C
ATOM   3470  O    TYR B  98      21.754  80.312   4.969  1.00 31.37      A    O
ATOM   3471  N    GLY B  99      22.094  82.038   6.289  1.00 29.58      A    N
ATOM   3472  CA   GLY B  99      20.751  82.126   6.775  1.00 30.64      A    C
ATOM   3473  C    GLY B  99      19.732  82.611   5.802  1.00 31.73      A    C
ATOM   3474  O    GLY B  99      18.656  82.123   5.745  1.00 32.30      A    O
ATOM   3475  N    LEU B 100      20.119  83.586   5.027  1.00 32.18      A    N
ATOM   3476  CA   LEU B 100      19.288  84.179   4.040  1.00 33.08      A    C
ATOM   3477  CB   LEU B 100      20.082  85.242   3.329  1.00 32.60      A    C
ATOM   3478  CG   LEU B 100      19.676  86.679   3.563  1.00 34.58      A    C
ATOM   3479  CD1  LEU B 100      18.838  86.820   4.774  1.00 30.16      A    C
ATOM   3480  CD2  LEU B 100      20.837  87.596   3.583  1.00 29.60      A    C
ATOM   3481  C    LEU B 100      18.875  83.136   3.054  1.00 34.71      A    C
ATOM   3482  O    LEU B 100      17.795  83.178   2.555  1.00 34.46      A    O
ATOM   3483  N    ALA B 101      19.758  82.211   2.755  1.00 35.90      A    N
ATOM   3484  CA   ALA B 101      19.466  81.140   1.857  1.00 36.53      A    C
ATOM   3485  CB   ALA B 101      20.698  80.376   1.570  1.00 36.55      A    C
ATOM   3486  C    ALA B 101      18.393  80.217   2.351  1.00 37.67      A    C
ATOM   3487  O    ALA B 101      17.562  79.803   1.598  1.00 40.44      A    O
ATOM   3488  N    SER B 102      18.427  79.865   3.615  1.00 37.23      A    N
ATOM   3489  CA   SER B 102      17.434  79.009   4.222  1.00 36.46      A    C
ATOM   3490  CB   SER B 102      17.837  78.666   5.627  1.00 36.16      A    C
ATOM   3491  OG   SER B 102      18.567  77.489   5.629  1.00 38.19      A    O
ATOM   3492  C    SER B 102      16.081  79.631   4.221  1.00 36.58      A    C
ATOM   3493  O    SER B 102      15.109  78.992   4.050  1.00 35.62      A    O
ATOM   3494  N    VAL B 103      16.055  80.913   4.433  1.00 37.47      A    N
ATOM   3495  CA   VAL B 103      14.854  81.674   4.434  1.00 40.45      A    C
ATOM   3496  CB   VAL B 103      15.128  83.079   4.774  1.00 40.41      A    C
ATOM   3497  CG1  VAL B 103      13.967  83.893   4.479  1.00 41.22      A    C
ATOM   3498  CG2  VAL B 103      15.447  83.184   6.182  1.00 39.90      A    C
ATOM   3499  C    VAL B 103      14.193  81.610   3.084  1.00 42.38      A    C
ATOM   3500  O    VAL B 103      12.998  81.627   2.987  1.00 44.43      A    O
ATOM   3501  N    ALA B 104      14.989  81.564   2.040  1.00 42.61      A    N
ATOM   3502  CA   ALA B 104      14.490  81.410   0.723  1.00 42.76      A    C
ATOM   3503  CB   ALA B 104      15.609  81.449  -0.192  1.00 41.86      A    C
ATOM   3504  C    ALA B 104      13.809  80.088   0.601  1.00 44.14      A    C
ATOM   3505  O    ALA B 104      12.765  79.975   0.022  1.00 45.42      A    O
ATOM   3506  N    LEU B 105      14.449  79.066   1.101  1.00 45.12      A    N
ATOM   3507  CA   LEU B 105      13.869  77.762   1.100  1.00 46.15      A    C
ATOM   3508  CB   LEU B 105      14.889  76.784   1.659  1.00 45.79      A    C
ATOM   3509  CG   LEU B 105      14.885  75.330   1.273  1.00 46.91      A    C
```

Appendix 1

```
ATOM   3510  CD1 LEU B 105      14.748  75.225  -0.164  1.00 47.54      A    C
ATOM   3511  CD2 LEU B 105      16.133  74.727   1.674  1.00 47.02      A    C
ATOM   3512  C   LEU B 105      12.633  77.705   1.949  1.00 46.95      A    C
ATOM   3513  O   LEU B 105      11.653  77.187   1.537  1.00 49.28      A    O
ATOM   3514  N   ILE B 106      12.698  78.232   3.154  1.00 47.23      A    N
ATOM   3515  CA  ILE B 106      11.613  78.166   4.110  1.00 46.85      A    C
ATOM   3516  CB  ILE B 106      12.024  78.862   5.366  1.00 45.99      A    C
ATOM   3517  CG1 ILE B 106      12.776  77.951   6.286  1.00 44.47      A    C
ATOM   3518  CD1 ILE B 106      13.213  78.669   7.436  1.00 45.74      A    C
ATOM   3519  CG2 ILE B 106      10.828  79.342   6.050  1.00 45.19      A    C
ATOM   3520  C   ILE B 106      10.285  78.839   3.793  1.00 47.64      A    C
ATOM   3521  O   ILE B 106       9.261  78.255   3.993  1.00 47.02      A    O
ATOM   3522  N   ASP B 107      10.303  80.078   3.351  1.00 48.93      A    N
ATOM   3523  CA  ASP B 107       9.103  80.770   2.946  1.00 51.11      A    C
ATOM   3524  CB  ASP B 107       8.796  81.898   3.925  1.00 51.62      A    C
ATOM   3525  CG  ASP B 107       7.449  82.520   3.701  1.00 55.41      A    C
ATOM   3526  OD1 ASP B 107       6.578  81.866   3.134  1.00 58.20      A    O
ATOM   3527  OD2 ASP B 107       7.237  83.665   4.105  1.00 57.09      A    O-1
ATOM   3528  C   ASP B 107       9.347  81.371   1.594  1.00 52.23      A    C
ATOM   3529  O   ASP B 107      10.152  82.251   1.461  1.00 52.98      A    O
ATOM   3530  N   PRO B 108       8.625  80.909   0.593  1.00 52.63      A    N
ATOM   3531  CA  PRO B 108       8.761  81.396  -0.762  1.00 51.38      A    C
ATOM   3532  CB  PRO B 108       7.843  80.475  -1.521  1.00 52.17      A    C
ATOM   3533  CG  PRO B 108       7.970  79.241  -0.819  1.00 52.21      A    C
ATOM   3534  CD  PRO B 108       7.952  79.612   0.599  1.00 53.00      A    C
ATOM   3535  C   PRO B 108       8.306  82.805  -0.877  1.00 50.71      A    C
ATOM   3536  O   PRO B 108       8.634  83.474  -1.810  1.00 50.98      A    O
ATOM   3537  N   LYS B 109       7.515  83.257   0.062  1.00 49.88      A    N
ATOM   3538  CA  LYS B 109       7.056  84.621   0.013  1.00 48.31      A    C
ATOM   3539  CB  LYS B 109       6.018  84.880   1.076  1.00 49.06      A    C
ATOM   3540  CG  LYS B 109       4.599  84.758   0.589  1.00 49.37      A    C
ATOM   3541  CD  LYS B 109       3.616  84.757   1.730  1.00 50.48      A    C
ATOM   3542  CE  LYS B 109       2.852  83.482   1.779  1.00 54.50      A    C
ATOM   3543  NZ  LYS B 109       3.320  82.540   2.828  1.00 54.21      A    N
ATOM   3544  C   LYS B 109       8.212  85.576   0.143  1.00 46.73      A    C
ATOM   3545  O   LYS B 109       8.177  86.666  -0.337  1.00 46.80      A    O
ATOM   3546  N   LEU B 110       9.245  85.146   0.824  1.00 44.46      A    N
ATOM   3547  CA  LEU B 110      10.373  85.987   1.089  1.00 41.20      A    C
ATOM   3548  CB  LEU B 110      10.728  85.855   2.549  1.00 40.58      A    C
ATOM   3549  CG  LEU B 110       9.627  86.322   3.454  1.00 37.60      A    C
ATOM   3550  CD1 LEU B 110      10.011  86.075   4.853  1.00 33.44      A    C
ATOM   3551  CD2 LEU B 110       9.464  87.750   3.223  1.00 33.01      A    C
ATOM   3552  C   LEU B 110      11.580  85.699   0.239  1.00 40.15      A    C
ATOM   3553  O   LEU B 110      12.575  86.321   0.388  1.00 39.95      A    O
ATOM   3554  N   ARG B 111      11.464  84.764  -0.672  1.00 38.33      A    N
ATOM   3555  CA  ARG B 111      12.562  84.309  -1.479  1.00 37.06      A    C
ATOM   3556  CB  ARG B 111      12.107  83.179  -2.383  1.00 36.37      A    C
ATOM   3557  CG  ARG B 111      13.156  82.667  -3.294  1.00 35.31      A    C
ATOM   3558  CD  ARG B 111      12.957  81.251  -3.585  1.00 35.46      A    C
ATOM   3559  NE  ARG B 111      13.934  80.784  -4.519  1.00 33.81      A    N
ATOM   3560  CZ  ARG B 111      14.085  79.536  -4.882  1.00 34.71      A    C
ATOM   3561  NH1 ARG B 111      13.328  78.606  -4.389  1.00 31.15      A    N
ATOM   3562  NH2 ARG B 111      15.016  79.229  -5.734  1.00 34.65      A    N
ATOM   3563  C   ARG B 111      13.132  85.431  -2.292  1.00 36.20      A    C
```

Appendix 1

```
ATOM   3564  O    ARG B 111      14.278  85.452  -2.578  1.00 36.82      A    O
ATOM   3565  N    ALA B 112      12.301  86.347  -2.698  1.00 35.21      A    N
ATOM   3566  CA   ALA B 112      12.750  87.534  -3.354  1.00 35.28      A    C
ATOM   3567  CB   ALA B 112      11.628  88.180  -4.035  1.00 35.07      A    C
ATOM   3568  C    ALA B 112      13.539  88.535  -2.534  1.00 35.25      A    C
ATOM   3569  O    ALA B 112      14.338  89.234  -3.065  1.00 35.02      A    O
ATOM   3570  N    LEU B 113      13.205  88.694  -1.276  1.00 34.51      A    N
ATOM   3571  CA   LEU B 113      13.957  89.547  -0.409  1.00 34.10      A    C
ATOM   3572  CB   LEU B 113      13.183  89.780   0.871  1.00 33.79      A    C
ATOM   3573  CG   LEU B 113      13.739  90.853   1.780  1.00 34.10      A    C
ATOM   3574  CD1  LEU B 113      13.867  92.131   1.119  1.00 30.45      A    C
ATOM   3575  CD2  LEU B 113      12.961  90.986   2.982  1.00 33.91      A    C
ATOM   3576  C    LEU B 113      15.321  88.974  -0.132  1.00 33.96      A    C
ATOM   3577  O    LEU B 113      16.295  89.636  -0.160  1.00 34.34      A    O
ATOM   3578  N    ALA B 114      15.352  87.697   0.104  1.00 33.42      A    N
ATOM   3579  CA   ALA B 114      16.561  87.006   0.379  1.00 33.66      A    C
ATOM   3580  CB   ALA B 114      16.267  85.616   0.694  1.00 33.72      A    C
ATOM   3581  C    ALA B 114      17.502  87.084  -0.775  1.00 33.98      A    C
ATOM   3582  O    ALA B 114      18.671  87.147  -0.587  1.00 35.11      A    O
ATOM   3583  N    GLY B 115      16.995  87.034  -1.978  1.00 33.46      A    N
ATOM   3584  CA   GLY B 115      17.834  87.202  -3.119  1.00 31.96      A    C
ATOM   3585  C    GLY B 115      18.411  88.566  -3.169  1.00 31.67      A    C
ATOM   3586  O    GLY B 115      19.532  88.739  -3.447  1.00 32.46      A    O
ATOM   3587  N    HIS B 116      17.609  89.552  -2.899  1.00 31.17      A    N
ATOM   3588  CA   HIS B 116      18.077  90.902  -2.893  1.00 31.21      A    C
ATOM   3589  CB   HIS B 116      16.875  91.806  -2.670  1.00 30.32      A    C
ATOM   3590  CG   HIS B 116      17.213  93.246  -2.282  1.00 28.39      A    C
ATOM   3591  ND1  HIS B 116      17.786  94.090  -3.142  1.00 27.14      A    N
ATOM   3592  CE1  HIS B 116      17.985  95.225  -2.518  1.00 25.96      A    C
ATOM   3593  NE2  HIS B 116      17.554  95.097  -1.286  1.00 29.23      A    N
ATOM   3594  CD2  HIS B 116      17.061  93.840  -1.116  1.00 27.02      A    C
ATOM   3595  C    HIS B 116      19.143  91.114  -1.834  1.00 32.41      A    C
ATOM   3596  O    HIS B 116      20.159  91.714  -2.090  1.00 32.56      A    O
ATOM   3597  N    ASP B 117      18.893  90.588  -0.654  1.00 31.10      A    N
ATOM   3598  CA   ASP B 117      19.814  90.629   0.439  1.00 31.28      A    C
ATOM   3599  CB   ASP B 117      19.174  90.027   1.673  1.00 30.99      A    C
ATOM   3600  CG   ASP B 117      18.265  90.960   2.398  1.00 31.73      A    C
ATOM   3601  OD1  ASP B 117      18.172  92.126   2.098  1.00 26.62      A    O
ATOM   3602  OD2  ASP B 117      17.633  90.498   3.320  1.00 33.94      A    O-1
ATOM   3603  C    ASP B 117      21.090  89.871   0.166  1.00 31.21      A    C
ATOM   3604  O    ASP B 117      22.137  90.288   0.550  1.00 31.11      A    O
ATOM   3605  N    LEU B 118      20.969  88.723  -0.455  1.00 30.21      A    N
ATOM   3606  CA   LEU B 118      22.076  87.902  -0.845  1.00 29.78      A    C
ATOM   3607  CB   LEU B 118      21.549  86.665  -1.504  1.00 29.37      A    C
ATOM   3608  CG   LEU B 118      21.790  85.312  -0.890  1.00 30.44      A    C
ATOM   3609  CD1  LEU B 118      22.492  85.400   0.379  1.00 26.19      A    C
ATOM   3610  CD2  LEU B 118      20.551  84.547  -0.758  1.00 27.84      A    C
ATOM   3611  C    LEU B 118      22.947  88.621  -1.825  1.00 30.72      A    C
ATOM   3612  O    LEU B 118      24.121  88.458  -1.823  1.00 32.77      A    O
ATOM   3613  N    ASP B 119      22.331  89.376  -2.703  1.00 30.81      A    N
ATOM   3614  CA   ASP B 119      22.961  90.226  -3.690  1.00 31.54      A    C
ATOM   3615  CB   ASP B 119      21.836  90.724  -4.602  1.00 31.98      A    C
ATOM   3616  CG   ASP B 119      22.275  91.702  -5.632  1.00 35.98      A    C
ATOM   3617  OD1  ASP B 119      23.431  91.990  -5.747  1.00 37.24      A    O
```

Appendix 1

```
ATOM   3618  OD2 ASP B 119      21.438  92.212  -6.345  1.00 41.23      A    O-1
ATOM   3619  C   ASP B 119      23.754  91.361  -3.059  1.00 31.04      A    C
ATOM   3620  O   ASP B 119      24.825  91.683  -3.459  1.00 31.17      A    O
ATOM   3621  N   ILE B 120      23.187  91.957  -2.044  1.00 30.73      A    N
ATOM   3622  CA  ILE B 120      23.850  92.928  -1.237  1.00 30.29      A    C
ATOM   3623  CB  ILE B 120      22.856  93.598  -0.323  1.00 30.75      A    C
ATOM   3624  CG1 ILE B 120      22.238  94.744  -1.066  1.00 29.79      A    C
ATOM   3625  CD1 ILE B 120      20.895  95.053  -0.694  1.00 31.00      A    C
ATOM   3626  CG2 ILE B 120      23.506  94.129   0.873  1.00 28.17      A    C
ATOM   3627  C   ILE B 120      25.035  92.359  -0.479  1.00 30.43      A    C
ATOM   3628  O   ILE B 120      26.057  92.965  -0.424  1.00 30.62      A    O
ATOM   3629  N   ALA B 121      24.900  91.176   0.078  1.00 29.09      A    N
ATOM   3630  CA  ALA B 121      25.985  90.544   0.776  1.00 27.56      A    C
ATOM   3631  CB  ALA B 121      25.522  89.317   1.440  1.00 27.36      A    C
ATOM   3632  C   ALA B 121      27.178  90.235  -0.081  1.00 27.44      A    C
ATOM   3633  O   ALA B 121      28.270  90.413   0.355  1.00 26.85      A    O
ATOM   3634  N   VAL B 122      26.963  89.733  -1.279  1.00 27.04      A    N
ATOM   3635  CA  VAL B 122      28.040  89.455  -2.194  1.00 26.31      A    C
ATOM   3636  CB  VAL B 122      27.549  88.792  -3.496  1.00 26.43      A    C
ATOM   3637  CG1 VAL B 122      28.543  88.864  -4.536  1.00 21.57      A    C
ATOM   3638  CG2 VAL B 122      27.198  87.388  -3.276  1.00 26.97      A    C
ATOM   3639  C   VAL B 122      28.744  90.728  -2.531  1.00 27.03      A    C
ATOM   3640  O   VAL B 122      29.918  90.785  -2.533  1.00 28.51      A    O
ATOM   3641  N   SER B 123      28.001  91.769  -2.781  1.00 27.70      A    N
ATOM   3642  CA  SER B 123      28.536  93.050  -3.108  1.00 29.51      A    C
ATOM   3643  CB  SER B 123      27.338  93.953  -3.278  1.00 29.62      A    C
ATOM   3644  OG  SER B 123      27.595  95.002  -4.132  1.00 33.17      A    O
ATOM   3645  C   SER B 123      29.400  93.639  -2.005  1.00 30.65      A    C
ATOM   3646  O   SER B 123      30.461  94.151  -2.245  1.00 31.26      A    O
ATOM   3647  N   LYS B 124      28.918  93.569  -0.785  1.00 30.34      A    N
ATOM   3648  CA  LYS B 124      29.648  93.999   0.372  1.00 30.01      A    C
ATOM   3649  CB  LYS B 124      28.732  94.121   1.559  1.00 30.51      A    C
ATOM   3650  CG  LYS B 124      28.003  95.383   1.534  1.00 31.65      A    C
ATOM   3651  CD  LYS B 124      27.131  95.545   2.694  1.00 33.30      A    C
ATOM   3652  CE  LYS B 124      27.124  96.936   3.110  1.00 32.41      A    C
ATOM   3653  NZ  LYS B 124      25.864  97.502   2.782  1.00 38.88      A    N
ATOM   3654  C   LYS B 124      30.891  93.222   0.698  1.00 29.43      A    C
ATOM   3655  O   LYS B 124      31.864  93.753   1.107  1.00 31.19      A    O
ATOM   3656  N   MET B 125      30.845  91.944   0.483  1.00 27.81      A    N
ATOM   3657  CA  MET B 125      31.949  91.084   0.741  1.00 26.55      A    C
ATOM   3658  CB  MET B 125      31.498  89.668   0.497  1.00 25.04      B    C
ATOM   3659  CG  MET B 125      32.452  88.683   0.853  1.00 25.54      B    C
ATOM   3660  SD  MET B 125      32.199  88.275   2.476  1.00 22.98      B    S
ATOM   3661  CE  MET B 125      32.978  86.778   2.494  1.00 23.04      B    C
ATOM   3662  C   MET B 125      33.142  91.455  -0.125  1.00 26.41      A    C
ATOM   3663  O   MET B 125      34.251  91.160   0.167  1.00 23.97      A    O
ATOM   3664  N   LYS B 126      32.874  92.120  -1.215  1.00 27.71      A    N
ATOM   3665  CA  LYS B 126      33.879  92.451  -2.171  1.00 28.01      A    C
ATOM   3666  CB  LYS B 126      33.277  92.383  -3.545  1.00 28.42      A    C
ATOM   3667  CG  LYS B 126      33.063  90.995  -3.997  1.00 31.04      A    C
ATOM   3668  CD  LYS B 126      32.140  90.957  -5.132  1.00 35.73      A    C
ATOM   3669  CE  LYS B 126      32.871  90.867  -6.410  1.00 38.08      A    C
ATOM   3670  NZ  LYS B 126      32.129  91.489  -7.507  1.00 40.06      A    N
ATOM   3671  C   LYS B 126      34.477  93.787  -1.903  1.00 28.37      A    C
```

Appendix 1

```
ATOM   3672  O    LYS B 126      35.356  94.218  -2.579  1.00  28.32      A    O
ATOM   3673  N    CYS B 127      33.967  94.434  -0.887  1.00  28.44      A    N
ATOM   3674  CA   CYS B 127      34.494  95.671  -0.396  1.00  28.81      A    C
ATOM   3675  CB   CYS B 127      33.455  96.363   0.464  1.00  30.46      A    C
ATOM   3676  SG   CYS B 127      32.189  97.148  -0.437  1.00  35.57      A    S
ATOM   3677  C    CYS B 127      35.789  95.471   0.332  1.00  27.60      A    C
ATOM   3678  O    CYS B 127      35.960  94.523   1.005  1.00  25.73      A    O
ATOM   3679  N    LYS B 128      36.701  96.397   0.150  1.00  27.62      A    N
ATOM   3680  CA   LYS B 128      38.058  96.331   0.666  1.00  27.96      A    C
ATOM   3681  CB   LYS B 128      38.905  97.418   0.067  1.00  29.10      A    C
ATOM   3682  CG   LYS B 128      40.270  96.994  -0.135  1.00  32.77      A    C
ATOM   3683  CD   LYS B 128      41.150  98.098   0.032  1.00  36.91      A    C
ATOM   3684  CE   LYS B 128      42.446  97.647   0.535  1.00  41.87      A    C
ATOM   3685  NZ   LYS B 128      43.521  98.377  -0.115  1.00  45.07      A    N
ATOM   3686  C    LYS B 128      38.206  96.339   2.151  1.00  26.37      A    C
ATOM   3687  O    LYS B 128      39.092  95.766   2.681  1.00  27.01      A    O
ATOM   3688  N    ARG B 129      37.283  96.987   2.799  1.00  25.89      A    N
ATOM   3689  CA   ARG B 129      37.194  97.004   4.209  1.00  26.40      A    C
ATOM   3690  CB   ARG B 129      35.984  97.819   4.584  1.00  27.70      A    C
ATOM   3691  CG   ARG B 129      35.570  97.730   5.977  1.00  30.46      A    C
ATOM   3692  CD   ARG B 129      36.347  98.662   6.815  1.00  35.27      A    C
ATOM   3693  NE   ARG B 129      36.033  98.563   8.223  1.00  34.18      A    N
ATOM   3694  CZ   ARG B 129      36.928  98.657   9.182  1.00  31.98      A    C
ATOM   3695  NH1  ARG B 129      38.186  98.845   8.887  1.00  25.61      A    N
ATOM   3696  NH2  ARG B 129      36.559  98.555  10.433  1.00  27.97      A    N
ATOM   3697  C    ARG B 129      37.028  95.603   4.692  1.00  26.00      A    C
ATOM   3698  O    ARG B 129      37.537  95.259   5.697  1.00  27.73      A    O
ATOM   3699  N    VAL B 130      36.266  94.811   3.986  1.00  25.19      A    N
ATOM   3700  CA   VAL B 130      36.146  93.423   4.286  1.00  23.69      A    C
ATOM   3701  CB   VAL B 130      34.955  92.861   3.581  1.00  24.08      A    C
ATOM   3702  CG1  VAL B 130      34.726  91.482   3.947  1.00  21.31      A    C
ATOM   3703  CG2  VAL B 130      33.804  93.664   3.896  1.00  23.34      A    C
ATOM   3704  C    VAL B 130      37.350  92.554   4.042  1.00  23.41      A    C
ATOM   3705  O    VAL B 130      37.711  91.817   4.881  1.00  25.02      A    O
ATOM   3706  N    TRP B 131      37.981  92.639   2.899  1.00  22.32      A    N
ATOM   3707  CA   TRP B 131      39.101  91.775   2.595  1.00  21.30      A    C
ATOM   3708  CB   TRP B 131      38.999  91.281   1.163  1.00  22.18      A    C
ATOM   3709  CG   TRP B 131      39.162  92.291   0.103  1.00  21.93      A    C
ATOM   3710  CD1  TRP B 131      38.199  92.831  -0.619  1.00  24.65      A    C
ATOM   3711  NE1  TRP B 131      38.696  93.696  -1.510  1.00  27.75      A    N
ATOM   3712  CE2  TRP B 131      40.047  93.723  -1.379  1.00  29.62      A    C
ATOM   3713  CD2  TRP B 131      40.373  92.834  -0.386  1.00  23.12      A    C
ATOM   3714  CE3  TRP B 131      41.702  92.671  -0.058  1.00  21.50      A    C
ATOM   3715  CZ3  TRP B 131      42.611  93.358  -0.715  1.00  25.10      A    C
ATOM   3716  CH2  TRP B 131      42.274  94.223  -1.709  1.00  30.09      A    C
ATOM   3717  CZ2  TRP B 131      40.995  94.426  -2.066  1.00  29.40      A    C
ATOM   3718  C    TRP B 131      40.495  92.309   2.888  1.00  21.70      A    C
ATOM   3719  O    TRP B 131      41.466  91.604   2.798  1.00  20.71      A    O
ATOM   3720  N    GLY B 132      40.533  93.568   3.275  1.00  20.59      A    N
ATOM   3721  CA   GLY B 132      41.684  94.444   3.307  1.00  20.37      A    C
ATOM   3722  C    GLY B 132      42.814  94.129   4.223  1.00  21.12      A    C
ATOM   3723  O    GLY B 132      43.895  94.549   4.029  1.00  21.48      A    O
ATOM   3724  N    ASP B 133      42.506  93.361   5.231  1.00  23.29      A    N
ATOM   3725  CA   ASP B 133      43.446  92.882   6.210  1.00  23.68      A    C
```

Appendix 1

```
ATOM   3726  CB  ASP B 133     42.748  92.074   7.289  1.00 22.58      A    C
ATOM   3727  CG  ASP B 133     41.862  91.002   6.736  1.00 28.10      A    C
ATOM   3728  OD1 ASP B 133     42.247  89.849   6.702  1.00 33.13      A    O
ATOM   3729  OD2 ASP B 133     40.753  91.288   6.365  1.00 28.73      A    O-1
ATOM   3730  C   ASP B 133     44.510  92.045   5.572  1.00 23.18      A    C
ATOM   3731  O   ASP B 133     45.586  91.973   6.082  1.00 24.25      A    O
ATOM   3732  N   TRP B 134     44.172  91.392   4.474  1.00 22.64      A    N
ATOM   3733  CA  TRP B 134     45.082  90.589   3.706  1.00 24.31      A    C
ATOM   3734  CB  TRP B 134     44.326  89.825   2.603  1.00 22.65      A    C
ATOM   3735  CG  TRP B 134     45.159  88.969   1.710  1.00 19.58      A    C
ATOM   3736  CD1 TRP B 134     45.594  89.289   0.499  1.00 20.34      A    C
ATOM   3737  NE1 TRP B 134     46.332  88.302  -0.020  1.00 19.91      A    N
ATOM   3738  CE2 TRP B 134     46.370  87.277   0.865  1.00 16.24      A    C
ATOM   3739  CD2 TRP B 134     45.638  87.661   1.965  1.00 18.17      A    C
ATOM   3740  CE3 TRP B 134     45.538  86.785   3.030  1.00 16.70      A    C
ATOM   3741  CZ3 TRP B 134     46.135  85.599   2.935  1.00 17.54      A    C
ATOM   3742  CH2 TRP B 134     46.851  85.247   1.827  1.00 17.97      A    C
ATOM   3743  CZ2 TRP B 134     46.975  86.069   0.782  1.00 14.03      A    C
ATOM   3744  C   TRP B 134     46.187  91.428   3.131  1.00 26.05      A    C
ATOM   3745  O   TRP B 134     47.306  91.055   3.199  1.00 25.92      A    O
ATOM   3746  N   GLU B 135     45.855  92.565   2.549  1.00 26.90      A    N
ATOM   3747  CA  GLU B 135     46.840  93.513   2.108  1.00 30.20      A    C
ATOM   3748  CB  GLU B 135     46.227  94.525   1.151  1.00 30.70      A    C
ATOM   3749  CG  GLU B 135     47.217  95.429   0.528  1.00 36.13      A    C
ATOM   3750  CD  GLU B 135     46.622  96.440  -0.383  1.00 44.17      A    C
ATOM   3751  OE1 GLU B 135     46.197  96.085  -1.470  1.00 50.34      A    O
ATOM   3752  OE2 GLU B 135     46.580  97.613  -0.028  1.00 46.87      A    O-1
ATOM   3753  C   GLU B 135     47.615  94.167   3.232  1.00 31.41      A    C
ATOM   3754  O   GLU B 135     48.784  94.379   3.151  1.00 31.46      A    O
ATOM   3755  N   GLU B 136     46.943  94.483   4.301  1.00 32.84      A    N
ATOM   3756  CA  GLU B 136     47.585  95.049   5.470  1.00 34.61      A    C
ATOM   3757  CB  GLU B 136     46.562  95.484   6.432  1.00 34.03      A    C
ATOM   3758  CG  GLU B 136     46.195  96.821   6.237  1.00 42.82      A    C
ATOM   3759  CD  GLU B 136     45.216  97.180   7.222  1.00 53.24      A    C
ATOM   3760  OE1 GLU B 136     44.306  96.385   7.446  1.00 54.83      A    O
ATOM   3761  OE2 GLU B 136     45.380  98.232   7.812  1.00 57.57      A    O-1
ATOM   3762  C   GLU B 136     48.589  94.210   6.228  1.00 35.03      A    C
ATOM   3763  O   GLU B 136     49.459  94.731   6.880  1.00 36.57      A    O
ATOM   3764  N   ASP B 137     48.440  92.913   6.171  1.00 33.08      A    N
ATOM   3765  CA  ASP B 137     49.321  92.050   6.858  1.00 32.03      A    C
ATOM   3766  CB  ASP B 137     48.611  90.777   7.250  1.00 33.70      A    C
ATOM   3767  CG  ASP B 137     47.667  90.966   8.379  1.00 38.49      A    C
ATOM   3768  OD1 ASP B 137     47.649  92.042   8.968  1.00 41.74      A    O
ATOM   3769  OD2 ASP B 137     46.925  90.038   8.665  1.00 40.80      A    O-1
ATOM   3770  C   ASP B 137     50.455  91.747   5.963  1.00 30.10      A    C
ATOM   3771  O   ASP B 137     51.351  91.076   6.342  1.00 29.27      A    O
ATOM   3772  N   GLY B 138     50.408  92.272   4.767  1.00 28.51      A    N
ATOM   3773  CA  GLY B 138     51.445  92.062   3.801  1.00 28.70      A    C
ATOM   3774  C   GLY B 138     51.395  90.813   2.982  1.00 29.40      A    C
ATOM   3775  O   GLY B 138     52.340  90.444   2.371  1.00 29.55      A    O
ATOM   3776  N   PHE B 139     50.291  90.126   3.023  1.00 28.41      A    N
ATOM   3777  CA  PHE B 139     50.084  88.994   2.160  1.00 28.55      A    C
ATOM   3778  CB  PHE B 139     49.035  88.083   2.750  1.00 27.97      A    C
ATOM   3779  CG  PHE B 139     49.365  87.613   4.091  1.00 28.46      A    C
```

Appendix 1

```
ATOM   3780  CD1 PHE B 139      50.562  87.080   4.351  1.00 29.05      A  C
ATOM   3781  CE1 PHE B 139      50.860  86.669   5.572  1.00 25.62      A  C
ATOM   3782  CZ  PHE B 139      49.995  86.752   6.534  1.00 22.19      A  C
ATOM   3783  CE2 PHE B 139      48.814  87.252   6.318  1.00 25.05      A  C
ATOM   3784  CD2 PHE B 139      48.485  87.698   5.106  1.00 27.94      A  C
ATOM   3785  C   PHE B 139      49.881  89.190   0.659  1.00 28.73      A  C
ATOM   3786  O   PHE B 139      50.287  88.393  -0.097  1.00 28.81      A  O
ATOM   3787  N   GLY B 140      49.240  90.246   0.245  1.00 28.77      A  N
ATOM   3788  CA  GLY B 140      49.166  90.537  -1.143  1.00 28.43      A  C
ATOM   3789  C   GLY B 140      48.245  91.681  -1.368  1.00 30.74      A  C
ATOM   3790  O   GLY B 140      47.537  92.077  -0.489  1.00 31.35      A  O
ATOM   3791  N   THR B 141      48.308  92.231  -2.559  1.00 30.49      A  N
ATOM   3792  CA  THR B 141      47.333  93.154  -3.072  1.00 30.25      A  C
ATOM   3793  CB  THR B 141      47.839  93.960  -4.226  1.00 32.08      A  C
ATOM   3794  OG1 THR B 141      48.418  93.122  -5.205  1.00 33.21      A  O
ATOM   3795  CG2 THR B 141      48.850  94.843  -3.751  1.00 32.93      A  C
ATOM   3796  C   THR B 141      45.986  92.575  -3.367  1.00 28.47      A  C
ATOM   3797  O   THR B 141      45.033  93.243  -3.245  1.00 27.36      A  O
ATOM   3798  N   ASP B 142      45.953  91.325  -3.782  1.00 27.79      A  N
ATOM   3799  CA  ASP B 142      44.765  90.663  -4.247  1.00 27.71      A  C
ATOM   3800  CB  ASP B 142      45.081  90.224  -5.648  1.00 28.82      A  C
ATOM   3801  CG  ASP B 142      43.949  89.612  -6.324  1.00 34.74      A  C
ATOM   3802  OD1 ASP B 142      43.074  89.126  -5.652  1.00 40.86      A  O
ATOM   3803  OD2 ASP B 142      43.940  89.599  -7.522  1.00 36.18      A  O-1
ATOM   3804  C   ASP B 142      44.263  89.484  -3.387  1.00 26.58      A  C
ATOM   3805  O   ASP B 142      44.936  88.525  -3.183  1.00 26.21      A  O
ATOM   3806  N   PRO B 143      43.048  89.589  -2.896  1.00 25.80      A  N
ATOM   3807  CA  PRO B 143      42.444  88.632  -1.986  1.00 26.46      A  C
ATOM   3808  CB  PRO B 143      41.179  89.336  -1.564  1.00 26.54      A  C
ATOM   3809  CG  PRO B 143      40.900  90.226  -2.572  1.00 26.34      A  C
ATOM   3810  CD  PRO B 143      42.085  90.606  -3.282  1.00 25.20      A  C
ATOM   3811  C   PRO B 143      42.151  87.233  -2.473  1.00 27.19      A  C
ATOM   3812  O   PRO B 143      42.114  86.361  -1.659  1.00 27.22      A  O
ATOM   3813  N   ILE B 144      41.896  87.030  -3.748  1.00 27.12      A  N
ATOM   3814  CA  ILE B 144      41.516  85.711  -4.206  1.00 27.01      A  C
ATOM   3815  CB  ILE B 144      40.192  85.720  -4.974  1.00 27.10      A  C
ATOM   3816  CG1 ILE B 144      40.404  86.324  -6.331  1.00 28.24      A  C
ATOM   3817  CD1 ILE B 144      39.307  86.236  -7.149  1.00 30.64      A  C
ATOM   3818  CG2 ILE B 144      39.158  86.430  -4.244  1.00 26.35      A  C
ATOM   3819  C   ILE B 144      42.536  84.903  -4.997  1.00 26.29      A  C
ATOM   3820  O   ILE B 144      42.383  83.735  -5.146  1.00 25.29      A  O
ATOM   3821  N   GLU B 145      43.579  85.548  -5.466  1.00 26.30      A  N
ATOM   3822  CA  GLU B 145      44.526  84.982  -6.376  1.00 27.40      A  C
ATOM   3823  CB  GLU B 145      45.549  86.036  -6.687  1.00 29.65      A  C
ATOM   3824  CG  GLU B 145      46.129  85.964  -8.075  1.00 40.46      A  C
ATOM   3825  CD  GLU B 145      47.355  86.819  -8.252  1.00 53.32      A  C
ATOM   3826  OE1 GLU B 145      47.743  87.498  -7.291  1.00 56.99      A  O
ATOM   3827  OE2 GLU B 145      47.924  86.827  -9.352  1.00 56.31      A  O-1
ATOM   3828  C   GLU B 145      45.252  83.795  -5.823  1.00 26.94      A  C
ATOM   3829  O   GLU B 145      45.467  82.840  -6.482  1.00 25.34      A  O
ATOM   3830  N   LYS B 146      45.662  83.897  -4.591  1.00 29.03      A  N
ATOM   3831  CA  LYS B 146      46.339  82.844  -3.910  1.00 30.06      A  C
ATOM   3832  CB  LYS B 146      47.804  83.142  -3.893  1.00 30.49      A  C
ATOM   3833  CG  LYS B 146      48.663  81.979  -3.735  1.00 37.00      A  C
```

Appendix 1

```
ATOM   3834  CD   LYS B 146      50.055  82.464  -3.557  1.00  47.24      A  C
ATOM   3835  CE   LYS B 146      50.242  83.808  -4.209  1.00  50.24      A  C
ATOM   3836  NZ   LYS B 146      50.990  84.800  -3.410  1.00  53.47      A  N
ATOM   3837  C    LYS B 146      45.882  82.816  -2.509  1.00  29.53      A  C
ATOM   3838  O    LYS B 146      45.618  83.820  -1.941  1.00  28.88      A  O
ATOM   3839  N    GLU B 147      45.791  81.620  -1.984  1.00  28.83      A  N
ATOM   3840  CA   GLU B 147      45.650  81.328  -0.605  1.00  27.56      A  C
ATOM   3841  CB   GLU B 147      46.885  81.758   0.117  1.00  27.46      A  C
ATOM   3842  CG   GLU B 147      47.993  80.828  -0.149  1.00  28.41      A  C
ATOM   3843  CD   GLU B 147      49.385  81.326   0.200  1.00  37.10      A  C
ATOM   3844  OE1  GLU B 147      50.320  80.550   0.056  1.00  42.73      A  O
ATOM   3845  OE2  GLU B 147      49.573  82.452   0.629  1.00  36.90      A  O-1
ATOM   3846  C    GLU B 147      44.410  81.961  -0.102  1.00  27.03      A  C
ATOM   3847  O    GLU B 147      43.492  82.024  -0.807  1.00  26.72      A  O
ATOM   3848  N    ASN B 148      44.391  82.423   1.126  1.00  26.43      A  N
ATOM   3849  CA   ASN B 148      43.273  83.150   1.682  1.00  25.29      A  C
ATOM   3850  CB   ASN B 148      43.177  84.531   1.078  1.00  23.70      A  C
ATOM   3851  CG   ASN B 148      42.526  85.507   1.986  1.00  23.88      A  C
ATOM   3852  OD1  ASN B 148      42.460  85.318   3.158  1.00  19.16      A  O
ATOM   3853  ND2  ASN B 148      42.028  86.542   1.438  1.00  18.39      A  N
ATOM   3854  C    ASN B 148      41.927  82.483   1.634  1.00  25.71      A  C
ATOM   3855  O    ASN B 148      40.975  83.083   1.340  1.00  25.83      A  O
ATOM   3856  N    ILE B 149      41.867  81.221   1.935  1.00  27.23      A  N
ATOM   3857  CA   ILE B 149      40.647  80.488   1.771  1.00  28.12      A  C
ATOM   3858  CB   ILE B 149      40.879  78.967   1.715  1.00  28.83      A  C
ATOM   3859  CG1  ILE B 149      39.705  78.287   1.050  1.00  29.63      A  C
ATOM   3860  CD1  ILE B 149      39.477  78.677  -0.310  1.00  27.65      A  C
ATOM   3861  CG2  ILE B 149      41.098  78.377   3.068  1.00  26.00      A  C
ATOM   3862  C    ILE B 149      39.567  80.930   2.729  1.00  29.61      A  C
ATOM   3863  O    ILE B 149      38.422  80.736   2.495  1.00  30.39      A  O
ATOM   3864  N    MET B 150      39.957  81.554   3.811  1.00  31.80      A  N
ATOM   3865  CA   MET B 150      38.969  81.987   4.731  1.00  33.24      A  C
ATOM   3866  CB   MET B 150      39.633  82.675   5.897  1.00  34.93      B  C
ATOM   3867  CG   MET B 150      40.922  83.337   5.570  1.00  39.56      B  C
ATOM   3868  SD   MET B 150      41.753  84.016   6.994  1.00  57.18      B  S
ATOM   3869  CE   MET B 150      40.483  85.026   7.660  1.00  50.44      B  C
ATOM   3870  C    MET B 150      38.087  82.983   4.065  1.00  31.86      A  C
ATOM   3871  O    MET B 150      36.906  82.861   4.092  1.00  33.40      A  O
ATOM   3872  N    TYR B 151      38.648  83.990   3.461  1.00  27.39      A  N
ATOM   3873  CA   TYR B 151      37.808  84.848   2.727  1.00  24.61      A  C
ATOM   3874  CB   TYR B 151      38.600  86.068   2.405  1.00  23.24      A  C
ATOM   3875  CG   TYR B 151      37.915  87.015   1.543  1.00  19.88      A  C
ATOM   3876  CD1  TYR B 151      36.924  87.805   2.021  1.00  18.74      A  C
ATOM   3877  CE1  TYR B 151      36.320  88.647   1.233  1.00  18.48      A  C
ATOM   3878  CZ   TYR B 151      36.696  88.724  -0.053  1.00  15.89      A  C
ATOM   3879  OH   TYR B 151      36.120  89.577  -0.886  1.00  11.54      A  O
ATOM   3880  CE2  TYR B 151      37.669  87.971  -0.530  1.00  15.90      A  C
ATOM   3881  CD2  TYR B 151      38.271  87.135   0.251  1.00  18.82      A  C
ATOM   3882  C    TYR B 151      37.167  84.306   1.469  1.00  23.59      A  C
ATOM   3883  O    TYR B 151      36.015  84.431   1.285  1.00  22.89      A  O
ATOM   3884  N    LYS B 152      37.951  83.737   0.593  1.00  22.89      A  N
ATOM   3885  CA   LYS B 152      37.496  83.310  -0.710  1.00  23.57      A  C
ATOM   3886  CB   LYS B 152      38.638  83.224  -1.721  1.00  22.92      A  C
ATOM   3887  CG   LYS B 152      39.461  82.016  -1.735  1.00  21.67      A  C
```

Appendix 1

```
ATOM   3888  CD   LYS B 152      40.573  82.287  -2.626  1.00 20.85      A  C
ATOM   3889  CE   LYS B 152      41.521  81.181  -2.719  1.00 19.22      A  C
ATOM   3890  NZ   LYS B 152      42.616  81.615  -3.511  1.00 15.24      A  N
ATOM   3891  C    LYS B 152      36.501  82.168  -0.763  1.00 22.82      A  C
ATOM   3892  O    LYS B 152      35.649  82.141  -1.586  1.00 22.12      A  O
ATOM   3893  N    GLY B 153      36.636  81.241   0.150  1.00 21.16      A  N
ATOM   3894  CA   GLY B 153      35.703  80.171   0.279  1.00 20.63      A  C
ATOM   3895  C    GLY B 153      34.321  80.616   0.643  1.00 22.06      A  C
ATOM   3896  O    GLY B 153      33.374  80.114   0.148  1.00 22.83      A  O
ATOM   3897  N    HIS B 154      34.214  81.567   1.525  1.00 21.59      A  N
ATOM   3898  CA   HIS B 154      32.957  82.132   1.822  1.00 22.10      A  C
ATOM   3899  CB   HIS B 154      33.090  83.043   3.010  1.00 21.52      A  C
ATOM   3900  CG   HIS B 154      33.060  82.332   4.310  1.00 25.68      A  C
ATOM   3901  ND1  HIS B 154      31.944  81.709   4.777  1.00 26.03      A  N
ATOM   3902  CE1  HIS B 154      32.212  81.160   5.936  1.00 26.47      A  C
ATOM   3903  NE2  HIS B 154      33.452  81.427   6.246  1.00 24.31      A  N
ATOM   3904  CD2  HIS B 154      34.003  82.157   5.248  1.00 27.56      A  C
ATOM   3905  C    HIS B 154      32.356  82.852   0.654  1.00 21.91      A  C
ATOM   3906  O    HIS B 154      31.219  82.704   0.402  1.00 23.96      A  O
ATOM   3907  N    LEU B 155      33.144  83.621  -0.060  1.00 21.04      A  N
ATOM   3908  CA   LEU B 155      32.699  84.378  -1.188  1.00 20.02      A  C
ATOM   3909  CB   LEU B 155      33.834  85.237  -1.705  1.00 18.05      A  C
ATOM   3910  CG   LEU B 155      33.515  86.107  -2.888  1.00 16.72      A  C
ATOM   3911  CD1  LEU B 155      32.515  87.087  -2.540  1.00 12.86      A  C
ATOM   3912  CD2  LEU B 155      34.685  86.731  -3.403  1.00 12.96      A  C
ATOM   3913  C    LEU B 155      32.221  83.453  -2.255  1.00 20.72      A  C
ATOM   3914  O    LEU B 155      31.279  83.704  -2.925  1.00 20.33      A  O
ATOM   3915  N    ASN B 156      32.918  82.360  -2.406  1.00 22.18      A  N
ATOM   3916  CA   ASN B 156      32.521  81.360  -3.329  1.00 22.35      A  C
ATOM   3917  CB   ASN B 156      33.620  80.385  -3.597  1.00 20.35      A  C
ATOM   3918  CG   ASN B 156      33.585  79.927  -4.983  1.00 21.56      A  C
ATOM   3919  OD1  ASN B 156      33.527  80.717  -5.848  1.00 22.95      A  O
ATOM   3920  ND2  ASN B 156      33.582  78.665  -5.197  1.00 16.00      A  N
ATOM   3921  C    ASN B 156      31.237  80.658  -3.041  1.00 21.93      A  C
ATOM   3922  O    ASN B 156      30.519  80.343  -3.910  1.00 23.24      A  O
ATOM   3923  N    LEU B 157      30.988  80.371  -1.801  1.00 22.47      A  N
ATOM   3924  CA   LEU B 157      29.745  79.839  -1.387  1.00 23.91      A  C
ATOM   3925  CB   LEU B 157      29.860  79.351   0.042  1.00 23.10      A  C
ATOM   3926  CG   LEU B 157      28.753  78.517   0.633  1.00 24.96      A  C
ATOM   3927  CD1  LEU B 157      28.316  77.559  -0.332  1.00 24.10      A  C
ATOM   3928  CD2  LEU B 157      29.170  77.837   1.821  1.00 17.53      A  C
ATOM   3929  C    LEU B 157      28.620  80.818  -1.567  1.00 24.86      A  C
ATOM   3930  O    LEU B 157      27.563  80.456  -1.935  1.00 25.21      A  O
ATOM   3931  N    MET B 158      28.862  82.062  -1.249  1.00 25.31      A  N
ATOM   3932  CA   MET B 158      27.885  83.097  -1.433  1.00 25.64      A  C
ATOM   3933  CB   MET B 158      28.303  84.371  -0.745  1.00 26.52      B  C
ATOM   3934  CG   MET B 158      28.430  84.284   0.726  1.00 24.22      B  C
ATOM   3935  SD   MET B 158      29.289  85.666   1.389  1.00 22.12      B  S
ATOM   3936  CE   MET B 158      28.368  86.949   0.757  1.00 18.29      B  C
ATOM   3937  C    MET B 158      27.528  83.378  -2.871  1.00 25.79      A  C
ATOM   3938  O    MET B 158      26.402  83.617  -3.163  1.00 27.59      A  O
ATOM   3939  N    TYR B 159      28.490  83.354  -3.765  1.00 24.37      A  N
ATOM   3940  CA   TYR B 159      28.235  83.601  -5.147  1.00 23.41      A  C
ATOM   3941  CB   TYR B 159      29.486  83.342  -5.959  1.00 22.18      A  C
```

Appendix 1

```
ATOM   3942  CG   TYR B 159      30.460  84.444  -6.133  1.00 23.29           A    C
ATOM   3943  CD1  TYR B 159      30.070  85.739  -6.157  1.00 26.04           A    C
ATOM   3944  CE1  TYR B 159      30.964  86.712  -6.325  1.00 24.35           A    C
ATOM   3945  CZ   TYR B 159      32.255  86.400  -6.485  1.00 24.79           A    C
ATOM   3946  OH   TYR B 159      33.156  87.375  -6.643  1.00 26.51           A    O
ATOM   3947  CE2  TYR B 159      32.660  85.132  -6.475  1.00 18.66           A    C
ATOM   3948  CD2  TYR B 159      31.789  84.174  -6.309  1.00 22.40           A    C
ATOM   3949  C    TYR B 159      27.272  82.533  -5.561  1.00 24.46           A    C
ATOM   3950  O    TYR B 159      26.329  82.769  -6.245  1.00 23.59           A    O
ATOM   3951  N    GLY B 160      27.565  81.326  -5.163  1.00 24.98           A    N
ATOM   3952  CA   GLY B 160      26.738  80.201  -5.463  1.00 26.66           A    C
ATOM   3953  C    GLY B 160      25.341  80.068  -4.916  1.00 26.45           A    C
ATOM   3954  O    GLY B 160      24.481  79.638  -5.592  1.00 28.45           A    O
ATOM   3955  N    LEU B 161      25.138  80.375  -3.669  1.00 25.55           A    N
ATOM   3956  CA   LEU B 161      23.837  80.392  -3.090  1.00 25.14           A    C
ATOM   3957  CB   LEU B 161      23.913  80.568  -1.588  1.00 24.61           A    C
ATOM   3958  CG   LEU B 161      24.648  79.494  -0.837  1.00 24.85           A    C
ATOM   3959  CD1  LEU B 161      24.921  79.910   0.535  1.00 26.87           A    C
ATOM   3960  CD2  LEU B 161      23.895  78.253  -0.868  1.00 21.96           A    C
ATOM   3961  C    LEU B 161      23.004  81.453  -3.724  1.00 24.94           A    C
ATOM   3962  O    LEU B 161      21.836  81.281  -3.886  1.00 23.56           A    O
ATOM   3963  N    TYR B 162      23.634  82.550  -4.089  1.00 24.88           A    N
ATOM   3964  CA   TYR B 162      22.943  83.667  -4.638  1.00 25.62           A    C
ATOM   3965  CB   TYR B 162      23.920  84.797  -4.885  1.00 25.02           A    C
ATOM   3966  CG   TYR B 162      23.360  85.859  -5.741  1.00 24.92           A    C
ATOM   3967  CD1  TYR B 162      22.522  86.786  -5.225  1.00 24.33           A    C
ATOM   3968  CE1  TYR B 162      21.998  87.711  -5.989  1.00 22.87           A    C
ATOM   3969  CZ   TYR B 162      22.270  87.729  -7.286  1.00 22.64           A    C
ATOM   3970  OH   TYR B 162      21.744  88.670  -8.048  1.00 23.72           A    O
ATOM   3971  CE2  TYR B 162      23.078  86.831  -7.839  1.00 24.00           A    C
ATOM   3972  CD2  TYR B 162      23.626  85.907  -7.081  1.00 24.46           A    C
ATOM   3973  C    TYR B 162      22.253  83.301  -5.912  1.00 27.33           A    C
ATOM   3974  O    TYR B 162      21.122  83.618  -6.100  1.00 29.01           A    O
ATOM   3975  N    GLN B 163      22.968  82.628  -6.776  1.00 29.00           A    N
ATOM   3976  CA   GLN B 163      22.477  82.106  -8.011  1.00 30.26           A    C
ATOM   3977  CB   GLN B 163      23.627  81.491  -8.750  1.00 29.88           A    C
ATOM   3978  CG   GLN B 163      23.309  81.156 -10.117  1.00 31.21           A    C
ATOM   3979  CD   GLN B 163      24.442  81.325 -11.007  1.00 34.81           A    C
ATOM   3980  OE1  GLN B 163      25.429  81.905 -10.656  1.00 38.47           A    O
ATOM   3981  NE2  GLN B 163      24.308  80.840 -12.182  1.00 35.23           A    N
ATOM   3982  C    GLN B 163      21.407  81.068  -7.826  1.00 30.59           A    C
ATOM   3983  O    GLN B 163      20.456  81.013  -8.544  1.00 31.57           A    O
ATOM   3984  N    LEU B 164      21.584  80.222  -6.855  1.00 31.04           A    N
ATOM   3985  CA   LEU B 164      20.580  79.274  -6.489  1.00 32.58           A    C
ATOM   3986  CB   LEU B 164      21.150  78.411  -5.393  1.00 32.82           A    C
ATOM   3987  CG   LEU B 164      21.300  76.913  -5.386  1.00 33.80           A    C
ATOM   3988  CD1  LEU B 164      21.706  76.341  -6.677  1.00 27.54           A    C
ATOM   3989  CD2  LEU B 164      22.325  76.637  -4.381  1.00 35.86           A    C
ATOM   3990  C    LEU B 164      19.269  79.865  -5.970  1.00 33.74           A    C
ATOM   3991  O    LEU B 164      18.222  79.435  -6.347  1.00 35.16           A    O
ATOM   3992  N    VAL B 165      19.318  80.790  -5.044  1.00 32.59           A    N
ATOM   3993  CA   VAL B 165      18.115  81.411  -4.615  1.00 31.93           A    C
ATOM   3994  CB   VAL B 165      18.384  82.338  -3.464  1.00 32.56           A    C
ATOM   3995  CG1  VAL B 165      17.187  83.041  -3.060  1.00 30.33           A    C
```

Appendix 1

```
ATOM   3996  CG2 VAL B 165      18.947  81.626  -2.347  1.00 31.45      A   C
ATOM   3997  C   VAL B 165      17.541  82.185  -5.762  1.00 32.46      A   C
ATOM   3998  O   VAL B 165      16.392  82.112  -6.066  1.00 32.18      A   O
ATOM   3999  N   THR B 166      18.371  82.950  -6.413  1.00 32.64      A   N
ATOM   4000  CA  THR B 166      17.929  83.675  -7.560  1.00 33.00      A   C
ATOM   4001  CB  THR B 166      18.515  85.091  -7.632  1.00 33.56      A   C
ATOM   4002  OG1 THR B 166      19.767  85.069  -8.276  1.00 34.36      A   O
ATOM   4003  CG2 THR B 166      18.710  85.653  -6.306  1.00 33.53      A   C
ATOM   4004  C   THR B 166      18.258  82.904  -8.817  1.00 34.33      A   C
ATOM   4005  O   THR B 166      19.087  82.020  -8.859  1.00 35.15      A   O
ATOM   4006  N   GLY B 167      17.586  83.224  -9.874  1.00 34.47      A   N
ATOM   4007  CA  GLY B 167      18.027  82.691 -11.118  1.00 33.76      A   C
ATOM   4008  C   GLY B 167      19.255  83.381 -11.613  1.00 32.89      A   C
ATOM   4009  O   GLY B 167      19.880  82.922 -12.499  1.00 32.33      A   O
ATOM   4010  N   SER B 168      19.576  84.502 -11.006  1.00 32.72      A   N
ATOM   4011  CA  SER B 168      20.385  85.530 -11.575  1.00 32.84      A   C
ATOM   4012  CB  SER B 168      20.458  86.701 -10.653  1.00 32.73      A   C
ATOM   4013  OG  SER B 168      21.397  87.604 -11.131  1.00 32.59      A   O
ATOM   4014  C   SER B 168      21.732  85.081 -11.816  1.00 32.79      A   C
ATOM   4015  O   SER B 168      22.277  84.394 -11.043  1.00 33.80      A   O
ATOM   4016  N   ARG B 169      22.303  85.483 -12.911  1.00 33.39      A   N
ATOM   4017  CA  ARG B 169      23.650  85.088 -13.143  1.00 33.48      A   C
ATOM   4018  CB  ARG B 169      23.723  83.976 -14.127  1.00 34.44      A   C
ATOM   4019  CG  ARG B 169      24.394  84.374 -15.292  1.00 38.97      A   C
ATOM   4020  CD  ARG B 169      23.489  84.050 -16.353  1.00 47.88      A   C
ATOM   4021  NE  ARG B 169      22.862  82.782 -16.109  1.00 46.58      A   N
ATOM   4022  CZ  ARG B 169      22.969  81.789 -16.954  1.00 50.83      A   C
ATOM   4023  NH1 ARG B 169      23.678  81.963 -18.034  1.00 52.74      A   N
ATOM   4024  NH2 ARG B 169      22.382  80.646 -16.731  1.00 49.00      A   N
ATOM   4025  C   ARG B 169      24.601  86.213 -13.444  1.00 32.69      A   C
ATOM   4026  O   ARG B 169      25.494  86.101 -14.207  1.00 32.42      A   O
ATOM   4027  N   ARG B 170      24.389  87.293 -12.745  1.00 33.64      A   N
ATOM   4028  CA  ARG B 170      25.268  88.422 -12.688  1.00 34.97      A   C
ATOM   4029  CB  ARG B 170      24.577  89.522 -11.944  1.00 36.48      A   C
ATOM   4030  CG  ARG B 170      24.558  89.297 -10.533  1.00 39.84      A   C
ATOM   4031  CD  ARG B 170      23.927  90.426  -9.931  1.00 48.55      A   C
ATOM   4032  NE  ARG B 170      24.739  91.588 -10.084  1.00 52.10      A   N
ATOM   4033  CZ  ARG B 170      24.312  92.802  -9.829  1.00 56.85      A   C
ATOM   4034  NH1 ARG B 170      23.076  92.975  -9.453  1.00 59.69      A   N
ATOM   4035  NH2 ARG B 170      25.109  93.831  -9.980  1.00 55.52      A   N
ATOM   4036  C   ARG B 170      26.610  88.192 -12.045  1.00 34.20      A   C
ATOM   4037  O   ARG B 170      27.512  88.929 -12.270  1.00 32.93      A   O
ATOM   4038  N   TYR B 171      26.723  87.201 -11.187  1.00 32.96      A   N
ATOM   4039  CA  TYR B 171      27.989  86.896 -10.576  1.00 32.63      A   C
ATOM   4040  CB  TYR B 171      27.851  86.742  -9.065  1.00 32.27      A   C
ATOM   4041  CG  TYR B 171      27.462  87.982  -8.356  1.00 31.10      A   C
ATOM   4042  CD1 TYR B 171      28.192  89.113  -8.475  1.00 31.66      A   C
ATOM   4043  CE1 TYR B 171      27.839  90.220  -7.857  1.00 30.26      A   C
ATOM   4044  CZ  TYR B 171      26.751  90.228  -7.104  1.00 32.15      A   C
ATOM   4045  OH  TYR B 171      26.395  91.341  -6.462  1.00 37.49      A   O
ATOM   4046  CE2 TYR B 171      26.012  89.135  -6.965  1.00 31.79      A   C
ATOM   4047  CD2 TYR B 171      26.369  88.020  -7.587  1.00 32.21      A   C
ATOM   4048  C   TYR B 171      28.653  85.672 -11.145  1.00 32.24      A   C
ATOM   4049  O   TYR B 171      29.578  85.210 -10.590  1.00 33.86      A   O
```

Appendix 1

```
ATOM   4050  N   GLU B 172      28.129  85.136 -12.218  1.00 31.59      A   N
ATOM   4051  CA  GLU B 172      28.534  83.855 -12.771  1.00 31.89      A   C
ATOM   4052  CB  GLU B 172      27.574  83.450 -13.877  1.00 33.60      A   C
ATOM   4053  CG  GLU B 172      27.764  82.059 -14.358  1.00 38.30      A   C
ATOM   4054  CD  GLU B 172      26.821  81.648 -15.414  1.00 45.71      A   C
ATOM   4055  OE1 GLU B 172      26.925  82.143 -16.523  1.00 47.08      A   O
ATOM   4056  OE2 GLU B 172      25.984  80.792 -15.168  1.00 49.89      A   O-1
ATOM   4057  C   GLU B 172      29.932  83.730 -13.295  1.00 30.36      A   C
ATOM   4058  O   GLU B 172      30.559  82.741 -13.134  1.00 31.55      A   O
ATOM   4059  N   ALA B 173      30.378  84.743 -13.984  1.00 29.41      A   N
ATOM   4060  CA  ALA B 173      31.689  84.789 -14.542  1.00 28.02      A   C
ATOM   4061  CB  ALA B 173      31.807  85.975 -15.373  1.00 26.37      A   C
ATOM   4062  C   ALA B 173      32.737  84.797 -13.478  1.00 28.29      A   C
ATOM   4063  O   ALA B 173      33.771  84.215 -13.637  1.00 27.83      A   O
ATOM   4064  N   GLU B 174      32.460  85.544 -12.426  1.00 27.69      A   N
ATOM   4065  CA  GLU B 174      33.232  85.601 -11.200  1.00 27.82      A   C
ATOM   4066  CB  GLU B 174      32.656  86.662 -10.318  1.00 29.07      A   C
ATOM   4067  CG  GLU B 174      33.151  87.973 -10.596  1.00 35.77      A   C
ATOM   4068  CD  GLU B 174      32.158  89.012 -10.309  1.00 45.10      A   C
ATOM   4069  OE1 GLU B 174      31.115  89.040 -10.943  1.00 52.19      A   O
ATOM   4070  OE2 GLU B 174      32.412  89.810  -9.437  1.00 48.82      A   O-1
ATOM   4071  C   GLU B 174      33.265  84.339 -10.386  1.00 25.67      A   C
ATOM   4072  O   GLU B 174      34.254  83.984  -9.844  1.00 24.10      A   O
ATOM   4073  N   HIS B 175      32.125  83.702 -10.282  1.00 24.19      A   N
ATOM   4074  CA  HIS B 175      31.947  82.438  -9.630  1.00 24.13      A   C
ATOM   4075  CB  HIS B 175      30.466  82.146  -9.676  1.00 24.73      A   C
ATOM   4076  CG  HIS B 175      30.018  80.997  -8.845  1.00 26.19      A   C
ATOM   4077  ND1 HIS B 175      30.746  80.489  -7.812  1.00 33.34      A   N
ATOM   4078  CE1 HIS B 175      30.108  79.485  -7.262  1.00 28.82      A   C
ATOM   4079  NE2 HIS B 175      28.981  79.327  -7.906  1.00 29.93      A   N
ATOM   4080  CD2 HIS B 175      28.897  80.263  -8.894  1.00 26.94      A   C
ATOM   4081  C   HIS B 175      32.739  81.340 -10.304  1.00 23.45      A   C
ATOM   4082  O   HIS B 175      33.331  80.544  -9.665  1.00 25.28      A   O
ATOM   4083  N   ALA B 176      32.743  81.294 -11.602  1.00 21.79      A   N
ATOM   4084  CA  ALA B 176      33.508  80.320 -12.291  1.00 21.74      A   C
ATOM   4085  CB  ALA B 176      33.151  80.339 -13.698  1.00 22.33      A   C
ATOM   4086  C   ALA B 176      34.994  80.501 -12.120  1.00 22.30      A   C
ATOM   4087  O   ALA B 176      35.713  79.566 -12.037  1.00 21.94      A   O
ATOM   4088  N   HIS B 177      35.432  81.735 -12.151  1.00 22.12      A   N
ATOM   4089  CA  HIS B 177      36.800  82.090 -12.006  1.00 23.34      A   C
ATOM   4090  CB  HIS B 177      36.920  83.576 -12.261  1.00 22.97      A   C
ATOM   4091  CG  HIS B 177      38.306  84.108 -12.166  1.00 31.68      A   C
ATOM   4092  ND1 HIS B 177      38.857  84.548 -10.995  1.00 33.38      A   N
ATOM   4093  CE1 HIS B 177      40.080  84.960 -11.216  1.00 31.63      A   C
ATOM   4094  NE2 HIS B 177      40.345  84.798 -12.490  1.00 31.58      A   N
ATOM   4095  CD2 HIS B 177      39.247  84.286 -13.108  1.00 34.49      A   C
ATOM   4096  C   HIS B 177      37.342  81.744 -10.638  1.00 23.85      A   C
ATOM   4097  O   HIS B 177      38.403  81.203 -10.521  1.00 24.26      A   O
ATOM   4098  N   LEU B 178      36.585  82.053  -9.610  1.00 23.69      A   N
ATOM   4099  CA  LEU B 178      36.945  81.696  -8.269  1.00 23.70      A   C
ATOM   4100  CB  LEU B 178      36.040  82.388  -7.255  1.00 22.93      A   C
ATOM   4101  CG  LEU B 178      36.479  82.318  -5.801  1.00 19.55      A   C
ATOM   4102  CD1 LEU B 178      37.900  82.687  -5.647  1.00 13.07      A   C
ATOM   4103  CD2 LEU B 178      35.638  83.146  -4.957  1.00 17.06      A   C
```

Appendix 1

```
ATOM   4104  C    LEU B 178      36.988  80.214  -8.008  1.00 24.96           A    C
ATOM   4105  O    LEU B 178      37.864  79.744  -7.352  1.00 25.90           A    O
ATOM   4106  N    THR B 179      36.018  79.486  -8.515  1.00 25.85           A    N
ATOM   4107  CA   THR B 179      35.974  78.042  -8.401  1.00 24.05           A    C
ATOM   4108  CB   THR B 179      34.727  77.477  -9.049  1.00 22.72           A    C
ATOM   4109  OG1  THR B 179      33.592  78.073  -8.493  1.00 23.25           A    O
ATOM   4110  CG2  THR B 179      34.619  76.072  -8.839  1.00 16.18           A    C
ATOM   4111  C    THR B 179      37.156  77.414  -9.088  1.00 23.45           A    C
ATOM   4112  O    THR B 179      37.677  76.480  -8.635  1.00 24.26           A    O
ATOM   4113  N    ARG B 180      37.555  77.914 -10.216  1.00 23.01           A    N
ATOM   4114  CA   ARG B 180      38.724  77.383 -10.876  1.00 25.60           A    C
ATOM   4115  CB   ARG B 180      38.801  77.796 -12.320  1.00 25.01           A    C
ATOM   4116  CG   ARG B 180      37.539  77.695 -12.967  1.00 25.59           A    C
ATOM   4117  CD   ARG B 180      37.673  77.874 -14.382  1.00 33.75           A    C
ATOM   4118  NE   ARG B 180      36.739  76.989 -14.999  1.00 41.80           A    N
ATOM   4119  CZ   ARG B 180      35.696  77.363 -15.692  1.00 40.67           A    C
ATOM   4120  NH1  ARG B 180      35.461  78.634 -15.931  1.00 35.47           A    N
ATOM   4121  NH2  ARG B 180      34.922  76.434 -16.176  1.00 36.82           A    N
ATOM   4122  C    ARG B 180      40.033  77.597 -10.185  1.00 26.15           A    C
ATOM   4123  O    ARG B 180      40.865  76.766 -10.238  1.00 27.82           A    O
ATOM   4124  N    ILE B 181      40.233  78.728  -9.564  1.00 26.54           A    N
ATOM   4125  CA   ILE B 181      41.416  78.923  -8.799  1.00 26.50           A    C
ATOM   4126  CB   ILE B 181      41.492  80.344  -8.300  1.00 28.05           A    C
ATOM   4127  CG1  ILE B 181      41.940  81.284  -9.384  1.00 26.33           A    C
ATOM   4128  CD1  ILE B 181      41.385  82.632  -9.180  1.00 25.42           A    C
ATOM   4129  CG2  ILE B 181      42.405  80.466  -7.154  1.00 27.90           A    C
ATOM   4130  C    ILE B 181      41.463  77.974  -7.627  1.00 25.81           A    C
ATOM   4131  O    ILE B 181      42.440  77.373  -7.381  1.00 25.76           A    O
ATOM   4132  N    ILE B 182      40.366  77.828  -6.934  1.00 26.54           A    N
ATOM   4133  CA   ILE B 182      40.277  76.929  -5.817  1.00 25.83           A    C
ATOM   4134  CB   ILE B 182      38.913  77.048  -5.142  1.00 24.79           A    C
ATOM   4135  CG1  ILE B 182      38.798  78.348  -4.389  1.00 21.64           A    C
ATOM   4136  CD1  ILE B 182      37.428  78.691  -4.007  1.00 19.67           A    C
ATOM   4137  CG2  ILE B 182      38.680  75.967  -4.191  1.00 24.08           A    C
ATOM   4138  C    ILE B 182      40.526  75.508  -6.260  1.00 27.42           A    C
ATOM   4139  O    ILE B 182      41.207  74.785  -5.611  1.00 27.64           A    O
ATOM   4140  N    HIS B 183      39.996  75.124  -7.396  1.00 28.21           A    N
ATOM   4141  CA   HIS B 183      40.226  73.816  -7.899  1.00 28.62           A    C
ATOM   4142  CB   HIS B 183      39.375  73.589  -9.135  1.00 29.55           A    C
ATOM   4143  CG   HIS B 183      39.821  72.429  -9.953  1.00 30.53           A    C
ATOM   4144  ND1  HIS B 183      39.576  71.134  -9.581  1.00 30.13           A    N
ATOM   4145  CE1  HIS B 183      40.120  70.325 -10.459  1.00 32.95           A    C
ATOM   4146  NE2  HIS B 183      40.721  71.050 -11.375  1.00 32.02           A    N
ATOM   4147  CD2  HIS B 183      40.551  72.367 -11.082  1.00 28.96           A    C
ATOM   4148  C    HIS B 183      41.687  73.571  -8.207  1.00 28.72           A    C
ATOM   4149  O    HIS B 183      42.192  72.549  -7.913  1.00 30.09           A    O
ATOM   4150  N    ASP B 184      42.348  74.513  -8.830  1.00 28.30           A    N
ATOM   4151  CA   ASP B 184      43.753  74.402  -9.112  1.00 29.07           A    C
ATOM   4152  CB   ASP B 184      44.192  75.510 -10.033  1.00 29.95           A    C
ATOM   4153  CG   ASP B 184      43.743  75.319 -11.391  1.00 32.36           A    C
ATOM   4154  OD1  ASP B 184      43.508  74.186 -11.791  1.00 32.70           A    O
ATOM   4155  OD2  ASP B 184      43.658  76.313 -12.077  1.00 32.67           A    O-1
ATOM   4156  C    ASP B 184      44.661  74.395  -7.925  1.00 29.09           A    C
ATOM   4157  O    ASP B 184      45.642  73.714  -7.928  1.00 28.90           A    O
```

Appendix 1

```
ATOM   4158  N   GLU B 185      44.355  75.223  -6.942  1.00 28.70           A   N
ATOM   4159  CA  GLU B 185      45.119  75.273  -5.726  1.00 27.72           A   C
ATOM   4160  CB  GLU B 185      44.720  76.430  -4.838  1.00 27.01           A   C
ATOM   4161  CG  GLU B 185      45.039  77.758  -5.335  1.00 24.80           A   C
ATOM   4162  CD  GLU B 185      44.923  78.789  -4.275  1.00 30.54           A   C
ATOM   4163  OE1 GLU B 185      43.929  79.488  -4.228  1.00 27.38           A   O
ATOM   4164  OE2 GLU B 185      45.834  78.920  -3.474  1.00 28.56           A   O-1
ATOM   4165  C   GLU B 185      45.015  73.970  -4.990  1.00 26.56           A   C
ATOM   4166  O   GLU B 185      45.971  73.508  -4.498  1.00 24.89           A   O
ATOM   4167  N   ILE B 186      43.850  73.367  -4.966  1.00 26.17           A   N
ATOM   4168  CA  ILE B 186      43.732  72.046  -4.431  1.00 26.20           A   C
ATOM   4169  CB  ILE B 186      42.279  71.575  -4.339  1.00 26.22           A   C
ATOM   4170  CG1 ILE B 186      41.523  72.285  -3.253  1.00 24.65           A   C
ATOM   4171  CD1 ILE B 186      40.070  72.294  -3.459  1.00 21.06           A   C
ATOM   4172  CG2 ILE B 186      42.208  70.182  -3.978  1.00 23.25           A   C
ATOM   4173  C   ILE B 186      44.552  71.059  -5.247  1.00 27.31           A   C
ATOM   4174  O   ILE B 186      45.209  70.232  -4.722  1.00 29.07           A   O
ATOM   4175  N   ALA B 187      44.542  71.156  -6.544  1.00 27.64           A   N
ATOM   4176  CA  ALA B 187      45.269  70.207  -7.328  1.00 27.89           A   C
ATOM   4177  CB  ALA B 187      44.919  70.341  -8.746  1.00 28.51           A   C
ATOM   4178  C   ALA B 187      46.773  70.217  -7.122  1.00 29.17           A   C
ATOM   4179  O   ALA B 187      47.391  69.207  -7.156  1.00 29.95           A   O
ATOM   4180  N   ALA B 188      47.345  71.381  -6.943  1.00 29.31           A   N
ATOM   4181  CA  ALA B 188      48.751  71.551  -6.611  1.00 29.94           A   C
ATOM   4182  CB  ALA B 188      49.194  72.915  -7.047  1.00 28.19           A   C
ATOM   4183  C   ALA B 188      49.302  71.242  -5.189  1.00 31.24           A   C
ATOM   4184  O   ALA B 188      50.471  71.272  -5.014  1.00 31.38           A   O
ATOM   4185  N   ASN B 189      48.486  71.067  -4.173  1.00 30.61           A   N
ATOM   4186  CA  ASN B 189      48.993  71.099  -2.818  1.00 32.34           A   C
ATOM   4187  CB  ASN B 189      47.921  71.593  -1.860  1.00 31.67           A   C
ATOM   4188  CG  ASN B 189      47.950  73.058  -1.700  1.00 31.43           A   C
ATOM   4189  OD1 ASN B 189      48.962  73.659  -1.818  1.00 32.90           A   O
ATOM   4190  ND2 ASN B 189      46.840  73.635  -1.442  1.00 26.05           A   N
ATOM   4191  C   ASN B 189      49.881  70.055  -2.134  1.00 34.60           A   C
ATOM   4192  O   ASN B 189      50.882  70.342  -1.524  1.00 35.17           A   O
ATOM   4193  N   PRO B 190      49.431  68.814  -2.242  1.00 36.73           A   N
ATOM   4194  CA  PRO B 190      49.887  67.813  -1.298  1.00 39.10           A   C
ATOM   4195  CB  PRO B 190      51.288  68.257  -0.991  1.00 38.91           A   C
ATOM   4196  CG  PRO B 190      51.393  69.609  -1.524  1.00 37.58           A   C
ATOM   4197  CD  PRO B 190      50.169  70.055  -2.096  1.00 39.99           A   C
ATOM   4198  C   PRO B 190      48.908  68.181  -0.204  1.00 40.90           A   C
ATOM   4199  O   PRO B 190      48.412  69.263  -0.229  1.00 43.11           A   O
ATOM   4200  N   PHE B 191      48.433  67.310   0.618  1.00 40.78           A   N
ATOM   4201  CA  PHE B 191      47.391  67.768   1.529  1.00 40.97           A   C
ATOM   4202  CB  PHE B 191      47.954  68.710   2.620  1.00 38.96           A   C
ATOM   4203  CG  PHE B 191      48.171  70.122   2.207  1.00 36.60           A   C
ATOM   4204  CD1 PHE B 191      47.138  70.993   2.102  1.00 32.41           A   C
ATOM   4205  CE1 PHE B 191      47.366  72.273   1.751  1.00 31.62           A   C
ATOM   4206  CZ  PHE B 191      48.608  72.704   1.532  1.00 26.58           A   C
ATOM   4207  CE2 PHE B 191      49.626  71.872   1.642  1.00 27.00           A   C
ATOM   4208  CD2 PHE B 191      49.422  70.601   1.997  1.00 31.48           A   C
ATOM   4209  C   PHE B 191      46.021  68.198   0.927  1.00 41.39           A   C
ATOM   4210  O   PHE B 191      45.842  68.190  -0.251  1.00 41.86           A   O
ATOM   4211  N   ALA B 192      45.104  68.627   1.794  1.00 43.13           A   N
```

Appendix 1

```
ATOM   4212  CA   ALA B 192      43.677  68.970   1.604  1.00 40.81      A    C
ATOM   4213  CB   ALA B 192      43.106  69.279   2.886  1.00 41.60      A    C
ATOM   4214  C    ALA B 192      43.365  70.115   0.747  1.00 39.96      A    C
ATOM   4215  O    ALA B 192      42.263  70.327   0.352  1.00 40.90      A    O
ATOM   4216  N    GLY B 193      44.351  70.926   0.571  1.00 40.68      A    N
ATOM   4217  CA   GLY B 193      44.337  71.962  -0.394  1.00 35.77      A    C
ATOM   4218  C    GLY B 193      43.900  73.131   0.348  1.00 33.19      A    C
ATOM   4219  O    GLY B 193      43.006  73.064   1.105  1.00 34.94      A    O
ATOM   4220  N    ILE B 194      44.553  74.200   0.048  1.00 32.30      A    N
ATOM   4221  CA   ILE B 194      44.295  75.530   0.522  1.00 29.48      A    C
ATOM   4222  CB   ILE B 194      43.269  76.229  -0.292  1.00 28.84      A    C
ATOM   4223  CG1  ILE B 194      43.155  75.525  -1.629  1.00 26.99      A    C
ATOM   4224  CD1  ILE B 194      42.032  75.906  -2.391  1.00 21.96      A    C
ATOM   4225  CG2  ILE B 194      43.712  77.593  -0.568  1.00 24.75      A    C
ATOM   4226  C    ILE B 194      44.351  75.900   1.987  1.00 30.39      A    C
ATOM   4227  O    ILE B 194      43.534  75.558   2.787  1.00 31.03      A    O
ATOM   4228  N    VAL B 195      45.439  76.585   2.282  1.00 28.23      A    N
ATOM   4229  CA   VAL B 195      45.690  77.364   3.462  1.00 26.84      A    C
ATOM   4230  CB   VAL B 195      47.176  77.580   3.620  1.00 26.65      A    C
ATOM   4231  CG1  VAL B 195      47.871  76.323   3.550  1.00 26.16      A    C
ATOM   4232  CG2  VAL B 195      47.704  78.486   2.610  1.00 23.66      A    C
ATOM   4233  C    VAL B 195      45.007  78.720   3.521  1.00 27.30      A    C
ATOM   4234  O    VAL B 195      44.762  79.329   2.537  1.00 25.75      A    O
ATOM   4235  N    CYS B 196      44.684  79.180   4.706  1.00 29.22      A    N
ATOM   4236  CA   CYS B 196      44.266  80.544   4.908  1.00 31.77      A    C
ATOM   4237  CB   CYS B 196      43.744  80.653   6.315  1.00 30.00      A    C
ATOM   4238  SG   CYS B 196      42.134  80.116   6.575  1.00 41.91      A    S
ATOM   4239  C    CYS B 196      45.366  81.588   4.730  1.00 32.27      A    C
ATOM   4240  O    CYS B 196      45.289  82.464   3.967  1.00 32.08      A    O
ATOM   4241  N    GLU B 197      46.371  81.486   5.555  1.00 34.52      A    N
ATOM   4242  CA   GLU B 197      47.516  82.330   5.583  1.00 36.16      A    C
ATOM   4243  CB   GLU B 197      47.790  82.776   6.998  1.00 38.43      A    C
ATOM   4244  CG   GLU B 197      47.027  83.987   7.439  1.00 41.33      A    C
ATOM   4245  CD   GLU B 197      45.929  83.724   8.420  1.00 46.63      A    C
ATOM   4246  OE1  GLU B 197      45.562  82.581   8.684  1.00 45.94      A    O
ATOM   4247  OE2  GLU B 197      45.406  84.697   8.930  1.00 51.36      A    O-1
ATOM   4248  C    GLU B 197      48.537  81.354   5.162  1.00 36.73      A    C
ATOM   4249  O    GLU B 197      48.284  80.199   5.159  1.00 38.11      A    O
ATOM   4250  N    PRO B 198      49.708  81.801   4.806  1.00 36.82      A    N
ATOM   4251  CA   PRO B 198      50.608  80.987   4.031  1.00 35.97      A    C
ATOM   4252  CB   PRO B 198      51.773  81.899   3.880  1.00 35.58      A    C
ATOM   4253  CG   PRO B 198      51.155  83.192   3.774  1.00 37.34      A    C
ATOM   4254  CD   PRO B 198      49.830  83.189   4.395  1.00 36.12      A    C
ATOM   4255  C    PRO B 198      51.014  79.679   4.647  1.00 36.17      A    C
ATOM   4256  O    PRO B 198      51.112  78.722   3.923  1.00 38.56      A    O
ATOM   4257  N    ASP B 199      51.252  79.596   5.928  1.00 34.64      A    N
ATOM   4258  CA   ASP B 199      51.508  78.289   6.464  1.00 34.01      A    C
ATOM   4259  CB   ASP B 199      52.874  78.190   7.056  1.00 35.18      A    C
ATOM   4260  CG   ASP B 199      53.230  76.822   7.371  1.00 40.85      A    C
ATOM   4261  OD1  ASP B 199      52.816  75.969   6.625  1.00 48.88      A    O
ATOM   4262  OD2  ASP B 199      53.915  76.577   8.350  1.00 47.12      A    O-1
ATOM   4263  C    ASP B 199      50.477  77.815   7.449  1.00 32.88      A    C
ATOM   4264  O    ASP B 199      50.762  77.055   8.316  1.00 31.60      A    O
ATOM   4265  N    ASN B 200      49.263  78.265   7.281  1.00 31.66      A    N
```

Appendix 1

```
ATOM   4266  CA   ASN B 200      48.234  78.061   8.242  1.00 30.75      A    C
ATOM   4267  CB   ASN B 200      47.726  79.431   8.631  1.00 30.70      A    C
ATOM   4268  CG   ASN B 200      48.333  79.956   9.847  1.00 32.74      A    C
ATOM   4269  OD1  ASN B 200      49.333  79.489  10.298  1.00 37.78      A    O
ATOM   4270  ND2  ASN B 200      47.718  80.950  10.401  1.00 29.88      A    N
ATOM   4271  C    ASN B 200      47.084  77.310   7.638  1.00 29.00      A    C
ATOM   4272  O    ASN B 200      46.448  77.824   6.817  1.00 28.95      A    O
ATOM   4273  N    TYR B 201      46.802  76.109   8.094  1.00 27.28      A    N
ATOM   4274  CA   TYR B 201      45.697  75.339   7.579  1.00 26.76      A    C
ATOM   4275  CB   TYR B 201      46.213  74.001   7.083  1.00 26.01      A    C
ATOM   4276  CG   TYR B 201      45.207  73.103   6.438  1.00 28.86      A    C
ATOM   4277  CD1  TYR B 201      45.146  72.968   5.079  1.00 32.06      A    C
ATOM   4278  CE1  TYR B 201      44.267  72.141   4.502  1.00 30.41      A    C
ATOM   4279  CZ   TYR B 201      43.442  71.445   5.275  1.00 29.71      A    C
ATOM   4280  OH   TYR B 201      42.572  70.620   4.721  1.00 29.85      A    O
ATOM   4281  CE2  TYR B 201      43.485  71.557   6.614  1.00 28.55      A    C
ATOM   4282  CD2  TYR B 201      44.357  72.358   7.185  1.00 27.19      A    C
ATOM   4283  C    TYR B 201      44.598  75.147   8.582  1.00 25.98      A    C
ATOM   4284  O    TYR B 201      44.782  74.661   9.627  1.00 27.21      A    O
ATOM   4285  N    PHE B 202      43.416  75.542   8.218  1.00 25.60      A    N
ATOM   4286  CA   PHE B 202      42.284  75.410   9.079  1.00 24.60      A    C
ATOM   4287  CB   PHE B 202      41.700  76.766   9.436  1.00 25.30      A    C
ATOM   4288  CG   PHE B 202      42.578  77.607  10.240  1.00 24.65      A    C
ATOM   4289  CD1  PHE B 202      42.499  77.582  11.573  1.00 26.58      A    C
ATOM   4290  CE1  PHE B 202      43.289  78.349  12.303  1.00 30.09      A    C
ATOM   4291  CZ   PHE B 202      44.162  79.166  11.709  1.00 29.00      A    C
ATOM   4292  CE2  PHE B 202      44.254  79.206  10.393  1.00 24.55      A    C
ATOM   4293  CD2  PHE B 202      43.472  78.449   9.658  1.00 23.59      A    C
ATOM   4294  C    PHE B 202      41.237  74.587   8.414  1.00 24.85      A    C
ATOM   4295  O    PHE B 202      40.932  74.765   7.309  1.00 25.09      A    O
ATOM   4296  N    VAL B 203      40.725  73.642   9.134  1.00 26.61      A    N
ATOM   4297  CA   VAL B 203      39.749  72.732   8.671  1.00 27.53      A    C
ATOM   4298  CB   VAL B 203      39.684  71.584   9.687  1.00 29.22      A    C
ATOM   4299  CG1  VAL B 203      38.396  71.420  10.352  1.00 28.90      A    C
ATOM   4300  CG2  VAL B 203      40.205  70.345   9.105  1.00 28.52      A    C
ATOM   4301  C    VAL B 203      38.440  73.409   8.356  1.00 28.48      A    C
ATOM   4302  O    VAL B 203      37.805  73.123   7.380  1.00 29.58      A    O
ATOM   4303  N    GLN B 204      38.035  74.312   9.207  1.00 28.05      A    N
ATOM   4304  CA   GLN B 204      36.783  74.997   9.034  1.00 26.77      A    C
ATOM   4305  CB   GLN B 204      36.370  75.709  10.319  1.00 26.39      A    C
ATOM   4306  CG   GLN B 204      37.132  76.942  10.647  1.00 24.65      A    C
ATOM   4307  CD   GLN B 204      38.365  76.658  11.419  1.00 24.52      A    C
ATOM   4308  OE1  GLN B 204      38.951  75.642  11.280  1.00 28.19      A    O
ATOM   4309  NE2  GLN B 204      38.750  77.554  12.236  1.00 21.07      A    N
ATOM   4310  C    GLN B 204      36.721  75.892   7.819  1.00 25.97      A    C
ATOM   4311  O    GLN B 204      35.722  76.010   7.211  1.00 24.02      A    O
ATOM   4312  N    CYS B 205      37.803  76.557   7.509  1.00 26.84      A    N
ATOM   4313  CA   CYS B 205      37.892  77.372   6.331  1.00 29.14      A    C
ATOM   4314  CB   CYS B 205      39.131  78.262   6.386  1.00 29.25      A    C
ATOM   4315  SG   CYS B 205      39.433  79.250   7.855  1.00 38.17      A    S
ATOM   4316  C    CYS B 205      37.823  76.560   5.038  1.00 29.06      A    C
ATOM   4317  O    CYS B 205      37.177  76.930   4.119  1.00 28.97      A    O
ATOM   4318  N    ASN B 206      38.505  75.439   5.015  1.00 29.21      A    N
ATOM   4319  CA   ASN B 206      38.438  74.455   3.967  1.00 29.20      A    C
```

Appendix 1

```
ATOM   4320  CB  ASN B 206      39.472  73.390   4.190  1.00  28.98      A    C
ATOM   4321  CG  ASN B 206      40.739  73.716   3.582  1.00  29.42      A    C
ATOM   4322  OD1 ASN B 206      40.979  73.393   2.469  1.00  27.35      A    O
ATOM   4323  ND2 ASN B 206      41.578  74.366   4.311  1.00  25.80      A    N
ATOM   4324  C   ASN B 206      37.090  73.809   3.788  1.00  29.22      A    C
ATOM   4325  O   ASN B 206      36.704  73.511   2.712  1.00  29.78      A    O
ATOM   4326  N   SER B 207      36.369  73.616   4.856  1.00  28.38      A    N
ATOM   4327  CA  SER B 207      35.048  73.085   4.754  1.00  29.39      A    C
ATOM   4328  CB  SER B 207      34.566  72.649   6.124  1.00  30.64      A    C
ATOM   4329  OG  SER B 207      33.628  73.509   6.681  1.00  32.65      A    O
ATOM   4330  C   SER B 207      34.062  73.969   3.963  1.00  29.54      A    C
ATOM   4331  O   SER B 207      33.247  73.484   3.252  1.00  29.92      A    O
ATOM   4332  N   VAL B 208      34.151  75.273   4.081  1.00  28.94      A    N
ATOM   4333  CA  VAL B 208      33.404  76.185   3.259  1.00  28.07      A    C
ATOM   4334  CB  VAL B 208      33.578  77.597   3.791  1.00  28.40      A    C
ATOM   4335  CG1 VAL B 208      32.614  78.541   3.202  1.00  26.89      A    C
ATOM   4336  CG2 VAL B 208      33.430  77.580   5.223  1.00  29.98      A    C
ATOM   4337  C   VAL B 208      33.772  76.127   1.801  1.00  28.01      A    C
ATOM   4338  O   VAL B 208      32.942  76.156   0.961  1.00  28.94      A    O
ATOM   4339  N   ALA B 209      35.032  76.059   1.496  1.00  26.18      A    N
ATOM   4340  CA  ALA B 209      35.436  75.955   0.128  1.00  26.93      A    C
ATOM   4341  CB  ALA B 209      36.912  76.108   0.031  1.00  25.86      A    C
ATOM   4342  C   ALA B 209      35.013  74.694  -0.596  1.00  27.28      A    C
ATOM   4343  O   ALA B 209      34.655  74.747  -1.719  1.00  28.05      A    O
ATOM   4344  N   TYR B 210      35.131  73.549   0.031  1.00  27.35      A    N
ATOM   4345  CA  TYR B 210      34.700  72.325  -0.569  1.00  27.56      A    C
ATOM   4346  CB  TYR B 210      35.150  71.141   0.256  1.00  26.71      A    C
ATOM   4347  CG  TYR B 210      36.573  70.777   0.011  1.00  27.00      A    C
ATOM   4348  CD1 TYR B 210      36.916  69.846  -0.923  1.00  27.62      A    C
ATOM   4349  CE1 TYR B 210      38.195  69.542  -1.147  1.00  25.80      A    C
ATOM   4350  CZ  TYR B 210      39.146  70.176  -0.450  1.00  27.67      A    C
ATOM   4351  OH  TYR B 210      40.425  69.879  -0.663  1.00  27.88      A    O
ATOM   4352  CE2 TYR B 210      38.825  71.098   0.462  1.00  23.14      A    C
ATOM   4353  CD2 TYR B 210      37.570  71.383   0.695  1.00  19.01      A    C
ATOM   4354  C   TYR B 210      33.219  72.317  -0.786  1.00  28.53      A    C
ATOM   4355  O   TYR B 210      32.766  71.920  -1.793  1.00  28.22      A    O
ATOM   4356  N   LEU B 211      32.469  72.818   0.165  1.00  28.50      A    N
ATOM   4357  CA  LEU B 211      31.050  72.907   0.058  1.00  28.65      A    C
ATOM   4358  CB  LEU B 211      30.455  73.440   1.343  1.00  29.31      A    C
ATOM   4359  CG  LEU B 211      28.964  73.690   1.410  1.00  31.13      A    C
ATOM   4360  CD1 LEU B 211      28.268  72.439   1.160  1.00  34.18      A    C
ATOM   4361  CD2 LEU B 211      28.512  74.268   2.713  1.00  29.56      A    C
ATOM   4362  C   LEU B 211      30.697  73.797  -1.084  1.00  28.56      A    C
ATOM   4363  O   LEU B 211      29.737  73.608  -1.712  1.00  30.83      A    O
ATOM   4364  N   SER B 212      31.472  74.810  -1.334  1.00  26.87      A    N
ATOM   4365  CA  SER B 212      31.201  75.696  -2.437  1.00  26.79      A    C
ATOM   4366  CB  SER B 212      32.041  76.948  -2.338  1.00  26.06      A    C
ATOM   4367  OG  SER B 212      33.063  76.943  -3.257  1.00  27.12      A    O
ATOM   4368  C   SER B 212      31.353  75.012  -3.763  1.00  26.65      A    C
ATOM   4369  O   SER B 212      30.790  75.398  -4.720  1.00  27.11      A    O
ATOM   4370  N   LEU B 213      32.172  74.000  -3.796  1.00  26.66      A    N
ATOM   4371  CA  LEU B 213      32.340  73.191  -4.960  1.00  27.00      A    C
ATOM   4372  CB  LEU B 213      33.524  72.274  -4.768  1.00  25.30      A    C
ATOM   4373  CG  LEU B 213      34.774  72.811  -5.413  1.00  26.15      A    C
```

Appendix 1

```
ATOM   4374  CD1 LEU B 213      34.637  74.243  -5.626  1.00 24.47      A   C
ATOM   4375  CD2 LEU B 213      35.966  72.522  -4.638  1.00 17.59      A   C
ATOM   4376  C   LEU B 213      31.096  72.428  -5.298  1.00 27.08      A   C
ATOM   4377  O   LEU B 213      30.745  72.293  -6.423  1.00 26.98      A   O
ATOM   4378  N   TRP B 214      30.439  71.930  -4.283  1.00 26.43      A   N
ATOM   4379  CA  TRP B 214      29.204  71.265  -4.459  1.00 27.31      A   C
ATOM   4380  CB  TRP B 214      28.733  70.599  -3.166  1.00 26.93      A   C
ATOM   4381  CG  TRP B 214      29.588  69.519  -2.675  1.00 24.99      A   C
ATOM   4382  CD1 TRP B 214      30.850  69.619  -2.331  1.00 24.66      A   C
ATOM   4383  NE1 TRP B 214      31.333  68.445  -1.920  1.00 26.01      A   N
ATOM   4384  CE2 TRP B 214      30.348  67.521  -2.003  1.00 30.82      A   C
ATOM   4385  CD2 TRP B 214      29.227  68.171  -2.470  1.00 29.09      A   C
ATOM   4386  CE3 TRP B 214      28.059  67.440  -2.651  1.00 30.83      A   C
ATOM   4387  CZ3 TRP B 214      28.068  66.127  -2.370  1.00 31.07      A   C
ATOM   4388  CH2 TRP B 214      29.197  65.504  -1.913  1.00 31.62      A   C
ATOM   4389  CZ2 TRP B 214      30.353  66.184  -1.723  1.00 33.54      A   C
ATOM   4390  C   TRP B 214      28.184  72.224  -4.980  1.00 27.59      A   C
ATOM   4391  O   TRP B 214      27.455  71.898  -5.826  1.00 30.37      A   O
ATOM   4392  N   VAL B 215      28.115  73.424  -4.490  1.00 27.31      A   N
ATOM   4393  CA  VAL B 215      27.074  74.295  -4.954  1.00 27.97      A   C
ATOM   4394  CB  VAL B 215      27.006  75.566  -4.119  1.00 28.05      A   C
ATOM   4395  CG1 VAL B 215      26.383  76.666  -4.827  1.00 25.67      A   C
ATOM   4396  CG2 VAL B 215      26.303  75.302  -2.917  1.00 25.40      A   C
ATOM   4397  C   VAL B 215      27.261  74.570  -6.410  1.00 29.11      A   C
ATOM   4398  O   VAL B 215      26.345  74.576  -7.169  1.00 31.06      A   O
ATOM   4399  N   TYR B 216      28.489  74.769  -6.795  1.00 30.19      A   N
ATOM   4400  CA  TYR B 216      28.851  75.031  -8.157  1.00 30.44      A   C
ATOM   4401  CB  TYR B 216      30.332  75.367  -8.226  1.00 29.01      A   C
ATOM   4402  CG  TYR B 216      30.723  75.863  -9.552  1.00 25.90      A   C
ATOM   4403  CD1 TYR B 216      30.711  77.159  -9.821  1.00 23.19      A   C
ATOM   4404  CE1 TYR B 216      31.036  77.600 -10.994  1.00 23.85      A   C
ATOM   4405  CZ  TYR B 216      31.363  76.743 -11.940  1.00 25.59      A   C
ATOM   4406  OH  TYR B 216      31.677  77.222 -13.148  1.00 27.55      A   O
ATOM   4407  CE2 TYR B 216      31.381  75.443 -11.705  1.00 22.57      A   C
ATOM   4408  CD2 TYR B 216      31.067  75.016 -10.534  1.00 24.59      A   C
ATOM   4409  C   TYR B 216      28.528  73.893  -9.113  1.00 31.28      A   C
ATOM   4410  O   TYR B 216      28.112  74.112 -10.183  1.00 32.09      A   O
ATOM   4411  N   ASP B 217      28.755  72.671  -8.712  1.00 32.99      A   N
ATOM   4412  CA  ASP B 217      28.385  71.515  -9.491  1.00 32.36      A   C
ATOM   4413  CB  ASP B 217      28.949  70.271  -8.859  1.00 31.32      A   C
ATOM   4414  CG  ASP B 217      30.404  70.210  -8.970  1.00 32.12      A   C
ATOM   4415  OD1 ASP B 217      30.955  70.936  -9.772  1.00 21.90      A   O
ATOM   4416  OD2 ASP B 217      30.998  69.427  -8.270  1.00 41.33      A   O-1
ATOM   4417  C   ASP B 217      26.892  71.420  -9.656  1.00 33.80      A   C
ATOM   4418  O   ASP B 217      26.420  71.021 -10.682  1.00 33.32      A   O
ATOM   4419  N   ARG B 218      26.147  71.799  -8.636  1.00 32.75      A   N
ATOM   4420  CA  ARG B 218      24.731  71.741  -8.725  1.00 33.61      A   C
ATOM   4421  CB  ARG B 218      24.097  71.990  -7.376  1.00 33.59      A   C
ATOM   4422  CG  ARG B 218      22.738  72.546  -7.415  1.00 36.93      A   C
ATOM   4423  CD  ARG B 218      21.684  71.526  -7.689  1.00 43.63      A   C
ATOM   4424  NE  ARG B 218      20.423  71.895  -7.064  1.00 48.33      A   N
ATOM   4425  CZ  ARG B 218      19.541  72.693  -7.615  1.00 50.06      A   C
ATOM   4426  NH1 ARG B 218      19.774  73.178  -8.805  1.00 55.11      A   N
ATOM   4427  NH2 ARG B 218      18.432  72.984  -7.003  1.00 50.04      A   N
```

Appendix 1

```
ATOM   4428  C    ARG B 218      24.258  72.682  -9.781  1.00 33.22      A    C
ATOM   4429  O    ARG B 218      23.355  72.383 -10.499  1.00 33.65      A    O
ATOM   4430  N    LEU B 219      24.864  73.842  -9.839  1.00 33.38      A    N
ATOM   4431  CA   LEU B 219      24.603  74.812 -10.870  1.00 33.14      A    C
ATOM   4432  CB   LEU B 219      25.186  76.153 -10.461  1.00 33.08      A    C
ATOM   4433  CG   LEU B 219      24.613  76.860  -9.242  1.00 34.35      A    C
ATOM   4434  CD1  LEU B 219      25.558  77.853  -8.732  1.00 32.37      A    C
ATOM   4435  CD2  LEU B 219      23.327  77.526  -9.547  1.00 31.36      A    C
ATOM   4436  C    LEU B 219      25.030  74.465 -12.295  1.00 33.61      A    C
ATOM   4437  O    LEU B 219      24.350  74.756 -13.225  1.00 33.13      A    O
ATOM   4438  N    HIS B 220      26.187  73.879 -12.465  1.00 33.07      A    N
ATOM   4439  CA   HIS B 220      26.732  73.649 -13.781  1.00 34.01      A    C
ATOM   4440  CB   HIS B 220      28.004  74.439 -13.947  1.00 33.06      A    C
ATOM   4441  CG   HIS B 220      27.850  75.882 -13.651  1.00 35.41      A    C
ATOM   4442  ND1  HIS B 220      27.439  76.780 -14.591  1.00 37.78      A    N
ATOM   4443  CE1  HIS B 220      27.374  77.973 -14.052  1.00 35.14      A    C
ATOM   4444  NE2  HIS B 220      27.730  77.878 -12.796  1.00 30.25      A    N
ATOM   4445  CD2  HIS B 220      28.025  76.582 -12.518  1.00 34.14      A    C
ATOM   4446  C    HIS B 220      26.979  72.218 -14.194  1.00 34.67      A    C
ATOM   4447  O    HIS B 220      27.624  71.986 -15.158  1.00 35.69      A    O
ATOM   4448  N    GLY B 221      26.434  71.264 -13.481  1.00 35.16      A    N
ATOM   4449  CA   GLY B 221      26.638  69.892 -13.841  1.00 36.03      A    C
ATOM   4450  C    GLY B 221      28.051  69.449 -13.936  1.00 37.52      A    C
ATOM   4451  O    GLY B 221      28.475  68.988 -14.931  1.00 39.06      A    O
ATOM   4452  N    THR B 222      28.751  69.527 -12.834  1.00 38.25      A    N
ATOM   4453  CA   THR B 222      30.176  69.599 -12.764  1.00 36.42      A    C
ATOM   4454  CB   THR B 222      30.522  71.010 -12.337  1.00 36.61      A    C
ATOM   4455  OG1  THR B 222      31.309  71.615 -13.340  1.00 34.47      A    O
ATOM   4456  CG2  THR B 222      31.165  71.069 -10.906  1.00 35.37      A    C
ATOM   4457  C    THR B 222      30.600  68.569 -11.746  1.00 36.31      A    C
ATOM   4458  O    THR B 222      29.777  68.094 -11.028  1.00 37.41      A    O
ATOM   4459  N    ASP B 223      31.865  68.191 -11.686  1.00 36.70      A    N
ATOM   4460  CA   ASP B 223      32.340  67.208 -10.709  1.00 38.16      A    C
ATOM   4461  CB   ASP B 223      32.680  65.875 -11.369  1.00 38.70      A    C
ATOM   4462  CG   ASP B 223      32.718  64.703 -10.396  1.00 43.61      A    C
ATOM   4463  OD1  ASP B 223      32.117  64.772  -9.347  1.00 46.01      A    O
ATOM   4464  OD2  ASP B 223      33.363  63.686 -10.674  1.00 45.41      A    O-1
ATOM   4465  C    ASP B 223      33.537  67.738  -9.966  1.00 37.65      A    C
ATOM   4466  O    ASP B 223      34.485  67.058  -9.755  1.00 36.35      A    O
ATOM   4467  N    TYR B 224      33.437  68.959  -9.514  1.00 38.38      A    N
ATOM   4468  CA   TYR B 224      34.545  69.618  -8.877  1.00 40.18      A    C
ATOM   4469  CB   TYR B 224      34.344  71.123  -8.748  1.00 39.97      A    C
ATOM   4470  CG   TYR B 224      34.819  71.861  -9.957  1.00 37.00      A    C
ATOM   4471  CD1  TYR B 224      36.120  71.839 -10.322  1.00 38.17      A    C
ATOM   4472  CE1  TYR B 224      36.538  72.481 -11.409  1.00 38.87      A    C
ATOM   4473  CZ   TYR B 224      35.665  73.138 -12.157  1.00 36.36      A    C
ATOM   4474  OH   TYR B 224      36.086  73.770 -13.255  1.00 36.76      A    O
ATOM   4475  CE2  TYR B 224      34.389  73.170 -11.829  1.00 36.74      A    C
ATOM   4476  CD2  TYR B 224      33.967  72.540 -10.744  1.00 35.07      A    C
ATOM   4477  C    TYR B 224      34.941  68.982  -7.577  1.00 41.57      A    C
ATOM   4478  O    TYR B 224      36.014  69.248  -7.099  1.00 43.12      A    O
ATOM   4479  N    ARG B 225      34.150  68.037  -7.097  1.00 41.58      A    N
ATOM   4480  CA   ARG B 225      34.401  67.388  -5.818  1.00 43.28      A    C
ATOM   4481  CB   ARG B 225      33.096  66.926  -5.298  1.00 43.01      A    C
```

Appendix 1

```
ATOM   4482  CG   ARG B 225      32.081  67.890  -5.731  1.00 42.35      A  C
ATOM   4483  CD   ARG B 225      30.730  67.331  -5.625  1.00 44.62      A  C
ATOM   4484  NE   ARG B 225      30.260  66.879  -6.904  1.00 48.21      A  N
ATOM   4485  CZ   ARG B 225      29.149  66.206  -7.045  1.00 48.30      A  C
ATOM   4486  NH1  ARG B 225      28.463  65.980  -5.976  1.00 50.78      A  N
ATOM   4487  NH2  ARG B 225      28.724  65.797  -8.217  1.00 42.34      A  N
ATOM   4488  C    ARG B 225      35.450  66.270  -5.703  1.00 44.23      A  C
ATOM   4489  O    ARG B 225      35.279  65.128  -6.054  1.00 44.88      A  O
ATOM   4490  N    ALA B 226      36.563  66.744  -5.166  1.00 44.39      A  N
ATOM   4491  CA   ALA B 226      37.728  66.064  -4.713  1.00 42.39      A  C
ATOM   4492  CB   ALA B 226      38.879  66.899  -5.005  1.00 42.70      A  C
ATOM   4493  C    ALA B 226      37.547  66.013  -3.236  1.00 41.09      A  C
ATOM   4494  O    ALA B 226      38.462  65.912  -2.499  1.00 39.16      A  O
ATOM   4495  N    ALA B 227      36.333  66.214  -2.821  1.00 41.56      A  N
ATOM   4496  CA   ALA B 227      35.995  66.189  -1.454  1.00 43.75      A  C
ATOM   4497  CB   ALA B 227      34.588  66.688  -1.338  1.00 41.45      A  C
ATOM   4498  C    ALA B 227      36.126  64.821  -0.833  1.00 46.53      A  C
ATOM   4499  O    ALA B 227      36.779  64.635   0.153  1.00 47.17      A  O
ATOM   4500  N    THR B 228      35.473  63.843  -1.426  1.00 51.25      A  N
ATOM   4501  CA   THR B 228      35.287  62.513  -0.831  1.00 54.24      A  C
ATOM   4502  CB   THR B 228      33.870  61.932  -1.061  1.00 55.39      A  C
ATOM   4503  OG1  THR B 228      33.495  61.129   0.056  1.00 56.53      A  O
ATOM   4504  CG2  THR B 228      33.795  61.111  -2.323  1.00 55.55      A  C
ATOM   4505  C    THR B 228      36.416  61.719  -1.418  1.00 54.80      A  C
ATOM   4506  O    THR B 228      36.443  60.489  -1.513  1.00 53.92      A  O
ATOM   4507  N    ARG B 229      37.361  62.552  -1.785  1.00 54.40      A  N
ATOM   4508  CA   ARG B 229      38.678  62.139  -2.051  1.00 53.56      A  C
ATOM   4509  CB   ARG B 229      39.323  62.948  -3.146  1.00 54.31      A  C
ATOM   4510  CG   ARG B 229      38.724  62.794  -4.460  1.00 60.15      A  C
ATOM   4511  CD   ARG B 229      39.706  63.295  -5.433  1.00 72.63      A  C
ATOM   4512  NE   ARG B 229      41.028  62.810  -5.090  1.00 79.64      A  N
ATOM   4513  CZ   ARG B 229      41.616  61.771  -5.670  1.00 82.32      A  C
ATOM   4514  NH1  ARG B 229      41.007  61.115  -6.649  1.00 82.64      A  N
ATOM   4515  NH2  ARG B 229      42.815  61.391  -5.270  1.00 81.64      A  N
ATOM   4516  C    ARG B 229      39.326  62.531  -0.809  1.00 50.35      A  C
ATOM   4517  O    ARG B 229      38.803  62.393   0.264  1.00 48.24      A  O
ATOM   4518  N    ALA B 230      40.491  63.063  -1.009  1.00 47.76      A  N
ATOM   4519  CA   ALA B 230      41.419  63.093   0.019  1.00 46.33      A  C
ATOM   4520  CB   ALA B 230      42.675  63.636  -0.450  1.00 47.05      A  C
ATOM   4521  C    ALA B 230      40.859  63.895   1.093  1.00 43.25      A  C
ATOM   4522  O    ALA B 230      41.080  63.594   2.211  1.00 44.59      A  O
ATOM   4523  N    TRP B 231      40.129  64.928   0.802  1.00 39.69      A  N
ATOM   4524  CA   TRP B 231      39.959  65.843   1.861  1.00 37.03      A  C
ATOM   4525  CB   TRP B 231      39.208  67.070   1.393  1.00 37.58      A  C
ATOM   4526  CG   TRP B 231      39.192  68.114   2.383  1.00 31.25      A  C
ATOM   4527  CD1  TRP B 231      40.206  68.860   2.743  1.00 28.84      A  C
ATOM   4528  NE1  TRP B 231      39.852  69.701   3.706  1.00 29.53      A  N
ATOM   4529  CE2  TRP B 231      38.546  69.500   4.001  1.00 26.30      A  C
ATOM   4530  CD2  TRP B 231      38.106  68.498   3.175  1.00 23.55      A  C
ATOM   4531  CE3  TRP B 231      36.797  68.088   3.265  1.00 24.55      A  C
ATOM   4532  CZ3  TRP B 231      36.001  68.688   4.149  1.00 21.93      A  C
ATOM   4533  CH2  TRP B 231      36.459  69.691   4.959  1.00 23.42      A  C
ATOM   4534  CZ2  TRP B 231      37.733  70.113   4.904  1.00 24.86      A  C
ATOM   4535  C    TRP B 231      39.295  65.233   3.068  1.00 37.28      A  C
```

Appendix 1

```
ATOM   4536  O    TRP B 231      39.787  65.377   4.132  1.00 35.34      A    O
ATOM   4537  N    LEU B 232      38.203  64.523   2.917  1.00 37.11      A    N
ATOM   4538  CA   LEU B 232      37.599  63.910   4.064  1.00 36.87      A    C
ATOM   4539  CB   LEU B 232      36.288  63.285   3.703  1.00 36.39      A    C
ATOM   4540  CG   LEU B 232      35.041  64.025   4.097  1.00 37.08      A    C
ATOM   4541  CD1  LEU B 232      35.372  65.189   4.895  1.00 33.87      A    C
ATOM   4542  CD2  LEU B 232      34.276  64.401   2.927  1.00 33.74      A    C
ATOM   4543  C    LEU B 232      38.532  62.899   4.628  1.00 37.77      A    C
ATOM   4544  O    LEU B 232      38.643  62.757   5.800  1.00 39.29      A    O
ATOM   4545  N    ASP B 233      39.192  62.171   3.770  1.00 37.58      A    N
ATOM   4546  CA   ASP B 233      40.172  61.238   4.213  1.00 39.32      A    C
ATOM   4547  CB   ASP B 233      40.667  60.388   3.056  1.00 39.32      A    C
ATOM   4548  CG   ASP B 233      39.589  59.567   2.447  1.00 44.63      A    C
ATOM   4549  OD1  ASP B 233      39.690  59.283   1.262  1.00 51.95      A    O
ATOM   4550  OD2  ASP B 233      38.635  59.217   3.136  1.00 44.51      A    O-1
ATOM   4551  C    ASP B 233      41.338  61.899   4.870  1.00 39.15      A    C
ATOM   4552  O    ASP B 233      41.848  61.399   5.811  1.00 40.98      A    O
ATOM   4553  N    PHE B 234      41.815  62.988   4.320  1.00 38.89      A    N
ATOM   4554  CA   PHE B 234      42.951  63.690   4.873  1.00 39.60      A    C
ATOM   4555  CB   PHE B 234      43.467  64.699   3.855  1.00 39.34      A    C
ATOM   4556  CG   PHE B 234      44.520  65.591   4.369  1.00 42.09      A    C
ATOM   4557  CD1  PHE B 234      45.802  65.181   4.443  1.00 43.02      A    C
ATOM   4558  CE1  PHE B 234      46.748  65.986   4.908  1.00 42.32      A    C
ATOM   4559  CZ   PHE B 234      46.445  67.214   5.328  1.00 45.19      A    C
ATOM   4560  CE2  PHE B 234      45.181  67.652   5.263  1.00 46.50      A    C
ATOM   4561  CD2  PHE B 234      44.220  66.845   4.797  1.00 45.09      A    C
ATOM   4562  C    PHE B 234      42.728  64.334   6.235  1.00 39.73      A    C
ATOM   4563  O    PHE B 234      43.568  64.286   7.090  1.00 40.40      A    O
ATOM   4564  N    ILE B 235      41.589  64.962   6.417  1.00 39.82      A    N
ATOM   4565  CA   ILE B 235      41.243  65.517   7.695  1.00 39.72      A    C
ATOM   4566  CB   ILE B 235      40.135  66.551   7.604  1.00 39.56      A    C
ATOM   4567  CG1  ILE B 235      38.786  65.938   7.364  1.00 36.47      A    C
ATOM   4568  CD1  ILE B 235      37.742  66.906   7.334  1.00 32.33      A    C
ATOM   4569  CG2  ILE B 235      40.402  67.476   6.487  1.00 37.02      A    C
ATOM   4570  C    ILE B 235      41.039  64.469   8.772  1.00 41.95      A    C
ATOM   4571  O    ILE B 235      41.219  64.725   9.917  1.00 41.06      A    O
ATOM   4572  N    GLN B 236      40.649  63.283   8.370  1.00 44.34      A    N
ATOM   4573  CA   GLN B 236      40.367  62.235   9.294  1.00 46.72      A    C
ATOM   4574  CB   GLN B 236      39.489  61.182   8.685  1.00 46.44      A    C
ATOM   4575  CG   GLN B 236      38.080  61.513   8.834  1.00 47.17      A    C
ATOM   4576  CD   GLN B 236      37.202  60.335   8.914  1.00 47.19      A    C
ATOM   4577  OE1  GLN B 236      36.702  59.870   7.925  1.00 45.41      A    O
ATOM   4578  NE2  GLN B 236      36.959  59.876  10.105  1.00 46.76      A    N
ATOM   4579  C    GLN B 236      41.568  61.631   9.929  1.00 49.29      A    C
ATOM   4580  O    GLN B 236      41.446  60.978  10.910  1.00 49.96      A    O
ATOM   4581  N    LYS B 237      42.740  61.833   9.389  1.00 51.49      A    N
ATOM   4582  CA   LYS B 237      43.860  61.222  10.036  1.00 53.73      A    C
ATOM   4583  CB   LYS B 237      44.500  60.264   9.072  1.00 54.57      A    C
ATOM   4584  CG   LYS B 237      45.028  60.925   7.893  1.00 55.38      A    C
ATOM   4585  CD   LYS B 237      46.100  60.089   7.337  1.00 59.47      A    C
ATOM   4586  CE   LYS B 237      45.653  59.471   6.082  1.00 63.26      A    C
ATOM   4587  NZ   LYS B 237      44.872  60.441   5.340  1.00 65.48      A    N
ATOM   4588  C    LYS B 237      44.907  62.192  10.494  1.00 55.03      A    C
ATOM   4589  O    LYS B 237      45.743  62.612   9.721  1.00 55.34      A    O
```

Appendix 1

```
ATOM   4590  N    ASP B 238     44.909  62.491  11.775  1.00  54.53      A   N
ATOM   4591  CA   ASP B 238     45.950  63.336  12.334  1.00  54.89      A   C
ATOM   4592  CB   ASP B 238     47.114  63.426  11.342  1.00  55.59      A   C
ATOM   4593  CG   ASP B 238     48.426  62.910  11.913  1.00  59.38      A   C
ATOM   4594  OD1  ASP B 238     48.440  61.809  12.466  1.00  60.12      A   O
ATOM   4595  OD2  ASP B 238     49.454  63.590  11.795  1.00  61.31      A   O-1
ATOM   4596  C    ASP B 238     45.519  64.742  12.662  1.00  53.15      A   C
ATOM   4597  O    ASP B 238     46.129  65.366  13.487  1.00  54.52      A   O
ATOM   4598  N    LEU B 239     44.467  65.226  12.035  1.00  50.15      A   N
ATOM   4599  CA   LEU B 239     43.890  66.498  12.383  1.00  46.70      A   C
ATOM   4600  CB   LEU B 239     43.423  67.229  11.153  1.00  46.07      A   C
ATOM   4601  CG   LEU B 239     44.391  68.114  10.420  1.00  44.59      A   C
ATOM   4602  CD1  LEU B 239     45.373  67.282   9.723  1.00  44.88      A   C
ATOM   4603  CD2  LEU B 239     43.623  68.833   9.459  1.00  42.23      A   C
ATOM   4604  C    LEU B 239     42.707  66.255  13.224  1.00  45.83      A   C
ATOM   4605  O    LEU B 239     42.036  67.154  13.606  1.00  45.26      A   O
ATOM   4606  N    ILE B 240     42.437  65.008  13.505  1.00  44.61      A   N
ATOM   4607  CA   ILE B 240     41.336  64.683  14.360  1.00  43.18      A   C
ATOM   4608  CB   ILE B 240     40.228  64.088  13.577  1.00  43.75      A   C
ATOM   4609  CG1  ILE B 240     38.900  64.443  14.205  1.00  41.05      A   C
ATOM   4610  CD1  ILE B 240     37.770  64.196  13.379  1.00  38.27      A   C
ATOM   4611  CG2  ILE B 240     40.387  62.638  13.555  1.00  43.41      A   C
ATOM   4612  C    ILE B 240     41.768  63.725  15.437  1.00  43.15      A   C
ATOM   4613  O    ILE B 240     42.719  63.020  15.291  1.00  42.86      A   O
ATOM   4614  N    ASP B 241     41.066  63.776  16.544  1.00  43.64      A   N
ATOM   4615  CA   ASP B 241     41.114  62.785  17.566  1.00  44.29      A   C
ATOM   4616  CB   ASP B 241     41.213  63.494  18.892  1.00  44.87      A   C
ATOM   4617  CG   ASP B 241     41.248  62.570  20.042  1.00  47.50      A   C
ATOM   4618  OD1  ASP B 241     42.221  62.589  20.782  1.00  46.96      A   O
ATOM   4619  OD2  ASP B 241     40.286  61.850  20.238  1.00  48.40      A   O-1
ATOM   4620  C    ASP B 241     39.789  62.084  17.447  1.00  44.24      A   C
ATOM   4621  O    ASP B 241     38.795  62.596  17.849  1.00  44.80      A   O
ATOM   4622  N    PRO B 242     39.784  60.917  16.850  1.00  44.04      A   N
ATOM   4623  CA   PRO B 242     38.565  60.184  16.592  1.00  44.30      A   C
ATOM   4624  CB   PRO B 242     39.049  59.031  15.747  1.00  44.93      A   C
ATOM   4625  CG   PRO B 242     40.433  58.988  15.933  1.00  42.77      A   C
ATOM   4626  CD   PRO B 242     40.897  60.312  16.135  1.00  43.46      A   C
ATOM   4627  C    PRO B 242     37.844  59.723  17.827  1.00  44.49      A   C
ATOM   4628  O    PRO B 242     36.665  59.579  17.800  1.00  44.76      A   O
ATOM   4629  N    GLU B 243     38.563  59.445  18.885  1.00  45.23      A   N
ATOM   4630  CA   GLU B 243     37.966  59.172  20.166  1.00  46.99      A   C
ATOM   4631  CB   GLU B 243     38.950  58.546  21.119  1.00  48.32      A   C
ATOM   4632  CG   GLU B 243     39.551  57.252  20.641  1.00  55.98      A   C
ATOM   4633  CD   GLU B 243     38.564  56.103  20.558  1.00  64.41      A   C
ATOM   4634  OE1  GLU B 243     37.475  56.170  21.121  1.00  66.38      A   O
ATOM   4635  OE2  GLU B 243     38.886  55.103  19.920  1.00  68.91      A   O-1
ATOM   4636  C    GLU B 243     37.271  60.340  20.819  1.00  46.63      A   C
ATOM   4637  O    GLU B 243     36.365  60.151  21.580  1.00  46.38      A   O
ATOM   4638  N    ARG B 244     37.724  61.554  20.579  1.00  45.47      A   N
ATOM   4639  CA   ARG B 244     37.015  62.669  21.149  1.00  43.81      A   C
ATOM   4640  CB   ARG B 244     37.967  63.636  21.821  1.00  44.29      A   C
ATOM   4641  CG   ARG B 244     38.402  63.146  23.166  1.00  46.74      A   C
ATOM   4642  CD   ARG B 244     39.512  63.944  23.776  1.00  51.15      A   C
ATOM   4643  NE   ARG B 244     40.699  64.000  22.952  1.00  52.32      A   N
```

Appendix 1

```
ATOM   4644  CZ   ARG B 244      41.721  64.780  23.200  1.00 51.03      A    C
ATOM   4645  NH1  ARG B 244      41.703  65.551  24.251  1.00 47.65      A    N
ATOM   4646  NH2  ARG B 244      42.752  64.777  22.395  1.00 52.04      A    N
ATOM   4647  C    ARG B 244      36.072  63.366  20.223  1.00 41.99      A    C
ATOM   4648  O    ARG B 244      35.296  64.159  20.671  1.00 41.61      A    O
ATOM   4649  N    GLY B 245      36.105  62.996  18.952  1.00 39.61      A    N
ATOM   4650  CA   GLY B 245      35.319  63.612  17.904  1.00 37.47      A    C
ATOM   4651  C    GLY B 245      35.606  65.072  17.731  1.00 37.25      A    C
ATOM   4652  O    GLY B 245      34.714  65.865  17.599  1.00 36.64      A    O
ATOM   4653  N    ALA B 246      36.879  65.416  17.779  1.00 35.70      A    N
ATOM   4654  CA   ALA B 246      37.304  66.779  17.819  1.00 33.76      A    C
ATOM   4655  CB   ALA B 246      37.629  67.137  19.183  1.00 33.65      A    C
ATOM   4656  C    ALA B 246      38.476  67.020  16.954  1.00 32.89      A    C
ATOM   4657  O    ALA B 246      39.409  66.293  16.987  1.00 31.75      A    O
ATOM   4658  N    PHE B 247      38.409  68.082  16.185  1.00 31.32      A    N
ATOM   4659  CA   PHE B 247      39.534  68.555  15.427  1.00 28.98      A    C
ATOM   4660  CB   PHE B 247      39.070  69.384  14.233  1.00 28.09      A    C
ATOM   4661  CG   PHE B 247      38.379  68.611  13.183  1.00 26.43      A    C
ATOM   4662  CD1  PHE B 247      39.051  67.767  12.387  1.00 28.69      A    C
ATOM   4663  CE1  PHE B 247      38.420  67.086  11.452  1.00 26.59      A    C
ATOM   4664  CZ   PHE B 247      37.139  67.232  11.286  1.00 25.29      A    C
ATOM   4665  CE2  PHE B 247      36.459  68.054  12.049  1.00 24.52      A    C
ATOM   4666  CD2  PHE B 247      37.058  68.749  12.979  1.00 24.80      A    C
ATOM   4667  C    PHE B 247      40.511  69.352  16.275  1.00 28.35      A    C
ATOM   4668  O    PHE B 247      40.174  69.990  17.212  1.00 28.14      A    O
ATOM   4669  N    TYR B 248      41.748  69.284  15.891  1.00 27.68      A    N
ATOM   4670  CA   TYR B 248      42.765  70.134  16.360  1.00 29.10      A    C
ATOM   4671  CB   TYR B 248      44.070  69.501  16.045  1.00 27.84      A    C
ATOM   4672  CG   TYR B 248      44.253  68.298  16.870  1.00 32.49      A    C
ATOM   4673  CD1  TYR B 248      44.578  68.412  18.186  1.00 35.45      A    C
ATOM   4674  CE1  TYR B 248      44.752  67.344  18.937  1.00 32.25      A    C
ATOM   4675  CZ   TYR B 248      44.578  66.127  18.401  1.00 33.10      A    C
ATOM   4676  OH   TYR B 248      44.758  65.066  19.201  1.00 38.06      A    O
ATOM   4677  CE2  TYR B 248      44.251  65.975  17.108  1.00 28.63      A    C
ATOM   4678  CD2  TYR B 248      44.089  67.043  16.353  1.00 30.64      A    C
ATOM   4679  C    TYR B 248      42.634  71.492  15.741  1.00 29.46      A    C
ATOM   4680  O    TYR B 248      41.972  71.656  14.779  1.00 29.70      A    O
ATOM   4681  N    LEU B 249      43.255  72.470  16.346  1.00 29.40      A    N
ATOM   4682  CA   LEU B 249      43.122  73.835  15.956  1.00 29.15      A    C
ATOM   4683  CB   LEU B 249      43.958  74.628  16.912  1.00 29.05      A    C
ATOM   4684  CG   LEU B 249      43.667  76.036  17.328  1.00 31.82      A    C
ATOM   4685  CD1  LEU B 249      42.259  76.171  17.675  1.00 33.75      A    C
ATOM   4686  CD2  LEU B 249      44.513  76.296  18.494  1.00 31.42      A    C
ATOM   4687  C    LEU B 249      43.611  74.135  14.577  1.00 29.04      A    C
ATOM   4688  O    LEU B 249      42.948  74.761  13.831  1.00 28.98      A    O
ATOM   4689  N    SER B 250      44.789  73.701  14.234  1.00 28.66      A    N
ATOM   4690  CA   SER B 250      45.279  74.017  12.934  1.00 28.88      A    C
ATOM   4691  CB   SER B 250      45.655  75.491  12.801  1.00 28.78      A    C
ATOM   4692  OG   SER B 250      46.549  75.949  13.774  1.00 27.73      A    O
ATOM   4693  C    SER B 250      46.384  73.113  12.527  1.00 29.27      A    C
ATOM   4694  O    SER B 250      46.832  72.346  13.295  1.00 27.65      A    O
ATOM   4695  N    TYR B 251      46.785  73.232  11.281  1.00 29.35      A    N
ATOM   4696  CA   TYR B 251      47.793  72.413  10.706  1.00 30.03      A    C
ATOM   4697  CB   TYR B 251      47.155  71.436   9.759  1.00 30.72      A    C
```

Appendix 1

```
ATOM   4698  CG   TYR B 251      48.089  70.713   8.894  1.00 32.69      A    C
ATOM   4699  CD1  TYR B 251      49.118  69.991   9.413  1.00 37.01      A    C
ATOM   4700  CE1  TYR B 251      49.963  69.339   8.616  1.00 39.56      A    C
ATOM   4701  CZ   TYR B 251      49.783  69.396   7.267  1.00 43.86      A    C
ATOM   4702  OH   TYR B 251      50.607  68.753   6.403  1.00 42.97      A    O
ATOM   4703  CE2  TYR B 251      48.775  70.107   6.745  1.00 40.47      A    C
ATOM   4704  CD2  TYR B 251      47.943  70.752   7.550  1.00 37.21      A    C
ATOM   4705  C    TYR B 251      48.713  73.317   9.994  1.00 31.63      A    C
ATOM   4706  O    TYR B 251      48.310  74.315   9.521  1.00 31.46      A    O
ATOM   4707  N    HIS B 252      49.982  72.979   9.969  1.00 33.50      A    N
ATOM   4708  CA   HIS B 252      50.973  73.855   9.403  1.00 34.70      A    C
ATOM   4709  CB   HIS B 252      51.659  74.581  10.550  1.00 32.93      A    C
ATOM   4710  CG   HIS B 252      50.701  75.301  11.432  1.00 31.51      A    C
ATOM   4711  ND1  HIS B 252      50.170  76.514  11.094  1.00 32.42      A    N
ATOM   4712  CE1  HIS B 252      49.318  76.892  12.015  1.00 29.37      A    C
ATOM   4713  NE2  HIS B 252      49.256  75.952  12.926  1.00 26.61      A    N
ATOM   4714  CD2  HIS B 252      50.116  74.950  12.590  1.00 28.75      A    C
ATOM   4715  C    HIS B 252      51.943  73.112   8.533  1.00 36.37      A    C
ATOM   4716  O    HIS B 252      52.839  72.508   9.005  1.00 37.66      A    O
ATOM   4717  N    PRO B 253      51.766  73.193   7.234  1.00 37.62      A    N
ATOM   4718  CA   PRO B 253      52.446  72.329   6.286  1.00 38.45      A    C
ATOM   4719  CB   PRO B 253      51.838  72.771   4.976  1.00 38.61      A    C
ATOM   4720  CG   PRO B 253      50.564  73.142   5.325  1.00 37.80      A    C
ATOM   4721  CD   PRO B 253      50.633  73.838   6.583  1.00 36.45      A    C
ATOM   4722  C    PRO B 253      53.960  72.392   6.223  1.00 39.30      A    C
ATOM   4723  O    PRO B 253      54.579  71.398   6.035  1.00 38.99      A    O
ATOM   4724  N    GLU B 254      54.562  73.538   6.367  1.00 42.07      A    N
ATOM   4725  CA   GLU B 254      55.998  73.585   6.288  1.00 44.57      A    C
ATOM   4726  CB   GLU B 254      56.468  75.026   6.287  1.00 45.51      A    C
ATOM   4727  CG   GLU B 254      57.907  75.235   6.621  1.00 50.50      A    C
ATOM   4728  CD   GLU B 254      58.758  75.317   5.404  1.00 58.04      A    C
ATOM   4729  OE1  GLU B 254      58.186  75.370   4.320  1.00 60.82      A    O
ATOM   4730  OE2  GLU B 254      59.988  75.303   5.507  1.00 58.21      A    O-1
ATOM   4731  C    GLU B 254      56.670  72.805   7.382  1.00 44.38      A    C
ATOM   4732  O    GLU B 254      57.636  72.149   7.155  1.00 45.05      A    O
ATOM   4733  N    SER B 255      56.172  72.940   8.583  1.00 44.04      A    N
ATOM   4734  CA   SER B 255      56.691  72.265   9.724  1.00 45.14      A    C
ATOM   4735  CB   SER B 255      56.477  73.121  10.937  1.00 44.81      A    C
ATOM   4736  OG   SER B 255      55.480  74.038  10.650  1.00 46.24      A    O
ATOM   4737  C    SER B 255      55.850  71.071   9.854  1.00 46.57      A    C
ATOM   4738  O    SER B 255      54.890  70.906   9.155  1.00 47.39      A    O
ATOM   4739  N    GLY B 256      56.139  70.240  10.813  1.00 46.82      A    N
ATOM   4740  CA   GLY B 256      55.254  69.126  10.944  1.00 47.92      A    C
ATOM   4741  C    GLY B 256      53.844  69.564  11.241  1.00 47.44      A    C
ATOM   4742  O    GLY B 256      52.956  69.116  10.603  1.00 45.53      A    O
ATOM   4743  N    ALA B 257      53.661  70.415  12.231  1.00 47.77      A    N
ATOM   4744  CA   ALA B 257      52.408  71.082  12.470  1.00 47.52      A    C
ATOM   4745  CB   ALA B 257      51.804  71.441  11.193  1.00 49.25      A    C
ATOM   4746  C    ALA B 257      51.380  70.366  13.270  1.00 47.05      A    C
ATOM   4747  O    ALA B 257      51.541  69.273  13.704  1.00 49.82      A    O
ATOM   4748  N    VAL B 258      50.284  71.048  13.433  1.00 45.14      A    N
ATOM   4749  CA   VAL B 258      49.153  70.584  14.207  1.00 42.49      A    C
ATOM   4750  CB   VAL B 258      48.939  69.087  14.161  1.00 41.99      A    C
ATOM   4751  CG1  VAL B 258      47.708  68.746  14.856  1.00 43.68      A    C
```

Appendix 1

```
ATOM   4752  CG2 VAL B 258      48.788  68.639  12.802  1.00 39.28      A  C
ATOM   4753  C   VAL B 258      49.284  71.058  15.619  1.00 40.54      A  C
ATOM   4754  O   VAL B 258      49.897  70.439  16.408  1.00 41.13      A  O
ATOM   4755  N   LYS B 259      48.666  72.171  15.918  1.00 38.06      A  N
ATOM   4756  CA  LYS B 259      48.626  72.682  17.239  1.00 36.33      A  C
ATOM   4757  CB  LYS B 259      47.839  73.973  17.224  1.00 36.06      A  C
ATOM   4758  CG  LYS B 259      48.708  75.145  16.947  1.00 31.34      A  C
ATOM   4759  CD  LYS B 259      47.993  76.428  17.024  1.00 25.42      A  C
ATOM   4760  CE  LYS B 259      48.857  77.503  16.487  1.00 28.39      A  C
ATOM   4761  NZ  LYS B 259      48.109  78.665  16.107  1.00 23.64      A  N
ATOM   4762  C   LYS B 259      47.929  71.634  18.043  1.00 36.27      A  C
ATOM   4763  O   LYS B 259      47.023  71.026  17.573  1.00 37.48      A  O
ATOM   4764  N   PRO B 260      48.330  71.441  19.281  1.00 35.52      A  N
ATOM   4765  CA  PRO B 260      47.946  70.283  20.066  1.00 34.67      A  C
ATOM   4766  CB  PRO B 260      49.111  70.141  20.993  1.00 33.77      A  C
ATOM   4767  CG  PRO B 260      49.639  71.419  21.075  1.00 35.33      A  C
ATOM   4768  CD  PRO B 260      49.599  71.960  19.757  1.00 34.99      A  C
ATOM   4769  C   PRO B 260      46.673  70.411  20.864  1.00 34.12      A  C
ATOM   4770  O   PRO B 260      46.395  69.583  21.675  1.00 35.86      A  O
ATOM   4771  N   TRP B 261      45.889  71.427  20.596  1.00 32.35      A  N
ATOM   4772  CA  TRP B 261      44.662  71.657  21.290  1.00 31.64      A  C
ATOM   4773  CB  TRP B 261      44.575  73.108  21.750  1.00 31.69      A  C
ATOM   4774  CG  TRP B 261      45.642  73.473  22.684  1.00 30.89      A  C
ATOM   4775  CD1 TRP B 261      45.659  73.253  23.992  1.00 27.46      A  C
ATOM   4776  NE1 TRP B 261      46.805  73.679  24.527  1.00 28.92      A  N
ATOM   4777  CE2 TRP B 261      47.577  74.217  23.552  1.00 26.77      A  C
ATOM   4778  CD2 TRP B 261      46.873  74.097  22.370  1.00 30.04      A  C
ATOM   4779  CE3 TRP B 261      47.443  74.567  21.204  1.00 29.08      A  C
ATOM   4780  CZ3 TRP B 261      48.656  75.133  21.275  1.00 31.92      A  C
ATOM   4781  CH2 TRP B 261      49.338  75.219  22.469  1.00 30.27      A  C
ATOM   4782  CZ2 TRP B 261      48.810  74.763  23.614  1.00 28.15      A  C
ATOM   4783  C   TRP B 261      43.495  71.316  20.424  1.00 31.39      A  C
ATOM   4784  O   TRP B 261      43.469  71.645  19.286  1.00 31.33      A  O
ATOM   4785  N   ILE B 262      42.528  70.634  20.983  1.00 30.96      A  N
ATOM   4786  CA  ILE B 262      41.303  70.402  20.295  1.00 30.89      A  C
ATOM   4787  CB  ILE B 262      40.653  69.080  20.666  1.00 31.83      A  C
ATOM   4788  CG1 ILE B 262      40.452  68.966  22.160  1.00 31.53      A  C
ATOM   4789  CD1 ILE B 262      39.492  67.976  22.513  1.00 29.94      A  C
ATOM   4790  CG2 ILE B 262      41.460  67.966  20.157  1.00 32.28      A  C
ATOM   4791  C   ILE B 262      40.362  71.557  20.498  1.00 30.86      A  C
ATOM   4792  O   ILE B 262      40.381  72.184  21.497  1.00 31.32      A  O
ATOM   4793  N   SER B 263      39.544  71.820  19.513  1.00 30.39      A  N
ATOM   4794  CA  SER B 263      38.703  72.982  19.505  1.00 29.85      A  C
ATOM   4795  CB  SER B 263      39.245  73.905  18.437  1.00 30.00      A  C
ATOM   4796  OG  SER B 263      38.420  74.987  18.247  1.00 31.65      A  O
ATOM   4797  C   SER B 263      37.255  72.683  19.236  1.00 28.33      A  C
ATOM   4798  O   SER B 263      36.932  72.190  18.231  1.00 29.53      A  O
ATOM   4799  N   ALA B 264      36.369  72.981  20.148  1.00 28.20      A  N
ATOM   4800  CA  ALA B 264      34.961  72.798  19.898  1.00 28.57      A  C
ATOM   4801  CB  ALA B 264      34.217  72.939  21.166  1.00 28.31      A  C
ATOM   4802  C   ALA B 264      34.297  73.639  18.809  1.00 27.83      A  C
ATOM   4803  O   ALA B 264      33.549  73.128  18.056  1.00 28.03      A  O
ATOM   4804  N   TYR B 265      34.546  74.923  18.750  1.00 28.11      A  N
ATOM   4805  CA  TYR B 265      33.957  75.733  17.720  1.00 28.45      A  C
```

Appendix 1

```
ATOM   4806  CB   TYR B 265      34.130  77.220  18.008  1.00 28.17      A    C
ATOM   4807  CG   TYR B 265      35.156  77.860  17.170  1.00 28.33      A    C
ATOM   4808  CD1  TYR B 265      34.833  78.387  15.968  1.00 24.71      A    C
ATOM   4809  CE1  TYR B 265      35.749  78.893  15.208  1.00 28.31      A    C
ATOM   4810  CZ   TYR B 265      37.018  78.948  15.632  1.00 29.58      A    C
ATOM   4811  OH   TYR B 265      37.959  79.512  14.861  1.00 27.87      A    O
ATOM   4812  CE2  TYR B 265      37.358  78.470  16.814  1.00 26.55      A    C
ATOM   4813  CD2  TYR B 265      36.443  77.918  17.570  1.00 27.93      A    C
ATOM   4814  C    TYR B 265      34.448  75.329  16.350  1.00 28.99      A    C
ATOM   4815  O    TYR B 265      33.726  75.356  15.400  1.00 27.97      A    O
ATOM   4816  N    THR B 266      35.706  74.970  16.270  1.00 28.35      A    N
ATOM   4817  CA   THR B 266      36.272  74.561  15.038  1.00 29.87      A    C
ATOM   4818  CB   THR B 266      37.721  74.244  15.230  1.00 29.93      A    C
ATOM   4819  OG1  THR B 266      38.427  75.413  15.544  1.00 31.56      A    O
ATOM   4820  CG2  THR B 266      38.294  73.696  14.007  1.00 29.90      A    C
ATOM   4821  C    THR B 266      35.588  73.304  14.585  1.00 31.54      A    C
ATOM   4822  O    THR B 266      35.246  73.154  13.447  1.00 31.94      A    O
ATOM   4823  N    THR B 267      35.449  72.378  15.509  1.00 31.92      A    N
ATOM   4824  CA   THR B 267      34.788  71.130  15.285  1.00 31.56      A    C
ATOM   4825  CB   THR B 267      34.976  70.220  16.445  1.00 32.05      A    C
ATOM   4826  OG1  THR B 267      36.313  69.777  16.466  1.00 33.43      A    O
ATOM   4827  CG2  THR B 267      34.132  69.044  16.296  1.00 31.92      A    C
ATOM   4828  C    THR B 267      33.330  71.282  15.017  1.00 31.50      A    C
ATOM   4829  O    THR B 267      32.803  70.608  14.224  1.00 31.71      A    O
ATOM   4830  N    ALA B 268      32.673  72.161  15.722  1.00 31.68      A    N
ATOM   4831  CA   ALA B 268      31.267  72.351  15.514  1.00 31.44      A    C
ATOM   4832  CB   ALA B 268      30.722  73.260  16.556  1.00 30.08      A    C
ATOM   4833  C    ALA B 268      30.944  72.879  14.145  1.00 31.92      A    C
ATOM   4834  O    ALA B 268      30.056  72.420  13.523  1.00 33.44      A    O
ATOM   4835  N    TRP B 269      31.670  73.875  13.698  1.00 31.17      A    N
ATOM   4836  CA   TRP B 269      31.452  74.475  12.423  1.00 30.73      A    C
ATOM   4837  CB   TRP B 269      32.368  75.688  12.337  1.00 31.64      A    C
ATOM   4838  CG   TRP B 269      32.531  76.382  11.040  1.00 35.76      A    C
ATOM   4839  CD1  TRP B 269      32.071  76.000   9.854  1.00 38.29      A    C
ATOM   4840  NE1  TRP B 269      32.414  76.881   8.898  1.00 41.01      A    N
ATOM   4841  CE2  TRP B 269      33.128  77.884   9.470  1.00 41.44      A    C
ATOM   4842  CD2  TRP B 269      33.220  77.602  10.813  1.00 40.70      A    C
ATOM   4843  CE3  TRP B 269      33.905  78.492  11.638  1.00 40.68      A    C
ATOM   4844  CZ3  TRP B 269      34.445  79.575  11.088  1.00 40.59      A    C
ATOM   4845  CH2  TRP B 269      34.337  79.828   9.746  1.00 39.67      A    C
ATOM   4846  CZ2  TRP B 269      33.691  78.993   8.919  1.00 38.20      A    C
ATOM   4847  C    TRP B 269      31.718  73.501  11.312  1.00 30.17      A    C
ATOM   4848  O    TRP B 269      30.988  73.425  10.383  1.00 29.80      A    O
ATOM   4849  N    THR B 270      32.798  72.764  11.410  1.00 30.01      A    N
ATOM   4850  CA   THR B 270      33.212  71.823  10.390  1.00 28.91      A    C
ATOM   4851  CB   THR B 270      34.656  71.328  10.669  1.00 29.95      A    C
ATOM   4852  OG1  THR B 270      35.516  72.434  10.659  1.00 31.20      A    O
ATOM   4853  CG2  THR B 270      35.157  70.397   9.651  1.00 24.02      A    C
ATOM   4854  C    THR B 270      32.283  70.660  10.178  1.00 28.57      A    C
ATOM   4855  O    THR B 270      32.079  70.255   9.095  1.00 27.12      A    O
ATOM   4856  N    LEU B 271      31.768  70.108  11.243  1.00 27.89      A    N
ATOM   4857  CA   LEU B 271      30.887  68.994  11.145  1.00 27.60      A    C
ATOM   4858  CB   LEU B 271      30.601  68.442  12.512  1.00 27.62      A    C
ATOM   4859  CG   LEU B 271      31.359  67.162  12.762  1.00 29.14      A    C
```

Appendix 1

```
ATOM   4860  CD1 LEU B 271      32.539  67.092  11.936  1.00 30.08      A    C
ATOM   4861  CD2 LEU B 271      31.726  67.016  14.147  1.00 30.34      A    C
ATOM   4862  C   LEU B 271      29.631  69.371  10.464  1.00 27.27      A    C
ATOM   4863  O   LEU B 271      29.110  68.665   9.650  1.00 26.21      A    O
ATOM   4864  N   ALA B 272      29.158  70.530  10.804  1.00 28.13      A    N
ATOM   4865  CA  ALA B 272      27.941  71.001  10.255  1.00 29.30      A    C
ATOM   4866  CB  ALA B 272      27.573  72.253  10.907  1.00 28.07      A    C
ATOM   4867  C   ALA B 272      28.034  71.173   8.767  1.00 30.10      A    C
ATOM   4868  O   ALA B 272      27.091  70.957   8.078  1.00 29.12      A    O
ATOM   4869  N   MET B 273      29.157  71.636   8.268  1.00 31.84      A    N
ATOM   4870  CA  MET B 273      29.328  71.779   6.844  1.00 33.97      A    C
ATOM   4871  CB  MET B 273      30.536  72.646   6.535  1.00 35.02      B    C
ATOM   4872  CG  MET B 273      30.252  73.794   5.629  1.00 38.23      B    C
ATOM   4873  SD  MET B 273      30.285  75.295   6.540  1.00 47.05      B    S
ATOM   4874  CE  MET B 273      29.825  76.445   5.360  1.00 43.42      B    C
ATOM   4875  C   MET B 273      29.387  70.466   6.113  1.00 34.12      A    C
ATOM   4876  O   MET B 273      28.827  70.289   5.074  1.00 34.00      A    O
ATOM   4877  N   VAL B 274      30.112  69.556   6.700  1.00 34.93      A    N
ATOM   4878  CA  VAL B 274      30.310  68.232   6.210  1.00 35.77      A    C
ATOM   4879  CB  VAL B 274      31.342  67.564   6.984  1.00 35.51      A    C
ATOM   4880  CG1 VAL B 274      31.601  66.280   6.403  1.00 37.61      A    C
ATOM   4881  CG2 VAL B 274      32.548  68.358   6.939  1.00 34.56      A    C
ATOM   4882  C   VAL B 274      29.050  67.424   6.179  1.00 37.65      A    C
ATOM   4883  O   VAL B 274      28.827  66.693   5.290  1.00 37.26      A    O
ATOM   4884  N   HIS B 275      28.189  67.635   7.139  1.00 39.50      A    N
ATOM   4885  CA  HIS B 275      26.990  66.861   7.245  1.00 40.87      A    C
ATOM   4886  CB  HIS B 275      26.145  67.350   8.397  1.00 41.41      A    C
ATOM   4887  CG  HIS B 275      24.819  66.679   8.507  1.00 43.36      A    C
ATOM   4888  ND1 HIS B 275      24.675  65.364   8.864  1.00 43.88      A    N
ATOM   4889  CE1 HIS B 275      23.400  65.056   8.892  1.00 43.05      A    C
ATOM   4890  NE2 HIS B 275      22.712  66.119   8.551  1.00 41.16      A    N
ATOM   4891  CD2 HIS B 275      23.575  67.151   8.312  1.00 43.52      A    C
ATOM   4892  C   HIS B 275      26.268  67.087   5.978  1.00 41.03      A    C
ATOM   4893  O   HIS B 275      25.506  66.265   5.539  1.00 42.42      A    O
ATOM   4894  N   GLY B 276      26.486  68.259   5.431  1.00 39.66      A    N
ATOM   4895  CA  GLY B 276      25.971  68.637   4.148  1.00 37.64      A    C
ATOM   4896  C   GLY B 276      26.520  67.846   3.012  1.00 36.24      A    C
ATOM   4897  O   GLY B 276      25.820  67.628   2.101  1.00 36.58      A    O
ATOM   4898  N   MET B 277      27.792  67.480   3.064  1.00 36.02      A    N
ATOM   4899  CA  MET B 277      28.451  66.746   1.996  1.00 36.12      A    C
ATOM   4900  CB  MET B 277      29.830  67.308   1.682  1.00 35.39      B    C
ATOM   4901  CG  MET B 277      29.931  68.793   1.614  1.00 34.96      B    C
ATOM   4902  SD  MET B 277      31.588  69.463   1.473  1.00 35.14      B    S
ATOM   4903  CE  MET B 277      31.897  70.036   3.082  1.00 31.25      B    C
ATOM   4904  C   MET B 277      28.579  65.285   2.280  1.00 36.48      A    C
ATOM   4905  O   MET B 277      28.340  64.494   1.441  1.00 37.17      A    O
ATOM   4906  N   ASP B 278      28.965  64.927   3.474  1.00 37.87      A    N
ATOM   4907  CA  ASP B 278      29.010  63.546   3.852  1.00 39.95      A    C
ATOM   4908  CB  ASP B 278      30.461  63.134   4.013  1.00 41.13      A    C
ATOM   4909  CG  ASP B 278      30.645  61.670   4.071  1.00 44.49      A    C
ATOM   4910  OD1 ASP B 278      29.656  60.968   4.064  1.00 51.64      A    O
ATOM   4911  OD2 ASP B 278      31.772  61.207   4.126  1.00 45.71      A    O-1
ATOM   4912  C   ASP B 278      28.300  63.401   5.156  1.00 39.90      A    C
ATOM   4913  O   ASP B 278      28.885  63.576   6.171  1.00 41.14      A    O
```

Appendix 1

```
ATOM   4914  N    PRO B 279      27.038  63.052   5.152  1.00 39.44       A  N
ATOM   4915  CA   PRO B 279      26.323  62.938   6.405  1.00 39.76       A  C
ATOM   4916  CB   PRO B 279      24.919  62.612   5.961  1.00 39.47       A  C
ATOM   4917  CG   PRO B 279      24.838  63.076   4.677  1.00 38.96       A  C
ATOM   4918  CD   PRO B 279      26.118  62.845   4.045  1.00 39.70       A  C
ATOM   4919  C    PRO B 279      26.881  61.867   7.313  1.00 40.04       A  C
ATOM   4920  O    PRO B 279      26.884  62.017   8.483  1.00 40.40       A  O
ATOM   4921  N    ALA B 280      27.342  60.778   6.775  1.00 40.39       A  N
ATOM   4922  CA   ALA B 280      27.819  59.737   7.623  1.00 41.11       A  C
ATOM   4923  CB   ALA B 280      28.133  58.527   6.862  1.00 41.49       A  C
ATOM   4924  C    ALA B 280      29.000  60.195   8.390  1.00 41.30       A  C
ATOM   4925  O    ALA B 280      29.220  59.738   9.482  1.00 39.90       A  O
ATOM   4926  N    PHE B 281      29.780  61.085   7.800  1.00 41.11       A  N
ATOM   4927  CA   PHE B 281      30.950  61.570   8.474  1.00 41.19       A  C
ATOM   4928  CB   PHE B 281      31.646  62.553   7.555  1.00 41.03       A  C
ATOM   4929  CG   PHE B 281      32.973  63.003   8.042  1.00 41.64       A  C
ATOM   4930  CD1  PHE B 281      34.104  62.597   7.436  1.00 39.53       A  C
ATOM   4931  CE1  PHE B 281      35.285  63.001   7.877  1.00 39.19       A  C
ATOM   4932  CZ   PHE B 281      35.373  63.816   8.909  1.00 36.03       A  C
ATOM   4933  CE2  PHE B 281      34.280  64.241   9.519  1.00 37.43       A  C
ATOM   4934  CD2  PHE B 281      33.087  63.844   9.097  1.00 40.84       A  C
ATOM   4935  C    PHE B 281      30.582  62.283   9.766  1.00 41.71       A  C
ATOM   4936  O    PHE B 281      31.103  61.989  10.802  1.00 41.23       A  O
ATOM   4937  N    SER B 282      29.680  63.230   9.703  1.00 41.05       A  N
ATOM   4938  CA   SER B 282      29.235  63.914  10.886  1.00 42.73       A  C
ATOM   4939  CB   SER B 282      28.519  65.165  10.494  1.00 42.89       A  C
ATOM   4940  OG   SER B 282      29.117  65.637   9.344  1.00 44.15       A  O
ATOM   4941  C    SER B 282      28.439  63.121  11.917  1.00 43.97       A  C
ATOM   4942  O    SER B 282      28.574  63.320  13.099  1.00 44.05       A  O
ATOM   4943  N    GLU B 283      27.580  62.246  11.453  1.00 44.44       A  N
ATOM   4944  CA   GLU B 283      26.775  61.442  12.328  1.00 44.81       A  C
ATOM   4945  CB   GLU B 283      25.759  60.637  11.527  1.00 44.82       A  C
ATOM   4946  CG   GLU B 283      24.617  61.430  10.902  1.00 43.12       A  C
ATOM   4947  CD   GLU B 283      23.997  60.730   9.719  1.00 46.73       A  C
ATOM   4948  OE1  GLU B 283      24.241  59.535   9.546  1.00 47.09       A  O
ATOM   4949  OE2  GLU B 283      23.254  61.354   8.971  1.00 45.01       A  O-1
ATOM   4950  C    GLU B 283      27.702  60.566  13.153  1.00 46.01       A  C
ATOM   4951  O    GLU B 283      27.472  60.275  14.305  1.00 46.68       A  O
ATOM   4952  N    ARG B 284      28.775  60.153  12.540  1.00 45.70       A  N
ATOM   4953  CA   ARG B 284      29.732  59.340  13.207  1.00 45.40       A  C
ATOM   4954  CB   ARG B 284      30.771  58.970  12.191  1.00 45.29       A  C
ATOM   4955  CG   ARG B 284      31.528  57.808  12.486  1.00 46.63       A  C
ATOM   4956  CD   ARG B 284      32.787  57.893  11.758  1.00 50.88       A  C
ATOM   4957  NE   ARG B 284      33.873  57.742  12.680  1.00 57.93       A  N
ATOM   4958  CZ   ARG B 284      34.791  56.804  12.585  1.00 61.15       A  C
ATOM   4959  NH1  ARG B 284      34.734  55.947  11.594  1.00 63.54       A  N
ATOM   4960  NH2  ARG B 284      35.753  56.723  13.478  1.00 59.12       A  N
ATOM   4961  C    ARG B 284      30.389  60.052  14.353  1.00 45.45       A  C
ATOM   4962  O    ARG B 284      30.564  59.497  15.396  1.00 47.46       A  O
ATOM   4963  N    TYR B 285      30.789  61.283  14.161  1.00 44.36       A  N
ATOM   4964  CA   TYR B 285      31.528  61.942  15.191  1.00 42.07       A  C
ATOM   4965  CB   TYR B 285      32.553  62.829  14.552  1.00 41.38       A  C
ATOM   4966  CG   TYR B 285      33.683  62.089  13.928  1.00 40.84       A  C
ATOM   4967  CD1  TYR B 285      34.552  61.368  14.685  1.00 38.37       A  C
```

Appendix 1

```
ATOM   4968  CE1  TYR B 285      35.566  60.714  14.134  1.00 37.70      A   C
ATOM   4969  CZ   TYR B 285      35.737  60.771  12.809  1.00 40.65      A   C
ATOM   4970  OH   TYR B 285      36.772  60.114  12.238  1.00 39.96      A   O
ATOM   4971  CE2  TYR B 285      34.889  61.489  12.033  1.00 40.20      A   C
ATOM   4972  CD2  TYR B 285      33.883  62.130  12.582  1.00 39.97      A   C
ATOM   4973  C    TYR B 285      30.738  62.732  16.195  1.00 41.50      A   C
ATOM   4974  O    TYR B 285      31.239  63.049  17.211  1.00 41.04      A   O
ATOM   4975  N    TYR B 286      29.490  63.021  15.912  1.00 42.46      A   N
ATOM   4976  CA   TYR B 286      28.689  63.958  16.692  1.00 43.08      A   C
ATOM   4977  CB   TYR B 286      27.362  64.194  15.998  1.00 42.32      A   C
ATOM   4978  CG   TYR B 286      26.407  65.145  16.655  1.00 42.74      A   C
ATOM   4979  CD1  TYR B 286      26.820  66.314  17.187  1.00 44.41      A   C
ATOM   4980  CE1  TYR B 286      25.943  67.154  17.760  1.00 45.14      A   C
ATOM   4981  CZ   TYR B 286      24.640  66.842  17.780  1.00 43.02      A   C
ATOM   4982  OH   TYR B 286      23.746  67.674  18.341  1.00 43.51      A   O
ATOM   4983  CE2  TYR B 286      24.216  65.706  17.244  1.00 42.80      A   C
ATOM   4984  CD2  TYR B 286      25.081  64.875  16.694  1.00 41.39      A   C
ATOM   4985  C    TYR B 286      28.465  63.584  18.131  1.00 44.05      A   C
ATOM   4986  O    TYR B 286      28.490  64.429  18.978  1.00 44.86      A   O
ATOM   4987  N    PRO B 287      28.221  62.320  18.412  1.00 44.71      A   N
ATOM   4988  CA   PRO B 287      28.082  61.890  19.785  1.00 44.60      A   C
ATOM   4989  CB   PRO B 287      27.784  60.410  19.624  1.00 44.81      A   C
ATOM   4990  CG   PRO B 287      27.771  60.150  18.258  1.00 43.89      A   C
ATOM   4991  CD   PRO B 287      27.545  61.364  17.547  1.00 43.98      A   C
ATOM   4992  C    PRO B 287      29.314  62.067  20.623  1.00 44.52      A   C
ATOM   4993  O    PRO B 287      29.241  62.444  21.751  1.00 44.16      A   O
ATOM   4994  N    ARG B 288      30.450  61.767  20.063  1.00 45.33      A   N
ATOM   4995  CA   ARG B 288      31.675  61.959  20.775  1.00 46.34      A   C
ATOM   4996  CB   ARG B 288      32.812  61.324  20.025  1.00 47.23      A   C
ATOM   4997  CG   ARG B 288      32.956  59.921  20.376  1.00 52.10      A   C
ATOM   4998  CD   ARG B 288      33.365  59.061  19.237  1.00 61.33      A   C
ATOM   4999  NE   ARG B 288      34.164  57.962  19.750  1.00 67.95      A   N
ATOM   5000  CZ   ARG B 288      34.353  56.802  19.145  1.00 70.22      A   C
ATOM   5001  NH1  ARG B 288      33.800  56.545  17.977  1.00 69.95      A   N
ATOM   5002  NH2  ARG B 288      35.101  55.890  19.725  1.00 70.97      A   N
ATOM   5003  C    ARG B 288      31.936  63.412  21.072  1.00 45.06      A   C
ATOM   5004  O    ARG B 288      32.421  63.735  22.126  1.00 45.20      A   O
ATOM   5005  N    PHE B 289      31.601  64.283  20.138  1.00 42.60      A   N
ATOM   5006  CA   PHE B 289      31.843  65.695  20.285  1.00 39.72      A   C
ATOM   5007  CB   PHE B 289      31.387  66.418  19.014  1.00 37.67      A   C
ATOM   5008  CG   PHE B 289      31.022  67.847  19.201  1.00 36.09      A   C
ATOM   5009  CD1  PHE B 289      31.965  68.826  19.162  1.00 35.81      A   C
ATOM   5010  CE1  PHE B 289      31.623  70.116  19.324  1.00 32.45      A   C
ATOM   5011  CZ   PHE B 289      30.362  70.443  19.498  1.00 30.64      A   C
ATOM   5012  CE2  PHE B 289      29.414  69.505  19.522  1.00 33.33      A   C
ATOM   5013  CD2  PHE B 289      29.731  68.221  19.364  1.00 35.31      A   C
ATOM   5014  C    PHE B 289      31.093  66.185  21.468  1.00 38.80      A   C
ATOM   5015  O    PHE B 289      31.622  66.904  22.261  1.00 38.23      A   O
ATOM   5016  N    LYS B 290      29.856  65.774  21.587  1.00 38.54      A   N
ATOM   5017  CA   LYS B 290      29.027  66.181  22.683  1.00 39.92      A   C
ATOM   5018  CB   LYS B 290      27.637  65.642  22.506  1.00 39.90      A   C
ATOM   5019  CG   LYS B 290      26.752  66.448  21.659  1.00 42.37      A   C
ATOM   5020  CD   LYS B 290      25.748  65.581  20.997  1.00 45.29      A   C
ATOM   5021  CE   LYS B 290      24.600  65.285  21.890  1.00 49.51      A   C
```

Appendix 1

```
ATOM   5022  NZ   LYS B 290      23.454  64.879  21.071  1.00 48.56          A  N
ATOM   5023  C    LYS B 290      29.574  65.680  23.971  1.00 39.46          A  C
ATOM   5024  O    LYS B 290      29.591  66.369  24.935  1.00 40.46          A  O
ATOM   5025  N    GLN B 291      30.039  64.460  23.991  1.00 39.56          A  N
ATOM   5026  CA   GLN B 291      30.558  63.943  25.211  1.00 40.86          A  C
ATOM   5027  CB   GLN B 291      30.992  62.490  25.007  1.00 40.98          A  C
ATOM   5028  CG   GLN B 291      31.198  61.712  26.274  1.00 49.22          A  C
ATOM   5029  CD   GLN B 291      31.722  60.292  26.057  1.00 58.45          A  C
ATOM   5030  OE1  GLN B 291      31.491  59.688  25.019  1.00 61.29          A  O
ATOM   5031  NE2  GLN B 291      32.414  59.753  27.051  1.00 57.02          A  N
ATOM   5032  C    GLN B 291      31.727  64.805  25.557  1.00 39.51          A  C
ATOM   5033  O    GLN B 291      31.875  65.240  26.659  1.00 38.62          A  O
ATOM   5034  N    THR B 292      32.553  65.070  24.578  1.00 38.62          A  N
ATOM   5035  CA   THR B 292      33.763  65.799  24.811  1.00 39.27          A  C
ATOM   5036  CB   THR B 292      34.638  65.781  23.583  1.00 40.59          A  C
ATOM   5037  OG1  THR B 292      34.679  64.465  23.048  1.00 42.09          A  O
ATOM   5038  CG2  THR B 292      36.004  66.197  23.930  1.00 41.13          A  C
ATOM   5039  C    THR B 292      33.632  67.226  25.279  1.00 38.25          A  C
ATOM   5040  O    THR B 292      34.391  67.650  26.091  1.00 37.91          A  O
ATOM   5041  N    PHE B 293      32.695  67.965  24.729  1.00 36.61          A  N
ATOM   5042  CA   PHE B 293      32.630  69.393  24.924  1.00 35.49          A  C
ATOM   5043  CB   PHE B 293      32.714  70.066  23.567  1.00 34.81          A  C
ATOM   5044  CG   PHE B 293      34.032  69.950  22.887  1.00 32.06          A  C
ATOM   5045  CD1  PHE B 293      35.166  70.364  23.479  1.00 28.23          A  C
ATOM   5046  CE1  PHE B 293      36.325  70.300  22.826  1.00 30.95          A  C
ATOM   5047  CZ   PHE B 293      36.382  69.832  21.585  1.00 30.53          A  C
ATOM   5048  CE2  PHE B 293      35.282  69.434  20.973  1.00 31.16          A  C
ATOM   5049  CD2  PHE B 293      34.111  69.497  21.610  1.00 31.52          A  C
ATOM   5050  C    PHE B 293      31.417  69.979  25.638  1.00 36.35          A  C
ATOM   5051  O    PHE B 293      31.483  71.057  26.163  1.00 34.82          A  O
ATOM   5052  N    VAL B 294      30.293  69.294  25.609  1.00 36.87          A  N
ATOM   5053  CA   VAL B 294      29.034  69.893  26.025  1.00 38.01          A  C
ATOM   5054  CB   VAL B 294      27.873  69.371  25.230  1.00 37.54          A  C
ATOM   5055  CG1  VAL B 294      26.600  69.854  25.829  1.00 35.33          A  C
ATOM   5056  CG2  VAL B 294      27.979  69.749  23.832  1.00 34.76          A  C
ATOM   5057  C    VAL B 294      28.647  69.676  27.468  1.00 39.47          A  C
ATOM   5058  O    VAL B 294      28.731  68.592  27.969  1.00 39.89          A  O
ATOM   5059  N    GLU B 295      28.202  70.726  28.127  1.00 41.49          A  N
ATOM   5060  CA   GLU B 295      27.774  70.612  29.493  1.00 43.61          A  C
ATOM   5061  CB   GLU B 295      28.565  71.561  30.348  1.00 44.69          A  C
ATOM   5062  CG   GLU B 295      27.824  72.000  31.559  1.00 47.63          A  C
ATOM   5063  CD   GLU B 295      28.662  72.789  32.517  1.00 51.90          A  C
ATOM   5064  OE1  GLU B 295      29.750  73.217  32.140  1.00 52.41          A  O
ATOM   5065  OE2  GLU B 295      28.241  72.982  33.656  1.00 50.97          A  O-1
ATOM   5066  C    GLU B 295      26.331  70.934  29.716  1.00 44.26          A  C
ATOM   5067  O    GLU B 295      25.946  72.054  29.617  1.00 44.63          A  O
ATOM   5068  N    VAL B 296      25.544  69.952  30.100  1.00 44.29          A  N
ATOM   5069  CA   VAL B 296      24.200  70.219  30.535  1.00 44.65          A  C
ATOM   5070  CB   VAL B 296      23.353  68.990  30.393  1.00 45.21          A  C
ATOM   5071  CG1  VAL B 296      22.063  69.154  31.082  1.00 42.80          A  C
ATOM   5072  CG2  VAL B 296      23.135  68.698  28.975  1.00 44.67          A  C
ATOM   5073  C    VAL B 296      24.193  70.707  31.970  1.00 45.46          A  C
ATOM   5074  O    VAL B 296      24.842  70.155  32.822  1.00 45.23          A  O
ATOM   5075  N    TYR B 297      23.475  71.778  32.237  1.00 46.84          A  N
```

Appendix 1

```
ATOM   5076  CA   TYR B 297      23.489  72.273  33.583  1.00 47.78           A        C
ATOM   5077  CB   TYR B 297      24.505  73.396  33.727  1.00 46.37           A        C
ATOM   5078  CG   TYR B 297      24.176  74.673  33.043  1.00 44.25           A        C
ATOM   5079  CD1  TYR B 297      23.689  75.710  33.750  1.00 39.53           A        C
ATOM   5080  CE1  TYR B 297      23.388  76.846  33.171  1.00 40.22           A        C
ATOM   5081  CZ   TYR B 297      23.608  77.018  31.878  1.00 42.02           A        C
ATOM   5082  OH   TYR B 297      23.279  78.224  31.366  1.00 39.13           A        O
ATOM   5083  CE2  TYR B 297      24.116  76.020  31.130  1.00 40.98           A        C
ATOM   5084  CD2  TYR B 297      24.414  74.857  31.713  1.00 39.98           A        C
ATOM   5085  C    TYR B 297      22.204  72.542  34.365  1.00 49.97           A        C
ATOM   5086  O    TYR B 297      22.176  72.345  35.557  1.00 51.67           A        O
ATOM   5087  N    ASP B 298      21.144  73.026  33.780  1.00 51.44           A        N
ATOM   5088  CA   ASP B 298      20.054  73.363  34.673  1.00 53.32           A        C
ATOM   5089  CB   ASP B 298      19.344  74.584  34.186  1.00 54.27           A        C
ATOM   5090  CG   ASP B 298      18.525  75.187  35.213  1.00 56.22           A        C
ATOM   5091  OD1  ASP B 298      18.874  75.057  36.383  1.00 59.26           A        O
ATOM   5092  OD2  ASP B 298      17.530  75.793  34.854  1.00 57.66           A        O
ATOM   5093  C    ASP B 298      19.040  72.289  34.881  1.00 54.02           A        C
ATOM   5094  O    ASP B 298      17.919  72.459  34.501  1.00 55.33           A        O
ATOM   5095  N    GLU B 299      19.431  71.171  35.445  1.00 54.06           A        N
ATOM   5096  CA   GLU B 299      18.572  70.015  35.481  1.00 54.43           A        C
ATOM   5097  CB   GLU B 299      17.366  70.162  36.406  1.00 55.42           A        C
ATOM   5098  CG   GLU B 299      17.367  71.351  37.284  1.00 58.87           A        C
ATOM   5099  CD   GLU B 299      17.455  71.014  38.726  1.00 63.30           A        C
ATOM   5100  OE1  GLU B 299      18.367  70.277  39.106  1.00 63.86           A        O
ATOM   5101  OE2  GLU B 299      16.620  71.501  39.493  1.00 64.01           A        O
ATOM   5102  C    GLU B 299      18.127  69.699  34.090  1.00 53.30           A        C
ATOM   5103  O    GLU B 299      16.989  69.388  33.859  1.00 53.09           A        O
ATOM   5104  N    GLY B 300      19.047  69.797  33.157  1.00 52.23           A        N
ATOM   5105  CA   GLY B 300      18.838  69.370  31.795  1.00 49.74           A        C
ATOM   5106  C    GLY B 300      18.209  70.409  30.923  1.00 48.66           A        C
ATOM   5107  O    GLY B 300      18.042  70.236  29.747  1.00 48.65           A        O
ATOM   5108  N    ARG B 301      17.847  71.507  31.531  1.00 47.36           A        N
ATOM   5109  CA   ARG B 301      17.329  72.649  30.824  1.00 46.46           A        C
ATOM   5110  CB   ARG B 301      16.561  73.524  31.770  1.00 46.59           A        C
ATOM   5111  CG   ARG B 301      15.404  72.786  32.313  1.00 48.84           A        C
ATOM   5112  CD   ARG B 301      14.327  73.681  32.802  1.00 53.07           A        C
ATOM   5113  NE   ARG B 301      14.705  74.330  34.039  1.00 57.01           A        N
ATOM   5114  CZ   ARG B 301      14.617  73.775  35.232  1.00 58.75           A        C
ATOM   5115  NH1  ARG B 301      14.161  72.550  35.361  1.00 58.89           A        N
ATOM   5116  NH2  ARG B 301      14.994  74.452  36.292  1.00 55.49           A        N
ATOM   5117  C    ARG B 301      18.295  73.427  29.934  1.00 45.44           A        C
ATOM   5118  O    ARG B 301      17.909  73.992  28.951  1.00 45.60           A        O
ATOM   5119  N    LYS B 302      19.553  73.442  30.298  1.00 43.23           A        N
ATOM   5120  CA   LYS B 302      20.493  74.294  29.645  1.00 41.55           A        C
ATOM   5121  CB   LYS B 302      20.779  75.483  30.530  1.00 41.93           A        C
ATOM   5122  CG   LYS B 302      19.611  76.389  30.655  1.00 44.38           A        C
ATOM   5123  CD   LYS B 302      19.871  77.541  31.538  1.00 47.27           A        C
ATOM   5124  CE   LYS B 302      18.602  78.173  31.939  1.00 51.22           A        C
ATOM   5125  NZ   LYS B 302      18.707  79.637  32.121  1.00 56.82           A        N
ATOM   5126  C    LYS B 302      21.750  73.562  29.275  1.00 39.95           A        C
ATOM   5127  O    LYS B 302      22.031  72.532  29.808  1.00 39.44           A        O
ATOM   5128  N    ALA B 303      22.465  74.094  28.310  1.00 37.17           A        N
ATOM   5129  CA   ALA B 303      23.711  73.533  27.864  1.00 35.61           A        C
```

Appendix 1

```
ATOM   5130  CB  ALA B 303      23.498  72.721  26.649  1.00 35.86           A    C
ATOM   5131  C   ALA B 303      24.654  74.659  27.575  1.00 33.86           A    C
ATOM   5132  O   ALA B 303      24.233  75.741  27.317  1.00 33.09           A    O
ATOM   5133  N   ARG B 304      25.934  74.396  27.673  1.00 31.52           A    N
ATOM   5134  CA  ARG B 304      26.938  75.339  27.275  1.00 30.96           A    C
ATOM   5135  CB  ARG B 304      27.162  76.359  28.354  1.00 31.18           A    C
ATOM   5136  CG  ARG B 304      27.649  75.786  29.578  1.00 31.45           A    C
ATOM   5137  CD  ARG B 304      27.573  76.745  30.617  1.00 37.17           A    C
ATOM   5138  NE  ARG B 304      27.934  76.103  31.839  1.00 42.55           A    N
ATOM   5139  CZ  ARG B 304      27.527  76.493  33.022  1.00 44.67           A    C
ATOM   5140  NH1 ARG B 304      26.770  77.541  33.140  1.00 44.21           A    N
ATOM   5141  NH2 ARG B 304      27.902  75.847  34.087  1.00 46.42           A    N
ATOM   5142  C   ARG B 304      28.204  74.594  26.953  1.00 30.38           A    C
ATOM   5143  O   ARG B 304      28.438  73.545  27.446  1.00 30.54           A    O
ATOM   5144  N   VAL B 305      29.012  75.149  26.087  1.00 29.75           A    N
ATOM   5145  CA  VAL B 305      30.051  74.390  25.449  1.00 28.20           A    C
ATOM   5146  CB  VAL B 305      29.767  74.333  23.965  1.00 28.04           A    C
ATOM   5147  CG1 VAL B 305      30.580  73.361  23.317  1.00 27.48           A    C
ATOM   5148  CG2 VAL B 305      28.415  73.963  23.757  1.00 23.19           A    C
ATOM   5149  C   VAL B 305      31.487  74.818  25.781  1.00 28.60           A    C
ATOM   5150  O   VAL B 305      31.816  75.966  25.799  1.00 28.67           A    O
ATOM   5151  N   ARG B 306      32.331  73.854  26.068  1.00 28.20           A    N
ATOM   5152  CA  ARG B 306      33.713  74.120  26.374  1.00 29.24           A    C
ATOM   5153  CB  ARG B 306      34.278  73.008  27.248  1.00 30.32           A    C
ATOM   5154  CG  ARG B 306      33.602  72.849  28.577  1.00 30.82           A    C
ATOM   5155  CD  ARG B 306      34.245  71.828  29.469  1.00 33.56           A    C
ATOM   5156  NE  ARG B 306      34.045  70.459  29.032  1.00 36.49           A    N
ATOM   5157  CZ  ARG B 306      32.993  69.716  29.329  1.00 36.26           A    C
ATOM   5158  NH1 ARG B 306      32.026  70.191  30.038  1.00 29.32           A    N
ATOM   5159  NH2 ARG B 306      32.900  68.504  28.892  1.00 36.54           A    N
ATOM   5160  C   ARG B 306      34.516  74.276  25.103  1.00 29.57           A    C
ATOM   5161  O   ARG B 306      34.327  73.549  24.197  1.00 29.69           A    O
ATOM   5162  N   GLU B 307      35.344  75.295  25.006  1.00 31.10           A    N
ATOM   5163  CA  GLU B 307      36.131  75.525  23.808  1.00 31.04           A    C
ATOM   5164  CB  GLU B 307      36.822  76.880  23.844  1.00 30.11           A    C
ATOM   5165  CG  GLU B 307      37.107  77.588  22.494  1.00 36.12           A    C
ATOM   5166  CD  GLU B 307      37.161  76.711  21.247  1.00 38.64           A    C
ATOM   5167  OE1 GLU B 307      36.121  76.473  20.687  1.00 39.19           A    O
ATOM   5168  OE2 GLU B 307      38.232  76.288  20.824  1.00 32.38           A    O
ATOM   5169  C   GLU B 307      37.133  74.428  23.577  1.00 30.21           A    C
ATOM   5170  O   GLU B 307      37.386  74.053  22.474  1.00 30.09           A    O
ATOM   5171  N   THR B 308      37.709  73.933  24.652  1.00 29.38           A    N
ATOM   5172  CA  THR B 308      38.814  73.006  24.600  1.00 30.75           A    C
ATOM   5173  CB  THR B 308      40.152  73.726  24.466  1.00 30.18           A    C
ATOM   5174  OG1 THR B 308      41.167  72.791  24.142  1.00 30.03           A    O
ATOM   5175  CG2 THR B 308      40.489  74.442  25.697  1.00 28.38           A    C
ATOM   5176  C   THR B 308      38.818  71.976  25.712  1.00 31.89           A    C
ATOM   5177  O   THR B 308      38.001  71.995  26.569  1.00 32.64           A    O
ATOM   5178  N   ALA B 309      39.714  71.028  25.614  1.00 33.25           A    N
ATOM   5179  CA  ALA B 309      39.809  69.903  26.524  1.00 35.55           A    C
ATOM   5180  CB  ALA B 309      40.485  68.807  25.838  1.00 35.26           A    C
ATOM   5181  C   ALA B 309      40.249  69.930  27.987  1.00 37.62           A    C
ATOM   5182  O   ALA B 309      39.712  69.232  28.802  1.00 41.21           A    O
ATOM   5183  N   GLY B 310      41.190  70.717  28.369  1.00 38.20           A    N
```

Appendix 1

```
ATOM   5184  CA  GLY B 310      41.658  70.526  29.709  1.00 38.56           A    C
ATOM   5185  C   GLY B 310      41.080  71.485  30.689  1.00 39.23           A    C
ATOM   5186  O   GLY B 310      41.770  71.942  31.529  1.00 38.92           A    O
ATOM   5187  N   THR B 311      39.822  71.827  30.552  1.00 40.11           A    N
ATOM   5188  CA  THR B 311      39.262  72.909  31.323  1.00 41.15           A    C
ATOM   5189  CB  THR B 311      39.507  74.228  30.606  1.00 40.93           A    C
ATOM   5190  OG1 THR B 311      39.132  75.309  31.440  1.00 41.70           A    O
ATOM   5191  CG2 THR B 311      38.736  74.294  29.328  1.00 38.87           A    C
ATOM   5192  C   THR B 311      37.788  72.700  31.587  1.00 42.53           A    C
ATOM   5193  O   THR B 311      37.177  71.910  30.949  1.00 43.19           A    O
ATOM   5194  N   ASP B 312      37.222  73.391  32.554  1.00 44.02           A    N
ATOM   5195  CA  ASP B 312      35.782  73.388  32.745  1.00 45.44           A    C
ATOM   5196  CB  ASP B 312      35.417  73.019  34.175  1.00 46.48           A    C
ATOM   5197  CG  ASP B 312      35.673  71.571  34.488  1.00 48.87           A    C
ATOM   5198  OD1 ASP B 312      35.096  70.700  33.828  1.00 46.62           A    O
ATOM   5199  OD2 ASP B 312      36.457  71.309  35.394  1.00 51.05           A    O-1
ATOM   5200  C   ASP B 312      35.153  74.705  32.378  1.00 45.17           A    C
ATOM   5201  O   ASP B 312      33.985  74.901  32.545  1.00 45.01           A    O
ATOM   5202  N   ASP B 313      35.948  75.624  31.888  1.00 44.77           A    N
ATOM   5203  CA  ASP B 313      35.440  76.915  31.537  1.00 45.19           A    C
ATOM   5204  CB  ASP B 313      36.575  77.903  31.346  1.00 45.91           A    C
ATOM   5205  CG  ASP B 313      37.297  78.233  32.638  1.00 49.17           A    C
ATOM   5206  OD1 ASP B 313      36.725  78.893  33.488  1.00 55.17           A    O
ATOM   5207  OD2 ASP B 313      38.451  77.842  32.810  1.00 52.26           A    O-1
ATOM   5208  C   ASP B 313      34.665  76.745  30.291  1.00 44.87           A    C
ATOM   5209  O   ASP B 313      34.920  75.862  29.548  1.00 44.89           A    O
ATOM   5210  N   ALA B 314      33.747  77.637  30.019  1.00 44.69           A    N
ATOM   5211  CA  ALA B 314      32.860  77.435  28.926  1.00 45.56           A    C
ATOM   5212  CB  ALA B 314      31.554  77.998  29.226  1.00 46.84           A    C
ATOM   5213  C   ALA B 314      33.415  78.047  27.685  1.00 45.78           A    C
ATOM   5214  O   ALA B 314      34.366  77.545  27.152  1.00 48.62           A    O
ATOM   5215  N   ASP B 315      32.876  79.132  27.200  1.00 44.07           A    N
ATOM   5216  CA  ASP B 315      33.243  79.507  25.861  1.00 42.19           A    C
ATOM   5217  CB  ASP B 315      32.167  80.365  25.244  1.00 42.55           A    C
ATOM   5218  CG  ASP B 315      30.973  79.591  24.850  1.00 45.93           A    C
ATOM   5219  OD1 ASP B 315      30.852  79.308  23.683  1.00 51.20           A    O
ATOM   5220  OD2 ASP B 315      30.139  79.294  25.686  1.00 46.97           A    O
ATOM   5221  C   ASP B 315      34.539  80.237  25.801  1.00 39.66           A    C
ATOM   5222  O   ASP B 315      34.579  81.410  25.719  1.00 39.49           A    O
ATOM   5223  N   GLY B 316      35.616  79.493  25.795  1.00 38.02           A    N
ATOM   5224  CA  GLY B 316      36.934  80.055  25.763  1.00 36.41           A    C
ATOM   5225  C   GLY B 316      37.395  80.453  24.398  1.00 36.40           A    C
ATOM   5226  O   GLY B 316      36.662  80.362  23.452  1.00 35.51           A    O
ATOM   5227  N   GLY B 317      38.618  80.929  24.300  1.00 35.30           A    N
ATOM   5228  CA  GLY B 317      39.151  81.299  23.027  1.00 34.62           A    C
ATOM   5229  C   GLY B 317      38.362  82.373  22.335  1.00 34.24           A    C
ATOM   5230  O   GLY B 317      38.219  83.461  22.809  1.00 33.06           A    O
ATOM   5231  N   VAL B 318      37.852  82.035  21.173  1.00 32.76           A    N
ATOM   5232  CA  VAL B 318      37.025  82.945  20.439  1.00 31.79           A    C
ATOM   5233  CB  VAL B 318      37.028  82.658  18.965  1.00 32.43           A    C
ATOM   5234  CG1 VAL B 318      38.387  82.875  18.437  1.00 28.77           A    C
ATOM   5235  CG2 VAL B 318      36.578  81.286  18.698  1.00 33.38           A    C
ATOM   5236  C   VAL B 318      35.653  83.181  21.030  1.00 30.57           A    C
ATOM   5237  O   VAL B 318      35.066  84.179  20.789  1.00 29.64           A    O
```

Appendix 1

```
ATOM   5238  N    GLY B 319      35.185  82.287  21.869  1.00  28.47      A  N
ATOM   5239  CA   GLY B 319      33.915  82.473  22.533  1.00  27.92      A  C
ATOM   5240  C    GLY B 319      32.720  82.009  21.769  1.00  27.01      A  C
ATOM   5241  O    GLY B 319      31.611  82.325  22.077  1.00  26.96      A  O
ATOM   5242  N    LEU B 320      32.991  81.245  20.748  1.00  26.10      A  N
ATOM   5243  CA   LEU B 320      31.992  80.847  19.838  1.00  25.73      A  C
ATOM   5244  CB   LEU B 320      32.437  81.165  18.437  1.00  25.01      A  C
ATOM   5245  CG   LEU B 320      32.623  82.614  18.060  1.00  27.97      A  C
ATOM   5246  CD1  LEU B 320      33.064  82.728  16.693  1.00  27.92      A  C
ATOM   5247  CD2  LEU B 320      31.427  83.387  18.255  1.00  28.29      A  C
ATOM   5248  C    LEU B 320      31.579  79.417  19.921  1.00  26.03      A  C
ATOM   5249  O    LEU B 320      30.836  79.014  19.130  1.00  27.18      A  O
ATOM   5250  N    ALA B 321      32.042  78.636  20.869  1.00  26.39      A  N
ATOM   5251  CA   ALA B 321      31.660  77.237  20.851  1.00  26.89      A  C
ATOM   5252  CB   ALA B 321      32.468  76.442  21.838  1.00  26.50      A  C
ATOM   5253  C    ALA B 321      30.169  76.915  21.004  1.00  26.37      A  C
ATOM   5254  O    ALA B 321      29.680  76.057  20.342  1.00  26.07      A  O
ATOM   5255  N    SER B 322      29.466  77.572  21.895  1.00  24.32      A  N
ATOM   5256  CA   SER B 322      28.063  77.308  22.061  1.00  25.10      A  C
ATOM   5257  CB   SER B 322      27.486  77.992  23.279  1.00  24.84      A  C
ATOM   5258  OG   SER B 322      28.170  77.668  24.433  1.00  24.66      A  O
ATOM   5259  C    SER B 322      27.233  77.679  20.916  1.00  25.64      A  C
ATOM   5260  O    SER B 322      26.329  76.998  20.600  1.00  28.04      A  O
ATOM   5261  N    ALA B 323      27.520  78.818  20.353  1.00  27.28      A  N
ATOM   5262  CA   ALA B 323      26.853  79.330  19.196  1.00  28.62      A  C
ATOM   5263  CB   ALA B 323      27.322  80.681  18.944  1.00  28.56      A  C
ATOM   5264  C    ALA B 323      27.023  78.496  17.962  1.00  29.79      A  C
ATOM   5265  O    ALA B 323      26.116  78.362  17.209  1.00  31.14      A  O
ATOM   5266  N    PHE B 324      28.206  77.985  17.727  1.00  30.20      A  N
ATOM   5267  CA   PHE B 324      28.419  77.055  16.660  1.00  30.89      A  C
ATOM   5268  CB   PHE B 324      29.885  76.921  16.331  1.00  30.76      A  C
ATOM   5269  CG   PHE B 324      30.342  77.906  15.335  1.00  33.33      A  C
ATOM   5270  CD1  PHE B 324      30.004  77.778  14.047  1.00  31.61      A  C
ATOM   5271  CE1  PHE B 324      30.398  78.671  13.167  1.00  34.42      A  C
ATOM   5272  CZ   PHE B 324      31.116  79.717  13.543  1.00  33.38      A  C
ATOM   5273  CE2  PHE B 324      31.445  79.872  14.800  1.00  36.60      A  C
ATOM   5274  CD2  PHE B 324      31.061  78.986  15.699  1.00  33.62      A  C
ATOM   5275  C    PHE B 324      27.745  75.736  16.877  1.00  31.04      A  C
ATOM   5276  O    PHE B 324      27.244  75.150  15.987  1.00  31.68      A  O
ATOM   5277  N    THR B 325      27.758  75.287  18.100  1.00  30.70      A  N
ATOM   5278  CA   THR B 325      27.116  74.064  18.471  1.00  30.76      A  C
ATOM   5279  CB   THR B 325      27.436  73.698  19.867  1.00  31.22      A  C
ATOM   5280  OG1  THR B 325      28.886  73.814  19.998  1.00  31.15      A  O
ATOM   5281  CG2  THR B 325      27.148  72.327  20.151  1.00  31.32      A  C
ATOM   5282  C    THR B 325      25.615  74.141  18.255  1.00  31.14      A  C
ATOM   5283  O    THR B 325      24.989  73.189  17.856  1.00  30.97      A  O
ATOM   5284  N    LEU B 326      25.062  75.309  18.462  1.00  30.15      A  N
ATOM   5285  CA   LEU B 326      23.691  75.549  18.209  1.00  30.07      A  C
ATOM   5286  CB   LEU B 326      23.395  76.974  18.573  1.00  29.12      A  C
ATOM   5287  CG   LEU B 326      21.982  77.470  18.483  1.00  26.60      A  C
ATOM   5288  CD1  LEU B 326      21.149  76.817  19.472  1.00  25.96      A  C
ATOM   5289  CD2  LEU B 326      21.963  78.915  18.673  1.00  24.58      A  C
ATOM   5290  C    LEU B 326      23.373  75.322  16.760  1.00  30.63      A  C
ATOM   5291  O    LEU B 326      22.431  74.679  16.450  1.00  31.54      A  O
```

Appendix 1

```
ATOM   5292  N    LEU B 327      24.192  75.826  15.871  1.00 31.14           A    N
ATOM   5293  CA   LEU B 327      24.081  75.541  14.469  1.00 32.01           A    C
ATOM   5294  CB   LEU B 327      25.049  76.429  13.717  1.00 32.76           A    C
ATOM   5295  CG   LEU B 327      25.484  76.126  12.301  1.00 32.51           A    C
ATOM   5296  CD1  LEU B 327      24.355  76.110  11.414  1.00 35.77           A    C
ATOM   5297  CD2  LEU B 327      26.413  77.142  11.861  1.00 35.28           A    C
ATOM   5298  C    LEU B 327      24.279  74.078  14.087  1.00 32.63           A    C
ATOM   5299  O    LEU B 327      23.620  73.573  13.241  1.00 31.74           A    O
ATOM   5300  N    LEU B 328      25.213  73.408  14.700  1.00 32.83           A    N
ATOM   5301  CA   LEU B 328      25.383  71.999  14.491  1.00 34.36           A    C
ATOM   5302  CB   LEU B 328      26.611  71.540  15.228  1.00 33.17           A    C
ATOM   5303  CG   LEU B 328      26.879  70.082  15.060  1.00 31.32           A    C
ATOM   5304  CD1  LEU B 328      26.994  69.780  13.637  1.00 28.59           A    C
ATOM   5305  CD2  LEU B 328      28.078  69.725  15.774  1.00 29.09           A    C
ATOM   5306  C    LEU B 328      24.205  71.172  14.951  1.00 36.19           A    C
ATOM   5307  O    LEU B 328      23.764  70.286  14.279  1.00 36.25           A    O
ATOM   5308  N    ALA B 329      23.697  71.479  16.117  1.00 38.16           A    N
ATOM   5309  CA   ALA B 329      22.552  70.797  16.646  1.00 39.80           A    C
ATOM   5310  CB   ALA B 329      22.257  71.286  17.989  1.00 40.02           A    C
ATOM   5311  C    ALA B 329      21.364  70.970  15.746  1.00 40.10           A    C
ATOM   5312  O    ALA B 329      20.585  70.081  15.585  1.00 41.49           A    O
ATOM   5313  N    ARG B 330      21.227  72.119  15.146  1.00 40.21           A    N
ATOM   5314  CA   ARG B 330      20.267  72.296  14.101  1.00 40.79           A    C
ATOM   5315  CB   ARG B 330      20.235  73.769  13.727  1.00 40.84           A    C
ATOM   5316  CG   ARG B 330      19.126  74.192  12.842  1.00 39.50           A    C
ATOM   5317  CD   ARG B 330      17.835  74.203  13.561  1.00 36.56           A    C
ATOM   5318  NE   ARG B 330      16.858  75.074  12.956  1.00 34.14           A    N
ATOM   5319  CZ   ARG B 330      15.860  74.659  12.222  1.00 35.27           A    C
ATOM   5320  NH1  ARG B 330      15.719  73.394  11.979  1.00 34.20           A    N
ATOM   5321  NH2  ARG B 330      15.021  75.506  11.732  1.00 32.40           A    N
ATOM   5322  C    ARG B 330      20.548  71.445  12.866  1.00 42.04           A    C
ATOM   5323  O    ARG B 330      19.671  70.841  12.339  1.00 43.99           A    O
ATOM   5324  N    GLU B 331      21.768  71.401  12.389  1.00 42.26           A    N
ATOM   5325  CA   GLU B 331      22.054  70.694  11.173  1.00 41.80           A    C
ATOM   5326  CB   GLU B 331      23.492  70.893  10.740  1.00 41.47           A    C
ATOM   5327  CG   GLU B 331      23.981  69.892   9.758  1.00 43.85           A    C
ATOM   5328  CD   GLU B 331      23.667  70.258   8.348  1.00 47.85           A    C
ATOM   5329  OE1  GLU B 331      23.586  71.441   8.089  1.00 46.59           A    O
ATOM   5330  OE2  GLU B 331      23.513  69.371   7.510  1.00 49.88           A    O-1
ATOM   5331  C    GLU B 331      21.757  69.252  11.352  1.00 42.18           A    C
ATOM   5332  O    GLU B 331      21.326  68.598  10.455  1.00 43.61           A    O
ATOM   5333  N    MET B 332      21.975  68.758  12.543  1.00 42.49           A    N
ATOM   5334  CA   MET B 332      21.770  67.367  12.835  1.00 42.21           A    C
ATOM   5335  CB   MET B 332      22.817  66.902  13.804  1.00 42.40           B    C
ATOM   5336  CG   MET B 332      24.170  67.301  13.445  1.00 40.68           B    C
ATOM   5337  SD   MET B 332      24.944  65.949  12.719  1.00 43.67           B    S
ATOM   5338  CE   MET B 332      26.002  66.786  11.682  1.00 46.41           B    C
ATOM   5339  C    MET B 332      20.409  67.047  13.394  1.00 43.19           A    C
ATOM   5340  O    MET B 332      20.149  65.941  13.748  1.00 42.83           A    O
ATOM   5341  N    GLY B 333      19.546  68.030  13.480  1.00 43.05           A    N
ATOM   5342  CA   GLY B 333      18.193  67.814  13.916  1.00 43.55           A    C
ATOM   5343  C    GLY B 333      18.001  67.482  15.366  1.00 44.63           A    C
ATOM   5344  O    GLY B 333      17.010  66.923  15.741  1.00 44.15           A    O
ATOM   5345  N    ASP B 334      18.968  67.845  16.174  1.00 44.93           A    N
```

Appendix 1

```
ATOM   5346  CA   ASP B 334      19.000  67.526  17.573  1.00 44.26           A    C
ATOM   5347  CB   ASP B 334      20.449  67.545  17.983  1.00 44.09           A    C
ATOM   5348  CG   ASP B 334      20.693  66.964  19.313  1.00 46.71           A    C
ATOM   5349  OD1  ASP B 334      19.823  66.976  20.159  1.00 47.65           A    O
ATOM   5350  OD2  ASP B 334      21.805  66.506  19.528  1.00 51.78           A    O-1
ATOM   5351  C    ASP B 334      18.263  68.581  18.331  1.00 44.16           A    C
ATOM   5352  O    ASP B 334      18.834  69.526  18.755  1.00 44.15           A    O
ATOM   5353  N    GLN B 335      16.968  68.416  18.470  1.00 44.22           A    N
ATOM   5354  CA   GLN B 335      16.144  69.401  19.108  1.00 44.56           A    C
ATOM   5355  CB   GLN B 335      14.677  69.069  18.938  1.00 45.04           A    C
ATOM   5356  CG   GLN B 335      14.250  68.800  17.540  1.00 47.03           A    C
ATOM   5357  CD   GLN B 335      12.783  69.063  17.313  1.00 46.47           A    C
ATOM   5358  OE1  GLN B 335      12.242  68.717  16.288  1.00 47.19           A    O
ATOM   5359  NE2  GLN B 335      12.149  69.668  18.267  1.00 40.32           A    N
ATOM   5360  C    GLN B 335      16.462  69.628  20.560  1.00 44.72           A    C
ATOM   5361  O    GLN B 335      16.355  70.732  21.023  1.00 44.61           A    O
ATOM   5362  N    GLN B 336      16.810  68.589  21.290  1.00 44.32           A    N
ATOM   5363  CA   GLN B 336      17.068  68.764  22.704  1.00 45.58           A    C
ATOM   5364  CB   GLN B 336      17.290  67.405  23.358  1.00 45.43           A    C
ATOM   5365  CG   GLN B 336      17.406  67.418  24.857  1.00 50.72           A    C
ATOM   5366  CD   GLN B 336      17.880  66.105  25.455  1.00 54.75           A    C
ATOM   5367  OE1  GLN B 336      18.527  65.311  24.807  1.00 56.39           A    O
ATOM   5368  NE2  GLN B 336      17.567  65.891  26.705  1.00 55.70           A    N
ATOM   5369  C    GLN B 336      18.251  69.672  22.984  1.00 43.83           A    C
ATOM   5370  O    GLN B 336      18.138  70.596  23.721  1.00 43.75           A    O
ATOM   5371  N    LEU B 337      19.372  69.415  22.356  1.00 41.55           A    N
ATOM   5372  CA   LEU B 337      20.537  70.255  22.480  1.00 40.50           A    C
ATOM   5373  CB   LEU B 337      21.715  69.583  21.798  1.00 41.09           A    C
ATOM   5374  CG   LEU B 337      23.105  70.132  22.051  1.00 43.82           A    C
ATOM   5375  CD1  LEU B 337      23.454  70.202  23.485  1.00 44.24           A    C
ATOM   5376  CD2  LEU B 337      24.091  69.328  21.343  1.00 46.69           A    C
ATOM   5377  C    LEU B 337      20.315  71.667  21.960  1.00 38.15           A    C
ATOM   5378  O    LEU B 337      20.766  72.625  22.519  1.00 36.66           A    O
ATOM   5379  N    PHE B 338      19.576  71.784  20.902  1.00 36.59           A    N
ATOM   5380  CA   PHE B 338      19.348  73.068  20.353  1.00 36.47           A    C
ATOM   5381  CB   PHE B 338      18.500  72.881  19.105  1.00 34.44           A    C
ATOM   5382  CG   PHE B 338      18.071  74.136  18.472  1.00 31.42           A    C
ATOM   5383  CD1  PHE B 338      18.682  74.571  17.365  1.00 28.68           A    C
ATOM   5384  CE1  PHE B 338      18.306  75.681  16.806  1.00 31.16           A    C
ATOM   5385  CZ   PHE B 338      17.293  76.397  17.333  1.00 30.70           A    C
ATOM   5386  CE2  PHE B 338      16.672  75.982  18.422  1.00 27.80           A    C
ATOM   5387  CD2  PHE B 338      17.047  74.871  18.982  1.00 27.26           A    C
ATOM   5388  C    PHE B 338      18.643  73.939  21.360  1.00 37.36           A    C
ATOM   5389  O    PHE B 338      19.004  75.062  21.580  1.00 38.14           A    O
ATOM   5390  N    ASP B 339      17.615  73.386  21.961  1.00 38.41           A    N
ATOM   5391  CA   ASP B 339      16.804  74.049  22.930  1.00 37.30           A    C
ATOM   5392  CB   ASP B 339      15.634  73.134  23.253  1.00 37.81           A    C
ATOM   5393  CG   ASP B 339      14.696  73.703  24.258  1.00 40.89           A    C
ATOM   5394  OD1  ASP B 339      13.772  74.414  23.903  1.00 41.33           A    O
ATOM   5395  OD2  ASP B 339      14.864  73.412  25.430  1.00 46.06           A    O-1
ATOM   5396  C    ASP B 339      17.621  74.386  24.143  1.00 36.01           A    C
ATOM   5397  O    ASP B 339      17.488  75.429  24.701  1.00 35.84           A    O
ATOM   5398  N    GLN B 340      18.481  73.487  24.551  1.00 34.01           A    N
ATOM   5399  CA   GLN B 340      19.281  73.711  25.709  1.00 33.77           A    C
```

Appendix 1

```
ATOM   5400  CB   GLN B 340      20.062  72.455  25.931  1.00 34.15           A C
ATOM   5401  CG   GLN B 340      19.475  71.611  26.930  1.00 34.28           A C
ATOM   5402  CD   GLN B 340      19.984  70.252  26.878  1.00 38.32           A C
ATOM   5403  OE1  GLN B 340      20.692  69.889  25.989  1.00 38.40           A O
ATOM   5404  NE2  GLN B 340      19.602  69.466  27.831  1.00 38.83           A N
ATOM   5405  C    GLN B 340      20.252  74.883  25.625  1.00 33.76           A C
ATOM   5406  O    GLN B 340      20.344  75.675  26.524  1.00 32.88           A O
ATOM   5407  N    LEU B 341      20.974  74.963  24.530  1.00 32.29           A N
ATOM   5408  CA   LEU B 341      21.863  76.038  24.244  1.00 30.43           A C
ATOM   5409  CB   LEU B 341      22.642  75.687  23.003  1.00 29.67           A C
ATOM   5410  CG   LEU B 341      23.464  74.432  23.080  1.00 24.68           A C
ATOM   5411  CD1  LEU B 341      23.786  73.955  21.745  1.00 19.91           A C
ATOM   5412  CD2  LEU B 341      24.665  74.673  23.844  1.00 23.42           A C
ATOM   5413  C    LEU B 341      21.156  77.354  24.073  1.00 30.79           A C
ATOM   5414  O    LEU B 341      21.627  78.352  24.508  1.00 30.48           A O
ATOM   5415  N    LEU B 342      20.023  77.344  23.419  1.00 31.30           A N
ATOM   5416  CA   LEU B 342      19.255  78.542  23.212  1.00 32.99           A C
ATOM   5417  CB   LEU B 342      18.115  78.281  22.254  1.00 33.83           A C
ATOM   5418  CG   LEU B 342      17.949  79.133  21.018  1.00 33.50           A C
ATOM   5419  CD1  LEU B 342      16.548  79.394  20.761  1.00 29.46           A C
ATOM   5420  CD2  LEU B 342      18.672  80.403  21.151  1.00 33.76           A C
ATOM   5421  C    LEU B 342      18.764  79.139  24.505  1.00 34.86           A C
ATOM   5422  O    LEU B 342      18.682  80.328  24.649  1.00 34.01           A O
ATOM   5423  N    ASN B 343      18.414  78.292  25.442  1.00 35.90           A N
ATOM   5424  CA   ASN B 343      18.054  78.748  26.757  1.00 36.52           A C
ATOM   5425  CB   ASN B 343      17.500  77.606  27.581  1.00 36.88           A C
ATOM   5426  CG   ASN B 343      16.135  77.204  27.165  1.00 38.14           A C
ATOM   5427  OD1  ASN B 343      15.387  77.992  26.658  1.00 43.30           A O
ATOM   5428  ND2  ASN B 343      15.809  75.969  27.367  1.00 37.53           A N
ATOM   5429  C    ASN B 343      19.213  79.391  27.471  1.00 36.18           A C
ATOM   5430  O    ASN B 343      19.065  80.331  28.183  1.00 35.48           A O
ATOM   5431  N    HIS B 344      20.369  78.812  27.325  1.00 36.09           A N
ATOM   5432  CA   HIS B 344      21.571  79.430  27.793  1.00 36.95           A C
ATOM   5433  CB   HIS B 344      22.633  78.373  27.715  1.00 36.77           A C
ATOM   5434  CG   HIS B 344      24.000  78.891  27.898  1.00 39.79           A C
ATOM   5435  ND1  HIS B 344      24.483  79.260  29.119  1.00 39.66           A N
ATOM   5436  CE1  HIS B 344      25.718  79.675  28.986  1.00 42.62           A C
ATOM   5437  NE2  HIS B 344      26.045  79.603  27.716  1.00 44.93           A N
ATOM   5438  CD2  HIS B 344      24.985  79.123  27.012  1.00 40.86           A C
ATOM   5439  C    HIS B 344      22.048  80.706  27.079  1.00 36.22           A C
ATOM   5440  O    HIS B 344      22.459  81.655  27.680  1.00 34.29           A O
ATOM   5441  N    LEU B 345      22.089  80.659  25.772  1.00 37.06           A N
ATOM   5442  CA   LEU B 345      22.448  81.791  24.981  1.00 37.08           A C
ATOM   5443  CB   LEU B 345      22.686  81.308  23.569  1.00 37.63           A C
ATOM   5444  CG   LEU B 345      24.082  81.032  23.068  1.00 37.64           A C
ATOM   5445  CD1  LEU B 345      25.000  80.661  24.157  1.00 41.07           A C
ATOM   5446  CD2  LEU B 345      24.017  79.963  22.071  1.00 36.43           A C
ATOM   5447  C    LEU B 345      21.503  82.962  24.913  1.00 38.08           A C
ATOM   5448  O    LEU B 345      21.928  84.064  24.970  1.00 39.21           A O
ATOM   5449  N    GLU B 346      20.232  82.745  24.661  1.00 39.00           A N
ATOM   5450  CA   GLU B 346      19.317  83.881  24.481  1.00 39.59           A C
ATOM   5451  CB   GLU B 346      18.129  83.466  23.615  1.00 40.29           A C
ATOM   5452  CG   GLU B 346      17.841  84.379  22.502  1.00 43.01           A C
ATOM   5453  CD   GLU B 346      16.502  84.154  21.935  1.00 52.02           A C
```

Appendix 1

```
ATOM   5454  OE1 GLU B 346      15.657  83.648  22.652  1.00 53.16           A    O
ATOM   5455  OE2 GLU B 346      16.279  84.473  20.773  1.00 53.82           A    O-1
ATOM   5456  C   GLU B 346      18.850  84.820  25.628  1.00 38.58           A    C
ATOM   5457  O   GLU B 346      18.868  86.008  25.510  1.00 38.30           A    O
ATOM   5458  N   PRO B 347      18.414  84.299  26.737  1.00 38.65           A    N
ATOM   5459  CA  PRO B 347      17.847  85.158  27.755  1.00 37.84           A    C
ATOM   5460  CB  PRO B 347      17.457  84.160  28.809  1.00 38.54           A    C
ATOM   5461  CG  PRO B 347      17.184  82.946  28.057  1.00 39.40           A    C
ATOM   5462  CD  PRO B 347      17.687  83.046  26.693  1.00 38.21           A    C
ATOM   5463  C   PRO B 347      18.800  86.192  28.309  1.00 36.94           A    C
ATOM   5464  O   PRO B 347      18.420  87.323  28.418  1.00 37.17           A    O
ATOM   5465  N   PRO B 348      20.029  85.814  28.587  1.00 36.37           A    N
ATOM   5466  CA  PRO B 348      21.039  86.706  29.102  1.00 35.73           A    C
ATOM   5467  CB  PRO B 348      22.243  85.819  29.177  1.00 34.21           A    C
ATOM   5468  CG  PRO B 348      21.795  84.505  28.920  1.00 36.24           A    C
ATOM   5469  CD  PRO B 348      20.385  84.437  28.870  1.00 36.15           A    C
ATOM   5470  C   PRO B 348      21.291  87.822  28.148  1.00 36.03           A    C
ATOM   5471  O   PRO B 348      21.601  88.902  28.533  1.00 36.73           A    O
ATOM   5472  N   ALA B 349      21.044  87.569  26.896  1.00 35.79           A    N
ATOM   5473  CA  ALA B 349      21.337  88.516  25.871  1.00 37.28           A    C
ATOM   5474  CB  ALA B 349      21.578  87.818  24.615  1.00 37.63           A    C
ATOM   5475  C   ALA B 349      20.244  89.550  25.721  1.00 37.78           A    C
ATOM   5476  O   ALA B 349      20.352  90.445  24.930  1.00 36.37           A    O
ATOM   5477  N   LYS B 350      19.198  89.428  26.508  1.00 39.09           A    N
ATOM   5478  CA  LYS B 350      18.178  90.447  26.562  1.00 41.11           A    C
ATOM   5479  CB  LYS B 350      18.623  91.616  27.419  1.00 41.22           A    C
ATOM   5484  C   LYS B 350      17.579  90.908  25.236  1.00 41.55           A    C
ATOM   5485  O   LYS B 350      17.636  92.053  24.889  1.00 41.21           A    O
ATOM   5486  N   PRO B 351      16.964  89.987  24.539  1.00 42.01           A    N
ATOM   5487  CA  PRO B 351      16.239  90.282  23.332  1.00 43.23           A    C
ATOM   5488  CB  PRO B 351      15.676  88.921  22.964  1.00 42.70           A    C
ATOM   5489  CG  PRO B 351      15.618  88.204  24.126  1.00 40.03           A    C
ATOM   5490  CD  PRO B 351      16.734  88.612  24.960  1.00 42.08           A    C
ATOM   5491  C   PRO B 351      15.090  91.200  23.628  1.00 45.26           A    C
ATOM   5492  O   PRO B 351      14.455  91.088  24.639  1.00 46.27           A    O
ATOM   5493  N   SER B 352      14.828  92.125  22.746  1.00 46.65           A    N
ATOM   5494  CA  SER B 352      13.604  92.353  22.809  1.00 47.36           A    C
ATOM   5495  CB  SER B 352      13.838  94.206  23.435  1.00 47.50           A    C
ATOM   5496  OG  SER B 352      14.144  95.154  22.468  1.00 46.22           A    O
ATOM   5497  C   SER B 352      13.132  93.005  21.399  1.00 48.34           A    C
ATOM   5498  O   SER B 352      13.928  93.160  20.509  1.00 49.01           A    O
ATOM   5499  N   ILE B 353      11.837  92.989  21.171  1.00 47.69           A    N
ATOM   5500  CA  ILE B 353      11.372  93.370  19.871  1.00 47.55           A    C
ATOM   5501  CB  ILE B 353      10.409  92.352  19.365  1.00 47.15           A    C
ATOM   5502  CG1 ILE B 353      11.140  91.047  19.210  1.00 43.89           A    C
ATOM   5503  CD1 ILE B 353      10.379  90.044  18.567  1.00 41.60           A    C
ATOM   5504  CG2 ILE B 353       9.827  92.793  18.083  1.00 46.50           A    C
ATOM   5505  C   ILE B 353      10.701  94.717  19.971  1.00 48.35           A    C
ATOM   5506  O   ILE B 353       9.716  94.830  20.624  1.00 49.61           A    O
ATOM   5507  N   VAL B 354      11.241  95.743  19.331  1.00 48.26           A    N
ATOM   5508  CA  VAL B 354      10.677  97.064  19.518  1.00 47.67           A    C
ATOM   5509  CB  VAL B 354      11.728  98.079  19.909  1.00 48.01           A    C
ATOM   5510  CG1 VAL B 354      11.107  99.406  20.084  1.00 48.57           A    C
ATOM   5511  CG2 VAL B 354      12.351  97.679  21.145  1.00 47.68           A    C
```

Appendix 1

```
ATOM   5512  C    VAL B 354       9.749  97.674  18.478  1.00 47.01           A  C
ATOM   5513  O    VAL B 354       8.670  98.098  18.821  1.00 49.44           A  O
ATOM   5514  N    SER B 355      10.101  97.737  17.222  1.00 43.20           A  N
ATOM   5515  CA   SER B 355       9.117  98.294  16.330  1.00 40.24           A  C
ATOM   5516  CB   SER B 355       9.598  99.650  15.876  1.00 39.96           A  C
ATOM   5517  OG   SER B 355       8.843 100.204  14.853  1.00 38.41           A  O
ATOM   5518  C    SER B 355       9.003  97.322  15.217  1.00 40.16           A  C
ATOM   5519  O    SER B 355       9.335  97.603  14.104  1.00 39.10           A  O
ATOM   5520  N    ALA B 356       8.573  96.133  15.585  1.00 38.78           A  N
ATOM   5521  CA   ALA B 356       8.558  94.968  14.744  1.00 38.90           A  C
ATOM   5522  CB   ALA B 356       7.731  95.199  13.584  1.00 38.44           A  C
ATOM   5523  C    ALA B 356       9.958  94.526  14.352  1.00 39.92           A  C
ATOM   5524  O    ALA B 356      10.143  93.802  13.414  1.00 40.57           A  O
ATOM   5525  N    SER B 357      10.938  94.951  15.121  1.00 41.39           A  N
ATOM   5526  CA   SER B 357      12.344  94.777  14.815  1.00 41.89           A  C
ATOM   5527  CB   SER B 357      12.924  96.133  14.522  1.00 42.26           A  C
ATOM   5528  OG   SER B 357      14.029  96.062  13.691  1.00 47.52           A  O
ATOM   5529  C    SER B 357      13.019  94.221  16.018  1.00 40.09           A  C
ATOM   5530  O    SER B 357      12.684  94.571  17.094  1.00 39.54           A  O
ATOM   5531  N    LEU B 358      13.986  93.357  15.828  1.00 39.38           A  N
ATOM   5532  CA   LEU B 358      14.630  92.676  16.933  1.00 38.97           A  C
ATOM   5533  CB   LEU B 358      14.693  91.182  16.675  1.00 38.14           A  C
ATOM   5534  CG   LEU B 358      15.745  90.418  17.427  1.00 34.10           A  C
ATOM   5535  CD1  LEU B 358      15.385  90.393  18.826  1.00 35.72           A  C
ATOM   5536  CD2  LEU B 358      15.827  89.076  16.908  1.00 28.17           A  C
ATOM   5537  C    LEU B 358      16.001  93.204  17.294  1.00 39.62           A  C
ATOM   5538  O    LEU B 358      16.809  93.463  16.455  1.00 39.18           A  O
ATOM   5539  N    ARG B 359      16.228  93.372  18.581  1.00 41.27           A  N
ATOM   5540  CA   ARG B 359      17.488  93.823  19.097  1.00 43.57           A  C
ATOM   5541  CB   ARG B 359      17.343  95.278  19.463  1.00 45.32           A  C
ATOM   5542  CG   ARG B 359      18.585  95.915  19.964  1.00 52.28           A  C
ATOM   5543  CD   ARG B 359      18.361  97.368  20.222  1.00 63.56           A  C
ATOM   5544  NE   ARG B 359      19.243  97.892  21.253  1.00 69.88           A  N
ATOM   5545  CZ   ARG B 359      18.873  98.131  22.502  1.00 72.15           A  C
ATOM   5546  NH1  ARG B 359      17.641  97.887  22.888  1.00 72.30           A  N
ATOM   5547  NH2  ARG B 359      19.741  98.622  23.361  1.00 72.26           A  N
ATOM   5548  C    ARG B 359      17.889  93.045  20.315  1.00 43.18           A  C
ATOM   5549  O    ARG B 359      17.066  92.713  21.097  1.00 44.16           A  O
ATOM   5550  N    TYR B 360      19.162  92.769  20.489  1.00 42.89           A  N
ATOM   5551  CA   TYR B 360      19.632  92.258  21.750  1.00 41.89           A  C
ATOM   5552  CB   TYR B 360      20.494  91.039  21.549  1.00 41.61           A  C
ATOM   5553  CG   TYR B 360      19.823  89.844  20.960  1.00 40.55           A  C
ATOM   5554  CD1  TYR B 360      19.247  88.896  21.752  1.00 38.06           A  C
ATOM   5555  CE1  TYR B 360      18.672  87.823  21.218  1.00 37.81           A  C
ATOM   5556  CZ   TYR B 360      18.675  87.667  19.879  1.00 38.83           A  C
ATOM   5557  OH   TYR B 360      18.087  86.598  19.308  1.00 37.70           A  O
ATOM   5558  CE2  TYR B 360      19.257  88.573  19.095  1.00 36.13           A  C
ATOM   5559  CD2  TYR B 360      19.825  89.637  19.622  1.00 36.77           A  C
ATOM   5560  C    TYR B 360      20.472  93.308  22.444  1.00 42.58           A  C
ATOM   5561  O    TYR B 360      21.457  93.738  21.931  1.00 42.11           A  O
ATOM   5562  N    GLU B 361      20.051  93.736  23.610  1.00 43.27           A  N
ATOM   5563  CA   GLU B 361      20.887  94.424  24.539  1.00 44.71           A  C
ATOM   5564  CB   GLU B 361      20.017  94.836  25.704  1.00 45.50           A  C
ATOM   5565  CG   GLU B 361      19.809  96.292  25.926  1.00 50.88           A  C
```

Appendix 1

```
ATOM   5566  CD   GLU B 361      19.613  96.603  27.401  1.00 60.37      A    C
ATOM   5567  OE1  GLU B 361      19.046  95.774  28.118  1.00 57.01      A    O
ATOM   5568  OE2  GLU B 361      20.042  97.673  27.856  1.00 63.38      A    O-1
ATOM   5569  C    GLU B 361      21.745  93.270  24.950  1.00 43.97      A    C
ATOM   5570  O    GLU B 361      21.244  92.174  24.994  1.00 45.45      A    O
ATOM   5571  N    HIS B 362      23.006  93.473  25.263  1.00 42.15      A    N
ATOM   5572  CA   HIS B 362      23.884  92.372  25.692  1.00 42.21      A    C
ATOM   5573  CB   HIS B 362      23.544  91.922  27.083  1.00 43.14      A    C
ATOM   5574  CG   HIS B 362      23.209  93.044  27.977  1.00 51.77      A    C
ATOM   5575  ND1  HIS B 362      24.045  94.117  28.145  1.00 58.46      A    N
ATOM   5576  CE1  HIS B 362      23.479  94.983  28.954  1.00 60.72      A    C
ATOM   5577  NE2  HIS B 362      22.300  94.513  29.303  1.00 61.20      A    N
ATOM   5578  CD2  HIS B 362      22.105  93.305  28.699  1.00 55.86      A    C
ATOM   5579  C    HIS B 362      24.116  91.124  24.898  1.00 39.77      A    C
ATOM   5580  O    HIS B 362      23.999  90.069  25.442  1.00 39.42      A    O
ATOM   5581  N    PRO B 363      24.518  91.239  23.653  1.00 38.05      A    N
ATOM   5582  CA   PRO B 363      24.974  90.087  22.909  1.00 37.70      A    C
ATOM   5583  CB   PRO B 363      25.391  90.683  21.588  1.00 36.67      A    C
ATOM   5584  CG   PRO B 363      25.345  92.085  21.763  1.00 38.35      A    C
ATOM   5585  CD   PRO B 363      24.374  92.380  22.770  1.00 37.95      A    C
ATOM   5586  C    PRO B 363      26.183  89.540  23.585  1.00 38.35      A    C
ATOM   5587  O    PRO B 363      27.006  90.275  24.054  1.00 38.95      A    O
ATOM   5588  N    GLY B 364      26.281  88.243  23.682  1.00 38.41      A    N
ATOM   5589  CA   GLY B 364      27.339  87.654  24.455  1.00 37.04      A    C
ATOM   5590  C    GLY B 364      28.600  87.271  23.765  1.00 36.63      A    C
ATOM   5591  O    GLY B 364      29.526  86.870  24.371  1.00 36.35      A    O
ATOM   5592  N    SER B 365      28.623  87.403  22.472  1.00 34.85      A    N
ATOM   5593  CA   SER B 365      29.719  86.953  21.720  1.00 33.40      A    C
ATOM   5594  CB   SER B 365      29.484  85.535  21.304  1.00 33.67      A    C
ATOM   5595  OG   SER B 365      28.896  85.471  20.049  1.00 33.36      A    O
ATOM   5596  C    SER B 365      29.773  87.820  20.526  1.00 33.93      A    C
ATOM   5597  O    SER B 365      28.885  88.583  20.280  1.00 34.21      A    O
ATOM   5598  N    LEU B 366      30.849  87.710  19.788  1.00 33.26      A    N
ATOM   5599  CA   LEU B 366      30.927  88.282  18.500  1.00 32.69      A    C
ATOM   5600  CB   LEU B 366      32.353  88.245  17.987  1.00 34.01      A    C
ATOM   5601  CG   LEU B 366      33.278  89.325  18.513  1.00 36.83      A    C
ATOM   5602  CD1  LEU B 366      34.405  89.459  17.639  1.00 37.97      A    C
ATOM   5603  CD2  LEU B 366      32.591  90.622  18.638  1.00 39.15      A    C
ATOM   5604  C    LEU B 366      30.025  87.494  17.619  1.00 31.35      A    C
ATOM   5605  O    LEU B 366      29.805  86.349  17.841  1.00 29.15      A    O
ATOM   5606  N    LEU B 367      29.477  88.144  16.622  1.00 31.01      A    N
ATOM   5607  CA   LEU B 367      28.624  87.516  15.657  1.00 31.47      A    C
ATOM   5608  CB   LEU B 367      29.313  86.342  15.002  1.00 31.77      A    C
ATOM   5609  CG   LEU B 367      30.635  86.487  14.331  1.00 31.45      A    C
ATOM   5610  CD1  LEU B 367      31.227  85.173  14.234  1.00 30.69      A    C
ATOM   5611  CD2  LEU B 367      30.392  87.051  13.024  1.00 33.91      A    C
ATOM   5612  C    LEU B 367      27.378  86.976  16.249  1.00 31.55      A    C
ATOM   5613  O    LEU B 367      26.866  86.050  15.730  1.00 31.57      A    O
ATOM   5614  N    PHE B 368      26.916  87.518  17.354  1.00 31.50      A    N
ATOM   5615  CA   PHE B 368      25.835  86.903  18.061  1.00 31.91      A    C
ATOM   5616  CB   PHE B 368      25.594  87.660  19.339  1.00 31.74      A    C
ATOM   5617  CG   PHE B 368      24.761  86.931  20.302  1.00 30.84      A    C
ATOM   5618  CD1  PHE B 368      25.273  85.885  20.983  1.00 27.88      A    C
ATOM   5619  CE1  PHE B 368      24.523  85.217  21.856  1.00 29.31      A    C
```

Appendix 1

```
ATOM   5620  CZ  PHE B 368      23.262  85.570  22.057  1.00 28.57      A    C
ATOM   5621  CE2 PHE B 368      22.738  86.608  21.392  1.00 26.82      A    C
ATOM   5622  CD2 PHE B 368      23.469  87.281  20.526  1.00 27.71      A    C
ATOM   5623  C   PHE B 368      24.529  86.824  17.356  1.00 31.63      A    C
ATOM   5624  O   PHE B 368      23.969  85.795  17.271  1.00 31.50      A    O
ATOM   5625  N   ASP B 369      24.060  87.926  16.835  1.00 32.06      A    N
ATOM   5626  CA  ASP B 369      22.848  87.941  16.049  1.00 32.76      A    C
ATOM   5627  CB  ASP B 369      22.228  89.343  15.933  1.00 32.17      A    C
ATOM   5628  CG  ASP B 369      22.961  90.251  15.002  1.00 32.84      A    C
ATOM   5629  OD1 ASP B 369      22.519  90.420  13.889  1.00 29.18      A    O
ATOM   5630  OD2 ASP B 369      23.959  90.829  15.392  1.00 37.64      A    O-1
ATOM   5631  C   ASP B 369      22.884  87.164  14.743  1.00 33.37      A    C
ATOM   5632  O   ASP B 369      21.897  86.651  14.350  1.00 33.94      A    O
ATOM   5633  N   GLU B 370      24.007  87.112  14.065  1.00 32.55      A    N
ATOM   5634  CA  GLU B 370      24.083  86.373  12.841  1.00 32.92      A    C
ATOM   5635  CB  GLU B 370      25.467  86.567  12.222  1.00 32.37      A    C
ATOM   5636  CG  GLU B 370      25.850  87.973  11.866  1.00 32.52      A    C
ATOM   5637  CD  GLU B 370      26.350  88.784  13.001  1.00 32.57      A    C
ATOM   5638  OE1 GLU B 370      25.943  88.558  14.098  1.00 33.35      A    O
ATOM   5639  OE2 GLU B 370      27.123  89.682  12.815  1.00 35.26      A    O-1
ATOM   5640  C   GLU B 370      23.848  84.886  13.029  1.00 33.26      A    C
ATOM   5641  O   GLU B 370      23.148  84.288  12.275  1.00 33.36      A    O
ATOM   5642  N   LEU B 371      24.510  84.301  14.010  1.00 32.96      A    N
ATOM   5643  CA  LEU B 371      24.393  82.890  14.383  1.00 32.75      A    C
ATOM   5644  CB  LEU B 371      25.569  82.425  15.218  1.00 32.46      A    C
ATOM   5645  CG  LEU B 371      26.889  82.475  14.481  1.00 34.48      A    C
ATOM   5646  CD1 LEU B 371      28.043  82.173  15.371  1.00 31.58      A    C
ATOM   5647  CD2 LEU B 371      26.924  81.660  13.238  1.00 29.61      A    C
ATOM   5648  C   LEU B 371      23.111  82.419  14.998  1.00 33.03      A    C
ATOM   5649  O   LEU B 371      22.744  81.309  14.848  1.00 33.41      A    O
ATOM   5650  N   LEU B 372      22.489  83.247  15.792  1.00 33.04      A    N
ATOM   5651  CA  LEU B 372      21.181  82.965  16.265  1.00 31.29      A    C
ATOM   5652  CB  LEU B 372      20.824  83.859  17.412  1.00 30.91      A    C
ATOM   5653  CG  LEU B 372      21.102  83.122  18.699  1.00 27.88      A    C
ATOM   5654  CD1 LEU B 372      22.516  82.921  19.009  1.00 15.15      A    C
ATOM   5655  CD2 LEU B 372      20.426  83.759  19.803  1.00 25.51      A    C
ATOM   5656  C   LEU B 372      20.184  83.020  15.161  1.00 31.56      A    C
ATOM   5657  O   LEU B 372      19.296  82.245  15.109  1.00 31.57      A    O
ATOM   5658  N   PHE B 373      20.345  83.964  14.270  1.00 31.70      A    N
ATOM   5659  CA  PHE B 373      19.526  84.025  13.098  1.00 32.14      A    C
ATOM   5660  CB  PHE B 373      19.862  85.288  12.320  1.00 32.10      A    C
ATOM   5661  CG  PHE B 373      19.409  85.288  10.916  1.00 34.11      A    C
ATOM   5662  CD1 PHE B 373      18.093  85.285  10.598  1.00 36.42      A    C
ATOM   5663  CE1 PHE B 373      17.704  85.295   9.322  1.00 32.63      A    C
ATOM   5664  CZ  PHE B 373      18.606  85.327   8.350  1.00 32.81      A    C
ATOM   5665  CE2 PHE B 373      19.898  85.346   8.635  1.00 33.09      A    C
ATOM   5666  CD2 PHE B 373      20.305  85.331   9.900  1.00 35.57      A    C
ATOM   5667  C   PHE B 373      19.759  82.831  12.254  1.00 32.71      A    C
ATOM   5668  O   PHE B 373      18.850  82.163  11.913  1.00 33.45      A    O
ATOM   5669  N   LEU B 374      20.993  82.510  11.972  1.00 32.87      A    N
ATOM   5670  CA  LEU B 374      21.251  81.359  11.157  1.00 34.01      A    C
ATOM   5671  CB  LEU B 374      22.704  81.302  10.732  1.00 33.27      A    C
ATOM   5672  CG  LEU B 374      23.244  80.014  10.151  1.00 34.88      A    C
ATOM   5673  CD1 LEU B 374      22.720  79.646   8.816  1.00 28.63      A    C
```

Appendix 1

```
ATOM   5674  CD2 LEU B 374      24.688  80.081  10.155  1.00 30.38           A    C
ATOM   5675  C   LEU B 374      20.823  80.044  11.741  1.00 35.10           A    C
ATOM   5676  O   LEU B 374      20.251  79.264  11.067  1.00 37.75           A    O
ATOM   5677  N   ALA B 375      21.088  79.795  12.993  1.00 35.40           A    N
ATOM   5678  CA  ALA B 375      20.668  78.565  13.607  1.00 35.64           A    C
ATOM   5679  CB  ALA B 375      21.268  78.443  14.961  1.00 36.59           A    C
ATOM   5680  C   ALA B 375      19.156  78.381  13.668  1.00 35.27           A    C
ATOM   5681  O   ALA B 375      18.657  77.300  13.622  1.00 34.79           A    O
ATOM   5682  N   LYS B 376      18.445  79.457  13.863  1.00 34.08           A    N
ATOM   5683  CA  LYS B 376      17.026  79.382  14.005  1.00 33.85           A    C
ATOM   5684  CB  LYS B 376      16.477  80.725  14.429  1.00 33.62           A    C
ATOM   5685  CG  LYS B 376      16.398  80.905  15.865  1.00 30.69           A    C
ATOM   5686  CD  LYS B 376      16.252  82.296  16.215  1.00 24.69           A    C
ATOM   5687  CE  LYS B 376      16.601  82.450  17.643  1.00 31.79           A    C
ATOM   5688  NZ  LYS B 376      15.946  83.575  18.304  1.00 33.81           A    N
ATOM   5689  C   LYS B 376      16.402  78.947  12.727  1.00 33.93           A    C
ATOM   5690  O   LYS B 376      15.410  78.308  12.701  1.00 35.55           A    O
ATOM   5691  N   VAL B 377      16.994  79.360  11.649  1.00 33.17           A    N
ATOM   5692  CA  VAL B 377      16.398  79.238  10.379  1.00 32.29           A    C
ATOM   5693  CB  VAL B 377      16.530  80.582   9.712  1.00 31.70           A    C
ATOM   5694  CG1 VAL B 377      17.057  80.488   8.395  1.00 33.38           A    C
ATOM   5695  CG2 VAL B 377      15.286  81.312   9.761  1.00 32.36           A    C
ATOM   5696  C   VAL B 377      17.017  78.130   9.555  1.00 32.68           A    C
ATOM   5697  O   VAL B 377      16.536  77.797   8.510  1.00 32.54           A    O
ATOM   5698  N   HIS B 378      18.075  77.525  10.030  1.00 31.08           A    N
ATOM   5699  CA  HIS B 378      18.834  76.654   9.191  1.00 31.34           A    C
ATOM   5700  CB  HIS B 378      20.092  76.249   9.941  1.00 31.03           A    C
ATOM   5701  CG  HIS B 378      21.107  75.567   9.100  1.00 28.83           A    C
ATOM   5702  ND1 HIS B 378      21.540  76.079   7.911  1.00 32.22           A    N
ATOM   5703  CE1 HIS B 378      22.426  75.268   7.385  1.00 31.95           A    C
ATOM   5704  NE2 HIS B 378      22.587  74.251   8.199  1.00 31.25           A    N
ATOM   5705  CD2 HIS B 378      21.771  74.413   9.275  1.00 31.24           A    C
ATOM   5706  C   HIS B 378      18.102  75.429   8.669  1.00 32.37           A    C
ATOM   5707  O   HIS B 378      17.564  74.642   9.388  1.00 31.85           A    O
ATOM   5708  N   ALA B 379      18.135  75.263   7.369  1.00 33.09           A    N
ATOM   5709  CA  ALA B 379      17.485  74.149   6.734  1.00 33.90           A    C
ATOM   5710  CB  ALA B 379      16.872  74.590   5.478  1.00 33.85           A    C
ATOM   5711  C   ALA B 379      18.369  72.948   6.499  1.00 34.17           A    C
ATOM   5712  O   ALA B 379      17.929  71.947   6.020  1.00 34.84           A    O
ATOM   5713  N   GLY B 380      19.624  73.072   6.836  1.00 34.67           A    N
ATOM   5714  CA  GLY B 380      20.600  72.054   6.582  1.00 33.09           A    C
ATOM   5715  C   GLY B 380      21.304  72.382   5.305  1.00 33.58           A    C
ATOM   5716  O   GLY B 380      20.711  72.841   4.400  1.00 33.15           A    O
ATOM   5717  N   PHE B 381      22.595  72.173   5.265  1.00 34.62           A    N
ATOM   5718  CA  PHE B 381      23.398  72.481   4.119  1.00 35.57           A    C
ATOM   5719  CB  PHE B 381      24.864  72.431   4.497  1.00 35.38           A    C
ATOM   5720  CG  PHE B 381      25.316  73.611   5.265  1.00 36.38           A    C
ATOM   5721  CD1 PHE B 381      25.158  74.871   4.768  1.00 37.27           A    C
ATOM   5722  CE1 PHE B 381      25.557  75.926   5.459  1.00 32.98           A    C
ATOM   5723  CZ  PHE B 381      26.094  75.766   6.642  1.00 34.03           A    C
ATOM   5724  CE2 PHE B 381      26.264  74.541   7.164  1.00 34.65           A    C
ATOM   5725  CD2 PHE B 381      25.878  73.473   6.485  1.00 36.52           A    C
ATOM   5726  C   PHE B 381      23.058  71.602   2.941  1.00 37.47           A    C
ATOM   5727  O   PHE B 381      23.088  72.017   1.814  1.00 37.05           A    O
```

Appendix 1

```
ATOM   5728  N    GLY B 382      22.742  70.360   3.248  1.00 39.46      A    N
ATOM   5729  CA   GLY B 382      22.307  69.389   2.276  1.00 40.72      A    C
ATOM   5730  C    GLY B 382      21.010  69.747   1.624  1.00 42.10      A    C
ATOM   5731  O    GLY B 382      20.832  69.564   0.465  1.00 42.03      A    O
ATOM   5732  N    ALA B 383      20.095  70.272   2.397  1.00 42.47      A    N
ATOM   5733  CA   ALA B 383      18.870  70.761   1.866  1.00 43.06      A    C
ATOM   5734  CB   ALA B 383      17.993  71.171   2.951  1.00 43.26      A    C
ATOM   5735  C    ALA B 383      19.138  71.902   0.975  1.00 43.46      A    C
ATOM   5736  O    ALA B 383      18.472  72.101   0.010  1.00 44.04      A    O
ATOM   5737  N    LEU B 384      20.108  72.692   1.352  1.00 44.25      A    N
ATOM   5738  CA   LEU B 384      20.447  73.909   0.653  1.00 44.78      A    C
ATOM   5739  CB   LEU B 384      21.481  74.701   1.443  1.00 44.40      A    C
ATOM   5740  CG   LEU B 384      21.151  76.060   2.008  1.00 41.69      A    C
ATOM   5741  CD1  LEU B 384      19.717  76.224   2.206  1.00 41.26      A    C
ATOM   5742  CD2  LEU B 384      21.873  76.210   3.249  1.00 35.39      A    C
ATOM   5743  C    LEU B 384      20.924  73.623  -0.747  1.00 44.97      A    C
ATOM   5744  O    LEU B 384      20.694  74.384  -1.643  1.00 45.55      A    O
ATOM   5745  N    LEU B 385      21.621  72.524  -0.914  1.00 45.04      A    N
ATOM   5746  CA   LEU B 385      22.084  72.066  -2.209  1.00 45.87      A    C
ATOM   5747  CB   LEU B 385      22.963  70.865  -2.032  1.00 45.73      A    C
ATOM   5748  CG   LEU B 385      24.412  71.060  -2.376  1.00 46.64      A    C
ATOM   5749  CD1  LEU B 385      24.876  72.214  -1.635  1.00 47.17      A    C
ATOM   5750  CD2  LEU B 385      25.130  69.893  -1.384  1.00 46.09      A    C
ATOM   5751  C    LEU B 385      20.951  71.717  -3.156  1.00 46.63      A    C
ATOM   5752  O    LEU B 385      21.023  71.924  -4.339  1.00 45.48      A    O
ATOM   5753  N    ARG B 386      19.898  71.182  -2.575  1.00 47.40      A    N
ATOM   5754  CA   ARG B 386      18.780  70.608  -3.269  1.00 47.61      A    C
ATOM   5755  CB   ARG B 386      18.267  69.418  -2.509  1.00 47.42      A    C
ATOM   5756  CG   ARG B 386      19.206  68.306  -2.455  1.00 48.22      A    C
ATOM   5757  CD   ARG B 386      18.539  67.099  -1.940  1.00 52.84      A    C
ATOM   5758  NE   ARG B 386      18.439  67.090  -0.497  1.00 56.87      A    N
ATOM   5759  CZ   ARG B 386      19.461  66.863   0.311  1.00 60.66      A    C
ATOM   5760  NH1  ARG B 386      20.656  66.632  -0.198  1.00 57.99      A    N
ATOM   5761  NH2  ARG B 386      19.282  66.868   1.626  1.00 59.85      A    N
ATOM   5762  C    ARG B 386      17.683  71.620  -3.428  1.00 47.81      A    C
ATOM   5763  O    ARG B 386      16.555  71.282  -3.663  1.00 48.08      A    O
ATOM   5764  N    MET B 387      18.041  72.881  -3.335  1.00 48.35      A    N
ATOM   5765  CA   MET B 387      17.092  73.949  -3.471  1.00 48.58      A    C
ATOM   5766  CB   MET B 387      17.794  75.258  -3.200  1.00 47.98      B    C
ATOM   5767  CG   MET B 387      16.939  76.457  -3.295  1.00 46.85      B    C
ATOM   5768  SD   MET B 387      17.671  77.777  -2.457  1.00 47.76      B    S
ATOM   5769  CE   MET B 387      16.310  78.810  -2.298  1.00 50.97      B    C
ATOM   5770  C    MET B 387      16.456  73.991  -4.840  1.00 48.80      A    C
ATOM   5771  O    MET B 387      17.105  73.857  -5.832  1.00 48.25      A    O
ATOM   5772  N    PRO B 388      15.167  74.240  -4.885  1.00 50.06      A    N
ATOM   5773  CA   PRO B 388      14.447  74.219  -6.134  1.00 49.92      A    C
ATOM   5774  CB   PRO B 388      13.004  74.121  -5.683  1.00 50.03      A    C
ATOM   5775  CG   PRO B 388      13.060  73.689  -4.330  1.00 50.81      A    C
ATOM   5776  CD   PRO B 388      14.233  74.300  -3.766  1.00 50.29      A    C
ATOM   5777  C    PRO B 388      14.668  75.499  -6.829  1.00 50.00      A    C
ATOM   5778  O    PRO B 388      15.056  76.425  -6.208  1.00 49.70      A    O
ATOM   5779  N    PRO B 389      14.347  75.574  -8.094  1.00 50.61      A    N
ATOM   5780  CA   PRO B 389      14.825  76.608  -8.977  1.00 51.32      A    C
ATOM   5781  CB   PRO B 389      14.522  76.003 -10.314  1.00 51.61      A    C
```

Appendix 1

```
ATOM   5782  CG   PRO B 389      14.778   74.606  -10.100  1.00 51.01      A    C
ATOM   5783  CD   PRO B 389      14.596   74.272   -8.688  1.00 50.55      A    C
ATOM   5784  C    PRO B 389      14.279   78.010   -8.917  1.00 52.56      A    C
ATOM   5785  O    PRO B 389      15.043   78.941   -8.926  1.00 52.05      A    O
ATOM   5786  N    PRO B 390      12.985   78.187   -8.915  1.00 53.79      A    N
ATOM   5787  CA   PRO B 390      12.493   79.523   -9.200  1.00 55.01      A    C
ATOM   5788  CB   PRO B 390      11.134   79.545   -8.535  1.00 55.75      A    C
ATOM   5789  CG   PRO B 390      11.229   78.547   -7.432  1.00 55.91      A    C
ATOM   5790  CD   PRO B 390      12.378   77.641   -7.697  1.00 55.23      A    C
ATOM   5791  C    PRO B 390      13.422   80.531   -8.573  1.00 54.76      A    C
ATOM   5792  O    PRO B 390      14.261   81.063   -9.267  1.00 53.69      A    O
ATOM   5793  N    LEU C  29     -13.936   17.779   29.733  1.00 59.24      A    N
ATOM   5794  CA   LEU C  29     -14.701   18.727   28.948  1.00 58.96      A    C
ATOM   5795  CB   LEU C  29     -16.068   18.132   28.710  1.00 59.18      A    C
ATOM   5796  CG   LEU C  29     -16.744   18.415   27.382  1.00 60.37      A    C
ATOM   5797  CD1  LEU C  29     -15.839   18.353   26.192  1.00 59.90      A    C
ATOM   5798  CD2  LEU C  29     -17.795   17.424   27.265  1.00 62.38      A    C
ATOM   5799  C    LEU C  29     -14.858   20.123   29.562  1.00 58.11      A    C
ATOM   5800  O    LEU C  29     -15.976   20.547   29.784  1.00 57.86      A    O
ATOM   5801  N    PRO C  30     -13.769   20.844   29.816  1.00 56.51      A    N
ATOM   5802  CA   PRO C  30     -13.885   22.168   30.407  1.00 55.63      A    C
ATOM   5803  CB   PRO C  30     -13.381   21.931   31.847  1.00 56.29      A    C
ATOM   5804  CG   PRO C  30     -12.454   20.830   31.750  1.00 55.13      A    C
ATOM   5805  CD   PRO C  30     -12.706   20.078   30.472  1.00 55.88      A    C
ATOM   5806  C    PRO C  30     -13.036   23.223   29.678  1.00 54.64      A    C
ATOM   5807  O    PRO C  30     -12.047   22.848   29.078  1.00 54.70      A    O
ATOM   5808  N    PRO C  31     -13.351   24.512   29.788  1.00 52.85      A    N
ATOM   5809  CA   PRO C  31     -12.652   25.539   28.998  1.00 50.92      A    C
ATOM   5810  CB   PRO C  31     -13.777   26.197   28.229  1.00 50.91      A    C
ATOM   5811  CG   PRO C  31     -15.045   25.661   28.839  1.00 52.87      A    C
ATOM   5812  CD   PRO C  31     -14.749   24.357   29.397  1.00 52.41      A    C
ATOM   5813  C    PRO C  31     -11.741   26.580   29.701  1.00 49.49      A    C
ATOM   5814  O    PRO C  31     -10.578   26.602   29.419  1.00 50.61      A    O
ATOM   5815  N    GLY C  32     -12.197   27.446   30.575  1.00 46.86      A    N
ATOM   5816  CA   GLY C  32     -11.252   28.172   31.413  1.00 42.45      A    C
ATOM   5817  C    GLY C  32     -11.345   27.652   32.831  1.00 40.58      A    C
ATOM   5818  O    GLY C  32     -10.806   28.194   33.748  1.00 39.80      A    O
ATOM   5819  N    ARG C  33     -12.004   26.515   32.945  1.00 37.96      A    N
ATOM   5820  CA   ARG C  33     -12.604   25.982   34.137  1.00 36.55      A    C
ATOM   5821  CB   ARG C  33     -13.957   25.389   33.797  1.00 36.11      A    C
ATOM   5822  CG   ARG C  33     -14.875   26.280   33.111  1.00 34.50      A    C
ATOM   5823  CD   ARG C  33     -15.984   26.693   34.000  1.00 32.88      A    C
ATOM   5824  NE   ARG C  33     -16.485   25.594   34.783  1.00 32.27      A    N
ATOM   5825  CZ   ARG C  33     -17.681   25.074   34.650  1.00 28.35      A    C
ATOM   5826  NH1  ARG C  33     -18.496   25.537   33.761  1.00 31.99      A    N
ATOM   5827  NH2  ARG C  33     -18.049   24.098   35.411  1.00 27.12      A    N
ATOM   5828  C    ARG C  33     -11.824   24.900   34.795  1.00 36.42      A    C
ATOM   5829  O    ARG C  33     -11.055   24.243   34.187  1.00 36.96      A    O
ATOM   5830  N    LEU C  34     -11.983   24.781   36.091  1.00 36.10      A    N
ATOM   5831  CA   LEU C  34     -11.439   23.695   36.892  1.00 34.25      A    C
ATOM   5832  CB   LEU C  34     -11.297   24.142   38.315  1.00 33.76      A    C
ATOM   5833  CG   LEU C  34     -10.578   25.455   38.347  1.00 34.67      A    C
ATOM   5834  CD1  LEU C  34     -10.643   26.028   39.661  1.00 29.49      A    C
ATOM   5835  CD2  LEU C  34      -9.194   25.278   37.887  1.00 28.62      A    C
```

Appendix 1

```
ATOM   5836  C    LEU C  34     -12.051  22.329  36.832  1.00  33.43     A   C
ATOM   5837  O    LEU C  34     -11.375  21.366  36.919  1.00  32.33     A   O
ATOM   5838  N    ALA C  35     -13.354  22.261  36.777  1.00  32.50     A   N
ATOM   5839  CA   ALA C  35     -14.035  21.008  36.797  1.00  32.98     A   C
ATOM   5840  CB   ALA C  35     -14.313  20.606  38.181  1.00  31.58     A   C
ATOM   5841  C    ALA C  35     -15.304  21.138  36.006  1.00  32.61     A   C
ATOM   5842  O    ALA C  35     -15.757  22.194  35.757  1.00  33.68     A   O
ATOM   5843  N    THR C  36     -15.860  20.034  35.581  1.00  32.24     A   N
ATOM   5844  CA   THR C  36     -17.137  20.028  34.923  1.00  32.59     A   C
ATOM   5845  CB   THR C  36     -17.333  18.757  34.153  1.00  32.31     A   C
ATOM   5846  OG1  THR C  36     -17.411  17.670  35.052  1.00  32.93     A   O
ATOM   5847  CG2  THR C  36     -16.214  18.544  33.270  1.00  28.73     A   C
ATOM   5848  C    THR C  36     -18.270  20.218  35.888  1.00  32.10     A   C
ATOM   5849  O    THR C  36     -18.124  19.990  37.043  1.00  33.37     A   O
ATOM   5850  N    THR C  37     -19.391  20.678  35.379  1.00  31.47     A   N
ATOM   5851  CA   THR C  37     -20.615  20.844  36.115  1.00  31.40     A   C
ATOM   5852  CB   THR C  37     -21.654  21.520  35.203  1.00  31.37     A   C
ATOM   5853  OG1  THR C  37     -21.285  22.864  34.970  1.00  30.33     A   O
ATOM   5854  CG2  THR C  37     -22.991  21.514  35.750  1.00  27.78     A   C
ATOM   5855  C    THR C  37     -21.053  19.473  36.590  1.00  33.72     A   C
ATOM   5856  O    THR C  37     -21.578  19.308  37.651  1.00  33.29     A   O
ATOM   5857  N    GLU C  38     -20.784  18.477  35.773  1.00  36.66     C   N
ATOM   5858  CA   GLU C  38     -21.143  17.108  36.036  1.00  38.92     C   C
ATOM   5859  CB   GLU C  38     -20.775  16.239  34.847  1.00  39.29     C   C
ATOM   5860  CG   GLU C  38     -21.669  15.062  34.657  1.00  45.70     C   C
ATOM   5861  CD   GLU C  38     -21.153  14.039  33.681  1.00  53.75     C   C
ATOM   5862  OE1  GLU C  38     -19.953  13.805  33.628  1.00  54.35     C   O
ATOM   5863  OE2  GLU C  38     -21.955  13.434  32.961  1.00  57.36     C   O
ATOM   5864  C    GLU C  38     -20.471  16.584  37.266  1.00  39.43     C   C
ATOM   5865  O    GLU C  38     -21.098  15.934  38.077  1.00  39.46     C   O
ATOM   5866  N    ASP C  39     -19.198  16.902  37.416  1.00  38.40     C   N
ATOM   5867  CA   ASP C  39     -18.472  16.675  38.641  1.00  37.56     C   C
ATOM   5868  CB   ASP C  39     -17.028  17.037  38.434  1.00  38.04     C   C
ATOM   5869  CG   ASP C  39     -16.317  16.056  37.591  1.00  43.45     C   C
ATOM   5870  OD1  ASP C  39     -16.954  15.086  37.184  1.00  48.40     C   O
ATOM   5871  OD2  ASP C  39     -15.130  16.242  37.314  1.00  44.96     C   O
ATOM   5872  C    ASP C  39     -19.005  17.416  39.857  1.00  36.58     C   C
ATOM   5873  O    ASP C  39     -19.102  16.837  40.901  1.00  36.49     C   O
ATOM   5874  N    TYR C  40     -19.381  18.673  39.739  1.00  33.69     A   N
ATOM   5875  CA   TYR C  40     -19.937  19.338  40.900  1.00  33.58     A   C
ATOM   5876  CB   TYR C  40     -20.129  20.821  40.654  1.00  33.20     A   C
ATOM   5877  CG   TYR C  40     -18.855  21.544  40.434  1.00  30.94     A   C
ATOM   5878  CD1  TYR C  40     -17.840  21.451  41.323  1.00  30.36     A   C
ATOM   5879  CE1  TYR C  40     -16.699  22.069  41.112  1.00  26.60     A   C
ATOM   5880  CZ   TYR C  40     -16.531  22.765  40.016  1.00  28.13     A   C
ATOM   5881  OH   TYR C  40     -15.390  23.405  39.790  1.00  31.84     A   O
ATOM   5882  CE2  TYR C  40     -17.491  22.869  39.127  1.00  30.00     A   C
ATOM   5883  CD2  TYR C  40     -18.642  22.267  39.324  1.00  27.07     A   C
ATOM   5884  C    TYR C  40     -21.220  18.736  41.394  1.00  33.72     A   C
ATOM   5885  O    TYR C  40     -21.373  18.496  42.549  1.00  33.28     A   O
ATOM   5886  N    PHE C  41     -22.146  18.477  40.497  1.00  33.40     A   N
ATOM   5887  CA   PHE C  41     -23.429  17.910  40.853  1.00  31.87     A   C
ATOM   5888  CB   PHE C  41     -24.417  18.051  39.710  1.00  31.04     A   C
ATOM   5889  CG   PHE C  41     -24.963  19.411  39.570  1.00  29.34     A   C
```

Appendix 1

```
ATOM   5890  CD1  PHE C  41     -26.239  19.676  39.861  1.00  26.77    A  C
ATOM   5891  CE1  PHE C  41     -26.703  20.892  39.736  1.00  26.52    A  C
ATOM   5892  CZ   PHE C  41     -25.916  21.872  39.340  1.00  23.42    A  C
ATOM   5893  CE2  PHE C  41     -24.665  21.639  39.044  1.00  25.08    A  C
ATOM   5894  CD2  PHE C  41     -24.187  20.428  39.156  1.00  27.42    A  C
ATOM   5895  C    PHE C  41     -23.294  16.492  41.322  1.00  31.77    A  C
ATOM   5896  O    PHE C  41     -24.156  15.957  41.950  1.00  31.03    A  O
ATOM   5897  N    ALA C  42     -22.173  15.892  41.003  1.00  32.72    A  N
ATOM   5898  CA   ALA C  42     -21.893  14.518  41.378  1.00  33.43    A  C
ATOM   5899  CB   ALA C  42     -21.299  13.805  40.229  1.00  31.42    A  C
ATOM   5900  C    ALA C  42     -21.046  14.305  42.626  1.00  34.68    A  C
ATOM   5901  O    ALA C  42     -20.682  13.212  42.919  1.00  36.24    A  O
ATOM   5902  N    GLN C  43     -20.707  15.358  43.338  1.00  35.46    A  N
ATOM   5903  CA   GLN C  43     -19.897  15.241  44.527  1.00  35.66    A  C
ATOM   5904  CB   GLN C  43     -19.529  16.616  45.042  1.00  34.89    A  C
ATOM   5905  CG   GLN C  43     -18.387  17.246  44.354  1.00  31.72    A  C
ATOM   5906  CD   GLN C  43     -18.247  18.700  44.685  1.00  29.60    A  C
ATOM   5907  OE1  GLN C  43     -19.124  19.462  44.445  1.00  27.92    A  O
ATOM   5908  NE2  GLN C  43     -17.133  19.076  45.207  1.00  22.68    A  N
ATOM   5909  C    GLN C  43     -20.573  14.461  45.628  1.00  36.29    A  C
ATOM   5910  O    GLN C  43     -19.984  13.628  46.257  1.00  35.59    A  O
ATOM   5911  N    GLN C  44     -21.835  14.739  45.844  1.00  36.68    A  N
ATOM   5912  CA   GLN C  44     -22.564  14.090  46.894  1.00  37.02    A  C
ATOM   5913  CB   GLN C  44     -23.947  14.677  46.930  1.00  36.00    A  C
ATOM   5914  CG   GLN C  44     -24.643  14.464  48.173  1.00  36.57    A  C
ATOM   5915  CD   GLN C  44     -25.728  15.413  48.348  1.00  36.87    A  C
ATOM   5916  OE1  GLN C  44     -25.773  16.426  47.713  1.00  35.06    A  O
ATOM   5917  NE2  GLN C  44     -26.631  15.090  49.208  1.00  37.03    A  N
ATOM   5918  C    GLN C  44     -22.676  12.600  46.710  1.00  37.12    A  C
ATOM   5919  O    GLN C  44     -22.546  11.853  47.635  1.00  35.46    A  O
ATOM   5920  N    ALA C  45     -22.963  12.167  45.505  1.00  38.15    A  N
ATOM   5921  CA   ALA C  45     -23.019  10.762  45.227  1.00  38.79    A  C
ATOM   5922  CB   ALA C  45     -23.569  10.551  43.922  1.00  38.35    A  C
ATOM   5923  C    ALA C  45     -21.694  10.043  45.365  1.00  39.01    A  C
ATOM   5924  O    ALA C  45     -21.633   8.973  45.893  1.00  39.50    A  O
ATOM   5925  N    LYS C  46     -20.631  10.637  44.887  1.00  38.54    A  N
ATOM   5926  CA   LYS C  46     -19.325  10.054  45.011  1.00  38.74    A  C
ATOM   5927  CB   LYS C  46     -18.361  10.737  44.090  1.00  38.56    A  C
ATOM   5928  CG   LYS C  46     -18.286  10.137  42.763  1.00  42.06    A  C
ATOM   5929  CD   LYS C  46     -18.375  11.187  41.728  1.00  48.19    A  C
ATOM   5930  CE   LYS C  46     -18.021  10.666  40.377  1.00  53.34    A  C
ATOM   5931  NZ   LYS C  46     -16.626  10.193  40.267  1.00  53.64    A  N
ATOM   5932  C    LYS C  46     -18.826  10.170  46.416  1.00  38.67    A  C
ATOM   5933  O    LYS C  46     -17.830   9.621  46.758  1.00  39.34    A  O
ATOM   5934  N    GLN C  47     -19.506  10.955  47.208  1.00  38.82    A  N
ATOM   5935  CA   GLN C  47     -19.130  11.164  48.572  1.00  39.93    A  C
ATOM   5936  CB   GLN C  47     -19.192   9.868  49.356  1.00  40.41    A  C
ATOM   5937  CG   GLN C  47     -20.566   9.319  49.545  1.00  44.79    A  C
ATOM   5938  CD   GLN C  47     -20.837   8.816  50.942  1.00  50.98    A  C
ATOM   5939  OE1  GLN C  47     -20.208   7.881  51.416  1.00  52.66    A  O
ATOM   5940  NE2  GLN C  47     -21.802   9.415  51.595  1.00  49.58    A  N
ATOM   5941  C    GLN C  47     -17.768  11.806  48.686  1.00  39.62    A  C
ATOM   5942  O    GLN C  47     -17.080  11.631  49.649  1.00  40.59    A  O
ATOM   5943  N    ALA C  48     -17.389  12.558  47.684  1.00  38.33    A  N
```

Appendix 1

```
ATOM   5944  CA   ALA C  48     -16.156  13.268  47.729  1.00 37.80      A  C
ATOM   5945  CB   ALA C  48     -15.135  12.482  47.075  1.00 36.25      A  C
ATOM   5946  C    ALA C  48     -16.248  14.637  47.098  1.00 38.29      A  C
ATOM   5947  O    ALA C  48     -16.921  14.810  46.133  1.00 38.72      A  O
ATOM   5948  N    VAL C  49     -15.545  15.606  47.655  1.00 37.45      A  N
ATOM   5949  CA   VAL C  49     -15.414  16.895  47.044  1.00 35.23      A  C
ATOM   5950  CB   VAL C  49     -14.887  17.919  48.012  1.00 34.51      A  C
ATOM   5951  CG1  VAL C  49     -15.904  18.278  48.968  1.00 32.42      A  C
ATOM   5952  CG2  VAL C  49     -13.705  17.431  48.663  1.00 33.19      A  C
ATOM   5953  C    VAL C  49     -14.500  16.794  45.851  1.00 34.84      A  C
ATOM   5954  O    VAL C  49     -13.695  15.924  45.770  1.00 34.38      A  O
ATOM   5955  N    THR C  50     -14.649  17.693  44.912  1.00 34.35      A  N
ATOM   5956  CA   THR C  50     -13.736  17.781  43.814  1.00 35.05      A  C
ATOM   5957  CB   THR C  50     -14.304  18.615  42.686  1.00 34.78      A  C
ATOM   5958  OG1  THR C  50     -14.268  19.971  43.047  1.00 35.81      A  O
ATOM   5959  CG2  THR C  50     -15.695  18.284  42.446  1.00 34.33      A  C
ATOM   5960  C    THR C  50     -12.440  18.387  44.309  1.00 35.68      A  C
ATOM   5961  O    THR C  50     -12.418  19.085  45.276  1.00 36.56      A  O
ATOM   5962  N    PRO C  51     -11.359  18.142  43.616  1.00 34.24      A  N
ATOM   5963  CA   PRO C  51     -10.047  18.557  44.060  1.00 32.22      A  C
ATOM   5964  CB   PRO C  51      -9.151  17.986  42.988  1.00 32.36      A  C
ATOM   5965  CG   PRO C  51      -9.892  16.933  42.431  1.00 33.20      A  C
ATOM   5966  CD   PRO C  51     -11.260  17.366  42.394  1.00 34.77      A  C
ATOM   5967  C    PRO C  51      -9.908  20.045  44.172  1.00 31.38      A  C
ATOM   5968  O    PRO C  51      -9.149  20.522  44.962  1.00 33.02      A  O
ATOM   5969  N    ASP C  52     -10.615  20.756  43.328  1.00 29.33      A  N
ATOM   5970  CA   ASP C  52     -10.728  22.193  43.396  1.00 27.00      A  C
ATOM   5971  CB   ASP C  52     -11.136  22.835  42.056  1.00 27.21      A  C
ATOM   5972  CG   ASP C  52     -12.476  22.434  41.567  1.00 31.01      A  C
ATOM   5973  OD1  ASP C  52     -13.230  23.304  41.201  1.00 32.41      A  O
ATOM   5974  OD2  ASP C  52     -12.759  21.264  41.455  1.00 36.10      A  O-1
ATOM   5975  C    ASP C  52     -11.460  22.764  44.588  1.00 25.60      A  C
ATOM   5976  O    ASP C  52     -11.153  23.791  45.051  1.00 24.19      A  O
ATOM   5977  N    VAL C  53     -12.486  22.099  45.015  1.00 24.58      A  N
ATOM   5978  CA   VAL C  53     -13.136  22.423  46.230  1.00 23.23      A  C
ATOM   5979  CB   VAL C  53     -14.441  21.722  46.307  1.00 23.93      A  C
ATOM   5980  CG1  VAL C  53     -14.984  21.769  47.651  1.00 23.11      A  C
ATOM   5981  CG2  VAL C  53     -15.349  22.323  45.366  1.00 19.17      A  C
ATOM   5982  C    VAL C  53     -12.236  22.142  47.416  1.00 23.40      A  C
ATOM   5983  O    VAL C  53     -12.255  22.833  48.351  1.00 21.93      A  O
ATOM   5984  N    MET C  54     -11.462  21.091  47.347  1.00 23.84      A  N
ATOM   5985  CA   MET C  54     -10.485  20.793  48.325  1.00 24.23      A  C
ATOM   5986  CB   MET C  54      -9.948  19.396  48.112  1.00 22.63      C  C
ATOM   5987  CG   MET C  54      -9.011  18.971  49.131  1.00 26.29      C  C
ATOM   5988  SD   MET C  54      -9.761  18.438  50.610  1.00 42.38      C  S
ATOM   5989  CE   MET C  54      -8.516  17.416  51.244  1.00 38.53      C  C
ATOM   5990  C    MET C  54      -9.376  21.824  48.402  1.00 25.04      A  C
ATOM   5991  O    MET C  54      -8.881  22.111  49.450  1.00 26.59      A  O
ATOM   5992  N    ALA C  55      -8.974  22.344  47.267  1.00 25.07      A  N
ATOM   5993  CA   ALA C  55      -8.013  23.390  47.178  1.00 24.58      A  C
ATOM   5994  CB   ALA C  55      -7.581  23.545  45.795  1.00 24.03      A  C
ATOM   5995  C    ALA C  55      -8.503  24.693  47.768  1.00 24.72      A  C
ATOM   5996  O    ALA C  55      -7.754  25.432  48.311  1.00 24.23      A  O
ATOM   5997  N    GLN C  56      -9.772  24.968  47.605  1.00 24.26      A  N
```

Appendix 1

```
ATOM   5998  CA   GLN C  56     -10.418  26.078  48.239  1.00  25.29      A    C
ATOM   5999  CB   GLN C  56     -11.791  26.293  47.618  1.00  24.54      A    C
ATOM   6000  CG   GLN C  56     -12.719  27.128  48.381  1.00  24.25      A    C
ATOM   6001  CD   GLN C  56     -12.429  28.556  48.273  1.00  27.13      A    C
ATOM   6002  OE1  GLN C  56     -11.781  28.979  47.385  1.00  28.05      A    O
ATOM   6003  NE2  GLN C  56     -12.893  29.313  49.200  1.00  31.00      A    N
ATOM   6004  C    GLN C  56     -10.494  25.922  49.727  1.00  25.43      A    C
ATOM   6005  O    GLN C  56     -10.379  26.831  50.457  1.00  24.11      A    O
ATOM   6006  N    LEU C  57     -10.737  24.713  50.132  1.00  26.50      A    N
ATOM   6007  CA   LEU C  57     -10.829  24.322  51.494  1.00  27.37      A    C
ATOM   6008  CB   LEU C  57     -11.276  22.889  51.560  1.00  27.08      A    C
ATOM   6009  CG   LEU C  57     -12.549  22.473  52.236  1.00  29.38      A    C
ATOM   6010  CD1  LEU C  57     -13.550  23.549  52.296  1.00  29.19      A    C
ATOM   6011  CD2  LEU C  57     -13.077  21.339  51.506  1.00  27.22      A    C
ATOM   6012  C    LEU C  57      -9.513  24.493  52.147  1.00  27.60      A    C
ATOM   6013  O    LEU C  57      -9.460  24.833  53.268  1.00  28.59      A    O
ATOM   6014  N    ALA C  58      -8.446  24.221  51.434  1.00  27.35      A    N
ATOM   6015  CA   ALA C  58      -7.103  24.436  51.931  1.00  27.00      A    C
ATOM   6016  CB   ALA C  58      -6.116  23.723  51.114  1.00  26.77      A    C
ATOM   6017  C    ALA C  58      -6.718  25.884  52.139  1.00  26.16      A    C
ATOM   6018  O    ALA C  58      -6.066  26.224  53.077  1.00  25.94      A    O
ATOM   6019  N    TYR C  59      -7.139  26.725  51.231  1.00  25.36      A    N
ATOM   6020  CA   TYR C  59      -6.959  28.139  51.338  1.00  24.92      A    C
ATOM   6021  CB   TYR C  59      -7.427  28.907  50.077  1.00  23.85      A    C
ATOM   6022  CG   TYR C  59      -7.940  30.283  50.409  1.00  20.15      A    C
ATOM   6023  CD1  TYR C  59      -7.089  31.308  50.668  1.00  21.03      A    C
ATOM   6024  CE1  TYR C  59      -7.543  32.499  51.006  1.00  22.59      A    C
ATOM   6025  CZ   TYR C  59      -8.862  32.694  51.116  1.00  24.41      A    C
ATOM   6026  OH   TYR C  59      -9.309  33.898  51.473  1.00  29.29      A    O
ATOM   6027  CE2  TYR C  59      -9.721  31.708  50.866  1.00  15.78      A    C
ATOM   6028  CD2  TYR C  59      -9.270  30.525  50.537  1.00  21.55      A    C
ATOM   6029  C    TYR C  59      -7.701  28.609  52.562  1.00  25.26      A    C
ATOM   6030  O    TYR C  59      -7.279  29.480  53.226  1.00  25.72      A    O
ATOM   6031  N    MET C  60      -8.837  28.035  52.821  1.00  24.59      A    N
ATOM   6032  CA   MET C  60      -9.598  28.350  53.975  1.00  25.19      A    C
ATOM   6033  CB   MET C  60     -10.985  27.742  53.840  1.00  24.64      C    C
ATOM   6034  CG   MET C  60     -11.930  28.515  52.919  1.00  21.59      C    C
ATOM   6035  SD   MET C  60     -13.413  27.676  52.395  1.00  27.35      C    S
ATOM   6036  CE   MET C  60     -14.275  27.640  53.877  1.00  21.26      C    C
ATOM   6037  C    MET C  60      -8.879  27.946  55.262  1.00  25.67      A    C
ATOM   6038  O    MET C  60      -9.045  28.544  56.271  1.00  24.66      A    O
ATOM   6039  N    ASN C  61      -8.092  26.897  55.191  1.00  24.35      A    N
ATOM   6040  CA   ASN C  61      -7.561  26.262  56.353  1.00  24.63      A    C
ATOM   6041  CB   ASN C  61      -8.144  24.863  56.418  1.00  24.00      A    C
ATOM   6042  CG   ASN C  61      -9.517  24.826  56.976  1.00  26.79      A    C
ATOM   6043  OD1  ASN C  61      -9.746  25.108  58.108  1.00  27.91      A    O
ATOM   6044  ND2  ASN C  61     -10.435  24.450  56.175  1.00  26.34      A    N
ATOM   6045  C    ASN C  61      -6.060  26.153  56.519  1.00  25.08      A    C
ATOM   6046  O    ASN C  61      -5.618  26.055  57.597  1.00  22.60      A    O
ATOM   6047  N    TYR C  62      -5.299  26.087  55.437  1.00  26.69      A    N
ATOM   6048  CA   TYR C  62      -3.892  25.723  55.500  1.00  26.81      A    C
ATOM   6049  CB   TYR C  62      -3.455  25.246  54.100  1.00  25.11      A    C
ATOM   6050  CG   TYR C  62      -2.255  24.364  54.103  1.00  20.63      A    C
ATOM   6051  CD1  TYR C  62      -2.365  23.014  54.038  1.00  12.35      A    C
```

Appendix 1

```
ATOM   6052  CE1  TYR C  62     -1.294  22.246  54.076  1.00 13.28    A    C
ATOM   6053  CZ   TYR C  62     -0.084  22.796  54.190  1.00 17.44    A    C
ATOM   6054  OH   TYR C  62      1.030  22.047  54.249  1.00 24.71    A    O
ATOM   6055  CE2  TYR C  62      0.046  24.118  54.266  1.00 17.85    A    C
ATOM   6056  CD2  TYR C  62     -1.005  24.889  54.212  1.00 18.33    A    C
ATOM   6057  C    TYR C  62     -2.828  26.660  56.095  1.00 28.48    A    C
ATOM   6058  O    TYR C  62     -2.116  26.292  57.014  1.00 27.35    A    O
ATOM   6059  N    ILE C  63     -2.681  27.843  55.532  1.00 30.59    A    N
ATOM   6060  CA   ILE C  63     -1.661  28.757  55.993  1.00 32.18    A    C
ATOM   6061  CB   ILE C  63     -1.366  29.848  55.033  1.00 30.85    A    C
ATOM   6062  CG1  ILE C  63     -1.027  29.283  53.706  1.00 31.12    A    C
ATOM   6063  CD1  ILE C  63     -0.744  30.291  52.789  1.00 26.18    A    C
ATOM   6064  CG2  ILE C  63     -0.183  30.573  55.479  1.00 32.08    A    C
ATOM   6065  C    ILE C  63     -2.012  29.375  57.305  1.00 34.41    A    C
ATOM   6066  O    ILE C  63     -3.105  29.779  57.548  1.00 34.19    A    O
ATOM   6067  N    ASP C  64     -1.049  29.436  58.178  1.00 37.72    A    N
ATOM   6068  CA   ASP C  64     -1.415  29.601  59.517  1.00 39.38    A    C
ATOM   6069  CB   ASP C  64     -0.857  28.491  60.399  1.00 41.78    A    C
ATOM   6070  CG   ASP C  64      0.510  28.692  60.756  1.00 43.32    A    C
ATOM   6071  OD1  ASP C  64      0.952  29.788  60.576  1.00 49.49    A    O
ATOM   6072  OD2  ASP C  64      1.126  27.762  61.232  1.00 46.06    A    O
ATOM   6073  C    ASP C  64     -1.653  30.923  60.194  1.00 39.33    A    C
ATOM   6074  O    ASP C  64     -2.249  30.929  61.223  1.00 42.00    A    O
ATOM   6075  N    PHE C  65     -1.370  32.067  59.653  1.00 36.84    A    N
ATOM   6076  CA   PHE C  65     -2.057  33.136  60.357  1.00 35.39    A    C
ATOM   6077  CB   PHE C  65     -1.102  34.122  61.004  1.00 35.72    A    C
ATOM   6078  CG   PHE C  65     -0.311  33.516  62.071  1.00 36.09    A    C
ATOM   6079  CD1  PHE C  65     -0.852  33.280  63.276  1.00 33.89    A    C
ATOM   6080  CE1  PHE C  65     -0.155  32.686  64.187  1.00 34.05    A    C
ATOM   6081  CZ   PHE C  65      1.079  32.314  63.940  1.00 34.59    A    C
ATOM   6082  CE2  PHE C  65      1.618  32.519  62.777  1.00 35.65    A    C
ATOM   6083  CD2  PHE C  65      0.939  33.101  61.837  1.00 36.37    A    C
ATOM   6084  C    PHE C  65     -3.101  33.819  59.569  1.00 33.91    A    C
ATOM   6085  O    PHE C  65     -3.942  34.457  60.121  1.00 32.64    A    O
ATOM   6086  N    ILE C  66     -3.030  33.639  58.264  1.00 32.83    A    N
ATOM   6087  CA   ILE C  66     -3.791  34.388  57.307  1.00 30.71    A    C
ATOM   6088  CB   ILE C  66     -2.839  34.973  56.311  1.00 31.44    A    C
ATOM   6089  CG1  ILE C  66     -2.045  33.874  55.661  1.00 30.19    A    C
ATOM   6090  CD1  ILE C  66     -1.231  34.317  54.625  1.00 27.13    A    C
ATOM   6091  CG2  ILE C  66     -1.880  35.784  57.015  1.00 28.96    A    C
ATOM   6092  C    ILE C  66     -4.930  33.688  56.603  1.00 30.58    A    C
ATOM   6093  O    ILE C  66     -5.630  34.287  55.853  1.00 31.91    A    O
ATOM   6094  N    SER C  67     -5.120  32.419  56.844  1.00 28.87    A    N
ATOM   6095  CA   SER C  67     -6.263  31.764  56.304  1.00 27.66    A    C
ATOM   6096  CB   SER C  67     -6.073  30.266  56.317  1.00 27.83    A    C
ATOM   6097  OG   SER C  67     -5.481  29.859  57.482  1.00 31.89    A    O
ATOM   6098  C    SER C  67     -7.458  32.225  57.087  1.00 25.90    A    C
ATOM   6099  O    SER C  67     -7.318  32.640  58.162  1.00 25.96    A    O
ATOM   6100  N    PRO C  68     -8.632  32.202  56.513  1.00 25.56    A    N
ATOM   6101  CA   PRO C  68     -9.824  32.704  57.165  1.00 24.50    A    C
ATOM   6102  CB   PRO C  68    -10.869  32.593  56.069  1.00 24.46    A    C
ATOM   6103  CG   PRO C  68    -10.188  32.410  54.910  1.00 24.60    A    C
ATOM   6104  CD   PRO C  68     -8.952  31.740  55.175  1.00 26.02    A    C
ATOM   6105  C    PRO C  68    -10.253  31.922  58.382  1.00 23.29    A    C
```

Appendix 1

```
ATOM   6106  O    PRO C  68     -10.910  32.437  59.222  1.00  22.80    A  O
ATOM   6107  N    PHE C  69      -9.916  30.664  58.420  1.00  22.24    A  N
ATOM   6108  CA   PHE C  69     -10.468  29.759  59.382  1.00  24.19    A  C
ATOM   6109  CB   PHE C  69     -11.285  28.648  58.704  1.00  24.36    A  C
ATOM   6110  CG   PHE C  69     -12.579  29.128  58.205  1.00  27.65    A  C
ATOM   6111  CD1  PHE C  69     -13.663  29.113  58.989  1.00  31.95    A  C
ATOM   6112  CE1  PHE C  69     -14.807  29.606  58.565  1.00  37.42    A  C
ATOM   6113  CZ   PHE C  69     -14.884  30.152  57.373  1.00  36.63    A  C
ATOM   6114  CE2  PHE C  69     -13.800  30.199  56.572  1.00  34.65    A  C
ATOM   6115  CD2  PHE C  69     -12.677  29.704  56.986  1.00  31.47    A  C
ATOM   6116  C    PHE C  69      -9.480  29.260  60.368  1.00  24.27    A  C
ATOM   6117  O    PHE C  69      -9.708  28.294  61.004  1.00  25.72    A  O
ATOM   6118  N    TYR C  70      -8.363  29.943  60.458  1.00  24.28    A  N
ATOM   6119  CA   TYR C  70      -7.276  29.548  61.312  1.00  23.68    A  C
ATOM   6120  CB   TYR C  70      -6.046  30.387  60.991  1.00  23.40    A  C
ATOM   6121  CG   TYR C  70      -4.909  30.174  61.917  1.00  23.75    A  C
ATOM   6122  CD1  TYR C  70      -4.070  29.108  61.777  1.00  26.92    A  C
ATOM   6123  CE1  TYR C  70      -3.094  28.898  62.609  1.00  26.34    A  C
ATOM   6124  CZ   TYR C  70      -2.919  29.740  63.595  1.00  30.34    A  C
ATOM   6125  OH   TYR C  70      -1.904  29.507  64.433  1.00  37.56    A  O
ATOM   6126  CE2  TYR C  70      -3.726  30.799  63.755  1.00  28.57    A  C
ATOM   6127  CD2  TYR C  70      -4.696  31.009  62.930  1.00  22.11    A  C
ATOM   6128  C    TYR C  70      -7.554  29.556  62.790  1.00  23.24    A  C
ATOM   6129  O    TYR C  70      -7.248  28.658  63.471  1.00  24.09    A  O
ATOM   6130  N    SER C  71      -8.156  30.590  63.286  1.00  24.06    A  N
ATOM   6131  CA   SER C  71      -8.268  30.733  64.694  1.00  25.89    A  C
ATOM   6132  CB   SER C  71      -7.153  31.621  65.196  1.00  25.77    A  C
ATOM   6133  OG   SER C  71      -7.594  32.534  66.115  1.00  27.14    A  O
ATOM   6134  C    SER C  71      -9.615  31.253  65.084  1.00  26.94    A  C
ATOM   6135  O    SER C  71     -10.275  31.851  64.314  1.00  25.19    A  O
ATOM   6136  N    ARG C  72     -10.038  30.972  66.292  1.00  28.42    A  N
ATOM   6137  CA   ARG C  72     -11.342  31.374  66.708  1.00  30.73    A  C
ATOM   6138  CB   ARG C  72     -11.966  30.353  67.635  1.00  32.50    A  C
ATOM   6139  CG   ARG C  72     -11.507  30.365  69.025  1.00  38.68    A  C
ATOM   6140  CD   ARG C  72     -12.512  29.698  69.925  1.00  45.44    A  C
ATOM   6141  NE   ARG C  72     -13.258  28.681  69.228  1.00  49.24    A  N
ATOM   6142  CZ   ARG C  72     -13.474  27.458  69.674  1.00  55.32    A  C
ATOM   6143  NH1  ARG C  72     -13.024  27.051  70.829  1.00  54.47    A  N
ATOM   6144  NH2  ARG C  72     -14.158  26.630  68.941  1.00  59.32    A  N
ATOM   6145  C    ARG C  72     -11.323  32.743  67.289  1.00  29.99    A  C
ATOM   6146  O    ARG C  72     -12.308  33.274  67.663  1.00  31.62    A  O
ATOM   6147  N    GLY C  73     -10.175  33.358  67.264  1.00  29.73    A  N
ATOM   6148  CA   GLY C  73     -10.021  34.712  67.686  1.00  30.71    A  C
ATOM   6149  C    GLY C  73     -10.551  35.809  66.817  1.00  32.42    A  C
ATOM   6150  O    GLY C  73     -10.819  35.630  65.690  1.00  32.12    A  O
ATOM   6151  N    CYS C  74     -10.706  36.976  67.385  1.00  32.60    A  N
ATOM   6152  CA   CYS C  74     -11.222  38.042  66.610  1.00  34.10    A  C
ATOM   6153  CB   CYS C  74     -12.331  38.853  67.364  1.00  34.23    A  C
ATOM   6154  SG   CYS C  74     -14.185  38.349  66.932  1.00  44.75    A  S
ATOM   6155  C    CYS C  74     -10.077  38.758  65.889  1.00  33.43    A  C
ATOM   6156  O    CYS C  74      -9.774  39.889  66.099  1.00  32.70    A  O
ATOM   6157  N    SER C  75      -9.450  38.000  65.010  1.00  31.86    A  N
ATOM   6158  CA   SER C  75      -8.431  38.455  64.114  1.00  31.48    A  C
ATOM   6159  CB   SER C  75      -7.240  37.582  64.266  1.00  31.82    A  C
```

Appendix 1

```
ATOM   6160  OG   SER C  75      -6.582  37.523  63.049  1.00 35.84      A    O
ATOM   6161  C    SER C  75      -8.915  38.336  62.686  1.00 30.54      A    C
ATOM   6162  O    SER C  75      -9.494  37.377  62.318  1.00 29.75      A    O
ATOM   6163  N    PHE C  76      -8.727  39.341  61.867  1.00 29.60      A    N
ATOM   6164  CA   PHE C  76      -9.370  39.322  60.583  1.00 29.58      A    C
ATOM   6165  CB   PHE C  76     -10.524  40.297  60.552  1.00 28.87      A    C
ATOM   6166  CG   PHE C  76     -11.663  39.859  61.351  1.00 28.47      A    C
ATOM   6167  CD1  PHE C  76     -12.593  39.060  60.812  1.00 27.24      A    C
ATOM   6168  CE1  PHE C  76     -13.611  38.622  61.541  1.00 29.54      A    C
ATOM   6169  CZ   PHE C  76     -13.708  38.975  62.819  1.00 29.83      A    C
ATOM   6170  CE2  PHE C  76     -12.779  39.749  63.375  1.00 29.64      A    C
ATOM   6171  CD2  PHE C  76     -11.782  40.203  62.648  1.00 26.75      A    C
ATOM   6172  C    PHE C  76      -8.492  39.566  59.421  1.00 30.58      A    C
ATOM   6173  O    PHE C  76      -8.873  40.209  58.521  1.00 31.99      A    O
ATOM   6174  N    GLU C  77      -7.304  39.030  59.476  1.00 32.69      A    N
ATOM   6175  CA   GLU C  77      -6.235  39.276  58.551  1.00 33.75      A    C
ATOM   6176  CB   GLU C  77      -5.023  38.504  58.998  1.00 34.62      A    C
ATOM   6177  CG   GLU C  77      -3.949  39.373  59.514  1.00 43.89      A    C
ATOM   6178  CD   GLU C  77      -3.509  39.035  60.912  1.00 50.76      A    C
ATOM   6179  OE1  GLU C  77      -4.063  39.585  61.867  1.00 52.13      A    O
ATOM   6180  OE2  GLU C  77      -2.578  38.255  61.042  1.00 49.05      A    O-1
ATOM   6181  C    GLU C  77      -6.550  38.840  57.183  1.00 32.31      A    C
ATOM   6182  O    GLU C  77      -6.166  39.442  56.251  1.00 32.87      A    O
ATOM   6183  N    ALA C  78      -7.228  37.730  57.081  1.00 32.99      A    N
ATOM   6184  CA   ALA C  78      -7.470  37.100  55.821  1.00 32.04      A    C
ATOM   6185  CB   ALA C  78      -8.158  35.843  56.043  1.00 30.78      A    C
ATOM   6186  C    ALA C  78      -8.297  37.986  54.947  1.00 32.69      A    C
ATOM   6187  O    ALA C  78      -8.089  38.070  53.777  1.00 33.18      A    O
ATOM   6188  N    TRP C  79      -9.285  38.594  55.554  1.00 31.83      A    N
ATOM   6189  CA   TRP C  79     -10.119  39.603  54.969  1.00 32.46      A    C
ATOM   6190  CB   TRP C  79     -11.319  39.843  55.850  1.00 30.34      A    C
ATOM   6191  CG   TRP C  79     -12.229  38.738  55.868  1.00 27.93      A    C
ATOM   6192  CD1  TRP C  79     -13.274  38.574  55.089  1.00 26.43      A    C
ATOM   6193  NE1  TRP C  79     -13.916  37.438  55.381  1.00 24.62      A    N
ATOM   6194  CE2  TRP C  79     -13.267  36.818  56.392  1.00 23.36      A    C
ATOM   6195  CD2  TRP C  79     -12.193  37.616  56.730  1.00 28.61      A    C
ATOM   6196  CE3  TRP C  79     -11.356  37.212  57.762  1.00 23.64      A    C
ATOM   6197  CZ3  TRP C  79     -11.622  36.078  58.381  1.00 27.00      A    C
ATOM   6198  CH2  TRP C  79     -12.718  35.304  58.028  1.00 30.24      A    C
ATOM   6199  CZ2  TRP C  79     -13.546  35.663  57.036  1.00 27.40      A    C
ATOM   6200  C    TRP C  79      -9.418  40.906  54.644  1.00 33.83      A    C
ATOM   6201  O    TRP C  79      -9.760  41.561  53.714  1.00 33.87      A    O
ATOM   6202  N    GLU C  80      -8.469  41.304  55.463  1.00 34.57      A    N
ATOM   6203  CA   GLU C  80      -7.667  42.464  55.178  1.00 35.40      A    C
ATOM   6204  CB   GLU C  80      -6.713  42.744  56.311  1.00 34.85      A    C
ATOM   6205  CG   GLU C  80      -7.245  43.698  57.308  1.00 41.72      A    C
ATOM   6206  CD   GLU C  80      -6.876  43.359  58.732  1.00 48.24      A    C
ATOM   6207  OE1  GLU C  80      -5.780  42.862  58.966  1.00 49.73      A    O
ATOM   6208  OE2  GLU C  80      -7.688  43.593  59.626  1.00 50.70      A    O-1
ATOM   6209  C    GLU C  80      -6.893  42.185  53.935  1.00 35.24      A    C
ATOM   6210  O    GLU C  80      -6.722  43.020  53.101  1.00 35.16      A    O
ATOM   6211  N    LEU C  81      -6.403  40.978  53.816  1.00 35.37      A    N
ATOM   6212  CA   LEU C  81      -5.674  40.592  52.645  1.00 36.46      A    C
ATOM   6213  CB   LEU C  81      -5.165  39.189  52.835  1.00 36.83      A    C
```

Appendix 1

```
ATOM   6214  CG   LEU C  81      -3.688  38.975  53.031  1.00 38.11      A    C
ATOM   6215  CD1  LEU C  81      -3.001  40.244  53.221  1.00 32.19      A    C
ATOM   6216  CD2  LEU C  81      -3.502  38.065  54.188  1.00 38.11      A    C
ATOM   6217  C    LEU C  81      -6.530  40.647  51.382  1.00 36.48      A    C
ATOM   6218  O    LEU C  81      -6.103  41.069  50.353  1.00 35.91      A    O
ATOM   6219  N    LYS C  82      -7.767  40.231  51.493  1.00 36.17      A    N
ATOM   6220  CA   LYS C  82      -8.704  40.298  50.403  1.00 36.33      A    C
ATOM   6221  CB   LYS C  82      -9.884  39.391  50.667  1.00 36.77      A    C
ATOM   6222  CG   LYS C  82      -9.837  38.073  50.022  1.00 35.84      A    C
ATOM   6223  CD   LYS C  82     -10.395  37.054  50.957  1.00 36.42      A    C
ATOM   6224  CE   LYS C  82     -11.845  37.147  51.126  1.00 35.38      A    C
ATOM   6225  NZ   LYS C  82     -12.470  35.944  50.661  1.00 36.27      A    N
ATOM   6226  C    LYS C  82      -9.222  41.681  50.076  1.00 35.78      A    C
ATOM   6227  O    LYS C  82      -9.773  41.874  49.048  1.00 36.86      A    O
ATOM   6228  N    HIS C  83      -9.023  42.632  50.948  1.00 34.78      A    N
ATOM   6229  CA   HIS C  83      -9.640  43.928  50.860  1.00 35.54      A    C
ATOM   6230  CB   HIS C  83      -9.250  44.654  49.591  1.00 35.49      A    C
ATOM   6231  CG   HIS C  83      -7.787  44.713  49.371  1.00 40.77      A    C
ATOM   6232  ND1  HIS C  83      -6.956  45.466  50.149  1.00 44.25      A    N
ATOM   6233  CE1  HIS C  83      -5.715  45.302  49.757  1.00 44.14      A    C
ATOM   6234  NE2  HIS C  83      -5.714  44.463  48.748  1.00 49.01      A    N
ATOM   6235  CD2  HIS C  83      -6.998  44.080  48.486  1.00 46.01      A    C
ATOM   6236  C    HIS C  83     -11.129  43.910  50.964  1.00 35.15      A    C
ATOM   6237  O    HIS C  83     -11.786  44.651  50.311  1.00 36.76      A    O
ATOM   6238  N    THR C  84     -11.658  43.090  51.834  1.00 33.67      A    N
ATOM   6239  CA   THR C  84     -13.066  43.097  52.100  1.00 32.58      A    C
ATOM   6240  CB   THR C  84     -13.441  41.875  52.875  1.00 32.53      A    C
ATOM   6241  OG1  THR C  84     -12.991  40.729  52.182  1.00 32.36      A    O
ATOM   6242  CG2  THR C  84     -14.894  41.791  53.042  1.00 32.42      A    C
ATOM   6243  C    THR C  84     -13.458  44.285  52.929  1.00 32.25      A    C
ATOM   6244  O    THR C  84     -12.886  44.545  53.934  1.00 33.21      A    O
ATOM   6245  N    PRO C  85     -14.474  44.989  52.519  1.00 30.68      A    N
ATOM   6246  CA   PRO C  85     -15.001  46.055  53.319  1.00 28.75      A    C
ATOM   6247  CB   PRO C  85     -16.046  46.640  52.410  1.00 29.36      A    C
ATOM   6248  CG   PRO C  85     -15.647  46.270  51.126  1.00 31.06      A    C
ATOM   6249  CD   PRO C  85     -15.092  44.975  51.207  1.00 31.22      A    C
ATOM   6250  C    PRO C  85     -15.650  45.498  54.539  1.00 27.40      A    C
ATOM   6251  O    PRO C  85     -16.135  44.428  54.506  1.00 27.42      A    O
ATOM   6252  N    GLN C  86     -15.671  46.261  55.602  1.00 26.10      A    N
ATOM   6253  CA   GLN C  86     -16.081  45.807  56.902  1.00 25.32      A    C
ATOM   6254  CB   GLN C  86     -15.893  46.948  57.895  1.00 25.13      A    C
ATOM   6255  CG   GLN C  86     -16.365  46.686  59.272  1.00 24.50      A    C
ATOM   6256  CD   GLN C  86     -17.813  46.921  59.429  1.00 29.17      A    C
ATOM   6257  OE1  GLN C  86     -18.318  47.871  58.911  1.00 35.81      A    O
ATOM   6258  NE2  GLN C  86     -18.487  46.062  60.130  1.00 25.29      A    N
ATOM   6259  C    GLN C  86     -17.510  45.335  56.898  1.00 24.93      A    C
ATOM   6260  O    GLN C  86     -17.851  44.349  57.475  1.00 24.12      A    O
ATOM   6261  N    ARG C  87     -18.333  46.076  56.202  1.00 25.19      A    N
ATOM   6262  CA   ARG C  87     -19.749  45.857  56.128  1.00 25.68      A    C
ATOM   6263  CB   ARG C  87     -20.373  46.992  55.400  1.00 24.10      A    C
ATOM   6264  CG   ARG C  87     -20.692  48.068  56.273  1.00 26.27      A    C
ATOM   6265  CD   ARG C  87     -21.301  49.139  55.518  1.00 32.12      A    C
ATOM   6266  NE   ARG C  87     -21.207  50.392  56.222  1.00 37.31      A    N
ATOM   6267  CZ   ARG C  87     -22.132  50.875  57.023  1.00 39.10      A    C
```

Appendix 1

```
ATOM   6268  NH1 ARG C  87     -23.248  50.225  57.231  1.00 39.06      A  N
ATOM   6269  NH2 ARG C  87     -21.930  52.016  57.598  1.00 38.36      A  N
ATOM   6270  C   ARG C  87     -20.154  44.576  55.480  1.00 26.09      A  C
ATOM   6271  O   ARG C  87     -21.219  44.093  55.654  1.00 26.28      A  O
ATOM   6272  N   VAL C  88     -19.272  44.061  54.675  1.00 27.16      A  N
ATOM   6273  CA  VAL C  88     -19.533  42.878  53.945  1.00 26.69      A  C
ATOM   6274  CB  VAL C  88     -19.036  43.083  52.513  1.00 26.99      A  C
ATOM   6275  CG1 VAL C  88     -18.898  41.830  51.802  1.00 24.56      A  C
ATOM   6276  CG2 VAL C  88     -19.958  43.963  51.832  1.00 25.95      A  C
ATOM   6277  C   VAL C  88     -18.974  41.645  54.616  1.00 26.37      A  C
ATOM   6278  O   VAL C  88     -19.234  40.583  54.200  1.00 27.34      A  O
ATOM   6279  N   ILE C  89     -18.206  41.813  55.665  1.00 25.32      A  N
ATOM   6280  CA  ILE C  89     -17.567  40.706  56.342  1.00 24.29      A  C
ATOM   6281  CB  ILE C  89     -16.580  41.150  57.412  1.00 23.63      A  C
ATOM   6282  CG1 ILE C  89     -15.445  41.942  56.836  1.00 23.64      A  C
ATOM   6283  CD1 ILE C  89     -14.575  42.549  57.841  1.00 19.00      A  C
ATOM   6284  CG2 ILE C  89     -15.952  40.015  58.043  1.00 22.49      A  C
ATOM   6285  C   ILE C  89     -18.556  39.715  56.939  1.00 24.98      A  C
ATOM   6286  O   ILE C  89     -18.318  38.558  56.939  1.00 26.84      A  O
ATOM   6287  N   LYS C  90     -19.678  40.184  57.434  1.00 24.18      A  N
ATOM   6288  CA  LYS C  90     -20.697  39.306  57.962  1.00 23.32      A  C
ATOM   6289  CB  LYS C  90     -21.824  40.113  58.588  1.00 22.95      A  C
ATOM   6290  CG  LYS C  90     -22.559  40.991  57.640  1.00 21.59      A  C
ATOM   6291  CD  LYS C  90     -23.672  41.703  58.283  1.00 21.11      A  C
ATOM   6292  CE  LYS C  90     -23.190  42.589  59.339  1.00 27.62      A  C
ATOM   6293  NZ  LYS C  90     -22.690  43.820  58.802  1.00 27.15      A  N
ATOM   6294  C   LYS C  90     -21.254  38.370  56.916  1.00 23.24      A  C
ATOM   6295  O   LYS C  90     -21.570  37.268  57.197  1.00 22.86      A  O
ATOM   6296  N   TYR C  91     -21.413  38.852  55.703  1.00 22.82      A  N
ATOM   6297  CA  TYR C  91     -21.839  38.042  54.594  1.00 22.09      A  C
ATOM   6298  CB  TYR C  91     -22.240  38.885  53.402  1.00 21.85      A  C
ATOM   6299  CG  TYR C  91     -23.277  39.877  53.743  1.00 21.56      A  C
ATOM   6300  CD1 TYR C  91     -24.528  39.493  54.069  1.00 20.98      A  C
ATOM   6301  CE1 TYR C  91     -25.441  40.377  54.408  1.00 22.54      A  C
ATOM   6302  CZ  TYR C  91     -25.121  41.673  54.421  1.00 31.18      A  C
ATOM   6303  OH  TYR C  91     -26.039  42.601  54.754  1.00 36.00      A  O
ATOM   6304  CE2 TYR C  91     -23.891  42.080  54.091  1.00 26.32      A  C
ATOM   6305  CD2 TYR C  91     -22.993  41.200  53.763  1.00 23.59      A  C
ATOM   6306  C   TYR C  91     -20.833  37.008  54.211  1.00 22.69      A  C
ATOM   6307  O   TYR C  91     -21.178  35.902  53.922  1.00 22.79      A  O
ATOM   6308  N   SER C  92     -19.574  37.381  54.218  1.00 22.51      A  N
ATOM   6309  CA  SER C  92     -18.534  36.464  53.857  1.00 21.90      A  C
ATOM   6310  CB  SER C  92     -17.220  37.195  53.890  1.00 22.25      A  C
ATOM   6311  OG  SER C  92     -16.151  36.339  53.737  1.00 18.63      A  O
ATOM   6312  C   SER C  92     -18.443  35.294  54.768  1.00 21.83      A  C
ATOM   6313  O   SER C  92     -18.368  34.210  54.320  1.00 23.05      A  O
ATOM   6314  N   ILE C  93     -18.438  35.537  56.056  1.00 21.73      A  N
ATOM   6315  CA  ILE C  93     -18.367  34.502  57.024  1.00 21.55      A  C
ATOM   6316  CB  ILE C  93     -18.291  35.068  58.447  1.00 21.41      A  C
ATOM   6317  CG1 ILE C  93     -17.039  35.871  58.669  1.00 22.18      A  C
ATOM   6318  CD1 ILE C  93     -17.038  36.643  59.960  1.00 18.42      A  C
ATOM   6319  CG2 ILE C  93     -18.327  33.990  59.414  1.00 19.43      A  C
ATOM   6320  C   ILE C  93     -19.573  33.617  56.951  1.00 21.53      A  C
ATOM   6321  O   ILE C  93     -19.446  32.442  57.023  1.00 22.64      A  O
```

Appendix 1

```
ATOM   6322  N    ALA C  94     -20.745  34.185  56.816  1.00 20.09      A  N
ATOM   6323  CA   ALA C  94     -21.929  33.395  56.664  1.00 22.17      A  C
ATOM   6324  CB   ALA C  94     -23.101  34.267  56.716  1.00 21.60      A  C
ATOM   6325  C    ALA C  94     -21.988  32.508  55.423  1.00 23.98      A  C
ATOM   6326  O    ALA C  94     -22.313  31.385  55.521  1.00 24.06      A  O
ATOM   6327  N    PHE C  95     -21.627  33.009  54.265  1.00 24.73      A  N
ATOM   6328  CA   PHE C  95     -21.521  32.205  53.074  1.00 24.81      A  C
ATOM   6329  CB   PHE C  95     -21.440  33.059  51.825  1.00 24.88      A  C
ATOM   6330  CG   PHE C  95     -22.628  33.900  51.615  1.00 29.45      A  C
ATOM   6331  CD1  PHE C  95     -23.871  33.371  51.639  1.00 32.98      A  C
ATOM   6332  CE1  PHE C  95     -24.953  34.152  51.469  1.00 34.75      A  C
ATOM   6333  CZ   PHE C  95     -24.810  35.457  51.279  1.00 33.90      A  C
ATOM   6334  CE2  PHE C  95     -23.597  35.989  51.225  1.00 33.98      A  C
ATOM   6335  CD2  PHE C  95     -22.509  35.227  51.395  1.00 31.53      A  C
ATOM   6336  C    PHE C  95     -20.474  31.113  53.100  1.00 24.81      A  C
ATOM   6337  O    PHE C  95     -20.663  30.089  52.524  1.00 25.40      A  O
ATOM   6338  N    TYR C  96     -19.364  31.343  53.760  1.00 24.89      A  N
ATOM   6339  CA   TYR C  96     -18.389  30.318  53.949  1.00 25.43      A  C
ATOM   6340  CB   TYR C  96     -17.183  30.838  54.689  1.00 25.06      A  C
ATOM   6341  CG   TYR C  96     -16.100  31.396  53.846  1.00 27.60      A  C
ATOM   6342  CD1  TYR C  96     -15.713  30.778  52.710  1.00 23.70      A  C
ATOM   6343  CE1  TYR C  96     -14.752  31.276  51.964  1.00 25.97      A  C
ATOM   6344  CZ   TYR C  96     -14.132  32.406  52.325  1.00 28.75      A  C
ATOM   6345  OH   TYR C  96     -13.161  32.886  51.526  1.00 26.14      A  O
ATOM   6346  CE2  TYR C  96     -14.497  33.056  53.447  1.00 28.83      A  C
ATOM   6347  CD2  TYR C  96     -15.462  32.553  54.199  1.00 27.69      A  C
ATOM   6348  C    TYR C  96     -19.032  29.253  54.776  1.00 25.04      A  C
ATOM   6349  O    TYR C  96     -18.780  28.113  54.581  1.00 24.80      A  O
ATOM   6350  N    ALA C  97     -19.830  29.661  55.742  1.00 24.03      A  N
ATOM   6351  CA   ALA C  97     -20.530  28.759  56.625  1.00 23.32      A  C
ATOM   6352  CB   ALA C  97     -21.159  29.534  57.758  1.00 21.77      A  C
ATOM   6353  C    ALA C  97     -21.555  27.850  55.979  1.00 22.88      A  C
ATOM   6354  O    ALA C  97     -21.611  26.715  56.293  1.00 21.58      A  O
ATOM   6355  N    TYR C  98     -22.383  28.381  55.096  1.00 23.32      A  N
ATOM   6356  CA   TYR C  98     -23.371  27.600  54.352  1.00 23.28      A  C
ATOM   6357  CB   TYR C  98     -24.385  28.482  53.615  1.00 22.87      A  C
ATOM   6358  CG   TYR C  98     -24.992  29.566  54.463  1.00 20.88      A  C
ATOM   6359  CD1  TYR C  98     -25.138  29.401  55.816  1.00 20.65      A  C
ATOM   6360  CE1  TYR C  98     -25.646  30.375  56.596  1.00 20.37      A  C
ATOM   6361  CZ   TYR C  98     -26.044  31.521  56.045  1.00 25.08      A  C
ATOM   6362  OH   TYR C  98     -26.557  32.479  56.831  1.00 23.18      A  O
ATOM   6363  CE2  TYR C  98     -25.929  31.709  54.702  1.00 22.38      A  C
ATOM   6364  CD2  TYR C  98     -25.411  30.745  53.923  1.00 17.77      A  C
ATOM   6365  C    TYR C  98     -22.721  26.579  53.444  1.00 24.67      A  C
ATOM   6366  O    TYR C  98     -23.194  25.498  53.296  1.00 25.04      A  O
ATOM   6367  N    GLY C  99     -21.612  26.934  52.842  1.00 24.01      A  N
ATOM   6368  CA   GLY C  99     -20.835  25.987  52.119  1.00 23.70      A  C
ATOM   6369  C    GLY C  99     -20.261  24.908  52.975  1.00 24.77      A  C
ATOM   6370  O    GLY C  99     -20.271  23.790  52.647  1.00 27.05      A  O
ATOM   6371  N    LEU C 100     -19.773  25.268  54.115  1.00 24.08      A  N
ATOM   6372  CA   LEU C 100     -19.157  24.325  54.976  1.00 24.08      A  C
ATOM   6373  CB   LEU C 100     -18.702  25.038  56.222  1.00 23.20      A  C
ATOM   6374  CG   LEU C 100     -17.241  25.271  56.459  1.00 21.52      A  C
ATOM   6375  CD1  LEU C 100     -16.454  24.868  55.336  1.00 18.02      A  C
```

Appendix 1

```
ATOM   6376  CD2  LEU C 100     -16.936  26.636  56.901  1.00 19.28      A    C
ATOM   6377  C    LEU C 100     -20.133  23.260  55.352  1.00 25.58      A    C
ATOM   6378  O    LEU C 100     -19.778  22.132  55.482  1.00 25.62      A    O
ATOM   6379  N    ALA C 101     -21.376  23.638  55.532  1.00 26.54      A    N
ATOM   6380  CA   ALA C 101     -22.417  22.715  55.845  1.00 26.53      A    C
ATOM   6381  CB   ALA C 101     -23.629  23.438  56.186  1.00 26.20      A    C
ATOM   6382  C    ALA C 101     -22.686  21.716  54.763  1.00 26.43      A    C
ATOM   6383  O    ALA C 101     -22.894  20.595  55.048  1.00 26.74      A    O
ATOM   6384  N    SER C 102     -22.700  22.123  53.523  1.00 25.57      A    N
ATOM   6385  CA   SER C 102     -22.831  21.189  52.434  1.00 26.10      A    C
ATOM   6386  CB   SER C 102     -23.032  21.884  51.126  1.00 26.00      A    C
ATOM   6387  OG   SER C 102     -24.370  22.131  50.957  1.00 27.89      A    O
ATOM   6388  C    SER C 102     -21.679  20.277  52.321  1.00 26.29      A    C
ATOM   6389  O    SER C 102     -21.832  19.143  52.117  1.00 26.57      A    O
ATOM   6390  N    VAL C 103     -20.505  20.793  52.525  1.00 26.51      A    N
ATOM   6391  CA   VAL C 103     -19.329  19.997  52.407  1.00 26.48      A    C
ATOM   6392  CB   VAL C 103     -18.073  20.831  52.666  1.00 27.39      A    C
ATOM   6393  CG1  VAL C 103     -16.931  19.988  53.061  1.00 27.39      A    C
ATOM   6394  CG2  VAL C 103     -17.712  21.597  51.494  1.00 24.46      A    C
ATOM   6395  C    VAL C 103     -19.471  18.858  53.383  1.00 27.18      A    C
ATOM   6396  O    VAL C 103     -19.028  17.782  53.136  1.00 27.97      A    O
ATOM   6397  N    ALA C 104     -20.100  19.117  54.500  1.00 28.72      A    N
ATOM   6398  CA   ALA C 104     -20.336  18.117  55.514  1.00 31.06      A    C
ATOM   6399  CB   ALA C 104     -20.845  18.748  56.738  1.00 30.90      A    C
ATOM   6400  C    ALA C 104     -21.262  17.006  55.077  1.00 31.78      A    C
ATOM   6401  O    ALA C 104     -21.119  15.888  55.468  1.00 31.18      A    O
ATOM   6402  N    LEU C 105     -22.265  17.379  54.317  1.00 32.58      A    N
ATOM   6403  CA   LEU C 105     -23.133  16.478  53.617  1.00 33.56      A    C
ATOM   6404  CB   LEU C 105     -24.252  17.273  53.020  1.00 32.97      A    C
ATOM   6405  CG   LEU C 105     -25.606  16.638  53.097  1.00 37.56      A    C
ATOM   6406  CD1  LEU C 105     -25.608  15.796  54.284  1.00 41.37      A    C
ATOM   6407  CD2  LEU C 105     -26.624  17.662  53.229  1.00 34.57      A    C
ATOM   6408  C    LEU C 105     -22.475  15.646  52.522  1.00 34.54      A    C
ATOM   6409  O    LEU C 105     -22.794  14.519  52.357  1.00 35.06      A    O
ATOM   6410  N    ILE C 106     -21.597  16.225  51.736  1.00 35.42      A    N
ATOM   6411  CA   ILE C 106     -20.920  15.500  50.700  1.00 37.12      A    C
ATOM   6412  CB   ILE C 106     -20.077  16.446  49.901  1.00 36.10      A    C
ATOM   6413  CG1  ILE C 106     -20.911  17.370  49.072  1.00 35.54      A    C
ATOM   6414  CD1  ILE C 106     -20.209  18.576  48.825  1.00 34.75      A    C
ATOM   6415  CG2  ILE C 106     -19.195  15.724  49.020  1.00 36.21      A    C
ATOM   6416  C    ILE C 106     -19.966  14.417  51.142  1.00 39.20      A    C
ATOM   6417  O    ILE C 106     -19.998  13.342  50.636  1.00 40.24      A    O
ATOM   6418  N    ASP C 107     -19.073  14.733  52.050  1.00 41.41      A    N
ATOM   6419  CA   ASP C 107     -18.056  13.814  52.441  1.00 42.85      A    C
ATOM   6420  CB   ASP C 107     -16.723  14.347  51.980  1.00 42.66      A    C
ATOM   6421  CG   ASP C 107     -15.640  13.322  52.023  1.00 47.94      A    C
ATOM   6422  OD1  ASP C 107     -15.768  12.330  52.736  1.00 48.65      A    O
ATOM   6423  OD2  ASP C 107     -14.642  13.507  51.330  1.00 51.08      A    O-1
ATOM   6424  C    ASP C 107     -18.023  13.632  53.931  1.00 43.52      A    C
ATOM   6425  O    ASP C 107     -17.670  14.517  54.639  1.00 42.84      A    O
ATOM   6426  N    PRO C 108     -18.334  12.441  54.395  1.00 44.30      A    N
ATOM   6427  CA   PRO C 108     -18.321  12.137  55.803  1.00 44.30      A    C
ATOM   6428  CB   PRO C 108     -18.695  10.661  55.812  1.00 43.86      A    C
ATOM   6429  CG   PRO C 108     -19.465  10.457  54.637  1.00 43.60      A    C
```

Appendix 1

```
ATOM   6430  CD   PRO C 108     -19.357  11.631  53.742  1.00 44.67      A  C
ATOM   6431  C    PRO C 108     -16.962  12.329  56.369  1.00 42.71      A  C
ATOM   6432  O    PRO C 108     -16.837  12.708  57.477  1.00 42.10      A  O
ATOM   6433  N    LYS C 109     -15.946  12.049  55.596  1.00 42.09      A  N
ATOM   6434  CA   LYS C 109     -14.593  12.192  56.068  1.00 41.47      A  C
ATOM   6435  CB   LYS C 109     -13.633  11.547  55.096  1.00 42.34      A  C
ATOM   6436  CG   LYS C 109     -13.087  10.236  55.562  1.00 46.11      A  C
ATOM   6437  CD   LYS C 109     -13.727   9.082  54.874  1.00 49.93      A  C
ATOM   6438  CE   LYS C 109     -12.911   8.653  53.706  1.00 53.34      A  C
ATOM   6439  NZ   LYS C 109     -13.308   7.344  53.188  1.00 51.90      A  N
ATOM   6440  C    LYS C 109     -14.220  13.637  56.378  1.00 39.41      A  C
ATOM   6441  O    LYS C 109     -13.324  13.893  57.129  1.00 39.60      A  O
ATOM   6442  N    LEU C 110     -14.934  14.581  55.805  1.00 36.61      A  N
ATOM   6443  CA   LEU C 110     -14.701  15.966  56.099  1.00 32.99      A  C
ATOM   6444  CB   LEU C 110     -14.663  16.776  54.821  1.00 32.39      A  C
ATOM   6445  CG   LEU C 110     -13.527  16.515  53.874  1.00 32.52      A  C
ATOM   6446  CD1  LEU C 110     -13.646  17.350  52.662  1.00 26.60      A  C
ATOM   6447  CD2  LEU C 110     -12.230  16.719  54.550  1.00 32.48      A  C
ATOM   6448  C    LEU C 110     -15.638  16.623  57.088  1.00 31.27      A  C
ATOM   6449  O    LEU C 110     -15.520  17.769  57.293  1.00 31.72      A  O
ATOM   6450  N    ARG C 111     -16.572  15.909  57.677  1.00 29.31      A  N
ATOM   6451  CA   ARG C 111     -17.523  16.528  58.584  1.00 27.40      A  C
ATOM   6452  CB   ARG C 111     -18.679  15.595  58.915  1.00 26.55      A  C
ATOM   6453  CG   ARG C 111     -19.844  16.217  59.581  1.00 23.13      A  C
ATOM   6454  CD   ARG C 111     -20.975  15.277  59.650  1.00 26.04      A  C
ATOM   6455  NE   ARG C 111     -22.185  15.833  60.217  1.00 28.06      A  N
ATOM   6456  CZ   ARG C 111     -23.332  15.193  60.275  1.00 29.03      A  C
ATOM   6457  NH1  ARG C 111     -23.434  14.007  59.796  1.00 30.46      A  N
ATOM   6458  NH2  ARG C 111     -24.380  15.753  60.781  1.00 27.05      A  N
ATOM   6459  C    ARG C 111     -16.918  17.105  59.835  1.00 27.30      A  C
ATOM   6460  O    ARG C 111     -17.347  18.107  60.300  1.00 27.45      A  O
ATOM   6461  N    ALA C 112     -15.935  16.458  60.409  1.00 27.17      A  N
ATOM   6462  CA   ALA C 112     -15.335  16.984  61.607  1.00 26.67      A  C
ATOM   6463  CB   ALA C 112     -14.328  16.054  62.120  1.00 25.92      A  C
ATOM   6464  C    ALA C 112     -14.691  18.288  61.331  1.00 26.70      A  C
ATOM   6465  O    ALA C 112     -14.824  19.216  62.075  1.00 25.67      A  O
ATOM   6466  N    LEU C 113     -13.959  18.336  60.246  1.00 26.55      A  N
ATOM   6467  CA   LEU C 113     -13.306  19.531  59.852  1.00 27.54      A  C
ATOM   6468  CB   LEU C 113     -12.420  19.236  58.677  1.00 27.58      A  C
ATOM   6469  CG   LEU C 113     -11.830  20.437  58.005  1.00 28.06      A  C
ATOM   6470  CD1  LEU C 113     -10.764  21.030  58.762  1.00 28.20      A  C
ATOM   6471  CD2  LEU C 113     -11.371  20.057  56.725  1.00 31.67      A  C
ATOM   6472  C    LEU C 113     -14.267  20.642  59.537  1.00 27.89      A  C
ATOM   6473  O    LEU C 113     -14.100  21.746  59.957  1.00 28.11      A  O
ATOM   6474  N    ALA C 114     -15.320  20.332  58.841  1.00 27.05      A  N
ATOM   6475  CA   ALA C 114     -16.345  21.309  58.658  1.00 27.92      A  C
ATOM   6476  CB   ALA C 114     -17.368  20.775  57.769  1.00 28.04      A  C
ATOM   6477  C    ALA C 114     -16.982  21.776  59.963  1.00 28.92      A  C
ATOM   6478  O    ALA C 114     -17.278  22.908  60.104  1.00 29.91      A  O
ATOM   6479  N    GLY C 115     -17.216  20.900  60.907  1.00 28.21      A  N
ATOM   6480  CA   GLY C 115     -17.765  21.327  62.153  1.00 28.20      A  C
ATOM   6481  C    GLY C 115     -16.825  22.257  62.835  1.00 28.72      A  C
ATOM   6482  O    GLY C 115     -17.198  23.153  63.511  1.00 29.41      A  O
ATOM   6483  N    HIS C 116     -15.564  21.982  62.708  1.00 28.82      A  N
```

Appendix 1

```
ATOM   6484  CA   HIS C 116     -14.596  22.854  63.286  1.00  28.03      A    C
ATOM   6485  CB   HIS C 116     -13.258  22.187  63.219  1.00  27.30      A    C
ATOM   6486  CG   HIS C 116     -12.127  23.106  63.454  1.00  30.16      A    C
ATOM   6487  ND1  HIS C 116     -11.838  23.609  64.689  1.00  33.64      A    N
ATOM   6488  CE1  HIS C 116     -10.792  24.390  64.605  1.00  31.63      A    C
ATOM   6489  NE2  HIS C 116     -10.388  24.403  63.359  1.00  34.88      A    N
ATOM   6490  CD2  HIS C 116     -11.205  23.605  62.619  1.00  30.30      A    C
ATOM   6491  C    HIS C 116     -14.566  24.250  62.663  1.00  27.56      A    C
ATOM   6492  O    HIS C 116     -14.508  25.220  63.344  1.00  27.03      A    O
ATOM   6493  N    ASP C 117     -14.637  24.344  61.355  1.00  26.20      A    N
ATOM   6494  CA   ASP C 117     -14.647  25.627  60.686  1.00  25.82      A    C
ATOM   6495  CB   ASP C 117     -14.574  25.454  59.181  1.00  25.75      A    C
ATOM   6496  CG   ASP C 117     -13.247  25.110  58.715  1.00  27.32      A    C
ATOM   6497  OD1  ASP C 117     -12.297  25.157  59.451  1.00  26.19      A    O
ATOM   6498  OD2  ASP C 117     -13.142  24.766  57.584  1.00  29.95      A    O-1
ATOM   6499  C    ASP C 117     -15.863  26.442  61.027  1.00  25.35      A    C
ATOM   6500  O    ASP C 117     -15.823  27.633  61.101  1.00  23.41      A    O
ATOM   6501  N    LEU C 118     -16.950  25.728  61.184  1.00  25.74      A    N
ATOM   6502  CA   LEU C 118     -18.217  26.225  61.568  1.00  27.73      A    C
ATOM   6503  CB   LEU C 118     -19.239  25.115  61.450  1.00  27.85      A    C
ATOM   6504  CG   LEU C 118     -20.360  25.344  60.451  1.00  30.70      A    C
ATOM   6505  CD1  LEU C 118     -20.023  26.440  59.558  1.00  30.03      A    C
ATOM   6506  CD2  LEU C 118     -20.763  24.136  59.671  1.00  26.40      A    C
ATOM   6507  C    LEU C 118     -18.160  26.830  62.959  1.00  28.32      A    C
ATOM   6508  O    LEU C 118     -18.778  27.810  63.216  1.00  29.67      A    O
ATOM   6509  N    ASP C 119     -17.395  26.241  63.847  1.00  27.47      A    N
ATOM   6510  CA   ASP C 119     -17.138  26.780  65.156  1.00  27.59      A    C
ATOM   6511  CB   ASP C 119     -16.277  25.754  65.843  1.00  29.47      A    C
ATOM   6512  CG   ASP C 119     -16.294  25.852  67.308  1.00  32.89      A    C
ATOM   6513  OD1  ASP C 119     -16.818  26.796  67.862  1.00  35.54      A    O
ATOM   6514  OD2  ASP C 119     -15.770  24.941  67.903  1.00  37.57      A    O-1
ATOM   6515  C    ASP C 119     -16.399  28.108  65.120  1.00  26.90      A    C
ATOM   6516  O    ASP C 119     -16.711  29.003  65.833  1.00  25.51      A    O
ATOM   6517  N    ILE C 120     -15.389  28.182  64.288  1.00  24.18      A    N
ATOM   6518  CA   ILE C 120     -14.628  29.372  64.078  1.00  23.55      A    C
ATOM   6519  CB   ILE C 120     -13.388  29.082  63.276  1.00  23.28      A    C
ATOM   6520  CG1  ILE C 120     -12.334  28.497  64.166  1.00  21.90      A    C
ATOM   6521  CD1  ILE C 120     -11.389  27.655  63.484  1.00  22.28      A    C
ATOM   6522  CG2  ILE C 120     -12.866  30.287  62.692  1.00  22.84      A    C
ATOM   6523  C    ILE C 120     -15.433  30.478  63.461  1.00  24.81      A    C
ATOM   6524  O    ILE C 120     -15.250  31.622  63.789  1.00  25.07      A    O
ATOM   6525  N    ALA C 121     -16.311  30.119  62.545  1.00  24.54      A    N
ATOM   6526  CA   ALA C 121     -17.178  31.057  61.876  1.00  24.04      A    C
ATOM   6527  CB   ALA C 121     -17.927  30.378  60.800  1.00  24.45      A    C
ATOM   6528  C    ALA C 121     -18.130  31.734  62.802  1.00  24.25      A    C
ATOM   6529  O    ALA C 121     -18.338  32.899  62.693  1.00  24.03      A    O
ATOM   6530  N    VAL C 122     -18.717  30.987  63.712  1.00  24.24      A    N
ATOM   6531  CA   VAL C 122     -19.528  31.557  64.765  1.00  23.93      A    C
ATOM   6532  CB   VAL C 122     -20.236  30.470  65.589  1.00  23.09      A    C
ATOM   6533  CG1  VAL C 122     -21.003  31.038  66.659  1.00  20.80      A    C
ATOM   6534  CG2  VAL C 122     -21.110  29.709  64.773  1.00  20.63      A    C
ATOM   6535  C    VAL C 122     -18.743  32.460  65.694  1.00  25.58      A    C
ATOM   6536  O    VAL C 122     -19.206  33.492  66.028  1.00  26.86      A    O
ATOM   6537  N    SER C 123     -17.550  32.086  66.097  1.00  26.35      A    N
```

Appendix 1

```
ATOM   6538  CA  SER C 123     -16.797  32.965  66.947  1.00 26.93      A    C
ATOM   6539  CB  SER C 123     -15.542  32.351  67.524  1.00 26.49      A    C
ATOM   6540  OG  SER C 123     -15.595  30.982  67.638  1.00 31.21      A    O
ATOM   6541  C   SER C 123     -16.429  34.239  66.288  1.00 27.87      A    C
ATOM   6542  O   SER C 123     -16.506  35.246  66.892  1.00 29.29      A    O
ATOM   6543  N   LYS C 124     -16.006  34.196  65.046  1.00 28.38      A    N
ATOM   6544  CA  LYS C 124     -15.667  35.403  64.327  1.00 28.57      A    C
ATOM   6545  CB  LYS C 124     -14.929  35.120  63.041  1.00 28.40      A    C
ATOM   6546  CG  LYS C 124     -13.640  34.425  63.256  1.00 28.84      A    C
ATOM   6547  CD  LYS C 124     -12.660  34.711  62.208  1.00 25.91      A    C
ATOM   6548  CE  LYS C 124     -11.418  34.089  62.585  1.00 30.66      A    C
ATOM   6549  NZ  LYS C 124     -10.351  35.017  62.764  1.00 28.11      A    N
ATOM   6550  C   LYS C 124     -16.827  36.314  64.103  1.00 27.72      A    C
ATOM   6551  O   LYS C 124     -16.688  37.490  64.160  1.00 28.22      A    O
ATOM   6552  N   MET C 125     -17.982  35.735  63.860  1.00 27.73      A    N
ATOM   6553  CA  MET C 125     -19.212  36.439  63.575  1.00 27.25      A    C
ATOM   6554  CB  MET C 125     -20.316  35.427  63.302  1.00 26.73      C    C
ATOM   6555  CG  MET C 125     -21.561  35.948  62.620  1.00 29.25      C    C
ATOM   6556  SD  MET C 125     -21.348  36.643  61.022  1.00 27.16      C    S
ATOM   6557  CE  MET C 125     -22.958  36.691  60.444  1.00 28.59      C    C
ATOM   6558  C   MET C 125     -19.586  37.310  64.727  1.00 26.10      A    C
ATOM   6559  O   MET C 125     -20.167  38.336  64.564  1.00 24.27      A    O
ATOM   6560  N   LYS C 126     -19.254  36.835  65.905  1.00 25.99      A    N
ATOM   6561  CA  LYS C 126     -19.465  37.527  67.158  1.00 28.12      A    C
ATOM   6562  CB  LYS C 126     -19.498  36.560  68.322  1.00 27.81      A    C
ATOM   6563  CG  LYS C 126     -20.834  35.941  68.552  1.00 29.21      A    C
ATOM   6564  CD  LYS C 126     -20.717  34.597  69.178  1.00 33.77      A    C
ATOM   6565  CE  LYS C 126     -21.030  34.608  70.621  1.00 34.76      A    C
ATOM   6566  NZ  LYS C 126     -21.845  33.468  71.075  1.00 40.77      A    N
ATOM   6567  C   LYS C 126     -18.541  38.660  67.424  1.00 28.65      A    C
ATOM   6568  O   LYS C 126     -18.824  39.491  68.216  1.00 28.32      A    O
ATOM   6569  N   CYS C 127     -17.429  38.695  66.736  1.00 29.42      A    N
ATOM   6570  CA  CYS C 127     -16.517  39.775  66.892  1.00 30.57      A    C
ATOM   6571  CB  CYS C 127     -15.201  39.456  66.240  1.00 31.03      A    C
ATOM   6572  SG  CYS C 127     -14.395  38.107  66.879  1.00 36.12      A    S
ATOM   6573  C   CYS C 127     -17.073  41.060  66.371  1.00 30.61      A    C
ATOM   6574  O   CYS C 127     -17.731  41.094  65.388  1.00 30.43      A    O
ATOM   6575  N   LYS C 128     -16.750  42.119  67.079  1.00 31.10      A    N
ATOM   6576  CA  LYS C 128     -17.294  43.443  66.889  1.00 31.42      A    C
ATOM   6577  CB  LYS C 128     -16.985  44.313  68.098  1.00 31.78      A    C
ATOM   6578  CG  LYS C 128     -17.373  45.721  67.921  1.00 33.33      A    C
ATOM   6579  CD  LYS C 128     -17.505  46.431  69.187  1.00 35.44      A    C
ATOM   6580  CE  LYS C 128     -18.272  47.688  69.996  1.00 36.96      A    C
ATOM   6581  NZ  LYS C 128     -18.063  48.695  70.046  1.00 38.57      A    N
ATOM   6582  C   LYS C 128     -16.858  44.112  65.615  1.00 30.47      A    C
ATOM   6583  O   LYS C 128     -17.435  45.065  65.194  1.00 30.29      A    O
ATOM   6584  N   ARG C 129     -15.797  43.611  65.029  1.00 30.47      A    N
ATOM   6585  CA  ARG C 129     -15.363  44.051  63.739  1.00 29.74      A    C
ATOM   6586  CB  ARG C 129     -14.030  43.410  63.417  1.00 30.67      A    C
ATOM   6587  CG  ARG C 129     -13.517  43.537  62.039  1.00 34.55      A    C
ATOM   6588  CD  ARG C 129     -13.304  44.950  61.630  1.00 40.35      A    C
ATOM   6589  NE  ARG C 129     -12.892  45.014  60.243  1.00 46.31      A    N
ATOM   6590  CZ  ARG C 129     -12.612  46.110  59.575  1.00 47.42      A    C
ATOM   6591  NH1 ARG C 129     -12.685  47.288  60.139  1.00 45.08      A    N
```

Appendix 1

```
ATOM   6592  NH2 ARG C 129     -12.256  46.015  58.324  1.00 45.33           A  N
ATOM   6593  C   ARG C 129     -16.412  43.688  62.741  1.00 29.37           A  C
ATOM   6594  O   ARG C 129     -16.683  44.417  61.855  1.00 29.13           A  O
ATOM   6595  N   VAL C 130     -16.961  42.511  62.869  1.00 28.32           A  N
ATOM   6596  CA  VAL C 130     -18.060  42.099  62.065  1.00 26.84           A  C
ATOM   6597  CB  VAL C 130     -18.265  40.617  62.211  1.00 26.49           A  C
ATOM   6598  CG1 VAL C 130     -19.315  40.177  61.355  1.00 25.87           A  C
ATOM   6599  CG2 VAL C 130     -17.052  39.928  61.915  1.00 24.89           A  C
ATOM   6600  C   VAL C 130     -19.376  42.801  62.285  1.00 26.84           A  C
ATOM   6601  O   VAL C 130     -19.974  43.223  61.353  1.00 27.07           A  O
ATOM   6602  N   TRP C 131     -19.839  42.927  63.507  1.00 26.00           A  N
ATOM   6603  CA  TRP C 131     -21.104  43.587  63.768  1.00 26.44           A  C
ATOM   6604  CB  TRP C 131     -21.904  42.824  64.809  1.00 26.86           A  C
ATOM   6605  CG  TRP C 131     -21.273  42.761  66.131  1.00 29.59           A  C
ATOM   6606  CD1 TRP C 131     -20.575  41.758  66.611  1.00 31.92           A  C
ATOM   6607  NE1 TRP C 131     -20.142  42.026  67.853  1.00 36.55           A  N
ATOM   6608  CE2 TRP C 131     -20.558  43.270  68.201  1.00 32.60           A  C
ATOM   6609  CD2 TRP C 131     -21.284  43.759  67.146  1.00 29.79           A  C
ATOM   6610  CE3 TRP C 131     -21.849  45.020  67.260  1.00 30.42           A  C
ATOM   6611  CZ3 TRP C 131     -21.662  45.712  68.383  1.00 32.76           A  C
ATOM   6612  CH2 TRP C 131     -20.938  45.196  69.424  1.00 32.31           A  C
ATOM   6613  CZ2 TRP C 131     -20.384  43.971  69.354  1.00 31.95           A  C
ATOM   6614  C   TRP C 131     -21.038  45.059  64.135  1.00 27.44           A  C
ATOM   6615  O   TRP C 131     -22.017  45.680  64.356  1.00 29.79           A  O
ATOM   6616  N   GLY C 132     -19.868  45.634  64.150  1.00 28.59           A  N
ATOM   6617  CA  GLY C 132     -19.696  46.979  64.628  1.00 29.35           A  C
ATOM   6618  C   GLY C 132     -20.372  48.082  63.895  1.00 30.32           A  C
ATOM   6619  O   GLY C 132     -20.515  49.137  64.408  1.00 30.07           A  O
ATOM   6620  N   ASP C 133     -20.786  47.817  62.678  1.00 31.89           A  N
ATOM   6621  CA  ASP C 133     -21.348  48.850  61.874  1.00 32.52           A  C
ATOM   6622  CB  ASP C 133     -21.586  48.429  60.413  1.00 33.61           A  C
ATOM   6623  CG  ASP C 133     -22.293  47.130  60.262  1.00 34.81           A  C
ATOM   6624  OD1 ASP C 133     -23.438  47.133  59.851  1.00 35.48           A  O
ATOM   6625  OD2 ASP C 133     -21.720  46.092  60.459  1.00 37.16           A  O-1
ATOM   6626  C   ASP C 133     -22.561  49.381  62.577  1.00 32.63           A  C
ATOM   6627  O   ASP C 133     -22.796  50.532  62.554  1.00 31.82           A  O
ATOM   6628  N   TRP C 134     -23.278  48.528  63.270  1.00 32.89           A  N
ATOM   6629  CA  TRP C 134     -24.507  48.895  63.929  1.00 33.58           A  C
ATOM   6630  CB  TRP C 134     -25.058  47.639  64.568  1.00 34.01           A  C
ATOM   6631  CG  TRP C 134     -26.355  47.747  65.230  1.00 34.95           A  C
ATOM   6632  CD1 TRP C 134     -26.583  47.761  66.535  1.00 33.70           A  C
ATOM   6633  NE1 TRP C 134     -27.891  47.852  66.784  1.00 32.53           A  N
ATOM   6634  CE2 TRP C 134     -28.556  47.886  65.603  1.00 31.34           A  C
ATOM   6635  CD2 TRP C 134     -27.610  47.808  64.607  1.00 35.20           A  C
ATOM   6636  CE3 TRP C 134     -28.029  47.822  63.290  1.00 32.88           A  C
ATOM   6637  CZ3 TRP C 134     -29.335  47.902  63.032  1.00 31.37           A  C
ATOM   6638  CH2 TRP C 134     -30.259  47.979  64.037  1.00 33.51           A  C
ATOM   6639  CZ2 TRP C 134     -29.893  47.972  65.334  1.00 32.64           A  C
ATOM   6640  C   TRP C 134     -24.333  49.955  64.974  1.00 33.98           A  C
ATOM   6641  O   TRP C 134     -25.099  50.865  65.031  1.00 33.57           A  O
ATOM   6642  N   GLU C 135     -23.310  49.850  65.800  1.00 35.36           A  N
ATOM   6643  CA  GLU C 135     -23.005  50.885  66.756  1.00 36.74           A  C
ATOM   6644  CB  GLU C 135     -21.904  50.417  67.677  1.00 37.78           A  C
ATOM   6645  CG  GLU C 135     -22.248  50.533  69.094  1.00 42.10           A  C
```

Appendix 1

```
ATOM   6646  CD   GLU C 135     -21.083  50.839  69.929  1.00 46.42      A  C
ATOM   6647  OE1  GLU C 135     -20.477  49.920  70.454  1.00 48.15      A  O
ATOM   6648  OE2  GLU C 135     -20.780  52.002  70.083  1.00 51.45      A  O-1
ATOM   6649  C    GLU C 135     -22.596  52.163  66.105  1.00 36.87      A  C
ATOM   6650  O    GLU C 135     -23.006  53.212  66.499  1.00 36.85      A  O
ATOM   6651  N    GLU C 136     -21.767  52.051  65.099  1.00 37.91      A  N
ATOM   6652  CA   GLU C 136     -21.228  53.174  64.367  1.00 39.30      A  C
ATOM   6653  CB   GLU C 136     -20.230  52.653  63.398  1.00 40.93      A  C
ATOM   6654  CG   GLU C 136     -18.854  53.003  63.696  1.00 48.56      A  C
ATOM   6655  CD   GLU C 136     -18.013  52.817  62.500  1.00 59.90      A  C
ATOM   6656  OE1  GLU C 136     -18.209  51.307  61.804  1.00 61.59      A  O
ATOM   6657  OE2  GLU C 136     -17.181  53.690  62.229  1.00 63.73      A  O-1
ATOM   6658  C    GLU C 136     -22.228  54.045  63.620  1.00 38.49      A  C
ATOM   6659  O    GLU C 136     -22.083  55.226  63.522  1.00 39.16      A  O
ATOM   6660  N    ASP C 137     -23.274  53.443  63.129  1.00 36.86      A  N
ATOM   6661  CA   ASP C 137     -24.270  54.169  62.432  1.00 35.71      A  C
ATOM   6662  CB   ASP C 137     -24.996  53.256  61.488  1.00 35.93      A  C
ATOM   6663  CG   ASP C 137     -24.155  52.849  60.331  1.00 37.85      A  C
ATOM   6664  OD1  ASP C 137     -23.091  53.431  60.161  1.00 35.72      A  O
ATOM   6665  OD2  ASP C 137     -24.551  51.956  59.592  1.00 35.84      A  O-1
ATOM   6666  C    ASP C 137     -25.204  54.739  63.433  1.00 35.25      A  C
ATOM   6667  O    ASP C 137     -26.144  55.378  63.084  1.00 34.20      A  O
ATOM   6668  N    GLY C 138     -24.912  54.524  64.698  1.00 35.07      A  N
ATOM   6669  CA   GLY C 138     -25.709  55.078  65.760  1.00 35.90      A  C
ATOM   6670  C    GLY C 138     -26.996  54.350  66.055  1.00 36.78      A  C
ATOM   6671  O    GLY C 138     -27.882  54.887  66.658  1.00 35.38      A  O
ATOM   6672  N    PHE C 139     -27.107  53.144  65.550  1.00 37.30      A  N
ATOM   6673  CA   PHE C 139     -28.209  52.258  65.836  1.00 38.04      A  C
ATOM   6674  CB   PHE C 139     -28.344  51.206  64.755  1.00 38.05      A  C
ATOM   6675  CG   PHE C 139     -28.633  51.768  63.423  1.00 37.26      A  C
ATOM   6676  CD1  PHE C 139     -29.513  52.773  63.281  1.00 35.59      A  C
ATOM   6677  CE1  PHE C 139     -29.760  53.283  62.076  1.00 38.22      A  C
ATOM   6678  CZ   PHE C 139     -29.128  52.807  61.007  1.00 36.58      A  C
ATOM   6679  CE2  PHE C 139     -28.254  51.827  61.127  1.00 36.26      A  C
ATOM   6680  CD2  PHE C 139     -28.004  51.304  62.314  1.00 36.33      A  C
ATOM   6681  C    PHE C 139     -28.325  51.660  67.214  1.00 38.85      A  C
ATOM   6682  O    PHE C 139     -29.377  51.470  67.666  1.00 40.65      A  O
ATOM   6683  N    GLY C 140     -27.247  51.337  67.873  1.00 39.75      A  N
ATOM   6684  CA   GLY C 140     -27.342  50.840  69.218  1.00 40.04      A  C
ATOM   6685  C    GLY C 140     -26.074  50.146  69.599  1.00 41.22      A  C
ATOM   6686  O    GLY C 140     -25.234  49.970  68.779  1.00 42.04      A  O
ATOM   6687  N    THR C 141     -25.926  49.750  70.845  1.00 40.58      A  N
ATOM   6688  CA   THR C 141     -24.702  49.093  71.232  1.00 39.76      A  C
ATOM   6689  CB   THR C 141     -24.260  49.486  72.612  1.00 39.67      A  C
ATOM   6690  OG1  THR C 141     -25.351  49.374  73.506  1.00 39.83      A  O
ATOM   6691  CG2  THR C 141     -23.848  50.871  72.597  1.00 39.19      A  C
ATOM   6692  C    THR C 141     -24.764  47.611  71.139  1.00 39.35      A  C
ATOM   6693  O    THR C 141     -23.769  46.961  71.226  1.00 39.83      A  O
ATOM   6694  N    ASP C 142     -25.950  47.081  70.955  1.00 39.08      A  N
ATOM   6695  CA   ASP C 142     -26.117  45.672  70.913  1.00 39.20      A  C
ATOM   6696  CB   ASP C 142     -27.044  45.295  72.028  1.00 40.42      A  C
ATOM   6697  CG   ASP C 142     -27.148  43.843  72.225  1.00 43.50      A  C
ATOM   6698  OD1  ASP C 142     -26.468  43.309  73.088  1.00 48.56      A  O
ATOM   6699  OD2  ASP C 142     -27.928  43.242  71.532  1.00 42.46      A  O-1
```

Appendix 1

```
ATOM   6700  C    ASP C 142     -26.682  45.224  69.591  1.00 39.41      A  C
ATOM   6701  O    ASP C 142     -27.702  45.676  69.174  1.00 38.94      A  O
ATOM   6702  N    PRO C 143     -25.970  44.338  68.930  1.00 40.01      A  N
ATOM   6703  CA   PRO C 143     -26.336  43.782  67.638  1.00 39.82      A  C
ATOM   6704  CB   PRO C 143     -25.121  42.954  67.286  1.00 39.94      A  C
ATOM   6705  CG   PRO C 143     -24.507  42.665  68.512  1.00 40.11      A  C
ATOM   6706  CD   PRO C 143     -24.669  43.834  69.350  1.00 39.58      A  C
ATOM   6707  C    PRO C 143     -27.578  42.935  67.586  1.00 39.89      A  C
ATOM   6708  O    PRO C 143     -28.178  42.890  66.581  1.00 41.34      A  O
ATOM   6709  N    ILE C 144     -27.943  42.227  68.618  1.00 39.78      A  N
ATOM   6710  CA   ILE C 144     -29.100  41.394  68.492  1.00 39.16      A  C
ATOM   6711  CB   ILE C 144     -28.821  40.032  69.031  1.00 39.28      A  C
ATOM   6712  CG1  ILE C 144     -28.604  40.119  70.520  1.00 38.48      A  C
ATOM   6713  CD1  ILE C 144     -28.342  38.859  71.116  1.00 38.35      A  C
ATOM   6714  CG2  ILE C 144     -27.615  39.474  68.380  1.00 37.93      A  C
ATOM   6715  C    ILE C 144     -30.368  41.854  69.139  1.00 39.44      A  C
ATOM   6716  O    ILE C 144     -31.326  41.189  69.055  1.00 39.01      A  O
ATOM   6717  N    GLU C 145     -30.372  42.968  69.823  1.00 41.08      A  N
ATOM   6718  CA   GLU C 145     -31.524  43.338  70.622  1.00 41.67      A  C
ATOM   6719  CB   GLU C 145     -31.163  44.589  71.407  1.00 42.67      A  C
ATOM   6720  CG   GLU C 145     -32.212  45.155  72.318  1.00 47.93      A  C
ATOM   6721  CD   GLU C 145     -31.678  46.272  73.182  1.00 55.34      A  C
ATOM   6722  OE1  GLU C 145     -31.056  45.997  74.201  1.00 57.64      A  O
ATOM   6723  OE2  GLU C 145     -31.872  47.435  72.854  1.00 56.26      A  O-1
ATOM   6724  C    GLU C 145     -32.767  43.579  69.821  1.00 40.86      A  C
ATOM   6725  O    GLU C 145     -33.810  43.075  70.117  1.00 41.06      A  O
ATOM   6726  N    LYS C 146     -32.667  44.395  68.808  1.00 40.14      A  N
ATOM   6727  CA   LYS C 146     -33.782  44.575  67.925  1.00 40.47      A  C
ATOM   6728  CB   LYS C 146     -34.718  45.654  68.411  1.00 40.43      A  C
ATOM   6729  CG   LYS C 146     -34.045  46.820  68.965  1.00 40.70      A  C
ATOM   6730  CD   LYS C 146     -34.993  47.893  69.170  1.00 45.88      A  C
ATOM   6731  CE   LYS C 146     -34.356  49.201  68.951  1.00 51.89      A  C
ATOM   6732  NZ   LYS C 146     -35.246  50.286  69.387  1.00 55.12      A  N
ATOM   6733  C    LYS C 146     -33.282  44.929  66.574  1.00 39.79      A  C
ATOM   6734  O    LYS C 146     -32.217  45.445  66.448  1.00 39.33      A  O
ATOM   6735  N    GLU C 147     -34.068  44.596  65.570  1.00 38.71      A  N
ATOM   6736  CA   GLU C 147     -33.784  44.914  64.211  1.00 37.40      A  C
ATOM   6737  CB   GLU C 147     -33.701  46.400  64.066  1.00 38.68      A  C
ATOM   6738  CG   GLU C 147     -34.473  47.113  65.128  1.00 41.64      A  C
ATOM   6739  CD   GLU C 147     -35.029  48.441  64.695  1.00 46.14      A  C
ATOM   6740  OE1  GLU C 147     -34.271  49.304  64.286  1.00 48.60      A  O
ATOM   6741  OE2  GLU C 147     -36.236  48.627  64.768  1.00 47.70      A  O-1
ATOM   6742  C    GLU C 147     -32.526  44.199  63.776  1.00 35.39      A  C
ATOM   6743  O    GLU C 147     -32.170  43.217  64.341  1.00 34.79      A  O
ATOM   6744  N    ASN C 148     -31.851  44.682  62.765  1.00 32.93      A  N
ATOM   6745  CA   ASN C 148     -30.632  44.063  62.353  1.00 31.10      A  C
ATOM   6746  CB   ASN C 148     -29.600  44.238  63.447  1.00 30.77      A  C
ATOM   6747  CG   ASN C 148     -28.212  44.293  62.931  1.00 28.22      A  C
ATOM   6748  OD1  ASN C 148     -28.001  44.464  61.784  1.00 31.32      A  O
ATOM   6749  ND2  ASN C 148     -27.273  44.150  63.779  1.00 22.13      A  N
ATOM   6750  C    ASN C 148     -30.689  42.600  61.965  1.00 31.94      A  C
ATOM   6751  O    ASN C 148     -29.792  41.893  62.303  1.00 31.17      A  O
ATOM   6752  N    ILE C 149     -31.697  42.140  61.239  1.00 31.71      A  N
ATOM   6753  CA   ILE C 149     -31.708  40.743  60.844  1.00 33.03      A  C
```

Appendix 1

```
ATOM   6754  CB   ILE C 149     -33.040  40.169  60.363  1.00 34.64      A   C
ATOM   6755  CG1  ILE C 149     -33.874  41.206  59.648  1.00 35.04      A   C
ATOM   6756  CD1  ILE C 149     -33.492  41.433  58.280  1.00 36.52      A   C
ATOM   6757  CG2  ILE C 149     -33.762  39.483  61.493  1.00 34.29      A   C
ATOM   6758  C    ILE C 149     -30.701  40.463  59.787  1.00 33.24      A   C
ATOM   6759  O    ILE C 149     -30.430  39.347  59.483  1.00 33.14      A   O
ATOM   6760  N    MET C 150     -30.162  41.506  59.219  1.00 33.84      A   N
ATOM   6761  CA   MET C 150     -29.094  41.321  58.320  1.00 36.01      A   C
ATOM   6762  CB   MET C 150     -28.723  42.651  57.682  1.00 38.54      C   C
ATOM   6763  CG   MET C 150     -27.756  43.550  58.397  1.00 43.64      C   C
ATOM   6764  SD   MET C 150     -27.911  45.282  57.954  1.00 52.82      C   S
ATOM   6765  CE   MET C 150     -26.981  45.386  56.479  1.00 51.69      C   C
ATOM   6766  C    MET C 150     -27.947  40.737  59.037  1.00 34.66      A   C
ATOM   6767  O    MET C 150     -27.343  39.842  58.573  1.00 35.08      A   O
ATOM   6768  N    TYR C 151     -27.678  41.179  60.239  1.00 34.06      A   N
ATOM   6769  CA   TYR C 151     -26.676  40.488  60.976  1.00 31.76      A   C
ATOM   6770  CB   TYR C 151     -25.964  41.432  61.907  1.00 30.21      A   C
ATOM   6771  CG   TYR C 151     -25.037  40.740  62.836  1.00 32.86      A   C
ATOM   6772  CD1  TYR C 151     -23.856  40.210  62.387  1.00 31.26      A   C
ATOM   6773  CE1  TYR C 151     -23.046  39.588  63.211  1.00 28.06      A   C
ATOM   6774  CZ   TYR C 151     -23.384  39.470  64.503  1.00 25.71      A   C
ATOM   6775  OH   TYR C 151     -22.556  38.850  65.357  1.00 24.35      A   O
ATOM   6776  CE2  TYR C 151     -24.529  39.983  64.965  1.00 25.18      A   C
ATOM   6777  CD2  TYR C 151     -25.347  40.592  64.153  1.00 26.33      A   C
ATOM   6778  C    TYR C 151     -27.179  39.287  61.738  1.00 30.60      A   C
ATOM   6779  O    TYR C 151     -26.637  38.245  61.645  1.00 30.75      A   O
ATOM   6780  N    LYS C 152     -28.204  39.463  62.524  1.00 29.86      A   N
ATOM   6781  CA   LYS C 152     -28.684  38.433  63.411  1.00 29.15      A   C
ATOM   6782  CB   LYS C 152     -29.432  39.039  64.582  1.00 29.41      A   C
ATOM   6783  CG   LYS C 152     -30.789  39.404  64.339  1.00 29.02      A   C
ATOM   6784  CD   LYS C 152     -31.177  40.401  65.346  1.00 29.97      A   C
ATOM   6785  CE   LYS C 152     -32.534  40.113  65.832  1.00 31.17      A   C
ATOM   6786  NZ   LYS C 152     -33.244  41.277  66.268  1.00 32.45      A   N
ATOM   6787  C    LYS C 152     -29.314  37.174  62.831  1.00 27.77      A   C
ATOM   6788  O    LYS C 152     -29.233  36.136  63.401  1.00 28.14      A   O
ATOM   6789  N    GLY C 153     -29.970  37.296  61.706  1.00 26.21      A   N
ATOM   6790  CA   GLY C 153     -30.442  36.158  60.970  1.00 23.20      A   C
ATOM   6791  C    GLY C 153     -29.347  35.282  60.445  1.00 22.35      A   C
ATOM   6792  O    GLY C 153     -29.443  34.121  60.452  1.00 21.28      A   O
ATOM   6793  N    HIS C 154     -28.294  35.857  59.952  1.00 22.12      A   N
ATOM   6794  CA   HIS C 154     -27.222  35.033  59.514  1.00 22.22      A   C
ATOM   6795  CB   HIS C 154     -26.176  35.827  58.795  1.00 21.31      A   C
ATOM   6796  CG   HIS C 154     -26.525  36.105  57.391  1.00 26.66      A   C
ATOM   6797  ND1  HIS C 154     -26.651  35.117  56.457  1.00 28.37      A   N
ATOM   6798  CE1  HIS C 154     -26.969  35.655  55.305  1.00 29.97      A   C
ATOM   6799  NE2  HIS C 154     -27.055  36.950  55.462  1.00 31.70      A   N
ATOM   6800  CD2  HIS C 154     -26.781  37.258  56.758  1.00 28.46      A   C
ATOM   6801  C    HIS C 154     -26.619  34.303  60.651  1.00 21.46      A   C
ATOM   6802  O    HIS C 154     -26.261  33.203  60.505  1.00 21.83      A   O
ATOM   6803  N    LEU C 155     -26.473  34.954  61.781  1.00 21.38      A   N
ATOM   6804  CA   LEU C 155     -25.909  34.328  62.943  1.00 20.20      A   C
ATOM   6805  CB   LEU C 155     -25.588  35.349  64.015  1.00 19.51      A   C
ATOM   6806  CG   LEU C 155     -25.258  34.964  65.440  1.00 19.25      A   C
ATOM   6807  CD1  LEU C 155     -24.034  34.254  65.564  1.00 17.35      A   C
```

Appendix 1

```
ATOM   6808  CD2 LEU C 155     -25.235  36.110  66.295  1.00 13.48      A   C
ATOM   6809  C   LEU C 155     -26.761  33.215  63.451  1.00 21.52      A   C
ATOM   6810  O   LEU C 155     -26.267  32.197  63.769  1.00 22.60      A   O
ATOM   6811  N   ASN C 156     -28.059  33.401  63.463  1.00 21.54      A   N
ATOM   6812  CA  ASN C 156     -28.952  32.359  63.864  1.00 23.49      A   C
ATOM   6813  CB  ASN C 156     -30.348  32.902  64.074  1.00 24.61      A   C
ATOM   6814  CG  ASN C 156     -31.078  32.180  65.144  1.00 27.38      A   C
ATOM   6815  OD1 ASN C 156     -30.566  31.972  66.188  1.00 26.46      A   O
ATOM   6816  ND2 ASN C 156     -32.266  31.784  64.876  1.00 26.68      A   N
ATOM   6817  C   ASN C 156     -28.966  31.100  63.028  1.00 24.24      A   C
ATOM   6818  O   ASN C 156     -29.094  30.047  63.543  1.00 25.26      A   O
ATOM   6819  N   LEU C 157     -28.852  31.226  61.725  1.00 24.99      A   N
ATOM   6820  CA  LEU C 157     -28.735  30.112  60.854  1.00 23.39      A   C
ATOM   6821  CB  LEU C 157     -28.855  30.563  59.414  1.00 23.68      A   C
ATOM   6822  CG  LEU C 157     -28.798  29.469  58.376  1.00 22.85      A   C
ATOM   6823  CD1 LEU C 157     -29.783  28.456  58.708  1.00 17.56      A   C
ATOM   6824  CD2 LEU C 157     -29.068  30.006  57.043  1.00 20.96      A   C
ATOM   6825  C   LEU C 157     -27.466  29.378  61.109  1.00 24.37      A   C
ATOM   6826  O   LEU C 157     -27.458  28.197  61.117  1.00 24.68      A   O
ATOM   6827  N   MET C 158     -26.398  30.109  61.338  1.00 24.89      A   N
ATOM   6828  CA  MET C 158     -25.078  29.556  61.606  1.00 24.51      A   C
ATOM   6829  CB  MET C 158     -24.026  30.651  61.634  1.00 23.94      C   C
ATOM   6830  CG  MET C 158     -23.895  31.391  60.376  1.00 24.46      C   C
ATOM   6831  SD  MET C 158     -22.793  32.760  60.374  1.00 30.60      C   S
ATOM   6832  CE  MET C 158     -21.396  32.017  61.068  1.00 23.18      C   C
ATOM   6833  C   MET C 158     -25.026  28.737  62.863  1.00 24.37      A   C
ATOM   6834  O   MET C 158     -24.399  27.722  62.912  1.00 23.29      A   O
ATOM   6835  N   TYR C 159     -25.716  29.195  63.885  1.00 25.87      A   N
ATOM   6836  CA  TYR C 159     -25.816  28.501  65.138  1.00 25.92      A   C
ATOM   6837  CB  TYR C 159     -26.781  29.271  66.026  1.00 26.85      A   C
ATOM   6838  CG  TYR C 159     -26.255  30.421  66.844  1.00 27.45      A   C
ATOM   6839  CD1 TYR C 159     -25.035  30.374  67.438  1.00 27.90      A   C
ATOM   6840  CE1 TYR C 159     -24.581  31.396  68.184  1.00 30.21      A   C
ATOM   6841  CZ  TYR C 159     -25.341  32.483  68.366  1.00 31.12      A   C
ATOM   6842  OH  TYR C 159     -24.852  33.484  69.130  1.00 33.78      A   O
ATOM   6843  CE2 TYR C 159     -26.564  32.561  67.793  1.00 29.38      A   C
ATOM   6844  CD2 TYR C 159     -27.015  31.539  67.055  1.00 28.65      A   C
ATOM   6845  C   TYR C 159     -26.439  27.153  64.932  1.00 26.35      A   C
ATOM   6846  O   TYR C 159     -25.949  26.163  65.368  1.00 27.24      A   O
ATOM   6847  N   GLY C 160     -27.530  27.113  64.228  1.00 26.13      A   N
ATOM   6848  CA  GLY C 160     -28.162  25.877  63.939  1.00 26.64      A   C
ATOM   6849  C   GLY C 160     -27.376  24.935  63.109  1.00 28.18      A   C
ATOM   6850  O   GLY C 160     -27.369  23.777  63.360  1.00 28.67      A   O
ATOM   6851  N   LEU C 161     -26.734  25.435  62.088  1.00 29.56      A   N
ATOM   6852  CA  LEU C 161     -26.021  24.594  61.184  1.00 30.24      A   C
ATOM   6853  CB  LEU C 161     -25.624  25.325  59.908  1.00 30.26      A   C
ATOM   6854  CG  LEU C 161     -26.753  25.405  58.882  1.00 32.92      A   C
ATOM   6855  CD1 LEU C 161     -26.531  26.434  57.876  1.00 32.35      A   C
ATOM   6856  CD2 LEU C 161     -27.025  24.117  58.213  1.00 33.04      A   C
ATOM   6857  C   LEU C 161     -24.897  23.925  61.899  1.00 29.99      A   C
ATOM   6858  O   LEU C 161     -24.568  22.815  61.637  1.00 29.69      A   O
ATOM   6859  N   TYR C 162     -24.323  24.625  62.833  1.00 30.48      A   N
ATOM   6860  CA  TYR C 162     -23.275  24.087  63.642  1.00 31.45      A   C
ATOM   6861  CB  TYR C 162     -22.738  25.212  64.491  1.00 31.99      A   C
```

Appendix 1

```
ATOM   6862  CG   TYR C 162     -21.780  24.750  65.508  1.00 33.11      A  C
ATOM   6863  CD1  TYR C 162     -20.484  24.493  65.179  1.00 34.50      A  C
ATOM   6864  CE1  TYR C 162     -19.638  24.053  66.076  1.00 34.98      A  C
ATOM   6865  CZ   TYR C 162     -20.061  23.843  67.319  1.00 37.49      A  C
ATOM   6866  OH   TYR C 162     -19.184  23.400  68.229  1.00 41.08      A  O
ATOM   6867  CE2  TYR C 162     -21.334  24.081  67.665  1.00 35.54      A  C
ATOM   6868  CD2  TYR C 162     -22.178  24.516  66.775  1.00 32.11      A  C
ATOM   6869  C    TYR C 162     -23.685  22.911  64.526  1.00 32.45      A  C
ATOM   6870  O    TYR C 162     -23.000  21.946  64.620  1.00 33.15      A  O
ATOM   6871  N    GLN C 163     -24.813  23.020  65.182  1.00 32.02      A  N
ATOM   6872  CA   GLN C 163     -25.360  21.940  65.934  1.00 32.86      A  C
ATOM   6873  CB   GLN C 163     -26.534  22.442  66.756  1.00 33.10      A  C
ATOM   6874  CG   GLN C 163     -26.683  21.760  68.052  1.00 32.65      A  C
ATOM   6875  CD   GLN C 163     -27.632  22.434  68.966  1.00 39.20      A  C
ATOM   6876  OE1  GLN C 163     -27.636  23.622  69.099  1.00 40.76      A  O
ATOM   6877  NE2  GLN C 163     -28.439  21.665  69.618  1.00 35.84      A  N
ATOM   6878  C    GLN C 163     -25.760  20.762  65.053  1.00 33.73      A  C
ATOM   6879  O    GLN C 163     -25.607  19.627  65.407  1.00 34.00      A  O
ATOM   6880  N    LEU C 164     -26.313  21.048  63.900  1.00 34.74      A  N
ATOM   6881  CA   LEU C 164     -26.691  20.027  62.957  1.00 33.89      A  C
ATOM   6882  CB   LEU C 164     -27.431  20.665  61.810  1.00 34.33      A  C
ATOM   6883  CG   LEU C 164     -28.765  20.113  61.368  1.00 34.16      A  C
ATOM   6884  CD1  LEU C 164     -29.404  19.359  62.436  1.00 33.67      A  C
ATOM   6885  CD2  LEU C 164     -29.612  21.215  60.963  1.00 29.50      A  C
ATOM   6886  C    LEU C 164     -25.529  19.244  62.415  1.00 34.15      A  C
ATOM   6887  O    LEU C 164     -25.637  18.087  62.185  1.00 34.95      A  O
ATOM   6888  N    VAL C 165     -24.449  19.921  62.128  1.00 33.48      A  N
ATOM   6889  CA   VAL C 165     -23.198  19.316  61.750  1.00 33.45      A  C
ATOM   6890  CB   VAL C 165     -22.320  20.358  61.211  1.00 33.78      A  C
ATOM   6891  CG1  VAL C 165     -21.045  19.797  60.827  1.00 31.98      A  C
ATOM   6892  CG2  VAL C 165     -22.959  20.966  60.079  1.00 31.33      A  C
ATOM   6893  C    VAL C 165     -22.427  18.532  62.799  1.00 34.25      A  C
ATOM   6894  O    VAL C 165     -21.812  17.541  62.548  1.00 34.21      A  O
ATOM   6895  N    THR C 166     -22.435  19.060  63.982  1.00 34.85      A  N
ATOM   6896  CA   THR C 166     -21.635  18.585  65.035  1.00 36.02      A  C
ATOM   6897  CB   THR C 166     -20.813  19.713  65.641  1.00 35.90      A  C
ATOM   6898  OG1  THR C 166     -21.663  20.767  66.041  1.00 36.37      A  O
ATOM   6899  CG2  THR C 166     -19.907  20.261  64.670  1.00 34.53      A  C
ATOM   6900  C    THR C 166     -22.683  18.192  65.983  1.00 37.84      A  C
ATOM   6901  O    THR C 166     -23.816  18.503  65.816  1.00 40.24      A  O
ATOM   6902  N    GLY C 167     -22.364  17.510  67.032  1.00 38.62      A  N
ATOM   6903  CA   GLY C 167     -23.429  17.319  67.980  1.00 39.20      A  C
ATOM   6904  C    GLY C 167     -23.571  18.438  68.962  1.00 39.45      A  C
ATOM   6905  O    GLY C 167     -24.498  18.470  69.703  1.00 39.84      A  O
ATOM   6906  N    SER C 168     -22.632  19.357  68.926  1.00 38.46      A  N
ATOM   6907  CA   SER C 168     -22.288  20.245  70.002  1.00 37.96      A  C
ATOM   6908  CB   SER C 168     -21.052  21.045  69.606  1.00 37.33      A  C
ATOM   6909  OG   SER C 168     -20.557  21.842  70.641  1.00 37.01      A  O
ATOM   6910  C    SER C 168     -23.374  21.171  70.427  1.00 37.79      A  C
ATOM   6911  O    SER C 168     -24.013  21.791  69.629  1.00 38.12      A  O
ATOM   6912  N    ARG C 169     -23.528  21.281  71.731  1.00 37.69      A  N
ATOM   6913  CA   ARG C 169     -24.545  22.082  72.354  1.00 37.63      A  C
ATOM   6914  CB   ARG C 169     -25.166  21.361  73.513  1.00 37.85      A  C
ATOM   6915  CG   ARG C 169     -25.791  20.090  73.158  1.00 42.05      A  C
```

Appendix 1

```
ATOM   6916  CD   ARG C 169    -26.627  19.572  74.259  1.00  50.30    A  C
ATOM   6917  NE   ARG C 169    -27.266  18.350  73.831  1.00  58.84    A  N
ATOM   6918  CZ   ARG C 169    -28.387  18.296  73.138  1.00  62.98    A  C
ATOM   6919  NH1  ARG C 169    -29.038  19.393  72.821  1.00  63.71    A  N
ATOM   6920  NH2  ARG C 169    -28.867  17.133  72.771  1.00  65.24    A  N
ATOM   6921  C    ARG C 169    -23.925  23.324  72.851  1.00  38.12    A  C
ATOM   6922  O    ARG C 169    -24.464  24.009  73.649  1.00  38.72    A  O
ATOM   6923  N    ARG C 170    -22.760  23.616  72.351  1.00  38.02    A  N
ATOM   6924  CA   ARG C 170    -22.019  24.751  72.793  1.00  37.49    A  C
ATOM   6925  CB   ARG C 170    -20.665  24.712  72.198  1.00  38.24    A  C
ATOM   6926  CG   ARG C 170    -20.167  26.019  72.013  1.00  39.73    A  C
ATOM   6927  CD   ARG C 170    -18.932  25.948  71.322  1.00  47.94    A  C
ATOM   6928  NE   ARG C 170    -18.094  26.984  71.831  1.00  54.49    A  N
ATOM   6929  CZ   ARG C 170    -16.812  26.835  72.012  1.00  56.53    A  C
ATOM   6930  NH1  ARG C 170    -16.261  25.700  71.688  1.00  58.79    A  N
ATOM   6931  NH2  ARG C 170    -16.104  27.818  72.493  1.00  58.07    A  N
ATOM   6932  C    ARG C 170    -22.593  26.126  72.570  1.00  37.49    A  C
ATOM   6933  O    ARG C 170    -22.407  26.984  73.372  1.00  39.52    A  O
ATOM   6934  N    TYR C 171    -23.269  26.365  71.475  1.00  35.66    A  N
ATOM   6935  CA   TYR C 171    -23.869  27.657  71.274  1.00  34.49    A  C
ATOM   6936  CB   TYR C 171    -23.593  28.190  69.878  1.00  33.80    A  C
ATOM   6937  CG   TYR C 171    -22.163  28.377  69.560  1.00  30.72    A  C
ATOM   6938  CD1  TYR C 171    -21.469  29.385  70.102  1.00  30.37    A  C
ATOM   6939  CE1  TYR C 171    -20.191  29.554  69.842  1.00  29.34    A  C
ATOM   6940  CZ   TYR C 171    -19.562  28.723  69.011  1.00  32.71    A  C
ATOM   6941  OH   TYR C 171    -18.249  28.927  68.749  1.00  32.40    A  O
ATOM   6942  CE2  TYR C 171    -20.235  27.706  68.440  1.00  31.02    A  C
ATOM   6943  CD2  TYR C 171    -21.519  27.545  68.717  1.00  28.18    A  C
ATOM   6944  C    TYR C 171    -25.348  27.636  71.542  1.00  34.42    A  C
ATOM   6945  O    TYR C 171    -26.012  28.563  71.272  1.00  33.96    A  O
ATOM   6946  N    GLU C 172    -25.843  26.565  72.110  1.00  35.38    A  N
ATOM   6947  CA   GLU C 172    -27.252  26.270  72.189  1.00  35.61    A  C
ATOM   6948  CB   GLU C 172    -27.406  24.923  72.856  1.00  35.57    A  C
ATOM   6949  CG   GLU C 172    -28.400  24.044  72.233  1.00  40.46    A  C
ATOM   6950  CD   GLU C 172    -28.939  23.020  73.159  1.00  45.67    A  C
ATOM   6951  OE1  GLU C 172    -29.010  23.292  74.339  1.00  49.72    A  O
ATOM   6952  OE2  GLU C 172    -29.307  21.940  72.715  1.00  48.20    A  O-1
ATOM   6953  C    GLU C 172    -28.088  27.268  72.933  1.00  34.94    A  C
ATOM   6954  O    GLU C 172    -29.144  27.607  72.516  1.00  35.83    A  O
ATOM   6955  N    ALA C 173    -27.606  27.719  74.058  1.00  34.59    A  N
ATOM   6956  CA   ALA C 173    -28.277  28.733  74.829  1.00  34.12    A  C
ATOM   6957  CB   ALA C 173    -27.658  28.840  76.189  1.00  32.66    A  C
ATOM   6958  C    ALA C 173    -28.391  30.091  74.136  1.00  33.23    A  C
ATOM   6959  O    ALA C 173    -29.307  30.801  74.355  1.00  33.50    A  O
ATOM   6960  N    GLU C 174    -27.387  30.473  73.384  1.00  33.00    A  N
ATOM   6961  CA   GLU C 174    -27.412  31.636  72.541  1.00  31.90    A  C
ATOM   6962  CB   GLU C 174    -26.083  31.758  71.863  1.00  31.78    A  C
ATOM   6963  CG   GLU C 174    -25.079  32.451  72.593  1.00  35.25    A  C
ATOM   6964  CD   GLU C 174    -23.765  31.815  72.435  1.00  40.73    A  C
ATOM   6965  OE1  GLU C 174    -23.606  30.761  73.008  1.00  46.46    A  O
ATOM   6966  OE2  GLU C 174    -22.895  32.357  71.771  1.00  37.23    A  O-1
ATOM   6967  C    GLU C 174    -28.398  31.476  71.449  1.00  31.33    A  C
ATOM   6968  O    GLU C 174    -29.099  32.382  71.122  1.00  31.15    A  O
ATOM   6969  N    HIS C 175    -28.380  30.302  70.847  1.00  29.90    A  N
```

Appendix 1

```
ATOM   6970  CA   HIS C 175     -29.211  29.952  69.739  1.00 30.87      A    C
ATOM   6971  CB   HIS C 175     -28.859  28.540  69.330  1.00 30.56      A    C
ATOM   6972  CG   HIS C 175     -29.476  28.073  68.052  1.00 34.22      A    C
ATOM   6973  ND1  HIS C 175     -29.675  26.749  67.778  1.00 35.39      A    N
ATOM   6974  CE1  HIS C 175     -30.206  26.618  66.590  1.00 34.03      A    C
ATOM   6975  NE2  HIS C 175     -30.366  27.812  66.081  1.00 31.55      A    N
ATOM   6976  CD2  HIS C 175     -29.904  28.736  66.968  1.00 33.29      A    C
ATOM   6977  C    HIS C 175     -30.651  30.013  70.141  1.00 31.85      A    C
ATOM   6978  O    HIS C 175     -31.450  30.539  69.438  1.00 32.92      A    O
ATOM   6979  N    ALA C 176     -30.982  29.467  71.287  1.00 31.29      A    N
ATOM   6980  CA   ALA C 176     -32.310  29.581  71.817  1.00 30.69      A    C
ATOM   6981  CB   ALA C 176     -32.459  28.705  73.001  1.00 29.34      A    C
ATOM   6982  C    ALA C 176     -32.707  31.004  72.150  1.00 30.23      A    C
ATOM   6983  O    ALA C 176     -33.792  31.414  71.912  1.00 30.15      A    O
ATOM   6984  N    HIS C 177     -31.817  31.757  72.723  1.00 30.44      A    N
ATOM   6985  CA   HIS C 177     -32.101  33.126  73.048  1.00 30.78      A    C
ATOM   6986  CB   HIS C 177     -30.966  33.624  73.923  1.00 28.76      A    C
ATOM   6987  CG   HIS C 177     -30.941  35.089  74.109  1.00 33.72      A    C
ATOM   6988  ND1  HIS C 177     -31.825  35.747  74.919  1.00 37.52      A    N
ATOM   6989  CE1  HIS C 177     -31.564  37.031  74.896  1.00 36.52      A    C
ATOM   6990  NE2  HIS C 177     -30.538  37.228  74.107  1.00 33.76      A    N
ATOM   6991  CD2  HIS C 177     -30.111  36.026  73.626  1.00 35.06      A    C
ATOM   6992  C    HIS C 177     -32.345  34.044  71.840  1.00 31.34      A    C
ATOM   6993  O    HIS C 177     -33.271  34.806  71.832  1.00 31.48      A    O
ATOM   6994  N    LEU C 178     -31.491  33.950  70.834  1.00 30.58      A    N
ATOM   6995  CA   LEU C 178     -31.645  34.634  69.567  1.00 30.13      A    C
ATOM   6996  CB   LEU C 178     -30.438  34.418  68.677  1.00 29.79      A    C
ATOM   6997  CG   LEU C 178     -29.927  35.532  67.794  1.00 28.39      A    C
ATOM   6998  CD1  LEU C 178     -29.423  35.043  66.585  1.00 24.41      A    C
ATOM   6999  CD2  LEU C 178     -30.823  36.650  67.567  1.00 27.12      A    C
ATOM   7000  C    LEU C 178     -32.841  34.190  68.815  1.00 30.43      A    C
ATOM   7001  O    LEU C 178     -33.498  34.975  68.237  1.00 29.23      A    O
ATOM   7002  N    THR C 179     -33.114  32.912  68.829  1.00 29.35      A    N
ATOM   7003  CA   THR C 179     -34.242  32.401  68.131  1.00 30.30      A    C
ATOM   7004  CB   THR C 179     -34.267  30.892  68.195  1.00 30.31      A    C
ATOM   7005  OG1  THR C 179     -33.216  30.377  67.412  1.00 28.39      A    O
ATOM   7006  CG2  THR C 179     -35.507  30.359  67.646  1.00 28.37      A    C
ATOM   7007  C    THR C 179     -35.511  32.986  68.688  1.00 31.69      A    C
ATOM   7008  O    THR C 179     -36.391  33.346  67.952  1.00 34.05      A    O
ATOM   7009  N    ARG C 180     -35.595  33.095  69.992  1.00 31.84      A    N
ATOM   7010  CA   ARG C 180     -36.740  33.675  70.649  1.00 31.88      A    C
ATOM   7011  CB   ARG C 180     -36.602  33.556  72.139  1.00 34.17      A    C
ATOM   7012  CG   ARG C 180     -37.235  32.402  72.727  1.00 37.37      A    C
ATOM   7013  CD   ARG C 180     -36.908  32.365  74.146  1.00 45.06      A    C
ATOM   7014  NE   ARG C 180     -36.324  31.103  74.523  1.00 51.75      A    N
ATOM   7015  CZ   ARG C 180     -35.199  30.980  75.198  1.00 54.06      A    C
ATOM   7016  NH1  ARG C 180     -34.505  32.027  75.591  1.00 50.84      A    N
ATOM   7017  NH2  ARG C 180     -34.767  29.789  75.479  1.00 57.15      A    N
ATOM   7018  C    ARG C 180     -36.932  35.117  70.328  1.00 30.89      A    C
ATOM   7019  O    ARG C 180     -38.015  35.577  70.225  1.00 30.51      A    O
ATOM   7020  N    ILE C 181     -35.850  35.839  70.205  1.00 29.97      A    N
ATOM   7021  CA   ILE C 181     -35.919  37.226  69.916  1.00 30.59      A    C
ATOM   7022  CB   ILE C 181     -34.536  37.796  69.829  1.00 31.44      A    C
ATOM   7023  CG1  ILE C 181     -33.855  37.796  71.156  1.00 32.45      A    C
```

Appendix 1

```
ATOM   7024  CD1 ILE C 181     -32.553  38.429  71.069  1.00 32.73      A    C
ATOM   7025  CG2 ILE C 181     -34.555  39.208  69.354  1.00 29.94      A    C
ATOM   7026  C   ILE C 181     -36.539  37.447  68.570  1.00 31.55      A    C
ATOM   7027  O   ILE C 181     -37.342  38.301  68.395  1.00 32.34      A    O
ATOM   7028  N   ILE C 182     -36.118  36.668  67.612  1.00 30.51      A    N
ATOM   7029  CA  ILE C 182     -36.617  36.753  66.293  1.00 30.06      A    C
ATOM   7030  CB  ILE C 182     -35.898  35.756  65.421  1.00 29.49      A    C
ATOM   7031  CG1 ILE C 182     -34.442  36.119  65.263  1.00 25.74      A    C
ATOM   7032  CD1 ILE C 182     -33.683  35.206  64.465  1.00 20.04      A    C
ATOM   7033  CG2 ILE C 182     -36.551  35.651  64.094  1.00 29.86      A    C
ATOM   7034  C   ILE C 182     -38.080  36.420  66.271  1.00 31.04      A    C
ATOM   7035  O   ILE C 182     -38.828  37.015  65.571  1.00 31.51      A    O
ATOM   7036  N   HIS C 183     -38.463  35.417  67.022  1.00 30.75      A    N
ATOM   7037  CA  HIS C 183     -39.825  34.988  67.079  1.00 31.82      A    C
ATOM   7038  CB  HIS C 183     -39.936  33.741  67.911  1.00 33.10      A    C
ATOM   7039  CG  HIS C 183     -41.329  33.428  68.321  1.00 34.58      A    C
ATOM   7040  ND1 HIS C 183     -41.901  33.936  69.451  1.00 38.68      A    N
ATOM   7041  CE1 HIS C 183     -43.138  33.510  69.544  1.00 42.12      A    C
ATOM   7042  NE2 HIS C 183     -43.384  32.732  68.515  1.00 42.37      A    N
ATOM   7043  CD2 HIS C 183     -42.267  32.664  67.738  1.00 38.21      A    C
ATOM   7044  C   HIS C 183     -40.754  35.991  67.662  1.00 32.71      A    C
ATOM   7045  O   HIS C 183     -41.845  36.159  67.193  1.00 33.66      A    O
ATOM   7046  N   ASP C 184     -40.333  36.604  68.745  1.00 32.35      A    N
ATOM   7047  CA  ASP C 184     -41.092  37.629  69.373  1.00 33.25      A    C
ATOM   7048  CB  ASP C 184     -40.437  38.054  70.654  1.00 33.23      A    C
ATOM   7049  CG  ASP C 184     -40.409  36.989  71.681  1.00 34.37      A    C
ATOM   7050  OD1 ASP C 184     -40.986  35.935  71.492  1.00 34.60      A    O
ATOM   7051  OD2 ASP C 184     -39.809  37.225  72.709  1.00 32.99      A    O-1
ATOM   7052  C   ASP C 184     -41.202  38.822  68.510  1.00 34.06      A    C
ATOM   7053  O   ASP C 184     -42.215  39.445  68.469  1.00 35.19      A    O
ATOM   7054  N   GLU C 185     -40.110  39.158  67.855  1.00 34.21      A    N
ATOM   7055  CA  GLU C 185     -40.034  40.299  66.992  1.00 33.57      A    C
ATOM   7056  CB  GLU C 185     -38.582  40.565  66.594  1.00 32.67      A    C
ATOM   7057  CG  GLU C 185     -38.314  41.904  65.954  1.00 38.24      A    C
ATOM   7058  CD  GLU C 185     -36.865  42.396  66.061  1.00 47.85      A    C
ATOM   7059  OE1 GLU C 185     -35.974  41.667  66.491  1.00 43.21      A    O
ATOM   7060  OE2 GLU C 185     -36.611  43.547  65.705  1.00 50.87      A    O-1
ATOM   7061  C   GLU C 185     -40.966  40.151  65.807  1.00 33.71      A    C
ATOM   7062  O   GLU C 185     -41.605  41.085  65.436  1.00 32.91      A    O
ATOM   7063  N   ILE C 186     -41.051  38.971  65.223  1.00 31.70      A    N
ATOM   7064  CA  ILE C 186     -41.950  38.732  64.132  1.00 32.42      A    C
ATOM   7065  CB  ILE C 186     -41.765  37.366  63.571  1.00 32.25      A    C
ATOM   7066  CG1 ILE C 186     -40.471  37.286  62.818  1.00 31.20      A    C
ATOM   7067  CD1 ILE C 186     -39.935  35.959  62.753  1.00 29.89      A    C
ATOM   7068  CG2 ILE C 186     -42.815  37.069  62.607  1.00 27.73      A    C
ATOM   7069  C   ILE C 186     -43.368  38.886  64.576  1.00 33.83      A    C
ATOM   7070  O   ILE C 186     -44.204  39.404  63.877  1.00 34.42      A    O
ATOM   7071  N   ALA C 187     -43.602  38.420  65.776  1.00 35.43      A    N
ATOM   7072  CA  ALA C 187     -44.877  38.450  66.428  1.00 35.96      A    C
ATOM   7073  CB  ALA C 187     -44.786  37.716  67.698  1.00 35.30      A    C
ATOM   7074  C   ALA C 187     -45.342  39.855  66.662  1.00 35.91      A    C
ATOM   7075  O   ALA C 187     -46.498  40.153  66.537  1.00 36.85      A    O
ATOM   7076  N   ALA C 188     -44.419  40.710  67.024  1.00 35.23      A    N
ATOM   7077  CA  ALA C 188     -44.694  42.104  67.219  1.00 34.53      A    C
```

Appendix 1

```
ATOM   7078  CB  ALA C 188     -43.601  42.735  67.961  1.00  32.48      A  C
ATOM   7079  C   ALA C 188     -45.076  42.914  65.996  1.00  35.43      A  C
ATOM   7080  O   ALA C 188     -45.857  43.807  66.105  1.00  34.94      A  O
ATOM   7081  N   ASN C 189     -44.497  42.608  64.849  1.00  36.12      A  N
ATOM   7082  CA  ASN C 189     -44.704  43.381  63.658  1.00  36.04      A  C
ATOM   7083  CB  ASN C 189     -43.634  43.066  62.638  1.00  35.47      A  C
ATOM   7084  CG  ASN C 189     -42.306  43.549  63.035  1.00  33.57      A  C
ATOM   7085  OD1 ASN C 189     -42.195  44.507  63.725  1.00  35.86      A  O
ATOM   7086  ND2 ASN C 189     -41.285  42.881  62.603  1.00  29.83      A  N
ATOM   7087  C   ASN C 189     -46.050  43.205  63.013  1.00  37.82      A  C
ATOM   7088  O   ASN C 189     -46.560  42.119  62.868  1.00  37.92      A  O
ATOM   7089  N   PRO C 190     -46.614  44.315  62.616  1.00  39.45      A  N
ATOM   7090  CA  PRO C 190     -47.751  44.349  61.730  1.00  40.12      A  C
ATOM   7091  CB  PRO C 190     -48.074  45.809  61.712  1.00  39.66      A  C
ATOM   7092  CG  PRO C 190     -46.858  46.429  61.882  1.00  40.41      A  C
ATOM   7093  CD  PRO C 190     -46.026  45.637  62.747  1.00  40.23      A  C
ATOM   7094  C   PRO C 190     -47.440  43.823  60.326  1.00  41.11      A  C
ATOM   7095  O   PRO C 190     -48.245  43.170  59.740  1.00  43.24      A  O
ATOM   7096  N   PHE C 191     -46.288  44.109  59.774  1.00  39.86      A  N
ATOM   7097  CA  PHE C 191     -45.898  43.448  58.565  1.00  38.75      A  C
ATOM   7098  CB  PHE C 191     -44.885  44.293  57.816  1.00  36.36      A  C
ATOM   7099  CG  PHE C 191     -43.799  44.759  58.656  1.00  31.97      A  C
ATOM   7100  CD1 PHE C 191     -42.670  44.051  58.739  1.00  32.94      A  C
ATOM   7101  CE1 PHE C 191     -41.690  44.448  59.532  1.00  30.16      A  C
ATOM   7102  CZ  PHE C 191     -41.816  45.539  60.262  1.00  26.72      A  C
ATOM   7103  CE2 PHE C 191     -42.927  46.239  60.210  1.00  33.80      A  C
ATOM   7104  CD2 PHE C 191     -43.922  45.861  59.419  1.00  31.86      A  C
ATOM   7105  C   PHE C 191     -45.320  42.122  58.973  1.00  39.42      A  C
ATOM   7106  O   PHE C 191     -44.955  41.945  60.099  1.00  40.34      A  O
ATOM   7107  N   ALA C 192     -45.189  41.185  58.064  1.00  39.69      A  N
ATOM   7108  CA  ALA C 192     -44.574  39.948  58.442  1.00  39.60      A  C
ATOM   7109  CB  ALA C 192     -45.080  38.865  57.615  1.00  39.61      A  C
ATOM   7110  C   ALA C 192     -43.082  40.049  58.312  1.00  39.58      A  C
ATOM   7111  O   ALA C 192     -42.608  40.403  57.290  1.00  40.97      A  O
ATOM   7112  N   GLY C 193     -42.347  39.734  59.367  1.00  39.41      A  N
ATOM   7113  CA  GLY C 193     -40.911  39.889  59.370  1.00  36.30      A  C
ATOM   7114  C   GLY C 193     -40.319  40.936  60.257  1.00  35.11      A  C
ATOM   7115  O   GLY C 193     -40.954  41.448  61.133  1.00  34.67      A  O
ATOM   7116  N   ILE C 194     -39.055  41.202  60.004  1.00  34.51      A  N
ATOM   7117  CA  ILE C 194     -38.230  42.093  60.778  1.00  33.09      A  C
ATOM   7118  CB  ILE C 194     -37.316  41.269  61.705  1.00  33.07      A  C
ATOM   7119  CG1 ILE C 194     -38.118  40.307  62.529  1.00  28.40      A  C
ATOM   7120  CD1 ILE C 194     -37.364  39.178  62.853  1.00  29.64      A  C
ATOM   7121  CG2 ILE C 194     -36.499  42.126  62.597  1.00  33.26      A  C
ATOM   7122  C   ILE C 194     -37.370  42.949  59.877  1.00  33.84      A  C
ATOM   7123  O   ILE C 194     -36.900  42.516  58.901  1.00  34.35      A  O
ATOM   7124  N   VAL C 195     -37.192  44.202  60.225  1.00  34.67      A  N
ATOM   7125  CA  VAL C 195     -36.319  45.133  59.510  1.00  34.21      A  C
ATOM   7126  CB  VAL C 195     -36.685  46.562  59.860  1.00  34.05      A  C
ATOM   7127  CG1 VAL C 195     -38.061  46.856  59.488  1.00  29.82      A  C
ATOM   7128  CG2 VAL C 195     -36.498  46.799  61.275  1.00  31.53      A  C
ATOM   7129  C   VAL C 195     -34.822  44.954  59.761  1.00  36.07      A  C
ATOM   7130  O   VAL C 195     -34.444  44.455  60.776  1.00  35.18      A  O
ATOM   7131  N   CYS C 196     -33.971  45.289  58.809  1.00  37.96      A  N
```

Appendix 1

```
ATOM   7132  CA  CYS C 196     -32.556  45.467  59.071  1.00 41.11      A  C
ATOM   7133  CB  CYS C 196     -31.839  45.560  57.776  1.00 40.47      A  C
ATOM   7134  SG  CYS C 196     -31.777  44.135  56.987  1.00 53.94      A  S
ATOM   7135  C   CYS C 196     -32.136  46.718  59.799  1.00 41.12      A  C
ATOM   7136  O   CYS C 196     -31.529  46.675  60.801  1.00 41.14      A  O
ATOM   7137  N   GLU C 197     -32.349  47.836  59.169  1.00 41.83      A  N
ATOM   7138  CA  GLU C 197     -31.952  49.104  59.674  1.00 42.08      A  C
ATOM   7139  CB  GLU C 197     -31.223  49.902  58.601  1.00 43.17      A  C
ATOM   7140  CG  GLU C 197     -29.747  49.579  58.492  1.00 45.65      A  C
ATOM   7141  CD  GLU C 197     -29.320  48.921  57.202  1.00 50.52      A  C
ATOM   7142  OE1 GLU C 197     -30.117  48.755  56.294  1.00 53.54      A  O
ATOM   7143  OE2 GLU C 197     -28.157  48.544  57.089  1.00 52.74      A  O-1
ATOM   7144  C   GLU C 197     -33.307  49.614  59.954  1.00 41.18      A  C
ATOM   7145  O   GLU C 197     -34.263  49.056  59.520  1.00 39.36      A  O
ATOM   7146  N   PRO C 198     -33.435  50.662  60.711  1.00 41.28      A  N
ATOM   7147  CA  PRO C 198     -34.733  50.897  61.254  1.00 41.20      A  C
ATOM   7148  CB  PRO C 198     -34.497  52.151  62.053  1.00 40.68      A  C
ATOM   7149  CG  PRO C 198     -33.185  51.929  62.622  1.00 38.54      A  C
ATOM   7150  CD  PRO C 198     -32.438  50.992  61.722  1.00 41.67      A  C
ATOM   7151  C   PRO C 198     -35.845  51.050  60.264  1.00 41.12      A  C
ATOM   7152  O   PRO C 198     -36.798  50.385  60.470  1.00 42.64      A  O
ATOM   7153  N   ASP C 199     -35.796  51.808  59.209  1.00 39.72      A  N
ATOM   7154  CA  ASP C 199     -36.988  51.752  58.374  1.00 38.31      A  C
ATOM   7155  CB  ASP C 199     -37.549  53.129  58.054  1.00 37.97      A  C
ATOM   7156  CG  ASP C 199     -38.934  53.066  57.521  1.00 42.17      A  C
ATOM   7157  OD1 ASP C 199     -39.674  52.244  57.997  1.00 49.57      A  O
ATOM   7158  OD2 ASP C 199     -39.312  53.830  56.636  1.00 46.42      A  O-1
ATOM   7159  C   ASP C 199     -36.885  50.904  57.117  1.00 36.25      A  C
ATOM   7160  O   ASP C 199     -37.665  51.054  56.251  1.00 35.50      A  O
ATOM   7161  N   ASN C 200     -35.910  50.027  57.041  1.00 34.18      A  N
ATOM   7162  CA  ASN C 200     -35.636  49.266  55.847  1.00 33.67      A  C
ATOM   7163  CB  ASN C 200     -34.164  49.282  55.571  1.00 33.43      A  C
ATOM   7164  CG  ASN C 200     -33.630  50.614  55.405  1.00 33.81      A  C
ATOM   7165  OD1 ASN C 200     -34.350  51.543  55.277  1.00 36.10      A  O
ATOM   7166  ND2 ASN C 200     -32.337  50.722  55.392  1.00 34.79      A  N
ATOM   7167  C   ASN C 200     -35.974  47.810  55.938  1.00 33.43      A  C
ATOM   7168  O   ASN C 200     -35.407  47.125  56.708  1.00 34.69      A  O
ATOM   7169  N   TYR C 201     -36.856  47.329  55.092  1.00 32.04      A  N
ATOM   7170  CA  TYR C 201     -37.207  45.932  55.078  1.00 30.19      A  C
ATOM   7171  CB  TYR C 201     -38.704  45.792  55.113  1.00 29.28      A  C
ATOM   7172  CG  TYR C 201     -39.195  44.398  55.079  1.00 29.74      A  C
ATOM   7173  CD1 TYR C 201     -39.458  43.717  56.228  1.00 30.07      A  C
ATOM   7174  CE1 TYR C 201     -39.905  42.473  56.193  1.00 30.19      A  C
ATOM   7175  CZ  TYR C 201     -40.104  41.880  55.004  1.00 31.77      A  C
ATOM   7176  OH  TYR C 201     -40.577  40.623  54.931  1.00 34.41      A  O
ATOM   7177  CE2 TYR C 201     -39.859  42.533  53.865  1.00 29.44      A  C
ATOM   7178  CD2 TYR C 201     -39.425  43.770  53.898  1.00 29.74      A  C
ATOM   7179  C   TYR C 201     -36.655  45.264  53.853  1.00 29.52      A  C
ATOM   7180  O   TYR C 201     -36.809  45.727  52.786  1.00 28.89      A  O
ATOM   7181  N   PHE C 202     -35.966  44.172  54.041  1.00 28.41      A  N
ATOM   7182  CA  PHE C 202     -35.425  43.420  52.959  1.00 28.26      A  C
ATOM   7183  CB  PHE C 202     -33.924  43.430  53.000  1.00 28.11      A  C
ATOM   7184  CG  PHE C 202     -33.335  44.743  52.689  1.00 29.95      A  C
ATOM   7185  CD1 PHE C 202     -33.212  45.159  51.424  1.00 33.68      A  C
```

Appendix 1

```
ATOM   7186  CE1 PHE C 202     -32.691  46.333  51.152  1.00 35.80      A    C
ATOM   7187  CZ  PHE C 202     -32.283  47.121  52.124  1.00 35.85      A    C
ATOM   7188  CE2 PHE C 202     -32.399  46.741  53.383  1.00 35.66      A    C
ATOM   7189  CD2 PHE C 202     -32.916  45.570  53.672  1.00 32.44      A    C
ATOM   7190  C   PHE C 202     -35.933  42.028  52.988  1.00 28.37      A    C
ATOM   7191  O   PHE C 202     -35.959  41.404  53.985  1.00 28.98      A    O
ATOM   7192  N   VAL C 203     -36.399  41.591  51.850  1.00 28.43      A    N
ATOM   7193  CA  VAL C 203     -36.884  40.269  51.627  1.00 27.36      A    C
ATOM   7194  CB  VAL C 203     -37.596  40.235  50.265  1.00 26.74      A    C
ATOM   7195  CG1 VAL C 203     -37.085  39.238  49.353  1.00 28.19      A    C
ATOM   7196  CG2 VAL C 203     -39.004  40.090  50.436  1.00 27.81      A    C
ATOM   7197  C   VAL C 203     -35.789  39.253  51.777  1.00 27.19      A    C
ATOM   7198  O   VAL C 203     -35.976  38.240  52.347  1.00 27.70      A    O
ATOM   7199  N   GLN C 204     -34.628  39.519  51.250  1.00 26.59      A    N
ATOM   7200  CA  GLN C 204     -33.558  38.571  51.385  1.00 27.48      A    C
ATOM   7201  CB  GLN C 204     -32.444  38.850  50.380  1.00 26.01      A    C
ATOM   7202  CG  GLN C 204     -31.523  39.984  50.708  1.00 22.88      A    C
ATOM   7203  CD  GLN C 204     -31.995  41.302  50.205  1.00 23.44      A    C
ATOM   7204  OE1 GLN C 204     -33.144  41.552  50.140  1.00 31.07      A    O
ATOM   7205  NE2 GLN C 204     -31.103  42.133  49.854  1.00 19.01      A    N
ATOM   7206  C   GLN C 204     -33.051  38.376  52.808  1.00 28.13      A    C
ATOM   7207  O   GLN C 204     -32.777  37.304  53.192  1.00 29.92      A    O
ATOM   7208  N   CYS C 205     -32.926  39.433  53.569  1.00 29.88      A    N
ATOM   7209  CA  CYS C 205     -32.434  39.344  54.923  1.00 31.17      A    C
ATOM   7210  CB  CYS C 205     -32.243  40.735  55.509  1.00 30.84      A    C
ATOM   7211  SG  CYS C 205     -31.077  41.772  54.667  1.00 39.03      A    S
ATOM   7212  C   CYS C 205     -33.389  38.511  55.736  1.00 29.75      A    C
ATOM   7213  O   CYS C 205     -32.999  37.683  56.494  1.00 29.54      A    O
ATOM   7214  N   ASN C 206     -34.659  38.719  55.490  1.00 27.86      A    N
ATOM   7215  CA  ASN C 206     -35.743  37.973  56.072  1.00 27.32      A    C
ATOM   7216  CB  ASN C 206     -37.050  38.590  55.683  1.00 27.62      A    C
ATOM   7217  CG  ASN C 206     -37.448  39.667  56.591  1.00 32.23      A    C
ATOM   7218  OD1 ASN C 206     -38.111  39.424  57.561  1.00 36.75      A    O
ATOM   7219  ND2 ASN C 206     -37.066  40.877  56.277  1.00 28.39      A    N
ATOM   7220  C   ASN C 206     -35.795  36.526  55.732  1.00 27.19      A    C
ATOM   7221  O   ASN C 206     -36.149  35.740  56.527  1.00 26.06      A    O
ATOM   7222  N   SER C 207     -35.440  36.159  54.534  1.00 26.14      A    N
ATOM   7223  CA  SER C 207     -35.457  34.773  54.213  1.00 26.33      A    C
ATOM   7224  CB  SER C 207     -35.224  34.573  52.716  1.00 26.93      A    C
ATOM   7225  OG  SER C 207     -33.897  34.724  52.355  1.00 26.93      A    O
ATOM   7226  C   SER C 207     -34.512  33.945  55.094  1.00 27.44      A    C
ATOM   7227  O   SER C 207     -34.839  32.872  55.490  1.00 27.79      A    O
ATOM   7228  N   VAL C 208     -33.350  34.484  55.410  1.00 28.16      A    N
ATOM   7229  CA  VAL C 208     -32.366  33.861  56.257  1.00 28.26      A    C
ATOM   7230  CB  VAL C 208     -31.057  34.676  56.264  1.00 28.88      A    C
ATOM   7231  CG1 VAL C 208     -30.079  34.124  57.143  1.00 28.16      A    C
ATOM   7232  CG2 VAL C 208     -30.494  34.742  54.928  1.00 29.54      A    C
ATOM   7233  C   VAL C 208     -32.872  33.650  57.654  1.00 27.82      A    C
ATOM   7234  O   VAL C 208     -32.656  32.640  58.230  1.00 27.78      A    O
ATOM   7235  N   ALA C 209     -33.569  34.619  58.181  1.00 28.42      A    N
ATOM   7236  CA  ALA C 209     -34.129  34.524  59.494  1.00 28.48      A    C
ATOM   7237  CB  ALA C 209     -34.755  35.818  59.870  1.00 25.57      A    C
ATOM   7238  C   ALA C 209     -35.147  33.450  59.577  1.00 29.91      A    C
ATOM   7239  O   ALA C 209     -35.148  32.708  60.511  1.00 32.59      A    O
```

Appendix 1

```
ATOM   7240  N    TYR C 210     -36.040  33.385  58.614  1.00  28.40   A  N
ATOM   7241  CA   TYR C 210     -37.058  32.358  58.575  1.00  28.51   A  C
ATOM   7242  CB   TYR C 210     -38.115  32.652  57.519  1.00  27.47   A  C
ATOM   7243  CG   TYR C 210     -39.129  33.658  57.958  1.00  24.86   A  C
ATOM   7244  CD1  TYR C 210     -40.266  33.284  58.596  1.00  24.20   A  C
ATOM   7245  CE1  TYR C 210     -41.160  34.190  58.999  1.00  20.16   A  C
ATOM   7246  CZ   TYR C 210     -40.925  35.496  58.787  1.00  26.12   A  C
ATOM   7247  OH   TYR C 210     -41.809  36.430  59.193  1.00  25.99   A  O
ATOM   7248  CE2  TYR C 210     -39.794  35.882  58.169  1.00  26.79   A  C
ATOM   7249  CD2  TYR C 210     -38.925  34.982  57.759  1.00  22.34   A  C
ATOM   7250  C    TYR C 210     -36.474  30.975  58.412  1.00  29.68   A  C
ATOM   7251  O    TYR C 210     -36.918  30.043  58.998  1.00  30.19   A  O
ATOM   7252  N    LEU C 211     -35.450  30.855  57.614  1.00  28.82   A  N
ATOM   7253  CA   LEU C 211     -34.780  29.605  57.447  1.00  28.61   A  C
ATOM   7254  CB   LEU C 211     -33.782  29.678  56.316  1.00  28.24   A  C
ATOM   7255  CG   LEU C 211     -33.299  28.345  55.812  1.00  29.83   A  C
ATOM   7256  CD1  LEU C 211     -34.388  27.553  55.301  1.00  28.13   A  C
ATOM   7257  CD2  LEU C 211     -32.272  28.503  54.808  1.00  33.29   A  C
ATOM   7258  C    LEU C 211     -34.126  29.112  58.706  1.00  28.60   A  C
ATOM   7259  O    LEU C 211     -34.004  27.943  58.904  1.00  28.38   A  O
ATOM   7260  N    SER C 212     -33.664  30.029  59.522  1.00  26.51   A  N
ATOM   7261  CA   SER C 212     -33.072  29.717  60.796  1.00  26.20   A  C
ATOM   7262  CB   SER C 212     -32.316  30.909  61.372  1.00  25.99   A  C
ATOM   7263  OG   SER C 212     -33.147  31.798  62.020  1.00  26.76   A  O
ATOM   7264  C    SER C 212     -34.045  29.096  61.771  1.00  26.59   A  C
ATOM   7265  O    SER C 212     -33.699  28.292  62.583  1.00  24.54   A  O
ATOM   7266  N    LEU C 213     -35.279  29.523  61.674  1.00  26.90   A  N
ATOM   7267  CA   LEU C 213     -36.353  28.982  62.435  1.00  26.25   A  C
ATOM   7268  CB   LEU C 213     -37.593  29.802  62.229  1.00  25.17   A  C
ATOM   7269  CG   LEU C 213     -37.543  31.224  62.691  1.00  27.27   A  C
ATOM   7270  CD1  LEU C 213     -38.841  31.827  62.578  1.00  22.47   A  C
ATOM   7271  CD2  LEU C 213     -37.063  31.292  64.042  1.00  25.48   A  C
ATOM   7272  C    LEU C 213     -36.614  27.556  62.081  1.00  26.96   A  C
ATOM   7273  O    LEU C 213     -36.835  26.764  62.938  1.00  27.20   A  O
ATOM   7274  N    TRP C 214     -36.572  27.226  60.806  1.00  26.35   A  N
ATOM   7275  CA   TRP C 214     -36.767  25.871  60.393  1.00  26.38   A  C
ATOM   7276  CB   TRP C 214     -36.852  25.763  58.877  1.00  26.47   A  C
ATOM   7277  CG   TRP C 214     -38.082  26.280  58.292  1.00  26.22   A  C
ATOM   7278  CD1  TRP C 214     -38.478  27.540  58.283  1.00  31.35   A  C
ATOM   7279  NE1  TRP C 214     -39.664  27.664  57.683  1.00  29.42   A  N
ATOM   7280  CE2  TRP C 214     -40.047  26.441  57.240  1.00  28.70   A  C
ATOM   7281  CD2  TRP C 214     -39.079  25.551  57.619  1.00  27.18   A  C
ATOM   7282  CE3  TRP C 214     -39.245  24.218  57.293  1.00  28.89   A  C
ATOM   7283  CZ3  TRP C 214     -40.337  23.851  56.641  1.00  27.63   A  C
ATOM   7284  CH2  TRP C 214     -41.278  24.750  56.284  1.00  27.27   A  C
ATOM   7285  CZ2  TRP C 214     -41.162  26.051  56.577  1.00  26.82   A  C
ATOM   7286  C    TRP C 214     -35.690  24.965  60.944  1.00  27.91   A  C
ATOM   7287  O    TRP C 214     -35.954  23.869  61.284  1.00  27.66   A  O
ATOM   7288  N    VAL C 215     -34.460  25.427  60.972  1.00  29.26   A  N
ATOM   7289  CA   VAL C 215     -33.333  24.697  61.505  1.00  28.51   A  C
ATOM   7290  CB   VAL C 215     -32.060  25.449  61.189  1.00  27.64   A  C
ATOM   7291  CG1  VAL C 215     -30.867  24.720  61.613  1.00  27.55   A  C
ATOM   7292  CG2  VAL C 215     -32.001  25.744  59.805  1.00  24.50   A  C
ATOM   7293  C    VAL C 215     -33.433  24.439  62.998  1.00  29.57   A  C
```

Appendix 1

```
ATOM   7294  O   VAL C 215     -33.210  23.372  63.450  1.00 30.51      A  O
ATOM   7295  N   TYR C 216     -33.813  25.440  63.744  1.00 29.79      A  N
ATOM   7296  CA  TYR C 216     -34.045  25.311  65.147  1.00 31.64      A  C
ATOM   7297  CB  TYR C 216     -34.385  26.661  65.749  1.00 31.33      A  C
ATOM   7298  CG  TYR C 216     -34.432  26.681  67.236  1.00 35.73      A  C
ATOM   7299  CD1 TYR C 216     -33.318  26.912  67.965  1.00 36.54      A  C
ATOM   7300  CE1 TYR C 216     -33.366  26.931  69.297  1.00 35.14      A  C
ATOM   7301  CZ  TYR C 216     -34.520  26.708  69.928  1.00 38.32      A  C
ATOM   7302  OH  TYR C 216     -34.537  26.722  71.271  1.00 40.53      A  O
ATOM   7303  CE2 TYR C 216     -35.643  26.470  69.242  1.00 38.15      A  C
ATOM   7304  CD2 TYR C 216     -35.601  26.466  67.914  1.00 40.84      A  C
ATOM   7305  C   TYR C 216     -35.149  24.343  65.388  1.00 31.55      A  C
ATOM   7306  O   TYR C 216     -35.112  23.602  66.288  1.00 30.94      A  O
ATOM   7307  N   ASP C 217     -36.150  24.353  64.555  1.00 32.67      A  N
ATOM   7308  CA  ASP C 217     -37.232  23.416  64.696  1.00 33.27      A  C
ATOM   7309  CB  ASP C 217     -38.328  23.746  63.710  1.00 32.67      A  C
ATOM   7310  CG  ASP C 217     -39.185  24.841  64.171  1.00 32.71      A  C
ATOM   7311  OD1 ASP C 217     -38.948  25.347  65.238  1.00 28.83      A  O
ATOM   7312  OD2 ASP C 217     -40.109  25.169  63.477  1.00 34.47      A  O-1
ATOM   7313  C   ASP C 217     -36.779  21.997  64.512  1.00 33.91      A  C
ATOM   7314  O   ASP C 217     -37.192  21.136  65.210  1.00 34.91      A  O
ATOM   7315  N   ARG C 218     -35.926  21.751  63.552  1.00 34.42      A  N
ATOM   7316  CA  ARG C 218     -35.451  20.418  63.325  1.00 35.67      A  C
ATOM   7317  CB  ARG C 218     -34.684  20.339  62.020  1.00 35.72      A  C
ATOM   7318  CG  ARG C 218     -33.568  19.372  62.019  1.00 37.80      A  C
ATOM   7319  CD  ARG C 218     -33.970  18.002  61.633  1.00 44.34      A  C
ATOM   7320  NE  ARG C 218     -32.858  17.284  61.045  1.00 50.84      A  N
ATOM   7321  CZ  ARG C 218     -32.109  16.393  61.677  1.00 55.42      A  C
ATOM   7322  NH1 ARG C 218     -32.340  16.066  62.934  1.00 56.30      A  N
ATOM   7323  NH2 ARG C 218     -31.116  15.818  61.038  1.00 56.36      A  N
ATOM   7324  C   ARG C 218     -34.645  19.861  64.462  1.00 36.33      A  C
ATOM   7325  O   ARG C 218     -34.670  18.699  64.725  1.00 35.66      A  O
ATOM   7326  N   LEU C 219     -33.861  20.718  65.075  1.00 37.29      A  N
ATOM   7327  CA  LEU C 219     -33.089  20.396  66.236  1.00 36.93      A  C
ATOM   7328  CB  LEU C 219     -32.136  21.543  66.528  1.00 35.74      A  C
ATOM   7329  CG  LEU C 219     -30.646  21.500  66.222  1.00 34.19      A  C
ATOM   7330  CD1 LEU C 219     -30.239  20.391  65.403  1.00 32.19      A  C
ATOM   7331  CD2 LEU C 219     -30.151  22.739  65.658  1.00 31.70      A  C
ATOM   7332  C   LEU C 219     -33.932  20.118  67.449  1.00 37.33      A  C
ATOM   7333  O   LEU C 219     -33.684  19.198  68.152  1.00 38.44      A  O
ATOM   7334  N   HIS C 220     -34.915  20.947  67.705  1.00 37.41      A  N
ATOM   7335  CA  HIS C 220     -35.671  20.862  68.937  1.00 37.72      A  C
ATOM   7336  CB  HIS C 220     -35.574  22.188  69.641  1.00 37.60      A  C
ATOM   7337  CG  HIS C 220     -34.180  22.619  69.879  1.00 39.33      A  C
ATOM   7338  ND1 HIS C 220     -33.429  22.124  70.903  1.00 42.37      A  N
ATOM   7339  CE1 HIS C 220     -32.230  22.654  70.860  1.00 42.75      A  C
ATOM   7340  NE2 HIS C 220     -32.182  23.486  69.848  1.00 39.98      A  N
ATOM   7341  CD2 HIS C 220     -33.386  23.474  69.211  1.00 40.85      A  C
ATOM   7342  C   HIS C 220     -37.113  20.350  69.020  1.00 36.74      A  C
ATOM   7343  O   HIS C 220     -37.610  20.216  70.087  1.00 35.65      A  O
ATOM   7344  N   GLY C 221     -37.770  20.056  67.920  1.00 36.76      A  N
ATOM   7345  CA  GLY C 221     -39.144  19.602  67.952  1.00 37.48      A  C
ATOM   7346  C   GLY C 221     -40.132  20.718  68.086  1.00 38.02      A  C
ATOM   7347  O   GLY C 221     -41.294  20.554  68.331  1.00 38.49      A  O
```

Appendix 1

```
ATOM   7348  N    THR C 222     -39.592  21.884  67.875  1.00 37.82      A    N
ATOM   7349  CA   THR C 222     -40.227  23.149  68.005  1.00 37.01      A    C
ATOM   7350  CB   THR C 222     -39.129  24.148  68.241  1.00 37.07      A    C
ATOM   7351  OG1  THR C 222     -39.542  25.067  69.232  1.00 37.63      A    O
ATOM   7352  CG2  THR C 222     -38.767  24.860  66.964  1.00 36.44      A    C
ATOM   7353  C    THR C 222     -41.078  23.483  66.784  1.00 37.08      A    C
ATOM   7354  O    THR C 222     -41.056  22.784  65.811  1.00 34.49      A    O
ATOM   7355  N    ASP C 223     -41.849  24.547  66.868  1.00 37.85      A    N
ATOM   7356  CA   ASP C 223     -42.658  24.991  65.761  1.00 39.61      A    C
ATOM   7357  CB   ASP C 223     -44.116  24.639  65.962  1.00 40.34      A    C
ATOM   7358  CG   ASP C 223     -44.886  24.614  64.677  1.00 45.64      A    C
ATOM   7359  OD1  ASP C 223     -44.369  24.151  63.679  1.00 48.74      A    O
ATOM   7360  OD2  ASP C 223     -46.029  25.057  64.661  1.00 53.10      A    O-1
ATOM   7361  C    ASP C 223     -42.505  26.461  65.409  1.00 38.62      A    C
ATOM   7362  O    ASP C 223     -43.439  27.146  65.165  1.00 38.13      A    O
ATOM   7363  N    TYR C 224     -41.297  26.933  65.356  1.00 38.69      A    N
ATOM   7364  CA   TYR C 224     -41.120  28.328  65.076  1.00 38.92      A    C
ATOM   7365  CB   TYR C 224     -39.746  28.829  65.438  1.00 38.31      A    C
ATOM   7366  CG   TYR C 224     -39.567  28.982  66.905  1.00 36.70      A    C
ATOM   7367  CD1  TYR C 224     -40.140  29.997  67.571  1.00 32.34      A    C
ATOM   7368  CE1  TYR C 224     -39.988  30.123  68.865  1.00 33.31      A    C
ATOM   7369  CZ   TYR C 224     -39.246  29.233  69.537  1.00 34.64      A    C
ATOM   7370  OH   TYR C 224     -39.059  29.344  70.875  1.00 32.89      A    O
ATOM   7371  CE2  TYR C 224     -38.665  28.221  68.904  1.00 35.65      A    C
ATOM   7372  CD2  TYR C 224     -38.826  28.096  67.611  1.00 35.22      A    C
ATOM   7373  C    TYR C 224     -41.529  28.751  63.711  1.00 39.05      A    C
ATOM   7374  O    TYR C 224     -41.803  29.887  63.524  1.00 39.81      A    O
ATOM   7375  N    ARG C 225     -41.688  27.850  62.773  1.00 38.69      A    N
ATOM   7376  CA   ARG C 225     -42.086  28.302  61.468  1.00 39.44      A    C
ATOM   7377  CB   ARG C 225     -41.945  27.173  60.490  1.00 39.09      A    C
ATOM   7378  CG   ARG C 225     -41.832  25.855  61.143  1.00 39.01      A    C
ATOM   7379  CD   ARG C 225     -41.264  24.846  60.239  1.00 38.10      A    C
ATOM   7380  NE   ARG C 225     -41.751  23.524  60.531  1.00 45.16      A    N
ATOM   7381  CZ   ARG C 225     -41.844  23.013  61.743  1.00 45.08      A    C
ATOM   7382  NH1  ARG C 225     -41.450  23.708  62.771  1.00 44.02      A    N
ATOM   7383  NH2  ARG C 225     -42.309  21.808  61.922  1.00 42.52      A    N
ATOM   7384  C    ARG C 225     -43.506  28.891  61.391  1.00 40.57      A    C
ATOM   7385  O    ARG C 225     -44.526  28.256  61.600  1.00 41.51      A    O
ATOM   7386  N    ALA C 226     -43.470  30.188  61.101  1.00 41.17      A    N
ATOM   7387  CA   ALA C 226     -44.548  31.111  60.837  1.00 38.38      A    C
ATOM   7388  CB   ALA C 226     -44.463  32.199  61.783  1.00 36.69      A    C
ATOM   7389  C    ALA C 226     -44.319  31.627  59.417  1.00 36.93      A    C
ATOM   7390  O    ALA C 226     -44.573  32.753  59.068  1.00 33.76      A    O
ATOM   7391  N    ALA C 227     -43.721  30.771  58.631  1.00 36.98      A    N
ATOM   7392  CA   ALA C 227     -43.274  31.116  57.317  1.00 37.84      A    C
ATOM   7393  CB   ALA C 227     -42.314  30.084  56.808  1.00 35.53      A    C
ATOM   7394  C    ALA C 227     -44.383  31.435  56.329  1.00 38.24      A    C
ATOM   7395  O    ALA C 227     -44.257  32.308  55.521  1.00 38.43      A    O
ATOM   7396  N    THR C 228     -45.459  30.684  56.390  1.00 38.76      A    N
ATOM   7397  CA   THR C 228     -46.545  30.892  55.487  1.00 40.72      A    C
ATOM   7398  CB   THR C 228     -47.680  29.909  55.683  1.00 41.66      A    C
ATOM   7399  OG1  THR C 228     -48.754  30.216  54.783  1.00 40.96      A    O
ATOM   7400  CG2  THR C 228     -48.180  29.982  57.061  1.00 42.70      A    C
ATOM   7401  C    THR C 228     -47.028  32.211  55.844  1.00 40.85      A    C
```

Appendix 1

```
ATOM   7402  O    THR C 228     -47.474  32.944  55.031  1.00  40.36      A    O
ATOM   7403  N    ARG C 229     -46.827  32.494  57.104  1.00  42.17      A    N
ATOM   7404  CA   ARG C 229     -47.785  33.049  57.983  1.00  43.71      A    C
ATOM   7405  CB   ARG C 229     -47.440  32.731  59.413  1.00  44.30      A    C
ATOM   7406  CG   ARG C 229     -48.265  31.645  59.858  1.00  47.64      A    C
ATOM   7407  CD   ARG C 229     -49.685  32.105  59.744  1.00  60.43      A    C
ATOM   7408  NE   ARG C 229     -49.843  33.407  60.395  1.00  68.95      A    N
ATOM   7409  CZ   ARG C 229     -50.988  34.072  60.537  1.00  72.02      A    C
ATOM   7410  NH1  ARG C 229     -52.127  33.560  60.098  1.00  70.74      A    N
ATOM   7411  NH2  ARG C 229     -50.989  35.251  61.141  1.00  71.83      A    N
ATOM   7412  C    ARG C 229     -47.716  34.455  57.648  1.00  41.47      A    C
ATOM   7413  O    ARG C 229     -47.693  35.354  58.449  1.00  40.72      A    O
ATOM   7414  N    ALA C 230     -47.718  34.546  56.352  1.00  40.89      A    N
ATOM   7415  CA   ALA C 230     -47.727  35.746  55.620  1.00  38.99      A    C
ATOM   7416  CB   ALA C 230     -48.359  36.847  56.362  1.00  38.99      A    C
ATOM   7417  C    ALA C 230     -46.351  36.045  55.338  1.00  37.00      A    C
ATOM   7418  O    ALA C 230     -46.131  36.885  54.512  1.00  39.81      A    O
ATOM   7419  N    TRP C 231     -45.373  35.365  55.892  1.00  32.80      A    N
ATOM   7420  CA   TRP C 231     -44.158  35.871  55.368  1.00  31.37      A    C
ATOM   7421  CB   TRP C 231     -42.905  35.244  55.935  1.00  31.91      A    C
ATOM   7422  CG   TRP C 231     -41.790  35.932  55.357  1.00  27.87      A    C
ATOM   7423  CD1  TRP C 231     -41.560  37.224  55.437  1.00  28.95      A    C
ATOM   7424  NE1  TRP C 231     -40.477  37.558  54.725  1.00  28.09      A    N
ATOM   7425  CE2  TRP C 231     -39.980  36.440  54.147  1.00  22.03      A    C
ATOM   7426  CD2  TRP C 231     -40.802  35.401  54.511  1.00  24.86      A    C
ATOM   7427  CE3  TRP C 231     -40.513  34.141  54.049  1.00  19.98      A    C
ATOM   7428  CZ3  TRP C 231     -39.456  33.987  53.275  1.00  22.41      A    C
ATOM   7429  CH2  TRP C 231     -38.658  35.032  52.943  1.00  19.52      A    C
ATOM   7430  CZ2  TRP C 231     -38.907  36.268  53.369  1.00  20.53      A    C
ATOM   7431  C    TRP C 231     -44.235  35.608  53.895  1.00  30.70      A    C
ATOM   7432  O    TRP C 231     -44.147  36.496  53.112  1.00  27.88      A    O
ATOM   7433  N    LEU C 232     -44.462  34.370  53.535  1.00  30.12      A    N
ATOM   7434  CA   LEU C 232     -44.647  34.019  52.168  1.00  31.68      A    C
ATOM   7435  CB   LEU C 232     -44.723  32.537  52.017  1.00  31.73      A    C
ATOM   7436  CG   LEU C 232     -43.443  31.796  52.290  1.00  32.45      A    C
ATOM   7437  CD1  LEU C 232     -43.750  30.392  52.388  1.00  30.66      A    C
ATOM   7438  CD2  LEU C 232     -42.456  32.032  51.246  1.00  29.74      A    C
ATOM   7439  C    LEU C 232     -45.848  34.643  51.556  1.00  33.80      A    C
ATOM   7440  O    LEU C 232     -45.813  34.989  50.444  1.00  35.83      A    O
ATOM   7441  N    ASP C 233     -46.935  34.764  52.271  1.00  35.87      A    N
ATOM   7442  CA   ASP C 233     -48.083  35.459  51.737  1.00  37.31      A    C
ATOM   7443  CB   ASP C 233     -49.293  35.250  52.630  1.00  37.80      A    C
ATOM   7444  CG   ASP C 233     -49.902  33.906  52.482  1.00  40.47      A    C
ATOM   7445  OD1  ASP C 233     -49.404  33.070  51.748  1.00  42.46      A    O
ATOM   7446  OD2  ASP C 233     -50.912  33.670  53.121  1.00  48.04      A    O-1
ATOM   7447  C    ASP C 233     -47.855  36.935  51.526  1.00  37.19      A    C
ATOM   7448  O    ASP C 233     -48.306  37.520  50.568  1.00  37.91      A    O
ATOM   7449  N    PHE C 234     -47.202  37.540  52.492  1.00  37.20      A    N
ATOM   7450  CA   PHE C 234     -46.885  38.955  52.504  1.00  35.95      A    C
ATOM   7451  CB   PHE C 234     -46.297  39.308  53.858  1.00  34.66      A    C
ATOM   7452  CG   PHE C 234     -45.742  40.672  53.951  1.00  36.03      A    C
ATOM   7453  CD1  PHE C 234     -46.537  41.744  53.999  1.00  36.94      A    C
ATOM   7454  CE1  PHE C 234     -46.015  42.948  54.094  1.00  35.81      A    C
ATOM   7455  CZ   PHE C 234     -44.711  43.109  54.162  1.00  31.23      A    C
```

Appendix 1

```
ATOM   7456  CE2 PHE C 234     -43.924  42.078  54.134  1.00 30.00      A  C
ATOM   7457  CD2 PHE C 234     -44.418  40.871  54.035  1.00 33.62      A  C
ATOM   7458  C   PHE C 234     -45.956  39.362  51.403  1.00 34.82      A  C
ATOM   7459  O   PHE C 234     -46.123  40.370  50.793  1.00 34.81      A  O
ATOM   7460  N   ILE C 235     -44.941  38.572  51.154  1.00 34.75      A  N
ATOM   7461  CA  ILE C 235     -43.971  38.919  50.143  1.00 34.76      A  C
ATOM   7462  CB  ILE C 235     -42.612  38.274  50.350  1.00 33.63      A  C
ATOM   7463  CG1 ILE C 235     -42.672  36.782  50.233  1.00 32.65      A  C
ATOM   7464  CD1 ILE C 235     -41.381  36.199  50.081  1.00 29.50      A  C
ATOM   7465  CG2 ILE C 235     -42.115  38.585  51.663  1.00 34.52      A  C
ATOM   7466  C   ILE C 235     -44.471  38.886  48.715  1.00 35.75      A  C
ATOM   7467  O   ILE C 235     -43.920  39.487  47.862  1.00 34.91      A  O
ATOM   7468  N   GLN C 236     -45.573  38.204  48.508  1.00 37.53      A  N
ATOM   7469  CA  GLN C 236     -46.236  38.129  47.236  1.00 39.33      A  C
ATOM   7470  CB  GLN C 236     -46.928  36.804  47.132  1.00 39.08      A  C
ATOM   7471  CG  GLN C 236     -46.122  35.675  46.701  1.00 42.09      A  C
ATOM   7472  CD  GLN C 236     -46.890  34.413  46.793  1.00 44.36      A  C
ATOM   7473  OE1 GLN C 236     -47.878  34.348  47.462  1.00 44.45      A  O
ATOM   7474  NE2 GLN C 236     -46.439  33.408  46.127  1.00 45.77      A  N
ATOM   7475  C   GLN C 236     -47.262  39.209  46.994  1.00 40.25      A  C
ATOM   7476  O   GLN C 236     -47.741  39.340  45.916  1.00 40.00      A  O
ATOM   7477  N   LYS C 237     -47.609  39.971  48.009  1.00 42.68      A  N
ATOM   7478  CA  LYS C 237     -48.428  41.161  47.861  1.00 43.96      A  C
ATOM   7479  CB  LYS C 237     -49.122  41.462  49.168  1.00 44.87      A  C
ATOM   7480  CG  LYS C 237     -50.486  40.879  49.388  1.00 48.15      A  C
ATOM   7481  CD  LYS C 237     -51.429  41.947  49.930  1.00 54.09      A  C
ATOM   7482  CE  LYS C 237     -51.916  41.690  51.333  1.00 56.16      A  C
ATOM   7483  NZ  LYS C 237     -51.321  40.489  51.943  1.00 56.89      A  N
ATOM   7484  C   LYS C 237     -47.578  42.370  47.548  1.00 44.98      A  C
ATOM   7485  O   LYS C 237     -47.311  43.150  48.413  1.00 45.54      A  O
ATOM   7486  N   ASP C 238     -47.077  42.494  46.339  1.00 46.40      A  N
ATOM   7487  CA  ASP C 238     -46.472  43.741  45.836  1.00 48.00      A  C
ATOM   7488  CB  ASP C 238     -47.436  44.937  45.862  1.00 49.36      A  C
ATOM   7489  CG  ASP C 238     -47.145  45.883  46.943  1.00 52.08      A  C
ATOM   7490  OD1 ASP C 238     -46.053  45.824  47.463  1.00 52.52      A  O
ATOM   7491  OD2 ASP C 238     -48.012  46.678  47.292  1.00 53.46      A  O-1
ATOM   7492  C   ASP C 238     -45.072  44.079  46.340  1.00 45.88      A  C
ATOM   7493  O   ASP C 238     -44.489  45.066  45.970  1.00 45.53      A  O
ATOM   7494  N   LEU C 239     -44.530  43.183  47.129  1.00 43.44      A  N
ATOM   7495  CA  LEU C 239     -43.120  43.069  47.284  1.00 40.62      A  C
ATOM   7496  CB  LEU C 239     -42.796  42.295  48.526  1.00 40.26      A  C
ATOM   7497  CG  LEU C 239     -42.036  43.095  49.543  1.00 40.77      A  C
ATOM   7498  CD1 LEU C 239     -42.597  44.415  49.613  1.00 44.38      A  C
ATOM   7499  CD2 LEU C 239     -42.085  42.475  50.848  1.00 39.63      A  C
ATOM   7500  C   LEU C 239     -42.573  42.387  46.057  1.00 39.08      A  C
ATOM   7501  O   LEU C 239     -41.412  42.419  45.804  1.00 38.90      A  O
ATOM   7502  N   ILE C 240     -43.443  41.789  45.278  1.00 36.95      A  N
ATOM   7503  CA  ILE C 240     -43.023  41.055  44.114  1.00 36.29      A  C
ATOM   7504  CB  ILE C 240     -43.397  39.608  44.261  1.00 36.01      A  C
ATOM   7505  CG1 ILE C 240     -42.439  38.724  43.493  1.00 35.96      A  C
ATOM   7506  CD1 ILE C 240     -42.347  37.408  44.018  1.00 33.12      A  C
ATOM   7507  CG2 ILE C 240     -44.706  39.417  43.722  1.00 37.03      A  C
ATOM   7508  C   ILE C 240     -43.720  41.545  42.882  1.00 34.45      A  C
ATOM   7509  O   ILE C 240     -44.799  41.968  42.960  1.00 35.54      A  O
```

Appendix 1

```
ATOM   7510  N   ASP C 241     -43.091  41.465  41.733  1.00 32.83      A  N
ATOM   7511  CA  ASP C 241     -43.806  41.517  40.498  1.00 32.81      A  C
ATOM   7512  CB  ASP C 241     -42.972  42.179  39.446  1.00 31.83      A  C
ATOM   7513  CG  ASP C 241     -43.718  42.436  38.190  1.00 37.36      A  C
ATOM   7514  OD1 ASP C 241     -44.619  41.690  37.863  1.00 37.32      A  O
ATOM   7515  OD2 ASP C 241     -43.396  43.388  37.509  1.00 38.24      A  O-1
ATOM   7516  C   ASP C 241     -44.016  40.067  40.135  1.00 32.87      A  C
ATOM   7517  O   ASP C 241     -43.087  39.366  39.883  1.00 33.09      A  O
ATOM   7518  N   PRO C 242     -45.246  39.602  40.184  1.00 32.00      A  N
ATOM   7519  CA  PRO C 242     -45.558  38.220  39.896  1.00 31.53      A  C
ATOM   7520  CB  PRO C 242     -46.999  38.124  40.293  1.00 30.11      A  C
ATOM   7521  CG  PRO C 242     -47.471  39.391  40.269  1.00 29.93      A  C
ATOM   7522  CD  PRO C 242     -46.453  40.334  40.522  1.00 30.83      A  C
ATOM   7523  C   PRO C 242     -45.334  37.826  38.459  1.00 32.75      A  C
ATOM   7524  O   PRO C 242     -44.931  36.750  38.183  1.00 33.49      A  O
ATOM   7525  N   GLU C 243     -45.630  38.709  37.543  1.00 34.37      A  N
ATOM   7526  CA  GLU C 243     -45.358  38.467  36.159  1.00 36.20      A  C
ATOM   7527  CB  GLU C 243     -46.096  39.467  35.287  1.00 37.73      A  C
ATOM   7528  CG  GLU C 243     -47.287  40.107  35.977  1.00 43.66      A  C
ATOM   7529  CD  GLU C 243     -48.470  39.203  36.036  1.00 51.60      A  C
ATOM   7530  OE1 GLU C 243     -48.533  38.276  35.248  1.00 55.60      A  O
ATOM   7531  OE2 GLU C 243     -49.342  39.392  36.870  1.00 54.57      A  O-1
ATOM   7532  C   GLU C 243     -43.881  38.356  35.817  1.00 35.84      A  C
ATOM   7533  O   GLU C 243     -43.524  37.549  35.033  1.00 35.23      A  O
ATOM   7534  N   ARG C 244     -43.020  39.150  36.424  1.00 35.20      A  N
ATOM   7535  CA  ARG C 244     -41.590  38.983  36.242  1.00 33.60      A  C
ATOM   7536  CB  ARG C 244     -40.902  40.332  36.205  1.00 33.28      A  C
ATOM   7537  CG  ARG C 244     -41.198  41.097  34.982  1.00 36.01      A  C
ATOM   7538  CD  ARG C 244     -40.694  42.505  34.986  1.00 39.54      A  C
ATOM   7539  NE  ARG C 244     -41.359  43.321  35.981  1.00 46.42      A  N
ATOM   7540  CZ  ARG C 244     -41.118  44.601  36.175  1.00 49.06      A  C
ATOM   7541  NH1 ARG C 244     -40.253  45.237  35.423  1.00 49.38      A  N
ATOM   7542  NH2 ARG C 244     -41.760  45.250  37.112  1.00 47.61      A  N
ATOM   7543  C   ARG C 244     -40.844  38.045  37.191  1.00 32.50      A  C
ATOM   7544  O   ARG C 244     -39.733  37.720  36.942  1.00 31.42      A  O
ATOM   7545  N   GLY C 245     -41.464  37.601  38.267  1.00 31.99      A  N
ATOM   7546  CA  GLY C 245     -40.807  36.808  39.276  1.00 31.55      A  C
ATOM   7547  C   GLY C 245     -39.654  37.503  39.953  1.00 32.83      A  C
ATOM   7548  O   GLY C 245     -38.630  36.924  40.160  1.00 33.04      A  O
ATOM   7549  N   ALA C 246     -39.828  38.771  40.260  1.00 32.37      A  N
ATOM   7550  CA  ALA C 246     -38.787  39.568  40.826  1.00 32.01      A  C
ATOM   7551  CB  ALA C 246     -38.259  40.463  39.783  1.00 32.15      A  C
ATOM   7552  C   ALA C 246     -39.293  40.374  41.973  1.00 31.87      A  C
ATOM   7553  O   ALA C 246     -40.264  41.040  41.842  1.00 31.23      A  O
ATOM   7554  N   PHE C 247     -38.608  40.346  43.096  1.00 30.85      A  N
ATOM   7555  CA  PHE C 247     -38.917  41.274  44.154  1.00 30.02      A  C
ATOM   7556  CB  PHE C 247     -38.382  40.799  45.481  1.00 30.23      A  C
ATOM   7557  CG  PHE C 247     -38.891  39.497  45.892  1.00 28.22      A  C
ATOM   7558  CD1 PHE C 247     -40.063  39.394  46.542  1.00 26.61      A  C
ATOM   7559  CE1 PHE C 247     -40.510  38.218  46.905  1.00 26.92      A  C
ATOM   7560  CZ  PHE C 247     -39.801  37.130  46.651  1.00 28.75      A  C
ATOM   7561  CE2 PHE C 247     -38.646  37.212  46.013  1.00 23.32      A  C
ATOM   7562  CD2 PHE C 247     -38.184  38.374  45.651  1.00 22.93      A  C
ATOM   7563  C   PHE C 247     -38.405  42.652  43.905  1.00 29.97      A  C
```

Appendix 1

```
ATOM   7564  O    PHE C 247     -37.394  42.843  43.319  1.00  29.28    A   O
ATOM   7565  N    TYR C 248     -39.127  43.616  44.422  1.00  30.23    A   N
ATOM   7566  CA   TYR C 248     -38.693  44.982  44.471  1.00  30.24    A   C
ATOM   7567  CB   TYR C 248     -39.858  45.889  44.773  1.00  28.92    A   C
ATOM   7568  CG   TYR C 248     -40.731  45.989  43.592  1.00  30.61    A   C
ATOM   7569  CD1  TYR C 248     -40.411  46.828  42.565  1.00  31.85    A   C
ATOM   7570  CE1  TYR C 248     -41.168  46.903  41.497  1.00  28.78    A   C
ATOM   7571  CZ   TYR C 248     -42.261  46.127  41.405  1.00  29.44    A   C
ATOM   7572  OH   TYR C 248     -43.024  46.206  40.311  1.00  31.72    A   O
ATOM   7573  CE2  TYR C 248     -42.601  45.284  42.395  1.00  28.63    A   C
ATOM   7574  CD2  TYR C 248     -41.848  45.211  43.472  1.00  27.34    A   C
ATOM   7575  C    TYR C 248     -37.598  45.104  45.486  1.00  29.55    A   C
ATOM   7576  O    TYR C 248     -37.411  44.240  46.253  1.00  30.98    A   O
ATOM   7577  N    LEU C 249     -36.823  46.151  45.425  1.00  29.38    A   N
ATOM   7578  CA   LEU C 249     -35.637  46.253  46.228  1.00  28.95    A   C
ATOM   7579  CB   LEU C 249     -34.866  47.474  45.758  1.00  28.86    A   C
ATOM   7580  CG   LEU C 249     -33.377  47.621  45.978  1.00  25.86    A   C
ATOM   7581  CD1  LEU C 249     -32.632  46.702  45.150  1.00  24.03    A   C
ATOM   7582  CD2  LEU C 249     -33.023  48.991  45.645  1.00  30.73    A   C
ATOM   7583  C    LEU C 249     -35.806  46.297  47.746  1.00  29.00    A   C
ATOM   7584  O    LEU C 249     -35.075  45.691  48.454  1.00  29.22    A   O
ATOM   7585  N    SER C 250     -36.744  47.065  48.229  1.00  28.55    A   N
ATOM   7586  CA   SER C 250     -36.935  47.201  49.640  1.00  29.37    A   C
ATOM   7587  CB   SER C 250     -35.907  48.121  50.258  1.00  28.36    A   C
ATOM   7588  OG   SER C 250     -35.727  49.268  49.522  1.00  26.24    A   O
ATOM   7589  C    SER C 250     -38.303  47.684  49.938  1.00  29.35    A   C
ATOM   7590  O    SER C 250     -38.969  48.156  49.089  1.00  29.47    A   O
ATOM   7591  N    TYR C 251     -38.721  47.536  51.169  1.00  30.70    A   N
ATOM   7592  CA   TYR C 251     -40.008  47.996  51.603  1.00  31.48    A   C
ATOM   7593  CB   TYR C 251     -40.915  46.811  51.882  1.00  31.76    A   C
ATOM   7594  CG   TYR C 251     -42.160  47.090  52.661  1.00  32.09    A   C
ATOM   7595  CD1  TYR C 251     -43.121  47.893  52.173  1.00  33.60    A   C
ATOM   7596  CE1  TYR C 251     -44.229  48.134  52.857  1.00  31.58    A   C
ATOM   7597  CZ   TYR C 251     -44.420  47.565  54.056  1.00  35.34    A   C
ATOM   7598  OH   TYR C 251     -45.548  47.805  54.743  1.00  34.32    A   O
ATOM   7599  CE2  TYR C 251     -43.498  46.745  54.571  1.00  36.83    A   C
ATOM   7600  CD2  TYR C 251     -42.376  46.510  53.874  1.00  37.30    A   C
ATOM   7601  C    TYR C 251     -39.736  48.825  52.821  1.00  32.06    A   C
ATOM   7602  O    TYR C 251     -38.863  48.527  53.558  1.00  31.56    A   O
ATOM   7603  N    HIS C 252     -40.451  49.912  52.975  1.00  33.04    A   N
ATOM   7604  CA   HIS C 252     -40.256  50.811  54.080  1.00  34.20    A   C
ATOM   7605  CB   HIS C 252     -39.584  52.062  53.566  1.00  32.11    A   C
ATOM   7606  CG   HIS C 252     -38.412  51.761  52.712  1.00  30.24    A   C
ATOM   7607  ND1  HIS C 252     -37.213  51.361  53.228  1.00  27.95    A   N
ATOM   7608  CE1  HIS C 252     -36.387  51.086  52.253  1.00  24.80    A   C
ATOM   7609  NE2  HIS C 252     -37.017  51.269  51.121  1.00  27.17    A   N
ATOM   7610  CD2  HIS C 252     -38.284  51.687  51.378  1.00  28.78    A   C
ATOM   7611  C    HIS C 252     -41.545  51.094  54.796  1.00  36.44    A   C
ATOM   7612  O    HIS C 252     -42.263  51.961  54.460  1.00  36.61    A   O
ATOM   7613  N    PRO C 253     -41.793  50.327  55.825  1.00  38.62    A   N
ATOM   7614  CA   PRO C 253     -43.088  50.214  56.459  1.00  40.02    A   C
ATOM   7615  CB   PRO C 253     -42.821  49.176  57.531  1.00  39.94    A   C
ATOM   7616  CG   PRO C 253     -41.414  49.078  57.631  1.00  39.33    A   C
ATOM   7617  CD   PRO C 253     -40.873  49.324  56.333  1.00  38.42    A   C
```

Appendix 1

```
ATOM   7618  C    PRO C 253     -43.683  51.436  57.109  1.00 41.87      A  C
ATOM   7619  O    PRO C 253     -44.848  51.685  56.977  1.00 42.58      A  O
ATOM   7620  N    GLU C 254     -42.936  52.164  57.882  1.00 43.46      A  N
ATOM   7621  CA   GLU C 254     -43.498  53.376  58.384  1.00 45.77      A  C
ATOM   7622  CB   GLU C 254     -42.543  53.955  59.417  1.00 46.59      A  C
ATOM   7623  CG   GLU C 254     -42.289  55.423  59.329  1.00 49.44      A  C
ATOM   7624  CD   GLU C 254     -42.871  56.157  60.484  1.00 55.58      A  C
ATOM   7625  OE1  GLU C 254     -43.534  55.543  61.317  1.00 56.90      A  O
ATOM   7626  OE2  GLU C 254     -42.686  57.359  60.575  1.00 59.69      A  O-1
ATOM   7627  C    GLU C 254     -43.712  54.384  57.298  1.00 45.65      A  C
ATOM   7628  O    GLU C 254     -44.744  54.979  57.169  1.00 45.31      A  O
ATOM   7629  N    SER C 255     -42.673  54.589  56.531  1.00 45.87      A  N
ATOM   7630  CA   SER C 255     -42.602  55.663  55.569  1.00 44.07      A  C
ATOM   7631  CB   SER C 255     -41.139  56.122  55.367  1.00 45.25      A  C
ATOM   7632  OG   SER C 255     -40.194  55.077  55.504  1.00 41.58      A  O
ATOM   7633  C    SER C 255     -43.204  55.276  54.275  1.00 42.17      A  C
ATOM   7634  O    SER C 255     -42.510  55.140  53.311  1.00 41.10      A  O
ATOM   7635  N    GLY C 256     -44.500  55.091  54.256  1.00 40.36      A  N
ATOM   7636  CA   GLY C 256     -45.112  54.605  53.067  1.00 38.92      A  C
ATOM   7637  C    GLY C 256     -44.698  53.208  52.714  1.00 39.28      A  C
ATOM   7638  O    GLY C 256     -45.046  52.316  53.432  1.00 36.77      A  O
ATOM   7639  N    ALA C 257     -43.987  53.042  51.591  1.00 38.36      A  N
ATOM   7640  CA   ALA C 257     -43.859  51.751  50.979  1.00 36.73      A  C
ATOM   7641  CB   ALA C 257     -45.119  51.446  50.310  1.00 36.76      A  C
ATOM   7642  C    ALA C 257     -42.626  51.260  50.170  1.00 35.92      A  C
ATOM   7643  O    ALA C 257     -41.635  51.033  50.730  1.00 36.15      A  O
ATOM   7644  N    VAL C 258     -42.734  51.012  48.870  1.00 34.44      A  N
ATOM   7645  CA   VAL C 258     -41.795  50.142  48.132  1.00 32.30      A  C
ATOM   7646  CB   VAL C 258     -42.581  49.051  47.433  1.00 32.61      A  C
ATOM   7647  CG1  VAL C 258     -41.726  48.012  46.878  1.00 27.35      A  C
ATOM   7648  CG2  VAL C 258     -43.549  48.491  48.340  1.00 34.23      A  C
ATOM   7649  C    VAL C 258     -40.859  50.754  47.082  1.00 31.93      A  C
ATOM   7650  O    VAL C 258     -41.287  51.361  46.152  1.00 31.15      A  O
ATOM   7651  N    LYS C 259     -39.571  50.541  47.222  1.00 30.27      A  N
ATOM   7652  CA   LYS C 259     -38.652  51.058  46.246  1.00 30.38      A  C
ATOM   7653  CB   LYS C 259     -37.225  50.849  46.696  1.00 29.96      A  C
ATOM   7654  CG   LYS C 259     -36.597  52.059  47.268  1.00 29.99      A  C
ATOM   7655  CD   LYS C 259     -35.263  51.791  47.785  1.00 29.34      A  C
ATOM   7656  CE   LYS C 259     -34.938  52.685  48.909  1.00 28.93      A  C
ATOM   7657  NZ   LYS C 259     -33.528  52.660  49.158  1.00 23.79      A  N
ATOM   7658  C    LYS C 259     -38.857  50.323  44.986  1.00 30.79      A  C
ATOM   7659  O    LYS C 259     -38.736  49.162  44.952  1.00 32.73      A  O
ATOM   7660  N    PRO C 260     -39.057  51.052  43.919  1.00 31.57      A  N
ATOM   7661  CA   PRO C 260     -39.715  50.616  42.702  1.00 31.60      A  C
ATOM   7662  CB   PRO C 260     -40.441  51.865  42.285  1.00 31.72      A  C
ATOM   7663  CG   PRO C 260     -39.656  52.897  42.761  1.00 32.66      A  C
ATOM   7664  CD   PRO C 260     -39.159  52.495  44.063  1.00 31.45      A  C
ATOM   7665  C    PRO C 260     -38.826  50.109  41.565  1.00 30.95      A  C
ATOM   7666  O    PRO C 260     -39.104  50.284  40.423  1.00 32.11      A  O
ATOM   7667  N    TRP C 261     -37.761  49.437  41.925  1.00 30.45      A  N
ATOM   7668  CA   TRP C 261     -36.907  48.791  40.992  1.00 29.35      A  C
ATOM   7669  CB   TRP C 261     -35.512  49.396  41.038  1.00 28.96      A  C
ATOM   7670  CG   TRP C 261     -35.447  50.835  40.710  1.00 29.53      A  C
ATOM   7671  CD1  TRP C 261     -35.325  51.365  39.508  1.00 30.14      A  C
```

Appendix 1

| | | | | | | | | | | | |
|---|---|---|---|---|---|---|---|---|---|---|---|
| ATOM | 7672 | NE1 | TRP | C 261 | -35.313 | 52.711 | 39.570 | 1.00 | 30.89 | A | N |
| ATOM | 7673 | CE2 | TRP | C 261 | -35.407 | 53.082 | 40.867 | 1.00 | 32.42 | A | C |
| ATOM | 7674 | CD2 | TRP | C 261 | -35.478 | 51.919 | 41.617 | 1.00 | 31.73 | A | C |
| ATOM | 7675 | CE3 | TRP | C 261 | -35.569 | 52.021 | 42.998 | 1.00 | 30.39 | A | C |
| ATOM | 7676 | CZ3 | TRP | C 261 | -35.580 | 53.257 | 43.554 | 1.00 | 30.05 | A | C |
| ATOM | 7677 | CH2 | TRP | C 261 | -35.501 | 54.391 | 42.785 | 1.00 | 33.52 | A | C |
| ATOM | 7678 | CZ2 | TRP | C 261 | -35.421 | 54.327 | 41.434 | 1.00 | 35.18 | A | C |
| ATOM | 7679 | C | TRP | C 261 | -36.899 | 47.359 | 41.446 | 1.00 | 29.46 | A | C |
| ATOM | 7680 | O | TRP | C 261 | -36.941 | 47.093 | 42.607 | 1.00 | 29.85 | A | O |
| ATOM | 7681 | N | ILE | C 262 | -36.869 | 46.429 | 40.525 | 1.00 | 29.02 | A | N |
| ATOM | 7682 | CA | ILE | C 262 | -36.740 | 45.047 | 40.881 | 1.00 | 28.38 | A | C |
| ATOM | 7683 | CB | ILE | C 262 | -37.534 | 44.160 | 39.959 | 1.00 | 29.11 | A | C |
| ATOM | 7684 | CG1 | ILE | C 262 | -37.143 | 44.393 | 38.524 | 1.00 | 27.91 | A | C |
| ATOM | 7685 | CD1 | ILE | C 262 | -37.693 | 43.439 | 37.641 | 1.00 | 23.97 | A | C |
| ATOM | 7686 | CG2 | ILE | C 262 | -38.977 | 44.381 | 40.150 | 1.00 | 27.99 | A | C |
| ATOM | 7687 | C | ILE | C 262 | -35.304 | 44.616 | 40.896 | 1.00 | 28.19 | A | C |
| ATOM | 7688 | O | ILE | C 262 | -34.547 | 45.077 | 40.121 | 1.00 | 28.25 | A | O |
| ATOM | 7689 | N | SER | C 263 | -34.931 | 43.744 | 41.809 | 1.00 | 28.50 | A | N |
| ATOM | 7690 | CA | SER | C 263 | -33.536 | 43.353 | 41.949 | 1.00 | 28.24 | A | C |
| ATOM | 7691 | CB | SER | C 263 | -33.066 | 43.689 | 43.351 | 1.00 | 29.04 | A | C |
| ATOM | 7692 | OG | SER | C 263 | -31.718 | 43.413 | 43.481 | 1.00 | 30.04 | A | O |
| ATOM | 7693 | C | SER | C 263 | -33.245 | 41.905 | 41.703 | 1.00 | 27.76 | A | C |
| ATOM | 7694 | O | SER | C 263 | -33.774 | 41.067 | 42.354 | 1.00 | 28.31 | A | O |
| ATOM | 7695 | N | ALA | C 264 | -32.390 | 41.614 | 40.748 | 1.00 | 26.49 | A | N |
| ATOM | 7696 | CA | ALA | C 264 | -32.025 | 40.250 | 40.485 | 1.00 | 25.41 | A | C |
| ATOM | 7697 | CB | ALA | C 264 | -31.323 | 40.170 | 39.231 | 1.00 | 26.16 | A | C |
| ATOM | 7698 | C | ALA | C 264 | -31.247 | 39.529 | 41.553 | 1.00 | 24.81 | A | C |
| ATOM | 7699 | O | ALA | C 264 | -31.539 | 38.421 | 41.849 | 1.00 | 25.28 | A | O |
| ATOM | 7700 | N | TYR | C 265 | -30.243 | 40.161 | 42.103 | 1.00 | 24.84 | A | N |
| ATOM | 7701 | CA | TYR | C 265 | -29.509 | 39.555 | 43.182 | 1.00 | 25.13 | A | C |
| ATOM | 7702 | CB | TYR | C 265 | -28.232 | 40.326 | 43.506 | 1.00 | 25.30 | A | C |
| ATOM | 7703 | CG | TYR | C 265 | -28.281 | 41.082 | 44.786 | 1.00 | 24.82 | A | C |
| ATOM | 7704 | CD1 | TYR | C 265 | -27.925 | 40.501 | 45.954 | 1.00 | 25.98 | A | C |
| ATOM | 7705 | CE1 | TYR | C 265 | -28.005 | 41.160 | 47.078 | 1.00 | 24.20 | A | C |
| ATOM | 7706 | CZ | TYR | C 265 | -28.425 | 42.424 | 47.070 | 1.00 | 26.27 | A | C |
| ATOM | 7707 | OH | TYR | C 265 | -28.500 | 43.090 | 48.225 | 1.00 | 30.50 | A | O |
| ATOM | 7708 | CE2 | TYR | C 265 | -28.731 | 43.014 | 45.945 | 1.00 | 21.62 | A | C |
| ATOM | 7709 | CD2 | TYR | C 265 | -28.707 | 42.361 | 44.830 | 1.00 | 23.91 | A | C |
| ATOM | 7710 | C | TYR | C 265 | -30.414 | 39.340 | 44.389 | 1.00 | 25.06 | A | C |
| ATOM | 7711 | O | TYR | C 265 | -30.310 | 38.375 | 45.068 | 1.00 | 25.29 | A | O |
| ATOM | 7712 | N | THR | C 266 | -31.325 | 40.251 | 44.625 | 1.00 | 25.44 | A | N |
| ATOM | 7713 | CA | THR | C 266 | -32.256 | 40.128 | 45.701 | 1.00 | 25.91 | A | C |
| ATOM | 7714 | CB | THR | C 266 | -33.163 | 41.321 | 45.740 | 1.00 | 25.17 | A | C |
| ATOM | 7715 | OG1 | THR | C 266 | -32.416 | 42.476 | 46.028 | 1.00 | 26.31 | A | O |
| ATOM | 7716 | CG2 | THR | C 266 | -34.161 | 41.151 | 46.768 | 1.00 | 24.16 | A | C |
| ATOM | 7717 | C | THR | C 266 | -33.161 | 38.943 | 45.556 | 1.00 | 27.16 | A | C |
| ATOM | 7718 | O | THR | C 266 | -33.403 | 38.271 | 46.503 | 1.00 | 27.81 | A | O |
| ATOM | 7719 | N | THR | C 267 | -33.710 | 38.759 | 44.369 | 1.00 | 27.27 | A | N |
| ATOM | 7720 | CA | THR | C 267 | -34.537 | 37.629 | 44.022 | 1.00 | 25.19 | A | C |
| ATOM | 7721 | CB | THR | C 267 | -35.226 | 37.849 | 42.665 | 1.00 | 25.79 | A | C |
| ATOM | 7722 | OG1 | THR | C 267 | -35.812 | 39.131 | 42.638 | 1.00 | 26.60 | A | O |
| ATOM | 7723 | CG2 | THR | C 267 | -36.264 | 36.896 | 42.471 | 1.00 | 15.36 | A | C |
| ATOM | 7724 | C | THR | C 267 | -33.826 | 36.314 | 43.991 | 1.00 | 25.80 | A | C |
| ATOM | 7725 | O | THR | C 267 | -34.330 | 35.353 | 44.433 | 1.00 | 27.21 | A | O |

Appendix 1

```
ATOM   7726  N    ALA C 268     -32.653  36.278  43.417  1.00 25.47      A  N
ATOM   7727  CA   ALA C 268     -31.957  35.046  43.284  1.00 25.36      A  C
ATOM   7728  CB   ALA C 268     -30.746  35.252  42.524  1.00 25.93      A  C
ATOM   7729  C    ALA C 268     -31.628  34.454  44.615  1.00 26.82      A  C
ATOM   7730  O    ALA C 268     -31.698  33.283  44.785  1.00 28.05      A  O
ATOM   7731  N    TRP C 269     -31.211  35.287  45.546  1.00 26.80      A  N
ATOM   7732  CA   TRP C 269     -30.917  34.887  46.894  1.00 25.98      A  C
ATOM   7733  CB   TRP C 269     -30.182  36.050  47.573  1.00 26.35      A  C
ATOM   7734  CG   TRP C 269     -29.911  36.012  49.021  1.00 28.39      A  C
ATOM   7735  CD1  TRP C 269     -30.295  35.089  49.880  1.00 32.36      A  C
ATOM   7736  NE1  TRP C 269     -29.893  35.386  51.121  1.00 36.15      A  N
ATOM   7737  CE2  TRP C 269     -29.206  36.559  51.090  1.00 38.78      A  C
ATOM   7738  CD2  TRP C 269     -29.194  36.979  49.777  1.00 37.34      A  C
ATOM   7739  CE3  TRP C 269     -28.541  38.179  49.469  1.00 39.42      A  C
ATOM   7740  CZ3  TRP C 269     -27.949  38.880  50.471  1.00 35.35      A  C
ATOM   7741  CH2  TRP C 269     -27.981  38.437  51.763  1.00 35.40      A  C
ATOM   7742  CZ2  TRP C 269     -28.596  37.284  52.102  1.00 36.41      A  C
ATOM   7743  C    TRP C 269     -32.140  34.445  47.651  1.00 26.30      A  C
ATOM   7744  O    TRP C 269     -32.140  33.411  48.248  1.00 26.37      A  O
ATOM   7745  N    THR C 270     -33.197  35.226  47.606  1.00 25.68      A  N
ATOM   7746  CA   THR C 270     -34.426  34.905  48.304  1.00 25.83      A  C
ATOM   7747  CB   THR C 270     -35.460  36.005  48.133  1.00 26.91      A  C
ATOM   7748  OG1  THR C 270     -34.859  37.241  48.380  1.00 24.44      A  O
ATOM   7749  CG2  THR C 270     -36.555  35.871  49.079  1.00 25.60      A  C
ATOM   7750  C    THR C 270     -35.081  33.656  47.824  1.00 25.90      A  C
ATOM   7751  O    THR C 270     -35.567  32.910  48.569  1.00 25.18      A  O
ATOM   7752  N    LEU C 271     -35.090  33.474  46.536  1.00 26.42      A  N
ATOM   7753  CA   LEU C 271     -35.629  32.298  45.942  1.00 25.67      A  C
ATOM   7754  CB   LEU C 271     -35.694  32.474  44.437  1.00 26.07      A  C
ATOM   7755  CG   LEU C 271     -37.032  32.699  43.772  1.00 26.27      A  C
ATOM   7756  CD1  LEU C 271     -38.013  33.292  44.656  1.00 22.46      A  C
ATOM   7757  CD2  LEU C 271     -36.891  33.520  42.572  1.00 22.20      A  C
ATOM   7758  C    LEU C 271     -34.878  31.056  46.316  1.00 25.03      A  C
ATOM   7759  O    LEU C 271     -35.457  30.053  46.546  1.00 24.77      A  O
ATOM   7760  N    ALA C 272     -33.575  31.121  46.377  1.00 25.83      A  N
ATOM   7761  CA   ALA C 272     -32.809  29.972  46.732  1.00 25.84      A  C
ATOM   7762  CB   ALA C 272     -31.377  30.266  46.582  1.00 25.20      A  C
ATOM   7763  C    ALA C 272     -33.095  29.497  48.129  1.00 26.27      A  C
ATOM   7764  O    ALA C 272     -33.123  28.348  48.381  1.00 25.71      A  O
ATOM   7765  N    MET C 273     -33.255  30.419  49.046  1.00 27.41      A  N
ATOM   7766  CA   MET C 273     -33.615  30.118  50.400  1.00 28.50      A  C
ATOM   7767  CB   MET C 273     -33.397  31.324  51.271  1.00 30.32      C  C
ATOM   7768  CG   MET C 273     -32.077  31.935  51.101  1.00 33.77      C  C
ATOM   7769  SD   MET C 273     -30.866  31.543  52.295  1.00 41.69      C  S
ATOM   7770  CE   MET C 273     -31.664  31.991  53.754  1.00 43.17      C  C
ATOM   7771  C    MET C 273     -34.998  29.595  50.606  1.00 28.11      A  C
ATOM   7772  O    MET C 273     -35.207  28.697  51.365  1.00 28.83      A  O
ATOM   7773  N    VAL C 274     -35.944  30.186  49.921  1.00 26.57      A  N
ATOM   7774  CA   VAL C 274     -37.315  29.788  50.013  1.00 25.94      A  C
ATOM   7775  CB   VAL C 274     -38.233  30.728  49.295  1.00 26.07      A  C
ATOM   7776  CG1  VAL C 274     -39.598  30.214  49.331  1.00 25.58      A  C
ATOM   7777  CG2  VAL C 274     -38.204  32.020  49.914  1.00 23.49      A  C
ATOM   7778  C    VAL C 274     -37.481  28.382  49.528  1.00 27.08      A  C
ATOM   7779  O    VAL C 274     -38.245  27.659  50.032  1.00 26.83      A  O
```

Appendix 1

```
ATOM   7780  N    HIS C 275     -36.701  27.977  48.568  1.00 28.05      A  N
ATOM   7781  CA   HIS C 275     -36.854  26.686  47.990  1.00 30.20      A  C
ATOM   7782  CB   HIS C 275     -35.833  26.483  46.904  1.00 29.85      A  C
ATOM   7783  CG   HIS C 275     -36.118  25.310  46.032  1.00 31.00      A  C
ATOM   7784  ND1  HIS C 275     -35.286  24.229  45.955  1.00 28.94      A  N
ATOM   7785  CE1  HIS C 275     -35.786  23.354  45.114  1.00 29.39      A  C
ATOM   7786  NE2  HIS C 275     -36.919  23.823  44.653  1.00 30.37      A  N
ATOM   7787  CD2  HIS C 275     -37.145  25.051  45.200  1.00 31.94      A  C
ATOM   7788  C    HIS C 275     -36.678  25.652  49.055  1.00 31.67      A  C
ATOM   7789  O    HIS C 275     -37.214  24.590  48.974  1.00 32.34      A  O
ATOM   7790  N    GLY C 276     -35.844  25.948  50.027  1.00 32.49      A  N
ATOM   7791  CA   GLY C 276     -35.718  25.093  51.175  1.00 33.38      A  C
ATOM   7792  C    GLY C 276     -36.923  24.998  52.069  1.00 35.50      A  C
ATOM   7793  O    GLY C 276     -37.240  23.956  52.498  1.00 37.07      A  O
ATOM   7794  N    MET C 277     -37.545  26.097  52.412  1.00 34.53      A  N
ATOM   7795  CA   MET C 277     -38.800  26.069  53.099  1.00 35.43      A  C
ATOM   7796  CB   MET C 277     -39.048  27.431  53.699  1.00 35.24      C  C
ATOM   7797  CG   MET C 277     -38.226  27.743  54.869  1.00 37.31      C  C
ATOM   7798  SD   MET C 277     -37.577  29.364  54.844  1.00 39.36      C  S
ATOM   7799  CE   MET C 277     -38.788  30.192  55.712  1.00 35.81      C  C
ATOM   7800  C    MET C 277     -40.040  25.680  52.308  1.00 36.68      A  C
ATOM   7801  O    MET C 277     -40.844  24.900  52.731  1.00 37.74      A  O
ATOM   7802  N    ASP C 278     -40.228  26.303  51.172  1.00 36.19      A  N
ATOM   7803  CA   ASP C 278     -41.391  26.087  50.351  1.00 35.89      A  C
ATOM   7804  CB   ASP C 278     -42.313  27.272  50.533  1.00 38.79      A  C
ATOM   7805  CG   ASP C 278     -43.599  27.153  49.744  1.00 43.19      A  C
ATOM   7806  OD1  ASP C 278     -43.648  26.390  48.810  1.00 48.56      A  O
ATOM   7807  OD2  ASP C 278     -44.559  27.842  50.042  1.00 48.26      A  O-1
ATOM   7808  C    ASP C 278     -41.064  25.934  48.892  1.00 34.33      A  C
ATOM   7809  O    ASP C 278     -41.142  26.866  48.185  1.00 33.69      A  O
ATOM   7810  N    PRO C 279     -40.727  24.752  48.427  1.00 33.08      A  N
ATOM   7811  CA   PRO C 279     -40.212  24.597  47.082  1.00 32.26      A  C
ATOM   7812  CB   PRO C 279     -39.868  23.126  47.017  1.00 31.46      A  C
ATOM   7813  CG   PRO C 279     -40.279  22.568  48.191  1.00 30.68      A  C
ATOM   7814  CD   PRO C 279     -40.481  23.548  49.199  1.00 31.84      A  C
ATOM   7815  C    PRO C 279     -41.168  25.006  45.970  1.00 32.56      A  C
ATOM   7816  O    PRO C 279     -40.779  25.337  44.902  1.00 33.42      A  O
ATOM   7817  N    ALA C 280     -42.435  24.954  46.240  1.00 32.20      A  N
ATOM   7818  CA   ALA C 280     -43.417  25.351  45.283  1.00 32.40      A  C
ATOM   7819  CB   ALA C 280     -44.737  25.019  45.780  1.00 30.79      A  C
ATOM   7820  C    ALA C 280     -43.330  26.812  44.963  1.00 31.94      A  C
ATOM   7821  O    ALA C 280     -43.638  27.202  43.890  1.00 33.20      A  O
ATOM   7822  N    PHE C 281     -42.974  27.617  45.940  1.00 31.79      A  N
ATOM   7823  CA   PHE C 281     -42.902  29.040  45.777  1.00 29.97      A  C
ATOM   7824  CB   PHE C 281     -42.605  29.652  47.137  1.00 28.72      A  C
ATOM   7825  CG   PHE C 281     -42.556  31.139  47.157  1.00 27.21      A  C
ATOM   7826  CD1  PHE C 281     -43.533  31.859  47.761  1.00 28.07      A  C
ATOM   7827  CE1  PHE C 281     -43.462  33.197  47.781  1.00 27.12      A  C
ATOM   7828  CZ   PHE C 281     -42.424  33.813  47.227  1.00 24.63      A  C
ATOM   7829  CE2  PHE C 281     -41.460  33.124  46.651  1.00 20.75      A  C
ATOM   7830  CD2  PHE C 281     -41.507  31.814  46.618  1.00 22.38      A  C
ATOM   7831  C    PHE C 281     -41.855  29.440  44.811  1.00 30.03      A  C
ATOM   7832  O    PHE C 281     -42.078  30.219  43.950  1.00 29.39      A  O
ATOM   7833  N    SER C 282     -40.676  28.927  44.988  1.00 30.99      A  N
```

Appendix 1

```
ATOM   7834  CA   SER C 282     -39.581  29.191  44.093  1.00  32.72      A    C
ATOM   7835  CB   SER C 282     -38.310  28.739  44.723  1.00  31.57      A    C
ATOM   7836  OG   SER C 282     -38.235  29.410  45.906  1.00  32.30      A    O
ATOM   7837  C    SER C 282     -39.738  28.634  42.719  1.00  33.98      A    C
ATOM   7838  O    SER C 282     -39.283  29.193  41.770  1.00  34.84      A    O
ATOM   7839  N    GLU C 283     -40.346  27.480  42.654  1.00  35.30      A    N
ATOM   7840  CA   GLU C 283     -40.602  26.794  41.421  1.00  36.69      A    C
ATOM   7841  CB   GLU C 283     -41.044  25.374  41.701  1.00  37.60      A    C
ATOM   7842  CG   GLU C 283     -39.921  24.395  41.860  1.00  39.43      A    C
ATOM   7843  CD   GLU C 283     -40.317  23.145  42.622  1.00  47.38      A    C
ATOM   7844  OE1  GLU C 283     -41.416  22.634  42.412  1.00  48.86      A    O
ATOM   7845  OE2  GLU C 283     -39.530  22.650  43.427  1.00  46.49      A    O-1
ATOM   7846  C    GLU C 283     -41.553  27.559  40.504  1.00  36.04      A    C
ATOM   7847  O    GLU C 283     -41.460  27.496  39.305  1.00  36.81      A    O
ATOM   7848  N    ARG C 284     -42.479  28.271  41.096  1.00  34.80      A    N
ATOM   7849  CA   ARG C 284     -43.371  29.152  40.404  1.00  33.49      A    C
ATOM   7850  CB   ARG C 284     -44.179  29.792  41.496  1.00  32.69      A    C
ATOM   7851  CG   ARG C 284     -45.357  30.558  41.157  1.00  35.76      A    C
ATOM   7852  CD   ARG C 284     -46.383  30.054  42.059  1.00  42.49      A    C
ATOM   7853  NE   ARG C 284     -47.197  31.061  42.670  1.00  47.23      A    N
ATOM   7854  CZ   ARG C 284     -48.502  30.919  42.841  1.00  52.81      A    C
ATOM   7855  NH1  ARG C 284     -49.097  29.810  42.442  1.00  47.82      A    N
ATOM   7856  NH2  ARG C 284     -49.218  31.869  43.423  1.00  49.44      A    N
ATOM   7857  C    ARG C 284     -42.662  30.285  39.715  1.00  33.99      A    C
ATOM   7858  O    ARG C 284     -42.910  30.575  38.567  1.00  34.90      A    O
ATOM   7859  N    TYR C 285     -41.800  30.961  40.443  1.00  31.10      A    N
ATOM   7860  CA   TYR C 285     -41.206  32.169  39.965  1.00  29.58      A    C
ATOM   7861  CB   TYR C 285     -41.086  33.172  41.106  1.00  30.02      A    C
ATOM   7862  CG   TYR C 285     -42.391  33.537  41.734  1.00  27.76      A    C
ATOM   7863  CD1  TYR C 285     -43.322  34.256  41.051  1.00  24.22      A    C
ATOM   7864  CE1  TYR C 285     -44.484  34.567  41.604  1.00  23.20      A    C
ATOM   7865  CZ   TYR C 285     -44.744  34.186  42.853  1.00  25.80      A    C
ATOM   7866  OH   TYR C 285     -45.915  34.486  43.435  1.00  26.67      A    O
ATOM   7867  CE2  TYR C 285     -43.836  33.481  43.546  1.00  27.33      A    C
ATOM   7868  CD2  TYR C 285     -42.684  33.171  43.003  1.00  23.85      A    C
ATOM   7869  C    TYR C 285     -39.900  32.040  39.233  1.00  28.84      A    C
ATOM   7870  O    TYR C 285     -39.505  32.920  38.559  1.00  28.94      A    O
ATOM   7871  N    TYR C 286     -39.232  30.927  39.333  1.00  28.95      A    N
ATOM   7872  CA   TYR C 286     -37.901  30.845  38.804  1.00  28.62      A    C
ATOM   7873  CB   TYR C 286     -37.315  29.496  39.173  1.00  28.15      A    C
ATOM   7874  CG   TYR C 286     -35.962  29.197  38.625  1.00  24.68      A    C
ATOM   7875  CD1  TYR C 286     -34.916  29.966  38.929  1.00  23.92      A    C
ATOM   7876  CE1  TYR C 286     -33.724  29.705  38.467  1.00  24.26      A    C
ATOM   7877  CZ   TYR C 286     -33.522  28.663  37.692  1.00  27.02      A    C
ATOM   7878  OH   TYR C 286     -32.269  28.439  37.252  1.00  27.49      A    O
ATOM   7879  CE2  TYR C 286     -34.541  27.870  37.364  1.00  25.45      A    C
ATOM   7880  CD2  TYR C 286     -35.747  28.139  37.828  1.00  21.73      A    C
ATOM   7881  C    TYR C 286     -37.778  31.072  37.313  1.00  29.04      A    C
ATOM   7882  O    TYR C 286     -36.903  31.766  36.885  1.00  31.25      A    O
ATOM   7883  N    PRO C 287     -38.662  30.484  36.538  1.00  28.30      A    N
ATOM   7884  CA   PRO C 287     -38.651  30.637  35.098  1.00  28.74      A    C
ATOM   7885  CB   PRO C 287     -39.770  29.715  34.674  1.00  28.10      A    C
ATOM   7886  CG   PRO C 287     -39.834  28.758  35.707  1.00  28.83      A    C
ATOM   7887  CD   PRO C 287     -39.561  29.405  36.942  1.00  28.01      A    C
```

Appendix 1

```
ATOM   7888  C   PRO C 287     -38.901  32.057  34.640  1.00 28.81      A  C
ATOM   7889  O   PRO C 287     -38.320  32.480  33.696  1.00 27.97      A  O
ATOM   7890  N   ARG C 288     -39.775  32.763  35.324  1.00 28.91      A  N
ATOM   7891  CA  ARG C 288     -40.034  34.159  35.082  1.00 28.02      A  C
ATOM   7892  CB  ARG C 288     -41.184  34.620  35.962  1.00 27.26      A  C
ATOM   7893  CG  ARG C 288     -42.523  34.112  35.577  1.00 25.76      A  C
ATOM   7894  CD  ARG C 288     -43.621  34.387  36.574  1.00 24.45      A  C
ATOM   7895  NE  ARG C 288     -44.376  33.196  36.855  1.00 25.39      A  N
ATOM   7896  CZ  ARG C 288     -45.480  33.124  37.564  1.00 30.84      A  C
ATOM   7897  NH1 ARG C 288     -46.026  34.175  38.079  1.00 28.96      A  N
ATOM   7898  NH2 ARG C 288     -46.054  31.981  37.733  1.00 32.04      A  N
ATOM   7899  C   ARG C 288     -38.804  35.001  35.349  1.00 28.72      A  C
ATOM   7900  O   ARG C 288     -38.497  35.882  34.604  1.00 29.55      A  O
ATOM   7901  N   PHE C 289     -38.105  34.688  36.424  1.00 27.89      A  N
ATOM   7902  CA  PHE C 289     -36.932  35.379  36.843  1.00 26.31      A  C
ATOM   7903  CB  PHE C 289     -36.476  34.854  38.231  1.00 26.70      A  C
ATOM   7904  CG  PHE C 289     -35.033  35.048  38.516  1.00 21.05      A  C
ATOM   7905  CD1 PHE C 289     -34.591  36.128  39.179  1.00 19.64      A  C
ATOM   7906  CE1 PHE C 289     -33.285  36.311  39.400  1.00 20.62      A  C
ATOM   7907  CZ  PHE C 289     -32.417  35.445  38.976  1.00 17.90      A  C
ATOM   7908  CE2 PHE C 289     -32.831  34.354  38.345  1.00 24.94      A  C
ATOM   7909  CD2 PHE C 289     -34.127  34.153  38.111  1.00 17.27      A  C
ATOM   7910  C   PHE C 289     -35.884  35.232  35.790  1.00 26.66      A  C
ATOM   7911  O   PHE C 289     -35.241  36.163  35.438  1.00 26.48      A  O
ATOM   7912  N   LYS C 290     -35.753  34.046  35.254  1.00 27.42      A  N
ATOM   7913  CA  LYS C 290     -34.790  33.784  34.218  1.00 28.38      A  C
ATOM   7914  CB  LYS C 290     -34.806  32.333  33.878  1.00 25.46      A  C
ATOM   7915  CG  LYS C 290     -33.818  31.585  34.609  1.00 30.10      A  C
ATOM   7916  CD  LYS C 290     -34.194  30.194  34.667  1.00 34.58      A  C
ATOM   7917  CE  LYS C 290     -33.448  29.402  33.692  1.00 36.61      A  C
ATOM   7918  NZ  LYS C 290     -34.103  28.125  33.518  1.00 36.55      A  N
ATOM   7919  C   LYS C 290     -35.034  34.580  32.967  1.00 29.13      A  C
ATOM   7920  O   LYS C 290     -34.144  35.038  32.329  1.00 29.56      A  O
ATOM   7921  N   GLN C 291     -36.280  34.720  32.610  1.00 29.42      A  N
ATOM   7922  CA  GLN C 291     -36.664  35.494  31.495  1.00 31.15      A  C
ATOM   7923  CB  GLN C 291     -38.163  35.389  31.417  1.00 32.08      A  C
ATOM   7924  CG  GLN C 291     -38.748  36.086  30.298  1.00 38.37      A  C
ATOM   7925  CD  GLN C 291     -38.520  35.338  29.059  1.00 48.46      A  C
ATOM   7926  OE1 GLN C 291     -38.781  34.148  28.999  1.00 52.21      A  O
ATOM   7927  NE2 GLN C 291     -38.015  36.010  28.050  1.00 48.13      A  N
ATOM   7928  C   GLN C 291     -36.301  36.931  31.694  1.00 30.60      A  C
ATOM   7929  O   GLN C 291     -35.791  37.562  30.828  1.00 30.31      A  O
ATOM   7930  N   THR C 292     -36.606  37.426  32.872  1.00 29.95      A  N
ATOM   7931  CA  THR C 292     -36.411  38.793  33.255  1.00 28.26      A  C
ATOM   7932  CB  THR C 292     -37.087  39.056  34.601  1.00 29.17      A  C
ATOM   7933  OG1 THR C 292     -38.463  38.755  34.502  1.00 27.94      A  O
ATOM   7934  CG2 THR C 292     -36.976  40.433  34.981  1.00 28.23      A  C
ATOM   7935  C   THR C 292     -34.996  39.269  33.312  1.00 27.21      A  C
ATOM   7936  O   THR C 292     -34.727  40.327  32.880  1.00 27.00      A  O
ATOM   7937  N   PHE C 293     -34.095  38.494  33.870  1.00 25.47      A  N
ATOM   7938  CA  PHE C 293     -32.745  38.964  34.078  1.00 24.06      A  C
ATOM   7939  CB  PHE C 293     -32.408  38.815  35.543  1.00 22.91      A  C
ATOM   7940  CG  PHE C 293     -33.319  39.524  36.459  1.00 23.90      A  C
ATOM   7941  CD1 PHE C 293     -33.406  40.874  36.461  1.00 22.76      A  C
```

Appendix 1

```
ATOM   7942  CE1 PHE C 293     -34.206  41.487  37.306  1.00 21.94      A    C
ATOM   7943  CZ  PHE C 293     -34.890  40.791  38.177  1.00 20.63      A    C
ATOM   7944  CE2 PHE C 293     -34.814  39.488  38.200  1.00 18.01      A    C
ATOM   7945  CD2 PHE C 293     -34.035  38.853  37.362  1.00 18.15      A    C
ATOM   7946  C   PHE C 293     -31.629  38.301  33.301  1.00 24.35      A    C
ATOM   7947  O   PHE C 293     -30.633  38.881  33.083  1.00 24.33      A    O
ATOM   7948  N   VAL C 294     -31.768  37.050  32.931  1.00 24.52      A    N
ATOM   7949  CA  VAL C 294     -30.646  36.295  32.394  1.00 25.28      A    C
ATOM   7950  CB  VAL C 294     -30.844  34.832  32.606  1.00 25.21      A    C
ATOM   7951  CG1 VAL C 294     -29.816  34.100  31.974  1.00 22.41      A    C
ATOM   7952  CG2 VAL C 294     -30.929  34.508  33.996  1.00 24.92      A    C
ATOM   7953  C   VAL C 294     -30.362  36.467  30.910  1.00 26.70      A    C
ATOM   7954  O   VAL C 294     -31.229  36.339  30.114  1.00 26.41      A    O
ATOM   7955  N   GLU C 295     -29.120  36.763  30.570  1.00 27.75      A    N
ATOM   7956  CA  GLU C 295     -28.668  36.791  29.208  1.00 27.94      A    C
ATOM   7957  CB  GLU C 295     -27.855  38.034  28.958  1.00 29.10      A    C
ATOM   7958  CG  GLU C 295     -28.031  38.575  27.590  1.00 31.68      A    C
ATOM   7959  CD  GLU C 295     -26.865  39.373  27.062  1.00 40.22      A    C
ATOM   7960  OE1 GLU C 295     -26.144  40.009  27.812  1.00 38.85      A    O
ATOM   7961  OE2 GLU C 295     -26.676  39.390  25.852  1.00 45.15      A    O-1
ATOM   7962  C   GLU C 295     -27.774  35.638  28.922  1.00 28.75      A    C
ATOM   7963  O   GLU C 295     -26.698  35.598  29.384  1.00 28.60      A    O
ATOM   7964  N   VAL C 296     -28.211  34.724  28.086  1.00 30.45      A    N
ATOM   7965  CA  VAL C 296     -27.340  33.731  27.512  1.00 31.70      A    C
ATOM   7966  CB  VAL C 296     -28.171  32.640  26.963  1.00 32.77      A    C
ATOM   7967  CG1 VAL C 296     -27.356  31.502  26.559  1.00 32.81      A    C
ATOM   7968  CG2 VAL C 296     -29.137  32.239  27.974  1.00 33.26      A    C
ATOM   7969  C   VAL C 296     -26.519  34.394  26.421  1.00 32.13      A    C
ATOM   7970  O   VAL C 296     -27.024  35.183  25.697  1.00 32.42      A    O
ATOM   7971  N   TYR C 297     -25.231  34.155  26.331  1.00 32.71      A    N
ATOM   7972  CA  TYR C 297     -24.519  34.952  25.384  1.00 33.12      A    C
ATOM   7973  CB  TYR C 297     -24.094  36.237  26.020  1.00 32.43      A    C
ATOM   7974  CG  TYR C 297     -22.889  36.149  26.873  1.00 31.31      A    C
ATOM   7975  CD1 TYR C 297     -21.660  36.226  26.331  1.00 31.66      A    C
ATOM   7976  CE1 TYR C 297     -20.589  36.175  27.066  1.00 31.11      A    C
ATOM   7977  CZ  TYR C 297     -20.698  36.074  28.376  1.00 33.72      A    C
ATOM   7978  OH  TYR C 297     -19.570  36.036  29.079  1.00 33.39      A    O
ATOM   7979  CE2 TYR C 297     -21.897  36.009  28.964  1.00 33.57      A    C
ATOM   7980  CD2 TYR C 297     -22.987  36.052  28.213  1.00 28.57      A    C
ATOM   7981  C   TYR C 297     -23.375  34.476  24.580  1.00 35.07      A    C
ATOM   7982  O   TYR C 297     -22.792  35.244  23.889  1.00 38.52      A    O
ATOM   7983  N   ASP C 298     -22.992  33.253  24.613  1.00 35.89      A    N
ATOM   7984  CA  ASP C 298     -21.860  32.994  23.777  1.00 35.97      A    C
ATOM   7985  CB  ASP C 298     -20.679  32.722  24.670  1.00 37.58      A    C
ATOM   7986  CG  ASP C 298     -19.453  32.478  23.936  1.00 39.63      A    C
ATOM   7987  OD1 ASP C 298     -19.323  33.026  22.878  1.00 47.57      A    O
ATOM   7988  OD2 ASP C 298     -18.607  31.739  24.400  1.00 39.04      A    O
ATOM   7989  C   ASP C 298     -22.201  31.793  22.991  1.00 35.84      A    C
ATOM   7990  O   ASP C 298     -21.653  30.764  23.191  1.00 36.83      A    O
ATOM   7991  N   GLU C 299     -23.189  31.917  22.141  1.00 34.67      A    N
ATOM   7992  CA  GLU C 299     -23.752  30.787  21.498  1.00 34.32      A    C
ATOM   7993  CB  GLU C 299     -22.741  30.180  20.559  1.00 35.10      A    C
ATOM   7994  CG  GLU C 299     -22.363  31.093  19.468  1.00 40.40      A    C
ATOM   7995  CD  GLU C 299     -21.365  30.516  18.553  1.00 48.96      A    C
```

Appendix 1

```
ATOM   7996  OE1 GLU C 299     -20.883  29.419  18.798  1.00 50.90      A    O
ATOM   7997  OE2 GLU C 299     -21.058  31.163  17.558  1.00 52.13      A    O
ATOM   7998  C   GLU C 299     -24.214  29.778  22.509  1.00 33.95      A    C
ATOM   7999  O   GLU C 299     -24.053  28.616  22.302  1.00 34.55      A    O
ATOM   8000  N   GLY C 300     -24.775  30.223  23.614  1.00 32.96      A    N
ATOM   8001  CA  GLY C 300     -25.270  29.343  24.644  1.00 31.37      A    C
ATOM   8002  C   GLY C 300     -24.310  28.855  25.700  1.00 30.82      A    C
ATOM   8003  O   GLY C 300     -24.674  28.197  26.608  1.00 28.71      A    O
ATOM   8004  N   ARG C 301     -23.065  29.204  25.561  1.00 31.58      A    N
ATOM   8005  CA  ARG C 301     -22.036  28.854  26.513  1.00 31.73      A    C
ATOM   8006  CB  ARG C 301     -20.689  28.941  25.829  1.00 32.52      A    C
ATOM   8007  CG  ARG C 301     -20.535  27.903  24.790  1.00 33.98      A    C
ATOM   8008  CD  ARG C 301     -19.235  27.971  24.129  1.00 37.50      A    C
ATOM   8009  NE  ARG C 301     -19.109  29.180  23.361  1.00 39.32      A    N
ATOM   8010  CZ  ARG C 301     -18.994  29.208  22.055  1.00 40.00      A    C
ATOM   8011  NH1 ARG C 301     -18.971  28.095  21.392  1.00 37.28      A    N
ATOM   8012  NH2 ARG C 301     -18.881  30.346  21.431  1.00 39.10      A    N
ATOM   8013  C   ARG C 301     -22.030  29.510  27.891  1.00 30.40      A    C
ATOM   8014  O   ARG C 301     -21.570  28.962  28.844  1.00 28.85      A    O
ATOM   8015  N   LYS C 302     -22.533  30.720  27.937  1.00 29.13      A    N
ATOM   8016  CA  LYS C 302     -22.317  31.612  29.023  1.00 28.65      A    C
ATOM   8017  CB  LYS C 302     -21.229  32.585  28.656  1.00 28.61      A    C
ATOM   8018  CG  LYS C 302     -19.937  31.883  28.463  1.00 31.49      A    C
ATOM   8019  CD  LYS C 302     -18.787  32.782  28.203  1.00 32.04      A    C
ATOM   8020  CE  LYS C 302     -17.536  32.011  28.186  1.00 29.21      A    C
ATOM   8021  NZ  LYS C 302     -16.505  32.709  27.512  1.00 29.98      A    N
ATOM   8022  C   LYS C 302     -23.571  32.308  29.340  1.00 28.62      A    C
ATOM   8023  O   LYS C 302     -24.448  32.289  28.581  1.00 28.68      A    O
ATOM   8024  N   ALA C 303     -23.668  32.851  30.525  1.00 28.97      A    N
ATOM   8025  CA  ALA C 303     -24.791  33.657  30.900  1.00 27.91      A    C
ATOM   8026  CB  ALA C 303     -25.845  32.824  31.472  1.00 24.38      A    C
ATOM   8027  C   ALA C 303     -24.293  34.689  31.870  1.00 27.98      A    C
ATOM   8028  O   ALA C 303     -23.319  34.462  32.515  1.00 28.16      A    O
ATOM   8029  N   ARG C 304     -24.985  35.822  31.914  1.00 27.93      A    N
ATOM   8030  CA  ARG C 304     -24.713  37.009  32.700  1.00 27.26      A    C
ATOM   8031  CB  ARG C 304     -24.240  38.101  31.784  1.00 28.16      A    C
ATOM   8032  CG  ARG C 304     -22.828  38.128  31.514  1.00 32.22      A    C
ATOM   8033  CD  ARG C 304     -22.481  39.280  30.645  1.00 38.21      A    C
ATOM   8034  NE  ARG C 304     -23.365  39.439  29.520  1.00 40.45      A    N
ATOM   8035  CZ  ARG C 304     -22.954  39.631  28.283  1.00 40.56      A    C
ATOM   8036  NH1 ARG C 304     -21.679  39.674  28.014  1.00 36.08      A    N
ATOM   8037  NH2 ARG C 304     -23.826  39.785  27.330  1.00 36.57      A    N
ATOM   8038  C   ARG C 304     -26.047  37.470  33.217  1.00 27.10      A    C
ATOM   8039  O   ARG C 304     -27.027  37.166  32.628  1.00 26.23      A    O
ATOM   8040  N   VAL C 305     -26.099  38.202  34.318  1.00 25.14      A    N
ATOM   8041  CA  VAL C 305     -27.379  38.621  34.871  1.00 23.81      A    C
ATOM   8042  CB  VAL C 305     -27.726  37.839  36.159  1.00 24.09      A    C
ATOM   8043  CG1 VAL C 305     -29.132  37.964  36.506  1.00 21.72      A    C
ATOM   8044  CG2 VAL C 305     -27.426  36.420  36.018  1.00 18.92      A    C
ATOM   8045  C   VAL C 305     -27.515  40.130  35.051  1.00 24.81      A    C
ATOM   8046  O   VAL C 305     -26.636  40.769  35.516  1.00 25.62      A    O
ATOM   8047  N   ARG C 306     -28.627  40.693  34.630  1.00 25.15      A    N
ATOM   8048  CA  ARG C 306     -28.930  42.097  34.820  1.00 24.65      A    C
ATOM   8049  CB  ARG C 306     -29.920  42.611  33.786  1.00 23.77      A    C
```

Appendix 1

```
ATOM   8050  CG   ARG C 306     -29.459  42.492  32.393  1.00 24.64      A    C
ATOM   8051  CD   ARG C 306     -30.489  42.852  31.377  1.00 30.05      A    C
ATOM   8052  NE   ARG C 306     -31.621  41.962  31.367  1.00 30.34      A    N
ATOM   8053  CZ   ARG C 306     -31.735  40.954  30.541  1.00 28.81      A    C
ATOM   8054  NH1  ARG C 306     -30.792  40.730  29.688  1.00 24.34      A    N
ATOM   8055  NH2  ARG C 306     -32.770  40.173  30.584  1.00 22.70      A    N
ATOM   8056  C    ARG C 306     -29.516  42.269  36.171  1.00 24.78      A    C
ATOM   8057  O    ARG C 306     -30.273  41.495  36.581  1.00 24.52      A    O
ATOM   8058  N    GLU C 307     -29.081  43.270  36.888  1.00 25.15      A    N
ATOM   8059  CA   GLU C 307     -29.537  43.560  38.220  1.00 25.42      A    C
ATOM   8060  CB   GLU C 307     -28.561  44.524  38.864  1.00 25.31      A    C
ATOM   8061  CG   GLU C 307     -28.892  45.011  40.218  1.00 23.38      A    C
ATOM   8062  CD   GLU C 307     -29.151  43.940  41.207  1.00 24.08      A    C
ATOM   8063  OE1  GLU C 307     -28.809  42.818  40.984  1.00 20.46      A    O
ATOM   8064  OE2  GLU C 307     -29.715  44.245  42.222  1.00 23.21      A    O
ATOM   8065  C    GLU C 307     -30.983  44.018  38.310  1.00 26.23      A    C
ATOM   8066  O    GLU C 307     -31.685  43.679  39.214  1.00 26.48      A    O
ATOM   8067  N    THR C 308     -31.393  44.781  37.325  1.00 27.35      A    N
ATOM   8068  CA   THR C 308     -32.681  45.436  37.287  1.00 27.94      A    C
ATOM   8069  CB   THR C 308     -32.627  46.809  37.978  1.00 28.30      A    C
ATOM   8070  OG1  THR C 308     -33.940  47.247  38.268  1.00 29.14      A    O
ATOM   8071  CG2  THR C 308     -31.942  47.815  37.161  1.00 20.08      A    C
ATOM   8072  C    THR C 308     -33.276  45.509  35.890  1.00 30.15      A    C
ATOM   8073  O    THR C 308     -32.654  45.128  34.955  1.00 31.66      A    O
ATOM   8074  N    ALA C 309     -34.503  45.971  35.769  1.00 31.83      A    N
ATOM   8075  CA   ALA C 309     -35.183  46.013  34.491  1.00 33.07      A    C
ATOM   8076  CB   ALA C 309     -36.635  46.122  34.726  1.00 30.60      A    C
ATOM   8077  C    ALA C 309     -34.821  46.937  33.335  1.00 35.29      A    C
ATOM   8078  O    ALA C 309     -34.693  46.497  32.235  1.00 38.87      A    O
ATOM   8079  N    GLY C 310     -34.740  48.222  33.474  1.00 36.42      A    N
ATOM   8080  CA   GLY C 310     -34.567  48.927  32.226  1.00 35.81      A    C
ATOM   8081  C    GLY C 310     -33.159  49.135  31.758  1.00 37.98      A    C
ATOM   8082  O    GLY C 310     -32.743  50.258  31.612  1.00 39.79      A    O
ATOM   8083  N    THR C 311     -32.408  48.077  31.539  1.00 36.78      A    N
ATOM   8084  CA   THR C 311     -31.023  48.224  31.172  1.00 37.74      A    C
ATOM   8085  CB   THR C 311     -30.155  48.443  32.422  1.00 37.90      A    C
ATOM   8086  OG1  THR C 311     -28.851  48.839  32.057  1.00 38.80      A    O
ATOM   8087  CG2  THR C 311     -30.033  47.225  33.192  1.00 36.85      A    C
ATOM   8088  C    THR C 311     -30.622  46.988  30.459  1.00 38.44      A    C
ATOM   8089  O    THR C 311     -31.263  46.002  30.621  1.00 39.23      A    O
ATOM   8090  N    ASP C 312     -29.581  47.038  29.649  1.00 38.93      A    N
ATOM   8091  CA   ASP C 312     -28.985  45.836  29.101  1.00 39.42      A    C
ATOM   8092  CB   ASP C 312     -28.570  45.987  27.637  1.00 39.94      A    C
ATOM   8093  CG   ASP C 312     -29.691  46.324  26.727  1.00 46.23      A    C
ATOM   8094  OD1  ASP C 312     -30.814  45.897  26.930  1.00 52.96      A    O
ATOM   8095  OD2  ASP C 312     -29.456  47.031  25.761  1.00 53.81      A    O-1
ATOM   8096  C    ASP C 312     -27.742  45.522  29.861  1.00 38.35      A    C
ATOM   8097  O    ASP C 312     -27.121  44.548  29.616  1.00 38.65      A    O
ATOM   8098  N    ASP C 313     -27.347  46.368  30.790  1.00 38.42      A    N
ATOM   8099  CA   ASP C 313     -26.107  46.173  31.539  1.00 38.35      A    C
ATOM   8100  CB   ASP C 313     -25.806  47.373  32.411  1.00 39.04      A    C
ATOM   8101  CG   ASP C 313     -25.133  48.484  31.687  1.00 43.83      A    C
ATOM   8102  OD1  ASP C 313     -25.551  49.623  31.836  1.00 47.63      A    O
ATOM   8103  OD2  ASP C 313     -24.160  48.253  30.996  1.00 48.88      A    O-1
```

Appendix 1

```
ATOM   8104  C   ASP C 313     -26.218  44.993  32.450  1.00 37.32      A    C
ATOM   8105  O   ASP C 313     -27.204  44.849  33.097  1.00 36.37      A    O
ATOM   8106  N   ALA C 314     -25.215  44.129  32.432  1.00 36.63      A    N
ATOM   8107  CA  ALA C 314     -25.202  42.865  33.152  1.00 36.96      A    C
ATOM   8108  CB  ALA C 314     -24.308  41.928  32.498  1.00 36.09      A    C
ATOM   8109  C   ALA C 314     -25.091  42.696  34.665  1.00 37.90      A    C
ATOM   8110  O   ALA C 314     -25.847  41.918  35.246  1.00 40.09      A    O
ATOM   8111  N   ASP C 315     -24.142  43.309  35.324  1.00 36.76      A    N
ATOM   8112  CA  ASP C 315     -24.244  43.174  36.745  1.00 36.26      A    C
ATOM   8113  CB  ASP C 315     -23.008  42.563  37.427  1.00 36.50      A    C
ATOM   8114  CG  ASP C 315     -23.074  41.039  37.515  1.00 38.59      A    C
ATOM   8115  OD1 ASP C 315     -23.608  40.497  38.458  1.00 38.66      A    O
ATOM   8116  OD2 ASP C 315     -22.602  40.349  36.623  1.00 42.16      A    O
ATOM   8117  C   ASP C 315     -24.618  44.502  37.262  1.00 34.35      A    C
ATOM   8118  O   ASP C 315     -25.599  45.057  36.875  1.00 33.74      A    O
ATOM   8119  N   GLY C 316     -23.846  45.055  38.133  1.00 32.34      A    N
ATOM   8120  CA  GLY C 316     -24.232  46.349  38.590  1.00 32.06      A    C
ATOM   8121  C   GLY C 316     -25.120  46.343  39.784  1.00 30.82      A    C
ATOM   8122  O   GLY C 316     -25.511  45.316  40.255  1.00 29.89      A    O
ATOM   8123  N   GLY C 317     -25.398  47.521  40.285  1.00 29.39      A    N
ATOM   8124  CA  GLY C 317     -25.779  47.667  41.647  1.00 29.22      A    C
ATOM   8125  C   GLY C 317     -24.624  47.173  42.462  1.00 28.60      A    C
ATOM   8126  O   GLY C 317     -23.534  47.610  42.298  1.00 29.45      A    O
ATOM   8127  N   VAL C 318     -24.885  46.218  43.317  1.00 28.51      A    N
ATOM   8128  CA  VAL C 318     -23.878  45.626  44.154  1.00 26.90      A    C
ATOM   8129  CB  VAL C 318     -24.477  44.974  45.380  1.00 27.14      A    C
ATOM   8130  CG1 VAL C 318     -25.106  45.975  46.187  1.00 25.76      A    C
ATOM   8131  CG2 VAL C 318     -25.430  43.923  45.027  1.00 25.61      A    C
ATOM   8132  C   VAL C 318     -22.936  44.706  43.427  1.00 27.50      A    C
ATOM   8133  O   VAL C 318     -21.949  44.299  43.969  1.00 27.15      A    O
ATOM   8134  N   GLY C 319     -23.251  44.413  42.188  1.00 27.63      A    N
ATOM   8135  CA  GLY C 319     -22.462  43.563  41.343  1.00 27.08      A    C
ATOM   8136  C   GLY C 319     -22.635  42.098  41.543  1.00 27.99      A    C
ATOM   8137  O   GLY C 319     -21.822  41.335  41.145  1.00 28.11      A    O
ATOM   8138  N   LEU C 320     -23.706  41.705  42.165  1.00 27.69      A    N
ATOM   8139  CA  LEU C 320     -23.788  40.343  42.593  1.00 28.86      A    C
ATOM   8140  CB  LEU C 320     -23.978  40.300  44.095  1.00 29.70      A    C
ATOM   8141  CG  LEU C 320     -22.814  40.645  45.001  1.00 31.65      A    C
ATOM   8142  CD1 LEU C 320     -23.241  40.633  46.369  1.00 29.49      A    C
ATOM   8143  CD2 LEU C 320     -21.764  39.695  44.832  1.00 31.54      A    C
ATOM   8144  C   LEU C 320     -24.790  39.421  41.950  1.00 28.08      A    C
ATOM   8145  O   LEU C 320     -24.919  38.342  42.398  1.00 29.13      A    O
ATOM   8146  N   ALA C 321     -25.505  39.856  40.932  1.00 28.56      A    N
ATOM   8147  CA  ALA C 321     -26.573  39.067  40.356  1.00 26.98      A    C
ATOM   8148  CB  ALA C 321     -27.368  39.893  39.396  1.00 26.29      A    C
ATOM   8149  C   ALA C 321     -26.160  37.770  39.721  1.00 26.98      A    C
ATOM   8150  O   ALA C 321     -26.752  36.789  39.989  1.00 27.64      A    O
ATOM   8151  N   SER C 322     -25.128  37.754  38.908  1.00 25.98      A    N
ATOM   8152  CA  SER C 322     -24.672  36.503  38.362  1.00 25.76      A    C
ATOM   8153  CB  SER C 322     -23.612  36.656  37.279  1.00 26.17      A    C
ATOM   8154  OG  SER C 322     -23.784  37.757  36.484  1.00 26.21      A    O
ATOM   8155  C   SER C 322     -24.178  35.525  39.398  1.00 26.12      A    C
ATOM   8156  O   SER C 322     -24.386  34.355  39.261  1.00 27.82      A    O
ATOM   8157  N   ALA C 323     -23.494  35.992  40.421  1.00 25.45      A    N
```

Appendix 1

```
ATOM   8158  CA   ALA C 323     -23.076  35.113  41.496  1.00 23.96      A  C
ATOM   8159  CB   ALA C 323     -22.128  35.810  42.376  1.00 22.08      A  C
ATOM   8160  C    ALA C 323     -24.195  34.484  42.314  1.00 24.94      A  C
ATOM   8161  O    ALA C 323     -24.135  33.343  42.621  1.00 22.87      A  O
ATOM   8162  N    PHE C 324     -25.198  35.250  42.684  1.00 24.55      A  N
ATOM   8163  CA   PHE C 324     -26.334  34.716  43.407  1.00 26.20      A  C
ATOM   8164  CB   PHE C 324     -27.146  35.812  44.111  1.00 26.45      A  C
ATOM   8165  CG   PHE C 324     -26.564  36.231  45.419  1.00 27.54      A  C
ATOM   8166  CD1  PHE C 324     -26.787  35.516  46.541  1.00 29.54      A  C
ATOM   8167  CE1  PHE C 324     -26.242  35.889  47.706  1.00 27.30      A  C
ATOM   8168  CZ   PHE C 324     -25.461  36.959  47.763  1.00 26.49      A  C
ATOM   8169  CE2  PHE C 324     -25.210  37.662  46.671  1.00 26.95      A  C
ATOM   8170  CD2  PHE C 324     -25.748  37.309  45.512  1.00 27.78      A  C
ATOM   8171  C    PHE C 324     -27.184  33.766  42.585  1.00 26.84      A  C
ATOM   8172  O    PHE C 324     -27.765  32.835  43.095  1.00 26.28      A  O
ATOM   8173  N    THR C 325     -27.274  34.067  41.306  1.00 27.32      A  N
ATOM   8174  CA   THR C 325     -28.006  33.298  40.349  1.00 26.05      A  C
ATOM   8175  CB   THR C 325     -28.120  34.029  39.057  1.00 26.25      A  C
ATOM   8176  OG1  THR C 325     -28.732  35.261  39.315  1.00 28.10      A  O
ATOM   8177  CG2  THR C 325     -28.997  33.336  38.156  1.00 25.82      A  C
ATOM   8178  C    THR C 325     -27.369  31.968  40.222  1.00 25.56      A  C
ATOM   8179  O    THR C 325     -28.014  30.998  40.096  1.00 26.29      A  O
ATOM   8180  N    LEU C 326     -26.074  31.934  40.290  1.00 25.65      A  N
ATOM   8181  CA   LEU C 326     -25.376  30.701  40.230  1.00 26.47      A  C
ATOM   8182  CB   LEU C 326     -23.904  30.966  40.207  1.00 26.25      A  C
ATOM   8183  CG   LEU C 326     -23.022  29.752  40.249  1.00 27.09      A  C
ATOM   8184  CD1  LEU C 326     -22.747  29.247  38.919  1.00 27.31      A  C
ATOM   8185  CD2  LEU C 326     -21.766  30.102  40.915  1.00 29.41      A  C
ATOM   8186  C    LEU C 326     -25.741  29.801  41.384  1.00 27.56      A  C
ATOM   8187  O    LEU C 326     -25.875  28.628  41.232  1.00 29.15      A  O
ATOM   8188  N    LEU C 327     -25.900  30.368  42.548  1.00 26.96      A  N
ATOM   8189  CA   LEU C 327     -26.472  29.670  43.657  1.00 26.40      A  C
ATOM   8190  CB   LEU C 327     -26.277  30.447  44.958  1.00 26.43      A  C
ATOM   8191  CG   LEU C 327     -27.078  30.074  46.198  1.00 25.26      A  C
ATOM   8192  CD1  LEU C 327     -26.665  28.797  46.705  1.00 22.54      A  C
ATOM   8193  CD2  LEU C 327     -26.901  31.055  47.215  1.00 25.10      A  C
ATOM   8194  C    LEU C 327     -27.911  29.276  43.450  1.00 26.35      A  C
ATOM   8195  O    LEU C 327     -28.273  28.217  43.806  1.00 26.15      A  O
ATOM   8196  N    LEU C 328     -28.727  30.123  42.861  1.00 25.55      A  N
ATOM   8197  CA   LEU C 328     -30.090  29.747  42.579  1.00 25.86      A  C
ATOM   8198  CB   LEU C 328     -30.829  30.903  41.961  1.00 25.50      A  C
ATOM   8199  CG   LEU C 328     -32.299  30.683  41.752  1.00 28.85      A  C
ATOM   8200  CD1  LEU C 328     -32.925  30.165  42.951  1.00 27.15      A  C
ATOM   8201  CD2  LEU C 328     -32.966  31.900  41.329  1.00 27.35      A  C
ATOM   8202  C    LEU C 328     -30.161  28.557  41.644  1.00 26.51      A  C
ATOM   8203  O    LEU C 328     -30.916  27.663  41.859  1.00 26.36      A  O
ATOM   8204  N    ALA C 329     -29.339  28.536  40.622  1.00 26.61      A  N
ATOM   8205  CA   ALA C 329     -29.301  27.444  39.689  1.00 26.30      A  C
ATOM   8206  CB   ALA C 329     -28.329  27.734  38.621  1.00 24.34      A  C
ATOM   8207  C    ALA C 329     -28.931  26.162  40.344  1.00 27.05      A  C
ATOM   8208  O    ALA C 329     -29.513  25.167  40.086  1.00 29.29      A  O
ATOM   8209  N    ARG C 330     -27.960  26.184  41.217  1.00 27.40      A  N
ATOM   8210  CA   ARG C 330     -27.596  25.002  41.929  1.00 26.21      A  C
ATOM   8211  CB   ARG C 330     -26.398  25.275  42.810  1.00 26.12      A  C
```

Appendix 1

```
ATOM   8212  CG  ARG C 330     -25.812  24.098  43.485  1.00 24.82     A    C
ATOM   8213  CD  ARG C 330     -25.374  23.088  42.515  1.00 22.82     A    C
ATOM   8214  NE  ARG C 330     -24.157  22.455  42.940  1.00 27.78     A    N
ATOM   8215  CZ  ARG C 330     -24.069  21.249  43.450  1.00 27.97     A    C
ATOM   8216  NH1 ARG C 330     -25.107  20.507  43.585  1.00 29.59     A    N
ATOM   8217  NH2 ARG C 330     -22.937  20.788  43.817  1.00 23.59     A    N
ATOM   8218  C   ARG C 330     -28.719  24.497  42.773  1.00 26.24     A    C
ATOM   8219  O   ARG C 330     -28.968  23.344  42.777  1.00 26.38     A    O
ATOM   8220  N   GLU C 331     -29.388  25.372  43.491  1.00 26.75     A    N
ATOM   8221  CA  GLU C 331     -30.487  25.012  44.352  1.00 26.65     A    C
ATOM   8222  CB  GLU C 331     -30.895  26.205  45.200  1.00 25.87     A    C
ATOM   8223  CG  GLU C 331     -32.176  26.071  45.941  1.00 27.51     A    C
ATOM   8224  CD  GLU C 331     -32.073  25.221  47.169  1.00 35.54     A    C
ATOM   8225  OE1 GLU C 331     -31.022  25.192  47.763  1.00 33.36     A    O
ATOM   8226  OE2 GLU C 331     -33.047  24.583  47.534  1.00 34.92     A    O-1
ATOM   8227  C   GLU C 331     -31.666  24.440  43.607  1.00 28.22     A    C
ATOM   8228  O   GLU C 331     -32.261  23.488  44.035  1.00 28.22     A    O
ATOM   8229  N   MET C 332     -31.954  25.028  42.466  1.00 29.21     A    N
ATOM   8230  CA  MET C 332     -32.945  24.542  41.532  1.00 30.15     A    C
ATOM   8231  CB  MET C 332     -33.395  25.641  40.568  1.00 30.01     C    C
ATOM   8232  CG  MET C 332     -34.024  26.874  41.179  1.00 28.61     C    C
ATOM   8233  SD  MET C 332     -35.510  26.673  42.104  1.00 34.65     C    S
ATOM   8234  CE  MET C 332     -34.766  26.560  43.620  1.00 24.95     C    C
ATOM   8235  C   MET C 332     -32.549  23.311  40.743  1.00 31.90     A    C
ATOM   8236  O   MET C 332     -33.360  22.720  40.127  1.00 32.57     A    O
ATOM   8237  N   GLY C 333     -31.302  22.918  40.746  1.00 32.85     A    N
ATOM   8238  CA  GLY C 333     -30.887  21.802  39.941  1.00 32.92     A    C
ATOM   8239  C   GLY C 333     -30.649  22.057  38.477  1.00 32.95     A    C
ATOM   8240  O   GLY C 333     -30.522  21.142  37.729  1.00 33.47     A    O
ATOM   8241  N   ASP C 334     -30.556  23.308  38.084  1.00 32.62     A    N
ATOM   8242  CA  ASP C 334     -30.464  23.712  36.710  1.00 30.80     A    C
ATOM   8243  CB  ASP C 334     -30.904  25.169  36.617  1.00 30.12     A    C
ATOM   8244  CG  ASP C 334     -31.257  25.623  35.215  1.00 33.60     A    C
ATOM   8245  OD1 ASP C 334     -30.965  24.974  34.236  1.00 30.18     A    O
ATOM   8246  OD2 ASP C 334     -31.830  26.676  35.090  1.00 33.27     A    O-1
ATOM   8247  C   ASP C 334     -29.038  23.606  36.288  1.00 29.42     A    C
ATOM   8248  O   ASP C 334     -28.340  24.528  36.326  1.00 29.30     A    O
ATOM   8249  N   GLN C 335     -28.623  22.450  35.844  1.00 28.39     A    N
ATOM   8250  CA  GLN C 335     -27.257  22.229  35.485  1.00 28.17     A    C
ATOM   8251  CB  GLN C 335     -27.018  20.777  35.171  1.00 27.05     A    C
ATOM   8252  CG  GLN C 335     -26.958  19.938  36.369  1.00 27.53     A    C
ATOM   8253  CD  GLN C 335     -26.536  18.541  36.120  1.00 30.43     A    C
ATOM   8254  OE1 GLN C 335     -27.084  17.627  36.662  1.00 28.54     A    O
ATOM   8255  NE2 GLN C 335     -25.539  18.374  35.324  1.00 27.21     A    N
ATOM   8256  C   GLN C 335     -26.813  23.116  34.361  1.00 28.69     A    C
ATOM   8257  O   GLN C 335     -25.688  23.488  34.310  1.00 29.74     A    O
ATOM   8258  N   GLN C 336     -27.699  23.414  33.441  1.00 28.50     A    N
ATOM   8259  CA  GLN C 336     -27.387  24.261  32.317  1.00 29.80     A    C
ATOM   8260  CB  GLN C 336     -28.499  24.173  31.305  1.00 30.30     A    C
ATOM   8261  CG  GLN C 336     -27.997  24.104  29.933  1.00 37.80     A    C
ATOM   8262  CD  GLN C 336     -28.825  24.873  29.017  1.00 43.78     A    C
ATOM   8263  OE1 GLN C 336     -28.499  25.036  27.870  1.00 49.16     A    O
ATOM   8264  NE2 GLN C 336     -29.918  25.351  29.506  1.00 42.14     A    N
ATOM   8265  C   GLN C 336     -27.076  25.710  32.568  1.00 28.33     A    C
```

Appendix 1

```
ATOM   8266  O    GLN C 336     -26.133  26.211  32.067  1.00 26.41      A    O
ATOM   8267  N    LEU C 337     -27.889  26.366  33.353  1.00 27.77      A    N
ATOM   8268  CA   LEU C 337     -27.625  27.714  33.764  1.00 28.17      A    C
ATOM   8269  CB   LEU C 337     -28.791  28.229  34.554  1.00 26.90      A    C
ATOM   8270  CG   LEU C 337     -28.765  29.707  34.815  1.00 27.33      A    C
ATOM   8271  CD1  LEU C 337     -28.421  30.525  33.621  1.00 21.38      A    C
ATOM   8272  CD2  LEU C 337     -30.007  30.130  35.414  1.00 24.64      A    C
ATOM   8273  C    LEU C 337     -26.345  27.830  34.576  1.00 28.77      A    C
ATOM   8274  O    LEU C 337     -25.602  28.736  34.421  1.00 28.14      A    O
ATOM   8275  N    PHE C 338     -26.098  26.856  35.418  1.00 28.48      A    N
ATOM   8276  CA   PHE C 338     -24.942  26.809  36.229  1.00 28.42      A    C
ATOM   8277  CB   PHE C 338     -25.047  25.554  37.055  1.00 28.32      A    C
ATOM   8278  CG   PHE C 338     -23.992  25.394  38.073  1.00 27.29      A    C
ATOM   8279  CD1  PHE C 338     -24.197  25.792  39.351  1.00 28.25      A    C
ATOM   8280  CE1  PHE C 338     -23.258  25.630  40.262  1.00 27.71      A    C
ATOM   8281  CZ   PHE C 338     -22.091  25.073  39.928  1.00 29.66      A    C
ATOM   8282  CE2  PHE C 338     -21.871  24.676  38.685  1.00 29.75      A    C
ATOM   8283  CD2  PHE C 338     -22.810  24.830  37.765  1.00 28.17      A    C
ATOM   8284  C    PHE C 338     -23.698  26.762  35.391  1.00 29.39      A    C
ATOM   8285  O    PHE C 338     -22.765  27.446  35.661  1.00 30.09      A    O
ATOM   8286  N    ASP C 339     -23.692  25.950  34.364  1.00 29.35      A    N
ATOM   8287  CA   ASP C 339     -22.556  25.888  33.502  1.00 28.42      A    C
ATOM   8288  CB   ASP C 339     -22.734  24.752  32.511  1.00 28.34      A    C
ATOM   8289  CG   ASP C 339     -21.460  24.136  32.116  1.00 31.22      A    C
ATOM   8290  OD1  ASP C 339     -20.876  23.416  32.908  1.00 31.91      A    O
ATOM   8291  OD2  ASP C 339     -21.040  24.349  31.003  1.00 36.79      A    O-1
ATOM   8292  C    ASP C 339     -22.324  27.200  32.788  1.00 28.07      A    C
ATOM   8293  O    ASP C 339     -21.240  27.650  32.651  1.00 28.47      A    O
ATOM   8294  N    GLN C 340     -23.374  27.801  32.309  1.00 27.46      A    N
ATOM   8295  CA   GLN C 340     -23.272  29.024  31.575  1.00 26.51      A    C
ATOM   8296  CB   GLN C 340     -24.634  29.371  31.017  1.00 25.80      A    C
ATOM   8297  CG   GLN C 340     -25.079  28.387  30.055  1.00 22.48      A    C
ATOM   8298  CD   GLN C 340     -26.428  28.617  29.554  1.00 24.20      A    C
ATOM   8299  OE1  GLN C 340     -27.327  28.911  30.272  1.00 22.78      A    O
ATOM   8300  NE2  GLN C 340     -26.584  28.464  28.292  1.00 26.84      A    N
ATOM   8301  C    GLN C 340     -22.738  30.143  32.416  1.00 27.42      A    C
ATOM   8302  O    GLN C 340     -21.931  30.913  31.985  1.00 27.93      A    O
ATOM   8303  N    LEU C 341     -23.239  30.236  33.629  1.00 25.20      A    N
ATOM   8304  CA   LEU C 341     -22.767  31.190  34.598  1.00 23.30      A    C
ATOM   8305  CB   LEU C 341     -23.727  31.260  35.761  1.00 22.76      A    C
ATOM   8306  CG   LEU C 341     -25.027  31.975  35.474  1.00 23.44      A    C
ATOM   8307  CD1  LEU C 341     -26.043  31.764  36.507  1.00 21.25      A    C
ATOM   8308  CD2  LEU C 341     -24.805  33.382  35.258  1.00 19.51      A    C
ATOM   8309  C    LEU C 341     -21.356  31.000  35.090  1.00 23.00      A    C
ATOM   8310  O    LEU C 341     -20.656  31.921  35.228  1.00 22.77      A    O
ATOM   8311  N    LEU C 342     -20.947  29.787  35.352  1.00 23.54      A    N
ATOM   8312  CA   LEU C 342     -19.594  29.505  35.723  1.00 24.54      A    C
ATOM   8313  CB   LEU C 342     -19.434  28.075  36.189  1.00 24.67      A    C
ATOM   8314  CG   LEU C 342     -18.380  27.831  37.254  1.00 23.16      A    C
ATOM   8315  CD1  LEU C 342     -18.403  28.851  38.271  1.00 21.49      A    C
ATOM   8316  CD2  LEU C 342     -18.477  26.517  37.869  1.00 19.09      A    C
ATOM   8317  C    LEU C 342     -18.634  29.815  34.633  1.00 25.96      A    C
ATOM   8318  O    LEU C 342     -17.564  30.266  34.875  1.00 26.74      A    O
ATOM   8319  N    ASN C 343     -19.023  29.541  33.416  1.00 27.66      A    N
```

Appendix 1

```
ATOM   8320  CA   ASN C 343     -18.188  29.889  32.313  1.00  27.43       A    C
ATOM   8321  CB   ASN C 343     -18.682  29.302  31.017  1.00  27.31       A    C
ATOM   8322  CG   ASN C 343     -18.657  27.827  31.006  1.00  26.07       A    C
ATOM   8323  OD1  ASN C 343     -17.816  27.217  31.572  1.00  29.04       A    O
ATOM   8324  ND2  ASN C 343     -19.584  27.253  30.337  1.00  22.24       A    N
ATOM   8325  C    ASN C 343     -18.026  31.365  32.213  1.00  27.53       A    C
ATOM   8326  O    ASN C 343     -17.005  31.818  31.847  1.00  27.91       A    O
ATOM   8327  N    HIS C 344     -19.061  32.115  32.505  1.00  27.30       A    N
ATOM   8328  CA   HIS C 344     -18.905  33.531  32.643  1.00  26.46       A    C
ATOM   8329  CB   HIS C 344     -20.276  34.130  32.787  1.00  25.33       A    C
ATOM   8330  CG   HIS C 344     -20.270  35.588  33.071  1.00  27.85       A    C
ATOM   8331  ND1  HIS C 344     -19.744  36.512  32.211  1.00  32.04       A    N
ATOM   8332  CE1  HIS C 344     -19.875  37.710  32.722  1.00  30.22       A    C
ATOM   8333  NE2  HIS C 344     -20.467  37.598  33.886  1.00  32.82       A    N
ATOM   8334  CD2  HIS C 344     -20.729  36.282  34.125  1.00  29.91       A    C
ATOM   8335  C    HIS C 344     -18.040  34.021  33.802  1.00  26.90       A    C
ATOM   8336  O    HIS C 344     -17.206  34.858  33.628  1.00  27.16       A    O
ATOM   8337  N    LEU C 345     -18.306  33.543  34.996  1.00  25.71       A    N
ATOM   8338  CA   LEU C 345     -17.599  34.004  36.166  1.00  26.22       A    C
ATOM   8339  CB   LEU C 345     -18.396  33.618  37.408  1.00  24.90       A    C
ATOM   8340  CG   LEU C 345     -19.782  34.207  37.491  1.00  25.71       A    C
ATOM   8341  CD1  LEU C 345     -20.652  33.529  38.482  1.00  22.30       A    C
ATOM   8342  CD2  LEU C 345     -19.765  35.664  37.656  1.00  16.59       A    C
ATOM   8343  C    LEU C 345     -16.168  33.612  36.393  1.00  26.79       A    C
ATOM   8344  O    LEU C 345     -15.364  34.423  36.742  1.00  27.30       A    O
ATOM   8345  N    GLU C 346     -15.888  32.335  36.321  1.00  27.72       A    N
ATOM   8346  CA   GLU C 346     -14.586  31.796  36.690  1.00  28.55       A    C
ATOM   8347  CB   GLU C 346     -14.715  30.321  37.031  1.00  27.61       A    C
ATOM   8348  CG   GLU C 346     -13.534  29.769  37.725  1.00  31.11       A    C
ATOM   8349  CD   GLU C 346     -13.779  28.469  38.397  1.00  31.94       A    C
ATOM   8350  OE1  GLU C 346     -14.397  27.600  37.816  1.00  34.24       A    O
ATOM   8351  OE2  GLU C 346     -13.332  28.301  39.508  1.00  33.04       A    O-1
ATOM   8352  C    GLU C 346     -13.345  32.058  35.849  1.00  28.47       A    C
ATOM   8353  O    GLU C 346     -12.338  32.351  36.380  1.00  29.10       A    O
ATOM   8354  N    PRO C 347     -13.394  31.958  34.538  1.00  29.68       A    N
ATOM   8355  CA   PRO C 347     -12.182  32.137  33.738  1.00  28.96       A    C
ATOM   8356  CB   PRO C 347     -12.674  31.822  32.350  1.00  28.40       A    C
ATOM   8357  CG   PRO C 347     -13.616  30.816  32.570  1.00  30.14       A    C
ATOM   8358  CD   PRO C 347     -14.333  31.091  33.825  1.00  29.94       A    C
ATOM   8359  C    PRO C 347     -11.475  33.471  33.734  1.00  27.75       A    C
ATOM   8360  O    PRO C 347     -10.289  33.486  33.751  1.00  27.45       A    O
ATOM   8361  N    PRO C 348     -12.197  34.560  33.683  1.00  27.58       A    N
ATOM   8362  CA   PRO C 348     -11.624  35.887  33.761  1.00  27.54       A    C
ATOM   8363  CB   PRO C 348     -12.793  36.760  33.389  1.00  26.85       A    C
ATOM   8364  CG   PRO C 348     -13.907  36.009  33.648  1.00  26.54       A    C
ATOM   8365  CD   PRO C 348     -13.633  34.628  33.476  1.00  27.43       A    C
ATOM   8366  C    PRO C 348     -10.998  36.233  35.127  1.00  29.20       A    C
ATOM   8367  O    PRO C 348     -10.126  37.028  35.246  1.00  30.31       A    O
ATOM   8368  N    ALA C 349     -11.440  35.522  36.123  1.00  30.64       A    N
ATOM   8369  CA   ALA C 349     -10.995  35.622  37.461  1.00  30.63       A    C
ATOM   8370  CB   ALA C 349     -11.990  35.098  38.328  1.00  30.62       A    C
ATOM   8371  C    ALA C 349      -9.737  34.879  37.646  1.00  30.86       A    C
ATOM   8372  O    ALA C 349      -9.134  35.001  38.642  1.00  32.87       A    O
ATOM   8373  N    LYS C 350      -9.326  34.133  36.657  1.00  31.05       A    N
```

Appendix 1

```
ATOM   8374  CA   LYS C 350      -8.005  33.547  36.617  1.00 30.22      A    C
ATOM   8375  CB   LYS C 350      -6.982  34.624  36.310  1.00 29.91      A    C
ATOM   8380  C    LYS C 350      -7.538  32.667  37.761  1.00 29.57      A    C
ATOM   8381  O    LYS C 350      -6.615  32.958  38.436  1.00 28.12      A    O
ATOM   8382  N    PRO C 351      -8.169  31.542  37.928  1.00 30.39      A    N
ATOM   8383  CA   PRO C 351      -7.805  30.630  38.988  1.00 31.36      A    C
ATOM   8384  CB   PRO C 351      -8.910  29.607  38.935  1.00 31.70      A    C
ATOM   8385  CG   PRO C 351      -9.406  29.677  37.660  1.00 31.38      A    C
ATOM   8386  CD   PRO C 351      -9.285  31.025  37.154  1.00 29.91      A    C
ATOM   8387  C    PRO C 351      -6.498  29.945  38.792  1.00 31.36      A    C
ATOM   8388  O    PRO C 351      -6.086  29.783  37.692  1.00 31.34      A    O
ATOM   8389  N    SER C 352      -5.862  29.570  39.882  1.00 32.52      A    N
ATOM   8390  CA   SER C 352      -4.787  28.624  39.893  1.00 33.83      A    C
ATOM   8391  CB   SER C 352      -3.474  29.303  39.651  1.00 34.74      A    C
ATOM   8392  OG   SER C 352      -3.482  30.549  40.237  1.00 32.91      A    O
ATOM   8393  C    SER C 352      -4.718  27.944  41.207  1.00 34.89      A    C
ATOM   8394  O    SER C 352      -5.112  28.484  42.187  1.00 35.92      A    O
ATOM   8395  N    ILE C 353      -4.176  26.750  41.220  1.00 35.19      A    N
ATOM   8396  CA   ILE C 353      -3.929  26.035  42.443  1.00 35.54      A    C
ATOM   8397  CB   ILE C 353      -4.589  24.683  42.371  1.00 35.17      A    C
ATOM   8398  CG1  ILE C 353      -6.078  24.886  42.449  1.00 34.99      A    C
ATOM   8399  CD1  ILE C 353      -6.842  23.988  41.607  1.00 37.36      A    C
ATOM   8400  CG2  ILE C 353      -4.209  23.853  43.469  1.00 34.18      A    C
ATOM   8401  C    ILE C 353      -2.447  25.930  42.604  1.00 35.97      A    C
ATOM   8402  O    ILE C 353      -1.785  25.412  41.768  1.00 37.00      A    O
ATOM   8403  N    VAL C 354      -1.918  26.490  43.670  1.00 36.63      A    N
ATOM   8404  CA   VAL C 354      -0.481  26.550  43.834  1.00 35.91      A    C
ATOM   8405  CB   VAL C 354       0.027  27.974  43.924  1.00 36.35      A    C
ATOM   8406  CG1  VAL C 354       1.466  28.000  44.207  1.00 34.26      A    C
ATOM   8407  CG2  VAL C 354      -0.229  28.642  42.664  1.00 33.28      A    C
ATOM   8408  C    VAL C 354       0.166  25.636  44.845  1.00 35.90      A    C
ATOM   8409  O    VAL C 354       1.089  24.953  44.520  1.00 37.40      A    O
ATOM   8410  N    SER C 355      -0.293  25.532  46.052  1.00 33.37      A    N
ATOM   8411  CA   SER C 355       0.339  24.475  46.809  1.00 31.45      A    C
ATOM   8412  CB   SER C 355       1.275  25.044  47.858  1.00 30.48      A    C
ATOM   8413  OG   SER C 355       1.849  24.061  48.647  1.00 33.10      A    O
ATOM   8414  C    SER C 355      -0.791  23.684  47.360  1.00 29.84      A    C
ATOM   8415  O    SER C 355      -1.006  23.603  48.528  1.00 29.20      A    O
ATOM   8416  N    ALA C 356      -1.538  23.149  46.413  1.00 28.36      A    N
ATOM   8417  CA   ALA C 356      -2.805  22.473  46.587  1.00 27.95      A    C
ATOM   8418  CB   ALA C 356      -2.666  21.315  47.461  1.00 25.11      A    C
ATOM   8419  C    ALA C 356      -3.878  23.406  47.087  1.00 27.29      A    C
ATOM   8420  O    ALA C 356      -4.831  22.988  47.664  1.00 27.09      A    O
ATOM   8421  N    SER C 357      -3.710  24.680  46.834  1.00 27.21      A    N
ATOM   8422  CA   SER C 357      -4.588  25.674  47.364  1.00 27.10      A    C
ATOM   8423  CB   SER C 357      -3.896  26.374  48.495  1.00 26.28      A    C
ATOM   8424  OG   SER C 357      -4.553  27.529  48.865  1.00 29.26      A    O
ATOM   8425  C    SER C 357      -4.985  26.631  46.293  1.00 26.61      A    C
ATOM   8426  O    SER C 357      -4.200  26.970  45.498  1.00 26.24      A    O
ATOM   8427  N    LEU C 358      -6.238  27.028  46.297  1.00 27.32      A    N
ATOM   8428  CA   LEU C 358      -6.850  27.829  45.273  1.00 27.76      A    C
ATOM   8429  CB   LEU C 358      -8.292  27.376  45.111  1.00 26.60      A    C
ATOM   8430  CG   LEU C 358      -9.183  28.079  44.115  1.00 26.31      A    C
ATOM   8431  CD1  LEU C 358      -8.656  27.948  42.754  1.00 23.28      A    C
```

Appendix 1

```
ATOM   8432  CD2 LEU C 358     -10.535  27.613  44.203  1.00  22.52      A   C
ATOM   8433  C   LEU C 358      -6.818  29.326  45.491  1.00  29.67      A   C
ATOM   8434  O   LEU C 358      -7.177  29.805  46.501  1.00  30.96      A   O
ATOM   8435  N   ARG C 359      -6.383  30.058  44.495  1.00  31.48      A   N
ATOM   8436  CA  ARG C 359      -6.422  31.494  44.510  1.00  36.08      A   C
ATOM   8437  CB  ARG C 359      -5.022  32.062  44.618  1.00  37.71      A   C
ATOM   8438  CG  ARG C 359      -4.372  31.951  45.949  1.00  44.71      A   C
ATOM   8439  CD  ARG C 359      -5.062  32.763  46.998  1.00  53.08      A   C
ATOM   8440  NE  ARG C 359      -4.294  32.773  48.223  1.00  55.29      A   N
ATOM   8441  CZ  ARG C 359      -3.958  31.686  48.881  1.00  56.11      A   C
ATOM   8442  NH1 ARG C 359      -4.329  30.508  48.424  1.00  54.01      A   N
ATOM   8443  NH2 ARG C 359      -3.254  31.786  49.983  1.00  54.90      A   N
ATOM   8444  C   ARG C 359      -6.948  31.992  43.208  1.00  36.61      A   C
ATOM   8445  O   ARG C 359      -6.620  31.468  42.204  1.00  37.90      A   O
ATOM   8446  N   TYR C 360      -7.725  33.045  43.230  1.00  36.48      A   N
ATOM   8447  CA  TYR C 360      -8.070  33.732  42.026  1.00  37.28      A   C
ATOM   8448  CB  TYR C 360      -9.550  34.033  42.003  1.00  36.96      A   C
ATOM   8449  CG  TYR C 360     -10.440  32.849  41.847  1.00  38.36      A   C
ATOM   8450  CD1 TYR C 360     -10.796  32.384  40.614  1.00  35.93      A   C
ATOM   8451  CE1 TYR C 360     -11.603  31.349  40.488  1.00  34.90      A   C
ATOM   8452  CZ  TYR C 360     -12.064  30.733  41.594  1.00  36.15      A   C
ATOM   8453  OH  TYR C 360     -12.877  29.658  41.499  1.00  36.58      A   O
ATOM   8454  CE2 TYR C 360     -11.729  31.167  42.802  1.00  30.99      A   C
ATOM   8455  CD2 TYR C 360     -10.938  32.211  42.930  1.00  37.01      A   C
ATOM   8456  C   TYR C 360      -7.337  35.034  41.983  1.00  37.96      A   C
ATOM   8457  O   TYR C 360      -7.543  35.879  42.790  1.00  37.86      A   O
ATOM   8458  N   GLU C 361      -6.465  35.186  41.024  1.00  39.65      A   N
ATOM   8459  CA  GLU C 361      -5.975  36.471  40.663  1.00  43.25      A   C
ATOM   8460  CB  GLU C 361      -4.933  36.309  39.592  1.00  44.05      A   C
ATOM   8461  CG  GLU C 361      -4.592  37.529  38.837  1.00  51.72      A   C
ATOM   8462  CD  GLU C 361      -3.179  37.492  38.360  1.00  60.95      A   C
ATOM   8463  OE1 GLU C 361      -2.644  36.389  38.285  1.00  63.37      A   O
ATOM   8464  OE2 GLU C 361      -2.593  38.541  38.058  1.00  63.87      A   O-1
ATOM   8465  C   GLU C 361      -7.186  37.071  40.076  1.00  43.78      A   C
ATOM   8466  O   GLU C 361      -7.935  36.385  39.438  1.00  46.75      A   O
ATOM   8467  N   HIS C 362      -7.396  38.347  40.234  1.00  42.91      A   N
ATOM   8468  CA  HIS C 362      -8.551  38.935  39.600  1.00  43.16      A   C
ATOM   8469  CB  HIS C 362      -8.345  38.898  38.106  1.00  43.90      A   C
ATOM   8470  CG  HIS C 362      -8.660  40.186  37.463  1.00  53.76      A   C
ATOM   8471  ND1 HIS C 362      -9.909  40.482  36.985  1.00  61.32      A   N
ATOM   8472  CE1 HIS C 362      -9.918  41.711  36.515  1.00  66.19      A   C
ATOM   8473  NE2 HIS C 362      -8.721  42.230  36.692  1.00  67.80      A   N
ATOM   8474  CD2 HIS C 362      -7.921  41.298  37.300  1.00  62.77      A   C
ATOM   8475  C   HIS C 362     -10.008  38.528  39.862  1.00  40.49      A   C
ATOM   8476  O   HIS C 362     -10.738  38.386  38.929  1.00  39.83      A   O
ATOM   8477  N   PRO C 363     -10.467  38.441  41.101  1.00  38.53      A   N
ATOM   8478  CA  PRO C 363     -11.875  38.172  41.359  1.00  37.04      A   C
ATOM   8479  CB  PRO C 363     -11.907  38.095  42.858  1.00  36.68      A   C
ATOM   8480  CG  PRO C 363     -10.884  38.880  43.256  1.00  35.77      A   C
ATOM   8481  CD  PRO C 363      -9.782  38.616  42.371  1.00  38.20      A   C
ATOM   8482  C   PRO C 363     -12.827  39.258  40.911  1.00  36.38      A   C
ATOM   8483  O   PRO C 363     -12.538  40.388  41.081  1.00  36.07      A   O
ATOM   8484  N   GLY C 364     -13.942  38.898  40.313  1.00  35.18      A   N
ATOM   8485  CA  GLY C 364     -14.905  39.833  39.764  1.00  34.28      A   C
```

Appendix 1

```
ATOM   8486  C    GLY C 364     -15.708  40.789  40.597  1.00 34.46      A  C
ATOM   8487  O    GLY C 364     -15.962  41.875  40.220  1.00 34.29      A  O
ATOM   8488  N    SER C 365     -16.140  40.333  41.742  1.00 33.57      A  N
ATOM   8489  CA   SER C 365     -17.060  41.052  42.562  1.00 31.72      A  C
ATOM   8490  CB   SER C 365     -18.473  40.590  42.330  1.00 31.20      A  C
ATOM   8491  OG   SER C 365     -18.642  39.272  42.702  1.00 30.28      A  O
ATOM   8492  C    SER C 365     -16.676  40.781  43.960  1.00 32.02      A  C
ATOM   8493  O    SER C 365     -15.762  40.082  44.198  1.00 33.01      A  O
ATOM   8494  N    LEU C 366     -17.392  41.361  44.880  1.00 32.42      A  N
ATOM   8495  CA   LEU C 366     -17.228  41.104  46.262  1.00 32.25      A  C
ATOM   8496  CB   LEU C 366     -18.099  42.055  47.053  1.00 33.12      A  C
ATOM   8497  CG   LEU C 366     -17.474  43.201  47.834  1.00 34.74      A  C
ATOM   8498  CD1  LEU C 366     -16.013  43.119  47.860  1.00 38.53      A  C
ATOM   8499  CD2  LEU C 366     -17.905  44.501  47.340  1.00 33.43      A  C
ATOM   8500  C    LEU C 366     -17.696  39.714  46.477  1.00 31.73      A  C
ATOM   8501  O    LEU C 366     -18.491  39.255  45.745  1.00 32.96      A  O
ATOM   8502  N    LEU C 367     -17.165  39.030  47.463  1.00 30.49      A  N
ATOM   8503  CA   LEU C 367     -17.628  37.713  47.814  1.00 28.04      A  C
ATOM   8504  CB   LEU C 367     -19.095  37.732  48.151  1.00 27.29      A  C
ATOM   8505  CG   LEU C 367     -19.618  38.615  49.251  1.00 27.52      A  C
ATOM   8506  CD1  LEU C 367     -21.054  38.560  49.265  1.00 25.20      A  C
ATOM   8507  CD2  LEU C 367     -19.053  38.266  50.575  1.00 24.99      A  C
ATOM   8508  C    LEU C 367     -17.421  36.697  46.754  1.00 28.13      A  C
ATOM   8509  O    LEU C 367     -18.093  35.746  46.739  1.00 27.93      A  O
ATOM   8510  N    PHE C 368     -16.494  36.903  45.855  1.00 28.17      A  N
ATOM   8511  CA   PHE C 368     -16.297  35.969  44.777  1.00 28.59      A  C
ATOM   8512  CB   PHE C 368     -15.231  36.565  43.880  1.00 28.88      A  C
ATOM   8513  CG   PHE C 368     -15.128  35.932  42.574  1.00 28.07      A  C
ATOM   8514  CD1  PHE C 368     -15.987  36.251  41.584  1.00 27.97      A  C
ATOM   8515  CE1  PHE C 368     -15.885  35.686  40.408  1.00 26.76      A  C
ATOM   8516  CZ   PHE C 368     -14.940  34.806  40.193  1.00 29.58      A  C
ATOM   8517  CE2  PHE C 368     -14.081  34.473  41.156  1.00 28.13      A  C
ATOM   8518  CD2  PHE C 368     -14.160  35.034  42.325  1.00 26.93      A  C
ATOM   8519  C    PHE C 368     -15.869  34.561  45.149  1.00 27.00      A  C
ATOM   8520  O    PHE C 368     -16.527  33.635  44.820  1.00 26.16      A  O
ATOM   8521  N    ASP C 369     -14.797  34.406  45.885  1.00 24.62      A  N
ATOM   8522  CA   ASP C 369     -14.414  33.092  46.314  1.00 23.78      A  C
ATOM   8523  CB   ASP C 369     -12.966  32.978  46.841  1.00 23.29      A  C
ATOM   8524  CG   ASP C 369     -12.799  33.368  48.290  1.00 27.28      A  C
ATOM   8525  OD1  ASP C 369     -12.752  32.505  49.151  1.00 25.28      A  O
ATOM   8526  OD2  ASP C 369     -12.650  34.543  48.570  1.00 27.46      A  O-1
ATOM   8527  C    ASP C 369     -15.419  32.450  47.203  1.00 23.51      A  C
ATOM   8528  O    ASP C 369     -15.574  31.281  47.162  1.00 23.17      A  O
ATOM   8529  N    GLU C 370     -16.077  33.224  48.033  1.00 24.17      A  N
ATOM   8530  CA   GLU C 370     -16.984  32.670  48.983  1.00 24.70      A  C
ATOM   8531  CB   GLU C 370     -17.576  33.793  49.821  1.00 24.61      A  C
ATOM   8532  CG   GLU C 370     -16.685  34.397  50.823  1.00 27.14      A  C
ATOM   8533  CD   GLU C 370     -15.834  35.476  50.279  1.00 33.81      A  C
ATOM   8534  OE1  GLU C 370     -15.978  35.828  49.138  1.00 37.13      A  O
ATOM   8535  OE2  GLU C 370     -14.993  35.988  50.972  1.00 39.75      A  O-1
ATOM   8536  C    GLU C 370     -18.127  31.982  48.324  1.00 25.33      A  C
ATOM   8537  O    GLU C 370     -18.401  30.865  48.609  1.00 25.05      A  O
ATOM   8538  N    LEU C 371     -18.812  32.666  47.440  1.00 25.45      A  N
ATOM   8539  CA   LEU C 371     -19.936  32.052  46.804  1.00 27.13      A  C
```

Appendix 1

```
ATOM   8540  CB   LEU C 371     -21.131  32.988  46.746  1.00 27.88      A  C
ATOM   8541  CG   LEU C 371     -21.420  34.002  45.690  1.00 32.53      A  C
ATOM   8542  CD1  LEU C 371     -22.441  34.944  46.155  1.00 29.77      A  C
ATOM   8543  CD2  LEU C 371     -20.206  34.710  45.419  1.00 41.34      A  C
ATOM   8544  C    LEU C 371     -19.697  31.207  45.558  1.00 27.55      A  C
ATOM   8545  O    LEU C 371     -20.535  30.493  45.149  1.00 27.07      A  O
ATOM   8546  N    LEU C 372     -18.526  31.251  44.993  1.00 26.26      A  N
ATOM   8547  CA   LEU C 372     -18.170  30.218  44.094  1.00 27.35      A  C
ATOM   8548  CB   LEU C 372     -16.930  30.575  43.316  1.00 26.90      A  C
ATOM   8549  CG   LEU C 372     -17.223  30.863  41.867  1.00 29.76      A  C
ATOM   8550  CD1  LEU C 372     -17.882  32.163  41.712  1.00 25.47      A  C
ATOM   8551  CD2  LEU C 372     -16.011  30.782  41.030  1.00 29.67      A  C
ATOM   8552  C    LEU C 372     -18.045  28.894  44.819  1.00 27.91      A  C
ATOM   8553  O    LEU C 372     -18.484  27.912  44.335  1.00 30.06      A  O
ATOM   8554  N    PHE C 373     -17.452  28.904  45.991  1.00 28.27      A  N
ATOM   8555  CA   PHE C 373     -17.330  27.749  46.843  1.00 26.55      A  C
ATOM   8556  CB   PHE C 373     -16.469  28.103  48.070  1.00 25.80      A  C
ATOM   8557  CG   PHE C 373     -16.619  27.191  49.217  1.00 23.21      A  C
ATOM   8558  CD1  PHE C 373     -16.189  25.916  49.149  1.00 21.21      A  C
ATOM   8559  CE1  PHE C 373     -16.337  25.089  50.172  1.00 21.78      A  C
ATOM   8560  CZ   PHE C 373     -16.895  25.510  51.297  1.00 23.84      A  C
ATOM   8561  CE2  PHE C 373     -17.319  26.773  51.398  1.00 24.10      A  C
ATOM   8562  CD2  PHE C 373     -17.182  27.611  50.377  1.00 23.37      A  C
ATOM   8563  C    PHE C 373     -18.690  27.294  47.241  1.00 26.15      A  C
ATOM   8564  O    PHE C 373     -18.944  26.142  47.255  1.00 26.22      A  O
ATOM   8565  N    LEU C 374     -19.567  28.206  47.571  1.00 25.92      A  N
ATOM   8566  CA   LEU C 374     -20.905  27.830  47.921  1.00 27.55      A  C
ATOM   8567  CB   LEU C 374     -21.619  28.983  48.598  1.00 26.79      A  C
ATOM   8568  CG   LEU C 374     -23.051  28.694  48.976  1.00 29.29      A  C
ATOM   8569  CD1  LEU C 374     -23.134  27.566  49.872  1.00 29.03      A  C
ATOM   8570  CD2  LEU C 374     -23.691  29.845  49.576  1.00 28.80      A  C
ATOM   8571  C    LEU C 374     -21.734  27.225  46.797  1.00 27.41      A  C
ATOM   8572  O    LEU C 374     -22.343  26.233  46.972  1.00 28.50      A  O
ATOM   8573  N    ALA C 375     -21.718  27.818  45.633  1.00 27.30      A  N
ATOM   8574  CA   ALA C 375     -22.445  27.303  44.512  1.00 25.67      A  C
ATOM   8575  CB   ALA C 375     -22.362  28.241  43.386  1.00 25.31      A  C
ATOM   8576  C    ALA C 375     -21.916  25.947  44.131  1.00 25.70      A  C
ATOM   8577  O    ALA C 375     -22.627  25.093  43.716  1.00 24.42      A  O
ATOM   8578  N    LYS C 376     -20.629  25.773  44.243  1.00 25.01      A  N
ATOM   8579  CA   LYS C 376     -20.017  24.514  43.946  1.00 26.08      A  C
ATOM   8580  CB   LYS C 376     -18.525  24.664  43.845  1.00 24.09      A  C
ATOM   8581  CG   LYS C 376     -18.076  25.149  42.558  1.00 26.62      A  C
ATOM   8582  CD   LYS C 376     -16.681  25.574  42.611  1.00 24.52      A  C
ATOM   8583  CE   LYS C 376     -16.298  26.331  41.418  1.00 24.84      A  C
ATOM   8584  NZ   LYS C 376     -14.873  26.211  41.214  1.00 25.27      A  N
ATOM   8585  C    LYS C 376     -20.387  23.349  44.843  1.00 27.82      A  C
ATOM   8586  O    LYS C 376     -20.411  22.243  44.397  1.00 28.54      A  O
ATOM   8587  N    VAL C 377     -20.641  23.578  46.113  1.00 27.99      A  N
ATOM   8588  CA   VAL C 377     -20.897  22.470  46.977  1.00 27.47      A  C
ATOM   8589  CB   VAL C 377     -19.940  22.473  48.181  1.00 27.59      A  C
ATOM   8590  CG1  VAL C 377     -18.568  22.459  47.713  1.00 29.45      A  C
ATOM   8591  CG2  VAL C 377     -20.154  23.612  49.047  1.00 24.17      A  C
ATOM   8592  C    VAL C 377     -22.338  22.284  47.386  1.00 27.41      A  C
ATOM   8593  O    VAL C 377     -22.708  21.271  47.901  1.00 27.89      A  O
```

Appendix 1

```
ATOM   8594  N   HIS C 378     -23.165  23.247  47.085  1.00 27.22     A  N
ATOM   8595  CA  HIS C 378     -24.434  23.342  47.712  1.00 28.90     A  C
ATOM   8596  CB  HIS C 378     -25.046  24.635  47.250  1.00 27.95     A  C
ATOM   8597  CG  HIS C 378     -26.328  24.981  47.910  1.00 30.63     A  C
ATOM   8598  ND1 HIS C 378     -26.460  25.069  49.264  1.00 30.92     A  N
ATOM   8599  CE1 HIS C 378     -27.688  25.413  49.560  1.00 30.37     A  C
ATOM   8600  NE2 HIS C 378     -28.350  25.575  48.440  1.00 32.99     A  N
ATOM   8601  CD2 HIS C 378     -27.529  25.290  47.393  1.00 30.73     A  C
ATOM   8602  C   HIS C 378     -25.326  22.156  47.436  1.00 29.31     A  C
ATOM   8603  O   HIS C 378     -25.607  21.818  46.324  1.00 29.96     A  O
ATOM   8604  N   ALA C 379     -25.746  21.512  48.508  1.00 29.32     A  N
ATOM   8605  CA  ALA C 379     -26.525  20.299  48.491  1.00 29.11     A  C
ATOM   8606  CB  ALA C 379     -26.114  19.448  49.634  1.00 26.76     A  C
ATOM   8607  C   ALA C 379     -28.013  20.564  48.525  1.00 29.70     A  C
ATOM   8608  O   ALA C 379     -28.826  19.694  48.339  1.00 30.08     A  O
ATOM   8609  N   GLY C 380     -28.336  21.813  48.752  1.00 29.33     A  N
ATOM   8610  CA  GLY C 380     -29.680  22.298  48.905  1.00 28.76     A  C
ATOM   8611  C   GLY C 380     -30.066  22.595  50.321  1.00 28.45     A  C
ATOM   8612  O   GLY C 380     -29.725  21.914  51.230  1.00 27.86     A  O
ATOM   8613  N   PHE C 381     -30.788  23.661  50.482  1.00 27.90     A  N
ATOM   8614  CA  PHE C 381     -31.162  24.123  51.759  1.00 30.51     A  C
ATOM   8615  CB  PHE C 381     -31.698  25.538  51.668  1.00 31.44     A  C
ATOM   8616  CG  PHE C 381     -30.631  26.584  51.589  1.00 35.55     A  C
ATOM   8617  CD1 PHE C 381     -29.680  26.678  52.533  1.00 38.61     A  C
ATOM   8618  CE1 PHE C 381     -28.742  27.613  52.455  1.00 37.57     A  C
ATOM   8619  CZ  PHE C 381     -28.718  28.450  51.455  1.00 39.24     A  C
ATOM   8620  CE2 PHE C 381     -29.621  28.385  50.512  1.00 40.72     A  C
ATOM   8621  CD2 PHE C 381     -30.584  27.473  50.570  1.00 40.46     A  C
ATOM   8622  C   PHE C 381     -32.061  23.157  52.508  1.00 30.67     A  C
ATOM   8623  O   PHE C 381     -31.955  23.018  53.688  1.00 29.94     A  O
ATOM   8624  N   GLY C 382     -32.935  22.492  51.784  1.00 30.61     A  N
ATOM   8625  CA  GLY C 382     -33.703  21.369  52.254  1.00 31.58     A  C
ATOM   8626  C   GLY C 382     -32.916  20.152  52.644  1.00 33.95     A  C
ATOM   8627  O   GLY C 382     -33.250  19.488  53.549  1.00 35.54     A  O
ATOM   8628  N   ALA C 383     -31.865  19.825  51.946  1.00 35.39     A  N
ATOM   8629  CA  ALA C 383     -30.984  18.789  52.427  1.00 36.67     A  C
ATOM   8630  CB  ALA C 383     -29.993  18.442  51.403  1.00 34.58     A  C
ATOM   8631  C   ALA C 383     -30.286  19.136  53.748  1.00 37.97     A  C
ATOM   8632  O   ALA C 383     -30.121  18.314  54.603  1.00 39.95     A  O
ATOM   8633  N   LEU C 384     -29.857  20.360  53.907  1.00 38.11     A  N
ATOM   8634  CA  LEU C 384     -29.159  20.749  55.093  1.00 38.69     A  C
ATOM   8635  CB  LEU C 384     -28.678  22.173  54.996  1.00 37.83     A  C
ATOM   8636  CG  LEU C 384     -27.747  22.559  53.884  1.00 33.05     A  C
ATOM   8637  CD1 LEU C 384     -27.464  23.991  53.952  1.00 28.63     A  C
ATOM   8638  CD2 LEU C 384     -26.531  21.784  53.978  1.00 31.44     A  C
ATOM   8639  C   LEU C 384     -30.061  20.590  56.277  1.00 41.27     A  C
ATOM   8640  O   LEU C 384     -29.643  20.175  57.330  1.00 41.87     A  O
ATOM   8641  N   LEU C 385     -31.324  20.883  56.069  1.00 43.17     A  N
ATOM   8642  CA  LEU C 385     -32.365  20.748  57.052  1.00 45.08     A  C
ATOM   8643  CB  LEU C 385     -33.664  21.130  56.412  1.00 44.71     A  C
ATOM   8644  CG  LEU C 385     -33.947  22.588  56.538  1.00 47.60     A  C
ATOM   8645  CD1 LEU C 385     -35.028  22.978  55.610  1.00 50.13     A  C
ATOM   8646  CD2 LEU C 385     -34.337  22.828  57.931  1.00 49.93     A  C
ATOM   8647  C   LEU C 385     -32.506  19.331  57.478  1.00 46.06     A  C
```

Appendix 1

```
ATOM   8648  O   LEU C 385     -32.769  19.036  58.598  1.00 47.42      A    O
ATOM   8649  N   ARG C 386     -32.340  18.445  56.536  1.00 46.81      A    N
ATOM   8650  CA  ARG C 386     -32.626  17.063  56.721  1.00 47.23      A    C
ATOM   8651  CB  ARG C 386     -33.358  16.521  55.508  1.00 48.13      A    C
ATOM   8652  CG  ARG C 386     -34.801  16.888  55.467  1.00 49.31      A    C
ATOM   8653  CD  ARG C 386     -35.544  16.085  54.464  1.00 49.07      A    C
ATOM   8654  NE  ARG C 386     -35.194  16.469  53.118  1.00 54.21      A    N
ATOM   8655  CZ  ARG C 386     -35.734  17.480  52.460  1.00 57.02      A    C
ATOM   8656  NH1 ARG C 386     -36.661  18.241  53.030  1.00 54.02      A    N
ATOM   8657  NH2 ARG C 386     -35.326  17.725  51.226  1.00 52.53      A    N
ATOM   8658  C   ARG C 386     -31.332  16.345  56.922  1.00 47.19      A    C
ATOM   8659  O   ARG C 386     -31.210  15.189  56.601  1.00 46.18      A    O
ATOM   8660  N   MET C 387     -30.353  17.052  57.446  1.00 46.64      A    N
ATOM   8661  CA  MET C 387     -29.043  16.478  57.642  1.00 46.70      A    C
ATOM   8662  CB  MET C 387     -28.065  17.556  58.076  1.00 45.60      C    C
ATOM   8663  CG  MET C 387     -26.635  17.160  57.922  1.00 44.62      C    C
ATOM   8664  SD  MET C 387     -25.473  18.374  58.385  1.00 43.37      C    S
ATOM   8665  CE  MET C 387     -25.582  19.431  57.018  1.00 39.96      C    C
ATOM   8666  C   MET C 387     -29.057  15.344  58.644  1.00 46.62      A    C
ATOM   8667  O   MET C 387     -29.607  15.459  59.698  1.00 45.98      A    O
ATOM   8668  N   PRO C 388     -28.431  14.244  58.298  1.00 46.56      A    N
ATOM   8669  CA  PRO C 388     -28.373  13.100  59.173  1.00 47.50      A    C
ATOM   8670  CB  PRO C 388     -27.667  12.086  58.313  1.00 47.78      A    C
ATOM   8671  CG  PRO C 388     -28.078  12.418  57.038  1.00 47.76      A    C
ATOM   8672  CD  PRO C 388     -28.098  13.853  56.939  1.00 46.16      A    C
ATOM   8673  C   PRO C 388     -27.578  13.414  60.390  1.00 47.99      A    C
ATOM   8674  O   PRO C 388     -26.742  14.245  60.345  1.00 48.18      A    O
ATOM   8675  N   PRO C 389     -27.830  12.712  61.460  1.00 48.76      A    N
ATOM   8676  CA  PRO C 389     -27.525  13.117  62.807  1.00 49.90      A    C
ATOM   8677  CB  PRO C 389     -28.163  12.003  63.595  1.00 48.64      A    C
ATOM   8678  CG  PRO C 389     -29.304  11.639  62.793  1.00 49.97      A    C
ATOM   8679  CD  PRO C 389     -29.163  12.152  61.424  1.00 49.21      A    C
ATOM   8680  C   PRO C 389     -26.098  13.264  63.238  1.00 51.26      A    C
ATOM   8681  O   PRO C 389     -25.777  14.241  63.873  1.00 52.13      A    O
ATOM   8682  N   PRO C 390     -25.270  12.291  62.958  1.00 51.98      A    N
ATOM   8683  CA  PRO C 390     -23.930  12.269  63.508  1.00 52.78      A    C
ATOM   8684  CB  PRO C 390     -23.191  11.352  62.563  1.00 53.57      A    C
ATOM   8685  CG  PRO C 390     -23.953  11.356  61.341  1.00 53.81      A    C
ATOM   8686  CD  PRO C 390     -25.347  11.649  61.652  1.00 52.15      A    C
ATOM   8687  C   PRO C 390     -23.325  13.628  63.477  1.00 52.73      A    C
ATOM   8688  O   PRO C 390     -23.553  14.348  64.414  1.00 52.94      A    O
ATOM   8689  N   LEU D  29     -35.946  67.999  20.162  1.00 58.01      A    N
ATOM   8690  CA  LEU D  29     -34.582  68.153  19.709  1.00 59.13      A    C
ATOM   8691  CB  LEU D  29     -34.468  69.455  18.934  1.00 59.46      A    C
ATOM   8692  CG  LEU D  29     -34.336  69.516  17.417  1.00 62.38      A    C
ATOM   8693  CD1 LEU D  29     -34.897  70.835  16.950  1.00 61.56      A    C
ATOM   8694  CD2 LEU D  29     -32.898  69.406  16.957  1.00 60.51      A    C
ATOM   8695  C   LEU D  29     -33.660  68.227  20.889  1.00 57.90      A    C
ATOM   8696  O   LEU D  29     -33.923  69.014  21.755  1.00 57.77      A    O
ATOM   8697  N   PRO D  30     -32.554  67.482  20.875  1.00 56.75      A    N
ATOM   8698  CA  PRO D  30     -31.594  67.472  21.980  1.00 56.00      A    C
ATOM   8699  CB  PRO D  30     -32.141  66.358  22.877  1.00 56.72      A    C
ATOM   8700  CG  PRO D  30     -32.883  65.519  21.985  1.00 56.34      A    C
ATOM   8701  CD  PRO D  30     -33.539  66.419  21.014  1.00 57.19      A    C
```

Appendix 1

```
ATOM   8702  C    PRO D  30     -30.152  67.142  21.590  1.00 54.44     A  C
ATOM   8703  O    PRO D  30     -29.931  66.319  20.724  1.00 55.05     A  O
ATOM   8704  N    PRO D  31     -29.180  67.691  22.295  1.00 51.99     A  N
ATOM   8705  CA   PRO D  31     -27.791  67.648  21.831  1.00 50.24     A  C
ATOM   8706  CB   PRO D  31     -27.553  69.088  21.464  1.00 50.12     A  C
ATOM   8707  CG   PRO D  31     -28.531  69.847  22.289  1.00 50.64     A  C
ATOM   8708  CD   PRO D  31     -29.719  69.045  22.383  1.00 51.10     A  C
ATOM   8709  C    PRO D  31     -26.692  67.201  22.819  1.00 49.37     A  C
ATOM   8710  O    PRO D  31     -25.845  67.990  23.173  1.00 49.99     A  O
ATOM   8711  N    GLY D  32     -26.670  65.953  23.241  1.00 47.06     A  N
ATOM   8712  CA   GLY D  32     -25.790  65.530  24.321  1.00 43.95     A  C
ATOM   8713  C    GLY D  32     -26.427  65.679  25.699  1.00 42.26     A  C
ATOM   8714  O    GLY D  32     -25.829  65.373  26.703  1.00 41.71     A  O
ATOM   8715  N    ARG D  33     -27.657  66.178  25.688  1.00 39.17     A  N
ATOM   8716  CA   ARG D  33     -28.593  66.263  26.792  1.00 36.93     A  C
ATOM   8717  CB   ARG D  33     -29.610  67.346  26.513  1.00 34.79     A  C
ATOM   8718  CG   ARG D  33     -29.097  68.701  26.560  1.00 33.21     A  C
ATOM   8719  CD   ARG D  33     -29.354  69.369  27.875  1.00 27.35     A  C
ATOM   8720  NE   ARG D  33     -30.743  69.391  28.204  1.00 26.70     A  N
ATOM   8721  CZ   ARG D  33     -31.566  70.335  27.839  1.00 24.93     A  C
ATOM   8722  NH1  ARG D  33     -31.129  71.333  27.138  1.00 23.98     A  N
ATOM   8723  NH2  ARG D  33     -32.817  70.263  28.173  1.00 20.92     A  N
ATOM   8724  C    ARG D  33     -29.330  64.965  27.000  1.00 36.53     A  C
ATOM   8725  O    ARG D  33     -29.232  64.107  26.199  1.00 36.51     A  O
ATOM   8726  N    LEU D  34     -30.071  64.820  28.078  1.00 36.09     A  N
ATOM   8727  CA   LEU D  34     -30.817  63.596  28.322  1.00 35.32     A  C
ATOM   8728  CB   LEU D  34     -30.572  63.095  29.725  1.00 34.29     A  C
ATOM   8729  CG   LEU D  34     -29.128  63.036  30.135  1.00 36.98     A  C
ATOM   8730  CD1  LEU D  34     -28.986  63.145  31.591  1.00 38.42     A  C
ATOM   8731  CD2  LEU D  34     -28.509  61.823  29.655  1.00 37.78     A  C
ATOM   8732  C    LEU D  34     -32.296  63.652  28.069  1.00 33.81     A  C
ATOM   8733  O    LEU D  34     -32.873  62.655  27.783  1.00 34.19     A  O
ATOM   8734  N    ALA D  35     -32.900  64.817  28.198  1.00 32.34     A  N
ATOM   8735  CA   ALA D  35     -34.302  65.012  27.949  1.00 31.84     A  C
ATOM   8736  CB   ALA D  35     -35.079  64.726  29.132  1.00 31.44     A  C
ATOM   8737  C    ALA D  35     -34.497  66.421  27.558  1.00 32.65     A  C
ATOM   8738  O    ALA D  35     -33.690  67.214  27.850  1.00 33.61     A  O
ATOM   8739  N    THR D  36     -35.587  66.729  26.903  1.00 31.71     A  N
ATOM   8740  CA   THR D  36     -35.851  68.074  26.471  1.00 32.29     A  C
ATOM   8741  CB   THR D  36     -36.820  68.113  25.322  1.00 34.53     A  C
ATOM   8742  OG1  THR D  36     -38.082  67.633  25.748  1.00 36.46     A  O
ATOM   8743  CG2  THR D  36     -36.331  67.292  24.214  1.00 31.65     A  C
ATOM   8744  C    THR D  36     -36.391  68.946  27.540  1.00 32.60     A  C
ATOM   8745  O    THR D  36     -36.943  68.494  28.465  1.00 32.45     A  O
ATOM   8746  N    THR D  37     -36.245  70.232  27.375  1.00 32.14     A  N
ATOM   8747  CA   THR D  37     -36.738  71.181  28.327  1.00 32.33     A  C
ATOM   8748  CB   THR D  37     -36.212  72.548  28.012  1.00 32.09     A  C
ATOM   8749  OG1  THR D  37     -34.810  72.502  28.116  1.00 29.34     A  O
ATOM   8750  CG2  THR D  37     -36.718  73.553  28.945  1.00 30.57     A  C
ATOM   8751  C    THR D  37     -38.244  71.151  28.460  1.00 34.08     A  C
ATOM   8752  O    THR D  37     -38.765  71.216  29.534  1.00 34.18     A  O
ATOM   8753  N    GLU D  38     -38.923  70.991  27.347  1.00 35.60     D  N
ATOM   8754  CA   GLU D  38     -40.359  70.872  27.308  1.00 36.62     D  C
ATOM   8755  CB   GLU D  38     -40.846  70.863  25.857  1.00 36.81     D  C
```

Appendix 1

```
ATOM   8756  CG   GLU D  38      -42.093  70.091  25.540  1.00 42.34      D    C
ATOM   8757  CD   GLU D  38      -42.476  70.119  24.064  1.00 51.43      D    C
ATOM   8758  OE1  GLU D  38      -42.240  71.118  23.366  1.00 53.16      D    O
ATOM   8759  OE2  GLU D  38      -43.050  69.143  23.583  1.00 54.09      D    O
ATOM   8760  C    GLU D  38      -40.792  69.653  28.107  1.00 36.57      D    C
ATOM   8761  O    GLU D  38      -41.801  69.680  28.752  1.00 37.20      D    O
ATOM   8762  N    ASP D  39      -39.999  68.605  28.106  1.00 35.31      D    N
ATOM   8763  CA   ASP D  39      -40.252  67.477  28.968  1.00 35.92      D    C
ATOM   8764  CB   ASP D  39      -39.263  66.381  28.682  1.00 34.77      D    C
ATOM   8765  CG   ASP D  39      -39.587  65.613  27.471  1.00 40.17      D    C
ATOM   8766  OD1  ASP D  39      -40.703  65.675  26.960  1.00 41.04      D    O
ATOM   8767  OD2  ASP D  39      -38.698  64.922  27.014  1.00 45.01      D    O
ATOM   8768  C    ASP D  39      -40.172  67.765  30.452  1.00 35.81      D    C
ATOM   8769  O    ASP D  39      -40.959  67.294  31.216  1.00 36.56      D    O
ATOM   8770  N    TYR D  40      -39.177  68.507  30.876  1.00 33.60      A    N
ATOM   8771  CA   TYR D  40      -39.023  68.751  32.271  1.00 31.42      A    C
ATOM   8772  CB   TYR D  40      -37.719  69.482  32.520  1.00 29.18      A    C
ATOM   8773  CG   TYR D  40      -36.512  68.657  32.221  1.00 24.19      A    C
ATOM   8774  CD1  TYR D  40      -36.380  67.400  32.709  1.00 21.32      A    C
ATOM   8775  CE1  TYR D  40      -35.306  66.674  32.414  1.00 20.25      A    C
ATOM   8776  CZ   TYR D  40      -34.346  67.184  31.633  1.00 18.96      A    C
ATOM   8777  OH   TYR D  40      -33.253  66.464  31.343  1.00 17.49      A    O
ATOM   8778  CE2  TYR D  40      -34.453  68.411  31.169  1.00 14.69      A    C
ATOM   8779  CD2  TYR D  40      -35.511  69.136  31.444  1.00 18.25      A    C
ATOM   8780  C    TYR D  40      -40.207  69.531  32.747  1.00 32.41      A    C
ATOM   8781  O    TYR D  40      -40.764  69.282  33.771  1.00 31.62      A    O
ATOM   8782  N    PHE D  41      -40.581  70.508  31.964  1.00 31.83      A    N
ATOM   8783  CA   PHE D  41      -41.730  71.308  32.232  1.00 31.74      A    C
ATOM   8784  CB   PHE D  41      -41.680  72.549  31.382  1.00 32.86      A    C
ATOM   8785  CG   PHE D  41      -40.746  73.587  31.887  1.00 31.13      A    C
ATOM   8786  CD1  PHE D  41      -41.205  74.704  32.466  1.00 29.54      A    C
ATOM   8787  CE1  PHE D  41      -40.364  75.638  32.917  1.00 31.54      A    C
ATOM   8788  CZ   PHE D  41      -39.057  75.489  32.768  1.00 29.08      A    C
ATOM   8789  CE2  PHE D  41      -38.585  74.402  32.176  1.00 32.99      A    C
ATOM   8790  CD2  PHE D  41      -39.419  73.461  31.741  1.00 30.95      A    C
ATOM   8791  C    PHE D  41      -43.062  70.575  32.124  1.00 32.36      A    C
ATOM   8792  O    PHE D  41      -44.040  70.999  32.662  1.00 32.31      A    O
ATOM   8793  N    ALA D  42      -43.107  69.459  31.434  1.00 31.37      A    N
ATOM   8794  CA   ALA D  42      -44.363  68.764  31.322  1.00 32.18      A    C
ATOM   8795  CB   ALA D  42      -44.531  68.197  29.971  1.00 30.31      A    C
ATOM   8796  C    ALA D  42      -44.601  67.709  32.359  1.00 32.02      A    C
ATOM   8797  O    ALA D  42      -45.659  67.154  32.419  1.00 32.93      A    O
ATOM   8798  N    GLN D  43      -43.626  67.457  33.197  1.00 30.50      A    N
ATOM   8799  CA   GLN D  43      -43.666  66.366  34.126  1.00 31.12      A    C
ATOM   8800  CB   GLN D  43      -42.412  66.365  34.964  1.00 30.66      A    C
ATOM   8801  CG   GLN D  43      -41.227  65.855  34.306  1.00 29.93      A    C
ATOM   8802  CD   GLN D  43      -39.989  65.948  35.112  1.00 30.01      A    C
ATOM   8803  OE1  GLN D  43      -39.498  67.002  35.367  1.00 31.25      A    O
ATOM   8804  NE2  GLN D  43      -39.457  64.836  35.466  1.00 26.68      A    N
ATOM   8805  C    GLN D  43      -44.816  66.444  35.073  1.00 31.82      A    C
ATOM   8806  O    GLN D  43      -45.413  65.458  35.362  1.00 30.52      A    O
ATOM   8807  N    GLN D  44      -45.118  67.618  35.577  1.00 33.21      A    N
ATOM   8808  CA   GLN D  44      -46.265  67.743  36.420  1.00 34.67      A    C
ATOM   8809  CB   GLN D  44      -46.313  69.109  37.053  1.00 33.77      A    C
```

Appendix 1

```
ATOM   8810  CG  GLN D  44     -47.081  69.084  38.320  1.00 39.49      A    C
ATOM   8811  CD  GLN D  44     -47.219  70.396  39.005  1.00 44.08      A    C
ATOM   8812  OE1 GLN D  44     -46.455  71.305  38.782  1.00 47.64      A    O
ATOM   8813  NE2 GLN D  44     -48.192  70.492  39.870  1.00 41.07      A    N
ATOM   8814  C   GLN D  44     -47.571  67.457  35.725  1.00 35.62      A    C
ATOM   8815  O   GLN D  44     -48.389  66.746  36.227  1.00 34.71      A    O
ATOM   8816  N   ALA D  45     -47.759  68.028  34.556  1.00 37.74      A    N
ATOM   8817  CA  ALA D  45     -48.931  67.780  33.763  1.00 38.31      A    C
ATOM   8818  CB  ALA D  45     -48.874  68.619  32.571  1.00 37.84      A    C
ATOM   8819  C   ALA D  45     -49.018  66.349  33.342  1.00 38.85      A    C
ATOM   8820  O   ALA D  45     -50.053  65.749  33.435  1.00 38.73      A    O
ATOM   8821  N   LYS D  46     -47.918  65.813  32.859  1.00 38.99      A    N
ATOM   8822  CA  LYS D  46     -47.823  64.410  32.556  1.00 39.63      A    C
ATOM   8823  CB  LYS D  46     -46.621  64.102  31.718  1.00 39.69      A    C
ATOM   8824  CG  LYS D  46     -46.820  64.448  30.285  1.00 40.12      A    C
ATOM   8825  CD  LYS D  46     -45.640  64.009  29.497  1.00 45.03      A    C
ATOM   8826  CE  LYS D  46     -45.290  64.937  28.352  1.00 49.68      A    C
ATOM   8827  NZ  LYS D  46     -43.832  65.038  28.059  1.00 44.85      A    N
ATOM   8828  C   LYS D  46     -47.875  63.543  33.772  1.00 40.93      A    C
ATOM   8829  O   LYS D  46     -48.282  62.422  33.699  1.00 41.96      A    O
ATOM   8830  N   GLN D  47     -47.445  64.048  34.909  1.00 42.50      A    N
ATOM   8831  CA  GLN D  47     -47.598  63.283  36.106  1.00 41.82      A    C
ATOM   8832  CB  GLN D  47     -48.897  62.590  35.982  1.00 42.95      A    C
ATOM   8833  CG  GLN D  47     -49.420  62.077  37.220  1.00 47.15      A    C
ATOM   8834  CD  GLN D  47     -50.701  62.713  37.485  1.00 51.29      A    C
ATOM   8835  OE1 GLN D  47     -50.869  63.850  37.146  1.00 46.93      A    O
ATOM   8836  NE2 GLN D  47     -51.627  61.996  38.085  1.00 50.93      A    N
ATOM   8837  C   GLN D  47     -46.560  62.226  36.303  1.00 40.56      A    C
ATOM   8838  O   GLN D  47     -46.780  61.329  37.042  1.00 40.27      A    O
ATOM   8839  N   ALA D  48     -45.457  62.333  35.601  1.00 38.04      A    N
ATOM   8840  CA  ALA D  48     -44.391  61.400  35.702  1.00 36.83      A    C
ATOM   8841  CB  ALA D  48     -44.591  60.327  34.722  1.00 35.34      A    C
ATOM   8842  C   ALA D  48     -43.075  62.086  35.457  1.00 36.09      A    C
ATOM   8843  O   ALA D  48     -42.960  62.909  34.603  1.00 36.99      A    O
ATOM   8844  N   VAL D  49     -42.074  61.711  36.208  1.00 34.07      A    N
ATOM   8845  CA  VAL D  49     -40.759  62.211  35.993  1.00 32.16      A    C
ATOM   8846  CB  VAL D  49     -39.888  61.913  37.169  1.00 30.90      A    C
ATOM   8847  CG1 VAL D  49     -40.490  62.396  38.377  1.00 27.76      A    C
ATOM   8848  CG2 VAL D  49     -39.648  60.503  37.281  1.00 30.18      A    C
ATOM   8849  C   VAL D  49     -40.173  61.600  34.766  1.00 31.77      A    C
ATOM   8850  O   VAL D  49     -40.564  60.565  34.380  1.00 32.20      A    O
ATOM   8851  N   THR D  50     -39.210  62.244  34.170  1.00 31.87      A    N
ATOM   8852  CA  THR D  50     -38.550  61.696  33.034  1.00 30.83      A    C
ATOM   8853  CB  THR D  50     -37.783  62.770  32.286  1.00 30.95      A    C
ATOM   8854  OG1 THR D  50     -36.601  63.099  32.984  1.00 28.61      A    O
ATOM   8855  CG2 THR D  50     -38.597  63.978  32.204  1.00 23.86      A    C
ATOM   8856  C   THR D  50     -37.680  60.568  33.501  1.00 32.10      A    C
ATOM   8857  O   THR D  50     -37.430  60.451  34.637  1.00 32.54      A    O
ATOM   8858  N   PRO D  51     -37.287  59.704  32.595  1.00 33.65      A    N
ATOM   8859  CA  PRO D  51     -36.530  58.499  32.876  1.00 32.92      A    C
ATOM   8860  CB  PRO D  51     -36.337  57.904  31.493  1.00 32.03      A    C
ATOM   8861  CG  PRO D  51     -37.314  58.486  30.692  1.00 32.35      A    C
ATOM   8862  CD  PRO D  51     -37.577  59.821  31.175  1.00 34.08      A    C
ATOM   8863  C   PRO D  51     -35.233  58.916  33.410  1.00 32.48      A    C
```

Appendix 1

```
ATOM   8864  O   PRO D  51     -34.575  58.278  34.156  1.00 34.21      A  O
ATOM   8865  N   ASP D  52     -34.879  60.068  32.935  1.00 31.36      A  N
ATOM   8866  CA  ASP D  52     -33.722  60.776  33.288  1.00 31.56      A  C
ATOM   8867  CB  ASP D  52     -33.929  62.054  32.504  1.00 33.16      A  C
ATOM   8868  CG  ASP D  52     -32.777  62.867  32.468  1.00 37.59      A  C
ATOM   8869  OD1 ASP D  52     -31.750  62.323  32.764  1.00 43.95      A  O
ATOM   8870  OD2 ASP D  52     -32.881  64.035  32.170  1.00 39.65      A  O-1
ATOM   8871  C   ASP D  52     -33.713  61.138  34.763  1.00 30.47      A  C
ATOM   8872  O   ASP D  52     -32.793  60.901  35.468  1.00 28.97      A  O
ATOM   8873  N   VAL D  53     -34.783  61.723  35.215  1.00 29.29      A  N
ATOM   8874  CA  VAL D  53     -35.002  61.960  36.589  1.00 29.85      A  C
ATOM   8875  CB  VAL D  53     -36.152  62.861  36.753  1.00 30.37      A  C
ATOM   8876  CG1 VAL D  53     -36.532  62.948  38.142  1.00 30.81      A  C
ATOM   8877  CG2 VAL D  53     -35.794  64.158  36.253  1.00 27.21      A  C
ATOM   8878  C   VAL D  53     -35.135  60.684  37.418  1.00 30.75      A  C
ATOM   8879  O   VAL D  53     -34.713  60.645  38.532  1.00 32.88      A  O
ATOM   8880  N   MET D  54     -35.731  59.650  36.876  1.00 29.54      A  N
ATOM   8881  CA  MET D  54     -35.806  58.380  37.544  1.00 28.30      A  C
ATOM   8882  CB  MET D  54     -36.721  57.416  36.815  1.00 28.90      D  C
ATOM   8883  CG  MET D  54     -36.956  56.133  37.523  1.00 28.77      D  C
ATOM   8884  SD  MET D  54     -38.169  56.290  38.760  1.00 40.09      D  S
ATOM   8885  CE  MET D  54     -38.974  54.785  38.613  1.00 42.07      D  C
ATOM   8886  C   MET D  54     -34.469  57.769  37.754  1.00 27.36      A  C
ATOM   8887  O   MET D  54     -34.255  57.113  38.704  1.00 28.29      A  O
ATOM   8888  N   ALA D  55     -33.573  57.973  36.830  1.00 25.92      A  N
ATOM   8889  CA  ALA D  55     -32.213  57.553  37.000  1.00 25.20      A  C
ATOM   8890  CB  ALA D  55     -31.483  57.600  35.727  1.00 23.91      A  C
ATOM   8891  C   ALA D  55     -31.437  58.222  38.122  1.00 24.01      A  C
ATOM   8892  O   ALA D  55     -30.591  57.618  38.667  1.00 23.56      A  O
ATOM   8893  N   GLN D  56     -31.693  59.486  38.405  1.00 23.78      A  N
ATOM   8894  CA  GLN D  56     -31.178  60.206  39.546  1.00 21.95      A  C
ATOM   8895  CB  GLN D  56     -31.531  61.683  39.383  1.00 20.93      A  C
ATOM   8896  CG  GLN D  56     -31.113  62.618  40.468  1.00 23.53      A  C
ATOM   8897  CD  GLN D  56     -29.660  62.614  40.759  1.00 24.13      A  C
ATOM   8898  OE1 GLN D  56     -28.892  62.233  39.954  1.00 29.56      A  O
ATOM   8899  NE2 GLN D  56     -29.299  63.019  41.908  1.00 12.81      A  N
ATOM   8900  C   GLN D  56     -31.714  59.618  40.839  1.00 21.75      A  C
ATOM   8901  O   GLN D  56     -31.010  59.445  41.776  1.00 20.57      A  O
ATOM   8902  N   LEU D  57     -32.985  59.306  40.848  1.00 21.14      A  N
ATOM   8903  CA  LEU D  57     -33.614  58.655  41.964  1.00 22.41      A  C
ATOM   8904  CB  LEU D  57     -35.114  58.630  41.816  1.00 22.67      A  C
ATOM   8905  CG  LEU D  57     -35.816  59.940  42.047  1.00 22.04      A  C
ATOM   8906  CD1 LEU D  57     -37.181  59.887  41.548  1.00 21.35      A  C
ATOM   8907  CD2 LEU D  57     -35.818  60.299  43.452  1.00 21.23      A  C
ATOM   8908  C   LEU D  57     -33.083  57.290  42.207  1.00 24.08      A  C
ATOM   8909  O   LEU D  57     -33.008  56.863  43.304  1.00 25.28      A  O
ATOM   8910  N   ALA D  58     -32.750  56.579  41.163  1.00 24.61      A  N
ATOM   8911  CA  ALA D  58     -32.112  55.303  41.328  1.00 25.10      A  C
ATOM   8912  CB  ALA D  58     -32.060  54.574  40.067  1.00 24.02      A  C
ATOM   8913  C   ALA D  58     -30.744  55.433  41.932  1.00 24.27      A  C
ATOM   8914  O   ALA D  58     -30.370  54.669  42.737  1.00 24.09      A  O
ATOM   8915  N   TYR D  59     -29.997  56.417  41.523  1.00 23.48      A  N
ATOM   8916  CA  TYR D  59     -28.719  56.671  42.112  1.00 24.30      A  C
ATOM   8917  CB  TYR D  59     -27.946  57.738  41.337  1.00 24.48      A  C
```

Appendix 1

```
ATOM   8918  CG   TYR D  59     -26.928  58.416  42.169  1.00  27.24     A    C
ATOM   8919  CD1  TYR D  59     -25.767  57.804  42.496  1.00  29.55     A    C
ATOM   8920  CE1  TYR D  59     -24.896  58.393  43.262  1.00  33.01     A    C
ATOM   8921  CZ   TYR D  59     -25.153  59.608  43.728  1.00  34.22     A    C
ATOM   8922  OH   TYR D  59     -24.244  60.203  44.507  1.00  41.40     A    O
ATOM   8923  CE2  TYR D  59     -26.290  60.231  43.447  1.00  28.83     A    C
ATOM   8924  CD2  TYR D  59     -27.162  59.643  42.681  1.00  29.77     A    C
ATOM   8925  C    TYR D  59     -28.848  57.031  43.584  1.00  24.37     A    C
ATOM   8926  O    TYR D  59     -28.076  56.614  44.377  1.00  22.55     A    O
ATOM   8927  N    MET D  60     -29.845  57.823  43.915  1.00  23.75     A    N
ATOM   8928  CA   MET D  60     -30.117  58.235  45.250  1.00  23.50     A    C
ATOM   8929  CB   MET D  60     -31.180  59.315  45.248  1.00  23.11     D    C
ATOM   8930  CG   MET D  60     -30.689  60.676  44.784  1.00  24.60     D    C
ATOM   8931  SD   MET D  60     -31.917  61.813  44.259  1.00  24.33     D    S
ATOM   8932  CE   MET D  60     -32.605  62.209  45.774  1.00  22.81     D    C
ATOM   8933  C    MET D  60     -30.484  57.080  46.130  1.00  23.70     A    C
ATOM   8934  O    MET D  60     -30.149  57.049  47.268  1.00  25.57     A    O
ATOM   8935  N    ASN D  61     -31.169  56.113  45.583  1.00  22.14     A    N
ATOM   8936  CA   ASN D  61     -31.707  55.065  46.379  1.00  22.17     A    C
ATOM   8937  CB   ASN D  61     -33.216  55.036  46.171  1.00  20.88     A    C
ATOM   8938  CG   ASN D  61     -33.930  56.156  46.829  1.00  23.99     A    C
ATOM   8939  OD1  ASN D  61     -34.233  56.086  47.966  1.00  27.27     A    O
ATOM   8940  ND2  ASN D  61     -34.218  57.172  46.108  1.00  19.71     A    N
ATOM   8941  C    ASN D  61     -31.205  53.675  46.150  1.00  22.52     A    C
ATOM   8942  O    ASN D  61     -31.455  52.856  46.934  1.00  23.56     A    O
ATOM   8943  N    TYR D  62     -30.610  53.365  45.025  1.00  22.74     A    N
ATOM   8944  CA   TYR D  62     -30.437  51.967  44.701  1.00  23.40     A    C
ATOM   8945  CB   TYR D  62     -30.224  51.816  43.183  1.00  23.77     A    C
ATOM   8946  CG   TYR D  62     -30.503  50.440  42.680  1.00  22.45     A    C
ATOM   8947  CD1  TYR D  62     -31.699  50.146  42.129  1.00  24.66     A    C
ATOM   8948  CE1  TYR D  62     -31.979  48.935  41.725  1.00  27.10     A    C
ATOM   8949  CZ   TYR D  62     -31.087  47.973  41.847  1.00  28.41     A    C
ATOM   8950  OH   TYR D  62     -31.472  46.766  41.386  1.00  31.19     A    O
ATOM   8951  CE2  TYR D  62     -29.881  48.227  42.408  1.00  22.30     A    C
ATOM   8952  CD2  TYR D  62     -29.593  49.441  42.786  1.00  16.80     A    C
ATOM   8953  C    TYR D  62     -29.436  51.088  45.411  1.00  24.18     A    C
ATOM   8954  O    TYR D  62     -29.807  50.086  45.942  1.00  23.34     A    O
ATOM   8955  N    ILE D  63     -28.155  51.410  45.348  1.00  24.67     A    N
ATOM   8956  CA   ILE D  63     -27.114  50.535  45.849  1.00  25.50     A    C
ATOM   8957  CB   ILE D  63     -25.784  50.833  45.230  1.00  25.14     A    C
ATOM   8958  CG1  ILE D  63     -25.867  50.670  43.740  1.00  25.97     A    C
ATOM   8959  CD1  ILE D  63     -24.685  51.104  43.026  1.00  15.83     A    C
ATOM   8960  CG2  ILE D  63     -24.786  49.896  45.729  1.00  25.51     A    C
ATOM   8961  C    ILE D  63     -26.987  50.486  47.352  1.00  27.57     A    C
ATOM   8962  O    ILE D  63     -27.122  51.461  48.009  1.00  24.84     A    O
ATOM   8963  N    ASP D  64     -26.778  49.324  47.923  1.00  30.43     A    N
ATOM   8964  CA   ASP D  64     -26.988  49.312  49.327  1.00  33.08     A    C
ATOM   8965  CB   ASP D  64     -27.878  48.188  49.904  1.00  34.22     A    C
ATOM   8966  CG   ASP D  64     -27.525  46.843  49.479  1.00  39.43     A    C
ATOM   8967  OD1  ASP D  64     -26.422  46.380  49.757  1.00  44.59     A    O
ATOM   8968  OD2  ASP D  64     -28.426  46.196  48.950  1.00  43.28     A    O
ATOM   8969  C    ASP D  64     -26.212  50.077  50.374  1.00  33.86     A    C
ATOM   8970  O    ASP D  64     -26.806  50.541  51.303  1.00  35.26     A    O
ATOM   8971  N    PHE D  65     -24.936  50.262  50.333  1.00  32.50     A    N
```

Appendix 1

```
ATOM   8972  CA   PHE D  65     -24.530  51.032  51.487  1.00 30.88      A  C
ATOM   8973  CB   PHE D  65     -23.458  50.313  52.266  1.00 29.34      A  C
ATOM   8974  CG   PHE D  65     -23.867  48.964  52.757  1.00 28.61      A  C
ATOM   8975  CD1  PHE D  65     -24.737  48.828  53.792  1.00 26.14      A  C
ATOM   8976  CE1  PHE D  65     -25.076  47.624  54.231  1.00 24.64      A  C
ATOM   8977  CZ   PHE D  65     -24.579  46.550  53.650  1.00 25.18      A  C
ATOM   8978  CE2  PHE D  65     -23.716  46.666  52.638  1.00 20.35      A  C
ATOM   8979  CD2  PHE D  65     -23.373  47.841  52.189  1.00 19.73      A  C
ATOM   8980  C    PHE D  65     -24.134  52.423  51.117  1.00 30.49      A  C
ATOM   8981  O    PHE D  65     -24.070  53.300  51.929  1.00 29.07      A  O
ATOM   8982  N    ILE D  66     -23.895  52.581  49.836  1.00 29.39      A  N
ATOM   8983  CA   ILE D  66     -23.315  53.755  49.285  1.00 28.61      A  C
ATOM   8984  CB   ILE D  66     -22.221  53.352  48.359  1.00 28.32      A  C
ATOM   8985  CG1  ILE D  66     -22.774  52.721  47.112  1.00 26.10      A  C
ATOM   8986  CD1  ILE D  66     -21.758  52.212  46.296  1.00 23.67      A  C
ATOM   8987  CG2  ILE D  66     -21.386  52.361  49.028  1.00 25.93      A  C
ATOM   8988  C    ILE D  66     -24.237  54.718  48.615  1.00 29.41      A  C
ATOM   8989  O    ILE D  66     -23.815  55.725  48.200  1.00 31.80      A  O
ATOM   8990  N    SER D  67     -25.496  54.396  48.492  1.00 28.14      A  N
ATOM   8991  CA   SER D  67     -26.453  55.355  48.038  1.00 27.64      A  C
ATOM   8992  CB   SER D  67     -27.724  54.663  47.565  1.00 28.02      A  C
ATOM   8993  OG   SER D  67     -27.959  53.489  48.252  1.00 26.33      A  O
ATOM   8994  C    SER D  67     -26.717  56.377  49.127  1.00 27.45      A  C
ATOM   8995  O    SER D  67     -26.700  56.052  50.262  1.00 26.58      A  O
ATOM   8996  N    PRO D  68     -26.977  57.613  48.760  1.00 26.41      A  N
ATOM   8997  CA   PRO D  68     -27.142  58.684  49.717  1.00 26.40      A  C
ATOM   8998  CB   PRO D  68     -27.335  59.902  48.824  1.00 26.94      A  C
ATOM   8999  CG   PRO D  68     -27.531  59.415  47.528  1.00 26.18      A  C
ATOM   9000  CD   PRO D  68     -26.861  58.158  47.415  1.00 26.73      A  C
ATOM   9001  C    PRO D  68     -28.318  58.496  50.647  1.00 26.93      A  C
ATOM   9002  O    PRO D  68     -28.293  58.952  51.744  1.00 26.24      A  O
ATOM   9003  N    PHE D  69     -29.342  57.821  50.179  1.00 27.05      A  N
ATOM   9004  CA   PHE D  69     -30.580  57.664  50.893  1.00 27.25      A  C
ATOM   9005  CB   PHE D  69     -31.772  58.250  50.149  1.00 27.13      A  C
ATOM   9006  CG   PHE D  69     -31.719  59.688  50.055  1.00 27.47      A  C
ATOM   9007  CD1  PHE D  69     -32.276  60.461  50.993  1.00 30.23      A  C
ATOM   9008  CE1  PHE D  69     -32.170  61.775  50.928  1.00 26.14      A  C
ATOM   9009  CZ   PHE D  69     -31.496  62.331  49.969  1.00 29.03      A  C
ATOM   9010  CE2  PHE D  69     -30.904  61.596  49.049  1.00 31.77      A  C
ATOM   9011  CD2  PHE D  69     -31.018  60.282  49.081  1.00 31.16      A  C
ATOM   9012  C    PHE D  69     -30.825  56.267  51.312  1.00 27.24      A  C
ATOM   9013  O    PHE D  69     -31.921  55.886  51.467  1.00 28.12      A  O
ATOM   9014  N    TYR D  70     -29.778  55.502  51.468  1.00 28.08      A  N
ATOM   9015  CA   TYR D  70     -29.877  54.168  51.970  1.00 27.60      A  C
ATOM   9016  CB   TYR D  70     -28.529  53.493  51.848  1.00 27.55      A  C
ATOM   9017  CG   TYR D  70     -28.545  52.089  52.316  1.00 30.50      A  C
ATOM   9018  CD1  TYR D  70     -29.141  51.128  51.565  1.00 27.85      A  C
ATOM   9019  CE1  TYR D  70     -29.194  49.889  51.972  1.00 30.53      A  C
ATOM   9020  CZ   TYR D  70     -28.659  49.548  53.140  1.00 36.12      A  C
ATOM   9021  OH   TYR D  70     -28.742  48.253  53.503  1.00 43.80      A  O
ATOM   9022  CE2  TYR D  70     -28.065  50.466  53.932  1.00 33.22      A  C
ATOM   9023  CD2  TYR D  70     -28.011  51.726  53.525  1.00 30.82      A  C
ATOM   9024  C    TYR D  70     -30.368  54.083  53.395  1.00 28.60      A  C
ATOM   9025  O    TYR D  70     -31.175  53.273  53.697  1.00 29.40      A  O
```

Appendix 1

```
ATOM   9026  N   SER D  71     -29.875  54.933  54.271  1.00  28.46      A   N
ATOM   9027  CA  SER D  71     -30.133  54.795  55.680  1.00  29.61      A   C
ATOM   9028  CB  SER D  71     -28.895  54.231  56.330  1.00  28.29      A   C
ATOM   9029  OG  SER D  71     -29.246  53.327  57.294  1.00  28.88      A   O
ATOM   9030  C   SER D  71     -30.508  56.058  56.418  1.00  29.82      A   C
ATOM   9031  O   SER D  71     -30.116  57.094  56.060  1.00  30.93      A   O
ATOM   9032  N   ARG D  72     -31.276  55.910  57.477  1.00  29.53      A   N
ATOM   9033  CA  ARG D  72     -31.519  56.887  58.518  1.00  30.37      A   C
ATOM   9034  CB  ARG D  72     -32.522  56.326  59.494  1.00  31.40      A   C
ATOM   9035  CG  ARG D  72     -33.842  56.955  59.514  1.00  36.44      A   C
ATOM   9036  CD  ARG D  72     -34.334  57.084  60.914  1.00  45.12      A   C
ATOM   9037  NE  ARG D  72     -35.632  56.494  61.078  1.00  49.83      A   N
ATOM   9038  CZ  ARG D  72     -36.609  56.636  60.211  1.00  53.07      A   C
ATOM   9039  NH1 ARG D  72     -36.425  57.365  59.143  1.00  48.31      A   N
ATOM   9040  NH2 ARG D  72     -37.765  56.050  60.416  1.00  52.52      A   N
ATOM   9041  C   ARG D  72     -30.255  57.143  59.274  1.00  29.85      A   C
ATOM   9042  O   ARG D  72     -30.086  58.154  59.863  1.00  31.01      A   O
ATOM   9043  N   GLY D  73     -29.350  56.197  59.200  1.00  30.54      A   N
ATOM   9044  CA  GLY D  73     -28.117  56.179  59.929  1.00  30.60      A   C
ATOM   9045  C   GLY D  73     -27.145  57.260  59.618  1.00  31.81      A   C
ATOM   9046  O   GLY D  73     -27.123  57.799  58.564  1.00  33.00      A   O
ATOM   9047  N   CYS D  74     -26.347  57.610  60.592  1.00  32.62      A   N
ATOM   9048  CA  CYS D  74     -25.504  58.748  60.432  1.00  34.16      A   C
ATOM   9049  CB  CYS D  74     -25.419  59.608  61.739  1.00  34.60      A   C
ATOM   9050  SG  CYS D  74     -26.381  61.225  61.645  1.00  41.37      A   S
ATOM   9051  C   CYS D  74     -24.223  58.306  59.739  1.00  32.84      A   C
ATOM   9052  O   CYS D  74     -23.152  58.344  60.252  1.00  33.05      A   O
ATOM   9053  N   SER D  75     -24.431  57.860  58.522  1.00  33.32      A   N
ATOM   9054  CA  SER D  75     -23.431  57.371  57.614  1.00  33.01      A   C
ATOM   9055  CB  SER D  75     -23.758  55.962  57.270  1.00  33.07      A   C
ATOM   9056  OG  SER D  75     -22.954  55.573  56.211  1.00  39.78      A   O
ATOM   9057  C   SER D  75     -23.307  58.177  56.323  1.00  31.33      A   C
ATOM   9058  O   SER D  75     -24.269  58.567  55.722  1.00  30.17      A   O
ATOM   9059  N   PHE D  76     -22.095  58.441  55.904  1.00  30.55      A   N
ATOM   9060  CA  PHE D  76     -21.887  59.365  54.838  1.00  29.51      A   C
ATOM   9061  CB  PHE D  76     -21.455  60.681  55.418  1.00  27.74      A   C
ATOM   9062  CG  PHE D  76     -22.508  61.315  56.191  1.00  29.74      A   C
ATOM   9063  CD1 PHE D  76     -23.414  62.114  55.580  1.00  29.67      A   C
ATOM   9064  CE1 PHE D  76     -24.426  62.669  56.284  1.00  29.86      A   C
ATOM   9065  CZ  PHE D  76     -24.545  62.408  57.599  1.00  31.10      A   C
ATOM   9066  CE2 PHE D  76     -23.673  61.606  58.208  1.00  28.85      A   C
ATOM   9067  CD2 PHE D  76     -22.661  61.057  57.514  1.00  30.35      A   C
ATOM   9068  C   PHE D  76     -21.006  58.932  53.722  1.00  30.26      A   C
ATOM   9069  O   PHE D  76     -20.402  59.730  53.117  1.00  30.02      A   O
ATOM   9070  N   GLU D  77     -21.010  57.657  53.408  1.00  32.93      A   N
ATOM   9071  CA  GLU D  77     -20.145  57.092  52.392  1.00  35.64      A   C
ATOM   9072  CB  GLU D  77     -20.292  55.580  52.315  1.00  36.60      A   C
ATOM   9073  CG  GLU D  77     -20.752  54.964  53.574  1.00  45.29      A   C
ATOM   9074  CD  GLU D  77     -20.070  53.670  53.882  1.00  57.22      A   C
ATOM   9075  OE1 GLU D  77     -19.456  53.552  54.949  1.00  63.58      A   O
ATOM   9076  OE2 GLU D  77     -20.153  52.755  53.067  1.00  60.34      A   O-1
ATOM   9077  C   GLU D  77     -20.374  57.684  51.033  1.00  34.80      A   C
ATOM   9078  O   GLU D  77     -19.479  57.812  50.273  1.00  35.98      A   O
ATOM   9079  N   ALA D  78     -21.606  58.018  50.749  1.00  34.07      A   N
```

Appendix 1

```
ATOM   9080  CA   ALA D  78     -21.987  58.533  49.482  1.00 32.64           A C
ATOM   9081  CB   ALA D  78     -23.430  58.713  49.485  1.00 32.00           A C
ATOM   9082  C    ALA D  78     -21.324  59.834  49.199  1.00 32.68           A C
ATOM   9083  O    ALA D  78     -20.898  60.073  48.118  1.00 33.15           A O
ATOM   9084  N    TRP D  79     -21.314  60.700  50.185  1.00 32.37           A N
ATOM   9085  CA   TRP D  79     -20.621  61.950  50.154  1.00 31.93           A C
ATOM   9086  CB   TRP D  79     -21.080  62.816  51.307  1.00 30.86           A C
ATOM   9087  CG   TRP D  79     -22.479  63.296  51.103  1.00 28.76           A C
ATOM   9088  CD1  TRP D  79     -22.852  64.399  50.492  1.00 23.90           A C
ATOM   9089  NE1  TRP D  79     -24.177  64.505  50.480  1.00 22.90           A N
ATOM   9090  CE2  TRP D  79     -24.707  63.433  51.110  1.00 20.97           A C
ATOM   9091  CD2  TRP D  79     -23.667  62.646  51.503  1.00 23.50           A C
ATOM   9092  CE3  TRP D  79     -23.942  61.471  52.172  1.00 20.42           A C
ATOM   9093  CZ3  TRP D  79     -25.185  61.150  52.390  1.00 20.79           A C
ATOM   9094  CH2  TRP D  79     -26.201  61.951  51.988  1.00 24.09           A C
ATOM   9095  CZ2  TRP D  79     -25.982  63.098  51.338  1.00 20.37           A C
ATOM   9096  C    TRP D  79     -19.123  61.804  50.082  1.00 33.23           A C
ATOM   9097  O    TRP D  79     -18.473  62.576  49.463  1.00 32.41           A O
ATOM   9098  N    GLU D  80     -18.599  60.805  50.759  1.00 33.74           A N
ATOM   9099  CA   GLU D  80     -17.210  60.490  50.741  1.00 35.83           A C
ATOM   9100  CB   GLU D  80     -16.948  59.355  51.707  1.00 36.53           A C
ATOM   9101  CG   GLU D  80     -16.935  59.772  53.130  1.00 44.11           A C
ATOM   9102  CD   GLU D  80     -17.037  58.639  54.113  1.00 55.05           A C
ATOM   9103  OE1  GLU D  80     -16.730  57.496  53.762  1.00 55.04           A O
ATOM   9104  OE2  GLU D  80     -17.423  58.901  55.256  1.00 55.45           A O-1
ATOM   9105  C    GLU D  80     -16.751  60.078  49.382  1.00 35.39           A C
ATOM   9106  O    GLU D  80     -15.717  60.466  48.951  1.00 35.85           A O
ATOM   9107  N    LEU D  81     -17.523  59.236  48.735  1.00 34.29           A N
ATOM   9108  CA   LEU D  81     -17.265  58.802  47.397  1.00 34.99           A C
ATOM   9109  CB   LEU D  81     -18.219  57.695  47.027  1.00 35.62           A C
ATOM   9110  CG   LEU D  81     -17.973  56.318  47.605  1.00 36.10           A C
ATOM   9111  CD1  LEU D  81     -19.138  55.476  47.511  1.00 37.76           A C
ATOM   9112  CD2  LEU D  81     -16.851  55.638  46.992  1.00 35.25           A C
ATOM   9113  C    LEU D  81     -17.358  59.932  46.414  1.00 36.22           A C
ATOM   9114  O    LEU D  81     -16.604  59.989  45.497  1.00 37.17           A O
ATOM   9115  N    LYS D  82     -18.288  60.841  46.646  1.00 36.02           A N
ATOM   9116  CA   LYS D  82     -18.443  62.096  45.921  1.00 36.33           A C
ATOM   9117  CB   LYS D  82     -19.793  62.682  46.221  1.00 37.31           A C
ATOM   9118  CG   LYS D  82     -20.784  62.502  45.171  1.00 38.84           A C
ATOM   9119  CD   LYS D  82     -21.715  63.638  45.206  1.00 43.78           A C
ATOM   9120  CE   LYS D  82     -22.752  63.487  46.258  1.00 44.47           A C
ATOM   9121  NZ   LYS D  82     -23.800  64.463  46.002  1.00 46.17           A N
ATOM   9122  C    LYS D  82     -17.412  63.154  46.245  1.00 35.31           A C
ATOM   9123  O    LYS D  82     -17.326  64.124  45.594  1.00 35.22           A O
ATOM   9124  N    HIS D  83     -16.648  62.946  47.286  1.00 36.47           A N
ATOM   9125  CA   HIS D  83     -15.673  63.887  47.773  1.00 36.50           A C
ATOM   9126  CB   HIS D  83     -14.595  64.101  46.730  1.00 38.00           A C
ATOM   9127  CG   HIS D  83     -13.821  62.863  46.425  1.00 43.79           A C
ATOM   9128  ND1  HIS D  83     -13.987  62.150  45.264  1.00 45.24           A N
ATOM   9129  CE1  HIS D  83     -13.210  61.090  45.296  1.00 47.44           A C
ATOM   9130  NE2  HIS D  83     -12.552  61.090  46.433  1.00 45.82           A N
ATOM   9131  CD2  HIS D  83     -12.911  62.189  47.154  1.00 44.03           A C
ATOM   9132  C    HIS D  83     -16.227  65.191  48.235  1.00 34.50           A C
ATOM   9133  O    HIS D  83     -15.618  66.198  48.061  1.00 35.34           A O
```

Appendix 1

```
ATOM   9134  N    THR D  84     -17.380  65.162  48.861  1.00 32.93      A  N
ATOM   9135  CA   THR D  84     -17.971  66.363  49.401  1.00 31.38      A  C
ATOM   9136  CB   THR D  84     -19.429  66.162  49.692  1.00 30.89      A  C
ATOM   9137  OG1  THR D  84     -20.040  65.649  48.546  1.00 34.89      A  O
ATOM   9138  CG2  THR D  84     -20.089  67.406  49.926  1.00 30.66      A  C
ATOM   9139  C    THR D  84     -17.265  66.795  50.652  1.00 30.30      A  C
ATOM   9140  O    THR D  84     -17.018  66.034  51.541  1.00 29.94      A  O
ATOM   9141  N    PRO D  85     -16.947  68.048  50.720  1.00 28.98      A  N
ATOM   9142  CA   PRO D  85     -16.372  68.595  51.917  1.00 28.80      A  C
ATOM   9143  CB   PRO D  85     -16.032  70.008  51.495  1.00 28.30      A  C
ATOM   9144  CG   PRO D  85     -16.061  69.995  50.072  1.00 28.63      A  C
ATOM   9145  CD   PRO D  85     -17.010  69.029  49.653  1.00 28.35      A  C
ATOM   9146  C    PRO D  85     -17.430  68.571  52.991  1.00 30.37      A  C
ATOM   9147  O    PRO D  85     -18.558  68.573  52.628  1.00 30.09      A  O
ATOM   9148  N    GLN D  86     -17.079  68.516  54.266  1.00 31.34      A  N
ATOM   9149  CA   GLN D  86     -18.077  68.413  55.323  1.00 30.99      A  C
ATOM   9150  CB   GLN D  86     -17.473  68.075  56.696  1.00 32.07      A  C
ATOM   9151  CG   GLN D  86     -17.437  69.193  57.755  1.00 34.14      A  C
ATOM   9152  CD   GLN D  86     -18.711  69.424  58.476  1.00 31.15      A  C
ATOM   9153  OE1  GLN D  86     -19.444  68.533  58.800  1.00 28.83      A  O
ATOM   9154  NE2  GLN D  86     -18.970  70.625  58.727  1.00 36.26      A  N
ATOM   9155  C    GLN D  86     -18.979  69.603  55.375  1.00 29.54      A  C
ATOM   9156  O    GLN D  86     -20.130  69.494  55.617  1.00 28.81      A  O
ATOM   9157  N    ARG D  87     -18.430  70.750  55.100  1.00 29.64      A  N
ATOM   9158  CA   ARG D  87     -19.148  71.986  55.157  1.00 29.18      A  C
ATOM   9159  CB   ARG D  87     -18.179  73.137  55.043  1.00 28.65      A  C
ATOM   9160  CG   ARG D  87     -17.418  73.313  56.255  1.00 27.83      A  C
ATOM   9161  CD   ARG D  87     -16.847  74.613  56.288  1.00 30.97      A  C
ATOM   9162  NE   ARG D  87     -15.668  74.623  57.104  1.00 37.81      A  N
ATOM   9163  CZ   ARG D  87     -15.560  75.263  58.247  1.00 36.04      A  C
ATOM   9164  NH1  ARG D  87     -16.568  75.941  58.710  1.00 31.19      A  N
ATOM   9165  NH2  ARG D  87     -14.443  75.221  58.907  1.00 27.44      A  N
ATOM   9166  C    ARG D  87     -20.298  72.102  54.175  1.00 29.31      A  C
ATOM   9167  O    ARG D  87     -21.253  72.769  54.431  1.00 30.48      A  O
ATOM   9168  N    VAL D  88     -20.181  71.403  53.068  1.00 27.56      A  N
ATOM   9169  CA   VAL D  88     -21.177  71.359  52.043  1.00 25.39      A  C
ATOM   9170  CB   VAL D  88     -20.515  71.203  50.726  1.00 26.10      A  C
ATOM   9171  CG1  VAL D  88     -21.487  71.151  49.698  1.00 22.56      A  C
ATOM   9172  CG2  VAL D  88     -19.624  72.298  50.514  1.00 24.53      A  C
ATOM   9173  C    VAL D  88     -22.207  70.270  52.148  1.00 24.50      A  C
ATOM   9174  O    VAL D  88     -23.134  70.274  51.414  1.00 26.46      A  O
ATOM   9175  N    ILE D  89     -22.055  69.343  53.051  1.00 21.31      A  N
ATOM   9176  CA   ILE D  89     -22.992  68.276  53.130  1.00 21.06      A  C
ATOM   9177  CB   ILE D  89     -22.534  67.216  54.085  1.00 20.22      A  C
ATOM   9178  CG1  ILE D  89     -21.230  66.639  53.655  1.00 19.93      A  C
ATOM   9179  CD1  ILE D  89     -20.713  65.645  54.600  1.00 19.47      A  C
ATOM   9180  CG2  ILE D  89     -23.424  66.092  54.087  1.00 17.92      A  C
ATOM   9181  C    ILE D  89     -24.387  68.744  53.463  1.00 22.33      A  C
ATOM   9182  O    ILE D  89     -25.316  68.222  52.990  1.00 21.92      A  O
ATOM   9183  N    LYS D  90     -24.516  69.736  54.302  1.00 23.65      A  N
ATOM   9184  CA   LYS D  90     -25.809  70.198  54.737  1.00 24.85      A  C
ATOM   9185  CB   LYS D  90     -25.689  71.252  55.839  1.00 25.03      A  C
ATOM   9186  CG   LYS D  90     -24.890  72.479  55.479  1.00 27.07      A  C
ATOM   9187  CD   LYS D  90     -24.771  73.447  56.611  1.00 29.72      A  C
```

Appendix 1

```
ATOM   9188  CE  LYS D  90     -24.148  72.840  57.857  1.00 28.88      A  C
ATOM   9189  NZ  LYS D  90     -22.695  72.853  57.880  1.00 24.51      A  N
ATOM   9190  C   LYS D  90     -26.637  70.723  53.603  1.00 26.24      A  C
ATOM   9191  O   LYS D  90     -27.802  70.489  53.574  1.00 26.79      A  O
ATOM   9192  N   TYR D  91     -26.008  71.448  52.693  1.00 26.33      A  N
ATOM   9193  CA  TYR D  91     -26.626  71.981  51.504  1.00 27.62      A  C
ATOM   9194  CB  TYR D  91     -25.648  72.862  50.747  1.00 28.80      A  C
ATOM   9195  CG  TYR D  91     -25.123  73.973  51.578  1.00 32.69      A  C
ATOM   9196  CD1 TYR D  91     -25.930  75.005  51.958  1.00 36.09      A  C
ATOM   9197  CE1 TYR D  91     -25.467  75.986  52.731  1.00 39.93      A  C
ATOM   9198  CZ  TYR D  91     -24.184  75.956  53.142  1.00 42.73      A  C
ATOM   9199  OH  TYR D  91     -23.715  76.946  53.929  1.00 49.12      A  O
ATOM   9200  CE2 TYR D  91     -23.374  74.953  52.785  1.00 36.75      A  C
ATOM   9201  CD2 TYR D  91     -23.837  73.970  52.022  1.00 32.82      A  C
ATOM   9202  C   TYR D  91     -27.052  70.883  50.610  1.00 27.71      A  C
ATOM   9203  O   TYR D  91     -28.079  70.925  50.003  1.00 28.35      A  O
ATOM   9204  N   SER D  92     -26.203  69.891  50.520  1.00 25.97      A  N
ATOM   9205  CA  SER D  92     -26.425  68.765  49.677  1.00 23.50      A  C
ATOM   9206  CB  SER D  92     -25.265  67.839  49.822  1.00 22.28      A  C
ATOM   9207  OG  SER D  92     -25.462  66.728  49.042  1.00 21.86      A  O
ATOM   9208  C   SER D  92     -27.639  68.001  50.060  1.00 23.33      A  C
ATOM   9209  O   SER D  92     -28.431  67.696  49.244  1.00 25.02      A  O
ATOM   9210  N   ILE D  93     -27.789  67.720  51.324  1.00 22.98      A  N
ATOM   9211  CA  ILE D  93     -28.916  67.011  51.810  1.00 22.74      A  C
ATOM   9212  CB  ILE D  93     -28.713  66.734  53.290  1.00 23.30      A  C
ATOM   9213  CG1 ILE D  93     -27.657  65.698  53.469  1.00 22.17      A  C
ATOM   9214  CD1 ILE D  93     -27.228  65.592  54.809  1.00 24.62      A  C
ATOM   9215  CG2 ILE D  93     -29.894  66.193  53.936  1.00 23.69      A  C
ATOM   9216  C   ILE D  93     -30.154  67.830  51.567  1.00 23.14      A  C
ATOM   9217  O   ILE D  93     -31.166  67.326  51.184  1.00 22.82      A  O
ATOM   9218  N   ALA D  94     -30.046  69.110  51.836  1.00 23.68      A  N
ATOM   9219  CA  ALA D  94     -31.113  70.046  51.644  1.00 22.46      A  C
ATOM   9220  CB  ALA D  94     -30.727  71.307  52.187  1.00 20.76      A  C
ATOM   9221  C   ALA D  94     -31.572  70.232  50.234  1.00 23.69      A  C
ATOM   9222  O   ALA D  94     -32.721  70.275  49.990  1.00 24.94      A  O
ATOM   9223  N   PHE D  95     -30.676  70.338  49.291  1.00 22.95      A  N
ATOM   9224  CA  PHE D  95     -31.097  70.431  47.912  1.00 23.05      A  C
ATOM   9225  CB  PHE D  95     -30.015  70.986  47.014  1.00 23.86      A  C
ATOM   9226  CG  PHE D  95     -29.619  72.354  47.383  1.00 24.36      A  C
ATOM   9227  CD1 PHE D  95     -30.546  73.283  47.639  1.00 27.22      A  C
ATOM   9228  CE1 PHE D  95     -30.194  74.505  47.993  1.00 30.50      A  C
ATOM   9229  CZ  PHE D  95     -28.920  74.824  48.111  1.00 28.15      A  C
ATOM   9230  CE2 PHE D  95     -27.986  73.932  47.851  1.00 28.75      A  C
ATOM   9231  CD2 PHE D  95     -28.324  72.703  47.493  1.00 26.33      A  C
ATOM   9232  C   PHE D  95     -31.783  69.213  47.360  1.00 22.46      A  C
ATOM   9233  O   PHE D  95     -32.661  69.315  46.582  1.00 22.49      A  O
ATOM   9234  N   TYR D  96     -31.360  68.057  47.779  1.00 21.83      A  N
ATOM   9235  CA  TYR D  96     -32.013  66.847  47.437  1.00 21.69      A  C
ATOM   9236  CB  TYR D  96     -31.285  65.717  48.106  1.00 22.39      A  C
ATOM   9237  CG  TYR D  96     -30.153  65.133  47.362  1.00 23.47      A  C
ATOM   9238  CD1 TYR D  96     -30.207  64.979  46.024  1.00 23.91      A  C
ATOM   9239  CE1 TYR D  96     -29.211  64.444  45.363  1.00 28.48      A  C
ATOM   9240  CZ  TYR D  96     -28.113  64.030  46.019  1.00 30.86      A  C
ATOM   9241  OH  TYR D  96     -27.082  63.486  45.330  1.00 28.92      A  O
```

Appendix 1

```
ATOM   9242  CE2 TYR D  96     -28.027  64.165  47.357  1.00 27.81      A    C
ATOM   9243  CD2 TYR D  96     -29.042  64.690  48.019  1.00 25.41      A    C
ATOM   9244  C   TYR D  96     -33.384  66.853  48.001  1.00 22.09      A    C
ATOM   9245  O   TYR D  96     -34.295  66.374  47.426  1.00 21.81      A    O
ATOM   9246  N   ALA D  97     -33.489  67.323  49.210  1.00 22.48      A    N
ATOM   9247  CA  ALA D  97     -34.725  67.342  49.903  1.00 22.23      A    C
ATOM   9248  CB  ALA D  97     -34.510  67.767  51.322  1.00 21.81      A    C
ATOM   9249  C   ALA D  97     -35.698  68.241  49.217  1.00 21.82      A    C
ATOM   9250  O   ALA D  97     -36.826  67.921  49.097  1.00 21.36      A    O
ATOM   9251  N   TYR D  98     -35.248  69.385  48.784  1.00 21.09      A    N
ATOM   9252  CA  TYR D  98     -36.103  70.265  48.061  1.00 23.34      A    C
ATOM   9253  CB  TYR D  98     -35.406  71.598  47.819  1.00 24.09      A    C
ATOM   9254  CG  TYR D  98     -34.909  72.276  49.069  1.00 24.39      A    C
ATOM   9255  CD1 TYR D  98     -35.461  72.010  50.306  1.00 21.96      A    C
ATOM   9256  CE1 TYR D  98     -34.989  72.624  51.433  1.00 25.35      A    C
ATOM   9257  CZ  TYR D  98     -33.983  73.502  51.321  1.00 28.41      A    C
ATOM   9258  OH  TYR D  98     -33.525  74.095  52.402  1.00 35.47      A    O
ATOM   9259  CE2 TYR D  98     -33.429  73.781  50.127  1.00 27.01      A    C
ATOM   9260  CD2 TYR D  98     -33.888  73.180  49.012  1.00 22.55      A    C
ATOM   9261  C   TYR D  98     -36.574  69.632  46.774  1.00 24.56      A    C
ATOM   9262  O   TYR D  98     -37.702  69.716  46.457  1.00 26.13      A    O
ATOM   9263  N   GLY D  99     -35.716  68.970  46.041  1.00 23.97      A    N
ATOM   9264  CA  GLY D  99     -36.145  68.252  44.885  1.00 23.46      A    C
ATOM   9265  C   GLY D  99     -37.106  67.105  45.096  1.00 24.84      A    C
ATOM   9266  O   GLY D  99     -38.017  66.921  44.339  1.00 25.89      A    O
ATOM   9267  N   LEU D 100     -36.893  66.342  46.142  1.00 23.23      A    N
ATOM   9268  CA  LEU D 100     -37.740  65.245  46.516  1.00 22.46      A    C
ATOM   9269  CB  LEU D 100     -37.183  64.543  47.713  1.00 21.83      A    C
ATOM   9270  CG  LEU D 100     -35.941  63.732  47.532  1.00 20.50      A    C
ATOM   9271  CD1 LEU D 100     -35.600  63.165  48.818  1.00 27.42      A    C
ATOM   9272  CD2 LEU D 100     -36.208  62.697  46.607  1.00 21.95      A    C
ATOM   9273  C   LEU D 100     -39.114  65.737  46.817  1.00 23.03      A    C
ATOM   9274  O   LEU D 100     -40.062  65.085  46.597  1.00 23.61      A    O
ATOM   9275  N   ALA D 101     -39.220  66.913  47.361  1.00 23.22      A    N
ATOM   9276  CA  ALA D 101     -40.505  67.481  47.597  1.00 24.44      A    C
ATOM   9277  CB  ALA D 101     -40.379  68.683  48.428  1.00 23.87      A    C
ATOM   9278  C   ALA D 101     -41.310  67.765  46.338  1.00 26.24      A    C
ATOM   9279  O   ALA D 101     -42.496  67.702  46.356  1.00 26.90      A    O
ATOM   9280  N   SER D 102     -40.648  68.159  45.276  1.00 25.16      A    N
ATOM   9281  CA  SER D 102     -41.250  68.332  43.971  1.00 25.55      A    C
ATOM   9282  CB  SER D 102     -40.347  69.125  43.081  1.00 24.64      A    C
ATOM   9283  OG  SER D 102     -40.473  70.452  43.397  1.00 24.31      A    O
ATOM   9284  C   SER D 102     -41.716  67.081  43.291  1.00 25.62      A    C
ATOM   9285  O   SER D 102     -42.709  67.067  42.676  1.00 25.43      A    O
ATOM   9286  N   VAL D 103     -40.950  66.036  43.434  1.00 26.77      A    N
ATOM   9287  CA  VAL D 103     -41.194  64.756  42.839  1.00 27.49      A    C
ATOM   9288  CB  VAL D 103     -40.146  63.816  43.277  1.00 26.63      A    C
ATOM   9289  CG1 VAL D 103     -40.569  62.447  43.112  1.00 25.35      A    C
ATOM   9290  CG2 VAL D 103     -38.942  64.061  42.529  1.00 25.19      A    C
ATOM   9291  C   VAL D 103     -42.513  64.260  43.334  1.00 29.89      A    C
ATOM   9292  O   VAL D 103     -43.217  63.583  42.642  1.00 30.24      A    O
ATOM   9293  N   ALA D 104     -42.815  64.597  44.566  1.00 30.24      A    N
ATOM   9294  CA  ALA D 104     -44.037  64.243  45.189  1.00 29.64      A    C
ATOM   9295  CB  ALA D 104     -43.952  64.577  46.615  1.00 29.88      A    C
```

Appendix 1

```
ATOM   9296  C    ALA D 104     -45.265  64.852  44.577  1.00  29.81      A  C
ATOM   9297  O    ALA D 104     -46.256  64.188  44.463  1.00  30.95      A  O
ATOM   9298  N    LEU D 105     -45.201  66.131  44.257  1.00  29.62      A  N
ATOM   9299  CA   LEU D 105     -46.214  66.826  43.516  1.00  29.20      A  C
ATOM   9300  CB   LEU D 105     -45.821  68.278  43.363  1.00  27.98      A  C
ATOM   9301  CG   LEU D 105     -46.441  69.424  44.120  1.00  27.58      A  C
ATOM   9302  CD1  LEU D 105     -46.216  70.623  43.389  1.00  19.90      A  C
ATOM   9303  CD2  LEU D 105     -47.853  69.249  44.316  1.00  22.58      A  C
ATOM   9304  C    LEU D 105     -46.323  66.277  42.141  1.00  30.42      A  C
ATOM   9305  O    LEU D 105     -47.370  65.970  41.695  1.00  31.05      A  O
ATOM   9306  N    ILE D 106     -45.215  66.142  41.464  1.00  30.65      A  N
ATOM   9307  CA   ILE D 106     -45.274  65.712  40.127  1.00  31.55      A  C
ATOM   9308  CB   ILE D 106     -43.890  65.496  39.631  1.00  31.81      A  C
ATOM   9309  CG1  ILE D 106     -43.211  66.777  39.259  1.00  28.27      A  C
ATOM   9310  CD1  ILE D 106     -41.818  66.571  39.204  1.00  25.96      A  C
ATOM   9311  CG2  ILE D 106     -43.886  64.561  38.481  1.00  31.72      A  C
ATOM   9312  C    ILE D 106     -45.896  64.350  40.012  1.00  33.64      A  C
ATOM   9313  O    ILE D 106     -46.819  64.203  39.284  1.00  35.71      A  O
ATOM   9314  N    ASP D 107     -45.407  63.351  40.716  1.00  33.96      A  N
ATOM   9315  CA   ASP D 107     -45.926  62.024  40.541  1.00  34.81      A  C
ATOM   9316  CB   ASP D 107     -44.821  61.222  39.904  1.00  35.09      A  C
ATOM   9317  CG   ASP D 107     -45.179  59.812  39.717  1.00  38.99      A  C
ATOM   9318  OD1  ASP D 107     -46.155  59.380  40.295  1.00  42.61      A  O
ATOM   9319  OD2  ASP D 107     -44.487  59.131  39.000  1.00  46.52      A  O-1
ATOM   9320  C    ASP D 107     -46.415  61.307  41.795  1.00  35.28      A  C
ATOM   9321  O    ASP D 107     -45.650  60.917  42.601  1.00  33.92      A  O
ATOM   9322  N    PRO D 108     -47.703  61.075  41.909  1.00  36.36      A  N
ATOM   9323  CA   PRO D 108     -48.318  60.510  43.103  1.00  36.42      A  C
ATOM   9324  CB   PRO D 108     -49.792  60.496  42.738  1.00  35.04      A  C
ATOM   9325  CG   PRO D 108     -49.907  61.349  41.673  1.00  36.00      A  C
ATOM   9326  CD   PRO D 108     -48.707  61.221  40.871  1.00  36.41      A  C
ATOM   9327  C    PRO D 108     -47.864  59.112  43.439  1.00  37.27      A  C
ATOM   9328  O    PRO D 108     -47.927  58.727  44.569  1.00  38.36      A  O
ATOM   9329  N    LYS D 109     -47.470  58.358  42.438  1.00  36.38      A  N
ATOM   9330  CA   LYS D 109     -46.934  57.040  42.605  1.00  36.42      A  C
ATOM   9331  CB   LYS D 109     -46.924  56.296  41.291  1.00  38.23      A  C
ATOM   9332  CG   LYS D 109     -48.185  55.525  41.020  1.00  42.90      A  C
ATOM   9333  CD   LYS D 109     -48.231  55.033  39.608  1.00  52.55      A  C
ATOM   9334  CE   LYS D 109     -48.707  56.074  38.633  1.00  56.15      A  C
ATOM   9335  NZ   LYS D 109     -47.649  57.025  38.236  1.00  56.48      A  N
ATOM   9336  C    LYS D 109     -45.575  57.028  43.230  1.00  34.26      A  C
ATOM   9337  O    LYS D 109     -45.152  56.041  43.724  1.00  34.26      A  O
ATOM   9338  N    LEU D 110     -44.889  58.137  43.167  1.00  32.45      A  N
ATOM   9339  CA   LEU D 110     -43.610  58.261  43.801  1.00  30.66      A  C
ATOM   9340  CB   LEU D 110     -42.623  58.861  42.826  1.00  30.95      A  C
ATOM   9341  CG   LEU D 110     -42.097  58.003  41.708  1.00  28.72      A  C
ATOM   9342  CD1  LEU D 110     -41.201  58.781  40.890  1.00  28.18      A  C
ATOM   9343  CD2  LEU D 110     -41.409  56.857  42.202  1.00  25.92      A  C
ATOM   9344  C    LEU D 110     -43.572  59.019  45.117  1.00  29.52      A  C
ATOM   9345  O    LEU D 110     -42.542  59.183  45.650  1.00  30.12      A  O
ATOM   9346  N    ARG D 111     -44.708  59.465  45.621  1.00  27.04      A  N
ATOM   9347  CA   ARG D 111     -44.813  60.289  46.809  1.00  25.45      A  C
ATOM   9348  CB   ARG D 111     -46.234  60.865  46.936  1.00  24.10      A  C
ATOM   9349  CG   ARG D 111     -46.473  61.804  48.082  1.00  22.29      A  C
```

Appendix 1

```
ATOM   9350  CD  ARG D 111     -47.654  62.665  47.917  1.00 23.93      A   C
ATOM   9351  NE  ARG D 111     -47.886  63.535  49.051  1.00 25.40      A   N
ATOM   9352  CZ  ARG D 111     -48.689  64.581  49.059  1.00 24.29      A   C
ATOM   9353  NH1 ARG D 111     -49.345  64.939  48.018  1.00 20.22      A   N
ATOM   9354  NH2 ARG D 111     -48.823  65.292  50.115  1.00 22.60      A   N
ATOM   9355  C   ARG D 111     -44.346  59.600  48.082  1.00 26.47      A   C
ATOM   9356  O   ARG D 111     -43.737  60.200  48.921  1.00 25.28      A   O
ATOM   9357  N   ALA D 112     -44.655  58.333  48.231  1.00 27.32      A   N
ATOM   9358  CA  ALA D 112     -44.194  57.593  49.374  1.00 26.67      A   C
ATOM   9359  CB  ALA D 112     -44.895  56.324  49.470  1.00 25.13      A   C
ATOM   9360  C   ALA D 112     -42.703  57.388  49.428  1.00 27.03      A   C
ATOM   9361  O   ALA D 112     -42.120  57.515  50.446  1.00 27.05      A   O
ATOM   9362  N   LEU D 113     -42.092  57.064  48.316  1.00 27.41      A   N
ATOM   9363  CA  LEU D 113     -40.665  57.005  48.278  1.00 28.80      A   C
ATOM   9364  CB  LEU D 113     -40.148  56.383  46.994  1.00 29.20      A   C
ATOM   9365  CG  LEU D 113     -38.640  56.380  46.888  1.00 32.54      A   C
ATOM   9366  CD1 LEU D 113     -37.974  55.202  47.459  1.00 32.76      A   C
ATOM   9367  CD2 LEU D 113     -38.176  56.633  45.539  1.00 34.00      A   C
ATOM   9368  C   LEU D 113     -40.035  58.354  48.541  1.00 27.80      A   C
ATOM   9369  O   LEU D 113     -39.038  58.428  49.171  1.00 28.38      A   O
ATOM   9370  N   ALA D 114     -40.628  59.415  48.054  1.00 26.39      A   N
ATOM   9371  CA  ALA D 114     -40.154  60.747  48.316  1.00 23.86      A   C
ATOM   9372  CB  ALA D 114     -40.869  61.735  47.482  1.00 22.59      A   C
ATOM   9373  C   ALA D 114     -40.252  61.100  49.773  1.00 23.32      A   C
ATOM   9374  O   ALA D 114     -39.429  61.769  50.286  1.00 23.76      A   O
ATOM   9375  N   GLY D 115     -41.298  60.669  50.416  1.00 21.77      A   N
ATOM   9376  CA  GLY D 115     -41.454  60.821  51.825  1.00 22.79      A   C
ATOM   9377  C   GLY D 115     -40.477  60.063  52.663  1.00 22.00      A   C
ATOM   9378  O   GLY D 115     -40.035  60.514  53.646  1.00 21.38      A   O
ATOM   9379  N   HIS D 116     -40.177  58.867  52.260  1.00 21.98      A   N
ATOM   9380  CA  HIS D 116     -39.206  58.081  52.928  1.00 22.37      A   C
ATOM   9381  CB  HIS D 116     -39.220  56.699  52.323  1.00 22.10      A   C
ATOM   9382  CG  HIS D 116     -38.098  55.855  52.770  1.00 21.98      A   C
ATOM   9383  ND1 HIS D 116     -37.002  55.619  51.997  1.00 26.54      A   N
ATOM   9384  CE1 HIS D 116     -36.155  54.877  52.661  1.00 28.38      A   C
ATOM   9385  NE2 HIS D 116     -36.671  54.615  53.834  1.00 25.61      A   N
ATOM   9386  CD2 HIS D 116     -37.887  55.215  53.926  1.00 22.13      A   C
ATOM   9387  C   HIS D 116     -37.827  58.686  52.845  1.00 24.46      A   C
ATOM   9388  O   HIS D 116     -37.086  58.657  53.779  1.00 24.85      A   O
ATOM   9389  N   ASP D 117     -37.503  59.208  51.684  1.00 24.72      A   N
ATOM   9390  CA  ASP D 117     -36.252  59.850  51.420  1.00 26.28      A   C
ATOM   9391  CB  ASP D 117     -36.115  60.196  49.959  1.00 25.90      A   C
ATOM   9392  CG  ASP D 117     -35.666  59.059  49.151  1.00 26.15      A   C
ATOM   9393  OD1 ASP D 117     -35.526  58.003  49.682  1.00 29.65      A   O
ATOM   9394  OD2 ASP D 117     -35.451  59.201  47.986  1.00 23.47      A   O-1
ATOM   9395  C   ASP D 117     -36.083  61.078  52.216  1.00 27.13      A   C
ATOM   9396  O   ASP D 117     -35.024  61.372  52.622  1.00 28.11      A   O
ATOM   9397  N   LEU D 118     -37.150  61.827  52.353  1.00 26.77      A   N
ATOM   9398  CA  LEU D 118     -37.189  63.003  53.160  1.00 26.86      A   C
ATOM   9399  CB  LEU D 118     -38.496  63.739  52.969  1.00 25.71      A   C
ATOM   9400  CG  LEU D 118     -38.674  64.527  51.702  1.00 25.49      A   C
ATOM   9401  CD1 LEU D 118     -39.996  65.163  51.668  1.00 22.72      A   C
ATOM   9402  CD2 LEU D 118     -37.628  65.506  51.536  1.00 21.95      A   C
ATOM   9403  C   LEU D 118     -36.997  62.705  54.605  1.00 27.71      A   C
```

Appendix 1

```
ATOM   9404  O    LEU D 118     -36.409  63.435  55.308  1.00 29.70      A  O
ATOM   9405  N    ASP D 119     -37.554  61.634  55.063  1.00 27.96      A  N
ATOM   9406  CA   ASP D 119     -37.342  61.227  56.398  1.00 28.90      A  C
ATOM   9407  CB   ASP D 119     -38.305  60.091  56.692  1.00 28.36      A  C
ATOM   9408  CG   ASP D 119     -38.204  59.573  58.070  1.00 31.46      A  C
ATOM   9409  OD1  ASP D 119     -37.773  60.262  58.960  1.00 30.62      A  O
ATOM   9410  OD2  ASP D 119     -38.545  58.443  58.274  1.00 40.95      A  O-1
ATOM   9411  C    ASP D 119     -35.878  60.869  56.609  1.00 28.99      A  C
ATOM   9412  O    ASP D 119     -35.299  61.218  57.577  1.00 31.38      A  O
ATOM   9413  N    ILE D 120     -35.273  60.183  55.679  1.00 27.96      A  N
ATOM   9414  CA   ILE D 120     -33.882  59.874  55.787  1.00 25.74      A  C
ATOM   9415  CB   ILE D 120     -33.404  58.945  54.654  1.00 25.31      A  C
ATOM   9416  CG1  ILE D 120     -33.606  57.523  55.027  1.00 25.34      A  C
ATOM   9417  CD1  ILE D 120     -33.772  56.692  53.916  1.00 27.35      A  C
ATOM   9418  CG2  ILE D 120     -31.997  59.054  54.426  1.00 23.85      A  C
ATOM   9419  C    ILE D 120     -33.135  61.166  55.808  1.00 24.38      A  C
ATOM   9420  O    ILE D 120     -32.213  61.306  56.509  1.00 25.22      A  O
ATOM   9421  N    ALA D 121     -33.565  62.123  55.033  1.00 24.13      A  N
ATOM   9422  CA   ALA D 121     -32.897  63.391  54.902  1.00 23.66      A  C
ATOM   9423  CB   ALA D 121     -33.538  64.186  53.842  1.00 22.09      A  C
ATOM   9424  C    ALA D 121     -32.842  64.192  56.165  1.00 22.88      A  C
ATOM   9425  O    ALA D 121     -31.855  64.765  56.445  1.00 20.97      A  O
ATOM   9426  N    VAL D 122     -33.934  64.224  56.894  1.00 23.44      A  N
ATOM   9427  CA   VAL D 122     -33.995  64.808  58.202  1.00 23.68      A  C
ATOM   9428  CB   VAL D 122     -35.464  64.923  58.645  1.00 24.14      A  C
ATOM   9429  CG1  VAL D 122     -35.605  65.383  60.023  1.00 20.78      A  C
ATOM   9430  CG2  VAL D 122     -36.180  65.812  57.753  1.00 21.74      A  C
ATOM   9431  C    VAL D 122     -33.103  64.125  59.244  1.00 24.54      A  C
ATOM   9432  O    VAL D 122     -32.398  64.795  59.904  1.00 24.30      A  O
ATOM   9433  N    SER D 123     -33.070  62.810  59.312  1.00 24.50      A  N
ATOM   9434  CA   SER D 123     -32.181  62.114  60.209  1.00 28.34      A  C
ATOM   9435  CB   SER D 123     -32.384  60.638  60.088  1.00 28.72      A  C
ATOM   9436  OG   SER D 123     -33.694  60.305  60.328  1.00 36.07      A  O
ATOM   9437  C    SER D 123     -30.708  62.344  59.983  1.00 29.41      A  C
ATOM   9438  O    SER D 123     -29.980  62.553  60.917  1.00 30.43      A  O
ATOM   9439  N    LYS D 124     -30.269  62.310  58.746  1.00 28.84      A  N
ATOM   9440  CA   LYS D 124     -28.926  62.678  58.402  1.00 28.84      A  C
ATOM   9441  CB   LYS D 124     -28.597  62.328  56.979  1.00 28.33      A  C
ATOM   9442  CG   LYS D 124     -28.852  60.941  56.635  1.00 29.67      A  C
ATOM   9443  CD   LYS D 124     -27.975  60.479  55.556  1.00 24.25      A  C
ATOM   9444  CE   LYS D 124     -28.173  59.075  55.378  1.00 24.25      A  C
ATOM   9445  NZ   LYS D 124     -27.016  58.394  55.877  1.00 28.06      A  N
ATOM   9446  C    LYS D 124     -28.603  64.121  58.671  1.00 29.66      A  C
ATOM   9447  O    LYS D 124     -27.492  64.446  58.963  1.00 30.90      A  O
ATOM   9448  N    MET D 125     -29.568  64.995  58.512  1.00 29.19      A  N
ATOM   9449  CA   MET D 125     -29.345  66.406  58.661  1.00 29.41      A  C
ATOM   9450  CB   MET D 125     -30.572  67.182  58.276  1.00 29.49      D  C
ATOM   9451  CG   MET D 125     -30.358  68.615  58.090  1.00 30.14      D  C
ATOM   9452  SD   MET D 125     -29.143  69.028  56.939  1.00 28.59      D  S
ATOM   9453  CE   MET D 125     -29.672  70.606  56.564  1.00 19.68      D  C
ATOM   9454  C    MET D 125     -28.960  66.649  60.075  1.00 29.59      A  C
ATOM   9455  O    MET D 125     -28.229  67.527  60.388  1.00 27.56      A  O
ATOM   9456  N    LYS D 126     -29.468  65.800  60.923  1.00 29.71      A  N
ATOM   9457  CA   LYS D 126     -29.226  65.881  62.326  1.00 29.96      A  C
```

Appendix 1

```
ATOM   9458  CB   LYS D 126     -30.407  65.336  63.065  1.00 29.60      A    C
ATOM   9459  CG   LYS D 126     -31.605  66.166  62.901  1.00 32.52      A    C
ATOM   9460  CD   LYS D 126     -32.821  65.418  63.242  1.00 35.59      A    C
ATOM   9461  CE   LYS D 126     -33.249  65.815  64.561  1.00 41.20      A    C
ATOM   9462  NZ   LYS D 126     -34.159  64.844  65.082  1.00 47.78      A    N
ATOM   9463  C    LYS D 126     -27.995  65.200  62.822  1.00 29.48      A    C
ATOM   9464  O    LYS D 126     -27.728  65.279  63.940  1.00 31.22      A    O
ATOM   9465  N    CYS D 127     -27.238  64.528  62.004  1.00 28.74      A    N
ATOM   9466  CA   CYS D 127     -25.979  64.003  62.447  1.00 29.53      A    C
ATOM   9467  CB   CYS D 127     -25.548  62.871  61.532  1.00 30.35      A    C
ATOM   9468  SG   CYS D 127     -26.457  61.362  61.612  1.00 37.31      A    S
ATOM   9469  C    CYS D 127     -24.867  65.056  62.622  1.00 28.60      A    C
ATOM   9470  O    CYS D 127     -24.824  66.021  61.924  1.00 29.28      A    O
ATOM   9471  N    LYS D 128     -23.951  64.804  63.536  1.00 27.20      A    N
ATOM   9472  CA   LYS D 128     -22.862  65.681  63.901  1.00 27.48      A    C
ATOM   9473  CB   LYS D 128     -22.090  65.104  65.069  1.00 29.18      A    C
ATOM   9474  CG   LYS D 128     -21.866  66.049  66.173  1.00 32.19      A    C
ATOM   9475  CD   LYS D 128     -20.445  66.156  66.514  1.00 40.27      A    C
ATOM   9476  CE   LYS D 128     -20.194  67.301  67.418  1.00 43.81      A    C
ATOM   9477  NZ   LYS D 128     -19.568  66.830  68.655  1.00 45.84      A    N
ATOM   9478  C    LYS D 128     -21.897  65.967  62.810  1.00 26.90      A    C
ATOM   9479  O    LYS D 128     -21.252  66.984  62.803  1.00 26.35      A    O
ATOM   9480  N    ARG D 129     -21.777  65.021  61.915  1.00 26.13      A    N
ATOM   9481  CA   ARG D 129     -20.990  65.162  60.734  1.00 26.41      A    C
ATOM   9482  CB   ARG D 129     -20.979  63.827  59.992  1.00 27.09      A    C
ATOM   9483  CG   ARG D 129     -20.190  63.709  58.721  1.00 28.84      A    C
ATOM   9484  CD   ARG D 129     -18.821  64.283  58.771  1.00 27.30      A    C
ATOM   9485  NE   ARG D 129     -18.199  64.209  57.467  1.00 32.44      A    N
ATOM   9486  CZ   ARG D 129     -16.972  64.593  57.167  1.00 33.87      A    C
ATOM   9487  NH1  ARG D 129     -16.182  65.109  58.062  1.00 30.50      A    N
ATOM   9488  NH2  ARG D 129     -16.542  64.479  55.947  1.00 33.93      A    N
ATOM   9489  C    ARG D 129     -21.560  66.292  59.917  1.00 26.21      A    C
ATOM   9490  O    ARG D 129     -20.841  67.055  59.356  1.00 25.01      A    O
ATOM   9491  N    VAL D 130     -22.866  66.393  59.848  1.00 26.56      A    N
ATOM   9492  CA   VAL D 130     -23.472  67.516  59.194  1.00 27.01      A    C
ATOM   9493  CB   VAL D 130     -24.950  67.290  58.907  1.00 27.18      A    C
ATOM   9494  CG1  VAL D 130     -25.411  68.241  57.938  1.00 26.31      A    C
ATOM   9495  CG2  VAL D 130     -25.198  65.944  58.435  1.00 27.16      A    C
ATOM   9496  C    VAL D 130     -23.343  68.857  59.841  1.00 27.52      A    C
ATOM   9497  O    VAL D 130     -23.047  69.788  59.179  1.00 27.03      A    O
ATOM   9498  N    TRP D 131     -23.623  68.965  61.128  1.00 28.52      A    N
ATOM   9499  CA   TRP D 131     -23.569  70.241  61.831  1.00 29.49      A    C
ATOM   9500  CB   TRP D 131     -24.794  70.442  62.680  1.00 29.38      A    C
ATOM   9501  CG   TRP D 131     -24.986  69.430  63.687  1.00 29.81      A    C
ATOM   9502  CD1  TRP D 131     -25.758  68.379  63.577  1.00 30.67      A    C
ATOM   9503  NE1  TRP D 131     -25.746  67.651  64.693  1.00 28.02      A    N
ATOM   9504  CE2  TRP D 131     -24.916  68.242  65.584  1.00 29.24      A    C
ATOM   9505  CD2  TRP D 131     -24.425  69.379  64.987  1.00 29.91      A    C
ATOM   9506  CE3  TRP D 131     -23.551  70.191  65.706  1.00 31.55      A    C
ATOM   9507  CZ3  TRP D 131     -23.215  69.829  66.950  1.00 28.46      A    C
ATOM   9508  CH2  TRP D 131     -23.731  68.693  67.525  1.00 27.60      A    C
ATOM   9509  CZ2  TRP D 131     -24.584  67.883  66.859  1.00 27.63      A    C
ATOM   9510  C    TRP D 131     -22.356  70.491  62.676  1.00 29.61      A    C
ATOM   9511  O    TRP D 131     -22.186  71.551  63.199  1.00 28.83      A    O
```

Appendix 1

```
ATOM   9512  N   GLY D 132     -21.485  69.514  62.741  1.00 28.44      A   N
ATOM   9513  CA  GLY D 132     -20.368  69.534  63.647  1.00 29.25      A   C
ATOM   9514  C   GLY D 132     -19.392  70.661  63.465  1.00 28.64      A   C
ATOM   9515  O   GLY D 132     -18.744  71.053  64.358  1.00 29.34      A   O
ATOM   9516  N   ASP D 133     -19.350  71.211  62.284  1.00 29.25      A   N
ATOM   9517  CA  ASP D 133     -18.431  72.257  61.932  1.00 29.05      A   C
ATOM   9518  CB  ASP D 133     -18.611  72.612  60.464  1.00 28.82      A   C
ATOM   9519  CG  ASP D 133     -20.019  72.953  60.106  1.00 29.85      A   C
ATOM   9520  OD1 ASP D 133     -20.831  72.085  59.863  1.00 29.76      A   O
ATOM   9521  OD2 ASP D 133     -20.290  74.119  59.985  1.00 31.83      A   O-1
ATOM   9522  C   ASP D 133     -18.640  73.481  62.787  1.00 28.87      A   C
ATOM   9523  O   ASP D 133     -17.787  74.294  62.943  1.00 27.95      A   O
ATOM   9524  N   TRP D 134     -19.835  73.625  63.290  1.00 28.40      A   N
ATOM   9525  CA  TRP D 134     -20.175  74.681  64.181  1.00 27.91      A   C
ATOM   9526  CB  TRP D 134     -21.683  74.613  64.396  1.00 26.91      A   C
ATOM   9527  CG  TRP D 134     -22.240  75.557  65.317  1.00 22.93      A   C
ATOM   9528  CD1 TRP D 134     -22.666  75.294  66.536  1.00 25.68      A   C
ATOM   9529  NE1 TRP D 134     -23.129  76.403  67.122  1.00 27.18      A   N
ATOM   9530  CE2 TRP D 134     -22.991  77.437  66.257  1.00 20.91      A   C
ATOM   9531  CD2 TRP D 134     -22.450  76.930  65.106  1.00 19.04      A   C
ATOM   9532  CE3 TRP D 134     -22.208  77.785  64.060  1.00 18.08      A   C
ATOM   9533  CZ3 TRP D 134     -22.514  79.065  64.205  1.00 18.91      A   C
ATOM   9534  CH2 TRP D 134     -23.065  79.541  65.356  1.00 21.53      A   C
ATOM   9535  CZ2 TRP D 134     -23.308  78.740  66.396  1.00 16.47      A   C
ATOM   9536  C   TRP D 134     -19.416  74.539  65.475  1.00 29.22      A   C
ATOM   9537  O   TRP D 134     -18.882  75.480  65.970  1.00 29.21      A   O
ATOM   9538  N   GLU D 135     -19.345  73.332  66.003  1.00 30.31      A   N
ATOM   9539  CA  GLU D 135     -18.560  73.077  67.191  1.00 33.09      A   C
ATOM   9540  CB  GLU D 135     -18.855  71.695  67.760  1.00 33.76      A   C
ATOM   9541  CG  GLU D 135     -18.750  71.606  69.251  1.00 38.27      A   C
ATOM   9542  CD  GLU D 135     -18.724  70.194  69.800  1.00 45.63      A   C
ATOM   9543  OE1 GLU D 135     -19.786  69.668  70.122  1.00 46.87      A   O
ATOM   9544  OE2 GLU D 135     -17.648  69.603  69.940  1.00 49.29      A   O-1
ATOM   9545  C   GLU D 135     -17.075  73.279  67.021  1.00 33.54      A   C
ATOM   9546  O   GLU D 135     -16.477  73.946  67.786  1.00 32.60      A   O
ATOM   9547  N   GLU D 136     -16.480  72.752  65.984  1.00 35.37      A   N
ATOM   9548  CA  GLU D 136     -15.127  73.125  65.718  1.00 38.85      A   C
ATOM   9549  CB  GLU D 136     -14.584  72.433  64.518  1.00 39.83      A   C
ATOM   9550  CG  GLU D 136     -15.259  71.233  64.225  1.00 44.88      A   C
ATOM   9551  CD  GLU D 136     -14.338  70.125  64.143  1.00 54.12      A   C
ATOM   9552  OE1 GLU D 136     -14.540  69.287  63.280  1.00 60.77      A   O
ATOM   9553  OE2 GLU D 136     -13.406  70.073  64.934  1.00 56.38      A   O-1
ATOM   9554  C   GLU D 136     -15.340  74.519  65.352  1.00 38.89      A   C
ATOM   9555  O   GLU D 136     -16.418  74.947  65.305  1.00 41.14      A   O
ATOM   9556  N   ASP D 137     -14.327  75.296  65.202  1.00 39.04      A   N
ATOM   9557  CA  ASP D 137     -14.634  76.613  64.780  1.00 38.96      A   C
ATOM   9558  CB  ASP D 137     -15.769  76.538  63.805  1.00 39.38      A   C
ATOM   9559  CG  ASP D 137     -15.309  76.497  62.379  1.00 40.68      A   C
ATOM   9560  OD1 ASP D 137     -14.275  75.921  62.080  1.00 39.19      A   O
ATOM   9561  OD2 ASP D 137     -16.003  77.037  61.556  1.00 40.05      A   O-1
ATOM   9562  C   ASP D 137     -15.106  77.305  65.994  1.00 37.42      A   C
ATOM   9563  O   ASP D 137     -15.078  78.476  66.080  1.00 39.16      A   O
ATOM   9564  N   GLY D 138     -15.517  76.519  66.947  1.00 36.47      A   N
ATOM   9565  CA  GLY D 138     -15.802  76.999  68.266  1.00 36.21      A   C
```

Appendix 1

```
ATOM   9566  C    GLY D 138     -16.881  78.004  68.487  1.00 35.59      A    C
ATOM   9567  O    GLY D 138     -16.728  78.821  69.316  1.00 34.04      A    O
ATOM   9568  N    PHE D 139     -17.974  77.924  67.759  1.00 36.54      A    N
ATOM   9569  CA   PHE D 139     -19.081  78.831  67.958  1.00 36.92      A    C
ATOM   9570  CB   PHE D 139     -19.797  79.137  66.667  1.00 37.13      A    C
ATOM   9571  CG   PHE D 139     -18.935  79.736  65.639  1.00 38.08      A    C
ATOM   9572  CD1  PHE D 139     -18.323  80.919  65.849  1.00 38.32      A    C
ATOM   9573  CE1  PHE D 139     -17.533  81.452  64.893  1.00 43.01      A    C
ATOM   9574  CZ   PHE D 139     -17.345  80.810  63.722  1.00 38.50      A    C
ATOM   9575  CE2  PHE D 139     -17.948  79.653  63.507  1.00 37.60      A    C
ATOM   9576  CD2  PHE D 139     -18.739  79.116  64.450  1.00 34.67      A    C
ATOM   9577  C    PHE D 139     -20.075  78.377  68.965  1.00 37.30      A    C
ATOM   9578  O    PHE D 139     -20.891  79.139  69.360  1.00 37.23      A    O
ATOM   9579  N    GLY D 140     -20.005  77.131  69.380  1.00 37.03      A    N
ATOM   9580  CA   GLY D 140     -20.903  76.643  70.390  1.00 37.31      A    C
ATOM   9581  C    GLY D 140     -21.095  75.173  70.299  1.00 38.33      A    C
ATOM   9582  O    GLY D 140     -20.600  74.575  69.402  1.00 40.26      A    O
ATOM   9583  N    THR D 141     -21.824  74.591  71.231  1.00 38.65      A    N
ATOM   9584  CA   THR D 141     -22.098  73.166  71.201  1.00 37.55      A    C
ATOM   9585  CB   THR D 141     -21.858  72.492  72.552  1.00 37.72      A    C
ATOM   9586  OG1  THR D 141     -22.788  72.977  73.498  1.00 36.47      A    O
ATOM   9587  CG2  THR D 141     -20.534  72.785  73.049  1.00 35.87      A    C
ATOM   9588  C    THR D 141     -23.486  72.805  70.735  1.00 37.76      A    C
ATOM   9589  O    THR D 141     -23.742  71.678  70.431  1.00 38.00      A    O
ATOM   9590  N    ASP D 142     -24.394  73.754  70.687  1.00 37.43      A    N
ATOM   9591  CA   ASP D 142     -25.699  73.454  70.156  1.00 37.33      A    C
ATOM   9592  CB   ASP D 142     -26.760  73.759  71.191  1.00 38.65      A    C
ATOM   9593  CG   ASP D 142     -28.127  73.751  70.635  1.00 41.20      A    C
ATOM   9594  OD1  ASP D 142     -28.832  72.771  70.781  1.00 45.39      A    O
ATOM   9595  OD2  ASP D 142     -28.506  74.742  70.051  1.00 43.36      A    O-1
ATOM   9596  C    ASP D 142     -25.973  74.184  68.873  1.00 35.61      A    C
ATOM   9597  O    ASP D 142     -25.986  75.380  68.827  1.00 35.05      A    O
ATOM   9598  N    PRO D 143     -26.168  73.416  67.828  1.00 33.33      A    N
ATOM   9599  CA   PRO D 143     -26.313  73.909  66.483  1.00 33.41      A    C
ATOM   9600  CB   PRO D 143     -26.410  72.644  65.681  1.00 33.77      A    C
ATOM   9601  CG   PRO D 143     -26.779  71.666  66.588  1.00 34.23      A    C
ATOM   9602  CD   PRO D 143     -26.217  71.968  67.846  1.00 33.58      A    C
ATOM   9603  C    PRO D 143     -27.506  74.779  66.244  1.00 33.20      A    C
ATOM   9604  O    PRO D 143     -27.427  75.612  65.412  1.00 32.74      A    O
ATOM   9605  N    ILE D 144     -28.605  74.567  66.928  1.00 33.67      A    N
ATOM   9606  CA   ILE D 144     -29.776  75.374  66.681  1.00 33.64      A    C
ATOM   9607  CB   ILE D 144     -31.008  74.517  66.512  1.00 33.59      A    C
ATOM   9608  CG1  ILE D 144     -31.312  73.770  67.770  1.00 32.37      A    C
ATOM   9609  CD1  ILE D 144     -32.658  73.561  67.919  1.00 32.22      A    C
ATOM   9610  CG2  ILE D 144     -30.808  73.532  65.434  1.00 32.89      A    C
ATOM   9611  C    ILE D 144     -30.106  76.467  67.661  1.00 34.12      A    C
ATOM   9612  O    ILE D 144     -31.018  77.186  67.440  1.00 32.64      A    O
ATOM   9613  N    GLU D 145     -29.374  76.577  68.751  1.00 36.21      A    N
ATOM   9614  CA   GLU D 145     -29.743  77.470  69.842  1.00 37.68      A    C
ATOM   9615  CB   GLU D 145     -28.767  77.274  70.981  1.00 38.63      A    C
ATOM   9616  CG   GLU D 145     -29.361  77.595  72.301  1.00 47.48      A    C
ATOM   9617  CD   GLU D 145     -28.422  78.238  73.260  1.00 57.31      A    C
ATOM   9618  OE1  GLU D 145     -27.208  78.137  73.085  1.00 59.57      A    O
ATOM   9619  OE2  GLU D 145     -28.912  78.842  74.218  1.00 60.33      A    O-1
```

Appendix 1

```
ATOM   9620  C   GLU D 145     -29.793  78.946  69.558  1.00 36.95           A  C
ATOM   9621  O   GLU D 145     -30.738  79.604  69.900  1.00 36.98           A  O
ATOM   9622  N   LYS D 146     -28.725  79.456  68.981  1.00 36.40           A  N
ATOM   9623  CA  LYS D 146     -28.639  80.816  68.524  1.00 36.58           A  C
ATOM   9624  CB  LYS D 146     -27.934  81.706  69.528  1.00 37.49           A  C
ATOM   9625  CG  LYS D 146     -26.536  81.286  69.848  1.00 40.83           A  C
ATOM   9626  CD  LYS D 146     -25.833  82.256  70.743  1.00 47.42           A  C
ATOM   9627  CE  LYS D 146     -24.464  81.746  71.117  1.00 48.21           A  C
ATOM   9628  NZ  LYS D 146     -23.395  82.712  70.872  1.00 50.28           A  N
ATOM   9629  C   LYS D 146     -27.834  80.791  67.285  1.00 35.27           A  C
ATOM   9630  O   LYS D 146     -27.039  79.932  67.125  1.00 35.41           A  O
ATOM   9631  N   GLU D 147     -28.083  81.746  66.414  1.00 33.36           A  N
ATOM   9632  CA  GLU D 147     -27.334  81.999  65.216  1.00 31.82           A  C
ATOM   9633  CB  GLU D 147     -25.925  82.390  65.556  1.00 32.21           A  C
ATOM   9634  CG  GLU D 147     -25.864  83.814  65.901  1.00 34.35           A  C
ATOM   9635  CD  GLU D 147     -24.815  84.154  66.911  1.00 39.83           A  C
ATOM   9636  OE1 GLU D 147     -23.814  83.466  66.995  1.00 42.53           A  O
ATOM   9637  OE2 GLU D 147     -24.983  85.130  67.623  1.00 45.45           A  O-1
ATOM   9638  C   GLU D 147     -27.423  80.842  64.276  1.00 29.77           A  C
ATOM   9639  O   GLU D 147     -28.388  80.148  64.319  1.00 28.41           A  O
ATOM   9640  N   ASN D 148     -26.428  80.645  63.425  1.00 27.04           A  N
ATOM   9641  CA  ASN D 148     -26.375  79.492  62.536  1.00 25.35           A  C
ATOM   9642  CB  ASN D 148     -26.121  78.245  63.373  1.00 24.36           A  C
ATOM   9643  CG  ASN D 148     -25.448  77.151  62.618  1.00 24.09           A  C
ATOM   9644  OD1 ASN D 148     -24.825  77.371  61.634  1.00 24.90           A  O
ATOM   9645  ND2 ASN D 148     -25.575  75.976  63.091  1.00 18.09           A  N
ATOM   9646  C   ASN D 148     -27.572  79.257  61.583  1.00 24.94           A  C
ATOM   9647  O   ASN D 148     -27.971  78.168  61.417  1.00 22.57           A  O
ATOM   9648  N   ILE D 149     -28.142  80.272  60.971  1.00 24.49           A  N
ATOM   9649  CA  ILE D 149     -29.298  80.007  60.131  1.00 26.20           A  C
ATOM   9650  CB  ILE D 149     -30.192  81.191  59.742  1.00 26.54           A  C
ATOM   9651  CG1 ILE D 149     -29.484  82.490  59.856  1.00 26.38           A  C
ATOM   9652  CD1 ILE D 149     -29.005  82.949  58.599  1.00 31.38           A  C
ATOM   9653  CG2 ILE D 149     -31.453  81.180  60.495  1.00 23.95           A  C
ATOM   9654  C   ILE D 149     -28.936  79.238  58.908  1.00 27.42           A  C
ATOM   9655  O   ILE D 149     -29.758  78.613  58.346  1.00 29.18           A  O
ATOM   9656  N   MET D 150     -27.700  79.237  58.507  1.00 28.31           A  N
ATOM   9657  CA  MET D 150     -27.394  78.408  57.401  1.00 28.77           A  C
ATOM   9658  CB  MET D 150     -25.935  78.542  56.999  1.00 30.98           D  C
ATOM   9659  CG  MET D 150     -24.955  78.628  58.146  1.00 39.53           D  C
ATOM   9660  SD  MET D 150     -23.214  78.692  57.742  1.00 55.12           D  S
ATOM   9661  CE  MET D 150     -22.503  78.886  59.336  1.00 53.26           D  C
ATOM   9662  C   MET D 150     -27.707  76.975  57.736  1.00 28.04           A  C
ATOM   9663  O   MET D 150     -28.277  76.314  56.942  1.00 30.13           A  O
ATOM   9664  N   TYR D 151     -27.358  76.437  58.883  1.00 26.00           A  N
ATOM   9665  CA  TYR D 151     -27.858  75.107  59.145  1.00 22.81           A  C
ATOM   9666  CB  TYR D 151     -27.025  74.444  60.211  1.00 20.87           A  C
ATOM   9667  CG  TYR D 151     -27.514  73.129  60.664  1.00 17.07           A  C
ATOM   9668  CD1 TYR D 151     -27.290  72.010  59.942  1.00 18.14           A  C
ATOM   9669  CE1 TYR D 151     -27.700  70.840  60.353  1.00 10.78           A  C
ATOM   9670  CZ  TYR D 151     -28.353  70.744  61.500  1.00 18.82           A  C
ATOM   9671  OH  TYR D 151     -28.794  69.561  61.963  1.00 20.02           A  O
ATOM   9672  CE2 TYR D 151     -28.589  71.833  62.231  1.00 18.31           A  C
ATOM   9673  CD2 TYR D 151     -28.169  73.002  61.827  1.00 18.20           A  C
```

Appendix 1

```
ATOM   9674  C   TYR D 151     -29.324  74.950  59.491  1.00 22.91      A  C
ATOM   9675  O   TYR D 151     -30.020  74.241  58.863  1.00 24.09      A  O
ATOM   9676  N   LYS D 152     -29.768  75.611  60.518  1.00 22.87      A  N
ATOM   9677  CA  LYS D 152     -31.084  75.427  61.059  1.00 23.98      A  C
ATOM   9678  CB  LYS D 152     -31.179  75.943  62.495  1.00 24.77      A  C
ATOM   9679  CG  LYS D 152     -31.033  77.401  62.663  1.00 26.79      A  C
ATOM   9680  CD  LYS D 152     -31.241  77.751  64.042  1.00 25.65      A  C
ATOM   9681  CE  LYS D 152     -30.479  78.957  64.414  1.00 30.28      A  C
ATOM   9682  NZ  LYS D 152     -30.936  79.457  65.685  1.00 27.82      A  N
ATOM   9683  C   LYS D 152     -32.210  75.891  60.166  1.00 23.60      A  C
ATOM   9684  O   LYS D 152     -33.287  75.397  60.233  1.00 24.06      A  O
ATOM   9685  N   GLY D 153     -31.939  76.844  59.317  1.00 23.50      A  N
ATOM   9686  CA  GLY D 153     -32.929  77.235  58.365  1.00 23.29      A  C
ATOM   9687  C   GLY D 153     -33.287  76.144  57.401  1.00 24.02      A  C
ATOM   9688  O   GLY D 153     -34.426  75.938  57.104  1.00 23.58      A  O
ATOM   9689  N   HIS D 154     -32.288  75.452  56.912  1.00 23.88      A  N
ATOM   9690  CA  HIS D 154     -32.532  74.372  56.019  1.00 24.13      A  C
ATOM   9691  CB  HIS D 154     -31.260  73.885  55.394  1.00 23.04      A  C
ATOM   9692  CG  HIS D 154     -30.716  74.791  54.348  1.00 27.38      A  C
ATOM   9693  ND1 HIS D 154     -31.208  74.840  53.078  1.00 26.32      A  N
ATOM   9694  CE1 HIS D 154     -30.521  75.701  52.369  1.00 27.01      A  C
ATOM   9695  NE2 HIS D 154     -29.606  76.224  53.141  1.00 32.79      A  N
ATOM   9696  CD2 HIS D 154     -29.702  75.668  54.380  1.00 30.30      A  C
ATOM   9697  C   HIS D 154     -33.278  73.267  56.679  1.00 23.93      A  C
ATOM   9698  O   HIS D 154     -34.115  72.708  56.102  1.00 24.62      A  O
ATOM   9699  N   LEU D 155     -32.955  72.967  57.910  1.00 23.14      A  N
ATOM   9700  CA  LEU D 155     -33.616  71.961  58.679  1.00 21.67      A  C
ATOM   9701  CB  LEU D 155     -32.877  71.866  59.995  1.00 20.36      A  C
ATOM   9702  CG  LEU D 155     -33.286  70.916  61.077  1.00 17.49      A  C
ATOM   9703  CD1 LEU D 155     -33.407  69.594  60.542  1.00 12.18      A  C
ATOM   9704  CD2 LEU D 155     -32.250  70.975  62.024  1.00 15.46      A  C
ATOM   9705  C   LEU D 155     -35.060  72.255  58.949  1.00 21.87      A  C
ATOM   9706  O   LEU D 155     -35.889  71.407  58.864  1.00 21.87      A  O
ATOM   9707  N   ASN D 156     -35.336  73.480  59.310  1.00 20.96      A  N
ATOM   9708  CA  ASN D 156     -36.669  73.903  59.528  1.00 21.16      A  C
ATOM   9709  CB  ASN D 156     -36.729  75.223  60.243  1.00 20.33      A  C
ATOM   9710  CG  ASN D 156     -37.934  75.341  61.086  1.00 23.12      A  C
ATOM   9711  OD1 ASN D 156     -38.234  74.498  61.885  1.00 22.21      A  O
ATOM   9712  ND2 ASN D 156     -38.645  76.373  60.889  1.00 23.58      A  N
ATOM   9713  C   ASN D 156     -37.536  73.874  58.305  1.00 21.59      A  C
ATOM   9714  O   ASN D 156     -38.681  73.589  58.408  1.00 20.61      A  O
ATOM   9715  N   LEU D 157     -36.979  74.212  57.157  1.00 21.15      A  N
ATOM   9716  CA  LEU D 157     -37.608  73.979  55.889  1.00 20.58      A  C
ATOM   9717  CB  LEU D 157     -36.851  74.639  54.750  1.00 21.35      A  C
ATOM   9718  CG  LEU D 157     -37.534  74.689  53.388  1.00 22.81      A  C
ATOM   9719  CD1 LEU D 157     -38.834  75.300  53.504  1.00 22.34      A  C
ATOM   9720  CD2 LEU D 157     -36.777  75.433  52.432  1.00 20.00      A  C
ATOM   9721  C   LEU D 157     -37.792  72.524  55.615  1.00 21.43      A  C
ATOM   9722  O   LEU D 157     -38.814  72.153  55.193  1.00 23.83      A  O
ATOM   9723  N   MET D 158     -36.818  71.697  55.908  1.00 19.57      A  N
ATOM   9724  CA  MET D 158     -36.944  70.273  55.720  1.00 20.52      A  C
ATOM   9725  CB  MET D 158     -35.618  69.560  55.914  1.00 20.64      D  C
ATOM   9726  CG  MET D 158     -34.586  69.922  54.937  1.00 22.07      D  C
ATOM   9727  SD  MET D 158     -32.948  69.384  55.216  1.00 24.36      D  S
```

Appendix 1

```
ATOM   9728  CE  MET D 158     -33.210  67.706  55.134  1.00 18.87          D   C
ATOM   9729  C   MET D 158     -38.017  69.658  56.580  1.00 22.21          A   C
ATOM   9730  O   MET D 158     -38.671  68.774  56.189  1.00 21.99          A   O
ATOM   9731  N   TYR D 159     -38.185  70.140  57.781  1.00 24.59          A   N
ATOM   9732  CA  TYR D 159     -39.198  69.623  58.645  1.00 24.85          A   C
ATOM   9733  CB  TYR D 159     -39.164  70.368  59.975  1.00 25.58          A   C
ATOM   9734  CG  TYR D 159     -38.208  69.884  61.029  1.00 27.75          A   C
ATOM   9735  CD1 TYR D 159     -37.966  68.553  61.216  1.00 29.31          A   C
ATOM   9736  CE1 TYR D 159     -37.122  68.135  62.162  1.00 20.24          A   C
ATOM   9737  CZ  TYR D 159     -36.506  69.034  62.933  1.00 23.86          A   C
ATOM   9738  OH  TYR D 159     -35.646  68.643  63.884  1.00 28.17          A   O
ATOM   9739  CE2 TYR D 159     -36.702  70.336  62.768  1.00 20.90          A   C
ATOM   9740  CD2 TYR D 159     -37.549  70.763  61.844  1.00 24.07          A   C
ATOM   9741  C   TYR D 159     -40.547  69.868  58.031  1.00 24.77          A   C
ATOM   9742  O   TYR D 159     -41.377  69.033  58.020  1.00 23.71          A   O
ATOM   9743  N   GLY D 160     -40.774  71.058  57.570  1.00 24.21          A   N
ATOM   9744  CA  GLY D 160     -42.018  71.366  56.936  1.00 23.17          A   C
ATOM   9745  C   GLY D 160     -42.361  70.650  55.675  1.00 22.95          A   C
ATOM   9746  O   GLY D 160     -43.461  70.282  55.465  1.00 22.00          A   O
ATOM   9747  N   LEU D 161     -41.382  70.489  54.832  1.00 22.42          A   N
ATOM   9748  CA  LEU D 161     -41.550  69.829  53.592  1.00 22.12          A   C
ATOM   9749  CB  LEU D 161     -40.285  69.930  52.782  1.00 22.95          A   C
ATOM   9750  CG  LEU D 161     -40.165  71.305  52.202  1.00 20.99          A   C
ATOM   9751  CD1 LEU D 161     -39.006  71.436  51.414  1.00 22.81          A   C
ATOM   9752  CD2 LEU D 161     -41.315  71.516  51.392  1.00 23.01          A   C
ATOM   9753  C   LEU D 161     -41.908  68.426  53.812  1.00 22.89          A   C
ATOM   9754  O   LEU D 161     -42.697  67.877  53.123  1.00 23.85          A   O
ATOM   9755  N   TYR D 162     -41.292  67.843  54.793  1.00 22.89          A   N
ATOM   9756  CA  TYR D 162     -41.508  66.483  55.116  1.00 23.42          A   C
ATOM   9757  CB  TYR D 162     -40.557  66.072  56.205  1.00 23.27          A   C
ATOM   9758  CG  TYR D 162     -40.916  64.780  56.807  1.00 24.07          A   C
ATOM   9759  CD1 TYR D 162     -40.568  63.630  56.204  1.00 22.17          A   C
ATOM   9760  CE1 TYR D 162     -40.913  62.478  56.715  1.00 25.61          A   C
ATOM   9761  CZ  TYR D 162     -41.593  62.431  57.852  1.00 24.51          A   C
ATOM   9762  OH  TYR D 162     -41.880  61.227  58.331  1.00 36.82          A   O
ATOM   9763  CE2 TYR D 162     -41.955  63.536  58.492  1.00 22.91          A   C
ATOM   9764  CD2 TYR D 162     -41.629  64.705  57.970  1.00 23.85          A   C
ATOM   9765  C   TYR D 162     -42.894  66.192  55.557  1.00 23.75          A   C
ATOM   9766  O   TYR D 162     -43.429  65.198  55.129  1.00 25.53          A   O
ATOM   9767  N   GLN D 163     -43.420  67.045  56.394  1.00 23.69          A   N
ATOM   9768  CA  GLN D 163     -44.770  66.984  56.840  1.00 25.09          A   C
ATOM   9769  CB  GLN D 163     -44.980  67.853  58.088  1.00 24.45          A   C
ATOM   9770  CG  GLN D 163     -46.360  67.730  58.628  1.00 29.60          A   C
ATOM   9771  CD  GLN D 163     -46.562  68.167  60.029  1.00 35.29          A   C
ATOM   9772  OE1 GLN D 163     -45.650  68.250  60.809  1.00 41.72          A   O
ATOM   9773  NE2 GLN D 163     -47.788  68.432  60.365  1.00 31.21          A   N
ATOM   9774  C   GLN D 163     -45.756  67.271  55.726  1.00 24.32          A   C
ATOM   9775  O   GLN D 163     -46.771  66.683  55.636  1.00 22.54          A   O
ATOM   9776  N   LEU D 164     -45.433  68.200  54.873  1.00 25.00          A   N
ATOM   9777  CA  LEU D 164     -46.271  68.473  53.744  1.00 26.38          A   C
ATOM   9778  CB  LEU D 164     -45.651  69.618  52.967  1.00 26.62          A   C
ATOM   9779  CG  LEU D 164     -46.304  70.914  52.558  1.00 25.85          A   C
ATOM   9780  CD1 LEU D 164     -47.422  71.267  53.387  1.00 25.58          A   C
ATOM   9781  CD2 LEU D 164     -45.316  71.991  52.547  1.00 26.59          A   C
```

Appendix 1

```
ATOM   9782  C   LEU D 164     -46.420  67.277  52.807  1.00 26.56      A  C
ATOM   9783  O   LEU D 164     -47.495  66.987  52.372  1.00 25.44      A  O
ATOM   9784  N   VAL D 165     -45.328  66.618  52.479  1.00 25.98      A  N
ATOM   9785  CA  VAL D 165     -45.360  65.426  51.665  1.00 25.52      A  C
ATOM   9786  CB  VAL D 165     -43.993  65.058  51.283  1.00 24.27      A  C
ATOM   9787  CG1 VAL D 165     -44.004  63.790  50.603  1.00 17.84      A  C
ATOM   9788  CG2 VAL D 165     -43.409  66.094  50.461  1.00 21.75      A  C
ATOM   9789  C   VAL D 165     -45.970  64.172  52.224  1.00 27.82      A  C
ATOM   9790  O   VAL D 165     -46.764  63.547  51.596  1.00 29.58      A  O
ATOM   9791  N   THR D 166     -45.499  63.766  53.373  1.00 28.71      A  N
ATOM   9792  CA  THR D 166     -46.109  62.759  54.182  1.00 29.99      A  C
ATOM   9793  CB  THR D 166     -45.135  62.133  55.148  1.00 29.39      A  C
ATOM   9794  OG1 THR D 166     -45.031  62.938  56.307  1.00 30.40      A  O
ATOM   9795  CG2 THR D 166     -43.836  62.029  54.564  1.00 29.61      A  C
ATOM   9796  C   THR D 166     -47.133  63.477  54.970  1.00 32.37      A  C
ATOM   9797  O   THR D 166     -47.168  64.668  55.027  1.00 37.24      A  O
ATOM   9798  N   GLY D 167     -47.971  62.791  55.652  1.00 31.10      A  N
ATOM   9799  CA  GLY D 167     -48.793  63.575  56.527  1.00 31.87      A  C
ATOM   9800  C   GLY D 167     -48.282  63.568  57.931  1.00 34.28      A  C
ATOM   9801  O   GLY D 167     -49.027  63.812  58.827  1.00 33.87      A  O
ATOM   9802  N   SER D 168     -47.008  63.275  58.107  1.00 34.63      A  N
ATOM   9803  CA  SER D 168     -46.469  62.823  59.368  1.00 34.67      A  C
ATOM   9804  CB  SER D 168     -45.237  62.016  59.129  1.00 33.81      A  C
ATOM   9805  OG  SER D 168     -44.765  61.554  60.332  1.00 35.17      A  O
ATOM   9806  C   SER D 168     -46.194  63.851  60.424  1.00 35.18      A  C
ATOM   9807  O   SER D 168     -45.549  64.823  60.193  1.00 35.09      A  O
ATOM   9808  N   ARG D 169     -46.648  63.555  61.623  1.00 35.34      A  N
ATOM   9809  CA  ARG D 169     -46.575  64.458  62.733  1.00 36.07      A  C
ATOM   9810  CB  ARG D 169     -47.873  64.440  63.495  1.00 36.34      A  C
ATOM   9811  CG  ARG D 169     -48.972  65.109  62.765  1.00 39.08      A  C
ATOM   9812  CD  ARG D 169     -50.144  65.347  63.645  1.00 47.96      A  C
ATOM   9813  NE  ARG D 169     -51.362  65.556  62.872  1.00 59.53      A  N
ATOM   9814  CZ  ARG D 169     -51.928  66.730  62.602  1.00 59.85      A  C
ATOM   9815  NH1 ARG D 169     -51.418  67.869  63.028  1.00 58.69      A  N
ATOM   9816  NH2 ARG D 169     -53.016  66.756  61.878  1.00 57.41      A  N
ATOM   9817  C   ARG D 169     -45.397  64.172  63.633  1.00 36.21      A  C
ATOM   9818  O   ARG D 169     -45.309  64.665  64.697  1.00 37.11      A  O
ATOM   9819  N   ARG D 170     -44.483  63.381  63.132  1.00 35.98      A  N
ATOM   9820  CA  ARG D 170     -43.285  62.876  63.772  1.00 35.19      A  C
ATOM   9821  CB  ARG D 170     -42.716  61.811  62.859  1.00 35.52      A  C
ATOM   9822  CG  ARG D 170     -41.255  61.575  62.874  1.00 40.54      A  C
ATOM   9823  CD  ARG D 170     -40.967  60.426  61.948  1.00 47.71      A  C
ATOM   9824  NE  ARG D 170     -39.645  59.870  62.097  1.00 54.72      A  N
ATOM   9825  CZ  ARG D 170     -39.352  58.857  62.881  1.00 60.04      A  C
ATOM   9826  NH1 ARG D 170     -40.278  58.287  63.608  1.00 60.72      A  N
ATOM   9827  NH2 ARG D 170     -38.121  58.437  62.966  1.00 62.16      A  N
ATOM   9828  C   ARG D 170     -42.212  63.857  64.215  1.00 34.08      A  C
ATOM   9829  O   ARG D 170     -41.597  63.648  65.220  1.00 33.90      A  O
ATOM   9830  N   TYR D 171     -42.005  64.913  63.447  1.00 31.20      A  N
ATOM   9831  CA  TYR D 171     -41.101  65.991  63.787  1.00 29.80      A  C
ATOM   9832  CB  TYR D 171     -40.164  66.312  62.649  1.00 30.58      A  C
ATOM   9833  CG  TYR D 171     -39.300  65.197  62.247  1.00 32.16      A  C
ATOM   9834  CD1 TYR D 171     -38.246  64.824  63.006  1.00 30.52      A  C
ATOM   9835  CE1 TYR D 171     -37.479  63.818  62.644  1.00 33.09      A  C
```

Appendix 1

```
ATOM   9836  CZ   TYR D 171     -37.746  63.161  61.495  1.00 36.83      A   C
ATOM   9837  OH   TYR D 171     -36.977  62.138  61.100  1.00 40.20      A   O
ATOM   9838  CE2  TYR D 171     -38.778  63.516  60.721  1.00 35.42      A   C
ATOM   9839  CD2  TYR D 171     -39.537  64.519  61.093  1.00 36.12      A   C
ATOM   9840  C    TYR D 171     -41.787  67.261  64.193  1.00 28.26      A   C
ATOM   9841  O    TYR D 171     -41.188  68.260  64.270  1.00 28.43      A   O
ATOM   9842  N    GLU D 172     -43.054  67.205  64.459  1.00 28.43      A   N
ATOM   9843  CA   GLU D 172     -43.812  68.381  64.721  1.00 29.12      A   C
ATOM   9844  CB   GLU D 172     -45.253  67.979  64.928  1.00 30.06      A   C
ATOM   9845  CG   GLU D 172     -46.247  68.937  64.455  1.00 34.28      A   C
ATOM   9846  CD   GLU D 172     -47.619  68.354  64.383  1.00 41.06      A   C
ATOM   9847  OE1  GLU D 172     -47.983  67.577  65.252  1.00 37.71      A   O
ATOM   9848  OE2  GLU D 172     -48.349  68.670  63.454  1.00 40.66      A   O-1
ATOM   9849  C    GLU D 172     -43.310  69.126  65.928  1.00 28.92      A   C
ATOM   9850  O    GLU D 172     -43.278  70.317  65.932  1.00 28.77      A   O
ATOM   9851  N    ALA D 173     -42.940  68.425  66.972  1.00 29.02      A   N
ATOM   9852  CA   ALA D 173     -42.464  69.078  68.163  1.00 30.02      A   C
ATOM   9853  CB   ALA D 173     -42.313  68.104  69.243  1.00 29.38      A   C
ATOM   9854  C    ALA D 173     -41.183  69.830  67.969  1.00 30.37      A   C
ATOM   9855  O    ALA D 173     -41.039  70.901  68.452  1.00 31.24      A   O
ATOM   9856  N    GLU D 174     -40.247  69.227  67.274  1.00 28.98      A   N
ATOM   9857  CA   GLU D 174     -38.999  69.847  66.900  1.00 28.41      A   C
ATOM   9858  CB   GLU D 174     -38.038  68.792  66.360  1.00 29.01      A   C
ATOM   9859  CG   GLU D 174     -38.021  67.569  67.187  1.00 32.71      A   C
ATOM   9860  CD   GLU D 174     -37.321  66.401  66.560  1.00 41.65      A   C
ATOM   9861  OE1  GLU D 174     -37.760  65.264  66.729  1.00 40.87      A   O
ATOM   9862  OE2  GLU D 174     -36.324  66.605  65.909  1.00 45.11      A   O-1
ATOM   9863  C    GLU D 174     -39.181  71.013  65.951  1.00 26.21      A   C
ATOM   9864  O    GLU D 174     -38.514  71.987  66.031  1.00 25.79      A   O
ATOM   9865  N    HIS D 175     -40.108  70.859  65.040  1.00 24.04      A   N
ATOM   9866  CA   HIS D 175     -40.529  71.872  64.113  1.00 21.81      A   C
ATOM   9867  CB   HIS D 175     -41.529  71.202  63.188  1.00 21.34      A   C
ATOM   9868  CG   HIS D 175     -41.863  71.968  61.950  1.00 19.85      A   C
ATOM   9869  ND1  HIS D 175     -40.992  72.810  61.318  1.00 18.81      A   N
ATOM   9870  CE1  HIS D 175     -41.570  73.342  60.274  1.00 17.10      A   C
ATOM   9871  NE2  HIS D 175     -42.773  72.843  60.181  1.00 21.50      A   N
ATOM   9872  CD2  HIS D 175     -42.982  71.982  61.213  1.00 17.41      A   C
ATOM   9873  C    HIS D 175     -41.144  73.097  64.777  1.00 20.55      A   C
ATOM   9874  O    HIS D 175     -40.841  74.184  64.429  1.00 19.86      A   O
ATOM   9875  N    ALA D 176     -42.002  72.908  65.746  1.00 18.93      A   N
ATOM   9876  CA   ALA D 176     -42.476  74.021  66.512  1.00 18.92      A   C
ATOM   9877  CB   ALA D 176     -43.564  73.590  67.421  1.00 18.43      A   C
ATOM   9878  C    ALA D 176     -41.384  74.722  67.297  1.00 18.51      A   C
ATOM   9879  O    ALA D 176     -41.294  75.896  67.313  1.00 18.18      A   O
ATOM   9880  N    HIS D 177     -40.543  73.963  67.928  1.00 17.59      A   N
ATOM   9881  CA   HIS D 177     -39.474  74.490  68.660  1.00 18.52      A   C
ATOM   9882  CB   HIS D 177     -38.819  73.297  69.268  1.00 19.84      A   C
ATOM   9883  CG   HIS D 177     -37.707  73.603  70.201  1.00 28.74      A   C
ATOM   9884  ND1  HIS D 177     -36.394  73.558  69.821  1.00 35.34      A   N
ATOM   9885  CE1  HIS D 177     -35.632  73.840  70.844  1.00 38.02      A   C
ATOM   9886  NE2  HIS D 177     -36.407  74.066  71.877  1.00 41.60      A   N
ATOM   9887  CD2  HIS D 177     -37.706  73.901  71.508  1.00 35.05      A   C
ATOM   9888  C    HIS D 177     -38.485  75.263  67.848  1.00 18.07      A   C
ATOM   9889  O    HIS D 177     -38.134  76.326  68.216  1.00 20.07      A   O
```

Appendix 1

```
ATOM   9890  N   LEU D 178     -38.054  74.725  66.736  1.00 18.29      A  N
ATOM   9891  CA  LEU D 178     -37.203  75.437  65.822  1.00 17.73      A  C
ATOM   9892  CB  LEU D 178     -36.579  74.500  64.791  1.00 15.65      A  C
ATOM   9893  CG  LEU D 178     -35.473  75.026  63.895  1.00 19.51      A  C
ATOM   9894  CD1 LEU D 178     -34.415  75.707  64.606  1.00 14.46      A  C
ATOM   9895  CD2 LEU D 178     -34.915  73.997  63.031  1.00 17.58      A  C
ATOM   9896  C   LEU D 178     -37.840  76.653  65.188  1.00 19.26      A  C
ATOM   9897  O   LEU D 178     -37.211  77.640  65.033  1.00 20.46      A  O
ATOM   9898  N   THR D 179     -39.102  76.568  64.837  1.00 20.54      A  N
ATOM   9899  CA  THR D 179     -39.792  77.672  64.241  1.00 21.17      A  C
ATOM   9900  CB  THR D 179     -41.216  77.235  63.792  1.00 21.51      A  C
ATOM   9901  OG1 THR D 179     -41.144  76.483  62.618  1.00 19.67      A  O
ATOM   9902  CG2 THR D 179     -42.081  78.369  63.524  1.00 17.81      A  C
ATOM   9903  C   THR D 179     -39.863  78.835  65.204  1.00 22.49      A  C
ATOM   9904  O   THR D 179     -39.601  79.928  64.835  1.00 23.92      A  O
ATOM   9905  N   ARG D 180     -40.222  78.576  66.442  1.00 21.47      A  N
ATOM   9906  CA  ARG D 180     -40.264  79.589  67.458  1.00 21.72      A  C
ATOM   9907  CB  ARG D 180     -40.999  79.121  68.710  1.00 23.36      A  C
ATOM   9908  CG  ARG D 180     -42.347  78.589  68.395  1.00 23.92      A  C
ATOM   9909  CD  ARG D 180     -43.443  78.824  69.366  1.00 23.12      A  C
ATOM   9910  NE  ARG D 180     -43.217  79.879  70.314  1.00 26.76      A  N
ATOM   9911  CZ  ARG D 180     -43.847  81.038  70.349  1.00 25.82      A  C
ATOM   9912  NH1 ARG D 180     -44.739  81.340  69.473  1.00 27.26      A  N
ATOM   9913  NH2 ARG D 180     -43.563  81.907  71.274  1.00 26.01      A  N
ATOM   9914  C   ARG D 180     -38.924  80.157  67.755  1.00 22.99      A  C
ATOM   9915  O   ARG D 180     -38.810  81.312  67.978  1.00 24.19      A  O
ATOM   9916  N   ILE D 181     -37.894  79.350  67.748  1.00 23.79      A  N
ATOM   9917  CA  ILE D 181     -36.567  79.868  67.950  1.00 23.99      A  C
ATOM   9918  CB  ILE D 181     -35.537  78.761  67.979  1.00 25.53      A  C
ATOM   9919  CG1 ILE D 181     -35.531  78.063  69.307  1.00 23.95      A  C
ATOM   9920  CD1 ILE D 181     -34.759  76.861  69.289  1.00 27.52      A  C
ATOM   9921  CG2 ILE D 181     -34.199  79.297  67.718  1.00 20.98      A  C
ATOM   9922  C   ILE D 181     -36.181  80.818  66.853  1.00 25.13      A  C
ATOM   9923  O   ILE D 181     -35.604  81.821  67.104  1.00 26.24      A  O
ATOM   9924  N   ILE D 182     -36.487  80.475  65.623  1.00 24.71      A  N
ATOM   9925  CA  ILE D 182     -36.157  81.320  64.520  1.00 24.40      A  C
ATOM   9926  CB  ILE D 182     -36.457  80.599  63.198  1.00 23.60      A  C
ATOM   9927  CG1 ILE D 182     -35.408  79.537  62.945  1.00 21.82      A  C
ATOM   9928  CD1 ILE D 182     -35.636  78.696  61.788  1.00 13.34      A  C
ATOM   9929  CG2 ILE D 182     -36.521  81.537  62.055  1.00 19.69      A  C
ATOM   9930  C   ILE D 182     -36.896  82.623  64.628  1.00 25.37      A  C
ATOM   9931  O   ILE D 182     -36.388  83.664  64.367  1.00 25.80      A  O
ATOM   9932  N   HIS D 183     -38.142  82.522  64.977  1.00 26.06      A  N
ATOM   9933  CA  HIS D 183     -38.984  83.640  65.122  1.00 27.65      A  C
ATOM   9934  CB  HIS D 183     -40.394  83.151  65.183  1.00 29.19      A  C
ATOM   9935  CG  HIS D 183     -41.388  84.237  65.301  1.00 33.59      A  C
ATOM   9936  ND1 HIS D 183     -41.938  84.588  66.503  1.00 40.17      A  N
ATOM   9937  CE1 HIS D 183     -42.780  85.574  66.316  1.00 39.94      A  C
ATOM   9938  NE2 HIS D 183     -42.791  85.873  65.035  1.00 40.62      A  N
ATOM   9939  CD2 HIS D 183     -41.931  85.050  64.377  1.00 34.06      A  C
ATOM   9940  C   HIS D 183     -38.672  84.549  66.259  1.00 28.15      A  C
ATOM   9941  O   HIS D 183     -38.739  85.702  66.092  1.00 28.03      A  O
ATOM   9942  N   ASP D 184     -38.367  84.015  67.425  1.00 30.08      A  N
ATOM   9943  CA  ASP D 184     -37.957  84.817  68.554  1.00 32.15      A  C
```

Appendix 1

```
ATOM   9944  CB  ASP D 184     -37.871  84.012  69.854  1.00 31.74      A  C
ATOM   9945  CG  ASP D 184     -39.199  83.435  70.283  1.00 39.81      A  C
ATOM   9946  OD1 ASP D 184     -39.220  82.410  70.974  1.00 44.21      A  O
ATOM   9947  OD2 ASP D 184     -40.243  83.978  69.927  1.00 46.52      A  O-1
ATOM   9948  C   ASP D 184     -36.655  85.538  68.274  1.00 32.57      A  C
ATOM   9949  O   ASP D 184     -36.491  86.654  68.674  1.00 32.79      A  O
ATOM   9950  N   GLU D 185     -35.731  84.886  67.585  1.00 32.15      A  N
ATOM   9951  CA  GLU D 185     -34.464  85.473  67.177  1.00 33.56      A  C
ATOM   9952  CB  GLU D 185     -33.453  84.420  66.731  1.00 32.87      A  C
ATOM   9953  CG  GLU D 185     -32.048  84.884  66.738  1.00 36.83      A  C
ATOM   9954  CD  GLU D 185     -31.029  83.790  66.668  1.00 45.21      A  C
ATOM   9955  OE1 GLU D 185     -31.406  82.625  66.702  1.00 45.58      A  O
ATOM   9956  OE2 GLU D 185     -29.839  84.092  66.592  1.00 43.46      A  O-1
ATOM   9957  C   GLU D 185     -34.585  86.598  66.186  1.00 33.54      A  C
ATOM   9958  O   GLU D 185     -33.828  87.532  66.226  1.00 34.38      A  O
ATOM   9959  N   ILE D 186     -35.531  86.483  65.281  1.00 33.22      A  N
ATOM   9960  CA  ILE D 186     -35.883  87.550  64.390  1.00 33.88      A  C
ATOM   9961  CB  ILE D 186     -36.851  87.058  63.342  1.00 34.53      A  C
ATOM   9962  CG1 ILE D 186     -36.134  86.231  62.313  1.00 33.91      A  C
ATOM   9963  CD1 ILE D 186     -37.023  85.355  61.621  1.00 35.18      A  C
ATOM   9964  CG2 ILE D 186     -37.458  88.153  62.662  1.00 31.45      A  C
ATOM   9965  C   ILE D 186     -36.454  88.730  65.152  1.00 34.72      A  C
ATOM   9966  O   ILE D 186     -36.131  89.849  64.898  1.00 35.02      A  O
ATOM   9967  N   ALA D 187     -37.280  88.454  66.125  1.00 34.10      A  N
ATOM   9968  CA  ALA D 187     -37.854  89.461  66.977  1.00 36.02      A  C
ATOM   9969  CB  ALA D 187     -38.856  88.843  67.831  1.00 36.09      A  C
ATOM   9970  C   ALA D 187     -36.858  90.268  67.822  1.00 36.47      A  C
ATOM   9971  O   ALA D 187     -37.091  91.396  68.136  1.00 35.36      A  O
ATOM   9972  N   ALA D 188     -35.771  89.661  68.229  1.00 37.23      A  N
ATOM   9973  CA  ALA D 188     -34.863  90.300  69.132  1.00 38.66      A  C
ATOM   9974  CB  ALA D 188     -34.479  89.375  70.166  1.00 36.76      A  C
ATOM   9975  C   ALA D 188     -33.641  90.887  68.485  1.00 40.30      A  C
ATOM   9976  O   ALA D 188     -32.707  91.212  69.149  1.00 41.80      A  O
ATOM   9977  N   ASN D 189     -33.635  91.033  67.181  1.00 40.68      A  N
ATOM   9978  CA  ASN D 189     -32.468  91.530  66.525  1.00 40.84      A  C
ATOM   9979  CB  ASN D 189     -32.028  90.608  65.388  1.00 40.72      A  C
ATOM   9980  CG  ASN D 189     -31.064  89.526  65.814  1.00 41.32      A  C
ATOM   9981  OD1 ASN D 189     -30.472  89.562  66.861  1.00 44.55      A  O
ATOM   9982  ND2 ASN D 189     -30.905  88.563  64.977  1.00 38.07      A  N
ATOM   9983  C   ASN D 189     -32.829  92.860  65.966  1.00 41.09      A  C
ATOM   9984  O   ASN D 189     -33.888  93.012  65.459  1.00 41.10      A  O
ATOM   9985  N   PRO D 190     -31.958  93.337  66.067  1.00 42.46      A  N
ATOM   9986  CA  PRO D 190     -32.098  95.032  65.260  1.00 43.00      A  C
ATOM   9987  CB  PRO D 190     -30.966  95.904  65.758  1.00 43.11      A  C
ATOM   9988  CG  PRO D 190     -29.976  94.972  66.224  1.00 42.32      A  C
ATOM   9989  CD  PRO D 190     -30.698  93.840  66.812  1.00 42.83      A  C
ATOM   9990  C   PRO D 190     -31.751  94.484  63.940  1.00 42.52      A  C
ATOM   9991  O   PRO D 190     -30.969  93.609  63.934  1.00 45.76      A  O
ATOM   9992  N   PHE D 191     -32.337  94.877  62.857  1.00 40.80      A  N
ATOM   9993  CA  PHE D 191     -32.013  94.219  61.604  1.00 38.71      A  C
ATOM   9994  CB  PHE D 191     -30.504  94.056  61.332  1.00 38.42      A  C
ATOM   9995  CG  PHE D 191     -29.873  92.842  61.930  1.00 35.61      A  C
ATOM   9996  CD1 PHE D 191     -30.122  91.600  61.443  1.00 33.62      A  C
ATOM   9997  CE1 PHE D 191     -29.552  90.536  61.990  1.00 28.77      A  C
```

Appendix 1

```
ATOM   9998  CZ   PHE D 191     -28.709  90.692  63.003  1.00 31.86    A  C
ATOM   9999  CE2  PHE D 191     -28.441  91.905  63.489  1.00 27.04    A  C
ATOM  10000  CD2  PHE D 191     -28.986  92.962  62.954  1.00 31.52    A  C
ATOM  10001  C    PHE D 191     -32.796  92.970  61.348  1.00 37.62    A  C
ATOM  10002  O    PHE D 191     -33.098  92.225  62.230  1.00 35.90    A  O
ATOM  10003  N    ALA D 192     -33.100  92.795  60.081  1.00 38.64    A  N
ATOM  10004  CA   ALA D 192     -33.823  91.678  59.548  1.00 38.94    A  C
ATOM  10005  CB   ALA D 192     -33.233  91.303  58.307  1.00 37.57    A  C
ATOM  10006  C    ALA D 192     -33.686  90.521  60.398  1.00 40.25    A  C
ATOM  10007  O    ALA D 192     -34.066  90.517  61.540  1.00 44.62    A  O
ATOM  10008  N    GLY D 193     -33.101  89.518  59.812  1.00 40.07    A  N
ATOM  10009  CA   GLY D 193     -33.181  88.206  60.358  1.00 38.74    A  C
ATOM  10010  C    GLY D 193     -32.073  87.785  61.248  1.00 37.56    A  C
ATOM  10011  O    GLY D 193     -31.987  88.250  62.323  1.00 38.57    A  O
ATOM  10012  N    ILE D 194     -31.265  86.859  60.805  1.00 34.83    A  N
ATOM  10013  CA   ILE D 194     -30.355  86.189  61.666  1.00 32.61    A  C
ATOM  10014  CB   ILE D 194     -30.936  84.859  62.044  1.00 32.88    A  C
ATOM  10015  CG1  ILE D 194     -32.236  85.071  62.785  1.00 30.55    A  C
ATOM  10016  CD1  ILE D 194     -33.111  83.952  62.749  1.00 31.21    A  C
ATOM  10017  CG2  ILE D 194     -29.988  84.072  62.855  1.00 32.31    A  C
ATOM  10018  C    ILE D 194     -29.058  85.983  60.982  1.00 32.30    A  C
ATOM  10019  O    ILE D 194     -29.008  85.795  59.820  1.00 33.78    A  O
ATOM  10020  N    VAL D 195     -27.993  86.019  61.738  1.00 31.92    A  N
ATOM  10021  CA   VAL D 195     -26.668  85.798  61.237  1.00 30.51    A  C
ATOM  10022  CB   VAL D 195     -25.651  86.468  62.124  1.00 30.80    A  C
ATOM  10023  CG1  VAL D 195     -25.779  87.905  62.042  1.00 27.19    A  C
ATOM  10024  CG2  VAL D 195     -25.786  86.024  63.500  1.00 28.80    A  C
ATOM  10025  C    VAL D 195     -26.351  84.337  61.087  1.00 30.83    A  C
ATOM  10026  O    VAL D 195     -27.096  83.521  61.492  1.00 29.41    A  O
ATOM  10027  N    CYS D 196     -25.244  84.002  60.485  1.00 33.46    A  N
ATOM  10028  CA   CYS D 196     -24.940  82.617  60.351  1.00 37.23    A  C
ATOM  10029  CB   CYS D 196     -24.397  82.337  58.967  1.00 36.79    A  C
ATOM  10030  SG   CYS D 196     -25.605  82.121  57.739  1.00 45.73    A  S
ATOM  10031  C    CYS D 196     -23.902  82.284  61.363  1.00 37.45    A  C
ATOM  10032  O    CYS D 196     -24.197  81.812  62.406  1.00 38.33    A  O
ATOM  10033  N    GLU D 197     -22.673  82.572  61.024  1.00 39.63    A  N
ATOM  10034  CA   GLU D 197     -21.576  82.675  61.946  1.00 40.32    A  C
ATOM  10035  CB   GLU D 197     -20.250  82.677  61.211  1.00 40.68    A  C
ATOM  10036  CG   GLU D 197     -19.742  81.322  60.755  1.00 42.17    A  C
ATOM  10037  CD   GLU D 197     -19.990  81.040  59.298  1.00 46.83    A  C
ATOM  10038  OE1  GLU D 197     -20.504  81.913  58.600  1.00 44.39    A  O
ATOM  10039  OE2  GLU D 197     -19.688  79.930  59.840  1.00 47.64    A  O-1
ATOM  10040  C    GLU D 197     -21.836  84.009  62.558  1.00 41.40    A  C
ATOM  10041  O    GLU D 197     -22.679  84.704  62.134  1.00 42.22    A  O
ATOM  10042  N    PRO D 198     -21.121  84.366  63.574  1.00 42.60    A  N
ATOM  10043  CA   PRO D 198     -21.512  85.436  64.457  1.00 42.52    A  C
ATOM  10044  CB   PRO D 198     -20.488  85.304  65.537  1.00 43.08    A  C
ATOM  10045  CG   PRO D 198     -20.300  83.874  65.627  1.00 43.86    A  C
ATOM  10046  CD   PRO D 198     -20.576  83.256  64.331  1.00 42.98    A  C
ATOM  10047  C    PRO D 198     -21.633  86.871  63.967  1.00 42.52    A  C
ATOM  10048  O    PRO D 198     -22.525  87.553  64.393  1.00 44.65    A  O
ATOM  10049  N    ASP D 199     -20.773  87.358  63.122  1.00 41.27    A  N
ATOM  10050  CA   ASP D 199     -21.026  88.667  62.585  1.00 39.32    A  C
ATOM  10051  CB   ASP D 199     -19.876  89.581  62.895  1.00 39.21    A  C
```

Appendix 1

```
ATOM  10052  CG   ASP D 199     -20.206  90.980  62.697  1.00 40.52      A  C
ATOM  10053  OD1  ASP D 199     -21.367  91.299  62.779  1.00 41.81      A  O
ATOM  10054  OD2  ASP D 199     -19.306  91.764  62.450  1.00 46.72      A  O-1
ATOM  10055  C    ASP D 199     -21.316  88.633  61.094  1.00 38.33      A  C
ATOM  10056  O    ASP D 199     -21.151  89.601  60.427  1.00 38.17      A  O
ATOM  10057  N    ASN D 200     -21.720  87.497  60.573  1.00 36.55      A  N
ATOM  10058  CA   ASN D 200     -21.864  87.328  59.148  1.00 35.10      A  C
ATOM  10059  CB   ASN D 200     -21.148  86.066  58.705  1.00 34.99      A  C
ATOM  10060  CG   ASN D 200     -19.665  86.174  58.719  1.00 35.42      A  C
ATOM  10061  OD1  ASN D 200     -19.102  87.198  58.966  1.00 34.64      A  O
ATOM  10062  ND2  ASN D 200     -19.023  85.081  58.459  1.00 34.96      A  N
ATOM  10063  C    ASN D 200     -23.299  87.183  58.748  1.00 33.26      A  C
ATOM  10064  O    ASN D 200     -23.908  86.227  59.077  1.00 33.27      A  O
ATOM  10065  N    TYR D 201     -23.825  88.141  58.018  1.00 31.73      A  N
ATOM  10066  CA   TYR D 201     -25.204  88.096  57.599  1.00 30.34      A  C
ATOM  10067  CB   TYR D 201     -25.894  89.427  57.926  1.00 30.81      A  C
ATOM  10068  CG   TYR D 201     -27.361  89.472  57.596  1.00 31.12      A  C
ATOM  10069  CD1  TYR D 201     -28.312  89.455  58.572  1.00 27.03      A  C
ATOM  10070  CE1  TYR D 201     -29.596  89.499  58.261  1.00 32.86      A  C
ATOM  10071  CZ   TYR D 201     -29.957  89.541  56.957  1.00 37.45      A  C
ATOM  10072  OH   TYR D 201     -31.237  89.568  56.571  1.00 39.16      A  O
ATOM  10073  CE2  TYR D 201     -29.043  89.557  55.993  1.00 36.15      A  C
ATOM  10074  CD2  TYR D 201     -27.776  89.526  56.302  1.00 31.33      A  C
ATOM  10075  C    TYR D 201     -25.273  87.810  56.124  1.00 28.72      A  C
ATOM  10076  O    TYR D 201     -24.796  88.549  55.345  1.00 26.79      A  O
ATOM  10077  N    PHE D 202     -25.868  86.701  55.768  1.00 27.16      A  N
ATOM  10078  CA   PHE D 202     -26.026  86.323  54.396  1.00 26.76      A  C
ATOM  10079  CB   PHE D 202     -25.454  84.948  54.140  1.00 26.41      A  C
ATOM  10080  CG   PHE D 202     -24.003  84.864  54.298  1.00 26.40      A  C
ATOM  10081  CD1  PHE D 202     -23.169  85.135  53.271  1.00 29.72      A  C
ATOM  10082  CE1  PHE D 202     -21.826  85.030  53.423  1.00 27.44      A  C
ATOM  10083  CZ   PHE D 202     -21.321  84.674  54.591  1.00 23.53      A  C
ATOM  10084  CE2  PHE D 202     -22.132  84.426  55.616  1.00 27.53      A  C
ATOM  10085  CD2  PHE D 202     -23.458  84.503  55.479  1.00 27.00      A  C
ATOM  10086  C    PHE D 202     -27.470  86.339  54.007  1.00 26.45      A  C
ATOM  10087  O    PHE D 202     -28.282  85.815  54.681  1.00 27.12      A  O
ATOM  10088  N    VAL D 203     -27.764  86.984  52.905  1.00 26.07      A  N
ATOM  10089  CA   VAL D 203     -29.105  87.132  52.396  1.00 25.88      A  C
ATOM  10090  CB   VAL D 203     -29.111  88.251  51.330  1.00 26.33      A  C
ATOM  10091  CG1  VAL D 203     -29.424  87.784  49.993  1.00 25.57      A  C
ATOM  10092  CG2  VAL D 203     -29.998  89.311  51.696  1.00 29.03      A  C
ATOM  10093  C    VAL D 203     -29.789  85.824  51.979  1.00 26.27      A  C
ATOM  10094  O    VAL D 203     -30.941  85.638  52.204  1.00 26.74      A  O
ATOM  10095  N    GLN D 204     -29.045  84.932  51.363  1.00 25.25      A  N
ATOM  10096  CA   GLN D 204     -29.532  83.646  50.925  1.00 25.36      A  C
ATOM  10097  CB   GLN D 204     -28.514  82.964  50.026  1.00 24.77      A  C
ATOM  10098  CG   GLN D 204     -27.273  82.527  50.711  1.00 22.08      A  C
ATOM  10099  CD   GLN D 204     -26.202  83.520  50.605  1.00 25.32      A  C
ATOM  10100  OE1  GLN D 204     -26.427  84.663  50.753  1.00 25.20      A  O
ATOM  10101  NE2  GLN D 204     -25.041  83.087  50.326  1.00 26.26      A  N
ATOM  10102  C    GLN D 204     -29.914  82.719  52.018  1.00 27.06      A  C
ATOM  10103  O    GLN D 204     -30.785  81.928  51.872  1.00 29.09      A  O
ATOM  10104  N    CYS D 205     -29.159  82.760  53.083  1.00 29.42      A  N
ATOM  10105  CA   CYS D 205     -29.356  81.937  54.247  1.00 31.02      A  C
```

Appendix 1

```
ATOM  10106  CB   CYS D 205     -28.148  82.021  55.153  1.00  30.93      A  C
ATOM  10107  SG   CYS D 205     -26.607  81.306  54.597  1.00  39.99      A  S
ATOM  10108  C    CYS D 205     -30.624  82.284  54.987  1.00  31.18      A  C
ATOM  10109  O    CYS D 205     -31.297  81.444  55.512  1.00  30.69      A  O
ATOM  10110  N    ASN D 206     -30.893  83.566  55.038  1.00  30.05      A  N
ATOM  10111  CA   ASN D 206     -32.115  84.105  55.556  1.00  29.57      A  C
ATOM  10112  CB   ASN D 206     -32.022  85.611  55.701  1.00  29.16      A  C
ATOM  10113  CG   ASN D 206     -31.477  86.016  57.016  1.00  31.80      A  C
ATOM  10114  OD1  ASN D 206     -32.171  86.129  57.984  1.00  33.72      A  O
ATOM  10115  ND2  ASN D 206     -30.219  86.206  57.057  1.00  32.94      A  N
ATOM  10116  C    ASN D 206     -33.309  83.713  54.744  1.00  28.62      A  C
ATOM  10117  O    ASN D 206     -34.360  83.542  55.249  1.00  27.16      A  O
ATOM  10118  N    SER D 207     -33.085  83.540  53.467  1.00  28.69      A  N
ATOM  10119  CA   SER D 207     -34.069  83.177  52.502  1.00  28.40      A  C
ATOM  10120  CB   SER D 207     -33.270  82.850  51.254  1.00  29.89      A  C
ATOM  10121  OG   SER D 207     -33.829  83.327  50.087  1.00  33.45      A  O
ATOM  10122  C    SER D 207     -34.714  81.887  52.879  1.00  27.03      A  C
ATOM  10123  O    SER D 207     -35.897  81.801  52.910  1.00  28.39      A  O
ATOM  10124  N    VAL D 208     -33.922  80.883  53.178  1.00  24.19      A  N
ATOM  10125  CA   VAL D 208     -34.417  79.593  53.590  1.00  23.24      A  C
ATOM  10126  CB   VAL D 208     -33.267  78.609  53.783  1.00  21.52      A  C
ATOM  10127  CG1  VAL D 208     -33.759  77.287  53.925  1.00  22.01      A  C
ATOM  10128  CG2  VAL D 208     -32.401  78.650  52.675  1.00  21.52      A  C
ATOM  10129  C    VAL D 208     -35.212  79.642  54.884  1.00  23.12      A  C
ATOM  10130  O    VAL D 208     -36.200  78.982  55.037  1.00  21.93      A  O
ATOM  10131  N    ALA D 209     -34.742  80.417  55.826  1.00  22.51      A  N
ATOM  10132  CA   ALA D 209     -35.378  80.517  57.092  1.00  22.00      A  C
ATOM  10133  CB   ALA D 209     -34.527  81.264  57.992  1.00  19.46      A  C
ATOM  10134  C    ALA D 209     -36.744  81.122  57.044  1.00  23.49      A  C
ATOM  10135  O    ALA D 209     -37.633  80.620  57.678  1.00  24.92      A  O
ATOM  10136  N    TYR D 210     -36.904  82.197  56.290  1.00  22.71      A  N
ATOM  10137  CA   TYR D 210     -38.183  82.843  56.122  1.00  23.83      A  C
ATOM  10138  CB   TYR D 210     -38.043  84.173  55.425  1.00  24.09      A  C
ATOM  10139  CG   TYR D 210     -37.628  85.246  56.358  1.00  24.46      A  C
ATOM  10140  CD1  TYR D 210     -38.542  85.946  57.088  1.00  24.67      A  C
ATOM  10141  CE1  TYR D 210     -38.152  86.889  57.934  1.00  23.71      A  C
ATOM  10142  CZ   TYR D 210     -36.841  87.138  58.072  1.00  23.61      A  C
ATOM  10143  OH   TYR D 210     -36.433  88.074  58.917  1.00  22.76      A  O
ATOM  10144  CE2  TYR D 210     -35.924  86.456  57.367  1.00  22.93      A  C
ATOM  10145  CD2  TYR D 210     -36.311  85.534  56.536  1.00  21.73      A  C
ATOM  10146  C    TYR D 210     -39.217  81.960  55.445  1.00  24.53      A  C
ATOM  10147  O    TYR D 210     -40.350  81.953  55.811  1.00  23.62      A  O
ATOM  10148  N    LEU D 211     -38.768  81.191  54.475  1.00  24.19      A  N
ATOM  10149  CA   LEU D 211     -39.535  80.198  53.787  1.00  24.33      A  C
ATOM  10150  CB   LEU D 211     -38.723  79.637  52.629  1.00  24.36      A  C
ATOM  10151  CG   LEU D 211     -39.397  78.942  51.465  1.00  27.21      A  C
ATOM  10152  CD1  LEU D 211     -40.610  79.644  51.015  1.00  25.20      A  C
ATOM  10153  CD2  LEU D 211     -38.448  78.756  50.333  1.00  27.55      A  C
ATOM  10154  C    LEU D 211     -39.992  79.123  54.735  1.00  23.57      A  C
ATOM  10155  O    LEU D 211     -41.043  78.630  54.610  1.00  24.00      A  O
ATOM  10156  N    SER D 212     -39.193  78.801  55.721  1.00  22.08      A  N
ATOM  10157  CA   SER D 212     -39.552  77.845  56.731  1.00  22.31      A  C
ATOM  10158  CB   SER D 212     -38.411  77.711  57.695  1.00  21.45      A  C
ATOM  10159  OG   SER D 212     -37.903  78.988  57.929  1.00  24.30      A  O
```

Appendix 1

```
ATOM  10160  C    SER D 212    -40.764  78.355  57.458  1.00  21.75    A  C
ATOM  10161  O    SER D 212    -41.603  77.629  57.818  1.00  23.57    A  O
ATOM  10162  N    LEU D 213    -40.833  79.636  57.678  1.00  20.11    A  N
ATOM  10163  CA   LEU D 213    -41.945  80.240  58.333  1.00  20.64    A  C
ATOM  10164  CB   LEU D 213    -41.660  81.707  58.513  1.00  20.57    A  C
ATOM  10165  CG   LEU D 213    -41.038  82.152  59.787  1.00  21.97    A  C
ATOM  10166  CD1  LEU D 213    -40.516  81.009  60.465  1.00  26.96    A  C
ATOM  10167  CD2  LEU D 213    -40.029  83.117  59.540  1.00  23.67    A  C
ATOM  10168  C    LEU D 213    -43.232  80.116  57.589  1.00  21.09    A  C
ATOM  10169  O    LEU D 213    -44.245  79.832  58.162  1.00  19.08    A  O
ATOM  10170  N    TRP D 214    -43.153  80.341  56.290  1.00  20.35    A  N
ATOM  10171  CA   TRP D 214    -44.256  80.225  55.388  1.00  19.34    A  C
ATOM  10172  CB   TRP D 214    -43.861  80.697  53.996  1.00  19.86    A  C
ATOM  10173  CG   TRP D 214    -43.772  82.181  53.856  1.00  21.75    A  C
ATOM  10174  CD1  TRP D 214    -42.832  82.955  54.344  1.00  18.43    A  C
ATOM  10175  NE1  TRP D 214    -43.058  84.229  54.043  1.00  17.54    A  N
ATOM  10176  CE2  TRP D 214    -44.189  84.312  53.311  1.00  18.25    A  C
ATOM  10177  CD2  TRP D 214    -44.666  83.037  53.168  1.00  18.95    A  C
ATOM  10178  CE3  TRP D 214    -45.834  82.845  52.454  1.00  18.02    A  C
ATOM  10179  CZ3  TRP D 214    -46.442  83.910  51.939  1.00  16.33    A  C
ATOM  10180  CH2  TRP D 214    -45.945  85.161  52.105  1.00  15.20    A  C
ATOM  10181  CZ2  TRP D 214    -44.815  85.385  52.789  1.00  18.43    A  C
ATOM  10182  C    TRP D 214    -44.748  78.823  55.354  1.00  19.29    A  C
ATOM  10183  O    TRP D 214    -45.906  78.597  55.377  1.00  19.80    A  O
ATOM  10184  N    VAL D 215    -43.854  77.873  55.330  1.00  18.39    A  N
ATOM  10185  CA   VAL D 215    -44.241  76.499  55.425  1.00  18.20    A  C
ATOM  10186  CB   VAL D 215    -43.086  75.598  55.112  1.00  17.26    A  C
ATOM  10187  CG1  VAL D 215    -43.386  74.217  55.423  1.00  14.16    A  C
ATOM  10188  CG2  VAL D 215    -42.740  75.717  53.752  1.00  15.86    A  C
ATOM  10189  C    VAL D 215    -44.885  76.111  56.738  1.00  19.84    A  C
ATOM  10190  O    VAL D 215    -45.889  75.459  56.738  1.00  20.07    A  O
ATOM  10191  N    TYR D 216    -44.322  76.535  57.851  1.00  20.36    A  N
ATOM  10192  CA   TYR D 216    -44.903  76.248  59.125  1.00  21.62    A  C
ATOM  10193  CB   TYR D 216    -44.054  76.732  60.313  1.00  21.59    A  C
ATOM  10194  CG   TYR D 216    -44.548  76.204  61.631  1.00  18.43    A  C
ATOM  10195  CD1  TYR D 216    -44.106  75.033  62.117  1.00  14.14    A  C
ATOM  10196  CE1  TYR D 216    -44.554  74.541  63.251  1.00  17.44    A  C
ATOM  10197  CZ   TYR D 216    -45.479  75.203  63.942  1.00  19.55    A  C
ATOM  10198  OH   TYR D 216    -45.954  74.694  65.096  1.00  18.60    A  O
ATOM  10199  CE2  TYR D 216    -45.958  76.359  63.478  1.00  18.94    A  C
ATOM  10200  CD2  TYR D 216    -45.494  76.859  62.340  1.00  18.49    A  C
ATOM  10201  C    TYR D 216    -46.273  76.864  59.172  1.00  23.21    A  C
ATOM  10202  O    TYR D 216    -47.169  76.283  59.673  1.00  23.15    A  O
ATOM  10203  N    ASP D 217    -46.429  78.031  58.598  1.00  23.75    A  N
ATOM  10204  CA   ASP D 217    -47.716  78.693  58.540  1.00  25.20    A  C
ATOM  10205  CB   ASP D 217    -47.543  80.073  57.971  1.00  24.77    A  C
ATOM  10206  CG   ASP D 217    -47.085  81.038  58.971  1.00  26.38    A  C
ATOM  10207  OD1  ASP D 217    -47.047  80.693  60.135  1.00  20.41    A  O
ATOM  10208  OD2  ASP D 217    -46.769  82.136  58.602  1.00  28.64    A  O-1
ATOM  10209  C    ASP D 217    -48.811  77.968  57.774  1.00  26.45    A  C
ATOM  10210  O    ASP D 217    -49.925  77.950  58.189  1.00  27.56    A  O
ATOM  10211  N    ARG D 218    -48.489  77.369  56.653  1.00  25.88    A  N
ATOM  10212  CA   ARG D 218    -49.436  76.560  55.950  1.00  26.73    A  C
ATOM  10213  CB   ARG D 218    -48.921  76.244  54.546  1.00  27.35    A  C
```

Appendix 1

```
ATOM  10214  CG   ARG D 218     -49.352  74.948  53.974  1.00  30.30    A  C
ATOM  10215  CD   ARG D 218     -50.630  74.991  53.170  1.00  36.46    A  C
ATOM  10216  NE   ARG D 218     -50.631  73.870  52.242  1.00  46.65    A  N
ATOM  10217  CZ   ARG D 218     -51.404  72.810  52.346  1.00  47.42    A  C
ATOM  10218  NH1  ARG D 218     -52.270  72.739  53.324  1.00  51.64    A  N
ATOM  10219  NH2  ARG D 218     -51.310  71.834  51.473  1.00  44.83    A  N
ATOM  10220  C    ARG D 218     -49.908  75.310  56.690  1.00  27.57    A  C
ATOM  10221  O    ARG D 218     -51.062  74.959  56.638  1.00  27.27    A  O
ATOM  10222  N    LEU D 219     -48.989  74.633  57.348  1.00  26.06    A  N
ATOM  10223  CA   LEU D 219     -49.295  73.486  58.140  1.00  24.58    A  C
ATOM  10224  CB   LEU D 219     -48.036  72.762  58.548  1.00  23.61    A  C
ATOM  10225  CG   LEU D 219     -47.181  72.073  57.492  1.00  25.10    A  C
ATOM  10226  CD1  LEU D 219     -45.760  71.904  57.901  1.00  14.69    A  C
ATOM  10227  CD2  LEU D 219     -47.761  70.787  57.050  1.00  21.64    A  C
ATOM  10228  C    LEU D 219     -50.146  73.777  59.341  1.00  25.36    A  C
ATOM  10229  O    LEU D 219     -50.946  72.990  59.712  1.00  24.88    A  O
ATOM  10230  N    HIS D 220     -49.937  74.904  59.972  1.00  26.32    A  N
ATOM  10231  CA   HIS D 220     -50.605  75.187  61.212  1.00  27.40    A  C
ATOM  10232  CB   HIS D 220     -49.590  75.253  62.327  1.00  27.49    A  C
ATOM  10233  CG   HIS D 220     -48.764  74.031  62.416  1.00  29.69    A  C
ATOM  10234  ND1  HIS D 220     -49.200  72.888  63.019  1.00  31.45    A  N
ATOM  10235  CE1  HIS D 220     -48.293  71.954  62.891  1.00  31.25    A  C
ATOM  10236  NE2  HIS D 220     -47.285  72.458  62.226  1.00  30.95    A  N
ATOM  10237  CD2  HIS D 220     -47.565  73.744  61.897  1.00  26.65    A  C
ATOM  10238  C    HIS D 220     -51.538  76.352  61.292  1.00  27.64    A  C
ATOM  10239  O    HIS D 220     -52.142  76.546  62.290  1.00  27.39    A  O
ATOM  10240  N    GLY D 221     -51.647  77.136  60.246  1.00  27.87    A  N
ATOM  10241  CA   GLY D 221     -52.550  78.257  60.271  1.00  28.84    A  C
ATOM  10242  C    GLY D 221     -52.083  79.481  60.997  1.00  29.96    A  C
ATOM  10243  O    GLY D 221     -52.837  80.328  61.321  1.00  31.20    A  O
ATOM  10244  N    THR D 222     -50.796  79.568  61.199  1.00  29.08    A  N
ATOM  10245  CA   THR D 222     -50.167  80.624  61.937  1.00  27.82    A  C
ATOM  10246  CB   THR D 222     -48.956  80.074  62.707  1.00  26.82    A  C
ATOM  10247  OG1  THR D 222     -48.305  79.099  61.920  1.00  25.58    A  O
ATOM  10248  CG2  THR D 222     -49.394  79.413  63.925  1.00  23.59    A  C
ATOM  10249  C    THR D 222     -49.813  81.800  61.046  1.00  28.13    A  C
ATOM  10250  O    THR D 222     -50.044  81.757  59.885  1.00  28.28    A  O
ATOM  10251  N    ASP D 223     -49.223  82.831  61.621  1.00  28.44    A  N
ATOM  10252  CA   ASP D 223     -48.871  84.080  60.961  1.00  30.29    A  C
ATOM  10253  CB   ASP D 223     -49.745  85.206  61.476  1.00  32.10    A  C
ATOM  10254  CG   ASP D 223     -49.737  86.437  60.592  1.00  39.15    A  C
ATOM  10255  OD1  ASP D 223     -49.579  86.354  59.381  1.00  48.43    A  O
ATOM  10256  OD2  ASP D 223     -49.931  87.523  61.122  1.00  46.40    A  O-1
ATOM  10257  C    ASP D 223     -47.429  84.490  61.130  1.00  29.16    A  C
ATOM  10258  O    ASP D 223     -47.153  85.624  61.280  1.00  28.69    A  O
ATOM  10259  N    TYR D 224     -46.515  83.551  61.050  1.00  28.66    A  N
ATOM  10260  CA   TYR D 224     -45.103  83.766  61.336  1.00  28.67    A  C
ATOM  10261  CB   TYR D 224     -44.379  82.437  61.624  1.00  27.42    A  C
ATOM  10262  CG   TYR D 224     -44.614  81.835  63.000  1.00  26.88    A  C
ATOM  10263  CD1  TYR D 224     -44.074  82.387  64.108  1.00  26.20    A  C
ATOM  10264  CE1  TYR D 224     -44.265  81.864  65.331  1.00  24.97    A  C
ATOM  10265  CZ   TYR D 224     -44.994  80.753  65.465  1.00  28.75    A  C
ATOM  10266  OH   TYR D 224     -45.203  80.214  66.671  1.00  27.90    A  O
ATOM  10267  CE2  TYR D 224     -45.521  80.164  64.387  1.00  24.00    A  C
```

Appendix 1

```
ATOM  10268  CD2  TYR  D  224   -45.336  80.692  63.174  1.00  26.38   A  C
ATOM  10269  C    TYR  D  224   -44.304  84.742  60.433  1.00  28.84   A  C
ATOM  10270  O    TYR  D  224   -43.284  85.195  60.825  1.00  28.53   A  O
ATOM  10271  N    ARG  D  225   -44.822  85.117  59.279  1.00  30.79   A  N
ATOM  10272  CA   ARG  D  225   -44.387  86.291  58.480  1.00  31.98   A  C
ATOM  10273  CB   ARG  D  225   -44.740  85.969  57.074  1.00  30.99   A  C
ATOM  10274  CG   ARG  D  225   -45.326  84.585  57.019  1.00  32.17   A  C
ATOM  10275  CD   ARG  D  225   -46.356  84.401  55.932  1.00  31.91   A  C
ATOM  10276  NE   ARG  D  225   -47.724  84.461  56.395  1.00  32.72   A  N
ATOM  10277  CZ   ARG  D  225   -48.706  83.707  55.948  1.00  34.41   A  C
ATOM  10278  NH1  ARG  D  225   -48.477  82.833  55.031  1.00  36.66   A  N
ATOM  10279  NH2  ARG  D  225   -49.912  83.817  56.429  1.00  32.57   A  N
ATOM  10280  C    ARG  D  225   -44.969  87.703  58.842  1.00  33.56   A  C
ATOM  10281  O    ARG  D  225   -46.122  87.792  59.125  1.00  35.34   A  O
ATOM  10282  N    ALA  D  226   -44.262  88.828  58.743  1.00  32.55   A  N
ATOM  10283  CA   ALA  D  226   -42.867  89.140  59.046  1.00  30.84   A  C
ATOM  10284  CB   ALA  D  226   -42.424  88.419  60.220  1.00  29.27   A  C
ATOM  10285  C    ALA  D  226   -41.807  89.072  57.953  1.00  29.61   A  C
ATOM  10286  O    ALA  D  226   -40.747  89.605  58.080  1.00  27.88   A  O
ATOM  10287  N    ALA  D  227   -42.136  88.453  56.853  1.00  29.21   A  N
ATOM  10288  CA   ALA  D  227   -41.294  88.503  55.724  1.00  29.54   A  C
ATOM  10289  CB   ALA  D  227   -41.794  87.607  54.677  1.00  27.31   A  C
ATOM  10290  C    ALA  D  227   -41.233  89.940  55.268  1.00  29.92   A  C
ATOM  10291  O    ALA  D  227   -40.288  90.351  54.708  1.00  30.98   A  O
ATOM  10292  N    THR  D  228   -42.312  90.661  55.440  1.00  32.35   A  N
ATOM  10293  CA   THR  D  228   -42.454  91.957  54.845  1.00  35.56   A  C
ATOM  10294  CB   THR  D  228   -43.692  92.645  55.332  1.00  35.53   A  C
ATOM  10295  OG1  THR  D  228   -44.833  91.839  55.079  1.00  38.93   A  O
ATOM  10296  CG2  THR  D  228   -43.844  93.975  54.653  1.00  36.97   A  C
ATOM  10297  C    THR  D  228   -41.434  92.748  55.471  1.00  36.54   A  C
ATOM  10298  O    THR  D  228   -40.772  93.571  54.891  1.00  36.57   A  O
ATOM  10299  N    ARG  D  229   -41.362  92.402  56.718  1.00  38.58   A  N
ATOM  10300  CA   ARG  D  229   -41.462  93.264  57.806  1.00  40.31   A  C
ATOM  10301  CB   ARG  D  229   -41.922  92.522  59.032  1.00  40.89   A  C
ATOM  10302  CG   ARG  D  229   -43.394  92.488  59.087  1.00  44.47   A  C
ATOM  10303  CD   ARG  D  229   -43.896  93.850  59.462  1.00  54.40   A  C
ATOM  10304  NE   ARG  D  229   -45.338  94.008  59.346  1.00  59.49   A  N
ATOM  10305  CZ   ARG  D  229   -46.239  93.514  60.184  1.00  62.74   A  C
ATOM  10306  NH1  ARG  D  229   -45.878  92.793  61.225  1.00  62.66   A  N
ATOM  10307  NH2  ARG  D  229   -47.522  93.743  59.973  1.00  65.18   A  N
ATOM  10308  C    ARG  D  229   -40.082  93.662  57.821  1.00  39.16   A  C
ATOM  10309  O    ARG  D  229   -39.422  93.736  58.819  1.00  37.62   A  O
ATOM  10310  N    ALA  D  230   -39.711  93.910  56.598  1.00  37.68   A  N
ATOM  10311  CA   ALA  D  230   -38.553  94.636  56.299  1.00  37.16   A  C
ATOM  10312  CB   ALA  D  230   -38.182  95.565  57.397  1.00  38.40   A  C
ATOM  10313  C    ALA  D  230   -37.552  93.659  56.152  1.00  35.06   A  C
ATOM  10314  O    ALA  D  230   -36.447  94.013  55.848  1.00  38.27   A  O
ATOM  10315  N    TRP  D  231   -37.876  92.406  56.283  1.00  31.74   A  N
ATOM  10316  CA   TRP  D  231   -36.804  91.606  55.868  1.00  30.47   A  C
ATOM  10317  CB   TRP  D  231   -37.029  90.125  56.052  1.00  30.96   A  C
ATOM  10318  CG   TRP  D  231   -35.918  89.435  55.470  1.00  27.52   A  C
ATOM  10319  CD1  TRP  D  231   -34.672  89.532  55.852  1.00  28.41   A  C
ATOM  10320  NE1  TRP  D  231   -33.877  88.798  55.073  1.00  26.22   A  N
ATOM  10321  CE2  TRP  D  231   -34.620  88.219  54.105  1.00  25.14   A  C
```

Appendix 1

```
ATOM  10322  CD2 TRP D 231     -35.921  88.611  54.320  1.00 24.74     A    C
ATOM  10323  CE3 TRP D 231     -36.901  88.139  53.468  1.00 22.79     A    C
ATOM  10324  CZ3 TRP D 231     -36.540  87.333  52.467  1.00 20.19     A    C
ATOM  10325  CH2 TRP D 231     -35.237  86.953  52.280  1.00 23.20     A    C
ATOM  10326  CZ2 TRP D 231     -34.261  87.388  53.083  1.00 23.80     A    C
ATOM  10327  C   TRP D 231     -36.683  91.963  54.411  1.00 30.63     A    C
ATOM  10328  O   TRP D 231     -35.647  92.256  53.935  1.00 29.27     A    O
ATOM  10329  N   LEU D 232     -37.782  91.914  53.701  1.00 31.23     A    N
ATOM  10330  CA  LEU D 232     -37.816  92.366  52.345  1.00 32.77     A    C
ATOM  10331  CB  LEU D 232     -39.062  91.903  51.651  1.00 32.90     A    C
ATOM  10332  CG  LEU D 232     -39.214  90.410  51.568  1.00 29.88     A    C
ATOM  10333  CD1 LEU D 232     -40.594  90.120  51.326  1.00 28.41     A    C
ATOM  10334  CD2 LEU D 232     -38.383  89.875  50.512  1.00 29.23     A    C
ATOM  10335  C   LEU D 232     -37.611  93.850  52.219  1.00 34.29     A    C
ATOM  10336  O   LEU D 232     -36.982  94.297  51.318  1.00 34.50     A    O
ATOM  10337  N   ASP D 233     -38.161  94.623  53.122  1.00 35.60     A    N
ATOM  10338  CA  ASP D 233     -37.813  96.014  53.156  1.00 38.27     A    C
ATOM  10339  CB  ASP D 233     -38.554  96.724  54.270  1.00 38.11     A    C
ATOM  10340  CG  ASP D 233     -39.967  96.943  53.976  1.00 43.16     A    C
ATOM  10341  OD1 ASP D 233     -40.301  96.975  52.809  1.00 42.90     A    O
ATOM  10342  OD2 ASP D 233     -40.762  97.078  54.914  1.00 51.03     A    O-1
ATOM  10343  C   ASP D 233     -36.344  96.178  53.464  1.00 38.22     A    C
ATOM  10344  O   ASP D 233     -35.663  96.931  52.821  1.00 38.71     A    O
ATOM  10345  N   PHE D 234     -35.855  95.478  54.466  1.00 37.70     A    N
ATOM  10346  CA  PHE D 234     -34.493  95.637  54.855  1.00 39.24     A    C
ATOM  10347  CB  PHE D 234     -34.240  94.818  56.106  1.00 38.24     A    C
ATOM  10348  CG  PHE D 234     -32.803  94.671  56.451  1.00 39.92     A    C
ATOM  10349  CD1 PHE D 234     -32.113  95.680  57.025  1.00 39.66     A    C
ATOM  10350  CE1 PHE D 234     -30.824  95.525  57.336  1.00 38.47     A    C
ATOM  10351  CZ  PHE D 234     -30.213  94.382  57.108  1.00 37.15     A    C
ATOM  10352  CE2 PHE D 234     -30.862  93.384  56.550  1.00 34.92     A    C
ATOM  10353  CD2 PHE D 234     -32.150  93.511  56.230  1.00 37.15     A    C
ATOM  10354  C   PHE D 234     -33.484  95.256  53.792  1.00 40.29     A    C
ATOM  10355  O   PHE D 234     -32.579  95.975  53.545  1.00 41.67     A    O
ATOM  10356  N   ILE D 235     -33.638  94.126  53.147  1.00 40.49     A    N
ATOM  10357  CA  ILE D 235     -32.618  93.667  52.241  1.00 41.29     A    C
ATOM  10358  CB  ILE D 235     -32.719  92.177  51.913  1.00 41.79     A    C
ATOM  10359  CG1 ILE D 235     -33.862  91.896  50.955  1.00 40.90     A    C
ATOM  10360  CD1 ILE D 235     -34.094  90.479  50.712  1.00 40.96     A    C
ATOM  10361  CG2 ILE D 235     -32.875  91.385  53.139  1.00 38.66     A    C
ATOM  10362  C   ILE D 235     -32.596  94.509  51.002  1.00 42.97     A    C
ATOM  10363  O   ILE D 235     -31.674  94.467  50.244  1.00 42.15     A    O
ATOM  10364  N   GLN D 236     -33.615  95.319  50.843  1.00 44.01     A    N
ATOM  10365  CA  GLN D 236     -33.707  96.140  49.687  1.00 46.52     A    C
ATOM  10366  CB  GLN D 236     -35.122  96.311  49.280  1.00 46.29     A    C
ATOM  10367  CG  GLN D 236     -35.500  95.395  48.237  1.00 48.77     A    C
ATOM  10368  CD  GLN D 236     -36.675  95.877  47.529  1.00 51.86     A    C
ATOM  10369  OE1 GLN D 236     -37.745  95.938  48.095  1.00 51.59     A    O
ATOM  10370  NE2 GLN D 236     -36.500  96.233  46.273  1.00 50.46     A    N
ATOM  10371  C   GLN D 236     -33.053  97.465  49.857  1.00 48.95     A    C
ATOM  10372  O   GLN D 236     -33.060  98.258  48.968  1.00 49.20     A    O
ATOM  10373  N   LYS D 237     -32.487  97.694  51.022  1.00 51.38     A    N
ATOM  10374  CA  LYS D 237     -31.646  98.828  51.248  1.00 52.99     A    C
ATOM  10375  CB  LYS D 237     -32.140  99.598  52.452  1.00 53.95     A    C
```

Appendix 1

```
ATOM  10376  CG   LYS D 237     -33.644  99.769  52.518  1.00 58.47      A    C
ATOM  10377  CD   LYS D 237     -34.095 100.207  53.898  1.00 62.07      A    C
ATOM  10378  CE   LYS D 237     -35.531 100.717  53.922  1.00 65.69      A    C
ATOM  10379  NZ   LYS D 237     -36.529 100.051  53.041  1.00 64.43      A    N
ATOM  10380  C    LYS D 237     -30.243  98.357  51.517  1.00 53.34      A    C
ATOM  10381  O    LYS D 237     -29.977  97.677  52.479  1.00 54.67      A    O
ATOM  10382  N    ASP D 238     -29.343  98.656  50.615  1.00 51.97      A    N
ATOM  10383  CA   ASP D 238     -27.933  98.631  50.918  1.00 50.98      A    C
ATOM  10384  CB   ASP D 238     -27.703  99.116  52.335  1.00 51.63      A    C
ATOM  10385  CG   ASP D 238     -26.870 100.373  52.404  1.00 53.32      A    C
ATOM  10386  OD1  ASP D 238     -25.856 100.347  53.086  1.00 55.43      A    O
ATOM  10387  OD2  ASP D 238     -27.237 101.396  51.829  1.00 51.79      A    O-1
ATOM  10388  C    ASP D 238     -27.370  97.248  50.783  1.00 48.66      A    C
ATOM  10389  O    ASP D 238     -26.199  97.079  50.608  1.00 49.12      A    O
ATOM  10390  N    LEU D 239     -28.227  96.255  50.879  1.00 45.49      A    N
ATOM  10391  CA   LEU D 239     -27.814  94.903  50.646  1.00 41.53      A    C
ATOM  10392  CB   LEU D 239     -28.678  93.960  51.449  1.00 39.96      A    C
ATOM  10393  CG   LEU D 239     -27.994  93.052  52.441  1.00 36.86      A    C
ATOM  10394  CD1  LEU D 239     -26.702  93.570  52.846  1.00 31.96      A    C
ATOM  10395  CD2  LEU D 239     -28.840  92.856  53.585  1.00 30.53      A    C
ATOM  10396  C    LEU D 239     -27.908  94.572  49.190  1.00 40.64      A    C
ATOM  10397  O    LEU D 239     -27.387  93.605  48.755  1.00 39.15      A    O
ATOM  10398  N    ILE D 240     -28.583  95.405  48.438  1.00 39.99      A    N
ATOM  10399  CA   ILE D 240     -28.804  95.126  47.057  1.00 40.12      A    C
ATOM  10400  CB   ILE D 240     -30.261  94.742  46.827  1.00 40.45      A    C
ATOM  10401  CG1  ILE D 240     -30.386  93.951  45.558  1.00 39.27      A    C
ATOM  10402  CD1  ILE D 240     -31.698  93.947  45.021  1.00 43.06      A    C
ATOM  10403  CG2  ILE D 240     -31.134  95.931  46.768  1.00 39.57      A    C
ATOM  10404  C    ILE D 240     -28.450  96.283  46.176  1.00 40.38      A    C
ATOM  10405  O    ILE D 240     -28.512  97.380  46.596  1.00 39.72      A    O
ATOM  10406  N    ASP D 241     -28.063  96.021  44.944  1.00 40.77      A    N
ATOM  10407  CA   ASP D 241     -27.956  97.056  43.940  1.00 40.98      A    C
ATOM  10408  CB   ASP D 241     -26.732  96.781  43.089  1.00 40.55      A    C
ATOM  10409  CG   ASP D 241     -26.379  97.907  42.178  1.00 42.77      A    C
ATOM  10410  OD1  ASP D 241     -27.248  98.681  41.800  1.00 40.95      A    O
ATOM  10411  OD2  ASP D 241     -25.210  98.013  41.830  1.00 42.23      A    O-1
ATOM  10412  C    ASP D 241     -29.222  96.948  43.110  1.00 41.26      A    C
ATOM  10413  O    ASP D 241     -29.406  96.005  42.428  1.00 40.47      A    O
ATOM  10414  N    PRO D 242     -30.123  97.898  43.223  1.00 41.90      A    N
ATOM  10415  CA   PRO D 242     -31.402  97.866  42.516  1.00 42.60      A    C
ATOM  10416  CB   PRO D 242     -32.099  99.103  43.050  1.00 42.74      A    C
ATOM  10417  CG   PRO D 242     -31.320  99.540  44.158  1.00 42.86      A    C
ATOM  10418  CD   PRO D 242     -29.949  99.167  43.904  1.00 41.35      A    C
ATOM  10419  C    PRO D 242     -31.322  97.949  40.995  1.00 42.96      A    C
ATOM  10420  O    PRO D 242     -32.033  97.314  40.259  1.00 43.18      A    O
ATOM  10421  N    GLU D 243     -30.429  98.798  40.553  1.00 43.00      A    N
ATOM  10422  CA   GLU D 243     -30.151  98.979  39.182  1.00 43.09      A    C
ATOM  10423  CB   GLU D 243     -29.179 100.125  39.030  1.00 43.92      A    C
ATOM  10424  CG   GLU D 243     -29.821 101.452  39.054  1.00 48.79      A    C
ATOM  10425  CD   GLU D 243     -30.534 101.755  37.780  1.00 59.02      A    C
ATOM  10426  OE1  GLU D 243     -30.084 101.313  36.714  1.00 60.70      A    O
ATOM  10427  OE2  GLU D 243     -31.559 102.436  37.835  1.00 61.09      A    O-1
ATOM  10428  C    GLU D 243     -29.597  97.714  38.584  1.00 42.05      A    C
ATOM  10429  O    GLU D 243     -29.889  97.380  37.467  1.00 42.47      A    O
```

Appendix 1

```
ATOM  10430  N    ARG D 244   -28.779  96.993  39.304  1.00  39.75     A  N
ATOM  10431  CA   ARG D 244   -28.325  95.755  38.742  1.00  38.23     A  C
ATOM  10432  CB   ARG D 244   -26.867  95.580  39.028  1.00  37.39     A  C
ATOM  10433  CG   ARG D 244   -26.119  96.712  38.517  1.00  37.65     A  C
ATOM  10434  CD   ARG D 244   -24.672  96.483  38.564  1.00  41.56     A  C
ATOM  10435  NE   ARG D 244   -24.186  96.695  39.896  1.00  45.44     A  N
ATOM  10436  CZ   ARG D 244   -22.922  96.854  40.201  1.00  48.79     A  C
ATOM  10437  NH1  ARG D 244   -22.024  96.842  39.251  1.00  50.20     A  N
ATOM  10438  NH2  ARG D 244   -22.564  97.028  41.452  1.00  43.65     A  N
ATOM  10439  C    ARG D 244   -29.108  94.515  39.112  1.00  37.33     A  C
ATOM  10440  O    ARG D 244   -28.884  93.497  38.570  1.00  37.47     A  O
ATOM  10441  N    GLY D 245   -30.040  94.608  40.025  1.00  36.29     A  N
ATOM  10442  CA   GLY D 245   -30.728  93.437  40.503  1.00  36.26     A  C
ATOM  10443  C    GLY D 245   -29.859  92.391  41.145  1.00  35.84     A  C
ATOM  10444  O    GLY D 245   -30.051  91.232  40.952  1.00  37.27     A  O
ATOM  10445  N    ALA D 246   -28.900  92.819  41.933  1.00  33.89     A  N
ATOM  10446  CA   ALA D 246   -27.924  91.925  42.468  1.00  32.55     A  C
ATOM  10447  CB   ALA D 246   -26.701  92.062  41.681  1.00  32.78     A  C
ATOM  10448  C    ALA D 246   -27.645  92.170  43.929  1.00  31.44     A  C
ATOM  10449  O    ALA D 246   -27.686  93.261  44.365  1.00  33.27     A  O
ATOM  10450  N    PHE D 247   -27.381  91.135  44.686  1.00  29.07     A  N
ATOM  10451  CA   PHE D 247   -27.139  91.304  46.095  1.00  26.34     A  C
ATOM  10452  CB   PHE D 247   -27.793  90.205  46.923  1.00  25.32     A  C
ATOM  10453  CG   PHE D 247   -29.262  90.345  47.113  1.00  21.97     A  C
ATOM  10454  CD1  PHE D 247   -29.773  91.264  47.942  1.00  21.41     A  C
ATOM  10455  CE1  PHE D 247   -31.098  91.352  48.119  1.00  22.81     A  C
ATOM  10456  CZ   PHE D 247   -31.932  90.524  47.478  1.00  21.98     A  C
ATOM  10457  CE2  PHE D 247   -31.444  89.597  46.664  1.00  23.54     A  C
ATOM  10458  CD2  PHE D 247   -30.128  89.494  46.488  1.00  24.50     A  C
ATOM  10459  C    PHE D 247   -25.663  91.285  46.359  1.00  26.47     A  C
ATOM  10460  O    PHE D 247   -24.931  90.579  45.762  1.00  25.48     A  O
ATOM  10461  N    TYR D 248   -25.241  92.100  47.287  1.00  27.35     A  N
ATOM  10462  CA   TYR D 248   -23.890  92.093  47.774  1.00  28.46     A  C
ATOM  10463  CB   TYR D 248   -23.596  93.372  48.533  1.00  27.71     A  C
ATOM  10464  CG   TYR D 248   -23.578  94.581  47.685  1.00  28.01     A  C
ATOM  10465  CD1  TYR D 248   -22.473  94.930  47.001  1.00  28.72     A  C
ATOM  10466  CE1  TYR D 248   -22.448  96.003  46.235  1.00  28.85     A  C
ATOM  10467  CZ   TYR D 248   -23.538  96.778  46.127  1.00  32.52     A  C
ATOM  10468  OH   TYR D 248   -23.510  97.868  45.332  1.00  33.94     A  O
ATOM  10469  CE2  TYR D 248   -24.656  96.465  46.804  1.00  31.82     A  C
ATOM  10470  CD2  TYR D 248   -24.669  95.379  47.582  1.00  33.10     A  C
ATOM  10471  C    TYR D 248   -23.677  90.857  48.622  1.00  28.98     A  C
ATOM  10472  O    TYR D 248   -24.596  90.316  49.139  1.00  29.70     A  O
ATOM  10473  N    LEU D 249   -22.449  90.418  48.743  1.00  30.15     A  N
ATOM  10474  CA   LEU D 249   -22.110  89.141  49.304  1.00  31.34     A  C
ATOM  10475  CB   LEU D 249   -20.611  89.037  49.253  1.00  31.37     A  C
ATOM  10476  CG   LEU D 249   -19.875  87.725  49.108  1.00  35.51     A  C
ATOM  10477  CD1  LEU D 249   -20.319  86.995  47.907  1.00  33.22     A  C
ATOM  10478  CD2  LEU D 249   -18.405  87.999  49.035  1.00  36.78     A  C
ATOM  10479  C    LEU D 249   -22.508  88.897  50.738  1.00  31.44     A  C
ATOM  10480  O    LEU D 249   -23.033  87.866  51.063  1.00  34.90     A  O
ATOM  10481  N    SER D 250   -22.250  89.834  51.605  1.00  30.71     A  N
ATOM  10482  CA   SER D 250   -22.631  89.668  52.969  1.00  30.68     A  C
ATOM  10483  CB   SER D 250   -21.627  88.836  53.718  1.00  30.92     A  C
```

Appendix 1

```
ATOM  10484  OG   SER D 250     -20.368  88.952  53.153  1.00 32.83      A  O
ATOM  10485  C    SER D 250     -22.748  90.977  53.633  1.00 31.01      A  C
ATOM  10486  O    SER D 250     -22.258  91.954  53.163  1.00 32.38      A  O
ATOM  10487  N    TYR D 251     -23.394  90.972  54.766  1.00 30.94      A  N
ATOM  10488  CA   TYR D 251     -23.541  92.145  55.549  1.00 30.82      A  C
ATOM  10489  CB   TYR D 251     -24.991  92.454  55.634  1.00 30.62      A  C
ATOM  10490  CG   TYR D 251     -25.334  93.387  56.700  1.00 33.19      A  C
ATOM  10491  CD1  TYR D 251     -24.870  94.663  56.687  1.00 36.80      A  C
ATOM  10492  CE1  TYR D 251     -25.192  95.509  57.645  1.00 39.82      A  C
ATOM  10493  CZ   TYR D 251     -25.989  95.094  58.648  1.00 44.59      A  C
ATOM  10494  OH   TYR D 251     -26.350  95.929  59.642  1.00 47.95      A  O
ATOM  10495  CE2  TYR D 251     -26.451  93.836  58.679  1.00 42.43      A  C
ATOM  10496  CD2  TYR D 251     -26.124  93.000  57.716  1.00 35.42      A  C
ATOM  10497  C    TYR D 251     -23.019  91.817  56.904  1.00 31.77      A  C
ATOM  10498  O    TYR D 251     -23.209  90.738  57.346  1.00 28.96      A  O
ATOM  10499  N    HIS D 252     -22.324  92.739  57.546  1.00 33.61      A  N
ATOM  10500  CA   HIS D 252     -21.806  92.496  58.893  1.00 35.64      A  C
ATOM  10501  CB   HIS D 252     -20.306  92.342  58.796  1.00 33.33      A  C
ATOM  10502  CG   HIS D 252     -19.908  91.282  57.843  1.00 31.96      A  C
ATOM  10503  ND1  HIS D 252     -19.805  91.494  56.496  1.00 28.72      A  N
ATOM  10504  CE1  HIS D 252     -19.496  90.371  55.906  1.00 27.13      A  C
ATOM  10505  NE2  HIS D 252     -19.420  89.434  56.817  1.00 26.93      A  N
ATOM  10506  CD2  HIS D 252     -19.689  89.974  58.033  1.00 28.55      A  C
ATOM  10507  C    HIS D 252     -22.196  93.523  59.949  1.00 37.69      A  C
ATOM  10508  O    HIS D 252     -21.698  94.600  59.999  1.00 37.73      A  O
ATOM  10509  N    PRO D 253     -23.112  93.161  60.810  1.00 40.10      A  N
ATOM  10510  CA   PRO D 253     -23.805  94.132  61.635  1.00 41.98      A  C
ATOM  10511  CB   PRO D 253     -24.877  93.293  62.303  1.00 41.63      A  C
ATOM  10512  CG   PRO D 253     -24.903  92.079  61.618  1.00 40.27      A  C
ATOM  10513  CD   PRO D 253     -23.593  91.820  61.097  1.00 39.24      A  C
ATOM  10514  C    PRO D 253     -23.006  94.963  62.650  1.00 43.39      A  C
ATOM  10515  O    PRO D 253     -23.348  96.113  62.758  1.00 44.06      A  O
ATOM  10516  N    GLU D 254     -22.043  94.425  63.389  1.00 44.77      A  N
ATOM  10517  CA   GLU D 254     -21.222  95.241  64.285  1.00 45.57      A  C
ATOM  10518  CB   GLU D 254     -20.361  94.379  65.189  1.00 45.83      A  C
ATOM  10519  CG   GLU D 254     -19.105  95.064  65.619  1.00 51.35      A  C
ATOM  10520  CD   GLU D 254     -18.935  95.149  67.095  1.00 55.99      A  C
ATOM  10521  OE1  GLU D 254     -19.367  94.241  67.796  1.00 56.72      A  O
ATOM  10522  OE2  GLU D 254     -18.355  96.122  67.561  1.00 57.70      A  O-1
ATOM  10523  C    GLU D 254     -20.347  96.242  63.584  1.00 44.78      A  C
ATOM  10524  O    GLU D 254     -20.276  97.379  63.964  1.00 44.84      A  O
ATOM  10525  N    SER D 255     -19.680  95.811  62.544  1.00 43.80      A  N
ATOM  10526  CA   SER D 255     -18.897  96.686  61.724  1.00 42.44      A  C
ATOM  10527  CB   SER D 255     -18.078  95.900  60.717  1.00 41.54      A  C
ATOM  10528  OG   SER D 255     -18.028  94.539  61.062  1.00 44.72      A  O
ATOM  10529  C    SER D 255     -19.971  97.362  61.018  1.00 41.90      A  C
ATOM  10530  O    SER D 255     -21.082  96.985  61.153  1.00 43.44      A  O
ATOM  10531  N    GLY D 256     -19.678  98.362  60.241  1.00 40.44      A  N
ATOM  10532  CA   GLY D 256     -20.703  98.850  59.362  1.00 40.83      A  C
ATOM  10533  C    GLY D 256     -21.202  97.871  58.300  1.00 39.80      A  C
ATOM  10534  O    GLY D 256     -22.362  97.819  58.019  1.00 40.06      A  O
ATOM  10535  N    ALA D 257     -20.297  97.059  57.789  1.00 36.82      A  N
ATOM  10536  CA   ALA D 257     -20.096  96.694  56.411  1.00 35.07      A  C
ATOM  10537  CB   ALA D 257     -18.693  96.226  56.234  1.00 34.10      A  C
```

Appendix 1

```
ATOM  10538  C    ALA D 257     -21.021  95.792  55.598  1.00  34.46    A    C
ATOM  10539  O    ALA D 257     -21.545  94.815  56.061  1.00  33.55    A    O
ATOM  10540  N    VAL D 258     -21.126  96.164  54.342  1.00  31.98    A    N
ATOM  10541  CA   VAL D 258     -21.592  95.324  53.294  1.00  31.35    A    C
ATOM  10542  CB   VAL D 258     -22.601  96.060  52.452  1.00  31.59    A    C
ATOM  10543  CG1  VAL D 258     -23.245  95.173  51.512  1.00  28.42    A    C
ATOM  10544  CG2  VAL D 258     -23.606  96.658  53.282  1.00  31.40    A    C
ATOM  10545  C    VAL D 258     -20.361  95.113  52.480  1.00  31.52    A    C
ATOM  10546  O    VAL D 258     -19.729  96.058  52.148  1.00  31.13    A    O
ATOM  10547  N    LYS D 259     -19.984  93.873  52.205  1.00  31.86    A    N
ATOM  10548  CA   LYS D 259     -18.849  93.593  51.315  1.00  32.23    A    C
ATOM  10549  CB   LYS D 259     -18.485  92.126  51.263  1.00  31.08    A    C
ATOM  10550  CG   LYS D 259     -18.084  91.550  52.518  1.00  32.81    A    C
ATOM  10551  CD   LYS D 259     -17.215  90.361  52.348  1.00  34.87    A    C
ATOM  10552  CE   LYS D 259     -16.662  89.919  53.668  1.00  37.75    A    C
ATOM  10553  NZ   LYS D 259     -16.675  88.493  53.843  1.00  40.78    A    N
ATOM  10554  C    LYS D 259     -19.216  94.031  49.946  1.00  32.31    A    C
ATOM  10555  O    LYS D 259     -20.292  93.821  49.502  1.00  33.08    A    O
ATOM  10556  N    PRO D 260     -18.266  94.577  49.250  1.00  32.08    A    N
ATOM  10557  CA   PRO D 260     -18.483  95.453  48.127  1.00  32.47    A    C
ATOM  10558  CB   PRO D 260     -17.253  96.314  48.164  1.00  31.70    A    C
ATOM  10559  CG   PRO D 260     -16.333  95.579  48.941  1.00  32.79    A    C
ATOM  10560  CD   PRO D 260     -17.080  94.974  49.978  1.00  31.71    A    C
ATOM  10561  C    PRO D 260     -18.625  94.745  46.801  1.00  32.83    A    C
ATOM  10562  O    PRO D 260     -18.634  95.383  45.803  1.00  35.06    A    O
ATOM  10563  N    TRP D 261     -18.785  93.446  46.822  1.00  32.84    A    N
ATOM  10564  CA   TRP D 261     -18.914  92.657  45.640  1.00  32.08    A    C
ATOM  10565  CB   TRP D 261     -17.906  91.522  45.683  1.00  31.31    A    C
ATOM  10566  CG   TRP D 261     -16.515  91.997  45.760  1.00  30.31    A    C
ATOM  10567  CD1  TRP D 261     -15.767  92.394  44.753  1.00  31.77    A    C
ATOM  10568  NE1  TRP D 261     -14.560  92.796  45.173  1.00  30.93    A    N
ATOM  10569  CE2  TRP D 261     -14.497  92.633  46.518  1.00  30.16    A    C
ATOM  10570  CD2  TRP D 261     -15.717  92.126  46.919  1.00  31.05    A    C
ATOM  10571  CE3  TRP D 261     -15.924  91.885  48.261  1.00  26.48    A    C
ATOM  10572  CZ3  TRP D 261     -14.928  92.114  49.112  1.00  25.04    A    C
ATOM  10573  CH2  TRP D 261     -13.726  92.613  48.692  1.00  29.83    A    C
ATOM  10574  CZ2  TRP D 261     -13.487  92.877  47.394  1.00  30.54    A    C
ATOM  10575  C    TRP D 261     -20.308  92.115  45.552  1.00  31.98    A    C
ATOM  10576  O    TRP D 261     -20.819  91.627  46.499  1.00  33.51    A    O
ATOM  10577  N    ILE D 262     -20.939  92.237  44.406  1.00  31.42    A    N
ATOM  10578  CA   ILE D 262     -22.228  91.636  44.212  1.00  29.47    A    C
ATOM  10579  CB   ILE D 262     -23.097  92.368  43.212  1.00  28.95    A    C
ATOM  10580  CG1  ILE D 262     -22.469  92.375  41.850  1.00  26.79    A    C
ATOM  10581  CD1  ILE D 262     -23.153  93.161  40.934  1.00  23.78    A    C
ATOM  10582  CG2  ILE D 262     -23.349  93.735  43.667  1.00  27.75    A    C
ATOM  10583  C    ILE D 262     -22.002  90.223  43.779  1.00  30.06    A    C
ATOM  10584  O    ILE D 262     -21.056  89.951  43.127  1.00  29.77    A    O
ATOM  10585  N    SER D 263     -22.843  89.315  44.217  1.00  28.66    A    N
ATOM  10586  CA   SER D 263     -22.650  87.935  43.871  1.00  27.91    A    C
ATOM  10587  CB   SER D 263     -22.213  87.146  45.081  1.00  28.10    A    C
ATOM  10588  OG   SER D 263     -22.804  85.911  45.092  1.00  27.61    A    O
ATOM  10589  C    SER D 263     -23.845  87.314  43.204  1.00  27.79    A    C
ATOM  10590  O    SER D 263     -24.938  87.402  43.660  1.00  27.12    A    O
ATOM  10591  N    ALA D 264     -23.604  86.724  42.062  1.00  26.50    A    N
```

Appendix 1

```
ATOM  10592  CA   ALA D 264     -24.643  86.079  41.317  1.00 25.22      A  C
ATOM  10593  CB   ALA D 264     -24.156  85.742  39.998  1.00 24.27      A  C
ATOM  10594  C    ALA D 264     -25.280  84.876  41.934  1.00 24.89      A  C
ATOM  10595  O    ALA D 264     -26.450  84.755  41.871  1.00 27.39      A  O
ATOM  10596  N    TYR D 265     -24.512  83.975  42.503  1.00 23.09      A  N
ATOM  10597  CA   TYR D 265     -25.077  82.801  43.113  1.00 24.09      A  C
ATOM  10598  CB   TYR D 265     -24.007  81.796  43.510  1.00 23.95      A  C
ATOM  10599  CG   TYR D 265     -23.666  81.680  44.966  1.00 27.89      A  C
ATOM  10600  CD1  TYR D 265     -24.255  80.749  45.762  1.00 30.05      A  C
ATOM  10601  CE1  TYR D 265     -23.937  80.640  47.035  1.00 29.09      A  C
ATOM  10602  CZ   TYR D 265     -22.987  81.436  47.555  1.00 33.74      A  C
ATOM  10603  OH   TYR D 265     -22.623  81.342  48.863  1.00 32.37      A  O
ATOM  10604  CE2  TYR D 265     -22.390  82.339  46.788  1.00 30.19      A  C
ATOM  10605  CD2  TYR D 265     -22.709  82.449  45.522  1.00 29.10      A  C
ATOM  10606  C    TYR D 265     -25.930  83.186  44.260  1.00 24.07      A  C
ATOM  10607  O    TYR D 265     -26.943  82.648  44.477  1.00 24.77      A  O
ATOM  10608  N    THR D 266     -25.490  84.163  44.992  1.00 23.95      A  N
ATOM  10609  CA   THR D 266     -26.218  84.626  46.106  1.00 24.73      A  C
ATOM  10610  CB   THR D 266     -25.445  85.727  46.780  1.00 24.79      A  C
ATOM  10611  OG1  THR D 266     -24.261  85.211  47.317  1.00 26.61      A  O
ATOM  10612  CG2  THR D 266     -26.212  86.294  47.867  1.00 24.39      A  C
ATOM  10613  C    THR D 266     -27.549  85.199  45.700  1.00 24.58      A  C
ATOM  10614  O    THR D 266     -28.515  84.963  46.352  1.00 23.70      A  O
ATOM  10615  N    THR D 267     -27.550  86.014  44.659  1.00 24.06      A  N
ATOM  10616  CA   THR D 267     -28.748  86.568  44.083  1.00 24.09      A  C
ATOM  10617  CB   THR D 267     -28.431  87.600  43.017  1.00 24.78      A  C
ATOM  10618  OG1  THR D 267     -27.515  88.543  43.512  1.00 27.03      A  O
ATOM  10619  CG2  THR D 267     -29.604  88.314  42.652  1.00 22.50      A  C
ATOM  10620  C    THR D 267     -29.675  85.549  43.468  1.00 23.42      A  C
ATOM  10621  O    THR D 267     -30.826  85.621  43.648  1.00 23.27      A  O
ATOM  10622  N    ALA D 268     -29.148  84.613  42.720  1.00 23.49      A  N
ATOM  10623  CA   ALA D 268     -29.959  83.663  42.037  1.00 24.02      A  C
ATOM  10624  CB   ALA D 268     -29.130  82.845  41.156  1.00 23.50      A  C
ATOM  10625  C    ALA D 268     -30.721  82.795  42.975  1.00 26.08      A  C
ATOM  10626  O    ALA D 268     -31.839  82.437  42.708  1.00 26.18      A  O
ATOM  10627  N    TRP D 269     -30.071  82.402  44.056  1.00 26.74      A  N
ATOM  10628  CA   TRP D 269     -30.702  81.673  45.127  1.00 25.81      A  C
ATOM  10629  CB   TRP D 269     -29.616  81.093  46.008  1.00 27.87      A  C
ATOM  10630  CG   TRP D 269     -29.979  80.397  47.271  1.00 29.23      A  C
ATOM  10631  CD1  TRP D 269     -31.175  80.299  47.839  1.00 28.81      A  C
ATOM  10632  NE1  TRP D 269     -31.101  79.596  48.976  1.00 30.92      A  N
ATOM  10633  CE2  TRP D 269     -29.814  79.221  49.175  1.00 32.51      A  C
ATOM  10634  CD2  TRP D 269     -29.085  79.702  48.118  1.00 30.52      A  C
ATOM  10635  CE3  TRP D 269     -27.724  79.453  48.086  1.00 26.15      A  C
ATOM  10636  CZ3  TRP D 269     -27.184  78.750  49.064  1.00 25.25      A  C
ATOM  10637  CH2  TRP D 269     -27.922  78.291  50.104  1.00 27.66      A  C
ATOM  10638  CZ2  TRP D 269     -29.241  78.509  50.183  1.00 31.68      A  C
ATOM  10639  C    TRP D 269     -31.725  82.414  45.930  1.00 25.89      A  C
ATOM  10640  O    TRP D 269     -32.780  81.910  46.142  1.00 26.28      A  O
ATOM  10641  N    THR D 270     -31.428  83.616  46.372  1.00 24.83      A  N
ATOM  10642  CA   THR D 270     -32.368  84.374  47.155  1.00 23.59      A  C
ATOM  10643  CB   THR D 270     -31.784  85.698  47.535  1.00 24.93      A  C
ATOM  10644  OG1  THR D 270     -30.558  85.486  48.165  1.00 23.19      A  O
ATOM  10645  CG2  THR D 270     -32.642  86.409  48.480  1.00 23.06      A  C
```

Appendix 1

```
ATOM  10646  C    THR D 270     -33.600  84.687  46.386  1.00  23.94     A  C
ATOM  10647  O    THR D 270     -34.671  84.532  46.843  1.00  24.16     A  O
ATOM  10648  N    LEU D 271     -33.407  85.118  45.174  1.00  23.76     A  N
ATOM  10649  CA   LEU D 271     -34.472  85.470  44.306  1.00  24.78     A  C
ATOM  10650  CB   LEU D 271     -33.875  85.890  43.002  1.00  23.81     A  C
ATOM  10651  CG   LEU D 271     -34.041  87.305  42.555  1.00  27.65     A  C
ATOM  10652  CD1  LEU D 271     -33.943  88.232  43.689  1.00  25.12     A  C
ATOM  10653  CD2  LEU D 271     -33.071  87.638  41.505  1.00  22.25     A  C
ATOM  10654  C    LEU D 271     -35.351  84.290  44.062  1.00  25.10     A  C
ATOM  10655  O    LEU D 271     -36.529  84.408  43.986  1.00  25.10     A  O
ATOM  10656  N    ALA D 272     -34.775  83.129  43.920  1.00  25.39     A  N
ATOM  10657  CA   ALA D 272     -35.575  81.993  43.660  1.00  24.87     A  C
ATOM  10658  CB   ALA D 272     -34.704  80.857  43.358  1.00  25.32     A  C
ATOM  10659  C    ALA D 272     -36.500  81.658  44.785  1.00  25.55     A  C
ATOM  10660  O    ALA D 272     -37.594  81.266  44.579  1.00  25.55     A  O
ATOM  10661  N    MET D 273     -36.004  81.743  45.992  1.00  27.19     A  N
ATOM  10662  CA   MET D 273     -36.766  81.536  47.187  1.00  28.19     A  C
ATOM  10663  CB   MET D 273     -35.864  81.179  48.314  1.00  29.96     D  C
ATOM  10664  CG   MET D 273     -35.176  79.939  48.031  1.00  34.31     D  C
ATOM  10665  SD   MET D 273     -34.895  79.131  49.516  1.00  41.29     D  S
ATOM  10666  CE   MET D 273     -34.691  77.501  48.961  1.00  41.48     D  C
ATOM  10667  C    MET D 273     -37.757  82.569  47.576  1.00  28.30     A  C
ATOM  10668  O    MET D 273     -38.777  82.256  48.107  1.00  28.93     A  O
ATOM  10669  N    VAL D 274     -37.405  83.808  47.346  1.00  28.24     A  N
ATOM  10670  CA   VAL D 274     -38.270  84.921  47.582  1.00  28.79     A  C
ATOM  10671  CB   VAL D 274     -37.578  86.215  47.391  1.00  28.53     A  C
ATOM  10672  CG1  VAL D 274     -38.546  87.302  47.433  1.00  27.15     A  C
ATOM  10673  CG2  VAL D 274     -36.641  86.402  48.428  1.00  27.78     A  C
ATOM  10674  C    VAL D 274     -39.457  84.880  46.686  1.00  29.99     A  C
ATOM  10675  O    VAL D 274     -40.485  85.382  47.001  1.00  30.50     A  O
ATOM  10676  N    HIS D 275     -39.292  84.268  45.549  1.00  30.26     A  N
ATOM  10677  CA   HIS D 275     -40.348  84.147  44.604  1.00  30.03     A  C
ATOM  10678  CB   HIS D 275     -39.830  83.616  43.290  1.00  31.45     A  C
ATOM  10679  CG   HIS D 275     -40.828  83.707  42.195  1.00  30.06     A  C
ATOM  10680  ND1  HIS D 275     -41.571  82.633  41.797  1.00  26.73     A  N
ATOM  10681  CE1  HIS D 275     -42.401  83.010  40.859  1.00  23.78     A  C
ATOM  10682  NE2  HIS D 275     -42.238  84.291  40.651  1.00  25.54     A  N
ATOM  10683  CD2  HIS D 275     -41.269  84.755  41.481  1.00  25.57     A  C
ATOM  10684  C    HIS D 275     -41.494  83.341  45.161  1.00  30.53     A  C
ATOM  10685  O    HIS D 275     -42.626  83.604  44.901  1.00  29.05     A  O
ATOM  10686  N    GLY D 276     -41.172  82.387  46.001  1.00  30.65     A  N
ATOM  10687  CA   GLY D 276     -42.158  81.691  46.774  1.00  31.24     A  C
ATOM  10688  C    GLY D 276     -42.968  82.531  47.724  1.00  32.77     A  C
ATOM  10689  O    GLY D 276     -44.085  82.209  47.997  1.00  32.67     A  O
ATOM  10690  N    MET D 277     -42.402  83.597  48.254  1.00  32.75     A  N
ATOM  10691  CA   MET D 277     -43.096  84.419  49.230  1.00  33.07     A  C
ATOM  10692  CB   MET D 277     -42.179  84.664  50.422  1.00  33.26     D  C
ATOM  10693  CG   MET D 277     -41.310  83.523  50.759  1.00  30.60     D  C
ATOM  10694  SD   MET D 277     -40.312  83.755  52.187  1.00  30.73     D  S
ATOM  10695  CE   MET D 277     -38.748  83.860  51.464  1.00  16.52     D  C
ATOM  10696  C    MET D 277     -43.655  85.737  48.733  1.00  32.64     A  C
ATOM  10697  O    MET D 277     -44.704  86.133  49.092  1.00  31.38     A  O
ATOM  10698  N    ASP D 278     -42.887  86.421  47.925  1.00  33.10     A  N
ATOM  10699  CA   ASP D 278     -43.263  87.670  47.320  1.00  33.14     A  C
```

Appendix 1

```
ATOM  10700  CB   ASP D 278     -42.581  89.788  48.082  1.00 34.63      A    C
ATOM  10701  CG   ASP D 278     -42.930  90.149  47.598  1.00 38.39      A    C
ATOM  10702  OD1  ASP D 278     -43.642  90.278  46.610  1.00 44.34      A    O
ATOM  10703  OD2  ASP D 278     -42.480  91.105  48.200  1.00 43.39      A    O-1
ATOM  10704  C    ASP D 278     -42.796  87.647  45.888  1.00 32.24      A    C
ATOM  10705  O    ASP D 278     -41.739  88.075  45.598  1.00 31.91      A    O
ATOM  10706  N    PRO D 279     -43.603  87.148  44.986  1.00 31.63      A    N
ATOM  10707  CA   PRO D 279     -43.208  86.950  43.602  1.00 31.09      A    C
ATOM  10708  CB   PRO D 279     -44.447  86.318  43.005  1.00 32.34      A    C
ATOM  10709  CG   PRO D 279     -45.464  86.503  43.968  1.00 32.07      A    C
ATOM  10710  CD   PRO D 279     -44.859  86.465  45.244  1.00 30.33      A    C
ATOM  10711  C    PRO D 279     -42.832  88.184  42.830  1.00 29.79      A    C
ATOM  10712  O    PRO D 279     -42.000  88.142  42.002  1.00 30.23      A    O
ATOM  10713  N    ALA D 280     -43.478  89.273  43.123  1.00 29.88      A    N
ATOM  10714  CA   ALA D 280     -43.243  90.524  42.475  1.00 30.76      A    C
ATOM  10715  CB   ALA D 280     -44.245  91.500  42.900  1.00 30.71      A    C
ATOM  10716  C    ALA D 280     -41.846  91.059  42.684  1.00 31.52      A    C
ATOM  10717  O    ALA D 280     -41.296  91.686  41.826  1.00 32.02      A    O
ATOM  10718  N    PHE D 281     -41.286  90.793  43.844  1.00 31.22      A    N
ATOM  10719  CA   PHE D 281     -39.947  91.169  44.162  1.00 30.89      A    C
ATOM  10720  CB   PHE D 281     -39.692  90.670  45.583  1.00 32.04      A    C
ATOM  10721  CG   PHE D 281     -38.386  91.096  46.201  1.00 28.47      A    C
ATOM  10722  CD1  PHE D 281     -38.368  91.959  47.234  1.00 24.58      A    C
ATOM  10723  CE1  PHE D 281     -37.221  92.310  47.795  1.00 27.69      A    C
ATOM  10724  CZ   PHE D 281     -36.071  91.803  47.370  1.00 25.15      A    C
ATOM  10725  CE2  PHE D 281     -36.060  90.937  46.373  1.00 24.73      A    C
ATOM  10726  CD2  PHE D 281     -37.204  90.563  45.799  1.00 25.55      A    C
ATOM  10727  C    PHE D 281     -38.998  90.488  43.225  1.00 31.70      A    C
ATOM  10728  O    PHE D 281     -38.151  91.106  42.668  1.00 33.22      A    O
ATOM  10729  N    SER D 282     -39.130  89.205  43.041  1.00 30.12      A    N
ATOM  10730  CA   SER D 282     -38.290  88.513  42.109  1.00 30.81      A    C
ATOM  10731  CB   SER D 282     -38.422  87.050  42.330  1.00 29.77      A    C
ATOM  10732  OG   SER D 282     -38.021  86.809  43.605  1.00 29.91      A    O
ATOM  10733  C    SER D 282     -38.481  88.871  40.645  1.00 32.50      A    C
ATOM  10734  O    SER D 282     -37.546  88.976  39.893  1.00 32.37      A    O
ATOM  10735  N    GLU D 283     -39.727  89.051  40.275  1.00 32.48      A    N
ATOM  10736  CA   GLU D 283     -40.099  89.353  38.929  1.00 33.22      A    C
ATOM  10737  CB   GLU D 283     -41.610  89.380  38.779  1.00 32.38      A    C
ATOM  10738  CG   GLU D 283     -42.235  88.036  38.560  1.00 32.86      A    C
ATOM  10739  CD   GLU D 283     -43.643  87.939  39.051  1.00 35.75      A    C
ATOM  10740  OE1  GLU D 283     -44.309  88.954  39.124  1.00 38.99      A    O
ATOM  10741  OE2  GLU D 283     -44.086  86.851  39.367  1.00 35.65      A    O-1
ATOM  10742  C    GLU D 283     -39.513  90.660  38.553  1.00 33.94      A    C
ATOM  10743  O    GLU D 283     -39.230  90.908  37.427  1.00 36.22      A    O
ATOM  10744  N    ARG D 284     -39.427  91.539  39.510  1.00 33.89      A    N
ATOM  10745  CA   ARG D 284     -38.878  92.830  39.293  1.00 34.47      A    C
ATOM  10746  CB   ARG D 284     -39.283  93.720  40.408  1.00 35.29      A    C
ATOM  10747  CG   ARG D 284     -38.438  94.855  40.554  1.00 40.36      A    C
ATOM  10748  CD   ARG D 284     -38.838  95.644  41.737  1.00 49.58      A    C
ATOM  10749  NE   ARG D 284     -38.169  96.921  41.698  1.00 56.25      A    N
ATOM  10750  CZ   ARG D 284     -38.234  97.848  42.631  1.00 60.14      A    C
ATOM  10751  NH1  ARG D 284     -38.957  97.676  43.703  1.00 60.63      A    N
ATOM  10752  NH2  ARG D 284     -37.560  98.956  42.483  1.00 61.00      A    N
ATOM  10753  C    ARG D 284     -37.411  92.918  39.038  1.00 34.84      A    C
```

Appendix 1

```
ATOM  10754  O    ARG D 284   -36.997  93.692  38.247  1.00  36.48   A  O
ATOM  10755  N    TYR D 285   -36.605  92.145  39.725  1.00  33.87   A  N
ATOM  10756  CA   TYR D 285   -35.182  92.272  39.580  1.00  31.37   A  C
ATOM  10757  CB   TYR D 285   -34.508  92.114  40.918  1.00  30.93   A  C
ATOM  10758  CG   TYR D 285   -34.754  93.184  41.892  1.00  28.56   A  C
ATOM  10759  CD1  TYR D 285   -34.220  94.427  41.739  1.00  27.67   A  C
ATOM  10760  CE1  TYR D 285   -34.455  95.385  42.642  1.00  28.20   A  C
ATOM  10761  CZ   TYR D 285   -35.211  95.101  43.727  1.00  33.65   A  C
ATOM  10762  OH   TYR D 285   -35.489  96.023  44.682  1.00  40.95   A  O
ATOM  10763  CE2  TYR D 285   -35.715  93.882  43.901  1.00  31.61   A  C
ATOM  10764  CD2  TYR D 285   -35.485  92.937  42.999  1.00  32.85   A  C
ATOM  10765  C    TYR D 285   -34.605  91.240  38.701  1.00  30.45   A  C
ATOM  10766  O    TYR D 285   -33.454  91.241  38.461  1.00  29.32   A  O
ATOM  10767  N    TYR D 286   -35.422  90.317  38.270  1.00  31.16   A  N
ATOM  10768  CA   TYR D 286   -34.946  89.199  37.507  1.00  31.56   A  C
ATOM  10769  CB   TYR D 286   -36.103  88.277  37.223  1.00  31.03   A  C
ATOM  10770  CG   TYR D 286   -35.753  87.053  36.459  1.00  32.05   A  C
ATOM  10771  CD1  TYR D 286   -34.740  86.253  36.846  1.00  29.02   A  C
ATOM  10772  CE1  TYR D 286   -34.455  85.164  36.157  1.00  32.19   A  C
ATOM  10773  CZ   TYR D 286   -35.176  84.849  35.071  1.00  29.45   A  C
ATOM  10774  OH   TYR D 286   -34.887  83.748  34.377  1.00  32.54   A  O
ATOM  10775  CE2  TYR D 286   -36.161  85.619  34.673  1.00  26.64   A  C
ATOM  10776  CD2  TYR D 286   -36.448  86.701  35.355  1.00  28.52   A  C
ATOM  10777  C    TYR D 286   -34.333  89.620  36.215  1.00  31.37   A  C
ATOM  10778  O    TYR D 286   -33.344  89.091  35.828  1.00  33.63   A  O
ATOM  10779  N    PRO D 287   -34.956  90.554  35.523  1.00  30.60   A  N
ATOM  10780  CA   PRO D 287   -34.427  91.038  34.274  1.00  30.03   A  C
ATOM  10781  CB   PRO D 287   -35.506  91.983  33.832  1.00  29.07   A  C
ATOM  10782  CG   PRO D 287   -36.630  91.427  34.357  1.00  31.15   A  C
ATOM  10783  CD   PRO D 287   -36.331  91.002  35.660  1.00  29.97   A  C
ATOM  10784  C    PRO D 287   -33.119  91.740  34.417  1.00  29.75   A  C
ATOM  10785  O    PRO D 287   -32.287  91.596  33.598  1.00  29.57   A  O
ATOM  10786  N    ARG D 288   -32.971  92.519  35.451  1.00  29.51   A  N
ATOM  10787  CA   ARG D 288   -31.725  93.161  35.736  1.00  29.93   A  C
ATOM  10788  CB   ARG D 288   -31.916  94.201  36.797  1.00  29.95   A  C
ATOM  10789  CG   ARG D 288   -33.308  94.649  36.811  1.00  36.90   A  C
ATOM  10790  CD   ARG D 288   -33.528  95.754  37.730  1.00  44.43   A  C
ATOM  10791  NE   ARG D 288   -34.536  96.634  37.207  1.00  51.79   A  N
ATOM  10792  CZ   ARG D 288   -35.373  97.319  37.955  1.00  57.26   A  C
ATOM  10793  NH1  ARG D 288   -35.316  97.243  39.265  1.00  57.96   A  N
ATOM  10794  NH2  ARG D 288   -36.264  98.087  37.388  1.00  60.19   A  N
ATOM  10795  C    ARG D 288   -30.669  92.182  36.083  1.00  28.83   A  C
ATOM  10796  O    ARG D 288   -29.568  92.336  35.695  1.00  28.51   A  O
ATOM  10797  N    PHE D 289   -31.036  91.153  36.805  1.00  28.23   A  N
ATOM  10798  CA   PHE D 289   -30.083  90.197  37.255  1.00  28.13   A  C
ATOM  10799  CB   PHE D 289   -30.730  89.151  38.180  1.00  28.05   A  C
ATOM  10800  CG   PHE D 289   -30.093  87.816  38.121  1.00  28.59   A  C
ATOM  10801  CD1  PHE D 289   -29.116  87.453  39.001  1.00  30.19   A  C
ATOM  10802  CE1  PHE D 289   -28.538  86.262  38.902  1.00  26.07   A  C
ATOM  10803  CZ   PHE D 289   -28.924  85.419  37.955  1.00  21.99   A  C
ATOM  10804  CE2  PHE D 289   -29.885  85.752  37.096  1.00  21.94   A  C
ATOM  10805  CD2  PHE D 289   -30.458  86.925  37.172  1.00  24.19   A  C
ATOM  10806  C    PHE D 289   -29.479  89.571  36.066  1.00  27.81   A  C
ATOM  10807  O    PHE D 289   -28.323  89.311  36.039  1.00  26.60   A  O
```

Appendix 1

```
ATOM  10808  N    LYS D 290     -30.313  89.319  35.084  1.00 29.37      A  N
ATOM  10309  CA   LYS D 290     -29.932  88.631  33.874  1.00 31.03      A  C
ATOM  10810  CB   LYS D 290     -31.150  88.351  33.032  1.00 30.67      A  C
ATOM  10811  CG   LYS D 290     -31.659  86.963  33.113  1.00 29.39      A  C
ATOM  10812  CD   LYS D 290     -33.127  86.953  32.993  1.00 30.14      A  C
ATOM  10813  CE   LYS D 290     -33.535  86.150  31.839  1.00 33.89      A  C
ATOM  10814  NZ   LYS D 290     -34.733  86.657  31.252  1.00 34.40      A  N
ATOM  10815  C    LYS D 290     -28.966  89.391  33.059  1.00 31.20      A  C
ATOM  10816  O    LYS D 290     -28.046  88.857  32.538  1.00 32.03      A  O
ATOM  10817  N    GLN D 291     -29.208  90.663  32.942  1.00 32.38      A  N
ATOM  10818  CA   GLN D 291     -28.384  91.493  32.142  1.00 33.87      A  C
ATOM  10819  CB   GLN D 291     -28.969  92.866  32.137  1.00 35.40      A  C
ATOM  10820  CG   GLN D 291     -28.030  93.887  31.717  1.00 42.68      A  C
ATOM  10821  CD   GLN D 291     -28.323  94.382  30.352  1.00 51.14      A  C
ATOM  10822  OE1  GLN D 291     -27.427  94.716  29.616  1.00 53.18      A  O
ATOM  10823  NE2  GLN D 291     -29.582  94.415  29.996  1.00 50.70      A  N
ATOM  10824  C    GLN D 291     -26.999  91.542  32.698  1.00 32.52      A  C
ATOM  10825  O    GLN D 291     -26.042  91.399  31.989  1.00 32.97      A  O
ATOM  10826  N    THR D 292     -26.921  91.719  33.994  1.00 30.56      A  N
ATOM  10827  CA   THR D 292     -25.687  91.779  34.710  1.00 27.87      A  C
ATOM  10828  CB   THR D 292     -26.042  91.983  36.140  1.00 28.18      A  C
ATOM  10829  OG1  THR D 292     -26.835  93.135  36.231  1.00 24.71      A  O
ATOM  10830  CG2  THR D 292     -24.883  92.183  36.957  1.00 26.10      A  C
ATOM  10831  C    THR D 292     -24.836  90.544  34.657  1.00 29.09      A  C
ATOM  10832  O    THR D 292     -23.662  90.628  34.498  1.00 29.58      A  O
ATOM  10833  N    PHE D 293     -25.431  89.391  34.815  1.00 28.45      A  N
ATOM  10834  CA   PHE D 293     -24.661  88.202  35.036  1.00 30.34      A  C
ATOM  10835  CB   PHE D 293     -25.164  87.527  36.291  1.00 30.49      A  C
ATOM  10836  CG   PHE D 293     -24.874  88.269  37.520  1.00 31.27      A  C
ATOM  10837  CD1  PHE D 293     -23.613  88.636  37.818  1.00 28.30      A  C
ATOM  10838  CE1  PHE D 293     -23.369  89.291  38.910  1.00 26.61      A  C
ATOM  10839  CZ   PHE D 293     -24.350  89.593  39.747  1.00 25.78      A  C
ATOM  10840  CE2  PHE D 293     -25.589  89.246  39.482  1.00 27.12      A  C
ATOM  10841  CD2  PHE D 293     -25.858  88.582  38.388  1.00 29.17      A  C
ATOM  10842  C    PHE D 293     -24.597  87.177  33.948  1.00 31.21      A  C
ATOM  10843  O    PHE D 293     -23.636  86.494  33.847  1.00 30.83      A  O
ATOM  10844  N    VAL D 294     -25.642  87.070  33.156  1.00 32.02      A  N
ATOM  10845  CA   VAL D 294     -25.772  85.985  32.222  1.00 33.93      A  C
ATOM  10846  CB   VAL D 294     -27.229  85.631  31.990  1.00 34.05      A  C
ATOM  10847  CG1  VAL D 294     -27.328  84.408  31.202  1.00 32.15      A  C
ATOM  10848  CG2  VAL D 294     -27.958  85.501  33.245  1.00 33.56      A  C
ATOM  10849  C    VAL D 294     -25.175  86.306  30.883  1.00 34.67      A  C
ATOM  10850  O    VAL D 294     -25.484  87.305  30.342  1.00 35.84      A  O
ATOM  10851  N    GLU D 295     -24.316  85.436  30.379  1.00 35.45      A  N
ATOM  10852  CA   GLU D 295     -23.783  85.525  29.049  1.00 36.83      A  C
ATOM  10853  CB   GLU D 295     -22.269  85.382  29.120  1.00 37.23      A  C
ATOM  10854  CG   GLU D 295     -21.557  85.501  27.817  1.00 41.32      A  C
ATOM  10855  CD   GLU D 295     -20.235  84.801  27.765  1.00 45.17      A  C
ATOM  10856  OE1  GLU D 295     -19.641  84.561  28.799  1.00 47.81      A  O
ATOM  10857  OE2  GLU D 295     -19.771  84.502  26.673  1.00 46.73      A  O-1
ATOM  10858  C    GLU D 295     -24.357  84.445  28.139  1.00 37.15      A  C
ATOM  10859  O    GLU D 295     -24.032  83.310  28.241  1.00 35.76      A  O
ATOM  10860  N    VAL D 296     -25.182  84.812  27.190  1.00 38.38      A  N
ATOM  10861  CA   VAL D 296     -25.625  83.887  26.165  1.00 38.63      A  C
```

Appendix 1

```
ATOM  10862  CB   VAL D 296     -26.872  84.443  25.550  1.00 38.81      A    C
ATOM  10863  CG1  VAL D 296     -27.415  83.545  24.580  1.00 38.57      A    C
ATOM  10864  CG2  VAL D 296     -27.866  84.646  26.581  1.00 39.54      A    C
ATOM  10865  C    VAL D 296     -24.521  83.684  25.128  1.00 38.96      A    C
ATOM  10866  O    VAL D 296     -23.897  84.618  24.754  1.00 39.93      A    O
ATOM  10867  N    TYR D 297     -24.231  82.466  24.723  1.00 39.96      A    N
ATOM  10868  CA   TYR D 297     -23.160  82.276  23.765  1.00 40.71      A    C
ATOM  10869  CB   TYR D 297     -21.836  82.001  24.448  1.00 39.96      A    C
ATOM  10870  CG   TYR D 297     -21.730  80.702  25.143  1.00 39.64      A    C
ATOM  10871  CD1  TYR D 297     -20.977  79.708  24.636  1.00 33.71      A    C
ATOM  10872  CE1  TYR D 297     -20.876  78.567  25.244  1.00 32.47      A    C
ATOM  10873  CZ   TYR D 297     -21.516  78.373  26.407  1.00 39.23      A    C
ATOM  10874  OH   TYR D 297     -21.411  77.198  27.048  1.00 36.05      A    O
ATOM  10875  CE2  TYR D 297     -22.260  79.342  26.950  1.00 40.28      A    C
ATOM  10876  CD2  TYR D 297     -22.355  80.498  26.328  1.00 39.40      A    C
ATOM  10877  C    TYR D 297     -23.281  81.449  22.495  1.00 42.67      A    C
ATOM  10878  O    TYR D 297     -22.754  81.816  21.490  1.00 43.60      A    O
ATOM  10879  N    ASP D 298     -23.863  80.293  22.496  1.00 44.41      A    N
ATOM  10880  CA   ASP D 298     -23.744  79.597  21.245  1.00 45.93      A    C
ATOM  10881  CB   ASP D 298     -23.859  78.115  21.415  1.00 46.78      A    C
ATOM  10882  CG   ASP D 298     -23.189  77.387  20.349  1.00 50.63      A    C
ATOM  10883  OD1  ASP D 298     -22.092  77.780  20.010  1.00 57.47      A    O
ATOM  10884  OD2  ASP D 298     -23.732  76.420  19.845  1.00 53.52      A    O
ATOM  10885  C    ASP D 298     -24.816  80.058  20.347  1.00 45.47      A    C
ATOM  10886  O    ASP D 298     -25.746  79.362  20.104  1.00 45.02      A    O
ATOM  10887  N    GLU D 299     -24.715  81.271  19.893  1.00 45.53      A    N
ATOM  10888  CA   GLU D 299     -25.679  81.732  18.964  1.00 46.85      A    C
ATOM  10889  CB   GLU D 299     -25.530  80.995  17.674  1.00 47.97      A    C
ATOM  10890  CG   GLU D 299     -24.700  81.708  16.704  1.00 52.73      A    C
ATOM  10891  CD   GLU D 299     -24.154  80.804  15.694  1.00 59.10      A    C
ATOM  10892  OE1  GLU D 299     -22.947  80.568  15.718  1.00 62.22      A    O
ATOM  10893  OE2  GLU D 299     -24.926  80.329  14.862  1.00 60.85      A    O
ATOM  10894  C    GLU D 299     -27.039  81.504  19.527  1.00 46.09      A    C
ATOM  10895  O    GLU D 299     -27.929  81.048  18.845  1.00 45.93      A    O
ATOM  10896  N    GLY D 300     -27.182  81.832  20.797  1.00 45.40      A    N
ATOM  10897  CA   GLY D 300     -28.430  81.774  21.515  1.00 42.90      A    C
ATOM  10898  C    GLY D 300     -28.688  80.408  22.055  1.00 42.18      A    C
ATOM  10899  O    GLY D 300     -29.642  80.184  22.722  1.00 42.00      A    O
ATOM  10900  N    ARG D 301     -27.823  79.485  21.713  1.00 41.45      A    N
ATOM  10901  CA   ARG D 301     -27.847  78.142  22.238  1.00 41.61      A    C
ATOM  10902  CB   ARG D 301     -27.078  77.230  21.327  1.00 42.02      A    C
ATOM  10903  CG   ARG D 301     -27.855  76.945  20.089  1.00 46.20      A    C
ATOM  10904  CD   ARG D 301     -27.258  75.872  19.254  1.00 51.24      A    C
ATOM  10905  NE   ARG D 301     -26.077  76.334  18.569  1.00 53.15      A    N
ATOM  10906  CZ   ARG D 301     -26.104  77.016  17.441  1.00 57.92      A    C
ATOM  10907  NH1  ARG D 301     -27.250  77.290  16.864  1.00 58.96      A    N
ATOM  10908  NH2  ARG D 301     -24.989  77.420  16.884  1.00 60.71      A    N
ATOM  10909  C    ARG D 301     -27.524  77.885  23.708  1.00 40.50      A    C
ATOM  10910  O    ARG D 301     -28.113  77.040  24.298  1.00 41.00      A    O
ATOM  10911  N    LYS D 302     -26.574  78.609  24.265  1.00 39.15      A    N
ATOM  10912  CA   LYS D 302     -26.079  78.355  25.606  1.00 38.06      A    C
ATOM  10913  CB   LYS D 302     -24.687  77.809  25.581  1.00 36.72      A    C
ATOM  10914  CG   LYS D 302     -24.609  76.378  25.453  1.00 37.48      A    C
ATOM  10915  CD   LYS D 302     -23.774  76.021  24.311  1.00 34.16      A    C
```

Appendix 1

```
ATOM  10916  CE   LYS D 302   -23.877  74.607  24.030  1.00  32.79    A  C
ATOM  10917  NZ   LYS D 302   -22.569  74.062  24.082  1.00  34.05    A  N
ATOM  10918  C    LYS D 302   -26.043  79.578  26.437  1.00  38.28    A  C
ATOM  10919  O    LYS D 302   -26.205  80.643  25.952  1.00  39.18    A  O
ATOM  10920  N    ALA D 303   -25.814  79.399  27.712  1.00  37.65    A  N
ATOM  10921  CA   ALA D 303   -25.627  80.497  28.614  1.00  36.49    A  C
ATOM  10922  CB   ALA D 303   -26.926  80.921  29.154  1.00  35.36    A  C
ATOM  10923  C    ALA D 303   -24.724  80.027  29.703  1.00  35.22    A  C
ATOM  10924  O    ALA D 303   -24.746  78.887  30.033  1.00  35.70    A  O
ATOM  10925  N    ARG D 304   -23.925  80.926  30.241  1.00  34.06    A  N
ATOM  10926  CA   ARG D 304   -23.118  80.698  31.417  1.00  31.69    A  C
ATOM  10927  CB   ARG D 304   -21.687  80.343  31.045  1.00  31.54    A  C
ATOM  10928  CG   ARG D 304   -21.021  81.283  30.125  1.00  30.05    A  C
ATOM  10929  CD   ARG D 304   -19.644  80.864  29.742  1.00  30.91    A  C
ATOM  10930  NE   ARG D 304   -19.291  81.563  28.539  1.00  38.91    A  N
ATOM  10931  CZ   ARG D 304   -18.697  81.040  27.483  1.00  43.14    A  C
ATOM  10932  NH1  ARG D 304   -18.315  79.790  27.492  1.00  44.66    A  N
ATOM  10933  NH2  ARG D 304   -18.467  81.782  26.421  1.00  35.63    A  N
ATOM  10934  C    ARG D 304   -23.218  81.934  32.303  1.00  31.84    A  C
ATOM  10935  O    ARG D 304   -23.617  82.952  31.846  1.00  29.13    A  O
ATOM  10936  N    VAL D 305   -22.905  81.817  33.584  1.00  32.04    A  N
ATOM  10937  CA   VAL D 305   -23.075  82.911  34.530  1.00  31.13    A  C
ATOM  10938  CB   VAL D 305   -24.179  82.588  35.553  1.00  31.49    A  C
ATOM  10939  CG1  VAL D 305   -24.615  83.773  36.300  1.00  26.54    A  C
ATOM  10940  CG2  VAL D 305   -25.336  82.006  34.863  1.00  29.44    A  C
ATOM  10941  C    VAL D 305   -21.796  83.374  35.214  1.00  31.71    A  C
ATOM  10942  O    VAL D 305   -20.983  82.597  35.614  1.00  32.22    A  O
ATOM  10943  N    ARG D 306   -21.648  84.677  35.317  1.00  31.69    A  N
ATOM  10944  CA   ARG D 306   -20.540  85.301  35.980  1.00  31.01    A  C
ATOM  10945  CB   ARG D 306   -20.292  86.676  35.416  1.00  29.30    A  C
ATOM  10946  CG   ARG D 306   -19.871  86.745  33.997  1.00  30.95    A  C
ATOM  10947  CD   ARG D 306   -19.600  88.167  33.567  1.00  28.41    A  C
ATOM  10948  NE   ARG D 306   -20.805  88.882  33.226  1.00  32.72    A  N
ATOM  10949  CZ   ARG D 306   -21.393  88.814  32.054  1.00  33.61    A  C
ATOM  10950  NH1  ARG D 306   -20.869  98.087  31.125  1.00  33.22    A  N
ATOM  10951  NH2  ARG D 306   -22.485  89.482  31.804  1.00  29.38    A  N
ATOM  10952  C    ARG D 306   -20.906  85.479  37.390  1.00  31.45    A  C
ATOM  10953  O    ARG D 306   -21.974  85.868  37.661  1.00  30.76    A  O
ATOM  10954  N    GLU D 307   -20.006  85.167  38.296  1.00  32.66    A  N
ATOM  10955  CA   GLU D 307   -20.223  85.356  39.719  1.00  33.16    A  C
ATOM  10956  CB   GLU D 307   -19.219  84.563  40.545  1.00  33.38    A  C
ATOM  10957  CG   GLU D 307   -19.291  84.805  42.030  1.00  32.05    A  C
ATOM  10958  CD   GLU D 307   -20.556  84.334  42.709  1.00  33.22    A  C
ATOM  10959  OE1  GLU D 307   -21.273  83.524  42.192  1.00  30.72    A  O
ATOM  10960  OE2  GLU D 307   -20.833  84.767  43.802  1.00  36.38    A  O
ATOM  10961  C    GLU D 307   -20.324  86.792  40.199  1.00  34.17    A  C
ATOM  10962  O    GLU D 307   -21.038  87.076  41.114  1.00  34.21    A  O
ATOM  10963  N    THR D 308   -19.587  87.677  39.559  1.00  34.40    A  N
ATOM  10964  CA   THR D 308   -19.414  89.042  40.007  1.00  35.33    A  C
ATOM  10965  CB   THR D 308   -18.272  89.110  41.022  1.00  34.97    A  C
ATOM  10966  OG1  THR D 308   -18.237  90.384  41.670  1.00  34.60    A  O
ATOM  10967  CG2  THR D 308   -17.008  88.845  40.353  1.00  33.02    A  C
ATOM  10968  C    THR D 308   -19.268  90.076  38.874  1.00  35.63    A  C
ATOM  10969  O    THR D 308   -19.142  89.739  37.741  1.00  35.35    A  O
```

Appendix 1

```
ATOM  10970  N    ALA D 309     -19.268  91.344  39.219  1.00  36.91      A  N
ATOM  10971  CA   ALA D 309     -19.334  92.422  38.249  1.00  38.13      A  C
ATOM  10972  CB   ALA D 309     -20.058  93.567  38.798  1.00  37.90      A  C
ATOM  10973  C    ALA D 309     -18.066  92.906  37.621  1.00  39.27      A  C
ATOM  10974  O    ALA D 309     -18.090  93.742  36.768  1.00  41.36      A  O
ATOM  10975  N    GLY D 310     -16.928  92.430  38.011  1.00  38.98      A  N
ATOM  10976  CA   GLY D 310     -15.768  93.037  37.422  1.00  38.24      A  C
ATOM  10977  C    GLY D 310     -15.125  92.257  36.350  1.00  37.50      A  C
ATOM  10978  O    GLY D 310     -13.993  92.470  36.087  1.00  37.27      A  O
ATOM  10979  N    THR D 311     -15.836  91.316  35.779  1.00  37.00      A  N
ATOM  10980  CA   THR D 311     -15.188  90.211  35.149  1.00  37.25      A  C
ATOM  10981  CB   THR D 311     -14.963  89.140  36.182  1.00  36.49      A  C
ATOM  10982  OG1  THR D 311     -14.040  88.202  35.683  1.00  36.91      A  O
ATOM  10983  CG2  THR D 311     -16.226  88.455  36.481  1.00  34.87      A  C
ATOM  10984  C    THR D 311     -15.883  89.622  33.941  1.00  38.32      A  C
ATOM  10985  O    THR D 311     -17.040  89.810  33.752  1.00  38.75      A  O
ATOM  10986  N    ASP D 312     -15.136  88.906  33.127  1.00  39.85      A  N
ATOM  10987  CA   ASP D 312     -15.687  88.211  31.997  1.00  41.49      A  C
ATOM  10988  CB   ASP D 312     -14.814  88.422  30.778  1.00  41.91      A  C
ATOM  10989  CG   ASP D 312     -14.934  89.792  30.206  1.00  46.40      A  C
ATOM  10990  OD1  ASP D 312     -16.015  90.219  29.843  1.00  41.27      A  O
ATOM  10991  OD2  ASP D 312     -13.916  90.460  30.106  1.00  52.81      A  O-1
ATOM  10992  C    ASP D 312     -15.764  86.742  32.284  1.00  41.25      A  C
ATOM  10993  O    ASP D 312     -16.389  86.005  31.576  1.00  40.33      A  O
ATOM  10994  N    ASP D 313     -15.128  86.318  33.354  1.00  40.70      A  N
ATOM  10995  CA   ASP D 313     -15.086  84.926  33.741  1.00  40.86      A  C
ATOM  10996  CB   ASP D 313     -14.032  84.750  34.830  1.00  41.29      A  C
ATOM  10997  CG   ASP D 313     -12.621  85.026  34.356  1.00  41.91      A  C
ATOM  10998  OD1  ASP D 313     -12.132  84.316  33.504  1.00  45.78      A  O
ATOM  10999  OD2  ASP D 313     -11.958  85.927  34.849  1.00  42.08      A  O-1
ATOM  11000  C    ASP D 313     -16.445  84.403  34.220  1.00  40.68      A  C
ATOM  11001  O    ASP D 313     -17.144  85.074  34.910  1.00  40.30      A  O
ATOM  11002  N    ALA D 314     -16.848  83.234  33.755  1.00  40.86      A  N
ATOM  11003  CA   ALA D 314     -18.155  82.656  34.086  1.00  41.31      A  C
ATOM  11004  CB   ALA D 314     -18.623  81.774  32.991  1.00  41.65      A  C
ATOM  11005  C    ALA D 314     -18.584  82.051  35.415  1.00  41.44      A  C
ATOM  11006  O    ALA D 314     -19.690  82.306  35.849  1.00  43.66      A  O
ATOM  11007  N    ASP D 315     -17.817  81.181  36.023  1.00  40.14      A  N
ATOM  11008  CA   ASP D 315     -18.352  80.599  37.242  1.00  40.09      A  C
ATOM  11009  CB   ASP D 315     -18.725  79.153  37.037  1.00  40.60      A  C
ATOM  11010  CG   ASP D 315     -20.098  78.978  36.554  1.00  42.89      A  C
ATOM  11011  OD1  ASP D 315     -20.987  79.281  37.315  1.00  46.70      A  O
ATOM  11012  OD2  ASP D 315     -20.273  78.525  35.425  1.00  43.07      A  O
ATOM  11013  C    ASP D 315     -17.382  80.644  38.342  1.00  38.85      A  C
ATOM  11014  O    ASP D 315     -16.879  79.644  38.757  1.00  38.09      A  O
ATOM  11015  N    GLY D 316     -17.134  81.840  38.809  1.00  37.19      A  N
ATOM  11016  CA   GLY D 316     -16.169  82.076  39.829  1.00  35.31      A  C
ATOM  11017  C    GLY D 316     -16.738  81.852  41.184  1.00  35.32      A  C
ATOM  11018  O    GLY D 316     -17.812  81.323  41.325  1.00  35.26      A  O
ATOM  11019  N    GLY D 317     -15.981  82.255  42.181  1.00  33.99      A  N
ATOM  11020  CA   GLY D 317     -16.320  82.084  43.560  1.00  32.20      A  C
ATOM  11021  C    GLY D 317     -16.468  80.652  43.936  1.00  31.46      A  C
ATOM  11022  O    GLY D 317     -15.625  79.851  43.723  1.00  29.65      A  O
ATOM  11023  N    VAL D 318     -17.608  80.355  44.494  1.00  30.93      A  N
```

Appendix 1

```
ATOM  11024  CA   VAL D 318   -17.966  79.011  44.794  1.00  29.78      A  C
ATOM  11025  CB   VAL D 318   -18.988  78.954  45.921  1.00  29.88      A  C
ATOM  11026  CG1  VAL D 318   -18.399  79.541  47.127  1.00  25.37      A  C
ATOM  11027  CG2  VAL D 318   -20.240  79.671  45.584  1.00  28.47      A  C
ATOM  11028  C    VAL D 318   -18.318  78.219  43.537  1.00  30.99      A  C
ATOM  11029  O    VAL D 318   -18.403  77.033  43.573  1.00  32.01      A  O
ATOM  11030  N    GLY D 319   -18.445  78.892  42.416  1.00  30.65      A  N
ATOM  11031  CA   GLY D 319   -18.645  78.253  41.141  1.00  30.22      A  C
ATOM  11032  C    GLY D 319   -20.035  77.779  40.854  1.00  30.35      A  C
ATOM  11033  O    GLY D 319   -20.258  76.958  40.019  1.00  30.84      A  O
ATOM  11034  N    LEU D 320   -20.971  78.317  41.586  1.00  29.26      A  N
ATOM  11035  CA   LEU D 320   -22.310  77.847  41.555  1.00  28.38      A  C
ATOM  11036  CB   LEU D 320   -22.751  77.528  42.960  1.00  23.78      A  C
ATOM  11037  CG   LEU D 320   -22.165  76.300  43.617  1.00  28.94      A  C
ATOM  11038  CD1  LEU D 320   -22.766  76.098  44.924  1.00  26.67      A  C
ATOM  11039  CD2  LEU D 320   -22.296  75.105  42.783  1.00  27.59      A  C
ATOM  11040  C    LEU D 320   -23.280  78.795  40.934  1.00  27.97      A  C
ATOM  11041  O    LEU D 320   -24.423  78.611  41.071  1.00  23.65      A  O
ATOM  11042  N    ALA D 321   -22.825  79.819  40.257  1.00  26.42      A  N
ATOM  11043  CA   ALA D 321   -23.733  80.755  39.655  1.00  26.59      A  C
ATOM  11044  CB   ALA D 321   -22.959  81.912  39.133  1.00  27.00      A  C
ATOM  11045  C    ALA D 321   -24.630  80.209  38.563  1.00  26.34      A  C
ATOM  11046  O    ALA D 321   -25.801  80.441  38.581  1.00  25.09      A  O
ATOM  11047  N    SER D 322   -24.073  79.467  37.628  1.00  25.21      A  N
ATOM  11048  CA   SER D 322   -24.853  78.892  36.560  1.00  25.22      A  C
ATOM  11049  CB   SER D 322   -23.969  78.190  35.545  1.00  24.82      A  C
ATOM  11050  OG   SER D 322   -23.118  79.021  34.843  1.00  23.66      A  O
ATOM  11051  C    SER D 322   -25.876  77.906  37.060  1.00  26.51      A  C
ATOM  11052  O    SER D 322   -26.975  77.880  36.609  1.00  27.83      A  O
ATOM  11053  N    ALA D 323   -25.475  77.073  37.992  1.00  27.33      A  N
ATOM  11054  CA   ALA D 323   -26.342  76.115  38.630  1.00  26.82      A  C
ATOM  11055  CB   ALA D 323   -25.542  75.213  39.455  1.00  25.63      A  C
ATOM  11056  C    ALA D 323   -27.472  76.694  39.455  1.00  27.92      A  C
ATOM  11057  O    ALA D 323   -28.551  76.199  39.423  1.00  28.73      A  O
ATOM  11058  N    PHE D 324   -27.207  77.707  40.247  1.00  28.02      A  N
ATOM  11059  CA   PHE D 324   -28.260  78.417  40.946  1.00  27.43      A  C
ATOM  11060  CB   PHE D 324   -27.734  79.254  42.111  1.00  27.47      A  C
ATOM  11061  CG   PHE D 324   -27.574  78.479  43.370  1.00  28.32      A  C
ATOM  11062  CD1  PHE D 324   -28.642  77.986  44.022  1.00  32.01      A  C
ATOM  11063  CE1  PHE D 324   -28.482  77.277  45.149  1.00  31.97      A  C
ATOM  11064  CZ   PHE D 324   -27.264  77.036  45.611  1.00  29.47      A  C
ATOM  11065  CE2  PHE D 324   -26.210  77.507  44.990  1.00  28.95      A  C
ATOM  11066  CD2  PHE D 324   -26.351  78.217  43.883  1.00  31.26      A  C
ATOM  11067  C    PHE D 324   -29.160  79.187  40.012  1.00  26.73      A  C
ATOM  11068  O    PHE D 324   -30.321  79.331  40.243  1.00  26.75      A  O
ATOM  11069  N    THR D 325   -28.572  79.701  38.961  1.00  25.92      A  N
ATOM  11070  CA   THR D 325   -29.296  80.389  37.926  1.00  24.74      A  C
ATOM  11071  CB   THR D 325   -28.389  81.152  36.998  1.00  25.28      A  C
ATOM  11072  OG1  THR D 325   -27.594  82.016  37.771  1.00  21.09      A  O
ATOM  11073  CG2  THR D 325   -29.177  81.975  36.091  1.00  23.40      A  C
ATOM  11074  C    THR D 325   -30.216  79.457  37.187  1.00  25.04      A  C
ATOM  11075  O    THR D 325   -31.291  79.830  36.856  1.00  23.69      A  O
ATOM  11076  N    LEU D 326   -29.791  78.229  36.985  1.00  23.13      A  N
ATOM  11077  CA   LEU D 326   -30.647  77.266  36.391  1.00  24.00      A  C
```

Appendix 1

```
ATOM  11078  CB  LEU D 326     -29.918  75.957  36.194  1.00 23.58      A  C
ATOM  11079  CG  LEU D 326     -30.660  74.830  35.486  1.00 27.16      A  C
ATOM  11080  CD1 LEU D 326     -30.856  75.051  34.054  1.00 25.95      A  C
ATOM  11081  CD2 LEU D 326     -30.000  73.563  35.690  1.00 25.98      A  C
ATOM  11082  C   LEU D 326     -31.867  77.037  37.236  1.00 24.97      A  C
ATOM  11083  O   LEU D 326     -32.936  76.975  36.730  1.00 27.24      A  O
ATOM  11084  N   LEU D 327     -31.712  76.926  38.535  1.00 25.21      A  N
ATOM  11085  CA  LEU D 327     -32.840  76.774  39.402  1.00 24.35      A  C
ATOM  11086  CB  LEU D 327     -32.419  76.384  40.812  1.00 26.24      A  C
ATOM  11087  CG  LEU D 327     -33.449  76.557  41.935  1.00 24.76      A  C
ATOM  11088  CD1 LEU D 327     -34.500  75.526  41.968  1.00 22.68      A  C
ATOM  11089  CD2 LEU D 327     -32.836  76.655  43.239  1.00 26.65      A  C
ATOM  11090  C   LEU D 327     -33.740  77.975  39.391  1.00 24.19      A  C
ATOM  11091  O   LEU D 327     -34.916  77.852  39.464  1.00 23.52      A  O
ATOM  11092  N   LEU D 328     -33.161  79.146  39.326  1.00 23.90      A  N
ATOM  11093  CA  LEU D 328     -33.908  80.372  39.273  1.00 24.83      A  C
ATOM  11094  CB  LEU D 328     -32.987  81.552  39.450  1.00 24.24      A  C
ATOM  11095  CG  LEU D 328     -33.597  82.931  39.321  1.00 24.70      A  C
ATOM  11096  CD1 LEU D 328     -34.666  83.210  40.266  1.00 22.68      A  C
ATOM  11097  CD2 LEU D 328     -32.595  84.007  39.337  1.00 25.16      A  C
ATOM  11098  C   LEU D 328     -34.753  80.545  38.026  1.00 25.31      A  C
ATOM  11099  O   LEU D 328     -35.822  81.061  38.085  1.00 24.74      A  O
ATOM  11100  N   ALA D 329     -34.236  80.153  36.888  1.00 25.47      A  N
ATOM  11101  CA  ALA D 329     -35.000  80.181  35.672  1.00 25.77      A  C
ATOM  11102  CB  ALA D 329     -34.151  79.880  34.496  1.00 23.31      A  C
ATOM  11103  C   ALA D 329     -36.180  79.250  35.727  1.00 25.71      A  C
ATOM  11104  O   ALA D 329     -37.232  79.573  35.292  1.00 26.14      A  O
ATOM  11105  N   ARG D 330     -36.015  78.090  36.291  1.00 25.98      A  N
ATOM  11106  CA  ARG D 330     -37.139  77.238  36.440  1.00 26.95      A  C
ATOM  11107  CB  ARG D 330     -36.696  75.913  37.004  1.00 28.35      A  C
ATOM  11108  CG  ARG D 330     -37.784  74.968  37.255  1.00 28.05      A  C
ATOM  11109  CD  ARG D 330     -38.251  74.349  36.006  1.00 29.21      A  C
ATOM  11110  NE  ARG D 330     -38.139  72.920  36.055  1.00 29.33      A  N
ATOM  11111  CZ  ARG D 330     -39.160  72.103  36.078  1.00 28.86      A  C
ATOM  11112  NH1 ARG D 330     -40.359  72.568  36.040  1.00 24.51      A  N
ATOM  11113  NH2 ARG D 330     -38.970  70.830  36.138  1.00 28.59      A  N
ATOM  11114  C   ARG D 330     -38.211  77.837  37.311  1.00 28.11      A  C
ATOM  11115  O   ARG D 330     -39.353  77.762  36.991  1.00 28.80      A  O
ATOM  11116  N   GLU D 331     -37.836  78.444  38.417  1.00 29.68      A  N
ATOM  11117  CA  GLU D 331     -38.766  79.076  39.310  1.00 29.56      A  C
ATOM  11118  CB  GLU D 331     -38.045  79.536  40.582  1.00 29.08      A  C
ATOM  11119  CG  GLU D 331     -38.854  80.409  41.508  1.00 26.85      A  C
ATOM  11120  CD  GLU D 331     -39.887  79.679  42.296  1.00 30.21      A  C
ATOM  11121  OE1 GLU D 331     -39.639  78.554  42.662  1.00 29.77      A  O
ATOM  11122  OE2 GLU D 331     -40.936  80.237  42.552  1.00 26.17      A  O-1
ATOM  11123  C   GLU D 331     -39.482  80.216  38.636  1.00 30.48      A  C
ATOM  11124  O   GLU D 331     -40.660  80.373  38.789  1.00 31.72      A  O
ATOM  11125  N   MET D 332     -38.765  80.979  37.838  1.00 31.40      A  N
ATOM  11126  CA  MET D 332     -39.349  82.081  37.123  1.00 32.67      A  C
ATOM  11127  CB  MET D 332     -38.342  83.162  36.806  1.00 31.75      D  C
ATOM  11128  CG  MET D 332     -37.572  83.682  37.939  1.00 33.75      D  C
ATOM  11129  SD  MET D 332     -38.406  84.462  39.273  1.00 38.81      D  S
ATOM  11130  CE  MET D 332     -39.413  85.589  38.499  1.00 31.09      D  C
ATOM  11131  C   MET D 332     -40.023  81.673  35.850  1.00 33.59      A  C
```

Appendix 1

```
ATOM  11132  O    MET D 332     -40.617  82.473  35.217  1.00 33.86      A    O
ATOM  11133  N    GLY D 333     -39.949  80.419  35.491  1.00 34.46      A    N
ATOM  11134  CA   GLY D 333     -40.594  79.955  34.304  1.00 35.50      A    C
ATOM  11135  C    GLY D 333     -39.935  80.327  33.013  1.00 37.11      A    C
ATOM  11136  O    GLY D 333     -40.576  80.367  32.003  1.00 37.14      A    O
ATOM  11137  N    ASP D 334     -38.648  80.602  33.057  1.00 36.94      A    N
ATOM  11138  CA   ASP D 334     -37.913  80.965  31.877  1.00 34.87      A    C
ATOM  11139  CB   ASP D 334     -36.743  81.813  32.292  1.00 34.21      A    C
ATOM  11140  CG   ASP D 334     -36.230  82.637  31.222  1.00 33.88      A    C
ATOM  11141  OD1  ASP D 334     -36.193  82.191  30.118  1.00 34.20      A    O
ATOM  11142  OD2  ASP D 334     -35.858  83.750  31.456  1.00 34.39      A    O-1
ATOM  11143  C    ASP D 334     -37.395  79.736  31.201  1.00 34.34      A    C
ATOM  11144  O    ASP D 334     -36.301  79.375  31.403  1.00 35.64      A    O
ATOM  11145  N    GLN D 335     -38.177  79.123  30.346  1.00 33.07      A    N
ATOM  11146  CA   GLN D 335     -37.749  77.946  29.628  1.00 32.68      A    C
ATOM  11147  CB   GLN D 335     -38.883  77.377  28.805  1.00 33.38      A    C
ATOM  11148  CG   GLN D 335     -40.054  77.043  29.573  1.00 33.70      A    C
ATOM  11149  CD   GLN D 335     -40.925  76.080  28.884  1.00 35.58      A    C
ATOM  11150  OE1  GLN D 335     -42.098  76.048  29.108  1.00 34.53      A    O
ATOM  11151  NE2  GLN D 335     -40.362  75.289  28.043  1.00 36.01      A    N
ATOM  11152  C    GLN D 335     -36.561  78.191  28.736  1.00 31.44      A    C
ATOM  11153  O    GLN D 335     -35.751  77.338  28.548  1.00 30.94      A    O
ATOM  11154  N    GLN D 336     -36.480  79.351  28.144  1.00 29.98      A    N
ATOM  11155  CA   GLN D 336     -35.389  79.626  27.268  1.00 30.06      A    C
ATOM  11156  CB   GLN D 336     -35.677  80.966  26.607  1.00 30.53      A    C
ATOM  11157  CG   GLN D 336     -34.774  81.406  25.486  1.00 37.59      A    C
ATOM  11158  CD   GLN D 336     -35.021  82.848  25.064  1.00 44.42      A    C
ATOM  11159  OE1  GLN D 336     -35.819  83.553  25.661  1.00 49.06      A    O
ATOM  11160  NE2  GLN D 336     -34.339  83.283  24.035  1.00 40.41      A    N
ATOM  11161  C    GLN D 336     -34.039  79.641  27.957  1.00 29.23      A    C
ATOM  11162  O    GLN D 336     -33.149  78.969  27.550  1.00 30.40      A    O
ATOM  11163  N    LEU D 337     -33.898  80.390  29.024  1.00 28.30      A    N
ATOM  11164  CA   LEU D 337     -32.695  80.381  29.812  1.00 27.50      A    C
ATOM  11165  CB   LEU D 337     -32.763  81.447  30.865  1.00 27.78      A    C
ATOM  11166  CG   LEU D 337     -31.627  81.687  31.817  1.00 28.94      A    C
ATOM  11167  CD1  LEU D 337     -30.372  82.046  31.137  1.00 30.18      A    C
ATOM  11168  CD2  LEU D 337     -32.015  82.725  32.739  1.00 27.55      A    C
ATOM  11169  C    LEU D 337     -32.425  79.038  30.432  1.00 26.58      A    C
ATOM  11170  O    LEU D 337     -31.319  78.621  30.513  1.00 24.73      A    O
ATOM  11171  N    PHE D 338     -33.458  78.343  30.831  1.00 25.36      A    N
ATOM  11172  CA   PHE D 338     -33.253  77.090  31.456  1.00 26.21      A    C
ATOM  11173  CB   PHE D 338     -34.608  76.516  31.820  1.00 25.74      A    C
ATOM  11174  CG   PHE D 338     -34.542  75.171  32.426  1.00 24.69      A    C
ATOM  11175  CD1  PHE D 338     -34.579  75.027  33.786  1.00 20.76      A    C
ATOM  11176  CE1  PHE D 338     -34.490  73.842  34.344  1.00 15.79      A    C
ATOM  11177  CZ   PHE D 338     -34.368  72.762  33.558  1.00 23.50      A    C
ATOM  11178  CE2  PHE D 338     -34.323  72.879  32.201  1.00 22.09      A    C
ATOM  11179  CD2  PHE D 338     -34.408  74.057  31.649  1.00 18.72      A    C
ATOM  11180  C    PHE D 338     -32.557  76.145  30.528  1.00 27.22      A    C
ATOM  11181  O    PHE D 338     -31.636  75.463  30.875  1.00 28.06      A    O
ATOM  11182  N    ASP D 339     -33.048  76.094  29.323  1.00 30.19      A    N
ATOM  11183  CA   ASP D 339     -32.460  75.294  28.288  1.00 30.76      A    C
ATOM  11184  CB   ASP D 339     -33.391  75.278  27.090  1.00 32.11      A    C
ATOM  11185  CG   ASP D 339     -32.972  74.308  26.050  1.00 35.17      A    C
```

Appendix 1

```
ATOM  11186  OD1  ASP  D  339    -32.856  73.136  26.358  1.00  37.07    A    O
ATOM  11187  OD2  ASP  D  339    -32.757  74.716  24.923  1.00  36.68    A    O-1
ATOM  11188  C    ASP  D  339    -31.074  75.747  27.892  1.00  29.64    A    C
ATOM  11189  O    ASP  D  339    -30.229  74.957  27.675  1.00  30.85    A    O
ATOM  11190  N    GLN  D  340    -30.858  77.030  27.782  1.00  27.44    A    N
ATOM  11191  CA   GLN  D  340    -29.563  77.513  27.435  1.00  26.88    A    C
ATOM  11192  CB   GLN  D  340    -29.599  79.020  27.350  1.00  27.85    A    C
ATOM  11193  CG   GLN  D  340    -30.162  79.562  26.112  1.00  26.68    A    C
ATOM  11194  CD   GLN  D  340    -30.410  81.020  26.153  1.00  30.84    A    C
ATOM  11195  OE1  GLN  D  340    -30.864  81.549  27.117  1.00  32.28    A    O
ATOM  11196  NE2  GLN  D  340    -30.143  81.670  25.076  1.00  25.26    A    N
ATOM  11197  C    GLN  D  340    -28.586  77.134  28.496  1.00  26.64    A    C
ATOM  11198  O    GLN  D  340    -27.504  76.755  28.221  1.00  27.53    A    O
ATOM  11199  N    LEU  D  341    -28.984  77.299  29.733  1.00  26.10    A    N
ATOM  11200  CA   LEU  D  341    -28.170  76.966  30.868  1.00  25.20    A    C
ATOM  11201  CB   LEU  D  341    -28.824  77.478  32.131  1.00  25.27    A    C
ATOM  11202  CG   LEU  D  341    -28.227  78.574  32.959  1.00  23.39    A    C
ATOM  11203  CD1  LEU  D  341    -27.110  79.218  32.299  1.00  18.52    A    C
ATOM  11204  CD2  LEU  D  341    -29.269  79.510  33.233  1.00  16.68    A    C
ATOM  11205  C    LEU  D  341    -27.885  75.500  31.004  1.00  25.61    A    C
ATOM  11206  O    LEU  D  341    -26.805  75.114  31.317  1.00  26.48    A    O
ATOM  11207  N    LEU  D  342    -28.882  74.685  30.767  1.00  25.03    A    N
ATOM  11208  CA   LEU  D  342    -28.698  73.272  30.762  1.00  24.93    A    C
ATOM  11209  CB   LEU  D  342    -30.022  72.557  30.739  1.00  25.05    A    C
ATOM  11210  CG   LEU  D  342    -30.003  71.156  31.289  1.00  22.27    A    C
ATOM  11211  CD1  LEU  D  342    -29.307  71.077  32.513  1.00  17.42    A    C
ATOM  11212  CD2  LEU  D  342    -31.319  70.604  31.434  1.00  22.72    A    C
ATOM  11213  C    LEU  D  342    -27.788  72.808  29.670  1.00  26.17    A    C
ATOM  11214  O    LEU  D  342    -27.061  71.901  29.862  1.00  26.88    A    O
ATOM  11215  N    ASN  D  343    -27.840  73.424  28.510  1.00  27.39    A    N
ATOM  11216  CA   ASN  D  343    -26.959  73.050  27.411  1.00  29.62    A    C
ATOM  11217  CB   ASN  D  343    -27.360  73.699  26.097  1.00  30.40    A    C
ATOM  11218  CG   ASN  D  343    -28.645  73.175  25.544  1.00  28.89    A    C
ATOM  11219  OD1  ASN  D  343    -29.045  72.075  25.778  1.00  31.56    A    O
ATOM  11220  ND2  ASN  D  343    -29.278  73.976  24.792  1.00  19.72    A    N
ATOM  11221  C    ASN  D  343    -25.490  73.304  27.704  1.00  30.75    A    C
ATOM  11222  O    ASN  D  343    -24.617  72.602  27.284  1.00  30.16    A    O
ATOM  11223  N    HIS  D  344    -25.238  74.372  28.412  1.00  32.05    A    N
ATOM  11224  CA   HIS  D  344    -23.942  74.588  28.958  1.00  31.51    A    C
ATOM  11225  CB   HIS  D  344    -23.917  75.959  29.563  1.00  32.13    A    C
ATOM  11226  CG   HIS  D  344    -22.631  76.292  30.212  1.00  33.10    A    C
ATOM  11227  ND1  HIS  D  344    -22.481  76.354  31.570  1.00  36.62    A    N
ATOM  11228  CE1  HIS  D  344    -21.244  76.681  31.853  1.00  35.84    A    C
ATOM  11229  NE2  HIS  D  344    -20.594  76.842  30.726  1.00  37.76    A    N
ATOM  11230  CD2  HIS  D  344    -21.439  76.607  29.687  1.00  32.09    A    C
ATOM  11231  C    HIS  D  344    -23.501  73.649  30.037  1.00  29.89    A    C
ATOM  11232  O    HIS  D  344    -22.411  73.221  30.039  1.00  30.62    A    O
ATOM  11233  N    LEU  D  345    -24.311  73.428  31.030  1.00  29.33    A    N
ATOM  11234  CA   LEU  D  345    -23.898  72.548  32.105  1.00  28.65    A    C
ATOM  11235  CB   LEU  D  345    -24.681  72.878  33.367  1.00  28.73    A    C
ATOM  11236  CG   LEU  D  345    -24.539  74.302  33.835  1.00  28.26    A    C
ATOM  11237  CD1  LEU  D  345    -25.546  74.629  34.806  1.00  25.12    A    C
ATOM  11238  CD2  LEU  D  345    -23.249  74.493  34.394  1.00  26.19    A    C
ATOM  11239  C    LEU  D  345    -23.835  71.049  31.930  1.00  27.67    A    C
```

Appendix 1

```
ATOM  11240  O    LEU D 345     -22.899  70.448  32.314  1.00  26.36      A    O
ATOM  11241  N    GLU D 346     -24.876  70.434  31.413  1.00  27.69      A    N
ATOM  11242  CA   GLU D 346     -24.960  68.978  31.392  1.00  29.20      A    C
ATOM  11243  CB   GLU D 346     -26.417  68.552  31.214  1.00  29.06      A    C
ATOM  11244  CG   GLU D 346     -26.741  67.103  31.433  1.00  31.31      A    C
ATOM  11245  CD   GLU D 346     -28.229  66.809  31.553  1.00  36.33      A    C
ATOM  11246  OE1  GLU D 346     -29.005  67.002  30.624  1.00  39.43      A    O
ATOM  11247  OE2  GLU D 346     -28.646  66.324  32.576  1.00  36.53      A    O-1
ATOM  11248  C    GLU D 346     -23.998  68.186  30.504  1.00  29.11      A    C
ATOM  11249  O    GLU D 346     -23.414  67.272  30.934  1.00  29.50      A    O
ATOM  11250  N    PRO D 347     -23.813  68.571  29.268  1.00  30.31      A    N
ATOM  11251  CA   PRO D 347     -23.034  67.802  28.300  1.00  30.69      A    C
ATOM  11252  CB   PRO D 347     -23.237  68.605  27.049  1.00  29.99      A    C
ATOM  11253  CG   PRO D 347     -24.510  69.176  27.206  1.00  29.68      A    C
ATOM  11254  CD   PRO D 347     -24.736  69.473  28.584  1.00  30.83      A    C
ATOM  11255  C    PRO D 347     -21.542  67.581  28.529  1.00  31.61      A    C
ATOM  11256  O    PRO D 347     -21.041  66.530  28.209  1.00  32.35      A    O
ATOM  11257  N    PRO D 348     -20.860  68.594  29.030  1.00  31.56      A    N
ATOM  11258  CA   PRO D 348     -19.478  68.542  29.464  1.00  30.21      A    C
ATOM  11259  CB   PRO D 348     -19.179  69.987  29.765  1.00  29.48      A    C
ATOM  11260  CG   PRO D 348     -20.413  70.613  29.831  1.00  30.23      A    C
ATOM  11261  CD   PRO D 348     -21.326  69.971  28.981  1.00  30.98      A    C
ATOM  11262  C    PRO D 348     -19.245  67.646  30.655  1.00  29.96      A    C
ATOM  11263  O    PRO D 348     -18.216  67.054  30.805  1.00  30.43      A    O
ATOM  11264  N    ALA D 349     -20.261  67.520  31.467  1.00  29.28      A    N
ATOM  11265  CA   ALA D 349     -20.232  66.640  32.595  1.00  29.38      A    C
ATOM  11266  CB   ALA D 349     -21.227  67.011  33.589  1.00  27.07      A    C
ATOM  11267  C    ALA D 349     -20.331  65.177  32.236  1.00  30.36      A    C
ATOM  11268  O    ALA D 349     -20.053  64.369  33.053  1.00  31.15      A    O
ATOM  11269  N    LYS D 350     -20.676  64.839  31.010  1.00  30.76      A    N
ATOM  11270  CA   LYS D 350     -20.765  63.458  30.594  1.00  30.48      A    C
ATOM  11271  CB   LYS D 350     -19.376  62.867  30.445  1.00  31.52      A    C
ATOM  11276  C    LYS D 350     -21.684  62.519  31.377  1.00  30.40      A    C
ATOM  11277  O    LYS D 350     -21.262  61.624  32.034  1.00  28.98      A    O
ATOM  11278  N    PRO D 351     -22.965  62.747  31.271  1.00  30.07      A    N
ATOM  11279  CA   PRO D 351     -23.947  61.864  31.840  1.00  30.79      A    C
ATOM  11280  CB   PRO D 351     -25.221  62.663  31.685  1.00  30.75      A    C
ATOM  11281  CG   PRO D 351     -24.984  63.568  30.660  1.00  29.48      A    C
ATOM  11282  CD   PRO D 351     -23.583  63.839  30.537  1.00  29.07      A    C
ATOM  11283  C    PRO D 351     -24.044  60.539  31.113  1.00  31.80      A    C
ATOM  11284  O    PRO D 351     -23.918  60.462  29.940  1.00  32.71      A    O
ATOM  11285  N    SER D 352     -24.265  59.485  31.842  1.00  33.19      A    N
ATOM  11286  CA   SER D 352     -24.558  58.227  31.258  1.00  35.07      A    C
ATOM  11287  CB   SER D 352     -23.298  57.445  31.028  1.00  34.71      A    C
ATOM  11288  OG   SER D 352     -22.794  56.940  32.219  1.00  39.80      A    O
ATOM  11289  C    SER D 352     -25.442  57.544  32.242  1.00  35.55      A    C
ATOM  11290  O    SER D 352     -25.399  57.835  33.381  1.00  36.02      A    O
ATOM  11291  N    ILE D 353     -26.248  56.618  31.795  1.00  35.05      A    N
ATOM  11292  CA   ILE D 353     -27.122  55.917  32.677  1.00  34.71      A    C
ATOM  11293  CB   ILE D 353     -28.533  56.025  32.165  1.00  33.55      A    C
ATOM  11294  CG1  ILE D 353     -28.934  57.481  32.234  1.00  31.01      A    C
ATOM  11295  CD1  ILE D 353     -30.318  57.743  32.098  1.00  28.16      A    C
ATOM  11296  CG2  ILE D 353     -29.429  55.165  32.944  1.00  32.41      A    C
ATOM  11297  C    ILE D 353     -26.675  54.503  32.703  1.00  35.84      A    C
```

Appendix 1

```
ATOM  11298  O    ILE D 353     -26.962  53.767  31.828  1.00 37.42     A  O
ATOM  11299  N    VAL D 354     -25.862  54.161  33.670  1.00 36.89     A  N
ATOM  11300  CA   VAL D 354     -25.272  52.857  33.673  1.00 35.98     A  C
ATOM  11301  CB   VAL D 354     -23.949  52.826  34.304  1.00 36.56     A  C
ATOM  11302  CG1  VAL D 354     -23.730  51.505  34.825  1.00 36.27     A  C
ATOM  11303  CG2  VAL D 354     -22.984  53.093  33.270  1.00 35.75     A  C
ATOM  11304  C    VAL D 354     -26.037  51.616  33.975  1.00 35.61     A  C
ATOM  11305  O    VAL D 354     -25.891  50.651  33.278  1.00 39.89     A  O
ATOM  11306  N    SER D 355     -26.849  51.573  34.979  1.00 33.02     A  N
ATOM  11307  CA   SER D 355     -27.705  50.433  34.989  1.00 31.34     A  C
ATOM  11308  CB   SER D 355     -27.103  49.292  35.780  1.00 31.51     A  C
ATOM  11309  OG   SER D 355     -28.038  48.593  36.534  1.00 32.33     A  O
ATOM  11310  C    SER D 355     -28.977  50.889  35.517  1.00 30.42     A  C
ATOM  11311  O    SER D 355     -29.422  50.425  36.498  1.00 29.66     A  O
ATOM  11312  N    ALA D 356     -29.528  51.857  34.825  1.00 30.92     A  N
ATOM  11313  CA   ALA D 356     -30.728  52.563  35.209  1.00 29.99     A  C
ATOM  11314  CB   ALA D 356     -31.779  51.632  35.589  1.00 29.52     A  C
ATOM  11315  C    ALA D 356     -30.443  53.576  36.284  1.00 29.60     A  C
ATOM  11316  O    ALA D 356     -31.313  54.127  36.889  1.00 28.22     A  O
ATOM  11317  N    SER D 357     -29.174  53.840  36.478  1.00 29.18     A  N
ATOM  11318  CA   SER D 357     -28.735  54.817  37.423  1.00 28.88     A  C
ATOM  11319  CB   SER D 357     -27.856  54.143  38.414  1.00 29.78     A  C
ATOM  11320  OG   SER D 357     -28.252  54.355  39.713  1.00 33.59     A  O
ATOM  11321  C    SER D 357     -27.920  55.866  36.722  1.00 29.48     A  C
ATOM  11322  O    SER D 357     -27.098  55.537  35.940  1.00 28.36     A  O
ATOM  11323  N    LEU D 358     -28.156  57.128  37.033  1.00 28.86     A  N
ATOM  11324  CA   LEU D 358     -27.461  58.245  36.437  1.00 27.80     A  C
ATOM  11325  CB   LEU D 358     -28.368  59.462  36.486  1.00 26.28     A  C
ATOM  11326  CG   LEU D 358     -27.982  60.835  35.981  1.00 26.57     A  C
ATOM  11327  CD1  LEU D 358     -27.527  60.785  34.589  1.00 22.74     A  C
ATOM  11328  CD2  LEU D 358     -29.086  61.792  36.140  1.00 20.45     A  C
ATOM  11329  C    LEU D 358     -26.124  58.531  37.088  1.00 28.26     A  C
ATOM  11330  O    LEU D 358     -26.034  58.566  38.254  1.00 29.26     A  O
ATOM  11331  N    ARG D 359     -25.080  58.699  36.304  1.00 29.48     A  N
ATOM  11332  CA   ARG D 359     -23.813  59.182  36.787  1.00 31.08     A  C
ATOM  11333  CB   ARG D 359     -22.785  58.081  36.857  1.00 32.11     A  C
ATOM  11334  CG   ARG D 359     -23.167  56.829  36.166  1.00 40.43     A  C
ATOM  11335  CD   ARG D 359     -22.027  55.877  35.974  1.00 50.20     A  C
ATOM  11336  NE   ARG D 359     -22.131  54.688  36.801  1.00 57.46     A  N
ATOM  11337  CZ   ARG D 359     -21.358  53.624  36.674  1.00 58.55     A  C
ATOM  11338  NH1  ARG D 359     -20.439  53.589  35.743  1.00 57.51     A  N
ATOM  11339  NH2  ARG D 359     -21.514  52.591  37.473  1.00 57.72     A  N
ATOM  11340  C    ARG D 359     -23.309  60.254  35.873  1.00 31.52     A  C
ATOM  11341  O    ARG D 359     -23.694  60.320  34.751  1.00 29.67     A  O
ATOM  11342  N    TYR D 360     -22.472  61.119  36.404  1.00 32.44     A  N
ATOM  11343  CA   TYR D 360     -21.736  62.106  35.642  1.00 33.91     A  C
ATOM  11344  CB   TYR D 360     -22.042  63.522  36.129  1.00 32.66     A  C
ATOM  11345  CG   TYR D 360     -23.409  64.035  35.810  1.00 32.66     A  C
ATOM  11346  CD1  TYR D 360     -23.686  64.625  34.613  1.00 31.88     A  C
ATOM  11347  CE1  TYR D 360     -24.920  65.087  34.331  1.00 31.14     A  C
ATOM  11348  CZ   TYR D 360     -25.906  64.950  35.241  1.00 31.99     A  C
ATOM  11349  OH   TYR D 360     -27.155  65.382  35.002  1.00 26.49     A  O
ATOM  11350  CE2  TYR D 360     -25.648  64.368  36.419  1.00 30.24     A  C
ATOM  11351  CD2  TYR D 360     -24.419  63.921  36.704  1.00 31.01     A  C
```

Appendix 1

```
ATOM  11352  C    TYR D 360     -20.266  61.879  35.804  1.00  34.72      A  C
ATOM  11353  O    TYR D 360     -19.737  61.959  36.858  1.00  35.11      A  O
ATOM  11354  N    GLU D 361     -19.597  61.586  34.731  1.00  36.61      A  N
ATOM  11355  CA   GLU D 361     -18.178  61.672  34.696  1.00  39.14      A  C
ATOM  11356  CB   GLU D 361     -17.739  61.050  33.385  1.00  39.85      A  C
ATOM  11357  CG   GLU D 361     -16.288  60.886  33.183  1.00  47.49      A  C
ATOM  11358  CD   GLU D 361     -15.724  59.709  33.902  1.00  59.40      A  C
ATOM  11359  OE1  GLU D 361     -16.337  59.240  34.869  1.00  60.87      A  O
ATOM  11360  OE2  GLU D 361     -14.650  59.246  33.509  1.00  62.94      A  O-1
ATOM  11361  C    GLU D 361     -17.961  63.171  34.727  1.00  39.07      A  C
ATOM  11362  O    GLU D 361     -18.735  63.901  34.145  1.00  40.30      A  O
ATOM  11363  N    HIS D 362     -16.941  63.668  35.382  1.00  38.29      A  N
ATOM  11364  CA   HIS D 362     -16.739  65.109  35.372  1.00  37.60      A  C
ATOM  11365  CB   HIS D 362     -16.319  65.554  33.990  1.00  38.57      A  C
ATOM  11366  CG   HIS D 362     -15.353  64.647  33.336  1.00  42.72      A  C
ATOM  11367  ND1  HIS D 362     -14.142  64.340  33.895  1.00  47.73      A  N
ATOM  11368  CE1  HIS D 362     -13.504  63.499  33.114  1.00  50.67      A  C
ATOM  11369  NE2  HIS D 362     -14.256  63.260  32.062  1.00  52.17      A  N
ATOM  11370  CD2  HIS D 362     -15.419  63.965  32.178  1.00  47.17      A  C
ATOM  11371  C    HIS D 362     -17.807  66.106  35.818  1.00  35.95      A  C
ATOM  11372  O    HIS D 362     -18.132  66.973  35.076  1.00  34.35      A  O
ATOM  11373  N    PRO D 363     -18.300  66.065  37.035  1.00  35.07      A  N
ATOM  11374  CA   PRO D 363     -19.183  67.137  37.473  1.00  33.41      A  C
ATOM  11375  CB   PRO D 363     -19.635  66.676  38.842  1.00  32.27      A  C
ATOM  11376  CG   PRO D 363     -18.821  65.621  39.196  1.00  33.12      A  C
ATOM  11377  CD   PRO D 363     -18.273  64.989  38.017  1.00  34.82      A  C
ATOM  11378  C    PRO D 363     -18.504  68.488  37.555  1.00  32.91      A  C
ATOM  11379  O    PRO D 363     -17.399  68.605  37.988  1.00  31.91      A  O
ATOM  11380  N    GLY D 364     -19.204  69.504  37.099  1.00  33.05      A  N
ATOM  11381  CA   GLY D 364     -18.731  70.871  36.986  1.00  33.98      A  C
ATOM  11382  C    GLY D 364     -18.378  71.629  38.230  1.00  34.28      A  C
ATOM  11383  O    GLY D 364     -17.579  72.522  38.228  1.00  33.43      A  O
ATOM  11384  N    SER D 365     -19.033  71.256  39.302  1.00  34.62      A  N
ATOM  11385  CA   SER D 365     -18.940  71.953  40.542  1.00  34.09      A  C
ATOM  11386  CB   SER D 365     -19.879  73.119  40.560  1.00  33.01      A  C
ATOM  11387  OG   SER D 365     -21.136  72.746  40.131  1.00  34.25      A  O
ATOM  11388  C    SER D 365     -19.238  71.050  41.674  1.00  34.23      A  C
ATOM  11389  O    SER D 365     -19.382  69.880  41.517  1.00  34.48      A  O
ATOM  11390  N    LEU D 366     -19.261  71.647  42.840  1.00  34.38      A  N
ATOM  11391  CA   LEU D 366     -19.775  71.070  44.029  1.00  33.87      A  C
ATOM  11392  CB   LEU D 366     -19.473  71.992  45.181  1.00  35.10      A  C
ATOM  11393  CG   LEU D 366     -18.461  71.611  46.230  1.00  38.44      A  C
ATOM  11394  CD1  LEU D 366     -17.319  70.949  45.638  1.00  39.37      A  C
ATOM  11395  CD2  LEU D 366     -18.012  72.840  46.802  1.00  42.94      A  C
ATOM  11396  C    LEU D 366     -21.236  71.055  43.836  1.00  32.08      A  C
ATOM  11397  O    LEU D 366     -21.747  71.829  43.107  1.00  31.14      A  O
ATOM  11398  N    LEU D 367     -21.904  70.141  44.480  1.00  30.23      A  N
ATOM  11399  CA   LEU D 367     -23.333  70.144  44.515  1.00  30.39      A  C
ATOM  11400  CB   LEU D 367     -23.842  71.473  45.029  1.00  29.10      A  C
ATOM  11401  CG   LEU D 367     -23.757  71.828  46.488  1.00  27.32      A  C
ATOM  11402  CD1  LEU D 367     -24.302  73.150  46.710  1.00  25.02      A  C
ATOM  11403  CD2  LEU D 367     -24.457  70.844  47.274  1.00  22.05      A  C
ATOM  11404  C    LEU D 367     -23.930  69.910  43.168  1.00  30.64      A  C
ATOM  11405  O    LEU D 367     -25.025  70.288  42.948  1.00  31.42      A  O
```

Appendix 1

```
ATOM  11406  N    PHE D 368     -23.175  69.362  42.241  1.00  30.84      A  N
ATOM  11407  CA   PHE D 368     -23.635  69.259  40.892  1.00  29.11      A  C
ATOM  11408  CB   PHE D 368     -22.475  68.832  40.019  1.00  29.65      A  C
ATOM  11409  CG   PHE D 368     -22.747  68.924  38.579  1.00  30.08      A  C
ATOM  11410  CD1  PHE D 368     -22.607  70.096  37.920  1.00  27.51      A  C
ATOM  11411  CE1  PHE D 368     -22.852  70.168  36.628  1.00  26.77      A  C
ATOM  11412  CZ   PHE D 368     -23.261  69.091  35.968  1.00  26.91      A  C
ATOM  11413  CE2  PHE D 368     -23.423  67.937  36.599  1.00  28.03      A  C
ATOM  11414  CD2  PHE D 368     -23.162  67.842  37.879  1.00  27.91      A  C
ATOM  11415  C    PHE D 368     -24.813  68.359  40.618  1.00  28.10      A  C
ATOM  11416  O    PHE D 368     -25.760  68.805  40.093  1.00  27.94      A  O
ATOM  11417  N    ASP D 369     -24.794  67.112  41.019  1.00  26.72      A  N
ATOM  11418  CA   ASP D 369     -25.963  66.295  40.791  1.00  27.36      A  C
ATOM  11419  CB   ASP D 369     -25.696  64.790  40.957  1.00  28.10      A  C
ATOM  11420  CG   ASP D 369     -25.712  64.330  42.362  1.00  29.97      A  C
ATOM  11421  OD1  ASP D 369     -26.703  63.798  42.796  1.00  29.98      A  O
ATOM  11422  OD2  ASP D 369     -24.702  64.434  43.022  1.00  33.16      A  O-1
ATOM  11423  C    ASP D 369     -27.203  66.780  41.509  1.00  26.29      A  C
ATOM  11424  O    ASP D 369     -28.272  66.647  41.021  1.00  25.68      A  O
ATOM  11425  N    GLU D 370     -27.027  67.312  42.692  1.00  25.86      A  N
ATOM  11426  CA   GLU D 370     -28.119  67.807  43.457  1.00  25.17      A  C
ATOM  11427  CB   GLU D 370     -27.595  68.193  44.831  1.00  25.62      A  C
ATOM  11428  CG   GLU D 370     -27.076  67.072  45.665  1.00  29.17      A  C
ATOM  11429  CD   GLU D 370     -25.599  67.005  45.716  1.00  34.11      A  C
ATOM  11430  OE1  GLU D 370     -24.983  67.328  44.745  1.00  37.60      A  O
ATOM  11431  OE2  GLU D 370     -25.033  66.613  46.713  1.00  33.91      A  O-1
ATOM  11432  C    GLU D 370     -28.852  68.980  42.874  1.00  23.92      A  C
ATOM  11433  O    GLU D 370     -30.016  68.976  42.814  1.00  23.90      A  O
ATOM  11434  N    LEU D 371     -28.166  70.012  42.479  1.00  23.72      A  N
ATOM  11435  CA   LEU D 371     -28.820  71.172  41.911  1.00  24.11      A  C
ATOM  11436  CB   LEU D 371     -27.838  72.320  41.844  1.00  25.26      A  C
ATOM  11437  CG   LEU D 371     -27.921  73.498  42.793  1.00  23.73      A  C
ATOM  11438  CD1  LEU D 371     -28.410  73.202  44.119  1.00  13.06      A  C
ATOM  11439  CD2  LEU D 371     -26.585  73.984  42.869  1.00  24.19      A  C
ATOM  11440  C    LEU D 371     -29.517  70.939  40.580  1.00  24.64      A  C
ATOM  11441  O    LEU D 371     -30.561  71.449  40.335  1.00  25.10      A  O
ATOM  11442  N    LEU D 372     -28.886  70.150  39.739  1.00  22.62      A  N
ATOM  11443  CA   LEU D 372     -29.433  69.656  38.518  1.00  23.79      A  C
ATOM  11444  CB   LEU D 372     -28.363  68.904  37.752  1.00  24.25      A  C
ATOM  11445  CG   LEU D 372     -27.886  69.554  36.477  1.00  22.09      A  C
ATOM  11446  CD1  LEU D 372     -27.200  70.746  36.784  1.00  18.88      A  C
ATOM  11447  CD2  LEU D 372     -26.975  68.678  35.849  1.00  28.02      A  C
ATOM  11448  C    LEU D 372     -30.637  68.768  38.702  1.00  24.70      A  C
ATOM  11449  O    LEU D 372     -31.522  68.801  37.934  1.00  24.62      A  O
ATOM  11450  N    PHE D 373     -30.644  67.942  39.709  1.00  23.79      A  N
ATOM  11451  CA   PHE D 373     -31.807  67.186  40.001  1.00  24.34      A  C
ATOM  11452  CB   PHE D 373     -31.498  66.213  41.145  1.00  23.79      A  C
ATOM  11453  CG   PHE D 373     -32.688  65.672  41.856  1.00  25.07      A  C
ATOM  11454  CD1  PHE D 373     -33.558  64.835  41.235  1.00  23.39      A  C
ATOM  11455  CE1  PHE D 373     -34.609  64.342  41.888  1.00  23.53      A  C
ATOM  11456  CZ   PHE D 373     -34.815  64.666  43.171  1.00  27.52      A  C
ATOM  11457  CE2  PHE D 373     -33.969  65.479  43.800  1.00  26.24      A  C
ATOM  11458  CD2  PHE D 373     -32.919  65.987  43.162  1.00  26.30      A  C
ATOM  11459  C    PHE D 373     -32.874  68.125  40.376  1.00  23.74      A  C
```

Appendix 1

```
ATOM  11460  O    PHE D 373     -33.941  68.050  39.911  1.00  24.61      A  O
ATOM  11461  N    LEU D 374     -32.563  69.033  41.245  1.00  23.65      A  N
ATOM  11462  CA   LEU D 374     -33.552  69.939  41.738  1.00  25.00      A  C
ATOM  11463  CB   LEU D 374     -32.981  70.718  42.910  1.00  22.88      A  C
ATOM  11464  CG   LEU D 374     -33.578  72.008  43.383  1.00  23.67      A  C
ATOM  11465  CD1  LEU D 374     -34.942  71.834  43.860  1.00  19.16      A  C
ATOM  11466  CD2  LEU D 374     -32.726  72.608  44.400  1.00  19.96      A  C
ATOM  11467  C    LEU D 374     -34.127  70.833  40.658  1.00  25.68      A  C
ATOM  11468  O    LEU D 374     -35.304  71.026  40.586  1.00  26.74      A  O
ATOM  11469  N    ALA D 375     -33.289  71.345  39.792  1.00  25.28      A  N
ATOM  11470  CA   ALA D 375     -33.753  72.224  38.762  1.00  25.28      A  C
ATOM  11471  CB   ALA D 375     -32.611  72.758  38.025  1.00  24.38      A  C
ATOM  11472  C    ALA D 375     -34.715  71.550  37.826  1.00  25.23      A  C
ATOM  11473  O    ALA D 375     -35.732  72.071  37.503  1.00  25.61      A  O
ATOM  11474  N    LYS D 376     -34.386  70.341  37.443  1.00  25.12      A  N
ATOM  11475  CA   LYS D 376     -35.175  69.534  36.559  1.00  23.91      A  C
ATOM  11476  CB   LYS D 376     -34.441  68.267  36.309  1.00  23.36      A  C
ATOM  11477  CG   LYS D 376     -33.355  68.414  35.394  1.00  22.93      A  C
ATOM  11478  CD   LYS D 376     -32.577  67.197  35.306  1.00  16.63      A  C
ATOM  11479  CE   LYS D 376     -31.504  67.471  34.391  1.00  21.38      A  C
ATOM  11480  NZ   LYS D 376     -30.798  66.294  34.045  1.00  30.36      A  N
ATOM  11481  C    LYS D 376     -36.549  69.187  37.038  1.00  24.83      A  C
ATOM  11482  O    LYS D 376     -37.438  69.088  36.252  1.00  25.73      A  O
ATOM  11483  N    VAL D 377     -36.719  68.990  38.328  1.00  23.60      A  N
ATOM  11484  CA   VAL D 377     -38.002  68.647  38.861  1.00  22.38      A  C
ATOM  11485  CB   VAL D 377     -37.936  67.492  39.854  1.00  22.96      A  C
ATOM  11486  CG1  VAL D 377     -37.440  66.295  39.213  1.00  22.41      A  C
ATOM  11487  CG2  VAL D 377     -37.144  67.814  41.010  1.00  22.04      A  C
ATOM  11488  C    VAL D 377     -38.775  69.768  39.455  1.00  22.66      A  C
ATOM  11489  O    VAL D 377     -39.902  69.609  39.724  1.00  22.72      A  O
ATOM  11490  N    HIS D 378     -38.195  70.927  39.603  1.00  24.61      A  N
ATOM  11491  CA   HIS D 378     -38.743  71.944  40.481  1.00  25.22      A  C
ATOM  11492  CB   HIS D 378     -37.657  72.964  40.794  1.00  25.07      A  C
ATOM  11493  CG   HIS D 378     -38.064  74.063  41.727  1.00  22.62      A  C
ATOM  11494  ND1  HIS D 378     -38.315  73.865  43.054  1.00  19.49      A  N
ATOM  11495  CE1  HIS D 378     -38.613  75.008  43.621  1.00  21.08      A  C
ATOM  11496  NE2  HIS D 378     -38.538  75.947  42.715  1.00  21.82      A  N
ATOM  11497  CD2  HIS D 378     -38.177  75.388  41.529  1.00  23.76      A  C
ATOM  11498  C    HIS D 378     -39.998  72.650  40.058  1.00  26.54      A  C
ATOM  11499  O    HIS D 378     -40.055  73.285  39.054  1.00  28.14      A  O
ATOM  11500  N    ALA D 379     -41.000  72.541  40.906  1.00  26.60      A  N
ATOM  11501  CA   ALA D 379     -42.338  73.000  40.655  1.00  27.01      A  C
ATOM  11502  CB   ALA D 379     -43.280  72.044  41.248  1.00  25.96      A  C
ATOM  11503  C    ALA D 379     -42.635  74.411  41.126  1.00  28.09      A  C
ATOM  11504  O    ALA D 379     -43.670  74.966  40.866  1.00  27.81      A  O
ATOM  11505  N    GLY D 380     -41.696  74.983  41.837  1.00  28.69      A  N
ATOM  11506  CA   GLY D 380     -41.851  76.280  42.418  1.00  29.39      A  C
ATOM  11507  C    GLY D 380     -42.159  76.250  43.887  1.00  30.94      A  C
ATOM  11508  O    GLY D 380     -42.883  75.440  44.369  1.00  30.16      A  O
ATOM  11509  N    PHE D 381     -41.567  77.182  44.586  1.00  31.03      A  N
ATOM  11510  CA   PHE D 381     -41.702  77.289  45.998  1.00  30.68      A  C
ATOM  11511  CB   PHE D 381     -40.674  78.237  46.570  1.00  29.83      A  C
ATOM  11512  CG   PHE D 381     -39.316  77.678  46.557  1.00  26.80      A  C
ATOM  11513  CD1  PHE D 381     -39.050  76.522  47.188  1.00  28.27      A  C
```

Appendix 1

```
ATOM  11514  CE1  PHE D 381   -37.838  76.014  47.140  1.00  29.93    A  C
ATOM  11515  CZ   PHE D 381   -36.884  76.622  46.457  1.00  25.32    A  C
ATOM  11516  CE2  PHE D 381   -37.123  77.728  45.824  1.00  26.28    A  C
ATOM  11517  CD2  PHE D 381   -38.322  78.263  45.858  1.00  23.93    A  C
ATOM  11518  C    PHE D 381   -43.090  77.584  46.443  1.00  31.32    A  C
ATOM  11519  O    PHE D 381   -43.527  77.064  47.417  1.00  31.88    A  O
ATOM  11520  N    GLY D 382   -43.781  78.418  45.706  1.00  31.45    A  N
ATOM  11521  CA   GLY D 382   -45.165  78.693  45.966  1.00  30.89    A  C
ATOM  11522  C    GLY D 382   -46.056  77.503  45.804  1.00  31.82    A  C
ATOM  11523  O    GLY D 382   -46.962  77.317  46.537  1.00  32.85    A  O
ATOM  11524  N    ALA D 383   -45.810  76.702  44.803  1.00  31.33    A  N
ATOM  11525  CA   ALA D 383   -46.534  75.466  44.624  1.00  31.14    A  C
ATOM  11526  CB   ALA D 383   -46.290  74.901  43.309  1.00  29.90    A  C
ATOM  11527  C    ALA D 383   -46.282  74.442  45.683  1.00  32.51    A  C
ATOM  11528  O    ALA D 383   -47.121  73.654  45.966  1.00  34.51    A  O
ATOM  11529  N    LEU D 384   -45.078  74.407  46.209  1.00  32.96    A  N
ATOM  11530  CA   LEU D 384   -44.735  73.498  47.267  1.00  31.40    A  C
ATOM  11531  CB   LEU D 384   -43.257  73.559  47.565  1.00  31.33    A  C
ATOM  11532  CG   LEU D 384   -42.284  72.891  46.620  1.00  29.54    A  C
ATOM  11533  CD1  LEU D 384   -40.920  73.306  46.883  1.00  21.25    A  C
ATOM  11534  CD2  LEU D 384   -42.375  71.452  46.692  1.00  30.65    A  C
ATOM  11535  C    LEU D 384   -45.562  73.815  48.488  1.00  31.74    A  C
ATOM  11536  O    LEU D 384   -46.066  72.937  49.126  1.00  32.18    A  O
ATOM  11537  N    LEU D 385   -45.750  75.094  48.740  1.00  30.94    A  N
ATOM  11538  CA   LEU D 385   -46.519  75.624  49.827  1.00  31.76    A  C
ATOM  11539  CB   LEU D 385   -46.460  77.122  49.746  1.00  32.76    A  C
ATOM  11540  CG   LEU D 385   -45.816  78.018  50.793  1.00  33.85    A  C
ATOM  11541  CD1  LEU D 385   -45.344  77.312  51.957  1.00  31.00    A  C
ATOM  11542  CD2  LEU D 385   -44.744  78.828  50.217  1.00  31.02    A  C
ATOM  11543  C    LEU D 385   -47.956  75.197  49.747  1.00  32.95    A  C
ATOM  11544  O    LEU D 385   -48.568  74.892  50.720  1.00  31.04    A  O
ATOM  11545  N    ARG D 386   -48.472  75.127  48.543  1.00  34.94    A  N
ATOM  11546  CA   ARG D 386   -49.853  74.807  48.322  1.00  36.95    A  C
ATOM  11547  CB   ARG D 386   -50.458  75.669  47.234  1.00  37.32    A  C
ATOM  11548  CG   ARG D 386   -50.442  77.117  47.569  1.00  43.50    A  C
ATOM  11549  CD   ARG D 386   -51.374  77.945  46.766  1.00  54.62    A  C
ATOM  11550  NE   ARG D 386   -50.708  78.846  45.834  1.00  62.58    A  N
ATOM  11551  CZ   ARG D 386   -49.575  79.497  46.060  1.00  67.17    A  C
ATOM  11552  NH1  ARG D 386   -48.944  79.375  47.205  1.00  66.41    A  N
ATOM  11553  NH2  ARG D 386   -49.070  80.281  45.124  1.00  67.09    A  N
ATOM  11554  C    ARG D 386   -50.071  73.349  48.059  1.00  36.94    A  C
ATOM  11555  O    ARG D 386   -51.056  72.975  47.551  1.00  37.55    A  O
ATOM  11556  N    MET D 387   -49.136  72.519  48.444  1.00  39.68    A  N
ATOM  11557  CA   MET D 387   -49.197  71.106  48.189  1.00  40.55    A  C
ATOM  11558  CB   MET D 387   -47.904  70.504  48.677  1.00  39.35    D  C
ATOM  11559  CG   MET D 387   -47.818  69.033  48.588  1.00  40.22    D  C
ATOM  11560  SD   MET D 387   -46.202  68.450  48.950  1.00  44.10    D  S
ATOM  11561  CE   MET D 387   -46.292  66.927  48.144  1.00  45.19    D  C
ATOM  11562  C    MET D 387   -50.367  70.381  48.827  1.00  42.31    A  C
ATOM  11563  O    MET D 387   -50.647  70.503  49.994  1.00  41.55    A  O
ATOM  11564  N    PRO D 388   -51.024  69.558  48.040  1.00  44.81    A  N
ATOM  11565  CA   PRO D 388   -52.204  68.834  48.476  1.00  46.11    A  C
ATOM  11566  CB   PRO D 388   -52.717  68.226  47.187  1.00  45.45    A  C
ATOM  11567  CG   PRO D 388   -52.183  69.024  46.161  1.00  45.06    A  C
```

Appendix 1

```
ATOM  11568  CD   PRO D 388     -50.892  69.519  46.586  1.00 45.25      A  C
ATOM  11569  C    PRO D 388     -51.869  67.751  49.425  1.00 47.45      A  C
ATOM  11570  O    PRO D 388     -50.808  67.234  49.376  1.00 47.35      A  O
ATOM  11571  N    PRO D 389     -52.811  67.349  50.240  1.00 49.57      A  N
ATOM  11572  CA   PRO D 389     -52.558  66.690  51.502  1.00 50.04      A  C
ATOM  11573  CB   PRO D 389     -53.891  66.813  52.178  1.00 49.53      A  C
ATOM  11574  CG   PRO D 389     -54.381  68.062  51.730  1.00 50.18      A  C
ATOM  11575  CD   PRO D 389     -53.831  68.377  50.404  1.00 50.05      A  C
ATOM  11576  C    PRO D 389     -52.118  65.259  51.568  1.00 52.03      A  C
ATOM  11577  O    PRO D 389     -51.337  64.956  52.435  1.00 53.25      A  O
ATOM  11578  N    PRO D 390     -52.631  64.379  50.750  1.00 52.89      A  N
ATOM  11579  CA   PRO D 390     -52.422  62.963  50.997  1.00 53.39      A  C
ATOM  11580  CB   PRO D 390     -52.794  62.319  49.677  1.00 53.16      A  C
ATOM  11581  CG   PRO D 390     -53.538  63.317  48.967  1.00 55.28      A  C
ATOM  11582  CD   PRO D 390     -52.964  64.618  49.358  1.00 53.69      A  C
ATOM  11583  C    PRO D 390     -50.985  62.687  51.330  1.00 53.34      A  C
ATOM  11584  O    PRO D 390     -50.631  62.771  52.485  1.00 52.96      A  O
ATOM  11585  N    LEU E  29     -57.579  11.566  57.718  1.00 53.84      A  N
ATOM  11586  CA   LEU E  29     -58.989  11.698  58.021  1.00 55.07      A  C
ATOM  11587  CB   LEU E  29     -59.123  12.793  59.041  1.00 55.55      A  C
ATOM  11588  CG   LEU E  29     -60.084  12.586  60.178  1.00 58.19      A  C
ATOM  11589  CD1  LEU E  29     -59.296  12.242  61.379  1.00 60.41      A  C
ATOM  11590  CD2  LEU E  29     -60.839  13.845  60.410  1.00 59.69      A  C
ATOM  11591  C    LEU E  29     -59.861  12.053  56.822  1.00 54.45      A  C
ATOM  11592  O    LEU E  29     -59.627  13.078  56.225  1.00 54.16      A  O
ATOM  11593  N    PRO E  30     -60.883  11.239  56.519  1.00 53.98      A  N
ATOM  11594  CA   PRO E  30     -61.780  11.415  55.378  1.00 53.69      A  C
ATOM  11595  CB   PRO E  30     -61.332  10.274  54.475  1.00 54.34      A  C
ATOM  11596  CG   PRO E  30     -60.975   9.258  55.366  1.00 53.05      A  C
ATOM  11597  CD   PRO E  30     -60.284   9.908  56.485  1.00 53.66      A  C
ATOM  11598  C    PRO E  30     -63.241  11.190  55.784  1.00 52.90      A  C
ATOM  11599  O    PRO E  30     -63.367  10.625  56.840  1.00 54.12      A  O
ATOM  11600  N    PRO E  31     -64.262  11.477  54.970  1.00 50.89      A  N
ATOM  11601  CA   PRO E  31     -65.662  11.385  55.416  1.00 49.09      A  C
ATOM  11602  CB   PRO E  31     -65.895  12.764  55.963  1.00 49.31      A  C
ATOM  11603  CG   PRO E  31     -64.901  13.603  55.229  1.00 50.80      A  C
ATOM  11604  CD   PRO E  31     -63.706  12.806  55.176  1.00 51.18      A  C
ATOM  11605  C    PRO E  31     -66.785  11.083  54.399  1.00 47.37      A  C
ATOM  11606  O    PRO E  31     -67.469  11.994  54.064  1.00 48.56      A  O
ATOM  11607  N    GLY E  32     -67.018   9.866  53.949  1.00 44.65      A  N
ATOM  11608  CA   GLY E  32     -67.934   9.606  52.855  1.00 40.19      A  C
ATOM  11609  C    GLY E  32     -67.172   9.528  51.551  1.00 38.19      A  C
ATOM  11610  O    GLY E  32     -67.674   9.141  50.527  1.00 35.82      A  O
ATOM  11611  N    ARG E  33     -65.904   9.896  51.655  1.00 36.23      A  N
ATOM  11612  CA   ARG E  33     -64.868   9.747  50.655  1.00 34.86      A  C
ATOM  11613  CB   ARG E  33     -63.875  10.848  50.841  1.00 33.68      A  C
ATOM  11614  CG   ARG E  33     -64.475  12.136  50.967  1.00 30.09      A  C
ATOM  11615  CD   ARG E  33     -64.093  12.968  49.840  1.00 28.96      A  C
ATOM  11616  NE   ARG E  33     -62.700  12.826  49.557  1.00 26.24      A  N
ATOM  11617  CZ   ARG E  33     -61.810  13.757  49.755  1.00 21.96      A  C
ATOM  11618  NH1  ARG E  33     -62.188  14.897  50.211  1.00 27.95      A  N
ATOM  11619  NH2  ARG E  33     -60.563  13.540  49.480  1.00 21.10      A  N
ATOM  11620  C    ARG E  33     -64.106   8.451  50.668  1.00 35.52      A  C
ATOM  11621  O    ARG E  33     -64.127   7.735  51.616  1.00 35.84      A  O
```

Appendix 1

```
ATOM  11622  N    LEU E  34     -63.542   8.110  49.534  1.00 36.14      A  N
ATOM  11623  CA   LEU E  34     -62.554   7.055  49.370  1.00 35.35      A  C
ATOM  11624  CB   LEU E  34     -62.545   6.610  47.926  1.00 35.76      A  C
ATOM  11625  CG   LEU E  34     -63.737   5.821  47.431  1.00 34.55      A  C
ATOM  11626  CD1  LEU E  34     -64.856   6.061  48.285  1.00 34.34      A  C
ATOM  11627  CD2  LEU E  34     -64.079   6.215  46.084  1.00 31.80      A  C
ATOM  11628  C    LEU E  34     -61.128   7.259  49.848  1.00 35.03      A  C
ATOM  11629  O    LEU E  34     -60.573   6.407  50.474  1.00 35.49      A  O
ATOM  11630  N    ALA E  35     -60.512   8.362  49.486  1.00 33.43      A  N
ATOM  11631  CA   ALA E  35     -59.136   8.580  49.825  1.00 33.28      A  C
ATOM  11632  CB   ALA E  35     -58.284   8.297  48.687  1.00 32.51      A  C
ATOM  11633  C    ALA E  35     -58.946   9.988  50.283  1.00 33.74      A  C
ATOM  11634  O    ALA E  35     -59.746  10.805  50.001  1.00 34.36      A  O
ATOM  11635  N    THR E  36     -57.893  10.265  51.020  1.00 33.19      A  N
ATOM  11636  CA   THR E  36     -57.652  11.616  51.475  1.00 34.12      A  C
ATOM  11637  CB   THR E  36     -56.707  11.727  52.686  1.00 35.00      A  C
ATOM  11638  OG1  THR E  36     -55.661  10.786  52.598  1.00 36.41      A  O
ATOM  11639  CG2  THR E  36     -57.431  11.461  53.922  1.00 35.47      A  C
ATOM  11640  C    THR E  36     -57.115  12.456  50.380  1.00 33.66      A  C
ATOM  11641  O    THR E  36     -56.505  11.975  49.487  1.00 34.83      A  O
ATOM  11642  N    THR E  37     -57.323  13.739  50.496  1.00 32.07      A  N
ATOM  11643  CA   THR E  37     -56.816  14.695  49.568  1.00 31.25      A  C
ATOM  11644  CB   THR E  37     -57.350  16.076  49.898  1.00 32.01      A  C
ATOM  11645  OG1  THR E  37     -58.726  16.113  49.596  1.00 30.65      A  O
ATOM  11646  CG2  THR E  37     -56.702  17.117  49.108  1.00 29.23      A  C
ATOM  11647  C    THR E  37     -55.306  14.644  49.574  1.00 33.12      A  C
ATOM  11648  O    THR E  37     -54.678  14.906  48.608  1.00 33.83      A  O
ATOM  11649  N    GLU E  38     -54.732  14.335  50.710  1.00 34.62      E  N
ATOM  11650  CA   GLU E  38     -53.315  14.237  50.856  1.00 35.82      E  C
ATOM  11651  CB   GLU E  38     -52.971  14.076  52.331  1.00 37.99      E  C
ATOM  11652  CG   GLU E  38     -51.508  14.165  52.679  1.00 45.22      E  C
ATOM  11653  CD   GLU E  38     -51.180  13.490  53.982  1.00 53.50      E  C
ATOM  11654  OE1  GLU E  38     -51.893  12.544  54.339  1.00 55.30      E  O
ATOM  11655  OE2  GLU E  38     -50.221  13.904  54.656  1.00 51.39      E  O
ATOM  11656  C    GLU E  38     -52.804  13.096  50.058  1.00 34.63      E  C
ATOM  11657  O    GLU E  38     -51.774  13.174  49.475  1.00 34.54      E  O
ATOM  11658  N    ASP E  39     -53.541  12.014  50.069  1.00 33.34      E  N
ATOM  11659  CA   ASP E  39     -53.199  10.854  49.302  1.00 32.35      E  C
ATOM  11660  CB   ASP E  39     -54.127   9.692  49.638  1.00 31.80      E  C
ATOM  11661  CG   ASP E  39     -53.802   9.031  50.944  1.00 35.74      E  C
ATOM  11662  OD1  ASP E  39     -52.722   9.253  51.478  1.00 37.27      E  O
ATOM  11663  OD2  ASP E  39     -54.617   8.263  51.446  1.00 36.98      E  O
ATOM  11664  C    ASP E  39     -53.221  11.128  47.814  1.00 30.78      E  C
ATOM  11665  O    ASP E  39     -52.330  10.735  47.149  1.00 30.99      E  O
ATOM  11666  N    TYR E  40     -54.218  11.827  47.297  1.00 27.97      A  N
ATOM  11667  CA   TYR E  40     -54.262  12.156  45.874  1.00 26.87      A  C
ATOM  11668  CB   TYR E  40     -55.544  12.861  45.503  1.00 25.99      A  C
ATOM  11669  CG   TYR E  40     -56.752  12.030  45.617  1.00 22.17      A  C
ATOM  11670  CD1  TYR E  40     -56.822  10.798  45.032  1.00 17.45      A  C
ATOM  11671  CE1  TYR E  40     -57.900  10.051  45.162  1.00 13.43      A  C
ATOM  11672  CZ   TYR E  40     -58.923  10.506  45.872  1.00 15.96      A  C
ATOM  11673  OH   TYR E  40     -60.032   9.792  46.009  1.00 14.32      A  O
ATOM  11674  CE2  TYR E  40     -58.872  11.707  46.451  1.00 18.90      A  C
ATOM  11675  CD2  TYR E  40     -57.817  12.459  46.325  1.00 16.33      A  C
```

Appendix 1

```
ATOM  11676  C    TYR E  40     -53.138  13.026  45.425  1.00 27.26      A   C
ATOM  11677  O    TYR E  40     -52.568  12.808  44.410  1.00 28.47      A   O
ATOM  11678  N    PHE E  41     -52.833  14.028  46.214  1.00 27.33      A   N
ATOM  11679  CA   PHE E  41     -51.741  14.935  45.997  1.00 27.24      A   C
ATOM  11680  CB   PHE E  41     -51.899  16.119  46.902  1.00 27.22      A   C
ATOM  11681  CG   PHE E  41     -52.759  17.197  46.351  1.00 28.27      A   C
ATOM  11682  CD1  PHE E  41     -52.227  18.367  45.956  1.00 26.13      A   C
ATOM  11683  CE1  PHE E  41     -52.983  19.314  45.507  1.00 24.18      A   C
ATOM  11684  CZ   PHE E  41     -54.286  19.131  45.413  1.00 22.94      A   C
ATOM  11685  CE2  PHE E  41     -54.836  17.997  45.795  1.00 18.99      A   C
ATOM  11686  CD2  PHE E  41     -54.092  17.044  46.249  1.00 25.06      A   C
ATOM  11687  C    PHE E  41     -50.385  14.293  46.172  1.00 27.12      A   C
ATOM  11688  O    PHE E  41     -49.398  14.784  45.716  1.00 27.48      A   O
ATOM  11689  N    ALA E  42     -50.344  13.176  46.838  1.00 26.09      A   N
ATOM  11690  CA   ALA E  42     -49.099  12.524  47.070  1.00 27.26      A   C
ATOM  11691  CB   ALA E  42     -49.064  12.042  48.422  1.00 26.83      A   C
ATOM  11692  C    ALA E  42     -48.776  11.402  46.121  1.00 28.87      A   C
ATOM  11693  O    ALA E  42     -47.770  10.786  46.262  1.00 30.30      A   O
ATOM  11694  N    GLN E  43     -49.636  11.142  45.159  1.00 29.70      A   N
ATOM  11695  CA   GLN E  43     -49.527  10.003  44.288  1.00 29.84      A   C
ATOM  11696  CB   GLN E  43     -50.720   9.976  43.360  1.00 30.06      A   C
ATOM  11697  CG   GLN E  43     -51.858   9.138  43.781  1.00 28.43      A   C
ATOM  11698  CD   GLN E  43     -53.121   9.458  43.068  1.00 29.27      A   C
ATOM  11699  OE1  GLN E  43     -53.477  10.583  42.944  1.00 30.44      A   O
ATOM  11700  NE2  GLN E  43     -53.795   8.463  42.592  1.00 25.48      A   N
ATOM  11701  C    GLN E  43     -48.280  10.024  43.470  1.00 30.72      A   C
ATOM  11702  O    GLN E  43     -47.677   9.042  43.276  1.00 31.82      A   O
ATOM  11703  N    GLN E  44     -47.909  11.164  42.949  1.00 32.86      A   N
ATOM  11704  CA   GLN E  44     -46.694  11.298  42.210  1.00 33.40      A   C
ATOM  11705  CB   GLN E  44     -46.658  12.689  41.658  1.00 33.14      A   C
ATOM  11706  CG   GLN E  44     -45.456  13.011  40.897  1.00 38.67      A   C
ATOM  11707  CD   GLN E  44     -45.739  13.732  39.644  1.00 45.57      A   C
ATOM  11708  OE1  GLN E  44     -46.601  14.587  39.579  1.00 44.06      A   O
ATOM  11709  NE2  GLN E  44     -44.993  13.410  38.631  1.00 49.03      A   N
ATOM  11710  C    GLN E  44     -45.455  11.073  43.007  1.00 33.70      A   C
ATOM  11711  O    GLN E  44     -44.572  10.406  42.588  1.00 33.26      A   O
ATOM  11712  N    ALA E  45     -45.374  11.660  44.171  1.00 33.72      A   N
ATOM  11713  CA   ALA E  45     -44.202  11.495  44.967  1.00 33.71      A   C
ATOM  11714  CB   ALA E  45     -44.312  12.337  46.141  1.00 33.34      A   C
ATOM  11715  C    ALA E  45     -44.049  10.045  45.351  1.00 34.95      A   C
ATOM  11716  O    ALA E  45     -42.990   9.489  45.261  1.00 36.19      A   O
ATOM  11717  N    LYS E  46     -45.135   9.417  45.737  1.00 34.00      A   N
ATOM  11718  CA   LYS E  46     -45.148   8.016  46.045  1.00 34.62      A   C
ATOM  11719  CB   LYS E  46     -46.399   7.685  46.805  1.00 34.94      A   C
ATOM  11720  CG   LYS E  46     -46.314   8.062  48.230  1.00 38.62      A   C
ATOM  11721  CD   LYS E  46     -47.650   8.223  48.828  1.00 41.19      A   C
ATOM  11722  CE   LYS E  46     -47.561   8.834  50.162  1.00 46.75      A   C
ATOM  11723  NZ   LYS E  46     -48.720   8.479  50.995  1.00 52.64      A   N
ATOM  11724  C    LYS E  46     -45.015   7.071  44.867  1.00 34.93      A   C
ATOM  11725  O    LYS E  46     -44.897   5.896  45.046  1.00 33.82      A   O
ATOM  11726  N    GLN E  47     -45.103   7.586  43.660  1.00 34.04      A   N
ATOM  11727  CA   GLN E  47     -45.119   6.784  42.454  1.00 34.67      A   C
ATOM  11728  CB   GLN E  47     -43.777   6.167  42.199  1.00 33.68      A   C
ATOM  11729  CG   GLN E  47     -42.698   7.142  42.207  1.00 39.80      A   C
```

Appendix 1

```
ATOM  11730  CD   GLN E  47    -41.632   6.841  41.220  1.00  48.98      A  C
ATOM  11731  OE1  GLN E  47    -40.767   6.016  41.450  1.00  49.62      A  O
ATOM  11732  NE2  GLN E  47    -41.672   7.528  40.103  1.00  49.25      A  N
ATOM  11733  C    GLN E  47    -46.191   5.721  42.379  1.00  33.75      A  C
ATOM  11734  O    GLN E  47    -45.963   4.688  41.860  1.00  34.51      A  O
ATOM  11735  N    ALA E  48    -47.354   5.973  42.926  1.00  32.47      A  N
ATOM  11736  CA   ALA E  48    -48.423   5.023  42.869  1.00  31.40      A  C
ATOM  11737  CB   ALA E  48    -48.253   4.042  43.925  1.00  31.27      A  C
ATOM  11738  C    ALA E  48    -49.756   5.701  43.006  1.00  31.17      A  C
ATOM  11739  O    ALA E  48    -49.867   6.691  43.655  1.00  31.63      A  O
ATOM  11740  N    VAL E  49    -50.752   5.144  42.353  1.00  29.15      A  N
ATOM  11741  CA   VAL E  49    -52.090   5.636  42.420  1.00  27.39      A  C
ATOM  11742  CB   VAL E  49    -52.891   5.352  41.135  1.00  28.21      A  C
ATOM  11743  CG1  VAL E  49    -52.321   6.010  39.983  1.00  25.56      A  C
ATOM  11744  CG2  VAL E  49    -53.056   3.941  40.885  1.00  23.53      A  C
ATOM  11745  C    VAL E  49    -52.815   5.094  43.618  1.00  29.34      A  C
ATOM  11746  O    VAL E  49    -52.533   4.045  44.121  1.00  30.41      A  O
ATOM  11747  N    THR E  50    -53.804   5.817  44.054  1.00  29.44      A  N
ATOM  11748  CA   THR E  50    -54.587   5.360  45.130  1.00  29.55      A  C
ATOM  11749  CB   THR E  50    -55.451   6.455  45.679  1.00  28.82      A  C
ATOM  11750  OG1  THR E  50    -56.533   6.670  44.819  1.00  30.17      A  O
ATOM  11751  CG2  THR E  50    -54.714   7.672  45.747  1.00  28.47      A  C
ATOM  11752  C    THR E  50    -55.398   4.199  44.647  1.00  30.27      A  C
ATOM  11753  O    THR E  50    -55.579   4.016  43.500  1.00  29.81      A  O
ATOM  11754  N    PRO E  51    -55.863   3.398  45.573  1.00  31.14      A  N
ATOM  11755  CA   PRO E  51    -56.594   2.199  45.263  1.00  31.70      A  C
ATOM  11756  CB   PRO E  51    -56.847   1.617  46.638  1.00  31.54      A  C
ATOM  11757  CG   PRO E  51    -55.813   2.113  47.431  1.00  28.28      A  C
ATOM  11758  CD   PRO E  51    -55.558   3.453  46.998  1.00  30.95      A  C
ATOM  11759  C    PRO E  51    -57.880   2.472  44.554  1.00  32.31      A  C
ATOM  11760  O    PRO E  51    -58.309   1.695  43.764  1.00  34.84      A  O
ATOM  11761  N    ASP E  52    -58.536   3.539  44.906  1.00  30.64      A  N
ATOM  11762  CA   ASP E  52    -59.695   3.951  44.187  1.00  30.47      A  C
ATOM  11763  CB   ASP E  52    -60.556   4.886  45.011  1.00  29.96      A  C
ATOM  11764  CG   ASP E  52    -59.926   6.179  45.259  1.00  33.55      A  C
ATOM  11765  OD1  ASP E  52    -58.781   6.237  45.644  1.00  32.61      A  O
ATOM  11766  OD2  ASP E  52    -60.614   7.153  45.111  1.00  38.81      A  O-1
ATOM  11767  C    ASP E  52    -59.435   4.420  42.763  1.00  29.37      A  C
ATOM  11768  O    ASP E  52    -60.235   4.246  41.902  1.00  28.73      A  O
ATOM  11769  N    VAL E  53    -58.308   5.045  42.545  1.00  27.63      A  N
ATOM  11770  CA   VAL E  53    -57.913   5.394  41.221  1.00  26.91      A  C
ATOM  11771  CB   VAL E  53    -56.758   6.386  41.194  1.00  28.11      A  C
ATOM  11772  CG1  VAL E  53    -56.158   6.481  39.868  1.00  23.23      A  C
ATOM  11773  CG2  VAL E  53    -57.240   7.685  41.598  1.00  23.32      A  C
ATOM  11774  C    VAL E  53    -57.666   4.158  40.404  1.00  27.29      A  C
ATOM  11775  O    VAL E  53    -57.994   4.125  39.277  1.00  28.32      A  O
ATOM  11776  N    MET E  54    -57.093   3.136  40.995  1.00  27.38      A  N
ATOM  11777  CA   MET E  54    -56.940   1.878  40.328  1.00  26.32      A  C
ATOM  11778  CB   MET E  54    -56.042   0.980  41.152  1.00  26.83      E  C
ATOM  11779  CG   MET E  54    -55.681  -0.317  40.541  1.00  30.05      E  C
ATOM  11780  SD   MET E  54    -54.569  -0.258  39.210  1.00  35.08      E  S
ATOM  11781  CE   MET E  54    -53.071  -0.045  40.032  1.00  39.09      E  C
ATOM  11782  C    MET E  54    -58.277   1.230  40.010  1.00  25.37      A  C
ATOM  11783  O    MET E  54    -58.478   0.741  38.948  1.00  24.59      A  O
```

Appendix 1

```
ATOM  11784  N    ALA E  55     -59.218   1.292  40.919  1.00  23.81      A  N
ATOM  11785  CA   ALA E  55     -60.538   0.796  40.654  1.00  22.98      A  C
ATOM  11786  CB   ALA E  55     -61.329   0.793  41.876  1.00  22.06      A  C
ATOM  11787  C    ALA E  55     -61.268   1.517  39.527  1.00  23.32      A  C
ATOM  11788  O    ALA E  55     -61.966   0.905  38.785  1.00  21.53      A  O
ATOM  11789  N    GLN E  56     -61.100   2.819  39.424  1.00  22.07      A  N
ATOM  11790  CA   GLN E  56     -61.593   3.553  38.309  1.00  21.53      A  C
ATOM  11791  CB   GLN E  56     -61.400   5.042  38.518  1.00  21.01      A  C
ATOM  11792  CG   GLN E  56     -61.548   5.879  37.288  1.00  20.63      A  C
ATOM  11793  CD   GLN E  56     -62.949   5.992  36.830  1.00  23.15      A  C
ATOM  11794  OE1  GLN E  56     -63.839   5.680  37.547  1.00  26.13      A  O
ATOM  11795  NE2  GLN E  56     -63.153   6.444  35.630  1.00  22.00      A  N
ATOM  11796  C    GLN E  56     -60.919   3.088  37.031  1.00  21.63      A  C
ATOM  11797  O    GLN E  56     -61.543   2.929  36.057  1.00  19.97      A  O
ATOM  11798  N    LEU E  57     -59.636   2.828  37.071  1.00  21.45      A  N
ATOM  11799  CA   LEU E  57     -58.904   2.281  35.953  1.00  21.94      A  C
ATOM  11800  CB   LEU E  57     -57.440   2.164  36.318  1.00  21.18      A  C
ATOM  11801  CG   LEU E  57     -56.336   3.024  35.762  1.00  24.50      A  C
ATOM  11802  CD1  LEU E  57     -56.768   4.348  35.322  1.00  23.18      A  C
ATOM  11803  CD2  LEU E  57     -55.265   3.151  36.713  1.00  25.18      A  C
ATOM  11804  C    LEU E  57     -59.435   0.917  35.578  1.00  22.60      A  C
ATOM  11805  O    LEU E  57     -59.477   0.563  34.471  1.00  23.08      A  O
ATOM  11806  N    ALA E  58     -59.831   0.147  36.554  1.00  22.81      A  N
ATOM  11807  CA   ALA E  58     -60.501  -1.099  36.341  1.00  21.27      A  C
ATOM  11808  CB   ALA E  58     -60.558  -1.854  37.575  1.00  21.37      A  C
ATOM  11809  C    ALA E  58     -61.851  -1.020  35.713  1.00  20.84      A  C
ATOM  11810  O    ALA E  58     -62.196  -1.860  34.968  1.00  23.56      A  O
ATOM  11811  N    TYR E  59     -62.639  -0.031  36.050  1.00  19.89      A  N
ATOM  11812  CA   TYR E  59     -63.892   0.168  35.387  1.00  20.54      A  C
ATOM  11813  CB   TYR E  59     -64.657   1.315  36.051  1.00  21.12      A  C
ATOM  11814  CG   TYR E  59     -65.643   1.985  35.147  1.00  21.26      A  C
ATOM  11815  CD1  TYR E  59     -66.755   1.340  34.747  1.00  21.76      A  C
ATOM  11816  CE1  TYR E  59     -67.613   1.886  33.920  1.00  24.75      A  C
ATOM  11817  CZ   TYR E  59     -67.415   3.104  33.465  1.00  26.41      A  C
ATOM  11818  OH   TYR E  59     -68.346   3.599  32.643  1.00  25.71      A  O
ATOM  11819  CE2  TYR E  59     -66.310   3.793  33.812  1.00  26.20      A  C
ATOM  11820  CD2  TYR E  59     -65.427   3.232  34.644  1.00  24.63      A  C
ATOM  11821  C    TYR E  59     -63.658   0.464  33.913  1.00  22.22      A  C
ATOM  11822  O    TYR E  59     -64.324  -0.012  33.052  1.00  23.85      A  O
ATOM  11823  N    MET E  60     -62.669   1.262  33.653  1.00  21.69      A  N
ATOM  11824  CA   MET E  60     -62.314   1.633  32.342  1.00  21.87      A  C
ATOM  11825  CB   MET E  60     -61.238   2.691  32.412  1.00  21.90      E  C
ATOM  11826  CG   MET E  60     -61.693   4.038  32.873  1.00  19.89      E  C
ATOM  11827  SD   MET E  60     -60.425   5.129  33.424  1.00  26.40      E  S
ATOM  11828  CE   MET E  60     -59.775   5.771  31.965  1.00  21.65      E  C
ATOM  11829  C    MET E  60     -61.848   0.466  31.510  1.00  22.86      A  C
ATOM  11830  O    MET E  60     -61.943   0.466  30.344  1.00  23.49      A  O
ATOM  11831  N    ASN E  61     -61.232  -0.499  32.121  1.00  22.01      A  N
ATOM  11832  CA   ASN E  61     -60.468  -1.426  31.355  1.00  21.47      A  C
ATOM  11833  CB   ASN E  61     -59.026  -1.363  31.817  1.00  20.45      A  C
ATOM  11834  CG   ASN E  61     -58.240  -0.321  31.154  1.00  21.54      A  C
ATOM  11835  OD1  ASN E  61     -57.689  -0.557  30.144  1.00  27.04      A  O
ATOM  11836  ND2  ASN E  61     -58.148   0.822  31.737  1.00  17.12      A  N
ATOM  11837  C    ASN E  61     -60.918  -2.834  31.479  1.00  22.19      A  C
```

Appendix 1

```
ATOM  11838  O    ASN E  61     -60.633   -3.597  30.636  1.00 20.91      A  O
ATOM  11839  N    TYR E  62     -61.546   -3.186  32.590  1.00 23.24      A  N
ATOM  11840  CA   TYR E  62     -61.784   -4.588  32.915  1.00 24.54      A  C
ATOM  11841  CB   TYR E  62     -61.960   -4.739  34.424  1.00 23.77      A  C
ATOM  11842  CG   TYR E  62     -61.703   -6.109  34.918  1.00 23.95      A  C
ATOM  11843  CD1  TYR E  62     -60.553   -6.410  35.581  1.00 25.02      A  C
ATOM  11844  CE1  TYR E  62     -60.307   -7.668  36.033  1.00 22.00      A  C
ATOM  11845  CZ   TYR E  62     -61.207   -8.632  35.789  1.00 23.63      A  C
ATOM  11846  OH   TYR E  62     -60.993   -9.883  36.220  1.00 26.96      A  O
ATOM  11847  CE2  TYR E  62     -62.352   -8.351  35.131  1.00 22.69      A  C
ATOM  11848  CD2  TYR E  62     -62.593   -7.118  34.700  1.00 22.92      A  C
ATOM  11849  C    TYR E  62     -62.825   -5.450  32.229  1.00 24.42      A  C
ATOM  11850  O    TYR E  62     -62.496   -6.476  31.734  1.00 23.35      A  O
ATOM  11851  N    ILE E  63     -64.084   -5.076  32.239  1.00 26.36      A  N
ATOM  11852  CA   ILE E  63     -65.080   -5.964  31.682  1.00 28.09      A  C
ATOM  11853  CB   ILE E  63     -66.503   -5.718  32.169  1.00 27.89      A  C
ATOM  11854  CG1  ILE E  63     -66.609   -5.887  33.672  1.00 25.05      A  C
ATOM  11855  CD1  ILE E  63     -67.871   -5.443  34.217  1.00 13.89      A  C
ATOM  11856  CG2  ILE E  63     -67.452   -6.642  31.467  1.00 25.51      A  C
ATOM  11857  C    ILE E  63     -65.064   -6.011  30.189  1.00 30.27      A  C
ATOM  11858  O    ILE E  63     -64.767   -5.060  29.537  1.00 31.46      A  O
ATOM  11859  N    ASP E  64     -65.421   -7.155  29.665  1.00 31.86      A  N
ATOM  11860  CA   ASP E  64     -65.155   -7.482  28.304  1.00 33.83      A  C
ATOM  11861  CB   ASP E  64     -65.524   -8.929  28.072  1.00 36.55      A  C
ATOM  11862  CG   ASP E  64     -64.373   -9.753  27.678  1.00 38.39      A  C
ATOM  11863  OD1  ASP E  64     -63.254   -9.342  27.931  1.00 41.97      A  O
ATOM  11864  OD2  ASP E  64     -64.592  -10.821  27.142  1.00 43.90      A  O
ATOM  11865  C    ASP E  64     -65.768   -6.676  27.181  1.00 34.08      A  C
ATOM  11866  O    ASP E  64     -65.087   -6.310  26.289  1.00 35.94      A  O
ATOM  11867  N    PHE E  65     -67.026   -6.403  27.113  1.00 32.06      A  N
ATOM  11868  CA   PHE E  65     -67.307   -5.632  25.922  1.00 31.20      A  C
ATOM  11869  CB   PHE E  65     -68.314   -6.356  25.047  1.00 29.93      A  C
ATOM  11870  CG   PHE E  65     -67.837   -7.676  24.581  1.00 31.03      A  C
ATOM  11871  CD1  PHE E  65     -66.859   -7.768  23.651  1.00 27.40      A  C
ATOM  11872  CE1  PHE E  65     -66.419   -8.958  23.250  1.00 23.35      A  C
ATOM  11873  CZ   PHE E  65     -66.926  -10.065  23.754  1.00 25.84      A  C
ATOM  11874  CE2  PHE E  65     -67.874  -10.001  24.678  1.00 28.29      A  C
ATOM  11875  CD2  PHE E  65     -68.330   -8.824  25.100  1.00 26.74      A  C
ATOM  11876  C    PHE E  65     -67.724   -4.241  26.272  1.00 30.51      A  C
ATOM  11877  O    PHE E  65     -67.698   -3.352  25.497  1.00 30.78      A  O
ATOM  11878  N    ILE E  66     -68.093   -4.078  27.507  1.00 30.05      A  N
ATOM  11879  CA   ILE E  66     -68.719   -2.894  27.945  1.00 29.65      A  C
ATOM  11880  CB   ILE E  66     -69.846   -3.312  28.803  1.00 30.29      A  C
ATOM  11881  CG1  ILE E  66     -69.338   -4.178  29.909  1.00 28.92      A  C
ATOM  11882  CD1  ILE E  66     -70.228   -4.249  30.956  1.00 31.43      A  C
ATOM  11883  CG2  ILE E  66     -70.704   -4.203  28.047  1.00 29.87      A  C
ATOM  11884  C    ILE E  66     -67.867   -1.852  28.641  1.00 29.94      A  C
ATOM  11885  O    ILE E  66     -68.341   -0.813  28.955  1.00 30.56      A  O
ATOM  11886  N    SER E  67     -66.613   -2.133  28.891  1.00 29.40      A  N
ATOM  11887  CA   SER E  67     -65.711   -1.110  29.360  1.00 28.90      A  C
ATOM  11888  CB   SER E  67     -64.471   -1.692  30.036  1.00 29.16      A  C
ATOM  11889  OG   SER E  67     -63.858   -2.699  29.300  1.00 30.59      A  O
ATOM  11890  C    SER E  67     -65.362   -0.168  28.233  1.00 28.68      A  C
ATOM  11891  O    SER E  67     -65.334   -0.550  27.099  1.00 28.50      A  O
```

Appendix 1

```
ATOM  11892  N    PRO E  68     -65.116   1.068  28.580  1.00  26.69      A  N
ATOM  11893  CA   PRO E  68     -64.862   2.149  27.660  1.00  25.86      A  C
ATOM  11894  CB   PRO E  68     -64.713   3.329  28.595  1.00  25.98      A  C
ATOM  11895  CG   PRO E  68     -64.843   2.831  29.893  1.00  23.52      A  C
ATOM  11896  CD   PRO E  68     -65.531   1.590  29.863  1.00  25.86      A  C
ATOM  11897  C    PRO E  68     -63.620   1.956  26.829  1.00  25.77      A  C
ATOM  11898  O    PRO E  68     -63.519   2.462  25.763  1.00  27.19      A  O
ATOM  11899  N    PHE E  69     -62.666   1.242  27.359  1.00  25.58      A  N
ATOM  11900  CA   PHE E  69     -61.402   1.038  26.708  1.00  25.65      A  C
ATOM  11901  CB   PHE E  69     -60.276   1.633  27.532  1.00  25.75      A  C
ATOM  11902  CG   PHE E  69     -60.365   3.077  27.641  1.00  27.57      A  C
ATOM  11903  CD1  PHE E  69     -59.763   3.865  26.737  1.00  29.53      A  C
ATOM  11904  CE1  PHE E  69     -59.889   5.155  26.802  1.00  30.91      A  C
ATOM  11905  CZ   PHE E  69     -60.642   5.702  27.743  1.00  31.77      A  C
ATOM  11906  CE2  PHE E  69     -61.265   4.951  28.639  1.00  29.95      A  C
ATOM  11907  CD2  PHE E  69     -61.140   3.653  28.584  1.00  28.28      A  C
ATOM  11908  C    PHE E  69     -61.117  -0.383  26.353  1.00  25.69      A  C
ATOM  11909  O    PHE E  69     -60.017  -0.801  26.400  1.00  26.23      A  O
ATOM  11910  N    TYR E  70     -62.143  -1.137  26.050  1.00  26.32      A  N
ATOM  11911  CA   TYR E  70     -61.977  -2.495  25.644  1.00  26.23      A  C
ATOM  11912  CB   TYR E  70     -63.324  -3.209  25.640  1.00  26.86      A  C
ATOM  11913  CG   TYR E  70     -63.262  -4.599  25.120  1.00  29.70      A  C
ATOM  11914  CD1  TYR E  70     -62.741  -5.608  25.892  1.00  29.74      A  C
ATOM  11915  CE1  TYR E  70     -62.639  -6.867  25.426  1.00  29.75      A  C
ATOM  11916  CZ   TYR E  70     -63.062  -7.159  24.190  1.00  32.40      A  C
ATOM  11917  OH   TYR E  70     -62.945  -8.431  23.791  1.00  39.79      A  O
ATOM  11918  CE2  TYR E  70     -63.586  -6.193  23.380  1.00  32.10      A  C
ATOM  11919  CD2  TYR E  70     -63.686  -4.917  23.844  1.00  30.94      A  C
ATOM  11920  C    TYR E  70     -61.300  -2.611  24.321  1.00  26.00      A  C
ATOM  11921  O    TYR E  70     -60.426  -3.385  24.157  1.00  26.58      A  O
ATOM  11922  N    SER E  71     -61.728  -1.831  23.367  1.00  26.17      A  N
ATOM  11923  CA   SER E  71     -61.333  -2.042  22.012  1.00  27.92      A  C
ATOM  11924  CB   SER E  71     -62.342  -2.961  21.333  1.00  28.66      A  C
ATOM  11925  OG   SER E  71     -62.774  -2.500  20.098  1.00  34.40      A  O
ATOM  11926  C    SER E  71     -61.129  -0.749  21.270  1.00  28.17      A  C
ATOM  11927  O    SER E  71     -61.600   0.240  21.674  1.00  25.93      A  O
ATOM  11928  N    ARG E  72     -60.372  -0.766  20.195  1.00  28.94      A  N
ATOM  11929  CA   ARG E  72     -60.175   0.440  19.432  1.00  30.60      A  C
ATOM  11930  CB   ARG E  72     -58.759   0.632  18.881  1.00  29.77      A  C
ATOM  11931  CG   ARG E  72     -58.133  -0.471  18.145  1.00  33.93      A  C
ATOM  11932  CD   ARG E  72     -56.964  -0.003  17.317  1.00  42.03      A  C
ATOM  11933  NE   ARG E  72     -55.714   0.165  18.037  1.00  47.18      A  N
ATOM  11934  CZ   ARG E  72     -54.575  -0.412  17.692  1.00  53.82      A  C
ATOM  11935  NH1  ARG E  72     -54.528  -1.189  16.650  1.00  55.45      A  N
ATOM  11936  NH2  ARG E  72     -53.478  -0.225  18.380  1.00  54.67      A  N
ATOM  11937  C    ARG E  72     -61.224   0.593  18.380  1.00  32.05      A  C
ATOM  11938  O    ARG E  72     -61.237   1.533  17.646  1.00  33.04      A  O
ATOM  11939  N    GLY E  73     -62.140  -0.340  18.387  1.00  33.04      A  N
ATOM  11940  CA   GLY E  73     -63.239  -0.376  17.473  1.00  35.08      A  C
ATOM  11941  C    GLY E  73     -64.274   0.674  17.681  1.00  36.31      A  C
ATOM  11942  O    GLY E  73     -64.391   1.225  18.710  1.00  37.04      A  O
ATOM  11943  N    CYS E  74     -65.013   0.984  16.659  1.00  37.61      A  N
ATOM  11944  CA   CYS E  74     -65.893   2.094  16.827  1.00  39.38      A  C
ATOM  11945  CB   CYS E  74     -65.834   3.143  15.652  1.00  40.18      A  C
```

Appendix 1

```
ATOM  11946  SG   CYS E  74     -64.720    4.651   16.054  1.00 43.86      A    S
ATOM  11947  C    CYS E  74     -67.211    1.651   17.451  1.00 38.65      A    C
ATOM  11948  O    CYS E  74     -68.250    1.588   16.859  1.00 39.79      A    O
ATOM  11949  N    SER E  75     -67.035    1.310   18.713  1.00 37.67      A    N
ATOM  11950  CA   SER E  75     -67.959    0.651   19.589  1.00 36.24      A    C
ATOM  11951  CB   SER E  75     -67.292   -0.627   20.025  1.00 36.75      A    C
ATOM  11952  OG   SER E  75     -68.171   -1.683   20.004  1.00 37.90      A    O
ATOM  11953  C    SER E  75     -68.188    1.482   20.823  1.00 34.59      A    C
ATOM  11954  O    SER E  75     -67.282    1.812   21.519  1.00 32.81      A    O
ATOM  11955  N    PHE E  76     -69.429    1.793   21.105  1.00 33.66      A    N
ATOM  11956  CA   PHE E  76     -69.718    2.746   22.130  1.00 33.49      A    C
ATOM  11957  CB   PHE E  76     -70.120    4.067   21.514  1.00 32.36      A    C
ATOM  11958  CG   PHE E  76     -69.013    4.715   20.810  1.00 31.06      A    C
ATOM  11959  CD1  PHE E  76     -68.135    5.498   21.470  1.00 25.89      A    C
ATOM  11960  CE1  PHE E  76     -67.113    6.024   20.837  1.00 27.84      A    C
ATOM  11961  CZ   PHE E  76     -66.926    5.780   19.539  1.00 27.18      A    C
ATOM  11962  CE2  PHE E  76     -67.754    5.005   18.882  1.00 30.06      A    C
ATOM  11963  CD2  PHE E  76     -68.793    4.462   19.507  1.00 29.55      A    C
ATOM  11964  C    PHE E  76     -70.645    2.339   23.219  1.00 34.96      A    C
ATOM  11965  O    PHE E  76     -71.307    3.145   23.737  1.00 37.35      A    O
ATOM  11966  N    GLU E  77     -70.627    1.080   23.590  1.00 35.93      A    N
ATOM  11967  CA   GLU E  77     -71.516    0.499   24.572  1.00 36.87      A    C
ATOM  11968  CB   GLU E  77     -71.238   -0.971   24.729  1.00 37.84      A    C
ATOM  11969  CG   GLU E  77     -72.189   -1.869   24.069  1.00 47.80      A    C
ATOM  11970  CD   GLU E  77     -71.492   -2.895   23.221  1.00 57.98      A    C
ATOM  11971  OE1  GLU E  77     -70.601   -2.494   22.477  1.00 61.46      A    O
ATOM  11972  OE2  GLU E  77     -71.823   -4.086   23.300  1.00 59.81      A    O-1
ATOM  11973  C    GLU E  77     -71.360    1.087   25.921  1.00 34.79      A    C
ATOM  11974  O    GLU E  77     -72.288    1.176   26.649  1.00 35.34      A    O
ATOM  11975  N    ALA E  78     -70.152    1.443   26.277  1.00 31.98      A    N
ATOM  11976  CA   ALA E  78     -69.897    1.942   27.580  1.00 29.49      A    C
ATOM  11977  CB   ALA E  78     -68.456    2.177   27.729  1.00 28.80      A    C
ATOM  11978  C    ALA E  78     -70.647    3.208   27.796  1.00 28.33      A    C
ATOM  11979  O    ALA E  78     -71.158    3.446   28.832  1.00 28.29      A    O
ATOM  11980  N    TRP E  79     -70.633    4.046   26.797  1.00 25.95      A    N
ATOM  11981  CA   TRP E  79     -71.360    5.268   26.777  1.00 26.94      A    C
ATOM  11982  CB   TRP E  79     -70.796    6.153   25.697  1.00 25.21      A    C
ATOM  11983  CG   TRP E  79     -69.396    6.568   25.968  1.00 24.44      A    C
ATOM  11984  CD1  TRP E  79     -69.003    7.667   26.580  1.00 22.44      A    C
ATOM  11985  NE1  TRP E  79     -67.668    7.729   26.633  1.00 19.95      A    N
ATOM  11986  CE2  TRP E  79     -67.161    6.620   26.047  1.00 15.27      A    C
ATOM  11987  CD2  TRP E  79     -68.214    5.866   25.631  1.00 18.77      A    C
ATOM  11988  CE3  TRP E  79     -67.956    4.668   25.002  1.00 21.60      A    C
ATOM  11989  CZ3  TRP E  79     -66.718    4.297   24.851  1.00 21.42      A    C
ATOM  11990  CH2  TRP E  79     -65.697    5.067   25.278  1.00 21.58      A    C
ATOM  11991  CZ2  TRP E  79     -65.898    6.231   25.883  1.00 18.57      A    C
ATOM  11992  C    TRP E  79     -72.875    5.119   26.741  1.00 28.24      A    C
ATOM  11993  O    TRP E  79     -73.602    5.892   27.297  1.00 27.21      A    O
ATOM  11994  N    GLU E  80     -73.324    4.090   26.062  1.00 30.07      A    N
ATOM  11995  CA   GLU E  80     -74.703    3.742   25.966  1.00 32.31      A    C
ATOM  11996  CB   GLU E  80     -74.826    2.540   25.059  1.00 33.05      A    C
ATOM  11997  CG   GLU E  80     -75.327    2.819   23.692  1.00 39.25      A    C
ATOM  11998  CD   GLU E  80     -74.646    2.004   22.629  1.00 47.34      A    C
ATOM  11999  OE1  GLU E  80     -74.489    0.804   22.812  1.00 48.84      A    O
```

Appendix 1

```
ATOM  12000  OE2  GLU  E  80   -74.268   2.564  21.601  1.00  48.73  A  O-1
ATOM  12001  C    GLU  E  80   -75.255   3.397  27.321  1.00  32.35  A  C
ATOM  12002  O    GLU  E  80   -76.320   3.787  27.657  1.00  32.92  A  O
ATOM  12003  N    LEU  E  81   -74.506   2.643  28.094  1.00  32.24  A  N
ATOM  12004  CA   LEU  E  81   -74.843   2.299  29.463  1.00  32.81  A  C
ATOM  12005  CB   LEU  E  81   -73.902   1.236  29.987  1.00  33.42  A  C
ATOM  12006  CG   LEU  E  81   -73.960  -0.098  29.316  1.00  33.34  A  C
ATOM  12007  CD1  LEU  E  81   -72.752  -0.786  29.594  1.00  32.98  A  C
ATOM  12008  CD2  LEU  E  81   -75.088  -0.867  29.798  1.00  29.94  A  C
ATOM  12009  C    LEU  E  81   -74.904   3.426  30.468  1.00  32.99  A  C
ATOM  12010  O    LEU  E  81   -75.672   3.383  31.381  1.00  32.65  A  O
ATOM  12011  N    LYS  E  82   -74.012   4.383  30.303  1.00  33.00  A  N
ATOM  12012  CA   LYS  E  82   -73.953   5.631  31.014  1.00  32.47  A  C
ATOM  12013  CB   LYS  E  82   -72.630   6.247  30.764  1.00  33.45  A  C
ATOM  12014  CG   LYS  E  82   -71.685   6.057  31.817  1.00  35.36  A  C
ATOM  12015  CD   LYS  E  82   -70.638   7.061  31.627  1.00  39.85  A  C
ATOM  12016  CE   LYS  E  82   -69.478   6.541  30.909  1.00  38.20  A  C
ATOM  12017  NZ   LYS  E  82   -68.426   7.426  31.220  1.00  36.23  A  N
ATOM  12018  C    LYS  E  82   -74.985   6.645  30.640  1.00  33.28  A  C
ATOM  12019  O    LYS  E  82   -75.215   7.576  31.357  1.00  33.10  A  O
ATOM  12020  N    HIS  E  83   -75.576   6.463  29.484  1.00  33.28  A  N
ATOM  12021  CA   HIS  E  83   -76.523   7.383  28.902  1.00  34.22  A  C
ATOM  12022  CB   HIS  E  83   -77.658   7.709  29.862  1.00  35.22  A  C
ATOM  12023  CG   HIS  E  83   -78.275   6.515  30.483  1.00  41.69  A  C
ATOM  12024  ND1  HIS  E  83   -78.760   5.475  29.742  1.00  44.89  A  N
ATOM  12025  CE1  HIS  E  83   -79.209   4.543  30.549  1.00  47.17  A  C
ATOM  12026  NE2  HIS  E  83   -79.045   4.950  31.787  1.00  47.37  A  N
ATOM  12027  CD2  HIS  E  83   -78.464   6.181  31.775  1.00  45.33  A  C
ATOM  12028  C    HIS  E  83   -75.957   8.670  28.376  1.00  31.81  A  C
ATOM  12029  O    HIS  E  83   -76.666   9.610  28.257  1.00  32.82  A  O
ATOM  12030  N    THR  E  84   -74.694   8.693  28.039  1.00  29.71  A  N
ATOM  12031  CA   THR  E  84   -74.056   9.876  27.546  1.00  26.41  A  C
ATOM  12032  CB   THR  E  84   -72.630   9.543  27.187  1.00  26.30  A  C
ATOM  12033  OG1  THR  E  84   -72.068   8.763  28.206  1.00  27.22  A  O
ATOM  12034  CG2  THR  E  84   -71.812  10.731  27.031  1.00  23.68  A  C
ATOM  12035  C    THR  E  84   -74.740  10.297  26.292  1.00  25.21  A  C
ATOM  12036  O    THR  E  84   -74.896   9.534  25.392  1.00  22.79  A  O
ATOM  12037  N    PRO  E  85   -75.092  11.555  26.221  1.00  24.45  A  N
ATOM  12038  CA   PRO  E  85   -75.600  12.128  24.999  1.00  23.89  A  C
ATOM  12039  CB   PRO  E  85   -75.828  13.547  25.408  1.00  22.42  A  C
ATOM  12040  CG   PRO  E  85   -76.162  13.458  26.712  1.00  24.48  A  C
ATOM  12041  CD   PRO  E  85   -75.284  12.493  27.314  1.00  23.82  A  C
ATOM  12042  C    PRO  E  85   -74.525  12.067  23.968  1.00  23.48  A  C
ATOM  12043  O    PRO  E  85   -73.410  12.121  24.333  1.00  22.28  A  O
ATOM  12044  N    GLN  E  86   -74.852  11.944  22.698  1.00  23.96  A  N
ATOM  12045  CA   GLN  E  86   -73.816  11.769  21.708  1.00  24.24  A  C
ATOM  12046  CB   GLN  E  86   -74.365  11.460  20.321  1.00  24.23  A  C
ATOM  12047  CG   GLN  E  86   -74.330  12.588  19.323  1.00  26.04  A  C
ATOM  12048  CD   GLN  E  86   -73.045  12.751  18.587  1.00  27.62  A  C
ATOM  12049  OE1  GLN  E  86   -72.439  11.823  18.153  1.00  31.95  A  O
ATOM  12050  NE2  GLN  E  86   -72.635  13.935  18.456  1.00  24.79  A  N
ATOM  12051  C    GLN  E  86   -72.886  12.932  21.660  1.00  23.15  A  C
ATOM  12052  O    GLN  E  86   -71.746  12.770  21.486  1.00  21.62  A  O
ATOM  12053  N    ARG  E  87   -73.408  14.109  21.843  1.00  24.13  A  N
```

Appendix 1

```
ATOM  12054  CA   ARG E  87   -72.684  15.331  21.674  1.00  26.14    A  C
ATOM  12055  CB   ARG E  87   -73.613  16.513  21.835  1.00  26.61    A  C
ATOM  12056  CG   ARG E  87   -74.063  17.105  20.587  1.00  26.43    A  C
ATOM  12057  CD   ARG E  87   -75.315  17.818  20.802  1.00  28.44    A  C
ATOM  12058  NE   ARG E  87   -76.153  17.777  19.630  1.00  31.10    A  N
ATOM  12059  CZ   ARG E  87   -75.955  18.497  18.542  1.00  32.18    A  C
ATOM  12060  NH1  ARG E  87   -74.959  19.316  18.458  1.00  32.26    A  N
ATOM  12061  NH2  ARG E  87   -76.742  18.380  17.533  1.00  25.88    A  N
ATOM  12062  C    ARG E  87   -71.556  15.458  22.647  1.00  26.90    A  C
ATOM  12063  O    ARG E  87   -70.671  16.236  22.457  1.00  28.19    A  O
ATOM  12064  N    VAL E  88   -71.600  14.699  23.716  1.00  24.27    A  N
ATOM  12065  CA   VAL E  88   -70.604  14.822  24.726  1.00  22.64    A  C
ATOM  12066  CB   VAL E  88   -71.254  15.066  26.034  1.00  23.67    A  C
ATOM  12067  CG1  VAL E  88   -72.654  14.872  25.885  1.00  28.89    A  C
ATOM  12068  CG2  VAL E  88   -70.715  14.190  27.047  1.00  24.27    A  C
ATOM  12069  C    VAL E  88   -69.660  13.692  24.863  1.00  21.58    A  C
ATOM  12070  O    VAL E  88   -68.889  13.681  25.740  1.00  22.58    A  O
ATOM  12071  N    ILE E  89   -69.742  12.728  23.993  1.00  19.64    A  N
ATOM  12072  CA   ILE E  89   -68.861  11.605  24.001  1.00  18.51    A  C
ATOM  12073  CB   ILE E  89   -69.300  10.556  23.021  1.00  18.72    A  C
ATOM  12074  CG1  ILE E  89   -70.590   9.924  23.472  1.00  16.13    A  C
ATOM  12075  CD1  ILE E  89   -71.162   9.055  22.515  1.00  11.38    A  C
ATOM  12076  CG2  ILE E  89   -68.316   9.522  22.923  1.00  16.44    A  C
ATOM  12077  C    ILE E  89   -67.474  12.055  23.726  1.00  19.32    A  C
ATOM  12078  O    ILE E  89   -66.557  11.552  24.255  1.00  18.06    A  O
ATOM  12079  N    LYS E  90   -67.348  13.044  22.881  1.00  20.33    A  N
ATOM  12080  CA   LYS E  90   -66.065  13.568  22.513  1.00  22.23    A  C
ATOM  12081  CB   LYS E  90   -66.174  14.520  21.332  1.00  21.44    A  C
ATOM  12082  CG   LYS E  90   -66.751  15.839  21.642  1.00  20.81    A  C
ATOM  12083  CD   LYS E  90   -66.705  16.747  20.478  1.00  20.05    A  C
ATOM  12084  CE   LYS E  90   -67.369  16.168  19.313  1.00  23.67    A  C
ATOM  12085  NZ   LYS E  90   -68.717  16.607  19.334  1.00  26.20    A  N
ATOM  12086  C    LYS E  90   -65.265  14.170  23.665  1.00  24.32    A  C
ATOM  12087  O    LYS E  90   -64.079  14.067  23.667  1.00  24.28    A  O
ATOM  12088  N    TYR E  91   -65.927  14.832  24.600  1.00  24.00    A  N
ATOM  12089  CA   TYR E  91   -65.335  15.289  25.826  1.00  26.25    A  C
ATOM  12090  CB   TYR E  91   -66.266  16.246  26.549  1.00  26.28    A  C
ATOM  12091  CG   TYR E  91   -66.726  17.325  25.674  1.00  31.09    A  C
ATOM  12092  CD1  TYR E  91   -65.893  18.297  25.307  1.00  39.76    A  C
ATOM  12093  CE1  TYR E  91   -66.287  19.251  24.489  1.00  44.66    A  C
ATOM  12094  CZ   TYR E  91   -67.519  19.247  24.021  1.00  44.34    A  C
ATOM  12095  OH   TYR E  91   -67.888  20.232  23.186  1.00  46.78    A  O
ATOM  12096  CE2  TYR E  91   -68.364  18.286  24.358  1.00  41.49    A  C
ATOM  12097  CD2  TYR E  91   -67.973  17.339  25.169  1.00  35.89    A  C
ATOM  12098  C    TYR E  91   -64.924  14.184  26.734  1.00  26.70    A  C
ATOM  12099  O    TYR E  91   -63.928  14.247  27.360  1.00  27.78    A  O
ATOM  12100  N    SER E  92   -65.743  13.173  26.807  1.00  26.03    A  N
ATOM  12101  CA   SER E  92   -65.542  12.048  27.662  1.00  25.63    A  C
ATOM  12102  CB   SER E  92   -66.734  11.130  27.471  1.00  25.95    A  C
ATOM  12103  OG   SER E  92   -66.696   9.983  28.244  1.00  26.88    A  O
ATOM  12104  C    SER E  92   -64.293  11.334  27.288  1.00  25.36    A  C
ATOM  12105  O    SER E  92   -63.515  10.979  28.104  1.00  27.20    A  O
ATOM  12106  N    ILE E  93   -64.099  11.130  26.021  1.00  25.46    A  N
ATOM  12107  CA   ILE E  93   -62.906  10.518  25.584  1.00  24.64    A  C
```

Appendix 1

```
ATOM  12108  CB   ILE E  93    -62.963  10.268  24.102  1.00  23.04    A    C
ATOM  12109  CG1  ILE E  93    -64.030   9.268  23.799  1.00  23.71    A    C
ATOM  12110  CD1  ILE E  93    -64.610   9.440  22.479  1.00  25.55    A    C
ATOM  12111  CG2  ILE E  93    -61.747   9.709  23.635  1.00  21.04    A    C
ATOM  12112  C    ILE E  93    -61.723  11.366  25.922  1.00  24.89    A    C
ATOM  12113  O    ILE E  93    -60.786  10.878  26.482  1.00  26.16    A    O
ATOM  12114  N    ALA E  94    -61.794  12.649  25.637  1.00  24.68    A    N
ATOM  12115  CA   ALA E  94    -60.682  13.548  25.834  1.00  23.70    A    C
ATOM  12116  CB   ALA E  94    -61.034  14.890  25.320  1.00  22.26    A    C
ATOM  12117  C    ALA E  94    -60.234  13.657  27.267  1.00  23.99    A    C
ATOM  12118  O    ALA E  94    -59.092  13.560  27.530  1.00  22.58    A    O
ATOM  12119  N    PHE E  95    -61.174  13.827  28.176  1.00  24.23    A    N
ATOM  12120  CA   PHE E  95    -60.949  13.855  29.612  1.00  25.43    A    C
ATOM  12121  CB   PHE E  95    -62.191  14.357  30.322  1.00  26.15    A    C
ATOM  12122  CG   PHE E  95    -62.574  15.721  29.931  1.00  28.40    A    C
ATOM  12123  CD1  PHE E  95    -61.642  16.690  29.821  1.00  30.20    A    C
ATOM  12124  CE1  PHE E  95    -61.992  17.942  29.473  1.00  31.19    A    C
ATOM  12125  CZ   PHE E  95    -63.273  18.230  29.194  1.00  28.10    A    C
ATOM  12126  CE2  PHE E  95    -64.199  17.290  29.318  1.00  27.47    A    C
ATOM  12127  CD2  PHE E  95    -63.864  16.045  29.687  1.00  28.26    A    C
ATOM  12128  C    PHE E  95    -60.423  12.598  30.279  1.00  25.19    A    C
ATOM  12129  O    PHE E  95    -59.596  12.672  31.134  1.00  26.30    A    O
ATOM  12130  N    TYR E  96    -60.882  11.440  29.872  1.00  25.13    A    N
ATOM  12131  CA   TYR E  96    -60.267  10.236  30.339  1.00  25.00    A    C
ATOM  12132  CB   TYR E  96    -60.915   9.010  29.746  1.00  25.65    A    C
ATOM  12133  CG   TYR E  96    -62.137   8.500  30.433  1.00  27.57    A    C
ATOM  12134  CD1  TYR E  96    -62.221   8.436  31.781  1.00  27.43    A    C
ATOM  12135  CE1  TYR E  96    -63.311   7.981  32.369  1.00  29.74    A    C
ATOM  12136  CZ   TYR E  96    -64.342   7.558  31.632  1.00  31.08    A    C
ATOM  12137  OH   TYR E  96    -65.443   7.099  32.241  1.00  33.17    A    O
ATOM  12138  CE2  TYR E  96    -64.289   7.588  30.303  1.00  31.81    A    C
ATOM  12139  CD2  TYR E  96    -63.203   8.060  29.708  1.00  31.81    A    C
ATOM  12140  C    TYR E  96    -58.853  10.291  29.850  1.00  24.26    A    C
ATOM  12141  O    TYR E  96    -57.969   9.961  30.554  1.00  22.92    A    O
ATOM  12142  N    ALA E  97    -58.658  10.747  28.631  1.00  22.08    A    N
ATOM  12143  CA   ALA E  97    -57.350  10.834  28.041  1.00  21.35    A    C
ATOM  12144  CB   ALA E  97    -57.459  11.196  26.600  1.00  19.01    A    C
ATOM  12145  C    ALA E  97    -56.379  11.767  28.741  1.00  21.96    A    C
ATOM  12146  O    ALA E  97    -55.262  11.446  28.882  1.00  21.67    A    O
ATOM  12147  N    TYR E  98    -56.805  12.930  29.162  1.00  22.15    A    N
ATOM  12148  CA   TYR E  98    -55.957  13.781  29.953  1.00  24.02    A    C
ATOM  12149  CB   TYR E  98    -56.608  15.147  30.155  1.00  24.52    A    C
ATOM  12150  CG   TYR E  98    -57.028  15.791  28.878  1.00  25.06    A    C
ATOM  12151  CD1  TYR E  98    -56.338  15.557  27.728  1.00  25.54    A    C
ATOM  12152  CE1  TYR E  98    -56.714  16.089  26.577  1.00  27.22    A    C
ATOM  12153  CZ   TYR E  98    -57.774  16.899  26.549  1.00  29.01    A    C
ATOM  12154  OH   TYR E  98    -58.124  17.428  25.376  1.00  32.50    A    O
ATOM  12155  CE2  TYR E  98    -58.474  17.167  27.663  1.00  25.91    A    C
ATOM  12156  CD2  TYR E  98    -58.097  16.625  28.821  1.00  21.64    A    C
ATOM  12157  C    TYR E  98    -55.555  13.161  31.287  1.00  26.13    A    C
ATOM  12158  O    TYR E  98    -54.459  13.328  31.718  1.00  28.00    A    O
ATOM  12159  N    GLY E  99    -56.470  12.464  31.935  1.00  25.34    A    N
ATOM  12160  CA   GLY E  99    -56.207  11.680  33.111  1.00  24.90    A    C
ATOM  12161  C    GLY E  99    -55.287  10.509  32.967  1.00  24.21    A    C
```

Appendix 1

```
ATOM  12162  O    GLY E  99    -54.522  10.226  33.794  1.00  25.56  A  O
ATOM  12163  N    LEU E 100    -55.408   9.822  31.876  1.00  23.91  A  N
ATOM  12164  CA   LEU E 100    -54.509   8.777  31.519  1.00  23.47  A  C
ATOM  12165  CB   LEU E 100    -54.916   8.199  30.191  1.00  24.00  A  C
ATOM  12166  CG   LEU E 100    -55.718   6.932  30.053  1.00  25.29  A  C
ATOM  12167  CD1  LEU E 100    -56.231   6.444  31.328  1.00  17.24  A  C
ATOM  12168  CD2  LEU E 100    -56.783   7.177  29.068  1.00  23.59  A  C
ATOM  12169  C    LEU E 100    -53.132   9.306  31.355  1.00  22.82  A  C
ATOM  12170  O    LEU E 100    -52.204   8.677  31.703  1.00  23.56  A  O
ATOM  12171  N    ALA E 101    -52.990  10.475  30.786  1.00  23.03  A  N
ATOM  12172  CA   ALA E 101    -51.683  11.053  30.654  1.00  23.39  A  C
ATOM  12173  CB   ALA E 101    -51.722  12.296  29.828  1.00  22.68  A  C
ATOM  12174  C    ALA E 101    -51.035  11.316  31.995  1.00  23.60  A  C
ATOM  12175  O    ALA E 101    -49.879  11.131  32.145  1.00  24.66  A  O
ATOM  12176  N    SER E 102    -51.792  11.760  32.963  1.00  23.47  A  N
ATOM  12177  CA   SER E 102    -51.297  11.897  34.306  1.00  25.29  A  C
ATOM  12178  CB   SER E 102    -52.173  12.775  35.158  1.00  25.16  A  C
ATOM  12179  OG   SER E 102    -52.078  14.096  34.739  1.00  27.25  A  O
ATOM  12180  C    SER E 102    -50.961  10.587  34.970  1.00  25.71  A  C
ATOM  12181  O    SER E 102    -50.003  10.476  35.642  1.00  26.96  A  O
ATOM  12182  N    VAL E 103    -51.729   9.568  34.710  1.00  24.26  A  N
ATOM  12183  CA   VAL E 103    -51.448   8.310  35.308  1.00  23.81  A  C
ATOM  12184  CB   VAL E 103    -52.474   7.293  34.948  1.00  22.75  A  C
ATOM  12185  CG1  VAL E 103    -51.998   5.968  35.273  1.00  19.79  A  C
ATOM  12186  CG2  VAL E 103    -53.720   7.568  35.649  1.00  21.63  A  C
ATOM  12187  C    VAL E 103    -50.099   7.837  34.874  1.00  26.37  A  C
ATOM  12188  O    VAL E 103    -49.390   7.323  35.655  1.00  27.73  A  O
ATOM  12189  N    ALA E 104    -49.739   8.020  33.619  1.00  27.64  A  N
ATOM  12190  CA   ALA E 104    -48.438   7.599  33.128  1.00  28.97  A  C
ATOM  12191  CB   ALA E 104    -48.353   7.727  31.666  1.00  28.18  A  C
ATOM  12192  C    ALA E 104    -47.281   8.314  33.765  1.00  29.23  A  C
ATOM  12193  O    ALA E 104    -46.254   7.760  33.941  1.00  31.13  A  O
ATOM  12194  N    LEU E 105    -47.441   9.580  34.017  1.00  29.58  A  N
ATOM  12195  CA   LEU E 105    -46.525  10.328  34.811  1.00  30.99  A  C
ATOM  12196  CB   LEU E 105    -46.815  11.808  34.645  1.00  31.00  A  C
ATOM  12197  CG   LEU E 105    -45.756  12.833  34.949  1.00  32.44  A  C
ATOM  12198  CD1  LEU E 105    -44.483  12.510  34.358  1.00  33.33  A  C
ATOM  12199  CD2  LEU E 105    -46.168  14.126  34.528  1.00  34.04  A  C
ATOM  12200  C    LEU E 105    -46.460   9.929  36.283  1.00  30.78  A  C
ATOM  12201  O    LEU E 105    -45.423   9.851  36.840  1.00  32.12  A  O
ATOM  12202  N    ILE E 106    -47.578   9.674  36.913  1.00  30.62  A  N
ATOM  12203  CA   ILE E 106    -47.569   9.237  38.289  1.00  30.69  A  C
ATOM  12204  CB   ILE E 106    -48.995   9.028  38.802  1.00  29.88  A  C
ATOM  12205  CG1  ILE E 106    -49.683  10.315  39.106  1.00  25.30  A  C
ATOM  12206  CD1  ILE E 106    -51.038  10.112  39.279  1.00  25.01  A  C
ATOM  12207  CG2  ILE E 106    -48.997   8.200  40.030  1.00  27.64  A  C
ATOM  12208  C    ILE E 106    -46.893   7.910  38.557  1.00  33.07  A  C
ATOM  12209  O    ILE E 106    -46.137   7.794  39.476  1.00  35.44  A  O
ATOM  12210  N    ASP E 107    -47.198   6.895  37.784  1.00  33.65  A  N
ATOM  12211  CA   ASP E 107    -46.665   5.608  38.034  1.00  34.98  A  C
ATOM  12212  CB   ASP E 107    -47.770   4.718  38.526  1.00  36.12  A  C
ATOM  12213  CG   ASP E 107    -47.305   3.321  38.767  1.00  43.84  A  C
ATOM  12214  OD1  ASP E 107    -46.107   3.069  38.660  1.00  51.02  A  O
ATOM  12215  OD2  ASP E 107    -48.121   2.458  39.074  1.00  51.50  A  O-1
```

Appendix 1

```
ATOM  12216  C    ASP E 107     -46.075   4.981  36.817  1.00  35.47      A  C
ATOM  12217  O    ASP E 107     -46.783   4.605  35.958  1.00  35.19      A  O
ATOM  12218  N    PRO E 108     -44.780   4.760  36.791  1.00  35.90      A  N
ATOM  12219  CA   PRO E 108     -44.123   4.272  35.594  1.00  35.44      A  C
ATOM  12220  CB   PRO E 108     -42.682   4.101  36.061  1.00  34.13      A  C
ATOM  12221  CG   PRO E 108     -42.566   4.859  37.170  1.00  34.66      A  C
ATOM  12222  CD   PRO E 108     -43.821   4.855  37.881  1.00  35.15      A  C
ATOM  12223  C    PRO E 108     -44.643   2.946  35.137  1.00  34.40      A  C
ATOM  12224  O    PRO E 108     -44.786   2.732  33.977  1.00  35.45      A  O
ATOM  12225  N    LYS E 109     -44.924   2.071  36.067  1.00  33.35      A  N
ATOM  12226  CA   LYS E 109     -45.395   0.751  35.775  1.00  33.69      A  C
ATOM  12227  CB   LYS E 109     -45.338  -0.113  37.004  1.00  34.07      A  C
ATOM  12228  CG   LYS E 109     -44.094  -0.898  37.039  1.00  38.18      A  C
ATOM  12229  CD   LYS E 109     -43.944  -1.626  38.308  1.00  48.15      A  C
ATOM  12230  CE   LYS E 109     -44.770  -0.994  39.368  1.00  54.80      A  C
ATOM  12231  NZ   LYS E 109     -44.544  -1.654  40.668  1.00  58.27      A  N
ATOM  12232  C    LYS E 109     -46.734   0.706  35.106  1.00  32.81      A  C
ATOM  12233  O    LYS E 109     -47.009  -0.183  34.375  1.00  32.83      A  O
ATOM  12234  N    LEU E 110     -47.556   1.697  35.337  1.00  32.70      A  N
ATOM  12235  CA   LEU E 110     -48.828   1.774  34.702  1.00  30.22      A  C
ATOM  12236  CB   LEU E 110     -49.807   2.508  35.587  1.00  30.09      A  C
ATOM  12237  CG   LEU E 110     -50.500   1.732  36.682  1.00  32.60      A  C
ATOM  12238  CD1  LEU E 110     -51.434   2.565  37.461  1.00  28.56      A  C
ATOM  12239  CD2  LEU E 110     -51.169   0.543  36.180  1.00  30.68      A  C
ATOM  12240  C    LEU E 110     -48.737   2.497  33.395  1.00  29.68      A  C
ATOM  12241  O    LEU E 110     -49.709   2.648  32.759  1.00  31.53      A  O
ATOM  12242  N    ARG E 111     -47.565   2.969  33.025  1.00  27.46      A  N
ATOM  12243  CA   ARG E 111     -47.382   3.795  31.856  1.00  26.45      A  C
ATOM  12244  CB   ARG E 111     -45.996   4.421  31.823  1.00  26.14      A  C
ATOM  12245  CG   ARG E 111     -45.669   5.194  30.577  1.00  23.87      A  C
ATOM  12246  CD   ARG E 111     -44.582   6.124  30.792  1.00  20.22      A  C
ATOM  12247  NE   ARG E 111     -44.336   7.029  29.696  1.00  24.19      A  N
ATOM  12248  CZ   ARG E 111     -43.540   8.084  29.763  1.00  24.94      A  C
ATOM  12249  NH1  ARG E 111     -42.922   8.379  30.845  1.00  13.48      A  N
ATOM  12250  NH2  ARG E 111     -43.360   8.848  28.747  1.00  23.59      A  N
ATOM  12251  C    ARG E 111     -47.684   3.137  30.556  1.00  27.04      A  C
ATOM  12252  O    ARG E 111     -48.210   3.748  29.686  1.00  27.50      A  O
ATOM  12253  N    ALA E 112     -47.319   1.888  30.417  1.00  26.88      A  N
ATOM  12254  CA   ALA E 112     -47.675   1.148  29.241  1.00  27.10      A  C
ATOM  12255  CB   ALA E 112     -46.949  -0.117  29.183  1.00  25.53      A  C
ATOM  12256  C    ALA E 112     -49.176   0.946  29.076  1.00  27.36      A  C
ATOM  12257  O    ALA E 112     -49.654   0.954  28.005  1.00  27.60      A  O
ATOM  12258  N    LEU E 113     -49.899   0.732  30.152  1.00  28.45      A  N
ATOM  12259  CA   LEU E 113     -51.328   0.607  30.122  1.00  28.72      A  C
ATOM  12260  CB   LEU E 113     -51.837   0.112  31.459  1.00  27.45      A  C
ATOM  12261  CG   LEU E 113     -53.324   0.109  31.711  1.00  29.61      A  C
ATOM  12262  CD1  LEU E 113     -54.079  -0.902  30.980  1.00  27.44      A  C
ATOM  12263  CD2  LEU E 113     -53.547  -0.031  33.100  1.00  32.75      A  C
ATOM  12264  C    LEU E 113     -51.996   1.887  29.734  1.00  28.89      A  C
ATOM  12265  O    LEU E 113     -52.927   1.917  28.986  1.00  29.34      A  O
ATOM  12266  N    ALA E 114     -51.490   2.961  30.259  1.00  28.91      A  N
ATOM  12267  CA   ALA E 114     -51.959   4.245  29.873  1.00  28.57      A  C
ATOM  12268  CB   ALA E 114     -51.379   5.281  30.719  1.00  27.31      A  C
ATOM  12269  C    ALA E 114     -51.688   4.513  28.425  1.00  28.53      A  C
```

Appendix 1

```
ATOM  12270  O    ALA E 114     -52.438   5.138  27.811  1.00 28.42    A  O
ATOM  12271  N    GLY E 115     -50.597   4.048  27.887  1.00 28.65    A  N
ATOM  12272  CA   GLY E 115     -50.343   4.257  26.499  1.00 28.21    A  C
ATOM  12273  C    GLY E 115     -51.345   3.606  25.615  1.00 29.40    A  C
ATOM  12274  O    GLY E 115     -51.817   4.189  24.694  1.00 30.59    A  O
ATOM  12275  N    HIS E 116     -51.687   2.387  25.939  1.00 29.03    A  N
ATOM  12276  CA   HIS E 116     -52.672   1.609  25.242  1.00 27.57    A  C
ATOM  12277  CB   HIS E 116     -52.580   0.209  25.803  1.00 26.54    A  C
ATOM  12278  CG   HIS E 116     -53.774  -0.626  25.568  1.00 26.96    A  C
ATOM  12279  ND1  HIS E 116     -53.981  -1.304  24.404  1.00 23.34    A  N
ATOM  12280  CE1  HIS E 116     -55.119  -1.939  24.473  1.00 23.82    A  C
ATOM  12281  NE2  HIS E 116     -55.633  -1.736  25.660  1.00 26.12    A  N
ATOM  12282  CD2  HIS E 116     -54.813  -0.912  26.361  1.00 23.33    A  C
ATOM  12283  C    HIS E 116     -54.092   2.173  25.273  1.00 28.31    A  C
ATOM  12284  O    HIS E 116     -54.815   2.086  24.318  1.00 27.97    A  O
ATOM  12285  N    ASP E 117     -54.476   2.713  26.407  1.00 26.73    A  N
ATOM  12286  CA   ASP E 117     -55.724   3.384  26.569  1.00 26.61    A  C
ATOM  12287  CB   ASP E 117     -55.977   3.699  28.027  1.00 26.54    A  C
ATOM  12288  CG   ASP E 117     -56.397   2.512  28.813  1.00 26.27    A  C
ATOM  12289  OD1  ASP E 117     -56.501   1.442  28.279  1.00 24.26    A  O
ATOM  12290  OD2  ASP E 117     -56.647   2.638  29.975  1.00 23.75    A  O-1
ATOM  12291  C    ASP E 117     -55.758   4.623  25.733  1.00 26.91    A  C
ATOM  12292  O    ASP E 117     -56.745   4.957  25.167  1.00 26.71    A  O
ATOM  12293  N    LEU E 118     -54.644   5.308  25.670  1.00 27.04    A  N
ATOM  12294  CA   LEU E 118     -54.502   6.480  24.853  1.00 27.19    A  C
ATOM  12295  CB   LEU E 118     -53.181   7.156  25.144  1.00 26.77    A  C
ATOM  12296  CG   LEU E 118     -53.151   8.447  25.934  1.00 27.42    A  C
ATOM  12297  CD1  LEU E 118     -54.463   8.801  26.469  1.00 25.92    A  C
ATOM  12298  CD2  LEU E 118     -52.149   8.412  27.028  1.00 24.54    A  C
ATOM  12299  C    LEU E 118     -54.648   6.176  23.375  1.00 27.52    A  C
ATOM  12300  O    LEU E 118     -55.250   6.894  22.647  1.00 26.93    A  O
ATOM  12301  N    ASP E 119     -54.107   5.070  22.946  1.00 27.30    A  N
ATOM  12302  CA   ASP E 119     -54.271   4.629  21.610  1.00 27.81    A  C
ATOM  12303  CB   ASP E 119     -53.473   3.366  21.459  1.00 28.55    A  C
ATOM  12304  CG   ASP E 119     -53.190   3.021  20.060  1.00 35.20    A  C
ATOM  12305  OD1  ASP E 119     -53.612   3.692  19.153  1.00 34.31    A  O
ATOM  12306  OD2  ASP E 119     -52.525   2.038  19.855  1.00 42.35    A  O-1
ATOM  12307  C    ASP E 119     -55.726   4.372  21.316  1.00 27.23    A  C
ATOM  12308  O    ASP E 119     -56.212   4.793  20.329  1.00 28.13    A  O
ATOM  12309  N    ILE E 120     -56.435   3.721  22.199  1.00 26.66    A  N
ATOM  12310  CA   ILE E 120     -57.849   3.490  22.028  1.00 25.83    A  C
ATOM  12311  CB   ILE E 120     -58.351   2.483  23.051  1.00 25.38    A  C
ATOM  12312  CG1  ILE E 120     -57.997   1.108  22.577  1.00 24.95    A  C
ATOM  12313  CD1  ILE E 120     -58.004   0.117  23.596  1.00 25.31    A  C
ATOM  12314  CG2  ILE E 120     -59.791   2.548  23.223  1.00 24.66    A  C
ATOM  12315  C    ILE E 120     -58.674   4.760  21.988  1.00 24.36    A  C
ATOM  12316  O    ILE E 120     -59.556   4.903  21.213  1.00 24.01    A  O
ATOM  12317  N    ALA E 121     -58.330   5.697  22.815  1.00 24.42    A  N
ATOM  12318  CA   ALA E 121     -59.018   6.936  22.863  1.00 24.60    A  C
ATOM  12319  CB   ALA E 121     -58.467   7.746  23.972  1.00 24.39    A  C
ATOM  12320  C    ALA E 121     -58.923   7.690  21.562  1.00 24.24    A  C
ATOM  12321  O    ALA E 121     -59.870   8.280  21.126  1.00 24.52    A  O
ATOM  12322  N    VAL E 122     -57.757   7.693  20.965  1.00 23.44    A  N
ATOM  12323  CA   VAL E 122     -57.560   8.308  19.688  1.00 23.75    A  C
```

Appendix 1

```
ATOM  12324  CB   VAL E 122     -56.084   8.367  19.335  1.00  23.64      A  C
ATOM  12325  CG1  VAL E 122     -55.907   8.726  17.972  1.00  23.67      A  C
ATOM  12326  CG2  VAL E 122     -55.426   9.366  20.127  1.00  22.06      A  C
ATOM  12327  C    VAL E 122     -58.359   7.625  18.588  1.00  24.74      A  C
ATOM  12328  O    VAL E 122     -58.942   8.278  17.787  1.00  23.83      A  O
ATOM  12329  N    SER E 123     -58.394   6.313  18.557  1.00  24.87      A  N
ATOM  12330  CA   SER E 123     -59.179   5.614  17.579  1.00  26.00      A  C
ATOM  12331  CB   SER E 123     -58.999   4.145  17.728  1.00  26.55      A  C
ATOM  12332  OG   SER E 123     -57.703   3.780  17.494  1.00  30.94      A  O
ATOM  12333  C    SER E 123     -60.635   5.840  17.690  1.00  26.22      A  C
ATOM  12334  O    SER E 123     -61.300   5.982  16.724  1.00  27.03      A  O
ATOM  12335  N    LYS E 124     -61.130   5.800  18.894  1.00  26.14      A  N
ATOM  12336  CA   LYS E 124     -62.510   5.990  19.160  1.00  25.65      A  C
ATOM  12337  CB   LYS E 124     -62.832   5.636  20.587  1.00  24.21      A  C
ATOM  12338  CG   LYS E 124     -62.726   4.180  20.834  1.00  26.11      A  C
ATOM  12339  CD   LYS E 124     -63.655   3.664  21.860  1.00  28.32      A  C
ATOM  12340  CE   LYS E 124     -63.568   2.205  21.943  1.00  28.18      A  C
ATOM  12341  NZ   LYS E 124     -64.829   1.568  21.699  1.00  30.25      A  N
ATOM  12342  C    LYS E 124     -62.932   7.366  18.803  1.00  26.12      A  C
ATOM  12343  O    LYS E 124     -64.020   7.577  18.389  1.00  26.72      A  O
ATOM  12344  N    MET E 125     -62.044   8.309  19.011  1.00  26.46      A  N
ATOM  12345  CA   MET E 125     -62.284   9.713  18.769  1.00  26.85      A  C
ATOM  12346  CB   MET E 125     -61.137  10.532  19.328  1.00  25.82      E  C
ATOM  12347  CG   MET E 125     -61.411  11.977  19.453  1.00  29.73      E  C
ATOM  12348  SD   MET E 125     -62.262  12.505  20.883  1.00  29.97      E  S
ATOM  12349  CE   MET E 125     -62.048  14.214  20.788  1.00  30.59      E  C
ATOM  12350  C    MET E 125     -62.564  10.042  17.317  1.00  26.79      A  C
ATOM  12351  O    MET E 125     -63.330  10.904  17.011  1.00  26.39      A  O
ATOM  12352  N    LYS E 126     -61.929   9.302  16.442  1.00  26.57      A  N
ATOM  12353  CA   LYS E 126     -62.118   9.385  15.023  1.00  27.80      A  C
ATOM  12354  CB   LYS E 126     -60.896   8.835  14.367  1.00  26.67      A  C
ATOM  12355  CG   LYS E 126     -59.703   9.541  14.731  1.00  28.26      A  C
ATOM  12356  CD   LYS E 126     -58.565   8.668  14.539  1.00  30.68      A  C
ATOM  12357  CE   LYS E 126     -57.694   9.167  13.514  1.00  30.56      A  C
ATOM  12358  NZ   LYS E 126     -57.127   8.024  12.891  1.00  28.12      A  N
ATOM  12359  C    LYS E 126     -63.351   8.686  14.481  1.00  28.24      A  C
ATOM  12360  O    LYS E 126     -63.751   8.892  13.377  1.00  29.36      A  O
ATOM  12361  N    CYS E 127     -63.957   7.868  15.289  1.00  28.44      A  N
ATOM  12362  CA   CYS E 127     -65.158   7.213  14.925  1.00  30.39      A  C
ATOM  12363  CB   CYS E 127     -65.530   6.223  16.018  1.00  31.06      A  C
ATOM  12364  SG   CYS E 127     -64.617   4.734  16.081  1.00  37.14      A  S
ATOM  12365  C    CYS E 127     -66.237   8.257  14.722  1.00  31.09      A  C
ATOM  12366  O    CYS E 127     -66.266   9.242  15.391  1.00  30.11      A  O
ATOM  12367  N    LYS E 128     -67.116   8.014  13.767  1.00  31.18      A  N
ATOM  12368  CA   LYS E 128     -68.185   8.898  13.360  1.00  30.44      A  C
ATOM  12369  CB   LYS E 128     -68.825   8.379  12.091  1.00  32.25      A  C
ATOM  12370  CG   LYS E 128     -69.226   9.467  11.176  1.00  36.62      A  C
ATOM  12371  CD   LYS E 128     -70.430   9.165  10.390  1.00  44.07      A  C
ATOM  12372  CE   LYS E 128     -70.800  10.355   9.513  1.00  43.30      A  C
ATOM  12373  NZ   LYS E 128     -70.840  10.093   8.060  1.00  44.94      A  N
ATOM  12374  C    LYS E 128     -69.244   9.210  14.391  1.00  27.93      A  C
ATOM  12375  O    LYS E 128     -69.815  10.250  14.389  1.00  28.65      A  O
ATOM  12376  N    ARG E 129     -69.515   8.290  15.264  1.00  26.08      A  N
ATOM  12377  CA   ARG E 129     -70.471   8.533  16.280  1.00  24.69      A  C
```

Appendix 1

```
ATOM  12378  CB   ARG E 129     -70.744   7.258  17.069  1.00  26.06     A   C
ATOM  12379  CG   ARG E 129     -71.437   7.429  18.379  1.00  26.89     A   C
ATOM  12380  CD   ARG E 129     -72.914   7.489  18.278  1.00  31.32     A   C
ATOM  12381  NE   ARG E 129     -73.536   7.388  19.577  1.00  39.33     A   N
ATOM  12382  CZ   ARG E 129     -74.749   7.812  19.885  1.00  40.15     A   C
ATOM  12383  NH1  ARG E 129     -75.503   8.394  18.997  1.00  37.26     A   N
ATOM  12384  NH2  ARG E 129     -75.206   7.664  21.102  1.00  42.74     A   N
ATOM  12385  C    ARG E 129     -69.998   9.672  17.146  1.00  24.45     A   C
ATOM  12386  O    ARG E 129     -70.802  10.329  17.738  1.00  23.72     A   O
ATOM  12387  N    VAL E 130     -68.693   9.831  17.285  1.00  23.89     A   N
ATOM  12388  CA   VAL E 130     -68.088  10.943  17.978  1.00  22.75     A   C
ATOM  12389  CB   VAL E 130     -66.634  10.593  18.398  1.00  23.91     A   C
ATOM  12390  CG1  VAL E 130     -66.007  11.643  19.222  1.00  22.67     A   C
ATOM  12391  CG2  VAL E 130     -66.596   9.349  19.111  1.00  24.12     A   C
ATOM  12392  C    VAL E 130     -68.134  12.276  17.292  1.00  23.24     A   C
ATOM  12393  O    VAL E 130     -68.531  13.225  17.862  1.00  25.14     A   O
ATOM  12394  N    TRP E 131     -67.716  12.353  16.058  1.00  22.97     A   N
ATOM  12395  CA   TRP E 131     -67.699  13.622  15.385  1.00  25.16     A   C
ATOM  12396  CB   TRP E 131     -66.465  13.741  14.542  1.00  25.03     A   C
ATOM  12397  CG   TRP E 131     -66.299  12.717  13.525  1.00  29.68     A   C
ATOM  12398  CD1  TRP E 131     -65.589  11.617  13.630  1.00  30.05     A   C
ATOM  12399  NE1  TRP E 131     -65.633  10.919  12.489  1.00  30.11     A   N
ATOM  12400  CE2  TRP E 131     -66.397  11.598  11.596  1.00  33.12     A   C
ATOM  12401  CD2  TRP E 131     -66.818  12.739  12.214  1.00  30.31     A   C
ATOM  12402  CE3  TRP E 131     -67.614  13.629  11.504  1.00  34.73     A   C
ATOM  12403  CZ3  TRP E 131     -67.940  13.347  10.254  1.00  34.23     A   C
ATOM  12404  CH2  TRP E 131     -67.507  12.199   9.650  1.00  36.08     A   C
ATOM  12405  CZ2  TRP E 131     -66.730  11.307  10.301  1.00  33.23     A   C
ATOM  12406  C    TRP E 131     -68.928  13.983  14.569  1.00  26.30     A   C
ATOM  12407  O    TRP E 131     -69.069  15.085  14.144  1.00  26.57     A   O
ATOM  12408  N    GLY E 132     -69.844  13.049  14.464  1.00  25.43     A   N
ATOM  12409  CA   GLY E 132     -70.913  13.059  13.518  1.00  26.21     A   C
ATOM  12410  C    GLY E 132     -71.938  14.138  13.620  1.00  27.22     A   C
ATOM  12411  O    GLY E 132     -72.682  14.351  12.729  1.00  27.53     A   O
ATOM  12412  N    ASP E 133     -71.958  14.806  14.737  1.00  27.39     A   N
ATOM  12413  CA   ASP E 133     -72.849  15.893  14.973  1.00  26.84     A   C
ATOM  12414  CB   ASP E 133     -72.713  16.367  16.411  1.00  24.80     A   C
ATOM  12415  CG   ASP E 133     -71.275  16.441  16.885  1.00  28.85     A   C
ATOM  12416  OD1  ASP E 133     -70.693  17.504  16.864  1.00  32.50     A   O
ATOM  12417  OD2  ASP E 133     -70.724  15.457  17.327  1.00  29.81     A   O-1
ATOM  12418  C    ASP E 133     -72.589  17.009  13.971  1.00  26.82     A   C
ATOM  12419  O    ASP E 133     -73.463  17.729  13.634  1.00  27.16     A   O
ATOM  12420  N    TRP E 134     -71.360  17.136  13.523  1.00  25.83     A   N
ATOM  12421  CA   TRP E 134     -70.953  18.158  12.596  1.00  27.38     A   C
ATOM  12422  CB   TRP E 134     -69.431  18.115  12.492  1.00  27.05     A   C
ATOM  12423  CG   TRP E 134     -68.784  19.136  11.657  1.00  26.29     A   C
ATOM  12424  CD1  TRP E 134     -68.201  18.935  10.492  1.00  22.04     A   C
ATOM  12425  NE1  TRP E 134     -67.700  20.072  10.017  1.00  26.08     A   N
ATOM  12426  CE2  TRP E 134     -67.954  21.070  10.897  1.00  19.10     A   C
ATOM  12427  CD2  TRP E 134     -68.622  20.509  11.951  1.00  21.41     A   C
ATOM  12428  CE3  TRP E 134     -68.992  21.317  13.004  1.00  21.36     A   C
ATOM  12429  CZ3  TRP E 134     -68.683  22.620  12.953  1.00  20.49     A   C
ATOM  12430  CH2  TRP E 134     -68.017  23.154  11.886  1.00  21.36     A   C
ATOM  12431  CZ2  TRP E 134     -67.637  22.393  10.851  1.00  19.13     A   C
```

Appendix 1

```
ATOM  12432  C    TRP E 134    -71.633  18.067  11.234  1.00 30.02      A  C
ATOM  12433  O    TRP E 134    -72.036  19.051  10.681  1.00 29.36      A  O
ATOM  12434  N    GLU E 135    -71.739  16.868  10.691  1.00 32.50      A  N
ATOM  12435  CA   GLU E 135    -72.581  16.561   9.561  1.00 35.51      A  C
ATOM  12436  CB   GLU E 135    -72.241  15.176   9.076  1.00 36.33      A  C
ATOM  12437  CG   GLU E 135    -72.489  14.959   7.658  1.00 40.05      A  C
ATOM  12438  CD   GLU E 135    -72.033  13.623   7.215  1.00 47.11      A  C
ATOM  12439  OE1  GLU E 135    -70.842  13.381   7.248  1.00 46.36      A  O
ATOM  12440  OE2  GLU E 135    -72.862  12.811   6.820  1.00 50.21      A  O-1
ATOM  12441  C    GLU E 135    -74.075  16.657   9.770  1.00 35.82      A  C
ATOM  12442  O    GLU E 135    -74.771  17.185   8.971  1.00 36.27      A  O
ATOM  12443  N    GLU E 136    -74.560  16.137  10.865  1.00 36.96      A  N
ATOM  12444  CA   GLU E 136    -75.975  16.047  11.119  1.00 38.71      A  C
ATOM  12445  CB   GLU E 136    -76.212  15.447  12.494  1.00 38.74      A  C
ATOM  12446  CG   GLU E 136    -76.762  14.062  12.502  1.00 47.18      A  C
ATOM  12447  CD   GLU E 136    -75.749  12.973  12.874  1.00 60.20      A  C
ATOM  12448  OE1  GLU E 136    -75.161  12.381  11.966  1.00 62.72      A  O
ATOM  12449  OE2  GLU E 136    -75.545  12.659  14.061  1.00 64.27      A  O-1
ATOM  12450  C    GLU E 136    -76.501  17.443  11.104  1.00 37.69      A  C
ATOM  12451  O    GLU E 136    -77.601  17.719  10.659  1.00 36.71      A  O
ATOM  12452  N    ASP E 137    -75.648  18.333  11.554  1.00 37.26      A  N
ATOM  12453  CA   ASP E 137    -75.991  19.697  11.803  1.00 36.22      A  C
ATOM  12454  CB   ASP E 137    -75.172  20.227  12.962  1.00 36.55      A  C
ATOM  12455  CG   ASP E 137    -75.723  19.831  14.305  1.00 40.59      A  C
ATOM  12456  OD1  ASP E 137    -76.800  19.237  14.392  1.00 38.35      A  O
ATOM  12457  OD2  ASP E 137    -75.053  20.102  15.288  1.00 42.31      A  O-1
ATOM  12458  C    ASP E 137    -75.818  20.542  10.576  1.00 35.16      A  C
ATOM  12459  O    ASP E 137    -76.164  21.688  10.571  1.00 35.49      A  O
ATOM  12460  N    GLY E 138    -75.276  19.972   9.524  1.00 34.20      A  N
ATOM  12461  CA   GLY E 138    -75.185  20.671   8.270  1.00 33.61      A  C
ATOM  12462  C    GLY E 138    -74.016  21.564   8.112  1.00 33.44      A  C
ATOM  12463  O    GLY E 138    -73.959  22.344   7.221  1.00 33.54      A  O
ATOM  12464  N    PHE E 139    -73.115  21.472   9.049  1.00 33.83      A  N
ATOM  12465  CA   PHE E 139    -71.812  22.078   8.979  1.00 33.07      A  C
ATOM  12466  CB   PHE E 139    -71.243  22.294  10.365  1.00 32.97      A  C
ATOM  12467  CG   PHE E 139    -72.132  23.080  11.266  1.00 31.61      A  C
ATOM  12468  CD1  PHE E 139    -72.511  24.336  10.949  1.00 30.27      A  C
ATOM  12469  CE1  PHE E 139    -73.295  25.040  11.756  1.00 32.33      A  C
ATOM  12470  CZ   PHE E 139    -73.726  24.511  12.897  1.00 29.32      A  C
ATOM  12471  CE2  PHE E 139    -73.378  23.279  13.228  1.00 29.24      A  C
ATOM  12472  CD2  PHE E 139    -72.576  22.562  12.425  1.00 31.16      A  C
ATOM  12473  C    PHE E 139    -70.814  21.511   7.986  1.00 33.38      A  C
ATOM  12474  O    PHE E 139    -70.023  22.217   7.489  1.00 33.63      A  O
ATOM  12475  N    GLY E 140    -70.902  20.249   7.637  1.00 33.21      A  N
ATOM  12476  CA   GLY E 140    -69.969  19.714   6.682  1.00 35.43      A  C
ATOM  12477  C    GLY E 140    -69.692  18.235   6.716  1.00 36.62      A  C
ATOM  12478  O    GLY E 140    -70.241  17.548   7.504  1.00 38.06      A  O
ATOM  12479  N    THR E 141    -68.842  17.742   5.837  1.00 36.34      A  N
ATOM  12480  CA   THR E 141    -68.564  16.328   5.781  1.00 36.84      A  C
ATOM  12481  CB   THR E 141    -68.652  15.818   4.376  1.00 36.19      A  C
ATOM  12482  OG1  THR E 141    -68.076  16.761   3.485  1.00 37.27      A  O
ATOM  12483  CG2  THR E 141    -70.040  15.655   4.017  1.00 35.53      A  C
ATOM  12484  C    THR E 141    -67.241  15.903   6.366  1.00 37.58      A  C
ATOM  12485  O    THR E 141    -67.025  14.754   6.606  1.00 38.08      A  O
```

Appendix 1

```
ATOM  12486  N    ASP E 142   -66.358  16.855   6.567  1.00  38.67      A  N
ATOM  12487  CA   ASP E 142   -65.069  16.617   7.162  1.00  39.61      A  C
ATOM  12488  CB   ASP E 142   -64.010  17.083   6.195  1.00  41.57      A  C
ATOM  12489  CG   ASP E 142   -62.651  16.717   6.621  1.00  46.22      A  C
ATOM  12490  OD1  ASP E 142   -62.375  15.535   6.729  1.00  49.68      A  O
ATOM  12491  OD2  ASP E 142   -61.846  17.605   6.838  1.00  51.21      A  O-1
ATOM  12492  C    ASP E 142   -64.899  17.403   8.428  1.00  37.81      A  C
ATOM  12493  O    ASP E 142   -64.819  18.595   8.404  1.00  37.11      A  O
ATOM  12494  N    PRO E 143   -64.808  16.717   9.542  1.00  36.13      A  N
ATOM  12495  CA   PRO E 143   -64.737  17.378  10.828  1.00  34.73      A  C
ATOM  12496  CB   PRO E 143   -64.935  16.243  11.798  1.00  33.47      A  C
ATOM  12497  CG   PRO E 143   -64.647  15.081  11.061  1.00  35.68      A  C
ATOM  12498  CD   PRO E 143   -65.073  15.297   9.712  1.00  35.88      A  C
ATOM  12499  C    PRO E 143   -63.467  18.152  11.085  1.00  33.55      A  C
ATOM  12500  O    PRO E 143   -63.457  18.879  12.014  1.00  33.62      A  O
ATOM  12501  N    ILE E 144   -62.426  18.005  10.297  1.00  31.99      A  N
ATOM  12502  CA   ILE E 144   -61.208  18.732  10.583  1.00  31.54      A  C
ATOM  12503  CB   ILE E 144   -60.033  17.789  10.860  1.00  29.22      A  C
ATOM  12504  CG1  ILE E 144   -59.761  16.912   9.675  1.00  27.06      A  C
ATOM  12505  CD1  ILE E 144   -58.441  16.531   9.570  1.00  21.64      A  C
ATOM  12506  CG2  ILE E 144   -60.318  16.940  12.015  1.00  27.07      A  C
ATOM  12507  C    ILE E 144   -60.773  19.822   9.610  1.00  33.08      A  C
ATOM  12508  O    ILE E 144   -59.846  20.526   9.876  1.00  33.20      A  O
ATOM  12509  N    GLU E 145   -61.429  19.937   8.478  1.00  33.96      A  N
ATOM  12510  CA   GLU E 145   -60.990  20.822   7.428  1.00  35.58      A  C
ATOM  12511  CB   GLU E 145   -61.834  20.559   6.204  1.00  36.75      A  C
ATOM  12512  CG   GLU E 145   -61.703  21.515   5.075  1.00  44.26      A  C
ATOM  12513  CD   GLU E 145   -62.908  21.522   4.200  1.00  52.48      A  C
ATOM  12514  OE1  GLU E 145   -63.685  22.469   4.280  1.00  52.75      A  O
ATOM  12515  OE2  GLU E 145   -63.083  20.581   3.423  1.00  56.14      A  O-1
ATOM  12516  C    GLU E 145   -61.014  22.279   7.807  1.00  35.19      A  C
ATOM  12517  O    GLU E 145   -60.098  23.017   7.511  1.00  35.30      A  O
ATOM  12518  N    LYS E 146   -62.085  22.684   8.449  1.00  33.85      A  N
ATOM  12519  CA   LYS E 146   -62.202  24.003   8.980  1.00  33.80      A  C
ATOM  12520  CB   LYS E 146   -62.781  24.936   7.964  1.00  34.11      A  C
ATOM  12521  CG   LYS E 146   -64.221  24.933   7.953  1.00  39.10      A  C
ATOM  12522  CD   LYS E 146   -64.691  25.100   6.591  1.00  47.31      A  C
ATOM  12523  CE   LYS E 146   -66.158  25.003   6.534  1.00  52.30      A  C
ATOM  12524  NZ   LYS E 146   -66.650  25.992   5.596  1.00  56.05      A  N
ATOM  12525  C    LYS E 146   -63.077  23.994  10.172  1.00  33.03      A  C
ATOM  12526  O    LYS E 146   -63.846  23.098  10.352  1.00  31.46      A  O
ATOM  12527  N    GLU E 147   -62.910  24.998  11.005  1.00  31.26      A  N
ATOM  12528  CA   GLU E 147   -63.763  25.249  12.125  1.00  31.25      A  C
ATOM  12529  CB   GLU E 147   -65.155  25.557  11.648  1.00  32.79      A  C
ATOM  12530  CG   GLU E 147   -65.330  26.972  11.237  1.00  33.85      A  C
ATOM  12531  CD   GLU E 147   -66.413  27.137  10.236  1.00  37.79      A  C
ATOM  12532  OE1  GLU E 147   -67.076  26.180   9.925  1.00  33.32      A  O
ATOM  12533  OE2  GLU E 147   -66.604  28.227   9.735  1.00  42.10      A  O-1
ATOM  12534  C    GLU E 147   -63.720  24.087  13.068  1.00  30.03      A  C
ATOM  12535  O    GLU E 147   -62.761  23.395  13.080  1.00  29.11      A  O
ATOM  12536  N    ASN E 148   -64.764  23.859  13.847  1.00  28.70      A  N
ATOM  12537  CA   ASN E 148   -64.835  22.715  14.760  1.00  27.59      A  C
ATOM  12538  CB   ASN E 148   -65.072  21.427  13.981  1.00  26.45      A  C
ATOM  12539  CG   ASN E 148   -65.904  20.467  14.711  1.00  25.25      A  C
```

Appendix 1

```
ATOM  12540  OD1 ASN E 148    -66.695  20.843  15.488  1.00  26.87    A  O
ATOM  12541  ND2 ASN E 148    -65.740  19.228  14.448  1.00  23.22    A  N
ATOM  12542  C   ASN E 148    -63.681  22.550  15.766  1.00  27.72    A  C
ATOM  12543  O   ASN E 148    -63.152  21.506  15.936  1.00  27.01    A  O
ATOM  12544  N   ILE E 149    -63.298  23.614  16.417  1.00  27.99    A  N
ATOM  12545  CA  ILE E 149    -62.169  23.593  17.305  1.00  30.41    A  C
ATOM  12546  CB  ILE E 149    -61.640  25.015  17.627  1.00  30.06    A  C
ATOM  12547  CG1 ILE E 149    -60.169  24.994  17.989  1.00  29.05    A  C
ATOM  12548  CD1 ILE E 149    -59.297  24.329  17.034  1.00  23.51    A  C
ATOM  12549  CG2 ILE E 149    -62.386  25.646  18.710  1.00  31.08    A  C
ATOM  12550  C   ILE E 149    -62.414  22.690  18.492  1.00  32.19    A  C
ATOM  12551  O   ILE E 149    -61.532  22.085  19.013  1.00  33.21    A  O
ATOM  12552  N   MET E 150    -63.656  22.580  18.877  1.00  33.31    A  N
ATOM  12553  CA  MET E 150    -63.973  21.703  19.936  1.00  34.84    A  C
ATOM  12554  CB  MET E 150    -65.450  21.801  20.236  1.00  36.34    E  C
ATOM  12555  CG  MET E 150    -66.309  21.715  19.015  1.00  39.04    E  C
ATOM  12556  SD  MET E 150    -68.061  21.813  19.308  1.00  51.72    E  S
ATOM  12557  CE  MET E 150    -68.618  22.625  17.899  1.00  51.15    E  C
ATOM  12558  C   MET E 150    -63.664  20.281  19.606  1.00  34.44    A  C
ATOM  12559  O   MET E 150    -63.152  19.583  20.409  1.00  36.79    A  O
ATOM  12560  N   TYR E 151    -64.050  19.770  18.478  1.00  31.72    A  N
ATOM  12561  CA  TYR E 151    -63.608  18.440  18.251  1.00  27.84    A  C
ATOM  12562  CB  TYR E 151    -64.485  17.793  17.229  1.00  26.61    A  C
ATOM  12563  CG  TYR E 151    -63.964  16.533  16.723  1.00  23.06    A  C
ATOM  12564  CD1 TYR E 151    -64.191  15.367  17.374  1.00  17.18    A  C
ATOM  12565  CE1 TYR E 151    -63.701  14.258  16.914  1.00  15.11    A  C
ATOM  12566  CZ  TYR E 151    -62.973  14.290  15.801  1.00  16.74    A  C
ATOM  12567  OH  TYR E 151    -62.473  13.178  15.292  1.00  23.22    A  O
ATOM  12568  CE2 TYR E 151    -62.734  15.416  15.159  1.00  17.71    A  C
ATOM  12569  CD2 TYR E 151    -63.218  16.513  15.603  1.00  18.57    A  C
ATOM  12570  C   TYR E 151    -62.124  18.322  17.916  1.00  28.92    A  C
ATOM  12571  O   TYR E 151    -61.406  17.561  18.505  1.00  27.85    A  O
ATOM  12572  N   LYS E 152    -61.682  19.088  16.952  1.00  26.14    A  N
ATOM  12573  CA  LYS E 152    -60.330  18.993  16.513  1.00  25.53    A  C
ATOM  12574  CB  LYS E 152    -60.166  19.464  15.058  1.00  26.87    A  C
ATOM  12575  CG  LYS E 152    -60.229  20.912  14.809  1.00  25.28    A  C
ATOM  12576  CD  LYS E 152    -59.782  21.209  13.462  1.00  28.87    A  C
ATOM  12577  CE  LYS E 152    -60.643  22.252  12.834  1.00  28.91    A  C
ATOM  12578  NZ  LYS E 152    -59.961  23.229  12.012  1.00  20.52    A  N
ATOM  12579  C   LYS E 152    -59.203  19.378  17.503  1.00  25.21    A  C
ATOM  12580  O   LYS E 152    -58.187  18.798  17.494  1.00  24.70    A  O
ATOM  12581  N   GLY E 153    -59.409  20.340  18.368  1.00  25.17    A  N
ATOM  12582  CA  GLY E 153    -58.425  20.629  19.368  1.00  23.71    A  C
ATOM  12583  C   GLY E 153    -58.161  19.514  20.343  1.00  23.89    A  C
ATOM  12584  O   GLY E 153    -57.050  19.276  20.697  1.00  22.71    A  O
ATOM  12585  N   HIS E 154    -59.194  18.846  20.793  1.00  22.45    A  N
ATOM  12586  CA  HIS E 154    -59.024  17.752  21.699  1.00  21.67    A  C
ATOM  12587  CB  HIS E 154    -60.364  17.269  22.169  1.00  21.22    A  C
ATOM  12588  CG  HIS E 154    -61.009  18.144  23.191  1.00  23.13    A  C
ATOM  12589  ND1 HIS E 154    -60.406  18.488  24.363  1.00  23.78    A  N
ATOM  12590  CE1 HIS E 154    -61.216  19.231  25.078  1.00  25.68    A  C
ATOM  12591  NE2 HIS E 154    -62.341  19.353  24.423  1.00  26.49    A  N
ATOM  12592  CD2 HIS E 154    -62.239  18.675  23.245  1.00  27.03    A  C
ATOM  12593  C   HIS E 154    -58.275  16.639  21.060  1.00  21.49    A  C
```

Appendix 1

```
ATOM  12594  O    HIS E 154     -57.452  16.024  21.664  1.00 23.88      A    O
ATOM  12595  N    LEU E 155     -58.594  16.368  19.823  1.00 21.16      A    N
ATOM  12596  CA   LEU E 155     -57.986  15.313  19.082  1.00 20.42      A    C
ATOM  12597  CB   LEU E 155     -58.697  15.131  17.749  1.00 18.81      A    C
ATOM  12598  CG   LEU E 155     -58.134  14.142  16.757  1.00 19.55      A    C
ATOM  12599  CD1  LEU E 155     -58.224  12.767  17.206  1.00 15.55      A    C
ATOM  12600  CD2  LEU E 155     -58.705  14.288  15.452  1.00 16.20      A    C
ATOM  12601  C    LEU E 155     -56.531  15.555  18.875  1.00 21.62      A    C
ATOM  12602  O    LEU E 155     -55.749  14.676  19.017  1.00 22.43      A    O
ATOM  12603  N    ASN E 156     -56.181  16.772  18.533  1.00 20.93      A    N
ATOM  12604  CA   ASN E 156     -54.822  17.179  18.378  1.00 21.46      A    C
ATOM  12605  CB   ASN E 156     -54.757  18.555  17.750  1.00 20.26      A    C
ATOM  12606  CG   ASN E 156     -53.460  18.825  17.118  1.00 21.45      A    C
ATOM  12607  OD1  ASN E 156     -53.004  18.071  16.333  1.00 25.88      A    O
ATOM  12608  ND2  ASN E 156     -52.836  19.876  17.509  1.00 17.45      A    N
ATOM  12609  C    ASN E 156     -54.055  17.134  19.658  1.00 22.47      A    C
ATOM  12610  O    ASN E 156     -52.914  16.793  19.661  1.00 22.86      A    O
ATOM  12611  N    LEU E 157     -54.688  17.504  20.749  1.00 22.98      A    N
ATOM  12612  CA   LEU E 157     -54.062  17.389  22.027  1.00 23.00      A    C
ATOM  12613  CB   LEU E 157     -54.821  18.166  23.106  1.00 23.88      A    C
ATOM  12614  CG   LEU E 157     -54.299  18.236  24.530  1.00 22.87      A    C
ATOM  12615  CD1  LEU E 157     -53.005  18.800  24.585  1.00 20.73      A    C
ATOM  12616  CD2  LEU E 157     -55.172  18.980  25.364  1.00 22.34      A    C
ATOM  12617  C    LEU E 157     -53.795  15.943  22.382  1.00 23.03      A    C
ATOM  12618  O    LEU E 157     -52.749  15.595  22.820  1.00 23.24      A    O
ATOM  12619  N    MET E 158     -54.751  15.105  22.105  1.00 22.92      A    N
ATOM  12620  CA   MET E 158     -54.601  13.682  22.254  1.00 22.98      A    C
ATOM  12621  CB   MET E 158     -55.933  12.949  22.100  1.00 22.21      E    C
ATOM  12622  CG   MET E 158     -57.072  13.650  22.711  1.00 21.55      E    C
ATOM  12623  SD   MET E 158     -58.688  12.969  22.608  1.00 29.62      E    S
ATOM  12624  CE   MET E 158     -58.397  11.286  22.596  1.00 24.46      E    C
ATOM  12625  C    MET E 158     -53.532  13.118  21.351  1.00 22.80      A    C
ATOM  12626  O    MET E 158     -52.875  12.231  21.708  1.00 24.13      A    O
ATOM  12627  N    TYR E 159     -53.355  13.622  20.166  1.00 22.80      A    N
ATOM  12628  CA   TYR E 159     -52.318  13.072  19.357  1.00 21.91      A    C
ATOM  12629  CB   TYR E 159     -52.242  13.740  18.012  1.00 21.85      A    C
ATOM  12630  CG   TYR E 159     -53.183  13.271  16.965  1.00 22.12      A    C
ATOM  12631  CD1  TYR E 159     -53.460  11.962  16.822  1.00 24.73      A    C
ATOM  12632  CE1  TYR E 159     -54.289  11.546  15.895  1.00 23.78      A    C
ATOM  12633  CZ   TYR E 159     -54.858  12.429  15.076  1.00 26.80      A    C
ATOM  12634  OH   TYR E 159     -55.702  11.979  14.136  1.00 29.03      A    O
ATOM  12635  CE2  TYR E 159     -54.613  13.734  15.188  1.00 25.40      A    C
ATOM  12636  CD2  TYR E 159     -53.793  14.152  16.112  1.00 23.75      A    C
ATOM  12637  C    TYR E 159     -51.021  13.289  20.023  1.00 22.08      A    C
ATOM  12638  O    TYR E 159     -50.213  12.448  20.025  1.00 22.65      A    O
ATOM  12639  N    GLY E 160     -50.809  14.468  20.530  1.00 21.11      A    N
ATOM  12640  CA   GLY E 160     -49.625  14.777  21.249  1.00 22.60      A    C
ATOM  12641  C    GLY E 160     -49.419  14.065  22.545  1.00 24.12      A    C
ATOM  12642  O    GLY E 160     -48.380  13.565  22.814  1.00 24.78      A    O
ATOM  12643  N    LEU E 161     -50.440  13.993  23.347  1.00 23.27      A    N
ATOM  12644  CA   LEU E 161     -50.312  13.259  24.557  1.00 23.57      A    C
ATOM  12645  CB   LEU E 161     -51.518  13.440  25.447  1.00 24.30      A    C
ATOM  12646  CG   LEU E 161     -51.799  14.844  25.914  1.00 21.59      A    C
ATOM  12647  CD1  LEU E 161     -53.008  14.893  26.650  1.00 23.04      A    C
```

Appendix 1

```
ATOM  12648  CD2  LEU  E  161    -50.737  15.296  26.726  1.00  21.67    A    C
ATOM  12649  C    LEU  E  161    -50.030  11.810  24.322  1.00  23.37    A    C
ATOM  12650  O    LEU  E  161    -49.323  11.234  25.049  1.00  23.00    A    O
ATOM  12651  N    TYR  E  162    -50.583  11.208  23.302  1.00  23.45    A    N
ATOM  12652  CA   TYR  E  162    -50.279   9.842  23.026  1.00  23.30    A    C
ATOM  12653  CB   TYR  E  162    -51.171   9.353  21.894  1.00  22.77    A    C
ATOM  12654  CG   TYR  E  162    -50.721   8.077  21.310  1.00  21.94    A    C
ATOM  12655  CD1  TYR  E  162    -51.046   6.904  21.893  1.00  20.48    A    C
ATOM  12656  CE1  TYR  E  162    -50.621   5.778  21.418  1.00  21.45    A    C
ATOM  12657  CZ   TYR  E  162    -49.856   5.773  20.345  1.00  24.89    A    C
ATOM  12658  OH   TYR  E  162    -49.455   4.584  19.868  1.00  28.81    A    O
ATOM  12659  CE2  TYR  E  162    -49.495   6.920  19.744  1.00  21.27    A    C
ATOM  12660  CD2  TYR  E  162    -49.925   8.047  20.212  1.00  17.33    A    C
ATOM  12661  C    TYR  E  162    -48.807   9.599  22.699  1.00  24.73    A    C
ATOM  12662  O    TYR  E  162    -48.214   8.723  23.227  1.00  26.37    A    O
ATOM  12663  N    GLN  E  163    -48.230  10.412  21.844  1.00  25.48    A    N
ATOM  12664  CA   GLN  E  163    -46.836  10.339  21.500  1.00  25.10    A    C
ATOM  12665  CB   GLN  E  163    -46.555  11.233  20.311  1.00  25.55    A    C
ATOM  12666  CG   GLN  E  163    -45.242  11.037  19.687  1.00  27.31    A    C
ATOM  12667  CD   GLN  E  163    -45.208  11.602  18.340  1.00  32.78    A    C
ATOM  12668  OE1  GLN  E  163    -46.229  11.836  17.765  1.00  36.44    A    O
ATOM  12669  NE2  GLN  E  163    -44.044  11.801  17.808  1.00  31.05    A    N
ATOM  12670  C    GLN  E  163    -45.865  10.615  22.639  1.00  23.25    A    C
ATOM  12671  O    GLN  E  163    -44.842  10.000  22.746  1.00  21.99    A    O
ATOM  12672  N    LEU  E  164    -46.208  11.556  23.479  1.00  22.97    A    N
ATOM  12673  CA   LEU  E  164    -45.442  11.848  24.653  1.00  22.06    A    C
ATOM  12674  CB   LEU  E  164    -46.116  12.979  25.377  1.00  21.06    A    C
ATOM  12675  CG   LEU  E  164    -45.412  14.244  25.742  1.00  20.70    A    C
ATOM  12676  CD1  LEU  E  164    -44.251  14.434  24.918  1.00  17.71    A    C
ATOM  12677  CD2  LEU  E  164    -46.346  15.319  25.520  1.00  21.03    A    C
ATOM  12678  C    LEU  E  164    -45.374  10.696  25.618  1.00  23.00    A    C
ATOM  12679  O    LEU  E  164    -44.338  10.400  26.137  1.00  22.85    A    O
ATOM  12680  N    VAL  E  165    -46.503  10.094  25.907  1.00  23.13    A    N
ATOM  12681  CA   VAL  E  165    -46.557   8.996  26.832  1.00  22.84    A    C
ATOM  12682  CB   VAL  E  165    -47.985   8.681  27.209  1.00  22.34    A    C
ATOM  12683  CG1  VAL  E  165    -48.073   7.380  27.882  1.00  18.61    A    C
ATOM  12684  CG2  VAL  E  165    -48.552   9.739  28.031  1.00  18.66    A    C
ATOM  12685  C    VAL  E  165    -45.876   7.768  26.319  1.00  24.38    A    C
ATOM  12686  O    VAL  E  165    -45.094   7.180  26.972  1.00  25.31    A    O
ATOM  12687  N    THR  E  166    -46.224   7.394  25.119  1.00  25.08    A    N
ATOM  12688  CA   THR  E  166    -45.607   6.305  24.432  1.00  27.44    A    C
ATOM  12689  CB   THR  E  166    -46.564   5.643  23.539  1.00  28.30    A    C
ATOM  12690  OG1  THR  E  166    -46.735   6.456  22.388  1.00  26.19    A    O
ATOM  12691  CG2  THR  E  166    -47.861   5.468  24.209  1.00  22.62    A    C
ATOM  12692  C    THR  E  166    -44.611   6.862  23.494  1.00  29.85    A    C
ATOM  12693  O    THR  E  166    -44.701   7.975  23.086  1.00  33.00    A    O
ATOM  12694  N    GLY  E  167    -43.653   6.093  23.096  1.00  30.19    A    N
ATOM  12695  CA   GLY  E  167    -42.745   6.648  22.124  1.00  32.09    A    C
ATOM  12696  C    GLY  E  167    -43.260   6.784  20.710  1.00  31.81    A    C
ATOM  12697  O    GLY  E  167    -42.609   7.248  19.862  1.00  31.66    A    O
ATOM  12698  N    SER  E  168    -44.466   6.365  20.476  1.00  32.42    A    N
ATOM  12699  CA   SER  E  168    -44.943   5.999  19.187  1.00  33.53    A    C
ATOM  12700  CB   SER  E  168    -46.133   5.109  19.385  1.00  32.58    A    C
ATOM  12701  OG   SER  E  168    -46.869   5.014  18.249  1.00  32.70    A    O
```

Appendix 1

```
ATOM  12702  C    SER E 168     -45.231   7.124  18.229  1.00 34.30      A  C
ATOM  12703  O    SER E 168     -45.816   8.112  18.573  1.00 34.99      A  O
ATOM  12704  N    ARG E 169     -44.801   6.942  17.000  1.00 34.65      A  N
ATOM  12705  CA   ARG E 169     -45.040   7.907  15.958  1.00 35.49      A  C
ATOM  12706  CB   ARG E 169     -43.776   8.420  15.319  1.00 35.30      A  C
ATOM  12707  CG   ARG E 169     -42.913   7.410  14.811  1.00 42.59      A  C
ATOM  12708  CD   ARG E 169     -41.735   7.348  15.654  1.00 52.43      A  C
ATOM  12709  NE   ARG E 169     -41.402   8.659  16.096  1.00 55.17      A  N
ATOM  12710  CZ   ARG E 169     -40.400   9.332  15.590  1.00 60.14      A  C
ATOM  12711  NH1  ARG E 169     -39.683   8.758  14.650  1.00 58.87      A  N
ATOM  12712  NH2  ARG E 169     -40.115  10.558  16.016  1.00 61.92      A  N
ATOM  12713  C    ARG E 169     -46.002   7.402  14.944  1.00 34.90      A  C
ATOM  12714  O    ARG E 169     -46.025   7.807  13.841  1.00 35.14      A  O
ATOM  12715  N    ARG E 170     -46.850   6.516  15.369  1.00 35.49      A  N
ATOM  12716  CA   ARG E 170     -47.886   6.011  14.524  1.00 35.15      A  C
ATOM  12717  CB   ARG E 170     -48.560   4.817  15.161  1.00 36.31      A  C
ATOM  12718  CG   ARG E 170     -49.634   5.110  16.110  1.00 40.12      A  C
ATOM  12719  CD   ARG E 170     -50.327   3.862  16.553  1.00 46.34      A  C
ATOM  12720  NE   ARG E 170     -51.522   3.629  15.784  1.00 49.65      A  N
ATOM  12721  CZ   ARG E 170     -52.105   2.458  15.648  1.00 54.91      A  C
ATOM  12722  NH1  ARG E 170     -51.602   1.423  16.246  1.00 56.85      A  N
ATOM  12723  NH2  ARG E 170     -53.190   2.323  14.921  1.00 54.60      A  N
ATOM  12724  C    ARG E 170     -48.876   7.065  14.109  1.00 34.43      A  C
ATOM  12725  O    ARG E 170     -49.547   6.902  13.138  1.00 35.24      A  O
ATOM  12726  N    TYR E 171     -48.956   8.144  14.860  1.00 33.10      A  N
ATOM  12727  CA   TYR E 171     -49.877   9.212  14.564  1.00 31.41      A  C
ATOM  12728  CB   TYR E 171     -50.720   9.482  15.772  1.00 31.62      A  C
ATOM  12729  CG   TYR E 171     -51.698   8.421  16.055  1.00 36.35      A  C
ATOM  12730  CD1  TYR E 171     -52.585   8.016  15.108  1.00 37.94      A  C
ATOM  12731  CE1  TYR E 171     -53.460   7.054  15.374  1.00 40.69      A  C
ATOM  12732  CZ   TYR E 171     -53.478   6.489  16.590  1.00 39.12      A  C
ATOM  12733  OH   TYR E 171     -54.367   5.525  16.878  1.00 44.35      A  O
ATOM  12734  CE2  TYR E 171     -52.629   6.876  17.537  1.00 36.48      A  C
ATOM  12735  CD2  TYR E 171     -51.752   7.824  17.275  1.00 36.61      A  C
ATOM  12736  C    TYR E 171     -49.253  10.506  14.090  1.00 29.44      A  C
ATOM  12737  O    TYR E 171     -49.918  11.461  13.937  1.00 27.54      A  O
ATOM  12738  N    GLU E 172     -47.973  10.502  13.834  1.00 28.86      A  N
ATOM  12739  CA   GLU E 172     -47.247  11.692  13.533  1.00 29.63      A  C
ATOM  12740  CB   GLU E 172     -45.783  11.329  13.426  1.00 30.03      A  C
ATOM  12741  CG   GLU E 172     -44.871  12.246  14.115  1.00 34.37      A  C
ATOM  12742  CD   GLU E 172     -43.510  11.703  14.314  1.00 38.92      A  C
ATOM  12743  OE1  GLU E 172     -42.883  11.253  13.368  1.00 39.58      A  O
ATOM  12744  OE2  GLU E 172     -43.043  11.730  15.434  1.00 40.28      A  O-1
ATOM  12745  C    GLU E 172     -47.718  12.416  12.276  1.00 29.19      A  C
ATOM  12746  O    GLU E 172     -47.809  13.601  12.258  1.00 29.58      A  O
ATOM  12747  N    ALA E 173     -48.020  11.708  11.221  1.00 28.09      A  N
ATOM  12748  CA   ALA E 173     -48.510  12.380  10.046  1.00 27.48      A  C
ATOM  12749  CB   ALA E 173     -48.609  11.441   8.950  1.00 26.53      A  C
ATOM  12750  C    ALA E 173     -49.824  13.076  10.239  1.00 27.41      A  C
ATOM  12751  O    ALA E 173     -49.992  14.157   9.786  1.00 28.58      A  O
ATOM  12752  N    GLU E 174     -50.756  12.434  10.896  1.00 26.02      A  N
ATOM  12753  CA   GLU E 174     -52.041  13.014  11.196  1.00 27.78      A  C
ATOM  12754  CB   GLU E 174     -52.939  11.987  11.861  1.00 29.94      A  C
ATOM  12755  CG   GLU E 174     -53.226  10.803  11.037  1.00 35.75      A  C
```

Appendix 1

```
ATOM  12756  CD   GLU E 174     -54.045   9.772  11.727  1.00 43.45      A  C
ATOM  12757  OE1  GLU E 174     -54.090   8.654  11.258  1.00 47.92      A  O
ATOM  12758  OE2  GLU E 174     -54.671  10.068  12.717  1.00 48.00      A  O-1
ATOM  12759  C    GLU E 174     -51.963  14.225  12.090  1.00 26.75      A  C
ATOM  12760  O    GLU E 174     -52.734  15.117  11.966  1.00 26.63      A  O
ATOM  12761  N    HIS E 175     -51.067  14.162  13.053  1.00 25.55      A  N
ATOM  12762  CA   HIS E 175     -50.709  15.191  14.008  1.00 23.33      A  C
ATOM  12763  CB   HIS E 175     -49.802  14.487  15.017  1.00 21.55      A  C
ATOM  12764  CG   HIS E 175     -49.534  15.241  16.274  1.00 21.18      A  C
ATOM  12765  ND1  HIS E 175     -50.343  16.230  16.749  1.00 20.78      A  N
ATOM  12766  CE1  HIS E 175     -49.837  16.722  17.847  1.00 18.05      A  C
ATOM  12767  NE2  HIS E 175     -48.742  16.063  18.118  1.00 19.68      A  N
ATOM  12768  CD2  HIS E 175     -48.529  15.134  17.154  1.00 15.81      A  C
ATOM  12769  C    HIS E 175     -50.063  16.456  13.403  1.00 23.70      A  C
ATOM  12770  O    HIS E 175     -50.400  17.543  13.750  1.00 23.61      A  O
ATOM  12771  N    ALA E 176     -49.142  16.286  12.487  1.00 23.30      A  N
ATOM  12772  CA   ALA E 176     -48.588  17.363  11.730  1.00 23.93      A  C
ATOM  12773  CB   ALA E 176     -47.549  16.825  10.843  1.00 23.57      A  C
ATOM  12774  C    ALA E 176     -49.638  18.015  10.888  1.00 25.45      A  C
ATOM  12775  O    ALA E 176     -49.744  19.195  10.778  1.00 26.16      A  O
ATOM  12776  N    HIS E 177     -50.426  17.198  10.269  1.00 27.10      A  N
ATOM  12777  CA   HIS E 177     -51.440  17.687   9.440  1.00 27.77      A  C
ATOM  12778  CB   HIS E 177     -52.066  16.499   8.764  1.00 29.67      A  C
ATOM  12779  CG   HIS E 177     -53.217  16.837   7.894  1.00 34.93      A  C
ATOM  12780  ND1  HIS E 177     -53.067  17.386   6.652  1.00 37.86      A  N
ATOM  12781  CE1  HIS E 177     -54.249  17.597   6.128  1.00 38.65      A  C
ATOM  12782  NE2  HIS E 177     -55.159  17.205   6.987  1.00 38.58      A  N
ATOM  12783  CD2  HIS E 177     -54.541  16.730   8.100  1.00 35.02      A  C
ATOM  12784  C    HIS E 177     -52.456  18.487  10.181  1.00 26.91      A  C
ATOM  12785  O    HIS E 177     -52.823  19.526   9.751  1.00 29.82      A  O
ATOM  12786  N    LEU E 178     -52.920  17.989  11.295  1.00 26.02      A  N
ATOM  12787  CA   LEU E 178     -53.841  18.690  12.127  1.00 25.01      A  C
ATOM  12788  CB   LEU E 178     -54.441  17.765  13.167  1.00 24.33      A  C
ATOM  12789  CG   LEU E 178     -55.565  18.399  13.949  1.00 22.51      A  C
ATOM  12790  CD1  LEU E 178     -56.518  18.851  12.974  1.00 18.24      A  C
ATOM  12791  CD2  LEU E 178     -56.182  17.460  14.853  1.00 11.27      A  C
ATOM  12792  C    LEU E 178     -53.296  19.933  12.763  1.00 25.97      A  C
ATOM  12793  O    LEU E 178     -53.983  20.878  12.906  1.00 28.60      A  O
ATOM  12794  N    THR E 179     -52.062  19.911  13.192  1.00 25.24      A  N
ATOM  12795  CA   THR E 179     -51.458  21.055  13.815  1.00 23.80      A  C
ATOM  12796  CB   THR E 179     -50.080  20.661  14.318  1.00 24.30      A  C
ATOM  12797  OG1  THR E 179     -50.219  19.795  15.401  1.00 25.15      A  O
ATOM  12798  CG2  THR E 179     -49.300  21.799  14.741  1.00 20.20      A  C
ATOM  12799  C    THR E 179     -51.334  22.220  12.865  1.00 23.67      A  C
ATOM  12800  O    THR E 179     -51.583  23.330  13.209  1.00 23.30      A  O
ATOM  12801  N    ARG E 180     -50.904  21.937  11.663  1.00 23.74      A  N
ATOM  12802  CA   ARG E 180     -50.846  22.920  10.618  1.00 24.05      A  C
ATOM  12803  CB   ARG E 180     -49.927  22.496   9.499  1.00 24.69      A  C
ATOM  12804  CG   ARG E 180     -48.534  22.335  10.002  1.00 26.03      A  C
ATOM  12805  CD   ARG E 180     -47.489  22.101   8.980  1.00 24.24      A  C
ATOM  12806  NE   ARG E 180     -47.553  23.101   7.967  1.00 25.24      A  N
ATOM  12807  CZ   ARG E 180     -46.929  24.250   7.977  1.00 27.12      A  C
ATOM  12808  NH1  ARG E 180     -46.142  24.586   8.953  1.00 21.45      A  N
ATOM  12809  NH2  ARG E 180     -47.113  25.061   6.973  1.00 24.12      A  N
```

Appendix 1

```
ATOM  12810  C    ARG E 180     -52.190  23.431  10.180  1.00 24.46      A  C
ATOM  12811  O    ARG E 180     -52.333  24.569   9.932  1.00 24.96      A  O
ATOM  12812  N    ILE E 181     -53.202  22.601  10.150  1.00 24.81      A  N
ATOM  12813  CA   ILE E 181     -54.511  23.121   9.914  1.00 24.30      A  C
ATOM  12814  CB   ILE E 181     -55.542  22.020   9.875  1.00 24.28      A  C
ATOM  12815  CG1  ILE E 181     -55.403  21.208   8.640  1.00 22.24      A  C
ATOM  12816  CD1  ILE E 181     -55.949  19.868   8.804  1.00 32.38      A  C
ATOM  12817  CG2  ILE E 181     -56.879  22.566   9.853  1.00 21.62      A  C
ATOM  12818  C    ILE E 181     -54.908  24.086  11.006  1.00 24.87      A  C
ATOM  12819  O    ILE E 181     -55.418  25.126  10.719  1.00 25.11      A  O
ATOM  12820  N    ILE E 182     -54.671  23.747  12.258  1.00 25.39      A  N
ATOM  12821  CA   ILE E 182     -55.031  24.624  13.337  1.00 26.02      A  C
ATOM  12822  CB   ILE E 182     -54.808  23.965  14.719  1.00 26.03      A  C
ATOM  12823  CG1  ILE E 182     -55.876  22.929  15.002  1.00 24.23      A  C
ATOM  12824  CD1  ILE E 182     -55.558  21.965  16.059  1.00 18.76      A  C
ATOM  12825  CG2  ILE E 182     -54.778  24.984  15.840  1.00 23.11      A  C
ATOM  12826  C    ILE E 182     -54.263  25.913  13.251  1.00 28.55      A  C
ATOM  12827  O    ILE E 182     -54.781  26.964  13.463  1.00 28.12      A  O
ATOM  12828  N    HIS E 183     -52.988  25.813  12.930  1.00 30.73      A  N
ATOM  12829  CA   HIS E 183     -52.153  26.967  12.871  1.00 31.16      A  C
ATOM  12830  CB   HIS E 183     -50.711  26.524  12.847  1.00 31.85      A  C
ATOM  12831  CG   HIS E 183     -49.747  27.641  12.717  1.00 33.80      A  C
ATOM  12832  ND1  HIS E 183     -49.239  28.038  11.508  1.00 34.72      A  N
ATOM  12833  CE1  HIS E 183     -48.425  29.050  11.695  1.00 35.46      A  C
ATOM  12834  NE2  HIS E 183     -48.379  29.316  12.980  1.00 37.14      A  N
ATOM  12835  CD2  HIS E 183     -49.199  28.449  13.643  1.00 34.68      A  C
ATOM  12836  C    HIS E 183     -52.474  27.866  11.700  1.00 31.10      A  C
ATOM  12837  O    HIS E 183     -52.474  29.042  11.833  1.00 29.93      A  O
ATOM  12838  N    ASP E 184     -52.726  27.281  10.551  1.00 31.77      A  N
ATOM  12839  CA   ASP E 184     -53.116  28.028   9.380  1.00 33.74      A  C
ATOM  12840  CB   ASP E 184     -53.234  27.130   8.155  1.00 33.54      A  C
ATOM  12841  CG   ASP E 184     -51.907  26.638   7.645  1.00 39.10      A  C
ATOM  12842  OD1  ASP E 184     -50.865  27.097   8.103  1.00 41.07      A  O
ATOM  12843  OD2  ASP E 184     -51.894  25.764   6.784  1.00 42.70      A  O-1
ATOM  12844  C    ASP E 184     -54.424  28.757   9.600  1.00 34.08      A  C
ATOM  12845  O    ASP E 184     -54.579  29.840   9.165  1.00 33.86      A  O
ATOM  12846  N    GLU E 185     -55.364  28.149  10.294  1.00 34.66      A  N
ATOM  12847  CA   GLU E 185     -56.592  28.790  10.645  1.00 34.09      A  C
ATOM  12848  CB   GLU E 185     -57.567  27.782  11.243  1.00 33.29      A  C
ATOM  12849  CG   GLU E 185     -58.873  27.691  10.530  1.00 37.21      A  C
ATOM  12850  CD   GLU E 185     -59.812  26.599  11.014  1.00 42.90      A  C
ATOM  12851  OE1  GLU E 185     -59.442  25.428  11.038  1.00 39.20      A  O
ATOM  12852  OE2  GLU E 185     -60.961  26.911  11.320  1.00 42.60      A  O-1
ATOM  12853  C    GLU E 185     -56.378  29.985  11.554  1.00 34.58      A  C
ATOM  12854  O    GLU E 185     -57.001  30.972  11.382  1.00 35.82      A  O
ATOM  12855  N    ILE E 186     -55.493  29.898  12.522  1.00 35.15      A  N
ATOM  12856  CA   ILE E 186     -55.210  31.010  13.410  1.00 36.60      A  C
ATOM  12857  CB   ILE E 186     -54.259  30.614  14.564  1.00 36.98      A  C
ATOM  12858  CG1  ILE E 186     -54.961  29.797  15.615  1.00 38.18      A  C
ATOM  12859  CD1  ILE E 186     -54.078  28.880  16.339  1.00 35.06      A  C
ATOM  12860  CG2  ILE E 186     -53.772  31.787  15.279  1.00 36.79      A  C
ATOM  12861  C    ILE E 186     -54.622  32.167  12.655  1.00 36.80      A  C
ATOM  12862  O    ILE E 186     -54.914  33.299  12.912  1.00 37.59      A  O
ATOM  12863  N    ALA E 187     -53.770  31.851  11.719  1.00 38.03      A  N
```

Appendix 1

```
ATOM  12864  CA   ALA E 187     -53.113  32.828  10.885  1.00 40.46      A  C
ATOM  12865  CB   ALA E 187     -52.055  32.196  10.087  1.00 40.18      A  C
ATOM  12866  C    ALA E 187     -54.059  33.587   9.995  1.00 41.52      A  C
ATOM  12867  O    ALA E 187     -53.786  34.687   9.618  1.00 42.69      A  O
ATOM  12868  N    ALA E 188     -55.183  32.987   9.677  1.00 41.50      A  N
ATOM  12869  CA   ALA E 188     -56.134  33.547   8.758  1.00 41.58      A  C
ATOM  12870  CB   ALA E 188     -56.598  32.512   7.896  1.00 39.81      A  C
ATOM  12871  C    ALA E 188     -57.328  34.236   9.361  1.00 42.74      A  C
ATOM  12872  O    ALA E 188     -58.230  34.576   8.658  1.00 42.61      A  O
ATOM  12873  N    ASN E 189     -57.361  34.394  10.663  1.00 42.81      A  N
ATOM  12874  CA   ASN E 189     -58.522  34.951  11.300  1.00 43.83      A  C
ATOM  12875  CB   ASN E 189     -59.061  34.040  12.388  1.00 43.78      A  C
ATOM  12876  CG   ASN E 189     -59.867  32.924  11.870  1.00 47.27      A  C
ATOM  12877  OD1  ASN E 189     -60.037  32.762  10.698  1.00 50.63      A  O
ATOM  12878  ND2  ASN E 189     -60.364  32.127  12.752  1.00 50.99      A  N
ATOM  12879  C    ASN E 189     -58.169  36.298  11.883  1.00 44.41      A  C
ATOM  12880  O    ASN E 189     -57.038  36.538  12.208  1.00 44.68      A  O
ATOM  12881  N    PRO E 190     -59.131  37.196  11.907  1.00 44.23      A  N
ATOM  12882  CA   PRO E 190     -58.967  38.529  12.443  1.00 44.75      A  C
ATOM  12883  CB   PRO E 190     -60.263  39.188  12.066  1.00 45.24      A  C
ATOM  12884  CG   PRO E 190     -60.846  38.351  11.094  1.00 45.16      A  C
ATOM  12885  CD   PRO E 190     -60.477  37.004  11.404  1.00 44.01      A  C
ATOM  12886  C    PRO E 190     -58.834  38.582  13.926  1.00 45.20      A  C
ATOM  12887  O    PRO E 190     -58.040  39.314  14.473  1.00 46.68      A  O
ATOM  12888  N    PHE E 191     -59.694  37.838  14.578  1.00 44.02      A  N
ATOM  12889  CA   PHE E 191     -59.667  37.659  15.990  1.00 42.10      A  C
ATOM  12890  CB   PHE E 191     -61.016  37.193  16.470  1.00 41.57      A  C
ATOM  12891  CG   PHE E 191     -61.536  36.018  15.736  1.00 43.50      A  C
ATOM  12892  CD1  PHE E 191     -61.270  34.755  16.158  1.00 44.17      A  C
ATOM  12893  CE1  PHE E 191     -61.740  33.694  15.486  1.00 45.88      A  C
ATOM  12894  CZ   PHE E 191     -62.490  33.878  14.393  1.00 48.18      A  C
ATOM  12895  CE2  PHE E 191     -62.757  35.125  13.957  1.00 44.02      A  C
ATOM  12896  CD2  PHE E 191     -62.296  36.176  14.617  1.00 45.49      A  C
ATOM  12897  C    PHE E 191     -58.641  36.603  16.185  1.00 41.14      A  C
ATOM  12898  O    PHE E 191     -58.227  35.984  15.250  1.00 40.06      A  O
ATOM  12899  N    ALA E 192     -58.226  36.361  17.399  1.00 39.79      A  N
ATOM  12900  CA   ALA E 192     -57.202  35.378  17.576  1.00 38.35      A  C
ATOM  12901  CB   ALA E 192     -56.298  35.820  18.655  1.00 37.63      A  C
ATOM  12902  C    ALA E 192     -57.845  34.092  17.936  1.00 36.31      A  C
ATOM  12903  O    ALA E 192     -58.409  34.014  18.940  1.00 37.25      A  O
ATOM  12904  N    GLY E 193     -57.775  33.085  17.102  1.00 34.98      A  N
ATOM  12905  CA   GLY E 193     -58.436  31.855  17.415  1.00 35.28      A  C
ATOM  12906  C    GLY E 193     -59.116  31.121  16.303  1.00 36.09      A  C
ATOM  12907  O    GLY E 193     -58.885  31.392  15.178  1.00 37.89      A  O
ATOM  12908  N    ILE E 194     -59.945  30.164  16.664  1.00 35.62      A  N
ATOM  12909  CA   ILE E 194     -60.774  29.425  15.759  1.00 34.34      A  C
ATOM  12910  CB   ILE E 194     -60.138  28.122  15.450  1.00 34.31      A  C
ATOM  12911  CG1  ILE E 194     -58.907  28.385  14.634  1.00 34.07      A  C
ATOM  12912  CD1  ILE E 194     -58.106  27.233  14.453  1.00 30.70      A  C
ATOM  12913  CG2  ILE E 194     -61.034  27.256  14.669  1.00 33.83      A  C
ATOM  12914  C    ILE E 194     -62.119  29.225  16.397  1.00 34.25      A  C
ATOM  12915  O    ILE E 194     -62.211  29.107  17.581  1.00 35.81      A  O
ATOM  12916  N    VAL E 195     -63.177  29.200  15.608  1.00 32.33      A  N
ATOM  12917  CA   VAL E 195     -64.547  29.047  16.101  1.00 32.21      A  C
```

Appendix 1

```
ATOM  12918  CB   VAL E 195     -65.532  29.788  15.234  1.00  32.28      A    C
ATOM  12919  CG1  VAL E 195     -65.230  31.224  15.213  1.00  30.55      A    C
ATOM  12920  CG2  VAL E 195     -65.591  29.214  13.869  1.00  27.67      A    C
ATOM  12921  C    VAL E 195     -65.022  27.612  16.219  1.00  33.43      A    C
ATOM  12922  O    VAL E 195     -64.582  26.793  15.486  1.00  34.32      A    O
ATOM  12923  N    CYS E 196     -65.859  27.284  17.185  1.00  33.97      A    N
ATOM  12924  CA   CYS E 196     -66.313  25.920  17.289  1.00  35.10      A    C
ATOM  12925  CB   CYS E 196     -67.113  25.755  18.589  1.00  32.97      A    C
ATOM  12926  SG   CYS E 196     -66.333  25.169  20.149  1.00  42.16      A    S
ATOM  12927  C    CYS E 196     -67.223  25.642  16.118  1.00  35.40      A    C
ATOM  12928  O    CYS E 196     -66.961  24.877  15.256  1.00  32.33      A    O
ATOM  12929  N    GLU E 197     -68.414  26.166  16.259  1.00  38.05      A    N
ATOM  12930  CA   GLU E 197     -69.427  26.220  15.243  1.00  39.04      A    C
ATOM  12931  CB   GLU E 197     -70.814  26.156  15.856  1.00  38.85      A    C
ATOM  12932  CG   GLU E 197     -71.279  24.790  16.125  1.00  41.38      A    C
ATOM  12933  CD   GLU E 197     -71.363  24.438  17.584  1.00  46.93      A    C
ATOM  12934  OE1  GLU E 197     -71.002  25.245  18.437  1.00  46.17      A    O
ATOM  12935  OE2  GLU E 197     -71.798  23.327  17.890  1.00  48.09      A    O-1
ATOM  12936  C    GLU E 197     -69.174  27.523  14.565  1.00  39.08      A    C
ATOM  12937  O    GLU E 197     -68.339  28.240  14.972  1.00  37.70      A    O
ATOM  12938  N    PRO E 198     -69.888  27.803  13.508  1.00  40.07      A    N
ATOM  12939  CA   PRO E 198     -69.545  28.858  12.590  1.00  39.83      A    C
ATOM  12940  CB   PRO E 198     -70.549  28.627  11.483  1.00  40.45      A    C
ATOM  12941  CG   PRO E 198     -70.716  27.205  11.468  1.00  40.16      A    C
ATOM  12942  CD   PRO E 198     -70.328  26.630  12.775  1.00  39.43      A    C
ATOM  12943  C    PRO E 198     -69.534  30.298  13.047  1.00  40.56      A    C
ATOM  12944  O    PRO E 198     -68.603  30.959  12.707  1.00  41.40      A    O
ATOM  12945  N    ASP E 199     -70.493  30.807  13.778  1.00  41.28      A    N
ATOM  12946  CA   ASP E 199     -70.320  32.171  14.258  1.00  41.26      A    C
ATOM  12947  CB   ASP E 199     -71.435  33.128  13.802  1.00  42.57      A    C
ATOM  12948  CG   ASP E 199     -71.225  34.582  14.261  1.00  45.69      A    C
ATOM  12949  OD1  ASP E 199     -70.103  35.031  14.376  1.00  47.44      A    O
ATOM  12950  OD2  ASP E 199     -72.199  35.309  14.486  1.00  54.27      A    O-1
ATOM  12951  C    ASP E 199     -70.119  32.173  15.761  1.00  40.49      A    C
ATOM  12952  O    ASP E 199     -70.410  33.136  16.405  1.00  40.33      A    O
ATOM  12953  N    ASN E 200     -69.607  31.075  16.285  1.00  38.32      A    N
ATOM  12954  CA   ASN E 200     -69.502  30.825  17.703  1.00  36.39      A    C
ATOM  12955  CB   ASN E 200     -70.126  29.485  17.974  1.00  36.61      A    C
ATOM  12956  CG   ASN E 200     -71.586  29.547  18.103  1.00  37.53      A    C
ATOM  12957  OD1  ASN E 200     -72.169  30.586  18.050  1.00  39.11      A    O
ATOM  12958  ND2  ASN E 200     -72.193  28.416  18.287  1.00  39.44      A    N
ATOM  12959  C    ASN E 200     -68.095  30.718  18.185  1.00  34.96      A    C
ATOM  12960  O    ASN E 200     -67.412  29.856  17.761  1.00  34.25      A    O
ATOM  12961  N    TYR E 201     -67.663  31.572  19.089  1.00  33.31      A    N
ATOM  12962  CA   TYR E 201     -66.305  31.452  19.599  1.00  33.12      A    C
ATOM  12963  CB   TYR E 201     -65.545  32.742  19.327  1.00  33.80      A    C
ATOM  12964  CG   TYR E 201     -64.123  32.797  19.770  1.00  31.47      A    C
ATOM  12965  CD1  TYR E 201     -63.108  32.698  18.871  1.00  28.56      A    C
ATOM  12966  CE1  TYR E 201     -61.836  32.767  19.275  1.00  31.07      A    C
ATOM  12967  CZ   TYR E 201     -61.566  32.950  20.577  1.00  28.16      A    C
ATOM  12968  OH   TYR E 201     -60.308  33.032  20.941  1.00  29.62      A    O
ATOM  12969  CE2  TYR E 201     -62.542  33.067  21.482  1.00  24.11      A    C
ATOM  12970  CD2  TYR E 201     -63.802  32.998  21.084  1.00  28.93      A    C
ATOM  12971  C    TYR E 201     -66.278  31.136  21.066  1.00  32.00      A    C
```

Appendix 1

```
ATOM  12972  O    TYR E 201     -66.849  31.834  21.842  1.00 32.42      A  O
ATOM  12973  N    PHE E 202     -65.614  30.064  21.431  1.00 30.24      A  N
ATOM  12974  CA   PHE E 202     -65.496  29.699  22.810  1.00 28.80      A  C
ATOM  12975  CB   PHE E 202     -66.162  28.358  23.107  1.00 29.52      A  C
ATOM  12976  CG   PHE E 202     -67.604  28.327  22.801  1.00 29.45      A  C
ATOM  12977  CD1  PHE E 202     -68.525  28.532  23.755  1.00 28.01      A  C
ATOM  12978  CE1  PHE E 202     -69.821  28.505  23.449  1.00 29.74      A  C
ATOM  12979  CZ   PHE E 202     -70.222  28.282  22.197  1.00 30.19      A  C
ATOM  12980  CE2  PHE E 202     -69.332  28.082  21.246  1.00 29.22      A  C
ATOM  12981  CD2  PHE E 202     -68.036  28.096  21.538  1.00 30.65      A  C
ATOM  12982  C    PHE E 202     -64.067  29.701  23.242  1.00 28.02      A  C
ATOM  12983  O    PHE E 202     -63.216  29.184  22.605  1.00 28.42      A  O
ATOM  12984  N    VAL E 203     -63.840  30.345  24.342  1.00 26.80      A  N
ATOM  12985  CA   VAL E 203     -62.562  30.436  24.976  1.00 26.22      A  C
ATOM  12986  CB   VAL E 203     -62.620  31.523  26.041  1.00 27.64      A  C
ATOM  12987  CG1  VAL E 203     -62.537  30.991  27.393  1.00 25.98      A  C
ATOM  12988  CG2  VAL E 203     -61.614  32.541  25.783  1.00 27.68      A  C
ATOM  12989  C    VAL E 203     -62.009  29.129  25.492  1.00 25.79      A  C
ATOM  12990  O    VAL E 203     -60.852  28.909  25.436  1.00 24.28      A  O
ATOM  12991  N    GLN E 204     -62.851  28.273  26.020  1.00 24.50      A  N
ATOM  12992  CA   GLN E 204     -62.389  26.993  26.510  1.00 24.81      A  C
ATOM  12993  CB   GLN E 204     -63.458  26.316  27.339  1.00 23.96      A  C
ATOM  12994  CG   GLN E 204     -64.707  25.987  26.597  1.00 23.79      A  C
ATOM  12995  CD   GLN E 204     -65.716  27.055  26.697  1.00 23.48      A  C
ATOM  12996  OE1  GLN E 204     -65.419  28.180  26.496  1.00 20.20      A  O
ATOM  12997  NE2  GLN E 204     -66.904  26.701  27.035  1.00 19.74      A  N
ATOM  12998  C    GLN E 204     -61.896  26.051  25.457  1.00 25.07      A  C
ATOM  12999  O    GLN E 204     -60.942  25.377  25.635  1.00 24.58      A  O
ATOM  13000  N    CYS E 205     -62.617  25.985  24.368  1.00 26.14      A  N
ATOM  13001  CA   CYS E 205     -62.289  25.154  23.242  1.00 28.39      A  C
ATOM  13002  CB   CYS E 205     -63.389  25.213  22.203  1.00 27.68      A  C
ATOM  13003  SG   CYS E 205     -65.077  24.895  22.644  1.00 38.04      A  S
ATOM  13004  C    CYS E 205     -60.998  25.606  22.612  1.00 27.69      A  C
ATOM  13005  O    CYS E 205     -60.205  24.840  22.221  1.00 28.62      A  O
ATOM  13006  N    ASN E 206     -60.830  26.895  22.528  1.00 27.19      A  N
ATOM  13007  CA   ASN E 206     -59.633  27.514  22.046  1.00 27.21      A  C
ATOM  13008  CB   ASN E 206     -59.849  28.988  21.874  1.00 27.88      A  C
ATOM  13009  CG   ASN E 206     -60.183  29.326  20.514  1.00 28.68      A  C
ATOM  13010  OD1  ASN E 206     -59.328  29.456  19.710  1.00 32.61      A  O
ATOM  13011  ND2  ASN E 206     -61.431  29.431  20.227  1.00 31.39      A  N
ATOM  13012  C    ASN E 206     -58.461  27.256  22.920  1.00 26.94      A  C
ATOM  13013  O    ASN E 206     -57.359  27.186  22.496  1.00 25.71      A  O
ATOM  13014  N    SER E 207     -58.762  27.048  24.170  1.00 27.89      A  N
ATOM  13015  CA   SER E 207     -57.820  26.678  25.157  1.00 28.53      A  C
ATOM  13016  CB   SER E 207     -58.668  26.327  26.350  1.00 30.50      A  C
ATOM  13017  OG   SER E 207     -58.179  26.856  27.527  1.00 36.58      A  O
ATOM  13018  C    SER E 207     -57.152  25.395  24.803  1.00 27.83      A  C
ATOM  13019  O    SER E 207     -55.969  25.290  24.904  1.00 29.72      A  O
ATOM  13020  N    VAL E 208     -57.928  24.405  24.419  1.00 23.79      A  N
ATOM  13021  CA   VAL E 208     -57.436  23.084  24.186  1.00 23.24      A  C
ATOM  13022  CB   VAL E 208     -58.564  22.117  23.996  1.00 23.07      A  C
ATOM  13023  CG1  VAL E 208     -58.055  20.814  23.806  1.00 20.52      A  C
ATOM  13024  CG2  VAL E 208     -59.434  22.150  25.162  1.00 20.58      A  C
ATOM  13025  C    VAL E 208     -56.521  22.996  23.037  1.00 24.32      A  C
```

Appendix 1

```
ATOM  13026  O    VAL E 208    -55.537  22.356  23.089  1.00  23.61    A  O
ATOM  13027  N    ALA E 209    -56.895  23.663  21.981  1.00  25.20    A  N
ATOM  13028  CA   ALA E 209    -56.125  23.786  20.775  1.00  25.13    A  C
ATOM  13029  CB   ALA E 209    -56.948  24.388  19.751  1.00  24.95    A  C
ATOM  13030  C    ALA E 209    -54.817  24.520  20.861  1.00  24.59    A  C
ATOM  13031  O    ALA E 209    -53.871  24.140  20.233  1.00  25.17    A  O
ATOM  13032  N    TYR E 210    -54.770  25.601  21.596  1.00  22.93    A  N
ATOM  13033  CA   TYR E 210    -53.514  26.264  21.789  1.00  23.28    A  C
ATOM  13034  CB   TYR E 210    -53.705  27.603  22.467  1.00  22.47    A  C
ATOM  13035  CG   TYR E 210    -54.030  28.731  21.536  1.00  23.42    A  C
ATOM  13036  CD1  TYR E 210    -53.057  29.435  20.925  1.00  23.61    A  C
ATOM  13037  CE1  TYR E 210    -53.361  30.440  20.099  1.00  23.15    A  C
ATOM  13038  CZ   TYR E 210    -54.643  30.762  19.869  1.00  23.26    A  C
ATOM  13039  OH   TYR E 210    -54.964  31.761  19.054  1.00  26.51    A  O
ATOM  13040  CE2  TYR E 210    -55.620  30.088  20.442  1.00  22.72    A  C
ATOM  13041  CD2  TYR E 210    -55.329  29.092  21.272  1.00  21.53    A  C
ATOM  13042  C    TYR E 210    -52.540  25.369  22.547  1.00  22.29    A  C
ATOM  13043  O    TYR E 210    -51.402  25.278  22.227  1.00  20.52    A  O
ATOM  13044  N    LEU E 211    -53.046  24.650  23.515  1.00  21.53    A  N
ATOM  13045  CA   LEU E 211    -52.245  23.728  24.249  1.00  22.94    A  C
ATOM  13046  CB   LEU E 211    -53.007  23.191  25.442  1.00  23.50    A  C
ATOM  13047  CG   LEU E 211    -52.342  22.382  26.529  1.00  23.97    A  C
ATOM  13048  CD1  LEU E 211    -51.220  23.091  27.182  1.00  23.54    A  C
ATOM  13049  CD2  LEU E 211    -53.388  22.075  27.511  1.00  29.39    A  C
ATOM  13050  C    LEU E 211    -51.664  22.631  23.386  1.00  23.33    A  C
ATOM  13051  O    LEU E 211    -50.578  22.208  23.598  1.00  24.16    A  O
ATOM  13052  N    SER E 212    -52.388  22.206  22.385  1.00  22.20    A  N
ATOM  13053  CA   SER E 212    -51.906  21.243  21.431  1.00  22.87    A  C
ATOM  13054  CB   SER E 212    -53.017  20.781  20.530  1.00  23.24    A  C
ATOM  13055  OG   SER E 212    -53.555  21.853  19.848  1.00  24.85    A  O
ATOM  13056  C    SER E 212    -50.701  21.702  20.636  1.00  21.99    A  C
ATOM  13057  O    SER E 212    -49.937  20.916  20.217  1.00  21.80    A  O
ATOM  13058  N    LEU E 213    -50.601  22.980  20.386  1.00  21.23    A  N
ATOM  13059  CA   LEU E 213    -49.432  23.556  19.793  1.00  21.95    A  C
ATOM  13060  CB   LEU E 213    -49.699  24.978  19.352  1.00  18.94    A  C
ATOM  13061  CG   LEU E 213    -50.920  25.068  18.498  1.00  19.95    A  C
ATOM  13062  CD1  LEU E 213    -51.369  26.425  18.321  1.00  13.47    A  C
ATOM  13063  CD2  LEU E 213    -50.729  24.398  17.214  1.00  17.70    A  C
ATOM  13064  C    LEU E 213    -48.232  23.480  20.674  1.00  22.81    A  C
ATOM  13065  O    LEU E 213    -47.163  23.214  20.224  1.00  22.89    A  O
ATOM  13066  N    TRP E 214    -48.452  23.727  21.945  1.00  22.50    A  N
ATOM  13067  CA   TRP E 214    -47.434  23.607  22.937  1.00  22.63    A  C
ATOM  13068  CB   TRP E 214    -47.942  24.107  24.277  1.00  23.16    A  C
ATOM  13069  CG   TRP E 214    -48.029  25.566  24.397  1.00  24.74    A  C
ATOM  13070  CD1  TRP E 214    -48.954  26.358  23.872  1.00  26.28    A  C
ATOM  13071  NE1  TRP E 214    -48.712  27.645  24.170  1.00  24.68    A  N
ATOM  13072  CE2  TRP E 214    -47.609  27.705  24.951  1.00  22.14    A  C
ATOM  13073  CD2  TRP E 214    -47.154  26.413  25.113  1.00  24.18    A  C
ATOM  13074  CE3  TRP E 214    -46.005  26.203  25.854  1.00  22.29    A  C
ATOM  13075  CZ3  TRP E 214    -45.396  27.248  26.404  1.00  21.16    A  C
ATOM  13076  CH2  TRP E 214    -45.867  28.515  26.231  1.00  25.91    A  C
ATOM  13077  CZ2  TRP E 214    -46.981  28.767  25.505  1.00  25.43    A  C
ATOM  13078  C    TRP E 214    -46.944  22.188  23.044  1.00  22.44    A  C
ATOM  13079  O    TRP E 214    -45.796  21.977  23.157  1.00  25.42    A  O
```

Appendix 1

```
ATOM  13080  N    VAL E 215   -47.816  21.215  23.004  1.00  20.82  A  N
ATOM  13081  CA   VAL E 215   -47.399  19.851  22.945  1.00  19.02  A  C
ATOM  13082  CB   VAL E 215   -48.558  18.919  23.224  1.00  18.96  A  C
ATOM  13083  CG1  VAL E 215   -48.124  17.552  23.217  1.00  16.29  A  C
ATOM  13084  CG2  VAL E 215   -49.218  19.265  24.484  1.00  15.10  A  C
ATOM  13085  C    VAL E 215   -46.698  19.461  21.663  1.00  20.97  A  C
ATOM  13086  O    VAL E 215   -45.709  18.836  21.706  1.00  22.68  A  O
ATOM  13087  N    TYR E 216   -47.192  19.876  20.517  1.00  20.63  A  N
ATOM  13088  CA   TYR E 216   -46.550  19.566  19.275  1.00  19.36  A  C
ATOM  13089  CB   TYR E 216   -47.374  20.082  18.073  1.00  19.89  A  C
ATOM  13090  CG   TYR E 216   -46.851  19.571  16.789  1.00  17.82  A  C
ATOM  13091  CD1  TYR E 216   -47.315  18.421  16.241  1.00  16.63  A  C
ATOM  13092  CE1  TYR E 216   -46.796  17.953  15.130  1.00  24.47  A  C
ATOM  13093  CZ   TYR E 216   -45.781  18.617  14.554  1.00  21.27  A  C
ATOM  13094  OH   TYR E 216   -45.227  18.157  13.436  1.00  24.47  A  O
ATOM  13095  CE2  TYR E 216   -45.319  19.742  15.078  1.00  17.47  A  C
ATOM  13096  CD2  TYR E 216   -45.843  20.209  16.166  1.00  14.64  A  C
ATOM  13097  C    TYR E 216   -45.142  20.144  19.269  1.00  20.52  A  C
ATOM  13098  O    TYR E 216   -44.249  19.593  18.716  1.00  19.17  A  O
ATOM  13099  N    ASP E 217   -44.974  21.294  19.871  1.00  21.84  A  N
ATOM  13100  CA   ASP E 217   -43.688  21.964  19.947  1.00  24.18  A  C
ATOM  13101  CB   ASP E 217   -43.875  23.352  20.493  1.00  25.12  A  C
ATOM  13102  CG   ASP E 217   -44.358  24.310  19.495  1.00  25.12  A  C
ATOM  13103  OD1  ASP E 217   -44.335  24.040  18.323  1.00  20.70  A  O
ATOM  13104  OD2  ASP E 217   -44.726  25.367  19.912  1.00  29.57  A  O-1
ATOM  13105  C    ASP E 217   -42.630  21.258  20.754  1.00  25.59  A  C
ATOM  13106  O    ASP E 217   -41.503  21.194  20.367  1.00  25.43  A  O
ATOM  13107  N    ARG E 218   -43.034  20.715  21.880  1.00  26.16  A  N
ATOM  13108  CA   ARG E 218   -42.188  19.922  22.697  1.00  26.58  A  C
ATOM  13109  CB   ARG E 218   -42.914  19.591  23.987  1.00  27.07  A  C
ATOM  13110  CG   ARG E 218   -42.365  18.424  24.710  1.00  32.45  A  C
ATOM  13111  CD   ARG E 218   -41.358  18.783  25.778  1.00  38.20  A  C
ATOM  13112  NE   ARG E 218   -41.474  17.820  26.858  1.00  45.93  A  N
ATOM  13113  CZ   ARG E 218   -41.043  16.576  26.775  1.00  45.60  A  C
ATOM  13114  NH1  ARG E 218   -40.445  16.155  25.696  1.00  41.20  A  N
ATOM  13115  NH2  ARG E 218   -41.218  15.753  27.763  1.00  45.31  A  N
ATOM  13116  C    ARG E 218   -41.722  18.675  21.992  1.00  26.46  A  C
ATOM  13117  O    ARG E 218   -40.596  18.305  22.119  1.00  26.77  A  O
ATOM  13118  N    LEU E 219   -42.596  18.020  21.268  1.00  25.09  A  N
ATOM  13119  CA   LEU E 219   -42.206  16.895  20.486  1.00  24.54  A  C
ATOM  13120  CB   LEU E 219   -43.416  16.145  19.988  1.00  24.41  A  C
ATOM  13121  CG   LEU E 219   -44.314  15.581  21.056  1.00  22.26  A  C
ATOM  13122  CD1  LEU E 219   -45.680  15.465  20.585  1.00  22.10  A  C
ATOM  13123  CD2  LEU E 219   -43.818  14.301  21.587  1.00  18.37  A  C
ATOM  13124  C    LEU E 219   -41.268  17.231  19.352  1.00  26.13  A  C
ATOM  13125  O    LEU E 219   -40.385  16.481  19.058  1.00  27.61  A  O
ATOM  13126  N    HIS E 220   -41.468  18.365  18.714  1.00  26.44  A  N
ATOM  13127  CA   HIS E 220   -40.771  18.683  17.499  1.00  25.76  A  C
ATOM  13128  CB   HIS E 220   -41.773  18.719  16.377  1.00  25.43  A  C
ATOM  13129  CG   HIS E 220   -42.463  17.422  16.193  1.00  25.80  A  C
ATOM  13130  ND1  HIS E 220   -41.831  16.340  15.659  1.00  26.92  A  N
ATOM  13131  CE1  HIS E 220   -42.643  15.314  15.670  1.00  26.50  A  C
ATOM  13132  NE2  HIS E 220   -43.776  15.696  16.200  1.00  29.03  A  N
ATOM  13133  CD2  HIS E 220   -43.683  17.002  16.556  1.00  25.24  A  C
```

Appendix 1

```
ATOM  13134  C    HIS E 220   -39.861  19.872  17.433  1.00  25.70   A  C
ATOM  13135  O    HIS E 220   -39.258  20.083  16.440  1.00  23.71   A  O
ATOM  13136  N    GLY E 221   -39.770  20.650  18.488  1.00  26.41   A  N
ATOM  13137  CA   GLY E 221   -38.866  21.775  18.503  1.00  28.12   A  C
ATOM  13138  C    GLY E 221   -39.325  23.001  17.764  1.00  31.02   A  C
ATOM  13139  O    GLY E 221   -38.583  23.905  17.513  1.00  30.72   A  O
ATOM  13140  N    THR E 222   -40.595  23.012  17.449  1.00  30.80   A  N
ATOM  13141  CA   THR E 222   -41.172  24.041  16.650  1.00  31.11   A  C
ATOM  13142  CB   THR E 222   -42.298  23.492  15.838  1.00  31.25   A  C
ATOM  13143  OG1  THR E 222   -42.991  22.555  16.624  1.00  31.57   A  O
ATOM  13144  CG2  THR E 222   -41.771  22.758  14.674  1.00  28.65   A  C
ATOM  13145  C    THR E 222   -41.615  25.182  17.510  1.00  32.25   A  C
ATOM  13146  O    THR E 222   -41.377  25.196  18.677  1.00  32.62   A  O
ATOM  13147  N    ASP E 223   -42.236  26.158  16.885  1.00  33.44   A  N
ATOM  13148  CA   ASP E 223   -42.712  27.357  17.550  1.00  34.46   A  C
ATOM  13149  CB   ASP E 223   -41.763  28.503  17.302  1.00  35.13   A  C
ATOM  13150  CG   ASP E 223   -41.736  29.499  18.413  1.00  41.62   A  C
ATOM  13151  OD1  ASP E 223   -41.946  29.197  19.568  1.00  47.96   A  O
ATOM  13152  OD2  ASP E 223   -41.491  30.645  18.121  1.00  47.61   A  O-1
ATOM  13153  C    ASP E 223   -44.128  27.733  17.157  1.00  33.90   A  C
ATOM  13154  O    ASP E 223   -44.449  28.862  17.019  1.00  32.37   A  O
ATOM  13155  N    TYR E 224   -44.990  26.756  17.086  1.00  32.99   A  N
ATOM  13156  CA   TYR E 224   -46.367  27.002  16.810  1.00  32.84   A  C
ATOM  13157  CB   TYR E 224   -47.127  25.724  16.510  1.00  31.78   A  C
ATOM  13158  CG   TYR E 224   -46.720  25.096  15.218  1.00  29.61   A  C
ATOM  13159  CD1  TYR E 224   -47.090  25.629  14.023  1.00  28.49   A  C
ATOM  13160  CE1  TYR E 224   -46.724  25.074  12.891  1.00  27.60   A  C
ATOM  13161  CZ   TYR E 224   -45.972  23.965  12.927  1.00  31.22   A  C
ATOM  13162  OH   TYR E 224   -45.589  23.385  11.787  1.00  35.01   A  O
ATOM  13163  CE2  TYR E 224   -45.596  23.427  14.083  1.00  27.59   A  C
ATOM  13164  CD2  TYR E 224   -45.964  23.980  15.201  1.00  27.90   A  C
ATOM  13165  C    TYR E 224   -47.008  27.809  17.902  1.00  33.68   A  C
ATOM  13166  O    TYR E 224   -48.052  28.332  17.702  1.00  33.96   A  O
ATOM  13167  N    ARG E 225   -46.323  28.073  18.997  1.00  35.56   A  N
ATOM  13168  CA   ARG E 225   -46.953  28.953  19.985  1.00  37.70   A  C
ATOM  13169  CB   ARG E 225   -46.459  28.644  21.387  1.00  40.01   A  C
ATOM  13170  CG   ARG E 225   -45.613  27.412  21.429  1.00  36.10   A  C
ATOM  13171  CD   ARG E 225   -44.913  27.167  22.740  1.00  38.31   A  C
ATOM  13172  NE   ARG E 225   -43.526  27.611  22.911  1.00  36.06   A  N
ATOM  13173  CZ   ARG E 225   -42.470  27.185  22.236  1.00  33.91   A  C
ATOM  13174  NH1  ARG E 225   -42.612  26.349  21.273  1.00  37.23   A  N
ATOM  13175  NH2  ARG E 225   -41.276  27.639  22.495  1.00  26.04   A  N
ATOM  13176  C    ARG E 225   -46.951  30.474  19.657  1.00  38.34   A  C
ATOM  13177  O    ARG E 225   -45.960  31.172  19.599  1.00  37.36   A  O
ATOM  13178  N    ALA E 226   -48.191  30.867  19.377  1.00  39.13   A  N
ATOM  13179  CA   ALA E 226   -48.754  32.140  19.004  1.00  35.98   A  C
ATOM  13180  CB   ALA E 226   -49.401  31.994  17.695  1.00  35.07   A  C
ATOM  13181  C    ALA E 226   -49.817  32.406  20.031  1.00  35.26   A  C
ATOM  13182  O    ALA E 226   -50.818  32.990  19.760  1.00  34.37   A  O
ATOM  13183  N    ALA E 227   -49.608  31.839  21.189  1.00  34.58   A  N
ATOM  13184  CA   ALA E 227   -50.473  31.965  22.324  1.00  34.57   A  C
ATOM  13185  CB   ALA E 227   -50.083  30.994  23.384  1.00  31.87   A  C
ATOM  13186  C    ALA E 227   -50.566  33.378  22.848  1.00  34.21   A  C
ATOM  13187  O    ALA E 227   -51.554  33.755  23.371  1.00  33.86   A  O
```

Appendix 1

```
ATOM  13188  N    THR E 228     -49.460  34.062  22.745  1.00 35.34      A  N
ATOM  13189  CA   THR E 228     -49.315  35.393  23.186  1.00 39.28      A  C
ATOM  13190  CB   THR E 228     -48.016  35.877  22.724  1.00 40.32      A  C
ATOM  13191  OG1  THR E 228     -47.058  34.850  22.948  1.00 47.59      A  O
ATOM  13192  CG2  THR E 228     -47.646  37.166  23.416  1.00 39.32      A  C
ATOM  13193  C    THR E 228     -50.184  36.204  22.386  1.00 39.84      A  C
ATOM  13194  O    THR E 228     -50.868  37.048  22.876  1.00 38.50      A  O
ATOM  13195  N    ARG E 229     -50.084  35.832  21.140  1.00 41.79      A  N
ATOM  13196  CA   ARG E 229     -49.952  36.696  20.062  1.00 44.09      A  C
ATOM  13197  CB   ARG E 229     -49.582  35.916  18.813  1.00 45.39      A  C
ATOM  13198  CG   ARG E 229     -48.117  35.690  18.617  1.00 53.32      A  C
ATOM  13199  CD   ARG E 229     -47.366  37.017  18.388  1.00 67.19      A  C
ATOM  13200  NE   ARG E 229     -46.989  37.252  16.994  1.00 74.71      A  N
ATOM  13201  CZ   ARG E 229     -46.654  38.437  16.499  1.00 76.72      A  C
ATOM  13202  NH1  ARG E 229     -46.649  39.510  17.271  1.00 74.96      A  N
ATOM  13203  NH2  ARG E 229     -46.330  38.545  15.227  1.00 78.31      A  N
ATOM  13204  C    ARG E 229     -51.348  37.048  20.078  1.00 41.92      A  C
ATOM  13205  O    ARG E 229     -52.020  37.061  19.092  1.00 40.67      A  O
ATOM  13206  N    ALA E 230     -51.736  37.266  21.300  1.00 40.73      A  N
ATOM  13207  CA   ALA E 230     -52.985  37.865  21.554  1.00 40.74      A  C
ATOM  13208  CB   ALA E 230     -53.358  38.853  20.439  1.00 40.33      A  C
ATOM  13209  C    ALA E 230     -54.049  36.905  21.700  1.00 37.63      A  C
ATOM  13210  O    ALA E 230     -55.133  37.330  21.948  1.00 40.10      A  O
ATOM  13211  N    TRP E 231     -53.817  35.623  21.585  1.00 34.16      A  N
ATOM  13212  CA   TRP E 231     -54.947  34.872  21.926  1.00 31.43      A  C
ATOM  13213  CB   TRP E 231     -54.765  33.388  21.759  1.00 31.23      A  C
ATOM  13214  CG   TRP E 231     -55.912  32.706  22.332  1.00 28.58      A  C
ATOM  13215  CD1  TRP E 231     -57.153  32.740  21.880  1.00 25.62      A  C
ATOM  13216  NE1  TRP E 231     -57.961  32.042  22.671  1.00 25.80      A  N
ATOM  13217  CE2  TRP E 231     -57.238  31.529  23.691  1.00 26.39      A  C
ATOM  13218  CD2  TRP E 231     -55.936  31.935  23.502  1.00 25.75      A  C
ATOM  13219  CE3  TRP E 231     -54.984  31.544  24.412  1.00 24.71      A  C
ATOM  13220  CZ3  TRP E 231     -55.369  30.781  25.439  1.00 22.37      A  C
ATOM  13221  CH2  TRP E 231     -56.667  30.386  25.595  1.00 19.28      A  C
ATOM  13222  CZ2  TRP E 231     -57.616  30.755  24.738  1.00 21.46      A  C
ATOM  13223  C    TRP E 231     -55.106  35.262  23.358  1.00 31.38      A  C
ATOM  13224  O    TRP E 231     -56.153  35.633  23.786  1.00 32.04      A  O
ATOM  13225  N    LEU E 232     -54.017  35.222  24.088  1.00 31.75      A  N
ATOM  13226  CA   LEU E 232     -53.985  35.634  25.468  1.00 32.33      A  C
ATOM  13227  CB   LEU E 232     -52.639  35.301  26.038  1.00 31.24      A  C
ATOM  13228  CG   LEU E 232     -52.403  34.410  27.223  1.00 28.69      A  C
ATOM  13229  CD1  LEU E 232     -53.431  33.421  27.386  1.00 28.74      A  C
ATOM  13230  CD2  LEU E 232     -51.152  33.783  26.996  1.00 27.63      A  C
ATOM  13231  C    LEU E 232     -54.268  37.103  25.664  1.00 34.57      A  C
ATOM  13232  O    LEU E 232     -54.949  37.475  26.566  1.00 35.57      A  O
ATOM  13233  N    ASP E 233     -53.703  37.938  24.822  1.00 35.99      A  N
ATOM  13234  CA   ASP E 233     -54.016  39.338  24.811  1.00 38.20      A  C
ATOM  13235  CB   ASP E 233     -53.169  40.046  23.768  1.00 39.63      A  C
ATOM  13236  CG   ASP E 233     -51.755  40.246  24.191  1.00 44.32      A  C
ATOM  13237  OD1  ASP E 233     -50.980  40.720  23.366  1.00 49.51      A  O
ATOM  13238  OD2  ASP E 233     -51.406  39.954  25.330  1.00 46.20      A  O-1
ATOM  13239  C    ASP E 233     -55.436  39.599  24.438  1.00 36.86      A  C
ATOM  13240  O    ASP E 233     -56.080  40.411  25.021  1.00 38.21      A  O
ATOM  13241  N    PHE E 234     -55.900  38.933  23.413  1.00 35.92      A  N
```

Appendix 1

```
ATOM  13242  CA   PHE E 234     -57.249  39.077  22.928  1.00  36.41     A    C
ATOM  13243  CB   PHE E 234     -57.330  38.298  21.624  1.00  35.66     A    C
ATOM  13244  CG   PHE E 234     -58.700  38.069  21.110  1.00  39.18     A    C
ATOM  13245  CD1  PHE E 234     -59.328  38.992  20.350  1.00  44.16     A    C
ATOM  13246  CE1  PHE E 234     -60.545  38.764  19.889  1.00  42.24     A    C
ATOM  13247  CZ   PHE E 234     -61.144  37.627  20.145  1.00  43.40     A    C
ATOM  13248  CE2  PHE E 234     -60.548  36.709  20.880  1.00  41.23     A    C
ATOM  13249  CD2  PHE E 234     -59.338  36.909  21.343  1.00  39.02     A    C
ATOM  13250  C    PHE E 234     -58.319  38.651  23.933  1.00  36.52     A    C
ATOM  13251  O    PHE E 234     -59.272  39.342  24.143  1.00  33.92     A    O
ATOM  13252  N    ILE E 235     -58.147  37.519  24.578  1.00  36.42     A    N
ATOM  13253  CA   ILE E 235     -59.153  37.045  25.507  1.00  37.41     A    C
ATOM  13254  CB   ILE E 235     -58.978  35.574  25.838  1.00  37.13     A    C
ATOM  13255  CG1  ILE E 235     -57.662  35.340  26.522  1.00  37.03     A    C
ATOM  13256  CD1  ILE E 235     -57.540  34.082  27.147  1.00  40.01     A    C
ATOM  13257  CG2  ILE E 235     -58.997  34.791  24.585  1.00  35.31     A    C
ATOM  13258  C    ILE E 235     -59.349  37.928  26.729  1.00  38.47     A    C
ATOM  13259  O    ILE E 235     -60.362  37.913  27.354  1.00  37.62     A    O
ATOM  13260  N    GLN E 236     -58.335  38.688  27.070  1.00  40.41     A    N
ATOM  13261  CA   GLN E 236     -58.415  39.733  28.059  1.00  42.85     A    C
ATOM  13262  CB   GLN E 236     -57.044  40.046  28.584  1.00  42.33     A    C
ATOM  13263  CG   GLN E 236     -56.465  38.911  29.291  1.00  45.33     A    C
ATOM  13264  CD   GLN E 236     -55.145  39.213  29.873  1.00  49.72     A    C
ATOM  13265  OE1  GLN E 236     -54.162  39.305  29.169  1.00  47.21     A    O
ATOM  13266  NE2  GLN E 236     -55.098  39.351  31.170  1.00  47.02     A    N
ATOM  13267  C    GLN E 236     -59.171  40.996  27.688  1.00  44.98     A    C
ATOM  13268  O    GLN E 236     -59.601  41.715  28.538  1.00  44.48     A    O
ATOM  13269  N    LYS E 237     -59.294  41.281  26.410  1.00  48.61     A    N
ATOM  13270  CA   LYS E 237     -60.000  42.463  25.968  1.00  51.43     A    C
ATOM  13271  CB   LYS E 237     -59.467  42.953  24.635  1.00  52.15     A    C
ATOM  13272  CG   LYS E 237     -57.998  43.210  24.588  1.00  55.00     A    C
ATOM  13273  CD   LYS E 237     -57.647  44.642  24.873  1.00  61.64     A    C
ATOM  13274  CE   LYS E 237     -56.148  44.805  25.132  1.00  63.90     A    C
ATOM  13275  NZ   LYS E 237     -55.605  43.928  26.217  1.00  65.42     A    N
ATOM  13276  C    LYS E 237     -61.475  42.215  25.831  1.00  52.41     A    C
ATOM  13277  O    LYS E 237     -61.988  42.133  24.753  1.00  54.48     A    O
ATOM  13278  N    ASP E 238     -62.158  42.087  26.940  1.00  53.47     A    N
ATOM  13279  CA   ASP E 238     -63.603  42.140  26.987  1.00  54.31     A    C
ATOM  13280  CB   ASP E 238     -64.158  43.318  26.183  1.00  55.78     A    C
ATOM  13281  CG   ASP E 238     -64.504  42.948  24.764  1.00  60.29     A    C
ATOM  13282  OD1  ASP E 238     -64.210  41.804  24.386  1.00  63.62     A    O
ATOM  13283  OD2  ASP E 238     -65.052  43.798  24.039  1.00  59.04     A    O-1
ATOM  13284  C    ASP E 238     -64.329  40.869  26.664  1.00  52.60     A    C
ATOM  13285  O    ASP E 238     -65.531  40.845  26.687  1.00  53.11     A    O
ATOM  13286  N    LEU E 239     -63.590  39.815  26.368  1.00  51.02     A    N
ATOM  13287  CA   LEU E 239     -64.028  38.454  26.608  1.00  48.12     A    C
ATOM  13288  CB   LEU E 239     -63.244  37.437  25.817  1.00  47.79     A    C
ATOM  13289  CG   LEU E 239     -63.946  37.057  24.535  1.00  48.02     A    C
ATOM  13290  CD1  LEU E 239     -63.877  38.247  23.676  1.00  52.55     A    C
ATOM  13291  CD2  LEU E 239     -63.280  35.956  23.889  1.00  40.97     A    C
ATOM  13292  C    LEU E 239     -64.010  38.141  28.087  1.00  46.41     A    C
ATOM  13293  O    LEU E 239     -64.713  37.322  28.563  1.00  45.89     A    O
ATOM  13294  N    ILE E 240     -63.197  38.842  28.821  1.00  44.15     A    N
ATOM  13295  CA   ILE E 240     -63.099  38.619  30.225  1.00  42.99     A    C
```

Appendix 1

```
ATOM  13296  CB   ILE E 240     -61.680  38.328  30.586  1.00  42.40      A  C
ATOM  13297  CG1  ILE E 240     -61.603  37.629  31.925  1.00  41.61      A  C
ATOM  13298  CD1  ILE E 240     -60.300  37.066  32.219  1.00  40.75      A  C
ATOM  13299  CG2  ILE E 240     -60.960  39.577  30.694  1.00  41.86      A  C
ATOM  13300  C    ILE E 240     -63.520  39.826  31.027  1.00  42.82      A  C
ATOM  13301  O    ILE E 240     -63.337  40.930  30.614  1.00  43.14      A  O
ATOM  13302  N    ASP E 241     -64.080  39.586  32.198  1.00  41.94      A  N
ATOM  13303  CA   ASP E 241     -64.283  40.603  33.191  1.00  41.50      A  C
ATOM  13304  CB   ASP E 241     -65.555  40.315  33.956  1.00  41.52      A  C
ATOM  13305  CG   ASP E 241     -65.838  41.317  35.010  1.00  42.61      A  C
ATOM  13306  OD1  ASP E 241     -64.941  41.970  35.515  1.00  43.63      A  O
ATOM  13307  OD2  ASP E 241     -66.979  41.451  35.350  1.00  43.13      A  O-1
ATOM  13308  C    ASP E 241     -63.127  40.464  34.128  1.00  42.12      A  C
ATOM  13309  O    ASP E 241     -63.024  39.480  34.801  1.00  40.75      A  O
ATOM  13310  N    PRO E 242     -62.236  41.435  34.125  1.00  42.47      A  N
ATOM  13311  CA   PRO E 242     -61.024  41.398  34.926  1.00  42.82      A  C
ATOM  13312  CB   PRO E 242     -60.307  42.654  34.487  1.00  41.78      A  C
ATOM  13313  CG   PRO E 242     -60.802  42.901  33.212  1.00  42.54      A  C
ATOM  13314  CD   PRO E 242     -62.217  42.596  33.248  1.00  42.93      A  C
ATOM  13315  C    PRO E 242     -61.277  41.440  36.411  1.00  43.20      A  C
ATOM  13316  O    PRO E 242     -60.603  40.830  37.200  1.00  42.37      A  O
ATOM  13317  N    GLU E 243     -62.246  42.236  36.782  1.00  43.64      A  N
ATOM  13318  CA   GLU E 243     -62.581  42.384  38.157  1.00  44.85      A  C
ATOM  13319  CB   GLU E 243     -63.502  43.564  38.353  1.00  45.99      A  C
ATOM  13320  CG   GLU E 243     -62.831  44.852  38.796  1.00  53.32      A  C
ATOM  13321  CD   GLU E 243     -61.435  45.093  38.221  1.00  65.25      A  C
ATOM  13322  OE1  GLU E 243     -60.483  44.366  38.576  1.00  67.86      A  O
ATOM  13323  OE2  GLU E 243     -61.271  46.051  37.441  1.00  67.23      A  O-1
ATOM  13324  C    GLU E 243     -63.135  41.116  38.739  1.00  43.41      A  C
ATOM  13325  O    GLU E 243     -62.935  40.846  39.872  1.00  42.97      A  O
ATOM  13326  N    ARG E 244     -63.855  40.340  37.968  1.00  41.91      A  N
ATOM  13327  CA   ARG E 244     -64.434  39.160  38.537  1.00  40.88      A  C
ATOM  13328  CB   ARG E 244     -65.904  39.086  38.172  1.00  41.23      A  C
ATOM  13329  CG   ARG E 244     -66.723  39.972  39.034  1.00  40.93      A  C
ATOM  13330  CD   ARG E 244     -68.160  39.882  38.767  1.00  42.61      A  C
ATOM  13331  NE   ARG E 244     -68.481  40.487  37.512  1.00  46.03      A  N
ATOM  13332  CZ   ARG E 244     -69.577  40.243  36.838  1.00  47.60      A  C
ATOM  13333  NH1  ARG E 244     -70.462  39.427  37.326  1.00  49.40      A  N
ATOM  13334  NH2  ARG E 244     -69.791  40.822  35.682  1.00  45.70      A  N
ATOM  13335  C    ARG E 244     -63.708  37.864  38.263  1.00  39.74      A  C
ATOM  13336  O    ARG E 244     -64.093  36.849  38.744  1.00  39.12      A  O
ATOM  13337  N    GLY E 245     -62.636  37.928  37.509  1.00  38.44      A  N
ATOM  13338  CA   GLY E 245     -61.919  36.761  37.075  1.00  36.39      A  C
ATOM  13339  C    GLY E 245     -62.743  35.819  36.261  1.00  35.47      A  C
ATOM  13340  O    GLY E 245     -62.654  34.644  36.416  1.00  36.36      A  O
ATOM  13341  N    ALA E 246     -63.574  36.350  35.394  1.00  34.35      A  N
ATOM  13342  CA   ALA E 246     -64.476  35.532  34.629  1.00  31.51      A  C
ATOM  13343  CB   ALA E 246     -65.808  35.569  35.249  1.00  31.74      A  C
ATOM  13344  C    ALA E 246     -64.596  35.849  33.172  1.00  31.16      A  C
ATOM  13345  O    ALA E 246     -64.798  36.962  32.797  1.00  30.20      A  O
ATOM  13346  N    PHE E 247     -64.528  34.817  32.362  1.00  30.11      A  N
ATOM  13347  CA   PHE E 247     -64.956  34.860  31.002  1.00  28.77      A  C
ATOM  13348  CB   PHE E 247     -64.328  33.716  30.226  1.00  28.18      A  C
ATOM  13349  CG   PHE E 247     -62.838  33.723  30.230  1.00  27.32      A  C
```

Appendix 1

```
ATOM  13350  CD1  PHE  E  247   -62.135  34.543  29.418  1.00  22.52   A  C
ATOM  13351  CE1  PHE  E  247   -60.806  34.528  29.446  1.00  20.01   A  C
ATOM  13352  CZ   PHE  E  247   -60.154  33.706  30.260  1.00  21.22   A  C
ATOM  13353  CE2  PHE  E  247   -60.821  32.888  31.047  1.00  19.41   A  C
ATOM  13354  CD2  PHE  E  247   -62.142  32.885  31.039  1.00  23.16   A  C
ATOM  13355  C    PHE  E  247   -66.474  34.856  30.845  1.00  29.88   A  C
ATOM  13356  O    PHE  E  247   -67.172  34.230  31.563  1.00  31.05   A  O
ATOM  13357  N    TYR  E  248   -66.942  35.587  29.864  1.00  30.97   A  N
ATOM  13358  CA   TYR  E  248   -68.274  35.566  29.374  1.00  31.27   A  C
ATOM  13359  CB   TYR  E  248   -68.503  36.816  28.554  1.00  32.93   A  C
ATOM  13360  CG   TYR  E  248   -68.580  38.059  29.377  1.00  33.38   A  C
ATOM  13361  CD1  TYR  E  248   -69.751  38.446  29.925  1.00  36.64   A  C
ATOM  13362  CE1  TYR  E  248   -69.835  39.527  30.658  1.00  37.05   A  C
ATOM  13363  CZ   TYR  E  248   -68.737  40.278  30.867  1.00  39.95   A  C
ATOM  13364  OH   TYR  E  248   -68.833  41.392  31.621  1.00  39.94   A  O
ATOM  13365  CE2  TYR  E  248   -67.557  39.927  30.336  1.00  38.50   A  C
ATOM  13366  CD2  TYR  E  248   -67.485  38.831  29.592  1.00  36.12   A  C
ATOM  13367  C    TYR  E  248   -68.488  34.324  28.548  1.00  30.73   A  C
ATOM  13368  O    TYR  E  248   -67.559  33.710  28.134  1.00  31.06   A  O
ATOM  13369  N    LEU  E  249   -69.729  33.973  28.300  1.00  30.68   A  N
ATOM  13370  CA   LEU  E  249   -70.084  32.709  27.699  1.00  30.83   A  C
ATOM  13371  CB   LEU  E  249   -71.608  32.597  27.675  1.00  29.76   A  C
ATOM  13372  CG   LEU  E  249   -72.376  31.276  27.635  1.00  31.72   A  C
ATOM  13373  CD1  LEU  E  249   -72.095  30.388  28.782  1.00  30.49   A  C
ATOM  13374  CD2  LEU  E  249   -73.811  31.497  27.552  1.00  27.96   A  C
ATOM  13375  C    LEU  E  249   -69.524  32.467  26.304  1.00  31.62   A  C
ATOM  13376  O    LEU  E  249   -69.070  31.396  26.030  1.00  31.82   A  O
ATOM  13377  N    SER  E  250   -69.583  33.442  25.422  1.00  31.25   A  N
ATOM  13378  CA   SER  E  250   -69.013  33.279  24.115  1.00  31.09   A  C
ATOM  13379  CB   SER  E  250   -69.820  32.348  23.244  1.00  32.17   A  C
ATOM  13380  OG   SER  E  250   -71.173  32.561  23.399  1.00  30.74   A  O
ATOM  13381  C    SER  E  250   -68.827  34.553  23.404  1.00  31.69   A  C
ATOM  13382  O    SER  E  250   -69.256  35.578  23.842  1.00  30.64   A  O
ATOM  13383  N    TYR  E  251   -68.178  34.445  22.272  1.00  32.11   A  N
ATOM  13384  CA   TYR  E  251   -67.965  35.562  21.411  1.00  33.93   A  C
ATOM  13385  CB   TYR  E  251   -66.501  35.951  21.401  1.00  34.17   A  C
ATOM  13386  CG   TYR  E  251   -66.121  36.926  20.340  1.00  37.95   A  C
ATOM  13387  CD1  TYR  E  251   -66.748  38.135  20.225  1.00  39.44   A  C
ATOM  13388  CE1  TYR  E  251   -66.412  38.991  19.282  1.00  40.91   A  C
ATOM  13389  CZ   TYR  E  251   -65.433  38.674  18.422  1.00  46.97   A  C
ATOM  13390  OH   TYR  E  251   -65.072  39.544  17.441  1.00  49.12   A  O
ATOM  13391  CE2  TYR  E  251   -64.807  37.486  18.506  1.00  44.94   A  C
ATOM  13392  CD2  TYR  E  251   -65.150  36.630  19.451  1.00  39.91   A  C
ATOM  13393  C    TYR  E  251   -68.435  35.189  20.035  1.00  34.75   A  C
ATOM  13394  O    TYR  E  251   -68.276  34.084  19.615  1.00  34.27   A  O
ATOM  13395  N    HIS  E  252   -69.047  36.124  19.343  1.00  36.31   A  N
ATOM  13396  CA   HIS  E  252   -69.576  35.863  18.032  1.00  37.88   A  C
ATOM  13397  CB   HIS  E  252   -71.062  35.892  18.160  1.00  36.27   A  C
ATOM  13398  CG   HIS  E  252   -71.527  35.062  19.286  1.00  36.45   A  C
ATOM  13399  ND1  HIS  E  252   -71.540  33.698  19.221  1.00  32.57   A  N
ATOM  13400  CE1  HIS  E  252   -71.931  33.220  20.373  1.00  34.29   A  C
ATOM  13401  NE2  HIS  E  252   -72.135  34.224  21.191  1.00  32.35   A  N
ATOM  13402  CD2  HIS  E  252   -71.872  35.387  20.542  1.00  33.47   A  C
ATOM  13403  C    HIS  E  252   -69.127  36.847  17.030  1.00  39.85   A  C
```

Appendix 1

```
ATOM  13404  O    HIS E 252   -69.647  37.906  16.930  1.00  41.69   A  O
ATOM  13405  N    PRO E 253   -68.172  36.444  16.246  1.00  40.68   A  N
ATOM  13406  CA   PRO E 253   -67.376  37.354  15.474  1.00  42.82   A  C
ATOM  13407  CB   PRO E 253   -66.335  36.432  14.858  1.00  42.08   A  C
ATOM  13408  CG   PRO E 253   -66.786  35.120  15.106  1.00  40.71   A  C
ATOM  13409  CD   PRO E 253   -67.544  35.136  16.305  1.00  40.65   A  C
ATOM  13410  C    PRO E 253   -68.109  38.200  14.434  1.00  44.54   A  C
ATOM  13411  O    PRO E 253   -67.715  39.330  14.278  1.00  43.79   A  O
ATOM  13412  N    GLU E 254   -69.097  37.691  13.713  1.00  46.46   A  N
ATOM  13413  CA   GLU E 254   -69.791  38.545  12.760  1.00  48.24   A  C
ATOM  13414  CB   GLU E 254   -70.710  37.702  11.882  1.00  49.20   A  C
ATOM  13415  CG   GLU E 254   -71.887  38.460  11.293  1.00  55.31   A  C
ATOM  13416  CD   GLU E 254   -71.784  38.666   9.807  1.00  63.74   A  C
ATOM  13417  OE1  GLU E 254   -71.303  37.766   9.116  1.00  62.03   A  O
ATOM  13418  OE2  GLU E 254   -72.183  39.728   9.316  1.00  67.04   A  O-1
ATOM  13419  C    GLU E 254   -70.612  39.664  13.342  1.00  47.23   A  C
ATOM  13420  O    GLU E 254   -70.442  40.799  12.995  1.00  48.00   A  O
ATOM  13421  N    SER E 255   -71.475  39.356  14.267  1.00  46.42   A  N
ATOM  13422  CA   SER E 255   -72.142  40.390  15.000  1.00  45.57   A  C
ATOM  13423  CB   SER E 255   -73.283  39.824  15.820  1.00  45.38   A  C
ATOM  13424  OG   SER E 255   -72.818  38.998  16.840  1.00  47.65   A  O
ATOM  13425  C    SER E 255   -71.182  41.185  15.864  1.00  45.09   A  C
ATOM  13426  O    SER E 255   -71.444  42.310  16.182  1.00  44.79   A  O
ATOM  13427  N    GLY E 256   -70.090  40.565  16.269  1.00  43.77   A  N
ATOM  13428  CA   GLY E 256   -69.170  41.136  17.223  1.00  42.20   A  C
ATOM  13429  C    GLY E 256   -69.637  41.074  18.650  1.00  40.62   A  C
ATOM  13430  O    GLY E 256   -69.108  41.724  19.495  1.00  40.92   A  O
ATOM  13431  N    ALA E 257   -70.667  40.296  18.886  1.00  39.21   A  N
ATOM  13432  CA   ALA E 257   -71.306  40.141  20.182  1.00  38.88   A  C
ATOM  13433  CB   ALA E 257   -72.715  39.597  19.977  1.00  39.73   A  C
ATOM  13434  C    ALA E 257   -70.600  39.299  21.229  1.00  36.85   A  C
ATOM  13435  O    ALA E 257   -70.047  38.296  20.931  1.00  33.49   A  O
ATOM  13436  N    VAL E 258   -70.701  39.713  22.467  1.00  35.77   A  N
ATOM  13437  CA   VAL E 258   -70.294  38.889  23.549  1.00  36.21   A  C
ATOM  13438  CB   VAL E 258   -69.248  39.562  24.372  1.00  36.52   A  C
ATOM  13439  CG1  VAL E 258   -69.198  38.966  25.687  1.00  36.87   A  C
ATOM  13440  CG2  VAL E 258   -67.945  39.445  23.706  1.00  35.67   A  C
ATOM  13441  C    VAL E 258   -71.511  38.620  24.366  1.00  35.88   A  C
ATOM  13442  O    VAL E 258   -72.112  39.517  24.840  1.00  37.80   A  O
ATOM  13443  N    LYS E 259   -71.877  37.370  24.528  1.00  34.33   A  N
ATOM  13444  CA   LYS E 259   -73.024  37.023  25.316  1.00  33.63   A  C
ATOM  13445  CB   LYS E 259   -73.228  35.531  25.297  1.00  33.09   A  C
ATOM  13446  CG   LYS E 259   -73.944  35.069  24.140  1.00  30.06   A  C
ATOM  13447  CD   LYS E 259   -74.612  33.819  24.391  1.00  30.15   A  C
ATOM  13448  CE   LYS E 259   -74.978  33.204  23.112  1.00  34.06   A  C
ATOM  13449  NZ   LYS E 259   -74.920  31.765  23.174  1.00  36.25   A  N
ATOM  13450  C    LYS E 259   -72.778  37.463  26.711  1.00  34.10   A  C
ATOM  13451  O    LYS E 259   -71.738  37.289  27.229  1.00  36.04   A  O
ATOM  13452  N    PRO E 260   -73.779  37.986  27.353  1.00  34.12   A  N
ATOM  13453  CA   PRO E 260   -73.597  38.826  28.506  1.00  34.11   A  C
ATOM  13454  CB   PRO E 260   -74.741  39.802  28.383  1.00  33.99   A  C
ATOM  13455  CG   PRO E 260   -75.636  39.221  27.498  1.00  34.35   A  C
ATOM  13456  CD   PRO E 260   -74.871  38.477  26.534  1.00  33.78   A  C
ATOM  13457  C    PRO E 260   -73.648  38.078  29.806  1.00  34.36   A  C
```

Appendix 1

```
ATOM  13458  O    PRO E 260     -73.956  38.634  30.814  1.00 35.61      A  O
ATOM  13459  N    TRP E 261     -73.299  36.814  29.789  1.00 32.62      A  N
ATOM  13460  CA   TRP E 261     -73.248  36.082  31.012  1.00 31.40      A  C
ATOM  13461  CB   TRP E 261     -74.217  34.920  30.981  1.00 30.50      A  C
ATOM  13462  CG   TRP E 261     -75.601  35.353  30.868  1.00 32.09      A  C
ATOM  13463  CD1  TRP E 261     -76.406  35.734  31.860  1.00 34.89      A  C
ATOM  13464  NE1  TRP E 261     -77.606  36.106  31.386  1.00 34.19      A  N
ATOM  13465  CE2  TRP E 261     -77.594  35.980  30.034  1.00 33.22      A  C
ATOM  13466  CD2  TRP E 261     -76.346  35.506  29.676  1.00 32.65      A  C
ATOM  13467  CE3  TRP E 261     -76.076  35.287  28.338  1.00 31.49      A  C
ATOM  13468  CZ3  TRP E 261     -77.031  35.535  27.447  1.00 33.77      A  C
ATOM  13469  CH2  TRP E 261     -78.262  35.994  27.831  1.00 35.51      A  C
ATOM  13470  CZ2  TRP E 261     -78.563  36.224  29.122  1.00 33.03      A  C
ATOM  13471  C    TRP E 261     -71.858  35.606  31.252  1.00 30.98      A  C
ATOM  13472  O    TRP E 261     -71.240  35.101  30.378  1.00 30.96      A  O
ATOM  13473  N    ILE E 262     -71.350  35.787  32.448  1.00 29.70      A  N
ATOM  13474  CA   ILE E 262     -70.145  35.092  32.825  1.00 28.45      A  C
ATOM  13475  CB   ILE E 262     -69.312  35.799  33.914  1.00 28.32      A  C
ATOM  13476  CG1  ILE E 262     -70.049  35.906  35.232  1.00 26.39      A  C
ATOM  13477  CD1  ILE E 262     -69.346  36.659  36.227  1.00 19.54      A  C
ATOM  13478  CG2  ILE E 262     -68.887  37.128  33.458  1.00 28.26      A  C
ATOM  13479  C    ILE E 262     -70.459  33.674  33.202  1.00 28.22      A  C
ATOM  13480  O    ILE E 262     -71.447  33.424  33.825  1.00 26.98      A  O
ATOM  13481  N    SER E 263     -69.601  32.764  32.790  1.00 27.32      A  N
ATOM  13482  CA   SER E 263     -69.737  31.355  33.064  1.00 26.25      A  C
ATOM  13483  CB   SER E 263     -69.679  30.602  31.777  1.00 26.64      A  C
ATOM  13484  OG   SER E 263     -69.734  29.249  32.011  1.00 27.80      A  O
ATOM  13485  C    SER E 263     -68.617  30.856  33.922  1.00 26.11      A  C
ATOM  13486  O    SER E 263     -67.493  31.050  33.626  1.00 27.56      A  O
ATOM  13487  N    ALA E 264     -68.947  30.228  35.025  1.00 25.82      A  N
ATOM  13488  CA   ALA E 264     -67.967  29.593  35.866  1.00 23.84      A  C
ATOM  13489  CB   ALA E 264     -68.585  29.223  37.128  1.00 23.94      A  C
ATOM  13490  C    ALA E 264     -67.288  28.401  35.284  1.00 24.14      A  C
ATOM  13491  O    ALA E 264     -66.123  28.265  35.386  1.00 25.14      A  O
ATOM  13492  N    TYR E 265     -68.042  27.518  34.682  1.00 23.58      A  N
ATOM  13493  CA   TYR E 265     -67.464  26.340  34.130  1.00 24.06      A  C
ATOM  13494  CB   TYR E 265     -68.533  25.340  33.735  1.00 24.32      A  C
ATOM  13495  CG   TYR E 265     -68.780  25.208  32.274  1.00 27.55      A  C
ATOM  13496  CD1  TYR E 265     -68.007  24.395  31.502  1.00 26.63      A  C
ATOM  13497  CE1  TYR E 265     -68.222  24.291  30.219  1.00 22.52      A  C
ATOM  13498  CZ   TYR E 265     -69.226  24.982  29.662  1.00 28.41      A  C
ATOM  13499  OH   TYR E 265     -69.461  24.862  28.352  1.00 31.99      A  O
ATOM  13500  CE2  TYR E 265     -70.010  25.778  30.388  1.00 30.31      A  C
ATOM  13501  CD2  TYR E 265     -69.791  25.891  31.667  1.00 28.47      A  C
ATOM  13502  C    TYR E 265     -66.493  26.635  33.009  1.00 24.53      A  C
ATOM  13503  O    TYR E 265     -65.505  25.996  32.895  1.00 25.43      A  O
ATOM  13504  N    THR E 266     -66.797  27.615  32.186  1.00 24.26      A  N
ATOM  13505  CA   THR E 266     -65.953  28.055  31.109  1.00 24.00      A  C
ATOM  13506  CB   THR E 266     -66.616  29.225  30.433  1.00 24.30      A  C
ATOM  13507  OG1  THR E 266     -67.827  28.816  29.836  1.00 28.70      A  O
ATOM  13508  CG2  THR E 266     -65.754  29.789  29.410  1.00 20.50      A  C
ATOM  13509  C    THR E 266     -64.642  28.611  31.572  1.00 23.59      A  C
ATOM  13510  O    THR E 266     -63.625  28.390  30.999  1.00 21.08      A  O
ATOM  13511  N    THR E 267     -64.718  29.426  32.592  1.00 24.05      A  N
```

Appendix 1

```
ATOM  13512  CA   THR E 267     -63.564  30.010  33.211  1.00 23.40      A    C
ATOM  13513  CB   THR E 267     -63.965  30.993  34.263  1.00 24.29      A    C
ATOM  13514  OG1  THR E 267     -64.937  31.876  33.752  1.00 23.73      A    O
ATOM  13515  CG2  THR E 267     -62.835  31.780  34.657  1.00 24.34      A    C
ATOM  13516  C    THR E 267     -62.661  29.029  33.874  1.00 23.27      A    C
ATOM  13517  O    THR E 267     -61.503  29.100  33.717  1.00 22.98      A    O
ATOM  13518  N    ALA E 268     -63.207  28.116  34.634  1.00 22.80      A    N
ATOM  13519  CA   ALA E 268     -62.396  27.145  35.314  1.00 23.09      A    C
ATOM  13520  CB   ALA E 268     -63.244  26.309  36.174  1.00 22.97      A    C
ATOM  13521  C    ALA E 268     -61.636  26.267  34.363  1.00 24.14      A    C
ATOM  13522  O    ALA E 268     -60.502  25.988  34.570  1.00 24.55      A    O
ATOM  13523  N    TRP E 269     -62.299  25.816  33.319  1.00 23.94      A    N
ATOM  13524  CA   TRP E 269     -61.689  24.994  32.323  1.00 23.59      A    C
ATOM  13525  CB   TRP E 269     -62.774  24.437  31.393  1.00 23.15      A    C
ATOM  13526  CG   TRP E 269     -62.356  23.814  30.145  1.00 27.29      A    C
ATOM  13527  CD1  TRP E 269     -61.135  23.800  29.631  1.00 32.15      A    C
ATOM  13528  NE1  TRP E 269     -61.113  23.156  28.454  1.00 34.82      A    N
ATOM  13529  CE2  TRP E 269     -62.372  22.727  28.176  1.00 35.03      A    C
ATOM  13530  CD2  TRP E 269     -63.179  23.134  29.219  1.00 31.32      A    C
ATOM  13531  CE3  TRP E 269     -64.534  22.828  29.167  1.00 34.73      A    C
ATOM  13532  CZ3  TRP E 269     -65.005  22.164  28.116  1.00 33.65      A    C
ATOM  13533  CH2  TRP E 269     -64.178  21.761  27.098  1.00 32.73      A    C
ATOM  13534  CZ2  TRP E 269     -62.861  22.041  27.103  1.00 33.47      A    C
ATOM  13535  C    TRP E 269     -60.625  25.775  31.608  1.00 25.10      A    C
ATOM  13536  O    TRP E 269     -59.565  25.270  31.384  1.00 25.31      A    O
ATOM  13537  N    THR E 270     -60.925  27.009  31.250  1.00 24.49      A    N
ATOM  13538  CA   THR E 270     -59.997  27.892  30.564  1.00 25.16      A    C
ATOM  13539  CB   THR E 270     -60.694  29.171  30.070  1.00 26.49      A    C
ATOM  13540  OG1  THR E 270     -61.934  28.830  29.512  1.00 21.27      A    O
ATOM  13541  CG2  THR E 270     -59.887  29.892  29.061  1.00 25.59      A    C
ATOM  13542  C    THR E 270     -58.787  28.276  31.385  1.00 25.67      A    C
ATOM  13543  O    THR E 270     -57.707  28.276  30.917  1.00 26.40      A    O
ATOM  13544  N    LEU E 271     -58.988  28.599  32.629  1.00 25.31      A    N
ATOM  13545  CA   LEU E 271     -57.893  28.856  33.511  1.00 24.36      A    C
ATOM  13546  CB   LEU E 271     -58.415  29.412  34.799  1.00 24.50      A    C
ATOM  13547  CG   LEU E 271     -58.514  30.901  35.049  1.00 25.51      A    C
ATOM  13548  CD1  LEU E 271     -58.629  31.758  33.879  1.00 21.24      A    C
ATOM  13549  CD2  LEU E 271     -59.585  31.165  35.998  1.00 20.99      A    C
ATOM  13550  C    LEU E 271     -57.023  27.651  33.753  1.00 23.98      A    C
ATOM  13551  O    LEU E 271     -55.852  27.764  33.829  1.00 22.67      A    O
ATOM  13552  N    ALA E 272     -57.601  26.485  33.879  1.00 23.64      A    N
ATOM  13553  CA   ALA E 272     -56.805  25.323  34.084  1.00 23.99      A    C
ATOM  13554  CB   ALA E 272     -57.662  24.160  34.402  1.00 23.51      A    C
ATOM  13555  C    ALA E 272     -55.896  25.037  32.922  1.00 24.42      A    C
ATOM  13556  O    ALA E 272     -54.801  24.662  33.115  1.00 24.99      A    O
ATOM  13557  N    MET E 273     -56.365  25.173  31.707  1.00 24.62      A    N
ATOM  13558  CA   MET E 273     -55.519  25.018  30.562  1.00 26.40      A    C
ATOM  13559  CB   MET E 273     -56.339  24.826  29.317  1.00 27.63      E    C
ATOM  13560  CG   MET E 273     -57.427  23.853  29.489  1.00 31.08      E    C
ATOM  13561  SD   MET E 273     -57.108  22.284  28.796  1.00 43.53      E    S
ATOM  13562  CE   MET E 273     -57.490  22.629  27.150  1.00 37.10      E    C
ATOM  13563  C    MET E 273     -54.459  26.063  30.351  1.00 26.42      A    C
ATOM  13564  O    MET E 273     -53.401  25.764  29.895  1.00 27.39      A    O
ATOM  13565  N    VAL E 274     -54.783  27.300  30.641  1.00 25.78      A    N
```

Appendix 1

```
ATOM  13566  CA   VAL E 274    -53.878  28.434  30.529  1.00 25.87      A    C
ATOM  13567  CB   VAL E 274    -54.621  29.757  30.604  1.00 25.30      A    C
ATOM  13568  CG1  VAL E 274    -53.706  30.870  30.682  1.00 25.25      A    C
ATOM  13569  CG2  VAL E 274    -55.427  29.910  29.431  1.00 20.76      A    C
ATOM  13570  C    VAL E 274    -52.689  28.364  31.475  1.00 27.19      A    C
ATOM  13571  O    VAL E 274    -51.620  28.715  31.139  1.00 26.20      A    O
ATOM  13572  N    HIS E 275    -52.900  27.789  32.633  1.00 29.18      A    N
ATOM  13573  CA   HIS E 275    -51.902  27.644  33.633  1.00 29.53      A    C
ATOM  13574  CB   HIS E 275    -52.487  26.964  34.846  1.00 30.04      A    C
ATOM  13575  CG   HIS E 275    -51.714  27.208  36.095  1.00 32.51      A    C
ATOM  13576  ND1  HIS E 275    -50.941  26.247  36.682  1.00 36.79      A    N
ATOM  13577  CE1  HIS E 275    -50.363  26.739  37.749  1.00 34.93      A    C
ATOM  13578  NE2  HIS E 275    -50.731  27.990  37.872  1.00 36.59      A    N
ATOM  13579  CD2  HIS E 275    -51.577  28.308  36.855  1.00 32.43      A    C
ATOM  13580  C    HIS E 275    -50.770  26.836  33.112  1.00 29.52      A    C
ATOM  13581  O    HIS E 275    -49.684  26.950  33.578  1.00 30.96      A    O
ATOM  13582  N    GLY E 276    -51.065  25.950  32.200  1.00 29.23      A    N
ATOM  13583  CA   GLY E 276    -50.091  25.189  31.476  1.00 28.69      A    C
ATOM  13584  C    GLY E 276    -49.250  26.037  30.599  1.00 30.42      A    C
ATOM  13585  O    GLY E 276    -48.140  25.729  30.409  1.00 31.09      A    O
ATOM  13586  N    MET E 277    -49.801  27.089  30.033  1.00 30.72      A    N
ATOM  13587  CA   MET E 277    -49.066  27.941  29.116  1.00 31.17      A    C
ATOM  13588  CB   MET E 277    -49.904  28.223  27.867  1.00 31.25      E    C
ATOM  13589  CG   MET E 277    -50.504  26.991  27.272  1.00 32.25      E    C
ATOM  13590  SD   MET E 277    -51.610  27.122  25.890  1.00 33.05      E    S
ATOM  13591  CE   MET E 277    -53.104  27.355  26.701  1.00 19.22      E    C
ATOM  13592  C    MET E 277    -48.549  29.228  29.709  1.00 30.26      A    C
ATOM  13593  O    MET E 277    -47.468  29.632  29.437  1.00 30.07      A    O
ATOM  13594  N    ASP E 278    -49.365  29.878  30.500  1.00 29.33      A    N
ATOM  13595  CA   ASP E 278    -49.024  31.122  31.115  1.00 28.74      A    C
ATOM  13596  CB   ASP E 278    -49.784  32.217  30.412  1.00 32.11      A    C
ATOM  13597  CG   ASP E 278    -49.164  33.574  30.566  1.00 34.89      A    C
ATOM  13598  OD1  ASP E 278    -48.432  33.831  31.494  1.00 41.78      A    O
ATOM  13599  OD2  ASP E 278    -49.429  34.424  29.749  1.00 40.97      A    O-1
ATOM  13600  C    ASP E 278    -49.449  31.132  32.531  1.00 26.97      A    C
ATOM  13601  O    ASP E 278    -50.454  31.651  32.829  1.00 25.94      A    O
ATOM  13602  N    PRO E 279    -48.657  30.622  33.428  1.00 26.18      A    N
ATOM  13603  CA   PRO E 279    -49.087  30.475  34.796  1.00 25.15      A    C
ATOM  13604  CB   PRO E 279    -47.881  29.868  35.447  1.00 25.96      A    C
ATOM  13605  CG   PRO E 279    -47.187  29.277  34.442  1.00 23.65      A    C
ATOM  13606  CD   PRO E 279    -47.320  30.077  33.272  1.00 26.36      A    C
ATOM  13607  C    PRO E 279    -49.415  31.783  35.419  1.00 25.53      A    C
ATOM  13608  O    PRO E 279    -50.268  31.847  36.232  1.00 26.87      A    O
ATOM  13609  N    ALA E 280    -48.741  32.825  35.026  1.00 24.69      A    N
ATOM  13610  CA   ALA E 280    -49.009  34.100  35.574  1.00 23.79      A    C
ATOM  13611  CB   ALA E 280    -48.048  35.079  35.080  1.00 22.41      A    C
ATOM  13612  C    ALA E 280    -50.405  34.537  35.291  1.00 24.95      A    C
ATOM  13613  O    ALA E 280    -51.015  35.127  36.112  1.00 24.72      A    O
ATOM  13614  N    PHE E 281    -50.921  34.253  34.116  1.00 25.54      A    N
ATOM  13615  CA   PHE E 281    -52.241  34.689  33.767  1.00 25.92      A    C
ATOM  13616  CB   PHE E 281    -52.470  34.239  32.327  1.00 27.52      A    C
ATOM  13617  CG   PHE E 281    -53.815  34.567  31.743  1.00 27.83      A    C
ATOM  13618  CD1  PHE E 281    -53.913  35.440  30.731  1.00 26.60      A    C
ATOM  13619  CE1  PHE E 281    -55.104  35.716  30.192  1.00 31.15      A    C
```

Appendix 1

```
ATOM  13620  CZ   PHE E 281     -56.193  35.117  30.617  1.00  25.79    A  C
ATOM  13621  CE2  PHE E 281     -56.125  34.234  31.577  1.00  24.02    A  C
ATOM  13622  CD2  PHE E 281     -54.950  33.940  32.142  1.00  25.71    A  C
ATOM  13623  C    PHE E 281     -53.287  34.108  34.683  1.00  26.43    A  C
ATOM  13624  O    PHE E 281     -54.082  34.809  35.220  1.00  26.59    A  O
ATOM  13625  N    SER E 282     -53.274  32.816  34.897  1.00  26.18    A  N
ATOM  13626  CA   SER E 282     -54.244  32.190  35.764  1.00  27.49    A  C
ATOM  13627  CB   SER E 282     -54.193  30.708  35.638  1.00  26.29    A  C
ATOM  13628  OG   SER E 282     -54.298  30.404  34.331  1.00  26.62    A  O
ATOM  13629  C    SER E 282     -54.173  32.585  37.211  1.00  28.69    A  C
ATOM  13630  O    SER E 282     -55.160  32.665  37.868  1.00  29.24    A  O
ATOM  13631  N    GLU E 283     -52.971  32.790  37.688  1.00  29.75    A  N
ATOM  13632  CA   GLU E 283     -52.722  33.217  39.032  1.00  31.05    A  C
ATOM  13633  CB   GLU E 283     -51.233  33.190  39.344  1.00  31.40    A  C
ATOM  13634  CG   GLU E 283     -50.640  31.829  39.472  1.00  32.33    A  C
ATOM  13635  CD   GLU E 283     -49.139  31.804  39.316  1.00  39.04    A  C
ATOM  13636  OE1  GLU E 283     -48.483  32.812  39.535  1.00  37.41    A  O
ATOM  13637  OE2  GLU E 283     -48.616  30.759  38.967  1.00  40.54    A  O-1
ATOM  13638  C    GLU E 283     -53.316  34.573  39.285  1.00  30.44    A  C
ATOM  13639  O    GLU E 283     -53.780  34.856  40.341  1.00  31.44    A  O
ATOM  13640  N    ARG E 284     -53.288  35.435  38.301  1.00  30.87    A  N
ATOM  13641  CA   ARG E 284     -53.873  36.743  38.447  1.00  31.89    A  C
ATOM  13642  CB   ARG E 284     -53.579  37.562  37.206  1.00  31.55    A  C
ATOM  13643  CG   ARG E 284     -54.085  38.919  37.318  1.00  38.81    A  C
ATOM  13644  CD   ARG E 284     -53.961  39.778  36.101  1.00  48.73    A  C
ATOM  13645  NE   ARG E 284     -55.038  40.771  36.125  1.00  58.15    A  N
ATOM  13646  CZ   ARG E 284     -55.024  41.986  35.585  1.00  62.44    A  C
ATOM  13647  NH1  ARG E 284     -53.962  42.454  34.959  1.00  62.93    A  N
ATOM  13648  NH2  ARG E 284     -56.091  42.746  35.693  1.00  61.76    A  N
ATOM  13649  C    ARG E 284     -55.363  36.684  38.655  1.00  31.03    A  C
ATOM  13650  O    ARG E 284     -55.919  37.343  39.495  1.00  31.05    A  O
ATOM  13651  N    TYR E 285     -55.997  35.889  37.832  1.00  28.64    A  N
ATOM  13652  CA   TYR E 285     -57.410  35.612  37.892  1.00  27.66    A  C
ATOM  13653  CB   TYR E 285     -57.928  35.291  36.508  1.00  27.08    A  C
ATOM  13654  CG   TYR E 285     -57.670  36.436  35.620  1.00  26.73    A  C
ATOM  13655  CD1  TYR E 285     -58.183  37.651  35.907  1.00  29.18    A  C
ATOM  13656  CE1  TYR E 285     -57.941  38.683  35.142  1.00  27.91    A  C
ATOM  13657  CZ   TYR E 285     -57.157  38.538  34.081  1.00  28.60    A  C
ATOM  13658  OH   TYR E 285     -56.907  39.598  33.300  1.00  30.87    A  O
ATOM  13659  CE2  TYR E 285     -56.617  37.357  33.790  1.00  26.14    A  C
ATOM  13660  CD2  TYR E 285     -56.864  36.328  34.552  1.00  22.57    A  C
ATOM  13661  C    TYR E 285     -58.006  34.735  38.964  1.00  27.15    A  C
ATOM  13662  O    TYR E 285     -59.111  34.927  39.334  1.00  24.96    A  O
ATOM  13663  N    TYR E 286     -57.258  33.770  39.452  1.00  27.22    A  N
ATOM  13664  CA   TYR E 286     -57.806  32.685  40.231  1.00  26.62    A  C
ATOM  13665  CB   TYR E 286     -56.717  31.627  40.416  1.00  26.72    A  C
ATOM  13666  CG   TYR E 286     -57.118  30.438  41.211  1.00  25.50    A  C
ATOM  13667  CD1  TYR E 286     -58.245  29.741  40.917  1.00  22.53    A  C
ATOM  13668  CE1  TYR E 286     -58.621  28.710  41.635  1.00  25.39    A  C
ATOM  13669  CZ   TYR E 286     -57.878  28.328  42.656  1.00  25.99    A  C
ATOM  13670  OH   TYR E 286     -58.259  27.275  43.378  1.00  23.18    A  O
ATOM  13671  CE2  TYR E 286     -56.757  28.993  42.965  1.00  24.78    A  C
ATOM  13672  CD2  TYR E 286     -56.386  30.034  42.252  1.00  22.20    A  C
ATOM  13673  C    TYR E 286     -58.515  33.065  41.542  1.00  27.32    A  C
```

Appendix 1

```
ATOM  13674  O    TYR E 286     -59.566  32.576  41.825  1.00 26.84      A  O
ATOM  13675  N    PRO E 287     -57.956  33.965  42.319  1.00 27.97      A  N
ATOM  13676  CA   PRO E 287     -58.613  34.456  43.515  1.00 28.56      A  C
ATOM  13677  CB   PRO E 287     -57.534  35.278  44.150  1.00 26.93      A  C
ATOM  13678  CG   PRO E 287     -56.356  34.713  43.657  1.00 29.47      A  C
ATOM  13679  CD   PRO E 287     -56.564  34.380  42.305  1.00 27.46      A  C
ATOM  13680  C    PRO E 287     -59.888  35.258  43.293  1.00 29.64      A  C
ATOM  13681  O    PRO E 287     -60.819  35.169  44.036  1.00 30.35      A  O
ATOM  13682  N    ARG E 288     -59.913  36.049  42.258  1.00 29.75      A  N
ATOM  13683  CA   ARG E 288     -61.107  36.741  41.874  1.00 30.81      A  C
ATOM  13684  CB   ARG E 288     -60.795  37.701  40.773  1.00 30.80      A  C
ATOM  13685  CG   ARG E 288     -59.864  38.726  41.183  1.00 33.86      A  C
ATOM  13686  CD   ARG E 288     -59.070  39.196  40.049  1.00 45.87      A  C
ATOM  13687  NE   ARG E 288     -58.297  40.382  40.349  1.00 54.77      A  N
ATOM  13688  CZ   ARG E 288     -58.800  41.533  40.783  1.00 62.51      A  C
ATOM  13689  NH1  ARG E 288     -60.094  41.689  40.986  1.00 62.15      A  N
ATOM  13690  NH2  ARG E 288     -57.991  42.550  41.025  1.00 65.33      A  N
ATOM  13691  C    ARG E 288     -62.223  35.806  41.469  1.00 30.95      A  C
ATOM  13692  O    ARG E 288     -63.358  36.052  41.729  1.00 31.01      A  O
ATOM  13693  N    PHE E 289     -61.859  34.733  40.810  1.00 30.81      A  N
ATOM  13694  CA   PHE E 289     -62.758  33.703  40.396  1.00 30.04      A  C
ATOM  13695  CB   PHE E 289     -61.994  32.721  39.521  1.00 30.18      A  C
ATOM  13696  CG   PHE E 289     -62.641  31.400  39.392  1.00 32.26      A  C
ATOM  13697  CD1  PHE E 289     -63.505  31.151  38.388  1.00 35.26      A  C
ATOM  13698  CE1  PHE E 289     -64.085  29.997  38.274  1.00 33.22      A  C
ATOM  13699  CZ   PHE E 289     -63.818  29.054  39.127  1.00 36.72      A  C
ATOM  13700  CE2  PHE E 289     -62.963  29.249  40.125  1.00 37.89      A  C
ATOM  13701  CD2  PHE E 289     -62.372  30.406  40.257  1.00 37.04      A  C
ATOM  13702  C    PHE E 289     -63.419  32.974  41.541  1.00 29.55      A  C
ATOM  13703  O    PHE E 289     -64.566  32.678  41.523  1.00 28.37      A  O
ATOM  13704  N    LYS E 290     -62.659  32.653  42.540  1.00 29.65      A  N
ATOM  13705  CA   LYS E 290     -63.209  32.007  43.677  1.00 29.16      A  C
ATOM  13706  CB   LYS E 290     -62.109  31.601  44.617  1.00 28.65      A  C
ATOM  13707  CG   LYS E 290     -61.256  30.481  44.188  1.00 27.82      A  C
ATOM  13708  CD   LYS E 290     -59.914  30.549  44.849  1.00 31.09      A  C
ATOM  13709  CE   LYS E 290     -59.747  29.471  45.844  1.00 33.69      A  C
ATOM  13710  NZ   LYS E 290     -58.501  29.573  46.576  1.00 33.67      A  N
ATOM  13711  C    LYS E 290     -64.157  32.945  44.347  1.00 29.23      A  C
ATOM  13712  O    LYS E 290     -65.145  32.556  44.865  1.00 29.73      A  O
ATOM  13713  N    GLN E 291     -63.825  34.202  44.396  1.00 29.54      A  N
ATOM  13714  CA   GLN E 291     -64.680  35.094  45.101  1.00 30.99      A  C
ATOM  13715  CB   GLN E 291     -64.024  36.456  45.240  1.00 33.24      A  C
ATOM  13716  CG   GLN E 291     -64.948  37.562  45.637  1.00 38.76      A  C
ATOM  13717  CD   GLN E 291     -64.664  38.161  46.975  1.00 48.53      A  C
ATOM  13718  OE1  GLN E 291     -64.303  39.322  47.069  1.00 52.06      A  O
ATOM  13719  NE2  GLN E 291     -64.863  37.390  48.027  1.00 47.61      A  N
ATOM  13720  C    GLN E 291     -66.001  35.190  44.436  1.00 30.70      A  C
ATOM  13721  O    GLN E 291     -67.019  35.181  45.059  1.00 30.94      A  O
ATOM  13722  N    THR E 292     -65.961  35.299  43.139  1.00 31.08      A  N
ATOM  13723  CA   THR E 292     -67.139  35.441  42.343  1.00 30.60      A  C
ATOM  13724  CB   THR E 292     -66.691  35.671  40.929  1.00 30.37      A  C
ATOM  13725  OG1  THR E 292     -65.683  36.647  40.941  1.00 32.90      A  O
ATOM  13726  CG2  THR E 292     -67.746  36.173  40.133  1.00 30.26      A  C
ATOM  13727  C    THR E 292     -68.092  34.270  42.370  1.00 29.69      A  C
```

Appendix 1

```
ATOM  13728  O    THR E 292     -69.259  34.436  42.471  1.00  28.92      A   O
ATOM  13729  N    PHE E 293     -67.564  33.081  42.249  1.00  29.90      A   N
ATOM  13730  CA   PHE E 293     -68.342  31.916  41.969  1.00  29.25      A   C
ATOM  13731  CB   PHE E 293     -67.704  31.216  40.805  1.00  28.43      A   C
ATOM  13732  CG   PHE E 293     -67.941  31.864  39.527  1.00  26.39      A   C
ATOM  13733  CD1  PHE E 293     -69.177  32.267  39.182  1.00  28.71      A   C
ATOM  13734  CE1  PHE E 293     -69.390  32.827  38.014  1.00  29.14      A   C
ATOM  13735  CZ   PHE E 293     -68.389  33.003  37.182  1.00  24.20      A   C
ATOM  13736  CE2  PHE E 293     -67.166  32.627  37.518  1.00  23.79      A   C
ATOM  13737  CD2  PHE E 293     -66.941  32.063  38.667  1.00  20.17      A   C
ATOM  13738  C    PHE E 293     -68.449  30.904  43.056  1.00  31.56      A   C
ATOM  13739  O    PHE E 293     -69.384  30.175  43.092  1.00  32.69      A   O
ATOM  13740  N    VAL E 294     -67.462  30.809  43.913  1.00  31.34      A   N
ATOM  13741  CA   VAL E 294     -67.383  29.694  44.827  1.00  31.48      A   C
ATOM  13742  CB   VAL E 294     -65.913  29.322  45.073  1.00  31.21      A   C
ATOM  13743  CG1  VAL E 294     -65.778  28.208  45.978  1.00  25.36      A   C
ATOM  13744  CG2  VAL E 294     -65.235  29.026  43.847  1.00  30.26      A   C
ATOM  13745  C    VAL E 294     -68.034  29.990  46.168  1.00  32.36      A   C
ATOM  13746  O    VAL E 294     -67.731  30.977  46.773  1.00  32.89      A   O
ATOM  13747  N    GLU E 295     -68.910  29.116  46.633  1.00  32.22      A   N
ATOM  13748  CA   GLU E 295     -69.419  29.217  47.980  1.00  33.20      A   C
ATOM  13749  CB   GLU E 295     -70.935  29.291  48.009  1.00  33.62      A   C
ATOM  13750  CG   GLU E 295     -71.578  28.505  49.101  1.00  37.68      A   C
ATOM  13751  CD   GLU E 295     -73.026  28.209  48.847  1.00  44.36      A   C
ATOM  13752  OE1  GLU E 295     -73.555  28.592  47.810  1.00  47.89      A   O
ATOM  13753  OE2  GLU E 295     -73.653  27.573  49.683  1.00  46.36      A   O-1
ATOM  13754  C    GLU E 295     -68.925  28.097  48.868  1.00  33.83      A   C
ATOM  13755  O    GLU E 295     -69.102  26.951  48.593  1.00  33.53      A   O
ATOM  13756  N    VAL E 296     -68.314  28.467  49.976  1.00  34.36      A   N
ATOM  13757  CA   VAL E 296     -67.863  27.524  50.964  1.00  34.93      A   C
ATOM  13758  CB   VAL E 296     -66.706  28.084  51.645  1.00  34.60      A   C
ATOM  13759  CG1  VAL E 296     -66.205  27.181  52.622  1.00  31.75      A   C
ATOM  13760  CG2  VAL E 296     -65.689  28.380  50.660  1.00  34.63      A   C
ATOM  13761  C    VAL E 296     -68.976  27.315  51.923  1.00  36.66      A   C
ATOM  13762  O    VAL E 296     -69.575  28.238  52.323  1.00  36.67      A   O
ATOM  13763  N    TYR E 297     -69.335  26.086  52.215  1.00  39.65      A   N
ATOM  13764  CA   TYR E 297     -70.554  25.931  52.961  1.00  41.70      A   C
ATOM  13765  CB   TYR E 297     -71.708  25.734  52.034  1.00  41.80      A   C
ATOM  13766  CG   TYR E 297     -71.873  24.365  51.493  1.00  43.49      A   C
ATOM  13767  CD1  TYR E 297     -72.678  23.462  52.106  1.00  44.09      A   C
ATOM  13768  CE1  TYR E 297     -72.861  22.246  51.588  1.00  43.53      A   C
ATOM  13769  CZ   TYR E 297     -72.248  21.921  50.441  1.00  45.15      A   C
ATOM  13770  OH   TYR E 297     -72.412  20.701  49.897  1.00  44.86      A   O
ATOM  13771  CE2  TYR E 297     -71.461  22.798  49.816  1.00  44.46      A   C
ATOM  13772  CD2  TYR E 297     -71.277  24.003  50.335  1.00  45.05      A   C
ATOM  13773  C    TYR E 297     -70.809  25.056  54.147  1.00  43.32      A   C
ATOM  13774  O    TYR E 297     -71.912  25.077  54.635  1.00  45.51      A   O
ATOM  13775  N    ASP E 298     -69.911  24.243  54.627  1.00  42.88      A   N
ATOM  13776  CA   ASP E 298     -70.388  23.481  55.774  1.00  43.64      A   C
ATOM  13777  CB   ASP E 298     -70.839  22.082  55.385  1.00  43.10      A   C
ATOM  13778  CG   ASP E 298     -70.830  21.138  56.515  1.00  48.55      A   C
ATOM  13779  OD1  ASP E 298     -71.354  21.468  57.571  1.00  50.17      A   O
ATOM  13780  OD2  ASP E 298     -70.323  20.032  56.344  1.00  52.22      A   O
ATOM  13781  C    ASP E 298     -69.400  23.525  56.883  1.00  42.78      A   C
```

Appendix 1

```
ATOM  13782  O    ASP E 298     -68.695  22.605  57.128  1.00 40.22      A  O
ATOM  13783  N    GLU E 299     -69.356  24.688  57.491  1.00 43.37      A  N
ATOM  13784  CA   GLU E 299     -68.388  25.062  58.481  1.00 44.00      A  C
ATOM  13785  CB   GLU E 299     -68.500  24.225  59.745  1.00 44.52      A  C
ATOM  13786  CG   GLU E 299     -69.785  24.405  60.471  1.00 48.86      A  C
ATOM  13787  CD   GLU E 299     -69.788  23.746  61.807  1.00 55.97      A  C
ATOM  13788  OE1  GLU E 299     -70.408  22.689  61.960  1.00 56.31      A  O
ATOM  13789  OE2  GLU E 299     -69.171  24.286  62.720  1.00 55.90      A  O
ATOM  13790  C    GLU E 299     -67.048  24.943  57.877  1.00 41.84      A  C
ATOM  13791  O    GLU E 299     -66.100  24.621  58.544  1.00 42.49      A  O
ATOM  13792  N    GLY E 300     -67.005  25.203  56.591  1.00 41.04      A  N
ATOM  13793  CA   GLY E 300     -65.802  25.203  55.799  1.00 39.24      A  C
ATOM  13794  C    GLY E 300     -65.389  23.881  55.257  1.00 38.72      A  C
ATOM  13795  O    GLY E 300     -64.369  23.760  54.643  1.00 38.41      A  O
ATOM  13796  N    ARG E 301     -66.175  22.870  55.524  1.00 38.10      A  N
ATOM  13797  CA   ARG E 301     -65.939  21.559  54.958  1.00 38.93      A  C
ATOM  13798  CB   ARG E 301     -66.576  20.486  55.815  1.00 37.93      A  C
ATOM  13799  CG   ARG E 301     -65.954  20.441  57.180  1.00 40.14      A  C
ATOM  13800  CD   ARG E 301     -66.546  19.433  58.084  1.00 37.71      A  C
ATOM  13801  NE   ARG E 301     -67.941  19.681  58.363  1.00 39.63      A  N
ATOM  13802  CZ   ARG E 301     -68.408  20.289  59.438  1.00 38.99      A  C
ATOM  13803  NH1  ARG E 301     -67.597  20.765  60.349  1.00 33.12      A  N
ATOM  13804  NH2  ARG E 301     -69.697  20.439  59.575  1.00 33.89      A  N
ATOM  13805  C    ARG E 301     -66.150  21.377  53.443  1.00 38.69      A  C
ATOM  13806  O    ARG E 301     -65.400  20.693  52.803  1.00 38.42      A  O
ATOM  13807  N    LYS E 302     -67.166  22.025  52.906  1.00 36.81      A  N
ATOM  13808  CA   LYS E 302     -67.552  21.871  51.528  1.00 36.20      A  C
ATOM  13809  CB   LYS E 302     -68.863  21.129  51.469  1.00 35.35      A  C
ATOM  13810  CG   LYS E 302     -68.867  19.915  52.289  1.00 37.67      A  C
ATOM  13811  CD   LYS E 302     -70.166  19.244  52.216  1.00 39.08      A  C
ATOM  13812  CE   LYS E 302     -70.186  18.019  53.028  1.00 40.75      A  C
ATOM  13813  NZ   LYS E 302     -71.544  17.556  53.185  1.00 41.18      A  N
ATOM  13814  C    LYS E 302     -67.644  23.156  50.723  1.00 35.32      A  C
ATOM  13815  O    LYS E 302     -67.787  24.213  51.253  1.00 35.53      A  O
ATOM  13816  N    ALA E 303     -67.538  23.019  49.424  1.00 34.41      A  N
ATOM  13817  CA   ALA E 303     -67.706  24.094  48.508  1.00 33.66      A  C
ATOM  13818  CB   ALA E 303     -66.407  24.530  48.057  1.00 34.17      A  C
ATOM  13819  C    ALA E 303     -68.575  23.662  47.348  1.00 33.14      A  C
ATOM  13820  O    ALA E 303     -68.530  22.552  46.930  1.00 33.11      A  O
ATOM  13821  N    ARG E 304     -69.352  24.603  46.844  1.00 32.53      A  N
ATOM  13822  CA   ARG E 304     -70.265  24.485  45.723  1.00 31.61      A  C
ATOM  13823  CB   ARG E 304     -71.635  24.870  46.190  1.00 31.07      A  C
ATOM  13824  CG   ARG E 304     -72.500  23.824  46.605  1.00 33.59      A  C
ATOM  13825  CD   ARG E 304     -73.886  24.349  46.679  1.00 34.80      A  C
ATOM  13826  NE   ARG E 304     -74.194  25.014  47.919  1.00 38.48      A  N
ATOM  13827  CZ   ARG E 304     -74.894  24.465  48.892  1.00 44.51      A  C
ATOM  13828  NH1  ARG E 304     -75.361  23.245  48.768  1.00 44.65      A  N
ATOM  13829  NH2  ARG E 304     -75.137  25.139  49.985  1.00 43.08      A  N
ATOM  13830  C    ARG E 304     -69.932  25.580  44.749  1.00 30.65      A  C
ATOM  13831  O    ARG E 304     -69.660  26.660  45.157  1.00 28.87      A  O
ATOM  13832  N    VAL E 305     -70.005  25.330  43.457  1.00 29.65      A  N
ATOM  13833  CA   VAL E 305     -69.773  26.405  42.503  1.00 29.61      A  C
ATOM  13834  CB   VAL E 305     -68.626  26.063  41.573  1.00 30.14      A  C
ATOM  13835  CG1  VAL E 305     -68.120  27.269  40.906  1.00 26.15      A  C
```

Appendix 1

```
ATOM  13836  CG2 VAL E 305     -67.545  25.465  42.337  1.00 27.89      A   C
ATOM  13837  C   VAL E 305     -70.970  26.902  41.698  1.00 29.09      A   C
ATOM  13838  O   VAL E 305     -71.583  26.164  40.991  1.00 29.25      A   O
ATOM  13839  N   ARG E 306     -71.285  28.176  41.820  1.00 28.53      A   N
ATOM  13840  CA  ARG E 306     -72.294  28.822  41.004  1.00 28.69      A   C
ATOM  13841  CB  ARG E 306     -72.532  30.248  41.488  1.00 28.10      A   C
ATOM  13842  CG  ARG E 306     -73.052  30.392  42.859  1.00 29.10      A   C
ATOM  13843  CD  ARG E 306     -73.320  31.818  43.246  1.00 27.22      A   C
ATOM  13844  NE  ARG E 306     -72.126  32.537  43.568  1.00 30.90      A   N
ATOM  13845  CZ  ARG E 306     -71.542  32.488  44.743  1.00 32.70      A   C
ATOM  13846  NH1 ARG E 306     -72.067  31.776  45.688  1.00 31.12      A   N
ATOM  13847  NH2 ARG E 306     -70.440  33.136  44.971  1.00 29.12      A   N
ATOM  13848  C   ARG E 306     -71.839  28.925  39.579  1.00 28.66      A   C
ATOM  13849  O   ARG E 306     -70.738  29.297  39.348  1.00 28.43      A   O
ATOM  13850  N   GLU E 307     -72.683  28.586  38.621  1.00 27.57      A   N
ATOM  13851  CA  GLU E 307     -72.366  28.787  37.216  1.00 27.00      A   C
ATOM  13852  CB  GLU E 307     -73.274  28.005  36.293  1.00 26.34      A   C
ATOM  13853  CG  GLU E 307     -73.164  28.386  34.842  1.00 29.20      A   C
ATOM  13854  CD  GLU E 307     -71.892  27.943  34.135  1.00 31.93      A   C
ATOM  13855  OE1 GLU E 307     -71.044  27.326  34.707  1.00 25.99      A   O
ATOM  13856  OE2 GLU E 307     -71.713  28.267  32.983  1.00 36.05      A   O
ATOM  13857  C   GLU E 307     -72.256  30.222  36.758  1.00 26.79      A   C
ATOM  13858  O   GLU E 307     -71.481  30.532  35.930  1.00 26.68      A   O
ATOM  13859  N   THR E 308     -73.057  31.092  37.313  1.00 26.67      A   N
ATOM  13860  CA  THR E 308     -73.242  32.418  36.784  1.00 28.32      A   C
ATOM  13861  CB  THR E 308     -74.355  32.465  35.696  1.00 28.19      A   C
ATOM  13862  OG1 THR E 308     -74.155  33.577  34.833  1.00 30.05      A   O
ATOM  13863  CG2 THR E 308     -75.691  32.527  36.284  1.00 23.96      A   C
ATOM  13864  C   THR E 308     -73.459  33.437  37.856  1.00 30.29      A   C
ATOM  13865  O   THR E 308     -73.542  33.110  38.999  1.00 31.52      A   O
ATOM  13866  N   ALA E 309     -73.488  34.683  37.440  1.00 33.03      A   N
ATOM  13867  CA  ALA E 309     -73.596  35.882  38.274  1.00 35.69      A   C
ATOM  13868  CB  ALA E 309     -73.206  37.056  37.515  1.00 34.26      A   C
ATOM  13869  C   ALA E 309     -74.825  36.219  39.070  1.00 37.88      A   C
ATOM  13870  O   ALA E 309     -74.733  36.777  40.132  1.00 40.07      A   O
ATOM  13871  N   GLY E 310     -75.994  35.983  38.546  1.00 38.98      A   N
ATOM  13872  CA  GLY E 310     -77.148  36.621  39.133  1.00 40.87      A   C
ATOM  13873  C   GLY E 310     -77.971  35.775  40.048  1.00 41.15      A   C
ATOM  13874  O   GLY E 310     -79.140  35.972  40.177  1.00 40.96      A   O
ATOM  13875  N   THR E 311     -77.344  34.803  40.657  1.00 41.16      A   N
ATOM  13876  CA  THR E 311     -78.059  33.719  41.234  1.00 41.53      A   C
ATOM  13877  CB  THR E 311     -78.141  32.587  40.220  1.00 41.29      A   C
ATOM  13878  OG1 THR E 311     -78.905  31.522  40.747  1.00 41.63      A   O
ATOM  13879  CG2 THR E 311     -76.801  32.080  39.878  1.00 40.71      A   C
ATOM  13880  C   THR E 311     -77.352  33.246  42.454  1.00 42.06      A   C
ATOM  13881  O   THR E 311     -76.192  33.473  42.596  1.00 39.93      A   O
ATOM  13882  N   ASP E 312     -78.067  32.575  43.333  1.00 43.48      A   N
ATOM  13883  CA  ASP E 312     -77.441  31.922  44.459  1.00 44.92      A   C
ATOM  13884  CB  ASP E 312     -78.223  32.144  45.750  1.00 45.49      A   C
ATOM  13885  CG  ASP E 312     -78.392  33.576  46.095  1.00 48.50      A   C
ATOM  13886  OD1 ASP E 312     -77.439  34.205  46.538  1.00 46.94      A   O
ATOM  13887  OD2 ASP E 312     -79.506  34.066  45.953  1.00 50.65      A   O-1
ATOM  13888  C   ASP E 312     -77.294  30.449  44.253  1.00 44.11      A   C
ATOM  13889  O   ASP E 312     -76.813  29.789  45.108  1.00 44.46      A   O
```

Appendix 1

```
ATOM  13890  N    ASP E 313   -77.673  29.941  43.101  1.00  44.17    A  N
ATOM  13891  CA   ASP E 313   -77.704  28.507  42.814  1.00  43.97    A  C
ATOM  13892  CB   ASP E 313   -78.879  28.221  41.902  1.00  43.92    A  C
ATOM  13893  CG   ASP E 313   -80.152  28.788  42.437  1.00  46.53    A  C
ATOM  13894  OD1  ASP E 313   -80.364  28.692  43.643  1.00  52.41    A  O
ATOM  13895  OD2  ASP E 313   -80.944  29.345  41.681  1.00  44.37    A  O-1
ATOM  13896  C    ASP E 313   -76.412  27.918  42.261  1.00  43.52    A  C
ATOM  13897  O    ASP E 313   -75.808  28.498  41.433  1.00  42.66    A  O
ATOM  13898  N    ALA E 314   -76.000  26.770  42.778  1.00  43.74    A  N
ATOM  13899  CA   ALA E 314   -74.666  26.213  42.606  1.00  43.81    A  C
ATOM  13900  CB   ALA E 314   -74.452  25.227  43.626  1.00  43.63    A  C
ATOM  13901  C    ALA E 314   -74.093  25.673  41.303  1.00  45.02    A  C
ATOM  13902  O    ALA E 314   -72.922  25.958  40.971  1.00  47.47    A  O
ATOM  13903  N    ASP E 315   -74.846  24.819  40.630  1.00  42.21    A  N
ATOM  13904  CA   ASP E 315   -74.366  24.219  39.395  1.00  39.79    A  C
ATOM  13905  CB   ASP E 315   -73.956  22.763  39.587  1.00  39.62    A  C
ATOM  13906  CG   ASP E 315   -72.571  22.608  40.068  1.00  40.12    A  C
ATOM  13907  OD1  ASP E 315   -71.675  22.608  39.271  1.00  40.35    A  O
ATOM  13908  OD2  ASP E 315   -72.357  22.449  41.249  1.00  41.68    A  O
ATOM  13909  C    ASP E 315   -75.407  24.282  38.315  1.00  37.49    A  C
ATOM  13910  O    ASP E 315   -75.934  23.293  37.901  1.00  35.49    A  O
ATOM  13911  N    GLY E 316   -75.663  25.479  37.841  1.00  35.34    A  N
ATOM  13912  CA   GLY E 316   -76.586  25.748  36.775  1.00  33.26    A  C
ATOM  13913  C    GLY E 316   -75.950  25.520  35.444  1.00  32.99    A  C
ATOM  13914  O    GLY E 316   -74.840  25.071  35.365  1.00  32.97    A  O
ATOM  13915  N    GLY E 317   -76.667  25.838  34.389  1.00  32.54    A  N
ATOM  13916  CA   GLY E 317   -76.216  25.599  33.042  1.00  30.02    A  C
ATOM  13917  C    GLY E 317   -75.975  24.161  32.697  1.00  29.35    A  C
ATOM  13918  O    GLY E 317   -76.801  23.342  32.885  1.00  25.64    A  O
ATOM  13919  N    VAL E 318   -74.793  23.881  32.204  1.00  28.56    A  N
ATOM  13920  CA   VAL E 318   -74.405  22.557  31.843  1.00  28.89    A  C
ATOM  13921  CB   VAL E 318   -73.227  22.553  30.899  1.00  29.77    A  C
ATOM  13922  CG1  VAL E 318   -73.617  23.141  29.596  1.00  28.68    A  C
ATOM  13923  CG2  VAL E 318   -72.089  23.284  31.456  1.00  31.35    A  C
ATOM  13924  C    VAL E 318   -74.155  21.726  33.070  1.00  28.69    A  C
ATOM  13925  O    VAL E 318   -73.971  20.556  32.992  1.00  28.60    A  O
ATOM  13926  N    GLY E 319   -74.219  22.364  34.213  1.00  28.10    A  N
ATOM  13927  CA   GLY E 319   -74.032  21.729  35.487  1.00  26.11    A  C
ATOM  13928  C    GLY E 319   -72.643  21.310  35.825  1.00  26.11    A  C
ATOM  13929  O    GLY E 319   -72.465  20.426  36.583  1.00  27.10    A  O
ATOM  13930  N    LEU E 320   -71.661  21.925  35.222  1.00  23.72    A  N
ATOM  13931  CA   LEU E 320   -70.323  21.488  35.396  1.00  23.81    A  C
ATOM  13932  CB   LEU E 320   -69.744  21.082  34.059  1.00  23.95    A  C
ATOM  13933  CG   LEU E 320   -70.311  19.897  33.306  1.00  25.18    A  C
ATOM  13934  CD1  LEU E 320   -69.570  19.643  32.098  1.00  27.10    A  C
ATOM  13935  CD2  LEU E 320   -70.341  18.690  34.092  1.00  27.91    A  C
ATOM  13936  C    LEU E 320   -69.357  22.363  36.176  1.00  24.33    A  C
ATOM  13937  O    LEU E 320   -68.229  22.048  36.249  1.00  23.48    A  O
ATOM  13938  N    ALA E 321   -69.814  23.438  36.770  1.00  24.97    A  N
ATOM  13939  CA   ALA E 321   -68.936  24.364  37.425  1.00  26.04    A  C
ATOM  13940  CB   ALA E 321   -69.685  25.563  37.813  1.00  25.50    A  C
ATOM  13941  C    ALA E 321   -68.167  23.825  38.596  1.00  27.08    A  C
ATOM  13942  O    ALA E 321   -67.016  24.105  38.707  1.00  27.57    A  O
ATOM  13943  N    SER E 322   -68.795  23.070  39.468  1.00  26.85    A  N
```

Appendix 1

```
ATOM  13944  CA   SER E 322     -68.083  22.469  40.564  1.00  26.90      A    C
ATOM  13945  CB   SER E 322     -69.033  21.770  41.530  1.00  27.16      A    C
ATOM  13946  OG   SER E 322     -70.063  22.600  41.945  1.00  25.90      A    O
ATOM  13947  C    SER E 322     -67.028  21.485  40.132  1.00  27.93      A    C
ATOM  13948  O    SER E 322     -65.961  21.462  40.651  1.00  29.48      A    O
ATOM  13949  N    ALA E 323     -67.350  20.645  39.185  1.00  27.87      A    N
ATOM  13950  CA   ALA E 323     -66.423  19.688  38.638  1.00  27.59      A    C
ATOM  13951  CB   ALA E 323     -67.132  18.790  37.763  1.00  26.94      A    C
ATOM  13952  C    ALA E 323     -65.241  20.250  37.903  1.00  28.65      A    C
ATOM  13953  O    ALA E 323     -64.161  19.787  38.052  1.00  29.50      A    O
ATOM  13954  N    PHE E 324     -65.450  21.228  37.056  1.00  28.41      A    N
ATOM  13955  CA   PHE E 324     -64.339  21.881  36.406  1.00  28.05      A    C
ATOM  13956  CB   PHE E 324     -64.798  22.754  35.253  1.00  28.29      A    C
ATOM  13957  CG   PHE E 324     -64.912  22.023  33.990  1.00  27.62      A    C
ATOM  13958  CD1  PHE E 324     -63.814  21.593  33.351  1.00  27.99      A    C
ATOM  13959  CE1  PHE E 324     -63.909  20.909  32.230  1.00  29.86      A    C
ATOM  13960  CZ   PHE E 324     -65.093  20.635  31.734  1.00  33.52      A    C
ATOM  13961  CE2  PHE E 324     -66.198  21.035  32.352  1.00  31.67      A    C
ATOM  13962  CD2  PHE E 324     -66.113  21.724  33.470  1.00  31.10      A    C
ATOM  13963  C    PHE E 324     -63.469  22.628  37.375  1.00  28.79      A    C
ATOM  13964  O    PHE E 324     -62.288  22.655  37.231  1.00  27.91      A    O
ATOM  13965  N    THR E 325     -64.105  23.227  38.366  1.00  28.29      A    N
ATOM  13966  CA   THR E 325     -63.463  23.936  39.438  1.00  27.62      A    C
ATOM  13967  CB   THR E 325     -64.481  24.640  40.278  1.00  27.95      A    C
ATOM  13968  OG1  THR E 325     -65.392  25.270  39.413  1.00  27.97      A    O
ATOM  13969  CG2  THR E 325     -63.879  25.656  41.067  1.00  28.42      A    C
ATOM  13970  C    THR E 325     -62.602  23.013  40.262  1.00  27.18      A    C
ATOM  13971  O    THR E 325     -61.568  23.376  40.728  1.00  27.60      A    O
ATOM  13972  N    LEU E 326     -63.042  21.796  40.427  1.00  26.44      A    N
ATOM  13973  CA   LEU E 326     -62.227  20.783  41.025  1.00  24.94      A    C
ATOM  13974  CB   LEU E 326     -63.038  19.529  41.199  1.00  24.75      A    C
ATOM  13975  CG   LEU E 326     -62.325  18.388  41.873  1.00  26.66      A    C
ATOM  13976  CD1  LEU E 326     -62.363  18.452  43.325  1.00  23.76      A    C
ATOM  13977  CD2  LEU E 326     -62.876  17.157  41.423  1.00  23.76      A    C
ATOM  13978  C    LEU E 326     -60.942  20.449  40.281  1.00  24.69      A    C
ATOM  13979  O    LEU E 326     -59.981  20.169  40.911  1.00  24.66      A    O
ATOM  13980  N    LEU E 327     -60.949  20.431  38.954  1.00  24.79      A    N
ATOM  13981  CA   LEU E 327     -59.741  20.294  38.171  1.00  23.85      A    C
ATOM  13982  CB   LEU E 327     -60.063  20.024  36.721  1.00  23.94      A    C
ATOM  13983  CG   LEU E 327     -59.081  20.282  35.600  1.00  23.33      A    C
ATOM  13984  CD1  LEU E 327     -57.936  19.426  35.623  1.00  16.57      A    C
ATOM  13985  CD2  LEU E 327     -59.773  20.121  34.364  1.00  22.44      A    C
ATOM  13986  C    LEU E 327     -58.815  21.472  38.305  1.00  24.23      A    C
ATOM  13987  O    LEU E 327     -57.637  21.336  38.403  1.00  23.80      A    O
ATOM  13988  N    LEU E 328     -59.389  22.641  38.302  1.00  23.66      A    N
ATOM  13989  CA   LEU E 328     -58.655  23.843  38.452  1.00  23.67      A    C
ATOM  13990  CB   LEU E 328     -59.569  25.013  38.158  1.00  22.39      A    C
ATOM  13991  CG   LEU E 328     -59.065  26.418  38.332  1.00  20.94      A    C
ATOM  13992  CD1  LEU E 328     -58.100  26.784  37.346  1.00  13.06      A    C
ATOM  13993  CD2  LEU E 328     -60.130  27.367  38.403  1.00  18.45      A    C
ATOM  13994  C    LEU E 328     -57.970  23.948  39.800  1.00  24.53      A    C
ATOM  13995  O    LEU E 328     -56.866  24.372  39.879  1.00  25.28      A    O
ATOM  13996  N    ALA E 329     -58.617  23.525  40.857  1.00  24.46      A    N
ATOM  13997  CA   ALA E 329     -57.998  23.551  42.152  1.00  25.07      A    C
```

Appendix 1

```
ATOM  13998  CB   ALA E 329     -58.974  23.186  43.206  1.00 24.40      A  C
ATOM  13999  C    ALA E 329     -56.808  22.650  42.174  1.00 25.26      A  C
ATOM  14000  O    ALA E 329     -55.802  22.972  42.713  1.00 25.50      A  O
ATOM  14001  N    ARG E 330     -56.935  21.520  41.541  1.00 24.74      A  N
ATOM  14002  CA   ARG E 330     -55.845  20.616  41.382  1.00 26.28      A  C
ATOM  14003  CB   ARG E 330     -56.361  19.369  40.704  1.00 26.24      A  C
ATOM  14004  CG   ARG E 330     -55.414  18.248  40.659  1.00 28.99      A  C
ATOM  14005  CD   ARG E 330     -55.261  17.583  41.995  1.00 26.77      A  C
ATOM  14006  NE   ARG E 330     -54.761  16.242  41.846  1.00 25.80      A  N
ATOM  14007  CZ   ARG E 330     -53.520  15.895  42.041  1.00 25.61      A  C
ATOM  14008  NH1  ARG E 330     -52.654  16.774  42.414  1.00 26.48      A  N
ATOM  14009  NH2  ARG E 330     -53.149  14.681  41.858  1.00 26.06      A  N
ATOM  14010  C    ARG E 330     -54.674  21.173  40.592  1.00 26.86      A  C
ATOM  14011  O    ARG E 330     -53.542  21.000  40.954  1.00 26.05      A  O
ATOM  14012  N    GLU E 331     -54.976  21.827  39.494  1.00 27.38      A  N
ATOM  14013  CA   GLU E 331     -54.007  22.482  38.674  1.00 27.69      A  C
ATOM  14014  CB   GLU E 331     -54.688  22.956  37.409  1.00 27.22      A  C
ATOM  14015  CG   GLU E 331     -53.827  23.734  36.485  1.00 29.29      A  C
ATOM  14016  CD   GLU E 331     -52.812  22.940  35.782  1.00 30.73      A  C
ATOM  14017  OE1  GLU E 331     -53.073  21.799  35.497  1.00 30.38      A  O
ATOM  14018  OE2  GLU E 331     -51.757  23.465  35.487  1.00 29.01      A  O-1
ATOM  14019  C    GLU E 331     -53.327  23.625  39.389  1.00 28.39      A  C
ATOM  14020  O    GLU E 331     -52.158  23.813  39.294  1.00 29.41      A  O
ATOM  14021  N    MET E 332     -54.085  24.367  40.151  1.00 28.34      A  N
ATOM  14022  CA   MET E 332     -53.540  25.452  40.907  1.00 29.66      A  C
ATOM  14023  CB   MET E 332     -54.601  26.456  41.227  1.00 30.27      E  C
ATOM  14024  CG   MET E 332     -55.247  27.027  40.080  1.00 32.49      E  C
ATOM  14025  SD   MET E 332     -54.227  28.155  39.275  1.00 39.06      E  S
ATOM  14026  CE   MET E 332     -54.525  27.585  37.697  1.00 35.79      E  C
ATOM  14027  C    MET E 332     -52.895  25.068  42.195  1.00 30.76      A  C
ATOM  14028  O    MET E 332     -52.265  25.863  42.813  1.00 31.79      A  O
ATOM  14029  N    GLY E 333     -53.058  23.842  42.604  1.00 30.90      A  N
ATOM  14030  CA   GLY E 333     -52.457  23.391  43.815  1.00 30.74      A  C
ATOM  14031  C    GLY E 333     -53.204  23.690  45.071  1.00 30.81      A  C
ATOM  14032  O    GLY E 333     -52.675  23.571  46.115  1.00 31.77      A  O
ATOM  14033  N    ASP E 334     -54.448  24.066  44.959  1.00 30.58      A  N
ATOM  14034  CA   ASP E 334     -55.257  24.422  46.090  1.00 29.77      A  C
ATOM  14035  CB   ASP E 334     -56.360  25.310  45.596  1.00 29.47      A  C
ATOM  14036  CG   ASP E 334     -57.036  26.018  46.652  1.00 31.42      A  C
ATOM  14037  OD1  ASP E 334     -56.827  25.732  47.802  1.00 32.22      A  O
ATOM  14038  OD2  ASP E 334     -57.798  26.894  46.332  1.00 33.43      A  O-1
ATOM  14039  C    ASP E 334     -55.879  23.216  46.725  1.00 29.76      A  C
ATOM  14040  O    ASP E 334     -56.970  22.853  46.428  1.00 30.05      A  O
ATOM  14041  N    GLN E 335     -55.160  22.610  47.640  1.00 28.88      A  N
ATOM  14042  CA   GLN E 335     -55.614  21.424  48.290  1.00 30.90      A  C
ATOM  14043  CB   GLN E 335     -54.547  20.888  49.204  1.00 31.32      A  C
ATOM  14044  CG   GLN E 335     -53.333  20.379  48.530  1.00 36.08      A  C
ATOM  14045  CD   GLN E 335     -52.530  19.501  49.408  1.00 38.92      A  C
ATOM  14046  OE1  GLN E 335     -51.351  19.379  49.260  1.00 40.50      A  O
ATOM  14047  NE2  GLN E 335     -53.175  18.883  50.330  1.00 37.90      A  N
ATOM  14048  C    GLN E 335     -56.873  21.659  49.077  1.00 31.95      A  C
ATOM  14049  O    GLN E 335     -57.737  20.842  49.101  1.00 30.87      A  O
ATOM  14050  N    GLN E 336     -56.975  22.779  49.745  1.00 33.02      A  N
ATOM  14051  CA   GLN E 336     -58.148  23.065  50.537  1.00 34.33      A  C
```

Appendix 1

```
ATOM  14052  CB   GLN E 336     -57.875  24.339  51.302  1.00  33.61     A    C
ATOM  14053  CG   GLN E 336     -58.878  24.713  52.285  1.00  40.07     A    C
ATOM  14054  CD   GLN E 336     -58.837  26.160  52.579  1.00  45.07     A    C
ATOM  14055  OE1  GLN E 336     -59.232  26.963  51.769  1.00  49.12     A    O
ATOM  14056  NE2  GLN E 336     -58.351  26.511  53.743  1.00  42.13     A    N
ATOM  14057  C    GLN E 336     -59.445  23.188  49.753  1.00  33.80     A    C
ATOM  14058  O    GLN E 336     -60.410  22.571  50.080  1.00  34.47     A    O
ATOM  14059  N    LEU E 337     -59.456  23.950  48.684  1.00  32.27     A    N
ATOM  14060  CA   LEU E 337     -60.610  23.984  47.815  1.00  31.38     A    C
ATOM  14061  CB   LEU E 337     -60.473  25.077  46.795  1.00  30.95     A    C
ATOM  14062  CG   LEU E 337     -61.661  25.120  45.878  1.00  31.56     A    C
ATOM  14063  CD1  LEU E 337     -62.927  25.465  46.602  1.00  26.44     A    C
ATOM  14064  CD2  LEU E 337     -61.372  26.090  44.831  1.00  30.84     A    C
ATOM  14065  C    LEU E 337     -60.933  22.648  47.140  1.00  31.06     A    C
ATOM  14066  O    LEU E 337     -62.058  22.298  46.991  1.00  30.24     A    O
ATOM  14067  N    PHE E 338     -59.919  21.908  46.754  1.00  29.11     A    N
ATOM  14068  CA   PHE E 338     -60.102  20.637  46.148  1.00  28.22     A    C
ATOM  14069  CB   PHE E 338     -58.741  20.111  45.727  1.00  28.36     A    C
ATOM  14070  CG   PHE E 338     -58.744  18.715  45.215  1.00  28.63     A    C
ATOM  14071  CD1  PHE E 338     -58.504  18.440  43.898  1.00  26.56     A    C
ATOM  14072  CE1  PHE E 338     -58.485  17.171  43.463  1.00  27.45     A    C
ATOM  14073  CZ   PHE E 338     -58.706  16.147  44.321  1.00  25.41     A    C
ATOM  14074  CE2  PHE E 338     -58.930  16.399  45.620  1.00  25.60     A    C
ATOM  14075  CD2  PHE E 338     -58.935  17.663  46.064  1.00  25.43     A    C
ATOM  14076  C    PHE E 338     -60.797  19.685  47.080  1.00  27.93     A    C
ATOM  14077  O    PHE E 338     -61.663  18.983  46.687  1.00  29.13     A    O
ATOM  14078  N    ASP E 339     -60.410  19.682  48.330  1.00  28.45     A    N
ATOM  14079  CA   ASP E 339     -61.062  18.912  49.339  1.00  27.60     A    C
ATOM  14080  CB   ASP E 339     -60.266  18.977  50.616  1.00  28.76     A    C
ATOM  14081  CG   ASP E 339     -60.688  17.952  51.611  1.00  34.64     A    C
ATOM  14082  OD1  ASP E 339     -60.374  16.781  51.432  1.00  32.91     A    O
ATOM  14083  OD2  ASP E 339     -61.326  18.330  52.592  1.00  39.18     A    O-1
ATOM  14084  C    ASP E 339     -62.463  19.332  49.605  1.00  26.74     A    C
ATOM  14085  O    ASP E 339     -63.291  18.520  49.777  1.00  27.20     A    O
ATOM  14086  N    GLN E 340     -62.726  20.613  49.661  1.00  24.86     A    N
ATOM  14087  CA   GLN E 340     -64.081  21.059  49.873  1.00  25.22     A    C
ATOM  14088  CB   GLN E 340     -64.143  22.561  50.058  1.00  23.82     A    C
ATOM  14089  CG   GLN E 340     -63.210  23.032  51.068  1.00  24.65     A    C
ATOM  14090  CD   GLN E 340     -63.178  24.499  51.233  1.00  30.38     A    C
ATOM  14091  OE1  GLN E 340     -62.811  25.207  50.346  1.00  33.80     A    O
ATOM  14092  NE2  GLN E 340     -63.513  24.961  52.396  1.00  22.72     A    N
ATOM  14093  C    GLN E 340     -64.988  20.650  48.754  1.00  25.65     A    C
ATOM  14094  O    GLN E 340     -66.064  20.216  48.995  1.00  24.71     A    O
ATOM  14095  N    LEU E 341     -64.533  20.784  47.523  1.00  25.30     A    N
ATOM  14096  CA   LEU E 341     -65.293  20.376  46.350  1.00  25.42     A    C
ATOM  14097  CB   LEU E 341     -64.542  20.852  45.112  1.00  25.02     A    C
ATOM  14098  CG   LEU E 341     -64.899  22.088  44.314  1.00  23.12     A    C
ATOM  14099  CD1  LEU E 341     -65.844  22.928  44.965  1.00  14.24     A    C
ATOM  14100  CD2  LEU E 341     -63.715  22.817  44.033  1.00  22.61     A    C
ATOM  14101  C    LEU E 341     -65.586  18.884  46.200  1.00  25.47     A    C
ATOM  14102  O    LEU E 341     -66.670  18.494  45.908  1.00  22.99     A    O
ATOM  14103  N    LEU E 342     -64.591  18.063  46.428  1.00  26.64     A    N
ATOM  14104  CA   LEU E 342     -64.736  16.635  46.450  1.00  27.35     A    C
ATOM  14105  CB   LEU E 342     -63.391  15.970  46.565  1.00  26.84     A    C
```

Appendix 1

```
ATOM  14106  CG   LEU E 342     -63.308  14.526  46.139  1.00 26.84      A  C
ATOM  14107  CD1  LEU E 342     -64.060  14.237  44.920  1.00 27.86      A  C
ATOM  14108  CD2  LEU E 342     -61.926  14.151  45.984  1.00 21.35      A  C
ATOM  14109  C    LEU E 342     -65.652  16.194  47.547  1.00 27.61      A  C
ATOM  14110  O    LEU E 342     -66.338  15.241  47.420  1.00 28.73      A  O
ATOM  14111  N    ASN E 343     -65.634  16.897  48.646  1.00 28.37      A  N
ATOM  14112  CA   ASN E 343     -66.536  16.617  49.726  1.00 28.88      A  C
ATOM  14113  CB   ASN E 343     -66.124  17.369  50.955  1.00 28.22      A  C
ATOM  14114  CG   ASN E 343     -64.961  16.762  51.607  1.00 28.05      A  C
ATOM  14115  OD1  ASN E 343     -64.677  15.626  51.412  1.00 29.11      A  O
ATOM  14116  ND2  ASN E 343     -64.276  17.517  52.381  1.00 22.87      A  N
ATOM  14117  C    ASN E 343     -67.988  16.829  49.419  1.00 29.25      A  C
ATOM  14118  O    ASN E 343     -68.812  16.107  49.876  1.00 30.86      A  O
ATOM  14119  N    HIS E 344     -68.275  17.880  48.693  1.00 29.21      A  N
ATOM  14120  CA   HIS E 344     -69.540  18.096  48.040  1.00 29.22      A  C
ATOM  14121  CB   HIS E 344     -69.531  19.527  47.540  1.00 28.84      A  C
ATOM  14122  CG   HIS E 344     -70.713  19.903  46.722  1.00 30.21      A  C
ATOM  14123  ND1  HIS E 344     -71.957  20.071  47.262  1.00 32.39      A  N
ATOM  14124  CE1  HIS E 344     -72.803  20.403  46.318  1.00 30.53      A  C
ATOM  14125  NE2  HIS E 344     -72.149  20.460  45.183  1.00 34.00      A  N
ATOM  14126  CD2  HIS E 344     -70.841  20.147  45.407  1.00 29.65      A  C
ATOM  14127  C    HIS E 344     -69.920  17.154  46.888  1.00 29.90      A  C
ATOM  14128  O    HIS E 344     -71.019  16.724  46.806  1.00 30.39      A  O
ATOM  14129  N    LEU E 345     -69.023  16.916  45.950  1.00 29.61      A  N
ATOM  14130  CA   LEU E 345     -69.302  16.041  44.840  1.00 28.04      A  C
ATOM  14131  CB   LEU E 345     -68.280  16.301  43.760  1.00 27.35      A  C
ATOM  14132  CG   LEU E 345     -68.213  17.697  43.215  1.00 27.61      A  C
ATOM  14133  CD1  LEU E 345     -66.974  17.915  42.450  1.00 20.26      A  C
ATOM  14134  CD2  LEU E 345     -69.387  17.965  42.407  1.00 27.83      A  C
ATOM  14135  C    LEU E 345     -69.369  14.556  45.041  1.00 28.53      A  C
ATOM  14136  O    LEU E 345     -70.238  13.930  44.550  1.00 26.94      A  O
ATOM  14137  N    GLU E 346     -68.361  13.988  45.674  1.00 29.60      A  N
ATOM  14138  CA   GLU E 346     -68.238  12.546  45.796  1.00 29.49      A  C
ATOM  14139  CB   GLU E 346     -66.790  12.120  46.010  1.00 29.82      A  C
ATOM  14140  CG   GLU E 346     -66.597  10.656  45.950  1.00 28.98      A  C
ATOM  14141  CD   GLU E 346     -65.174  10.204  45.879  1.00 33.97      A  C
ATOM  14142  OE1  GLU E 346     -64.855   9.519  44.947  1.00 37.10      A  O
ATOM  14143  OE2  GLU E 346     -64.368  10.476  46.745  1.00 35.45      A  O-1
ATOM  14144  C    GLU E 346     -69.186  11.750  46.661  1.00 30.78      A  C
ATOM  14145  O    GLU E 346     -69.613  10.735  46.236  1.00 32.26      A  O
ATOM  14146  N    PRO E 347     -69.521  12.177  47.864  1.00 31.47      A  N
ATOM  14147  CA   PRO E 347     -70.395  11.372  48.705  1.00 31.21      A  C
ATOM  14148  CB   PRO E 347     -70.357  12.120  50.007  1.00 30.95      A  C
ATOM  14149  CG   PRO E 347     -69.100  12.697  50.001  1.00 31.60      A  C
ATOM  14150  CD   PRO E 347     -68.921  13.224  48.678  1.00 31.37      A  C
ATOM  14151  C    PRO E 347     -71.818  11.143  48.242  1.00 30.91      A  C
ATOM  14152  O    PRO E 347     -72.292  10.057  48.323  1.00 32.06      A  O
ATOM  14153  N    PRO E 348     -72.465  12.157  47.735  1.00 30.83      A  N
ATOM  14154  CA   PRO E 348     -73.823  12.068  47.253  1.00 30.49      A  C
ATOM  14155  CB   PRO E 348     -74.066  13.455  46.761  1.00 30.25      A  C
ATOM  14156  CG   PRO E 348     -73.240  14.227  47.520  1.00 31.55      A  C
ATOM  14157  CD   PRO E 348     -72.021  13.535  47.749  1.00 30.56      A  C
ATOM  14158  C    PRO E 348     -73.950  11.118  46.105  1.00 30.41      A  C
ATOM  14159  O    PRO E 348     -74.988  10.575  45.881  1.00 30.05      A  O
```

Appendix 1

```
ATOM  14160  N    ALA E 349    -72.855  10.938  45.408  1.00  28.80      A  N
ATOM  14161  CA   ALA E 349    -72.786  10.117  44.245  1.00  28.39      A  C
ATOM  14162  CB   ALA E 349    -71.631  10.477  43.450  1.00  26.19      A  C
ATOM  14163  C    ALA E 349    -72.803   8.651  44.583  1.00  28.79      A  C
ATOM  14164  O    ALA E 349    -73.007   7.830  43.729  1.00  27.46      A  O
ATOM  14165  N    LYS E 350    -72.644   8.351  45.854  1.00  28.70      A  N
ATOM  14166  CA   LYS E 350    -72.621   6.991  46.337  1.00  30.20      A  C
ATOM  14167  CB   LYS E 350    -74.026   6.415  46.444  1.00  30.97      E  C
ATOM  14168  CG   LYS E 350    -74.966   7.248  47.231  1.00  35.51      E  C
ATOM  14169  CD   LYS E 350    -75.123   6.679  48.591  1.00  46.47      E  C
ATOM  14170  CE   LYS E 350    -76.087   7.452  49.464  1.00  49.49      E  C
ATOM  14171  NZ   LYS E 350    -77.214   6.622  49.933  1.00  51.86      E  N
ATOM  14172  C    LYS E 350    -71.630   6.038  45.672  1.00  28.99      A  C
ATOM  14173  O    LYS E 350    -71.980   5.095  45.021  1.00  26.78      A  O
ATOM  14174  N    PRO E 351    -70.374   6.323  45.868  1.00  28.64      A  N
ATOM  14175  CA   PRO E 351    -69.322   5.476  45.368  1.00  29.44      A  C
ATOM  14176  CB   PRO E 351    -68.074   6.270  45.708  1.00  28.86      A  C
ATOM  14177  CG   PRO E 351    -68.462   7.193  46.687  1.00  27.81      A  C
ATOM  14178  CD   PRO E 351    -69.839   7.537  46.471  1.00  28.87      A  C
ATOM  14179  C    PRO E 351    -69.273   4.114  46.033  1.00  30.53      A  C
ATOM  14180  O    PRO E 351    -69.524   3.983  47.196  1.00  30.86      A  O
ATOM  14181  N    SER E 352    -68.953   3.094  45.275  1.00  31.24      A  N
ATOM  14182  CA   SER E 352    -68.680   1.815  45.843  1.00  33.36      A  C
ATOM  14183  CB   SER E 352    -69.959   1.011  46.055  1.00  35.01      A  C
ATOM  14184  OG   SER E 352    -70.316   0.198  44.978  1.00  38.00      A  O
ATOM  14185  C    SER E 352    -67.697   1.103  44.978  1.00  33.53      A  C
ATOM  14186  O    SER E 352    -67.591   1.377  43.837  1.00  34.31      A  O
ATOM  14187  N    ILE E 353    -66.956   0.180  45.538  1.00  33.14      A  N
ATOM  14188  CA   ILE E 353    -66.040  -0.605  44.780  1.00  32.58      A  C
ATOM  14189  CB   ILE E 353    -64.621  -0.424  45.298  1.00  32.27      A  C
ATOM  14190  CG1  ILE E 353    -64.169   0.983  45.031  1.00  31.14      A  C
ATOM  14191  CD1  ILE E 353    -62.824   1.235  45.322  1.00  33.54      A  C
ATOM  14192  CG2  ILE E 353    -63.683  -1.292  44.601  1.00  33.25      A  C
ATOM  14193  C    ILE E 353    -66.512  -2.025  44.883  1.00  33.78      A  C
ATOM  14194  O    ILE E 353    -66.559  -2.573  45.930  1.00  34.30      A  O
ATOM  14195  N    VAL E 354    -66.921  -2.602  43.775  1.00  34.36      A  N
ATOM  14196  CA   VAL E 354    -67.487  -3.916  43.824  1.00  33.91      A  C
ATOM  14197  CB   VAL E 354    -68.786  -4.014  43.151  1.00  34.06      A  C
ATOM  14198  CG1  VAL E 354    -69.124  -5.424  42.989  1.00  33.37      A  C
ATOM  14199  CG2  VAL E 354    -69.780  -3.394  43.975  1.00  30.11      A  C
ATOM  14200  C    VAL E 354    -66.642  -5.095  43.441  1.00  35.87      A  C
ATOM  14201  O    VAL E 354    -66.580  -6.058  44.180  1.00  38.35      A  O
ATOM  14202  N    SER E 355    -65.958  -5.083  42.337  1.00  35.41      A  N
ATOM  14203  CA   SER E 355    -65.090  -6.224  42.193  1.00  34.81      A  C
ATOM  14204  CB   SER E 355    -65.636  -7.185  41.160  1.00  35.13      A  C
ATOM  14205  OG   SER E 355    -64.825  -8.305  41.005  1.00  38.11      A  O
ATOM  14206  C    SER E 355    -63.730  -5.750  41.835  1.00  33.64      A  C
ATOM  14207  O    SER E 355    -63.187  -6.151  40.849  1.00  34.13      A  O
ATOM  14208  N    ALA E 356    -63.215  -4.881  42.696  1.00  31.05      A  N
ATOM  14209  CA   ALA E 356    -62.022  -4.068  42.512  1.00  29.15      A  C
ATOM  14210  CB   ALA E 356    -60.824  -4.903  42.326  1.00  26.37      A  C
ATOM  14211  C    ALA E 356    -62.181  -3.021  41.416  1.00  28.65      A  C
ATOM  14212  O    ALA E 356    -61.239  -2.538  40.880  1.00  28.30      A  O
ATOM  14213  N    SER E 357    -63.416  -2.663  41.143  1.00  29.19      A  N
```

Appendix 1

```
ATOM  14214  CA   SER E 357     -63.790   -1.746  40.106  1.00  29.42      A    C
ATOM  14215  CB   SER E 357     -64.423   -2.532  38.973  1.00  29.98      A    C
ATOM  14216  OG   SER E 357     -64.873   -1.740  37.926  1.00  31.14      A    O
ATOM  14217  C    SER E 357     -64.724   -0.729  40.719  1.00  29.82      A    C
ATOM  14218  O    SER E 357     -65.460   -1.038  41.580  1.00  29.68      A    O
ATOM  14219  N    LEU E 358     -64.657    0.508  40.286  1.00  30.12      A    N
ATOM  14220  CA   LEU E 358     -65.291    1.584  40.992  1.00  29.86      A    C
ATOM  14221  CB   LEU E 358     -64.331    2.740  41.110  1.00  28.51      A    C
ATOM  14222  CG   LEU E 358     -65.022    4.045  41.393  1.00  26.61      A    C
ATOM  14223  CD1  LEU E 358     -65.555    4.077  42.748  1.00  27.63      A    C
ATOM  14224  CD2  LEU E 358     -64.140    5.149  41.167  1.00  18.77      A    C
ATOM  14225  C    LEU E 358     -66.543    2.072  40.324  1.00  31.28      A    C
ATOM  14226  O    LEU E 358     -66.545    2.382  39.189  1.00  32.54      A    O
ATOM  14227  N    ARG E 359     -67.630    2.162  41.045  1.00  33.02      A    N
ATOM  14228  CA   ARG E 359     -68.827    2.660  40.420  1.00  35.50      A    C
ATOM  14229  CB   ARG E 359     -69.725    1.519  40.032  1.00  35.21      A    C
ATOM  14230  CG   ARG E 359     -70.396    1.746  38.691  1.00  46.06      A    C
ATOM  14231  CD   ARG E 359     -69.475    1.605  37.455  1.00  49.52      A    C
ATOM  14232  NE   ARG E 359     -69.521    0.265  36.890  1.00  50.64      A    N
ATOM  14233  CZ   ARG E 359     -68.572   -0.649  37.012  1.00  52.68      A    C
ATOM  14234  NH1  ARG E 359     -67.464   -0.409  37.673  1.00  45.94      A    N
ATOM  14235  NH2  ARG E 359     -68.750   -1.824  36.464  1.00  54.03      A    N
ATOM  14236  C    ARG E 359     -69.587    3.680  41.234  1.00  35.29      A    C
ATOM  14237  O    ARG E 359     -69.422    3.768  42.391  1.00  34.99      A    O
ATOM  14238  N    TYR E 360     -70.379    4.488  40.588  1.00  35.79      A    N
ATOM  14239  CA   TYR E 360     -71.213    5.415  41.288  1.00  36.14      A    C
ATOM  14240  CB   TYR E 360     -70.879    6.872  40.914  1.00  36.16      A    C
ATOM  14241  CG   TYR E 360     -69.514    7.378  41.266  1.00  33.18      A    C
ATOM  14242  CD1  TYR E 360     -69.238    7.886  42.487  1.00  33.00      A    C
ATOM  14243  CE1  TYR E 360     -68.019    8.337  42.784  1.00  31.92      A    C
ATOM  14244  CZ   TYR E 360     -67.054    8.277  41.872  1.00  34.17      A    C
ATOM  14245  OH   TYR E 360     -65.812    8.694  42.160  1.00  34.57      A    O
ATOM  14246  CE2  TYR E 360     -67.303    7.785  40.671  1.00  31.20      A    C
ATOM  14247  CD2  TYR E 360     -68.521    7.362  40.366  1.00  32.04      A    C
ATOM  14248  C    TYR E 360     -72.659    5.134  40.962  1.00  36.81      A    C
ATOM  14249  O    TYR E 360     -73.029    5.110  39.840  1.00  35.99      A    O
ATOM  14250  N    GLU E 361     -73.463    4.904  41.974  1.00  38.38      A    N
ATOM  14251  CA   GLU E 361     -74.885    5.087  41.943  1.00  40.51      A    C
ATOM  14252  CB   GLU E 361     -75.458    4.615  43.258  1.00  41.60      A    C
ATOM  14253  CG   GLU E 361     -76.495    3.541  43.219  1.00  49.35      A    C
ATOM  14254  CD   GLU E 361     -77.189    3.358  44.554  1.00  58.35      A    C
ATOM  14255  OE1  GLU E 361     -76.513    3.344  45.585  1.00  61.04      A    O
ATOM  14256  OE2  GLU E 361     -78.416    3.229  44.584  1.00  60.97      A    O-1
ATOM  14257  C    GLU E 361     -74.999    6.576  41.941  1.00  40.32      A    C
ATOM  14258  O    GLU E 361     -74.156    7.262  42.501  1.00  42.22      A    O
ATOM  14259  N    HIS E 362     -76.037    7.111  41.365  1.00  39.60      A    N
ATOM  14260  CA   HIS E 362     -76.264    8.532  41.495  1.00  38.15      A    C
ATOM  14261  CB   HIS E 362     -76.701    8.868  42.894  1.00  38.72      A    C
ATOM  14262  CG   HIS E 362     -77.780    7.985  43.409  1.00  43.87      A    C
ATOM  14263  ND1  HIS E 362     -78.726    7.433  42.592  1.00  45.28      A    N
ATOM  14264  CE1  HIS E 362     -79.535    6.681  43.304  1.00  48.77      A    C
ATOM  14265  NE2  HIS E 362     -79.151    6.736  44.556  1.00  50.51      A    N
ATOM  14266  CD2  HIS E 362     -78.056    7.543  44.650  1.00  46.08      A    C
ATOM  14267  C    HIS E 362     -75.203    9.524  41.123  1.00  36.12      A    C
```

Appendix 1

```
ATOM  14268  O    HIS E 362   -75.017  10.417  41.862  1.00  36.49  A  O
ATOM  14269  N    PRO E 363   -74.576   9.437  39.969  1.00  34.60  A  N
ATOM  14270  CA   PRO E 363   -73.719  10.527  39.516  1.00  33.77  A  C
ATOM  14271  CB   PRO E 363   -73.190  10.002  38.207  1.00  33.80  A  C
ATOM  14272  CG   PRO E 363   -74.087   9.002  37.839  1.00  34.71  A  C
ATOM  14273  CD   PRO E 363   -74.468   8.322  39.051  1.00  33.55  A  C
ATOM  14274  C    PRO E 363   -74.438  11.814  39.238  1.00  32.91  A  C
ATOM  14275  O    PRO E 363   -75.404  11.817  38.552  1.00  32.05  A  O
ATOM  14276  N    GLY E 364   -73.919  12.912  39.721  1.00  33.10  A  N
ATOM  14277  CA   GLY E 364   -74.618  14.173  39.681  1.00  34.13  A  C
ATOM  14278  C    GLY E 364   -74.586  15.047  38.446  1.00  35.57  A  C
ATOM  14279  O    GLY E 364   -75.214  16.059  38.401  1.00  35.97  A  O
ATOM  14280  N    SER E 365   -73.819  14.672  37.451  1.00  35.23  A  N
ATOM  14281  CA   SER E 365   -73.685  15.487  36.295  1.00  34.67  A  C
ATOM  14282  CB   SER E 365   -72.709  16.606  36.542  1.00  33.84  A  C
ATOM  14283  OG   SER E 365   -71.444  16.111  36.775  1.00  34.64  A  O
ATOM  14284  C    SER E 365   -73.264  14.596  35.189  1.00  33.75  A  C
ATOM  14285  O    SER E 365   -73.055  13.445  35.412  1.00  35.36  A  O
ATOM  14286  N    LEU E 366   -73.219  15.127  33.986  1.00  33.03  A  N
ATOM  14287  CA   LEU E 366   -72.679  14.431  32.855  1.00  32.33  A  C
ATOM  14288  CB   LEU E 366   -72.833  15.253  31.590  1.00  32.43  A  C
ATOM  14289  CG   LEU E 366   -73.933  15.144  30.552  1.00  32.35  A  C
ATOM  14290  CD1  LEU E 366   -74.972  14.186  30.853  1.00  25.12  A  C
ATOM  14291  CD2  LEU E 366   -74.508  16.452  30.458  1.00  34.82  A  C
ATOM  14292  C    LEU E 366   -71.243  14.379  33.147  1.00  31.68  A  C
ATOM  14293  O    LEU E 366   -70.776  15.189  33.855  1.00  33.07  A  O
ATOM  14294  N    LEU E 367   -70.539  13.411  32.623  1.00  30.60  A  N
ATOM  14295  CA   LEU E 367   -69.104  13.373  32.755  1.00  29.43  A  C
ATOM  14296  CB   LEU E 367   -68.484  14.630  32.173  1.00  27.64  A  C
ATOM  14297  CG   LEU E 367   -68.635  14.985  30.722  1.00  26.24  A  C
ATOM  14298  CD1  LEU E 367   -68.209  16.308  30.540  1.00  28.81  A  C
ATOM  14299  CD2  LEU E 367   -67.927  14.106  29.822  1.00  23.74  A  C
ATOM  14300  C    LEU E 367   -68.643  13.233  34.181  1.00  29.89  A  C
ATOM  14301  O    LEU E 367   -67.574  13.643  34.506  1.00  28.75  A  O
ATOM  14302  N    PHE E 368   -69.461  12.664  35.042  1.00  30.00  A  N
ATOM  14303  CA   PHE E 368   -69.095  12.651  36.410  1.00  30.17  A  C
ATOM  14304  CB   PHE E 368   -70.277  12.206  37.251  1.00  31.10  A  C
ATOM  14305  CG   PHE E 368   -70.060  12.369  38.680  1.00  31.13  A  C
ATOM  14306  CD1  PHE E 368   -70.206  13.571  39.262  1.00  29.10  A  C
ATOM  14307  CE1  PHE E 368   -69.977  13.723  40.553  1.00  31.59  A  C
ATOM  14308  CZ   PHE E 368   -69.609  12.702  41.273  1.00  32.05  A  C
ATOM  14309  CE2  PHE E 368   -69.460  11.509  40.716  1.00  33.09  A  C
ATOM  14310  CD2  PHE E 368   -69.680  11.333  39.438  1.00  27.00  A  C
ATOM  14311  C    PHE E 368   -67.843  11.863  36.746  1.00  28.87  A  C
ATOM  14312  O    PHE E 368   -66.995  12.368  37.393  1.00  28.98  A  O
ATOM  14313  N    ASP E 369   -67.737  10.640  36.292  1.00  27.58  A  N
ATOM  14314  CA   ASP E 369   -66.539   9.867  36.469  1.00  27.02  A  C
ATOM  14315  CB   ASP E 369   -66.789   8.371  36.371  1.00  27.80  A  C
ATOM  14316  CG   ASP E 369   -67.009   7.911  34.999  1.00  33.07  A  C
ATOM  14317  OD1  ASP E 369   -66.078   7.449  34.385  1.00  39.64  A  O
ATOM  14318  OD2  ASP E 369   -68.119   8.004  34.524  1.00  34.79  A  O-1
ATOM  14319  C    ASP E 369   -65.310  10.309  35.716  1.00  25.28  A  C
ATOM  14320  O    ASP E 369   -64.243  10.092  36.157  1.00  24.68  A  O
ATOM  14321  N    GLU E 370   -65.479  10.879  34.545  1.00  25.53  A  N
```

Appendix 1

```
ATOM  14322  CA   GLU E 370     -64.340  11.330  33.774  1.00  26.09      A  C
ATOM  14323  CB   GLU E 370     -64.828  11.827  32.407  1.00  23.97      A  C
ATOM  14324  CG   GLU E 370     -65.311  10.765  31.473  1.00  27.06      A  C
ATOM  14325  CD   GLU E 370     -66.798  10.466  31.552  1.00  29.27      A  C
ATOM  14326  OE1  GLU E 370     -67.399  10.638  32.596  1.00  20.01      A  O
ATOM  14327  OE2  GLU E 370     -67.344  10.023  30.560  1.00  26.29      A  O-1
ATOM  14328  C    GLU E 370     -63.584  12.446  34.464  1.00  25.26      A  C
ATOM  14329  O    GLU E 370     -62.409  12.432  34.573  1.00  23.07      A  O
ATOM  14330  N    LEU E 371     -64.318  13.445  34.868  1.00  25.89      A  N
ATOM  14331  CA   LEU E 371     -63.786  14.575  35.563  1.00  26.60      A  C
ATOM  14332  CB   LEU E 371     -64.803  15.699  35.547  1.00  25.92      A  C
ATOM  14333  CG   LEU E 371     -64.864  16.462  34.253  1.00  26.71      A  C
ATOM  14334  CD1  LEU E 371     -65.761  17.606  34.334  1.00  25.32      A  C
ATOM  14335  CD2  LEU E 371     -63.547  16.846  33.760  1.00  26.66      A  C
ATOM  14336  C    LEU E 371     -63.247  14.310  36.960  1.00  26.46      A  C
ATOM  14337  O    LEU E 371     -62.224  14.815  37.327  1.00  26.40      A  O
ATOM  14338  N    LEU E 372     -63.961  13.529  37.735  1.00  25.50      A  N
ATOM  14339  CA   LEU E 372     -63.466  13.110  39.004  1.00  24.54      A  C
ATOM  14340  CB   LEU E 372     -64.546  12.384  39.772  1.00  23.23      A  C
ATOM  14341  CG   LEU E 372     -65.040  13.052  41.030  1.00  22.20      A  C
ATOM  14342  CD1  LEU E 372     -65.790  14.264  40.766  1.00  14.18      A  C
ATOM  14343  CD2  LEU E 372     -65.845  12.156  41.832  1.00  17.49      A  C
ATOM  14344  C    LEU E 372     -62.227  12.253  38.874  1.00  25.03      A  C
ATOM  14345  O    LEU E 372     -61.324  12.354  39.632  1.00  25.87      A  O
ATOM  14346  N    PHE E 373     -62.188  11.394  37.899  1.00  24.78      A  N
ATOM  14347  CA   PHE E 373     -60.987  10.675  37.671  1.00  23.72      A  C
ATOM  14348  CB   PHE E 373     -61.222   9.621  36.618  1.00  21.29      A  C
ATOM  14349  CG   PHE E 373     -60.006   9.159  35.944  1.00  19.90      A  C
ATOM  14350  CD1  PHE E 373     -59.074   8.429  36.584  1.00  20.83      A  C
ATOM  14351  CE1  PHE E 373     -58.015   8.018  35.955  1.00  21.72      A  C
ATOM  14352  CZ   PHE E 373     -57.860   8.286  34.677  1.00  23.71      A  C
ATOM  14353  CE2  PHE E 373     -58.752   8.984  34.036  1.00  23.77      A  C
ATOM  14354  CD2  PHE E 373     -59.821   9.405  34.647  1.00  22.80      A  C
ATOM  14355  C    PHE E 373     -59.880  11.600  37.272  1.00  23.82      A  C
ATOM  14356  O    PHE E 373     -58.834  11.526  37.804  1.00  26.70      A  O
ATOM  14357  N    LEU E 374     -60.103  12.508  36.371  1.00  21.77      A  N
ATOM  14358  CA   LEU E 374     -59.031  13.368  36.003  1.00  22.97      A  C
ATOM  14359  CB   LEU E 374     -59.420  14.182  34.797  1.00  22.45      A  C
ATOM  14360  CG   LEU E 374     -58.645  15.434  34.547  1.00  23.42      A  C
ATOM  14361  CD1  LEU E 374     -57.380  15.092  33.913  1.00  20.04      A  C
ATOM  14362  CD2  LEU E 374     -59.468  16.207  33.650  1.00  21.44      A  C
ATOM  14363  C    LEU E 374     -58.493  14.261  37.116  1.00  22.41      A  C
ATOM  14364  O    LEU E 374     -57.326  14.419  37.254  1.00  22.61      A  O
ATOM  14365  N    ALA E 375     -59.352  14.838  37.911  1.00  21.99      A  N
ATOM  14366  CA   ALA E 375     -58.920  15.686  38.986  1.00  23.56      A  C
ATOM  14367  CB   ALA E 375     -60.080  16.423  39.580  1.00  22.02      A  C
ATOM  14368  C    ALA E 375     -58.077  14.992  40.055  1.00  24.30      A  C
ATOM  14369  O    ALA E 375     -57.179  15.569  40.584  1.00  25.23      A  O
ATOM  14370  N    LYS E 376     -58.384  13.750  40.340  1.00  23.85      A  N
ATOM  14371  CA   LYS E 376     -57.653  12.946  41.281  1.00  23.61      A  C
ATOM  14372  CB   LYS E 376     -58.381  11.663  41.586  1.00  23.58      A  C
ATOM  14373  CG   LYS E 376     -59.530  11.844  42.435  1.00  21.74      A  C
ATOM  14374  CD   LYS E 376     -60.354  10.658  42.521  1.00  21.18      A  C
ATOM  14375  CE   LYS E 376     -61.544  10.955  43.355  1.00  26.57      A  C
```

Appendix 1

```
ATOM  14376  NZ   LYS E 376   -62.123   9.792  43.964  1.00  31.71   A  N
ATOM  14377  C    LYS E 376   -56.250  12.665  40.867  1.00  25.50   A  C
ATOM  14378  O    LYS E 376   -55.397  12.538  41.676  1.00  27.13   A  O
ATOM  14379  N    VAL E 377   -56.017  12.552  39.588  1.00  24.95   A  N
ATOM  14380  CA   VAL E 377   -54.719  12.257  39.120  1.00  24.42   A  C
ATOM  14381  CB   VAL E 377   -54.744  11.088  38.119  1.00  25.17   A  C
ATOM  14382  CG1  VAL E 377   -55.253   9.886  38.755  1.00  22.38   A  C
ATOM  14383  CG2  VAL E 377   -55.520  11.392  36.924  1.00  22.03   A  C
ATOM  14384  C    VAL E 377   -53.941  13.414  38.569  1.00  26.21   A  C
ATOM  14385  O    VAL E 377   -52.786  13.274  38.306  1.00  27.87   A  O
ATOM  14386  N    HIS E 378   -54.530  14.574  38.428  1.00  27.16   A  N
ATOM  14387  CA   HIS E 378   -53.953  15.567  37.559  1.00  27.44   A  C
ATOM  14388  CB   HIS E 378   -54.977  16.672  37.353  1.00  26.85   A  C
ATOM  14389  CG   HIS E 378   -54.590  17.686  36.333  1.00  27.22   A  C
ATOM  14390  ND1  HIS E 378   -54.195  17.356  35.069  1.00  30.12   A  N
ATOM  14391  CE1  HIS E 378   -53.930  18.444  34.391  1.00  28.58   A  C
ATOM  14392  NE2  HIS E 378   -54.141  19.472  35.173  1.00  29.12   A  N
ATOM  14393  CD2  HIS E 378   -54.557  19.027  36.391  1.00  27.99   A  C
ATOM  14394  C    HIS E 378   -52.624  16.149  37.981  1.00  26.62   A  C
ATOM  14395  O    HIS E 378   -52.498  16.760  38.992  1.00  27.36   A  O
ATOM  14396  N    ALA E 379   -51.622  15.970  37.151  1.00  26.29   A  N
ATOM  14397  CA   ALA E 379   -50.270  16.390  37.447  1.00  25.91   A  C
ATOM  14398  CB   ALA E 379   -49.313  15.483  36.820  1.00  23.37   A  C
ATOM  14399  C    ALA E 379   -49.984  17.813  37.041  1.00  26.69   A  C
ATOM  14400  O    ALA E 379   -48.953  18.354  37.322  1.00  27.61   A  O
ATOM  14401  N    GLY E 380   -50.934  18.404  36.372  1.00  26.93   A  N
ATOM  14402  CA   GLY E 380   -50.842  19.752  35.908  1.00  25.43   A  C
ATOM  14403  C    GLY E 380   -50.469  19.781  34.472  1.00  26.27   A  C
ATOM  14404  O    GLY E 380   -49.751  18.978  33.995  1.00  25.54   A  O
ATOM  14405  N    PHE E 381   -50.980  20.743  33.777  1.00  26.34   A  N
ATOM  14406  CA   PHE E 381   -50.686  20.861  32.398  1.00  26.98   A  C
ATOM  14407  CB   PHE E 381   -51.669  21.786  31.708  1.00  27.22   A  C
ATOM  14408  CG   PHE E 381   -52.990  21.163  31.521  1.00  26.71   A  C
ATOM  14409  CD1  PHE E 381   -53.123  20.030  30.777  1.00  27.38   A  C
ATOM  14410  CE1  PHE E 381   -54.305  19.452  30.653  1.00  27.03   A  C
ATOM  14411  CZ   PHE E 381   -55.358  19.965  31.281  1.00  27.99   A  C
ATOM  14412  CE2  PHE E 381   -55.241  21.048  32.029  1.00  23.50   A  C
ATOM  14413  CD2  PHE E 381   -54.078  21.647  32.155  1.00  25.29   A  C
ATOM  14414  C    PHE E 381   -49.240  21.133  32.094  1.00  27.50   A  C
ATOM  14415  O    PHE E 381   -48.740  20.644  31.135  1.00  28.91   A  O
ATOM  14416  N    GLY E 382   -48.570  21.900  32.927  1.00  26.72   A  N
ATOM  14417  CA   GLY E 382   -47.165  22.126  32.749  1.00  26.52   A  C
ATOM  14418  C    GLY E 382   -46.349  20.878  32.863  1.00  28.41   A  C
ATOM  14419  O    GLY E 382   -45.421  20.672  32.140  1.00  29.32   A  O
ATOM  14420  N    ALA E 383   -46.715  20.037  33.796  1.00  28.53   A  N
ATOM  14421  CA   ALA E 383   -46.051  18.794  34.020  1.00  28.20   A  C
ATOM  14422  CB   ALA E 383   -46.558  18.192  35.251  1.00  26.88   A  C
ATOM  14423  C    ALA E 383   -46.133  17.816  32.881  1.00  29.74   A  C
ATOM  14424  O    ALA E 383   -45.184  17.134  32.631  1.00  30.46   A  O
ATOM  14425  N    LEU E 384   -47.285  17.730  32.232  1.00  29.26   A  N
ATOM  14426  CA   LEU E 384   -47.539  16.848  31.113  1.00  29.02   A  C
ATOM  14427  CB   LEU E 384   -49.006  16.837  30.727  1.00  28.24   A  C
ATOM  14428  CG   LEU E 384   -49.956  16.170  31.696  1.00  29.05   A  C
ATOM  14429  CD1  LEU E 384   -51.371  16.217  31.337  1.00  26.61   A  C
```

Appendix 1

```
ATOM  14430  CD2  LEU  E  384    -49.555   14.827   32.035  1.00  31.56      A    C
ATOM  14431  C    LEU  E  384    -46.693   17.219   29.939  1.00  30.12      A    C
ATOM  14432  O    LEU  E  384    -46.241   16.385   29.210  1.00  30.66      A    O
ATOM  14433  N    LEU  E  385    -46.486   18.499   29.782  1.00  31.36      A    N
ATOM  14434  CA   LEU  E  385    -45.657   19.054   28.753  1.00  33.35      A    C
ATOM  14435  CB   LEU  E  385    -45.692   20.544   28.895  1.00  34.17      A    C
ATOM  14436  CG   LEU  E  385    -46.000   21.484   27.769  1.00  33.95      A    C
ATOM  14437  CD1  LEU  E  385    -46.582   20.802   26.615  1.00  33.05      A    C
ATOM  14438  CD2  LEU  E  385    -46.926   22.452   28.311  1.00  33.47      A    C
ATOM  14439  C    LEU  E  385    -44.224   18.627   28.857  1.00  34.49      A    C
ATOM  14440  O    LEU  E  385    -43.553   18.433   27.896  1.00  33.68      A    O
ATOM  14441  N    ARG  E  386    -43.762   18.506   30.075  1.00  36.57      A    N
ATOM  14442  CA   ARG  E  386    -42.384   18.276   30.377  1.00  37.64      A    C
ATOM  14443  CB   ARG  E  386    -41.984   19.080   31.581  1.00  37.50      A    C
ATOM  14444  CG   ARG  E  386    -41.660   20.463   31.295  1.00  40.45      A    C
ATOM  14445  CD   ARG  E  386    -41.087   21.087   32.488  1.00  46.12      A    C
ATOM  14446  NE   ARG  E  386    -41.994   21.038   33.606  1.00  47.27      A    N
ATOM  14447  CZ   ARG  E  386    -42.916   21.945   33.822  1.00  46.94      A    C
ATOM  14448  NH1  ARG  E  386    -43.033   22.942   32.984  1.00  45.99      A    N
ATOM  14449  NH2  ARG  E  386    -43.697   21.853   34.868  1.00  43.73      A    N
ATOM  14450  C    ARG  E  386    -42.148   16.836   30.656  1.00  38.17      A    C
ATOM  14451  O    ARG  E  386    -41.159   16.478   31.208  1.00  39.07      A    O
ATOM  14452  N    MET  E  387    -43.096   16.018   30.300  1.00  38.59      A    N
ATOM  14453  CA   MET  E  387    -43.049   14.648   30.633  1.00  39.49      A    C
ATOM  14454  CB   MET  E  387    -44.338   14.018   30.187  1.00  38.54      E    C
ATOM  14455  CG   MET  E  387    -44.578   12.701   30.776  1.00  38.50      E    C
ATOM  14456  SD   MET  E  387    -45.397   11.621   29.708  1.00  37.94      E    S
ATOM  14457  CE   MET  E  387    -47.009   12.219   29.830  1.00  38.06      E    C
ATOM  14458  C    MET  E  387    -41.885   13.976   29.977  1.00  40.66      A    C
ATOM  14459  O    MET  E  387    -41.609   14.185   28.835  1.00  41.11      A    O
ATOM  14460  N    PRO  E  388    -41.228   13.092   30.688  1.00  42.60      A    N
ATOM  14461  CA   PRO  E  388    -40.053   12.435   30.143  1.00  44.62      A    C
ATOM  14462  CB   PRO  E  388    -39.238   12.121   31.381  1.00  43.37      A    C
ATOM  14463  CG   PRO  E  388    -40.199   12.044   32.401  1.00  44.85      A    C
ATOM  14464  CD   PRO  E  388    -41.190   13.067   32.144  1.00  42.14      A    C
ATOM  14465  C    PRO  E  388    -40.374   11.181   29.400  1.00  45.93      A    C
ATOM  14466  O    PRO  E  388    -41.426   10.648   29.529  1.00  45.71      A    O
ATOM  14467  N    PRO  E  389    -39.416   10.677   28.676  1.00  47.46      A    N
ATOM  14468  CA   PRO  E  389    -39.647    9.878   27.504  1.00  49.76      A    C
ATOM  14469  CB   PRO  E  389    -38.312    9.972   26.798  1.00  49.57      A    C
ATOM  14470  CG   PRO  E  389    -37.787   11.251   27.197  1.00  48.05      A    C
ATOM  14471  CD   PRO  E  389    -38.523   11.776   28.356  1.00  47.79      A    C
ATOM  14472  C    PRO  E  389    -40.073    8.432   27.601  1.00  52.32      A    C
ATOM  14473  O    PRO  E  389    -40.892    8.002   26.812  1.00  52.85      A    O
ATOM  14474  N    PRO  E  390    -39.508    7.670   28.487  1.00  54.17      A    N
ATOM  14475  CA   PRO  E  390    -39.614    6.237   28.335  1.00  55.63      A    C
ATOM  14476  CB   PRO  E  390    -39.458    5.737   29.753  1.00  56.12      A    C
ATOM  14477  CG   PRO  E  390    -38.628    6.779   30.386  1.00  56.48      A    C
ATOM  14478  CD   PRO  E  390    -39.166    8.045   29.851  1.00  54.90      A    C
ATOM  14479  C    PRO  E  390    -40.946    5.902   27.741  1.00  56.07      A    C
ATOM  14480  O    PRO  E  390    -40.989    5.736   26.533  1.00  55.89      A    O
ATOM  14481  N    LEU  F   29      4.231  103.089   31.911  1.00  64.76      A    N
ATOM  14482  CA   LEU  F   29      4.324  101.774   31.313  1.00  65.79      A    C
ATOM  14483  CB   LEU  F   29      5.144  101.836   30.041  1.00  66.21      A    C
```

Appendix 1

```
ATOM  14484  CG   LEU F  29       6.444 102.588  30.139  1.00 68.68      A  C
ATOM  14485  CD1  LEU F  29       6.683 103.259  28.829  1.00 71.74      A  C
ATOM  14486  CD2  LEU F  29       6.364 103.602  31.229  1.00 68.77      A  C
ATOM  14487  C    LEU F  29       4.970 100.775  32.224  1.00 64.93      A  C
ATOM  14488  O    LEU F  29       5.939 101.103  32.873  1.00 65.77      A  O
ATOM  14489  N    PRO F  30       4.491  99.530  32.207  1.00 63.51      A  N
ATOM  14490  CA   PRO F  30       4.967  98.473  33.102  1.00 62.02      A  C
ATOM  14491  CB   PRO F  30       3.751  98.252  33.981  1.00 62.82      A  C
ATOM  14492  CG   PRO F  30       2.616  98.572  33.121  1.00 61.37      A  C
ATOM  14493  CD   PRO F  30       3.072  99.804  32.435  1.00 63.27      A  C
ATOM  14494  C    PRO F  30       5.233  97.184  32.374  1.00 60.42      A  C
ATOM  14495  O    PRO F  30       4.671  97.032  31.323  1.00 62.24      A  O
ATOM  14496  N    PRO F  31       5.967  96.240  32.932  1.00 57.85      A  N
ATOM  14497  CA   PRO F  31       6.257  94.996  32.216  1.00 56.31      A  C
ATOM  14498  CB   PRO F  31       7.688  95.200  31.782  1.00 55.94      A  C
ATOM  14499  CG   PRO F  31       8.223  96.078  32.766  1.00 58.27      A  C
ATOM  14500  CD   PRO F  31       7.169  96.992  33.239  1.00 57.69      A  C
ATOM  14501  C    PRO F  31       6.117  93.691  33.031  1.00 54.72      A  C
ATOM  14502  O    PRO F  31       7.025  93.291  33.729  1.00 55.14      A  O
ATOM  14503  N    GLY F  32       4.995  93.002  32.899  1.00 51.40      A  N
ATOM  14504  CA   GLY F  32       4.688  91.874  33.752  1.00 47.40      A  C
ATOM  14505  C    GLY F  32       4.003  92.262  35.046  1.00 44.87      A  C
ATOM  14506  O    GLY F  32       3.670  91.431  35.842  1.00 43.76      A  O
ATOM  14507  N    ARG F  33       3.782  93.553  35.198  1.00 41.57      A  N
ATOM  14508  CA   ARG F  33       3.240  94.172  36.377  1.00 38.29      A  C
ATOM  14509  CB   ARG F  33       3.982  95.452  36.661  1.00 36.13      A  C
ATOM  14510  CG   ARG F  33       5.327  95.212  37.068  1.00 34.95      A  C
ATOM  14511  CD   ARG F  33       5.454  95.383  38.487  1.00 28.48      A  C
ATOM  14512  NE   ARG F  33       4.757  96.565  38.885  1.00 29.75      A  N
ATOM  14513  CZ   ARG F  33       5.334  97.697  39.206  1.00 28.47      A  C
ATOM  14514  NH1  ARG F  33       6.620  97.803  39.150  1.00 28.37      A  N
ATOM  14515  NH2  ARG F  33       4.626  98.719  39.557  1.00 25.90      A  N
ATOM  14516  C    ARG F  33       1.800  94.472  36.227  1.00 37.16      A  C
ATOM  14517  O    ARG F  33       1.350  94.685  35.166  1.00 38.17      A  O
ATOM  14518  N    LEU F  34       1.056  94.388  37.301  1.00 36.73      A  N
ATOM  14519  CA   LEU F  34      -0.344  94.735  37.323  1.00 35.31      A  C
ATOM  14520  CB   LEU F  34      -0.943  94.241  38.601  1.00 35.64      A  C
ATOM  14521  CG   LEU F  34      -1.516  92.852  38.654  1.00 39.39      A  C
ATOM  14522  CD1  LEU F  34      -1.614  92.253  37.332  1.00 38.79      A  C
ATOM  14523  CD2  LEU F  34      -0.733  92.026  39.547  1.00 38.00      A  C
ATOM  14524  C    LEU F  34      -0.657  96.198  37.171  1.00 34.49      A  C
ATOM  14525  O    LEU F  34      -1.591  96.574  36.537  1.00 33.03      A  O
ATOM  14526  N    ALA F  35       0.117  97.012  37.847  1.00 34.02      A  N
ATOM  14527  CA   ALA F  35      -0.095  98.423  37.886  1.00 33.06      A  C
ATOM  14528  CB   ALA F  35      -0.975  98.751  38.979  1.00 32.34      A  C
ATOM  14529  C    ALA F  35       1.210  99.102  38.077  1.00 33.86      A  C
ATOM  14530  O    ALA F  35       2.120  98.512  38.541  1.00 32.96      A  O
ATOM  14531  N    THR F  36       1.276 100.367  37.719  1.00 34.53      A  N
ATOM  14532  CA   THR F  36       2.460 101.183  37.890  1.00 35.64      A  C
ATOM  14533  CB   THR F  36       2.469 102.373  36.960  1.00 35.59      A  C
ATOM  14534  OG1  THR F  36       1.462 103.269  37.355  1.00 38.26      A  O
ATOM  14535  CG2  THR F  36       2.144 101.972  35.611  1.00 33.23      A  C
ATOM  14536  C    THR F  36       2.663 101.684  39.302  1.00 36.32      A  C
ATOM  14537  O    THR F  36       1.750 101.744  40.068  1.00 37.51      A  O
```

Appendix 1

```
ATOM  14538  N    THR F  37      3.893  102.024  39.616  1.00  35.95     A  N
ATOM  14539  CA   THR F  37      4.303  102.530  40.891  1.00  36.68     A  C
ATOM  14540  CB   THR F  37      5.830  102.671  40.904  1.00  36.63     A  C
ATOM  14541  OG1  THR F  37      6.415  101.393  40.823  1.00  33.68     A  O
ATOM  14542  CG2  THR F  37      6.312  103.257  42.116  1.00  39.12     A  C
ATOM  14543  C    THR F  37      3.585  103.845  41.112  1.00  39.09     A  C
ATOM  14544  O    THR F  37      3.128  104.143  42.164  1.00  39.46     A  O
ATOM  14545  N    GLU F  38      3.441  104.612  40.063  1.00  40.39     F  N
ATOM  14546  CA   GLU F  38      2.803  105.880  40.143  1.00  41.17     F  C
ATOM  14547  CB   GLU F  38      2.774  106.500  38.753  1.00  41.81     F  C
ATOM  14548  CG   GLU F  38      3.237  107.940  38.647  1.00  47.93     F  C
ATOM  14549  CD   GLU F  38      3.874  108.289  37.298  1.00  55.20     F  C
ATOM  14550  OE1  GLU F  38      5.105  108.406  37.234  1.00  52.93     F  O
ATOM  14551  OE2  GLU F  38      3.145  108.476  36.306  1.00  57.64     F  O
ATOM  14552  C    GLU F  38      1.397  105.636  40.584  1.00  41.22     F  C
ATOM  14553  O    GLU F  38      0.796  106.413  41.273  1.00  40.86     F  O
ATOM  14554  N    ASP F  39      0.833  104.577  40.072  1.00  40.77     F  N
ATOM  14555  CA   ASP F  39     -0.508  104.223  40.392  1.00  40.76     F  C
ATOM  14556  CB   ASP F  39     -0.981  103.144  39.454  1.00  41.62     F  C
ATOM  14557  CG   ASP F  39     -1.538  103.684  38.183  1.00  44.60     F  C
ATOM  14558  OD1  ASP F  39     -1.865  104.869  38.127  1.00  45.44     F  O
ATOM  14559  OD2  ASP F  39     -1.679  102.905  37.237  1.00  48.00     F  O
ATOM  14560  C    ASP F  39     -0.674  103.799  41.836  1.00  40.64     F  C
ATOM  14561  O    ASP F  39     -1.647  104.128  42.460  1.00  41.74     F  O
ATOM  14562  N    TYR F  40      0.262  103.029  42.361  1.00  37.42     A  N
ATOM  14563  CA   TYR F  40      0.212  102.651  43.745  1.00  35.12     A  C
ATOM  14564  CB   TYR F  40      1.275  101.614  44.052  1.00  34.69     A  C
ATOM  14565  CG   TYR F  40      1.029  100.297  43.408  1.00  36.37     A  C
ATOM  14566  CD1  TYR F  40     -0.194   99.681  43.507  1.00  35.11     A  C
ATOM  14567  CE1  TYR F  40     -0.413   98.513  42.922  1.00  31.58     A  C
ATOM  14568  CZ   TYR F  40      0.555   97.933  42.208  1.00  33.44     A  C
ATOM  14569  OH   TYR F  40      0.305   96.753  41.644  1.00  37.26     A  O
ATOM  14570  CE2  TYR F  40      1.760   98.498  42.081  1.00  29.87     A  C
ATOM  14571  CD2  TYR F  40      1.999   99.668  42.678  1.00  32.83     A  C
ATOM  14572  C    TYR F  40      0.357  103.834  44.658  1.00  34.45     A  C
ATOM  14573  O    TYR F  40     -0.313  103.945  45.635  1.00  33.24     A  O
ATOM  14574  N    PHE F  41      1.272  104.713  44.316  1.00  33.07     A  N
ATOM  14575  CA   PHE F  41      1.609  105.860  45.123  1.00  31.95     A  C
ATOM  14576  CB   PHE F  41      2.977  106.402  44.734  1.00  31.97     A  C
ATOM  14577  CG   PHE F  41      4.119  105.802  45.475  1.00  30.86     A  C
ATOM  14578  CD1  PHE F  41      4.714  106.458  46.491  1.00  27.85     A  C
ATOM  14579  CE1  PHE F  41      5.775  105.917  47.133  1.00  31.37     A  C
ATOM  14580  CZ   PHE F  41      6.250  104.731  46.770  1.00  26.58     A  C
ATOM  14581  CE2  PHE F  41      5.674  104.066  45.764  1.00  30.39     A  C
ATOM  14582  CD2  PHE F  41      4.629  104.596  45.113  1.00  31.63     A  C
ATOM  14583  C    PHE F  41      0.568  106.966  45.103  1.00  31.21     A  C
ATOM  14584  O    PHE F  41      0.618  107.871  45.893  1.00  31.62     A  O
ATOM  14585  N    ALA F  42     -0.370  106.881  44.181  1.00  30.70     A  N
ATOM  14586  CA   ALA F  42     -1.436  107.850  44.022  1.00  29.54     A  C
ATOM  14587  CB   ALA F  42     -1.579  108.142  42.604  1.00  28.83     A  C
ATOM  14588  C    ALA F  42     -2.784  107.438  44.556  1.00  31.12     A  C
ATOM  14589  O    ALA F  42     -3.734  108.101  44.326  1.00  33.46     A  O
ATOM  14590  N    GLN F  43     -2.873  106.306  45.212  1.00  31.44     A  N
ATOM  14591  CA   GLN F  43     -4.128  105.782  45.653  1.00  32.89     A  C
```

Appendix 1

```
ATOM  14592  CB   GLN F  43    -3.936 104.374  46.226  1.00 32.43      A  C
ATOM  14593  CG   GLN F  43    -3.873 103.288  45.183  1.00 31.66      A  C
ATOM  14594  CD   GLN F  43    -3.461 101.928  45.690  1.00 31.04      A  C
ATOM  14595  OE1  GLN F  43    -2.330 101.665  45.875  1.00 33.61      A  O
ATOM  14596  NE2  GLN F  43    -4.391 101.066  45.855  1.00 26.08      A  N
ATOM  14597  C    GLN F  43    -4.785 106.674  46.652  1.00 33.93      A  C
ATOM  14598  O    GLN F  43    -5.948 106.900  46.605  1.00 34.96      A  O
ATOM  14599  N    GLN F  44    -4.026 107.178  47.587  1.00 35.13      A  N
ATOM  14600  CA   GLN F  44    -4.564 107.994  48.637  1.00 36.68      A  C
ATOM  14601  CB   GLN F  44    -3.449 108.268  49.619  1.00 36.13      A  C
ATOM  14602  CG   GLN F  44    -3.820 108.836  50.919  1.00 40.12      A  C
ATOM  14603  CD   GLN F  44    -2.779 108.591  51.949  1.00 42.22      A  C
ATOM  14604  OE1  GLN F  44    -1.957 107.728  51.788  1.00 38.31      A  O
ATOM  14605  NE2  GLN F  44    -2.807 109.350  53.015  1.00 39.81      A  N
ATOM  14606  C    GLN F  44    -5.154 109.276  48.086  1.00 37.25      A  C
ATOM  14607  O    GLN F  44    -6.222 109.669  48.454  1.00 37.99      A  O
ATOM  14608  N    ALA F  45    -4.454 109.911  47.173  1.00 37.41      A  N
ATOM  14609  CA   ALA F  45    -4.899 111.137  46.542  1.00 37.54      A  C
ATOM  14610  CB   ALA F  45    -3.825 111.659  45.678  1.00 36.91      A  C
ATOM  14611  C    ALA F  45    -6.158 110.981  45.727  1.00 37.54      A  C
ATOM  14612  O    ALA F  45    -6.999 111.835  45.708  1.00 36.30      A  O
ATOM  14613  N    LYS F  46    -6.251 109.868  45.036  1.00 37.94      A  N
ATOM  14614  CA   LYS F  46    -7.374 109.522  44.226  1.00 38.20      A  C
ATOM  14615  CB   LYS F  46    -6.913 108.558  43.162  1.00 39.50      A  C
ATOM  14616  CG   LYS F  46    -6.669 109.164  41.832  1.00 41.63      A  C
ATOM  14617  CD   LYS F  46    -6.137 108.160  40.899  1.00 46.75      A  C
ATOM  14618  CE   LYS F  46    -5.341 108.784  39.801  1.00 49.80      A  C
ATOM  14619  NZ   LYS F  46    -5.399 107.929  38.598  1.00 50.75      A  N
ATOM  14620  C    LYS F  46    -8.496 108.881  45.005  1.00 37.42      A  C
ATOM  14621  O    LYS F  46    -9.560 108.697  44.491  1.00 38.02      A  O
ATOM  14622  N    GLN F  47    -8.222 108.517  46.235  1.00 36.03      A  N
ATOM  14623  CA   GLN F  47    -9.160 107.860  47.108  1.00 35.39      A  C
ATOM  14624  CB   GLN F  47   -10.292 108.780  47.448  1.00 34.90      A  C
ATOM  14625  CG   GLN F  47    -9.887 109.931  48.245  1.00 38.11      A  C
ATOM  14626  CD   GLN F  47   -10.962 110.400  49.137  1.00 46.21      A  C
ATOM  14627  OE1  GLN F  47   -12.064 110.617  48.713  1.00 46.21      A  O
ATOM  14628  NE2  GLN F  47   -10.652 110.555  50.396  1.00 46.75      A  N
ATOM  14629  C    GLN F  47    -9.721 106.563  46.604  1.00 34.57      A  C
ATOM  14630  O    GLN F  47   -10.861 106.294  46.814  1.00 33.79      A  O
ATOM  14631  N    ALA F  48    -8.913 105.782  45.924  1.00 33.08      A  N
ATOM  14632  CA   ALA F  48    -9.325 104.497  45.452  1.00 33.24      A  C
ATOM  14633  CB   ALA F  48    -9.885 104.636  44.117  1.00 33.52      A  C
ATOM  14634  C    ALA F  48    -8.172 103.571  45.407  1.00 32.28      A  C
ATOM  14635  O    ALA F  48    -7.107 103.963  45.101  1.00 34.02      A  O
ATOM  14636  N    VAL F  49    -8.401 102.318  45.686  1.00 30.79      A  N
ATOM  14637  CA   VAL F  49    -7.365 101.347  45.513  1.00 30.52      A  C
ATOM  14638  CB   VAL F  49    -7.662 100.097  46.258  1.00 30.68      A  C
ATOM  14639  CG1  VAL F  49    -7.558 100.340  47.693  1.00 31.94      A  C
ATOM  14640  CG2  VAL F  49    -8.961  99.593  45.901  1.00 29.13      A  C
ATOM  14641  C    VAL F  49    -7.176 101.018  44.058  1.00 29.88      A  C
ATOM  14642  O    VAL F  49    -8.056 101.249  43.292  1.00 29.13      A  O
ATOM  14643  N    THR F  50    -6.037 100.456  43.688  1.00 28.75      A  N
ATOM  14644  CA   THR F  50    -5.875  99.973  42.351  1.00 30.03      A  C
ATOM  14645  CB   THR F  50    -4.458  99.607  41.941  1.00 30.07      A  C
```

Appendix 1

```
ATOM  14646  OG1 THR F  50   -3.955  98.596  42.772 1.00 30.78    A  O
ATOM  14647  CG2 THR F  50   -3.572 100.748  41.989 1.00 33.09    A  C
ATOM  14648  C   THR F  50   -6.700  98.755  42.208 1.00 30.17    A  C
ATOM  14649  O   THR F  50   -6.967  98.083  43.133 1.00 29.59    A  O
ATOM  14650  N   PRO F  51   -7.073  98.452  40.997 1.00 30.30    A  N
ATOM  14651  CA  PRO F  51   -7.956  97.342  40.751 1.00 30.28    A  C
ATOM  14652  CB  PRO F  51   -8.119  97.403  39.252 1.00 29.14    A  C
ATOM  14653  CG  PRO F  51   -7.979  98.729  38.952 1.00 27.71    A  C
ATOM  14654  CD  PRO F  51   -6.937  99.253  39.789 1.00 29.62    A  C
ATOM  14655  C   PRO F  51   -7.367  96.030  41.195 1.00 30.51    A  C
ATOM  14656  O   PRO F  51   -8.078  95.220  41.724 1.00 32.17    A  O
ATOM  14657  N   ASP F  52   -6.076  95.853  41.021 1.00 28.59    A  N
ATOM  14658  CA  ASP F  52   -5.385  94.697  41.517 1.00 29.02    A  C
ATOM  14659  CB  ASP F  52   -3.992  94.564  40.914 1.00 29.64    A  C
ATOM  14660  CG  ASP F  52   -3.070  95.654  41.302 1.00 31.58    A  C
ATOM  14661  OD1 ASP F  52   -2.044  95.349  41.844 1.00 33.10    A  O
ATOM  14662  OD2 ASP F  52   -3.336  96.806  41.050 1.00 35.43    A  O-1
ATOM  14663  C   ASP F  52   -5.378  94.529  43.029 1.00 28.94    A  C
ATOM  14664  O   ASP F  52   -5.302  93.439  43.494 1.00 29.60    A  O
ATOM  14665  N   VAL F  53   -5.386  95.627  43.759 1.00 27.16    A  N
ATOM  14666  CA  VAL F  53   -5.528  95.677  45.199 1.00 26.40    A  C
ATOM  14667  CB  VAL F  53   -5.116  97.040  45.739 1.00 26.07    A  C
ATOM  14668  CG1 VAL F  53   -5.601  97.225  47.060 1.00 24.45    A  C
ATOM  14669  CG2 VAL F  53   -3.675  97.164  45.744 1.00 21.08    A  C
ATOM  14670  C   VAL F  53   -6.898  95.265  45.682 1.00 27.31    A  C
ATOM  14671  O   VAL F  53   -7.049  94.601  46.656 1.00 28.01    A  O
ATOM  14672  N   MET F  54   -7.893  95.687  44.948 1.00 28.36    A  N
ATOM  14673  CA  MET F  54   -9.258  95.284  45.119 1.00 30.04    A  C
ATOM  14674  CB  MET F  54  -10.127  96.122  44.190 1.00 30.83    F  C
ATOM  14675  CG  MET F  54  -11.602  96.045  44.349 1.00 30.72    F  C
ATOM  14676  SD  MET F  54  -12.292  96.332  45.922 1.00 39.46    F  S
ATOM  14677  CE  MET F  54  -12.659  98.010  45.861 1.00 39.18    F  C
ATOM  14678  C   MET F  54   -9.413  93.784  44.881 1.00 29.83    A  C
ATOM  14679  O   MET F  54  -10.142  93.138  45.557 1.00 29.56    A  O
ATOM  14680  N   ALA F  55   -8.694  93.250  43.917 1.00 28.44    A  N
ATOM  14681  CA  ALA F  55   -8.630  91.830  43.687 1.00 28.34    A  C
ATOM  14682  CB  ALA F  55   -8.007  91.514  42.348 1.00 25.79    A  C
ATOM  14683  C   ALA F  55   -7.993  91.034  44.797 1.00 27.39    A  C
ATOM  14684  O   ALA F  55   -8.420  89.955  45.055 1.00 25.91    A  O
ATOM  14685  N   GLN F  56   -6.948  91.566  45.409 1.00 26.52    A  N
ATOM  14686  CA  GLN F  56   -6.386  91.006  46.621 1.00 26.18    A  C
ATOM  14687  CB  GLN F  56   -5.083  91.699  46.983 1.00 25.90    A  C
ATOM  14688  CG  GLN F  56   -4.522  91.328  48.312 1.00 27.42    A  C
ATOM  14689  CD  GLN F  56   -3.808  90.044  48.307 1.00 31.67    A  C
ATOM  14690  OE1 GLN F  56   -3.231  89.662  47.338 1.00 35.56    A  O
ATOM  14691  NE2 GLN F  56   -3.840  89.369  49.396 1.00 29.16    A  N
ATOM  14692  C   GLN F  56   -7.371  91.045  47.777 1.00 25.40    A  C
ATOM  14693  O   GLN F  56   -7.567  90.107  48.423 1.00 24.81    A  O
ATOM  14694  N   LEU F  57   -8.047  92.139  47.957 1.00 25.44    A  N
ATOM  14695  CA  LEU F  57   -9.026  92.244  48.961 1.00 27.05    A  C
ATOM  14696  CB  LEU F  57   -9.580  93.648  48.942 1.00 27.36    A  C
ATOM  14697  CG  LEU F  57   -9.465  94.537  50.158 1.00 29.63    A  C
ATOM  14698  CD1 LEU F  57   -8.209  94.348  50.864 1.00 25.77    A  C
ATOM  14699  CD2 LEU F  57   -9.623  95.944  49.794 1.00 30.89    A  C
```

Appendix 1

```
ATOM  14700  C    LEU F  57   -10.090  91.217  48.669  1.00  27.43  A  C
ATOM  14701  O    LEU F  57   -10.649  90.652  49.546  1.00  28.11  A  O
ATOM  14702  N    ALA F  58   -10.374  90.985  47.413  1.00  26.83  A  N
ATOM  14703  CA   ALA F  58   -11.288  89.953  47.005  1.00  27.10  A  C
ATOM  14704  CB   ALA F  58   -11.611  90.097  45.580  1.00  26.78  A  C
ATOM  14705  C    ALA F  58   -10.847  88.536  47.314  1.00  27.59  A  C
ATOM  14706  O    ALA F  58   -11.641  87.762  47.690  1.00  28.66  A  O
ATOM  14707  N    TYR F  59    -9.584  88.201  47.147  1.00  27.59  A  N
ATOM  14708  CA   TYR F  59    -9.083  86.921  47.537  1.00  26.77  A  C
ATOM  14709  CB   TYR F  59    -7.599  86.778  47.183  1.00  26.39  A  C
ATOM  14710  CG   TYR F  59    -6.866  85.807  48.057  1.00  25.23  A  C
ATOM  14711  CD1  TYR F  59    -7.125  84.477  48.001  1.00  27.78  A  C
ATOM  14712  CE1  TYR F  59    -6.493  83.610  48.802  1.00  27.32  A  C
ATOM  14713  CZ   TYR F  59    -5.601  84.053  49.683  1.00  28.88  A  C
ATOM  14714  OH   TYR F  59    -4.970  83.194  50.486  1.00  26.64  A  O
ATOM  14715  CE2  TYR F  59    -5.336  85.356  49.766  1.00  30.09  A  C
ATOM  14716  CD2  TYR F  59    -5.957  86.224  48.962  1.00  28.08  A  C
ATOM  14717  C    TYR F  59    -9.276  86.816  49.016  1.00  26.60  A  C
ATOM  14718  O    TYR F  59    -9.649  85.819  49.528  1.00  27.36  A  O
ATOM  14719  N    MET F  60    -8.992  87.884  49.704  1.00  26.13  A  N
ATOM  14720  CA   MET F  60    -9.046  87.895  51.124  1.00  26.20  A  C
ATOM  14721  CB   MET F  60    -8.513  89.216  51.636  1.00  24.57  F  C
ATOM  14722  CG   MET F  60    -7.040  89.393  51.505  1.00  24.98  F  C
ATOM  14723  SD   MET F  60    -6.445  91.034  51.676  1.00  27.79  F  S
ATOM  14724  CE   MET F  60    -6.534  91.291  53.359  1.00  25.11  F  C
ATOM  14725  C    MET F  60   -10.433  87.630  51.638  1.00  27.17  A  C
ATOM  14726  O    MET F  60   -10.604  87.053  52.655  1.00  28.36  A  O
ATOM  14727  N    ASN F  61   -11.428  88.067  50.914  1.00  27.56  A  N
ATOM  14728  CA   ASN F  61   -12.766  88.099  51.422  1.00  28.64  A  C
ATOM  14729  CB   ASN F  61   -13.258  89.531  51.338  1.00  28.13  A  C
ATOM  14730  CG   ASN F  61   -12.785  90.384  52.447  1.00  28.69  A  C
ATOM  14731  OD1  ASN F  61   -13.299  90.322  53.512  1.00  31.82  A  O
ATOM  14732  ND2  ASN F  61   -11.840  91.218  52.187  1.00  23.66  A  N
ATOM  14733  C    ASN F  61   -13.806  87.276  50.726  1.00  28.84  A  C
ATOM  14734  O    ASN F  61   -14.777  86.955  51.316  1.00  29.31  A  O
ATOM  14735  N    TYR F  62   -13.651  87.034  49.444  1.00  28.87  A  N
ATOM  14736  CA   TYR F  62   -14.754  86.525  48.649  1.00  28.63  A  C
ATOM  14737  CB   TYR F  62   -14.448  86.784  47.177  1.00  27.94  A  C
ATOM  14738  CG   TYR F  62   -15.649  86.839  46.333  1.00  25.26  A  C
ATOM  14739  CD1  TYR F  62   -16.078  87.998  45.816  1.00  22.16  A  C
ATOM  14740  CE1  TYR F  62   -17.175  88.045  45.069  1.00  23.45  A  C
ATOM  14741  CZ   TYR F  62   -17.865  86.936  44.855  1.00  25.77  A  C
ATOM  14742  OH   TYR F  62   -18.989  86.956  44.113  1.00  27.81  A  O
ATOM  14743  CE2  TYR F  62   -17.451  85.780  45.352  1.00  27.56  A  C
ATOM  14744  CD2  TYR F  62   -16.367  85.728  46.067  1.00  24.17  A  C
ATOM  14745  C    TYR F  62   -15.316  85.111  48.814  1.00  30.05  A  C
ATOM  14746  O    TYR F  62   -16.483  84.962  49.010  1.00  32.42  A  O
ATOM  14747  N    ILE F  63   -14.518  84.077  48.722  1.00  29.76  A  N
ATOM  14748  CA   ILE F  63   -15.055  82.753  48.808  1.00  29.69  A  C
ATOM  14749  CB   ILE F  63   -14.176  81.747  48.059  1.00  30.05  A  C
ATOM  14750  CG1  ILE F  63   -14.079  82.171  46.612  1.00  29.19  A  C
ATOM  14751  CD1  ILE F  63   -12.899  81.740  45.931  1.00  28.04  A  C
ATOM  14752  CG2  ILE F  63   -14.772  80.406  48.088  1.00  25.53  A  C
ATOM  14753  C    ILE F  63   -15.442  82.321  50.209  1.00  31.56  A  C
```

Appendix 1

```
ATOM  14754  O    ILE F  63     -14.854  82.723  51.160  1.00  31.73      A  O
ATOM  14755  N    ASP F  64     -16.452  81.480  50.299  1.00  33.07      A  N
ATOM  14756  CA   ASP F  64     -17.125  81.138  51.529  1.00  34.37      A  C
ATOM  14757  CB   ASP F  64     -18.267  80.216  51.231  1.00  34.91      A  C
ATOM  14758  CG   ASP F  64     -19.529  80.905  51.034  1.00  38.55      A  C
ATOM  14759  OD1  ASP F  64     -20.421  80.246  50.552  1.00  43.79      A  O
ATOM  14760  OD2  ASP F  64     -19.664  82.072  51.338  1.00  39.57      A  O
ATOM  14761  C    ASP F  64     -16.396  80.454  52.649  1.00  34.60      A  C
ATOM  14762  O    ASP F  64     -16.710  80.702  53.764  1.00  35.84      A  O
ATOM  14763  N    PHE F  65     -15.522  79.512  52.445  1.00  31.57      A  N
ATOM  14764  CA   PHE F  65     -15.000  78.982  53.681  1.00  30.30      A  C
ATOM  14765  CB   PHE F  65     -15.477  77.554  53.877  1.00  28.99      A  C
ATOM  14766  CG   PHE F  65     -16.945  77.446  53.964  1.00  29.77      A  C
ATOM  14767  CD1  PHE F  65     -17.607  77.849  55.087  1.00  32.55      A  C
ATOM  14768  CE1  PHE F  65     -18.912  77.784  55.159  1.00  23.46      A  C
ATOM  14769  CZ   PHE F  65     -19.600  77.348  54.133  1.00  28.66      A  C
ATOM  14770  CE2  PHE F  65     -18.988  76.958  53.014  1.00  26.53      A  C
ATOM  14771  CD2  PHE F  65     -17.675  77.012  52.916  1.00  27.65      A  C
ATOM  14772  C    PHE F  65     -13.534  79.119  53.729  1.00  29.98      A  C
ATOM  14773  O    PHE F  65     -12.928  79.033  54.743  1.00  29.97      A  O
ATOM  14774  N    ILE F  66     -12.992  79.345  52.566  1.00  29.21      A  N
ATOM  14775  CA   ILE F  66     -11.605  79.195  52.336  1.00  29.86      A  C
ATOM  14776  CB   ILE F  66     -11.409  78.337  51.128  1.00  29.37      A  C
ATOM  14777  CG1  ILE F  66     -12.234  78.829  49.993  1.00  26.58      A  C
ATOM  14778  CD1  ILE F  66     -11.710  78.455  48.760  1.00  28.31      A  C
ATOM  14779  CG2  ILE F  66     -11.884  76.999  51.419  1.00  29.85      A  C
ATOM  14780  C    ILE F  66     -10.803  80.466  52.233  1.00  31.40      A  C
ATOM  14781  O    ILE F  66      -9.614  80.427  52.212  1.00  33.20      A  O
ATOM  14782  N    SER F  67     -11.480  81.584  52.153  1.00  30.93      A  N
ATOM  14783  CA   SER F  67     -10.862  82.870  52.219  1.00  30.13      A  C
ATOM  14784  CB   SER F  67     -11.714  83.895  51.491  1.00  29.69      A  C
ATOM  14785  OG   SER F  67     -12.702  84.432  52.284  1.00  31.59      A  O
ATOM  14786  C    SER F  67     -10.506  83.225  53.663  1.00  29.80      A  C
ATOM  14787  O    SER F  67     -11.195  82.859  54.558  1.00  29.64      A  O
ATOM  14788  N    PRO F  68      -9.387  83.892  53.869  1.00  28.29      A  N
ATOM  14789  CA   PRO F  68      -8.835  84.134  55.191  1.00  27.82      A  C
ATOM  14790  CB   PRO F  68      -7.509  84.774  54.883  1.00  27.61      A  C
ATOM  14791  CG   PRO F  68      -7.548  85.134  53.541  1.00  26.61      A  C
ATOM  14792  CD   PRO F  68      -8.431  84.277  52.841  1.00  25.94      A  C
ATOM  14793  C    PRO F  68      -9.654  84.994  56.117  1.00  28.21      A  C
ATOM  14794  O    PRO F  68      -9.581  84.896  57.296  1.00  30.11      A  O
ATOM  14795  N    PHE F  69     -10.455  85.844  55.557  1.00  27.35      A  N
ATOM  14796  CA   PHE F  69     -11.216  86.718  56.369  1.00  27.69      A  C
ATOM  14797  CB   PHE F  69     -10.951  88.165  56.009  1.00  27.69      A  C
ATOM  14798  CG   PHE F  69      -9.597  88.578  56.316  1.00  28.52      A  C
ATOM  14799  CD1  PHE F  69      -9.285  89.060  57.539  1.00  29.24      A  C
ATOM  14800  CE1  PHE F  69      -8.052  89.393  57.825  1.00  31.84      A  C
ATOM  14801  CZ   PHE F  69      -7.099  89.218  56.923  1.00  32.00      A  C
ATOM  14802  CE2  PHE F  69      -7.386  88.714  55.709  1.00  31.28      A  C
ATOM  14803  CD2  PHE F  69      -8.612  88.396  55.417  1.00  29.24      A  C
ATOM  14804  C    PHE F  69     -12.656  86.399  56.355  1.00  27.58      A  C
ATOM  14805  O    PHE F  69     -13.446  87.253  56.505  1.00  29.33      A  O
ATOM  14806  N    TYR F  70     -12.990  85.162  56.107  1.00  27.12      A  N
ATOM  14807  CA   TYR F  70     -14.349  84.736  56.104  1.00  28.25      A  C
```

Appendix 1

```
ATOM  14808  CB   TYR F  70     -14.461  83.348  55.498  1.00  27.54      A  C
ATOM  14809  CG   TYR F  70     -15.839  82.835  55.488  1.00  28.57      A  C
ATOM  14810  CD1  TYR F  70     -16.744  83.269  54.568  1.00  27.41      A  C
ATOM  14811  CE1  TYR F  70     -18.005  82.824  54.585  1.00  28.09      A  C
ATOM  14812  CZ   TYR F  70     -18.385  81.944  55.525  1.00  29.20      A  C
ATOM  14813  OH   TYR F  70     -19.637  81.463  55.564  1.00  37.12      A  O
ATOM  14814  CE2  TYR F  70     -17.524  81.517  56.442  1.00  26.83      A  C
ATOM  14815  CD2  TYR F  70     -16.262  81.951  56.424  1.00  29.39      A  C
ATOM  14816  C    TYR F  70     -15.015  84.791  57.447  1.00  29.73      A  C
ATOM  14817  O    TYR F  70     -16.104  85.247  57.575  1.00  30.62      A  O
ATOM  14818  N    SER F  71     -14.335  84.336  58.460  1.00  31.82      A  N
ATOM  14819  CA   SER F  71     -14.953  84.106  59.719  1.00  33.87      A  C
ATOM  14820  CB   SER F  71     -15.263  82.641  59.837  1.00  33.79      A  C
ATOM  14821  OG   SER F  71     -16.390  82.468  60.610  1.00  37.76      A  O
ATOM  14822  C    SER F  71     -14.082  84.492  60.871  1.00  34.71      A  C
ATOM  14823  O    SER F  71     -12.911  84.517  60.763  1.00  33.79      A  O
ATOM  14824  N    ARG F  72     -14.708  84.781  61.989  1.00  36.39      A  N
ATOM  14825  CA   ARG F  72     -14.043  85.196  63.198  1.00  37.81      A  C
ATOM  14826  CB   ARG F  72     -14.915  86.262  63.879  1.00  38.10      A  C
ATOM  14827  CG   ARG F  72     -15.250  86.076  65.299  1.00  41.05      A  C
ATOM  14828  CD   ARG F  72     -16.409  86.922  65.750  1.00  44.44      A  C
ATOM  14829  NE   ARG F  72     -16.234  88.358  65.620  1.00  47.50      A  N
ATOM  14830  CZ   ARG F  72     -17.191  89.239  65.869  1.00  50.33      A  C
ATOM  14831  NH1  ARG F  72     -18.365  88.846  66.278  1.00  48.24      A  N
ATOM  14832  NH2  ARG F  72     -16.988  90.509  65.711  1.00  52.89      A  N
ATOM  14833  C    ARG F  72     -13.719  83.944  64.021  1.00  37.32      A  C
ATOM  14834  O    ARG F  72     -13.040  83.953  65.019  1.00  36.18      A  O
ATOM  14835  N    GLY F  73     -14.140  82.832  63.473  1.00  37.40      A  N
ATOM  14836  CA   GLY F  73     -13.920  81.532  64.036  1.00  37.61      A  C
ATOM  14837  C    GLY F  73     -12.506  81.076  63.930  1.00  38.05      A  C
ATOM  14838  O    GLY F  73     -11.764  81.600  63.170  1.00  37.68      A  O
ATOM  14839  N    CYS F  74     -12.113  80.115  64.728  1.00  37.71      A  N
ATOM  14840  CA   CYS F  74     -10.728  79.742  64.670  1.00  37.87      A  C
ATOM  14841  CB   CYS F  74     -10.061  79.584  66.094  1.00  38.27      A  C
ATOM  14842  SG   CYS F  74      -8.983  81.075  66.670  1.00  42.50      A  S
ATOM  14843  C    CYS F  74     -10.508  78.664  63.593  1.00  35.96      A  C
ATOM  14844  O    CYS F  74     -10.037  77.605  63.818  1.00  36.32      A  O
ATOM  14845  N    SER F  75     -10.858  79.024  62.381  1.00  34.46      A  N
ATOM  14846  CA   SER F  75     -10.742  78.193  61.238  1.00  33.01      A  C
ATOM  14847  CB   SER F  75     -12.001  78.290  60.443  1.00  31.92      A  C
ATOM  14848  OG   SER F  75     -11.763  77.820  59.160  1.00  40.45      A  O
ATOM  14849  C    SER F  75      -9.620  78.687  60.396  1.00  32.00      A  C
ATOM  14850  O    SER F  75      -9.514  79.834  60.141  1.00  29.93      A  O
ATOM  14851  N    PHE F  76      -8.746  77.799  59.986  1.00  31.70      A  N
ATOM  14852  CA   PHE F  76      -7.551  78.219  59.313  1.00  31.85      A  C
ATOM  14853  CB   PHE F  76      -6.340  78.064  60.222  1.00  31.40      A  C
ATOM  14854  CG   PHE F  76      -6.275  79.095  61.247  1.00  28.01      A  C
ATOM  14855  CD1  PHE F  76      -5.746  80.302  60.961  1.00  23.82      A  C
ATOM  14856  CE1  PHE F  76      -5.749  81.262  61.860  1.00  24.22      A  C
ATOM  14857  CZ   PHE F  76      -6.274  81.051  63.052  1.00  23.39      A  C
ATOM  14858  CE2  PHE F  76      -6.821  79.877  63.364  1.00  23.80      A  C
ATOM  14859  CD2  PHE F  76      -6.834  78.901  62.468  1.00  25.40      A  C
ATOM  14860  C    PHE F  76      -7.271  77.696  57.950  1.00  32.48      A  C
ATOM  14861  O    PHE F  76      -6.165  77.652  57.575  1.00  32.94      A  O
```

Appendix 1

```
ATOM  14862  N    GLU F  77   -8.268  77.295  57.208  1.00  33.27     A  N
ATOM  14863  CA   GLU F  77   -8.008  76.657  55.946  1.00  34.27     A  C
ATOM  14864  CB   GLU F  77   -9.144  75.738  55.484  1.00  36.10     A  C
ATOM  14865  CG   GLU F  77  -10.437  76.363  55.141  1.00  43.15     A  C
ATOM  14866  CD   GLU F  77  -11.494  76.101  56.196  1.00  53.95     A  C
ATOM  14867  OE1  GLU F  77  -11.624  76.910  57.136  1.00  51.59     A  O
ATOM  14868  OE2  GLU F  77  -12.194  75.088  56.076  1.00  53.33     A  O-1
ATOM  14869  C    GLU F  77   -7.439  77.487  54.831  1.00  32.47     A  C
ATOM  14870  O    GLU F  77   -6.904  76.967  53.919  1.00  34.15     A  O
ATOM  14871  N    ALA F  78   -7.568  78.780  54.899  1.00  31.20     A  N
ATOM  14872  CA   ALA F  78   -7.027  79.616  53.886  1.00  30.23     A  C
ATOM  14873  CB   ALA F  78   -7.369  80.996  54.187  1.00  28.68     A  C
ATOM  14874  C    ALA F  78   -5.544  79.458  53.881  1.00  31.70     A  C
ATOM  14875  O    ALA F  78   -4.918  79.430  52.866  1.00  32.95     A  O
ATOM  14876  N    TRP F  79   -5.002  79.420  55.073  1.00  31.64     A  N
ATOM  14877  CA   TRP F  79   -3.630  79.164  55.352  1.00  31.51     A  C
ATOM  14878  CB   TRP F  79   -3.347  79.533  56.800  1.00  31.06     A  C
ATOM  14879  CG   TRP F  79   -3.358  80.992  57.003  1.00  31.21     A  C
ATOM  14880  CD1  TRP F  79   -2.329  81.830  56.855  1.00  29.87     A  C
ATOM  14881  NE1  TRP F  79   -2.710  83.095  57.084  1.00  26.18     A  N
ATOM  14882  CE2  TRP F  79   -4.032  83.102  57.388  1.00  28.39     A  C
ATOM  14883  CD2  TRP F  79   -4.470  81.794  57.344  1.00  29.49     A  C
ATOM  14884  CE3  TRP F  79   -5.793  81.528  57.629  1.00  29.52     A  C
ATOM  14885  CZ3  TRP F  79   -6.595  82.547  57.944  1.00  32.34     A  C
ATOM  14886  CH2  TRP F  79   -6.129  83.837  57.997  1.00  31.49     A  C
ATOM  14887  CZ2  TRP F  79   -4.854  84.136  57.714  1.00  28.96     A  C
ATOM  14888  C    TRP F  79   -3.157  77.768  54.989  1.00  32.78     A  C
ATOM  14889  O    TRP F  79   -2.079  77.609  54.541  1.00  34.08     A  O
ATOM  14890  N    GLU F  80   -3.965  76.753  55.199  1.00  33.73     A  N
ATOM  14891  CA   GLU F  80   -3.601  75.414  54.790  1.00  35.90     A  C
ATOM  14892  CB   GLU F  80   -4.564  74.362  55.279  1.00  36.12     A  C
ATOM  14893  CG   GLU F  80   -4.744  74.275  56.740  1.00  41.28     A  C
ATOM  14894  CD   GLU F  80   -6.014  73.618  57.065  1.00  48.62     A  C
ATOM  14895  OE1  GLU F  80   -6.593  73.942  58.086  1.00  48.71     A  O
ATOM  14896  OE2  GLU F  80   -6.444  72.778  56.278  1.00  53.01     A  O-1
ATOM  14897  C    GLU F  80   -3.469  75.288  53.317  1.00  35.20     A  C
ATOM  14898  O    GLU F  80   -2.665  74.562  52.847  1.00  34.85     A  O
ATOM  14899  N    LEU F  81   -4.314  75.984  52.601  1.00  35.11     A  N
ATOM  14900  CA   LEU F  81   -4.235  76.048  51.185  1.00  36.15     A  C
ATOM  14901  CB   LEU F  81   -5.403  76.854  50.676  1.00  36.27     A  C
ATOM  14902  CG   LEU F  81   -6.641  76.135  50.211  1.00  39.81     A  C
ATOM  14903  CD1  LEU F  81   -6.651  74.737  50.676  1.00  37.81     A  C
ATOM  14904  CD2  LEU F  81   -7.847  76.854  50.671  1.00  41.56     A  C
ATOM  14905  C    LEU F  81   -2.943  76.697  50.737  1.00  36.77     A  C
ATOM  14906  O    LEU F  81   -2.334  76.254  49.817  1.00  37.00     A  O
ATOM  14907  N    LYS F  82   -2.541  77.746  51.429  1.00  36.74     A  N
ATOM  14908  CA   LYS F  82   -1.336  78.489  51.165  1.00  37.54     A  C
ATOM  14909  CB   LYS F  82   -1.369  79.831  51.910  1.00  38.16     A  C
ATOM  14910  CG   LYS F  82   -1.198  81.118  51.086  1.00  41.80     A  C
ATOM  14911  CD   LYS F  82   -2.102  82.305  51.566  1.00  46.31     A  C
ATOM  14912  CE   LYS F  82   -1.412  83.666  51.718  1.00  46.59     A  C
ATOM  14913  NZ   LYS F  82   -1.399  84.703  50.593  1.00  47.07     A  N
ATOM  14914  C    LYS F  82   -0.131  77.663  51.567  1.00  37.64     A  C
ATOM  14915  O    LYS F  82    0.959  77.928  51.170  1.00  37.23     A  O
```

Appendix 1

```
ATOM  14916  N    HIS F 83   -0.357  76.636  52.353  1.00  37.00    A  N
ATOM  14917  CA   HIS F 83    0.700  75.890  52.992  1.00  37.43    A  C
ATOM  14918  CB   HIS F 83    1.667  75.344  51.979  1.00  37.63    A  C
ATOM  14919  CG   HIS F 83    1.043  74.461  50.970  1.00  42.55    A  C
ATOM  14920  ND1  HIS F 83    0.457  73.269  51.297  1.00  44.51    A  N
ATOM  14921  CE1  HIS F 83   -0.029  72.717  50.210  1.00  47.76    A  C
ATOM  14922  NE2  HIS F 83    0.246  73.498  49.190  1.00  44.54    A  N
ATOM  14923  CD2  HIS F 83    0.914  74.594  49.638  1.00  44.28    A  C
ATOM  14924  C    HIS F 83    1.529  76.675  53.913  1.00  35.27    A  C
ATOM  14925  O    HIS F 83    2.693  76.521  53.916  1.00  35.70    A  O
ATOM  14926  N    THR F 84    0.921  77.497  54.709  1.00  33.48    A  N
ATOM  14927  CA   THR F 84    1.650  78.363  55.563  1.00  31.93    A  C
ATOM  14928  CB   THR F 84    0.767  79.521  55.958  1.00  31.79    A  C
ATOM  14929  OG1  THR F 84    0.345  80.224  54.802  1.00  30.48    A  O
ATOM  14930  CG2  THR F 84    1.500  80.435  56.802  1.00  28.36    A  C
ATOM  14931  C    THR F 84    2.057  77.595  56.785  1.00  30.88    A  C
ATOM  14932  O    THR F 84    1.254  76.973  57.392  1.00  31.65    A  O
ATOM  14933  N    PRO F 85    3.315  77.647  57.146  1.00  29.30    A  N
ATOM  14934  CA   PRO F 85    3.777  76.963  58.338  1.00  28.65    A  C
ATOM  14935  CB   PRO F 85    5.268  77.191  58.297  1.00  27.82    A  C
ATOM  14936  CG   PRO F 85    5.566  77.532  56.974  1.00  26.67    A  C
ATOM  14937  CD   PRO F 85    4.434  78.158  56.363  1.00  28.28    A  C
ATOM  14938  C    PRO F 85    3.198  77.602  59.563  1.00  29.22    A  C
ATOM  14939  O    PRO F 85    2.945  78.753  59.541  1.00  29.07    A  O
ATOM  14940  N    GLN F 86    3.012  76.848  60.625  1.00  29.98    A  N
ATOM  14941  CA   GLN F 86    2.245  77.284  61.768  1.00  29.88    A  C
ATOM  14942  CB   GLN F 86    2.141  76.187  62.780  1.00  29.98    A  C
ATOM  14943  CG   GLN F 86    1.440  76.614  64.011  1.00  32.38    A  C
ATOM  14944  CD   GLN F 86    2.343  77.138  65.082  1.00  34.62    A  C
ATOM  14945  OE1  GLN F 86    1.967  77.998  65.843  1.00  35.89    A  O
ATOM  14946  NE2  GLN F 86    3.520  76.605  65.161  1.00  35.48    A  N
ATOM  14947  C    GLN F 86    2.824  78.494  62.425  1.00  29.68    A  C
ATOM  14948  O    GLN F 86    2.118  79.360  62.843  1.00  30.03    A  O
ATOM  14949  N    ARG F 87    4.134  78.536  62.471  1.00  29.87    A  N
ATOM  14950  CA   ARG F 87    4.898  79.596  63.069  1.00  28.47    A  C
ATOM  14951  CB   ARG F 87    6.340  79.167  63.186  1.00  27.79    A  C
ATOM  14952  CG   ARG F 87    6.679  78.420  64.437  1.00  29.02    A  C
ATOM  14953  CD   ARG F 87    7.991  77.765  64.307  1.00  28.91    A  C
ATOM  14954  NE   ARG F 87    8.172  76.690  65.242  1.00  32.77    A  N
ATOM  14955  CZ   ARG F 87    8.195  76.840  66.543  1.00  33.95    A  C
ATOM  14956  NH1  ARG F 87    8.065  78.020  67.050  1.00  36.30    A  N
ATOM  14957  NH2  ARG F 87    8.359  75.814  67.328  1.00  31.75    A  N
ATOM  14958  C    ARG F 87    4.781  80.926  62.388  1.00  27.79    A  C
ATOM  14959  O    ARG F 87    5.070  81.929  62.938  1.00  27.91    A  O
ATOM  14960  N    VAL F 88    4.363  80.922  61.159  1.00  27.10    A  N
ATOM  14961  CA   VAL F 88    4.307  82.132  60.423  1.00  26.43    A  C
ATOM  14962  CB   VAL F 88    4.957  81.903  59.078  1.00  27.60    A  C
ATOM  14963  CG1  VAL F 88    4.663  82.983  58.161  1.00  29.42    A  C
ATOM  14964  CG2  VAL F 88    6.389  81.801  59.257  1.00  28.50    A  C
ATOM  14965  C    VAL F 88    2.918  82.662  60.289  1.00  25.38    A  C
ATOM  14966  O    VAL F 88    2.723  83.696  59.755  1.00  25.67    A  O
ATOM  14967  N    ILE F 89    1.950  81.935  60.783  1.00  24.37    A  N
ATOM  14968  CA   ILE F 89    0.591  82.354  60.643  1.00  24.71    A  C
ATOM  14969  CB   ILE F 89   -0.420  81.316  61.105  1.00  24.52    A  C
```

Appendix 1

```
ATOM  14970  CG1  ILE  F  89   -0.363  80.087  60.253  1.00  24.05  A  C
ATOM  14971  CD1  ILE  F  89   -0.875  78.892  60.910  1.00  24.68  A  C
ATOM  14972  CG2  ILE  F  89   -1.768  81.830  60.916  1.00  25.26  A  C
ATOM  14973  C    ILE  F  89    0.385  83.656  61.363  1.00  25.26  A  C
ATOM  14974  O    ILE  F  89   -0.300  84.500  60.900  1.00  24.78  A  O
ATOM  14975  N    LYS  F  90    1.013  83.828  62.502  1.00  25.09  A  N
ATOM  14976  CA   LYS  F  90    0.858  85.061  63.231  1.00  25.89  A  C
ATOM  14977  CB   LYS  F  90    1.474  84.990  64.607  1.00  25.82  A  C
ATOM  14978  CG   LYS  F  90    2.863  85.447  64.669  1.00  25.72  A  C
ATOM  14979  CD   LYS  F  90    3.725  84.468  65.317  1.00  30.94  A  C
ATOM  14980  CE   LYS  F  90    3.139  83.926  66.573  1.00  28.60  A  C
ATOM  14981  NZ   LYS  F  90    3.824  82.734  66.939  1.00  27.16  A  N
ATOM  14982  C    LYS  F  90    1.364  86.256  62.497  1.00  26.63  A  C
ATOM  14983  O    LYS  F  90    0.855  87.307  62.664  1.00  27.03  A  O
ATOM  14984  N    TYR  F  91    2.420  86.096  61.729  1.00  26.92  A  N
ATOM  14985  CA   TYR  F  91    2.923  87.157  60.897  1.00  28.02  A  C
ATOM  14986  CB   TYR  F  91    4.345  86.889  60.412  1.00  29.15  A  C
ATOM  14987  CG   TYR  F  91    5.271  86.623  61.523  1.00  31.62  A  C
ATOM  14988  CD1  TYR  F  91    5.634  87.601  62.366  1.00  36.40  A  C
ATOM  14989  CE1  TYR  F  91    6.437  87.360  63.410  1.00  38.27  A  C
ATOM  14990  CZ   TYR  F  91    6.882  86.135  63.625  1.00  40.36  A  C
ATOM  14991  OH   TYR  F  91    7.695  85.902  64.671  1.00  43.58  A  O
ATOM  14992  CE2  TYR  F  91    6.531  85.139  62.805  1.00  41.05  A  C
ATOM  14993  CD2  TYR  F  91    5.725  85.382  61.768  1.00  35.71  A  C
ATOM  14994  C    TYR  F  91    2.032  87.507  59.774  1.00  27.84  A  C
ATOM  14995  O    TYR  F  91    1.902  88.634  59.448  1.00  27.88  A  O
ATOM  14996  N    SER  F  92    1.465  86.492  59.166  1.00  29.09  A  N
ATOM  14997  CA   SER  F  92    0.611  86.645  58.029  1.00  28.06  A  C
ATOM  14998  CB   SER  F  92    0.321  85.298  57.449  1.00  28.33  A  C
ATOM  14999  OG   SER  F  92   -0.885  85.327  56.798  1.00  30.66  A  O
ATOM  15000  C    SER  F  92   -0.656  87.392  58.342  1.00  27.59  A  C
ATOM  15001  O    SER  F  92   -1.061  88.211  57.592  1.00  29.18  A  O
ATOM  15002  N    ILE  F  93   -1.264  87.106  59.464  1.00  24.56  A  N
ATOM  15003  CA   ILE  F  93   -2.414  87.837  59.904  1.00  23.68  A  C
ATOM  15004  CB   ILE  F  93   -2.988  87.178  61.152  1.00  24.04  A  C
ATOM  15005  CG1  ILE  F  93   -3.471  85.784  60.845  1.00  21.44  A  C
ATOM  15006  CD1  ILE  F  93   -3.749  84.994  62.016  1.00  16.80  A  C
ATOM  15007  CG2  ILE  F  93   -4.104  87.934  61.693  1.00  23.33  A  C
ATOM  15008  C    ILE  F  93   -2.123  89.285  60.207  1.00  23.22  A  C
ATOM  15009  O    ILE  F  93   -2.853  90.154  59.850  1.00  23.38  A  O
ATOM  15010  N    ALA  F  94   -1.032  89.522  60.885  1.00  23.03  A  N
ATOM  15011  CA   ALA  F  94   -0.616  90.843  61.217  1.00  22.88  A  C
ATOM  15012  CB   ALA  F  94    0.508  90.758  62.125  1.00  21.95  A  C
ATOM  15013  C    ALA  F  94   -0.278  91.762  60.066  1.00  23.31  A  C
ATOM  15014  O    ALA  F  94   -0.677  92.876  60.065  1.00  21.76  A  O
ATOM  15015  N    PHE  F  95    0.471  91.282  59.101  1.00  23.61  A  N
ATOM  15016  CA   PHE  F  95    0.784  92.046  57.918  1.00  24.95  A  C
ATOM  15017  CB   PHE  F  95    1.895  91.408  57.108  1.00  25.29  A  C
ATOM  15018  CG   PHE  F  95    3.181  91.314  57.839  1.00  32.82  A  C
ATOM  15019  CD1  PHE  F  95    3.529  92.237  58.738  1.00  35.49  A  C
ATOM  15020  CE1  PHE  F  95    4.664  92.138  59.394  1.00  38.69  A  C
ATOM  15021  CZ   PHE  F  95    5.469  91.128  59.183  1.00  38.78  A  C
ATOM  15022  CE2  PHE  F  95    5.160  90.217  58.288  1.00  38.62  A  C
ATOM  15023  CD2  PHE  F  95    4.034  90.293  57.626  1.00  37.61  A  C
```

Appendix 1

```
ATOM  15024  C    PHE F  95    -0.415  92.366  57.056  1.00  24.04    A  C
ATOM  15025  O    PHE F  95    -0.465  93.374  56.422  1.00  24.16    A  O
ATOM  15026  N    TYR F  96    -1.354  91.462  57.003  1.00  23.36    A  N
ATOM  15027  CA   TYR F  96    -2.577  91.673  56.301  1.00  24.33    A  C
ATOM  15028  CB   TYR F  96    -3.445  90.444  56.418  1.00  24.98    A  C
ATOM  15029  CG   TYR F  96    -3.369  89.439  55.322  1.00  25.85    A  C
ATOM  15030  CD1  TYR F  96    -3.394  89.808  54.020  1.00  26.06    A  C
ATOM  15031  CE1  TYR F  96    -3.352  88.903  53.060  1.00  29.60    A  C
ATOM  15032  CZ   TYR F  96    -3.324  87.591  53.376  1.00  31.19    A  C
ATOM  15033  OH   TYR F  96    -3.265  86.651  52.410  1.00  31.56    A  O
ATOM  15034  CE2  TYR F  96    -3.321  87.201  54.653  1.00  29.72    A  C
ATOM  15035  CD2  TYR F  96    -3.353  88.108  55.607  1.00  28.34    A  C
ATOM  15036  C    TYR F  96    -3.311  92.782  56.957  1.00  23.99    A  C
ATOM  15037  O    TYR F  96    -3.929  93.564  56.313  1.00  23.60    A  O
ATOM  15038  N    ALA F  97    -3.276  92.790  58.272  1.00  23.78    A  N
ATOM  15039  CA   ALA F  97    -3.913  93.797  59.076  1.00  22.84    A  C
ATOM  15040  CB   ALA F  97    -3.928  93.383  60.510  1.00  21.63    A  C
ATOM  15041  C    ALA F  97    -3.318  95.163  58.907  1.00  23.40    A  C
ATOM  15042  O    ALA F  97    -4.009  96.125  58.820  1.00  21.99    A  O
ATOM  15043  N    TYR F  98    -2.011  95.234  58.849  1.00  24.91    A  N
ATOM  15044  CA   TYR F  98    -1.366  96.496  58.647  1.00  24.41    A  C
ATOM  15045  CB   TYR F  98     0.151  96.408  58.800  1.00  24.03    A  C
ATOM  15046  CG   TYR F  98     0.624  95.797  60.085  1.00  24.84    A  C
ATOM  15047  CD1  TYR F  98    -0.137  95.829  61.214  1.00  24.67    A  C
ATOM  15048  CE1  TYR F  98     0.293  95.251  62.365  1.00  22.44    A  C
ATOM  15049  CZ   TYR F  98     1.492  94.624  62.401  1.00  25.43    A  C
ATOM  15050  OH   TYR F  98     1.937  94.033  63.523  1.00  29.06    A  O
ATOM  15051  CE2  TYR F  98     2.260  94.581  61.311  1.00  22.91    A  C
ATOM  15052  CD2  TYR F  98     1.835  95.168  60.163  1.00  25.34    A  C
ATOM  15053  C    TYR F  98    -1.794  97.039  57.305  1.00  24.71    A  C
ATOM  15054  O    TYR F  98    -1.998  98.193  57.151  1.00  24.62    A  O
ATOM  15055  N    GLY F  99    -1.952  96.183  56.329  1.00  25.87    A  N
ATOM  15056  CA   GLY F  99    -2.444  96.592  55.039  1.00  26.31    A  C
ATOM  15057  C    GLY F  99    -3.851  97.126  54.998  1.00  26.82    A  C
ATOM  15058  O    GLY F  99    -4.136  98.058  54.333  1.00  26.93    A  O
ATOM  15059  N    LEU F 100    -4.724  96.485  55.735  1.00  26.45    A  N
ATOM  15060  CA   LEU F 100    -6.105  96.834  55.841  1.00  25.91    A  C
ATOM  15061  CB   LEU F 100    -6.809  95.832  56.693  1.00  25.25    A  C
ATOM  15062  CG   LEU F 100    -7.587  94.655  56.188  1.00  25.73    A  C
ATOM  15063  CD1  LEU F 100    -7.823  94.641  54.744  1.00  17.66    A  C
ATOM  15064  CD2  LEU F 100    -6.896  93.481  56.666  1.00  18.43    A  C
ATOM  15065  C    LEU F 100    -6.312  98.183  56.442  1.00  26.59    A  C
ATOM  15066  O    LEU F 100    -7.251  98.823  56.167  1.00  27.25    A  O
ATOM  15067  N    ALA F 101    -5.456  98.562  57.351  1.00  26.25    A  N
ATOM  15068  CA   ALA F 101    -5.494  99.844  57.970  1.00  26.36    A  C
ATOM  15069  CB   ALA F 101    -4.542  99.844  59.076  1.00  26.63    A  C
ATOM  15070  C    ALA F 101    -5.206 100.996  57.038  1.00  26.37    A  C
ATOM  15071  O    ALA F 101    -5.777 102.032  57.146  1.00  25.72    A  O
ATOM  15072  N    SER F 102    -4.235 100.811  56.178  1.00  26.96    A  N
ATOM  15073  CA   SER F 102    -3.919 101.712  55.102  1.00  28.67    A  C
ATOM  15074  CB   SER F 102    -2.566 101.416  54.527  1.00  28.91    A  C
ATOM  15075  OG   SER F 102    -1.574 101.907  55.361  1.00  31.78    A  O
ATOM  15076  C    SER F 102    -4.998 101.760  54.053  1.00  29.45    A  C
ATOM  15077  O    SER F 102    -5.243 102.762  53.477  1.00  29.35    A  O
```

Appendix 1

```
ATOM   15078  N    VAL F 103      -5.652 100.647  53.845  1.00  29.77       A    N
ATOM   15079  CA   VAL F 103      -6.797 100.601  52.985  1.00  29.44       A    C
ATOM   15080  CB   VAL F 103      -7.302  99.175  52.781  1.00  29.65       A    C
ATOM   15081  CG1  VAL F 103      -8.657  99.168  52.281  1.00  27.45       A    C
ATOM   15082  CG2  VAL F 103      -6.451  98.456  51.842  1.00  27.28       A    C
ATOM   15083  C    VAL F 103      -7.859 101.485  53.576  1.00  29.28       A    C
ATOM   15084  O    VAL F 103      -8.516 102.186  52.889  1.00  30.41       A    O
ATOM   15085  N    ALA F 104      -8.001 101.475  54.873  1.00  28.17       A    N
ATOM   15086  CA   ALA F 104      -8.962 102.326  55.508  1.00  29.80       A    C
ATOM   15087  CB   ALA F 104      -9.007 102.031  56.931  1.00  28.19       A    C
ATOM   15088  C    ALA F 104      -8.645 103.776  55.299  1.00  30.98       A    C
ATOM   15089  O    ALA F 104      -9.509 104.592  55.207  1.00  31.64       A    O
ATOM   15090  N    LEU F 105      -7.373 104.085  55.340  1.00  33.08       A    N
ATOM   15091  CA   LEU F 105      -6.829 105.386  55.058  1.00  34.81       A    C
ATOM   15092  CB   LEU F 105      -5.370 105.379  55.445  1.00  34.49       A    C
ATOM   15093  CG   LEU F 105      -4.794 106.661  55.950  1.00  36.88       A    C
ATOM   15094  CD1  LEU F 105      -5.944 107.427  56.336  1.00  41.44       A    C
ATOM   15095  CD2  LEU F 105      -4.003 106.359  57.106  1.00  34.05       A    C
ATOM   15096  C    LEU F 105      -6.962 105.846  53.624  1.00  35.51       A    C
ATOM   15097  O    LEU F 105      -7.221 106.971  53.379  1.00  36.03       A    O
ATOM   15098  N    ILE F 106      -6.738 104.983  52.661  1.00  36.00       A    N
ATOM   15099  CA   ILE F 106      -6.983 105.361  51.295  1.00  36.20       A    C
ATOM   15100  CB   ILE F 106      -6.565 104.266  50.395  1.00  35.74       A    C
ATOM   15101  CG1  ILE F 106      -5.068 104.109  50.414  1.00  36.36       A    C
ATOM   15102  CD1  ILE F 106      -4.637 102.813  49.872  1.00  37.45       A    C
ATOM   15103  CG2  ILE F 106      -7.061 104.535  49.048  1.00  30.99       A    C
ATOM   15104  C    ILE F 106      -8.416 105.627  50.863  1.00  37.27       A    C
ATOM   15105  O    ILE F 106      -8.696 106.616  50.289  1.00  37.11       A    O
ATOM   15106  N    ASP F 107      -9.324 104.716  51.095  1.00  37.87       A    N
ATOM   15107  CA   ASP F 107     -10.666 104.953  50.666  1.00  38.71       A    C
ATOM   15108  CB   ASP F 107     -11.042 103.954  49.616  1.00  39.31       A    C
ATOM   15109  CG   ASP F 107     -12.338 104.289  48.957  1.00  44.70       A    C
ATOM   15110  OD1  ASP F 107     -12.969 105.267  49.333  1.00  46.22       A    O
ATOM   15111  OD2  ASP F 107     -12.731 103.577  48.046  1.00  50.40       A    O-1
ATOM   15112  C    ASP F 107     -11.695 104.880  51.735  1.00  37.76       A    C
ATOM   15113  O    ASP F 107     -11.924 103.873  52.291  1.00  38.19       A    O
ATOM   15114  N    PRO F 108     -12.398 105.953  51.937  1.00  38.69       A    N
ATOM   15115  CA   PRO F 108     -13.433 106.017  52.949  1.00  38.31       A    C
ATOM   15116  CB   PRO F 108     -13.957 107.432  52.797  1.00  37.64       A    C
ATOM   15117  CG   PRO F 108     -12.891 108.146  52.214  1.00  40.04       A    C
ATOM   15118  CD   PRO F 108     -12.195 107.255  51.313  1.00  38.68       A    C
ATOM   15119  C    PRO F 108     -14.530 105.012  52.713  1.00  37.04       A    C
ATOM   15120  O    PRO F 108     -15.098 104.553  53.651  1.00  37.54       A    O
ATOM   15121  N    LYS F 109     -14.824 104.691  51.477  1.00  35.98       A    N
ATOM   15122  CA   LYS F 109     -15.842 103.739  51.165  1.00  35.27       A    C
ATOM   15123  CB   LYS F 109     -16.130 103.761  49.686  1.00  36.37       A    C
ATOM   15124  CG   LYS F 109     -17.280 104.648  49.329  1.00  40.97       A    C
ATOM   15125  CD   LYS F 109     -17.116 105.331  48.014  1.00  49.11       A    C
ATOM   15126  CE   LYS F 109     -17.388 106.813  48.131  1.00  55.49       A    C
ATOM   15127  NZ   LYS F 109     -17.800 107.461  46.844  1.00  55.82       A    N
ATOM   15128  C    LYS F 109     -15.502 102.358  51.650  1.00  34.74       A    C
ATOM   15129  O    LYS F 109     -16.358 101.563  51.877  1.00  32.85       A    O
ATOM   15130  N    LEU F 110     -14.229 102.078  51.809  1.00  34.00       A    N
ATOM   15131  CA   LEU F 110     -13.809 100.761  52.201  1.00  33.27       A    C
```

Appendix 1

```
ATOM  15132  CB   LEU F 110     -12.619 100.302  51.392  1.00 32.40      A    C
ATOM  15133  CG   LEU F 110     -12.872  99.943  49.944  1.00 33.14      A    C
ATOM  15134  CD1  LEU F 110     -11.604  99.675  49.215  1.00 28.92      A    C
ATOM  15135  CD2  LEU F 110     -13.802  98.820  49.821  1.00 32.06      A    C
ATOM  15136  C    LEU F 110     -13.468 100.633  53.642  1.00 33.47      A    C
ATOM  15137  O    LEU F 110     -13.064  99.601  54.055  1.00 35.04      A    O
ATOM  15138  N    ARG F 111     -13.631 101.687  54.397  1.00 30.60      A    N
ATOM  15139  CA   ARG F 111     -13.239 101.695  55.768  1.00 30.10      A    C
ATOM  15140  CB   ARG F 111     -13.343 103.108  56.325  1.00 28.96      A    C
ATOM  15141  CG   ARG F 111     -12.703 103.309  57.652  1.00 27.53      A    C
ATOM  15142  CD   ARG F 111     -12.699 104.690  58.039  1.00 27.31      A    C
ATOM  15143  NE   ARG F 111     -12.028 104.928  59.295  1.00 33.47      A    N
ATOM  15144  CZ   ARG F 111     -11.490 106.082  59.621  1.00 35.36      A    C
ATOM  15145  NH1  ARG F 111     -11.531 107.069  58.769  1.00 33.01      A    N
ATOM  15146  NH2  ARG F 111     -10.907 106.248  60.780  1.00 31.64      A    N
ATOM  15147  C    ARG F 111     -14.011 100.693  56.597  1.00 30.02      A    C
ATOM  15148  O    ARG F 111     -13.466 100.078  57.437  1.00 29.67      A    O
ATOM  15149  N    ALA F 112     -15.287 100.529  56.358  1.00 30.33      A    N
ATOM  15150  CA   ALA F 112     -16.029  99.563  57.123  1.00 30.85      A    C
ATOM  15151  CB   ALA F 112     -17.463  99.704  56.870  1.00 29.69      A    C
ATOM  15152  C    ALA F 112     -15.572  98.149  56.891  1.00 30.49      A    C
ATOM  15153  O    ALA F 112     -15.516  97.362  57.782  1.00 31.56      A    O
ATOM  15154  N    LEU F 113     -15.248  97.838  55.666  1.00 30.58      A    N
ATOM  15155  CA   LEU F 113     -14.756  96.537  55.341  1.00 29.49      A    C
ATOM  15156  CB   LEU F 113     -14.629  96.401  53.839  1.00 28.76      A    C
ATOM  15157  CG   LEU F 113     -14.000  95.142  53.298  1.00 33.42      A    C
ATOM  15158  CD1  LEU F 113     -14.910  93.967  53.274  1.00 30.28      A    C
ATOM  15159  CD2  LEU F 113     -13.490  95.413  51.988  1.00 34.08      A    C
ATOM  15160  C    LEU F 113     -13.453  96.255  56.011  1.00 29.15      A    C
ATOM  15161  O    LEU F 113     -13.237  95.206  56.495  1.00 29.48      A    O
ATOM  15162  N    ALA F 114     -12.580  97.222  56.020  1.00 27.19      A    N
ATOM  15163  CA   ALA F 114     -11.315  97.076  56.645  1.00 26.29      A    C
ATOM  15164  CB   ALA F 114     -10.497  98.255  56.391  1.00 26.25      A    C
ATOM  15165  C    ALA F 114     -11.507  96.864  58.106  1.00 26.34      A    C
ATOM  15166  O    ALA F 114     -10.782  96.169  58.719  1.00 27.07      A    O
ATOM  15167  N    GLY F 115     -12.490  97.497  58.668  1.00 26.06      A    N
ATOM  15168  CA   GLY F 115     -12.790  97.268  60.037  1.00 26.22      A    C
ATOM  15169  C    GLY F 115     -13.271  95.890  60.328  1.00 26.82      A    C
ATOM  15170  O    GLY F 115     -12.854  95.313  61.259  1.00 26.02      A    O
ATOM  15171  N    HIS F 116     -14.159  95.369  59.508  1.00 27.58      A    N
ATOM  15172  CA   HIS F 116     -14.663  94.042  59.694  1.00 27.42      A    C
ATOM  15173  CB   HIS F 116     -15.766  93.753  58.699  1.00 27.07      A    C
ATOM  15174  CG   HIS F 116     -16.099  92.310  58.569  1.00 30.91      A    C
ATOM  15175  ND1  HIS F 116     -15.707  91.552  57.502  1.00 31.41      A    N
ATOM  15176  CE1  HIS F 116     -16.121  90.320  57.664  1.00 34.50      A    C
ATOM  15177  NE2  HIS F 116     -16.771  90.253  58.798  1.00 31.47      A    N
ATOM  15178  CD2  HIS F 116     -16.790  91.487  59.373  1.00 32.95      A    C
ATOM  15179  C    HIS F 116     -13.550  93.042  59.596  1.00 27.08      A    C
ATOM  15180  O    HIS F 116     -13.534  92.112  60.321  1.00 28.91      A    O
ATOM  15181  N    ASP F 117     -12.626  93.245  58.689  1.00 25.99      A    N
ATOM  15182  CA   ASP F 117     -11.423  92.448  58.577  1.00 27.08      A    C
ATOM  15183  CB   ASP F 117     -10.727  92.709  57.276  1.00 26.56      A    C
ATOM  15184  CG   ASP F 117     -11.448  92.155  56.149  1.00 26.39      A    C
ATOM  15185  OD1  ASP F 117     -12.261  91.293  56.318  1.00 28.30      A    O
```

Appendix 1

```
ATOM  15186  OD2 ASP F 117    -11.221  92.607  55.076  1.00 31.28      A    O-1
ATOM  15187  C   ASP F 117    -10.416  92.512  59.679  1.00 27.27      A    C
ATOM  15188  O   ASP F 117     -9.797  91.553  59.996  1.00 28.08      A    O
ATOM  15189  N   LEU F 118    -10.227  93.690  60.215  1.00 27.35      A    N
ATOM  15190  CA  LEU F 118     -9.397  93.903  61.363  1.00 26.33      A    C
ATOM  15191  CB  LEU F 118     -9.270  95.387  61.625  1.00 26.19      A    C
ATOM  15192  CG  LEU F 118     -7.974  96.090  61.301  1.00 25.08      A    C
ATOM  15193  CD1 LEU F 118     -7.148  95.236  60.529  1.00 26.11      A    C
ATOM  15194  CD2 LEU F 118     -8.216  97.326  60.575  1.00 21.45      A    C
ATOM  15195  C   LEU F 118     -9.981  93.193  62.545  1.00 25.92      A    C
ATOM  15196  O   LEU F 118     -9.289  92.694  63.371  1.00 26.27      A    O
ATOM  15197  N   ASP F 119    -11.286  93.212  62.618  1.00 25.16      A    N
ATOM  15198  CA  ASP F 119    -12.037  92.537  63.625  1.00 25.87      A    C
ATOM  15199  CB  ASP F 119    -13.477  92.918  63.407  1.00 27.47      A    C
ATOM  15200  CG  ASP F 119    -14.397  92.454  64.470  1.00 29.55      A    C
ATOM  15201  OD1 ASP F 119    -13.991  91.833  65.402  1.00 31.43      A    O
ATOM  15202  OD2 ASP F 119    -15.571  92.734  64.367  1.00 33.82      A    O-1
ATOM  15203  C   ASP F 119    -11.849  91.048  63.523  1.00 26.80      A    C
ATOM  15204  O   ASP F 119    -11.660  90.408  64.497  1.00 27.90      A    O
ATOM  15205  N   ILE F 120    -11.907  90.504  62.329  1.00 25.56      A    N
ATOM  15206  CA  ILE F 120    -11.594  89.121  62.070  1.00 24.49      A    C
ATOM  15207  CB  ILE F 120    -12.013  88.733  60.669  1.00 25.23      A    C
ATOM  15208  CG1 ILE F 120    -13.482  88.505  60.636  1.00 23.97      A    C
ATOM  15209  CD1 ILE F 120    -14.024  88.613  59.384  1.00 25.26      A    C
ATOM  15210  CG2 ILE F 120    -11.347  87.502  60.247  1.00 22.92      A    C
ATOM  15211  C   ILE F 120    -10.135  88.744  62.313  1.00 25.51      A    C
ATOM  15212  O   ILE F 120     -9.836  87.725  62.862  1.00 24.41      A    O
ATOM  15213  N   ALA F 121     -9.227  89.600  61.916  1.00 24.82      A    N
ATOM  15214  CA  ALA F 121     -7.832  89.393  62.158  1.00 24.07      A    C
ATOM  15215  CB  ALA F 121     -7.028  90.412  61.451  1.00 21.43      A    C
ATOM  15216  C   ALA F 121     -7.459  89.313  63.639  1.00 24.16      A    C
ATOM  15217  O   ALA F 121     -6.677  88.509  64.010  1.00 23.37      A    O
ATOM  15218  N   VAL F 122     -8.015  90.147  64.485  1.00 25.09      A    N
ATOM  15219  CA  VAL F 122     -7.777  90.032  65.900  1.00 24.67      A    C
ATOM  15220  CB  VAL F 122     -8.342  91.222  66.659  1.00 25.58      A    C
ATOM  15221  CG1 VAL F 122     -8.335  90.991  68.097  1.00 23.55      A    C
ATOM  15222  CG2 VAL F 122     -7.562  92.430  66.363  1.00 21.58      A    C
ATOM  15223  C   VAL F 122     -8.310  88.759  66.482  1.00 25.47      A    C
ATOM  15224  O   VAL F 122     -7.657  88.096  67.202  1.00 27.51      A    O
ATOM  15225  N   SER F 123     -9.494  88.387  66.095  1.00 26.40      A    N
ATOM  15226  CA  SER F 123    -10.108  87.176  66.567  1.00 27.16      A    C
ATOM  15227  CB  SER F 123    -11.484  87.086  65.949  1.00 26.69      A    C
ATOM  15228  OG  SER F 123    -12.450  86.772  66.880  1.00 30.02      A    O
ATOM  15229  C   SER F 123     -9.332  85.920  66.196  1.00 27.48      A    C
ATOM  15230  O   SER F 123     -9.219  85.039  66.968  1.00 27.28      A    O
ATOM  15231  N   LYS F 124     -8.836  85.852  64.985  1.00 27.53      A    N
ATOM  15232  CA  LYS F 124     -7.971  84.799  64.551  1.00 26.91      A    C
ATOM  15233  CB  LYS F 124     -7.879  84.743  63.044  1.00 26.18      A    C
ATOM  15234  CG  LYS F 124     -8.910  83.859  62.447  1.00 26.47      A    C
ATOM  15235  CD  LYS F 124     -9.200  84.150  61.025  1.00 26.21      A    C
ATOM  15236  CE  LYS F 124     -9.594  82.928  60.298  1.00 29.55      A    C
ATOM  15237  NZ  LYS F 124    -11.025  82.631  60.323  1.00 32.03      A    N
ATOM  15238  C   LYS F 124     -6.621  84.788  65.237  1.00 28.24      A    C
ATOM  15239  O   LYS F 124     -6.071  83.750  65.471  1.00 28.03      A    O
```

Appendix 1

```
ATOM  15240  N    MET F 125   -6.100  85.949  65.572  1.00  26.55    A  N
ATOM  15241  CA   MET F 125   -4.816  86.037  66.217  1.00  27.25    A  C
ATOM  15242  CB   MET F 125   -4.382  87.476  66.339  1.00  26.65    F  C
ATOM  15243  CG   MET F 125   -2.950  87.686  66.517  1.00  24.00    F  C
ATOM  15244  SD   MET F 125   -1.970  87.423  65.112  1.00  22.16    F  S
ATOM  15245  CE   MET F 125   -0.542  88.266  65.561  1.00  14.35    F  C
ATOM  15246  C    MET F 125   -4.815  85.360  67.554  1.00  29.64    A  C
ATOM  15247  O    MET F 125   -3.838  84.808  67.975  1.00  30.06    A  O
ATOM  15248  N    LYS F 126   -5.953  85.423  68.206  1.00  31.97    A  N
ATOM  15249  CA   LYS F 126   -6.152  84.919  69.539  1.00  34.02    A  C
ATOM  15250  CB   LYS F 126   -7.333  85.638  70.164  1.00  34.19    A  C
ATOM  15251  CG   LYS F 126   -7.048  87.002  70.720  1.00  34.91    A  C
ATOM  15252  CD   LYS F 126   -8.264  87.885  70.776  1.00  38.19    A  C
ATOM  15253  CE   LYS F 126   -9.056  87.740  72.057  1.00  41.23    A  C
ATOM  15254  NZ   LYS F 126   -8.939  88.884  73.012  1.00  42.13    A  N
ATOM  15255  C    LYS F 126   -6.346  83.416  69.612  1.00  34.39    A  C
ATOM  15256  O    LYS F 126   -6.279  82.844  70.652  1.00  35.72    A  O
ATOM  15257  N    CYS F 127   -6.584  82.788  68.485  1.00  34.52    A  N
ATOM  15258  CA   CYS F 127   -6.756  81.356  68.386  1.00  33.95    A  C
ATOM  15259  CB   CYS F 127   -7.240  81.007  67.001  1.00  32.82    A  C
ATOM  15260  SG   CYS F 127   -8.925  81.264  66.697  1.00  40.89    A  S
ATOM  15261  C    CYS F 127   -5.480  80.614  68.672  1.00  33.54    A  C
ATOM  15262  O    CYS F 127   -4.430  81.053  68.337  1.00  32.46    A  O
ATOM  15263  N    LYS F 128   -5.602  79.466  69.298  1.00  33.67    A  N
ATOM  15264  CA   LYS F 128   -4.475  78.698  69.788  1.00  33.82    A  C
ATOM  15265  CB   LYS F 128   -4.953  77.555  70.652  1.00  33.59    A  C
ATOM  15266  CG   LYS F 128   -4.157  77.390  71.849  1.00  35.68    A  C
ATOM  15267  CD   LYS F 128   -3.895  75.997  72.088  1.00  40.88    A  C
ATOM  15268  CE   LYS F 128   -2.952  75.860  73.189  1.00  44.72    A  C
ATOM  15269  NZ   LYS F 128   -3.328  74.742  74.035  1.00  46.93    A  N
ATOM  15270  C    LYS F 128   -3.546  78.184  68.724  1.00  32.79    A  C
ATOM  15271  O    LYS F 128   -2.394  77.985  68.960  1.00  32.01    A  O
ATOM  15272  N    ARG F 129   -4.098  77.986  67.554  1.00  31.56    A  N
ATOM  15273  CA   ARG F 129   -3.401  77.589  66.385  1.00  32.24    A  C
ATOM  15274  CB   ARG F 129   -4.412  77.477  65.250  1.00  32.01    A  C
ATOM  15275  CG   ARG F 129   -3.854  77.218  63.897  1.00  34.06    A  C
ATOM  15276  CD   ARG F 129   -2.943  76.079  63.938  1.00  32.13    A  C
ATOM  15277  NE   ARG F 129   -2.262  75.809  62.699  1.00  35.47    A  N
ATOM  15278  CZ   ARG F 129   -1.477  74.767  62.538  1.00  36.12    A  C
ATOM  15279  NH1  ARG F 129   -1.313  73.939  63.531  1.00  35.63    A  N
ATOM  15280  NH2  ARG F 129   -0.880  74.545  61.403  1.00  27.76    A  N
ATOM  15281  C    ARG F 129   -2.365  78.610  66.029  1.00  32.08    A  C
ATOM  15282  O    ARG F 129   -1.319  78.257  65.585  1.00  33.85    A  O
ATOM  15283  N    VAL F 130   -2.680  79.878  66.156  1.00  30.62    A  N
ATOM  15284  CA   VAL F 130   -1.688  80.922  66.039  1.00  28.59    A  C
ATOM  15285  CB   VAL F 130   -2.370  82.228  65.837  1.00  28.35    A  C
ATOM  15286  CG1  VAL F 130   -1.419  83.236  65.469  1.00  26.88    A  C
ATOM  15287  CG2  VAL F 130   -3.334  82.074  64.793  1.00  27.77    A  C
ATOM  15288  C    VAL F 130   -0.624  81.069  67.118  1.00  27.76    A  C
ATOM  15289  O    VAL F 130    0.502  81.194  66.805  1.00  27.14    A  O
ATOM  15290  N    TRP F 131   -1.007  81.066  68.377  1.00  26.64    A  N
ATOM  15291  CA   TRP F 131   -0.088  81.215  69.485  1.00  27.19    A  C
ATOM  15292  CB   TRP F 131   -0.643  82.177  70.535  1.00  26.84    A  C
ATOM  15293  CG   TRP F 131   -1.840  81.715  71.197  1.00  29.62    A  C
```

Appendix 1

```
ATOM  15294  CD1 TRP F 131    -3.069  82.032  70.887  1.00  28.55      A  C
ATOM  15295  NE1 TRP F 131    -3.933  81.400  71.675  1.00  29.47      A  N
ATOM  15296  CE2 TRP F 131    -3.239  80.631  72.546  1.00  32.52      A  C
ATOM  15297  CD2 TRP F 131    -1.918  80.814  72.272  1.00  28.57      A  C
ATOM  15298  CE3 TRP F 131    -0.988  80.135  73.025  1.00  30.46      A  C
ATOM  15299  CZ3 TRP F 131    -1.414  79.336  74.003  1.00  34.27      A  C
ATOM  15300  CH2 TRP F 131    -2.731  79.184  74.270  1.00  32.58      A  C
ATOM  15301  CZ2 TRP F 131    -3.670  79.820  73.552  1.00  33.81      A  C
ATOM  15302  C   TRP F 131     0.436  79.965  70.170  1.00  26.79      A  C
ATOM  15303  O   TRP F 131     1.296  80.066  70.970  1.00  27.41      A  O
ATOM  15304  N   GLY F 132    -0.045  78.796  69.823  1.00  25.55      A  N
ATOM  15305  CA  GLY F 132     0.278  77.570  70.510  1.00  26.37      A  C
ATOM  15306  C   GLY F 132     1.687  77.039  70.435  1.00  27.44      A  C
ATOM  15307  O   GLY F 132     2.038  76.130  71.079  1.00  27.89      A  O
ATOM  15308  N   ASP F 133     2.498  77.609  69.601  1.00  28.82      A  N
ATOM  15309  CA  ASP F 133     3.849  77.217  69.559  1.00  29.96      A  C
ATOM  15310  CB  ASP F 133     4.595  77.811  68.383  1.00  30.40      A  C
ATOM  15311  CG  ASP F 133     4.279  79.220  68.137  1.00  32.05      A  C
ATOM  15312  OD1 ASP F 133     5.097  80.055  68.397  1.00  33.10      A  O
ATOM  15313  OD2 ASP F 133     3.257  79.506  67.588  1.00  33.31      A  O-1
ATOM  15314  C   ASP F 133     4.503  77.532  70.848  1.00  30.58      A  C
ATOM  15315  O   ASP F 133     5.365  76.833  71.256  1.00  32.18      A  O
ATOM  15316  N   TRP F 134     4.089  78.594  71.499  1.00  31.16      A  N
ATOM  15317  CA  TRP F 134     4.697  78.996  72.736  1.00  31.06      A  C
ATOM  15318  CB  TRP F 134     4.092  80.327  73.156  1.00  29.58      A  C
ATOM  15319  CG  TRP F 134     4.582  80.940  74.417  1.00  27.91      A  C
ATOM  15320  CD1 TRP F 134     3.960  80.926  75.588  1.00  25.30      A  C
ATOM  15321  NE1 TRP F 134     4.668  81.563  76.509  1.00  23.78      A  N
ATOM  15322  CE2 TRP F 134     5.791  82.048  75.931  1.00  25.96      A  C
ATOM  15323  CD2 TRP F 134     5.762  81.674  74.612  1.00  24.61      A  C
ATOM  15324  CE3 TRP F 134     6.811  82.031  73.807  1.00  25.71      A  C
ATOM  15325  CZ3 TRP F 134     7.812  82.741  74.332  1.00  27.77      A  C
ATOM  15326  CH2 TRP F 134     7.819  83.091  75.638  1.00  29.55      A  C
ATOM  15327  CZ2 TRP F 134     6.808  82.767  76.458  1.00  28.54      A  C
ATOM  15328  C   TRP F 134     4.549  77.958  73.821  1.00  32.43      A  C
ATOM  15329  O   TRP F 134     5.482  77.681  74.499  1.00  32.98      A  O
ATOM  15330  N   GLU F 135     3.368  77.407  73.989  1.00  33.68      A  N
ATOM  15331  CA  GLU F 135     3.186  76.249  74.831  1.00  36.71      A  C
ATOM  15332  CB  GLU F 135     1.736  76.087  75.267  1.00  36.48      A  C
ATOM  15333  CG  GLU F 135     1.354  74.715  75.657  1.00  41.10      A  C
ATOM  15334  CD  GLU F 135    -0.067  74.617  76.064  1.00  50.85      A  C
ATOM  15335  OE1 GLU F 135    -0.698  75.655  76.157  1.00  54.75      A  O
ATOM  15336  OE2 GLU F 135    -0.577  73.521  76.300  1.00  53.03      A  O-1
ATOM  15337  C   GLU F 135     3.823  74.957  74.305  1.00  37.71      A  C
ATOM  15338  O   GLU F 135     4.365  74.187  75.048  1.00  37.97      A  O
ATOM  15339  N   GLU F 136     3.769  74.734  73.015  1.00  38.50      A  N
ATOM  15340  CA  GLU F 136     4.364  73.561  72.428  1.00  40.21      A  C
ATOM  15341  CB  GLU F 136     4.081  73.543  70.960  1.00  41.58      A  C
ATOM  15342  CG  GLU F 136     3.516  72.282  70.483  1.00  50.04      A  C
ATOM  15343  CD  GLU F 136     2.065  72.141  70.799  1.00  62.36      A  C
ATOM  15344  OE1 GLU F 136     1.708  71.940  71.978  1.00  67.42      A  O
ATOM  15345  OE2 GLU F 136     1.268  72.219  69.860  1.00  65.97      A  O-1
ATOM  15346  C   GLU F 136     5.845  73.505  72.621  1.00  39.51      A  C
ATOM  15347  O   GLU F 136     6.399  72.466  72.815  1.00  40.01      A  O
```

Appendix 1

```
ATOM  15348  N    ASP F 137    6.483  74.651  72.615  1.00  39.38    A  N
ATOM  15349  CA   ASP F 137    7.909  74.746  72.795  1.00  39.59    A  C
ATOM  15350  CB   ASP F 137    8.439  75.994  72.131  1.00  39.54    A  C
ATOM  15351  CG   ASP F 137    8.524  75.864  70.659  1.00  43.41    A  C
ATOM  15352  OD1  ASP F 137    8.423  74.758  70.138  1.00  43.71    A  O
ATOM  15353  OD2  ASP F 137    8.706  76.874  69.999  1.00  47.65    A  O-1
ATOM  15354  C    ASP F 137    8.305  74.721  74.245  1.00  39.44    A  C
ATOM  15355  O    ASP F 137    9.456  74.702  74.563  1.00  39.94    A  O
ATOM  15356  N    GLY F 138    7.335  74.687  75.130  1.00  39.48    A  N
ATOM  15357  CA   GLY F 138    7.569  74.598  76.548  1.00  38.75    A  C
ATOM  15358  C    GLY F 138    7.661  75.890  77.296  1.00  39.28    A  C
ATOM  15359  O    GLY F 138    7.877  75.914  78.449  1.00  39.12    A  O
ATOM  15360  N    PHE F 139    7.514  76.985  76.617  1.00  39.59    A  N
ATOM  15361  CA   PHE F 139    7.589  78.247  77.280  1.00  40.17    A  C
ATOM  15362  CB   PHE F 139    7.868  79.337  76.282  1.00  41.11    A  C
ATOM  15363  CG   PHE F 139    9.038  79.077  75.412  1.00  42.39    A  C
ATOM  15364  CD1  PHE F 139   10.288  78.974  75.926  1.00  45.09    A  C
ATOM  15365  CE1  PHE F 139   11.357  78.761  75.118  1.00  41.85    A  C
ATOM  15366  CZ   PHE F 139   11.194  78.669  73.819  1.00  41.65    A  C
ATOM  15367  CE2  PHE F 139    9.977  78.772  73.284  1.00  42.23    A  C
ATOM  15368  CD2  PHE F 139    8.899  78.971  74.071  1.00  42.39    A  C
ATOM  15369  C    PHE F 139    6.505  78.659  78.258  1.00  40.17    A  C
ATOM  15370  O    PHE F 139    6.770  79.368  79.151  1.00  40.66    A  O
ATOM  15371  N    GLY F 140    5.269  78.277  78.079  1.00  40.83    A  N
ATOM  15372  CA   GLY F 140    4.275  78.655  79.051  1.00  40.31    A  C
ATOM  15373  C    GLY F 140    2.929  78.253  78.566  1.00  40.85    A  C
ATOM  15374  O    GLY F 140    2.835  77.771  77.490  1.00  41.61    A  O
ATOM  15375  N    THR F 141    1.885  78.462  79.335  1.00  40.88    A  N
ATOM  15376  CA   THR F 141    0.548  78.228  78.818  1.00  40.26    A  C
ATOM  15377  CB   THR F 141   -0.243  77.368  79.720  1.00  40.60    A  C
ATOM  15378  OG1  THR F 141   -0.296  77.973  81.001  1.00  42.45    A  O
ATOM  15379  CG2  THR F 141    0.420  76.064  79.822  1.00  39.03    A  C
ATOM  15380  C    THR F 141   -0.220  79.483  78.523  1.00  39.85    A  C
ATOM  15381  O    THR F 141   -1.317  79.441  78.063  1.00  39.38    A  O
ATOM  15382  N    ASP F 142    0.410  80.602  78.770  1.00  39.90    A  N
ATOM  15383  CA   ASP F 142   -0.136  81.862  78.436  1.00  39.98    A  C
ATOM  15384  CB   ASP F 142   -0.253  82.638  79.702  1.00  40.48    A  C
ATOM  15385  CG   ASP F 142   -1.429  83.488  79.714  1.00  46.75    A  C
ATOM  15386  OD1  ASP F 142   -2.545  82.961  79.743  1.00  53.16    A  O
ATOM  15387  OD2  ASP F 142   -1.254  84.684  79.678  1.00  49.84    A  O-1
ATOM  15388  C    ASP F 142    0.762  82.637  77.521  1.00  39.62    A  C
ATOM  15389  O    ASP F 142    1.843  83.000  77.894  1.00  39.16    A  O
ATOM  15390  N    PRO F 143    0.267  82.945  76.341  1.00  38.26    A  N
ATOM  15391  CA   PRO F 143    0.981  83.719  75.339  1.00  37.56    A  C
ATOM  15392  CB   PRO F 143    0.029  83.697  74.157  1.00  36.33    A  C
ATOM  15393  CG   PRO F 143   -0.990  82.820  74.483  1.00  36.46    A  C
ATOM  15394  CD   PRO F 143   -1.088  82.659  75.902  1.00  38.01    A  C
ATOM  15395  C    PRO F 143    1.321  85.162  75.689  1.00  38.19    A  C
ATOM  15396  O    PRO F 143    2.183  85.695  75.052  1.00  38.25    A  O
ATOM  15397  N    ILE F 144    0.645  85.802  76.616  1.00  37.96    A  N
ATOM  15398  CA   ILE F 144    0.888  87.203  76.821  1.00  39.29    A  C
ATOM  15399  CB   ILE F 144   -0.358  88.019  76.556  1.00  39.98    A  C
ATOM  15400  CG1  ILE F 144   -1.453  87.647  77.527  1.00  39.33    A  C
ATOM  15401  CD1  ILE F 144   -2.199  88.740  77.990  1.00  38.17    A  C
```

Appendix 1

```
ATOM  15402  CG2  ILE  F  144   -0.824  87.800  75.172  1.00  38.62  A  C
ATOM  15403  C    ILE  F  144    1.474  87.624  78.149  1.00  40.99  A  C
ATOM  15404  O    ILE  F  144    1.895  88.727  78.292  1.00  39.78  A  O
ATOM  15405  N    GLU  F  145    1.542  86.724  79.112  1.00  42.59  A  N
ATOM  15406  CA   GLU  F  145    1.959  87.063  80.453  1.00  45.23  A  C
ATOM  15407  CB   GLU  F  145    2.011  85.739  81.218  1.00  46.35  A  C
ATOM  15408  CG   GLU  F  145    1.398  85.689  82.594  1.00  52.89  A  C
ATOM  15409  CD   GLU  F  145    1.589  84.346  83.295  1.00  61.20  A  C
ATOM  15410  OE1  GLU  F  145    0.582  83.710  83.686  1.00  60.88  A  O
ATOM  15411  OE2  GLU  F  145    2.744  83.930  83.465  1.00  64.14  A  O-1
ATOM  15412  C    GLU  F  145    3.359  87.624  80.553  1.00  44.81  A  C
ATOM  15413  O    GLU  F  145    3.537  88.723  80.992  1.00  44.96  A  O
ATOM  15414  N    LYS  F  146    4.359  86.848  80.185  1.00  44.83  A  N
ATOM  15415  CA   LYS  F  146    5.721  87.317  80.163  1.00  43.84  A  C
ATOM  15416  CB   LYS  F  146    6.558  86.600  81.184  1.00  43.94  A  C
ATOM  15417  CG   LYS  F  146    6.266  85.172  81.298  1.00  45.71  A  C
ATOM  15418  CD   LYS  F  146    7.378  84.470  81.985  1.00  49.81  A  C
ATOM  15419  CE   LYS  F  146    6.967  83.108  82.427  1.00  52.07  A  C
ATOM  15420  NZ   LYS  F  146    7.231  82.060  81.408  1.00  50.73  A  N
ATOM  15421  C    LYS  F  146    6.274  87.058  78.807  1.00  43.11  A  C
ATOM  15422  O    LYS  F  146    5.823  86.169  78.137  1.00  42.06  A  O
ATOM  15423  N    GLU  F  147    7.197  87.897  78.377  1.00  42.49  A  N
ATOM  15424  CA   GLU  F  147    7.977  87.645  77.191  1.00  41.59  A  C
ATOM  15425  CB   GLU  F  147    8.747  86.364  77.373  1.00  42.29  A  C
ATOM  15426  CG   GLU  F  147   10.041  86.577  78.050  1.00  45.77  A  C
ATOM  15427  CD   GLU  F  147   10.382  85.503  79.009  1.00  53.76  A  C
ATOM  15428  OE1  GLU  F  147    9.941  84.372  78.826  1.00  55.34  A  O
ATOM  15429  OE2  GLU  F  147   11.104  85.791  79.961  1.00  56.81  A  O-1
ATOM  15430  C    GLU  F  147    7.114  87.573  75.966  1.00  40.22  A  C
ATOM  15431  O    GLU  F  147    6.060  88.126  75.960  1.00  40.33  A  O
ATOM  15432  N    ASN  F  148    7.553  86.846  74.950  1.00  37.67  A  N
ATOM  15433  CA   ASN  F  148    6.766  86.578  73.750  1.00  34.95  A  C
ATOM  15434  CB   ASN  F  148    5.582  85.699  74.064  1.00  34.07  A  C
ATOM  15435  CG   ASN  F  148    5.127  84.941  72.891  1.00  34.43  A  C
ATOM  15436  OD1  ASN  F  148    5.879  84.724  71.992  1.00  39.59  A  O
ATOM  15437  ND2  ASN  F  148    3.913  84.526  72.892  1.00  26.62  A  N
ATOM  15438  C    ASN  F  148    6.290  87.775  72.983  1.00  34.22  A  C
ATOM  15439  O    ASN  F  148    5.216  87.808  72.501  1.00  32.00  A  O
ATOM  15440  N    ILE  F  149    7.139  88.757  72.890  1.00  34.85  A  N
ATOM  15441  CA   ILE  F  149    6.811  89.983  72.255  1.00  35.64  A  C
ATOM  15442  CB   ILE  F  149    7.840  91.085  72.576  1.00  35.16  A  C
ATOM  15443  CG1  ILE  F  149    7.283  92.441  72.246  1.00  36.63  A  C
ATOM  15444  CD1  ILE  F  149    6.407  92.951  73.259  1.00  37.77  A  C
ATOM  15445  CG2  ILE  F  149    9.078  90.929  71.828  1.00  34.36  A  C
ATOM  15446  C    ILE  F  149    6.571  89.738  70.782  1.00  36.67  A  C
ATOM  15447  O    ILE  F  149    5.881  90.476  70.131  1.00  36.69  A  O
ATOM  15448  N    MET  F  150    7.121  88.664  70.262  1.00  37.05  A  N
ATOM  15449  CA   MET  F  150    6.972  88.418  68.862  1.00  37.13  A  C
ATOM  15450  CB   MET  F  150    7.812  87.225  68.421  1.00  39.22  F  C
ATOM  15451  CG   MET  F  150    7.899  86.075  69.404  1.00  43.27  F  C
ATOM  15452  SD   MET  F  150    8.618  84.555  68.787  1.00  51.22  F  S
ATOM  15453  CE   MET  F  150    7.749  84.386  67.283  1.00  51.69  F  C
ATOM  15454  C    MET  F  150    5.540  88.221  68.464  1.00  35.36  A  C
ATOM  15455  O    MET  F  150    5.152  88.698  67.447  1.00  37.01  A  O
```

Appendix 1

```
ATOM  15456  N    TYR F 151      4.782  87.454  69.213  1.00 32.27      A  N
ATOM  15457  CA   TYR F 151      3.348  87.441  69.113  1.00 29.48      A  C
ATOM  15458  CB   TYR F 151      2.862  86.172  69.754  1.00 27.91      A  C
ATOM  15459  CG   TYR F 151      1.403  86.079  69.982  1.00 26.44      A  C
ATOM  15460  CD1  TYR F 151      0.550  85.801  68.959  1.00 28.40      A  C
ATOM  15461  CE1  TYR F 151     -0.743  85.710  69.166  1.00 26.15      A  C
ATOM  15462  CZ   TYR F 151     -1.209  85.870  70.399  1.00 24.69      A  C
ATOM  15463  OH   TYR F 151     -2.515  85.756  70.583  1.00 28.62      A  O
ATOM  15464  CE2  TYR F 151     -0.401  86.133  71.422  1.00 20.93      A  C
ATOM  15465  CD2  TYR F 151      0.880  86.231  71.222  1.00 22.75      A  C
ATOM  15466  C    TYR F 151      2.601  88.651  69.665  1.00 28.92      A  C
ATOM  15467  O    TYR F 151      1.788  89.198  69.030  1.00 28.32      A  O
ATOM  15468  N    LYS F 152      2.924  89.035  70.876  1.00 29.26      A  N
ATOM  15469  CA   LYS F 152      2.221  89.991  71.704  1.00 28.96      A  C
ATOM  15470  CB   LYS F 152      2.977  90.121  72.998  1.00 30.19      A  C
ATOM  15471  CG   LYS F 152      2.224  89.910  74.204  1.00 30.59      A  C
ATOM  15472  CD   LYS F 152      3.139  89.510  75.293  1.00 32.51      A  C
ATOM  15473  CE   LYS F 152      4.173  90.507  75.583  1.00 32.56      A  C
ATOM  15474  NZ   LYS F 152      4.686  90.228  76.904  1.00 30.54      A  N
ATOM  15475  C    LYS F 152      2.158  91.363  71.167  1.00 28.12      A  C
ATOM  15476  O    LYS F 152      1.180  92.005  71.312  1.00 28.93      A  O
ATOM  15477  N    GLY F 153      3.252  91.831  70.615  1.00 25.48      A  N
ATOM  15478  CA   GLY F 153      3.318  93.105  69.954  1.00 25.90      A  C
ATOM  15479  C    GLY F 153      2.489  93.247  68.712  1.00 26.23      A  C
ATOM  15480  O    GLY F 153      1.919  94.260  68.467  1.00 27.39      A  O
ATOM  15481  N    HIS F 154      2.441  92.215  67.914  1.00 25.88      A  N
ATOM  15482  CA   HIS F 154      1.566  92.234  66.805  1.00 24.60      A  C
ATOM  15483  CB   HIS F 154      1.830  91.040  65.914  1.00 24.04      A  C
ATOM  15484  CG   HIS F 154      3.106  91.144  65.143  1.00 28.14      A  C
ATOM  15485  ND1  HIS F 154      3.333  92.131  64.224  1.00 25.54      A  N
ATOM  15486  CE1  HIS F 154      4.529  91.985  63.708  1.00 23.62      A  C
ATOM  15487  NE2  HIS F 154      5.095  90.954  64.276  1.00 22.98      A  N
ATOM  15488  CD2  HIS F 154      4.227  90.403  65.170  1.00 27.65      A  C
ATOM  15489  C    HIS F 154      0.143  92.319  67.289  1.00 24.18      A  C
ATOM  15490  O    HIS F 154     -0.594  93.100  66.801  1.00 25.70      A  O
ATOM  15491  N    LEU F 155     -0.230  91.569  68.291  1.00 21.59      A  N
ATOM  15492  CA   LEU F 155     -1.558  91.637  68.778  1.00 20.51      A  C
ATOM  15493  CB   LEU F 155     -1.777  90.563  69.817  1.00 20.10      A  C
ATOM  15494  CG   LEU F 155     -3.144  90.486  70.430  1.00 20.40      A  C
ATOM  15495  CD1  LEU F 155     -4.171  90.363  69.440  1.00 18.51      A  C
ATOM  15496  CD2  LEU F 155     -3.241  89.417  71.374  1.00 17.85      A  C
ATOM  15497  C    LEU F 155     -1.891  92.983  69.322  1.00 21.56      A  C
ATOM  15498  O    LEU F 155     -2.935  93.473  69.094  1.00 21.57      A  O
ATOM  15499  N    ASN F 156     -0.997  93.587  70.070  1.00 21.90      A  N
ATOM  15500  CA   ASN F 156     -1.233  94.903  70.608  1.00 22.74      A  C
ATOM  15501  CB   ASN F 156     -0.207  95.252  71.655  1.00 23.15      A  C
ATOM  15502  CG   ASN F 156     -0.756  96.131  72.705  1.00 25.00      A  C
ATOM  15503  OD1  ASN F 156     -1.728  95.827  73.284  1.00 28.82      A  O
ATOM  15504  ND2  ASN F 156     -0.155  97.226  72.918  1.00 20.70      A  N
ATOM  15505  C    ASN F 156     -1.358  96.020  69.598  1.00 23.72      A  C
ATOM  15506  O    ASN F 156     -2.129  96.915  69.758  1.00 23.39      A  O
ATOM  15507  N    LEU F 157     -0.536  95.987  68.577  1.00 23.43      A  N
ATOM  15508  CA   LEU F 157     -0.656  96.901  67.502  1.00 23.36      A  C
ATOM  15509  CB   LEU F 157      0.572  96.853  66.588  1.00 20.67      A  C
```

Appendix 1

```
ATOM  15510  CG   LEU F 157     0.695  97.852  65.448  1.00  22.45      A  C
ATOM  15511  CD1  LEU F 157     0.516  99.251  65.839  1.00  11.91      A  C
ATOM  15512  CD2  LEU F 157     1.888  97.695  64.662  1.00  18.67      A  C
ATOM  15513  C    LEU F 157    -1.967  96.668  66.784  1.00  24.55      A  C
ATOM  15514  O    LEU F 157    -2.636  97.593  66.479  1.00  24.63      A  O
ATOM  15515  N    MET F 158    -2.350  95.427  66.563  1.00  23.76      A  N
ATOM  15516  CA   MET F 158    -3.591  95.133  65.874  1.00  25.52      A  C
ATOM  15517  CB   MET F 158    -3.741  93.650  65.529  1.00  26.93      F  C
ATOM  15518  CG   MET F 158    -2.680  93.057  64.646  1.00  30.94      F  C
ATOM  15519  SD   MET F 158    -2.749  91.290  64.419  1.00  31.88      F  S
ATOM  15520  CE   MET F 158    -4.430  91.125  64.132  1.00  31.42      F  C
ATOM  15521  C    MET F 158    -4.797  95.636  66.635  1.00  25.14      A  C
ATOM  15522  O    MET F 158    -5.722  96.141  66.072  1.00  24.24      A  O
ATOM  15523  N    TYR F 159    -4.742  95.535  67.937  1.00  24.06      A  N
ATOM  15524  CA   TYR F 159    -5.792  96.058  68.765  1.00  24.49      A  C
ATOM  15525  CB   TYR F 159    -5.387  95.883  70.207  1.00  23.23      A  C
ATOM  15526  CG   TYR F 159    -5.641  94.581  70.867  1.00  20.77      A  C
ATOM  15527  CD1  TYR F 159    -6.675  93.785  70.525  1.00  21.34      A  C
ATOM  15528  CE1  TYR F 159    -6.885  92.632  71.155  1.00  22.00      A  C
ATOM  15529  CZ   TYR F 159    -6.066  92.257  72.165  1.00  23.05      A  C
ATOM  15530  OH   TYR F 159    -6.238  91.086  72.830  1.00  21.13      A  O
ATOM  15531  CE2  TYR F 159    -5.048  93.043  72.500  1.00  23.05      A  C
ATOM  15532  CD2  TYR F 159    -4.849  94.176  71.870  1.00  22.83      A  C
ATOM  15533  C    TYR F 159    -5.978  97.551  68.591  1.00  24.67      A  C
ATOM  15534  O    TYR F 159    -7.065  98.003  68.444  1.00  25.49      A  O
ATOM  15535  N    GLY F 160    -4.917  98.315  68.643  1.00  24.76      A  N
ATOM  15536  CA   GLY F 160    -5.007  99.713  68.411  1.00  25.12      A  C
ATOM  15537  C    GLY F 160    -5.423 100.078  67.029  1.00  27.15      A  C
ATOM  15538  O    GLY F 160    -6.236 100.918  66.935  1.00  28.55      A  O
ATOM  15539  N    LEU F 161    -4.862  99.410  66.056  1.00  27.28      A  N
ATOM  15540  CA   LEU F 161    -5.155  99.686  64.683  1.00  27.98      A  C
ATOM  15541  CB   LEU F 161    -4.283  98.827  63.794  1.00  27.13      A  C
ATOM  15542  CG   LEU F 161    -3.192  99.525  63.033  1.00  27.85      A  C
ATOM  15543  CD1  LEU F 161    -2.850 100.776  63.617  1.00  27.83      A  C
ATOM  15544  CD2  LEU F 161    -2.004  98.697  62.918  1.00  29.52      A  C
ATOM  15545  C    LEU F 161    -6.614  99.461  64.365  1.00  27.92      A  C
ATOM  15546  O    LEU F 161    -7.200 100.196  63.626  1.00  28.31      A  O
ATOM  15547  N    TYR F 162    -7.198  98.438  64.938  1.00  28.55      A  N
ATOM  15548  CA   TYR F 162    -8.611  98.220  64.803  1.00  29.48      A  C
ATOM  15549  CB   TYR F 162    -8.985  96.854  65.389  1.00  28.71      A  C
ATOM  15550  CG   TYR F 162   -10.441  96.660  65.701  1.00  29.57      A  C
ATOM  15551  CD1  TYR F 162   -11.298  96.183  64.762  1.00  31.95      A  C
ATOM  15552  CE1  TYR F 162   -12.600  96.042  65.017  1.00  30.45      A  C
ATOM  15553  CZ   TYR F 162   -13.067  96.351  66.206  1.00  30.42      A  C
ATOM  15554  OH   TYR F 162   -14.364  96.184  66.411  1.00  33.88      A  O
ATOM  15555  CE2  TYR F 162   -12.260  96.845  67.161  1.00  29.71      A  C
ATOM  15556  CD2  TYR F 162   -10.960  96.990  66.915  1.00  27.11      A  C
ATOM  15557  C    TYR F 162    -9.464  99.333  65.397  1.00  29.49      A  C
ATOM  15558  O    TYR F 162   -10.395  99.723  64.802  1.00  29.31      A  O
ATOM  15559  N    GLN F 163    -9.154  99.825  66.581  1.00  29.74      A  N
ATOM  15560  CA   GLN F 163    -9.939 100.905  67.144  1.00  29.40      A  C
ATOM  15561  CB   GLN F 163    -9.665 101.116  68.632  1.00  29.38      A  C
ATOM  15562  CG   GLN F 163   -10.675 101.965  69.326  1.00  26.54      A  C
ATOM  15563  CD   GLN F 163   -10.514 101.950  70.801  1.00  30.76      A  C
```

Appendix 1

```
ATOM  15564  OE1  GLN F 163   -10.177 100.959  71.364  1.00 36.05      A  O
ATOM  15565  NE2  GLN F 163   -10.753 103.044  71.429  1.00 24.60      A  N
ATOM  15566  C    GLN F 163    -9.828 102.188  66.366  1.00 28.38      A  C
ATOM  15567  O    GLN F 163   -10.770 102.908  66.223  1.00 27.02      A  O
ATOM  15568  N    LEU F 164    -8.651 102.466  65.868  1.00 28.34      A  N
ATOM  15569  CA   LEU F 164    -8.416 103.654  65.110  1.00 29.07      A  C
ATOM  15570  CB   LEU F 164    -6.967 103.680  64.706  1.00 29.83      A  C
ATOM  15571  CG   LEU F 164    -5.945 104.654  65.246  1.00 32.33      A  C
ATOM  15572  CD1  LEU F 164    -5.861 104.622  66.716  1.00 33.81      A  C
ATOM  15573  CD2  LEU F 164    -4.630 104.280  64.697  1.00 30.20      A  C
ATOM  15574  C    LEU F 164    -9.267 103.656  63.868  1.00 29.65      A  C
ATOM  15575  O    LEU F 164    -9.841 104.642  63.526  1.00 30.35      A  O
ATOM  15576  N    VAL F 165    -9.327 102.542  63.187  1.00 28.47      A  N
ATOM  15577  CA   VAL F 165   -10.171 102.370  62.035  1.00 28.97      A  C
ATOM  15578  CB   VAL F 165    -9.852 101.061  61.387  1.00 28.53      A  C
ATOM  15579  CG1  VAL F 165   -10.796 100.742  60.329  1.00 29.19      A  C
ATOM  15580  CG2  VAL F 165    -8.551 101.124  60.846  1.00 28.21      A  C
ATOM  15581  C    VAL F 165   -11.657 102.448  62.301  1.00 28.99      A  C
ATOM  15582  O    VAL F 165   -12.381 103.077  61.608  1.00 29.00      A  O
ATOM  15583  N    THR F 166   -12.092 101.775  63.323  1.00 28.21      A  N
ATOM  15584  CA   THR F 166   -13.463 101.754  63.666  1.00 29.22      A  C
ATOM  15585  CB   THR F 166   -13.936 100.390  64.016  1.00 27.56      A  C
ATOM  15586  OG1  THR F 166   -13.390 100.037  65.266  1.00 26.21      A  O
ATOM  15587  CG2  THR F 166   -13.497  99.427  63.067  1.00 22.79      A  C
ATOM  15588  C    THR F 166   -13.641 102.544  64.902  1.00 32.54      A  C
ATOM  15589  O    THR F 166   -12.717 102.854  65.617  1.00 35.20      A  O
ATOM  15590  N    GLY F 167   -14.862 102.859  65.194  1.00 33.76      A  N
ATOM  15591  CA   GLY F 167   -15.115 103.431  66.477  1.00 36.04      A  C
ATOM  15592  C    GLY F 167   -14.846 102.495  67.614  1.00 36.19      A  C
ATOM  15593  O    GLY F 167   -14.618 102.928  68.678  1.00 37.43      A  O
ATOM  15594  N    SER F 168   -14.884 101.208  67.352  1.00 35.56      A  N
ATOM  15595  CA   SER F 168   -15.178 100.171  68.293  1.00 33.28      A  C
ATOM  15596  CB   SER F 168   -15.274  98.877  67.548  1.00 33.13      A  C
ATOM  15597  OG   SER F 168   -16.290  98.100  68.069  1.00 35.01      A  O
ATOM  15598  C    SER F 168   -14.229  99.999  69.442  1.00 33.36      A  C
ATOM  15599  O    SER F 168   -13.057 100.120  69.298  1.00 32.06      A  O
ATOM  15600  N    ARG F 169   -14.818  99.699  70.587  1.00 32.45      A  N
ATOM  15601  CA   ARG F 169   -14.182  99.478  71.863  1.00 32.92      A  C
ATOM  15602  CB   ARG F 169   -14.839 100.301  72.936  1.00 33.84      A  C
ATOM  15603  CG   ARG F 169   -14.525 101.716  72.945  1.00 38.07      A  C
ATOM  15604  CD   ARG F 169   -15.510 102.413  73.812  1.00 44.37      A  C
ATOM  15605  NE   ARG F 169   -15.209 102.291  75.234  1.00 49.86      A  N
ATOM  15606  CZ   ARG F 169   -16.117 102.229  76.200  1.00 51.54      A  C
ATOM  15607  NH1  ARG F 169   -17.391 102.263  75.925  1.00 53.02      A  N
ATOM  15608  NH2  ARG F 169   -15.747 102.127  77.443  1.00 50.62      A  N
ATOM  15609  C    ARG F 169   -14.345  98.033  72.240  1.00 32.74      A  C
ATOM  15610  O    ARG F 169   -14.308  97.688  73.376  1.00 31.78      A  O
ATOM  15611  N    ARG F 170   -14.529  97.201  71.243  1.00 31.26      A  N
ATOM  15612  CA   ARG F 170   -14.755  95.803  71.402  1.00 30.31      A  C
ATOM  15613  CB   ARG F 170   -14.955  95.209  70.022  1.00 30.68      A  C
ATOM  15614  CG   ARG F 170   -14.991  93.736  69.951  1.00 32.40      A  C
ATOM  15615  CD   ARG F 170   -15.635  93.238  68.696  1.00 37.28      A  C
ATOM  15616  NE   ARG F 170   -15.388  91.822  68.553  1.00 42.64      A  N
ATOM  15617  CZ   ARG F 170   -16.134  90.868  69.079  1.00 45.94      A  C
```

Appendix 1

```
ATOM  15618  NH1  ARG F 170   -17.225   91.161   69.751  1.00  42.02      A  N
ATOM  15619  NH2  ARG F 170   -15.785   89.614   68.918  1.00  46.55      A  N
ATOM  15620  C    ARG F 170   -13.590   95.136   72.098  1.00  30.56      A  C
ATOM  15621  O    ARG F 170   -13.767   94.270   72.911  1.00  30.62      A  O
ATOM  15622  N    TYR F 171   -12.384   95.538   71.780  1.00  29.48      A  N
ATOM  15623  CA   TYR F 171   -11.249   94.969   72.454  1.00  29.72      A  C
ATOM  15624  CB   TYR F 171   -10.259   94.415   71.469  1.00  29.72      A  C
ATOM  15625  CG   TYR F 171   -10.812   93.493   70.452  1.00  29.80      A  C
ATOM  15626  CD1  TYR F 171   -11.134   92.206   70.758  1.00  28.37      A  C
ATOM  15627  CE1  TYR F 171   -11.610   91.405   69.839  1.00  28.71      A  C
ATOM  15628  CZ   TYR F 171   -11.746   91.869   68.596  1.00  32.41      A  C
ATOM  15629  OH   TYR F 171   -12.212   91.094   67.627  1.00  37.79      A  O
ATOM  15630  CE2  TYR F 171   -11.426   93.118   68.273  1.00  29.60      A  C
ATOM  15631  CD2  TYR F 171   -10.962   93.906   69.182  1.00  28.09      A  C
ATOM  15632  C    TYR F 171   -10.516   95.894   73.390  1.00  30.20      A  C
ATOM  15633  O    TYR F 171    -9.467   95.578   73.808  1.00  29.80      A  O
ATOM  15634  N    GLU F 172   -11.077   97.032   73.719  1.00  30.60      A  N
ATOM  15635  CA   GLU F 172   -10.353   98.078   74.377  1.00  32.07      A  C
ATOM  15636  CB   GLU F 172   -11.182   99.353   74.390  1.00  32.94      A  C
ATOM  15637  CG   GLU F 172   -11.092  100.210   75.611  1.00  37.57      A  C
ATOM  15638  CD   GLU F 172   -11.877  101.485   75.495  1.00  42.43      A  C
ATOM  15639  OE1  GLU F 172   -12.780  101.734   76.285  1.00  42.88      A  O
ATOM  15640  OE2  GLU F 172   -11.581  102.276   74.630  1.00  44.86      A  O-1
ATOM  15641  C    GLU F 172    -9.871   97.638   75.733  1.00  32.81      A  C
ATOM  15642  O    GLU F 172    -8.818   98.013   76.173  1.00  33.39      A  O
ATOM  15643  N    ALA F 173   -10.644   96.811   76.396  1.00  32.87      A  N
ATOM  15644  CA   ALA F 173   -10.219   96.273   77.658  1.00  31.91      A  C
ATOM  15645  CB   ALA F 173   -11.341   95.576   78.304  1.00  31.30      A  C
ATOM  15646  C    ALA F 173    -9.014   95.374   77.575  1.00  31.69      A  C
ATOM  15647  O    ALA F 173    -8.125   95.461   78.361  1.00  32.78      A  O
ATOM  15648  N    GLU F 174    -8.998   94.486   76.619  1.00  30.27      A  N
ATOM  15649  CA   GLU F 174    -7.854   93.643   76.393  1.00  29.18      A  C
ATOM  15650  CB   GLU F 174    -8.150   92.700   75.267  1.00  29.41      A  C
ATOM  15651  CG   GLU F 174    -8.869   91.525   75.637  1.00  32.90      A  C
ATOM  15652  CD   GLU F 174    -9.564   90.954   74.487  1.00  42.58      A  C
ATOM  15653  OE1  GLU F 174   -10.699   91.326   74.241  1.00  46.54      A  O
ATOM  15654  OE2  GLU F 174    -8.985   90.125   73.798  1.00  45.27      A  O-1
ATOM  15655  C    GLU F 174    -6.653   94.453   76.007  1.00  27.71      A  C
ATOM  15656  O    GLU F 174    -5.567   94.143   76.337  1.00  26.84      A  O
ATOM  15657  N    HIS F 175    -6.895   95.483   75.246  1.00  27.04      A  N
ATOM  15658  CA   HIS F 175    -5.869   96.331   74.747  1.00  26.25      A  C
ATOM  15659  CB   HIS F 175    -6.551   97.369   73.916  1.00  24.98      A  C
ATOM  15660  CG   HIS F 175    -5.628   98.168   73.092  1.00  21.74      A  C
ATOM  15661  ND1  HIS F 175    -6.026   99.277   72.413  1.00  21.90      A  N
ATOM  15662  CE1  HIS F 175    -5.005   99.775   71.763  1.00  20.60      A  C
ATOM  15663  NE2  HIS F 175    -3.957   99.036   72.020  1.00  19.27      A  N
ATOM  15664  CD2  HIS F 175    -4.328   98.010   72.822  1.00  20.84      A  C
ATOM  15665  C    HIS F 175    -5.096   97.040   75.810  1.00  27.19      A  C
ATOM  15666  O    HIS F 175    -3.908   97.100   75.753  1.00  27.76      A  O
ATOM  15667  N    ALA F 176    -5.799   97.587   76.777  1.00  26.45      A  N
ATOM  15668  CA   ALA F 176    -5.207   98.235   77.912  1.00  25.93      A  C
ATOM  15669  CB   ALA F 176    -6.258   98.829   78.736  1.00  24.03      A  C
ATOM  15670  C    ALA F 176    -4.397   97.314   78.757  1.00  25.50      A  C
ATOM  15671  O    ALA F 176    -3.376   97.676   79.243  1.00  27.14      A  O
```

Appendix 1

```
ATOM  15672  N    HIS F 177    -4.892  96.126  78.956  1.00  24.95      A  N
ATOM  15673  CA   HIS F 177    -4.214  95.160  79.733  1.00  25.68      A  C
ATOM  15674  CB   HIS F 177    -5.125  93.964  79.885  1.00  25.36      A  C
ATOM  15675  CG   HIS F 177    -4.506  92.811  80.592  1.00  29.14      A  C
ATOM  15676  ND1  HIS F 177    -3.926  92.921  81.828  1.00  35.50      A  N
ATOM  15677  CE1  HIS F 177    -3.458  91.752  82.198  1.00  33.69      A  C
ATOM  15678  NE2  HIS F 177    -3.731  90.885  81.255  1.00  31.04      A  N
ATOM  15679  CD2  HIS F 177    -4.392  91.518  80.247  1.00  30.41      A  C
ATOM  15680  C    HIS F 177    -2.903  94.742  79.140  1.00  27.71      A  C
ATOM  15681  O    HIS F 177    -1.943  94.629  79.841  1.00  29.76      A  O
ATOM  15682  N    LEU F 178    -2.874  94.486  77.846  1.00  28.61      A  N
ATOM  15683  CA   LEU F 178    -1.648  94.193  77.128  1.00  28.24      A  C
ATOM  15684  CB   LEU F 178    -1.956  93.683  75.709  1.00  27.80      A  C
ATOM  15685  CG   LEU F 178    -0.922  92.963  74.850  1.00  24.87      A  C
ATOM  15686  CD1  LEU F 178    -0.204  92.028  75.658  1.00  23.20      A  C
ATOM  15687  CD2  LEU F 178    -1.492  92.261  73.710  1.00  20.68      A  C
ATOM  15688  C    LEU F 178    -0.707  95.363  77.074  1.00  28.39      A  C
ATOM  15689  O    LEU F 178     0.455  95.222  77.200  1.00  27.38      A  O
ATOM  15690  N    THR F 179    -1.233  96.532  76.840  1.00  28.66      A  N
ATOM  15691  CA   THR F 179    -0.396  97.663  76.706  1.00  29.05      A  C
ATOM  15692  CB   THR F 179    -1.207  98.869  76.339  1.00  29.07      A  C
ATOM  15693  OG1  THR F 179    -1.799  98.633  75.093  1.00  27.30      A  O
ATOM  15694  CG2  THR F 179    -0.379 100.054  76.195  1.00  27.87      A  C
ATOM  15695  C    THR F 179     0.303  97.815  78.030  1.00  30.29      A  C
ATOM  15696  O    THR F 179     1.464  98.071  78.077  1.00  29.95      A  O
ATOM  15697  N    ARG F 180    -0.425  97.605  79.101  1.00  31.02      A  N
ATOM  15698  CA   ARG F 180     0.113  97.675  80.436  1.00  31.75      A  C
ATOM  15699  CB   ARG F 180    -1.023  97.567  81.433  1.00  32.94      A  C
ATOM  15700  CG   ARG F 180    -0.728  98.021  82.819  1.00  38.90      A  C
ATOM  15701  CD   ARG F 180    -1.149  97.000  83.844  1.00  46.68      A  C
ATOM  15702  NE   ARG F 180    -0.033  96.146  84.213  1.00  52.62      A  N
ATOM  15703  CZ   ARG F 180    -0.070  94.832  84.187  1.00  52.01      A  C
ATOM  15704  NH1  ARG F 180    -1.162  94.232  83.824  1.00  51.82      A  N
ATOM  15705  NH2  ARG F 180     0.983  94.129  84.519  1.00  52.79      A  N
ATOM  15706  C    ARG F 180     1.198  96.651  80.740  1.00  30.30      A  C
ATOM  15707  O    ARG F 180     2.200  96.989  81.280  1.00  30.16      A  O
ATOM  15708  N    ILE F 181     1.008  95.414  80.347  1.00  29.04      A  N
ATOM  15709  CA   ILE F 181     2.002  94.391  80.502  1.00  27.74      A  C
ATOM  15710  CB   ILE F 181     1.437  93.063  80.007  1.00  27.71      A  C
ATOM  15711  CG1  ILE F 181     0.397  92.519  80.946  1.00  31.22      A  C
ATOM  15712  CD1  ILE F 181    -0.296  91.325  80.450  1.00  27.10      A  C
ATOM  15713  CG2  ILE F 181     2.467  92.035  79.888  1.00  24.45      A  C
ATOM  15714  C    ILE F 181     3.289  94.724  79.737  1.00  28.48      A  C
ATOM  15715  O    ILE F 181     4.348  94.522  80.220  1.00  29.81      A  O
ATOM  15716  N    ILE F 182     3.181  95.245  78.539  1.00  27.63      A  N
ATOM  15717  CA   ILE F 182     4.317  95.635  77.770  1.00  27.73      A  C
ATOM  15718  CB   ILE F 182     3.935  96.024  76.362  1.00  27.84      A  C
ATOM  15719  CG1  ILE F 182     3.538  94.794  75.589  1.00  26.68      A  C
ATOM  15720  CD1  ILE F 182     3.023  95.051  74.253  1.00  24.07      A  C
ATOM  15721  CG2  ILE F 182     5.054  96.647  75.677  1.00  22.79      A  C
ATOM  15722  C    ILE F 182     5.050  96.755  78.376  1.00  29.56      A  C
ATOM  15723  O    ILE F 182     6.230  96.749  78.379  1.00  30.75      A  O
ATOM  15724  N    HIS F 183     4.338  97.742  78.871  1.00  31.61      A  N
ATOM  15725  CA   HIS F 183     4.983  98.858  79.512  1.00  34.77      A  C
```

Appendix 1

```
ATOM  15726  CB   HIS F 183    3.964  99.928  79.840  1.00 35.66   A   C
ATOM  15727  CG   HIS F 183    4.433 100.923  80.852  1.00 38.17   A   C
ATOM  15728  ND1  HIS F 183    4.202 100.774  82.191  1.00 37.84   A   N
ATOM  15729  CE1  HIS F 183    4.716 101.789  82.840  1.00 36.31   A   C
ATOM  15730  NE2  HIS F 183    5.269 102.595  81.963  1.00 35.11   A   N
ATOM  15731  CD2  HIS F 183    5.111 102.075  80.718  1.00 37.03   A   C
ATOM  15732  C    HIS F 183    5.733  98.437  80.753  1.00 34.93   A   C
ATOM  15733  O    HIS F 183    6.843  98.803  80.970  1.00 34.15   A   O
ATOM  15734  N    ASP F 184    5.103  97.627  81.554  1.00 35.14   A   N
ATOM  15735  CA   ASP F 184    5.746  97.080  82.712  1.00 35.08   A   C
ATOM  15736  CB   ASP F 184    4.733  96.343  83.554  1.00 34.41   A   C
ATOM  15737  CG   ASP F 184    3.885  97.260  84.339  1.00 36.33   A   C
ATOM  15738  OD1  ASP F 184    4.139  98.455  34.349  1.00 35.06   A   O
ATOM  15739  OD2  ASP F 184    2.942  96.791  84.937  1.00 41.72   A   O-1
ATOM  15740  C    ASP F 184    6.935  96.191  82.403  1.00 35.10   A   C
ATOM  15741  O    ASP F 184    7.891  96.215  83.094  1.00 35.77   A   O
ATOM  15742  N    GLU F 185    6.858  95.372  81.381  1.00 35.60   A   N
ATOM  15743  CA   GLU F 185    7.984  94.550  81.028  1.00 36.18   A   C
ATOM  15744  CB   GLU F 185    7.624  93.548  79.960  1.00 36.35   A   C
ATOM  15745  CG   GLU F 185    7.411  92.188  80.475  1.00 39.06   A   C
ATOM  15746  CD   GLU F 185    6.960  91.232  79.438  1.00 47.78   A   C
ATOM  15747  OE1  GLU F 185    5.929  91.479  78.832  1.00 47.93   A   O
ATOM  15748  OE2  GLU F 185    7.627  90.216  79.224  1.00 48.82   A   O-1
ATOM  15749  C    GLU F 185    9.137  95.395  80.591  1.00 36.14   A   C
ATOM  15750  O    GLU F 185   10.236  95.170  80.969  1.00 36.32   A   O
ATOM  15751  N    ILE F 186    8.870  96.415  79.819  1.00 36.37   A   N
ATOM  15752  CA   ILE F 186    9.926  97.276  79.396  1.00 37.03   A   C
ATOM  15753  CB   ILE F 186    9.380  98.330  78.464  1.00 36.71   A   C
ATOM  15754  CG1  ILE F 186    9.081  97.733  77.110  1.00 37.39   A   C
ATOM  15755  CD1  ILE F 186    8.274  98.595  76.283  1.00 36.06   A   C
ATOM  15756  CG2  ILE F 186   10.336  99.405  78.277  1.00 35.85   A   C
ATOM  15757  C    ILE F 186   10.593  97.929  80.596  1.00 38.15   A   C
ATOM  15758  O    ILE F 186   11.793  97.979  80.680  1.00 39.22   A   O
ATOM  15759  N    ALA F 187    9.805  98.378  81.552  1.00 39.06   A   N
ATOM  15760  CA   ALA F 187   10.283  98.951  82.804  1.00 39.98   A   C
ATOM  15761  CB   ALA F 187    9.165  99.536  83.559  1.00 39.66   A   C
ATOM  15762  C    ALA F 187   11.072  98.052  83.720  1.00 39.72   A   C
ATOM  15763  O    ALA F 187   11.979  98.488  84.363  1.00 39.98   A   O
ATOM  15764  N    ALA F 188   10.685  96.811  83.830  1.00 39.28   A   N
ATOM  15765  CA   ALA F 188   11.433  95.846  84.610  1.00 41.07   A   C
ATOM  15766  CB   ALA F 188   10.646  94.608  84.784  1.00 39.55   A   C
ATOM  15767  C    ALA F 188   12.838  95.526  84.098  1.00 42.49   A   C
ATOM  15768  O    ALA F 188   13.724  95.237  84.862  1.00 42.55   A   O
ATOM  15769  N    ASN F 189   13.012  95.578  82.791  1.00 42.43   A   N
ATOM  15770  CA   ASN F 189   14.222  95.167  82.144  1.00 42.48   A   C
ATOM  15771  CB   ASN F 189   13.928  94.811  80.700  1.00 43.30   A   C
ATOM  15772  CG   ASN F 189   13.147  93.561  80.570  1.00 42.15   A   C
ATOM  15773  OD1  ASN F 189   13.281  92.684  81.363  1.00 42.08   A   O
ATOM  15774  ND2  ASN F 189   12.322  93.477  79.568  1.00 41.04   A   N
ATOM  15775  C    ASN F 189   15.350  96.153  82.206  1.00 42.35   A   C
ATOM  15776  O    ASN F 189   15.144  97.322  82.087  1.00 41.73   A   O
ATOM  15777  N    PRO F 190   16.546  95.652  82.446  1.00 41.92   A   N
ATOM  15778  CA   PRO F 190   17.789  96.412  82.385  1.00 41.28   A   C
ATOM  15779  CB   PRO F 190   18.775  95.441  82.957  1.00 40.39   A   C
```

Appendix 1

```
ATOM  15780  CG   PRO F 190    18.221  94.191  82.724  1.00  41.61      A  C
ATOM  15781  CD   PRO F 190    16.798  94.290  82.883  1.00  41.54      A  C
ATOM  15782  C    PRO F 190    18.243  96.893  81.006  1.00  41.06      A  C
ATOM  15783  O    PRO F 190    18.803  97.939  80.874  1.00  41.30      A  O
ATOM  15784  N    PHE F 191    18.041  96.073  80.004  1.00  40.05      A  N
ATOM  15785  CA   PHE F 191    18.139  96.431  78.624  1.00  38.24      A  C
ATOM  15786  CB   PHE F 191    18.476  95.161  77.827  1.00  37.86      A  C
ATOM  15787  CG   PHE F 191    17.421  94.124  77.964  1.00  35.90      A  C
ATOM  15788  CD1  PHE F 191    16.306  94.187  77.209  1.00  35.07      A  C
ATOM  15789  CE1  PHE F 191    15.356  93.293  77.350  1.00  33.87      A  C
ATOM  15790  CZ   PHE F 191    15.487  92.325  78.233  1.00  30.92      A  C
ATOM  15791  CE2  PHE F 191    16.568  92.245  78.987  1.00  28.45      A  C
ATOM  15792  CD2  PHE F 191    17.521  93.127  78.869  1.00  33.41      A  C
ATOM  15793  C    PHE F 191    16.888  97.083  78.199  1.00  37.28      A  C
ATOM  15794  O    PHE F 191    15.899  96.903  78.844  1.00  36.74      A  O
ATOM  15795  N    ALA F 192    16.859  97.827  77.112  1.00  36.66      A  N
ATOM  15796  CA   ALA F 192    15.583  98.381  76.667  1.00  35.93      A  C
ATOM  15797  CB   ALA F 192    15.784  99.703  76.006  1.00  34.32      A  C
ATOM  15798  C    ALA F 192    14.821  97.463  75.744  1.00  35.80      A  C
ATOM  15799  O    ALA F 192    15.251  97.199  74.665  1.00  36.50      A  O
ATOM  15800  N    GLY F 193    13.686  96.971  76.207  1.00  36.00      A  N
ATOM  15801  CA   GLY F 193    12.883  96.046  75.447  1.00  36.61      A  C
ATOM  15802  C    GLY F 193    12.326  94.822  76.128  1.00  36.53      A  C
ATOM  15803  O    GLY F 193    12.290  94.716  77.306  1.00  37.54      A  O
ATOM  15804  N    ILE F 194    11.860  93.902  75.319  1.00  36.10      A  N
ATOM  15805  CA   ILE F 194    11.314  92.652  75.745  1.00  36.27      A  C
ATOM  15806  CB   ILE F 194     9.797  92.674  75.677  1.00  36.09      A  C
ATOM  15807  CG1  ILE F 194     9.284  93.868  76.444  1.00  36.77      A  C
ATOM  15808  CD1  ILE F 194     7.858  94.006  76.425  1.00  36.97      A  C
ATOM  15809  CG2  ILE F 194     9.201  91.464  76.289  1.00  30.80      A  C
ATOM  15810  C    ILE F 194    11.894  91.619  74.817  1.00  38.54      A  C
ATOM  15811  O    ILE F 194    12.353  91.946  73.774  1.00  39.86      A  O
ATOM  15812  N    VAL F 195    11.883  90.366  75.212  1.00  38.60      A  N
ATOM  15813  CA   VAL F 195    12.496  89.321  74.451  1.00  39.15      A  C
ATOM  15814  CB   VAL F 195    13.383  88.501  75.299  1.00  38.80      A  C
ATOM  15815  CG1  VAL F 195    14.438  89.324  75.846  1.00  35.39      A  C
ATOM  15816  CG2  VAL F 195    12.606  87.837  76.346  1.00  37.69      A  C
ATOM  15817  C    VAL F 195    11.414  88.431  73.961  1.00  42.24      A  C
ATOM  15818  O    VAL F 195    10.381  88.408  74.539  1.00  43.33      A  O
ATOM  15819  N    CYS F 196    11.596  87.800  72.823  1.00  43.86      A  N
ATOM  15820  CA   CYS F 196    10.685  86.787  72.375  1.00  45.01      A  C
ATOM  15821  CB   CYS F 196    10.925  86.505  70.938  1.00  44.77      A  C
ATOM  15822  SG   CYS F 196    10.944  87.906  70.026  1.00  50.55      A  S
ATOM  15823  C    CYS F 196    10.748  85.515  73.150  1.00  46.53      A  C
ATOM  15824  O    CYS F 196     9.778  84.970  73.540  1.00  47.09      A  O
ATOM  15825  N    GLU F 197    11.916  84.925  73.132  1.00  49.00      A  N
ATOM  15826  CA   GLU F 197    12.243  83.756  73.902  1.00  50.53      A  C
ATOM  15827  CB   GLU F 197    13.310  82.931  73.231  1.00  51.61      A  C
ATOM  15828  CG   GLU F 197    12.807  81.822  72.426  1.00  55.33      A  C
ATOM  15829  CD   GLU F 197    12.121  82.308  71.210  1.00  62.24      A  C
ATOM  15830  OE1  GLU F 197    12.507  83.352  70.659  1.00  63.66      A  O
ATOM  15831  OE2  GLU F 197    11.183  81.650  70.799  1.00  65.43      A  O-1
ATOM  15832  C    GLU F 197    12.888  84.348  75.056  1.00  50.30      A  C
ATOM  15833  O    GLU F 197    13.223  85.483  75.046  1.00  50.50      A  O
```

Appendix 1

```
ATOM  15834  N    PRO F 198    13.148  83.548  76.046  1.00  51.15   A  N
ATOM  15835  CA   PRO F 198    13.678  84.062  77.282  1.00  51.26   A  C
ATOM  15836  CB   PRO F 198    13.696  82.831  78.156  1.00  51.24   A  C
ATOM  15837  CG   PRO F 198    12.600  82.022  77.648  1.00  50.69   A  C
ATOM  15838  CD   PRO F 198    12.283  82.394  76.281  1.00  50.54   A  C
ATOM  15839  C    PRO F 198    15.035  84.738  77.125  1.00  51.08   A  C
ATOM  15840  O    PRO F 198    15.308  85.655  77.857  1.00  53.00   A  O
ATOM  15841  N    ASP F 199    15.859  84.318  76.192  1.00  49.17   A  N
ATOM  15842  CA   ASP F 199    17.144  84.959  76.004  1.00  47.24   A  C
ATOM  15843  CB   ASP F 199    18.266  83.978  76.291  1.00  47.43   A  C
ATOM  15844  CG   ASP F 199    19.484  84.640  76.825  1.00  48.96   A  C
ATOM  15845  OD1  ASP F 199    19.361  85.705  77.404  1.00  49.89   A  O
ATOM  15846  OD2  ASP F 199    20.571  84.105  76.657  1.00  51.01   A  O-1
ATOM  15847  C    ASP F 199    17.344  85.559  74.636  1.00  45.60   A  C
ATOM  15848  O    ASP F 199    18.451  85.726  74.208  1.00  45.46   A  O
ATOM  15849  N    ASN F 200    16.282  85.841  73.921  1.00  43.18   A  N
ATOM  15850  CA   ASN F 200    16.413  86.249  72.551  1.00  40.78   A  C
ATOM  15851  CB   ASN F 200    15.642  85.317  71.646  1.00  41.85   A  C
ATOM  15852  CG   ASN F 200    16.324  84.013  71.410  1.00  41.41   A  C
ATOM  15853  OD1  ASN F 200    17.463  83.849  71.684  1.00  42.76   A  O
ATOM  15854  ND2  ASN F 200    15.610  83.088  70.850  1.00  42.05   A  N
ATOM  15855  C    ASN F 200    15.811  87.591  72.444  1.00  39.54   A  C
ATOM  15856  O    ASN F 200    14.736  87.793  72.869  1.00  40.34   A  O
ATOM  15857  N    TYR F 201    16.529  88.527  71.887  1.00  37.42   A  N
ATOM  15858  CA   TYR F 201    16.046  89.859  71.753  1.00  35.17   A  C
ATOM  15859  CB   TYR F 201    16.915  90.801  72.562  1.00  34.51   A  C
ATOM  15860  CG   TYR F 201    16.494  92.232  72.512  1.00  35.67   A  C
ATOM  15861  CD1  TYR F 201    15.832  92.817  73.559  1.00  38.53   A  C
ATOM  15862  CE1  TYR F 201    15.464  94.095  73.508  1.00  34.84   A  C
ATOM  15863  CZ   TYR F 201    15.725  94.812  72.405  1.00  35.36   A  C
ATOM  15864  OH   TYR F 201    15.358  96.100  72.327  1.00  37.95   A  O
ATOM  15865  CE2  TYR F 201    16.356  94.262  71.369  1.00  34.78   A  C
ATOM  15866  CD2  TYR F 201    16.737  92.991  71.418  1.00  33.82   A  C
ATOM  15867  C    TYR F 201    16.127  90.177  70.305  1.00  34.31   A  C
ATOM  15868  O    TYR F 201    17.124  89.988  69.702  1.00  33.85   A  O
ATOM  15869  N    PHE F 202    15.036  90.626  69.739  1.00  33.61   A  N
ATOM  15870  CA   PHE F 202    15.022  90.977  68.351  1.00  31.66   A  C
ATOM  15871  CB   PHE F 202    14.114  90.056  67.588  1.00  32.26   A  C
ATOM  15872  CG   PHE F 202    14.602  88.691  67.536  1.00  30.62   A  C
ATOM  15873  CD1  PHE F 202    15.453  88.307  66.580  1.00  28.91   A  C
ATOM  15874  CE1  PHE F 202    15.897  87.096  66.549  1.00  27.46   A  C
ATOM  15875  CZ   PHE F 202    15.537  86.233  67.478  1.00  29.73   A  C
ATOM  15876  CE2  PHE F 202    14.720  86.593  68.443  1.00  28.98   A  C
ATOM  15877  CD2  PHE F 202    14.251  87.807  68.480  1.00  29.30   A  C
ATOM  15878  C    PHE F 202    14.598  92.366  68.174  1.00  30.83   A  C
ATOM  15879  O    PHE F 202    13.671  92.798  68.723  1.00  31.21   A  O
ATOM  15880  N    VAL F 203    15.330  93.087  67.393  1.00  30.53   A  N
ATOM  15881  CA   VAL F 203    15.041  94.463  67.188  1.00  29.90   A  C
ATOM  15882  CB   VAL F 203    16.242  95.136  66.567  1.00  30.58   A  C
ATOM  15883  CG1  VAL F 203    16.047  95.473  65.150  1.00  30.48   A  C
ATOM  15884  CG2  VAL F 203    16.654  96.269  67.380  1.00  32.51   A  C
ATOM  15885  C    VAL F 203    13.741  94.737  66.476  1.00  29.55   A  C
ATOM  15886  O    VAL F 203    13.065  95.655  66.774  1.00  28.70   A  O
ATOM  15887  N    GLN F 204    13.430  93.936  65.491  1.00  28.87   A  N
```

Appendix 1

```
ATOM  15888  CA   GLN F 204    12.212  94.061  64.740  1.00  29.02      A  C
ATOM  15889  CB   GLN F 204    12.267  93.218  63.473  1.00  28.28      A  C
ATOM  15890  CG   GLN F 204    12.249  91.736  63.674  1.00  24.35      A  C
ATOM  15891  CD   GLN F 204    13.614  91.164  63.836  1.00  29.02      A  C
ATOM  15892  OE1  GLN F 204    14.488  91.776  64.359  1.00  28.98      A  O
ATOM  15893  NE2  GLN F 204    13.787  89.981  63.396  1.00  31.34      A  N
ATOM  15894  C    GLN F 204    10.964  93.780  65.522  1.00  30.06      A  C
ATOM  15895  O    GLN F 204    10.002  94.471  65.370  1.00  30.01      A  O
ATOM  15896  N    CYS F 205    11.000  92.766  66.362  1.00  30.97      A  N
ATOM  15897  CA   CYS F 205     9.884  92.435  67.226  1.00  32.37      A  C
ATOM  15898  CB   CYS F 205    10.183  91.168  68.046  1.00  31.22      A  C
ATOM  15899  SG   CYS F 205    10.457  89.577  67.260  1.00  39.33      A  S
ATOM  15900  C    CYS F 205     9.552  93.575  68.198  1.00  31.24      A  C
ATOM  15901  O    CYS F 205     8.423  93.887  68.400  1.00  30.02      A  O
ATOM  15902  N    ASN F 206    10.568  94.162  68.791  1.00  29.73      A  N
ATOM  15903  CA   ASN F 206    10.451  95.271  69.688  1.00  29.62      A  C
ATOM  15904  CB   ASN F 206    11.761  95.548  70.353  1.00  30.08      A  C
ATOM  15905  CG   ASN F 206    11.995  94.738  71.563  1.00  32.65      A  C
ATOM  15906  OD1  ASN F 206    11.774  95.197  72.624  1.00  40.97      A  O
ATOM  15907  ND2  ASN F 206    12.428  93.540  71.411  1.00  33.32      A  N
ATOM  15908  C    ASN F 206     9.897  96.525  69.073  1.00  29.34      A  C
ATOM  15909  O    ASN F 206     9.202  97.231  69.722  1.00  28.83      A  O
ATOM  15910  N    SER F 207    10.232  96.790  67.828  1.00  27.04      A  N
ATOM  15911  CA   SER F 207     9.772  97.944  67.102  1.00  28.86      A  C
ATOM  15912  CB   SER F 207    10.468  98.052  65.762  1.00  29.63      A  C
ATOM  15913  OG   SER F 207    10.152  96.966  64.962  1.00  31.05      A  O
ATOM  15914  C    SER F 207     8.282  97.942  66.920  1.00  28.22      A  C
ATOM  15915  O    SER F 207     7.680  98.952  66.913  1.00  28.42      A  O
ATOM  15916  N    VAL F 208     7.718  96.776  66.732  1.00  27.20      A  N
ATOM  15917  CA   VAL F 208     6.307  96.556  66.754  1.00  26.65      A  C
ATOM  15918  CB   VAL F 208     5.999  95.166  66.229  1.00  26.16      A  C
ATOM  15919  CG1  VAL F 208     4.618  94.999  65.967  1.00  25.98      A  C
ATOM  15920  CG2  VAL F 208     6.712  94.923  65.037  1.00  26.92      A  C
ATOM  15921  C    VAL F 208     5.690  96.797  68.118  1.00  25.91      A  C
ATOM  15922  O    VAL F 208     4.652  97.315  68.227  1.00  25.20      A  O
ATOM  15923  N    ALA F 209     6.334  96.391  69.174  1.00  27.03      A  N
ATOM  15924  CA   ALA F 209     5.831  96.717  70.479  1.00  28.04      A  C
ATOM  15925  CB   ALA F 209     6.578  95.997  71.485  1.00  27.51      A  C
ATOM  15926  C    ALA F 209     5.819  98.193  70.804  1.00  28.23      A  C
ATOM  15927  O    ALA F 209     4.851  98.682  71.282  1.00  28.49      A  O
ATOM  15928  N    TYR F 210     6.888  98.908  70.531  1.00  29.38      A  N
ATOM  15929  CA   TYR F 210     6.920 100.331  70.772  1.00  28.48      A  C
ATOM  15930  CB   TYR F 210     8.310 100.881  70.545  1.00  28.74      A  C
ATOM  15931  CG   TYR F 210     9.236 100.522  71.642  1.00  30.69      A  C
ATOM  15932  CD1  TYR F 210     9.472 101.364  72.664  1.00  29.76      A  C
ATOM  15933  CE1  TYR F 210    10.263 101.016  73.655  1.00  28.52      A  C
ATOM  15934  CZ   TYR F 210    10.829  99.808  73.657  1.00  29.90      A  C
ATOM  15935  OH   TYR F 210    11.646  99.426  74.648  1.00  31.28      A  O
ATOM  15936  CE2  TYR F 210    10.596  98.961  72.672  1.00  29.49      A  C
ATOM  15937  CD2  TYR F 210     9.813  99.310  71.682  1.00  30.53      A  C
ATOM  15938  C    TYR F 210     5.910 101.078  69.953  1.00  28.09      A  C
ATOM  15939  O    TYR F 210     5.262 101.963  70.430  1.00  29.06      A  O
ATOM  15940  N    LEU F 211     5.762 100.683  68.716  1.00  24.36      A  N
ATOM  15941  CA   LEU F 211     4.863 101.317  67.819  1.00  22.96      A  C
```

Appendix 1

```
ATOM   15942  CB   LEU F 211       5.046 100.725  66.444  1.00 23.24           A    C
ATOM   15943  CG   LEU F 211       4.131 101.075  65.311  1.00 25.11           A    C
ATOM   15944  CD1  LEU F 211       4.080 102.482  65.150  1.00 22.15           A    C
ATOM   15945  CD2  LEU F 211       4.642 100.447  64.115  1.00 26.40           A    C
ATOM   15946  C    LEU F 211       3.453 101.197  68.305  1.00 22.91           A    C
ATOM   15947  O    LEU F 211       2.668 102.059  68.153  1.00 21.73           A    O
ATOM   15948  N    SER F 212       3.148 100.087  68.906  1.00 23.09           A    N
ATOM   15949  CA   SER F 212       1.871  99.877  69.528  1.00 22.31           A    C
ATOM   15950  CB   SER F 212       1.628  98.416  69.828  1.00 21.28           A    C
ATOM   15951  OG   SER F 212       2.067  98.035  71.072  1.00 22.21           A    O
ATOM   15952  C    SER F 212       1.592 100.790  70.698  1.00 23.24           A    C
ATOM   15953  O    SER F 212       0.487 101.081  70.971  1.00 24.61           A    O
ATOM   15954  N    LEU F 213       2.616 101.228  71.386  1.00 23.31           A    N
ATOM   15955  CA   LEU F 213       2.481 102.193  72.440  1.00 24.12           A    C
ATOM   15956  CB   LEU F 213       3.745 102.284  73.246  1.00 22.38           A    C
ATOM   15957  CG   LEU F 213       4.127 100.990  73.904  1.00 25.45           A    C
ATOM   15958  CD1  LEU F 213       5.386 101.139  74.551  1.00 27.87           A    C
ATOM   15959  CD2  LEU F 213       3.121 100.459  74.822  1.00 21.31           A    C
ATOM   15960  C    LEU F 213       2.052 103.530  71.974  1.00 23.80           A    C
ATOM   15961  O    LEU F 213       1.232 104.120  72.571  1.00 23.79           A    O
ATOM   15962  N    TRP F 214       2.598 103.969  70.865  1.00 24.71           A    N
ATOM   15963  CA   TRP F 214       2.195 105.202  70.250  1.00 25.10           A    C
ATOM   15964  CB   TRP F 214       3.073 105.524  69.053  1.00 24.02           A    C
ATOM   15965  CG   TRP F 214       4.450 105.816  69.390  1.00 22.31           A    C
ATOM   15966  CD1  TRP F 214       5.290 104.998  69.969  1.00 24.02           A    C
ATOM   15967  NE1  TRP F 214       6.485 105.577  70.138  1.00 24.22           A    N
ATOM   15968  CE2  TRP F 214       6.422 106.840  69.670  1.00 21.24           A    C
ATOM   15969  CD2  TRP F 214       5.152 107.026  69.184  1.00 20.73           A    C
ATOM   15970  CE3  TRP F 214       4.823 108.258  68.642  1.00 23.24           A    C
ATOM   15971  CZ3  TRP F 214       5.764 109.215  68.611  1.00 24.90           A    C
ATOM   15972  CH2  TRP F 214       7.020 108.987  69.103  1.00 21.20           A    C
ATOM   15973  CZ2  TRP F 214       7.363 107.803  69.631  1.00 21.21           A    C
ATOM   15974  C    TRP F 214       0.757 105.149  69.823  1.00 27.27           A    C
ATOM   15975  O    TRP F 214       0.033 106.074  70.013  1.00 29.02           A    O
ATOM   15976  N    VAL F 215       0.349 104.047  69.241  1.00 26.96           A    N
ATOM   15977  CA   VAL F 215      -1.013 103.845  68.891  1.00 25.35           A    C
ATOM   15978  CB   VAL F 215      -1.158 102.646  68.010  1.00 25.69           A    C
ATOM   15979  CG1  VAL F 215      -2.568 102.394  67.685  1.00 22.73           A    C
ATOM   15980  CG2  VAL F 215      -0.395 102.843  66.819  1.00 21.58           A    C
ATOM   15981  C    VAL F 215      -1.938 103.809  70.080  1.00 25.85           A    C
ATOM   15982  O    VAL F 215      -2.979 104.366  70.037  1.00 25.83           A    O
ATOM   15983  N    TYR F 216      -1.553 103.190  71.163  1.00 27.29           A    N
ATOM   15984  CA   TYR F 216      -2.365 103.287  72.354  1.00 29.55           A    C
ATOM   15985  CB   TYR F 216      -1.866 102.362  73.461  1.00 30.52           A    C
ATOM   15986  CG   TYR F 216      -2.817 102.256  74.603  1.00 32.57           A    C
ATOM   15987  CD1  TYR F 216      -3.765 101.293  74.640  1.00 32.91           A    C
ATOM   15988  CE1  TYR F 216      -4.631 101.216  75.635  1.00 32.88           A    C
ATOM   15989  CZ   TYR F 216      -4.577 102.104  76.625  1.00 33.44           A    C
ATOM   15990  OH   TYR F 216      -5.456 102.016  77.629  1.00 36.51           A    O
ATOM   15991  CE2  TYR F 216      -3.664 103.074  76.623  1.00 31.52           A    C
ATOM   15992  CD2  TYR F 216      -2.791 103.149  75.618  1.00 35.30           A    C
ATOM   15993  C    TYR F 216      -2.477 104.713  72.869  1.00 30.56           A    C
ATOM   15994  O    TYR F 216      -3.519 105.136  73.258  1.00 31.19           A    O
ATOM   15995  N    ASP F 217      -1.387 105.452  72.821  1.00 30.25           A    N
```

Appendix 1

```
ATOM  15996  CA   ASP F 217     -1.334 106.831  73.246  1.00 30.47      A    C
ATOM  15997  CB   ASP F 217      0.086 107.342  73.155  1.00 30.05      A    C
ATOM  15998  CG   ASP F 217      0.942 106.845  74.256  1.00 30.88      A    C
ATOM  15999  OD1  ASP F 217      0.404 106.290  75.196  1.00 29.25      A    O
ATOM  16000  OD2  ASP F 217      2.146 106.990  74.190  1.00 29.16      A    O-1
ATOM  16001  C    ASP F 217     -2.219 107.738  72.455  1.00 30.57      A    C
ATOM  16002  O    ASP F 217     -2.796 108.629  72.981  1.00 31.54      A    O
ATOM  16003  N    ARG F 218     -2.296 107.527  71.171  1.00 30.97      A    N
ATOM  16004  CA   ARG F 218     -3.188 108.285  70.379  1.00 30.77      A    C
ATOM  16005  CB   ARG F 218     -2.973 108.029  68.900  1.00 30.26      A    C
ATOM  16006  CG   ARG F 218     -4.193 108.269  68.089  1.00 33.47      A    C
ATOM  16007  CD   ARG F 218     -4.297 109.635  67.450  1.00 36.90      A    C
ATOM  16008  NE   ARG F 218     -4.656 109.480  66.053  1.00 42.22      A    N
ATOM  16009  CZ   ARG F 218     -5.868 109.620  65.568  1.00 45.17      A    C
ATOM  16010  NH1  ARG F 218     -6.839 109.962  66.356  1.00 43.21      A    N
ATOM  16011  NH2  ARG F 218     -6.113 109.410  64.298  1.00 46.23      A    N
ATOM  16012  C    ARG F 218     -4.610 108.032  70.749  1.00 31.03      A    C
ATOM  16013  O    ARG F 218     -5.409 108.909  70.734  1.00 29.85      A    O
ATOM  16014  N    LEU F 219     -4.953 106.804  71.015  1.00 32.49      A    N
ATOM  16015  CA   LEU F 219     -6.303 106.512  71.400  1.00 33.97      A    C
ATOM  16016  CB   LEU F 219     -6.578 105.034  71.291  1.00 34.04      A    C
ATOM  16017  CG   LEU F 219     -6.687 104.445  69.898  1.00 35.72      A    C
ATOM  16018  CD1  LEU F 219     -6.756 102.975  69.968  1.00 35.09      A    C
ATOM  16019  CD2  LEU F 219     -7.855 104.967  69.203  1.00 31.54      A    C
ATOM  16020  C    LEU F 219     -6.732 107.064  72.753  1.00 35.10      A    C
ATOM  16021  O    LEU F 219     -7.834 107.503  72.913  1.00 35.18      A    O
ATOM  16022  N    HIS F 220     -5.857 107.012  73.729  1.00 35.90      A    N
ATOM  16023  CA   HIS F 220     -6.240 107.340  75.071  1.00 36.55      A    C
ATOM  16024  CB   HIS F 220     -6.095 106.100  75.935  1.00 35.71      A    C
ATOM  16025  CG   HIS F 220     -6.833 104.928  75.400  1.00 37.95      A    C
ATOM  16026  ND1  HIS F 220     -8.194 104.838  75.439  1.00 38.94      A    N
ATOM  16027  CE1  HIS F 220     -8.581 103.721  74.871  1.00 39.56      A    C
ATOM  16028  NE2  HIS F 220     -7.513 103.080  74.463  1.00 44.16      A    N
ATOM  16029  CD2  HIS F 220     -6.410 103.824  74.761  1.00 43.07      A    C
ATOM  16030  C    HIS F 220     -5.633 108.565  75.721  1.00 36.73      A    C
ATOM  16031  O    HIS F 220     -5.909 108.830  76.846  1.00 37.54      A    O
ATOM  16032  N    GLY F 221     -4.829 109.323  75.014  1.00 35.93      A    N
ATOM  16033  CA   GLY F 221     -4.238 110.505  75.595  1.00 36.06      A    C
ATOM  16034  C    GLY F 221     -3.078 110.270  76.530  1.00 36.11      A    C
ATOM  16035  O    GLY F 221     -2.660 111.135  77.247  1.00 35.20      A    O
ATOM  16036  N    THR F 222     -2.565 109.064  76.499  1.00 35.89      A    N
ATOM  16037  CA   THR F 222     -1.510 108.631  77.372  1.00 35.31      A    C
ATOM  16038  CB   THR F 222     -1.664 107.188  77.764  1.00 36.12      A    C
ATOM  16039  OG1  THR F 222     -1.694 106.379  76.595  1.00 35.35      A    O
ATOM  16040  CG2  THR F 222     -2.910 107.019  78.522  1.00 29.29      A    C
ATOM  16041  C    THR F 222     -0.124 108.897  76.868  1.00 35.62      A    C
ATOM  16042  O    THR F 222      0.077 109.548  75.881  1.00 35.83      A    O
ATOM  16043  N    ASP F 223      0.843 108.453  77.618  1.00 36.01      A    N
ATOM  16044  CA   ASP F 223      2.184 108.750  77.272  1.00 37.23      A    C
ATOM  16045  CB   ASP F 223      2.609 109.944  78.070  1.00 38.91      A    C
ATOM  16046  CG   ASP F 223      3.935 110.429  77.708  1.00 42.88      A    C
ATOM  16047  OD1  ASP F 223      4.229 110.575  76.529  1.00 43.93      A    O
ATOM  16048  OD2  ASP F 223      4.690 110.702  78.634  1.00 48.87      A    O-1
ATOM  16049  C    ASP F 223      3.109 107.607  77.523  1.00 36.44      A    C
```

Appendix 1

```
ATOM  16050  O    ASP F 223     4.147 107.774  78.083  1.00 36.75      A  O
ATOM  16051  N    TYR F 224     2.754 106.470  76.982  1.00 35.90      A  N
ATOM  16052  CA   TYR F 224     3.538 105.270  77.041  1.00 36.33      A  C
ATOM  16053  CB   TYR F 224     2.699 104.083  76.638  1.00 35.20      A  C
ATOM  16054  CG   TYR F 224     1.796 103.583  77.706  1.00 35.60      A  C
ATOM  16055  CD1  TYR F 224     2.259 102.799  78.705  1.00 36.73      A  C
ATOM  16056  CE1  TYR F 224     1.443 102.335  79.661  1.00 30.92      A  C
ATOM  16057  CZ   TYR F 224     0.154 102.646  79.626  1.00 30.93      A  C
ATOM  16058  OH   TYR F 224    -0.661 102.175  80.576  1.00 30.71      A  O
ATOM  16059  CE2  TYR F 224    -0.334 103.407  78.652  1.00 34.40      A  C
ATOM  16060  CD2  TYR F 224     0.472 103.868  77.701  1.00 34.97      A  C
ATOM  16061  C    TYR F 224     4.847 105.295  76.251  1.00 37.45      A  C
ATOM  16062  O    TYR F 224     5.611 104.398  76.403  1.00 38.17      A  O
ATOM  16063  N    ARG F 225     5.160 106.346  75.507  1.00 38.53      A  N
ATOM  16064  CA   ARG F 225     6.437 106.399  74.795  1.00 40.67      A  C
ATOM  16065  CB   ARG F 225     6.375 107.347  73.612  1.00 40.91      A  C
ATOM  16066  CG   ARG F 225     4.982 107.656  73.150  1.00 42.13      A  C
ATOM  16067  CD   ARG F 225     4.798 109.020  72.485  1.00 45.37      A  C
ATOM  16068  NE   ARG F 225     3.476 109.566  72.777  1.00 49.63      A  N
ATOM  16069  CZ   ARG F 225     3.167 110.836  73.021  1.00 49.95      A  C
ATOM  16070  NH1  ARG F 225     4.052 111.794  72.997  1.00 51.69      A  N
ATOM  16071  NH2  ARG F 225     1.940 111.162  73.279  1.00 51.46      A  N
ATOM  16072  C    ARG F 225     7.684 106.692  75.662  1.00 41.40      A  C
ATOM  16073  O    ARG F 225     7.886 107.717  76.292  1.00 40.85      A  O
ATOM  16074  N    ALA F 226     8.479 105.643  75.677  1.00 41.96      A  N
ATOM  16075  CA   ALA F 226     9.748 105.489  76.293  1.00 39.90      A  C
ATOM  16076  CB   ALA F 226     9.647 104.410  77.251  1.00 38.86      A  C
ATOM  16077  C    ALA F 226    10.635 105.050  75.154  1.00 39.46      A  C
ATOM  16078  O    ALA F 226    11.604 104.349  75.340  1.00 36.43      A  O
ATOM  16079  N    ALA F 227    10.218 105.415  73.958  1.00 39.42      A  N
ATOM  16080  CA   ALA F 227    10.788 104.919  72.746  1.00 40.68      A  C
ATOM  16081  CB   ALA F 227    10.010 105.436  71.596  1.00 38.70      A  C
ATOM  16082  C    ALA F 227    12.219 105.339  72.655  1.00 42.38      A  C
ATOM  16083  O    ALA F 227    13.077 104.577  72.342  1.00 42.15      A  O
ATOM  16084  N    THR F 228    12.424 106.585  72.975  1.00 45.02      A  N
ATOM  16085  CA   THR F 228    13.700 107.189  72.883  1.00 47.56      A  C
ATOM  16086  CB   THR F 228    13.663 108.597  73.349  1.00 48.48      A  C
ATOM  16087  OG1  THR F 228    14.948 108.948  73.851  1.00 49.90      A  O
ATOM  16088  CG2  THR F 228    12.684 108.702  74.419  1.00 49.45      A  C
ATOM  16089  C    THR F 228    14.538 106.482  73.832  1.00 47.52      A  C
ATOM  16090  O    THR F 228    15.713 106.355  73.613  1.00 45.85      A  O
ATOM  16091  N    ARG F 229    13.848 105.977  74.833  1.00 47.95      A  N
ATOM  16092  CA   ARG F 229    14.237 106.020  76.190  1.00 48.80      A  C
ATOM  16093  CB   ARG F 229    13.111 105.559  77.089  1.00 49.36      A  C
ATOM  16094  CG   ARG F 229    12.732 106.523  78.168  1.00 53.53      A  C
ATOM  16095  CD   ARG F 229    13.046 105.972  79.550  1.00 62.73      A  C
ATOM  16096  NE   ARG F 229    14.480 106.027  79.813  1.00 69.03      A  N
ATOM  16097  CZ   ARG F 229    15.124 105.342  80.752  1.00 71.58      A  C
ATOM  16098  NH1  ARG F 229    14.480 104.551  81.585  1.00 72.87      A  N
ATOM  16099  NH2  ARG F 229    16.430 105.450  80.858  1.00 71.24      A  N
ATOM  16100  C    ARG F 229    15.225 104.980  76.059  1.00 46.95      A  C
ATOM  16101  O    ARG F 229    15.368 104.106  76.868  1.00 46.02      A  O
ATOM  16102  N    ALA F 230    15.918 105.135  74.968  1.00 45.76      A  N
ATOM  16103  CA   ALA F 230    16.959 104.251  74.748  1.00 45.83      A  C
```

Appendix 1

```
ATOM  16104  CB   ALA F 230    17.764 104.069  75.996  1.00  45.90    A  C
ATOM  16105  C    ALA F 230    16.315 103.005  74.426  1.00  44.43    A  C
ATOM  16106  O    ALA F 230    16.913 101.991  74.641  1.00  46.87    A  O
ATOM  16107  N    TRP F 231    15.105 103.004  73.922  1.00  41.91    A  N
ATOM  16108  CA   TRP F 231    14.892 101.921  73.068  1.00  39.24    A  C
ATOM  16109  CB   TRP F 231    13.480 101.712  72.636  1.00  38.05    A  C
ATOM  16110  CG   TRP F 231    13.496 100.586  71.727  1.00  36.39    A  C
ATOM  16111  CD1  TRP F 231    13.912  99.359  72.002  1.00  35.25    A  C
ATOM  16112  NE1  TRP F 231    13.845  98.573  70.929  1.00  29.47    A  N
ATOM  16113  CE2  TRP F 231    13.372  99.305  69.897  1.00  31.11    A  C
ATOM  16114  CD2  TRP F 231    13.157 100.586  70.371  1.00  32.01    A  C
ATOM  16115  CE3  TRP F 231    12.664 101.539  69.509  1.00  33.70    A  C
ATOM  16116  CZ3  TRP F 231    12.415 101.184  68.244  1.00  35.93    A  C
ATOM  16117  CH2  TRP F 231    12.632  99.894  67.804  1.00  32.26    A  C
ATOM  16118  CZ2  TRP F 231    13.111  98.946  68.620  1.00  30.36    A  C
ATOM  16119  C    TRP F 231    15.718 102.316  71.895  1.00  39.10    A  C
ATOM  16120  O    TRP F 231    16.532 101.587  71.440  1.00  38.87    A  O
ATOM  16121  N    LEU F 232    15.475 103.517  71.421  1.00  38.93    A  N
ATOM  16122  CA   LEU F 232    16.186 104.085  70.301  1.00  39.56    A  C
ATOM  16123  CB   LEU F 232    15.568 105.410  69.924  1.00  39.16    A  C
ATOM  16124  CG   LEU F 232    14.735 105.536  68.677  1.00  39.18    A  C
ATOM  16125  CD1  LEU F 232    14.369 104.242  68.185  1.00  40.57    A  C
ATOM  16126  CD2  LEU F 232    13.546 106.286  68.968  1.00  37.83    A  C
ATOM  16127  C    LEU F 232    17.642 104.304  70.575  1.00  40.27    A  C
ATOM  16128  O    LEU F 232    18.461 104.086  69.744  1.00  40.34    A  O
ATOM  16129  N    ASP F 233    17.943 104.798  71.748  1.00  41.47    A  N
ATOM  16130  CA   ASP F 233    19.305 105.002  72.151  1.00  43.59    A  C
ATOM  16131  CB   ASP F 233    19.386 105.820  73.429  1.00  44.45    A  C
ATOM  16132  CG   ASP F 233    18.984 107.260  73.242  1.00  49.18    A  C
ATOM  16133  OD1  ASP F 233    18.925 107.757  72.124  1.00  51.40    A  O
ATOM  16134  OD2  ASP F 233    18.711 107.920  74.239  1.00  55.21    A  O-1
ATOM  16135  C    ASP F 233    20.036 103.705  72.313  1.00  44.08    A  C
ATOM  16136  O    ASP F 233    21.167 103.602  71.964  1.00  45.58    A  O
ATOM  16137  N    PHE F 234    19.386 102.722  72.887  1.00  43.19    A  N
ATOM  16138  CA   PHE F 234    19.956 101.420  73.067  1.00  42.91    A  C
ATOM  16139  CB   PHE F 234    18.942 100.657  73.864  1.00  41.83    A  C
ATOM  16140  CG   PHE F 234    19.290  99.262  74.101  1.00  42.55    A  C
ATOM  16141  CD1  PHE F 234    20.313  98.936  74.900  1.00  45.84    A  C
ATOM  16142  CE1  PHE F 234    20.609  97.666  75.129  1.00  46.75    A  C
ATOM  16143  CZ   PHE F 234    19.885  96.709  74.588  1.00  45.66    A  C
ATOM  16144  CE2  PHE F 234    18.862  97.013  73.812  1.00  43.69    A  C
ATOM  16145  CD2  PHE F 234    18.557  98.272  73.574  1.00  42.57    A  C
ATOM  16146  C    PHE F 234    20.290 100.624  71.803  1.00  43.84    A  C
ATOM  16147  O    PHE F 234    21.343 100.109  71.661  1.00  43.71    A  O
ATOM  16148  N    ILE F 235    19.365 100.500  70.882  1.00  44.86    A  N
ATOM  16149  CA   ILE F 235    19.576  99.686  69.711  1.00  43.46    A  C
ATOM  16150  CB   ILE F 235    18.315  99.472  68.927  1.00  42.91    A  C
ATOM  16151  CG1  ILE F 235    17.773 100.790  68.425  1.00  41.57    A  C
ATOM  16152  CD1  ILE F 235    16.692 100.668  67.497  1.00  38.32    A  C
ATOM  16153  CG2  ILE F 235    17.330  98.842  69.785  1.00  41.89    A  C
ATOM  16154  C    ILE F 235    20.633 100.314  68.879  1.00  43.76    A  C
ATOM  16155  O    ILE F 235    21.270  99.674  68.098  1.00  43.84    A  O
ATOM  16156  N    GLN F 236    20.853 101.581  69.125  1.00  44.07    A  N
ATOM  16157  CA   GLN F 236    21.832 102.319  68.388  1.00  44.71    A  C
```

Appendix 1

```
ATOM  16158  CB   GLN F 236    21.504 103.793  68.383  1.00  44.03    A    C
ATOM  16159  CG   GLN F 236    21.086 104.255  67.029  1.00  45.43    A    C
ATOM  16160  CD   GLN F 236    20.542 105.636  66.996  1.00  46.96    A    C
ATOM  16161  OE1  GLN F 236    19.954 106.084  67.935  1.00  49.65    A    O
ATOM  16162  NE2  GLN F 236    20.724 106.314  65.900  1.00  43.97    A    N
ATOM  16163  C    GLN F 236    23.220 102.009  68.905  1.00  45.93    A    C
ATOM  16164  O    GLN F 236    24.181 102.437  68.354  1.00  45.09    A    O
ATOM  16165  N    LYS F 237    23.297 101.211  69.952  1.00  48.50    A    N
ATOM  16166  CA   LYS F 237    24.559 100.759  70.474  1.00  50.51    A    C
ATOM  16167  CB   LYS F 237    24.613 101.058  71.953  1.00  50.82    A    C
ATOM  16168  CG   LYS F 237    24.487 102.492  72.240  1.00  54.07    A    C
ATOM  16169  CD   LYS F 237    24.025 102.755  73.625  1.00  60.58    A    C
ATOM  16170  CE   LYS F 237    23.761 104.238  73.823  1.00  64.06    A    C
ATOM  16171  NZ   LYS F 237    22.782 104.549  74.898  1.00  65.51    A    N
ATOM  16172  C    LYS F 237    24.732  99.283  70.268  1.00  51.67    A    C
ATOM  16173  O    LYS F 237    24.080  98.478  70.894  1.00  51.42    A    O
ATOM  16174  N    ASP F 238    25.532  98.944  69.281  1.00  52.36    A    N
ATOM  16175  CA   ASP F 238    26.079  97.614  69.101  1.00  53.23    A    C
ATOM  16176  CB   ASP F 238    26.964  97.203  70.248  1.00  54.85    A    C
ATOM  16177  CG   ASP F 238    26.250  96.362  71.201  1.00  61.96    A    C
ATOM  16178  OD1  ASP F 238    25.022  96.412  71.104  1.00  68.65    A    O
ATOM  16179  OD2  ASP F 238    26.872  95.679  72.038  1.00  66.73    A    O-1
ATOM  16180  C    ASP F 238    25.050  96.535  68.811  1.00  51.38    A    C
ATOM  16181  O    ASP F 238    25.354  95.372  68.863  1.00  52.75    A    O
ATOM  16182  N    LEU F 239    23.830  96.939  68.528  1.00  48.74    A    N
ATOM  16183  CA   LEU F 239    22.910  96.127  67.806  1.00  45.62    A    C
ATOM  16184  CB   LEU F 239    21.528  96.283  68.369  1.00  44.98    A    C
ATOM  16185  CG   LEU F 239    21.378  95.523  69.660  1.00  45.09    A    C
ATOM  16186  CD1  LEU F 239    22.042  96.326  70.715  1.00  47.96    A    C
ATOM  16187  CD2  LEU F 239    19.973  95.340  69.967  1.00  42.93    A    C
ATOM  16188  C    LEU F 239    22.961  96.624  66.405  1.00  44.27    A    C
ATOM  16189  O    LEU F 239    22.396  96.059  65.533  1.00  42.59    A    O
ATOM  16190  N    ILE F 240    23.672  97.710  66.211  1.00  42.92    A    N
ATOM  16191  CA   ILE F 240    23.744  98.289  64.915  1.00  43.04    A    C
ATOM  16192  CB   ILE F 240    22.885  99.505  64.806  1.00  42.44    A    C
ATOM  16193  CG1  ILE F 240    22.328  99.545  63.407  1.00  42.95    A    C
ATOM  16194  CD1  ILE F 240    21.825 100.820  62.981  1.00  46.43    A    C
ATOM  16195  CG2  ILE F 240    23.655 100.727  65.089  1.00  40.01    A    C
ATOM  16196  C    ILE F 240    25.147  98.591  64.426  1.00  44.79    A    C
ATOM  16197  O    ILE F 240    26.054  98.785  65.199  1.00  45.20    A    O
ATOM  16198  N    ASP F 241    25.321  98.570  63.119  1.00  44.89    A    N
ATOM  16199  CA   ASP F 241    26.541  99.010  62.534  1.00  45.06    A    C
ATOM  16200  CB   ASP F 241    27.064  97.985  61.546  1.00  43.94    A    C
ATOM  16201  CG   ASP F 241    28.263  98.466  60.806  1.00  46.04    A    C
ATOM  16202  OD1  ASP F 241    28.505  99.672  60.760  1.00  42.72    A    O
ATOM  16203  OD2  ASP F 241    28.968  97.642  60.252  1.00  45.42    A    O-1
ATOM  16204  C    ASP F 241    26.169 100.285  61.846  1.00  44.86    A    C
ATOM  16205  O    ASP F 241    25.419 100.283  60.928  1.00  44.17    A    O
ATOM  16206  N    PRO F 242    26.667 101.387  62.348  1.00  45.05    A    N
ATOM  16207  CA   PRO F 242    26.331 102.676  61.807  1.00  45.45    A    C
ATOM  16208  CB   PRO F 242    27.062 103.607  62.736  1.00  44.66    A    C
ATOM  16209  CG   PRO F 242    27.127 102.923  63.911  1.00  44.65    A    C
ATOM  16210  CD   PRO F 242    26.459 101.564  63.555  1.00  46.05    A    C
ATOM  16211  C    PRO F 242    26.835 102.844  60.420  1.00  45.77    A    C
```

Appendix 1

```
ATOM  16212  O    PRO F 242    26.195 103.440 59.607 1.00 44.95    A  O
ATOM  16213  N    GLU F 243    28.016 102.348 60.161 1.00 47.34    A  N
ATOM  16214  CA   GLU F 243    28.537 102.488 58.847 1.00 48.53    A  C
ATOM  16215  CB   GLU F 243    29.951 101.979 58.815 1.00 49.55    A  C
ATOM  16216  CG   GLU F 243    30.987 102.984 59.175 1.00 55.83    A  C
ATOM  16217  CD   GLU F 243    30.640 103.822 60.363 1.00 62.94    A  C
ATOM  16218  OE1  GLU F 243    30.879 103.398 61.512 1.00 64.65    A  O
ATOM  16219  OE2  GLU F 243    30.161 104.938 60.146 1.00 66.27    A  O-1
ATOM  16220  C    GLU F 243    27.698 101.731 57.850 1.00 47.67    A  C
ATOM  16221  O    GLU F 243    27.382 102.236 56.806 1.00 48.07    A  O
ATOM  16222  N    ARG F 244    27.364 100.496 58.152 1.00 45.28    A  N
ATOM  16223  CA   ARG F 244    26.654  99.688 57.196 1.00 43.14    A  C
ATOM  16224  CB   ARG F 244    27.093  98.229 57.297 1.00 42.30    A  C
ATOM  16225  CG   ARG F 244    28.315  97.943 56.460 1.00 42.52    A  C
ATOM  16226  CD   ARG F 244    28.950  96.570 56.657 1.00 40.16    A  C
ATOM  16227  NE   ARG F 244    28.955  96.170 58.040 1.00 40.93    A  N
ATOM  16228  CZ   ARG F 244    29.190  94.951 58.481 1.00 39.36    A  C
ATOM  16229  NH1  ARG F 244    29.450  93.962 57.664 1.00 31.96    A  N
ATOM  16230  NH2  ARG F 244    29.147  94.736 59.765 1.00 36.36    A  N
ATOM  16231  C    ARG F 244    25.129  99.904 57.190 1.00 41.58    A  C
ATOM  16232  O    ARG F 244    24.454  99.520 56.268 1.00 41.81    A  O
ATOM  16233  N    GLY F 245    24.625 100.608 58.179 1.00 38.97    A  N
ATOM  16234  CA   GLY F 245    23.211 100.844 58.325 1.00 36.67    A  C
ATOM  16235  C    GLY F 245    22.375  99.613 58.537 1.00 35.74    A  C
ATOM  16236  O    GLY F 245    21.318  99.468 57.972 1.00 34.76    A  O
ATOM  16237  N    ALA F 246    22.893  98.728 59.363 1.00 34.10    A  N
ATOM  16238  CA   ALA F 246    22.374  97.418 59.525 1.00 31.96    A  C
ATOM  16239  CB   ALA F 246    23.141  96.505 58.698 1.00 31.39    A  C
ATOM  16240  C    ALA F 246    22.406  96.962 60.938 1.00 31.88    A  C
ATOM  16241  O    ALA F 246    23.355  97.148 61.631 1.00 30.05    A  O
ATOM  16242  N    PHE F 247    21.333  96.310 61.325 1.00 31.56    A  N
ATOM  16243  CA   PHE F 247    21.216  95.694 62.607 1.00 30.49    A  C
ATOM  16244  CB   PHE F 247    19.753  95.644 63.008 1.00 30.66    A  C
ATOM  16245  CG   PHE F 247    19.169  96.966 63.339 1.00 28.71    A  C
ATOM  16246  CD1  PHE F 247    19.450  97.584 64.504 1.00 31.71    A  C
ATOM  16247  CE1  PHE F 247    18.925  98.762 64.783 1.00 28.88    A  C
ATOM  16248  CZ   PHE F 247    18.108  99.335 63.926 1.00 28.26    A  C
ATOM  16249  CE2  PHE F 247    17.820  98.745 62.781 1.00 26.12    A  C
ATOM  16250  CD2  PHE F 247    18.329  97.580 62.490 1.00 26.68    A  C
ATOM  16251  C    PHE F 247    21.825  94.308 62.634 1.00 31.40    A  C
ATOM  16252  O    PHE F 247    21.781  93.598 61.701 1.00 31.96    A  O
ATOM  16253  N    TYR F 248    22.416  93.941 63.737 1.00 32.02    A  N
ATOM  16254  CA   TYR F 248    22.804  92.593 63.951 1.00 33.51    A  C
ATOM  16255  CB   TYR F 248    23.835  92.503 65.044 1.00 33.80    A  C
ATOM  16256  CG   TYR F 248    25.130  93.073 64.609 1.00 33.94    A  C
ATOM  16257  CD1  TYR F 248    25.963  92.390 63.785 1.00 37.65    A  C
ATOM  16258  CE1  TYR F 248    27.107  92.919 63.393 1.00 37.90    A  C
ATOM  16259  CZ   TYR F 248    27.441  94.155 63.813 1.00 39.34    A  C
ATOM  16260  OH   TYR F 248    28.600  94.740 63.446 1.00 44.80    A  O
ATOM  16261  CE2  TYR F 248    26.639  94.829 64.618 1.00 37.61    A  C
ATOM  16262  CD2  TYR F 248    25.508  94.305 65.012 1.00 34.83    A  C
ATOM  16263  C    TYR F 248    21.560  91.792 64.234 1.00 34.22    A  C
ATOM  16264  O    TYR F 248    20.568  92.334 64.588 1.00 35.18    A  O
ATOM  16265  N    LEU F 249    21.618  90.505 63.984 1.00 33.58    A  N
```

Appendix 1

```
ATOM  16266  CA   LEU F 249    20.466  89.655  63.955  1.00 33.90      A   C
ATOM  16267  CB   LEU F 249    20.905  88.281  63.535  1.00 34.56      A   C
ATOM  16268  CG   LEU F 249    19.957  87.239  62.997  1.00 33.47      A   C
ATOM  16269  CD1  LEU F 249    19.764  87.511  61.606  1.00 29.77      A   C
ATOM  16270  CD2  LEU F 249    20.618  85.924  63.171  1.00 32.59      A   C
ATOM  16271  C    LEU F 249    19.770  89.533  65.258  1.00 34.16      A   C
ATOM  16272  O    LEU F 249    18.582  89.504  65.303  1.00 34.80      A   O
ATOM  16273  N    SER F 250    20.521  89.398  66.316  1.00 33.42      A   N
ATOM  16274  CA   SER F 250    19.915  89.276  67.592  1.00 32.57      A   C
ATOM  16275  CB   SER F 250    19.214  87.929  67.731  1.00 33.34      A   C
ATOM  16276  OG   SER F 250    20.052  86.846  67.516  1.00 28.39      A   O
ATOM  16277  C    SER F 250    20.828  89.575  68.747  1.00 33.89      A   C
ATOM  16278  O    SER F 250    22.006  89.611  68.617  1.00 31.86      A   O
ATOM  16279  N    TYR F 251    20.216  89.791  69.889  1.00 34.90      A   N
ATOM  16280  CA   TYR F 251    20.901  90.068  71.106  1.00 36.76      A   C
ATOM  16281  CB   TYR F 251    20.530  91.456  71.518  1.00 36.91      A   C
ATOM  16282  CG   TYR F 251    20.967  91.847  72.883  1.00 41.33      A   C
ATOM  16283  CD1  TYR F 251    22.230  91.591  73.312  1.00 46.04      A   C
ATOM  16284  CE1  TYR F 251    22.623  91.963  74.536  1.00 51.57      A   C
ATOM  16285  CZ   TYR F 251    21.748  92.608  75.352  1.00 53.49      A   C
ATOM  16286  OH   TYR F 251    22.139  92.986  76.593  1.00 55.68      A   O
ATOM  16287  CE2  TYR F 251    20.492  92.879  74.940  1.00 49.19      A   C
ATOM  16288  CD2  TYR F 251    20.116  92.502  73.726  1.00 45.39      A   C
ATOM  16289  C    TYR F 251    20.479  89.094  72.180  1.00 38.18      A   C
ATOM  16290  O    TYR F 251    19.343  88.773  72.297  1.00 35.78      A   O
ATOM  16291  N    HIS F 252    21.400  88.628  72.983  1.00 40.48      A   N
ATOM  16292  CA   HIS F 252    21.001  87.740  74.030  1.00 42.96      A   C
ATOM  16293  CB   HIS F 252    21.439  86.355  73.652  1.00 42.98      A   C
ATOM  16294  CG   HIS F 252    20.978  85.972  72.296  1.00 40.73      A   C
ATOM  16295  ND1  HIS F 252    21.613  86.374  71.154  1.00 39.10      A   N
ATOM  16296  CE1  HIS F 252    20.952  85.939  70.111  1.00 37.90      A   C
ATOM  16297  NE2  HIS F 252    19.906  85.272  70.537  1.00 37.17      A   N
ATOM  16298  CD2  HIS F 252    19.892  85.292  71.898  1.00 41.57      A   C
ATOM  16299  C    HIS F 252    21.559  88.183  75.321  1.00 45.53      A   C
ATOM  16300  O    HIS F 252    22.676  87.953  75.624  1.00 45.85      A   O
ATOM  16301  N    PRO F 253    20.722  88.836  76.081  1.00 48.07      A   N
ATOM  16302  CA   PRO F 253    21.115  89.619  77.231  1.00 49.82      A   C
ATOM  16303  CB   PRO F 253    19.806  90.254  77.656  1.00 49.90      A   C
ATOM  16304  CG   PRO F 253    19.001  90.223  76.498  1.00 48.46      A   C
ATOM  16305  CD   PRO F 253    19.295  88.974  75.828  1.00 47.38      A   C
ATOM  16306  C    PRO F 253    21.751  88.860  78.370  1.00 51.71      A   C
ATOM  16307  O    PRO F 253    22.595  89.419  79.003  1.00 52.48      A   O
ATOM  16308  N    GLU F 254    21.308  87.657  78.662  1.00 54.09      A   N
ATOM  16309  CA   GLU F 254    21.848  86.913  79.762  1.00 56.63      A   C
ATOM  16310  CB   GLU F 254    21.118  85.604  79.902  1.00 57.77      A   C
ATOM  16311  CG   GLU F 254    22.046  84.448  80.172  1.00 63.56      A   C
ATOM  16312  CD   GLU F 254    22.121  84.087  81.642  1.00 72.01      A   C
ATOM  16313  OE1  GLU F 254    21.639  84.860  82.481  1.00 75.02      A   O
ATOM  16314  OE2  GLU F 254    22.673  83.036  81.975  1.00 75.55      A   O-1
ATOM  16315  C    GLU F 254    23.253  86.559  79.553  1.00 56.55      A   C
ATOM  16316  O    GLU F 254    24.074  86.641  80.430  1.00 57.70      A   O
ATOM  16317  N    SER F 255    23.517  86.107  78.367  1.00 57.01      A   N
ATOM  16318  CA   SER F 255    24.777  85.544  78.066  1.00 55.96      A   C
ATOM  16319  CB   SER F 255    24.528  84.313  77.247  1.00 56.45      A   C
```

Appendix 1

```
ATOM  16320  OG   SER F 255    23.689  84.656  76.183  1.00  54.37    A  O
ATOM  16321  C    SER F 255    25.422  86.460  77.151  1.00  55.72    A  C
ATOM  16322  O    SER F 255    25.237  86.340  75.967  1.00  56.32    A  O
ATOM  16323  N    GLY F 256    26.178  87.390  77.676  1.00  54.80    A  N
ATOM  16324  CA   GLY F 256    26.945  88.189  76.795  1.00  52.59    A  C
ATOM  16325  C    GLY F 256    25.955  88.868  75.920  1.00  51.46    A  C
ATOM  16326  O    GLY F 256    25.178  89.635  76.384  1.00  50.61    A  O
ATOM  16327  N    ALA F 257    25.993  88.546  74.641  1.00  49.42    A  N
ATOM  16328  CA   ALA F 257    25.567  89.463  73.651  1.00  48.37    A  C
ATOM  16329  CB   ALA F 257    26.435  90.620  73.727  1.00  48.60    A  C
ATOM  16330  C    ALA F 257    25.470  88.946  72.223  1.00  47.42    A  C
ATOM  16331  O    ALA F 257    25.369  87.787  72.009  1.00  48.63    A  O
ATOM  16332  N    VAL F 258    25.573  89.871  71.281  1.00  45.26    A  N
ATOM  16333  CA   VAL F 258    25.101  89.864  69.896  1.00  42.92    A  C
ATOM  16334  CB   VAL F 258    25.362  91.233  69.311  1.00  42.49    A  C
ATOM  16335  CG1  VAL F 258    24.739  91.381  68.040  1.00  41.18    A  C
ATOM  16336  CG2  VAL F 258    24.902  92.261  70.213  1.00  41.01    A  C
ATOM  16337  C    VAL F 258    25.607  88.901  68.829  1.00  42.33    A  C
ATOM  16338  O    VAL F 258    26.767  88.755  68.613  1.00  42.98    A  O
ATOM  16339  N    LYS F 259    24.685  88.299  68.113  1.00  40.99    A  N
ATOM  16340  CA   LYS F 259    25.007  87.485  66.978  1.00  39.39    A  C
ATOM  16341  CB   LYS F 259    23.742  86.780  66.521  1.00  39.39    A  C
ATOM  16342  CG   LYS F 259    23.793  85.287  66.587  1.00  38.05    A  C
ATOM  16343  CD   LYS F 259    22.761  84.681  67.463  1.00  33.65    A  C
ATOM  16344  CE   LYS F 259    21.832  83.850  66.697  1.00  37.83    A  C
ATOM  16345  NZ   LYS F 259    21.084  82.979  67.569  1.00  37.29    A  N
ATOM  16346  C    LYS F 259    25.647  88.333  65.874  1.00  38.53    A  C
ATOM  16347  O    LYS F 259    25.234  89.423  65.620  1.00  38.71    A  O
ATOM  16348  N    PRO F 260    26.639  87.794  65.193  1.00  37.33    A  N
ATOM  16349  CA   PRO F 260    27.616  88.549  64.431  1.00  36.68    A  C
ATOM  16350  CB   PRO F 260    28.843  87.677  64.525  1.00  35.67    A  C
ATOM  16351  CG   PRO F 260    28.397  86.441  65.035  1.00  35.43    A  C
ATOM  16352  CD   PRO F 260    27.311  86.732  65.917  1.00  37.32    A  C
ATOM  16353  C    PRO F 260    27.331  88.828  62.983  1.00  36.29    A  C
ATOM  16354  O    PRO F 260    28.213  89.254  62.308  1.00  37.91    A  O
ATOM  16355  N    TRP F 261    26.120  88.625  62.534  1.00  34.50    A  N
ATOM  16356  CA   TRP F 261    25.783  88.849  61.165  1.00  33.21    A  C
ATOM  16357  CB   TRP F 261    25.207  87.575  60.569  1.00  32.48    A  C
ATOM  16358  CG   TRP F 261    26.079  86.409  60.739  1.00  32.90    A  C
ATOM  16359  CD1  TRP F 261    27.056  86.035  59.930  1.00  34.37    A  C
ATOM  16360  NE1  TRP F 261    27.660  84.933  60.393  1.00  33.72    A  N
ATOM  16361  CE2  TRP F 261    27.063  84.567  61.557  1.00  29.90    A  C
ATOM  16362  CD2  TRP F 261    26.059  85.470  61.796  1.00  28.70    A  C
ATOM  16363  CE3  TRP F 261    25.298  85.320  62.926  1.00  29.07    A  C
ATOM  16364  CZ3  TRP F 261    25.546  84.290  63.733  1.00  31.10    A  C
ATOM  16365  CH2  TRP F 261    26.548  83.407  63.479  1.00  29.24    A  C
ATOM  16366  CZ2  TRP F 261    27.325  83.529  62.396  1.00  29.35    A  C
ATOM  16367  C    TRP F 261    24.785  89.957  61.126  1.00  32.93    A  C
ATOM  16368  O    TRP F 261    23.910  89.994  61.916  1.00  33.67    A  O
ATOM  16369  N    ILE F 262    24.961  90.890  60.228  1.00  32.15    A  N
ATOM  16370  CA   ILE F 262    23.938  91.837  59.927  1.00  31.66    A  C
ATOM  16371  CB   ILE F 262    24.505  93.126  59.384  1.00  30.84    A  C
ATOM  16372  CG1  ILE F 262    25.361  92.874  58.177  1.00  28.80    A  C
ATOM  16373  CD1  ILE F 262    25.594  94.044  57.386  1.00  24.78    A  C
```

Appendix 1

```
ATOM  16374  CG2  ILE  F  262    25.322  93.737  60.393  1.00  32.11    A    C
ATOM  16375  C    ILE  F  262    22.894  91.210  59.023  1.00  31.89    A    C
ATOM  16376  O    ILE  F  262    23.192  90.350  58.254  1.00  32.01    A    O
ATOM  16377  N    SER  F  263    21.658  91.617  59.193  1.00  30.73    A    N
ATOM  16378  CA   SER  F  263    20.550  91.046  58.500  1.00  29.39    A    C
ATOM  16379  CB   SER  F  263    19.637  90.385  59.499  1.00  28.80    A    C
ATOM  16380  OG   SER  F  263    18.427  90.110  58.909  1.00  26.31    A    O
ATOM  16381  C    SER  F  263    19.789  92.121  57.816  1.00  30.17    A    C
ATOM  16382  O    SER  F  263    19.465  93.076  58.428  1.00  31.40    A    O
ATOM  16383  N    ALA  F  264    19.550  91.995  56.530  1.00  28.95    A    N
ATOM  16384  CA   ALA  F  264    18.760  92.963  55.832  1.00  27.96    A    C
ATOM  16385  CB   ALA  F  264    18.959  92.822  54.390  1.00  27.09    A    C
ATOM  16386  C    ALA  F  264    17.295  93.018  56.159  1.00  28.34    A    C
ATOM  16387  O    ALA  F  264    16.763  94.071  56.308  1.00  29.24    A    O
ATOM  16388  N    TYR  F  265    16.655  91.871  56.229  1.00  28.43    A    N
ATOM  16389  CA   TYR  F  265    15.234  91.779  56.473  1.00  27.39    A    C
ATOM  16390  CB   TYR  F  265    14.679  90.356  56.239  1.00  27.11    A    C
ATOM  16391  CG   TYR  F  265    14.445  89.579  57.481  1.00  24.80    A    C
ATOM  16392  CD1  TYR  F  265    13.252  89.626  58.126  1.00  23.93    A    C
ATOM  16393  CE1  TYR  F  265    13.074  88.975  59.250  1.00  24.56    A    C
ATOM  16394  CZ   TYR  F  265    14.067  88.244  59.754  1.00  23.80    A    C
ATOM  16395  OH   TYR  F  265    13.877  87.584  60.880  1.00  29.54    A    O
ATOM  16396  CE2  TYR  F  265    15.236  88.172  59.154  1.00  23.93    A    C
ATOM  16397  CD2  TYR  F  265    15.429  88.830  58.032  1.00  23.79    A    C
ATOM  16398  C    TYR  F  265    14.921  92.309  57.837  1.00  27.37    A    C
ATOM  16399  O    TYR  F  265    13.943  92.952  58.033  1.00  27.44    A    O
ATOM  16400  N    THR  F  266    15.794  92.036  58.774  1.00  27.60    A    N
ATOM  16401  CA   THR  F  266    15.647  92.547  60.085  1.00  28.03    A    C
ATOM  16402  CB   THR  F  266    16.808  92.102  60.911  1.00  28.38    A    C
ATOM  16403  OG1  THR  F  266    16.716  90.718  61.150  1.00  31.76    A    O
ATOM  16404  CG2  THR  F  266    16.825  92.778  62.196  1.00  27.20    A    C
ATOM  16405  C    THR  F  266    15.720  94.043  60.078  1.00  28.96    A    C
ATOM  16406  O    THR  F  266    14.915  94.695  60.669  1.00  27.92    A    O
ATOM  16407  N    THR  F  267    16.721  94.572  59.414  1.00  28.30    A    N
ATOM  16408  CA   THR  F  267    16.917  95.989  59.335  1.00  28.47    A    C
ATOM  16409  CB   THR  F  267    18.223  96.313  58.659  1.00  27.99    A    C
ATOM  16410  OG1  THR  F  267    19.279  95.733  59.379  1.00  28.09    A    O
ATOM  16411  CG2  THR  F  267    18.443  97.715  58.678  1.00  26.89    A    C
ATOM  16412  C    THR  F  267    15.798  96.681  58.608  1.00  29.66    A    C
ATOM  16413  O    THR  F  267    15.380  97.725  58.990  1.00  32.37    A    O
ATOM  16414  N    ALA  F  268    15.352  96.106  57.517  1.00  30.68    A    N
ATOM  16415  CA   ALA  F  268    14.310  96.698  56.696  1.00  31.72    A    C
ATOM  16416  CB   ALA  F  268    14.161  95.975  55.433  1.00  31.12    A    C
ATOM  16417  C    ALA  F  268    12.983  96.810  57.336  1.00  32.79    A    C
ATOM  16418  O    ALA  F  268    12.305  97.762  57.142  1.00  34.46    A    O
ATOM  16419  N    TRP  F  269    12.591  95.787  58.057  1.00  32.66    A    N
ATOM  16420  CA   TRP  F  269    11.387  95.821  58.804  1.00  31.47    A    C
ATOM  16421  CB   TRP  F  269    11.139  94.410  59.306  1.00  32.51    A    C
ATOM  16422  CG   TRP  F  269    10.144  94.181  60.347  1.00  35.35    A    C
ATOM  16423  CD1  TRP  F  269     9.519  95.091  61.086  1.00  38.11    A    C
ATOM  16424  NE1  TRP  F  269     8.690  94.507  61.973  1.00  36.03    A    N
ATOM  16425  CE2  TRP  F  269     8.776  93.161  61.814  1.00  38.29    A    C
ATOM  16426  CD2  TRP  F  269     9.686  92.924  60.799  1.00  38.36    A    C
ATOM  16427  CE3  TRP  F  269     9.964  91.607  60.445  1.00  38.34    A    C
```

Appendix 1

```
ATOM  16428  CZ3  TRP  F  269   9.335  90.631  61.093  1.00  31.32  A  C
ATOM  16429  CH2  TRP  F  269   8.439  90.901  62.086  1.00  35.69  A  C
ATOM  16430  CZ2  TRP  F  269   8.158  92.153  62.475  1.00  35.62  A  C
ATOM  16431  C    TRP  F  269  11.480  96.823  59.906  1.00  30.29  A  C
ATOM  16432  O    TRP  F  269  10.612  97.612  60.059  1.00  30.47  A  O
ATOM  16433  N    THR  F  270  12.557  96.800  60.657  1.00  28.82  A  N
ATOM  16434  CA   THR  F  270  12.741  97.688  61.798  1.00  28.00  A  C
ATOM  16435  CB   THR  F  270  14.047  97.408  62.461  1.00  28.70  A  C
ATOM  16436  OG1  THR  F  270  14.113  96.039  62.755  1.00  29.61  A  O
ATOM  16437  CG2  THR  F  270  14.153  98.152  63.712  1.00  28.01  A  C
ATOM  16438  C    THR  F  270  12.789  99.141  61.446  1.00  27.82  A  C
ATOM  16439  O    THR  F  270  12.150  99.919  62.065  1.00  26.89  A  O
ATOM  16440  N    LEU  F  271  13.543  99.470  60.425  1.00  26.24  A  N
ATOM  16441  CA   LEU  F  271  13.691 100.815  59.971  1.00  26.09  A  C
ATOM  16442  CB   LEU  F  271  14.663 100.851  58.825  1.00  26.59  A  C
ATOM  16443  CG   LEU  F  271  16.040 101.442  58.983  1.00  26.01  A  C
ATOM  16444  CD1  LEU  F  271  16.450 101.503  60.364  1.00  21.49  A  C
ATOM  16445  CD2  LEU  F  271  17.039 100.741  58.156  1.00  23.69  A  C
ATOM  16446  C    LEU  F  271  12.400 101.389  59.512  1.00  26.81  A  C
ATOM  16447  O    LEU  F  271  12.173 102.540  59.637  1.00  27.90  A  O
ATOM  16448  N    ALA  F  272  11.572 100.579  58.906  1.00  26.49  A  N
ATOM  16449  CA   ALA  F  272  10.282 101.003  58.486  1.00  26.04  A  C
ATOM  16450  CB   ALA  F  272   9.705  99.969  57.675  1.00  24.20  A  C
ATOM  16451  C    ALA  F  272   9.342 101.366  59.585  1.00  27.55  A  C
ATOM  16452  O    ALA  F  272   8.626 102.305  59.479  1.00  27.62  A  O
ATOM  16453  N    MET  F  273   9.287 100.562  60.620  1.00  29.22  A  N
ATOM  16454  CA   MET  F  273   8.521 100.865  61.795  1.00  30.24  A  C
ATOM  16455  CB   MET  F  273   8.355  99.625  62.631  1.00  30.70  F  C
ATOM  16456  CG   MET  F  273   7.663  98.567  61.854  1.00  34.31  F  C
ATOM  16457  SD   MET  F  273   6.584  97.491  62.729  1.00  40.00  F  S
ATOM  16458  CE   MET  F  273   5.785  98.607  63.792  1.00  41.04  F  C
ATOM  16459  C    MET  F  273   9.036 102.035  62.582  1.00  30.29  A  C
ATOM  16460  O    MET  F  273   8.282 102.836  63.039  1.00  30.03  A  O
ATOM  16461  N    VAL  F  274  10.340 102.144  62.691  1.00  30.22  A  N
ATOM  16462  CA   VAL  F  274  10.963 103.259  63.384  1.00  29.68  A  C
ATOM  16463  CB   VAL  F  274  12.439 103.082  63.592  1.00  28.51  A  C
ATOM  16464  CG1  VAL  F  274  12.974 104.251  64.209  1.00  25.43  A  C
ATOM  16465  CG2  VAL  F  274  12.665 102.000  64.480  1.00  26.67  A  C
ATOM  16466  C    VAL  F  274  10.681 104.587  62.709  1.00  29.90  A  C
ATOM  16467  O    VAL  F  274  10.606 105.585  63.343  1.00  28.12  A  O
ATOM  16468  N    HIS  F  275  10.485 104.559  61.412  1.00  29.70  A  N
ATOM  16469  CA   HIS  F  275  10.207 105.735  60.645  1.00  30.57  A  C
ATOM  16470  CB   HIS  F  275  10.159 105.399  59.178  1.00  29.45  A  C
ATOM  16471  CG   HIS  F  275  10.166 106.587  58.276  1.00  30.30  A  C
ATOM  16472  ND1  HIS  F  275   9.058 107.003  57.597  1.00  30.57  A  N
ATOM  16473  CE1  HIS  F  275   9.354 108.055  56.875  1.00  26.60  A  C
ATOM  16474  NE2  HIS  F  275  10.619 108.333  57.055  1.00  27.82  A  N
ATOM  16475  CD2  HIS  F  275  11.151 107.430  57.923  1.00  30.10  A  C
ATOM  16476  C    HIS  F  275   8.921 106.357  61.092  1.00  31.34  A  C
ATOM  16477  O    HIS  F  275   8.723 107.521  60.962  1.00  31.91  A  O
ATOM  16478  N    GLY  F  276   7.997 105.565  61.575  1.00  31.39  A  N
ATOM  16479  CA   GLY  F  276   6.821 106.139  62.169  1.00  31.87  A  C
ATOM  16480  C    GLY  F  276   6.995 106.906  63.444  1.00  33.44  A  C
ATOM  16481  O    GLY  F  276   6.414 107.938  63.614  1.00  34.57  A  O
```

Appendix 1

```
ATOM  16482  N    MET F 277    7.723 106.342 64.383  1.00 33.54    A  N
ATOM  16483  CA   MET F 277    8.136 107.038 65.578  1.00 33.90    A  C
ATOM  16484  CB   MET F 277    8.394 106.042 66.667  1.00 34.41    F  C
ATOM  16485  CG   MET F 277    7.378 104.981 66.665  1.00 32.60    F  C
ATOM  16486  SD   MET F 277    7.806 103.651 67.697  1.00 35.86    F  S
ATOM  16487  CE   MET F 277    8.816 102.676 66.690  1.00 35.72    F  C
ATOM  16488  C    MET F 277    9.220 108.089 65.521  1.00 35.26    A  C
ATOM  16489  O    MET F 277    9.090 109.099 66.114  1.00 37.17    A  O
ATOM  16490  N    ASP F 278   10.308 107.832 64.834  1.00 35.37    A  N
ATOM  16491  CA   ASP F 278   11.354 108.805 64.676  1.00 34.72    A  C
ATOM  16492  CB   ASP F 278   12.464 108.452 65.634  1.00 35.40    A  C
ATOM  16493  CG   ASP F 278   13.505 109.482 65.728  1.00 36.32    A  C
ATOM  16494  OD1  ASP F 278   13.423 110.508 65.085  1.00 37.32    A  O
ATOM  16495  OD2  ASP F 278   14.435 109.239 66.450  1.00 37.30    A  O-1
ATOM  16496  C    ASP F 278   11.867 108.777 63.272  1.00 34.36    A  C
ATOM  16497  O    ASP F 278   12.720 108.024 62.948  1.00 34.76    A  O
ATOM  16498  N    PRO F 279   11.358 109.627 62.423  1.00 34.20    A  N
ATOM  16499  CA   PRO F 279   11.736 109.578 61.029  1.00 34.13    A  C
ATOM  16500  CB   PRO F 279   10.827 110.618 60.404  1.00 32.18    A  C
ATOM  16501  CG   PRO F 279   10.196 111.253 61.437  1.00 31.02    A  C
ATOM  16502  CD   PRO F 279   10.121 110.377 62.565  1.00 33.19    A  C
ATOM  16503  C    PRO F 279   13.199 109.847 60.737  1.00 36.40    A  C
ATOM  16504  O    PRO F 279   13.741 109.395 59.775  1.00 38.79    A  O
ATOM  16505  N    ALA F 280   13.827 110.620 61.580  1.00 38.67    A  N
ATOM  16506  CA   ALA F 280   15.186 111.036 61.378  1.00 38.51    A  C
ATOM  16507  CB   ALA F 280   15.569 111.924 62.459  1.00 39.06    A  C
ATOM  16508  C    ALA F 280   16.093 109.888 61.388  1.00 38.24    A  C
ATOM  16509  O    ALA F 280   17.034 109.840 60.672  1.00 39.07    A  O
ATOM  16510  N    PHE F 281   15.818 108.983 62.290  1.00 37.80    A  N
ATOM  16511  CA   PHE F 281   16.623 107.830 62.526  1.00 36.69    A  C
ATOM  16512  CB   PHE F 281   15.987 107.129 63.711  1.00 35.38    A  C
ATOM  16513  CG   PHE F 281   16.642 105.885 64.146  1.00 35.02    A  C
ATOM  16514  CD1  PHE F 281   17.136 105.767 65.397  1.00 34.96    A  C
ATOM  16515  CE1  PHE F 281   17.696 104.608 65.796  1.00 37.47    A  C
ATOM  16516  CZ   PHE F 281   17.735 103.548 64.961  1.00 35.00    A  C
ATOM  16517  CE2  PHE F 281   17.220 103.645 63.744  1.00 31.14    A  C
ATOM  16518  CD2  PHE F 281   16.666 104.791 63.341  1.00 34.26    A  C
ATOM  16519  C    PHE F 281   16.645 106.968 61.291  1.00 37.35    A  C
ATOM  16520  O    PHE F 281   17.652 106.484 60.912  1.00 38.17    A  O
ATOM  16521  N    SER F 282   15.520 106.740 60.673  1.00 37.77    A  N
ATOM  16522  CA   SER F 282   15.495 105.987 59.451  1.00 38.76    A  C
ATOM  16523  CB   SER F 282   14.105 105.490 59.197  1.00 39.25    A  C
ATOM  16524  OG   SER F 282   13.806 104.557 60.180  1.00 41.27    A  O
ATOM  16525  C    SER F 282   16.073 106.663 58.250  1.00 39.35    A  C
ATOM  16526  O    SER F 282   16.748 106.076 57.479  1.00 38.81    A  O
ATOM  16527  N    GLU F 283   15.777 107.934 58.118  1.00 39.76    A  N
ATOM  16528  CA   GLU F 283   16.260 108.726 57.030  1.00 40.61    A  C
ATOM  16529  CB   GLU F 283   15.660 110.126 57.097  1.00 40.10    A  C
ATOM  16530  CG   GLU F 283   14.506 110.351 56.129  1.00 42.45    A  C
ATOM  16531  CD   GLU F 283   13.289 111.044 56.721  1.00 52.47    A  C
ATOM  16532  OE1  GLU F 283   13.417 111.779 57.700  1.00 56.64    A  O
ATOM  16533  OE2  GLU F 283   12.188 110.869 56.201  1.00 50.94    A  O-1
ATOM  16534  C    GLU F 283   17.772 108.725 57.092  1.00 40.44    A  C
ATOM  16535  O    GLU F 283   18.442 108.817 56.109  1.00 41.85    A  O
```

Appendix 1

```
ATOM  16536  N    ARG F 284     18.295 108.635 58.285  1.00 39.74    A  N
ATOM  16537  CA   ARG F 284     19.706 108.540 58.508  1.00 40.04    A  C
ATOM  16538  CB   ARG F 284     19.930 108.721 59.982  1.00 40.81    A  C
ATOM  16539  CG   ARG F 284     21.300 108.996 60.339  1.00 44.19    A  C
ATOM  16540  CD   ARG F 284     21.500 108.881 61.781  1.00 52.52    A  C
ATOM  16541  NE   ARG F 284     22.739 108.177 62.003  1.00 60.42    A  N
ATOM  16542  CZ   ARG F 284     23.815 108.700 62.563  1.00 64.71    A  C
ATOM  16543  NH1  ARG F 284     23.814 109.956 62.977  1.00 65.09    A  N
ATOM  16544  NH2  ARG F 284     24.896 107.960 62.701  1.00 64.79    A  N
ATOM  16545  C    ARG F 284     20.446 107.295 58.058  1.00 39.14    A  C
ATOM  16546  O    ARG F 284     21.501 107.376 57.519  1.00 40.22    A  O
ATOM  16547  N    TYR F 285     19.928 106.134 58.356  1.00 37.10    A  N
ATOM  16548  CA   TYR F 285     20.621 104.927 58.048  1.00 34.85    A  C
ATOM  16549  CB   TYR F 285     20.389 103.932 59.157  1.00 35.08    A  C
ATOM  16550  CG   TYR F 285     20.944 104.292 60.490  1.00 35.38    A  C
ATOM  16551  CD1  TYR F 285     22.273 104.430 60.677  1.00 35.16    A  C
ATOM  16552  CE1  TYR F 285     22.766 104.714 61.865  1.00 36.25    A  C
ATOM  16553  CZ   TYR F 285     21.950 104.870 62.907  1.00 36.68    A  C
ATOM  16554  OH   TYR F 285     22.467 105.195 64.121  1.00 38.25    A  O
ATOM  16555  CE2  TYR F 285     20.628 104.735 62.755  1.00 36.17    A  C
ATOM  16556  CD2  TYR F 285     20.135 104.456 61.567  1.00 37.54    A  C
ATOM  16557  C    TYR F 285     20.155 104.335 56.755  1.00 34.24    A  C
ATOM  16558  O    TYR F 285     20.699 103.390 56.285  1.00 32.66    A  O
ATOM  16559  N    TYR F 286     19.129 104.903 56.176  1.00 32.98    A  N
ATOM  16560  CA   TYR F 286     18.543 104.333 54.993  1.00 32.83    A  C
ATOM  16561  CB   TYR F 286     17.268 105.067 54.662  1.00 31.38    A  C
ATOM  16562  CG   TYR F 286     16.566 104.530 53.472  1.00 32.35    A  C
ATOM  16563  CD1  TYR F 286     16.221 103.222 53.393  1.00 34.04    A  C
ATOM  16564  CE1  TYR F 286     15.599 102.733 52.315  1.00 30.08    A  C
ATOM  16565  CZ   TYR F 286     15.313 103.526 51.303  1.00 27.56    A  C
ATOM  16566  OH   TYR F 286     14.686 103.020 50.229  1.00 31.27    A  O
ATOM  16567  CE2  TYR F 286     15.654 104.819 51.346  1.00 30.90    A  C
ATOM  16568  CD2  TYR F 286     16.275 105.318 52.416  1.00 31.23    A  C
ATOM  16569  C    TYR F 286     19.419 104.258 53.766  1.00 33.45    A  C
ATOM  16570  O    TYR F 286     19.434 103.285 53.094  1.00 33.67    A  O
ATOM  16571  N    PRO F 287     20.143 105.307 53.456  1.00 34.76    A  N
ATOM  16572  CA   PRO F 287     21.012 105.284 52.307  1.00 34.77    A  C
ATOM  16573  CB   PRO F 287     21.533 106.691 52.286  1.00 34.49    A  C
ATOM  16574  CG   PRO F 287     20.532 107.423 52.942  1.00 35.36    A  C
ATOM  16575  CD   PRO F 287     20.121 106.646 54.032  1.00 34.91    A  C
ATOM  16576  C    PRO F 287     22.125 104.293 52.473  1.00 34.90    A  C
ATOM  16577  O    PRO F 287     22.537 103.689 51.536  1.00 33.82    A  O
ATOM  16578  N    ARG F 288     22.639 104.164 53.666  1.00 34.72    A  N
ATOM  16579  CA   ARG F 288     23.654 103.189 53.905  1.00 36.14    A  C
ATOM  16580  CB   ARG F 288     24.225 103.372 55.280  1.00 37.68    A  C
ATOM  16581  CG   ARG F 288     24.536 104.780 55.607  1.00 44.18    A  C
ATOM  16582  CD   ARG F 288     25.322 104.862 56.863  1.00 50.55    A  C
ATOM  16583  NE   ARG F 288     24.891 105.935 57.724  1.00 57.73    A  N
ATOM  16584  CZ   ARG F 288     25.580 107.042 57.924  1.00 61.02    A  C
ATOM  16585  NH1  ARG F 288     26.730 107.207 57.320  1.00 62.28    A  N
ATOM  16586  NH2  ARG F 288     25.127 107.979 58.729  1.00 60.85    A  N
ATOM  16587  C    ARG F 288     23.174 101.775 53.723  1.00 35.46    A  C
ATOM  16588  O    ARG F 288     23.834 100.974 53.142  1.00 35.53    A  O
ATOM  16589  N    PHE F 289     21.979 101.504 54.180  1.00 34.16    A  N
```

Appendix 1

```
ATOM  16590  CA   PHE F 289   21.386 100.215 54.083 1.00 32.44  A  C
ATOM  16591  CB   PHE F 289   19.964 100.305 54.655 1.00 31.94  A  C
ATOM  16592  CG   PHE F 289   19.075  99.160 54.296 1.00 30.84  A  C
ATOM  16593  CD1  PHE F 289   19.096  98.025 55.013 1.00 32.09  A  C
ATOM  16594  CE1  PHE F 289   18.318  97.012 54.700 1.00 29.66  A  C
ATOM  16595  CZ   PHE F 289   17.513  97.080 53.680 1.00 28.69  A  C
ATOM  16596  CE2  PHE F 289   17.453  98.169 52.942 1.00 29.12  A  C
ATOM  16597  CD2  PHE F 289   18.217  99.219 53.237 1.00 31.87  A  C
ATOM  16598  C    PHE F 289   21.296  99.841 52.646 1.00 31.18  A  C
ATOM  16599  O    PHE F 289   21.567  99.742 52.279 1.00 29.37  A  O
ATOM  16600  N    LYS F 290   20.897 100.766 51.820 1.00 30.07  A  N
ATOM  16601  CA   LYS F 290   20.767 100.457 50.442 1.00 31.55  A  C
ATOM  16602  CB   LYS F 290   20.260 101.668 49.718 1.00 30.19  A  C
ATOM  16603  CG   LYS F 290   18.800 101.874 49.781 1.00 32.18  A  C
ATOM  16604  CD   LYS F 290   18.481 103.270 49.482 1.00 33.22  A  C
ATOM  16605  CE   LYS F 290   17.798 103.420 48.223 1.00 35.61  A  C
ATOM  16606  NZ   LYS F 290   17.453 104.784 48.123 1.00 34.01  A  N
ATOM  16607  C    LYS F 290   22.089 100.075 49.880 1.00 32.19  A  C
ATOM  16608  O    LYS F 290   22.204  99.133 49.190 1.00 32.86  A  O
ATOM  16609  N    GLN F 291   23.104 100.823 50.192 1.00 33.77  A  N
ATOM  16610  CA   GLN F 291   24.434 100.515 49.763 1.00 35.64  A  C
ATOM  16611  CB   GLN F 291   25.345 101.684 50.086 1.00 37.28  A  C
ATOM  16612  CG   GLN F 291   26.787 101.435 49.885 1.00 43.50  A  C
ATOM  16613  CD   GLN F 291   27.466 102.592 49.256 1.00 53.23  A  C
ATOM  16614  OE1  GLN F 291   27.176 102.943 48.125 1.00 58.54  A  O
ATOM  16615  NE2  GLN F 291   28.380 103.202 49.977 1.00 52.63  A  N
ATOM  16616  C    GLN F 291   24.943  99.214 50.338 1.00 34.01  A  C
ATOM  16617  O    GLN F 291   25.599  98.503 49.679 1.00 35.01  A  O
ATOM  16618  N    THR F 292   24.646  98.919 51.578 1.00 33.10  A  N
ATOM  16619  CA   THR F 292   25.053  97.674 52.156 1.00 31.38  A  C
ATOM  16620  CB   THR F 292   24.762  97.675 53.652 1.00 32.50  A  C
ATOM  16621  OG1  THR F 292   25.473  98.726 54.275 1.00 31.81  A  O
ATOM  16622  CG2  THR F 292   25.157  96.410 54.271 1.00 31.90  A  C
ATOM  16623  C    THR F 292   24.462  96.430 51.538 1.00 31.13  A  C
ATOM  16624  O    THR F 292   25.134  95.471 51.368 1.00 31.42  A  O
ATOM  16625  N    PHE F 293   23.187  96.452 51.237 1.00 29.94  A  N
ATOM  16626  CA   PHE F 293   22.450  95.265 50.883 1.00 29.17  A  C
ATOM  16627  CB   PHE F 293   21.316  95.098 51.886 1.00 27.93  A  C
ATOM  16628  CG   PHE F 293   21.734  94.662 53.229 1.00 26.39  A  C
ATOM  16629  CD1  PHE F 293   22.327  93.486 53.411 1.00 27.94  A  C
ATOM  16630  CE1  PHE F 293   22.666  93.104 54.628 1.00 25.21  A  C
ATOM  16631  CZ   PHE F 293   22.410  93.861 55.663 1.00 21.96  A  C
ATOM  16632  CE2  PHE F 293   21.841  95.009 55.525 1.00 22.03  A  C
ATOM  16633  CD2  PHE F 293   21.483  95.420 54.324 1.00 27.44  A  C
ATOM  16634  C    PHE F 293   21.845  95.180 49.484 1.00 29.61  A  C
ATOM  16635  O    PHE F 293   21.595  94.120 49.015 1.00 29.23  A  O
ATOM  16636  N    VAL F 294   21.574  96.301 48.845 1.00 29.34  A  N
ATOM  16637  CA   VAL F 294   20.750  96.339 47.637 1.00 28.82  A  C
ATOM  16638  CB   VAL F 294   19.932  97.619 47.594 1.00 28.06  A  C
ATOM  16639  CG1  VAL F 294   19.191  97.747 46.349 1.00 25.93  A  C
ATOM  16640  CG2  VAL F 294   19.062  97.743 48.726 1.00 27.03  A  C
ATOM  16641  C    VAL F 294   21.484  96.277 46.303 1.00 30.98  A  C
ATOM  16642  O    VAL F 294   22.368  97.040 46.065 1.00 30.20  A  O
ATOM  16643  N    GLU F 295   21.060  95.383 45.422 1.00 33.11  A  N
```

Appendix 1

```
ATOM  16644  CA   GLU F 295      21.581  95.286  44.077  1.00 32.69      A  C
ATOM  16645  CB   GLU F 295      21.937  93.847  43.850  1.00 33.50      A  C
ATOM  16646  CG   GLU F 295      22.834  93.596  42.717  1.00 34.73      A  C
ATOM  16647  CD   GLU F 295      22.907  92.169  42.367  1.00 36.46      A  C
ATOM  16648  OE1  GLU F 295      23.158  91.337  43.236  1.00 35.99      A  O
ATOM  16649  OE2  GLU F 295      22.720  91.892  41.202  1.00 40.25      A  O-1
ATOM  16650  C    GLU F 295      20.608  95.685  42.987  1.00 32.84      A  C
ATOM  16651  O    GLU F 295      19.727  94.966  42.670  1.00 31.40      A  O
ATOM  16652  N    VAL F 296      20.825  96.814  42.350  1.00 34.30      A  N
ATOM  16653  CA   VAL F 296      20.061  97.173  41.171  1.00 35.71      A  C
ATOM  16654  CB   VAL F 296      20.242  98.614  40.845  1.00 35.53      A  C
ATOM  16655  CG1  VAL F 296      19.564  98.943  39.604  1.00 35.23      A  C
ATOM  16656  CG2  VAL F 296      19.708  99.427  41.915  1.00 35.27      A  C
ATOM  16657  C    VAL F 296      20.610  96.360  40.038  1.00 37.73      A  C
ATOM  16658  O    VAL F 296      21.789  96.275  39.905  1.00 38.47      A  O
ATOM  16659  N    TYR F 297      19.774  95.711  39.246  1.00 39.24      A  N
ATOM  16660  CA   TYR F 297      20.324  94.775  38.311  1.00 39.95      A  C
ATOM  16661  CB   TYR F 297      20.349  93.374  38.915  1.00 40.22      A  C
ATOM  16662  CG   TYR F 297      19.074  92.607  38.911  1.00 39.75      A  C
ATOM  16663  CD1  TYR F 297      18.694  91.922  37.826  1.00 39.12      A  C
ATOM  16664  CE1  TYR F 297      17.594  91.217  37.826  1.00 41.67      A  C
ATOM  16665  CZ   TYR F 297      16.829  91.164  38.916  1.00 42.43      A  C
ATOM  16666  OH   TYR F 297      15.706  90.427  38.841  1.00 44.46      A  O
ATOM  16667  CE2  TYR F 297      17.166  91.825  40.019  1.00 39.32      A  C
ATOM  16668  CD2  TYR F 297      18.286  92.532  40.019  1.00 40.94      A  C
ATOM  16669  C    TYR F 297      19.979  94.714  36.851  1.00 41.64      A  C
ATOM  16670  O    TYR F 297      20.647  94.039  36.125  1.00 44.56      A  O
ATOM  16671  N    ASP F 298      18.991  95.392  36.356  1.00 42.43      A  N
ATOM  16672  CA   ASP F 298      18.676  95.094  34.973  1.00 42.63      A  C
ATOM  16673  CB   ASP F 298      17.249  94.578  34.927  1.00 43.20      A  C
ATOM  16674  CG   ASP F 298      16.878  93.947  33.651  1.00 45.16      A  C
ATOM  16675  OD1  ASP F 298      17.741  93.648  32.861  1.00 47.97      A  O
ATOM  16676  OD2  ASP F 298      15.691  93.767  33.416  1.00 43.44      A  O
ATOM  16677  C    ASP F 298      18.814  96.398  34.266  1.00 42.13      A  C
ATOM  16678  O    ASP F 298      17.891  96.985  33.803  1.00 41.87      A  O
ATOM  16679  N    GLU F 299      20.032  96.873  34.267  1.00 42.19      A  N
ATOM  16680  CA   GLU F 299      20.355  98.166  33.748  1.00 43.81      A  C
ATOM  16681  CB   GLU F 299      20.378  98.213  32.212  1.00 44.16      A  C
ATOM  16682  CG   GLU F 299      21.399  97.281  31.485  1.00 47.79      A  C
ATOM  16683  CD   GLU F 299      22.860  97.354  31.977  1.00 56.57      A  C
ATOM  16684  OE1  GLU F 299      23.434  98.450  32.052  1.00 58.02      A  O
ATOM  16685  OE2  GLU F 299      23.464  96.304  32.275  1.00 54.96      A  O
ATOM  16686  C    GLU F 299      19.412  99.156  34.428  1.00 43.35      A  C
ATOM  16687  O    GLU F 299      18.899 100.060  33.828  1.00 43.13      A  O
ATOM  16688  N    GLY F 300      19.208  98.938  35.713  1.00 43.69      A  N
ATOM  16689  CA   GLY F 300      18.394  99.769  36.561  1.00 42.02      A  C
ATOM  16690  C    GLY F 300      16.909  99.537  36.670  1.00 41.78      A  C
ATOM  16691  O    GLY F 300      16.234 100.282  37.318  1.00 41.71      A  O
ATOM  16692  N    ARG F 301      16.380  98.511  36.051  1.00 41.29      A  N
ATOM  16693  CA   ARG F 301      14.976  98.258  36.201  1.00 39.82      A  C
ATOM  16694  CB   ARG F 301      14.416  97.769  34.900  1.00 41.20      A  C
ATOM  16695  CG   ARG F 301      15.045  98.410  33.745  1.00 43.47      A  C
ATOM  16696  CD   ARG F 301      14.321  98.103  32.498  1.00 45.07      A  C
ATOM  16697  NE   ARG F 301      14.891  96.941  31.861  1.00 48.18      A  N
```

Appendix 1

```
ATOM  16698  CZ   ARG F 301    15.923  96.940  31.041  1.00  49.65    A    C
ATOM  16699  NH1  ARG F 301    16.514  98.045  30.684  1.00  49.55    A    N
ATOM  16700  NH2  ARG F 301    16.348  95.808  30.566  1.00  49.71    A    N
ATOM  16701  C    ARG F 301    14.591  97.323  37.313  1.00  38.80    A    C
ATOM  16702  O    ARG F 301    13.451  97.172  37.594  1.00  38.89    A    O
ATOM  16703  N    LYS F 302    15.546  96.691  37.942  1.00  37.14    A    N
ATOM  16704  CA   LYS F 302    15.226  95.768  38.990  1.00  35.73    A    C
ATOM  16705  CB   LYS F 302    15.210  94.349  38.465  1.00  35.49    A    C
ATOM  16706  CG   LYS F 302    14.588  94.224  37.140  1.00  37.30    A    C
ATOM  16707  CD   LYS F 302    13.978  92.902  36.973  1.00  41.36    A    C
ATOM  16708  CE   LYS F 302    13.486  92.688  35.595  1.00  41.53    A    C
ATOM  16709  NZ   LYS F 302    13.975  91.434  35.053  1.00  43.38    A    N
ATOM  16710  C    LYS F 302    16.154  95.876  40.148  1.00  34.32    A    C
ATOM  16711  O    LYS F 302    17.197  96.408  40.027  1.00  33.39    A    O
ATOM  16712  N    ALA F 303    15.740  95.359  41.286  1.00  32.79    A    N
ATOM  16713  CA   ALA F 303    16.603  95.229  42.417  1.00  29.58    A    C
ATOM  16714  CB   ALA F 303    16.407  96.334  43.337  1.00  29.16    A    C
ATOM  16715  C    ALA F 303    16.301  93.941  43.084  1.00  28.99    A    C
ATOM  16716  O    ALA F 303    15.233  93.457  42.991  1.00  26.82    A    O
ATOM  16717  N    ARG F 304    17.296  93.405  43.748  1.00  29.42    A    N
ATOM  16718  CA   ARG F 304    17.157  92.320  44.667  1.00  30.23    A    C
ATOM  16719  CB   ARG F 304    17.607  91.033  44.036  1.00  31.84    A    C
ATOM  16720  CG   ARG F 304    18.801  91.167  43.249  1.00  32.40    A    C
ATOM  16721  CD   ARG F 304    19.143  89.887  42.654  1.00  35.79    A    C
ATOM  16722  NE   ARG F 304    20.445  89.915  42.051  1.00  39.76    A    N
ATOM  16723  CZ   ARG F 304    20.708  89.468  40.844  1.00  42.67    A    C
ATOM  16724  NH1  ARG F 304    19.774  88.945  40.106  1.00  39.09    A    N
ATOM  16725  NH2  ARG F 304    21.918  89.550  40.379  1.00  46.40    A    N
ATOM  16726  C    ARG F 304    17.989  92.657  45.876  1.00  30.07    A    C
ATOM  16727  O    ARG F 304    18.818  93.486  45.809  1.00  31.52    A    O
ATOM  16728  N    VAL F 305    17.738  92.034  47.007  1.00  30.03    A    N
ATOM  16729  CA   VAL F 305    18.408  92.411  48.240  1.00  27.39    A    C
ATOM  16730  CB   VAL F 305    17.395  92.990  49.201  1.00  27.10    A    C
ATOM  16731  CG1  VAL F 305    18.030  93.638  50.351  1.00  21.95    A    C
ATOM  16732  CG2  VAL F 305    16.530  93.932  48.502  1.00  24.68    A    C
ATOM  16733  C    VAL F 305    19.098  91.262  48.913  1.00  27.92    A    C
ATOM  16734  O    VAL F 305    18.495  90.279  49.148  1.00  28.62    A    O
ATOM  16735  N    ARG F 306    20.370  91.411  49.211  1.00  27.74    A    N
ATOM  16736  CA   ARG F 306    21.154  90.447  49.944  1.00  27.30    A    C
ATOM  16737  CB   ARG F 306    22.618  90.830  49.845  1.00  27.87    A    C
ATOM  16738  CG   ARG F 306    23.233  90.624  48.513  1.00  26.71    A    C
ATOM  16739  CD   ARG F 306    24.706  90.862  48.520  1.00  29.62    A    C
ATOM  16740  NE   ARG F 306    25.071  92.225  48.830  1.00  32.74    A    N
ATOM  16741  CZ   ARG F 306    25.091  93.202  47.949  1.00  34.71    A    C
ATOM  16742  NH1  ARG F 306    24.737  92.975  46.723  1.00  31.62    A    N
ATOM  16743  NH2  ARG F 306    25.414  94.413  48.292  1.00  36.48    A    N
ATOM  16744  C    ARG F 306    20.779  90.420  51.388  1.00  28.14    A    C
ATOM  16745  O    ARG F 306    20.605  91.425  51.979  1.00  27.79    A    O
ATOM  16746  N    GLU F 307    20.608  89.248  51.946  1.00  28.54    A    N
ATOM  16747  CA   GLU F 307    20.257  89.109  53.342  1.00  28.84    A    C
ATOM  16748  CB   GLU F 307    19.793  87.713  53.663  1.00  27.26    A    C
ATOM  16749  CG   GLU F 307    19.680  87.403  55.110  1.00  28.56    A    C
ATOM  16750  CD   GLU F 307    18.694  88.251  55.878  1.00  28.80    A    C
ATOM  16751  OE1  GLU F 307    17.816  88.817  55.297  1.00  27.53    A    O
```

Appendix 1

```
ATOM  16752  OE2 GLU F 307     18.787  88.329  57.084  1.00 27.01      A  O
ATOM  16753  C   GLU F 307     21.343  89.535  54.271  1.00 30.40      A  C
ATOM  16754  O   GLU F 307     21.103  90.059  55.314  1.00 31.79      A  O
ATOM  16755  N   THR F 308     22.559  89.293  53.873  1.00 32.15      A  N
ATOM  16756  CA  THR F 308     23.645  89.477  54.775  1.00 32.37      A  C
ATOM  16757  CB  THR F 308     23.721  88.317  55.754  1.00 31.13      A  C
ATOM  16758  OG1 THR F 308     24.359  88.743  56.938  1.00 31.46      A  O
ATOM  16759  CG2 THR F 308     24.424  87.167  55.208  1.00 30.30      A  C
ATOM  16760  C   THR F 308     24.939  89.903  54.101  1.00 33.92      A  C
ATOM  16761  O   THR F 308     24.995  90.033  52.919  1.00 33.96      A  O
ATOM  16762  N   ALA F 309     25.934  90.205  54.903  1.00 35.77      A  N
ATOM  16763  CA  ALA F 309     27.215  90.781  54.515  1.00 36.66      A  C
ATOM  16764  CB  ALA F 309     27.883  91.276  55.668  1.00 35.02      A  C
ATOM  16765  C   ALA F 309     28.207  90.026  53.659  1.00 39.16      A  C
ATOM  16766  O   ALA F 309     28.878  90.606  52.860  1.00 42.12      A  O
ATOM  16767  N   GLY F 310     28.368  88.744  53.832  1.00 39.53      A  N
ATOM  16768  CA  GLY F 310     29.513  88.104  53.216  1.00 39.36      A  C
ATOM  16769  C   GLY F 310     29.277  87.415  51.897  1.00 37.94      A  C
ATOM  16770  O   GLY F 310     29.925  86.481  51.561  1.00 37.91      A  O
ATOM  16771  N   THR F 311     28.300  87.855  51.163  1.00 36.06      A  N
ATOM  16772  CA  THR F 311     27.799  87.011  50.143  1.00 35.40      A  C
ATOM  16773  CB  THR F 311     26.639  86.194  50.696  1.00 34.98      A  C
ATOM  16774  OG1 THR F 311     25.960  85.544  49.647  1.00 33.56      A  O
ATOM  16775  CG2 THR F 311     25.710  87.062  51.396  1.00 32.55      A  C
ATOM  16776  C   THR F 311     27.399  87.815  48.953  1.00 36.25      A  C
ATOM  16777  O   THR F 311     27.277  88.991  49.035  1.00 36.19      A  O
ATOM  16778  N   ASP F 312     27.208  87.168  47.832  1.00 37.66      A  N
ATOM  16779  CA  ASP F 312     26.627  87.847  46.720  1.00 39.18      A  C
ATOM  16780  CB  ASP F 312     27.570  87.806  45.520  1.00 40.50      A  C
ATOM  16781  CG  ASP F 312     28.871  88.564  45.770  1.00 47.60      A  C
ATOM  16782  OD1 ASP F 312     28.834  89.778  45.956  1.00 47.81      A  O
ATOM  16783  OD2 ASP F 312     29.946  87.959  45.776  1.00 53.30      A  O-1
ATOM  16784  C   ASP F 312     25.243  87.325  46.408  1.00 37.99      A  C
ATOM  16785  O   ASP F 312     24.572  87.875  45.604  1.00 37.65      A  O
ATOM  16786  N   ASP F 313     24.808  86.278  47.077  1.00 37.95      A  N
ATOM  16787  CA  ASP F 313     23.483  85.725  46.868  1.00 39.10      A  C
ATOM  16788  CB  ASP F 313     23.356  84.394  47.614  1.00 39.65      A  C
ATOM  16789  CG  ASP F 313     24.529  83.439  47.399  1.00 43.94      A  C
ATOM  16790  OD1 ASP F 313     24.814  83.068  46.272  1.00 47.57      A  O
ATOM  16791  OD2 ASP F 313     25.144  82.987  48.365  1.00 46.11      A  O-1
ATOM  16792  C   ASP F 313     22.351  86.645  47.356  1.00 39.37      A  C
ATOM  16793  O   ASP F 313     22.376  87.124  48.454  1.00 39.26      A  O
ATOM  16794  N   ALA F 314     21.341  86.871  46.543  1.00 39.09      A  N
ATOM  16795  CA  ALA F 314     20.140  87.546  46.989  1.00 37.96      A  C
ATOM  16796  CB  ALA F 314     19.423  88.112  45.856  1.00 36.53      A  C
ATOM  16797  C   ALA F 314     19.207  86.664  47.774  1.00 38.89      A  C
ATOM  16798  O   ALA F 314     19.053  85.514  47.472  1.00 38.91      A  O
ATOM  16799  N   ASP F 315     18.530  87.249  48.742  1.00 38.35      A  N
ATOM  16800  CA  ASP F 315     17.432  86.633  49.447  1.00 38.71      A  C
ATOM  16801  CB  ASP F 315     16.293  86.427  48.492  1.00 39.43      A  C
ATOM  16802  CG  ASP F 315     15.520  87.654  48.274  1.00 43.31      A  C
ATOM  16803  OD1 ASP F 315     14.908  88.079  49.227  1.00 44.65      A  O
ATOM  16804  OD2 ASP F 315     15.536  88.186  47.169  1.00 45.13      A  O
ATOM  16805  C   ASP F 315     17.704  85.371  50.203  1.00 37.74      A  C
```

Appendix 1

```
ATOM  16806  O    ASP F 315    16.921  84.483  50.245  1.00  37.34    A  O
ATOM  16807  N    GLY F 316    18.809  85.356  50.884  1.00  36.98    A  N
ATOM  16808  CA   GLY F 316    19.205  84.209  51.637  1.00  37.03    A  C
ATOM  16809  C    GLY F 316    18.482  84.165  52.948  1.00  37.58    A  C
ATOM  16810  O    GLY F 316    17.526  84.860  53.130  1.00  37.76    A  O
ATOM  16811  N    GLY F 317    18.922  83.299  53.839  1.00  37.00    A  N
ATOM  16812  CA   GLY F 317    18.351  83.169  55.157  1.00  35.95    A  C
ATOM  16813  C    GLY F 317    16.890  82.826  55.181  1.00  35.16    A  C
ATOM  16814  O    GLY F 317    16.448  81.867  54.653  1.00  35.09    A  O
ATOM  16815  N    VAL F 318    16.148  83.678  55.825  1.00  34.68    A  N
ATOM  16816  CA   VAL F 318    14.731  83.599  55.884  1.00  33.55    A  C
ATOM  16817  CB   VAL F 318    14.267  84.472  57.000  1.00  34.23    A  C
ATOM  16818  CG1  VAL F 318    13.331  85.458  56.565  1.00  33.41    A  C
ATOM  16819  CG2  VAL F 318    13.771  83.675  58.079  1.00  30.67    A  C
ATOM  16820  C    VAL F 318    14.070  83.884  54.546  1.00  34.23    A  C
ATOM  16821  O    VAL F 318    12.967  83.485  54.314  1.00  34.78    A  O
ATOM  16822  N    GLY F 319    14.757  84.565  53.649  1.00  33.04    A  N
ATOM  16823  CA   GLY F 319    14.213  84.879  52.350  1.00  31.73    A  C
ATOM  16824  C    GLY F 319    13.330  86.076  52.167  1.00  32.29    A  C
ATOM  16825  O    GLY F 319    12.681  86.197  51.195  1.00  33.10    A  O
ATOM  16826  N    LEU F 320    13.298  86.966  53.114  1.00  31.23    A  N
ATOM  16827  CA   LEU F 320    12.388  88.051  53.035  1.00  30.44    A  C
ATOM  16828  CB   LEU F 320    11.581  88.048  54.293  1.00  28.61    A  C
ATOM  16829  CG   LEU F 320    10.688  86.835  54.317  1.00  30.35    A  C
ATOM  16830  CD1  LEU F 320     9.984  86.704  55.581  1.00  28.70    A  C
ATOM  16831  CD2  LEU F 320     9.737  86.864  53.216  1.00  24.31    A  C
ATOM  16832  C    LEU F 320    12.998  89.403  52.752  1.00  30.62    A  C
ATOM  16833  O    LEU F 320    12.339  90.374  52.796  1.00  31.20    A  O
ATOM  16834  N    ALA F 321    14.263  89.465  52.427  1.00  30.74    A  N
ATOM  16835  CA   ALA F 321    14.907  90.745  52.305  1.00  31.27    A  C
ATOM  16836  CB   ALA F 321    16.369  90.540  52.156  1.00  30.03    A  C
ATOM  16837  C    ALA F 321    14.381  91.699  51.227  1.00  32.83    A  C
ATOM  16838  O    ALA F 321    14.181  92.849  51.511  1.00  33.97    A  O
ATOM  16839  N    SER F 322    14.150  91.240  50.009  1.00  31.82    A  N
ATOM  16840  CA   SER F 322    13.580  92.091  49.003  1.00  31.60    A  C
ATOM  16841  CB   SER F 322    13.592  91.382  47.680  1.00  31.45    A  C
ATOM  16842  OG   SER F 322    14.852  90.901  47.419  1.00  35.64    A  O
ATOM  16843  C    SER F 322    12.181  92.580  49.313  1.00  31.79    A  C
ATOM  16844  O    SER F 322    11.879  93.705  49.090  1.00  32.39    A  O
ATOM  16845  N    ALA F 323    11.335  91.708  49.819  1.00  30.92    A  N
ATOM  16846  CA   ALA F 323     9.981  92.033  50.224  1.00  30.84    A  C
ATOM  16847  CB   ALA F 323     9.256  90.824  50.547  1.00  30.00    A  C
ATOM  16848  C    ALA F 323     9.853  92.995  51.369  1.00  31.34    A  C
ATOM  16849  O    ALA F 323     8.960  93.775  51.406  1.00  31.48    A  O
ATOM  16850  N    PHE F 324    10.710  92.883  52.348  1.00  30.60    A  N
ATOM  16851  CA   PHE F 324    10.765  93.873  53.381  1.00  30.85    A  C
ATOM  16852  CB   PHE F 324    11.445  93.344  54.625  1.00  31.69    A  C
ATOM  16853  CG   PHE F 324    10.522  92.610  55.506  1.00  30.09    A  C
ATOM  16854  CD1  PHE F 324     9.493  93.241  56.092  1.00  30.74    A  C
ATOM  16855  CE1  PHE F 324     8.634  92.571  56.865  1.00  36.21    A  C
ATOM  16856  CZ   PHE F 324     8.777  91.251  57.050  1.00  33.62    A  C
ATOM  16857  CE2  PHE F 324     9.770  90.615  56.459  1.00  34.14    A  C
ATOM  16858  CD2  PHE F 324    10.635  91.285  55.684  1.00  30.42    A  C
ATOM  16859  C    PHE F 324    11.271  95.208  52.944  1.00  31.04    A  C
```

Appendix 1

```
ATOM  16860  O    PHE F 324   10.767  96.209  53.343  1.00 30.76   A  O
ATOM  16861  N    THR F 325   12.258  95.187  52.080  1.00 30.83   A  N
ATOM  16862  CA   THR F 325   12.834  96.370  51.509  1.00 28.96   A  C
ATOM  16863  CB   THR F 325   14.101  96.046  50.737  1.00 29.08   A  C
ATOM  16864  OG1  THR F 325   14.959  95.318  51.582  1.00 27.67   A  O
ATOM  16865  CG2  THR F 325   14.806  97.250  50.344  1.00 25.75   A  C
ATOM  16866  C    THR F 325   11.795  97.083  50.682  1.00 29.92   A  C
ATOM  16867  O    THR F 325   11.759  98.273  50.650  1.00 31.57   A  O
ATOM  16868  N    LEU F 326   10.933  96.337  50.030  1.00 28.76   A  N
ATOM  16869  CA   LEU F 326    9.848  96.916  49.293  1.00 28.14   A  C
ATOM  16870  CB   LEU F 326    9.112  95.834  48.548  1.00 26.15   A  C
ATOM  16871  CG   LEU F 326    8.030  96.261  47.620  1.00 26.26   A  C
ATOM  16872  CD1  LEU F 326    8.577  96.603  46.371  1.00 26.67   A  C
ATOM  16873  CD2  LEU F 326    7.140  95.177  47.474  1.00 27.29   A  C
ATOM  16874  C    LEU F 326    8.908  97.673  50.199  1.00 29.37   A  C
ATOM  16875  O    LEU F 326    8.383  98.681  49.834  1.00 30.61   A  O
ATOM  16876  N    LEU F 327    8.656  97.163  51.376  1.00 28.97   A  N
ATOM  16877  CA   LEU F 327    7.926  97.923  52.336  1.00 29.44   A  C
ATOM  16878  CB   LEU F 327    7.497  97.052  53.482  1.00 29.82   A  C
ATOM  16879  CG   LEU F 327    6.704  97.799  54.523  1.00 28.72   A  C
ATOM  16880  CD1  LEU F 327    5.345  98.044  54.011  1.00 24.25   A  C
ATOM  16881  CD2  LEU F 327    6.650  96.962  55.680  1.00 32.33   A  C
ATOM  16882  C    LEU F 327    8.663  99.137  52.847  1.00 30.60   A  C
ATOM  16883  O    LEU F 327    8.085 100.152  53.080  1.00 30.57   A  O
ATOM  16884  N    LEU F 328    9.950  98.995  53.064  1.00 30.42   A  N
ATOM  16885  CA   LEU F 328   10.741 100.082  53.530  1.00 29.95   A  C
ATOM  16886  CB   LEU F 328   12.125  99.612  53.891  1.00 28.92   A  C
ATOM  16887  CG   LEU F 328   13.073 100.660  54.421  1.00 27.42   A  C
ATOM  16888  CD1  LEU F 328   12.622 101.241  55.668  1.00 25.96   A  C
ATOM  16889  CD2  LEU F 328   14.432 100.161  54.563  1.00 21.86   A  C
ATOM  16890  C    LEU F 328   10.799 101.166  52.510  1.00 31.24   A  C
ATOM  16891  O    LEU F 328   10.708 102.301  52.832  1.00 31.88   A  O
ATOM  16892  N    ALA F 329   10.946 100.804  51.263  1.00 31.39   A  N
ATOM  16893  CA   ALA F 329   11.004 101.769  50.206  1.00 31.62   A  C
ATOM  16894  CB   ALA F 329   11.349 101.096  48.919  1.00 32.48   A  C
ATOM  16895  C    ALA F 329    9.737 102.549  50.073  1.00 31.47   A  C
ATOM  16896  O    ALA F 329    9.763 103.712  49.853  1.00 31.38   A  O
ATOM  16897  N    ARG F 330    8.619 101.893  50.234  1.00 31.11   A  N
ATOM  16898  CA   ARG F 330    7.343 102.556  50.336  1.00 30.75   A  C
ATOM  16899  CB   ARG F 330    6.226 101.531  50.260  1.00 30.62   A  C
ATOM  16900  CG   ARG F 330    4.892 102.083  50.339  1.00 25.48   A  C
ATOM  16901  CD   ARG F 330    4.434 102.540  49.041  1.00 26.94   A  C
ATOM  16902  NE   ARG F 330    3.020 102.374  48.934  1.00 23.83   A  N
ATOM  16903  CZ   ARG F 330    2.195 103.332  48.635  1.00 26.73   A  C
ATOM  16904  NH1  ARG F 330    2.621 104.523  48.416  1.00 28.31   A  N
ATOM  16905  NH2  ARG F 330    0.940 103.091  48.567  1.00 31.72   A  N
ATOM  16906  C    ARG F 330    7.205 103.466  51.560  1.00 31.55   A  C
ATOM  16907  O    ARG F 330    6.690 104.539  51.463  1.00 31.78   A  O
ATOM  16908  N    GLU F 331    7.702 103.035  52.700  1.00 30.74   A  N
ATOM  16909  CA   GLU F 331    7.741 103.864  53.865  1.00 30.44   A  C
ATOM  16910  CB   GLU F 331    8.196 103.080  55.088  1.00 30.40   A  C
ATOM  16911  CG   GLU F 331    8.284 103.858  56.359  1.00 27.10   A  C
ATOM  16912  CD   GLU F 331    6.974 104.365  56.902  1.00 30.54   A  C
ATOM  16913  OE1  GLU F 331    6.041 103.623  57.012  1.00 32.86   A  O
```

Appendix 1

```
ATOM  16914  OE2 GLU F 331      6.871 105.513  57.249  1.00 29.82      A  O-1
ATOM  16915  C   GLU F 331      8.585 105.092  53.612  1.00 32.38      A  C
ATOM  16916  O   GLU F 331      8.280 106.131  54.095  1.00 34.26      A  O
ATOM  16917  N   MET F 332      9.625 104.991  52.811  1.00 32.97      A  N
ATOM  16918  CA  MET F 332     10.480 106.134  52.563  1.00 33.12      A  C
ATOM  16919  CB  MET F 332     11.932 105.721  52.533  1.00 33.04      F  C
ATOM  16920  CG  MET F 332     12.300 104.800  53.602  1.00 33.56      F  C
ATOM  16921  SD  MET F 332     12.236 105.454  55.236  1.00 40.09      F  S
ATOM  16922  CE  MET F 332     13.660 106.427  55.255  1.00 35.39      F  C
ATOM  16923  C   MET F 332     10.166 106.979  51.363  1.00 33.11      A  C
ATOM  16924  O   MET F 332     10.799 107.944  51.107  1.00 34.14      A  O
ATOM  16925  N   GLY F 333      9.176 106.609  50.617  1.00 33.18      A  N
ATOM  16926  CA  GLY F 333      8.850 107.354  49.454  1.00 33.34      A  C
ATOM  16927  C   GLY F 333      9.764 107.157  48.297  1.00 33.54      A  C
ATOM  16928  O   GLY F 333      9.770 107.947  47.412  1.00 35.18      A  O
ATOM  16929  N   ASP F 334     10.528 106.090  48.299  1.00 34.11      A  N
ATOM  16930  CA  ASP F 334     11.477 105.808  47.255  1.00 33.86      A  C
ATOM  16931  CB  ASP F 334     12.553 104.946  47.831  1.00 33.16      A  C
ATOM  16932  CG  ASP F 334     13.729 104.846  46.971  1.00 36.08      A  C
ATOM  16933  OD1 ASP F 334     13.598 104.978  45.775  1.00 32.95      A  O
ATOM  16934  OD2 ASP F 334     14.808 104.627  47.491  1.00 36.10      A  O-1
ATOM  16935  C   ASP F 334     10.793 105.084  46.121  1.00 34.76      A  C
ATOM  16936  O   ASP F 334     10.717 103.898  46.087  1.00 36.26      A  O
ATOM  16937  N   GLN F 335     10.259 105.843  45.197  1.00 34.10      A  N
ATOM  16938  CA  GLN F 335      9.531 105.309  44.093  1.00 33.87      A  C
ATOM  16939  CB  GLN F 335      8.831 106.408  43.318  1.00 33.69      A  C
ATOM  16940  CG  GLN F 335      7.609 106.927  43.995  1.00 35.34      A  C
ATOM  16941  CD  GLN F 335      6.723 107.784  43.130  1.00 37.96      A  C
ATOM  16942  OE1 GLN F 335      6.080 108.675  43.611  1.00 41.83      A  O
ATOM  16943  NE2 GLN F 335      6.679 107.505  41.863  1.00 35.45      A  N
ATOM  16944  C   GLN F 335     10.396 104.474  43.206  1.00 33.37      A  C
ATOM  16945  O   GLN F 335      9.932 103.556  42.617  1.00 33.36      A  O
ATOM  16946  N   GLN F 336     11.643 104.852  43.065  1.00 32.81      A  N
ATOM  16947  CA  GLN F 336     12.588 104.117  42.263  1.00 33.28      A  C
ATOM  16948  CB  GLN F 336     13.853 104.936  42.126  1.00 33.85      A  C
ATOM  16949  CG  GLN F 336     14.455 104.950  40.798  1.00 38.77      A  C
ATOM  16950  CD  GLN F 336     15.931 105.103  40.846  1.00 41.16      A  C
ATOM  16951  OE1 GLN F 336     16.489 105.500  41.834  1.00 43.11      A  O
ATOM  16952  NE2 GLN F 336     16.574 104.773  39.771  1.00 43.82      A  N
ATOM  16953  C   GLN F 336     12.971 102.761  42.779  1.00 31.91      A  C
ATOM  16954  O   GLN F 336     12.931 101.822  42.055  1.00 31.03      A  O
ATOM  16955  N   LEU F 337     13.351 102.668  44.035  1.00 28.71      A  N
ATOM  16956  CA  LEU F 337     13.613 101.387  44.625  1.00 28.60      A  C
ATOM  16957  CB  LEU F 337     14.219 101.536  45.997  1.00 27.09      A  C
ATOM  16958  CG  LEU F 337     14.673 100.263  46.641  1.00 25.36      A  C
ATOM  16959  CD1 LEU F 337     15.468  99.497  45.670  1.00 26.38      A  C
ATOM  16960  CD2 LEU F 337     15.396 100.452  47.895  1.00 21.09      A  C
ATOM  16961  C   LEU F 337     12.367 100.515  44.654  1.00 29.14      A  C
ATOM  16962  O   LEU F 337     12.430  99.367  44.357  1.00 30.26      A  O
ATOM  16963  N   PHE F 338     11.228 101.085  44.958  1.00 28.95      A  N
ATOM  16964  CA  PHE F 338     10.004 100.340  44.958  1.00 28.91      A  C
ATOM  16965  CB  PHE F 338      8.900 101.242  45.504  1.00 28.44      A  C
ATOM  16966  CG  PHE F 338      7.556 100.629  45.531  1.00 24.29      A  C
ATOM  16967  CD1 PHE F 338      7.021 100.200  46.681  1.00 24.07      A  C
```

Appendix 1

```
ATOM  16968  CE1  PHE F 338    5.817  99.666  46.693  1.00 22.53   A    C
ATOM  16969  CZ   PHE F 338    5.125  99.569  45.580  1.00 20.75   A    C
ATOM  16970  CE2  PHE F 338    5.623 100.003  44.441  1.00 21.91   A    C
ATOM  16971  CD2  PHE F 338    6.810 100.540  44.408  1.00 23.74   A    C
ATOM  16972  C    PHE F 338    9.652  99.774  43.587  1.00 29.06   A    C
ATOM  16973  O    PHE F 338    9.301  98.643  43.476  1.00 28.96   A    O
ATOM  16974  N    ASP F 339    9.790 100.551  42.541  1.00 29.48   A    N
ATOM  16975  CA   ASP F 339    9.547 100.043  41.220  1.00 30.31   A    C
ATOM  16976  CB   ASP F 339    9.622 101.178  40.230  1.00 31.61   A    C
ATOM  16977  CG   ASP F 339    9.112 100.818  38.898  1.00 34.17   A    C
ATOM  16978  OD1  ASP F 339    7.909 100.855  38.694  1.00 37.89   A    O
ATOM  16979  OD2  ASP F 339    9.922 100.540  38.034  1.00 37.69   A    O-1
ATOM  16980  C    ASP F 339   10.524  98.957  40.855  1.00 31.17   A    C
ATOM  16981  O    ASP F 339   10.184  97.988  40.255  1.00 32.77   A    O
ATOM  16982  N    GLN F 340   11.766  99.133  41.188  1.00 29.52   A    N
ATOM  16983  CA   GLN F 340   12.706  98.116  40.906  1.00 29.49   A    C
ATOM  16984  CB   GLN F 340   14.078  98.622  41.219  1.00 30.87   A    C
ATOM  16985  CG   GLN F 340   14.568  99.596  40.286  1.00 30.96   A    C
ATOM  16986  CD   GLN F 340   15.691 100.322  40.838  1.00 34.06   A    C
ATOM  16987  OE1  GLN F 340   15.846 100.413  42.005  1.00 38.96   A    O
ATOM  16988  NE2  GLN F 340   16.491 100.845  39.997  1.00 37.87   A    N
ATOM  16989  C    GLN F 340   12.486  96.839  41.642  1.00 29.72   A    C
ATOM  16990  O    GLN F 340   12.640  95.790  41.093  1.00 29.22   A    O
ATOM  16991  N    LEU F 341   12.186  96.938  42.916  1.00 28.83   A    N
ATOM  16992  CA   LEU F 341   12.005  95.773  43.717  1.00 27.87   A    C
ATOM  16993  CB   LEU F 341   11.819  96.182  45.152  1.00 27.04   A    C
ATOM  16994  CG   LEU F 341   12.821  95.857  46.210  1.00 26.88   A    C
ATOM  16995  CD1  LEU F 341   14.059  95.382  45.630  1.00 17.59   A    C
ATOM  16996  CD2  LEU F 341   13.033  97.033  47.054  1.00 20.98   A    C
ATOM  16997  C    LEU F 341   10.822  94.969  43.261  1.00 28.79   A    C
ATOM  16998  O    LEU F 341   10.896  93.785  43.177  1.00 28.46   A    O
ATOM  16999  N    LEU F 342    9.729  95.632  42.955  1.00 28.42   A    N
ATOM  17000  CA   LEU F 342    8.540  94.997  42.449  1.00 29.36   A    C
ATOM  17001  CB   LEU F 342    7.351  95.928  42.476  1.00 28.40   A    C
ATOM  17002  CG   LEU F 342    5.983  95.291  42.452  1.00 26.43   A    C
ATOM  17003  CD1  LEU F 342    5.844  94.312  43.486  1.00 27.32   A    C
ATOM  17004  CD2  LEU F 342    4.967  96.289  42.628  1.00 25.90   A    C
ATOM  17005  C    LEU F 342    8.687  94.320  41.095  1.00 30.54   A    C
ATOM  17006  O    LEU F 342    8.106  93.313  40.869  1.00 30.95   A    O
ATOM  17007  N    ASN F 343    9.467  94.889  40.210  1.00 29.85   A    N
ATOM  17008  CA   ASN F 343    9.762  94.273  38.943  1.00 30.41   A    C
ATOM  17009  CB   ASN F 343   10.523  95.212  38.031  1.00 30.09   A    C
ATOM  17010  CG   ASN F 343    9.684  96.279  37.474  1.00 28.93   A    C
ATOM  17011  OD1  ASN F 343    8.505  96.172  37.427  1.00 33.85   A    O
ATOM  17012  ND2  ASN F 343   10.298  97.309  37.020  1.00 22.29   A    N
ATOM  17013  C    ASN F 343   10.517  92.978  39.099  1.00 30.57   A    C
ATOM  17014  O    ASN F 343   10.362  92.096  38.336  1.00 31.15   A    O
ATOM  17015  N    HIS F 344   11.398  92.904  40.058  1.00 30.46   A    N
ATOM  17016  CA   HIS F 344   11.980  91.654  40.413  1.00 31.81   A    C
ATOM  17017  CB   HIS F 344   13.212  91.912  41.250  1.00 31.41   A    C
ATOM  17018  CG   HIS F 344   13.781  90.707  41.921  1.00 33.47   A    C
ATOM  17019  ND1  HIS F 344   13.477  90.373  43.214  1.00 35.63   A    N
ATOM  17020  CE1  HIS F 344   14.144  89.297  43.554  1.00 38.49   A    C
ATOM  17021  NE2  HIS F 344   14.889  88.935  42.536  1.00 36.74   A    N
```

Appendix 1

```
ATOM  17022  CD2  HIS  F  344    14.689  89.806  41.509  1.00  34.77  A  C
ATOM  17023  C    HIS  F  344    11.062  90.677  41.108  1.00  32.40  A  C
ATOM  17024  O    HIS  F  344    11.095  89.518  40.851  1.00  32.65  A  O
ATOM  17025  N    LEU  F  345    10.307  91.151  42.067  1.00  32.05  A  N
ATOM  17026  CA   LEU  F  345     9.493  90.282  42.873  1.00  33.02  A  C
ATOM  17027  CB   LEU  F  345     9.101  91.087  44.086  1.00  31.94  A  C
ATOM  17028  CG   LEU  F  345     9.548  90.862  45.507  1.00  33.13  A  C
ATOM  17029  CD1  LEU  F  345    10.667  89.964  45.681  1.00  29.89  A  C
ATOM  17030  CD2  LEU  F  345     9.745  92.133  46.183  1.00  25.90  A  C
ATOM  17031  C    LEU  F  345     8.222  89.676  42.273  1.00  33.78  A  C
ATOM  17032  O    LEU  F  345     7.999  88.503  42.343  1.00  34.38  A  O
ATOM  17033  N    GLU  F  346     7.361  90.522  41.755  1.00  32.83  A  N
ATOM  17034  CA   GLU  F  346     6.109  90.161  41.108  1.00  33.66  A  C
ATOM  17035  CB   GLU  F  346     5.242  91.397  41.033  1.00  32.33  A  C
ATOM  17036  CG   GLU  F  346     3.815  91.114  40.966  1.00  37.37  A  C
ATOM  17037  CD   GLU  F  346     2.968  92.332  40.847  1.00  44.58  A  C
ATOM  17038  OE1  GLU  F  346     3.371  93.316  40.256  1.00  45.10  A  O
ATOM  17039  OE2  GLU  F  346     1.858  92.311  41.323  1.00  46.46  A  O-1
ATOM  17040  C    GLU  F  346     6.050  89.411  39.749  1.00  34.93  A  C
ATOM  17041  O    GLU  F  346     5.240  88.551  39.571  1.00  34.92  A  O
ATOM  17042  N    PRO  F  347     6.857  89.751  38.771  1.00  35.28  A  N
ATOM  17043  CA   PRO  F  347     6.671  89.140  37.465  1.00  35.30  A  C
ATOM  17044  CB   PRO  F  347     7.621  89.927  36.618  1.00  35.82  A  C
ATOM  17045  CG   PRO  F  347     7.517  91.207  37.191  1.00  35.49  A  C
ATOM  17046  CD   PRO  F  347     7.592  90.998  38.617  1.00  34.25  A  C
ATOM  17047  C    PRO  F  347     6.884  87.641  37.427  1.00  34.79  A  C
ATOM  17048  O    PRO  F  347     6.151  86.963  36.776  1.00  35.93  A  O
ATOM  17049  N    PRO  F  348     7.835  87.152  38.188  1.00  33.57  A  N
ATOM  17050  CA   PRO  F  348     8.133  85.749  38.383  1.00  33.10  A  C
ATOM  17051  CB   PRO  F  348     9.285  85.810  39.354  1.00  32.96  A  C
ATOM  17052  CG   PRO  F  348     9.833  87.030  39.214  1.00  31.49  A  C
ATOM  17053  CD   PRO  F  348     8.885  87.986  38.740  1.00  32.88  A  C
ATOM  17054  C    PRO  F  348     7.014  84.951  39.014  1.00  33.97  A  C
ATOM  17055  O    PRO  F  348     6.828  83.813  38.735  1.00  34.56  A  O
ATOM  17056  N    ALA  F  349     6.270  85.605  39.866  1.00  34.66  A  N
ATOM  17057  CA   ALA  F  349     5.236  85.033  40.676  1.00  35.28  A  C
ATOM  17058  CB   ALA  F  349     4.968  85.906  41.817  1.00  34.36  A  C
ATOM  17059  C    ALA  F  349     3.964  84.689  39.912  1.00  35.95  A  C
ATOM  17060  O    ALA  F  349     3.103  83.988  40.410  1.00  35.27  A  O
ATOM  17061  N    LYS  F  350     3.893  85.158  38.677  1.00  36.15  A  N
ATOM  17062  CA   LYS  F  350     2.806  84.845  37.784  1.00  36.94  A  C
ATOM  17063  CB   LYS  F  350     2.900  83.409  37.318  1.00  36.43  A  C
ATOM  17068  C    LYS  F  350     1.440  85.160  38.324  1.00  36.74  A  C
ATOM  17069  O    LYS  F  350     0.633  84.308  38.516  1.00  38.71  A  O
ATOM  17070  N    PRO  F  351     1.191  86.417  38.564  1.00  35.99  A  N
ATOM  17071  CA   PRO  F  351    -0.105  86.813  39.022  1.00  36.71  A  C
ATOM  17072  CB   PRO  F  351     0.097  88.268  39.314  1.00  36.44  A  C
ATOM  17073  CG   PRO  F  351     1.126  88.650  38.492  1.00  34.74  A  C
ATOM  17074  CD   PRO  F  351     2.065  87.573  38.481  1.00  36.04  A  C
ATOM  17075  C    PRO  F  351    -1.132  86.669  37.966  1.00  37.36  A  C
ATOM  17076  O    PRO  F  351    -0.899  86.976  36.844  1.00  38.17  A  O
ATOM  17077  N    SER  F  352    -2.289  86.199  38.344  1.00  37.94  A  N
ATOM  17078  CA   SER  F  352    -3.415  86.256  37.476  1.00  38.67  A  C
ATOM  17079  CB   SER  F  352    -3.721  84.895  36.897  1.00  38.87  A  C
```

Appendix 1

```
ATOM  17080  OG   SER F 352      -4.226  84.042  37.865  1.00 39.47      A  O
ATOM  17081  C    SER F 352      -4.573  86.759  38.269  1.00 38.76      A  C
ATOM  17082  O    SER F 352      -4.693  86.481  39.417  1.00 39.07      A  O
ATOM  17083  N    ILE F 353      -5.451  87.501  37.646  1.00 38.42      A  N
ATOM  17084  CA   ILE F 353      -6.662  87.872  38.299  1.00 37.07      A  C
ATOM  17085  CB   ILE F 353      -6.901  89.317  38.126  1.00 37.02      A  C
ATOM  17086  CG1  ILE F 353      -5.846  90.089  38.869  1.00 34.14      A  C
ATOM  17087  CD1  ILE F 353      -6.016  91.472  38.777  1.00 29.31      A  C
ATOM  17088  CG2  ILE F 353      -8.190  89.667  38.663  1.00 36.34      A  C
ATOM  17089  C    ILE F 353      -7.745  87.131  37.607  1.00 36.73      A  C
ATOM  17090  O    ILE F 353      -7.982  87.348  36.484  1.00 37.05      A  O
ATOM  17091  N    VAL F 354      -8.388  86.207  38.270  1.00 37.36      A  N
ATOM  17092  CA   VAL F 354      -9.304  85.378  37.570  1.00 36.27      A  C
ATOM  17093  CB   VAL F 354      -9.088  83.942  37.872  1.00 36.64      A  C
ATOM  17094  CG1  VAL F 354     -10.231  83.160  37.427  1.00 34.36      A  C
ATOM  17095  CG2  VAL F 354      -7.884  83.507  37.181  1.00 35.63      A  C
ATOM  17096  C    VAL F 354     -10.745  85.752  37.656  1.00 36.49      A  C
ATOM  17097  O    VAL F 354     -11.371  85.916  36.632  1.00 41.41      A  O
ATOM  17098  N    SER F 355     -11.322  85.971  38.795  1.00 32.72      A  N
ATOM  17099  CA   SER F 355     -12.689  86.399  38.639  1.00 31.29      A  C
ATOM  17100  CB   SER F 355     -13.634  85.282  39.034  1.00 31.02      A  C
ATOM  17101  OG   SER F 355     -14.940  85.700  39.261  1.00 31.62      A  O
ATOM  17102  C    SER F 355     -12.884  87.633  39.443  1.00 30.84      A  C
ATOM  17103  O    SER F 355     -13.685  87.690  40.312  1.00 30.45      A  O
ATOM  17104  N    ALA F 356     -12.095  88.632  39.110  1.00 29.11      A  N
ATOM  17105  CA   ALA F 356     -11.969  89.830  39.888  1.00 28.63      A  C
ATOM  17106  CB   ALA F 356     -13.291  90.379  40.199  1.00 26.52      A  C
ATOM  17107  C    ALA F 356     -11.210  89.530  41.142  1.00 28.32      A  C
ATOM  17108  O    ALA F 356     -11.317  90.242  42.096  1.00 29.45      A  O
ATOM  17109  N    SER F 357     -10.448  88.456  41.104  1.00 26.56      A  N
ATOM  17110  CA   SER F 357      -9.724  87.948  42.236  1.00 26.21      A  C
ATOM  17111  CB   SER F 357     -10.469  86.755  42.790  1.00 26.98      A  C
ATOM  17112  OG   SER F 357     -10.184  86.502  44.126  1.00 27.25      A  O
ATOM  17113  C    SER F 357      -8.290  87.586  41.916  1.00 26.04      A  C
ATOM  17114  O    SER F 357      -8.004  86.990  40.937  1.00 26.16      A  O
ATOM  17115  N    LEU F 358      -7.391  87.924  42.800  1.00 26.62      A  N
ATOM  17116  CA   LEU F 358      -6.005  87.766  42.540  1.00 26.68      A  C
ATOM  17117  CB   LEU F 358      -5.294  89.030  42.924  1.00 26.18      A  C
ATOM  17118  CG   LEU F 358      -3.800  88.918  42.895  1.00 27.38      A  C
ATOM  17119  CD1  LEU F 358      -3.371  88.900  41.509  1.00 26.96      A  C
ATOM  17120  CD2  LEU F 358      -3.213  90.006  43.612  1.00 19.35      A  C
ATOM  17121  C    LEU F 358      -5.319  86.562  43.150  1.00 28.88      A  C
ATOM  17122  O    LEU F 358      -5.409  86.292  44.290  1.00 30.11      A  O
ATOM  17123  N    ARG F 359      -4.617  85.847  42.311  1.00 31.47      A  N
ATOM  17124  CA   ARG F 359      -3.829  84.716  42.699  1.00 34.83      A  C
ATOM  17125  CB   ARG F 359      -4.427  83.461  42.103  1.00 37.00      A  C
ATOM  17126  CG   ARG F 359      -5.754  83.068  42.649  1.00 44.49      A  C
ATOM  17127  CD   ARG F 359      -5.581  82.234  43.903  1.00 57.11      A  C
ATOM  17128  NE   ARG F 359      -6.824  81.910  44.596  1.00 60.97      A  N
ATOM  17129  CZ   ARG F 359      -7.820  82.754  44.806  1.00 62.53      A  C
ATOM  17130  NH1  ARG F 359      -7.761  83.995  44.360  1.00 61.42      A  N
ATOM  17131  NH2  ARG F 359      -8.889  82.335  45.442  1.00 60.75      A  N
ATOM  17132  C    ARG F 359      -2.407  84.851  42.195  1.00 34.76      A  C
ATOM  17133  O    ARG F 359      -2.166  85.409  41.175  1.00 33.97      A  O
```

Appendix 1

```
ATOM  17134  N    TYR F 360   -1.466  84.339  42.957  1.00  35.43      A  N
ATOM  17135  CA   TYR F 360   -0.119  84.141  42.485  1.00  36.11      A  C
ATOM  17136  CB   TYR F 360    0.908  84.695  43.460  1.00  35.02      A  C
ATOM  17137  CG   TYR F 360    0.936  86.167  43.463  1.00  33.41      A  C
ATOM  17138  CD1  TYR F 360    1.649  86.853  42.544  1.00  31.80      A  C
ATOM  17139  CE1  TYR F 360    1.630  88.162  42.525  1.00  33.63      A  C
ATOM  17140  CZ   TYR F 360    0.888  88.829  43.422  1.00  34.21      A  C
ATOM  17141  OH   TYR F 360    0.856  90.171  43.422  1.00  33.95      A  O
ATOM  17142  CE2  TYR F 360    0.167  88.172  44.321  1.00  31.59      A  C
ATOM  17143  CD2  TYR F 360    0.184  86.870  44.340  1.00  31.24      A  C
ATOM  17144  C    TYR F 360    0.132  82.684  42.339  1.00  37.19      A  C
ATOM  17145  O    TYR F 360    0.106  81.964  43.280  1.00  37.82      A  O
ATOM  17146  N    GLU F 361    0.387  82.253  41.136  1.00  38.39      A  N
ATOM  17147  CA   GLU F 361    1.092  81.047  40.906  1.00  41.78      A  C
ATOM  17148  CB   GLU F 361    1.015  80.675  39.436  1.00  42.50      A  C
ATOM  17149  CG   GLU F 361    1.090  79.214  39.184  1.00  52.58      A  C
ATOM  17150  CD   GLU F 361    0.476  78.796  37.881  1.00  63.48      A  C
ATOM  17151  OE1  GLU F 361   -0.738  78.518  37.859  1.00  66.74      A  O
ATOM  17152  OE2  GLU F 361    1.206  78.715  36.880  1.00  64.59      A  O-1
ATOM  17153  C    GLU F 361    2.469  81.466  41.252  1.00  41.39      A  C
ATOM  17154  O    GLU F 361    2.826  82.625  41.024  1.00  43.40      A  O
ATOM  17155  N    HIS F 362    3.257  80.547  41.779  1.00  39.44      A  N
ATOM  17156  CA   HIS F 362    4.647  80.840  42.107  1.00  38.87      A  C
ATOM  17157  CB   HIS F 362    5.419  81.009  40.832  1.00  38.75      A  C
ATOM  17158  CG   HIS F 362    5.161  79.919  39.873  1.00  45.77      A  C
ATOM  17159  ND1  HIS F 362    5.422  78.612  40.185  1.00  51.51      A  N
ATOM  17160  CE1  HIS F 362    5.044  77.847  39.187  1.00  52.39      A  C
ATOM  17161  NE2  HIS F 362    4.546  78.614  38.241  1.00  51.05      A  N
ATOM  17162  CD2  HIS F 362    4.600  79.914  38.648  1.00  49.27      A  C
ATOM  17163  C    HIS F 362    5.040  81.947  43.039  1.00  36.18      A  C
ATOM  17164  O    HIS F 362    5.856  82.732  42.696  1.00  36.20      A  O
ATOM  17165  N    PRO F 363    4.504  81.992  44.236  1.00  34.21      A  N
ATOM  17166  CA   PRO F 363    5.009  82.966  45.172  1.00  33.41      A  C
ATOM  17167  CB   PRO F 363    4.061  82.818  46.343  1.00  33.56      A  C
ATOM  17168  CG   PRO F 363    3.547  81.561  46.227  1.00  31.92      A  C
ATOM  17169  CD   PRO F 363    3.376  81.282  44.825  1.00  33.19      A  C
ATOM  17170  C    PRO F 363    6.443  82.689  45.573  1.00  33.08      A  C
ATOM  17171  O    PRO F 363    6.864  81.581  45.759  1.00  33.20      A  O
ATOM  17172  N    GLY F 364    7.212  83.744  45.648  1.00  32.60      A  N
ATOM  17173  CA   GLY F 364    8.618  83.683  45.937  1.00  32.07      A  C
ATOM  17174  C    GLY F 364    9.008  83.222  47.300  1.00  33.58      A  C
ATOM  17175  O    GLY F 364    9.969  82.563  47.482  1.00  34.78      A  O
ATOM  17176  N    SER F 365    8.241  83.634  48.276  1.00  33.54      A  N
ATOM  17177  CA   SER F 365    8.618  83.499  49.631  1.00  32.70      A  C
ATOM  17178  CB   SER F 365    9.164  84.805  50.158  1.00  32.72      A  C
ATOM  17179  OG   SER F 365    8.598  85.920  49.546  1.00  33.94      A  O
ATOM  17180  C    SER F 365    7.408  83.119  50.363  1.00  32.38      A  C
ATOM  17181  O    SER F 365    6.385  82.954  49.790  1.00  31.95      A  O
ATOM  17182  N    LEU F 366    7.572  82.958  51.655  1.00  32.38      A  N
ATOM  17183  CA   LEU F 366    6.514  82.979  52.622  1.00  31.47      A  C
ATOM  17184  CB   LEU F 366    7.069  82.592  53.980  1.00  32.53      A  C
ATOM  17185  CG   LEU F 366    7.038  81.214  54.608  1.00  33.01      A  C
ATOM  17186  CD1  LEU F 366    6.356  80.263  53.771  1.00  32.11      A  C
ATOM  17187  CD2  LEU F 366    8.385  80.754  54.901  1.00  30.50      A  C
```

Appendix 1

```
ATOM  17188  C    LEU F 366    6.020  84.407  52.697  1.00  30.16    A   C
ATOM  17189  O    LEU F 366    6.704  85.312  52.325  1.00  28.23    A   O
ATOM  17190  N    LEU F 367    4.791  84.592  53.099  1.00  23.03    A   N
ATOM  17191  CA   LEU F 367    4.263  85.907  53.346  1.00  27.32    A   C
ATOM  17192  CB   LEU F 367    5.099  86.632  54.347  1.00  26.01    A   C
ATOM  17193  CG   LEU F 367    5.056  86.024  55.702  1.00  26.68    A   C
ATOM  17194  CD1  LEU F 367    5.816  86.815  56.623  1.00  27.09    A   C
ATOM  17195  CD2  LEU F 367    3.691  85.930  56.121  1.00  23.36    A   C
ATOM  17196  C    LEU F 367    4.228  86.714  52.121  1.00  26.93    A   C
ATOM  17197  O    LEU F 367    4.206  87.884  52.193  1.00  27.46    A   O
ATOM  17198  N    PHE F 368    4.294  86.067  50.983  1.00  26.46    A   N
ATOM  17199  CA   PHE F 368    4.372  86.763  49.736  1.00  25.47    A   C
ATOM  17200  CB   PHE F 368    4.727  85.747  48.660  1.00  25.00    A   C
ATOM  17201  CG   PHE F 368    4.992  86.346  47.340  1.00  22.49    A   C
ATOM  17202  CD1  PHE F 368    6.210  86.811  47.006  1.00  20.39    A   C
ATOM  17203  CE1  PHE F 368    6.407  87.362  45.830  1.00  19.16    A   C
ATOM  17204  CZ   PHE F 368    5.408  87.478  44.986  1.00  20.18    A   C
ATOM  17205  CE2  PHE F 368    4.208  87.043  45.307  1.00  17.34    A   C
ATOM  17206  CD2  PHE F 368    3.999  86.480  46.448  1.00  15.96    A   C
ATOM  17207  C    PHE F 368    3.193  87.613  49.286  1.00  26.56    A   C
ATOM  17208  O    PHE F 368    3.358  88.749  49.016  1.00  27.37    A   O
ATOM  17209  N    ASP F 369    2.005  87.070  49.223  1.00  25.86    A   N
ATOM  17210  CA   ASP F 369    0.868  87.899  48.980  1.00  26.60    A   C
ATOM  17211  CB   ASP F 369   -0.365  87.093  48.554  1.00  26.87    A   C
ATOM  17212  CG   ASP F 369   -1.108  86.478  49.687  1.00  28.87    A   C
ATOM  17213  OD1  ASP F 369   -2.030  87.088  50.155  1.00  31.80    A   O
ATOM  17214  OD2  ASP F 369   -0.803  85.356  50.058  1.00  27.26    A   O-1
ATOM  17215  C    ASP F 369    0.605  88.908  50.082  1.00  27.35    A   C
ATOM  17216  O    ASP F 369    0.176  89.987  49.820  1.00  27.44    A   O
ATOM  17217  N    GLU F 370    0.868  88.544  51.313  1.00  26.81    A   N
ATOM  17218  CA   GLU F 370    0.705  89.459  52.394  1.00  27.63    A   C
ATOM  17219  CB   GLU F 370    1.054  88.721  53.676  1.00  26.82    A   C
ATOM  17220  CG   GLU F 370    0.143  87.615  54.063  1.00  28.28    A   C
ATOM  17221  CD   GLU F 370    0.528  86.294  53.539  1.00  29.49    A   C
ATOM  17222  OE1  GLU F 370    1.148  86.232  52.531  1.00  31.98    A   O
ATOM  17223  OE2  GLU F 370    0.164  85.298  54.085  1.00  28.76    A   O-1
ATOM  17224  C    GLU F 370    1.596  90.676  52.319  1.00  26.88    A   C
ATOM  17225  O    GLU F 370    1.152  91.764  52.438  1.00  28.23    A   O
ATOM  17226  N    LEU F 371    2.869  90.484  52.144  1.00  25.53    A   N
ATOM  17227  CA   LEU F 371    3.757  91.602  52.026  1.00  24.77    A   C
ATOM  17228  CB   LEU F 371    5.191  91.189  52.227  1.00  24.45    A   C
ATOM  17229  CG   LEU F 371    5.627  90.978  53.664  1.00  27.02    A   C
ATOM  17230  CD1  LEU F 371    7.055  90.738  53.702  1.00  27.04    A   C
ATOM  17231  CD2  LEU F 371    5.257  92.033  54.602  1.00  20.44    A   C
ATOM  17232  C    LEU F 371    3.584  92.467  50.798  1.00  24.62    A   C
ATOM  17233  O    LEU F 371    3.797  93.632  50.828  1.00  24.76    A   O
ATOM  17234  N    LEU F 372    3.243  91.872  49.695  1.00  23.38    A   N
ATOM  17235  CA   LEU F 372    2.966  92.652  48.536  1.00  24.70    A   C
ATOM  17236  CB   LEU F 372    2.879  91.810  47.287  1.00  23.69    A   C
ATOM  17237  CG   LEU F 372    4.116  91.938  46.425  1.00  22.79    A   C
ATOM  17238  CD1  LEU F 372    5.295  91.684  47.181  1.00  19.08    A   C
ATOM  17239  CD2  LEU F 372    4.101  91.077  45.242  1.00  21.06    A   C
ATOM  17240  C    LEU F 372    1.757  93.498  48.670  1.00  25.48    A   C
ATOM  17241  O    LEU F 372    1.721  94.577  48.201  1.00  29.21    A   O
```

Appendix 1

```
ATOM  17242  N    PHE F 373     0.744   92.984  49.299  1.00  24.22      A  N
ATOM  17243  CA   PHE F 373    -0.421   93.761  49.535  1.00  22.47      A  C
ATOM  17244  CB   PHE F 373    -1.484   92.838  50.113  1.00  21.21      A  C
ATOM  17245  CG   PHE F 373    -2.531   93.497  50.898  1.00  15.73      A  C
ATOM  17246  CD1  PHE F 373    -3.421   94.322  50.328  1.00  17.20      A  C
ATOM  17247  CE1  PHE F 373    -4.373   94.879  51.048  1.00  14.58      A  C
ATOM  17248  CZ   PHE F 373    -4.464   94.624  52.334  1.00  12.23      A  C
ATOM  17249  CE2  PHE F 373    -3.595   93.797  52.917  1.00  11.68      A  C
ATOM  17250  CD2  PHE F 373    -2.652   93.233  52.211  1.00  14.28      A  C
ATOM  17251  C    PHE F 373    -0.084   94.928  50.417  1.00  23.37      A  C
ATOM  17252  O    PHE F 373    -0.441   96.021  50.140  1.00  23.62      A  O
ATOM  17253  N    LEU F 374     0.661   94.694  51.456  1.00  23.36      A  N
ATOM  17254  CA   LEU F 374     0.958   95.752  52.367  1.00  25.18      A  C
ATOM  17255  CB   LEU F 374     1.635   95.190  53.600  1.00  25.61      A  C
ATOM  17256  CG   LEU F 374     2.361   96.074  54.563  1.00  22.11      A  C
ATOM  17257  CD1  LEU F 374     1.488   97.091  55.081  1.00  25.07      A  C
ATOM  17258  CD2  LEU F 374     2.800   95.222  55.612  1.00  19.35      A  C
ATOM  17259  C    LEU F 374     1.745   96.905  51.784  1.00  25.29      A  C
ATOM  17260  O    LEU F 374     1.464   98.031  52.069  1.00  25.17      A  O
ATOM  17261  N    ALA F 375     2.733   96.609  50.980  1.00  25.34      A  N
ATOM  17262  CA   ALA F 375     3.514   97.616  50.310  1.00  26.60      A  C
ATOM  17263  CB   ALA F 375     4.752   97.028  49.784  1.00  27.78      A  C
ATOM  17264  C    ALA F 375     2.816   98.447  49.263  1.00  27.23      A  C
ATOM  17265  O    ALA F 375     3.081   99.598  49.126  1.00  28.09      A  O
ATOM  17266  N    LYS F 376     1.948   97.829  48.506  1.00  26.24      A  N
ATOM  17267  CA   LYS F 376     1.186   98.511  47.512  1.00  26.98      A  C
ATOM  17268  CB   LYS F 376     0.414   97.508  46.691  1.00  27.55      A  C
ATOM  17269  CG   LYS F 376     1.278   96.708  45.840  1.00  28.34      A  C
ATOM  17270  CD   LYS F 376     0.485   95.955  44.884  1.00  27.82      A  C
ATOM  17271  CE   LYS F 376     1.299   94.996  44.130  1.00  24.35      A  C
ATOM  17272  NZ   LYS F 376     0.459   94.148  43.334  1.00  22.89      A  N
ATOM  17273  C    LYS F 376     0.275   99.513  48.141  1.00  26.59      A  C
ATOM  17274  O    LYS F 376    -0.028  100.511  47.586  1.00  26.98      A  O
ATOM  17275  N    VAL F 377    -0.145   99.213  49.331  1.00  25.40      A  N
ATOM  17276  CA   VAL F 377    -1.158   99.942  49.983  1.00  25.62      A  C
ATOM  17277  CB   VAL F 377    -2.138   98.911  50.488  1.00  25.65      A  C
ATOM  17278  CG1  VAL F 377    -2.603   99.172  51.826  1.00  24.15      A  C
ATOM  17279  CG2  VAL F 377    -3.207   98.722  49.540  1.00  24.34      A  C
ATOM  17280  C    VAL F 377    -0.653  100.909  51.069  1.00  26.10      A  C
ATOM  17281  O    VAL F 377    -1.321  101.813  51.458  1.00  25.91      A  O
ATOM  17282  N    HIS F 378     0.564  100.742  51.507  1.00  26.13      A  N
ATOM  17283  CA   HIS F 378     1.019  101.345  52.721  1.00  27.08      A  C
ATOM  17284  CB   HIS F 378     2.359  100.738  53.058  1.00  26.08      A  C
ATOM  17285  CG   HIS F 378     2.910  101.149  54.375  1.00  27.53      A  C
ATOM  17286  ND1  HIS F 378     2.356  100.762  55.560  1.00  29.92      A  N
ATOM  17287  CE1  HIS F 378     3.052  101.254  56.553  1.00  23.49      A  C
ATOM  17288  NE2  HIS F 378     4.059  101.923  56.053  1.00  21.37      A  N
ATOM  17289  CD2  HIS F 378     3.999  101.867  54.694  1.00  28.44      A  C
ATOM  17290  C    HIS F 378     1.154  102.834  52.706  1.00  28.44      A  C
ATOM  17291  O    HIS F 378     1.913  103.396  51.976  1.00  28.32      A  O
ATOM  17292  N    ALA F 379     0.424  103.481  53.585  1.00  28.66      A  N
ATOM  17293  CA   ALA F 379     0.424  104.906  53.676  1.00  29.47      A  C
ATOM  17294  CB   ALA F 379    -0.875  105.361  54.083  1.00  30.35      A  C
ATOM  17295  C    ALA F 379     1.448  105.411  54.631  1.00  29.87      A  C
```

Appendix 1

```
ATOM  17296  O    ALA F 379    1.606 106.559 54.772 1.00 30.75    A  O
ATOM  17297  N    GLY F 380    2.128 104.527 55.301 1.00 28.80    A  N
ATOM  17298  CA   GLY F 380    3.140 104.910 56.221 1.00 28.69    A  C
ATOM  17299  C    GLY F 380    2.640 104.907 57.613 1.00 29.15    A  C
ATOM  17300  O    GLY F 380    1.539 105.219 57.884 1.00 30.06    A  O
ATOM  17301  N    PHE F 381    3.513 104.529 58.496 1.00 29.60    A  N
ATOM  17302  CA   PHE F 381    3.207 104.325 59.866 1.00 30.11    A  C
ATOM  17303  CB   PHE F 381    4.333 103.561 60.513 1.00 29.37    A  C
ATOM  17304  CG   PHE F 381    4.309 102.139 60.175 1.00 30.51    A  C
ATOM  17305  CD1  PHE F 381    3.233 101.375 60.483 1.00 28.68    A  C
ATOM  17306  CE1  PHE F 381    3.184 100.094 60.158 1.00 24.21    A  C
ATOM  17307  CZ   PHE F 381    4.144  99.554 59.495 1.00 27.66    A  C
ATOM  17308  CE2  PHE F 381    5.214 100.272 59.155 1.00 33.47    A  C
ATOM  17309  CD2  PHE F 381    5.301 101.568 59.476 1.00 31.91    A  C
ATOM  17310  C    PHE F 381    2.811 105.553 60.614 1.00 30.89    A  C
ATOM  17311  O    PHE F 381    1.952 105.510 61.428 1.00 32.10    A  O
ATOM  17312  N    GLY F 382    3.467 106.648 60.315 1.00 30.25    A  N
ATOM  17313  CA   GLY F 382    3.137 107.912 60.887 1.00 29.72    A  C
ATOM  17314  C    GLY F 382    1.772 108.299 60.461 1.00 30.34    A  C
ATOM  17315  O    GLY F 382    1.039 108.862 61.205 1.00 31.46    A  O
ATOM  17316  N    ALA F 383    1.433 107.979 59.238 1.00 29.54    A  N
ATOM  17317  CA   ALA F 383    0.117 109.245 58.712 1.00 28.94    A  C
ATOM  17318  CB   ALA F 383    0.101 107.966 57.288 1.00 26.49    A  C
ATOM  17319  C    ALA F 383   -1.007 107.504 59.406 1.00 28.70    A  C
ATOM  17320  O    ALA F 383   -2.047 108.035 59.583 1.00 29.79    A  O
ATOM  17321  N    LEU F 384   -0.792 106.257 59.752 1.00 28.37    A  N
ATOM  17322  CA   LEU F 384   -1.769 105.480 60.464 1.00 28.43    A  C
ATOM  17323  CB   LEU F 384   -1.341 104.034 60.570 1.00 26.26    A  C
ATOM  17324  CG   LEU F 384   -0.974 103.329 59.296 1.00 23.90    A  C
ATOM  17325  CD1  LEU F 384   -0.467 101.973 59.514 1.00 17.28    A  C
ATOM  17326  CD2  LEU F 384   -2.115 103.312 58.442 1.00 22.46    A  C
ATOM  17327  C    LEU F 384   -2.029 106.060 61.821 1.00 29.60    A  C
ATOM  17328  O    LEU F 384   -3.128 106.128 62.274 1.00 27.14    A  O
ATOM  17329  N    LEU F 385   -0.970 106.514 62.439 1.00 31.41    A  N
ATOM  17330  CA   LEU F 385   -0.979 107.056 63.754 1.00 33.23    A  C
ATOM  17331  CB   LEU F 385    0.430 107.404 64.116 1.00 34.21    A  C
ATOM  17332  CG   LEU F 385    1.128 106.731 65.250 1.00 35.74    A  C
ATOM  17333  CD1  LEU F 385    0.407 105.549 65.613 1.00 36.74    A  C
ATOM  17334  CD2  LEU F 385    2.478 106.393 64.814 1.00 38.15    A  C
ATOM  17335  C    LEU F 385   -1.830 108.291 63.816 1.00 34.32    A  C
ATOM  17336  O    LEU F 385   -2.288 108.691 64.840 1.00 34.61    A  O
ATOM  17337  N    ARG F 386   -2.009 108.910 62.684 1.00 35.70    A  N
ATOM  17338  CA   ARG F 386   -2.729 110.129 62.600 1.00 36.65    A  C
ATOM  17339  CB   ARG F 386   -1.952 111.117 61.781 1.00 35.68    A  C
ATOM  17340  CG   ARG F 386   -0.838 111.724 62.516 1.00 41.29    A  C
ATOM  17341  CD   ARG F 386   -0.348 112.954 61.873 1.00 46.27    A  C
ATOM  17342  NE   ARG F 386    0.534 112.630 60.778 1.00 54.24    A  N
ATOM  17343  CZ   ARG F 386    1.729 112.085 60.916 1.00 58.84    A  C
ATOM  17344  NH1  ARG F 386    2.183 111.797 62.116 1.00 60.30    A  N
ATOM  17345  NH2  ARG F 386    2.473 111.837 59.855 1.00 56.77    A  N
ATOM  17346  C    ARG F 386   -4.054 109.919 61.964 1.00 36.58    A  C
ATOM  17347  O    ARG F 386   -4.668 110.842 61.568 1.00 38.32    A  O
ATOM  17348  N    MET F 387   -4.499 108.700 61.855 1.00 35.94    A  N
ATOM  17349  CA   MET F 387   -5.680 109.444 61.091 1.00 36.62    A  C
```

Appendix 1

```
ATOM  17350  CB   MET F 387      -5.856 106.951  61.001  1.00 36.57      F  C
ATOM  17351  CG   MET F 387      -7.161 106.479  60.539  1.00 38.82      F  C
ATOM  17352  SD   MET F 387      -7.219 104.728  60.521  1.00 40.39      F  S
ATOM  17353  CE   MET F 387      -8.708 104.520  59.684  1.00 42.90      F  C
ATOM  17354  C    MET F 387      -6.913 109.117  61.668  1.00 36.83      A  C
ATOM  17355  O    MET F 387      -7.154 109.071  62.843  1.00 35.63      A  O
ATOM  17356  N    PRO F 388      -7.714 109.726  60.815  1.00 37.68      A  N
ATOM  17357  CA   PRO F 388      -8.869 110.461  61.267  1.00 39.26      A  C
ATOM  17358  CB   PRO F 388      -9.257 111.232  60.034  1.00 38.89      A  C
ATOM  17359  CG   PRO F 388      -8.112 111.313  59.294  1.00 37.97      A  C
ATOM  17360  CD   PRO F 388      -7.449 110.067  59.422  1.00 38.09      A  C
ATOM  17361  C    PRO F 388      -9.983 109.561  61.684  1.00 40.93      A  C
ATOM  17362  O    PRO F 388     -10.158 108.497  61.176  1.00 42.27      A  O
ATOM  17363  N    PRO F 389     -10.744 110.042  62.624  1.00 41.88      A  N
ATOM  17364  CA   PRO F 389     -11.613 109.270  63.474  1.00 43.85      A  C
ATOM  17365  CB   PRO F 389     -12.153 110.342  64.419  1.00 43.24      A  C
ATOM  17366  CG   PRO F 389     -11.671 111.579  63.907  1.00 42.94      A  C
ATOM  17367  CD   PRO F 389     -10.429 111.298  63.270  1.00 42.19      A  C
ATOM  17368  C    PRO F 389     -12.766 108.427  62.944  1.00 45.84      A  C
ATOM  17369  O    PRO F 389     -12.816 107.272  63.269  1.00 45.82      A  O
ATOM  17370  N    PRO F 390     -13.730 108.987  62.262  1.00 47.16      A  N
ATOM  17371  CA   PRO F 390     -14.983 108.257  62.097  1.00 48.10      A  C
ATOM  17372  CB   PRO F 390     -15.507 108.744  60.773  1.00 47.35      A  C
ATOM  17373  CG   PRO F 390     -14.327 109.168  60.064  1.00 49.16      A  C
ATOM  17374  CD   PRO F 390     -13.310 109.639  61.028  1.00 47.66      A  C
ATOM  17375  C    PRO F 390     -14.709 106.778  62.064  1.00 48.73      A  C
ATOM  17376  O    PRO F 390     -14.807 106.161  63.106  1.00 48.96      A  O
ATOM  17377  N    LEU G  29     -76.496  70.867  47.424  1.00 46.38      A  N
ATOM  17378  CA   LEU G  29     -76.943  72.009  48.211  1.00 47.82      A  C
ATOM  17379  CB   LEU G  29     -76.085  72.068  49.473  1.00 47.85      A  C
ATOM  17380  CG   LEU G  29     -76.485  72.743  50.784  1.00 49.24      A  C
ATOM  17381  CD1  LEU G  29     -77.333  73.937  50.664  1.00 47.22      A  C
ATOM  17382  CD2  LEU G  29     -77.048  71.807  51.773  1.00 51.07      A  C
ATOM  17383  C    LEU G  29     -76.866  73.347  47.454  1.00 47.51      A  C
ATOM  17384  O    LEU G  29     -75.798  73.740  47.089  1.00 47.66      A  O
ATOM  17385  N    PRO G  30     -77.988  74.037  47.266  1.00 47.29      A  N
ATOM  17386  CA   PRO G  30     -78.041  75.332  46.598  1.00 47.16      A  C
ATOM  17387  CB   PRO G  30     -78.819  75.015  45.337  1.00 48.41      A  C
ATOM  17388  CG   PRO G  30     -79.647  74.007  45.711  1.00 47.62      A  C
ATOM  17389  CD   PRO G  30     -78.797  73.090  46.526  1.00 48.86      A  C
ATOM  17390  C    PRO G  30     -78.811  76.367  47.377  1.00 46.79      A  C
ATOM  17391  O    PRO G  30     -79.680  76.024  48.154  1.00 45.71      A  O
ATOM  17392  N    PRO G  31     -78.534  77.631  47.089  1.00 45.56      A  N
ATOM  17393  CA   PRO G  31     -78.879  78.747  47.965  1.00 44.79      A  C
ATOM  17394  CB   PRO G  31     -77.522  79.333  48.290  1.00 45.46      A  C
ATOM  17395  CG   PRO G  31     -76.594  78.743  47.327  1.00 44.41      A  C
ATOM  17396  CD   PRO G  31     -77.093  77.475  46.911  1.00 44.24      A  C
ATOM  17397  C    PRO G  31     -79.851  79.883  47.592  1.00 44.64      A  C
ATOM  17398  O    PRO G  31     -80.031  80.670  48.489  1.00 44.94      A  O
ATOM  17399  N    GLY G  32     -80.425  79.924  46.394  1.00 43.50      A  N
ATOM  17400  CA   GLY G  32     -81.056  81.063  45.720  1.00 40.27      A  C
ATOM  17401  C    GLY G  32     -80.801  80.975  44.201  1.00 40.01      A  C
ATOM  17402  O    GLY G  32     -81.371  81.651  43.394  1.00 37.72      A  O
ATOM  17403  N    ARG G  33     -79.921  80.058  43.860  1.00 38.67      A  N
```

Appendix 1

```
ATOM  17404  CA   ARG G  33     -79.542  79.668  42.547  1.00 37.52        A    C
ATOM  17405  CB   ARG G  33     -78.165  79.115  42.672  1.00 36.95        A    C
ATOM  17406  CG   ARG G  33     -77.329  79.973  43.493  1.00 35.19        A    C
ATOM  17407  CD   ARG G  33     -76.183  80.445  42.703  1.00 34.31        A    C
ATOM  17408  NE   ARG G  33     -75.622  79.335  42.005  1.00 33.27        A    N
ATOM  17409  CZ   ARG G  33     -74.571  78.678  42.413  1.00 30.03        A    C
ATOM  17410  NH1  ARG G  33     -73.951  79.054  43.482  1.00 33.12        A    N
ATOM  17411  NH2  ARG G  33     -74.137  77.678  41.726  1.00 24.26        A    N
ATOM  17412  C    ARG G  33     -80.406  78.668  41.813  1.00 38.10        A    C
ATOM  17413  O    ARG G  33     -81.201  77.989  42.372  1.00 38.30        A    O
ATOM  17414  N    LEU G  34     -80.269  78.652  40.513  1.00 37.70        A    N
ATOM  17415  CA   LEU G  34     -80.834  77.647  39.638  1.00 38.11        A    C
ATOM  17416  CB   LEU G  34     -80.845  78.161  38.220  1.00 37.25        A    C
ATOM  17417  CG   LEU G  34     -82.037  79.018  37.888  1.00 35.16        A    C
ATOM  17418  CD1  LEU G  34     -82.501  79.555  39.121  1.00 34.92        A    C
ATOM  17419  CD2  LEU G  34     -81.621  80.102  37.032  1.00 34.65        A    C
ATOM  17420  C    LEU G  34     -80.233  76.254  39.702  1.00 38.29        A    C
ATOM  17421  O    LEU G  34     -80.915  75.283  39.566  1.00 39.22        A    O
ATOM  17422  N    ALA G  35     -78.934  76.173  39.856  1.00 37.51        A    N
ATOM  17423  CA   ALA G  35     -78.251  74.905  39.895  1.00 37.22        A    C
ATOM  17424  CB   ALA G  35     -77.935  74.426  38.538  1.00 35.80        A    C
ATOM  17425  C    ALA G  35     -77.013  75.009  40.732  1.00 37.15        A    C
ATOM  17426  O    ALA G  35     -76.632  76.057  41.104  1.00 37.96        A    O
ATOM  17427  N    THR G  36     -76.414  73.891  41.050  1.00 37.11        A    N
ATOM  17428  CA   THR G  36     -75.244  73.882  41.880  1.00 36.77        A    C
ATOM  17429  CB   THR G  36     -75.106  72.595  42.672  1.00 37.31        A    C
ATOM  17430  OG1  THR G  36     -75.197  71.487  41.800  1.00 39.74        A    O
ATOM  17431  CG2  THR G  36     -76.164  72.487  43.673  1.00 35.37        A    C
ATOM  17432  C    THR G  36     -73.999  74.090  41.109  1.00 35.89        A    C
ATOM  17433  O    THR G  36     -73.900  73.764  39.978  1.00 36.26        A    O
ATOM  17434  N    THR G  37     -73.012  74.598  41.781  1.00 36.06        A    N
ATOM  17435  CA   THR G  37     -71.727  74.795  41.192  1.00 36.86        A    C
ATOM  17436  CB   THR G  37     -70.792  75.455  42.163  1.00 36.55        A    C
ATOM  17437  OG1  THR G  37     -71.253  76.768  42.427  1.00 37.47        A    O
ATOM  17438  CG2  THR G  37     -69.438  75.527  41.619  1.00 31.72        A    C
ATOM  17439  C    THR G  37     -71.201  73.455  40.811  1.00 38.91        A    C
ATOM  17440  O    THR G  37     -70.483  73.329  39.866  1.00 39.20        A    O
ATOM  17441  N    GLU G  38     -71.559  72.450  41.589  1.00 40.35        G    N
ATOM  17442  CA   GLU G  38     -71.158  71.101  41.314  1.00 41.08        G    C
ATOM  17443  CB   GLU G  38     -71.546  70.187  42.456  1.00 42.48        G    C
ATOM  17444  CG   GLU G  38     -70.836  68.876  42.412  1.00 49.11        G    C
ATOM  17445  CD   GLU G  38     -71.020  68.039  43.638  1.00 57.05        G    C
ATOM  17446  OE1  GLU G  38     -70.093  67.981  44.457  1.00 58.02        G    O
ATOM  17447  OE2  GLU G  38     -72.076  67.410  43.775  1.00 59.41        G    O
ATOM  17448  C    GLU G  38     -71.718  70.594  40.012  1.00 39.57        G    C
ATOM  17449  O    GLU G  38     -71.022  70.018  39.242  1.00 38.79        G    O
ATOM  17450  N    ASP G  39     -72.971  70.850  39.745  1.00 37.77        G    N
ATOM  17451  CA   ASP G  39     -73.522  70.474  38.465  1.00 37.20        G    C
ATOM  17452  CB   ASP G  39     -75.039  70.598  38.487  1.00 37.14        G    C
ATOM  17453  CG   ASP G  39     -75.680  69.679  39.488  1.00 39.58        G    C
ATOM  17454  OD1  ASP G  39     -75.177  68.591  39.699  1.00 37.98        G    O
ATOM  17455  OD2  ASP G  39     -76.690  70.037  40.073  1.00 44.89        G    O
ATOM  17456  C    ASP G  39     -72.903  71.187  37.265  1.00 35.02        G    C
ATOM  17457  O    ASP G  39     -72.610  70.583  36.289  1.00 34.38        G    O
```

Appendix 1

```
ATOM  17458  N    TYR  G  40   -72.659  72.471  37.347  1.00  32.74  A  N
ATOM  17459  CA   TYR  G  40   -72.085  73.160  36.219  1.00  30.50  A  C
ATOM  17460  CB   TYR  G  40   -72.003  74.653  36.497  1.00  29.83  A  C
ATOM  17461  CG   TYR  G  40   -73.322  75.357  36.652  1.00  28.17  A  C
ATOM  17462  CD1  TYR  G  40   -74.308  75.238  35.715  1.00  25.78  A  C
ATOM  17463  CE1  TYR  G  40   -75.465  75.871  35.853  1.00  19.88  A  C
ATOM  17464  CZ   TYR  G  40   -75.679  76.627  36.914  1.00  22.70  A  C
ATOM  17465  OH   TYR  G  40   -76.867  77.238  37.015  1.00  21.68  A  O
ATOM  17466  CE2  TYR  G  40   -74.737  76.776  37.851  1.00  19.58  A  C
ATOM  17467  CD2  TYR  G  40   -73.576  76.152  37.727  1.00  22.05  A  C
ATOM  17468  C    TYR  G  40   -70.723  72.608  35.860  1.00  29.68  A  C
ATOM  17469  O    TYR  G  40   -70.414  72.414  34.739  1.00  29.03  A  O
ATOM  17470  N    PHE  G  41   -69.904  72.340  36.842  1.00  30.27  A  N
ATOM  17471  CA   PHE  G  41   -68.614  71.772  36.608  1.00  29.97  A  C
ATOM  17472  CB   PHE  G  41   -67.726  71.944  37.808  1.00  30.40  A  C
ATOM  17473  CG   PHE  G  41   -67.113  73.305  37.916  1.00  29.85  A  C
ATOM  17474  CD1  PHE  G  41   -65.840  73.529  37.537  1.00  23.05  A  C
ATOM  17475  CE1  PHE  G  41   -65.307  74.725  37.651  1.00  27.51  A  C
ATOM  17476  CZ   PHE  G  41   -66.010  75.711  38.142  1.00  25.02  A  C
ATOM  17477  CE2  PHE  G  41   -67.263  75.510  38.537  1.00  25.06  A  C
ATOM  17478  CD2  PHE  G  41   -67.805  74.337  38.436  1.00  25.42  A  C
ATOM  17479  C    PHE  G  41   -68.662  70.363  36.076  1.00  31.72  A  C
ATOM  17480  O    PHE  G  41   -67.779  69.938  35.384  1.00  33.75  A  O
ATOM  17481  N    ALA  G  42   -69.753  69.672  36.335  1.00  33.00  A  N
ATOM  17482  CA   ALA  G  42   -69.980  68.286  35.919  1.00  33.85  A  C
ATOM  17483  CB   ALA  G  42   -70.769  67.612  36.938  1.00  32.44  A  C
ATOM  17484  C    ALA  G  42   -70.644  68.027  34.578  1.00  34.80  A  C
ATOM  17485  O    ALA  G  42   -70.875  66.905  34.243  1.00  35.96  A  O
ATOM  17486  N    GLN  G  43   -70.993  69.058  33.832  1.00  35.25  A  N
ATOM  17487  CA   GLN  G  43   -71.709  68.911  32.580  1.00  34.41  A  C
ATOM  17488  CB   GLN  G  43   -72.073  70.285  32.047  1.00  33.40  A  C
ATOM  17489  CG   GLN  G  43   -73.236  70.928  32.703  1.00  31.29  A  C
ATOM  17490  CD   GLN  G  43   -73.406  72.371  32.336  1.00  32.91  A  C
ATOM  17491  OE1  GLN  G  43   -72.686  73.190  32.802  1.00  30.76  A  O
ATOM  17492  NE2  GLN  G  43   -74.386  72.676  31.529  1.00  25.67  A  N
ATOM  17493  C    GLN  G  43   -70.936  68.163  31.528  1.00  34.34  A  C
ATOM  17494  O    GLN  G  43   -71.436  67.337  30.850  1.00  36.01  A  O
ATOM  17495  N    GLN  G  44   -69.682  68.470  31.408  1.00  35.00  A  N
ATOM  17496  CA   GLN  G  44   -68.858  67.851  30.436  1.00  36.67  A  C
ATOM  17497  CB   GLN  G  44   -67.477  68.439  30.587  1.00  36.76  A  C
ATOM  17498  CG   GLN  G  44   -66.595  68.349  29.416  1.00  39.16  A  C
ATOM  17499  CD   GLN  G  44   -65.628  69.465  29.362  1.00  42.36  A  C
ATOM  17500  OE1  GLN  G  44   -65.742  70.429  30.084  1.00  43.48  A  O
ATOM  17501  NE2  GLN  G  44   -64.668  69.350  28.502  1.00  44.29  A  N
ATOM  17502  C    GLN  G  44   -68.787  66.376  30.677  1.00  37.81  A  C
ATOM  17503  O    GLN  G  44   -68.852  65.616  29.762  1.00  38.50  A  O
ATOM  17504  N    ALA  G  45   -68.631  65.961  31.916  1.00  38.66  A  N
ATOM  17505  CA   ALA  G  45   -68.551  64.540  32.249  1.00  40.12  A  C
ATOM  17506  CB   ALA  G  45   -68.092  64.358  33.645  1.00  37.67  A  C
ATOM  17507  C    ALA  G  45   -69.822  63.756  32.007  1.00  41.25  A  C
ATOM  17508  O    ALA  G  45   -69.795  62.635  31.562  1.00  42.38  A  O
ATOM  17509  N    LYS  G  46   -70.939  64.388  32.274  1.00  40.93  A  N
ATOM  17510  CA   LYS  G  46   -72.210  63.789  32.042  1.00  42.09  A  C
ATOM  17511  CB   LYS  G  46   -73.224  64.420  32.957  1.00  41.34  A  C
```

Appendix 1

```
ATOM  17512  CG   LYS G  46     -73.239  63.795  34.280  1.00 45.07      A    C
ATOM  17513  CD   LYS G  46     -74.154  64.486  35.204  1.00 47.16      A    C
ATOM  17514  CE   LYS G  46     -73.587  64.498  36.568  1.00 50.55      A    C
ATOM  17515  NZ   LYS G  46     -73.893  65.755  37.273  1.00 51.70      A    N
ATOM  17516  C    LYS G  46     -72.660  63.932  30.615  1.00 42.12      A    C
ATOM  17517  O    LYS G  46     -73.659  63.410  30.244  1.00 42.08      A    O
ATOM  17518  N    GLN G  47     -71.932  64.699  29.844  1.00 42.05      A    N
ATOM  17519  CA   GLN G  47     -72.239  64.942  28.469  1.00 42.27      A    C
ATOM  17520  CB   GLN G  47     -72.057  63.683  27.654  1.00 42.26      A    C
ATOM  17521  CG   GLN G  47     -70.658  63.412  27.188  1.00 44.47      A    C
ATOM  17522  CD   GLN G  47     -70.543  62.130  26.366  1.00 49.55      A    C
ATOM  17523  OE1  GLN G  47     -71.241  61.162  26.599  1.00 49.48      A    O
ATOM  17524  NE2  GLN G  47     -69.658  62.131  25.409  1.00 50.56      A    N
ATOM  17525  C    GLN G  47     -73.635  65.499  28.309  1.00 42.32      A    C
ATOM  17526  O    GLN G  47     -74.293  65.208  27.356  1.00 42.94      A    O
ATOM  17527  N    ALA G  48     -74.086  66.297  29.254  1.00 40.90      A    N
ATOM  17528  CA   ALA G  48     -75.347  66.973  29.129  1.00 40.46      A    C
ATOM  17529  CB   ALA G  48     -76.392  66.139  29.705  1.00 40.09      A    C
ATOM  17530  C    ALA G  48     -75.369  68.323  29.803  1.00 40.89      A    C
ATOM  17531  O    ALA G  48     -74.804  68.478  30.839  1.00 42.24      A    O
ATOM  17532  N    VAL G  49     -76.061  69.291  29.237  1.00 39.07      A    N
ATOM  17533  CA   VAL G  49     -76.196  70.548  29.912  1.00 38.22      A    C
ATOM  17534  CB   VAL G  49     -76.425  71.738  28.962  1.00 38.13      A    C
ATOM  17535  CG1  VAL G  49     -75.366  71.834  27.976  1.00 36.86      A    C
ATOM  17536  CG2  VAL G  49     -77.729  71.702  28.316  1.00 38.43      A    C
ATOM  17537  C    VAL G  49     -77.251  70.487  30.955  1.00 37.43      A    C
ATOM  17538  O    VAL G  49     -78.181  69.747  30.828  1.00 37.98      A    O
ATOM  17539  N    THR G  50     -77.111  71.313  31.973  1.00 35.99      A    N
ATOM  17540  CA   THR G  50     -78.122  71.475  32.993  1.00 35.21      A    C
ATOM  17541  CB   THR G  50     -77.622  72.284  34.154  1.00 34.47      A    C
ATOM  17542  OG1  THR G  50     -77.661  73.654  33.829  1.00 34.78      A    O
ATOM  17543  CG2  THR G  50     -76.249  71.940  34.457  1.00 33.07      A    C
ATOM  17544  C    THR G  50     -79.344  72.161  32.462  1.00 35.87      A    C
ATOM  17545  O    THR G  50     -79.292  72.859  31.523  1.00 35.83      A    O
ATOM  17546  N    PRO G  51     -80.452  71.973  33.113  1.00 36.62      A    N
ATOM  17547  CA   PRO G  51     -81.733  72.401  32.611  1.00 36.84      A    C
ATOM  17548  CB   PRO G  51     -82.655  71.944  33.712  1.00 37.03      A    C
ATOM  17549  CG   PRO G  51     -82.031  70.754  34.187  1.00 37.21      A    C
ATOM  17550  CD   PRO G  51     -80.601  70.817  33.978  1.00 36.32      A    C
ATOM  17551  C    PRO G  51     -81.849  73.880  32.410  1.00 36.38      A    C
ATOM  17552  O    PRO G  51     -82.490  74.316  31.498  1.00 38.13      A    O
ATOM  17553  N    ASP G  52     -81.249  74.631  33.294  1.00 35.12      A    N
ATOM  17554  CA   ASP G  52     -81.171  76.057  33.191  1.00 33.31      A    C
ATOM  17555  CB   ASP G  52     -80.799  76.705  34.527  1.00 33.03      A    C
ATOM  17556  CG   ASP G  52     -79.511  76.242  35.070  1.00 36.40      A    C
ATOM  17557  OD1  ASP G  52     -79.147  75.099  34.897  1.00 41.05      A    O
ATOM  17558  OD2  ASP G  52     -78.834  77.036  35.679  1.00 40.33      A    O-1
ATOM  17559  C    ASP G  52     -80.359  76.574  32.014  1.00 32.17      A    C
ATOM  17560  O    ASP G  52     -80.697  77.557  31.432  1.00 31.76      A    O
ATOM  17561  N    VAL G  53     -79.292  75.896  31.668  1.00 30.95      A    N
ATOM  17562  CA   VAL G  53     -78.543  76.178  30.470  1.00 29.83      A    C
ATOM  17563  CB   VAL G  53     -77.259  75.361  30.452  1.00 30.01      A    C
ATOM  17564  CG1  VAL G  53     -76.679  75.277  29.118  1.00 28.35      A    C
ATOM  17565  CG2  VAL G  53     -76.297  75.951  31.358  1.00 28.60      A    C
```

Appendix 1

```
ATOM  17566  C    VAL G  53     -79.354  75.934  29.219  1.00  29.28      A  C
ATOM  17567  O    VAL G  53     -79.318  76.690  28.311  1.00  30.21      A  O
ATOM  17568  N    MET G  54     -80.079  74.851  29.203  1.00  28.89      A  N
ATOM  17569  CA   MET G  54     -80.966  74.538  28.152  1.00  29.55      A  C
ATOM  17570  CB   MET G  54     -81.466  73.122  28.326  1.00  30.61      G  C
ATOM  17571  CG   MET G  54     -82.319  72.671  27.237  1.00  33.43      G  C
ATOM  17572  SD   MET G  54     -81.482  72.095  25.824  1.00  42.89      G  S
ATOM  17573  CE   MET G  54     -82.853  71.553  24.921  1.00  47.66      G  C
ATOM  17574  C    MET G  54     -82.088  75.551  28.059  1.00  29.26      A  C
ATOM  17575  O    MET G  54     -82.483  75.918  27.005  1.00  29.28      A  O
ATOM  17576  N    ALA G  55     -82.579  76.015  29.181  1.00  28.41      A  N
ATOM  17577  CA   ALA G  55     -83.547  77.077  29.205  1.00  27.91      A  C
ATOM  17578  CB   ALA G  55     -84.098  77.254  30.557  1.00  27.34      A  C
ATOM  17579  C    ALA G  55     -82.988  78.368  28.659  1.00  27.51      A  C
ATOM  17580  O    ALA G  55     -83.672  79.116  28.067  1.00  27.63      A  O
ATOM  17581  N    GLN G  56     -81.732  78.630  28.911  1.00  27.63      A  N
ATOM  17582  CA   GLN G  56     -81.048  79.727  28.292  1.00  27.25      A  C
ATOM  17583  CB   GLN G  56     -79.710  79.990  28.992  1.00  26.83      A  C
ATOM  17584  CG   GLN G  56     -78.737  80.839  28.260  1.00  26.93      A  C
ATOM  17585  CD   GLN G  56     -79.060  82.259  28.291  1.00  26.22      A  C
ATOM  17586  OE1  GLN G  56     -79.589  82.730  29.224  1.00  33.04      A  O
ATOM  17587  NE2  GLN G  56     -78.728  82.952  27.275  1.00  26.83      A  N
ATOM  17588  C    GLN G  56     -80.898  79.527  26.801  1.00  27.19      A  C
ATOM  17589  O    GLN G  56     -81.032  80.415  26.068  1.00  26.40      A  O
ATOM  17590  N    LEU G  57     -80.602  78.323  26.392  1.00  26.71      A  N
ATOM  17591  CA   LEU G  57     -80.445  77.981  25.008  1.00  27.52      A  C
ATOM  17592  CB   LEU G  57     -80.017  76.545  24.888  1.00  27.96      A  C
ATOM  17593  CG   LEU G  57     -78.701  76.158  24.259  1.00  29.62      A  C
ATOM  17594  CD1  LEU G  57     -77.765  77.267  24.169  1.00  27.93      A  C
ATOM  17595  CD2  LEU G  57     -78.101  75.065  25.008  1.00  26.23      A  C
ATOM  17596  C    LEU G  57     -81.739  78.210  24.304  1.00  27.57      A  C
ATOM  17597  O    LEU G  57     -81.764  78.594  23.200  1.00  29.27      A  O
ATOM  17598  N    ALA G  58     -82.816  77.949  24.988  1.00  27.64      A  N
ATOM  17599  CA   ALA G  58     -84.144  78.263  24.548  1.00  28.46      A  C
ATOM  17600  CB   ALA G  58     -85.099  77.669  25.460  1.00  28.30      A  C
ATOM  17601  C    ALA G  58     -84.437  79.743  24.400  1.00  28.88      A  C
ATOM  17602  O    ALA G  58     -85.125  80.131  23.512  1.00  30.04      A  O
ATOM  17603  N    TYR G  59     -83.936  80.563  25.292  1.00  28.02      A  N
ATOM  17604  CA   TYR G  59     -84.227  81.960  25.224  1.00  28.94      A  C
ATOM  17605  CB   TYR G  59     -83.572  82.723  26.380  1.00  28.03      A  C
ATOM  17606  CG   TYR G  59     -83.307  84.145  26.010  1.00  25.47      A  C
ATOM  17607  CD1  TYR G  59     -84.333  84.985  25.768  1.00  26.97      A  C
ATOM  17608  CE1  TYR G  59     -84.132  86.228  25.414  1.00  24.14      A  C
ATOM  17609  CZ   TYR G  59     -82.906  86.688  25.274  1.00  21.07      A  C
ATOM  17610  OH   TYR G  59     -82.793  87.959  24.906  1.00  24.81      A  O
ATOM  17611  CE2  TYR G  59     -81.848  85.901  25.510  1.00  18.78      A  C
ATOM  17612  CD2  TYR G  59     -82.046  84.627  25.860  1.00  22.44      A  C
ATOM  17613  C    TYR G  59     -83.654  82.416  23.922  1.00  29.16      A  C
ATOM  17614  O    TYR G  59     -84.227  83.181  23.211  1.00  29.29      A  O
ATOM  17615  N    MET G  60     -82.480  81.904  23.655  1.00  28.15      A  N
ATOM  17616  CA   MET G  60     -81.694  82.214  22.525  1.00  27.69      A  C
ATOM  17617  CB   MET G  60     -80.341  81.531  22.703  1.00  27.60      G  C
ATOM  17618  CG   MET G  60     -79.385  82.163  23.721  1.00  23.08      G  C
ATOM  17619  SD   MET G  60     -77.984  81.194  24.254  1.00  29.28      G  S
```

Appendix 1

```
ATOM  17620  CE   MET G  60     -76.906  81.284  22.916  1.00  16.62     G  C
ATOM  17621  C    MET G  60     -82.324  81.800  21.230  1.00  28.21     A  C
ATOM  17622  O    MET G  60     -82.236  82.478  20.265  1.00  29.09     A  O
ATOM  17623  N    ASN G  61     -82.922  80.633  21.212  1.00  27.86     A  N
ATOM  17624  CA   ASN G  61     -83.327  80.016  19.979  1.00  26.79     A  C
ATOM  17625  CB   ASN G  61     -82.683  78.640  19.907  1.00  26.62     A  C
ATOM  17626  CG   ASN G  61     -81.289  78.662  19.404  1.00  28.37     A  C
ATOM  17627  OD1  ASN G  61     -81.049  78.740  18.245  1.00  23.66     A  O
ATOM  17628  ND2  ASN G  61     -80.364  78.531  20.283  1.00  27.27     A  N
ATOM  17629  C    ASN G  61     -84.806  79.860  19.695  1.00  25.94     A  C
ATOM  17630  O    ASN G  61     -85.169  79.685  18.602  1.00  24.22     A  O
ATOM  17631  N    TYR G  62     -85.633  79.819  20.708  1.00  25.20     A  N
ATOM  17632  CA   TYR G  62     -87.033  79.486  20.545  1.00  25.37     A  C
ATOM  17633  CB   TYR G  62     -87.589  79.047  21.892  1.00  24.74     A  C
ATOM  17634  CG   TYR G  62     -88.790  78.182  21.824  1.00  23.64     A  C
ATOM  17635  CD1  TYR G  62     -88.701  76.831  21.997  1.00  24.05     A  C
ATOM  17636  CE1  TYR G  62     -89.786  76.055  21.943  1.00  21.52     A  C
ATOM  17637  CZ   TYR G  62     -90.968  76.615  21.718  1.00  25.65     A  C
ATOM  17638  OH   TYR G  62     -92.085  75.883  21.662  1.00  27.53     A  O
ATOM  17639  CE2  TYR G  62     -91.071  77.943  21.554  1.00  23.84     A  C
ATOM  17640  CD2  TYR G  62     -90.011  78.706  21.617  1.00  23.16     A  C
ATOM  17641  C    TYR G  62     -88.048  80.402  19.930  1.00  25.96     A  C
ATOM  17642  O    TYR G  62     -88.741  79.991  19.069  1.00  27.44     A  O
ATOM  17643  N    ILE G  63     -88.230  81.609  20.408  1.00  27.26     A  N
ATOM  17644  CA   ILE G  63     -89.297  82.408  19.853  1.00  27.57     A  C
ATOM  17645  CB   ILE G  63     -89.844  83.448  20.789  1.00  27.35     A  C
ATOM  17646  CG1  ILE G  63     -90.243  82.792  22.081  1.00  28.21     A  C
ATOM  17647  CD1  ILE G  63     -90.631  83.716  23.124  1.00  20.27     A  C
ATOM  17648  CG2  ILE G  63     -91.055  84.040  20.205  1.00  24.96     A  C
ATOM  17649  C    ILE G  63     -89.006  82.994  18.521  1.00  29.06     A  C
ATOM  17650  O    ILE G  63     -87.929  83.303  18.228  1.00  29.08     A  O
ATOM  17651  N    ASP G  64     -90.028  83.142  17.717  1.00  32.37     A  N
ATOM  17652  CA   ASP G  64     -89.890  83.388  16.303  1.00  34.32     A  C
ATOM  17653  CB   ASP G  64     -91.221  83.217  15.632  1.00  35.26     A  C
ATOM  17654  CG   ASP G  64     -91.394  81.887  15.047  1.00  39.33     A  C
ATOM  17655  OD1  ASP G  64     -92.471  81.619  14.557  1.00  41.90     A  O
ATOM  17656  OD2  ASP G  64     -90.465  81.097  15.073  1.00  47.24     A  O
ATOM  17657  C    ASP G  64     -89.229  84.635  15.730  1.00  34.83     A  C
ATOM  17658  O    ASP G  64     -88.455  84.507  14.866  1.00  36.19     A  O
ATOM  17659  N    PHE G  65     -89.478  85.842  16.119  1.00  34.51     A  N
ATOM  17660  CA   PHE G  65     -88.638  86.801  15.436  1.00  34.02     A  C
ATOM  17661  CB   PHE G  65     -89.453  87.798  14.622  1.00  34.42     A  C
ATOM  17662  CG   PHE G  65     -90.312  87.161  13.606  1.00  33.79     A  C
ATOM  17663  CD1  PHE G  65     -89.798  86.778  12.416  1.00  33.19     A  C
ATOM  17664  CE1  PHE G  65     -90.557  86.169  11.516  1.00  29.67     A  C
ATOM  17665  CZ   PHE G  65     -91.835  85.936  11.781  1.00  33.99     A  C
ATOM  17666  CE2  PHE G  65     -92.367  86.296  12.953  1.00  32.54     A  C
ATOM  17667  CD2  PHE G  65     -91.624  86.906  13.858  1.00  32.06     A  C
ATOM  17668  C    PHE G  65     -87.718  87.473  16.404  1.00  34.14     A  C
ATOM  17669  O    PHE G  65     -86.715  88.018  16.054  1.00  33.99     A  O
ATOM  17670  N    ILE G  66     -88.084  87.402  17.656  1.00  34.01     A  N
ATOM  17671  CA   ILE G  66     -87.381  88.112  18.675  1.00  33.67     A  C
ATOM  17672  CB   ILE G  66     -88.364  88.664  19.631  1.00  34.81     A  C
ATOM  17673  CG1  ILE G  66     -88.999  87.531  20.384  1.00  32.47     A  C
```

Appendix 1

```
ATOM  17674  CD1  ILE  G  66   -90.092  87.942  21.124  1.00  29.53  A  C
ATOM  17675  CG2  ILE  G  66   -89.392  89.384  18.886  1.00  36.97  A  C
ATOM  17676  C    ILE  G  66   -86.285  87.411  19.452  1.00  33.34  A  C
ATOM  17677  O    ILE  G  66   -85.598  88.027  20.207  1.00  32.35  A  O
ATOM  17678  N    SER  G  67   -86.114  86.124  19.294  1.00  31.20  A  N
ATOM  17679  CA   SER  G  67   -85.007  85.509  19.951  1.00  29.71  A  C
ATOM  17680  CB   SER  G  67   -85.207  84.020  20.068  1.00  27.93  A  C
ATOM  17681  OG   SER  G  67   -85.180  83.432  18.841  1.00  31.06  A  O
ATOM  17682  C    SER  G  67   -83.715  85.923  19.261  1.00  28.96  A  C
ATOM  17683  O    SER  G  67   -83.722  86.230  18.119  1.00  29.10  A  O
ATOM  17684  N    PRO  G  68   -82.608  85.946  19.974  1.00  28.55  A  N
ATOM  17685  CA   PRO  G  68   -81.360  86.445  19.440  1.00  28.36  A  C
ATOM  17686  CB   PRO  G  68   -80.410  86.324  20.628  1.00  27.98  A  C
ATOM  17687  CG   PRO  G  68   -81.080  85.640  21.602  1.00  25.94  A  C
ATOM  17688  CD   PRO  G  68   -82.496  85.774  21.417  1.00  27.75  A  C
ATOM  17689  C    PRO  G  68   -80.842  85.674  18.272  1.00  28.48  A  C
ATOM  17690  O    PRO  G  68   -80.224  86.226  17.441  1.00  29.32  A  O
ATOM  17691  N    PHE  G  69   -81.044  84.387  18.251  1.00  29.44  A  N
ATOM  17692  CA   PHE  G  69   -80.409  83.549  17.270  1.00  30.94  A  C
ATOM  17693  CB   PHE  G  69   -79.603  82.439  17.907  1.00  30.28  A  C
ATOM  17694  CG   PHE  G  69   -78.334  82.901  18.449  1.00  32.42  A  C
ATOM  17695  CD1  PHE  G  69   -77.205  82.835  17.724  1.00  34.43  A  C
ATOM  17696  CE1  PHE  G  69   -76.074  83.289  18.221  1.00  33.68  A  C
ATOM  17697  CZ   PHE  G  69   -76.047  83.823  19.420  1.00  34.25  A  C
ATOM  17698  CE2  PHE  G  69   -77.151  83.928  20.139  1.00  33.60  A  C
ATOM  17699  CD2  PHE  G  69   -78.279  83.477  19.666  1.00  33.50  A  C
ATOM  17700  C    PHE  G  69   -81.326  83.020  16.228  1.00  31.60  A  C
ATOM  17701  O    PHE  G  69   -81.039  82.046  15.606  1.00  32.84  A  O
ATOM  17702  N    TYR  G  70   -82.448  83.689  16.086  1.00  31.89  A  N
ATOM  17703  CA   TYR  G  70   -83.468  83.309  15.162  1.00  32.45  A  C
ATOM  17704  CB   TYR  G  70   -84.711  84.139  15.411  1.00  32.27  A  C
ATOM  17705  CG   TYR  G  70   -85.766  83.922  14.396  1.00  30.09  A  C
ATOM  17706  CD1  TYR  G  70   -86.631  82.875  14.493  1.00  28.08  A  C
ATOM  17707  CE1  TYR  G  70   -87.553  82.676  13.564  1.00  27.67  A  C
ATOM  17708  CZ   TYR  G  70   -87.613  83.515  12.524  1.00  29.58  A  C
ATOM  17709  OH   TYR  G  70   -88.550  83.324  11.598  1.00  39.78  A  O
ATOM  17710  CE2  TYR  G  70   -86.771  84.536  12.398  1.00  25.92  A  C
ATOM  17711  CD2  TYR  G  70   -85.862  84.732  13.315  1.00  26.38  A  C
ATOM  17712  C    TYR  G  70   -83.093  83.376  13.706  1.00  32.87  A  C
ATOM  17713  O    TYR  G  70   -83.365  82.496  12.952  1.00  33.17  A  O
ATOM  17714  N    SER  G  71   -82.480  84.448  13.296  1.00  32.49  A  N
ATOM  17715  CA   SER  G  71   -82.301  84.651  11.913  1.00  33.65  A  C
ATOM  17716  CB   SER  G  71   -83.225  85.743  11.424  1.00  34.41  A  C
ATOM  17717  OG   SER  G  71   -83.164  85.894  10.052  1.00  35.97  A  O
ATOM  17718  C    SER  G  71   -80.928  85.078  11.739  1.00  34.32  A  C
ATOM  17719  O    SER  G  71   -80.294  85.477  12.644  1.00  36.42  A  O
ATOM  17720  N    ARG  G  72   -80.441  84.916  10.550  1.00  34.33  A  N
ATOM  17721  CA   ARG  G  72   -79.091  85.149  10.295  1.00  34.35  A  C
ATOM  17722  CB   ARG  G  72   -78.606  84.001   9.476  1.00  34.56  A  C
ATOM  17723  CG   ARG  G  72   -77.703  84.353   8.448  1.00  38.15  A  C
ATOM  17724  CD   ARG  G  72   -78.137  83.732   7.214  1.00  44.90  A  C
ATOM  17725  NE   ARG  G  72   -77.825  82.326   7.171  1.00  45.30  A  N
ATOM  17726  CZ   ARG  G  72   -76.610  81.845   7.126  1.00  50.66  A  C
ATOM  17727  NH1  ARG  G  72   -75.585  82.656   7.132  1.00  49.33  A  N
```

Appendix 1

```
ATOM  17728  NH2  ARG G  72   -76.434  80.555   7.056  1.00  53.12  A  N
ATOM  17729  C    ARG G  72   -79.036  86.452   9.590  1.00  34.72  A  C
ATOM  17730  O    ARG G  72   -78.010  86.946   9.229  1.00  35.97  A  O
ATOM  17731  N    GLY G  73   -80.197  87.036   9.462  1.00  34.31  A  N
ATOM  17732  CA   GLY G  73   -80.384  88.293   8.804  1.00  34.94  A  C
ATOM  17733  C    GLY G  73   -79.903  89.448   9.619  1.00  36.14  A  C
ATOM  17734  O    GLY G  73   -79.622  89.302  10.762  1.00  36.76  A  O
ATOM  17735  N    CYS G  74   -79.789  90.612   9.028  1.00  36.19  A  N
ATOM  17736  CA   CYS G  74   -79.294  91.706   9.802  1.00  37.09  A  C
ATOM  17737  CB   CYS G  74   -78.174  92.510   9.073  1.00  37.49  A  C
ATOM  17738  SG   CYS G  74   -76.435  91.994   9.669  1.00  45.15  A  S
ATOM  17739  C    CYS G  74   -80.409  92.439  10.547  1.00  36.47  A  C
ATOM  17740  O    CYS G  74   -80.689  93.598  10.380  1.00  36.69  A  O
ATOM  17741  N    SER G  75   -81.031  91.656  11.402  1.00  34.75  A  N
ATOM  17742  CA   SER G  75   -82.103  92.043  12.251  1.00  33.89  A  C
ATOM  17743  CB   SER G  75   -83.273  91.168  11.977  1.00  34.44  A  C
ATOM  17744  OG   SER G  75   -84.177  91.318  13.015  1.00  41.88  A  O
ATOM  17745  C    SER G  75   -81.711  91.874  13.693  1.00  32.29  A  C
ATOM  17746  O    SER G  75   -81.070  90.939  14.055  1.00  29.48  A  O
ATOM  17747  N    PHE G  76   -82.088  92.832  14.515  1.00  31.77  A  N
ATOM  17748  CA   PHE G  76   -81.615  92.915  15.871  1.00  30.27  A  C
ATOM  17749  CB   PHE G  76   -80.519  93.972  15.956  1.00  29.33  A  C
ATOM  17750  CG   PHE G  76   -79.279  93.545  15.338  1.00  27.40  A  C
ATOM  17751  CD1  PHE G  76   -78.425  92.785  16.022  1.00  26.00  A  C
ATOM  17752  CE1  PHE G  76   -77.347  92.328  15.447  1.00  26.07  A  C
ATOM  17753  CZ   PHE G  76   -77.094  92.610  14.189  1.00  24.16  A  C
ATOM  17754  CE2  PHE G  76   -77.923  93.325  13.491  1.00  24.14  A  C
ATOM  17755  CD2  PHE G  76   -79.011  93.798  14.049  1.00  27.56  A  C
ATOM  17756  C    PHE G  76   -82.653  93.161  16.925  1.00  30.71  A  C
ATOM  17757  O    PHE G  76   -82.384  93.823  17.851  1.00  32.17  A  O
ATOM  17758  N    GLU G  77   -83.833  92.614  16.786  1.00  31.23  A  N
ATOM  17759  CA   GLU G  77   -84.954  92.909  17.661  1.00  31.72  A  C
ATOM  17760  CB   GLU G  77   -86.209  92.197  17.160  1.00  33.10  A  C
ATOM  17761  CG   GLU G  77   -87.183  93.042  16.359  1.00  40.30  A  C
ATOM  17762  CD   GLU G  77   -87.192  92.722  14.868  1.00  51.81  A  C
ATOM  17763  OE1  GLU G  77   -86.944  93.606  14.041  1.00  53.58  A  O
ATOM  17764  OE2  GLU G  77   -87.442  91.577  14.516  1.00  57.21  A  O-1
ATOM  17765  C    GLU G  77   -84.687  92.521  19.091  1.00  29.72  A  C
ATOM  17766  O    GLU G  77   -85.207  93.100  19.989  1.00  29.17  A  O
ATOM  17767  N    ALA G  78   -83.892  91.490  19.259  1.00  28.81  A  N
ATOM  17768  CA   ALA G  78   -83.550  90.948  20.541  1.00  28.24  A  C
ATOM  17769  CB   ALA G  78   -82.849  89.710  20.342  1.00  28.42  A  C
ATOM  17770  C    ALA G  78   -82.756  91.838  21.435  1.00  28.63  A  C
ATOM  17771  O    ALA G  78   -83.009  91.916  22.591  1.00  28.66  A  O
ATOM  17772  N    TRP G  79   -81.755  92.470  20.882  1.00  27.74  A  N
ATOM  17773  CA   TRP G  79   -81.031  93.492  21.572  1.00  28.52  A  C
ATOM  17774  CB   TRP G  79   -79.699  93.778  20.893  1.00  28.20  A  C
ATOM  17775  CG   TRP G  79   -78.813  92.608  20.854  1.00  25.42  A  C
ATOM  17776  CD1  TRP G  79   -77.832  92.311  21.695  1.00  24.30  A  C
ATOM  17777  NE1  TRP G  79   -77.251  91.161  21.352  1.00  24.79  A  N
ATOM  17778  CE2  TRP G  79   -77.872  90.671  20.248  1.00  25.65  A  C
ATOM  17779  CD2  TRP G  79   -78.864  91.559  19.919  1.00  27.11  A  C
ATOM  17780  CE3  TRP G  79   -79.660  91.287  18.826  1.00  29.38  A  C
ATOM  17781  CZ3  TRP G  79   -79.436  90.172  18.138  1.00  30.02  A  C
```

Appendix 1

```
ATOM  17782  CH2 TRP G  79     -78.437  89.309  18.479  1.00  28.79      A    C
ATOM  17783  CZ2 TRP G  79     -77.645  89.533  19.532  1.00  24.65      A    C
ATOM  17784  C   TRP G  79     -81.859  94.732  21.847  1.00  30.62      A    C
ATOM  17785  O   TRP G  79     -81.656  95.389  22.815  1.00  30.89      A    O
ATOM  17786  N   GLU G  80     -82.764  95.069  20.961  1.00  32.20      A    N
ATOM  17787  CA  GLU G  80     -83.631  96.183  21.168  1.00  34.41      A    C
ATOM  17788  CB  GLU G  80     -84.469  96.385  19.919  1.00  35.76      A    C
ATOM  17789  CG  GLU G  80     -83.783  97.170  18.842  1.00  41.81      A    C
ATOM  17790  CD  GLU G  80     -84.306  96.941  17.446  1.00  50.06      A    C
ATOM  17791  OE1 GLU G  80     -83.527  97.012  16.489  1.00  51.50      A    O
ATOM  17792  OE2 GLU G  80     -85.495  96.713  17.287  1.00  55.77      A    O-1
ATOM  17793  C   GLU G  80     -84.514  95.925  22.355  1.00  34.43      A    C
ATOM  17794  O   GLU G  80     -84.746  96.764  23.172  1.00  34.05      A    O
ATOM  17795  N   LEU G  81     -85.015  94.721  22.436  1.00  34.33      A    N
ATOM  17796  CA  LEU G  81     -85.860  94.329  23.513  1.00  34.01      A    C
ATOM  17797  CB  LEU G  81     -86.323  92.915  23.283  1.00  34.47      A    C
ATOM  17798  CG  LEU G  81     -87.722  92.659  22.783  1.00  35.22      A    C
ATOM  17799  CD1 LEU G  81     -88.485  93.892  22.562  1.00  30.17      A    C
ATOM  17800  CD2 LEU G  81     -87.667  91.826  21.567  1.00  34.80      A    C
ATOM  17801  C   LEU G  81     -85.157  94.382  24.850  1.00  34.33      A    C
ATOM  17802  O   LEU G  81     -85.748  94.706  25.843  1.00  33.10      A    O
ATOM  17803  N   LYS G  82     -83.893  94.024  24.890  1.00  33.50      A    N
ATOM  17804  CA  LYS G  82     -83.192  94.040  26.152  1.00  33.29      A    C
ATOM  17805  CB  LYS G  82     -82.475  92.733  26.450  1.00  33.69      A    C
ATOM  17806  CG  LYS G  82     -81.294  92.401  25.645  1.00  34.89      A    C
ATOM  17807  CD  LYS G  82     -80.912  91.009  25.934  1.00  37.46      A    C
ATOM  17808  CE  LYS G  82     -79.791  90.547  25.100  1.00  40.76      A    C
ATOM  17809  NZ  LYS G  82     -79.121  89.464  25.764  1.00  41.97      A    N
ATOM  17810  C   LYS G  82     -82.342  95.255  26.418  1.00  32.52      A    C
ATOM  17811  O   LYS G  82     -81.657  95.328  27.429  1.00  30.89      A    O
ATOM  17812  N   HIS G  83     -82.470  96.206  25.539  1.00  33.14      A    N
ATOM  17813  CA  HIS G  83     -81.810  97.476  25.566  1.00  34.11      A    C
ATOM  17814  CB  HIS G  83     -82.259  98.268  26.753  1.00  35.12      A    C
ATOM  17815  CG  HIS G  83     -83.729  98.438  26.818  1.00  42.28      A    C
ATOM  17816  ND1 HIS G  83     -84.504  97.784  27.737  1.00  47.14      A    N
ATOM  17817  CE1 HIS G  83     -85.761  98.113  27.556  1.00  49.94      A    C
ATOM  17818  NE2 HIS G  83     -85.829  98.956  26.552  1.00  48.91      A    N
ATOM  17819  CD2 HIS G  83     -84.571  99.172  26.070  1.00  46.83      A    C
ATOM  17820  C   HIS G  83     -80.334  97.533  25.470  1.00  32.74      A    C
ATOM  17821  O   HIS G  83     -79.754  98.415  26.015  1.00  33.79      A    O
ATOM  17822  N   THR G  84     -79.731  96.634  24.732  1.00  30.37      A    N
ATOM  17823  CA  THR G  84     -78.313  96.705  24.536  1.00  27.76      A    C
ATOM  17824  CB  THR G  84     -77.809  95.495  23.833  1.00  26.72      A    C
ATOM  17825  OG1 THR G  84     -78.368  94.345  24.415  1.00  28.23      A    O
ATOM  17826  CG2 THR G  84     -76.384  95.403  23.964  1.00  27.13      A    C
ATOM  17827  C   THR G  84     -77.966  97.912  23.708  1.00  27.01      A    C
ATOM  17828  O   THR G  84     -78.506  98.116  22.660  1.00  27.75      A    O
ATOM  17829  N   PRO G  85     -77.028  98.688  24.198  1.00  25.03      A    N
ATOM  17830  CA  PRO G  85     -76.493  99.824  23.504  1.00  23.99      A    C
ATOM  17831  CB  PRO G  85     -75.459 100.320  24.477  1.00  23.64      A    C
ATOM  17832  CG  PRO G  85     -75.876  99.851  25.701  1.00  23.19      A    C
ATOM  17833  CD  PRO G  85     -76.469  98.597  25.533  1.00  24.86      A    C
ATOM  17834  C   PRO G  85     -75.814  99.330  22.291  1.00  23.60      A    C
ATOM  17835  O   PRO G  85     -75.321  98.290  22.349  1.00  23.69      A    O
```

Appendix 1

```
ATOM  17836  N   GLN G  86    -75.796 100.047  21.204  1.00  24.28      A  N
ATOM  17837  CA  GLN G  86    -75.187  99.521  20.022  1.00  25.18      A  C
ATOM  17838  CB  GLN G  86    -75.576 100.273  18.759  1.00  25.73      A  C
ATOM  17839  CG  GLN G  86    -74.683 101.304  18.288  1.00  29.94      A  C
ATOM  17840  CD  GLN G  86    -73.445 100.822  17.642  1.00  28.98      A  C
ATOM  17841  OE1 GLN G  86    -73.427  99.896  16.897  1.00  31.21      A  O
ATOM  17842  NE2 GLN G  86    -72.412 101.517  17.878  1.00  29.84      A  N
ATOM  17843  C   GLN G  86    -73.720  99.227  20.113  1.00  25.17      A  C
ATOM  17844  O   GLN G  86    -73.274  98.335  19.513  1.00  25.56      A  O
ATOM  17845  N   ARG G  87    -72.975  99.980  20.882  1.00  25.99      A  N
ATOM  17846  CA  ARG G  87    -71.557  99.783  21.006  1.00  26.16      A  C
ATOM  17847  CB  ARG G  87    -70.937 100.925  21.789  1.00  25.08      A  C
ATOM  17848  CG  ARG G  87    -70.323 101.965  20.953  1.00  25.19      A  C
ATOM  17849  CD  ARG G  87    -70.016 103.134  21.750  1.00  24.94      A  C
ATOM  17850  NE  ARG G  87    -70.239 104.349  21.023  1.00  33.40      A  N
ATOM  17851  CZ  ARG G  87    -69.371 104.896  20.194  1.00  35.58      A  C
ATOM  17852  NH1 ARG G  87    -68.227 104.327  19.966  1.00  32.61      A  N
ATOM  17853  NH2 ARG G  87    -69.665 106.005  19.586  1.00  29.12      A  N
ATOM  17854  C   ARG G  87    -71.235  98.440  21.617  1.00  26.37      A  C
ATOM  17855  O   ARG G  87    -70.245  97.860  21.351  1.00  25.34      A  O
ATOM  17856  N   VAL G  88    -72.156  97.942  22.388  1.00  26.99      A  N
ATOM  17857  CA  VAL G  88    -71.986  96.718  23.088  1.00  27.25      A  C
ATOM  17858  CB  VAL G  88    -72.659  96.859  24.433  1.00  27.73      A  C
ATOM  17859  CG1 VAL G  88    -72.640  95.625  25.165  1.00  26.82      A  C
ATOM  17860  CG2 VAL G  88    -71.975  97.865  25.179  1.00  29.50      A  C
ATOM  17861  C   VAL G  88    -72.420  95.448  22.356  1.00  27.57      A  C
ATOM  17862  O   VAL G  88    -72.135  94.390  22.791  1.00  27.87      A  O
ATOM  17863  N   ILE G  89    -73.088  95.559  21.229  1.00  26.78      A  N
ATOM  17864  CA  ILE G  89    -73.622  94.407  20.531  1.00  26.23      A  C
ATOM  17865  CB  ILE G  89    -74.589  94.810  19.406  1.00  26.96      A  C
ATOM  17866  CG1 ILE G  89    -75.754  95.555  19.981  1.00  26.71      A  C
ATOM  17867  CD1 ILE G  89    -76.519  96.201  18.981  1.00  23.35      A  C
ATOM  17868  CG2 ILE G  89    -75.208  93.667  18.775  1.00  25.70      A  C
ATOM  17869  C   ILE G  89    -72.565  93.423  20.069  1.00  25.74      A  C
ATOM  17870  O   ILE G  89    -72.778  92.264  20.109  1.00  26.75      A  O
ATOM  17871  N   LYS G  90    -71.417  93.895  19.654  1.00  24.71      A  N
ATOM  17872  CA  LYS G  90    -70.375  93.011  19.216  1.00  24.24      A  C
ATOM  17873  CB  LYS G  90    -69.181  93.744  18.602  1.00  23.59      A  C
ATOM  17874  CG  LYS G  90    -68.641  94.920  19.344  1.00  20.41      A  C
ATOM  17875  CD  LYS G  90    -67.499  95.544  18.626  1.00  13.96      A  C
ATOM  17876  CE  LYS G  90    -67.857  96.751  17.828  1.00  16.65      A  C
ATOM  17877  NZ  LYS G  90    -68.718  97.727  18.476  1.00  12.53      A  N
ATOM  17878  C   LYS G  90    -69.946  92.130  20.333  1.00  24.26      A  C
ATOM  17879  O   LYS G  90    -69.570  91.023  20.131  1.00  23.72      A  O
ATOM  17880  N   TYR G  91    -69.963  92.663  21.531  1.00  23.69      A  N
ATOM  17881  CA  TYR G  91    -69.659  91.883  22.690  1.00  24.02      A  C
ATOM  17882  CB  TYR G  91    -69.470  92.798  23.877  1.00  24.68      A  C
ATOM  17883  CG  TYR G  91    -68.387  93.769  23.614  1.00  26.16      A  C
ATOM  17884  CD1 TYR G  91    -67.133  93.347  23.372  1.00  24.34      A  C
ATOM  17885  CE1 TYR G  91    -66.190  94.193  23.113  1.00  30.84      A  C
ATOM  17886  CZ  TYR G  91    -66.462  95.501  23.070  1.00  32.22      A  C
ATOM  17887  OH  TYR G  91    -65.492  96.380  22.785  1.00  31.50      A  O
ATOM  17888  CE2 TYR G  91    -67.683  95.948  23.290  1.00  30.10      A  C
ATOM  17889  CD2 TYR G  91    -68.635  95.099  23.556  1.00  27.14      A  C
```

Appendix 1

```
ATOM  17890  C    TYR G  91     -70.635  90.797  22.977  1.00  23.61      A    C
ATOM  17891  O    TYR G  91     -70.264  89.704  23.263  1.00  24.63      A    O
ATOM  17892  N    SER G  92     -71.899  91.123  22.873  1.00  23.49      A    N
ATOM  17893  CA   SER G  92     -72.962  90.227  23.179  1.00  23.52      A    C
ATOM  17894  CB   SER G  92     -74.234  91.017  23.065  1.00  23.35      A    C
ATOM  17895  OG   SER G  92     -75.353  90.262  23.340  1.00  24.14      A    O
ATOM  17896  C    SER G  92     -72.977  89.021  22.273  1.00  25.36      A    C
ATOM  17897  O    SER G  92     -73.191  87.931  22.706  1.00  26.33      A    O
ATOM  17898  N    ILE G  93     -72.759  89.246  20.998  1.00  25.61      A    N
ATOM  17899  CA   ILE G  93     -72.618  88.205  20.024  1.00  24.78      A    C
ATOM  17900  CB   ILE G  93     -72.623  88.783  18.582  1.00  26.08      A    C
ATOM  17901  CG1  ILE G  93     -73.875  89.590  18.299  1.00  23.20      A    C
ATOM  17902  CD1  ILE G  93     -73.917  90.196  16.937  1.00  20.01      A    C
ATOM  17903  CG2  ILE G  93     -72.464  87.723  17.566  1.00  22.09      A    C
ATOM  17904  C    ILE G  93     -71.393  87.349  20.208  1.00  24.78      A    C
ATOM  17905  O    ILE G  93     -71.481  86.170  20.123  1.00  27.04      A    O
ATOM  17906  N    ALA G  94     -70.246  87.938  20.463  1.00  23.75      A    N
ATOM  17907  CA   ALA G  94     -69.043  87.166  20.742  1.00  22.44      A    C
ATOM  17908  CB   ALA G  94     -67.909  88.065  20.824  1.00  21.30      A    C
ATOM  17909  C    ALA G  94     -69.072  86.284  21.966  1.00  22.94      A    C
ATOM  17910  O    ALA G  94     -68.736  85.168  21.885  1.00  21.98      A    O
ATOM  17911  N    PHE G  95     -69.528  86.796  23.082  1.00  23.13      A    N
ATOM  17912  CA   PHE G  95     -69.742  86.020  24.287  1.00  25.43      A    C
ATOM  17913  CB   PHE G  95     -69.910  86.925  25.510  1.00  25.75      A    C
ATOM  17914  CG   PHE G  95     -68.770  87.821  25.714  1.00  25.76      A    C
ATOM  17915  CD1  PHE G  95     -67.523  87.341  25.760  1.00  32.82      A    C
ATOM  17916  CE1  PHE G  95     -66.476  88.163  25.908  1.00  32.86      A    C
ATOM  17917  CZ   PHE G  95     -66.666  89.454  25.984  1.00  28.57      A    C
ATOM  17918  CE2  PHE G  95     -67.873  89.936  25.934  1.00  27.20      A    C
ATOM  17919  CD2  PHE G  95     -69.929  89.137  25.791  1.00  26.05      A    C
ATOM  17920  C    PHE G  95     -70.794  84.923  24.221  1.00  26.26      A    C
ATOM  17921  O    PHE G  95     -70.649  83.919  24.838  1.00  26.56      A    O
ATOM  17922  N    TYR G  96     -71.859  85.134  23.492  1.00  26.20      A    N
ATOM  17923  CA   TYR G  96     -72.784  84.082  23.261  1.00  26.94      A    C
ATOM  17924  CB   TYR G  96     -73.953  84.553  22.432  1.00  26.55      A    C
ATOM  17925  CG   TYR G  96     -75.141  85.088  23.160  1.00  28.97      A    C
ATOM  17926  CD1  TYR G  96     -75.597  84.530  24.315  1.00  24.28      A    C
ATOM  17927  CE1  TYR G  96     -76.663  85.046  24.935  1.00  24.03      A    C
ATOM  17928  CZ   TYR G  96     -77.293  86.112  24.404  1.00  24.53      A    C
ATOM  17929  OH   TYR G  96     -78.372  86.654  24.993  1.00  22.76      A    O
ATOM  17930  CE2  TYR G  96     -76.859  86.668  23.287  1.00  23.34      A    C
ATOM  17931  CD2  TYR G  96     -75.815  86.167  22.668  1.00  28.96      A    C
ATOM  17932  C    TYR G  96     -72.079  83.025  22.468  1.00  26.55      A    C
ATOM  17933  O    TYR G  96     -72.319  81.871  22.619  1.00  27.15      A    O
ATOM  17934  N    ALA G  97     -71.271  83.450  21.538  1.00  25.90      A    N
ATOM  17935  CA   ALA G  97     -70.599  82.544  20.671  1.00  27.00      A    C
ATOM  17936  CB   ALA G  97     -69.955  83.294  19.535  1.00  26.09      A    C
ATOM  17937  C    ALA G  97     -69.600  81.655  21.378  1.00  27.62      A    C
ATOM  17938  O    ALA G  97     -69.465  80.519  21.067  1.00  27.86      A    O
ATOM  17939  N    TYR G  98     -69.857  82.209  22.301  1.00  28.06      A    N
ATOM  17940  CA   TYR G  98     -67.899  81.454  23.043  1.00  28.61      A    C
ATOM  17941  CB   TYR G  98     -66.933  82.352  23.805  1.00  29.64      A    C
ATOM  17942  CG   TYR G  98     -66.246  83.418  22.977  1.00  30.70      A    C
ATOM  17943  CD1  TYR G  98     -66.140  83.319  21.624  1.00  32.01      A    C
```

Appendix 1

```
ATOM  17944  CE1 TYR G  98     -65.536  84.273  20.913  1.00  32.83      A    C
ATOM  17945  CZ  TYR G  98     -65.041  85.332  21.535  1.00  32.98      A    C
ATOM  17946  OH  TYR G  98     -64.446  86.290  20.823  1.00  37.78      A    O
ATOM  17947  CE2 TYR G  98     -65.126  85.457  22.847  1.00  31.20      A    C
ATOM  17948  CD2 TYR G  98     -65.720  84.524  23.560  1.00  31.57      A    C
ATOM  17949  C   TYR G  98     -68.559  80.420  23.897  1.00  28.28      A    C
ATOM  17950  O   TYR G  98     -68.015  79.392  24.114  1.00  29.98      A    O
ATOM  17951  N   GLY G  99     -69.726  80.731  24.406  1.00  27.98      A    N
ATOM  17952  CA  GLY G  99     -70.593  79.804  25.074  1.00  28.81      A    C
ATOM  17953  C   GLY G  99     -71.125  78.691  24.221  1.00  30.46      A    C
ATOM  17954  O   GLY G  99     -71.213  77.594  24.634  1.00  30.91      A    O
ATOM  17955  N   LEU G 100     -71.474  79.008  23.009  1.00  31.77      A    N
ATOM  17956  CA  LEU G 100     -71.926  78.050  22.057  1.00  32.81      A    C
ATOM  17957  CB  LEU G 100     -72.288  78.762  20.785  1.00  33.07      A    C
ATOM  17958  CG  LEU G 100     -73.745  79.060  20.589  1.00  33.41      A    C
ATOM  17959  CD1 LEU G 100     -74.512  78.745  21.772  1.00  27.56      A    C
ATOM  17960  CD2 LEU G 100     -73.927  80.442  20.180  1.00  33.45      A    C
ATOM  17961  C   LEU G 100     -70.864  77.037  21.764  1.00  33.23      A    C
ATOM  17962  O   LEU G 100     -71.162  75.911  21.543  1.00  33.49      A    O
ATOM  17963  N   ALA G 101     -69.621  77.452  21.734  1.00  32.94      A    N
ATOM  17964  CA  ALA G 101     -68.527  76.544  21.549  1.00  33.46      A    C
ATOM  17965  CB  ALA G 101     -67.281  77.312  21.394  1.00  33.06      A    C
ATOM  17966  C   ALA G 101     -68.374  75.543  22.678  1.00  34.04      A    C
ATOM  17967  O   ALA G 101     -68.051  74.423  22.483  1.00  34.07      A    O
ATOM  17968  N   SER G 102     -68.553  75.993  23.885  1.00  33.90      A    N
ATOM  17969  CA  SER G 102     -68.442  75.128  25.011  1.00  34.01      A    C
ATOM  17970  CB  SER G 102     -68.189  75.897  26.287  1.00  34.37      A    C
ATOM  17971  OG  SER G 102     -66.862  76.292  26.334  1.00  31.78      A    O
ATOM  17972  C   SER G 102     -69.554  74.126  25.120  1.00  34.41      A    C
ATOM  17973  O   SER G 102     -69.378  73.074  25.638  1.00  34.38      A    O
ATOM  17974  N   VAL G 103     -70.719  74.507  24.680  1.00  34.70      A    N
ATOM  17975  CA  VAL G 103     -71.859  73.639  24.679  1.00  34.78      A    C
ATOM  17976  CB  VAL G 103     -73.075  74.413  24.257  1.00  35.02      A    C
ATOM  17977  CG1 VAL G 103     -74.093  73.556  23.640  1.00  33.48      A    C
ATOM  17978  CG2 VAL G 103     -73.630  75.123  25.418  1.00  33.05      A    C
ATOM  17979  C   VAL G 103     -71.582  72.486  23.764  1.00  36.32      A    C
ATOM  17980  O   VAL G 103     -71.933  71.375  24.026  1.00  36.53      A    O
ATOM  17981  N   ALA G 104     -70.924  72.791  22.673  1.00  37.10      A    N
ATOM  17982  CA  ALA G 104     -70.635  71.841  21.642  1.00  37.48      A    C
ATOM  17983  CB  ALA G 104     -70.007  72.543  20.485  1.00  36.33      A    C
ATOM  17984  C   ALA G 104     -69.750  70.747  22.114  1.00  37.64      A    C
ATOM  17985  O   ALA G 104     -69.903  69.634  21.729  1.00  38.39      A    O
ATOM  17986  N   LEU G 105     -68.766  71.116  22.895  1.00  39.02      A    N
ATOM  17987  CA  LEU G 105     -67.939  70.201  23.630  1.00  40.25      A    C
ATOM  17988  CB  LEU G 105     -66.818  70.976  24.282  1.00  40.71      A    C
ATOM  17989  CG  LEU G 105     -65.422  70.423  24.245  1.00  41.59      A    C
ATOM  17990  CD1 LEU G 105     -65.297  69.576  23.079  1.00  41.48      A    C
ATOM  17991  CD2 LEU G 105     -64.481  71.518  24.151  1.00  36.50      A    C
ATOM  17992  C   LEU G 105     -68.668  69.412  24.703  1.00  39.90      A    C
ATOM  17993  O   LEU G 105     -68.407  68.272  24.877  1.00  40.32      A    O
ATOM  17994  N   ILE G 106     -69.532  70.041  25.468  1.00  40.08      A    N
ATOM  17995  CA  ILE G 106     -70.261  69.331  26.489  1.00  40.32      A    C
ATOM  17996  CB  ILE G 106     -71.145  70.287  27.236  1.00  39.06      A    C
ATOM  17997  CG1 ILE G 106     -70.341  71.249  28.061  1.00  37.32      A    C
```

Appendix 1

```
ATOM  17998  CD1  ILE  G  106   -71.193  72.225  28.741  1.00  33.48  A  C
ATOM  17999  CG2  ILE  G  106   -72.096  69.552  28.088  1.00  37.07  A  C
ATOM  18000  C    ILE  G  106   -71.237  68.262  26.036  1.00  41.68  A  C
ATOM  18001  O    ILE  G  106   -71.221  67.186  26.555  1.00  41.87  A  O
ATOM  18002  N    ASP  G  107   -72.130  68.586  25.123  1.00  42.67  A  N
ATOM  18003  CA   ASP  G  107   -73.103  67.625  24.689  1.00  44.43  A  C
ATOM  18004  CB   ASP  G  107   -74.461  68.036  25.177  1.00  44.28  A  C
ATOM  18005  CG   ASP  G  107   -75.491  67.072  24.793  1.00  49.17  A  C
ATOM  18006  OD1  ASP  G  107   -75.153  66.176  24.028  1.00  49.13  A  O
ATOM  18007  OD2  ASP  G  107   -76.622  67.183  25.251  1.00  52.46  A  O-1
ATOM  18008  C    ASP  G  107   -73.185  67.501  23.196  1.00  44.83  A  C
ATOM  18009  O    ASP  G  107   -73.673  68.386  22.554  1.00  44.29  A  O
ATOM  18010  N    PRO  G  108   -72.760  66.360  22.668  1.00  45.08  A  N
ATOM  18011  CA   PRO  G  108   -72.530  66.111  21.247  1.00  44.64  A  C
ATOM  18012  CB   PRO  G  108   -71.985  64.688  21.240  1.00  44.31  A  C
ATOM  18013  CG   PRO  G  108   -71.749  64.349  22.597  1.00  43.14  A  C
ATOM  18014  CD   PRO  G  108   -72.689  65.108  23.407  1.00  44.59  A  C
ATOM  18015  C    PRO  G  108   -73.776  66.173  20.410  1.00  44.62  A  C
ATOM  18016  O    PRO  G  108   -73.725  66.343  19.227  1.00  45.10  A  O
ATOM  18017  N    LYS  G  109   -74.906  66.012  21.038  1.00  43.43  A  N
ATOM  18018  CA   LYS  G  109   -76.126  66.064  20.321  1.00  43.44  A  C
ATOM  18019  CB   LYS  G  109   -77.116  65.077  20.894  1.00  44.43  A  C
ATOM  18020  CG   LYS  G  109   -77.635  65.385  22.249  1.00  46.34  A  C
ATOM  18021  CD   LYS  G  109   -78.085  64.116  22.836  1.00  51.22  A  C
ATOM  18022  CE   LYS  G  109   -77.374  63.000  22.128  1.00  51.98  A  C
ATOM  18023  NZ   LYS  G  109   -77.834  61.678  22.533  1.00  52.99  A  N
ATOM  18024  C    LYS  G  109   -76.685  67.444  20.360  1.00  42.06  A  C
ATOM  18025  O    LYS  G  109   -77.784  67.662  19.932  1.00  42.85  A  O
ATOM  18026  N    LEU  G  110   -75.930  68.372  20.913  1.00  39.40  A  N
ATOM  18027  CA   LEU  G  110   -76.263  69.763  20.784  1.00  36.29  A  C
ATOM  18028  CB   LEU  G  110   -76.274  70.471  22.120  1.00  35.48  A  C
ATOM  18029  CG   LEU  G  110   -77.389  70.158  23.085  1.00  34.87  A  C
ATOM  18030  CD1  LEU  G  110   -77.231  70.971  24.296  1.00  31.12  A  C
ATOM  18031  CD2  LEU  G  110   -78.711  70.328  22.486  1.00  28.38  A  C
ATOM  18032  C    LEU  G  110   -75.336  70.443  19.841  1.00  35.31  A  C
ATOM  18033  O    LEU  G  110   -75.524  71.565  19.551  1.00  36.79  A  O
ATOM  18034  N    ARG  G  111   -74.337  69.742  19.353  1.00  33.23  A  N
ATOM  18035  CA   ARG  G  111   -73.322  70.306  18.495  1.00  31.50  A  C
ATOM  18036  CB   ARG  G  111   -72.179  69.325  18.299  1.00  31.34  A  C
ATOM  18037  CG   ARG  G  111   -71.016  69.858  17.547  1.00  28.30  A  C
ATOM  18038  CD   ARG  G  111   -69.871  68.962  17.617  1.00  31.10  A  C
ATOM  18039  NE   ARG  G  111   -68.684  69.478  16.952  1.00  30.90  A  N
ATOM  18040  CZ   ARG  G  111   -67.466  69.001  17.107  1.00  27.49  A  C
ATOM  18041  NH1  ARG  G  111   -67.244  68.006  17.902  1.00  27.51  A  N
ATOM  18042  NH2  ARG  G  111   -66.469  69.531  16.478  1.00  25.45  A  N
ATOM  18043  C    ARG  G  111   -73.805  70.824  17.175  1.00  31.27  A  C
ATOM  18044  O    ARG  G  111   -73.276  71.754  16.686  1.00  33.61  A  O
ATOM  18045  N    ALA  G  112   -74.758  70.169  16.570  1.00  30.80  A  N
ATOM  18046  CA   ALA  G  112   -75.273  70.613  15.315  1.00  30.66  A  C
ATOM  18047  CB   ALA  G  112   -76.161  69.599  14.751  1.00  28.87  A  C
ATOM  18048  C    ALA  G  112   -75.988  71.923  15.463  1.00  30.87  A  C
ATOM  18049  O    ALA  G  112   -75.876  72.793  14.648  1.00  29.50  A  O
ATOM  18050  N    LEU  G  113   -76.773  72.029  16.507  1.00  30.11  A  N
ATOM  18051  CA   LEU  G  113   -77.401  73.258  16.866  1.00  28.73  A  C
```

Appendix 1

```
ATOM  18052  CB   LEU G 113    -78.349  72.999  17.993  1.00  28.45      A    C
ATOM  18053  CG   LEU G 113    -79.042  74.200  18.553  1.00  30.95      A    C
ATOM  18054  CD1  LEU G 113    -80.039  74.657  17.641  1.00  33.68      A    C
ATOM  18055  CD2  LEU G 113    -79.649  73.824  19.773  1.00  33.99      A    C
ATOM  18056  C    LEU G 113    -76.419  74.330  17.271  1.00  28.65      A    C
ATOM  18057  O    LEU G 113    -76.507  75.448  16.879  1.00  28.46      A    O
ATOM  18058  N    ALA G 114    -75.434  73.981  18.039  1.00  27.46      A    N
ATOM  18059  CA   ALA G 114    -74.501  74.982  18.399  1.00  28.72      A    C
ATOM  18060  CB   ALA G 114    -73.466  74.442  19.315  1.00  28.60      A    C
ATOM  18061  C    ALA G 114    -73.889  75.496  17.136  1.00  27.27      A    C
ATOM  18062  O    ALA G 114    -73.629  76.644  17.021  1.00  27.91      A    O
ATOM  18063  N    GLY G 115    -73.657  74.644  16.173  1.00  25.77      A    N
ATOM  18064  CA   GLY G 115    -73.089  75.098  14.942  1.00  24.14      A    C
ATOM  18065  C    GLY G 115    -73.959  76.053  14.214  1.00  24.77      A    C
ATOM  18066  O    GLY G 115    -73.528  76.996  13.639  1.00  26.38      A    O
ATOM  18067  N    HIS G 116    -75.227  75.786  14.235  1.00  26.29      A    N
ATOM  18068  CA   HIS G 116    -76.151  76.621  13.553  1.00  26.58      A    C
ATOM  18069  CB   HIS G 116    -77.515  75.975  13.602  1.00  26.04      A    C
ATOM  18070  CG   HIS G 116    -78.613  76.882  13.217  1.00  26.49      A    C
ATOM  18071  ND1  HIS G 116    -78.839  77.252  11.923  1.00  30.79      A    N
ATOM  18072  CE1  HIS G 116    -79.857  78.075  11.882  1.00  29.78      A    C
ATOM  18073  NE2  HIS G 116    -80.289  78.259  13.105  1.00  28.10      A    N
ATOM  18074  CD2  HIS G 116    -79.534  77.516  13.955  1.00  24.24      A    C
ATOM  18075  C    HIS G 116    -76.158  78.020  14.144  1.00  27.82      A    C
ATOM  18076  O    HIS G 116    -76.172  78.986  13.455  1.00  27.40      A    O
ATOM  18077  N    ASP G 117    -76.127  78.094  15.451  1.00  27.34      A    N
ATOM  18078  CA   ASP G 117    -76.091  79.338  16.156  1.00  28.82      A    C
ATOM  18079  CB   ASP G 117    -76.296  79.108  17.616  1.00  28.30      A    C
ATOM  18080  CG   ASP G 117    -77.664  78.774  17.918  1.00  31.20      A    C
ATOM  18081  OD1  ASP G 117    -78.470  78.745  17.018  1.00  28.31      A    O
ATOM  18082  OD2  ASP G 117    -77.957  78.544  19.055  1.00  32.91      A    O-1
ATOM  18083  C    ASP G 117    -74.847  80.108  15.939  1.00  29.57      A    C
ATOM  18084  O    ASP G 117    -74.859  81.287  15.942  1.00  29.73      A    O
ATOM  18085  N    LEU G 118    -73.759  79.393  15.820  1.00  30.45      A    N
ATOM  18086  CA   LEU G 118    -72.477  79.943  15.521  1.00  31.34      A    C
ATOM  18087  CB   LEU G 118    -71.418  78.886  15.720  1.00  31.22      A    C
ATOM  18088  CG   LEU G 118    -70.431  79.070  16.851  1.00  30.96      A    C
ATOM  18089  CD1  LEU G 118    -70.911  80.068  17.762  1.00  25.17      A    C
ATOM  18090  CD2  LEU G 118    -70.180  77.809  17.558  1.00  26.95      A    C
ATOM  18091  C    LEU G 118    -72.419  80.575  14.142  1.00  31.91      A    C
ATOM  18092  O    LEU G 118    -71.768  81.537  13.935  1.00  32.73      A    O
ATOM  18093  N    ASP G 119    -73.093  79.988  13.188  1.00  31.63      A    N
ATOM  18094  CA   ASP G 119    -73.242  80.535  11.863  1.00  31.45      A    C
ATOM  18095  CB   ASP G 119    -73.885  79.446  11.005  1.00  32.54      A    C
ATOM  18096  CG   ASP G 119    -73.961  79.765   9.543  1.00  36.81      A    C
ATOM  18097  OD1  ASP G 119    -73.164  80.514   9.008  1.00  40.64      A    O
ATOM  18098  OD2  ASP G 119    -74.833  79.230   8.892  1.00  42.27      A    O-1
ATOM  18099  C    ASP G 119    -74.042  81.828  11.863  1.00  30.09      A    C
ATOM  18100  O    ASP G 119    -73.704  82.760  11.191  1.00  30.46      A    O
ATOM  18101  N    ILE G 120    -75.112  81.863  12.622  1.00  27.91      A    N
ATOM  18102  CA   ILE G 120    -75.949  83.027  12.747  1.00  27.23      A    C
ATOM  18103  CB   ILE G 120    -77.237  82.691  13.531  1.00  27.53      A    C
ATOM  18104  CG1  ILE G 120    -78.203  82.007  12.615  1.00  27.86      A    C
ATOM  18105  CD1  ILE G 120    -79.452  81.696  13.224  1.00  29.74      A    C
```

Appendix 1

```
ATOM  18106  CG2  ILE  G  120   -77.910  83.874  14.046  1.00  25.77    A  C
ATOM  18107  C    ILE  G  120   -75.140  84.131  13.372  1.00  26.79    A  C
ATOM  18108  O    ILE  G  120   -75.173  85.247  12.945  1.00  27.30    A  O
ATOM  18109  N    ALA  G  121   -74.351  83.769  14.349  1.00  25.47    A  N
ATOM  18110  CA   ALA  G  121   -73.536  84.702  15.049  1.00  24.90    A  C
ATOM  18111  CB   ALA  G  121   -72.856  83.999  16.160  1.00  23.81    A  C
ATOM  18112  C    ALA  G  121   -72.511  85.400  14.215  1.00  24.03    A  C
ATOM  18113  O    ALA  G  121   -72.358  86.551  14.329  1.00  23.45    A  O
ATOM  18114  N    VAL  G  122   -71.792  84.690  13.396  1.00  24.38    A  N
ATOM  18115  CA   VAL  G  122   -70.845  85.287  12.490  1.00  26.12    A  C
ATOM  18116  CB   VAL  G  122   -70.129  84.185  11.716  1.00  27.54    A  C
ATOM  18117  CG1  VAL  G  122   -69.490  84.669  10.489  1.00  22.80    A  C
ATOM  18118  CG2  VAL  G  122   -69.186  83.485  12.572  1.00  26.99    A  C
ATOM  18119  C    VAL  G  122   -71.543  86.180  11.498  1.00  26.73    A  C
ATOM  18120  O    VAL  G  122   -71.124  87.243  11.203  1.00  26.20    A  O
ATOM  18121  N    SER  G  123   -72.651  85.709  11.005  1.00  27.89    A  N
ATOM  18122  CA   SER  G  123   -73.411  86.398  10.035  1.00  28.29    A  C
ATOM  18123  CB   SER  G  123   -74.527  85.478   9.618  1.00  29.12    A  C
ATOM  18124  OG   SER  G  123   -75.504  86.165   8.919  1.00  33.80    A  O
ATOM  18125  C    SER  G  123   -73.949  87.698  10.567  1.00  28.36    A  C
ATOM  18126  O    SER  G  123   -73.915  88.694   9.901  1.00  28.69    A  O
ATOM  18127  N    LYS  G  124   -74.453  87.674  11.781  1.00  26.85    A  N
ATOM  18128  CA   LYS  G  124   -74.935  88.848  12.469  1.00  24.87    A  C
ATOM  18129  CB   LYS  G  124   -75.752  88.473  13.670  1.00  24.13    A  C
ATOM  18130  CG   LYS  G  124   -77.147  88.782  13.501  1.00  22.98    A  C
ATOM  18131  CD   LYS  G  124   -77.998  87.681  13.847  1.00  29.55    A  C
ATOM  18132  CE   LYS  G  124   -79.171  88.182  14.568  1.00  30.62    A  C
ATOM  18133  NZ   LYS  G  124   -80.147  88.737  13.656  1.00  30.20    A  N
ATOM  18134  C    LYS  G  124   -73.884  89.857  12.822  1.00  25.76    A  C
ATOM  18135  O    LYS  G  124   -74.132  91.026  12.851  1.00  26.36    A  O
ATOM  18136  N    MET  G  125   -72.707  89.361  13.113  1.00  24.85    A  N
ATOM  18137  CA   MET  G  125   -71.555  90.120  13.524  1.00  26.38    A  C
ATOM  18138  CB   MET  G  125   -70.454  89.143  13.889  1.00  26.33    G  C
ATOM  18139  CG   MET  G  125   -69.313  89.676  14.693  1.00  27.47    G  C
ATOM  18140  SD   MET  G  125   -69.671  90.351  16.285  1.00  28.07    G  S
ATOM  18141  CE   MET  G  125   -68.111  90.301  16.977  1.00  25.90    G  C
ATOM  18142  C    MET  G  125   -71.079  91.082  12.458  1.00  27.15    A  C
ATOM  18143  O    MET  G  125   -70.568  92.111  12.740  1.00  25.60    A  O
ATOM  18144  N    LYS  G  126   -71.311  90.709  11.221  1.00  28.38    A  N
ATOM  18145  CA   LYS  G  126   -70.916  91.445  10.063  1.00  29.81    A  C
ATOM  18146  CB   LYS  G  126   -70.680  90.492   8.922  1.00  28.59    A  C
ATOM  18147  CG   LYS  G  126   -69.478  89.669   9.071  1.00  33.43    A  C
ATOM  18148  CD   LYS  G  126   -69.512  88.482   8.201  1.00  36.82    A  C
ATOM  18149  CE   LYS  G  126   -69.042  88.811   6.848  1.00  39.61    A  C
ATOM  18150  NZ   LYS  G  126   -69.082  87.625   6.044  1.00  42.20    A  N
ATOM  18151  C    LYS  G  126   -71.908  92.482   9.637  1.00  30.47    A  C
ATOM  18152  O    LYS  G  126   -71.643  93.215   8.751  1.00  31.55    A  O
ATOM  18153  N    CYS  G  127   -73.060  92.528  10.259  1.00  30.44    A  N
ATOM  18154  CA   CYS  G  127   -74.070  93.480   9.909  1.00  30.81    A  C
ATOM  18155  CB   CYS  G  127   -75.392  93.102  10.537  1.00  31.75    A  C
ATOM  18156  SG   CYS  G  127   -76.296  91.852   9.724  1.00  36.10    A  S
ATOM  18157  C    CYS  G  127   -73.615  94.795  10.404  1.00  31.02    A  C
ATOM  18158  O    CYS  G  127   -72.968  94.850  11.388  1.00  33.05    A  O
ATOM  18159  N    LYS  G  128   -73.958  95.858   9.709  1.00  29.36    A  N
```

Appendix 1

```
ATOM  18160  CA   LYS G 128     -73.454  97.183   9.993  1.00 27.38     A    C
ATOM  18161  CB   LYS G 128     -73.815  98.137   8.894  1.00 26.74     A    C
ATOM  18162  CG   LYS G 128     -73.186  99.426   9.078  1.00 28.98     A    C
ATOM  18163  CD   LYS G 128     -72.839 100.043   7.821  1.00 32.51     A    C
ATOM  18164  CE   LYS G 128     -72.472 101.467   8.001  1.00 33.98     A    C
ATOM  18165  NZ   LYS G 128     -72.377 102.115   6.702  1.00 33.76     A    N
ATOM  18166  C    LYS G 128     -73.855  97.766  11.309  1.00 26.56     A    C
ATOM  18167  O    LYS G 128     -73.175  98.578  11.853  1.00 27.97     A    O
ATOM  18168  N    ARG G 129     -74.972  97.328  11.824  1.00 25.15     A    N
ATOM  18169  CA   ARG G 129     -75.456  97.758  13.100  1.00 23.88     A    C
ATOM  18170  CB   ARG G 129     -76.783  97.077  13.334  1.00 23.64     A    C
ATOM  18171  CG   ARG G 129     -77.373  97.220  14.660  1.00 24.57     A    C
ATOM  18172  CD   ARG G 129     -77.577  98.633  15.026  1.00 25.70     A    C
ATOM  18173  NE   ARG G 129     -78.267  98.735  16.274  1.00 28.67     A    N
ATOM  18174  CZ   ARG G 129     -78.385  99.834  16.980  1.00 32.99     A    C
ATOM  18175  NH1  ARG G 129     -77.880 100.948  16.567  1.00 36.19     A    N
ATOM  18176  NH2  ARG G 129     -79.026  99.820  18.107  1.00 33.84     A    N
ATOM  18177  C    ARG G 129     -74.472  97.404  14.184  1.00 24.32     A    C
ATOM  18178  O    ARG G 129     -74.267  98.151  15.085  1.00 25.12     A    O
ATOM  18179  N    VAL G 130     -73.886  96.236  14.098  1.00 24.07     A    N
ATOM  18180  CA   VAL G 130     -72.792  95.865  14.934  1.00 24.05     A    C
ATOM  18181  CB   VAL G 130     -72.556  94.373  14.804  1.00 22.62     A    C
ATOM  18182  CG1  VAL G 130     -71.397  93.940  15.532  1.00 20.90     A    C
ATOM  18183  CG2  VAL G 130     -73.680  93.664  15.287  1.00 25.81     A    C
ATOM  18184  C    VAL G 130     -71.471  96.625  14.759  1.00 25.85     A    C
ATOM  18185  O    VAL G 130     -70.908  97.047  15.708  1.00 26.95     A    O
ATOM  18186  N    TRP G 131     -70.972  96.796  13.557  1.00 25.11     A    N
ATOM  18187  CA   TRP G 131     -69.738  97.522  13.361  1.00 24.68     A    C
ATOM  18188  CB   TRP G 131     -68.845  96.770  12.400  1.00 25.70     A    C
ATOM  18189  CG   TRP G 131     -69.320  96.669  10.976  1.00 27.65     A    C
ATOM  18190  CD1  TRP G 131     -69.850  95.611  10.419  1.00 27.93     A    C
ATOM  18191  NE1  TRP G 131     -70.142  95.842   9.151  1.00 25.95     A    N
ATOM  18192  CE2  TRP G 131     -69.785  97.109   8.840  1.00 25.14     A    C
ATOM  18193  CD2  TRP G 131     -69.252  97.656   9.969  1.00 24.42     A    C
ATOM  18194  CE3  TRP G 131     -68.786  98.949   9.919  1.00 25.70     A    C
ATOM  18195  CZ3  TRP G 131     -68.884  99.613   8.782  1.00 29.63     A    C
ATOM  18196  CH2  TRP G 131     -69.413  99.039   7.663  1.00 26.10     A    C
ATOM  18197  CZ2  TRP G 131     -69.865  97.785   7.671  1.00 23.97     A    C
ATOM  18198  C    TRP G 131     -69.802  98.984  12.946  1.00 25.15     A    C
ATOM  18199  O    TRP G 131     -68.833  99.617  12.897  1.00 25.43     A    O
ATOM  18200  N    GLY G 132     -70.965  99.517  12.696  1.00 26.39     A    N
ATOM  18201  CA   GLY G 132     -71.111 100.741  11.953  1.00 28.38     A    C
ATOM  18202  C    GLY G 132     -70.607 101.842  12.784  1.00 29.44     A    C
ATOM  18203  O    GLY G 132     -70.497 102.972  12.448  1.00 30.73     A    O
ATOM  18204  N    ASP G 133     -70.273 101.377  13.929  1.00 31.04     A    N
ATOM  18205  CA   ASP G 133     -69.809 102.113  15.024  1.00 31.54     A    C
ATOM  18206  CB   ASP G 133     -69.573 100.992  16.020  1.00 31.78     A    C
ATOM  18207  CG   ASP G 133     -68.842 101.394  17.133  1.00 34.89     A    C
ATOM  18208  OD1  ASP G 133     -69.278 102.353  17.741  1.00 44.61     A    O
ATOM  18209  OD2  ASP G 133     -67.831 100.780  17.423  1.00 33.78     A    O-1
ATOM  18210  C    ASP G 133     -68.516 102.818  14.615  1.00 31.24     A    C
ATOM  18211  O    ASP G 133     -68.327 103.958  14.898  1.00 31.43     A    O
ATOM  18212  N    TRP G 134     -67.661 102.095  13.916  1.00 30.41     A    N
ATOM  18213  CA   TRP G 134     -66.411 102.553  13.383  1.00 30.69     A    C
```

Appendix 1

```
ATOM  18214  CB   TRP G 134     -65.739 101.333  12.771  1.00 28.85      A    C
ATOM  18215  CG   TRP G 134     -64.403 101.531  12.267  1.00 26.83      A    C
ATOM  18216  CD1  TRP G 134     -64.052 101.604  10.999  1.00 29.33      A    C
ATOM  18217  NE1  TRP G 134     -62.723 101.790  10.881  1.00 28.51      A    N
ATOM  18218  CE2  TRP G 134     -62.179 101.851  12.121  1.00 24.90      A    C
ATOM  18219  CD2  TRP G 134     -63.212 101.679  13.023  1.00 25.11      A    C
ATOM  18220  CE3  TRP G 134     -62.923 101.701  14.376  1.00 22.90      A    C
ATOM  18221  CZ3  TRP G 134     -61.659 101.868  14.752  1.00 23.04      A    C
ATOM  18222  CH2  TRP G 134     -60.652 102.026  13.832  1.00 24.93      A    C
ATOM  18223  CZ2  TRP G 134     -60.893 102.020  12.511  1.00 20.86      A    C
ATOM  18224  C    TRP G 134     -66.512 103.674  12.351  1.00 31.90      A    C
ATOM  18225  O    TRP G 134     -65.758 104.591  12.392  1.00 32.20      A    O
ATOM  18226  N    GLU G 135     -67.437 103.591  11.415  1.00 32.28      A    N
ATOM  18227  CA   GLU G 135     -67.702 104.680  10.508  1.00 33.73      A    C
ATOM  18228  CB   GLU G 135     -68.541 104.208   9.342  1.00 33.28      A    C
ATOM  18229  CG   GLU G 135     -68.703 105.214   8.289  1.00 37.83      A    C
ATOM  18230  CD   GLU G 135     -69.368 104.696   7.085  1.00 45.10      A    C
ATOM  18231  OE1  GLU G 135     -69.075 103.588   6.658  1.00 49.67      A    O
ATOM  18232  OE2  GLU G 135     -70.186 105.408   6.531  1.00 47.80      A    O-1
ATOM  18233  C    GLU G 135     -68.288 105.906  11.158  1.00 33.91      A    C
ATOM  18234  O    GLU G 135     -67.920 106.990  10.855  1.00 34.62      A    O
ATOM  18235  N    GLU G 136     -69.205 105.722  12.069  1.00 34.76      A    N
ATOM  18236  CA   GLU G 136     -69.871 106.821  12.720  1.00 37.06      A    C
ATOM  18237  CB   GLU G 136     -70.996 106.300  13.584  1.00 38.28      A    C
ATOM  18238  CG   GLU G 136     -72.299 106.970  13.341  1.00 46.60      A    C
ATOM  18239  CD   GLU G 136     -73.456 106.012  13.131  1.00 58.26      A    C
ATOM  18240  OE1  GLU G 136     -73.674 105.144  13.969  1.00 63.38      A    O
ATOM  18241  OE2  GLU G 136     -74.180 106.135  12.139  1.00 61.39      A    O-1
ATOM  18242  C    GLU G 136     -68.918 107.699  13.516  1.00 36.73      A    C
ATOM  18243  O    GLU G 136     -69.083 108.882  13.602  1.00 35.18      A    O
ATOM  18244  N    ASP G 137     -67.870 107.103  14.031  1.00 36.57      A    N
ATOM  18245  CA   ASP G 137     -66.876 107.822  14.772  1.00 35.60      A    C
ATOM  18246  CB   ASP G 137     -66.179 106.872  15.705  1.00 35.23      A    C
ATOM  18247  CG   ASP G 137     -66.995 106.547  16.890  1.00 36.73      A    C
ATOM  18248  OD1  ASP G 137     -68.061 107.113  17.057  1.00 36.88      A    O
ATOM  18249  OD2  ASP G 137     -66.578 105.733  17.671  1.00 37.83      A    O-1
ATOM  18250  C    ASP G 137     -65.872 108.509  13.879  1.00 36.29      A    C
ATOM  18251  O    ASP G 137     -65.035 109.222  14.341  1.00 35.53      A    O
ATOM  18252  N    GLY G 138     -65.969 108.282  12.586  1.00 36.23      A    N
ATOM  18253  CA   GLY G 138     -65.067 108.882  11.645  1.00 36.21      A    C
ATOM  18254  C    GLY G 138     -63.779 108.160  11.431  1.00 36.81      A    C
ATOM  18255  O    GLY G 138     -62.889 108.678  10.853  1.00 36.94      A    O
ATOM  18256  N    PHE G 139     -63.650 106.991  11.993  1.00 36.51      A    N
ATOM  18257  CA   PHE G 139     -62.500 106.171  11.737  1.00 37.35      A    C
ATOM  18258  CB   PHE G 139     -62.358 105.160  12.829  1.00 37.74      A    C
ATOM  18259  CG   PHE G 139     -62.277 105.750  14.172  1.00 38.35      A    C
ATOM  18260  CD1  PHE G 139     -61.296 106.622  14.485  1.00 37.73      A    C
ATOM  18261  CE1  PHE G 139     -61.222 107.136  15.714  1.00 39.99      A    C
ATOM  18262  CZ   PHE G 139     -62.121 106.786  16.638  1.00 36.47      A    C
ATOM  18263  CE2  PHE G 139     -63.097 105.949  16.338  1.00 33.50      A    C
ATOM  18264  CD2  PHE G 139     -63.173 105.420  15.128  1.00 35.46      A    C
ATOM  18265  C    PHE G 139     -62.317 105.502  10.391  1.00 37.86      A    C
ATOM  18266  O    PHE G 139     -61.233 105.377   9.949  1.00 38.39      A    O
ATOM  18267  N    GLY G 140     -63.360 104.937   9.827  1.00 37.52      A    N
```

Appendix 1

```
ATOM  18268  CA   GLY G 140     -63.274 104.311   8.538  1.00 37.47      A    C
ATOM  18269  C    GLY G 140     -64.548 103.819   7.890  1.00 38.43      A    C
ATOM  18270  O    GLY G 140     -65.549 103.650   8.506  1.00 38.73      A    O
ATOM  18271  N    THR G 141     -64.487 103.603   6.605  1.00 38.70      A    N
ATOM  18272  CA   THR G 141     -65.488 102.871   5.881  1.00 39.17      A    C
ATOM  18273  CB   THR G 141     -65.476 103.240   4.394  1.00 39.87      A    C
ATOM  18274  OG1  THR G 141     -66.639 103.997   4.114  1.00 40.50      A    O
ATOM  18275  CG2  THR G 141     -65.455 102.036   3.501  1.00 38.88      A    C
ATOM  18276  C    THR G 141     -65.479 101.387   6.154  1.00 38.90      A    C
ATOM  18277  O    THR G 141     -66.492 100.751   6.140  1.00 39.04      A    O
ATOM  18278  N    ASP G 142     -64.298 100.351   6.385  1.00 39.17      A    N
ATOM  18279  CA   ASP G 142     -64.092  99.425   6.527  1.00 37.92      A    C
ATOM  18280  CB   ASP G 142     -63.047  99.033   5.499  1.00 38.90      A    C
ATOM  18281  CG   ASP G 142     -62.604  97.643   5.630  1.00 42.57      A    C
ATOM  18282  OD1  ASP G 142     -62.081  97.282   6.660  1.00 45.84      A    O
ATOM  18283  OD2  ASP G 142     -62.774  96.903   4.697  1.00 43.91      A    O-1
ATOM  18284  C    ASP G 142     -63.613  99.012   7.904  1.00 34.98      A    C
ATOM  18285  O    ASP G 142     -62.563  99.380   8.297  1.00 35.00      A    O
ATOM  18286  N    PRO G 143     -64.392  98.223   8.616  1.00 33.95      A    N
ATOM  18287  CA   PRO G 143     -64.088  97.792   9.973  1.00 32.32      A    C
ATOM  18288  CB   PRO G 143     -65.339  97.069  10.384  1.00 30.85      A    C
ATOM  18289  CG   PRO G 143     -65.927  96.684   9.223  1.00 33.31      A    C
ATOM  18290  CD   PRO G 143     -65.617  97.591   8.150  1.00 33.46      A    C
ATOM  18291  C    PRO G 143     -62.880  96.917  10.180  1.00 32.89      A    C
ATOM  18292  O    PRO G 143     -62.316  96.975  11.217  1.00 33.09      A    O
ATOM  18293  N    ILE G 144     -62.515  96.088   9.231  1.00 34.73      A    N
ATOM  18294  CA   ILE G 144     -61.381  95.220   9.430  1.00 36.44      A    C
ATOM  18295  CB   ILE G 144     -61.664  93.803   8.979  1.00 37.23      A    C
ATOM  18296  CG1  ILE G 144     -61.638  93.717   7.467  1.00 38.08      A    C
ATOM  18297  CD1  ILE G 144     -61.243  92.428   6.991  1.00 37.17      A    C
ATOM  18298  CG2  ILE G 144     -62.942  93.347   9.498  1.00 35.10      A    C
ATOM  18299  C    ILE G 144     -60.047  95.563   8.817  1.00 37.27      A    C
ATOM  18300  O    ILE G 144     -59.111  94.900   9.065  1.00 37.44      A    O
ATOM  18301  N    GLU G 145     -59.962  96.559   7.979  1.00 38.87      A    N
ATOM  18302  CA   GLU G 145     -58.742  96.806   7.232  1.00 39.68      A    C
ATOM  18303  CB   GLU G 145     -59.054  97.899   6.236  1.00 41.19      A    C
ATOM  18304  CG   GLU G 145     -57.932  98.734   5.798  1.00 47.16      A    C
ATOM  18305  CD   GLU G 145     -58.387  99.853   4.932  1.00 56.16      A    C
ATOM  18306  OE1  GLU G 145     -58.252 101.005   5.330  1.00 58.67      A    O
ATOM  18307  OE2  GLU G 145     -58.886  99.590   3.844  1.00 59.60      A    O-1
ATOM  18308  C    GLU G 145     -57.539  97.169   8.067  1.00 39.14      A    C
ATOM  18309  O    GLU G 145     -56.454  96.686   7.879  1.00 39.72      A    O
ATOM  18310  N    LYS G 146     -57.765  98.053   8.999  1.00 39.13      A    N
ATOM  18311  CA   LYS G 146     -56.745  98.579   9.824  1.00 38.27      A    C
ATOM  18312  CB   LYS G 146     -56.502  99.967   9.322  1.00 38.74      A    C
ATOM  18313  CG   LYS G 146     -55.339 100.667   9.789  1.00 41.48      A    C
ATOM  18314  CD   LYS G 146     -55.667 102.086   9.633  1.00 44.21      A    C
ATOM  18315  CE   LYS G 146     -57.069 102.191   9.179  1.00 48.28      A    C
ATOM  18316  NZ   LYS G 146     -57.807 103.318   9.774  1.00 49.53      A    N
ATOM  18317  C    LYS G 146     -57.379  98.632  11.169  1.00 36.88      A    C
ATOM  18318  O    LYS G 146     -58.528  98.914  11.271  1.00 37.54      A    O
ATOM  18319  N    GLU G 147     -56.621  98.336  12.196  1.00 34.42      A    N
ATOM  18320  CA   GLU G 147     -56.966  98.617  13.562  1.00 34.12      A    C
ATOM  18321  CB   GLU G 147     -57.123 100.110  13.742  1.00 33.60      A    C
```

Appendix 1

```
ATOM  18322  CG   GLU G 147   -55.819 100.827  13.616  1.00 33.85      A  C
ATOM  18323  CD   GLU G 147   -55.929 102.274  13.260  1.00 37.55      A  C
ATOM  18324  OE1  GLU G 147   -54.928 102.962  13.350  1.00 38.06      A  O
ATOM  18325  OE2  GLU G 147   -56.987 102.744  12.891  1.00 40.28      A  O-1
ATOM  18326  C    GLU G 147   -58.170  97.856  14.037  1.00 34.34      A  C
ATOM  18327  O    GLU G 147   -58.368  96.764  13.611  1.00 36.10      A  O
ATOM  18328  N    ASN G 148   -58.945  98.427  14.941  1.00 32.20      A  N
ATOM  18329  CA   ASN G 148   -60.249  97.934  15.318  1.00 29.88      A  C
ATOM  18330  CB   ASN G 148   -61.199  98.126  14.161  1.00 30.34      A  C
ATOM  18331  CG   ASN G 148   -62.628  97.999  14.547  1.00 30.73      A  C
ATOM  18332  OD1  ASN G 148   -62.954  98.019  15.674  1.00 35.10      A  O
ATOM  18333  ND2  ASN G 148   -63.475  97.905  13.600  1.00 26.60      A  N
ATOM  18334  C    ASN G 148   -60.335  96.516  15.777  1.00 29.60      A  C
ATOM  18335  O    ASN G 148   -61.250  95.856  15.414  1.00 27.82      A  O
ATOM  18336  N    ILE G 149   -59.393  96.060  16.578  1.00 29.41      A  N
ATOM  18337  CA   ILE G 149   -59.367  94.686  17.009  1.00 29.98      A  C
ATOM  18338  CB   ILE G 149   -58.040  94.176  17.553  1.00 30.26      A  C
ATOM  18339  CG1  ILE G 149   -57.208  95.272  18.160  1.00 28.81      A  C
ATOM  18340  CD1  ILE G 149   -57.111  95.159  19.641  1.00 33.59      A  C
ATOM  18341  CG2  ILE G 149   -57.335  93.389  16.522  1.00 31.51      A  C
ATOM  18342  C    ILE G 149   -60.370  94.466  18.057  1.00 29.55      A  C
ATOM  18343  O    ILE G 149   -60.559  93.395  18.483  1.00 30.64      A  O
ATOM  18344  N    MET G 150   -61.003  95.514  18.488  1.00 30.18      A  N
ATOM  18345  CA   MET G 150   -62.083  95.298  19.356  1.00 31.08      A  C
ATOM  18346  CB   MET G 150   -62.659  96.632  19.793  1.00 32.87      G  C
ATOM  18347  CG   MET G 150   -62.472  97.793  18.844  1.00 36.21      G  C
ATOM  18348  SD   MET G 150   -63.247  99.341  19.343  1.00 50.98      G  S
ATOM  18349  CE   MET G 150   -64.728  99.370  18.403  1.00 47.62      G  C
ATOM  18350  C    MET G 150   -63.090  94.558  18.555  1.00 30.11      A  C
ATOM  18351  O    MET G 150   -63.610  93.573  18.970  1.00 31.28      A  O
ATOM  18352  N    TYR G 151   -63.418  95.059  17.394  1.00 28.47      A  N
ATOM  18353  CA   TYR G 151   -64.288  94.314  16.533  1.00 26.71      A  C
ATOM  18354  CB   TYR G 151   -64.827  95.263  15.499  1.00 26.41      A  C
ATOM  18355  CG   TYR G 151   -65.671  94.602  14.504  1.00 27.81      A  C
ATOM  18356  CD1  TYR G 151   -66.921  94.188  14.828  1.00 25.13      A  C
ATOM  18357  CE1  TYR G 151   -67.670  93.588  13.948  1.00 26.14      A  C
ATOM  18358  CZ   TYR G 151   -67.187  93.373  12.703  1.00 27.41      A  C
ATOM  18359  OH   TYR G 151   -67.936  92.760  11.779  1.00 25.82      A  O
ATOM  18360  CE2  TYR G 151   -65.960  93.768  12.360  1.00 26.83      A  C
ATOM  18361  CD2  TYR G 151   -65.215  94.379  13.243  1.00 25.71      A  C
ATOM  18362  C    TYR G 151   -63.718  93.077  15.848  1.00 26.32      A  C
ATOM  18363  O    TYR G 151   -64.223  92.015  15.969  1.00 25.41      A  O
ATOM  18364  N    LYS G 152   -62.644  93.262  15.131  1.00 26.73      A  N
ATOM  18365  CA   LYS G 152   -62.061  92.252  14.300  1.00 28.67      A  C
ATOM  18366  CB   LYS G 152   -61.209  92.833  13.175  1.00 28.90      A  C
ATOM  18367  CG   LYS G 152   -59.823  93.104  13.463  1.00 28.78      A  C
ATOM  18368  CD   LYS G 152   -59.440  94.275  12.658  1.00 28.13      A  C
ATOM  18369  CE   LYS G 152   -58.090  94.158  12.105  1.00 28.59      A  C
ATOM  18370  NZ   LYS G 152   -57.553  95.444  11.829  1.00 31.80      A  N
ATOM  18371  C    LYS G 152   -61.451  91.062  14.960  1.00 27.85      A  C
ATOM  18372  O    LYS G 152   -61.399  90.045  14.386  1.00 29.63      A  O
ATOM  18373  N    GLY G 153   -60.982  91.190  16.167  1.00 26.79      A  N
ATOM  18374  CA   GLY G 153   -60.548  90.025  16.877  1.00 25.34      A  C
ATOM  18375  C    GLY G 153   -61.607  89.025  17.226  1.00 25.85      A  C
```

Appendix 1

```
ATOM  18376  O    GLY G 153     -61.390  87.856  17.136  1.00  27.73   A  O
ATOM  18377  N    HIS G 154     -62.744  89.509  17.669  1.00  25.31   A  N
ATOM  18378  CA   HIS G 154     -63.858  88.668  17.989  1.00  25.59   A  C
ATOM  18379  CB   HIS G 154     -64.955  89.483  18.638  1.00  24.80   A  C
ATOM  18380  CG   HIS G 154     -64.693  89.778  20.062  1.00  28.04   A  C
ATOM  18381  ND1  HIS G 154     -64.493  88.795  20.988  1.00  29.67   A  N
ATOM  18382  CE1  HIS G 154     -64.245  89.339  22.155  1.00  30.17   A  C
ATOM  18383  NE2  HIS G 154     -64.275  90.638  22.016  1.00  31.32   A  N
ATOM  18384  CD2  HIS G 154     -64.554  90.939  20.719  1.00  31.36   A  C
ATOM  18385  C    HIS G 154     -64.383  87.953  16.806  1.00  25.59   A  C
ATOM  18386  O    HIS G 154     -64.720  86.820  16.887  1.00  24.69   A  O
ATOM  18387  N    LEU G 155     -64.458  88.646  15.694  1.00  26.12   A  N
ATOM  18388  CA   LEU G 155     -64.906  88.043  14.484  1.00  26.67   A  C
ATOM  18389  CB   LEU G 155     -65.091  89.096  13.412  1.00  25.90   A  C
ATOM  18390  CG   LEU G 155     -65.554  88.652  12.050  1.00  23.54   A  C
ATOM  18391  CD1  LEU G 155     -66.852  88.026  12.120  1.00  22.96   A  C
ATOM  18392  CD2  LEU G 155     -65.566  89.793  11.161  1.00  19.61   A  C
ATOM  18393  C    LEU G 155     -63.996  86.940  14.016  1.00  27.44   A  C
ATOM  18394  O    LEU G 155     -64.457  85.916  13.633  1.00  27.67   A  O
ATOM  18395  N    ASN G 156     -62.705  87.152  14.055  1.00  27.35   A  N
ATOM  18396  CA   ASN G 156     -61.777  86.110  13.733  1.00  28.59   A  C
ATOM  18397  CB   ASN G 156     -60.373  86.649  13.625  1.00  30.27   A  C
ATOM  18398  CG   ASN G 156     -59.554  85.877  12.671  1.00  30.55   A  C
ATOM  18399  OD1  ASN G 156     -59.969  85.637  11.585  1.00  33.71   A  O
ATOM  18400  ND2  ASN G 156     -58.418  85.447  13.083  1.00  25.46   A  N
ATOM  18401  C    ASN G 156     -61.825  84.952  14.681  1.00  28.37   A  C
ATOM  18402  O    ASN G 156     -61.619  83.848  14.314  1.00  29.33   A  O
ATOM  18403  N    LEU G 157     -62.039  85.222  15.941  1.00  27.90   A  N
ATOM  18404  CA   LEU G 157     -62.154  84.159  16.886  1.00  26.45   A  C
ATOM  18405  CB   LEU G 157     -62.127  84.654  18.314  1.00  26.07   A  C
ATOM  18406  CG   LEU G 157     -62.066  83.535  19.319  1.00  25.63   A  C
ATOM  18407  CD1  LEU G 157     -60.970  82.640  19.045  1.00  22.94   A  C
ATOM  18408  CD2  LEU G 157     -61.984  83.999  20.667  1.00  22.66   A  C
ATOM  18409  C    LEU G 157     -63.364  83.349  16.620  1.00  26.61   A  C
ATOM  18410  O    LEU G 157     -63.325  82.177  16.720  1.00  28.06   A  O
ATOM  18411  N    MET G 158     -64.445  84.011  16.284  1.00  25.59   A  N
ATOM  18412  CA   MET G 158     -65.682  83.395  15.886  1.00  25.73   A  C
ATOM  18413  CB   MET G 158     -66.780  84.441  15.773  1.00  26.03   G  C
ATOM  18414  CG   MET G 158     -67.235  85.024  17.067  1.00  27.33   G  C
ATOM  18415  SD   MET G 158     -68.199  86.492  16.977  1.00  30.58   G  S
ATOM  18416  CE   MET G 158     -69.549  85.961  16.060  1.00  35.98   G  C
ATOM  18417  C    MET G 158     -65.571  82.589  14.598  1.00  25.94   A  C
ATOM  18418  O    MET G 158     -66.066  81.528  14.524  1.00  27.70   A  O
ATOM  18419  N    TYR G 159     -64.858  83.065  13.607  1.00  25.59   A  N
ATOM  18420  CA   TYR G 159     -64.748  82.330  12.384  1.00  24.86   A  C
ATOM  18421  CB   TYR G 159     -63.791  83.001  11.434  1.00  24.71   A  C
ATOM  18422  CG   TYR G 159     -64.314  84.097  10.588  1.00  23.71   A  C
ATOM  18423  CD1  TYR G 159     -65.579  84.093  10.115  1.00  24.04   A  C
ATOM  18424  CE1  TYR G 159     -66.024  85.096   9.346  1.00  20.94   A  C
ATOM  18425  CZ   TYR G 159     -65.222  86.101   9.032  1.00  23.19   A  C
ATOM  18426  OH   TYR G 159     -65.682  87.090   8.268  1.00  27.96   A  O
ATOM  18427  CE2  TYR G 159     -63.972  86.138   9.497  1.00  25.07   A  C
ATOM  18428  CD2  TYR G 159     -63.525  85.152  10.261  1.00  25.43   A  C
ATOM  18429  C    TYR G 159     -64.129  81.027  12.702  1.00  25.41   A  C
```

Appendix 1

```
ATOM  18430  O    TYR G 159    -64.531  80.041  12.182  1.00  23.92    A  O
ATOM  18431  N    GLY G 160    -63.100  81.027  13.515  1.00  25.98    A  N
ATOM  18432  CA   GLY G 160    -62.459  79.801  13.897  1.00  27.80    A  C
ATOM  18433  C    GLY G 160    -63.300  78.838  14.698  1.00  29.28    A  C
ATOM  18434  O    GLY G 160    -63.265  77.668  14.508  1.00  30.03    A  O
ATOM  18435  N    LEU G 161    -64.040  79.358  15.634  1.00  28.94    A  N
ATOM  18436  CA   LEU G 161    -64.854  78.541  16.462  1.00  29.88    A  C
ATOM  18437  CB   LEU G 161    -65.340  79.318  17.658  1.00  30.37    A  C
ATOM  18438  CG   LEU G 161    -64.221  79.637  18.618  1.00  31.41    A  C
ATOM  18439  CD1  LEU G 161    -64.634  80.696  19.484  1.00  34.91    A  C
ATOM  18440  CD2  LEU G 161    -63.894  78.484  19.412  1.00  30.15    A  C
ATOM  18441  C    LEU G 161    -65.958  77.883  15.716  1.00  29.40    A  C
ATOM  18442  O    LEU G 161    -66.331  76.795  15.998  1.00  27.69    A  O
ATOM  18443  N    TYR G 162    -66.484  78.580  14.752  1.00  29.75    A  N
ATOM  18444  CA   TYR G 162    -67.420  77.988  13.888  1.00  31.59    A  C
ATOM  18445  CB   TYR G 162    -67.922  79.043  12.933  1.00  31.41    A  C
ATOM  18446  CG   TYR G 162    -68.740  78.495  11.833  1.00  31.63    A  C
ATOM  18447  CD1  TYR G 162    -69.977  77.983  12.072  1.00  30.09    A  C
ATOM  18448  CE1  TYR G 162    -70.704  77.480  11.094  1.00  29.94    A  C
ATOM  18449  CZ   TYR G 162    -70.220  77.459   9.850  1.00  31.63    A  C
ATOM  18450  OH   TYR G 162    -70.961  76.946   8.859  1.00  35.15    A  O
ATOM  18451  CE2  TYR G 162    -69.005  77.936   9.586  1.00  30.24    A  C
ATOM  18452  CD2  TYR G 162    -68.271  78.454  10.565  1.00  31.91    A  C
ATOM  18453  C    TYR G 162    -66.832  76.847  13.103  1.00  32.51    A  C
ATOM  18454  O    TYR G 162    -67.431  75.823  13.000  1.00  34.34    A  O
ATOM  18455  N    GLN G 163    -65.663  77.011  12.535  1.00  33.22    A  N
ATOM  18456  CA   GLN G 163    -65.097  75.929  11.772  1.00  34.34    A  C
ATOM  18457  CB   GLN G 163    -63.918  76.383  10.924  1.00  33.07    A  C
ATOM  18458  CG   GLN G 163    -63.492  75.389   9.934  1.00  33.36    A  C
ATOM  18459  CD   GLN G 163    -62.589  75.929   8.877  1.00  37.87    A  C
ATOM  18460  OE1  GLN G 163    -62.853  76.930   8.273  1.00  40.23    A  O
ATOM  18461  NE2  GLN G 163    -61.544  75.220   8.611  1.00  37.46    A  N
ATOM  18462  C    GLN G 163    -64.786  74.708  12.629  1.00  34.99    A  C
ATOM  18463  O    GLN G 163    -64.976  73.595  12.211  1.00  35.81    A  O
ATOM  18464  N    LEU G 164    -64.317  74.927  13.834  1.00  36.12    A  N
ATOM  18465  CA   LEU G 164    -64.017  73.852  14.743  1.00  37.03    A  C
ATOM  18466  CB   LEU G 164    -63.452  74.434  16.014  1.00  36.96    A  C
ATOM  18467  CG   LEU G 164    -62.016  74.176  16.403  1.00  39.83    A  C
ATOM  18468  CD1  LEU G 164    -61.178  73.844  15.239  1.00  36.48    A  C
ATOM  18469  CD2  LEU G 164    -61.497  75.356  17.115  1.00  38.18    A  C
ATOM  18470  C    LEU G 164    -65.223  73.038  15.119  1.00  38.31    A  C
ATOM  18471  O    LEU G 164    -65.150  71.850  15.228  1.00  37.94    A  O
ATOM  18472  N    VAL G 165    -66.316  73.719  15.386  1.00  39.63    A  N
ATOM  18473  CA   VAL G 165    -67.557  73.109  15.754  1.00  39.45    A  C
ATOM  18474  CB   VAL G 165    -68.459  74.162  16.255  1.00  39.58    A  C
ATOM  18475  CG1  VAL G 165    -69.687  73.578  16.836  1.00  37.02    A  C
ATOM  18476  CG2  VAL G 165    -67.737  74.912  17.277  1.00  40.64    A  C
ATOM  18477  C    VAL G 165    -68.182  72.315  14.649  1.00  40.06    A  C
ATOM  18478  O    VAL G 165    -68.630  71.226  14.827  1.00  39.50    A  O
ATOM  18479  N    THR G 166    -68.178  72.912  13.495  1.00  40.93    A  N
ATOM  18480  CA   THR G 166    -68.833  72.397  12.342  1.00  41.25    A  C
ATOM  18481  CB   THR G 166    -69.619  73.496  11.649  1.00  41.50    A  C
ATOM  18482  OG1  THR G 166    -68.715  74.462  11.149  1.00  38.95    A  O
ATOM  18483  CG2  THR G 166    -70.548  74.170  12.592  1.00  37.94    A  C
```

Appendix 1

```
ATOM  18484  C    THR G 166   -67.785  71.941  11.388  1.00  42.96   A  C
ATOM  18485  O    THR G 166   -66.627  72.233  11.528  1.00  44.28   A  O
ATOM  18486  N    GLY G 167   -68.183  71.229  10.379  1.00  42.74   A  N
ATOM  18487  CA   GLY G 167   -67.268  70.989   9.303  1.00  42.40   A  C
ATOM  18488  C    GLY G 167   -66.835  72.214   8.544  1.00  40.82   A  C
ATOM  18489  O    GLY G 167   -65.774  72.269   8.034  1.00  41.37   A  O
ATOM  18490  N    SER G 168   -67.701  73.192   8.473  1.00  39.03   A  N
ATOM  18491  CA   SER G 168   -67.858  74.056   7.348  1.00  37.39   A  C
ATOM  18492  CB   SER G 168   -69.063  74.931   7.575  1.00  37.58   A  C
ATOM  18493  OG   SER G 168   -69.512  75.470   6.382  1.00  37.42   A  O
ATOM  18494  C    SER G 168   -66.681  74.894   6.975  1.00  36.78   A  C
ATOM  18495  O    SER G 168   -66.039  75.421   7.798  1.00  36.29   A  O
ATOM  18496  N    ARG G 169   -66.449  75.006   5.679  1.00  36.35   A  N
ATOM  18497  CA   ARG G 169   -65.419  75.820   5.063  1.00  36.22   A  C
ATOM  18498  CB   ARG G 169   -64.679  75.051   3.990  1.00  37.53   A  C
ATOM  18499  CG   ARG G 169   -63.549  74.252   4.545  1.00  44.02   A  C
ATOM  18500  CD   ARG G 169   -62.959  73.267   3.579  1.00  52.80   A  C
ATOM  18501  NE   ARG G 169   -62.473  72.081   4.264  1.00  59.33   A  N
ATOM  18502  CZ   ARG G 169   -61.234  71.903   4.702  1.00  62.99   A  C
ATOM  18503  NH1  ARG G 169   -60.312  72.827   4.538  1.00  63.86   A  N
ATOM  18504  NH2  ARG G 169   -60.908  70.784   5.307  1.00  63.36   A  N
ATOM  18505  C    ARG G 169   -66.054  77.060   4.518  1.00  34.77   A  C
ATOM  18506  O    ARG G 169   -65.518  77.777   3.756  1.00  34.46   A  O
ATOM  18507  N    ARG G 170   -67.226  77.321   5.000  1.00  34.04   A  N
ATOM  18508  CA   ARG G 170   -68.028  78.417   4.589  1.00  34.45   A  C
ATOM  18509  CB   ARG G 170   -69.297  78.278   5.356  1.00  35.20   A  C
ATOM  18510  CG   ARG G 170   -69.888  79.504   5.708  1.00  36.29   A  C
ATOM  18511  CD   ARG G 170   -71.301  79.331   5.810  1.00  39.51   A  C
ATOM  18512  NE   ARG G 170   -71.872  80.527   5.307  1.00  42.30   A  N
ATOM  18513  CZ   ARG G 170   -73.143  80.792   5.311  1.00  44.03   A  C
ATOM  18514  NH1  ARG G 170   -73.960  79.923   5.805  1.00  48.00   A  N
ATOM  18515  NH2  ARG G 170   -73.574  81.923   4.817  1.00  44.82   A  N
ATOM  18516  C    ARG G 170   -67.489  79.818   4.796  1.00  35.27   A  C
ATOM  18517  O    ARG G 170   -67.665  80.663   3.972  1.00  35.27   A  O
ATOM  18518  N    TYR G 171   -66.852  80.072   5.917  1.00  35.75   A  N
ATOM  18519  CA   TYR G 171   -66.248  81.359   6.166  1.00  36.72   A  C
ATOM  18520  CB   TYR G 171   -66.639  81.915   7.530  1.00  35.80   A  C
ATOM  18521  CG   TYR G 171   -68.097  82.061   7.723  1.00  34.03   A  C
ATOM  18522  CD1  TYR G 171   -68.786  83.014   7.067  1.00  32.51   A  C
ATOM  18523  CE1  TYR G 171   -70.086  83.142   7.216  1.00  32.82   A  C
ATOM  18524  CZ   TYR G 171   -70.742  82.326   8.035  1.00  35.68   A  C
ATOM  18525  OH   TYR G 171   -72.060  82.445   8.177  1.00  34.58   A  O
ATOM  18526  CE2  TYR G 171   -70.090  81.366   8.704  1.00  33.85   A  C
ATOM  18527  CD2  TYR G 171   -68.778  81.235   8.541  1.00  33.15   A  C
ATOM  18528  C    TYR G 171   -64.750  81.304   6.049  1.00  38.11   A  C
ATOM  18529  O    TYR G 171   -64.093  82.215   6.433  1.00  38.50   A  O
ATOM  18530  N    GLU G 172   -64.229  80.224   5.504  1.00  39.23   A  N
ATOM  18531  CA   GLU G 172   -62.822  79.943   5.494  1.00  41.32   A  C
ATOM  18532  CB   GLU G 172   -62.572  78.545   4.920  1.00  42.53   A  C
ATOM  18533  CG   GLU G 172   -61.109  78.211   4.793  1.00  44.99   A  C
ATOM  18534  CD   GLU G 172   -60.783  76.772   4.652  1.00  46.88   A  C
ATOM  18535  OE1  GLU G 172   -60.495  76.362   3.553  1.00  49.88   A  O
ATOM  18536  OE2  GLU G 172   -60.733  76.049   5.628  1.00  48.37   A  O-1
ATOM  18537  C    GLU G 172   -61.957  80.925   4.756  1.00  41.66   A  C
```

Appendix 1

```
ATOM  18538  O    GLU G 172     -60.886  81.238   5.200  1.00 43.04      A  O
ATOM  18539  N    ALA G 173     -62.385  81.352   3.593  1.00 40.89      A  N
ATOM  18540  CA   ALA G 173     -61.667  82.352   2.844  1.00 40.50      A  C
ATOM  18541  CB   ALA G 173     -62.239  82.476   1.518  1.00 39.83      A  C
ATOM  18542  C    ALA G 173     -61.640  83.694   3.518  1.00 40.87      A  C
ATOM  18543  O    ALA G 173     -60.691  84.398   3.417  1.00 41.02      A  O
ATOM  18544  N    GLU G 174     -62.745  84.061   4.133  1.00 41.47      A  N
ATOM  18545  CA   GLU G 174     -62.889  85.274   4.901  1.00 41.79      A  C
ATOM  18546  CB   GLU G 174     -64.322  85.362   5.387  1.00 41.70      A  C
ATOM  18547  CG   GLU G 174     -65.239  86.161   4.543  1.00 46.37      A  C
ATOM  18548  CD   GLU G 174     -66.694  85.869   4.798  1.00 49.88      A  C
ATOM  18549  OE1  GLU G 174     -67.536  86.203   3.970  1.00 48.88      A  O
ATOM  18550  OE2  GLU G 174     -67.007  85.307   5.822  1.00 52.66      A  O-1
ATOM  18551  C    GLU G 174     -61.983  85.282   6.116  1.00 40.90      A  C
ATOM  18552  O    GLU G 174     -61.402  86.278   6.441  1.00 41.12      A  O
ATOM  18553  N    HIS G 175     -61.939  84.148   6.788  1.00 38.99      A  N
ATOM  18554  CA   HIS G 175     -61.141  83.864   7.953  1.00 38.14      A  C
ATOM  18555  CB   HIS G 175     -61.507  82.451   8.360  1.00 37.49      A  C
ATOM  18556  CG   HIS G 175     -60.919  82.002   9.651  1.00 35.01      A  C
ATOM  18557  ND1  HIS G 175     -61.054  80.725  10.122  1.00 29.52      A  N
ATOM  18558  CE1  HIS G 175     -60.429  80.612  11.266  1.00 25.87      A  C
ATOM  18559  NE2  HIS G 175     -59.899  81.770  11.555  1.00 25.57      A  N
ATOM  18560  CD2  HIS G 175     -60.194  82.657  10.566  1.00 29.20      A  C
ATOM  18561  C    HIS G 175     -59.652  83.922   7.730  1.00 38.76      A  C
ATOM  18562  O    HIS G 175     -58.943  84.501   8.492  1.00 39.34      A  O
ATOM  18563  N    ALA G 176     -59.169  83.307   6.677  1.00 37.90      A  N
ATOM  18564  CA   ALA G 176     -57.760  83.338   6.362  1.00 36.99      A  C
ATOM  18565  CB   ALA G 176     -57.484  82.457   5.240  1.00 36.62      A  C
ATOM  18566  C    ALA G 176     -57.278  84.726   6.055  1.00 36.37      A  C
ATOM  18567  O    ALA G 176     -56.202  85.100   6.418  1.00 36.24      A  O
ATOM  18568  N    HIS G 177     -58.103  85.471   5.360  1.00 34.67      A  N
ATOM  18569  CA   HIS G 177     -57.856  86.841   5.054  1.00 34.12      A  C
ATOM  18570  CB   HIS G 177     -58.943  87.282   4.088  1.00 34.45      A  C
ATOM  18571  CG   HIS G 177     -58.938  88.737   3.803  1.00 36.18      A  C
ATOM  18572  ND1  HIS G 177     -57.970  89.335   3.048  1.00 37.13      A  N
ATOM  18573  CE1  HIS G 177     -58.195  90.624   2.989  1.00 37.86      A  C
ATOM  18574  NE2  HIS G 177     -59.283  90.880   3.673  1.00 37.88      A  N
ATOM  18575  CD2  HIS G 177     -59.765  89.717   4.192  1.00 36.20      A  C
ATOM  18576  C    HIS G 177     -57.805  87.783   6.256  1.00 33.52      A  C
ATOM  18577  O    HIS G 177     -56.950  88.614   6.334  1.00 33.47      A  O
ATOM  18578  N    LEU G 178     -58.748  87.664   7.168  1.00 32.37      A  N
ATOM  18579  CA   LEU G 178     -58.751  88.429   8.390  1.00 31.83      A  C
ATOM  18580  CB   LEU G 178     -60.036  88.191   9.159  1.00 32.14      A  C
ATOM  18581  CG   LEU G 178     -60.274  88.934  10.455  1.00 30.77      A  C
ATOM  18582  CD1  LEU G 178     -59.980  90.354  10.303  1.00 31.13      A  C
ATOM  18583  CD2  LEU G 178     -61.618  88.745  10.952  1.00 26.90      A  C
ATOM  18584  C    LEU G 178     -57.579  88.076   9.248  1.00 32.01      A  C
ATOM  18585  O    LEU G 178     -56.955  88.911   9.817  1.00 30.70      A  O
ATOM  18586  N    THR G 179     -57.276  86.806   9.294  1.00 31.20      A  N
ATOM  18587  CA   THR G 179     -56.163  86.306  10.021  1.00 31.23      A  C
ATOM  18588  CB   THR G 179     -56.172  84.838   9.958  1.00 31.31      A  C
ATOM  18589  OG1  THR G 179     -57.294  84.380  10.666  1.00 27.58      A  O
ATOM  18590  CG2  THR G 179     -54.966  84.296  10.560  1.00 32.39      A  C
ATOM  18591  C    THR G 179     -54.856  86.835   9.497  1.00 32.17      A  C
```

Appendix 1

```
ATOM  18592  O    THR G 179     -53.942  87.026  10.232  1.00 32.93      A    O
ATOM  18593  N    ARG G 180     -54.765  87.003   8.203  1.00 31.98      A    N
ATOM  18594  CA   ARG G 180     -53.603  87.595   7.603  1.00 32.79      A    C
ATOM  18595  CB   ARG G 180     -53.579  87.400   6.107  1.00 33.43      A    C
ATOM  18596  CG   ARG G 180     -53.162  86.044   5.695  1.00 36.69      A    C
ATOM  18597  CD   ARG G 180     -52.897  85.970   4.239  1.00 43.31      A    C
ATOM  18598  NE   ARG G 180     -54.111  86.161   3.486  1.00 46.12      A    N
ATOM  18599  CZ   ARG G 180     -54.841  85.164   3.044  1.00 49.60      A    C
ATOM  18600  NH1  ARG G 180     -54.433  83.934   3.272  1.00 49.02      A    N
ATOM  18601  NH2  ARG G 180     -55.951  85.391   2.374  1.00 41.44      A    N
ATOM  18602  C    ARG G 180     -53.456  89.025   7.960  1.00 32.49      A    C
ATOM  18603  O    ARG G 180     -52.398  89.527   8.053  1.00 32.05      A    O
ATOM  18604  N    ILE G 181     -54.562  89.704   8.066  1.00 32.72      A    N
ATOM  18605  CA   ILE G 181     -54.530  91.082   8.402  1.00 31.33      A    C
ATOM  18606  CB   ILE G 181     -55.897  91.690   8.267  1.00 31.58      A    C
ATOM  18607  CG1  ILE G 181     -56.221  91.889   6.812  1.00 31.61      A    C
ATOM  18608  CD1  ILE G 181     -57.638  92.105   6.534  1.00 31.10      A    C
ATOM  18609  CG2  ILE G 181     -55.939  92.996   8.914  1.00 27.33      A    C
ATOM  18610  C    ILE G 181     -54.014  91.258   9.793  1.00 31.34      A    C
ATOM  18611  O    ILE G 181     -53.240  92.121  10.040  1.00 31.24      A    O
ATOM  18612  N    ILE G 182     -54.480  90.432  10.704  1.00 29.61      A    N
ATOM  18613  CA   ILE G 182     -54.088  90.556  12.068  1.00 29.21      A    C
ATOM  18614  CB   ILE G 182     -54.930  89.622  12.948  1.00 28.53      A    C
ATOM  18615  CG1  ILE G 182     -56.306  90.224  13.119  1.00 23.67      A    C
ATOM  18616  CD1  ILE G 182     -57.290  89.376  13.746  1.00 18.06      A    C
ATOM  18617  CG2  ILE G 182     -54.332  89.454  14.276  1.00 24.81      A    C
ATOM  18618  C    ILE G 182     -52.603  90.314  12.190  1.00 32.02      A    C
ATOM  18619  O    ILE G 182     -51.899  91.064  12.785  1.00 32.93      A    O
ATOM  18620  N    HIS G 183     -52.135  89.263  11.571  1.00 33.80      A    N
ATOM  18621  CA   HIS G 183     -50.760  88.922  11.570  1.00 35.25      A    C
ATOM  18622  CB   HIS G 183     -50.602  87.625  10.830  1.00 36.46      A    C
ATOM  18623  CG   HIS G 183     -49.190  87.262  10.546  1.00 39.19      A    C
ATOM  18624  ND1  HIS G 183     -48.536  87.675   9.420  1.00 42.49      A    N
ATOM  18625  CE1  HIS G 183     -47.310  87.211   9.431  1.00 45.41      A    C
ATOM  18626  NE2  HIS G 183     -47.143  86.518  10.530  1.00 41.53      A    N
ATOM  18627  CD2  HIS G 183     -48.303  86.536  11.246  1.00 41.33      A    C
ATOM  18628  C    HIS G 183     -49.917  89.963  10.917  1.00 36.66      A    C
ATOM  18629  O    HIS G 183     -48.894  90.289  11.411  1.00 38.81      A    O
ATOM  18630  N    ASP G 184     -50.314  90.490   9.789  1.00 36.77      A    N
ATOM  18631  CA   ASP G 184     -49.494  91.498   9.198  1.00 37.32      A    C
ATOM  18632  CB   ASP G 184     -49.960  91.849   7.782  1.00 37.21      A    C
ATOM  18633  CG   ASP G 184     -49.907  90.673   6.795  1.00 37.24      A    C
ATOM  18634  OD1  ASP G 184     -49.343  89.627   7.070  1.00 34.74      A    O
ATOM  18635  OD2  ASP G 184     -50.445  90.810   5.710  1.00 36.51      A    O-1
ATOM  18636  C    ASP G 184     -49.420  92.723  10.091  1.00 39.26      A    C
ATOM  18637  O    ASP G 184     -48.390  93.257  10.273  1.00 40.13      A    O
ATOM  18638  N    GLU G 185     -50.507  93.150  10.693  1.00 39.47      A    N
ATOM  18639  CA   GLU G 185     -50.505  94.329  11.552  1.00 39.90      A    C
ATOM  18640  CB   GLU G 185     -51.897  94.643  12.023  1.00 39.46      A    C
ATOM  18641  CG   GLU G 185     -52.553  95.646  11.224  1.00 44.30      A    C
ATOM  18642  CD   GLU G 185     -53.722  96.241  11.899  1.00 48.44      A    C
ATOM  18643  OE1  GLU G 185     -54.811  95.710  11.743  1.00 47.80      A    O
ATOM  18644  OE2  GLU G 185     -53.567  97.264  12.551  1.00 50.32      A    O-1
ATOM  18645  C    GLU G 185     -49.638  94.218  12.771  1.00 39.24      A    C
```

Appendix 1

```
ATOM  18646  O    GLU G 185     -49.005  95.152  13.142  1.00 38.97      A    O
ATOM  18647  N    ILE G 186     -49.634  93.057  13.392  1.00 38.49      A    N
ATOM  18648  CA   ILE G 186     -48.795  92.795  14.513  1.00 39.16      A    C
ATOM  18649  CB   ILE G 186     -49.052  91.395  15.019  1.00 39.22      A    C
ATOM  18650  CG1  ILE G 186     -50.392  91.313  15.695  1.00 37.38      A    C
ATOM  18651  CD1  ILE G 186     -50.793  89.940  15.991  1.00 36.04      A    C
ATOM  18652  CG2  ILE G 186     -48.058  90.989  16.000  1.00 40.07      A    C
ATOM  18653  C    ILE G 186     -47.348  92.928  14.094  1.00 39.84      A    C
ATOM  18654  O    ILE G 186     -46.559  93.524  14.779  1.00 40.57      A    O
ATOM  18655  N    ALA G 187     -47.013  92.408  12.937  1.00 39.38      A    N
ATOM  18656  CA   ALA G 187     -45.684  92.549  12.399  1.00 39.08      A    C
ATOM  18657  CB   ALA G 187     -45.523  91.674  11.227  1.00 38.69      A    C
ATOM  18658  C    ALA G 187     -45.256  93.981  12.081  1.00 39.13      A    C
ATOM  18659  O    ALA G 187     -44.115  94.318  12.209  1.00 39.83      A    O
ATOM  18660  N    ALA G 188     -46.160  94.785  11.581  1.00 38.15      A    N
ATOM  18661  CA   ALA G 188     -45.878  96.150  11.246  1.00 38.63      A    C
ATOM  18662  CB   ALA G 188     -46.977  96.710  10.470  1.00 38.22      A    C
ATOM  18663  C    ALA G 188     -45.576  97.027  12.425  1.00 40.35      A    C
ATOM  18664  O    ALA G 188     -44.818  97.963  12.330  1.00 40.77      A    O
ATOM  18665  N    ASN G 189     -46.231  96.724  13.532  1.00 41.56      A    N
ATOM  18666  CA   ASN G 189     -46.190  97.492  14.757  1.00 41.40      A    C
ATOM  18667  CB   ASN G 189     -47.429  97.233  15.590  1.00 41.48      A    C
ATOM  18668  CG   ASN G 189     -48.607  97.926  15.078  1.00 40.79      A    C
ATOM  18669  OD1  ASN G 189     -48.493  98.879  14.360  1.00 37.50      A    O
ATOM  18670  ND2  ASN G 189     -49.759  97.443  15.427  1.00 36.84      A    N
ATOM  18671  C    ASN G 189     -45.011  97.253  15.636  1.00 41.40      A    C
ATOM  18672  O    ASN G 189     -44.453  96.203  15.648  1.00 41.29      A    O
ATOM  18673  N    PRO G 190     -44.691  98.247  16.427  1.00 41.78      A    N
ATOM  18674  CA   PRO G 190     -43.580  98.195  17.354  1.00 42.85      A    C
ATOM  18675  CB   PRO G 190     -42.968  99.574  17.223  1.00 43.58      A    C
ATOM  18676  CG   PRO G 190     -43.986 100.397  16.663  1.00 42.83      A    C
ATOM  18677  CD   PRO G 190     -44.855  99.577  15.855  1.00 41.93      A    C
ATOM  18678  C    PRO G 190     -43.943  97.888  18.807  1.00 43.97      A    C
ATOM  18679  O    PRO G 190     -43.101  98.017  19.633  1.00 44.56      A    O
ATOM  18680  N    PHE G 191     -45.166  97.568  19.119  1.00 44.24      A    N
ATOM  18681  CA   PHE G 191     -45.606  97.194  20.446  1.00 43.48      A    C
ATOM  18682  CB   PHE G 191     -46.546  98.123  21.015  1.00 42.32      A    C
ATOM  18683  CG   PHE G 191     -47.424  98.714  20.000  1.00 38.28      A    C
ATOM  18684  CD1  PHE G 191     -48.543  98.068  19.585  1.00 35.66      A    C
ATOM  18685  CE1  PHE G 191     -49.327  98.601  18.674  1.00 32.29      A    C
ATOM  18686  CZ   PHE G 191     -49.021  99.753  18.155  1.00 30.36      A    C
ATOM  18687  CE2  PHE G 191     -47.928 100.405  18.535  1.00 33.73      A    C
ATOM  18688  CD2  PHE G 191     -47.131  99.899  19.445  1.00 35.03      A    C
ATOM  18689  C    PHE G 191     -46.076  95.871  20.169  1.00 45.33      A    C
ATOM  18690  O    PHE G 191     -46.031  95.440  19.064  1.00 47.42      A    O
ATOM  18691  N    ALA G 192     -46.638  95.217  21.148  1.00 46.03      A    N
ATOM  18692  CA   ALA G 192     -47.137  93.885  20.941  1.00 44.87      A    C
ATOM  18693  CB   ALA G 192     -47.624  93.396  22.183  1.00 44.93      A    C
ATOM  18694  C    ALA G 192     -48.240  93.682  19.970  1.00 44.40      A    C
ATOM  18695  O    ALA G 192     -48.215  92.776  19.212  1.00 48.15      A    O
ATOM  18696  N    GLY G 193     -49.288  94.428  20.023  1.00 41.77      A    N
ATOM  18697  CA   GLY G 193     -50.361  94.019  19.168  1.00 38.90      A    C
ATOM  18698  C    GLY G 193     -50.959  95.010  18.245  1.00 36.88      A    C
ATOM  18699  O    GLY G 193     -50.305  95.544  17.417  1.00 37.23      A    O
```

Appendix 1

```
ATOM  18700  N    ILE G 194     -52.246  95.218  18.415  1.00 34.99      A  N
ATOM  18701  CA   ILE G 194     -53.018  96.099  17.585  1.00 34.25      A  C
ATOM  18702  CB   ILE G 194     -53.871  95.305  16.583  1.00 33.80      A  C
ATOM  18703  CG1  ILE G 194     -53.016  94.344  15.796  1.00 32.84      A  C
ATOM  18704  CD1  ILE G 194     -53.743  93.206  15.266  1.00 28.51      A  C
ATOM  18705  CG2  ILE G 194     -54.501  96.193  15.609  1.00 34.39      A  C
ATOM  18706  C    ILE G 194     -53.882  97.010  18.421  1.00 34.00      A  C
ATOM  18707  O    ILE G 194     -54.304  96.679  19.471  1.00 35.19      A  O
ATOM  18708  N    VAL G 195     -54.077  98.211  17.947  1.00 32.68      A  N
ATOM  18709  CA   VAL G 195     -54.899  99.176  18.610  1.00 31.59      A  C
ATOM  18710  CB   VAL G 195     -54.519 100.553  18.204  1.00 31.34      A  C
ATOM  18711  CG1  VAL G 195     -53.115 100.790  18.504  1.00 26.86      A  C
ATOM  18712  CG2  VAL G 195     -54.781 100.747  16.796  1.00 30.11      A  C
ATOM  18713  C    VAL G 195     -56.353  98.964  18.348  1.00 32.40      A  C
ATOM  18714  O    VAL G 195     -56.712  98.318  17.430  1.00 31.94      A  O
ATOM  18715  N    CYS G 196     -57.214  99.515  19.157  1.00 33.36      A  N
ATOM  18716  CA   CYS G 196     -58.599  99.346  18.880  1.00 34.81      A  C
ATOM  18717  CB   CYS G 196     -59.373  99.385  20.173  1.00 33.67      A  C
ATOM  18718  SG   CYS G 196     -59.575  97.891  21.023  1.00 38.94      A  S
ATOM  18719  C    CYS G 196     -58.991 100.519  18.078  1.00 36.20      A  C
ATOM  18720  O    CYS G 196     -59.379 100.405  16.983  1.00 36.88      A  O
ATOM  18721  N    GLU G 197     -58.899 101.677  18.676  1.00 38.86      A  N
ATOM  18722  CA   GLU G 197     -59.174 102.928  18.040  1.00 39.68      A  C
ATOM  18723  CB   GLU G 197     -59.936 103.841  18.971  1.00 40.87      A  C
ATOM  18724  CG   GLU G 197     -61.407 103.739  18.900  1.00 44.46      A  C
ATOM  18725  CD   GLU G 197     -61.995 103.118  20.103  1.00 49.93      A  C
ATOM  18726  OE1  GLU G 197     -61.252 102.774  21.005  1.00 46.83      A  O
ATOM  18727  OE2  GLU G 197     -63.215 102.981  20.152  1.00 51.43      A  O-1
ATOM  18728  C    GLU G 197     -57.800 103.411  17.989  1.00 39.17      A  C
ATOM  18729  O    GLU G 197     -57.024 103.023  18.779  1.00 39.65      A  O
ATOM  18730  N    PRO G 198     -57.477 104.275  17.071  1.00 38.55      A  N
ATOM  18731  CA   PRO G 198     -56.099 104.670  16.910  1.00 37.65      A  C
ATOM  18732  CB   PRO G 198     -56.177 105.700  15.814  1.00 36.56      A  C
ATOM  18733  CG   PRO G 198     -57.540 105.830  15.485  1.00 37.41      A  C
ATOM  18734  CD   PRO G 198     -58.281 104.701  15.947  1.00 38.58      A  C
ATOM  18735  C    PRO G 198     -55.559 105.288  18.167  1.00 36.96      A  C
ATOM  18736  O    PRO G 198     -56.217 106.032  18.844  1.00 37.41      A  O
ATOM  18737  N    ASP G 199     -54.359 104.880  18.493  1.00 35.29      A  N
ATOM  18738  CA   ASP G 199     -53.684 105.237  19.714  1.00 34.47      A  C
ATOM  18739  CB   ASP G 199     -53.428 106.724  19.865  1.00 34.00      A  C
ATOM  18740  CG   ASP G 199     -52.266 107.008  20.774  1.00 36.23      A  C
ATOM  18741  OD1  ASP G 199     -51.229 106.390  20.609  1.00 34.78      A  O
ATOM  18742  OD2  ASP G 199     -52.367 107.846  21.655  1.00 39.53      A  O-1
ATOM  18743  C    ASP G 199     -54.330 104.704  20.968  1.00 32.67      A  C
ATOM  18744  O    ASP G 199     -54.046 105.176  22.004  1.00 31.46      A  O
ATOM  18745  N    ASN G 200     -55.194 103.725  20.879  1.00 30.91      A  N
ATOM  18746  CA   ASN G 200     -55.752 103.161  22.074  1.00 30.01      A  C
ATOM  18747  CB   ASN G 200     -57.246 103.260  22.018  1.00 28.57      A  C
ATOM  18748  CG   ASN G 200     -57.760 104.479  22.604  1.00 28.80      A  C
ATOM  18749  OD1  ASN G 200     -57.044 105.290  23.076  1.00 32.78      A  O
ATOM  18750  ND2  ASN G 200     -59.025 104.615  22.589  1.00 33.19      A  N
ATOM  18751  C    ASN G 200     -55.389 101.715  22.135  1.00 29.95      A  C
ATOM  18752  O    ASN G 200     -55.815 100.987  21.344  1.00 31.27      A  O
ATOM  18753  N    TYR G 201     -54.593 101.280  23.072  1.00 29.57      A  N
```

Appendix 1

```
ATOM  18754  CA   TYR G 201     -54.263  99.884  23.083  1.00  29.61      A  C
ATOM  18755  CB   TYR G 201     -52.763  99.742  23.022  1.00  30.11      A  C
ATOM  18756  CG   TYR G 201     -52.212  98.364  23.054  1.00  28.37      A  C
ATOM  18757  CD1  TYR G 201     -51.658  97.808  21.943  1.00  32.06      A  C
ATOM  18758  CE1  TYR G 201     -51.122  96.576  21.984  1.00  34.15      A  C
ATOM  18759  CZ   TYR G 201     -51.144  95.881  23.153  1.00  34.89      A  C
ATOM  18760  OH   TYR G 201     -50.614  94.643  23.236  1.00  35.92      A  O
ATOM  18761  CE2  TYR G 201     -51.681  96.426  24.250  1.00  29.42      A  C
ATOM  18762  CD2  TYR G 201     -52.205  97.644  24.201  1.00  27.65      A  C
ATOM  18763  C    TYR G 201     -54.834  99.208  24.293  1.00  28.74      A  C
ATOM  18764  O    TYR G 201     -54.627  99.620  25.368  1.00  29.40      A  O
ATOM  18765  N    PHE G 202     -55.588  98.160  24.088  1.00  27.99      A  N
ATOM  18766  CA   PHE G 202     -56.162  97.417  25.181  1.00  27.55      A  C
ATOM  18767  CB   PHE G 202     -57.671  97.447  25.110  1.00  27.07      A  C
ATOM  18768  CG   PHE G 202     -58.244  98.782  25.224  1.00  25.03      A  C
ATOM  18769  CD1  PHE G 202     -58.576  99.288  26.425  1.00  26.61      A  C
ATOM  18770  CE1  PHE G 202     -59.096 100.501  26.512  1.00  29.45      A  C
ATOM  18771  CZ   PHE G 202     -59.295 101.229  25.397  1.00  30.03      A  C
ATOM  18772  CE2  PHE G 202     -58.968 100.738  24.212  1.00  25.54      A  C
ATOM  18773  CD2  PHE G 202     -58.442  99.538  24.125  1.00  25.18      A  C
ATOM  18774  C    PHE G 202     -55.691  95.997  25.170  1.00  27.01      A  C
ATOM  18775  O    PHE G 202     -55.696  95.362  24.163  1.00  26.70      A  O
ATOM  18776  N    VAL G 203     -55.255  95.529  26.316  1.00  25.32      A  N
ATOM  18777  CA   VAL G 203     -54.718  94.200  26.480  1.00  25.23      A  C
ATOM  18778  CB   VAL G 203     -54.033  94.061  27.831  1.00  25.80      A  C
ATOM  18779  CG1  VAL G 203     -54.958  93.726  28.884  1.00  24.78      A  C
ATOM  18780  CG2  VAL G 203     -53.014  93.079  27.776  1.00  26.86      A  C
ATOM  18781  C    VAL G 203     -55.717  93.112  26.265  1.00  25.11      A  C
ATOM  18782  O    VAL G 203     -55.422  92.104  25.707  1.00  24.79      A  O
ATOM  18783  N    GLN G 204     -56.905  93.334  26.766  1.00  24.60      A  N
ATOM  18784  CA   GLN G 204     -57.996  92.422  26.633  1.00  24.35      A  C
ATOM  18785  CB   GLN G 204     -59.108  92.778  27.610  1.00  24.02      A  C
ATOM  18786  CG   GLN G 204     -60.036  93.853  27.219  1.00  19.44      A  C
ATOM  18787  CD   GLN G 204     -59.575  95.175  27.609  1.00  21.55      A  C
ATOM  18788  OE1  GLN G 204     -58.478  95.355  28.000  1.00  18.83      A  O
ATOM  18789  NE2  GLN G 204     -60.427  96.104  27.532  1.00  25.08      A  N
ATOM  18790  C    GLN G 204     -58.477  92.258  25.209  1.00  26.24      A  C
ATOM  18791  O    GLN G 204     -58.757  91.191  24.795  1.00  26.24      A  O
ATOM  18792  N    CYS G 205     -58.559  93.332  24.464  1.00  27.86      A  N
ATOM  18793  CA   CYS G 205     -58.954  93.253  23.091  1.00  30.15      A  C
ATOM  18794  CB   CYS G 205     -59.146  94.635  22.484  1.00  29.94      A  C
ATOM  18795  SG   CYS G 205     -60.381  95.739  23.138  1.00  36.91      A  S
ATOM  18796  C    CYS G 205     -57.958  92.442  22.275  1.00  30.29      A  C
ATOM  18797  O    CYS G 205     -58.340  91.730  21.421  1.00  31.55      A  O
ATOM  18798  N    ASN G 206     -56.676  92.598  22.550  1.00  29.99      A  N
ATOM  18799  CA   ASN G 206     -55.584  91.860  21.938  1.00  29.20      A  C
ATOM  18800  CB   ASN G 206     -54.254  92.458  22.329  1.00  28.63      A  C
ATOM  18801  CG   ASN G 206     -53.819  93.531  21.431  1.00  31.21      A  C
ATOM  18802  OD1  ASN G 206     -53.173  93.289  20.479  1.00  32.85      A  O
ATOM  18803  ND2  ASN G 206     -54.139  94.730  21.759  1.00  32.03      A  N
ATOM  18804  C    ASN G 206     -55.559  90.410  22.294  1.00  29.27      A  C
ATOM  18805  O    ASN G 206     -55.046  89.613  21.603  1.00  30.15      A  O
ATOM  18806  N    SER G 207     -56.107  90.092  23.430  1.00  30.28      A  N
ATOM  18807  CA   SER G 207     -56.219  88.751  23.902  1.00  30.14      A  C
```

Appendix 1

```
ATOM   18808  CB   SER G 207     -56.961  88.829  25.214  1.00  31.14      A   C
ATOM   18809  OG   SER G 207     -56.569  87.827  26.066  1.00  34.66      A   O
ATOM   18810  C    SER G 207     -57.045  87.932  22.954  1.00  29.22      A   C
ATOM   18811  O    SER G 207     -56.715  86.832  22.638  1.00  29.32      A   O
ATOM   18812  N    VAL G 208     -58.138  88.498  22.506  1.00  27.42      A   N
ATOM   18813  CA   VAL G 208     -58.988  87.878  21.540  1.00  26.27      A   C
ATOM   18814  CB   VAL G 208     -60.278  88.682  21.410  1.00  25.73      A   C
ATOM   18815  CG1  VAL G 208     -61.182  88.075  20.495  1.00  21.71      A   C
ATOM   18816  CG2  VAL G 208     -60.909  88.757  22.701  1.00  25.72      A   C
ATOM   18817  C    VAL G 208     -58.266  87.694  20.219  1.00  27.01      A   C
ATOM   18818  O    VAL G 208     -58.342  86.665  19.621  1.00  26.00      A   O
ATOM   18819  N    ALA G 209     -57.528  88.684  19.787  1.00  25.90      A   N
ATOM   18820  CA   ALA G 209     -56.817  88.552  18.559  1.00  26.93      A   C
ATOM   18821  CB   ALA G 209     -56.189  89.817  18.213  1.00  27.88      A   C
ATOM   18822  C    ALA G 209     -55.791  87.476  18.558  1.00  27.80      A   C
ATOM   18823  O    ALA G 209     -55.690  86.764  17.621  1.00  30.36      A   O
ATOM   18824  N    TYR G 210     -55.000  87.372  19.590  1.00  27.11      A   N
ATOM   18825  CA   TYR G 210     -54.032  86.317  19.675  1.00  26.61      A   C
ATOM   18826  CB   TYR G 210     -53.028  86.606  20.761  1.00  26.43      A   C
ATOM   18827  CG   TYR G 210     -52.009  87.608  20.367  1.00  24.28      A   C
ATOM   18828  CD1  TYR G 210     -50.824  87.230  19.853  1.00  26.32      A   C
ATOM   18829  CE1  TYR G 210     -49.915  88.137  19.494  1.00  20.29      A   C
ATOM   18830  CZ   TYR G 210     -50.180  89.438  19.673  1.00  25.51      A   C
ATOM   18831  OH   TYR G 210     -49.286  90.368  19.333  1.00  26.17      A   O
ATOM   18832  CE2  TYR G 210     -51.331  89.835  20.195  1.00  21.17      A   C
ATOM   18833  CD2  TYR G 210     -52.229  88.939  20.541  1.00  23.79      A   C
ATOM   18834  C    TYR G 210     -54.594  84.908  19.780  1.00  27.81      A   C
ATOM   18835  O    TYR G 210     -54.079  84.001  19.207  1.00  28.68      A   O
ATOM   18836  N    LEU G 211     -55.660  84.739  20.521  1.00  26.79      A   N
ATOM   18837  CA   LEU G 211     -56.280  83.461  20.696  1.00  27.56      A   C
ATOM   18838  CB   LEU G 211     -57.393  83.550  21.713  1.00  28.41      A   C
ATOM   18839  CG   LEU G 211     -58.074  82.267  22.117  1.00  29.82      A   C
ATOM   18840  CD1  LEU G 211     -57.230  81.431  22.959  1.00  27.37      A   C
ATOM   18841  CD2  LEU G 211     -59.302  82.589  22.812  1.00  34.88      A   C
ATOM   18842  C    LEU G 211     -56.816  82.955  19.402  1.00  28.94      A   C
ATOM   18843  O    LEU G 211     -56.828  81.808  19.140  1.00  28.25      A   O
ATOM   18844  N    SER G 212     -57.294  83.871  18.609  1.00  29.71      A   N
ATOM   18845  CA   SER G 212     -57.791  83.610  17.302  1.00  30.11      A   C
ATOM   18846  CB   SER G 212     -58.461  84.844  16.773  1.00  29.61      A   C
ATOM   18847  OG   SER G 212     -57.587  85.635  16.057  1.00  29.72      A   O
ATOM   18848  C    SER G 212     -56.717  83.102  16.374  1.00  31.38      A   C
ATOM   18849  O    SER G 212     -56.984  82.419  15.446  1.00  32.52      A   O
ATOM   18850  N    LEU G 213     -55.501  83.504  16.616  1.00  31.13      A   N
ATOM   18851  CA   LEU G 213     -54.398  82.974  15.899  1.00  31.51      A   C
ATOM   18852  CB   LEU G 213     -53.158  83.809  16.108  1.00  31.21      A   C
ATOM   18853  CG   LEU G 213     -53.292  85.234  15.652  1.00  32.40      A   C
ATOM   18854  CD1  LEU G 213     -52.175  86.045  16.069  1.00  36.11      A   C
ATOM   18855  CD2  LEU G 213     -53.468  85.327  14.227  1.00  34.89      A   C
ATOM   18856  C    LEU G 213     -54.161  81.534  16.212  1.00  31.98      A   C
ATOM   18857  O    LEU G 213     -53.805  80.796  15.368  1.00  31.58      A   O
ATOM   18858  N    TRP G 214     -54.329  81.165  17.460  1.00  32.97      A   N
ATOM   18859  CA   TRP G 214     -54.144  79.803  17.881  1.00  32.84      A   C
ATOM   18860  CB   TRP G 214     -54.197  79.662  19.400  1.00  33.60      A   C
ATOM   18861  CG   TRP G 214     -53.000  80.185  20.100  1.00  33.24      A   C
```

Appendix 1

```
ATOM  18862  CD1  TRP G 214   -52.639  81.455  20.200  1.00  35.34   A  C
ATOM  18863  NE1  TRP G 214   -51.497  81.576  20.899  1.00  34.77   A  N
ATOM  18864  CE2  TRP G 214   -51.101  80.340  21.287  1.00  33.66   A  C
ATOM  18865  CD2  TRP G 214   -52.028  79.444  20.808  1.00  32.04   A  C
ATOM  18866  CE3  TRP G 214   -51.835  78.101  21.053  1.00  29.42   A  C
ATOM  18867  CZ3  TRP G 214   -50.775  77.730  21.748  1.00  29.41   A  C
ATOM  18868  CH2  TRP G 214   -49.872  78.638  22.212  1.00  32.27   A  C
ATOM  18869  CZ2  TRP G 214   -50.013  79.952  21.986  1.00  31.57   A  C
ATOM  18870  C    TRP G 214   -55.161  78.924  17.255  1.00  34.08   A  C
ATOM  18871  O    TRP G 214   -54.878  77.822  16.918  1.00  35.26   A  O
ATOM  18872  N    VAL G 215   -56.375  79.414  17.164  1.00  33.36   A  N
ATOM  18873  CA   VAL G 215   -57.459  78.676  16.589  1.00  32.32   A  C
ATOM  18874  CB   VAL G 215   -58.787  79.331  16.907  1.00  32.50   A  C
ATOM  18875  CG1  VAL G 215   -59.881  78.728  16.152  1.00  31.99   A  C
ATOM  18876  CG2  VAL G 215   -59.050  79.183  18.315  1.00  31.98   A  C
ATOM  18877  C    VAL G 215   -57.238  78.482  15.132  1.00  32.34   A  C
ATOM  18878  O    VAL G 215   -57.492  77.449  14.598  1.00  31.80   A  O
ATOM  18879  N    TYR G 216   -56.768  79.500  14.472  1.00  32.58   A  N
ATOM  18880  CA   TYR G 216   -56.515  79.354  13.086  1.00  32.50   A  C
ATOM  18881  CB   TYR G 216   -56.109  80.673  12.474  1.00  31.93   A  C
ATOM  18882  CG   TYR G 216   -55.997  80.588  10.998  1.00  34.01   A  C
ATOM  18883  CD1  TYR G 216   -56.995  81.027  10.197  1.00  32.92   A  C
ATOM  18884  CE1  TYR G 216   -56.900  80.943   8.901  1.00  34.64   A  C
ATOM  18885  CZ   TYR G 216   -55.808  80.398   8.358  1.00  36.94   A  C
ATOM  18886  OH   TYR G 216   -55.719  80.314   7.016  1.00  40.16   A  O
ATOM  18887  CE2  TYR G 216   -54.807  79.957   9.117  1.00  34.09   A  C
ATOM  18888  CD2  TYR G 216   -54.899  80.052  10.417  1.00  33.07   A  C
ATOM  18889  C    TYR G 216   -55.461  78.314  12.864  1.00  32.64   A  C
ATOM  18890  O    TYR G 216   -55.519  77.581  11.963  1.00  32.89   A  O
ATOM  18891  N    ASP G 217   -54.461  78.263  13.690  1.00  34.13   A  N
ATOM  18892  CA   ASP G 217   -53.399  77.323  13.469  1.00  35.61   A  C
ATOM  18893  CB   ASP G 217   -52.212  77.668  14.313  1.00  35.49   A  C
ATOM  18894  CG   ASP G 217   -51.585  78.851  13.841  1.00  37.14   A  C
ATOM  18895  OD1  ASP G 217   -50.733  79.375  14.508  1.00  44.63   A  O
ATOM  18896  OD2  ASP G 217   -51.963  79.287  12.774  1.00  39.25   A  O-1
ATOM  18897  C    ASP G 217   -53.782  75.894  13.599  1.00  36.04   A  C
ATOM  18898  O    ASP G 217   -53.327  75.071  12.874  1.00  37.24   A  O
ATOM  18899  N    ARG G 218   -54.619  75.618  14.556  1.00  36.44   A  N
ATOM  18900  CA   ARG G 218   -55.086  74.307  14.808  1.00  38.91   A  C
ATOM  18901  CB   ARG G 218   -55.865  74.298  16.099  1.00  39.49   A  C
ATOM  18902  CG   ARG G 218   -57.006  73.376  16.143  1.00  45.16   A  C
ATOM  18903  CD   ARG G 218   -56.561  71.967  16.084  1.00  53.72   A  C
ATOM  18904  NE   ARG G 218   -57.290  71.107  16.998  1.00  61.90   A  N
ATOM  18905  CZ   ARG G 218   -58.293  70.322  16.649  1.00  62.06   A  C
ATOM  18906  NH1  ARG G 218   -58.701  70.298  15.401  1.00  63.36   A  N
ATOM  18907  NH2  ARG G 218   -58.885  69.564  17.545  1.00  62.94   A  N
ATOM  18908  C    ARG G 218   -55.882  73.754  13.653  1.00  39.34   A  C
ATOM  18909  O    ARG G 218   -55.817  72.592  13.377  1.00  39.70   A  O
ATOM  18910  N    LEU G 219   -56.663  74.600  13.015  1.00  39.27   A  N
ATOM  18911  CA   LEU G 219   -57.345  74.284  11.794  1.00  39.03   A  C
ATOM  18912  CB   LEU G 219   -58.275  75.413  11.421  1.00  37.34   A  C
ATOM  18913  CG   LEU G 219   -59.423  75.593  12.369  1.00  37.75   A  C
ATOM  18914  CD1  LEU G 219   -60.163  76.787  12.083  1.00  34.79   A  C
ATOM  18915  CD2  LEU G 219   -60.305  74.441  12.343  1.00  36.03   A  C
```

Appendix 1

```
ATOM  18916  C    LEU G 219     -56.423  74.044  10.634  1.00  40.72      A    C
ATOM  18917  O    LEU G 219     -56.639  73.148   9.852  1.00  41.65      A    O
ATOM  18918  N    HIS G 220     -55.421  74.886  10.493  1.00  40.54      A    N
ATOM  18919  CA   HIS G 220     -54.591  74.852   9.321  1.00  40.31      A    C
ATOM  18920  CB   HIS G 220     -54.705  76.165   8.595  1.00  40.69      A    C
ATOM  18921  CG   HIS G 220     -56.096  76.499   8.202  1.00  40.74      A    C
ATOM  18922  ND1  HIS G 220     -56.757  75.849   7.201  1.00  41.50      A    N
ATOM  18923  CE1  HIS G 220     -57.973  76.328   7.099  1.00  41.71      A    C
ATOM  18924  NE2  HIS G 220     -58.122  77.268   7.999  1.00  41.23      A    N
ATOM  18925  CD2  HIS G 220     -56.961  77.392   8.701  1.00  38.47      A    C
ATOM  18926  C    HIS G 220     -53.141  74.444   9.426  1.00  40.78      A    C
ATOM  18927  O    HIS G 220     -52.449  74.507   8.468  1.00  40.57      A    O
ATOM  18928  N    GLY G 221     -52.664  73.993  10.563  1.00  41.69      A    N
ATOM  18929  CA   GLY G 221     -51.323  73.456  10.617  1.00  41.16      A    C
ATOM  18930  C    GLY G 221     -50.295  74.537  10.569  1.00  42.25      A    C
ATOM  18931  O    GLY G 221     -49.121  74.336  10.388  1.00  41.32      A    O
ATOM  18932  N    THR G 222     -50.803  75.723  10.750  1.00  43.01      A    N
ATOM  18933  CA   THR G 222     -50.063  76.934  10.716  1.00  43.69      A    C
ATOM  18934  CB   THR G 222     -51.022  78.016  10.319  1.00  44.45      A    C
ATOM  18935  OG1  THR G 222     -50.354  78.908   9.445  1.00  49.97      A    O
ATOM  18936  CG2  THR G 222     -51.619  78.758  11.549  1.00  45.24      A    C
ATOM  18937  C    THR G 222     -49.311  77.246  12.008  1.00  42.79      A    C
ATOM  18938  O    THR G 222     -49.475  76.584  12.984  1.00  42.12      A    O
ATOM  18939  N    ASP G 223     -48.469  78.259  11.998  1.00  42.93      A    N
ATOM  18940  CA   ASP G 223     -47.808  78.709  13.211  1.00  44.11      A    C
ATOM  18941  CB   ASP G 223     -46.350  78.283  13.217  1.00  44.02      A    C
ATOM  18942  CG   ASP G 223     -45.657  78.562  14.524  1.00  48.24      A    C
ATOM  18943  OD1  ASP G 223     -46.275  78.492  15.581  1.00  47.92      A    O
ATOM  18944  OD2  ASP G 223     -44.455  78.829  14.502  1.00  51.47      A    O-1
ATOM  18945  C    ASP G 223     -47.907  80.211  13.389  1.00  43.53      A    C
ATOM  18946  O    ASP G 223     -46.935  80.916  13.535  1.00  41.59      A    O
ATOM  18947  N    TYR G 224     -49.126  80.682  13.403  1.00  42.90      A    N
ATOM  18948  CA   TYR G 224     -49.349  82.089  13.550  1.00  44.05      A    C
ATOM  18949  CB   TYR G 224     -50.727  82.476  13.054  1.00  43.83      A    C
ATOM  18950  CG   TYR G 224     -50.803  82.646  11.576  1.00  42.92      A    C
ATOM  18951  CD1  TYR G 224     -50.179  83.675  10.955  1.00  40.44      A    C
ATOM  18952  CE1  TYR G 224     -50.258  83.826   9.640  1.00  38.21      A    C
ATOM  18953  CZ   TYR G 224     -50.951  82.956   8.914  1.00  41.13      A    C
ATOM  18954  OH   TYR G 224     -51.008  83.115   7.584  1.00  43.90      A    O
ATOM  18955  CE2  TYR G 224     -51.578  81.924   9.491  1.00  43.34      A    C
ATOM  18956  CD2  TYR G 224     -51.506  81.770  10.804  1.00  44.15      A    C
ATOM  18957  C    TYR G 224     -49.073  82.603  14.952  1.00  43.88      A    C
ATOM  18958  O    TYR G 224     -48.986  83.771  15.153  1.00  44.63      A    O
ATOM  18959  N    ARG G 225     -48.817  81.730  15.896  1.00  44.23      A    N
ATOM  18960  CA   ARG G 225     -48.535  82.179  17.233  1.00  44.39      A    C
ATOM  18961  CB   ARG G 225     -48.635  81.018  18.175  1.00  45.13      A    C
ATOM  18962  CG   ARG G 225     -49.713  80.060  17.859  1.00  41.78      A    C
ATOM  18963  CD   ARG G 225     -49.321  78.728  18.366  1.00  41.01      A    C
ATOM  18964  NE   ARG G 225     -48.613  78.025  17.337  1.00  47.65      A    N
ATOM  18965  CZ   ARG G 225     -48.820  76.766  17.035  1.00  51.40      A    C
ATOM  18966  NH1  ARG G 225     -49.698  76.085  17.699  1.00  52.09      A    N
ATOM  18967  NH2  ARG G 225     -48.165  76.195  16.070  1.00  55.64      A    N
ATOM  18968  C    ARG G 225     -47.183  82.836  17.444  1.00  45.21      A    C
ATOM  18969  O    ARG G 225     -46.126  82.256  17.263  1.00  45.65      A    O
```

Appendix 1

```
ATOM  18970  N    ALA G 226    -47.301  84.104  17.798  1.00  44.93    A  N
ATOM  18971  CA   ALA G 226    -46.269  85.025  18.167  1.00  42.71    A  C
ATOM  18972  CB   ALA G 226    -46.198  86.067  17.173  1.00  41.42    A  C
ATOM  18973  C    ALA G 226    -46.734  85.614  19.473  1.00  42.10    A  C
ATOM  18974  O    ALA G 226    -46.534  86.766  19.760  1.00  40.31    A  O
ATOM  18975  N    ALA G 227    -47.419  84.800  20.239  1.00  41.45    A  N
ATOM  18976  CA   ALA G 227    -47.957  85.216  21.492  1.00  42.11    A  C
ATOM  18977  CB   ALA G 227    -48.772  84.107  22.032  1.00  39.22    A  C
ATOM  18978  C    ALA G 227    -46.873  85.611  22.474  1.00  42.61    A  C
ATOM  18979  O    ALA G 227    -46.976  86.581  23.145  1.00  42.07    A  O
ATOM  18980  N    THR G 228    -45.851  84.805  22.595  1.00  44.57    A  N
ATOM  18981  CA   THR G 228    -44.719  85.150  23.396  1.00  46.73    A  C
ATOM  18982  CB   THR G 228    -43.691  84.068  23.326  1.00  47.25    A  C
ATOM  18983  OG1  THR G 228    -42.489  84.494  23.968  1.00  48.92    A  O
ATOM  18984  CG2  THR G 228    -43.397  83.801  21.926  1.00  48.22    A  C
ATOM  18985  C    THR G 228    -44.102  86.292  22.729  1.00  47.04    A  C
ATOM  18986  O    THR G 228    -43.737  87.241  23.346  1.00  44.94    A  O
ATOM  18987  N    ARG G 229    -43.844  85.993  21.454  1.00  49.86    A  N
ATOM  18988  CA   ARG G 229    -43.100  86.924  20.722  1.00  50.85    A  C
ATOM  18989  CB   ARG G 229    -43.823  87.271  19.437  1.00  51.83    A  C
ATOM  18990  CG   ARG G 229    -43.055  87.137  18.113  1.00  53.22    A  C
ATOM  18991  CD   ARG G 229    -41.597  87.450  18.248  1.00  59.34    A  C
ATOM  18992  NE   ARG G 229    -41.221  88.749  17.722  1.00  61.78    A  N
ATOM  18993  CZ   ARG G 229    -40.041  89.314  17.929  1.00  61.74    A  C
ATOM  18994  NH1  ARG G 229    -39.130  88.688  18.636  1.00  60.40    A  N
ATOM  18995  NH2  ARG G 229    -39.773  90.495  17.418  1.00  60.81    A  N
ATOM  18996  C    ARG G 229    -43.284  87.952  21.807  1.00  50.70    A  C
ATOM  18997  O    ARG G 229    -43.534  87.633  22.988  1.00  52.57    A  O
ATOM  18998  N    ALA G 230    -43.191  89.206  21.467  1.00  47.91    A  N
ATOM  18999  CA   ALA G 230    -43.207  90.099  22.589  1.00  46.13    A  C
ATOM  19000  CB   ALA G 230    -42.786  91.521  22.255  1.00  46.32    A  C
ATOM  19001  C    ALA G 230    -44.494  90.061  23.324  1.00  42.62    A  C
ATOM  19002  O    ALA G 230    -44.507  90.523  24.413  1.00  43.64    A  O
ATOM  19003  N    TRP G 231    -45.574  89.524  22.785  1.00  38.35    A  N
ATOM  19004  CA   TRP G 231    -46.824  89.936  23.364  1.00  35.10    A  C
ATOM  19005  CB   TRP G 231    -48.046  89.431  22.591  1.00  33.70    A  C
ATOM  19006  CG   TRP G 231    -49.296  90.030  23.133  1.00  29.59    A  C
ATOM  19007  CD1  TRP G 231    -49.617  91.303  23.093  1.00  28.97    A  C
ATOM  19008  NE1  TRP G 231    -50.775  91.525  23.706  1.00  24.66    A  N
ATOM  19009  CE2  TRP G 231    -51.242  90.360  24.202  1.00  24.61    A  C
ATOM  19010  CD2  TRP G 231    -50.327  89.388  23.863  1.00  24.29    A  C
ATOM  19011  CE3  TRP G 231    -50.574  88.085  24.246  1.00  23.57    A  C
ATOM  19012  CZ3  TRP G 231    -51.694  87.825  24.933  1.00  21.88    A  C
ATOM  19013  CH2  TRP G 231    -52.600  88.819  25.244  1.00  21.20    A  C
ATOM  19014  CZ2  TRP G 231    -52.386  90.091  24.895  1.00  20.82    A  C
ATOM  19015  C    TRP G 231    -46.988  89.622  24.821  1.00  35.03    A  C
ATOM  19016  O    TRP G 231    -47.250  90.496  25.587  1.00  35.11    A  O
ATOM  19017  N    LEU G 232    -46.820  88.397  25.225  1.00  34.41    A  N
ATOM  19018  CA   LEU G 232    -46.815  88.145  26.638  1.00  34.91    A  C
ATOM  19019  CB   LEU G 232    -46.851  86.668  26.933  1.00  34.78    A  C
ATOM  19020  CG   LEU G 232    -48.140  85.966  26.596  1.00  30.81    A  C
ATOM  19021  CD1  LEU G 232    -47.860  84.558  26.551  1.00  31.14    A  C
ATOM  19022  CD2  LEU G 232    -49.126  86.222  27.617  1.00  32.17    A  C
ATOM  19023  C    LEU G 232    -45.660  88.824  27.333  1.00  36.33    A  C
```

Appendix 1

```
ATOM  19024  O    LEU G 232     -45.799  89.317  28.399  1.00 37.25      A    O
ATOM  19025  N    ASP G 233     -44.508  88.859  26.710  1.00 37.42      A    N
ATOM  19026  CA   ASP G 233     -43.383  89.577  27.254  1.00 38.01      A    C
ATOM  19027  CB   ASP G 233     -42.175  89.353  26.377  1.00 39.44      A    C
ATOM  19028  CG   ASP G 233     -41.554  88.009  26.563  1.00 43.88      A    C
ATOM  19029  OD1  ASP G 233     -42.005  87.242  27.413  1.00 44.83      A    O
ATOM  19030  OD2  ASP G 233     -40.601  87.720  25.837  1.00 47.81      A    O-1
ATOM  19031  C    ASP G 233     -43.598  91.063  27.348  1.00 37.29      A    C
ATOM  19032  O    ASP G 233     -43.175  91.694  28.271  1.00 38.33      A    O
ATOM  19033  N    PHE G 234     -44.177  91.642  26.331  1.00 35.83      A    N
ATOM  19034  CA   PHE G 234     -44.435  93.056  26.322  1.00 34.72      A    C
ATOM  19035  CB   PHE G 234     -44.888  93.476  24.942  1.00 33.74      A    C
ATOM  19036  CG   PHE G 234     -45.518  94.786  24.900  1.00 33.33      A    C
ATOM  19037  CD1  PHE G 234     -44.781  95.909  24.970  1.00 33.85      A    C
ATOM  19038  CE1  PHE G 234     -45.364  97.091  24.922  1.00 32.41      A    C
ATOM  19039  CZ   PHE G 234     -46.675  97.181  24.793  1.00 31.32      A    C
ATOM  19040  CE2  PHE G 234     -47.416  96.091  24.714  1.00 32.57      A    C
ATOM  19041  CD2  PHE G 234     -46.852  94.903  24.768  1.00 30.73      A    C
ATOM  19042  C    PHE G 234     -45.425  93.496  27.361  1.00 33.98      A    C
ATOM  19043  O    PHE G 234     -45.247  94.491  28.001  1.00 32.69      A    O
ATOM  19044  N    ILE G 235     -46.493  92.753  27.519  1.00 33.50      A    N
ATOM  19045  CA   ILE G 235     -47.483  93.105  28.512  1.00 34.69      A    C
ATOM  19046  CB   ILE G 235     -48.870  92.519  28.256  1.00 34.22      A    C
ATOM  19047  CG1  ILE G 235     -48.915  91.032  28.494  1.00 34.03      A    C
ATOM  19048  CD1  ILE G 235     -50.225  90.432  28.223  1.00 32.20      A    C
ATOM  19049  CG2  ILE G 235     -49.268  92.800  26.908  1.00 32.90      A    C
ATOM  19050  C    ILE G 235     -47.021  93.012  29.966  1.00 35.80      A    C
ATOM  19051  O    ILE G 235     -47.478  93.729  30.798  1.00 35.34      A    O
ATOM  19052  N    GLN G 236     -46.089  92.121  30.208  1.00 37.11      A    N
ATOM  19053  CA   GLN G 236     -45.479  91.870  31.472  1.00 40.95      A    C
ATOM  19054  CB   GLN G 236     -44.580  90.672  31.358  1.00 41.99      A    C
ATOM  19055  CG   GLN G 236     -45.269  89.378  31.396  1.00 46.02      A    C
ATOM  19056  CD   GLN G 236     -44.583  88.438  32.286  1.00 50.81      A    C
ATOM  19057  OE1  GLN G 236     -45.206  87.688  33.000  1.00 54.73      A    O
ATOM  19058  NE2  GLN G 236     -43.287  88.499  32.297  1.00 50.63      A    N
ATOM  19059  C    GLN G 236     -44.688  93.022  32.023  1.00 42.30      A    C
ATOM  19060  O    GLN G 236     -44.547  93.117  33.193  1.00 42.59      A    O
ATOM  19061  N    LYS G 237     -44.178  93.899  31.176  1.00 44.83      A    N
ATOM  19062  CA   LYS G 237     -43.586  95.158  31.608  1.00 47.19      A    C
ATOM  19063  CB   LYS G 237     -42.217  95.368  31.023  1.00 47.40      A    C
ATOM  19064  CG   LYS G 237     -41.933  94.586  29.833  1.00 49.58      A    C
ATOM  19065  CD   LYS G 237     -40.834  95.235  29.085  1.00 55.21      A    C
ATOM  19066  CE   LYS G 237     -40.869  94.824  27.658  1.00 60.40      A    C
ATOM  19067  NZ   LYS G 237     -40.122  93.576  27.407  1.00 62.32      A    N
ATOM  19068  C    LYS G 237     -44.425  96.365  31.284  1.00 48.29      A    C
ATOM  19069  O    LYS G 237     -44.937  96.468  30.221  1.00 49.86      A    O
ATOM  19070  N    ASP G 238     -44.570  97.284  32.222  1.00 49.61      A    N
ATOM  19071  CA   ASP G 238     -45.273  98.544  31.987  1.00 49.90      A    C
ATOM  19072  CB   ASP G 238     -44.765  99.213  30.712  1.00 51.39      A    C
ATOM  19073  CG   ASP G 238     -43.868 100.416  30.984  1.00 55.28      A    C
ATOM  19074  OD1  ASP G 238     -42.859 100.294  31.690  1.00 56.78      A    O
ATOM  19075  OD2  ASP G 238     -44.156 101.493  30.466  1.00 56.73      A    O-1
ATOM  19076  C    ASP G 238     -46.789  98.455  31.965  1.00 48.90      A    C
ATOM  19077  O    ASP G 238     -47.457  99.250  32.566  1.00 49.51      A    O
```

Appendix 1

```
ATOM  19078  N   LEU G 239     -47.338  97.467  31.290  1.00 46.76      A    N
ATOM  19079  CA  LEU G 239     -48.784  97.328  31.239  1.00 44.81      A    C
ATOM  19080  CB  LEU G 239     -49.224  96.753  29.898  1.00 45.27      A    C
ATOM  19081  CG  LEU G 239     -49.650  97.782  28.862  1.00 45.55      A    C
ATOM  19082  CD1 LEU G 239     -50.000  97.127  27.594  1.00 43.68      A    C
ATOM  19083  CD2 LEU G 239     -50.796  98.582  29.356  1.00 45.29      A    C
ATOM  19084  C   LEU G 239     -49.409  96.569  32.397  1.00 42.99      A    C
ATOM  19085  O   LEU G 239     -50.586  96.566  32.572  1.00 42.31      A    O
ATOM  19086  N   ILE G 240     -48.604  95.952  33.217  1.00 41.20      A    N
ATOM  19087  CA  ILE G 240     -49.141  95.211  34.315  1.00 40.60      A    C
ATOM  19088  CB  ILE G 240     -48.732  93.773  34.209  1.00 40.78      A    C
ATOM  19089  CG1 ILE G 240     -49.729  92.895  34.924  1.00 41.26      A    C
ATOM  19090  CD1 ILE G 240     -49.561  91.499  34.622  1.00 41.80      A    C
ATOM  19091  CG2 ILE G 240     -47.448  93.580  34.820  1.00 42.26      A    C
ATOM  19092  C   ILE G 240     -48.612  95.781  35.589  1.00 39.28      A    C
ATOM  19093  O   ILE G 240     -47.581  96.329  35.575  1.00 38.93      A    O
ATOM  19094  N   ASP G 241     -49.353  95.684  36.681  1.00 38.58      A    N
ATOM  19095  CA  ASP G 241     -48.826  95.952  38.002  1.00 36.60      A    C
ATOM  19096  CB  ASP G 241     -49.790  96.784  38.833  1.00 35.67      A    C
ATOM  19097  CG  ASP G 241     -49.354  96.945  40.266  1.00 39.00      A    C
ATOM  19098  OD1 ASP G 241     -48.562  96.166  40.752  1.00 42.15      A    O
ATOM  19099  OD2 ASP G 241     -49.818  97.847  40.942  1.00 41.45      A    O-1
ATOM  19100  C   ASP G 241     -48.617  94.612  38.640  1.00 35.86      A    C
ATOM  19101  O   ASP G 241     -49.533  93.939  38.983  1.00 35.37      A    O
ATOM  19102  N   PRO G 242     -47.373  94.237  38.776  1.00 35.50      A    N
ATOM  19103  CA  PRO G 242     -46.958  92.964  39.328  1.00 34.40      A    C
ATOM  19104  CB  PRO G 242     -45.471  93.027  39.169  1.00 34.73      A    C
ATOM  19105  CG  PRO G 242     -45.233  94.108  38.268  1.00 35.77      A    C
ATOM  19106  CD  PRO G 242     -46.222  95.078  38.510  1.00 35.26      A    C
ATOM  19107  C   PRO G 242     -47.324  92.750  40.772  1.00 34.66      A    C
ATOM  19108  O   PRO G 242     -47.712  91.683  41.128  1.00 35.25      A    O
ATOM  19109  N   GLU G 243     -47.247  93.770  41.587  1.00 34.74      A    N
ATOM  19110  CA  GLU G 243     -47.586  93.626  42.969  1.00 34.61      A    C
ATOM  19111  CB  GLU G 243     -47.340  94.923  43.670  1.00 35.78      A    C
ATOM  19112  CG  GLU G 243     -46.314  94.849  44.708  1.00 43.78      A    C
ATOM  19113  CD  GLU G 243     -45.057  95.565  44.343  1.00 50.14      A    C
ATOM  19114  OE1 GLU G 243     -44.711  95.639  43.166  1.00 50.71      A    O
ATOM  19115  OE2 GLU G 243     -44.400  96.057  45.249  1.00 54.17      A    O-1
ATOM  19116  C   GLU G 243     -49.010  93.227  43.162  1.00 33.58      A    C
ATOM  19117  O   GLU G 243     -49.311  92.476  44.012  1.00 33.20      A    O
ATOM  19118  N   ARG G 244     -49.889  93.757  42.354  1.00 32.13      A    N
ATOM  19119  CA  ARG G 244     -51.274  93.404  42.402  1.00 30.13      A    C
ATOM  19120  CB  ARG G 244     -52.074  94.657  42.291  1.00 31.21      A    C
ATOM  19121  CG  ARG G 244     -51.870  95.533  43.379  1.00 32.71      A    C
ATOM  19122  CD  ARG G 244     -52.254  96.862  43.008  1.00 41.34      A    C
ATOM  19123  NE  ARG G 244     -51.995  97.739  44.116  1.00 50.11      A    N
ATOM  19124  CZ  ARG G 244     -51.953  99.049  44.044  1.00 54.47      A    C
ATOM  19125  NH1 ARG G 244     -52.150  99.666  42.897  1.00 53.68      A    N
ATOM  19126  NH2 ARG G 244     -51.701  99.733  45.136  1.00 54.75      A    N
ATOM  19127  C   ARG G 244     -51.793  92.415  41.389  1.00 28.95      A    C
ATOM  19128  O   ARG G 244     -52.929  92.080  41.403  1.00 27.93      A    O
ATOM  19129  N   GLY G 245     -50.958  91.957  40.498  1.00 28.66      A    N
ATOM  19130  CA  GLY G 245     -51.410  91.022  39.506  1.00 27.34      A    C
ATOM  19131  C   GLY G 245     -52.545  91.515  38.661  1.00 28.06      A    C
```

Appendix 1

```
ATOM  19132  O    GLY G 245     -53.441  90.785  38.407  1.00  29.65      A  O
ATOM  19133  N    ALA G 246     -52.482  92.768  38.236  1.00  26.83      A  N
ATOM  19134  CA   ALA G 246     -53.519  93.419  37.489  1.00  25.49      A  C
ATOM  19135  CB   ALA G 246     -54.358  94.203  38.380  1.00  24.99      A  C
ATOM  19136  C    ALA G 246     -52.985  94.295  36.383  1.00  26.07      A  C
ATOM  19137  O    ALA G 246     -51.956  94.869  36.496  1.00  26.85      A  O
ATOM  19138  N    PHE G 247     -53.720  94.368  35.295  1.00  25.45      A  N
ATOM  19139  CA   PHE G 247     -53.408  95.237  34.189  1.00  25.60      A  C
ATOM  19140  CB   PHE G 247     -53.952  94.676  32.890  1.00  25.78      A  C
ATOM  19141  CG   PHE G 247     -53.340  93.404  32.488  1.00  24.56      A  C
ATOM  19142  CD1  PHE G 247     -52.094  93.362  32.033  1.00  22.75      A  C
ATOM  19143  CE1  PHE G 247     -51.555  92.221  31.697  1.00  20.81      A  C
ATOM  19144  CZ   PHE G 247     -52.231  91.123  31.810  1.00  18.47      A  C
ATOM  19145  CE2  PHE G 247     -53.455  91.136  32.254  1.00  22.29      A  C
ATOM  19146  CD2  PHE G 247     -54.016  92.248  32.590  1.00  24.59      A  C
ATOM  19147  C    PHE G 247     -53.894  96.649  34.358  1.00  26.22      A  C
ATOM  19148  O    PHE G 247     -54.934  96.897  34.883  1.00  26.60      A  O
ATOM  19149  N    TYR G 248     -53.118  97.572  33.844  1.00  24.88      A  N
ATOM  19150  CA   TYR G 248     -53.519  98.944  33.740  1.00  25.26      A  C
ATOM  19151  CB   TYR G 248     -52.338  99.801  33.427  1.00  24.19      A  C
ATOM  19152  CG   TYR G 248     -51.487  99.994  34.597  1.00  26.68      A  C
ATOM  19153  CD1  TYR G 248     -51.943 100.675  35.667  1.00  27.90      A  C
ATOM  19154  CE1  TYR G 248     -51.203 100.836  36.720  1.00  30.30      A  C
ATOM  19155  CZ   TYR G 248     -49.963 100.305  36.753  1.00  34.56      A  C
ATOM  19156  OH   TYR G 248     -49.191 100.471  37.846  1.00  37.02      A  O
ATOM  19157  CE2  TYR G 248     -49.482  99.613  35.707  1.00  30.03      A  C
ATOM  19158  CD2  TYR G 248     -50.233  99.469  34.642  1.00  27.81      A  C
ATOM  19159  C    TYR G 248     -54.548  99.094  32.674  1.00  25.04      A  C
ATOM  19160  O    TYR G 248     -54.620  98.315  31.785  1.00  25.64      A  O
ATOM  19161  N    LEU G 249     -55.333 100.134  32.759  1.00  26.19      A  N
ATOM  19162  CA   LEU G 249     -56.454 100.296  31.881  1.00  26.82      A  C
ATOM  19163  CB   LEU G 249     -57.175 101.580  32.263  1.00  26.53      A  C
ATOM  19164  CG   LEU G 249     -58.622 101.839  31.924  1.00  26.40      A  C
ATOM  19165  CD1  LEU G 249     -59.475 100.829  32.458  1.00  21.86      A  C
ATOM  19166  CD2  LEU G 249     -59.006 103.135  32.453  1.00  31.61      A  C
ATOM  19167  C    LEU G 249     -56.094 100.345  30.406  1.00  28.05      A  C
ATOM  19168  O    LEU G 249     -56.722  99.680  29.645  1.00  28.18      A  O
ATOM  19169  N    SER G 250     -55.098 101.112  30.006  1.00  27.85      A  N
ATOM  19170  CA   SER G 250     -54.720 101.137  28.631  1.00  28.92      A  C
ATOM  19171  CB   SER G 250     -55.709 101.908  27.807  1.00  28.76      A  C
ATOM  19172  OG   SER G 250     -56.209 102.987  28.490  1.00  29.74      A  O
ATOM  19173  C    SER G 250     -53.347 101.636  28.373  1.00  29.21      A  C
ATOM  19174  O    SER G 250     -52.738 102.162  29.227  1.00  29.47      A  O
ATOM  19175  N    TYR G 251     -52.882 101.451  27.157  1.00  28.95      A  N
ATOM  19176  CA   TYR G 251     -51.617 101.963  26.693  1.00  30.75      A  C
ATOM  19177  CB   TYR G 251     -50.764 100.831  26.184  1.00  30.48      A  C
ATOM  19178  CG   TYR G 251     -49.484 101.248  25.563  1.00  33.44      A  C
ATOM  19179  CD1  TYR G 251     -48.675 102.155  26.173  1.00  38.16      A  C
ATOM  19180  CE1  TYR G 251     -47.524 102.534  25.625  1.00  36.93      A  C
ATOM  19181  CZ   TYR G 251     -47.126 101.999  24.459  1.00  39.90      A  C
ATOM  19182  OH   TYR G 251     -45.938 102.400  23.932  1.00  42.65      A  O
ATOM  19183  CE2  TYR G 251     -47.895 101.087  23.836  1.00  36.31      A  C
ATOM  19184  CD2  TYR G 251     -49.067 100.722  24.384  1.00  34.61      A  C
ATOM  19185  C    TYR G 251     -51.910 102.887  25.551  1.00  31.67      A  C
```

Appendix 1

```
ATOM  19186  O    TYR G 251     -52.812 102.657  24.829  1.00 32.16      A    O
ATOM  19187  N    HIS G 252     -51.167 103.956  25.398  1.00 31.85      A    N
ATOM  19188  CA   HIS G 252     -51.366 104.816  24.259  1.00 34.10      A    C
ATOM  19189  CB   HIS G 252     -52.026 106.064  24.741  1.00 31.99      A    C
ATOM  19190  CG   HIS G 252     -53.171 105.773  25.615  1.00 30.47      A    C
ATOM  19191  ND1  HIS G 252     -54.379 105.379  25.122  1.00 33.66      A    N
ATOM  19192  CE1  HIS G 252     -55.188 105.120  26.118  1.00 33.32      A    C
ATOM  19193  NE2  HIS G 252     -54.532 105.299  27.238  1.00 31.59      A    N
ATOM  19194  CD2  HIS G 252     -53.261 105.683  26.950  1.00 30.45      A    C
ATOM  19195  C    HIS G 252     -50.065 105.095  23.589  1.00 37.76      A    C
ATOM  19196  O    HIS G 252     -49.290 105.885  24.024  1.00 38.35      A    O
ATOM  19197  N    PRO G 253     -49.836 104.400  22.509  1.00 39.80      A    N
ATOM  19198  CA   PRO G 253     -48.522 104.195  21.969  1.00 41.25      A    C
ATOM  19199  CB   PRO G 253     -48.807 103.256  20.818  1.00 41.36      A    C
ATOM  19200  CG   PRO G 253     -49.917 102.557  21.227  1.00 40.86      A    C
ATOM  19201  CD   PRO G 253     -50.788 103.521  21.847  1.00 40.33      A    C
ATOM  19202  C    PRO G 253     -47.838 105.429  21.502  1.00 43.38      A    C
ATOM  19203  O    PRO G 253     -46.654 105.527  21.637  1.00 43.94      A    O
ATOM  19204  N    GLU G 254     -48.551 106.291  20.820  1.00 45.03      A    N
ATOM  19205  CA   GLU G 254     -47.925 107.437  20.240  1.00 45.90      A    C
ATOM  19206  CB   GLU G 254     -48.912 108.121  19.347  1.00 47.85      A    C
ATOM  19207  CG   GLU G 254     -48.581 109.529  19.136  1.00 55.85      A    C
ATOM  19208  CD   GLU G 254     -49.365 110.123  18.039  1.00 66.86      A    C
ATOM  19209  OE1  GLU G 254     -50.431 109.572  17.707  1.00 69.25      A    O
ATOM  19210  OE2  GLU G 254     -48.913 111.155  17.522  1.00 71.42      A    O-1
ATOM  19211  C    GLU G 254     -47.486 108.421  21.235  1.00 44.30      A    C
ATOM  19212  O    GLU G 254     -46.391 108.885  21.221  1.00 45.42      A    O
ATOM  19213  N    SER G 255     -48.410 108.736  22.097  1.00 43.11      A    N
ATOM  19214  CA   SER G 255     -48.198 109.573  23.239  1.00 41.63      A    C
ATOM  19215  CB   SER G 255     -49.501 109.916  23.898  1.00 41.18      A    C
ATOM  19216  OG   SER G 255     -49.457 109.507  25.202  1.00 35.34      A    O
ATOM  19217  C    SER G 255     -47.440 108.761  24.196  1.00 42.01      A    C
ATOM  19218  O    SER G 255     -47.294 107.578  24.072  1.00 41.77      A    O
ATOM  19219  N    GLY G 256     -46.921 109.350  25.210  1.00 42.65      A    N
ATOM  19220  CA   GLY G 256     -46.025 108.459  25.811  1.00 44.79      A    C
ATOM  19221  C    GLY G 256     -46.641 107.166  26.278  1.00 44.36      A    C
ATOM  19222  O    GLY G 256     -46.238 106.190  25.757  1.00 43.37      A    O
ATOM  19223  N    ALA G 257     -47.585 107.083  27.202  1.00 42.65      A    N
ATOM  19224  CA   ALA G 257     -47.918 105.731  27.563  1.00 40.93      A    C
ATOM  19225  CB   ALA G 257     -46.745 105.165  28.246  1.00 40.82      A    C
ATOM  19226  C    ALA G 257     -49.236 105.273  28.246  1.00 39.95      A    C
ATOM  19227  O    ALA G 257     -50.213 105.100  27.578  1.00 40.80      A    O
ATOM  19228  N    VAL G 258     -49.207 105.000  29.550  1.00 36.53      A    N
ATOM  19229  CA   VAL G 258     -50.182 104.146  30.239  1.00 33.65      A    C
ATOM  19230  CB   VAL G 258     -49.456 103.042  30.984  1.00 32.94      A    C
ATOM  19231  CG1  VAL G 258     -50.367 102.079  31.467  1.00 29.45      A    C
ATOM  19232  CG2  VAL G 258     -48.489 102.384  30.126  1.00 33.38      A    C
ATOM  19233  C    VAL G 258     -51.098 104.786  31.255  1.00 32.54      A    C
ATOM  19234  O    VAL G 258     -50.661 105.437  32.135  1.00 32.84      A    O
ATOM  19235  N    LYS G 259     -52.386 104.581  31.134  1.00 31.76      A    N
ATOM  19236  CA   LYS G 259     -53.318 105.126  32.084  1.00 30.77      A    C
ATOM  19237  CB   LYS G 259     -54.723 104.887  31.612  1.00 29.54      A    C
ATOM  19238  CG   LYS G 259     -55.062 105.641  30.431  1.00 27.02      A    C
ATOM  19239  CD   LYS G 259     -56.501 105.895  30.327  1.00 26.66      A    C
```

Appendix 1

```
ATOM  19240  CE   LYS G 259     -56.844  106.523   29.030  1.00 24.09     A  C
ATOM  19241  NZ   LYS G 259     -58.222  106.376   28.734  1.00 23.09     A  N
ATOM  19242  C    LYS G 259     -53.101  104.468   33.397  1.00 31.26     A  C
ATOM  19243  O    LYS G 259     -52.966  103.309   33.455  1.00 31.12     A  O
ATOM  19244  N    PRO G 260     -53.127  105.219   34.465  1.00 31.67     A  N
ATOM  19245  CA   PRO G 260     -52.517  104.826   35.718  1.00 31.89     A  C
ATOM  19246  CB   PRO G 260     -52.051  106.144   36.268  1.00 31.12     A  C
ATOM  19247  CG   PRO G 260     -52.929  107.097   35.703  1.00 31.37     A  C
ATOM  19248  CD   PRO G 260     -53.229  106.669   34.370  1.00 31.61     A  C
ATOM  19249  C    PRO G 260     -53.445  104.114   36.680  1.00 31.84     A  C
ATOM  19250  O    PRO G 260     -53.149  103.950   37.824  1.00 33.51     A  O
ATOM  19251  N    TRP G 261     -54.558  103.662   36.157  1.00 30.76     A  N
ATOM  19252  CA   TRP G 261     -55.517  102.923   36.904  1.00 29.97     A  C
ATOM  19253  CB   TRP G 261     -56.904  103.508   36.682  1.00 30.28     A  C
ATOM  19254  CG   TRP G 261     -57.075  104.909   37.107  1.00 31.93     A  C
ATOM  19255  CD1  TRP G 261     -57.382  105.325   38.322  1.00 33.89     A  C
ATOM  19256  NE1  TRP G 261     -57.453  106.657   38.360  1.00 35.74     A  N
ATOM  19257  CE2  TRP G 261     -57.209  107.149   37.119  1.00 32.33     A  C
ATOM  19258  CD2  TRP G 261     -56.969  106.070   36.303  1.00 31.04     A  C
ATOM  19259  CE3  TRP G 261     -56.683  106.297   34.973  1.00 32.63     A  C
ATOM  19260  CZ3  TRP G 261     -56.658  107.567   34.528  1.00 33.55     A  C
ATOM  19261  CH2  TRP G 261     -56.890  108.623   35.368  1.00 34.44     A  C
ATOM  19262  CZ2  TRP G 261     -57.175  108.436   36.666  1.00 32.09     A  C
ATOM  19263  C    TRP G 261     -55.487  101.502   36.423  1.00 29.23     A  C
ATOM  19264  O    TRP G 261     -55.465  101.247   35.271  1.00 30.01     A  O
ATOM  19265  N    ILE G 262     -55.545  100.581   37.345  1.00 28.22     A  N
ATOM  19266  CA   ILE G 262     -55.695   99.201   37.038  1.00 26.69     A  C
ATOM  19267  CB   ILE G 262     -54.931   98.389   38.019  1.00 26.96     A  C
ATOM  19268  CG1  ILE G 262     -55.359   98.756   39.411  1.00 25.73     A  C
ATOM  19269  CD1  ILE G 262     -55.000   97.794   40.389  1.00 19.33     A  C
ATOM  19270  CG2  ILE G 262     -53.503   98.664   37.872  1.00 26.57     A  C
ATOM  19271  C    ILE G 262     -57.148   98.816   37.083  1.00 25.93     A  C
ATOM  19272  O    ILE G 262     -57.865   99.329   37.866  1.00 24.90     A  O
ATOM  19273  N    SER G 263     -57.554   97.917   36.207  1.00 26.05     A  N
ATOM  19274  CA   SER G 263     -58.932   97.531   36.043  1.00 25.46     A  C
ATOM  19275  CB   SER G 263     -59.390   97.915   34.644  1.00 26.42     A  C
ATOM  19276  OG   SER G 263     -60.451   97.135   34.200  1.00 28.88     A  O
ATOM  19277  C    SER G 263     -59.133   96.073   36.226  1.00 25.99     A  C
ATOM  19278  O    SER G 263     -58.498   95.310   35.600  1.00 27.38     A  O
ATOM  19279  N    ALA G 264     -60.042   95.690   37.091  1.00 25.21     A  N
ATOM  19280  CA   ALA G 264     -60.354   94.303   37.321  1.00 25.13     A  C
ATOM  19281  CB   ALA G 264     -61.239   94.217   38.468  1.00 24.73     A  C
ATOM  19282  C    ALA G 264     -60.936   93.475   36.189  1.00 24.92     A  C
ATOM  19283  O    ALA G 264     -60.486   92.403   35.963  1.00 24.43     A  O
ATOM  19284  N    TYR G 265     -61.935   93.983   35.505  1.00 24.46     A  N
ATOM  19285  CA   TYR G 265     -62.585   93.302   34.410  1.00 24.28     A  C
ATOM  19286  CB   TYR G 265     -63.888   94.014   33.998  1.00 24.42     A  C
ATOM  19287  CG   TYR G 265     -63.750   94.896   32.801  1.00 25.48     A  C
ATOM  19288  CD1  TYR G 265     -63.810   94.384   31.546  1.00 23.10     A  C
ATOM  19289  CE1  TYR G 265     -63.632   95.135   30.517  1.00 23.27     A  C
ATOM  19290  CZ   TYR G 265     -63.408   96.423   30.686  1.00 26.52     A  C
ATOM  19291  OH   TYR G 265     -63.229   97.171   29.614  1.00 31.36     A  O
ATOM  19292  CE2  TYR G 265     -63.334   96.966   31.891  1.00 24.17     A  C
ATOM  19293  CD2  TYR G 265     -63.498   96.217   32.933  1.00 24.22     A  C
```

Appendix 1

```
ATOM   19294  C    TYR G 265     -61.622  93.076  33.254  1.00 24.00      A    C
ATOM   19295  O    TYR G 265     -61.652  92.078  32.611  1.00 24.12      A    O
ATOM   19296  N    THR G 266     -60.753  94.038  33.047  1.00 23.25      A    N
ATOM   19297  CA   THR G 266     -59.766  94.013  32.012  1.00 23.87      A    C
ATOM   19298  CB   THR G 266     -58.924  95.298  32.076  1.00 23.32      A    C
ATOM   19299  OG1  THR G 266     -59.680  96.416  31.660  1.00 24.87      A    O
ATOM   19300  CG2  THR G 266     -57.747  95.208  31.217  1.00 21.60      A    C
ATOM   19301  C    THR G 266     -58.821  92.880  32.253  1.00 24.94      A    C
ATOM   19302  O    THR G 266     -58.526  92.115  31.391  1.00 23.56      A    O
ATOM   19303  N    THR G 267     -58.343  92.816  33.472  1.00 25.79      A    N
ATOM   19304  CA   THR G 267     -57.495  91.767  33.933  1.00 25.48      A    C
ATOM   19305  CB   THR G 267     -57.021  92.069  35.349  1.00 26.48      A    C
ATOM   19306  OG1  THR G 267     -56.571  93.399  35.397  1.00 22.38      A    O
ATOM   19307  CG2  THR G 267     -55.942  91.197  35.723  1.00 26.12      A    C
ATOM   19308  C    THR G 267     -58.161  90.441  33.959  1.00 25.36      A    C
ATOM   19309  O    THR G 267     -57.600  89.485  33.562  1.00 25.36      A    O
ATOM   19310  N    ALA G 268     -59.374  90.390  34.446  1.00 24.89      A    N
ATOM   19311  CA   ALA G 268     -60.075  89.138  34.511  1.00 25.06      A    C
ATOM   19312  CB   ALA G 268     -61.408  89.331  35.163  1.00 23.28      A    C
ATOM   19313  C    ALA G 268     -60.283  88.537  33.156  1.00 26.53      A    C
ATOM   19314  O    ALA G 268     -60.079  87.371  32.972  1.00 28.77      A    O
ATOM   19315  N    TRP G 269     -60.721  89.338  32.211  1.00 25.41      A    N
ATOM   19316  CA   TRP G 269     -60.916  88.869  30.875  1.00 25.51      A    C
ATOM   19317  CB   TRP G 269     -61.714  89.909  30.087  1.00 26.69      A    C
ATOM   19318  CG   TRP G 269     -61.730  89.893  28.615  1.00 29.83      A    C
ATOM   19319  CD1  TRP G 269     -61.065  89.076  27.790  1.00 35.53      A    C
ATOM   19320  NE1  TRP G 269     -61.313  89.379  26.512  1.00 33.01      A    N
ATOM   19321  CE2  TRP G 269     -62.153  90.445  26.474  1.00 34.76      A    C
ATOM   19322  CD2  TRP G 269     -62.435  90.794  27.780  1.00 35.82      A    C
ATOM   19323  CE3  TRP G 269     -63.274  91.882  28.015  1.00 34.83      A    C
ATOM   19324  CZ3  TRP G 269     -63.776  92.532  26.977  1.00 32.48      A    C
ATOM   19325  CH2  TRP G 269     -63.488  92.156  25.692  1.00 35.29      A    C
ATOM   19326  CZ2  TRP G 269     -62.672  91.121  25.418  1.00 32.64      A    C
ATOM   19327  C    TRP G 269     -59.631  88.478  30.233  1.00 25.56      A    C
ATOM   19328  O    TRP G 269     -59.556  87.447  29.658  1.00 25.45      A    O
ATOM   19329  N    THR G 270     -58.600  89.278  30.344  1.00 25.56      A    N
ATOM   19330  CA   THR G 270     -57.359  88.936  29.689  1.00 25.69      A    C
ATOM   19331  CB   THR G 270     -56.283  89.990  29.887  1.00 24.50      A    C
ATOM   19332  OG1  THR G 270     -56.785  91.251  29.562  1.00 22.96      A    O
ATOM   19333  CG2  THR G 270     -55.159  89.731  29.024  1.00 23.43      A    C
ATOM   19334  C    THR G 270     -56.752  87.650  30.191  1.00 27.01      A    C
ATOM   19335  O    THR G 270     -56.332  86.854  29.448  1.00 24.85      A    O
ATOM   19336  N    LEU G 271     -56.650  87.466  31.474  1.00 28.90      A    N
ATOM   19337  CA   LEU G 271     -56.030  86.260  31.912  1.00 30.09      A    C
ATOM   19338  CB   LEU G 271     -55.168  86.440  33.167  1.00 31.43      A    C
ATOM   19339  CG   LEU G 271     -55.539  86.232  34.594  1.00 33.47      A    C
ATOM   19340  CD1  LEU G 271     -54.977  87.328  35.389  1.00 28.56      A    C
ATOM   19341  CD2  LEU G 271     -56.961  86.178  34.683  1.00 33.18      A    C
ATOM   19342  C    LEU G 271     -56.775  84.964  31.722  1.00 29.78      A    C
ATOM   19343  O    LEU G 271     -56.188  83.947  31.552  1.00 28.98      A    O
ATOM   19344  N    ALA G 272     -58.080  85.026  31.681  1.00 30.10      A    N
ATOM   19345  CA   ALA G 272     -58.856  83.872  31.378  1.00 29.64      A    C
ATOM   19346  CB   ALA G 272     -60.255  84.230  31.428  1.00 29.94      A    C
ATOM   19347  C    ALA G 272     -58.526  83.432  30.004  1.00 30.48      A    C
```

Appendix 1

```
ATOM  19348  O    ALA G 272    -58.429  82.282  29.728  1.00  31.14    A  O
ATOM  19349  N    MET G 273    -58.413  84.390  29.125  1.00  29.50    A  N
ATOM  19350  CA   MET G 273    -58.072  84.161  27.766  1.00  31.49    A  C
ATOM  19351  CB   MET G 273    -58.323  85.430  27.001  1.00  30.78    G  C
ATOM  19352  CG   MET G 273    -58.627  85.246  25.595  1.00  34.80    G  C
ATOM  19353  SD   MET G 273    -60.153  85.962  25.051  1.00  43.28    G  S
ATOM  19354  CE   MET G 273    -61.247  85.121  26.078  1.00  41.14    G  C
ATOM  19355  C    MET G 273    -56.658  83.661  27.558  1.00  32.59    A  C
ATOM  19356  O    MET G 273    -56.422  82.779  26.782  1.00  33.80    A  O
ATOM  19357  N    VAL G 274    -55.719  84.250  28.263  1.00  31.91    A  N
ATOM  19358  CA   VAL G 274    -54.326  83.885  28.189  1.00  31.68    A  C
ATOM  19359  CB   VAL G 274    -53.447  84.833  28.998  1.00  31.60    A  C
ATOM  19360  CG1  VAL G 274    -52.130  84.273  29.129  1.00  31.16    A  C
ATOM  19361  CG2  VAL G 274    -53.329  86.132  28.337  1.00  30.69    A  C
ATOM  19362  C    VAL G 274    -54.110  82.459  28.659  1.00  32.49    A  C
ATOM  19363  O    VAL G 274    -53.275  81.763  28.180  1.00  31.51    A  O
ATOM  19364  N    HIS G 275    -54.932  82.041  29.578  1.00  31.79    A  N
ATOM  19365  CA   HIS G 275    -54.804  80.762  30.157  1.00  32.68    A  C
ATOM  19366  CB   HIS G 275    -55.862  80.604  31.208  1.00  33.60    A  C
ATOM  19367  CG   HIS G 275    -55.680  79.423  32.086  1.00  35.04    A  C
ATOM  19368  ND1  HIS G 275    -56.572  78.389  32.116  1.00  36.03    A  N
ATOM  19369  CE1  HIS G 275    -56.171  77.493  32.987  1.00  38.44    A  C
ATOM  19370  NE2  HIS G 275    -55.053  77.912  33.526  1.00  39.40    A  N
ATOM  19371  CD2  HIS G 275    -54.728  79.121  32.983  1.00  37.32    A  C
ATOM  19372  C    HIS G 275    -54.961  79.759  29.069  1.00  33.11    A  C
ATOM  19373  O    HIS G 275    -54.376  78.716  29.107  1.00  33.61    A  O
ATOM  19374  N    GLY G 276    -55.794  80.056  28.102  1.00  33.21    A  N
ATOM  19375  CA   GLY G 276    -55.915  79.178  26.977  1.00  33.72    A  C
ATOM  19376  C    GLY G 276    -54.670  79.049  26.166  1.00  34.47    A  C
ATOM  19377  O    GLY G 276    -54.362  77.996  25.757  1.00  35.05    A  O
ATOM  19378  N    MET G 277    -54.011  80.144  25.852  1.00  35.45    A  N
ATOM  19379  CA   MET G 277    -52.670  80.146  25.292  1.00  34.61    A  C
ATOM  19380  CB   MET G 277    -52.407  81.470  24.617  1.00  33.57    G  C
ATOM  19381  CG   MET G 277    -53.368  81.775  23.560  1.00  35.12    G  C
ATOM  19382  SD   MET G 277    -53.578  83.479  23.280  1.00  42.87    G  S
ATOM  19383  CE   MET G 277    -51.962  83.984  23.085  1.00  45.33    G  C
ATOM  19384  C    MET G 277    -51.489  79.790  26.180  1.00  35.04    A  C
ATOM  19385  O    MET G 277    -50.624  79.071  25.775  1.00  35.70    A  O
ATOM  19386  N    ASP G 278    -51.416  80.368  27.366  1.00  34.21    A  N
ATOM  19387  CA   ASP G 278    -50.324  80.089  28.269  1.00  33.34    A  C
ATOM  19388  CB   ASP G 278    -49.282  81.154  28.137  1.00  33.59    A  C
ATOM  19389  CG   ASP G 278    -48.075  80.875  28.955  1.00  36.03    A  C
ATOM  19390  OD1  ASP G 278    -47.936  79.801  29.512  1.00  38.06    A  O
ATOM  19391  OD2  ASP G 278    -47.241  81.745  29.034  1.00  35.37    A  O-1
ATOM  19392  C    ASP G 278    -50.686  79.977  29.721  1.00  32.91    A  C
ATOM  19393  O    ASP G 278    -50.594  80.912  30.438  1.00  34.26    A  O
ATOM  19394  N    PRO G 279    -50.983  78.789  30.177  1.00  31.40    A  N
ATOM  19395  CA   PRO G 279    -51.535  78.587  31.494  1.00  30.83    A  C
ATOM  19396  CB   PRO G 279    -51.611  77.076  31.567  1.00  30.81    A  C
ATOM  19397  CG   PRO G 279    -51.676  76.667  30.281  1.00  28.37    A  C
ATOM  19398  CD   PRO G 279    -50.829  77.509  29.507  1.00  30.47    A  C
ATOM  19399  C    PRO G 279    -50.655  79.099  32.608  1.00  31.45    A  C
ATOM  19400  O    PRO G 279    -51.130  79.522  33.620  1.00  32.98    A  O
ATOM  19401  N    ALA G 280    -49.367  78.999  32.422  1.00  30.23    A  N
```

Appendix 1

```
ATOM  19402  CA   ALA G 280     -48.419  79.377  33.418  1.00 29.88      A    C
ATOM  19403  CB   ALA G 280     -47.065  78.921  33.019  1.00 28.68      A    C
ATOM  19404  C    ALA G 280     -48.435  80.853  33.736  1.00 30.12      A    C
ATOM  19405  O    ALA G 280     -48.308  81.208  34.864  1.00 29.50      A    O
ATOM  19406  N    PHE G 281     -48.591  81.693  32.720  1.00 30.13      A    N
ATOM  19407  CA   PHE G 281     -48.721  83.132  32.862  1.00 29.76      A    C
ATOM  19408  CB   PHE G 281     -48.730  83.768  31.475  1.00 28.52      A    C
ATOM  19409  CG   PHE G 281     -48.905  85.243  31.468  1.00 26.53      A    C
ATOM  19410  CD1  PHE G 281     -47.913  86.056  31.014  1.00 21.92      A    C
ATOM  19411  CE1  PHE G 281     -48.069  87.387  31.006  1.00 21.07      A    C
ATOM  19412  CZ   PHE G 281     -49.216  87.924  31.429  1.00 19.96      A    C
ATOM  19413  CE2  PHE G 281     -50.214  87.136  31.870  1.00 19.05      A    C
ATOM  19414  CD2  PHE G 281     -50.070  85.815  31.887  1.00 19.20      A    C
ATOM  19415  C    PHE G 281     -49.967  83.514  33.621  1.00 30.46      A    C
ATOM  19416  O    PHE G 281     -49.935  84.286  34.510  1.00 31.10      A    O
ATOM  19417  N    SER G 282     -51.074  82.920  33.288  1.00 30.86      A    N
ATOM  19418  CA   SER G 282     -52.266  83.168  34.036  1.00 31.67      A    C
ATOM  19419  CB   SER G 282     -53.459  82.620  33.311  1.00 30.69      A    C
ATOM  19420  OG   SER G 282     -53.865  83.566  32.408  1.00 30.89      A    O
ATOM  19421  C    SER G 282     -52.211  92.722  35.485  1.00 32.46      A    C
ATOM  19422  O    SER G 282     -52.697  83.385  36.336  1.00 33.45      A    O
ATOM  19423  N    GLU G 283     -51.606  81.582  35.730  1.00 34.28      A    N
ATOM  19424  CA   GLU G 283     -51.406  81.015  37.043  1.00 35.34      A    C
ATOM  19425  CB   GLU G 283     -50.826  79.620  36.897  1.00 36.85      A    C
ATOM  19426  CG   GLU G 283     -51.845  78.528  36.951  1.00 43.61      A    C
ATOM  19427  CD   GLU G 283     -51.637  77.410  35.940  1.00 52.91      A    C
ATOM  19428  OE1  GLU G 283     -50.508  76.966  35.730  1.00 53.63      A    O
ATOM  19429  OE2  GLU G 283     -52.628  76.954  35.368  1.00 53.57      A    O-1
ATOM  19430  C    GLU G 283     -50.540  81.891  37.944  1.00 33.82      A    C
ATOM  19431  O    GLU G 283     -50.743  81.993  39.126  1.00 32.99      A    O
ATOM  19432  N    ARG G 284     -49.581  82.538  37.334  1.00 33.04      A    N
ATOM  19433  CA   ARG G 284     -48.653  83.374  38.010  1.00 31.72      A    C
ATOM  19434  CB   ARG G 284     -47.651  83.842  36.977  1.00 31.76      A    C
ATOM  19435  CG   ARG G 284     -46.599  84.787  37.433  1.00 35.90      A    C
ATOM  19436  CD   ARG G 284     -45.228  84.300  37.133  1.00 39.02      A    C
ATOM  19437  NE   ARG G 284     -44.433  85.307  36.479  1.00 46.38      A    N
ATOM  19438  CZ   ARG G 284     -43.138  85.191  36.234  1.00 49.55      A    C
ATOM  19439  NH1  ARG G 284     -42.501  84.110  36.597  1.00 44.53      A    N
ATOM  19440  NH2  ARG G 284     -42.480  86.169  35.640  1.00 44.51      A    N
ATOM  19441  C    ARG G 284     -49.340  84.532  38.705  1.00 30.14      A    C
ATOM  19442  O    ARG G 284     -49.022  84.829  39.799  1.00 29.32      A    O
ATOM  19443  N    TYR G 285     -50.304  85.170  38.086  1.00 29.60      A    N
ATOM  19444  CA   TYR G 285     -50.970  86.313  38.673  1.00 28.77      A    C
ATOM  19445  CB   TYR G 285     -51.146  87.362  37.597  1.00 28.67      A    C
ATOM  19446  CG   TYR G 285     -49.891  87.717  36.934  1.00 27.58      A    C
ATOM  19447  CD1  TYR G 285     -48.987  98.486  37.545  1.00 26.60      A    C
ATOM  19448  CE1  TYR G 285     -47.863  88.791  36.950  1.00 29.20      A    C
ATOM  19449  CZ   TYR G 285     -47.609  88.334  35.739  1.00 28.39      A    C
ATOM  19450  OH   TYR G 285     -46.458  88.648  35.156  1.00 29.59      A    O
ATOM  19451  CE2  TYR G 285     -48.473  87.565  35.119  1.00 28.98      A    C
ATOM  19452  CD2  TYR G 285     -49.602  87.258  35.706  1.00 28.82      A    C
ATOM  19453  C    TYR G 285     -52.310  86.106  39.354  1.00 27.38      A    C
ATOM  19454  O    TYR G 285     -52.787  86.967  39.996  1.00 28.82      A    O
ATOM  19455  N    TYR G 286     -52.919  84.967  39.191  1.00 26.68      A    N
```

Appendix 1

```
ATOM  19456  CA   TYR G 286     -54.288  84.799  39.557  1.00 26.83      A  C
ATOM  19457  CB   TYR G 286     -54.792  83.436  39.092  1.00 26.65      A  C
ATOM  19458  CG   TYR G 286     -56.169  83.078  39.533  1.00 25.90      A  C
ATOM  19459  CD1  TYR G 286     -57.234  83.826  39.171  1.00 28.09      A  C
ATOM  19460  CE1  TYR G 286     -58.468  83.523  39.587  1.00 27.76      A  C
ATOM  19461  CZ   TYR G 286     -58.663  82.451  40.356  1.00 25.89      A  C
ATOM  19462  OH   TYR G 286     -59.898  82.114  40.754  1.00 29.67      A  O
ATOM  19463  CE2  TYR G 286     -57.630  81.700  40.727  1.00 25.65      A  C
ATOM  19464  CD2  TYR G 286     -56.399  82.002  40.317  1.00 26.03      A  C
ATOM  19465  C    TYR G 286     -54.512  84.987  41.022  1.00 27.61      A  C
ATOM  19466  O    TYR G 286     -55.486  85.533  41.425  1.00 28.21      A  O
ATOM  19467  N    PRO G 287     -53.611  84.488  41.837  1.00 28.51      A  N
ATOM  19468  CA   PRO G 287     -53.720  84.690  43.260  1.00 28.14      A  C
ATOM  19469  CB   PRO G 287     -52.590  83.846  43.775  1.00 27.35      A  C
ATOM  19470  CG   PRO G 287     -52.479  82.848  42.845  1.00 28.45      A  C
ATOM  19471  CD   PRO G 287     -52.619  83.455  41.572  1.00 27.28      A  C
ATOM  19472  C    PRO G 287     -53.594  86.133  43.673  1.00 28.41      A  C
ATOM  19473  O    PRO G 287     -54.323  86.539  44.505  1.00 30.30      A  O
ATOM  19474  N    ARG G 288     -52.689  86.878  43.084  1.00 26.28      A  N
ATOM  19475  CA   ARG G 288     -52.561  88.285  43.313  1.00 26.22      A  C
ATOM  19476  CB   ARG G 288     -51.332  88.804  42.616  1.00 25.11      A  C
ATOM  19477  CG   ARG G 288     -50.118  88.739  43.436  1.00 24.39      A  C
ATOM  19478  CD   ARG G 288     -48.961  89.004  42.621  1.00 25.11      A  C
ATOM  19479  NE   ARG G 288     -48.409  87.836  42.000  1.00 20.02      A  N
ATOM  19480  CZ   ARG G 288     -47.400  87.878  41.170  1.00 23.15      A  C
ATOM  19481  NH1  ARG G 288     -46.855  89.009  40.899  1.00 22.53      A  N
ATOM  19482  NH2  ARG G 288     -46.924  86.800  40.642  1.00 17.69      A  N
ATOM  19483  C    ARG G 288     -53.765  89.075  42.882  1.00 27.03      A  C
ATOM  19484  O    ARG G 288     -54.168  89.972  43.553  1.00 26.86      A  O
ATOM  19485  N    PHE G 289     -54.359  98.712  41.766  1.00 26.62      A  N
ATOM  19486  CA   PHE G 289     -55.542  89.369  41.301  1.00 24.77      A  C
ATOM  19487  CB   PHE G 289     -55.955  88.737  39.986  1.00 24.32      A  C
ATOM  19488  CG   PHE G 289     -57.320  89.073  39.563  1.00 22.93      A  C
ATOM  19489  CD1  PHE G 289     -57.581  90.233  38.924  1.00 24.61      A  C
ATOM  19490  CE1  PHE G 289     -58.794  90.532  38.567  1.00 24.37      A  C
ATOM  19491  CZ   PHE G 289     -59.774  89.708  38.823  1.00 24.48      A  C
ATOM  19492  CE2  PHE G 289     -59.544  88.563  39.445  1.00 25.94      A  C
ATOM  19493  CD2  PHE G 289     -58.336  88.242  39.806  1.00 19.67      A  C
ATOM  19494  C    PHE G 289     -56.643  89.204  42.301  1.00 24.93      A  C
ATOM  19495  O    PHE G 289     -57.363  90.118  42.582  1.00 22.72      A  O
ATOM  19496  N    LYS G 290     -56.760  88.017  42.843  1.00 25.49      A  N
ATOM  19497  CA   LYS G 290     -57.789  87.757  43.783  1.00 27.59      A  C
ATOM  19498  CB   LYS G 290     -57.715  86.319  44.205  1.00 27.96      A  C
ATOM  19499  CG   LYS G 290     -58.394  85.378  43.313  1.00 30.78      A  C
ATOM  19500  CD   LYS G 290     -57.857  84.017  43.488  1.00 34.18      A  C
ATOM  19501  CE   LYS G 290     -58.778  83.272  44.320  1.00 40.77      A  C
ATOM  19502  NZ   LYS G 290     -58.476  81.868  44.399  1.00 44.98      A  N
ATOM  19503  C    LYS G 290     -57.652  88.596  45.017  1.00 29.39      A  C
ATOM  19504  O    LYS G 290     -58.592  89.100  45.531  1.00 29.76      A  O
ATOM  19505  N    GLN G 291     -56.451  88.690  45.524  1.00 30.54      A  N
ATOM  19506  CA   GLN G 291     -56.171  89.463  46.682  1.00 31.22      A  C
ATOM  19507  CB   GLN G 291     -54.748  89.175  47.062  1.00 31.94      A  C
ATOM  19508  CG   GLN G 291     -54.182  89.873  48.201  1.00 38.81      A  C
ATOM  19509  CD   GLN G 291     -52.699  89.723  48.178  1.00 50.17      A  C
```

Appendix 1

```
ATOM  19510  OE1  GLN  G  291  -52.094  89.664  47.118  1.00  53.88  A  O
ATOM  19511  NE2  GLN  G  291  -52.097  89.634  49.340  1.00  49.69  A  N
ATOM  19512  C    GLN  G  291  -56.418  90.932  46.465  1.00  31.04  A  C
ATOM  19513  O    GLN  G  291  -56.996  91.555  47.294  1.00  32.97  A  O
ATOM  19514  N    THR  G  292  -56.012  91.478  45.343  1.00  28.41  A  N
ATOM  19515  CA   THR  G  292  -56.286  92.855  45.039  1.00  27.73  A  C
ATOM  19516  CB   THR  G  292  -55.589  93.209  43.716  1.00  28.68  A  C
ATOM  19517  OG1  THR  G  292  -54.212  92.963  43.840  1.00  25.12  A  O
ATOM  19518  CG2  THR  G  292  -55.781  94.607  43.350  1.00  26.58  A  C
ATOM  19519  C    THR  G  292  -57.744  93.264  44.887  1.00  28.82  A  C
ATOM  19520  O    THR  G  292  -58.161  94.231  45.452  1.00  28.80  A  O
ATOM  19521  N    PHE  G  293  -58.507  92.543  44.093  1.00  28.16  A  N
ATOM  19522  CA   PHE  G  293  -59.820  92.983  43.678  1.00  26.30  A  C
ATOM  19523  CB   PHE  G  293  -59.941  92.820  42.176  1.00  25.51  A  C
ATOM  19524  CG   PHE  G  293  -59.139  93.763  41.370  1.00  23.40  A  C
ATOM  19525  CD1  PHE  G  293  -59.284  95.099  41.485  1.00  20.78  A  C
ATOM  19526  CE1  PHE  G  293  -58.571  95.913  40.711  1.00  21.84  A  C
ATOM  19527  CZ   PHE  G  293  -57.753  95.422  39.801  1.00  19.27  A  C
ATOM  19528  CE2  PHE  G  293  -57.618  94.128  39.660  1.00  21.90  A  C
ATOM  19529  CD2  PHE  G  293  -58.303  93.300  40.425  1.00  21.23  A  C
ATOM  19530  C    PHE  G  293  -61.029  92.322  44.327  1.00  26.31  A  C
ATOM  19531  O    PHE  G  293  -62.065  92.901  44.382  1.00  25.29  A  O
ATOM  19532  N    VAL  G  294  -60.911  91.100  44.799  1.00  25.74  A  N
ATOM  19533  CA   VAL  G  294  -62.060  90.345  45.285  1.00  26.57  A  C
ATOM  19534  CB   VAL  G  294  -61.873  88.869  45.016  1.00  26.66  A  C
ATOM  19535  CG1  VAL  G  294  -62.963  88.061  45.588  1.00  27.45  A  C
ATOM  19536  CG2  VAL  G  294  -61.730  88.624  43.620  1.00  24.49  A  C
ATOM  19537  C    VAL  G  294  -62.366  90.495  46.761  1.00  27.20  A  C
ATOM  19538  O    VAL  G  294  -61.497  90.404  47.561  1.00  25.45  A  O
ATOM  19539  N    GLU  G  295  -63.631  90.714  47.089  1.00  28.30  A  N
ATOM  19540  CA   GLU  G  295  -64.126  90.779  48.453  1.00  29.69  A  C
ATOM  19541  CB   GLU  G  295  -64.886  92.076  48.612  1.00  29.00  A  C
ATOM  19542  CG   GLU  G  295  -65.525  92.253  49.935  1.00  33.75  A  C
ATOM  19543  CD   GLU  G  295  -66.650  93.259  49.951  1.00  43.68  A  C
ATOM  19544  OE1  GLU  G  295  -66.740  94.090  49.057  1.00  44.79  A  O
ATOM  19545  OE2  GLU  G  295  -67.456  93.237  50.880  1.00  46.82  A  O-1
ATOM  19546  C    GLU  G  295  -65.080  89.644  48.813  1.00  29.76  A  C
ATOM  19547  O    GLU  G  295  -66.110  89.552  48.249  1.00  30.26  A  O
ATOM  19548  N    VAL  G  296  -64.767  88.816  49.792  1.00  31.10  A  N
ATOM  19549  CA   VAL  G  296  -65.714  87.804  50.276  1.00  32.37  A  C
ATOM  19550  CB   VAL  G  296  -64.991  86.571  50.700  1.00  32.06  A  C
ATOM  19551  CG1  VAL  G  296  -65.894  85.616  51.277  1.00  28.19  A  C
ATOM  19552  CG2  VAL  G  296  -64.324  85.996  49.548  1.00  29.97  A  C
ATOM  19553  C    VAL  G  296  -66.639  88.320  51.377  1.00  34.43  A  C
ATOM  19554  O    VAL  G  296  -66.215  89.003  52.264  1.00  36.45  A  O
ATOM  19555  N    TYR  G  297  -67.920  88.020  51.293  1.00  36.36  A  N
ATOM  19556  CA   TYR  G  297  -68.848  88.653  52.191  1.00  36.73  A  C
ATOM  19557  CB   TYR  G  297  -69.331  89.961  51.570  1.00  36.06  A  C
ATOM  19558  CG   TYR  G  297  -70.370  89.851  50.496  1.00  33.91  A  C
ATOM  19559  CD1  TYR  G  297  -71.686  90.068  50.770  1.00  26.19  A  C
ATOM  19560  CE1  TYR  G  297  -72.604  89.993  49.821  1.00  27.53  A  C
ATOM  19561  CZ   TYR  G  297  -72.240  89.725  48.572  1.00  28.21  A  C
ATOM  19562  OH   TYR  G  297  -73.192  89.650  47.648  1.00  28.45  A  O
ATOM  19563  CE2  TYR  G  297  -70.957  89.529  48.251  1.00  30.26  A  C
```

Appendix 1

```
ATOM  19564  CD2 TYR G 297    -70.025  89.594  49.200  1.00  31.18    A  C
ATOM  19565  C   TYR G 297    -70.012  87.933  52.852  1.00  39.00    A  C
ATOM  19566  O   TYR G 297    -70.507  88.386  53.839  1.00  40.59    A  O
ATOM  19567  N   ASP G 298    -70.563  86.885  52.327  1.00  41.16    A  N
ATOM  19568  CA  ASP G 298    -71.700  86.397  53.098  1.00  42.72    A  C
ATOM  19569  CB  ASP G 298    -72.788  85.789  52.224  1.00  44.48    A  C
ATOM  19570  CG  ASP G 298    -74.085  85.750  52.897  1.00  45.46    A  C
ATOM  19571  OD1 ASP G 298    -74.145  86.239  54.007  1.00  47.94    A  O
ATOM  19572  OD2 ASP G 298    -75.037  85.242  52.323  1.00  47.59    A  O
ATOM  19573  C   ASP G 298    -71.265  85.382  54.081  1.00  42.03    A  C
ATOM  19574  O   ASP G 298    -71.636  84.260  53.970  1.00  42.26    A  O
ATOM  19575  N   GLU G 299    -70.432  85.764  55.019  1.00  41.12    A  N
ATOM  19576  CA  GLU G 299    -69.867  84.819  55.922  1.00  41.19    A  C
ATOM  19577  CB  GLU G 299    -70.949  84.209  56.794  1.00  42.12    A  C
ATOM  19578  CG  GLU G 299    -71.593  85.175  57.749  1.00  47.24    A  C
ATOM  19579  CD  GLU G 299    -71.856  84.600  59.105  1.00  54.17    A  C
ATOM  19580  OE1 GLU G 299    -70.953  84.596  59.945  1.00  56.70    A  O
ATOM  19581  OE2 GLU G 299    -72.986  84.181  59.350  1.00  57.44    A  O
ATOM  19582  C   GLU G 299    -69.188  83.786  55.085  1.00  39.33    A  C
ATOM  19583  O   GLU G 299    -69.192  82.629  55.388  1.00  39.92    A  O
ATOM  19584  N   GLY G 300    -68.604  84.237  54.004  1.00  38.06    A  N
ATOM  19585  CA  GLY G 300    -67.923  83.391  53.060  1.00  36.12    A  C
ATOM  19586  C   GLY G 300    -68.712  82.763  51.945  1.00  35.61    A  C
ATOM  19587  O   GLY G 300    -68.155  82.065  51.176  1.00  35.34    A  O
ATOM  19588  N   ARG G 301    -70.010  82.975  51.909  1.00  35.37    A  N
ATOM  19589  CA  ARG G 301    -70.934  82.610  50.835  1.00  36.37    A  C
ATOM  19590  CB  ARG G 301    -72.335  82.724  51.344  1.00  37.69    A  C
ATOM  19591  CG  ARG G 301    -72.484  82.212  52.714  1.00  40.76    A  C
ATOM  19592  CD  ARG G 301    -73.852  81.806  52.958  1.00  42.61    A  C
ATOM  19593  NE  ARG G 301    -73.917  81.164  54.227  1.00  51.21    A  N
ATOM  19594  CZ  ARG G 301    -74.208  81.798  55.340  1.00  54.66    A  C
ATOM  19595  NH1 ARG G 301    -74.474  83.077  55.320  1.00  53.33    A  N
ATOM  19596  NH2 ARG G 301    -74.225  81.148  56.474  1.00  57.15    A  N
ATOM  19597  C   ARG G 301    -70.861  83.295  49.480  1.00  36.18    A  C
ATOM  19598  O   ARG G 301    -71.166  82.729  48.482  1.00  35.82    A  O
ATOM  19599  N   LYS G 302    -70.496  84.552  49.500  1.00  36.03    A  N
ATOM  19600  CA  LYS G 302    -70.599  85.412  48.382  1.00  34.75    A  C
ATOM  19601  CB  LYS G 302    -71.699  86.406  48.650  1.00  33.97    A  C
ATOM  19602  CG  LYS G 302    -73.051  85.879  48.449  1.00  32.36    A  C
ATOM  19603  CD  LYS G 302    -74.063  86.731  49.067  1.00  29.04    A  C
ATOM  19604  CE  LYS G 302    -75.371  86.100  49.014  1.00  28.04    A  C
ATOM  19605  NZ  LYS G 302    -76.306  86.878  49.734  1.00  32.12    A  N
ATOM  19606  C   LYS G 302    -69.307  86.139  48.160  1.00  34.57    A  C
ATOM  19607  O   LYS G 302    -68.505  86.256  49.027  1.00  34.83    A  O
ATOM  19608  N   ALA G 303    -69.134  86.602  46.949  1.00  33.26    A  N
ATOM  19609  CA  ALA G 303    -68.037  87.427  46.565  1.00  31.65    A  C
ATOM  19610  CB  ALA G 303    -67.007  86.606  45.928  1.00  31.30    A  C
ATOM  19611  C   ALA G 303    -68.553  88.462  45.594  1.00  30.54    A  C
ATOM  19612  O   ALA G 303    -69.451  88.201  44.865  1.00  29.94    A  O
ATOM  19613  N   ARG G 304    -67.977  89.643  45.616  1.00  29.48    A  N
ATOM  19614  CA  ARG G 304    -68.244  90.675  44.638  1.00  27.92    A  C
ATOM  19615  CB  ARG G 304    -69.224  91.717  45.160  1.00  26.79    A  C
ATOM  19616  CG  ARG G 304    -68.804  92.379  46.386  1.00  26.67    A  C
ATOM  19617  CD  ARG G 304    -69.794  93.313  46.915  1.00  28.87    A  C
```

Appendix 1

```
ATOM  19618  NE   ARG G 304    -69.518  93.553  48.312  1.00 34.04      A  N
ATOM  19619  CZ   ARG G 304    -70.431  93.621  49.259  1.00 38.19      A  C
ATOM  19620  NH1  ARG G 304    -71.694  93.510  48.964  1.00 39.12      A  N
ATOM  19621  NH2  ARG G 304    -70.081  93.807  50.503  1.00 36.18      A  N
ATOM  19622  C    ARG G 304    -66.886  91.249  44.303  1.00 27.58      A  C
ATOM  19623  O    ARG G 304    -65.981  91.056  45.029  1.00 28.78      A  O
ATOM  19624  N    VAL G 305    -66.719  91.913  43.183  1.00 26.62      A  N
ATOM  19625  CA   VAL G 305    -65.401  92.362  42.773  1.00 24.78      A  C
ATOM  19626  CB   VAL G 305    -64.946  91.581  41.553  1.00 25.61      A  C
ATOM  19627  CG1  VAL G 305    -63.618  92.006  41.074  1.00 23.49      A  C
ATOM  19628  CG2  VAL G 305    -64.959  90.162  41.836  1.00 23.85      A  C
ATOM  19629  C    VAL G 305    -65.283  93.852  42.512  1.00 24.64      A  C
ATOM  19630  O    VAL G 305    -66.065  94.422  41.820  1.00 24.31      A  O
ATOM  19631  N    ARG G 306    -64.256  94.470  43.042  1.00 24.87      A  N
ATOM  19632  CA   ARG G 306    -63.973  95.868  42.799  1.00 25.07      A  C
ATOM  19633  CB   ARG G 306    -63.079  96.399  43.903  1.00 24.57      A  C
ATOM  19634  CG   ARG G 306    -63.543  96.178  45.257  1.00 22.63      A  C
ATOM  19635  CD   ARG G 306    -62.607  96.775  46.249  1.00 26.54      A  C
ATOM  19636  NE   ARG G 306    -61.456  95.940  46.476  1.00 30.64      A  N
ATOM  19637  CZ   ARG G 306    -61.384  94.970  47.369  1.00 32.40      A  C
ATOM  19638  NH1  ARG G 306    -62.380  94.721  48.160  1.00 26.49      A  N
ATOM  19639  NH2  ARG G 306    -60.304  94.252  47.459  1.00 28.86      A  N
ATOM  19640  C    ARG G 306    -63.311  96.105  41.475  1.00 24.19      A  C
ATOM  19641  O    ARG G 306    -62.480  95.377  41.106  1.00 23.20      A  O
ATOM  19642  N    GLU G 307    -63.722  97.110  40.744  1.00 25.92      A  N
ATOM  19643  CA   GLU G 307    -63.116  97.444  39.459  1.00 26.86      A  C
ATOM  19644  CB   GLU G 307    -64.064  98.311  38.617  1.00 26.75      A  C
ATOM  19645  CG   GLU G 307    -63.516  98.908  37.338  1.00 27.08      A  C
ATOM  19646  CD   GLU G 307    -62.962  97.912  36.356  1.00 27.94      A  C
ATOM  19647  OE1  GLU G 307    -63.094  96.749  36.563  1.00 27.84      A  O
ATOM  19648  OE2  GLU G 307    -62.373  98.285  35.372  1.00 28.06      A  O
ATOM  19649  C    GLU G 307    -61.682  97.981  39.499  1.00 27.42      A  C
ATOM  19650  O    GLU G 307    -60.904  97.705  38.648  1.00 26.95      A  O
ATOM  19651  N    THR G 308    -61.382  98.783  40.497  1.00 27.93      A  N
ATOM  19652  CA   THR G 308    -60.126  99.501  40.587  1.00 28.88      A  C
ATOM  19653  CB   THR G 308    -60.202 100.854  39.876  1.00 27.87      A  C
ATOM  19654  OG1  THR G 308    -58.899 101.366  39.677  1.00 26.46      A  O
ATOM  19655  CG2  THR G 308    -60.987 101.803  40.625  1.00 24.74      A  C
ATOM  19656  C    THR G 308    -59.575  99.567  42.005  1.00 30.65      A  C
ATOM  19657  O    THR G 308    -60.184  99.065  42.901  1.00 31.57      A  O
ATOM  19658  N    ALA G 309    -58.379 100.108  42.158  1.00 32.03      A  N
ATOM  19659  CA   ALA G 309    -57.595 100.224  43.397  1.00 33.23      A  C
ATOM  19660  CB   ALA G 309    -56.169 100.356  43.090  1.00 31.40      A  C
ATOM  19661  C    ALA G 309    -57.946 101.101  44.598  1.00 35.75      A  C
ATOM  19662  O    ALA G 309    -57.679 100.748  45.720  1.00 38.70      A  O
ATOM  19663  N    GLY G 310    -58.471 102.272  44.421  1.00 36.77      A  N
ATOM  19664  CA   GLY G 310    -58.531 103.142  45.576  1.00 35.10      A  C
ATOM  19665  C    GLY G 310    -59.853 103.149  46.276  1.00 35.37      A  C
ATOM  19666  O    GLY G 310    -60.267 104.128  46.795  1.00 36.06      A  O
ATOM  19667  N    THR G 311    -60.556 102.056  46.230  1.00 33.81      A  N
ATOM  19668  CA   THR G 311    -61.936 102.128  46.519  1.00 33.13      A  C
ATOM  19669  CB   THR G 311    -62.682 102.312  45.213  1.00 32.88      A  C
ATOM  19670  OG1  THR G 311    -64.064 102.340  45.457  1.00 29.61      A  O
ATOM  19671  CG2  THR G 311    -62.382 101.211  44.297  1.00 32.02      A  C
```

Appendix 1

```
ATOM  19672  C    THR G 311     -62.420 100.924  47.255  1.00  33.78      A  C
ATOM  19673  O    THR G 311     -61.843  99.887  47.205  1.00  33.39      A  O
ATOM  19674  N    ASP G 312     -63.506 101.083  47.954  1.00  34.35      A  N
ATOM  19675  CA   ASP G 312     -64.214  99.956  48.456  1.00  35.86      A  C
ATOM  19676  CB   ASP G 312     -64.685 100.266  49.847  1.00  37.31      A  C
ATOM  19677  CG   ASP G 312     -63.591 100.329  50.785  1.00  40.18      A  C
ATOM  19678  OD1  ASP G 312     -62.767  99.441  50.723  1.00  44.47      A  O
ATOM  19679  OD2  ASP G 312     -63.517 101.262  51.569  1.00  43.98      A  O-1
ATOM  19680  C    ASP G 312     -65.393  99.590  47.601  1.00  35.52      A  C
ATOM  19681  O    ASP G 312     -65.941  98.549  47.743  1.00  35.47      A  O
ATOM  19682  N    ASP G 313     -65.773 100.472  46.710  1.00  35.82      A  N
ATOM  19683  CA   ASP G 313     -66.910 100.239  45.890  1.00  36.50      A  C
ATOM  19684  CB   ASP G 313     -67.164 101.406  44.952  1.00  36.66      A  C
ATOM  19685  CG   ASP G 313     -67.169 102.756  45.636  1.00  43.61      A  C
ATOM  19686  OD1  ASP G 313     -67.747 102.926  46.701  1.00  51.02      A  O
ATOM  19687  OD2  ASP G 313     -66.610 103.693  45.064  1.00  52.52      A  O-1
ATOM  19688  C    ASP G 313     -66.606  99.018  45.078  1.00  35.44      A  C
ATOM  19689  O    ASP G 313     -65.501  98.799  44.699  1.00  34.03      A  O
ATOM  19690  N    ALA G 314     -67.625  98.224  44.810  1.00  34.60      A  N
ATOM  19691  CA   ALA G 314     -67.507  97.034  44.015  1.00  33.94      A  C
ATOM  19692  CB   ALA G 314     -68.119  95.899  44.716  1.00  32.63      A  C
ATOM  19693  C    ALA G 314     -68.189  97.251  42.686  1.00  34.09      A  C
ATOM  19694  O    ALA G 314     -69.130  97.961  42.605  1.00  33.42      A  O
ATOM  19695  N    ASP G 315     -67.680  96.664  41.632  1.00  34.75      A  N
ATOM  19696  CA   ASP G 315     -68.329  96.694  40.337  1.00  35.00      A  C
ATOM  19697  CB   ASP G 315     -69.619  95.935  40.388  1.00  35.69      A  C
ATOM  19698  CG   ASP G 315     -69.440  94.576  40.027  1.00  39.73      A  C
ATOM  19699  OD1  ASP G 315     -68.725  94.393  39.072  1.00  46.24      A  O
ATOM  19700  OD2  ASP G 315     -69.936  93.702  40.719  1.00  41.30      A  O
ATOM  19701  C    ASP G 315     -68.622  98.003  39.722  1.00  34.19      A  C
ATOM  19702  O    ASP G 315     -69.625  98.166  39.142  1.00  34.00      A  O
ATOM  19703  N    GLY G 316     -67.703  98.927  39.821  1.00  33.63      A  N
ATOM  19704  CA   GLY G 316     -67.794 100.203  39.165  1.00  33.58      A  C
ATOM  19705  C    GLY G 316     -67.257 100.200  37.763  1.00  32.85      A  C
ATOM  19706  O    GLY G 316     -67.093  99.156  37.173  1.00  31.29      A  O
ATOM  19707  N    GLY G 317     -66.987 101.379  37.230  1.00  32.01      A  N
ATOM  19708  CA   GLY G 317     -66.501 101.529  35.881  1.00  30.83      A  C
ATOM  19709  C    GLY G 317     -67.480 101.019  34.881  1.00  31.45      A  C
ATOM  19710  O    GLY G 317     -68.591 101.406  34.935  1.00  32.01      A  O
ATOM  19711  N    VAL G 318     -67.089 100.088  34.025  1.00  31.11      A  N
ATOM  19712  CA   VAL G 318     -68.040  99.422  33.135  1.00  31.97      A  C
ATOM  19713  CB   VAL G 318     -67.397  98.721  31.974  1.00  30.99      A  C
ATOM  19714  CG1  VAL G 318     -66.805  99.680  31.083  1.00  33.01      A  C
ATOM  19715  CG2  VAL G 318     -66.424  97.742  32.410  1.00  33.45      A  C
ATOM  19716  C    VAL G 318     -69.019  98.476  33.815  1.00  31.38      A  C
ATOM  19717  O    VAL G 318     -69.959  98.044  33.216  1.00  31.38      A  O
ATOM  19718  N    GLY G 319     -68.779  98.159  35.067  1.00  29.67      A  N
ATOM  19719  CA   GLY G 319     -69.669  97.347  35.854  1.00  28.78      A  C
ATOM  19720  C    GLY G 319     -69.531  95.868  35.743  1.00  28.10      A  C
ATOM  19721  O    GLY G 319     -70.329  95.162  36.219  1.00  29.47      A  O
ATOM  19722  N    LEU G 320     -68.487  95.426  35.107  1.00  27.46      A  N
ATOM  19723  CA   LEU G 320     -68.344  94.062  34.699  1.00  26.49      A  C
ATOM  19724  CB   LEU G 320     -68.114  94.071  33.212  1.00  26.32      A  C
ATOM  19725  CG   LEU G 320     -69.314  94.534  32.435  1.00  27.39      A  C
```

Appendix 1

```
ATOM  19726  CD1  LEU G 320    -69.029  94.478  31.046  1.00  28.67      A  C
ATOM  19727  CD2  LEU G 320    -70.368  93.629  32.716  1.00  27.71      A  C
ATOM  19728  C    LEU G 320    -67.330  93.159  35.387  1.00  25.55      A  C
ATOM  19729  O    LEU G 320    -67.193  92.058  35.040  1.00  26.85      A  O
ATOM  19730  N    ALA G 321    -66.642  93.625  36.387  1.00  24.51      A  N
ATOM  19731  CA   ALA G 321    -65.614  92.838  37.028  1.00  23.07      A  C
ATOM  19732  CB   ALA G 321    -64.852  93.692  37.949  1.00  23.58      A  C
ATOM  19733  C    ALA G 321    -66.014  91.538  37.726  1.00  23.74      A  C
ATOM  19734  O    ALA G 321    -65.269  90.592  37.706  1.00  23.77      A  O
ATOM  19735  N    SER G 322    -67.156  91.510  38.382  1.00  21.95      A  N
ATOM  19736  CA   SER G 322    -67.674  90.285  39.921  1.00  20.54      A  C
ATOM  19737  CB   SER G 322    -68.916  90.541  39.745  1.00  20.07      A  C
ATOM  19738  OG   SER G 322    -68.698  91.381  40.820  1.00  21.44      A  O
ATOM  19739  C    SER G 322    -68.019  89.248  37.905  1.00  20.48      A  C
ATOM  19740  O    SER G 322    -67.702  88.137  38.107  1.00  19.56      A  O
ATOM  19741  N    ALA G 323    -68.693  89.623  36.838  1.00  20.88      A  N
ATOM  19742  CA   ALA G 323    -69.056  88.743  35.744  1.00  20.39      A  C
ATOM  19743  CB   ALA G 323    -69.912  89.448  34.842  1.00  21.18      A  C
ATOM  19744  C    ALA G 323    -67.910  88.183  34.971  1.00  21.02      A  C
ATOM  19745  O    ALA G 323    -67.907  87.049  34.623  1.00  21.14      A  O
ATOM  19746  N    PHE G 324    -66.945  89.014  34.678  1.00  21.81      A  N
ATOM  19747  CA   PHE G 324    -65.709  88.592  34.092  1.00  22.28      A  C
ATOM  19748  CB   PHE G 324    -64.931  89.744  33.471  1.00  23.47      A  C
ATOM  19749  CG   PHE G 324    -65.402  90.110  32.101  1.00  25.95      A  C
ATOM  19750  CD1  PHE G 324    -65.113  89.339  31.043  1.00  28.76      A  C
ATOM  19751  CE1  PHE G 324    -65.567  89.661  29.828  1.00  28.29      A  C
ATOM  19752  CZ   PHE G 324    -66.289  90.746  29.664  1.00  26.68      A  C
ATOM  19753  CE2  PHE G 324    -66.592  91.507  30.685  1.00  25.54      A  C
ATOM  19754  CD2  PHE G 324    -66.171  91.207  31.887  1.00  26.34      A  C
ATOM  19755  C    PHE G 324    -64.883  87.742  34.991  1.00  22.53      A  C
ATOM  19756  O    PHE G 324    -64.171  86.911  34.560  1.00  23.19      A  O
ATOM  19757  N    THR G 325    -64.968  88.009  36.260  1.00  22.77      A  N
ATOM  19758  CA   THR G 325    -64.297  87.238  37.263  1.00  22.84      A  C
ATOM  19759  CB   THR G 325    -64.258  87.979  38.529  1.00  23.33      A  C
ATOM  19760  OG1  THR G 325    -64.022  89.338  38.218  1.00  25.77      A  O
ATOM  19761  CG2  THR G 325    -63.180  87.486  39.338  1.00  22.64      A  C
ATOM  19762  C    THR G 325    -64.829  85.842  37.417  1.00  22.52      A  C
ATOM  19763  O    THR G 325    -64.112  84.956  37.687  1.00  22.58      A  O
ATOM  19764  N    LEU G 326    -66.112  85.697  37.239  1.00  22.26      A  N
ATOM  19765  CA   LEU G 326    -66.768  84.443  37.194  1.00  23.62      A  C
ATOM  19766  CB   LEU G 326    -68.259  84.682  37.073  1.00  22.90      A  C
ATOM  19767  CG   LEU G 326    -69.212  83.542  37.272  1.00  24.32      A  C
ATOM  19768  CD1  LEU G 326    -69.291  83.084  38.625  1.00  22.78      A  C
ATOM  19769  CD2  LEU G 326    -70.500  83.922  36.817  1.00  27.18      A  C
ATOM  19770  C    LEU G 326    -66.277  83.627  36.040  1.00  24.21      A  C
ATOM  19771  O    LEU G 326    -66.062  82.476  36.174  1.00  25.33      A  O
ATOM  19772  N    LEU G 327    -66.088  84.236  34.900  1.00  23.74      A  N
ATOM  19773  CA   LEU G 327    -65.555  83.526  33.791  1.00  23.57      A  C
ATOM  19774  CB   LEU G 327    -65.589  84.419  32.567  1.00  25.05      A  C
ATOM  19775  CG   LEU G 327    -64.699  83.988  31.425  1.00  24.81      A  C
ATOM  19776  CD1  LEU G 327    -65.122  82.696  30.898  1.00  24.00      A  C
ATOM  19777  CD2  LEU G 327    -64.760  84.957  30.397  1.00  24.45      A  C
ATOM  19778  C    LEU G 327    -64.155  83.028  34.055  1.00  23.69      A  C
ATOM  19779  O    LEU G 327    -63.802  81.929  33.751  1.00  23.07      A  O
```

Appendix 1

```
ATOM  19780  N    LEU G 328     -63.357  83.881  34.633  1.00  22.77      A  N
ATOM  19781  CA   LEU G 328     -62.041  83.536  35.019  1.00  22.37      A  C
ATOM  19782  CB   LEU G 328     -61.337  84.779  35.471  1.00  20.92      A  C
ATOM  19783  CG   LEU G 328     -60.017  84.588  36.137  1.00  20.48      A  C
ATOM  19784  CD1  LEU G 328     -59.008  84.402  35.169  1.00  16.36      A  C
ATOM  19785  CD2  LEU G 328     -59.723  85.747  36.919  1.00  19.73      A  C
ATOM  19786  C    LEU G 328     -61.989  82.467  36.081  1.00  23.89      A  C
ATOM  19787  O    LEU G 328     -61.185  81.606  36.021  1.00  22.36      A  O
ATOM  19788  N    ALA G 329     -62.871  82.523  37.048  1.00  23.11      A  N
ATOM  19789  CA   ALA G 329     -62.851  81.536  38.072  1.00  25.42      A  C
ATOM  19790  CB   ALA G 329     -63.860  81.342  39.098  1.00  24.64      A  C
ATOM  19791  C    ALA G 329     -63.099  80.177  37.480  1.00  27.31      A  C
ATOM  19792  O    ALA G 329     -62.425  79.247  37.808  1.00  28.43      A  O
ATOM  19793  N    ARG G 330     -64.051  80.079  36.573  1.00  28.05      A  N
ATOM  19794  CA   ARG G 330     -64.324  78.864  35.859  1.00  27.52      A  C
ATOM  19795  CB   ARG G 330     -65.554  79.055  35.000  1.00  27.46      A  C
ATOM  19796  CG   ARG G 330     -66.009  77.859  34.257  1.00  27.34      A  C
ATOM  19797  CD   ARG G 330     -66.963  77.018  35.003  1.00  24.79      A  C
ATOM  19798  NE   ARG G 330     -67.842  76.306  34.111  1.00  33.55      A  N
ATOM  19799  CZ   ARG G 330     -67.737  75.032  33.812  1.00  34.97      A  C
ATOM  19800  NH1  ARG G 330     -66.802  74.316  34.337  1.00  31.41      A  N
ATOM  19801  NH2  ARG G 330     -68.565  74.477  32.983  1.00  35.08      A  N
ATOM  19802  C    ARG G 330     -63.168  78.409  35.022  1.00  27.71      A  C
ATOM  19803  O    ARG G 330     -62.800  77.304  35.078  1.00  27.37      A  O
ATOM  19804  N    GLU G 331     -62.552  79.285  34.289  1.00  30.23      A  N
ATOM  19805  CA   GLU G 331     -61.379  78.933  33.529  1.00  32.71      A  C
ATOM  19806  CB   GLU G 331     -60.997  80.045  32.562  1.00  31.74      A  C
ATOM  19807  CG   GLU G 331     -59.649  79.942  31.964  1.00  34.65      A  C
ATOM  19808  CD   GLU G 331     -59.547  79.088  30.743  1.00  37.29      A  C
ATOM  19809  OE1  GLU G 331     -60.513  78.816  30.091  1.00  39.78      A  O
ATOM  19810  OE2  GLU G 331     -58.463  78.664  30.433  1.00  42.52      A  O-1
ATOM  19811  C    GLU G 331     -60.197  78.471  34.352  1.00  34.08      A  C
ATOM  19812  O    GLU G 331     -59.456  77.674  33.907  1.00  36.05      A  O
ATOM  19813  N    MET G 332     -60.034  78.966  35.553  1.00  35.97      A  N
ATOM  19814  CA   MET G 332     -58.936  78.566  36.398  1.00  37.22      A  C
ATOM  19815  CB   MET G 332     -58.490  79.673  37.335  1.00  36.88      G  C
ATOM  19816  CG   MET G 332     -57.979  80.398  36.686  1.00  38.14      G  C
ATOM  19817  SD   MET G 332     -56.838  80.554  35.431  1.00  41.01      G  S
ATOM  19818  CE   MET G 332     -55.378  80.935  36.251  1.00  37.74      G  C
ATOM  19819  C    MET G 332     -59.337  77.415  37.246  1.00  38.70      A  C
ATOM  19820  O    MET G 332     -58.554  76.916  37.994  1.00  39.75      A  O
ATOM  19821  N    GLY G 333     -60.582  77.024  37.151  1.00  38.91      A  N
ATOM  19822  CA   GLY G 333     -61.083  75.927  37.922  1.00  38.19      A  C
ATOM  19823  C    GLY G 333     -61.323  76.191  39.368  1.00  37.53      A  C
ATOM  19824  O    GLY G 333     -61.426  75.276  40.130  1.00  37.39      A  O
ATOM  19825  N    ASP G 334     -61.441  77.445  39.743  1.00  37.14      A  N
ATOM  19826  CA   ASP G 334     -61.638  77.306  41.119  1.00  36.19      A  C
ATOM  19827  CB   ASP G 334     -61.176  79.219  41.319  1.00  37.05      A  C
ATOM  19828  CG   ASP G 334     -61.230  79.646  42.734  1.00  41.01      A  C
ATOM  19829  OD1  ASP G 334     -61.777  78.934  43.541  1.00  42.28      A  O
ATOM  19830  OD2  ASP G 334     -60.703  80.689  43.056  1.00  40.54      A  O-1
ATOM  19831  C    ASP G 334     -63.080  77.730  41.452  1.00  35.09      A  C
ATOM  19832  O    ASP G 334     -63.794  78.654  41.307  1.00  36.02      A  O
ATOM  19833  N    GLN G 335     -63.496  76.565  41.876  1.00  34.81      A  N
```

Appendix 1

```
ATOM  19834  CA   GLN G 335     -64.869  76.262  42.146  1.00  34.10      A    C
ATOM  19835  CB   GLN G 335     -65.015  74.773  42.369  1.00  33.43      A    C
ATOM  19836  CG   GLN G 335     -65.100  73.958  41.125  1.00  33.76      A    C
ATOM  19837  CD   GLN G 335     -65.630  72.542  41.341  1.00  37.45      A    C
ATOM  19838  OE1  GLN G 335     -65.006  71.595  40.959  1.00  38.62      A    O
ATOM  19839  NE2  GLN G 335     -66.777  72.416  41.933  1.00  34.78      A    N
ATOM  19840  C    GLN G 335     -65.478  77.054  43.284  1.00  34.09      A    C
ATOM  19841  O    GLN G 335     -66.619  77.372  43.253  1.00  34.60      A    O
ATOM  19842  N    GLN G 336     -64.727  77.323  44.327  1.00  33.94      A    N
ATOM  19843  CA   GLN G 336     -65.243  78.113  45.418  1.00  33.83      A    C
ATOM  19844  CB   GLN G 336     -64.280  78.070  46.600  1.00  34.04      A    C
ATOM  19845  CG   GLN G 336     -64.733  78.808  47.825  1.00  36.88      A    C
ATOM  19846  CD   GLN G 336     -63.716  78.851  48.941  1.00  40.49      A    C
ATOM  19847  OE1  GLN G 336     -62.528  78.797  48.716  1.00  40.80      A    O
ATOM  19848  NE2  GLN G 336     -64.191  78.952  50.155  1.00  39.61      A    N
ATOM  19849  C    GLN G 336     -65.534  79.536  45.016  1.00  33.13      A    C
ATOM  19850  O    GLN G 336     -66.583  80.033  45.249  1.00  31.68      A    O
ATOM  19851  N    LEU G 337     -64.602  80.186  44.363  1.00  31.80      A    N
ATOM  19852  CA   LEU G 337     -64.857  81.526  43.911  1.00  31.60      A    C
ATOM  19853  CB   LEU G 337     -63.618  82.189  43.370  1.00  31.49      A    C
ATOM  19854  CG   LEU G 337     -63.851  83.642  43.059  1.00  30.09      A    C
ATOM  19855  CD1  LEU G 337     -64.289  84.399  44.210  1.00  28.07      A    C
ATOM  19856  CD2  LEU G 337     -62.652  84.209  42.553  1.00  27.67      A    C
ATOM  19857  C    LEU G 337     -66.000  81.625  42.929  1.00  30.33      A    C
ATOM  19858  O    LEU G 337     -66.715  82.568  42.959  1.00  30.60      A    O
ATOM  19859  N    PHE G 338     -66.176  80.631  42.084  1.00  28.80      A    N
ATOM  19860  CA   PHE G 338     -67.252  80.624  41.136  1.00  28.20      A    C
ATOM  19861  CB   PHE G 338     -67.119  79.373  40.310  1.00  28.45      A    C
ATOM  19862  CG   PHE G 338     -68.112  79.228  39.241  1.00  27.29      A    C
ATOM  19863  CD1  PHE G 338     -67.825  79.581  37.972  1.00  26.15      A    C
ATOM  19864  CE1  PHE G 338     -68.716  79.424  37.007  1.00  27.10      A    C
ATOM  19865  CZ   PHE G 338     -69.896  78.880  37.276  1.00  26.51      A    C
ATOM  19866  CE2  PHE G 338     -70.196  78.527  38.520  1.00  25.12      A    C
ATOM  19867  CD2  PHE G 338     -69.310  78.669  39.487  1.00  25.98      A    C
ATOM  19868  C    PHE G 338     -68.568  80.649  41.854  1.00  28.32      A    C
ATOM  19869  O    PHE G 338     -69.435  81.398  41.517  1.00  26.62      A    O
ATOM  19870  N    ASP G 339     -68.688  79.832  42.877  1.00  29.72      A    N
ATOM  19871  CA   ASP G 339     -69.876  79.739  43.676  1.00  29.79      A    C
ATOM  19872  CB   ASP G 339     -69.684  78.629  44.696  1.00  30.89      A    C
ATOM  19873  CG   ASP G 339     -70.946  78.270  45.425  1.00  35.42      A    C
ATOM  19874  OD1  ASP G 339     -71.792  77.639  44.834  1.00  38.59      A    O
ATOM  19875  OD2  ASP G 339     -71.092  78.610  46.592  1.00  38.13      A    O-1
ATOM  19876  C    ASP G 339     -70.194  81.004  44.392  1.00  28.24      A    C
ATOM  19877  O    ASP G 339     -71.297  81.405  44.437  1.00  28.09      A    O
ATOM  19878  N    GLN G 340     -69.207  81.622  44.969  1.00  27.02      A    N
ATOM  19879  CA   GLN G 340     -69.426  82.824  45.696  1.00  28.29      A    C
ATOM  19880  CB   GLN G 340     -68.110  83.213  46.324  1.00  29.50      A    C
ATOM  19881  CG   GLN G 340     -67.890  82.584  47.616  1.00  28.34      A    C
ATOM  19882  CD   GLN G 340     -66.492  82.597  48.057  1.00  31.05      A    C
ATOM  19883  OE1  GLN G 340     -65.609  82.888  47.320  1.00  36.94      A    O
ATOM  19884  NE2  GLN G 340     -66.286  82.235  49.267  1.00  27.03      A    N
ATOM  19885  C    GLN G 340     -69.958  83.975  44.861  1.00  28.40      A    C
ATOM  19886  O    GLN G 340     -70.918  84.577  45.218  1.00  29.43      A    O
ATOM  19887  N    LEU G 341     -69.334  84.236  43.728  1.00  27.02      A    N
```

Appendix 1

```
ATOM  19888  CA   LEU G 341     -69.760  85.225  42.754  1.00  25.92      A  C
ATOM  19889  CB   LEU G 341     -68.725  85.332  41.649  1.00  25.92      A  C
ATOM  19890  CG   LEU G 341     -67.400  85.946  41.981  1.00  23.50      A  C
ATOM  19891  CD1  LEU G 341     -66.471  85.592  40.960  1.00  21.85      A  C
ATOM  19892  CD2  LEU G 341     -67.537  87.367  42.100  1.00  18.72      A  C
ATOM  19893  C    LEU G 341     -71.091  84.938  42.140  1.00  25.37      A  C
ATOM  19894  O    LEU G 341     -71.857  85.809  41.900  1.00  24.30      A  O
ATOM  19895  N    LEU G 342     -71.357  83.689  41.874  1.00  25.38      A  N
ATOM  19896  CA   LEU G 342     -72.638  83.308  41.379  1.00  27.06      A  C
ATOM  19897  CB   LEU G 342     -72.636  81.867  40.936  1.00  27.00      A  C
ATOM  19898  CG   LEU G 342     -73.662  81.585  39.866  1.00  25.15      A  C
ATOM  19899  CD1  LEU G 342     -73.694  82.651  38.871  1.00  17.60      A  C
ATOM  19900  CD2  LEU G 342     -73.441  80.303  39.264  1.00  21.56      A  C
ATOM  19901  C    LEU G 342     -73.722  83.584  42.380  1.00  28.24      A  C
ATOM  19902  O    LEU G 342     -74.788  83.946  42.030  1.00  30.35      A  O
ATOM  19903  N    ASN G 343     -73.430  83.379  43.635  1.00  29.59      A  N
ATOM  19904  CA   ASN G 343     -74.318  83.730  44.721  1.00  29.56      A  C
ATOM  19905  CB   ASN G 343     -73.825  83.160  46.017  1.00  29.91      A  C
ATOM  19906  CG   ASN G 343     -73.978  81.695  46.080  1.00  30.81      A  C
ATOM  19907  OD1  ASN G 343     -74.913  81.159  45.598  1.00  33.76      A  O
ATOM  19908  ND2  ASN G 343     -73.065  81.053  46.690  1.00  28.58      A  N
ATOM  19909  C    ASN G 343     -74.534  85.186  44.863  1.00  28.55      A  C
ATOM  19910  O    ASN G 343     -75.547  85.622  45.299  1.00  28.18      A  O
ATOM  19911  N    HIS G 344     -73.532  85.948  44.556  1.00  27.07      A  N
ATOM  19912  CA   HIS G 344     -73.744  87.346  44.466  1.00  28.24      A  C
ATOM  19913  CB   HIS G 344     -72.394  87.987  44.465  1.00  28.42      A  C
ATOM  19914  CG   HIS G 344     -72.426  89.433  44.183  1.00  31.26      A  C
ATOM  19915  ND1  HIS G 344     -72.834  90.344  45.112  1.00  31.69      A  N
ATOM  19916  CE1  HIS G 344     -72.754  91.546  44.603  1.00  31.33      A  C
ATOM  19917  NE2  HIS G 344     -72.315  91.444  43.370  1.00  36.47      A  N
ATOM  19918  CD2  HIS G 344     -72.095  90.132  43.084  1.00  31.67      A  C
ATOM  19919  C    HIS G 344     -74.554  87.850  43.279  1.00  27.19      A  C
ATOM  19920  O    HIS G 344     -75.445  88.627  43.412  1.00  27.59      A  O
ATOM  19921  N    LEU G 345     -74.154  87.469  42.098  1.00  26.84      A  N
ATOM  19922  CA   LEU G 345     -74.840  87.852  40.902  1.00  25.29      A  C
ATOM  19923  CB   LEU G 345     -73.913  87.670  39.708  1.00  26.47      A  C
ATOM  19924  CG   LEU G 345     -72.499  88.213  39.688  1.00  26.28      A  C
ATOM  19925  CD1  LEU G 345     -71.616  87.387  38.842  1.00  19.84      A  C
ATOM  19926  CD2  LEU G 345     -72.496  89.584  39.247  1.00  23.80      A  C
ATOM  19927  C    LEU G 345     -76.198  87.260  40.568  1.00  25.06      A  C
ATOM  19928  O    LEU G 345     -77.042  87.944  40.150  1.00  24.34      A  O
ATOM  19929  N    GLU G 346     -76.364  85.971  40.647  1.00  26.31      A  N
ATOM  19930  CA   GLU G 346     -77.614  85.461  40.170  1.00  26.83      A  C
ATOM  19931  CB   GLU G 346     -77.512  84.013  39.761  1.00  26.92      A  C
ATOM  19932  CG   GLU G 346     -78.513  83.632  38.735  1.00  31.00      A  C
ATOM  19933  CD   GLU G 346     -78.593  82.175  38.515  1.00  35.00      A  C
ATOM  19934  OE1  GLU G 346     -78.082  81.674  37.531  1.00  32.30      A  O
ATOM  19935  OE2  GLU G 346     -79.183  81.526  39.342  1.00  44.51      A  O-1
ATOM  19936  C    GLU G 346     -78.887  85.740  40.929  1.00  27.92      A  C
ATOM  19937  O    GLU G 346     -79.827  86.161  40.346  1.00  30.25      A  O
ATOM  19938  N    PRO G 347     -78.941  85.565  42.224  1.00  27.78      A  N
ATOM  19939  CA   PRO G 347     -80.207  85.739  42.906  1.00  28.06      A  C
ATOM  19940  CB   PRO G 347     -79.818  85.467  44.327  1.00  27.32      A  C
ATOM  19941  CG   PRO G 347     -78.828  84.537  44.204  1.00  27.32      A  C
```

Appendix 1

```
ATOM  19942  CD   PRO G 347     -77.988  84.929  43.120  1.00 27.07      A    C
ATOM  19943  C    PRO G 347     -80.875  87.110  42.809  1.00 28.92      A    C
ATOM  19944  O    PRO G 347     -82.063  87.137  42.668  1.00 30.73      A    O
ATOM  19945  N    PRO G 348     -80.150  88.210  42.869  1.00 27.77      A    N
ATOM  19946  CA   PRO G 348     -80.753  89.511  42.750  1.00 28.14      A    C
ATOM  19947  CB   PRO G 348     -79.597  90.414  43.005  1.00 27.25      A    C
ATOM  19948  CG   PRO G 348     -78.737  89.688  43.693  1.00 26.46      A    C
ATOM  19949  CD   PRO G 348     -78.779  88.356  43.321  1.00 27.67      A    C
ATOM  19950  C    PRO G 348     -81.328  89.786  41.397  1.00 30.26      A    C
ATOM  19951  O    PRO G 348     -82.132  90.641  41.256  1.00 31.70      A    O
ATOM  19952  N    ALA G 349     -80.905  89.034  40.419  1.00 30.54      A    N
ATOM  19953  CA   ALA G 349     -81.340  89.214  39.074  1.00 32.07      A    C
ATOM  19954  CB   ALA G 349     -80.356  88.664  38.148  1.00 32.72      A    C
ATOM  19955  C    ALA G 349     -82.676  88.600  38.827  1.00 32.78      A    C
ATOM  19956  O    ALA G 349     -83.232  88.807  37.804  1.00 32.83      A    O
ATOM  19957  N    LYS G 350     -83.182  87.861  39.793  1.00 34.52      A    N
ATOM  19958  CA   LYS G 350     -84.497  87.248  39.746  1.00 35.11      A    C
ATOM  19959  CB   LYS G 350     -85.577  88.264  39.957  1.00 35.14      G    C
ATOM  19960  CG   LYS G 350     -85.418  89.009  41.209  1.00 41.58      G    C
ATOM  19961  CD   LYS G 350     -86.130  88.334  42.331  1.00 51.72      G    C
ATOM  19962  CE   LYS G 350     -85.648  88.812  43.687  1.00 55.09      G    C
ATOM  19963  NZ   LYS G 350     -86.481  89.896  44.253  1.00 51.83      G    N
ATOM  19964  C    LYS G 350     -84.800  86.375  38.575  1.00 34.11      A    C
ATOM  19965  O    LYS G 350     -85.674  86.630  37.815  1.00 34.01      A    O
ATOM  19966  N    PRO G 351     -84.052  85.313  38.465  1.00 34.02      A    N
ATOM  19967  CA   PRO G 351     -84.273  84.353  37.423  1.00 33.93      A    C
ATOM  19968  CB   PRO G 351     -83.160  83.365  37.652  1.00 32.38      A    C
ATOM  19969  CG   PRO G 351     -82.812  83.523  38.941  1.00 33.55      A    C
ATOM  19970  CD   PRO G 351     -82.933  84.906  39.297  1.00 33.95      A    C
ATOM  19971  C    PRO G 351     -85.590  83.673  37.561  1.00 34.13      A    C
ATOM  19972  O    PRO G 351     -86.034  83.424  38.631  1.00 33.94      A    O
ATOM  19973  N    SER G 352     -86.211  83.393  36.441  1.00 35.51      A    N
ATOM  19974  CA   SER G 352     -87.377  82.574  36.398  1.00 36.37      A    C
ATOM  19975  CB   SER G 352     -88.596  83.438  36.400  1.00 36.62      A    C
ATOM  19976  OG   SER G 352     -88.905  83.827  35.119  1.00 38.09      A    O
ATOM  19977  C    SER G 352     -87.316  81.749  35.145  1.00 36.82      A    C
ATOM  19978  O    SER G 352     -86.721  82.144  34.204  1.00 37.88      A    O
ATOM  19979  N    ILE G 353     -87.901  80.572  35.136  1.00 37.05      A    N
ATOM  19980  CA   ILE G 353     -88.056  79.835  33.906  1.00 36.73      A    C
ATOM  19981  CB   ILE G 353     -87.458  78.491  34.008  1.00 37.18      A    C
ATOM  19982  CG1  ILE G 353     -85.958  78.626  33.936  1.00 38.27      A    C
ATOM  19983  CD1  ILE G 353     -85.251  77.735  34.789  1.00 37.24      A    C
ATOM  19984  CG2  ILE G 353     -87.922  77.678  32.879  1.00 36.84      A    C
ATOM  19985  C    ILE G 353     -89.502  79.647  33.625  1.00 36.81      A    C
ATOM  19986  O    ILE G 353     -90.164  79.019  34.382  1.00 37.42      A    O
ATOM  19987  N    VAL G 354     -90.000  80.227  32.548  1.00 36.48      A    N
ATOM  19988  CA   VAL G 354     -91.418  80.206  32.292  1.00 35.75      A    C
ATOM  19989  CB   VAL G 354     -91.934  81.575  31.868  1.00 36.05      A    C
ATOM  19990  CG1  VAL G 354     -93.325  81.495  31.418  1.00 30.30      A    C
ATOM  19991  CG2  VAL G 354     -91.846  82.504  32.985  1.00 34.87      A    C
ATOM  19992  C    VAL G 354     -91.885  79.168  31.317  1.00 36.59      A    C
ATOM  19993  O    VAL G 354     -92.641  78.306  31.682  1.00 37.93      A    O
ATOM  19994  N    SER G 355     -91.435  79.193  30.092  1.00 35.31      A    N
ATOM  19995  CA   SER G 355     -91.917  78.172  29.192  1.00 34.26      A    C
```

Appendix 1

```
ATOM  19996  CB   SER G 355     -92.578  78.768  27.969  1.00  34.85      A    C
ATOM  19997  OG   SER G 355     -93.436  77.866  27.333  1.00  37.67      A    O
ATOM  19998  C    SER G 355     -90.779  77.300  28.836  1.00  32.98      A    C
ATOM  19999  O    SER G 355     -90.604  76.931  27.722  1.00  34.24      A    O
ATOM  20000  N    ALA G 356     -89.971  76.983  29.811  1.00  31.30      A    N
ATOM  20001  CA   ALA G 356     -88.766  76.264  29.535  1.00  30.37      A    C
ATOM  20002  CB   ALA G 356     -89.037  75.213  28.577  1.00  29.16      A    C
ATOM  20003  C    ALA G 356     -87.716  77.227  29.017  1.00  29.65      A    C
ATOM  20004  O    ALA G 356     -86.682  76.837  28.569  1.00  29.98      A    O
ATOM  20005  N    SER G 357     -88.011  78.504  29.121  1.00  28.38      A    N
ATOM  20006  CA   SER G 357     -87.113  79.552  28.731  1.00  27.73      A    C
ATOM  20007  CB   SER G 357     -87.808  80.474  27.783  1.00  27.87      A    C
ATOM  20008  OG   SER G 357     -87.272  80.424  26.520  1.00  31.89      A    O
ATOM  20009  C    SER G 357     -86.698  80.365  29.927  1.00  27.40      A    C
ATOM  20010  O    SER G 357     -87.519  80.768  30.693  1.00  24.57      A    O
ATOM  20011  N    LEU G 358     -85.404  80.605  30.049  1.00  26.78      A    N
ATOM  20012  CA   LEU G 358     -84.808  81.442  31.074  1.00  26.61      A    C
ATOM  20013  CB   LEU G 358     -83.353  81.052  31.244  1.00  25.54      A    C
ATOM  20014  CG   LEU G 358     -82.441  81.742  32.235  1.00  25.89      A    C
ATOM  20015  CD1  LEU G 358     -83.025  81.674  33.594  1.00  28.40      A    C
ATOM  20016  CD2  LEU G 358     -81.118  81.158  32.216  1.00  20.41      A    C
ATOM  20017  C    LEU G 358     -84.913  82.943  30.856  1.00  28.43      A    C
ATOM  20018  O    LEU G 358     -84.636  83.450  29.815  1.00  27.87      A    O
ATOM  20019  N    ARG G 359     -85.333  83.645  31.886  1.00  31.59      A    N
ATOM  20020  CA   ARG G 359     -85.411  85.089  31.881  1.00  35.98      A    C
ATOM  20021  CB   ARG G 359     -86.842  85.558  31.739  1.00  37.75      A    C
ATOM  20022  CG   ARG G 359     -87.489  85.320  30.420  1.00  45.27      A    C
ATOM  20023  CD   ARG G 359     -86.897  86.167  29.320  1.00  55.51      A    C
ATOM  20024  NE   ARG G 359     -87.574  85.919  28.060  1.00  59.02      A    N
ATOM  20025  CZ   ARG G 359     -87.647  84.737  27.473  1.00  58.49      A    C
ATOM  20026  NH1  ARG G 359     -87.077  83.693  28.019  1.00  57.09      A    N
ATOM  20027  NH2  ARG G 359     -88.303  84.608  26.349  1.00  56.22      A    N
ATOM  20028  C    ARG G 359     -84.900  85.647  33.176  1.00  37.16      A    C
ATOM  20029  O    ARG G 359     -84.996  85.026  34.175  1.00  37.26      A    O
ATOM  20030  N    TYR G 360     -84.354  86.837  33.137  1.00  37.79      A    N
ATOM  20031  CA   TYR G 360     -83.977  87.506  34.336  1.00  37.84      A    C
ATOM  20032  CB   TYR G 360     -82.501  87.805  34.320  1.00  36.23      A    C
ATOM  20033  CG   TYR G 360     -81.645  86.620  34.555  1.00  34.94      A    C
ATOM  20034  CD1  TYR G 360     -81.462  86.135  35.809  1.00  28.59      A    C
ATOM  20035  CE1  TYR G 360     -80.698  85.086  36.024  1.00  27.94      A    C
ATOM  20036  CZ   TYR G 360     -80.090  84.482  34.986  1.00  30.50      A    C
ATOM  20037  OH   TYR G 360     -79.315  83.412  35.193  1.00  25.18      A    O
ATOM  20038  CE2  TYR G 360     -80.230  84.946  33.737  1.00  29.10      A    C
ATOM  20039  CD2  TYR G 360     -80.997  86.004  33.524  1.00  34.01      A    C
ATOM  20040  C    TYR G 360     -84.684  88.788  34.367  1.00  39.23      A    C
ATOM  20041  O    TYR G 360     -84.537  89.584  33.506  1.00  39.09      A    O
ATOM  20042  N    GLU G 361     -85.478  88.986  35.377  1.00  41.87      A    N
ATOM  20043  CA   GLU G 361     -85.945  90.276  35.728  1.00  43.90      A    C
ATOM  20044  CB   GLU G 361     -87.011  90.106  36.764  1.00  43.95      A    C
ATOM  20045  CG   GLU G 361     -87.579  91.354  37.253  1.00  52.40      A    C
ATOM  20046  CD   GLU G 361     -89.024  91.217  37.467  1.00  58.30      A    C
ATOM  20047  OE1  GLU G 361     -89.545  90.225  36.998  1.00  62.29      A    O
ATOM  20048  OE2  GLU G 361     -89.640  92.068  38.098  1.00  62.06      A    O-1
ATOM  20049  C    GLU G 361     -84.709  90.821  36.334  1.00  44.17      A    C
```

Appendix 1

```
ATOM  20050  O    GLU G 361     -83.922  90.059  36.846  1.00 45.28    A  O
ATOM  20051  N    HIS G 362     -84.509  92.119  36.304  1.00 43.58    A  N
ATOM  20052  CA   HIS G 362     -83.350  92.706  36.986  1.00 43.28    A  C
ATOM  20053  CB   HIS G 362     -83.560  92.798  38.492  1.00 43.40    A  C
ATOM  20054  CG   HIS G 362     -84.897  93.315  38.884  1.00 51.92    A  C
ATOM  20055  ND1  HIS G 362     -85.420  94.480  38.379  1.00 57.24    A  N
ATOM  20056  CE1  HIS G 362     -86.617  94.675  38.887  1.00 58.92    A  C
ATOM  20057  NE2  HIS G 362     -86.885  93.685  39.709  1.00 58.30    A  N
ATOM  20058  CD2  HIS G 362     -85.828  92.820  39.725  1.00 56.47    A  C
ATOM  20059  C    HIS G 362     -81.939  92.205  36.735  1.00 40.66    A  C
ATOM  20060  O    HIS G 362     -81.257  91.931  37.668  1.00 40.53    A  O
ATOM  20061  N    PRO G 363     -81.475  92.179  35.499  1.00 40.29    A  N
ATOM  20062  CA   PRO G 363     -80.068  91.914  35.256  1.00 38.59    A  C
ATOM  20063  CB   PRO G 363     -79.975  91.897  33.740  1.00 38.02    A  C
ATOM  20064  CG   PRO G 363     -81.114  92.469  33.275  1.00 38.43    A  C
ATOM  20065  CD   PRO G 363     -82.191  92.242  34.226  1.00 39.79    A  C
ATOM  20066  C    PRO G 363     -79.206  93.000  35.802  1.00 37.54    A  C
ATOM  20067  O    PRO G 363     -79.518  94.141  35.717  1.00 37.70    A  O
ATOM  20068  N    GLY G 364     -78.114  92.612  36.391  1.00 36.72    A  N
ATOM  20069  CA   GLY G 364     -77.228  93.503  37.089  1.00 36.63    A  C
ATOM  20070  C    GLY G 364     -76.455  94.467  36.280  1.00 36.78    A  C
ATOM  20071  O    GLY G 364     -76.010  95.465  36.754  1.00 36.85    A  O
ATOM  20072  N    SER G 365     -76.217  94.081  35.060  1.00 36.40    A  N
ATOM  20073  CA   SER G 365     -75.196  94.673  34.284  1.00 35.34    A  C
ATOM  20074  CB   SER G 365     -73.852  94.105  34.682  1.00 34.65    A  C
ATOM  20075  OG   SER G 365     -73.413  93.171  33.765  1.00 35.56    A  O
ATOM  20076  C    SER G 365     -75.490  94.429  32.853  1.00 34.49    A  C
ATOM  20077  O    SER G 365     -76.385  93.706  32.519  1.00 34.10    A  O
ATOM  20078  N    LEU G 366     -74.718  95.085  32.022  1.00 33.39    A  N
ATOM  20079  CA   LEU G 366     -74.690  94.844  30.623  1.00 33.11    A  C
ATOM  20080  CB   LEU G 366     -73.732  95.816  29.954  1.00 33.25    A  C
ATOM  20081  CG   LEU G 366     -74.207  96.917  29.039  1.00 33.28    A  C
ATOM  20082  CD1  LEU G 366     -75.622  97.073  29.155  1.00 33.87    A  C
ATOM  20083  CD2  LEU G 366     -73.566  98.135  29.466  1.00 33.28    A  C
ATOM  20084  C    LEU G 366     -74.159  93.457  30.466  1.00 32.11    A  C
ATOM  20085  O    LEU G 366     -73.433  92.973  31.272  1.00 32.39    A  O
ATOM  20086  N    LEU G 367     -74.587  92.795  29.432  1.00 30.86    A  N
ATOM  20087  CA   LEU G 367     -74.023  91.539  29.096  1.00 30.52    A  C
ATOM  20088  CB   LEU G 367     -72.538  91.704  28.981  1.00 29.95    A  C
ATOM  20089  CG   LEU G 367     -72.015  92.490  27.810  1.00 31.75    A  C
ATOM  20090  CD1  LEU G 367     -70.550  92.454  27.779  1.00 31.82    A  C
ATOM  20091  CD2  LEU G 367     -72.570  91.990  26.551  1.00 31.76    A  C
ATOM  20092  C    LEU G 367     -74.331  90.423  30.075  1.00 30.80    A  C
ATOM  20093  O    LEU G 367     -73.666  89.448  30.073  1.00 31.09    A  O
ATOM  20094  N    PHE G 368     -75.332  90.582  30.916  1.00 29.85    A  N
ATOM  20095  CA   PHE G 368     -75.593  89.661  31.994  1.00 28.37    A  C
ATOM  20096  CB   PHE G 368     -76.694  90.279  32.841  1.00 28.77    A  C
ATOM  20097  CG   PHE G 368     -76.894  89.628  34.142  1.00 24.13    A  C
ATOM  20098  CD1  PHE G 368     -76.079  89.911  35.173  1.00 20.95    A  C
ATOM  20099  CE1  PHE G 368     -76.247  89.320  36.336  1.00 24.05    A  C
ATOM  20100  CZ   PHE G 368     -77.238  88.442  36.496  1.00 24.86    A  C
ATOM  20101  CE2  PHE G 368     -78.061  88.157  35.488  1.00 23.45    A  C
ATOM  20102  CD2  PHE G 368     -77.903  88.744  34.332  1.00 20.75    A  C
ATOM  20103  C    PHE G 368     -75.966  89.224  31.671  1.00 27.99    A  C
```

Appendix 1

```
ATOM  20104  O    PHE G 368     -75.350  87.337  32.161  1.00  28.75      A   O
ATOM  20105  N    ASP G 369     -76.963  87.999  30.854  1.00  26.95      A   N
ATOM  20106  CA   ASP G 369     -77.262  86.662  30.423  1.00  26.93      A   C
ATOM  20107  CB   ASP G 369     -78.660  86.494  29.779  1.00  27.33      A   C
ATOM  20108  CG   ASP G 369     -78.744  86.942  28.340  1.00  30.43      A   C
ATOM  20109  OD1  ASP G 369     -78.683  86.124  27.444  1.00  26.86      A   O
ATOM  20110  OD2  ASP G 369     -78.948  88.119  28.117  1.00  34.18      A   O-1
ATOM  20111  C    ASP G 369     -76.158  86.020  29.625  1.00  26.34      A   C
ATOM  20112  O    ASP G 369     -76.001  84.850  29.683  1.00  26.06      A   O
ATOM  20113  N    GLU G 370     -75.429  86.785  28.847  1.00  24.64      A   N
ATOM  20114  CA   GLU G 370     -74.347  86.235  28.079  1.00  25.23      A   C
ATOM  20115  CB   GLU G 370     -73.759  87.363  27.257  1.00  24.61      A   C
ATOM  20116  CG   GLU G 370     -74.560  87.862  26.146  1.00  26.25      A   C
ATOM  20117  CD   GLU G 370     -75.525  88.917  26.527  1.00  30.19      A   C
ATOM  20118  OE1  GLU G 370     -75.895  88.994  27.666  1.00  32.86      A   O
ATOM  20119  OE2  GLU G 370     -75.964  89.638  25.676  1.00  26.57      A   O-1
ATOM  20120  C    GLU G 370     -73.196  85.721  28.890  1.00  24.62      A   C
ATOM  20121  O    GLU G 370     -72.739  84.662  28.700  1.00  24.94      A   O
ATOM  20122  N    LEU G 371     -72.702  86.568  29.760  1.00  25.38      A   N
ATOM  20123  CA   LEU G 371     -71.614  86.296  30.643  1.00  25.33      A   C
ATOM  20124  CB   LEU G 371     -71.253  87.588  31.367  1.00  24.22      A   C
ATOM  20125  CG   LEU G 371     -69.883  88.221  31.215  1.00  24.55      A   C
ATOM  20126  CD1  LEU G 371     -69.160  87.747  30.031  1.00  26.16      A   C
ATOM  20127  CD2  LEU G 371     -69.971  89.682  31.175  1.00  22.97      A   C
ATOM  20128  C    LEU G 371     -71.966  85.212  31.628  1.00  25.65      A   C
ATOM  20129  O    LEU G 371     -71.193  84.358  31.883  1.00  25.44      A   O
ATOM  20130  N    LEU G 372     -73.150  85.257  32.186  1.00  25.44      A   N
ATOM  20131  CA   LEU G 372     -73.589  84.189  33.042  1.00  25.83      A   C
ATOM  20132  CB   LEU G 372     -74.874  84.530  33.753  1.00  26.11      A   C
ATOM  20133  CG   LEU G 372     -74.708  84.838  35.225  1.00  30.11      A   C
ATOM  20134  CD1  LEU G 372     -74.159  86.201  35.412  1.00  28.71      A   C
ATOM  20135  CD2  LEU G 372     -75.988  84.693  35.949  1.00  30.91      A   C
ATOM  20136  C    LEU G 372     -73.728  82.869  32.329  1.00  25.74      A   C
ATOM  20137  O    LEU G 372     -73.431  81.866  32.884  1.00  26.14      A   O
ATOM  20138  N    PHE G 373     -74.216  82.889  31.109  1.00  24.89      A   N
ATOM  20139  CA   PHE G 373     -74.311  81.716  30.275  1.00  23.65      A   C
ATOM  20140  CB   PHE G 373     -75.102  82.054  29.019  1.00  23.65      A   C
ATOM  20141  CG   PHE G 373     -74.884  81.142  27.884  1.00  22.98      A   C
ATOM  20142  CD1  PHE G 373     -75.357  79.883  27.905  1.00  25.37      A   C
ATOM  20143  CE1  PHE G 373     -75.179  79.072  26.865  1.00  27.62      A   C
ATOM  20144  CZ   PHE G 373     -74.538  79.511  25.772  1.00  28.60      A   C
ATOM  20145  CE2  PHE G 373     -74.087  80.757  25.728  1.00  26.53      A   C
ATOM  20146  CD2  PHE G 373     -74.265  81.569  26.764  1.00  22.85      A   C
ATOM  20147  C    PHE G 373     -72.981  81.146  29.927  1.00  23.28      A   C
ATOM  20148  O    PHE G 373     -72.799  79.986  29.948  1.00  25.24      A   O
ATOM  20149  N    LEU G 374     -72.053  81.997  29.597  1.00  22.74      A   N
ATOM  20150  CA   LEU G 374     -70.732  81.593  29.275  1.00  23.34      A   C
ATOM  20151  CB   LEU G 374     -69.996  82.765  28.673  1.00  22.74      A   C
ATOM  20152  CG   LEU G 374     -68.498  82.766  28.557  1.00  21.74      A   C
ATOM  20153  CD1  LEU G 374     -67.993  81.715  27.694  1.00  20.35      A   C
ATOM  20154  CD2  LEU G 374     -68.103  84.027  28.045  1.00  21.74      A   C
ATOM  20155  C    LEU G 374     -69.992  80.994  30.438  1.00  24.81      A   C
ATOM  20156  O    LEU G 374     -69.291  80.057  30.285  1.00  24.91      A   O
ATOM  20157  N    ALA G 375     -70.134  81.566  31.608  1.00  26.14      A   N
```

Appendix 1

```
ATOM  20158  CA   ALA G 375     -69.489  81.046  32.785  1.00 26.74      A    C
ATOM  20159  CB   ALA G 375     -69.611  82.006  33.883  1.00 26.47      A    C
ATOM  20160  C    ALA G 375     -69.966  79.658  33.210  1.00 27.12      A    C
ATOM  20161  O    ALA G 375     -69.212  78.847  33.674  1.00 26.86      A    O
ATOM  20162  N    LYS G 376     -71.248  79.426  33.085  1.00 26.30      A    N
ATOM  20163  CA   LYS G 376     -71.817  78.172  33.439  1.00 27.43      A    C
ATOM  20164  CB   LYS G 376     -73.319  78.257  33.416  1.00 27.43      A    C
ATOM  20165  CG   LYS G 376     -73.885  78.891  34.585  1.00 26.25      A    C
ATOM  20166  CD   LYS G 376     -75.217  79.430  34.334  1.00 20.86      A    C
ATOM  20167  CE   LYS G 376     -75.714  80.090  35.546  1.00 22.48      A    C
ATOM  20168  NZ   LYS G 376     -77.149  80.163  35.531  1.00 21.13      A    N
ATOM  20169  C    LYS G 376     -71.333  77.054  32.569  1.00 28.65      A    C
ATOM  20170  O    LYS G 376     -71.197  75.957  33.000  1.00 29.57      A    O
ATOM  20171  N    VAL G 377     -71.059  77.363  31.329  1.00 28.83      A    N
ATOM  20172  CA   VAL G 377     -70.791  76.396  30.307  1.00 28.68      A    C
ATOM  20173  CB   VAL G 377     -71.662  76.790  29.096  1.00 29.03      A    C
ATOM  20174  CG1  VAL G 377     -70.940  76.810  27.842  1.00 28.51      A    C
ATOM  20175  CG2  VAL G 377     -72.887  76.022  29.040  1.00 24.90      A    C
ATOM  20176  C    VAL G 377     -69.310  76.176  29.947  1.00 29.02      A    C
ATOM  20177  O    VAL G 377     -68.946  75.163  29.442  1.00 30.06      A    O
ATOM  20178  N    HIS G 378     -68.449  77.103  30.292  1.00 29.39      A    N
ATOM  20179  CA   HIS G 378     -67.109  77.187  29.751  1.00 30.23      A    C
ATOM  20180  CB   HIS G 378     -66.539  78.464  30.304  1.00 29.65      A    C
ATOM  20181  CG   HIS G 378     -65.214  78.841  29.759  1.00 28.47      A    C
ATOM  20182  ND1  HIS G 378     -64.976  79.004  28.427  1.00 30.12      A    N
ATOM  20183  CE1  HIS G 378     -63.737  79.389  28.244  1.00 28.70      A    C
ATOM  20184  NE2  HIS G 378     -63.162  79.478  29.416  1.00 27.76      A    N
ATOM  20185  CD2  HIS G 378     -64.069  79.162  30.381  1.00 28.97      A    C
ATOM  20186  C    HIS G 378     -66.165  76.020  30.043  1.00 31.38      A    C
ATOM  20187  O    HIS G 378     -65.952  75.642  31.147  1.00 32.77      A    O
ATOM  20188  N    ALA G 379     -65.617  75.434  28.999  1.00 31.42      A    N
ATOM  20189  CA   ALA G 379     -64.849  74.235  29.096  1.00 30.40      A    C
ATOM  20190  CB   ALA G 379     -65.146  73.406  27.975  1.00 29.89      A    C
ATOM  20191  C    ALA G 379     -63.405  74.547  29.108  1.00 30.83      A    C
ATOM  20192  O    ALA G 379     -62.574  73.708  29.255  1.00 31.89      A    O
ATOM  20193  N    GLY G 380     -63.122  75.801  28.960  1.00 30.61      A    N
ATOM  20194  CA   GLY G 380     -61.780  76.247  28.900  1.00 30.31      A    C
ATOM  20195  C    GLY G 380     -61.375  76.553  27.510  1.00 31.43      A    C
ATOM  20196  O    GLY G 380     -61.710  75.912  26.585  1.00 30.87      A    O
ATOM  20197  N    PHE G 381     -60.631  77.605  27.392  1.00 32.03      A    N
ATOM  20198  CA   PHE G 381     -60.134  78.017  26.142  1.00 32.46      A    C
ATOM  20199  CB   PHE G 381     -59.551  79.375  26.252  1.00 31.53      A    C
ATOM  20200  CG   PHE G 381     -60.570  80.393  26.332  1.00 34.04      A    C
ATOM  20201  CD1  PHE G 381     -61.485  80.511  25.342  1.00 33.04      A    C
ATOM  20202  CE1  PHE G 381     -62.439  81.425  25.416  1.00 33.40      A    C
ATOM  20203  CZ   PHE G 381     -62.513  82.199  26.471  1.00 34.76      A    C
ATOM  20204  CE2  PHE G 381     -61.638  82.086  27.468  1.00 33.62      A    C
ATOM  20205  CD2  PHE G 381     -60.682  81.190  27.414  1.00 34.23      A    C
ATOM  20206  C    PHE G 381     -59.205  77.028  25.578  1.00 33.44      A    C
ATOM  20207  O    PHE G 381     -59.138  76.872  24.417  1.00 34.86      A    O
ATOM  20208  N    GLY G 382     -58.466  76.356  26.414  1.00 34.37      A    N
ATOM  20209  CA   GLY G 382     -57.651  75.276  25.941  1.00 36.63      A    C
ATOM  20210  C    GLY G 382     -58.408  74.117  25.386  1.00 37.35      A    C
ATOM  20211  O    GLY G 382     -58.018  73.561  24.423  1.00 38.18      A    O
```

Appendix 1

```
ATOM  20212  N    ALA G 383     -59.490  73.735  26.018  1.00 38.47      A  N
ATOM  20213  CA   ALA G 383     -60.261  72.624  25.529  1.00 39.23      A  C
ATOM  20214  CB   ALA G 383     -61.341  72.292  26.479  1.00 36.80      A  C
ATOM  20215  C    ALA G 383     -60.826  72.933  24.177  1.00 39.69      A  C
ATOM  20216  O    ALA G 383     -60.851  72.113  23.311  1.00 40.71      A  O
ATOM  20217  N    LEU G 384     -61.278  74.149  24.025  1.00 40.24      A  N
ATOM  20218  CA   LEU G 384     -61.889  74.635  22.824  1.00 40.81      A  C
ATOM  20219  CB   LEU G 384     -62.326  76.069  23.042  1.00 40.63      A  C
ATOM  20220  CG   LEU G 384     -63.783  76.460  23.216  1.00 40.52      A  C
ATOM  20221  CD1  LEU G 384     -64.592  75.367  23.751  1.00 39.50      A  C
ATOM  20222  CD2  LEU G 384     -63.919  77.696  24.027  1.00 35.02      A  C
ATOM  20223  C    LEU G 384     -60.890  74.578  21.707  1.00 41.78      A  C
ATOM  20224  O    LEU G 384     -61.213  74.280  20.597  1.00 40.35      A  O
ATOM  20225  N    LEU G 385     -59.657  74.885  22.019  1.00 43.07      A  N
ATOM  20226  CA   LEU G 385     -58.580  74.820  21.081  1.00 44.90      A  C
ATOM  20227  CB   LEU G 385     -57.315  75.223  21.784  1.00 45.10      A  C
ATOM  20228  CG   LEU G 385     -56.375  76.266  21.239  1.00 46.88      A  C
ATOM  20229  CD1  LEU G 385     -57.023  77.118  20.248  1.00 50.10      A  C
ATOM  20230  CD2  LEU G 385     -55.926  77.084  22.355  1.00 48.36      A  C
ATOM  20231  C    LEU G 385     -58.427  73.400  20.623  1.00 45.53      A  C
ATOM  20232  O    LEU G 385     -58.128  73.149  19.496  1.00 45.07      A  O
ATOM  20233  N    ARG G 386     -58.630  72.459  21.520  1.00 46.62      A  N
ATOM  20234  CA   ARG G 386     -58.321  71.084  21.224  1.00 48.52      A  C
ATOM  20235  CB   ARG G 386     -57.304  70.519  22.206  1.00 48.82      A  C
ATOM  20236  CG   ARG G 386     -57.815  69.773  23.351  1.00 52.55      A  C
ATOM  20237  CD   ARG G 386     -56.768  69.739  24.421  1.00 55.25      A  C
ATOM  20238  NE   ARG G 386     -55.624  70.565  24.098  1.00 56.41      A  N
ATOM  20239  CZ   ARG G 386     -55.146  71.503  24.897  1.00 57.45      A  C
ATOM  20240  NH1  ARG G 386     -55.726  71.734  26.049  1.00 57.36      A  N
ATOM  20241  NH2  ARG G 386     -54.097  72.204  24.543  1.00 54.09      A  N
ATOM  20242  C    ARG G 386     -59.522  70.200  20.950  1.00 48.95      A  C
ATOM  20243  O    ARG G 386     -59.455  69.012  20.997  1.00 49.78      A  O
ATOM  20244  N    MET G 387     -60.602  70.830  20.564  1.00 49.24      A  N
ATOM  20245  CA   MET G 387     -61.851  70.183  20.331  1.00 49.51      A  C
ATOM  20246  CB   MET G 387     -62.844  71.233  19.858  1.00 49.86      G  C
ATOM  20247  CG   MET G 387     -64.280  70.845  19.949  1.00 50.19      G  C
ATOM  20248  SD   MET G 387     -65.407  71.998  19.229  1.00 55.56      G  S
ATOM  20249  CE   MET G 387     -65.403  73.221  20.475  1.00 51.67      G  C
ATOM  20250  C    MET G 387     -61.671  69.165  19.257  1.00 49.58      A  C
ATOM  20251  O    MET G 387     -60.903  69.354  18.362  1.00 50.16      A  O
ATOM  20252  N    PRO G 388     -62.471  68.124  19.299  1.00 49.41      A  N
ATOM  20253  CA   PRO G 388     -62.441  67.092  18.292  1.00 49.23      A  C
ATOM  20254  CB   PRO G 388     -62.946  65.881  19.047  1.00 48.96      A  C
ATOM  20255  CG   PRO G 388     -62.965  66.266  20.410  1.00 49.71      A  C
ATOM  20256  CD   PRO G 388     -63.213  67.670  20.459  1.00 49.54      A  C
ATOM  20257  C    PRO G 388     -63.353  67.388  17.140  1.00 49.21      A  C
ATOM  20258  O    PRO G 388     -64.325  68.058  17.274  1.00 47.93      A  O
ATOM  20259  N    PRO G 389     -63.030  66.788  16.027  1.00 49.74      A  N
ATOM  20260  CA   PRO G 389     -63.397  67.180  14.686  1.00 50.78      A  C
ATOM  20261  CB   PRO G 389     -62.599  66.190  13.850  1.00 51.28      A  C
ATOM  20262  CG   PRO G 389     -62.305  65.118  14.717  1.00 50.66      A  C
ATOM  20263  CD   PRO G 389     -62.012  65.757  15.987  1.00 50.90      A  C
ATOM  20264  C    PRO G 389     -64.834  67.104  14.262  1.00 52.47      A  C
ATOM  20265  O    PRO G 389     -65.273  67.914  13.480  1.00 52.19      A  O
```

Appendix 1

```
ATOM  20266  N    PRO G 390    -65.535  66.109  14.728  1.00  53.64    A  N
ATOM  20267  CA   PRO G 390    -66.845  65.773  14.211  1.00  54.89    A  C
ATOM  20268  CB   PRO G 390    -67.413  64.873  15.299  1.00  56.02    A  C
ATOM  20269  CG   PRO G 390    -66.242  64.545  16.184  1.00  56.28    A  C
ATOM  20270  CD   PRO G 390    -65.358  65.675  16.111  1.00  53.68    A  C
ATOM  20271  C    PRO G 390    -67.727  66.972  13.997  1.00  54.94    A  C
ATOM  20272  O    PRO G 390    -67.515  67.686  13.038  1.00  54.55    A  O
ATOM  20273  N    LEU H  29     46.916  75.696  47.981  1.00  67.55    A  N
ATOM  20274  CA   LEU H  29     46.344  74.548  47.297  1.00  68.10    A  C
ATOM  20275  CB   LEU H  29     47.457  73.739  46.600  1.00  68.84    A  C
ATOM  20276  CG   LEU H  29     47.188  72.912  45.327  1.00  69.63    A  C
ATOM  20277  CD1  LEU H  29     46.831  73.761  44.152  1.00  69.23    A  C
ATOM  20278  CD2  LEU H  29     48.356  72.043  44.970  1.00  69.46    A  C
ATOM  20279  C    LEU H  29     45.496  73.662  48.218  1.00  67.20    A  C
ATOM  20280  O    LEU H  29     45.996  73.076  49.156  1.00  65.72    A  O
ATOM  20281  N    PRO H  30     44.208  73.576  47.895  1.00  66.85    A  N
ATOM  20282  CA   PRO H  30     43.238  72.654  48.469  1.00  66.28    A  C
ATOM  20283  CB   PRO H  30     42.324  73.591  49.250  1.00  66.83    A  C
ATOM  20284  CG   PRO H  30     42.387  74.818  48.544  1.00  65.49    A  C
ATOM  20285  CD   PRO H  30     43.809  74.955  48.176  1.00  66.74    A  C
ATOM  20286  C    PRO H  30     42.496  72.103  47.283  1.00  65.41    A  C
ATOM  20287  O    PRO H  30     42.669  72.711  46.241  1.00  65.15    A  O
ATOM  20288  N    PRO H  31     41.689  71.057  47.411  1.00  64.11    A  N
ATOM  20289  CA   PRO H  31     41.078  70.419  46.234  1.00  62.65    A  C
ATOM  20290  CB   PRO H  31     41.592  69.001  46.313  1.00  62.81    A  C
ATOM  20291  CG   PRO H  31     42.633  69.010  47.355  1.00  63.87    A  C
ATOM  20292  CD   PRO H  31     42.445  70.122  48.241  1.00  63.30    A  C
ATOM  20293  C    PRO H  31     39.531  70.439  46.105  1.00  61.92    A  C
ATOM  20294  O    PRO H  31     38.990  71.237  45.348  1.00  62.20    A  O
ATOM  20295  N    GLY H  32     38.828  69.570  46.821  1.00  59.21    A  N
ATOM  20296  CA   GLY H  32     37.401  69.703  46.992  1.00  54.73    A  C
ATOM  20297  C    GLY H  32     37.164  70.346  48.342  1.00  53.44    A  C
ATOM  20298  O    GLY H  32     36.070  70.451  48.831  1.00  52.89    A  O
ATOM  20299  N    ARG H  33     38.261  70.748  48.940  1.00  51.14    A  N
ATOM  20300  CA   ARG H  33     38.346  71.285  50.266  1.00  49.37    A  C
ATOM  20301  CB   ARG H  33     39.748  71.104  50.759  1.00  48.82    A  C
ATOM  20302  CG   ARG H  33     40.151  69.729  50.803  1.00  44.73    A  C
ATOM  20303  CD   ARG H  33     39.885  69.188  52.130  1.00  44.95    A  C
ATOM  20304  NE   ARG H  33     40.404  70.017  53.178  1.00  45.37    A  N
ATOM  20305  CZ   ARG H  33     41.450  69.710  53.908  1.00  42.59    A  C
ATOM  20306  NH1  ARG H  33     42.094  68.598  53.699  1.00  42.35    A  N
ATOM  20307  NH2  ARG H  33     41.853  70.522  54.843  1.00  41.88    A  N
ATOM  20308  C    ARG H  33     38.006  72.732  50.400  1.00  49.68    A  C
ATOM  20309  O    ARG H  33     37.892  73.425  49.434  1.00  50.58    A  O
ATOM  20310  N    LEU H  34     37.877  73.188  51.627  1.00  48.74    A  N
ATOM  20311  CA   LEU H  34     37.472  74.548  51.910  1.00  48.30    A  C
ATOM  20312  CB   LEU H  34     36.357  74.534  52.946  1.00  49.27    A  C
ATOM  20313  CG   LEU H  34     34.941  74.611  52.415  1.00  50.25    A  C
ATOM  20314  CD1  LEU H  34     34.954  74.358  50.964  1.00  48.85    A  C
ATOM  20315  CD2  LEU H  34     34.125  73.599  53.101  1.00  50.49    A  C
ATOM  20316  C    LEU H  34     38.553  75.433  52.423  1.00  46.90    A  C
ATOM  20317  O    LEU H  34     38.571  76.584  52.142  1.00  45.88    A  O
ATOM  20318  N    ALA H  35     39.424  74.872  53.226  1.00  45.47    A  N
ATOM  20319  CA   ALA H  35     40.481  75.583  53.891  1.00  45.18    A  C
```

Appendix 1

```
ATOM  20320  CB   ALA H  35      40.026  76.112  55.212  1.00 44.63      A  C
ATOM  20321  C    ALA H  35      41.588  74.583  54.061  1.00 45.63      A  C
ATOM  20322  O    ALA H  35      41.403  73.456  53.771  1.00 45.97      A  O
ATOM  20323  N    THR H  36      42.738  74.988  54.553  1.00 44.76      A  N
ATOM  20324  CA   THR H  36      43.840  74.077  54.615  1.00 44.76      A  C
ATOM  20325  CB   THR H  36      45.139  74.654  54.065  1.00 45.02      A  C
ATOM  20326  OG1  THR H  36      45.580  75.700  54.903  1.00 43.25      A  O
ATOM  20327  CG2  THR H  36      44.959  75.167  52.700  1.00 43.58      A  C
ATOM  20328  C    THR H  36      44.068  73.690  56.021  1.00 45.27      A  C
ATOM  20329  O    THR H  36      43.698  74.378  56.921  1.00 45.17      A  O
ATOM  20330  N    THR H  37      44.703  72.563  56.197  1.00 45.37      A  N
ATOM  20331  CA   THR H  37      44.876  72.004  57.497  1.00 46.69      A  C
ATOM  20332  CB   THR H  37      45.483  70.605  57.399  1.00 46.18      A  C
ATOM  20333  OG1  THR H  37      44.685  69.836  56.514  1.00 49.68      A  O
ATOM  20334  CG2  THR H  37      45.544  69.927  58.712  1.00 42.92      A  C
ATOM  20335  C    THR H  37      45.683  73.004  58.276  1.00 48.05      A  C
ATOM  20336  O    THR H  37      45.493  73.155  59.450  1.00 47.81      A  O
ATOM  20337  N    GLU H  38      46.577  73.698  57.588  1.00 49.47      H  N
ATOM  20338  CA   GLU H  38      47.402  74.725  58.194  1.00 50.19      H  C
ATOM  20339  CB   GLU H  38      48.478  75.243  57.228  1.00 51.07      H  C
ATOM  20340  CG   GLU H  38      49.548  76.090  57.896  1.00 53.83      H  C
ATOM  20341  CD   GLU H  38      50.492  76.772  56.932  1.00 61.66      H  C
ATOM  20342  OE1  GLU H  38      50.051  77.593  56.112  1.00 61.89      H  O
ATOM  20343  OE2  GLU H  38      51.702  76.504  57.001  1.00 63.23      H  O
ATOM  20344  C    GLU H  38      46.538  75.842  58.666  1.00 48.77      H  C
ATOM  20345  O    GLU H  38      46.727  76.327  59.745  1.00 48.01      H  O
ATOM  20346  N    ASP H  39      45.570  76.225  57.854  1.00 47.64      H  N
ATOM  20347  CA   ASP H  39      44.650  77.279  58.250  1.00 48.06      H  C
ATOM  20348  CB   ASP H  39      43.654  77.628  57.139  1.00 47.92      H  C
ATOM  20349  CG   ASP H  39      44.173  78.637  56.150  1.00 51.73      H  C
ATOM  20350  OD1  ASP H  39      45.108  79.386  56.441  1.00 53.95      H  O
ATOM  20351  OD2  ASP H  39      43.627  78.689  55.042  1.00 53.82      H  O
ATOM  20352  C    ASP H  39      43.872  76.855  59.481  1.00 46.62      H  C
ATOM  20353  O    ASP H  39      43.706  77.620  60.387  1.00 47.07      H  O
ATOM  20354  N    TYR H  40      43.373  75.635  59.513  1.00 43.99      A  N
ATOM  20355  CA   TYR H  40      42.603  75.186  60.652  1.00 42.31      A  C
ATOM  20356  CB   TYR H  40      42.004  73.815  60.390  1.00 42.50      A  C
ATOM  20357  CG   TYR H  40      40.948  73.775  59.350  1.00 37.54      A  C
ATOM  20358  CD1  TYR H  40      39.837  74.548  59.457  1.00 34.12      A  C
ATOM  20359  CE1  TYR H  40      38.904  74.516  58.531  1.00 31.06      A  C
ATOM  20360  CZ   TYR H  40      39.046  73.711  57.471  1.00 31.98      A  C
ATOM  20361  OH   TYR H  40      38.072  73.683  56.547  1.00 31.25      A  O
ATOM  20362  CE2  TYR H  40      40.133  72.931  57.332  1.00 33.78      A  C
ATOM  20363  CD2  TYR H  40      41.065  72.958  58.262  1.00 34.75      A  C
ATOM  20364  C    TYR H  40      43.415  75.131  61.919  1.00 42.75      A  C
ATOM  20365  O    TYR H  40      42.947  75.447  62.972  1.00 41.42      A  O
ATOM  20366  N    PHE H  41      44.640  74.652  61.805  1.00 43.59      A  N
ATOM  20367  CA   PHE H  41      45.581  74.571  62.914  1.00 44.06      A  C
ATOM  20368  CB   PHE H  41      46.711  73.596  62.604  1.00 43.75      A  C
ATOM  20369  CG   PHE H  41      46.356  72.166  62.841  1.00 43.62      A  C
ATOM  20370  CD1  PHE H  41      46.681  71.557  64.011  1.00 41.76      A  C
ATOM  20371  CE1  PHE H  41      46.358  70.284  64.248  1.00 40.53      A  C
ATOM  20372  CZ   PHE H  41      45.696  69.582  63.322  1.00 42.75      A  C
ATOM  20373  CE2  PHE H  41      45.344  70.161  62.148  1.00 44.47      A  C
```

Appendix 1

```
ATOM   20374  CD2 PHE H  41      45.681  71.440  61.904  1.00 44.53      A    C
ATOM   20375  C   PHE H  41      46.062  75.945  63.384  1.00 44.96      A    C
ATOM   20376  O   PHE H  41      46.468  76.125  64.505  1.00 44.14      A    O
ATOM   20377  N   ALA H  42      46.002  76.900  62.478  1.00 46.43      A    N
ATOM   20378  CA  ALA H  42      46.327  78.301  62.707  1.00 48.39      A    C
ATOM   20379  CB  ALA H  42      46.480  78.992  61.420  1.00 48.77      A    C
ATOM   20380  C   ALA H  42      45.434  79.119  63.606  1.00 49.43      A    C
ATOM   20381  O   ALA H  42      45.883  80.040  64.230  1.00 50.60      A    O
ATOM   20382  N   GLN H  43      44.167  78.767  63.659  1.00 49.79      A    N
ATOM   20383  CA  GLN H  43      43.099  79.650  64.041  1.00 50.16      A    C
ATOM   20384  CB  GLN H  43      41.792  78.871  64.003  1.00 49.97      A    C
ATOM   20385  CG  GLN H  43      41.151  78.746  62.675  1.00 49.24      A    C
ATOM   20386  CD  GLN H  43      40.040  77.772  62.703  1.00 48.49      A    C
ATOM   20387  OE1 GLN H  43      40.132  76.758  63.323  1.00 42.65      A    O
ATOM   20388  NE2 GLN H  43      38.975  78.089  62.044  1.00 49.65      A    N
ATOM   20389  C   GLN H  43      43.208  80.208  65.419  1.00 49.74      A    C
ATOM   20390  O   GLN H  43      42.899  81.342  65.653  1.00 50.31      A    O
ATOM   20391  N   GLN H  44      43.582  79.369  66.343  1.00 49.19      A    N
ATOM   20392  CA  GLN H  44      43.675  79.752  67.707  1.00 49.33      A    C
ATOM   20393  CB  GLN H  44      44.059  78.520  68.472  1.00 48.58      A    C
ATOM   20394  CG  GLN H  44      44.548  78.747  69.814  1.00 49.26      A    C
ATOM   20395  CD  GLN H  44      44.322  77.569  70.644  1.00 53.17      A    C
ATOM   20396  OE1 GLN H  44      44.200  76.475  70.147  1.00 52.22      A    O
ATOM   20397  NE2 GLN H  44      44.241  77.770  71.922  1.00 54.54      A    N
ATOM   20398  C   GLN H  44      44.731  80.798  67.883  1.00 50.12      A    C
ATOM   20399  O   GLN H  44      44.580  81.741  68.614  1.00 50.38      A    O
ATOM   20400  N   ALA H  45      45.847  80.582  67.242  1.00 50.35      A    N
ATOM   20401  CA  ALA H  45      46.950  81.479  67.357  1.00 50.08      A    C
ATOM   20402  CB  ALA H  45      48.112  80.913  66.661  1.00 50.18      A    C
ATOM   20403  C   ALA H  45      46.584  82.805  66.765  1.00 49.83      A    C
ATOM   20404  O   ALA H  45      46.974  83.849  67.269  1.00 49.37      A    O
ATOM   20405  N   LYS H  46      45.894  82.735  65.644  1.00 48.16      A    N
ATOM   20406  CA  LYS H  46      45.334  83.889  64.991  1.00 48.14      A    C
ATOM   20407  CB  LYS H  46      44.800  83.553  63.625  1.00 48.32      A    C
ATOM   20408  CG  LYS H  46      45.829  83.178  62.655  1.00 46.82      A    C
ATOM   20409  CD  LYS H  46      45.446  83.701  61.360  1.00 45.75      A    C
ATOM   20410  CE  LYS H  46      46.020  82.891  60.291  1.00 49.18      A    C
ATOM   20411  NZ  LYS H  46      45.376  83.187  59.011  1.00 50.35      A    N
ATOM   20412  C   LYS H  46      44.250  84.516  65.799  1.00 48.38      A    C
ATOM   20413  O   LYS H  46      44.056  85.686  65.753  1.00 48.12      A    O
ATOM   20414  N   GLN H  47      43.530  83.710  66.533  1.00 48.11      A    N
ATOM   20415  CA  GLN H  47      42.412  84.209  67.253  1.00 48.46      A    C
ATOM   20416  CB  GLN H  47      42.797  85.447  68.019  1.00 49.17      A    C
ATOM   20417  CG  GLN H  47      43.839  85.230  69.085  1.00 53.45      A    C
ATOM   20418  CD  GLN H  47      43.429  84.251  70.182  1.00 58.50      A    C
ATOM   20419  OE1 GLN H  47      43.984  84.286  71.271  1.00 60.29      A    O
ATOM   20420  NE2 GLN H  47      42.478  83.373  69.895  1.00 54.67      A    N
ATOM   20421  C   GLN H  47      41.259  84.510  66.332  1.00 47.35      A    C
ATOM   20422  O   GLN H  47      40.466  85.357  66.620  1.00 46.63      A    O
ATOM   20423  N   ALA H  48      41.180  83.798  65.232  1.00 44.85      A    N
ATOM   20424  CA  ALA H  48      40.036  83.908  64.389  1.00 43.58      A    C
ATOM   20425  CB  ALA H  48      40.327  84.857  63.343  1.00 43.04      A    C
ATOM   20426  C   ALA H  48      39.682  82.579  63.783  1.00 43.21      A    C
ATOM   20427  O   ALA H  48      40.556  81.860  63.401  1.00 43.79      A    O
```

Appendix 1

```
ATOM  20428  N    VAL H 49    38.397  82.273  63.671  1.00  41.77    A  N
ATOM  20429  CA   VAL H 49    37.934  81.077  62.986  1.00  40.39    A  C
ATOM  20430  CB   VAL H 49    36.518  80.696  63.368  1.00  39.69    A  C
ATOM  20431  CG1  VAL H 49    36.425  80.407  64.793  1.00  38.62    A  C
ATOM  20432  CG2  VAL H 49    35.562  81.720  62.988  1.00  38.84    A  C
ATOM  20433  C    VAL H 49    38.039  81.227  61.498  1.00  41.08    A  C
ATOM  20434  O    VAL H 49    37.983  82.312  61.004  1.00  42.83    A  O
ATOM  20435  N    THR H 50    38.171  80.133  60.785  1.00  40.65    A  N
ATOM  20436  CA   THR H 50    38.151  80.192  59.348  1.00  41.00    A  C
ATOM  20437  CB   THR H 50    38.669  78.905  58.700  1.00  41.29    A  C
ATOM  20438  OG1  THR H 50    37.675  77.903  58.727  1.00  42.06    A  O
ATOM  20439  CG2  THR H 50    39.832  78.385  59.451  1.00  41.03    A  C
ATOM  20440  C    THR H 50    36.757  80.497  58.910  1.00  41.48    A  C
ATOM  20441  O    THR H 50    35.837  80.254  59.612  1.00  41.47    A  O
ATOM  20442  N    PRO H 51    36.622  81.069  57.738  1.00  42.06    A  N
ATOM  20443  CA   PRO H 51    35.368  81.581  57.225  1.00  41.30    A  C
ATOM  20444  CB   PRO H 51    35.767  82.051  55.859  1.00  40.69    A  C
ATOM  20445  CG   PRO H 51    37.104  82.412  55.992  1.00  42.42    A  C
ATOM  20446  CD   PRO H 51    37.740  81.515  56.921  1.00  42.31    A  C
ATOM  20447  C    PRO H 51    34.409  80.447  57.108  1.00  41.25    A  C
ATOM  20448  O    PRO H 51    33.219  80.519  57.241  1.00  41.48    A  O
ATOM  20449  N    ASP H 52    35.050  79.342  56.886  1.00  39.80    A  N
ATOM  20450  CA   ASP H 52    34.510  78.055  56.727  1.00  38.71    A  C
ATOM  20451  CB   ASP H 52    35.843  77.319  56.740  1.00  40.52    A  C
ATOM  20452  CG   ASP H 52    35.778  75.975  56.306  1.00  43.90    A  C
ATOM  20453  OD1  ASP H 52    35.671  75.767  55.133  1.00  52.84    A  O
ATOM  20454  OD2  ASP H 52    35.937  75.108  57.133  1.00  49.60    A  O-1
ATOM  20455  C    ASP H 52    33.742  77.641  57.972  1.00  37.12    A  C
ATOM  20456  O    ASP H 52    32.618  77.220  57.926  1.00  35.80    A  O
ATOM  20457  N    VAL H 53    34.413  77.742  59.086  1.00  34.98    A  N
ATOM  20458  CA   VAL H 53    33.893  77.484  60.377  1.00  33.95    A  C
ATOM  20459  CB   VAL H 53    34.988  77.451  61.399  1.00  34.39    A  C
ATOM  20460  CG1  VAL H 53    34.457  77.691  62.743  1.00  33.99    A  C
ATOM  20461  CG2  VAL H 53    35.695  76.173  61.350  1.00  32.04    A  C
ATOM  20462  C    VAL H 53    32.883  78.499  60.738  1.00  34.47    A  C
ATOM  20463  O    VAL H 53    32.016  78.220  61.485  1.00  35.89    A  O
ATOM  20464  N    MET H 54    33.051  79.713  60.276  1.00  33.88    A  N
ATOM  20465  CA   MET H 54    32.076  80.731  60.539  1.00  33.67    A  C
ATOM  20466  CB   MET H 54    32.649  82.116  60.275  1.00  33.90    H  C
ATOM  20467  CG   MET H 54    31.788  83.270  60.712  1.00  36.43    H  C
ATOM  20468  SD   MET H 54    31.576  83.612  62.445  1.00  41.94    H  S
ATOM  20469  CE   MET H 54    30.481  84.937  62.380  1.00  44.41    H  C
ATOM  20470  C    MET H 54    30.750  80.487  59.849  1.00  32.73    A  C
ATOM  20471  O    MET H 54    29.731  80.727  60.390  1.00  32.96    A  O
ATOM  20472  N    ALA H 55    30.795  80.020  58.634  1.00  31.17    A  N
ATOM  20473  CA   ALA H 55    29.613  79.712  57.910  1.00  30.13    A  C
ATOM  20474  CB   ALA H 55    29.939  79.387  56.527  1.00  29.35    A  C
ATOM  20475  C    ALA H 55    28.887  78.600  58.596  1.00  30.90    A  C
ATOM  20476  O    ALA H 55    27.700  78.540  58.561  1.00  30.44    A  O
ATOM  20477  N    GLN H 56    29.623  77.690  59.190  1.00  31.17    A  N
ATOM  20478  CA   GLN H 56    29.041  76.589  59.895  1.00  31.96    A  C
ATOM  20479  CB   GLN H 56    30.113  75.616  60.341  1.00  32.12    A  C
ATOM  20480  CG   GLN H 56    29.717  74.689  61.439  1.00  32.10    A  C
ATOM  20481  CD   GLN H 56    28.813  73.624  60.965  1.00  35.45    A  C
```

Appendix 1

```
ATOM  20482  OE1 GLN H  56      28.691  73.419  59.797  1.00 33.56      A    O
ATOM  20483  NE2 GLN H  56      28.173  72.940  61.866  1.00 32.39      A    N
ATOM  20484  C   GLN H  56      28.299  77.084  61.075  1.00 32.97      A    C
ATOM  20485  O   GLN H  56      27.244  76.651  61.370  1.00 33.93      A    O
ATOM  20486  N   LEU H  57      28.891  78.033  61.741  1.00 32.17      A    N
ATOM  20487  CA  LEU H  57      28.332  78.694  62.869  1.00 32.71      A    C
ATOM  20488  CB  LEU H  57      29.349  79.682  63.364  1.00 32.42      A    C
ATOM  20489  CG  LEU H  57      29.952  79.653  64.744  1.00 33.28      A    C
ATOM  20490  CD1 LEU H  57      29.832  78.368  65.433  1.00 30.75      A    C
ATOM  20491  CD2 LEU H  57      31.355  80.095  64.659  1.00 33.38      A    C
ATOM  20492  C   LEU H  57      27.062  79.414  62.487  1.00 32.85      A    C
ATOM  20493  O   LEU H  57      26.154  79.493  63.246  1.00 32.96      A    O
ATOM  20494  N   ALA H  58      27.033  79.945  61.291  1.00 32.14      A    N
ATOM  20495  CA  ALA H  58      25.856  80.481  60.666  1.00 33.00      A    C
ATOM  20496  CB  ALA H  58      26.234  81.186  59.423  1.00 32.13      A    C
ATOM  20497  C   ALA H  58      24.754  79.459  60.392  1.00 33.22      A    C
ATOM  20498  O   ALA H  58      23.620  79.749  60.535  1.00 33.77      A    O
ATOM  20499  N   TYR H  59      25.087  78.263  59.987  1.00 32.98      A    N
ATOM  20500  CA  TYR H  59      24.076  77.282  59.818  1.00 32.59      A    C
ATOM  20501  CB  TYR H  59      24.651  75.978  59.292  1.00 32.31      A    C
ATOM  20502  CG  TYR H  59      23.807  74.811  59.657  1.00 31.55      A    C
ATOM  20503  CD1 TYR H  59      22.587  74.626  59.093  1.00 33.76      A    C
ATOM  20504  CE1 TYR H  59      21.810  73.590  59.432  1.00 30.40      A    C
ATOM  20505  CZ  TYR H  59      22.232  72.726  60.344  1.00 31.15      A    C
ATOM  20506  OH  TYR H  59      21.441  71.704  60.695  1.00 32.57      A    O
ATOM  20507  CE2 TYR H  59      23.428  72.884  60.927  1.00 34.65      A    C
ATOM  20508  CD2 TYR H  59      24.210  73.914  60.584  1.00 31.97      A    C
ATOM  20509  C   TYR H  59      23.493  77.069  61.170  1.00 32.88      A    C
ATOM  20510  O   TYR H  59      22.337  76.944  61.317  1.00 33.39      A    O
ATOM  20511  N   MET H  60      24.333  77.016  62.170  1.00 32.96      A    N
ATOM  20512  CA  MET H  60      23.908  76.786  63.528  1.00 33.55      A    C
ATOM  20513  CB  MET H  60      25.113  76.540  64.406  1.00 33.45      H    C
ATOM  20514  CG  MET H  60      25.853  75.281  64.087  1.00 33.06      H    C
ATOM  20515  SD  MET H  60      27.427  75.194  64.804  1.00 28.39      H    S
ATOM  20516  CE  MET H  60      27.027  74.556  66.341  1.00 27.33      H    C
ATOM  20517  C   MET H  60      23.048  77.868  64.132  1.00 34.14      A    C
ATOM  20518  O   MET H  60      22.198  77.606  64.925  1.00 34.47      A    O
ATOM  20519  N   ASN H  61      23.316  79.098  63.776  1.00 33.35      A    N
ATOM  20520  CA  ASN H  61      22.696  80.168  64.466  1.00 33.69      A    C
ATOM  20521  CB  ASN H  61      23.789  81.046  65.078  1.00 34.59      A    C
ATOM  20522  CG  ASN H  61      24.255  80.567  66.403  1.00 33.87      A    C
ATOM  20523  OD1 ASN H  61      23.595  80.732  67.369  1.00 34.02      A    O
ATOM  20524  ND2 ASN H  61      25.403  80.002  66.449  1.00 33.68      A    N
ATOM  20525  C   ASN H  61      21.777  81.020  63.647  1.00 33.80      A    C
ATOM  20526  O   ASN H  61      20.963  81.677  64.199  1.00 33.75      A    O
ATOM  20527  N   TYR H  62      21.943  81.069  62.340  1.00 32.71      A    N
ATOM  20528  CA  TYR H  62      21.285  82.102  61.576  1.00 32.17      A    C
ATOM  20529  CB  TYR H  62      21.931  82.236  60.196  1.00 32.20      A    C
ATOM  20530  CG  TYR H  62      21.693  83.581  59.558  1.00 31.16      A    C
ATOM  20531  CD1 TYR H  62      22.676  84.530  59.537  1.00 30.55      A    C
ATOM  20532  CE1 TYR H  62      22.462  85.729  58.991  1.00 33.52      A    C
ATOM  20533  CZ  TYR H  62      21.252  86.017  58.465  1.00 32.32      A    C
ATOM  20534  OH  TYR H  62      21.035  87.241  57.907  1.00 27.38      A    O
ATOM  20535  CE2 TYR H  62      20.271  85.088  58.475  1.00 27.57      A    C
```

Appendix 1

```
ATOM  20536  CD2  TYR  H  62  20.487  83.902  58.997  1.00  24.43  A  C
ATOM  20537  C    TYR  H  62  19.802  82.145  61.373  1.00  33.09  A  C
ATOM  20538  O    TYR  H  62  19.179  83.140  61.654  1.00  33.67  A  O
ATOM  20539  N    ILE  H  63  19.259  81.111  60.778  1.00  33.18  A  N
ATOM  20540  CA   ILE  H  63  17.903  81.144  60.330  1.00  32.71  A  C
ATOM  20541  CB   ILE  H  63  17.657  80.180  59.236  1.00  32.63  A  C
ATOM  20542  CG1  ILE  H  63  18.584  80.480  58.088  1.00  33.26  A  C
ATOM  20543  CD1  ILE  H  63  18.438  79.530  57.002  1.00  32.44  A  C
ATOM  20544  CG2  ILE  H  63  16.264  80.309  58.771  1.00  28.42  A  C
ATOM  20545  C    ILE  H  63  16.940  80.886  61.415  1.00  33.80  A  C
ATOM  20546  O    ILE  H  63  17.214  80.150  62.292  1.00  33.78  A  O
ATOM  20547  N    ASP  H  64  15.778  81.484  61.312  1.00  35.28  A  N
ATOM  20548  CA   ASP  H  64  14.927  81.673  62.445  1.00  38.05  A  C
ATOM  20549  CB   ASP  H  64  13.784  82.566  62.026  1.00  38.99  A  C
ATOM  20550  CG   ASP  H  64  13.889  83.926  62.583  1.00  43.53  A  C
ATOM  20551  OD1  ASP  H  64  14.787  84.187  63.374  1.00  48.49  A  O
ATOM  20552  OD2  ASP  H  64  13.074  84.756  62.211  1.00  47.49  A  O
ATOM  20553  C    ASP  H  64  14.334  80.513  63.231  1.00  38.68  A  C
ATOM  20554  O    ASP  H  64  14.515  80.468  64.427  1.00  40.19  A  O
ATOM  20555  N    PHE  H  65  13.619  79.585  62.661  1.00  38.38  A  N
ATOM  20556  CA   PHE  H  65  13.129  78.589  63.583  1.00  38.45  A  C
ATOM  20557  CB   PHE  H  65  11.633  78.452  63.470  1.00  39.09  A  C
ATOM  20558  CG   PHE  H  65  10.905  79.721  63.670  1.00  40.72  A  C
ATOM  20559  CD1  PHE  H  65  10.684  80.197  64.904  1.00  41.72  A  C
ATOM  20560  CE1  PHE  H  65  10.034  81.327  65.079  1.00  42.94  A  C
ATOM  20561  CZ   PHE  H  65   9.604  82.018  64.044  1.00  41.66  A  C
ATOM  20562  CE2  PHE  H  65   9.822  81.576  62.821  1.00  43.23  A  C
ATOM  20563  CD2  PHE  H  65  10.465  80.440  62.623  1.00  41.25  A  C
ATOM  20564  C    PHE  H  65  13.776  77.276  63.395  1.00  37.54  A  C
ATOM  20565  O    PHE  H  65  13.688  76.423  64.206  1.00  38.48  A  O
ATOM  20566  N    ILE  H  66  14.390  77.112  62.260  1.00  37.71  A  N
ATOM  20567  CA   ILE  H  66  14.877  75.839  61.855  1.00  35.93  A  C
ATOM  20568  CB   ILE  H  66  14.586  75.665  60.396  1.00  36.65  A  C
ATOM  20569  CG1  ILE  H  66  15.242  76.766  59.617  1.00  32.98  A  C
ATOM  20570  CD1  ILE  H  66  15.515  76.413  58.305  1.00  29.22  A  C
ATOM  20571  CG2  ILE  H  66  13.152  75.813  60.161  1.00  36.02  A  C
ATOM  20572  C    ILE  H  66  16.338  75.621  62.106  1.00  35.65  A  C
ATOM  20573  O    ILE  H  66  16.800  74.530  61.988  1.00  36.36  A  O
ATOM  20574  N    SER  H  67  17.067  76.663  62.439  1.00  34.06  A  N
ATOM  20575  CA   SER  H  67  18.449  76.504  62.809  1.00  33.72  A  C
ATOM  20576  CB   SER  H  67  19.204  77.803  62.715  1.00  33.09  A  C
ATOM  20577  OG   SER  H  67  18.758  78.699  63.653  1.00  33.13  A  O
ATOM  20578  C    SER  H  67  18.586  75.878  64.172  1.00  33.89  A  C
ATOM  20579  O    SER  H  67  17.784  76.094  65.033  1.00  33.87  A  O
ATOM  20580  N    PRO  H  68  19.613  75.080  64.361  1.00  33.69  A  N
ATOM  20581  CA   PRO  H  68  19.686  74.223  65.524  1.00  33.68  A  C
ATOM  20582  CB   PRO  H  68  20.956  73.438  65.289  1.00  32.31  A  C
ATOM  20583  CG   PRO  H  68  21.457  73.839  64.057  1.00  34.01  A  C
ATOM  20584  CD   PRO  H  68  20.506  74.596  63.319  1.00  32.72  A  C
ATOM  20585  C    PRO  H  68  19.731  74.967  66.822  1.00  34.07  A  C
ATOM  20586  O    PRO  H  68  19.167  74.521  67.764  1.00  33.61  A  O
ATOM  20587  N    PHE  H  69  20.396  76.101  66.846  1.00  34.03  A  N
ATOM  20588  CA   PHE  H  69  20.629  76.845  68.057  1.00  34.20  A  C
ATOM  20589  CB   PHE  H  69  22.104  77.073  68.294  1.00  33.07  A  C
```

Appendix 1

```
ATOM  20590  CG   PHE H  69    22.808  75.849  68.632  1.00  33.38    A  C
ATOM  20591  CD1  PHE H  69    22.959  75.478  69.920  1.00  31.44    A  C
ATOM  20592  CE1  PHE H  69    23.534  74.356  70.217  1.00  31.19    A  C
ATOM  20593  CZ   PHE H  69    23.968  73.549  69.263  1.00  33.53    A  C
ATOM  20594  CE2  PHE H  69    23.810  73.870  67.977  1.00  35.58    A  C
ATOM  20595  CD2  PHE H  69    23.223  75.000  67.659  1.00  33.46    A  C
ATOM  20596  C    PHE H  69    19.875  78.116  68.096  1.00  34.52    A  C
ATOM  20597  O    PHE H  69    20.346  79.054  68.623  1.00  36.45    A  O
ATOM  20598  N    TYR H  70    18.722  78.136  67.469  1.00  34.93    A  N
ATOM  20599  CA   TYR H  70    17.791  79.240  67.523  1.00  35.34    A  C
ATOM  20600  CB   TYR H  70    16.694  79.042  66.492  1.00  34.96    A  C
ATOM  20601  CG   TYR H  70    15.667  80.127  66.515  1.00  33.26    A  C
ATOM  20602  CD1  TYR H  70    15.884  81.305  65.889  1.00  30.16    A  C
ATOM  20603  CE1  TYR H  70    14.994  82.279  65.940  1.00  32.82    A  C
ATOM  20604  CZ   TYR H  70    13.854  82.102  66.622  1.00  33.50    A  C
ATOM  20605  OH   TYR H  70    12.942  83.094  66.662  1.00  36.58    A  O
ATOM  20606  CE2  TYR H  70    13.605  80.943  67.241  1.00  32.41    A  C
ATOM  20607  CD2  TYR H  70    14.499  79.969  67.182  1.00  32.06    A  C
ATOM  20608  C    TYR H  70    17.154  79.531  68.869  1.00  36.12    A  C
ATOM  20609  O    TYR H  70    16.983  80.651  69.233  1.00  36.51    A  O
ATOM  20610  N    SER H  71    16.775  78.504  69.588  1.00  36.25    A  N
ATOM  20611  CA   SER H  71    15.844  78.651  70.649  1.00  37.65    A  C
ATOM  20612  CB   SER H  71    14.492  78.266  70.110  1.00  37.02    A  C
ATOM  20613  OG   SER H  71    13.483  78.668  70.948  1.00  38.64    A  O
ATOM  20614  C    SER H  71    16.229  77.699  71.719  1.00  38.73    A  C
ATOM  20615  O    SER H  71    16.778  76.705  71.429  1.00  39.71    A  O
ATOM  20616  N    ARG H  72    15.910  77.986  72.962  1.00  40.12    A  N
ATOM  20617  CA   ARG H  72    16.193  77.060  74.032  1.00  41.74    A  C
ATOM  20618  CB   ARG H  72    16.713  77.772  75.262  1.00  42.23    A  C
ATOM  20619  CG   ARG H  72    15.795  78.752  75.889  1.00  44.80    A  C
ATOM  20620  CD   ARG H  72    16.536  79.569  76.924  1.00  50.25    A  C
ATOM  20621  NE   ARG H  72    16.659  78.856  78.181  1.00  55.14    A  N
ATOM  20622  CZ   ARG H  72    17.798  78.440  78.711  1.00  57.22    A  C
ATOM  20623  NH1  ARG H  72    18.944  78.656  78.099  1.00  54.45    A  N
ATOM  20624  NH2  ARG H  72    17.778  77.791  79.856  1.00  56.18    A  N
ATOM  20625  C    ARG H  72    14.998  76.180  74.345  1.00  42.20    A  C
ATOM  20626  O    ARG H  72    15.008  75.393  75.251  1.00  43.62    A  O
ATOM  20627  N    GLY H  73    13.985  76.306  73.520  1.00  42.31    A  N
ATOM  20628  CA   GLY H  73    12.784  75.522  73.590  1.00  41.64    A  C
ATOM  20629  C    GLY H  73    12.934  74.094  73.169  1.00  42.20    A  C
ATOM  20630  O    GLY H  73    13.897  73.722  72.558  1.00  40.69    A  O
ATOM  20631  N    CYS H  74    11.964  73.282  73.531  1.00  42.86    A  N
ATOM  20632  CA   CYS H  74    12.048  71.889  73.186  1.00  44.36    A  C
ATOM  20633  CB   CYS H  74    11.784  70.955  74.411  1.00  44.26    A  C
ATOM  20634  SG   CYS H  74    13.401  70.393  75.279  1.00  51.80    A  S
ATOM  20635  C    CYS H  74    11.419  71.594  71.805  1.00  43.17    A  C
ATOM  20636  O    CYS H  74    10.448  70.910  71.647  1.00  43.17    A  O
ATOM  20637  N    SER H  75    12.053  72.224  70.828  1.00  43.11    A  N
ATOM  20638  CA   SER H  75    11.746  72.201  69.426  1.00  42.66    A  C
ATOM  20639  CB   SER H  75    11.525  73.605  68.948  1.00  42.76    A  C
ATOM  20640  OG   SER H  75    11.107  73.593  67.613  1.00  50.39    A  O
ATOM  20641  C    SER H  75    12.930  71.682  68.693  1.00  41.51    A  C
ATOM  20642  O    SER H  75    14.003  72.134  68.898  1.00  40.97    A  O
ATOM  20643  N    PHE H  76    12.730  70.712  67.821  1.00  40.61    A  N
```

Appendix 1

```
ATOM  20644  CA   PHE  H  76    13.834  70.069  67.152  1.00  38.48      A  C
ATOM  20645  CB   PHE  H  76    14.037  68.686  67.688  1.00  38.60      A  C
ATOM  20646  CG   PHE  H  76    14.505  68.674  69.057  1.00  38.04      A  C
ATOM  20647  CD1  PHE  H  76    15.822  68.701  69.328  1.00  36.97      A  C
ATOM  20648  CE1  PHE  H  76    16.255  68.707  70.596  1.00  37.86      A  C
ATOM  20649  CZ   PHE  H  76    15.379  68.695  71.596  1.00  36.19      A  C
ATOM  20650  CE2  PHE  H  76    14.076  68.684  71.345  1.00  38.38      A  C
ATOM  20651  CD2  PHE  H  76    13.632  68.674  70.084  1.00  38.33      A  C
ATOM  20652  C    PHE  H  76    13.795  70.059  65.662  1.00  38.18      A  C
ATOM  20653  O    PHE  H  76    14.187  69.131  65.058  1.00  37.29      A  O
ATOM  20654  N    GLU  H  77    13.354  71.145  65.083  1.00  38.56      A  N
ATOM  20655  CA   GLU  H  77    13.131  71.226  63.671  1.00  39.38      A  C
ATOM  20656  CB   GLU  H  77    12.452  72.545  63.345  1.00  40.31      A  C
ATOM  20657  CG   GLU  H  77    11.663  73.090  64.520  1.00  50.89      A  C
ATOM  20658  CD   GLU  H  77    10.209  73.399  64.197  1.00  61.49      A  C
ATOM  20659  OE1  GLU  H  77     9.297  72.727  64.726  1.00  63.23      A  O
ATOM  20660  OE2  GLU  H  77     9.975  74.319  63.410  1.00  64.81      A  O-1
ATOM  20661  C    GLU  H  77    14.398  71.010  62.870  1.00  37.13      A  C
ATOM  20662  O    GLU  H  77    14.385  70.401  61.842  1.00  36.47      A  O
ATOM  20663  N    ALA  H  78    15.504  71.495  63.376  1.00  36.12      A  N
ATOM  20664  CA   ALA  H  78    16.761  71.402  62.676  1.00  34.64      A  C
ATOM  20665  CB   ALA  H  78    17.801  72.087  63.456  1.00  32.49      A  C
ATOM  20666  C    ALA  H  78    17.148  69.970  62.477  1.00  33.65      A  C
ATOM  20667  O    ALA  H  78    17.671  69.604  61.469  1.00  32.39      A  O
ATOM  20668  N    TRP  H  79    16.927  69.187  63.503  1.00  32.46      A  N
ATOM  20669  CA   TRP  H  79    17.193  67.789  63.492  1.00  32.12      A  C
ATOM  20670  CB   TRP  H  79    17.223  67.307  64.930  1.00  31.16      A  C
ATOM  20671  CG   TRP  H  79    18.416  67.830  65.637  1.00  31.69      A  C
ATOM  20672  CD1  TRP  H  79    19.611  67.255  65.707  1.00  27.32      A  C
ATOM  20673  NE1  TRP  H  79    20.459  68.012  66.409  1.00  24.80      A  N
ATOM  20674  CE2  TRP  H  79    19.819  69.143  66.798  1.00  26.29      A  C
ATOM  20675  CD2  TRP  H  79    18.530  69.061  66.334  1.00  30.39      A  C
ATOM  20676  CE3  TRP  H  79    17.664  70.105  66.603  1.00  30.65      A  C
ATOM  20677  CZ3  TRP  H  79    18.108  71.134  67.308  1.00  28.41      A  C
ATOM  20678  CH2  TRP  H  79    19.391  71.183  67.756  1.00  28.06      A  C
ATOM  20679  CZ2  TRP  H  79    20.261  70.198  67.519  1.00  22.98      A  C
ATOM  20680  C    TRP  H  79    16.323  66.952  62.553  1.00  32.81      A  C
ATOM  20681  O    TRP  H  79    16.803  66.065  61.910  1.00  32.82      A  O
ATOM  20682  N    GLU  H  80    15.039  67.256  62.478  1.00  33.13      A  N
ATOM  20683  CA   GLU  H  80    14.105  66.622  61.569  1.00  34.44      A  C
ATOM  20684  CB   GLU  H  80    12.692  67.065  61.841  1.00  33.69      A  C
ATOM  20685  CG   GLU  H  80    12.353  66.989  63.236  1.00  39.41      A  C
ATOM  20686  CD   GLU  H  80    11.091  67.676  63.577  1.00  48.55      A  C
ATOM  20687  OE1  GLU  H  80    10.747  67.666  64.752  1.00  48.30      A  O
ATOM  20688  OE2  GLU  H  80    10.434  68.213  62.692  1.00  51.99      A  O-1
ATOM  20689  C    GLU  H  80    14.408  66.882  60.145  1.00  34.24      A  C
ATOM  20690  O    GLU  H  80    14.276  66.041  59.325  1.00  33.64      A  O
ATOM  20691  N    LEU  H  81    14.813  68.094  59.881  1.00  35.59      A  N
ATOM  20692  CA   LEU  H  81    15.219  68.525  58.580  1.00  36.86      A  C
ATOM  20693  CB   LEU  H  81    15.503  69.989  58.665  1.00  36.81      A  C
ATOM  20694  CG   LEU  H  81    14.772  70.899  57.731  1.00  38.73      A  C
ATOM  20695  CD1  LEU  H  81    13.646  70.216  57.154  1.00  35.76      A  C
ATOM  20696  CD2  LEU  H  81    14.346  72.085  58.458  1.00  40.92      A  C
ATOM  20697  C    LEU  H  81    16.444  67.805  58.070  1.00  37.68      A  C
```

Appendix 1

```
ATOM  20698  O    LEU H  81     16.534  67.501  56.924  1.00  37.68      A  O
ATOM  20699  N    LYS H  82     17.381  67.546  58.959  1.00  37.29      A  N
ATOM  20700  CA   LYS H  82     18.561  66.767  58.699  1.00  37.74      A  C
ATOM  20701  CB   LYS H  82     19.595  67.120  59.721  1.00  38.57      A  C
ATOM  20702  CG   LYS H  82     20.718  67.878  59.183  1.00  41.49      A  C
ATOM  20703  CD   LYS H  82     21.423  68.593  60.252  1.00  42.68      A  C
ATOM  20704  CE   LYS H  82     22.079  67.652  61.132  1.00  45.91      A  C
ATOM  20705  NZ   LYS H  82     22.517  68.367  62.305  1.00  50.86      A  N
ATOM  20706  C    LYS H  82     18.321  65.273  58.778  1.00  38.08      A  C
ATOM  20707  O    LYS H  82     19.196  64.493  58.512  1.00  37.30      A  O
ATOM  20708  N    HIS H  83     17.139  64.889  59.209  1.00  37.17      A  N
ATOM  20709  CA   HIS H  83     16.750  63.517  59.300  1.00  37.40      A  C
ATOM  20710  CB   HIS H  83     16.922  62.868  57.967  1.00  38.01      A  C
ATOM  20711  CG   HIS H  83     16.040  63.441  56.935  1.00  43.40      A  C
ATOM  20712  ND1  HIS H  83     14.684  63.505  57.091  1.00  49.31      A  N
ATOM  20713  CE1  HIS H  83     14.153  64.078  56.035  1.00  50.41      A  C
ATOM  20714  NE2  HIS H  83     15.121  64.407  55.210  1.00  47.90      A  N
ATOM  20715  CD2  HIS H  83     16.312  64.015  55.749  1.00  48.86      A  C
ATOM  20716  C    HIS H  83     17.445  62.700  60.340  1.00  36.00      A  C
ATOM  20717  O    HIS H  83     17.493  61.513  60.234  1.00  37.56      A  O
ATOM  20718  N    THR H  84     17.964  63.342  61.354  1.00  33.39      A  N
ATOM  20719  CA   THR H  84     18.615  62.664  62.438  1.00  32.76      A  C
ATOM  20720  CB   THR H  84     19.230  63.688  63.364  1.00  33.37      A  C
ATOM  20721  OG1  THR H  84     19.947  64.630  62.597  1.00  36.41      A  O
ATOM  20722  CG2  THR H  84     20.151  63.070  64.338  1.00  31.18      A  C
ATOM  20723  C    THR H  84     17.659  61.845  63.265  1.00  31.57      A  C
ATOM  20724  O    THR H  84     16.651  62.325  63.674  1.00  30.47      A  O
ATOM  20725  N    PRO H  85     18.046  60.624  63.560  1.00  29.88      A  N
ATOM  20726  CA   PRO H  85     17.301  59.717  64.402  1.00  30.20      A  C
ATOM  20727  CB   PRO H  85     18.148  58.476  64.373  1.00  29.65      A  C
ATOM  20728  CG   PRO H  85     18.856  58.541  63.177  1.00  30.81      A  C
ATOM  20729  CD   PRO H  85     18.996  59.907  62.724  1.00  30.01      A  C
ATOM  20730  C    PRO H  85     17.219  60.198  65.801  1.00  30.06      A  C
ATOM  20731  O    PRO H  85     18.091  60.836  66.252  1.00  31.07      A  O
ATOM  20732  N    GLN H  86     16.165  59.866  66.486  1.00  29.97      A  N
ATOM  20733  CA   GLN H  86     15.941  60.416  67.770  1.00  30.32      A  C
ATOM  20734  CB   GLN H  86     14.597  59.974  68.295  1.00  27.67      A  C
ATOM  20735  CG   GLN H  86     14.325  60.331  69.695  1.00  31.32      A  C
ATOM  20736  CD   GLN H  86     14.961  59.434  70.720  1.00  34.52      A  C
ATOM  20737  OE1  GLN H  86     14.988  58.247  70.593  1.00  36.06      A  O
ATOM  20738  NE2  GLN H  86     15.439  60.018  71.754  1.00  31.58      A  N
ATOM  20739  C    GLN H  86     17.079  60.014  68.667  1.00  31.41      A  C
ATOM  20740  O    GLN H  86     17.510  60.753  69.509  1.00  31.57      A  O
ATOM  20741  N    ARG H  87     17.576  58.817  68.471  1.00  31.93      A  N
ATOM  20742  CA   ARG H  87     18.643  58.297  69.305  1.00  32.10      A  C
ATOM  20743  CB   ARG H  87     18.790  56.800  69.095  1.00  31.24      A  C
ATOM  20744  CG   ARG H  87     17.785  56.024  69.863  1.00  33.83      A  C
ATOM  20745  CD   ARG H  87     17.931  54.568  69.735  1.00  32.98      A  C
ATOM  20746  NE   ARG H  87     16.660  53.897  69.859  1.00  37.61      A  N
ATOM  20747  CZ   ARG H  87     16.236  53.260  70.938  1.00  38.92      A  C
ATOM  20748  NH1  ARG H  87     16.973  53.202  72.009  1.00  35.43      A  N
ATOM  20749  NH2  ARG H  87     15.067  52.683  70.938  1.00  34.97      A  N
ATOM  20750  C    ARG H  87     19.963  59.053  69.210  1.00  31.24      A  C
ATOM  20751  O    ARG H  87     20.663  59.199  70.142  1.00  31.44      A  O
```

Appendix 1

```
ATOM  20752  N    VAL H  88      20.234  59.577  68.054  1.00 30.09      A  N
ATOM  20753  CA   VAL H  88      21.446  60.261  67.775  1.00 29.60      A  C
ATOM  20754  CB   VAL H  88      21.724  60.111  66.307  1.00 30.92      A  C
ATOM  20755  CG1  VAL H  88      23.038  60.610  65.956  1.00 30.17      A  C
ATOM  20756  CG2  VAL H  88      21.595  58.710  65.949  1.00 31.48      A  C
ATOM  20757  C    VAL H  88      21.458  61.713  68.171  1.00 28.86      A  C
ATOM  20758  O    VAL H  88      22.479  62.297  68.202  1.00 27.36      A  O
ATOM  20759  N    ILE H  89      20.314  62.265  68.496  1.00 27.48      A  N
ATOM  20760  CA   ILE H  89      20.156  63.685  68.736  1.00 27.32      A  C
ATOM  20761  CB   ILE H  89      18.693  64.043  68.971  1.00 27.51      A  C
ATOM  20762  CG1  ILE H  89      17.843  63.725  67.764  1.00 25.76      A  C
ATOM  20763  CD1  ILE H  89      16.522  64.323  67.806  1.00 22.13      A  C
ATOM  20764  CG2  ILE H  89      18.546  65.466  69.222  1.00 26.83      A  C
ATOM  20765  C    ILE H  89      20.974  64.213  69.882  1.00 28.04      A  C
ATOM  20766  O    ILE H  89      21.455  65.298  69.830  1.00 27.84      A  O
ATOM  20767  N    LYS H  90      21.085  63.421  70.924  1.00 29.80      A  N
ATOM  20768  CA   LYS H  90      21.865  63.702  72.095  1.00 30.34      A  C
ATOM  20769  CB   LYS H  90      21.607  62.644  73.143  1.00 30.91      A  C
ATOM  20770  CG   LYS H  90      22.209  61.345  72.820  1.00 32.36      A  C
ATOM  20771  CD   LYS H  90      22.054  60.386  73.917  1.00 36.15      A  C
ATOM  20772  CE   LYS H  90      20.695  60.441  74.435  1.00 39.51      A  C
ATOM  20773  NZ   LYS H  90      19.860  59.467  73.787  1.00 39.51      A  N
ATOM  20774  C    LYS H  90      23.327  63.778  71.808  1.00 31.88      A  C
ATOM  20775  O    LYS H  90      24.020  64.561  72.383  1.00 31.06      A  O
ATOM  20776  N    TYR H  91      23.801  62.902  70.950  1.00 32.98      A  N
ATOM  20777  CA   TYR H  91      25.157  62.968  70.484  1.00 34.53      A  C
ATOM  20778  CB   TYR H  91      25.567  61.687  69.791  1.00 34.94      A  C
ATOM  20779  CG   TYR H  91      25.352  60.465  70.588  1.00 38.74      A  C
ATOM  20780  CD1  TYR H  91      26.126  60.183  71.663  1.00 44.23      A  C
ATOM  20781  CE1  TYR H  91      25.917  59.064  72.390  1.00 47.94      A  C
ATOM  20782  CZ   TYR H  91      24.937  58.215  72.036  1.00 48.79      A  C
ATOM  20783  OH   TYR H  91      24.733  57.090  72.752  1.00 50.25      A  O
ATOM  20784  CE2  TYR H  91      24.165  58.474  70.969  1.00 45.30      A  C
ATOM  20785  CD2  TYR H  91      24.373  59.585  70.257  1.00 42.42      A  C
ATOM  20786  C    TYR H  91      25.443  64.164  69.618  1.00 34.15      A  C
ATOM  20787  O    TYR H  91      26.478  64.743  69.701  1.00 36.43      A  O
ATOM  20788  N    SER H  92      24.513  64.504  68.763  1.00 32.12      A  N
ATOM  20789  CA   SER H  92      24.674  65.621  67.899  1.00 29.54      A  C
ATOM  20790  CB   SER H  92      23.521  65.690  66.926  1.00 27.63      A  C
ATOM  20791  OG   SER H  92      23.330  66.988  66.542  1.00 25.35      A  O
ATOM  20792  C    SER H  92      24.775  66.884  68.695  1.00 29.96      A  C
ATOM  20793  O    SER H  92      25.530  67.750  68.369  1.00 29.40      A  O
ATOM  20794  N    ILE H  93      23.979  66.995  69.738  1.00 29.96      A  N
ATOM  20795  CA   ILE H  93      24.033  68.141  70.623  1.00 28.74      A  C
ATOM  20796  CB   ILE H  93      22.879  68.163  71.630  1.00 28.66      A  C
ATOM  20797  CG1  ILE H  93      21.541  68.218  70.946  1.00 30.79      A  C
ATOM  20798  CD1  ILE H  93      20.415  67.876  71.870  1.00 33.46      A  C
ATOM  20799  CG2  ILE H  93      22.958  69.327  72.465  1.00 25.41      A  C
ATOM  20800  C    ILE H  93      25.299  68.255  71.410  1.00 26.81      A  C
ATOM  20801  O    ILE H  93      25.795  69.296  71.557  1.00 27.66      A  O
ATOM  20802  N    ALA H  94      25.794  67.176  71.950  1.00 25.04      A  N
ATOM  20803  CA   ALA H  94      27.018  67.227  72.671  1.00 25.16      A  C
ATOM  20804  CB   ALA H  94      27.223  65.969  73.327  1.00 24.38      A  C
ATOM  20805  C    ALA H  94      28.226  67.593  71.836  1.00 26.75      A  C
```

Appendix 1

```
ATOM  20806  O    ALA H  94    29.006  68.405  72.208  1.00  26.35    A    O
ATOM  20807  N    PHE H  95    28.349  66.994  70.680  1.00  27.35    A    N
ATOM  20808  CA   PHE H  95    29.424  67.308  69.799  1.00  28.73    A    C
ATOM  20809  CB   PHE H  95    29.514  66.302  68.669  1.00  29.58    A    C
ATOM  20810  CG   PHE H  95    29.823  64.926  69.143  1.00  33.23    A    C
ATOM  20811  CD1  PHE H  95    30.853  64.684  69.988  1.00  39.27    A    C
ATOM  20812  CE1  PHE H  95    31.086  63.450  70.425  1.00  38.85    A    C
ATOM  20813  CZ   PHE H  95    30.293  62.454  70.044  1.00  39.10    A    C
ATOM  20814  CE2  PHE H  95    29.303  62.675  69.233  1.00  36.37    A    C
ATOM  20815  CD2  PHE H  95    29.055  63.890  68.789  1.00  35.14    A    C
ATOM  20816  C    PHE H  95    29.392  68.736  69.338  1.00  29.58    A    C
ATOM  20817  O    PHE H  95    30.385  69.358  69.139  1.00  31.20    A    O
ATOM  20818  N    TYR H  96    28.228  69.273  69.171  1.00  30.75    A    N
ATOM  20819  CA   TYR H  96    28.136  70.638  68.811  1.00  29.71    A    C
ATOM  20820  CB   TYR H  96    26.690  70.981  68.593  1.00  29.99    A    C
ATOM  20821  CG   TYR H  96    26.212  70.956  67.192  1.00  29.63    A    C
ATOM  20822  CD1  TYR H  96    27.025  71.262  66.161  1.00  31.34    A    C
ATOM  20823  CE1  TYR H  96    26.561  71.246  64.894  1.00  30.39    A    C
ATOM  20824  CZ   TYR H  96    25.271  70.943  64.656  1.00  30.12    A    C
ATOM  20825  OH   TYR H  96    24.784  70.921  63.412  1.00  29.04    A    O
ATOM  20826  CE2  TYR H  96    24.456  70.615  65.671  1.00  31.49    A    C
ATOM  20827  CD2  TYR H  96    24.918  70.625  66.911  1.00  32.25    A    C
ATOM  20828  C    TYR H  96    28.673  71.448  69.930  1.00  29.14    A    C
ATOM  20829  O    TYR H  96    29.343  72.395  69.723  1.00  27.64    A    O
ATOM  20830  N    ALA H  97    28.305  71.065  71.128  1.00  29.21    A    N
ATOM  20831  CA   ALA H  97    28.706  71.726  72.339  1.00  29.61    A    C
ATOM  20832  CB   ALA H  97    27.957  71.173  73.484  1.00  27.98    A    C
ATOM  20833  C    ALA H  97    30.194  71.641  72.588  1.00  30.01    A    C
ATOM  20834  O    ALA H  97    30.774  72.544  73.085  1.00  30.12    A    O
ATOM  20835  N    TYR H  98    30.797  70.518  72.291  1.00  30.22    A    N
ATOM  20836  CA   TYR H  98    32.219  70.395  72.432  1.00  31.62    A    C
ATOM  20837  CB   TYR H  98    32.674  68.956  72.310  1.00  31.30    A    C
ATOM  20838  CG   TYR H  98    32.009  67.997  73.251  1.00  30.84    A    C
ATOM  20839  CD1  TYR H  98    31.505  68.402  74.450  1.00  30.25    A    C
ATOM  20840  CE1  TYR H  98    30.891  67.535  75.264  1.00  29.23    A    C
ATOM  20841  CZ   TYR H  98    30.779  66.262  74.900  1.00  31.19    A    C
ATOM  20842  OH   TYR H  98    30.167  65.384  75.709  1.00  34.92    A    O
ATOM  20843  CE2  TYR H  98    31.257  65.842  73.739  1.00  27.74    A    C
ATOM  20844  CD2  TYR H  98    31.872  66.691  72.927  1.00  30.65    A    C
ATOM  20845  C    TYR H  98    32.967  71.312  71.490  1.00  33.36    A    C
ATOM  20846  O    TYR H  98    33.961  71.874  71.856  1.00  34.43    A    O
ATOM  20847  N    GLY H  99    32.474  71.461  70.274  1.00  34.38    A    N
ATOM  20848  CA   GLY H  99    33.008  72.372  69.290  1.00  34.63    A    C
ATOM  20849  C    GLY H  99    32.903  73.828  69.658  1.00  36.23    A    C
ATOM  20850  O    GLY H  99    33.729  74.619  69.347  1.00  36.97    A    O
ATOM  20851  N    LEU H 100    31.821  74.171  70.279  1.00  36.49    A    N
ATOM  20852  CA   LEU H 100    31.571  75.492  70.776  1.00  37.27    A    C
ATOM  20853  CB   LEU H 100    30.144  75.589  71.285  1.00  36.33    A    C
ATOM  20854  CG   LEU H 100    29.047  76.185  70.433  1.00  35.54    A    C
ATOM  20855  CD1  LEU H 100    29.519  76.668  69.150  1.00  33.51    A    C
ATOM  20856  CD2  LEU H 100    27.975  75.235  70.246  1.00  34.25    A    C
ATOM  20857  C    LEU H 100    32.536  75.891  71.871  1.00  38.18    A    C
ATOM  20858  O    LEU H 100    32.841  77.026  72.023  1.00  37.98    A    O
ATOM  20859  N    ALA H 101    32.970  74.949  72.672  1.00  38.63    A    N
```

Appendix 1

```
ATOM  20860  CA   ALA H 101    33.909  75.241  73.715  1.00 39.32      A    C
ATOM  20861  CB   ALA H 101    34.099  74.056  74.561  1.00 39.68      A    C
ATOM  20862  C    ALA H 101    35.221  75.693  73.172  1.00 39.21      A    C
ATOM  20863  O    ALA H 101    35.843  76.544  73.696  1.00 37.91      A    O
ATOM  20864  N    SER H 102    35.655  75.051  72.130  1.00 40.56      A    N
ATOM  20865  CA   SER H 102    36.836  75.418  71.421  1.00 41.99      A    C
ATOM  20866  CB   SER H 102    37.227  74.330  70.468  1.00 42.67      A    C
ATOM  20867  OG   SER H 102    37.833  73.306  71.182  1.00 44.86      A    O
ATOM  20868  C    SER H 102    36.727  76.739  70.730  1.00 42.40      A    C
ATOM  20869  O    SER H 102    37.672  77.445  70.661  1.00 42.92      A    O
ATOM  20870  N    VAL H 103    35.559  77.058  70.219  1.00 42.41      A    N
ATOM  20871  CA   VAL H 103    35.309  78.357  69.628  1.00 42.61      A    C
ATOM  20872  CB   VAL H 103    33.983  78.405  68.869  1.00 42.54      A    C
ATOM  20873  CG1  VAL H 103    33.745  79.732  68.308  1.00 39.48      A    C
ATOM  20874  CG2  VAL H 103    34.001  77.408  67.744  1.00 41.70      A    C
ATOM  20875  C    VAL H 103    35.471  79.473  70.658  1.00 43.94      A    C
ATOM  20876  O    VAL H 103    35.935  80.533  70.357  1.00 43.33      A    O
ATOM  20877  N    ALA H 104    35.102  79.201  71.887  1.00 45.24      A    N
ATOM  20878  CA   ALA H 104    35.376  80.086  72.990  1.00 46.99      A    C
ATOM  20879  CB   ALA H 104    34.702  79.567  74.193  1.00 46.41      A    C
ATOM  20880  C    ALA H 104    36.868  80.291  73.279  1.00 47.96      A    C
ATOM  20881  O    ALA H 104    37.280  81.367  73.625  1.00 48.46      A    O
ATOM  20882  N    LEU H 105    37.648  79.234  73.185  1.00 48.55      A    N
ATOM  20883  CA   LEU H 105    39.079  79.301  73.281  1.00 49.81      A    C
ATOM  20884  CB   LEU H 105    39.641  77.905  73.382  1.00 50.40      A    C
ATOM  20885  CG   LEU H 105    39.848  77.392  74.787  1.00 53.10      A    C
ATOM  20886  CD1  LEU H 105    40.765  76.250  74.787  1.00 53.85      A    C
ATOM  20887  CD2  LEU H 105    40.408  78.476  75.604  1.00 56.62      A    C
ATOM  20888  C    LEU H 105    39.773  80.022  72.161  1.00 49.93      A    C
ATOM  20889  O    LEU H 105    40.715  80.701  72.388  1.00 50.53      A    O
ATOM  20890  N    ILE H 106    39.363  79.777  70.940  1.00 50.12      A    N
ATOM  20891  CA   ILE H 106    39.972  80.390  69.786  1.00 50.77      A    C
ATOM  20892  CB   ILE H 106    39.380  79.796  68.553  1.00 50.31      A    C
ATOM  20893  CG1  ILE H 106    39.899  78.410  68.337  1.00 50.31      A    C
ATOM  20894  CD1  ILE H 106    39.320  77.829  67.177  1.00 51.60      A    C
ATOM  20895  CG2  ILE H 106    39.730  80.621  67.393  1.00 50.54      A    C
ATOM  20896  C    ILE H 106    39.815  81.874  69.552  1.00 52.26      A    C
ATOM  20897  O    ILE H 106    40.762  82.552  69.197  1.00 53.47      A    O
ATOM  20898  N    ASP H 107    38.594  82.364  69.669  1.00 52.42      A    N
ATOM  20899  CA   ASP H 107    38.263  83.666  69.174  1.00 52.61      A    C
ATOM  20900  CB   ASP H 107    37.477  83.469  67.900  1.00 52.78      A    C
ATOM  20901  CG   ASP H 107    37.316  84.712  67.125  1.00 57.24      A    C
ATOM  20902  OD1  ASP H 107    37.371  85.778  67.749  1.00 57.51      A    O
ATOM  20903  OD2  ASP H 107    37.119  84.618  65.895  1.00 59.31      A    O-1
ATOM  20904  C    ASP H 107    37.450  84.401  70.184  1.00 52.38      A    C
ATOM  20905  O    ASP H 107    36.273  84.262  70.256  1.00 52.41      A    O
ATOM  20906  N    PRO H 108    38.092  85.219  70.977  1.00 52.76      A    N
ATOM  20907  CA   PRO H 108    37.469  85.774  72.163  1.00 51.35      A    C
ATOM  20908  CB   PRO H 108    38.617  86.528  72.823  1.00 51.66      A    C
ATOM  20909  CG   PRO H 108    39.813  86.268  71.991  1.00 51.16      A    C
ATOM  20910  CD   PRO H 108    39.311  85.957  70.652  1.00 52.85      A    C
ATOM  20911  C    PRO H 108    36.364  86.684  71.745  1.00 49.69      A    C
ATOM  20912  O    PRO H 108    35.528  87.045  72.516  1.00 49.01      A    O
ATOM  20913  N    LYS H 109    36.389  87.059  70.488  1.00 49.02      A    N
```

Appendix 1

```
ATOM   20914  CA   LYS H 109      35.346  87.880  69.917  1.00 48.40           A    C
ATOM   20915  CB   LYS H 109      35.742  88.443  68.565  1.00 48.60           A    C
ATOM   20916  CG   LYS H 109      36.450  89.775  68.660  1.00 53.35           A    C
ATOM   20917  CD   LYS H 109      36.279  90.642  67.428  1.00 60.77           A    C
ATOM   20918  CE   LYS H 109      36.843  90.005  66.176  1.00 63.38           A    C
ATOM   20919  NZ   LYS H 109      36.060  88.820  65.747  1.00 64.93           A    N
ATOM   20920  C    LYS H 109      34.072  87.100  69.822  1.00 46.73           A    C
ATOM   20921  O    LYS H 109      33.022  87.668  69.693  1.00 46.29           A    O
ATOM   20922  N    LEU H 110      34.188  85.785  69.868  1.00 44.06           A    N
ATOM   20923  CA   LEU H 110      33.042  84.924  69.817  1.00 41.34           A    C
ATOM   20924  CB   LEU H 110      33.170  83.918  68.692  1.00 41.38           A    C
ATOM   20925  CG   LEU H 110      33.351  84.522  67.322  1.00 40.77           A    C
ATOM   20926  CD1  LEU H 110      33.803  83.521  66.379  1.00 37.59           A    C
ATOM   20927  CD2  LEU H 110      32.110  85.103  66.861  1.00 40.12           A    C
ATOM   20928  C    LEU H 110      32.709  84.204  71.079  1.00 39.49           A    C
ATOM   20929  O    LEU H 110      31.868  83.388  71.049  1.00 40.11           A    O
ATOM   20930  N    ARG H 111      33.359  84.480  72.180  1.00 37.11           A    N
ATOM   20931  CA   ARG H 111      33.125  83.679  73.361  1.00 36.70           A    C
ATOM   20932  CB   ARG H 111      34.155  83.968  74.449  1.00 36.68           A    C
ATOM   20933  CG   ARG H 111      34.115  83.061  75.634  1.00 37.44           A    C
ATOM   20934  CD   ARG H 111      35.422  83.056  76.324  1.00 39.25           A    C
ATOM   20935  NE   ARG H 111      35.323  82.629  77.703  1.00 42.92           A    N
ATOM   20936  CZ   ARG H 111      36.334  82.199  78.435  1.00 43.62           A    C
ATOM   20937  NH1  ARG H 111      37.537  82.127  77.933  1.00 41.17           A    N
ATOM   20938  NH2  ARG H 111      36.136  81.843  79.674  1.00 41.01           A    N
ATOM   20939  C    ARG H 111      31.709  83.779  73.875  1.00 36.29           A    C
ATOM   20940  O    ARG H 111      31.134  82.810  74.269  1.00 36.99           A    O
ATOM   20941  N    ALA H 112      31.131  84.955  73.847  1.00 35.23           A    N
ATOM   20942  CA   ALA H 112      29.775  85.120  74.303  1.00 34.28           A    C
ATOM   20943  CB   ALA H 112      29.405  86.544  74.288  1.00 33.84           A    C
ATOM   20944  C    ALA H 112      28.806  84.338  73.490  1.00 33.88           A    C
ATOM   20945  O    ALA H 112      27.917  83.749  74.018  1.00 30.96           A    O
ATOM   20946  N    LEU H 113      28.986  84.326  72.184  1.00 34.97           A    N
ATOM   20947  CA   LEU H 113      28.098  83.580  71.329  1.00 35.87           A    C
ATOM   20948  CB   LEU H 113      28.389  83.843  69.876  1.00 35.25           A    C
ATOM   20949  CG   LEU H 113      27.517  83.087  68.915  1.00 35.85           A    C
ATOM   20950  CD1  LEU H 113      26.206  83.708  68.779  1.00 31.11           A    C
ATOM   20951  CD2  LEU H 113      28.179  82.930  67.600  1.00 35.04           A    C
ATOM   20952  C    LEU H 113      28.144  82.108  71.622  1.00 37.04           A    C
ATOM   20953  O    LEU H 113      27.139  81.485  71.742  1.00 36.99           A    O
ATOM   20954  N    ALA H 114      29.318  81.569  71.826  1.00 36.60           A    N
ATOM   20955  CA   ALA H 114      29.432  80.215  72.272  1.00 36.41           A    C
ATOM   20956  CB   ALA H 114      30.834  79.870  72.363  1.00 36.75           A    C
ATOM   20957  C    ALA H 114      28.754  79.998  73.617  1.00 37.02           A    C
ATOM   20958  O    ALA H 114      28.207  78.971  73.879  1.00 37.96           A    O
ATOM   20959  N    GLY H 115      28.822  80.960  74.494  1.00 36.68           A    N
ATOM   20960  CA   GLY H 115      28.132  80.830  75.733  1.00 36.27           A    C
ATOM   20961  C    GLY H 115      26.665  80.794  75.506  1.00 36.18           A    C
ATOM   20962  O    GLY H 115      25.971  80.071  76.138  1.00 37.12           A    O
ATOM   20963  N    HIS H 116      26.180  81.611  74.609  1.00 35.31           A    N
ATOM   20964  CA   HIS H 116      24.780  81.611  74.372  1.00 35.36           A    C
ATOM   20965  CB   HIS H 116      24.433  82.750  73.426  1.00 34.89           A    C
ATOM   20966  CG   HIS H 116      23.062  82.673  72.852  1.00 38.16           A    C
ATOM   20967  ND1  HIS H 116      21.928  82.720  73.618  1.00 39.35           A    N
```

Appendix 1

```
ATOM  20968  CE1  HIS  H  116   20.872  82.626  72.846  1.00  36.26  A  C
ATOM  20969  NE2  HIS  H  116   21.279  82.515  71.604  1.00  36.28  A  N
ATOM  20970  CD2  HIS  H  116   22.643  82.556  71.578  1.00  38.21  A  C
ATOM  20971  C    HIS  H  116   24.382  80.253  73.845  1.00  36.11  A  C
ATOM  20972  O    HIS  H  116   23.432  79.674  74.283  1.00  36.24  A  O
ATOM  20973  N    ASP  H  117   25.141  79.732  72.904  1.00  36.70  A  N
ATOM  20974  CA   ASP  H  117   24.848  78.464  72.269  1.00  37.03  A  C
ATOM  20975  CB   ASP  H  117   25.707  78.263  71.035  1.00  37.00  A  C
ATOM  20976  CG   ASP  H  117   25.334  79.157  69.932  1.00  38.31  A  C
ATOM  20977  OD1  ASP  H  117   24.242  79.668  69.940  1.00  35.98  A  O
ATOM  20978  OD2  ASP  H  117   26.136  79.365  69.051  1.00  38.73  A  O-1
ATOM  20979  C    ASP  H  117   24.916  77.257  73.168  1.00  37.44  A  C
ATOM  20980  O    ASP  H  117   24.116  76.377  73.058  1.00  37.22  A  O
ATOM  20981  N    LEU  H  118   25.907  77.235  74.040  1.00  37.52  A  N
ATOM  20982  CA   LEU  H  118   26.092  76.211  75.048  1.00  37.26  A  C
ATOM  20983  CB   LEU  H  118   27.388  76.454  75.786  1.00  37.53  A  C
ATOM  20984  CG   LEU  H  118   28.662  75.684  75.476  1.00  39.28  A  C
ATOM  20985  CD1  LEU  H  118   28.418  74.583  74.567  1.00  36.54  A  C
ATOM  20986  CD2  LEU  H  118   29.717  76.564  74.942  1.00  35.86  A  C
ATOM  20987  C    LEU  H  118   24.935  76.205  76.021  1.00  36.72  A  C
ATOM  20988  O    LEU  H  118   24.547  75.193  76.516  1.00  36.12  A  O
ATOM  20989  N    ASP  H  119   24.411  77.371  76.311  1.00  36.15  A  N
ATOM  20990  CA   ASP  H  119   23.262  77.486  77.154  1.00  36.42  A  C
ATOM  20991  CB   ASP  H  119   22.985  78.957  77.373  1.00  37.85  A  C
ATOM  20992  CG   ASP  H  119   21.906  79.207  78.372  1.00  42.58  A  C
ATOM  20993  OD1  ASP  H  119   21.442  78.270  78.959  1.00  47.34  A  O
ATOM  20994  OD2  ASP  H  119   21.494  80.340  78.569  1.00  49.72  A  O-1
ATOM  20995  C    ASP  H  119   22.090  76.817  76.495  1.00  35.08  A  C
ATOM  20996  O    ASP  H  119   21.389  76.059  77.100  1.00  33.83  A  O
ATOM  20997  N    ILE  H  120   21.899  77.099  75.230  1.00  34.80  A  N
ATOM  20998  CA   ILE  H  120   20.868  76.478  74.446  1.00  34.35  A  C
ATOM  20999  CB   ILE  H  120   20.699  77.123  73.111  1.00  34.33  A  C
ATOM  21000  CG1  ILE  H  120   19.725  78.262  73.253  1.00  34.55  A  C
ATOM  21001  CD1  ILE  H  120   19.939  79.352  72.327  1.00  34.86  A  C
ATOM  21002  CG2  ILE  H  120   20.091  76.187  72.176  1.00  33.97  A  C
ATOM  21003  C    ILE  H  120   21.077  75.018  74.300  1.00  34.67  A  C
ATOM  21004  O    ILE  H  120   20.168  74.265  74.404  1.00  36.29  A  O
ATOM  21005  N    ALA  H  121   22.304  74.613  74.118  1.00  33.98  A  N
ATOM  21006  CA   ALA  H  121   22.592  73.227  74.012  1.00  34.10  A  C
ATOM  21007  CB   ALA  H  121   24.023  73.038  73.756  1.00  34.05  A  C
ATOM  21008  C    ALA  H  121   22.183  72.472  75.255  1.00  35.11  A  C
ATOM  21009  O    ALA  H  121   21.702  71.392  75.156  1.00  35.57  A  O
ATOM  21010  N    VAL  H  122   22.385  73.015  76.431  1.00  35.60  A  N
ATOM  21011  CA   VAL  H  122   21.943  72.340  77.635  1.00  36.45  A  C
ATOM  21012  CB   VAL  H  122   22.551  72.983  78.874  1.00  37.23  A  C
ATOM  21013  CG1  VAL  H  122   21.919  72.498  80.101  1.00  36.31  A  C
ATOM  21014  CG2  VAL  H  122   23.986  72.720  78.922  1.00  37.97  A  C
ATOM  21015  C    VAL  H  122   20.429  72.164  77.786  1.00  37.13  A  C
ATOM  21016  O    VAL  H  122   19.981  71.093  78.087  1.00  37.31  A  O
ATOM  21017  N    SER  H  123   19.636  73.184  77.522  1.00  36.60  A  N
ATOM  21018  CA   SER  H  123   18.221  73.008  77.615  1.00  36.69  A  C
ATOM  21019  CB   SER  H  123   17.486  74.282  77.297  1.00  37.51  A  C
ATOM  21020  OG   SER  H  123   18.339  75.352  77.251  1.00  41.93  A  O
ATOM  21021  C    SER  H  123   17.713  72.002  76.659  1.00  36.11  A  C
```

Appendix 1

```
ATOM  21022  O    SER H 123      16.971  71.142  77.028  1.00 36.44      A    O
ATOM  21023  N    LYS H 124      18.136  72.085  75.424  1.00 34.45      A    N
ATOM  21024  CA   LYS H 124      17.610  71.200  74.429  1.00 33.64      A    C
ATOM  21025  CB   LYS H 124      18.179  71.506  73.047  1.00 33.33      A    C
ATOM  21026  CG   LYS H 124      17.568  72.694  72.364  1.00 31.65      A    C
ATOM  21027  CD   LYS H 124      17.631  72.614  70.884  1.00 30.75      A    C
ATOM  21028  CE   LYS H 124      16.856  73.695  70.225  1.00 31.72      A    C
ATOM  21029  NZ   LYS H 124      15.619  73.978  70.899  1.00 33.52      A    N
ATOM  21030  C    LYS H 124      17.952  69.824  74.886  1.00 33.71      A    C
ATOM  21031  O    LYS H 124      17.176  68.916  74.794  1.00 32.53      A    O
ATOM  21032  N    MET H 125      19.124  69.707  75.466  1.00 34.35      A    N
ATOM  21033  CA   MET H 125      19.668  68.456  75.869  1.00 35.15      A    C
ATOM  21034  CB   MET H 125      20.994  68.714  76.535  1.00 35.72      H    C
ATOM  21035  CG   MET H 125      21.841  67.538  76.768  1.00 35.27      H    C
ATOM  21036  SD   MET H 125      21.876  66.436  75.440  1.00 36.71      H    S
ATOM  21037  CE   MET H 125      23.233  65.421  75.793  1.00 28.29      H    C
ATOM  21038  C    MET H 125      18.707  67.921  76.854  1.00 35.92      A    C
ATOM  21039  O    MET H 125      18.444  66.761  76.920  1.00 36.22      A    O
ATOM  21040  N    LYS H 126      18.169  68.814  77.640  1.00 36.19      A    N
ATOM  21041  CA   LYS H 126      17.293  68.433  78.717  1.00 37.58      A    C
ATOM  21042  CB   LYS H 126      17.299  69.504  79.790  1.00 37.37      A    C
ATOM  21043  CG   LYS H 126      18.368  69.298  80.810  1.00 38.94      A    C
ATOM  21044  CD   LYS H 126      18.918  70.580  81.353  1.00 42.98      A    C
ATOM  21045  CE   LYS H 126      17.905  71.346  82.161  1.00 43.24      A    C
ATOM  21046  NZ   LYS H 126      18.183  71.382  83.593  1.00 40.77      A    N
ATOM  21047  C    LYS H 126      15.896  68.006  78.307  1.00 38.07      A    C
ATOM  21048  O    LYS H 126      15.174  67.459  79.076  1.00 38.91      A    O
ATOM  21049  N    CYS H 127      15.532  68.263  77.076  1.00 38.15      A    N
ATOM  21050  CA   CYS H 127      14.219  67.956  76.563  1.00 38.45      A    C
ATOM  21051  CB   CYS H 127      14.000  68.716  75.267  1.00 39.04      A    C
ATOM  21052  SG   CYS H 127      13.577  70.410  75.405  1.00 42.98      A    S
ATOM  21053  C    CYS H 127      13.971  66.471  76.378  1.00 37.18      A    C
ATOM  21054  O    CYS H 127      14.855  65.743  76.101  1.00 35.57      A    O
ATOM  21055  N    LYS H 128      12.735  66.057  76.536  1.00 36.22      A    N
ATOM  21056  CA   LYS H 128      12.350  64.661  76.543  1.00 36.27      A    C
ATOM  21057  CB   LYS H 128      10.908  64.493  76.946  1.00 36.99      A    C
ATOM  21058  CG   LYS H 128      10.602  63.094  77.200  1.00 41.29      A    C
ATOM  21059  CD   LYS H 128       9.222  62.866  77.617  1.00 48.21      A    C
ATOM  21060  CE   LYS H 128       9.068  61.458  78.102  1.00 51.49      A    C
ATOM  21061  NZ   LYS H 128       7.812  61.248  78.837  1.00 52.16      A    N
ATOM  21062  C    LYS H 128      12.578  63.930  75.262  1.00 34.77      A    C
ATOM  21063  O    LYS H 128      12.772  62.747  75.243  1.00 34.33      A    O
ATOM  21064  N    ARG H 129      12.517  64.664  74.181  1.00 34.51      A    N
ATOM  21065  CA   ARG H 129      12.734  64.128  72.886  1.00 34.13      A    C
ATOM  21066  CB   ARG H 129      12.586  65.235  71.880  1.00 34.23      A    C
ATOM  21067  CG   ARG H 129      12.911  64.868  70.490  1.00 33.52      A    C
ATOM  21068  CD   ARG H 129      12.161  63.706  69.976  1.00 36.89      A    C
ATOM  21069  NE   ARG H 129      12.385  63.560  68.554  1.00 39.55      A    N
ATOM  21070  CZ   ARG H 129      11.938  62.562  67.822  1.00 39.80      A    C
ATOM  21071  NH1  ARG H 129      11.241  61.602  68.365  1.00 36.21      A    N
ATOM  21072  NH2  ARG H 129      12.204  62.526  66.545  1.00 42.42      A    N
ATOM  21073  C    ARG H 129      14.117  63.589  72.830  1.00 34.43      A    C
ATOM  21074  O    ARG H 129      14.350  62.546  72.303  1.00 35.85      A    O
ATOM  21075  N    VAL H 130      15.053  64.327  73.370  1.00 33.82      A    N
```

Appendix 1

```
ATOM  21076  CA   VAL H 130      16.399  63.847  73.470  1.00 32.86      A    C
ATOM  21077  CB   VAL H 130      17.294  64.951  73.969  1.00 32.86      A    C
ATOM  21078  CG1  VAL H 130      18.653  64.509  73.987  1.00 30.64      A    C
ATOM  21079  CG2  VAL H 130      17.168  66.114  73.118  1.00 29.77      A    C
ATOM  21080  C    VAL H 130      16.623  62.638  74.355  1.00 34.09      A    C
ATOM  21081  O    VAL H 130      17.287  61.729  73.953  1.00 33.22      A    O
ATOM  21082  N    TRP H 131      16.116  62.637  75.577  1.00 34.97      A    N
ATOM  21083  CA   TRP H 131      16.376  61.531  76.491  1.00 36.08      A    C
ATOM  21084  CB   TRP H 131      16.679  61.982  77.917  1.00 35.76      A    C
ATOM  21085  CG   TRP H 131      15.609  62.758  78.600  1.00 38.00      A    C
ATOM  21086  CD1  TRP H 131      15.574  64.063  78.743  1.00 37.26      A    C
ATOM  21087  NE1  TRP H 131      14.481  64.440  79.424  1.00 41.30      A    N
ATOM  21088  CE2  TRP H 131      13.757  63.333  79.729  1.00 40.11      A    C
ATOM  21089  CD2  TRP H 131      14.445  62.258  79.245  1.00 39.49      A    C
ATOM  21090  CE3  TRP H 131      13.922  60.996  79.448  1.00 39.59      A    C
ATOM  21091  CZ3  TRP H 131      12.772  60.877  80.103  1.00 39.77      A    C
ATOM  21092  CH2  TRP H 131      12.112  61.959  80.582  1.00 40.21      A    C
ATOM  21093  CZ2  TRP H 131      12.590  63.200  80.411  1.00 42.89      A    C
ATOM  21094  C    TRP H 131      15.347  60.432  76.515  1.00 37.45      A    C
ATOM  21095  O    TRP H 131      15.512  59.450  77.199  1.00 37.69      A    O
ATOM  21096  N    GLY H 132      14.301  60.581  75.733  1.00 38.36      A    N
ATOM  21097  CA   GLY H 132      13.124  59.754  75.844  1.00 39.28      A    C
ATOM  21098  C    GLY H 132      13.225  58.265  75.610  1.00 39.56      A    C
ATOM  21099  O    GLY H 132      12.382  57.547  76.028  1.00 40.51      A    O
ATOM  21100  N    ASP H 133      14.252  57.818  74.922  1.00 39.34      A    N
ATOM  21101  CA   ASP H 133      14.364  56.443  74.563  1.00 38.46      A    C
ATOM  21102  CB   ASP H 133      15.554  56.218  73.674  1.00 38.53      A    C
ATOM  21103  CG   ASP H 133      16.679  57.085  74.012  1.00 41.16      A    C
ATOM  21104  OD1  ASP H 133      17.780  56.575  74.221  1.00 43.50      A    O
ATOM  21105  OD2  ASP H 133      16.476  58.277  74.048  1.00 40.76      A    O-1
ATOM  21106  C    ASP H 133      14.475  55.619  75.794  1.00 37.90      A    C
ATOM  21107  O    ASP H 133      14.138  54.463  75.813  1.00 37.03      A    O
ATOM  21108  N    TRP H 134      15.000  56.230  76.824  1.00 37.08      A    N
ATOM  21109  CA   TRP H 134      15.212  55.557  78.062  1.00 37.45      A    C
ATOM  21110  CB   TRP H 134      15.962  56.482  79.005  1.00 35.97      A    C
ATOM  21111  CG   TRP H 134      16.233  55.921  80.318  1.00 36.94      A    C
ATOM  21112  CD1  TRP H 134      15.519  56.106  81.414  1.00 35.21      A    C
ATOM  21113  NE1  TRP H 134      16.039  55.420  82.437  1.00 34.97      A    N
ATOM  21114  CE2  TRP H 134      17.152  54.773  82.015  1.00 33.59      A    C
ATOM  21115  CD2  TRP H 134      17.303  55.064  80.683  1.00 37.17      A    C
ATOM  21116  CE3  TRP H 134      18.368  54.500  79.998  1.00 37.55      A    C
ATOM  21117  CZ3  TRP H 134      19.216  53.705  80.674  1.00 37.35      A    C
ATOM  21118  CH2  TRP H 134      19.042  53.447  82.000  1.00 36.69      A    C
ATOM  21119  CZ2  TRP H 134      18.014  53.969  82.690  1.00 37.37      A    C
ATOM  21120  C    TRP H 134      13.909  55.115  78.663  1.00 38.48      A    C
ATOM  21121  O    TRP H 134      13.809  54.010  79.101  1.00 37.68      A    O
ATOM  21122  N    GLU H 135      12.913  55.990  78.682  1.00 40.28      A    N
ATOM  21123  CA   GLU H 135      11.591  55.624  79.114  1.00 42.50      A    C
ATOM  21124  CB   GLU H 135      10.712  56.835  79.268  1.00 43.52      A    C
ATOM  21125  CG   GLU H 135       9.272  56.450  79.429  1.00 47.34      A    C
ATOM  21126  CD   GLU H 135       8.526  57.348  80.344  1.00 55.02      A    C
ATOM  21127  OE1  GLU H 135       8.894  58.515  80.438  1.00 56.70      A    O
ATOM  21128  OE2  GLU H 135       7.561  56.894  80.971  1.00 57.02      A    O-1
ATOM  21129  C    GLU H 135      10.887  54.642  78.231  1.00 43.06      A    C
```

Appendix 1

```
ATOM  21130  O    GLU H 135      10.278  53.723  78.701  1.00 43.57      A    O
ATOM  21131  N    GLU H 136      10.963  54.860  76.938  1.00 43.34      A    N
ATOM  21132  CA   GLU H 136      10.301  54.038  75.950  1.00 44.85      A    C
ATOM  21133  CB   GLU H 136      10.522  54.600  74.595  1.00 45.54      A    C
ATOM  21134  CG   GLU H 136       9.626  55.677  74.302  1.00 50.14      A    C
ATOM  21135  CD   GLU H 136       8.873  55.382  73.099  1.00 61.33      A    C
ATOM  21136  OE1  GLU H 136       8.784  56.254  72.233  1.00 65.25      A    O
ATOM  21137  OE2  GLU H 136       8.380  54.261  72.988  1.00 62.97      A    O-1
ATOM  21138  C    GLU H 136      10.760  52.619  75.945  1.00 44.79      A    C
ATOM  21139  O    GLU H 136      10.016  51.754  75.630  1.00 45.71      A    O
ATOM  21140  N    ASP H 137      11.987  52.380  76.341  1.00 45.41      A    N
ATOM  21141  CA   ASP H 137      12.530  51.055  76.398  1.00 46.00      A    C
ATOM  21142  CB   ASP H 137      14.019  51.085  76.210  1.00 46.09      A    C
ATOM  21143  CG   ASP H 137      14.418  51.620  74.889  1.00 49.61      A    C
ATOM  21144  OD1  ASP H 137      13.603  51.652  73.980  1.00 51.19      A    O
ATOM  21145  OD2  ASP H 137      15.560  52.008  74.752  1.00 51.61      A    O-1
ATOM  21146  C    ASP H 137      12.233  50.424  77.711  1.00 46.40      A    C
ATOM  21147  O    ASP H 137      12.552  49.286  77.917  1.00 46.79      A    O
ATOM  21148  N    GLY H 138      11.605  51.156  78.608  1.00 46.53      A    N
ATOM  21149  CA   GLY H 138      11.209  50.599  79.879  1.00 46.67      A    C
ATOM  21150  C    GLY H 138      12.279  50.602  80.916  1.00 46.62      A    C
ATOM  21151  O    GLY H 138      12.187  49.973  81.938  1.00 46.09      A    O
ATOM  21152  N    PHE H 139      13.332  51.309  80.617  1.00 46.46      A    N
ATOM  21153  CA   PHE H 139      14.357  51.543  81.587  1.00 46.80      A    C
ATOM  21154  CB   PHE H 139      15.638  51.956  80.918  1.00 46.07      A    C
ATOM  21155  CG   PHE H 139      16.190  50.920  80.015  1.00 45.06      A    C
ATOM  21156  CD1  PHE H 139      16.288  49.641  80.409  1.00 41.98      A    C
ATOM  21157  CE1  PHE H 139      16.798  48.734  79.607  1.00 42.53      A    C
ATOM  21158  CZ   PHE H 139      17.204  49.064  78.397  1.00 42.86      A    C
ATOM  21159  CE2  PHE H 139      17.112  50.298  77.980  1.00 42.85      A    C
ATOM  21160  CD2  PHE H 139      16.619  51.235  78.779  1.00 44.01      A    C
ATOM  21161  C    PHE H 139      13.976  52.418  82.771  1.00 47.37      A    C
ATOM  21162  O    PHE H 139      14.475  52.214  83.825  1.00 48.57      A    O
ATOM  21163  N    GLY H 140      13.061  53.348  82.590  1.00 47.18      A    N
ATOM  21164  CA   GLY H 140      12.534  54.135  83.672  1.00 47.90      A    C
ATOM  21165  C    GLY H 140      12.028  55.494  83.254  1.00 48.52      A    C
ATOM  21166  O    GLY H 140      12.132  55.878  82.126  1.00 48.75      A    O
ATOM  21167  N    THR H 141      11.488  56.234  84.192  1.00 48.57      A    N
ATOM  21168  CA   THR H 141      11.025  57.555  83.901  1.00 48.95      A    C
ATOM  21169  CB   THR H 141       9.776  57.836  84.668  1.00 49.00      A    C
ATOM  21170  OG1  THR H 141       9.981  57.503  86.032  1.00 48.88      A    O
ATOM  21171  CG2  THR H 141       8.715  56.979  84.171  1.00 49.42      A    C
ATOM  21172  C    THR H 141      12.020  58.657  84.178  1.00 49.47      A    C
ATOM  21173  O    THR H 141      11.764  59.775  83.843  1.00 49.28      A    O
ATOM  21174  N    ASP H 142      13.155  58.345  84.770  1.00 50.10      A    N
ATOM  21175  CA   ASP H 142      14.155  59.350  85.048  1.00 51.04      A    C
ATOM  21176  CB   ASP H 142      14.444  59.354  86.531  1.00 51.89      A    C
ATOM  21177  CG   ASP H 142      15.421  60.391  86.916  1.00 54.99      A    C
ATOM  21178  OD1  ASP H 142      15.094  61.557  86.790  1.00 59.11      A    O
ATOM  21179  OD2  ASP H 142      16.508  60.059  87.367  1.00 56.89      A    O-1
ATOM  21180  C    ASP H 142      15.440  59.078  84.327  1.00 50.24      A    C
ATOM  21181  O    ASP H 142      16.020  58.066  84.500  1.00 50.23      A    O
ATOM  21182  N    PRO H 143      15.879  60.000  83.510  1.00 50.23      A    N
ATOM  21183  CA   PRO H 143      17.105  59.839  82.757  1.00 49.97      A    C
```

Appendix 1

```
ATOM  21184  CB   PRO H 143      17.103  61.057  81.850  1.00 49.99       A  C
ATOM  21185  CG   PRO H 143      16.095  61.903  82.329  1.00 48.94       A  C
ATOM  21186  CD   PRO H 143      15.092  61.092  82.958  1.00 49.91       A  C
ATOM  21187  C    PRO H 143      18.379  59.756  83.564  1.00 49.71       A  C
ATOM  21188  O    PRO H 143      19.291  59.153  83.111  1.00 49.38       A  O
ATOM  21189  N    ILE H 144      18.484  60.406  84.697  1.00 49.97       A  N
ATOM  21190  CA   ILE H 144      19.749  60.367  85.386  1.00 49.74       A  C
ATOM  21191  CB   ILE H 144      20.273  61.760  85.678  1.00 49.60       A  C
ATOM  21192  CG1  ILE H 144      19.762  62.213  87.021  1.00 49.22       A  C
ATOM  21193  CD1  ILE H 144      19.647  63.629  87.143  1.00 50.06       A  C
ATOM  21194  CG2  ILE H 144      19.859  62.699  84.614  1.00 48.38       A  C
ATOM  21195  C    ILE H 144      19.848  59.566  86.663  1.00 50.09       A  C
ATOM  21196  O    ILE H 144      20.888  59.503  87.220  1.00 50.65       A  O
ATOM  21197  N    GLU H 145      18.788  58.947  87.122  1.00 49.99       A  N
ATOM  21198  CA   GLU H 145      18.814  58.379  88.442  1.00 50.31       A  C
ATOM  21199  CB   GLU H 145      17.468  57.767  88.732  1.00 50.97       A  C
ATOM  21200  CG   GLU H 145      17.206  57.373  90.136  1.00 53.93       A  C
ATOM  21201  CD   GLU H 145      15.917  56.630  90.254  1.00 61.68       A  C
ATOM  21202  OE1  GLU H 145      15.922  55.406  90.104  1.00 62.74       A  O
ATOM  21203  OE2  GLU H 145      14.880  57.251  90.483  1.00 61.96       A  O-1
ATOM  21204  C    GLU H 145      19.880  57.335  88.589  1.00 49.97       A  C
ATOM  21205  O    GLU H 145      20.592  57.338  89.560  1.00 50.47       A  O
ATOM  21206  N    LYS H 146      19.986  56.428  87.641  1.00 49.35       A  N
ATOM  21207  CA   LYS H 146      21.061  55.467  87.634  1.00 48.34       A  C
ATOM  21208  CB   LYS H 146      20.663  54.241  88.404  1.00 48.65       A  C
ATOM  21209  CG   LYS H 146      19.717  53.407  87.661  1.00 51.80       A  C
ATOM  21210  CD   LYS H 146      18.834  52.641  88.574  1.00 56.29       A  C
ATOM  21211  CE   LYS H 146      17.761  51.955  87.794  1.00 58.95       A  C
ATOM  21212  NZ   LYS H 146      17.336  52.812  86.696  1.00 56.42       A  N
ATOM  21213  C    LYS H 146      21.362  55.094  86.220  1.00 46.54       A  C
ATOM  21214  O    LYS H 146      20.547  55.260  85.370  1.00 45.82       A  O
ATOM  21215  N    GLU H 147      22.554  54.590  85.980  1.00 45.18       A  N
ATOM  21216  CA   GLU H 147      22.926  54.077  84.693  1.00 43.58       A  C
ATOM  21217  CB   GLU H 147      21.970  53.002  84.274  1.00 42.74       A  C
ATOM  21218  CG   GLU H 147      22.387  51.674  84.698  1.00 44.86       A  C
ATOM  21219  CD   GLU H 147      21.310  50.890  85.354  1.00 51.44       A  C
ATOM  21220  OE1  GLU H 147      20.288  50.625  84.735  1.00 52.60       A  O
ATOM  21221  OE2  GLU H 147      21.499  50.481  86.496  1.00 55.01       A  O-1
ATOM  21222  C    GLU H 147      22.933  55.184  83.698  1.00 42.41       A  C
ATOM  21223  O    GLU H 147      23.055  56.313  84.062  1.00 41.31       A  O
ATOM  21224  N    ASN H 148      22.795  54.841  82.436  1.00 41.46       A  N
ATOM  21225  CA   ASN H 148      22.618  55.793  81.381  1.00 40.72       A  C
ATOM  21226  CB   ASN H 148      21.287  56.446  81.553  1.00 40.31       A  C
ATOM  21227  CG   ASN H 148      20.736  56.937  80.293  1.00 41.21       A  C
ATOM  21228  OD1  ASN H 148      21.091  56.474  79.247  1.00 43.57       A  O
ATOM  21229  ND2  ASN H 148      19.858  57.879  80.376  1.00 36.63       A  N
ATOM  21230  C    ASN H 148      23.657  56.856  81.237  1.00 41.54       A  C
ATOM  21231  O    ASN H 148      23.323  57.994  81.098  1.00 40.65       A  O
ATOM  21232  N    ILE H 149      24.913  56.482  81.264  1.00 42.22       A  N
ATOM  21233  CA   ILE H 149      25.977  57.439  81.152  1.00 43.19       A  C
ATOM  21234  CB   ILE H 149      27.297  56.894  81.567  1.00 43.05       A  C
ATOM  21235  CG1  ILE H 149      27.416  55.470  81.123  1.00 44.82       A  C
ATOM  21236  CD1  ILE H 149      28.777  55.010  81.087  1.00 47.53       A  C
ATOM  21237  CG2  ILE H 149      27.420  56.958  83.006  1.00 43.15       A  C
```

Appendix 1

```
ATOM  21238  C    ILE H 149      26.033  57.839  79.727  1.00  43.68      A  C
ATOM  21239  O    ILE H 149      26.738  58.721  79.327  1.00  44.81      A  O
ATOM  21240  N    MET H 150      25.258  57.144  78.952  1.00  44.24      A  N
ATOM  21241  CA   MET H 150      25.166  57.423  77.569  1.00  44.46      A  C
ATOM  21242  CB   MET H 150      24.233  56.395  76.994  1.00  45.39      H  C
ATOM  21243  CG   MET H 150      24.114  56.347  75.534  1.00  51.96      H  C
ATOM  21244  SD   MET H 150      22.751  55.276  75.229  1.00  62.27      H  S
ATOM  21245  CE   MET H 150      22.443  54.757  76.887  1.00  60.19      H  C
ATOM  21246  C    MET H 150      24.605  58.825  77.454  1.00  42.83      A  C
ATOM  21247  O    MET H 150      25.018  59.599  76.644  1.00  43.01      A  O
ATOM  21248  N    TYR H 151      23.645  59.149  78.274  1.00  39.57      A  N
ATOM  21249  CA   TYR H 151      23.102  60.461  78.240  1.00  38.20      A  C
ATOM  21250  CB   TYR H 151      21.603  60.375  78.391  1.00  36.77      A  C
ATOM  21251  CG   TYR H 151      20.901  61.668  78.586  1.00  34.99      A  C
ATOM  21252  CD1  TYR H 151      20.837  62.582  77.597  1.00  32.53      A  C
ATOM  21253  CE1  TYR H 151      20.207  63.732  77.777  1.00  32.50      A  C
ATOM  21254  CZ   TYR H 151      19.626  64.000  78.944  1.00  32.22      A  C
ATOM  21255  OH   TYR H 151      18.970  65.162  79.112  1.00  33.19      A  O
ATOM  21256  CE2  TYR H 151      19.663  63.112  79.936  1.00  33.36      A  C
ATOM  21257  CD2  TYR H 151      20.295  61.962  79.764  1.00  34.73      A  C
ATOM  21258  C    TYR H 151      23.715  61.338  79.301  1.00  38.20      A  C
ATOM  21259  O    TYR H 151      24.080  62.444  79.034  1.00  38.56      A  O
ATOM  21260  N    LYS H 152      23.850  60.789  80.490  1.00  37.30      A  N
ATOM  21261  CA   LYS H 152      24.179  61.481  81.702  1.00  37.04      A  C
ATOM  21262  CB   LYS H 152      24.240  60.440  82.786  1.00  37.72      A  C
ATOM  21263  CG   LYS H 152      23.386  60.688  83.943  1.00  39.61      A  C
ATOM  21264  CD   LYS H 152      22.894  59.408  84.501  1.00  44.20      A  C
ATOM  21265  CE   LYS H 152      23.865  58.738  85.398  1.00  41.90      A  C
ATOM  21266  NZ   LYS H 152      23.534  57.337  85.398  1.00  41.85      A  N
ATOM  21267  C    LYS H 152      25.511  62.154  81.699  1.00  36.13      A  C
ATOM  21268  O    LYS H 152      25.626  63.266  82.096  1.00  35.42      A  O
ATOM  21269  N    GLY H 153      26.521  61.436  81.265  1.00  35.05      A  N
ATOM  21270  CA   GLY H 153      27.874  61.914  81.176  1.00  34.43      A  C
ATOM  21271  C    GLY H 153      28.090  63.047  80.219  1.00  36.21      A  C
ATOM  21272  O    GLY H 153      28.897  63.899  80.446  1.00  35.86      A  O
ATOM  21273  N    HIS H 154      27.407  63.029  79.101  1.00  36.68      A  N
ATOM  21274  CA   HIS H 154      27.424  64.173  78.233  1.00  37.37      A  C
ATOM  21275  CB   HIS H 154      26.744  63.857  76.922  1.00  37.60      A  C
ATOM  21276  CG   HIS H 154      27.588  63.086  75.973  1.00  39.12      A  C
ATOM  21277  ND1  HIS H 154      28.796  63.545  75.525  1.00  38.70      A  N
ATOM  21278  CE1  HIS H 154      29.308  62.667  74.693  1.00  36.83      A  C
ATOM  21279  NE2  HIS H 154      28.476  61.660  74.590  1.00  35.13      A  N
ATOM  21280  CD2  HIS H 154      27.388  61.901  75.370  1.00  38.91      A  C
ATOM  21281  C    HIS H 154      26.765  65.364  78.874  1.00  36.68      A  C
ATOM  21282  O    HIS H 154      27.275  66.437  78.817  1.00  36.63      A  O
ATOM  21283  N    LEU H 155      25.626  65.159  79.501  1.00  36.12      A  N
ATOM  21284  CA   LEU H 155      24.915  66.244  80.121  1.00  36.00      A  C
ATOM  21285  CB   LEU H 155      23.573  65.798  80.671  1.00  35.40      A  C
ATOM  21286  CG   LEU H 155      22.736  66.875  81.341  1.00  33.43      A  C
ATOM  21287  CD1  LEU H 155      22.260  67.859  80.394  1.00  29.42      A  C
ATOM  21288  CD2  LEU H 155      21.612  66.309  82.060  1.00  29.25      A  C
ATOM  21289  C    LEU H 155      25.738  66.855  81.206  1.00  36.59      A  C
ATOM  21290  O    LEU H 155      25.719  68.029  81.386  1.00  36.85      A  O
ATOM  21291  N    ASN H 156      26.452  66.038  81.947  1.00  37.17      A  N
```

Appendix 1

```
ATOM  21292  CA   ASN H 156    27.418  66.543  82.869  1.00 37.26      A  C
ATOM  21293  CB   ASN H 156    27.916  65.462  83.798  1.00 38.24      A  C
ATOM  21294  CG   ASN H 156    28.307  66.010  85.122  1.00 39.17      A  C
ATOM  21295  OD1  ASN H 156    27.578  66.769  85.699  1.00 39.76      A  O
ATOM  21296  ND2  ASN H 156    29.465  65.656  85.586  1.00 32.27      A  N
ATOM  21297  C    ASN H 156    28.587  67.266  82.266  1.00 36.45      A  C
ATOM  21298  O    ASN H 156    29.024  68.229  82.787  1.00 37.03      A  O
ATOM  21299  N    LEU H 157    29.157  66.772  81.205  1.00 36.58      A  N
ATOM  21300  CA   LEU H 157    30.284  67.462  80.668  1.00 36.60      A  C
ATOM  21301  CB   LEU H 157    30.965  66.654  79.572  1.00 35.83      A  C
ATOM  21302  CG   LEU H 157    32.215  67.147  78.853  1.00 34.71      A  C
ATOM  21303  CD1  LEU H 157    33.370  67.365  79.722  1.00 25.23      A  C
ATOM  21304  CD2  LEU H 157    32.585  66.234  77.799  1.00 33.87      A  C
ATOM  21305  C    LEU H 157    29.818  68.807  80.194  1.00 38.62      A  C
ATOM  21306  O    LEU H 157    30.488  69.801  80.362  1.00 39.31      A  O
ATOM  21307  N    MET H 158    28.646  68.818  79.591  1.00 38.67      A  N
ATOM  21308  CA   MET H 158    28.091  70.005  78.980  1.00 37.99      A  C
ATOM  21309  CB   MET H 158    26.829  69.678  78.196  1.00 38.93      H  C
ATOM  21310  CG   MET H 158    27.028  68.947  76.909  1.00 39.14      H  C
ATOM  21311  SD   MET H 158    25.507  68.392  76.197  1.00 37.55      H  S
ATOM  21312  CE   MET H 158    24.812  69.844  75.587  1.00 37.35      H  C
ATOM  21313  C    MET H 158    27.826  71.086  79.988  1.00 36.78      A  C
ATOM  21314  O    MET H 158    28.029  72.216  79.709  1.00 36.21      A  O
ATOM  21315  N    TYR H 159    27.364  70.718  81.165  1.00 36.52      A  N
ATOM  21316  CA   TYR H 159    27.139  71.654  82.240  1.00 36.67      A  C
ATOM  21317  CB   TYR H 159    26.690  70.922  83.480  1.00 35.96      A  C
ATOM  21318  CG   TYR H 159    25.249  70.563  83.636  1.00 34.64      A  C
ATOM  21319  CD1  TYR H 159    24.247  71.372  83.203  1.00 32.52      A  C
ATOM  21320  CE1  TYR H 159    22.971  71.036  83.397  1.00 30.72      A  C
ATOM  21321  CZ   TYR H 159    22.677  69.889  84.044  1.00 31.87      A  C
ATOM  21322  OH   TYR H 159    21.407  69.488  84.269  1.00 31.39      A  O
ATOM  21323  CE2  TYR H 159    23.641  69.106  84.482  1.00 32.45      A  C
ATOM  21324  CD2  TYR H 159    24.901  69.434  84.297  1.00 32.74      A  C
ATOM  21325  C    TYR H 159    28.455  72.285  82.602  1.00 37.18      A  C
ATOM  21326  O    TYR H 159    28.544  73.462  82.793  1.00 37.21      A  O
ATOM  21327  N    GLY H 160    29.486  71.483  82.692  1.00 36.50      A  N
ATOM  21328  CA   GLY H 160    30.777  72.001  82.988  1.00 38.04      A  C
ATOM  21329  C    GLY H 160    31.394  72.931  82.002  1.00 38.70      A  C
ATOM  21330  O    GLY H 160    31.925  73.910  82.394  1.00 38.99      A  O
ATOM  21331  N    LEU H 161    31.338  72.607  80.729  1.00 39.93      A  N
ATOM  21332  CA   LEU H 161    31.897  73.441  79.687  1.00 40.09      A  C
ATOM  21333  CB   LEU H 161    31.755  72.775  78.338  1.00 39.59      A  C
ATOM  21334  CG   LEU H 161    32.712  71.763  77.756  1.00 40.17      A  C
ATOM  21335  CD1  LEU H 161    34.107  71.965  78.106  1.00 37.90      A  C
ATOM  21336  CD2  LEU H 161    32.272  70.428  78.050  1.00 39.19      A  C
ATOM  21337  C    LEU H 161    31.212  74.773  79.617  1.00 40.43      A  C
ATOM  21338  O    LEU H 161    31.827  75.765  79.362  1.00 38.58      A  O
ATOM  21339  N    TYR H 162    29.916  74.782  79.815  1.00 41.08      A  N
ATOM  21340  CA   TYR H 162    29.186  76.012  79.771  1.00 43.04      A  C
ATOM  21341  CB   TYR H 162    27.700  75.712  79.930  1.00 43.41      A  C
ATOM  21342  CG   TYR H 162    26.845  76.874  80.308  1.00 41.54      A  C
ATOM  21343  CD1  TYR H 162    26.488  77.804  79.383  1.00 39.72      A  C
ATOM  21344  CE1  TYR H 162    25.747  78.839  79.715  1.00 41.42      A  C
ATOM  21345  CZ   TYR H 162    25.314  78.982  80.978  1.00 45.33      A  C
```

Appendix 1

```
ATOM  21346  OH   TYR H 162     24.544  80.047  81.292  1.00 47.18      A    O
ATOM  21347  CE2  TYR H 162     25.647  78.076  81.924  1.00 45.91      A    C
ATOM  21348  CD2  TYR H 162     26.399  77.027  81.585  1.00 43.10      A    C
ATOM  21349  C    TYR H 162     29.640  76.944  80.862  1.00 43.92      A    C
ATOM  21350  O    TYR H 162     29.876  78.096  80.622  1.00 43.00      A    O
ATOM  21351  N    GLN H 163     29.763  76.434  82.067  1.00 44.77      A    N
ATOM  21352  CA   GLN H 163     30.169  77.260  83.154  1.00 45.23      A    C
ATOM  21353  CB   GLN H 163     30.130  76.490  84.425  1.00 44.97      A    C
ATOM  21354  CG   GLN H 163     29.265  77.105  85.397  1.00 47.35      A    C
ATOM  21355  CD   GLN H 163     29.745  76.888  86.760  1.00 50.51      A    C
ATOM  21356  OE1  GLN H 163     29.263  76.042  87.455  1.00 52.79      A    O
ATOM  21357  NE2  GLN H 163     30.714  77.641  87.156  1.00 52.77      A    N
ATOM  21358  C    GLN H 163     31.543  77.794  82.936  1.00 45.80      A    C
ATOM  21359  O    GLN H 163     31.810  78.925  83.206  1.00 46.96      A    O
ATOM  21360  N    LEU H 164     32.425  76.962  82.451  1.00 45.76      A    N
ATOM  21361  CA   LEU H 164     33.767  77.373  82.176  1.00 45.68      A    C
ATOM  21362  CB   LEU H 164     34.582  76.157  81.772  1.00 46.13      A    C
ATOM  21363  CG   LEU H 164     35.908  75.801  82.426  1.00 46.83      A    C
ATOM  21364  CD1  LEU H 164     35.830  75.861  83.874  1.00 46.37      A    C
ATOM  21365  CD2  LEU H 164     36.353  74.463  82.024  1.00 46.46      A    C
ATOM  21366  C    LEU H 164     33.857  78.451  81.110  1.00 46.79      A    C
ATOM  21367  O    LEU H 164     34.694  79.301  81.194  1.00 47.96      A    O
ATOM  21368  N    VAL H 165     33.066  78.368  80.062  1.00 46.45      A    N
ATOM  21369  CA   VAL H 165     32.978  79.409  79.055  1.00 46.05      A    C
ATOM  21370  CB   VAL H 165     32.163  78.943  77.908  1.00 45.77      A    C
ATOM  21371  CG1  VAL H 165     32.023  80.012  76.918  1.00 44.91      A    C
ATOM  21372  CG2  VAL H 165     32.764  77.765  77.310  1.00 44.28      A    C
ATOM  21373  C    VAL H 165     32.363  80.706  79.541  1.00 47.11      A    C
ATOM  21374  O    VAL H 165     32.812  81.779  79.250  1.00 47.37      A    O
ATOM  21375  N    THR H 166     31.264  80.562  80.228  1.00 47.71      A    N
ATOM  21376  CA   THR H 166     30.544  81.677  80.745  1.00 49.38      A    C
ATOM  21377  CB   THR H 166     29.029  81.527  80.540  1.00 49.79      A    C
ATOM  21378  OG1  THR H 166     28.487  80.678  81.538  1.00 50.18      A    O
ATOM  21379  CG2  THR H 166     28.715  80.963  79.207  1.00 48.07      A    C
ATOM  21380  C    THR H 166     30.825  81.802  82.212  1.00 50.43      A    C
ATOM  21381  O    THR H 166     31.424  80.959  82.833  1.00 51.95      A    O
ATOM  21382  N    GLY H 167     30.399  82.877  82.792  1.00 50.21      A    N
ATOM  21383  CA   GLY H 167     30.388  82.914  84.221  1.00 50.53      A    C
ATOM  21384  C    GLY H 167     29.385  81.996  84.854  1.00 49.69      A    C
ATOM  21385  O    GLY H 167     29.535  81.614  85.978  1.00 49.67      A    O
ATOM  21386  N    SER H 168     28.341  81.678  84.119  1.00 49.09      A    N
ATOM  21387  CA   SER H 168     27.043  81.396  84.669  1.00 48.53      A    C
ATOM  21388  CB   SER H 168     26.012  81.254  83.574  1.00 48.21      A    C
ATOM  21389  OG   SER H 168     24.742  81.175  84.145  1.00 48.34      A    O
ATOM  21390  C    SER H 168     26.979  80.227  85.581  1.00 48.22      A    C
ATOM  21391  O    SER H 168     27.521  79.197  85.320  1.00 47.94      A    O
ATOM  21392  N    ARG H 169     26.293  80.438  86.678  1.00 48.64      A    N
ATOM  21393  CA   ARG H 169     26.183  79.506  87.760  1.00 49.67      A    C
ATOM  21394  CB   ARG H 169     26.420  80.227  89.083  1.00 50.79      A    C
ATOM  21395  CG   ARG H 169     27.881  80.441  89.468  1.00 54.89      A    C
ATOM  21396  CD   ARG H 169     28.067  80.583  90.992  1.00 62.72      A    C
ATOM  21397  NE   ARG H 169     29.423  80.965  91.399  1.00 67.58      A    N
ATOM  21398  CZ   ARG H 169     30.272  80.188  92.073  1.00 69.10      A    C
ATOM  21399  NH1  ARG H 169     29.946  78.960  92.435  1.00 67.55      A    N
```

Appendix 1

```
ATOM  21400  NH2  ARG H 169    31.468  80.638  92.380  1.00  69.94    A    N
ATOM  21401  C    ARG H 169    24.794  78.959  87.660  1.00  49.29    A    C
ATOM  21402  O    ARG H 169    24.266  78.350  88.541  1.00  49.59    A    O
ATOM  21403  N    ARG H 170    24.223  79.190  86.514  1.00  49.24    A    N
ATOM  21404  CA   ARG H 170    22.871  78.853  86.206  1.00  49.82    A    C
ATOM  21405  CB   ARG H 170    22.555  79.426  84.831  1.00  50.74    A    C
ATOM  21406  CG   ARG H 170    21.507  78.730  84.036  1.00  53.33    A    C
ATOM  21407  CD   ARG H 170    21.186  79.542  82.818  1.00  57.16    A    C
ATOM  21408  NE   ARG H 170    20.043  78.989  82.116  1.00  63.83    A    N
ATOM  21409  CZ   ARG H 170    18.781  79.157  82.475  1.00  66.25    A    C
ATOM  21410  NH1  ARG H 170    18.474  79.879  83.522  1.00  66.06    A    N
ATOM  21411  NH2  ARG H 170    17.821  78.598  81.782  1.00  66.28    A    N
ATOM  21412  C    ARG H 170    22.553  77.380  86.269  1.00  49.25    A    C
ATOM  21413  O    ARG H 170    21.466  77.020  86.655  1.00  49.62    A    O
ATOM  21414  N    TYR H 171    23.473  76.520  85.869  1.00  47.90    A    N
ATOM  21415  CA   TYR H 171    23.184  75.097  85.873  1.00  46.83    A    C
ATOM  21416  CB   TYR H 171    23.576  74.458  84.550  1.00  46.27    A    C
ATOM  21417  CG   TYR H 171    22.702  74.886  83.432  1.00  42.88    A    C
ATOM  21418  CD1  TYR H 171    21.420  74.484  83.367  1.00  40.93    A    C
ATOM  21419  CE1  TYR H 171    20.641  74.879  82.385  1.00  41.29    A    C
ATOM  21420  CZ   TYR H 171    21.115  75.686  81.440  1.00  41.36    A    C
ATOM  21421  OH   TYR H 171    20.300  76.081  80.433  1.00  42.86    A    O
ATOM  21422  CE2  TYR H 171    22.384  76.102  81.486  1.00  39.05    A    C
ATOM  21423  CD2  TYR H 171    23.160  75.702  82.469  1.00  38.25    A    C
ATOM  21424  C    TYR H 171    23.825  74.365  87.000  1.00  47.45    A    C
ATOM  21425  O    TYR H 171    23.694  73.186  87.135  1.00  47.47    A    O
ATOM  21426  N    GLU H 172    24.520  75.110  87.815  1.00  47.39    A    N
ATOM  21427  CA   GLU H 172    25.481  74.603  88.750  1.00  47.79    A    C
ATOM  21428  CB   GLU H 172    26.250  75.773  89.326  1.00  47.81    A    C
ATOM  21429  CG   GLU H 172    27.272  75.441  90.326  1.00  50.42    A    C
ATOM  21430  CD   GLU H 172    27.639  76.626  91.157  1.00  52.82    A    C
ATOM  21431  OE1  GLU H 172    26.850  77.017  92.017  1.00  54.17    A    O
ATOM  21432  OE2  GLU H 172    28.722  77.166  90.963  1.00  52.37    A    O-1
ATOM  21433  C    GLU H 172    24.915  73.688  89.816  1.00  47.37    A    C
ATOM  21434  O    GLU H 172    25.552  72.759  90.213  1.00  46.88    A    O
ATOM  21435  N    ALA H 173    23.709  73.950  90.267  1.00  47.27    A    N
ATOM  21436  CA   ALA H 173    23.048  73.038  91.167  1.00  46.84    A    C
ATOM  21437  CB   ALA H 173    21.746  73.611  91.639  1.00  46.00    A    C
ATOM  21438  C    ALA H 173    22.805  71.727  90.494  1.00  46.79    A    C
ATOM  21439  O    ALA H 173    22.986  70.697  91.068  1.00  48.10    A    O
ATOM  21440  N    GLU H 174    22.373  71.765  89.261  1.00  46.02    A    N
ATOM  21441  CA   GLU H 174    22.122  70.548  88.555  1.00  45.91    A    C
ATOM  21442  CB   GLU H 174    21.546  70.897  87.204  1.00  46.39    A    C
ATOM  21443  CG   GLU H 174    20.123  71.182  87.239  1.00  49.14    A    C
ATOM  21444  CD   GLU H 174    19.697  72.024  86.105  1.00  56.07    A    C
ATOM  21445  OE1  GLU H 174    19.062  73.047  86.312  1.00  57.12    A    O
ATOM  21446  OE2  GLU H 174    19.979  71.661  84.979  1.00  60.67    A    O-1
ATOM  21447  C    GLU H 174    23.399  69.753  88.395  1.00  44.56    A    C
ATOM  21448  O    GLU H 174    23.404  68.567  88.491  1.00  43.34    A    O
ATOM  21449  N    HIS H 175    24.465  70.468  88.112  1.00  43.80    A    N
ATOM  21450  CA   HIS H 175    25.777  69.961  87.849  1.00  43.30    A    C
ATOM  21451  CB   HIS H 175    26.628  71.157  87.528  1.00  42.65    A    C
ATOM  21452  CG   HIS H 175    27.936  70.832  86.902  1.00  39.98    A    C
ATOM  21453  ND1  HIS H 175    28.906  71.774  86.712  1.00  36.48    A    N
```

Appendix 1

```
ATOM  21454  CE1  HIS H 175    29.948  71.218  86.139  1.00  38.98    A  C
ATOM  21455  NE2  HIS H 175    29.690  69.944  85.961  1.00  39.02    A  N
ATOM  21456  CD2  HIS H 175    28.436  69.678  86.424  1.00  39.18    A  C
ATOM  21457  C    HIS H 175    26.363  69.262  89.026  1.00  44.82    A  C
ATOM  21458  O    HIS H 175    27.057  68.300  88.893  1.00  44.57    A  O
ATOM  21459  N    ALA H 176    26.150  69.826  90.190  1.00  47.04    A  N
ATOM  21460  CA   ALA H 176    26.540  69.226  91.437  1.00  48.14    A  C
ATOM  21461  CB   ALA H 176    26.421  70.210  92.505  1.00  48.04    A  C
ATOM  21462  C    ALA H 176    25.748  67.984  91.771  1.00  48.66    A  C
ATOM  21463  O    ALA H 176    26.271  67.011  92.248  1.00  48.66    A  O
ATOM  21464  N    HIS H 177    24.461  68.040  91.547  1.00  48.89    A  N
ATOM  21465  CA   HIS H 177    23.643  66.883  91.760  1.00  49.03    A  C
ATOM  21466  CB   HIS H 177    22.194  67.270  91.525  1.00  49.93    A  C
ATOM  21467  CG   HIS H 177    21.216  66.179  91.784  1.00  53.52    A  C
ATOM  21468  ND1  HIS H 177    21.404  65.224  92.748  1.00  56.69    A  N
ATOM  21469  CE1  HIS H 177    20.381  64.398  92.749  1.00  61.44    A  C
ATOM  21470  NE2  HIS H 177    19.532  64.792  91.827  1.00  60.71    A  N
ATOM  21471  CD2  HIS H 177    20.028  65.906  91.215  1.00  56.96    A  C
ATOM  21472  C    HIS H 177    24.017  65.747  90.851  1.00  47.73    A  C
ATOM  21473  O    HIS H 177    24.125  64.646  91.295  1.00  48.05    A  O
ATOM  21474  N    LEU H 178    24.195  66.006  89.570  1.00  46.94    A  N
ATOM  21475  CA   LEU H 178    24.573  64.955  88.633  1.00  46.29    A  C
ATOM  21476  CB   LEU H 178    24.539  65.464  87.202  1.00  46.17    A  C
ATOM  21477  CG   LEU H 178    24.184  64.498  86.092  1.00  44.31    A  C
ATOM  21478  CD1  LEU H 178    25.249  64.488  85.150  1.00  46.64    A  C
ATOM  21479  CD2  LEU H 178    23.967  63.169  86.579  1.00  39.59    A  C
ATOM  21480  C    LEU H 178    25.923  64.367  88.878  1.00  45.78    A  C
ATOM  21481  O    LEU H 178    26.122  63.176  88.312  1.00  44.82    A  O
ATOM  21482  N    THR H 179    26.862  65.243  89.120  1.00  45.68    A  N
ATOM  21483  CA   THR H 179    28.221  64.863  89.309  1.00  46.84    A  C
ATOM  21484  CB   THR H 179    29.098  66.075  89.185  1.00  46.87    A  C
ATOM  21485  OG1  THR H 179    30.183  66.018  90.091  1.00  47.48    A  O
ATOM  21486  CG2  THR H 179    28.262  67.288  89.417  1.00  49.98    A  C
ATOM  21487  C    THR H 179    28.333  64.015  90.568  1.00  47.13    A  C
ATOM  21488  O    THR H 179    29.122  63.120  90.638  1.00  46.83    A  O
ATOM  21489  N    ARG H 180    27.508  64.301  91.555  1.00  47.77    A  N
ATOM  21490  CA   ARG H 180    27.400  63.462  92.724  1.00  48.51    A  C
ATOM  21491  CB   ARG H 180    26.514  64.119  93.773  1.00  49.54    A  C
ATOM  21492  CG   ARG H 180    27.242  64.602  95.017  1.00  53.96    A  C
ATOM  21493  CD   ARG H 180    26.906  66.053  95.433  1.00  60.00    A  C
ATOM  21494  NE   ARG H 180    28.048  66.762  96.020  1.00  65.93    A  N
ATOM  21495  CZ   ARG H 180    28.234  68.087  96.014  1.00  66.19    A  C
ATOM  21496  NH1  ARG H 180    27.364  68.894  95.463  1.00  65.71    A  N
ATOM  21497  NH2  ARG H 180    29.299  68.614  96.576  1.00  62.04    A  N
ATOM  21498  C    ARG H 180    26.856  62.103  92.376  1.00  47.93    A  C
ATOM  21499  O    ARG H 180    27.321  61.102  92.841  1.00  48.60    A  O
ATOM  21500  N    ILE H 181    25.848  62.061  91.539  1.00  47.00    A  N
ATOM  21501  CA   ILE H 181    25.238  60.799  91.207  1.00  45.48    A  C
ATOM  21502  CB   ILE H 181    24.060  60.992  90.284  1.00  45.59    A  C
ATOM  21503  CG1  ILE H 181    22.813  61.287  91.060  1.00  42.41    A  C
ATOM  21504  CD1  ILE H 181    21.769  61.829  90.237  1.00  44.70    A  C
ATOM  21505  CG2  ILE H 181    23.811  59.774  89.496  1.00  43.93    A  C
ATOM  21506  C    ILE H 181    26.240  59.887  90.539  1.00  45.67    A  C
ATOM  21507  O    ILE H 181    26.291  58.717  90.822  1.00  46.18    A  O
```

Appendix 1

```
ATOM  21508  N    ILE H 182    27.040  60.441  89.654  1.00 44.64    A    N
ATOM  21509  CA   ILE H 182    28.073  59.704  88.996  1.00 44.44    A    C
ATOM  21510  CB   ILE H 182    28.748  60.585  87.971  1.00 44.31    A    C
ATOM  21511  CG1  ILE H 182    27.724  61.118  86.999  1.00 43.74    A    C
ATOM  21512  CD1  ILE H 182    28.279  61.892  85.902  1.00 42.52    A    C
ATOM  21513  CG2  ILE H 182    29.778  59.852  87.219  1.00 42.53    A    C
ATOM  21514  C    ILE H 182    29.094  59.221  89.980  1.00 45.63    A    C
ATOM  21515  O    ILE H 182    29.559  58.133  89.886  1.00 45.11    A    O
ATOM  21516  N    HIS H 183    29.454  60.057  90.925  1.00 47.77    A    N
ATOM  21517  CA   HIS H 183    30.453  59.704  91.891  1.00 48.70    A    C
ATOM  21518  CB   HIS H 183    30.655  60.876  92.811  1.00 49.15    A    C
ATOM  21519  CG   HIS H 183    31.461  60.556  94.017  1.00 52.82    A    C
ATOM  21520  ND1  HIS H 183    30.896  60.341  95.248  1.00 54.96    A    N
ATOM  21521  CE1  HIS H 183    31.845  60.087  96.121  1.00 56.78    A    C
ATOM  21522  NE2  HIS H 183    33.003  60.131  95.499  1.00 56.31    A    N
ATOM  21523  CD2  HIS H 183    32.791  60.417  94.182  1.00 53.28    A    C
ATOM  21524  C    HIS H 183    30.048  58.563  92.747  1.00 48.34    A    C
ATOM  21525  O    HIS H 183    30.821  57.687  92.988  1.00 48.17    A    O
ATOM  21526  N    ASP H 184    28.847  58.603  93.268  1.00 48.14    A    N
ATOM  21527  CA   ASP H 184    28.404  57.521  94.081  1.00 49.65    A    C
ATOM  21528  CB   ASP H 184    27.067  57.816  94.695  1.00 49.89    A    C
ATOM  21529  CG   ASP H 184    26.974  59.187  95.230  1.00 53.46    A    C
ATOM  21530  OD1  ASP H 184    27.852  59.602  95.992  1.00 51.35    A    O
ATOM  21531  OD2  ASP H 184    25.991  59.845  94.903  1.00 58.37    A    O-1
ATOM  21532  C    ASP H 184    28.282  56.301  93.264  1.00 50.49    A    C
ATOM  21533  O    ASP H 184    28.587  55.236  93.705  1.00 51.05    A    O
ATOM  21534  N    GLU H 185    27.776  56.462  92.059  1.00 52.06    A    N
ATOM  21535  CA   GLU H 185    27.509  55.338  91.195  1.00 52.16    A    C
ATOM  21536  CB   GLU H 185    26.785  55.785  89.936  1.00 52.71    A    C
ATOM  21537  CG   GLU H 185    26.268  54.633  89.101  1.00 55.31    A    C
ATOM  21538  CD   GLU H 185    24.929  54.874  88.436  1.00 57.49    A    C
ATOM  21539  OE1  GLU H 185    24.407  55.978  88.475  1.00 56.07    A    O
ATOM  21540  OE2  GLU H 185    24.394  53.940  87.838  1.00 59.56    A    O-1
ATOM  21541  C    GLU H 185    28.766  54.603  90.851  1.00 51.52    A    C
ATOM  21542  O    GLU H 185    28.805  53.411  90.904  1.00 50.77    A    O
ATOM  21543  N    ILE H 186    29.814  55.325  90.536  1.00 50.83    A    N
ATOM  21544  CA   ILE H 186    31.070  54.709  90.204  1.00 51.19    A    C
ATOM  21545  CB   ILE H 186    32.063  55.764  89.877  1.00 51.37    A    C
ATOM  21546  CG1  ILE H 186    31.632  56.505  88.635  1.00 50.69    A    C
ATOM  21547  CD1  ILE H 186    32.738  56.952  87.822  1.00 51.27    A    C
ATOM  21548  CG2  ILE H 186    33.385  55.168  89.668  1.00 50.26    A    C
ATOM  21549  C    ILE H 186    31.670  53.928  91.333  1.00 51.83    A    C
ATOM  21550  O    ILE H 186    32.225  52.880  91.135  1.00 52.22    A    O
ATOM  21551  N    ALA H 187    31.595  54.498  92.519  1.00 52.42    A    N
ATOM  21552  CA   ALA H 187    32.079  53.931  93.767  1.00 52.58    A    C
ATOM  21553  CB   ALA H 187    31.989  54.934  94.835  1.00 52.25    A    C
ATOM  21554  C    ALA H 187    31.347  52.707  94.180  1.00 52.18    A    C
ATOM  21555  O    ALA H 187    31.889  51.846  94.811  1.00 52.65    A    O
ATOM  21556  N    ALA H 188    30.068  52.704  93.908  1.00 52.50    A    N
ATOM  21557  CA   ALA H 188    29.205  51.571  94.136  1.00 52.35    A    C
ATOM  21558  CB   ALA H 188    27.819  51.978  94.074  1.00 51.43    A    C
ATOM  21559  C    ALA H 188    29.452  50.350  93.268  1.00 52.84    A    C
ATOM  21560  O    ALA H 188    29.125  49.275  93.662  1.00 52.39    A    O
ATOM  21561  N    ASN H 189    30.035  50.516  92.097  1.00 53.16    A    N
```

Appendix 1

```
ATOM  21562  CA   ASN H 189    30.292  49.398  91.218  1.00  53.85      A  C
ATOM  21563  CB   ASN H 189    30.313  49.832  89.783  1.00  53.31      A  C
ATOM  21564  CG   ASN H 189    28.974  50.086  89.258  1.00  52.19      A  C
ATOM  21565  OD1  ASN H 189    28.045  49.417  89.616  1.00  52.37      A  O
ATOM  21566  ND2  ASN H 189    28.852  51.063  88.409  1.00  46.38      A  N
ATOM  21567  C    ASN H 189    31.551  48.664  91.489  1.00  55.43      A  C
ATOM  21568  O    ASN H 189    32.564  49.243  91.781  1.00  55.80      A  O
ATOM  21569  N    PRO H 190    31.466  47.362  91.365  1.00  56.51      A  N
ATOM  21570  CA   PRO H 190    32.612  46.487  91.401  1.00  57.41      A  C
ATOM  21571  CB   PRO H 190    31.967  45.117  91.319  1.00  57.81      A  C
ATOM  21572  CG   PRO H 190    30.553  45.344  91.556  1.00  57.20      A  C
ATOM  21573  CD   PRO H 190    30.274  46.624  90.991  1.00  56.67      A  C
ATOM  21574  C    PRO H 190    33.542  46.691  90.218  1.00  58.15      A  C
ATOM  21575  O    PRO H 190    34.747  46.653  90.397  1.00  59.03      A  O
ATOM  21576  N    PHE H 191    32.998  46.840  89.023  1.00  57.02      A  N
ATOM  21577  CA   PHE H 191    33.819  47.092  87.861  1.00  56.24      A  C
ATOM  21578  CB   PHE H 191    33.085  46.761  86.564  1.00  56.46      A  C
ATOM  21579  CG   PHE H 191    31.732  47.358  86.457  1.00  56.24      A  C
ATOM  21580  CD1  PHE H 191    31.544  48.522  85.778  1.00  57.84      A  C
ATOM  21581  CE1  PHE H 191    30.330  49.074  85.676  1.00  58.72      A  C
ATOM  21582  CZ   PHE H 191    29.281  48.471  86.242  1.00  60.79      A  C
ATOM  21583  CE2  PHE H 191    29.451  47.301  86.919  1.00  59.78      A  C
ATOM  21584  CD2  PHE H 191    30.659  46.751  87.013  1.00  56.68      A  C
ATOM  21585  C    PHE H 191    34.557  48.420  87.729  1.00  56.12      A  C
ATOM  21586  O    PHE H 191    35.660  48.433  87.266  1.00  56.90      A  O
ATOM  21587  N    ALA H 192    33.949  49.541  88.062  1.00  54.44      A  N
ATOM  21588  CA   ALA H 192    34.603  50.793  87.718  1.00  53.35      A  C
ATOM  21589  CB   ALA H 192    36.014  50.499  87.402  1.00  52.72      A  C
ATOM  21590  C    ALA H 192    33.994  51.543  86.529  1.00  52.53      A  C
ATOM  21591  O    ALA H 192    34.297  51.271  85.393  1.00  51.38      A  O
ATOM  21592  N    GLY H 193    33.138  52.497  86.818  1.00  51.39      A  N
ATOM  21593  CA   GLY H 193    32.503  53.231  85.776  1.00  51.15      A  C
ATOM  21594  C    GLY H 193    31.071  52.859  85.684  1.00  50.76      A  C
ATOM  21595  O    GLY H 193    30.587  52.164  86.521  1.00  50.97      A  O
ATOM  21596  N    ILE H 194    30.407  53.328  84.646  1.00  50.11      A  N
ATOM  21597  CA   ILE H 194    28.977  53.154  84.500  1.00  49.62      A  C
ATOM  21598  CB   ILE H 194    28.303  54.486  84.641  1.00  49.85      A  C
ATOM  21599  CG1  ILE H 194    29.135  55.348  85.570  1.00  52.46      A  C
ATOM  21600  CD1  ILE H 194    28.612  55.418  86.917  1.00  54.99      A  C
ATOM  21601  CG2  ILE H 194    26.947  54.336  85.189  1.00  49.86      A  C
ATOM  21602  C    ILE H 194    28.529  52.507  83.206  1.00  48.59      A  C
ATOM  21603  O    ILE H 194    28.988  52.838  82.145  1.00  47.05      A  O
ATOM  21604  N    VAL H 195    27.614  51.562  83.326  1.00  47.55      A  N
ATOM  21605  CA   VAL H 195    26.985  50.942  82.187  1.00  46.46      A  C
ATOM  21606  CB   VAL H 195    26.169  49.796  82.602  1.00  46.25      A  C
ATOM  21607  CG1  VAL H 195    26.987  48.797  83.301  1.00  45.28      A  C
ATOM  21608  CG2  VAL H 195    25.047  50.265  83.386  1.00  44.42      A  C
ATOM  21609  C    VAL H 195    26.022  51.877  81.531  1.00  45.96      A  C
ATOM  21610  O    VAL H 195    25.345  52.587  82.191  1.00  45.36      A  O
ATOM  21611  N    CYS H 196    25.992  51.917  80.219  1.00  45.79      A  N
ATOM  21612  CA   CYS H 196    25.025  52.738  79.564  1.00  46.72      A  C
ATOM  21613  CB   CYS H 196    25.287  52.713  78.087  1.00  46.61      A  C
ATOM  21614  SG   CYS H 196    26.564  53.711  77.537  1.00  48.56      A  S
ATOM  21615  C    CYS H 196    23.664  52.184  79.790  1.00  47.52      A  C
```

Appendix 1

```
ATOM  21616  O    CYS H 196    22.794  52.839  80.244  1.00 47.16    A  O
ATOM  21617  N    GLU H 197    23.482  50.933  79.452  1.00 49.92    A  N
ATOM  21618  CA   GLU H 197    22.204  50.274  79.576  1.00 51.35    A  C
ATOM  21619  CB   GLU H 197    21.747  49.667  78.261  1.00 52.12    A  C
ATOM  21620  CG   GLU H 197    20.885  50.533  77.426  1.00 53.49    A  C
ATOM  21621  CD   GLU H 197    21.570  51.033  76.196  1.00 57.32    A  C
ATOM  21622  OE1  GLU H 197    22.789  50.890  76.067  1.00 55.67    A  O
ATOM  21623  OE2  GLU H 197    20.882  51.586  75.350  1.00 58.65    A  O-1
ATOM  21624  C    GLU H 197    22.510  49.146  80.455  1.00 51.49    A  C
ATOM  21625  O    GLU H 197    23.622  48.712  80.535  1.00 51.88    A  O
ATOM  21626  N    PRO H 198    21.500  48.619  81.080  1.00 51.23    A  N
ATOM  21627  CA   PRO H 198    21.733  47.615  82.066  1.00 50.49    A  C
ATOM  21628  CB   PRO H 198    20.340  47.183  82.395  1.00 50.93    A  C
ATOM  21629  CG   PRO H 198    19.527  48.345  82.159  1.00 52.37    A  C
ATOM  21630  CD   PRO H 198    20.202  49.251  81.244  1.00 51.84    A  C
ATOM  21631  C    PRO H 198    22.473  46.527  81.374  1.00 49.77    A  C
ATOM  21632  O    PRO H 198    22.119  46.103  80.309  1.00 49.52    A  O
ATOM  21633  N    ASP H 199    23.573  46.166  82.001  1.00 49.45    A  N
ATOM  21634  CA   ASP H 199    24.561  45.217  81.543  1.00 48.61    A  C
ATOM  21635  CB   ASP H 199    24.036  43.802  81.373  1.00 48.58    A  C
ATOM  21636  CG   ASP H 199    25.119  42.782  81.482  1.00 52.83    A  C
ATOM  21637  OD1  ASP H 199    26.187  43.100  81.978  1.00 57.55    A  O
ATOM  21638  OD2  ASP H 199    24.930  41.649  81.085  1.00 57.87    A  O-1
ATOM  21639  C    ASP H 199    25.238  45.686  80.307  1.00 47.04    A  C
ATOM  21640  O    ASP H 199    25.835  44.913  79.617  1.00 48.71    A  O
ATOM  21641  N    ASN H 200    25.184  46.953  80.007  1.00 45.12    A  N
ATOM  21642  CA   ASN H 200    25.992  47.365  78.893  1.00 44.04    A  C
ATOM  21643  CB   ASN H 200    25.111  47.789  77.755  1.00 44.68    A  C
ATOM  21644  CG   ASN H 200    24.710  46.647  76.928  1.00 44.41    A  C
ATOM  21645  OD1  ASN H 200    23.582  46.500  76.582  1.00 46.33    A  O
ATOM  21646  ND2  ASN H 200    25.642  45.814  76.613  1.00 44.66    A  N
ATOM  21647  C    ASN H 200    27.042  48.386  79.231  1.00 42.49    A  C
ATOM  21648  O    ASN H 200    26.757  49.442  79.692  1.00 41.09    A  O
ATOM  21649  N    TYR H 201    28.284  48.024  79.019  1.00 40.93    A  N
ATOM  21650  CA   TYR H 201    29.365  48.906  79.348  1.00 39.38    A  C
ATOM  21651  CB   TYR H 201    30.253  48.234  80.372  1.00 39.49    A  C
ATOM  21652  CG   TYR H 201    31.338  49.065  80.936  1.00 38.60    A  C
ATOM  21653  CD1  TYR H 201    31.298  49.497  82.219  1.00 41.81    A  C
ATOM  21654  CE1  TYR H 201    32.298  50.248  82.718  1.00 42.21    A  C
ATOM  21655  CZ   TYR H 201    33.346  50.540  81.932  1.00 41.99    A  C
ATOM  21656  OH   TYR H 201    34.377  51.262  82.385  1.00 40.18    A  O
ATOM  21657  CE2  TYR H 201    33.398  50.102  80.677  1.00 41.06    A  C
ATOM  21658  CD2  TYR H 201    32.423  49.374  80.194  1.00 39.99    A  C
ATOM  21659  C    TYR H 201    30.137  49.294  78.117  1.00 38.58    A  C
ATOM  21660  O    TYR H 201    30.531  48.479  77.353  1.00 38.41    A  O
ATOM  21661  N    PHE H 202    30.326  50.580  77.931  1.00 38.20    A  N
ATOM  21662  CA   PHE H 202    31.037  51.111  76.797  1.00 37.29    A  C
ATOM  21663  CB   PHE H 202    30.100  51.941  75.911  1.00 36.67    A  C
ATOM  21664  CG   PHE H 202    29.069  51.144  75.203  1.00 36.33    A  C
ATOM  21665  CD1  PHE H 202    29.353  50.514  74.044  1.00 34.24    A  C
ATOM  21666  CE1  PHE H 202    28.428  49.795  73.428  1.00 36.22    A  C
ATOM  21667  CZ   PHE H 202    27.198  49.684  73.940  1.00 34.88    A  C
ATOM  21668  CE2  PHE H 202    26.896  50.291  75.075  1.00 36.57    A  C
ATOM  21669  CD2  PHE H 202    27.815  51.024  75.709  1.00 35.11    A  C
```

Appendix 1

```
ATOM  21670  C   PHE H 202     32.187  51.968  77.276  1.00 37.73      A  C
ATOM  21671  O   PHE H 202     32.046  52.790  78.124  1.00 36.19      A  O
ATOM  21672  N   VAL H 203     33.342  51.754  76.705  1.00 38.29      A  N
ATOM  21673  CA  VAL H 203     34.507  52.525  77.014  1.00 37.90      A  C
ATOM  21674  CB  VAL H 203     35.739  51.866  76.402  1.00 37.49      A  C
ATOM  21675  CG1 VAL H 203     36.008  52.349  75.058  1.00 36.34      A  C
ATOM  21676  CG2 VAL H 203     36.878  52.060  77.235  1.00 40.00      A  C
ATOM  21677  C   VAL H 203     34.379  53.990  76.634  1.00 38.59      A  C
ATOM  21678  O   VAL H 203     34.838  54.837  77.333  1.00 40.22      A  O
ATOM  21679  N   GLN H 204     33.790  54.293  75.504  1.00 38.10      A  N
ATOM  21680  CA  GLN H 204     33.633  55.674  75.103  1.00 37.40      A  C
ATOM  21681  CB  GLN H 204     33.298  55.801  73.624  1.00 36.88      A  C
ATOM  21682  CG  GLN H 204     31.975  55.313  73.212  1.00 33.70      A  C
ATOM  21683  CD  GLN H 204     31.918  53.854  73.164  1.00 35.34      A  C
ATOM  21684  OE1 GLN H 204     32.571  53.182  73.907  1.00 31.74      A  O
ATOM  21685  NE2 GLN H 204     31.125  53.351  72.290  1.00 32.83      A  N
ATOM  21686  C   GLN H 204     32.705  56.503  75.960  1.00 38.83      A  C
ATOM  21687  O   GLN H 204     32.917  57.655  76.147  1.00 39.40      A  O
ATOM  21688  N   CYS H 205     31.633  55.910  76.418  1.00 39.70      A  N
ATOM  21689  CA  CYS H 205     30.691  56.581  77.270  1.00 40.91      A  C
ATOM  21690  CB  CYS H 205     29.419  55.781  77.330  1.00 41.12      A  C
ATOM  21691  SG  CYS H 205     28.769  55.445  75.739  1.00 49.09      A  S
ATOM  21692  C   CYS H 205     31.221  56.942  78.646  1.00 40.37      A  C
ATOM  21693  O   CYS H 205     30.932  57.982  79.158  1.00 39.65      A  O
ATOM  21694  N   ASN H 206     31.995  56.050  79.223  1.00 40.53      A  N
ATOM  21695  CA  ASN H 206     32.692  56.287  80.464  1.00 40.64      A  C
ATOM  21696  CB  ASN H 206     33.278  55.012  81.017  1.00 40.43      A  C
ATOM  21697  CG  ASN H 206     32.320  54.268  81.853  1.00 41.37      A  C
ATOM  21698  OD1 ASN H 206     32.296  54.415  83.030  1.00 39.59      A  O
ATOM  21699  ND2 ASN H 206     31.534  53.439  81.239  1.00 44.26      A  N
ATOM  21700  C   ASN H 206     33.727  57.358  80.373  1.00 39.61      A  C
ATOM  21701  O   ASN H 206     33.955  58.052  81.294  1.00 39.41      A  O
ATOM  21702  N   SER H 207     34.375  57.456  79.246  1.00 39.68      A  N
ATOM  21703  CA  SER H 207     35.419  58.427  79.077  1.00 39.56      A  C
ATOM  21704  CB  SER H 207     36.239  58.159  77.827  1.00 38.79      A  C
ATOM  21705  OG  SER H 207     35.673  58.689  76.683  1.00 40.02      A  O
ATOM  21706  C   SER H 207     34.898  59.833  79.171  1.00 39.88      A  C
ATOM  21707  O   SER H 207     35.565  60.703  79.647  1.00 39.95      A  O
ATOM  21708  N   VAL H 208     33.697  60.032  78.681  1.00 39.56      A  N
ATOM  21709  CA  VAL H 208     33.010  61.286  78.785  1.00 39.51      A  C
ATOM  21710  CB  VAL H 208     31.762  61.275  77.919  1.00 39.64      A  C
ATOM  21711  CG1 VAL H 208     30.983  62.511  78.103  1.00 38.71      A  C
ATOM  21712  CG2 VAL H 208     32.131  61.110  76.522  1.00 36.62      A  C
ATOM  21713  C   VAL H 208     32.645  61.641  80.194  1.00 38.98      A  C
ATOM  21714  O   VAL H 208     32.773  62.747  80.608  1.00 39.77      A  O
ATOM  21715  N   ALA H 209     32.162  60.677  80.921  1.00 38.82      A  N
ATOM  21716  CA  ALA H 209     31.798  60.872  82.274  1.00 39.28      A  C
ATOM  21717  CB  ALA H 209     31.162  59.662  82.745  1.00 39.98      A  C
ATOM  21718  C   ALA H 209     32.972  61.218  83.162  1.00 40.09      A  C
ATOM  21719  O   ALA H 209     32.865  62.075  83.998  1.00 39.63      A  O
ATOM  21720  N   TYR H 210     34.085  60.535  82.971  1.00 40.29      A  N
ATOM  21721  CA  TYR H 210     35.335  60.828  83.648  1.00 41.42      A  C
ATOM  21722  CB  TYR H 210     36.345  59.697  83.444  1.00 41.88      A  C
ATOM  21723  CG  TYR H 210     36.073  58.496  84.280  1.00 42.85      A  C
```

Appendix 1

```
ATOM  21724  CD1 TYR H 210      36.536  58.412  85.555  1.00 46.51      A    C
ATOM  21725  CE1 TYR H 210      36.272  57.314  86.323  1.00 45.45      A    C
ATOM  21726  CZ  TYR H 210      35.543  56.298  85.809  1.00 43.98      A    C
ATOM  21727  OH  TYR H 210      35.281  55.214  86.559  1.00 44.45      A    O
ATOM  21728  CE2 TYR H 210      35.077  56.368  84.553  1.00 41.09      A    C
ATOM  21729  CD2 TYR H 210      35.338  57.450  83.798  1.00 39.55      A    C
ATOM  21730  C   TYR H 210      35.949  62.174  83.311  1.00 41.29      A    C
ATOM  21731  O   TYR H 210      36.455  62.826  84.147  1.00 41.81      A    O
ATOM  21732  N   LEU H 211      35.893  62.592  82.078  1.00 41.83      A    N
ATOM  21733  CA  LEU H 211      36.367  63.903  81.716  1.00 43.14      A    C
ATOM  21734  CB  LEU H 211      36.357  64.055  80.223  1.00 42.16      A    C
ATOM  21735  CG  LEU H 211      36.913  65.303  79.607  1.00 44.29      A    C
ATOM  21736  CD1 LEU H 211      38.370  65.279  79.835  1.00 47.68      A    C
ATOM  21737  CD2 LEU H 211      36.641  65.288  78.144  1.00 43.25      A    C
ATOM  21738  C   LEU H 211      35.577  65.009  82.382  1.00 44.05      A    C
ATOM  21739  O   LEU H 211      36.079  66.053  82.679  1.00 44.48      A    O
ATOM  21740  N   SER H 212      34.310  64.765  82.604  1.00 44.77      A    N
ATOM  21741  CA  SER H 212      33.440  65.718  83.242  1.00 44.90      A    C
ATOM  21742  CB  SER H 212      32.017  65.223  83.194  1.00 43.33      A    C
ATOM  21743  OG  SER H 212      31.980  63.951  83.737  1.00 42.18      A    O
ATOM  21744  C   SER H 212      33.839  66.004  84.662  1.00 45.24      A    C
ATOM  21745  O   SER H 212      33.699  67.102  85.135  1.00 46.09      A    O
ATOM  21746  N   LEU H 213      34.299  64.988  85.355  1.00 45.35      A    N
ATOM  21747  CA  LEU H 213      34.735  65.149  86.728  1.00 45.77      A    C
ATOM  21748  CB  LEU H 213      34.970  63.813  87.391  1.00 44.77      A    C
ATOM  21749  CG  LEU H 213      33.808  62.857  87.280  1.00 43.39      A    C
ATOM  21750  CD1 LEU H 213      34.257  61.514  87.606  1.00 41.97      A    C
ATOM  21751  CD2 LEU H 213      32.661  63.233  88.099  1.00 38.59      A    C
ATOM  21752  C   LEU H 213      35.943  66.047  86.837  1.00 46.14      A    C
ATOM  21753  O   LEU H 213      36.025  66.860  87.702  1.00 45.80      A    O
ATOM  21754  N   TRP H 214      36.851  65.917  85.903  1.00 46.78      A    N
ATOM  21755  CA  TRP H 214      37.974  66.782  85.854  1.00 47.33      A    C
ATOM  21756  CB  TRP H 214      38.924  66.390  84.736  1.00 46.68      A    C
ATOM  21757  CG  TRP H 214      39.740  65.192  85.027  1.00 46.50      A    C
ATOM  21758  CD1 TRP H 214      39.286  63.976  85.296  1.00 47.24      A    C
ATOM  21759  NE1 TRP H 214      40.310  63.114  85.492  1.00 49.00      A    N
ATOM  21760  CE2 TRP H 214      41.480  63.791  85.347  1.00 49.13      A    C
ATOM  21761  CD2 TRP H 214      41.157  65.101  85.051  1.00 47.08      A    C
ATOM  21762  CE3 TRP H 214      42.185  66.003  84.853  1.00 45.10      A    C
ATOM  21763  CZ3 TRP H 214      43.452  65.569  84.957  1.00 44.74      A    C
ATOM  21764  CH2 TRP H 214      43.744  64.270  85.251  1.00 44.52      A    C
ATOM  21765  CZ2 TRP H 214      42.777  63.364  85.458  1.00 47.00      A    C
ATOM  21766  C   TRP H 214      37.429  68.151  85.637  1.00 48.51      A    C
ATOM  21767  O   TRP H 214      37.941  69.102  86.139  1.00 49.74      A    O
ATOM  21768  N   VAL H 215      36.396  68.259  84.850  1.00 49.41      A    N
ATOM  21769  CA  VAL H 215      35.795  69.532  84.618  1.00 49.93      A    C
ATOM  21770  CB  VAL H 215      34.847  69.437  83.473  1.00 50.46      A    C
ATOM  21771  CG1 VAL H 215      34.283  70.775  83.118  1.00 48.98      A    C
ATOM  21772  CG2 VAL H 215      35.591  68.870  82.334  1.00 51.15      A    C
ATOM  21773  C   VAL H 215      35.140  70.093  85.844  1.00 50.62      A    C
ATOM  21774  O   VAL H 215      35.242  71.245  86.120  1.00 50.92      A    O
ATOM  21775  N   TYR H 216      34.448  69.272  86.587  1.00 50.97      A    N
ATOM  21776  CA  TYR H 216      33.844  69.753  87.789  1.00 51.63      A    C
ATOM  21777  CB  TYR H 216      32.969  68.694  88.396  1.00 51.60      A    C
```

Appendix 1

```
ATOM  21778  CG   TYR H 216    32.222  69.224  89.546  1.00  53.96    A    C
ATOM  21779  CD1  TYR H 216    30.977  69.742  89.393  1.00  53.91    A    C
ATOM  21780  CE1  TYR H 216    30.301  70.244  90.432  1.00  54.56    A    C
ATOM  21781  CZ   TYR H 216    30.869  70.238  91.655  1.00  56.75    A    C
ATOM  21782  OH   TYR H 216    30.197  70.732  92.722  1.00  57.19    A    O
ATOM  21783  CE2  TYR H 216    32.104  69.726  91.834  1.00  57.08    A    C
ATOM  21784  CD2  TYR H 216    32.774  69.229  90.787  1.00  55.84    A    C
ATOM  21785  C    TYR H 216    34.897  70.187  88.776  1.00  51.71    A    C
ATOM  21786  O    TYR H 216    34.760  71.166  89.451  1.00  50.39    A    O
ATOM  21787  N    ASP H 217    35.955  69.416  88.851  1.00  51.96    A    N
ATOM  21788  CA   ASP H 217    37.047  69.701  89.742  1.00  52.00    A    C
ATOM  21789  CB   ASP H 217    37.956  68.494  89.871  1.00  50.62    A    C
ATOM  21790  CG   ASP H 217    37.346  67.438  90.705  1.00  49.93    A    C
ATOM  21791  OD1  ASP H 217    36.359  67.745  91.347  1.00  50.36    A    O
ATOM  21792  OD2  ASP H 217    37.809  66.311  90.728  1.00  50.34    A    O-1
ATOM  21793  C    ASP H 217    37.776  70.981  89.405  1.00  52.85    A    C
ATOM  21794  O    ASP H 217    38.204  71.694  90.276  1.00  52.81    A    O
ATOM  21795  N    ARG H 218    37.926  71.281  88.139  1.00  53.80    A    N
ATOM  21796  CA   ARG H 218    38.567  72.515  87.815  1.00  55.58    A    C
ATOM  21797  CB   ARG H 218    38.764  72.668  86.335  1.00  55.58    A    C
ATOM  21798  CG   ARG H 218    39.516  73.892  85.991  1.00  57.45    A    C
ATOM  21799  CD   ARG H 218    40.295  73.690  84.752  1.00  60.58    A    C
ATOM  21800  NE   ARG H 218    40.500  74.934  84.028  1.00  63.73    A    N
ATOM  21801  CZ   ARG H 218    40.169  76.126  84.494  1.00  62.05    A    C
ATOM  21802  NH1  ARG H 218    39.617  76.227  85.675  1.00  63.16    A    N
ATOM  21803  NH2  ARG H 218    40.385  77.204  83.784  1.00  59.59    A    N
ATOM  21804  C    ARG H 218    37.770  73.671  88.317  1.00  56.32    A    C
ATOM  21805  O    ARG H 218    38.307  74.619  88.810  1.00  57.71    A    O
ATOM  21806  N    LEU H 219    36.477  73.626  88.131  1.00  57.05    A    N
ATOM  21807  CA   LEU H 219    35.635  74.675  88.641  1.00  57.16    A    C
ATOM  21808  CB   LEU H 219    34.234  74.599  88.024  1.00  57.48    A    C
ATOM  21809  CG   LEU H 219    34.049  74.633  86.501  1.00  57.50    A    C
ATOM  21810  CD1  LEU H 219    32.878  73.817  86.126  1.00  57.69    A    C
ATOM  21811  CD2  LEU H 219    33.845  76.001  85.997  1.00  56.61    A    C
ATOM  21812  C    LEU H 219    35.558  74.761  90.161  1.00  56.72    A    C
ATOM  21813  O    LEU H 219    35.506  75.829  90.715  1.00  56.04    A    O
ATOM  21814  N    HIS H 220    35.479  73.640  90.838  1.00  55.92    A    N
ATOM  21815  CA   HIS H 220    35.203  73.691  92.251  1.00  55.98    A    C
ATOM  21816  CB   HIS H 220    33.955  72.899  92.566  1.00  55.65    A    C
ATOM  21817  CG   HIS H 220    32.775  73.314  91.764  1.00  56.62    A    C
ATOM  21818  ND1  HIS H 220    32.175  74.535  91.909  1.00  59.62    A    N
ATOM  21819  CE1  HIS H 220    31.171  74.634  91.068  1.00  59.44    A    C
ATOM  21820  NE2  HIS H 220    31.098  73.519  90.380  1.00  59.90    A    N
ATOM  21821  CD2  HIS H 220    32.083  72.674  90.801  1.00  58.91    A    C
ATOM  21822  C    HIS H 220    36.346  73.269  93.127  1.00  56.32    A    C
ATOM  21823  O    HIS H 220    36.216  73.213  94.323  1.00  56.55    A    O
ATOM  21824  N    GLY H 221    37.468  72.931  92.527  1.00  56.05    A    N
ATOM  21825  CA   GLY H 221    38.652  72.639  93.293  1.00  55.62    A    C
ATOM  21826  C    GLY H 221    38.681  71.304  93.999  1.00  55.92    A    C
ATOM  21827  O    GLY H 221    39.577  71.067  94.780  1.00  55.93    A    O
ATOM  21828  N    THR H 222    37.720  70.436  93.690  1.00  55.34    A    N
ATOM  21829  CA   THR H 222    37.545  69.133  94.323  1.00  53.91    A    C
ATOM  21830  CB   THR H 222    36.129  68.675  94.244  1.00  53.51    A    C
ATOM  21831  OG1  THR H 222    35.787  68.484  92.889  1.00  52.61    A    O
```

Appendix 1

```
ATOM  21832  CG2  THR H 222    35.254  69.685  94.757  1.00  54.24    A    C
ATOM  21833  C    THR H 222    38.424  68.026  93.757  1.00  54.33    A    C
ATOM  21834  O    THR H 222    39.290  68.279  92.950  1.00  53.01    A    O
ATOM  21835  N    ASP H 223    38.196  66.800  94.215  1.00  55.02    A    N
ATOM  21836  CA   ASP H 223    38.981  65.645  93.794  1.00  56.45    A    C
ATOM  21837  CB   ASP H 223    39.950  65.177  94.857  1.00  56.88    A    C
ATOM  21838  CG   ASP H 223    41.086  64.381  94.277  1.00  59.63    A    C
ATOM  21839  OD1  ASP H 223    41.509  64.654  93.164  1.00  61.37    A    O
ATOM  21840  OD2  ASP H 223    41.582  63.470  94.934  1.00  63.20    A    O-1
ATOM  21841  C    ASP H 223    38.216  64.445  93.257  1.00  56.03    A    C
ATOM  21842  O    ASP H 223    38.603  63.322  93.495  1.00  55.55    A    O
ATOM  21843  N    TYR H 224    37.187  64.692  92.470  1.00  55.21    A    N
ATOM  21844  CA   TYR H 224    36.345  63.629  91.980  1.00  54.40    A    C
ATOM  21845  CB   TYR H 224    35.098  64.170  91.293  1.00  53.80    A    C
ATOM  21846  CG   TYR H 224    33.997  64.547  92.221  1.00  51.85    A    C
ATOM  21847  CD1  TYR H 224    33.242  63.606  92.847  1.00  47.27    A    C
ATOM  21848  CE1  TYR H 224    32.267  63.959  93.685  1.00  44.93    A    C
ATOM  21849  CZ   TYR H 224    32.016  65.271  93.923  1.00  44.06    A    C
ATOM  21850  OH   TYR H 224    31.026  65.670  94.770  1.00  37.41    A    O
ATOM  21851  CE2  TYR H 224    32.744  66.208  93.318  1.00  46.31    A    C
ATOM  21852  CD2  TYR H 224    33.718  65.853  92.472  1.00  50.72    A    C
ATOM  21853  C    TYR H 224    37.123  62.708  91.062  1.00  54.79    A    C
ATOM  21854  O    TYR H 224    36.708  61.611  90.810  1.00  54.52    A    O
ATOM  21855  N    ARG H 225    38.309  63.085  90.651  1.00  54.93    A    N
ATOM  21856  CA   ARG H 225    38.978  62.274  89.682  1.00  56.54    A    C
ATOM  21857  CB   ARG H 225    40.104  63.070  89.124  1.00  56.92    A    C
ATOM  21858  CG   ARG H 225    39.769  64.513  89.139  1.00  57.13    A    C
ATOM  21859  CD   ARG H 225    40.977  65.368  89.123  1.00  58.92    A    C
ATOM  21860  NE   ARG H 225    40.987  66.229  90.285  1.00  61.44    A    N
ATOM  21861  CZ   ARG H 225    42.024  66.960  90.642  1.00  63.18    A    C
ATOM  21862  NH1  ARG H 225    43.120  66.929  89.919  1.00  61.92    A    N
ATOM  21863  NH2  ARG H 225    41.968  67.718  91.714  1.00  63.51    A    N
ATOM  21864  C    ARG H 225    39.536  60.992  90.242  1.00  57.73    A    C
ATOM  21865  O    ARG H 225    40.526  60.957  90.948  1.00  58.38    A    O
ATOM  21866  N    ALA H 226    38.821  59.935  89.879  1.00  58.35    A    N
ATOM  21867  CA   ALA H 226    39.089  58.546  90.148  1.00  57.79    A    C
ATOM  21868  CB   ALA H 226    37.862  57.399  90.639  1.00  57.15    A    C
ATOM  21869  C    ALA H 226    39.501  57.899  88.857  1.00  57.72    A    C
ATOM  21870  O    ALA H 226    39.249  56.746  88.644  1.00  55.99    A    O
ATOM  21871  N    ALA H 227    40.028  58.702  87.963  1.00  58.52    A    N
ATOM  21872  CA   ALA H 227    40.347  58.243  86.653  1.00  60.04    A    C
ATOM  21873  CB   ALA H 227    40.709  59.418  85.821  1.00  58.27    A    C
ATOM  21874  C    ALA H 227    41.443  57.179  86.584  1.00  62.06    A    C
ATOM  21875  O    ALA H 227    41.289  56.172  85.923  1.00  62.07    A    O
ATOM  21876  N    THR H 228    42.591  57.442  87.170  1.00  64.55    A    N
ATOM  21877  CA   THR H 228    43.614  56.463  87.020  1.00  66.59    A    C
ATOM  21878  CB   THR H 228    44.843  56.763  87.864  1.00  66.31    A    C
ATOM  21879  OG1  THR H 228    45.703  57.671  87.163  1.00  68.62    A    O
ATOM  21880  CG2  THR H 228    45.594  55.482  88.152  1.00  64.68    A    C
ATOM  21881  C    THR H 228    42.913  55.408  87.724  1.00  67.64    A    C
ATOM  21882  O    THR H 228    42.721  54.339  87.211  1.00  67.12    A    O
ATOM  21883  N    ARG H 229    42.634  55.789  88.957  1.00  68.67    A    N
ATOM  21884  CA   ARG H 229    42.147  54.888  89.938  1.00  69.03    A    C
ATOM  21885  CB   ARG H 229    40.952  55.456  90.702  1.00  69.37    A    C
```

Appendix 1

```
ATOM  21886  CG   ARG H 229   41.278  55.885  92.113  1.00  72.94     A    C
ATOM  21887  CD   ARG H 229   40.047  56.138  92.978  1.00  77.63     A    C
ATOM  21888  NE   ARG H 229   39.501  54.916  93.547  1.00  81.05     A    N
ATOM  21889  CZ   ARG H 229   39.654  54.513  94.806  1.00  82.54     A    C
ATOM  21890  NH1  ARG H 229   40.355  55.227  95.675  1.00  81.91     A    N
ATOM  21891  NH2  ARG H 229   39.103  53.376  95.198  1.00  80.77     A    N
ATOM  21892  C    ARG H 229   41.734  53.814  89.039  1.00  67.89     A    C
ATOM  21893  O    ARG H 229   42.306  53.608  87.984  1.00  68.24     A    O
ATOM  21894  N    ALA H 230   40.664  53.189  89.414  1.00  66.40     A    N
ATOM  21895  CA   ALA H 230   40.356  51.982  88.784  1.00  65.43     A    C
ATOM  21896  CB   ALA H 230   39.088  51.441  89.373  1.00  65.77     A    C
ATOM  21897  C    ALA H 230   40.211  52.219  87.309  1.00  63.78     A    C
ATOM  21898  O    ALA H 230   40.697  51.447  86.536  1.00  63.94     A    O
ATOM  21899  N    TRP H 231   39.558  53.277  86.891  1.00  61.37     A    N
ATOM  21900  CA   TRP H 231   39.060  53.217  85.562  1.00  59.02     A    C
ATOM  21901  CB   TRP H 231   38.274  54.464  85.214  1.00  58.65     A    C
ATOM  21902  CG   TRP H 231   37.629  54.323  83.911  1.00  54.35     A    C
ATOM  21903  CD1  TRP H 231   36.672  53.457  83.595  1.00  52.27     A    C
ATOM  21904  NE1  TRP H 231   36.339  53.571  82.304  1.00  49.88     A    N
ATOM  21905  CE2  TRP H 231   37.101  54.544  81.745  1.00  47.85     A    C
ATOM  21906  CD2  TRP H 231   37.931  55.030  82.733  1.00  49.63     A    C
ATOM  21907  CE3  TRP H 231   38.818  56.040  82.419  1.00  48.89     A    C
ATOM  21908  CZ3  TRP H 231   38.833  56.508  81.173  1.00  47.62     A    C
ATOM  21909  CH2  TRP H 231   38.000  56.007  80.214  1.00  46.59     A    C
ATOM  21910  CZ2  TRP H 231   37.128  55.019  80.480  1.00  46.33     A    C
ATOM  21911  C    TRP H 231   40.153  53.036  84.563  1.00  59.03     A    C
ATOM  21912  O    TRP H 231   40.061  52.233  83.686  1.00  58.01     A    O
ATOM  21913  N    LEU H 232   41.192  53.818  84.657  1.00  59.45     A    N
ATOM  21914  CA   LEU H 232   42.217  53.715  83.655  1.00  59.49     A    C
ATOM  21915  CB   LEU H 232   43.224  54.819  83.858  1.00  59.03     A    C
ATOM  21916  CG   LEU H 232   43.495  55.796  82.737  1.00  60.35     A    C
ATOM  21917  CD1  LEU H 232   42.455  55.759  81.721  1.00  60.82     A    C
ATOM  21918  CD2  LEU H 232   43.619  57.148  83.268  1.00  57.93     A    C
ATOM  21919  C    LEU H 232   42.879  52.347  83.679  1.00  59.77     A    C
ATOM  21920  O    LEU H 232   43.163  51.774  82.656  1.00  58.80     A    O
ATOM  21921  N    ASP H 233   43.143  51.823  84.856  1.00  60.26     A    N
ATOM  21922  CA   ASP H 233   43.715  50.512  84.922  1.00  62.22     A    C
ATOM  21923  CB   ASP H 233   44.005  50.126  86.371  1.00  63.15     A    C
ATOM  21924  CG   ASP H 233   45.116  50.936  87.000  1.00  65.95     A    C
ATOM  21925  OD1  ASP H 233   45.919  51.532  86.273  1.00  68.08     A    O
ATOM  21926  OD2  ASP H 233   45.184  50.972  88.235  1.00  66.61     A    O-1
ATOM  21927  C    ASP H 233   42.750  49.496  84.341  1.00  62.62     A    C
ATOM  21928  O    ASP H 233   43.118  48.659  83.549  1.00  62.23     A    O
ATOM  21929  N    PHE H 234   41.492  49.597  84.723  1.00  62.69     A    N
ATOM  21930  CA   PHE H 234   40.496  48.616  84.397  1.00  62.44     A    C
ATOM  21931  CB   PHE H 234   39.184  49.077  84.975  1.00  62.77     A    C
ATOM  21932  CG   PHE H 234   38.014  48.260  84.572  1.00  63.85     A    C
ATOM  21933  CD1  PHE H 234   37.945  46.942  84.877  1.00  65.56     A    C
ATOM  21934  CE1  PHE H 234   36.869  46.224  84.520  1.00  65.96     A    C
ATOM  21935  CZ   PHE H 234   35.850  46.813  83.871  1.00  65.37     A    C
ATOM  21936  CE2  PHE H 234   35.904  48.104  83.579  1.00  63.77     A    C
ATOM  21937  CD2  PHE H 234   36.964  48.827  83.929  1.00  63.29     A    C
ATOM  21938  C    PHE H 234   40.363  48.488  82.918  1.00  62.26     A    C
ATOM  21939  O    PHE H 234   40.246  47.416  82.408  1.00  62.73     A    O
```

Appendix 1

```
ATOM  21940  N    ILE H 235      40.412  49.576  82.191  1.00 62.12      A    N
ATOM  21941  CA   ILE H 235      40.186  49.469  80.770  1.00 61.77      A    C
ATOM  21942  CB   ILE H 235      39.696  50.751  80.105  1.00 60.71      A    C
ATOM  21943  CG1  ILE H 235      40.618  51.917  80.352  1.00 58.09      A    C
ATOM  21944  CD1  ILE H 235      40.177  53.120  79.646  1.00 49.56      A    C
ATOM  21945  CG2  ILE H 235      38.349  51.078  80.608  1.00 59.20      A    C
ATOM  21946  C    ILE H 235      41.343  48.800  80.058  1.00 63.21      A    C
ATOM  21947  O    ILE H 235      41.299  48.540  78.877  1.00 63.23      A    O
ATOM  21948  N    GLN H 236      42.375  48.491  80.814  1.00 64.36      A    N
ATOM  21949  CA   GLN H 236      43.517  47.814  80.262  1.00 65.43      A    C
ATOM  21950  CB   GLN H 236      44.799  48.511  80.627  1.00 65.20      A    C
ATOM  21951  CG   GLN H 236      45.238  49.503  79.603  1.00 65.63      A    C
ATOM  21952  CD   GLN H 236      46.276  50.436  80.122  1.00 66.21      A    C
ATOM  21953  OE1  GLN H 236      46.025  51.199  81.031  1.00 66.38      A    O
ATOM  21954  NE2  GLN H 236      47.450  50.382  79.546  1.00 62.13      A    N
ATOM  21955  C    GLN H 236      43.529  46.385  80.694  1.00 66.18      A    C
ATOM  21956  O    GLN H 236      44.534  45.747  80.621  1.00 66.43      A    O
ATOM  21957  N    LYS H 237      42.375  45.894  81.107  1.00 67.06      A    N
ATOM  21958  CA   LYS H 237      42.232  44.572  81.658  1.00 68.53      A    C
ATOM  21959  CB   LYS H 237      41.786  44.697  83.097  1.00 69.09      A    C
ATOM  21960  CG   LYS H 237      42.593  43.961  84.109  1.00 71.75      A    C
ATOM  21961  CD   LYS H 237      41.663  43.206  85.053  1.00 75.76      A    C
ATOM  21962  CE   LYS H 237      41.970  43.482  86.517  1.00 76.48      A    C
ATOM  21963  NZ   LYS H 237      40.739  43.655  87.299  1.00 76.49      A    N
ATOM  21964  C    LYS H 237      41.143  43.836  80.901  1.00 68.88      A    C
ATOM  21965  O    LYS H 237      40.073  43.534  81.433  1.00 69.43      A    O
ATOM  21966  N    ASP H 238      41.422  43.574  79.635  1.00 68.04      A    N
ATOM  21967  CA   ASP H 238      40.597  42.734  78.779  1.00 67.08      A    C
ATOM  21968  CB   ASP H 238      39.934  41.638  79.580  1.00 68.05      A    C
ATOM  21969  CG   ASP H 238      40.794  40.429  79.677  1.00 70.32      A    C
ATOM  21970  OD1  ASP H 238      41.061  39.980  80.790  1.00 71.70      A    O
ATOM  21971  OD2  ASP H 238      41.249  39.959  78.631  1.00 73.06      A    O-1
ATOM  21972  C    ASP H 238      39.577  43.493  78.017  1.00 64.78      A    C
ATOM  21973  O    ASP H 238      38.995  42.983  77.102  1.00 65.04      A    O
ATOM  21974  N    LEU H 239      39.406  44.746  78.364  1.00 62.04      A    N
ATOM  21975  CA   LEU H 239      38.608  45.634  77.565  1.00 58.94      A    C
ATOM  21976  CB   LEU H 239      38.139  46.790  78.415  1.00 59.02      A    C
ATOM  21977  CG   LEU H 239      36.728  47.299  78.208  1.00 58.10      A    C
ATOM  21978  CD1  LEU H 239      35.954  46.473  77.255  1.00 57.28      A    C
ATOM  21979  CD2  LEU H 239      36.041  47.425  79.498  1.00 56.99      A    C
ATOM  21980  C    LEU H 239      39.388  46.111  76.367  1.00 56.91      A    C
ATOM  21981  O    LEU H 239      38.838  46.669  75.466  1.00 56.39      A    O
ATOM  21982  N    ILE H 240      40.685  45.885  76.358  1.00 55.88      A    N
ATOM  21983  CA   ILE H 240      41.543  46.392  75.302  1.00 54.49      A    C
ATOM  21984  CB   ILE H 240      42.321  47.584  75.797  1.00 54.28      A    C
ATOM  21985  CG1  ILE H 240      42.757  48.450  74.643  1.00 53.93      A    C
ATOM  21986  CD1  ILE H 240      44.172  48.733  74.654  1.00 52.73      A    C
ATOM  21987  CG2  ILE H 240      43.511  47.135  76.503  1.00 55.27      A    C
ATOM  21988  C    ILE H 240      42.537  45.392  74.791  1.00 53.43      A    C
ATOM  21989  O    ILE H 240      42.953  44.547  75.513  1.00 53.61      A    O
ATOM  21990  N    ASP H 241      42.910  45.508  73.529  1.00 53.05      A    N
ATOM  21991  CA   ASP H 241      43.955  44.711  72.933  1.00 51.92      A    C
ATOM  21992  CB   ASP H 241      43.490  44.207  71.594  1.00 51.11      A    C
ATOM  21993  CG   ASP H 241      44.554  43.530  70.858  1.00 51.45      A    C
```

Appendix 1

```
ATOM  21994  OD1  ASP  H  241      45.693  43.677  71.269  1.00  51.26      A    O
ATOM  21995  OD2  ASP  H  241      44.273  42.842  69.888  1.00  50.45      A    O-1
ATOM  21996  C    ASP  H  241      45.181  45.568  72.728  1.00  52.73      A    C
ATOM  21997  O    ASP  H  241      45.225  46.379  71.841  1.00  51.50      A    O
ATOM  21998  N    PRO  H  242      46.172  45.392  73.584  1.00  53.44      A    N
ATOM  21999  CA   PRO  H  242      47.327  46.277  73.671  1.00  52.76      A    C
ATOM  22000  CB   PRO  H  242      48.063  45.759  74.869  1.00  51.95      A    C
ATOM  22001  CG   PRO  H  242      47.089  45.048  75.608  1.00  54.66      A    C
ATOM  22002  CD   PRO  H  242      46.241  44.378  74.627  1.00  54.37      A    C
ATOM  22003  C    PRO  H  242      48.224  46.279  72.495  1.00  52.63      A    C
ATOM  22004  O    PRO  H  242      48.805  47.277  72.211  1.00  52.66      A    O
ATOM  22005  N    GLU  H  243      48.433  45.155  71.864  1.00  52.22      A    N
ATOM  22006  CA   GLU  H  243      49.234  45.197  70.685  1.00  52.63      A    C
ATOM  22007  CB   GLU  H  243      49.705  43.800  70.331  1.00  53.74      A    C
ATOM  22008  CG   GLU  H  243      50.721  43.268  71.313  1.00  58.69      A    C
ATOM  22009  CD   GLU  H  243      52.126  43.781  71.066  1.00  67.97      A    C
ATOM  22010  OE1  GLU  H  243      52.660  44.504  71.927  1.00  66.81      A    O
ATOM  22011  OE2  GLU  H  243      52.703  43.458  70.010  1.00  69.45      A    O-1
ATOM  22012  C    GLU  H  243      48.569  45.911  69.523  1.00  51.48      A    C
ATOM  22013  O    GLU  H  243      49.174  46.686  68.838  1.00  51.53      A    O
ATOM  22014  N    ARG  H  244      47.305  45.621  69.286  1.00  50.64      A    N
ATOM  22015  CA   ARG  H  244      46.549  46.261  68.214  1.00  48.68      A    C
ATOM  22016  CB   ARG  H  244      45.335  45.432  67.791  1.00  48.31      A    C
ATOM  22017  CG   ARG  H  244      45.686  44.288  66.904  1.00  48.00      A    C
ATOM  22018  CD   ARG  H  244      44.517  43.512  66.430  1.00  49.86      A    C
ATOM  22019  NE   ARG  H  244      43.693  43.001  67.514  1.00  55.91      A    N
ATOM  22020  CZ   ARG  H  244      42.708  42.132  67.349  1.00  54.89      A    C
ATOM  22021  NH1  ARG  H  244      42.440  41.677  66.160  1.00  57.65      A    N
ATOM  22022  NH2  ARG  H  244      41.996  41.720  68.365  1.00  52.06      A    N
ATOM  22023  C    ARG  H  244      46.198  47.722  68.478  1.00  48.27      A    C
ATOM  22024  O    ARG  H  244      45.964  48.480  67.566  1.00  47.05      A    O
ATOM  22025  N    GLY  H  245      46.196  48.115  69.738  1.00  46.93      A    N
ATOM  22026  CA   GLY  H  245      45.765  49.437  70.114  1.00  45.82      A    C
ATOM  22027  C    GLY  H  245      44.285  49.735  70.019  1.00  45.06      A    C
ATOM  22028  O    GLY  H  245      43.895  50.843  69.796  1.00  46.91      A    O
ATOM  22029  N    ALA  H  246      43.436  48.754  70.201  1.00  43.24      A    N
ATOM  22030  CA   ALA  H  246      42.037  49.010  70.036  1.00  40.43      A    C
ATOM  22031  CB   ALA  H  246      41.577  48.445  68.762  1.00  40.91      A    C
ATOM  22032  C    ALA  H  246      41.232  48.475  71.170  1.00  38.05      A    C
ATOM  22033  O    ALA  H  246      41.592  47.524  71.766  1.00  36.78      A    O
ATOM  22034  N    PHE  H  247      40.142  49.130  71.461  1.00  35.67      A    N
ATOM  22035  CA   PHE  H  247      39.189  48.610  72.372  1.00  34.46      A    C
ATOM  22036  CB   PHE  H  247      38.404  49.724  72.982  1.00  35.12      A    C
ATOM  22037  CG   PHE  H  247      39.179  50.559  73.868  1.00  34.43      A    C
ATOM  22038  CD1  PHE  H  247      39.546  50.123  75.082  1.00  35.63      A    C
ATOM  22039  CE1  PHE  H  247      40.248  50.890  75.873  1.00  34.78      A    C
ATOM  22040  CZ   PHE  H  247      40.583  52.082  75.491  1.00  32.57      A    C
ATOM  22041  CE2  PHE  H  247      40.228  52.535  74.291  1.00  34.34      A    C
ATOM  22042  CD2  PHE  H  247      39.538  51.788  73.489  1.00  34.23      A    C
ATOM  22043  C    PHE  H  247      38.242  47.676  71.721  1.00  34.21      A    C
ATOM  22044  O    PHE  H  247      37.889  47.807  70.600  1.00  33.93      A    O
ATOM  22045  N    TYR  H  248      37.811  46.723  72.495  1.00  34.76      A    N
ATOM  22046  CA   TYR  H  248      36.728  45.877  72.132  1.00  34.46      A    C
ATOM  22047  CB   TYR  H  248      36.756  44.614  72.977  1.00  33.43      A    C
```

Appendix 1

```
ATOM  22048  CG   TYR H 248     37.876  43.706  72.596  1.00 37.35      A    C
ATOM  22049  CD1  TYR H 248     37.788  42.916  71.499  1.00 38.20      A    C
ATOM  22050  CE1  TYR H 248     38.790  42.129  71.143  1.00 35.62      A    C
ATOM  22051  CZ   TYR H 248     39.916  42.103  71.872  1.00 39.43      A    C
ATOM  22052  OH   TYR H 248     40.930  41.293  71.507  1.00 44.67      A    O
ATOM  22053  CE2  TYR H 248     40.047  42.866  72.967  1.00 38.77      A    C
ATOM  22054  CD2  TYR H 248     39.038  43.658  73.330  1.00 39.73      A    C
ATOM  22055  C    TYR H 248     35.454  46.698  72.260  1.00 33.81      A    C
ATOM  22056  O    TYR H 248     35.430  47.683  72.937  1.00 33.29      A    O
ATOM  22057  N    LEU H 249     34.417  46.292  71.555  1.00 33.35      A    N
ATOM  22058  CA   LEU H 249     33.192  47.043  71.438  1.00 33.53      A    C
ATOM  22059  CB   LEU H 249     32.316  46.306  70.456  1.00 33.89      A    C
ATOM  22060  CG   LEU H 249     30.988  46.826  69.969  1.00 36.15      A    C
ATOM  22061  CD1  LEU H 249     31.217  48.014  69.203  1.00 39.02      A    C
ATOM  22062  CD2  LEU H 249     30.411  45.818  69.066  1.00 40.38      A    C
ATOM  22063  C    LEU H 249     32.415  47.281  72.703  1.00 32.28      A    C
ATOM  22064  O    LEU H 249     32.030  48.370  72.965  1.00 32.40      A    O
ATOM  22065  N    SER H 250     32.184  46.263  73.490  1.00 32.87      A    N
ATOM  22066  CA   SER H 250     31.569  46.456  74.774  1.00 33.69      A    C
ATOM  22067  CB   SER H 250     30.080  46.662  74.668  1.00 34.62      A    C
ATOM  22068  OG   SER H 250     29.494  45.675  73.894  1.00 36.20      A    O
ATOM  22069  C    SER H 250     31.847  45.345  75.704  1.00 34.24      A    C
ATOM  22070  O    SER H 250     32.330  44.337  75.318  1.00 35.04      A    O
ATOM  22071  N    TYR H 251     31.518  45.560  76.954  1.00 34.89      A    N
ATOM  22072  CA   TYR H 251     31.698  44.590  77.980  1.00 34.90      A    C
ATOM  22073  CB   TYR H 251     32.798  45.054  78.885  1.00 34.05      A    C
ATOM  22074  CG   TYR H 251     32.800  44.471  80.261  1.00 38.22      A    C
ATOM  22075  CD1  TYR H 251     33.013  43.133  80.483  1.00 40.20      A    C
ATOM  22076  CE1  TYR H 251     33.023  42.642  81.727  1.00 39.38      A    C
ATOM  22077  CZ   TYR H 251     32.864  43.488  82.767  1.00 43.00      A    C
ATOM  22078  OH   TYR H 251     32.878  43.058  84.046  1.00 42.12      A    O
ATOM  22079  CE2  TYR H 251     32.669  44.797  82.565  1.00 43.12      A    C
ATOM  22080  CD2  TYR H 251     32.652  45.280  81.344  1.00 41.39      A    C
ATOM  22081  C    TYR H 251     30.424  44.474  78.730  1.00 34.63      A    C
ATOM  22082  O    TYR H 251     29.728  45.413  78.885  1.00 34.13      A    O
ATOM  22083  N    HIS H 252     30.089  43.292  79.169  1.00 37.03      A    N
ATOM  22084  CA   HIS H 252     28.853  43.129  79.881  1.00 39.61      A    C
ATOM  22085  CB   HIS H 252     27.881  42.404  78.978  1.00 39.17      A    C
ATOM  22086  CG   HIS H 252     27.751  43.056  77.654  1.00 35.74      A    C
ATOM  22087  ND1  HIS H 252     28.674  42.896  76.656  1.00 35.96      A    N
ATOM  22088  CE1  HIS H 252     28.343  43.645  75.633  1.00 35.01      A    C
ATOM  22089  NE2  HIS H 252     27.257  44.312  75.946  1.00 32.62      A    N
ATOM  22090  CD2  HIS H 252     26.867  43.961  77.205  1.00 34.70      A    C
ATOM  22091  C    HIS H 252     29.061  42.439  81.186  1.00 42.51      A    C
ATOM  22092  O    HIS H 252     29.425  41.301  81.241  1.00 42.31      A    O
ATOM  22093  N    PRO H 253     28.858  43.196  82.241  1.00 45.27      A    N
ATOM  22094  CA   PRO H 253     29.253  42.867  83.606  1.00 46.71      A    C
ATOM  22095  CB   PRO H 253     28.927  44.150  84.349  1.00 46.70      A    C
ATOM  22096  CG   PRO H 253     29.058  45.152  83.362  1.00 46.84      A    C
ATOM  22097  CD   PRO H 253     28.489  44.601  82.140  1.00 45.32      A    C
ATOM  22098  C    PRO H 253     28.592  41.677  84.279  1.00 47.73      A    C
ATOM  22099  O    PRO H 253     29.247  40.971  85.003  1.00 48.02      A    O
ATOM  22100  N    GLU H 254     27.308  41.485  84.061  1.00 49.02      A    N
ATOM  22101  CA   GLU H 254     26.611  40.358  84.626  1.00 50.56      A    C
```

Appendix 1

```
ATOM  22102  CB   GLU H 254     25.103  40.534  84.513  1.00  51.60      A  C
ATOM  22103  CG   GLU H 254     24.318  39.281  84.290  1.00  56.15      A  C
ATOM  22104  CD   GLU H 254     23.727  38.744  85.534  1.00  63.28      A  C
ATOM  22105  OE1  GLU H 254     23.741  39.459  86.537  1.00  63.00      A  O
ATOM  22106  OE2  GLU H 254     23.288  37.592  85.531  1.00  65.88      A  O-1
ATOM  22107  C    GLU H 254     27.069  39.019  84.102  1.00  50.22      A  C
ATOM  22108  O    GLU H 254     27.122  38.076  84.832  1.00  50.92      A  O
ATOM  22109  N    SER H 255     27.401  38.955  82.833  1.00  49.60      A  N
ATOM  22110  CA   SER H 255     27.820  37.743  82.212  1.00  48.32      A  C
ATOM  22111  CB   SER H 255     27.190  37.652  80.847  1.00  48.68      A  C
ATOM  22112  OG   SER H 255     27.721  38.633  80.012  1.00  47.13      A  O
ATOM  22113  C    SER H 255     29.299  37.732  82.050  1.00  48.84      A  C
ATOM  22114  O    SER H 255     29.853  36.793  81.569  1.00  48.42      A  O
ATOM  22115  N    GLY H 256     29.949  38.736  82.568  1.00  48.95      A  N
ATOM  22116  CA   GLY H 256     31.343  38.829  82.318  1.00  49.64      A  C
ATOM  22117  C    GLY H 256     31.538  39.234  80.909  1.00  50.38      A  C
ATOM  22118  O    GLY H 256     31.115  40.275  80.527  1.00  51.94      A  O
ATOM  22119  N    ALA H 257     32.104  38.364  80.117  1.00  50.69      A  N
ATOM  22120  CA   ALA H 257     32.979  38.690  79.022  1.00  50.86      A  C
ATOM  22121  CB   ALA H 257     33.717  37.433  78.532  1.00  51.00      A  C
ATOM  22122  C    ALA H 257     32.466  39.502  77.837  1.00  48.87      A  C
ATOM  22123  O    ALA H 257     31.305  39.547  77.556  1.00  48.68      A  O
ATOM  22124  N    VAL H 258     33.453  40.061  77.155  1.00  46.55      A  N
ATOM  22125  CA   VAL H 258     33.465  41.141  76.194  1.00  44.51      A  C
ATOM  22126  CB   VAL H 258     34.864  41.642  76.226  1.00  44.01      A  C
ATOM  22127  CG1  VAL H 258     35.057  42.753  75.337  1.00  42.73      A  C
ATOM  22128  CG2  VAL H 258     35.192  41.987  77.584  1.00  45.21      A  C
ATOM  22129  C    VAL H 258     33.161  40.843  74.743  1.00  42.52      A  C
ATOM  22130  O    VAL H 258     33.520  39.832  74.267  1.00  43.39      A  O
ATOM  22131  N    LYS H 259     32.538  41.744  74.014  1.00  40.66      A  N
ATOM  22132  CA   LYS H 259     32.223  41.450  72.632  1.00  40.08      A  C
ATOM  22133  CB   LYS H 259     31.377  42.546  72.041  1.00  39.44      A  C
ATOM  22134  CG   LYS H 259     30.059  42.603  72.633  1.00  40.32      A  C
ATOM  22135  CD   LYS H 259     28.973  42.637  71.649  1.00  42.18      A  C
ATOM  22136  CE   LYS H 259     27.672  42.670  72.363  1.00  42.94      A  C
ATOM  22137  NZ   LYS H 259     26.922  43.854  72.020  1.00  45.45      A  N
ATOM  22138  C    LYS H 259     33.454  41.273  71.798  1.00  40.47      A  C
ATOM  22139  O    LYS H 259     34.324  42.094  71.811  1.00  42.07      A  O
ATOM  22140  N    PRO H 260     33.530  40.222  71.019  1.00  40.61      A  N
ATOM  22141  CA   PRO H 260     34.805  39.912  70.417  1.00  40.20      A  C
ATOM  22142  CB   PRO H 260     34.630  38.451  70.051  1.00  39.84      A  C
ATOM  22143  CG   PRO H 260     33.263  38.291  69.850  1.00  38.59      A  C
ATOM  22144  CD   PRO H 260     32.597  39.114  70.842  1.00  40.39      A  C
ATOM  22145  C    PRO H 260     35.102  40.669  69.176  1.00  39.63      A  C
ATOM  22146  O    PRO H 260     35.526  40.072  68.234  1.00  42.75      A  O
ATOM  22147  N    TRP H 261     34.939  41.967  69.175  1.00  37.20      A  N
ATOM  22148  CA   TRP H 261     35.332  42.727  68.018  1.00  35.17      A  C
ATOM  22149  CB   TRP H 261     34.139  43.074  67.123  1.00  34.35      A  C
ATOM  22150  CG   TRP H 261     33.490  41.926  66.448  1.00  35.52      A  C
ATOM  22151  CD1  TRP H 261     33.822  41.401  65.268  1.00  36.68      A  C
ATOM  22152  NE1  TRP H 261     33.020  40.362  64.966  1.00  33.99      A  N
ATOM  22153  CE2  TRP H 261     32.123  40.201  65.975  1.00  33.88      A  C
ATOM  22154  CD2  TRP H 261     32.383  41.178  66.916  1.00  34.89      A  C
ATOM  22155  CE3  TRP H 261     31.597  41.233  68.049  1.00  37.55      A  C
```

Appendix 1

```
ATOM  22156  CZ3  TRP H 261    30.611  40.335  68.186  1.00 39.33    A  C
ATOM  22157  CH2  TRP H 261    30.378  39.379  67.235  1.00 35.87    A  C
ATOM  22158  CZ2  TRP H 261    31.121  39.294  66.126  1.00 30.35    A  C
ATOM  22159  C    TRP H 261    36.024  43.970  68.480  1.00 33.86    A  C
ATOM  22160  O    TRP H 261    35.740  44.467  69.498  1.00 32.99    A  O
ATOM  22161  N    ILE H 262    36.963  44.457  67.716  1.00 33.47    A  N
ATOM  22162  CA   ILE H 262    37.588  45.692  68.050  1.00 31.85    A  C
ATOM  22163  CB   ILE H 262    39.108  45.641  67.890  1.00 32.16    A  C
ATOM  22164  CG1  ILE H 262    39.508  45.115  66.536  1.00 32.17    A  C
ATOM  22165  CD1  ILE H 262    40.862  45.374  66.205  1.00 24.82    A  C
ATOM  22166  CG2  ILE H 262    39.703  44.814  68.959  1.00 32.19    A  C
ATOM  22167  C    ILE H 262    36.949  46.799  67.251  1.00 31.50    A  C
ATOM  22168  O    ILE H 262    36.607  46.610  66.131  1.00 31.39    A  O
ATOM  22169  N    SER H 263    36.766  47.950  67.861  1.00 30.65    A  N
ATOM  22170  CA   SER H 263    36.082  49.051  67.228  1.00 28.93    A  C
ATOM  22171  CB   SER H 263    34.848  49.357  68.032  1.00 29.28    A  C
ATOM  22172  OG   SER H 263    34.134  50.390  67.472  1.00 26.87    A  O
ATOM  22173  C    SER H 263    36.871  50.310  67.092  1.00 28.15    A  C
ATOM  22174  O    SER H 263    37.210  50.904  68.039  1.00 28.90    A  O
ATOM  22175  N    ALA H 264    37.112  50.744  65.878  1.00 28.66    A  N
ATOM  22176  CA   ALA H 264    37.850  51.949  65.623  1.00 28.78    A  C
ATOM  22177  CB   ALA H 264    38.106  52.050  64.214  1.00 27.79    A  C
ATOM  22178  C    ALA H 264    37.220  53.221  66.107  1.00 30.81    A  C
ATOM  22179  O    ALA H 264    37.883  54.062  66.653  1.00 30.94    A  O
ATOM  22180  N    TYR H 265    35.934  53.365  65.883  1.00 31.74    A  N
ATOM  22181  CA   TYR H 265    35.226  54.515  66.357  1.00 33.03    A  C
ATOM  22182  CB   TYR H 265    33.829  54.671  65.713  1.00 33.75    A  C
ATOM  22183  CG   TYR H 265    32.665  54.394  66.613  1.00 34.86    A  C
ATOM  22184  CD1  TYR H 265    32.083  55.379  67.330  1.00 34.15    A  C
ATOM  22185  CE1  TYR H 265    31.073  55.122  68.136  1.00 33.59    A  C
ATOM  22186  CZ   TYR H 265    30.611  53.877  68.245  1.00 34.20    A  C
ATOM  22187  OH   TYR H 265    29.601  53.611  69.069  1.00 32.29    A  O
ATOM  22188  CE2  TYR H 265    31.154  52.890  67.555  1.00 35.31    A  C
ATOM  22189  CD2  TYR H 265    32.160  53.144  66.740  1.00 35.45    A  C
ATOM  22190  C    TYR H 265    35.231  54.529  67.860  1.00 34.35    A  C
ATOM  22191  O    TYR H 265    35.330  55.549  68.440  1.00 35.97    A  O
ATOM  22192  N    THR H 266    35.090  53.388  68.489  1.00 34.23    A  N
ATOM  22193  CA   THR H 266    35.068  53.344  69.926  1.00 34.65    A  C
ATOM  22194  CB   THR H 266    34.834  51.931  70.407  1.00 34.21    A  C
ATOM  22195  OG1  THR H 266    33.563  51.496  69.966  1.00 37.96    A  O
ATOM  22196  CG2  THR H 266    34.883  51.858  71.872  1.00 31.51    A  C
ATOM  22197  C    THR H 266    36.388  53.787  70.469  1.00 34.89    A  C
ATOM  22198  O    THR H 266    36.474  54.490  71.445  1.00 32.90    A  O
ATOM  22199  N    THR H 267    37.417  53.268  69.853  1.00 35.20    A  N
ATOM  22200  CA   THR H 267    38.759  53.558  70.217  1.00 36.97    A  C
ATOM  22201  CB   THR H 267    39.669  52.701  69.359  1.00 37.61    A  C
ATOM  22202  OG1  THR H 267    39.548  51.365  69.777  1.00 37.98    A  O
ATOM  22203  CG2  THR H 267    41.075  53.085  69.496  1.00 36.51    A  C
ATOM  22204  C    THR H 267    39.120  54.988  69.988  1.00 37.02    A  C
ATOM  22205  O    THR H 267    39.607  55.630  70.856  1.00 36.06    A  O
ATOM  22206  N    ALA H 268    38.870  55.486  68.803  1.00 37.52    A  N
ATOM  22207  CA   ALA H 268    39.264  56.821  68.476  1.00 37.34    A  C
ATOM  22208  CB   ALA H 268    38.946  57.089  67.082  1.00 36.20    A  C
ATOM  22209  C    ALA H 268    38.574  57.819  69.354  1.00 38.86    A  C
```

Appendix 1

```
ATOM  22210  O    ALA H 268    39.176  58.741  69.824  1.00  38.60    A  O
ATOM  22211  N    TRP H 269    37.295  57.662  69.571  1.00  38.28    A  N
ATOM  22212  CA   TRP H 269    36.636  58.605  70.409  1.00  39.75    A  C
ATOM  22213  CB   TRP H 269    35.136  58.334  70.382  1.00  40.51    A  C
ATOM  22214  CG   TRP H 269    34.366  58.763  71.533  1.00  41.55    A  C
ATOM  22215  CD1  TRP H 269    34.838  59.259  72.675  1.00  43.86    A  C
ATOM  22216  NE1  TRP H 269    33.825  59.562  73.510  1.00  45.26    A  N
ATOM  22217  CE2  TRP H 269    32.650  59.258  72.903  1.00  45.04    A  C
ATOM  22218  CD2  TRP H 269    32.956  58.750  71.656  1.00  44.78    A  C
ATOM  22219  CE3  TRP H 269    31.916  58.355  70.827  1.00  45.86    A  C
ATOM  22220  CZ3  TRP H 269    30.653  58.464  71.280  1.00  44.43    A  C
ATOM  22221  CH2  TRP H 269    30.382  58.959  72.525  1.00  42.40    A  C
ATOM  22222  CZ2  TRP H 269    31.365  59.362  73.354  1.00  42.73    A  C
ATOM  22223  C    TRP H 269    37.201  58.521  71.794  1.00  40.37    A  C
ATOM  22224  O    TRP H 269    37.509  59.510  72.383  1.00  40.48    A  O
ATOM  22225  N    THR H 270    37.353  57.319  72.309  1.00  41.07    A  N
ATOM  22226  CA   THR H 270    37.811  57.118  73.668  1.00  40.92    A  C
ATOM  22227  CB   THR H 270    37.848  55.649  74.006  1.00  40.92    A  C
ATOM  22228  OG1  THR H 270    36.548  55.147  74.030  1.00  39.73    A  O
ATOM  22229  CG2  THR H 270    38.359  55.448  75.341  1.00  44.05    A  C
ATOM  22230  C    THR H 270    39.196  57.639  73.911  1.00  41.02    A  C
ATOM  22231  O    THR H 270    39.458  58.228  74.900  1.00  41.93    A  O
ATOM  22232  N    LEU H 271    40.090  57.379  72.995  1.00  40.68    A  N
ATOM  22233  CA   LEU H 271    41.451  57.792  73.140  1.00  41.10    A  C
ATOM  22234  CB   LEU H 271    42.286  57.248  72.003  1.00  40.73    A  C
ATOM  22235  CG   LEU H 271    43.301  56.152  72.254  1.00  39.76    A  C
ATOM  22236  CD1  LEU H 271    42.855  55.219  73.291  1.00  37.00    A  C
ATOM  22237  CD2  LEU H 271    43.642  55.435  70.991  1.00  37.66    A  C
ATOM  22238  C    LEU H 271    41.549  59.269  73.161  1.00  41.56    A  C
ATOM  22239  O    LEU H 271    42.341  59.803  73.861  1.00  41.94    A  O
ATOM  22240  N    ALA H 272    40.759  59.926  72.348  1.00  42.27    A  N
ATOM  22241  CA   ALA H 272    40.779  61.360  72.277  1.00  42.82    A  C
ATOM  22242  CB   ALA H 272    40.014  61.850  71.125  1.00  42.05    A  C
ATOM  22243  C    ALA H 272    40.344  62.032  73.547  1.00  44.08    A  C
ATOM  22244  O    ALA H 272    40.880  63.045  73.890  1.00  45.47    A  O
ATOM  22245  N    MET H 273    39.361  61.505  74.248  1.00  44.58    A  N
ATOM  22246  CA   MET H 273    39.024  62.072  75.528  1.00  45.67    A  C
ATOM  22247  CB   MET H 273    37.725  61.522  76.074  1.00  45.03    H  C
ATOM  22248  CG   MET H 273    36.592  61.771  75.163  1.00  49.38    H  C
ATOM  22249  SD   MET H 273    35.057  62.325  75.836  1.00  54.65    H  S
ATOM  22250  CE   MET H 273    34.773  63.687  74.790  1.00  49.96    H  C
ATOM  22251  C    MET H 273    40.124  61.891  76.525  1.00  46.43    A  C
ATOM  22252  O    MET H 273    40.403  62.768  77.286  1.00  47.53    A  O
ATOM  22253  N    VAL H 274    40.710  60.714  76.532  1.00  46.98    A  N
ATOM  22254  CA   VAL H 274    41.760  60.363  77.464  1.00  46.57    A  C
ATOM  22255  CB   VAL H 274    42.025  58.883  77.514  1.00  46.16    A  C
ATOM  22256  CG1  VAL H 274    43.173  58.609  78.355  1.00  44.12    A  C
ATOM  22257  CG2  VAL H 274    40.882  58.231  78.092  1.00  45.85    A  C
ATOM  22258  C    VAL H 274    43.028  61.159  77.310  1.00  46.68    A  C
ATOM  22259  O    VAL H 274    43.676  61.440  78.256  1.00  45.39    A  O
ATOM  22260  N    HIS H 275    43.343  61.575  76.116  1.00  47.96    A  N
ATOM  22261  CA   HIS H 275    44.547  62.292  75.908  1.00  49.53    A  C
ATOM  22262  CB   HIS H 275    44.719  62.675  74.474  1.00  50.12    A  C
ATOM  22263  CG   HIS H 275    46.075  63.200  74.165  1.00  54.51    A  C
```

Appendix 1

```
ATOM  22264  ND1  HIS  H  275    46.303  64.507  73.825  1.00  56.83      A  N
ATOM  22265  CE1  HIS  H  275    47.586  64.682  73.596  1.00  55.36      A  C
ATOM  22266  NE2  HIS  H  275    48.201  63.539  73.796  1.00  55.94      A  N
ATOM  22267  CD2  HIS  H  275    47.279  62.596  74.151  1.00  55.41      A  C
ATOM  22268  C    HIS  H  275    44.351  63.504  76.684  1.00  49.64      A  C
ATOM  22269  O    HIS  H  275    45.233  64.272  76.848  1.00  50.56      A  O
ATOM  22270  N    GLY  H  276    43.124  63.736  77.042  1.00  49.13      A  N
ATOM  22271  CA   GLY  H  276    42.767  64.792  77.949  1.00  48.72      A  C
ATOM  22272  C    GLY  H  276    43.133  64.610  79.376  1.00  48.40      A  C
ATOM  22273  O    GLY  H  276    43.430  65.550  80.043  1.00  47.59      A  O
ATOM  22274  N    MET  H  277    42.973  63.402  79.866  1.00  48.58      A  N
ATOM  22275  CA   MET  H  277    43.221  63.130  81.254  1.00  49.26      A  C
ATOM  22276  CB   MET  H  277    42.143  62.229  81.825  1.00  49.44      H  C
ATOM  22277  CG   MET  H  277    40.883  62.938  82.181  1.00  50.67      H  C
ATOM  22278  SD   MET  H  277    39.453  61.931  82.026  1.00  54.44      H  S
ATOM  22279  CE   MET  H  277    39.402  61.807  80.293  1.00  53.63      H  C
ATOM  22280  C    MET  H  277    44.563  62.510  81.466  1.00  49.36      A  C
ATOM  22281  O    MET  H  277    45.109  62.637  82.511  1.00  50.61      A  O
ATOM  22282  N    ASP  H  278    45.050  61.801  80.463  1.00  48.86      A  N
ATOM  22283  CA   ASP  H  278    46.283  61.073  80.513  1.00  47.99      A  C
ATOM  22284  CB   ASP  H  278    45.996  59.705  81.049  1.00  47.81      A  C
ATOM  22285  CG   ASP  H  278    47.212  58.930  81.296  1.00  49.59      A  C
ATOM  22286  OD1  ASP  H  278    48.028  58.788  80.396  1.00  49.07      A  O
ATOM  22287  OD2  ASP  H  278    47.348  58.444  82.399  1.00  50.66      A  O-1
ATOM  22288  C    ASP  H  278    46.906  60.926  79.154  1.00  48.04      A  C
ATOM  22289  O    ASP  H  278    46.819  59.902  78.557  1.00  45.31      A  O
ATOM  22290  N    PRO  H  279    47.591  61.946  78.700  1.00  49.24      A  N
ATOM  22291  CA   PRO  H  279    48.122  62.025  77.352  1.00  50.24      A  C
ATOM  22292  CB   PRO  H  279    48.813  63.369  77.346  1.00  49.89      A  C
ATOM  22293  CG   PRO  H  279    48.838  63.792  78.700  1.00  49.10      A  C
ATOM  22294  CD   PRO  H  279    47.688  63.236  79.360  1.00  49.45      A  C
ATOM  22295  C    PRO  H  279    49.115  60.936  77.062  1.00  51.62      A  C
ATOM  22296  O    PRO  H  279    49.311  60.542  75.940  1.00  52.05      A  O
ATOM  22297  N    ALA  H  280    49.751  60.458  78.098  1.00  52.61      A  N
ATOM  22298  CA   ALA  H  280    50.692  59.389  77.963  1.00  53.64      A  C
ATOM  22299  CB   ALA  H  280    51.345  59.148  79.272  1.00  53.56      A  C
ATOM  22300  C    ALA  H  280    50.008  58.141  77.493  1.00  53.50      A  C
ATOM  22301  O    ALA  H  280    50.522  57.440  76.674  1.00  54.54      A  O
ATOM  22302  N    PHE  H  281    48.840  57.868  78.042  1.00  53.27      A  N
ATOM  22303  CA   PHE  H  281    48.048  56.707  77.686  1.00  52.38      A  C
ATOM  22304  CB   PHE  H  281    46.818  56.735  78.552  1.00  52.37      A  C
ATOM  22305  CG   PHE  H  281    45.869  55.602  78.366  1.00  52.31      A  C
ATOM  22306  CD1  PHE  H  281    45.762  54.635  79.312  1.00  50.34      A  C
ATOM  22307  CE1  PHE  H  281    44.878  53.642  79.178  1.00  51.65      A  C
ATOM  22308  CZ   PHE  H  281    44.045  53.611  78.121  1.00  52.31      A  C
ATOM  22309  CE2  PHE  H  281    44.105  54.573  77.191  1.00  51.34      A  C
ATOM  22310  CD2  PHE  H  281    45.001  55.566  77.312  1.00  53.02      A  C
ATOM  22311  C    PHE  H  281    47.636  56.747  76.262  1.00  52.55      A  C
ATOM  22312  O    PHE  H  281    47.740  55.791  75.576  1.00  53.14      A  O
ATOM  22313  N    SER  H  282    47.134  57.855  75.790  1.00  52.30      A  N
ATOM  22314  CA   SER  H  282    46.815  57.931  74.393  1.00  52.07      A  C
ATOM  22315  CB   SER  H  282    45.911  59.086  74.101  1.00  52.24      A  C
ATOM  22316  OG   SER  H  282    44.695  58.824  74.710  1.00  51.68      A  O
ATOM  22317  C    SER  H  282    48.017  57.900  73.497  1.00  52.47      A  C
```

Appendix 1

```
ATOM  22318  O    SER H 282      47.955  57.442  72.383  1.00  51.92      A    O
ATOM  22319  N    GLU H 283      49.104  58.451  73.997  1.00  53.08      A    N
ATOM  22320  CA   GLU H 283      50.349  58.510  73.271  1.00  53.24      A    C
ATOM  22321  CB   GLU H 283      51.336  59.396  74.001  1.00  54.43      A    C
ATOM  22322  CG   GLU H 283      51.557  60.753  73.373  1.00  55.74      A    C
ATOM  22323  CD   GLU H 283      52.015  61.774  74.371  1.00  62.67      A    C
ATOM  22324  OE1  GLU H 283      53.078  61.588  74.974  1.00  61.92      A    O
ATOM  22325  OE2  GLU H 283      51.314  62.773  74.566  1.00  65.06      A    O-1
ATOM  22326  C    GLU H 283      50.888  57.119  73.029  1.00  52.34      A    C
ATOM  22327  O    GLU H 283      51.462  56.844  71.998  1.00  51.32      A    O
ATOM  22328  N    ARG H 284      50.690  56.253  74.006  1.00  51.86      A    N
ATOM  22329  CA   ARG H 284      51.105  54.869  73.910  1.00  52.03      A    C
ATOM  22330  CB   ARG H 284      50.827  54.146  75.212  1.00  52.40      A    C
ATOM  22331  CG   ARG H 284      51.883  53.191  75.639  1.00  57.23      A    C
ATOM  22332  CD   ARG H 284      51.329  51.939  76.257  1.00  61.85      A    C
ATOM  22333  NE   ARG H 284      51.390  50.859  75.295  1.00  66.92      A    N
ATOM  22334  CZ   ARG H 284      51.219  49.580  75.572  1.00  70.21      A    C
ATOM  22335  NH1  ARG H 284      50.986  49.186  76.807  1.00  72.18      A    N
ATOM  22336  NH2  ARG H 284      51.292  48.694  74.603  1.00  70.19      A    N
ATOM  22337  C    ARG H 284      50.419  54.100  72.842  1.00  50.72      A    C
ATOM  22338  O    ARG H 284      51.053  53.346  72.163  1.00  52.00      A    O
ATOM  22339  N    TYR H 285      49.114  54.259  72.696  1.00  48.68      A    N
ATOM  22340  CA   TYR H 285      48.394  53.451  71.739  1.00  46.26      A    C
ATOM  22341  CB   TYR H 285      47.107  52.903  72.335  1.00  44.85      A    C
ATOM  22342  CG   TYR H 285      47.251  52.178  73.633  1.00  39.47      A    C
ATOM  22343  CD1  TYR H 285      47.677  50.904  73.682  1.00  35.15      A    C
ATOM  22344  CE1  TYR H 285      47.794  50.263  74.847  1.00  33.81      A    C
ATOM  22345  CZ   TYR H 285      47.470  50.875  75.985  1.00  36.17      A    C
ATOM  22346  OH   TYR H 285      47.572  50.225  77.165  1.00  38.95      A    O
ATOM  22347  CE2  TYR H 285      47.021  52.125  75.962  1.00  38.33      A    C
ATOM  22348  CD2  TYR H 285      46.919  52.770  74.801  1.00  38.35      A    C
ATOM  22349  C    TYR H 285      48.116  54.057  70.385  1.00  46.94      A    C
ATOM  22350  O    TYR H 285      47.729  53.350  69.501  1.00  47.81      A    O
ATOM  22351  N    TYR H 286      48.330  55.348  70.203  1.00  46.37      A    N
ATOM  22352  CA   TYR H 286      47.886  56.002  68.986  1.00  46.01      A    C
ATOM  22353  CB   TYR H 286      48.117  57.516  69.062  1.00  45.43      A    C
ATOM  22354  CG   TYR H 286      47.751  58.315  67.826  1.00  42.69      A    C
ATOM  22355  CD1  TYR H 286      46.482  58.355  67.354  1.00  41.87      A    C
ATOM  22356  CE1  TYR H 286      46.164  59.069  66.288  1.00  39.31      A    C
ATOM  22357  CZ   TYR H 286      47.099  59.768  65.666  1.00  42.16      A    C
ATOM  22358  OH   TYR H 286      46.804  60.484  64.565  1.00  42.77      A    O
ATOM  22359  CE2  TYR H 286      48.353  59.763  66.108  1.00  42.35      A    C
ATOM  22360  CD2  TYR H 286      48.672  59.052  67.180  1.00  43.13      A    C
ATOM  22361  C    TYR H 286      48.536  55.424  67.758  1.00  47.00      A    C
ATOM  22362  O    TYR H 286      47.910  55.245  66.766  1.00  47.29      A    O
ATOM  22363  N    PRO H 287      49.815  55.164  67.802  1.00  47.60      A    N
ATOM  22364  CA   PRO H 287      50.480  54.591  66.640  1.00  48.25      A    C
ATOM  22365  CB   PRO H 287      51.931  54.572  67.063  1.00  47.65      A    C
ATOM  22366  CG   PRO H 287      51.969  55.289  68.342  1.00  47.96      A    C
ATOM  22367  CD   PRO H 287      50.698  55.195  68.959  1.00  47.08      A    C
ATOM  22368  C    PRO H 287      50.003  53.194  66.290  1.00  48.78      A    C
ATOM  22369  O    PRO H 287      49.875  52.874  65.138  1.00  48.60      A    O
ATOM  22370  N    ARG H 288      49.801  52.363  67.295  1.00  48.62      A    N
ATOM  22371  CA   ARG H 288      49.331  51.020  67.102  1.00  49.13      A    C
```

Appendix 1

```
ATOM  22372  CB   ARG H 288      49.319  50.269  68.411  1.00  50.18      A  C
ATOM  22373  CG   ARG H 288      50.574  49.525  68.709  1.00  54.81      A  C
ATOM  22374  CD   ARG H 288      50.727  49.294  70.180  1.00  61.08      A  C
ATOM  22375  NE   ARG H 288      52.098  48.961  70.519  1.00  68.96      A  N
ATOM  22376  CZ   ARG H 288      52.797  47.986  69.950  1.00  71.99      A  C
ATOM  22377  NH1  ARG H 288      52.249  47.239  69.013  1.00  70.41      A  N
ATOM  22378  NH2  ARG H 288      54.048  47.761  70.315  1.00  71.62      A  N
ATOM  22379  C    ARG H 288      47.954  51.070  66.532  1.00  47.83      A  C
ATOM  22380  O    ARG H 288      47.602  50.310  65.679  1.00  47.01      A  O
ATOM  22381  N    PHE H 289      47.165  51.999  67.006  1.00  46.74      A  N
ATOM  22382  CA   PHE H 289      45.830  52.127  66.510  1.00  45.84      A  C
ATOM  22383  CB   PHE H 289      45.068  53.165  67.320  1.00  44.84      A  C
ATOM  22384  CG   PHE H 289      43.970  53.810  66.584  1.00  42.02      A  C
ATOM  22385  CD1  PHE H 289      42.674  53.522  66.851  1.00  43.02      A  C
ATOM  22386  CE1  PHE H 289      41.684  54.105  66.159  1.00  41.30      A  C
ATOM  22387  CZ   PHE H 289      41.966  54.982  65.207  1.00  42.70      A  C
ATOM  22388  CE2  PHE H 289      43.241  55.289  64.937  1.00  43.88      A  C
ATOM  22389  CD2  PHE H 289      44.234  54.704  65.624  1.00  43.75      A  C
ATOM  22390  C    PHE H 289      45.825  52.449  65.033  1.00  46.54      A  C
ATOM  22391  O    PHE H 289      45.076  51.877  64.302  1.00  47.55      A  O
ATOM  22392  N    LYS H 290      46.686  53.331  64.572  1.00  46.88      A  N
ATOM  22393  CA   LYS H 290      46.693  53.703  63.178  1.00  47.54      A  C
ATOM  22394  CB   LYS H 290      47.741  54.758  62.926  1.00  48.72      A  C
ATOM  22395  CG   LYS H 290      47.407  56.145  63.352  1.00  50.30      A  C
ATOM  22396  CD   LYS H 290      48.658  56.932  63.615  1.00  54.13      A  C
ATOM  22397  CE   LYS H 290      48.959  57.915  62.530  1.00  56.28      A  C
ATOM  22398  NZ   LYS H 290      50.222  57.654  61.809  1.00  57.87      A  N
ATOM  22399  C    LYS H 290      47.000  52.524  62.305  1.00  47.27      A  C
ATOM  22400  O    LYS H 290      46.478  52.377  61.234  1.00  46.89      A  O
ATOM  22401  N    GLN H 291      47.895  51.693  62.766  1.00  47.35      A  N
ATOM  22402  CA   GLN H 291      48.249  50.518  62.028  1.00  48.09      A  C
ATOM  22403  CB   GLN H 291      49.395  49.806  62.729  1.00  48.93      A  C
ATOM  22404  CG   GLN H 291      49.807  48.540  62.088  1.00  54.06      A  C
ATOM  22405  CD   GLN H 291      51.168  48.632  61.507  1.00  62.17      A  C
ATOM  22406  OE1  GLN H 291      51.988  49.391  61.993  1.00  66.56      A  O
ATOM  22407  NE2  GLN H 291      51.430  47.864  60.457  1.00  59.66      A  N
ATOM  22408  C    GLN H 291      47.078  49.588  61.919  1.00  46.69      A  C
ATOM  22409  O    GLN H 291      46.830  49.025  60.897  1.00  46.72      A  O
ATOM  22410  N    THR H 292      46.368  49.406  62.999  1.00  44.28      A  N
ATOM  22411  CA   THR H 292      45.285  48.494  62.957  1.00  43.23      A  C
ATOM  22412  CB   THR H 292      44.673  48.353  64.310  1.00  42.90      A  C
ATOM  22413  OG1  THR H 292      45.697  48.064  65.237  1.00  44.51      A  O
ATOM  22414  CG2  THR H 292      43.766  47.241  64.329  1.00  40.42      A  C
ATOM  22415  C    THR H 292      44.220  48.943  62.010  1.00  42.93      A  C
ATOM  22416  O    THR H 292      43.708  48.165  61.269  1.00  43.90      A  O
ATOM  22417  N    PHE H 293      43.874  50.209  62.052  1.00  41.25      A  N
ATOM  22418  CA   PHE H 293      42.658  50.666  61.431  1.00  39.06      A  C
ATOM  22419  CB   PHE H 293      41.824  51.372  62.476  1.00  37.81      A  C
ATOM  22420  CG   PHE H 293      41.268  50.477  63.509  1.00  35.21      A  C
ATOM  22421  CD1  PHE H 293      40.565  49.358  63.170  1.00  32.58      A  C
ATOM  22422  CE1  PHE H 293      40.058  48.563  64.116  1.00  30.08      A  C
ATOM  22423  CZ   PHE H 293      40.232  48.867  65.412  1.00  32.96      A  C
ATOM  22424  CE2  PHE H 293      40.915  49.963  65.768  1.00  29.99      A  C
ATOM  22425  CD2  PHE H 293      41.420  50.768  64.823  1.00  33.82      A  C
```

Appendix 1

```
ATOM  22426  C    PHE H 293    42.755  51.517  60.201  1.00  39.14    A    C
ATOM  22427  O    PHE H 293    41.930  51.423  59.370  1.00  39.27    A    O
ATOM  22428  N    VAL H 294    43.758  52.364  60.101  1.00  39.34    A    N
ATOM  22429  CA   VAL H 294    43.793  53.446  59.118  1.00  38.85    A    C
ATOM  22430  CB   VAL H 294    44.603  54.625  59.657  1.00  38.56    A    C
ATOM  22431  CG1  VAL H 294    44.626  55.745  58.710  1.00  36.26    A    C
ATOM  22432  CG2  VAL H 294    44.129  55.046  60.992  1.00  36.05    A    C
ATOM  22433  C    VAL H 294    44.373  53.097  57.775  1.00  39.83    A    C
ATOM  22434  O    VAL H 294    45.414  52.542  57.709  1.00  39.65    A    O
ATOM  22435  N    GLU H 295    43.704  53.474  56.701  1.00  41.43    A    N
ATOM  22436  CA   GLU H 295    44.196  53.207  55.370  1.00  42.44    A    C
ATOM  22437  CB   GLU H 295    43.089  52.568  54.542  1.00  42.67    A    C
ATOM  22438  CG   GLU H 295    43.562  51.654  53.440  1.00  45.55    A    C
ATOM  22439  CD   GLU H 295    42.608  51.498  52.269  1.00  51.25    A    C
ATOM  22440  OE1  GLU H 295    41.396  51.544  52.439  1.00  49.68    A    O
ATOM  22441  OE2  GLU H 295    43.077  51.298  51.151  1.00  52.24    A    O-1
ATOM  22442  C    GLU H 295    44.597  54.457  54.639  1.00  42.61    A    C
ATOM  22443  O    GLU H 295    43.765  55.241  54.306  1.00  43.54    A    O
ATOM  22444  N    VAL H 296    45.860  54.609  54.295  1.00  41.60    A    N
ATOM  22445  CA   VAL H 296    46.252  55.675  53.402  1.00  41.44    A    C
ATOM  22446  CB   VAL H 296    47.660  56.042  53.620  1.00  41.89    A    C
ATOM  22447  CG1  VAL H 296    48.107  56.936  52.541  1.00  40.48    A    C
ATOM  22448  CG2  VAL H 296    47.809  56.680  54.926  1.00  39.20    A    C
ATOM  22449  C    VAL H 296    46.084  55.312  51.945  1.00  42.09    A    C
ATOM  22450  O    VAL H 296    46.417  54.252  51.558  1.00  43.17    A    O
ATOM  22451  N    TYR H 297    45.512  56.175  51.138  1.00  43.12    A    N
ATOM  22452  CA   TYR H 297    45.255  55.769  49.787  1.00  43.81    A    C
ATOM  22453  CB   TYR H 297    43.903  55.082  49.740  1.00  43.82    A    C
ATOM  22454  CG   TYR H 297    42.721  55.986  49.707  1.00  44.03    A    C
ATOM  22455  CD1  TYR H 297    42.145  56.311  48.526  1.00  44.00    A    C
ATOM  22456  CE1  TYR H 297    41.082  57.112  48.465  1.00  46.86    A    C
ATOM  22457  CZ   TYR H 297    40.534  57.602  49.599  1.00  48.57    A    C
ATOM  22458  OH   TYR H 297    39.448  58.413  49.502  1.00  46.44    A    O
ATOM  22459  CE2  TYR H 297    41.076  57.279  50.802  1.00  48.14    A    C
ATOM  22460  CD2  TYR H 297    42.168  56.475  50.849  1.00  44.73    A    C
ATOM  22461  C    TYR H 297    45.476  56.682  48.573  1.00  45.87    A    C
ATOM  22462  O    TYR H 297    45.621  56.209  47.488  1.00  46.14    A    O
ATOM  22463  N    ASP H 298    45.424  57.977  48.658  1.00  48.58    A    N
ATOM  22464  CA   ASP H 298    45.612  58.624  47.373  1.00  51.86    A    C
ATOM  22465  CB   ASP H 298    44.680  59.804  47.181  1.00  52.41    A    C
ATOM  22466  CG   ASP H 298    44.386  60.041  45.763  1.00  54.59    A    C
ATOM  22467  OD1  ASP H 298    44.894  59.287  44.950  1.00  55.52    A    O
ATOM  22468  OD2  ASP H 298    43.670  60.976  45.447  1.00  58.08    A    O
ATOM  22469  C    ASP H 298    47.045  59.004  47.076  1.00  52.69    A    C
ATOM  22470  O    ASP H 298    47.355  60.166  46.946  1.00  53.17    A    O
ATOM  22471  N    GLU H 299    47.921  58.023  46.983  1.00  52.97    A    N
ATOM  22472  CA   GLU H 299    49.320  58.305  46.824  1.00  53.13    A    C
ATOM  22473  CB   GLU H 299    49.593  59.046  45.549  1.00  53.82    A    C
ATOM  22474  CG   GLU H 299    49.226  58.302  44.342  1.00  57.67    A    C
ATOM  22475  CD   GLU H 299    50.140  58.609  43.247  1.00  66.83    A    C
ATOM  22476  OE1  GLU H 299    51.324  58.839  43.544  1.00  70.78    A    O
ATOM  22477  OE2  GLU H 299    49.697  58.648  42.092  1.00  68.91    A    O
ATOM  22478  C    GLU H 299    49.661  59.177  47.955  1.00  51.89    A    C
ATOM  22479  O    GLU H 299    50.334  60.165  47.795  1.00  51.61    A    O
```

Appendix 1

```
ATOM  22480  N    GLY H 300      49.158  58.799  49.109  1.00  50.42      A    N
ATOM  22481  CA   GLY H 300      49.476  59.422  50.364  1.00  47.24      A    C
ATOM  22482  C    GLY H 300      48.587  60.566  50.737  1.00  45.66      A    C
ATOM  22483  O    GLY H 300      48.641  61.061  51.833  1.00  44.69      A    O
ATOM  22484  N    ARG H 301      47.735  60.980  49.839  1.00  44.26      A    N
ATOM  22485  CA   ARG H 301      46.939  62.132  50.135  1.00  44.25      A    C
ATOM  22486  CB   ARG H 301      46.916  63.071  48.957  1.00  44.13      A    C
ATOM  22487  CG   ARG H 301      46.624  62.448  47.678  1.00  45.60      A    C
ATOM  22488  CD   ARG H 301      46.779  63.453  46.618  1.00  49.81      A    C
ATOM  22489  NE   ARG H 301      46.597  62.867  45.313  1.00  55.20      A    N
ATOM  22490  CZ   ARG H 301      47.491  62.940  44.353  1.00  57.42      A    C
ATOM  22491  NH1  ARG H 301      48.617  63.583  44.545  1.00  58.32      A    N
ATOM  22492  NH2  ARG H 301      47.248  62.389  43.199  1.00  58.99      A    N
ATOM  22493  C    ARG H 301      45.539  61.921  50.688  1.00  43.63      A    C
ATOM  22494  O    ARG H 301      44.809  62.844  50.777  1.00  44.51      A    O
ATOM  22495  N    LYS H 302      45.171  60.714  51.062  1.00  42.80      A    N
ATOM  22496  CA   LYS H 302      43.870  60.460  51.624  1.00  41.53      A    C
ATOM  22497  CB   LYS H 302      42.867  60.166  50.536  1.00  41.83      A    C
ATOM  22498  CG   LYS H 302      42.489  61.344  49.706  1.00  41.84      A    C
ATOM  22499  CD   LYS H 302      41.651  60.955  48.527  1.00  39.78      A    C
ATOM  22500  CE   LYS H 302      41.217  62.134  47.770  1.00  40.98      A    C
ATOM  22501  NZ   LYS H 302      40.328  61.788  46.670  1.00  45.25      A    N
ATOM  22502  C    LYS H 302      43.918  59.335  52.612  1.00  41.02      A    C
ATOM  22503  O    LYS H 302      44.862  58.618  52.680  1.00  41.84      A    O
ATOM  22504  N    ALA H 303      42.896  59.202  53.413  1.00  39.87      A    N
ATOM  22505  CA   ALA H 303      42.863  58.155  54.392  1.00  38.29      A    C
ATOM  22506  CB   ALA H 303      43.523  58.612  55.594  1.00  37.00      A    C
ATOM  22507  C    ALA H 303      41.443  57.802  54.694  1.00  38.22      A    C
ATOM  22508  O    ALA H 303      40.596  58.636  54.613  1.00  38.89      A    O
ATOM  22509  N    ARG H 304      41.191  56.556  55.056  1.00  37.89      A    N
ATOM  22510  CA   ARG H 304      39.885  56.104  55.502  1.00  36.07      A    C
ATOM  22511  CB   ARG H 304      39.078  55.578  54.329  1.00  34.67      A    C
ATOM  22512  CG   ARG H 304      39.811  54.623  53.461  1.00  35.13      A    C
ATOM  22513  CD   ARG H 304      39.114  54.392  52.173  1.00  37.04      A    C
ATOM  22514  NE   ARG H 304      39.828  53.460  51.314  1.00  42.94      A    N
ATOM  22515  CZ   ARG H 304      39.865  53.521  49.992  1.00  45.14      A    C
ATOM  22516  NH1  ARG H 304      39.225  54.457  49.357  1.00  44.33      A    N
ATOM  22517  NH2  ARG H 304      40.529  52.636  49.296  1.00  44.96      A    N
ATOM  22518  C    ARG H 304      40.111  55.043  56.562  1.00  36.21      A    C
ATOM  22519  O    ARG H 304      41.098  54.388  56.529  1.00  38.23      A    O
ATOM  22520  N    VAL H 305      39.212  54.887  57.512  1.00  34.41      A    N
ATOM  22521  CA   VAL H 305      39.426  53.996  58.625  1.00  33.21      A    C
ATOM  22522  CB   VAL H 305      39.232  54.754  59.938  1.00  33.71      A    C
ATOM  22523  CG1  VAL H 305      39.931  54.118  61.070  1.00  28.64      A    C
ATOM  22524  CG2  VAL H 305      39.680  56.131  59.781  1.00  34.94      A    C
ATOM  22525  C    VAL H 305      38.519  52.782  58.614  1.00  34.00      A    C
ATOM  22526  O    VAL H 305      37.340  52.900  58.501  1.00  34.77      A    O
ATOM  22527  N    ARG H 306      39.083  51.601  58.733  1.00  33.83      A    N
ATOM  22528  CA   ARG H 306      38.295  50.399  58.924  1.00  34.20      A    C
ATOM  22529  CB   ARG H 306      39.175  49.168  58.737  1.00  34.35      A    C
ATOM  22530  CG   ARG H 306      39.716  49.010  57.333  1.00  35.44      A    C
ATOM  22531  CD   ARG H 306      40.659  47.835  57.128  1.00  33.52      A    C
ATOM  22532  NE   ARG H 306      41.816  47.895  57.982  1.00  32.88      A    N
ATOM  22533  CZ   ARG H 306      42.936  48.508  57.662  1.00  35.86      A    C
```

Appendix 1

```
ATOM  22534  NH1 ARG H 306     43.048  49.087  56.500  1.00  29.72      A  N
ATOM  22535  NH2 ARG H 306     43.939  48.533  58.505  1.00  31.03      A  N
ATOM  22536  C   ARG H 306     37.679  50.401  60.303  1.00  33.55      A  C
ATOM  22537  O   ARG H 306     38.306  50.794  61.223  1.00  32.06      A  O
ATOM  22538  N   GLU H 307     36.413  50.044  60.424  1.00  34.70      A  N
ATOM  22539  CA  GLU H 307     35.739  49.953  61.721  1.00  34.64      A  C
ATOM  22540  CB  GLU H 307     34.226  49.938  61.613  1.00  34.56      A  C
ATOM  22541  CG  GLU H 307     33.486  49.546  62.886  1.00  36.51      A  C
ATOM  22542  CD  GLU H 307     33.666  50.503  64.038  1.00  41.01      A  C
ATOM  22543  OE1 GLU H 307     34.091  51.617  63.805  1.00  46.78      A  O
ATOM  22544  OE2 GLU H 307     33.389  50.152  65.173  1.00  34.66      A  O
ATOM  22545  C   GLU H 307     36.216  48.858  62.608  1.00  34.56      A  C
ATOM  22546  O   GLU H 307     36.252  48.995  63.777  1.00  33.32      A  O
ATOM  22547  N   THR H 308     36.569  47.753  62.013  1.00  35.61      A  N
ATOM  22548  CA  THR H 308     36.902  46.597  62.772  1.00  37.92      A  C
ATOM  22549  CB  THR H 308     35.697  45.757  63.098  1.00  38.22      A  C
ATOM  22550  OG1 THR H 308     36.134  44.579  63.744  1.00  40.31      A  O
ATOM  22551  CG2 THR H 308     34.950  45.371  61.874  1.00  35.97      A  C
ATOM  22552  C   THR H 308     37.962  45.743  62.155  1.00  39.88      A  C
ATOM  22553  O   THR H 308     38.458  46.006  61.095  1.00  40.48      A  O
ATOM  22554  N   ALA H 309     38.290  44.708  62.893  1.00  42.41      A  N
ATOM  22555  CA  ALA H 309     39.447  43.859  62.719  1.00  43.93      A  C
ATOM  22556  CB  ALA H 309     39.652  43.039  63.934  1.00  44.82      A  C
ATOM  22557  C   ALA H 309     39.571  43.009  61.487  1.00  44.88      A  C
ATOM  22558  O   ALA H 309     40.653  42.706  61.081  1.00  47.31      A  O
ATOM  22559  N   GLY H 310     38.496  42.548  60.910  1.00  44.49      A  N
ATOM  22560  CA  GLY H 310     38.655  41.520  59.902  1.00  43.83      A  C
ATOM  22561  C   GLY H 310     38.420  41.825  58.448  1.00  44.12      A  C
ATOM  22562  O   GLY H 310     38.115  40.959  57.690  1.00  45.04      A  O
ATOM  22563  N   THR H 311     38.520  43.064  58.061  1.00  43.26      A  N
ATOM  22564  CA  THR H 311     37.926  43.486  56.841  1.00  42.71      A  C
ATOM  22565  CB  THR H 311     36.555  44.019  57.187  1.00  42.01      A  C
ATOM  22566  OG1 THR H 311     35.941  44.568  56.047  1.00  41.29      A  O
ATOM  22567  CG2 THR H 311     36.666  45.056  58.227  1.00  39.62      A  C
ATOM  22568  C   THR H 311     38.748  44.563  56.168  1.00  43.59      A  C
ATOM  22569  O   THR H 311     39.489  45.244  56.800  1.00  42.48      A  O
ATOM  22570  N   ASP H 312     38.620  44.706  54.866  1.00  45.47      A  N
ATOM  22571  CA  ASP H 312     39.168  45.859  54.198  1.00  46.98      A  C
ATOM  22572  CB  ASP H 312     39.735  45.513  52.841  1.00  47.11      A  C
ATOM  22573  CG  ASP H 312     40.716  44.401  52.862  1.00  51.76      A  C
ATOM  22574  OD1 ASP H 312     41.738  44.467  53.543  1.00  52.55      A  O
ATOM  22575  OD2 ASP H 312     40.485  43.454  52.111  1.00  57.12      A  O-1
ATOM  22576  C   ASP H 312     38.134  46.947  53.965  1.00  46.73      A  C
ATOM  22577  O   ASP H 312     38.461  47.963  53.470  1.00  47.25      A  O
ATOM  22578  N   ASP H 313     36.880  46.735  54.272  1.00  46.43      A  N
ATOM  22579  CA  ASP H 313     35.917  47.782  54.056  1.00  47.36      A  C
ATOM  22580  CB  ASP H 313     34.490  47.256  54.209  1.00  46.85      A  C
ATOM  22581  CG  ASP H 313     34.183  46.058  53.344  1.00  47.52      A  C
ATOM  22582  OD1 ASP H 313     34.021  44.980  53.882  1.00  50.02      A  O
ATOM  22583  OD2 ASP H 313     34.014  46.174  52.143  1.00  50.60      A  O-1
ATOM  22584  C   ASP H 313     36.159  48.933  55.031  1.00  47.64      A  C
ATOM  22585  O   ASP H 313     36.391  48.709  56.194  1.00  47.49      A  O
ATOM  22586  N   ALA H 314     36.076  50.164  54.552  1.00  47.87      A  N
ATOM  22587  CA  ALA H 314     36.384  51.320  55.368  1.00  49.49      A  C
```

Appendix 1

```
ATOM  22588  CB   ALA H 314      36.472  52.550  54.540  1.00  48.75      A  C
ATOM  22589  C    ALA H 314      35.406  51.538  56.490  1.00  50.40      A  C
ATOM  22590  O    ALA H 314      35.272  50.693  57.344  1.00  53.13      A  O
ATOM  22591  N    ASP H 315      34.726  52.661  56.537  1.00  49.39      A  N
ATOM  22592  CA   ASP H 315      33.868  52.850  57.659  1.00  47.94      A  C
ATOM  22593  CB   ASP H 315      33.220  54.186  57.647  1.00  48.04      A  C
ATOM  22594  CG   ASP H 315      34.198  55.263  57.614  1.00  46.92      A  C
ATOM  22595  OD1  ASP H 315      34.509  55.802  58.659  1.00  46.38      A  O
ATOM  22596  OD2  ASP H 315      34.674  55.575  56.536  1.00  46.85      A  O
ATOM  22597  C    ASP H 315      32.917  51.791  57.386  1.00  48.07      A  C
ATOM  22598  O    ASP H 315      32.842  51.352  56.269  1.00  49.66      A  O
ATOM  22599  N    GLY H 316      32.273  51.311  58.427  1.00  45.59      A  N
ATOM  22600  CA   GLY H 316      31.512  50.104  58.421  1.00  42.96      A  C
ATOM  22601  C    GLY H 316      30.847  50.221  59.733  1.00  42.33      A  C
ATOM  22602  O    GLY H 316      31.152  51.133  60.425  1.00  42.59      A  O
ATOM  22603  N    GLY H 317      29.965  49.314  60.093  1.00  41.92      A  N
ATOM  22604  CA   GLY H 317      29.269  49.391  61.352  1.00  40.64      A  C
ATOM  22605  C    GLY H 317      28.397  50.609  61.510  1.00  40.66      A  C
ATOM  22606  O    GLY H 317      27.529  50.884  60.742  1.00  39.69      A  O
ATOM  22607  N    VAL H 318      28.666  51.353  62.548  1.00  40.85      A  N
ATOM  22608  CA   VAL H 318      28.039  52.626  62.791  1.00  40.63      A  C
ATOM  22609  CB   VAL H 318      28.416  53.080  64.152  1.00  41.08      A  C
ATOM  22610  CG1  VAL H 318      29.485  54.039  64.104  1.00  41.56      A  C
ATOM  22611  CG2  VAL H 318      27.265  53.559  64.857  1.00  42.57      A  C
ATOM  22612  C    VAL H 318      28.361  53.693  61.730  1.00  39.80      A  C
ATOM  22613  O    VAL H 318      27.621  54.610  61.539  1.00  39.45      A  O
ATOM  22614  N    GLY H 319      29.452  53.527  61.009  1.00  39.49      A  N
ATOM  22615  CA   GLY H 319      29.850  54.432  59.953  1.00  37.95      A  C
ATOM  22616  C    GLY H 319      30.680  55.648  60.292  1.00  37.01      A  C
ATOM  22617  O    GLY H 319      30.870  56.502  59.476  1.00  38.09      A  O
ATOM  22618  N    LEU H 320      31.155  55.718  61.509  1.00  35.26      A  N
ATOM  22619  CA   LEU H 320      31.783  56.894  62.028  1.00  34.54      A  C
ATOM  22620  CB   LEU H 320      31.107  57.243  63.319  1.00  34.82      A  C
ATOM  22621  CG   LEU H 320      29.664  57.603  63.142  1.00  35.21      A  C
ATOM  22622  CD1  LEU H 320      29.050  57.758  64.441  1.00  34.51      A  C
ATOM  22623  CD2  LEU H 320      29.641  58.833  62.440  1.00  32.63      A  C
ATOM  22624  C    LEU H 320      33.265  56.867  62.289  1.00  34.40      A  C
ATOM  22625  O    LEU H 320      33.775  57.786  62.832  1.00  34.81      A  O
ATOM  22626  N    ALA H 321      33.957  55.819  61.907  1.00  34.51      A  N
ATOM  22627  CA   ALA H 321      35.358  55.679  62.245  1.00  34.62      A  C
ATOM  22628  CB   ALA H 321      35.835  54.365  61.826  1.00  33.23      A  C
ATOM  22629  C    ALA H 321      36.270  56.739  61.678  1.00  35.17      A  C
ATOM  22630  O    ALA H 321      37.119  57.249  62.357  1.00  35.24      A  O
ATOM  22631  N    SER H 322      36.099  57.075  60.431  1.00  34.66      A  N
ATOM  22632  CA   SER H 322      36.908  58.130  59.921  1.00  35.47      A  C
ATOM  22633  CB   SER H 322      36.704  58.224  58.426  1.00  35.02      A  C
ATOM  22634  OG   SER H 322      36.797  56.959  57.880  1.00  34.84      A  O
ATOM  22635  C    SER H 322      36.670  59.475  60.609  1.00  35.73      A  C
ATOM  22636  O    SER H 322      37.590  60.162  60.959  1.00  36.03      A  O
ATOM  22637  N    ALA H 323      35.431  59.843  60.821  1.00  35.50      A  N
ATOM  22638  CA   ALA H 323      35.114  61.090  61.469  1.00  35.91      A  C
ATOM  22639  CB   ALA H 323      33.682  61.284  61.465  1.00  36.68      A  C
ATOM  22640  C    ALA H 323      35.602  61.190  62.877  1.00  35.96      A  C
ATOM  22641  O    ALA H 323      36.002  62.223  63.316  1.00  36.23      A  O
```

Appendix 1

```
ATOM  22642  N   PHE H 324    35.496  60.134  63.639  1.00  35.67    A  N
ATOM  22643  CA  PHE H 324    36.022  60.161  64.983  1.00  35.73    A  C
ATOM  22644  CB  PHE H 324    35.480  59.028  65.811  1.00  35.90    A  C
ATOM  22645  CG  PHE H 324    34.222  59.359  66.522  1.00  36.90    A  C
ATOM  22646  CD1 PHE H 324    34.195  60.301  67.482  1.00  39.78    A  C
ATOM  22647  CE1 PHE H 324    33.064  60.593  68.112  1.00  39.66    A  C
ATOM  22648  CZ  PHE H 324    31.956  59.965  67.803  1.00  37.78    A  C
ATOM  22649  CE2 PHE H 324    31.954  59.050  66.857  1.00  38.62    A  C
ATOM  22650  CD2 PHE H 324    33.071  58.737  66.219  1.00  37.88    A  C
ATOM  22651  C   PHE H 324    37.524  60.227  65.005  1.00  36.28    A  C
ATOM  22652  O   PHE H 324    38.114  60.729  65.901  1.00  35.69    A  O
ATOM  22653  N   THR H 325    38.113  59.633  63.999  1.00  37.23    A  N
ATOM  22654  CA  THR H 325    39.526  59.658  63.763  1.00  37.35    A  C
ATOM  22655  CB  THR H 325    39.885  58.639  62.784  1.00  36.38    A  C
ATOM  22656  OG1 THR H 325    39.314  57.436  63.239  1.00  37.71    A  O
ATOM  22657  CG2 THR H 325    41.331  58.477  62.748  1.00  35.31    A  C
ATOM  22658  C   THR H 325    40.077  61.015  63.409  1.00  38.02    A  C
ATOM  22659  O   THR H 325    41.146  61.358  63.806  1.00  38.97    A  O
ATOM  22660  N   LEU H 326    39.316  61.784  62.667  1.00  37.50    A  N
ATOM  22661  CA  LEU H 326    39.688  63.121  62.347  1.00  37.07    A  C
ATOM  22662  CB  LEU H 326    38.621  63.762  61.507  1.00  36.47    A  C
ATOM  22663  CG  LEU H 326    38.856  65.163  60.991  1.00  37.95    A  C
ATOM  22664  CD1 LEU H 326    39.604  65.176  59.728  1.00  37.72    A  C
ATOM  22665  CD2 LEU H 326    37.563  65.826  60.800  1.00  36.17    A  C
ATOM  22666  C   LEU H 326    39.799  63.836  63.641  1.00  37.07    A  C
ATOM  22667  O   LEU H 326    40.673  64.618  63.810  1.00  36.87    A  O
ATOM  22668  N   LEU H 327    38.908  63.549  64.566  1.00  37.00    A  N
ATOM  22669  CA  LEU H 327    39.005  64.106  65.884  1.00  37.13    A  C
ATOM  22670  CB  LEU H 327    37.717  63.887  66.660  1.00  35.24    A  C
ATOM  22671  CG  LEU H 327    37.636  64.412  68.084  1.00  33.61    A  C
ATOM  22672  CD1 LEU H 327    37.659  65.841  68.174  1.00  26.11    A  C
ATOM  22673  CD2 LEU H 327    36.452  63.925  68.738  1.00  30.76    A  C
ATOM  22674  C   LEU H 327    40.226  63.646  66.666  1.00  38.57    A  C
ATOM  22675  O   LEU H 327    40.851  64.420  67.338  1.00  38.98    A  O
ATOM  22676  N   LEU H 328    40.557  62.379  66.584  1.00  38.89    A  N
ATOM  22677  CA  LEU H 328    41.679  61.872  67.316  1.00  38.47    A  C
ATOM  22678  CB  LEU H 328    41.795  60.383  67.124  1.00  37.92    A  C
ATOM  22679  CG  LEU H 328    42.862  59.697  67.940  1.00  35.73    A  C
ATOM  22680  CD1 LEU H 328    42.624  59.834  69.367  1.00  31.76    A  C
ATOM  22681  CD2 LEU H 328    42.909  58.303  67.580  1.00  37.19    A  C
ATOM  22682  C   LEU H 328    42.940  62.518  66.855  1.00  39.40    A  C
ATOM  22683  O   LEU H 328    43.769  62.839  67.637  1.00  39.83    A  O
ATOM  22684  N   ALA H 329    43.084  62.666  65.560  1.00  39.48    A  N
ATOM  22685  CA  ALA H 329    44.235  63.280  64.981  1.00  39.69    A  C
ATOM  22686  CB  ALA H 329    44.186  63.146  63.518  1.00  38.64    A  C
ATOM  22687  C   ALA H 329    44.365  64.725  65.374  1.00  40.75    A  C
ATOM  22688  O   ALA H 329    45.431  65.204  65.628  1.00  41.94    A  O
ATOM  22689  N   ARG H 330    43.267  65.426  65.432  1.00  40.83    A  N
ATOM  22690  CA  ARG H 330    43.317  66.787  65.850  1.00  41.50    A  C
ATOM  22691  CB  ARG H 330    41.921  67.369  65.741  1.00  41.60    A  C
ATOM  22692  CG  ARG H 330    41.822  68.820  65.934  1.00  41.52    A  C
ATOM  22693  CD  ARG H 330    42.596  69.554  64.917  1.00  42.45    A  C
ATOM  22694  NE  ARG H 330    42.061  70.873  64.729  1.00  48.68    A  N
ATOM  22695  CZ  ARG H 330    42.549  71.958  65.291  1.00  48.86    A  C
```

Appendix 1

```
ATOM  22696  NH1  ARG  H  330   43.600  71.896  66.064  1.00  48.12   A  N
ATOM  22697  NH2  ARG  H  330   41.982  73.105  65.079  1.00  48.25   A  N
ATOM  22698  C    ARG  H  330   43.816  66.899  67.268  1.00  41.88   A  C
ATOM  22699  O    ARG  H  330   44.669  67.679  67.547  1.00  41.98   A  O
ATOM  22700  N    GLU  H  331   43.299  66.097  68.162  1.00  42.96   A  N
ATOM  22701  CA   GLU  H  331   43.722  66.119  69.530  1.00  45.26   A  C
ATOM  22702  CB   GLU  H  331   42.905  65.127  70.296  1.00  44.77   A  C
ATOM  22703  CG   GLU  H  331   43.439  64.838  71.611  1.00  48.19   A  C
ATOM  22704  CD   GLU  H  331   43.000  65.834  72.613  1.00  56.47   A  C
ATOM  22705  OE1  GLU  H  331   41.984  66.464  72.383  1.00  58.43   A  O
ATOM  22706  OE2  GLU  H  331   43.654  65.999  73.641  1.00  57.69   A  O-1
ATOM  22707  C    GLU  H  331   45.173  65.746  69.653  1.00  47.11   A  C
ATOM  22708  O    GLU  H  331   45.905  66.268  70.453  1.00  48.11   A  O
ATOM  22709  N    MET  H  332   45.573  64.808  68.833  1.00  48.23   A  N
ATOM  22710  CA   MET  H  332   46.928  64.310  68.795  1.00  49.81   A  C
ATOM  22711  CB   MET  H  332   46.962  62.933  68.147  1.00  49.90   H  C
ATOM  22712  CG   MET  H  332   47.361  61.857  69.098  1.00  50.59   H  C
ATOM  22713  SD   MET  H  332   46.407  61.825  70.578  1.00  50.65   H  S
ATOM  22714  CE   MET  H  332   47.428  60.829  71.559  1.00  53.42   H  C
ATOM  22715  C    MET  H  332   47.988  65.233  68.209  1.00  50.19   A  C
ATOM  22716  O    MET  H  332   49.148  65.070  68.468  1.00  50.50   A  O
ATOM  22717  N    GLY  H  333   47.576  66.192  67.411  1.00  50.01   A  N
ATOM  22718  CA   GLY  H  333   48.479  67.027  66.671  1.00  49.74   A  C
ATOM  22719  C    GLY  H  333   48.848  66.506  65.317  1.00  49.71   A  C
ATOM  22720  O    GLY  H  333   49.646  67.079  64.639  1.00  49.86   A  O
ATOM  22721  N    ASP  H  334   48.206  65.444  64.894  1.00  49.62   A  N
ATOM  22722  CA   ASP  H  334   48.606  64.740  63.711  1.00  48.32   A  C
ATOM  22723  CB   ASP  H  334   48.067  63.331  63.815  1.00  48.73   A  C
ATOM  22724  CG   ASP  H  334   48.709  62.377  62.874  1.00  50.02   A  C
ATOM  22725  OD1  ASP  H  334   49.359  62.801  61.928  1.00  50.09   A  O
ATOM  22726  OD2  ASP  H  334   48.539  61.178  63.088  1.00  51.12   A  O-1
ATOM  22727  C    ASP  H  334   48.058  65.433  62.500  1.00  47.33   A  C
ATOM  22728  O    ASP  H  334   47.005  65.153  62.026  1.00  47.88   A  O
ATOM  22729  N    GLN  H  335   48.810  66.389  62.023  1.00  46.47   A  N
ATOM  22730  CA   GLN  H  335   48.445  67.161  60.874  1.00  47.23   A  C
ATOM  22731  CB   GLN  H  335   49.367  68.343  60.699  1.00  48.23   A  C
ATOM  22732  CG   GLN  H  335   48.828  69.613  61.282  1.00  49.61   A  C
ATOM  22733  CD   GLN  H  335   49.637  70.799  60.955  1.00  48.20   A  C
ATOM  22734  OE1  GLN  H  335   50.275  71.370  61.805  1.00  44.89   A  O
ATOM  22735  NE2  GLN  H  335   49.611  71.183  59.714  1.00  47.21   A  N
ATOM  22736  C    GLN  H  335   48.377  66.384  59.608  1.00  47.33   A  C
ATOM  22737  O    GLN  H  335   47.619  66.720  58.739  1.00  45.85   A  O
ATOM  22738  N    GLN  H  336   49.225  65.392  59.448  1.00  47.32   A  N
ATOM  22739  CA   GLN  H  336   49.117  64.593  58.250  1.00  47.12   A  C
ATOM  22740  CB   GLN  H  336   50.349  63.738  58.089  1.00  47.17   A  C
ATOM  22741  CG   GLN  H  336   50.748  63.600  56.694  1.00  50.08   A  C
ATOM  22742  CD   GLN  H  336   51.709  62.506  56.502  1.00  55.43   A  C
ATOM  22743  OE1  GLN  H  336   52.341  62.408  55.467  1.00  58.17   A  O
ATOM  22744  NE2  GLN  H  336   51.842  61.666  57.492  1.00  53.38   A  N
ATOM  22745  C    GLN  H  336   47.881  63.724  58.108  1.00  45.74   A  C
ATOM  22746  O    GLN  H  336   47.259  63.718  57.097  1.00  45.25   A  O
ATOM  22747  N    LEU  H  337   47.557  62.972  59.134  1.00  44.54   A  N
ATOM  22748  CA   LEU  H  337   46.387  62.136  59.139  1.00  43.41   A  C
ATOM  22749  CB   LEU  H  337   46.342  61.391  60.442  1.00  43.68   A  C
```

Appendix 1

```
ATOM  22750  CG   LEU H 337      45.960  59.937  60.502  1.00 42.47      A    C
ATOM  22751  CD1  LEU H 337      45.329  59.668  61.809  1.00 40.37      A    C
ATOM  22752  CD2  LEU H 337      45.095  59.532  59.368  1.00 38.23      A    C
ATOM  22753  C    LEU H 337      45.140  62.963  59.036  1.00 42.80      A    C
ATOM  22754  O    LEU H 337      44.248  62.646  58.310  1.00 42.54      A    O
ATOM  22755  N    PHE H 338      45.105  64.052  59.768  1.00 40.74      A    N
ATOM  22756  CA   PHE H 338      43.943  64.883  59.793  1.00 38.73      A    C
ATOM  22757  CB   PHE H 338      44.181  66.045  60.759  1.00 38.37      A    C
ATOM  22758  CG   PHE H 338      43.143  67.100  60.705  1.00 38.22      A    C
ATOM  22759  CD1  PHE H 338      42.362  67.380  61.787  1.00 37.68      A    C
ATOM  22760  CE1  PHE H 338      41.414  68.331  61.722  1.00 33.37      A    C
ATOM  22761  CZ   PHE H 338      41.221  69.033  60.579  1.00 32.41      A    C
ATOM  22762  CE2  PHE H 338      41.972  68.779  59.504  1.00 35.82      A    C
ATOM  22763  CD2  PHE H 338      42.933  67.814  59.561  1.00 37.97      A    C
ATOM  22764  C    PHE H 338      43.692  65.376  58.399  1.00 37.71      A    C
ATOM  22765  O    PHE H 338      42.593  65.397  57.938  1.00 37.44      A    O
ATOM  22766  N    ASP H 339      44.731  65.781  57.724  1.00 37.06      A    N
ATOM  22767  CA   ASP H 339      44.607  66.241  56.379  1.00 37.21      A    C
ATOM  22768  CB   ASP H 339      45.909  66.860  55.927  1.00 37.65      A    C
ATOM  22769  CG   ASP H 339      45.792  67.549  54.624  1.00 40.67      A    C
ATOM  22770  OD1  ASP H 339      45.159  68.599  54.574  1.00 43.09      A    O
ATOM  22771  OD2  ASP H 339      46.342  67.047  53.650  1.00 43.13      A    O-1
ATOM  22772  C    ASP H 339      44.180  65.175  55.422  1.00 36.14      A    C
ATOM  22773  O    ASP H 339      43.442  65.408  54.534  1.00 35.50      A    O
ATOM  22774  N    GLN H 340      44.703  63.992  55.560  1.00 35.95      A    N
ATOM  22775  CA   GLN H 340      44.280  62.934  54.693  1.00 35.30      A    C
ATOM  22776  CB   GLN H 340      45.210  61.765  54.844  1.00 36.43      A    C
ATOM  22777  CG   GLN H 340      46.521  62.039  54.265  1.00 37.31      A    C
ATOM  22778  CD   GLN H 340      47.548  61.079  54.679  1.00 37.64      A    C
ATOM  22779  OE1  GLN H 340      47.640  60.732  55.823  1.00 40.06      A    O
ATOM  22780  NE2  GLN H 340      48.340  60.641  53.739  1.00 37.47      A    N
ATOM  22781  C    GLN H 340      42.846  62.522  54.898  1.00 34.54      A    C
ATOM  22782  O    GLN H 340      42.156  62.263  53.963  1.00 34.33      A    O
ATOM  22783  N    LEU H 341      42.412  62.444  56.138  1.00 32.57      A    N
ATOM  22784  CA   LEU H 341      41.049  62.110  56.438  1.00 32.20      A    C
ATOM  22785  CB   LEU H 341      40.884  61.896  57.932  1.00 31.34      A    C
ATOM  22786  CG   LEU H 341      41.590  60.709  58.524  1.00 27.28      A    C
ATOM  22787  CD1  LEU H 341      41.596  60.791  59.963  1.00 24.96      A    C
ATOM  22788  CD2  LEU H 341      40.949  59.488  58.068  1.00 25.70      A    C
ATOM  22789  C    LEU H 341      40.049  63.134  55.939  1.00 32.93      A    C
ATOM  22790  O    LEU H 341      39.077  62.792  55.371  1.00 32.10      A    O
ATOM  22791  N    LEU H 342      40.319  64.401  56.127  1.00 33.84      A    N
ATOM  22792  CA   LEU H 342      39.448  65.435  55.636  1.00 35.10      A    C
ATOM  22793  CB   LEU H 342      39.885  66.801  56.147  1.00 35.03      A    C
ATOM  22794  CG   LEU H 342      38.793  67.851  56.047  1.00 35.64      A    C
ATOM  22795  CD1  LEU H 342      37.601  67.482  56.826  1.00 32.67      A    C
ATOM  22796  CD2  LEU H 342      39.202  69.247  56.333  1.00 32.31      A    C
ATOM  22797  C    LEU H 342      39.290  65.419  54.120  1.00 36.49      A    C
ATOM  22798  O    LEU H 342      38.269  65.795  53.602  1.00 37.16      A    O
ATOM  22799  N    ASN H 343      40.338  65.041  53.427  1.00 37.56      A    N
ATOM  22800  CA   ASN H 343      40.317  64.877  51.998  1.00 38.42      A    C
ATOM  22801  CB   ASN H 343      41.707  64.677  51.443  1.00 38.06      A    C
ATOM  22802  CG   ASN H 343      42.498  65.917  51.445  1.00 40.89      A    C
ATOM  22803  OD1  ASN H 343      41.970  66.980  51.466  1.00 41.68      A    O
```

Appendix 1

```
ATOM  22804  ND2  ASN  H  343    43.787  65.782  51.447  1.00  41.28    A  N
ATOM  22805  C    ASN  H  343    39.444  63.761  51.545  1.00  38.73    A  C
ATOM  22806  O    ASN  H  343    38.862  63.828  50.510  1.00  39.33    A  O
ATOM  22807  N    HIS  H  344    39.442  62.679  52.284  1.00  38.79    A  N
ATOM  22808  CA   HIS  H  344    38.533  61.613  52.015  1.00  38.53    A  C
ATOM  22809  CB   HIS  H  344    38.951  60.459  52.875  1.00  39.89    A  C
ATOM  22810  CG   HIS  H  344    37.944  59.372  52.960  1.00  42.61    A  C
ATOM  22811  ND1  HIS  H  344    37.602  58.601  51.884  1.00  41.63    A  N
ATOM  22812  CE1  HIS  H  344    36.716  57.708  52.250  1.00  42.98    A  C
ATOM  22813  NE2  HIS  H  344    36.475  57.868  53.530  1.00  45.54    A  N
ATOM  22814  CD2  HIS  H  344    37.232  58.901  54.001  1.00  42.84    A  C
ATOM  22815  C    HIS  H  344    37.108  61.955  52.323  1.00  37.31    A  C
ATOM  22816  O    HIS  H  344    36.230  61.692  51.569  1.00  36.75    A  O
ATOM  22817  N    LEU  H  345    36.904  62.515  53.493  1.00  37.12    A  N
ATOM  22818  CA   LEU  H  345    35.604  62.882  53.966  1.00  36.53    A  C
ATOM  22819  CB   LEU  H  345    35.759  63.176  55.445  1.00  35.54    A  C
ATOM  22820  CG   LEU  H  345    35.391  62.145  56.487  1.00  35.40    A  C
ATOM  22821  CD1  LEU  H  345    35.093  60.875  55.915  1.00  34.08    A  C
ATOM  22822  CD2  LEU  H  345    36.375  61.991  57.547  1.00  38.31    A  C
ATOM  22823  C    LEU  H  345    34.889  64.059  53.343  1.00  36.96    A  C
ATOM  22824  O    LEU  H  345    33.763  63.951  52.959  1.00  37.32    A  O
ATOM  22825  N    GLU  H  346    35.506  65.217  53.328  1.00  36.87    A  N
ATOM  22826  CA   GLU  H  346    34.823  66.417  52.883  1.00  36.71    A  C
ATOM  22827  CB   GLU  H  346    35.502  67.656  53.449  1.00  37.28    A  C
ATOM  22828  CG   GLU  H  346    34.755  68.933  53.234  1.00  40.60    A  C
ATOM  22829  CD   GLU  H  346    35.282  70.082  54.012  1.00  42.38    A  C
ATOM  22830  OE1  GLU  H  346    36.320  69.997  54.640  1.00  45.62    A  O
ATOM  22831  OE2  GLU  H  346    34.643  71.107  54.008  1.00  49.39    A  O-1
ATOM  22832  C    GLU  H  346    34.447  66.593  51.409  1.00  36.38    A  C
ATOM  22833  O    GLU  H  346    33.380  67.006  51.100  1.00  37.48    A  O
ATOM  22834  N    PRO  H  347    35.299  66.289  50.473  1.00  36.58    A  N
ATOM  22835  CA   PRO  H  347    34.986  66.653  49.108  1.00  36.59    A  C
ATOM  22836  CB   PRO  H  347    36.219  66.208  48.396  1.00  34.60    A  C
ATOM  22837  CG   PRO  H  347    37.228  66.591  49.326  1.00  36.38    A  C
ATOM  22838  CD   PRO  H  347    36.740  66.341  50.675  1.00  36.40    A  C
ATOM  22839  C    PRO  H  347    33.750  66.015  48.526  1.00  37.98    A  C
ATOM  22840  O    PRO  H  347    32.989  66.636  47.843  1.00  38.93    A  O
ATOM  22841  N    PRO  H  348    33.552  64.764  48.835  1.00  39.05    A  N
ATOM  22842  CA   PRO  H  348    32.405  63.993  48.408  1.00  39.42    A  C
ATOM  22843  CB   PRO  H  348    32.728  62.646  48.985  1.00  39.99    A  C
ATOM  22844  CG   PRO  H  348    34.113  62.582  48.909  1.00  40.82    A  C
ATOM  22845  CD   PRO  H  348    34.668  63.890  49.156  1.00  39.11    A  C
ATOM  22846  C    PRO  H  348    31.102  64.509  48.969  1.00  38.96    A  C
ATOM  22847  O    PRO  H  348    30.063  64.372  48.382  1.00  39.41    A  O
ATOM  22848  N    ALA  H  349    31.202  65.149  50.106  1.00  37.83    A  N
ATOM  22849  CA   ALA  H  349    30.061  65.609  50.824  1.00  37.81    A  C
ATOM  22850  CB   ALA  H  349    30.384  65.736  52.251  1.00  35.58    A  C
ATOM  22851  C    ALA  H  349    29.537  66.892  50.229  1.00  39.18    A  C
ATOM  22852  O    ALA  H  349    28.475  67.323  50.564  1.00  39.63    A  O
ATOM  22853  N    LYS  H  350    30.271  67.432  49.269  1.00  41.14    A  N
ATOM  22854  CA   LYS  H  350    29.900  68.612  48.487  1.00  41.66    A  C
ATOM  22855  CB   LYS  H  350    28.799  68.285  47.494  1.00  42.61    H  C
ATOM  22856  CG   LYS  H  350    29.012  67.021  46.740  1.00  47.36    H  C
ATOM  22857  CD   LYS  H  350    29.411  67.278  45.338  1.00  56.12    H  C
```

Appendix 1

```
ATOM  22858  CE   LYS H 350      28.750  66.320  44.397  1.00 59.80           H  C
ATOM  22859  NZ   LYS H 350      28.956  66.734  43.001  1.00 63.26           H  N
ATOM  22860  C    LYS H 350      29.555  69.887  49.225  1.00 41.06           A  C
ATOM  22861  O    LYS H 350      28.484  70.373  49.102  1.00 39.64           A  O
ATOM  22862  N    PRO H 351      30.497  70.432  49.965  1.00 41.18           A  N
ATOM  22863  CA   PRO H 351      30.267  71.643  50.723  1.00 40.54           A  C
ATOM  22864  CB   PRO H 351      31.595  71.871  51.408  1.00 40.38           A  C
ATOM  22865  CG   PRO H 351      32.546  71.145  50.678  1.00 40.23           A  C
ATOM  22866  CD   PRO H 351      31.922  70.121  49.861  1.00 41.09           A  C
ATOM  22867  C    PRO H 351      29.985  72.793  49.824  1.00 41.74           A  C
ATOM  22868  O    PRO H 351      30.547  72.873  48.780  1.00 41.25           A  O
ATOM  22869  N    SER H 352      29.082  73.660  50.230  1.00 43.05           A  N
ATOM  22870  CA   SER H 352      28.801  74.883  49.537  1.00 44.11           A  C
ATOM  22871  CB   SER H 352      27.637  74.694  48.611  1.00 43.50           A  C
ATOM  22872  OG   SER H 352      26.948  73.539  48.970  1.00 46.81           A  O
ATOM  22873  C    SER H 352      28.438  75.387  50.587  1.00 45.20           A  C
ATOM  22874  O    SER H 352      27.932  75.523  51.622  1.00 46.03           A  O
ATOM  22875  N    ILE H 353      28.670  77.156  50.309  1.00 44.32           A  N
ATOM  22876  CA   ILE H 353      28.336  78.219  51.223  1.00 43.36           A  C
ATOM  22877  CB   ILE H 353      29.604  78.952  51.587  1.00 42.85           A  C
ATOM  22878  CG1  ILE H 353      30.512  77.996  52.298  1.00 40.90           A  C
ATOM  22879  CD1  ILE H 353      31.633  78.629  52.899  1.00 36.92           A  C
ATOM  22880  CG2  ILE H 353      29.354  80.035  52.510  1.00 42.10           A  C
ATOM  22881  C    ILE H 353      27.341  79.120  50.541  1.00 43.46           A  C
ATOM  22882  O    ILE H 353      27.636  79.706  49.571  1.00 42.60           A  O
ATOM  22883  N    VAL H 354      26.123  79.186  51.022  1.00 44.56           A  N
ATOM  22884  CA   VAL H 354      25.111  79.834  50.242  1.00 44.85           A  C
ATOM  22885  CB   VAL H 354      23.889  79.003  50.133  1.00 45.25           A  C
ATOM  22886  CG1  VAL H 354      23.041  79.513  49.045  1.00 44.04           A  C
ATOM  22887  CG2  VAL H 354      24.292  77.628  49.864  1.00 46.73           A  C
ATOM  22888  C    VAL H 354      24.761  81.263  50.524  1.00 45.08           A  C
ATOM  22889  O    VAL H 354      24.717  82.054  49.593  1.00 47.28           A  O
ATOM  22890  N    SER H 355      24.555  81.627  51.768  1.00 43.26           A  N
ATOM  22891  CA   SER H 355      24.442  83.037  52.075  1.00 41.71           A  C
ATOM  22892  CB   SER H 355      23.032  83.397  52.494  1.00 43.66           A  C
ATOM  22893  OG   SER H 355      22.766  84.768  52.392  1.00 46.10           A  O
ATOM  22894  C    SER H 355      25.309  83.226  53.221  1.00 39.75           A  C
ATOM  22895  O    SER H 355      24.853  83.546  54.259  1.00 39.08           A  O
ATOM  22896  N    ALA H 356      26.581  82.987  53.027  1.00 37.35           A  N
ATOM  22897  CA   ALA H 356      27.526  82.988  54.109  1.00 35.61           A  C
ATOM  22898  CB   ALA H 356      27.633  84.325  54.759  1.00 34.51           A  C
ATOM  22899  C    ALA H 356      27.159  81.926  55.100  1.00 34.33           A  C
ATOM  22900  O    ALA H 356      27.452  82.035  56.256  1.00 34.24           A  O
ATOM  22901  N    SER H 357      26.539  80.878  54.601  1.00 33.43           A  N
ATOM  22902  CA   SER H 357      26.141  79.745  55.393  1.00 30.87           A  C
ATOM  22903  CB   SER H 357      24.653  79.729  55.489  1.00 29.81           A  C
ATOM  22904  OG   SER H 357      24.262  79.099  56.647  1.00 30.46           A  O
ATOM  22905  C    SER H 357      26.605  78.435  54.826  1.00 28.77           A  C
ATOM  22906  O    SER H 357      26.609  78.241  53.683  1.00 26.46           A  O
ATOM  22907  N    LEU H 358      26.966  77.513  55.672  1.00 29.12           A  N
ATOM  22908  CA   LEU H 358      27.472  76.239  55.230  1.00 32.56           A  C
ATOM  22909  CB   LEU H 358      28.679  75.867  56.056  1.00 31.31           A  C
ATOM  22910  CG   LEU H 358      29.324  74.569  55.650  1.00 33.79           A  C
ATOM  22911  CD1  LEU H 358      29.757  74.543  54.244  1.00 34.95           A  C
```

Appendix 1

```
ATOM  22912  CD2 LEU H 358      30.454  74.390  56.477  1.00 36.99      A   C
ATOM  22913  C   LEU H 358      26.507  75.047  55.164  1.00 34.55      A   C
ATOM  22914  O   LEU H 358      25.866  74.721  56.109  1.00 36.01      A   O
ATOM  22915  N   ARG H 359      26.452  74.397  54.012  1.00 36.56      A   N
ATOM  22916  CA  ARG H 359      25.673  73.181  53.801  1.00 39.14      A   C
ATOM  22917  CB  ARG H 359      24.491  73.456  52.902  1.00 40.58      A   C
ATOM  22918  CG  ARG H 359      23.465  74.395  53.446  1.00 47.82      A   C
ATOM  22919  CD  ARG H 359      22.626  73.815  54.577  1.00 53.28      A   C
ATOM  22920  NE  ARG H 359      21.692  74.826  55.040  1.00 63.23      A   N
ATOM  22921  CZ  ARG H 359      22.057  76.037  55.433  1.00 64.76      A   C
ATOM  22922  NH1 ARG H 359      23.325  76.362  55.461  1.00 61.48      A   N
ATOM  22923  NH2 ARG H 359      21.153  76.917  55.804  1.00 64.20      A   N
ATOM  22924  C   ARG H 359      26.441  72.080  53.114  1.00 38.44      A   C
ATOM  22925  O   ARG H 359      27.293  72.335  52.348  1.00 39.66      A   O
ATOM  22926  N   TYR H 360      26.109  70.847  53.375  1.00 37.64      A   N
ATOM  22927  CA  TYR H 360      26.661  69.788  52.598  1.00 37.52      A   C
ATOM  22928  CB  TYR H 360      27.336  68.772  53.487  1.00 36.20      A   C
ATOM  22929  CG  TYR H 360      28.596  69.249  54.130  1.00 36.02      A   C
ATOM  22930  CD1 TYR H 360      29.787  69.196  53.469  1.00 35.88      A   C
ATOM  22931  CE1 TYR H 360      30.917  69.605  54.049  1.00 33.60      A   C
ATOM  22932  CZ  TYR H 360      30.881  70.090  55.303  1.00 36.61      A   C
ATOM  22933  OH  TYR H 360      32.011  70.504  55.889  1.00 37.02      A   O
ATOM  22934  CE2 TYR H 360      29.724  70.152  55.976  1.00 32.62      A   C
ATOM  22935  CD2 TYR H 360      28.600  69.724  55.403  1.00 34.03      A   C
ATOM  22936  C   TYR H 360      25.560  69.144  51.811  1.00 38.10      A   C
ATOM  22937  O   TYR H 360      24.589  68.714  52.357  1.00 39.19      A   O
ATOM  22938  N   GLU H 361      25.696  69.101  50.510  1.00 39.19      A   N
ATOM  22939  CA  GLU H 361      24.900  68.221  49.703  1.00 43.08      A   C
ATOM  22940  CB  GLU H 361      25.129  68.546  48.212  1.00 43.33      A   C
ATOM  22941  CG  GLU H 361      24.136  67.972  47.187  1.00 49.20      A   C
ATOM  22942  CD  GLU H 361      24.370  68.400  45.689  1.00 58.10      A   C
ATOM  22943  OE1 GLU H 361      25.492  68.694  45.249  1.00 59.78      A   O
ATOM  22944  OE2 GLU H 361      23.406  68.424  44.913  1.00 56.41      A   O-1
ATOM  22945  C   GLU H 361      25.552  66.919  50.118  1.00 44.01      A   C
ATOM  22946  O   GLU H 361      26.727  66.925  50.438  1.00 45.54      A   O
ATOM  22947  N   HIS H 362      24.838  65.812  50.145  1.00 43.26      A   N
ATOM  22948  CA  HIS H 362      25.490  64.520  50.351  1.00 43.12      A   C
ATOM  22949  CB  HIS H 362      26.216  64.068  49.097  1.00 41.76      A   C
ATOM  22950  CG  HIS H 362      25.495  64.380  47.833  1.00 46.69      A   C
ATOM  22951  ND1 HIS H 362      24.237  63.910  47.565  1.00 51.52      A   N
ATOM  22952  CE1 HIS H 362      23.847  64.357  46.392  1.00 51.69      A   C
ATOM  22953  NE2 HIS H 362      24.811  65.092  45.884  1.00 49.80      A   N
ATOM  22954  CD2 HIS H 362      25.852  65.122  46.765  1.00 48.30      A   C
ATOM  22955  C   HIS H 362      26.409  64.258  51.539  1.00 42.46      A   C
ATOM  22956  O   HIS H 362      27.463  63.732  51.354  1.00 42.44      A   O
ATOM  22957  N   PRO H 363      25.991  64.536  52.754  1.00 42.71      A   N
ATOM  22958  CA  PRO H 363      26.750  64.107  53.922  1.00 42.01      A   C
ATOM  22959  CB  PRO H 363      25.967  64.688  55.070  1.00 41.80      A   C
ATOM  22960  CG  PRO H 363      24.639  64.834  54.567  1.00 42.59      A   C
ATOM  22961  CD  PRO H 363      24.734  65.167  53.146  1.00 43.52      A   C
ATOM  22962  C   PRO H 363      26.779  62.611  54.055  1.00 41.58      A   C
ATOM  22963  O   PRO H 363      25.793  61.961  53.867  1.00 40.76      A   O
ATOM  22964  N   GLY H 364      27.929  62.068  54.389  1.00 41.04      A   N
ATOM  22965  CA  GLY H 364      28.153  60.645  54.296  1.00 39.88      A   C
```

Appendix 1

```
ATOM  22966  C    GLY H 364    27.891  59.845  55.526  1.00  39.15   A  C
ATOM  22967  O    GLY H 364    28.048  58.657  55.550  1.00  38.77   A  O
ATOM  22968  N    SER H 365    27.515  60.520  56.578  1.00  37.48   A  N
ATOM  22969  CA   SER H 365    27.258  59.827  57.785  1.00  35.54   A  C
ATOM  22970  CB   SER H 365    28.544  59.351  58.441  1.00  35.67   A  C
ATOM  22971  OG   SER H 365    29.175  60.349  59.159  1.00  31.89   A  O
ATOM  22972  C    SER H 365    26.363  60.573  58.717  1.00  35.49   A  C
ATOM  22973  O    SER H 365    25.981  61.673  58.478  1.00  34.71   A  O
ATOM  22974  N    LEU H 366    26.014  59.890  59.772  1.00  35.02   A  N
ATOM  22975  CA   LEU H 366    25.334  60.443  60.872  1.00  35.58   A  C
ATOM  22976  CB   LEU H 366    25.086  59.367  61.899  1.00  36.64   A  C
ATOM  22977  CG   LEU H 366    23.661  58.895  62.034  1.00  39.90   A  C
ATOM  22978  CD1  LEU H 366    22.924  59.384  60.889  1.00  41.82   A  C
ATOM  22979  CD2  LEU H 366    23.683  57.434  62.023  1.00  45.40   A  C
ATOM  22980  C    LEU H 366    26.308  61.386  61.438  1.00  34.12   A  C
ATOM  22981  O    LEU H 366    27.462  61.192  61.304  1.00  33.18   A  O
ATOM  22982  N    LEU H 367    25.819  62.460  61.998  1.00  32.82   A  N
ATOM  22983  CA   LEU H 367    26.633  63.370  62.741  1.00  31.76   A  C
ATOM  22984  CB   LEU H 367    27.288  62.646  63.874  1.00  30.74   A  C
ATOM  22985  CG   LEU H 367    26.407  62.167  64.987  1.00  33.89   A  C
ATOM  22986  CD1  LEU H 367    27.146  61.290  65.838  1.00  32.86   A  C
ATOM  22987  CD2  LEU H 367    25.882  63.280  65.783  1.00  35.81   A  C
ATOM  22988  C    LEU H 367    27.690  64.057  61.924  1.00  31.19   A  C
ATOM  22989  O    LEU H 367    28.627  64.513  62.470  1.00  31.43   A  O
ATOM  22990  N    PHE H 368    27.553  64.094  60.617  1.00  29.20   A  N
ATOM  22991  CA   PHE H 368    28.609  64.555  59.784  1.00  27.99   A  C
ATOM  22992  CB   PHE H 368    28.177  64.361  58.351  1.00  27.52   A  C
ATOM  22993  CG   PHE H 368    29.223  64.635  57.360  1.00  27.88   A  C
ATOM  22994  CD1  PHE H 368    30.161  63.710  57.075  1.00  26.87   A  C
ATOM  22995  CE1  PHE H 368    31.105  63.969  56.169  1.00  26.95   A  C
ATOM  22996  CZ   PHE H 368    31.127  65.144  55.531  1.00  27.84   A  C
ATOM  22997  CE2  PHE H 368    30.203  66.063  55.794  1.00  26.76   A  C
ATOM  22998  CD2  PHE H 368    29.254  65.814  56.687  1.00  27.60   A  C
ATOM  22999  C    PHE H 368    29.006  65.979  59.949  1.00  28.52   A  C
ATOM  23000  O    PHE H 368    30.108  66.226  60.244  1.00  29.02   A  O
ATOM  23001  N    ASP H 369    28.113  66.920  59.790  1.00  28.49   A  N
ATOM  23002  CA   ASP H 369    28.497  68.299  59.981  1.00  30.06   A  C
ATOM  23003  CB   ASP H 369    27.434  69.286  59.463  1.00  30.90   A  C
ATOM  23004  CG   ASP H 369    26.246  69.400  60.358  1.00  33.99   A  C
ATOM  23005  OD1  ASP H 369    26.159  70.320  61.141  1.00  31.02   A  O
ATOM  23006  OD2  ASP H 369    25.377  68.553  60.271  1.00  41.03   A  O-1
ATOM  23007  C    ASP H 369    28.961  68.632  61.385  1.00  30.18   A  C
ATOM  23008  O    ASP H 369    29.793  69.471  61.571  1.00  29.88   A  O
ATOM  23009  N    GLU H 370    28.369  67.993  62.367  1.00  30.36   A  N
ATOM  23010  CA   GLU H 370    28.757  68.201  63.716  1.00  31.55   A  C
ATOM  23011  CB   GLU H 370    27.860  67.369  64.607  1.00  31.27   A  C
ATOM  23012  CG   GLU H 370    26.459  67.805  64.578  1.00  34.30   A  C
ATOM  23013  CD   GLU H 370    25.507  66.890  63.887  1.00  36.08   A  C
ATOM  23014  OE1  GLU H 370    25.776  66.322  62.849  1.00  38.48   A  O
ATOM  23015  OE2  GLU H 370    24.428  66.786  64.399  1.00  40.34   A  O-1
ATOM  23016  C    GLU H 370    30.166  67.776  63.980  1.00  32.23   A  C
ATOM  23017  O    GLU H 370    30.903  68.501  64.568  1.00  33.16   A  O
ATOM  23018  N    LEU H 371    30.525  66.579  63.560  1.00  32.32   A  N
ATOM  23019  CA   LEU H 371    31.843  66.043  63.786  1.00  31.85   A  C
```

Appendix 1

```
ATOM  23020  CB   LEU H 371   31.901  64.556  63.514  1.00  30.79   A  C
ATOM  23021  CG   LEU H 371   31.431  63.677  64.660  1.00  30.47   A  C
ATOM  23022  CD1  LEU H 371   31.397  62.263  64.358  1.00  29.53   A  C
ATOM  23023  CD2  LEU H 371   32.189  63.859  65.836  1.00  31.93   A  C
ATOM  23024  C    LEU H 371   32.917  66.780  63.070  1.00  33.03   A  C
ATOM  23025  O    LEU H 371   33.957  66.973  63.600  1.00  34.89   A  O
ATOM  23026  N    LEU H 372   32.653  67.180  61.851  1.00  32.94   A  N
ATOM  23027  CA   LEU H 372   33.578  67.968  61.076  1.00  32.58   A  C
ATOM  23028  CB   LEU H 372   33.121  68.085  59.641  1.00  31.57   A  C
ATOM  23029  CG   LEU H 372   33.857  67.191  58.685  1.00  30.99   A  C
ATOM  23030  CD1  LEU H 372   33.369  65.846  58.778  1.00  31.76   A  C
ATOM  23031  CD2  LEU H 372   33.662  67.652  57.352  1.00  32.57   A  C
ATOM  23032  C    LEU H 372   33.857  69.332  61.657  1.00  33.31   A  C
ATOM  23033  O    LEU H 372   34.949  69.798  61.576  1.00  33.95   A  O
ATOM  23034  N    PHE H 373   32.845  69.966  62.217  1.00  33.49   A  N
ATOM  23035  CA   PHE H 373   32.969  71.235  62.882  1.00  31.94   A  C
ATOM  23036  CB   PHE H 373   31.569  71.730  63.272  1.00  31.13   A  C
ATOM  23037  CG   PHE H 373   31.532  72.764  64.358  1.00  29.15   A  C
ATOM  23038  CD1  PHE H 373   31.994  74.024  64.158  1.00  29.84   A  C
ATOM  23039  CE1  PHE H 373   31.955  74.922  65.134  1.00  27.68   A  C
ATOM  23040  CZ   PHE H 373   31.411  74.613  66.310  1.00  28.61   A  C
ATOM  23041  CE2  PHE H 373   30.921  73.405  66.520  1.00  29.01   A  C
ATOM  23042  CD2  PHE H 373   30.975  72.481  65.559  1.00  29.05   A  C
ATOM  23043  C    PHE H 373   33.864  71.110  64.078  1.00  33.14   A  C
ATOM  23044  O    PHE H 373   34.725  71.907  64.269  1.00  31.58   A  O
ATOM  23045  N    LEU H 374   33.666  70.083  64.869  1.00  33.52   A  N
ATOM  23046  CA   LEU H 374   34.445  69.916  66.052  1.00  34.35   A  C
ATOM  23047  CB   LEU H 374   33.884  68.777  66.858  1.00  33.58   A  C
ATOM  23048  CG   LEU H 374   34.803  68.293  67.941  1.00  33.71   A  C
ATOM  23049  CD1  LEU H 374   35.116  69.346  68.869  1.00  33.65   A  C
ATOM  23050  CD2  LEU H 374   34.185  67.179  68.631  1.00  33.94   A  C
ATOM  23051  C    LEU H 374   35.914  69.710  65.760  1.00  35.86   A  C
ATOM  23052  O    LEU H 374   36.756  70.337  66.357  1.00  36.75   A  O
ATOM  23053  N    ALA H 375   36.200  68.856  64.805  1.00  35.04   A  N
ATOM  23054  CA   ALA H 375   37.543  68.566  64.403  1.00  35.07   A  C
ATOM  23055  CB   ALA H 375   37.560  67.495  63.434  1.00  35.18   A  C
ATOM  23056  C    ALA H 375   38.234  69.751  63.838  1.00  35.07   A  C
ATOM  23057  O    ALA H 375   39.400  69.901  63.994  1.00  34.79   A  O
ATOM  23058  N    LYS H 376   37.508  70.573  63.128  1.00  34.66   A  N
ATOM  23059  CA   LYS H 376   38.085  71.749  62.557  1.00  34.74   A  C
ATOM  23060  CB   LYS H 376   37.143  72.398  61.578  1.00  33.45   A  C
ATOM  23061  CG   LYS H 376   37.246  71.853  60.232  1.00  29.83   A  C
ATOM  23062  CD   LYS H 376   36.105  72.239  59.383  1.00  23.54   A  C
ATOM  23063  CE   LYS H 376   36.043  71.385  58.177  1.00  24.27   A  C
ATOM  23064  NZ   LYS H 376   35.388  72.021  57.090  1.00  23.53   A  N
ATOM  23065  C    LYS H 376   38.551  72.721  63.623  1.00  35.77   A  C
ATOM  23066  O    LYS H 376   39.547  73.378  63.467  1.00  37.44   A  O
ATOM  23067  N    VAL H 377   37.830  72.788  64.717  1.00  34.80   A  N
ATOM  23068  CA   VAL H 377   38.107  73.763  65.718  1.00  34.56   A  C
ATOM  23069  CB   VAL H 377   36.873  74.594  66.104  1.00  33.93   A  C
ATOM  23070  CG1  VAL H 377   36.354  75.367  64.994  1.00  27.75   A  C
ATOM  23071  CG2  VAL H 377   35.836  73.773  66.715  1.00  31.45   A  C
ATOM  23072  C    VAL H 377   38.639  73.202  66.979  1.00  36.11   A  C
ATOM  23073  O    VAL H 377   38.970  73.950  67.837  1.00  36.74   A  O
```

Appendix 1

```
ATOM  23074  N    HIS H 378      38.725  71.900  67.124  1.00 36.66      A    N
ATOM  23075  CA   HIS H 378      39.057  71.353  68.424  1.00 37.03      A    C
ATOM  23076  CB   HIS H 378      38.880  69.851  68.381  1.00 36.66      A    C
ATOM  23077  CG   HIS H 378      39.182  69.155  69.662  1.00 37.04      A    C
ATOM  23078  ND1  HIS H 378      38.447  69.335  70.803  1.00 40.50      A    N
ATOM  23079  CE1  HIS H 378      38.936  68.586  71.766  1.00 35.95      A    C
ATOM  23080  NE2  HIS H 378      39.958  67.916  71.286  1.00 39.83      A    N
ATOM  23081  CD2  HIS H 378      40.128  68.249  69.970  1.00 38.49      A    C
ATOM  23082  C    HIS H 378      40.434  71.752  68.920  1.00 37.98      A    C
ATOM  23083  O    HIS H 378      41.405  71.666  68.224  1.00 37.09      A    O
ATOM  23084  N    ALA H 379      40.494  72.231  70.144  1.00 38.36      A    N
ATOM  23085  CA   ALA H 379      41.734  72.704  70.720  1.00 39.38      A    C
ATOM  23086  CB   ALA H 379      41.514  73.994  71.402  1.00 38.81      A    C
ATOM  23087  C    ALA H 379      42.355  71.728  71.689  1.00 39.43      A    C
ATOM  23088  O    ALA H 379      43.304  72.032  72.343  1.00 39.33      A    O
ATOM  23089  N    GLY H 380      41.757  70.577  71.822  1.00 37.55      A    N
ATOM  23090  CA   GLY H 380      42.232  69.612  72.753  1.00 36.87      A    C
ATOM  23091  C    GLY H 380      41.508  69.677  74.064  1.00 37.84      A    C
ATOM  23092  O    GLY H 380      41.206  70.693  74.584  1.00 37.74      A    O
ATOM  23093  N    PHE H 381      41.207  68.536  74.601  1.00 37.83      A    N
ATOM  23094  CA   PHE H 381      40.448  68.492  75.785  1.00 39.45      A    C
ATOM  23095  CB   PHE H 381      40.053  67.082  76.051  1.00 38.97      A    C
ATOM  23096  CG   PHE H 381      38.973  66.644  75.195  1.00 40.17      A    C
ATOM  23097  CD1  PHE H 381      37.738  67.168  75.343  1.00 40.03      A    C
ATOM  23098  CE1  PHE H 381      36.741  66.801  74.556  1.00 39.92      A    C
ATOM  23099  CZ   PHE H 381      36.952  65.927  73.600  1.00 45.19      A    C
ATOM  23100  CE2  PHE H 381      38.176  65.400  73.415  1.00 43.67      A    C
ATOM  23101  CD2  PHE H 381      39.184  65.757  74.203  1.00 42.63      A    C
ATOM  23102  C    PHE H 381      41.171  69.109  76.930  1.00 41.96      A    C
ATOM  23103  O    PHE H 381      40.573  69.698  77.799  1.00 42.67      A    O
ATOM  23104  N    GLY H 382      42.476  68.930  76.942  1.00 43.38      A    N
ATOM  23105  CA   GLY H 382      43.311  69.471  77.976  1.00 44.43      A    C
ATOM  23106  C    GLY H 382      43.317  70.961  78.015  1.00 45.76      A    C
ATOM  23107  O    GLY H 382      43.287  71.536  79.054  1.00 46.48      A    O
ATOM  23108  N    ALA H 383      43.355  71.590  76.867  1.00 46.89      A    N
ATOM  23109  CA   ALA H 383      43.327  73.027  76.795  1.00 48.37      A    C
ATOM  23110  CB   ALA H 383      43.522  73.438  75.405  1.00 48.02      A    C
ATOM  23111  C    ALA H 383      42.046  73.591  77.307  1.00 49.38      A    C
ATOM  23112  O    ALA H 383      42.020  74.544  78.026  1.00 50.10      A    O
ATOM  23113  N    LEU H 384      40.970  72.959  76.923  1.00 50.79      A    N
ATOM  23114  CA   LEU H 384      39.652  73.322  77.324  1.00 52.14      A    C
ATOM  23115  CB   LEU H 384      38.684  72.344  76.720  1.00 52.68      A    C
ATOM  23116  CG   LEU H 384      37.698  72.732  75.661  1.00 51.43      A    C
ATOM  23117  CD1  LEU H 384      38.351  73.611  74.687  1.00 52.13      A    C
ATOM  23118  CD2  LEU H 384      37.283  71.473  75.031  1.00 49.12      A    C
ATOM  23119  C    LEU H 384      39.596  73.162  78.798  1.00 53.18      A    C
ATOM  23120  O    LEU H 384      38.860  73.817  79.483  1.00 54.15      A    O
ATOM  23121  N    LEU H 385      40.372  72.230  79.282  1.00 53.71      A    N
ATOM  23122  CA   LEU H 385      40.453  71.950  80.683  1.00 55.07      A    C
ATOM  23123  CB   LEU H 385      41.397  70.801  80.864  1.00 54.53      A    C
ATOM  23124  CG   LEU H 385      40.946  69.813  81.901  1.00 54.99      A    C
ATOM  23125  CD1  LEU H 385      39.899  70.432  82.753  1.00 53.65      A    C
ATOM  23126  CD2  LEU H 385      40.443  68.623  81.218  1.00 52.02      A    C
ATOM  23127  C    LEU H 385      40.988  73.154  81.416  1.00 56.57      A    C
```

Appendix 1

```
ATOM  23128  O    LEU H 385     40.590  73.481  82.503  1.00 56.44      A   O
ATOM  23129  N    ARG H 386     41.892  73.841  80.766  1.00 58.35      A   N
ATOM  23130  CA   ARG H 386     42.564  74.955  81.343  1.00 59.57      A   C
ATOM  23131  CB   ARG H 386     44.038  74.897  81.006  1.00 59.92      A   C
ATOM  23132  CG   ARG H 386     44.684  73.593  81.237  1.00 61.57      A   C
ATOM  23133  CD   ARG H 386     45.495  73.258  80.031  1.00 65.43      A   C
ATOM  23134  NE   ARG H 386     46.564  72.309  80.270  1.00 66.19      A   N
ATOM  23135  CZ   ARG H 386     46.410  71.122  80.818  1.00 65.65      A   C
ATOM  23136  NH1  ARG H 386     45.229  70.725  81.217  1.00 63.83      A   N
ATOM  23137  NH2  ARG H 386     47.456  70.346  80.984  1.00 64.85      A   N
ATOM  23138  C    ARG H 386     41.991  76.266  80.853  1.00 60.13      A   C
ATOM  23139  O    ARG H 386     42.648  77.269  80.898  1.00 61.04      A   O
ATOM  23140  N    MET H 387     40.766  76.270  80.383  1.00 59.75      A   N
ATOM  23141  CA   MET H 387     40.270  77.437  79.707  1.00 58.95      A   C
ATOM  23142  CB   MET H 387     38.922  77.112  79.116  1.00 58.81      H   C
ATOM  23143  CG   MET H 387     37.900  78.171  79.220  1.00 59.27      H   C
ATOM  23144  SD   MET H 387     36.632  77.929  78.015  1.00 61.63      H   S
ATOM  23145  CE   MET H 387     37.572  77.098  76.801  1.00 59.07      H   C
ATOM  23146  C    MET H 387     40.212  78.652  80.608  1.00 59.35      A   C
ATOM  23147  O    MET H 387     39.755  78.580  81.730  1.00 59.72      A   O
ATOM  23148  N    PRO H 388     40.659  79.790  80.105  1.00 59.28      A   N
ATOM  23149  CA   PRO H 388     40.718  81.022  80.876  1.00 59.51      A   C
ATOM  23150  CB   PRO H 388     41.506  81.942  79.960  1.00 59.66      A   C
ATOM  23151  CG   PRO H 388     41.656  81.248  78.728  1.00 58.84      A   C
ATOM  23152  CD   PRO H 388     41.597  79.844  78.995  1.00 58.65      A   C
ATOM  23153  C    PRO H 388     39.381  81.647  81.217  1.00 59.72      A   C
ATOM  23154  O    PRO H 388     38.506  81.737  80.401  1.00 59.45      A   O
ATOM  23155  N    PRO H 389     39.286  82.143  82.427  1.00 59.93      A   N
ATOM  23156  CA   PRO H 389     38.063  82.413  83.166  1.00 60.45      A   C
ATOM  23157  CB   PRO H 389     38.592  83.010  84.461  1.00 60.64      A   C
ATOM  23158  CG   PRO H 389     40.019  82.763  84.473  1.00 60.60      A   C
ATOM  23159  CD   PRO H 389     40.423  81.987  83.321  1.00 59.80      A   C
ATOM  23160  C    PRO H 389     36.993  83.336  82.627  1.00 61.26      A   C
ATOM  23161  O    PRO H 389     35.838  82.993  82.604  1.00 60.66      A   O
ATOM  23162  N    PRO H 390     37.344  84.538  82.255  1.00 62.52      A   N
ATOM  23163  CA   PRO H 390     36.281  85.474  81.939  1.00 63.17      A   C
ATOM  23164  CB   PRO H 390     36.946  86.447  81.007  1.00 62.65      A   C
ATOM  23165  CG   PRO H 390     38.008  85.626  80.333  1.00 64.62      A   C
ATOM  23166  CD   PRO H 390     38.370  84.490  81.204  1.00 62.88      A   C
ATOM  23167  C    PRO H 390     35.197  84.719  81.226  1.00 63.39      A   C
ATOM  23168  O    PRO H 390     34.205  84.435  81.872  1.00 63.51      A   O
ATOM  23169  N    LEU I  29     34.568  45.413  41.716  1.00 76.00      A   N
ATOM  23170  CA   LEU I  29     33.710  44.497  42.412  1.00 76.21      A   C
ATOM  23171  CB   LEU I  29     32.268  44.957  42.246  1.00 76.35      A   C
ATOM  23172  CG   LEU I  29     31.567  45.551  43.462  1.00 76.78      A   C
ATOM  23173  CD1  LEU I  29     31.654  47.029  43.429  1.00 76.29      A   C
ATOM  23174  CD2  LEU I  29     30.130  45.120  43.503  1.00 76.15      A   C
ATOM  23175  C    LEU I  29     33.914  43.051  41.927  1.00 75.79      A   C
ATOM  23176  O    LEU I  29     33.396  42.638  40.872  1.00 76.22      A   O
ATOM  23177  N    PRO I  30     34.656  42.273  42.706  1.00 74.59      A   N
ATOM  23178  CA   PRO I  30     35.060  40.935  42.272  1.00 73.62      A   C
ATOM  23179  CB   PRO I  30     36.594  40.980  42.384  1.00 73.56      A   C
ATOM  23180  CG   PRO I  30     36.943  42.356  42.613  1.00 74.40      A   C
ATOM  23181  CD   PRO I  30     35.783  43.043  43.224  1.00 74.68      A   C
```

Appendix 1

```
ATOM  23182  C    PRO I  30   34.565  39.771  43.103  1.00  71.81  A  C
ATOM  23183  O    PRO I  30   34.906  39.671  44.271  1.00  72.23  A  O
ATOM  23184  N    PRO I  31   33.864  38.853  42.471  1.00  69.47  A  N
ATOM  23185  CA   PRO I  31   33.396  37.644  43.123  1.00  67.48  A  C
ATOM  23186  CB   PRO I  31   31.990  37.556  42.632  1.00  68.32  A  C
ATOM  23187  CG   PRO I  31   31.595  38.941  42.464  1.00  69.39  A  C
ATOM  23188  CD   PRO I  31   32.763  39.697  42.023  1.00  69.34  A  C
ATOM  23189  C    PRO I  31   34.146  36.429  42.636  1.00  65.35  A  C
ATOM  23190  O    PRO I  31   34.965  35.920  43.351  1.00  65.48  A  O
ATOM  23191  N    GLY I  32   33.854  35.952  41.440  1.00  62.50  A  N
ATOM  23192  CA   GLY I  32   34.652  34.905  40.813  1.00  58.42  A  C
ATOM  23193  C    GLY I  32   35.575  35.426  39.721  1.00  55.37  A  C
ATOM  23194  O    GLY I  32   36.189  34.681  38.991  1.00  54.14  A  O
ATOM  23195  N    ARG I  33   35.614  36.743  39.635  1.00  52.43  A  N
ATOM  23196  CA   ARG I  33   36.410  37.511  38.720  1.00  48.96  A  C
ATOM  23197  CB   ARG I  33   35.766  38.841  38.616  1.00  48.11  A  C
ATOM  23198  CG   ARG I  33   34.392  38.703  38.229  1.00  48.54  A  C
ATOM  23199  CD   ARG I  33   34.289  38.666  36.753  1.00  45.90  A  C
ATOM  23200  NE   ARG I  33   34.997  39.768  36.157  1.00  44.26  A  N
ATOM  23201  CZ   ARG I  33   34.468  40.945  35.955  1.00  45.01  A  C
ATOM  23202  NH1  ARG I  33   33.228  41.137  36.267  1.00  48.61  A  N
ATOM  23203  NH2  ARG I  33   35.155  41.904  35.406  1.00  44.56  A  N
ATOM  23204  C    ARG I  33   37.865  37.706  39.059  1.00  47.67  A  C
ATOM  23205  O    ARG I  33   38.246  37.764  40.193  1.00  47.26  A  O
ATOM  23206  N    LEU I  34   38.680  37.707  38.028  1.00  46.30  A  N
ATOM  23207  CA   LEU I  34   40.055  38.133  38.058  1.00  43.54  A  C
ATOM  23208  CB   LEU I  34   40.821  37.538  36.897  1.00  43.00  A  C
ATOM  23209  CG   LEU I  34   40.750  36.021  36.822  1.00  41.50  A  C
ATOM  23210  CD1  LEU I  34   41.126  35.424  35.518  1.00  34.68  A  C
ATOM  23211  CD2  LEU I  34   41.385  35.353  37.945  1.00  35.99  A  C
ATOM  23212  C    LEU I  34   40.343  39.590  38.202  1.00  43.42  A  C
ATOM  23213  O    LEU I  34   41.258  39.942  38.871  1.00  44.61  A  O
ATOM  23214  N    ALA I  35   39.596  40.439  37.532  1.00  42.42  A  N
ATOM  23215  CA   ALA I  35   39.836  41.866  37.573  1.00  41.68  A  C
ATOM  23216  CB   ALA I  35   40.912  42.234  36.665  1.00  40.86  A  C
ATOM  23217  C    ALA I  35   38.598  42.611  37.214  1.00  42.15  A  C
ATOM  23218  O    ALA I  35   37.717  42.061  36.657  1.00  42.65  A  O
ATOM  23219  N    THR I  36   38.530  43.871  37.573  1.00  42.39  A  N
ATOM  23220  CA   THR I  36   37.346  44.648  37.317  1.00  42.41  A  C
ATOM  23221  CB   THR I  36   37.070  45.761  38.368  1.00  42.42  A  C
ATOM  23222  OG1  THR I  36   38.078  46.754  38.356  1.00  41.25  A  O
ATOM  23223  CG2  THR I  36   36.982  45.188  39.710  1.00  40.73  A  C
ATOM  23224  C    THR I  36   37.255  45.157  35.912  1.00  42.81  A  C
ATOM  23225  O    THR I  36   38.229  45.269  35.240  1.00  42.90  A  O
ATOM  23226  N    THR I  37   36.040  45.452  35.505  1.00  42.31  A  N
ATOM  23227  CA   THR I  37   35.713  45.970  34.218  1.00  42.03  A  C
ATOM  23228  CB   THR I  37   34.251  46.191  34.105  1.00  40.94  A  C
ATOM  23229  OG1  THR I  37   33.611  44.960  33.926  1.00  39.36  A  O
ATOM  23230  CG2  THR I  37   33.961  46.976  32.941  1.00  43.41  A  C
ATOM  23231  C    THR I  37   36.366  47.289  34.033  1.00  44.11  A  C
ATOM  23232  O    THR I  37   36.813  47.633  32.968  1.00  45.35  A  O
ATOM  23233  N    GLU I  38   36.411  48.046  35.094  1.00  45.21  I  N
ATOM  23234  CA   GLU I  38   37.008  49.324  35.031  1.00  45.95  I  C
ATOM  23235  CB   GLU I  38   36.963  49.954  36.391  1.00  46.15  I  C
```

Appendix 1

```
ATOM  23236  CG   GLU I  38     37.151  51.397  36.380  1.00  52.89    I  C
ATOM  23237  CD   GLU I  38     37.456  51.967  37.745  1.00  60.65    I  C
ATOM  23238  OE1  GLU I  38     37.570  51.192  38.715  1.00  60.75    I  O
ATOM  23239  OE2  GLU I  38     37.581  53.200  37.846  1.00  60.83    I  O
ATOM  23240  C    GLU I  38     38.403  49.016  34.673  1.00  45.48    I  C
ATOM  23241  O    GLU I  38     38.995  49.669  33.859  1.00  46.67    I  O
ATOM  23242  N    ASP I  39     38.937  47.981  35.272  1.00  44.36    I  N
ATOM  23243  CA   ASP I  39     40.312  47.668  35.021  1.00  43.17    I  C
ATOM  23244  CB   ASP I  39     40.746  46.514  35.899  1.00  43.35    I  C
ATOM  23245  CG   ASP I  39     41.156  46.947  37.250  1.00  45.83    I  C
ATOM  23246  OD1  ASP I  39     41.230  48.141  37.491  1.00  45.31    I  O
ATOM  23247  OD2  ASP I  39     41.409  46.093  38.093  1.00  48.52    I  O
ATOM  23248  C    ASP I  39     40.544  47.327  33.576  1.00  40.77    I  C
ATOM  23249  O    ASP I  39     41.495  47.761  33.019  1.00  39.83    I  O
ATOM  23250  N    TYR I  40     39.686  46.518  32.977  1.00  38.52    A  N
ATOM  23251  CA   TYR I  40     39.838  46.144  31.574  1.00  37.79    A  C
ATOM  23252  CB   TYR I  40     38.893  45.035  31.173  1.00  36.39    A  C
ATOM  23253  CG   TYR I  40     39.102  43.750  31.870  1.00  33.32    A  C
ATOM  23254  CD1  TYR I  40     40.327  43.152  31.924  1.00  29.84    A  C
ATOM  23255  CE1  TYR I  40     40.496  41.992  32.563  1.00  28.75    A  C
ATOM  23256  CZ   TYR I  40     39.447  41.413  33.152  1.00  32.68    A  C
ATOM  23257  OH   TYR I  40     39.560  40.244  33.807  1.00  30.08    A  O
ATOM  23258  CE2  TYR I  40     38.232  41.988  33.097  1.00  34.37    A  C
ATOM  23259  CD2  TYR I  40     38.069  43.134  32.467  1.00  31.05    A  C
ATOM  23260  C    TYR I  40     39.693  47.295  30.612  1.00  38.63    A  C
ATOM  23261  O    TYR I  40     40.407  47.399  29.664  1.00  38.96    A  O
ATOM  23262  N    PHE I  41     38.737  48.161  30.846  1.00  38.12    A  N
ATOM  23263  CA   PHE I  41     38.615  49.318  30.021  1.00  39.34    A  C
ATOM  23264  CB   PHE I  41     37.264  49.964  30.144  1.00  39.98    A  C
ATOM  23265  CG   PHE I  41     36.167  49.166  29.573  1.00  40.02    A  C
ATOM  23266  CD1  PHE I  41     35.444  49.621  28.523  1.00  40.52    A  C
ATOM  23267  CE1  PHE I  41     34.433  48.890  28.019  1.00  37.84    A  C
ATOM  23268  CZ   PHE I  41     34.137  47.719  28.543  1.00  31.35    A  C
ATOM  23269  CE2  PHE I  41     34.838  47.257  29.593  1.00  38.19    A  C
ATOM  23270  CD2  PHE I  41     35.838  47.962  30.100  1.00  39.19    A  C
ATOM  23271  C    PHE I  41     39.690  50.319  30.240  1.00  39.35    A  C
ATOM  23272  O    PHE I  41     39.918  51.139  29.416  1.00  42.20    A  O
ATOM  23273  N    ALA I  42     40.365  50.286  31.348  1.00  38.70    A  N
ATOM  23274  CA   ALA I  42     41.367  51.294  31.534  1.00  38.76    A  C
ATOM  23275  CB   ALA I  42     41.356  51.779  32.916  1.00  38.77    A  C
ATOM  23276  C    ALA I  42     42.755  50.881  31.128  1.00  39.27    A  C
ATOM  23277  O    ALA I  42     43.688  51.612  31.325  1.00  39.43    A  O
ATOM  23278  N    GLN I  43     42.883  49.714  30.528  1.00  39.72    A  N
ATOM  23279  CA   GLN I  43     44.179  49.196  30.145  1.00  40.22    A  C
ATOM  23280  CB   GLN I  43     44.041  47.793  29.575  1.00  39.90    A  C
ATOM  23281  CG   GLN I  43     43.784  46.682  30.530  1.00  40.96    A  C
ATOM  23282  CD   GLN I  43     43.458  45.395  29.830  1.00  42.06    A  C
ATOM  23283  OE1  GLN I  43     42.737  45.376  28.878  1.00  40.20    A  O
ATOM  23284  NE2  GLN I  43     43.996  44.324  30.306  1.00  43.61    A  N
ATOM  23285  C    GLN I  43     44.915  50.051  29.132  1.00  40.27    A  C
ATOM  23286  O    GLN I  43     46.081  50.228  29.210  1.00  40.45    A  O
ATOM  23287  N    GLN I  44     44.228  50.538  28.141  1.00  41.02    A  N
ATOM  23288  CA   GLN I  44     44.861  51.330  27.130  1.00  42.57    A  C
ATOM  23289  CB   GLN I  44     43.835  51.642  26.081  1.00  42.34    A  C
```

Appendix 1

```
ATOM  23290  CG   GLN I  44     44.369  51.978  24.760  1.00 46.35      A    C
ATOM  23291  CD   GLN I  44     43.353  51.733  23.709  1.00 53.16      A    C
ATOM  23292  OE1  GLN I  44     42.335  51.109  23.966  1.00 55.02      A    O
ATOM  23293  NE2  GLN I  44     43.612  52.204  22.516  1.00 50.79      A    N
ATOM  23294  C    GLN I  44     45.434  52.631  27.641  1.00 43.33      A    C
ATOM  23295  O    GLN I  44     46.491  53.040  27.250  1.00 42.37      A    O
ATOM  23296  N    ALA I  45     44.688  53.327  28.476  1.00 43.83      A    N
ATOM  23297  CA   ALA I  45     45.129  54.591  29.008  1.00 44.33      A    C
ATOM  23298  CB   ALA I  45     44.027  55.210  29.759  1.00 43.67      A    C
ATOM  23299  C    ALA I  45     46.331  54.429  29.900  1.00 44.48      A    C
ATOM  23300  O    ALA I  45     47.261  55.205  29.864  1.00 44.39      A    O
ATOM  23301  N    LYS I  46     46.251  53.411  30.730  1.00 43.42      A    N
ATOM  23302  CA   LYS I  46     47.299  52.971  31.603  1.00 42.95      A    C
ATOM  23303  CB   LYS I  46     46.760  51.944  32.576  1.00 42.18      A    C
ATOM  23304  CG   LYS I  46     46.304  52.539  33.848  1.00 44.01      A    C
ATOM  23305  CD   LYS I  46     45.240  51.738  34.501  1.00 49.36      A    C
ATOM  23306  CE   LYS I  46     45.724  51.091  35.770  1.00 50.45      A    C
ATOM  23307  NZ   LYS I  46     44.692  50.304  36.452  1.00 47.93      A    N
ATOM  23308  C    LYS I  46     48.496  52.457  30.835  1.00 42.62      A    C
ATOM  23309  O    LYS I  46     49.608  52.530  31.295  1.00 41.49      A    O
ATOM  23310  N    GLN I  47     48.244  51.934  29.656  1.00 42.63      A    N
ATOM  23311  CA   GLN I  47     49.274  51.398  28.806  1.00 43.48      A    C
ATOM  23312  CB   GLN I  47     50.401  52.343  28.766  1.00 43.84      A    C
ATOM  23313  CG   GLN I  47     50.013  53.587  28.217  1.00 48.21      A    C
ATOM  23314  CD   GLN I  47     50.861  53.912  27.109  1.00 57.28      A    C
ATOM  23315  OE1  GLN I  47     52.057  54.092  27.279  1.00 56.43      A    O
ATOM  23316  NE2  GLN I  47     50.281  53.968  25.925  1.00 60.28      A    N
ATOM  23317  C    GLN I  47     49.796  50.097  29.273  1.00 42.38      A    C
ATOM  23318  O    GLN I  47     50.878  49.714  28.969  1.00 42.96      A    O
ATOM  23319  N    ALA I  48     48.996  49.413  30.032  1.00 40.59      A    N
ATOM  23320  CA   ALA I  48     49.390  48.142  30.461  1.00 38.69      A    C
ATOM  23321  CB   ALA I  48     49.944  48.256  31.780  1.00 38.24      A    C
ATOM  23322  C    ALA I  48     48.196  47.259  30.467  1.00 37.86      A    C
ATOM  23323  O    ALA I  48     47.122  47.681  30.754  1.00 37.05      A    O
ATOM  23324  N    VAL I  49     48.423  46.018  30.112  1.00 36.81      A    N
ATOM  23325  CA   VAL I  49     47.461  44.983  30.266  1.00 36.09      A    C
ATOM  23326  CB   VAL I  49     47.786  43.778  29.435  1.00 35.44      A    C
ATOM  23327  CG1  VAL I  49     47.888  44.152  28.028  1.00 36.65      A    C
ATOM  23328  CG2  VAL I  49     49.009  43.144  29.878  1.00 34.37      A    C
ATOM  23329  C    VAL I  49     47.364  44.585  31.686  1.00 35.21      A    C
ATOM  23330  O    VAL I  49     48.249  44.786  32.458  1.00 35.15      A    O
ATOM  23331  N    THR I  50     46.248  44.014  32.006  1.00 35.17      A    N
ATOM  23332  CA   THR I  50     45.958  43.567  33.309  1.00 35.98      A    C
ATOM  23333  CB   THR I  50     44.505  43.335  33.360  1.00 36.24      A    C
ATOM  23334  OG1  THR I  50     44.061  43.539  34.676  1.00 41.62      A    O
ATOM  23335  CG2  THR I  50     44.191  41.995  32.972  1.00 34.41      A    C
ATOM  23336  C    THR I  50     46.769  42.327  33.614  1.00 36.03      A    C
ATOM  23337  O    THR I  50     47.153  41.669  32.739  1.00 37.06      A    O
ATOM  23338  N    PRO I  51     47.049  42.009  34.859  1.00 36.79      A    N
ATOM  23339  CA   PRO I  51     47.887  40.868  35.163  1.00 35.02      A    C
ATOM  23340  CB   PRO I  51     47.940  40.893  36.675  1.00 34.48      A    C
ATOM  23341  CG   PRO I  51     47.623  42.196  37.025  1.00 34.99      A    C
ATOM  23342  CD   PRO I  51     46.661  42.687  36.092  1.00 36.25      A    C
ATOM  23343  C    PRO I  51     47.284  39.574  34.678  1.00 35.17      A    C
```

Appendix 1

```
ATOM  23344  O    PRO I  51      47.987  38.665  34.350  1.00  36.83      A    O
ATOM  23345  N    ASP I  52      45.981  39.473  34.702  1.00  33.84      A    N
ATOM  23346  CA   ASP I  52      45.334  38.335  34.148  1.00  32.61      A    C
ATOM  23347  CB   ASP I  52      43.896  38.196  34.629  1.00  33.53      A    C
ATOM  23348  CG   ASP I  52      43.001  39.240  34.124  1.00  35.07      A    C
ATOM  23349  OD1  ASP I  52      41.929  38.851  33.710  1.00  36.13      A    O
ATOM  23350  OD2  ASP I  52      43.325  40.419  34.182  1.00  35.25      A    O-1
ATOM  23351  C    ASP I  52      45.490  38.207  32.658  1.00  31.98      A    C
ATOM  23352  O    ASP I  52      45.590  37.146  32.160  1.00  33.08      A    O
ATOM  23353  N    VAL I  53      45.494  39.306  31.954  1.00  30.66      A    N
ATOM  23354  CA   VAL I  53      45.720  39.289  30.537  1.00  30.07      A    C
ATOM  23355  CB   VAL I  53      45.288  40.573  29.899  1.00  28.57      A    C
ATOM  23356  CG1  VAL I  53      45.856  40.721  28.592  1.00  27.37      A    C
ATOM  23357  CG2  VAL I  53      43.850  40.598  29.816  1.00  30.05      A    C
ATOM  23358  C    VAL I  53      47.131  38.861  30.174  1.00  31.35      A    C
ATOM  23359  O    VAL I  53      47.344  38.234  29.185  1.00  31.90      A    O
ATOM  23360  N    MET I  54      48.089  39.248  30.991  1.00  31.35      A    N
ATOM  23361  CA   MET I  54      49.450  38.770  30.897  1.00  31.30      A    C
ATOM  23362  CB   MET I  54      50.353  39.517  31.866  1.00  31.51      I    C
ATOM  23363  CG   MET I  54      51.797  39.280  31.672  1.00  30.76      I    C
ATOM  23364  SD   MET I  54      52.442  39.899  30.188  1.00  40.95      I    S
ATOM  23365  CE   MET I  54      52.696  41.535  30.620  1.00  38.38      I    C
ATOM  23366  C    MET I  54      49.559  37.298  31.144  1.00  30.33      A    C
ATOM  23367  O    MET I  54      50.276  36.641  30.475  1.00  29.99      A    O
ATOM  23368  N    ALA I  55      48.825  36.813  32.121  1.00  29.41      A    N
ATOM  23369  CA   ALA I  55      48.741  35.414  32.419  1.00  29.30      A    C
ATOM  23370  CB   ALA I  55      47.993  35.189  33.649  1.00  28.51      A    C
ATOM  23371  C    ALA I  55      48.156  34.604  31.291  1.00  29.15      A    C
ATOM  23372  O    ALA I  55      48.574  33.494  31.090  1.00  28.54      A    O
ATOM  23373  N    GLN I  56      47.177  35.148  30.580  1.00  27.17      A    N
ATOM  23374  CA   GLN I  56      46.662  34.529  29.380  1.00  27.74      A    C
ATOM  23375  CB   GLN I  56      45.369  35.177  28.904  1.00  27.66      A    C
ATOM  23376  CG   GLN I  56      44.967  34.855  27.481  1.00  29.10      A    C
ATOM  23377  CD   GLN I  56      44.257  33.548  27.293  1.00  29.56      A    C
ATOM  23378  OE1  GLN I  56      43.623  33.053  28.170  1.00  27.82      A    O
ATOM  23379  NE2  GLN I  56      44.354  33.005  26.123  1.00  28.26      A    N
ATOM  23380  C    GLN I  56      47.687  34.471  28.276  1.00  28.01      A    C
ATOM  23381  O    GLN I  56      47.758  33.535  27.557  1.00  29.34      A    O
ATOM  23382  N    LEU I  57      48.481  35.506  28.160  1.00  27.26      A    N
ATOM  23383  CA   LEU I  57      49.546  35.582  27.187  1.00  27.22      A    C
ATOM  23384  CB   LEU I  57      50.183  36.958  27.233  1.00  26.26      A    C
ATOM  23385  CG   LEU I  57      49.441  38.013  26.470  1.00  26.25      A    C
ATOM  23386  CD1  LEU I  57      49.962  39.343  26.695  1.00  25.39      A    C
ATOM  23387  CD2  LEU I  57      49.432  37.694  25.047  1.00  24.02      A    C
ATOM  23388  C    LEU I  57      50.592  34.555  27.437  1.00  27.17      A    C
ATOM  23389  O    LEU I  57      51.154  34.027  26.563  1.00  26.43      A    O
ATOM  23390  N    ALA I  58      50.877  34.349  28.688  1.00  28.36      A    N
ATOM  23391  CA   ALA I  58      51.787  33.355  29.139  1.00  28.38      A    C
ATOM  23392  CB   ALA I  58      51.966  33.494  30.573  1.00  28.70      A    C
ATOM  23393  C    ALA I  58      51.266  32.001  28.823  1.00  28.59      A    C
ATOM  23394  O    ALA I  58      51.979  31.128  28.453  1.00  28.44      A    O
ATOM  23395  N    TYR I  59      49.988  31.816  28.972  1.00  28.00      A    N
ATOM  23396  CA   TYR I  59      49.465  30.563  28.588  1.00  27.35      A    C
ATOM  23397  CB   TYR I  59      47.996  30.485  28.917  1.00  28.68      A    C
```

Appendix 1

```
ATOM   23398  CG   TYR I  59      47.342  29.471  28.092  1.00 27.98           A    C
ATOM   23399  CD1  TYR I  59      47.526  28.178  28.355  1.00 28.74           A    C
ATOM   23400  CE1  TYR I  59      46.988  27.257  27.612  1.00 33.35           A    C
ATOM   23401  CZ   TYR I  59      46.263  27.595  26.554  1.00 35.37           A    C
ATOM   23402  OH   TYR I  59      45.734  26.607  25.814  1.00 36.26           A    O
ATOM   23403  CE2  TYR I  59      46.063  28.888  26.244  1.00 35.44           A    C
ATOM   23404  CD2  TYR I  59      46.602  29.815  27.008  1.00 29.11           A    C
ATOM   23405  C    TYR I  59      49.694  30.380  27.106  1.00 27.36           A    C
ATOM   23406  O    TYR I  59      50.056  29.340  26.650  1.00 28.13           A    O
ATOM   23407  N    MET I  60      49.470  31.422  26.348  1.00 26.23           A    N
ATOM   23408  CA   MET I  60      49.643  31.356  24.935  1.00 25.14           A    C
ATOM   23409  CB   MET I  60      49.100  32.618  24.313  1.00 24.38           I    C
ATOM   23410  CG   MET I  60      47.634  32.735  24.393  1.00 24.77           I    C
ATOM   23411  SD   MET I  60      47.024  34.349  24.194  1.00 25.28           I    S
ATOM   23412  CE   MET I  60      47.018  34.501  22.479  1.00 27.48           I    C
ATOM   23413  C    MET I  60      51.082  31.098  24.537  1.00 25.59           A    C
ATOM   23414  O    MET I  60      51.361  30.402  23.627  1.00 25.92           A    O
ATOM   23415  N    ASN I  61      51.997  31.701  25.243  1.00 25.18           A    N
ATOM   23416  CA   ASN I  61      53.374  31.638  24.883  1.00 26.04           A    C
ATOM   23417  CB   ASN I  61      53.914  33.050  24.886  1.00 25.38           A    C
ATOM   23418  CG   ASN I  61      53.448  33.828  23.748  1.00 27.25           A    C
ATOM   23419  OD1  ASN I  61      54.039  33.800  22.717  1.00 26.95           A    O
ATOM   23420  ND2  ASN I  61      52.380  34.529  23.917  1.00 20.65           A    N
ATOM   23421  C    ASN I  61      54.334  30.755  25.657  1.00 26.86           A    C
ATOM   23422  O    ASN I  61      55.299  30.349  25.125  1.00 27.58           A    O
ATOM   23423  N    TYR I  62      54.116  30.533  26.932  1.00 27.19           A    N
ATOM   23424  CA   TYR I  62      55.165  30.015  27.796  1.00 28.54           A    C
ATOM   23425  CB   TYR I  62      54.741  30.237  29.247  1.00 28.06           A    C
ATOM   23426  CG   TYR I  62      55.876  30.270  30.214  1.00 30.50           A    C
ATOM   23427  CD1  TYR I  62      56.332  31.436  30.723  1.00 33.07           A    C
ATOM   23428  CE1  TYR I  62      57.360  31.455  31.567  1.00 32.54           A    C
ATOM   23429  CZ   TYR I  62      57.957  30.314  31.908  1.00 32.67           A    C
ATOM   23430  OH   TYR I  62      59.007  30.312  32.766  1.00 35.82           A    O
ATOM   23431  CE2  TYR I  62      57.517  29.162  31.405  1.00 30.01           A    C
ATOM   23432  CD2  TYR I  62      56.512  29.140  30.579  1.00 28.04           A    C
ATOM   23433  C    TYR I  62      55.718  28.596  27.667  1.00 29.46           A    C
ATOM   23434  O    TYR I  62      56.893  28.410  27.553  1.00 29.81           A    O
ATOM   23435  N    ILE I  63      54.879  27.595  27.789  1.00 29.68           A    N
ATOM   23436  CA   ILE I  63      55.358  26.242  27.834  1.00 29.97           A    C
ATOM   23437  CB   ILE I  63      54.400  25.297  28.502  1.00 29.05           A    C
ATOM   23438  CG1  ILE I  63      54.185  25.735  29.902  1.00 26.65           A    C
ATOM   23439  CD1  ILE I  63      53.178  25.011  30.522  1.00 23.75           A    C
ATOM   23440  CG2  ILE I  63      54.998  23.990  28.642  1.00 28.56           A    C
ATOM   23441  C    ILE I  63      55.803  25.715  26.518  1.00 31.47           A    C
ATOM   23442  O    ILE I  63      55.199  25.923  25.516  1.00 32.64           A    O
ATOM   23443  N    ASP I  64      56.881  24.980  26.555  1.00 33.32           A    N
ATOM   23444  CA   ASP I  64      57.645  24.713  25.389  1.00 35.67           A    C
ATOM   23445  CB   ASP I  64      58.891  23.973  25.754  1.00 36.96           A    C
ATOM   23446  CG   ASP I  64      60.075  24.797  25.621  1.00 40.99           A    C
ATOM   23447  OD1  ASP I  64      59.950  26.010  25.548  1.00 47.19           A    O
ATOM   23448  OD2  ASP I  64      61.145  24.242  25.599  1.00 46.36           A    O
ATOM   23449  C    ASP I  64      57.023  23.977  24.252  1.00 36.12           A    C
ATOM   23450  O    ASP I  64      57.238  24.338  23.152  1.00 37.55           A    O
ATOM   23451  N    PHE I  65      56.295  22.920  24.399  1.00 34.90           A    N
```

Appendix 1

```
ATOM  23452  CA   PHE  I  65   55.933  22.389  23.116  1.00  34.68  A  C
ATOM  23453  CB   PHE  I  65   56.453  20.968  22.998  1.00  33.93  A  C
ATOM  23454  CG   PHE  I  65   57.911  20.907  22.738  1.00  34.73  A  C
ATOM  23455  CD1  PHE  I  65   58.403  21.146  21.499  1.00  34.79  A  C
ATOM  23456  CE1  PHE  I  65   59.700  21.113  21.263  1.00  33.80  A  C
ATOM  23457  CZ   PHE  I  65   60.546  20.863  22.242  1.00  35.55  A  C
ATOM  23458  CE2  PHE  I  65   60.097  20.644  23.482  1.00  36.98  A  C
ATOM  23459  CD2  PHE  I  65   58.789  20.673  23.736  1.00  35.85  A  C
ATOM  23460  C    PHE  I  65   54.486  22.526  22.815  1.00  33.12  A  C
ATOM  23461  O    PHE  I  65   54.061  22.447  21.707  1.00  32.86  A  O
ATOM  23462  N    ILE  I  66   53.754  22.746  23.876  1.00  32.38  A  N
ATOM  23463  CA   ILE  I  66   52.337  22.635  23.909  1.00  32.71  A  C
ATOM  23464  CB   ILE  I  66   51.945  21.797  25.090  1.00  32.62  A  C
ATOM  23465  CG1  ILE  I  66   52.310  22.496  26.352  1.00  30.42  A  C
ATOM  23466  CD1  ILE  I  66   52.003  21.723  27.438  1.00  28.86  A  C
ATOM  23467  CG2  ILE  I  66   52.737  20.562  25.105  1.00  30.82  A  C
ATOM  23468  C    ILE  I  66   51.625  23.943  23.950  1.00  32.89  A  C
ATOM  23469  O    ILE  I  66   50.453  23.981  23.988  1.00  33.35  A  O
ATOM  23470  N    SER  I  67   52.361  25.023  23.956  1.00  32.88  A  N
ATOM  23471  CA   SER  I  67   51.795  26.341  23.809  1.00  32.94  A  C
ATOM  23472  CB   SER  I  67   52.877  27.346  24.062  1.00  33.76  A  C
ATOM  23473  OG   SER  I  67   52.799  27.665  25.379  1.00  41.39  A  O
ATOM  23474  C    SER  I  67   51.251  26.538  22.427  1.00  31.14  A  C
ATOM  23475  O    SER  I  67   51.773  26.004  21.508  1.00  32.22  A  O
ATOM  23476  N    PRO  I  68   50.187  27.283  22.273  1.00  29.81  A  N
ATOM  23477  CA   PRO  I  68   49.632  27.526  20.956  1.00  28.57  A  C
ATOM  23478  CB   PRO  I  68   48.372  28.297  21.265  1.00  29.11  A  C
ATOM  23479  CG   PRO  I  68   48.392  28.556  22.642  1.00  28.47  A  C
ATOM  23480  CD   PRO  I  68   49.246  27.650  23.317  1.00  28.29  A  C
ATOM  23481  C    PRO  I  68   50.591  28.309  20.071  1.00  28.69  A  C
ATOM  23482  O    PRO  I  68   50.716  28.046  18.922  1.00  29.31  A  O
ATOM  23483  N    PHE  I  69   51.294  29.250  20.643  1.00  27.35  A  N
ATOM  23484  CA   PHE  I  69   52.179  30.101  19.905  1.00  28.51  A  C
ATOM  23485  CB   PHE  I  69   51.896  31.569  20.171  1.00  26.31  A  C
ATOM  23486  CG   PHE  I  69   50.589  31.982  19.687  1.00  27.12  A  C
ATOM  23487  CD1  PHE  I  69   50.437  32.493  18.443  1.00  24.84  A  C
ATOM  23488  CE1  PHE  I  69   49.252  32.827  17.985  1.00  26.36  A  C
ATOM  23489  CZ   PHE  I  69   48.183  32.659  18.729  1.00  30.68  A  C
ATOM  23490  CE2  PHE  I  69   48.293  32.130  19.970  1.00  30.60  A  C
ATOM  23491  CD2  PHE  I  69   49.487  31.796  20.442  1.00  27.17  A  C
ATOM  23492  C    PHE  I  69   53.643  29.772  19.984  1.00  29.29  A  C
ATOM  23493  O    PHE  I  69   54.432  30.606  19.750  1.00  31.96  A  O
ATOM  23494  N    TYR  I  70   53.991  28.548  20.303  1.00  28.59  A  N
ATOM  23495  CA   TYR  I  70   55.366  28.127  20.369  1.00  28.76  A  C
ATOM  23496  CB   TYR  I  70   55.449  26.736  21.020  1.00  28.73  A  C
ATOM  23497  CG   TYR  I  70   56.825  26.159  21.001  1.00  28.31  A  C
ATOM  23498  CD1  TYR  I  70   57.767  26.585  21.887  1.00  28.21  A  C
ATOM  23499  CE1  TYR  I  70   59.010  26.109  21.850  1.00  33.02  A  C
ATOM  23500  CZ   TYR  I  70   59.341  25.195  20.929  1.00  31.85  A  C
ATOM  23501  OH   TYR  I  70   60.601  24.728  20.900  1.00  37.10  A  O
ATOM  23502  CE2  TYR  I  70   58.434  24.766  20.039  1.00  28.37  A  C
ATOM  23503  CD2  TYR  I  70   57.200  25.239  20.069  1.00  25.90  A  C
ATOM  23504  C    TYR  I  70   56.186  28.167  19.055  1.00  29.71  A  C
ATOM  23505  O    TYR  I  70   57.300  28.582  19.066  1.00  29.20  A  O
```

Appendix 1

```
ATOM  23506  N    SER I  71      55.643  27.706  17.942  1.00  31.03      A  N
ATOM  23507  CA   SER I  71      56.354  27.730  16.674  1.00  30.78      A  C
ATOM  23508  CB   SER I  71      57.268  26.546  16.505  1.00  31.70      A  C
ATOM  23509  OG   SER I  71      56.575  25.469  16.008  1.00  28.83      A  O
ATOM  23510  C    SER I  71      55.477  27.828  15.472  1.00  31.07      A  C
ATOM  23511  O    SER I  71      54.316  27.664  15.543  1.00  30.45      A  O
ATOM  23512  N    ARG I  72      56.080  28.123  14.350  1.00  32.36      A  N
ATOM  23513  CA   ARG I  72      55.345  28.453  13.178  1.00  33.58      A  C
ATOM  23514  CB   ARG I  72      56.031  29.553  12.388  1.00  34.24      A  C
ATOM  23515  CG   ARG I  72      57.460  29.372  12.116  1.00  37.61      A  C
ATOM  23516  CD   ARG I  72      57.897  30.271  10.998  1.00  47.73      A  C
ATOM  23517  NE   ARG I  72      57.816  31.685  11.330  1.00  51.72      A  N
ATOM  23518  CZ   ARG I  72      58.670  32.592  10.897  1.00  54.06      A  C
ATOM  23519  NH1  ARG I  72      59.659  32.236  10.115  1.00  54.49      A  N
ATOM  23520  NH2  ARG I  72      58.543  33.844  11.251  1.00  53.12      A  N
ATOM  23521  C    ARG I  72      55.072  27.217  12.385  1.00  33.80      A  C
ATOM  23522  O    ARG I  72      54.465  27.233  11.347  1.00  34.42      A  O
ATOM  23523  N    GLY I  73      55.503  26.125  12.962  1.00  34.91      A  N
ATOM  23524  CA   GLY I  73      55.284  24.800  12.453  1.00  35.08      A  C
ATOM  23525  C    GLY I  73      53.875  24.290  12.514  1.00  36.56      A  C
ATOM  23526  O    GLY I  73      53.082  24.717  13.299  1.00  35.31      A  O
ATOM  23527  N    CYS I  74      53.568  23.356  11.648  1.00  37.31      A  N
ATOM  23528  CA   CYS I  74      52.223  22.890  11.576  1.00  38.81      A  C
ATOM  23529  CB   CYS I  74      51.764  22.688  10.104  1.00  39.83      A  C
ATOM  23530  SG   CYS I  74      50.811  24.163   9.439  1.00  48.45      A  S
ATOM  23531  C    CYS I  74      51.971  21.782  12.600  1.00  38.13      A  C
ATOM  23532  O    CYS I  74      51.707  20.668  12.299  1.00  38.35      A  O
ATOM  23533  N    SER I  75      52.094  22.191  13.849  1.00  37.64      A  N
ATOM  23534  CA   SER I  75      51.849  21.428  15.038  1.00  38.16      A  C
ATOM  23535  CB   SER I  75      53.062  21.514  15.912  1.00  38.78      A  C
ATOM  23536  OG   SER I  75      52.778  20.883  17.135  1.00  46.36      A  O
ATOM  23537  C    SER I  75      50.696  21.966  15.861  1.00  36.77      A  C
ATOM  23538  O    SER I  75      50.644  23.121  16.160  1.00  35.14      A  O
ATOM  23539  N    PHE I  76      49.752  21.128  16.223  1.00  35.96      A  N
ATOM  23540  CA   PHE I  76      48.549  21.623  16.865  1.00  35.68      A  C
ATOM  23541  CB   PHE I  76      47.369  21.574  15.919  1.00  34.60      A  C
ATOM  23542  CG   PHE I  76      47.507  22.514  14.819  1.00  32.03      A  C
ATOM  23543  CD1  PHE I  76      47.037  23.774  14.925  1.00  28.75      A  C
ATOM  23544  CE1  PHE I  76      47.211  24.640  13.957  1.00  26.94      A  C
ATOM  23545  CZ   PHE I  76      47.873  24.276  12.862  1.00  31.27      A  C
ATOM  23546  CE2  PHE I  76      48.372  23.047  12.743  1.00  30.83      A  C
ATOM  23547  CD2  PHE I  76      48.191  22.168  13.711  1.00  31.83      A  C
ATOM  23548  C    PHE I  76      48.242  21.062  18.212  1.00  36.41      A  C
ATOM  23549  O    PHE I  76      47.132  20.883  18.546  1.00  36.54      A  O
ATOM  23550  N    GLU I  77      49.285  20.832  18.972  1.00  37.49      A  N
ATOM  23551  CA   GLU I  77      49.246  20.146  20.231  1.00  38.26      A  C
ATOM  23552  CB   GLU I  77      50.658  19.877  20.716  1.00  39.05      A  C
ATOM  23553  CG   GLU I  77      51.588  19.437  19.605  1.00  48.44      A  C
ATOM  23554  CD   GLU I  77      52.227  18.093  19.854  1.00  57.79      A  C
ATOM  23555  OE1  GLU I  77      53.117  18.022  20.705  1.00  60.69      A  O
ATOM  23556  OE2  GLU I  77      51.851  17.109  19.201  1.00  58.52      A  O-1
ATOM  23557  C    GLU I  77      48.438  20.887  21.253  1.00  36.65      A  C
ATOM  23558  O    GLU I  77      47.822  20.304  22.069  1.00  37.10      A  O
ATOM  23559  N    ALA I  78      48.483  22.193  21.199  1.00  35.56      A  N
```

Appendix 1

```
ATOM  23560  CA   ALA I  78     47.843  23.003  22.174  1.00 33.80      A    C
ATOM  23561  CB   ALA I  78     48.076  24.380  21.838  1.00 32.20      A    C
ATOM  23562  C    ALA I  78     46.403  22.735  22.088  1.00 34.45      A    C
ATOM  23563  O    ALA I  78     45.730  22.601  23.072  1.00 34.74      A    O
ATOM  23564  N    TRP I  79     45.962  22.716  20.852  1.00 33.98      A    N
ATOM  23565  CA   TRP I  79     44.619  22.472  20.422  1.00 35.11      A    C
ATOM  23566  CB   TRP I  79     44.494  22.867  18.966  1.00 33.82      A    C
ATOM  23567  CG   TRP I  79     44.500  24.326  18.772  1.00 30.49      A    C
ATOM  23568  CD1  TRP I  79     43.469  25.127  18.883  1.00 28.08      A    C
ATOM  23569  NE1  TRP I  79     43.828  26.392  18.661  1.00 25.74      A    N
ATOM  23570  CE2  TRP I  79     45.152  26.428  18.400  1.00 23.28      A    C
ATOM  23571  CD2  TRP I  79     45.606  25.144  18.459  1.00 23.27      A    C
ATOM  23572  CE3  TRP I  79     46.941  24.905  18.227  1.00 27.72      A    C
ATOM  23573  CZ3  TRP I  79     47.727  25.925  17.941  1.00 29.81      A    C
ATOM  23574  CH2  TRP I  79     47.241  27.200  17.887  1.00 32.50      A    C
ATOM  23575  CZ2  TRP I  79     45.952  27.468  18.118  1.00 26.91      A    C
ATOM  23576  C    TRP I  79     44.109  21.068  20.681  1.00 37.45      A    C
ATOM  23577  O    TRP I  79     42.965  20.872  20.965  1.00 38.23      A    O
ATOM  23578  N    GLU I  80     44.978  20.093  20.520  1.00 38.37      A    N
ATOM  23579  CA   GLU I  80     44.671  18.718  20.796  1.00 39.97      A    C
ATOM  23580  CB   GLU I  80     45.830  17.830  20.371  1.00 41.39      A    C
ATOM  23581  CG   GLU I  80     45.797  17.369  18.955  1.00 45.39      A    C
ATOM  23582  CD   GLU I  80     47.154  17.116  18.372  1.00 50.64      A    C
ATOM  23583  OE1  GLU I  80     48.069  16.721  19.078  1.00 52.14      A    O
ATOM  23584  OE2  GLU I  80     47.303  17.307  17.181  1.00 52.37      A    O-1
ATOM  23585  C    GLU I  80     44.400  18.537  22.257  1.00 39.22      A    C
ATOM  23586  O    GLU I  80     43.553  17.788  22.642  1.00 38.62      A    O
ATOM  23587  N    LEU I  81     45.180  19.213  23.068  1.00 39.08      A    N
ATOM  23588  CA   LEU I  81     44.983  19.232  24.483  1.00 39.89      A    C
ATOM  23589  CB   LEU I  81     46.169  19.868  25.164  1.00 40.28      A    C
ATOM  23590  CG   LEU I  81     47.453  19.064  25.127  1.00 41.72      A    C
ATOM  23591  CD1  LEU I  81     48.586  19.851  25.603  1.00 41.03      A    C
ATOM  23592  CD2  LEU I  81     47.361  17.824  25.877  1.00 39.14      A    C
ATOM  23593  C    LEU I  81     43.722  19.919  24.908  1.00 39.45      A    C
ATOM  23594  O    LEU I  81     43.141  19.546  25.873  1.00 38.98      A    O
ATOM  23595  N    LYS I  82     43.335  20.951  24.186  1.00 38.64      A    N
ATOM  23596  CA   LYS I  82     42.217  21.799  24.529  1.00 38.63      A    C
ATOM  23597  CB   LYS I  82     42.365  23.122  23.806  1.00 38.65      A    C
ATOM  23598  CG   LYS I  82     42.260  24.379  24.590  1.00 39.64      A    C
ATOM  23599  CD   LYS I  82     42.353  25.541  23.629  1.00 41.60      A    C
ATOM  23600  CE   LYS I  82     42.943  26.761  24.207  1.00 40.33      A    C
ATOM  23601  NZ   LYS I  82     41.993  27.798  24.722  1.00 44.19      A    N
ATOM  23602  C    LYS I  82     40.965  21.147  24.068  1.00 38.76      A    C
ATOM  23603  O    LYS I  82     39.896  21.539  24.421  1.00 39.16      A    O
ATOM  23604  N    HIS I  83     41.126  20.154  23.232  1.00 38.55      A    N
ATOM  23605  CA   HIS I  83     40.018  19.452  22.658  1.00 38.11      A    C
ATOM  23606  CB   HIS I  83     39.133  18.936  23.760  1.00 38.51      A    C
ATOM  23607  CG   HIS I  83     39.710  17.764  24.456  1.00 39.94      A    C
ATOM  23608  ND1  HIS I  83     39.941  17.738  25.803  1.00 39.78      A    N
ATOM  23609  CE1  HIS I  83     40.489  16.590  26.121  1.00 44.95      A    C
ATOM  23610  NE2  HIS I  83     40.637  15.880  25.026  1.00 45.89      A    N
ATOM  23611  CD2  HIS I  83     40.158  16.594  23.970  1.00 41.27      A    C
ATOM  23612  C    HIS I  83     39.219  20.159  21.610  1.00 37.54      A    C
ATOM  23613  O    HIS I  83     38.085  19.867  21.433  1.00 37.39      A    O
```

Appendix 1

```
ATOM  23614  N    THR I  84      39.842  21.061  20.885  1.00 36.93      A    N
ATOM  23615  CA   THR I  84      39.209  21.733  19.778  1.00 35.86      A    C
ATOM  23616  CB   THR I  84      40.068  22.859  19.306  1.00 35.99      A    C
ATOM  23617  OG1  THR I  84      40.568  23.542  20.429  1.00 32.18      A    O
ATOM  23618  CG2  THR I  84      39.292  23.796  18.492  1.00 37.42      A    C
ATOM  23619  C    THR I  84      38.992  20.810  18.606  1.00 35.43      A    C
ATOM  23620  O    THR I  84      39.870  20.083  18.228  1.00 34.39      A    O
ATOM  23621  N    PRO I  85      37.808  20.856  18.034  1.00 34.38      A    N
ATOM  23622  CA   PRO I  85      37.520  20.114  16.822  1.00 33.11      A    C
ATOM  23623  CB   PRO I  85      36.034  20.328  16.648  1.00 34.18      A    C
ATOM  23624  CG   PRO I  85      35.543  20.834  17.862  1.00 29.91      A    C
ATOM  23625  CD   PRO I  85      36.603  21.460  18.598  1.00 33.53      A    C
ATOM  23626  C    PRO I  85      38.267  20.762  15.696  1.00 32.56      A    C
ATOM  23627  O    PRO I  85      38.435  21.926  15.769  1.00 32.62      A    O
ATOM  23628  N    GLN I  86      38.659  20.048  14.662  1.00 32.49      A    N
ATOM  23629  CA   GLN I  86      39.482  20.637  13.626  1.00 32.51      A    C
ATOM  23630  CB   GLN I  86      40.031  19.611  12.628  1.00 32.49      A    C
ATOM  23631  CG   GLN I  86      39.354  19.480  11.289  1.00 33.66      A    C
ATOM  23632  CD   GLN I  86      39.597  20.580  10.296  1.00 31.41      A    C
ATOM  23633  OE1  GLN I  86      38.688  21.088   9.723  1.00 36.48      A    O
ATOM  23634  NE2  GLN I  86      40.812  20.895  10.052  1.00 32.56      A    N
ATOM  23635  C    GLN I  86      38.823  21.794  12.951  1.00 31.90      A    C
ATOM  23636  O    GLN I  86      39.446  22.746  12.602  1.00 31.14      A    O
ATOM  23637  N    ARG I  87      37.531  21.703  12.816  1.00 31.54      A    N
ATOM  23638  CA   ARG I  87      36.767  22.673  12.107  1.00 31.35      A    C
ATOM  23639  CB   ARG I  87      35.364  22.175  11.990  1.00 31.10      A    C
ATOM  23640  CG   ARG I  87      35.073  21.598  10.668  1.00 30.76      A    C
ATOM  23641  CD   ARG I  87      33.781  20.952  10.712  1.00 31.31      A    C
ATOM  23642  NE   ARG I  87      33.703  19.801   9.871  1.00 34.64      A    N
ATOM  23643  CZ   ARG I  87      33.493  19.858   8.583  1.00 36.29      A    C
ATOM  23644  NH1  ARG I  87      33.408  21.003   7.990  1.00 34.91      A    N
ATOM  23645  NH2  ARG I  87      33.429  18.767   7.898  1.00 37.75      A    N
ATOM  23646  C    ARG I  87      36.794  24.029  12.744  1.00 31.47      A    C
ATOM  23647  O    ARG I  87      36.521  25.006  12.112  1.00 32.00      A    O
ATOM  23648  N    VAL I  88      37.083  24.075  14.018  1.00 31.77      A    N
ATOM  23649  CA   VAL I  88      37.033  25.308  14.743  1.00 30.70      A    C
ATOM  23650  CB   VAL I  88      36.410  25.082  16.076  1.00 30.69      A    C
ATOM  23651  CG1  VAL I  88      36.866  26.076  17.007  1.00 30.43      A    C
ATOM  23652  CG2  VAL I  88      35.008  25.137  15.972  1.00 29.67      A    C
ATOM  23653  C    VAL I  88      38.388  25.898  14.970  1.00 30.81      A    C
ATOM  23654  O    VAL I  88      38.508  26.885  15.616  1.00 31.78      A    O
ATOM  23655  N    ILE I  89      39.411  25.240  14.479  1.00 28.92      A    N
ATOM  23656  CA   ILE I  89      40.758  25.649  14.729  1.00 26.99      A    C
ATOM  23657  CB   ILE I  89      41.792  24.566  14.363  1.00 27.18      A    C
ATOM  23658  CG1  ILE I  89      41.698  23.411  15.322  1.00 23.91      A    C
ATOM  23659  CD1  ILE I  89      42.482  22.294  14.951  1.00 18.94      A    C
ATOM  23660  CG2  ILE I  89      43.161  25.100  14.467  1.00 24.91      A    C
ATOM  23661  C    ILE I  89      41.027  26.976  14.104  1.00 27.10      A    C
ATOM  23662  O    ILE I  89      41.701  27.769  14.661  1.00 26.25      A    O
ATOM  23663  N    LYS I  90      40.474  27.203  12.934  1.00 25.83      A    N
ATOM  23664  CA   LYS I  90      40.691  28.424  12.208  1.00 25.58      A    C
ATOM  23665  CB   LYS I  90      40.063  28.351  10.820  1.00 26.36      A    C
ATOM  23666  CG   LYS I  90      38.615  28.010  10.808  1.00 23.73      A    C
ATOM  23667  CD   LYS I  90      37.992  28.195   9.502  1.00 23.90      A    C
```

Appendix 1

```
ATOM  23668  CE   LYS I  90      38.382  27.136   8.580  1.00  23.96      A    C
ATOM  23669  NZ   LYS I  90      37.962  25.848   8.996  1.00  20.60      A    N
ATOM  23670  C    LYS I  90      40.182  29.616  12.960  1.00  26.39      A    C
ATOM  23671  O    LYS I  90      40.772  30.648  12.922  1.00  26.72      A    O
ATOM  23672  N    TYR I  91      39.054  29.458  13.615  1.00  25.64      A    N
ATOM  23673  CA   TYR I  91      38.494  30.466  14.460  1.00  27.23      A    C
ATOM  23674  CB   TYR I  91      37.084  30.120  14.835  1.00  28.94      A    C
ATOM  23675  CG   TYR I  91      36.244  29.818  13.675  1.00  31.89      A    C
ATOM  23676  CD1  TYR I  91      36.022  30.745  12.718  1.00  35.11      A    C
ATOM  23677  CE1  TYR I  91      35.271  30.460  11.654  1.00  38.85      A    C
ATOM  23678  CZ   TYR I  91      34.739  29.235  11.531  1.00  40.72      A    C
ATOM  23679  OH   TYR I  91      33.990  28.924  10.462  1.00  48.05      A    O
ATOM  23680  CE2  TYR I  91      34.956  28.299  12.456  1.00  37.17      A    C
ATOM  23681  CD2  TYR I  91      35.702  28.590  13.518  1.00  34.78      A    C
ATOM  23682  C    TYR I  91      39.260  30.795  15.694  1.00  27.81      A    C
ATOM  23683  O    TYR I  91      39.290  31.912  16.092  1.00  28.42      A    O
ATOM  23684  N    SER I  92      39.823  29.783  16.325  1.00  27.15      A    N
ATOM  23685  CA   SER I  92      40.608  29.947  17.502  1.00  24.26      A    C
ATOM  23686  CB   SER I  92      41.052  28.558  17.910  1.00  22.93      A    C
ATOM  23687  OG   SER I  92      41.662  28.526  19.160  1.00  27.04      A    O
ATOM  23688  C    SER I  92      41.806  30.801  17.155  1.00  23.44      A    C
ATOM  23689  O    SER I  92      42.062  31.782  17.744  1.00  22.46      A    O
ATOM  23690  N    ILE I  93      42.490  30.430  16.121  1.00  21.16      A    N
ATOM  23691  CA   ILE I  93      43.631  31.128  15.725  1.00  20.22      A    C
ATOM  23692  CB   ILE I  93      44.198  30.432  14.503  1.00  19.03      A    C
ATOM  23693  CG1  ILE I  93      44.896  29.182  14.882  1.00  17.07      A    C
ATOM  23694  CD1  ILE I  93      45.215  28.411  13.778  1.00  14.49      A    C
ATOM  23695  CG2  ILE I  93      45.119  31.267  13.782  1.00  17.71      A    C
ATOM  23696  C    ILE I  93      43.244  32.542  15.366  1.00  22.15      A    C
ATOM  23697  O    ILE I  93      43.903  33.468  15.712  1.00  22.44      A    O
ATOM  23698  N    ALA I  94      42.164  32.716  14.651  1.00  22.36      A    N
ATOM  23699  CA   ALA I  94      41.778  34.032  14.266  1.00  23.74      A    C
ATOM  23700  CB   ALA I  94      40.628  33.943  13.366  1.00  23.51      A    C
ATOM  23701  C    ALA I  94      41.453  34.952  15.411  1.00  24.79      A    C
ATOM  23702  O    ALA I  94      41.879  36.068  15.428  1.00  24.40      A    O
ATOM  23703  N    PHE I  95      40.684  34.469  16.362  1.00  24.99      A    N
ATOM  23704  CA   PHE I  95      40.365  35.215  17.556  1.00  25.93      A    C
ATOM  23705  CB   PHE I  95      39.164  34.643  18.264  1.00  26.08      A    C
ATOM  23706  CG   PHE I  95      37.934  34.839  17.503  1.00  30.46      A    C
ATOM  23707  CD1  PHE I  95      37.471  36.077  17.260  1.00  34.64      A    C
ATOM  23708  CE1  PHE I  95      36.391  36.260  16.540  1.00  37.48      A    C
ATOM  23709  CZ   PHE I  95      35.766  35.222  16.007  1.00  39.01      A    C
ATOM  23710  CE2  PHE I  95      36.208  34.006  16.202  1.00  37.79      A    C
ATOM  23711  CD2  PHE I  95      37.294  33.810  16.936  1.00  36.02      A    C
ATOM  23712  C    PHE I  95      41.514  35.529  18.466  1.00  26.74      A    C
ATOM  23713  O    PHE I  95      41.555  36.583  19.038  1.00  28.56      A    O
ATOM  23714  N    TYR I  96      42.463  34.628  18.580  1.00  26.45      A    N
ATOM  23715  CA   TYR I  96      43.647  34.926  19.323  1.00  26.98      A    C
ATOM  23716  CB   TYR I  96      44.585  33.754  19.328  1.00  26.66      A    C
ATOM  23717  CG   TYR I  96      44.391  32.811  20.444  1.00  28.63      A    C
ATOM  23718  CD1  TYR I  96      44.181  33.249  21.703  1.00  24.91      A    C
ATOM  23719  CE1  TYR I  96      43.990  32.391  22.688  1.00  28.29      A    C
ATOM  23720  CZ   TYR I  96      44.015  31.066  22.449  1.00  29.03      A    C
ATOM  23721  OH   TYR I  96      43.829  30.166  23.435  1.00  27.58      A    O
```

Appendix 1

```
ATOM  23722  CE2  TYR  I   96      44.219  30.609  21.219  1.00  31.40      A    C
ATOM  23723  CD2  TYR  I   96      44.413  31.466  20.227  1.00  28.47      A    C
ATOM  23724  C    TYR  I   96      44.349  36.058  18.654  1.00  27.98      A    C
ATOM  23725  O    TYR  I   96      44.797  36.945  19.291  1.00  30.26      A    O
ATOM  23726  N    ALA  I   97      44.467  36.019  17.356  1.00  27.23      A    N
ATOM  23727  CA   ALA  I   97      45.148  37.071  16.659  1.00  27.92      A    C
ATOM  23728  CB   ALA  I   97      45.317  36.722  15.244  1.00  26.82      A    C
ATOM  23729  C    ALA  I   97      44.470  38.408  16.780  1.00  28.50      A    C
ATOM  23730  O    ALA  I   97      45.109  39.409  16.833  1.00  26.29      A    O
ATOM  23731  N    TYR  I   98      43.157  38.422  16.751  1.00  29.36      A    N
ATOM  23732  CA   TYR  I   98      42.429  39.662  16.847  1.00  29.97      A    C
ATOM  23733  CB   TYR  I   98      40.933  39.479  16.586  1.00  31.20      A    C
ATOM  23734  CG   TYR  I   98      40.586  38.878  15.250  1.00  31.73      A    C
ATOM  23735  CD1  TYR  I   98      41.467  38.921  14.216  1.00  31.35      A    C
ATOM  23736  CE1  TYR  I   98      41.172  38.375  13.043  1.00  31.22      A    C
ATOM  23737  CZ   TYR  I   98      39.993  37.777  12.871  1.00  33.69      A    C
ATOM  23738  OH   TYR  I   98      39.736  37.239  11.663  1.00  33.23      A    O
ATOM  23739  CE2  TYR  I   98      39.089  37.727  13.869  1.00  26.99      A    C
ATOM  23740  CD2  TYR  I   98      39.383  38.271  15.041  1.00  27.05      A    C
ATOM  23741  C    TYR  I   98      42.656  40.295  18.179  1.00  29.64      A    C
ATOM  23742  O    TYR  I   98      42.738  41.468  18.284  1.00  30.94      A    O
ATOM  23743  N    GLY  I   99      42.710  39.488  19.207  1.00  28.21      A    N
ATOM  23744  CA   GLY  I   99      43.092  39.924  20.514  1.00  28.31      A    C
ATOM  23745  C    GLY  I   99      44.510  40.393  20.664  1.00  29.18      A    C
ATOM  23746  O    GLY  I   99      44.815  41.318  21.347  1.00  29.05      A    O
ATOM  23747  N    LEU  I  100      45.389  39.708  19.997  1.00  29.51      A    N
ATOM  23748  CA   LEU  I  100      46.778  40.019  20.023  1.00  31.04      A    C
ATOM  23749  CB   LEU  I  100      47.504  39.017  19.172  1.00  31.45      A    C
ATOM  23750  CG   LEU  I  100      48.351  37.918  19.758  1.00  33.91      A    C
ATOM  23751  CD1  LEU  I  100      48.234  37.771  21.219  1.00  30.48      A    C
ATOM  23752  CD2  LEU  I  100      48.126  36.643  19.044  1.00  32.65      A    C
ATOM  23753  C    LEU  I  100      47.009  41.393  19.471  1.00  31.39      A    C
ATOM  23754  O    LEU  I  100      47.854  42.082  19.919  1.00  33.14      A    O
ATOM  23755  N    ALA  I  101      46.248  41.769  18.474  1.00  30.77      A    N
ATOM  23756  CA   ALA  I  101      46.355  43.057  17.850  1.00  29.98      A    C
ATOM  23757  CB   ALA  I  101      45.578  43.100  16.571  1.00  29.57      A    C
ATOM  23758  C    ALA  I  101      46.022  44.226  18.735  1.00  30.05      A    C
ATOM  23759  O    ALA  I  101      46.638  45.231  18.643  1.00  29.83      A    O
ATOM  23760  N    SER  I  102      45.036  44.096  19.581  1.00  29.64      A    N
ATOM  23761  CA   SER  I  102      44.742  45.085  20.583  1.00  31.58      A    C
ATOM  23762  CB   SER  I  102      43.408  44.831  21.215  1.00  31.54      A    C
ATOM  23763  OG   SER  I  102      42.394  45.083  20.308  1.00  33.22      A    O
ATOM  23764  C    SER  I  102      45.826  45.236  21.619  1.00  33.17      A    C
ATOM  23765  O    SER  I  102      46.113  46.315  22.050  1.00  34.55      A    O
ATOM  23766  N    VAL  I  103      46.457  44.138  21.986  1.00  33.10      A    N
ATOM  23767  CA   VAL  I  103      47.548  44.155  22.930  1.00  32.34      A    C
ATOM  23768  CB   VAL  I  103      48.064  42.761  23.244  1.00  32.53      A    C
ATOM  23769  CG1  VAL  I  103      49.409  42.824  23.852  1.00  30.75      A    C
ATOM  23770  CG2  VAL  I  103      47.154  42.066  24.157  1.00  32.06      A    C
ATOM  23771  C    VAL  I  103      48.659  44.999  22.368  1.00  32.49      A    C
ATOM  23772  O    VAL  I  103      49.298  45.725  23.071  1.00  32.55      A    O
ATOM  23773  N    ALA  I  104      48.857  44.917  21.079  1.00  31.40      A    N
ATOM  23774  CA   ALA  I  104      49.838  45.711  20.424  1.00  32.59      A    C
ATOM  23775  CB   ALA  I  104      49.852  45.368  19.028  1.00  31.21      A    C
```

Appendix 1

```
ATOM  23776  C    ALA I 104      49.528  47.180  20.594  1.00 34.02      A  C
ATOM  23777  O    ALA I 104      50.382  47.968  20.850  1.00 32.01      A  O
ATOM  23778  N    LEU I 105      48.273  47.534  20.456  1.00 37.51      A  N
ATOM  23779  CA   LEU I 105      47.856  48.867  20.744  1.00 40.59      A  C
ATOM  23780  CB   LEU I 105      46.378  48.953  20.385  1.00 40.34      A  C
ATOM  23781  CG   LEU I 105      45.713  50.232  19.924  1.00 42.42      A  C
ATOM  23782  CD1  LEU I 105      46.649  51.026  19.142  1.00 42.29      A  C
ATOM  23783  CD2  LEU I 105      44.537  49.945  19.106  1.00 41.22      A  C
ATOM  23784  C    LEU I 105      48.052  49.266  22.209  1.00 41.61      A  C
ATOM  23785  O    LEU I 105      48.626  50.271  22.484  1.00 41.62      A  O
ATOM  23786  N    ILE I 106      47.598  48.451  23.141  1.00 43.04      A  N
ATOM  23787  CA   ILE I 106      47.658  48.774  24.551  1.00 43.90      A  C
ATOM  23788  CB   ILE I 106      47.067  47.633  25.341  1.00 43.26      A  C
ATOM  23789  CG1  ILE I 106      45.588  47.526  25.124  1.00 44.18      A  C
ATOM  23790  CD1  ILE I 106      45.046  46.314  25.730  1.00 44.42      A  C
ATOM  23791  CG2  ILE I 106      47.317  47.803  26.769  1.00 43.05      A  C
ATOM  23792  C    ILE I 106      49.031  48.962  25.174  1.00 45.00      A  C
ATOM  23793  O    ILE I 106      49.237  49.910  25.877  1.00 45.15      A  O
ATOM  23794  N    ASP I 107      49.946  48.032  24.959  1.00 45.72      A  N
ATOM  23795  CA   ASP I 107      51.288  48.164  25.470  1.00 46.07      A  C
ATOM  23796  CB   ASP I 107      51.587  47.090  26.489  1.00 46.45      A  C
ATOM  23797  CG   ASP I 107      52.797  47.413  27.323  1.00 51.15      A  C
ATOM  23798  OD1  ASP I 107      53.725  48.041  26.831  1.00 51.13      A  O
ATOM  23799  OD2  ASP I 107      52.841  47.025  28.481  1.00 57.03      A  O-1
ATOM  23800  C    ASP I 107      52.305  48.095  24.379  1.00 45.64      A  C
ATOM  23801  O    ASP I 107      52.449  47.127  23.734  1.00 45.24      A  O
ATOM  23802  N    PRO I 108      53.021  49.168  24.201  1.00 45.89      A  N
ATOM  23803  CA   PRO I 108      54.050  49.260  23.193  1.00 45.58      A  C
ATOM  23804  CB   PRO I 108      54.472  50.713  23.285  1.00 46.31      A  C
ATOM  23805  CG   PRO I 108      53.396  51.376  23.935  1.00 46.70      A  C
ATOM  23806  CD   PRO I 108      52.844  50.442  24.886  1.00 46.28      A  C
ATOM  23807  C    PRO I 108      55.181  48.325  23.505  1.00 44.31      A  C
ATOM  23808  O    PRO I 108      55.906  47.894  22.644  1.00 44.76      A  O
ATOM  23809  N    LYS I 109      55.318  48.047  24.778  1.00 42.43      A  N
ATOM  23810  CA   LYS I 109      56.337  47.192  25.310  1.00 41.50      A  C
ATOM  23811  CB   LYS I 109      56.294  47.258  26.811  1.00 42.49      A  C
ATOM  23812  CG   LYS I 109      57.440  47.970  27.405  1.00 45.13      A  C
ATOM  23813  CD   LYS I 109      57.002  48.718  28.604  1.00 54.77      A  C
ATOM  23814  CE   LYS I 109      56.022  47.899  29.442  1.00 58.52      A  C
ATOM  23815  NZ   LYS I 109      55.726  48.479  30.787  1.00 57.01      A  N
ATOM  23816  C    LYS I 109      56.161  45.788  24.837  1.00 40.01      A  C
ATOM  23817  O    LYS I 109      57.087  45.072  24.613  1.00 39.71      A  O
ATOM  23818  N    LEU I 110      54.918  45.412  24.686  1.00 39.28      A  N
ATOM  23819  CA   LEU I 110      54.540  44.114  24.224  1.00 36.46      A  C
ATOM  23820  CB   LEU I 110      53.327  43.650  25.000  1.00 35.64      A  C
ATOM  23821  CG   LEU I 110      53.453  43.358  26.469  1.00 32.52      A  C
ATOM  23822  CD1  LEU I 110      52.148  43.088  27.044  1.00 31.33      A  C
ATOM  23823  CD2  LEU I 110      54.252  42.192  26.603  1.00 30.76      A  C
ATOM  23824  C    LEU I 110      54.237  44.042  22.735  1.00 35.93      A  C
ATOM  23825  O    LEU I 110      53.704  43.085  22.296  1.00 37.52      A  O
ATOM  23826  N    ARG I 111      54.514  45.079  21.977  1.00 34.53      A  N
ATOM  23827  CA   ARG I 111      54.217  45.070  20.567  1.00 33.28      A  C
ATOM  23828  CB   ARG I 111      54.309  46.467  19.972  1.00 33.55      A  C
ATOM  23829  CG   ARG I 111      53.525  46.642  18.696  1.00 34.03      A  C
```

Appendix 1

```
ATOM  23830  CD   ARG I 111    53.421  48.052  18.251  1.00 34.74    A    C
ATOM  23831  NE   ARG I 111    53.201  48.183  16.822  1.00 38.90    A    N
ATOM  23832  CZ   ARG I 111    52.635  49.225  16.244  1.00 39.57    A    C
ATOM  23833  NH1  ARG I 111    52.207  50.230  16.957  1.00 39.28    A    N
ATOM  23834  NH2  ARG I 111    52.478  49.254  14.961  1.00 33.39    A    N
ATOM  23835  C    ARG I 111    55.027  44.056  19.792  1.00 32.30    A    C
ATOM  23836  O    ARG I 111    54.529  43.431  18.912  1.00 31.72    A    O
ATOM  23837  N    ALA I 112    56.285  43.897  20.131  1.00 31.04    A    N
ATOM  23838  CA   ALA I 112    57.110  42.938  19.463  1.00 29.53    A    C
ATOM  23839  CB   ALA I 112    58.485  43.056  19.927  1.00 27.54    A    C
ATOM  23840  C    ALA I 112    56.609  41.541  19.687  1.00 30.67    A    C
ATOM  23841  O    ALA I 112    56.598  40.748  18.788  1.00 30.26    A    O
ATOM  23842  N    LEU I 113    56.192  41.231  20.894  1.00 29.93    A    N
ATOM  23843  CA   LEU I 113    55.725  39.910  21.153  1.00 29.70    A    C
ATOM  23844  CB   LEU I 113    55.435  39.781  22.636  1.00 29.31    A    C
ATOM  23845  CG   LEU I 113    54.848  38.476  23.095  1.00 30.21    A    C
ATOM  23846  CD1  LEU I 113    55.810  37.390  22.977  1.00 32.85    A    C
ATOM  23847  CD2  LEU I 113    54.355  38.579  24.432  1.00 29.87    A    C
ATOM  23848  C    LEU I 113    54.501  39.577  20.347  1.00 29.99    A    C
ATOM  23849  O    LEU I 113    54.421  38.575  19.708  1.00 29.61    A    O
ATOM  23850  N    ALA I 114    53.549  40.467  20.388  1.00 29.39    A    N
ATOM  23851  CA   ALA I 114    52.299  40.278  19.756  1.00 28.07    A    C
ATOM  23852  CB   ALA I 114    51.448  41.404  20.053  1.00 27.42    A    C
ATOM  23853  C    ALA I 114    52.490  40.135  18.279  1.00 27.82    A    C
ATOM  23854  O    ALA I 114    51.807  39.391  17.651  1.00 28.23    A    O
ATOM  23855  N    GLY I 115    53.412  40.874  17.728  1.00 26.42    A    N
ATOM  23856  CA   GLY I 115    53.743  40.718  16.350  1.00 25.86    A    C
ATOM  23857  C    GLY I 115    54.325  39.386  16.073  1.00 26.52    A    C
ATOM  23858  O    GLY I 115    54.013  38.753  15.135  1.00 27.55    A    O
ATOM  23859  N    HIS I 116    55.210  38.953  16.923  1.00 26.96    A    N
ATOM  23860  CA   HIS I 116    55.779  37.667  16.752  1.00 25.04    A    C
ATOM  23861  CB   HIS I 116    56.901  37.477  17.738  1.00 23.46    A    C
ATOM  23862  CG   HIS I 116    57.208  36.059  18.027  1.00 26.51    A    C
ATOM  23863  ND1  HIS I 116    57.847  35.252  17.132  1.00 27.02    A    N
ATOM  23864  CE1  HIS I 116    57.960  34.053  17.637  1.00 23.12    A    C
ATOM  23865  NE2  HIS I 116    57.407  34.053  18.822  1.00 22.85    A    N
ATOM  23866  CD2  HIS I 116    56.934  35.294  19.092  1.00 22.71    A    C
ATOM  23867  C    HIS I 116    54.700  36.629  16.866  1.00 24.76    A    C
ATOM  23868  O    HIS I 116    54.663  35.741  16.105  1.00 24.58    A    O
ATOM  23869  N    ASP I 117    53.786  36.766  17.792  1.00 25.22    A    N
ATOM  23870  CA   ASP I 117    52.660  35.848  17.858  1.00 26.89    A    C
ATOM  23871  CB   ASP I 117    51.814  36.117  19.072  1.00 25.49    A    C
ATOM  23872  CG   ASP I 117    52.447  35.700  20.285  1.00 28.15    A    C
ATOM  23873  OD1  ASP I 117    53.451  35.051  20.209  1.00 30.42    A    O
ATOM  23874  OD2  ASP I 117    51.953  36.013  21.329  1.00 27.62    A    O-1
ATOM  23875  C    ASP I 117    51.748  35.856  16.630  1.00 28.23    A    C
ATOM  23876  O    ASP I 117    51.304  34.845  16.192  1.00 28.82    A    O
ATOM  23877  N    LEU I 118    51.504  37.028  16.086  1.00 28.49    A    N
ATOM  23878  CA   LEU I 118    50.736  37.226  14.889  1.00 29.44    A    C
ATOM  23879  CB   LEU I 118    50.655  38.708  14.578  1.00 27.73    A    C
ATOM  23880  CG   LEU I 118    49.370  39.486  14.694  1.00 27.99    A    C
ATOM  23881  CD1  LEU I 118    48.357  38.730  15.374  1.00 26.14    A    C
ATOM  23882  CD2  LEU I 118    49.609  40.725  15.408  1.00 24.75    A    C
ATOM  23883  C    LEU I 118    51.391  36.542  13.733  1.00 30.93    A    C
```

Appendix 1

```
ATOM  23884  O    LEU I 118    50.754  36.015  12.870  1.00 30.43    A  O
ATOM  23885  N    ASP I 119    52.697  36.580  13.718  1.00 31.76    A  N
ATOM  23886  CA   ASP I 119    53.466  35.898  12.718  1.00 32.57    A  C
ATOM  23887  CB   ASP I 119    54.910  36.304  12.902  1.00 32.61    A  C
ATOM  23888  CG   ASP I 119    55.812  35.592  12.007  1.00 38.71    A  C
ATOM  23889  OD1  ASP I 119    55.319  35.011  11.081  1.00 41.90    A  O
ATOM  23890  OD2  ASP I 119    57.009  35.590  12.210  1.00 50.54    A  O-1
ATOM  23891  C    ASP I 119    53.301  34.386  12.778  1.00 32.34    A  C
ATOM  23892  O    ASP I 119    53.158  33.731  11.792  1.00 32.26    A  O
ATOM  23893  N    ILE I 120    53.337  33.839  13.965  1.00 32.02    A  N
ATOM  23894  CA   ILE I 120    53.065  32.455  14.179  1.00 31.41    A  C
ATOM  23895  CB   ILE I 120    53.342  32.077  15.573  1.00 31.44    A  C
ATOM  23896  CG1  ILE I 120    54.813  31.841  15.744  1.00 30.90    A  C
ATOM  23897  CD1  ILE I 120    55.250  31.904  17.075  1.00 27.60    A  C
ATOM  23898  CG2  ILE I 120    52.568  30.860  15.915  1.00 32.10    A  C
ATOM  23899  C    ILE I 120    51.652  32.053  13.857  1.00 31.32    A  C
ATOM  23900  O    ILE I 120    51.410  30.967  13.432  1.00 31.72    A  O
ATOM  23901  N    ALA I 121    50.719  32.923  14.153  1.00 30.14    A  N
ATOM  23902  CA   ALA I 121    49.345  32.678  13.875  1.00 30.08    A  C
ATOM  23903  CB   ALA I 121    48.519  33.750  14.483  1.00 30.57    A  C
ATOM  23904  C    ALA I 121    49.052  32.580  12.418  1.00 30.03    A  C
ATOM  23905  O    ALA I 121    48.358  31.717  12.001  1.00 30.57    A  O
ATOM  23906  N    VAL I 122    49.587  33.480  11.639  1.00 30.44    A  N
ATOM  23907  CA   VAL I 122    49.378  33.448  10.238  1.00 30.13    A  C
ATOM  23908  CB   VAL I 122    50.073  34.571   9.600  1.00 30.08    A  C
ATOM  23909  CG1  VAL I 122    50.261  34.303   8.175  1.00 30.38    A  C
ATOM  23910  CG2  VAL I 122    49.287  35.760   9.766  1.00 30.82    A  C
ATOM  23911  C    VAL I 122    49.944  32.202   9.655  1.00 31.82    A  C
ATOM  23912  O    VAL I 122    49.374  31.648   8.776  1.00 31.86    A  O
ATOM  23913  N    SER I 123    51.095  31.788  10.134  1.00 32.48    A  N
ATOM  23914  CA   SER I 123    51.762  30.599   9.688  1.00 33.07    A  C
ATOM  23915  CB   SER I 123    53.037  30.500  10.474  1.00 34.79    A  C
ATOM  23916  OG   SER I 123    54.065  29.923   9.745  1.00 36.00    A  O
ATOM  23917  C    SER I 123    50.986  29.341   9.960  1.00 33.48    A  C
ATOM  23918  O    SER I 123    50.910  28.466   9.157  1.00 33.33    A  O
ATOM  23919  N    LYS I 124    50.448  29.242  11.146  1.00 33.23    A  N
ATOM  23920  CA   LYS I 124    49.615  28.128  11.520  1.00 32.77    A  C
ATOM  23921  CB   LYS I 124    49.381  28.081  13.013  1.00 31.55    A  C
ATOM  23922  CG   LYS I 124    50.474  27.467  13.765  1.00 29.97    A  C
ATOM  23923  CD   LYS I 124    50.179  27.494  15.175  1.00 29.55    A  C
ATOM  23924  CE   LYS I 124    51.214  26.821  15.941  1.00 32.31    A  C
ATOM  23925  NZ   LYS I 124    51.764  25.697  15.236  1.00 34.31    A  N
ATOM  23926  C    LYS I 124    48.315  28.052  10.764  1.00 33.65    A  C
ATOM  23927  O    LYS I 124    47.813  26.997  10.510  1.00 34.44    A  O
ATOM  23928  N    MET I 125    47.761  29.195  10.441  1.00 32.96    A  N
ATOM  23929  CA   MET I 125    46.502  29.284   9.782  1.00 32.98    A  C
ATOM  23930  CB   MET I 125    46.093  30.737   9.687  1.00 32.93    I  C
ATOM  23931  CG   MET I 125    44.701  30.973   9.313  1.00 32.97    I  C
ATOM  23932  SD   MET I 125    43.500  30.464  10.453  1.00 33.10    I  S
ATOM  23933  CE   MET I 125    42.113  31.222   9.786  1.00 28.62    I  C
ATOM  23934  C    MET I 125    46.563  28.634   8.430  1.00 32.55    A  C
ATOM  23935  O    MET I 125    45.615  28.124   7.969  1.00 32.63    A  O
ATOM  23936  N    LYS I 126    47.724  28.654   7.822  1.00 33.01    A  N
ATOM  23937  CA   LYS I 126    47.940  28.196   6.485  1.00 32.31    A  C
```

Appendix 1

```
ATOM  23938  CB   LYS I 126     49.116  28.951   5.898  1.00  32.49      A  C
ATOM  23939  CG   LYS I 126     48.814  30.317   5.391  1.00  34.46      A  C
ATOM  23940  CD   LYS I 126     50.021  31.203   5.321  1.00  38.64      A  C
ATOM  23941  CE   LYS I 126     50.940  30.890   4.169  1.00  43.11      A  C
ATOM  23942  NZ   LYS I 126     51.327  32.068   3.346  1.00  44.43      A  N
ATOM  23943  C    LYS I 126     48.205  26.724   6.433  1.00  33.10      A  C
ATOM  23944  O    LYS I 126     48.251  26.135   5.400  1.00  33.76      A  O
ATOM  23945  N    CYS I 127     48.391  26.117   7.571  1.00  33.63      A  N
ATOM  23946  CA   CYS I 127     48.614  24.699   7.640  1.00  35.48      A  C
ATOM  23947  CB   CYS I 127     49.052  24.334   9.047  1.00  36.84      A  C
ATOM  23948  SG   CYS I 127     50.779  24.283   9.398  1.00  43.35      A  S
ATOM  23949  C    CYS I 127     47.365  23.934   7.239  1.00  34.52      A  C
ATOM  23950  O    CYS I 127     46.299  24.328   7.539  1.00  33.57      A  O
ATOM  23951  N    LYS I 128     47.516  22.824   6.558  1.00  34.82      A  N
ATOM  23952  CA   LYS I 128     46.395  22.076   6.034  1.00  35.13      A  C
ATOM  23953  CB   LYS I 128     46.843  21.110   4.950  1.00  35.89      A  C
ATOM  23954  CG   LYS I 128     45.896  20.004   4.695  1.00  37.21      A  C
ATOM  23955  CD   LYS I 128     45.750  19.713   3.254  1.00  39.07      A  C
ATOM  23956  CE   LYS I 128     45.685  18.260   3.045  1.00  43.84      A  C
ATOM  23957  NZ   LYS I 128     45.060  17.903   1.776  1.00  44.97      A  N
ATOM  23958  C    LYS I 128     45.522  21.395   7.071  1.00  33.95      A  C
ATOM  23959  O    LYS I 128     44.412  21.050   6.815  1.00  34.70      A  O
ATOM  23960  N    ARG I 129     46.027  21.215   8.253  1.00  31.58      A  N
ATOM  23961  CA   ARG I 129     45.190  20.791   9.313  1.00  30.52      A  C
ATOM  23962  CB   ARG I 129     46.018  20.598  10.555  1.00  29.43      A  C
ATOM  23963  CG   ARG I 129     45.276  20.472  11.815  1.00  31.61      A  C
ATOM  23964  CD   ARG I 129     44.679  19.154  11.924  1.00  33.97      A  C
ATOM  23965  NE   ARG I 129     43.856  18.976  13.088  1.00  32.99      A  N
ATOM  23966  CZ   ARG I 129     42.978  18.007  13.191  1.00  35.52      A  C
ATOM  23967  NH1  ARG I 129     42.837  17.178  12.199  1.00  36.21      A  N
ATOM  23968  NH2  ARG I 129     42.250  17.857  14.262  1.00  28.78      A  N
ATOM  23969  C    ARG I 129     44.136  21.829   9.546  1.00  30.89      A  C
ATOM  23970  O    ARG I 129     43.027  21.511   9.841  1.00  30.27      A  O
ATOM  23971  N    VAL I 130     44.490  23.086   9.471  1.00  31.76      A  N
ATOM  23972  CA   VAL I 130     43.489  24.109   9.618  1.00  32.36      A  C
ATOM  23973  CB   VAL I 130     44.088  25.484   9.805  1.00  32.51      A  C
ATOM  23974  CG1  VAL I 130     43.027  26.458   9.891  1.00  32.07      A  C
ATOM  23975  CG2  VAL I 130     44.878  25.539  11.027  1.00  33.96      A  C
ATOM  23976  C    VAL I 130     42.470  24.224   8.515  1.00  33.09      A  C
ATOM  23977  O    VAL I 130     41.318  24.312   8.776  1.00  33.74      A  O
ATOM  23978  N    TRP I 131     42.896  24.255   7.276  1.00  32.26      A  N
ATOM  23979  CA   TRP I 131     41.974  24.465   6.200  1.00  33.08      A  C
ATOM  23980  CB   TRP I 131     42.545  25.414   5.178  1.00  34.13      A  C
ATOM  23981  CG   TRP I 131     43.762  24.968   4.507  1.00  37.05      A  C
ATOM  23982  CD1  TRP I 131     44.990  25.308   4.826  1.00  41.11      A  C
ATOM  23983  NE1  TRP I 131     45.872  24.737   3.999  1.00  43.79      A  N
ATOM  23984  CE2  TRP I 131     45.200  23.983   3.098  1.00  42.40      A  C
ATOM  23985  CD2  TRP I 131     43.867  24.109   3.384  1.00  41.66      A  C
ATOM  23986  CE3  TRP I 131     42.949  23.436   2.586  1.00  45.70      A  C
ATOM  23987  CZ3  TRP I 131     43.406  22.681   1.577  1.00  43.52      A  C
ATOM  23988  CH2  TRP I 131     44.746  22.569   1.332  1.00  44.78      A  C
ATOM  23989  CZ2  TRP I 131     45.658  23.224   2.072  1.00  42.09      A  C
ATOM  23990  C    TRP I 131     41.479  23.229   5.512  1.00  33.86      A  C
ATOM  23991  O    TRP I 131     40.744  23.315   4.608  1.00  33.84      A  O
```

Appendix 1

```
ATOM  23992  N    GLY I 132    41.868  22.062   5.958  1.00 34.37    A  N
ATOM  23993  CA   GLY I 132    41.638  20.832   5.252  1.00 32.95    A  C
ATOM  23994  C    GLY I 132    40.248  20.280   5.212  1.00 33.65    A  C
ATOM  23995  O    GLY I 132    39.998  19.323   4.578  1.00 33.33    A  O
ATOM  23996  N    ASP I 133    39.353  20.866   5.953  1.00 33.82    A  N
ATOM  23997  CA   ASP I 133    38.004  20.410   5.921  1.00 34.43    A  C
ATOM  23998  CB   ASP I 133    37.145  21.150   6.928  1.00 34.15    A  C
ATOM  23999  CG   ASP I 133    37.500  22.579   7.046  1.00 36.67    A  C
ATOM  24000  OD1  ASP I 133    36.699  23.421   6.680  1.00 39.39    A  O
ATOM  24001  OD2  ASP I 133    38.580  22.875   7.493  1.00 42.57    A  O-1
ATOM  24002  C    ASP I 133    37.521  20.639   4.514  1.00 35.04    A  C
ATOM  24003  O    ASP I 133    36.746  19.896   3.998  1.00 32.49    A  O
ATOM  24004  N    TRP I 134    38.015  21.690   3.904  1.00 34.99    A  N
ATOM  24005  CA   TRP I 134    37.528  22.116   2.633  1.00 36.62    A  C
ATOM  24006  CB   TRP I 134    38.251  23.382   2.232  1.00 36.01    A  C
ATOM  24007  CG   TRP I 134    37.884  23.959   0.920  1.00 37.64    A  C
ATOM  24008  CD1  TRP I 134    38.618  23.937  -0.211  1.00 34.73    A  C
ATOM  24009  NE1  TRP I 134    37.975  24.571  -1.198  1.00 34.02    A  N
ATOM  24010  CE2  TRP I 134    36.796  25.047  -0.716  1.00 34.12    A  C
ATOM  24011  CD2  TRP I 134    36.709  24.670   0.611  1.00 34.30    A  C
ATOM  24012  CE3  TRP I 134    35.594  25.033   1.334  1.00 33.04    A  C
ATOM  24013  CZ3  TRP I 134    34.638  25.737   0.731  1.00 32.33    A  C
ATOM  24014  CH2  TRP I 134    34.732  26.086  -0.586  1.00 36.50    A  C
ATOM  24015  CZ2  TRP I 134    35.810  25.757  -1.333  1.00 36.88    A  C
ATOM  24016  C    TRP I 134    37.753  21.085   1.606  1.00 37.25    A  C
ATOM  24017  O    TRP I 134    36.925  20.867   0.787  1.00 36.28    A  O
ATOM  24018  N    GLU I 135    38.932  20.511   1.613  1.00 40.34    A  N
ATOM  24019  CA   GLU I 135    39.262  19.395   0.769  1.00 42.96    A  C
ATOM  24020  CB   GLU I 135    40.748  19.166   0.780  1.00 42.65    A  C
ATOM  24021  CG   GLU I 135    41.289  19.081  -0.576  1.00 48.19    A  C
ATOM  24022  CD   GLU I 135    42.653  18.495  -0.623  1.00 54.45    A  C
ATOM  24023  OE1  GLU I 135    43.629  19.246  -0.640  1.00 55.59    A  O
ATOM  24024  OE2  GLU I 135    42.759  17.282  -0.691  1.00 56.74    A  O-1
ATOM  24025  C    GLU I 135    38.547  18.118   1.106  1.00 43.35    A  C
ATOM  24026  O    GLU I 135    38.153  17.387   0.245  1.00 44.16    A  O
ATOM  24027  N    GLU I 136    38.451  17.832   2.382  1.00 44.20    A  N
ATOM  24028  CA   GLU I 136    37.833  16.636   2.880  1.00 45.73    A  C
ATOM  24029  CB   GLU I 136    38.113  16.476   4.359  1.00 46.21    A  C
ATOM  24030  CG   GLU I 136    38.837  15.211   4.726  1.00 52.73    A  C
ATOM  24031  CD   GLU I 136    40.340  15.378   4.907  1.00 63.15    A  C
ATOM  24032  OE1  GLU I 136    40.821  15.229   6.043  1.00 62.20    A  O
ATOM  24033  OE2  GLU I 136    41.054  15.640   3.919  1.00 66.60    A  O-1
ATOM  24034  C    GLU I 136    36.356  16.604   2.562  1.00 45.08    A  C
ATOM  24035  O    GLU I 136    35.804  15.568   2.359  1.00 45.53    A  O
ATOM  24036  N    ASP I 137    35.741  17.762   2.469  1.00 44.01    A  N
ATOM  24037  CA   ASP I 137    34.327  17.890   2.209  1.00 43.31    A  C
ATOM  24038  CB   ASP I 137    33.779  19.157   2.818  1.00 42.90    A  C
ATOM  24039  CG   ASP I 137    33.670  19.077   4.276  1.00 44.98    A  C
ATOM  24040  OD1  ASP I 137    33.747  17.977   4.799  1.00 44.12    A  O
ATOM  24041  OD2  ASP I 137    33.517  20.114   4.903  1.00 48.80    A  O-1
ATOM  24042  C    ASP I 137    34.002  17.914   0.747  1.00 43.50    A  C
ATOM  24043  O    ASP I 137    32.873  18.018   0.387  1.00 42.82    A  O
ATOM  24044  N    GLY I 138    35.015  17.821  -0.084  1.00 44.17    A  N
ATOM  24045  CA   GLY I 138    34.869  17.738  -1.513  1.00 44.14    A  C
```

Appendix 1

```
ATOM  24046  C    GLY I 138      34.829  19.037  -2.252  1.00 45.85      A    C
ATOM  24047  O    GLY I 138      34.586  19.073  -3.418  1.00 45.90      A    O
ATOM  24048  N    PHE I 139      34.995  20.124  -1.550  1.00 46.81      A    N
ATOM  24049  CA   PHE I 139      34.960  21.406  -2.200  1.00 46.89      A    C
ATOM  24050  CB   PHE I 139      34.597  22.468  -1.202  1.00 46.20      A    C
ATOM  24051  CG   PHE I 139      33.275  22.254  -0.629  1.00 47.04      A    C
ATOM  24052  CD1  PHE I 139      32.224  21.980  -1.430  1.00 48.23      A    C
ATOM  24053  CE1  PHE I 139      31.012  21.775  -0.925  1.00 46.93      A    C
ATOM  24054  CZ   PHE I 139      30.825  21.802   0.378  1.00 47.75      A    C
ATOM  24055  CE2  PHE I 139      31.851  22.049   1.196  1.00 48.20      A    C
ATOM  24056  CD2  PHE I 139      33.074  22.269   0.699  1.00 48.81      A    C
ATOM  24057  C    PHE I 139      36.073  21.812  -3.116  1.00 47.14      A    C
ATOM  24058  O    PHE I 139      35.825  22.469  -4.088  1.00 47.93      A    O
ATOM  24059  N    GLY I 140      37.301  21.524  -2.757  1.00 46.85      A    N
ATOM  24060  CA   GLY I 140      38.410  21.883  -3.600  1.00 46.77      A    C
ATOM  24061  C    GLY I 140      39.700  21.349  -3.078  1.00 47.11      A    C
ATOM  24062  O    GLY I 140      39.770  20.924  -1.957  1.00 48.39      A    O
ATOM  24063  N    THR I 141      40.734  21.406  -3.882  1.00 46.70      A    N
ATOM  24064  CA   THR I 141      42.053  21.189  -3.370  1.00 45.93      A    C
ATOM  24065  CB   THR I 141      42.968  20.516  -4.391  1.00 45.97      A    C
ATOM  24066  OG1  THR I 141      43.083  21.325  -5.551  1.00 46.14      A    O
ATOM  24067  CG2  THR I 141      42.404  19.230  -4.807  1.00 45.72      A    C
ATOM  24068  C    THR I 141      42.642  22.501  -2.940  1.00 44.73      A    C
ATOM  24069  O    THR I 141      43.636  22.515  -2.284  1.00 43.81      A    O
ATOM  24070  N    ASP I 142      42.018  23.603  -3.306  1.00 44.00      A    N
ATOM  24071  CA   ASP I 142      42.547  24.903  -2.949  1.00 45.32      A    C
ATOM  24072  CB   ASP I 142      42.829  25.673  -4.215  1.00 45.35      A    C
ATOM  24073  CG   ASP I 142      43.934  26.646  -4.059  1.00 49.72      A    C
ATOM  24074  OD1  ASP I 142      45.094  26.238  -4.133  1.00 55.01      A    O
ATOM  24075  OD2  ASP I 142      43.663  27.821  -3.877  1.00 51.74      A    O-1
ATOM  24076  C    ASP I 142      41.639  25.749  -2.074  1.00 44.89      A    C
ATOM  24077  O    ASP I 142      40.614  26.186  -2.496  1.00 44.06      A    O
ATOM  24078  N    PRO I 143      42.059  26.009  -0.855  1.00 45.44      A    N
ATOM  24079  CA   PRO I 143      41.271  26.774   0.107  1.00 45.23      A    C
ATOM  24080  CB   PRO I 143      42.105  26.698   1.358  1.00 43.89      A    C
ATOM  24081  CG   PRO I 143      43.413  26.639   0.870  1.00 46.09      A    C
ATOM  24082  CD   PRO I 143      43.431  25.860  -0.386  1.00 44.84      A    C
ATOM  24083  C    PRO I 143      40.987  28.213  -0.253  1.00 45.06      A    C
ATOM  24084  O    PRO I 143      39.970  28.663   0.174  1.00 44.18      A    O
ATOM  24085  N    ILE I 144      41.848  28.925  -0.973  1.00 45.29      A    N
ATOM  24086  CA   ILE I 144      41.524  30.301  -1.314  1.00 45.86      A    C
ATOM  24087  CB   ILE I 144      42.657  31.299  -1.073  1.00 45.18      A    C
ATOM  24088  CG1  ILE I 144      43.969  30.789  -1.581  1.00 43.36      A    C
ATOM  24089  CD1  ILE I 144      44.767  31.849  -2.099  1.00 38.40      A    C
ATOM  24090  CG2  ILE I 144      42.783  31.652   0.347  1.00 45.86      A    C
ATOM  24091  C    ILE I 144      41.058  30.580  -2.696  1.00 47.51      A    C
ATOM  24092  O    ILE I 144      40.884  31.704  -3.025  1.00 48.01      A    O
ATOM  24093  N    GLU I 145      40.924  29.591  -3.539  1.00 49.10      A    N
ATOM  24094  CA   GLU I 145      40.604  29.903  -4.904  1.00 50.97      A    C
ATOM  24095  CB   GLU I 145      40.642  28.620  -5.715  1.00 52.22      A    C
ATOM  24096  CG   GLU I 145      41.494  28.686  -6.942  1.00 58.62      A    C
ATOM  24097  CD   GLU I 145      41.304  27.494  -7.834  1.00 66.37      A    C
ATOM  24098  OE1  GLU I 145      40.665  26.521  -7.395  1.00 69.47      A    O
ATOM  24099  OE2  GLU I 145      41.784  27.526  -8.969  1.00 68.41      A    O-1
```

Appendix 1

```
ATOM  24100  C    GLU I 145     39.249  30.567  -5.088  1.00  50.07      A  C
ATOM  24101  O    GLU I 145     39.130  31.571  -5.755  1.00  49.11      A  O
ATOM  24102  N    LYS I 146     38.216  29.967  -4.545  1.00  49.19      A  N
ATOM  24103  CA   LYS I 146     36.912  30.546  -4.643  1.00  49.15      A  C
ATOM  24104  CB   LYS I 146     36.188  29.976  -5.839  1.00  49.54      A  C
ATOM  24105  CG   LYS I 146     36.541  28.563  -6.127  1.00  52.57      A  C
ATOM  24106  CD   LYS I 146     35.813  28.040  -7.316  1.00  60.02      A  C
ATOM  24107  CE   LYS I 146     35.455  26.568  -7.152  1.00  64.77      A  C
ATOM  24108  NZ   LYS I 146     36.608  25.626  -7.193  1.00  67.17      A  N
ATOM  24109  C    LYS I 146     36.135  30.265  -3.396  1.00  47.98      A  C
ATOM  24110  O    LYS I 146     36.294  29.247  -2.790  1.00  47.97      A  O
ATOM  24111  N    GLU I 147     35.298  31.198  -3.007  1.00  46.96      A  N
ATOM  24112  CA   GLU I 147     34.413  31.002  -1.894  1.00  45.71      A  C
ATOM  24113  CB   GLU I 147     33.511  29.847  -2.192  1.00  46.38      A  C
ATOM  24114  CG   GLU I 147     32.928  29.988  -3.526  1.00  48.47      A  C
ATOM  24115  CD   GLU I 147     32.438  28.719  -4.095  1.00  54.31      A  C
ATOM  24116  OE1  GLU I 147     32.738  27.655  -3.583  1.00  57.05      A  O
ATOM  24117  OE2  GLU I 147     31.742  28.773  -5.089  1.00  57.86      A  O-1
ATOM  24118  C    GLU I 147     35.193  30.775  -0.646  1.00  44.08      A  C
ATOM  24119  O    GLU I 147     36.254  31.291  -0.516  1.00  43.58      A  O
ATOM  24120  N    ASN I 148     34.659  30.010   0.282  1.00  41.75      A  N
ATOM  24121  CA   ASN I 148     35.373  29.695   1.500  1.00  40.09      A  C
ATOM  24122  CB   ASN I 148     36.573  28.821   1.222  1.00  39.17      A  C
ATOM  24123  CG   ASN I 148     37.054  28.103   2.427  1.00  38.55      A  C
ATOM  24124  OD1  ASN I 148     36.346  27.956   3.372  1.00  39.89      A  O
ATOM  24125  ND2  ASN I 148     38.252  27.636   2.386  1.00  30.46      A  N
ATOM  24126  C    ASN I 148     35.823  30.931   2.191  1.00  38.86      A  C
ATOM  24127  O    ASN I 148     36.908  31.005   2.624  1.00  36.97      A  O
ATOM  24128  N    ILE I 149     34.967  31.918   2.222  1.00  38.09      A  N
ATOM  24129  CA   ILE I 149     35.279  33.184   2.799  1.00  38.76      A  C
ATOM  24130  CB   ILE I 149     34.299  34.267   2.386  1.00  38.39      A  C
ATOM  24131  CG1  ILE I 149     34.935  35.612   2.561  1.00  39.60      A  C
ATOM  24132  CD1  ILE I 149     35.964  35.899   1.588  1.00  40.51      A  C
ATOM  24133  CG2  ILE I 149     33.094  34.257   3.224  1.00  40.01      A  C
ATOM  24134  C    ILE I 149     35.458  33.049   4.290  1.00  39.35      A  C
ATOM  24135  O    ILE I 149     36.163  33.797   4.912  1.00  41.20      A  O
ATOM  24136  N    MET I 150     34.826  32.049   4.850  1.00  39.03      A  N
ATOM  24137  CA   MET I 150     34.924  31.821   6.251  1.00  39.25      A  C
ATOM  24138  CB   MET I 150     34.034  30.673   6.629  1.00  40.34      I  C
ATOM  24139  CG   MET I 150     34.219  29.509   5.752  1.00  45.67      I  C
ATOM  24140  SD   MET I 150     33.861  27.945   6.502  1.00  59.87      I  S
ATOM  24141  CE   MET I 150     33.511  27.001   5.047  1.00  55.50      I  C
ATOM  24142  C    MET I 150     36.335  31.508   6.663  1.00  39.07      A  C
ATOM  24143  O    MET I 150     36.753  31.880   7.736  1.00  38.58      A  O
ATOM  24144  N    TYR I 151     37.066  30.765   5.858  1.00  36.60      A  N
ATOM  24145  CA   TYR I 151     38.460  30.650   6.101  1.00  34.67      A  C
ATOM  24146  CB   TYR I 151     39.007  29.426   5.403  1.00  33.81      A  C
ATOM  24147  CG   TYR I 151     40.491  29.336   5.406  1.00  31.61      A  C
ATOM  24148  CD1  TYR I 151     41.174  29.171   6.559  1.00  30.72      A  C
ATOM  24149  CE1  TYR I 151     42.489  29.087   6.578  1.00  27.78      A  C
ATOM  24150  CZ   TYR I 151     43.166  29.171   5.449  1.00  29.82      A  C
ATOM  24151  OH   TYR I 151     44.498  29.084   5.514  1.00  19.70      A  O
ATOM  24152  CE2  TYR I 151     42.514  29.327   4.269  1.00  29.98      A  C
ATOM  24153  CD2  TYR I 151     41.198  29.413   4.255  1.00  29.04      A  C
```

Appendix 1

```
ATOM   24154  C    TYR I 151      39.192  31.871   5.641  1.00 35.06      A   C
ATOM   24155  O    TYR I 151      39.890  32.483   6.379  1.00 36.42      A   O
ATOM   24156  N    LYS I 152      39.022  32.213   4.391  1.00 32.80      A   N
ATOM   24157  CA   LYS I 152      39.807  33.225   3.744  1.00 31.10      A   C
ATOM   24158  CB   LYS I 152      39.803  33.056   2.220  1.00 32.57      A   C
ATOM   24159  CG   LYS I 152      38.648  33.532   1.435  1.00 31.11      A   C
ATOM   24160  CD   LYS I 152      38.922  33.326  -0.015  1.00 32.01      A   C
ATOM   24161  CE   LYS I 152      37.746  32.854  -0.813  1.00 35.69      A   C
ATOM   24162  NZ   LYS I 152      37.865  33.240  -2.230  1.00 34.78      A   N
ATOM   24163  C    LYS I 152      39.677  34.649   4.224  1.00 30.02      A   C
ATOM   24164  O    LYS I 152      40.588  35.391   4.122  1.00 28.78      A   O
ATOM   24165  N    GLY I 153      38.524  35.024   4.715  1.00 28.75      A   N
ATOM   24166  CA   GLY I 153      38.345  36.357   5.203  1.00 27.60      A   C
ATOM   24167  C    GLY I 153      39.188  36.600   6.414  1.00 28.65      A   C
ATOM   24168  O    GLY I 153      39.749  37.647   6.602  1.00 29.24      A   O
ATOM   24169  N    HIS I 154      39.230  35.599   7.260  1.00 28.45      A   N
ATOM   24170  CA   HIS I 154      40.018  35.615   8.455  1.00 27.79      A   C
ATOM   24171  CB   HIS I 154      39.724  34.367   9.242  1.00 26.77      A   C
ATOM   24172  CG   HIS I 154      38.498  34.469  10.070  1.00 29.44      A   C
ATOM   24173  ND1  HIS I 154      38.293  35.488  10.952  1.00 29.61      A   N
ATOM   24174  CE1  HIS I 154      37.130  35.332  11.535  1.00 30.90      A   C
ATOM   24175  NE2  HIS I 154      36.575  34.248  11.064  1.00 32.88      A   N
ATOM   24176  CD2  HIS I 154      37.412  33.687  10.150  1.00 33.07      A   C
ATOM   24177  C    HIS I 154      41.482  35.699   8.173  1.00 27.78      A   C
ATOM   24178  O    HIS I 154      42.193  36.412   8.799  1.00 27.30      A   O
ATOM   24179  N    LEU I 155      41.931  34.941   7.214  1.00 27.98      A   N
ATOM   24180  CA   LEU I 155      43.298  34.960   6.893  1.00 27.74      A   C
ATOM   24181  CB   LEU I 155      43.635  33.856   5.932  1.00 28.34      A   C
ATOM   24182  CG   LEU I 155      45.054  33.773   5.433  1.00 28.69      A   C
ATOM   24183  CD1  LEU I 155      46.043  33.729   6.489  1.00 26.76      A   C
ATOM   24184  CD2  LEU I 155      45.185  32.632   4.584  1.00 30.46      A   C
ATOM   24185  C    LEU I 155      43.662  36.285   6.372  1.00 28.30      A   C
ATOM   24186  O    LEU I 155      44.702  36.764   6.652  1.00 29.84      A   O
ATOM   24187  N    ASN I 156      42.807  36.876   5.569  1.00 28.28      A   N
ATOM   24188  CA   ASN I 156      43.077  38.174   5.014  1.00 27.83      A   C
ATOM   24189  CB   ASN I 156      42.097  38.515   3.903  1.00 27.60      A   C
ATOM   24190  CG   ASN I 156      42.684  39.425   2.871  1.00 25.89      A   C
ATOM   24191  OD1  ASN I 156      43.744  39.224   2.413  1.00 29.80      A   O
ATOM   24192  ND2  ASN I 156      41.996  40.432   2.544  1.00 24.15      A   N
ATOM   24193  C    ASN I 156      43.139  39.247   6.043  1.00 28.10      A   C
ATOM   24194  O    ASN I 156      43.962  40.100   5.991  1.00 28.96      A   O
ATOM   24195  N    LEU I 157      42.239  39.214   6.987  1.00 29.08      A   N
ATOM   24196  CA   LEU I 157      42.291  40.166   8.052  1.00 29.38      A   C
ATOM   24197  CB   LEU I 157      41.090  40.038   8.956  1.00 29.98      A   C
ATOM   24198  CG   LEU I 157      41.034  41.053  10.071  1.00 31.40      A   C
ATOM   24199  CD1  LEU I 157      41.212  42.405   9.517  1.00 34.53      A   C
ATOM   24200  CD2  LEU I 157      39.759  40.974  10.745  1.00 30.32      A   C
ATOM   24201  C    LEU I 157      43.530  39.980   8.848  1.00 30.26      A   C
ATOM   24202  O    LEU I 157      44.139  40.920   9.217  1.00 32.03      A   O
ATOM   24203  N    MET I 158      43.900  38.743   9.102  1.00 29.68      A   N
ATOM   24204  CA   MET I 158      45.096  38.435   9.850  1.00 29.03      A   C
ATOM   24205  CB   MET I 158      45.234  36.936  10.141  1.00 29.54      I   C
ATOM   24206  CG   MET I 158      44.189  36.326  11.052  1.00 30.44      I   C
ATOM   24207  SD   MET I 158      44.125  34.561  11.178  1.00 30.36      I   S
```

Appendix 1

```
ATOM  24208  CE   MET I 158     45.680  34.295  11.855  1.00  28.21     I  C
ATOM  24209  C    MET I 158     46.313  38.941   9.135  1.00  28.46     A  C
ATOM  24210  O    MET I 158     47.181  39.447   9.742  1.00  26.72     A  O
ATOM  24211  N    TYR I 159     46.368  38.830   7.833  1.00  27.62     A  N
ATOM  24212  CA   TYR I 159     47.513  39.312   7.119  1.00  28.56     A  C
ATOM  24213  CB   TYR I 159     47.288  39.183   5.654  1.00  27.95     A  C
ATOM  24214  CG   TYR I 159     47.565  37.874   5.043  1.00  29.39     A  C
ATOM  24215  CD1  TYR I 159     48.511  37.043   5.535  1.00  30.45     A  C
ATOM  24216  CE1  TYR I 159     48.744  35.865   4.954  1.00  30.43     A  C
ATOM  24217  CZ   TYR I 159     48.039  35.509   3.880  1.00  30.11     A  C
ATOM  24218  OH   TYR I 159     48.258  34.331   3.264  1.00  30.04     A  O
ATOM  24219  CE2  TYR I 159     47.108  36.328   3.389  1.00  31.65     A  C
ATOM  24220  CD2  TYR I 159     46.877  37.479   3.957  1.00  29.66     A  C
ATOM  24221  C    TYR I 159     47.694  40.767   7.302  1.00  29.80     A  C
ATOM  24222  O    TYR I 159     48.779  41.230   7.452  1.00  32.15     A  O
ATOM  24223  N    GLY I 160     46.633  41.515   7.210  1.00  28.83     A  N
ATOM  24224  CA   GLY I 160     46.738  42.919   7.394  1.00  28.94     A  C
ATOM  24225  C    GLY I 160     47.127  43.333   8.771  1.00  29.42     A  C
ATOM  24226  O    GLY I 160     47.893  44.231   8.973  1.00  29.03     A  O
ATOM  24227  N    LEU I 161     46.545  42.648   9.722  1.00  30.17     A  N
ATOM  24228  CA   LEU I 161     46.737  42.930  11.097  1.00  30.17     A  C
ATOM  24229  CB   LEU I 161     45.863  42.014  11.904  1.00  30.63     A  C
ATOM  24230  CG   LEU I 161     44.811  42.657  12.753  1.00  30.96     A  C
ATOM  24231  CD1  LEU I 161     44.261  43.773  12.040  1.00  30.34     A  C
ATOM  24232  CD2  LEU I 161     43.783  41.680  12.981  1.00  33.04     A  C
ATOM  24233  C    LEU I 161     48.156  42.735  11.477  1.00  30.59     A  C
ATOM  24234  O    LEU I 161     48.697  43.528  12.152  1.00  30.97     A  O
ATOM  24235  N    TYR I 162     48.774  41.680  11.017  1.00  30.96     A  N
ATOM  24236  CA   TYR I 162     50.162  41.466  11.256  1.00  32.02     A  C
ATOM  24237  CB   TYR I 162     50.564  40.172  10.584  1.00  31.61     A  C
ATOM  24238  CG   TYR I 162     52.040  39.964  10.452  1.00  33.67     A  C
ATOM  24239  CD1  TYR I 162     52.752  39.479  11.488  1.00  31.91     A  C
ATOM  24240  CE1  TYR I 162     54.050  39.288  11.406  1.00  29.47     A  C
ATOM  24241  CZ   TYR I 162     54.702  39.545  10.301  1.00  30.16     A  C
ATOM  24242  OH   TYR I 162     56.014  39.322  10.322  1.00  28.04     A  O
ATOM  24243  CE2  TYR I 162     54.058  40.044   9.224  1.00  34.66     A  C
ATOM  24244  CD2  TYR I 162     52.719  40.236   9.292  1.00  36.72     A  C
ATOM  24245  C    TYR I 162     51.021  42.556  10.677  1.00  32.92     A  C
ATOM  24246  O    TYR I 162     51.926  42.995  11.312  1.00  33.00     A  O
ATOM  24247  N    GLN I 163     50.762  42.958   9.447  1.00  33.89     A  N
ATOM  24248  CA   GLN I 163     51.516  44.022   8.845  1.00  34.41     A  C
ATOM  24249  CB   GLN I 163     51.240  44.180   7.374  1.00  35.05     A  C
ATOM  24250  CG   GLN I 163     52.103  45.198   6.746  1.00  34.20     A  C
ATOM  24251  CD   GLN I 163     52.273  44.984   5.299  1.00  36.90     A  C
ATOM  24252  OE1  GLN I 163     51.633  44.157   4.723  1.00  31.01     A  O
ATOM  24253  NE2  GLN I 163     53.131  45.741   4.702  1.00  36.35     A  N
ATOM  24254  C    GLN I 163     51.310  45.314   9.567  1.00  33.37     A  C
ATOM  24255  O    GLN I 163     52.203  46.081   9.701  1.00  32.59     A  O
ATOM  24256  N    LEU I 164     50.109  45.546  10.026  1.00  33.35     A  N
ATOM  24257  CA   LEU I 164     49.824  46.742  10.763  1.00  33.78     A  C
ATOM  24258  CB   LEU I 164     48.377  46.696  11.191  1.00  33.88     A  C
ATOM  24259  CG   LEU I 164     47.444  47.869  11.110  1.00  36.83     A  C
ATOM  24260  CD1  LEU I 164     47.987  48.850  10.210  1.00  39.47     A  C
ATOM  24261  CD2  LEU I 164     46.163  47.422  10.594  1.00  38.65     A  C
```

Appendix 1

```
ATOM  24262  C    LEU I 164    50.636  46.822  12.013  1.00  33.64    A  C
ATOM  24263  O    LEU I 164    51.141  47.845  12.321  1.00  34.60    A  O
ATOM  24264  N    VAL I 165    50.688  45.740  12.756  1.00  33.25    A  N
ATOM  24265  CA   VAL I 165    51.406  45.603  13.995  1.00  31.96    A  C
ATOM  24266  CB   VAL I 165    51.023  44.305  14.653  1.00  32.48    A  C
ATOM  24267  CG1  VAL I 165    51.930  43.962  15.774  1.00  26.99    A  C
ATOM  24268  CG2  VAL I 165    49.623  44.363  15.109  1.00  31.07    A  C
ATOM  24269  C    VAL I 165    52.901  45.694  13.863  1.00  33.04    A  C
ATOM  24270  O    VAL I 165    53.572  46.283  14.647  1.00  31.49    A  O
ATOM  24271  N    THR I 166    53.424  45.015  12.883  1.00  34.19    A  N
ATOM  24272  CA   THR I 166    54.820  45.028  12.578  1.00  35.43    A  C
ATOM  24273  CB   THR I 166    55.301  43.647  12.168  1.00  35.69    A  C
ATOM  24274  OG1  THR I 166    54.868  43.358  10.841  1.00  35.63    A  O
ATOM  24275  CG2  THR I 166    54.794  42.631  13.068  1.00  29.50    A  C
ATOM  24276  C    THR I 166    54.954  45.901  11.371  1.00  38.02    A  C
ATOM  24277  O    THR I 166    53.983  46.292  10.760  1.00  39.94    A  O
ATOM  24278  N    GLY I 167    56.147  46.181  10.950  1.00  39.33    A  N
ATOM  24279  CA   GLY I 167    56.209  46.873   9.689  1.00  40.22    A  C
ATOM  24280  C    GLY I 167    56.364  45.925   8.540  1.00  40.99    A  C
ATOM  24281  O    GLY I 167    56.503  46.324   7.434  1.00  41.25    A  O
ATOM  24282  N    SER I 168    56.364  44.653   8.849  1.00  41.00    A  N
ATOM  24283  CA   SER I 168    56.876  43.613   7.987  1.00  40.84    A  C
ATOM  24284  CB   SER I 168    57.011  42.349   8.808  1.00  40.67    A  C
ATOM  24285  OG   SER I 168    57.320  41.273   8.005  1.00  41.50    A  O
ATOM  24286  C    SER I 168    56.119  43.352   6.695  1.00  41.13    A  C
ATOM  24287  O    SER I 168    54.936  43.378   6.658  1.00  41.32    A  O
ATOM  24288  N    ARG I 169    56.840  43.097   5.623  1.00  41.59    A  N
ATOM  24289  CA   ARG I 169    56.251  42.843   4.331  1.00  41.84    A  C
ATOM  24290  CB   ARG I 169    56.921  43.659   3.260  1.00  42.14    A  C
ATOM  24291  CG   ARG I 169    57.178  45.039   3.693  1.00  47.66    A  C
ATOM  24292  CD   ARG I 169    57.284  45.991   2.553  1.00  52.45    A  C
ATOM  24293  NE   ARG I 169    57.860  45.365   1.393  1.00  56.21    A  N
ATOM  24294  CZ   ARG I 169    57.887  45.912   0.199  1.00  58.36    A  C
ATOM  24295  NH1  ARG I 169    57.355  47.100   0.011  1.00  60.23    A  N
ATOM  24296  NH2  ARG I 169    58.426  45.260  -0.803  1.00  55.11    A  N
ATOM  24297  C    ARG I 169    56.353  41.397   4.019  1.00  41.22    A  C
ATOM  24298  O    ARG I 169    56.240  40.995   2.929  1.00  41.59    A  O
ATOM  24299  N    ARG I 170    56.542  40.603   5.026  1.00  41.04    A  N
ATOM  24300  CA   ARG I 170    56.789  39.209   4.859  1.00  41.37    A  C
ATOM  24301  CB   ARG I 170    57.006  38.637   6.250  1.00  42.19    A  C
ATOM  24302  CG   ARG I 170    56.544  37.265   6.496  1.00  44.90    A  C
ATOM  24303  CD   ARG I 170    57.212  36.741   7.719  1.00  48.73    A  C
ATOM  24304  NE   ARG I 170    56.721  35.435   8.075  1.00  51.13    A  N
ATOM  24305  CZ   ARG I 170    57.331  34.304   7.780  1.00  54.26    A  C
ATOM  24306  NH1  ARG I 170    58.468  34.328   7.133  1.00  50.08    A  N
ATOM  24307  NH2  ARG I 170    56.798  33.148   8.139  1.00  55.55    A  N
ATOM  24308  C    ARG I 170    55.642  38.529   4.167  1.00  40.77    A  C
ATOM  24309  O    ARG I 170    55.839  37.710   3.306  1.00  40.52    A  O
ATOM  24310  N    TYR I 171    54.438  38.893   4.552  1.00  39.47    A  N
ATOM  24311  CA   TYR I 171    53.242  38.372   3.954  1.00  38.72    A  C
ATOM  24312  CB   TYR I 171    52.264  38.002   5.034  1.00  38.22    A  C
ATOM  24313  CG   TYR I 171    52.729  36.947   5.964  1.00  36.30    A  C
ATOM  24314  CD1  TYR I 171    52.971  35.684   5.537  1.00  37.15    A  C
ATOM  24315  CE1  TYR I 171    53.370  34.759   6.372  1.00  35.23    A  C
```

Appendix 1

```
ATOM  24316  CZ   TYR I 171     53.509  35.071   7.645  1.00  35.31      A   C
ATOM  24317  OH   TYR I 171     53.902  34.153   8.498  1.00  40.18      A   O
ATOM  24318  CE2  TYR I 171     53.272  36.286   8.095  1.00  34.85      A   C
ATOM  24319  CD2  TYR I 171     52.879  37.209   7.269  1.00  35.57      A   C
ATOM  24320  C    TYR I 171     52.557  39.282   2.932  1.00  39.13      A   C
ATOM  24321  O    TYR I 171     51.493  38.997   2.501  1.00  39.26      A   O
ATOM  24322  N    GLU I 172     53.194  40.358   2.521  1.00  40.08      A   N
ATOM  24323  CA   GLU I 172     52.545  41.383   1.729  1.00  40.90      A   C
ATOM  24324  CB   GLU I 172     53.478  42.574   1.583  1.00  41.95      A   C
ATOM  24325  CG   GLU I 172     52.864  43.765   0.912  1.00  46.47      A   C
ATOM  24326  CD   GLU I 172     53.737  44.972   0.931  1.00  51.21      A   C
ATOM  24327  OE1  GLU I 172     54.738  45.001   0.216  1.00  50.08      A   O
ATOM  24328  OE2  GLU I 172     53.416  45.907   1.656  1.00  52.34      A   O-1
ATOM  24329  C    GLU I 172     52.027  40.963   0.372  1.00  39.44      A   C
ATOM  24330  O    GLU I 172     50.993  41.371  -0.038  1.00  39.23      A   O
ATOM  24331  N    ALA I 173     52.784  40.159  -0.320  1.00  38.40      A   N
ATOM  24332  CA   ALA I 173     52.414  39.621  -1.585  1.00  37.25      A   C
ATOM  24333  CB   ALA I 173     53.582  38.968  -2.143  1.00  35.71      A   C
ATOM  24334  C    ALA I 173     51.239  38.674  -1.539  1.00  37.91      A   C
ATOM  24335  O    ALA I 173     50.413  38.695  -2.383  1.00  38.98      A   O
ATOM  24336  N    GLU I 174     51.197  37.826  -0.543  1.00  38.06      A   N
ATOM  24337  CA   GLU I 174     50.071  36.970  -0.277  1.00  38.82      A   C
ATOM  24338  CB   GLU I 174     50.389  36.074   0.899  1.00  39.66      A   C
ATOM  24339  CG   GLU I 174     51.174  34.860   0.584  1.00  43.42      A   C
ATOM  24340  CD   GLU I 174     51.881  34.265   1.778  1.00  51.02      A   C
ATOM  24341  OE1  GLU I 174     51.259  33.744   2.701  1.00  47.88      A   O
ATOM  24342  OE2  GLU I 174     53.098  34.292   1.773  1.00  55.87      A   O-1
ATOM  24343  C    GLU I 174     48.813  37.746   0.048  1.00  38.05      A   C
ATOM  24344  O    GLU I 174     47.735  37.317  -0.248  1.00  38.92      A   O
ATOM  24345  N    HIS I 175     48.974  38.848   0.750  1.00  36.46      A   N
ATOM  24346  CA   HIS I 175     47.901  39.738   1.124  1.00  34.45      A   C
ATOM  24347  CB   HIS I 175     48.464  40.778   2.057  1.00  32.91      A   C
ATOM  24348  CG   HIS I 175     47.444  41.474   2.880  1.00  31.18      A   C
ATOM  24349  ND1  HIS I 175     47.712  42.628   3.550  1.00  27.90      A   N
ATOM  24350  CE1  HIS I 175     46.644  43.015   4.198  1.00  30.43      A   C
ATOM  24351  NE2  HIS I 175     45.689  42.155   3.966  1.00  31.00      A   N
ATOM  24352  CD2  HIS I 175     46.165  41.180   3.144  1.00  31.20      A   C
ATOM  24353  C    HIS I 175     47.247  40.410  -0.045  1.00  34.24      A   C
ATOM  24354  O    HIS I 175     46.075  40.604  -0.060  1.00  33.06      A   O
ATOM  24355  N    ALA I 176     48.061  40.833  -0.986  1.00  34.82      A   N
ATOM  24356  CA   ALA I 176     47.641  41.428  -2.222  1.00  34.29      A   C
ATOM  24357  CB   ALA I 176     48.790  41.942  -2.904  1.00  34.60      A   C
ATOM  24358  C    ALA I 176     46.918  40.500  -3.119  1.00  32.99      A   C
ATOM  24359  O    ALA I 176     46.016  40.882  -3.769  1.00  34.76      A   O
ATOM  24360  N    HIS I 177     47.380  39.285  -3.204  1.00  32.61      A   N
ATOM  24361  CA   HIS I 177     46.675  38.295  -3.944  1.00  32.49      A   C
ATOM  24362  CB   HIS I 177     47.521  37.074  -4.075  1.00  32.09      A   C
ATOM  24363  CG   HIS I 177     46.889  36.008  -4.896  1.00  34.83      A   C
ATOM  24364  ND1  HIS I 177     46.556  36.193  -6.194  1.00  36.51      A   N
ATOM  24365  CE1  HIS I 177     46.026  35.089  -6.665  1.00  37.84      A   C
ATOM  24366  NE2  HIS I 177     46.001  34.197  -5.706  1.00  36.73      A   N
ATOM  24367  CD2  HIS I 177     46.541  34.745  -4.586  1.00  32.46      A   C
ATOM  24368  C    HIS I 177     45.352  37.906  -3.363  1.00  32.26      A   C
ATOM  24369  O    HIS I 177     44.422  37.742  -4.070  1.00  33.47      A   O
```

Appendix 1

```
ATOM  24370  N    LEU I 178     45.285  37.708  -2.073  1.00 32.03      A  N
ATOM  24371  CA   LEU I 178     44.039  37.387  -1.452  1.00 32.84      A  C
ATOM  24372  CB   LEU I 178     44.232  36.914  -0.017  1.00 32.46      A  C
ATOM  24373  CG   LEU I 178     43.071  36.253   0.707  1.00 30.39      A  C
ATOM  24374  CD1  LEU I 178     42.486  35.250  -0.129  1.00 26.32      A  C
ATOM  24375  CD2  LEU I 178     43.440  35.703   2.049  1.00 26.60      A  C
ATOM  24376  C    LEU I 178     43.069  38.526  -1.533  1.00 33.65      A  C
ATOM  24377  O    LEU I 178     41.901  38.331  -1.666  1.00 33.25      A  O
ATOM  24378  N    THR I 179     43.544  39.730  -1.380  1.00 32.78      A  N
ATOM  24379  CA   THR I 179     42.648  40.823  -1.388  1.00 32.36      A  C
ATOM  24380  CB   THR I 179     43.351  42.034  -0.941  1.00 32.45      A  C
ATOM  24381  OG1  THR I 179     43.843  41.799   0.353  1.00 31.25      A  O
ATOM  24382  CG2  THR I 179     42.443  43.159  -0.879  1.00 31.50      A  C
ATOM  24383  C    THR I 179     41.990  41.016  -2.728  1.00 34.88      A  C
ATOM  24384  O    THR I 179     40.824  41.235  -2.797  1.00 34.62      A  O
ATOM  24385  N    ARG I 180     42.746  40.940  -3.801  1.00 36.31      A  N
ATOM  24386  CA   ARG I 180     42.147  41.052  -5.106  1.00 37.87      A  C
ATOM  24387  CB   ARG I 180     43.156  41.271  -6.233  1.00 38.99      A  C
ATOM  24388  CG   ARG I 180     43.604  40.057  -6.961  1.00 44.78      A  C
ATOM  24389  CD   ARG I 180     43.368  40.128  -8.438  1.00 52.88      A  C
ATOM  24390  NE   ARG I 180     42.629  38.956  -8.846  1.00 56.47      A  N
ATOM  24391  CZ   ARG I 180     43.062  37.737  -8.644  1.00 55.98      A  C
ATOM  24392  NH1  ARG I 180     44.225  37.582  -8.084  1.00 55.22      A  N
ATOM  24393  NH2  ARG I 180     42.339  36.694  -8.994  1.00 56.11      A  N
ATOM  24394  C    ARG I 180     41.216  39.914  -5.357  1.00 36.60      A  C
ATOM  24395  O    ARG I 180     40.186  40.086  -5.903  1.00 36.46      A  O
ATOM  24396  N    ILE I 181     41.567  38.751  -4.885  1.00 36.48      A  N
ATOM  24397  CA   ILE I 181     40.740  37.611  -5.115  1.00 36.64      A  C
ATOM  24398  CB   ILE I 181     41.309  36.426  -4.430  1.00 36.19      A  C
ATOM  24399  CG1  ILE I 181     42.383  35.799  -5.272  1.00 38.15      A  C
ATOM  24400  CD1  ILE I 181     42.994  34.624  -4.653  1.00 37.79      A  C
ATOM  24401  CG2  ILE I 181     40.255  35.437  -4.197  1.00 36.70      A  C
ATOM  24402  C    ILE I 181     39.392  37.821  -4.504  1.00 37.09      A  C
ATOM  24403  O    ILE I 181     38.404  37.434  -5.043  1.00 38.62      A  O
ATOM  24404  N    ILE I 182     39.381  38.384  -3.321  1.00 37.54      A  N
ATOM  24405  CA   ILE I 182     38.178  38.690  -2.613  1.00 37.63      A  C
ATOM  24406  CB   ILE I 182     38.508  39.052  -1.192  1.00 36.69      A  C
ATOM  24407  CG1  ILE I 182     38.683  37.806  -0.374  1.00 34.26      A  C
ATOM  24408  CD1  ILE I 182     39.236  38.102   0.943  1.00 28.58      A  C
ATOM  24409  CG2  ILE I 182     37.446  39.834  -0.585  1.00 34.45      A  C
ATOM  24410  C    ILE I 182     37.369  39.779  -3.263  1.00 39.60      A  C
ATOM  24411  O    ILE I 182     36.176  39.724  -3.292  1.00 38.74      A  O
ATOM  24412  N    HIS I 183     38.064  40.797  -3.734  1.00 41.46      A  N
ATOM  24413  CA   HIS I 183     37.488  41.926  -4.424  1.00 43.41      A  C
ATOM  24414  CB   HIS I 183     38.565  42.962  -4.678  1.00 45.38      A  C
ATOM  24415  CG   HIS I 183     38.131  44.102  -5.539  1.00 49.37      A  C
ATOM  24416  ND1  HIS I 183     38.356  44.138  -6.895  1.00 51.14      A  N
ATOM  24417  CE1  HIS I 183     37.866  45.251  -7.385  1.00 51.56      A  C
ATOM  24418  NE2  HIS I 183     37.331  45.938  -6.398  1.00 53.60      A  N
ATOM  24419  CD2  HIS I 183     37.492  45.245  -5.233  1.00 52.32      A  C
ATOM  24420  C    HIS I 183     36.873  41.536  -5.718  1.00 43.11      A  C
ATOM  24421  O    HIS I 183     35.825  41.954  -6.042  1.00 42.70      A  O
ATOM  24422  N    ASP I 184     37.562  40.703  -6.450  1.00 43.78      A  N
ATOM  24423  CA   ASP I 184     37.077  40.163  -7.679  1.00 44.26      A  C
```

Appendix 1

```
ATOM  24424  CB   ASP I 184      38.108  39.223  -8.272  1.00 44.52      A    C
ATOM  24425  CG   ASP I 184      39.191  39.921  -9.060  1.00 47.46      A    C
ATOM  24426  OD1  ASP I 184      39.241  41.146  -9.143  1.00 47.63      A    O
ATOM  24427  OD2  ASP I 184      40.020  39.212  -9.616  1.00 51.40      A    O-1
ATOM  24428  C    ASP I 184      35.843  39.361  -7.415  1.00 44.78      A    C
ATOM  24429  O    ASP I 184      34.977  39.359  -8.206  1.00 45.56      A    O
ATOM  24430  N    GLU I 185      35.791  38.610  -6.332  1.00 45.59      A    N
ATOM  24431  CA   GLU I 185      34.634  37.784  -6.035  1.00 45.39      A    C
ATOM  24432  CB   GLU I 185      34.918  36.810  -4.885  1.00 45.82      A    C
ATOM  24433  CG   GLU I 185      34.880  35.351  -5.282  1.00 45.96      A    C
ATOM  24434  CD   GLU I 185      35.274  34.371  -4.198  1.00 49.00      A    C
ATOM  24435  OE1  GLU I 185      36.287  34.550  -3.526  1.00 45.72      A    O
ATOM  24436  OE2  GLU I 185      34.577  33.374  -4.046  1.00 47.22      A    O-1
ATOM  24437  C    GLU I 185      33.421  38.615  -5.761  1.00 45.32      A    C
ATOM  24438  O    GLU I 185      32.368  38.336  -6.245  1.00 46.31      A    O
ATOM  24439  N    ILE I 186      33.586  39.668  -4.998  1.00 45.20      A    N
ATOM  24440  CA   ILE I 186      32.484  40.522  -4.664  1.00 45.74      A    C
ATOM  24441  CB   ILE I 186      32.922  41.612  -3.714  1.00 44.64      A    C
ATOM  24442  CG1  ILE I 186      33.524  40.982  -2.490  1.00 44.97      A    C
ATOM  24443  CD1  ILE I 186      34.045  41.951  -1.526  1.00 44.06      A    C
ATOM  24444  CG2  ILE I 186      31.781  42.422  -3.280  1.00 42.86      A    C
ATOM  24445  C    ILE I 186      31.919  41.133  -5.908  1.00 47.10      A    C
ATOM  24446  O    ILE I 186      30.735  41.220  -6.076  1.00 48.64      A    O
ATOM  24447  N    ALA I 187      32.780  41.551  -6.797  1.00 47.56      A    N
ATOM  24448  CA   ALA I 187      32.350  42.143  -8.018  1.00 48.12      A    C
ATOM  24449  CB   ALA I 187      33.513  42.690  -8.721  1.00 48.24      A    C
ATOM  24450  C    ALA I 187      31.568  41.200  -8.921  1.00 48.60      A    C
ATOM  24451  O    ALA I 187      30.633  41.596  -9.556  1.00 48.65      A    O
ATOM  24452  N    ALA I 188      31.985  39.963  -9.023  1.00 48.66      A    N
ATOM  24453  CA   ALA I 188      31.294  39.033  -9.879  1.00 49.49      A    C
ATOM  24454  CB   ALA I 188      32.083  37.801 -10.045  1.00 48.05      A    C
ATOM  24455  C    ALA I 188      29.875  38.710  -9.467  1.00 50.58      A    C
ATOM  24456  O    ALA I 188      29.003  38.614 -10.293  1.00 51.45      A    O
ATOM  24457  N    ASN I 189      29.650  38.532  -8.184  1.00 51.23      A    N
ATOM  24458  CA   ASN I 189      28.346  38.174  -7.667  1.00 51.36      A    C
ATOM  24459  CB   ASN I 189      28.481  37.667  -6.242  1.00 51.20      A    C
ATOM  24460  CG   ASN I 189      29.137  36.351  -6.184  1.00 51.24      A    C
ATOM  24461  OD1  ASN I 189      29.303  35.714  -7.188  1.00 48.71      A    O
ATOM  24462  ND2  ASN I 189      29.535  35.939  -5.015  1.00 50.10      A    N
ATOM  24463  C    ASN I 189      27.267  39.219  -7.709  1.00 51.36      A    C
ATOM  24464  O    ASN I 189      27.509  40.373  -7.456  1.00 51.87      A    O
ATOM  24465  N    PRO I 190      26.052  38.790  -8.006  1.00 51.56      A    N
ATOM  24466  CA   PRO I 190      24.865  39.642  -7.939  1.00 51.94      A    C
ATOM  24467  CB   PRO I 190      23.785  38.732  -8.482  1.00 51.99      A    C
ATOM  24468  CG   PRO I 190      24.230  37.414  -8.158  1.00 51.55      A    C
ATOM  24469  CD   PRO I 190      25.690  37.398  -8.262  1.00 50.88      A    C
ATOM  24470  C    PRO I 190      24.478  40.116  -6.537  1.00 52.52      A    C
ATOM  24471  O    PRO I 190      24.055  41.232  -6.339  1.00 52.32      A    O
ATOM  24472  N    PHE I 191      24.590  39.215  -5.582  1.00 51.58      A    N
ATOM  24473  CA   PHE I 191      24.211  39.463  -4.214  1.00 50.67      A    C
ATOM  24474  CB   PHE I 191      23.882  38.175  -3.507  1.00 50.31      A    C
ATOM  24475  CG   PHE I 191      24.992  37.227  -3.473  1.00 50.89      A    C
ATOM  24476  CD1  PHE I 191      26.059  37.455  -2.676  1.00 49.33      A    C
ATOM  24477  CE1  PHE I 191      27.053  36.605  -2.642  1.00 51.32      A    C
```

Appendix 1

```
ATOM  24478  CZ   PHE I 191      27.026  35.504  -3.409  1.00 52.74      A    C
ATOM  24479  CE2  PHE I 191      25.981  35.268  -4.213  1.00 53.72      A    C
ATOM  24480  CD2  PHE I 191      24.972  36.115  -4.240  1.00 51.56      A    C
ATOM  24481  C    PHE I 191      25.045  40.385  -3.335  1.00 50.29      A    C
ATOM  24482  O    PHE I 191      24.533  40.897  -2.384  1.00 51.49      A    O
ATOM  24483  N    ALA I 192      26.325  40.569  -3.589  1.00 48.43      A    N
ATOM  24484  CA   ALA I 192      27.054  41.426  -2.685  1.00 46.95      A    C
ATOM  24485  CB   ALA I 192      26.096  42.325  -2.027  1.00 46.61      A    C
ATOM  24486  C    ALA I 192      27.712  40.601  -1.623  1.00 46.48      A    C
ATOM  24487  O    ALA I 192      27.074  40.219  -0.698  1.00 47.11      A    O
ATOM  24488  N    GLY I 193      28.983  40.312  -1.735  1.00 45.53      A    N
ATOM  24489  CA   GLY I 193      29.581  39.409  -0.794  1.00 43.59      A    C
ATOM  24490  C    GLY I 193      29.999  38.110  -1.402  1.00 42.87      A    C
ATOM  24491  O    GLY I 193      30.024  37.953  -2.578  1.00 42.69      A    O
ATOM  24492  N    ILE I 194      30.400  37.190  -0.558  1.00 41.89      A    N
ATOM  24493  CA   ILE I 194      30.950  35.958  -1.008  1.00 40.41      A    C
ATOM  24494  CB   ILE I 194      32.459  35.943  -0.837  1.00 40.16      A    C
ATOM  24495  CG1  ILE I 194      33.085  36.967  -1.750  1.00 40.10      A    C
ATOM  24496  CD1  ILE I 194      34.309  37.522  -1.277  1.00 37.90      A    C
ATOM  24497  CG2  ILE I 194      33.004  34.637  -1.206  1.00 37.96      A    C
ATOM  24498  C    ILE I 194      30.354  34.947  -0.131  1.00 41.50      A    C
ATOM  24499  O    ILE I 194      30.061  35.224   0.986  1.00 41.12      A    O
ATOM  24500  N    VAL I 195      30.151  33.763  -0.662  1.00 41.94      A    N
ATOM  24501  CA   VAL I 195      29.604  32.648   0.080  1.00 41.72      A    C
ATOM  24502  CB   VAL I 195      28.792  31.800  -0.828  1.00 41.67      A    C
ATOM  24503  CG1  VAL I 195      27.739  32.619  -1.401  1.00 39.65      A    C
ATOM  24504  CG2  VAL I 195      29.646  31.230  -1.908  1.00 39.88      A    C
ATOM  24505  C    VAL I 195      30.623  31.804   0.818  1.00 42.28      A    C
ATOM  24506  O    VAL I 195      31.762  31.943   0.619  1.00 42.13      A    O
ATOM  24507  N    CYS I 196      30.208  30.885   1.646  1.00 44.17      A    N
ATOM  24508  CA   CYS I 196      31.184  30.057   2.299  1.00 47.24      A    C
ATOM  24509  CB   CYS I 196      30.800  29.862   3.752  1.00 46.52      A    C
ATOM  24510  SG   CYS I 196      31.096  31.227   4.803  1.00 52.08      A    S
ATOM  24511  C    CYS I 196      31.216  28.736   1.582  1.00 48.10      A    C
ATOM  24512  O    CYS I 196      31.989  28.553   0.708  1.00 48.29      A    O
ATOM  24513  N    GLU I 197      30.329  27.831   1.903  1.00 50.21      A    N
ATOM  24514  CA   GLU I 197      30.060  26.714   1.038  1.00 51.49      A    C
ATOM  24515  CB   GLU I 197      29.328  25.603   1.770  1.00 51.78      A    C
ATOM  24516  CG   GLU I 197      30.020  25.061   2.998  1.00 53.34      A    C
ATOM  24517  CD   GLU I 197      30.021  26.009   4.140  1.00 59.41      A    C
ATOM  24518  OE1  GLU I 197      29.575  27.145   4.004  1.00 58.32      A    O
ATOM  24519  OE2  GLU I 197      30.485  25.621   5.197  1.00 63.96      A    O-1
ATOM  24520  C    GLU I 197      29.199  27.275  -0.048  1.00 51.89      A    C
ATOM  24521  O    GLU I 197      28.664  28.336   0.077  1.00 51.04      A    O
ATOM  24522  N    PRO I 198      29.019  26.519  -1.100  1.00 52.53      A    N
ATOM  24523  CA   PRO I 198      28.516  27.019  -2.363  1.00 53.27      A    C
ATOM  24524  CB   PRO I 198      28.662  25.808  -3.277  1.00 53.20      A    C
ATOM  24525  CG   PRO I 198      29.655  24.943  -2.618  1.00 53.22      A    C
ATOM  24526  CD   PRO I 198      30.056  25.522  -1.320  1.00 52.48      A    C
ATOM  24527  C    PRO I 198      27.112  27.623  -2.395  1.00 53.66      A    C
ATOM  24528  O    PRO I 198      26.947  28.595  -3.092  1.00 54.55      A    O
ATOM  24529  N    ASP I 199      26.135  27.110  -1.682  1.00 53.18      A    N
ATOM  24530  CA   ASP I 199      24.883  27.844  -1.631  1.00 53.00      A    C
ATOM  24531  CB   ASP I 199      23.655  26.988  -1.932  1.00 53.32      A    C
```

Appendix 1

```
ATOM  24532  CG   ASP I 199      22.463  27.812  -2.386  1.00 56.24      A        C
ATOM  24533  OD1  ASP I 199      22.578  29.025  -2.531  1.00 57.94      A        O
ATOM  24534  OD2  ASP I 199      21.387  27.258  -2.583  1.00 59.21      A        O-1
ATOM  24535  C    ASP I 199      24.721  28.565  -0.320  1.00 51.58      A        C
ATOM  24536  O    ASP I 199      23.648  28.997  -0.008  1.00 52.23      A        O
ATOM  24537  N    ASN I 200      25.785  28.698   0.447  1.00 48.67      A        N
ATOM  24538  CA   ASN I 200      25.656  29.224   1.779  1.00 46.13      A        C
ATOM  24539  CB   ASN I 200      26.385  28.322   2.736  1.00 45.86      A        C
ATOM  24540  CG   ASN I 200      25.665  27.046   3.018  1.00 47.11      A        C
ATOM  24541  OD1  ASN I 200      24.489  26.918   2.816  1.00 44.48      A        O
ATOM  24542  ND2  ASN I 200      26.394  26.083   3.510  1.00 47.88      A        N
ATOM  24543  C    ASN I 200      26.238  30.596   1.942  1.00 44.30      A        C
ATOM  24544  O    ASN I 200      27.389  30.781   1.750  1.00 44.45      A        O
ATOM  24545  N    TYR I 201      25.429  31.555   2.341  1.00 42.42      A        N
ATOM  24546  CA   TYR I 201      25.914  32.895   2.562  1.00 39.84      A        C
ATOM  24547  CB   TYR I 201      25.156  33.877   1.671  1.00 37.80      A        C
ATOM  24548  CG   TYR I 201      25.598  35.294   1.766  1.00 32.89      A        C
ATOM  24549  CD1  TYR I 201      26.389  35.855   0.822  1.00 32.92      A        C
ATOM  24550  CE1  TYR I 201      26.771  37.126   0.922  1.00 32.35      A        C
ATOM  24551  CZ   TYR I 201      26.374  37.842   1.969  1.00 29.56      A        C
ATOM  24552  OH   TYR I 201      26.745  39.120   2.095  1.00 34.80      A        O
ATOM  24553  CE2  TYR I 201      25.604  37.311   2.899  1.00 27.36      A        C
ATOM  24554  CD2  TYR I 201      25.220  36.064   2.798  1.00 29.80      A        C
ATOM  24555  C    TYR I 201      25.770  33.244   4.019  1.00 39.70      A        C
ATOM  24556  O    TYR I 201      24.727  33.105   4.569  1.00 38.81      A        O
ATOM  24557  N    PHE I 202      26.849  33.667   4.649  1.00 39.59      A        N
ATOM  24558  CA   PHE I 202      26.817  34.035   6.053  1.00 39.12      A        C
ATOM  24559  CB   PHE I 202      27.711  33.120   6.858  1.00 37.86      A        C
ATOM  24560  CG   PHE I 202      27.252  31.728   6.890  1.00 36.92      A        C
ATOM  24561  CD1  PHE I 202      26.388  31.306   7.834  1.00 35.90      A        C
ATOM  24562  CE1  PHE I 202      25.982  30.063   7.845  1.00 34.08      A        C
ATOM  24563  CZ   PHE I 202      26.408  29.218   6.918  1.00 35.31      A        C
ATOM  24564  CE2  PHE I 202      27.254  29.608   5.987  1.00 32.06      A        C
ATOM  24565  CD2  PHE I 202      27.672  30.846   5.960  1.00 34.67      A        C
ATOM  24566  C    PHE I 202      27.217  35.458   6.324  1.00 39.39      A        C
ATOM  24567  O    PHE I 202      28.233  35.898   5.898  1.00 40.48      A        O
ATOM  24568  N    VAL I 203      26.394  36.180   7.047  1.00 39.76      A        N
ATOM  24569  CA   VAL I 203      26.673  37.560   7.349  1.00 38.30      A        C
ATOM  24570  CB   VAL I 203      25.455  38.223   7.987  1.00 37.81      A        C
ATOM  24571  CG1  VAL I 203      25.610  38.363   9.409  1.00 35.89      A        C
ATOM  24572  CG2  VAL I 203      25.253  39.509   7.423  1.00 39.07      A        C
ATOM  24573  C    VAL I 203      27.921  37.783   8.189  1.00 38.35      A        C
ATOM  24574  O    VAL I 203      28.655  38.694   7.954  1.00 38.96      A        O
ATOM  24575  N    GLN I 204      28.145  36.975   9.200  1.00 37.10      A        N
ATOM  24576  CA   GLN I 204      29.320  37.130  10.028  1.00 36.42      A        C
ATOM  24577  CB   GLN I 204      29.198  36.297  11.279  1.00 35.55      A        C
ATOM  24578  CG   GLN I 204      29.181  34.847  11.032  1.00 34.24      A        C
ATOM  24579  CD   GLN I 204      27.865  34.375  10.630  1.00 32.92      A        C
ATOM  24580  OE1  GLN I 204      27.182  35.014   9.899  1.00 35.27      A        O
ATOM  24581  NE2  GLN I 204      27.484  33.258  11.133  1.00 33.80      A        N
ATOM  24582  C    GLN I 204      30.637  36.864   9.327  1.00 36.66      A        C
ATOM  24583  O    GLN I 204      31.572  37.568   9.526  1.00 36.98      A        O
ATOM  24584  N    CYS I 205      30.697  35.834   8.509  1.00 37.27      A        N
ATOM  24585  CA   CYS I 205      31.857  35.532   7.710  1.00 37.36      A        C
```

Appendix 1

```
ATOM  24586  CB   CYS I 205    31.733  34.193   6.963  1.00  36.69    A  C
ATOM  24587  SG   CYS I 205    31.147  32.673   7.744  1.00  45.43    A  S
ATOM  24588  C    CYS I 205    32.129  36.666   6.731  1.00  36.62    A  C
ATOM  24589  O    CYS I 205    33.245  36.955   6.430  1.00  37.62    A  O
ATOM  24590  N    ASN I 206    31.098  37.284   6.212  1.00  35.19    A  N
ATOM  24591  CA   ASN I 206    31.279  38.413   5.328  1.00  35.24    A  C
ATOM  24592  CB   ASN I 206    30.033  38.704   4.519  1.00  34.95    A  C
ATOM  24593  CG   ASN I 206    29.845  37.747   3.406  1.00  36.95    A  C
ATOM  24594  OD1  ASN I 206    30.246  37.985   2.310  1.00  40.46    A  O
ATOM  24595  ND2  ASN I 206    29.215  36.660   3.685  1.00  36.85    A  N
ATOM  24596  C    ASN I 206    31.893  39.661   5.954  1.00  34.87    A  C
ATOM  24597  O    ASN I 206    32.662  40.352   5.346  1.00  35.03    A  O
ATOM  24598  N    SER I 207    31.577  39.889   7.204  1.00  33.75    A  N
ATOM  24599  CA   SER I 207    32.039  41.014   7.936  1.00  33.90    A  C
ATOM  24600  CB   SER I 207    31.545  40.846   9.334  1.00  34.87    A  C
ATOM  24601  OG   SER I 207    30.544  41.757   9.601  1.00  40.31    A  O
ATOM  24602  C    SER I 207    33.521  41.046   8.028  1.00  33.28    A  C
ATOM  24603  O    SER I 207    34.109  42.084   7.997  1.00  33.03    A  O
ATOM  24604  N    VAL I 208    34.115  39.892   8.217  1.00  31.98    A  N
ATOM  24605  CA   VAL I 208    35.536  39.762   8.350  1.00  31.92    A  C
ATOM  24606  CB   VAL I 208    35.917  38.332   8.633  1.00  32.18    A  C
ATOM  24607  CG1  VAL I 208    37.317  38.236   8.969  1.00  33.38    A  C
ATOM  24608  CG2  VAL I 208    35.125  37.793   9.711  1.00  30.39    A  C
ATOM  24609  C    VAL I 208    36.181  40.150   7.085  1.00  32.34    A  C
ATOM  24610  O    VAL I 208    37.148  40.835   7.063  1.00  32.56    A  O
ATOM  24611  N    ALA I 209    35.614  39.688   6.008  1.00  32.94    A  N
ATOM  24612  CA   ALA I 209    36.138  39.962   4.715  1.00  33.47    A  C
ATOM  24613  CB   ALA I 209    35.406  39.182   3.722  1.00  34.14    A  C
ATOM  24614  C    ALA I 209    36.110  41.399   4.341  1.00  33.90    A  C
ATOM  24615  O    ALA I 209    37.009  41.865   3.731  1.00  34.32    A  O
ATOM  24616  N    TYR I 210    35.046  42.102   4.648  1.00  34.59    A  N
ATOM  24617  CA   TYR I 210    35.010  43.515   4.344  1.00  34.55    A  C
ATOM  24618  CB   TYR I 210    33.590  44.087   4.399  1.00  34.91    A  C
ATOM  24619  CG   TYR I 210    32.765  43.733   3.188  1.00  38.51    A  C
ATOM  24620  CD1  TYR I 210    32.753  44.534   2.077  1.00  39.29    A  C
ATOM  24621  CE1  TYR I 210    32.025  44.204   0.983  1.00  36.87    A  C
ATOM  24622  CZ   TYR I 210    31.324  43.062   0.976  1.00  38.45    A  C
ATOM  24623  OH   TYR I 210    30.587  42.710  -0.083  1.00  40.85    A  O
ATOM  24624  CE2  TYR I 210    31.327  42.251   2.044  1.00  39.24    A  C
ATOM  24625  CD2  TYR I 210    32.029  42.582   3.143  1.00  37.20    A  C
ATOM  24626  C    TYR I 210    36.013  44.273   5.167  1.00  34.05    A  C
ATOM  24627  O    TYR I 210    36.705  45.117   4.689  1.00  33.07    A  O
ATOM  24628  N    LEU I 211    36.111  43.912   6.418  1.00  33.28    A  N
ATOM  24629  CA   LEU I 211    37.022  44.547   7.323  1.00  33.03    A  C
ATOM  24630  CB   LEU I 211    36.764  44.079   8.733  1.00  32.82    A  C
ATOM  24631  CG   LEU I 211    37.458  44.824   9.843  1.00  33.15    A  C
ATOM  24632  CD1  LEU I 211    36.850  46.111  10.121  1.00  32.08    A  C
ATOM  24633  CD2  LEU I 211    37.457  44.015  11.045  1.00  33.85    A  C
ATOM  24634  C    LEU I 211    38.461  44.382   6.932  1.00  32.86    A  C
ATOM  24635  O    LEU I 211    39.274  45.221   7.176  1.00  32.91    A  O
ATOM  24636  N    SER I 212    38.760  43.270   6.322  1.00  32.28    A  N
ATOM  24637  CA   SER I 212    40.076  42.998   5.854  1.00  33.23    A  C
ATOM  24638  CB   SER I 212    40.135  41.608   5.293  1.00  33.05    A  C
ATOM  24639  OG   SER I 212    39.725  41.613   3.975  1.00  32.52    A  O
```

Appendix 1

```
ATOM  24640  C    SER I 212    40.467  43.975   4.802  1.00  33.72    A  C
ATOM  24641  O    SER I 212    41.580  44.396   4.735  1.00  35.27    A  O
ATOM  24642  N    LEU I 213    39.517  44.305   3.965  1.00  33.37    A  N
ATOM  24643  CA   LEU I 213    39.680  45.220   2.869  1.00  33.14    A  C
ATOM  24644  CB   LEU I 213    38.400  45.280   2.081  1.00  32.70    A  C
ATOM  24645  CG   LEU I 213    38.258  44.518   0.795  1.00  30.07    A  C
ATOM  24646  CD1  LEU I 213    39.149  43.399   0.771  1.00  31.74    A  C
ATOM  24647  CD2  LEU I 213    36.921  44.084   0.688  1.00  26.30    A  C
ATOM  24648  C    LEU I 213    40.008  46.589   3.333  1.00  33.81    A  C
ATOM  24649  O    LEU I 213    40.864  47.219   2.806  1.00  34.38    A  O
ATOM  24650  N    TRP I 214    39.343  47.021   4.372  1.00  34.88    A  N
ATOM  24651  CA   TRP I 214    39.622  48.290   4.981  1.00  35.80    A  C
ATOM  24652  CB   TRP I 214    38.638  48.562   6.093  1.00  35.59    A  C
ATOM  24653  CG   TRP I 214    37.297  49.041   5.703  1.00  37.59    A  C
ATOM  24654  CD1  TRP I 214    36.335  48.335   5.129  1.00  39.52    A  C
ATOM  24655  NE1  TRP I 214    35.229  49.083   4.955  1.00  39.70    A  N
ATOM  24656  CE2  TRP I 214    35.466  50.317   5.465  1.00  40.66    A  C
ATOM  24657  CD2  TRP I 214    36.755  50.324   5.935  1.00  39.47    A  C
ATOM  24658  CE3  TRP I 214    37.243  51.484   6.498  1.00  41.10    A  C
ATOM  24659  CZ3  TRP I 214    36.449  52.550   6.556  1.00  42.62    A  C
ATOM  24660  CH2  TRP I 214    35.186  52.522   6.069  1.00  43.24    A  C
ATOM  24661  CZ2  TRP I 214    34.670  51.412   5.519  1.00  42.50    A  C
ATOM  24662  C    TRP I 214    41.021  48.340   5.535  1.00  36.44    A  C
ATOM  24663  O    TRP I 214    41.675  49.336   5.458  1.00  37.31    A  O
ATOM  24664  N    VAL I 215    41.462  47.249   6.118  1.00  37.17    A  N
ATOM  24665  CA   VAL I 215    42.819  47.113   6.601  1.00  36.44    A  C
ATOM  24666  CB   VAL I 215    42.985  45.867   7.477  1.00  37.07    A  C
ATOM  24667  CG1  VAL I 215    44.384  45.478   7.593  1.00  34.99    A  C
ATOM  24668  CG2  VAL I 215    42.428  46.097   8.806  1.00  34.97    A  C
ATOM  24669  C    VAL I 215    43.838  47.145   5.490  1.00  35.96    A  C
ATOM  24670  O    VAL I 215    44.857  47.745   5.614  1.00  35.01    A  O
ATOM  24671  N    TYR I 216    43.552  46.509   4.384  1.00  36.43    A  N
ATOM  24672  CA   TYR I 216    44.441  46.604   3.261  1.00  38.12    A  C
ATOM  24673  CB   TYR I 216    43.969  45.714   2.128  1.00  37.38    A  C
ATOM  24674  CG   TYR I 216    44.963  45.566   1.030  1.00  38.17    A  C
ATOM  24675  CD1  TYR I 216    45.798  44.488   0.975  1.00  37.58    A  C
ATOM  24676  CE1  TYR I 216    46.700  44.348  -0.010  1.00  37.06    A  C
ATOM  24677  CZ   TYR I 216    46.794  45.289  -0.972  1.00  36.74    A  C
ATOM  24678  OH   TYR I 216    47.720  45.155  -1.959  1.00  29.95    A  O
ATOM  24679  CE2  TYR I 216    45.979  46.370  -0.934  1.00  37.28    A  C
ATOM  24680  CD2  TYR I 216    45.071  46.500   0.053  1.00  37.51    A  C
ATOM  24681  C    TYR I 216    44.517  48.040   2.786  1.00  39.58    A  C
ATOM  24682  O    TYR I 216    45.567  48.537   2.489  1.00  39.76    A  O
ATOM  24683  N    ASP I 217    43.382  48.702   2.729  1.00  39.81    A  N
ATOM  24684  CA   ASP I 217    43.312  50.043   2.241  1.00  40.87    A  C
ATOM  24685  CB   ASP I 217    41.888  50.504   2.256  1.00  40.80    A  C
ATOM  24686  CG   ASP I 217    41.148  50.068   1.083  1.00  38.55    A  C
ATOM  24687  OD1  ASP I 217    41.750  49.508   0.174  1.00  36.69    A  O
ATOM  24688  OD2  ASP I 217    39.953  50.264   1.078  1.00  38.22    A  O-1
ATOM  24689  C    ASP I 217    44.082  50.983   3.067  1.00  42.34    A  C
ATOM  24690  O    ASP I 217    44.691  51.878   2.558  1.00  42.91    A  O
ATOM  24691  N    ARG I 218    43.998  50.807   4.363  1.00  43.88    A  N
ATOM  24692  CA   ARG I 218    44.775  51.581   5.281  1.00  44.59    A  C
ATOM  24693  CB   ARG I 218    44.333  51.289   6.700  1.00  44.41    A  C
```

Appendix 1

```
ATOM  24694  CG   ARG I 218      45.395  51.411   7.724  1.00  47.43      A    C
ATOM  24695  CD   ARG I 218      45.701  52.839   8.112  1.00  51.87      A    C
ATOM  24696  NE   ARG I 218      46.335  52.885   9.420  1.00  56.30      A    N
ATOM  24697  CZ   ARG I 218      47.627  52.722   9.630  1.00  56.33      A    C
ATOM  24698  NH1  ARG I 218      48.428  52.515   8.622  1.00  59.70      A    N
ATOM  24699  NH2  ARG I 218      48.119  52.768  10.839  1.00  53.41      A    N
ATOM  24700  C    ARG I 218      46.245  51.325   5.105  1.00  44.68      A    C
ATOM  24701  O    ARG I 218      47.011  52.226   5.164  1.00  45.39      A    O
ATOM  24702  N    LEU I 219      46.653  50.089   4.931  1.00  45.16      A    N
ATOM  24703  CA   LEU I 219      48.045  49.830   4.659  1.00  45.61      A    C
ATOM  24704  CB   LEU I 219      48.344  48.342   4.732  1.00  45.05      A    C
ATOM  24705  CG   LEU I 219      48.352  47.612   6.062  1.00  44.67      A    C
ATOM  24706  CD1  LEU I 219      48.180  46.165   5.800  1.00  43.24      A    C
ATOM  24707  CD2  LEU I 219      49.607  47.847   6.771  1.00  42.86      A    C
ATOM  24708  C    LEU I 219      48.504  50.355   3.321  1.00  47.06      A    C
ATOM  24709  O    LEU I 219      49.565  50.903   3.208  1.00  48.49      A    O
ATOM  24710  N    HIS I 220      47.704  50.152   2.293  1.00  48.27      A    N
ATOM  24711  CA   HIS I 220      48.116  50.440   0.947  1.00  48.13      A    C
ATOM  24712  CB   HIS I 220      47.874  49.211   0.135  1.00  48.71      A    C
ATOM  24713  CG   HIS I 220      48.807  48.107   0.454  1.00  48.37      A    C
ATOM  24714  ND1  HIS I 220      50.158  48.226   0.309  1.00  49.42      A    N
ATOM  24715  CE1  HIS I 220      50.731  47.099   0.656  1.00  51.73      A    C
ATOM  24716  NE2  HIS I 220      49.794  46.252   1.007  1.00  48.44      A    N
ATOM  24717  CD2  HIS I 220      48.584  46.861   0.893  1.00  47.32      A    C
ATOM  24718  C    HIS I 220      47.550  51.629   0.200  1.00  48.95      A    C
ATOM  24719  O    HIS I 220      47.941  51.871  -0.905  1.00  48.78      A    O
ATOM  24720  N    GLY I 221      46.613  52.357   0.761  1.00  49.38      A    N
ATOM  24721  CA   GLY I 221      46.076  53.502   0.054  1.00  50.81      A    C
ATOM  24722  C    GLY I 221      44.980  53.234  -0.946  1.00  51.85      A    C
ATOM  24723  O    GLY I 221      44.551  54.103  -1.658  1.00  52.49      A    O
ATOM  24724  N    THR I 222      44.496  52.017  -0.956  1.00  51.83      A    N
ATOM  24725  CA   THR I 222      43.536  51.576  -1.921  1.00  51.46      A    C
ATOM  24726  CB   THR I 222      43.574  50.084  -2.060  1.00  51.82      A    C
ATOM  24727  OG1  THR I 222      43.175  49.473  -0.833  1.00  50.77      A    O
ATOM  24728  CG2  THR I 222      44.936  49.685  -2.368  1.00  51.58      A    C
ATOM  24729  C    THR I 222      42.165  52.026  -1.541  1.00  51.19      A    C
ATOM  24730  O    THR I 222      42.005  52.728  -0.588  1.00  50.84      A    O
ATOM  24731  N    ASP I 223      41.173  51.691  -2.335  1.00  51.39      A    N
ATOM  24732  CA   ASP I 223      39.816  52.032  -1.985  1.00  52.10      A    C
ATOM  24733  CB   ASP I 223      39.352  53.223  -2.808  1.00  52.92      A    C
ATOM  24734  CG   ASP I 223      38.007  53.751  -2.395  1.00  56.00      A    C
ATOM  24735  OD1  ASP I 223      37.535  53.523  -1.282  1.00  56.46      A    O
ATOM  24736  OD2  ASP I 223      37.413  54.444  -3.213  1.00  58.07      A    O-1
ATOM  24737  C    ASP I 223      38.965  50.824  -2.228  1.00  51.09      A    C
ATOM  24738  O    ASP I 223      37.979  50.877  -2.911  1.00  50.06      A    O
ATOM  24739  N    TYR I 224      39.360  49.743  -1.592  1.00  50.36      A    N
ATOM  24740  CA   TYR I 224      38.751  48.465  -1.791  1.00  49.46      A    C
ATOM  24741  CB   TYR I 224      39.611  47.325  -1.304  1.00  49.26      A    C
ATOM  24742  CG   TYR I 224      40.586  46.837  -2.323  1.00  48.93      A    C
ATOM  24743  CD1  TYR I 224      40.185  46.098  -3.380  1.00  48.43      A    C
ATOM  24744  CE1  TYR I 224      41.058  45.672  -4.285  1.00  46.92      A    C
ATOM  24745  CZ   TYR I 224      42.361  45.958  -4.140  1.00  47.93      A    C
ATOM  24746  OH   TYR I 224      43.282  45.527  -5.047  1.00  44.39      A    O
ATOM  24747  CE2  TYR I 224      42.775  46.677  -3.101  1.00  48.80      A    C
```

Appendix 1

```
ATOM  24748  CD2  TYR I 224    41.907  47.106  -2.208  1.00  49.96    A   C
ATOM  24749  C    TYR I 224    37.412  48.422  -1.156  1.00  49.10    A   C
ATOM  24750  O    TYR I 224    36.717  47.486  -1.358  1.00  49.29    A   O
ATOM  24751  N    ARG I 225    36.977  49.487  -0.516  1.00  48.52    A   N
ATOM  24752  CA   ARG I 225    35.642  49.462   0.051  1.00  48.67    A   C
ATOM  24753  CB   ARG I 225    35.572  50.341   1.264  1.00  48.58    A   C
ATOM  24754  CG   ARG I 225    36.740  50.137   2.162  1.00  49.66    A   C
ATOM  24755  CD   ARG I 225    37.176  51.427   2.766  1.00  54.89    A   C
ATOM  24756  NE   ARG I 225    38.183  52.056   1.948  1.00  60.72    A   N
ATOM  24757  CZ   ARG I 225    38.817  53.166   2.264  1.00  61.79    A   C
ATOM  24758  NH1  ARG I 225    38.552  53.760   3.398  1.00  62.82    A   N
ATOM  24759  NH2  ARG I 225    39.719  53.666   1.453  1.00  59.28    A   N
ATOM  24760  C    ARG I 225    34.442  49.707  -0.888  1.00  48.28    A   C
ATOM  24761  O    ARG I 225    34.166  50.771  -1.417  1.00  47.72    A   O
ATOM  24762  N    ALA I 226    33.801  48.568  -1.090  1.00  47.32    A   N
ATOM  24763  CA   ALA I 226    32.529  48.305  -1.673  1.00  44.45    A   C
ATOM  24764  CB   ALA I 226    32.621  47.107  -2.475  1.00  43.92    A   C
ATOM  24765  C    ALA I 226    31.739  47.997  -0.457  1.00  43.66    A   C
ATOM  24766  O    ALA I 226    30.769  47.293  -0.500  1.00  39.81    A   O
ATOM  24767  N    ALA I 227    32.255  48.457   0.664  1.00  44.26    A   N
ATOM  24768  CA   ALA I 227    31.643  48.123   1.905  1.00  46.38    A   C
ATOM  24769  CB   ALA I 227    32.513  48.636   3.024  1.00  43.56    A   C
ATOM  24770  C    ALA I 227    30.289  48.745   1.988  1.00  48.41    A   C
ATOM  24771  O    ALA I 227    29.294  48.114   2.245  1.00  48.58    A   O
ATOM  24772  N    THR I 228    30.285  50.039   1.798  1.00  51.61    A   N
ATOM  24773  CA   THR I 228    29.119  50.844   2.011  1.00  54.27    A   C
ATOM  24774  CB   THR I 228    29.455  52.325   1.944  1.00  55.56    A   C
ATOM  24775  OG1  THR I 228    28.353  53.061   1.403  1.00  54.91    A   O
ATOM  24776  CG2  THR I 228    30.722  52.532   1.130  1.00  55.65    A   C
ATOM  24777  C    THR I 228    28.124  50.448   0.996  1.00  54.64    A   C
ATOM  24778  O    THR I 228    26.923  50.344   1.222  1.00  55.50    A   O
ATOM  24779  N    ARG I 229    28.684  50.286  -0.170  1.00  53.83    A   N
ATOM  24780  CA   ARG I 229    27.812  50.209  -1.243  1.00  53.21    A   C
ATOM  24781  CB   ARG I 229    28.498  50.070  -2.590  1.00  54.00    A   C
ATOM  24782  CG   ARG I 229    29.793  49.398  -2.588  1.00  59.65    A   C
ATOM  24783  CD   ARG I 229    30.724  50.169  -3.443  1.00  69.22    A   C
ATOM  24784  NE   ARG I 229    31.296  49.369  -4.512  1.00  74.01    A   N
ATOM  24785  CZ   ARG I 229    30.717  48.327  -5.087  1.00  76.50    A   C
ATOM  24786  NH1  ARG I 229    29.515  47.931  -4.718  1.00  74.05    A   N
ATOM  24787  NH2  ARG I 229    31.365  47.679  -6.041  1.00  77.74    A   N
ATOM  24788  C    ARG I 229    27.149  48.980  -0.881  1.00  50.20    A   C
ATOM  24789  O    ARG I 229    26.571  48.845   0.162  1.00  47.00    A   O
ATOM  24790  N    ALA I 230    27.286  48.048  -1.754  1.00  48.90    A   N
ATOM  24791  CA   ALA I 230    26.258  47.147  -1.887  1.00  48.95    A   C
ATOM  24792  CB   ALA I 230    26.659  46.110  -2.903  1.00  49.41    A   C
ATOM  24793  C    ALA I 230    26.062  46.532  -0.552  1.00  47.21    A   C
ATOM  24794  O    ALA I 230    24.958  46.445  -0.091  1.00  46.81    A   O
ATOM  24795  N    TRP I 231    27.128  46.117   0.086  1.00  44.78    A   N
ATOM  24796  CA   TRP I 231    26.991  45.176   1.162  1.00  42.32    A   C
ATOM  24797  CB   TRP I 231    28.353  44.626   1.546  1.00  41.92    A   C
ATOM  24798  CG   TRP I 231    28.256  43.539   2.485  1.00  35.24    A   C
ATOM  24799  CD1  TRP I 231    27.827  42.322   2.234  1.00  32.62    A   C
ATOM  24800  NE1  TRP I 231    27.851  41.578   3.340  1.00  33.06    A   N
ATOM  24801  CE2  TRP I 231    28.318  42.338   4.365  1.00  29.91    A   C
```

Appendix 1

```
ATOM  24802  CD2  TRP  I  231    28.575  43.580   3.856  1.00  30.48    A    C
ATOM  24803  CE3  TRP  I  231    29.066  44.557   4.702  1.00  30.02    A    C
ATOM  24804  CZ3  TRP  I  231    29.269  44.260   5.977  1.00  24.29    A    C
ATOM  24805  CH2  TRP  I  231    29.006  43.019   6.459  1.00  27.10    A    C
ATOM  24806  CZ2  TRP  I  231    28.524  42.037   5.669  1.00  27.25    A    C
ATOM  24807  C    TRP  I  231    26.230  45.613   2.376  1.00  41.57    A    C
ATOM  24808  O    TRP  I  231    25.355  44.923   2.785  1.00  39.34    A    O
ATOM  24809  N    LEU  I  232    26.524  46.766   2.929  1.00  41.44    A    N
ATOM  24810  CA   LEU  I  232    25.752  47.233   4.066  1.00  43.63    A    C
ATOM  24811  CB   LEU  I  232    26.369  48.471   4.678  1.00  43.72    A    C
ATOM  24812  CG   LEU  I  232    27.055  48.268   6.009  1.00  42.82    A    C
ATOM  24813  CD1  LEU  I  232    28.253  47.537   5.837  1.00  39.15    A    C
ATOM  24814  CD2  LEU  I  232    27.413  49.540   6.548  1.00  44.28    A    C
ATOM  24815  C    LEU  I  232    24.285  47.467   3.746  1.00  45.05    A    C
ATOM  24816  O    LEU  I  232    23.432  47.256   4.566  1.00  44.08    A    O
ATOM  24817  N    ASP  I  233    24.016  47.931   2.544  1.00  46.99    A    N
ATOM  24818  CA   ASP  I  233    22.674  48.072   2.043  1.00  48.18    A    C
ATOM  24819  CB   ASP  I  233    22.679  48.959   0.814  1.00  48.58    A    C
ATOM  24820  CG   ASP  I  233    22.992  50.372   1.148  1.00  52.38    A    C
ATOM  24821  OD1  ASP  I  233    22.728  50.772   2.277  1.00  52.44    A    O
ATOM  24822  OD2  ASP  I  233    23.511  51.099   0.303  1.00  55.81    A    O-1
ATOM  24823  C    ASP  I  233    21.936  46.780   1.809  1.00  48.28    A    C
ATOM  24824  O    ASP  I  233    20.782  46.684   2.100  1.00  49.19    A    O
ATOM  24825  N    PHE  I  234    22.622  45.795   1.270  1.00  48.24    A    N
ATOM  24826  CA   PHE  I  234    22.086  44.472   1.010  1.00  47.58    A    C
ATOM  24827  CB   PHE  I  234    23.074  43.719   0.135  1.00  47.02    A    C
ATOM  24828  CG   PHE  I  234    22.801  42.277  -0.010  1.00  46.38    A    C
ATOM  24829  CD1  PHE  I  234    21.756  41.834  -0.720  1.00  46.63    A    C
ATOM  24830  CE1  PHE  I  234    21.528  40.512  -0.854  1.00  45.89    A    C
ATOM  24831  CZ   PHE  I  234    22.353  39.643  -0.308  1.00  43.55    A    C
ATOM  24832  CE2  PHE  I  234    23.401  40.065   0.383  1.00  45.12    A    C
ATOM  24833  CD2  PHE  I  234    23.636  41.357   0.527  1.00  45.97    A    C
ATOM  24834  C    PHE  I  234    21.687  43.685   2.252  1.00  48.14    A    C
ATOM  24835  O    PHE  I  234    20.748  42.944   2.240  1.00  48.48    A    O
ATOM  24836  N    ILE  I  235    22.447  43.809   3.315  1.00  48.35    A    N
ATOM  24837  CA   ILE  I  235    22.167  43.061   4.524  1.00  47.98    A    C
ATOM  24838  CB   ILE  I  235    23.387  42.881   5.426  1.00  47.27    A    C
ATOM  24839  CG1  ILE  I  235    23.990  44.211   5.822  1.00  45.35    A    C
ATOM  24840  CD1  ILE  I  235    25.043  44.096   6.792  1.00  43.09    A    C
ATOM  24841  CG2  ILE  I  235    24.382  42.042   4.719  1.00  44.29    A    C
ATOM  24842  C    ILE  I  235    20.907  43.485   5.229  1.00  49.11    A    C
ATOM  24843  O    ILE  I  235    20.228  42.700   5.825  1.00  49.18    A    O
ATOM  24844  N    GLN  I  236    20.618  44.757   5.099  1.00  50.75    A    N
ATOM  24845  CA   GLN  I  236    19.427  45.366   5.626  1.00  52.87    A    C
ATOM  24846  CB   GLN  I  236    19.599  46.875   5.689  1.00  52.49    A    C
ATOM  24847  CG   GLN  I  236    20.948  47.284   6.205  1.00  53.73    A    C
ATOM  24848  CD   GLN  I  236    20.970  48.593   6.943  1.00  55.45    A    C
ATOM  24849  OE1  GLN  I  236    21.642  49.510   6.548  1.00  55.99    A    O
ATOM  24850  NE2  GLN  I  236    20.279  48.662   8.044  1.00  56.55    A    N
ATOM  24851  C    GLN  I  236    18.165  44.971   4.881  1.00  53.96    A    C
ATOM  24852  O    GLN  I  236    17.108  45.221   5.357  1.00  53.66    A    O
ATOM  24853  N    LYS  I  237    18.296  44.337   3.727  1.00  56.19    A    N
ATOM  24854  CA   LYS  I  237    17.155  43.868   2.970  1.00  57.15    A    C
ATOM  24855  CB   LYS  I  237    17.375  44.164   1.502  1.00  57.09    A    C
```

Appendix 1

```
ATOM  24856  CG   LYS I 237      17.589  45.572   1.117  1.00 57.39      A    C
ATOM  24857  CD   LYS I 237      17.413  45.692  -0.370  1.00 60.86      A    C
ATOM  24858  CE   LYS I 237      18.312  46.741  -1.003  1.00 63.27      A    C
ATOM  24859  NZ   LYS I 237      18.851  46.281  -2.297  1.00 62.14      A    N
ATOM  24860  C    LYS I 237      17.034  42.381   3.022  1.00 58.16      A    C
ATOM  24861  O    LYS I 237      17.624  41.707   2.211  1.00 58.47      A    O
ATOM  24862  N    ASP I 238      16.264  41.873   3.964  1.00 58.88      A    N
ATOM  24863  CA   ASP I 238      15.832  40.484   3.973  1.00 60.25      A    C
ATOM  24864  CB   ASP I 238      15.747  39.943   2.553  1.00 60.96      A    C
ATOM  24865  CG   ASP I 238      14.334  39.811   2.053  1.00 64.33      A    C
ATOM  24866  OD1  ASP I 238      13.514  40.718   2.305  1.00 64.60      A    O
ATOM  24867  OD2  ASP I 238      14.069  38.806   1.379  1.00 64.42      A    O-1
ATOM  24868  C    ASP I 238      16.743  39.579   4.725  1.00 59.35      A    C
ATOM  24869  O    ASP I 238      16.385  38.473   5.021  1.00 59.07      A    O
ATOM  24870  N    LEU I 239      17.942  40.047   4.996  1.00 59.00      A    N
ATOM  24871  CA   LEU I 239      18.838  39.336   5.868  1.00 58.22      A    C
ATOM  24872  CB   LEU I 239      20.267  39.605   5.467  1.00 58.36      A    C
ATOM  24873  CG   LEU I 239      21.037  38.495   4.790  1.00 56.06      A    C
ATOM  24874  CD1  LEU I 239      20.148  37.649   4.023  1.00 53.16      A    C
ATOM  24875  CD2  LEU I 239      21.996  39.141   3.906  1.00 55.13      A    C
ATOM  24876  C    LEU I 239      18.649  39.751   7.300  1.00 57.97      A    C
ATOM  24877  O    LEU I 239      19.124  39.099   8.185  1.00 58.18      A    O
ATOM  24878  N    ILE I 240      17.948  40.845   7.529  1.00 56.99      A    N
ATOM  24879  CA   ILE I 240      17.810  41.371   8.864  1.00 56.16      A    C
ATOM  24880  CB   ILE I 240      18.556  42.656   9.012  1.00 55.60      A    C
ATOM  24881  CG1  ILE I 240      19.051  42.797  10.437  1.00 55.95      A    C
ATOM  24882  CD1  ILE I 240      19.630  44.128  10.754  1.00 53.74      A    C
ATOM  24883  CG2  ILE I 240      17.667  43.765   8.736  1.00 55.41      A    C
ATOM  24884  C    ILE I 240      16.387  41.630   9.257  1.00 56.17      A    C
ATOM  24885  O    ILE I 240      15.557  41.847   8.434  1.00 56.41      A    O
ATOM  24886  N    ASP I 241      16.137  41.577  10.551  1.00 56.27      A    N
ATOM  24887  CA   ASP I 241      14.891  41.986  11.133  1.00 55.81      A    C
ATOM  24888  CB   ASP I 241      14.432  40.910  12.103  1.00 56.39      A    C
ATOM  24889  CG   ASP I 241      13.090  41.173  12.667  1.00 57.95      A    C
ATOM  24890  OD1  ASP I 241      12.703  42.328  12.764  1.00 58.97      A    O
ATOM  24891  OD2  ASP I 241      12.415  40.224  13.025  1.00 58.83      A    O-1
ATOM  24892  C    ASP I 241      15.148  43.283  11.855  1.00 54.55      A    C
ATOM  24893  O    ASP I 241      15.713  43.311  12.903  1.00 53.87      A    O
ATOM  24894  N    PRO I 242      14.766  44.368  11.230  1.00 53.98      A    N
ATOM  24895  CA   PRO I 242      15.072  45.691  11.711  1.00 53.94      A    C
ATOM  24896  CB   PRO I 242      14.623  46.561  10.567  1.00 54.01      A    C
ATOM  24897  CG   PRO I 242      14.672  45.732   9.462  1.00 53.11      A    C
ATOM  24898  CD   PRO I 242      14.146  44.466   9.923  1.00 54.10      A    C
ATOM  24899  C    PRO I 242      14.381  46.046  12.990  1.00 53.72      A    C
ATOM  24900  O    PRO I 242      14.884  46.857  13.704  1.00 54.40      A    O
ATOM  24901  N    GLU I 243      13.212  45.514  13.247  1.00 53.72      A    N
ATOM  24902  CA   GLU I 243      12.570  45.771  14.510  1.00 54.72      A    C
ATOM  24903  CB   GLU I 243      11.149  45.259  14.485  1.00 55.14      A    C
ATOM  24904  CG   GLU I 243      10.297  46.039  13.546  1.00 58.20      A    C
ATOM  24905  CD   GLU I 243      10.560  47.511  13.644  1.00 64.38      A    C
ATOM  24906  OE1  GLU I 243      10.506  48.014  14.763  1.00 66.79      A    O
ATOM  24907  OE2  GLU I 243      10.824  48.179  12.633  1.00 65.34      A    O-1
ATOM  24908  C    GLU I 243      13.338  45.165  15.650  1.00 54.04      A    C
ATOM  24909  O    GLU I 243      13.493  45.757  16.676  1.00 54.51      A    O
```

Appendix 1

```
ATOM  24910  N    ARG I 244      13.821  43.960  15.445  1.00 52.91      A  N
ATOM  24911  CA   ARG I 244      14.523  43.228  16.462  1.00 51.40      A  C
ATOM  24912  CB   ARG I 244      14.161  41.781  16.303  1.00 51.30      A  C
ATOM  24913  CG   ARG I 244      12.720  41.599  16.207  1.00 53.27      A  C
ATOM  24914  CD   ARG I 244      12.303  40.344  16.821  1.00 51.71      A  C
ATOM  24915  NE   ARG I 244      12.337  39.313  15.822  1.00 54.55      A  N
ATOM  24916  CZ   ARG I 244      11.960  38.077  16.047  1.00 57.47      A  C
ATOM  24917  NH1  ARG I 244      11.515  37.764  17.243  1.00 58.14      A  N
ATOM  24918  NH2  ARG I 244      12.005  37.176  15.084  1.00 54.44      A  N
ATOM  24919  C    ARG I 244      16.027  43.375  16.516  1.00 49.93      A  C
ATOM  24920  O    ARG I 244      16.643  42.931  17.456  1.00 49.48      A  O
ATOM  24921  N    GLY I 245      16.602  44.023  15.524  1.00 48.67      A  N
ATOM  24922  CA   GLY I 245      18.036  44.149  15.408  1.00 47.38      A  C
ATOM  24923  C    GLY I 245      18.813  42.858  15.314  1.00 46.33      A  C
ATOM  24924  O    GLY I 245      19.791  42.680  15.977  1.00 47.12      A  O
ATOM  24925  N    ALA I 246      18.380  41.961  14.462  1.00 43.49      A  N
ATOM  24926  CA   ALA I 246      19.001  40.684  14.385  1.00 41.10      A  C
ATOM  24927  CB   ALA I 246      18.253  39.749  15.217  1.00 41.13      A  C
ATOM  24928  C    ALA I 246      19.056  40.195  12.970  1.00 39.78      A  C
ATOM  24929  O    ALA I 246      18.268  40.557  12.165  1.00 39.48      A  O
ATOM  24930  N    PHE I 247      20.016  39.358  12.673  1.00 37.95      A  N
ATOM  24931  CA   PHE I 247      20.151  38.881  11.339  1.00 37.04      A  C
ATOM  24932  CB   PHE I 247      21.593  38.825  10.906  1.00 36.38      A  C
ATOM  24933  CG   PHE I 247      22.213  40.123  10.689  1.00 32.40      A  C
ATOM  24934  CD1  PHE I 247      22.042  40.789   9.539  1.00 36.90      A  C
ATOM  24935  CE1  PHE I 247      22.634  41.960   9.344  1.00 34.84      A  C
ATOM  24936  CZ   PHE I 247      23.415  42.474  10.286  1.00 35.12      A  C
ATOM  24937  CE2  PHE I 247      23.599  41.824  11.424  1.00 32.27      A  C
ATOM  24938  CD2  PHE I 247      23.020  40.658  11.621  1.00 33.51      A  C
ATOM  24939  C    PHE I 247      19.623  37.507  11.320  1.00 38.01      A  C
ATOM  24940  O    PHE I 247      19.718  36.788  12.259  1.00 37.43      A  O
ATOM  24941  N    TYR I 248      19.059  37.137  10.206  1.00 39.19      A  N
ATOM  24942  CA   TYR I 248      18.603  35.798  10.036  1.00 39.46      A  C
ATOM  24943  CB   TYR I 248      17.638  35.724   8.880  1.00 39.18      A  C
ATOM  24944  CG   TYR I 248      16.285  36.229   9.255  1.00 39.50      A  C
ATOM  24945  CD1  TYR I 248      15.324  35.396   9.742  1.00 38.05      A  C
ATOM  24946  CE1  TYR I 248      14.128  35.857  10.085  1.00 39.88      A  C
ATOM  24947  CZ   TYR I 248      13.847  37.170   9.947  1.00 41.62      A  C
ATOM  24948  OH   TYR I 248      12.631  37.645  10.294  1.00 39.77      A  O
ATOM  24949  CE2  TYR I 248      14.768  38.014   9.472  1.00 41.15      A  C
ATOM  24950  CD2  TYR I 248      15.975  37.547   9.123  1.00 42.24      A  C
ATOM  24951  C    TYR I 248      19.841  34.966   9.858  1.00 39.29      A  C
ATOM  24952  O    TYR I 248      20.889  35.490   9.589  1.00 38.67      A  O
ATOM  24953  N    LEU I 249      19.732  33.680  10.087  1.00 39.03      A  N
ATOM  24954  CA   LEU I 249      20.888  32.834  10.197  1.00 39.75      A  C
ATOM  24955  CB   LEU I 249      20.418  31.450  10.551  1.00 39.49      A  C
ATOM  24956  CG   LEU I 249      21.422  30.486  11.103  1.00 39.03      A  C
ATOM  24957  CD1  LEU I 249      21.857  30.996  12.378  1.00 42.63      A  C
ATOM  24958  CD2  LEU I 249      20.819  29.174  11.269  1.00 38.87      A  C
ATOM  24959  C    LEU I 249      21.743  32.729   8.964  1.00 40.41      A  C
ATOM  24960  O    LEU I 249      22.917  32.772   9.037  1.00 41.85      A  O
ATOM  24961  N    SER I 250      21.154  32.537   7.822  1.00 40.65      A  N
ATOM  24962  CA   SER I 250      21.942  32.458   6.634  1.00 41.11      A  C
ATOM  24963  CB   SER I 250      22.629  31.130   6.534  1.00 40.50      A  C
```

Appendix 1

```
ATOM  24964  OG   SER I 250      21.701  30.125   6.340  1.00 40.74      A    O
ATOM  24965  C    SER I 250      21.095  32.698   5.437  1.00 41.41      A    C
ATOM  24966  O    SER I 250      19.899  32.698   5.524  1.00 41.36      A    O
ATOM  24967  N    TYR I 251      21.742  32.899   4.315  1.00 41.65      A    N
ATOM  24968  CA   TYR I 251      21.088  33.175   3.080  1.00 43.64      A    C
ATOM  24969  CB   TYR I 251      21.457  34.569   2.673  1.00 43.23      A    C
ATOM  24970  CG   TYR I 251      21.158  34.954   1.285  1.00 45.05      A    C
ATOM  24971  CD1  TYR I 251      19.888  34.962   0.819  1.00 46.35      A    C
ATOM  24972  CE1  TYR I 251      19.633  35.331  -0.429  1.00 51.52      A    C
ATOM  24973  CZ   TYR I 251      20.659  35.719  -1.258  1.00 53.56      A    C
ATOM  24974  OH   TYR I 251      20.414  36.098  -2.539  1.00 54.25      A    O
ATOM  24975  CE2  TYR I 251      21.922  35.726  -0.807  1.00 51.82      A    C
ATOM  24976  CD2  TYR I 251      22.159  35.351   0.451  1.00 50.96      A    C
ATOM  24977  C    TYR I 251      21.570  32.176   2.084  1.00 44.71      A    C
ATOM  24978  O    TYR I 251      22.679  31.780   2.143  1.00 45.14      A    O
ATOM  24979  N    HIS I 252      20.717  31.731   1.189  1.00 46.87      A    N
ATOM  24980  CA   HIS I 252      21.131  30.816   0.145  1.00 47.49      A    C
ATOM  24981  CB   HIS I 252      20.572  29.496   0.495  1.00 46.20      A    C
ATOM  24982  CG   HIS I 252      20.761  29.209   1.930  1.00 45.99      A    C
ATOM  24983  ND1  HIS I 252      21.822  28.486   2.391  1.00 43.84      A    N
ATOM  24984  CE1  HIS I 252      21.788  28.452   3.701  1.00 41.82      A    C
ATOM  24985  NE2  HIS I 252      20.754  29.153   4.104  1.00 45.04      A    N
ATOM  24986  CD2  HIS I 252      20.105  29.650   3.014  1.00 44.35      A    C
ATOM  24987  C    HIS I 252      20.686  31.260  -1.138  1.00 49.77      A    C
ATOM  24988  O    HIS I 252      19.559  31.133  -1.560  1.00 49.42      A    O
ATOM  24989  N    PRO I 253      21.630  31.828  -1.893  1.00 52.08      A    N
ATOM  24990  CA   PRO I 253      21.407  32.618  -3.082  1.00 53.34      A    C
ATOM  24991  CB   PRO I 253      22.809  33.106  -3.419  1.00 53.54      A    C
ATOM  24992  CG   PRO I 253      23.695  32.338  -2.611  1.00 52.26      A    C
ATOM  24993  CD   PRO I 253      22.994  31.975  -1.407  1.00 51.64      A    C
ATOM  24994  C    PRO I 253      20.831  31.885  -4.254  1.00 54.69      A    C
ATOM  24995  O    PRO I 253      19.997  32.438  -4.923  1.00 55.09      A    O
ATOM  24996  N    GLU I 254      21.302  30.691  -4.540  1.00 55.71      A    N
ATOM  24997  CA   GLU I 254      20.898  30.027  -5.737  1.00 57.14      A    C
ATOM  24998  CB   GLU I 254      21.590  28.701  -5.827  1.00 58.22      A    C
ATOM  24999  CG   GLU I 254      20.634  27.549  -5.902  1.00 62.30      A    C
ATOM  25000  CD   GLU I 254      20.775  26.732  -7.176  1.00 67.83      A    C
ATOM  25001  OE1  GLU I 254      21.449  27.169  -8.109  1.00 68.80      A    O
ATOM  25002  OE2  GLU I 254      20.184  25.653  -7.257  1.00 69.66      A    O-1
ATOM  25003  C    GLU I 254      19.435  29.772  -5.685  1.00 56.86      A    C
ATOM  25004  O    GLU I 254      18.711  29.993  -6.623  1.00 57.63      A    O
ATOM  25005  N    SER I 255      19.008  29.263  -4.565  1.00 56.45      A    N
ATOM  25006  CA   SER I 255      17.632  28.992  -4.333  1.00 55.53      A    C
ATOM  25007  CB   SER I 255      17.506  27.854  -3.390  1.00 55.44      A    C
ATOM  25008  OG   SER I 255      17.820  28.373  -2.150  1.00 56.46      A    O
ATOM  25009  C    SER I 255      17.103  30.153  -3.600  1.00 54.63      A    C
ATOM  25010  O    SER I 255      17.739  30.698  -2.736  1.00 54.17      A    O
ATOM  25011  N    GLY I 256      15.918  30.544  -3.963  1.00 53.93      A    N
ATOM  25012  CA   GLY I 256      15.311  31.606  -3.253  1.00 53.73      A    C
ATOM  25013  C    GLY I 256      16.240  32.210  -2.257  1.00 53.18      A    C
ATOM  25014  O    GLY I 256      16.977  33.073  -2.589  1.00 52.45      A    O
ATOM  25015  N    ALA I 257      16.167  31.763  -1.018  1.00 52.43      A    N
ATOM  25016  CA   ALA I 257      16.464  32.642   0.061  1.00 51.24      A    C
ATOM  25017  CB   ALA I 257      15.433  33.710   0.088  1.00 51.82      A    C
```

Appendix 1

```
ATOM  25018  C    ALA I 257      16.773  32.138   1.476  1.00 50.01      A  C
ATOM  25019  O    ALA I 257      17.278  31.085   1.674  1.00 48.84      A  O
ATOM  25020  N    VAL I 258      16.411  32.977   2.433  1.00 43.98      A  N
ATOM  25021  CA   VAL I 258      16.878  33.044   3.805  1.00 47.56      A  C
ATOM  25022  CB   VAL I 258      16.530  34.394   4.317  1.00 47.58      A  C
ATOM  25023  CG1  VAL I 258      16.957  34.577   5.708  1.00 44.53      A  C
ATOM  25024  CG2  VAL I 258      17.130  35.395   3.445  1.00 47.95      A  C
ATOM  25025  C    VAL I 258      16.354  32.082   4.822  1.00 47.49      A  C
ATOM  25026  O    VAL I 258      15.202  31.800   4.839  1.00 48.46      A  O
ATOM  25027  N    LYS I 259      17.204  31.627   5.718  1.00 47.09      A  N
ATOM  25028  CA   LYS I 259      16.750  30.794   6.823  1.00 47.06      A  C
ATOM  25029  CB   LYS I 259      17.924  30.115   7.507  1.00 46.30      A  C
ATOM  25030  CG   LYS I 259      17.987  28.668   7.221  1.00 46.31      A  C
ATOM  25031  CD   LYS I 259      19.339  28.081   7.398  1.00 44.25      A  C
ATOM  25032  CE   LYS I 259      19.501  26.849   6.581  1.00 41.16      A  C
ATOM  25033  NZ   LYS I 259      20.651  26.069   6.979  1.00 42.52      A  N
ATOM  25034  C    LYS I 259      15.916  31.591   7.814  1.00 47.04      A  C
ATOM  25035  O    LYS I 259      16.173  32.739   8.025  1.00 46.76      A  O
ATOM  25036  N    PRO I 260      14.933  30.954   8.425  1.00 46.71      A  N
ATOM  25037  CA   PRO I 260      13.875  31.623   9.168  1.00 46.24      A  C
ATOM  25038  CB   PRO I 260      12.714  30.659   9.029  1.00 45.89      A  C
ATOM  25039  CG   PRO I 260      13.289  29.432   8.679  1.00 46.43      A  C
ATOM  25040  CD   PRO I 260      14.416  29.740   7.809  1.00 46.74      A  C
ATOM  25041  C    PRO I 260      14.101  31.899  10.635  1.00 46.49      A  C
ATOM  25042  O    PRO I 260      13.175  32.377  11.249  1.00 47.26      A  O
ATOM  25043  N    TRP I 261      15.278  31.628  11.175  1.00 44.30      A  N
ATOM  25044  CA   TRP I 261      15.541  31.843  12.570  1.00 42.05      A  C
ATOM  25045  CB   TRP I 261      16.068  30.574  13.180  1.00 41.23      A  C
ATOM  25046  CG   TRP I 261      15.229  29.373  12.936  1.00 40.50      A  C
ATOM  25047  CD1  TRP I 261      14.267  28.900  13.731  1.00 38.51      A  C
ATOM  25048  NE1  TRP I 261      13.727  27.788  13.219  1.00 37.11      A  N
ATOM  25049  CE2  TRP I 261      14.344  27.502  12.045  1.00 37.64      A  C
ATOM  25050  CD2  TRP I 261      15.308  28.473  11.844  1.00 39.06      A  C
ATOM  25051  CE3  TRP I 261      16.093  28.400  10.708  1.00 39.26      A  C
ATOM  25052  CZ3  TRP I 261      15.883  27.380   9.843  1.00 33.55      A  C
ATOM  25053  CH2  TRP I 261      14.920  26.442  10.072  1.00 31.31      A  C
ATOM  25054  CZ2  TRP I 261      14.141  26.480  11.167  1.00 33.84      A  C
ATOM  25055  C    TRP I 261      16.560  32.932  12.733  1.00 42.73      A  C
ATOM  25056  O    TRP I 261      17.557  32.920  12.075  1.00 43.21      A  O
ATOM  25057  N    ILE I 262      16.294  33.900  13.590  1.00 42.02      A  N
ATOM  25058  CA   ILE I 262      17.303  34.857  13.942  1.00 40.56      A  C
ATOM  25059  CB   ILE I 262      16.744  36.138  14.512  1.00 40.84      A  C
ATOM  25060  CG1  ILE I 262      15.647  35.872  15.509  1.00 41.92      A  C
ATOM  25061  CD1  ILE I 262      15.576  36.891  16.562  1.00 38.37      A  C
ATOM  25062  CG2  ILE I 262      16.213  36.962  13.450  1.00 40.50      A  C
ATOM  25063  C    ILE I 262      18.308  34.270  14.903  1.00 40.06      A  C
ATOM  25064  O    ILE I 262      17.974  33.464  15.723  1.00 38.67      A  O
ATOM  25065  N    SER I 263      19.550  34.687  14.764  1.00 39.20      A  N
ATOM  25066  CA   SER I 263      20.630  34.194  15.573  1.00 37.45      A  C
ATOM  25067  CB   SER I 263      21.596  33.417  14.710  1.00 38.54      A  C
ATOM  25068  OG   SER I 263      22.865  33.358  15.305  1.00 37.36      A  O
ATOM  25069  C    SER I 263      21.389  35.293  16.251  1.00 36.85      A  C
ATOM  25070  O    SER I 263      21.854  36.188  15.619  1.00 35.89      A  O
ATOM  25071  N    ALA I 264      21.504  35.205  17.561  1.00 35.61      A  N
```

Appendix 1

```
ATOM   25072  CA   ALA I 264      22.273  36.138  18.348  1.00 34.82      A   C
ATOM   25073  CB   ALA I 264      21.987  35.927  19.759  1.00 34.99      A   C
ATOM   25074  C    ALA I 264      23.774  36.138  18.125  1.00 34.84      A   C
ATOM   25075  O    ALA I 264      24.397  37.179  18.060  1.00 33.59      A   O
ATOM   25076  N    TYR I 265      24.363  34.963  18.045  1.00 32.57      A   N
ATOM   25077  CA   TYR I 265      25.780  34.890  17.833  1.00 31.85      A   C
ATOM   25078  CB   TYR I 265      26.347  33.486  18.080  1.00 30.39      A   C
ATOM   25079  CG   TYR I 265      26.726  32.691  16.867  1.00 31.72      A   C
ATOM   25080  CD1  TYR I 265      27.929  32.851  16.256  1.00 29.56      A   C
ATOM   25081  CE1  TYR I 265      28.232  32.159  15.176  1.00 32.04      A   C
ATOM   25082  CZ   TYR I 265      27.368  31.251  14.697  1.00 31.93      A   C
ATOM   25083  OH   TYR I 265      27.677  30.526  13.623  1.00 34.22      A   O
ATOM   25084  CE2  TYR I 265      26.203  31.057  15.283  1.00 32.50      A   C
ATOM   25085  CD2  TYR I 265      25.883  31.763  16.353  1.00 31.81      A   C
ATOM   25086  C    TYR I 265      26.114  35.479  16.494  1.00 31.61      A   C
ATOM   25087  O    TYR I 265      27.076  36.152  16.364  1.00 32.31      A   O
ATOM   25088  N    THR I 266      25.290  35.248  15.502  1.00 32.03      A   N
ATOM   25089  CA   THR I 266      25.518  35.842  14.216  1.00 32.92      A   C
ATOM   25090  CB   THR I 266      24.507  35.345  13.211  1.00 33.32      A   C
ATOM   25091  OG1  THR I 266      24.740  33.976  12.957  1.00 34.29      A   O
ATOM   25092  CG2  THR I 266      24.632  36.069  11.962  1.00 30.02      A   C
ATOM   25093  C    THR I 266      25.440  37.344  14.253  1.00 34.08      A   C
ATOM   25094  O    THR I 266      26.219  38.018  13.637  1.00 34.79      A   O
ATOM   25095  N    THR I 267      24.448  37.861  14.929  1.00 34.62      A   N
ATOM   25096  CA   THR I 267      24.305  39.281  15.036  1.00 34.89      A   C
ATOM   25097  CB   THR I 267      22.983  39.656  15.656  1.00 35.28      A   C
ATOM   25098  OG1  THR I 267      21.935  39.084  14.904  1.00 35.30      A   O
ATOM   25099  CG2  THR I 267      22.816  41.111  15.637  1.00 33.55      A   C
ATOM   25100  C    THR I 267      25.366  39.960  15.818  1.00 34.70      A   C
ATOM   25101  O    THR I 267      25.812  41.001  15.437  1.00 34.06      A   O
ATOM   25102  N    ALA I 268      25.710  39.379  16.951  1.00 34.73      A   N
ATOM   25103  CA   ALA I 268      26.585  40.010  17.895  1.00 34.72      A   C
ATOM   25104  CB   ALA I 268      26.649  39.217  19.136  1.00 34.18      A   C
ATOM   25105  C    ALA I 268      27.940  40.204  17.357  1.00 35.39      A   C
ATOM   25106  O    ALA I 268      28.535  41.203  17.577  1.00 36.08      A   O
ATOM   25107  N    TRP I 269      28.440  39.186  16.697  1.00 36.65      A   N
ATOM   25108  CA   TRP I 269      29.690  39.234  15.989  1.00 36.67      A   C
ATOM   25109  CB   TRP I 269      30.030  37.812  15.578  1.00 37.38      A   C
ATOM   25110  CG   TRP I 269      31.081  37.592  14.581  1.00 38.32      A   C
ATOM   25111  CD1  TRP I 269      31.769  38.505  13.906  1.00 39.52      A   C
ATOM   25112  NE1  TRP I 269      32.636  37.913  13.062  1.00 41.12      A   N
ATOM   25113  CE2  TRP I 269      32.496  36.568  13.174  1.00 42.99      A   C
ATOM   25114  CD2  TRP I 269      31.524  36.340  14.120  1.00 40.76      A   C
ATOM   25115  CE3  TRP I 269      31.185  35.033  14.420  1.00 42.11      A   C
ATOM   25116  CZ3  TRP I 269      31.811  34.043  13.777  1.00 45.53      A   C
ATOM   25117  CH2  TRP I 269      32.784  34.294  12.843  1.00 43.96      A   C
ATOM   25118  CZ2  TRP I 269      33.136  35.550  12.522  1.00 44.36      A   C
ATOM   25119  C    TRP I 269      29.663  40.156  14.805  1.00 37.14      A   C
ATOM   25120  O    TRP I 269      30.556  40.915  14.593  1.00 37.58      A   O
ATOM   25121  N    THR I 270      28.625  40.076  14.011  1.00 37.73      A   N
ATOM   25122  CA   THR I 270      28.549  40.896  12.837  1.00 37.52      A   C
ATOM   25123  CB   THR I 270      27.295  40.562  12.032  1.00 39.44      A   C
ATOM   25124  OG1  THR I 270      27.132  39.153  11.972  1.00 38.00      A   O
ATOM   25125  CG2  THR I 270      27.358  41.139  10.640  1.00 34.91      A   C
```

Appendix 1

```
ATOM  25126  C    THR I 270    28.510  42.351  13.189  1.00  37.69    A  C
ATOM  25127  O    THR I 270    29.185  43.134  12.597  1.00  37.77    A  O
ATOM  25128  N    LEU I 271    27.712  42.707  14.168  1.00  35.87    A  N
ATOM  25129  CA   LEU I 271    27.564  44.086  14.516  1.00  34.99    A  C
ATOM  25130  CB   LEU I 271    26.499  44.274  15.573  1.00  34.80    A  C
ATOM  25131  CG   LEU I 271    25.047  44.212  15.130  1.00  34.68    A  C
ATOM  25132  CD1  LEU I 271    24.129  44.393  16.260  1.00  36.09    A  C
ATOM  25133  CD2  LEU I 271    24.740  45.160  14.074  1.00  27.95    A  C
ATOM  25134  C    LEU I 271    28.841  44.666  14.981  1.00  34.81    A  C
ATOM  25135  O    LEU I 271    29.129  45.771  14.680  1.00  34.83    A  O
ATOM  25136  N    ALA I 272    29.611  43.913  15.724  1.00  34.43    A  N
ATOM  25137  CA   ALA I 272    30.861  44.388  16.236  1.00  33.51    A  C
ATOM  25138  CB   ALA I 272    31.402  43.394  17.167  1.00  32.19    A  C
ATOM  25139  C    ALA I 272    31.878  44.711  15.184  1.00  33.66    A  C
ATOM  25140  O    ALA I 272    32.584  45.659  15.269  1.00  32.95    A  O
ATOM  25141  N    MET I 273    31.990  43.867  14.201  1.00  35.38    A  N
ATOM  25142  CA   MET I 273    32.829  44.144  13.081  1.00  37.81    A  C
ATOM  25143  CB   MET I 273    33.158  42.883  12.327  1.00  38.41    I  C
ATOM  25144  CG   MET I 273    34.081  42.049  13.151  1.00  44.19    I  C
ATOM  25145  SD   MET I 273    34.868  40.773  12.295  1.00  52.20    I  S
ATOM  25146  CE   MET I 273    35.165  41.630  10.823  1.00  55.60    I  C
ATOM  25147  C    MET I 273    32.337  45.249  12.220  1.00  37.66    A  C
ATOM  25148  O    MET I 273    33.090  46.041  11.762  1.00  38.72    A  O
ATOM  25149  N    VAL I 274    31.048  45.329  12.046  1.00  37.90    A  N
ATOM  25150  CA   VAL I 274    30.475  46.396  11.262  1.00  38.40    A  C
ATOM  25151  CB   VAL I 274    29.006  46.214  11.043  1.00  38.44    A  C
ATOM  25152  CG1  VAL I 274    28.430  47.422  10.465  1.00  37.63    A  C
ATOM  25153  CG2  VAL I 274    28.787  45.110  10.158  1.00  35.33    A  C
ATOM  25154  C    VAL I 274    30.757  47.751  11.875  1.00  39.42    A  C
ATOM  25155  O    VAL I 274    30.976  48.691  11.182  1.00  39.39    A  O
ATOM  25156  N    HIS I 275    30.803  47.804  13.184  1.00  40.38    A  N
ATOM  25157  CA   HIS I 275    30.971  49.012  13.928  1.00  42.33    A  C
ATOM  25158  CB   HIS I 275    30.900  48.711  15.404  1.00  43.23    A  C
ATOM  25159  CG   HIS I 275    30.896  49.917  16.289  1.00  45.09    A  C
ATOM  25160  ND1  HIS I 275    31.898  50.164  17.198  1.00  47.22    A  N
ATOM  25161  CE1  HIS I 275    31.627  51.276  17.847  1.00  42.14    A  C
ATOM  25162  NE2  HIS I 275    30.485  51.746  17.412  1.00  41.29    A  N
ATOM  25163  CD2  HIS I 275    30.002  50.912  16.444  1.00  43.68    A  C
ATOM  25164  C    HIS I 275    32.276  49.667  13.585  1.00  43.79    A  C
ATOM  25165  O    HIS I 275    32.395  50.851  13.658  1.00  46.00    A  O
ATOM  25166  N    GLY I 276    33.286  48.900  13.261  1.00  43.37    A  N
ATOM  25167  CA   GLY I 276    34.508  49.482  12.793  1.00  42.62    A  C
ATOM  25168  C    GLY I 276    34.438  50.183  11.476  1.00  43.74    A  C
ATOM  25169  O    GLY I 276    35.056  51.186  11.294  1.00  44.01    A  O
ATOM  25170  N    MET I 277    33.779  49.582  10.507  1.00  44.81    A  N
ATOM  25171  CA   MET I 277    33.448  50.226   9.253  1.00  45.46    A  C
ATOM  25172  CB   MET I 277    33.030  49.166   8.259  1.00  44.73    I  C
ATOM  25173  CG   MET I 277    34.107  48.236   7.876  1.00  47.66    I  C
ATOM  25174  SD   MET I 277    33.555  46.635   7.394  1.00  49.54    I  S
ATOM  25175  CE   MET I 277    34.997  45.981   6.645  1.00  51.10    I  C
ATOM  25176  C    MET I 277    32.359  51.290   9.298  1.00  46.19    A  C
ATOM  25177  O    MET I 277    32.490  52.340   8.731  1.00  46.87    A  O
ATOM  25178  N    ASP I 278    31.242  50.959   9.918  1.00  46.31    A  N
ATOM  25179  CA   ASP I 278    30.089  51.820   9.942  1.00  45.55    A  C
```

Appendix 1

```
ATOM  25180  CB   ASP I 278    29.073  51.293   8.978  1.00 45.90    A  C
ATOM  25181  CG   ASP I 278    27.897  52.152   8.887  1.00 47.96    A  C
ATOM  25182  OD1  ASP I 278    27.693  52.928   9.785  1.00 52.84    A  O
ATOM  25183  OD2  ASP I 278    27.170  52.067   7.922  1.00 50.79    A  O-1
ATOM  25184  C    ASP I 278    29.455  51.894  11.286  1.00 45.20    A  C
ATOM  25185  O    ASP I 278    28.533  51.214  11.527  1.00 44.67    A  O
ATOM  25186  N    PRO I 279    29.927  52.756  12.151  1.00 45.60    A  N
ATOM  25187  CA   PRO I 279    29.478  52.806  13.526  1.00 46.12    A  C
ATOM  25188  CB   PRO I 279    30.269  53.957  14.083  1.00 46.30    A  C
ATOM  25189  CG   PRO I 279    31.405  54.033  13.293  1.00 46.60    A  C
ATOM  25190  CD   PRO I 279    31.030  53.623  11.952  1.00 46.23    A  C
ATOM  25191  C    PRO I 279    28.018  53.110  13.661  1.00 46.84    A  C
ATOM  25192  O    PRO I 279    27.366  52.649  14.549  1.00 46.86    A  O
ATOM  25193  N    ALA I 280    27.504  53.914  12.776  1.00 47.70    A  N
ATOM  25194  CA   ALA I 280    26.146  54.331  12.905  1.00 48.27    A  C
ATOM  25195  CB   ALA I 280    25.813  55.275  11.837  1.00 48.02    A  C
ATOM  25196  C    ALA I 280    25.254  53.135  12.828  1.00 48.20    A  C
ATOM  25197  O    ALA I 280    24.262  53.068  13.501  1.00 48.72    A  O
ATOM  25198  N    PHE I 281    25.616  52.201  11.975  1.00 47.66    A  N
ATOM  25199  CA   PHE I 281    24.808  51.043  11.680  1.00 46.73    A  C
ATOM  25200  CB   PHE I 281    25.513  50.276  10.587  1.00 46.09    A  C
ATOM  25201  CG   PHE I 281    24.881  48.988  10.220  1.00 44.74    A  C
ATOM  25202  CD1  PHE I 281    24.304  48.819   8.996  1.00 44.11    A  C
ATOM  25203  CE1  PHE I 281    23.777  47.663   8.666  1.00 42.83    A  C
ATOM  25204  CZ   PHE I 281    23.826  46.658   9.512  1.00 41.90    A  C
ATOM  25205  CE2  PHE I 281    24.400  46.792  10.695  1.00 39.12    A  C
ATOM  25206  CD2  PHE I 281    24.932  47.933  11.052  1.00 39.22    A  C
ATOM  25207  C    PHE I 281    24.589  50.137  12.848  1.00 47.56    A  C
ATOM  25208  O    PHE I 281    23.504  49.660  13.070  1.00 47.53    A  O
ATOM  25209  N    SER I 282    25.651  49.851  13.567  1.00 47.28    A  N
ATOM  25210  CA   SER I 282    25.582  49.077  14.777  1.00 47.44    A  C
ATOM  25211  CB   SER I 282    26.963  48.634  15.175  1.00 47.59    A  C
ATOM  25212  OG   SER I 282    27.496  47.861  14.150  1.00 49.81    A  O
ATOM  25213  C    SER I 282    24.875  49.737  15.928  1.00 47.37    A  C
ATOM  25214  O    SER I 282    24.165  49.103  16.660  1.00 47.41    A  O
ATOM  25215  N    GLU I 283    25.096  51.020  16.091  1.00 46.76    A  N
ATOM  25216  CA   GLU I 283    24.456  51.778  17.139  1.00 47.45    A  C
ATOM  25217  CB   GLU I 283    24.929  53.196  17.109  1.00 47.26    A  C
ATOM  25218  CG   GLU I 283    26.301  53.345  16.681  1.00 48.39    A  C
ATOM  25219  CD   GLU I 283    27.012  54.282  17.531  1.00 50.55    A  C
ATOM  25220  OE1  GLU I 283    26.843  54.187  18.734  1.00 52.13    A  O
ATOM  25221  OE2  GLU I 283    27.735  55.111  17.012  1.00 51.53    A  O-1
ATOM  25222  C    GLU I 283    22.974  51.778  16.967  1.00 47.43    A  C
ATOM  25223  O    GLU I 283    22.229  51.796  17.900  1.00 47.34    A  O
ATOM  25224  N    ARG I 284    22.564  51.795  15.730  1.00 46.95    A  N
ATOM  25225  CA   ARG I 284    21.189  51.772  15.413  1.00 47.52    A  C
ATOM  25226  CB   ARG I 284    21.042  51.851  13.912  1.00 47.67    A  C
ATOM  25227  CG   ARG I 284    19.649  51.788  13.497  1.00 49.17    A  C
ATOM  25228  CD   ARG I 284    19.471  51.905  12.043  1.00 55.45    A  C
ATOM  25229  NE   ARG I 284    18.146  51.425  11.723  1.00 58.63    A  N
ATOM  25230  CZ   ARG I 284    17.556  51.537  10.551  1.00 61.75    A  C
ATOM  25231  NH1  ARG I 284    18.167  52.127   9.556  1.00 66.56    A  N
ATOM  25232  NH2  ARG I 284    16.352  51.046  10.379  1.00 60.15    A  N
ATOM  25233  C    ARG I 284    20.533  50.509  15.897  1.00 47.32    A  C
```

Appendix 1

```
ATOM  25234  O    ARG I 284     19.415  50.529  16.340  1.00 47.90      A  O
ATOM  25235  N    TYR I 285     21.220  49.394  15.797  1.00 46.21      A  N
ATOM  25236  CA   TYR I 285     20.593  48.135  16.086  1.00 45.69      A  C
ATOM  25237  CB   TYR I 285     20.958  47.131  15.023  1.00 45.96      A  C
ATOM  25238  CG   TYR I 285     20.502  47.501  13.669  1.00 46.69      A  C
ATOM  25239  CD1  TYR I 285     19.200  47.379  13.326  1.00 48.62      A  C
ATOM  25240  CE1  TYR I 285     18.768  47.709  12.121  1.00 51.49      A  C
ATOM  25241  CZ   TYR I 285     19.628  48.174  11.211  1.00 54.38      A  C
ATOM  25242  OH   TYR I 285     19.149  48.504   9.977  1.00 54.67      A  O
ATOM  25243  CE2  TYR I 285     20.946  48.304  11.518  1.00 52.16      A  C
ATOM  25244  CD2  TYR I 285     21.373  47.967  12.736  1.00 49.33      A  C
ATOM  25245  C    TYR I 285     20.931  47.570  17.422  1.00 45.43      A  C
ATOM  25246  O    TYR I 285     20.305  46.678  17.864  1.00 44.91      A  O
ATOM  25247  N    TYR I 286     21.938  48.095  18.065  1.00 45.99      A  N
ATOM  25248  CA   TYR I 286     22.426  47.522  19.286  1.00 46.49      A  C
ATOM  25249  CB   TYR I 286     23.666  48.270  19.704  1.00 46.22      A  C
ATOM  25250  CG   TYR I 286     24.311  47.760  20.934  1.00 46.00      A  C
ATOM  25251  CD1  TYR I 286     24.659  46.459  21.063  1.00 42.85      A  C
ATOM  25252  CE1  TYR I 286     25.222  46.015  22.175  1.00 42.65      A  C
ATOM  25253  CZ   TYR I 286     25.448  46.863  23.173  1.00 45.79      A  C
ATOM  25254  OH   TYR I 286     26.018  46.460  24.312  1.00 49.91      A  O
ATOM  25255  CE2  TYR I 286     25.102  48.139  23.072  1.00 47.97      A  C
ATOM  25256  CD2  TYR I 286     24.550  48.584  21.965  1.00 46.36      A  C
ATOM  25257  C    TYR I 286     21.398  47.513  20.398  1.00 47.61      A  C
ATOM  25258  O    TYR I 286     21.270  46.568  21.122  1.00 48.47      A  O
ATOM  25259  N    PRO I 287     20.661  48.577  20.558  1.00 48.17      A  N
ATOM  25260  CA   PRO I 287     19.646  48.585  21.574  1.00 47.28      A  C
ATOM  25261  CB   PRO I 287     19.103  49.974  21.449  1.00 47.56      A  C
ATOM  25262  CG   PRO I 287     20.217  50.725  21.050  1.00 48.47      A  C
ATOM  25263  CD   PRO I 287     20.887  49.923  20.054  1.00 48.79      A  C
ATOM  25264  C    PRO I 287     18.585  47.576  21.280  1.00 46.58      A  C
ATOM  25265  O    PRO I 287     18.109  46.939  22.176  1.00 45.87      A  O
ATOM  25266  N    ARG I 288     18.188  47.452  20.034  1.00 46.52      A  N
ATOM  25267  CA   ARG I 288     17.153  46.494  19.659  1.00 46.84      A  C
ATOM  25268  CB   ARG I 288     16.732  46.711  18.227  1.00 47.41      A  C
ATOM  25269  CG   ARG I 288     15.880  47.927  18.022  1.00 52.10      A  C
ATOM  25270  CD   ARG I 288     15.989  48.510  16.641  1.00 56.71      A  C
ATOM  25271  NE   ARG I 288     15.906  49.956  16.715  1.00 63.68      A  N
ATOM  25272  CZ   ARG I 288     15.757  50.765  15.675  1.00 65.16      A  C
ATOM  25273  NH1  ARG I 288     15.676  50.277  14.458  1.00 63.56      A  N
ATOM  25274  NH2  ARG I 288     15.706  52.064  15.862  1.00 63.69      A  N
ATOM  25275  C    ARG I 288     17.544  45.049  19.880  1.00 45.94      A  C
ATOM  25276  O    ARG I 288     16.774  44.253  20.366  1.00 44.68      A  O
ATOM  25277  N    PHE I 289     18.772  44.744  19.524  1.00 45.53      A  N
ATOM  25278  CA   PHE I 289     19.375  43.455  19.723  1.00 44.96      A  C
ATOM  25279  CB   PHE I 289     20.774  43.522  19.139  1.00 44.27      A  C
ATOM  25280  CG   PHE I 289     21.654  42.438  19.564  1.00 42.74      A  C
ATOM  25281  CD1  PHE I 289     21.657  41.241  18.919  1.00 42.67      A  C
ATOM  25282  CE1  PHE I 289     22.468  40.253  19.290  1.00 41.47      A  C
ATOM  25283  CZ   PHE I 289     23.271  40.417  20.304  1.00 42.33      A  C
ATOM  25284  CE2  PHE I 289     23.292  41.589  20.967  1.00 46.66      A  C
ATOM  25285  CD2  PHE I 289     22.493  42.603  20.595  1.00 44.80      A  C
ATOM  25286  C    PHE I 289     19.445  43.109  21.187  1.00 45.00      A  C
ATOM  25287  O    PHE I 289     19.154  42.003  21.580  1.00 44.87      A  O
```

Appendix 1

```
ATOM  25288  N    LYS I 290      19.803  44.071  22.007  1.00  44.54      A    N
ATOM  25289  CA   LYS I 290      19.836  43.855  23.423  1.00  45.24      A    C
ATOM  25290  CB   LYS I 290      20.353  45.107  24.096  1.00  45.18      A    C
ATOM  25291  CG   LYS I 290      21.730  45.022  24.599  1.00  43.39      A    C
ATOM  25292  CD   LYS I 290      22.430  46.289  24.336  1.00  48.12      A    C
ATOM  25293  CE   LYS I 290      22.240  47.275  25.424  1.00  47.10      A    C
ATOM  25294  NZ   LYS I 290      22.850  46.859  26.663  1.00  45.57      A    N
ATOM  25295  C    LYS I 290      18.479  43.515  24.007  1.00  45.73      A    C
ATOM  25296  O    LYS I 290      18.381  42.664  24.861  1.00  46.41      A    O
ATOM  25297  N    GLN I 291      17.435  44.207  23.589  1.00  45.66      A    N
ATOM  25298  CA   GLN I 291      16.118  43.858  24.075  1.00  46.44      A    C
ATOM  25299  CB   GLN I 291      15.055  44.938  23.801  1.00  46.45      A    C
ATOM  25300  CG   GLN I 291      13.629  44.430  23.740  1.00  50.92      A    C
ATOM  25301  CD   GLN I 291      12.675  45.015  24.786  1.00  55.41      A    C
ATOM  25302  OE1  GLN I 291      12.397  46.197  24.796  1.00  56.97      A    O
ATOM  25303  NE2  GLN I 291      12.143  44.163  25.635  1.00  51.26      A    N
ATOM  25304  C    GLN I 291      15.715  42.491  23.588  1.00  45.06      A    C
ATOM  25305  O    GLN I 291      15.209  41.726  24.339  1.00  45.74      A    O
ATOM  25306  N    THR I 292      15.982  42.181  22.340  1.00  43.49      A    N
ATOM  25307  CA   THR I 292      15.579  40.906  21.778  1.00  42.30      A    C
ATOM  25308  CB   THR I 292      15.958  40.828  20.298  1.00  42.65      A    C
ATOM  25309  OG1  THR I 292      15.375  41.909  19.577  1.00  43.80      A    O
ATOM  25310  CG2  THR I 292      15.494  39.568  19.717  1.00  41.30      A    C
ATOM  25311  C    THR I 292      16.205  39.694  22.407  1.00  40.85      A    C
ATOM  25312  O    THR I 292      15.558  38.709  22.602  1.00  41.32      A    O
ATOM  25313  N    PHE I 293      17.495  39.754  22.645  1.00  38.73      A    N
ATOM  25314  CA   PHE I 293      18.254  38.580  23.002  1.00  37.30      A    C
ATOM  25315  CB   PHE I 293      19.437  38.478  22.043  1.00  36.29      A    C
ATOM  25316  CG   PHE I 293      19.095  37.946  20.715  1.00  31.25      A    C
ATOM  25317  CD1  PHE I 293      18.526  36.735  20.588  1.00  27.99      A    C
ATOM  25318  CE1  PHE I 293      18.235  36.260  19.387  1.00  29.25      A    C
ATOM  25319  CZ   PHE I 293      18.497  36.975  18.294  1.00  28.94      A    C
ATOM  25320  CE2  PHE I 293      19.050  38.172  18.398  1.00  26.92      A    C
ATOM  25321  CD2  PHE I 293      19.360  38.655  19.593  1.00  27.18      A    C
ATOM  25322  C    PHE I 293      18.773  38.491  24.427  1.00  37.46      A    C
ATOM  25323  O    PHE I 293      18.853  37.457  24.982  1.00  37.71      A    O
ATOM  25324  N    VAL I 294      19.185  39.592  24.990  1.00  38.19      A    N
ATOM  25325  CA   VAL I 294      19.922  39.589  26.222  1.00  38.75      A    C
ATOM  25326  CB   VAL I 294      20.659  40.902  26.341  1.00  37.98      A    C
ATOM  25327  CG1  VAL I 294      21.309  41.009  27.640  1.00  35.54      A    C
ATOM  25328  CG2  VAL I 294      21.620  41.078  25.242  1.00  32.92      A    C
ATOM  25329  C    VAL I 294      19.063  39.450  27.464  1.00  41.06      A    C
ATOM  25330  O    VAL I 294      18.145  40.191  27.641  1.00  41.34      A    O
ATOM  25331  N    GLU I 295      19.368  38.520  28.348  1.00  42.57      A    N
ATOM  25332  CA   GLU I 295      18.602  38.446  29.571  1.00  44.09      A    C
ATOM  25333  CB   GLU I 295      18.027  37.054  29.780  1.00  43.85      A    C
ATOM  25334  CG   GLU I 295      17.449  36.829  31.147  1.00  42.57      A    C
ATOM  25335  CD   GLU I 295      17.199  35.398  31.441  1.00  48.48      A    C
ATOM  25336  OE1  GLU I 295      17.120  34.598  30.516  1.00  54.31      A    O
ATOM  25337  OE2  GLU I 295      17.064  35.047  32.598  1.00  47.64      A    O-1
ATOM  25338  C    GLU I 295      19.385  38.858  30.794  1.00  45.64      A    C
ATOM  25339  O    GLU I 295      20.343  38.257  31.143  1.00  45.67      A    O
ATOM  25340  N    VAL I 296      18.938  39.890  31.475  1.00  48.33      A    N
ATOM  25341  CA   VAL I 296      19.552  40.281  32.721  1.00  50.01      A    C
```

Appendix 1

```
ATOM  25342  CB   VAL I 296      19.416  41.759  32.945  1.00 50.14      A    C
ATOM  25343  CG1  VAL I 296      19.933  42.123  34.275  1.00 49.41      A    C
ATOM  25344  CG2  VAL I 296      20.152  42.509  31.890  1.00 47.90      A    C
ATOM  25345  C    VAL I 296      18.937  39.512  33.879  1.00 52.39      A    C
ATOM  25346  O    VAL I 296      17.747  39.466  34.030  1.00 53.18      A    O
ATOM  25347  N    TYR I 297      19.758  38.818  34.640  1.00 54.58      A    N
ATOM  25348  CA   TYR I 297      19.222  37.912  35.601  1.00 55.97      A    C
ATOM  25349  CB   TYR I 297      19.331  36.490  35.124  1.00 55.35      A    C
ATOM  25350  CG   TYR I 297      20.669  35.848  35.226  1.00 56.52      A    C
ATOM  25351  CD1  TYR I 297      20.936  34.958  36.218  1.00 56.17      A    C
ATOM  25352  CE1  TYR I 297      22.103  34.346  36.296  1.00 56.80      A    C
ATOM  25353  CZ   TYR I 297      23.046  34.598  35.374  1.00 57.20      A    C
ATOM  25354  OH   TYR I 297      24.245  33.972  35.448  1.00 58.43      A    O
ATOM  25355  CE2  TYR I 297      22.813  35.464  34.383  1.00 56.09      A    C
ATOM  25356  CD2  TYR I 297      21.629  36.077  34.302  1.00 54.11      A    C
ATOM  25357  C    TYR I 297      19.669  37.993  37.017  1.00 58.41      A    C
ATOM  25358  O    TYR I 297      19.337  37.131  37.801  1.00 59.68      A    O
ATOM  25359  N    ASP I 298      20.404  38.986  37.426  1.00 60.00      A    N
ATOM  25360  CA   ASP I 298      20.633  38.913  38.841  1.00 61.78      A    C
ATOM  25361  CB   ASP I 298      22.000  38.358  39.120  1.00 62.11      A    C
ATOM  25362  CG   ASP I 298      22.100  37.852  40.460  1.00 63.99      A    C
ATOM  25363  OD1  ASP I 298      22.704  36.801  40.705  1.00 64.14      A    O
ATOM  25364  OD2  ASP I 298      21.506  38.526  41.278  1.00 69.47      A    O
ATOM  25365  C    ASP I 298      20.427  40.195  39.565  1.00 62.39      A    C
ATOM  25366  O    ASP I 298      21.307  40.728  40.163  1.00 62.46      A    O
ATOM  25367  N    GLU I 299      19.242  40.731  39.507  1.00 63.47      A    N
ATOM  25368  CA   GLU I 299      19.082  41.942  40.225  1.00 64.39      A    C
ATOM  25369  CB   GLU I 299      19.500  41.680  41.644  1.00 64.90      A    C
ATOM  25370  CG   GLU I 299      18.530  42.086  42.701  1.00 69.09      A    C
ATOM  25371  CD   GLU I 299      19.248  42.418  43.983  1.00 74.24      A    C
ATOM  25372  OE1  GLU I 299      19.324  43.600  44.355  1.00 74.38      A    O
ATOM  25373  OE2  GLU I 299      19.772  41.487  44.602  1.00 76.69      A    O
ATOM  25374  C    GLU I 299      20.100  42.826  39.577  1.00 63.15      A    C
ATOM  25375  O    GLU I 299      20.637  43.703  40.202  1.00 63.68      A    O
ATOM  25376  N    GLY I 300      20.375  42.574  38.313  1.00 61.63      A    N
ATOM  25377  CA   GLY I 300      21.285  43.376  37.525  1.00 60.26      A    C
ATOM  25378  C    GLY I 300      22.756  43.031  37.586  1.00 59.52      A    C
ATOM  25379  O    GLY I 300      23.552  43.675  36.953  1.00 59.05      A    O
ATOM  25380  N    ARG I 301      23.120  42.030  38.365  1.00 58.62      A    N
ATOM  25381  CA   ARG I 301      24.485  41.524  38.416  1.00 57.92      A    C
ATOM  25382  CB   ARG I 301      24.619  40.574  39.581  1.00 58.90      A    C
ATOM  25383  CG   ARG I 301      24.698  41.252  40.899  1.00 62.78      A    C
ATOM  25384  CD   ARG I 301      24.811  40.234  41.943  1.00 68.33      A    C
ATOM  25385  NE   ARG I 301      23.628  40.202  42.765  1.00 72.34      A    N
ATOM  25386  CZ   ARG I 301      23.221  41.219  43.494  1.00 74.05      A    C
ATOM  25387  NH1  ARG I 301      23.909  42.336  43.478  1.00 74.80      A    N
ATOM  25388  NH2  ARG I 301      22.134  41.116  44.230  1.00 73.85      A    N
ATOM  25389  C    ARG I 301      25.026  40.828  37.178  1.00 55.95      A    C
ATOM  25390  O    ARG I 301      26.159  41.016  36.788  1.00 55.20      A    O
ATOM  25391  N    LYS I 302      24.201  39.983  36.600  1.00 53.04      A    N
ATOM  25392  CA   LYS I 302      24.618  39.098  35.562  1.00 50.51      A    C
ATOM  25393  CB   LYS I 302      24.634  37.709  36.108  1.00 50.57      A    C
ATOM  25394  CG   LYS I 302      25.568  37.596  37.216  1.00 50.17      A    C
ATOM  25395  CD   LYS I 302      25.361  36.327  37.943  1.00 49.78      A    C
```

Appendix 1

```
ATOM  25396  CE   LYS I 302     26.470  36.135  38.886  1.00  53.15      A  C
ATOM  25397  NZ   LYS I 302     26.607  34.754  39.349  1.00  54.27      A  N
ATOM  25398  C    LYS I 302     23.731  39.166  34.368  1.00  49.01      A  C
ATOM  25399  O    LYS I 302     22.651  39.630  34.453  1.00  48.92      A  O
ATOM  25400  N    ALA I 303     24.231  38.715  33.244  1.00  47.11      A  N
ATOM  25401  CA   ALA I 303     23.474  38.676  32.018  1.00  45.27      A  C
ATOM  25402  CB   ALA I 303     23.754  39.848  31.246  1.00  45.23      A  C
ATOM  25403  C    ALA I 303     23.816  37.459  31.213  1.00  44.20      A  C
ATOM  25404  O    ALA I 303     24.913  36.990  31.252  1.00  44.76      A  O
ATOM  25405  N    ARG I 304     22.857  36.962  30.463  1.00  42.78      A  N
ATOM  25406  CA   ARG I 304     23.056  35.846  29.558  1.00  41.81      A  C
ATOM  25407  CB   ARG I 304     22.656  34.550  30.251  1.00  42.25      A  C
ATOM  25408  CG   ARG I 304     21.289  34.572  30.819  1.00  44.49      A  C
ATOM  25409  CD   ARG I 304     20.740  33.227  31.003  1.00  48.80      A  C
ATOM  25410  NE   ARG I 304     20.945  32.766  32.348  1.00  58.21      A  N
ATOM  25411  CZ   ARG I 304     19.975  32.432  33.171  1.00  58.60      A  C
ATOM  25412  NH1  ARG I 304     18.742  32.508  32.762  1.00  58.96      A  N
ATOM  25413  NH2  ARG I 304     20.245  32.017  34.388  1.00  57.26      A  N
ATOM  25414  C    ARG I 304     22.302  36.055  28.233  1.00  40.15      A  C
ATOM  25415  O    ARG I 304     21.390  36.821  28.171  1.00  40.04      A  O
ATOM  25416  N    VAL I 305     22.696  35.386  27.168  1.00  38.17      A  N
ATOM  25417  CA   VAL I 305     22.108  35.641  25.863  1.00  35.80      A  C
ATOM  25418  CB   VAL I 305     23.146  36.263  24.941  1.00  34.30      A  C
ATOM  25419  CG1  VAL I 305     22.575  36.645  23.700  1.00  34.67      A  C
ATOM  25420  CG2  VAL I 305     23.686  37.441  25.523  1.00  32.77      A  C
ATOM  25421  C    VAL I 305     21.461  34.430  25.185  1.00  36.36      A  C
ATOM  25422  O    VAL I 305     22.078  33.418  24.990  1.00  35.31      A  O
ATOM  25423  N    ARG I 306     20.195  34.561  24.840  1.00  36.46      A  N
ATOM  25424  CA   ARG I 306     19.477  33.581  24.060  1.00  36.95      A  C
ATOM  25425  CB   ARG I 306     18.000  33.913  24.065  1.00  36.79      A  C
ATOM  25426  CG   ARG I 306     17.332  33.653  25.343  1.00  37.17      A  C
ATOM  25427  CD   ARG I 306     15.954  34.233  25.382  1.00  37.16      A  C
ATOM  25428  NE   ARG I 306     15.947  35.646  25.097  1.00  39.49      A  N
ATOM  25429  CZ   ARG I 306     15.670  36.551  26.002  1.00  38.16      A  C
ATOM  25430  NH1  ARG I 306     15.392  36.148  27.203  1.00  34.92      A  N
ATOM  25431  NH2  ARG I 306     15.681  37.825  25.716  1.00  33.64      A  N
ATOM  25432  C    ARG I 306     19.957  33.607  22.649  1.00  37.01      A  C
ATOM  25433  O    ARG I 306     20.169  34.645  22.107  1.00  37.01      A  O
ATOM  25434  N    GLU I 307     20.177  32.449  22.071  1.00  36.48      A  N
ATOM  25435  CA   GLU I 307     20.565  32.346  20.689  1.00  37.44      A  C
ATOM  25436  CB   GLU I 307     21.065  30.953  20.389  1.00  36.54      A  C
ATOM  25437  CG   GLU I 307     21.347  30.651  18.953  1.00  36.84      A  C
ATOM  25438  CD   GLU I 307     22.387  31.521  18.294  1.00  35.47      A  C
ATOM  25439  OE1  GLU I 307     22.989  32.363  18.887  1.00  33.63      A  O
ATOM  25440  OE2  GLU I 307     22.576  31.360  17.103  1.00  37.79      A  O
ATOM  25441  C    GLU I 307     19.490  32.769  19.713  1.00  39.12      A  C
ATOM  25442  O    GLU I 307     19.739  33.423  18.744  1.00  39.89      A  O
ATOM  25443  N    THR I 308     18.278  32.385  19.980  1.00  40.40      A  N
ATOM  25444  CA   THR I 308     17.260  32.617  19.021  1.00  43.12      A  C
ATOM  25445  CB   THR I 308     17.167  31.463  18.061  1.00  42.87      A  C
ATOM  25446  OG1  THR I 308     16.693  31.930  16.804  1.00  45.61      A  O
ATOM  25447  CG2  THR I 308     16.302  30.406  18.561  1.00  43.72      A  C
ATOM  25448  C    THR I 308     15.962  33.108  19.618  1.00  44.82      A  C
ATOM  25449  O    THR I 308     15.876  33.303  20.801  1.00  45.80      A  O
```

Appendix 1

```
ATOM  25450  N    ALA I 309      15.008  33.419  18.771  1.00 46.91      A    N
ATOM  25451  CA   ALA I 309      13.765  34.092  19.145  1.00 48.56      A    C
ATOM  25452  CB   ALA I 309      13.129  34.607  17.983  1.00 48.54      A    C
ATOM  25453  C    ALA I 309      12.715  33.449  19.997  1.00 49.72      A    C
ATOM  25454  O    ALA I 309      12.059  34.109  20.770  1.00 52.37      A    O
ATOM  25455  N    GLY I 310      12.430  32.179  19.834  1.00 49.52      A    N
ATOM  25456  CA   GLY I 310      11.284  31.620  20.409  1.00 49.91      A    C
ATOM  25457  C    GLY I 310      11.441  30.866  21.697  1.00 50.02      A    C
ATOM  25458  O    GLY I 310      10.663  30.008  21.997  1.00 50.45      A    O
ATOM  25459  N    THR I 311      12.479  31.154  22.439  1.00 48.93      A    N
ATOM  25460  CA   THR I 311      12.876  30.272  23.484  1.00 48.28      A    C
ATOM  25461  CB   THR I 311      13.983  29.376  22.996  1.00 48.46      A    C
ATOM  25462  OG1  THR I 311      14.391  28.513  24.044  1.00 49.75      A    O
ATOM  25463  CG2  THR I 311      15.142  30.196  22.548  1.00 47.91      A    C
ATOM  25464  C    THR I 311      13.346  31.079  24.632  1.00 47.95      A    C
ATOM  25465  O    THR I 311      13.647  32.220  24.479  1.00 46.92      A    O
ATOM  25466  N    ASP I 312      13.388  30.470  25.792  1.00 48.28      A    N
ATOM  25467  CA   ASP I 312      13.869  31.129  26.969  1.00 49.19      A    C
ATOM  25468  CB   ASP I 312      12.989  30.751  28.149  1.00 50.50      A    C
ATOM  25469  CG   ASP I 312      11.723  31.540  28.210  1.00 52.68      A    C
ATOM  25470  OD1  ASP I 312      11.721  32.704  27.851  1.00 53.03      A    O
ATOM  25471  OD2  ASP I 312      10.719  30.997  28.646  1.00 56.97      A    O-1
ATOM  25472  C    ASP I 312      15.301  30.791  27.292  1.00 48.36      A    C
ATOM  25473  O    ASP I 312      15.929  31.467  28.062  1.00 47.19      A    O
ATOM  25474  N    ASP I 313      15.805  29.728  26.688  1.00 48.82      A    N
ATOM  25475  CA   ASP I 313      17.131  29.179  26.975  1.00 48.93      A    C
ATOM  25476  CB   ASP I 313      17.248  27.812  26.346  1.00 48.63      A    C
ATOM  25477  CG   ASP I 313      16.028  27.001  26.527  1.00 51.45      A    C
ATOM  25478  OD1  ASP I 313      15.885  26.367  27.567  1.00 53.87      A    O
ATOM  25479  OD2  ASP I 313      15.198  26.984  25.630  1.00 54.37      A    O-1
ATOM  25480  C    ASP I 313      18.297  30.027  26.534  1.00 47.94      A    C
ATOM  25481  O    ASP I 313      18.278  30.546  25.459  1.00 47.09      A    O
ATOM  25482  N    ALA I 314      19.306  30.167  27.388  1.00 47.80      A    N
ATOM  25483  CA   ALA I 314      20.395  31.119  27.149  1.00 48.24      A    C
ATOM  25484  CB   ALA I 314      21.114  31.350  28.395  1.00 47.62      A    C
ATOM  25485  C    ALA I 314      21.424  30.974  26.027  1.00 48.78      A    C
ATOM  25486  O    ALA I 314      21.657  31.921  25.268  1.00 48.97      A    O
ATOM  25487  N    ASP I 315      22.086  29.840  25.939  1.00 48.14      A    N
ATOM  25488  CA   ASP I 315      23.132  29.749  24.954  1.00 47.75      A    C
ATOM  25489  CB   ASP I 315      24.508  29.757  25.615  1.00 47.66      A    C
ATOM  25490  CG   ASP I 315      25.028  31.143  25.879  1.00 48.75      A    C
ATOM  25491  OD1  ASP I 315      25.342  31.847  24.936  1.00 46.30      A    O
ATOM  25492  OD2  ASP I 315      25.146  31.535  27.033  1.00 47.38      A    O
ATOM  25493  C    ASP I 315      22.964  28.524  24.124  1.00 46.58      A    C
ATOM  25494  O    ASP I 315      23.741  27.624  24.165  1.00 46.92      A    O
ATOM  25495  N    GLY I 316      21.933  28.536  23.312  1.00 45.10      A    N
ATOM  25496  CA   GLY I 316      21.639  27.452  22.427  1.00 43.35      A    C
ATOM  25497  C    GLY I 316      22.441  27.549  21.169  1.00 43.35      A    C
ATOM  25498  O    GLY I 316      23.249  28.424  21.018  1.00 43.53      A    O
ATOM  25499  N    GLY I 317      22.186  26.664  20.234  1.00 42.47      A    N
ATOM  25500  CA   GLY I 317      22.912  26.664  18.995  1.00 42.03      A    C
ATOM  25501  C    GLY I 317      24.354  26.300  19.137  1.00 41.48      A    C
ATOM  25502  O    GLY I 317      24.674  25.241  19.595  1.00 41.07      A    O
ATOM  25503  N    VAL I 318      25.237  27.171  18.712  1.00 40.64      A    N
```

Appendix 1

```
ATOM  25504  CA   VAL I 318    26.635  26.859  18.812  1.00 39.76    A    C
ATOM  25505  CB   VAL I 318    27.471  27.507  17.769  1.00 38.69    A    C
ATOM  25506  CG1  VAL I 318    27.315  26.813  16.508  1.00 36.52    A    C
ATOM  25507  CG2  VAL I 318    27.168  28.919  17.652  1.00 38.99    A    C
ATOM  25508  C    VAL I 318    27.126  27.255  20.148  1.00 40.10    A    C
ATOM  25509  O    VAL I 318    28.269  27.112  20.423  1.00 42.23    A    O
ATOM  25510  N    GLY I 319    26.234  27.761  20.972  1.00 40.30    A    N
ATOM  25511  CA   GLY I 319    26.511  28.049  22.356  1.00 38.05    A    C
ATOM  25512  C    GLY I 319    27.382  29.232  22.590  1.00 37.35    A    C
ATOM  25513  O    GLY I 319    27.965  29.359  23.617  1.00 38.11    A    O
ATOM  25514  N    LEU I 320    27.475  30.088  21.608  1.00 35.87    A    N
ATOM  25515  CA   LEU I 320    28.419  31.156  21.619  1.00 33.83    A    C
ATOM  25516  CB   LEU I 320    29.190  31.095  20.326  1.00 33.18    A    C
ATOM  25517  CG   LEU I 320    30.160  29.954  20.254  1.00 32.16    A    C
ATOM  25518  CD1  LEU I 320    30.838  29.964  18.994  1.00 36.21    A    C
ATOM  25519  CD2  LEU I 320    31.128  30.113  21.282  1.00 33.32    A    C
ATOM  25520  C    LEU I 320    27.834  32.527  21.804  1.00 32.81    A    C
ATOM  25521  O    LEU I 320    28.516  33.482  21.681  1.00 33.18    A    O
ATOM  25522  N    ALA I 321    26.558  32.620  22.087  1.00 32.27    A    N
ATOM  25523  CA   ALA I 321    25.904  33.910  22.147  1.00 31.89    A    C
ATOM  25524  CB   ALA I 321    24.430  33.714  22.204  1.00 32.15    A    C
ATOM  25525  C    ALA I 321    26.332  34.913  23.197  1.00 31.37    A    C
ATOM  25526  O    ALA I 321    26.488  36.061  22.890  1.00 30.88    A    O
ATOM  25527  N    SER I 322    26.488  34.498  24.435  1.00 31.06    A    N
ATOM  25528  CA   SER I 322    26.945  35.424  25.448  1.00 30.09    A    C
ATOM  25529  CB   SER I 322    26.894  34.823  26.850  1.00 29.80    A    C
ATOM  25530  OG   SER I 322    25.701  34.165  27.130  1.00 26.13    A    O
ATOM  25531  C    SER I 322    28.338  35.911  25.168  1.00 30.15    A    C
ATOM  25532  O    SER I 322    28.627  37.060  25.267  1.00 29.54    A    O
ATOM  25533  N    ALA I 323    29.199  34.997  24.808  1.00 31.07    A    N
ATOM  25534  CA   ALA I 323    30.580  35.292  24.536  1.00 31.42    A    C
ATOM  25535  CB   ALA I 323    31.275  34.055  24.270  1.00 32.13    A    C
ATOM  25536  C    ALA I 323    30.786  36.238  23.381  1.00 31.79    A    C
ATOM  25537  O    ALA I 323    31.644  37.058  23.389  1.00 31.14    A    O
ATOM  25538  N    PHE I 324    30.028  36.091  22.338  1.00 31.62    A    N
ATOM  25539  CA   PHE I 324    30.063  37.082  21.306  1.00 33.23    A    C
ATOM  25540  CB   PHE I 324    29.447  36.569  20.038  1.00 34.14    A    C
ATOM  25541  CG   PHE I 324    30.411  35.926  19.177  1.00 34.23    A    C
ATOM  25542  CD1  PHE I 324    31.475  36.602  18.739  1.00 36.18    A    C
ATOM  25543  CE1  PHE I 324    32.367  36.021  17.976  1.00 38.73    A    C
ATOM  25544  CZ   PHE I 324    32.233  34.764  17.667  1.00 37.26    A    C
ATOM  25545  CE2  PHE I 324    31.196  34.080  18.109  1.00 38.42    A    C
ATOM  25546  CD2  PHE I 324    30.294  34.645  18.857  1.00 33.90    A    C
ATOM  25547  C    PHE I 324    29.505  38.413  21.669  1.00 33.21    A    C
ATOM  25548  O    PHE I 324    29.929  39.410  21.200  1.00 34.10    A    O
ATOM  25549  N    THR I 325    28.484  38.392  22.468  1.00 34.40    A    N
ATOM  25550  CA   THR I 325    27.857  39.585  22.915  1.00 35.69    A    C
ATOM  25551  CB   THR I 325    26.547  39.270  23.515  1.00 36.87    A    C
ATOM  25552  OG1  THR I 325    26.037  38.153  22.811  1.00 40.89    A    O
ATOM  25553  CG2  THR I 325    25.632  40.382  23.345  1.00 34.16    A    C
ATOM  25554  C    THR I 325    28.771  40.300  23.824  1.00 35.30    A    C
ATOM  25555  O    THR I 325    28.713  41.476  23.945  1.00 36.53    A    O
ATOM  25556  N    LEU I 326    29.624  39.560  24.482  1.00 35.54    A    N
ATOM  25557  CA   LEU I 326    30.643  40.157  25.295  1.00 35.69    A    C
```

Appendix 1

```
ATOM  25558  CB   LEU I 326    31.357  39.093  26.073  1.00  36.19      A  C
ATOM  25559  CG   LEU I 326    32.411  39.520  27.056  1.00  38.94      A  C
ATOM  25560  CD1  LEU I 326    31.807  40.164  28.188  1.00  41.82      A  C
ATOM  25561  CD2  LEU I 326    33.108  38.330  27.490  1.00  39.84      A  C
ATOM  25562  C    LEU I 326    31.633  40.977  24.537  1.00  34.91      A  C
ATOM  25563  O    LEU I 326    31.972  42.020  24.954  1.00  36.48      A  O
ATOM  25564  N    LEU I 327    32.100  40.500  23.412  1.00  35.82      A  N
ATOM  25565  CA   LEU I 327    32.922  41.290  22.521  1.00  35.12      A  C
ATOM  25566  CB   LEU I 327    33.473  40.417  21.418  1.00  35.36      A  C
ATOM  25567  CG   LEU I 327    34.118  41.061  20.207  1.00  33.77      A  C
ATOM  25568  CD1  LEU I 327    35.481  41.478  20.474  1.00  31.85      A  C
ATOM  25569  CD2  LEU I 327    34.141  40.085  19.170  1.00  36.25      A  C
ATOM  25570  C    LEU I 327    32.165  42.481  21.942  1.00  36.35      A  C
ATOM  25571  O    LEU I 327    32.696  43.530  21.743  1.00  36.12      A  O
ATOM  25572  N    LEU I 328    30.903  42.294  21.667  1.00  35.89      A  N
ATOM  25573  CA   LEU I 328    30.090  43.359  21.204  1.00  36.96      A  C
ATOM  25574  CB   LEU I 328    28.718  42.843  20.864  1.00  37.52      A  C
ATOM  25575  CG   LEU I 328    27.892  43.940  20.241  1.00  39.01      A  C
ATOM  25576  CD1  LEU I 328    28.644  44.662  19.208  1.00  36.51      A  C
ATOM  25577  CD2  LEU I 328    26.589  43.479  19.736  1.00  37.26      A  C
ATOM  25578  C    LEU I 328    29.966  44.431  22.241  1.00  37.40      A  C
ATOM  25579  O    LEU I 328    30.065  45.550  21.934  1.00  37.25      A  O
ATOM  25580  N    ALA I 329    29.762  44.081  23.487  1.00  38.21      A  N
ATOM  25581  CA   ALA I 329    29.640  45.071  24.524  1.00  37.92      A  C
ATOM  25582  CB   ALA I 329    29.310  44.441  25.813  1.00  36.75      A  C
ATOM  25583  C    ALA I 329    30.906  45.853  24.615  1.00  38.70      A  C
ATOM  25584  O    ALA I 329    30.875  47.015  24.875  1.00  40.22      A  O
ATOM  25585  N    ARG I 330    32.033  45.209  24.413  1.00  38.54      A  N
ATOM  25586  CA   ARG I 330    33.281  45.922  24.380  1.00  37.42      A  C
ATOM  25587  CB   ARG I 330    34.431  44.938  24.424  1.00  37.41      A  C
ATOM  25588  CG   ARG I 330    35.749  45.542  24.624  1.00  35.72      A  C
ATOM  25589  CD   ARG I 330    35.987  45.905  26.029  1.00  38.95      A  C
ATOM  25590  NE   ARG I 330    37.401  45.852  26.313  1.00  40.93      A  N
ATOM  25591  CZ   ARG I 330    38.164  46.909  26.397  1.00  37.69      A  C
ATOM  25592  NH1  ARG I 330    37.646  48.083  26.256  1.00  37.35      A  N
ATOM  25593  NH2  ARG I 330    39.429  46.785  26.604  1.00  32.59      A  N
ATOM  25594  C    ARG I 330    33.403  46.869  23.211  1.00  37.24      A  C
ATOM  25595  O    ARG I 330    33.816  47.973  23.360  1.00  36.38      A  O
ATOM  25596  N    GLU I 331    33.008  46.428  22.042  1.00  37.20      A  N
ATOM  25597  CA   GLU I 331    33.105  47.226  20.851  1.00  38.79      A  C
ATOM  25598  CB   GLU I 331    32.594  46.405  19.675  1.00  38.32      A  C
ATOM  25599  CG   GLU I 331    32.768  46.988  18.322  1.00  39.84      A  C
ATOM  25600  CD   GLU I 331    34.130  47.540  18.060  1.00  44.65      A  C
ATOM  25601  OE1  GLU I 331    35.103  46.903  18.419  1.00  43.63      A  O
ATOM  25602  OE2  GLU I 331    34.229  48.615  17.486  1.00  46.52      A  O-1
ATOM  25603  C    GLU I 331    32.275  48.480  20.999  1.00  39.86      A  C
ATOM  25604  O    GLU I 331    32.729  49.553  20.727  1.00  39.53      A  O
ATOM  25605  N    MET I 332    31.062  48.314  21.479  1.00  40.60      A  N
ATOM  25606  CA   MET I 332    30.122  49.375  21.760  1.00  41.69      A  C
ATOM  25607  CB   MET I 332    28.754  48.797  21.985  1.00  40.63      I  C
ATOM  25608  CG   MET I 332    28.072  48.349  20.746  1.00  41.61      I  C
ATOM  25609  SD   MET I 332    28.709  49.032  19.289  1.00  44.99      I  S
ATOM  25610  CE   MET I 332    27.268  49.392  18.426  1.00  42.98      I  C
ATOM  25611  C    MET I 332    30.465  50.280  22.915  1.00  42.86      A  C
```

Appendix 1

```
ATOM  25612  O    MET I 332      29.988  51.365  22.979  1.00 43.59      A    O
ATOM  25613  N    GLY I 333      31.280  49.826  23.833  1.00 42.85      A    N
ATOM  25614  CA   GLY I 333      31.556  50.561  25.031  1.00 42.00      A    C
ATOM  25615  C    GLY I 333      30.579  50.364  26.138  1.00 41.78      A    C
ATOM  25616  O    GLY I 333      30.608  51.090  27.069  1.00 42.31      A    O
ATOM  25617  N    ASP I 334      29.735  49.364  26.039  1.00 41.44      A    N
ATOM  25618  CA   ASP I 334      28.657  49.162  26.976  1.00 41.06      A    C
ATOM  25619  CB   ASP I 334      27.516  48.440  26.269  1.00 41.91      A    C
ATOM  25620  CG   ASP I 334      26.331  48.154  27.152  1.00 44.74      A    C
ATOM  25621  OD1  ASP I 334      26.456  48.178  28.366  1.00 47.48      A    O
ATOM  25622  OD2  ASP I 334      25.269  47.865  26.617  1.00 45.50      A    O-1
ATOM  25623  C    ASP I 334      29.133  48.395  28.177  1.00 40.36      A    C
ATOM  25624  O    ASP I 334      28.806  47.279  28.357  1.00 38.53      A    O
ATOM  25625  N    GLN I 335      29.840  49.085  29.041  1.00 40.44      A    N
ATOM  25626  CA   GLN I 335      30.597  48.548  30.143  1.00 40.62      A    C
ATOM  25627  CB   GLN I 335      31.211  49.680  30.915  1.00 40.10      A    C
ATOM  25628  CG   GLN I 335      32.521  50.128  30.455  1.00 40.24      A    C
ATOM  25629  CD   GLN I 335      33.201  50.983  31.447  1.00 42.47      A    C
ATOM  25630  OE1  GLN I 335      33.663  52.040  31.130  1.00 44.49      A    O
ATOM  25631  NE2  GLN I 335      33.271  50.531  32.656  1.00 37.13      A    N
ATOM  25632  C    GLN I 335      29.768  47.794  31.102  1.00 40.88      A    C
ATOM  25633  O    GLN I 335      30.244  46.914  31.734  1.00 41.28      A    O
ATOM  25634  N    GLN I 336      28.540  48.212  31.274  1.00 42.40      A    N
ATOM  25635  CA   GLN I 336      27.648  47.560  32.183  1.00 43.01      A    C
ATOM  25636  CB   GLN I 336      26.393  48.380  32.263  1.00 43.81      A    C
ATOM  25637  CG   GLN I 336      25.334  47.795  33.099  1.00 50.95      A    C
ATOM  25638  CD   GLN I 336      24.124  48.648  33.063  1.00 60.29      A    C
ATOM  25639  OE1  GLN I 336      24.109  49.652  32.375  1.00 62.96      A    O
ATOM  25640  NE2  GLN I 336      23.101  48.276  33.806  1.00 60.22      A    N
ATOM  25641  C    GLN I 336      27.318  46.170  31.731  1.00 41.73      A    C
ATOM  25642  O    GLN I 336      27.360  45.251  32.494  1.00 41.77      A    O
ATOM  25643  N    LEU I 337      26.988  46.027  30.466  1.00 39.13      A    N
ATOM  25644  CA   LEU I 337      26.747  44.729  29.890  1.00 36.94      A    C
ATOM  25645  CB   LEU I 337      26.228  44.879  28.477  1.00 36.31      A    C
ATOM  25646  CG   LEU I 337      25.166  43.956  27.913  1.00 35.62      A    C
ATOM  25647  CD1  LEU I 337      25.443  43.591  26.520  1.00 32.14      A    C
ATOM  25648  CD2  LEU I 337      24.760  42.767  28.742  1.00 30.20      A    C
ATOM  25649  C    LEU I 337      27.988  43.861  29.910  1.00 34.96      A    C
ATOM  25650  O    LEU I 337      27.917  42.695  30.136  1.00 33.31      A    O
ATOM  25651  N    PHE I 338      29.136  44.434  29.679  1.00 33.26      A    N
ATOM  25652  CA   PHE I 338      30.297  43.626  29.627  1.00 34.43      A    C
ATOM  25653  CB   PHE I 338      31.469  44.533  29.354  1.00 35.29      A    C
ATOM  25654  CG   PHE I 338      32.799  43.874  29.392  1.00 38.07      A    C
ATOM  25655  CD1  PHE I 338      33.466  43.609  28.241  1.00 38.64      A    C
ATOM  25656  CE1  PHE I 338      34.657  43.047  28.272  1.00 38.80      A    C
ATOM  25657  CZ   PHE I 338      35.228  42.738  29.445  1.00 38.82      A    C
ATOM  25658  CE2  PHE I 338      34.604  43.012  30.596  1.00 36.92      A    C
ATOM  25659  CD2  PHE I 338      33.414  43.586  30.576  1.00 38.85      A    C
ATOM  25660  C    PHE I 338      30.416  42.993  30.964  1.00 35.30      A    C
ATOM  25661  O    PHE I 338      30.538  41.814  31.066  1.00 35.96      A    O
ATOM  25662  N    ASP I 339      30.299  43.777  32.008  1.00 35.94      A    N
ATOM  25663  CA   ASP I 339      30.419  43.288  33.354  1.00 36.13      A    C
ATOM  25664  CB   ASP I 339      30.313  44.461  34.311  1.00 36.38      A    C
ATOM  25665  CG   ASP I 339      30.902  44.176  35.655  1.00 36.60      A    C
```

Appendix 1

```
ATOM  25666  OD1  ASP I 339    32.112  44.148  35.786  1.00  35.72    A    O
ATOM  25667  OD2  ASP I 339    30.164  43.988  36.597  1.00  34.21    A    O-1
ATOM  25668  C    ASP I 339    29.371  42.279  33.710  1.00  36.25    A    C
ATOM  25669  O    ASP I 339    29.649  41.277  34.287  1.00  36.80    A    O
ATOM  25670  N    GLN I 340    28.141  42.532  33.377  1.00  37.14    A    N
ATOM  25671  CA   GLN I 340    27.161  41.524  33.667  1.00  39.59    A    C
ATOM  25672  CB   GLN I 340    25.744  42.044  33.474  1.00  40.41    A    C
ATOM  25673  CG   GLN I 340    25.650  43.371  32.833  1.00  43.42    A    C
ATOM  25674  CD   GLN I 340    24.281  43.923  32.887  1.00  47.42    A    C
ATOM  25675  OE1  GLN I 340    23.776  44.192  33.940  1.00  48.87    A    O
ATOM  25676  NE2  GLN I 340    23.677  44.107  31.755  1.00  44.88    A    N
ATOM  25677  C    GLN I 340    27.395  40.219  32.919  1.00  39.14    A    C
ATOM  25678  O    GLN I 340    27.207  39.181  33.460  1.00  39.96    A    O
ATOM  25679  N    LEU I 341    27.796  40.274  31.670  1.00  38.78    A    N
ATOM  25680  CA   LEU I 341    28.108  39.075  30.935  1.00  37.77    A    C
ATOM  25681  CB   LEU I 341    28.415  39.439  29.497  1.00  38.33    A    C
ATOM  25682  CG   LEU I 341    27.517  39.192  28.306  1.00  37.66    A    C
ATOM  25683  CD1  LEU I 341    26.251  38.559  28.643  1.00  38.33    A    C
ATOM  25684  CD2  LEU I 341    27.335  40.418  27.527  1.00  33.09    A    C
ATOM  25685  C    LEU I 341    29.301  38.318  31.481  1.00  37.52    A    C
ATOM  25686  O    LEU I 341    29.269  37.134  31.614  1.00  37.54    A    O
ATOM  25687  N    LEU I 342    30.372  39.015  31.785  1.00  36.38    A    N
ATOM  25688  CA   LEU I 342    31.572  38.394  32.274  1.00  35.77    A    C
ATOM  25689  CB   LEU I 342    32.701  39.394  32.329  1.00  34.91    A    C
ATOM  25690  CG   LEU I 342    34.129  38.885  32.335  1.00  35.03    A    C
ATOM  25691  CD1  LEU I 342    34.436  37.841  31.342  1.00  28.14    A    C
ATOM  25692  CD2  LEU I 342    35.051  40.011  32.180  1.00  33.35    A    C
ATOM  25693  C    LEU I 342    31.337  37.704  33.596  1.00  36.65    A    C
ATOM  25694  O    LEU I 342    31.945  36.716  33.905  1.00  35.45    A    O
ATOM  25695  N    ASN I 343    30.450  38.254  34.392  1.00  38.29    A    N
ATOM  25696  CA   ASN I 343    30.058  37.605  35.614  1.00  38.80    A    C
ATOM  25697  CB   ASN I 343    29.230  38.500  36.479  1.00  40.02    A    C
ATOM  25698  CG   ASN I 343    30.014  39.560  37.098  1.00  42.15    A    C
ATOM  25699  OD1  ASN I 343    31.093  39.346  37.563  1.00  47.76    A    O
ATOM  25700  ND2  ASN I 343    29.463  40.716  37.134  1.00  45.49    A    N
ATOM  25701  C    ASN I 343    29.330  36.342  35.405  1.00  38.13    A    C
ATOM  25702  O    ASN I 343    29.443  35.444  36.190  1.00  38.72    A    O
ATOM  25703  N    HIS I 344    28.500  36.308  34.396  1.00  37.13    A    N
ATOM  25704  CA   HIS I 344    27.866  35.084  34.037  1.00  37.23    A    C
ATOM  25705  CB   HIS I 344    26.805  35.362  33.011  1.00  36.74    A    C
ATOM  25706  CG   HIS I 344    26.223  34.143  32.406  1.00  38.59    A    C
ATOM  25707  ND1  HIS I 344    25.400  33.303  33.100  1.00  40.09    A    N
ATOM  25708  CE1  HIS I 344    25.020  32.323  32.315  1.00  40.26    A    C
ATOM  25709  NE2  HIS I 344    25.585  32.487  31.142  1.00  40.22    A    N
ATOM  25710  CD2  HIS I 344    26.344  33.619  31.173  1.00  39.80    A    C
ATOM  25711  C    HIS I 344    28.854  34.093  33.506  1.00  37.09    A    C
ATOM  25712  O    HIS I 344    28.823  32.954  33.840  1.00  37.11    A    O
ATOM  25713  N    LEU I 345    29.690  34.523  32.594  1.00  37.45    A    N
ATOM  25714  CA   LEU I 345    30.622  33.618  31.960  1.00  38.04    A    C
ATOM  25715  CB   LEU I 345    31.219  34.346  30.779  1.00  38.46    A    C
ATOM  25716  CG   LEU I 345    30.696  34.055  29.406  1.00  38.90    A    C
ATOM  25717  CD1  LEU I 345    29.559  33.161  29.465  1.00  37.84    A    C
ATOM  25718  CD2  LEU I 345    30.334  35.297  28.763  1.00  36.31    A    C
ATOM  25719  C    LEU I 345    31.800  33.075  32.714  1.00  37.95    A    C
```

Appendix 1

```
ATOM  25720  O    LEU I 345    32.039  31.895  32.708  1.00  38.19    A  O
ATOM  25721  N    GLU I 346    32.601  33.953  33.269  1.00  37.42    A  N
ATOM  25722  CA   GLU I 346    33.869  33.560  33.869  1.00  39.45    A  C
ATOM  25723  CB   GLU I 346    34.736  34.803  33.973  1.00  38.94    A  C
ATOM  25724  CG   GLU I 346    36.092  34.602  34.504  1.00  42.14    A  C
ATOM  25725  CD   GLU I 346    36.954  35.757  34.238  1.00  44.97    A  C
ATOM  25726  OE1  GLU I 346    36.652  36.861  34.656  1.00  46.34    A  O
ATOM  25727  OE2  GLU I 346    37.955  35.575  33.600  1.00  47.71    A  O-1
ATOM  25728  C    GLU I 346    33.940  32.700  35.160  1.00  40.44    A  C
ATOM  25729  O    GLU I 346    34.602  31.705  35.165  1.00  39.81    A  O
ATOM  25730  N    PRO I 347    33.206  33.028  36.217  1.00  41.28    A  N
ATOM  25731  CA   PRO I 347    33.318  32.327  37.490  1.00  41.23    A  C
ATOM  25732  CB   PRO I 347    32.294  33.056  38.320  1.00  40.64    A  C
ATOM  25733  CG   PRO I 347    32.400  34.372  37.886  1.00  39.94    A  C
ATOM  25734  CD   PRO I 347    32.781  34.404  36.469  1.00  41.05    A  C
ATOM  25735  C    PRO I 347    33.017  30.851  37.505  1.00  41.81    A  C
ATOM  25736  O    PRO I 347    33.702  30.121  38.143  1.00  41.90    A  O
ATOM  25737  N    PRO I 348    32.091  30.421  36.811  1.00  43.29    A  N
ATOM  25738  CA   PRO I 348    31.739  29.011  36.629  1.00  44.49    A  C
ATOM  25739  CB   PRO I 348    30.408  29.008  35.932  1.00  44.73    A  C
ATOM  25740  CG   PRO I 348    30.265  30.297  35.428  1.00  45.09    A  C
ATOM  25741  CD   PRO I 348    30.853  31.191  36.376  1.00  43.23    A  C
ATOM  25742  C    PRO I 348    32.779  28.314  35.798  1.00  45.25    A  C
ATOM  25743  O    PRO I 348    32.905  27.134  35.907  1.00  46.24    A  O
ATOM  25744  N    ALA I 349    33.518  29.046  34.992  1.00  44.72    A  N
ATOM  25745  CA   ALA I 349    34.589  28.475  34.219  1.00  44.04    A  C
ATOM  25746  CB   ALA I 349    34.940  29.354  33.111  1.00  43.90    A  C
ATOM  25747  C    ALA I 349    35.800  28.160  35.087  1.00  44.14    A  C
ATOM  25748  O    ALA I 349    36.718  27.524  34.646  1.00  43.47    A  O
ATOM  25749  N    LYS I 350    35.763  28.581  36.341  1.00  42.81    A  N
ATOM  25750  CA   LYS I 350    36.767  28.243  37.325  1.00  42.20    A  C
ATOM  25751  CB   LYS I 350    36.566  26.826  37.833  1.00  41.34    A  C
ATOM  25756  C    LYS I 350    38.215  28.525  36.952  1.00  42.05    A  C
ATOM  25757  O    LYS I 350    39.036  27.658  36.926  1.00  41.60    A  O
ATOM  25758  N    PRO I 351    38.488  29.775  36.678  1.00  41.45    A  N
ATOM  25759  CA   PRO I 351    39.769  30.210  36.189  1.00  41.11    A  C
ATOM  25760  CB   PRO I 351    39.532  31.670  35.986  1.00  40.87    A  C
ATOM  25761  CG   PRO I 351    38.604  31.999  36.983  1.00  39.99    A  C
ATOM  25762  CD   PRO I 351    37.665  30.914  37.057  1.00  40.81    A  C
ATOM  25763  C    PRO I 351    40.780  30.086  37.250  1.00  42.09    A  C
ATOM  25764  O    PRO I 351    40.473  30.374  38.362  1.00  43.21    A  O
ATOM  25765  N    SER I 352    41.985  29.690  36.909  1.00  42.47    A  N
ATOM  25766  CA   SER I 352    43.053  29.640  37.867  1.00  42.33    A  C
ATOM  25767  CB   SER I 352    43.274  28.213  38.206  1.00  42.08    A  C
ATOM  25768  OG   SER I 352    42.502  27.472  37.312  1.00  45.50    A  O
ATOM  25769  C    SER I 352    44.324  30.238  37.312  1.00  42.01    A  C
ATOM  25770  O    SER I 352    44.661  30.033  36.183  1.00  41.66    A  O
ATOM  25771  N    ILE I 353    45.047  30.976  38.118  1.00  40.97    A  N
ATOM  25772  CA   ILE I 353    46.335  31.437  37.697  1.00  40.15    A  C
ATOM  25773  CB   ILE I 353    46.433  32.922  37.937  1.00  40.49    A  C
ATOM  25774  CG1  ILE I 353    45.456  33.621  37.041  1.00  39.18    A  C
ATOM  25775  CD1  ILE I 353    45.757  34.973  36.884  1.00  36.82    A  C
ATOM  25776  CG2  ILE I 353    47.784  33.429  37.606  1.00  40.25    A  C
ATOM  25777  C    ILE I 353    47.390  30.728  38.492  1.00  39.18    A  C
```

Appendix 1

```
ATOM  25778  O    ILE I 353     47.580  31.028  39.613  1.00  38.40    A  O
ATOM  25779  N    VAL I 354     48.044  29.741  37.922  1.00  39.19    A  N
ATOM  25780  CA   VAL I 354     48.956  28.992  38.743  1.00  39.17    A  C
ATOM  25781  CB   VAL I 354     48.637  27.486  38.921  1.00  39.21    A  C
ATOM  25782  CG1  VAL I 354     47.391  27.082  38.291  1.00  37.75    A  C
ATOM  25783  CG2  VAL I 354     49.762  26.646  38.561  1.00  35.81    A  C
ATOM  25784  C    VAL I 354     50.445  29.269  38.714  1.00  39.75    A  C
ATOM  25785  O    VAL I 354     51.050  29.319  39.758  1.00  43.22    A  O
ATOM  25786  N    SER I 355     51.074  29.479  37.599  1.00  37.82    A  N
ATOM  25787  CA   SER I 355     52.391  30.013  37.773  1.00  36.13    A  C
ATOM  25788  CB   SER I 355     53.436  28.935  37.678  1.00  35.98    A  C
ATOM  25789  OG   SER I 355     54.535  29.339  36.941  1.00  37.50    A  O
ATOM  25790  C    SER I 355     52.626  31.167  36.852  1.00  36.22    A  C
ATOM  25791  O    SER I 355     53.436  31.112  35.970  1.00  35.30    A  O
ATOM  25792  N    ALA I 356     51.867  32.219  37.102  1.00  35.86    A  N
ATOM  25793  CA   ALA I 356     51.762  33.385  36.258  1.00  35.03    A  C
ATOM  25794  CB   ALA I 356     53.069  34.003  36.084  1.00  35.24    A  C
ATOM  25795  C    ALA I 356     51.171  33.040  34.934  1.00  34.09    A  C
ATOM  25796  O    ALA I 356     51.459  33.664  33.972  1.00  33.41    A  O
ATOM  25797  N    SER I 357     50.340  32.020  34.920  1.00  33.94    A  N
ATOM  25798  CA   SER I 357     49.714  31.513  33.730  1.00  33.79    A  C
ATOM  25799  CB   SER I 357     50.433  30.268  33.320  1.00  33.15    A  C
ATOM  25800  OG   SER I 357     50.435  30.121  31.956  1.00  30.70    A  O
ATOM  25801  C    SER I 357     48.277  31.163  34.003  1.00  33.94    A  C
ATOM  25802  O    SER I 357     47.997  30.586  34.999  1.00  33.74    A  O
ATOM  25803  N    LEU I 358     47.377  31.472  33.088  1.00  33.92    A  N
ATOM  25804  CA   LEU I 358     45.971  31.307  33.322  1.00  34.59    A  C
ATOM  25805  CB   LEU I 358     45.240  32.574  32.950  1.00  34.15    A  C
ATOM  25806  CG   LEU I 358     43.759  32.521  32.647  1.00  33.55    A  C
ATOM  25807  CD1  LEU I 358     42.955  32.557  33.865  1.00  30.65    A  C
ATOM  25808  CD2  LEU I 358     43.418  33.656  31.845  1.00  31.48    A  C
ATOM  25809  C    LEU I 358     45.332  30.163  32.613  1.00  35.89    A  C
ATOM  25810  O    LEU I 358     45.497  30.006  31.461  1.00  36.93    A  O
ATOM  25811  N    ARG I 359     44.561  29.390  33.351  1.00  38.06    A  N
ATOM  25812  CA   ARG I 359     43.773  28.295  32.852  1.00  40.39    A  C
ATOM  25813  CB   ARG I 359     44.405  26.993  33.256  1.00  41.33    A  C
ATOM  25814  CG   ARG I 359     45.816  26.865  32.886  1.00  46.13    A  C
ATOM  25815  CD   ARG I 359     45.944  26.226  31.539  1.00  53.64    A  C
ATOM  25816  NE   ARG I 359     47.293  25.836  31.199  1.00  55.15    A  N
ATOM  25817  CZ   ARG I 359     48.333  26.639  31.238  1.00  55.71    A  C
ATOM  25818  NH1  ARG I 359     48.195  27.881  31.602  1.00  55.33    A  N
ATOM  25819  NH2  ARG I 359     49.512  26.180  30.908  1.00  57.08    A  N
ATOM  25820  C    ARG I 359     42.394  28.318  33.430  1.00  39.94    A  C
ATOM  25821  O    ARG I 359     42.200  28.749  34.520  1.00  39.05    A  O
ATOM  25822  N    TYR I 360     41.446  27.795  32.686  1.00  41.12    A  N
ATOM  25823  CA   TYR I 360     40.105  27.587  33.169  1.00  42.07    A  C
ATOM  25824  CB   TYR I 360     39.113  28.168  32.186  1.00  40.01    A  C
ATOM  25825  CG   TYR I 360     39.150  29.656  32.108  1.00  37.64    A  C
ATOM  25826  CD1  TYR I 360     38.526  30.422  33.034  1.00  35.43    A  C
ATOM  25827  CE1  TYR I 360     38.574  31.739  32.973  1.00  31.13    A  C
ATOM  25828  CZ   TYR I 360     39.232  32.331  31.992  1.00  29.60    A  C
ATOM  25829  OH   TYR I 360     39.272  33.650  31.944  1.00  27.87    A  O
ATOM  25830  CE2  TYR I 360     39.858  31.618  31.068  1.00  31.71    A  C
ATOM  25831  CD2  TYR I 360     39.818  30.292  31.121  1.00  34.69    A  C
```

Appendix 1

```
ATOM  25832  C    TYR I 360      39.854  26.118  33.289  1.00  44.76    A  C
ATOM  25833  O    TYR I 360      39.902  25.430  32.326  1.00  45.57    A  O
ATOM  25834  N    GLU I 361      39.622  25.628  34.487  1.00  48.41    A  N
ATOM  25835  CA   GLU I 361      39.013  24.347  34.695  1.00  52.52    A  C
ATOM  25836  CB   GLU I 361      38.900  24.106  36.184  1.00  53.80    A  C
ATOM  25837  CG   GLU I 361      39.351  22.750  36.701  1.00  60.87    A  C
ATOM  25838  CD   GLU I 361      39.021  22.534  38.179  1.00  69.88    A  C
ATOM  25839  OE1  GLU I 361      39.309  23.419  39.005  1.00  70.57    A  O
ATOM  25840  OE2  GLU I 361      38.479  21.473  38.530  1.00  73.08    A  O-1
ATOM  25841  C    GLU I 361      37.646  24.631  34.195  1.00  53.54    A  C
ATOM  25842  O    GLU I 361      37.140  25.705  34.453  1.00  55.36    A  O
ATOM  25843  N    HIS I 362      37.007  23.704  33.510  1.00  53.82    A  N
ATOM  25844  CA   HIS I 362      35.633  23.931  33.017  1.00  54.77    A  C
ATOM  25845  CB   HIS I 362      34.608  23.872  34.142  1.00  54.94    A  C
ATOM  25846  CG   HIS I 362      34.949  22.899  35.214  1.00  62.06    A  C
ATOM  25847  ND1  HIS I 362      34.766  23.173  36.547  1.00  66.54    A  N
ATOM  25848  CE1  HIS I 362      35.168  22.141  37.261  1.00  68.12    A  C
ATOM  25849  NE2  HIS I 362      35.596  21.207  36.439  1.00  67.66    A  N
ATOM  25850  CD2  HIS I 362      35.471  21.655  35.153  1.00  65.75    A  C
ATOM  25851  C    HIS I 362      35.244  25.103  32.144  1.00  53.20    A  C
ATOM  25852  O    HIS I 362      34.339  25.819  32.488  1.00  54.10    A  O
ATOM  25853  N    PRO I 363      35.867  25.260  30.998  1.00  51.79    A  N
ATOM  25854  CA   PRO I 363      35.389  26.231  30.038  1.00  50.59    A  C
ATOM  25855  CB   PRO I 363      36.409  26.147  28.939  1.00  50.22    A  C
ATOM  25856  CG   PRO I 363      37.049  24.943  29.130  1.00  50.90    A  C
ATOM  25857  CD   PRO I 363      37.142  24.731  30.561  1.00  51.69    A  C
ATOM  25858  C    PRO I 363      34.046  25.841  29.512  1.00  49.82    A  C
ATOM  25859  O    PRO I 363      33.808  24.717  29.159  1.00  49.72    A  O
ATOM  25860  N    GLY I 364      33.156  26.800  29.452  1.00  48.45    A  N
ATOM  25861  CA   GLY I 364      31.774  26.533  29.176  1.00  46.93    A  C
ATOM  25862  C    GLY I 364      31.344  26.651  27.752  1.00  46.35    A  C
ATOM  25863  O    GLY I 364      30.187  26.679  27.483  1.00  46.46    A  O
ATOM  25864  N    SER I 365      32.282  26.763  26.839  1.00  44.79    A  N
ATOM  25865  CA   SER I 365      31.977  26.849  25.441  1.00  42.41    A  C
ATOM  25866  CB   SER I 365      31.426  28.203  25.077  1.00  42.65    A  C
ATOM  25867  OG   SER I 365      32.434  29.125  24.895  1.00  42.08    A  O
ATOM  25868  C    SER I 365      33.191  26.551  24.643  1.00  41.87    A  C
ATOM  25869  O    SER I 365      34.240  26.339  25.179  1.00  41.52    A  O
ATOM  25870  N    LEU I 366      33.006  26.511  23.344  1.00  39.86    A  N
ATOM  25871  CA   LEU I 366      34.074  26.410  22.407  1.00  39.32    A  C
ATOM  25872  CB   LEU I 366      33.526  26.222  21.015  1.00  39.28    A  C
ATOM  25873  CG   LEU I 366      33.469  24.873  20.331  1.00  39.60    A  C
ATOM  25874  CD1  LEU I 366      33.917  23.814  21.175  1.00  36.73    A  C
ATOM  25875  CD2  LEU I 366      32.093  24.612  19.904  1.00  42.24    A  C
ATOM  25876  C    LEU I 366      34.688  27.754  22.518  1.00  38.68    A  C
ATOM  25877  O    LEU I 366      34.090  28.620  23.065  1.00  38.21    A  O
ATOM  25878  N    LEU I 367      35.929  27.893  22.126  1.00  36.64    A  N
ATOM  25879  CA   LEU I 367      36.559  29.181  22.023  1.00  34.61    A  C
ATOM  25880  CB   LEU I 367      35.905  30.003  20.968  1.00  33.61    A  C
ATOM  25881  CG   LEU I 367      35.853  29.309  19.653  1.00  36.10    A  C
ATOM  25882  CD1  LEU I 367      35.117  30.154  18.732  1.00  36.69    A  C
ATOM  25883  CD2  LEU I 367      37.231  29.187  19.217  1.00  35.51    A  C
ATOM  25884  C    LEU I 367      36.447  29.941  23.283  1.00  34.00    A  C
ATOM  25885  O    LEU I 367      36.333  31.116  23.227  1.00  33.63    A  O
```

Appendix 1

```
ATOM  25886  N    PHE I 368    36.402  29.287  24.421  1.00  32.42    A  N
ATOM  25887  CA   PHE I 368    36.296  30.041  25.627  1.00  31.29    A  C
ATOM  25888  CB   PHE I 368    35.948  29.102  26.755  1.00  31.25    A  C
ATOM  25889  CG   PHE I 368    35.519  29.782  27.975  1.00  28.30    A  C
ATOM  25890  CD1  PHE I 368    34.238  30.136  28.144  1.00  26.43    A  C
ATOM  25891  CE1  PHE I 368    33.862  30.762  29.234  1.00  31.19    A  C
ATOM  25892  CZ   PHE I 368    34.750  31.040  30.183  1.00  30.57    A  C
ATOM  25893  CE2  PHE I 368    36.022  30.692  30.026  1.00  29.59    A  C
ATOM  25894  CD2  PHE I 368    36.405  30.074  28.943  1.00  25.58    A  C
ATOM  25895  C    PHE I 368    37.476  30.919  26.023  1.00  31.08    A  C
ATOM  25896  O    PHE I 368    37.294  32.050  26.289  1.00  31.91    A  O
ATOM  25897  N    ASP I 369    38.680  30.411  26.106  1.00  29.64    A  N
ATOM  25898  CA   ASP I 369    39.772  31.281  26.467  1.00  28.90    A  C
ATOM  25899  CB   ASP I 369    41.041  30.544  26.935  1.00  27.32    A  C
ATOM  25900  CG   ASP I 369    41.851  29.968  25.828  1.00  31.84    A  C
ATOM  25901  OD1  ASP I 369    42.734  30.616  25.295  1.00  33.12    A  O
ATOM  25902  OD2  ASP I 369    41.653  28.812  25.523  1.00  35.41    A  O-1
ATOM  25903  C    ASP I 369    40.027  32.343  25.432  1.00  28.62    A  C
ATOM  25904  O    ASP I 369    40.364  33.446  25.743  1.00  28.60    A  O
ATOM  25905  N    GLU I 370    39.864  31.987  24.182  1.00  28.54    A  N
ATOM  25906  CA   GLU I 370    40.081  32.928  23.131  1.00  28.88    A  C
ATOM  25907  CB   GLU I 370    39.868  32.207  21.830  1.00  29.13    A  C
ATOM  25908  CG   GLU I 370    40.839  31.148  21.584  1.00  33.84    A  C
ATOM  25909  CD   GLU I 370    40.349  29.813  21.972  1.00  37.83    A  C
ATOM  25910  OE1  GLU I 370    39.484  29.736  22.805  1.00  38.93    A  O
ATOM  25911  OE2  GLU I 370    40.845  28.830  21.471  1.00  39.36    A  O-1
ATOM  25912  C    GLU I 370    39.157  34.113  23.125  1.00  28.14    A  C
ATOM  25913  O    GLU I 370    39.580  35.208  23.050  1.00  29.13    A  O
ATOM  25914  N    LEU I 371    37.876  33.878  23.190  1.00  27.38    A  N
ATOM  25915  CA   LEU I 371    36.915  34.941  23.199  1.00  27.37    A  C
ATOM  25916  CB   LEU I 371    35.530  34.385  22.984  1.00  27.69    A  C
ATOM  25917  CG   LEU I 371    35.136  34.089  21.560  1.00  29.42    A  C
ATOM  25918  CD1  LEU I 371    33.705  33.832  21.507  1.00  28.20    A  C
ATOM  25919  CD2  LEU I 371    35.544  35.141  20.582  1.00  28.02    A  C
ATOM  25920  C    LEU I 371    36.950  35.871  24.390  1.00  27.55    A  C
ATOM  25921  O    LEU I 371    36.740  37.031  24.252  1.00  27.51    A  O
ATOM  25922  N    LEU I 372    37.182  35.340  25.566  1.00  26.66    A  N
ATOM  25923  CA   LEU I 372    37.441  36.142  26.722  1.00  25.88    A  C
ATOM  25924  CB   LEU I 372    37.411  35.273  27.967  1.00  25.62    A  C
ATOM  25925  CG   LEU I 372    36.112  35.223  28.760  1.00  25.60    A  C
ATOM  25926  CD1  LEU I 372    35.063  34.406  28.142  1.00  22.50    A  C
ATOM  25927  CD2  LEU I 372    36.335  34.764  30.127  1.00  25.56    A  C
ATOM  25928  C    LEU I 372    38.732  36.941  26.615  1.00  26.45    A  C
ATOM  25929  O    LEU I 372    38.801  38.060  26.976  1.00  27.14    A  O
ATOM  25930  N    PHE I 373    39.769  36.367  26.088  1.00  26.69    A  N
ATOM  25931  CA   PHE I 373    40.961  37.114  25.979  1.00  26.75    A  C
ATOM  25932  CB   PHE I 373    42.057  36.218  25.419  1.00  26.73    A  C
ATOM  25933  CG   PHE I 373    43.158  36.937  24.754  1.00  25.32    A  C
ATOM  25934  CD1  PHE I 373    43.939  37.803  25.438  1.00  24.08    A  C
ATOM  25935  CE1  PHE I 373    44.918  38.452  24.821  1.00  22.46    A  C
ATOM  25936  CZ   PHE I 373    45.151  38.244  23.529  1.00  21.93    A  C
ATOM  25937  CE2  PHE I 373    44.406  37.402  22.841  1.00  21.65    A  C
ATOM  25938  CD2  PHE I 373    43.419  36.748  23.434  1.00  23.57    A  C
ATOM  25939  C    PHE I 373    40.633  38.268  25.082  1.00  27.56    A  C
```

Appendix 1

```
ATOM  25940  O    PHE I 373     40.962  39.386  25.368  1.00  27.28    A  O
ATOM  25941  N    LEU I 374     39.943  37.995  24.005  1.00  27.60    A  N
ATOM  25942  CA   LEU I 374     39.622  39.016  23.044  1.00  28.73    A  C
ATOM  25943  CB   LEU I 374     39.012  38.392  21.824  1.00  27.93    A  C
ATOM  25944  CG   LEU I 374     38.513  39.333  20.768  1.00  29.02    A  C
ATOM  25945  CD1  LEU I 374     39.565  40.224  20.289  1.00  25.75    A  C
ATOM  25946  CD2  LEU I 374     37.975  38.554  19.673  1.00  29.17    A  C
ATOM  25947  C    LEU I 374     38.745  40.128  23.547  1.00  29.74    A  C
ATOM  25948  O    LEU I 374     38.987  41.256  23.282  1.00  29.35    A  O
ATOM  25949  N    ALA I 375     37.725  39.788  24.285  1.00  30.83    A  N
ATOM  25950  CA   ALA I 375     36.867  40.757  24.901  1.00  32.54    A  C
ATOM  25951  CB   ALA I 375     35.686  40.113  25.439  1.00  32.23    A  C
ATOM  25952  C    ALA I 375     37.559  41.584  25.951  1.00  34.25    A  C
ATOM  25953  O    ALA I 375     37.232  42.720  26.148  1.00  36.32    A  O
ATOM  25954  N    LYS I 376     38.483  41.003  26.680  1.00  34.20    A  N
ATOM  25955  CA   LYS I 376     39.221  41.792  27.649  1.00  33.24    A  C
ATOM  25956  CB   LYS I 376     39.945  40.936  28.664  1.00  33.79    A  C
ATOM  25957  CG   LYS I 376     39.069  40.176  29.580  1.00  32.93    A  C
ATOM  25958  CD   LYS I 376     39.820  39.043  30.134  1.00  32.97    A  C
ATOM  25959  CE   LYS I 376     39.129  38.458  31.278  1.00  36.03    A  C
ATOM  25960  NZ   LYS I 376     39.952  37.519  31.993  1.00  38.83    A  N
ATOM  25961  C    LYS I 376     40.129  42.838  27.064  1.00  33.21    A  C
ATOM  25962  O    LYS I 376     40.288  43.863  27.625  1.00  32.14    A  O
ATOM  25963  N    VAL I 377     40.754  42.554  25.940  1.00  33.45    A  N
ATOM  25964  CA   VAL I 377     41.640  43.513  25.335  1.00  33.57    A  C
ATOM  25965  CB   VAL I 377     42.886  42.861  24.768  1.00  34.12    A  C
ATOM  25966  CG1  VAL I 377     43.690  42.277  25.842  1.00  32.72    A  C
ATOM  25967  CG2  VAL I 377     42.561  41.857  23.729  1.00  33.63    A  C
ATOM  25968  C    VAL I 377     41.105  44.412  24.277  1.00  34.41    A  C
ATOM  25969  O    VAL I 377     41.710  45.381  23.990  1.00  36.17    A  O
ATOM  25970  N    HIS I 378     39.956  44.140  23.721  1.00  34.43    A  N
ATOM  25971  CA   HIS I 378     39.611  44.720  22.464  1.00  34.00    A  C
ATOM  25972  CB   HIS I 378     38.293  44.120  22.065  1.00  33.94    A  C
ATOM  25973  CG   HIS I 378     37.837  44.482  20.709  1.00  31.38    A  C
ATOM  25974  ND1  HIS I 378     38.535  44.166  19.583  1.00  35.79    A  N
ATOM  25975  CE1  HIS I 378     37.888  44.597  18.532  1.00  31.70    A  C
ATOM  25976  NE2  HIS I 378     36.799  45.198  18.942  1.00  30.90    A  N
ATOM  25977  CD2  HIS I 378     36.741  45.132  20.299  1.00  31.23    A  C
ATOM  25978  C    HIS I 378     39.538  46.222  22.476  1.00  35.21    A  C
ATOM  25979  O    HIS I 378     38.828  46.818  23.214  1.00  37.01    A  O
ATOM  25980  N    ALA I 379     40.306  46.827  21.606  1.00  35.92    A  N
ATOM  25981  CA   ALA I 379     40.458  48.252  21.535  1.00  35.96    A  C
ATOM  25982  CB   ALA I 379     41.783  48.556  20.991  1.00  35.73    A  C
ATOM  25983  C    ALA I 379     39.411  48.879  20.662  1.00  36.04    A  C
ATOM  25984  O    ALA I 379     39.243  50.055  20.627  1.00  35.64    A  O
ATOM  25985  N    GLY I 380     38.711  48.037  19.953  1.00  36.99    A  N
ATOM  25986  CA   GLY I 380     37.786  48.416  18.930  1.00  35.11    A  C
ATOM  25987  C    GLY I 380     38.371  48.219  17.572  1.00  35.05    A  C
ATOM  25988  O    GLY I 380     39.497  48.492  17.347  1.00  35.35    A  O
ATOM  25989  N    PHE I 381     37.563  47.748  16.658  1.00  34.80    A  N
ATOM  25990  CA   PHE I 381     37.964  47.519  15.302  1.00  35.06    A  C
ATOM  25991  CB   PHE I 381     36.850  46.822  14.586  1.00  35.23    A  C
ATOM  25992  CG   PHE I 381     36.744  45.404  14.935  1.00  37.44    A  C
ATOM  25993  CD1  PHE I 381     37.807  44.579  14.786  1.00  36.67    A  C
```

Appendix 1

```
ATOM  25994  CE1 PHE I 381    37.716  43.335  15.111  1.00 34.98       A  C
ATOM  25995  CZ  PHE I 381    36.591  42.856  15.591  1.00 38.01       A  C
ATOM  25996  CE2 PHE I 381    35.554  43.619  15.742  1.00 37.89       A  C
ATOM  25997  CD2 PHE I 381    35.611  44.888  15.420  1.00 38.85       A  C
ATOM  25998  C   PHE I 381    38.387  48.753  14.547  1.00 36.09       A  C
ATOM  25999  O   PHE I 381    39.276  48.711  13.743  1.00 35.78       A  O
ATOM  26000  N   GLY I 382    37.712  49.852  14.793  1.00 36.26       A  N
ATOM  26001  CA  GLY I 382    38.071  51.110  14.214  1.00 36.96       A  C
ATOM  26002  C   GLY I 382    39.421  51.542  14.671  1.00 38.04       A  C
ATOM  26003  O   GLY I 382    40.191  52.043  13.924  1.00 38.36       A  O
ATOM  26004  N   ALA I 383    39.715  51.326  15.926  1.00 37.75       A  N
ATOM  26005  CA  ALA I 383    41.011  51.656  16.421  1.00 39.18       A  C
ATOM  26006  CB  ALA I 383    41.045  51.496  17.886  1.00 37.75       A  C
ATOM  26007  C   ALA I 383    42.087  50.830  15.747  1.00 40.31       A  C
ATOM  26008  O   ALA I 383    43.118  51.310  15.399  1.00 40.70       A  O
ATOM  26009  N   LEU I 384    41.809  49.575  15.513  1.00 41.66       A  N
ATOM  26010  CA  LEU I 384    42.807  48.673  15.024  1.00 42.83       A  C
ATOM  26011  CB  LEU I 384    42.224  47.279  14.882  1.00 41.94       A  C
ATOM  26012  CG  LEU I 384    42.563  46.153  15.845  1.00 42.72       A  C
ATOM  26013  CD1 LEU I 384    43.161  46.572  17.111  1.00 40.66       A  C
ATOM  26014  CD2 LEU I 384    41.392  45.347  16.102  1.00 45.15       A  C
ATOM  26015  C   LEU I 384    43.255  49.230  13.702  1.00 43.97       A  C
ATOM  26016  O   LEU I 384    44.385  49.115  13.312  1.00 44.84       A  O
ATOM  26017  N   LEU I 385    42.322  49.854  13.027  1.00 44.93       A  N
ATOM  26018  CA  LEU I 385    42.504  50.488  11.749  1.00 46.59       A  C
ATOM  26019  CB  LEU I 385    41.178  50.984  11.264  1.00 46.71       A  C
ATOM  26020  CG  LEU I 385    40.532  50.337  10.069  1.00 47.31       A  C
ATOM  26021  CD1 LEU I 385    41.284  49.195   9.584  1.00 43.80       A  C
ATOM  26022  CD2 LEU I 385    39.142  49.962  10.417  1.00 48.11       A  C
ATOM  26023  C   LEU I 385    43.447  51.647  11.771  1.00 47.60       A  C
ATOM  26024  O   LEU I 385    44.083  51.930  10.811  1.00 47.55       A  O
ATOM  26025  N   ARG I 386    43.508  52.343  12.876  1.00 49.69       A  N
ATOM  26026  CA  ARG I 386    44.237  53.583  12.920  1.00 52.85       A  C
ATOM  26027  CB  ARG I 386    43.398  54.657  13.599  1.00 53.63       A  C
ATOM  26028  CG  ARG I 386    42.136  54.972  12.872  1.00 55.71       A  C
ATOM  26029  CD  ARG I 386    41.381  56.049  13.521  1.00 58.36       A  C
ATOM  26030  NE  ARG I 386    40.820  55.657  14.799  1.00 64.17       A  N
ATOM  26031  CZ  ARG I 386    39.549  55.339  14.999  1.00 64.85       A  C
ATOM  26032  NH1 ARG I 386    38.719  55.321  13.992  1.00 64.59       A  N
ATOM  26033  NH2 ARG I 386    39.112  55.042  16.204  1.00 63.44       A  N
ATOM  26034  C   ARG I 386    45.568  53.457  13.603  1.00 53.42       A  C
ATOM  26035  O   ARG I 386    46.138  54.428  14.022  1.00 53.69       A  O
ATOM  26036  N   MET I 387    46.042  52.241  13.725  1.00 54.33       A  N
ATOM  26037  CA  MET I 387    47.178  51.973  14.543  1.00 55.25       A  C
ATOM  26038  CB  MET I 387    47.415  50.491  14.587  1.00 55.25       I  C
ATOM  26039  CG  MET I 387    48.522  50.108  15.473  1.00 56.92       I  C
ATOM  26040  SD  MET I 387    49.093  48.452  15.214  1.00 64.55       I  S
ATOM  26041  CE  MET I 387    47.615  47.515  15.486  1.00 57.64       I  C
ATOM  26042  C   MET I 387    48.392  52.641  14.010  1.00 55.51       A  C
ATOM  26043  O   MET I 387    48.605  52.646  12.825  1.00 55.10       A  O
ATOM  26044  N   PRO I 388    49.206  53.153  14.920  1.00 56.36       A  N
ATOM  26045  CA  PRO I 388    50.459  53.809  14.626  1.00 56.61       A  C
ATOM  26046  CB  PRO I 388    50.808  54.450  15.955  1.00 56.41       A  C
ATOM  26047  CG  PRO I 388    49.616  54.550  16.637  1.00 56.24       A  C
```

Appendix 1

```
ATOM  26048  CD   PRO I 388    48.823  53.394  16.305  1.00 56.45    A    C
ATOM  26049  C    PRO I 388    51.531  52.835  14.273  1.00 57.70    A    C
ATOM  26050  O    PRO I 388    51.613  51.766  14.807  1.00 57.49    A    O
ATOM  26051  N    PRO I 389    52.454  53.269  13.459  1.00 59.01    A    N
ATOM  26052  CA   PRO I 389    53.220  52.417  12.574  1.00 60.20    A    C
ATOM  26053  CB   PRO I 389    53.635  53.391  11.482  1.00 60.01    A    C
ATOM  26054  CG   PRO I 389    53.367  54.678  11.999  1.00 59.67    A    C
ATOM  26055  CD   PRO I 389    52.227  54.571  12.858  1.00 58.82    A    C
ATOM  26056  C    PRO I 389    54.454  51.651  13.042  1.00 61.81    A    C
ATOM  26057  O    PRO I 389    54.670  50.547  12.566  1.00 61.26    A    O
ATOM  26058  N    PRO I 390    55.265  52.224  13.917  1.00 62.92    A    N
ATOM  26059  CA   PRO I 390    56.671  51.850  13.958  1.00 63.43    A    C
ATOM  26060  CB   PRO I 390    56.968  51.740  15.446  1.00 63.44    A    C
ATOM  26061  CG   PRO I 390    55.692  51.452  16.045  1.00 63.99    A    C
ATOM  26062  CD   PRO I 390    54.670  52.172  15.262  1.00 63.21    A    C
ATOM  26063  C    PRO I 390    56.864  50.528  13.243  1.00 63.97    A    C
ATOM  26064  O    PRO I 390    56.370  49.497  13.682  1.00 64.49    A    O
ATOM  26065  N    LEU J  29     7.246  72.916 -23.166  1.00 68.45    A    N
ATOM  26066  CA   LEU J  29     6.116  73.007 -24.070  1.00 69.44    A    C
ATOM  26067  CB   LEU J  29     6.604  72.750 -25.487  1.00 69.95    A    C
ATOM  26068  CG   LEU J  29     6.084  73.632 -26.620  1.00 70.83    A    C
ATOM  26069  CD1  LEU J  29     6.615  75.053 -26.559  1.00 68.10    A    C
ATOM  26070  CD2  LEU J  29     6.448  72.970 -27.917  1.00 69.80    A    C
ATOM  26071  C    LEU J  29     4.991  72.040 -23.703  1.00 68.92    A    C
ATOM  26072  O    LEU J  29     5.208  71.113 -22.955  1.00 69.04    A    O
ATOM  26073  N    PRO J  30     3.796  72.272 -24.238  1.00 67.95    A    N
ATOM  26074  CA   PRO J  30     2.631  71.445 -23.963  1.00 66.68    A    C
ATOM  26075  CB   PRO J  30     1.596  72.464 -23.461  1.00 66.64    A    C
ATOM  26076  CG   PRO J  30     1.932  73.660 -24.099  1.00 67.13    A    C
ATOM  26077  CD   PRO J  30     3.441  73.690 -24.190  1.00 68.32    A    C
ATOM  26078  C    PRO J  30     2.130  70.726 -25.202  1.00 64.98    A    C
ATOM  26079  O    PRO J  30     1.983  71.284 -26.277  1.00 65.43    A    O
ATOM  26080  N    PRO J  31     1.841  69.459 -25.035  1.00 62.76    A    N
ATOM  26081  CA   PRO J  31     1.623  68.576 -26.167  1.00 61.10    A    C
ATOM  26082  CB   PRO J  31     2.175  67.254 -25.667  1.00 61.05    A    C
ATOM  26083  CG   PRO J  31     2.605  67.495 -24.252  1.00 61.74    A    C
ATOM  26084  CD   PRO J  31     2.831  68.917 -24.115  1.00 62.24    A    C
ATOM  26085  C    PRO J  31     0.206  68.394 -26.667  1.00 59.68    A    C
ATOM  26086  O    PRO J  31     0.060  67.674 -27.630  1.00 59.98    A    O
ATOM  26087  N    GLY J  32    -0.784  69.052 -26.082  1.00 58.00    A    N
ATOM  26088  CA   GLY J  32    -2.186  68.708 -26.243  1.00 55.01    A    C
ATOM  26089  C    GLY J  32    -2.938  69.016 -24.971  1.00 52.98    A    C
ATOM  26090  O    GLY J  32    -4.042  68.599 -24.775  1.00 52.96    A    O
ATOM  26091  N    ARG J  33    -2.295  69.797 -24.124  1.00 50.94    A    N
ATOM  26092  CA   ARG J  33    -2.666  70.036 -22.750  1.00 48.76    A    C
ATOM  26093  CB   ARG J  33    -1.510  69.685 -21.856  1.00 48.22    A    C
ATOM  26094  CG   ARG J  33    -0.879  68.440 -22.159  1.00 46.81    A    C
ATOM  26095  CD   ARG J  33    -0.964  67.629 -20.950  1.00 45.86    A    C
ATOM  26096  NE   ARG J  33    -0.546  68.404 -19.821  1.00 44.49    A    N
ATOM  26097  CZ   ARG J  33     0.452  68.078 -19.039  1.00 41.23    A    C
ATOM  26098  NH1  ARG J  33     1.120  66.989 -19.250  1.00 37.73    A    N
ATOM  26099  NH2  ARG J  33     0.765  68.853 -18.045  1.00 41.86    A    N
ATOM  26100  C    ARG J  33    -2.878  71.483 -22.548  1.00 47.64    A    C
ATOM  26101  O    ARG J  33    -2.515  72.252 -23.371  1.00 46.96    A    O
```

Appendix 1

```
ATOM  26102  N    LEU J  34     -3.533  71.851 -21.475  1.00 46.71      A  N
ATOM  26103  CA   LEU J  34     -3.616  73.235 -21.070  1.00 46.62      A  C
ATOM  26104  CB   LEU J  34     -4.705  73.388 -20.037  1.00 46.99      A  C
ATOM  26105  CG   LEU J  34     -6.069  72.854 -20.365  1.00 48.58      A  C
ATOM  26106  CD1  LEU J  34     -6.060  72.361 -21.749  1.00 47.68      A  C
ATOM  26107  CD2  LEU J  34     -6.379  71.777 -19.402  1.00 46.24      A  C
ATOM  26108  C    LEU J  34     -2.368  73.887 -20.528  1.00 46.02      A  C
ATOM  26109  O    LEU J  34     -2.039  74.970 -20.896  1.00 45.51      A  O
ATOM  26110  N    ALA J  35     -1.720  73.242 -19.586  1.00 46.08      A  N
ATOM  26111  CA   ALA J  35     -0.632  73.839 -18.890  1.00 47.37      A  C
ATOM  26112  CB   ALA J  35     -1.131  74.461 -17.662  1.00 47.71      A  C
ATOM  26113  C    ALA J  35      0.437  72.833 -18.569  1.00 48.36      A  C
ATOM  26114  O    ALA J  35      0.180  71.673 -18.502  1.00 49.79      A  O
ATOM  26115  N    THR J  36      1.650  73.311 -18.393  1.00 48.15      A  N
ATOM  26116  CA   THR J  36      2.794  72.482 -18.101  1.00 48.11      A  C
ATOM  26117  CB   THR J  36      4.039  73.256 -18.317  1.00 48.92      A  C
ATOM  26118  OG1  THR J  36      3.756  74.618 -18.052  1.00 51.86      A  O
ATOM  26119  CG2  THR J  36      4.460  73.143 -19.728  1.00 47.48      A  C
ATOM  26120  C    THR J  36      2.829  71.971 -16.698  1.00 47.29      A  C
ATOM  26121  O    THR J  36      2.402  72.608 -15.787  1.00 46.58      A  O
ATOM  26122  N    THR J  37      3.426  70.824 -16.528  1.00 46.69      A  N
ATOM  26123  CA   THR J  37      3.416  70.185 -15.270  1.00 45.84      A  C
ATOM  26124  CB   THR J  37      4.222  68.926 -15.355  1.00 44.70      A  C
ATOM  26125  OG1  THR J  37      3.553  67.979 -16.161  1.00 39.78      A  O
ATOM  26126  CG2  THR J  37      4.382  68.363 -14.062  1.00 44.55      A  C
ATOM  26127  C    THR J  37      4.079  71.178 -14.359  1.00 48.12      A  C
ATOM  26128  O    THR J  37      3.653  71.380 -13.254  1.00 47.97      A  O
ATOM  26129  N    GLU J  38      5.110  71.832 -14.874  1.00 49.04      J  N
ATOM  26130  CA   GLU J  38      5.909  72.795 -14.162  1.00 49.12      J  C
ATOM  26131  CB   GLU J  38      7.036  73.279 -15.063  1.00 50.10      J  C
ATOM  26132  CG   GLU J  38      7.757  74.523 -14.613  1.00 53.35      J  C
ATOM  26133  CD   GLU J  38      8.719  75.084 -15.647  1.00 57.26      J  C
ATOM  26134  OE1  GLU J  38      8.310  75.316 -16.785  1.00 59.30      J  O
ATOM  26135  OE2  GLU J  38      9.892  75.309 -15.327  1.00 57.87      J  O
ATOM  26136  C    GLU J  38      5.040  73.937 -13.774  1.00 48.64      J  C
ATOM  26137  O    GLU J  38      5.114  74.450 -12.696  1.00 48.57      J  O
ATOM  26138  N    ASP J  39      4.171  74.341 -14.653  1.00 48.59      J  N
ATOM  26139  CA   ASP J  39      3.294  75.412 -14.270  1.00 49.20      J  C
ATOM  26140  CB   ASP J  39      2.514  75.926 -15.458  1.00 49.68      J  C
ATOM  26141  CG   ASP J  39      3.135  77.122 -16.067  1.00 53.77      J  C
ATOM  26142  OD1  ASP J  39      3.768  77.904 -15.354  1.00 56.09      J  O
ATOM  26143  OD2  ASP J  39      2.992  77.282 -17.273  1.00 57.96      J  O
ATOM  26144  C    ASP J  39      2.380  75.050 -13.111  1.00 48.29      J  C
ATOM  26145  O    ASP J  39      2.169  75.865 -12.242  1.00 48.22      J  O
ATOM  26146  N    TYR J  40      1.835  73.842 -13.093  1.00 46.47      A  N
ATOM  26147  CA   TYR J  40      0.991  73.445 -11.979  1.00 45.79      A  C
ATOM  26148  CB   TYR J  40      0.304  72.099 -12.237  1.00 45.36      A  C
ATOM  26149  CG   TYR J  40     -0.617  72.042 -13.435  1.00 42.20      A  C
ATOM  26150  CD1  TYR J  40     -1.736  72.822 -13.514  1.00 39.77      A  C
ATOM  26151  CE1  TYR J  40     -2.538  72.763 -14.590  1.00 42.30      A  C
ATOM  26152  CZ   TYR J  40     -2.236  71.923 -15.605  1.00 40.96      A  C
ATOM  26153  OH   TYR J  40     -3.027  71.838 -16.698  1.00 39.14      A  O
ATOM  26154  CE2  TYR J  40     -1.143  71.146 -15.533  1.00 39.90      A  C
ATOM  26155  CD2  TYR J  40     -0.357  71.200 -14.470  1.00 37.97      A  C
```

Appendix 1

```
ATOM  26156  C    TYR J  40       1.742  73.401 -10.663  1.00 45.99      A  C
ATOM  26157  O    TYR J  40       1.251  73.783  -9.646  1.00 44.75      A  O
ATOM  26158  N    PHE J  41       2.942  72.876 -10.701  1.00 47.24      A  N
ATOM  26159  CA   PHE J  41       3.768  72.719  -9.528  1.00 47.72      A  C
ATOM  26160  CB   PHE J  41       4.959  71.862  -9.850  1.00 47.29      A  C
ATOM  26161  CG   PHE J  41       4.696  70.419  -9.705  1.00 49.99      A  C
ATOM  26162  CD1  PHE J  41       4.841  69.804  -8.507  1.00 49.58      A  C
ATOM  26163  CE1  PHE J  41       4.579  68.478  -8.382  1.00 54.75      A  C
ATOM  26164  CZ   PHE J  41       4.166  67.763  -9.447  1.00 52.38      A  C
ATOM  26165  CE2  PHE J  41       4.018  68.365 -10.638  1.00 51.21      A  C
ATOM  26166  CD2  PHE J  41       4.278  69.675 -10.770  1.00 51.16      A  C
ATOM  26167  C    PHE J  41       4.179  74.023  -8.911  1.00 48.47      A  C
ATOM  26168  O    PHE J  41       4.382  74.125  -7.730  1.00 48.49      A  O
ATOM  26169  N    ALA J  42       4.219  75.051  -9.732  1.00 49.39      A  N
ATOM  26170  CA   ALA J  42       4.667  76.359  -9.311  1.00 49.61      A  C
ATOM  26171  CB   ALA J  42       5.309  77.038 -10.445  1.00 49.22      A  C
ATOM  26172  C    ALA J  42       3.595  77.246  -8.762  1.00 49.95      A  C
ATOM  26173  O    ALA J  42       3.869  78.322  -8.326  1.00 50.82      A  O
ATOM  26174  N    GLN J  43       2.362  76.813  -8.800  1.00 49.65      A  N
ATOM  26175  CA   GLN J  43       1.305  77.704  -8.468  1.00 48.85      A  C
ATOM  26176  CB   GLN J  43      -0.064  77.043  -8.623  1.00 48.64      A  C
ATOM  26177  CG   GLN J  43      -0.253  76.253  -9.848  1.00 45.93      A  C
ATOM  26178  CD   GLN J  43      -1.622  75.666  -9.978  1.00 43.46      A  C
ATOM  26179  OE1  GLN J  43      -1.846  74.556  -9.600  1.00 40.91      A  O
ATOM  26180  NE2  GLN J  43      -2.524  76.399 -10.551  1.00 38.88      A  N
ATOM  26181  C    GLN J  43       1.504  78.159  -7.064  1.00 48.95      A  C
ATOM  26182  O    GLN J  43       1.215  79.266  -6.746  1.00 49.52      A  O
ATOM  26183  N    GLN J  44       1.976  77.303  -6.191  1.00 49.32      A  N
ATOM  26184  CA   GLN J  44       2.042  77.704  -4.807  1.00 49.77      A  C
ATOM  26185  CB   GLN J  44       2.396  76.529  -3.908  1.00 50.08      A  C
ATOM  26186  CG   GLN J  44       1.611  76.470  -2.610  1.00 52.10      A  C
ATOM  26187  CD   GLN J  44       1.980  75.300  -1.720  1.00 54.30      A  C
ATOM  26188  OE1  GLN J  44       2.424  74.277  -2.187  1.00 57.55      A  O
ATOM  26189  NE2  GLN J  44       1.781  75.451  -0.437  1.00 51.73      A  N
ATOM  26190  C    GLN J  44       2.985  78.853  -4.606  1.00 49.42      A  C
ATOM  26191  O    GLN J  44       2.702  79.761  -3.881  1.00 49.33      A  O
ATOM  26192  N    ALA J  45       4.141  78.790  -5.218  1.00 49.29      A  N
ATOM  26193  CA   ALA J  45       5.087  79.867  -5.121  1.00 49.56      A  C
ATOM  26194  CB   ALA J  45       6.363  79.440  -5.693  1.00 49.35      A  C
ATOM  26195  C    ALA J  45       4.622  81.144  -5.780  1.00 49.94      A  C
ATOM  26196  O    ALA J  45       4.811  82.211  -5.270  1.00 50.20      A  O
ATOM  26197  N    LYS J  46       4.055  81.017  -6.961  1.00 50.47      A  N
ATOM  26198  CA   LYS J  46       3.543  82.140  -7.716  1.00 50.93      A  C
ATOM  26199  CB   LYS J  46       3.183  81.709  -9.132  1.00 50.95      A  C
ATOM  26200  CG   LYS J  46       4.220  82.038 -10.169  1.00 52.36      A  C
ATOM  26201  CD   LYS J  46       3.778  81.653 -11.556  1.00 51.75      A  C
ATOM  26202  CE   LYS J  46       4.811  80.836 -12.282  1.00 51.54      A  C
ATOM  26203  NZ   LYS J  46       4.364  80.346 -13.598  1.00 49.00      A  N
ATOM  26204  C    LYS J  46       2.354  82.785  -7.019  1.00 50.68      A  C
ATOM  26205  O    LYS J  46       2.036  83.919  -7.240  1.00 49.79      A  O
ATOM  26206  N    GLN J  47       1.677  82.015  -6.202  1.00 50.49      A  N
ATOM  26207  CA   GLN J  47       0.568  82.523  -5.456  1.00 50.89      A  C
ATOM  26208  CB   GLN J  47       0.998  83.745  -4.684  1.00 50.89      A  C
ATOM  26209  CG   GLN J  47       1.850  83.393  -3.516  1.00 55.00      A  C
```

Appendix 1

```
ATOM  26210  CD   GLN J  47     1.797  84.393  -2.398  1.00  60.46     A    C
ATOM  26211  OE1  GLN J  47     2.315  85.488  -2.520  1.00  59.66     A    O
ATOM  26212  NE2  GLN J  47     1.211  84.001  -1.278  1.00  53.53     A    N
ATOM  26213  C    GLN J  47    -0.602  82.812  -6.361  1.00  50.03     A    C
ATOM  26214  O    GLN J  47    -1.473  83.551  -6.008  1.00  49.89     A    O
ATOM  26215  N    ALA J  48    -0.588  82.228  -7.544  1.00  49.03     A    N
ATOM  26216  CA   ALA J  48    -1.655  82.371  -8.493  1.00  48.17     A    C
ATOM  26217  CB   ALA J  48    -1.282  83.372  -9.514  1.00  47.53     A    C
ATOM  26218  C    ALA J  48    -1.939  81.055  -9.146  1.00  47.73     A    C
ATOM  26219  O    ALA J  48    -1.031  80.377  -9.544  1.00  48.24     A    O
ATOM  26220  N    VAL J  49    -3.200  80.694  -9.269  1.00  46.52     A    N
ATOM  26221  CA   VAL J  49    -3.518  79.478  -9.981  1.00  45.35     A    C
ATOM  26222  CB   VAL J  49    -4.897  78.904  -9.657  1.00  45.48     A    C
ATOM  26223  CG1  VAL J  49    -5.024  78.629  -8.233  1.00  44.03     A    C
ATOM  26224  CG2  VAL J  49    -5.996  79.769 -10.140  1.00  43.63     A    C
ATOM  26225  C    VAL J  49    -3.382  79.624 -11.456  1.00  44.83     A    C
ATOM  26226  O    VAL J  49    -3.533  80.685 -12.004  1.00  45.04     A    O
ATOM  26227  N    THR J  50    -3.181  78.505 -12.099  1.00  44.51     A    N
ATOM  26228  CA   THR J  50    -3.053  78.460 -13.516  1.00  46.24     A    C
ATOM  26229  CB   THR J  50    -2.915  77.046 -13.943  1.00  46.36     A    C
ATOM  26230  OG1  THR J  50    -1.735  76.507 -13.387  1.00  48.48     A    O
ATOM  26231  CG2  THR J  50    -2.772  76.988 -15.395  1.00  49.35     A    C
ATOM  26232  C    THR J  50    -4.348  78.907 -14.078  1.00  45.62     A    C
ATOM  26233  O    THR J  50    -5.332  78.805 -13.432  1.00  46.55     A    O
ATOM  26234  N    PRO J  51    -4.355  79.405 -15.292  1.00  45.40     A    N
ATOM  26235  CA   PRO J  51    -5.585  79.834 -15.932  1.00  44.88     A    C
ATOM  26236  CB   PRO J  51    -5.082  80.380 -17.253  1.00  44.01     A    C
ATOM  26237  CG   PRO J  51    -3.821  80.926 -16.942  1.00  44.59     A    C
ATOM  26238  CD   PRO J  51    -3.241  80.216 -15.769  1.00  45.85     A    C
ATOM  26239  C    PRO J  51    -6.593  78.720 -16.150  1.00  44.26     A    C
ATOM  26240  O    PRO J  51    -7.763  78.954 -16.039  1.00  44.51     A    O
ATOM  26241  N    ASP J  52    -6.145  77.535 -16.496  1.00  43.00     A    N
ATOM  26242  CA   ASP J  52    -7.047  76.437 -16.644  1.00  42.89     A    C
ATOM  26243  CB   ASP J  52    -6.420  75.270 -17.390  1.00  43.20     A    C
ATOM  26244  CG   ASP J  52    -5.363  74.588 -16.624  1.00  47.58     A    C
ATOM  26245  OD1  ASP J  52    -5.570  73.450 -16.243  1.00  46.06     A    O
ATOM  26246  OD2  ASP J  52    -4.313  75.173 -16.411  1.00  50.72     A    O-1
ATOM  26247  C    ASP J  52    -7.686  76.059 -15.333  1.00  42.39     A    C
ATOM  26248  O    ASP J  52    -8.802  75.673 -15.289  1.00  43.11     A    O
ATOM  26249  N    VAL J  53    -6.952  76.149 -14.256  1.00  41.64     A    N
ATOM  26250  CA   VAL J  53    -7.502  75.896 -12.952  1.00  40.89     A    C
ATOM  26251  CB   VAL J  53    -6.410  75.783 -11.893  1.00  40.65     A    C
ATOM  26252  CG1  VAL J  53    -6.968  75.898 -10.545  1.00  38.44     A    C
ATOM  26253  CG2  VAL J  53    -5.700  74.488 -12.036  1.00  37.32     A    C
ATOM  26254  C    VAL J  53    -8.550  76.939 -12.626  1.00  41.85     A    C
ATOM  26255  O    VAL J  53    -9.494  76.679 -11.947  1.00  42.09     A    O
ATOM  26256  N    MET J  54    -8.339  78.140 -13.108  1.00  42.44     A    N
ATOM  26257  CA   MET J  54    -9.296  79.200 -12.988  1.00  42.39     A    C
ATOM  26258  CB   MET J  54    -8.729  80.444 -13.608  1.00  42.92     J    C
ATOM  26259  CG   MET J  54    -8.623  81.558 -12.701  1.00  44.41     J    C
ATOM  26260  SD   MET J  54   -10.141  81.970 -11.975  1.00  50.41     J    S
ATOM  26261  CE   MET J  54    -9.695  82.035 -10.306  1.00  48.10     J    C
ATOM  26262  C    MET J  54   -10.557  78.894 -13.736  1.00  42.70     A    C
ATOM  26263  O    MET J  54   -11.621  79.184 -13.276  1.00  42.81     A    O
```

Appendix 1

```
ATOM  26264  N    ALA J  55     -10.414  78.358 -14.927  1.00 40.61      A N
ATOM  26265  CA   ALA J  55     -11.522  77.965 -15.745  1.00 40.06      A C
ATOM  26266  CB   ALA J  55     -11.039  77.558 -17.061  1.00 39.56      A C
ATOM  26267  C    ALA J  55     -12.337  76.870 -15.118  1.00 39.81      A C
ATOM  26268  O    ALA J  55     -13.513  76.845 -15.247  1.00 39.50      A O
ATOM  26269  N    GLN J  56     -11.683  75.943 -14.466  1.00 39.44      A N
ATOM  26270  CA   GLN J  56     -12.343  74.916 -13.722  1.00 39.80      A C
ATOM  26271  CB   GLN J  56     -11.336  73.923 -13.202  1.00 40.03      A C
ATOM  26272  CG   GLN J  56     -11.864  73.027 -12.131  1.00 40.40      A C
ATOM  26273  CD   GLN J  56     -12.747  71.985 -12.667  1.00 40.95      A C
ATOM  26274  OE1  GLN J  56     -12.767  71.761 -13.833  1.00 37.84      A O
ATOM  26275  NE2  GLN J  56     -13.496  71.357 -11.825  1.00 37.57      A N
ATOM  26276  C    GLN J  56     -13.106  75.521 -12.581  1.00 39.66      A C
ATOM  26277  O    GLN J  56     -14.174  75.135 -12.250  1.00 40.83      A O
ATOM  26278  N    LEU J  57     -12.533  76.504 -11.964  1.00 39.35      A N
ATOM  26279  CA   LEU J  57     -13.209  77.141 -10.895  1.00 38.60      A C
ATOM  26280  CB   LEU J  57     -12.328  78.214 -10.324  1.00 38.59      A C
ATOM  26281  CG   LEU J  57     -11.736  78.006  -8.945  1.00 41.21      A C
ATOM  26282  CD1  LEU J  57     -12.061  76.671  -8.387  1.00 37.68      A C
ATOM  26283  CD2  LEU J  57     -10.267  78.240  -8.946  1.00 39.71      A C
ATOM  26284  C    LEU J  57     -14.455  77.756 -11.448  1.00 38.84      A C
ATOM  26285  O    LEU J  57     -15.473  77.725 -10.833  1.00 39.03      A O
ATOM  26286  N    ALA J  58     -14.364  78.322 -12.630  1.00 37.76      A N
ATOM  26287  CA   ALA J  58     -15.492  78.915 -13.292  1.00 37.13      A C
ATOM  26288  CB   ALA J  58     -15.056  79.535 -14.505  1.00 36.45      A C
ATOM  26289  C    ALA J  58     -16.540  77.887 -13.595  1.00 37.84      A C
ATOM  26290  O    ALA J  58     -17.699  78.134 -13.493  1.00 38.42      A O
ATOM  26291  N    TYR J  59     -16.133  76.711 -13.985  1.00 37.58      A N
ATOM  26292  CA   TYR J  59     -17.111  75.725 -14.259  1.00 38.05      A C
ATOM  26293  CB   TYR J  59     -16.461  74.462 -14.736  1.00 38.42      A C
ATOM  26294  CG   TYR J  59     -17.288  73.297 -14.426  1.00 37.05      A C
ATOM  26295  CD1  TYR J  59     -18.450  73.084 -15.069  1.00 43.80      A C
ATOM  26296  CE1  TYR J  59     -19.213  72.041 -14.771  1.00 44.85      A C
ATOM  26297  CZ   TYR J  59     -18.830  71.202 -13.813  1.00 44.50      A C
ATOM  26298  OH   TYR J  59     -19.610  70.157 -13.524  1.00 45.98      A O
ATOM  26299  CE2  TYR J  59     -17.693  71.399 -13.155  1.00 42.17      A C
ATOM  26300  CD2  TYR J  59     -16.935  72.441 -13.459  1.00 40.93      A C
ATOM  26301  C    TYR J  59     -17.847  75.444 -12.978  1.00 39.03      A C
ATOM  26302  O    TYR J  59     -19.030  75.298 -12.934  1.00 38.96      A O
ATOM  26303  N    MET J  60     -17.102  75.359 -11.912  1.00 38.81      A N
ATOM  26304  CA   MET J  60     -17.672  75.070 -10.643  1.00 38.43      A C
ATOM  26305  CB   MET J  60     -16.585  74.751  -9.642  1.00 37.42      J C
ATOM  26306  CG   MET J  60     -15.825  73.517  -9.936  1.00 37.21      J C
ATOM  26307  SD   MET J  60     -14.344  73.325  -8.996  1.00 37.03      J S
ATOM  26308  CE   MET J  60     -14.930  73.002  -7.400  1.00 33.59      J C
ATOM  26309  C    MET J  60     -18.602  76.155 -10.151  1.00 38.73      A C
ATOM  26310  O    MET J  60     -19.477  75.904  -9.391  1.00 39.68      A O
ATOM  26311  N    ASN J  61     -18.381  77.380 -10.539  1.00 37.30      A N
ATOM  26312  CA   ASN J  61     -19.003  78.430  -9.815  1.00 37.22      A C
ATOM  26313  CB   ASN J  61     -17.908  79.317  -9.241  1.00 38.23      A C
ATOM  26314  CG   ASN J  61     -17.362  78.820  -7.980  1.00 37.42      A C
ATOM  26315  OD1  ASN J  61     -17.920  79.036  -6.953  1.00 35.42      A O
ATOM  26316  ND2  ASN J  61     -16.236  78.197  -8.044  1.00 36.12      A N
ATOM  26317  C    ASN J  61     -19.913  79.318 -10.584  1.00 37.55      A C
```

Appendix 1

```
ATOM  26318  O    ASN J  61    -20.766  79.916 -10.013  1.00 37.93      A  O
ATOM  26319  N    TYR J  62    -19.640  79.507 -11.856  1.00 36.44      A  N
ATOM  26320  CA   TYR J  62    -20.262  80.571 -12.609  1.00 36.16      A  C
ATOM  26321  CB   TYR J  62    -19.422  80.839 -13.842  1.00 35.96      A  C
ATOM  26322  CG   TYR J  62    -19.620  82.164 -14.465  1.00 34.94      A  C
ATOM  26323  CD1  TYR J  62    -18.627  83.089 -14.469  1.00 33.96      A  C
ATOM  26324  CE1  TYR J  62    -18.802  84.289 -15.055  1.00 37.96      A  C
ATOM  26325  CZ   TYR J  62    -19.979  84.576 -15.652  1.00 38.25      A  C
ATOM  26326  OH   TYR J  62    -20.200  85.775 -16.232  1.00 32.80      A  O
ATOM  26327  CE2  TYR J  62    -20.966  83.661 -15.658  1.00 34.49      A  C
ATOM  26328  CD2  TYR J  62    -20.780  82.474 -15.090  1.00 31.87      A  C
ATOM  26329  C    TYR J  62    -21.725  80.546 -13.000  1.00 36.68      A  C
ATOM  26330  O    TYR J  62    -22.401  81.510 -12.813  1.00 37.62      A  O
ATOM  26331  N    ILE J  63    -22.226  79.507 -13.626  1.00 36.60      A  N
ATOM  26332  CA   ILE J  63    -23.607  79.584 -14.033  1.00 36.49      A  C
ATOM  26333  CB   ILE J  63    -23.909  78.790 -15.269  1.00 35.97      A  C
ATOM  26334  CG1  ILE J  63    -22.778  78.913 -16.261  1.00 34.76      A  C
ATOM  26335  CD1  ILE J  63    -22.861  77.947 -17.364  1.00 24.59      A  C
ATOM  26336  CG2  ILE J  63    -25.113  79.334 -15.913  1.00 34.51      A  C
ATOM  26337  C    ILE J  63    -24.638  79.339 -12.955  1.00 38.46      A  C
ATOM  26338  O    ILE J  63    -24.447  78.589 -12.060  1.00 39.09      A  O
ATOM  26339  N    ASP J  64    -25.776  79.966 -13.114  1.00 40.98      A  N
ATOM  26340  CA   ASP J  64    -26.757  80.161 -12.086  1.00 43.06      A  C
ATOM  26341  CB   ASP J  64    -27.875  80.976 -12.665  1.00 44.05      A  C
ATOM  26342  CG   ASP J  64    -27.953  82.320 -12.097  1.00 47.63      A  C
ATOM  26343  OD1  ASP J  64    -27.193  82.629 -11.203  1.00 53.62      A  O
ATOM  26344  OD2  ASP J  64    -28.778  83.091 -12.564  1.00 51.29      A  O
ATOM  26345  C    ASP J  64    -27.413  79.978 -11.432  1.00 43.26      A  C
ATOM  26346  O    ASP J  64    -27.611  79.010 -10.265  1.00 46.29      A  O
ATOM  26347  N    PHE J  65    -27.837  77.950 -12.106  1.00 41.33      A  N
ATOM  26348  CA   PHE J  65    -28.431  76.943 -11.260  1.00 40.22      A  C
ATOM  26349  CB   PHE J  65    -29.903  76.851 -11.537  1.00 40.10      A  C
ATOM  26350  CG   PHE J  65    -30.621  78.121 -11.285  1.00 41.72      A  C
ATOM  26351  CD1  PHE J  65    -30.784  78.574 -10.013  1.00 41.48      A  C
ATOM  26352  CE1  PHE J  65    -31.417  79.711  -9.781  1.00 41.22      A  C
ATOM  26353  CZ   PHE J  65    -31.890  80.432 -10.809  1.00 44.72      A  C
ATOM  26354  CE2  PHE J  65    -31.733  80.002 -12.076  1.00 42.44      A  C
ATOM  26355  CD2  PHE J  65    -31.107  78.867 -12.315  1.00 39.76      A  C
ATOM  26356  C    PHE J  65    -27.765  75.627 -11.379  1.00 39.24      A  C
ATOM  26357  O    PHE J  65    -27.906  74.766 -10.563  1.00 39.09      A  O
ATOM  26358  N    ILE J  66    -27.036  75.494 -12.451  1.00 37.86      A  N
ATOM  26359  CA   ILE J  66    -26.547  74.242 -12.872  1.00 36.38      A  C
ATOM  26360  CB   ILE J  66    -26.752  74.179 -14.349  1.00 36.43      A  C
ATOM  26361  CG1  ILE J  66    -26.094  75.355 -15.010  1.00 35.93      A  C
ATOM  26362  CD1  ILE J  66    -25.925  75.177 -16.406  1.00 32.60      A  C
ATOM  26363  CG2  ILE J  66    -28.171  74.339 -14.622  1.00 33.91      A  C
ATOM  26364  C    ILE J  66    -25.123  73.934 -12.460  1.00 37.49      A  C
ATOM  26365  O    ILE J  66    -24.694  72.818 -12.526  1.00 36.89      A  O
ATOM  26366  N    SER J  67    -24.394  74.931 -12.013  1.00 37.79      A  N
ATOM  26367  CA   SER J  67    -23.069  74.715 -11.484  1.00 37.45      A  C
ATOM  26368  CB   SER J  67    -22.315  76.021 -11.405  1.00 37.46      A  C
ATOM  26369  OG   SER J  67    -22.926  76.914 -10.540  1.00 36.70      A  O
ATOM  26370  C    SER J  67    -23.121  74.019 -10.142  1.00 37.95      A  C
ATOM  26371  O    SER J  67    -24.061  74.172  -9.425  1.00 38.10      A  O
```

Appendix 1

```
ATOM  26372  N    PRO  J  68   -22.103  73.242   -9.833  1.00  37.34   A  N
ATOM  26373  CA   PRO  J  68   -22.072  72.432   -8.637  1.00  37.66   A  C
ATOM  26374  CB   PRO  J  68   -20.725  71.746   -8.724  1.00  36.86   A  C
ATOM  26375  CG   PRO  J  68   -20.274  71.926   -9.982  1.00  36.18   A  C
ATOM  26376  CD   PRO  J  68   -20.855  73.108  -10.566  1.00  37.20   A  C
ATOM  26377  C    PRO  J  68   -22.101  73.251   -7.399  1.00  38.58   A  C
ATOM  26378  O    PRO  J  68   -22.615  72.835   -6.410  1.00  40.35   A  O
ATOM  26379  N    PHE  J  69   -21.502  74.412   -7.442  1.00  39.16   A  N
ATOM  26380  CA   PHE  J  69   -21.366  75.198   -6.257  1.00  38.23   A  C
ATOM  26381  CB   PHE  J  69   -19.905  75.397   -5.903  1.00  37.68   A  C
ATOM  26382  CG   PHE  J  69   -19.238  74.133   -5.538  1.00  37.74   A  C
ATOM  26383  CD1  PHE  J  69   -19.178  73.726   -4.254  1.00  35.81   A  C
ATOM  26384  CE1  PHE  J  69   -18.613  72.584   -3.938  1.00  37.37   A  C
ATOM  26385  CZ   PHE  J  69   -18.113  71.797   -4.880  1.00  40.43   A  C
ATOM  26386  CE2  PHE  J  69   -18.179  72.160   -6.166  1.00  40.39   A  C
ATOM  26387  CD2  PHE  J  69   -18.741  73.313   -6.494  1.00  38.17   A  C
ATOM  26388  C    PHE  J  69   -22.172  76.442   -6.198  1.00  37.85   A  C
ATOM  26389  O    PHE  J  69   -21.887  77.301   -5.460  1.00  38.90   A  O
ATOM  26390  N    TYR  J  70   -23.191  76.536   -6.996  1.00  37.60   A  N
ATOM  26391  CA   TYR  J  70   -24.055  77.650   -6.912  1.00  38.03   A  C
ATOM  26392  CB   TYR  J  70   -24.999  77.604   -8.080  1.00  38.51   A  C
ATOM  26393  CG   TYR  J  70   -25.991  78.670   -8.034  1.00  41.63   A  C
ATOM  26394  CD1  TYR  J  70   -25.710  79.902   -8.516  1.00  44.39   A  C
ATOM  26395  CE1  TYR  J  70   -26.615  80.879   -8.457  1.00  43.92   A  C
ATOM  26396  CZ   TYR  J  70   -27.796  80.637   -7.910  1.00  43.60   A  C
ATOM  26397  OH   TYR  J  70   -28.696  81.623   -7.865  1.00  53.06   A  O
ATOM  26398  CE2  TYR  J  70   -28.096  79.438   -7.412  1.00  44.60   A  C
ATOM  26399  CD2  TYR  J  70   -27.207  78.461   -7.479  1.00  43.80   A  C
ATOM  26400  C    TYR  J  70   -24.808  77.697   -5.594  1.00  38.42   A  C
ATOM  26401  O    TYR  J  70   -24.943  78.725   -4.989  1.00  38.01   A  O
ATOM  26402  N    SER  J  71   -25.297  76.562   -5.139  1.00  38.39   A  N
ATOM  26403  CA   SER  J  71   -26.179  76.552   -3.997  1.00  38.52   A  C
ATOM  26404  CB   SER  J  71   -27.600  76.275   -4.449  1.00  38.35   A  C
ATOM  26405  OG   SER  J  71   -28.464  77.189   -3.871  1.00  39.92   A  O
ATOM  26406  C    SER  J  71   -25.852  75.637   -2.853  1.00  37.92   A  C
ATOM  26407  O    SER  J  71   -25.327  74.588   -3.022  1.00  37.84   A  O
ATOM  26408  N    ARG  J  72   -26.182  76.113   -1.674  1.00  38.94   A  N
ATOM  26409  CA   ARG  J  72   -26.232  75.385   -0.426  1.00  40.40   A  C
ATOM  26410  CB   ARG  J  72   -26.455  76.375    0.665  1.00  40.72   A  C
ATOM  26411  CG   ARG  J  72   -25.685  76.188    1.856  1.00  44.31   A  C
ATOM  26412  CD   ARG  J  72   -26.439  76.843    2.941  1.00  49.53   A  C
ATOM  26413  NE   ARG  J  72   -25.842  78.088    3.326  1.00  52.05   A  N
ATOM  26414  CZ   ARG  J  72   -24.705  78.157    3.972  1.00  54.74   A  C
ATOM  26415  NH1  ARG  J  72   -24.086  77.048    4.268  1.00  53.04   A  N
ATOM  26416  NH2  ARG  J  72   -24.198  79.319    4.315  1.00  55.14   A  N
ATOM  26417  C    ARG  J  72   -27.357  74.404   -0.354  1.00  40.94   A  C
ATOM  26418  O    ARG  J  72   -27.329  73.473    0.401  1.00  41.12   A  O
ATOM  26419  N    GLY  J  73   -28.369  74.652   -1.159  1.00  42.26   A  N
ATOM  26420  CA   GLY  J  73   -29.590  73.895   -1.199  1.00  42.88   A  C
ATOM  26421  C    GLY  J  73   -29.432  72.517   -1.751  1.00  44.42   A  C
ATOM  26422  O    GLY  J  73   -28.486  72.240   -2.438  1.00  43.40   A  O
ATOM  26423  N    CYS  J  74   -30.363  71.634   -1.440  1.00  45.91   A  N
ATOM  26424  CA   CYS  J  74   -30.203  70.271   -1.893  1.00  47.96   A  C
ATOM  26425  CB   CYS  J  74   -30.574  69.203   -0.824  1.00  47.52   A  C
```

Appendix 1

```
ATOM  26426  SG   CYS J  74    -29.040  68.585   0.191  1.00 56.28    A  S
ATOM  26427  C    CYS J  74    -30.727  70.116  -3.313  1.00 47.73    A  C
ATOM  26428  O    CYS J  74    -31.705  69.505  -3.589  1.00 48.43    A  O
ATOM  26429  N    SER J  75    -29.987  70.762  -4.192  1.00 47.85    A  N
ATOM  26430  CA   SER J  75    -30.171  70.813  -5.603  1.00 47.21    A  C
ATOM  26431  CB   SER J  75    -30.214  72.265  -5.992  1.00 47.16    A  C
ATOM  26432  OG   SER J  75    -30.255  72.399  -7.385  1.00 50.85    A  O
ATOM  26433  C    SER J  75    -28.959  70.172  -6.264  1.00 46.57    A  C
ATOM  26434  O    SER J  75    -27.860  70.490  -5.951  1.00 46.83    A  O
ATOM  26435  N    PHE J  76    -29.154  69.242  -7.169  1.00 44.68    A  N
ATOM  26436  CA   PHE J  76    -28.042  68.546  -7.746  1.00 42.66    A  C
ATOM  26437  CB   PHE J  76    -27.964  67.145  -7.211  1.00 42.02    A  C
ATOM  26438  CG   PHE J  76    -27.627  67.103  -5.796  1.00 41.36    A  C
ATOM  26439  CD1  PHE J  76    -26.335  67.015  -5.390  1.00 39.36    A  C
ATOM  26440  CE1  PHE J  76    -26.043  67.028  -4.086  1.00 38.41    A  C
ATOM  26441  CZ   PHE J  76    -27.031  67.132  -3.184  1.00 34.68    A  C
ATOM  26442  CE2  PHE J  76    -28.293  67.232  -3.572  1.00 33.29    A  C
ATOM  26443  CD2  PHE J  76    -28.599  67.217  -4.859  1.00 36.62    A  C
ATOM  26444  C    PHE J  76    -28.030  68.522  -9.238  1.00 42.84    A  C
ATOM  26445  O    PHE J  76    -27.613  67.570  -9.804  1.00 42.47    A  O
ATOM  26446  N    GLU J  77    -28.434  69.611  -9.848  1.00 42.18    A  N
ATOM  26447  CA   GLU J  77    -28.585  69.691 -11.273  1.00 43.12    A  C
ATOM  26448  CB   GLU J  77    -29.142  71.040 -11.674  1.00 43.67    A  C
ATOM  26449  CG   GLU J  77    -30.580  70.992 -12.069  1.00 49.27    A  C
ATOM  26450  CD   GLU J  77    -31.435  72.013 -11.354  1.00 57.80    A  C
ATOM  26451  OE1  GLU J  77    -32.061  71.673 -10.343  1.00 61.13    A  O
ATOM  26452  OE2  GLU J  77    -31.509  73.150 -11.822  1.00 56.45    A  O-1
ATOM  26453  C    GLU J  77    -27.288  69.452 -11.965  1.00 41.99    A  C
ATOM  26454  O    GLU J  77    -27.250  68.932 -13.021  1.00 42.20    A  O
ATOM  26455  N    ALA J  78    -26.211  69.855 -11.346  1.00 41.56    A  N
ATOM  26456  CA   ALA J  78    -24.911  69.754 -11.948  1.00 41.60    A  C
ATOM  26457  CB   ALA J  78    -23.929  70.404 -11.060  1.00 41.55    A  C
ATOM  26458  C    ALA J  78    -24.486  68.349 -12.201  1.00 40.90    A  C
ATOM  26459  O    ALA J  78    -23.883  68.058 -13.195  1.00 40.64    A  O
ATOM  26460  N    TRP J  79    -24.738  67.516 -11.215  1.00 40.12    A  N
ATOM  26461  CA   TRP J  79    -24.521  66.099 -11.243  1.00 39.28    A  C
ATOM  26462  CB   TRP J  79    -24.599  65.552  -9.825  1.00 38.79    A  C
ATOM  26463  CG   TRP J  79    -23.413  65.948  -9.027  1.00 39.80    A  C
ATOM  26464  CD1  TRP J  79    -22.294  65.250  -8.883  1.00 41.45    A  C
ATOM  26465  NE1  TRP J  79    -21.413  65.922  -8.116  1.00 40.88    A  N
ATOM  26466  CE2  TRP J  79    -21.966  67.107  -7.752  1.00 40.78    A  C
ATOM  26467  CD2  TRP J  79    -23.224  67.158  -8.303  1.00 40.36    A  C
ATOM  26468  CE3  TRP J  79    -24.000  68.282  -8.083  1.00 40.47    A  C
ATOM  26469  CZ3  TRP J  79    -23.510  69.255  -7.337  1.00 39.72    A  C
ATOM  26470  CH2  TRP J  79    -22.259  69.177  -6.800  1.00 40.16    A  C
ATOM  26471  CZ2  TRP J  79    -21.465  68.112  -7.001  1.00 38.60    A  C
ATOM  26472  C    TRP J  79    -25.422  65.382 -12.207  1.00 39.51    A  C
ATOM  26473  O    TRP J  79    -25.038  64.448 -12.838  1.00 39.32    A  O
ATOM  26474  N    GLU J  80    -26.652  65.830 -12.301  1.00 40.63    A  N
ATOM  26475  CA   GLU J  80    -27.606  65.261 -13.215  1.00 43.36    A  C
ATOM  26476  CB   GLU J  80    -28.956  65.932 -13.034  1.00 44.83    A  C
ATOM  26477  CG   GLU J  80    -30.029  65.116 -12.363  1.00 49.77    A  C
ATOM  26478  CD   GLU J  80    -30.793  65.861 -11.270  1.00 55.51    A  C
ATOM  26479  OE1  GLU J  80    -30.982  67.067 -11.355  1.00 53.99    A  O
```

Appendix 1

```
ATOM  26480  OE2  GLU  J  80  -31.219  65.225  -10.307  1.00  57.03  A  O-1
ATOM  26481  C    GLU  J  80  -27.151  65.458  -14.640  1.00  43.94  A  C
ATOM  26482  O    GLU  J  80  -27.269  64.587  -15.452  1.00  43.91  A  O
ATOM  26483  N    LEU  J  81  -26.644  66.632  -14.943  1.00  44.54  A  N
ATOM  26484  CA   LEU  J  81  -26.100  66.932  -16.243  1.00  46.16  A  C
ATOM  26485  CB   LEU  J  81  -25.762  68.389  -16.277  1.00  46.09  A  C
ATOM  26486  CG   LEU  J  81  -26.877  69.305  -16.688  1.00  48.40  A  C
ATOM  26487  CD1  LEU  J  81  -28.159  68.604  -16.511  1.00  48.74  A  C
ATOM  26488  CD2  LEU  J  81  -26.804  70.484  -15.819  1.00  50.46  A  C
ATOM  26489  C    LEU  J  81  -24.861  66.162  -16.644  1.00  47.33  A  C
ATOM  26490  O    LEU  J  81  -24.726  65.721  -17.746  1.00  48.12  A  O
ATOM  26491  N    LYS  J  82  -23.942  66.045  -15.716  1.00  48.24  A  N
ATOM  26492  CA   LYS  J  82  -22.753  65.263  -15.862  1.00  48.05  A  C
ATOM  26493  CB   LYS  J  82  -21.745  65.687  -14.824  1.00  48.21  A  C
ATOM  26494  CG   LYS  J  82  -20.610  66.444  -15.411  1.00  50.27  A  C
ATOM  26495  CD   LYS  J  82  -19.671  66.942  -14.353  1.00  50.38  A  C
ATOM  26496  CE   LYS  J  82  -19.653  66.038  -13.188  1.00  48.77  A  C
ATOM  26497  NZ   LYS  J  82  -19.236  66.749  -12.004  1.00  47.85  A  N
ATOM  26498  C    LYS  J  82  -23.030  63.784  -15.771  1.00  47.94  A  C
ATOM  26499  O    LYS  J  82  -22.211  62.994  -16.115  1.00  48.29  A  O
ATOM  26500  N    HIS  J  83  -24.205  63.418  -15.321  1.00  47.61  A  N
ATOM  26501  CA   HIS  J  83  -24.588  62.033  -15.293  1.00  47.74  A  C
ATOM  26502  CB   HIS  J  83  -24.280  61.409  -16.618  1.00  49.18  A  C
ATOM  26503  CG   HIS  J  83  -25.220  61.829  -17.685  1.00  54.23  A  C
ATOM  26504  ND1  HIS  J  83  -24.823  62.563  -18.772  1.00  58.19  A  N
ATOM  26505  CE1  HIS  J  83  -25.867  62.807  -19.532  1.00  59.99  A  C
ATOM  26506  NE2  HIS  J  83  -26.925  62.264  -18.972  1.00  59.73  A  N
ATOM  26507  CD2  HIS  J  83  -26.548  61.656  -17.809  1.00  57.23  A  C
ATOM  26508  C    HIS  J  83  -23.982  61.189  -14.239  1.00  46.55  A  C
ATOM  26509  O    HIS  J  83  -23.797  60.019  -14.425  1.00  46.26  A  O
ATOM  26510  N    THR  J  84  -23.701  61.789  -13.112  1.00  44.57  A  N
ATOM  26511  CA   THR  J  84  -23.153  61.067  -12.016  1.00  42.29  A  C
ATOM  26512  CB   THR  J  84  -22.736  62.026  -10.960  1.00  42.43  A  C
ATOM  26513  OG1  THR  J  84  -21.768  62.912  -11.486  1.00  42.70  A  O
ATOM  26514  CG2  THR  J  84  -22.124  61.322   -9.864  1.00  42.90  A  C
ATOM  26515  C    THR  J  84  -24.188  60.186  -11.418  1.00  40.72  A  C
ATOM  26516  O    THR  J  84  -25.278  60.607  -11.172  1.00  41.88  A  O
ATOM  26517  N    PRO  J  85  -23.825  58.960  -11.157  1.00  38.56  A  N
ATOM  26518  CA   PRO  J  85  -24.685  58.040  -10.464  1.00  37.71  A  C
ATOM  26519  CB   PRO  J  85  -23.903  56.767  -10.543  1.00  37.89  A  C
ATOM  26520  CG   PRO  J  85  -23.180  56.895  -11.728  1.00  37.72  A  C
ATOM  26521  CD   PRO  J  85  -22.715  58.257  -11.766  1.00  38.10  A  C
ATOM  26522  C    PRO  J  85  -24.776  58.467   -9.060  1.00  37.53  A  C
ATOM  26523  O    PRO  J  85  -23.862  59.040   -8.610  1.00  38.31  A  O
ATOM  26524  N    GLN  J  86  -25.860  58.199   -8.376  1.00  37.83  A  N
ATOM  26525  CA   GLN  J  86  -26.038  58.714   -7.045  1.00  36.22  A  C
ATOM  26526  CB   GLN  J  86  -27.493  58.644   -6.578  1.00  35.70  A  C
ATOM  26527  CG   GLN  J  86  -27.869  57.616   -5.556  1.00  35.25  A  C
ATOM  26528  CD   GLN  J  86  -27.120  57.686   -4.265  1.00  36.20  A  C
ATOM  26529  OE1  GLN  J  86  -27.070  58.689   -3.598  1.00  33.76  A  O
ATOM  26530  NE2  GLN  J  86  -26.552  56.595   -3.906  1.00  32.62  A  N
ATOM  26531  C    GLN  J  86  -25.025  58.207   -6.044  1.00  35.60  A  C
ATOM  26532  O    GLN  J  86  -24.623  58.905   -5.166  1.00  34.80  A  O
ATOM  26533  N    ARG  J  87  -24.583  56.990   -6.208  1.00  34.69  A  N
```

Appendix 1

```
ATOM  26534  CA   ARG J  87   -23.688  56.410  -5.255  1.00  34.45    A  C
ATOM  26535  CB   ARG J  87   -23.489  54.946  -5.554  1.00  32.94    A  C
ATOM  26536  CG   ARG J  87   -24.350  54.047  -4.740  1.00  34.56    A  C
ATOM  26537  CD   ARG J  87   -24.339  52.679  -5.314  1.00  36.31    A  C
ATOM  26538  NE   ARG J  87   -25.530  51.909  -5.052  1.00  38.77    A  N
ATOM  26539  CZ   ARG J  87   -25.919  51.533  -3.861  1.00  37.64    A  C
ATOM  26540  NH1  ARG J  87   -25.245  51.866  -2.806  1.00  35.73    A  N
ATOM  26541  NH2  ARG J  87   -26.994  50.841  -3.735  1.00  38.78    A  N
ATOM  26542  C    ARG J  87   -22.370  57.136  -5.207  1.00  34.62    A  C
ATOM  26543  O    ARG J  87   -21.634  57.050  -4.260  1.00  35.21    A  O
ATOM  26544  N    VAL J  88   -22.080  57.832  -6.274  1.00  34.04    A  N
ATOM  26545  CA   VAL J  88   -20.817  58.448  -6.468  1.00  34.15    A  C
ATOM  26546  CB   VAL J  88   -20.338  58.151  -7.885  1.00  34.92    A  C
ATOM  26547  CG1  VAL J  88   -19.459  59.197  -8.381  1.00  34.74    A  C
ATOM  26548  CG2  VAL J  88   -19.664  56.879  -7.921  1.00  34.00    A  C
ATOM  26549  C    VAL J  88   -20.868  59.922  -6.187  1.00  33.67    A  C
ATOM  26550  O    VAL J  88   -19.906  60.590  -6.279  1.00  33.48    A  O
ATOM  26551  N    ILE J  89   -22.011  60.439  -5.846  1.00  33.23    A  N
ATOM  26552  CA   ILE J  89   -22.082  61.849  -5.631  1.00  33.55    A  C
ATOM  26553  CB   ILE J  89   -23.503  62.333  -5.556  1.00  33.90    A  C
ATOM  26554  CG1  ILE J  89   -24.154  62.127  -6.883  1.00  36.39    A  C
ATOM  26555  CD1  ILE J  89   -25.467  62.689  -6.915  1.00  41.12    A  C
ATOM  26556  CG2  ILE J  89   -23.562  63.764  -5.443  1.00  32.60    A  C
ATOM  26557  C    ILE J  89   -21.236  62.308  -4.470  1.00  33.07    A  C
ATOM  26558  O    ILE J  89   -20.619  63.324  -4.552  1.00  32.61    A  O
ATOM  26559  N    LYS J  90   -21.200  61.541  -3.403  1.00  32.22    A  N
ATOM  26560  CA   LYS J  90   -20.455  61.881  -2.212  1.00  31.73    A  C
ATOM  26561  CB   LYS J  90   -20.736  60.881  -1.109  1.00  29.47    A  C
ATOM  26562  CG   LYS J  90   -20.572  59.491  -1.545  1.00  28.23    A  C
ATOM  26563  CD   LYS J  90   -20.300  58.579  -0.426  1.00  30.25    A  C
ATOM  26564  CE   LYS J  90   -21.537  57.976   0.138  1.00  37.29    A  C
ATOM  26565  NZ   LYS J  90   -22.556  57.596  -0.845  1.00  35.72    A  N
ATOM  26566  C    LYS J  90   -18.969  61.980  -2.429  1.00  32.82    A  C
ATOM  26567  O    LYS J  90   -18.330  62.807  -1.856  1.00  32.64    A  O
ATOM  26568  N    TYR J  91   -18.411  61.107  -3.229  1.00  33.72    A  N
ATOM  26569  CA   TYR J  91   -17.037  61.253  -3.590  1.00  36.36    A  C
ATOM  26570  CB   TYR J  91   -16.553  60.017  -4.288  1.00  37.67    A  C
ATOM  26571  CG   TYR J  91   -16.873  58.783  -3.532  1.00  44.10    A  C
ATOM  26572  CD1  TYR J  91   -16.442  58.610  -2.240  1.00  51.12    A  C
ATOM  26573  CE1  TYR J  91   -16.748  57.491  -1.544  1.00  53.43    A  C
ATOM  26574  CZ   TYR J  91   -17.478  56.521  -2.146  1.00  54.54    A  C
ATOM  26575  OH   TYR J  91   -17.800  55.386  -1.495  1.00  58.09    A  O
ATOM  26576  CE2  TYR J  91   -17.908  56.672  -3.411  1.00  52.15    A  C
ATOM  26577  CD2  TYR J  91   -17.613  57.794  -4.094  1.00  47.37    A  C
ATOM  26578  C    TYR J  91   -16.763  62.501  -4.404  1.00  36.39    A  C
ATOM  26579  O    TYR J  91   -15.816  63.185  -4.167  1.00  36.96    A  O
ATOM  26580  N    SER J  92   -17.626  62.815  -5.341  1.00  35.57    A  N
ATOM  26581  CA   SER J  92   -17.417  63.970  -6.161  1.00  35.37    A  C
ATOM  26582  CB   SER J  92   -18.478  64.025  -7.225  1.00  34.74    A  C
ATOM  26583  OG   SER J  92   -18.868  65.328  -7.476  1.00  36.36    A  O
ATOM  26584  C    SER J  92   -17.384  65.256  -5.366  1.00  36.10    A  C
ATOM  26585  O    SER J  92   -16.617  66.115  -5.644  1.00  36.26    A  O
ATOM  26586  N    ILE J  93   -18.249  65.398  -4.387  1.00  36.64    A  N
ATOM  26587  CA   ILE J  93   -18.233  66.548  -3.511  1.00  36.67    A  C
```

Appendix 1

```
ATOM  26588  CB   ILE J  93     -19.466  66.565  -2.613  1.00  36.04      A    C
ATOM  26589  CG1  ILE J  93     -20.704  66.770  -3.434  1.00  34.09      A    C
ATOM  26590  CD1  ILE J  93     -21.901  66.750  -2.640  1.00  32.73      A    C
ATOM  26591  CG2  ILE J  93     -19.398  67.668  -1.650  1.00  37.53      A    C
ATOM  26592  C    ILE J  93     -16.977  66.640  -2.654  1.00  37.18      A    C
ATOM  26593  O    ILE J  93     -16.445  67.689  -2.435  1.00  36.70      A    O
ATOM  26594  N    ALA J  94     -16.526  65.517  -2.148  1.00  37.63      A    N
ATOM  26595  CA   ALA J  94     -15.318  65.467  -1.385  1.00  36.91      A    C
ATOM  26596  CB   ALA J  94     -15.186  64.135  -0.826  1.00  36.79      A    C
ATOM  26597  C    ALA J  94     -14.077  65.809  -2.154  1.00  36.96      A    C
ATOM  26598  O    ALA J  94     -13.329  66.609  -1.745  1.00  37.44      A    O
ATOM  26599  N    PHE J  95     -13.866  65.217  -3.291  1.00  36.50      A    N
ATOM  26600  CA   PHE J  95     -12.696  65.532  -4.045  1.00  37.13      A    C
ATOM  26601  CB   PHE J  95     -12.561  64.606  -5.227  1.00  36.52      A    C
ATOM  26602  CG   PHE J  95     -12.365  63.213  -4.826  1.00  40.13      A    C
ATOM  26603  CD1  PHE J  95     -11.629  62.931  -3.734  1.00  45.78      A    C
ATOM  26604  CE1  PHE J  95     -11.446  61.670  -3.321  1.00  48.26      A    C
ATOM  26605  CZ   PHE J  95     -12.003  60.680  -3.993  1.00  48.33      A    C
ATOM  26606  CE2  PHE J  95     -12.732  60.941  -5.089  1.00  46.44      A    C
ATOM  26607  CD2  PHE J  95     -12.923  62.192  -5.501  1.00  41.41      A    C
ATOM  26608  C    PHE J  95     -12.679  66.970  -4.443  1.00  37.32      A    C
ATOM  26609  O    PHE J  95     -11.649  67.570  -4.539  1.00  37.63      A    O
ATOM  26610  N    TYR J  96     -13.833  67.524  -4.703  1.00  36.40      A    N
ATOM  26611  CA   TYR J  96     -13.875  68.888  -5.070  1.00  35.65      A    C
ATOM  26612  CB   TYR J  96     -15.293  69.278  -5.377  1.00  36.18      A    C
ATOM  26613  CG   TYR J  96     -15.640  69.256  -6.827  1.00  36.57      A    C
ATOM  26614  CD1  TYR J  96     -14.739  69.625  -7.769  1.00  35.35      A    C
ATOM  26615  CE1  TYR J  96     -15.041  69.614  -9.041  1.00  38.64      A    C
ATOM  26616  CZ   TYR J  96     -16.272  69.245  -9.428  1.00  41.52      A    C
ATOM  26617  OH   TYR J  96     -16.575  69.229 -10.750  1.00  38.01      A    O
ATOM  26618  CE2  TYR J  96     -17.186  68.848  -8.512  1.00  40.42      A    C
ATOM  26619  CD2  TYR J  96     -16.869  68.851  -7.237  1.00  35.42      A    C
ATOM  26620  C    TYR J  96     -13.393  69.699  -3.937  1.00  35.90      A    C
ATOM  26621  O    TYR J  96     -12.599  70.568  -4.096  1.00  36.03      A    O
ATOM  26622  N    ALA J  97     -13.889  69.387  -2.767  1.00  35.34      A    N
ATOM  26623  CA   ALA J  97     -13.558  70.084  -1.559  1.00  34.28      A    C
ATOM  26624  CB   ALA J  97     -14.411  69.570  -0.467  1.00  33.16      A    C
ATOM  26625  C    ALA J  97     -12.097  69.964  -1.182  1.00  33.95      A    C
ATOM  26626  O    ALA J  97     -11.503  70.893  -0.726  1.00  33.11      A    O
ATOM  26627  N    TYR J  98     -11.526  68.797  -1.362  1.00  33.33      A    N
ATOM  26628  CA   TYR J  98     -10.160  68.599  -1.007  1.00  33.68      A    C
ATOM  26629  CB   TYR J  98      -9.767  67.148  -1.159  1.00  34.15      A    C
ATOM  26630  CG   TYR J  98     -10.524  66.223  -0.271  1.00  32.84      A    C
ATOM  26631  CD1  TYR J  98     -11.108  66.678   0.868  1.00  33.08      A    C
ATOM  26632  CE1  TYR J  98     -11.806  65.864   1.657  1.00  34.47      A    C
ATOM  26633  CZ   TYR J  98     -11.917  64.568   1.342  1.00  34.77      A    C
ATOM  26634  OH   TYR J  98     -12.613  63.759   2.160  1.00  34.77      A    O
ATOM  26635  CE2  TYR J  98     -11.350  64.079   0.217  1.00  33.47      A    C
ATOM  26636  CD2  TYR J  98     -10.656  64.901  -0.577  1.00  33.61      A    C
ATOM  26637  C    TYR J  98      -9.331  69.496  -1.873  1.00  35.20      A    C
ATOM  26638  O    TYR J  98      -8.384  70.070  -1.437  1.00  37.03      A    O
ATOM  26639  N    GLY J  99      -9.721  69.619  -3.120  1.00  34.76      A    N
ATOM  26640  CA   GLY J  99      -9.150  70.569  -4.035  1.00  35.33      A    C
ATOM  26641  C    GLY J  99      -9.338  72.023  -3.677  1.00  36.22      A    C
```

Appendix 1

```
ATOM  26642  O    GLY J  99      -8.512  72.829  -3.933  1.00 37.58      A    O
ATOM  26643  N    LEU J 100     -10.477  72.362  -3.140  1.00 36.35      A    N
ATOM  26644  CA   LEU J 100     -10.787  73.708  -2.787  1.00 36.43      A    C
ATOM  26645  CB   LEU J 100     -12.227  73.794  -2.326  1.00 36.59      A    C
ATOM  26646  CG   LEU J 100     -13.337  74.345  -3.207  1.00 37.92      A    C
ATOM  26647  CD1  LEU J 100     -12.887  74.674  -4.575  1.00 35.35      A    C
ATOM  26648  CD2  LEU J 100     -14.457  73.379  -3.241  1.00 38.48      A    C
ATOM  26649  C    LEU J 100      -9.863  74.187  -1.711  1.00 36.43      A    C
ATOM  26650  O    LEU J 100      -9.506  75.335  -1.658  1.00 33.79      A    O
ATOM  26651  N    ALA J 101      -9.509  73.281  -0.827  1.00 36.89      A    N
ATOM  26652  CA   ALA J 101      -8.604  73.569   0.256  1.00 38.87      A    C
ATOM  26653  CB   ALA J 101      -8.596  72.448   1.241  1.00 38.26      A    C
ATOM  26654  C    ALA J 101      -7.197  73.918  -0.188  1.00 39.52      A    C
ATOM  26655  O    ALA J 101      -6.575  74.784   0.350  1.00 38.99      A    O
ATOM  26656  N    SER J 102      -6.701  73.237  -1.183  1.00 39.48      A    N
ATOM  26657  CA   SER J 102      -5.442  73.587  -1.745  1.00 42.00      A    C
ATOM  26658  CB   SER J 102      -5.009  72.550  -2.736  1.00 41.71      A    C
ATOM  26659  OG   SER J 102      -5.022  71.302  -2.143  1.00 44.62      A    O
ATOM  26660  C    SER J 102      -5.482  74.955  -2.378  1.00 43.23      A    C
ATOM  26661  O    SER J 102      -4.555  75.709  -2.310  1.00 43.54      A    O
ATOM  26662  N    VAL J 103      -6.574  75.282  -3.003  1.00 44.08      A    N
ATOM  26663  CA   VAL J 103      -6.687  76.569  -3.609  1.00 44.84      A    C
ATOM  26664  CB   VAL J 103      -7.965  76.659  -4.418  1.00 44.96      A    C
ATOM  26665  CG1  VAL J 103      -8.158  78.025  -4.977  1.00 42.18      A    C
ATOM  26666  CG2  VAL J 103      -7.946  75.645  -5.507  1.00 43.86      A    C
ATOM  26667  C    VAL J 103      -6.579  77.656  -2.556  1.00 45.78      A    C
ATOM  26668  O    VAL J 103      -6.000  78.671  -2.788  1.00 46.16      A    O
ATOM  26669  N    ALA J 104      -7.131  77.433  -1.389  1.00 47.77      A    N
ATOM  26670  CA   ALA J 104      -7.058  78.411  -0.343  1.00 49.06      A    C
ATOM  26671  CB   ALA J 104      -7.800  77.929   0.812  1.00 48.66      A    C
ATOM  26672  C    ALA J 104      -5.610  78.621   0.028  1.00 50.48      A    C
ATOM  26673  O    ALA J 104      -5.174  79.712   0.282  1.00 51.80      A    O
ATOM  26674  N    LEU J 105      -4.880  77.538   0.094  1.00 51.25      A    N
ATOM  26675  CA   LEU J 105      -3.467  77.581   0.307  1.00 52.18      A    C
ATOM  26676  CB   LEU J 105      -2.980  76.151   0.453  1.00 52.96      A    C
ATOM  26677  CG   LEU J 105      -2.036  75.833   1.576  1.00 54.22      A    C
ATOM  26678  CD1  LEU J 105      -2.064  76.959   2.488  1.00 57.16      A    C
ATOM  26679  CD2  LEU J 105      -2.507  74.661   2.261  1.00 54.21      A    C
ATOM  26680  C    LEU J 105      -2.698  78.249  -0.816  1.00 52.54      A    C
ATOM  26681  O    LEU J 105      -1.814  79.012  -0.580  1.00 51.96      A    O
ATOM  26682  N    ILE J 106      -2.994  77.906  -2.047  1.00 52.64      A    N
ATOM  26683  CA   ILE J 106      -2.255  78.477  -3.126  1.00 53.01      A    C
ATOM  26684  CB   ILE J 106      -2.736  77.912  -4.427  1.00 52.82      A    C
ATOM  26685  CG1  ILE J 106      -2.091  76.579  -4.701  1.00 54.18      A    C
ATOM  26686  CD1  ILE J 106      -2.580  75.958  -5.915  1.00 51.20      A    C
ATOM  26687  CG2  ILE J 106      -2.393  78.832  -5.531  1.00 52.94      A    C
ATOM  26688  C    ILE J 106      -2.410  79.967  -3.284  1.00 53.74      A    C
ATOM  26689  O    ILE J 106      -1.436  80.670  -3.396  1.00 54.82      A    O
ATOM  26690  N    ASP J 107      -3.630  80.455  -3.338  1.00 52.99      A    N
ATOM  26691  CA   ASP J 107      -3.810  81.870  -3.502  1.00 52.75      A    C
ATOM  26692  CB   ASP J 107      -4.343  82.156  -4.874  1.00 52.68      A    C
ATOM  26693  CG   ASP J 107      -4.706  83.560  -5.029  1.00 53.52      A    C
ATOM  26694  OD1  ASP J 107      -4.687  84.242  -4.006  1.00 53.41      A    O
ATOM  26695  OD2  ASP J 107      -4.983  83.980  -6.149  1.00 54.25      A    O-1
```

Appendix 1

```
ATOM  26696  C    ASP J 107    -4.714  82.520  -2.489  1.00 52.44    A  C
ATOM  26697  O    ASP J 107    -5.892  82.333  -2.479  1.00 53.08    A  O
ATOM  26698  N    PRO J 108    -4.132  83.344  -1.665  1.00 52.18    A  N
ATOM  26699  CA   PRO J 108    -4.799  83.934  -0.527  1.00 52.24    A  C
ATOM  26700  CB   PRO J 108    -3.690  84.727   0.114  1.00 52.08    A  C
ATOM  26701  CG   PRO J 108    -2.490  84.188  -0.425  1.00 52.57    A  C
ATOM  26702  CD   PRO J 108    -2.757  83.801  -1.769  1.00 51.95    A  C
ATOM  26703  C    PRO J 108    -5.904  84.842  -0.989  1.00 52.03    A  C
ATOM  26704  O    PRO J 108    -6.818  85.145  -0.265  1.00 51.93    A  O
ATOM  26705  N    LYS J 109    -5.765  85.300  -2.215  1.00 51.12    A  N
ATOM  26706  CA   LYS J 109    -6.746  86.129  -2.862  1.00 50.31    A  C
ATOM  26707  CB   LYS J 109    -6.171  86.759  -4.121  1.00 50.31    A  C
ATOM  26708  CG   LYS J 109    -5.417  88.044  -3.830  1.00 54.18    A  C
ATOM  26709  CD   LYS J 109    -4.771  88.685  -5.057  1.00 61.08    A  C
ATOM  26710  CE   LYS J 109    -4.793  87.797  -6.292  1.00 61.71    A  C
ATOM  26711  NZ   LYS J 109    -4.214  88.446  -7.486  1.00 60.25    A  N
ATOM  26712  C    LYS J 109    -8.020  85.337  -3.103  1.00 48.90    A  C
ATOM  26713  O    LYS J 109    -9.094  85.868  -3.128  1.00 48.40    A  O
ATOM  26714  N    LEU J 110    -7.881  84.044  -3.270  1.00 46.93    A  N
ATOM  26715  CA   LEU J 110    -9.006  83.205  -3.535  1.00 45.77    A  C
ATOM  26716  CB   LEU J 110    -8.668  82.232  -4.642  1.00 44.61    A  C
ATOM  26717  CG   LEU J 110    -8.666  82.798  -6.039  1.00 44.59    A  C
ATOM  26718  CD1  LEU J 110    -8.249  81.792  -6.994  1.00 39.01    A  C
ATOM  26719  CD2  LEU J 110    -9.981  83.318  -6.403  1.00 41.17    A  C
ATOM  26720  C    LEU J 110    -9.441  82.452  -2.314  1.00 45.29    A  C
ATOM  26721  O    LEU J 110   -10.145  81.512  -2.405  1.00 44.89    A  O
ATOM  26722  N    ARG J 111    -8.961  82.829  -1.161  1.00 44.96    A  N
ATOM  26723  CA   ARG J 111    -9.232  82.035   0.008  1.00 44.81    A  C
ATOM  26724  CB   ARG J 111    -8.367  82.474   1.183  1.00 44.72    A  C
ATOM  26725  CG   ARG J 111    -8.648  81.752   2.468  1.00 46.52    A  C
ATOM  26726  CD   ARG J 111    -7.400  81.483   3.210  1.00 49.40    A  C
ATOM  26727  NE   ARG J 111    -7.600  80.870   4.503  1.00 48.67    A  N
ATOM  26728  CZ   ARG J 111    -6.618  80.618   5.345  1.00 50.51    A  C
ATOM  26729  NH1  ARG J 111    -5.395  80.944   5.022  1.00 53.18    A  N
ATOM  26730  NH2  ARG J 111    -6.855  80.059   6.497  1.00 47.53    A  N
ATOM  26731  C    ARG J 111   -10.668  82.021   0.392  1.00 43.64    A  C
ATOM  26732  O    ARG J 111   -11.175  81.033   0.802  1.00 43.37    A  O
ATOM  26733  N    ALA J 112   -11.292  83.170   0.307  1.00 43.71    A  N
ATOM  26734  CA   ALA J 112   -12.668  83.358   0.667  1.00 43.12    A  C
ATOM  26735  CB   ALA J 112   -12.969  84.784   0.607  1.00 42.98    A  C
ATOM  26736  C    ALA J 112   -13.623  82.598  -0.216  1.00 43.09    A  C
ATOM  26737  O    ALA J 112   -14.595  82.049   0.221  1.00 42.41    A  O
ATOM  26738  N    LEU J 113   -13.331  82.594  -1.487  1.00 42.69    A  N
ATOM  26739  CA   LEU J 113   -14.155  81.925  -2.423  1.00 41.91    A  C
ATOM  26740  CB   LEU J 113   -13.559  82.095  -3.782  1.00 41.89    A  C
ATOM  26741  CG   LEU J 113   -14.332  81.504  -4.924  1.00 42.90    A  C
ATOM  26742  CD1  LEU J 113   -15.605  82.219  -5.114  1.00 43.18    A  C
ATOM  26743  CD2  LEU J 113   -13.520  81.559  -6.134  1.00 38.93    A  C
ATOM  26744  C    LEU J 113   -14.125  80.498  -2.065  1.00 41.97    A  C
ATOM  26745  O    LEU J 113   -15.102  79.814  -2.114  1.00 42.21    A  O
ATOM  26746  N    ALA J 114   -12.956  80.043  -1.710  1.00 41.95    A  N
ATOM  26747  CA   ALA J 114   -12.747  78.673  -1.372  1.00 41.15    A  C
ATOM  26748  CB   ALA J 114   -11.329  78.472  -1.072  1.00 41.19    A  C
ATOM  26749  C    ALA J 114   -13.543  78.339  -0.178  1.00 41.11    A  C
```

Appendix 1

```
ATOM  26750  O    ALA J 114     -14.098  77.302  -0.085  1.00  40.99    A  O
ATOM  26751  N    GLY J 115     -13.535  79.214   0.785  1.00  40.87    A  N
ATOM  26752  CA   GLY J 115     -14.246  78.961   1.997  1.00  41.75    A  C
ATOM  26753  C    GLY J 115     -15.721  78.879   1.778  1.00  42.73    A  C
ATOM  26754  O    GLY J 115     -16.382  78.112   2.399  1.00  43.59    A  O
ATOM  26755  N    HIS J 116     -16.218  79.727   0.914  1.00  42.38    A  N
ATOM  26756  CA   HIS J 116     -17.589  79.743   0.539  1.00  42.66    A  C
ATOM  26757  CB   HIS J 116     -17.782  80.938  -0.363  1.00  43.41    A  C
ATOM  26758  CG   HIS J 116     -19.070  80.943  -1.094  1.00  47.29    A  C
ATOM  26759  ND1  HIS J 116     -20.274  81.077  -0.461  1.00  48.77    A  N
ATOM  26760  CE1  HIS J 116     -21.236  81.049  -1.352  1.00  47.74    A  C
ATOM  26761  NE2  HIS J 116     -20.697  80.893  -2.538  1.00  47.80    A  N
ATOM  26762  CD2  HIS J 116     -19.343  80.838  -2.407  1.00  48.26    A  C
ATOM  26763  C    HIS J 116     -18.004  78.465  -0.157  1.00  41.66    A  C
ATOM  26764  O    HIS J 116     -19.037  77.938   0.099  1.00  42.65    A  O
ATOM  26765  N    ASP J 117     -17.188  77.960  -1.042  1.00  40.22    A  N
ATOM  26766  CA   ASP J 117     -17.447  76.686  -1.662  1.00  39.86    A  C
ATOM  26767  CB   ASP J 117     -16.481  76.425  -2.797  1.00  39.96    A  C
ATOM  26768  CG   ASP J 117     -16.806  77.195  -3.989  1.00  41.77    A  C
ATOM  26769  OD1  ASP J 117     -17.752  77.934  -3.940  1.00  44.97    A  O
ATOM  26770  OD2  ASP J 117     -16.125  77.098  -4.978  1.00  44.21    A  O-1
ATOM  26771  C    ASP J 117     -17.422  75.526  -0.692  1.00  40.01    A  C
ATOM  26772  O    ASP J 117     -18.131  74.574  -0.847  1.00  40.39    A  O
ATOM  26773  N    LEU J 118     -16.538  75.583   0.277  1.00  39.76    A  N
ATOM  26774  CA   LEU J 118     -16.449  74.552   1.264  1.00  39.49    A  C
ATOM  26775  CB   LEU J 118     -15.255  74.775   2.149  1.00  40.01    A  C
ATOM  26776  CG   LEU J 118     -14.057  73.845   2.096  1.00  40.12    A  C
ATOM  26777  CD1  LEU J 118     -14.324  72.545   1.481  1.00  36.36    A  C
ATOM  26778  CD2  LEU J 118     -12.920  74.499   1.441  1.00  40.51    A  C
ATOM  26779  C    LEU J 118     -17.710  74.528   2.065  1.00  39.57    A  C
ATOM  26780  O    LEU J 118     -18.158  73.511   2.487  1.00  39.72    A  O
ATOM  26781  N    ASP J 119     -18.267  75.686   2.294  1.00  39.21    A  N
ATOM  26782  CA   ASP J 119     -19.498  75.800   2.999  1.00  40.23    A  C
ATOM  26783  CB   ASP J 119     -19.820  77.267   3.116  1.00  40.43    A  C
ATOM  26784  CG   ASP J 119     -20.818  77.574   4.181  1.00  46.54    A  C
ATOM  26785  OD1  ASP J 119     -21.188  76.702   4.970  1.00  46.65    A  O
ATOM  26786  OD2  ASP J 119     -21.230  78.724   4.239  1.00  50.69    A  O-1
ATOM  26787  C    ASP J 119     -20.577  75.120   2.208  1.00  40.04    A  C
ATOM  26788  O    ASP J 119     -21.337  74.361   2.726  1.00  39.31    A  O
ATOM  26789  N    ILE J 120     -20.630  75.399   0.929  1.00  39.22    A  N
ATOM  26790  CA   ILE J 120     -21.595  74.779   0.070  1.00  38.19    A  C
ATOM  26791  CB   ILE J 120     -21.617  75.391  -1.326  1.00  38.50    A  C
ATOM  26792  CG1  ILE J 120     -22.454  76.651  -1.327  1.00  36.58    A  C
ATOM  26793  CD1  ILE J 120     -22.065  77.650  -2.306  1.00  35.62    A  C
ATOM  26794  CG2  ILE J 120     -22.222  74.454  -2.280  1.00  35.32    A  C
ATOM  26795  C    ILE J 120     -21.378  73.301  -0.001  1.00  37.81    A  C
ATOM  26796  O    ILE J 120     -22.306  72.564   0.008  1.00  39.52    A  O
ATOM  26797  N    ALA J 121     -20.150  72.861  -0.057  1.00  36.58    A  N
ATOM  26798  CA   ALA J 121     -19.889  71.442  -0.115  1.00  36.47    A  C
ATOM  26799  CB   ALA J 121     -18.449  71.201  -0.333  1.00  35.95    A  C
ATOM  26800  C    ALA J 121     -20.354  70.665   1.094  1.00  36.17    A  C
ATOM  26801  O    ALA J 121     -20.859  69.592   0.988  1.00  35.29    A  O
ATOM  26802  N    VAL J 122     -20.141  71.207   2.257  1.00  36.25    A  N
ATOM  26803  CA   VAL J 122     -20.563  70.542   3.434  1.00  37.00    A  C
```

Appendix 1

```
ATOM  26804  CB   VAL J 122   -20.031  71.274   4.659  1.00  38.22    A  C
ATOM  26805  CG1  VAL J 122   -20.634  70.740   5.912  1.00  36.35    A  C
ATOM  26806  CG2  VAL J 122   -18.549  71.179   4.706  1.00  36.37    A  C
ATOM  26807  C    VAL J 122   -22.061  70.381   3.535  1.00  36.97    A  C
ATOM  26808  O    VAL J 122   -22.514  69.348   3.927  1.00  36.70    A  O
ATOM  26809  N    SER J 123   -22.833  71.404   3.224  1.00  37.03    A  N
ATOM  26810  CA   SER J 123   -24.274  71.252   3.246  1.00  37.39    A  C
ATOM  26811  CB   SER J 123   -25.004  72.572   3.220  1.00  37.75    A  C
ATOM  26812  OG   SER J 123   -24.285  73.535   2.544  1.00  43.76    A  O
ATOM  26813  C    SER J 123   -24.831  70.316   2.216  1.00  36.25    A  C
ATOM  26814  O    SER J 123   -25.650  69.517   2.512  1.00  35.76    A  O
ATOM  26815  N    LYS J 124   -24.338  70.377   1.010  1.00  34.64    A  N
ATOM  26816  CA   LYS J 124   -24.826  69.502  -0.001  1.00  35.11    A  C
ATOM  26817  CB   LYS J 124   -24.179  69.830  -1.323  1.00  34.98    A  C
ATOM  26818  CG   LYS J 124   -24.998  70.703  -2.195  1.00  35.70    A  C
ATOM  26819  CD   LYS J 124   -24.229  71.138  -3.383  1.00  38.07    A  C
ATOM  26820  CE   LYS J 124   -25.114  71.393  -4.538  1.00  34.77    A  C
ATOM  26821  NZ   LYS J 124   -26.130  72.338  -4.181  1.00  35.96    A  N
ATOM  26822  C    LYS J 124   -24.582  68.071   0.365  1.00  35.68    A  C
ATOM  26823  O    LYS J 124   -25.358  67.217   0.074  1.00  36.55    A  O
ATOM  26824  N    MET J 125   -23.464  67.821   0.994  1.00  36.07    A  N
ATOM  26825  CA   MET J 125   -23.094  66.512   1.469  1.00  36.65    A  C
ATOM  26826  CB   MET J 125   -21.634  66.492   1.870  1.00  35.88    J  C
ATOM  26827  CG   MET J 125   -21.107  65.169   2.175  1.00  33.08    J  C
ATOM  26828  SD   MET J 125   -20.202  64.469   0.875  1.00  34.79    J  S
ATOM  26829  CE   MET J 125   -19.279  63.292   1.695  1.00  33.15    J  C
ATOM  26830  C    MET J 125   -24.006  65.943   2.554  1.00  37.72    A  C
ATOM  26831  O    MET J 125   -24.190  64.767   2.665  1.00  38.12    A  O
ATOM  26832  N    LYS J 126   -24.595  66.796   3.347  1.00  38.29    A  N
ATOM  26833  CA   LYS J 126   -25.581  66.352   4.288  1.00  39.36    A  C
ATOM  26834  CB   LYS J 126   -25.694  67.357   5.402  1.00  39.26    A  C
ATOM  26835  CG   LYS J 126   -24.755  67.102   6.482  1.00  40.71    A  C
ATOM  26836  CD   LYS J 126   -23.944  68.273   6.751  1.00  44.04    A  C
ATOM  26837  CE   LYS J 126   -24.753  69.345   7.351  1.00  46.50    A  C
ATOM  26838  NZ   LYS J 126   -24.842  69.202   8.790  1.00  48.31    A  N
ATOM  26839  C    LYS J 126   -26.947  66.053   3.679  1.00  40.06    A  C
ATOM  26840  O    LYS J 126   -27.764  65.425   4.286  1.00  38.77    A  O
ATOM  26841  N    CYS J 127   -27.170  66.482   2.453  1.00  40.71    A  N
ATOM  26842  CA   CYS J 127   -28.418  66.240   1.763  1.00  41.28    A  C
ATOM  26843  CB   CYS J 127   -28.415  66.921   0.412  1.00  41.56    A  C
ATOM  26844  SG   CYS J 127   -28.832  68.607   0.361  1.00  47.11    A  S
ATOM  26845  C    CYS J 127   -28.577  64.773   1.564  1.00  40.09    A  C
ATOM  26846  O    CYS J 127   -27.632  64.108   1.345  1.00  40.89    A  O
ATOM  26847  N    LYS J 128   -29.792  64.283   1.649  1.00  39.82    A  N
ATOM  26848  CA   LYS J 128   -30.098  62.864   1.562  1.00  39.87    A  C
ATOM  26849  CB   LYS J 128   -31.520  62.616   2.001  1.00  40.76    A  C
ATOM  26850  CG   LYS J 128   -31.910  61.196   1.990  1.00  44.91    A  C
ATOM  26851  CD   LYS J 128   -32.947  60.922   3.025  1.00  52.33    A  C
ATOM  26852  CE   LYS J 128   -34.112  60.183   2.453  1.00  53.99    A  C
ATOM  26853  NZ   LYS J 128   -34.742  59.362   3.470  1.00  56.42    A  N
ATOM  26854  C    LYS J 128   -29.822  62.208   0.222  1.00  38.48    A  C
ATOM  26855  O    LYS J 128   -29.519  61.055   0.140  1.00  37.80    A  O
ATOM  26856  N    ARG J 129   -29.909  62.979  -0.827  1.00  37.50    A  N
ATOM  26857  CA   ARG J 129   -29.633  62.484  -2.128  1.00  38.15    A  C
```

Appendix 1

```
ATOM  26858  CB   ARG J 129   -29.776  63.623  -3.112  1.00 38.47    A    C
ATOM  26859  CG   ARG J 129   -29.336  63.354  -4.524  1.00 41.36    A    C
ATOM  26860  CD   ARG J 129   -30.208  62.378  -5.252  1.00 41.26    A    C
ATOM  26861  NE   ARG J 129   -29.613  61.941  -6.492  1.00 44.08    A    N
ATOM  26862  CZ   ARG J 129   -29.916  60.807  -7.080  1.00 43.68    A    C
ATOM  26863  NH1  ARG J 129   -30.802  60.023  -6.541  1.00 41.79    A    N
ATOM  26864  NH2  ARG J 129   -29.346  60.462  -8.200  1.00 41.55    A    N
ATOM  26865  C    ARG J 129   -28.219  61.990  -2.110  1.00 38.93    A    C
ATOM  26866  O    ARG J 129   -27.885  60.985  -2.694  1.00 38.98    A    O
ATOM  26867  N    VAL J 130   -27.363  62.716  -1.441  1.00 38.67    A    N
ATOM  26868  CA   VAL J 130   -26.026  62.247  -1.263  1.00 38.02    A    C
ATOM  26869  CB   VAL J 130   -25.169  63.325  -0.718  1.00 38.58    A    C
ATOM  26870  CG1  VAL J 130   -23.791  62.839  -0.551  1.00 37.46    A    C
ATOM  26871  CG2  VAL J 130   -25.207  64.470  -1.610  1.00 37.40    A    C
ATOM  26872  C    VAL J 130   -25.839  61.014  -0.425  1.00 39.40    A    C
ATOM  26873  O    VAL J 130   -25.092  60.167  -0.800  1.00 40.76    A    O
ATOM  26874  N    TRP J 131   -26.463  60.921   0.734  1.00 38.73    A    N
ATOM  26875  CA   TRP J 131   -26.247  59.772   1.607  1.00 39.32    A    C
ATOM  26876  CB   TRP J 131   -25.998  60.208   3.048  1.00 39.15    A    C
ATOM  26877  CG   TRP J 131   -27.141  60.907   3.707  1.00 41.10    A    C
ATOM  26878  CD1  TRP J 131   -27.283  62.208   3.851  1.00 39.59    A    C
ATOM  26879  NE1  TRP J 131   -28.436  62.498   4.460  1.00 40.42    A    N
ATOM  26880  CE2  TRP J 131   -29.071  61.341   4.769  1.00 39.45    A    C
ATOM  26881  CD2  TRP J 131   -28.285  60.316   4.296  1.00 39.62    A    C
ATOM  26882  CE3  TRP J 131   -28.707  59.016   4.484  1.00 38.81    A    C
ATOM  26883  CZ3  TRP J 131   -29.868  58.810   5.107  1.00 40.58    A    C
ATOM  26884  CH2  TRP J 131   -30.632  59.857   5.575  1.00 39.59    A    C
ATOM  26885  CZ2  TRP J 131   -30.248  61.128   5.412  1.00 39.64    A    C
ATOM  26886  C    TRP J 131   -27.249  58.616   1.575  1.00 41.12    A    C
ATOM  26887  O    TRP J 131   -27.053  57.612   2.227  1.00 41.64    A    O
ATOM  26888  N    GLY J 132   -28.298  58.739   0.778  1.00 41.58    A    N
ATOM  26889  CA   GLY J 132   -29.483  57.911   0.855  1.00 39.92    A    C
ATOM  26890  C    GLY J 132   -29.381  56.439   0.593  1.00 39.41    A    C
ATOM  26891  O    GLY J 132   -30.233  55.692   0.950  1.00 39.99    A    O
ATOM  26892  N    ASP J 133   -28.335  56.041  -0.073  1.00 38.70    A    N
ATOM  26893  CA   ASP J 133   -28.161  54.676  -0.463  1.00 38.96    A    C
ATOM  26894  CB   ASP J 133   -26.919  54.529  -1.317  1.00 38.19    A    C
ATOM  26895  CG   ASP J 133   -25.705  55.195  -0.714  1.00 43.76    A    C
ATOM  26896  OD1  ASP J 133   -24.846  54.486  -0.182  1.00 47.09    A    O
ATOM  26897  OD2  ASP J 133   -25.575  56.419  -0.784  1.00 48.15    A    O-1
ATOM  26898  C    ASP J 133   -28.078  53.833   0.765  1.00 39.13    A    C
ATOM  26899  O    ASP J 133   -28.455  52.698   0.766  1.00 39.15    A    O
ATOM  26900  N    TRP J 134   -27.592  54.417   1.835  1.00 39.33    A    N
ATOM  26901  CA   TRP J 134   -27.463  53.707   3.079  1.00 39.92    A    C
ATOM  26902  CB   TRP J 134   -26.820  54.653   4.101  1.00 39.21    A    C
ATOM  26903  CG   TRP J 134   -26.656  54.103   5.466  1.00 36.72    A    C
ATOM  26904  CD1  TRP J 134   -27.400  54.389   6.532  1.00 35.99    A    C
ATOM  26905  NE1  TRP J 134   -26.972  53.703   7.606  1.00 36.50    A    N
ATOM  26906  CE2  TRP J 134   -25.902  52.952   7.242  1.00 34.46    A    C
ATOM  26907  CD2  TRP J 134   -25.676  53.187   5.902  1.00 33.09    A    C
ATOM  26908  CE3  TRP J 134   -24.624  52.542   5.288  1.00 30.94    A    C
ATOM  26909  CZ3  TRP J 134   -23.873  51.717   6.009  1.00 30.99    A    C
ATOM  26910  CH2  TRP J 134   -24.115  51.498   7.335  1.00 29.68    A    C
ATOM  26911  CZ2  TRP J 134   -25.124  52.106   7.976  1.00 31.79    A    C
```

Appendix 1

```
ATOM  26912  C    TRP J 134     -28.794  53.238   3.600  1.00 40.26      A  C
ATOM  26913  O    TRP J 134     -28.939  52.113   3.976  1.00 39.81      A  O
ATOM  26914  N    GLU J 135     -29.768  54.115   3.623  1.00 40.92      A  N
ATOM  26915  CA   GLU J 135     -31.131  53.735   3.911  1.00 43.20      A  C
ATOM  26916  CB   GLU J 135     -31.968  54.966   4.219  1.00 43.59      A  C
ATOM  26917  CG   GLU J 135     -33.373  54.843   3.804  1.00 48.11      A  C
ATOM  26918  CD   GLU J 135     -34.288  55.599   4.671  1.00 53.20      A  C
ATOM  26919  OE1  GLU J 135     -34.058  56.776   4.910  1.00 53.18      A  O
ATOM  26920  OE2  GLU J 135     -35.268  55.012   5.101  1.00 56.13      A  O-1
ATOM  26921  C    GLU J 135     -31.792  52.854   2.859  1.00 43.10      A  C
ATOM  26922  O    GLU J 135     -32.444  51.896   3.178  1.00 43.65      A  O
ATOM  26923  N    GLU J 136     -31.578  53.165   1.598  1.00 43.00      A  N
ATOM  26924  CA   GLU J 136     -32.189  52.420   0.530  1.00 44.60      A  C
ATOM  26925  CB   GLU J 136     -31.825  52.997  -0.833  1.00 46.28      A  C
ATOM  26926  CG   GLU J 136     -32.503  54.288  -1.264  1.00 51.59      A  C
ATOM  26927  CD   GLU J 136     -32.159  54.698  -2.708  1.00 63.26      A  C
ATOM  26928  OE1  GLU J 136     -31.169  55.420  -2.950  1.00 62.82      A  O
ATOM  26929  OE2  GLU J 136     -32.902  54.308  -3.626  1.00 66.41      A  O-1
ATOM  26930  C    GLU J 136     -31.744  50.983   0.574  1.00 44.55      A  C
ATOM  26931  O    GLU J 136     -32.491  50.114   0.243  1.00 45.17      A  O
ATOM  26932  N    ASP J 137     -30.516  50.731   0.988  1.00 44.55      A  N
ATOM  26933  CA   ASP J 137     -29.966  49.393   1.055  1.00 44.62      A  C
ATOM  26934  CB   ASP J 137     -28.449  49.410   1.063  1.00 45.02      A  C
ATOM  26935  CG   ASP J 137     -27.847  49.898  -0.218  1.00 46.71      A  C
ATOM  26936  OD1  ASP J 137     -28.455  49.839  -1.269  1.00 47.66      A  O
ATOM  26937  OD2  ASP J 137     -26.720  50.344  -0.177  1.00 53.68      A  O-1
ATOM  26938  C    ASP J 137     -30.418  48.659   2.278  1.00 44.64      A  C
ATOM  26939  O    ASP J 137     -30.168  47.501   2.422  1.00 45.31      A  O
ATOM  26940  N    GLY J 138     -31.097  49.335   3.165  1.00 44.31      A  N
ATOM  26941  CA   GLY J 138     -31.528  48.696   4.378  1.00 45.03      A  C
ATOM  26942  C    GLY J 138     -30.605  48.788   5.564  1.00 45.96      A  C
ATOM  26943  O    GLY J 138     -30.873  48.226   6.582  1.00 46.18      A  O
ATOM  26944  N    PHE J 139     -29.495  49.474   5.441  1.00 45.62      A  N
ATOM  26945  CA   PHE J 139     -28.630  49.620   6.584  1.00 45.61      A  C
ATOM  26946  CB   PHE J 139     -27.251  50.018   6.129  1.00 44.70      A  C
ATOM  26947  CG   PHE J 139     -26.644  49.075   5.187  1.00 41.45      A  C
ATOM  26948  CD1  PHE J 139     -26.482  47.780   5.508  1.00 37.21      A  C
ATOM  26949  CE1  PHE J 139     -25.918  46.938   4.635  1.00 40.50      A  C
ATOM  26950  CZ   PHE J 139     -25.495  47.378   3.432  1.00 38.33      A  C
ATOM  26951  CE2  PHE J 139     -25.628  48.643   3.108  1.00 37.50      A  C
ATOM  26952  CD2  PHE J 139     -26.197  49.499   3.973  1.00 41.82      A  C
ATOM  26953  C    PHE J 139     -29.061  50.472   7.783  1.00 45.98      A  C
ATOM  26954  O    PHE J 139     -28.836  50.092   8.888  1.00 46.75      A  O
ATOM  26955  N    GLY J 140     -29.587  51.653   7.562  1.00 45.75      A  N
ATOM  26956  CA   GLY J 140     -30.106  52.439   8.646  1.00 46.55      A  C
ATOM  26957  C    GLY J 140     -30.836  53.663   8.194  1.00 46.98      A  C
ATOM  26958  O    GLY J 140     -30.703  54.044   7.071  1.00 46.61      A  O
ATOM  26959  N    THR J 141     -31.603  54.287   9.071  1.00 46.93      A  N
ATOM  26960  CA   THR J 141     -32.122  55.621   8.807  1.00 46.99      A  C
ATOM  26961  CB   THR J 141     -33.380  55.995   9.592  1.00 47.27      A  C
ATOM  26962  OG1  THR J 141     -33.182  55.813  10.991  1.00 46.72      A  O
ATOM  26963  CG2  THR J 141     -34.524  55.166   9.119  1.00 44.48      A  C
ATOM  26964  C    THR J 141     -31.072  56.669   8.917  1.00 46.98      A  C
ATOM  26965  O    THR J 141     -31.166  57.706   8.311  1.00 47.52      A  O
```

Appendix 1

```
ATOM  26966  N    ASP J 142    -30.080  56.391   9.740  1.00 47.11      A  N
ATOM  26967  CA   ASP J 142    -29.068  57.369  10.052  1.00 47.16      A  C
ATOM  26968  CB   ASP J 142    -28.983  57.525  11.543  1.00 47.98      A  C
ATOM  26969  CG   ASP J 142    -28.066  58.601  11.944  1.00 49.27      A  C
ATOM  26970  OD1  ASP J 142    -28.078  59.639  11.317  1.00 53.41      A  O
ATOM  26971  OD2  ASP J 142    -27.325  58.424  12.885  1.00 52.12      A  O-1
ATOM  26972  C    ASP J 142    -27.709  56.993   9.559  1.00 45.93      A  C
ATOM  26973  O    ASP J 142    -27.123  56.042  10.021  1.00 44.48      A  O
ATOM  26974  N    PRO J 143    -27.211  57.806   8.645  1.00 44.83      A  N
ATOM  26975  CA   PRO J 143    -25.942  57.609   7.978  1.00 44.55      A  C
ATOM  26976  CB   PRO J 143    -25.894  58.790   7.030  1.00 43.94      A  C
ATOM  26977  CG   PRO J 143    -26.781  59.731   7.560  1.00 44.26      A  C
ATOM  26978  CD   PRO J 143    -27.879  58.992   8.134  1.00 44.74      A  C
ATOM  26979  C    PRO J 143    -24.740  57.632   8.869  1.00 43.78      A  C
ATOM  26980  O    PRO J 143    -23.862  56.873   8.614  1.00 43.16      A  O
ATOM  26981  N    ILE J 144    -24.673  58.506   9.850  1.00 44.79      A  N
ATOM  26982  CA   ILE J 144    -23.490  58.597  10.674  1.00 46.10      A  C
ATOM  26983  CB   ILE J 144    -23.093  60.056  10.970  1.00 45.87      A  C
ATOM  26984  CG1  ILE J 144    -23.691  60.527  12.285  1.00 43.34      A  C
ATOM  26985  CD1  ILE J 144    -23.655  61.948  12.438  1.00 42.47      A  C
ATOM  26986  CG2  ILE J 144    -23.481  60.935   9.835  1.00 43.87      A  C
ATOM  26987  C    ILE J 144    -23.478  57.763  11.939  1.00 47.95      A  C
ATOM  26988  O    ILE J 144    -22.463  57.598  12.553  1.00 47.96      A  O
ATOM  26989  N    GLU J 145    -24.598  57.192  12.300  1.00 50.01      A  N
ATOM  26990  CA   GLU J 145    -24.697  56.527  13.564  1.00 51.80      A  C
ATOM  26991  CB   GLU J 145    -26.105  56.010  13.726  1.00 53.33      A  C
ATOM  26992  CG   GLU J 145    -26.351  55.208  14.976  1.00 58.88      A  C
ATOM  26993  CD   GLU J 145    -27.767  54.793  15.101  1.00 66.13      A  C
ATOM  26994  OE1  GLU J 145    -28.099  53.679  14.670  1.00 67.79      A  O
ATOM  26995  OE2  GLU J 145    -28.561  55.588  15.609  1.00 68.46      A  O-1
ATOM  26996  C    GLU J 145    -23.752  55.379  13.727  1.00 51.59      A  C
ATOM  26997  O    GLU J 145    -23.171  55.224  14.768  1.00 51.95      A  O
ATOM  26998  N    LYS J 146    -23.611  54.537  12.730  1.00 51.28      A  N
ATOM  26999  CA   LYS J 146    -22.657  53.461  12.852  1.00 51.16      A  C
ATOM  27000  CB   LYS J 146    -23.314  52.223  13.409  1.00 51.59      A  C
ATOM  27001  CG   LYS J 146    -24.642  51.910  12.824  1.00 53.86      A  C
ATOM  27002  CD   LYS J 146    -25.126  50.557  13.285  1.00 59.95      A  C
ATOM  27003  CE   LYS J 146    -26.096  49.937  12.300  1.00 63.09      A  C
ATOM  27004  NZ   LYS J 146    -25.948  48.474  12.166  1.00 64.38      A  N
ATOM  27005  C    LYS J 146    -22.071  53.144  11.536  1.00 49.85      A  C
ATOM  27006  O    LYS J 146    -22.696  53.346  10.545  1.00 51.18      A  O
ATOM  27007  N    GLU J 147    -20.852  52.665  11.516  1.00 47.94      A  N
ATOM  27008  CA   GLU J 147    -20.283  52.157  10.298  1.00 46.82      A  C
ATOM  27009  CB   GLU J 147    -21.152  51.049   9.754  1.00 47.37      A  C
ATOM  27010  CG   GLU J 147    -20.887  49.710  10.348  1.00 49.45      A  C
ATOM  27011  CD   GLU J 147    -22.117  48.887  10.448  1.00 53.85      A  C
ATOM  27012  OE1  GLU J 147    -23.178  49.459  10.509  1.00 57.46      A  O
ATOM  27013  OE2  GLU J 147    -22.047  47.668  10.468  1.00 55.70      A  O-1
ATOM  27014  C    GLU J 147    -20.200  53.248   9.282  1.00 45.52      A  C
ATOM  27015  O    GLU J 147    -20.129  54.397   9.618  1.00 45.94      A  O
ATOM  27016  N    ASN J 148    -20.271  52.893   8.018  1.00 43.49      A  N
ATOM  27017  CA   ASN J 148    -20.367  53.895   6.994  1.00 41.30      A  C
ATOM  27018  CB   ASN J 148    -21.707  54.616   7.124  1.00 40.54      A  C
ATOM  27019  CG   ASN J 148    -22.192  55.208   5.835  1.00 35.12      A  C
```

Appendix 1

```
ATOM  27020  OD1  ASN  J  148   -21.788  54.813   4.796  1.00  35.72  A  O
ATOM  27021  ND2  ASN  J  148   -23.068  56.145   5.919  1.00  23.49  A  N
ATOM  27022  C    ASN  J  148   -19.261  54.907   7.001  1.00  40.85  A  C
ATOM  27023  O    ASN  J  148   -19.517  56.064   6.903  1.00  41.30  A  O
ATOM  27024  N    ILE  J  149   -18.018  54.504   7.089  1.00  40.82  A  N
ATOM  27025  CA   ILE  J  149   -16.991  55.529   6.985  1.00  41.73  A  C
ATOM  27026  CB   ILE  J  149   -15.645  55.210   7.619  1.00  41.84  A  C
ATOM  27027  CG1  ILE  J  149   -15.297  53.766   7.416  1.00  41.56  A  C
ATOM  27028  CD1  ILE  J  149   -14.835  53.487   6.099  1.00  44.27  A  C
ATOM  27029  CG2  ILE  J  149   -15.654  55.598   9.060  1.00  40.44  A  C
ATOM  27030  C    ILE  J  149   -16.783  56.096   5.613  1.00  41.94  A  C
ATOM  27031  O    ILE  J  149   -16.205  57.125   5.478  1.00  42.35  A  O
ATOM  27032  N    MET  J  150   -17.297  55.450   4.591  1.00  43.11  A  N
ATOM  27033  CA   MET  J  150   -17.146  56.029   3.286  1.00  44.10  A  C
ATOM  27034  CB   MET  J  150   -17.750  55.125   2.223  1.00  44.14  J  C
ATOM  27035  CG   MET  J  150   -18.909  54.320   2.730  1.00  49.51  J  C
ATOM  27036  SD   MET  J  150   -19.895  53.459   1.518  1.00  54.79  J  S
ATOM  27037  CE   MET  J  150   -21.289  54.502   1.421  1.00  56.89  J  C
ATOM  27038  C    MET  J  150   -17.839  57.350   3.268  1.00  42.18  A  C
ATOM  27039  O    MET  J  150   -17.308  58.309   2.822  1.00  43.18  A  O
ATOM  27040  N    TYR  J  151   -19.047  57.420   3.733  1.00  40.28  A  N
ATOM  27041  CA   TYR  J  151   -19.616  58.723   3.843  1.00  38.25  A  C
ATOM  27042  CB   TYR  J  151   -21.094  58.532   4.060  1.00  37.76  A  C
ATOM  27043  CG   TYR  J  151   -21.821  59.776   4.279  1.00  31.51  A  C
ATOM  27044  CD1  TYR  J  151   -21.973  60.671   3.273  1.00  29.45  A  C
ATOM  27045  CE1  TYR  J  151   -22.618  61.798   3.463  1.00  32.39  A  C
ATOM  27046  CZ   TYR  J  151   -23.148  62.050   4.658  1.00  33.48  A  C
ATOM  27047  OH   TYR  J  151   -23.822  63.198   4.849  1.00  35.89  A  O
ATOM  27048  CE2  TYR  J  151   -23.020  61.171   5.660  1.00  31.27  A  C
ATOM  27049  CD2  TYR  J  151   -22.362  60.053   5.473  1.00  26.33  A  C
ATOM  27050  C    TYR  J  151   -19.090  59.594   4.954  1.00  37.71  A  C
ATOM  27051  O    TYR  J  151   -18.696  60.711   4.771  1.00  37.20  A  O
ATOM  27052  N    LYS  J  152   -19.168  59.061   6.144  1.00  37.32  A  N
ATOM  27053  CA   LYS  J  152   -18.881  59.792   7.331  1.00  36.93  A  C
ATOM  27054  CB   LYS  J  152   -19.523  59.157   8.558  1.00  37.57  A  C
ATOM  27055  CG   LYS  J  152   -18.749  58.149   9.345  1.00  41.46  A  C
ATOM  27056  CD   LYS  J  152   -19.557  57.775  10.555  1.00  45.63  A  C
ATOM  27057  CE   LYS  J  152   -19.550  56.306  10.859  1.00  44.67  A  C
ATOM  27058  NZ   LYS  J  152   -19.902  56.060  12.260  1.00  42.46  A  N
ATOM  27059  C    LYS  J  152   -17.448  60.208   7.464  1.00  36.22  A  C
ATOM  27060  O    LYS  J  152   -17.170  61.233   8.006  1.00  35.96  A  O
ATOM  27061  N    GLY  J  153   -16.535  59.422   6.947  1.00  34.96  A  N
ATOM  27062  CA   GLY  J  153   -15.172  59.846   6.978  1.00  35.83  A  C
ATOM  27063  C    GLY  J  153   -14.937  61.082   6.169  1.00  36.57  A  C
ATOM  27064  O    GLY  J  153   -14.261  61.971   6.578  1.00  36.65  A  O
ATOM  27065  N    HIS  J  154   -15.480  61.141   4.985  1.00  36.43  A  N
ATOM  27066  CA   HIS  J  154   -15.247  62.297   4.182  1.00  35.48  A  C
ATOM  27067  CB   HIS  J  154   -15.779  62.102   2.783  1.00  34.70  A  C
ATOM  27068  CG   HIS  J  154   -15.044  61.082   1.987  1.00  37.83  A  C
ATOM  27069  ND1  HIS  J  154   -13.898  61.364   1.297  1.00  39.71  A  N
ATOM  27070  CE1  HIS  J  154   -13.485  60.289   0.669  1.00  41.97  A  C
ATOM  27071  NE2  HIS  J  154   -14.323  59.315   0.930  1.00  41.83  A  N
ATOM  27072  CD2  HIS  J  154   -15.311  59.788   1.745  1.00  39.20  A  C
ATOM  27073  C    HIS  J  154   -15.836  63.512   4.785  1.00  34.79  A  C
```

Appendix 1

```
ATOM  27074  O    HIS  J 154    -15.257  64.523   4.755  1.00 36.26    A  O
ATOM  27075  N    LEU  J 155    -17.018  63.415   5.319  1.00 35.17    A  N
ATOM  27076  CA   LEU  J 155    -17.671  64.560   5.883  1.00 36.24    A  C
ATOM  27077  CB   LEU  J 155    -19.072  64.193   6.302  1.00 36.44    A  C
ATOM  27078  CG   LEU  J 155    -19.963  65.173   7.022  1.00 35.21    A  C
ATOM  27079  CD1  LEU  J 155    -20.067  66.452   6.351  1.00 29.52    A  C
ATOM  27080  CD2  LEU  J 155    -21.269  64.578   7.191  1.00 39.81    A  C
ATOM  27081  C    LEU  J 155    -16.930  65.123   7.047  1.00 37.91    A  C
ATOM  27082  O    LEU  J 155    -16.884  66.294   7.242  1.00 38.15    A  O
ATOM  27083  N    ASN  J 156    -16.368  64.254   7.844  1.00 39.35    A  N
ATOM  27084  CA   ASN  J 156    -15.578  64.684   8.931  1.00 40.93    A  C
ATOM  27085  CB   ASN  J 156    -15.182  63.509   9.767  1.00 41.12    A  C
ATOM  27086  CG   ASN  J 156    -14.877  63.910  11.124  1.00 44.94    A  C
ATOM  27087  OD1  ASN  J 156    -15.618  64.660  11.704  1.00 43.80    A  O
ATOM  27088  ND2  ASN  J 156    -13.762  63.469  11.640  1.00 47.15    A  N
ATOM  27089  C    ASN  J 156    -14.368  65.430   8.470  1.00 40.93    A  C
ATOM  27090  O    ASN  J 156    -14.011  66.414   9.026  1.00 41.79    A  O
ATOM  27091  N    LEU  J 157    -13.736  64.953   7.433  1.00 40.01    A  N
ATOM  27092  CA   LEU  J 157    -12.605  65.621   6.902  1.00 39.82    A  C
ATOM  27093  CB   LEU  J 157    -11.996  64.779   5.813  1.00 39.51    A  C
ATOM  27094  CG   LEU  J 157    -10.616  65.132   5.332  1.00 39.88    A  C
ATOM  27095  CD1  LEU  J 157     -9.778  65.477   6.460  1.00 44.28    A  C
ATOM  27096  CD2  LEU  J 157    -10.065  63.979   4.705  1.00 39.13    A  C
ATOM  27097  C    LEU  J 157    -13.012  66.977   6.383  1.00 40.91    A  C
ATOM  27098  O    LEU  J 157    -12.312  67.937   6.525  1.00 41.94    A  O
ATOM  27099  N    MET  J 158    -14.148  67.036   5.737  1.00 41.16    A  N
ATOM  27100  CA   MET  J 158    -14.634  68.265   5.187  1.00 41.18    A  C
ATOM  27101  CB   MET  J 158    -15.825  67.997   4.294  1.00 42.17    J  C
ATOM  27102  CG   MET  J 158    -15.570  66.988   3.207  1.00 42.29    J  C
ATOM  27103  SD   MET  J 158    -17.003  66.411   2.307  1.00 38.72    J  S
ATOM  27104  CE   MET  J 158    -17.539  67.895   1.589  1.00 32.34    J  C
ATOM  27105  C    MET  J 158    -14.950  69.292   6.253  1.00 41.39    A  C
ATOM  27106  O    MET  J 158    -14.737  70.451   6.067  1.00 41.31    A  O
ATOM  27107  N    TYR  J 159    -15.475  68.850   7.373  1.00 40.95    A  N
ATOM  27108  CA   TYR  J 159    -15.826  69.743   8.436  1.00 40.45    A  C
ATOM  27109  CB   TYR  J 159    -16.346  68.944   9.596  1.00 40.30    A  C
ATOM  27110  CG   TYR  J 159    -17.805  68.632   9.608  1.00 39.15    A  C
ATOM  27111  CD1  TYR  J 159    -18.728  69.484   9.086  1.00 39.48    A  C
ATOM  27112  CE1  TYR  J 159    -20.021  69.187   9.130  1.00 39.03    A  C
ATOM  27113  CZ   TYR  J 159    -20.416  68.041   9.706  1.00 39.41    A  C
ATOM  27114  OH   TYR  J 159    -21.718  67.698   9.756  1.00 43.35    A  O
ATOM  27115  CE2  TYR  J 159    -19.529  67.202  10.237  1.00 39.64    A  C
ATOM  27116  CD2  TYR  J 159    -18.249  67.490  10.189  1.00 39.38    A  C
ATOM  27117  C    TYR  J 159    -14.599  70.414   8.933  1.00 40.78    A  C
ATOM  27118  O    TYR  J 159    -14.611  71.559   9.243  1.00 40.99    A  O
ATOM  27119  N    GLY  J 160    -13.562  69.644   9.130  1.00 40.94    A  N
ATOM  27120  CA   GLY  J 160    -12.339  70.158   9.659  1.00 41.30    A  C
ATOM  27121  C    GLY  J 160    -11.723  71.066   8.677  1.00 42.51    A  C
ATOM  27122  O    GLY  J 160    -11.195  72.102   8.987  1.00 43.57    A  O
ATOM  27123  N    LEU  J 161    -11.772  70.630   7.449  1.00 42.04    A  N
ATOM  27124  CA   LEU  J 161    -11.172  71.365   6.380  1.00 41.70    A  C
ATOM  27125  CB   LEU  J 161    -11.344  70.575   5.108  1.00 42.54    A  C
ATOM  27126  CG   LEU  J 161    -10.051  70.116   4.516  1.00 44.42    A  C
ATOM  27127  CD1  LEU  J 161     -9.040  70.106   5.556  1.00 48.97    A  C
```

Appendix 1

```
ATOM  27128  CD2  LEU J 161   -10.195  68.782   3.953  1.00  48.97   A  C
ATOM  27129  C    LEU J 161   -11.828  72.701   6.231  1.00  40.61   A  C
ATOM  27130  O    LEU J 161   -11.187  73.675   5.965  1.00  40.25   A  O
ATOM  27131  N    TYR J 162   -13.131  72.732   6.383  1.00  40.43   A  N
ATOM  27132  CA   TYR J 162   -13.849  73.963   6.302  1.00  40.51   A  C
ATOM  27133  CB   TYR J 162   -15.335  73.693   6.337  1.00  40.38   A  C
ATOM  27134  CG   TYR J 162   -16.129  74.921   6.553  1.00  39.13   A  C
ATOM  27135  CD1  TYR J 162   -16.258  75.845   5.582  1.00  38.91   A  C
ATOM  27136  CE1  TYR J 162   -16.940  76.957   5.788  1.00  44.22   A  C
ATOM  27137  CZ   TYR J 162   -17.536  77.164   6.969  1.00  44.55   A  C
ATOM  27138  OH   TYR J 162   -18.245  78.286   7.172  1.00  47.88   A  O
ATOM  27139  CE2  TYR J 162   -17.423  76.270   7.954  1.00  44.00   A  C
ATOM  27140  CD2  TYR J 162   -16.732  75.157   7.742  1.00  43.64   A  C
ATOM  27141  C    TYR J 162   -13.492  74.938   7.386  1.00  41.33   A  C
ATOM  27142  O    TYR J 162   -13.325  76.098   7.137  1.00  42.11   A  O
ATOM  27143  N    GLN J 163   -13.378  74.470   8.608  1.00  41.93   A  N
ATOM  27144  CA   GLN J 163   -12.996  75.357   9.670  1.00  42.21   A  C
ATOM  27145  CB   GLN J 163   -13.159  74.731  11.015  1.00  42.30   A  C
ATOM  27146  CG   GLN J 163   -13.616  75.727  11.996  1.00  42.49   A  C
ATOM  27147  CD   GLN J 163   -13.528  75.230  13.370  1.00  46.68   A  C
ATOM  27148  OE1  GLN J 163   -14.114  74.227  13.695  1.00  46.86   A  O
ATOM  27149  NE2  GLN J 163   -12.788  75.919  14.199  1.00  47.85   A  N
ATOM  27150  C    GLN J 163   -11.621  75.908   9.517  1.00  42.67   A  C
ATOM  27151  O    GLN J 163   -11.363  77.045   9.850  1.00  42.53   A  O
ATOM  27152  N    LEU J 164   -10.746  75.061   9.023  1.00  43.33   A  N
ATOM  27153  CA   LEU J 164    -9.357  75.352   8.860  1.00  43.34   A  C
ATOM  27154  CB   LEU J 164    -8.718  74.119   8.296  1.00  43.28   A  C
ATOM  27155  CG   LEU J 164    -7.410  73.550   8.781  1.00  43.03   A  C
ATOM  27156  CD1  LEU J 164    -7.043  74.030  10.079  1.00  40.19   A  C
ATOM  27157  CD2  LEU J 164    -7.517  72.102   8.811  1.00  41.81   A  C
ATOM  27158  C    LEU J 164    -9.165  76.473   7.890  1.00  45.17   A  C
ATOM  27159  O    LEU J 164    -8.387  77.376   8.116  1.00  44.80   A  O
ATOM  27160  N    VAL J 165    -9.841  76.361   6.758  1.00  46.32   A  N
ATOM  27161  CA   VAL J 165    -9.872  77.407   5.750  1.00  46.34   A  C
ATOM  27162  CB   VAL J 165   -10.488  76.966   4.410  1.00  46.00   A  C
ATOM  27163  CG1  VAL J 165   -10.669  78.123   3.510  1.00  42.75   A  C
ATOM  27164  CG2  VAL J 165    -9.607  75.995   3.725  1.00  44.20   A  C
ATOM  27165  C    VAL J 165   -10.580  78.579   6.331  1.00  47.66   A  C
ATOM  27166  O    VAL J 165   -10.228  79.699   6.116  1.00  47.67   A  O
ATOM  27167  N    THR J 166   -11.595  78.299   7.095  1.00  49.36   A  N
ATOM  27168  CA   THR J 166   -12.289  79.360   7.755  1.00  51.40   A  C
ATOM  27169  CB   THR J 166   -13.780  79.450   7.403  1.00  51.88   A  C
ATOM  27170  OG1  THR J 166   -14.495  78.418   8.067  1.00  49.20   A  O
ATOM  27171  CG2  THR J 166   -14.013  79.343   5.931  1.00  52.81   A  C
ATOM  27172  C    THR J 166   -12.152  79.188   9.246  1.00  53.20   A  C
ATOM  27173  O    THR J 166   -11.895  78.104   9.788  1.00  52.25   A  O
ATOM  27174  N    GLY J 167   -12.329  80.301   9.901  1.00  54.24   A  N
ATOM  27175  CA   GLY J 167   -12.268  80.314  11.314  1.00  55.63   A  C
ATOM  27176  C    GLY J 167   -13.668  80.022  11.657  1.00  56.14   A  C
ATOM  27177  O    GLY J 167   -14.047  80.125  12.790  1.00  57.12   A  O
ATOM  27178  N    SER J 168   -14.458  79.658  10.675  1.00  55.75   A  N
ATOM  27179  CA   SER J 168   -15.850  79.518  10.962  1.00  55.94   A  C
ATOM  27180  CB   SER J 168   -16.663  79.458   9.697  1.00  55.97   A  C
ATOM  27181  OG   SER J 168   -18.024  79.481  10.018  1.00  56.78   A  O
```

Appendix 1

```
ATOM  27182  C    SER J 168   -16.104  78.324  11.828  1.00  56.13   A  C
ATOM  27183  O    SER J 168   -15.556  77.277  11.623  1.00  55.87   A  O
ATOM  27184  N    ARG J 169   -16.977  78.488  12.791  1.00  56.59   A  N
ATOM  27185  CA   ARG J 169   -17.323  77.409  13.675  1.00  57.77   A  C
ATOM  27186  CB   ARG J 169   -16.955  77.763  15.099  1.00  58.52   A  C
ATOM  27187  CG   ARG J 169   -16.979  79.236  15.374  1.00  62.41   A  C
ATOM  27188  CD   ARG J 169   -16.339  79.585  16.707  1.00  65.51   A  C
ATOM  27189  NE   ARG J 169   -15.508  78.508  17.197  1.00  68.05   A  N
ATOM  27190  CZ   ARG J 169   -14.188  78.532  17.225  1.00  68.35   A  C
ATOM  27191  NH1  ARG J 169   -13.549  79.590  16.792  1.00  68.19   A  N
ATOM  27192  NH2  ARG J 169   -13.515  77.492  17.686  1.00  65.85   A  N
ATOM  27193  C    ARG J 169   -18.774  77.015  13.596  1.00  57.15   A  C
ATOM  27194  O    ARG J 169   -19.326  76.610  14.570  1.00  57.53   A  O
ATOM  27195  N    ARG J 170   -19.398  77.188  12.444  1.00  56.87   A  N
ATOM  27196  CA   ARG J 170   -20.803  76.849  12.250  1.00  55.94   A  C
ATOM  27197  CB   ARG J 170   -21.338  77.332  10.939  1.00  56.44   A  C
ATOM  27198  CG   ARG J 170   -20.340  77.314   9.880  1.00  59.16   A  C
ATOM  27199  CD   ARG J 170   -20.985  77.072   8.578  1.00  61.17   A  C
ATOM  27200  NE   ARG J 170   -22.422  76.965   8.663  1.00  62.43   A  N
ATOM  27201  CZ   ARG J 170   -23.255  77.841   8.133  1.00  63.42   A  C
ATOM  27202  NH1  ARG J 170   -22.790  78.904   7.536  1.00  63.12   A  N
ATOM  27203  NH2  ARG J 170   -24.549  77.668   8.228  1.00  63.10   A  N
ATOM  27204  C    ARG J 170   -21.057  75.399  12.353  1.00  54.56   A  C
ATOM  27205  O    ARG J 170   -22.106  74.992  12.766  1.00  53.78   A  O
ATOM  27206  N    TYR J 171   -20.087  74.624  11.932  1.00  53.44   A  N
ATOM  27207  CA   TYR J 171   -20.221  73.201  11.925  1.00  53.02   A  C
ATOM  27208  CB   TYR J 171   -19.737  72.619  10.603  1.00  52.98   A  C
ATOM  27209  CG   TYR J 171   -20.444  73.123   9.377  1.00  49.91   A  C
ATOM  27210  CD1  TYR J 171   -21.791  73.080   9.277  1.00  49.24   A  C
ATOM  27211  CE1  TYR J 171   -22.416  73.534   8.187  1.00  49.44   A  C
ATOM  27212  CZ   TYR J 171   -21.707  74.022   7.160  1.00  49.53   A  C
ATOM  27213  OH   TYR J 171   -22.337  74.491   6.053  1.00  46.45   A  O
ATOM  27214  CE2  TYR J 171   -20.368  74.073   7.234  1.00  49.27   A  C
ATOM  27215  CD2  TYR J 171   -19.748  73.626   8.326  1.00  48.60   A  C
ATOM  27216  C    TYR J 171   -19.474  72.570  13.069  1.00  53.39   A  C
ATOM  27217  O    TYR J 171   -19.236  71.397  13.058  1.00  53.95   A  O
ATOM  27218  N    GLU J 172   -19.068  73.367  14.032  1.00  53.15   A  N
ATOM  27219  CA   GLU J 172   -18.216  72.899  15.099  1.00  53.92   A  C
ATOM  27220  CB   GLU J 172   -17.740  74.068  15.965  1.00  54.87   A  C
ATOM  27221  CG   GLU J 172   -16.473  73.796  16.771  1.00  58.51   A  C
ATOM  27222  CD   GLU J 172   -15.872  75.019  17.454  1.00  61.73   A  C
ATOM  27223  OE1  GLU J 172   -14.802  75.474  17.048  1.00  61.75   A  O
ATOM  27224  OE2  GLU J 172   -16.444  75.523  18.419  1.00  62.13   A  O-1
ATOM  27225  C    GLU J 172   -18.843  71.842  15.967  1.00  53.30   A  C
ATOM  27226  O    GLU J 172   -18.181  70.936  16.402  1.00  52.74   A  O
ATOM  27227  N    ALA J 173   -20.108  71.979  16.282  1.00  53.31   A  N
ATOM  27228  CA   ALA J 173   -20.775  70.946  17.060  1.00  53.48   A  C
ATOM  27229  CB   ALA J 173   -22.107  71.407  17.522  1.00  52.32   A  C
ATOM  27230  C    ALA J 173   -20.899  69.627  16.318  1.00  54.01   A  C
ATOM  27231  O    ALA J 173   -20.676  68.575  16.875  1.00  54.60   A  O
ATOM  27232  N    GLU J 174   -21.263  69.692  15.054  1.00  52.82   A  N
ATOM  27233  CA   GLU J 174   -21.333  68.512  14.247  1.00  52.20   A  C
ATOM  27234  CB   GLU J 174   -21.879  68.840  12.872  1.00  53.31   A  C
ATOM  27235  CG   GLU J 174   -23.345  69.107  12.845  1.00  57.55   A  C
```

Appendix 1

```
ATOM  27236  CD   GLU J 174   -23.707  70.215  11.920  1.00  63.79   A  C
ATOM  27237  OE1  GLU J 174   -22.852  71.039  11.652  1.00  65.19   A  O
ATOM  27238  OE2  GLU J 174   -24.844  70.280  11.455  1.00  66.17   A  O-1
ATOM  27239  C    GLU J 174   -19.974  67.899  14.122  1.00  50.68   A  C
ATOM  27240  O    GLU J 174   -19.857  66.714  14.197  1.00  51.79   A  O
ATOM  27241  N    HIS J 175   -18.945  68.708  13.939  1.00  48.18   A  N
ATOM  27242  CA   HIS J 175   -17.600  68.188  13.797  1.00  46.28   A  C
ATOM  27243  CB   HIS J 175   -16.620  69.315  13.532  1.00  44.86   A  C
ATOM  27244  CG   HIS J 175   -15.295  68.856  13.015  1.00  40.58   A  C
ATOM  27245  ND1  HIS J 175   -14.241  69.705  12.833  1.00  36.47   A  N
ATOM  27246  CE1  HIS J 175   -13.215  69.037  12.362  1.00  36.02   A  C
ATOM  27247  NE2  HIS J 175   -13.559  67.778  12.249  1.00  34.00   A  N
ATOM  27248  CD2  HIS J 175   -14.854  67.639  12.657  1.00  36.32   A  C
ATOM  27249  C    HIS J 175   -17.129  67.425  15.010  1.00  46.78   A  C
ATOM  27250  O    HIS J 175   -16.541  66.391  14.871  1.00  45.93   A  O
ATOM  27251  N    ALA J 176   -17.378  67.933  16.202  1.00  47.37   A  N
ATOM  27252  CA   ALA J 176   -16.977  67.217  17.396  1.00  47.77   A  C
ATOM  27253  CB   ALA J 176   -17.220  68.041  18.581  1.00  47.15   A  C
ATOM  27254  C    ALA J 176   -17.686  65.916  17.556  1.00  47.80   A  C
ATOM  27255  O    ALA J 176   -17.085  64.907  17.827  1.00  48.18   A  O
ATOM  27256  N    HIS J 177   -18.985  65.946  17.380  1.00  48.30   A  N
ATOM  27257  CA   HIS J 177   -19.804  64.804  17.645  1.00  47.78   A  C
ATOM  27258  CB   HIS J 177   -21.246  65.215  17.391  1.00  48.14   A  C
ATOM  27259  CG   HIS J 177   -22.239  64.109  17.506  1.00  51.18   A  C
ATOM  27260  ND1  HIS J 177   -22.957  63.652  16.432  1.00  53.39   A  N
ATOM  27261  CE1  HIS J 177   -23.750  62.682  16.814  1.00  53.86   A  C
ATOM  27262  NE2  HIS J 177   -23.591  62.510  18.105  1.00  56.46   A  N
ATOM  27263  CD2  HIS J 177   -22.656  63.395  18.563  1.00  52.19   A  C
ATOM  27264  C    HIS J 177   -19.411  63.674  16.759  1.00  47.40   A  C
ATOM  27265  O    HIS J 177   -19.221  62.596  17.209  1.00  47.31   A  O
ATOM  27266  N    LEU J 178   -19.258  63.934  15.482  1.00  47.46   A  N
ATOM  27267  CA   LEU J 178   -18.911  62.914  14.521  1.00  46.94   A  C
ATOM  27268  CB   LEU J 178   -18.966  63.475  13.111  1.00  46.03   A  C
ATOM  27269  CG   LEU J 178   -18.549  62.563  11.979  1.00  44.08   A  C
ATOM  27270  CD1  LEU J 178   -19.104  61.229  12.131  1.00  41.46   A  C
ATOM  27271  CD2  LEU J 178   -18.986  63.112  10.714  1.00  44.00   A  C
ATOM  27272  C    LEU J 178   -17.563  62.327  14.806  1.00  47.40   A  C
ATOM  27273  O    LEU J 178   -17.350  61.161  14.611  1.00  47.22   A  O
ATOM  27274  N    THR J 179   -16.649  63.165  15.258  1.00  48.45   A  N
ATOM  27275  CA   THR J 179   -15.320  62.744  15.654  1.00  48.84   A  C
ATOM  27276  CB   THR J 179   -14.393  63.941  15.928  1.00  49.02   A  C
ATOM  27277  OG1  THR J 179   -14.484  64.859  14.853  1.00  49.05   A  O
ATOM  27278  CG2  THR J 179   -12.997  63.510  15.996  1.00  48.31   A  C
ATOM  27279  C    THR J 179   -15.399  61.807  16.846  1.00  47.81   A  C
ATOM  27280  O    THR J 179   -14.721  60.830  16.902  1.00  47.28   A  O
ATOM  27281  N    ARG J 180   -16.280  62.079  17.773  1.00  48.12   A  N
ATOM  27282  CA   ARG J 180   -16.438  61.181  18.881  1.00  49.44   A  C
ATOM  27283  CB   ARG J 180   -17.534  61.688  19.787  1.00  50.11   A  C
ATOM  27284  CG   ARG J 180   -17.107  62.488  20.970  1.00  54.22   A  C
ATOM  27285  CD   ARG J 180   -16.669  61.592  22.109  1.00  62.62   A  C
ATOM  27286  NE   ARG J 180   -17.691  61.260  23.097  1.00  66.84   A  N
ATOM  27287  CZ   ARG J 180   -18.072  60.020  23.379  1.00  70.70   A  C
ATOM  27288  NH1  ARG J 180   -17.560  58.988  22.725  1.00  69.19   A  N
ATOM  27289  NH2  ARG J 180   -18.991  59.812  24.295  1.00  71.61   A  N
```

Appendix 1

```
ATOM  27290  C   ARG J 180     -16.859  59.839  18.357  1.00  48.56      A    C
ATOM  27291  O   ARG J 180     -16.345  58.838  18.754  1.00  48.20      A    O
ATOM  27292  N   ILE J 181     -17.800  59.825  17.441  1.00  48.52      A    N
ATOM  27293  CA  ILE J 181     -18.358  58.588  16.939  1.00  48.14      A    C
ATOM  27294  CB  ILE J 181     -19.403  58.867  15.869  1.00  47.99      A    C
ATOM  27295  CG1 ILE J 181     -20.616  59.523  16.443  1.00  46.52      A    C
ATOM  27296  CD1 ILE J 181     -21.547  59.855  15.419  1.00  47.00      A    C
ATOM  27297  CG2 ILE J 181     -19.889  57.626  15.256  1.00  49.03      A    C
ATOM  27298  C   ILE J 181     -17.304  57.768  16.274  1.00  47.39      A    C
ATOM  27299  O   ILE J 181     -17.231  56.598  16.463  1.00  46.46      A    O
ATOM  27300  N   ILE J 182     -16.502  58.391  15.456  1.00  47.30      A    N
ATOM  27301  CA  ILE J 182     -15.441  57.686  14.819  1.00  48.27      A    C
ATOM  27302  CB  ILE J 182     -14.741  58.615  13.853  1.00  47.97      A    C
ATOM  27303  CG1 ILE J 182     -15.778  59.258  12.959  1.00  47.11      A    C
ATOM  27304  CD1 ILE J 182     -15.269  60.326  12.073  1.00  42.66      A    C
ATOM  27305  CG2 ILE J 182     -13.743  57.886  13.022  1.00  47.23      A    C
ATOM  27306  C   ILE J 182     -14.467  57.198  15.866  1.00  49.45      A    C
ATOM  27307  O   ILE J 182     -13.980  56.085  15.825  1.00  49.25      A    O
ATOM  27308  N   HIS J 183     -14.156  58.055  16.808  1.00  49.83      A    N
ATOM  27309  CA  HIS J 183     -13.189  57.674  17.780  1.00  49.66      A    C
ATOM  27310  CB  HIS J 183     -12.866  58.863  18.644  1.00  50.46      A    C
ATOM  27311  CG  HIS J 183     -12.192  58.516  19.925  1.00  52.21      A    C
ATOM  27312  ND1 HIS J 183     -10.928  57.996  19.973  1.00  54.43      A    N
ATOM  27313  CE1 HIS J 183     -10.599  57.782  21.227  1.00  56.66      A    C
ATOM  27314  NE2 HIS J 183     -11.603  58.151  21.991  1.00  54.40      A    N
ATOM  27315  CD2 HIS J 183     -12.610  58.618  21.203  1.00  52.92      A    C
ATOM  27316  C   HIS J 183     -13.694  56.528  18.592  1.00  48.58      A    C
ATOM  27317  O   HIS J 183     -13.016  55.560  18.771  1.00  48.32      A    O
ATOM  27318  N   ASP J 184     -14.917  56.641  19.064  1.00  48.35      A    N
ATOM  27319  CA  ASP J 184     -15.531  55.609  19.863  1.00  48.24      A    C
ATOM  27320  CB  ASP J 184     -16.893  56.054  20.342  1.00  47.73      A    C
ATOM  27321  CG  ASP J 184     -16.815  56.993  21.488  1.00  50.61      A    C
ATOM  27322  OD1 ASP J 184     -17.751  57.753  21.716  1.00  55.96      A    O
ATOM  27323  OD2 ASP J 184     -15.804  56.995  22.173  1.00  52.47      A    O-1
ATOM  27324  C   ASP J 184     -15.660  54.328  19.090  1.00  48.32      A    C
ATOM  27325  O   ASP J 184     -15.551  53.289  19.636  1.00  48.49      A    O
ATOM  27326  N   GLU J 185     -15.950  54.408  17.809  1.00  49.39      A    N
ATOM  27327  CA  GLU J 185     -16.067  53.222  16.974  1.00  50.50      A    C
ATOM  27328  CB  GLU J 185     -16.681  53.594  15.619  1.00  50.63      A    C
ATOM  27329  CG  GLU J 185     -17.264  52.454  14.837  1.00  53.26      A    C
ATOM  27330  CD  GLU J 185     -18.471  52.826  13.987  1.00  55.93      A    C
ATOM  27331  OE1 GLU J 185     -18.777  53.998  13.811  1.00  53.48      A    O
ATOM  27332  OE2 GLU J 185     -19.131  51.916  13.502  1.00  55.53      A    O-1
ATOM  27333  C   GLU J 185     -14.750  52.490  16.805  1.00  50.84      A    C
ATOM  27334  O   GLU J 185     -14.678  51.281  16.838  1.00  50.16      A    O
ATOM  27335  N   ILE J 186     -13.695  53.241  16.592  1.00  51.20      A    N
ATOM  27336  CA  ILE J 186     -12.403  52.639  16.438  1.00  51.79      A    C
ATOM  27337  CB  ILE J 186     -11.377  53.683  16.183  1.00  51.59      A    C
ATOM  27338  CG1 ILE J 186     -11.415  54.090  14.730  1.00  52.00      A    C
ATOM  27339  CD1 ILE J 186     -10.858  55.409  14.462  1.00  51.75      A    C
ATOM  27340  CG2 ILE J 186     -10.059  53.149  16.487  1.00  52.03      A    C
ATOM  27341  C   ILE J 186     -12.035  51.938  17.715  1.00  52.05      A    C
ATOM  27342  O   ILE J 186     -11.487  50.858  17.722  1.00  51.14      A    O
ATOM  27343  N   ALA J 187     -12.354  52.578  18.812  1.00  51.78      A    N
```

Appendix 1

```
ATOM  27344  CA   ALA J 187   -12.022  52.053  20.100  1.00  52.13      A  C
ATOM  27345  CB   ALA J 187   -12.291  53.085  21.148  1.00  51.48      A  C
ATOM  27346  C    ALA J 187   -12.713  50.733  20.414  1.00  52.10      A  C
ATOM  27347  O    ALA J 187   -12.168  49.915  21.091  1.00  52.87      A  O
ATOM  27348  N    ALA J 188   -13.953  50.580  20.006  1.00  52.09      A  N
ATOM  27349  CA   ALA J 188   -14.716  49.374  20.223  1.00  50.93      A  C
ATOM  27350  CB   ALA J 188   -16.111  49.644  19.930  1.00  51.27      A  C
ATOM  27351  C    ALA J 188   -14.280  48.130  19.494  1.00  50.82      A  C
ATOM  27352  O    ALA J 188   -14.347  47.049  20.022  1.00  50.57      A  O
ATOM  27353  N    ASN J 189   -13.895  48.269  18.246  1.00  50.61      A  N
ATOM  27354  CA   ASN J 189   -13.631  47.116  17.426  1.00  50.73      A  C
ATOM  27355  CB   ASN J 189   -13.658  47.483  15.940  1.00  50.59      A  C
ATOM  27356  CG   ASN J 189   -15.010  47.928  15.443  1.00  48.74      A  C
ATOM  27357  OD1  ASN J 189   -16.032  47.575  15.965  1.00  45.61      A  O
ATOM  27358  ND2  ASN J 189   -14.999  48.706  14.409  1.00  48.60      A  N
ATOM  27359  C    ASN J 189   -12.327  46.421  17.713  1.00  51.44      A  C
ATOM  27360  O    ASN J 189   -11.317  47.033  17.891  1.00  51.50      A  O
ATOM  27361  N    PRO J 190   -12.349  45.116  17.710  1.00  51.78      A  N
ATOM  27362  CA   PRO J 190   -11.141  44.352  17.550  1.00  52.13      A  C
ATOM  27363  CB   PRO J 190   -11.669  42.947  17.481  1.00  52.41      A  C
ATOM  27364  CG   PRO J 190   -12.987  43.100  16.826  1.00  52.36      A  C
ATOM  27365  CD   PRO J 190   -13.455  44.496  16.988  1.00  52.06      A  C
ATOM  27366  C    PRO J 190   -10.754  44.751  16.181  1.00  51.85      A  C
ATOM  27367  O    PRO J 190   -11.621  45.105  15.463  1.00  52.92      A  O
ATOM  27368  N    PHE J 191    -9.500  44.806  15.834  1.00  51.03      A  N
ATOM  27369  CA   PHE J 191    -9.120  45.222  14.490  1.00  50.49      A  C
ATOM  27370  CB   PHE J 191    -9.894  44.504  13.390  1.00  50.16      A  C
ATOM  27371  CG   PHE J 191   -11.146  45.158  13.010  1.00  51.33      A  C
ATOM  27372  CD1  PHE J 191   -11.139  46.389  12.451  1.00  53.67      A  C
ATOM  27373  CE1  PHE J 191   -12.275  46.983  12.101  1.00  55.11      A  C
ATOM  27374  CZ   PHE J 191   -13.446  46.352  12.304  1.00  57.40      A  C
ATOM  27375  CE2  PHE J 191   -13.473  45.124  12.863  1.00  55.07      A  C
ATOM  27376  CD2  PHE J 191   -12.336  44.532  13.199  1.00  54.82      A  C
ATOM  27377  C    PHE J 191    -9.153  46.723  14.388  1.00  48.61      A  C
ATOM  27378  O    PHE J 191    -9.902  47.380  15.054  1.00  48.52      A  O
ATOM  27379  N    ALA J 192    -8.309  47.287  13.575  1.00  48.09      A  N
ATOM  27380  CA   ALA J 192    -8.162  48.711  13.648  1.00  48.27      A  C
ATOM  27381  CB   ALA J 192    -6.716  49.064  13.620  1.00  47.47      A  C
ATOM  27382  C    ALA J 192    -8.905  49.417  12.550  1.00  48.31      A  C
ATOM  27383  O    ALA J 192    -8.694  49.144  11.413  1.00  48.52      A  O
ATOM  27384  N    GLY J 193    -9.781  50.334  12.911  1.00  48.83      A  N
ATOM  27385  CA   GLY J 193   -10.597  51.021  11.937  1.00  49.63      A  C
ATOM  27386  C    GLY J 193   -12.090  50.738  11.941  1.00  50.80      A  C
ATOM  27387  O    GLY J 193   -12.627  50.139  12.844  1.00  51.60      A  O
ATOM  27388  N    ILE J 194   -12.761  51.181  10.902  1.00  49.74      A  N
ATOM  27389  CA   ILE J 194   -14.187  51.075  10.831  1.00  49.49      A  C
ATOM  27390  CB   ILE J 194   -14.747  52.451  10.951  1.00  49.34      A  C
ATOM  27391  CG1  ILE J 194   -14.152  53.108  12.165  1.00  49.17      A  C
ATOM  27392  CD1  ILE J 194   -14.437  54.524  12.236  1.00  48.55      A  C
ATOM  27393  CG2  ILE J 194   -16.219  52.435  11.107  1.00  49.66      A  C
ATOM  27394  C    ILE J 194   -14.638  50.493   9.520  1.00  49.82      A  C
ATOM  27395  O    ILE J 194   -14.097  50.836   8.514  1.00  51.12      A  O
ATOM  27396  N    VAL J 195   -15.618  49.596   9.523  1.00  48.86      A  N
ATOM  27397  CA   VAL J 195   -16.171  49.056   8.281  1.00  48.15      A  C
```

Appendix 1

```
ATOM  27398  CB   VAL J 195     -17.064  47.874   8.519  1.00  48.05      A    C
ATOM  27399  CG1  VAL J 195     -16.462  46.916   9.424  1.00  47.92      A    C
ATOM  27400  CG2  VAL J 195     -18.362  48.307   9.002  1.00  46.38      A    C
ATOM  27401  C    VAL J 195     -16.998  50.056   7.502  1.00  48.76      A    C
ATOM  27402  O    VAL J 195     -17.602  50.900   8.085  1.00  47.47      A    O
ATOM  27403  N    CYS J 196     -16.980  49.986   6.180  1.00  49.71      A    N
ATOM  27404  CA   CYS J 196     -17.873  50.776   5.345  1.00  50.75      A    C
ATOM  27405  CB   CYS J 196     -17.363  50.736   3.907  1.00  50.88      A    C
ATOM  27406  SG   CYS J 196     -16.278  52.043   3.383  1.00  52.93      A    S
ATOM  27407  C    CYS J 196     -19.335  50.350   5.358  1.00  50.97      A    C
ATOM  27408  O    CYS J 196     -20.224  51.107   5.605  1.00  49.65      A    O
ATOM  27409  N    GLU J 197     -19.567  49.162   4.852  1.00  52.75      A    N
ATOM  27410  CA   GLU J 197     -20.869  48.545   4.852  1.00  53.58      A    C
ATOM  27411  CB   GLU J 197     -21.178  47.853   3.531  1.00  54.27      A    C
ATOM  27412  CG   GLU J 197     -21.924  48.705   2.502  1.00  55.08      A    C
ATOM  27413  CD   GLU J 197     -21.082  49.097   1.332  1.00  58.94      A    C
ATOM  27414  OE1  GLU J 197     -19.866  48.936   1.402  1.00  59.82      A    O
ATOM  27415  OE2  GLU J 197     -21.623  49.575   0.338  1.00  58.17      A    O-1
ATOM  27416  C    GLU J 197     -20.630  47.553   5.909  1.00  53.65      A    C
ATOM  27417  O    GLU J 197     -19.555  47.457   6.394  1.00  54.47      A    O
ATOM  27418  N    PRO J 198     -21.603  46.790   6.304  1.00  54.00      A    N
ATOM  27419  CA   PRO J 198     -21.382  46.021   7.504  1.00  53.50      A    C
ATOM  27420  CB   PRO J 198     -22.727  45.393   7.736  1.00  53.75      A    C
ATOM  27421  CG   PRO J 198     -23.634  46.432   7.314  1.00  54.78      A    C
ATOM  27422  CD   PRO J 198     -22.980  47.262   6.261  1.00  54.53      A    C
ATOM  27423  C    PRO J 198     -20.275  45.008   7.471  1.00  52.56      A    C
ATOM  27424  O    PRO J 198     -19.589  44.922   8.426  1.00  53.19      A    O
ATOM  27425  N    ASP J 199     -20.061  44.242   6.445  1.00  51.16      A    N
ATOM  27426  CA   ASP J 199     -18.932  43.359   6.572  1.00  50.29      A    C
ATOM  27427  CB   ASP J 199     -19.284  41.941   6.199  1.00  51.00      A    C
ATOM  27428  CG   ASP J 199     -18.486  40.955   6.954  1.00  54.02      A    C
ATOM  27429  OD1  ASP J 199     -18.090  41.286   8.070  1.00  56.45      A    O
ATOM  27430  OD2  ASP J 199     -18.241  39.857   6.441  1.00  55.74      A    O-1
ATOM  27431  C    ASP J 199     -17.750  43.816   5.777  1.00  48.36      A    C
ATOM  27432  O    ASP J 199     -16.875  43.057   5.514  1.00  46.95      A    O
ATOM  27433  N    ASN J 200     -17.749  45.062   5.374  1.00  46.86      A    N
ATOM  27434  CA   ASN J 200     -16.836  45.486   4.357  1.00  46.24      A    C
ATOM  27435  CB   ASN J 200     -17.626  46.175   3.257  1.00  46.78      A    C
ATOM  27436  CG   ASN J 200     -18.496  45.248   2.478  1.00  47.88      A    C
ATOM  27437  OD1  ASN J 200     -18.250  44.072   2.401  1.00  50.02      A    O
ATOM  27438  ND2  ASN J 200     -19.505  45.794   1.866  1.00  47.37      A    N
ATOM  27439  C    ASN J 200     -15.856  46.469   4.873  1.00  45.07      A    C
ATOM  27440  O    ASN J 200     -16.224  47.556   5.201  1.00  45.53      A    O
ATOM  27441  N    TYR J 201     -14.593  46.110   4.919  1.00  43.13      A    N
ATOM  27442  CA   TYR J 201     -13.575  47.031   5.373  1.00  43.08      A    C
ATOM  27443  CB   TYR J 201     -12.731  46.349   6.453  1.00  43.18      A    C
ATOM  27444  CG   TYR J 201     -11.601  47.159   7.028  1.00  45.62      A    C
ATOM  27445  CD1  TYR J 201     -11.691  47.733   8.274  1.00  48.38      A    C
ATOM  27446  CE1  TYR J 201     -10.653  48.466   8.775  1.00  49.31      A    C
ATOM  27447  CZ   TYR J 201      -9.525  48.613   8.025  1.00  49.44      A    C
ATOM  27448  OH   TYR J 201      -8.455  49.329   8.466  1.00  52.60      A    O
ATOM  27449  CE2  TYR J 201      -9.437  48.057   6.813  1.00  43.78      A    C
ATOM  27450  CD2  TYR J 201     -10.443  47.345   6.326  1.00  44.38      A    C
ATOM  27451  C    TYR J 201     -12.723  47.499   4.201  1.00  42.29      A    C
```

Appendix 1

```
ATOM  27452  O    TYR J 201   -12.175  46.718   3.488  1.00 40.83      A  O
ATOM  27453  N    PHE J 202   -12.650  48.790   3.990  1.00 42.26      A  N
ATOM  27454  CA   PHE J 202   -11.821  49.293   2.920  1.00 43.23      A  C
ATOM  27455  CB   PHE J 202   -12.662  50.008   1.857  1.00 43.58      A  C
ATOM  27456  CG   PHE J 202   -13.663  49.137   1.189  1.00 44.54      A  C
ATOM  27457  CD1  PHE J 202   -13.318  48.366   0.139  1.00 45.77      A  C
ATOM  27458  CE1  PHE J 202   -14.229  47.582  -0.449  1.00 45.22      A  C
ATOM  27459  CZ   PHE J 202   -15.486  47.552  -0.012  1.00 44.77      A  C
ATOM  27460  CE2  PHE J 202   -15.849  48.294   1.014  1.00 44.67      A  C
ATOM  27461  CD2  PHE J 202   -14.954  49.090   1.619  1.00 45.41      A  C
ATOM  27462  C    PHE J 202   -10.773  50.217   3.481  1.00 43.22      A  C
ATOM  27463  O    PHE J 202   -11.087  51.130   4.193  1.00 43.00      A  O
ATOM  27464  N    VAL J 203    -9.521  49.955   3.166  1.00 43.22      A  N
ATOM  27465  CA   VAL J 203    -8.413  50.726   3.689  1.00 42.58      A  C
ATOM  27466  CB   VAL J 203    -7.088  50.081   3.443  1.00 42.66      A  C
ATOM  27467  CG1  VAL J 203    -6.846  49.929   2.036  1.00 41.94      A  C
ATOM  27468  CG2  VAL J 203    -6.028  50.900   4.035  1.00 43.89      A  C
ATOM  27469  C    VAL J 203    -8.404  52.154   3.236  1.00 42.52      A  C
ATOM  27470  O    VAL J 203    -8.023  53.030   3.950  1.00 42.11      A  O
ATOM  27471  N    GLN J 204    -8.828  52.353   2.018  1.00 43.10      A  N
ATOM  27472  CA   GLN J 204    -8.936  53.642   1.421  1.00 43.85      A  C
ATOM  27473  CB   GLN J 204    -9.497  53.399   0.045  1.00 45.25      A  C
ATOM  27474  CG   GLN J 204    -9.937  51.965  -0.112  1.00 44.13      A  C
ATOM  27475  CD   GLN J 204   -10.955  51.816  -1.155  1.00 48.42      A  C
ATOM  27476  OE1  GLN J 204   -10.915  50.907  -1.941  1.00 51.18      A  O
ATOM  27477  NE2  GLN J 204   -11.878  52.718  -1.189  1.00 52.40      A  N
ATOM  27478  C    GLN J 204    -9.920  54.492   2.168  1.00 44.56      A  C
ATOM  27479  O    GLN J 204    -9.689  55.639   2.406  1.00 45.27      A  O
ATOM  27480  N    CYS J 205   -11.045  53.914   2.519  1.00 44.35      A  N
ATOM  27481  CA   CYS J 205   -12.072  54.606   3.238  1.00 44.51      A  C
ATOM  27482  CB   CYS J 205   -13.369  53.775   3.303  1.00 45.37      A  C
ATOM  27483  SG   CYS J 205   -14.349  53.372   1.782  1.00 48.66      A  S
ATOM  27484  C    CYS J 205   -11.557  55.012   4.617  1.00 44.05      A  C
ATOM  27485  O    CYS J 205   -11.899  56.046   5.131  1.00 44.49      A  O
ATOM  27486  N    ASN J 206   -10.728  54.178   5.210  1.00 42.86      A  N
ATOM  27487  CA   ASN J 206   -10.104  54.456   6.496  1.00 41.47      A  C
ATOM  27488  CB   ASN J 206    -9.516  53.192   7.085  1.00 40.94      A  C
ATOM  27489  CG   ASN J 206   -10.553  52.317   7.690  1.00 42.33      A  C
ATOM  27490  OD1  ASN J 206   -10.939  52.507   8.807  1.00 43.41      A  O
ATOM  27491  ND2  ASN J 206   -11.017  51.356   6.945  1.00 39.72      A  N
ATOM  27492  C    ASN J 206    -9.127  55.629   6.578  1.00 40.34      A  C
ATOM  27493  O    ASN J 206    -9.095  56.341   7.534  1.00 38.94      A  O
ATOM  27494  N    SER J 207    -8.365  55.840   5.537  1.00 38.69      A  N
ATOM  27495  CA   SER J 207    -7.355  56.838   5.539  1.00 38.27      A  C
ATOM  27496  CB   SER J 207    -6.706  56.852   4.184  1.00 38.23      A  C
ATOM  27497  OG   SER J 207    -7.662  56.636   3.212  1.00 39.46      A  O
ATOM  27498  C    SER J 207    -7.979  58.169   5.786  1.00 37.70      A  C
ATOM  27499  O    SER J 207    -7.415  58.996   6.455  1.00 37.22      A  O
ATOM  27500  N    VAL J 208    -9.152  58.360   5.224  1.00 36.05      A  N
ATOM  27501  CA   VAL J 208    -9.913  59.562   5.377  1.00 35.25      A  C
ATOM  27502  CB   VAL J 208   -11.127  59.534   4.430  1.00 35.57      A  C
ATOM  27503  CG1  VAL J 208   -11.774  60.854   4.322  1.00 33.48      A  C
ATOM  27504  CG2  VAL J 208   -10.720  59.085   3.091  1.00 31.72      A  C
ATOM  27505  C    VAL J 208   -10.355  59.775   6.797  1.00 35.83      A  C
```

Appendix 1

```
ATOM  27506  O    VAL J 208   -10.420  60.868   7.270  1.00 35.54    A   O
ATOM  27507  N    ALA J 209   -10.723  58.712   7.459  1.00 36.26    A   N
ATOM  27508  CA   ALA J 209   -11.251  58.851   8.771  1.00 37.12    A   C
ATOM  27509  CB   ALA J 209   -11.802  57.539   9.218  1.00 36.10    A   C
ATOM  27510  C    ALA J 209   -10.217  59.339   9.724  1.00 37.39    A   C
ATOM  27511  O    ALA J 209   -10.449  60.253  10.476  1.00 36.87    A   O
ATOM  27512  N    TYR J 210    -9.067  58.699   9.666  1.00 38.28    A   N
ATOM  27513  CA   TYR J 210    -7.904  59.014  10.482  1.00 38.85    A   C
ATOM  27514  CB   TYR J 210    -6.837  57.946  10.309  1.00 38.29    A   C
ATOM  27515  CG   TYR J 210    -7.174  56.674  11.005  1.00 38.71    A   C
ATOM  27516  CD1  TYR J 210    -6.833  56.483  12.308  1.00 41.56    A   C
ATOM  27517  CE1  TYR J 210    -7.141  55.343  12.947  1.00 41.19    A   C
ATOM  27518  CZ   TYR J 210    -7.813  54.376  12.299  1.00 41.85    A   C
ATOM  27519  OH   TYR J 210    -8.114  53.247  12.957  1.00 44.81    A   O
ATOM  27520  CE2  TYR J 210    -8.181  54.534  11.008  1.00 39.52    A   C
ATOM  27521  CD2  TYR J 210    -7.858  55.673  10.369  1.00 39.25    A   C
ATOM  27522  C    TYR J 210    -7.344  60.387  10.211  1.00 38.42    A   C
ATOM  27523  O    TYR J 210    -6.925  61.074  11.096  1.00 39.63    A   O
ATOM  27524  N    LEU J 211    -7.342  60.766   8.961  1.00 37.08    A   N
ATOM  27525  CA   LEU J 211    -6.870  62.033   8.548  1.00 37.08    A   C
ATOM  27526  CB   LEU J 211    -6.930  62.082   7.049  1.00 37.42    A   C
ATOM  27527  CG   LEU J 211    -6.346  63.300   6.388  1.00 37.56    A   C
ATOM  27528  CD1  LEU J 211    -5.374  63.919   7.258  1.00 38.04    A   C
ATOM  27529  CD2  LEU J 211    -5.716  62.875   5.148  1.00 39.74    A   C
ATOM  27530  C    LEU J 211    -7.741  63.080   9.145  1.00 37.82    A   C
ATOM  27531  O    LEU J 211    -7.314  64.142   9.499  1.00 37.74    A   O
ATOM  27532  N    SER J 212    -8.999  62.748   9.244  1.00 39.00    A   N
ATOM  27533  CA   SER J 212   -10.012  63.621   9.781  1.00 40.05    A   C
ATOM  27534  CB   SER J 212   -11.338  62.918   9.731  1.00 39.76    A   C
ATOM  27535  OG   SER J 212   -11.174  61.644  10.299  1.00 41.90    A   O
ATOM  27536  C    SER J 212    -9.667  63.877  11.199  1.00 39.62    A   C
ATOM  27537  O    SER J 212    -9.854  64.937  11.710  1.00 38.75    A   O
ATOM  27538  N    LEU J 213    -9.158  62.856  11.838  1.00 40.32    A   N
ATOM  27539  CA   LEU J 213    -8.742  62.931  13.211  1.00 41.62    A   C
ATOM  27540  CB   LEU J 213    -8.324  61.546  13.636  1.00 41.49    A   C
ATOM  27541  CG   LEU J 213    -9.512  60.642  13.799  1.00 40.97    A   C
ATOM  27542  CD1  LEU J 213    -9.100  59.324  14.293  1.00 39.71    A   C
ATOM  27543  CD2  LEU J 213   -10.400  61.273  14.754  1.00 39.31    A   C
ATOM  27544  C    LEU J 213    -7.602  63.915  13.469  1.00 41.84    A   C
ATOM  27545  O    LEU J 213    -7.621  64.663  14.400  1.00 40.94    A   O
ATOM  27546  N    TRP J 214    -6.629  63.903  12.595  1.00 42.77    A   N
ATOM  27547  CA   TRP J 214    -5.525  64.794  12.666  1.00 43.15    A   C
ATOM  27548  CB   TRP J 214    -4.573  64.487  11.528  1.00 42.40    A   C
ATOM  27549  CG   TRP J 214    -3.776  63.257  11.755  1.00 42.62    A   C
ATOM  27550  CD1  TRP J 214    -4.215  62.005  11.728  1.00 41.90    A   C
ATOM  27551  NE1  TRP J 214    -3.219  61.145  11.988  1.00 44.35    A   N
ATOM  27552  CE2  TRP J 214    -2.083  61.857  12.191  1.00 45.75    A   C
ATOM  27553  CD2  TRP J 214    -2.405  63.188  12.054  1.00 43.24    A   C
ATOM  27554  CE3  TRP J 214    -1.413  64.132  12.220  1.00 42.70    A   C
ATOM  27555  CZ3  TRP J 214    -0.194  63.723  12.507  1.00 45.13    A   C
ATOM  27556  CH2  TRP J 214     0.106  62.396  12.646  1.00 47.36    A   C
ATOM  27557  CZ2  TRP J 214    -0.831  61.442  12.496  1.00 48.00    A   C
ATOM  27558  C    TRP J 214    -6.017  66.191  12.544  1.00 44.02    A   C
ATOM  27559  O    TRP J 214    -5.575  67.051  13.251  1.00 45.75    A   O
```

Appendix 1

```
ATOM  27560  N    VAL J 215   -6.928  66.421  11.626  1.00 43.69      A  N
ATOM  27561  CA   VAL J 215   -7.431  67.747  11.341  1.00 43.07      A  C
ATOM  27562  CB   VAL J 215   -8.317  67.730  10.123  1.00 42.97      A  C
ATOM  27563  CG1  VAL J 215   -9.013  68.999   9.971  1.00 39.79      A  C
ATOM  27564  CG2  VAL J 215   -7.524  67.416   8.913  1.00 40.02      A  C
ATOM  27565  C    VAL J 215   -8.158  68.335  12.513  1.00 44.40      A  C
ATOM  27566  O    VAL J 215   -8.086  69.497  12.777  1.00 44.65      A  O
ATOM  27567  N    TYR J 216   -8.892  67.505  13.211  1.00 45.66      A  N
ATOM  27568  CA   TYR J 216   -9.605  67.929  14.387  1.00 46.30      A  C
ATOM  27569  CB   TYR J 216  -10.465  66.785  14.925  1.00 45.83      A  C
ATOM  27570  CG   TYR J 216  -11.377  67.230  16.020  1.00 44.32      A  C
ATOM  27571  CD1  TYR J 216  -12.556  67.839  15.731  1.00 41.95      A  C
ATOM  27572  CE1  TYR J 216  -13.367  68.265  16.684  1.00 44.49      A  C
ATOM  27573  CZ   TYR J 216  -13.017  68.119  17.972  1.00 45.92      A  C
ATOM  27574  OH   TYR J 216  -13.872  68.567  18.930  1.00 44.19      A  O
ATOM  27575  CE2  TYR J 216  -11.840  67.529  18.295  1.00 44.21      A  C
ATOM  27576  CD2  TYR J 216  -11.033  67.086  17.328  1.00 41.00      A  C
ATOM  27577  C    TYR J 216   -8.680  68.385  15.484  1.00 47.34      A  C
ATOM  27578  O    TYR J 216   -8.936  69.366  16.157  1.00 46.82      A  O
ATOM  27579  N    ASP J 217   -7.613  67.634  15.676  1.00 46.98      A  N
ATOM  27580  CA   ASP J 217   -6.635  67.934  16.682  1.00 46.39      A  C
ATOM  27581  CB   ASP J 217   -5.611  66.816  16.726  1.00 45.52      A  C
ATOM  27582  CG   ASP J 217   -6.118  65.623  17.450  1.00 46.49      A  C
ATOM  27583  OD1  ASP J 217   -7.165  65.757  18.076  1.00 43.35      A  O
ATOM  27584  OD2  ASP J 217   -5.494  64.565  17.409  1.00 47.07      A  O-1
ATOM  27585  C    ASP J 217   -5.983  69.256  16.399  1.00 46.20      A  C
ATOM  27586  O    ASP J 217   -5.943  70.112  17.231  1.00 45.06      A  O
ATOM  27587  N    ARG J 218   -5.578  69.465  15.174  1.00 47.06      A  N
ATOM  27588  CA   ARG J 218   -4.829  70.635  14.870  1.00 47.62      A  C
ATOM  27589  CB   ARG J 218   -4.564  70.725  13.385  1.00 47.09      A  C
ATOM  27590  CG   ARG J 218   -4.563  72.116  12.879  1.00 49.02      A  C
ATOM  27591  CD   ARG J 218   -3.213  72.783  13.009  1.00 52.81      A  C
ATOM  27592  NE   ARG J 218   -2.987  73.806  12.005  1.00 52.90      A  N
ATOM  27593  CZ   ARG J 218   -3.547  74.999  12.023  1.00 56.28      A  C
ATOM  27594  NH1  ARG J 218   -4.364  75.319  13.000  1.00 55.35      A  N
ATOM  27595  NH2  ARG J 218   -3.296  75.865  11.060  1.00 56.35      A  N
ATOM  27596  C    ARG J 218   -5.697  71.755  15.270  1.00 47.96      A  C
ATOM  27597  O    ARG J 218   -5.231  72.773  15.700  1.00 49.08      A  O
ATOM  27598  N    LEU J 219   -6.978  71.587  15.062  1.00 48.05      A  N
ATOM  27599  CA   LEU J 219   -7.956  72.576  15.432  1.00 47.71      A  C
ATOM  27600  CB   LEU J 219   -9.269  72.186  14.795  1.00 47.61      A  C
ATOM  27601  CG   LEU J 219   -9.973  73.005  13.734  1.00 47.16      A  C
ATOM  27602  CD1  LEU J 219   -9.038  73.862  12.962  1.00 48.45      A  C
ATOM  27603  CD2  LEU J 219  -10.696  72.102  12.837  1.00 43.45      A  C
ATOM  27604  C    LEU J 219   -8.159  72.773  16.917  1.00 48.30      A  C
ATOM  27605  O    LEU J 219   -8.231  73.868  17.392  1.00 48.47      A  O
ATOM  27606  N    HIS J 220   -8.317  71.701  17.656  1.00 49.50      A  N
ATOM  27607  CA   HIS J 220   -8.632  71.833  19.063  1.00 51.09      A  C
ATOM  27608  CB   HIS J 220   -9.942  71.129  19.347  1.00 50.86      A  C
ATOM  27609  CG   HIS J 220  -11.012  71.505  18.390  1.00 54.02      A  C
ATOM  27610  ND1  HIS J 220  -11.524  72.771  18.332  1.00 56.75      A  N
ATOM  27611  CE1  HIS J 220  -12.425  72.835  17.378  1.00 57.17      A  C
ATOM  27612  NE2  HIS J 220  -12.498  71.659  16.799  1.00 57.78      A  N
ATOM  27613  CD2  HIS J 220  -11.615  70.812  17.405  1.00 56.15      A  C
```

Appendix 1

```
ATOM  27614  C    HIS J 220   -7.548  71.401  20.028  1.00 51.60    A  C
ATOM  27615  O    HIS J 220   -7.683  71.567  21.208  1.00 51.33    A  O
ATOM  27616  N    GLY J 221   -6.448  70.881  19.530  1.00 52.56    A  N
ATOM  27617  CA   GLY J 221   -5.374  70.489  20.410  1.00 53.40    A  C
ATOM  27618  C    GLY J 221   -5.601  69.229  21.189  1.00 53.97    A  C
ATOM  27619  O    GLY J 221   -5.063  69.031  22.251  1.00 53.83    A  O
ATOM  27620  N    THR J 222   -6.418  68.377  20.629  1.00 54.07    A  N
ATOM  27621  CA   THR J 222   -6.667  67.090  21.177  1.00 54.12    A  C
ATOM  27622  CB   THR J 222   -8.006  66.602  20.775  1.00 53.89    A  C
ATOM  27623  OG1  THR J 222   -8.140  66.789  19.372  1.00 55.63    A  O
ATOM  27624  CG2  THR J 222   -9.043  67.384  21.461  1.00 52.23    A  C
ATOM  27625  C    THR J 222   -5.622  66.162  20.659  1.00 54.14    A  C
ATOM  27626  O    THR J 222   -4.707  66.580  19.983  1.00 53.33    A  O
ATOM  27627  N    ASP J 223   -5.792  64.890  20.977  1.00 54.79    A  N
ATOM  27628  CA   ASP J 223   -4.859  63.839  20.638  1.00 55.51    A  C
ATOM  27629  CB   ASP J 223   -4.211  63.320  21.893  1.00 55.87    A  C
ATOM  27630  CG   ASP J 223   -3.062  62.427  21.612  1.00 58.50    A  C
ATOM  27631  OD1  ASP J 223   -2.402  62.580  20.583  1.00 59.40    A  O
ATOM  27632  OD2  ASP J 223   -2.804  61.567  22.442  1.00 61.34    A  O-1
ATOM  27633  C    ASP J 223   -5.465  62.664  19.916  1.00 55.31    A  C
ATOM  27634  O    ASP J 223   -5.061  61.556  20.140  1.00 55.58    A  O
ATOM  27635  N    TYR J 224   -6.417  62.887  19.035  1.00 55.05    A  N
ATOM  27636  CA   TYR J 224   -7.180  61.776  18.469  1.00 55.58    A  C
ATOM  27637  CB   TYR J 224   -8.420  62.251  17.717  1.00 55.00    A  C
ATOM  27638  CG   TYR J 224   -9.548  62.631  18.634  1.00 52.38    A  C
ATOM  27639  CD1  TYR J 224  -10.402  61.695  19.127  1.00 51.18    A  C
ATOM  27640  CE1  TYR J 224  -11.398  62.034  19.957  1.00 49.68    A  C
ATOM  27641  CZ   TYR J 224  -11.563  63.309  20.307  1.00 49.00    A  C
ATOM  27642  OH   TYR J 224  -12.570  63.650  21.148  1.00 47.98    A  O
ATOM  27643  CE2  TYR J 224  -10.736  64.250  19.840  1.00 49.71    A  C
ATOM  27644  CD2  TYR J 224   -9.738  63.915  19.022  1.00 50.70    A  C
ATOM  27645  C    TYR J 224   -6.368  60.756  17.680  1.00 56.18    A  C
ATOM  27646  O    TYR J 224   -6.697  59.594  17.668  1.00 56.58    A  O
ATOM  27647  N    ARG J 225   -5.301  61.230  17.062  1.00 56.62    A  N
ATOM  27648  CA   ARG J 225   -4.250  60.467  16.401  1.00 57.51    A  C
ATOM  27649  CB   ARG J 225   -3.001  61.283  16.335  1.00 57.10    A  C
ATOM  27650  CG   ARG J 225   -3.121  62.485  15.529  1.00 58.03    A  C
ATOM  27651  CD   ARG J 225   -1.959  63.356  15.801  1.00 61.14    A  C
ATOM  27652  NE   ARG J 225   -2.256  64.337  16.825  1.00 65.33    A  N
ATOM  27653  CZ   ARG J 225   -1.375  64.806  17.683  1.00 65.54    A  C
ATOM  27654  NH1  ARG J 225   -0.144  64.380  17.643  1.00 65.36    A  N
ATOM  27655  NH2  ARG J 225   -1.727  65.694  18.577  1.00 65.18    A  N
ATOM  27656  C    ARG J 225   -3.876  59.070  16.845  1.00 58.68    A  C
ATOM  27657  O    ARG J 225   -2.796  58.852  17.317  1.00 59.71    A  O
ATOM  27658  N    ALA J 226   -4.763  58.114  16.667  1.00 59.34    A  N
ATOM  27659  CA   ALA J 226   -4.531  56.728  17.055  1.00 58.33    A  C
ATOM  27660  CB   ALA J 226   -5.798  56.090  17.485  1.00 58.17    A  C
ATOM  27661  C    ALA J 226   -4.025  56.056  15.814  1.00 58.03    A  C
ATOM  27662  O    ALA J 226   -4.129  54.868  15.639  1.00 55.56    A  O
ATOM  27663  N    ALA J 227   -3.523  56.863  14.903  1.00 59.05    A  N
ATOM  27664  CA   ALA J 227   -3.153  56.411  13.597  1.00 60.31    A  C
ATOM  27665  CB   ALA J 227   -2.691  57.566  12.823  1.00 59.32    A  C
ATOM  27666  C    ALA J 227   -2.049  55.423  13.756  1.00 61.72    A  C
ATOM  27667  O    ALA J 227   -1.977  54.398  13.110  1.00 61.24    A  O
```

Appendix 1

```
ATOM  27668  N    THR J 228   -1.201  55.793  14.692  1.00  64.22    A  N
ATOM  27669  CA   THR J 228    0.100  55.229  14.962  1.00  65.73    A  C
ATOM  27670  CB   THR J 228    0.690  55.913  16.182  1.00  66.66    A  C
ATOM  27671  OG1  THR J 228    1.197  54.925  17.087  1.00  68.06    A  O
ATOM  27672  CG2  THR J 228   -0.376  56.734  16.878  1.00  65.87    A  C
ATOM  27673  C    THR J 228   -0.158  53.852  15.363  1.00  65.58    A  C
ATOM  27674  O    THR J 228    0.629  52.949  15.235  1.00  65.11    A  O
ATOM  27675  N    ARG J 229   -1.354  53.703  15.832  1.00  66.06    A  N
ATOM  27676  CA   ARG J 229   -1.639  52.621  16.666  1.00  65.59    A  C
ATOM  27677  CB   ARG J 229   -2.950  52.820  17.394  1.00  66.55    A  C
ATOM  27678  CG   ARG J 229   -2.756  53.529  18.694  1.00  69.25    A  C
ATOM  27679  CD   ARG J 229   -3.751  53.100  19.734  1.00  75.99    A  C
ATOM  27680  NE   ARG J 229   -3.816  51.662  19.971  1.00  78.45    A  N
ATOM  27681  CZ   ARG J 229   -3.044  50.981  20.811  1.00  79.38    A  C
ATOM  27682  NH1  ARG J 229   -2.085  51.583  21.497  1.00  79.53    A  N
ATOM  27683  NH2  ARG J 229   -3.223  49.682  20.942  1.00  79.03    A  N
ATOM  27684  C    ARG J 229   -1.751  51.650  15.601  1.00  63.52    A  C
ATOM  27685  O    ARG J 229   -1.076  51.756  14.593  1.00  61.63    A  O
ATOM  27686  N    ALA J 230   -2.614  50.708  15.827  1.00  61.45    A  N
ATOM  27687  CA   ALA J 230   -2.563  49.552  15.043  1.00  60.04    A  C
ATOM  27688  CB   ALA J 230   -3.607  48.605  15.470  1.00  60.82    A  C
ATOM  27689  C    ALA J 230   -2.759  49.974  13.637  1.00  58.04    A  C
ATOM  27690  O    ALA J 230   -2.217  49.366  12.741  1.00  58.46    A  O
ATOM  27691  N    TRP J 231   -3.515  51.025  13.411  1.00  54.98    A  N
ATOM  27692  CA   TRP J 231   -4.139  51.061  12.144  1.00  52.43    A  C
ATOM  27693  CB   TRP J 231   -4.993  52.305  11.940  1.00  52.03    A  C
ATOM  27694  CG   TRP J 231   -5.568  52.310  10.577  1.00  48.18    A  C
ATOM  27695  CD1  TRP J 231   -6.496  51.486  10.105  1.00  45.89    A  C
ATOM  27696  NE1  TRP J 231   -6.747  51.742   8.814  1.00  45.28    A  N
ATOM  27697  CE2  TRP J 231   -5.951  52.766   8.416  1.00  41.39    A  C
ATOM  27698  CD2  TRP J 231   -5.195  53.140   9.504  1.00  43.05    A  C
ATOM  27699  CE3  TRP J 231   -4.292  54.170   9.361  1.00  41.89    A  C
ATOM  27700  CZ3  TRP J 231   -4.184  54.765   8.167  1.00  42.78    A  C
ATOM  27701  CH2  TRP J 231   -4.951  54.375   7.100  1.00  41.82    A  C
ATOM  27702  CZ2  TRP J 231   -5.840  53.373   7.207  1.00  39.89    A  C
ATOM  27703  C    TRP J 231   -3.082  51.017  11.119  1.00  51.69    A  C
ATOM  27704  O    TRP J 231   -3.111  50.182  10.263  1.00  50.21    A  O
ATOM  27705  N    LEU J 232   -2.115  51.886  11.243  1.00  51.80    A  N
ATOM  27706  CA   LEU J 232   -1.066  51.940  10.273  1.00  51.86    A  C
ATOM  27707  CB   LEU J 232   -0.124  53.061  10.655  1.00  51.23    A  C
ATOM  27708  CG   LEU J 232    0.321  54.074   9.618  1.00  50.27    A  C
ATOM  27709  CD1  LEU J 232   -0.652  54.243   8.566  1.00  44.87    A  C
ATOM  27710  CD2  LEU J 232    0.606  55.369  10.243  1.00  50.81    A  C
ATOM  27711  C    LEU J 232   -0.354  50.618  10.290  1.00  52.65    A  C
ATOM  27712  O    LEU J 232   -0.009  50.081   9.270  1.00  51.97    A  O
ATOM  27713  N    ASP J 233   -0.126  50.106  11.482  1.00  54.36    A  N
ATOM  27714  CA   ASP J 233    0.508  48.814  11.676  1.00  55.93    A  C
ATOM  27715  CB   ASP J 233    0.800  48.588  13.144  1.00  56.02    A  C
ATOM  27716  CG   ASP J 233    2.069  49.214  13.567  1.00  58.97    A  C
ATOM  27717  OD1  ASP J 233    3.004  49.258  12.773  1.00  59.71    A  O
ATOM  27718  OD2  ASP J 233    2.136  49.662  14.699  1.00  61.41    A  O-1
ATOM  27719  C    ASP J 233   -0.332  47.683  11.173  1.00  55.79    A  C
ATOM  27720  O    ASP J 233    0.159  46.726  10.632  1.00  55.15    A  O
ATOM  27721  N    PHE J 234   -1.620  47.809  11.406  1.00  56.13    A  N
```

Appendix 1

```
ATOM  27722  CA   PHE J 234     -2.616  46.827  11.052  1.00  57.13      A    C
ATOM  27723  CB   PHE J 234     -3.913  47.276  11.686  1.00  57.22      A    C
ATOM  27724  CG   PHE J 234     -5.086  46.509  11.280  1.00  58.46      A    C
ATOM  27725  CD1  PHE J 234     -5.226  45.219  11.643  1.00  62.49      A    C
ATOM  27726  CE1  PHE J 234     -6.318  44.541  11.286  1.00  63.14      A    C
ATOM  27727  CZ   PHE J 234     -7.279  45.140  10.575  1.00  61.52      A    C
ATOM  27728  CE2  PHE J 234     -7.159  46.409  10.228  1.00  59.39      A    C
ATOM  27729  CD2  PHE J 234     -6.080  47.094  10.572  1.00  59.01      A    C
ATOM  27730  C    PHE J 234     -2.786  46.583   9.563  1.00  57.13      A    C
ATOM  27731  O    PHE J 234     -2.929  45.467   9.130  1.00  57.03      A    O
ATOM  27732  N    ILE J 235     -2.778  47.631   8.770  1.00  57.00      A    N
ATOM  27733  CA   ILE J 235     -2.884  47.449   7.337  1.00  58.01      A    C
ATOM  27734  CB   ILE J 235     -3.277  48.711   6.599  1.00  57.56      A    C
ATOM  27735  CG1  ILE J 235     -2.142  49.682   6.506  1.00  55.08      A    C
ATOM  27736  CD1  ILE J 235     -2.643  51.046   6.579  1.00  53.56      A    C
ATOM  27737  CG2  ILE J 235     -4.362  49.394   7.322  1.00  56.02      A    C
ATOM  27738  C    ILE J 235     -1.658  46.800   6.751  1.00  59.52      A    C
ATOM  27739  O    ILE J 235     -1.686  46.224   5.690  1.00  58.74      A    O
ATOM  27740  N    GLN J 236     -0.575  46.929   7.490  1.00  61.78      A    N
ATOM  27741  CA   GLN J 236      0.707  46.377   7.143  1.00  63.26      A    C
ATOM  27742  CB   GLN J 236      1.814  47.057   7.908  1.00  63.77      A    C
ATOM  27743  CG   GLN J 236      2.157  48.407   7.353  1.00  64.44      A    C
ATOM  27744  CD   GLN J 236      3.622  48.620   7.214  1.00  65.68      A    C
ATOM  27745  OE1  GLN J 236      4.241  49.187   8.079  1.00  67.88      A    O
ATOM  27746  NE2  GLN J 236      4.188  48.178   6.113  1.00  65.52      A    N
ATOM  27747  C    GLN J 236      0.777  44.881   7.217  1.00  64.33      A    C
ATOM  27748  O    GLN J 236      1.591  44.291   6.570  1.00  65.39      A    O
ATOM  27749  N    LYS J 237     -0.081  44.246   7.985  1.00  65.68      A    N
ATOM  27750  CA   LYS J 237     -0.100  42.800   7.937  1.00  66.62      A    C
ATOM  27751  CB   LYS J 237     -0.003  42.183   9.323  1.00  66.76      A    C
ATOM  27752  CG   LYS J 237     -0.861  42.810  10.344  1.00  68.20      A    C
ATOM  27753  CD   LYS J 237     -0.220  42.736  11.683  1.00  71.99      A    C
ATOM  27754  CE   LYS J 237      1.121  43.414  11.670  1.00  73.74      A    C
ATOM  27755  NZ   LYS J 237      2.173  42.593  11.049  1.00  73.06      A    N
ATOM  27756  C    LYS J 237     -1.298  42.258   7.215  1.00  66.53      A    C
ATOM  27757  O    LYS J 237     -2.416  42.462   7.585  1.00  66.35      A    O
ATOM  27758  N    ASP J 238     -1.005  41.660   6.088  1.00  67.68      A    N
ATOM  27759  CA   ASP J 238     -1.817  40.683   5.389  1.00  68.26      A    C
ATOM  27760  CB   ASP J 238     -2.181  39.477   6.273  1.00  68.62      A    C
ATOM  27761  CG   ASP J 238     -3.469  39.641   7.007  1.00  70.73      A    C
ATOM  27762  OD1  ASP J 238     -3.784  40.766   7.423  1.00  72.43      A    O
ATOM  27763  OD2  ASP J 238     -4.156  38.626   7.193  1.00  70.28      A    O-1
ATOM  27764  C    ASP J 238     -2.968  41.336   4.638  1.00  67.67      A    C
ATOM  27765  O    ASP J 238     -3.651  40.709   3.859  1.00  67.90      A    O
ATOM  27766  N    LEU J 239     -3.143  42.621   4.890  1.00  66.64      A    N
ATOM  27767  CA   LEU J 239     -3.976  43.489   4.090  1.00  65.42      A    C
ATOM  27768  CB   LEU J 239     -4.557  44.538   4.990  1.00  65.30      A    C
ATOM  27769  CG   LEU J 239     -5.979  44.970   4.824  1.00  64.63      A    C
ATOM  27770  CD1  LEU J 239     -6.756  44.280   5.836  1.00  66.71      A    C
ATOM  27771  CD2  LEU J 239     -5.992  46.404   5.120  1.00  65.69      A    C
ATOM  27772  C    LEU J 239     -3.186  44.179   2.979  1.00  64.71      A    C
ATOM  27773  O    LEU J 239     -3.742  44.854   2.153  1.00  64.10      A    O
ATOM  27774  N    ILE J 240     -1.877  44.010   2.990  1.00  64.03      A    N
ATOM  27775  CA   ILE J 240     -1.022  44.529   1.951  1.00  63.50      A    C
```

Appendix 1

```
ATOM  27776  CB   ILE J 240      -0.299  45.780   2.398  1.00  63.92      A  C
ATOM  27777  CG1  ILE J 240       0.521  46.344   1.268  1.00  63.51      A  C
ATOM  27778  CD1  ILE J 240       1.062  47.659   1.595  1.00  65.93      A  C
ATOM  27779  CG2  ILE J 240       0.630  45.487   3.502  1.00  64.52      A  C
ATOM  27780  C    ILE J 240       0.019  43.540   1.558  1.00  62.64      A  C
ATOM  27781  O    ILE J 240       0.405  42.719   2.332  1.00  63.00      A  O
ATOM  27782  N    ASP J 241       0.463  43.610   0.328  1.00  62.25      A  N
ATOM  27783  CA   ASP J 241       1.563  42.802  -0.088  1.00  62.08      A  C
ATOM  27784  CB   ASP J 241       1.327  42.220  -1.467  1.00  61.40      A  C
ATOM  27785  CG   ASP J 241       2.559  41.603  -2.034  1.00  60.96      A  C
ATOM  27786  OD1  ASP J 241       3.633  41.860  -1.502  1.00  56.48      A  O
ATOM  27787  OD2  ASP J 241       2.456  40.857  -2.997  1.00  60.47      A  O-1
ATOM  27788  C    ASP J 241       2.724  43.755  -0.122  1.00  62.49      A  C
ATOM  27789  O    ASP J 241       2.761  44.668  -0.893  1.00  61.89      A  O
ATOM  27790  N    PRO J 242       3.642  43.570   0.786  1.00  62.49      A  N
ATOM  27791  CA   PRO J 242       4.782  44.442   0.881  1.00  62.14      A  C
ATOM  27792  CB   PRO J 242       5.526  43.882   2.065  1.00  62.81      A  C
ATOM  27793  CG   PRO J 242       4.866  42.568   2.391  1.00  62.97      A  C
ATOM  27794  CD   PRO J 242       3.919  42.256   1.348  1.00  62.59      A  C
ATOM  27795  C    PRO J 242       5.639  44.371  -0.340  1.00  61.89      A  C
ATOM  27796  O    PRO J 242       6.118  45.373  -0.771  1.00  61.35      A  O
ATOM  27797  N    GLU J 243       5.870  43.210  -0.904  1.00  61.91      A  N
ATOM  27798  CA   GLU J 243       6.750  43.242  -2.038  1.00  62.43      A  C
ATOM  27799  CB   GLU J 243       7.191  41.838  -2.455  1.00  63.32      A  C
ATOM  27800  CG   GLU J 243       7.526  40.904  -1.305  1.00  67.26      A  C
ATOM  27801  CD   GLU J 243       8.905  41.146  -0.682  1.00  74.12      A  C
ATOM  27802  OE1  GLU J 243       9.842  40.364  -0.944  1.00  75.73      A  O
ATOM  27803  OE2  GLU J 243       9.058  42.103   0.090  1.00  71.94      A  O-1
ATOM  27804  C    GLU J 243       6.192  44.042  -3.208  1.00  61.25      A  C
ATOM  27805  O    GLU J 243       6.882  44.877  -3.720  1.00  61.28      A  O
ATOM  27806  N    ARG J 244       4.953  43.797  -3.627  1.00  59.77      A  N
ATOM  27807  CA   ARG J 244       4.332  44.534  -4.733  1.00  57.85      A  C
ATOM  27808  CB   ARG J 244       3.143  43.789  -5.340  1.00  57.08      A  C
ATOM  27809  CG   ARG J 244       3.447  42.374  -5.731  1.00  59.16      A  C
ATOM  27810  CD   ARG J 244       2.278  41.623  -6.344  1.00  65.09      A  C
ATOM  27811  NE   ARG J 244       1.741  40.573  -5.466  1.00  69.71      A  N
ATOM  27812  CZ   ARG J 244       0.589  39.922  -5.647  1.00  69.22      A  C
ATOM  27813  NH1  ARG J 244      -0.181  40.187  -6.665  1.00  68.10      A  N
ATOM  27814  NH2  ARG J 244       0.201  38.995  -4.800  1.00  67.94      A  N
ATOM  27815  C    ARG J 244       3.985  45.954  -4.323  1.00  56.63      A  C
ATOM  27816  O    ARG J 244       3.754  46.807  -5.151  1.00  55.83      A  O
ATOM  27817  N    GLY J 245       4.024  46.199  -3.023  1.00  55.18      A  N
ATOM  27818  CA   GLY J 245       3.644  47.461  -2.426  1.00  53.06      A  C
ATOM  27819  C    GLY J 245       2.201  47.853  -2.599  1.00  52.36      A  C
ATOM  27820  O    GLY J 245       1.892  49.009  -2.727  1.00  53.59      A  O
ATOM  27821  N    ALA J 246       1.308  46.887  -2.606  1.00  50.09      A  N
ATOM  27822  CA   ALA J 246      -0.044  47.145  -2.998  1.00  47.60      A  C
ATOM  27823  CB   ALA J 246      -0.265  46.543  -4.317  1.00  47.90      A  C
ATOM  27824  C    ALA J 246      -1.061  46.619  -2.035  1.00  46.58      A  C
ATOM  27825  O    ALA J 246      -0.950  45.527  -1.586  1.00  46.31      A  O
ATOM  27826  N    PHE J 247      -2.092  47.382  -1.751  1.00  45.22      A  N
ATOM  27827  CA   PHE J 247      -3.193  46.847  -0.988  1.00  44.03      A  C
ATOM  27828  CB   PHE J 247      -3.989  47.963  -0.382  1.00  43.27      A  C
ATOM  27829  CG   PHE J 247      -3.228  48.786   0.588  1.00  44.00      A  C
```

Appendix 1

```
ATOM  27830  CD1  PHE  J  247   -3.112  48.402   1.888  1.00  43.20  A  C
ATOM  27831  CE1  PHE  J  247   -2.453  49.164   2.758  1.00  37.88  A  C
ATOM  27832  CZ   PHE  J  247   -1.906  50.305   2.368  1.00  38.98  A  C
ATOM  27833  CE2  PHE  J  247   -2.010  50.714   1.106  1.00  36.52  A  C
ATOM  27834  CD2  PHE  J  247   -2.662  49.974   0.217  1.00  41.44  A  C
ATOM  27835  C    PHE  J  247   -4.120  45.885  -1.727  1.00  43.22  A  C
ATOM  27836  O    PHE  J  247   -4.376  46.022  -2.892  1.00  42.88  A  O
ATOM  27837  N    TYR  J  248   -4.691  44.901  -0.997  1.00  42.13  A  N
ATOM  27838  CA   TYR  J  248   -5.653  44.030  -1.424  1.00  42.30  A  C
ATOM  27839  CB   TYR  J  248   -5.690  42.805  -0.548  1.00  43.39  A  C
ATOM  27840  CG   TYR  J  248   -4.597  41.837  -0.850  1.00  45.23  A  C
ATOM  27841  CD1  TYR  J  248   -4.677  41.018  -1.935  1.00  46.43  A  C
ATOM  27842  CE1  TYR  J  248   -3.712  40.158  -2.234  1.00  50.12  A  C
ATOM  27843  CZ   TYR  J  248   -2.614  40.094  -1.453  1.00  51.96  A  C
ATOM  27844  OH   TYR  J  248   -1.647  39.220  -1.768  1.00  53.36  A  O
ATOM  27845  CE2  TYR  J  248   -2.491  40.883  -0.361  1.00  50.49  A  C
ATOM  27846  CD2  TYR  J  248   -3.482  41.752  -0.061  1.00  48.73  A  C
ATOM  27847  C    TYR  J  248   -6.963  44.747  -1.351  1.00  42.24  A  C
ATOM  27848  O    TYR  J  248   -7.114  45.682  -0.629  1.00  42.43  A  O
ATOM  27849  N    LEU  J  249   -7.929  44.297  -2.107  1.00  41.95  A  N
ATOM  27850  CA   LEU  J  249   -9.123  45.067  -2.318  1.00  41.23  A  C
ATOM  27851  CB   LEU  J  249   -9.942  44.296  -3.325  1.00  40.17  A  C
ATOM  27852  CG   LEU  J  249  -11.073  44.860  -4.130  1.00  39.92  A  C
ATOM  27853  CD1  LEU  J  249  -10.673  46.034  -4.912  1.00  40.10  A  C
ATOM  27854  CD2  LEU  J  249  -11.529  43.786  -5.026  1.00  36.64  A  C
ATOM  27855  C    LEU  J  249   -9.980  45.370  -1.101  1.00  41.65  A  C
ATOM  27856  O    LEU  J  249  -10.342  46.492  -0.889  1.00  42.10  A  O
ATOM  27857  N    SER  J  250  -10.323  44.368  -0.316  1.00  41.64  A  N
ATOM  27858  CA   SER  J  250  -11.082  44.595   0.877  1.00  41.30  A  C
ATOM  27859  CB   SER  J  250  -12.583  44.644   0.616  1.00  41.85  A  C
ATOM  27860  OG   SER  J  250  -12.939  44.237  -0.663  1.00  39.87  A  O
ATOM  27861  C    SER  J  250  -10.796  43.560   1.905  1.00  42.15  A  C
ATOM  27862  O    SER  J  250  -10.293  42.530   1.608  1.00  42.19  A  O
ATOM  27863  N    TYR  J  251  -11.170  43.849   3.129  1.00  42.23  A  N
ATOM  27864  CA   TYR  J  251  -11.029  42.921   4.202  1.00  43.94  A  C
ATOM  27865  CB   TYR  J  251  -10.090  43.496   5.259  1.00  44.37  A  C
ATOM  27866  CG   TYR  J  251  -10.135  42.773   6.580  1.00  48.35  A  C
ATOM  27867  CD1  TYR  J  251   -9.743  41.467   6.685  1.00  50.86  A  C
ATOM  27868  CE1  TYR  J  251   -9.799  40.816   7.873  1.00  51.94  A  C
ATOM  27869  CZ   TYR  J  251  -10.236  41.465   8.979  1.00  52.24  A  C
ATOM  27870  OH   TYR  J  251  -10.286  40.817  10.173  1.00  52.20  A  O
ATOM  27871  CE2  TYR  J  251  -10.631  42.748   8.898  1.00  49.06  A  C
ATOM  27872  CD2  TYR  J  251  -10.579  43.396   7.715  1.00  48.81  A  C
ATOM  27873  C    TYR  J  251  -12.399  42.684   4.791  1.00  43.86  A  C
ATOM  27874  O    TYR  J  251  -13.125  43.604   4.916  1.00  43.47  A  O
ATOM  27875  N    HIS  J  252  -12.747  41.454   5.139  1.00  44.85  A  N
ATOM  27876  CA   HIS  J  252  -14.000  41.191   5.824  1.00  45.30  A  C
ATOM  27877  CB   HIS  J  252  -14.862  40.455   4.851  1.00  43.79  A  C
ATOM  27878  CG   HIS  J  252  -14.824  41.076   3.514  1.00  41.54  A  C
ATOM  27879  ND1  HIS  J  252  -15.533  42.206   3.219  1.00  41.94  A  N
ATOM  27880  CE1  HIS  J  252  -15.263  42.587   1.993  1.00  39.16  A  C
ATOM  27881  NE2  HIS  J  252  -14.374  41.759   1.498  1.00  41.64  A  N
ATOM  27882  CD2  HIS  J  252  -14.067  40.817   2.436  1.00  42.19  A  C
ATOM  27883  C    HIS  J  252  -13.865  40.453   7.143  1.00  47.43  A  C
```

Appendix 1

```
ATOM  27884  O    HIS J 252   -13.584  39.287   7.190  1.00 47.96      A    O
ATOM  27885  N    PRO J 253   -14.064  41.159   8.230  1.00 48.90      A    N
ATOM  27886  CA   PRO J 253   -13.794  40.586   9.537  1.00 50.51      A    C
ATOM  27887  CB   PRO J 253   -14.101  41.737  10.478  1.00 50.71      A    C
ATOM  27888  CG   PRO J 253   -14.692  42.760   9.678  1.00 49.25      A    C
ATOM  27889  CD   PRO J 253   -14.240  42.600   8.315  1.00 48.54      A    C
ATOM  27890  C    PRO J 253   -14.625  39.415   9.966  1.00 52.01      A    C
ATOM  27891  O    PRO J 253   -14.055  38.462  10.414  1.00 53.01      A    O
ATOM  27892  N    GLU J 254   -15.933  39.487   9.892  1.00 53.21      A    N
ATOM  27893  CA   GLU J 254   -16.759  38.391  10.329  1.00 55.39      A    C
ATOM  27894  CB   GLU J 254   -18.224  38.760  10.213  1.00 55.97      A    C
ATOM  27895  CG   GLU J 254   -19.119  37.628   9.837  1.00 59.79      A    C
ATOM  27896  CD   GLU J 254   -19.635  36.865  11.020  1.00 65.64      A    C
ATOM  27897  OE1  GLU J 254   -20.564  37.342  11.675  1.00 68.05      A    O
ATOM  27898  OE2  GLU J 254   -19.129  35.774  11.295  1.00 68.12      A    O-1
ATOM  27899  C    GLU J 254   -16.456  37.236   9.441  1.00 55.63      A    C
ATOM  27900  O    GLU J 254   -16.336  36.099   9.840  1.00 53.88      A    O
ATOM  27901  N    SER J 255   -16.208  37.613   8.211  1.00 57.42      A    N
ATOM  27902  CA   SER J 255   -16.382  36.820   7.025  1.00 57.89      A    C
ATOM  27903  CB   SER J 255   -16.729  37.704   5.824  1.00 58.15      A    C
ATOM  27904  OG   SER J 255   -18.121  37.867   5.644  1.00 57.70      A    O
ATOM  27905  C    SER J 255   -15.067  36.216   6.827  1.00 57.35      A    C
ATOM  27906  O    SER J 255   -14.657  35.980   5.730  1.00 57.38      A    O
ATOM  27907  N    GLY J 256   -14.380  35.992   7.927  1.00 56.77      A    N
ATOM  27908  CA   GLY J 256   -13.006  35.628   7.821  1.00 56.43      A    C
ATOM  27909  C    GLY J 256   -12.199  36.756   7.230  1.00 56.55      A    C
ATOM  27910  O    GLY J 256   -12.094  37.799   7.821  1.00 56.66      A    O
ATOM  27911  N    ALA J 257   -11.695  36.591   6.021  1.00 55.21      A    N
ATOM  27912  CA   ALA J 257   -10.573  37.383   5.599  1.00 52.97      A    C
ATOM  27913  CB   ALA J 257    -9.395  36.480   5.443  1.00 53.12      A    C
ATOM  27914  C    ALA J 257   -10.658  38.335   4.412  1.00 50.96      A    C
ATOM  27915  O    ALA J 257   -11.395  39.281   4.408  1.00 50.32      A    O
ATOM  27916  N    VAL J 258    -9.798  38.091   3.444  1.00 48.61      A    N
ATOM  27917  CA   VAL J 258    -9.319  39.092   2.527  1.00 46.08      A    C
ATOM  27918  CB   VAL J 258    -7.818  39.338   2.770  1.00 46.49      A    C
ATOM  27919  CG1  VAL J 258    -7.234  40.186   1.731  1.00 46.23      A    C
ATOM  27920  CG2  VAL J 258    -7.616  39.976   4.058  1.00 44.89      A    C
ATOM  27921  C    VAL J 258    -9.562  38.715   1.092  1.00 44.38      A    C
ATOM  27922  O    VAL J 258    -9.376  37.594   0.716  1.00 43.35      A    O
ATOM  27923  N    LYS J 259    -9.994  39.680   0.304  1.00 42.98      A    N
ATOM  27924  CA   LYS J 259   -10.191  39.514  -1.112  1.00 42.48      A    C
ATOM  27925  CB   LYS J 259   -10.967  40.695  -1.654  1.00 42.15      A    C
ATOM  27926  CG   LYS J 259   -12.333  40.389  -2.179  1.00 40.81      A    C
ATOM  27927  CD   LYS J 259   -13.361  41.328  -1.625  1.00 33.62      A    C
ATOM  27928  CE   LYS J 259   -14.739  40.981  -2.087  1.00 36.98      A    C
ATOM  27929  NZ   LYS J 259   -15.624  42.127  -2.297  1.00 36.33      A    N
ATOM  27930  C    LYS J 259    -8.858  39.454  -1.781  1.00 43.04      A    C
ATOM  27931  O    LYS J 259    -8.048  40.283  -1.562  1.00 42.93      A    O
ATOM  27932  N    PRO J 260    -8.681  38.531  -2.691  1.00 43.44      A    N
ATOM  27933  CA   PRO J 260    -7.375  38.147  -3.168  1.00 43.99      A    C
ATOM  27934  CB   PRO J 260    -7.584  36.711  -3.592  1.00 43.16      A    C
ATOM  27935  CG   PRO J 260    -8.931  36.601  -3.864  1.00 43.37      A    C
ATOM  27936  CD   PRO J 260    -9.607  37.417  -2.857  1.00 44.44      A    C
ATOM  27937  C    PRO J 260    -6.853  38.953  -4.316  1.00 43.55      A    C
```

Appendix 1

```
ATOM  27938  O    PRO J 260      -5.947  38.507  -4.932  1.00 45.09      A  O
ATOM  27939  N    TRP J 261      -7.389  40.120  -4.574  1.00 41.63      A  N
ATOM  27940  CA   TRP J 261      -6.888  40.904  -5.653  1.00 41.59      A  C
ATOM  27941  CB   TRP J 261      -7.980  41.177  -6.645  1.00 42.44      A  C
ATOM  27942  CG   TRP J 261      -8.571  39.986  -7.227  1.00 44.42      A  C
ATOM  27943  CD1  TRP J 261      -8.152  39.353  -8.299  1.00 45.36      A  C
ATOM  27944  NE1  TRP J 261      -8.934  38.295  -8.562  1.00 44.73      A  N
ATOM  27945  CE2  TRP J 261      -9.917  38.234  -7.626  1.00 44.94      A  C
ATOM  27946  CD2  TRP J 261      -9.723  39.292  -6.775  1.00 44.88      A  C
ATOM  27947  CE3  TRP J 261     -10.589  39.457  -5.718  1.00 41.54      A  C
ATOM  27948  CZ3  TRP J 261     -11.582  38.591  -5.575  1.00 43.12      A  C
ATOM  27949  CH2  TRP J 261     -11.757  37.548  -6.436  1.00 41.43      A  C
ATOM  27950  CZ2  TRP J 261     -10.933  37.346  -7.466  1.00 42.82      A  C
ATOM  27951  C    TRP J 261      -6.390  42.201  -5.110  1.00 41.29      A  C
ATOM  27952  O    TRP J 261      -6.959  42.735  -4.213  1.00 40.84      A  O
ATOM  27953  N    ILE J 262      -5.318  42.708  -5.681  1.00 40.47      A  N
ATOM  27954  CA   ILE J 262      -4.752  43.958  -5.238  1.00 40.12      A  C
ATOM  27955  CB   ILE J 262      -3.225  43.912  -5.145  1.00 40.47      A  C
ATOM  27956  CG1  ILE J 262      -2.607  43.483  -6.463  1.00 42.16      A  C
ATOM  27957  CD1  ILE J 262      -1.167  43.538  -6.491  1.00 40.01      A  C
ATOM  27958  CG2  ILE J 262      -2.795  42.968  -4.105  1.00 38.75      A  C
ATOM  27959  C    ILE J 262      -5.190  45.046  -6.168  1.00 39.72      A  C
ATOM  27960  O    ILE J 262      -5.176  44.870  -7.339  1.00 40.84      A  O
ATOM  27961  N    SER J 263      -5.601  46.163  -5.616  1.00 38.91      A  N
ATOM  27962  CA   SER J 263      -6.194  47.218  -6.386  1.00 37.47      A  C
ATOM  27963  CB   SER J 263      -7.455  47.655  -5.700  1.00 37.51      A  C
ATOM  27964  OG   SER J 263      -8.040  48.678  -6.436  1.00 37.10      A  O
ATOM  27965  C    SER J 263      -5.295  48.392  -6.438  1.00 36.79      A  C
ATOM  27966  O    SER J 263      -4.879  48.859  -5.431  1.00 35.68      A  O
ATOM  27967  N    ALA J 264      -4.969  48.852  -7.626  1.00 37.29      A  N
ATOM  27968  CA   ALA J 264      -4.123  50.010  -7.767  1.00 37.30      A  C
ATOM  27969  CB   ALA J 264      -3.804  50.191  -9.173  1.00 36.30      A  C
ATOM  27970  C    ALA J 264      -4.730  51.277  -7.234  1.00 38.10      A  C
ATOM  27971  O    ALA J 264      -4.114  51.978  -6.485  1.00 38.93      A  O
ATOM  27972  N    TYR J 265      -5.960  51.551  -7.611  1.00 37.83      A  N
ATOM  27973  CA   TYR J 265      -6.638  52.736  -7.183  1.00 37.67      A  C
ATOM  27974  CB   TYR J 265      -7.993  52.358  -7.883  1.00 38.50      A  C
ATOM  27975  CG   TYR J 265      -9.206  52.568  -7.058  1.00 37.94      A  C
ATOM  27976  CD1  TYR J 265      -9.821  53.541  -6.352  1.00 35.70      A  C
ATOM  27977  CE1  TYR J 265     -10.883  53.277  -5.624  1.00 34.42      A  C
ATOM  27978  CZ   TYR J 265     -11.378  52.054  -5.592  1.00 36.17      A  C
ATOM  27979  OH   TYR J 265     -12.458  51.810  -4.846  1.00 40.58      A  O
ATOM  27980  CE2  TYR J 265     -10.818  51.077  -6.281  1.00 37.14      A  C
ATOM  27981  CD2  TYR J 265      -9.751  51.329  -7.015  1.00 39.94      A  C
ATOM  27982  C    TYR J 265      -6.752  52.699  -5.688  1.00 37.81      A  C
ATOM  27983  O    TYR J 265      -6.620  53.681  -5.027  1.00 37.63      A  O
ATOM  27984  N    THR J 266      -6.992  51.543  -5.134  1.00 37.76      A  N
ATOM  27985  CA   THR J 266      -7.118  51.494  -3.723  1.00 37.62      A  C
ATOM  27986  CB   THR J 266      -7.507  50.126  -3.290  1.00 37.38      A  C
ATOM  27987  OG1  THR J 266      -8.777  49.832  -3.828  1.00 36.80      A  O
ATOM  27988  CG2  THR J 266      -7.611  50.075  -1.836  1.00 36.31      A  C
ATOM  27989  C    THR J 266      -5.829  51.883  -3.068  1.00 38.45      A  C
ATOM  27990  O    THR J 266      -5.804  52.692  -2.188  1.00 38.23      A  O
ATOM  27991  N    THR J 267      -4.749  51.307  -3.527  1.00 38.92      A  N
```

Appendix 1

```
ATOM  27992  CA   THR J 267   -3.458  51.622  -2.992  1.00 39.42      A  C
ATOM  27993  CB   THR J 267   -2.405  50.815  -3.689  1.00 39.09      A  C
ATOM  27994  OG1  THR J 267   -2.641  49.447  -3.456  1.00 43.61      A  O
ATOM  27995  CG2  THR J 267   -1.121  51.131  -3.143  1.00 40.46      A  C
ATOM  27996  C    THR J 267   -3.077  53.067  -3.191  1.00 38.34      A  C
ATOM  27997  O    THR J 267   -2.521  53.676  -2.339  1.00 37.72      A  O
ATOM  27998  N    ALA J 268   -3.320  53.602  -4.352  1.00 37.62      A  N
ATOM  27999  CA   ALA J 268   -2.860  54.924  -4.593  1.00 37.68      A  C
ATOM  28000  CB   ALA J 268   -3.092  55.256  -6.027  1.00 37.14      A  C
ATOM  28001  C    ALA J 268   -3.529  55.940  -3.696  1.00 38.69      A  C
ATOM  28002  O    ALA J 268   -2.904  56.319  -3.168  1.00 37.54      A  O
ATOM  28003  N    TRP J 269   -4.834  55.837  -3.581  1.00 39.36      A  N
ATOM  28004  CA   TRP J 269   -5.598  56.774  -2.828  1.00 40.50      A  C
ATOM  28005  CB   TRP J 269   -7.078  56.464  -3.035  1.00 41.18      A  C
ATOM  28006  CG   TRP J 269   -8.046  57.005  -2.048  1.00 43.24      A  C
ATOM  28007  CD1  TRP J 269   -7.768  57.675  -0.926  1.00 45.02      A  C
ATOM  28008  NE1  TRP J 269   -8.894  58.002  -0.274  1.00 46.45      A  N
ATOM  28009  CE2  TRP J 269   -9.957  57.545  -0.985  1.00 48.49      A  C
ATOM  28010  CD2  TRP J 269   -9.454  56.912  -2.113  1.00 46.92      A  C
ATOM  28011  CE3  TRP J 269  -10.344  56.350  -3.020  1.00 47.79      A  C
ATOM  28012  CZ3  TRP J 269  -11.650  56.428  -2.763  1.00 50.37      A  C
ATOM  28013  CH2  TRP J 269  -12.131  57.072  -1.630  1.00 50.52      A  C
ATOM  28014  CZ2  TRP J 269  -11.299  57.633  -0.730  1.00 47.85      A  C
ATOM  28015  C    TRP J 269   -5.177  56.658  -1.402  1.00 40.32      A  C
ATOM  28016  O    TRP J 269   -4.937  57.627  -0.735  1.00 40.34      A  O
ATOM  28017  N    THR J 270   -5.049  55.449  -0.930  1.00 39.87      A  N
ATOM  28018  CA   THR J 270   -4.631  55.254   0.429  1.00 40.78      A  C
ATOM  28019  CB   THR J 270   -4.658  53.790   0.753  1.00 41.11      A  C
ATOM  28020  OG1  THR J 270   -6.002  53.366   0.807  1.00 40.42      A  O
ATOM  28021  CG2  THR J 270   -4.056  53.574   2.057  1.00 42.30      A  C
ATOM  28022  C    THR J 270   -3.234  55.788   0.739  1.00 40.44      A  C
ATOM  28023  O    THR J 270   -3.018  56.390   1.742  1.00 38.83      A  O
ATOM  28024  N    LEU J 271   -2.283  55.547  -0.136  1.00 41.67      A  N
ATOM  28025  CA   LEU J 271   -0.929  55.994   0.080  1.00 43.16      A  C
ATOM  28026  CB   LEU J 271   -0.046  55.538  -1.054  1.00 42.80      A  C
ATOM  28027  CG   LEU J 271    0.948  54.425  -0.821  1.00 43.25      A  C
ATOM  28028  CD1  LEU J 271    0.492  53.541   0.264  1.00 41.07      A  C
ATOM  28029  CD2  LEU J 271    1.115  53.663  -2.058  1.00 38.59      A  C
ATOM  28030  C    LEU J 271   -0.834  57.472   0.141  1.00 44.12      A  C
ATOM  28031  O    LEU J 271   -0.182  58.010   0.991  1.00 44.87      A  O
ATOM  28032  N    ALA J 272   -1.484  58.138  -0.778  1.00 44.60      A  N
ATOM  28033  CA   ALA J 272   -1.427  59.571  -0.824  1.00 44.95      A  C
ATOM  28034  CB   ALA J 272   -2.128  60.087  -2.042  1.00 43.94      A  C
ATOM  28035  C    ALA J 272   -2.003  60.177   0.425  1.00 45.39      A  C
ATOM  28036  O    ALA J 272   -1.621  61.226   0.840  1.00 45.67      A  O
ATOM  28037  N    MET J 273   -2.992  59.556   0.998  1.00 46.05      A  N
ATOM  28038  CA   MET J 273   -3.449  60.014   2.268  1.00 48.10      A  C
ATOM  28039  CB   MET J 273   -4.863  59.599   2.524  1.00 49.27      J  C
ATOM  28040  CG   MET J 273   -5.743  60.787   2.508  1.00 52.46      J  C
ATOM  28041  SD   MET J 273   -7.396  60.312   2.378  1.00 56.87      J  S
ATOM  28042  CE   MET J 273   -7.593  60.255   0.634  1.00 57.73      J  C
ATOM  28043  C    MET J 273   -2.559  59.766   3.447  1.00 48.87      A  C
ATOM  28044  O    MET J 273   -2.484  60.564   4.334  1.00 48.81      A  O
ATOM  28045  N    VAL J 274   -1.894  58.630   3.474  1.00 50.01      A  N
```

Appendix 1

```
ATOM  28046  CA   VAL J 274   -1.024  58.328  4.587  1.00  50.06  A  C
ATOM  28047  CB   VAL J 274   -0.524  56.934  4.578  1.00  50.42  A  C
ATOM  28048  CG1  VAL J 274    0.603  56.833  5.535  1.00  50.01  A  C
ATOM  28049  CG2  VAL J 274   -1.621  56.015  4.963  1.00  48.70  A  C
ATOM  28050  C    VAL J 274    0.138  59.264  4.662  1.00  50.08  A  C
ATOM  28051  O    VAL J 274    0.632  59.543  5.710  1.00  49.87  A  O
ATOM  28052  N    HIS J 275    0.554  59.750  3.518  1.00  50.23  A  N
ATOM  28053  CA   HIS J 275    1.715  60.579  3.402  1.00  51.21  A  C
ATOM  28054  CB   HIS J 275    1.886  60.983  1.973  1.00  51.51  A  C
ATOM  28055  CG   HIS J 275    3.259  61.447  1.627  1.00  54.96  A  C
ATOM  28056  ND1  HIS J 275    3.548  62.758  1.353  1.00  55.02  A  N
ATOM  28057  CE1  HIS J 275    4.820  62.870  1.041  1.00  53.14  A  C
ATOM  28058  NE2  HIS J 275    5.370  61.679  1.109  1.00  52.86  A  N
ATOM  28059  CD2  HIS J 275    4.414  60.770  1.464  1.00  55.43  A  C
ATOM  28060  C    HIS J 275    1.486  61.794  4.234  1.00  51.32  A  C
ATOM  28061  O    HIS J 275    2.375  62.367  4.782  1.00  51.36  A  O
ATOM  28062  N    GLY J 276    0.252  62.199  4.307  1.00  51.19  A  N
ATOM  28063  CA   GLY J 276   -0.121  63.291  5.153  1.00  51.21  A  C
ATOM  28064  C    GLY J 276    0.143  62.955  6.583  1.00  51.63  A  C
ATOM  28065  O    GLY J 276    0.349  63.826  7.351  1.00  50.98  A  O
ATOM  28066  N    MET J 277    0.102  61.683  6.931  1.00  52.33  A  N
ATOM  28067  CA   MET J 277    0.245  61.287  8.308  1.00  53.42  A  C
ATOM  28068  CB   MET J 277   -0.913  60.382  8.715  1.00  53.83  J  C
ATOM  28069  CG   MET J 277   -2.233  61.110  8.792  1.00  56.82  J  C
ATOM  28070  SD   MET J 277   -3.633  60.042  8.846  1.00  59.66  J  S
ATOM  28071  CE   MET J 277   -3.503  59.250  7.278  1.00  55.51  J  C
ATOM  28072  C    MET J 277    1.572  60.659  8.650  1.00  53.11  A  C
ATOM  28073  O    MET J 277    2.163  61.030  9.618  1.00  53.75  A  O
ATOM  28074  N    ASP J 278    2.008  59.685  7.875  1.00  52.12  A  N
ATOM  28075  CA   ASP J 278    3.317  59.088  8.022  1.00  51.22  A  C
ATOM  28076  CB   ASP J 278    3.184  57.717  8.650  1.00  51.51  A  C
ATOM  28077  CG   ASP J 278    4.494  57.064  8.889  1.00  54.32  A  C
ATOM  28078  OD1  ASP J 278    5.506  57.729  8.785  1.00  58.73  A  O
ATOM  28079  OD2  ASP J 278    4.529  55.882  9.192  1.00  54.96  A  O-1
ATOM  28080  C    ASP J 278    3.989  58.976  6.680  1.00  50.48  A  C
ATOM  28081  O    ASP J 278    3.817  58.035  5.973  1.00  49.50  A  O
ATOM  28082  N    PRO J 279    4.789  59.949  6.341  1.00  50.34  A  N
ATOM  28083  CA   PRO J 279    5.388  60.015  5.028  1.00  50.16  A  C
ATOM  28084  CB   PRO J 279    6.219  61.274  5.105  1.00  50.55  A  C
ATOM  28085  CG   PRO J 279    5.569  62.066  6.057  1.00  50.41  A  C
ATOM  28086  CD   PRO J 279    5.061  61.164  7.097  1.00  50.37  A  C
ATOM  28087  C    PRO J 279    6.257  58.838  4.791  1.00  49.95  A  C
ATOM  28088  O    PRO J 279    6.364  58.379  3.698  1.00  49.39  A  O
ATOM  28089  N    ALA J 280    6.866  58.340  5.835  1.00  50.30  A  N
ATOM  28090  CA   ALA J 280    7.811  57.280  5.691  1.00  50.42  A  C
ATOM  28091  CB   ALA J 280    8.325  56.945  7.006  1.00  50.83  A  C
ATOM  28092  C    ALA J 280    7.129  56.091  5.102  1.00  50.36  A  C
ATOM  28093  O    ALA J 280    7.666  55.422  4.259  1.00  49.89  A  O
ATOM  28094  N    PHE J 281    5.919  55.842  5.567  1.00  50.60  A  N
ATOM  28095  CA   PHE J 281    5.123  54.700  5.171  1.00  49.76  A  C
ATOM  28096  CB   PHE J 281    3.814  54.798  5.943  1.00  49.84  A  C
ATOM  28097  CG   PHE J 281    2.870  53.667  5.737  1.00  49.33  A  C
ATOM  28098  CD1  PHE J 281    2.690  52.750  6.708  1.00  47.69  A  C
ATOM  28099  CE1  PHE J 281    1.839  51.748  6.547  1.00  47.77  A  C
```

Appendix 1

```
ATOM  28100  CZ   PHE J 281    1.133  51.647   5.440  1.00  47.44      A  C
ATOM  28101  CE2  PHE J 281    1.270  52.554   4.473  1.00  49.18      A  C
ATOM  28102  CD2  PHE J 281    2.115  53.568   4.617  1.00  47.59      A  C
ATOM  28103  C    PHE J 281    4.851  54.765   3.697  1.00  49.78      A  C
ATOM  28104  O    PHE J 281    5.034  53.821   2.994  1.00  48.88      A  O
ATOM  28105  N    SER J 282    4.438  55.915   3.228  1.00  49.85      A  N
ATOM  28106  CA   SER J 282    4.184  56.071   1.837  1.00  50.70      A  C
ATOM  28107  CB   SER J 282    3.630  57.444   1.581  1.00  50.81      A  C
ATOM  28108  OG   SER J 282    2.245  57.415   1.662  1.00  52.89      A  O
ATOM  28109  C    SER J 282    5.429  55.895   1.029  1.00  51.26      A  C
ATOM  28110  O    SER J 282    5.398  55.312  -0.020  1.00  51.07      A  O
ATOM  28111  N    GLU J 283    6.526  56.426   1.535  1.00  52.16      A  N
ATOM  28112  CA   GLU J 283    7.757  56.524   0.793  1.00  52.65      A  C
ATOM  28113  CB   GLU J 283    8.733  57.407   1.557  1.00  52.72      A  C
ATOM  28114  CG   GLU J 283    8.464  58.864   1.439  1.00  56.28      A  C
ATOM  28115  CD   GLU J 283    9.377  59.721   2.278  1.00  63.28      A  C
ATOM  28116  OE1  GLU J 283   10.287  59.186   2.932  1.00  62.96      A  O
ATOM  28117  OE2  GLU J 283    9.190  60.944   2.280  1.00  64.40      A  O-1
ATOM  28118  C    GLU J 283    8.402  55.203   0.381  1.00  52.25      A  C
ATOM  28119  O    GLU J 283    8.934  55.104  -0.699  1.00  51.27      A  O
ATOM  28120  N    ARG J 284    8.408  54.223   1.266  1.00  52.25      A  N
ATOM  28121  CA   ARG J 284    8.882  52.891   0.952  1.00  52.50      A  C
ATOM  28122  CB   ARG J 284    9.095  52.107   2.239  1.00  53.75      A  C
ATOM  28123  CG   ARG J 284    7.895  51.943   3.103  1.00  55.46      A  C
ATOM  28124  CD   ARG J 284    8.180  51.051   4.281  1.00  63.04      A  C
ATOM  28125  NE   ARG J 284    8.644  49.717   3.912  1.00  69.36      A  N
ATOM  28126  CZ   ARG J 284    8.628  48.673   4.734  1.00  72.38      A  C
ATOM  28127  NH1  ARG J 284    8.167  48.821   5.952  1.00  72.10      A  N
ATOM  28128  NH2  ARG J 284    9.065  47.485   4.341  1.00  71.85      A  N
ATOM  28129  C    ARG J 284    8.088  52.056  -0.013  1.00  51.46      A  C
ATOM  28130  O    ARG J 284    8.636  51.409  -0.878  1.00  52.26      A  O
ATOM  28131  N    TYR J 285    6.785  52.034   0.170  1.00  50.43      A  N
ATOM  28132  CA   TYR J 285    5.861  51.359  -0.732  1.00  48.66      A  C
ATOM  28133  CB   TYR J 285    4.494  51.183  -0.108  1.00  47.20      A  C
ATOM  28134  CG   TYR J 285    4.572  50.357   1.110  1.00  47.05      A  C
ATOM  28135  CD1  TYR J 285    4.951  49.060   1.040  1.00  46.66      A  C
ATOM  28136  CE1  TYR J 285    5.054  48.318   2.145  1.00  47.95      A  C
ATOM  28137  CZ   TYR J 285    4.774  48.855   3.351  1.00  48.54      A  C
ATOM  28138  OH   TYR J 285    4.869  48.083   4.462  1.00  48.66      A  O
ATOM  28139  CE2  TYR J 285    4.405  50.145   3.455  1.00  45.99      A  C
ATOM  28140  CD2  TYR J 285    4.307  50.888   2.343  1.00  47.40      A  C
ATOM  28141  C    TYR J 285    5.776  51.961  -2.100  1.00  47.63      A  C
ATOM  28142  O    TYR J 285    5.637  51.268  -3.061  1.00  47.67      A  O
ATOM  28143  N    TYR J 286    5.914  53.260  -2.183  1.00  46.16      A  N
ATOM  28144  CA   TYR J 286    5.557  53.946  -3.378  1.00  46.99      A  C
ATOM  28145  CB   TYR J 286    5.771  55.447  -3.190  1.00  46.39      A  C
ATOM  28146  CG   TYR J 286    5.557  56.285  -4.426  1.00  46.37      A  C
ATOM  28147  CD1  TYR J 286    4.522  56.043  -5.294  1.00  44.50      A  C
ATOM  28148  CE1  TYR J 286    4.334  56.801  -6.389  1.00  43.27      A  C
ATOM  28149  CZ   TYR J 286    5.177  57.811  -6.648  1.00  44.96      A  C
ATOM  28150  OH   TYR J 286    5.008  58.578  -7.744  1.00  43.51      A  O
ATOM  28151  CE2  TYR J 286    6.201  58.072  -5.819  1.00  47.62      A  C
ATOM  28152  CD2  TYR J 286    6.389  57.315  -4.715  1.00  46.75      A  C
ATOM  28153  C    TYR J 286    6.319  53.474  -4.583  1.00  47.28      A  C
```

Appendix 1

```
ATOM  28154  O    TYR J 286      5.733  53.234  -5.604  1.00 48.08      A   O
ATOM  28155  N    PRO J 287      7.616  53.314  -4.483  1.00 47.00      A   N
ATOM  28156  CA   PRO J 287      8.383  52.883  -5.638  1.00 47.04      A   C
ATOM  28157  CB   PRO J 287      9.780  52.832  -5.082  1.00 46.70      A   C
ATOM  28158  CG   PRO J 287      9.764  53.808  -4.068  1.00 47.55      A   C
ATOM  28159  CD   PRO J 287      8.493  53.759  -3.411  1.00 45.82      A   C
ATOM  28160  C    PRO J 287      7.956  51.518  -6.100  1.00 46.21      A   C
ATOM  28161  O    PRO J 287      7.906  51.223  -7.259  1.00 45.70      A   O
ATOM  28162  N    ARG J 288      7.688  50.672  -5.144  1.00 46.63      A   N
ATOM  28163  CA   ARG J 288      7.280  49.322  -5.405  1.00 48.91      A   C
ATOM  28164  CB   ARG J 288      7.309  48.510  -4.121  1.00 48.62      A   C
ATOM  28165  CG   ARG J 288      8.570  47.723  -3.957  1.00 53.24      A   C
ATOM  28166  CD   ARG J 288      8.671  47.144  -2.588  1.00 61.29      A   C
ATOM  28167  NE   ARG J 288      9.609  47.850  -1.731  1.00 64.94      A   N
ATOM  28168  CZ   ARG J 288      9.730  47.642  -0.433  1.00 66.38      A   C
ATOM  28169  NH1  ARG J 288      8.985  46.742   0.159  1.00 66.87      A   N
ATOM  28170  NH2  ARG J 288     10.601  48.329   0.265  1.00 66.41      A   N
ATOM  28171  C    ARG J 288      5.941  49.276  -6.123  1.00 49.21      A   C
ATOM  28172  O    ARG J 288      5.693  48.416  -6.928  1.00 48.16      A   O
ATOM  28173  N    PHE J 289      5.085  50.225  -5.794  1.00 49.38      A   N
ATOM  28174  CA   PHE J 289      3.782  50.354  -6.386  1.00 49.72      A   C
ATOM  28175  CB   PHE J 289      3.077  51.513  -5.706  1.00 50.03      A   C
ATOM  28176  CG   PHE J 289      1.888  52.020  -6.431  1.00 50.18      A   C
ATOM  28177  CD1  PHE J 289      0.654  51.512  -6.181  1.00 51.20      A   C
ATOM  28178  CE1  PHE J 289     -0.414  51.974  -6.815  1.00 48.54      A   C
ATOM  28179  CZ   PHE J 289     -0.297  52.955  -7.692  1.00 47.96      A   C
ATOM  28180  CE2  PHE J 289      0.905  53.494  -7.953  1.00 49.09      A   C
ATOM  28181  CD2  PHE J 289      1.992  53.039  -7.318  1.00 50.33      A   C
ATOM  28182  C    PHE J 289      3.882  50.640  -7.844  1.00 49.53      A   C
ATOM  28183  O    PHE J 289      3.170  50.090  -8.653  1.00 48.91      A   O
ATOM  28184  N    LYS J 290      4.780  51.536  -8.172  1.00 49.50      A   N
ATOM  28185  CA   LYS J 290      5.020  51.857  -9.545  1.00 49.65      A   C
ATOM  28186  CB   LYS J 290      6.037  52.968  -9.652  1.00 50.21      A   C
ATOM  28187  CG   LYS J 290      5.459  54.299  -9.893  1.00 50.98      A   C
ATOM  28188  CD   LYS J 290      5.565  55.142  -8.689  1.00 52.38      A   C
ATOM  28189  CE   LYS J 290      6.901  55.739  -8.594  1.00 57.07      A   C
ATOM  28190  NZ   LYS J 290      6.898  57.074  -9.184  1.00 59.06      A   N
ATOM  28191  C    LYS J 290      5.531  50.645 -10.253  1.00 48.66      A   C
ATOM  28192  O    LYS J 290      5.105  50.356 -11.321  1.00 47.94      A   O
ATOM  28193  N    GLN J 291      6.439  49.900  -9.662  1.00 48.61      A   N
ATOM  28194  CA   GLN J 291      6.933  48.804 -10.430  1.00 48.29      A   C
ATOM  28195  CB   GLN J 291      8.033  48.022  -9.701  1.00 48.98      A   C
ATOM  28196  CG   GLN J 291      7.961  46.481  -9.796  1.00 54.13      A   C
ATOM  28197  CD   GLN J 291      9.011  45.794 -10.714  1.00 60.91      A   C
ATOM  28198  OE1  GLN J 291      8.758  45.538 -11.890  1.00 61.17      A   O
ATOM  28199  NE2  GLN J 291     10.154  45.446 -10.149  1.00 61.25      A   N
ATOM  28200  C    GLN J 291      5.720  47.994 -10.678  1.00 46.83      A   C
ATOM  28201  O    GLN J 291      5.497  47.576 -11.778  1.00 46.81      A   O
ATOM  28202  N    THR J 292      4.900  47.794  -9.666  1.00 45.48      A   N
ATOM  28203  CA   THR J 292      3.729  46.957  -9.857  1.00 44.60      A   C
ATOM  28204  CB   THR J 292      3.073  46.668  -8.550  1.00 44.72      A   C
ATOM  28205  OG1  THR J 292      4.007  46.014  -7.704  1.00 47.32      A   O
ATOM  28206  CG2  THR J 292      1.947  45.764  -8.769  1.00 45.93      A   C
ATOM  28207  C    THR J 292      2.621  47.397 -10.787  1.00 41.97      A   C
```

Appendix 1

```
ATOM  28208  O    THR J 292    2.218  46.646 -11.624  1.00 41.35      A  O
ATOM  28209  N    PHE J 293    2.107  48.595 -10.631  1.00 39.12      A  N
ATOM  28210  CA   PHE J 293    0.951  48.955 -11.423  1.00 38.09      A  C
ATOM  28211  CB   PHE J 293   -0.087  49.608 -10.546  1.00 37.11      A  C
ATOM  28212  CG   PHE J 293   -0.640  48.719  -9.491  1.00 35.31      A  C
ATOM  28213  CD1  PHE J 293   -1.233  47.553  -9.806  1.00 34.09      A  C
ATOM  28214  CE1  PHE J 293   -1.738  46.778  -8.865  1.00 34.17      A  C
ATOM  28215  CZ   PHE J 293   -1.680  47.148  -7.602  1.00 37.70      A  C
ATOM  28216  CE2  PHE J 293   -1.111  48.298  -7.261  1.00 38.56      A  C
ATOM  28217  CD2  PHE J 293   -0.604  49.081  -8.192  1.00 35.33      A  C
ATOM  28218  C    PHE J 293    1.155  49.771 -12.683  1.00 38.70      A  C
ATOM  28219  O    PHE J 293    0.503  49.559 -13.651  1.00 38.15      A  O
ATOM  28220  N    VAL J 294    2.071  50.710 -12.645  1.00 39.19      A  N
ATOM  28221  CA   VAL J 294    2.264  51.696 -13.681  1.00 39.54      A  C
ATOM  28222  CB   VAL J 294    3.148  52.768 -13.152  1.00 38.29      A  C
ATOM  28223  CG1  VAL J 294    3.161  53.904 -14.030  1.00 37.02      A  C
ATOM  28224  CG2  VAL J 294    2.693  53.178 -11.859  1.00 39.73      A  C
ATOM  28225  C    VAL J 294    2.865  51.184 -14.964  1.00 41.61      A  C
ATOM  28226  O    VAL J 294    3.722  50.358 -14.951  1.00 42.35      A  O
ATOM  28227  N    GLU J 295    2.409  51.708 -16.084  1.00 43.07      A  N
ATOM  28228  CA   GLU J 295    3.056  51.461 -17.349  1.00 44.39      A  C
ATOM  28229  CB   GLU J 295    2.277  50.470 -18.185  1.00 44.00      A  C
ATOM  28230  CG   GLU J 295    2.373  50.678 -19.640  1.00 45.45      A  C
ATOM  28231  CD   GLU J 295    1.380  49.868 -20.370  1.00 53.37      A  C
ATOM  28232  OE1  GLU J 295    1.159  48.735 -19.974  1.00 58.48      A  O
ATOM  28233  OE2  GLU J 295    0.800  50.334 -21.337  1.00 53.61      A  O-1
ATOM  28234  C    GLU J 295    3.359  52.732 -18.130  1.00 45.00      A  C
ATOM  28235  O    GLU J 295    2.515  53.577 -18.305  1.00 45.22      A  O
ATOM  28236  N    VAL J 296    4.588  52.832 -18.613  1.00 44.41      A  N
ATOM  28237  CA   VAL J 296    5.068  53.978 -19.335  1.00 44.45      A  C
ATOM  28238  CB   VAL J 296    6.489  54.252 -18.928  1.00 44.43      A  C
ATOM  28239  CG1  VAL J 296    7.062  55.308 -19.741  1.00 44.53      A  C
ATOM  28240  CG2  VAL J 296    6.548  54.620 -17.493  1.00 42.94      A  C
ATOM  28241  C    VAL J 296    5.009  53.647 -20.792  1.00 45.11      A  C
ATOM  28242  O    VAL J 296    5.414  52.597 -21.157  1.00 45.38      A  O
ATOM  28243  N    TYR J 297    4.435  54.496 -21.620  1.00 46.51      A  N
ATOM  28244  CA   TYR J 297    4.243  54.097 -22.996  1.00 48.33      A  C
ATOM  28245  CB   TYR J 297    2.881  53.463 -23.172  1.00 47.74      A  C
ATOM  28246  CG   TYR J 297    1.710  54.391 -23.122  1.00 48.88      A  C
ATOM  28247  CD1  TYR J 297    1.125  54.830 -24.264  1.00 49.73      A  C
ATOM  28248  CE1  TYR J 297    0.079  55.624 -24.232  1.00 51.03      A  C
ATOM  28249  CZ   TYR J 297   -0.427  56.005 -23.051  1.00 52.94      A  C
ATOM  28250  OH   TYR J 297   -1.501  56.820 -23.063  1.00 52.61      A  O
ATOM  28251  CE2  TYR J 297    0.115  55.587 -21.895  1.00 50.48      A  C
ATOM  28252  CD2  TYR J 297    1.170  54.783 -21.933  1.00 51.08      A  C
ATOM  28253  C    TYR J 297    4.538  54.918 -24.236  1.00 50.33      A  C
ATOM  28254  O    TYR J 297    4.415  54.384 -25.295  1.00 50.75      A  O
ATOM  28255  N    ASP J 298    4.902  56.178 -24.197  1.00 52.24      A  N
ATOM  28256  CA   ASP J 298    5.083  56.784 -25.511  1.00 53.77      A  C
ATOM  28257  CB   ASP J 298    3.987  57.791 -25.844  1.00 54.08      A  C
ATOM  28258  CG   ASP J 298    3.940  58.141 -27.316  1.00 55.78      A  C
ATOM  28259  OD1  ASP J 298    3.015  57.751 -28.013  1.00 53.27      A  O
ATOM  28260  OD2  ASP J 298    4.835  58.813 -27.793  1.00 59.21      A  O
ATOM  28261  C    ASP J 298    6.446  57.402 -25.600  1.00 54.22      A  C
```

Appendix 1

```
ATOM  28262  O    ASP J 298    6.613   58.590  -25.714  1.00  53.62    A   O
ATOM  28263  N    GLU J 299    7.416   56.506  -25.561  1.00  55.10    A   N
ATOM  28264  CA   GLU J 299    8.813   56.812  -25.486  1.00  55.81    A   C
ATOM  28265  CB   GLU J 299    9.288   57.490  -26.748  1.00  57.09    A   C
ATOM  28266  CG   GLU J 299    9.693   56.494  -27.832  1.00  61.20    A   C
ATOM  28267  CD   GLU J 299    9.318   56.936  -29.231  1.00  66.08    A   C
ATOM  28268  OE1  GLU J 299    9.892   57.918  -29.713  1.00  65.41    A   O
ATOM  28269  OE2  GLU J 299    8.460   56.297  -29.852  1.00  66.44    A   O
ATOM  28270  C    GLU J 299    9.054   57.625  -24.261  1.00  55.08    A   C
ATOM  28271  O    GLU J 299    9.878   58.505  -24.230  1.00  55.93    A   O
ATOM  28272  N    GLY J 300    8.321   57.272  -23.228  1.00  53.79    A   N
ATOM  28273  CA   GLY J 300    8.458   57.841  -21.913  1.00  51.99    A   C
ATOM  28274  C    GLY J 300    7.532   58.990  -21.690  1.00  51.01    A   C
ATOM  28275  O    GLY J 300    7.365   59.472  -20.608  1.00  49.54    A   O
ATOM  28276  N    ARG J 301    6.900   59.405  -22.752  1.00  50.65    A   N
ATOM  28277  CA   ARG J 301    5.969   60.493  -22.714  1.00  50.69    A   C
ATOM  28278  CB   ARG J 301    5.717   60.999  -24.118  1.00  51.72    A   C
ATOM  28279  CG   ARG J 301    6.767   61.951  -24.598  1.00  52.07    A   C
ATOM  28280  CD   ARG J 301    6.492   62.400  -25.997  1.00  54.91    A   C
ATOM  28281  NE   ARG J 301    6.416   61.278  -26.906  1.00  58.22    A   N
ATOM  28282  CZ   ARG J 301    7.266   61.065  -27.895  1.00  60.59    A   C
ATOM  28283  NH1  ARG J 301    8.253   61.904  -28.101  1.00  59.24    A   N
ATOM  28284  NH2  ARG J 301    7.126   60.012  -28.676  1.00  58.16    A   N
ATOM  28285  C    ARG J 301    4.675   60.268  -21.932  1.00  50.13    A   C
ATOM  28286  O    ARG J 301    4.117   61.190  -21.414  1.00  50.56    A   O
ATOM  28287  N    LYS J 302    4.214   59.041  -21.835  1.00  49.24    A   N
ATOM  28288  CA   LYS J 302    2.910   58.771  -21.273  1.00  48.34    A   C
ATOM  28289  CB   LYS J 302    1.942   58.471  -22.385  1.00  49.04    A   C
ATOM  28290  CG   LYS J 302    1.453   59.694  -23.076  1.00  48.58    A   C
ATOM  28291  CD   LYS J 302    0.974   59.395  -24.420  1.00  44.83    A   C
ATOM  28292  CE   LYS J 302    0.354   60.588  -24.993  1.00  43.64    A   C
ATOM  28293  NZ   LYS J 302    0.163   60.472  -26.429  1.00  45.83    A   N
ATOM  28294  C    LYS J 302    2.855   57.665  -20.248  1.00  47.88    A   C
ATOM  28295  O    LYS J 302    3.755   56.878  -20.132  1.00  49.15    A   O
ATOM  28296  N    ALA J 303    1.786   57.622  -19.488  1.00  45.38    A   N
ATOM  28297  CA   ALA J 303    1.609   56.531  -18.570  1.00  42.95    A   C
ATOM  28298  CB   ALA J 303    2.286   56.847  -17.314  1.00  43.39    A   C
ATOM  28299  C    ALA J 303    0.157   56.207  -18.331  1.00  41.07    A   C
ATOM  28300  O    ALA J 303   -0.665   57.071  -18.434  1.00  41.26    A   O
ATOM  28301  N    ARG J 304   -0.129   54.948  -18.026  1.00  38.30    A   N
ATOM  28302  CA   ARG J 304   -1.464   54.454  -17.695  1.00  36.12    A   C
ATOM  28303  CB   ARG J 304   -2.184   53.935  -18.934  1.00  34.63    A   C
ATOM  28304  CG   ARG J 304   -1.462   52.876  -19.698  1.00  33.01    A   C
ATOM  28305  CD   ARG J 304   -2.025   52.746  -21.071  1.00  37.39    A   C
ATOM  28306  NE   ARG J 304   -1.240   51.898  -21.952  1.00  41.33    A   N
ATOM  28307  CZ   ARG J 304   -1.089   52.096  -23.246  1.00  39.72    A   C
ATOM  28308  NH1  ARG J 304   -1.672   53.085  -23.829  1.00  40.86    A   N
ATOM  28309  NH2  ARG J 304   -0.375   51.288  -23.967  1.00  41.37    A   N
ATOM  28310  C    ARG J 304   -1.332   53.370  -16.638  1.00  35.98    A   C
ATOM  28311  O    ARG J 304   -0.357   52.696  -16.598  1.00  36.07    A   O
ATOM  28312  N    VAL J 305   -2.295   53.204  -15.756  1.00  35.35    A   N
ATOM  28313  CA   VAL J 305   -2.082   52.355  -14.600  1.00  34.82    A   C
ATOM  28314  CB   VAL J 305   -2.332   53.146  -13.331  1.00  34.88    A   C
ATOM  28315  CG1  VAL J 305   -1.916   52.412  -12.158  1.00  35.41    A   C
```

Appendix 1

```
ATOM  28316  CG2  VAL  J  305   -1.602  54.400  -13.367  1.00  32.63  A  C
ATOM  28317  C    VAL  J  305   -2.921  51.097  -14.576  1.00  34.26  A  C
ATOM  28318  O    VAL  J  305   -4.085  51.146  -14.674  1.00  34.74  A  O
ATOM  28319  N    ARG  J  306   -2.311  49.951  -14.449  1.00  35.03  A  N
ATOM  28320  CA   ARG  J  306   -3.065  48.739  -14.353  1.00  36.30  A  C
ATOM  28321  CB   ARG  J  306   -2.133  47.557  -14.464  1.00  35.85  A  C
ATOM  28322  CG   ARG  J  306   -1.952  47.042  -15.847  1.00  37.76  A  C
ATOM  28323  CD   ARG  J  306   -0.524  46.690  -16.134  1.00  46.28  A  C
ATOM  28324  NE   ARG  J  306    0.229  46.511  -14.902  1.00  51.93  A  N
ATOM  28325  CZ   ARG  J  306    1.460  46.944  -14.687  1.00  52.50  A  C
ATOM  28326  NH1  ARG  J  306    2.116  47.576  -15.622  1.00  53.16  A  N
ATOM  28327  NH2  ARG  J  306    2.026  46.747  -13.519  1.00  52.49  A  N
ATOM  28328  C    ARG  J  306   -3.730  48.721  -13.020  1.00  36.77  A  C
ATOM  28329  O    ARG  J  306   -3.108  49.001  -12.050  1.00  36.75  A  O
ATOM  28330  N    GLU  J  307   -5.028  48.482  -12.981  1.00  37.63  A  N
ATOM  28331  CA   GLU  J  307   -5.790  48.393  -11.726  1.00  37.75  A  C
ATOM  28332  CB   GLU  J  307   -7.276  48.597  -11.982  1.00  37.30  A  C
ATOM  28333  CG   GLU  J  307   -8.180  48.116  -10.933  1.00  36.28  A  C
ATOM  28334  CD   GLU  J  307   -8.133  48.923   -9.697  1.00  37.93  A  C
ATOM  28335  OE1  GLU  J  307   -7.544  49.979   -9.731  1.00  40.04  A  O
ATOM  28336  OE2  GLU  J  307   -8.673  48.487   -8.689  1.00  30.22  A  O
ATOM  28337  C    GLU  J  307   -5.506  47.188  -10.814  1.00  38.14  A  C
ATOM  28338  O    GLU  J  307   -5.478  47.292   -9.610  1.00  37.28  A  O
ATOM  28339  N    THR  J  308   -5.257  46.051  -11.420  1.00  39.43  A  N
ATOM  28340  CA   THR  J  308   -4.983  44.852  -10.677  1.00  41.22  A  C
ATOM  28341  CB   THR  J  308   -6.228  44.057  -10.454  1.00  40.53  A  C
ATOM  28342  OG1  THR  J  308   -6.065  43.292   -9.269  1.00  42.11  A  O
ATOM  28343  CG2  THR  J  308   -6.455  43.168  -11.582  1.00  35.37  A  C
ATOM  28344  C    THR  J  308   -3.869  43.987  -11.265  1.00  43.91  A  C
ATOM  28345  O    THR  J  308   -3.420  44.206  -12.341  1.00  45.53  A  O
ATOM  28346  N    ALA  J  309   -3.430  43.004  -10.511  1.00  46.27  A  N
ATOM  28347  CA   ALA  J  309   -2.239  42.229  -10.782  1.00  47.97  A  C
ATOM  28348  CB   ALA  J  309   -1.883  41.447   -9.589  1.00  47.64  A  C
ATOM  28349  C    ALA  J  309   -2.186  41.341  -12.001  1.00  49.63  A  C
ATOM  28350  O    ALA  J  309   -1.127  40.991  -12.459  1.00  51.92  A  O
ATOM  28351  N    GLY  J  310   -3.297  40.897  -12.508  1.00  49.56  A  N
ATOM  28352  CA   GLY  J  310   -3.199  39.797  -13.420  1.00  49.89  A  C
ATOM  28353  C    GLY  J  310   -3.143  40.142  -14.868  1.00  50.63  A  C
ATOM  28354  O    GLY  J  310   -3.320  39.297  -15.695  1.00  50.20  A  O
ATOM  28355  N    THR  J  311   -2.946  41.395  -15.177  1.00  50.67  A  N
ATOM  28356  CA   THR  J  311   -3.357  41.851  -16.458  1.00  51.17  A  C
ATOM  28357  CB   THR  J  311   -4.752  42.434  -16.356  1.00  51.18  A  C
ATOM  28358  OG1  THR  J  311   -5.093  43.057  -17.591  1.00  50.41  A  O
ATOM  28359  CG2  THR  J  311   -4.808  43.447  -15.292  1.00  47.99  A  C
ATOM  28360  C    THR  J  311   -2.465  42.863  -17.091  1.00  52.63  A  C
ATOM  28361  O    THR  J  311   -1.687  43.498  -16.448  1.00  53.40  A  O
ATOM  28362  N    ASP  J  312   -2.622  43.022  -18.384  1.00  53.89  A  N
ATOM  28363  CA   ASP  J  312   -1.958  44.058  -19.123  1.00  54.97  A  C
ATOM  28364  CB   ASP  J  312   -1.386  43.498  -20.405  1.00  55.49  A  C
ATOM  28365  CG   ASP  J  312   -0.361  42.432  -20.156  1.00  59.37  A  C
ATOM  28366  OD1  ASP  J  312    0.130  42.298  -19.019  1.00  60.94  A  O
ATOM  28367  OD2  ASP  J  312   -0.050  41.704  -21.093  1.00  61.83  A  O-1
ATOM  28368  C    ASP  J  312   -2.926  45.166  -19.434  1.00  54.98  A  C
ATOM  28369  O    ASP  J  312   -2.658  46.017  -20.238  1.00  55.05  A  O
```

Appendix 1

```
ATOM  28370  N    ASP J 313      -4.065  45.174 -18.777  1.00 55.12       A  N
ATOM  28371  CA   ASP J 313      -5.118  46.069 -19.177  1.00 54.74       A  C
ATOM  28372  CB   ASP J 313      -6.461  45.395 -19.001  1.00 55.19       A  C
ATOM  28373  CG   ASP J 313      -6.912  44.672 -20.224  1.00 56.37       A  C
ATOM  28374  OD1  ASP J 313      -7.412  45.309 -21.122  1.00 55.40       A  O
ATOM  28375  OD2  ASP J 313      -6.785  43.460 -20.303  1.00 62.35       A  O-1
ATOM  28376  C    ASP J 313      -5.149  47.396 -18.481  1.00 54.19       A  C
ATOM  28377  O    ASP J 313      -5.137  47.490 -17.287  1.00 53.46       A  O
ATOM  28378  N    ALA J 314      -5.171  48.429 -19.297  1.00 54.17       A  N
ATOM  28379  CA   ALA J 314      -5.705  49.732 -18.986  1.00 53.25       A  C
ATOM  28380  CB   ALA J 314      -6.949  49.955 -19.766  1.00 54.75       A  C
ATOM  28381  C    ALA J 314      -5.994  50.011 -17.567  1.00 51.30       A  C
ATOM  28382  O    ALA J 314      -5.171  49.852 -16.732  1.00 52.58       A  O
ATOM  28383  N    ASP J 315      -7.198  50.494 -17.350  1.00 48.96       A  N
ATOM  28384  CA   ASP J 315      -7.695  50.971 -16.086  1.00 46.85       A  C
ATOM  28385  CB   ASP J 315      -8.168  52.404 -16.195  1.00 46.46       A  C
ATOM  28386  CG   ASP J 315      -7.104  53.418 -15.920  1.00 48.06       A  C
ATOM  28387  OD1  ASP J 315      -6.884  53.759 -14.752  1.00 44.29       A  O
ATOM  28388  OD2  ASP J 315      -6.519  53.905 -16.892  1.00 44.84       A  O
ATOM  28389  C    ASP J 315      -8.957  50.228 -15.899  1.00 45.90       A  C
ATOM  28390  O    ASP J 315      -9.988  50.770 -16.177  1.00 45.35       A  O
ATOM  28391  N    GLY J 316      -8.888  49.014 -15.390  1.00 43.26       A  N
ATOM  28392  CA   GLY J 316     -10.052  48.209 -15.176  1.00 41.50       A  C
ATOM  28393  C    GLY J 316     -10.700  48.580 -13.878  1.00 41.05       A  C
ATOM  28394  O    GLY J 316     -10.509  49.657 -13.416  1.00 39.03       A  O
ATOM  28395  N    GLY J 317     -11.495  47.689 -13.313  1.00 40.84       A  N
ATOM  28396  CA   GLY J 317     -12.215  47.949 -12.082  1.00 39.66       A  C
ATOM  28397  C    GLY J 317     -13.171  49.106 -12.139  1.00 39.90       A  C
ATOM  28398  O    GLY J 317     -13.986  49.206 -13.013  1.00 40.82       A  O
ATOM  28399  N    VAL J 318     -13.046  49.997 -11.192  1.00 38.68       A  N
ATOM  28400  CA   VAL J 318     -13.734  51.254 -11.242  1.00 36.90       A  C
ATOM  28401  CB   VAL J 318     -13.755  51.949  -9.902  1.00 36.96       A  C
ATOM  28402  CG1  VAL J 318     -14.296  51.041  -8.862  1.00 34.16       A  C
ATOM  28403  CG2  VAL J 318     -12.417  52.435  -9.535  1.00 36.30       A  C
ATOM  28404  C    VAL J 318     -13.272  52.183 -12.360  1.00 37.51       A  C
ATOM  28405  O    VAL J 318     -14.034  52.971 -12.815  1.00 38.48       A  O
ATOM  28406  N    GLY J 319     -12.045  52.065 -12.836  1.00 37.21       A  N
ATOM  28407  CA   GLY J 319     -11.511  53.012 -13.798  1.00 34.41       A  C
ATOM  28408  C    GLY J 319     -10.709  54.173 -13.278  1.00 34.41       A  C
ATOM  28409  O    GLY J 319     -10.515  55.133 -13.939  1.00 34.83       A  O
ATOM  28410  N    LEU J 320     -10.247  54.084 -12.060  1.00 33.92       A  N
ATOM  28411  CA   LEU J 320      -9.698  55.228 -11.423  1.00 33.01       A  C
ATOM  28412  CB   LEU J 320     -10.508  55.506 -10.179  1.00 33.20       A  C
ATOM  28413  CG   LEU J 320     -11.955  55.868 -10.422  1.00 34.84       A  C
ATOM  28414  CD1  LEU J 320     -12.604  56.245  -9.164  1.00 36.68       A  C
ATOM  28415  CD2  LEU J 320     -12.033  56.966 -11.342  1.00 36.86       A  C
ATOM  28416  C    LEU J 320      -8.240  55.132 -11.099  1.00 32.62       A  C
ATOM  28417  O    LEU J 320      -7.703  55.993 -10.482  1.00 32.28       A  O
ATOM  28418  N    ALA J 321      -7.587  54.078 -11.501  1.00 32.56       A  N
ATOM  28419  CA   ALA J 321      -6.210  53.953 -11.124  1.00 33.07       A  C
ATOM  28420  CB   ALA J 321      -5.685  52.651 -11.576  1.00 31.99       A  C
ATOM  28421  C    ALA J 321      -5.320  55.045 -11.651  1.00 32.84       A  C
ATOM  28422  O    ALA J 321      -4.627  55.647 -10.892  1.00 31.81       A  O
ATOM  28423  N    SER J 322      -5.348  55.334 -12.932  1.00 32.21       A  N
```

Appendix 1

```
ATOM  28424  CA   SER J 322    -4.516  56.387 -13.424  1.00 32.46      A  C
ATOM  28425  CB   SER J 322    -4.721  56.578 -14.890  1.00 33.11      A  C
ATOM  28426  OG   SER J 322    -4.310  55.472 -15.586  1.00 34.45      A  O
ATOM  28427  C    SER J 322    -4.839  57.688 -12.774  1.00 33.50      A  C
ATOM  28428  O    SER J 322    -3.962  58.386 -12.362  1.00 34.98      A  O
ATOM  28429  N    ALA J 323    -6.103  58.018 -12.662  1.00 33.32      A  N
ATOM  28430  CA   ALA J 323    -6.497  59.266 -12.067  1.00 32.71      A  C
ATOM  28431  CB   ALA J 323    -7.932  59.440 -12.198  1.00 32.64      A  C
ATOM  28432  C    ALA J 323    -6.100  59.414 -10.626  1.00 33.83      A  C
ATOM  28433  O    ALA J 323    -5.761  60.479 -10.212  1.00 34.39      A  O
ATOM  28434  N    PHE J 324    -6.216  58.364  -9.845  1.00 34.75      A  N
ATOM  28435  CA   PHE J 324    -5.732  58.338  -8.476  1.00 37.47      A  C
ATOM  28436  CB   PHE J 324    -6.328  57.173  -7.705  1.00 38.55      A  C
ATOM  28437  CG   PHE J 324    -7.642  57.463  -7.127  1.00 39.32      A  C
ATOM  28438  CD1  PHE J 324    -7.759  58.287  -6.081  1.00 41.92      A  C
ATOM  28439  CE1  PHE J 324    -8.959  58.560  -5.558  1.00 45.37      A  C
ATOM  28440  CZ   PHE J 324   -10.043  58.003  -6.074  1.00 43.84      A  C
ATOM  28441  CE2  PHE J 324    -9.940  57.184  -7.122  1.00 42.43      A  C
ATOM  28442  CD2  PHE J 324    -8.758  56.908  -7.637  1.00 41.07      A  C
ATOM  28443  C    PHE J 324    -4.215  58.368  -8.342  1.00 38.27      A  C
ATOM  28444  O    PHE J 324    -3.662  58.903  -7.420  1.00 37.38      A  O
ATOM  28445  N    THR J 325    -3.570  57.724  -9.286  1.00 39.01      A  N
ATOM  28446  CA   THR J 325    -2.145  57.725  -9.379  1.00 40.05      A  C
ATOM  28447  CB   THR J 325    -1.688  56.765 -10.424  1.00 40.44      A  C
ATOM  28448  OG1  THR J 325    -1.985  55.464  -9.973  1.00 40.94      A  O
ATOM  28449  CG2  THR J 325    -0.236  56.853 -10.590  1.00 41.12      A  C
ATOM  28450  C    THR J 325    -1.629  59.113  -9.633  1.00 39.27      A  C
ATOM  28451  O    THR J 325    -0.637  59.498  -9.096  1.00 39.81      A  O
ATOM  28452  N    LEU J 326    -2.340  59.864 -10.439  1.00 38.20      A  N
ATOM  28453  CA   LEU J 326    -1.989  61.223 -10.685  1.00 38.74      A  C
ATOM  28454  CB   LEU J 326    -2.926  61.825 -11.712  1.00 38.58      A  C
ATOM  28455  CG   LEU J 326    -2.705  63.237 -12.219  1.00 38.85      A  C
ATOM  28456  CD1  LEU J 326    -1.623  63.304 -13.187  1.00 35.77      A  C
ATOM  28457  CD2  LEU J 326    -3.911  63.690 -12.860  1.00 40.99      A  C
ATOM  28458  C    LEU J 326    -2.034  62.003  -9.398  1.00 38.48      A  C
ATOM  28459  O    LEU J 326    -1.243  62.859  -9.179  1.00 38.35      A  O
ATOM  28460  N    LEU J 327    -2.982  61.733  -8.541  1.00 39.06      A  N
ATOM  28461  CA   LEU J 327    -2.972  62.374  -7.255  1.00 38.92      A  C
ATOM  28462  CB   LEU J 327    -4.298  62.214  -6.522  1.00 37.67      A  C
ATOM  28463  CG   LEU J 327    -4.300  62.772  -5.100  1.00 38.44      A  C
ATOM  28464  CD1  LEU J 327    -4.521  64.220  -5.073  1.00 33.08      A  C
ATOM  28465  CD2  LEU J 327    -5.303  62.093  -4.265  1.00 36.60      A  C
ATOM  28466  C    LEU J 327    -1.801  61.962  -6.382  1.00 39.08      A  C
ATOM  28467  O    LEU J 327    -1.276  62.761  -5.669  1.00 40.28      A  O
ATOM  28468  N    LEU J 328    -1.433  60.700  -6.403  1.00 38.23      A  N
ATOM  28469  CA   LEU J 328    -0.371  60.219  -5.566  1.00 37.69      A  C
ATOM  28470  CB   LEU J 328    -0.236  58.711  -5.696  1.00 36.74      A  C
ATOM  28471  CG   LEU J 328     0.790  57.951  -4.879  1.00 33.32      A  C
ATOM  28472  CD1  LEU J 328     0.711  58.305  -3.475  1.00 27.54      A  C
ATOM  28473  CD2  LEU J 328     0.678  56.499  -5.033  1.00 28.83      A  C
ATOM  28474  C    LEU J 328     0.895  60.879  -5.963  1.00 38.29      A  C
ATOM  28475  O    LEU J 328     1.642  61.302  -5.152  1.00 38.49      A  O
ATOM  28476  N    ALA J 329     1.103  60.965  -7.251  1.00 38.94      A  N
ATOM  28477  CA   ALA J 329     2.283  61.519  -7.828  1.00 40.04      A  C
```

Appendix 1

```
ATOM  28478  CB   ALA J 329     2.197  61.404  -9.288  1.00 39.83      A    C
ATOM  28479  C    ALA J 329     2.437  62.962  -7.436  1.00 40.85      A    C
ATOM  28480  O    ALA J 329     3.518  63.420  -7.224  1.00 41.62      A    O
ATOM  28481  N    ARG J 330     1.357  63.697  -7.363  1.00 40.15      A    N
ATOM  28482  CA   ARG J 330     1.443  65.045  -6.878  1.00 41.04      A    C
ATOM  28483  CB   ARG J 330     0.121  65.751  -7.070  1.00 41.43      A    C
ATOM  28484  CG   ARG J 330     0.169  67.193  -6.788  1.00 39.17      A    C
ATOM  28485  CD   ARG J 330     0.809  67.897  -7.914  1.00 42.69      A    C
ATOM  28486  NE   ARG J 330     0.163  69.155  -8.176  1.00 44.08      A    N
ATOM  28487  CZ   ARG J 330     0.536  70.277  -7.619  1.00 45.06      A    C
ATOM  28488  NH1  ARG J 330     1.530  70.275  -6.794  1.00 49.17      A    N
ATOM  28489  NH2  ARG J 330    -0.079  71.384  -7.877  1.00 43.96      A    N
ATOM  28490  C    ARG J 330     1.853  65.143  -5.426  1.00 41.31      A    C
ATOM  28491  O    ARG J 330     2.677  65.926  -5.082  1.00 40.05      A    O
ATOM  28492  N    GLU J 331     1.258  64.336  -4.584  1.00 41.95      A    N
ATOM  28493  CA   GLU J 331     1.570  64.281  -3.183  1.00 42.92      A    C
ATOM  28494  CB   GLU J 331     0.575  63.417  -2.435  1.00 42.25      A    C
ATOM  28495  CG   GLU J 331     0.922  63.158  -1.017  1.00 44.56      A    C
ATOM  28496  CD   GLU J 331     0.293  64.115  -0.059  1.00 50.03      A    C
ATOM  28497  OE1  GLU J 331    -0.778  64.606  -0.354  1.00 51.91      A    O
ATOM  28498  OE2  GLU J 331     0.861  64.369   1.002  1.00 51.38      A    O-1
ATOM  28499  C    GLU J 331     2.971  63.812  -2.934  1.00 43.23      A    C
ATOM  28500  O    GLU J 331     3.584  64.206  -1.995  1.00 44.83      A    O
ATOM  28501  N    MET J 332     3.480  62.968  -3.791  1.00 43.50      A    N
ATOM  28502  CA   MET J 332     4.777  62.421  -3.580  1.00 43.95      A    C
ATOM  28503  CB   MET J 332     4.828  61.025  -4.132  1.00 44.28      J    C
ATOM  28504  CG   MET J 332     4.066  60.055  -3.340  1.00 43.81      J    C
ATOM  28505  SD   MET J 332     4.642  59.701  -1.732  1.00 47.48      J    S
ATOM  28506  CE   MET J 332     4.291  61.169  -0.853  1.00 41.75      J    C
ATOM  28507  C    MET J 332     5.862  63.247  -4.202  1.00 45.71      A    C
ATOM  28508  O    MET J 332     7.011  62.923  -4.107  1.00 45.55      A    O
ATOM  28509  N    GLY J 333     5.479  64.308  -4.872  1.00 46.54      A    N
ATOM  28510  CA   GLY J 333     6.413  65.177  -5.508  1.00 47.39      A    C
ATOM  28511  C    GLY J 333     6.913  64.704  -6.840  1.00 48.41      A    C
ATOM  28512  O    GLY J 333     7.763  65.329  -7.408  1.00 50.53      A    O
ATOM  28513  N    ASP J 334     6.368  63.637  -7.376  1.00 47.80      A    N
ATOM  28514  CA   ASP J 334     6.956  63.048  -8.547  1.00 47.11      A    C
ATOM  28515  CB   ASP J 334     6.531  61.602  -8.594  1.00 46.75      A    C
ATOM  28516  CG   ASP J 334     7.160  60.839  -9.690  1.00 47.99      A    C
ATOM  28517  OD1  ASP J 334     7.765  61.420 -10.579  1.00 49.60      A    O
ATOM  28518  OD2  ASP J 334     7.053  59.624  -9.662  1.00 47.53      A    O-1
ATOM  28519  C    ASP J 334     6.491  63.768  -9.770  1.00 47.09      A    C
ATOM  28520  O    ASP J 334     5.515  63.425 -10.343  1.00 48.24      A    O
ATOM  28521  N    GLN J 335     7.222  64.788 -10.171  1.00 47.02      A    N
ATOM  28522  CA   GLN J 335     6.879  65.578 -11.343  1.00 47.20      A    C
ATOM  28523  CB   GLN J 335     7.744  66.820 -11.436  1.00 47.04      A    C
ATOM  28524  CG   GLN J 335     7.359  67.918 -10.483  1.00 47.39      A    C
ATOM  28525  CD   GLN J 335     8.008  69.243 -10.816  1.00 49.20      A    C
ATOM  28526  OE1  GLN J 335     8.521  69.938  -9.947  1.00 45.18      A    O
ATOM  28527  NE2  GLN J 335     7.965  69.603 -12.076  1.00 47.61      A    N
ATOM  28528  C    GLN J 335     6.900  64.824 -12.654  1.00 47.95      A    C
ATOM  28529  O    GLN J 335     6.141  65.121 -13.530  1.00 48.09      A    O
ATOM  28530  N    GLN J 336     7.810  63.889 -12.815  1.00 48.61      A    N
ATOM  28531  CA   GLN J 336     7.834  63.107 -14.014  1.00 49.08      A    C
```

Appendix 1

```
ATOM  28532  CB   GLN J 336      9.094  62.247 -14.089  1.00 49.79      A  C
ATOM  28533  CG   GLN J 336      9.224  61.397 -15.365  1.00 51.40      A  C
ATOM  28534  CD   GLN J 336     10.422  60.452 -15.371  1.00 56.10      A  C
ATOM  28535  OE1  GLN J 336     10.698  59.765 -14.408  1.00 50.04      A  O
ATOM  28536  NE2  GLN J 336     11.125  60.418 -16.476  1.00 55.57      A  N
ATOM  28537  C    GLN J 336      6.638  62.239 -14.145  1.00 49.04      A  C
ATOM  28538  O    GLN J 336      6.051  62.180 -15.181  1.00 50.18      A  O
ATOM  28539  N    LEU J 337      6.272  61.525 -13.112  1.00 48.35      A  N
ATOM  28540  CA   LEU J 337      5.124  60.665 -13.246  1.00 47.79      A  C
ATOM  28541  CB   LEU J 337      4.879  59.857 -11.994  1.00 47.75      A  C
ATOM  28542  CG   LEU J 337      4.369  58.431 -12.137  1.00 48.41      A  C
ATOM  28543  CD1  LEU J 337      3.310  58.189 -11.180  1.00 46.70      A  C
ATOM  28544  CD2  LEU J 337      3.916  58.090 -13.501  1.00 45.59      A  C
ATOM  28545  C    LEU J 337      3.931  61.500 -13.497  1.00 47.38      A  C
ATOM  28546  O    LEU J 337      3.089  61.173 -14.277  1.00 48.87      A  O
ATOM  28547  N    PHE J 338      3.854  62.602 -12.815  1.00 44.84      A  N
ATOM  28548  CA   PHE J 338      2.667  63.343 -12.877  1.00 43.85      A  C
ATOM  28549  CB   PHE J 338      2.774  64.513 -11.952  1.00 43.51      A  C
ATOM  28550  CG   PHE J 338      1.756  65.538 -12.177  1.00 46.52      A  C
ATOM  28551  CD1  PHE J 338      0.876  65.884 -11.191  1.00 48.84      A  C
ATOM  28552  CE1  PHE J 338     -0.048  66.836 -11.406  1.00 47.86      A  C
ATOM  28553  CZ   PHE J 338     -0.107  67.447 -12.603  1.00 47.68      A  C
ATOM  28554  CE2  PHE J 338      0.747  67.111 -13.573  1.00 45.61      A  C
ATOM  28555  CD2  PHE J 338      1.664  66.163 -13.372  1.00 45.36      A  C
ATOM  28556  C    PHE J 338      2.462  63.758 -14.290  1.00 43.34      A  C
ATOM  28557  O    PHE J 338      1.388  63.705 -14.781  1.00 43.05      A  O
ATOM  28558  N    ASP J 339      3.519  64.154 -14.957  1.00 44.02      A  N
ATOM  28559  CA   ASP J 339      3.434  64.576 -16.336  1.00 43.31      A  C
ATOM  28560  CB   ASP J 339      4.759  65.157 -16.801  1.00 43.56      A  C
ATOM  28561  CG   ASP J 339      4.681  65.760 -18.179  1.00 47.21      A  C
ATOM  28562  OD1  ASP J 339      4.110  66.845 -18.341  1.00 48.21      A  O
ATOM  28563  OD2  ASP J 339      5.194  65.151 -19.110  1.00 50.11      A  O-1
ATOM  28564  C    ASP J 339      2.999  63.479 -17.260  1.00 41.67      A  C
ATOM  28565  O    ASP J 339      2.283  63.700 -18.183  1.00 40.79      A  O
ATOM  28566  N    GLN J 340      3.482  62.286 -17.036  1.00 40.42      A  N
ATOM  28567  CA   GLN J 340      3.113  61.220 -17.922  1.00 39.47      A  C
ATOM  28568  CB   GLN J 340      3.968  60.018 -17.656  1.00 39.19      A  C
ATOM  28569  CG   GLN J 340      5.406  60.351 -17.643  1.00 38.11      A  C
ATOM  28570  CD   GLN J 340      6.295  59.203 -17.325  1.00 33.89      A  C
ATOM  28571  OE1  GLN J 340      7.031  58.764 -18.162  1.00 35.01      A  O
ATOM  28572  NE2  GLN J 340      6.253  58.732 -16.121  1.00 27.45      A  N
ATOM  28573  C    GLN J 340      1.654  60.851 -17.902  1.00 39.55      A  C
ATOM  28574  O    GLN J 340      1.058  60.625 -18.929  1.00 39.77      A  O
ATOM  28575  N    LEU J 341      1.090  60.772 -16.717  1.00 38.08      A  N
ATOM  28576  CA   LEU J 341     -0.302  60.455 -16.547  1.00 36.46      A  C
ATOM  28577  CB   LEU J 341     -0.605  60.320 -15.082  1.00 36.41      A  C
ATOM  28578  CG   LEU J 341      0.043  59.148 -14.445  1.00 33.82      A  C
ATOM  28579  CD1  LEU J 341     -0.102  59.252 -13.018  1.00 31.04      A  C
ATOM  28580  CD2  LEU J 341     -0.552  57.941 -14.953  1.00 32.49      A  C
ATOM  28581  C    LEU J 341     -1.224  61.481 -17.122  1.00 35.96      A  C
ATOM  28582  O    LEU J 341     -2.161  61.159 -17.772  1.00 34.79      A  O
ATOM  28583  N    LEU J 342     -0.927  62.729 -16.897  1.00 35.49      A  N
ATOM  28584  CA   LEU J 342     -1.687  63.802 -17.450  1.00 36.62      A  C
ATOM  28585  CB   LEU J 342     -1.180  65.112 -16.907  1.00 36.58      A  C
```

Appendix 1

```
ATOM  28586  CG   LEU J 342   -2.093  66.318 -16.971  1.00 38.81      A  C
ATOM  28587  CD1  LEU J 342   -3.514  65.973 -16.761  1.00 40.19      A  C
ATOM  28588  CD2  LEU J 342   -1.660  67.334 -16.019  1.00 37.71      A  C
ATOM  28589  C    LEU J 342   -1.651  63.796 -18.959  1.00 37.68      A  C
ATOM  28590  O    LEU J 342   -2.544  64.237 -19.594  1.00 38.76      A  O
ATOM  28591  N    ASN J 343   -0.574  63.358 -19.538  1.00 39.67      A  N
ATOM  28592  CA   ASN J 343   -0.546  63.220 -20.960  1.00 41.17      A  C
ATOM  28593  CB   ASN J 343    0.867  62.957 -21.420  1.00 41.39      A  C
ATOM  28594  CG   ASN J 343    1.676  64.196 -21.505  1.00 43.34      A  C
ATOM  28595  OD1  ASN J 343    1.154  65.266 -21.648  1.00 46.41      A  O
ATOM  28596  ND2  ASN J 343    2.957  64.057 -21.414  1.00 44.44      A  N
ATOM  28597  C    ASN J 343   -1.485  62.163 -21.470  1.00 41.31      A  C
ATOM  28598  O    ASN J 343   -2.039  62.273 -22.525  1.00 41.96      A  O
ATOM  28599  N    HIS J 344   -1.579  61.079 -20.745  1.00 42.33      A  N
ATOM  28600  CA   HIS J 344   -2.531  60.065 -21.079  1.00 42.87      A  C
ATOM  28601  CB   HIS J 344   -2.189  58.826 -20.294  1.00 43.44      A  C
ATOM  28602  CG   HIS J 344   -3.085  57.680 -20.579  1.00 46.45      A  C
ATOM  28603  ND1  HIS J 344   -3.276  57.187 -21.841  1.00 49.76      A  N
ATOM  28604  CE1  HIS J 344   -4.112  56.175 -21.791  1.00 52.68      A  C
ATOM  28605  NE2  HIS J 344   -4.473  56.001 -20.539  1.00 52.66      A  N
ATOM  28606  CD2  HIS J 344   -3.840  56.926 -19.760  1.00 47.83      A  C
ATOM  28607  C    HIS J 344   -3.975  60.417 -20.847  1.00 41.73      A  C
ATOM  28608  O    HIS J 344   -4.780  60.200 -21.690  1.00 40.84      A  O
ATOM  28609  N    LEU J 345   -4.290  60.930 -19.673  1.00 41.13      A  N
ATOM  28610  CA   LEU J 345   -5.645  61.267 -19.339  1.00 41.41      A  C
ATOM  28611  CB   LEU J 345   -5.700  61.608 -17.861  1.00 41.07      A  C
ATOM  28612  CG   LEU J 345   -6.087  60.603 -16.792  1.00 41.24      A  C
ATOM  28613  CD1  LEU J 345   -6.046  59.264 -17.294  1.00 40.24      A  C
ATOM  28614  CD2  LEU J 345   -5.191  60.685 -15.631  1.00 40.97      A  C
ATOM  28615  C    LEU J 345   -6.295  62.426 -20.048  1.00 42.18      A  C
ATOM  28616  O    LEU J 345   -7.370  62.291 -20.575  1.00 42.92      A  O
ATOM  28617  N    GLU J 346   -5.684  63.591 -19.989  1.00 43.10      A  N
ATOM  28618  CA   GLU J 346   -6.312  64.823 -20.430  1.00 43.37      A  C
ATOM  28619  CB   GLU J 346   -5.538  66.021 -19.907  1.00 43.48      A  C
ATOM  28620  CG   GLU J 346   -6.223  67.310 -20.131  1.00 46.23      A  C
ATOM  28621  CD   GLU J 346   -5.687  68.442 -19.314  1.00 48.99      A  C
ATOM  28622  OE1  GLU J 346   -6.467  69.295 -18.930  1.00 51.73      A  O
ATOM  28623  OE2  GLU J 346   -4.501  68.525 -19.075  1.00 51.62      A  O-1
ATOM  28624  C    GLU J 346   -6.626  65.025 -21.890  1.00 43.33      A  C
ATOM  28625  O    GLU J 346   -7.680  65.469 -22.210  1.00 44.35      A  O
ATOM  28626  N    PRO J 347   -5.718  64.739 -22.794  1.00 42.93      A  N
ATOM  28627  CA   PRO J 347   -5.961  65.088 -24.193  1.00 42.46      A  C
ATOM  28628  CB   PRO J 347   -4.610  64.882 -24.832  1.00 42.14      A  C
ATOM  28629  CG   PRO J 347   -3.723  65.220 -23.788  1.00 43.11      A  C
ATOM  28630  CD   PRO J 347   -4.296  64.631 -22.547  1.00 43.07      A  C
ATOM  28631  C    PRO J 347   -7.092  64.391 -24.945  1.00 42.01      A  C
ATOM  28632  O    PRO J 347   -7.746  65.020 -25.716  1.00 42.07      A  O
ATOM  28633  N    PRO J 348   -7.300  63.115 -24.735  1.00 41.05      A  N
ATOM  28634  CA   PRO J 348   -8.426  62.409 -25.316  1.00 39.97      A  C
ATOM  28635  CB   PRO J 348   -8.113  60.969 -24.993  1.00 39.44      A  C
ATOM  28636  CG   PRO J 348   -7.116  61.006 -24.042  1.00 40.15      A  C
ATOM  28637  CD   PRO J 348   -6.335  62.180 -24.180  1.00 39.80      A  C
ATOM  28638  C    PRO J 348   -9.786  62.853 -24.771  1.00 39.63      A  C
ATOM  28639  O    PRO J 348  -10.806  62.649 -25.395  1.00 39.95      A  O
```

Appendix 1

```
ATOM  28640  N    ALA J 349   -9.747  63.537 -23.643  1.00 38.35      A  N
ATOM  28641  CA   ALA J 349  -10.903  64.095 -23.000  1.00 37.37      A  C
ATOM  28642  CB   ALA J 349  -10.649  64.238 -21.581  1.00 37.52      A  C
ATOM  28643  C    ALA J 349  -11.278  65.414 -23.563  1.00 37.79      A  C
ATOM  28644  O    ALA J 349  -12.270  65.953 -23.210  1.00 37.86      A  O
ATOM  28645  N    LYS J 350  -10.452  65.948 -24.434  1.00 39.44      A  N
ATOM  28646  CA   LYS J 350  -10.790  67.144 -25.167  1.00 39.91      A  C
ATOM  28647  CB   LYS J 350  -11.754  66.834 -26.292  1.00 39.32      A  C
ATOM  28652  C    LYS J 350  -11.256  68.330 -24.359  1.00 40.75      A  C
ATOM  28653  O    LYS J 350  -12.355  68.758 -24.511  1.00 40.97      A  O
ATOM  28654  N    PRO J 351  -10.399  68.870 -23.521  1.00 41.73      A  N
ATOM  28655  CA   PRO J 351  -10.754  70.031 -22.731  1.00 42.90      A  C
ATOM  28656  CB   PRO J 351   -9.530  70.233 -21.864  1.00 42.79      A  C
ATOM  28657  CG   PRO J 351   -8.478  69.698 -22.591  1.00 42.47      A  C
ATOM  28658  CD   PRO J 351   -9.000  68.517 -23.309  1.00 42.29      A  C
ATOM  28659  C    PRO J 351  -10.909  71.211 -23.608  1.00 43.67      A  C
ATOM  28660  O    PRO J 351  -10.270  71.282 -24.614  1.00 44.10      A  O
ATOM  28661  N    SER J 352  -11.757  72.137 -23.239  1.00 44.24      A  N
ATOM  28662  CA   SER J 352  -11.814  73.366 -23.969  1.00 44.55      A  C
ATOM  28663  CB   SER J 352  -12.718  73.216 -25.172  1.00 44.22      A  C
ATOM  28664  OG   SER J 352  -14.025  73.559 -24.884  1.00 43.80      A  O
ATOM  28665  C    SER J 352  -12.251  74.478 -23.066  1.00 44.61      A  C
ATOM  28666  O    SER J 352  -12.977  74.255 -22.163  1.00 44.84      A  O
ATOM  28667  N    ILE J 353  -11.795  75.687 -23.297  1.00 44.45      A  N
ATOM  28668  CA   ILE J 353  -12.267  76.789 -22.497  1.00 43.68      A  C
ATOM  28669  CB   ILE J 353  -11.111  77.622 -22.045  1.00 43.74      A  C
ATOM  28670  CG1  ILE J 353   -9.953  76.716 -21.686  1.00 41.10      A  C
ATOM  28671  CD1  ILE J 353   -9.461  76.914 -20.342  1.00 34.66      A  C
ATOM  28672  CG2  ILE J 353  -11.491  78.414 -20.847  1.00 44.35      A  C
ATOM  28673  C    ILE J 353  -13.190  77.675 -23.280  1.00 43.74      A  C
ATOM  28674  O    ILE J 353  -12.780  78.352 -24.168  1.00 43.53      A  O
ATOM  28675  N    VAL J 354  -14.462  77.642 -22.974  1.00 44.15      A  N
ATOM  28676  CA   VAL J 354  -15.375  78.309 -23.831  1.00 44.20      A  C
ATOM  28677  CB   VAL J 354  -16.622  77.522 -23.999  1.00 44.36      A  C
ATOM  28678  CG1  VAL J 354  -17.619  78.288 -24.767  1.00 43.77      A  C
ATOM  28679  CG2  VAL J 354  -16.285  76.310 -24.718  1.00 44.73      A  C
ATOM  28680  C    VAL J 354  -15.687  79.709 -23.437  1.00 44.73      A  C
ATOM  28681  O    VAL J 354  -15.408  80.605 -24.183  1.00 47.48      A  O
ATOM  28682  N    SER J 355  -16.195  79.970 -22.274  1.00 43.79      A  N
ATOM  28683  CA   SER J 355  -16.329  81.365 -22.010  1.00 43.36      A  C
ATOM  28684  CB   SER J 355  -17.785  81.758 -21.900  1.00 44.05      A  C
ATOM  28685  OG   SER J 355  -17.986  82.811 -20.988  1.00 43.14      A  O
ATOM  28686  C    SER J 355  -15.641  81.582 -20.726  1.00 43.48      A  C
ATOM  28687  O    SER J 355  -16.237  81.969 -19.759  1.00 43.78      A  O
ATOM  28688  N    ALA J 356  -14.349  81.314 -20.752  1.00 41.72      A  N
ATOM  28689  CA   ALA J 356  -13.517  81.291 -19.587  1.00 40.83      A  C
ATOM  28690  CB   ALA J 356  -13.595  82.548 -18.914  1.00 39.28      A  C
ATOM  28691  C    ALA J 356  -13.933  80.200 -18.660  1.00 41.45      A  C
ATOM  28692  O    ALA J 356  -13.784  80.329 -17.480  1.00 42.66      A  O
ATOM  28693  N    SER J 357  -14.453  79.119 -19.200  1.00 41.13      A  N
ATOM  28694  CA   SER J 357  -14.913  78.035 -18.382  1.00 39.87      A  C
ATOM  28695  CB   SER J 357  -16.406  78.058 -18.314  1.00 39.43      A  C
ATOM  28696  OG   SER J 357  -16.875  77.666 -17.077  1.00 39.10      A  O
ATOM  28697  C    SER J 357  -14.472  76.776 -19.012  1.00 39.97      A  C
```

Appendix 1

```
ATOM  28698  O    SER J 357     -14.435  76.670 -20.189  1.00 40.90      A    O
ATOM  28699  N    LEU J 358     -14.136  75.806 -18.205  1.00 39.84      A    N
ATOM  28700  CA   LEU J 358     -13.534  74.614 -18.691  1.00 40.50      A    C
ATOM  28701  CB   LEU J 358     -12.330  74.277 -17.832  1.00 40.60      A    C
ATOM  28702  CG   LEU J 358     -11.681  72.925 -18.024  1.00 40.44      A    C
ATOM  28703  CD1  LEU J 358     -11.082  72.840 -19.341  1.00 39.85      A    C
ATOM  28704  CD2  LEU J 358     -10.694  72.667 -16.983  1.00 40.05      A    C
ATOM  28705  C    LEU J 358     -14.481  73.440 -18.754  1.00 42.01      A    C
ATOM  28706  O    LEU J 358     -15.178  73.165 -17.823  1.00 42.21      A    O
ATOM  28707  N    ARG J 359     -14.460  72.754 -19.887  1.00 44.03      A    N
ATOM  28708  CA   ARG J 359     -15.229  71.551 -20.124  1.00 45.88      A    C
ATOM  28709  CB   ARG J 359     -16.378  71.817 -21.081  1.00 45.72      A    C
ATOM  28710  CG   ARG J 359     -17.313  72.884 -20.668  1.00 50.24      A    C
ATOM  28711  CD   ARG J 359     -18.351  72.381 -19.702  1.00 58.37      A    C
ATOM  28712  NE   ARG J 359     -18.961  73.447 -18.920  1.00 62.66      A    N
ATOM  28713  CZ   ARG J 359     -18.557  74.708 -18.914  1.00 67.42      A    C
ATOM  28714  NH1  ARG J 359     -17.548  75.095 -19.655  1.00 67.66      A    N
ATOM  28715  NH2  ARG J 359     -19.175  75.595 -18.168  1.00 68.34      A    N
ATOM  28716  C    ARG J 359     -14.369  70.488 -20.754  1.00 45.94      A    C
ATOM  28717  O    ARG J 359     -13.434  70.788 -21.419  1.00 46.00      A    O
ATOM  28718  N    TYR J 360     -14.723  69.244 -20.509  1.00 47.03      A    N
ATOM  28719  CA   TYR J 360     -14.235  68.105 -21.230  1.00 47.54      A    C
ATOM  28720  CB   TYR J 360     -13.620  67.124 -20.279  1.00 47.45      A    C
ATOM  28721  CG   TYR J 360     -12.396  67.595 -19.601  1.00 46.61      A    C
ATOM  28722  CD1  TYR J 360     -11.176  67.507 -20.210  1.00 44.30      A    C
ATOM  28723  CE1  TYR J 360     -10.086  67.912 -19.596  1.00 46.93      A    C
ATOM  28724  CZ   TYR J 360     -10.178  68.420 -18.351  1.00 48.49      A    C
ATOM  28725  OH   TYR J 360      -9.070  68.832 -17.712  1.00 48.85      A    O
ATOM  28726  CE2  TYR J 360     -11.366  68.506 -17.726  1.00 44.66      A    C
ATOM  28727  CD2  TYR J 360     -12.456  68.089 -18.345  1.00 43.48      A    C
ATOM  28728  C    TYR J 360     -15.382  67.409 -21.902  1.00 48.02      A    C
ATOM  28729  O    TYR J 360     -16.323  67.020 -21.284  1.00 47.22      A    O
ATOM  28730  N    GLU J 361     -15.313  67.303 -23.207  1.00 49.53      A    N
ATOM  28731  CA   GLU J 361     -16.210  66.507 -24.005  1.00 50.42      A    C
ATOM  28732  CB   GLU J 361     -16.149  67.050 -25.427  1.00 50.47      A    C
ATOM  28733  CG   GLU J 361     -16.926  66.282 -26.489  1.00 57.42      A    C
ATOM  28734  CD   GLU J 361     -16.555  66.674 -27.912  1.00 63.17      A    C
ATOM  28735  OE1  GLU J 361     -15.660  67.495 -28.077  1.00 65.88      A    O
ATOM  28736  OE2  GLU J 361     -17.146  66.163 -28.869  1.00 64.24      A    O-1
ATOM  28737  C    GLU J 361     -15.504  65.207 -23.931  1.00 49.77      A    C
ATOM  28738  O    GLU J 361     -14.331  65.188 -24.085  1.00 50.61      A    O
ATOM  28739  N    HIS J 362     -16.144  64.098 -23.693  1.00 48.92      A    N
ATOM  28740  CA   HIS J 362     -15.323  62.891 -23.634  1.00 49.08      A    C
ATOM  28741  CB   HIS J 362     -14.383  62.853 -24.834  1.00 49.09      A    C
ATOM  28742  CG   HIS J 362     -15.086  62.742 -26.147  1.00 52.52      A    C
ATOM  28743  ND1  HIS J 362     -16.007  61.763 -26.405  1.00 55.54      A    N
ATOM  28744  CE1  HIS J 362     -16.477  61.915 -27.623  1.00 57.36      A    C
ATOM  28745  NE2  HIS J 362     -15.883  62.951 -28.170  1.00 54.91      A    N
ATOM  28746  CD2  HIS J 362     -15.012  63.488 -27.269  1.00 53.94      A    C
ATOM  28747  C    HIS J 362     -14.499  62.569 -22.399  1.00 47.41      A    C
ATOM  28748  O    HIS J 362     -13.475  61.953 -22.510  1.00 47.20      A    O
ATOM  28749  N    PRO J 363     -14.986  62.903 -21.230  1.00 46.43      A    N
ATOM  28750  CA   PRO J 363     -14.278  62.564 -20.014  1.00 45.82      A    C
ATOM  28751  CB   PRO J 363     -15.192  63.100 -18.942  1.00 45.58      A    C
```

Appendix 1

```
ATOM  28752  CG   PRO J 363    -16.448  63.215 -19.551  1.00 46.15      A  C
ATOM  28753  CD   PRO J 363    -16.227  63.599 -20.927  1.00 46.00      A  C
ATOM  28754  C    PRO J 363    -14.157  61.082 -19.846  1.00 45.94      A  C
ATOM  28755  O    PRO J 363    -15.098  60.376 -20.028  1.00 46.79      A  O
ATOM  28756  N    GLY J 364    -12.975  60.616 -19.501  1.00 45.15      A  N
ATOM  28757  CA   GLY J 364    -12.645  59.213 -19.449  1.00 44.01      A  C
ATOM  28758  C    GLY J 364    -13.164  58.299 -18.376  1.00 43.90      A  C
ATOM  28759  O    GLY J 364    -13.088  57.114 -18.470  1.00 44.12      A  O
ATOM  28760  N    SER J 365    -13.629  58.850 -17.301  1.00 43.30      A  N
ATOM  28761  CA   SER J 365    -14.055  58.027 -16.229  1.00 43.27      A  C
ATOM  28762  CB   SER J 365    -12.887  57.542 -15.396  1.00 43.53      A  C
ATOM  28763  OG   SER J 365    -12.315  58.575 -14.639  1.00 44.30      A  O
ATOM  28764  C    SER J 365    -14.995  58.846 -15.431  1.00 42.86      A  C
ATOM  28765  O    SER J 365    -15.261  59.965 -15.758  1.00 42.52      A  O
ATOM  28766  N    LEU J 366    -15.516  58.239 -14.393  1.00 42.62      A  N
ATOM  28767  CA   LEU J 366    -16.320  58.886 -13.433  1.00 42.66      A  C
ATOM  28768  CB   LEU J 366    -16.807  57.848 -12.466  1.00 43.59      A  C
ATOM  28769  CG   LEU J 366    -18.217  57.306 -12.553  1.00 46.38      A  C
ATOM  28770  CD1  LEU J 366    -18.935  57.845 -13.720  1.00 43.92      A  C
ATOM  28771  CD2  LEU J 366    -18.151  55.825 -12.619  1.00 48.63      A  C
ATOM  28772  C    LEU J 366    -15.408  59.822 -12.704  1.00 42.53      A  C
ATOM  28773  O    LEU J 366    -14.261  59.529 -12.549  1.00 41.58      A  O
ATOM  28774  N    LEU J 367    -15.916  60.949 -12.241  1.00 42.23      A  N
ATOM  28775  CA   LEU J 367    -15.132  61.849 -11.425  1.00 41.16      A  C
ATOM  28776  CB   LEU J 367    -14.588  61.079 -10.256  1.00 40.48      A  C
ATOM  28777  CG   LEU J 367    -15.476  60.533  -9.170  1.00 41.47      A  C
ATOM  28778  CD1  LEU J 367    -14.657  59.802  -8.224  1.00 43.98      A  C
ATOM  28779  CD2  LEU J 367    -16.162  61.607  -8.481  1.00 40.59      A  C
ATOM  28780  C    LEU J 367    -13.954  62.465 -12.139  1.00 41.03      A  C
ATOM  28781  O    LEU J 367    -12.995  62.795 -11.534  1.00 42.51      A  O
ATOM  28782  N    PHE J 368    -14.003  62.580 -13.442  1.00 39.93      A  N
ATOM  28783  CA   PHE J 368    -12.844  62.976 -14.172  1.00 38.66      A  C
ATOM  28784  CB   PHE J 368    -13.201  62.880 -15.648  1.00 37.93      A  C
ATOM  28785  CG   PHE J 368    -12.054  63.010 -16.543  1.00 37.77      A  C
ATOM  28786  CD1  PHE J 368    -11.287  61.935 -16.855  1.00 38.76      A  C
ATOM  28787  CE1  PHE J 368    -10.228  62.065 -17.661  1.00 37.63      A  C
ATOM  28788  CZ   PHE J 368     -9.921  63.262 -18.155  1.00 39.11      A  C
ATOM  28789  CE2  PHE J 368    -10.674  64.337 -17.855  1.00 39.95      A  C
ATOM  28790  CD2  PHE J 368    -11.728  64.212 -17.062  1.00 38.62      A  C
ATOM  28791  C    PHE J 368    -12.344  64.361 -13.902  1.00 38.41      A  C
ATOM  28792  O    PHE J 368    -11.232  64.547 -13.583  1.00 38.08      A  O
ATOM  28793  N    ASP J 369    -13.186  65.335 -14.076  1.00 37.83      A  N
ATOM  28794  CA   ASP J 369    -12.843  66.691 -13.786  1.00 37.79      A  C
ATOM  28795  CB   ASP J 369    -13.874  67.664 -14.334  1.00 37.50      A  C
ATOM  28796  CG   ASP J 369    -15.061  67.819 -13.447  1.00 39.69      A  C
ATOM  28797  OD1  ASP J 369    -15.077  68.730 -12.647  1.00 35.56      A  O
ATOM  28798  OD2  ASP J 369    -16.002  67.040 -13.569  1.00 45.46      A  O-1
ATOM  28799  C    ASP J 369    -12.553  66.947 -12.333  1.00 37.34      A  C
ATOM  28800  O    ASP J 369    -11.800  67.815 -12.018  1.00 37.68      A  O
ATOM  28801  N    GLU J 370    -13.205  66.239 -11.447  1.00 37.22      A  N
ATOM  28802  CA   GLU J 370    -12.981  66.453 -10.056  1.00 37.33      A  C
ATOM  28803  CB   GLU J 370    -13.985  65.637  -9.260  1.00 37.35      A  C
ATOM  28804  CG   GLU J 370    -15.384  66.079  -9.395  1.00 37.60      A  C
ATOM  28805  CD   GLU J 370    -16.153  65.281 -10.368  1.00 41.22      A  C
```

Appendix 1

```
ATOM  28806  OE1  GLU  J  370   -15.609  64.372 -10.957  1.00 42.62      A  O
ATOM  28807  OE2  GLU  J  370   -17.315  65.554 -10.540  1.00 41.90      A  O-1
ATOM  28808  C    GLU  J  370   -11.587  66.063  -9.629  1.00 38.20      A  C
ATOM  28809  O    GLU  J  370   -10.938  66.767  -8.915  1.00 38.02      A  O
ATOM  28810  N    LEU  J  371   -11.184  64.881 -10.035  1.00 37.90      A  N
ATOM  28811  CA   LEU  J  371    -9.887  64.335  -9.770  1.00 37.91      A  C
ATOM  28812  CB   LEU  J  371    -9.882  62.855 -10.116  1.00 38.57      A  C
ATOM  28813  CG   LEU  J  371    -9.689  61.864  -8.985  1.00 35.99      A  C
ATOM  28814  CD1  LEU  J  371    -9.875  62.568  -7.751  1.00 35.68      A  C
ATOM  28815  CD2  LEU  J  371   -10.623  60.731  -9.070  1.00 32.27      A  C
ATOM  28816  C    LEU  J  371    -8.745  65.062 -10.451  1.00 38.08      A  C
ATOM  28817  O    LEU  J  371    -7.689  65.227  -9.890  1.00 37.38      A  O
ATOM  28818  N    LEU  J  372    -8.944  65.468 -11.680  1.00 37.02      A  N
ATOM  28819  CA   LEU  J  372    -7.942  66.267 -12.329  1.00 36.38      A  C
ATOM  28820  CB   LEU  J  372    -8.219  66.420 -13.814  1.00 35.34      A  C
ATOM  28821  CG   LEU  J  372    -7.665  65.347 -14.737  1.00 35.69      A  C
ATOM  28822  CD1  LEU  J  372    -8.033  63.997 -14.333  1.00 32.25      A  C
ATOM  28823  CD2  LEU  J  372    -8.147  65.550 -16.086  1.00 35.42      A  C
ATOM  28824  C    LEU  J  372    -7.757  67.599 -11.660  1.00 36.11      A  C
ATOM  28825  O    LEU  J  372    -6.670  67.990 -11.416  1.00 36.31      A  O
ATOM  28826  N    PHE  J  373    -8.822  68.267 -11.307  1.00 36.00      A  N
ATOM  28827  CA   PHE  J  373    -8.696  69.550 -10.689  1.00 36.48      A  C
ATOM  28828  CB   PHE  J  373   -10.088  70.126 -10.494  1.00 36.35      A  C
ATOM  28829  CG   PHE  J  373   -10.221  71.060  -9.362  1.00 34.32      A  C
ATOM  28830  CD1  PHE  J  373    -9.891  72.365  -9.490  1.00 34.58      A  C
ATOM  28831  CE1  PHE  J  373   -10.017  73.198  -8.455  1.00 33.52      A  C
ATOM  28832  CZ   PHE  J  373   -10.497  72.758  -7.300  1.00 32.20      A  C
ATOM  28833  CE2  PHE  J  373   -10.855  71.484  -7.171  1.00 34.63      A  C
ATOM  28834  CD2  PHE  J  373   -10.728  70.641  -8.186  1.00 32.26      A  C
ATOM  28835  C    PHE  J  373    -7.947  69.380  -9.387  1.00 37.73      A  C
ATOM  28836  O    PHE  J  373    -7.101  70.152  -9.026  1.00 37.85      A  O
ATOM  28837  N    LEU  J  374    -8.263  68.331  -8.683  1.00 38.07      A  N
ATOM  28838  CA   LEU  J  374    -7.605  68.059  -7.457  1.00 38.72      A  C
ATOM  28839  CB   LEU  J  374    -8.312  66.936  -6.736  1.00 38.22      A  C
ATOM  28840  CG   LEU  J  374    -7.539  66.392  -5.561  1.00 39.45      A  C
ATOM  28841  CD1  LEU  J  374    -7.598  67.294  -4.414  1.00 38.46      A  C
ATOM  28842  CD2  LEU  J  374    -8.064  65.078  -5.205  1.00 39.32      A  C
ATOM  28843  C    LEU  J  374    -6.141  67.761  -7.641  1.00 39.36      A  C
ATOM  28844  O    LEU  J  374    -5.330  68.211  -6.891  1.00 40.23      A  O
ATOM  28845  N    ALA  J  375    -5.792  66.977  -8.628  1.00 38.68      A  N
ATOM  28846  CA   ALA  J  375    -4.407  66.739  -8.856  1.00 38.23      A  C
ATOM  28847  CB   ALA  J  375    -4.225  65.714  -9.875  1.00 37.78      A  C
ATOM  28848  C    ALA  J  375    -3.721  68.013  -9.253  1.00 39.18      A  C
ATOM  28849  O    ALA  J  375    -2.657  68.302  -8.804  1.00 39.80      A  O
ATOM  28850  N    LYS  J  376    -4.352  68.799 -10.089  1.00 38.11      A  N
ATOM  28851  CA   LYS  J  376    -3.721  69.978 -10.588  1.00 37.99      A  C
ATOM  28852  CB   LYS  J  376    -4.544  70.591 -11.670  1.00 37.61      A  C
ATOM  28853  CG   LYS  J  376    -4.168  70.185 -12.989  1.00 36.33      A  C
ATOM  28854  CD   LYS  J  376    -5.314  70.414 -13.864  1.00 35.04      A  C
ATOM  28855  CE   LYS  J  376    -5.008  70.118 -15.261  1.00 36.01      A  C
ATOM  28856  NZ   LYS  J  376    -6.158  70.399 -16.092  1.00 35.40      A  N
ATOM  28857  C    LYS  J  376    -3.389  70.986  -9.510  1.00 39.63      A  C
ATOM  28858  O    LYS  J  376    -2.455  71.732  -9.639  1.00 39.76      A  O
ATOM  28859  N    VAL  J  377    -4.149  71.029  -8.443  1.00 39.75      A  N
```

Appendix 1

```
ATOM  28860  CA   VAL J 377    -3.841  71.972  -7.407  1.00 39.74      A  C
ATOM  28861  CB   VAL J 377    -5.027  72.864  -7.051  1.00 39.95      A  C
ATOM  28862  CG1  VAL J 377    -5.486  73.643  -8.209  1.00 37.92      A  C
ATOM  28863  CG2  VAL J 377    -6.128  72.091  -6.415  1.00 35.97      A  C
ATOM  28864  C    VAL J 377    -3.371  71.395  -6.114  1.00 40.96      A  C
ATOM  28865  O    VAL J 377    -3.240  72.114  -5.196  1.00 42.69      A  O
ATOM  28866  N    HIS J 378    -3.122  70.117  -5.998  1.00 41.25      A  N
ATOM  28867  CA   HIS J 378    -2.908  69.558  -4.683  1.00 40.73      A  C
ATOM  28868  CB   HIS J 378    -2.978  68.055  -4.796  1.00 40.49      A  C
ATOM  28869  CG   HIS J 378    -3.046  67.350  -3.492  1.00 37.64      A  C
ATOM  28870  ND1  HIS J 378    -3.993  67.637  -2.550  1.00 38.57      A  N
ATOM  28871  CE1  HIS J 378    -3.807  66.867  -1.505  1.00 38.66      A  C
ATOM  28872  NE2  HIS J 378    -2.789  66.072  -1.751  1.00 38.08      A  N
ATOM  28873  CD2  HIS J 378    -2.296  66.355  -2.987  1.00 36.22      A  C
ATOM  28874  C    HIS J 378    -1.619  69.980  -4.023  1.00 41.38      A  C
ATOM  28875  O    HIS J 378    -0.582  69.862  -4.597  1.00 42.43      A  O
ATOM  28876  N    ALA J 379    -1.701  70.460  -2.794  1.00 41.30      A  N
ATOM  28877  CA   ALA J 379    -0.572  70.987  -2.053  1.00 41.66      A  C
ATOM  28878  CB   ALA J 379    -0.973  72.210  -1.395  1.00 40.92      A  C
ATOM  28879  C    ALA J 379     0.026  70.042  -1.024  1.00 43.14      A  C
ATOM  28880  O    ALA J 379     0.935  70.396  -0.316  1.00 43.63      A  O
ATOM  28881  N    GLY J 380    -0.508  68.842  -0.938  1.00 42.78      A  N
ATOM  28882  CA   GLY J 380    -0.102  67.904   0.064  1.00 41.81      A  C
ATOM  28883  C    GLY J 380    -1.064  67.905   1.215  1.00 42.49      A  C
ATOM  28884  O    GLY J 380    -1.470  68.903   1.713  1.00 40.87      A  O
ATOM  28885  N    PHE J 381    -1.430  66.727   1.629  1.00 43.90      A  N
ATOM  28886  CA   PHE J 381    -2.310  66.559   2.737  1.00 45.44      A  C
ATOM  28887  CB   PHE J 381    -2.793  65.137   2.804  1.00 45.15      A  C
ATOM  28888  CG   PHE J 381    -3.853  64.826   1.800  1.00 46.87      A  C
ATOM  28889  CD1  PHE J 381    -4.974  65.577   1.731  1.00 47.28      A  C
ATOM  28890  CE1  PHE J 381    -5.915  65.309   0.842  1.00 46.29      A  C
ATOM  28891  CZ   PHE J 381    -5.775  64.295  -0.000  1.00 45.73      A  C
ATOM  28892  CE2  PHE J 381    -4.696  63.538   0.038  1.00 47.24      A  C
ATOM  28893  CD2  PHE J 381    -3.728  63.791   0.929  1.00 49.44      A  C
ATOM  28894  C    PHE J 381    -1.618  67.039   3.980  1.00 46.99      A  C
ATOM  28895  O    PHE J 381    -2.237  67.469   4.907  1.00 49.17      A  O
ATOM  28896  N    GLY J 382    -0.304  66.990   3.975  1.00 48.23      A  N
ATOM  28897  CA   GLY J 382     0.498  67.640   4.985  1.00 47.69      A  C
ATOM  28898  C    GLY J 382     0.438  69.144   5.041  1.00 47.49      A  C
ATOM  28899  O    GLY J 382     0.436  69.699   6.078  1.00 48.13      A  O
ATOM  28900  N    ALA J 383     0.424  69.807   3.914  1.00 48.23      A  N
ATOM  28901  CA   ALA J 383     0.305  71.242   3.880  1.00 49.66      A  C
ATOM  28902  CB   ALA J 383     0.437  71.711   2.511  1.00 49.97      A  C
ATOM  28903  C    ALA J 383    -1.012  71.682   4.421  1.00 50.77      A  C
ATOM  28904  O    ALA J 383    -1.159  72.728   4.982  1.00 51.31      A  O
ATOM  28905  N    LEU J 384    -2.004  70.877   4.165  1.00 51.96      A  N
ATOM  28906  CA   LEU J 384    -3.341  71.172   4.554  1.00 52.37      A  C
ATOM  28907  CB   LEU J 384    -4.293  70.213   3.865  1.00 52.84      A  C
ATOM  28908  CG   LEU J 384    -5.055  70.626   2.601  1.00 50.53      A  C
ATOM  28909  CD1  LEU J 384    -4.501  71.769   1.879  1.00 49.32      A  C
ATOM  28910  CD2  LEU J 384    -5.233  69.504   1.682  1.00 49.73      A  C
ATOM  28911  C    LEU J 384    -3.517  71.205   6.053  1.00 53.57      A  C
ATOM  28912  O    LEU J 384    -4.261  72.010   6.541  1.00 53.89      A  O
ATOM  28913  N    LEU J 385    -2.868  70.318   6.789  1.00 54.35      A  N
```

Appendix 1

```
ATOM  28914  CA   LEU J 385    -2.904  70.368   8.252  1.00  55.42      A  C
ATOM  28915  CB   LEU J 385    -2.480  69.073   8.889  1.00  55.52      A  C
ATOM  28916  CG   LEU J 385    -3.093  67.843   8.313  1.00  55.97      A  C
ATOM  28917  CD1  LEU J 385    -3.034  68.027   6.869  1.00  55.56      A  C
ATOM  28918  CD2  LEU J 385    -2.218  66.722   8.711  1.00  55.71      A  C
ATOM  28919  C    LEU J 385    -2.152  71.500   8.914  1.00  56.24      A  C
ATOM  28920  O    LEU J 385    -2.436  71.853  10.022  1.00  55.61      A  O
ATOM  28921  N    ARG J 386    -1.163  72.043   8.236  1.00  57.73      A  N
ATOM  28922  CA   ARG J 386    -0.317  73.061   8.807  1.00  59.20      A  C
ATOM  28923  CB   ARG J 386     1.097  72.887   8.346  1.00  59.25      A  C
ATOM  28924  CG   ARG J 386     1.754  71.785   9.017  1.00  60.70      A  C
ATOM  28925  CD   ARG J 386     2.476  70.950   8.051  1.00  62.25      A  C
ATOM  28926  NE   ARG J 386     3.483  70.241   8.780  1.00  64.81      A  N
ATOM  28927  CZ   ARG J 386     3.640  68.939   8.756  1.00  65.79      A  C
ATOM  28928  NH1  ARG J 386     2.840  68.217   8.008  1.00  65.33      A  N
ATOM  28929  NH2  ARG J 386     4.598  68.376   9.471  1.00  65.22      A  N
ATOM  28930  C    ARG J 386    -0.789  74.400   8.383  1.00  59.66      A  C
ATOM  28931  O    ARG J 386    -0.136  75.393   8.579  1.00  59.68      A  O
ATOM  28932  N    MET J 387    -1.970  74.421   7.829  1.00  60.34      A  N
ATOM  28933  CA   MET J 387    -2.468  75.592   7.188  1.00  61.36      A  C
ATOM  28934  CB   MET J 387    -3.771  75.240   6.501  1.00  60.80      J  C
ATOM  28935  CG   MET J 387    -4.228  76.237   5.501  1.00  61.33      J  C
ATOM  28936  SD   MET J 387    -5.824  75.911   4.811  1.00  58.45      J  S
ATOM  28937  CE   MET J 387    -6.720  77.120   5.682  1.00  54.59      J  C
ATOM  28938  C    MET J 387    -2.627  76.767   8.139  1.00  62.24      A  C
ATOM  28939  O    MET J 387    -2.976  76.621   9.291  1.00  61.72      A  O
ATOM  28940  N    PRO J 388    -2.396  77.946   7.611  1.00  63.72      A  N
ATOM  28941  CA   PRO J 388    -2.392  79.174   8.370  1.00  65.06      A  C
ATOM  28942  CB   PRO J 388    -1.842  80.172   7.372  1.00  64.81      A  C
ATOM  28943  CG   PRO J 388    -1.095  79.373   6.393  1.00  64.59      A  C
ATOM  28944  CD   PRO J 388    -1.296  77.936   6.655  1.00  64.28      A  C
ATOM  28945  C    PRO J 388    -3.754  79.588   8.816  1.00  66.64      A  C
ATOM  28946  O    PRO J 388    -4.730  79.232   8.242  1.00  66.61      A  O
ATOM  28947  N    PRO J 389    -3.819  80.438   9.806  1.00  68.19      A  N
ATOM  28948  CA   PRO J 389    -5.039  80.651  10.550  1.00  69.44      A  C
ATOM  28949  CB   PRO J 389    -4.525  81.315  11.785  1.00  69.25      A  C
ATOM  28950  CG   PRO J 389    -3.302  80.626  12.024  1.00  69.45      A  C
ATOM  28951  CD   PRO J 389    -2.694  80.287  10.716  1.00  68.35      A  C
ATOM  28952  C    PRO J 389    -6.146  81.469   9.943  1.00  70.99      A  C
ATOM  28953  O    PRO J 389    -7.251  80.974   9.908  1.00  72.25      A  O
ATOM  28954  N    PRO J 390    -5.909  82.687   9.512  1.00  71.65      A  N
ATOM  28955  CA   PRO J 390    -7.031  83.483   9.060  1.00  72.00      A  C
ATOM  28956  CB   PRO J 390    -6.374  84.519   8.195  1.00  72.20      A  C
ATOM  28957  CG   PRO J 390    -5.225  83.812   7.628  1.00  72.90      A  C
ATOM  28958  CD   PRO J 390    -4.833  82.701   8.523  1.00  72.04      A  C
ATOM  28959  C    PRO J 390    -7.915  82.614   8.220  1.00  71.98      A  C
ATOM  28960  O    PRO J 390    -8.877  82.094   8.747  1.00  71.61      A  O
ATOM  28961  O    HOH W   1   -73.415  25.982  31.469  1.00  33.96      W  O
ATOM  28962  O    HOH W   2   -52.131  38.623  33.847  1.00  36.18      W  O
ATOM  28963  O    HOH W   3    18.056  96.792   0.901  1.00  28.49      W  O
ATOM  28964  O    HOH W   4   -70.365  92.191  37.151  1.00  23.11      W  O
ATOM  28965  O    HOH W   5    38.845  79.320  19.915  1.00  32.72      W  O
ATOM  28966  O    HOH W   6   -67.212  17.148  15.495  1.00  19.46      W  O
ATOM  28967  O    HOH W   7   -43.325  65.507  60.986  1.00  14.99      W  O
```

Appendix 1

```
ATOM  28968  O  HOH W   8    1.796  81.565  64.332  1.00  22.45  W  O
ATOM  28969  O  HOH W   9   18.248  39.777  43.264  1.00  46.22  W  O
ATOM  28970  O  HOH W  10   36.336  37.996  64.439  1.00  56.78  W  O
ATOM  28971  O  HOH W  11  -28.644  39.709  54.981  1.00  38.31  W  O
ATOM  28972  O  HOH W  12  -79.300  92.308  39.502  1.00  23.27  W  O
ATOM  28973  O  HOH W  13  -22.512  76.846  38.323  1.00  34.72  W  O
ATOM  28974  O  HOH W  14  -12.059  18.672  27.731  1.00  43.40  W  O
ATOM  28975  O  HOH W  15  -70.263  20.035  38.322  1.00  21.15  W  O
ATOM  28976  O  HOH W  16   17.897  25.763  -5.557  1.00  49.36  W  O
ATOM  28977  O  HOH W  17  -64.712  99.615  33.795  1.00  31.47  W  O
ATOM  28978  O  HOH W  18   -4.848  22.638  76.246  1.00  22.02  W  O
ATOM  28979  O  HOH W  19    1.077  22.633  61.539  1.00  25.60  W  O
ATOM  28980  O  HOH W  20  -58.715  -3.149  19.873  1.00  35.63  W  O
ATOM  28981  O  HOH W  21  -45.086  70.937  61.780  1.00  29.95  W  O
ATOM  28982  O  HOH W  22    7.284  83.821   6.810  1.00  34.01  W  O
ATOM  28983  O  HOH W  23    6.341  25.354  53.763  1.00  16.54  W  O
ATOM  28984  O  HOH W  24  -46.970  15.602  48.011  1.00  40.20  W  O
ATOM  28985  O  HOH W  25  -36.994  47.654  37.815  1.00  30.29  W  O
ATOM  28986  O  HOH W  26   26.812  67.955 -11.096  1.00  33.96  W  O
ATOM  28987  O  HOH W  27   17.258  84.727  60.237  1.00  31.74  W  O
ATOM  28988  O  HOH W  28  -25.996  42.872  41.134  1.00  37.35  W  O
ATOM  28989  O  HOH W  29  -76.404 102.116  13.661  1.00  40.44  W  O
ATOM  28990  O  HOH W  30  -82.225  86.598  14.472  1.00  37.48  W  O
ATOM  28991  O  HOH W  31   25.083  85.198 -10.338  1.00  22.04  W  O
ATOM  28992  O  HOH W  32   39.753  80.707 -12.730  1.00  45.77  W  O
ATOM  28993  O  HOH W  33  -47.710  60.690  63.130  1.00  30.91  W  O
ATOM  28994  O  HOH W  34   38.396  70.229  -8.007  1.00  34.97  W  O
ATOM  28995  O  HOH W  35   39.567  24.811  11.286  1.00  22.41  W  O
ATOM  28996  O  HOH W  36   47.077  39.215  -7.989  1.00  24.07  W  O
ATOM  28997  O  HOH W  37  -62.007  10.308  47.882  1.00  27.58  W  O
ATOM  28998  O  HOH W  38   13.607  24.491  79.975  1.00  21.38  W  O
ATOM  28999  O  HOH W  39   52.794  40.376  70.001  1.00  44.93  W  O
ATOM  29000  O  HOH W  40  -63.832  75.033  32.803  1.00  39.45  W  O
ATOM  29001  O  HOH W  41   18.954  61.528  71.591  1.00  18.46  W  O
ATOM  29002  O  HOH W  42  -77.771  11.757  22.859  1.00  27.91  W  O
ATOM  29003  O  HOH W  43   -4.765  82.305  -8.313  1.00  37.73  W  O
ATOM  29004  O  HOH W  44  -50.176   9.395  11.054  1.00  27.96  W  O
ATOM  29005  O  HOH W  45  -48.024  11.978  52.080  1.00  44.19  W  O
ATOM  29006  O  HOH W  46  -43.466  79.388  43.119  1.00  24.91  W  O
ATOM  29007  O  HOH W  47  -48.507  -0.695  32.253  1.00  24.23  W  O
ATOM  29008  O  HOH W  48  -77.756 102.401  21.200  1.00  25.01  W  O
ATOM  29009  O  HOH W  49   18.269 108.720  68.846  1.00  43.94  W  O
ATOM  29010  O  HOH W  50   34.626  79.049  21.654  1.00  38.41  W  O
ATOM  29011  O  HOH W  51   -2.047  99.468  69.974  1.00  20.67  W  O
ATOM  29012  O  HOH W  52  -56.435 107.737  20.672  1.00  36.99  W  O
ATOM  29013  O  HOH W  53   -1.478 109.386  46.745  1.00  36.81  W  O
ATOM  29014  O  HOH W  54  -40.357  66.099  67.217  1.00  27.77  W  O
ATOM  29015  O  HOH W  55  -22.194  70.146  56.478  1.00  14.28  W  O
ATOM  29016  O  HOH W  56  -32.947  51.104   6.416  1.00  30.56  W  O
ATOM  29017  O  HOH W  57    1.998  95.587  39.689  1.00  24.34  W  O
ATOM  29018  O  HOH W  58  -73.188  19.116   6.569  1.00  37.96  W  O
ATOM  29019  O  HOH W  59  -27.998  20.872  45.644  1.00  44.16  W  O
ATOM  29020  O  HOH W  60   -5.865  20.561  48.656  1.00  36.46  W  O
ATOM  29021  O  HOH W  61  -28.598  41.841  28.432  1.00  34.60  W  O
```

Appendix 1

```
ATOM  29022  O  HOH W  62   -20.874  84.055  49.823  1.00 44.40  W  O
ATOM  29023  O  HOH W  63   -71.663  42.561  22.742  1.00 28.79  W  O
ATOM  29024  O  HOH W  64    16.309  13.945  86.426  1.00 41.64  W  O
ATOM  29025  O  HOH W  65   -64.376  79.558   9.519  1.00 25.35  W  O
ATOM  29026  O  HOH W  66   -58.738  17.445   5.877  1.00 33.69  W  O
ATOM  29027  O  HOH W  67   -60.274  78.557   8.037  1.00 34.00  W  O
ATOM  29028  O  HOH W  68    43.310 100.060   2.263  1.00 46.80  W  O
ATOM  29029  O  HOH W  69   -13.655  38.586  37.077  1.00 37.19  W  O
ATOM  29030  O  HOH W  70    24.403  70.797  56.545  1.00 42.62  W  O
ATOM  29031  O  HOH W  71    48.830  20.665   8.960  1.00 37.08  W  O
ATOM  29032  O  HOH W  72   -38.935  27.574  20.419  1.00 35.11  W  O
ATOM  29033  O  HOH W  73    15.720  26.976  86.577  1.00 30.66  W  O
ATOM  29034  O  HOH W  74    31.128  88.553  48.254  1.00 39.25  W  O
ATOM  29035  O  HOH W  75   -24.599  24.828  51.204  1.00 30.79  W  O
ATOM  29036  O  HOH W  76   -31.522  58.588  -2.444  1.00 39.69  W  O
ATOM  29037  O  HOH W  77    -8.153  39.220  75.612  1.00 29.37  W  O
ATOM  29038  O  HOH W  78    50.143  44.031   2.732  1.00 29.48  W  O
ATOM  29039  O  HOH W  79   -40.867  75.487  36.511  1.00 42.77  W  O
ATOM  29040  O  HOH W  80   -45.433  24.433  60.966  1.00 35.06  W  O
ATOM  29041  O  HOH W  81   -11.042  14.410  61.290  1.00 31.71  W  O
ATOM  29042  O  HOH W  82   -10.984  48.533  -2.462  1.00 40.94  W  O
ATOM  29043  O  HOH W  83   -46.103  14.306  16.377  1.00 20.28  W  O
ATOM  29044  O  HOH W  84   -49.530  23.289  34.901  1.00 31.27  W  O
ATOM  29045  O  HOH W  85    10.383  14.545  43.739  1.00 39.53  W  O
ATOM  29046  O  HOH W  86     0.294  75.385  67.790  1.00 37.06  W  O
ATOM  29047  O  HOH W  87   -41.098  74.608  57.731  1.00 22.67  W  O
ATOM  29048  O  HOH W  88    40.952  89.030   3.073  1.00 27.98  W  O
ATOM  29049  O  HOH W  89    -0.685  22.518  43.687  1.00 26.96  W  O
ATOM  29050  O  HOH W  90   -62.162  20.552  53.373  1.00 33.44  W  O
ATOM  29051  O  HOH W  91   -19.400  77.228  34.079  1.00 36.62  W  O
ATOM  29052  O  HOH W  92     1.189  84.341  49.635  1.00 34.87  W  O
ATOM  29053  O  HOH W  93    53.003  41.058   5.548  1.00 32.20  W  O
ATOM  29054  O  HOH W  94    36.043  65.756  96.041  1.00 42.37  W  O
ATOM  29055  O  HOH W  95   -15.296  41.899  69.509  1.00 28.89  W  O
ATOM  29056  O  HOH W  96   -23.952  24.392  69.456  1.00 24.98  W  O
ATOM  29057  O  HOH W  97   -58.692   4.741  47.836  1.00 37.78  W  O
ATOM  29058  O  HOH W  98   -46.497  28.462  48.023  1.00 25.37  W  O
ATOM  29059  O  HOH W  99    20.818  15.346  69.302  1.00 37.46  W  O
ATOM  29060  O  HOH W 100    32.188  41.932  39.895  1.00 48.91  W  O
ATOM  29061  O  HOH W 101   -14.179  17.719  35.750  1.00 27.16  W  O
ATOM  29062  O  HOH W 102    13.007  49.715  85.836  1.00 36.10  W  O
ATOM  29063  O  HOH W 103   -35.935  43.366  49.565  1.00 21.47  W  O
ATOM  29064  O  HOH W 104     8.670  15.457  88.921  1.00 35.36  W  O
ATOM  29065  O  HOH W 105   -24.798  14.253  43.619  1.00 25.75  W  O
ATOM  29066  O  HOH W 106   -57.874  75.950  29.026  1.00 24.14  W  O
ATOM  29067  O  HOH W 107    -4.572  29.129  53.278  1.00 46.79  W  O
ATOM  29068  O  HOH W 108   -66.729   0.377  48.586  1.00 31.40  W  O
ATOM  29069  O  HOH W 109    29.123  52.124  30.258  1.00 33.83  W  O
ATOM  29070  O  HOH W 110   -68.664  87.803  56.346  1.00 48.43  W  O
ATOM  29071  O  HOH W 111   -81.360  73.699  36.528  1.00 44.34  W  O
ATOM  29072  O  HOH W 112    -0.206  99.913  55.637  1.00 27.95  W  O
ATOM  29073  O  HOH W 113     5.703  27.215  68.348  1.00 31.05  W  O
ATOM  29074  O  HOH W 114    14.693  67.002  14.926  1.00 32.47  W  O
ATOM  29075  O  HOH W 115   -22.316  62.371  62.619  1.00 39.61  W  O
```

Appendix 1

```
ATOM  29076  O  HOH W 116  -15.452  33.990  29.976  1.00 38.29  W  O
ATOM  29077  O  HOH W 117  -71.494  96.580  18.297  1.00 15.72  W  O
ATOM  29078  O  HOH W 118   17.364 101.428  79.015  1.00 37.78  W  O
ATOM  29079  O  HOH W 119    2.625  25.898  55.933  1.00 24.22  W  O
ATOM  29080  O  HOH W 120   13.657 103.365   7.278  1.00 31.45  W  O
ATOM  29081  O  HOH W 121  -18.771  86.174  30.867  1.00 30.75  W  O
ATOM  29082  O  HOH W 122  -23.184  25.656  28.349  1.00 44.80  W  O
ATOM  29083  O  HOH W 123  -14.822  25.034  37.325  1.00 31.49  W  O
ATOM  29084  O  HOH W 124   48.722  55.455  48.758  1.00 32.78  W  O
ATOM  29085  O  HOH W 125   30.799  78.074  47.946  1.00 30.75  W  O
ATOM  29086  O  HOH W 126  -73.671  36.689  34.563  1.00 47.73  W  O
ATOM  29087  O  HOH W 127  -63.512  -5.035  45.943  1.00 24.83  W  O
ATOM  29088  O  HOH W 128  -45.368  14.997  13.119  1.00 25.74  W  O
ATOM  29089  O  HOH W 129  -11.158 102.404  46.606  1.00 34.57  W  O
ATOM  29090  O  HOH W 130   31.338  62.917  -6.669  1.00 46.34  W  O
ATOM  29091  O  HOH W 131  -65.138  99.293  41.824  1.00 21.44  W  O
ATOM  29092  O  HOH W 132   -9.662  38.706  33.551  1.00 32.96  W  O
ATOM  29093  O  HOH W 133   20.505  78.642  59.998  1.00 36.67  W  O
ATOM  29094  O  HOH W 134   50.524  93.366   1.220  1.00 31.92  W  O
ATOM  29095  O  HOH W 135   29.930  68.306  31.548  1.00 33.25  W  O
ATOM  29096  O  HOH W 136   29.577  92.220 -10.846  1.00 46.18  W  O
ATOM  29097  O  HOH W 137  -58.783  -2.522  40.772  1.00 28.20  W  O
ATOM  29098  O  HOH W 138    0.832  19.861  63.946  1.00 37.83  W  O
ATOM  29099  O  HOH W 139   41.110  81.928  61.474  1.00 36.03  W  O
ATOM  29100  O  HOH W 140   -2.525  32.414  78.817  1.00 39.79  W  O
ATOM  29101  O  HOH W 141  -71.144  26.802  27.352  1.00 26.40  W  O
ATOM  29102  O  HOH W 142  -19.643  75.928  57.635  1.00 33.69  W  O
ATOM  29103  O  HOH W 143  -43.598  55.693  46.288  1.00 26.95  W  O
ATOM  29104  O  HOH W 144  -77.513  79.008  39.608  1.00 26.47  W  O
ATOM  29105  O  HOH W 145   20.532  85.317  44.147  1.00 23.09  W  O
ATOM  29106  O  HOH W 146  -14.323  29.364  45.778  1.00 26.56  W  O
ATOM  29107  O  HOH W 147  -34.336  19.672  72.410  1.00 24.40  W  O
ATOM  29108  O  HOH W 148   27.196  60.108   3.959  1.00 41.39  W  O
ATOM  29109  O  HOH W 149   -1.533  16.492  51.919  1.00 26.37  W  O
ATOM  29110  O  HOH W 150  -23.703  36.649  22.031  1.00 30.50  W  O
ATOM  29111  O  HOH W 151  -33.262  21.863  48.969  1.00 29.90  W  O
ATOM  29112  O  HOH W 152  -73.459 103.816  18.030  1.00 30.03  W  O
ATOM  29113  O  HOH W 153  -66.059  96.974  36.496  1.00 29.35  W  O
ATOM  29114  O  HOH W 154  -72.163  24.797  35.394  1.00 29.92  W  O
ATOM  29115  O  HOH W 155  -45.381  98.448  36.020  1.00 40.41  W  O
ATOM  29116  O  HOH W 156  -31.087  67.142  29.987  1.00 31.02  W  O
ATOM  29117  O  HOH W 157    4.704  23.300  48.351  1.00 37.33  W  O
ATOM  29118  O  HOH W 158   43.543  16.875   9.448  1.00 39.03  W  O
ATOM  29119  O  HOH W 159  -11.546  84.088  48.497  1.00 30.61  W  O
ATOM  29120  O  HOH W 160   36.184  42.622  53.192  1.00 45.97  W  O
ATOM  29121  O  HOH W 161  -16.917  74.898  11.477  1.00 47.67  W  O
ATOM  29122  O  HOH W 162   36.958  84.443  64.141  1.00 38.64  W  O
ATOM  29123  O  HOH W 163  -64.824  21.173   8.708  1.00 35.80  W  O
ATOM  29124  O  HOH W 164  -22.851  50.861  29.772  1.00 29.77  W  O
ATOM  29125  O  HOH W 165   30.164  21.328  64.337  1.00 31.66  W  O
ATOM  29126  O  HOH W 166    0.668  26.393  57.789  1.00 27.58  W  O
ATOM  29127  O  HOH W 167  -57.234  15.088   6.372  1.00 55.98  W  O
ATOM  29128  O  HOH W 168  -77.898  83.211  31.207  1.00 26.62  W  O
ATOM  29129  O  HOH W 169   32.605  18.454  64.832  1.00 38.87  W  O
```

Appendix 1

```
ATOM  29130  O  HOH W 170   29.705  78.024  -4.966  1.00 29.65   W  O
ATOM  29131  O  HOH W 171   46.454  78.507  14.730  1.00 23.91   W  O
ATOM  29132  O  HOH W 172  -37.744  71.371  24.665  1.00 40.66   W  O
ATOM  29133  O  HOH W 173  -71.931  93.983  42.497  1.00 36.20   W  O
ATOM  29134  O  HOH W 174  -69.329  13.722  20.715  1.00 17.94   W  O
ATOM  29135  O  HOH W 175  -26.113  61.207  39.417  1.00 20.46   W  O
ATOM  29136  O  HOH W 176  -25.598  49.264  60.392  1.00 25.08   W  O
ATOM  29137  O  HOH W 177  -51.884  72.494  64.015  1.00 25.05   W  O
ATOM  29138  O  HOH W 178  -69.695  18.528  20.963  1.00 32.38   W  O
ATOM  29139  O  HOH W 179    1.011  33.923  70.667  1.00 34.55   W  O
ATOM  29140  O  HOH W 180  -11.651  44.358  56.288  1.00 25.50   W  O
ATOM  29141  O  HOH W 181  -48.590  80.050  54.642  1.00 32.88   W  O
ATOM  29142  O  HOH W 182   22.232  97.552  36.136  1.00 41.37   W  O
ATOM  29143  O  HOH W 183  -23.806  73.816  61.467  1.00 32.42   W  O
ATOM  29144  O  HOH W 184   41.753  73.348  11.683  1.00 26.74   W  O
ATOM  29145  O  HOH W 185    5.554  37.404  68.130  1.00 27.26   W  O
ATOM  29146  O  HOH W 186  -50.148  15.247  49.618  1.00 44.12   W  O
ATOM  29147  O  HOH W 187    1.558  39.556  62.407  1.00 33.79   W  O
ATOM  29148  O  HOH W 188   28.346  33.319  37.100  1.00 39.89   W  O
ATOM  29149  O  HOH W 189  -34.394  60.500  29.748  1.00 33.15   W  O
ATOM  29150  O  HOH W 190  -19.439  42.884  58.552  1.00 25.71   W  O
ATOM  29151  O  HOH W 191  -32.691  53.266  58.249  1.00 59.62   W  O
ATOM  29152  O  HOH W 192   26.212  55.003   8.359  1.00 42.38   W  O
ATOM  29153  O  HOH W 193  -60.664  98.195  50.213  1.00 34.60   W  O
ATOM  29154  O  HOH W 194  -36.128  95.446  60.722  1.00 30.54   W  O
ATOM  29155  O  HOH W 195  -17.721  58.681 -17.217  1.00 35.78   W  O
ATOM  29156  O  HOH W 196   -0.742  41.029  65.328  1.00 33.69   W  O
ATOM  29157  O  HOH W 197   27.381  83.434  21.939  1.00 27.09   W  O
ATOM  29158  O  HOH W 198  -42.855   4.298  16.698  1.00 39.84   W  O
ATOM  29159  O  HOH W 199  -12.052  67.064  10.850  1.00 38.77   W  O
ATOM  29160  O  HOH W 200  -67.550 101.554  20.074  1.00 29.46   W  O
ATOM  29161  O  HOH W 201   -3.243   8.778  60.359  1.00 53.47   W  O
ATOM  29162  O  HOH W 202   11.826  88.682  49.361  1.00 22.72   W  O
ATOM  29163  O  HOH W 203   50.565  22.237   5.736  1.00 34.73   W  O
ATOM  29164  O  HOH W 204   -8.122 100.610  73.175  1.00 22.55   W  O
ATOM  29165  O  HOH W 205   17.567  41.081  37.178  1.00 34.29   W  O
ATOM  29166  O  HOH W 206  -47.038  13.986  45.016  1.00 41.40   W  O
ATOM  29167  O  HOH W 207  -15.784  35.972  69.452  1.00 27.67   W  O
ATOM  29168  O  HOH W 208  -26.457  71.515  -8.965  1.00 40.74   W  O
ATOM  29169  O  HOH W 209   -3.269  25.959  38.302  1.00 37.81   W  O
ATOM  29170  O  HOH W 210  -20.710  78.258  15.764  1.00 51.21   W  O
ATOM  29171  O  HOH W 211  -18.225  69.335  33.662  1.00 31.58   W  O
ATOM  29172  O  HOH W 212   33.867  44.691  37.433  1.00 34.61   W  O
ATOM  29173  O  HOH W 213  -21.494  77.759  49.735  1.00 37.48   W  O
ATOM  29174  O  HOH W 214   14.129  58.664  64.666  1.00 35.33   W  O
ATOM  29175  O  HOH W 215   11.633  90.498  78.488  1.00 32.76   W  O
ATOM  29176  O  HOH W 216   13.194  73.032   9.607  1.00 33.07   W  O
ATOM  29177  O  HOH W 217  -47.451  66.369  68.031  1.00 25.09   W  O
ATOM  29178  O  HOH W 218   29.851  91.217  58.561  1.00 40.34   W  O
ATOM  29179  O  HOH W 219   29.722  22.109  50.655  1.00 35.92   W  O
ATOM  29180  O  HOH W 220    3.639 110.795  38.696  1.00 35.68   W  O
ATOM  29181  O  HOH W 221  -73.677 102.415  22.330  1.00 30.35   W  O
ATOM  29182  O  HOH W 222  -52.867  24.002  49.132  1.00 30.54   W  O
ATOM  29183  O  HOH W 223  -42.335  11.022  22.798  1.00 19.47   W  O
```

Appendix 1

```
ATOM  29184  O  HOH W 224    4.927  16.244  48.222  1.00  29.43    W    O
ATOM  29185  O  HOH W 225  -62.379  94.168   2.956  1.00  36.14    W    O
ATOM  29186  O  HOH W 226   22.392  33.635  58.982  1.00  34.06    W    O
ATOM  29187  O  HOH W 227  -50.314  21.579  38.992  1.00  40.55    W    O
ATOM  29188  O  HOH W 228   24.668  17.697  62.756  1.00  27.74    W    O
ATOM  29189  O  HOH W 229   35.528  19.648  13.367  1.00  39.66    W    O
ATOM  29190  O  HOH W 230  -66.473  78.408  25.816  1.00  37.46    W    O
ATOM  29191  O  HOH W 231  -75.291  28.427  38.944  1.00  29.73    W    O
ATOM  29192  O  HOH W 232  -11.360  89.166  36.606  1.00  28.74    W    O
ATOM  29193  O  HOH W 233  -27.600  56.567  53.657  1.00  31.26    W    O
ATOM  29194  O  HOH W 234  -66.277  31.150  25.739  1.00  33.10    W    O
ATOM  29195  O  HOH W 235  -55.227  38.608  16.740  1.00  30.94    W    O
ATOM  29196  O  HOH W 236   47.271  67.329  -5.484  1.00  27.94    W    O
ATOM  29197  O  HOH W 237   29.004  89.759  71.824  1.00  36.92    W    O
ATOM  29198  O  HOH W 238   -2.550  28.580  85.362  1.00  19.65    W    O
ATOM  29199  O  HOH W 239    9.406  87.217  48.147  1.00  36.69    W    O
ATOM  29200  O  HOH W 240  -35.297  43.267  56.830  1.00  34.51    W    O
ATOM  29201  O  HOH W 241  -23.765  46.597  57.154  1.00  38.64    W    O
ATOM  29202  O  HOH W 242  -77.787  81.756  33.460  1.00  23.63    W    O
ATOM  29203  O  HOH W 243    5.048  16.331  83.543  1.00  31.95    W    O
ATOM  29204  O  HOH W 244    3.789  84.596  78.570  1.00  30.30    W    O
ATOM  29205  O  HOH W 245   52.098  59.590  64.843  1.00  33.68    W    O
ATOM  29206  O  HOH W 246   29.776  61.753  51.378  1.00  44.84    W    O
ATOM  29207  O  HOH W 247   25.456  66.804  58.958  1.00  44.77    W    O
ATOM  29208  O  HOH W 248   40.983  67.427  -1.650  1.00  30.90    W    O
ATOM  29209  O  HOH W 249   40.671  76.275  14.448  1.00  31.74    W    O
ATOM  29210  O  HOH W 250  -34.208  53.633  37.136  1.00  46.09    W    O
ATOM  29211  O  HOH W 251  -11.652  97.756  70.411  1.00  33.19    W    O
ATOM  29212  O  HOH W 252  -45.215  66.912  25.751  1.00  43.92    W    O
ATOM  29213  O  HOH W 253  -28.776  86.497  64.829  1.00  30.31    W    O
ATOM  29214  O  HOH W 254   37.533  68.904  30.048  1.00  42.45    W    O
ATOM  29215  O  HOH W 255   28.283  96.257  67.369  1.00  38.29    W    O
ATOM  29216  O  HOH W 256   21.808  86.478  50.918  1.00  23.17    W    O
ATOM  29217  O  HOH W 257  -46.694  89.640  19.321  1.00  21.22    W    O
ATOM  29218  O  HOH W 258  -30.286  22.370  33.221  1.00  36.37    W    O
ATOM  29219  O  HOH W 259  -51.881  80.776  57.963  1.00  27.90    W    O
ATOM  29220  O  HOH W 260   -4.814  74.418  67.843  1.00  35.85    W    O
ATOM  29221  O  HOH W 261   50.198  76.772   0.741  1.00  34.89    W    O
ATOM  29222  O  HOH W 262   -8.531  35.837   3.092  1.00  40.85    W    O
ATOM  29223  O  HOH W 263  -19.658  29.986  74.019  1.00  37.85    W    O
ATOM  29224  O  HOH W 264  -74.747  13.118  43.271  1.00  29.92    W    O
ATOM  29225  O  HOH W 265  -85.586  74.531  27.783  1.00  31.56    W    O
ATOM  29226  O  HOH W 266  -23.239  59.343  -2.957  1.00  27.22    W    O
ATOM  29227  O  HOH W 267  -46.295  93.566  17.180  1.00  27.19    W    O
ATOM  29228  O  HOH W 268    2.921  73.537   3.583  1.00  32.56    W    O
ATOM  29229  O  HOH W 269   22.318 101.111  32.165  1.00  39.52    W    O
ATOM  29230  O  HOH W 270    0.024 111.376  79.697  1.00  38.67    W    O
ATOM  29231  O  HOH W 271   26.786  72.776  57.932  1.00  30.19    W    O
ATOM  29232  O  HOH W 272    4.745 107.407  58.068  1.00  28.87    W    O
ATOM  29233  O  HOH W 273  -79.534   8.206  39.841  1.00  41.69    W    O
ATOM  29234  O  HOH W 274   31.594  95.930  -4.324  1.00  32.70    W    O
ATOM  29235  O  HOH W 275   34.093  47.621  37.435  1.00  34.83    W    O
ATOM  29236  O  HOH W 276  -51.512  19.174  41.267  1.00  37.98    W    O
ATOM  29237  O  HOH W 277    0.541  41.173 -17.335  1.00  36.62    W    O
```

Appendix 1

```
ATOM  29238  O   HOH W 278      41.831  58.642   6.799  1.00 36.71      W    O
ATOM  29239  O   HOH W 279      -9.393 107.100  64.577  1.00 30.55      W    O
ATOM  29240  O   HOH W 280     -17.875 104.407  67.002  1.00 42.47      W    O
ATOM  29241  O   HOH W 281     -59.177  14.686  52.955  1.00 36.04      W    O
ATOM  29242  O   HOH W 282     -71.823  95.940   6.056  1.00 36.32      W    O
ATOM  29243  O   HOH W 283      -0.145  34.703  66.727  1.00 24.07      W    O
ATOM  29244  O   HOH W 284     -21.298  54.991  60.178  1.00 33.87      W    O
ATOM  29245  O   HOH W 285      33.262  58.455  59.254  1.00 47.27      W    O
ATOM  29246  O   HOH W 286     -26.195  56.547  28.900  1.00 30.75      W    O
ATOM  29247  O   HOH W 287     -32.193  30.125  30.842  1.00 41.10      W    O
ATOM  29248  O   HOH W 288     -39.915  24.310  20.653  1.00 34.49      W    O
ATOM  29249  O   HOH W 289       5.398  51.162   9.318  1.00 33.11      W    O
ATOM  29250  O   HOH W 290     -11.546  84.617  45.866  1.00 33.67      W    O
ATOM  29251  O   HOH W 291     -50.477  37.451  30.069  1.00 37.51      W    O
ATOM  29252  O   HOH W 292     -59.665  81.900  14.605  1.00 44.41      W    O
ATOM  29253  O   HOH W 293       0.339  82.229  86.050  1.00 38.18      W    O
ATOM  29254  O   HOH W 294     -75.603  95.485   6.983  1.00 32.25      W    O
ATOM  29255  O   HOH W 295     -46.912  79.952  36.905  1.00 25.12      W    O
ATOM  29256  O   HOH W 296      38.396  74.001 -14.090  1.00 23.51      W    O
ATOM  29257  O   HOH W 297       7.507  79.990  70.855  1.00 34.62      W    O
ATOM  29258  O   HOH W 298       7.891  90.314  12.919  1.00 40.04      W    O
ATOM  29259  O   HOH W 299     -53.656  30.357   6.547  1.00 30.65      W    O
ATOM  29260  O   HOH W 300     -72.632  -6.904  25.400  1.00 35.95      W    O
ATOM  29261  O   HOH W 301     -73.837  21.057  42.768  1.00 41.81      W    O
ATOM  29262  O   HOH W 302      18.155  75.998  84.934  1.00 48.12      W    O
ATOM  29263  O   HOH W 303      30.314  29.544  28.159  1.00 37.26      W    O
ATOM  29264  O   HOH W 304      22.887  65.979   3.985  1.00 34.65      W    O
ATOM  29265  O   HOH W 305      10.796  49.041   9.033  1.00 38.10      W    O
ATOM  29266  O   HOH W 306      13.451  37.462  57.066  1.00 30.25      W    O
ATOM  29267  O   HOH W 307      22.603  32.978  89.930  1.00 46.75      W    O
ATOM  29268  O   HOH W 308     -56.001  80.030  43.836  1.00 38.10      W    O
ATOM  29269  O   HOH W 309     -24.782  62.749  65.625  1.00 29.04      W    O
ATOM  29270  O   HOH W 310       8.522  52.303  81.780  1.00 37.94      W    O
ATOM  29271  O   HOH W 311     -31.877  65.549   2.707  1.00 37.73      W    O
ATOM  29272  O   HOH W 312     -37.848  16.816  18.991  1.00 42.19      W    O
ATOM  29273  O   HOH W 313     -38.173  61.420  65.930  1.00 44.63      W    O
ATOM  29274  O   HOH W 314     -22.442  88.859  28.205  1.00 32.37      W    O
ATOM  29275  O   HOH W 315      24.800  34.423  44.537  1.00 34.59      W    O
ATOM  29276  O   HOH W 316     -61.328  99.415  29.637  1.00 33.77      W    O
ATOM  29277  O   HOH W 317     -40.298   9.026  19.508  1.00 28.05      W    O
ATOM  29278  O   HOH W 318     -83.958  75.546  40.099  1.00 34.48      W    O
ATOM  29279  O   HOH W 319       0.824  39.907 -14.000  1.00 55.05      W    O
ATOM  29280  O   HOH W 320      25.887  63.753  -0.130  1.00 35.55      W    O
ATOM  29281  O   HOH W 321     -25.586  16.417  74.292  1.00 52.74      W    O
ATOM  29282  O   HOH W 322      23.811  97.099  13.264  1.00 38.83      W    O
ATOM  29283  O   HOH W 323      13.706  29.628  53.430  1.00 18.36      W    O
ATOM  29284  O   HOH W 324      28.481  31.813  25.021  1.00 38.28      W    O
ATOM  29285  O   HOH W 325     -46.910  82.767  47.811  1.00 32.44      W    O
ATOM  29286  O   HOH W 326     -68.494  66.126  26.949  1.00 49.28      W    O
ATOM  29287  O   HOH W 327      31.221  27.231  32.786  1.00 30.46      W    O
ATOM  29288  O   HOH W 328     -91.261  91.167  15.062  1.00 31.98      W    O
ATOM  29289  O   HOH W 329     -70.339   2.303  31.695  1.00 27.07      W    O
ATOM  29290  O   HOH W 330      -1.311 106.135  47.650  1.00 26.68      W    O
ATOM  29291  O   HOH W 331      49.476  18.307  15.832  1.00 27.83      W    O
```

Appendix 1

```
ATOM  29292  O  HOH W 332   -31.830  83.873  27.842  1.00 33.38   W  O
ATOM  29293  O  HOH W 333     5.246  82.621  69.492  1.00 28.74   W  O
ATOM  29294  O  HOH W 334   -82.696  95.495  36.301  1.00 39.05   W  O
ATOM  29295  O  HOH W 335   -27.492  45.236  36.066  1.00 29.44   W  O
ATOM  29296  O  HOH W 336   -22.254  73.729  38.436  1.00 24.70   W  O
ATOM  29297  O  HOH W 337     2.011  16.690  83.265  1.00 41.27   W  O
ATOM  29298  O  HOH W 338   -56.375  25.568   7.685  1.00 28.94   W  O
ATOM  29299  O  HOH W 339   -68.892   5.391  14.563  1.00 27.18   W  O
ATOM  29300  O  HOH W 340    23.927  36.090  81.616  1.00 41.29   W  O
ATOM  29301  O  HOH W 341    21.631  63.649  13.025  1.00 35.75   W  O
ATOM  29302  O  HOH W 342   -83.029  90.052  16.734  1.00 34.19   W  O
ATOM  29303  O  HOH W 343   -85.813  73.733  31.439  1.00 40.27   W  O
ATOM  29304  O  HOH W 344    32.979  86.534  20.790  1.00 37.63   W  O
ATOM  29305  O  HOH W 345   -19.907  82.059  21.270  1.00 35.14   W  O
ATOM  29306  O  HOH W 346     2.815  82.526  70.519  1.00 41.51   W  O
ATOM  29307  O  HOH W 347    31.929  72.672  31.981  1.00 46.69   W  O
ATOM  29308  O  HOH W 348   -22.424  72.078  14.088  1.00 52.44   W  O
ATOM  29309  O  HOH W 349   -48.607  45.746  55.323  1.00 52.70   W  O
ATOM  29310  O  HOH W 350     2.725  42.907  61.707  1.00 25.99   W  O
ATOM  29311  O  HOH W 351   -43.357   7.760  34.509  1.00 35.75   W  O
ATOM  29312  O  HOH W 352   -32.172  90.496  30.496  1.00 33.04   W  O
ATOM  29313  O  HOH W 353    23.798  38.658  81.145  1.00 58.29   W  O
ATOM  29314  O  HOH W 354   -54.452  42.208  30.515  1.00 37.62   W  O
ATOM  29315  O  HOH W 355   -16.282  68.770  61.134  1.00 40.02   W  O
ATOM  29316  O  HOH W 356   -24.158  49.747  38.468  1.00 36.69   W  O
ATOM  29317  O  HOH W 357    32.717  53.235  16.669  1.00 61.06   W  O
ATOM  29318  O  HOH W 358   -65.372 104.279  37.228  1.00 26.09   W  O
ATOM  29319  O  HOH W 359    32.986  68.116  45.407  1.00 37.55   W  O
ATOM  29320  O  HOH W 360    38.860  74.461  34.996  1.00 34.02   W  O
ATOM  29321  O  HOH W 361   -79.978  97.752  20.627  1.00 32.01   W  O
ATOM  29322  O  HOH W 362    43.548  61.644  42.851  1.00 43.52   W  O
ATOM  29323  O  HOH W 363    13.623 108.363  49.859  1.00 42.01   W  O
ATOM  29324  O  HOH W 364   -57.836  -1.128  43.572  1.00 43.18   W  O
ATOM  29325  O  HOH W 365    28.130  86.819 -15.003  1.00 42.96   W  O
ATOM  29326  O  HOH W 366    16.602  79.382  33.885  1.00 47.93   W  O
ATOM  29327  O  HOH W 367   -41.951   8.391  37.537  1.00 49.91   W  O
ATOM  29328  O  HOH W 368   -28.023  95.154  34.787  1.00 45.65   W  O
ATOM  29329  O  HOH W 369   -40.250  12.412  24.150  1.00 29.34   W  O
ATOM  29330  O  HOH W 370    31.963  61.943  53.198  1.00 29.64   W  O
ATOM  29331  O  HOH W 371    30.558  56.279  16.642  1.00 39.71   W  O
ATOM  29332  O  HOH W 372     7.947  74.400 -21.634  1.00 36.86   W  O
ATOM  29333  O  HOH W 373   -39.776  13.550  26.632  1.00 74.87   W  O
ATOM  29334  O  HOH W 374    31.777  78.510  32.495  1.00 42.25   W  O
ATOM  29335  O  HOH W 375   -13.568  90.106  73.081  1.00 26.83   W  O
ATOM  29336  O  HOH W 376    45.385  82.327  -9.293  1.00 28.90   W  O
ATOM  29337  O  HOH W 377    18.025  13.584  90.301  1.00 53.37   W  O
ATOM  29338  O  HOH W 378   -24.516  38.535  70.050  1.00 29.59   W  O
ATOM  29339  O  HOH W 379    -8.655  68.898  18.738  1.00208.64   W  O
ATOM  29340  O  HOH W 380    31.558  50.611  71.394  1.00 30.99   W  O
ATOM  29341  O  HOH W 381   -55.373  85.022  46.814  1.00 41.12   W  O
ATOM  29342  O  HOH W 382    16.521  50.402  84.306  1.00 44.41   W  O
ATOM  29343  O  HOH W 383    10.294  46.395  -6.942  1.00 43.01   W  O
ATOM  29344  O  HOH W 384    48.045  89.444  -4.756  1.00 55.77   W  O
ATOM  29345  O  HOH W 385     1.321  98.767  86.177  1.00 41.55   W  O
```

Appendix 1

```
ATOM  29346  O   HOH W 386    37.132  49.154  23.121  1.00 33.80      W   O
ATOM  29347  O   HOH W 387   -27.537  62.209  65.579  1.00 46.80      W   O
ATOM  29348  O   HOH W 388   -19.585  49.975  52.194  1.00 30.31      W   O
ATOM  29349  O   HOH W 389     3.367 110.697  64.024  1.00 35.73      W   O
ATOM  29350  O   HOH W 390    24.623  19.278  47.041  1.00 71.93      W   O
ATOM  29351  O   HOH W 391    17.841  56.428  85.482  1.00 36.49      W   O
ATOM  29352  O   HOH W 392    11.166  75.654  23.441  1.00 31.23      W   O
ATOM  29353  O   HOH W 393    56.128  32.199   9.146  1.00 54.84      W   O
ATOM  29354  O   HOH W 394    50.609  95.079  -6.258  1.00 45.63      W   O
ATOM  29355  O   HOH W 395   -45.223  83.145  30.620  1.00 25.18      W   O
ATOM  29356  O   HOH W 396    16.465  67.630   0.956  1.00 46.42      W   O
ATOM  29357  O   HOH W 397     5.623  99.749  29.101  1.00 53.44      W   O
ATOM  29358  O   HOH W 398   -17.604  74.434  42.488  1.00 38.86      W   O
ATOM  29359  O   HOH W 399    40.072  93.321  13.345  1.00 23.19      W   O
ATOM  29360  O   HOH W 400    12.055  27.345  53.213  1.00 33.10      W   O
ATOM  29361  O   HOH W 401    21.855  25.945  87.477  1.00 26.63      W   O
ATOM  29362  O   HOH W 402    26.586  57.185  59.632  1.00 29.52      W   O
ATOM  29363  O   HOH W 403   -70.633 101.944  45.121  1.00 29.13      W   O
ATOM  29364  O   HOH W 404   -73.901  75.376  44.584  1.00 24.12      W   O
ATOM  29365  O   HOH W 405   -55.092  15.058  10.627  1.00 30.68      W   O
ATOM  29366  O   HOH W 406   -85.798  74.361  34.530  1.00 45.66      W   O
ATOM  29367  O   HOH W 407   -40.823  10.307  42.607  1.00 42.15      W   O
ATOM  29368  O   HOH W 408    17.417 100.795  31.162  1.00 35.58      W   O
ATOM  29369  O   HOH W 409    25.184  32.396  11.072  1.00 43.77      W   O
ATOM  29370  O   HOH W 410    29.277  62.939  46.442  1.00 40.48      W   O
ATOM  29371  O   HOH W 411    50.171  69.362  63.889  1.00 59.14      W   O
ATOM  29372  O   HOH W 412    -0.171  38.493  37.393  1.00 53.81      W   O
ATOM  29373  O   HOH W 413    16.319  64.215  86.186  1.00 45.64      W   O
ATOM  29374  O   HOH W 414    31.811  60.342  58.201  1.00 33.11      W   O
ATOM  29375  O   HOH W 415   -13.844  71.785  56.632  1.00 36.11      W   O
ATOM  29376  O   HOH W 416    45.590  15.973  -0.263  1.00 47.35      W   O
ATOM  29377  O   HOH W 417   -54.492 106.009  41.020  1.00 33.80      W   O
ATOM  29378  O   HOH W 418   -61.734  27.374  49.916  1.00 36.27      W   O
ATOM  29379  O   HOH W 419    23.785  15.537  69.370  1.00 35.70      W   O
ATOM  29380  O   HOH W 420   -76.462  23.580  52.111  1.00 41.73      W   O
ATOM  29381  O   HOH W 421   -48.660  61.514  65.320  1.00 38.22      W   O
ATOM  29382  O   HOH W 422    -0.440  44.219  79.314  1.00 33.10      W   O
ATOM  29383  O   HOH W 423    16.145  71.657  -0.951  1.00 40.66      W   O
ATOM  29384  O   HOH W 424    47.693  52.392  54.878  1.00 42.24      W   O
ATOM  29385  O   HOH W 425   -24.760  22.101  29.716  1.00 39.57      W   O
ATOM  29386  O   HOH W 426    38.121  26.636  23.956  1.00 41.76      W   O
ATOM  29387  O   HOH W 427    -1.849  66.196  21.470  1.00 43.17      W   O
ATOM  29388  O   HOH W 428    39.240  65.181  26.646  1.00 44.35      W   O
ATOM  29389  O   HOH W 429   -33.579  53.538  51.845  1.00 39.77      W   O
ATOM  29390  O   HOH W 430    19.981  79.021 -10.372  1.00 27.96      W   O
ATOM  29391  O   HOH W 431    12.807  84.209  48.745  1.00 35.03      W   O
ATOM  29392  O   HOH W 432    16.208  33.827  48.391  1.00 38.60      W   O
ATOM  29393  O   HOH W 433   -16.939  87.369  34.543  1.00111.23      W   O
ATOM  29394  O   HOH W 434    34.399  46.579  44.686  1.00 62.70      W   O
ATOM  29395  O   HOH W 435    13.200  41.953   7.189  1.00 57.26      W   O
ATOM  29396  O   HOH W 436   -45.062  94.780  65.615  1.00 43.43      W   O
ATOM  29397  O   HOH W 437    14.548   8.547  51.635  1.00 38.51      W   O
ATOM  29398  O   HOH W 438   -75.531  67.822  32.904  1.00 32.95      W   O
ATOM  29399  O   HOH W 439     7.044  32.336  85.122  1.00 48.32      W   O
```

Appendix 1

```
ATOM  29400  O  HOH W 440   -40.379  91.527  61.855  1.00 47.22   W  O
ATOM  29401  O  HOH W 441   -47.720  61.787  54.961  1.00 30.47   W  O
ATOM  29402  O  HOH W 442     0.597  28.333  89.559  1.00 32.43   W  O
ATOM  29403  O  HOH W 443    13.580  83.661  29.555  1.00 46.21   W  O
ATOM  29404  O  HOH W 444    -4.709  41.495  -7.860  1.00 67.25   W  O
ATOM  29405  O  HOH W 445    -3.842  72.499  72.293  1.00 51.71   W  O
ATOM  29406  O  HOH W 446    11.770  79.492 -10.670  1.00 42.26   W  O
ATOM  29407  O  HOH W 447    19.215  69.350   8.361  1.00 40.32   W  O
ATOM  29408  O  HOH W 448    28.870  77.121  47.840  1.00 58.76   W  O
ATOM  29409  O  HOH W 449    -9.771  77.416  12.945  1.00 53.07   W  O
ATOM  29410  O  HOH W 450    -9.469  19.426  79.207  1.00 41.76   W  O
ATOM  29411  O  HOH W 451   -67.636 100.956  49.058  1.00 48.83   W  O
ATOM  29412  O  HOH W 452     0.912  16.735  41.928  1.00 38.39   W  O
ATOM  29413  O  HOH W 453    36.863  22.628  -7.669  1.00 47.66   W  O
ATOM  29414  O  HOH W 454    34.290  18.615  34.244  1.00 58.38   W  O
ATOM  29415  O  HOH W 455   -24.644  19.718  33.105  1.00 39.90   W  O
ATOM  29416  O  HOH W 456    -2.594  45.485  49.368  1.00 47.51   W  O
ATOM  29417  O  HOH W 457    42.933  26.678  29.400  1.00 50.99   W  O
ATOM  29418  O  HOH W 458    37.992  39.189  35.034  1.00 45.16   W  O
ATOM  29419  O  HOH W 459    10.574  47.964  17.399  1.00 56.51   W  O
ATOM  29420  O  HOH W 460    22.990  30.054  32.346  1.00 45.56   W  O
ATOM  29421  O  HOH W 461   -51.488  62.253  48.177  1.00 66.63   W  O
ATOM  29422  O  HOH W 462   -14.954  57.150  44.643  1.00 43.33   W  O
ATOM  29423  O  HOH W 463    24.926  12.030  54.665  1.00 35.26   W  O
ATOM  29424  O  HOH W 464   -20.295  81.444  41.635  1.00 38.59   W  O
ATOM  29425  O  HOH W 465    -9.417  12.252  66.169  1.00 51.01   W  O
ATOM  29426  O  HOH W 466    39.779  19.024  64.915  1.00 43.89   W  O
ATOM  29427  O  HOH W 467   -48.669  40.472  57.230  1.00 57.96   W  O
ATOM  29428  O  HOH W 468    40.943  46.046  60.248  1.00 45.35   W  O
ATOM  29429  O  HOH W 469   -50.064  95.061  46.348  1.00 55.92   W  O
ATOM  29430  O  HOH W 470    -2.303  69.089  16.959  1.00 61.88   W  O
ATOM  29431  O  HOH W 471   -68.608 101.859   5.003  1.00 46.75   W  O
ATOM  29432  O  HOH W 472   -57.837  70.504  26.820  1.00 53.30   W  O
ATOM  29433  O  HOH W 473   -45.495 102.156  16.681  1.00 63.58   W  O
ATOM  29434  O  HOH W 474   -15.725  51.755  -1.458  1.00 53.18   W  O
ATOM  29435  O  HOH W 475   -54.754  46.941  23.311  1.00 49.85   W  O
ATOM  29436  O  HOH W 476     4.849 105.620  32.809  1.00 45.77   W  O
ATOM  29437  O  HOH W 477   -78.961  18.140  13.890  1.00 32.74   W  O
ATOM  29438  O  HOH W 478   -21.548  74.684  56.488  1.00 28.24   W  O
ATOM  29439  O  HOH W 479   -42.496  96.868  19.209  1.00 55.22   W  O
ATOM  29440  O  HOH W 480   -50.358  41.041  17.350  1.00 45.54   W  O
ATOM  29441  O  HOH W 481     5.049  14.966  43.883  1.00 45.04   W  O
ATOM  29442  O  HOH W 482   -82.645  87.620  29.584  1.00 32.56   W  O
ATOM  29443  O  HOH W 483    10.835  54.464 -21.151  1.00 40.85   W  O
ATOM  29444  O  HOH W 484     6.855  71.135 -17.239  1.00 30.87   W  O
ATOM  29445  O  HOH W 485    22.611  42.839  -3.555  1.00 52.26   W  O
ATOM  29446  O  HOH W 486    45.732  86.377  58.946  1.00 38.12   W  O
ATOM  29447  O  HOH W 487   -18.522  93.107  33.579  1.00 51.09   W  O
ATOM  29448  O  HOH W 488   -12.702  36.672  46.901  1.00 33.40   W  O
ATOM  29449  O  HOH W 489    -8.260  75.163  60.203  1.00 34.53   W  O
ATOM  29450  O  HOH W 490    50.007  60.652  60.331  1.00 49.71   W  O
ATOM  29451  O  HOH W 491   -15.873  14.208  43.721  1.00 23.07   W  O
ATOM  29452  O  HOH W 492    27.294  80.362 -11.660  1.00 30.43   W  O
ATOM  29453  O  HOH W 493   -20.576  18.671  32.987  1.00 26.70   W  O
```

Appendix 1

```
ATOM  29454  O  HOH W 494  -65.922  14.881    3.458  1.00  33.63  W  O
ATOM  29455  O  HOH W 495  -69.286  96.414   49.159  1.00  61.27  W  O
ATOM  29456  O  HOH W 496  -55.264  88.765   49.808  1.00  46.41  W  O
ATOM  29457  O  HOH W 497   26.884  52.521    3.988  1.00  43.55  W  O
ATOM  29458  O  HOH W 498   41.294  56.741   -0.853  1.00  38.54  W  O
ATOM  29459  O  HOH W 499  -74.761  19.069    4.574  1.00  39.26  W  O
ATOM  29460  O  HOH W 500  -88.878  79.546   37.929  1.00  32.73  W  O
ATOM  29461  O  HOH W 501  -16.011  79.287   59.249  1.00  46.61  W  O
ATOM  29462  O  HOH W 502  -57.280  36.603   40.921  1.00  74.50  W  O
ATOM  29463  O  HOH W 503   10.067  88.488   -1.052  1.00  47.09  W  O
ATOM  29464  O  HOH W 504  -68.089  61.488   29.328  1.00  48.00  W  O
ATOM  29465  O  HOH W 505  -62.197  74.412   43.258  1.00  46.76  W  O
ATOM  29466  O  HOH W 506   10.875  98.295   33.010  1.00  51.01  W  O
ATOM  29467  O  HOH W 507  -44.462  55.993   38.540  1.00  33.13  W  O
ATOM  29468  O  HOH W 508   32.896  78.447  -17.438  1.00  50.64  W  O
ATOM  29469  O  HOH W 509  -56.890  14.007   12.190  1.00  26.01  W  O
ATOM  29470  O  HOH W 510   28.839  81.174   21.945  1.00  42.69  W  O
ATOM  29471  O  HOH W 511  -50.967   8.666   47.805  1.00  43.51  W  O
ATOM  29472  O  HOH W 512   53.139  26.133   18.250  1.00  51.07  W  O
ATOM  29473  O  HOH W 513   49.863  16.857   23.401  1.00  56.48  W  O
ATOM  29474  O  HOH W 514    6.953  78.323   14.640  1.00  66.87  W  O
ATOM  29475  O  HOH W 515  -80.632  69.164   29.660  1.00  35.71  W  O
ATOM  29476  O  HOH W 516    7.706  39.499    0.833  1.00  47.28  W  O
ATOM  29477  O  HOH W 517  -13.587  62.460  -28.439  1.00  50.05  W  O
ATOM  29478  O  HOH W 518   31.596  98.196   59.500  1.00  54.46  W  O
ATOM  29479  O  HOH W 519    1.571  65.715    9.872  1.00  36.90  W  O
ATOM  29480  O  HOH W 520   52.110  27.326    7.352  1.00  34.25  W  O
ATOM  29481  O  HOH W 521    4.161  74.478   64.966  1.00  46.30  W  O
ATOM  29482  O  HOH W 522   38.414  43.909   -8.198  1.00  45.18  W  O
ATOM  29483  O  HOH W 523  -43.450  72.977   35.446  1.00  29.69  W  O
ATOM  29484  O  HOH W 524   36.616  92.916   -4.475  1.00  42.74  W  O
ATOM  29485  O  HOH W 525  -49.952  10.429   56.117  1.00  47.98  W  O
ATOM  29486  O  HOH W 526   35.432  26.036   62.688  1.00  34.43  W  O
ATOM  29487  O  HOH W 527  -77.249  80.976    4.607  1.00  49.95  W  O
ATOM  29488  O  HOH W 528  -62.408  29.946   12.669  1.00  52.60  W  O
ATOM  29489  O  HOH W 529   -3.365  68.020   19.652  1.00  84.04  W  O
ATOM  29490  O  HOH W 530   25.156  13.475   35.195  1.00  54.84  W  O
ATOM  29491  O  HOH W 531  -40.419  55.285   65.795  1.00  42.61  W  O
ATOM  29492  O  HOH W 532   26.051  37.219   47.185  1.00  36.76  W  O
ATOM  29493  O  HOH W 533  -11.713  12.551   52.780  1.00  51.47  W  O
ATOM  29494  O  HOH W 534   37.971  58.823   47.928  1.00  40.25  W  O
ATOM  29495  O  HOH W 535  -38.163  89.959   59.664  1.00  36.49  W  O
ATOM  29496  O  HOH W 536   50.821  53.774   62.316  1.00  33.67  W  O
ATOM  29497  O  HOH W 537   23.689  64.841   19.910  1.00  57.36  W  O
ATOM  29498  O  HOH W 538    1.350  35.010   72.784  1.00  42.33  W  O
ATOM  29499  O  HOH W 539   41.986  49.030   54.618  1.00  56.17  W  O
ATOM  29500  O  HOH W 540  -84.006  90.010   24.267  1.00  39.94  W  O
ATOM  29501  O  HOH W 541  -72.568  95.504   37.533  1.00  44.74  W  O
ATOM  29502  O  HOH W 542  -61.547  72.675    9.289  1.00  43.99  W  O
ATOM  29503  O  HOH W 543  -80.390  67.106   23.354  1.00  41.63  W  O
ATOM  29504  O  HOH W 544  -84.223  85.536   44.190  1.00  35.23  W  O
ATOM  29505  O  HOH W 545   36.116  54.517   -0.272  1.00  31.53  W  O
ATOM  29506  O  HOH W 546  -14.593  89.095   67.136  1.00  64.31  W  O
ATOM  29507  O  HOH W 547   -3.894  74.263   60.020  1.00  54.53  W  O
```

Appendix 1

```
ATOM  29508  O    HOH W 548      14.339  39.149  49.652  1.00 47.08      W    O
ATOM  29509  O    HOH W 549     -30.317  16.116  64.492  1.00 60.46      W    O
ATOM  29510  O    HOH W 550     -43.458  61.959  28.003  1.00 43.86      W    O
ATOM  29511  O    HOH W 551     -26.050  26.026  68.385  1.00 24.35      W    O
ATOM  29512  O    HOH W 552      42.883  28.393  29.184  1.00 39.14      W    O
ATOM  29513  O    HOH W 553       0.810  58.620  14.765  1.00 38.95      W    O
ATOM  29514  O    HOH W 554      -6.732  52.754 -21.138  1.00 40.33      W    O
ATOM  29515  O    HOH W 555      23.928  59.278  56.121  1.00 43.96      W    O
ATOM  29516  O    HOH W 556     -50.543  62.172  45.945  1.00 38.08      W    O
ATOM  29517  O    HOH W 557      36.796  90.062  -4.250  1.00 36.86      W    O
ATOM  29518  O    HOH W 558     -21.198  10.385  64.746  1.00 42.83      W    O
ATOM  29519  O    HOH W 559     -83.289  70.312  29.918  1.00 37.01      W    O
ATOM  29520  O    HOH W 560       7.039  51.772   7.036  1.00 51.10      W    O
ATOM  29521  O    HOH W 561     -21.787   9.122  61.445  1.00 60.17      W    O
ATOM  29522  O    HOH W 562     -14.730  11.507  43.884  1.00 35.50      W    O
ATOM  29523  O    HOH W 563      41.471  56.701   9.866  1.00 44.91      W    O
ATOM  29524  O    HOH W 564      48.129  68.706  -3.315  1.00 18.27      W    O
ATOM  29525  O    HOH W 565     -23.991   9.532  60.142  1.00 50.86      W    O
ATOM  29526  O    HOH W 566     -22.765  41.358  71.275  1.00 38.48      W    O
ATOM  29527  O    HOH W 567      24.109  17.549  35.408  1.00 44.27      W    O
ATOM  29528  O    HOH W 568      16.448  29.720  84.044  1.00 20.52           O
ATOM  29529  O    HOH W 569      18.031  31.686  85.195  1.00 22.31           O
ATOM  29530  zn   zn  K   1       1.171  27.927  64.975  1.00103.92          ZN
END
```

Appendix 2

```
HEADER                                                            UNNAMED
TITLE     CRYSTAL STRUCTURE CASTELLANIELLA DEFRAGRANS LINALOOL
TITLE    2 DEHYDRATASE-ISOMERASE (CDLD) AT 2.6 ANGSTROM RESOLUTION
COMPND    MOL_ID: 1;
COMPND   2 MOLECULE: CDLD;
COMPND   3 CHAIN: A, B, C, D, E;
COMPND   4 FRAGMENT: CDLD, FULL-LENGTH;
COMPND   5 ENGINEERED: YES
SOURCE    MOL_ID: 1;
SOURCE   2 ORGANISM_SCIENTIFIC: CASTELLANIELLA DEFRAGRANS;
SOURCE   3 EXPRESSION_SYSTEM: E. COLI;
SOURCE   4 EXPRESSION_SYSTEM_PLASMID: PARZ-CDLD
EXPDTA    X-RAY DIFFRACTION
AUTHOR    DOUGLAS R. DAVIES
JRNL         REF    TO BE PUBLISHED
JRNL         REFN
REMARK   1
REMARK   2
REMARK   2 RESOLUTION. 2.60 ANGSTROMS.
REMARK   3
REMARK   3 REFINEMENT.
REMARK   3   PROGRAM     : REFMAC 5.7.0032
REMARK   3   AUTHORS     : MURSHUDOV,VAGIN,DODSON
REMARK   3
REMARK   3    REFINEMENT TARGET : MAXIMUM LIKELIHOOD
REMARK   3
REMARK   3  DATA USED IN REFINEMENT.
REMARK   3   RESOLUTION RANGE HIGH (ANGSTROMS) : 2.60
REMARK   3   RESOLUTION RANGE LOW  (ANGSTROMS) : 48.98
REMARK   3   DATA CUTOFF            (SIGMA(F)) : 0.000
REMARK   3   COMPLETENESS FOR RANGE        (%) : NULL
REMARK   3   NUMBER OF REFLECTIONS             : 70153
REMARK   3
REMARK   3  FIT TO DATA USED IN REFINEMENT.
REMARK   3   CROSS-VALIDATION METHOD          : THROUGHOUT
REMARK   3   FREE R VALUE TEST SET SELECTION  : RANDOM
REMARK   3   R VALUE     (WORKING + TEST SET) : 0.175
REMARK   3   R VALUE            (WORKING SET) : 0.172
REMARK   3   FREE R VALUE                     : 0.222
REMARK   3   FREE R VALUE TEST SET SIZE   (%) : 5.000
REMARK   3   FREE R VALUE TEST SET COUNT      : 3535
REMARK   3
REMARK   3  FIT IN THE HIGHEST RESOLUTION BIN.
REMARK   3   TOTAL NUMBER OF BINS USED           : 20
REMARK   3   BIN RESOLUTION RANGE HIGH           : 2.60
REMARK   3   BIN RESOLUTION RANGE LOW            : 2.67
REMARK   3   REFLECTION IN BIN     (WORKING SET) : 4931
REMARK   3   BIN COMPLETENESS (WORKING+TEST) (%) : 99.81
REMARK   3   BIN R VALUE           (WORKING SET) : 0.2700
REMARK   3   BIN FREE R VALUE SET COUNT          : 239
REMARK   3   BIN FREE R VALUE                    : 0.3330
REMARK   3
REMARK   3  NUMBER OF NON-HYDROGEN ATOMS USED IN REFINEMENT.
REMARK   3   ALL ATOMS              : 14541
```

Appendix 2

```
REMARK   3
REMARK   3  B VALUES.
REMARK   3   FROM WILSON PLOT            (A**2) : 46.99
REMARK   3   MEAN B VALUE      (OVERALL, A**2) : 28.64
REMARK   3   OVERALL ANISOTROPIC B VALUE.
REMARK   3    B11 (A**2) : -1.85000
REMARK   3    B22 (A**2) :  0.20000
REMARK   3    B33 (A**2) :  1.39000
REMARK   3    B12 (A**2) : -0.00000
REMARK   3    B13 (A**2) :  0.54000
REMARK   3    B23 (A**2) : -0.00000
REMARK   3
REMARK   3  ESTIMATED OVERALL COORDINATE ERROR.
REMARK   3   ESU BASED ON R VALUE                      (A): 0.599
REMARK   3   ESU BASED ON FREE R VALUE                 (A): 0.274
REMARK   3   ESU BASED ON MAXIMUM LIKELIHOOD           (A): 0.203
REMARK   3   ESU FOR B VALUES BASED ON MAXIMUM LIKELIHOOD (A**2): 20.693
REMARK   3
REMARK   3 CORRELATION COEFFICIENTS.
REMARK   3   CORRELATION COEFFICIENT FO-FC      : 0.955
REMARK   3   CORRELATION COEFFICIENT FO-FC FREE : 0.928
REMARK   3
REMARK   3  RMS DEVIATIONS FROM IDEAL VALUES        COUNT    RMS    WEIGHT
REMARK   3   BOND LENGTHS REFINED ATOMS        (A): 14830 ; 0.011 ; 0.019
REMARK   3   BOND LENGTHS OTHERS               (A): 13619 ; 0.001 ; 0.020
REMARK   3   BOND ANGLES REFINED ATOMS   (DEGREES): 20203 ; 1.430 ; 1.949
REMARK   3   BOND ANGLES OTHERS          (DEGREES): 31229 ; 0.833 ; 3.001
REMARK   3   TORSION ANGLES, PERIOD 1    (DEGREES):  1814 ; 6.015 ; 5.000
REMARK   3   TORSION ANGLES, PERIOD 2    (DEGREES):   702 ;33.362 ;22.949
REMARK   3   TORSION ANGLES, PERIOD 3    (DEGREES):  2240 ;15.509 ;15.000
REMARK   3   TORSION ANGLES, PERIOD 4    (DEGREES):   100 ;13.684 ;15.000
REMARK   3   CHIRAL-CENTER RESTRAINTS       (A**3):  2137 ; 0.078 ; 0.200
REMARK   3   GENERAL PLANES REFINED ATOMS     (A): 16921 ; 0.006 ; 0.021
REMARK   3   GENERAL PLANES OTHERS            (A):  3631 ; 0.001 ; 0.020
REMARK   3   NON-BONDED CONTACTS REFINED ATOMS (A):  NULL ;  NULL ;  NULL
REMARK   3   NON-BONDED CONTACTS OTHERS       (A):  NULL ;  NULL ;  NULL
REMARK   3   NON-BONDED TORSION REFINED ATOMS (A):  NULL ;  NULL ;  NULL
REMARK   3   NON-BONDED TORSION OTHERS        (A):  NULL ;  NULL ;  NULL
REMARK   3   H-BOND (X...Y) REFINED ATOMS     (A):  NULL ;  NULL ;  NULL
REMARK   3   H-BOND (X...Y) OTHERS            (A):  NULL ;  NULL ;  NULL
REMARK   3   POTENTIAL METAL-ION REFINED ATOMS (A):  NULL ;  NULL ;  NULL
REMARK   3   POTENTIAL METAL-ION OTHERS       (A):  NULL ;  NULL ;  NULL
REMARK   3   SYMMETRY VDW REFINED ATOMS       (A):  NULL ;  NULL ;  NULL
REMARK   3   SYMMETRY VDW OTHERS              (A):  NULL ;  NULL ;  NULL
REMARK   3   SYMMETRY H-BOND REFINED ATOMS    (A):  NULL ;  NULL ;  NULL
REMARK   3   SYMMETRY H-BOND OTHERS           (A):  NULL ;  NULL ;  NULL
REMARK   3   SYMMETRY METAL-ION REFINED ATOMS (A):  NULL ;  NULL ;  NULL
REMARK   3   SYMMETRY METAL-ION OTHERS        (A):  NULL ;  NULL ;  NULL
REMARK   3
REMARK   3  ISOTROPIC THERMAL FACTOR RESTRAINTS.    COUNT    RMS    WEIGHT
REMARK   3   MAIN-CHAIN BOND REFINED ATOMS  (A**2):  7259 ; 1.380 ; 2.822
REMARK   3   MAIN-CHAIN BOND OTHER ATOMS    (A**2):  7258 ; 1.380 ; 2.822
REMARK   3   MAIN-CHAIN ANGLE REFINED ATOMS (A**2):  9066 ; 2.181 ; 4.231
REMARK   3   SIDE-CHAIN BOND REFINED ATOMS  (A**2):  NULL ;  NULL ;  NULL
```

Appendix 2

```
REMARK   3   SIDE-CHAIN ANGLE REFINED ATOMS (A**2):  NULL ;  NULL ;  NULL
REMARK   3
REMARK   3  ANISOTROPIC THERMAL FACTOR RESTRAINTS.    COUNT    RMS    WEIGHT
REMARK   3   RIGID-BOND RESTRAINTS          (A**2):   NULL ;  NULL ;  NULL
REMARK   3   SPHERICITY; FREE ATOMS         (A**2):   NULL ;  NULL ;  NULL
REMARK   3   SPHERICITY; BONDED ATOMS       (A**2):   NULL ;  NULL ;  NULL
REMARK   3
REMARK   3  NCS RESTRAINTS STATISTICS
REMARK   3   NUMBER OF DIFFERENT NCS GROUPS : 0
REMARK   3
REMARK   3  TLS DETAILS
REMARK   3   NUMBER OF TLS GROUPS  : 20
REMARK   3
REMARK   3   TLS GROUP : 1
REMARK   3    NUMBER OF COMPONENTS GROUP : 1
REMARK   3    COMPONENTS        C SSSEQI   TO  C SSSEQI
REMARK   3    RESIDUE RANGE :   A    28         A   143
REMARK   3    ORIGIN FOR THE GROUP (A):   75.6381  -5.5209 266.0477
REMARK   3    T TENSOR
REMARK   3      T11:   0.1592 T22:   0.1160
REMARK   3      T33:   0.2140 T12:  -0.0258
REMARK   3      T13:  -0.0011 T23:  -0.0144
REMARK   3    L TENSOR
REMARK   3      L11:   0.7130 L22:   0.1113
REMARK   3      L33:   0.7165 L12:  -0.1049
REMARK   3      L13:   0.3807 L23:  -0.2709
REMARK   3    S TENSOR
REMARK   3      S11:   0.0160 S12:  -0.0669 S13:   0.0441
REMARK   3      S21:   0.0528 S22:   0.0013 S23:  -0.0092
REMARK   3      S31:  -0.0678 S32:   0.0000 S33:  -0.0173
REMARK   3
REMARK   3   TLS GROUP : 2
REMARK   3    NUMBER OF COMPONENTS GROUP : 1
REMARK   3    COMPONENTS        C SSSEQI   TO  C SSSEQI
REMARK   3    RESIDUE RANGE :   A   144         A   234
REMARK   3    ORIGIN FOR THE GROUP (A):   56.7959 -12.9004 267.9353
REMARK   3    T TENSOR
REMARK   3      T11:   0.1194 T22:   0.1544
REMARK   3      T33:   0.1719 T12:  -0.0308
REMARK   3      T13:   0.0102 T23:   0.0222
REMARK   3    L TENSOR
REMARK   3      L11:   1.3025 L22:   0.2249
REMARK   3      L33:   2.5885 L12:  -0.4265
REMARK   3      L13:   1.1500 L23:  -0.0351
REMARK   3    S TENSOR
REMARK   3      S11:   0.0119 S12:  -0.0323 S13:  -0.1602
REMARK   3      S21:   0.0430 S22:   0.0101 S23:   0.0605
REMARK   3      S31:   0.1349 S32:  -0.2047 S33:  -0.0220
REMARK   3
REMARK   3   TLS GROUP : 3
REMARK   3    NUMBER OF COMPONENTS GROUP : 1
REMARK   3    COMPONENTS        C SSSEQI   TO  C SSSEQI
REMARK   3    RESIDUE RANGE :   A   235         A   342
REMARK   3    ORIGIN FOR THE GROUP (A):   64.5386 -12.3246 246.6445
```

Appendix 2

```
REMARK   3     T TENSOR
REMARK   3        T11:   0.1760 T22:   0.1664
REMARK   3        T33:   0.0974 T12:  -0.0362
REMARK   3        T13:  -0.0016 T23:  -0.0633
REMARK   3     L TENSOR
REMARK   3        L11:   1.2738 L22:   1.6416
REMARK   3        L33:   1.1364 L12:  -0.2812
REMARK   3        L13:   0.7149 L23:  -0.5146
REMARK   3     S TENSOR
REMARK   3        S11:  -0.0290 S12:   0.0823 S13:  -0.0574
REMARK   3        S21:  -0.0720 S22:   0.0488 S23:   0.0581
REMARK   3        S31:  -0.0658 S32:  -0.1491 S33:  -0.0198
REMARK   3
REMARK   3   TLS GROUP : 4
REMARK   3    NUMBER OF COMPONENTS GROUP : 1
REMARK   3    COMPONENTS        C SSSEQI   TO   C SSSEQI
REMARK   3    RESIDUE RANGE :   A    343           A    390
REMARK   3    ORIGIN FOR THE GROUP (A):  78.4719  -9.2508 258.0299
REMARK   3     T TENSOR
REMARK   3        T11:   0.1055 T22:   0.1458
REMARK   3        T33:   0.1612 T12:   0.0044
REMARK   3        T13:  -0.0044 T23:  -0.0518
REMARK   3     L TENSOR
REMARK   3        L11:   0.1507 L22:   1.5137
REMARK   3        L33:   1.8262 L12:   0.2931
REMARK   3        L13:   0.3007 L23:  -0.1552
REMARK   3     S TENSOR
REMARK   3        S11:   0.0075 S12:   0.0907 S13:  -0.0598
REMARK   3        S21:   0.0651 S22:   0.1444 S23:   0.0324
REMARK   3        S31:  -0.0174 S32:  -0.0316 S33:  -0.1519
REMARK   3
REMARK   3   TLS GROUP : 5
REMARK   3    NUMBER OF COMPONENTS GROUP : 1
REMARK   3    COMPONENTS        C SSSEQI   TO   C SSSEQI
REMARK   3    RESIDUE RANGE :   B     28           B    133
REMARK   3    ORIGIN FOR THE GROUP (A):  97.5475  21.2559 284.5644
REMARK   3     T TENSOR
REMARK   3        T11:   0.0801 T22:   0.1414
REMARK   3        T33:   0.1666 T12:   0.0201
REMARK   3        T13:   0.0053 T23:   0.0093
REMARK   3     L TENSOR
REMARK   3        L11:   0.4390 L22:   0.6445
REMARK   3        L33:   0.6349 L12:   0.2702
REMARK   3        L13:   0.1051 L23:  -0.0340
REMARK   3     S TENSOR
REMARK   3        S11:   0.0020 S12:  -0.0875 S13:   0.0603
REMARK   3        S21:   0.0300 S22:   0.0263 S23:  -0.0063
REMARK   3        S31:  -0.0688 S32:  -0.0697 S33:  -0.0283
REMARK   3
REMARK   3   TLS GROUP : 6
REMARK   3    NUMBER OF COMPONENTS GROUP : 1
REMARK   3    COMPONENTS        C SSSEQI   TO   C SSSEQI
REMARK   3    RESIDUE RANGE :   B    134           B    169
REMARK   3    ORIGIN FOR THE GROUP (A):  84.5786  11.3386 292.7480
```

Appendix 2

```
REMARK   3     T TENSOR
REMARK   3        T11:   0.0707 T22:   0.2261
REMARK   3        T33:   0.1550 T12:   0.0006
REMARK   3        T13:   0.0196 T23:   0.0319
REMARK   3     L TENSOR
REMARK   3        L11:   5.6867 L22:   1.6696
REMARK   3        L33:   2.0323 L12:   1.7028
REMARK   3        L13:   2.7987 L23:   0.2959
REMARK   3     S TENSOR
REMARK   3        S11:   0.3521 S12:  -0.1538 S13:  -0.0332
REMARK   3        S21:   0.1721 S22:  -0.1859 S23:   0.0022
REMARK   3        S31:   0.1145 S32:  -0.2770 S33:  -0.1661
REMARK   3
REMARK   3  TLS GROUP : 7
REMARK   3     NUMBER OF COMPONENTS GROUP : 1
REMARK   3     COMPONENTS        C SSSEQI   TO   C SSSEQI
REMARK   3     RESIDUE RANGE :   B    170         B    239
REMARK   3     ORIGIN FOR THE GROUP (A):  88.9171    1.2258  295.9030
REMARK   3     T TENSOR
REMARK   3        T11:   0.0756 T22:   0.1459
REMARK   3        T33:   0.1699 T12:  -0.0335
REMARK   3        T13:  -0.0177 T23:   0.0240
REMARK   3     L TENSOR
REMARK   3        L11:   2.1677 L22:   1.0963
REMARK   3        L33:   2.2583 L12:   0.3080
REMARK   3        L13:   0.2116 L23:   0.4218
REMARK   3     S TENSOR
REMARK   3        S11:   0.0263 S12:  -0.0459 S13:  -0.1720
REMARK   3        S21:   0.0847 S22:   0.0173 S23:  -0.0562
REMARK   3        S31:   0.2513 S32:  -0.0128 S33:  -0.0436
REMARK   3
REMARK   3  TLS GROUP : 8
REMARK   3     NUMBER OF COMPONENTS GROUP : 1
REMARK   3     COMPONENTS        C SSSEQI   TO   C SSSEQI
REMARK   3     RESIDUE RANGE :   B    240         B    390
REMARK   3     ORIGIN FOR THE GROUP (A): 101.8932    4.4624  278.8921
REMARK   3     T TENSOR
REMARK   3        T11:   0.0587 T22:   0.1468
REMARK   3        T33:   0.1847 T12:   0.0148
REMARK   3        T13:   0.0072 T23:   0.0086
REMARK   3     L TENSOR
REMARK   3        L11:   0.4338 L22:   1.4022
REMARK   3        L33:   1.0088 L12:   0.0390
REMARK   3        L13:   0.3242 L23:   0.3779
REMARK   3     S TENSOR
REMARK   3        S11:   0.0491 S12:   0.0502 S13:   0.0205
REMARK   3        S21:  -0.0544 S22:  -0.0155 S23:  -0.0797
REMARK   3        S31:   0.0242 S32:  -0.0407 S33:  -0.0336
REMARK   3
REMARK   3  TLS GROUP : 9
REMARK   3     NUMBER OF COMPONENTS GROUP : 1
REMARK   3     COMPONENTS        C SSSEQI   TO   C SSSEQI
REMARK   3     RESIDUE RANGE :   C     28         C     73
REMARK   3     ORIGIN FOR THE GROUP (A):  53.8149   51.2900  241.3306
```

Appendix 2

```
REMARK   3    T TENSOR
REMARK   3       T11:   0.1446 T22:   0.1725
REMARK   3       T33:   0.0869 T12:   0.0754
REMARK   3       T13:  -0.0034 T23:   0.0368
REMARK   3    L TENSOR
REMARK   3       L11:   1.1935 L22:   1.9529
REMARK   3       L33:   1.0385 L12:  -0.5415
REMARK   3       L13:   1.0707 L23:  -0.1268
REMARK   3    S TENSOR
REMARK   3       S11:  -0.0458 S12:  -0.0140 S13:  -0.0832
REMARK   3       S21:   0.0198 S22:   0.0660 S23:   0.3564
REMARK   3       S31:  -0.0427 S32:  -0.0178 S33:  -0.0202
REMARK   3
REMARK   3   TLS GROUP : 10
REMARK   3    NUMBER OF COMPONENTS GROUP : 1
REMARK   3    COMPONENTS        C SSSEQI    TO   C SSSEQI
REMARK   3    RESIDUE RANGE :   C    74         C    168
REMARK   3    ORIGIN FOR THE GROUP (A):  52.4982  50.0265 260.4812
REMARK   3    T TENSOR
REMARK   3       T11:   0.1408 T22:   0.1182
REMARK   3       T33:   0.1444 T12:   0.0116
REMARK   3       T13:  -0.0120 T23:   0.0140
REMARK   3    L TENSOR
REMARK   3       L11:   2.0536 L22:   0.6796
REMARK   3       L33:   1.8985 L12:  -0.5943
REMARK   3       L13:   1.2024 L23:  -0.5229
REMARK   3    S TENSOR
REMARK   3       S11:   0.0676 S12:  -0.0148 S13:  -0.0559
REMARK   3       S21:  -0.0295 S22:  -0.0971 S23:   0.0435
REMARK   3       S31:   0.1794 S32:  -0.0400 S33:   0.0295
REMARK   3
REMARK   3   TLS GROUP : 11
REMARK   3    NUMBER OF COMPONENTS GROUP : 1
REMARK   3    COMPONENTS        C SSSEQI    TO   C SSSEQI
REMARK   3    RESIDUE RANGE :   C   169         C    239
REMARK   3    ORIGIN FOR THE GROUP (A):  51.0070  64.5323 268.8166
REMARK   3    T TENSOR
REMARK   3       T11:   0.1153 T22:   0.0857
REMARK   3       T33:   0.1640 T12:   0.0444
REMARK   3       T13:   0.0037 T23:  -0.0077
REMARK   3    L TENSOR
REMARK   3       L11:   3.3985 L22:   1.0587
REMARK   3       L33:   1.7922 L12:   0.2952
REMARK   3       L13:   0.5808 L23:  -0.1179
REMARK   3    S TENSOR
REMARK   3       S11:  -0.0648 S12:  -0.1542 S13:   0.3412
REMARK   3       S21:  -0.0785 S22:   0.0273 S23:  -0.0456
REMARK   3       S31:  -0.2155 S32:  -0.0751 S33:   0.0375
REMARK   3
REMARK   3   TLS GROUP : 12
REMARK   3    NUMBER OF COMPONENTS GROUP : 1
REMARK   3    COMPONENTS        C SSSEQI    TO   C SSSEQI
REMARK   3    RESIDUE RANGE :   C   240         C    390
REMARK   3    ORIGIN FOR THE GROUP (A):  64.8263  63.4452 251.8048
```

Appendix 2

```
REMARK   3     T TENSOR
REMARK   3        T11:   0.1151 T22:   0.0931
REMARK   3        T33:   0.1453 T12:   0.0223
REMARK   3        T13:   0.0016 T23:   0.0497
REMARK   3     L TENSOR
REMARK   3        L11:   1.3500 L22:   1.0975
REMARK   3        L33:   0.9537 L12:  -0.0702
REMARK   3        L13:   0.2302 L23:   0.3116
REMARK   3     S TENSOR
REMARK   3        S11:   0.0639 S12:   0.0938 S13:   0.1596
REMARK   3        S21:  -0.0821 S22:   0.0177 S23:  -0.0998
REMARK   3        S31:  -0.0520 S32:   0.0418 S33:  -0.0815
REMARK   3
REMARK   3   TLS GROUP : 13
REMARK   3    NUMBER OF COMPONENTS GROUP : 1
REMARK   3    COMPONENTS        C SSSEQI   TO   C SSSEQI
REMARK   3    RESIDUE RANGE :   D    28        D    135
REMARK   3    ORIGIN FOR THE GROUP (A):  82.6578  55.4303 274.6219
REMARK   3     T TENSOR
REMARK   3        T11:   0.1158 T22:   0.1297
REMARK   3        T33:   0.2046 T12:   0.0014
REMARK   3        T13:   0.0031 T23:  -0.0098
REMARK   3     L TENSOR
REMARK   3        L11:   0.2931 L22:   0.7762
REMARK   3        L33:   0.6480 L12:  -0.1268
REMARK   3        L13:  -0.0989 L23:  -0.6103
REMARK   3     S TENSOR
REMARK   3        S11:  -0.0501 S12:   0.0084 S13:   0.0200
REMARK   3        S21:  -0.0112 S22:   0.0233 S23:  -0.0208
REMARK   3        S31:   0.0244 S32:  -0.0783 S33:   0.0268
REMARK   3
REMARK   3   TLS GROUP : 14
REMARK   3    NUMBER OF COMPONENTS GROUP : 1
REMARK   3    COMPONENTS        C SSSEQI   TO   C SSSEQI
REMARK   3    RESIDUE RANGE :   D    136       D    180
REMARK   3    ORIGIN FOR THE GROUP (A):  77.9792  50.2857 291.6052
REMARK   3     T TENSOR
REMARK   3        T11:   0.0473 T22:   0.1646
REMARK   3        T33:   0.2071 T12:   0.0192
REMARK   3        T13:  -0.0069 T23:  -0.0102
REMARK   3     L TENSOR
REMARK   3        L11:   0.9666 L22:   6.7876
REMARK   3        L33:   1.3641 L12:  -0.9411
REMARK   3        L13:   0.1601 L23:  -0.2535
REMARK   3     S TENSOR
REMARK   3        S11:  -0.1058 S12:  -0.1433 S13:  -0.0594
REMARK   3        S21:   0.1103 S22:  -0.0135 S23:   0.0726
REMARK   3        S31:   0.0451 S32:  -0.0614 S33:   0.1193
REMARK   3
REMARK   3   TLS GROUP : 15
REMARK   3    NUMBER OF COMPONENTS GROUP : 1
REMARK   3    COMPONENTS        C SSSEQI   TO   C SSSEQI
REMARK   3    RESIDUE RANGE :   D    181       D    300
REMARK   3    ORIGIN FOR THE GROUP (A):  96.9576  47.7564 292.6310
```

Appendix 2

```
REMARK   3     T TENSOR
REMARK   3         T11:   0.1288 T22:   0.1086
REMARK   3         T33:   0.2003 T12:   0.0121
REMARK   3         T13:  -0.0188 T23:  -0.0131
REMARK   3     L TENSOR
REMARK   3         L11:   1.7078 L22:   0.1407
REMARK   3         L33:   1.4583 L12:  -0.4779
REMARK   3         L13:  -1.0378 L23:   0.3030
REMARK   3     S TENSOR
REMARK   3         S11:  -0.0975 S12:  -0.1083 S13:   0.0709
REMARK   3         S21:   0.0512 S22:   0.0367 S23:  -0.0361
REMARK   3         S31:  -0.0220 S32:   0.0656 S33:   0.0609
REMARK   3
REMARK   3   TLS GROUP : 16
REMARK   3    NUMBER OF COMPONENTS GROUP : 1
REMARK   3    COMPONENTS        C SSSEQI   TO   C SSSEQI
REMARK   3    RESIDUE RANGE :   D   301          D   390
REMARK   3    ORIGIN FOR THE GROUP (A):   96.4510  53.5373 273.8105
REMARK   3     T TENSOR
REMARK   3         T11:   0.0858 T22:   0.1285
REMARK   3         T33:   0.1863 T12:  -0.0226
REMARK   3         T13:   0.0154 T23:   0.0339
REMARK   3     L TENSOR
REMARK   3         L11:   1.5198 L22:   1.5685
REMARK   3         L33:   0.2121 L12:  -0.8536
REMARK   3         L13:   0.3161 L23:   0.1441
REMARK   3     S TENSOR
REMARK   3         S11:  -0.0596 S12:   0.1300 S13:   0.1194
REMARK   3         S21:  -0.0315 S22:  -0.0281 S23:  -0.0956
REMARK   3         S31:   0.0129 S32:   0.0649 S33:   0.0877
REMARK   3
REMARK   3   TLS GROUP : 17
REMARK   3    NUMBER OF COMPONENTS GROUP : 1
REMARK   3    COMPONENTS        C SSSEQI   TO   C SSSEQI
REMARK   3    RESIDUE RANGE :   E    28          E   177
REMARK   3    ORIGIN FOR THE GROUP (A):   46.7328  13.0740 247.7560
REMARK   3     T TENSOR
REMARK   3         T11:   0.1067 T22:   0.2196
REMARK   3         T33:   0.0927 T12:  -0.0124
REMARK   3         T13:  -0.0438 T23:  -0.0153
REMARK   3     L TENSOR
REMARK   3         L11:   0.8939 L22:   1.6077
REMARK   3         L33:   0.2807 L12:  -0.7296
REMARK   3         L13:  -0.4873 L23:   0.2847
REMARK   3     S TENSOR
REMARK   3         S11:  -0.0269 S12:  -0.1639 S13:  -0.0474
REMARK   3         S21:   0.0024 S22:   0.0120 S23:   0.0279
REMARK   3         S31:   0.0098 S32:   0.0859 S33:   0.0149
REMARK   3
REMARK   3   TLS GROUP : 18
REMARK   3    NUMBER OF COMPONENTS GROUP : 1
REMARK   3    COMPONENTS        C SSSEQI   TO   C SSSEQI
REMARK   3    RESIDUE RANGE :   E   178          E   183
REMARK   3    ORIGIN FOR THE GROUP (A):   30.1208  22.2867 255.9400
```

Appendix 2

```
REMARK   3     T TENSOR
REMARK   3        T11:   0.0704 T22:   0.2326
REMARK   3        T33:   0.2124 T12:   0.0200
REMARK   3        T13:  -0.0751 T23:  -0.0424
REMARK   3     L TENSOR
REMARK   3        L11:  10.5601 L22:   6.8456
REMARK   3        L33:   2.2430 L12:   0.5507
REMARK   3        L13:  -4.6733 L23:   0.8480
REMARK   3     S TENSOR
REMARK   3        S11:   0.0937 S12:  -0.4158 S13:   0.0440
REMARK   3        S21:  -0.6078 S22:  -0.1269 S23:   0.2984
REMARK   3        S31:  -0.1404 S32:   0.1668 S33:   0.0332
REMARK   3
REMARK   3    TLS GROUP : 19
REMARK   3     NUMBER OF COMPONENTS GROUP : 1
REMARK   3     COMPONENTS        C SSSEQI    TO   C SSSEQI
REMARK   3     RESIDUE RANGE :   E     184          E     245
REMARK   3     ORIGIN FOR THE GROUP (A):  31.2972  28.4808 245.8136
REMARK   3     T TENSOR
REMARK   3        T11:   0.0761 T22:   0.1897
REMARK   3        T33:   0.1935 T12:   0.0101
REMARK   3        T13:  -0.0964 T23:  -0.0593
REMARK   3     L TENSOR
REMARK   3        L11:   0.6138 L22:   1.5048
REMARK   3        L33:   0.7400 L12:   0.4231
REMARK   3        L13:  -0.5937 L23:  -0.8361
REMARK   3     S TENSOR
REMARK   3        S11:   0.0208 S12:   0.0197 S13:   0.0486
REMARK   3        S21:  -0.0307 S22:   0.0509 S23:   0.2707
REMARK   3        S31:  -0.0263 S32:  -0.0483 S33:  -0.0717
REMARK   3
REMARK   3    TLS GROUP : 20
REMARK   3     NUMBER OF COMPONENTS GROUP : 1
REMARK   3     COMPONENTS        C SSSEQI    TO   C SSSEQI
REMARK   3     RESIDUE RANGE :   E     246          E     390
REMARK   3     ORIGIN FOR THE GROUP (A):  46.5743  24.7178 234.0556
REMARK   3     T TENSOR
REMARK   3        T11:   0.1876 T22:   0.1834
REMARK   3        T33:   0.0329 T12:   0.0099
REMARK   3        T13:  -0.0673 T23:  -0.0287
REMARK   3     L TENSOR
REMARK   3        L11:   1.3676 L22:   2.4263
REMARK   3        L33:   0.2823 L12:   0.0576
REMARK   3        L13:   0.5131 L23:  -0.4344
REMARK   3     S TENSOR
REMARK   3        S11:  -0.0078 S12:  -0.0297 S13:   0.0923
REMARK   3        S21:  -0.2847 S22:  -0.0165 S23:   0.1202
REMARK   3        S31:   0.0248 S32:  -0.0025 S33:   0.0243
REMARK   3
REMARK   3   BULK SOLVENT MODELLING.
REMARK   3    METHOD USED : MASK
REMARK   3    PARAMETERS FOR MASK CALCULATION
REMARK   3    VDW PROBE RADIUS   : 1.20
REMARK   3    ION PROBE RADIUS   : 0.80
```

Appendix 2

```
REMARK   3   SHRINKAGE RADIUS       : 0.80
REMARK   3
REMARK   3   OTHER REFINEMENT REMARKS:  HYDROGENS HAVE BEEN ADDED IN THE
REMARK   3   RIDING POSITIONS U VALUES : RESIDUAL ONLY
REMARK   4
REMARK   4 NULL COMPLIES WITH FORMAT V. 3.1, 01-AUG-2007
REMARK 200
REMARK 200 EXPERIMENTAL DETAILS
REMARK 200   EXPERIMENT TYPE                : X-RAY DIFFRACTION
REMARK 200   DATE OF DATA COLLECTION        : 18-APR-2013
REMARK 200   TEMPERATURE           (KELVIN) : 100.0
REMARK 200   PH                             : 5.50
REMARK 200   NUMBER OF CRYSTALS USED        : 1
REMARK 200
REMARK 200   SYNCHROTRON              (Y/N) : Y
REMARK 200   RADIATION SOURCE               : APS
REMARK 200   BEAMLINE                       : 21-ID-D
REMARK 200   X-RAY GENERATOR MODEL          : NULL
REMARK 200   MONOCHROMATIC OR LAUE    (M/L) : NULL
REMARK 200   WAVELENGTH OR RANGE        (A) : 0.93005
REMARK 200   MONOCHROMATOR                  : NULL
REMARK 200   OPTICS                         : NULL
REMARK 200
REMARK 200   DETECTOR TYPE                  : CCD
REMARK 200   DETECTOR MANUFACTURER          : NULL
REMARK 200   INTENSITY-INTEGRATION SOFTWARE : NULL
REMARK 200   DATA SCALING SOFTWARE          : NULL
REMARK 200
REMARK 200   NUMBER OF UNIQUE REFLECTIONS   : 70173
REMARK 200   RESOLUTION RANGE HIGH      (A) : 2.600
REMARK 200   RESOLUTION RANGE LOW       (A) : NULL
REMARK 200   REJECTION CRITERIA  (SIGMA(I)) : -3.000
REMARK 200
REMARK 200 OVERALL.
REMARK 200   COMPLETENESS FOR RANGE     (%) : 99.8
REMARK 200   DATA REDUNDANCY                : NULL
REMARK 200   R MERGE                    (I) : 0.07400
REMARK 200   R SYM                      (I) : NULL
REMARK 200   <I/SIGMA(I)> FOR THE DATA SET  : 16.1700
REMARK 200
REMARK 200 IN THE HIGHEST RESOLUTION SHELL.
REMARK 200   HIGHEST RESOLUTION SHELL, RANGE HIGH (A) : 2.60
REMARK 200   HIGHEST RESOLUTION SHELL, RANGE LOW  (A) : 2.67
REMARK 200   COMPLETENESS FOR SHELL     (%) : 99.9
REMARK 200   DATA REDUNDANCY IN SHELL       : NULL
REMARK 200   R MERGE FOR SHELL          (I) : 0.51400
REMARK 200   R SYM FOR SHELL            (I) : NULL
REMARK 200   <I/SIGMA(I)> FOR SHELL         : 2.700
REMARK 200
REMARK 200 DIFFRACTION PROTOCOL: SINGLE WAVELENGTH
REMARK 200 METHOD USED TO DETERMINE THE STRUCTURE: MOLECULAR REPLACEMENT
REMARK 200 SOFTWARE USED: PHASER
REMARK 200 STARTING MODEL: NULL
REMARK 200
```

Appendix 2

```
REMARK 200 REMARK: NULL
REMARK 280
REMARK 280 CRYSTAL
REMARK 280 SOLVENT CONTENT, VS   (%): NULL
REMARK 280 MATTHEWS COEFFICIENT, VM (ANGSTROMS**3/DA): NULL
REMARK 280
REMARK 280 CRYSTALLIZATION CONDITIONS: 39.55% (V/V) 2X MORPHEUS
REMARK 280  PRECIPITANT 2, MES PH 6.12, IMIDAZOLE PH 3.88, PH 5.5, VAPOR
REMARK 280  DIFFUSION, TEMPERATURE 289K
REMARK 290
REMARK 290 CRYSTALLOGRAPHIC SYMMETRY
REMARK 290 SYMMETRY OPERATORS FOR SPACE GROUP: P 1 21 1
REMARK 290
REMARK 290      SYMOP    SYMMETRY
REMARK 290     NNNMMM   OPERATOR
REMARK 290       1555   X,Y,Z
REMARK 290       2555   -X,1/2+Y,-Z
REMARK 290
REMARK 290     WHERE NNN -> OPERATOR NUMBER
REMARK 290           MMM -> TRANSLATION VECTOR
REMARK 290
REMARK 290 CRYSTALLOGRAPHIC SYMMETRY TRANSFORMATIONS
REMARK 290 THE FOLLOWING TRANSFORMATIONS OPERATE ON THE ATOM/HETATM
REMARK 290 RECORDS IN THIS ENTRY TO PRODUCE CRYSTALLOGRAPHICALLY
REMARK 290 RELATED MOLECULES.
REMARK 290     SMTRY1   1  1.000000  0.000000  0.000000        0.00000
REMARK 290     SMTRY2   1  0.000000  1.000000  0.000000        0.00000
REMARK 290     SMTRY3   1  0.000000  0.000000  1.000000        0.00000
REMARK 290     SMTRY1   2 -1.000000  0.000000  0.000000        0.00000
REMARK 290     SMTRY2   2  0.000000  1.000000  0.000000       55.61000
REMARK 290     SMTRY3   2  0.000000  0.000000 -1.000000        0.00000
REMARK 290
REMARK 290 REMARK: NULL
REMARK 300
REMARK 300 BIOMOLECULE: NULL
REMARK 300 SEE REMARK 350 FOR THE AUTHOR PROVIDED AND/OR PROGRAM
REMARK 300 GENERATED ASSEMBLY INFORMATION FOR THE STRUCTURE IN
REMARK 300 THIS ENTRY. THE REMARK MAY ALSO PROVIDE INFORMATION ON
REMARK 300 BURIED SURFACE AREA.
REMARK 300
REMARK 300 REMARK: THE BIOLOGICAL ASSEMBLY IS A PENTAMER
REMARK 465
REMARK 465 MISSING RESIDUES
REMARK 465 THE FOLLOWING RESIDUES WERE NOT LOCATED IN THE
REMARK 465 EXPERIMENT. (M=MODEL NUMBER; RES=RESIDUE NAME; C=CHAIN
REMARK 465 IDENTIFIER; SSEQ=SEQUENCE NUMBER; I=INSERTION CODE.)
REMARK 465
REMARK 465   M RES C  SSEQI
REMARK 465     ALA A   391
REMARK 465     ALA A   392
REMARK 465     LYS A   393
REMARK 465     LEU A   394
REMARK 465     ALA A   395
REMARK 465     GLY A   396
```

Appendix 2

```
REMARK 465     LYS A  397
REMARK 465     ALA B  391
REMARK 465     ALA B  392
REMARK 465     LYS B  393
REMARK 465     LEU B  394
REMARK 465     ALA B  395
REMARK 465     GLY B  396
REMARK 465     LYS B  397
REMARK 465     ALA C  391
REMARK 465     ALA C  392
REMARK 465     LYS C  393
REMARK 465     LEU C  394
REMARK 465     ALA C  395
REMARK 465     GLY C  396
REMARK 465     LYS C  397
REMARK 465     ALA D  391
REMARK 465     ALA D  392
REMARK 465     LYS D  393
REMARK 465     LEU D  394
REMARK 465     ALA D  395
REMARK 465     GLY D  396
REMARK 465     LYS D  397
REMARK 465     ALA E  391
REMARK 465     ALA E  392
REMARK 465     LYS E  393
REMARK 465     LEU E  394
REMARK 465     ALA E  395
REMARK 465     GLY E  396
REMARK 465     LYS E  397
REMARK 470
REMARK 470 MISSING ATOM
REMARK 470 THE FOLLOWING RESIDUES HAVE MISSING ATOMS(M=MODEL NUMBER;
REMARK 470 RES=RESIDUE NAME; C=CHAIN IDENTIFIER; SSEQ=SEQUENCE NUMBER;
REMARK 470 I=INSERTION CODE):
REMARK 470   M RES CSSEQI  ATOMS
REMARK 470     GLU A  28    CG   CD   OE1  OE2
REMARK 470     LYS A 109    CG   CD   CE   NZ
REMARK 470     GLU A 145    CG   CD   OE1  OE2
REMARK 470     LYS A 146    CG   CD   CE   NZ
REMARK 470     LYS A 237    CG   CD   CE   NZ
REMARK 470     GLU A 243    CG   CD   OE1  OE2
REMARK 470     GLU A 254    CG   CD   OE1  OE2
REMARK 470     GLN A 291    CG   CD   OE1  NE2
REMARK 470     LYS A 350    CG   CD   CE   NZ
REMARK 470     ARG A 359    CG   CD   NE   CZ   NH1  NH2
REMARK 470     GLU A 361    CG   CD   OE1  OE2
REMARK 470     GLU B  28    CG   CD   OE1  OE2
REMARK 470     LYS B 109    CG   CD   CE   NZ
REMARK 470     GLU B 243    CG   CD   OE1  OE2
REMARK 470     LYS B 350    CG   CD   CE   NZ
REMARK 470     GLU B 361    CG   CD   OE1  OE2
REMARK 470     GLU C  28    CG   CD   OE1  OE2
REMARK 470     LYS C 109    CG   CD   CE   NZ
REMARK 470     LYS C 237    CG   CD   CE   NZ
```

Appendix 2

```
REMARK 470        GLU C  243     CG   CD   OE1  OE2
REMARK 470        LYS C  350     CG   CD   CE   NZ
REMARK 470        GLU D   28     CG   CD   OE1  OE2
REMARK 470        LYS D  109     CG   CD   CE   NZ
REMARK 470        LYS D  237     CG   CD   CE   NZ
REMARK 470        GLU D  243     CG   CD   OE1  OE2
REMARK 470        GLN D  291     CG   CD   OE1  NE2
REMARK 470        LYS D  350     CG   CD   CE   NZ
REMARK 470        GLU E   28     CG   CD   OE1  OE2
REMARK 470        GLU E   38     CG   CD   OE1  OE2
REMARK 470        LYS E  109     CG   CD   CE   NZ
REMARK 470        LYS E  146     CG   CD   CE   NZ
REMARK 470        ARG E  180     CG   CD   NE   CZ   NH1  NH2
REMARK 470        LYS E  237     CG   CD   CE   NZ
REMARK 470        GLU E  243     CG   CD   OE1  OE2
REMARK 470        GLN E  291     CG   CD   OE1  NE2
REMARK 470        LYS E  350     CG   CD   CE   NZ
SEQRES    1 A  370  GLU LEU PRO PRO GLY ARG LEU ALA THR THR GLU ASP TYR
SEQRES    2 A  370  PHE ALA GLN GLN ALA LYS GLN ALA VAL THR PRO ASP VAL
SEQRES    3 A  370  MET ALA GLN LEU ALA TYR MET ASN TYR ILE ASP PHE ILE
SEQRES    4 A  370  SER PRO PHE TYR SER ARG GLY CYS SER PHE GLU ALA TRP
SEQRES    5 A  370  GLU LEU LYS HIS THR PRO GLN ARG VAL ILE LYS TYR SER
SEQRES    6 A  370  ILE ALA PHE TYR ALA TYR GLY LEU ALA SER VAL ALA LEU
SEQRES    7 A  370  ILE ASP PRO LYS LEU ARG ALA LEU ALA GLY HIS ASP LEU
SEQRES    8 A  370  ASP ILE ALA VAL SER LYS MET LYS CYS LYS ARG VAL TRP
SEQRES    9 A  370  GLY ASP TRP GLU GLU ASP GLY PHE GLY THR ASP PRO ILE
SEQRES   10 A  370  GLU LYS GLU ASN ILE MET TYR LYS GLY HIS LEU ASN LEU
SEQRES   11 A  370  MET TYR GLY LEU TYR GLN LEU VAL THR GLY SER ARG ARG
SEQRES   12 A  370  TYR GLU ALA GLU HIS ALA HIS LEU THR ARG ILE ILE HIS
SEQRES   13 A  370  ASP GLU ILE ALA ALA ASN PRO PHE ALA GLY ILE VAL CYS
SEQRES   14 A  370  GLU PRO ASP ASN TYR PHE VAL GLN CYS ASN SER VAL ALA
SEQRES   15 A  370  TYR LEU SER LEU TRP VAL TYR ASP ARG LEU HIS GLY THR
SEQRES   16 A  370  ASP TYR ARG ALA ALA THR ARG ALA TRP LEU ASP PHE ILE
SEQRES   17 A  370  GLN LYS ASP LEU ILE ASP PRO GLU ARG GLY ALA PHE TYR
SEQRES   18 A  370  LEU SER TYR HIS PRO GLU SER GLY ALA VAL LYS PRO TRP
SEQRES   19 A  370  ILE SER ALA TYR THR THR ALA TRP THR LEU ALA MET VAL
SEQRES   20 A  370  HIS GLY MET ASP PRO ALA PHE SER GLU ARG TYR TYR PRO
SEQRES   21 A  370  ARG PHE LYS GLN THR PHE VAL GLU VAL TYR ASP GLU GLY
SEQRES   22 A  370  ARG LYS ALA ARG VAL ARG GLU THR ALA GLY THR ASP ASP
SEQRES   23 A  370  ALA ASP GLY GLY VAL GLY LEU ALA SER ALA PHE THR LEU
SEQRES   24 A  370  LEU LEU ALA ARG GLU MET GLY ASP GLN GLN LEU PHE ASP
SEQRES   25 A  370  GLN LEU LEU ASN HIS LEU GLU PRO PRO ALA LYS PRO SER
SEQRES   26 A  370  ILE VAL SER ALA SER LEU ARG TYR GLU HIS PRO GLY SER
SEQRES   27 A  370  LEU LEU PHE ASP GLU LEU LEU PHE LEU ALA LYS VAL HIS
SEQRES   28 A  370  ALA GLY PHE GLY ALA LEU LEU ARG MET PRO PRO PRO ALA
SEQRES   29 A  370  ALA LYS LEU ALA GLY LYS
SEQRES    1 B  370  GLU LEU PRO PRO GLY ARG LEU ALA THR THR GLU ASP TYR
SEQRES    2 B  370  PHE ALA GLN GLN ALA LYS GLN ALA VAL THR PRO ASP VAL
SEQRES    3 B  370  MET ALA GLN LEU ALA TYR MET ASN TYR ILE ASP PHE ILE
SEQRES    4 B  370  SER PRO PHE TYR SER ARG GLY CYS SER PHE GLU ALA TRP
SEQRES    5 B  370  GLU LEU LYS HIS THR PRO GLN ARG VAL ILE LYS TYR SER
SEQRES    6 B  370  ILE ALA PHE TYR ALA TYR GLY LEU ALA SER VAL ALA LEU
SEQRES    7 B  370  ILE ASP PRO LYS LEU ARG ALA LEU ALA GLY HIS ASP LEU
SEQRES    8 B  370  ASP ILE ALA VAL SER LYS MET LYS CYS LYS ARG VAL TRP
```

```
Appendix 2
SEQRES   9 B  370  GLY ASP TRP GLU GLU ASP GLY PHE GLY THR ASP PRO ILE
SEQRES  10 B  370  GLU LYS GLU ASN ILE MET TYR LYS GLY HIS LEU ASN LEU
SEQRES  11 B  370  MET TYR GLY LEU TYR GLN LEU VAL THR GLY SER ARG ARG
SEQRES  12 B  370  TYR GLU ALA GLU HIS ALA HIS LEU THR ARG ILE ILE HIS
SEQRES  13 B  370  ASP GLU ILE ALA ALA ASN PRO PHE ALA GLY ILE VAL CYS
SEQRES  14 B  370  GLU PRO ASP ASN TYR PHE VAL GLN CYS ASN SER VAL ALA
SEQRES  15 B  370  TYR LEU SER LEU TRP VAL TYR ASP ARG LEU HIS GLY THR
SEQRES  16 B  370  ASP TYR ARG ALA ALA THR ARG ALA TRP LEU ASP PHE ILE
SEQRES  17 B  370  GLN LYS ASP LEU ILE ASP PRO GLU ARG GLY ALA PHE TYR
SEQRES  18 B  370  LEU SER TYR HIS PRO GLU SER GLY ALA VAL LYS PRO TRP
SEQRES  19 B  370  ILE SER ALA TYR THR THR ALA TRP THR LEU ALA MET VAL
SEQRES  20 B  370  HIS GLY MET ASP PRO ALA PHE SER GLU ARG TYR TYR PRO
SEQRES  21 B  370  ARG PHE LYS GLN THR PHE VAL GLU VAL TYR ASP GLU GLY
SEQRES  22 B  370  ARG LYS ALA ARG VAL ARG GLU THR ALA GLY THR ASP ASP
SEQRES  23 B  370  ALA ASP GLY GLY VAL GLY LEU ALA SER ALA PHE THR LEU
SEQRES  24 B  370  LEU LEU ALA ARG GLU MET GLY ASP GLN GLN LEU PHE ASP
SEQRES  25 B  370  GLN LEU LEU ASN HIS LEU GLU PRO PRO ALA LYS PRO SER
SEQRES  26 B  370  ILE VAL SER ALA SER LEU ARG TYR GLU HIS PRO GLY SER
SEQRES  27 B  370  LEU LEU PHE ASP GLU LEU LEU PHE LEU ALA LYS VAL HIS
SEQRES  28 B  370  ALA GLY PHE GLY ALA LEU LEU ARG MET PRO PRO PRO ALA
SEQRES  29 B  370  ALA LYS LEU ALA GLY LYS
SEQRES   1 C  370  GLU LEU PRO PRO GLY ARG LEU ALA THR THR GLU ASP TYR
SEQRES   2 C  370  PHE ALA GLN GLN ALA LYS GLN ALA VAL THR PRO ASP VAL
SEQRES   3 C  370  MET ALA GLN LEU ALA TYR MET ASN TYR ILE ASP PHE ILE
SEQRES   4 C  370  SER PRO PHE TYR SER ARG GLY CYS SER PHE GLU ALA TRP
SEQRES   5 C  370  GLU LEU LYS HIS THR PRO GLN ARG VAL ILE LYS TYR SER
SEQRES   6 C  370  ILE ALA PHE TYR ALA TYR GLY LEU ALA SER VAL ALA LEU
SEQRES   7 C  370  ILE ASP PRO LYS LEU ARG ALA LEU ALA GLY HIS ASP LEU
SEQRES   8 C  370  ASP ILE ALA VAL SER LYS MET LYS CYS LYS ARG VAL TRP
SEQRES   9 C  370  GLY ASP TRP GLU GLU ASP GLY PHE GLY THR ASP PRO ILE
SEQRES  10 C  370  GLU LYS GLU ASN ILE MET TYR LYS GLY HIS LEU ASN LEU
SEQRES  11 C  370  MET TYR GLY LEU TYR GLN LEU VAL THR GLY SER ARG ARG
SEQRES  12 C  370  TYR GLU ALA GLU HIS ALA HIS LEU THR ARG ILE ILE HIS
SEQRES  13 C  370  ASP GLU ILE ALA ALA ASN PRO PHE ALA GLY ILE VAL CYS
SEQRES  14 C  370  GLU PRO ASP ASN TYR PHE VAL GLN CYS ASN SER VAL ALA
SEQRES  15 C  370  TYR LEU SER LEU TRP VAL TYR ASP ARG LEU HIS GLY THR
SEQRES  16 C  370  ASP TYR ARG ALA ALA THR ARG ALA TRP LEU ASP PHE ILE
SEQRES  17 C  370  GLN LYS ASP LEU ILE ASP PRO GLU ARG GLY ALA PHE TYR
SEQRES  18 C  370  LEU SER TYR HIS PRO GLU SER GLY ALA VAL LYS PRO TRP
SEQRES  19 C  370  ILE SER ALA TYR THR THR ALA TRP THR LEU ALA MET VAL
SEQRES  20 C  370  HIS GLY MET ASP PRO ALA PHE SER GLU ARG TYR TYR PRO
SEQRES  21 C  370  ARG PHE LYS GLN THR PHE VAL GLU VAL TYR ASP GLU GLY
SEQRES  22 C  370  ARG LYS ALA ARG VAL ARG GLU THR ALA GLY THR ASP ASP
SEQRES  23 C  370  ALA ASP GLY GLY VAL GLY LEU ALA SER ALA PHE THR LEU
SEQRES  24 C  370  LEU LEU ALA ARG GLU MET GLY ASP GLN GLN LEU PHE ASP
SEQRES  25 C  370  GLN LEU LEU ASN HIS LEU GLU PRO PRO ALA LYS PRO SER
SEQRES  26 C  370  ILE VAL SER ALA SER LEU ARG TYR GLU HIS PRO GLY SER
SEQRES  27 C  370  LEU LEU PHE ASP GLU LEU LEU PHE LEU ALA LYS VAL HIS
SEQRES  28 C  370  ALA GLY PHE GLY ALA LEU LEU ARG MET PRO PRO PRO ALA
SEQRES  29 C  370  ALA LYS LEU ALA GLY LYS
SEQRES   1 D  370  GLU LEU PRO PRO GLY ARG LEU ALA THR THR GLU ASP TYR
SEQRES   2 D  370  PHE ALA GLN GLN ALA LYS GLN ALA VAL THR PRO ASP VAL
SEQRES   3 D  370  MET ALA GLN LEU ALA TYR MET ASN TYR ILE ASP PHE ILE
SEQRES   4 D  370  SER PRO PHE TYR SER ARG GLY CYS SER PHE GLU ALA TRP
```

Appendix 2

```
SEQRES    5 D  370  GLU LEU LYS HIS THR PRO GLN ARG VAL ILE LYS TYR SER
SEQRES    6 D  370  ILE ALA PHE TYR ALA TYR GLY LEU ALA SER VAL ALA LEU
SEQRES    7 D  370  ILE ASP PRO LYS LEU ARG ALA LEU ALA GLY HIS ASP LEU
SEQRES    8 D  370  ASP ILE ALA VAL SER LYS MET LYS CYS LYS ARG VAL TRP
SEQRES    9 D  370  GLY ASP TRP GLU GLU ASP GLY PHE GLY THR ASP PRO ILE
SEQRES   10 D  370  GLU LYS GLU ASN ILE MET TYR LYS GLY HIS LEU ASN LEU
SEQRES   11 D  370  MET TYR GLY LEU TYR GLN LEU VAL THR GLY SER ARG ARG
SEQRES   12 D  370  TYR GLU ALA GLU HIS ALA HIS LEU THR ARG ILE ILE HIS
SEQRES   13 D  370  ASP GLU ILE ALA ALA ASN PRO PHE ALA GLY ILE VAL CYS
SEQRES   14 D  370  GLU PRO ASP ASN TYR PHE VAL GLN CYS ASN SER VAL ALA
SEQRES   15 D  370  TYR LEU SER LEU TRP VAL TYR ASP ARG LEU HIS GLY THR
SEQRES   16 D  370  ASP TYR ARG ALA ALA THR ARG ALA TRP LEU ASP PHE ILE
SEQRES   17 D  370  GLN LYS ASP LEU ILE ASP PRO GLU ARG GLY ALA PHE TYR
SEQRES   18 D  370  LEU SER TYR HIS PRO GLU SER GLY ALA VAL LYS PRO TRP
SEQRES   19 D  370  ILE SER ALA TYR THR THR ALA TRP THR LEU ALA MET VAL
SEQRES   20 D  370  HIS GLY MET ASP PRO ALA PHE SER GLU ARG TYR TYR PRO
SEQRES   21 D  370  ARG PHE LYS GLN THR PHE VAL GLU VAL TYR ASP GLU GLY
SEQRES   22 D  370  ARG LYS ALA ARG VAL ARG GLU THR ALA GLY THR ASP ASP
SEQRES   23 D  370  ALA ASP GLY GLY VAL GLY LEU ALA SER ALA PHE THR LEU
SEQRES   24 D  370  LEU LEU ALA ARG GLU MET GLY ASP GLN GLN LEU PHE ASP
SEQRES   25 D  370  GLN LEU LEU ASN HIS LEU GLU PRO PRO ALA LYS PRO SER
SEQRES   26 D  370  ILE VAL SER ALA SER LEU ARG TYR GLU HIS PRO GLY SER
SEQRES   27 D  370  LEU LEU PHE ASP GLU LEU LEU PHE LEU ALA LYS VAL HIS
SEQRES   28 D  370  ALA GLY PHE GLY ALA LEU LEU ARG MET PRO PRO PRO ALA
SEQRES   29 D  370  ALA LYS LEU ALA GLY LYS
SEQRES    1 E  370  GLU LEU PRO PRO GLY ARG LEU ALA THR THR GLU ASP TYR
SEQRES    2 E  370  PHE ALA GLN GLN ALA LYS GLN ALA VAL THR PRO ASP VAL
SEQRES    3 E  370  MET ALA GLN LEU ALA TYR MET ASN TYR ILE ASP PHE ILE
SEQRES    4 E  370  SER PRO PHE TYR SER ARG GLY CYS SER PHE GLU ALA TRP
SEQRES    5 E  370  GLU LEU LYS HIS THR PRO GLN ARG VAL ILE LYS TYR SER
SEQRES    6 E  370  ILE ALA PHE TYR ALA TYR GLY LEU ALA SER VAL ALA LEU
SEQRES    7 E  370  ILE ASP PRO LYS LEU ARG ALA LEU ALA GLY HIS ASP LEU
SEQRES    8 E  370  ASP ILE ALA VAL SER LYS MET LYS CYS LYS ARG VAL TRP
SEQRES    9 E  370  GLY ASP TRP GLU GLU ASP GLY PHE GLY THR ASP PRO ILE
SEQRES   10 E  370  GLU LYS GLU ASN ILE MET TYR LYS GLY HIS LEU ASN LEU
SEQRES   11 E  370  MET TYR GLY LEU TYR GLN LEU VAL THR GLY SER ARG ARG
SEQRES   12 E  370  TYR GLU ALA GLU HIS ALA HIS LEU THR ARG ILE ILE HIS
SEQRES   13 E  370  ASP GLU ILE ALA ALA ASN PRO PHE ALA GLY ILE VAL CYS
SEQRES   14 E  370  GLU PRO ASP ASN TYR PHE VAL GLN CYS ASN SER VAL ALA
SEQRES   15 E  370  TYR LEU SER LEU TRP VAL TYR ASP ARG LEU HIS GLY THR
SEQRES   16 E  370  ASP TYR ARG ALA ALA THR ARG ALA TRP LEU ASP PHE ILE
SEQRES   17 E  370  GLN LYS ASP LEU ILE ASP PRO GLU ARG GLY ALA PHE TYR
SEQRES   18 E  370  LEU SER TYR HIS PRO GLU SER GLY ALA VAL LYS PRO TRP
SEQRES   19 E  370  ILE SER ALA TYR THR THR ALA TRP THR LEU ALA MET VAL
SEQRES   20 E  370  HIS GLY MET ASP PRO ALA PHE SER GLU ARG TYR TYR PRO
SEQRES   21 E  370  ARG PHE LYS GLN THR PHE VAL GLU VAL TYR ASP GLU GLY
SEQRES   22 E  370  ARG LYS ALA ARG VAL ARG GLU THR ALA GLY THR ASP ASP
SEQRES   23 E  370  ALA ASP GLY GLY VAL GLY LEU ALA SER ALA PHE THR LEU
SEQRES   24 E  370  LEU LEU ALA ARG GLU MET GLY ASP GLN GLN LEU PHE ASP
SEQRES   25 E  370  GLN LEU LEU ASN HIS LEU GLU PRO PRO ALA LYS PRO SER
SEQRES   26 E  370  ILE VAL SER ALA SER LEU ARG TYR GLU HIS PRO GLY SER
SEQRES   27 E  370  LEU LEU PHE ASP GLU LEU LEU PHE LEU ALA LYS VAL HIS
SEQRES   28 E  370  ALA GLY PHE GLY ALA LEU LEU ARG MET PRO PRO PRO ALA
SEQRES   29 E  370  ALA LYS LEU ALA GLY LYS
```

Appendix 2

```
HET    ZN   A1001        1
HET    ZN   B1001        1
HET    ZN   C1001        1
HET    ZN   D1001        1
HET    ZN   E1001        1
HETNAM      ZN ZINC ION
FORMUL  6   ZN    5(ZN1 2+)
FORMUL 11   HOH   *143(H2 O)
HELIX    1   1 THR A   36  GLN A   47  1                                  12
HELIX    2   2 THR A   50  TYR A   62  1                                  13
HELIX    3   3 PHE A   76  HIS A   83  1                                   8
HELIX    4   4 PRO A   85  ARG A   87  5                                   3
HELIX    5   5 VAL A   88  ASP A  107  1                                  20
HELIX    6   6 LEU A  110  CYS A  127  1                                  18
HELIX    7   7 CYS A  127  GLY A  132  1                                   6
HELIX    8   8 GLY A  132  ASP A  137  1                                   6
HELIX    9   9 ASN A  148  GLY A  167  1                                  20
HELIX   10  10 TYR A  171  ASN A  189  1                                  19
HELIX   11  11 PHE A  202  GLY A  221  1                                  20
HELIX   12  12 ASP A  223  ALA A  226  5                                   4
HELIX   13  13 ALA A  227  LYS A  237  1                                  11
HELIX   14  14 SER A  263  GLY A  276  1                                  14
HELIX   15  15 ASP A  278  PHE A  293  1                                  16
HELIX   16  16 LEU A  320  MET A  332  1                                  13
HELIX   17  17 ASP A  334  GLU A  346  1                                  13
HELIX   18  18 PRO A  347  ALA A  349  5                                   3
HELIX   19  19 LEU A  367  HIS A  378  1                                  12
HELIX   20  20 GLY A  380  ARG A  386  1                                   7
HELIX   21  21 THR B   36  GLN B   47  1                                  12
HELIX   22  22 THR B   50  TYR B   62  1                                  13
HELIX   23  23 PHE B   76  HIS B   83  1                                   8
HELIX   24  24 PRO B   85  ARG B   87  5                                   3
HELIX   25  25 VAL B   88  ASP B  107  1                                  20
HELIX   26  26 LEU B  110  CYS B  127  1                                  18
HELIX   27  27 CYS B  127  GLY B  132  1                                   6
HELIX   28  28 GLY B  132  ASP B  137  1                                   6
HELIX   29  29 ASN B  148  GLY B  167  1                                  20
HELIX   30  30 TYR B  171  ASN B  189  1                                  19
HELIX   31  31 PHE B  202  GLY B  221  1                                  20
HELIX   32  32 ASP B  223  ALA B  226  5                                   4
HELIX   33  33 ALA B  227  GLN B  236  1                                  10
HELIX   34  34 SER B  263  GLY B  276  1                                  14
HELIX   35  35 ASP B  278  PHE B  293  1                                  16
HELIX   36  36 LEU B  320  GLY B  333  1                                  14
HELIX   37  37 ASP B  334  GLU B  346  1                                  13
HELIX   38  38 PRO B  347  ALA B  349  5                                   3
HELIX   39  39 LEU B  367  HIS B  378  1                                  12
HELIX   40  40 GLY B  380  ARG B  386  1                                   7
HELIX   41  41 THR C   36  GLN C   43  1                                   8
HELIX   42  42 THR C   50  TYR C   62  1                                  13
HELIX   43  43 PHE C   76  HIS C   83  1                                   8
HELIX   44  44 PRO C   85  ARG C   87  5                                   3
HELIX   45  45 VAL C   88  ASP C  107  1                                  20
HELIX   46  46 LEU C  110  LYS C  126  1                                  17
```

Appendix 2

```
HELIX    47  47 CYS C  127  GLY C  132  1                               6
HELIX    48  48 GLY C  132  ASP C  137  1                               6
HELIX    49  49 ASN C  148  GLY C  167  1                              20
HELIX    50  50 TYR C  171  ASN C  189  1                              19
HELIX    51  51 PHE C  202  GLY C  221  1                              20
HELIX    52  52 ASP C  223  ALA C  226  5                               4
HELIX    53  53 ALA C  227  LYS C  237  1                              11
HELIX    54  54 SER C  263  HIS C  275  1                              13
HELIX    55  55 ASP C  278  PHE C  293  1                              16
HELIX    56  56 LEU C  320  MET C  332  1                              13
HELIX    57  57 ASP C  334  LYS C  350  1                              17
HELIX    58  58 LEU C  367  HIS C  378  1                              12
HELIX    59  59 GLY C  380  ARG C  386  1                               7
HELIX    60  60 THR D   36  GLN D   47  1                              12
HELIX    61  61 THR D   50  TYR D   62  1                              13
HELIX    62  62 PHE D   76  LYS D   82  1                               7
HELIX    63  63 PRO D   85  ARG D   87  5                               3
HELIX    64  64 VAL D   88  ASP D  107  1                              20
HELIX    65  65 LEU D  110  CYS D  127  1                              18
HELIX    66  66 CYS D  127  GLY D  132  1                               6
HELIX    67  67 GLY D  132  ASP D  137  1                               6
HELIX    68  68 ASN D  148  GLY D  167  1                              20
HELIX    69  69 TYR D  171  ASN D  189  1                              19
HELIX    70  70 PHE D  202  GLY D  221  1                              20
HELIX    71  71 ASP D  223  ALA D  226  5                               4
HELIX    72  72 ALA D  227  LYS D  237  1                              11
HELIX    73  73 SER D  263  ASP D  278  1                              16
HELIX    74  74 ASP D  278  PHE D  293  1                              16
HELIX    75  75 LEU D  320  GLY D  333  1                              14
HELIX    76  76 ASP D  334  GLU D  346  1                              13
HELIX    77  77 PRO D  347  ALA D  349  5                               3
HELIX    78  78 LEU D  367  HIS D  378  1                              12
HELIX    79  79 GLY D  380  ARG D  386  1                               7
HELIX    80  80 THR E   36  GLN E   47  1                              12
HELIX    81  81 THR E   50  TYR E   62  1                              13
HELIX    82  82 PHE E   76  HIS E   83  1                               8
HELIX    83  83 PRO E   85  ARG E   87  5                               3
HELIX    84  84 VAL E   88  ASP E  107  1                              20
HELIX    85  85 LEU E  110  CYS E  127  1                              18
HELIX    86  86 CYS E  127  GLY E  132  1                               6
HELIX    87  87 GLY E  132  ASP E  137  1                               6
HELIX    88  88 ASN E  148  GLY E  167  1                              20
HELIX    89  89 TYR E  171  ASN E  189  1                              19
HELIX    90  90 PHE E  202  GLY E  221  1                              20
HELIX    91  91 ASP E  223  ALA E  226  5                               4
HELIX    92  92 ALA E  227  ILE E  235  1                               9
HELIX    93  93 SER E  263  GLY E  276  1                              14
HELIX    94  94 ASP E  278  PHE E  293  1                              16
HELIX    95  95 LEU E  320  GLY E  333  1                              14
HELIX    96  96 ASP E  334  GLU E  346  1                              13
HELIX    97  97 PRO E  347  ALA E  349  5                               3
HELIX    98  98 LEU E  367  HIS E  378  1                              12
HELIX    99  99 GLY E  380  ARG E  386  1                               7
SHEET     1   A 2 ILE A  240  ASP A  241  0
```

Appendix 2

```
SHEET    2   A 2 ALA A 246  PHE A 247 -1  O  ALA A 246  N  ASP A 241
SHEET    1   B 2 VAL A 294  TYR A 297  0
SHEET    2   B 2 LYS A 302  VAL A 305 -1  O  ARG A 304  N  GLU A 295
SHEET    1   C 2 PRO A 351  VAL A 354  0
SHEET    2   C 2 SER A 357  TYR A 360 -1  O  SER A 357  N  VAL A 354
SHEET    1   D 2 ILE B 240  ASP B 241  0
SHEET    2   D 2 ALA B 246  PHE B 247 -1  O  ALA B 246  N  ASP B 241
SHEET    1   E 2 TYR B 251  HIS B 252  0
SHEET    2   E 2 ALA B 257  VAL B 258 -1  O  ALA B 257  N  HIS B 252
SHEET    1   F 2 VAL B 294  TYR B 297  0
SHEET    2   F 2 LYS B 302  VAL B 305 -1  O  ARG B 304  N  GLU B 295
SHEET    1   G 2 PRO B 351  VAL B 354  0
SHEET    2   G 2 SER B 357  TYR B 360 -1  O  ARG B 359  N  SER B 352
SHEET    1   H 2 ILE C 240  ASP C 241  0
SHEET    2   H 2 ALA C 246  PHE C 247 -1  O  ALA C 246  N  ASP C 241
SHEET    1   I 2 VAL C 294  TYR C 297  0
SHEET    2   I 2 LYS C 302  VAL C 305 -1  O  LYS C 302  N  TYR C 297
SHEET    1   J 2 PRO C 351  VAL C 354  0
SHEET    2   J 2 SER C 357  TYR C 360 -1  O  SER C 357  N  VAL C 354
SHEET    1   K 2 ILE D 240  ASP D 241  0
SHEET    2   K 2 ALA D 246  PHE D 247 -1  O  ALA D 246  N  ASP D 241
SHEET    1   L 2 TYR D 251  HIS D 252  0
SHEET    2   L 2 ALA D 257  VAL D 258 -1  O  ALA D 257  N  HIS D 252
SHEET    1   M 2 VAL D 294  TYR D 297  0
SHEET    2   M 2 LYS D 302  VAL D 305 -1  O  LYS D 302  N  TYR D 297
SHEET    1   N 2 PRO D 351  VAL D 354  0
SHEET    2   N 2 SER D 357  TYR D 360 -1  O  SER D 357  N  VAL D 354
SHEET    1   O 2 ILE E 240  ASP E 241  0
SHEET    2   O 2 ALA E 246  PHE E 247 -1  O  ALA E 246  N  ASP E 241
SHEET    1   P 2 TYR E 251  HIS E 252  0
SHEET    2   P 2 ALA E 257  VAL E 258 -1  O  ALA E 257  N  HIS E 252
SHEET    1   Q 2 VAL E 294  TYR E 297  0
SHEET    2   Q 2 LYS E 302  VAL E 305 -1  O  ARG E 304  N  GLU E 295
SHEET    1   R 2 PRO E 351  VAL E 354  0
SHEET    2   R 2 SER E 357  TYR E 360 -1  O  ARG E 359  N  SER E 352
SSBOND   1 CYS A   74    CYS A  127                          1555   1555
SSBOND   2 CYS B   74    CYS B  127                          1555   1555
SSBOND   3 CYS C   74    CYS C  127                          1555   1555
SSBOND   4 CYS D   74    CYS D  127                          1555   1555
SSBOND   5 CYS E   74    CYS E  127                          1555   1555
CRYST1   88.700  111.220  120.420  90.00 102.72  90.00 P 1 21 1      10
ORIGX1      1.000000  0.000000  0.000000        0.00000
ORIGX2      0.000000  1.000000  0.000000        0.00000
ORIGX3      0.000000  0.000000  1.000000        0.00000
SCALE1      0.011274  0.000000  0.002545        0.00000
SCALE2     -0.000000  0.008991  0.000000        0.00000
SCALE3      0.000000 -0.000000  0.008513        0.00000
ATOM     1  N   GLU A  28      91.507 -20.010 246.678  1.00 32.50           N
ATOM     2  CA  GLU A  28      91.683 -18.892 245.668  1.00 36.70           C
ATOM     3  C   GLU A  28      90.917 -17.597 246.072  1.00 40.65           C
ATOM     4  O   GLU A  28      89.666 -17.575 246.095  1.00 39.06           O
ATOM     5  CB  GLU A  28      91.256 -19.344 244.258  1.00 36.11           C
ATOM     6  N   LEU A  29      91.672 -16.529 246.384  1.00 42.31           N
ATOM     7  CA  LEU A  29      91.118 -15.291 246.987  1.00 40.66           C
```

Appendix 2

```
ATOM      8  C    LEU A  29      90.745 -14.247 245.943  1.00 40.27           C
ATOM      9  O    LEU A  29      91.631 -13.657 245.330  1.00 45.72           O
ATOM     10  CB   LEU A  29      92.142 -14.666 247.949  1.00 39.65           C
ATOM     11  CG   LEU A  29      91.703 -13.407 248.716  1.00 39.69           C
ATOM     12  CD1  LEU A  29      90.594 -13.769 249.702  1.00 38.56           C
ATOM     13  CD2  LEU A  29      92.882 -12.720 249.424  1.00 38.64           C
ATOM     14  N    PRO A  30      89.445 -13.984 245.745  1.00 39.39           N
ATOM     15  CA   PRO A  30      89.121 -12.987 244.714  1.00 39.48           C
ATOM     16  C    PRO A  30      89.638 -11.603 245.086  1.00 38.73           C
ATOM     17  O    PRO A  30      89.903 -11.343 246.234  1.00 36.69           O
ATOM     18  CB   PRO A  30      87.587 -13.007 244.652  1.00 39.48           C
ATOM     19  CG   PRO A  30      87.188 -14.311 245.274  1.00 39.76           C
ATOM     20  CD   PRO A  30      88.233 -14.600 246.316  1.00 40.31           C
ATOM     21  N    PRO A  31      89.805 -10.727 244.109  1.00 41.01           N
ATOM     22  CA   PRO A  31      90.483  -9.473 244.430  1.00 40.99           C
ATOM     23  C    PRO A  31      89.589  -8.474 245.156  1.00 39.78           C
ATOM     24  O    PRO A  31      88.422  -8.297 244.790  1.00 38.34           O
ATOM     25  CB   PRO A  31      90.899  -8.930 243.056  1.00 43.17           C
ATOM     26  CG   PRO A  31      90.018  -9.627 242.060  1.00 43.41           C
ATOM     27  CD   PRO A  31      89.623 -10.943 242.661  1.00 42.25           C
ATOM     28  N    GLY A  32      90.160  -7.817 246.165  1.00 38.48           N
ATOM     29  CA   GLY A  32      89.439  -6.830 246.985  1.00 35.58           C
ATOM     30  C    GLY A  32      88.736  -7.422 248.204  1.00 33.64           C
ATOM     31  O    GLY A  32      88.225  -6.677 249.038  1.00 32.72           O
ATOM     32  N    ARG A  33      88.693  -8.758 248.284  1.00 30.57           N
ATOM     33  CA   ARG A  33      88.034  -9.501 249.363  1.00 28.79           C
ATOM     34  C    ARG A  33      89.014  -9.729 250.490  1.00 27.49           C
ATOM     35  O    ARG A  33      90.209  -9.572 250.285  1.00 26.17           O
ATOM     36  CB   ARG A  33      87.551 -10.867 248.867  1.00 27.94           C
ATOM     37  CG   ARG A  33      86.365 -10.824 247.910  1.00 27.56           C
ATOM     38  CD   ARG A  33      85.064 -10.835 248.678  1.00 27.12           C
ATOM     39  NE   ARG A  33      84.971 -12.035 249.500  1.00 26.99           N
ATOM     40  CZ   ARG A  33      84.567 -13.230 249.063  1.00 26.17           C
ATOM     41  NH1  ARG A  33      84.192 -13.406 247.796  1.00 26.54           N
ATOM     42  NH2  ARG A  33      84.524 -14.261 249.901  1.00 25.19           N
ATOM     43  N    LEU A  34      88.502 -10.151 251.647  1.00 27.77           N
ATOM     44  CA   LEU A  34      89.304 -10.312 252.888  1.00 27.46           C
ATOM     45  C    LEU A  34      89.556 -11.773 253.274  1.00 26.88           C
ATOM     46  O    LEU A  34      90.660 -12.119 253.703  1.00 26.71           O
ATOM     47  CB   LEU A  34      88.601  -9.648 254.063  1.00 27.51           C
ATOM     48  CG   LEU A  34      88.319  -8.155 253.945  1.00 29.24           C
ATOM     49  CD1  LEU A  34      87.327  -7.729 255.033  1.00 28.96           C
ATOM     50  CD2  LEU A  34      89.615  -7.347 253.996  1.00 29.26           C
ATOM     51  N    ALA A  35      88.512 -12.604 253.182  1.00 25.58           N
ATOM     52  CA   ALA A  35      88.672 -14.054 253.236  1.00 25.86           C
ATOM     53  C    ALA A  35      87.855 -14.762 252.125  1.00 27.49           C
ATOM     54  O    ALA A  35      86.923 -14.175 251.560  1.00 25.26           O
ATOM     55  CB   ALA A  35      88.320 -14.579 254.614  1.00 24.82           C
ATOM     56  N    THR A  36      88.249 -15.998 251.781  1.00 29.76           N
ATOM     57  CA   THR A  36      87.490 -16.810 250.809  1.00 30.88           C
ATOM     58  C    THR A  36      86.089 -17.163 251.344  1.00 31.49           C
ATOM     59  O    THR A  36      85.797 -17.083 252.553  1.00 29.88           O
ATOM     60  CB   THR A  36      88.209 -18.136 250.409  1.00 32.23           C
ATOM     61  OG1  THR A  36      88.264 -19.051 251.520  1.00 33.99           O
```

Appendix 2

```
ATOM     62  CG2 THR A  36      89.636 -17.880 249.893  1.00 32.59           C
ATOM     63  N   THR A  37      85.229 -17.549 250.416  1.00 31.13           N
ATOM     64  CA  THR A  37      83.894 -17.998 250.751  1.00 31.81           C
ATOM     65  C   THR A  37      83.968 -19.371 251.411  1.00 31.82           C
ATOM     66  O   THR A  37      83.152 -19.711 252.251  1.00 31.21           O
ATOM     67  CB  THR A  37      83.043 -18.061 249.475  1.00 33.65           C
ATOM     68  OG1 THR A  37      82.974 -16.755 248.879  1.00 33.45           O
ATOM     69  CG2 THR A  37      81.645 -18.560 249.779  1.00 34.93           C
ATOM     70  N   GLU A  38      84.952 -20.163 250.995  1.00 33.20           N
ATOM     71  CA  GLU A  38      85.258 -21.422 251.629  1.00 34.70           C
ATOM     72  C   GLU A  38      85.539 -21.147 253.093  1.00 33.89           C
ATOM     73  O   GLU A  38      84.992 -21.813 253.956  1.00 32.28           O
ATOM     74  CB  GLU A  38      86.485 -22.055 250.961  1.00 38.19           C
ATOM     75  CG  GLU A  38      86.839 -23.459 251.443  1.00 40.62           C
ATOM     76  CD  GLU A  38      88.090 -24.035 250.779  1.00 42.04           C
ATOM     77  OE1 GLU A  38      88.866 -23.300 250.125  1.00 40.17           O
ATOM     78  OE2 GLU A  38      88.301 -25.255 250.915  1.00 45.86           O
ATOM     79  N   ASP A  39      86.387 -20.152 253.363  1.00 34.25           N
ATOM     80  CA  ASP A  39      86.753 -19.804 254.739  1.00 34.64           C
ATOM     81  C   ASP A  39      85.513 -19.552 255.620  1.00 33.59           C
ATOM     82  O   ASP A  39      85.422 -20.083 256.752  1.00 34.74           O
ATOM     83  CB  ASP A  39      87.723 -18.591 254.793  1.00 33.94           C
ATOM     84  CG  ASP A  39      89.189 -18.948 254.468  1.00 33.13           C
ATOM     85  OD1 ASP A  39      89.555 -20.143 254.475  1.00 31.68           O
ATOM     86  OD2 ASP A  39      89.974 -18.006 254.189  1.00 32.21           O
ATOM     87  N   TYR A  40      84.558 -18.779 255.094  1.00 30.15           N
ATOM     88  CA  TYR A  40      83.333 -18.434 255.844  1.00 29.38           C
ATOM     89  C   TYR A  40      82.442 -19.637 256.201  1.00 28.72           C
ATOM     90  O   TYR A  40      82.024 -19.778 257.353  1.00 26.50           O
ATOM     91  CB  TYR A  40      82.518 -17.349 255.104  1.00 28.64           C
ATOM     92  CG  TYR A  40      83.228 -15.999 255.003  1.00 28.77           C
ATOM     93  CD1 TYR A  40      83.817 -15.382 256.134  1.00 28.69           C
ATOM     94  CD2 TYR A  40      83.345 -15.353 253.788  1.00 28.72           C
ATOM     95  CE1 TYR A  40      84.485 -14.166 256.025  1.00 27.80           C
ATOM     96  CE2 TYR A  40      84.008 -14.138 253.672  1.00 28.89           C
ATOM     97  CZ  TYR A  40      84.575 -13.548 254.783  1.00 28.10           C
ATOM     98  OH  TYR A  40      85.233 -12.352 254.610  1.00 26.95           O
ATOM     99  N   PHE A  41      82.195 -20.512 255.225  1.00 28.86           N
ATOM    100  CA  PHE A  41      81.383 -21.714 255.442  1.00 29.28           C
ATOM    101  C   PHE A  41      82.097 -22.729 256.334  1.00 30.72           C
ATOM    102  O   PHE A  41      81.462 -23.531 257.024  1.00 30.53           O
ATOM    103  CB  PHE A  41      81.004 -22.329 254.103  1.00 29.12           C
ATOM    104  CG  PHE A  41      79.858 -21.627 253.434  1.00 28.76           C
ATOM    105  CD1 PHE A  41      79.979 -20.309 253.011  1.00 28.41           C
ATOM    106  CD2 PHE A  41      78.638 -22.276 253.241  1.00 29.28           C
ATOM    107  CE1 PHE A  41      78.907 -19.653 252.409  1.00 28.85           C
ATOM    108  CE2 PHE A  41      77.562 -21.616 252.639  1.00 29.33           C
ATOM    109  CZ  PHE A  41      77.698 -20.309 252.216  1.00 28.09           C
ATOM    110  N   ALA A  42      83.421 -22.658 256.363  1.00 33.05           N
ATOM    111  CA  ALA A  42      84.224 -23.552 257.211  1.00 34.55           C
ATOM    112  C   ALA A  42      84.292 -23.129 258.685  1.00 33.62           C
ATOM    113  O   ALA A  42      84.687 -23.935 259.506  1.00 37.48           O
ATOM    114  CB  ALA A  42      85.644 -23.684 256.649  1.00 33.86           C
ATOM    115  N   GLN A  43      83.943 -21.883 259.008  1.00 31.48           N
```

Appendix 2

```
ATOM    116  CA   GLN A  43      84.063 -21.343 260.383  1.00 31.29           C
ATOM    117  C    GLN A  43      83.507 -22.256 261.453  1.00 31.38           C
ATOM    118  O    GLN A  43      84.143 -22.509 262.474  1.00 31.08           O
ATOM    119  CB   GLN A  43      83.356 -19.974 260.516  1.00 30.26           C
ATOM    120  CG   GLN A  43      84.176 -18.804 260.004  1.00 28.96           C
ATOM    121  CD   GLN A  43      83.400 -17.499 260.002  1.00 29.58           C
ATOM    122  OE1  GLN A  43      83.878 -16.476 260.516  1.00 27.87           O
ATOM    123  NE2  GLN A  43      82.199 -17.519 259.415  1.00 27.90           N
ATOM    124  N    GLN A  44      82.298 -22.734 261.228  1.00 34.01           N
ATOM    125  CA   GLN A  44      81.676 -23.615 262.191  1.00 34.67           C
ATOM    126  C    GLN A  44      82.470 -24.909 262.383  1.00 33.22           C
ATOM    127  O    GLN A  44      82.873 -25.232 263.501  1.00 33.62           O
ATOM    128  CB   GLN A  44      80.265 -23.904 261.757  1.00 35.04           C
ATOM    129  CG   GLN A  44      79.404 -24.416 262.891  1.00 36.14           C
ATOM    130  CD   GLN A  44      77.956 -24.020 262.716  1.00 36.10           C
ATOM    131  OE1  GLN A  44      77.609 -23.143 261.876  1.00 34.68           O
ATOM    132  NE2  GLN A  44      77.092 -24.661 263.495  1.00 34.30           N
ATOM    133  N    ALA A  45      82.721 -25.620 261.291  1.00 34.32           N
ATOM    134  CA   ALA A  45      83.615 -26.802 261.310  1.00 36.91           C
ATOM    135  C    ALA A  45      84.904 -26.545 262.128  1.00 37.37           C
ATOM    136  O    ALA A  45      85.236 -27.313 263.036  1.00 36.71           O
ATOM    137  CB   ALA A  45      83.966 -27.227 259.878  1.00 35.83           C
ATOM    138  N    LYS A  46      85.594 -25.444 261.819  1.00 35.99           N
ATOM    139  CA   LYS A  46      86.861 -25.088 262.481  1.00 36.22           C
ATOM    140  C    LYS A  46      86.717 -24.528 263.905  1.00 34.39           C
ATOM    141  O    LYS A  46      87.723 -24.369 264.608  1.00 31.80           O
ATOM    142  CB   LYS A  46      87.663 -24.088 261.635  1.00 36.10           C
ATOM    143  CG   LYS A  46      88.107 -24.633 260.298  1.00 39.60           C
ATOM    144  CD   LYS A  46      88.986 -23.643 259.543  1.00 42.91           C
ATOM    145  CE   LYS A  46      89.371 -24.190 258.167  1.00 46.23           C
ATOM    146  NZ   LYS A  46      90.774 -23.829 257.795  1.00 48.66           N
ATOM    147  N    GLN A  47      85.484 -24.236 264.322  1.00 34.84           N
ATOM    148  CA   GLN A  47      85.210 -23.633 265.642  1.00 35.20           C
ATOM    149  C    GLN A  47      85.967 -22.327 265.875  1.00 32.95           C
ATOM    150  O    GLN A  47      86.391 -22.019 266.994  1.00 33.01           O
ATOM    151  CB   GLN A  47      85.475 -24.621 266.792  1.00 36.80           C
ATOM    152  CG   GLN A  47      84.594 -25.864 266.758  1.00 39.66           C
ATOM    153  CD   GLN A  47      84.164 -26.315 268.150  1.00 44.07           C
ATOM    154  OE1  GLN A  47      84.988 -26.690 268.999  1.00 46.12           O
ATOM    155  NE2  GLN A  47      82.864 -26.268 268.393  1.00 44.03           N
ATOM    156  N    ALA A  48      86.096 -21.545 264.814  1.00 31.31           N
ATOM    157  CA   ALA A  48      86.786 -20.265 264.886  1.00 31.73           C
ATOM    158  C    ALA A  48      86.291 -19.340 263.771  1.00 32.70           C
ATOM    159  O    ALA A  48      86.092 -19.776 262.621  1.00 32.97           O
ATOM    160  CB   ALA A  48      88.292 -20.467 264.779  1.00 29.15           C
ATOM    161  N    VAL A  49      86.094 -18.072 264.118  1.00 31.12           N
ATOM    162  CA   VAL A  49      85.745 -17.052 263.133  1.00 30.30           C
ATOM    163  C    VAL A  49      86.964 -16.589 262.352  1.00 29.04           C
ATOM    164  O    VAL A  49      88.055 -16.602 262.865  1.00 27.73           O
ATOM    165  CB   VAL A  49      85.085 -15.811 263.772  1.00 30.61           C
ATOM    166  CG1  VAL A  49      83.767 -16.201 264.421  1.00 30.90           C
ATOM    167  CG2  VAL A  49      86.025 -15.117 264.773  1.00 30.30           C
ATOM    168  N    THR A  50      86.750 -16.131 261.123  1.00 29.56           N
ATOM    169  CA   THR A  50      87.833 -15.635 260.294  1.00 29.99           C
```

Appendix 2

```
ATOM    170  C   THR A  50      88.425 -14.387 260.928  1.00 28.41           C
ATOM    171  O   THR A  50      87.734 -13.716 261.673  1.00 28.81           O
ATOM    172  CB  THR A  50      87.336 -15.269 258.880  1.00 30.97           C
ATOM    173  OG1 THR A  50      86.351 -14.224 258.954  1.00 29.70           O
ATOM    174  CG2 THR A  50      86.761 -16.494 258.195  1.00 30.44           C
ATOM    175  N   PRO A  51      89.699 -14.079 260.647  1.00 27.48           N
ATOM    176  CA  PRO A  51      90.245 -12.839 261.227  1.00 27.68           C
ATOM    177  C   PRO A  51      89.448 -11.571 260.914  1.00 26.03           C
ATOM    178  O   PRO A  51      99.354 -10.716 261.781  1.00 25.58           O
ATOM    179  CB  PRO A  51      91.668 -12.769 260.658  1.00 26.46           C
ATOM    180  CG  PRO A  51      92.043 -14.204 260.491  1.00 27.31           C
ATOM    181  CD  PRO A  51      90.769 -14.957 260.146  1.00 27.35           C
ATOM    182  N   ASP A  52      88.853 -11.459 259.725  1.00 25.89           N
ATOM    183  CA  ASP A  52      88.026 -10.260 259.390  1.00 26.10           C
ATOM    184  C   ASP A  52      86.698 -10.160 260.202  1.00 27.16           C
ATOM    185  O   ASP A  52      86.287  -9.061 260.615  1.00 27.36           O
ATOM    186  CB  ASP A  52      87.766 -10.137 257.879  1.00 25.42           C
ATOM    187  CG  ASP A  52      87.016 -11.317 257.310  1.00 26.30           C
ATOM    188  OD1 ASP A  52      87.404 -12.471 257.596  1.00 28.11           O
ATOM    189  OD2 ASP A  52      86.030 -11.095 256.573  1.00 26.00           O
ATOM    190  N   VAL A  53      86.048 -11.302 260.438  1.00 26.63           N
ATOM    191  CA  VAL A  53      84.911 -11.368 261.344  1.00 26.18           C
ATOM    192  C   VAL A  53      85.369 -10.961 262.746  1.00 26.98           C
ATOM    193  O   VAL A  53      84.697 -10.169 263.432  1.00 28.51           O
ATOM    194  CB  VAL A  53      84.272 -12.781 261.356  1.00 26.30           C
ATOM    195  CG1 VAL A  53      83.381 -12.990 262.572  1.00 25.71           C
ATOM    196  CG2 VAL A  53      83.477 -13.049 260.075  1.00 25.22           C
ATOM    197  N   MET A  54      86.507 -11.490 263.190  1.00 26.17           N
ATOM    198  CA  MET A  54      87.024 -11.128 264.530  1.00 25.60           C
ATOM    199  C   MET A  54      87.267  -9.601 264.610  1.00 25.01           C
ATOM    200  O   MET A  54      86.984  -8.954 265.635  1.00 23.44           O
ATOM    201  CB  MET A  54      88.309 -11.892 264.846  1.00 24.87           C
ATOM    202  CG  MET A  54      88.902 -11.571 266.195  1.00 25.27           C
ATOM    203  SD  MET A  54      87.768 -11.809 267.576  1.00 27.99           S
ATOM    204  CE  MET A  54      88.360 -13.374 268.241  1.00 28.36           C
ATOM    205  N   ALA A  55      87.768  -9.052 263.505  1.00 24.25           N
ATOM    206  CA  ALA A  55      87.967  -7.626 263.370  1.00 25.02           C
ATOM    207  C   ALA A  55      86.655  -6.847 263.389  1.00 24.23           C
ATOM    208  O   ALA A  55      86.629  -5.723 263.879  1.00 24.74           O
ATOM    209  CB  ALA A  55      88.758  -7.302 262.108  1.00 25.42           C
ATOM    210  N   GLN A  56      85.579  -7.431 262.874  1.00 23.57           N
ATOM    211  CA  GLN A  56      84.274  -6.784 262.937  1.00 23.01           C
ATOM    212  C   GLN A  56      83.792  -6.761 264.384  1.00 23.29           C
ATOM    213  O   GLN A  56      83.218  -5.760 264.857  1.00 23.50           O
ATOM    214  CB  GLN A  56      83.262  -7.500 262.036  1.00 23.11           C
ATOM    215  CG  GLN A  56      81.802  -7.083 262.216  1.00 22.69           C
ATOM    216  CD  GLN A  56      81.539  -5.664 261.784  1.00 22.09           C
ATOM    217  OE1 GLN A  56      82.214  -5.150 260.908  1.00 23.08           O
ATOM    218  NE2 GLN A  56      80.543  -5.032 262.378  1.00 21.98           N
ATOM    219  N   LEU A  57      84.019  -7.857 265.097  1.00 23.06           N
ATOM    220  CA  LEU A  57      83.670  -7.882 266.510  1.00 22.67           C
ATOM    221  C   LEU A  57      84.455  -6.801 267.276  1.00 22.35           C
ATOM    222  O   LEU A  57      83.974  -6.252 268.273  1.00 22.45           O
ATOM    223  CB  LEU A  57      83.888  -9.270 267.095  1.00 22.65           C
```

Appendix 2

```
ATOM    224  CG   LEU A  57      82.880 -10.329 266.600  1.00 23.75           C
ATOM    225  CD1  LEU A  57      81.484 -10.118 267.160  1.00 23.06           C
ATOM    226  CD2  LEU A  57      83.362 -11.717 266.998  1.00 24.16           C
ATOM    227  N    ALA A  58      85.664  -6.500 266.817  1.00 21.14           N
ATOM    228  CA   ALA A  58      86.457  -5.463 267.446  1.00 20.43           C
ATOM    229  C    ALA A  58      85.901  -4.042 267.121  1.00 19.61           C
ATOM    230  O    ALA A  58      85.924  -3.173 267.970  1.00 18.27           O
ATOM    231  CB   ALA A  58      87.918  -5.597 267.039  1.00 19.71           C
ATOM    232  N    TYR A  59      85.389  -3.814 265.916  1.00 18.90           N
ATOM    233  CA   TYR A  59      84.729  -2.560 265.646  1.00 20.13           C
ATOM    234  C    TYR A  59      83.560  -2.442 266.608  1.00 20.68           C
ATOM    235  O    TYR A  59      83.315  -1.388 267.174  1.00 22.73           O
ATOM    236  CB   TYR A  59      84.245  -2.442 264.188  1.00 21.10           C
ATOM    237  CG   TYR A  59      83.186  -1.385 264.051  1.00 21.97           C
ATOM    238  CD1  TYR A  59      83.491  -0.012 264.194  1.00 23.06           C
ATOM    239  CD2  TYR A  59      81.859  -1.746 263.850  1.00 22.79           C
ATOM    240  CE1  TYR A  59      82.484   0.968 264.125  1.00 22.78           C
ATOM    241  CE2  TYR A  59      80.860  -0.789 263.758  1.00 23.31           C
ATOM    242  CZ   TYR A  59      81.156   0.555 263.913  1.00 23.00           C
ATOM    243  OH   TYR A  59      80.090   1.430 263.836  1.00 23.16           O
ATOM    244  N    MET A  60      82.874  -3.555 266.817  1.00 20.12           N
ATOM    245  CA   MET A  60      81.682  -3.586 267.607  1.00 19.92           C
ATOM    246  C    MET A  60      81.895  -3.395 269.094  1.00 19.92           C
ATOM    247  O    MET A  60      81.008  -2.884 269.771  1.00 19.74           O
ATOM    248  CB   MET A  60      80.970  -4.915 267.365  1.00 21.01           C
ATOM    249  CG   MET A  60      80.346  -4.993 265.978  1.00 20.43           C
ATOM    250  SD   MET A  60      79.899  -6.659 265.558  1.00 18.80           S
ATOM    251  CE   MET A  60      78.468  -6.962 266.564  1.00 19.11           C
ATOM    252  N    ASN A  61      83.057  -3.800 269.604  1.00 20.28           N
ATOM    253  CA   ASN A  61      83.297  -3.853 271.054  1.00 20.17           C
ATOM    254  C    ASN A  61      84.435  -3.041 271.632  1.00 19.62           C
ATOM    255  O    ASN A  61      84.464  -2.848 272.831  1.00 19.26           O
ATOM    256  CB   ASN A  61      83.524  -5.294 271.466  1.00 20.67           C
ATOM    257  CG   ASN A  61      82.253  -6.086 271.452  1.00 21.50           C
ATOM    258  OD1  ASN A  61      81.492  -6.091 272.431  1.00 21.80           O
ATOM    259  ND2  ASN A  61      81.992  -6.740 270.337  1.00 22.31           N
ATOM    260  N    TYR A  62      85.354  -2.549 270.807  1.00 20.03           N
ATOM    261  CA   TYR A  62      86.659  -2.134 271.325  1.00 20.57           C
ATOM    262  C    TYR A  62      86.730  -0.751 271.962  1.00 20.83           C
ATOM    263  O    TYR A  62      87.049  -0.654 273.118  1.00 21.64           O
ATOM    264  CB   TYR A  62      87.763  -2.277 270.257  1.00 20.87           C
ATOM    265  CG   TYR A  62      89.160  -2.353 270.852  1.00 21.15           C
ATOM    266  CD1  TYR A  62      89.835  -1.205 271.242  1.00 19.99           C
ATOM    267  CD2  TYR A  62      89.792  -3.581 271.032  1.00 21.99           C
ATOM    268  CE1  TYR A  62      91.090  -1.265 271.784  1.00 20.40           C
ATOM    269  CE2  TYR A  62      91.067  -3.655 271.580  1.00 22.54           C
ATOM    270  CZ   TYR A  62      91.712  -2.487 271.952  1.00 22.24           C
ATOM    271  OH   TYR A  62      92.966  -2.544 272.517  1.00 22.88           O
ATOM    272  N    ILE A  63      86.499   0.308 271.191  1.00 21.45           N
ATOM    273  CA   ILE A  63      86.787   1.660 271.636  1.00 21.11           C
ATOM    274  C    ILE A  63      85.738   2.126 272.623  1.00 21.65           C
ATOM    275  O    ILE A  63      84.551   2.036 272.323  1.00 22.40           O
ATOM    276  CB   ILE A  63      86.829   2.659 270.439  1.00 20.42           C
ATOM    277  CG1  ILE A  63      87.963   2.293 269.482  1.00 19.95           C
```

Appendix 2

```
ATOM    278  CG2 ILE A  63      87.038   4.102 270.910  1.00 19.19           C
ATOM    279  CD1 ILE A  63      87.875   2.979 268.128  1.00 19.73           C
ATOM    280  N   ASP A  64      86.194   2.644 273.770  1.00 22.17           N
ATOM    281  CA  ASP A  64      85.342   3.270 274.783  1.00 23.31           C
ATOM    282  C   ASP A  64      84.371   4.299 274.201  1.00 22.44           C
ATOM    283  O   ASP A  64      84.740   5.111 273.360  1.00 22.54           O
ATOM    284  CB  ASP A  64      86.197   3.949 275.866  1.00 25.69           C
ATOM    285  CG  ASP A  64      86.938   2.950 276.745  1.00 28.37           C
ATOM    286  OD1 ASP A  64      86.291   2.033 277.292  1.00 32.01           O
ATOM    287  OD2 ASP A  64      88.166   3.085 276.904  1.00 31.78           O
ATOM    288  N   PHE A  65      83.125   4.250 274.672  1.00 21.99           N
ATOM    289  CA  PHE A  65      82.064   5.233 274.360  1.00 20.29           C
ATOM    290  C   PHE A  65      81.477   5.179 272.956  1.00 19.77           C
ATOM    291  O   PHE A  65      80.296   5.457 272.799  1.00 19.88           O
ATOM    292  CB  PHE A  65      82.526   6.669 274.631  1.00 19.38           C
ATOM    293  CG  PHE A  65      83.219   6.349 275.950  1.00 19.45           C
ATOM    294  CD1 PHE A  65      82.688   6.298 277.125  1.00 19.12           C
ATOM    295  CD2 PHE A  65      84.412   7.583 276.034  1.00 18.85           C
ATOM    296  CE1 PHE A  65      83.326   6.476 278.343  1.00 18.62           C
ATOM    297  CE2 PHE A  65      85.053   7.740 277.250  1.00 18.47           C
ATOM    298  CZ  PHE A  65      84.513   7.184 278.407  1.00 18.32           C
ATOM    299  N   ILE A  66      82.280   4.883 271.934  1.00 19.89           N
ATOM    300  CA  ILE A  66      81.827   5.106 270.530  1.00 20.39           C
ATOM    301  C   ILE A  66      81.592   3.829 269.705  1.00 20.80           C
ATOM    302  O   ILE A  66      81.133   3.876 268.562  1.00 24.12           O
ATOM    303  CB  ILE A  66      82.750   6.088 269.731  1.00 19.26           C
ATOM    304  CG1 ILE A  66      84.122   5.491 269.487  1.00 19.43           C
ATOM    305  CG2 ILE A  66      82.863   7.446 270.415  1.00 18.11           C
ATOM    306  CD1 ILE A  66      84.741   5.968 268.193  1.00 19.68           C
ATOM    307  N   SER A  67      81.919   2.685 270.276  1.00 20.31           N
ATOM    308  CA  SER A  67      81.579   1.415 269.653  1.00 19.68           C
ATOM    309  C   SER A  67      80.108   1.081 269.958  1.00 20.82           C
ATOM    310  O   SER A  67      79.554   1.518 270.962  1.00 19.71           O
ATOM    311  CB  SER A  67      82.523   0.306 270.151  1.00 18.46           C
ATOM    312  OG  SER A  67      82.667   0.341 271.554  1.00 16.68           O
ATOM    313  N   PRO A  68      79.468   0.299 269.084  1.00 22.50           N
ATOM    314  CA  PRO A  68      78.041   0.109 269.302  1.00 23.45           C
ATOM    315  C   PRO A  68      77.735  -0.729 270.529  1.00 23.05           C
ATOM    316  O   PRO A  68      76.685  -0.554 271.119  1.00 23.89           O
ATOM    317  CB  PRO A  68      77.568  -0.565 268.013  1.00 22.81           C
ATOM    318  CG  PRO A  68      78.793  -1.234 267.468  1.00 22.62           C
ATOM    319  CD  PRO A  68      79.950  -0.375 267.870  1.00 22.30           C
ATOM    320  N   PHE A  69      78.638  -1.602 270.941  1.00 24.41           N
ATOM    321  CA  PHE A  69      78.326  -2.491 272.078  1.00 25.57           C
ATOM    322  C   PHE A  69      79.127  -2.193 273.351  1.00 24.20           C
ATOM    323  O   PHE A  69      79.442  -3.088 274.159  1.00 25.42           O
ATOM    324  CB  PHE A  69      78.394  -3.952 271.625  1.00 25.97           C
ATOM    325  CG  PHE A  69      77.306  -4.305 270.645  1.00 27.39           C
ATOM    326  CD1 PHE A  69      76.071  -4.771 271.096  1.00 28.12           C
ATOM    327  CD2 PHE A  69      77.493  -4.136 269.290  1.00 26.85           C
ATOM    328  CE1 PHE A  69      75.059  -5.078 270.202  1.00 28.91           C
ATOM    329  CE2 PHE A  69      76.481  -4.445 268.392  1.00 28.18           C
ATOM    330  CZ  PHE A  69      75.261  -4.910 268.846  1.00 28.08           C
ATOM    331  N   TYR A  70      79.397  -0.904 273.549  1.00 21.75           N
```

Appendix 2

```
ATOM    332  CA  TYR A  70      80.184  -0.456 274.676  1.00 20.27           C
ATOM    333  C   TYR A  70      79.435  -0.516 276.004  1.00 19.69           C
ATOM    334  O   TYR A  70      80.029  -0.684 277.043  1.00 19.70           O
ATOM    335  CB  TYR A  70      80.677   0.973 274.435  1.00 20.00           C
ATOM    336  CG  TYR A  70      81.312   1.561 275.673  1.00 19.61           C
ATOM    337  CD1 TYR A  70      82.572   1.119 276.110  1.00 19.02           C
ATOM    338  CD2 TYR A  70      80.633   2.501 276.431  1.00 18.94           C
ATOM    339  CE1 TYR A  70      83.154   1.621 277.250  1.00 19.28           C
ATOM    340  CE2 TYR A  70      81.202   3.021 277.576  1.00 20.91           C
ATOM    341  CZ  TYR A  70      82.465   2.575 277.994  1.00 21.46           C
ATOM    342  OH  TYR A  70      83.024   3.110 279.150  1.00 22.64           O
ATOM    343  N   SER A  71      78.127  -0.353 275.966  1.00 20.94           N
ATOM    344  CA  SER A  71      77.351  -0.075 277.158  1.00 20.84           C
ATOM    345  C   SER A  71      75.900  -0.392 276.901  1.00 22.27           C
ATOM    346  O   SER A  71      75.397  -0.196 275.800  1.00 20.81           O
ATOM    347  CB  SER A  71      77.469   1.396 277.492  1.00 20.39           C
ATOM    348  OG  SER A  71      76.450   1.785 278.371  1.00 20.97           O
ATOM    349  N   ARG A  72      75.211  -0.836 277.933  1.00 25.10           N
ATOM    350  CA  ARG A  72      73.769  -1.022 277.833  1.00 28.23           C
ATOM    351  C   ARG A  72      72.953   0.284 278.061  1.00 28.11           C
ATOM    352  O   ARG A  72      71.730   0.249 278.170  1.00 27.17           O
ATOM    353  CB  ARG A  72      73.320  -2.141 278.778  1.00 31.19           C
ATOM    354  CG  ARG A  72      73.638  -1.923 280.242  1.00 32.82           C
ATOM    355  CD  ARG A  72      72.872  -2.875 281.132  1.00 35.05           C
ATOM    356  NE  ARG A  72      73.305  -4.261 280.994  1.00 38.42           N
ATOM    357  CZ  ARG A  72      73.246  -5.176 281.973  1.00 43.78           C
ATOM    358  NH1 ARG A  72      73.652  -6.422 281.757  1.00 43.56           N
ATOM    359  NH2 ARG A  72      72.809  -4.853 283.191  1.00 45.08           N
ATOM    360  N   GLY A  73      73.620   1.433 278.110  1.00 28.09           N
ATOM    361  CA  GLY A  73      72.914   2.695 278.267  1.00 29.01           C
ATOM    362  C   GLY A  73      72.207   3.114 276.990  1.00 29.66           C
ATOM    363  O   GLY A  73      72.506   2.622 275.911  1.00 30.03           O
ATOM    364  N   CYS A  74      71.286   4.061 277.101  1.00 29.08           N
ATOM    365  CA  CYS A  74      70.661   4.669 275.910  1.00 26.68           C
ATOM    366  C   CYS A  74      71.567   5.709 275.252  1.00 25.11           C
ATOM    367  O   CYS A  74      71.238   6.872 275.114  1.00 25.57           O
ATOM    368  CB  CYS A  74      69.291   5.241 276.278  1.00 25.77           C
ATOM    369  SG  CYS A  74      68.145   3.893 276.712  1.00 25.03           S
ATOM    370  N   SER A  75      72.731   5.240 274.847  1.00 25.07           N
ATOM    371  CA  SER A  75      73.709   6.016 274.115  1.00 23.04           C
ATOM    372  C   SER A  75      73.899   5.479 272.677  1.00 21.76           C
ATOM    373  O   SER A  75      73.963   4.254 272.474  1.00 18.86           O
ATOM    374  CB  SER A  75      75.023   5.888 274.817  1.00 23.13           C
ATOM    375  OG  SER A  75      75.938   6.664 274.102  1.00 25.90           O
ATOM    376  N   PHE A  76      74.053   6.390 271.704  1.00 20.37           N
ATOM    377  CA  PHE A  76      74.000   6.004 270.294  1.00 19.75           C
ATOM    378  C   PHE A  76      75.094   6.588 269.384  1.00 20.39           C
ATOM    379  O   PHE A  76      74.972   6.610 268.157  1.00 18.20           O
ATOM    380  CB  PHE A  76      72.569   6.238 269.770  1.00 18.24           C
ATOM    381  CG  PHE A  76      71.575   5.297 270.371  1.00 17.22           C
ATOM    382  CD1 PHE A  76      71.489   3.968 269.923  1.00 16.43           C
ATOM    383  CD2 PHE A  76      70.779   5.685 271.438  1.00 16.83           C
ATOM    384  CE1 PHE A  76      70.601   3.075 270.518  1.00 15.90           C
ATOM    385  CE2 PHE A  76      69.895   4.781 272.033  1.00 16.40           C
```

Appendix 2

```
ATOM    386  CZ   PHE A  76      69.805   3.480 271.565  1.00 15.57           C
ATOM    387  N    GLU A  77      76.187   7.016 269.993  1.00 23.15           N
ATOM    388  CA   GLU A  77      77.326   7.552 269.238  1.00 25.20           C
ATOM    389  C    GLU A  77      77.691   6.674 268.041  1.00 23.95           C
ATOM    390  O    GLU A  77      77.943   7.178 266.955  1.00 24.32           O
ATOM    391  CB   GLU A  77      78.569   7.707 270.139  1.00 28.92           C
ATOM    392  CG   GLU A  77      78.652   9.010 270.953  1.00 33.08           C
ATOM    393  CD   GLU A  77      77.967   8.917 272.311  1.00 36.56           C
ATOM    394  OE1  GLU A  77      77.445   7.820 272.645  1.00 38.76           O
ATOM    395  OE2  GLU A  77      77.961   9.933 273.040  1.00 37.77           O
ATOM    396  N    ALA A  78      77.752   5.368 268.228  1.00 23.16           N
ATOM    397  CA   ALA A  78      78.202   4.508 267.136  1.00 24.28           C
ATOM    398  C    ALA A  78      77.367   4.780 265.893  1.00 24.27           C
ATOM    399  O    ALA A  78      77.861   4.839 264.773  1.00 22.73           O
ATOM    400  CB   ALA A  78      78.106   3.041 267.532  1.00 25.11           C
ATOM    401  N    TRP A  79      76.084   5.002 266.128  1.00 25.51           N
ATOM    402  CA   TRP A  79      75.126   5.249 265.064  1.00 24.47           C
ATOM    403  C    TRP A  79      75.131   6.692 264.539  1.00 24.99           C
ATOM    404  O    TRP A  79      75.015   6.902 263.325  1.00 28.40           O
ATOM    405  CB   TRP A  79      73.745   4.806 265.553  1.00 22.93           C
ATOM    406  CG   TRP A  79      73.651   3.294 265.686  1.00 21.00           C
ATOM    407  CD1  TRP A  79      73.261   2.415 264.709  1.00 19.82           C
ATOM    408  CD2  TRP A  79      73.944   2.498 266.849  1.00 19.10           C
ATOM    409  NE1  TRP A  79      73.288   1.138 265.198  1.00 19.53           N
ATOM    410  CE2  TRP A  79      73.699   1.156 266.505  1.00 19.01           C
ATOM    411  CE3  TRP A  79      74.370   2.791 268.150  1.00 18.48           C
ATOM    412  CZ2  TRP A  79      73.890   0.095 267.412  1.00 19.15           C
ATOM    413  CZ3  TRP A  79      74.535   1.741 269.055  1.00 18.65           C
ATOM    414  CH2  TRP A  79      74.305   0.406 268.677  1.00 18.51           C
ATOM    415  N    GLU A  80      75.288   7.676 265.417  1.00 24.37           N
ATOM    416  CA   GLU A  80      75.537   9.060 264.968  1.00 26.15           C
ATOM    417  C    GLU A  80      76.732   9.142 263.997  1.00 25.37           C
ATOM    418  O    GLU A  80      76.645   9.750 262.947  1.00 23.66           O
ATOM    419  CB   GLU A  80      75.783  10.023 266.160  1.00 28.28           C
ATOM    420  CG   GLU A  80      74.560  10.313 267.058  1.00 29.73           C
ATOM    421  CD   GLU A  80      74.917  10.601 268.543  1.00 32.63           C
ATOM    422  OE1  GLU A  80      75.988  11.219 268.821  1.00 30.73           O
ATOM    423  OE2  GLU A  80      74.116  10.205 269.442  1.00 31.90           O
ATOM    424  N    LEU A  81      77.843   8.508 264.348  1.00 26.58           N
ATOM    425  CA   LEU A  81      79.053   8.532 263.517  1.00 26.78           C
ATOM    426  C    LEU A  81      78.886   7.896 262.157  1.00 27.43           C
ATOM    427  O    LEU A  81      79.479   8.358 261.184  1.00 27.11           O
ATOM    428  CB   LEU A  81      80.193   7.829 264.241  1.00 28.13           C
ATOM    429  CG   LEU A  81      80.670   8.598 265.487  1.00 28.66           C
ATOM    430  CD1  LEU A  81      81.517   7.661 266.345  1.00 29.16           C
ATOM    431  CD2  LEU A  81      81.420   9.888 265.125  1.00 27.08           C
ATOM    432  N    LYS A  82      78.083   6.831 262.099  1.00 28.90           N
ATOM    433  CA   LYS A  82      77.683   6.199 260.819  1.00 28.63           C
ATOM    434  C    LYS A  82      76.593   6.954 260.052  1.00 27.16           C
ATOM    435  O    LYS A  82      76.295   6.607 258.933  1.00 24.90           O
ATOM    436  CB   LYS A  82      77.110   4.814 261.059  1.00 28.82           C
ATOM    437  CG   LYS A  82      78.090   3.725 261.390  1.00 29.56           C
ATOM    438  CD   LYS A  82      77.277   2.569 261.978  1.00 31.24           C
ATOM    439  CE   LYS A  82      77.552   1.240 261.302  1.00 31.33           C
```

Appendix 2

```
ATOM    440  NZ   LYS A  82      76.630   0.227 261.860  1.00 31.03           N
ATOM    441  N    HIS A  83      75.964   7.942 260.671  1.00 28.37           N
ATOM    442  CA   HIS A  83      74.812   8.641 260.070  1.00 30.23           C
ATOM    443  C    HIS A  83      73.643   7.691 259.801  1.00 27.57           C
ATOM    444  O    HIS A  83      72.888   7.912 258.861  1.00 26.88           O
ATOM    445  CB   HIS A  83      75.196   9.388 258.777  1.00 32.56           C
ATOM    446  CG   HIS A  83      76.436  10.217 258.902  1.00 36.75           C
ATOM    447  ND1  HIS A  83      76.433  11.478 259.463  1.00 38.07           N
ATOM    448  CD2  HIS A  83      77.721   9.960 258.550  1.00 37.79           C
ATOM    449  CE1  HIS A  83      77.661  11.966 259.447  1.00 38.43           C
ATOM    450  NE2  HIS A  83      78.461  11.062 258.904  1.00 39.53           N
ATOM    451  N    THR A  84      73.525   6.638 260.616  1.00 24.84           N
ATOM    452  CA   THR A  84      72.370   5.756 260.601  1.00 22.25           C
ATOM    453  C    THR A  84      71.143   6.596 260.902  1.00 22.00           C
ATOM    454  O    THR A  84      71.071   7.248 261.934  1.00 20.65           O
ATOM    455  CB   THR A  84      72.461   4.680 261.691  1.00 21.41           C
ATOM    456  OG1  THR A  84      73.536   3.808 261.401  1.00 20.47           O
ATOM    457  CG2  THR A  84      71.206   3.859 261.738  1.00 21.49           C
ATOM    458  N    PRO A  85      70.182   6.608 259.984  1.00 22.09           N
ATOM    459  CA   PRO A  85      68.922   7.295 260.245  1.00 21.38           C
ATOM    460  C    PRO A  85      68.137   6.661 261.390  1.00 20.31           C
ATOM    461  O    PRO A  85      68.034   5.440 261.491  1.00 19.55           O
ATOM    462  CB   PRO A  85      68.137   7.116 258.934  1.00 22.03           C
ATOM    463  CG   PRO A  85      69.138   6.707 257.904  1.00 21.99           C
ATOM    464  CD   PRO A  85      70.221   5.980 258.650  1.00 22.29           C
ATOM    465  N    GLN A  86      67.531   7.506 262.207  1.00 20.52           N
ATOM    466  CA   GLN A  86      66.707   7.058 263.326  1.00 20.53           C
ATOM    467  C    GLN A  86      65.876   5.825 263.027  1.00 21.40           C
ATOM    468  O    GLN A  86      65.930   4.863 263.783  1.00 22.76           O
ATOM    469  CB   GLN A  86      65.793   8.176 263.815  1.00 19.79           C
ATOM    470  CG   GLN A  86      65.082   7.844 265.125  1.00 20.09           C
ATOM    471  CD   GLN A  86      63.836   7.015 264.903  1.00 20.57           C
ATOM    472  OE1  GLN A  86      63.100   7.253 263.943  1.00 22.68           O
ATOM    473  NE2  GLN A  86      63.597   6.030 265.766  1.00 20.02           N
ATOM    474  N    ARG A  87      65.115   5.829 261.939  1.00 22.43           N
ATOM    475  CA   ARG A  87      64.163   4.732 261.696  1.00 22.66           C
ATOM    476  C    ARG A  87      64.841   3.383 261.486  1.00 23.57           C
ATOM    477  O    ARG A  87      64.209   2.336 261.624  1.00 25.20           O
ATOM    478  CB   ARG A  87      63.226   5.058 260.527  1.00 21.93           C
ATOM    479  CG   ARG A  87      62.306   6.238 260.823  1.00 21.90           C
ATOM    480  CD   ARG A  87      61.422   6.581 259.640  1.00 22.01           C
ATOM    481  NE   ARG A  87      60.722   7.839 259.853  1.00 22.39           N
ATOM    482  CZ   ARG A  87      59.528   7.975 260.433  1.00 23.53           C
ATOM    483  NH1  ARG A  87      58.840   6.926 260.866  1.00 23.90           N
ATOM    484  NH2  ARG A  87      59.001   9.179 260.566  1.00 23.33           N
ATOM    485  N    VAL A  88      66.138   3.404 261.203  1.00 23.50           N
ATOM    486  CA   VAL A  88      66.848   2.200 260.827  1.00 22.36           C
ATOM    487  C    VAL A  88      67.580   1.610 262.016  1.00 22.67           C
ATOM    488  O    VAL A  88      68.015   0.447 261.970  1.00 23.59           O
ATOM    489  CB   VAL A  88      67.808   2.540 259.675  1.00 23.49           C
ATOM    490  CG1  VAL A  88      68.893   1.505 259.498  1.00 24.22           C
ATOM    491  CG2  VAL A  88      67.009   2.701 258.405  1.00 23.77           C
ATOM    492  N    ILE A  89      67.685   2.367 263.109  1.00 22.07           N
ATOM    493  CA   ILE A  89      68.477   1.909 264.257  1.00 21.19           C
```

Appendix 2

```
ATOM    494  C    ILE A  89      68.016   0.548 264.772  1.00 20.92           C
ATOM    495  O    ILE A  89      68.837  -0.341 265.057  1.00 20.41           O
ATOM    496  CB   ILE A  89      68.520   2.939 265.388  1.00 21.55           C
ATOM    497  CG1  ILE A  89      69.181   4.243 264.894  1.00 21.77           C
ATOM    498  CG2  ILE A  89      69.327   2.378 266.556  1.00 22.17           C
ATOM    499  CD1  ILE A  89      69.208   5.364 265.907  1.00 21.86           C
ATOM    500  N    LYS A  90      66.707   0.361 264.864  1.00 20.94           N
ATOM    501  CA   LYS A  90      66.167  -0.938 265.313  1.00 20.71           C
ATOM    502  C    LYS A  90      66.634  -2.122 264.476  1.00 20.59           C
ATOM    503  O    LYS A  90      66.774  -3.227 265.003  1.00 19.38           O
ATOM    504  CB   LYS A  90      64.645  -0.918 265.323  1.00 21.38           C
ATOM    505  CG   LYS A  90      63.987  -0.467 264.010  1.00 21.42           C
ATOM    506  CD   LYS A  90      62.462  -0.533 264.082  1.00 21.34           C
ATOM    507  CE   LYS A  90      61.881   0.486 265.044  1.00 21.16           C
ATOM    508  NZ   LYS A  90      62.031   1.890 264.565  1.00 21.52           N
ATOM    509  N    TYR A  91      66.849  -1.905 263.176  1.00 21.79           N
ATOM    510  CA   TYR A  91      67.213  -3.016 262.278  1.00 23.65           C
ATOM    511  C    TYR A  91      68.680  -3.347 262.473  1.00 22.39           C
ATOM    512  O    TYR A  91      69.088  -4.517 262.485  1.00 21.49           O
ATOM    513  CB   TYR A  91      66.882  -2.708 260.799  1.00 25.44           C
ATOM    514  CG   TYR A  91      65.432  -2.371 260.613  1.00 28.09           C
ATOM    515  CD1  TYR A  91      64.453  -3.354 260.695  1.00 31.75           C
ATOM    516  CD2  TYR A  91      65.033  -1.068 260.425  1.00 28.92           C
ATOM    517  CE1  TYR A  91      63.114  -3.037 260.573  1.00 33.06           C
ATOM    518  CE2  TYR A  91      63.708  -0.737 260.306  1.00 30.43           C
ATOM    519  CZ   TYR A  91      62.751  -1.719 260.380  1.00 32.57           C
ATOM    520  OH   TYR A  91      61.425  -1.363 260.271  1.00 36.58           O
ATOM    521  N    SER A  92      69.452  -2.284 262.648  1.00 22.37           N
ATOM    522  CA   SER A  92      70.873  -2.376 262.871  1.00 20.98           C
ATOM    523  C    SER A  92      71.155  -3.202 264.094  1.00 20.09           C
ATOM    524  O    SER A  92      71.984  -4.091 264.038  1.00 19.52           O
ATOM    525  CB   SER A  92      71.471  -0.999 263.052  1.00 20.54           C
ATOM    526  OG   SER A  92      72.817  -1.141 263.434  1.00 20.60           O
ATOM    527  N    ILE A  93      70.443  -2.934 265.186  1.00 20.13           N
ATOM    528  CA   ILE A  93      70.651  -3.695 266.430  1.00 20.15           C
ATOM    529  C    ILE A  93      70.260  -5.151 266.168  1.00 20.28           C
ATOM    530  O    ILE A  93      71.008  -6.083 266.488  1.00 20.26           O
ATOM    531  CB   ILE A  93      69.870  -3.071 267.625  1.00 20.57           C
ATOM    532  CG1  ILE A  93      70.421  -1.684 267.953  1.00 21.54           C
ATOM    533  CG2  ILE A  93      70.042  -3.869 268.907  1.00 20.70           C
ATOM    534  CD1  ILE A  93      69.483  -0.801 268.753  1.00 21.94           C
ATOM    535  N    ALA A  94      69.106  -5.342 265.537  1.00 20.15           N
ATOM    536  CA   ALA A  94      68.554  -6.665 265.373  1.00 20.85           C
ATOM    537  C    ALA A  94      69.503  -7.537 264.554  1.00 22.27           C
ATOM    538  O    ALA A  94      69.862  -8.655 264.984  1.00 21.67           O
ATOM    539  CB   ALA A  94      67.181  -6.596 264.729  1.00 21.38           C
ATOM    540  N    PHE A  95      69.940  -7.028 263.397  1.00 21.85           N
ATOM    541  CA   PHE A  95      70.844  -7.800 262.573  1.00 21.57           C
ATOM    542  C    PHE A  95      72.189  -7.998 263.258  1.00 21.47           C
ATOM    543  O    PHE A  95      72.752  -9.100 263.195  1.00 21.00           O
ATOM    544  CB   PHE A  95      70.979  -7.190 261.180  1.00 23.51           C
ATOM    545  CG   PHE A  95      69.676  -7.161 260.425  1.00 24.24           C
ATOM    546  CD1  PHE A  95      68.901  -8.315 260.311  1.00 24.07           C
ATOM    547  CD2  PHE A  95      69.226  -6.005 259.856  1.00 24.48           C
```

Appendix 2

```
ATOM    548  CE1 PHE A  95      67.695  -8.302 259.657  1.00 24.98           C
ATOM    549  CE2 PHE A  95      68.019  -5.980 259.198  1.00 25.16           C
ATOM    550  CZ  PHE A  95      67.244  -7.122 259.110  1.00 25.27           C
ATOM    551  N   TYR A  96      72.689  -6.985 263.965  1.00 20.67           N
ATOM    552  CA  TYR A  96      73.860  -7.234 264.771  1.00 21.45           C
ATOM    553  C   TYR A  96      73.616  -8.477 265.634  1.00 23.01           C
ATOM    554  O   TYR A  96      74.354  -9.449 265.535  1.00 24.47           O
ATOM    555  CB  TYR A  96      74.240  -6.034 265.632  1.00 21.00           C
ATOM    556  CG  TYR A  96      75.132  -5.003 264.927  1.00 20.13           C
ATOM    557  CD1 TYR A  96      76.205  -5.402 264.127  1.00 18.80           C
ATOM    558  CD2 TYR A  96      74.927  -3.643 265.118  1.00 18.92           C
ATOM    559  CE1 TYR A  96      77.017  -4.487 263.525  1.00 18.40           C
ATOM    560  CE2 TYR A  96      75.724  -2.729 264.499  1.00 18.93           C
ATOM    561  CZ  TYR A  96      76.769  -3.156 263.704  1.00 19.35           C
ATOM    562  OH  TYR A  96      77.583  -2.229 263.086  1.00 20.93           O
ATOM    563  N   ALA A  97      72.534  -8.471 266.415  1.00 24.11           N
ATOM    564  CA  ALA A  97      72.171  -9.607 267.290  1.00 23.40           C
ATOM    565  C   ALA A  97      72.068 -10.986 266.609  1.00 23.35           C
ATOM    566  O   ALA A  97      72.480 -11.997 267.170  1.00 24.71           O
ATOM    567  CB  ALA A  97      70.875  -9.300 268.030  1.00 23.08           C
ATOM    568  N   TYR A  98      71.491 -11.053 265.423  1.00 23.13           N
ATOM    569  CA  TYR A  98      71.353 -12.335 264.752  1.00 21.65           C
ATOM    570  C   TYR A  98      72.759 -12.852 264.405  1.00 22.60           C
ATOM    571  O   TYR A  98      73.093 -14.037 264.627  1.00 24.31           O
ATOM    572  CB  TYR A  98      70.439 -12.186 263.529  1.00 21.77           C
ATOM    573  CG  TYR A  98      69.057 -11.563 263.856  1.00 21.04           C
ATOM    574  CD1 TYR A  98      68.489 -11.708 265.116  1.00 20.09           C
ATOM    575  CD2 TYR A  98      68.328 -10.840 262.901  1.00 20.66           C
ATOM    576  CE1 TYR A  98      67.261 -11.140 265.432  1.00 19.81           C
ATOM    577  CE2 TYR A  98      67.091 -10.266 263.219  1.00 20.54           C
ATOM    578  CZ  TYR A  98      66.564 -10.426 264.496  1.00 19.63           C
ATOM    579  OH  TYR A  98      65.344  -9.897 264.869  1.00 18.31           O
ATOM    580  N   GLY A  99      73.618 -11.951 263.943  1.00 21.72           N
ATOM    581  CA  GLY A  99      75.010 -12.284 263.751  1.00 21.25           C
ATOM    582  C   GLY A  99      75.623 -12.824 265.027  1.00 21.83           C
ATOM    583  O   GLY A  99      76.270 -13.899 265.032  1.00 21.61           O
ATOM    584  N   LEU A 100      75.419 -12.089 266.118  1.00 21.18           N
ATOM    585  CA  LEU A 100      76.026 -12.461 267.381  1.00 21.86           C
ATOM    586  C   LEU A 100      75.562 -13.835 267.850  1.00 23.43           C
ATOM    587  O   LEU A 100      76.305 -14.553 268.546  1.00 24.27           O
ATOM    588  CB  LEU A 100      75.749 -11.422 268.436  1.00 21.85           C
ATOM    589  CG  LEU A 100      76.491 -10.094 268.203  1.00 22.95           C
ATOM    590  CD1 LEU A 100      75.687  -8.941 268.791  1.00 22.94           C
ATOM    591  CD2 LEU A 100      77.915 -10.125 268.767  1.00 22.24           C
ATOM    592  N   ALA A 101      74.346 -14.206 267.460  1.00 23.37           N
ATOM    593  CA  ALA A 101      73.806 -15.514 267.801  1.00 23.43           C
ATOM    594  C   ALA A 101      74.613 -16.624 267.134  1.00 22.33           C
ATOM    595  O   ALA A 101      74.885 -17.642 267.737  1.00 21.35           O
ATOM    596  CB  ALA A 101      72.357 -15.597 267.375  1.00 23.46           C
ATOM    597  N   SER A 102      74.990 -16.399 265.887  1.00 22.16           N
ATOM    598  CA  SER A 102      75.704 -17.377 265.115  1.00 21.39           C
ATOM    599  C   SER A 102      77.138 -17.451 265.553  1.00 21.82           C
ATOM    600  O   SER A 102      77.720 -18.547 265.553  1.00 22.20           O
ATOM    601  CB  SER A 102      75.593 -17.055 263.636  1.00 21.90           C
```

Appendix 2

```
ATOM    602  OG  SER A 102      74.299 -17.412 263.160  1.00 22.26           O
ATOM    603  N   VAL A 103      77.692 -16.311 265.991  1.00 22.22           N
ATOM    604  CA  VAL A 103      79.046 -16.283 266.582  1.00 20.98           C
ATOM    605  C   VAL A 103      79.107 -17.177 267.804  1.00 20.73           C
ATOM    606  O   VAL A 103      80.110 -17.848 268.034  1.00 21.53           O
ATOM    607  CB  VAL A 103      79.533 -14.848 266.907  1.00 20.78           C
ATOM    608  CG1 VAL A 103      80.765 -14.832 267.811  1.00 20.36           C
ATOM    609  CG2 VAL A 103      79.892 -14.127 265.630  1.00 21.50           C
ATOM    610  N   ALA A 104      78.033 -17.206 268.577  1.00 20.64           N
ATOM    611  CA  ALA A 104      77.928 -18.119 269.702  1.00 21.58           C
ATOM    612  C   ALA A 104      78.012 -19.574 269.280  1.00 23.94           C
ATOM    613  O   ALA A 104      78.551 -20.398 269.993  1.00 24.29           O
ATOM    614  CB  ALA A 104      76.619 -17.901 270.411  1.00 21.82           C
ATOM    615  N   LEU A 105      77.423 -19.899 268.138  1.00 27.26           N
ATOM    616  CA  LEU A 105      77.475 -21.258 267.625  1.00 28.90           C
ATOM    617  C   LEU A 105      78.851 -21.613 267.056  1.00 30.39           C
ATOM    618  O   LEU A 105      79.304 -22.742 267.161  1.00 29.19           O
ATOM    619  CB  LEU A 105      76.430 -21.442 266.534  1.00 29.75           C
ATOM    620  CG  LEU A 105      75.187 -22.225 266.899  1.00 29.80           C
ATOM    621  CD1 LEU A 105      74.312 -22.404 265.667  1.00 28.80           C
ATOM    622  CD2 LEU A 105      75.585 -23.570 267.471  1.00 30.98           C
ATOM    623  N   ILE A 106      79.506 -20.641 266.437  1.00 31.24           N
ATOM    624  CA  ILE A 106      80.776 -20.887 265.776  1.00 31.74           C
ATOM    625  C   ILE A 106      81.929 -21.128 266.744  1.00 32.49           C
ATOM    626  O   ILE A 106      82.739 -21.989 266.473  1.00 35.62           O
ATOM    627  CB  ILE A 106      81.155 -19.720 264.841  1.00 32.46           C
ATOM    628  CG1 ILE A 106      80.232 -19.714 263.615  1.00 32.83           C
ATOM    629  CG2 ILE A 106      82.635 -19.777 264.439  1.00 32.07           C
ATOM    630  CD1 ILE A 106      80.311 -18.424 262.818  1.00 33.37           C
ATOM    631  N   ASP A 107      82.037 -20.368 267.833  1.00 31.98           N
ATOM    632  CA  ASP A 107      83.245 -20.418 268.668  1.00 31.79           C
ATOM    633  C   ASP A 107      82.856 -20.388 270.138  1.00 32.27           C
ATOM    634  O   ASP A 107      82.507 -19.341 270.665  1.00 32.40           O
ATOM    635  CB  ASP A 107      84.200 -19.267 268.300  1.00 31.02           C
ATOM    636  CG  ASP A 107      85.563 -19.344 269.014  1.00 31.61           C
ATOM    637  OD1 ASP A 107      85.727 -20.130 269.995  1.00 31.76           O
ATOM    638  OD2 ASP A 107      86.470 -18.578 268.587  1.00 30.39           O
ATOM    639  N   PRO A 108      82.914 -21.550 270.806  1.00 32.48           N
ATOM    640  CA  PRO A 108      82.479 -21.594 272.197  1.00 32.20           C
ATOM    641  C   PRO A 108      83.198 -20.605 273.087  1.00 31.39           C
ATOM    642  O   PRO A 108      82.577 -20.037 273.987  1.00 33.31           O
ATOM    643  CB  PRO A 108      82.793 -23.039 272.622  1.00 32.63           C
ATOM    644  CG  PRO A 108      82.740 -23.824 271.352  1.00 32.36           C
ATOM    645  CD  PRO A 108      83.233 -22.892 270.274  1.00 32.11           C
ATOM    646  N   LYS A 109      84.487 -20.392 272.833  1.00 30.50           N
ATOM    647  CA  LYS A 109      85.280 -19.372 273.556  1.00 29.81           C
ATOM    648  C   LYS A 109      84.770 -17.900 273.351  1.00 30.90           C
ATOM    649  O   LYS A 109      85.189 -16.992 274.065  1.00 31.17           O
ATOM    650  CB  LYS A 109      86.770 -19.498 273.174  1.00 27.91           C
ATOM    651  N   LEU A 110      83.878 -17.665 272.383  1.00 30.56           N
ATOM    652  CA  LEU A 110      83.349 -16.326 272.099  1.00 29.50           C
ATOM    653  C   LEU A 110      81.892 -16.158 272.514  1.00 28.78           C
ATOM    654  O   LEU A 110      81.256 -15.136 272.222  1.00 28.88           O
ATOM    655  CB  LEU A 110      83.439 -16.052 270.603  1.00 29.21           C
```

Appendix 2

```
ATOM    656  CG   LEU A 110      84.812 -15.733 270.036  1.00 28.47           C
ATOM    657  CD1  LEU A 110      84.662 -15.202 268.628  1.00 26.97           C
ATOM    658  CD2  LEU A 110      85.529 -14.717 270.895  1.00 28.70           C
ATOM    659  N    ARG A 111      81.374 -17.178 273.179  1.00 27.04           N
ATOM    660  CA   ARG A 111      79.965 -17.288 273.450  1.00 27.25           C
ATOM    661  C    ARG A 111      79.606 -16.358 274.578  1.00 26.95           C
ATOM    662  O    ARG A 111      78.645 -15.598 274.491  1.00 30.22           O
ATOM    663  CB   ARG A 111      79.603 -18.743 273.793  1.00 26.97           C
ATOM    664  CG   ARG A 111      78.185 -18.948 274.270  1.00 25.81           C
ATOM    665  CD   ARG A 111      77.687 -20.346 273.956  1.00 25.08           C
ATOM    666  NE   ARG A 111      76.268 -20.526 274.288  1.00 24.84           N
ATOM    667  CZ   ARG A 111      75.521 -21.572 273.919  1.00 24.85           C
ATOM    668  NH1  ARG A 111      76.025 -22.576 273.208  1.00 22.81           N
ATOM    669  NH2  ARG A 111      74.241 -21.613 274.264  1.00 26.22           N
ATOM    670  N    ALA A 112      80.398 -16.401 275.632  1.00 26.40           N
ATOM    671  CA   ALA A 112      80.258 -15.449 276.705  1.00 25.95           C
ATOM    672  C    ALA A 112      80.185 -13.972 276.185  1.00 26.15           C
ATOM    673  O    ALA A 112      79.282 -13.196 276.584  1.00 24.42           O
ATOM    674  CB   ALA A 112      81.400 -15.643 277.669  1.00 25.21           C
ATOM    675  N    LEU A 113      81.106 -13.615 275.285  1.00 24.93           N
ATOM    676  CA   LEU A 113      81.131 -12.286 274.661  1.00 24.91           C
ATOM    677  C    LEU A 113      79.878 -11.998 273.852  1.00 24.66           C
ATOM    678  O    LEU A 113      79.304 -10.919 273.966  1.00 24.83           O
ATOM    679  CB   LEU A 113      82.338 -12.149 273.734  1.00 26.19           C
ATOM    680  CG   LEU A 113      82.444 -10.858 272.915  1.00 28.32           C
ATOM    681  CD1  LEU A 113      82.697  -9.681 273.836  1.00 29.94           C
ATOM    682  CD2  LEU A 113      83.526 -10.901 271.842  1.00 29.10           C
ATOM    683  N    ALA A 114      79.460 -12.943 273.016  1.00 23.63           N
ATOM    684  CA   ALA A 114      78.258 -12.740 272.223  1.00 22.89           C
ATOM    685  C    ALA A 114      77.035 -12.542 273.133  1.00 22.75           C
ATOM    686  O    ALA A 114      76.156 -11.700 272.873  1.00 21.31           O
ATOM    687  CB   ALA A 114      78.057 -13.916 271.293  1.00 23.58           C
ATOM    688  N    GLY A 115      77.000 -13.299 274.225  1.00 21.76           N
ATOM    689  CA   GLY A 115      75.943 -13.165 275.190  1.00 21.36           C
ATOM    690  C    GLY A 115      75.883 -11.748 275.698  1.00 22.17           C
ATOM    691  O    GLY A 115      74.818 -11.103 275.699  1.00 22.85           O
ATOM    692  N    HIS A 116      77.049 -11.251 276.112  1.00 22.82           N
ATOM    693  CA   HIS A 116      77.188  -9.884 276.644  1.00 20.58           C
ATOM    694  C    HIS A 116      76.750  -8.865 275.602  1.00 19.33           C
ATOM    695  O    HIS A 116      75.958  -8.001 275.865  1.00 19.47           O
ATOM    696  CB   HIS A 116      78.627  -9.634 277.108  1.00 20.14           C
ATOM    697  CG   HIS A 116      78.892  -8.215 277.476  1.00 19.97           C
ATOM    698  ND1  HIS A 116      79.627  -7.368 276.674  1.00 19.51           N
ATOM    699  CD2  HIS A 116      78.462  -7.473 278.520  1.00 19.51           C
ATOM    700  CE1  HIS A 116      79.661  -6.169 277.218  1.00 19.53           C
ATOM    701  NE2  HIS A 116      78.961  -6.206 278.336  1.00 19.78           N
ATOM    702  N    ASP A 117      77.241  -8.985 274.397  1.00 19.64           N
ATOM    703  CA   ASP A 117      76.772  -8.113 273.323  1.00 20.46           C
ATOM    704  C    ASP A 117      75.276  -8.203 273.076  1.00 21.36           C
ATOM    705  O    ASP A 117      74.687  -7.220 272.656  1.00 21.93           O
ATOM    706  CB   ASP A 117      77.497  -8.419 272.007  1.00 20.30           C
ATOM    707  CG   ASP A 117      78.920  -7.901 271.997  1.00 20.77           C
ATOM    708  OD1  ASP A 117      79.339  -7.318 273.038  1.00 22.65           O
ATOM    709  OD2  ASP A 117      79.612  -8.058 270.963  1.00 19.13           O
```

Appendix 2

```
ATOM    710  N    LEU A 118      74.666   -9.372 273.289  1.00 22.05           N
ATOM    711  CA   LEU A 118      73.218   -9.506 273.090  1.00 21.53           C
ATOM    712  C    LEU A 118      72.435   -8.853 274.224  1.00 21.29           C
ATOM    713  O    LEU A 118      71.394   -8.271 274.002  1.00 22.00           O
ATOM    714  CB   LEU A 118      72.820  -10.963 272.984  1.00 21.52           C
ATOM    715  CG   LEU A 118      73.144  -11.637 271.663  1.00 20.79           C
ATOM    716  CD1  LEU A 118      72.989  -13.129 271.841  1.00 20.36           C
ATOM    717  CD2  LEU A 118      72.237  -11.159 270.555  1.00 20.97           C
ATOM    718  N    ASP A 119      72.942   -8.955 275.442  1.00 21.32           N
ATOM    719  CA   ASP A 119      72.386   -8.210 276.571  1.00 21.77           C
ATOM    720  C    ASP A 119      72.243   -6.718 276.245  1.00 21.29           C
ATOM    721  O    ASP A 119      71.223   -6.086 276.516  1.00 20.93           O
ATOM    722  CB   ASP A 119      73.333   -8.364 277.748  1.00 23.25           C
ATOM    723  CG   ASP A 119      72.704   -8.038 279.062  1.00 24.88           C
ATOM    724  OD1  ASP A 119      71.490   -7.725 279.146  1.00 26.93           O
ATOM    725  OD2  ASP A 119      73.449   -8.131 280.040  1.00 27.15           O
ATOM    726  N    ILE A 120      73.284   -6.179 275.634  1.00 20.82           N
ATOM    727  CA   ILE A 120      73.363   -4.773 275.290  1.00 20.64           C
ATOM    728  C    ILE A 120      72.425   -4.409 274.169  1.00 19.73           C
ATOM    729  O    ILE A 120      71.837   -3.311 274.163  1.00 18.99           O
ATOM    730  CB   ILE A 120      74.811   -4.392 274.945  1.00 20.55           C
ATOM    731  CG1  ILE A 120      75.585   -4.253 276.281  1.00 21.33           C
ATOM    732  CG2  ILE A 120      74.844   -3.115 274.117  1.00 19.93           C
ATOM    733  CD1  ILE A 120      77.086   -4.215 276.164  1.00 21.90           C
ATOM    734  N    ALA A 121      72.274   -5.351 273.243  1.00 18.72           N
ATOM    735  CA   ALA A 121      71.413   -5.173 272.094  1.00 17.81           C
ATOM    736  C    ALA A 121      70.005   -5.045 272.582  1.00 17.61           C
ATOM    737  O    ALA A 121      69.282   -4.164 272.167  1.00 17.82           O
ATOM    738  CB   ALA A 121      71.522   -6.357 271.164  1.00 18.23           C
ATOM    739  N    VAL A 122      69.613   -5.923 273.486  1.00 18.03           N
ATOM    740  CA   VAL A 122      68.259   -5.861 274.020  1.00 18.54           C
ATOM    741  C    VAL A 122      68.027   -4.545 274.772  1.00 19.74           C
ATOM    742  O    VAL A 122      67.091   -3.802 274.441  1.00 20.39           O
ATOM    743  CB   VAL A 122      67.959   -7.076 274.901  1.00 17.87           C
ATOM    744  CG1  VAL A 122      66.570   -6.939 275.526  1.00 17.68           C
ATOM    745  CG2  VAL A 122      68.118   -8.365 274.089  1.00 16.76           C
ATOM    746  N    SER A 123      68.898   -4.216 275.732  1.00 20.39           N
ATOM    747  CA   SER A 123      68.788   -2.923 276.414  1.00 21.41           C
ATOM    748  C    SER A 123      68.711   -1.791 275.429  1.00 21.92           C
ATOM    749  O    SER A 123      67.831   -0.965 275.561  1.00 24.60           O
ATOM    750  CB   SER A 123      69.938   -2.625 277.363  1.00 21.01           C
ATOM    751  OG   SER A 123      70.395   -3.818 277.913  1.00 22.13           O
ATOM    752  N    LYS A 124      69.596   -1.744 274.435  1.00 20.95           N
ATOM    753  CA   LYS A 124      69.588   -0.582 273.547  1.00 20.53           C
ATOM    754  C    LYS A 124      68.294   -0.540 272.742  1.00 20.54           C
ATOM    755  O    LYS A 124      67.749    0.534 272.439  1.00 20.08           O
ATOM    756  CB   LYS A 124      70.793   -0.563 272.623  1.00 19.76           C
ATOM    757  CG   LYS A 124      72.093   -0.211 273.315  1.00 19.38           C
ATOM    758  CD   LYS A 124      73.132    0.210 272.286  1.00 19.12           C
ATOM    759  CE   LYS A 124      74.399    0.720 272.909  1.00 18.64           C
ATOM    760  NZ   LYS A 124      74.195    1.736 273.960  1.00 18.79           N
ATOM    761  N    MET A 125      67.790   -1.719 272.423  1.00 19.84           N
ATOM    762  CA   MET A 125      66.608   -1.834 271.584  1.00 20.12           C
ATOM    763  C    MET A 125      65.378   -1.274 272.319  1.00 21.91           C
```

Appendix 2

```
ATOM    764  O    MET A 125      64.439   -0.800  271.685  1.00  23.07           O
ATOM    765  CB   MET A 125      66.404   -3.309  271.214  1.00  18.59           C
ATOM    766  CG   MET A 125      65.302   -3.587  270.240  1.00  17.52           C
ATOM    767  SD   MET A 125      65.806   -3.196  268.570  1.00  15.82           S
ATOM    768  CE   MET A 125      64.731   -4.312  267.705  1.00  16.32           C
ATOM    769  N    LYS A 126      65.380   -1.314  273.647  1.00  22.55           N
ATOM    770  CA   LYS A 126      64.232   -0.810  274.412  1.00  22.80           C
ATOM    771  C    LYS A 126      64.264    0.689  274.627  1.00  22.13           C
ATOM    772  O    LYS A 126      63.288    1.230  275.115  1.00  20.97           O
ATOM    773  CB   LYS A 126      64.145   -1.480  275.790  1.00  24.08           C
ATOM    774  CG   LYS A 126      64.057   -2.997  275.718  1.00  26.12           C
ATOM    775  CD   LYS A 126      64.354   -3.645  277.060  1.00  27.47           C
ATOM    776  CE   LYS A 126      63.224   -3.339  278.026  1.00  29.74           C
ATOM    777  NZ   LYS A 126      63.093   -4.434  279.021  1.00  31.59           N
ATOM    778  N    CYS A 127      65.378    1.351  274.306  1.00  22.63           N
ATOM    779  CA   CYS A 127      65.505    2.820  274.469  1.00  23.19           C
ATOM    780  C    CYS A 127      64.545    3.554  273.568  1.00  23.65           C
ATOM    781  O    CYS A 127      64.301    3.115  272.448  1.00  22.81           O
ATOM    782  CB   CYS A 127      66.901    3.312  274.088  1.00  23.37           C
ATOM    783  SG   CYS A 127      68.177    2.631  275.144  1.00  23.36           S
ATOM    784  N    LYS A 128      64.047    4.699  274.035  1.00  24.79           N
ATOM    785  CA   LYS A 128      63.085    5.489  273.276  1.00  25.39           C
ATOM    786  C    LYS A 128      63.649    6.091  271.982  1.00  23.44           C
ATOM    787  O    LYS A 128      62.934    6.214  270.997  1.00  22.39           O
ATOM    788  CB   LYS A 128      62.510    6.583  274.145  1.00  28.55           C
ATOM    789  CG   LYS A 128      61.498    7.454  273.430  1.00  31.34           C
ATOM    790  CD   LYS A 128      60.456    7.921  274.408  1.00  33.81           C
ATOM    791  CE   LYS A 128      59.562    8.962  273.777  1.00  36.06           C
ATOM    792  NZ   LYS A 128      58.586    9.439  274.794  1.00  38.15           N
ATOM    793  N    ARG A 129      64.918    6.460  271.968  1.00  22.75           N
ATOM    794  CA   ARG A 129      65.562    6.849  270.702  1.00  23.97           C
ATOM    795  C    ARG A 129      65.293    5.829  269.569  1.00  23.01           C
ATOM    796  O    ARG A 129      65.214    6.214  268.420  1.00  21.98           O
ATOM    797  CB   ARG A 129      67.073    7.045  270.896  1.00  24.83           C
ATOM    798  CG   ARG A 129      67.892    7.233  269.622  1.00  26.03           C
ATOM    799  CD   ARG A 129      67.290    8.344  268.779  1.00  27.15           C
ATOM    800  NE   ARG A 129      68.110    8.703  267.628  1.00  28.13           N
ATOM    801  CZ   ARG A 129      67.823    9.688  266.771  1.00  27.42           C
ATOM    802  NH1  ARG A 129      66.726   10.435  266.898  1.00  26.36           N
ATOM    803  NH2  ARG A 129      68.654    9.932  265.778  1.00  28.27           N
ATOM    804  N    VAL A 130      65.131    4.548  269.910  1.00  22.55           N
ATOM    805  CA   VAL A 130      64.929    3.485  268.926  1.00  21.42           C
ATOM    806  C    VAL A 130      63.478    3.245  268.512  1.00  20.97           C
ATOM    807  O    VAL A 130      63.198    3.168  267.316  1.00  20.50           O
ATOM    808  CB   VAL A 130      65.540    2.171  269.411  1.00  21.56           C
ATOM    809  CG1  VAL A 130      65.458    1.103  268.321  1.00  21.63           C
ATOM    810  CG2  VAL A 130      66.990    2.416  269.801  1.00  22.86           C
ATOM    811  N    TRP A 131      62.566    3.086  269.466  1.00  20.77           N
ATOM    812  CA   TRP A 131      61.147    2.875  269.111  1.00  22.07           C
ATOM    813  C    TRP A 131      60.324    4.155  268.929  1.00  23.57           C
ATOM    814  O    TRP A 131      59.204    4.088  268.444  1.00  25.64           O
ATOM    815  CB   TRP A 131      60.448    1.965  270.125  1.00  22.09           C
ATOM    816  CG   TRP A 131      60.465    2.442  271.563  1.00  22.01           C
ATOM    817  CD1  TRP A 131      61.356    2.077  272.545  1.00  21.03           C
```

Appendix 2

```
ATOM    818  CD2 TRP A 131      59.528    3.324 272.186  1.00 21.83           C
ATOM    819  NE1 TRP A 131      61.047    2.701 273.713  1.00 21.00           N
ATOM    820  CE2 TRP A 131      59.923    3.467 273.529  1.00 21.72           C
ATOM    821  CE3 TRP A 131      58.395    4.014 271.737  1.00 22.43           C
ATOM    822  CZ2 TRP A 131      59.236    4.291 274.431  1.00 22.08           C
ATOM    823  CZ3 TRP A 131      57.703    4.842 272.646  1.00 22.23           C
ATOM    824  CH2 TRP A 131      58.133    4.967 273.972  1.00 21.97           C
ATOM    825  N   GLY A 132      60.894    5.305 269.294  1.00 24.30           N
ATOM    826  CA  GLY A 132      60.173    6.578 269.404  1.00 23.57           C
ATOM    827  C   GLY A 132      59.465    7.077 268.171  1.00 23.95           C
ATOM    828  O   GLY A 132      58.470    7.780 268.280  1.00 24.66           O
ATOM    829  N   ASP A 133      59.972    6.740 266.991  1.00 24.89           N
ATOM    830  CA  ASP A 133      59.236    7.025 265.753  1.00 24.61           C
ATOM    831  C   ASP A 133      57.747    6.607 265.865  1.00 24.36           C
ATOM    832  O   ASP A 133      56.857    7.294 265.341  1.00 25.17           O
ATOM    833  CB  ASP A 133      59.891    6.355 264.534  1.00 24.32           C
ATOM    834  CG  ASP A 133      59.971    4.812 264.649  1.00 24.88           C
ATOM    835  OD1 ASP A 133      60.938    4.291 265.258  1.00 25.98           O
ATOM    836  OD2 ASP A 133      59.093    4.102 264.112  1.00 25.61           O
ATOM    837  N   TRP A 134      57.474    5.494 266.543  1.00 23.23           N
ATOM    838  CA  TRP A 134      56.082    5.085 266.803  1.00 24.01           C
ATOM    839  C   TRP A 134      55.231    6.197 267.440  1.00 24.56           C
ATOM    840  O   TRP A 134      54.096    6.425 267.038  1.00 24.61           O
ATOM    841  CB  TRP A 134      56.045    3.842 267.695  1.00 22.73           C
ATOM    842  CG  TRP A 134      54.696    3.217 267.766  1.00 21.89           C
ATOM    843  CD1 TRP A 134      53.857    3.198 268.837  1.00 21.39           C
ATOM    844  CD2 TRP A 134      54.029    2.509 266.721  1.00 21.32           C
ATOM    845  NE1 TRP A 134      52.704    2.525 268.529  1.00 20.55           N
ATOM    846  CE2 TRP A 134      52.777    2.089 267.238  1.00 20.16           C
ATOM    847  CE3 TRP A 134      54.367    2.186 265.399  1.00 21.04           C
ATOM    848  CZ2 TRP A 134      51.852    1.381 266.487  1.00 20.02           C
ATOM    849  CZ3 TRP A 134      53.434    1.483 264.633  1.00 21.14           C
ATOM    850  CH2 TRP A 134      52.185    1.088 265.190  1.00 21.22           C
ATOM    851  N   GLU A 135      55.794    6.870 268.436  1.00 25.86           N
ATOM    852  CA  GLU A 135      55.120    7.961 269.117  1.00 28.00           C
ATOM    853  C   GLU A 135      55.125    9.243 268.301  1.00 28.89           C
ATOM    854  O   GLU A 135      54.115    9.941 268.259  1.00 28.19           O
ATOM    855  CB  GLU A 135      55.787    8.227 270.467  1.00 28.48           C
ATOM    856  CG  GLU A 135      55.090    9.271 271.327  1.00 28.45           C
ATOM    857  CD  GLU A 135      55.638    9.302 272.741  1.00 29.93           C
ATOM    858  OE1 GLU A 135      56.013    8.229 273.249  1.00 31.58           O
ATOM    859  OE2 GLU A 135      55.686   10.383 273.364  1.00 31.18           O
ATOM    860  N   GLU A 136      56.267    9.559 267.691  1.00 30.28           N
ATOM    861  CA  GLU A 136      56.442   10.808 266.956  1.00 32.60           C
ATOM    862  C   GLU A 136      55.488   10.871 265.763  1.00 30.49           C
ATOM    863  O   GLU A 136      54.995   11.929 265.404  1.00 29.17           O
ATOM    864  CB  GLU A 136      57.884   10.936 266.467  1.00 37.85           C
ATOM    865  CG  GLU A 136      58.506   12.301 266.700  1.00 43.29           C
ATOM    866  CD  GLU A 136      59.302   12.362 268.000  1.00 49.70           C
ATOM    867  OE1 GLU A 136      59.118   13.346 268.763  1.00 53.72           O
ATOM    868  OE2 GLU A 136      60.110   11.433 268.259  1.00 49.21           O
ATOM    869  N   ASP A 137      55.240    9.718 265.152  1.00 30.51           N
ATOM    870  CA  ASP A 137      54.334    9.598 264.006  1.00 28.85           C
ATOM    871  C   ASP A 137      52.855    9.665 264.411  1.00 29.54           C
```

Appendix 2

```
ATOM    872  O   ASP A 137      51.992   9.823 263.562  1.00 31.68           O
ATOM    873  CB  ASP A 137      54.595   8.273 263.274  1.00 27.74           C
ATOM    874  CG  ASP A 137      55.935   8.248 262.544  1.00 28.06           C
ATOM    875  OD1 ASP A 137      56.517   9.315 262.348  1.00 28.06           O
ATOM    876  OD2 ASP A 137      56.402   7.161 262.138  1.00 28.21           O
ATOM    877  N   GLY A 138      52.562   9.508 265.696  1.00 29.11           N
ATOM    878  CA  GLY A 138      51.205   9.635 266.215  1.00 28.05           C
ATOM    879  C   GLY A 138      50.457   8.323 266.384  1.00 27.37           C
ATOM    880  O   GLY A 138      49.257   8.332 266.548  1.00 26.39           O
ATOM    881  N   PHE A 139      51.147   7.190 266.354  1.00 27.13           N
ATOM    882  CA  PHE A 139      50.460   5.887 266.459  1.00 26.24           C
ATOM    883  C   PHE A 139      50.193   5.393 267.872  1.00 25.51           C
ATOM    884  O   PHE A 139      49.420   4.476 268.024  1.00 25.83           O
ATOM    885  CB  PHE A 139      51.239   4.792 265.733  1.00 25.68           C
ATOM    886  CG  PHE A 139      51.510   5.105 264.305  1.00 26.09           C
ATOM    887  CD1 PHE A 139      50.463   5.362 263.431  1.00 25.77           C
ATOM    888  CD2 PHE A 139      52.818   5.157 263.822  1.00 25.57           C
ATOM    889  CE1 PHE A 139      50.717   5.690 262.112  1.00 25.61           C
ATOM    890  CE2 PHE A 139      53.078   5.473 262.500  1.00 24.04           C
ATOM    891  CZ  PHE A 139      52.032   5.719 261.643  1.00 25.11           C
ATOM    892  N   GLY A 140      50.852   5.950 268.886  1.00 25.08           N
ATOM    893  CA  GLY A 140      50.680   5.470 270.266  1.00 24.31           C
ATOM    894  C   GLY A 140      51.908   5.741 271.126  1.00 25.02           C
ATOM    895  O   GLY A 140      53.008   6.035 270.595  1.00 23.08           O
ATOM    896  N   THR A 141      51.735   5.661 272.453  1.00 24.47           N
ATOM    897  CA  THR A 141      52.860   5.886 273.363  1.00 24.58           C
ATOM    898  C   THR A 141      53.494   4.581 273.843  1.00 25.03           C
ATOM    899  O   THR A 141      54.537   4.596 274.490  1.00 23.42           O
ATOM    900  CB  THR A 141      52.455   6.744 274.550  1.00 23.90           C
ATOM    901  OG1 THR A 141      51.454   6.063 275.298  1.00 24.13           O
ATOM    902  CG2 THR A 141      51.928   8.113 274.073  1.00 23.83           C
ATOM    903  N   ASP A 142      52.877   3.457 273.495  1.00 26.43           N
ATOM    904  CA  ASP A 142      53.420   2.156 273.825  1.00 29.92           C
ATOM    905  C   ASP A 142      53.805   1.380 272.544  1.00 29.50           C
ATOM    906  O   ASP A 142      52.959   1.065 271.698  1.00 28.37           O
ATOM    907  CB  ASP A 142      52.419   1.368 274.671  1.00 32.52           C
ATOM    908  CG  ASP A 142      53.002   0.074 275.197  1.00 36.06           C
ATOM    909  OD1 ASP A 142      53.543  -0.724 274.397  1.00 35.86           O
ATOM    910  OD2 ASP A 142      52.921  -0.151 276.423  1.00 41.96           O
ATOM    911  N   PRO A 143      55.092   1.044 272.406  1.00 28.97           N
ATOM    912  CA  PRO A 143      55.524   0.397 271.169  1.00 29.45           C
ATOM    913  C   PRO A 143      55.179  -1.123 271.095  1.00 29.57           C
ATOM    914  O   PRO A 143      55.329  -1.745 270.036  1.00 27.74           O
ATOM    915  CB  PRO A 143      57.041   0.644 271.178  1.00 28.55           C
ATOM    916  CG  PRO A 143      57.385   0.576 272.632  1.00 29.49           C
ATOM    917  CD  PRO A 143      56.186   1.129 273.390  1.00 29.06           C
ATOM    918  N   ILE A 144      54.718  -1.726 272.183  1.00 29.97           N
ATOM    919  CA  ILE A 144      54.384  -3.141 272.102  1.00 32.90           C
ATOM    920  C   ILE A 144      52.897  -3.504 272.207  1.00 34.49           C
ATOM    921  O   ILE A 144      52.531  -4.556 271.709  1.00 35.67           O
ATOM    922  CB  ILE A 144      55.233  -4.004 273.076  1.00 33.41           C
ATOM    923  CG1 ILE A 144      54.920  -3.700 274.542  1.00 32.77           C
ATOM    924  CG2 ILE A 144      56.727  -3.812 272.797  1.00 33.70           C
ATOM    925  CD1 ILE A 144      55.582  -4.675 275.496  1.00 30.82           C
```

Appendix 2

```
ATOM    926  N    GLU A 145      52.050  -2.654 272.812  1.00 37.57           N
ATOM    927  CA   GLU A 145      50.607  -2.990 273.049  1.00 37.71           C
ATOM    928  C    GLU A 145      49.912  -3.487 271.762  1.00 36.83           C
ATOM    929  O    GLU A 145      49.412  -4.613 271.741  1.00 36.31           O
ATOM    930  CB   GLU A 145      49.808  -1.821 273.705  1.00 33.54           C
ATOM    931  N    LYS A 146      49.931  -2.659 270.708  1.00 35.88           N
ATOM    932  CA   LYS A 146      49.212  -2.908 269.447  1.00 36.85           C
ATOM    933  C    LYS A 146      50.191  -2.815 268.277  1.00 36.06           C
ATOM    934  O    LYS A 146      51.136  -2.025 268.311  1.00 36.65           O
ATOM    935  CB   LYS A 146      48.066  -1.859 269.235  1.00 33.23           C
ATOM    936  N    GLU A 147      49.962  -3.618 267.242  1.00 34.29           N
ATOM    937  CA   GLU A 147      50.574  -3.371 265.937  1.00 33.68           C
ATOM    938  C    GLU A 147      52.122  -3.373 265.976  1.00 31.53           C
ATOM    939  O    GLU A 147      52.721  -4.088 266.768  1.00 29.37           O
ATOM    940  CB   GLU A 147      50.000  -2.047 265.390  1.00 36.26           C
ATOM    941  CG   GLU A 147      48.467  -2.079 265.259  1.00 37.84           C
ATOM    942  CD   GLU A 147      47.754  -0.725 265.325  1.00 35.41           C
ATOM    943  OE1  GLU A 147      48.379   0.348 265.475  1.00 33.64           O
ATOM    944  OE2  GLU A 147      46.521  -0.762 265.235  1.00 34.37           O
ATOM    945  N    ASN A 148      52.758  -2.615 265.087  1.00 29.54           N
ATOM    946  CA   ASN A 148      54.187  -2.295 265.184  1.00 28.25           C
ATOM    947  C    ASN A 148      55.121  -3.524 265.207  1.00 27.66           C
ATOM    948  O    ASN A 148      56.180  -3.545 265.857  1.00 23.51           O
ATOM    949  CB   ASN A 148      54.436  -1.406 266.408  1.00 27.30           C
ATOM    950  CG   ASN A 148      55.805  -0.742 266.388  1.00 26.01           C
ATOM    951  OD1  ASN A 148      56.359  -0.464 265.322  1.00 25.96           O
ATOM    952  ND2  ASN A 148      56.330  -0.437 267.570  1.00 25.32           N
ATOM    953  N    ILE A 149      54.719  -4.532 264.457  1.00 29.08           N
ATOM    954  CA   ILE A 149      55.448  -5.775 264.410  1.00 32.01           C
ATOM    955  C    ILE A 149      56.858  -5.584 263.834  1.00 33.63           C
ATOM    956  O    ILE A 149      57.733  -6.428 263.997  1.00 34.57           O
ATOM    957  CB   ILE A 149      54.632  -6.829 263.648  1.00 32.76           C
ATOM    958  CG1  ILE A 149      55.108  -8.227 263.996  1.00 35.33           C
ATOM    959  CG2  ILE A 149      54.669  -6.598 262.157  1.00 33.79           C
ATOM    960  CD1  ILE A 149      54.625  -8.696 265.355  1.00 36.05           C
ATOM    961  N    MET A 150      57.093  -4.464 263.167  1.00 35.62           N
ATOM    962  CA   MET A 150      58.440  -4.185 262.661  1.00 36.22           C
ATOM    963  C    MET A 150      59.463  -4.000 263.777  1.00 30.73           C
ATOM    964  O    MET A 150      60.624  -4.297 263.591  1.00 29.37           O
ATOM    965  CB   MET A 150      58.450  -2.946 261.756  1.00 40.58           C
ATOM    966  CG   MET A 150      57.975  -1.673 262.431  1.00 44.98           C
ATOM    967  SD   MET A 150      57.615  -0.405 261.213  1.00 53.91           S
ATOM    968  CE   MET A 150      57.475   1.022 262.304  1.00 57.65           C
ATOM    969  N    TYR A 151      59.038  -3.461 264.908  1.00 27.86           N
ATOM    970  CA   TYR A 151      59.945  -3.214 266.026  1.00 25.73           C
ATOM    971  C    TYR A 151      59.900  -4.394 266.956  1.00 24.02           C
ATOM    972  O    TYR A 151      60.894  -5.035 267.185  1.00 22.26           O
ATOM    973  CB   TYR A 151      59.551  -1.943 266.772  1.00 25.40           C
ATOM    974  CG   TYR A 151      60.160  -1.847 268.125  1.00 25.22           C
ATOM    975  CD1  TYR A 151      61.461  -1.442 268.277  1.00 26.37           C
ATOM    976  CD2  TYR A 151      59.441  -2.191 269.266  1.00 25.63           C
ATOM    977  CE1  TYR A 151      62.049  -1.362 269.535  1.00 26.15           C
ATOM    978  CE2  TYR A 151      60.013  -2.101 270.522  1.00 24.90           C
ATOM    979  CZ   TYR A 151      61.320  -1.697 270.642  1.00 24.61           C
```

Appendix 2

```
ATOM    980  OH   TYR A 151      61.909  -1.615 271.856  1.00 23.81           O
ATOM    981  N    LYS A 152      58.715  -4.700 267.460  1.00 24.68           N
ATOM    982  CA   LYS A 152      58.568  -5.713 268.505  1.00 24.88           C
ATOM    983  C    LYS A 152      58.750  -7.155 268.028  1.00 23.05           C
ATOM    984  O    LYS A 152      58.952  -8.041 268.835  1.00 22.55           O
ATOM    985  CB   LYS A 152      57.209  -5.566 269.200  1.00 26.66           C
ATOM    986  CG   LYS A 152      56.018  -6.020 268.389  1.00 27.76           C
ATOM    987  CD   LYS A 152      54.748  -5.572 269.066  1.00 30.67           C
ATOM    988  CE   LYS A 152      53.533  -6.300 268.521  1.00 32.80           C
ATOM    989  NZ   LYS A 152      52.287  -5.576 268.913  1.00 34.34           N
ATOM    990  N    GLY A 153      58.605  -7.395 266.735  1.00 21.34           N
ATOM    991  CA   GLY A 153      58.933  -8.682 266.180  1.00 20.35           C
ATOM    992  C    GLY A 153      60.409  -8.918 266.397  1.00 20.50           C
ATOM    993  O    GLY A 153      60.793  -9.932 266.963  1.00 20.17           O
ATOM    994  N    HIS A 154      61.252  -7.975 265.984  1.00 21.16           N
ATOM    995  CA   HIS A 154      62.678  -8.105 266.254  1.00 22.36           C
ATOM    996  C    HIS A 154      62.951  -8.167 267.777  1.00 24.14           C
ATOM    997  O    HIS A 154      63.686  -9.063 268.267  1.00 23.32           O
ATOM    998  CB   HIS A 154      63.457  -6.963 265.632  1.00 22.94           C
ATOM    999  CG   HIS A 154      63.476  -6.978 264.132  1.00 24.09           C
ATOM   1000  ND1  HIS A 154      64.344  -7.760 263.403  1.00 23.73           N
ATOM   1001  CD2  HIS A 154      62.764  -6.269 263.228  1.00 24.42           C
ATOM   1002  CE1  HIS A 154      64.157  -7.536 262.116  1.00 24.03           C
ATOM   1003  NE2  HIS A 154      63.204  -6.636 261.982  1.00 23.85           N
ATOM   1004  N    LEU A 155      62.359  -7.242 268.546  1.00 24.04           N
ATOM   1005  CA   LEU A 155      62.646  -7.228 269.974  1.00 23.98           C
ATOM   1006  C    LEU A 155      62.445  -8.631 270.513  1.00 24.14           C
ATOM   1007  O    LEU A 155      63.282  -9.136 271.271  1.00 24.73           O
ATOM   1008  CB   LEU A 155      61.791  -6.227 270.737  1.00 23.88           C
ATOM   1009  CG   LEU A 155      61.923  -6.328 272.253  1.00 24.88           C
ATOM   1010  CD1  LEU A 155      63.362  -6.169 272.727  1.00 25.45           C
ATOM   1011  CD2  LEU A 155      61.029  -5.297 272.910  1.00 25.69           C
ATOM   1012  N    ASN A 156      61.363  -9.279 270.083  1.00 24.23           N
ATOM   1013  CA   ASN A 156      60.987 -10.574 270.642  1.00 24.40           C
ATOM   1014  C    ASN A 156      61.856 -11.726 270.196  1.00 23.01           C
ATOM   1015  O    ASN A 156      62.140 -12.639 270.976  1.00 24.34           O
ATOM   1016  CB   ASN A 156      59.543 -10.915 270.343  1.00 25.73           C
ATOM   1017  CG   ASN A 156      58.997 -11.934 271.320  1.00 27.94           C
ATOM   1018  OD1  ASN A 156      59.005 -11.708 272.540  1.00 30.42           O
ATOM   1019  ND2  ASN A 156      58.556 -13.069 270.805  1.00 28.03           N
ATOM   1020  N    LEU A 157      62.254 -11.703 268.941  1.00 20.74           N
ATOM   1021  CA   LEU A 157      63.241 -12.625 268.477  1.00 20.04           C
ATOM   1022  C    LEU A 157      64.514 -12.370 269.283  1.00 20.69           C
ATOM   1023  O    LEU A 157      65.140 -13.325 269.748  1.00 22.12           O
ATOM   1024  CB   LEU A 157      63.479 -12.463 266.965  1.00 19.76           C
ATOM   1025  CG   LEU A 157      64.496 -13.460 266.420  1.00 19.94           C
ATOM   1026  CD1  LEU A 157      64.045 -14.876 266.740  1.00 20.50           C
ATOM   1027  CD2  LEU A 157      64.743 -13.304 264.930  1.00 19.80           C
ATOM   1028  N    MET A 158      64.886 -11.103 269.503  1.00 20.88           N
ATOM   1029  CA   MET A 158      66.125 -10.823 270.238  1.00 21.26           C
ATOM   1030  C    MET A 158      66.053 -11.347 271.676  1.00 20.53           C
ATOM   1031  O    MET A 158      66.978 -12.005 272.140  1.00 19.20           O
ATOM   1032  CB   MET A 158      66.467  -9.348 270.216  1.00 22.26           C
ATOM   1033  CG   MET A 158      66.883  -8.810 268.848  1.00 23.38           C
```

Appendix 2

```
ATOM   1034  SD  MET A 158      66.876  -6.999 268.827  1.00 23.01           S
ATOM   1035  CE  MET A 158      67.941  -6.748 270.245  1.00 23.97           C
ATOM   1036  N   TYR A 159      64.951 -11.106 272.369  1.00 20.51           N
ATOM   1037  CA  TYR A 159      64.768 -11.750 273.687  1.00 22.29           C
ATOM   1038  C   TYR A 159      65.098 -13.264 273.654  1.00 22.62           C
ATOM   1039  O   TYR A 159      65.732 -13.815 274.569  1.00 22.71           O
ATOM   1040  CB  TYR A 159      63.319 -11.627 274.202  1.00 22.26           C
ATOM   1041  CG  TYR A 159      62.886 -10.295 274.754  1.00 22.57           C
ATOM   1042  CD1 TYR A 159      63.742  -9.517 275.501  1.00 22.50           C
ATOM   1043  CD2 TYR A 159      61.589  -9.819 274.515  1.00 23.81           C
ATOM   1044  CE1 TYR A 159      63.333  -8.306 276.025  1.00 24.53           C
ATOM   1045  CE2 TYR A 159      61.153  -8.602 275.031  1.00 25.02           C
ATOM   1046  CZ  TYR A 159      62.019  -7.849 275.807  1.00 26.78           C
ATOM   1047  OH  TYR A 159      61.610  -6.621 276.336  1.00 28.82           O
ATOM   1048  N   GLY A 160      64.627 -13.948 272.631  1.00 21.59           N
ATOM   1049  CA  GLY A 160      64.751 -15.395 272.651  1.00 22.66           C
ATOM   1050  C   GLY A 160      66.166 -15.889 272.401  1.00 21.37           C
ATOM   1051  O   GLY A 160      66.619 -16.879 272.990  1.00 21.31           O
ATOM   1052  N   LEU A 161      66.843 -15.193 271.501  1.00 20.50           N
ATOM   1053  CA  LEU A 161      68.202 -15.519 271.123  1.00 20.15           C
ATOM   1054  C   LEU A 161      69.135 -15.262 272.317  1.00 20.62           C
ATOM   1055  O   LEU A 161      69.943 -16.129 272.696  1.00 20.02           O
ATOM   1056  CB  LEU A 161      68.600 -14.724 269.860  1.00 19.69           C
ATOM   1057  CG  LEU A 161      67.871 -15.131 268.552  1.00 19.15           C
ATOM   1058  CD1 LEU A 161      68.348 -14.319 267.387  1.00 18.80           C
ATOM   1059  CD2 LEU A 161      68.097 -16.584 268.186  1.00 20.08           C
ATOM   1060  N   TYR A 162      68.981 -14.100 272.947  1.00 20.38           N
ATOM   1061  CA  TYR A 162      69.737 -13.799 274.133  1.00 20.59           C
ATOM   1062  C   TYR A 162      69.703 -15.031 275.062  1.00 21.47           C
ATOM   1063  O   TYR A 162      70.745 -15.600 275.419  1.00 19.47           O
ATOM   1064  CB  TYR A 162      69.190 -12.535 274.844  1.00 20.87           C
ATOM   1065  CG  TYR A 162      69.838 -12.304 276.207  1.00 22.16           C
ATOM   1066  CD1 TYR A 162      71.180 -11.910 276.326  1.00 22.30           C
ATOM   1067  CD2 TYR A 162      69.131 -12.529 277.377  1.00 23.05           C
ATOM   1068  CE1 TYR A 162      71.766 -11.711 277.578  1.00 22.80           C
ATOM   1069  CE2 TYR A 162      69.720 -12.350 278.629  1.00 23.67           C
ATOM   1070  CZ  TYR A 162      71.027 -11.943 278.727  1.00 22.99           C
ATOM   1071  OH  TYR A 162      71.570 -11.807 279.982  1.00 23.88           O
ATOM   1072  N   GLN A 163      68.485 -15.454 275.417  1.00 22.55           N
ATOM   1073  CA  GLN A 163      68.297 -16.559 276.332  1.00 22.30           C
ATOM   1074  C   GLN A 163      68.881 -17.854 275.819  1.00 21.75           C
ATOM   1075  O   GLN A 163      69.398 -18.630 276.600  1.00 21.66           O
ATOM   1076  CB  GLN A 163      66.831 -16.766 276.646  1.00 23.52           C
ATOM   1077  CG  GLN A 163      66.574 -17.609 277.897  1.00 23.53           C
ATOM   1078  CD  GLN A 163      65.220 -17.303 278.507  1.00 23.93           C
ATOM   1079  OE1 GLN A 163      64.632 -16.247 278.262  1.00 25.06           O
ATOM   1080  NE2 GLN A 163      64.715 -18.226 279.301  1.00 24.78           N
ATOM   1081  N   LEU A 164      68.807 -18.094 274.516  1.00 21.08           N
ATOM   1082  CA  LEU A 164      69.382 -19.313 273.980  1.00 21.03           C
ATOM   1083  C   LEU A 164      70.887 -19.360 274.178  1.00 20.86           C
ATOM   1084  O   LEU A 164      71.440 -20.391 274.469  1.00 21.29           O
ATOM   1085  CB  LEU A 164      69.050 -19.465 272.494  1.00 21.45           C
ATOM   1086  CG  LEU A 164      67.704 -20.096 272.173  1.00 21.45           C
ATOM   1087  CD1 LEU A 164      67.466 -20.021 270.679  1.00 21.42           C
```

Appendix 2

```
ATOM   1088  CD2 LEU A 164      67.661 -21.541 272.693  1.00 21.74           C
ATOM   1089  N   VAL A 165      71.533 -18.220 274.036  1.00 21.58           N
ATOM   1090  CA  VAL A 165      72.988 -18.126 274.090  1.00 21.53           C
ATOM   1091  C   VAL A 165      73.525 -18.212 275.500  1.00 21.52           C
ATOM   1092  O   VAL A 165      74.474 -18.960 275.778  1.00 23.20           O
ATOM   1093  CB  VAL A 165      73.450 -16.801 273.458  1.00 20.82           C
ATOM   1094  CG1 VAL A 165      74.936 -16.636 273.613  1.00 21.66           C
ATOM   1095  CG2 VAL A 165      73.074 -16.778 271.982  1.00 19.97           C
ATOM   1096  N   THR A 166      72.897 -17.452 276.381  1.00 21.82           N
ATOM   1097  CA  THR A 166      73.376 -17.228 277.738  1.00 22.02           C
ATOM   1098  C   THR A 166      72.719 -18.118 278.802  1.00 23.69           C
ATOM   1099  O   THR A 166      73.276 -18.288 279.873  1.00 24.62           O
ATOM   1100  CB  THR A 166      73.110 -15.764 278.172  1.00 22.48           C
ATOM   1101  OG1 THR A 166      71.702 -15.527 278.293  1.00 21.17           O
ATOM   1102  CG2 THR A 166      73.708 -14.758 277.178  1.00 22.47           C
ATOM   1103  N   GLY A 167      71.536 -18.663 278.537  1.00 25.11           N
ATOM   1104  CA  GLY A 167      70.744 -19.301 279.584  1.00 25.24           C
ATOM   1105  C   GLY A 167      70.231 -18.325 280.630  1.00 27.29           C
ATOM   1106  O   GLY A 167      69.682 -18.740 281.641  1.00 28.97           O
ATOM   1107  N   SER A 168      70.382 -17.023 280.413  1.00 28.73           N
ATOM   1108  CA  SER A 168      69.973 -16.050 281.429  1.00 28.96           C
ATOM   1109  C   SER A 168      68.467 -15.833 281.351  1.00 29.40           C
ATOM   1110  O   SER A 168      67.893 -15.814 280.261  1.00 29.87           O
ATOM   1111  CB  SER A 168      70.697 -14.711 281.235  1.00 28.59           C
ATOM   1112  OG  SER A 168      70.039 -13.671 281.954  1.00 28.65           O
ATOM   1113  N   ARG A 169      67.851 -15.632 282.507  1.00 29.24           N
ATOM   1114  CA  ARG A 169      66.427 -15.343 282.607  1.00 29.60           C
ATOM   1115  C   ARG A 169      66.138 -13.870 282.813  1.00 26.70           C
ATOM   1116  O   ARG A 169      65.019 -13.481 283.096  1.00 23.79           O
ATOM   1117  CB  ARG A 169      65.830 -16.127 283.762  1.00 33.43           C
ATOM   1118  CG  ARG A 169      66.237 -17.590 283.734  1.00 39.30           C
ATOM   1119  CD  ARG A 169      65.183 -18.501 284.345  1.00 43.38           C
ATOM   1120  NE  ARG A 169      64.548 -17.910 285.527  1.00 46.41           N
ATOM   1121  CZ  ARG A 169      63.375 -18.294 286.033  1.00 48.42           C
ATOM   1122  NH1 ARG A 169      62.687 -19.287 285.478  1.00 52.59           N
ATOM   1123  NH2 ARG A 169      62.878 -17.680 287.099  1.00 48.41           N
ATOM   1124  N   ARG A 170      67.154 -13.048 282.660  1.00 26.83           N
ATOM   1125  CA  ARG A 170      67.007 -11.622 282.841  1.00 30.09           C
ATOM   1126  C   ARG A 170      65.775 -10.993 282.155  1.00 28.60           C
ATOM   1127  O   ARG A 170      65.082 -10.226 282.776  1.00 29.30           O
ATOM   1128  CB  ARG A 170      68.262 -10.968 282.317  1.00 34.87           C
ATOM   1129  CG  ARG A 170      68.398  -9.492 282.581  1.00 40.96           C
ATOM   1130  CD  ARG A 170      69.763  -9.082 282.060  1.00 48.63           C
ATOM   1131  NE  ARG A 170      69.842  -7.655 281.797  1.00 53.59           N
ATOM   1132  CZ  ARG A 170      69.965  -6.737 282.745  1.00 53.86           C
ATOM   1133  NH1 ARG A 170      70.009  -7.108 284.023  1.00 52.88           N
ATOM   1134  NH2 ARG A 170      70.037  -5.445 282.410  1.00 54.71           N
ATOM   1135  N   TYR A 171      65.521 -11.309 280.890  1.00 26.90           N
ATOM   1136  CA  TYR A 171      64.403 -10.721 280.153  1.00 27.59           C
ATOM   1137  C   TYR A 171      63.190 -11.654 279.991  1.00 29.19           C
ATOM   1138  O   TYR A 171      62.235 -11.289 279.344  1.00 31.66           O
ATOM   1139  CB  TYR A 171      64.850 -10.231 278.763  1.00 25.33           C
ATOM   1140  CG  TYR A 171      65.974  -9.211 278.778  1.00 24.90           C
ATOM   1141  CD1 TYR A 171      65.782  -7.903 279.293  1.00 24.65           C
```

Appendix 2

```
ATOM   1142  CD2 TYR A 171      67.224  -9.529 278.252  1.00 24.13           C
ATOM   1143  CE1 TYR A 171      66.805  -6.964 279.283  1.00 23.68           C
ATOM   1144  CE2 TYR A 171      68.252  -8.604 278.253  1.00 24.74           C
ATOM   1145  CZ  TYR A 171      68.042  -7.329 278.760  1.00 25.06           C
ATOM   1146  OH  TYR A 171      69.094  -6.451 278.730  1.00 25.40           O
ATOM   1147  N   GLU A 172      63.211 -12.816 280.632  1.00 32.09           N
ATOM   1148  CA  GLU A 172      62.190 -13.865 280.472  1.00 32.19           C
ATOM   1149  C   GLU A 172      60.726 -13.431 280.673  1.00 31.37           C
ATOM   1150  O   GLU A 172      59.848 -13.826 279.909  1.00 28.82           O
ATOM   1151  CB  GLU A 172      62.506 -15.006 281.457  1.00 33.44           C
ATOM   1152  CG  GLU A 172      61.449 -16.114 281.530  1.00 33.37           C
ATOM   1153  CD  GLU A 172      62.015 -17.432 282.023  1.00 32.64           C
ATOM   1154  OE1 GLU A 172      62.342 -18.303 281.193  1.00 32.02           O
ATOM   1155  OE2 GLU A 172      62.160 -17.595 283.247  1.00 34.79           O
ATOM   1156  N   ALA A 173      60.474 -12.653 281.722  1.00 30.88           N
ATOM   1157  CA  ALA A 173      59.120 -12.163 282.016  1.00 29.97           C
ATOM   1158  C   ALA A 173      58.661 -11.220 280.899  1.00 30.79           C
ATOM   1159  O   ALA A 173      57.527 -11.297 280.426  1.00 28.95           O
ATOM   1160  CB  ALA A 173      59.078 -11.466 283.379  1.00 27.58           C
ATOM   1161  N   GLU A 174      59.561 -10.354 280.452  1.00 31.26           N
ATOM   1162  CA  GLU A 174      59.235  -9.482 279.324  1.00 33.47           C
ATOM   1163  C   GLU A 174      59.003 -10.297 278.035  1.00 31.44           C
ATOM   1164  O   GLU A 174      58.141  -9.952 277.227  1.00 30.48           O
ATOM   1165  CB  GLU A 174      60.325  -8.422 279.128  1.00 35.22           C
ATOM   1166  CG  GLU A 174      60.457  -7.467 280.315  1.00 36.87           C
ATOM   1167  CD  GLU A 174      61.814  -6.756 280.374  1.00 41.25           C
ATOM   1168  OE1 GLU A 174      62.640  -6.876 279.443  1.00 41.59           O
ATOM   1169  OE2 GLU A 174      62.064  -6.033 281.359  1.00 46.06           O
ATOM   1170  N   HIS A 175      59.772 -11.378 277.873  1.00 29.16           N
ATOM   1171  CA  HIS A 175      59.701 -12.274 276.706  1.00 27.09           C
ATOM   1172  C   HIS A 175      58.391 -13.027 276.626  1.00 26.58           C
ATOM   1173  O   HIS A 175      57.794 -13.144 275.553  1.00 24.41           O
ATOM   1174  CB  HIS A 175      60.830 -13.299 276.759  1.00 26.13           C
ATOM   1175  CG  HIS A 175      61.012 -14.062 275.491  1.00 24.31           C
ATOM   1176  ND1 HIS A 175      61.729 -15.233 275.430  1.00 24.68           N
ATOM   1177  CD2 HIS A 175      60.574 -13.825 274.236  1.00 24.42           C
ATOM   1178  CE1 HIS A 175      61.751 -15.674 274.186  1.00 24.72           C
ATOM   1179  NE2 HIS A 175      61.049 -14.841 273.441  1.00 24.92           N
ATOM   1180  N   ALA A 176      57.970 -13.562 277.769  1.00 26.98           N
ATOM   1181  CA  ALA A 176      56.632 -14.158 277.902  1.00 27.32           C
ATOM   1182  C   ALA A 176      55.487 -13.130 277.667  1.00 25.63           C
ATOM   1183  O   ALA A 176      54.512 -13.429 276.955  1.00 23.53           O
ATOM   1184  CB  ALA A 176      56.484 -14.855 279.251  1.00 26.41           C
ATOM   1185  N   HIS A 177      55.615 -11.925 278.214  1.00 25.03           N
ATOM   1186  CA  HIS A 177      54.566 -10.918 277.997  1.00 26.51           C
ATOM   1187  C   HIS A 177      54.438 -10.564 276.496  1.00 26.78           C
ATOM   1188  O   HIS A 177      53.332 -10.430 275.966  1.00 26.76           O
ATOM   1189  CB  HIS A 177      54.792  -9.673 278.862  1.00 26.35           C
ATOM   1190  CG  HIS A 177      53.831  -8.552 278.588  1.00 29.63           C
ATOM   1191  ND1 HIS A 177      52.494  -8.601 278.941  1.00 30.73           N
ATOM   1192  CD2 HIS A 177      54.021  -7.344 278.001  1.00 29.74           C
ATOM   1193  CE1 HIS A 177      51.904  -7.478 278.569  1.00 30.62           C
ATOM   1194  NE2 HIS A 177      52.810  -6.696 278.003  1.00 30.22           N
ATOM   1195  N   LEU A 178      55.561 -10.448 275.804  1.00 27.47           N
```

Appendix 2

```
ATOM   1196  CA   LEU A 178      55.537 -10.034 274.405  1.00 28.57           C
ATOM   1197  C    LEU A 178      55.109 -11.192 273.514  1.00 29.17           C
ATOM   1198  O    LEU A 178      54.296 -11.000 272.619  1.00 31.38           O
ATOM   1199  CB   LEU A 178      56.896  -9.457 273.968  1.00 28.61           C
ATOM   1200  CG   LEU A 178      57.004  -8.787 272.588  1.00 29.96           C
ATOM   1201  CD1  LEU A 178      55.906  -7.767 272.341  1.00 29.33           C
ATOM   1202  CD2  LEU A 178      58.369  -8.123 272.350  1.00 29.91           C
ATOM   1203  N    THR A 179      55.626 -12.393 273.745  1.00 28.17           N
ATOM   1204  CA   THR A 179      55.169 -13.530 272.955  1.00 30.02           C
ATOM   1205  C    THR A 179      53.617 -13.691 273.035  1.00 29.93           C
ATOM   1206  O    THR A 179      52.957 -13.977 272.030  1.00 26.43           O
ATOM   1207  CB   THR A 179      55.904 -14.825 273.367  1.00 32.14           C
ATOM   1208  OG1  THR A 179      57.320 -14.617 273.273  1.00 34.14           O
ATOM   1209  CG2  THR A 179      55.516 -15.985 272.461  1.00 31.99           C
ATOM   1210  N    ARG A 180      53.044 -13.462 274.220  1.00 30.82           N
ATOM   1211  CA   ARG A 180      51.597 -13.532 274.400  1.00 31.14           C
ATOM   1212  C    ARG A 180      50.912 -12.460 273.573  1.00 29.96           C
ATOM   1213  O    ARG A 180      49.982 -12.766 272.815  1.00 33.18           O
ATOM   1214  CB   ARG A 180      51.186 -13.415 275.875  1.00 34.58           C
ATOM   1215  CG   ARG A 180      49.828 -14.047 276.204  1.00 39.86           C
ATOM   1216  CD   ARG A 180      48.919 -13.155 277.070  1.00 43.32           C
ATOM   1217  NE   ARG A 180      48.460 -11.933 276.373  1.00 45.56           N
ATOM   1218  CZ   ARG A 180      48.822 -10.674 276.666  1.00 45.29           C
ATOM   1219  NH1  ARG A 180      49.652 -10.400 277.678  1.00 43.69           N
ATOM   1220  NH2  ARG A 180      48.333  -9.666 275.937  1.00 44.30           N
ATOM   1221  N    ILE A 181      51.359 -11.216 273.700  1.00 27.01           N
ATOM   1222  CA   ILE A 181      50.774 -10.143 272.913  1.00 27.63           C
ATOM   1223  C    ILE A 181      50.628 -10.519 271.431  1.00 28.20           C
ATOM   1224  O    ILE A 181      49.556 -10.363 270.848  1.00 30.56           O
ATOM   1225  CB   ILE A 181      51.600  -8.848 273.024  1.00 28.18           C
ATOM   1226  CG1  ILE A 181      51.273  -8.128 274.327  1.00 27.96           C
ATOM   1227  CG2  ILE A 181      51.326  -7.923 271.835  1.00 28.51           C
ATOM   1228  CD1  ILE A 181      52.176  -6.942 274.603  1.00 28.33           C
ATOM   1229  N    ILE A 182      51.726 -10.984 270.842  1.00 28.16           N
ATOM   1230  CA   ILE A 182      51.798 -11.397 269.442  1.00 28.70           C
ATOM   1231  C    ILE A 182      50.907 -12.600 269.119  1.00 28.17           C
ATOM   1232  O    ILE A 182      50.240 -12.599 268.104  1.00 27.85           O
ATOM   1233  CB   ILE A 182      53.264 -11.749 269.054  1.00 29.02           C
ATOM   1234  CG1  ILE A 182      54.107 -10.492 269.015  1.00 30.82           C
ATOM   1235  CG2  ILE A 182      53.358 -12.446 267.706  1.00 27.46           C
ATOM   1236  CD1  ILE A 182      55.602 -10.762 268.960  1.00 32.99           C
ATOM   1237  N    HIS A 183      50.945 -13.644 269.947  1.00 29.03           N
ATOM   1238  CA   HIS A 183      50.029 -14.784 269.800  1.00 28.48           C
ATOM   1239  C    HIS A 183      48.581 -14.313 269.791  1.00 28.52           C
ATOM   1240  O    HIS A 183      47.823 -14.730 268.910  1.00 27.84           O
ATOM   1241  CB   HIS A 183      50.249 -15.804 270.909  1.00 29.06           C
ATOM   1242  CG   HIS A 183      49.142 -16.804 271.058  1.00 31.45           C
ATOM   1243  ND1  HIS A 183      49.030 -17.921 270.255  1.00 32.25           N
ATOM   1244  CD2  HIS A 183      48.119 -16.875 271.945  1.00 31.71           C
ATOM   1245  CE1  HIS A 183      47.981 -18.630 270.631  1.00 31.70           C
ATOM   1246  NE2  HIS A 183      47.410 -18.015 271.650  1.00 33.15           N
ATOM   1247  N    ASP A 184      48.211 -13.433 270.737  1.00 28.36           N
ATOM   1248  CA   ASP A 184      46.823 -12.924 270.829  1.00 28.57           C
ATOM   1249  C    ASP A 184      46.423 -12.039 269.630  1.00 29.53           C
```

Appendix 2

```
ATOM   1250  O    ASP A 184      45.290 -12.151 269.133  1.00 29.37           O
ATOM   1251  CB   ASP A 184      46.555 -12.179 272.157  1.00 27.89           C
ATOM   1252  CG   ASP A 184      46.589 -13.098 273.378  1.00 27.50           C
ATOM   1253  OD1  ASP A 184      46.896 -14.299 273.225  1.00 29.16           O
ATOM   1254  OD2  ASP A 184      46.339 -12.620 274.499  1.00 25.37           O
ATOM   1255  N    GLU A 185      47.335 -11.182 269.164  1.00 30.45           N
ATOM   1256  CA   GLU A 185      47.092 -10.379 267.958  1.00 31.83           C
ATOM   1257  C    GLU A 185      46.881 -11.237 266.706  1.00 34.27           C
ATOM   1258  O    GLU A 185      46.006 -10.946 265.872  1.00 36.78           O
ATOM   1259  CB   GLU A 185      48.230  -9.389 267.711  1.00 32.97           C
ATOM   1260  CG   GLU A 185      47.963  -7.977 268.240  1.00 34.29           C
ATOM   1261  CD   GLU A 185      48.961  -6.927 267.717  1.00 35.09           C
ATOM   1262  OE1  GLU A 185      50.125  -6.864 268.225  1.00 35.36           O
ATOM   1263  OE2  GLU A 185      48.571  -6.148 266.815  1.00 30.72           O
ATOM   1264  N    ILE A 186      47.669 -12.299 266.571  1.00 34.46           N
ATOM   1265  CA   ILE A 186      47.528 -13.198 265.434  1.00 35.22           C
ATOM   1266  C    ILE A 186      46.164 -13.876 265.484  1.00 37.29           C
ATOM   1267  O    ILE A 186      45.434 -13.867 264.482  1.00 41.20           O
ATOM   1268  CB   ILE A 186      48.646 -14.250 265.380  1.00 34.49           C
ATOM   1269  CG1  ILE A 186      49.988 -13.554 265.141  1.00 34.30           C
ATOM   1270  CG2  ILE A 186      48.394 -15.245 264.252  1.00 34.22           C
ATOM   1271  CD1  ILE A 186      51.208 -14.404 265.427  1.00 33.49           C
ATOM   1272  N    ALA A 187      45.821 -14.430 266.653  1.00 35.69           N
ATOM   1273  CA   ALA A 187      44.513 -15.061 266.879  1.00 33.26           C
ATOM   1274  C    ALA A 187      43.318 -14.140 266.522  1.00 33.07           C
ATOM   1275  O    ALA A 187      42.366 -14.589 265.883  1.00 33.31           O
ATOM   1276  CB   ALA A 187      44.402 -15.551 268.316  1.00 31.10           C
ATOM   1277  N    ALA A 188      43.396 -12.864 266.904  1.00 31.84           N
ATOM   1278  CA   ALA A 188      42.289 -11.902 266.718  1.00 31.43           C
ATOM   1279  C    ALA A 188      42.198 -11.263 265.323  1.00 33.10           C
ATOM   1280  O    ALA A 188      41.238 -10.560 265.061  1.00 32.39           O
ATOM   1281  CB   ALA A 188      42.381 -10.788 267.762  1.00 29.82           C
ATOM   1282  N    ASN A 189      43.192 -11.467 264.455  1.00 33.88           N
ATOM   1283  CA   ASN A 189      43.188 -10.863 263.118  1.00 35.63           C
ATOM   1284  C    ASN A 189      42.582 -11.802 262.090  1.00 35.35           C
ATOM   1285  O    ASN A 189      42.878 -12.999 262.101  1.00 36.15           O
ATOM   1286  CB   ASN A 189      44.610 -10.474 262.672  1.00 37.39           C
ATOM   1287  CG   ASN A 189      45.114  -9.194 263.342  1.00 37.62           C
ATOM   1288  OD1  ASN A 189      44.333  -8.411 263.887  1.00 34.69           O
ATOM   1289  ND2  ASN A 189      46.430  -8.976 263.294  1.00 40.23           N
ATOM   1290  N    PRO A 190      41.723 -11.265 261.199  1.00 35.51           N
ATOM   1291  CA   PRO A 190      41.047 -12.080 260.148  1.00 35.38           C
ATOM   1292  C    PRO A 190      42.025 -12.623 259.140  1.00 34.88           C
ATOM   1293  O    PRO A 190      41.827 -13.702 258.629  1.00 36.65           O
ATOM   1294  CB   PRO A 190      40.103 -11.086 259.447  1.00 36.21           C
ATOM   1295  CG   PRO A 190      40.615  -9.725 259.816  1.00 37.42           C
ATOM   1296  CD   PRO A 190      41.354  -9.837 261.133  1.00 35.18           C
ATOM   1297  N    PHE A 191      43.051 -11.830 258.834  1.00 34.20           N
ATOM   1298  CA   PHE A 191      44.183 -12.253 258.031  1.00 31.89           C
ATOM   1299  C    PHE A 191      45.179 -12.830 259.013  1.00 32.53           C
ATOM   1300  O    PHE A 191      45.042 -12.599 260.214  1.00 34.32           O
ATOM   1301  CB   PHE A 191      44.817 -11.076 257.288  1.00 30.58           C
ATOM   1302  CG   PHE A 191      45.208  -9.932 258.194  1.00 30.44           C
ATOM   1303  CD1  PHE A 191      44.285  -8.935 258.526  1.00 29.30           C
```

Appendix 2

```
ATOM   1304  CD2 PHE A 191      46.483   -9.862 258.738  1.00 29.88           C
ATOM   1305  CE1 PHE A 191      44.630   -7.891 259.369  1.00 28.87           C
ATOM   1306  CE2 PHE A 191      46.838   -8.814 259.572  1.00 30.33           C
ATOM   1307  CZ  PHE A 191      45.910   -7.826 259.895  1.00 29.60           C
ATOM   1308  N   ALA A 192      46.162  -13.571 258.490  1.00 33.64           N
ATOM   1309  CA  ALA A 192      47.190  -14.245 259.292  1.00 34.60           C
ATOM   1310  C   ALA A 192      48.398  -13.324 259.478  1.00 34.42           C
ATOM   1311  O   ALA A 192      49.114  -13.023 258.504  1.00 35.31           O
ATOM   1312  CB  ALA A 192      47.630  -15.558 258.631  1.00 33.27           C
ATOM   1313  N   GLY A 193      48.617  -12.897 260.724  1.00 32.26           N
ATOM   1314  CA  GLY A 193      49.760  -12.064 261.075  1.00 33.83           C
ATOM   1315  C   GLY A 193      49.368  -10.707 261.645  1.00 34.01           C
ATOM   1316  O   GLY A 193      48.222  -10.500 262.034  1.00 33.86           O
ATOM   1317  N   ILE A 194      50.333   -9.789 261.689  1.00 32.74           N
ATOM   1318  CA  ILE A 194      50.188   -8.520 262.405  1.00 35.11           C
ATOM   1319  C   ILE A 194      50.687   -7.372 261.517  1.00 33.86           C
ATOM   1320  O   ILE A 194      51.605   -7.552 260.723  1.00 36.40           O
ATOM   1321  CB  ILE A 194      50.981   -8.528 263.750  1.00 36.40           C
ATOM   1322  CG1 ILE A 194      50.544   -9.715 264.636  1.00 37.55           C
ATOM   1323  CG2 ILE A 194      50.798   -7.218 264.509  1.00 34.86           C
ATOM   1324  CD1 ILE A 194      51.293   -9.864 265.950  1.00 36.41           C
ATOM   1325  N   VAL A 195      50.075   -6.204 261.654  1.00 30.41           N
ATOM   1326  CA  VAL A 195      50.461   -5.042 260.877  1.00 30.14           C
ATOM   1327  C   VAL A 195      51.612   -4.303 261.529  1.00 30.93           C
ATOM   1328  O   VAL A 195      51.826   -4.423 262.727  1.00 31.86           O
ATOM   1329  CB  VAL A 195      49.299   -4.039 260.719  1.00 30.34           C
ATOM   1330  CG1 VAL A 195      48.149   -4.679 259.971  1.00 29.88           C
ATOM   1331  CG2 VAL A 195      48.847   -3.480 262.068  1.00 30.24           C
ATOM   1332  N   CYS A 196      52.336   -3.518 260.738  1.00 31.80           N
ATOM   1333  CA  CYS A 196      53.348   -2.618 261.275  1.00 32.13           C
ATOM   1334  C   CYS A 196      52.667   -1.307 261.675  1.00 33.72           C
ATOM   1335  O   CYS A 196      52.116   -1.192 262.776  1.00 30.90           O
ATOM   1336  CB  CYS A 196      54.459   -2.381 260.247  1.00 31.73           C
ATOM   1337  SG  CYS A 196      55.483   -3.822 259.923  1.00 34.43           S
ATOM   1338  N   GLU A 197      52.723   -0.318 260.777  1.00 38.25           N
ATOM   1339  CA  GLU A 197      51.890    0.869 260.865  1.00 39.71           C
ATOM   1340  C   GLU A 197      50.452    0.407 260.673  1.00 39.50           C
ATOM   1341  O   GLU A 197      50.196   -0.682 260.135  1.00 38.73           O
ATOM   1342  CB  GLU A 197      52.289    1.908 259.804  1.00 42.80           C
ATOM   1343  CG  GLU A 197      53.700    2.520 259.973  1.00 45.45           C
ATOM   1344  CD  GLU A 197      54.842    1.782 259.223  1.00 47.14           C
ATOM   1345  OE1 GLU A 197      54.574    0.815 258.458  1.00 40.79           O
ATOM   1346  OE2 GLU A 197      56.033    2.190 259.393  1.00 47.94           O
ATOM   1347  N   PRO A 198      49.499    1.192 261.161  1.00 41.41           N
ATOM   1348  CA  PRO A 198      48.121    0.758 260.949  1.00 41.72           C
ATOM   1349  C   PRO A 198      47.796    0.611 259.454  1.00 42.84           C
ATOM   1350  O   PRO A 198      48.085    1.519 258.660  1.00 47.39           O
ATOM   1351  CB  PRO A 198      47.291    1.875 261.590  1.00 42.35           C
ATOM   1352  CG  PRO A 198      48.200    2.561 262.557  1.00 43.45           C
ATOM   1353  CD  PRO A 198      49.615    2.330 262.094  1.00 43.05           C
ATOM   1354  N   ASP A 199      47.211   -0.529 259.094  1.00 39.78           N
ATOM   1355  CA  ASP A 199      46.854   -0.868 257.710  1.00 38.47           C
ATOM   1356  C   ASP A 199      48.043   -1.142 256.763  1.00 36.79           C
ATOM   1357  O   ASP A 199      47.893   -1.036 255.529  1.00 33.76           O
```

Appendix 2

```
ATOM   1358  CB  ASP A 199      45.921   0.167 257.072  1.00 37.69           C
ATOM   1359  CG  ASP A 199      45.069  -0.440 255.969  1.00 41.04           C
ATOM   1360  OD1 ASP A 199      44.534  -1.560 256.189  1.00 40.52           O
ATOM   1361  OD2 ASP A 199      44.956   0.174 254.877  1.00 44.47           O
ATOM   1362  N   ASN A 200      49.200  -1.507 257.331  1.00 33.55           N
ATOM   1363  CA  ASN A 200      50.389  -1.860 256.538  1.00 32.44           C
ATOM   1364  C   ASN A 200      50.905  -3.216 256.938  1.00 31.49           C
ATOM   1365  O   ASN A 200      51.549  -3.353 257.980  1.00 33.45           O
ATOM   1366  CB  ASN A 200      51.522  -0.842 256.749  1.00 33.51           C
ATOM   1367  CG  ASN A 200      51.357   0.434 255.931  1.00 34.20           C
ATOM   1368  OD1 ASN A 200      50.525   0.525 255.015  1.00 34.10           O
ATOM   1369  ND2 ASN A 200      52.162   1.436 256.264  1.00 34.77           N
ATOM   1370  N   TYR A 201      50.635  -4.225 256.121  1.00 30.53           N
ATOM   1371  CA  TYR A 201      51.145  -5.570 256.387  1.00 28.42           C
ATOM   1372  C   TYR A 201      52.335  -5.847 255.489  1.00 27.88           C
ATOM   1373  O   TYR A 201      52.271  -5.649 254.284  1.00 25.52           O
ATOM   1374  CB  TYR A 201      50.056  -6.586 256.137  1.00 27.47           C
ATOM   1375  CG  TYR A 201      50.393  -8.035 256.444  1.00 26.85           C
ATOM   1376  CD1 TYR A 201      51.219  -8.788 255.605  1.00 26.29           C
ATOM   1377  CD2 TYR A 201      49.816  -8.677 257.530  1.00 25.89           C
ATOM   1378  CE1 TYR A 201      51.479 -10.118 255.879  1.00 25.95           C
ATOM   1379  CE2 TYR A 201      50.075 -10.010 257.800  1.00 25.38           C
ATOM   1380  CZ  TYR A 201      50.900 -10.724 256.981  1.00 24.93           C
ATOM   1381  OH  TYR A 201      51.145 -12.045 257.271  1.00 23.56           O
ATOM   1382  N   PHE A 202      53.413  -6.330 256.089  1.00 28.72           N
ATOM   1383  CA  PHE A 202      54.638  -6.619 255.374  1.00 27.25           C
ATOM   1384  C   PHE A 202      55.037  -8.030 255.678  1.00 27.55           C
ATOM   1385  O   PHE A 202      55.157  -8.371 256.853  1.00 29.80           O
ATOM   1386  CB  PHE A 202      55.722  -5.707 255.907  1.00 26.79           C
ATOM   1387  CG  PHE A 202      55.620  -4.273 255.431  1.00 27.75           C
ATOM   1388  CD1 PHE A 202      56.107  -3.901 254.192  1.00 27.03           C
ATOM   1389  CD2 PHE A 202      55.080  -3.296 256.247  1.00 27.34           C
ATOM   1390  CE1 PHE A 202      56.030  -2.597 253.777  1.00 27.38           C
ATOM   1391  CE2 PHE A 202      55.026  -1.984 255.846  1.00 26.93           C
ATOM   1392  CZ  PHE A 202      55.500  -1.635 254.608  1.00 27.90           C
ATOM   1393  N   VAL A 203      55.289  -8.860 254.669  1.00 28.02           N
ATOM   1394  CA  VAL A 203      55.600 -10.262 254.998  1.00 29.07           C
ATOM   1395  C   VAL A 203      56.926 -10.428 255.757  1.00 29.95           C
ATOM   1396  O   VAL A 203      57.023 -11.314 256.617  1.00 31.88           O
ATOM   1397  CB  VAL A 203      55.490 -11.256 253.813  1.00 28.07           C
ATOM   1398  CG1 VAL A 203      54.078 -11.267 253.267  1.00 28.32           C
ATOM   1399  CG2 VAL A 203      56.446 -10.919 252.703  1.00 28.53           C
ATOM   1400  N   GLN A 204      57.916  -9.574 255.487  1.00 28.34           N
ATOM   1401  CA  GLN A 204      59.238  -9.752 256.096  1.00 28.23           C
ATOM   1402  C   GLN A 204      59.160  -9.543 257.594  1.00 29.36           C
ATOM   1403  O   GLN A 204      59.798 -10.253 258.359  1.00 29.20           O
ATOM   1404  CB  GLN A 204      60.318  -8.836 255.473  1.00 28.12           C
ATOM   1405  CG  GLN A 204      60.136  -7.328 255.617  1.00 28.27           C
ATOM   1406  CD  GLN A 204      59.306  -6.724 254.497  1.00 29.92           C
ATOM   1407  OE1 GLN A 204      58.199  -7.162 254.213  1.00 29.35           O
ATOM   1408  NE2 GLN A 204      59.847  -5.718 253.849  1.00 32.23           N
ATOM   1409  N   CYS A 205      58.358  -8.564 258.006  1.00 30.55           N
ATOM   1410  CA  CYS A 205      58.233  -8.210 259.406  1.00 30.77           C
ATOM   1411  C   CYS A 205      57.512  -9.321 260.142  1.00 30.17           C
```

Appendix 2

```
ATOM   1412  O    CYS A 205      57.850   -9.631  261.275  1.00  31.46           O
ATOM   1413  CB   CYS A 205      57.530   -6.854  259.556  1.00  32.19           C
ATOM   1414  SG   CYS A 205      58.321   -5.531  258.554  1.00  38.02           S
ATOM   1415  N    ASN A 206      56.543   -9.954  259.493  1.00  29.01           N
ATOM   1416  CA   ASN A 206      55.881  -11.089  260.118  1.00  28.47           C
ATOM   1417  C    ASN A 206      56.794  -12.281  260.211  1.00  26.72           C
ATOM   1418  O    ASN A 206      56.771  -12.991  261.196  1.00  27.00           O
ATOM   1419  CB   ASN A 206      54.586  -11.469  259.398  1.00  28.41           C
ATOM   1420  CG   ASN A 206      53.486  -10.474  259.647  1.00  27.56           C
ATOM   1421  OD1  ASN A 206      52.684  -10.648  260.548  1.00  26.52           O
ATOM   1422  ND2  ASN A 206      53.470   -9.403  258.872  1.00  27.67           N
ATOM   1423  N    SER A 207      57.630  -12.492  259.209  1.00  27.23           N
ATOM   1424  CA   SER A 207      58.521  -13.652  259.246  1.00  27.99           C
ATOM   1425  C    SER A 207      59.372  -13.619  260.500  1.00  27.58           C
ATOM   1426  O    SER A 207      59.692  -14.663  261.044  1.00  26.94           O
ATOM   1427  CB   SER A 207      59.396  -13.745  258.000  1.00  27.71           C
ATOM   1428  OG   SER A 207      60.380  -12.741  258.018  1.00  29.82           O
ATOM   1429  N    VAL A 208      59.698  -12.418  260.978  1.00  28.54           N
ATOM   1430  CA   VAL A 208      60.441  -12.271  262.221  1.00  29.50           C
ATOM   1431  C    VAL A 208      59.573  -12.633  263.433  1.00  29.11           C
ATOM   1432  O    VAL A 208      60.013  -13.368  264.323  1.00  29.99           O
ATOM   1433  CB   VAL A 208      61.010  -10.839  262.394  1.00  30.66           C
ATOM   1434  CG1  VAL A 208      61.736  -10.710  263.723  1.00  29.64           C
ATOM   1435  CG2  VAL A 208      61.959  -10.473  261.258  1.00  30.70           C
ATOM   1436  N    ALA A 209      58.360  -12.091  263.485  1.00  28.82           N
ATOM   1437  CA   ALA A 209      57.450  -12.368  264.590  1.00  27.89           C
ATOM   1438  C    ALA A 209      57.264  -13.872  264.727  1.00  27.61           C
ATOM   1439  O    ALA A 209      57.315  -14.403  265.839  1.00  28.40           O
ATOM   1440  CB   ALA A 209      56.111  -11.703  264.346  1.00  28.50           C
ATOM   1441  N    TYR A 210      57.072  -14.558  263.599  1.00  25.63           N
ATOM   1442  CA   TYR A 210      56.802  -16.003  263.629  1.00  25.84           C
ATOM   1443  C    TYR A 210      58.025  -16.796  264.075  1.00  24.65           C
ATOM   1444  O    TYR A 210      57.921  -17.716  264.905  1.00  24.79           O
ATOM   1445  CB   TYR A 210      56.241  -16.537  262.281  1.00  25.52           C
ATOM   1446  CG   TYR A 210      54.758  -16.239  262.115  1.00  25.20           C
ATOM   1447  CD1  TYR A 210      54.338  -15.034  261.619  1.00  24.16           C
ATOM   1448  CD2  TYR A 210      53.775  -17.157  262.485  1.00  27.41           C
ATOM   1449  CE1  TYR A 210      52.994  -14.729  261.474  1.00  24.78           C
ATOM   1450  CE2  TYR A 210      52.409  -16.856  262.336  1.00  26.82           C
ATOM   1451  CZ   TYR A 210      52.043  -15.623  261.822  1.00  24.76           C
ATOM   1452  OH   TYR A 210      50.754  -15.244  261.655  1.00  24.21           O
ATOM   1453  N    LEU A 211      59.179  -16.433  263.537  1.00  23.26           N
ATOM   1454  CA   LEU A 211      60.406  -17.067  263.938  1.00  22.89           C
ATOM   1455  C    LEU A 211      60.584  -16.900  265.454  1.00  24.11           C
ATOM   1456  O    LEU A 211      61.061  -17.824  266.135  1.00  25.84           O
ATOM   1457  CB   LEU A 211      61.573  -16.469  263.157  1.00  23.36           C
ATOM   1458  CG   LEU A 211      62.904  -17.214  263.172  1.00  24.46           C
ATOM   1459  CD1  LEU A 211      62.693  -18.696  262.911  1.00  25.41           C
ATOM   1460  CD2  LEU A 211      63.890  -16.643  262.169  1.00  24.79           C
ATOM   1461  N    SER A 212      60.157  -15.756  265.992  1.00  23.33           N
ATOM   1462  CA   SER A 212      60.285  -15.489  267.413  1.00  24.24           C
ATOM   1463  C    SER A 212      59.432  -16.439  268.269  1.00  24.86           C
ATOM   1464  O    SER A 212      59.752  -16.699  269.433  1.00  25.64           O
ATOM   1465  CB   SER A 212      59.946  -14.020  267.729  1.00  25.13           C
```

Appendix 2

```
ATOM   1466  OG  SER A 212      58.573 -13.836 268.029  1.00 25.73           O
ATOM   1467  N   LEU A 213      58.351 -16.959 267.697  1.00 24.62           N
ATOM   1468  CA  LEU A 213      57.495 -17.928 268.399  1.00 23.03           C
ATOM   1469  C   LEU A 213      58.168 -19.279 268.413  1.00 22.94           C
ATOM   1470  O   LEU A 213      58.046 -20.005 269.391  1.00 20.89           O
ATOM   1471  CB  LEU A 213      56.105 -18.035 267.761  1.00 22.59           C
ATOM   1472  CG  LEU A 213      55.310 -16.740 267.511  1.00 22.29           C
ATOM   1473  CD1 LEU A 213      53.933 -17.013 266.924  1.00 22.11           C
ATOM   1474  CD2 LEU A 213      55.183 -15.904 268.767  1.00 22.59           C
ATOM   1475  N   TRP A 214      58.890 -19.625 267.343  1.00 23.96           N
ATOM   1476  CA  TRP A 214      59.640 -20.892 267.358  1.00 25.35           C
ATOM   1477  C   TRP A 214      60.722 -20.884 268.459  1.00 26.52           C
ATOM   1478  O   TRP A 214      60.909 -21.885 269.156  1.00 28.32           O
ATOM   1479  CB  TRP A 214      60.248 -21.256 265.986  1.00 25.13           C
ATOM   1480  CG  TRP A 214      59.249 -21.723 264.926  1.00 24.37           C
ATOM   1481  CD1 TRP A 214      58.265 -20.979 264.382  1.00 25.14           C
ATOM   1482  CD2 TRP A 214      59.188 -22.995 264.277  1.00 24.60           C
ATOM   1483  NE1 TRP A 214      57.584 -21.689 263.450  1.00 25.53           N
ATOM   1484  CE2 TRP A 214      58.125 -22.939 263.362  1.00 25.32           C
ATOM   1485  CE3 TRP A 214      59.923 -24.193 264.385  1.00 26.18           C
ATOM   1486  CZ2 TRP A 214      57.771 -24.028 262.540  1.00 24.43           C
ATOM   1487  CZ3 TRP A 214      59.567 -25.290 263.564  1.00 24.46           C
ATOM   1488  CH2 TRP A 214      58.503 -25.185 262.657  1.00 24.20           C
ATOM   1489  N   VAL A 215      61.408 -19.755 268.635  1.00 26.86           N
ATOM   1490  CA  VAL A 215      62.473 -19.667 269.627  1.00 25.19           C
ATOM   1491  C   VAL A 215      61.873 -19.770 271.007  1.00 25.03           C
ATOM   1492  O   VAL A 215      62.385 -20.508 271.855  1.00 26.02           O
ATOM   1493  CB  VAL A 215      63.269 -18.356 269.484  1.00 25.74           C
ATOM   1494  CG1 VAL A 215      64.049 -18.038 270.751  1.00 25.55           C
ATOM   1495  CG2 VAL A 215      64.220 -18.451 268.304  1.00 25.45           C
ATOM   1496  N   TYR A 216      60.785 -19.037 271.245  1.00 24.95           N
ATOM   1497  CA  TYR A 216      60.079 -19.155 272.533  1.00 24.66           C
ATOM   1498  C   TYR A 216      59.635 -20.597 272.812  1.00 24.26           C
ATOM   1499  O   TYR A 216      59.809 -21.082 273.941  1.00 23.41           O
ATOM   1500  CB  TYR A 216      58.866 -18.226 272.622  1.00 24.91           C
ATOM   1501  CG  TYR A 216      58.282 -18.141 274.020  1.00 26.06           C
ATOM   1502  CD1 TYR A 216      57.310 -19.027 274.441  1.00 26.47           C
ATOM   1503  CD2 TYR A 216      58.715 -17.170 274.925  1.00 25.76           C
ATOM   1504  CE1 TYR A 216      56.775 -18.946 275.719  1.00 27.15           C
ATOM   1505  CE2 TYR A 216      58.190 -17.076 276.195  1.00 26.50           C
ATOM   1506  CZ  TYR A 216      57.220 -17.971 276.596  1.00 27.40           C
ATOM   1507  OH  TYR A 216      56.693 -17.903 277.873  1.00 27.13           O
ATOM   1508  N   ASP A 217      59.072 -21.282 271.809  1.00 23.89           N
ATOM   1509  CA  ASP A 217      58.577 -22.648 272.036  1.00 25.68           C
ATOM   1510  C   ASP A 217      59.717 -23.578 272.407  1.00 26.72           C
ATOM   1511  O   ASP A 217      59.557 -24.468 273.244  1.00 24.73           O
ATOM   1512  CB  ASP A 217      57.845 -23.211 270.823  1.00 25.35           C
ATOM   1513  CG  ASP A 217      56.534 -22.515 270.565  1.00 25.28           C
ATOM   1514  OD1 ASP A 217      56.004 -21.832 271.488  1.00 24.11           O
ATOM   1515  OD2 ASP A 217      56.043 -22.669 269.424  1.00 24.90           O
ATOM   1516  N   ARG A 218      60.873 -23.333 271.800  1.00 28.31           N
ATOM   1517  CA  ARG A 218      62.046 -24.147 272.034  1.00 30.78           C
ATOM   1518  C   ARG A 218      62.629 -23.933 273.453  1.00 29.66           C
ATOM   1519  O   ARG A 218      63.200 -24.847 274.048  1.00 26.63           O
```

Appendix 2

```
ATOM   1520  CB   ARG A 218      63.041 -23.886 270.910  1.00 35.31           C
ATOM   1521  CG   ARG A 218      64.474 -24.284 271.175  1.00 40.95           C
ATOM   1522  CD   ARG A 218      64.765 -25.770 271.101  1.00 44.48           C
ATOM   1523  NE   ARG A 218      66.224 -25.913 271.122  1.00 54.54           N
ATOM   1524  CZ   ARG A 218      67.017 -25.755 272.199  1.00 54.22           C
ATOM   1525  NH1  ARG A 218      66.526 -25.502 273.418  1.00 51.71           N
ATOM   1526  NH2  ARG A 218      68.330 -25.875 272.055  1.00 52.30           N
ATOM   1527  N    LEU A 219      62.432 -22.747 274.014  1.00 28.14           N
ATOM   1528  CA   LEU A 219      62.838 -22.488 275.390  1.00 27.63           C
ATOM   1529  C    LEU A 219      61.851 -22.983 276.449  1.00 27.71           C
ATOM   1530  O    LEU A 219      62.222 -23.076 277.628  1.00 25.28           O
ATOM   1531  CB   LEU A 219      63.043 -20.989 275.583  1.00 28.73           C
ATOM   1532  CG   LEU A 219      64.252 -20.439 274.823  1.00 30.05           C
ATOM   1533  CD1  LEU A 219      64.067 -18.980 274.494  1.00 30.79           C
ATOM   1534  CD2  LEU A 219      65.523 -20.647 275.628  1.00 30.41           C
ATOM   1535  N    HIS A 220      60.606 -23.288 276.054  1.00 27.48           N
ATOM   1536  CA   HIS A 220      59.534 -23.523 277.040  1.00 26.53           C
ATOM   1537  C    HIS A 220      58.600 -24.690 276.781  1.00 25.07           C
ATOM   1538  O    HIS A 220      57.769 -24.987 277.619  1.00 24.45           O
ATOM   1539  CB   HIS A 220      58.712 -22.228 277.232  1.00 26.61           C
ATOM   1540  CG   HIS A 220      59.491 -21.124 277.870  1.00 27.00           C
ATOM   1541  ND1  HIS A 220      59.830 -19.965 277.207  1.00 28.58           N
ATOM   1542  CD2  HIS A 220      60.047 -21.025 279.099  1.00 27.45           C
ATOM   1543  CE1  HIS A 220      60.539 -19.189 278.006  1.00 27.01           C
ATOM   1544  NE2  HIS A 220      60.682 -19.809 279.162  1.00 26.67           N
ATOM   1545  N    GLY A 221      58.734 -25.349 275.638  1.00 25.69           N
ATOM   1546  CA   GLY A 221      57.894 -26.496 275.280  1.00 25.32           C
ATOM   1547  C    GLY A 221      56.467 -26.167 274.919  1.00 26.29           C
ATOM   1548  O    GLY A 221      55.609 -27.019 275.013  1.00 29.59           O
ATOM   1549  N    THR A 222      56.221 -24.936 274.486  1.00 27.73           N
ATOM   1550  CA   THR A 222      54.889 -24.437 274.155  1.00 27.48           C
ATOM   1551  C    THR A 222      54.611 -24.691 272.681  1.00 27.36           C
ATOM   1552  O    THR A 222      55.421 -25.301 272.003  1.00 25.67           O
ATOM   1553  CB   THR A 222      54.807 -22.927 274.454  1.00 29.81           C
ATOM   1554  OG1  THR A 222      55.931 -22.243 273.846  1.00 31.66           O
ATOM   1555  CG2  THR A 222      54.820 -22.669 275.965  1.00 28.30           C
ATOM   1556  N    ASP A 223      53.474 -24.235 272.175  1.00 29.62           N
ATOM   1557  CA   ASP A 223      53.092 -24.566 270.801  1.00 32.59           C
ATOM   1558  C    ASP A 223      52.563 -23.342 270.063  1.00 32.66           C
ATOM   1559  O    ASP A 223      51.692 -23.464 269.190  1.00 32.36           O
ATOM   1560  CB   ASP A 223      52.056 -25.725 270.770  1.00 33.35           C
ATOM   1561  CG   ASP A 223      52.019 -26.474 269.399  1.00 36.35           C
ATOM   1562  OD1  ASP A 223      53.080 -26.688 268.782  1.00 36.36           O
ATOM   1563  OD2  ASP A 223      50.926 -26.859 268.924  1.00 39.53           O
ATOM   1564  N    TYR A 224      53.105 -22.171 270.412  1.00 32.90           N
ATOM   1565  CA   TYR A 224      52.796 -20.897 269.721  1.00 32.63           C
ATOM   1566  C    TYR A 224      53.086 -20.939 268.242  1.00 32.07           C
ATOM   1567  O    TYR A 224      52.452 -20.236 267.476  1.00 32.78           O
ATOM   1568  CB   TYR A 224      53.636 -19.759 270.280  1.00 32.99           C
ATOM   1569  CG   TYR A 224      53.221 -19.302 271.644  1.00 32.13           C
ATOM   1570  CD1  TYR A 224      51.962 -18.764 271.850  1.00 33.30           C
ATOM   1571  CD2  TYR A 224      54.082 -19.379 272.715  1.00 31.95           C
ATOM   1572  CE1  TYR A 224      51.554 -18.325 273.094  1.00 32.38           C
ATOM   1573  CE2  TYR A 224      53.689 -18.941 273.962  1.00 32.87           C
```

Appendix 2

```
ATOM   1574  CZ   TYR A 224      52.420 -18.422 274.139  1.00 33.05           C
ATOM   1575  OH   TYR A 224      52.018 -17.982 275.362  1.00 32.64           O
ATOM   1576  N    ARG A 225      54.065 -21.755 267.861  1.00 34.08           N
ATOM   1577  CA   ARG A 225      54.471 -21.921 266.458  1.00 34.64           C
ATOM   1578  C    ARG A 225      53.418 -22.564 265.592  1.00 31.91           C
ATOM   1579  O    ARG A 225      53.522 -22.505 264.375  1.00 30.71           O
ATOM   1580  CB   ARG A 225      55.762 -22.749 266.345  1.00 36.86           C
ATOM   1581  CG   ARG A 225      55.573 -24.208 265.950  1.00 38.45           C
ATOM   1582  CD   ARG A 225      56.695 -25.084 266.480  1.00 39.16           C
ATOM   1583  NE   ARG A 225      56.431 -25.333 267.889  1.00 40.28           N
ATOM   1584  CZ   ARG A 225      56.580 -26.497 268.504  1.00 39.11           C
ATOM   1585  NH1  ARG A 225      56.280 -26.587 269.802  1.00 41.37           N
ATOM   1586  NH2  ARG A 225      57.020 -27.562 267.848  1.00 37.36           N
ATOM   1587  N    ALA A 226      52.437 -23.209 266.221  1.00 31.72           N
ATOM   1588  CA   ALA A 226      51.331 -23.848 265.513  1.00 29.81           C
ATOM   1589  C    ALA A 226      50.639 -22.876 264.560  1.00 29.79           C
ATOM   1590  O    ALA A 226      50.187 -23.294 263.500  1.00 28.60           O
ATOM   1591  CB   ALA A 226      50.334 -24.427 266.500  1.00 29.78           C
ATOM   1592  N    ALA A 227      50.594 -21.582 264.910  1.00 31.04           N
ATOM   1593  CA   ALA A 227      50.018 -20.527 264.017  1.00 29.90           C
ATOM   1594  C    ALA A 227      50.734 -20.329 262.650  1.00 30.53           C
ATOM   1595  O    ALA A 227      50.159 -19.735 261.720  1.00 30.06           O
ATOM   1596  CB   ALA A 227      49.934 -19.204 264.751  1.00 28.66           C
ATOM   1597  N    THR A 228      51.955 -20.861 262.536  1.00 30.21           N
ATOM   1598  CA   THR A 228      52.789 -20.747 261.332  1.00 31.16           C
ATOM   1599  C    THR A 228      52.181 -21.360 260.047  1.00 32.42           C
ATOM   1600  O    THR A 228      52.249 -20.760 258.967  1.00 32.05           O
ATOM   1601  CB   THR A 228      54.186 -21.381 261.589  1.00 31.23           C
ATOM   1602  OG1  THR A 228      54.716 -20.914 262.843  1.00 31.29           O
ATOM   1603  CG2  THR A 228      55.167 -21.049 260.472  1.00 30.26           C
ATOM   1604  N    ARG A 229      51.606 -22.557 260.146  1.00 33.55           N
ATOM   1605  CA   ARG A 229      50.968 -23.164 258.982  1.00 33.66           C
ATOM   1606  C    ARG A 229      49.977 -22.174 258.313  1.00 31.28           C
ATOM   1607  O    ARG A 229      50.158 -21.823 257.159  1.00 27.80           O
ATOM   1608  CB   ARG A 229      50.326 -24.507 259.367  1.00 36.27           C
ATOM   1609  CG   ARG A 229      49.588 -25.267 258.262  1.00 39.59           C
ATOM   1610  CD   ARG A 229      50.284 -25.263 256.903  1.00 43.09           C
ATOM   1611  NE   ARG A 229      51.719 -25.548 256.978  1.00 48.89           N
ATOM   1612  CZ   ARG A 229      52.605 -25.306 256.000  1.00 55.86           C
ATOM   1613  NH1  ARG A 229      52.213 -24.772 254.840  1.00 59.14           N
ATOM   1614  NH2  ARG A 229      53.901 -25.589 256.178  1.00 54.62           N
ATOM   1615  N    ALA A 230      48.986 -21.670 259.050  1.00 30.77           N
ATOM   1616  CA   ALA A 230      48.009 -20.724 258.467  1.00 30.37           C
ATOM   1617  C    ALA A 230      48.690 -19.553 257.779  1.00 30.30           C
ATOM   1618  O    ALA A 230      48.297 -19.142 256.693  1.00 31.53           O
ATOM   1619  CB   ALA A 230      47.042 -20.205 259.517  1.00 28.70           C
ATOM   1620  N    TRP A 231      49.719 -19.019 258.419  1.00 30.07           N
ATOM   1621  CA   TRP A 231      50.422 -17.867 257.879  1.00 30.08           C
ATOM   1622  C    TRP A 231      51.110 -18.203 256.575  1.00 30.16           C
ATOM   1623  O    TRP A 231      51.087 -17.400 255.643  1.00 29.63           O
ATOM   1624  CB   TRP A 231      51.442 -17.331 258.886  1.00 30.10           C
ATOM   1625  CG   TRP A 231      52.229 -16.207 258.357  1.00 28.60           C
ATOM   1626  CD1  TRP A 231      51.761 -14.992 258.007  1.00 29.88           C
ATOM   1627  CD2  TRP A 231      53.628 -16.190 258.109  1.00 27.50           C
```

Appendix 2

```
ATOM   1628  NE1 TRP A 231      52.790 -14.203 257.548  1.00 29.97           N
ATOM   1629  CE2 TRP A 231      53.948 -14.924 257.604  1.00 27.76           C
ATOM   1630  CE3 TRP A 231      54.649 -17.116 258.289  1.00 28.03           C
ATOM   1631  CZ2 TRP A 231      55.244 -14.560 257.261  1.00 28.59           C
ATOM   1632  CZ3 TRP A 231      55.946 -16.755 257.933  1.00 28.66           C
ATOM   1633  CH2 TRP A 231      56.227 -15.489 257.422  1.00 27.74           C
ATOM   1634  N   LEU A 232      51.714 -19.390 256.511  1.00 30.78           N
ATOM   1635  CA  LEU A 232      52.427 -19.801 255.309  1.00 31.43           C
ATOM   1636  C   LEU A 232      51.456 -19.987 254.148  1.00 33.21           C
ATOM   1637  O   LEU A 232      51.776 -19.605 253.023  1.00 36.52           O
ATOM   1638  CB  LEU A 232      53.258 -21.058 255.554  1.00 30.53           C
ATOM   1639  CG  LEU A 232      54.474 -20.866 256.464  1.00 29.83           C
ATOM   1640  CD1 LEU A 232      55.141 -22.210 256.731  1.00 30.05           C
ATOM   1641  CD2 LEU A 232      55.476 -19.882 255.872  1.00 29.26           C
ATOM   1642  N   ASP A 233      50.273 -20.546 254.437  1.00 32.96           N
ATOM   1643  CA  ASP A 233      49.175 -20.658 253.464  1.00 32.22           C
ATOM   1644  C   ASP A 233      48.671 -19.277 253.051  1.00 32.60           C
ATOM   1645  O   ASP A 233      48.348 -19.047 251.887  1.00 32.85           O
ATOM   1646  CB  ASP A 233      47.976 -21.438 254.039  1.00 30.71           C
ATOM   1647  CG  ASP A 233      48.305 -22.866 254.369  1.00 31.09           C
ATOM   1648  OD1 ASP A 233      49.354 -23.362 253.921  1.00 30.56           O
ATOM   1649  OD2 ASP A 233      47.515 -23.508 255.098  1.00 32.76           O
ATOM   1650  N   PHE A 234      48.564 -18.370 254.009  1.00 31.77           N
ATOM   1651  CA  PHE A 234      49.028 -17.061 253.702  1.00 33.33           C
ATOM   1652  C   PHE A 234      48.961 -16.313 252.762  1.00 34.29           C
ATOM   1653  O   PHE A 234      48.531 -15.794 251.737  1.00 35.52           O
ATOM   1654  CB  PHE A 234      47.805 -16.232 254.957  1.00 33.02           C
ATOM   1655  CG  PHE A 234      47.508 -14.807 254.661  1.00 34.46           C
ATOM   1656  CD1 PHE A 234      46.308 -14.455 254.040  1.00 37.20           C
ATOM   1657  CD2 PHE A 234      48.431 -13.818 254.944  1.00 33.34           C
ATOM   1658  CE1 PHE A 234      46.027 -13.122 253.740  1.00 36.98           C
ATOM   1659  CE2 PHE A 234      48.160 -12.491 254.655  1.00 34.22           C
ATOM   1660  CZ  PHE A 234      46.961 -12.137 254.047  1.00 36.31           C
ATOM   1661  N   ILE A 235      50.245 -16.275 253.093  1.00 34.24           N
ATOM   1662  CA  ILE A 235      51.176 -15.485 252.290  1.00 34.46           C
ATOM   1663  C   ILE A 235      51.368 -16.016 250.874  1.00 33.91           C
ATOM   1664  O   ILE A 235      51.920 -15.310 250.045  1.00 34.66           O
ATOM   1665  CB  ILE A 235      52.555 -15.330 252.957  1.00 34.17           C
ATOM   1666  CG1 ILE A 235      53.283 -16.670 253.004  1.00 32.43           C
ATOM   1667  CG2 ILE A 235      52.410 -14.700 254.346  1.00 33.78           C
ATOM   1668  CD1 ILE A 235      54.617 -16.553 253.668  1.00 32.62           C
ATOM   1669  N   GLN A 236      50.928 -17.244 250.602  1.00 34.69           N
ATOM   1670  CA  GLN A 236      50.906 -17.766 249.238  1.00 35.18           C
ATOM   1671  C   GLN A 236      49.675 -17.353 248.426  1.00 37.27           C
ATOM   1672  O   GLN A 236      49.763 -17.254 247.215  1.00 39.02           O
ATOM   1673  CB  GLN A 236      51.077 -19.280 249.244  1.00 36.33           C
ATOM   1674  CG  GLN A 236      52.528 -19.663 249.454  1.00 37.92           C
ATOM   1675  CD  GLN A 236      52.731 -21.093 249.911  1.00 40.14           C
ATOM   1676  OE1 GLN A 236      52.201 -21.520 250.938  1.00 40.92           O
ATOM   1677  NE2 GLN A 236      53.556 -21.827 249.177  1.00 40.17           N
ATOM   1678  N   LYS A 237      48.540 -17.105 249.079  1.00 40.32           N
ATOM   1679  CA  LYS A 237      47.286 -16.733 248.382  1.00 41.28           C
ATOM   1680  C   LYS A 237      47.171 -15.191 248.241  1.00 43.94           C
ATOM   1681  O   LYS A 237      46.525 -14.535 249.062  1.00 44.37           O
```

Appendix 2

```
ATOM   1682  CB  LYS A 237      46.047 -17.337 249.110  1.00 36.67           C
ATOM   1683  N   ASP A 238      47.809 -14.637 247.202  1.00 46.68           N
ATOM   1684  CA  ASP A 238      47.734 -13.191 246.826  1.00 49.87           C
ATOM   1685  C   ASP A 238      48.910 -12.335 247.262  1.00 49.88           C
ATOM   1686  O   ASP A 238      49.111 -11.245 246.710  1.00 53.97           O
ATOM   1687  CB  ASP A 238      46.448 -12.476 247.301  1.00 51.99           C
ATOM   1688  CG  ASP A 238      45.373 -12.425 246.239  1.00 53.60           C
ATOM   1689  OD1 ASP A 238      45.615 -12.852 245.086  1.00 54.73           O
ATOM   1690  OD2 ASP A 238      44.276 -11.942 246.575  1.00 52.98           O
ATOM   1691  N   LEU A 239      49.674 -12.789 248.253  1.00 46.47           N
ATOM   1692  CA  LEU A 239      50.865 -12.040 248.655  1.00 39.82           C
ATOM   1693  C   LEU A 239      52.116 -12.440 247.881  1.00 36.88           C
ATOM   1694  O   LEU A 239      53.100 -11.724 247.898  1.00 37.24           O
ATOM   1695  CB  LEU A 239      51.065 -12.106 250.170  1.00 37.70           C
ATOM   1696  CG  LEU A 239      50.305 -10.955 250.852  1.00 37.91           C
ATOM   1697  CD1 LEU A 239      50.364 -11.053 252.360  1.00 37.66           C
ATOM   1698  CD2 LEU A 239      50.841  -9.597 250.417  1.00 38.49           C
ATOM   1699  N   ILE A 240      52.063 -13.559 247.174  1.00 36.29           N
ATOM   1700  CA  ILE A 240      53.179 -14.006 246.340  1.00 35.29           C
ATOM   1701  C   ILE A 240      52.747 -14.287 244.894  1.00 35.63           C
ATOM   1702  O   ILE A 240      51.633 -14.713 244.626  1.00 34.72           O
ATOM   1703  CB  ILE A 240      53.832 -15.270 246.941  1.00 33.74           C
ATOM   1704  CG1 ILE A 240      55.287 -15.390 246.488  1.00 33.44           C
ATOM   1705  CG2 ILE A 240      53.060 -16.524 246.566  1.00 34.62           C
ATOM   1706  CD1 ILE A 240      55.998 -16.631 246.990  1.00 32.50           C
ATOM   1707  N   ASP A 241      53.654 -14.034 243.969  1.00 38.03           N
ATOM   1708  CA  ASP A 241      53.524 -14.508 242.600  1.00 41.39           C
ATOM   1709  C   ASP A 241      54.279 -15.835 242.526  1.00 42.26           C
ATOM   1710  O   ASP A 241      55.503 -15.852 242.637  1.00 43.06           O
ATOM   1711  CB  ASP A 241      54.118 -13.486 241.622  1.00 42.43           C
ATOM   1712  CG  ASP A 241      54.284 -14.041 240.220  1.00 43.55           C
ATOM   1713  OD1 ASP A 241      54.387 -15.283 240.046  1.00 44.41           O
ATOM   1714  OD2 ASP A 241      54.331 -13.219 239.285  1.00 43.28           O
ATOM   1715  N   PRO A 242      53.556 -16.955 242.345  1.00 40.85           N
ATOM   1716  CA  PRO A 242      54.261 -18.233 242.474  1.00 38.88           C
ATOM   1717  C   PRO A 242      55.275 -18.553 241.369  1.00 37.74           C
ATOM   1718  O   PRO A 242      56.273 -19.210 241.661  1.00 35.52           O
ATOM   1719  CB  PRO A 242      53.123 -19.267 242.489  1.00 38.99           C
ATOM   1720  CG  PRO A 242      51.910 -18.505 242.887  1.00 39.63           C
ATOM   1721  CD  PRO A 242      52.095 -17.143 242.284  1.00 40.06           C
ATOM   1722  N   GLU A 243      55.025 -18.117 240.129  1.00 38.59           N
ATOM   1723  CA  GLU A 243      55.908 -18.455 238.996  1.00 38.34           C
ATOM   1724  C   GLU A 243      57.249 -17.730 239.117  1.00 39.89           C
ATOM   1725  O   GLU A 243      58.307 -18.309 238.837  1.00 39.38           O
ATOM   1726  CB  GLU A 243      55.252 -18.125 237.647  1.00 37.93           C
ATOM   1727  N   ARG A 244      57.201 -16.471 239.550  1.00 38.71           N
ATOM   1728  CA  ARG A 244      58.401 -15.640 239.664  1.00 38.23           C
ATOM   1729  C   ARG A 244      59.134 -15.788 241.041  1.00 38.78           C
ATOM   1730  O   ARG A 244      60.296 -15.390 241.213  1.00 32.77           O
ATOM   1731  CB  ARG A 244      58.026 -14.189 239.356  1.00 38.67           C
ATOM   1732  CG  ARG A 244      57.657 -13.958 237.894  1.00 38.90           C
ATOM   1733  CD  ARG A 244      57.527 -12.476 237.544  1.00 41.90           C
ATOM   1734  NE  ARG A 244      56.402 -11.842 238.255  1.00 44.11           N
ATOM   1735  CZ  ARG A 244      56.096 -10.536 238.245  1.00 40.32           C
```

Appendix 2

```
ATOM   1736  NH1 ARG A 244      56.823   -9.662 237.558  1.00 38.14           N
ATOM   1737  NH2 ARG A 244      55.045  -10.101 238.943  1.00 40.62           N
ATOM   1738  N   GLY A 245      58.465  -16.405 242.010  1.00 39.45           N
ATOM   1739  CA  GLY A 245      59.073  -16.659 243.306  1.00 38.29           C
ATOM   1740  C   GLY A 245      59.274  -15.389 244.106  1.00 37.63           C
ATOM   1741  O   GLY A 245      60.211  -15.304 244.884  1.00 38.94           O
ATOM   1742  N   ALA A 246      58.377  -14.420 243.940  1.00 35.22           N
ATOM   1743  CA  ALA A 246      58.538  -13.115 244.549  1.00 34.91           C
ATOM   1744  C   ALA A 246      57.296  -12.674 245.313  1.00 33.11           C
ATOM   1745  O   ALA A 246      56.197  -12.885 244.866  1.00 33.01           O
ATOM   1746  CB  ALA A 246      58.879  -12.096 243.473  1.00 37.24           C
ATOM   1747  N   PHE A 247      57.499  -12.060 246.476  1.00 33.14           N
ATOM   1748  CA  PHE A 247      56.417  -11.446 247.218  1.00 32.76           C
ATOM   1749  C   PHE A 247      56.165  -10.056 246.677  1.00 31.55           C
ATOM   1750  O   PHE A 247      57.060   -9.420 246.144  1.00 30.91           O
ATOM   1751  CB  PHE A 247      56.747  -11.376 248.706  1.00 33.70           C
ATOM   1752  CG  PHE A 247      56.769  -12.713 249.361  1.00 34.88           C
ATOM   1753  CD1 PHE A 247      55.587  -13.305 249.788  1.00 35.33           C
ATOM   1754  CD2 PHE A 247      57.958  -13.409 249.511  1.00 34.80           C
ATOM   1755  CE1 PHE A 247      55.600  -14.559 250.372  1.00 34.68           C
ATOM   1756  CE2 PHE A 247      57.979  -14.663 250.103  1.00 34.62           C
ATOM   1757  CZ  PHE A 247      56.798  -15.241 250.528  1.00 33.83           C
ATOM   1758  N   TYR A 248      54.926   -9.604 246.804  1.00 31.74           N
ATOM   1759  CA  TYR A 248      54.584   -8.238 246.494  1.00 32.27           C
ATOM   1760  C   TYR A 248      55.065   -7.414 247.661  1.00 32.61           C
ATOM   1761  O   TYR A 248      55.481   -7.949 248.688  1.00 31.96           O
ATOM   1762  CB  TYR A 248      53.084   -8.091 246.228  1.00 33.25           C
ATOM   1763  CG  TYR A 248      52.724   -8.662 244.881  1.00 35.41           C
ATOM   1764  CD1 TYR A 248      52.861   -7.891 243.723  1.00 37.70           C
ATOM   1765  CD2 TYR A 248      52.311   -9.980 244.742  1.00 35.71           C
ATOM   1766  CE1 TYR A 248      52.562   -8.405 242.475  1.00 36.76           C
ATOM   1767  CE2 TYR A 248      52.023  -10.505 243.493  1.00 35.82           C
ATOM   1768  CZ  TYR A 248      52.147   -9.709 242.368  1.00 36.19           C
ATOM   1769  OH  TYR A 248      51.876  -10.206 241.121  1.00 37.30           O
ATOM   1770  N   LEU A 249      55.040   -6.106 247.483  1.00 33.73           N
ATOM   1771  CA  LEU A 249      55.667   -5.192 248.422  1.00 34.45           C
ATOM   1772  C   LEU A 249      54.992   -5.158 249.794  1.00 32.20           C
ATOM   1773  O   LEU A 249      55.677   -5.130 250.806  1.00 33.16           O
ATOM   1774  CB  LEU A 249      55.698   -3.802 247.804  1.00 37.60           C
ATOM   1775  CG  LEU A 249      56.644   -2.764 248.380  1.00 40.32           C
ATOM   1776  CD1 LEU A 249      58.093   -3.220 248.325  1.00 42.76           C
ATOM   1777  CD2 LEU A 249      56.468   -1.498 247.569  1.00 41.82           C
ATOM   1778  N   SER A 250      53.664   -5.184 249.818  1.00 30.74           N
ATOM   1779  CA  SER A 250      52.891   -5.071 251.054  1.00 29.95           C
ATOM   1780  C   SER A 250      51.407   -5.348 250.844  1.00 31.65           C
ATOM   1781  O   SER A 250      50.908   -5.226 249.730  1.00 35.61           O
ATOM   1782  CB  SER A 250      53.036   -3.666 251.601  1.00 28.65           C
ATOM   1783  OG  SER A 250      52.979   -2.746 250.546  1.00 28.00           O
ATOM   1784  N   TYR A 251      50.705   -5.681 251.918  1.00 31.46           N
ATOM   1785  CA  TYR A 251      49.258   -5.901 251.896  1.00 33.14           C
ATOM   1786  C   TYR A 251      48.650   -4.811 252.752  1.00 31.75           C
ATOM   1787  O   TYR A 251      49.348   -4.282 253.610  1.00 31.59           O
ATOM   1788  CB  TYR A 251      48.959   -7.296 252.466  1.00 36.26           C
ATOM   1789  CG  TYR A 251      47.503   -7.610 252.791  1.00 39.42           C
```

Appendix 2

```
ATOM   1790  CD1 TYR A 251      46.541  -7.688 251.779  1.00 40.85           C
ATOM   1791  CD2 TYR A 251      47.095  -7.890 254.110  1.00 39.97           C
ATOM   1792  CE1 TYR A 251      45.209  -7.988 252.071  1.00 42.30           C
ATOM   1793  CE2 TYR A 251      45.764  -8.192 254.409  1.00 40.41           C
ATOM   1794  CZ  TYR A 251      44.830  -8.242 253.387  1.00 40.92           C
ATOM   1795  OH  TYR A 251      43.519  -8.533 253.655  1.00 41.04           O
ATOM   1796  N   HIS A 252      47.377  -4.465 252.537  1.00 30.93           N
ATOM   1797  CA  HIS A 252      46.714  -3.380 253.300  1.00 30.86           C
ATOM   1798  C   HIS A 252      45.260  -3.706 253.602  1.00 31.64           C
ATOM   1799  O   HIS A 252      44.392  -3.396 252.815  1.00 32.01           O
ATOM   1800  CB  HIS A 252      46.815  -2.051 252.548  1.00 30.26           C
ATOM   1801  CG  HIS A 252      48.220  -1.676 252.224  1.00 30.80           C
ATOM   1802  ND1 HIS A 252      49.042  -1.013 253.112  1.00 31.01           N
ATOM   1803  CD2 HIS A 252      48.980  -1.949 251.138  1.00 31.72           C
ATOM   1804  CE1 HIS A 252      50.239  -0.865 252.571  1.00 31.46           C
ATOM   1805  NE2 HIS A 252      50.230  -1.428 251.376  1.00 31.75           N
ATOM   1806  N   PRO A 253      44.995  -4.340 254.751  1.00 34.41           N
ATOM   1807  CA  PRO A 253      43.693  -4.960 255.077  1.00 35.15           C
ATOM   1808  C   PRO A 253      42.396  -4.127 255.008  1.00 35.17           C
ATOM   1809  O   PRO A 253      41.366  -4.699 254.659  1.00 34.79           O
ATOM   1810  CB  PRO A 253      43.882  -5.496 256.507  1.00 34.64           C
ATOM   1811  CG  PRO A 253      45.286  -5.207 256.893  1.00 35.84           C
ATOM   1812  CD  PRO A 253      46.051  -4.790 255.670  1.00 35.47           C
ATOM   1813  N   GLU A 254      42.402  -2.835 255.349  1.00 35.50           N
ATOM   1814  CA  GLU A 254      41.138  -2.059 255.297  1.00 35.54           C
ATOM   1815  C   GLU A 254      40.636  -2.010 253.857  1.00 36.55           C
ATOM   1816  O   GLU A 254      39.446  -2.188 253.586  1.00 38.84           O
ATOM   1817  CB  GLU A 254      41.269  -0.643 255.878  1.00 33.56           C
ATOM   1818  N   SER A 255      41.582  -1.826 252.948  1.00 36.99           N
ATOM   1819  CA  SER A 255      41.338  -1.643 251.526  1.00 35.97           C
ATOM   1820  C   SER A 255      41.385  -2.954 250.690  1.00 35.20           C
ATOM   1821  O   SER A 255      40.971  -2.959 249.532  1.00 33.97           O
ATOM   1822  CB  SER A 255      42.378  -0.625 251.003  1.00 37.08           C
ATOM   1823  OG  SER A 255      43.512  -0.522 251.882  1.00 37.32           O
ATOM   1824  N   GLY A 256      41.900  -4.046 251.265  1.00 33.92           N
ATOM   1825  CA  GLY A 256      42.150  -5.289 250.524  1.00 31.87           C
ATOM   1826  C   GLY A 256      43.319  -5.224 249.544  1.00 30.94           C
ATOM   1827  O   GLY A 256      43.706  -6.238 248.963  1.00 29.39           O
ATOM   1828  N   ALA A 257      43.901  -4.037 249.371  1.00 30.72           N
ATOM   1829  CA  ALA A 257      44.907  -3.791 248.316  1.00 29.77           C
ATOM   1830  C   ALA A 257      46.269  -4.479 248.534  1.00 28.18           C
ATOM   1831  O   ALA A 257      46.731  -4.617 249.655  1.00 27.92           O
ATOM   1832  CB  ALA A 257      45.108  -2.293 248.151  1.00 29.53           C
ATOM   1833  N   VAL A 258      46.905  -4.887 247.445  1.00 27.65           N
ATOM   1834  CA  VAL A 258      48.266  -5.424 247.467  1.00 27.91           C
ATOM   1835  C   VAL A 258      49.107  -4.575 246.519  1.00 28.42           C
ATOM   1836  O   VAL A 258      48.912  -4.666 245.318  1.00 29.45           O
ATOM   1837  CB  VAL A 258      48.275  -6.893 246.980  1.00 28.13           C
ATOM   1838  CG1 VAL A 258      49.688  -7.437 246.827  1.00 28.02           C
ATOM   1839  CG2 VAL A 258      47.447  -7.778 247.910  1.00 29.11           C
ATOM   1840  N   LYS A 259      50.026  -3.743 247.015  1.00 29.31           N
ATOM   1841  CA  LYS A 259      50.865  -2.932 246.092  1.00 29.63           C
ATOM   1842  C   LYS A 259      51.421  -3.848 245.011  1.00 29.69           C
ATOM   1843  O   LYS A 259      51.985  -4.905 245.331  1.00 27.61           O
```

Appendix 2

```
ATOM   1844  CB  LYS A 259      52.010  -2.183 246.793  1.00 30.45           C
ATOM   1845  CG  LYS A 259      51.533  -1.108 247.756  1.00 31.71           C
ATOM   1846  CD  LYS A 259      52.643  -0.242 248.328  1.00 32.77           C
ATOM   1847  CE  LYS A 259      52.031   0.835 249.213  1.00 35.82           C
ATOM   1848  NZ  LYS A 259      53.000   1.541 250.106  1.00 40.63           N
ATOM   1849  N   PRO A 260      51.230  -3.464 243.726  1.00 30.67           N
ATOM   1850  CA  PRO A 260      51.412  -4.417 242.625  1.00 30.19           C
ATOM   1851  C   PRO A 260      52.830  -4.614 242.132  1.00 29.61           C
ATOM   1852  O   PRO A 260      53.007  -5.167 241.064  1.00 33.25           O
ATOM   1853  CB  PRO A 260      50.544  -3.824 241.511  1.00 29.78           C
ATOM   1854  CG  PRO A 260      50.606  -2.361 241.761  1.00 30.63           C
ATOM   1855  CD  PRO A 260      50.623  -2.202 243.255  1.00 30.10           C
ATOM   1856  N   TRP A 261      53.827  -4.201 242.893  1.00 28.30           N
ATOM   1857  CA  TRP A 261      55.219  -4.387 242.496  1.00 28.17           C
ATOM   1858  C   TRP A 261      55.822  -5.489 243.299  1.00 26.59           C
ATOM   1859  O   TRP A 261      55.602  -5.557 244.486  1.00 29.33           O
ATOM   1860  CB  TRP A 261      56.019  -3.123 242.777  1.00 28.70           C
ATOM   1861  CG  TRP A 261      55.512  -1.984 242.043  1.00 29.82           C
ATOM   1862  CD1 TRP A 261      55.765  -1.698 240.757  1.00 31.82           C
ATOM   1863  CD2 TRP A 261      54.646  -0.961 242.523  1.00 30.21           C
ATOM   1864  NE1 TRP A 261      55.119  -0.562 240.391  1.00 31.59           N
ATOM   1865  CE2 TRP A 261      54.420  -0.083 241.460  1.00 30.70           C
ATOM   1866  CE3 TRP A 261      54.042  -0.698 243.746  1.00 30.91           C
ATOM   1867  CZ2 TRP A 261      53.607   1.041 241.573  1.00 29.88           C
ATOM   1868  CZ3 TRP A 261      53.229   0.430 243.859  1.00 30.35           C
ATOM   1869  CH2 TRP A 261      53.023   1.277 242.780  1.00 29.89           C
ATOM   1870  N   ILE A 262      56.608  -6.343 242.683  1.00 25.53           N
ATOM   1871  CA  ILE A 262      57.330  -7.323 243.458  1.00 25.81           C
ATOM   1872  C   ILE A 262      58.609  -6.698 243.996  1.00 27.29           C
ATOM   1873  O   ILE A 262      59.074  -5.666 243.481  1.00 27.85           O
ATOM   1874  CB  ILE A 262      57.632  -8.591 242.657  1.00 25.79           C
ATOM   1875  CG1 ILE A 262      58.356  -8.270 241.369  1.00 25.04           C
ATOM   1876  CG2 ILE A 262      56.334  -9.307 242.324  1.00 26.31           C
ATOM   1877  CD1 ILE A 262      58.663  -9.504 240.569  1.00 25.84           C
ATOM   1878  N   SER A 263      59.158  -7.315 245.047  1.00 27.61           N
ATOM   1879  CA  SER A 263      60.309  -6.766 245.777  1.00 27.11           C
ATOM   1880  C   SER A 263      61.304  -7.833 246.202  1.00 27.97           C
ATOM   1881  O   SER A 263      60.970  -8.768 246.965  1.00 27.11           O
ATOM   1882  CB  SER A 263      59.845  -6.021 247.017  1.00 26.84           C
ATOM   1883  OG  SER A 263      60.905  -5.832 247.939  1.00 26.31           O
ATOM   1884  N   ALA A 264      62.538  -7.648 245.736  1.00 26.90           N
ATOM   1885  CA  ALA A 264      63.611  -8.590 245.983  1.00 27.00           C
ATOM   1886  C   ALA A 264      64.082  -8.609 247.420  1.00 26.65           C
ATOM   1887  O   ALA A 264      64.342  -9.678 247.995  1.00 29.87           O
ATOM   1888  CB  ALA A 264      64.781  -8.271 245.084  1.00 28.46           C
ATOM   1889  N   TYR A 265      64.225  -7.443 248.015  1.00 24.32           N
ATOM   1890  CA  TYR A 265      64.795  -7.420 249.322  1.00 23.89           C
ATOM   1891  C   TYR A 265      63.756  -7.996 250.288  1.00 22.82           C
ATOM   1892  O   TYR A 265      64.089  -8.730 251.195  1.00 22.04           O
ATOM   1893  CB  TYR A 265      65.295  -6.012 249.685  1.00 25.34           C
ATOM   1894  CG  TYR A 265      64.361  -5.248 250.563  1.00 26.78           C
ATOM   1895  CD1 TYR A 265      64.355  -5.453 251.932  1.00 25.68           C
ATOM   1896  CD2 TYR A 265      63.443  -4.344 250.019  1.00 28.25           C
ATOM   1897  CE1 TYR A 265      63.474  -4.774 252.742  1.00 26.87           C
```

Appendix 2

```
ATOM   1898  CE2 TYR A 265      62.568  -3.662 250.826  1.00 27.74           C
ATOM   1899  CZ  TYR A 265      62.589  -3.889 252.179  1.00 27.34           C
ATOM   1900  OH  TYR A 265      61.726  -3.208 252.974  1.00 29.52           O
ATOM   1901  N   THR A 266      62.488  -7.681 250.064  1.00 24.46           N
ATOM   1902  CA  THR A 266      61.383  -8.230 250.850  1.00 23.63           C
ATOM   1903  C   THR A 266      61.433  -9.744 250.775  1.00 24.27           C
ATOM   1904  O   THR A 266      61.429 -10.439 251.793  1.00 23.69           O
ATOM   1905  CB  THR A 266      60.043  -7.775 250.275  1.00 23.10           C
ATOM   1906  OG1 THR A 266      59.957  -6.351 250.353  1.00 25.37           O
ATOM   1907  CG2 THR A 266      58.894  -8.387 251.025  1.00 22.77           C
ATOM   1908  N   THR A 267      61.501 -10.237 249.545  1.00 24.92           N
ATOM   1909  CA  THR A 267      61.525 -11.661 249.290  1.00 25.60           C
ATOM   1910  C   THR A 267      62.746 -12.355 249.875  1.00 25.76           C
ATOM   1911  O   THR A 267      62.599 -13.334 250.577  1.00 26.59           O
ATOM   1912  CB  THR A 267      61.450 -11.965 247.783  1.00 25.81           C
ATOM   1913  OG1 THR A 267      60.295 -11.321 247.221  1.00 24.95           O
ATOM   1914  CG2 THR A 267      61.392 -13.495 247.549  1.00 25.41           C
ATOM   1915  N   ALA A 268      63.940 -11.845 249.611  1.00 26.84           N
ATOM   1916  CA  ALA A 268      65.159 -12.522 250.083  1.00 27.84           C
ATOM   1917  C   ALA A 268      65.179 -12.706 251.614  1.00 27.84           C
ATOM   1918  O   ALA A 268      65.448 -13.796 252.130  1.00 28.85           O
ATOM   1919  CB  ALA A 268      66.390 -11.757 249.617  1.00 27.94           C
ATOM   1920  N   TRP A 269      64.889 -11.632 252.328  1.00 27.57           N
ATOM   1921  CA  TRP A 269      64.793 -11.665 253.780  1.00 29.75           C
ATOM   1922  C   TRP A 269      63.770 -12.746 254.192  1.00 30.10           C
ATOM   1923  O   TRP A 269      64.097 -13.662 254.956  1.00 28.21           O
ATOM   1924  CB  TRP A 269      64.392 -10.257 254.245  1.00 30.64           C
ATOM   1925  CG  TRP A 269      64.058 -10.006 255.682  1.00 30.12           C
ATOM   1926  CD1 TRP A 269      63.763 -10.919 256.648  1.00 30.91           C
ATOM   1927  CD2 TRP A 269      63.891  -8.708 256.289  1.00 31.90           C
ATOM   1928  NE1 TRP A 269      63.464 -10.282 257.833  1.00 32.49           N
ATOM   1929  CE2 TRP A 269      63.527  -8.919 257.637  1.00 32.66           C
ATOM   1930  CE3 TRP A 269      64.012  -7.382 255.820  1.00 31.01           C
ATOM   1931  CZ2 TRP A 269      63.292  -7.851 258.526  1.00 29.85           C
ATOM   1932  CZ3 TRP A 269      63.769  -6.321 256.713  1.00 30.05           C
ATOM   1933  CH2 TRP A 269      63.423  -6.571 258.046  1.00 29.90           C
ATOM   1934  N   THR A 270      62.557 -12.650 253.635  1.00 30.25           N
ATOM   1935  CA  THR A 270      61.423 -13.473 254.048  1.00 26.92           C
ATOM   1936  C   THR A 270      61.760 -14.930 253.828  1.00 25.24           C
ATOM   1937  O   THR A 270      61.629 -15.735 254.721  1.00 23.32           O
ATOM   1938  CB  THR A 270      60.115 -13.090 253.298  1.00 26.48           C
ATOM   1939  OG1 THR A 270      59.826 -11.694 253.471  1.00 25.89           O
ATOM   1940  CG2 THR A 270      58.947 -13.859 253.847  1.00 25.91           C
ATOM   1941  N   LEU A 271      62.224 -15.270 252.642  1.00 26.73           N
ATOM   1942  CA  LEU A 271      62.632 -16.659 252.372  1.00 27.80           C
ATOM   1943  C   LEU A 271      63.696 -17.127 253.347  1.00 29.02           C
ATOM   1944  O   LEU A 271      63.699 -18.283 253.743  1.00 30.42           O
ATOM   1945  CB  LEU A 271      63.162 -16.836 250.957  1.00 26.19           C
ATOM   1946  CG  LEU A 271      62.104 -16.659 249.879  1.00 27.16           C
ATOM   1947  CD1 LEU A 271      62.693 -16.888 248.497  1.00 26.33           C
ATOM   1948  CD2 LEU A 271      60.947 -17.622 250.129  1.00 28.92           C
ATOM   1949  N   ALA A 272      64.591 -16.236 253.752  1.00 28.77           N
ATOM   1950  CA  ALA A 272      65.650 -16.659 254.644  1.00 29.03           C
ATOM   1951  C   ALA A 272      65.067 -17.087 255.978  1.00 28.83           C
```

Appendix 2

```
ATOM   1952  O    ALA A 272      65.416  -18.135  256.524  1.00  30.91           O
ATOM   1953  CB   ALA A 272      66.665  -15.551  254.829  1.00  29.96           C
ATOM   1954  N    MET A 273      64.149  -16.293  256.499  1.00  29.37           N
ATOM   1955  CA   MET A 273      63.580  -16.580  257.807  1.00  29.10           C
ATOM   1956  C    MET A 273      62.668  -17.794  257.747  1.00  29.94           C
ATOM   1957  O    MET A 273      62.672  -18.643  258.639  1.00  29.74           O
ATOM   1958  CB   MET A 273      62.836  -15.365  258.311  1.00  28.80           C
ATOM   1959  CG   MET A 273      63.752  -14.168  258.449  1.00  29.69           C
ATOM   1960  SD   MET A 273      63.575  -13.382  260.055  1.00  32.80           S
ATOM   1961  CE   MET A 273      64.975  -12.265  260.001  1.00  33.77           C
ATOM   1962  N    VAL A 274      61.905  -17.886  256.666  1.00  31.06           N
ATOM   1963  CA   VAL A 274      60.990  -18.996  256.472  1.00  29.91           C
ATOM   1964  C    VAL A 274      61.769  -20.321  256.357  1.00  29.86           C
ATOM   1965  O    VAL A 274      61.369  -21.329  256.940  1.00  27.67           O
ATOM   1966  CB   VAL A 274      60.074  -18.736  255.266  1.00  28.82           C
ATOM   1967  CG1  VAL A 274      59.317  -20.001  254.873  1.00  30.35           C
ATOM   1968  CG2  VAL A 274      59.097  -17.633  255.603  1.00  26.87           C
ATOM   1969  N    HIS A 275      62.911  -20.302  255.669  1.00  30.29           N
ATOM   1970  CA   HIS A 275      63.713  -21.512  255.526  1.00  30.47           C
ATOM   1971  C    HIS A 275      63.957  -22.195  256.869  1.00  29.42           C
ATOM   1972  O    HIS A 275      64.131  -23.408  256.904  1.00  29.36           O
ATOM   1973  CB   HIS A 275      65.053  -21.230  254.827  1.00  31.74           C
ATOM   1974  CG   HIS A 275      65.814  -22.473  254.441  1.00  34.12           C
ATOM   1975  ND1  HIS A 275      66.991  -22.849  255.055  1.00  33.84           N
ATOM   1976  CD2  HIS A 275      65.561  -23.426  253.510  1.00  32.96           C
ATOM   1977  CE1  HIS A 275      67.436  -23.969  254.510  1.00  31.75           C
ATOM   1978  NE2  HIS A 275      66.582  -24.344  253.580  1.00  32.51           N
ATOM   1979  N    GLY A 276      63.975  -21.429  257.962  1.00  29.09           N
ATOM   1980  CA   GLY A 276      64.243  -21.992  259.290  1.00  28.31           C
ATOM   1981  C    GLY A 276      63.033  -22.661  259.931  1.00  29.25           C
ATOM   1982  O    GLY A 276      63.166  -23.468  260.878  1.00  28.57           O
ATOM   1983  N    MET A 277      61.843  -22.326  259.427  1.00  28.63           N
ATOM   1984  CA   MET A 277      60.586  -22.813  259.999  1.00  27.14           C
ATOM   1985  C    MET A 277      59.985  -23.902  259.116  1.00  26.91           C
ATOM   1986  O    MET A 277      59.505  -24.943  259.616  1.00  25.39           O
ATOM   1987  CB   MET A 277      59.616  -21.657  260.112  1.00  27.33           C
ATOM   1988  CG   MET A 277      60.113  -20.551  261.011  1.00  27.45           C
ATOM   1989  SD   MET A 277      58.856  -19.301  261.303  1.00  28.61           S
ATOM   1990  CE   MET A 277      59.107  -18.215  259.897  1.00  27.96           C
ATOM   1991  N    ASP A 278      59.994  -23.620  257.807  1.00  25.22           N
ATOM   1992  CA   ASP A 278      59.587  -24.554  256.772  1.00  24.57           C
ATOM   1993  C    ASP A 278      60.554  -24.471  255.580  1.00  24.19           C
ATOM   1994  O    ASP A 278      60.417  -23.607  254.742  1.00  22.32           O
ATOM   1995  CB   ASP A 278      58.154  -24.258  256.346  1.00  24.75           C
ATOM   1996  CG   ASP A 278      57.660  -25.189  255.248  1.00  24.69           C
ATOM   1997  OD1  ASP A 278      58.316  -26.222  254.937  1.00  25.40           O
ATOM   1998  OD2  ASP A 278      56.614  -24.842  254.676  1.00  24.56           O
ATOM   1999  N    PRO A 279      61.557  -25.362  255.538  1.00  25.56           N
ATOM   2000  CA   PRO A 279      62.588  -25.375  254.518  1.00  26.62           C
ATOM   2001  C    PRO A 279      62.066  -25.598  253.128  1.00  27.86           C
ATOM   2002  O    PRO A 279      62.436  -24.863  252.199  1.00  30.13           O
ATOM   2003  CB   PRO A 279      63.455  -26.564  254.925  1.00  27.47           C
ATOM   2004  CG   PRO A 279      63.365  -26.589  256.403  1.00  27.25           C
ATOM   2005  CD   PRO A 279      61.944  -26.188  256.699  1.00  26.86           C
```

Appendix 2

```
ATOM   2006  N    ALA A 280      61.215  -26.606 252.981  1.00 28.23           N
ATOM   2007  CA   ALA A 280      60.643  -26.938 251.677  1.00 28.28           C
ATOM   2008  C    ALA A 280      60.058  -25.694 250.999  1.00 27.73           C
ATOM   2009  O    ALA A 280      60.132  -25.550 249.789  1.00 28.68           O
ATOM   2010  CB   ALA A 280      59.571  -28.020 251.832  1.00 27.87           C
ATOM   2011  N    PHE A 281      59.467  -24.800 251.784  1.00 28.05           N
ATOM   2012  CA   PHE A 281      58.854  -23.588 251.240  1.00 28.99           C
ATOM   2013  C    PHE A 281      59.901  -22.733 250.492  1.00 29.97           C
ATOM   2014  O    PHE A 281      59.720  -22.401 249.332  1.00 28.29           O
ATOM   2015  CB   PHE A 281      58.183  -22.827 252.380  1.00 28.56           C
ATOM   2016  CG   PHE A 281      57.389  -21.631 251.956  1.00 29.28           C
ATOM   2017  CD1  PHE A 281      58.020  -20.487 251.493  1.00 30.68           C
ATOM   2018  CD2  PHE A 281      56.020  -21.611 252.108  1.00 29.74           C
ATOM   2019  CE1  PHE A 281      57.292  -19.362 251.138  1.00 31.10           C
ATOM   2020  CE2  PHE A 281      55.285  -20.488 251.761  1.00 30.94           C
ATOM   2021  CZ   PHE A 281      55.920  -19.357 251.276  1.00 30.31           C
ATOM   2022  N    SER A 282      61.017  -22.418 251.137  1.00 30.48           N
ATOM   2023  CA   SER A 282      62.033  -21.607 250.483  1.00 31.12           C
ATOM   2024  C    SER A 282      62.810  -22.370 249.418  1.00 31.42           C
ATOM   2025  O    SER A 282      63.096  -21.811 248.375  1.00 32.05           O
ATOM   2026  CB   SER A 282      62.978  -21.002 251.509  1.00 32.12           C
ATOM   2027  OG   SER A 282      62.246  -20.267 252.458  1.00 30.40           O
ATOM   2028  N    GLU A 283      63.132  -23.637 249.652  1.00 35.12           N
ATOM   2029  CA   GLU A 283      63.785  -24.459 248.608  1.00 38.32           C
ATOM   2030  C    GLU A 283      62.960  -24.444 247.309  1.00 38.71           C
ATOM   2031  O    GLU A 283      63.503  -24.370 246.202  1.00 39.27           O
ATOM   2032  CB   GLU A 283      64.021  -25.895 249.099  1.00 41.65           C
ATOM   2033  CG   GLU A 283      65.382  -26.108 249.763  1.00 46.36           C
ATOM   2034  CD   GLU A 283      65.376  -27.181 250.856  1.00 51.47           C
ATOM   2035  OE1  GLU A 283      64.669  -28.231 250.733  1.00 48.26           O
ATOM   2036  OE2  GLU A 283      66.109  -26.957 251.851  1.00 52.12           O
ATOM   2037  N    ARG A 284      61.642  -24.471 247.465  1.00 39.23           N
ATOM   2038  CA   ARG A 284      60.728  -24.437 246.340  1.00 39.74           C
ATOM   2039  C    ARG A 284      60.783  -23.097 245.609  1.00 36.80           C
ATOM   2040  O    ARG A 284      60.766  -23.071 244.388  1.00 35.69           O
ATOM   2041  CB   ARG A 284      59.297  -24.745 246.803  1.00 41.72           C
ATOM   2042  CG   ARG A 284      58.254  -24.636 245.701  1.00 45.86           C
ATOM   2043  CD   ARG A 284      56.947  -25.346 246.055  1.00 48.38           C
ATOM   2044  NE   ARG A 284      56.189  -24.676 247.131  1.00 49.11           N
ATOM   2045  CZ   ARG A 284      55.995  -25.154 248.371  1.00 51.11           C
ATOM   2046  NH1  ARG A 284      56.489  -26.337 248.764  1.00 52.94           N
ATOM   2047  NH2  ARG A 284      55.289  -24.441 249.241  1.00 48.39           N
ATOM   2048  N    TYR A 285      60.861  -21.985 246.334  1.00 35.30           N
ATOM   2049  CA   TYR A 285      60.833  -20.672 245.662  1.00 35.14           C
ATOM   2050  C    TYR A 285      62.184  -20.083 245.255  1.00 32.92           C
ATOM   2051  O    TYR A 285      62.230  -19.242 244.360  1.00 29.64           O
ATOM   2052  CB   TYR A 285      60.042  -19.647 246.471  1.00 34.25           C
ATOM   2053  CG   TYR A 285      58.577  -19.986 246.542  1.00 34.73           C
ATOM   2054  CD1  TYR A 285      57.769  -19.935 245.409  1.00 35.70           C
ATOM   2055  CD2  TYR A 285      58.003  -20.371 247.729  1.00 33.23           C
ATOM   2056  CE1  TYR A 285      56.436  -20.262 245.478  1.00 33.96           C
ATOM   2057  CE2  TYR A 285      56.685  -20.678 247.804  1.00 32.44           C
ATOM   2058  CZ   TYR A 285      55.909  -20.626 246.684  1.00 34.03           C
ATOM   2059  OH   TYR A 285      54.586  -20.940 246.802  1.00 37.24           O
```

Appendix 2

```
ATOM   2060  N   TYR A 286      63.263 -20.544 245.882  1.00 32.53           N
ATOM   2061  CA  TYR A 286      64.601 -19.947 245.698  1.00 33.11           C
ATOM   2062  C   TYR A 286      65.112 -19.966 244.256  1.00 32.55           C
ATOM   2063  O   TYR A 286      65.620 -18.951 243.803  1.00 33.64           O
ATOM   2064  CB  TYR A 286      65.613 -20.585 246.645  1.00 32.32           C
ATOM   2065  CG  TYR A 286      67.018 -20.052 246.604  1.00 33.25           C
ATOM   2066  CD1 TYR A 286      67.277 -18.698 246.744  1.00 33.15           C
ATOM   2067  CD2 TYR A 286      68.115 -20.928 246.489  1.00 34.71           C
ATOM   2068  CE1 TYR A 286      68.579 -18.210 246.734  1.00 34.10           C
ATOM   2069  CE2 TYR A 286      69.421 -20.452 246.479  1.00 35.31           C
ATOM   2070  CZ  TYR A 286      69.650 -19.091 246.605  1.00 36.03           C
ATOM   2071  OH  TYR A 286      70.947 -18.618 246.597  1.00 38.82           O
ATOM   2072  N   PRO A 287      64.970 -21.099 243.537  1.00 33.67           N
ATOM   2073  CA  PRO A 287      65.434 -21.104 242.141  1.00 33.46           C
ATOM   2074  C   PRO A 287      64.778 -20.041 241.303  1.00 30.98           C
ATOM   2075  O   PRO A 287      65.453 -19.396 240.537  1.00 30.87           O
ATOM   2076  CB  PRO A 287      65.052 -22.507 241.627  1.00 34.49           C
ATOM   2077  CG  PRO A 287      64.999 -23.360 242.846  1.00 35.37           C
ATOM   2078  CD  PRO A 287      64.547 -22.448 243.974  1.00 35.24           C
ATOM   2079  N   ARG A 288      63.474 -19.862 241.467  1.00 33.55           N
ATOM   2080  CA  ARG A 288      62.683 -18.906 240.661  1.00 34.85           C
ATOM   2081  C   ARG A 288      62.962 -17.446 241.001  1.00 32.77           C
ATOM   2082  O   ARG A 288      63.021 -16.590 240.109  1.00 29.74           O
ATOM   2083  CB  ARG A 288      61.183 -19.185 240.842  1.00 38.48           C
ATOM   2084  CG  ARG A 288      60.754 -20.520 240.274  1.00 42.16           C
ATOM   2085  CD  ARG A 288      59.327 -20.848 240.649  1.00 47.80           C
ATOM   2086  NE  ARG A 288      59.153 -22.277 240.914  1.00 52.83           N
ATOM   2087  CZ  ARG A 288      58.067 -22.812 241.471  1.00 56.19           C
ATOM   2088  NH1 ARG A 288      57.029 -22.050 241.824  1.00 55.94           N
ATOM   2089  NH2 ARG A 288      58.021 -24.118 241.681  1.00 56.92           N
ATOM   2090  N   PHE A 289      63.117 -17.180 242.299  1.00 32.15           N
ATOM   2091  CA  PHE A 289      63.577 -15.887 242.805  1.00 31.14           C
ATOM   2092  C   PHE A 289      64.900 -15.481 242.181  1.00 30.79           C
ATOM   2093  O   PHE A 289      65.036 -14.335 241.754  1.00 31.59           O
ATOM   2094  CB  PHE A 289      63.695 -15.922 244.325  1.00 31.46           C
ATOM   2095  CG  PHE A 289      64.600 -14.863 244.906  1.00 33.63           C
ATOM   2096  CD1 PHE A 289      64.094 -13.641 245.311  1.00 33.25           C
ATOM   2097  CD2 PHE A 289      65.969 -15.116 245.096  1.00 33.89           C
ATOM   2098  CE1 PHE A 289      64.931 -12.683 245.870  1.00 34.06           C
ATOM   2099  CE2 PHE A 289      66.804 -14.164 245.652  1.00 32.90           C
ATOM   2100  CZ  PHE A 289      66.286 -12.945 246.042  1.00 33.19           C
ATOM   2101  N   LYS A 290      65.863 -16.405 242.132  1.00 28.56           N
ATOM   2102  CA  LYS A 290      67.135 -16.128 241.489  1.00 28.93           C
ATOM   2103  C   LYS A 290      66.910 -15.733 240.023  1.00 29.70           C
ATOM   2104  O   LYS A 290      67.420 -14.702 239.588  1.00 28.34           O
ATOM   2105  CB  LYS A 290      68.102 -17.320 241.574  1.00 31.23           C
ATOM   2106  CG  LYS A 290      68.748 -17.572 242.939  1.00 33.61           C
ATOM   2107  CD  LYS A 290      69.403 -18.957 243.043  1.00 35.46           C
ATOM   2108  CE  LYS A 290      70.623 -19.074 242.131  1.00 37.97           C
ATOM   2109  NZ  LYS A 290      71.490 -20.234 242.466  1.00 38.14           N
ATOM   2110  N   GLN A 291      66.156 -16.541 239.265  1.00 30.42           N
ATOM   2111  CA  GLN A 291      65.862 -16.220 237.841  1.00 31.24           C
ATOM   2112  C   GLN A 291      65.212 -14.826 237.710  1.00 29.82           C
ATOM   2113  O   GLN A 291      65.624 -14.033 236.866  1.00 28.47           O
```

Appendix 2

```
ATOM   2114  CB  GLN A 291      65.000 -17.307 237.134  1.00 28.91           C
ATOM   2115  N   THR A 292      64.228 -14.535 238.566  1.00 28.36           N
ATOM   2116  CA  THR A 292      63.490 -13.262 238.521  1.00 28.20           C
ATOM   2117  C   THR A 292      64.344 -11.995 238.732  1.00 26.39           C
ATOM   2118  O   THR A 292      64.177 -11.026 238.013  1.00 25.21           O
ATOM   2119  CB  THR A 292      62.360 -13.238 239.592  1.00 28.43           C
ATOM   2120  OG1 THR A 292      61.451 -14.321 239.375  1.00 28.72           O
ATOM   2121  CG2 THR A 292      61.586 -11.915 239.551  1.00 28.45           C
ATOM   2122  N   PHE A 293      65.210 -12.006 239.741  1.00 26.37           N
ATOM   2123  CA  PHE A 293      65.849 -10.778 240.239  1.00 28.92           C
ATOM   2124  C   PHE A 293      67.380 -10.707 240.066  1.00 30.63           C
ATOM   2125  O   PHE A 293      67.921  -9.604 239.943  1.00 29.63           O
ATOM   2126  CB  PHE A 293      65.573 -10.613 241.727  1.00 28.80           C
ATOM   2127  CG  PHE A 293      64.152 -10.306 242.082  1.00 28.92           C
ATOM   2128  CD1 PHE A 293      63.519  -9.181 241.591  1.00 30.75           C
ATOM   2129  CD2 PHE A 293      63.466 -11.107 242.981  1.00 27.82           C
ATOM   2130  CE1 PHE A 293      62.216  -8.880 241.972  1.00 30.38           C
ATOM   2131  CE2 PHE A 293      62.173 -10.812 243.360  1.00 27.22           C
ATOM   2132  CZ  PHE A 293      61.545  -9.700 242.859  1.00 28.15           C
ATOM   2133  N   VAL A 294      68.057 -11.866 240.070  1.00 30.64           N
ATOM   2134  CA  VAL A 294      69.524 -11.927 240.179  1.00 32.80           C
ATOM   2135  C   VAL A 294      70.281 -11.856 238.824  1.00 33.09           C
ATOM   2136  O   VAL A 294      70.153 -12.734 237.992  1.00 35.11           O
ATOM   2137  CB  VAL A 294      69.957 -13.186 240.976  1.00 32.34           C
ATOM   2138  CG1 VAL A 294      71.471 -13.341 241.001  1.00 31.96           C
ATOM   2139  CG2 VAL A 294      69.431 -13.119 242.402  1.00 31.42           C
ATOM   2140  N   GLU A 295      71.062 -10.796 238.634  1.00 31.93           N
ATOM   2141  CA  GLU A 295      71.945 -10.638 237.491  1.00 30.58           C
ATOM   2142  C   GLU A 295      73.364 -11.166 237.786  1.00 31.37           C
ATOM   2143  O   GLU A 295      74.100 -10.582 238.586  1.00 32.30           O
ATOM   2144  CB  GLU A 295      72.038  -9.158 237.095  1.00 28.90           C
ATOM   2145  CG  GLU A 295      72.968  -8.941 235.922  1.00 28.70           C
ATOM   2146  CD  GLU A 295      73.126  -7.500 235.528  1.00 30.12           C
ATOM   2147  OE1 GLU A 295      72.692  -6.603 236.274  1.00 32.57           O
ATOM   2148  OE2 GLU A 295      73.725  -7.266 234.464  1.00 30.25           O
ATOM   2149  N   VAL A 296      73.758 -12.256 237.134  1.00 30.71           N
ATOM   2150  CA  VAL A 296      75.155 -12.666 237.141  1.00 30.78           C
ATOM   2151  C   VAL A 296      75.881 -11.871 236.055  1.00 30.50           C
ATOM   2152  O   VAL A 296      75.329 -11.616 234.980  1.00 31.07           O
ATOM   2153  CB  VAL A 296      75.319 -14.190 236.967  1.00 30.53           C
ATOM   2154  CG1 VAL A 296      76.792 -14.582 237.018  1.00 30.79           C
ATOM   2155  CG2 VAL A 296      74.557 -14.935 238.062  1.00 29.90           C
ATOM   2156  N   TYR A 297      77.094 -11.423 236.363  1.00 30.69           N
ATOM   2157  CA  TYR A 297      77.858 -10.579 235.433  1.00 31.00           C
ATOM   2158  C   TYR A 297      79.374 -10.795 235.595  1.00 30.41           C
ATOM   2159  O   TYR A 297      79.822 -11.639 236.382  1.00 28.18           O
ATOM   2160  CB  TYR A 297      77.427  -9.093 235.542  1.00 31.01           C
ATOM   2161  CG  TYR A 297      77.949  -8.317 236.747  1.00 32.35           C
ATOM   2162  CD1 TYR A 297      77.289  -8.351 237.988  1.00 32.93           C
ATOM   2163  CD2 TYR A 297      79.077  -7.511 236.632  1.00 33.11           C
ATOM   2164  CE1 TYR A 297      77.767  -7.624 239.084  1.00 34.10           C
ATOM   2165  CE2 TYR A 297      79.562  -6.775 237.710  1.00 34.39           C
ATOM   2166  CZ  TYR A 297      78.918  -6.831 238.939  1.00 35.56           C
ATOM   2167  OH  TYR A 297      79.448  -6.101 239.991  1.00 34.32           O
```

Appendix 2

```
ATOM   2168  N    ASP A 298      80.158 -10.073 234.808  1.00 31.51           N
ATOM   2169  CA   ASP A 298      81.596 -10.233 234.836  1.00 32.23           C
ATOM   2170  C    ASP A 298      81.991 -11.724 234.730  1.00 33.12           C
ATOM   2171  O    ASP A 298      82.662 -12.274 235.610  1.00 31.17           O
ATOM   2172  CB   ASP A 298      82.139  -9.607 236.114  1.00 32.40           C
ATOM   2173  CG   ASP A 298      83.617  -9.350 236.047  1.00 32.93           C
ATOM   2174  OD1  ASP A 298      84.020  -8.580 235.159  1.00 32.35           O
ATOM   2175  OD2  ASP A 298      84.366  -9.912 236.879  1.00 32.28           O
ATOM   2176  N    GLU A 299      81.534 -12.376 233.658  1.00 34.81           N
ATOM   2177  CA   GLU A 299      81.942 -13.749 233.342  1.00 35.16           C
ATOM   2178  C    GLU A 299      81.805 -14.683 234.541  1.00 33.33           C
ATOM   2179  O    GLU A 299      82.640 -15.542 234.765  1.00 34.25           O
ATOM   2180  CB   GLU A 299      83.396 -13.760 232.848  1.00 39.43           C
ATOM   2181  CG   GLU A 299      83.739 -12.684 231.810  1.00 41.07           C
ATOM   2182  CD   GLU A 299      85.026 -12.992 231.059  1.00 44.23           C
ATOM   2183  OE1  GLU A 299      84.947 -13.269 229.840  1.00 46.28           O
ATOM   2184  OE2  GLU A 299      86.117 -12.983 231.682  1.00 46.84           O
ATOM   2185  N    GLY A 300      80.758 -14.485 235.325  1.00 32.16           N
ATOM   2186  CA   GLY A 300      80.393 -15.414 236.380  1.00 32.41           C
ATOM   2187  C    GLY A 300      80.949 -15.096 237.754  1.00 33.07           C
ATOM   2188  O    GLY A 300      80.570 -15.732 238.722  1.00 32.73           O
ATOM   2189  N    ARG A 301      81.843 -14.120 237.849  1.00 33.79           N
ATOM   2190  CA   ARG A 301      82.543 -13.838 239.106  1.00 34.21           C
ATOM   2191  C    ARG A 301      81.689 -13.023 240.093  1.00 33.71           C
ATOM   2192  O    ARG A 301      81.894 -13.116 241.302  1.00 32.48           O
ATOM   2193  CB   ARG A 301      83.883 -13.128 238.843  1.00 34.00           C
ATOM   2194  CG   ARG A 301      84.928 -14.022 238.182  1.00 35.44           C
ATOM   2195  CD   ARG A 301      86.224 -13.271 237.900  1.00 36.46           C
ATOM   2196  NE   ARG A 301      86.039 -12.230 236.887  1.00 37.86           N
ATOM   2197  CZ   ARG A 301      86.335 -12.341 235.584  1.00 38.70           C
ATOM   2198  NH1  ARG A 301      86.865 -13.445 235.070  1.00 38.30           N
ATOM   2199  NH2  ARG A 301      86.102 -11.316 234.775  1.00 38.91           N
ATOM   2200  N    LYS A 302      80.733 -12.253 239.574  1.00 33.27           N
ATOM   2201  CA   LYS A 302      79.981 -11.283 240.374  1.00 32.70           C
ATOM   2202  C    LYS A 302      78.501 -11.414 240.137  1.00 32.94           C
ATOM   2203  O    LYS A 302      78.052 -12.025 239.164  1.00 35.31           O
ATOM   2204  CB   LYS A 302      80.404  -9.865 240.013  1.00 33.92           C
ATOM   2205  CG   LYS A 302      81.824  -9.527 240.476  1.00 35.59           C
ATOM   2206  CD   LYS A 302      82.364  -8.241 239.860  1.00 34.62           C
ATOM   2207  CE   LYS A 302      83.550  -7.719 240.638  1.00 32.92           C
ATOM   2208  NZ   LYS A 302      84.681  -7.460 239.721  1.00 33.56           N
ATOM   2209  N    ALA A 303      77.728 -10.846 241.042  1.00 30.75           N
ATOM   2210  CA   ALA A 303      76.285 -10.829 240.891  1.00 28.84           C
ATOM   2211  C    ALA A 303      75.741  -9.617 241.629  1.00 27.67           C
ATOM   2212  O    ALA A 303      76.289  -9.231 242.651  1.00 26.87           O
ATOM   2213  CB   ALA A 303      75.679 -12.118 241.425  1.00 28.05           C
ATOM   2214  N    ARG A 304      74.700  -8.996 241.080  1.00 27.56           N
ATOM   2215  CA   ARG A 304      73.994  -7.892 241.735  1.00 27.42           C
ATOM   2216  C    ARG A 304      72.491  -8.119 241.546  1.00 30.39           C
ATOM   2217  O    ARG A 304      72.091  -8.777 240.585  1.00 31.66           O
ATOM   2218  CB   ARG A 304      74.429  -6.569 241.145  1.00 25.55           C
ATOM   2219  CG   ARG A 304      74.241  -6.500 239.657  1.00 25.62           C
ATOM   2220  CD   ARG A 304      74.727  -5.186 239.077  1.00 25.33           C
ATOM   2221  NE   ARG A 304      74.980  -5.411 237.657  1.00 26.14           N
```

Appendix 2

```
ATOM   2222  CZ   ARG A 304      76.036   -4.977 236.979  1.00 25.40           C
ATOM   2223  NH1  ARG A 304      76.146   -5.273 235.699  1.00 25.04           N
ATOM   2224  NH2  ARG A 304      76.976   -4.254 237.556  1.00 25.99           N
ATOM   2225  N    VAL A 305      71.653   -7.593 242.439  1.00 31.08           N
ATOM   2226  CA   VAL A 305      70.236   -7.979 242.437  1.00 31.26           C
ATOM   2227  C    VAL A 305      69.272   -6.813 242.208  1.00 30.91           C
ATOM   2228  O    VAL A 305      69.341   -5.787 242.901  1.00 31.20           O
ATOM   2229  CB   VAL A 305      69.879   -8.677 243.744  1.00 32.58           C
ATOM   2230  CG1  VAL A 305      68.465   -9.241 243.690  1.00 33.75           C
ATOM   2231  CG2  VAL A 305      70.887   -9.781 244.021  1.00 33.67           C
ATOM   2232  N    ARG A 306      68.378   -6.981 241.233  1.00 28.88           N
ATOM   2233  CA   ARG A 306      67.350   -5.980 240.955  1.00 29.85           C
ATOM   2234  C    ARG A 306      66.326   -6.003 242.060  1.00 28.87           C
ATOM   2235  O    ARG A 306      65.988   -7.078 242.556  1.00 28.84           O
ATOM   2236  CB   ARG A 306      66.640   -6.268 239.634  1.00 30.69           C
ATOM   2237  CG   ARG A 306      67.556   -6.221 238.421  1.00 29.97           C
ATOM   2238  CD   ARG A 306      66.756   -6.438 237.161  1.00 29.85           C
ATOM   2239  NE   ARG A 306      66.373   -7.828 237.038  1.00 30.07           N
ATOM   2240  CZ   ARG A 306      67.183   -8.799 236.626  1.00 31.70           C
ATOM   2241  NH1  ARG A 306      68.448   -8.556 236.302  1.00 33.10           N
ATOM   2242  NH2  ARG A 306      66.731  -10.038 236.551  1.00 31.87           N
ATOM   2243  N    GLU A 307      65.837   -4.823 242.434  1.00 27.64           N
ATOM   2244  CA   GLU A 307      64.841   -4.691 243.500  1.00 27.93           C
ATOM   2245  C    GLU A 307      63.397   -5.017 243.044  1.00 28.12           C
ATOM   2246  O    GLU A 307      62.583   -5.479 243.845  1.00 28.89           O
ATOM   2247  CB   GLU A 307      64.912   -3.287 244.106  1.00 26.56           C
ATOM   2248  CG   GLU A 307      63.726   -2.898 244.968  1.00 26.40           C
ATOM   2249  CD   GLU A 307      63.471   -3.834 246.143  1.00 27.72           C
ATOM   2250  OE1  GLU A 307      64.409   -4.555 246.589  1.00 30.02           O
ATOM   2251  OE2  GLU A 307      62.321   -3.827 246.636  1.00 26.63           O
ATOM   2252  N    THR A 308      63.090   -4.784 241.771  1.00 28.81           N
ATOM   2253  CA   THR A 308      61.733   -4.968 241.252  1.00 29.24           C
ATOM   2254  C    THR A 308      61.786   -5.361 239.761  1.00 31.70           C
ATOM   2255  O    THR A 308      62.880   -5.547 239.212  1.00 35.21           O
ATOM   2256  CB   THR A 308      60.854   -3.721 241.559  1.00 27.25           C
ATOM   2257  OG1  THR A 308      59.479   -4.088 241.490  1.00 30.22           O
ATOM   2258  CG2  THR A 308      61.114   -2.563 240.617  1.00 25.18           C
ATOM   2259  N    ALA A 309      60.627   -5.430 239.106  1.00 32.54           N
ATOM   2260  CA   ALA A 309      60.432   -6.276 237.915  1.00 33.59           C
ATOM   2261  C    ALA A 309      60.628   -5.668 236.521  1.00 35.95           C
ATOM   2262  O    ALA A 309      61.051   -6.364 235.581  1.00 41.87           O
ATOM   2263  CB   ALA A 309      59.046   -6.913 237.967  1.00 33.26           C
ATOM   2264  N    GLY A 310      60.282   -4.414 236.329  1.00 34.81           N
ATOM   2265  CA   GLY A 310      60.333   -3.879 234.963  1.00 34.17           C
ATOM   2266  C    GLY A 310      61.515   -2.962 234.832  1.00 32.39           C
ATOM   2267  O    GLY A 310      61.357   -1.807 234.449  1.00 32.17           O
ATOM   2268  N    THR A 311      62.686   -3.454 235.221  1.00 30.32           N
ATOM   2269  CA   THR A 311      63.883   -2.632 235.237  1.00 29.85           C
ATOM   2270  C    THR A 311      65.127   -3.469 235.088  1.00 29.70           C
ATOM   2271  O    THR A 311      65.100   -4.673 235.255  1.00 28.19           O
ATOM   2272  CB   THR A 311      63.997   -1.791 236.517  1.00 30.52           C
ATOM   2273  OG1  THR A 311      65.138   -0.921 236.415  1.00 30.94           O
ATOM   2274  CG2  THR A 311      64.125   -2.674 237.747  1.00 30.18           C
ATOM   2275  N    ASP A 312      66.211   -2.811 234.715  1.00 32.39           N
```

Appendix 2

```
ATOM   2276  CA   ASP A 312      67.518  -3.449 234.626  1.00 33.51           C
ATOM   2277  C    ASP A 312      68.404  -2.998 235.764  1.00 33.01           C
ATOM   2278  O    ASP A 312      69.392  -3.655 236.048  1.00 34.30           O
ATOM   2279  CB   ASP A 312      68.182  -3.110 233.291  1.00 33.28           C
ATOM   2280  CG   ASP A 312      67.593  -3.896 232.132  1.00 34.73           C
ATOM   2281  OD1  ASP A 312      67.300  -5.107 232.312  1.00 33.19           O
ATOM   2282  OD2  ASP A 312      67.440  -3.308 231.032  1.00 36.70           O
ATOM   2283  N    ASP A 313      68.052  -1.873 236.388  1.00 31.67           N
ATOM   2284  CA   ASP A 313      68.842  -1.274 237.464  1.00 32.39           C
ATOM   2285  C    ASP A 313      68.894  -2.243 238.678  1.00 34.35           C
ATOM   2286  O    ASP A 313      67.903  -2.894 239.016  1.00 37.51           O
ATOM   2287  CB   ASP A 313      68.242   0.083 237.910  1.00 30.01           C
ATOM   2288  CG   ASP A 313      68.139   1.126 236.770  1.00 29.55           C
ATOM   2289  OD1  ASP A 313      69.136   1.415 236.063  1.00 29.86           O
ATOM   2290  OD2  ASP A 313      67.042   1.697 236.603  1.00 27.65           O
ATOM   2291  N    ALA A 314      70.052  -2.337 239.322  1.00 33.12           N
ATOM   2292  CA   ALA A 314      70.226  -3.216 240.462  1.00 31.60           C
ATOM   2293  C    ALA A 314      70.211  -2.381 241.720  1.00 30.59           C
ATOM   2294  O    ALA A 314      70.693  -1.266 241.715  1.00 29.98           O
ATOM   2295  CB   ALA A 314      71.533  -3.966 240.349  1.00 30.50           C
ATOM   2296  N    ASP A 315      69.646  -2.929 242.790  1.00 28.77           N
ATOM   2297  CA   ASP A 315      69.593  -2.259 244.089  1.00 29.40           C
ATOM   2298  C    ASP A 315      68.843  -0.939 244.148  1.00 27.90           C
ATOM   2299  O    ASP A 315      69.228  -0.036 244.871  1.00 26.59           O
ATOM   2300  CB   ASP A 315      70.999  -2.124 244.714  1.00 29.07           C
ATOM   2301  CG   ASP A 315      71.487  -3.437 245.277  1.00 30.58           C
ATOM   2302  OD1  ASP A 315      70.780  -4.008 246.144  1.00 30.74           O
ATOM   2303  OD2  ASP A 315      72.546  -3.926 244.829  1.00 31.58           O
ATOM   2304  N    GLY A 316      67.740  -0.841 243.436  1.00 27.49           N
ATOM   2305  CA   GLY A 316      66.848   0.281 243.661  1.00 28.44           C
ATOM   2306  C    GLY A 316      66.056   0.183 244.969  1.00 28.96           C
ATOM   2307  O    GLY A 316      66.299  -0.684 245.840  1.00 29.95           O
ATOM   2308  N    GLY A 317      65.073   1.068 245.090  1.00 29.12           N
ATOM   2309  CA   GLY A 317      64.239   1.120 246.269  1.00 28.85           C
ATOM   2310  C    GLY A 317      65.075   1.539 247.459  1.00 27.63           C
ATOM   2311  O    GLY A 317      65.585   2.650 247.497  1.00 29.50           O
ATOM   2312  N    VAL A 318      65.236   0.630 248.414  1.00 25.94           N
ATOM   2313  CA   VAL A 318      65.955   0.913 249.660  1.00 23.22           C
ATOM   2314  C    VAL A 318      67.434   0.528 249.531  1.00 23.92           C
ATOM   2315  O    VAL A 318      68.226   0.818 250.416  1.00 24.80           O
ATOM   2316  CB   VAL A 318      65.328   0.188 250.893  1.00 21.16           C
ATOM   2317  CG1  VAL A 318      63.975   0.785 251.251  1.00 19.75           C
ATOM   2318  CG2  VAL A 318      65.215  -1.325 250.676  1.00 20.49           C
ATOM   2319  N    GLY A 319      67.808  -0.125 248.438  1.00 24.51           N
ATOM   2320  CA   GLY A 319      69.214  -0.423 248.149  1.00 24.66           C
ATOM   2321  C    GLY A 319      69.726  -1.648 248.869  1.00 26.00           C
ATOM   2322  O    GLY A 319      70.933  -1.779 249.072  1.00 27.59           O
ATOM   2323  N    LEU A 320      68.818  -2.549 249.254  1.00 26.77           N
ATOM   2324  CA   LEU A 320      69.177  -3.691 250.095  1.00 26.78           C
ATOM   2325  C    LEU A 320      69.947  -5.031 249.452  1.00 26.62           C
ATOM   2326  O    LEU A 320      69.164  -6.048 250.078  1.00 25.97           O
ATOM   2327  CB   LEU A 320      68.430  -3.610 251.411  1.00 27.26           C
ATOM   2328  CG   LEU A 320      68.784  -2.371 252.248  1.00 28.26           C
ATOM   2329  CD1  LEU A 320      68.078  -2.414 253.594  1.00 28.86           C
```

Appendix 2

```
ATOM   2330  CD2 LEU A 320      70.282  -2.254 252.467  1.00 28.26           C
ATOM   2331  N   ALA A 321      68.559  -5.037 248.182  1.00 28.25           N
ATOM   2332  CA  ALA A 321      68.374  -6.277 247.461  1.00 27.40           C
ATOM   2333  C   ALA A 321      69.584  -7.204 247.575  1.00 27.25           C
ATOM   2334  O   ALA A 321      69.471  -8.322 248.096  1.00 25.97           O
ATOM   2335  CB  ALA A 321      68.075  -5.981 246.009  1.00 28.24           C
ATOM   2336  N   SER A 322      70.739  -6.740 247.103  1.00 26.90           N
ATOM   2337  CA  SER A 322      71.926  -7.590 247.072  1.00 27.09           C
ATOM   2338  C   SER A 322      72.360  -8.001 248.472  1.00 27.69           C
ATOM   2339  O   SER A 322      72.688  -9.165 248.692  1.00 29.10           O
ATOM   2340  CB  SER A 322      73.070  -6.912 246.347  1.00 27.86           C
ATOM   2341  OG  SER A 322      72.742  -6.704 244.990  1.00 28.48           O
ATOM   2342  N   ALA A 323      72.315  -7.070 249.419  1.00 26.43           N
ATOM   2343  CA  ALA A 323      72.710  -7.367 250.788  1.00 26.77           C
ATOM   2344  C   ALA A 323      71.888  -8.475 251.397  1.00 28.36           C
ATOM   2345  O   ALA A 323      72.449  -9.347 252.059  1.00 30.11           O
ATOM   2346  CB  ALA A 323      72.613  -6.129 251.670  1.00 26.31           C
ATOM   2347  N   PHE A 324      70.564  -8.432 251.213  1.00 28.38           N
ATOM   2348  CA  PHE A 324      69.675  -9.442 251.825  1.00 27.33           C
ATOM   2349  C   PHE A 324      69.735 -10.729 251.074  1.00 26.65           C
ATOM   2350  O   PHE A 324      69.649 -11.794 251.655  1.00 26.59           O
ATOM   2351  CB  PHE A 324      68.232  -8.977 251.912  1.00 27.57           C
ATOM   2352  CG  PHE A 324      67.954  -8.098 253.107  1.00 26.97           C
ATOM   2353  CD1 PHE A 324      68.063  -8.603 254.389  1.00 27.52           C
ATOM   2354  CD2 PHE A 324      67.551  -6.802 252.953  1.00 25.68           C
ATOM   2355  CE1 PHE A 324      67.793  -7.818 255.494  1.00 27.21           C
ATOM   2356  CE2 PHE A 324      67.274  -6.011 254.058  1.00 26.97           C
ATOM   2357  CZ  PHE A 324      67.400  -6.516 255.331  1.00 26.34           C
ATOM   2358  N   THR A 325      69.917 -10.638 249.778  1.00 28.67           N
ATOM   2359  CA  THR A 325      70.114 -11.842 248.974  1.00 30.39           C
ATOM   2360  C   THR A 325      71.374 -12.624 249.406  1.00 31.09           C
ATOM   2361  O   THR A 325      71.373 -13.864 249.410  1.00 28.58           O
ATOM   2362  CB  THR A 325      70.232 -11.469 247.496  1.00 30.96           C
ATOM   2363  OG1 THR A 325      69.087 -10.696 247.102  1.00 31.37           O
ATOM   2364  CG2 THR A 325      70.316 -12.695 246.669  1.00 32.15           C
ATOM   2365  N   LEU A 326      72.437 -11.889 249.758  1.00 31.14           N
ATOM   2366  CA  LEU A 326      73.644 -12.479 250.322  1.00 30.76           C
ATOM   2367  C   LEU A 326      73.310 -13.300 251.581  1.00 32.49           C
ATOM   2368  O   LEU A 326      73.812 -14.428 251.757  1.00 35.66           O
ATOM   2369  CB  LEU A 326      74.650 -11.394 250.666  1.00 31.16           C
ATOM   2370  CG  LEU A 326      75.970 -11.894 251.244  1.00 32.94           C
ATOM   2371  CD1 LEU A 326      76.843 -12.565 250.197  1.00 33.04           C
ATOM   2372  CD2 LEU A 326      76.703 -10.729 251.873  1.00 34.43           C
ATOM   2373  N   LEU A 327      72.464 -12.752 252.449  1.00 29.98           N
ATOM   2374  CA  LEU A 327      71.993 -13.495 253.615  1.00 30.49           C
ATOM   2375  C   LEU A 327      71.217 -14.782 253.198  1.00 28.90           C
ATOM   2376  O   LEU A 327      71.466 -15.863 253.692  1.00 26.78           O
ATOM   2377  CB  LEU A 327      71.143 -12.574 254.503  1.00 31.31           C
ATOM   2378  CG  LEU A 327      70.445 -13.278 255.675  1.00 33.26           C
ATOM   2379  CD1 LEU A 327      71.486 -13.957 256.571  1.00 33.31           C
ATOM   2380  CD2 LEU A 327      69.541 -12.334 256.464  1.00 32.13           C
ATOM   2381  N   LEU A 328      70.292 -14.652 252.265  1.00 29.46           N
ATOM   2382  CA  LEU A 328      69.583 -15.807 251.721  1.00 30.36           C
ATOM   2383  C   LEU A 328      70.535 -16.882 251.210  1.00 32.03           C
```

Appendix 2

```
ATOM   2384  O    LEU A 328      70.432 -18.045 251.596  1.00 32.17           O
ATOM   2385  CB   LEU A 328      68.673 -15.375 250.578  1.00 30.01           C
ATOM   2386  CG   LEU A 328      67.820 -16.479 249.974  1.00 30.57           C
ATOM   2387  CD1  LEU A 328      67.013 -17.170 251.050  1.00 30.70           C
ATOM   2388  CD2  LEU A 328      66.879 -15.894 248.941  1.00 31.13           C
ATOM   2389  N    ALA A 329      71.477 -16.485 250.352  1.00 33.73           N
ATOM   2390  CA   ALA A 329      72.489 -17.416 249.819  1.00 32.07           C
ATOM   2391  C    ALA A 329      73.077 -18.262 250.910  1.00 31.27           C
ATOM   2392  O    ALA A 329      73.138 -19.486 250.781  1.00 31.42           O
ATOM   2393  CB   ALA A 329      73.607 -16.663 249.132  1.00 32.30           C
ATOM   2394  N    ARG A 330      73.515 -17.590 251.976  1.00 30.88           N
ATOM   2395  CA   ARG A 330      74.141 -18.243 253.109  1.00 29.50           C
ATOM   2396  C    ARG A 330      73.141 -19.168 253.764  1.00 30.10           C
ATOM   2397  O    ARG A 330      73.465 -20.295 254.072  1.00 31.33           O
ATOM   2398  CB   ARG A 330      74.619 -17.204 254.104  1.00 30.72           C
ATOM   2399  CG   ARG A 330      75.452 -17.759 255.250  1.00 31.77           C
ATOM   2400  CD   ARG A 330      76.855 -18.191 254.815  1.00 32.80           C
ATOM   2401  NE   ARG A 330      77.764 -18.099 255.958  1.00 34.28           N
ATOM   2402  CZ   ARG A 330      78.184 -19.118 256.711  1.00 34.26           C
ATOM   2403  NH1  ARG A 330      77.833 -20.376 256.437  1.00 36.60           N
ATOM   2404  NH2  ARG A 330      78.978 -18.877 257.745  1.00 32.47           N
ATOM   2405  N    GLU A 331      71.914 -18.705 253.954  1.00 30.79           N
ATOM   2406  CA   GLU A 331      70.887 -19.539 254.578  1.00 31.34           C
ATOM   2407  C    GLU A 331      70.647 -20.808 253.763  1.00 31.89           C
ATOM   2408  O    GLU A 331      70.475 -21.863 254.362  1.00 33.79           O
ATOM   2409  CB   GLU A 331      69.579 -18.748 254.789  1.00 30.94           C
ATOM   2410  CG   GLU A 331      68.378 -19.561 255.263  1.00 30.95           C
ATOM   2411  CD   GLU A 331      68.497 -20.058 256.688  1.00 31.50           C
ATOM   2412  OE1  GLU A 331      68.996 -19.287 257.547  1.00 27.84           O
ATOM   2413  OE2  GLU A 331      68.060 -21.219 256.945  1.00 32.33           O
ATOM   2414  N    MET A 332      70.655 -20.711 252.422  1.00 30.95           N
ATOM   2415  CA   MET A 332      70.422 -21.869 251.539  1.00 31.01           C
ATOM   2416  C    MET A 332      71.687 -22.636 251.141  1.00 32.25           C
ATOM   2417  O    MET A 332      71.654 -23.415 250.201  1.00 33.76           O
ATOM   2418  CB   MET A 332      69.734 -21.446 250.240  1.00 30.79           C
ATOM   2419  CG   MET A 332      68.538 -20.517 250.396  1.00 32.73           C
ATOM   2420  SD   MET A 332      67.170 -21.134 251.407  1.00 34.20           S
ATOM   2421  CE   MET A 332      66.503 -22.388 250.298  1.00 35.68           C
ATOM   2422  N    GLY A 333      72.810 -22.422 251.820  1.00 33.43           N
ATOM   2423  CA   GLY A 333      74.062 -23.142 251.473  1.00 33.43           C
ATOM   2424  C    GLY A 333      74.549 -22.978 250.025  1.00 31.54           C
ATOM   2425  O    GLY A 333      75.121 -23.891 249.464  1.00 32.36           O
ATOM   2426  N    ASP A 334      74.325 -21.811 249.438  1.00 29.59           N
ATOM   2427  CA   ASP A 334      74.620 -21.557 248.025  1.00 30.84           C
ATOM   2428  C    ASP A 334      75.953 -20.809 247.928  1.00 29.40           C
ATOM   2429  O    ASP A 334      75.973 -19.588 247.776  1.00 29.81           O
ATOM   2430  CB   ASP A 334      73.469 -20.706 247.414  1.00 31.29           C
ATOM   2431  CG   ASP A 334      73.585 -20.507 245.894  1.00 33.29           C
ATOM   2432  OD1  ASP A 334      74.689 -20.686 245.310  1.00 34.29           O
ATOM   2433  OD2  ASP A 334      72.543 -20.150 245.281  1.00 32.92           O
ATOM   2434  N    GLN A 335      77.063 -21.530 248.026  1.00 28.00           N
ATOM   2435  CA   GLN A 335      78.381 -20.886 248.004  1.00 27.68           C
ATOM   2436  C    GLN A 335      78.623 -20.068 246.736  1.00 27.86           C
ATOM   2437  O    GLN A 335      79.165 -18.963 246.794  1.00 28.34           O
```

Appendix 2

```
ATOM   2438  CB   GLN A 335      79.483 -21.910 248.197  1.00 28.35           C
ATOM   2439  CG   GLN A 335      79.368 -22.653 249.520  1.00 30.51           C
ATOM   2440  CD   GLN A 335      80.613 -23.475 249.911  1.00 32.24           C
ATOM   2441  OE1  GLN A 335      81.735 -23.266 249.422  1.00 30.31           O
ATOM   2442  NE2  GLN A 335      80.402 -24.418 250.820  1.00 33.49           N
ATOM   2443  N    GLN A 336      78.189 -20.583 245.595  1.00 28.09           N
ATOM   2444  CA   GLN A 336      78.407 -19.890 244.349  1.00 29.45           C
ATOM   2445  C    GLN A 336      77.789 -18.487 244.336  1.00 29.89           C
ATOM   2446  O    GLN A 336      78.486 -17.522 244.023  1.00 30.95           O
ATOM   2447  CB   GLN A 336      77.876 -20.687 243.158  1.00 32.11           C
ATOM   2448  CG   GLN A 336      77.991 -19.885 241.863  1.00 34.02           C
ATOM   2449  CD   GLN A 336      77.900 -20.723 240.624  1.00 34.84           C
ATOM   2450  OE1  GLN A 336      78.634 -20.513 239.659  1.00 35.65           O
ATOM   2451  NE2  GLN A 336      76.991 -21.672 240.638  1.00 35.91           N
ATOM   2452  N    LEU A 337      76.499 -18.371 244.653  1.00 28.21           N
ATOM   2453  CA   LEU A 337      75.844 -17.062 244.647  1.00 27.92           C
ATOM   2454  C    LEU A 337      76.378 -16.102 245.704  1.00 28.42           C
ATOM   2455  O    LEU A 337      76.563 -14.921 245.443  1.00 28.93           O
ATOM   2456  CB   LEU A 337      74.327 -17.179 244.810  1.00 28.14           C
ATOM   2457  CG   LEU A 337      73.610 -15.820 244.635  1.00 26.74           C
ATOM   2458  CD1  LEU A 337      73.850 -15.223 243.267  1.00 25.53           C
ATOM   2459  CD2  LEU A 337      72.117 -15.934 244.888  1.00 27.50           C
ATOM   2460  N    PHE A 338      76.611 -16.612 246.900  1.00 29.34           N
ATOM   2461  CA   PHE A 338      77.250 -15.851 247.974  1.00 29.47           C
ATOM   2462  C    PHE A 338      78.563 -15.194 247.503  1.00 29.20           C
ATOM   2463  O    PHE A 338      78.753 -13.983 247.628  1.00 29.99           O
ATOM   2464  CB   PHE A 338      77.524 -16.805 249.136  1.00 31.19           C
ATOM   2465  CG   PHE A 338      78.152 -16.161 250.313  1.00 32.38           C
ATOM   2466  CD1  PHE A 338      79.496 -15.851 250.314  1.00 33.04           C
ATOM   2467  CD2  PHE A 338      77.392 -15.870 251.437  1.00 34.25           C
ATOM   2468  CE1  PHE A 338      80.077 -15.248 251.416  1.00 33.24           C
ATOM   2469  CE2  PHE A 338      77.962 -15.265 252.540  1.00 34.30           C
ATOM   2470  CZ   PHE A 338      79.311 -14.960 252.529  1.00 34.10           C
ATOM   2471  N    ASP A 339      79.463 -15.995 246.955  1.00 27.56           N
ATOM   2472  CA   ASP A 339      80.737 -15.473 246.501  1.00 27.40           C
ATOM   2473  C    ASP A 339      80.539 -14.345 245.478  1.00 27.29           C
ATOM   2474  O    ASP A 339      81.189 -13.300 245.551  1.00 25.88           O
ATOM   2475  CB   ASP A 339      81.557 -16.594 245.882  1.00 27.29           C
ATOM   2476  CG   ASP A 339      82.928 -16.142 245.460  1.00 27.18           C
ATOM   2477  OD1  ASP A 339      83.807 -16.071 246.360  1.00 26.32           O
ATOM   2478  OD2  ASP A 339      83.109 -15.865 244.238  1.00 26.89           O
ATOM   2479  N    GLN A 340      79.622 -14.551 244.541  1.00 26.46           N
ATOM   2480  CA   GLN A 340      79.405 -13.570 243.486  1.00 27.16           C
ATOM   2481  C    GLN A 340      78.924 -12.245 244.058  1.00 28.77           C
ATOM   2482  O    GLN A 340      79.388 -11.176 243.637  1.00 28.52           O
ATOM   2483  CB   GLN A 340      78.393 -14.075 242.461  1.00 26.43           C
ATOM   2484  CG   GLN A 340      78.889 -15.255 241.635  1.00 25.92           C
ATOM   2485  CD   GLN A 340      77.769 -15.986 240.932  1.00 25.14           C
ATOM   2486  OE1  GLN A 340      76.608 -16.009 241.390  1.00 24.17           O
ATOM   2487  NE2  GLN A 340      78.103 -16.584 239.805  1.00 24.01           N
ATOM   2488  N    LEU A 341      78.001 -12.334 245.019  1.00 29.66           N
ATOM   2489  CA   LEU A 341      77.358 -11.156 245.608  1.00 28.81           C
ATOM   2490  C    LEU A 341      78.331 -10.391 246.428  1.00 26.96           C
ATOM   2491  O    LEU A 341      78.329  -9.174 246.399  1.00 26.56           O
```

Appendix 2

```
ATOM   2492  CB   LEU A 341      76.207  -11.558 246.516  1.00 28.61           C
ATOM   2493  CG   LEU A 341      75.010  -12.028 245.720  1.00 29.16           C
ATOM   2494  CD1  LEU A 341      73.953  -12.567 246.672  1.00 30.91           C
ATOM   2495  CD2  LEU A 341      74.456  -10.912 244.850  1.00 29.18           C
ATOM   2496  N    LEU A 342      79.146  -11.110 247.180  1.00 26.43           N
ATOM   2497  CA   LEU A 342      80.126  -10.458 248.031  1.00 28.15           C
ATOM   2498  C    LEU A 342      81.230   -9.821 247.177  1.00 27.97           C
ATOM   2499  O    LEU A 342      81.746   -8.764 247.550  1.00 28.68           O
ATOM   2500  CB   LEU A 342      80.715  -11.440 249.057  1.00 28.44           C
ATOM   2501  CG   LEU A 342      81.469  -10.816 250.232  1.00 28.90           C
ATOM   2502  CD1  LEU A 342      80.606   -9.762 250.916  1.00 29.74           C
ATOM   2503  CD2  LEU A 342      81.899  -11.873 251.230  1.00 27.80           C
ATOM   2504  N    ASN A 343      81.566  -10.451 246.036  1.00 27.14           N
ATOM   2505  CA   ASN A 343      82.500   -9.859 245.052  1.00 25.93           C
ATOM   2506  C    ASN A 343      81.987   -8.531 244.462  1.00 25.48           C
ATOM   2507  O    ASN A 343      82.778   -7.674 244.086  1.00 26.05           O
ATOM   2508  CB   ASN A 343      82.836  -10.854 243.938  1.00 24.96           C
ATOM   2509  CG   ASN A 343      83.815  -11.943 244.377  1.00 24.42           C
ATOM   2510  OD1  ASN A 343      84.533  -11.811 245.377  1.00 24.58           O
ATOM   2511  ND2  ASN A 343      83.838  -13.034 243.624  1.00 22.81           N
ATOM   2512  N    HIS A 344      80.666   -8.363 244.426  1.00 26.30           N
ATOM   2513  CA   HIS A 344      80.021   -7.105 244.009  1.00 27.72           C
ATOM   2514  C    HIS A 344      80.041   -6.079 245.133  1.00 27.47           C
ATOM   2515  O    HIS A 344      80.374   -4.919 244.925  1.00 27.38           O
ATOM   2516  CB   HIS A 344      78.564   -7.364 243.563  1.00 28.08           C
ATOM   2517  CG   HIS A 344      77.784   -6.121 243.255  1.00 29.05           C
ATOM   2518  ND1  HIS A 344      78.028   -5.343 242.144  1.00 30.92           N
ATOM   2519  CD2  HIS A 344      76.744   -5.540 243.894  1.00 29.98           C
ATOM   2520  CE1  HIS A 344      77.186   -4.327 242.121  1.00 30.86           C
ATOM   2521  NE2  HIS A 344      76.398   -4.420 243.177  1.00 30.99           N
ATOM   2522  N    LEU A 345      79.716   -6.538 246.333  1.00 27.12           N
ATOM   2523  CA   LEU A 345      79.409   -5.660 247.445  1.00 26.89           C
ATOM   2524  C    LEU A 345      80.629   -5.144 248.191  1.00 26.34           C
ATOM   2525  O    LEU A 345      80.748   -3.933 248.463  1.00 27.12           O
ATOM   2526  CB   LEU A 345      78.531   -6.412 248.441  1.00 27.65           C
ATOM   2527  CG   LEU A 345      77.062   -6.525 248.062  1.00 27.54           C
ATOM   2528  CD1  LEU A 345      76.336   -7.527 248.968  1.00 26.06           C
ATOM   2529  CD2  LEU A 345      76.442   -5.133 248.090  1.00 27.17           C
ATOM   2530  N    GLU A 346      81.519   -6.063 248.535  1.00 25.03           N
ATOM   2531  CA   GLU A 346      82.624   -5.746 249.409  1.00 25.02           C
ATOM   2532  C    GLU A 346      83.690   -4.887 248.759  1.00 24.31           C
ATOM   2533  O    GLU A 346      83.904   -3.781 249.234  1.00 26.50           O
ATOM   2534  CB   GLU A 346      83.235   -7.013 250.012  1.00 26.05           C
ATOM   2535  CG   GLU A 346      84.205   -6.726 251.138  1.00 26.62           C
ATOM   2536  CD   GLU A 346      84.377   -7.898 252.057  1.00 26.86           C
ATOM   2537  OE1  GLU A 346      84.718   -9.013 251.607  1.00 28.87           O
ATOM   2538  OE2  GLU A 346      84.184   -7.692 253.257  1.00 28.99           O
ATOM   2539  N    PRO A 347      84.347   -5.353 247.679  1.00 23.32           N
ATOM   2540  CA   PRO A 347      85.507   -4.539 247.207  1.00 24.42           C
ATOM   2541  C    PRO A 347      85.239   -3.040 247.004  1.00 25.40           C
ATOM   2542  O    PRO A 347      86.023   -2.225 247.462  1.00 24.66           O
ATOM   2543  CB   PRO A 347      85.937   -5.219 245.900  1.00 23.18           C
ATOM   2544  CG   PRO A 347      85.464   -6.637 246.049  1.00 23.74           C
ATOM   2545  CD   PRO A 347      84.198   -6.597 246.893  1.00 23.71           C
```

Appendix 2

```
ATOM   2546  N   PRO A 348      84.118  -2.666 246.371  1.00 26.84           N
ATOM   2547  CA  PRO A 348      83.945  -1.210 246.267  1.00 26.12           C
ATOM   2548  C   PRO A 348      83.785  -0.495 247.603  1.00 25.67           C
ATOM   2549  O   PRO A 348      84.007   0.694 247.664  1.00 25.04           O
ATOM   2550  CB  PRO A 348      82.683  -1.048 245.409  1.00 25.60           C
ATOM   2551  CG  PRO A 348      82.013  -2.368 245.430  1.00 26.45           C
ATOM   2552  CD  PRO A 348      83.065  -3.409 245.661  1.00 26.35           C
ATOM   2553  N   ALA A 349      83.388  -1.192 248.663  1.00 26.91           N
ATOM   2554  CA  ALA A 349      83.267  -0.536 249.969  1.00 26.64           C
ATOM   2555  C   ALA A 349      84.621  -0.212 250.625  1.00 25.30           C
ATOM   2556  O   ALA A 349      84.651   0.442 251.663  1.00 23.30           O
ATOM   2557  CB  ALA A 349      82.390  -1.352 250.912  1.00 26.38           C
ATOM   2558  N   LYS A 350      85.709  -0.669 250.002  1.00 25.78           N
ATOM   2559  CA  LYS A 350      87.099  -0.336 250.383  1.00 27.11           C
ATOM   2560  C   LYS A 350      87.340  -0.559 251.908  1.00 28.37           C
ATOM   2561  O   LYS A 350      87.639   0.390 252.668  1.00 29.79           O
ATOM   2562  CB  LYS A 350      87.512   1.069 249.861  1.00 26.70           C
ATOM   2563  N   PRO A 351      87.203  -1.830 252.352  1.00 26.73           N
ATOM   2564  CA  PRO A 351      87.458  -2.201 253.716  1.00 27.40           C
ATOM   2565  C   PRO A 351      88.934  -2.146 254.012  1.00 29.30           C
ATOM   2566  O   PRO A 351      89.745  -2.433 253.143  1.00 29.93           O
ATOM   2567  CB  PRO A 351      87.039  -3.659 253.765  1.00 26.35           C
ATOM   2568  CG  PRO A 351      87.331  -4.165 252.407  1.00 25.91           C
ATOM   2569  CD  PRO A 351      87.053  -3.019 251.496  1.00 26.28           C
ATOM   2570  N   SER A 352      89.271  -1.788 255.238  1.00 31.37           N
ATOM   2571  CA  SER A 352      90.641  -1.808 255.690  1.00 32.53           C
ATOM   2572  C   SER A 352      90.559  -2.306 257.108  1.00 32.16           C
ATOM   2573  O   SER A 352      89.571  -2.025 257.813  1.00 30.48           O
ATOM   2574  CB  SER A 352      91.253  -0.400 255.663  1.00 33.24           C
ATOM   2575  OG  SER A 352      90.480   0.490 256.450  1.00 33.28           O
ATOM   2576  N   ILE A 353      91.594  -3.044 257.506  1.00 30.87           N
ATOM   2577  CA  ILE A 353      91.783  -3.455 258.895  1.00 29.37           C
ATOM   2578  C   ILE A 353      92.895  -2.609 259.525  1.00 28.13           C
ATOM   2579  O   ILE A 353      94.023  -2.606 259.042  1.00 27.44           O
ATOM   2580  CB  ILE A 353      92.073  -4.966 258.981  1.00 28.37           C
ATOM   2581  CG1 ILE A 353      90.875  -5.722 258.370  1.00 28.69           C
ATOM   2582  CG2 ILE A 353      92.349  -5.353 260.420  1.00 28.64           C
ATOM   2583  CD1 ILE A 353      90.724  -7.181 258.725  1.00 29.04           C
ATOM   2584  N   VAL A 354      92.545  -1.863 260.575  1.00 27.13           N
ATOM   2585  CA  VAL A 354      93.483  -0.998 261.296  1.00 26.29           C
ATOM   2586  C   VAL A 354      93.396  -1.265 262.798  1.00 24.56           C
ATOM   2587  O   VAL A 354      92.321  -1.199 263.384  1.00 25.11           O
ATOM   2588  CB  VAL A 354      93.210   0.508 261.010  1.00 27.02           C
ATOM   2589  CG1 VAL A 354      94.064   1.403 261.920  1.00 27.27           C
ATOM   2590  CG2 VAL A 354      93.474   0.839 259.547  1.00 25.94           C
ATOM   2591  N   SER A 355      94.543  -1.551 263.411  1.00 24.44           N
ATOM   2592  CA  SER A 355      94.628  -1.990 264.815  1.00 23.82           C
ATOM   2593  C   SER A 355      93.657  -3.137 265.080  1.00 24.42           C
ATOM   2594  O   SER A 355      92.993  -3.168 266.108  1.00 24.36           O
ATOM   2595  CB  SER A 355      94.386  -0.820 265.780  1.00 23.36           C
ATOM   2596  OG  SER A 355      94.976  -1.055 267.073  1.00 23.74           O
ATOM   2597  N   ALA A 356      93.585  -4.067 264.122  1.00 26.44           N
ATOM   2598  CA  ALA A 356      92.805  -5.312 264.219  1.00 26.78           C
ATOM   2599  C   ALA A 356      91.307  -5.044 264.326  1.00 27.40           C
```

Appendix 2

```
ATOM   2600  O    ALA A 356      90.579  -5.791 264.994  1.00 26.97           O
ATOM   2601  CB   ALA A 356      93.288  -6.176 265.395  1.00 26.74           C
ATOM   2602  N    SER A 357      90.869  -3.989 263.637  1.00 27.79           N
ATOM   2603  CA   SER A 357      89.472  -3.532 263.645  1.00 27.46           C
ATOM   2604  C    SER A 357      89.061  -3.153 262.214  1.00 26.90           C
ATOM   2605  O    SER A 357      89.779  -2.417 261.540  1.00 25.07           O
ATOM   2606  CB   SER A 357      89.347  -2.320 264.577  1.00 27.76           C
ATOM   2607  OG   SER A 357      88.072  -2.197 265.155  1.00 25.91           O
ATOM   2608  N    LEU A 358      87.916  -3.668 261.763  1.00 26.80           N
ATOM   2609  CA   LEU A 358      87.416  -3.450 260.403  1.00 25.38           C
ATOM   2610  C    LEU A 358      86.643  -2.132 260.201  1.00 26.41           C
ATOM   2611  O    LEU A 358      85.790  -1.772 260.990  1.00 27.28           O
ATOM   2612  CB   LEU A 358      86.488  -4.594 260.065  1.00 24.28           C
ATOM   2613  CG   LEU A 358      85.896  -4.571 258.669  1.00 22.70           C
ATOM   2614  CD1  LEU A 358      86.993  -4.638 257.648  1.00 22.63           C
ATOM   2615  CD2  LEU A 358      84.970  -5.743 258.495  1.00 22.72           C
ATOM   2616  N    ARG A 359      86.941  -1.427 259.127  1.00 27.65           N
ATOM   2617  CA   ARG A 359      86.257  -0.183 258.796  1.00 29.73           C
ATOM   2618  C    ARG A 359      85.973  -0.242 257.287  1.00 31.22           C
ATOM   2619  O    ARG A 359      86.780  -0.794 256.528  1.00 33.13           O
ATOM   2620  CB   ARG A 359      87.139   1.045 259.164  1.00 29.56           C
ATOM   2621  N    TYR A 360      84.835   0.281 256.845  1.00 30.09           N
ATOM   2622  CA   TYR A 360      84.594   0.388 255.417  1.00 31.20           C
ATOM   2623  C    TYR A 360      84.633   1.860 255.005  1.00 31.91           C
ATOM   2624  O    TYR A 360      83.892   2.668 255.545  1.00 32.46           O
ATOM   2625  CB   TYR A 360      83.252  -0.232 255.060  1.00 30.95           C
ATOM   2626  CG   TYR A 360      83.205  -1.745 255.124  1.00 31.10           C
ATOM   2627  CD1  TYR A 360      83.733  -2.523 254.095  1.00 31.19           C
ATOM   2628  CD2  TYR A 360      82.565  -2.403 256.184  1.00 33.12           C
ATOM   2629  CE1  TYR A 360      83.685  -3.914 254.135  1.00 31.71           C
ATOM   2630  CE2  TYR A 360      82.497  -3.794 256.233  1.00 32.79           C
ATOM   2631  CZ   TYR A 360      83.062  -4.549 255.203  1.00 32.82           C
ATOM   2632  OH   TYR A 360      83.003  -5.929 255.240  1.00 34.14           O
ATOM   2633  N    GLU A 361      85.495   2.207 254.056  1.00 32.29           N
ATOM   2634  CA   GLU A 361      85.614   3.594 253.617  1.00 33.45           C
ATOM   2635  C    GLU A 361      84.382   4.016 252.803  1.00 33.73           C
ATOM   2636  O    GLU A 361      83.989   5.165 252.870  1.00 31.84           O
ATOM   2637  CB   GLU A 361      86.915   3.829 252.818  1.00 34.07           C
ATOM   2638  N    HIS A 362      83.778   3.100 252.040  1.00 35.95           N
ATOM   2639  CA   HIS A 362      82.639   3.444 251.165  1.00 38.05           C
ATOM   2640  C    HIS A 362      81.461   2.454 251.277  1.00 32.92           C
ATOM   2641  O    HIS A 362      81.068   1.822 250.312  1.00 31.40           O
ATOM   2642  CB   HIS A 362      83.091   3.637 249.696  1.00 42.22           C
ATOM   2643  CG   HIS A 362      84.087   4.745 249.518  1.00 53.57           C
ATOM   2644  ND1  HIS A 362      83.896   6.012 250.044  1.00 59.77           N
ATOM   2645  CD2  HIS A 362      85.295   4.774 248.897  1.00 56.72           C
ATOM   2646  CE1  HIS A 362      84.944   6.769 249.755  1.00 60.59           C
ATOM   2647  NE2  HIS A 362      85.804   6.045 249.056  1.00 59.07           N
ATOM   2648  N    PRO A 363      80.849   2.362 252.459  1.00 30.64           N
ATOM   2649  CA   PRO A 363      79.689   1.470 252.552  1.00 29.39           C
ATOM   2650  C    PRO A 363      78.651   1.814 251.470  1.00 26.91           C
ATOM   2651  O    PRO A 363      78.354   2.978 251.227  1.00 24.49           O
ATOM   2652  CB   PRO A 363      79.150   1.742 253.964  1.00 29.35           C
ATOM   2653  CG   PRO A 363      79.559   3.156 254.241  1.00 29.91           C
```

Appendix 2

```
ATOM   2654  CD  PRO A 363      80.937   3.268 253.619  1.00 30.64           C
ATOM   2655  N   GLY A 364      78.135   0.796 250.811  1.00 26.25           N
ATOM   2656  CA  GLY A 364      77.387   0.993 249.567  1.00 27.06           C
ATOM   2657  C   GLY A 364      75.898   1.195 249.735  1.00 27.72           C
ATOM   2658  O   GLY A 364      75.216   1.488 248.751  1.00 25.09           O
ATOM   2659  N   SER A 365      75.428   1.063 250.987  1.00 28.01           N
ATOM   2660  CA  SER A 365      74.020   1.078 251.362  1.00 27.24           C
ATOM   2661  C   SER A 365      73.938   1.298 252.850  1.00 27.87           C
ATOM   2662  O   SER A 365      74.964   1.297 253.544  1.00 29.26           O
ATOM   2663  CB  SER A 365      73.357  -0.280 251.045  1.00 27.88           C
ATOM   2664  OG  SER A 365      73.728  -1.322 251.951  1.00 26.50           O
ATOM   2665  N   LEU A 366      72.719   1.444 253.352  1.00 27.62           N
ATOM   2666  CA  LEU A 366      72.480   1.398 254.799  1.00 27.68           C
ATOM   2667  C   LEU A 366      72.683  -0.040 255.259  1.00 28.31           C
ATOM   2668  O   LEU A 366      72.708  -0.974 254.443  1.00 27.58           O
ATOM   2669  CB  LEU A 366      71.044   1.824 255.166  1.00 27.65           C
ATOM   2670  CG  LEU A 366      70.571   3.206 254.693  1.00 27.56           C
ATOM   2671  CD1 LEU A 366      69.052   3.330 254.795  1.00 27.29           C
ATOM   2672  CD2 LEU A 366      71.270   4.296 255.491  1.00 26.86           C
ATOM   2673  N   LEU A 367      72.820  -0.203 256.572  1.00 27.97           N
ATOM   2674  CA  LEU A 367      72.911  -1.518 257.197  1.00 29.46           C
ATOM   2675  C   LEU A 367      74.079  -2.334 256.643  1.00 29.43           C
ATOM   2676  O   LEU A 367      74.073  -3.566 256.700  1.00 29.58           O
ATOM   2677  CB  LEU A 367      71.575  -2.281 257.047  1.00 28.85           C
ATOM   2678  CG  LEU A 367      70.414  -1.496 257.639  1.00 28.68           C
ATOM   2679  CD1 LEU A 367      69.119  -2.204 257.350  1.00 28.70           C
ATOM   2680  CD2 LEU A 367      70.616  -1.344 259.143  1.00 30.24           C
ATOM   2681  N   PHE A 368      75.095  -1.641 256.134  1.00 29.44           N
ATOM   2682  CA  PHE A 368      76.150  -2.312 255.387  1.00 27.87           C
ATOM   2683  C   PHE A 368      76.981  -3.232 256.263  1.00 27.44           C
ATOM   2684  O   PHE A 368      76.960  -4.435 256.049  1.00 26.88           O
ATOM   2685  CB  PHE A 368      77.047  -1.318 254.680  1.00 27.71           C
ATOM   2686  CG  PHE A 368      77.945  -1.951 253.679  1.00 26.57           C
ATOM   2687  CD1 PHE A 368      77.449  -2.336 252.454  1.00 27.47           C
ATOM   2688  CD2 PHE A 368      79.269  -2.190 253.973  1.00 25.47           C
ATOM   2689  CE1 PHE A 368      78.284  -2.926 251.515  1.00 28.59           C
ATOM   2690  CE2 PHE A 368      80.111  -2.791 253.053  1.00 25.50           C
ATOM   2691  CZ  PHE A 368      79.623  -3.149 251.822  1.00 27.12           C
ATOM   2692  N   ASP A 369      77.702  -2.708 257.254  1.00 25.88           N
ATOM   2693  CA  ASP A 369      78.519  -3.616 258.026  1.00 26.18           C
ATOM   2694  C   ASP A 369      77.678  -4.634 258.824  1.00 25.66           C
ATOM   2695  O   ASP A 369      78.088  -5.768 258.978  1.00 26.38           O
ATOM   2696  CB  ASP A 369      79.560  -2.894 258.882  1.00 27.15           C
ATOM   2697  CG  ASP A 369      78.975  -2.216 260.070  1.00 29.39           C
ATOM   2698  OD1 ASP A 369      78.398  -1.125 259.854  1.00 31.06           O
ATOM   2699  OD2 ASP A 369      79.122  -2.754 261.210  1.00 30.67           O
ATOM   2700  N   GLU A 370      76.503  -4.243 259.296  1.00 25.67           N
ATOM   2701  CA  GLU A 370      75.596  -5.190 259.944  1.00 25.93           C
ATOM   2702  C   GLU A 370      75.302  -6.420 259.082  1.00 26.25           C
ATOM   2703  O   GLU A 370      75.292  -7.553 259.573  1.00 26.83           O
ATOM   2704  CB  GLU A 370      74.258  -4.530 260.279  1.00 25.83           C
ATOM   2705  CG  GLU A 370      74.325  -3.422 261.328  1.00 26.54           C
ATOM   2706  CD  GLU A 370      74.638  -2.041 260.774  1.00 26.42           C
ATOM   2707  OE1 GLU A 370      75.072  -1.907 259.597  1.00 26.41           O
```

Appendix 2

```
ATOM   2708  OE2 GLU A 370      74.438  -1.082 261.540  1.00 25.02           O
ATOM   2709  N   LEU A 371      75.043  -6.197 257.800  1.00 26.08           N
ATOM   2710  CA  LEU A 371      74.533  -7.263 256.937  1.00 25.25           C
ATOM   2711  C   LEU A 371      75.621  -8.168 256.400  1.00 24.90           C
ATOM   2712  O   LEU A 371      75.447  -9.387 256.333  1.00 26.29           O
ATOM   2713  CB  LEU A 371      73.709  -6.679 255.798  1.00 25.13           C
ATOM   2714  CG  LEU A 371      72.274  -6.347 256.216  1.00 25.39           C
ATOM   2715  CD1 LEU A 371      71.555  -5.587 255.118  1.00 26.40           C
ATOM   2716  CD2 LEU A 371      71.468  -7.594 256.566  1.00 25.28           C
ATOM   2717  N   LEU A 372      76.737  -7.581 256.005  1.00 24.90           N
ATOM   2718  CA  LEU A 372      77.912  -8.371 255.626  1.00 25.26           C
ATOM   2719  C   LEU A 372      78.406  -9.187 256.826  1.00 25.60           C
ATOM   2720  O   LEU A 372      78.731 -10.382 256.695  1.00 25.20           O
ATOM   2721  CB  LEU A 372      79.018  -7.471 255.077  1.00 25.87           C
ATOM   2722  CG  LEU A 372      78.982  -7.230 253.549  1.00 25.76           C
ATOM   2723  CD1 LEU A 372      77.763  -6.437 253.103  1.00 24.58           C
ATOM   2724  CD2 LEU A 372      80.262  -6.536 253.106  1.00 25.54           C
ATOM   2725  N   PHE A 373      78.430  -8.555 258.000  1.00 23.74           N
ATOM   2726  CA  PHE A 373      78.720  -9.292 259.219  1.00 23.41           C
ATOM   2727  C   PHE A 373      77.767 -10.495 259.373  1.00 24.25           C
ATOM   2728  O   PHE A 373      78.218 -11.613 259.611  1.00 23.27           O
ATOM   2729  CB  PHE A 373      78.623  -8.385 260.447  1.00 22.88           C
ATOM   2730  CG  PHE A 373      78.629  -9.118 261.756  1.00 22.32           C
ATOM   2731  CD1 PHE A 373      79.709  -9.925 262.119  1.00 22.03           C
ATOM   2732  CD2 PHE A 373      77.555  -8.997 262.641  1.00 22.91           C
ATOM   2733  CE1 PHE A 373      79.716 -10.596 263.337  1.00 22.03           C
ATOM   2734  CE2 PHE A 373      77.559  -9.659 263.868  1.00 22.26           C
ATOM   2735  CZ  PHE A 373      78.647 -10.453 264.219  1.00 21.92           C
ATOM   2736  N   LEU A 374      76.457 -10.253 259.260  1.00 23.56           N
ATOM   2737  CA  LEU A 374      75.475 -11.294 259.466  1.00 22.14           C
ATOM   2738  C   LEU A 374      75.684 -12.437 258.486  1.00 23.12           C
ATOM   2739  O   LEU A 374      75.821 -13.606 258.875  1.00 22.51           O
ATOM   2740  CB  LEU A 374      74.078 -10.726 259.318  1.00 21.38           C
ATOM   2741  CG  LEU A 374      72.950 -11.746 259.456  1.00 21.65           C
ATOM   2742  CD1 LEU A 374      73.185 -12.676 260.669  1.00 22.23           C
ATOM   2743  CD2 LEU A 374      71.597 -11.042 259.542  1.00 20.56           C
ATOM   2744  N   ALA A 375      75.744 -12.093 257.206  1.00 23.92           N
ATOM   2745  CA  ALA A 375      75.882 -13.100 256.169  1.00 23.82           C
ATOM   2746  C   ALA A 375      77.145 -13.891 256.328  1.00 24.31           C
ATOM   2747  O   ALA A 375      77.169 -15.063 255.965  1.00 26.95           O
ATOM   2748  CB  ALA A 375      75.870 -12.462 254.802  1.00 24.89           C
ATOM   2749  N   LYS A 376      78.205 -13.268 256.838  1.00 23.36           N
ATOM   2750  CA  LYS A 376      79.484 -13.975 256.946  1.00 23.60           C
ATOM   2751  C   LYS A 376      79.444 -15.064 257.987  1.00 24.78           C
ATOM   2752  O   LYS A 376      80.072 -16.108 257.814  1.00 27.89           O
ATOM   2753  CB  LYS A 376      80.649 -13.031 257.213  1.00 23.50           C
ATOM   2754  CG  LYS A 376      81.134 -12.323 255.958  1.00 24.26           C
ATOM   2755  CD  LYS A 376      82.124 -11.232 256.271  1.00 23.88           C
ATOM   2756  CE  LYS A 376      82.524 -10.513 255.001  1.00 24.23           C
ATOM   2757  NZ  LYS A 376      83.798  -9.756 255.191  1.00 24.98           N
ATOM   2758  N   VAL A 377      78.673 -14.859 259.038  1.00 24.24           N
ATOM   2759  CA  VAL A 377      78.689 -15.785 260.149  1.00 25.02           C
ATOM   2760  C   VAL A 377      77.430 -16.647 260.231  1.00 24.28           C
ATOM   2761  O   VAL A 377      77.365 -17.568 261.043  1.00 22.36           O
```

Appendix 2

```
ATOM   2762  CB   VAL A 377      78.890 -15.031 261.472  1.00 25.64           C
ATOM   2763  CG1  VAL A 377      80.159 -14.191 261.393  1.00 25.79           C
ATOM   2764  CG2  VAL A 377      77.668 -14.166 261.806  1.00 26.58           C
ATOM   2765  N    HIS A 378      76.445 -16.367 259.384  1.00 24.08           N
ATOM   2766  CA   HIS A 378      75.128 -16.960 259.570  1.00 24.12           C
ATOM   2767  C    HIS A 378      75.175 -18.499 259.502  1.00 23.92           C
ATOM   2768  O    HIS A 378      75.577 -19.062 258.504  1.00 21.78           O
ATOM   2769  CB   HIS A 378      74.162 -16.413 258.537  1.00 24.23           C
ATOM   2770  CG   HIS A 378      72.730 -16.774 258.794  1.00 25.30           C
ATOM   2771  ND1  HIS A 378      72.087 -16.485 259.978  1.00 24.78           N
ATOM   2772  CD2  HIS A 378      71.807 -17.366 258.000  1.00 25.33           C
ATOM   2773  CE1  HIS A 378      70.836 -16.891 259.911  1.00 24.31           C
ATOM   2774  NE2  HIS A 378      70.640 -17.430 258.722  1.00 25.50           N
ATOM   2775  N    ALA A 379      74.762 -19.149 260.587  1.00 24.16           N
ATOM   2776  CA   ALA A 379      74.788 -20.602 260.690  1.00 25.16           C
ATOM   2777  C    ALA A 379      73.492 -21.239 260.191  1.00 26.10           C
ATOM   2778  O    ALA A 379      73.444 -22.445 259.998  1.00 26.84           O
ATOM   2779  CB   ALA A 379      75.061 -21.027 262.130  1.00 24.23           C
ATOM   2780  N    GLY A 380      72.457 -20.429 259.966  1.00 25.69           N
ATOM   2781  CA   GLY A 380      71.141 -20.933 259.590  1.00 24.12           C
ATOM   2782  C    GLY A 380      70.175 -20.694 260.732  1.00 23.01           C
ATOM   2783  O    GLY A 380      70.488 -20.937 261.884  1.00 24.12           O
ATOM   2784  N    PHE A 381      68.990 -20.210 260.416  1.00 22.28           N
ATOM   2785  CA   PHE A 381      68.003 -19.950 261.444  1.00 22.04           C
ATOM   2786  C    PHE A 381      67.588 -21.251 262.099  1.00 22.38           C
ATOM   2787  O    PHE A 381      67.312 -21.297 263.303  1.00 24.76           O
ATOM   2788  CB   PHE A 381      66.821 -19.157 260.863  1.00 21.65           C
ATOM   2789  CG   PHE A 381      67.179 -17.720 260.528  1.00 21.62           C
ATOM   2790  CD1  PHE A 381      67.386 -16.787 261.535  1.00 21.13           C
ATOM   2791  CD2  PHE A 381      67.344 -17.313 259.224  1.00 22.02           C
ATOM   2792  CE1  PHE A 381      67.721 -15.488 261.246  1.00 20.71           C
ATOM   2793  CE2  PHE A 381      67.692 -15.998 258.922  1.00 21.24           C
ATOM   2794  CZ   PHE A 381      67.878 -15.090 259.939  1.00 21.04           C
ATOM   2795  N    GLY A 382      67.573 -22.323 261.320  1.00 22.55           N
ATOM   2796  CA   GLY A 382      67.355 -23.643 261.870  1.00 22.28           C
ATOM   2797  C    GLY A 382      68.406 -23.967 262.923  1.00 22.13           C
ATOM   2798  O    GLY A 382      68.067 -24.326 264.045  1.00 23.38           O
ATOM   2799  N    ALA A 383      69.679 -23.831 262.584  1.00 21.32           N
ATOM   2800  CA   ALA A 383      70.723 -24.194 263.527  1.00 22.12           C
ATOM   2801  C    ALA A 383      70.621 -23.349 264.799  1.00 24.14           C
ATOM   2802  O    ALA A 383      70.771 -23.869 265.894  1.00 25.27           O
ATOM   2803  CB   ALA A 383      72.105 -24.086 262.887  1.00 21.60           C
ATOM   2804  N    LEU A 384      70.325 -22.059 264.655  1.00 26.11           N
ATOM   2805  CA   LEU A 384      70.124 -21.197 265.818  1.00 27.47           C
ATOM   2806  C    LEU A 384      68.959 -21.665 266.665  1.00 26.66           C
ATOM   2807  O    LEU A 384      68.965 -21.461 267.866  1.00 26.05           O
ATOM   2808  CB   LEU A 384      69.881 -19.720 265.410  1.00 28.81           C
ATOM   2809  CG   LEU A 384      70.971 -18.888 264.714  1.00 29.34           C
ATOM   2810  CD1  LEU A 384      70.443 -17.490 264.460  1.00 30.97           C
ATOM   2811  CD2  LEU A 384      72.281 -18.810 265.490  1.00 28.74           C
ATOM   2812  N    LEU A 385      67.927 -22.232 266.052  1.00 28.44           N
ATOM   2813  CA   LEU A 385      66.791 -22.744 266.842  1.00 31.44           C
ATOM   2814  C    LEU A 385      67.190 -23.954 267.682  1.00 31.70           C
ATOM   2815  O    LEU A 385      66.694 -24.126 268.790  1.00 32.40           O
```

Appendix 2

```
ATOM   2816  CB   LEU A 385      65.616 -23.142 265.952  1.00 33.73           C
ATOM   2817  CG   LEU A 385      64.581 -22.081 265.593  1.00 36.13           C
ATOM   2818  CD1  LEU A 385      63.748 -22.559 264.413  1.00 36.54           C
ATOM   2819  CD2  LEU A 385      63.681 -21.778 266.784  1.00 37.58           C
ATOM   2820  N    ARG A 386      68.076 -24.790 267.147  1.00 31.72           N
ATOM   2821  CA   ARG A 386      68.514 -26.003 267.826  1.00 33.42           C
ATOM   2822  C    ARG A 386      69.800 -25.789 268.623  1.00 33.45           C
ATOM   2823  O    ARG A 386      70.560 -26.734 268.851  1.00 35.91           O
ATOM   2824  CB   ARG A 386      68.722 -27.132 266.799  1.00 36.14           C
ATOM   2825  CG   ARG A 386      67.438 -27.617 266.133  1.00 37.43           C
ATOM   2826  CD   ARG A 386      67.737 -28.645 265.062  1.00 39.07           C
ATOM   2827  NE   ARG A 386      68.418 -28.069 263.880  1.00 41.35           N
ATOM   2828  CZ   ARG A 386      67.816 -27.631 262.760  1.00 40.25           C
ATOM   2829  NH1  ARG A 386      66.480 -27.655 262.634  1.00 37.00           N
ATOM   2830  NH2  ARG A 386      68.564 -27.142 261.758  1.00 38.32           N
ATOM   2831  N    MET A 387      70.028 -24.563 269.084  1.00 32.35           N
ATOM   2832  CA   MET A 387      71.272 -24.227 269.775  1.00 32.04           C
ATOM   2833  C    MET A 387      71.454 -25.002 271.087  1.00 31.35           C
ATOM   2834  O    MET A 387      70.617 -24.917 271.960  1.00 28.89           O
ATOM   2835  CB   MET A 387      71.341 -22.725 270.047  1.00 30.75           C
ATOM   2836  CG   MET A 387      72.745 -22.233 270.359  1.00 31.41           C
ATOM   2837  SD   MET A 387      72.813 -20.488 270.821  1.00 31.46           S
ATOM   2838  CE   MET A 387      72.529 -19.743 269.219  1.00 31.66           C
ATOM   2839  N    PRO A 388      72.560 -25.754 271.222  1.00 34.05           N
ATOM   2840  CA   PRO A 388      72.874 -26.502 272.460  1.00 34.56           C
ATOM   2841  C    PRO A 388      73.051 -25.588 273.659  1.00 35.05           C
ATOM   2842  O    PRO A 388      73.634 -24.525 273.516  1.00 36.69           O
ATOM   2843  CB   PRO A 388      74.230 -27.142 272.150  1.00 34.59           C
ATOM   2844  CG   PRO A 388      74.309 -27.174 270.658  1.00 35.61           C
ATOM   2845  CD   PRO A 388      73.600 -25.939 270.192  1.00 34.38           C
ATOM   2846  N    PRO A 389      72.582 -25.993 274.843  1.00 35.01           N
ATOM   2847  CA   PRO A 389      72.768 -25.111 275.989  1.00 35.20           C
ATOM   2848  C    PRO A 389      74.248 -24.807 276.279  1.00 35.95           C
ATOM   2849  O    PRO A 389      75.132 -25.460 275.733  1.00 31.44           O
ATOM   2850  CB   PRO A 389      72.094 -25.873 277.141  1.00 34.99           C
ATOM   2851  CG   PRO A 389      72.049 -27.286 276.702  1.00 35.30           C
ATOM   2852  CD   PRO A 389      71.887 -27.232 275.212  1.00 35.77           C
ATOM   2853  N    PRO A 390      74.507 -23.796 277.124  1.00 41.63           N
ATOM   2854  CA   PRO A 390      75.847 -23.163 277.186  1.00 44.83           C
ATOM   2855  C    PRO A 390      77.020 -24.051 277.655  1.00 48.05           C
ATOM   2856  O    PRO A 390      76.948 -24.688 278.708  1.00 52.37           O
ATOM   2857  CB   PRO A 390      75.641 -21.956 278.124  1.00 45.12           C
ATOM   2858  CG   PRO A 390      74.289 -22.120 278.750  1.00 45.35           C
ATOM   2859  CD   PRO A 390      73.494 -23.094 277.940  1.00 42.44           C
TER    2860       PRO A 390
ATOM   2861  N    GLU B  28     122.703  15.906 275.659  1.00 26.96           N
ATOM   2862  CA   GLU B  28     122.470  15.882 274.155  1.00 30.07           C
ATOM   2863  C    GLU B  28     120.958  15.938 273.805  1.00 31.99           C
ATOM   2864  O    GLU B  28     120.193  15.019 274.138  1.00 28.82           O
ATOM   2865  CB   GLU B  28     123.090  14.630 273.511  1.00 31.04           C
ATOM   2866  N    LEU B  29     120.544  17.012 273.129  1.00 32.09           N
ATOM   2867  CA   LEU B  29     119.127  17.365 273.014  1.00 31.98           C
ATOM   2868  C    LEU B  29     118.547  16.847 271.717  1.00 30.42           C
ATOM   2869  O    LEU B  29     118.849  17.404 270.694  1.00 27.82           O
```

Appendix 2

```
ATOM   2870  CB   LEU B  29     118.962  18.895 273.084  1.00 31.20           C
ATOM   2871  CG   LEU B  29     117.551  19.481 272.955  1.00 31.36           C
ATOM   2872  CD1  LEU B  29     116.615  18.927 274.017  1.00 31.62           C
ATOM   2873  CD2  LEU B  29     117.571  21.001 273.035  1.00 31.39           C
ATOM   2874  N    PRO B  30     117.694  15.793 271.763  1.00 31.75           N
ATOM   2875  CA   PRO B  30     117.194  15.217 270.501  1.00 31.70           C
ATOM   2876  C    PRO B  30     116.451  16.223 269.663  1.00 32.71           C
ATOM   2877  O    PRO B  30     115.923  17.176 270.207  1.00 32.27           O
ATOM   2878  CB   PRO B  30     116.233  14.110 270.945  1.00 30.45           C
ATOM   2879  CG   PRO B  30     116.640  13.766 272.334  1.00 31.53           C
ATOM   2880  CD   PRO B  30     117.198  15.043 272.933  1.00 32.09           C
ATOM   2881  N    PRO B  31     116.400  16.003 268.339  1.00 35.34           N
ATOM   2882  CA   PRO B  31     115.766  16.992 267.463  1.00 35.60           C
ATOM   2883  C    PRO B  31     114.282  17.156 267.771  1.00 34.51           C
ATOM   2884  O    PRO B  31     113.562  16.154 267.906  1.00 34.86           O
ATOM   2885  CB   PRO B  31     115.987  16.425 266.043  1.00 35.30           C
ATOM   2886  CG   PRO B  31     116.346  14.979 266.208  1.00 34.61           C
ATOM   2887  CD   PRO B  31     116.840  14.788 267.617  1.00 34.85           C
ATOM   2888  N    GLY B  32     113.848  18.407 267.908  1.00 33.80           N
ATOM   2889  CA   GLY B  32     112.426  18.725 268.146  1.00 32.26           C
ATOM   2890  C    GLY B  32     111.968  18.761 269.606  1.00 30.12           C
ATOM   2891  O    GLY B  32     110.807  19.101 269.895  1.00 27.88           O
ATOM   2892  N    ARG B  33     112.878  18.404 270.514  1.00 28.40           N
ATOM   2893  CA   ARG B  33     112.587  18.281 271.929  1.00 27.80           C
ATOM   2894  C    ARG B  33     112.793  19.613 272.625  1.00 28.58           C
ATOM   2895  O    ARG B  33     113.533  20.457 272.152  1.00 29.62           O
ATOM   2896  CB   ARG B  33     113.494  17.224 272.556  1.00 27.74           C
ATOM   2897  CG   ARG B  33     113.117  15.772 272.249  1.00 28.27           C
ATOM   2898  CD   ARG B  33     111.977  15.235 273.116  1.00 27.23           C
ATOM   2899  NE   ARG B  33     112.347  15.180 274.532  1.00 27.14           N
ATOM   2900  CZ   ARG B  33     112.968  14.164 275.128  1.00 27.14           C
ATOM   2901  NH1  ARG B  33     113.287  13.072 274.432  1.00 28.44           N
ATOM   2902  NH2  ARG B  33     113.262  14.228 276.435  1.00 25.61           N
ATOM   2903  N    LEU B  34     112.160  19.788 273.773  1.00 30.25           N
ATOM   2904  CA   LEU B  34     112.281  21.033 274.530  1.00 31.48           C
ATOM   2905  C    LEU B  34     113.319  20.907 275.636  1.00 32.20           C
ATOM   2906  O    LEU B  34     114.022  21.874 275.970  1.00 30.55           O
ATOM   2907  CB   LEU B  34     110.913  21.458 275.085  1.00 32.70           C
ATOM   2908  CG   LEU B  34     109.867  21.630 273.954  1.00 33.71           C
ATOM   2909  CD1  LEU B  34     108.439  21.806 274.483  1.00 34.83           C
ATOM   2910  CD2  LEU B  34     110.263  22.770 273.018  1.00 33.20           C
ATOM   2911  N    ALA B  35     113.445  19.712 276.193  1.00 30.94           N
ATOM   2912  CA   ALA B  35     114.467  19.494 277.192  1.00 30.24           C
ATOM   2913  C    ALA B  35     114.904  18.033 277.179  1.00 29.37           C
ATOM   2914  O    ALA B  35     114.215  17.184 276.617  1.00 30.67           O
ATOM   2915  CB   ALA B  35     113.943  19.915 278.554  1.00 30.12           C
ATOM   2916  N    THR B  36     116.057  17.740 277.763  1.00 26.94           N
ATOM   2917  CA   THR B  36     116.517  16.349 277.807  1.00 26.87           C
ATOM   2918  C    THR B  36     115.769  15.547 278.888  1.00 24.79           C
ATOM   2919  O    THR B  36     115.283  16.095 279.879  1.00 22.82           O
ATOM   2920  CB   THR B  36     118.042  16.243 278.042  1.00 26.48           C
ATOM   2921  OG1  THR B  36     118.390  16.753 279.348  1.00 25.60           O
ATOM   2922  CG2  THR B  36     118.773  17.007 276.969  1.00 26.29           C
ATOM   2923  N    THR B  37     115.690  14.245 278.664  1.00 23.13           N
```

Appendix 2

```
ATOM   2924  CA  THR B  37     115.169  13.321 279.635  1.00 22.49           C
ATOM   2925  C   THR B  37     115.904  13.454 280.951  1.00 23.50           C
ATOM   2926  O   THR B  37     115.302  13.491 282.016  1.00 24.31           O
ATOM   2927  CB  THR B  37     115.291  11.898 279.096  1.00 21.81           C
ATOM   2928  OG1 THR B  37     114.352  11.732 278.025  1.00 21.72           O
ATOM   2929  CG2 THR B  37     115.010  10.890 280.166  1.00 22.15           C
ATOM   2930  N   GLU B  38     117.216  13.557 280.870  1.00 25.90           N
ATOM   2931  CA  GLU B  38     118.048  13.677 282.047  1.00 27.69           C
ATOM   2932  C   GLU B  38     117.609  14.888 282.830  1.00 26.20           C
ATOM   2933  O   GLU B  38     117.538  14.867 284.056  1.00 27.53           O
ATOM   2934  CB  GLU B  38     119.514  13.794 281.617  1.00 30.79           C
ATOM   2935  CG  GLU B  38     120.522  13.934 282.744  1.00 33.29           C
ATOM   2936  CD  GLU B  38     121.800  14.579 282.246  1.00 35.64           C
ATOM   2937  OE1 GLU B  38     122.459  13.966 281.389  1.00 37.62           O
ATOM   2938  OE2 GLU B  38     122.126  15.702 282.674  1.00 36.17           O
ATOM   2939  N   ASP B  39     117.309  15.950 282.112  1.00 25.89           N
ATOM   2940  CA  ASP B  39     116.777  17.134 282.750  1.00 26.36           C
ATOM   2941  C   ASP B  39     115.407  16.914 283.371  1.00 25.91           C
ATOM   2942  O   ASP B  39     115.175  17.410 284.462  1.00 27.86           O
ATOM   2943  CB  ASP B  39     116.771  18.343 281.785  1.00 27.73           C
ATOM   2944  CG  ASP B  39     118.104  19.109 281.794  1.00 27.87           C
ATOM   2945  OD1 ASP B  39     118.989  18.803 282.630  1.00 28.10           O
ATOM   2946  OD2 ASP B  39     118.263  20.029 280.982  1.00 27.34           O
ATOM   2947  N   TYR B  40     114.503  16.178 282.717  1.00 24.35           N
ATOM   2948  CA  TYR B  40     113.201  15.915 283.337  1.00 23.46           C
ATOM   2949  C   TYR B  40     113.362  15.067 284.582  1.00 22.76           C
ATOM   2950  O   TYR B  40     112.670  15.290 285.553  1.00 21.73           O
ATOM   2951  CB  TYR B  40     112.201  15.244 282.386  1.00 23.68           C
ATOM   2952  CG  TYR B  40     111.757  16.124 281.257  1.00 24.20           C
ATOM   2953  CD1 TYR B  40     111.191  17.374 281.492  1.00 25.14           C
ATOM   2954  CD2 TYR B  40     111.904  15.715 279.951  1.00 24.71           C
ATOM   2955  CE1 TYR B  40     110.806  18.197 280.437  1.00 25.25           C
ATOM   2956  CE2 TYR B  40     111.527  16.519 278.898  1.00 25.07           C
ATOM   2957  CZ  TYR B  40     110.977  17.747 279.135  1.00 25.75           C
ATOM   2958  OH  TYR B  40     110.608  18.501 278.049  1.00 26.34           O
ATOM   2959  N   PHE B  41     114.272  14.099 284.558  1.00 22.44           N
ATOM   2960  CA  PHE B  41     114.453  13.228 285.706  1.00 22.70           C
ATOM   2961  C   PHE B  41     115.209  13.857 286.819  1.00 22.24           C
ATOM   2962  O   PHE B  41     115.232  13.326 287.920  1.00 22.38           O
ATOM   2963  CB  PHE B  41     115.192  11.974 285.319  1.00 23.86           C
ATOM   2964  CG  PHE B  41     114.319  10.963 284.694  1.00 24.89           C
ATOM   2965  CD1 PHE B  41     113.719  11.221 283.457  1.00 24.41           C
ATOM   2966  CD2 PHE B  41     114.054   9.783 285.340  1.00 23.68           C
ATOM   2967  CE1 PHE B  41     112.900  10.296 282.870  1.00 24.10           C
ATOM   2968  CE2 PHE B  41     113.228   8.856 284.754  1.00 24.57           C
ATOM   2969  CZ  PHE B  41     112.663   9.103 283.512  1.00 24.51           C
ATOM   2970  N   ALA B  42     115.851  14.976 286.547  1.00 22.63           N
ATOM   2971  CA  ALA B  42     116.617  15.638 287.592  1.00 24.37           C
ATOM   2972  C   ALA B  42     115.841  16.802 288.226  1.00 24.81           C
ATOM   2973  O   ALA B  42     116.319  17.422 289.164  1.00 28.10           O
ATOM   2974  CB  ALA B  42     117.968  16.099 287.040  1.00 23.58           C
ATOM   2975  N   GLN B  43     114.657  17.109 287.732  1.00 23.78           N
ATOM   2976  CA  GLN B  43     113.877  18.177 288.362  1.00 25.49           C
ATOM   2977  C   GLN B  43     113.748  18.021 289.859  1.00 25.60           C
```

Appendix 2

```
ATOM   2978  O    GLN B  43     113.920  18.987 290.596  1.00 25.74           O
ATOM   2979  CB   GLN B  43     112.468  18.280 287.799  1.00 25.27           C
ATOM   2980  CG   GLN B  43     112.432  18.837 286.414  1.00 26.02           C
ATOM   2981  CD   GLN B  43     111.143  18.501 285.711  1.00 27.41           C
ATOM   2982  OE1  GLN B  43     110.416  19.397 285.290  1.00 29.17           O
ATOM   2983  NE2  GLN B  43     110.854  17.209 285.567  1.00 27.20           N
ATOM   2984  N    GLN B  44     113.405  16.830 290.322  1.00 28.11           N
ATOM   2985  CA   GLN B  44     113.230  16.671 291.754  1.00 30.79           C
ATOM   2986  C    GLN B  44     114.538  16.968 292.516  1.00 30.03           C
ATOM   2987  O    GLN B  44     114.533  17.742 293.463  1.00 30.39           O
ATOM   2988  CB   GLN B  44     112.672  15.303 292.093  1.00 33.33           C
ATOM   2989  CG   GLN B  44     112.163  15.239 293.532  1.00 36.49           C
ATOM   2990  CD   GLN B  44     111.305  14.012 293.823  1.00 37.32           C
ATOM   2991  OE1  GLN B  44     110.837  13.301 292.911  1.00 37.46           O
ATOM   2992  NE2  GLN B  44     111.081  13.770 295.102  1.00 36.06           N
ATOM   2993  N    ALA B  45     115.658  16.416 292.056  1.00 30.19           N
ATOM   2994  CA   ALA B  45     116.968  16.690 292.667  1.00 30.00           C
ATOM   2995  C    ALA B  45     117.362  18.185 292.649  1.00 30.35           C
ATOM   2996  O    ALA B  45     117.818  18.731 293.651  1.00 28.26           O
ATOM   2997  CB   ALA B  45     118.048  15.845 291.990  1.00 29.18           C
ATOM   2998  N    LYS B  46     117.199  18.847 291.515  1.00 32.71           N
ATOM   2999  CA   LYS B  46     117.484  20.286 291.437  1.00 36.30           C
ATOM   3000  C    LYS B  46     116.431  21.150 292.151  1.00 34.80           C
ATOM   3001  O    LYS B  46     116.601  22.356 292.269  1.00 34.05           O
ATOM   3002  CB   LYS B  46     117.594  20.738 289.972  1.00 41.84           C
ATOM   3003  CG   LYS B  46     118.689  20.035 289.170  1.00 46.16           C
ATOM   3004  CD   LYS B  46     118.921  20.687 287.806  1.00 51.47           C
ATOM   3005  CE   LYS B  46     119.927  19.894 286.958  1.00 55.86           C
ATOM   3006  NZ   LYS B  46     119.675  19.983 285.482  1.00 55.15           N
ATOM   3007  N    GLN B  47     115.342  20.543 292.617  1.00 32.08           N
ATOM   3008  CA   GLN B  47     114.253  21.287 293.197  1.00 29.73           C
ATOM   3009  C    GLN B  47     113.774  22.403 292.276  1.00 26.52           C
ATOM   3010  O    GLN B  47     113.476  23.506 292.713  1.00 26.62           O
ATOM   3011  CB   GLN B  47     114.653  21.872 294.550  1.00 32.79           C
ATOM   3012  CG   GLN B  47     114.959  20.842 295.618  1.00 35.10           C
ATOM   3013  CD   GLN B  47     114.612  21.354 297.012  1.00 40.04           C
ATOM   3014  OE1  GLN B  47     115.188  22.347 297.492  1.00 37.12           O
ATOM   3015  NE2  GLN B  47     113.639  20.688 297.665  1.00 42.70           N
ATOM   3016  N    ALA B  48     113.680  22.114 290.994  1.00 23.81           N
ATOM   3017  CA   ALA B  48     113.199  23.098 290.066  1.00 22.32           C
ATOM   3018  C    ALA B  48     112.681  22.427 288.814  1.00 22.19           C
ATOM   3019  O    ALA B  48     113.285  21.483 288.303  1.00 24.28           O
ATOM   3020  CB   ALA B  48     114.312  24.068 289.725  1.00 22.61           C
ATOM   3021  N    VAL B  49     111.550  22.908 288.324  1.00 21.17           N
ATOM   3022  CA   VAL B  49     110.985  22.391 287.104  1.00 20.83           C
ATOM   3023  C    VAL B  49     111.742  22.984 285.928  1.00 21.78           C
ATOM   3024  O    VAL B  49     112.284  24.097 286.015  1.00 23.11           O
ATOM   3025  CB   VAL B  49     109.498  22.776 286.938  1.00 20.31           C
ATOM   3026  CG1  VAL B  49     108.658  22.300 288.109  1.00 19.55           C
ATOM   3027  CG2  VAL B  49     109.339  24.284 286.715  1.00 20.01           C
ATOM   3028  N    THR B  50     111.739  22.265 284.812  1.00 22.51           N
ATOM   3029  CA   THR B  50     112.384  22.755 283.588  1.00 24.37           C
ATOM   3030  C    THR B  50     111.674  24.016 283.047  1.00 25.81           C
ATOM   3031  O    THR B  50     110.517  24.263 283.372  1.00 27.42           O
```

Appendix 2

```
ATOM   3032  CB   THR B  50     112.387  21.664 282.505  1.00 23.57           C
ATOM   3033  OG1  THR B  50     111.039  21.416 282.039  1.00 22.80           O
ATOM   3034  CG2  THR B  50     112.996  20.389 283.065  1.00 22.68           C
ATOM   3035  N    PRO B  51     112.359  24.824 282.224  1.00 26.92           N
ATOM   3036  CA   PRO B  51     111.613  25.966 281.647  1.00 26.16           C
ATOM   3037  C    PRO B  51     110.322  25.592 280.894  1.00 24.43           C
ATOM   3038  O    PRO B  51     109.353  26.322 280.959  1.00 25.53           O
ATOM   3039  CB   PRO B  51     112.641  26.613 280.713  1.00 25.04           C
ATOM   3040  CG   PRO B  51     113.934  26.389 281.442  1.00 25.76           C
ATOM   3041  CD   PRO B  51     113.819  25.017 282.096  1.00 27.25           C
ATOM   3042  N    ASP B  52     110.291  24.452 280.231  1.00 23.74           N
ATOM   3043  CA   ASP B  52     109.136  24.091 279.427  1.00 22.80           C
ATOM   3044  C    ASP B  52     107.946  23.713 280.326  1.00 22.67           C
ATOM   3045  O    ASP B  52     106.799  24.139 280.075  1.00 19.78           O
ATOM   3046  CB   ASP B  52     109.479  23.001 278.382  1.00 23.65           C
ATOM   3047  CG   ASP B  52     109.992  21.680 278.996  1.00 24.85           C
ATOM   3048  OD1  ASP B  52     110.977  21.661 279.765  1.00 23.82           O
ATOM   3049  OD2  ASP B  52     109.394  20.630 278.658  1.00 28.14           O
ATOM   3050  N    VAL B  53     108.223  22.941 281.377  1.00 21.66           N
ATOM   3051  CA   VAL B  53     107.200  22.584 282.336  1.00 21.74           C
ATOM   3052  C    VAL B  53     106.621  23.883 282.924  1.00 22.72           C
ATOM   3053  O    VAL B  53     105.404  23.995 283.097  1.00 23.09           O
ATOM   3054  CB   VAL B  53     107.752  21.621 283.427  1.00 21.88           C
ATOM   3055  CG1  VAL B  53     106.932  21.698 284.707  1.00 21.22           C
ATOM   3056  CG2  VAL B  53     107.853  20.180 282.893  1.00 20.27           C
ATOM   3057  N    MET B  54     107.465  24.885 283.167  1.00 22.85           N
ATOM   3058  CA   MET B  54     106.970  26.200 283.658  1.00 23.79           C
ATOM   3059  C    MET B  54     106.072  26.886 282.648  1.00 21.79           C
ATOM   3060  O    MET B  54     105.028  27.434 283.017  1.00 21.70           O
ATOM   3061  CB   MET B  54     108.123  27.159 284.032  1.00 26.14           C
ATOM   3062  CG   MET B  54     107.683  28.509 284.631  1.00 26.79           C
ATOM   3063  SD   MET B  54     106.902  28.393 286.246  1.00 28.20           S
ATOM   3064  CE   MET B  54     108.379  28.199 287.271  1.00 27.56           C
ATOM   3065  N    ALA B  55     106.482  26.865 281.384  1.00 20.67           N
ATOM   3066  CA   ALA B  55     105.615  27.316 280.293  1.00 21.03           C
ATOM   3067  C    ALA B  55     104.276  26.556 280.228  1.00 21.16           C
ATOM   3068  O    ALA B  55     103.289  27.128 279.811  1.00 24.06           O
ATOM   3069  CB   ALA B  55     106.319  27.225 278.958  1.00 20.56           C
ATOM   3070  N    GLN B  56     104.232  25.294 280.638  1.00 19.29           N
ATOM   3071  CA   GLN B  56     102.954  24.577 280.702  1.00 19.08           C
ATOM   3072  C    GLN B  56     102.068  25.104 281.872  1.00 18.28           C
ATOM   3073  O    GLN B  56     100.896  25.365 281.706  1.00 16.32           O
ATOM   3074  CB   GLN B  56     103.214  23.053 280.798  1.00 18.78           C
ATOM   3075  CG   GLN B  56     102.019  22.193 281.156  1.00 18.12           C
ATOM   3076  CD   GLN B  56     101.007  22.087 280.049  1.00 18.85           C
ATOM   3077  OE1  GLN B  56     101.301  22.251 278.860  1.00 19.13           O
ATOM   3078  NE2  GLN B  56      99.800  21.771 280.434  1.00 19.52           N
ATOM   3079  N    LEU B  57     102.667  25.268 283.044  1.00 18.00           N
ATOM   3080  CA   LEU B  57     102.013  25.936 284.149  1.00 18.34           C
ATOM   3081  C    LEU B  57     101.473  27.312 283.787  1.00 19.01           C
ATOM   3082  O    LEU B  57     100.427  27.708 284.279  1.00 18.89           O
ATOM   3083  CB   LEU B  57     102.945  26.038 285.365  1.00 17.94           C
ATOM   3084  CG   LEU B  57     103.317  24.694 286.034  1.00 17.70           C
ATOM   3085  CD1  LEU B  57     104.390  24.952 287.078  1.00 18.10           C
```

Appendix 2

```
ATOM   3086  CD2 LEU B  57     102.136  23.955 286.670  1.00 17.33           C
ATOM   3087  N   ALA B  58     102.176  28.048 282.940  1.00 20.35           N
ATOM   3088  CA  ALA B  58     101.653  29.346 282.461  1.00 20.46           C
ATOM   3089  C   ALA B  58     100.467  29.144 281.516  1.00 19.48           C
ATOM   3090  O   ALA B  58      99.544  29.906 281.521  1.00 20.77           O
ATOM   3091  CB  ALA B  58     102.764  30.170 281.778  1.00 20.36           C
ATOM   3092  N   TYR B  59     100.497  28.127 280.685  1.00 20.08           N
ATOM   3093  CA  TYR B  59      99.338  27.826 279.850  1.00 21.37           C
ATOM   3094  C   TYR B  59      98.189  27.543 280.793  1.00 22.31           C
ATOM   3095  O   TYR B  59      97.100  28.060 280.636  1.00 23.96           O
ATOM   3096  CB  TYR B  59      99.572  26.617 278.914  1.00 21.36           C
ATOM   3097  CG  TYR B  59      98.275  26.009 278.498  1.00 21.13           C
ATOM   3098  CD1 TYR B  59      97.416  26.680 277.627  1.00 21.54           C
ATOM   3099  CD2 TYR B  59      97.864  24.809 279.030  1.00 21.60           C
ATOM   3100  CE1 TYR B  59      96.192  26.153 277.297  1.00 21.97           C
ATOM   3101  CE2 TYR B  59      96.641  24.265 278.706  1.00 21.83           C
ATOM   3102  CZ  TYR B  59      95.816  24.935 277.852  1.00 21.96           C
ATOM   3103  OH  TYR B  59      94.627  24.356 277.551  1.00 24.78           O
ATOM   3104  N   MET B  60      98.468  26.747 281.814  1.00 23.19           N
ATOM   3105  CA  MET B  60      97.447  26.324 282.745  1.00 22.88           C
ATOM   3106  C   MET B  60      96.888  27.466 283.612  1.00 22.40           C
ATOM   3107  O   MET B  60      95.743  27.386 284.057  1.00 21.03           O
ATOM   3108  CB  MET B  60      97.973  25.185 283.620  1.00 22.91           C
ATOM   3109  CG  MET B  60      98.198  23.883 282.869  1.00 23.10           C
ATOM   3110  SD  MET B  60      99.229  22.767 283.835  1.00 23.76           S
ATOM   3111  CE  MET B  60      98.126  22.318 285.140  1.00 23.96           C
ATOM   3112  N   ASN B  61      97.663  28.531 283.813  1.00 21.91           N
ATOM   3113  CA  ASN B  61      97.284  29.573 284.770  1.00 22.12           C
ATOM   3114  C   ASN B  61      97.221  30.996 284.227  1.00 21.18           C
ATOM   3115  O   ASN B  61      96.653  31.868 284.867  1.00 19.36           O
ATOM   3116  CB  ASN B  61      98.243  29.560 285.962  1.00 22.45           C
ATOM   3117  CG  ASN B  61      98.066  28.352 286.844  1.00 24.60           C
ATOM   3118  OD1 ASN B  61      97.446  28.439 287.896  1.00 26.38           O
ATOM   3119  ND2 ASN B  61      98.604  27.210 286.424  1.00 25.22           N
ATOM   3120  N   TYR B  62      97.801  31.263 283.070  1.00 20.99           N
ATOM   3121  CA  TYR B  62      98.078  32.674 282.754  1.00 21.56           C
ATOM   3122  C   TYR B  62      96.871  33.549 282.367  1.00 20.12           C
ATOM   3123  O   TYR B  62      96.595  34.538 283.004  1.00 19.86           O
ATOM   3124  CB  TYR B  62      99.193  32.837 281.697  1.00 21.22           C
ATOM   3125  CG  TYR B  62      99.822  34.201 281.787  1.00 21.58           C
ATOM   3126  CD1 TYR B  62      99.274  35.297 281.135  1.00 21.70           C
ATOM   3127  CD2 TYR B  62     100.943  34.401 282.558  1.00 22.69           C
ATOM   3128  CE1 TYR B  62      99.841  36.552 281.240  1.00 22.33           C
ATOM   3129  CE2 TYR B  62     101.521  35.655 282.666  1.00 23.53           C
ATOM   3130  CZ  TYR B  62     100.965  36.724 282.012  1.00 22.86           C
ATOM   3131  OH  TYR B  62     101.562  37.950 282.145  1.00 25.31           O
ATOM   3132  N   ILE B  63      96.217  33.219 281.272  1.00 20.21           N
ATOM   3133  CA  ILE B  63      95.310  34.152 280.647  1.00 19.73           C
ATOM   3134  C   ILE B  63      93.984  34.124 281.362  1.00 20.25           C
ATOM   3135  O   ILE B  63      93.431  33.060 281.630  1.00 18.86           O
ATOM   3136  CB  ILE B  63      95.131  33.830 279.161  1.00 19.77           C
ATOM   3137  CG1 ILE B  63      96.516  33.770 278.493  1.00 20.27           C
ATOM   3138  CG2 ILE B  63      94.269  34.892 278.490  1.00 19.09           C
ATOM   3139  CD1 ILE B  63      96.543  33.434 277.003  1.00 19.96           C
```

Appendix 2

```
ATOM   3140  N    ASP B  64      93.503  35.322 281.687  1.00 22.45           N
ATOM   3141  CA   ASP B  64      92.162  35.530 282.223  1.00 23.13           C
ATOM   3142  C    ASP B  64      91.102  34.784 281.439  1.00 22.44           C
ATOM   3143  O    ASP B  64      91.116  34.766 280.217  1.00 21.36           O
ATOM   3144  CB   ASP B  64      91.814  37.012 282.223  1.00 25.51           C
ATOM   3145  CG   ASP B  64      92.645  37.804 283.216  1.00 27.66           C
ATOM   3146  OD1  ASP B  64      93.230  37.213 284.151  1.00 32.07           O
ATOM   3147  OD2  ASP B  64      92.705  39.025 283.063  1.00 23.83           O
ATOM   3148  N    PHE B  65      90.225  34.114 282.181  1.00 22.02           N
ATOM   3149  CA   PHE B  65      89.025  33.455 281.664  1.00 21.58           C
ATOM   3150  C    PHE B  65      89.260  32.168 280.919  1.00 22.04           C
ATOM   3151  O    PHE B  65      88.564  31.178 281.200  1.00 22.86           O
ATOM   3152  CB   PHE B  65      88.176  34.407 280.809  1.00 20.46           C
ATOM   3153  CG   PHE B  65      87.907  35.718 281.476  1.00 20.23           C
ATOM   3154  CD1  PHE B  65      87.448  35.759 282.802  1.00 19.88           C
ATOM   3155  CD2  PHE B  65      88.118  36.927 280.799  1.00 20.18           C
ATOM   3156  CE1  PHE B  65      87.209  36.970 283.440  1.00 19.46           C
ATOM   3157  CE2  PHE B  65      87.867  38.134 281.431  1.00 19.86           C
ATOM   3158  CZ   PHE B  65      87.417  38.155 282.751  1.00 19.98           C
ATOM   3159  N    ILE B  66      90.189  32.167 279.964  1.00 22.12           N
ATOM   3160  CA   ILE B  66      90.297  31.007 279.069  1.00 23.07           C
ATOM   3161  C    ILE B  66      91.300  29.934 279.518  1.00 24.25           C
ATOM   3162  O    ILE B  66      91.300  28.817 278.974  1.00 24.79           O
ATOM   3163  CB   ILE B  66      90.581  31.410 277.604  1.00 22.66           C
ATOM   3164  CG1  ILE B  66      91.967  32.056 277.460  1.00 22.62           C
ATOM   3165  CG2  ILE B  66      89.470  32.316 277.096  1.00 21.87           C
ATOM   3166  CD1  ILE B  66      92.417  32.221 276.019  1.00 21.84           C
ATOM   3167  N    SER B  67      92.146  30.251 280.499  1.00 23.97           N
ATOM   3168  CA   SER B  67      93.128  29.268 280.946  1.00 24.15           C
ATOM   3169  C    SER B  67      92.362  28.236 281.780  1.00 23.00           C
ATOM   3170  O    SER B  67      91.369  28.558 282.394  1.00 22.63           O
ATOM   3171  CB   SER B  67      94.292  29.941 281.711  1.00 24.26           C
ATOM   3172  OG   SER B  67      93.864  30.539 282.937  1.00 24.68           O
ATOM   3173  N    PRO B  68      92.815  26.994 281.788  1.00 21.78           N
ATOM   3174  CA   PRO B  68      92.044  25.942 282.431  1.00 21.15           C
ATOM   3175  C    PRO B  68      91.896  26.084 283.960  1.00 21.03           C
ATOM   3176  O    PRO B  68      90.863  25.656 284.494  1.00 20.95           O
ATOM   3177  CB   PRO B  68      92.824  24.667 282.096  1.00 21.20           C
ATOM   3178  CG   PRO B  68      94.182  25.092 281.693  1.00 21.36           C
ATOM   3179  CD   PRO B  68      94.124  26.541 281.303  1.00 21.80           C
ATOM   3180  N    PHE B  69      92.899  26.662 284.630  1.00 19.80           N
ATOM   3181  CA   PHE B  69      92.908  26.856 286.096  1.00 20.06           C
ATOM   3182  C    PHE B  69      92.764  28.321 286.510  1.00 20.68           C
ATOM   3183  O    PHE B  69      93.269  28.762 287.529  1.00 21.07           O
ATOM   3184  CB   PHE B  69      94.149  26.202 286.727  1.00 20.10           C
ATOM   3185  CG   PHE B  69      94.146  24.712 286.570  1.00 20.72           C
ATOM   3186  CD1  PHE B  69      94.576  24.132 285.391  1.00 20.58           C
ATOM   3187  CD2  PHE B  69      93.628  23.901 287.561  1.00 20.91           C
ATOM   3188  CE1  PHE B  69      94.509  22.771 285.213  1.00 20.74           C
ATOM   3189  CE2  PHE B  69      93.556  22.541 287.384  1.00 21.90           C
ATOM   3190  CZ   PHE B  69      93.994  21.971 286.205  1.00 21.10           C
ATOM   3191  N    TYR B  70      92.015  29.068 285.720  1.00 22.06           N
ATOM   3192  CA   TYR B  70      91.714  30.451 286.046  1.00 22.51           C
ATOM   3193  C    TYR B  70      90.766  30.574 287.243  1.00 22.32           C
```

Appendix 2

```
ATOM   3194  O    TYR B  70      90.945  31.456 288.057  1.00 22.74           O
ATOM   3195  CB   TYR B  70      91.105  31.170 284.823  1.00 22.83           C
ATOM   3196  CG   TYR B  70      90.640  32.574 285.151  1.00 23.03           C
ATOM   3197  CD1  TYR B  70      91.572  33.612 285.340  1.00 22.87           C
ATOM   3198  CD2  TYR B  70      89.284  32.853 285.329  1.00 22.20           C
ATOM   3199  CE1  TYR B  70      91.163  34.891 285.654  1.00 23.23           C
ATOM   3200  CE2  TYR B  70      88.872  34.125 285.660  1.00 23.07           C
ATOM   3201  CZ   TYR B  70      89.809  35.140 285.816  1.00 23.13           C
ATOM   3202  OH   TYR B  70      89.388  36.399 286.137  1.00 23.80           O
ATOM   3203  N    SER B  71      89.736  29.738 287.339  1.00 23.36           N
ATOM   3204  CA   SER B  71      88.761  29.925 288.420  1.00 25.64           C
ATOM   3205  C    SER B  71      88.047  28.669 288.879  1.00 25.78           C
ATOM   3206  O    SER B  71      87.961  27.676 288.150  1.00 25.55           O
ATOM   3207  CB   SER B  71      87.717  31.001 288.037  1.00 26.99           C
ATOM   3208  OG   SER B  71      86.397  30.481 287.968  1.00 26.98           O
ATOM   3209  N    ARG B  72      87.497  28.722 290.088  1.00 26.67           N
ATOM   3210  CA   ARG B  72      86.822  27.539 290.605  1.00 28.69           C
ATOM   3211  C    ARG B  72      85.364  27.384 290.123  1.00 26.29           C
ATOM   3212  O    ARG B  72      84.695  26.399 290.435  1.00 24.97           O
ATOM   3213  CB   ARG B  72      86.989  27.392 292.132  1.00 30.06           C
ATOM   3214  CG   ARG B  72      86.562  28.540 292.998  1.00 32.05           C
ATOM   3215  CD   ARG B  72      86.290  28.019 294.409  1.00 34.93           C
ATOM   3216  NE   ARG B  72      87.513  27.815 295.180  1.00 36.33           N
ATOM   3217  CZ   ARG B  72      87.759  28.355 296.380  1.00 39.13           C
ATOM   3218  NH1  ARG B  72      88.907  28.110 296.988  1.00 41.09           N
ATOM   3219  NH2  ARG B  72      86.873  29.129 297.004  1.00 40.61           N
ATOM   3220  N    GLY B  73      84.898  28.322 289.313  1.00 25.59           N
ATOM   3221  CA   GLY B  73      83.546  28.254 288.768  1.00 25.73           C
ATOM   3222  C    GLY B  73      83.346  27.139 287.767  1.00 25.86           C
ATOM   3223  O    GLY B  73      84.297  26.469 287.374  1.00 26.44           O
ATOM   3224  N    CYS B  74      82.096  26.964 287.341  1.00 27.00           N
ATOM   3225  CA   CYS B  74      81.722  25.913 286.398  1.00 26.50           C
ATOM   3226  C    CYS B  74      81.841  26.379 284.946  1.00 26.35           C
ATOM   3227  O    CYS B  74      80.935  26.227 284.155  1.00 25.30           O
ATOM   3228  CB   CYS B  74      80.341  25.340 286.751  1.00 26.42           C
ATOM   3229  SG   CYS B  74      80.390  24.313 288.265  1.00 28.21           S
ATOM   3230  N    SER B  75      83.024  26.890 284.615  1.00 27.99           N
ATOM   3231  CA   SER B  75      83.367  27.368 283.280  1.00 29.62           C
ATOM   3232  C    SER B  75      84.441  26.483 282.580  1.00 27.49           C
ATOM   3233  O    SER B  75      85.493  26.179 283.152  1.00 27.04           O
ATOM   3234  CB   SER B  75      83.891  28.793 283.390  1.00 32.87           C
ATOM   3235  OG   SER B  75      84.610  29.128 282.210  1.00 39.14           O
ATOM   3236  N    PHE B  76      84.188  26.102 281.328  1.00 25.46           N
ATOM   3237  CA   PHE B  76      84.984  25.076 280.664  1.00 24.50           C
ATOM   3238  C    PHE B  76      85.598  25.547 279.360  1.00 26.08           C
ATOM   3239  O    PHE B  76      85.934  24.755 278.501  1.00 27.60           O
ATOM   3240  CB   PHE B  76      84.163  23.776 280.559  1.00 22.39           C
ATOM   3241  CG   PHE B  76      83.994  23.131 281.877  1.00 21.62           C
ATOM   3242  CD1  PHE B  76      84.997  22.323 282.387  1.00 21.60           C
ATOM   3243  CD2  PHE B  76      82.934  23.455 282.684  1.00 21.30           C
ATOM   3244  CE1  PHE B  76      84.896  21.777 283.660  1.00 21.38           C
ATOM   3245  CE2  PHE B  76      82.819  22.924 283.958  1.00 21.47           C
ATOM   3246  CZ   PHE B  76      83.808  22.085 284.451  1.00 21.92           C
ATOM   3247  N    GLU B  77      85.832  26.847 279.279  1.00 29.46           N
```

Appendix 2

```
ATOM   3248  CA  GLU B  77      86.246  27.505 278.042  1.00 31.10           C
ATOM   3249  C   GLU B  77      87.595  26.945 277.562  1.00 30.18           C
ATOM   3250  O   GLU B  77      87.779  26.724 276.364  1.00 33.32           O
ATOM   3251  CB  GLU B  77      86.220  29.058 278.179  1.00 34.75           C
ATOM   3252  CG  GLU B  77      85.128  29.565 279.157  1.00 38.40           C
ATOM   3253  CD  GLU B  77      84.510  30.937 278.862  1.00 43.32           C
ATOM   3254  OE1 GLU B  77      83.355  31.151 279.305  1.00 45.29           O
ATOM   3255  OE2 GLU B  77      85.151  31.814 278.223  1.00 47.35           O
ATOM   3256  N   ALA B  78      88.517  26.631 278.458  1.00 27.96           N
ATOM   3257  CA  ALA B  78      89.792  26.050 277.985  1.00 27.28           C
ATOM   3258  C   ALA B  78      89.613  24.705 277.273  1.00 27.20           C
ATOM   3259  O   ALA B  78      90.323  24.382 276.317  1.00 29.31           O
ATOM   3260  CB  ALA B  78      90.790  25.896 279.122  1.00 27.28           C
ATOM   3261  N   TRP B  79      88.680  23.905 277.765  1.00 27.51           N
ATOM   3262  CA  TRP B  79      88.399  22.615 277.175  1.00 26.01           C
ATOM   3263  C   TRP B  79      87.620  22.810 275.880  1.00 26.66           C
ATOM   3264  O   TRP B  79      87.936  22.166 274.911  1.00 27.27           O
ATOM   3265  CB  TRP B  79      87.689  21.726 278.187  1.00 24.98           C
ATOM   3266  CG  TRP B  79      88.628  21.293 279.295  1.00 24.89           C
ATOM   3267  CD1 TRP B  79      89.414  20.191 279.292  1.00 24.79           C
ATOM   3268  CD2 TRP B  79      88.901  21.969 280.544  1.00 24.16           C
ATOM   3269  NE1 TRP B  79      90.143  20.130 280.445  1.00 23.92           N
ATOM   3270  CE2 TRP B  79      89.827  21.200 281.237  1.00 24.34           C
ATOM   3271  CE3 TRP B  79      88.442  23.142 281.137  1.00 23.87           C
ATOM   3272  CZ2 TRP B  79      90.313  21.571 282.496  1.00 25.01           C
ATOM   3273  CZ3 TRP B  79      88.907  23.494 282.392  1.00 23.11           C
ATOM   3274  CH2 TRP B  79      89.833  22.721 283.050  1.00 23.87           C
ATOM   3275  N   GLU B  80      86.674  23.749 275.838  1.00 27.67           N
ATOM   3276  CA  GLU B  80      86.014  24.130 274.565  1.00 30.36           C
ATOM   3277  C   GLU B  80      87.019  24.522 273.491  1.00 29.04           C
ATOM   3278  O   GLU B  80      86.925  24.063 272.364  1.00 30.56           O
ATOM   3279  CB  GLU B  80      85.032  25.301 274.747  1.00 32.10           C
ATOM   3280  CG  GLU B  80      83.683  24.925 275.349  1.00 34.61           C
ATOM   3281  CD  GLU B  80      83.018  26.082 276.111  1.00 36.02           C
ATOM   3282  OE1 GLU B  80      83.319  27.242 275.765  1.00 34.31           O
ATOM   3283  OE2 GLU B  80      82.218  25.830 277.059  1.00 35.13           O
ATOM   3284  N   LEU B  81      87.972  25.379 273.842  1.00 29.89           N
ATOM   3285  CA  LEU B  81      89.056  25.761 272.933  1.00 29.96           C
ATOM   3286  C   LEU B  81      89.896  24.586 272.418  1.00 28.97           C
ATOM   3287  O   LEU B  81      90.236  24.571 271.257  1.00 26.12           O
ATOM   3288  CB  LEU B  81      89.964  26.821 273.570  1.00 31.07           C
ATOM   3289  CG  LEU B  81      89.329  28.218 273.648  1.00 32.46           C
ATOM   3290  CD1 LEU B  81      90.166  29.111 274.550  1.00 33.36           C
ATOM   3291  CD2 LEU B  81      89.112  28.890 272.292  1.00 31.05           C
ATOM   3292  N   LYS B  82      90.206  23.608 273.268  1.00 31.30           N
ATOM   3293  CA  LYS B  82      90.926  22.372 272.837  1.00 30.99           C
ATOM   3294  C   LYS B  82      90.069  21.301 272.190  1.00 28.57           C
ATOM   3295  O   LYS B  82      90.599  20.292 271.749  1.00 29.45           O
ATOM   3296  CB  LYS B  82      91.576  21.690 274.028  1.00 33.60           C
ATOM   3297  CG  LYS B  82      92.750  22.435 274.594  1.00 36.56           C
ATOM   3298  CD  LYS B  82      92.993  21.995 276.029  1.00 39.75           C
ATOM   3299  CE  LYS B  82      93.266  20.511 276.139  1.00 41.18           C
ATOM   3300  NZ  LYS B  82      93.696  20.220 277.531  1.00 45.56           N
ATOM   3301  N   HIS B  83      88.756  21.497 272.174  1.00 28.26           N
```

Appendix 2

```
ATOM   3302  CA   HIS B  83      87.785  20.540 271.590  1.00 30.51           C
ATOM   3303  C    HIS B  83      87.727  19.225 272.360  1.00 27.45           C
ATOM   3304  O    HIS B  83      87.511  18.192 271.780  1.00 30.43           O
ATOM   3305  CB   HIS B  83      88.036  20.267 270.083  1.00 32.77           C
ATOM   3306  CG   HIS B  83      88.127  21.506 269.242  1.00 38.19           C
ATOM   3307  ND1  HIS B  83      87.030  22.301 268.960  1.00 42.94           N
ATOM   3308  CD2  HIS B  83      89.186  22.092 268.625  1.00 39.86           C
ATOM   3309  CE1  HIS B  83      87.408  23.322 268.210  1.00 42.14           C
ATOM   3310  NE2  HIS B  83      88.712  23.221 267.997  1.00 42.10           N
ATOM   3311  N    THR B  84      87.909  19.279 273.666  1.00 24.89           N
ATOM   3312  CA   THR B  84      87.826  18.114 274.520  1.00 22.92           C
ATOM   3313  C    THR B  84      86.393  17.571 274.535  1.00 22.74           C
ATOM   3314  O    THR B  84      85.472  18.229 275.008  1.00 20.29           O
ATOM   3315  CB   THR B  84      88.258  18.505 275.954  1.00 23.89           C
ATOM   3316  OG1  THR B  84      89.418  19.346 275.899  1.00 22.23           O
ATOM   3317  CG2  THR B  84      88.596  17.268 276.785  1.00 24.75           C
ATOM   3318  N    PRO B  85      86.178  16.358 273.998  1.00 23.01           N
ATOM   3319  CA   PRO B  85      84.845  15.789 274.162  1.00 21.21           C
ATOM   3320  C    PRO B  85      84.378  15.917 275.607  1.00 20.92           C
ATOM   3321  O    PRO B  85      85.194  15.874 276.508  1.00 21.09           O
ATOM   3322  CB   PRO B  85      85.048  14.311 273.808  1.00 21.40           C
ATOM   3323  CG   PRO B  85      86.267  14.266 272.983  1.00 22.12           C
ATOM   3324  CD   PRO B  85      87.147  15.370 273.489  1.00 23.08           C
ATOM   3325  N    GLN B  86      83.080  16.040 275.840  1.00 22.19           N
ATOM   3326  CA   GLN B  86      82.536  16.069 277.225  1.00 23.43           C
ATOM   3327  C    GLN B  86      82.964  14.907 278.156  1.00 24.12           C
ATOM   3328  O    GLN B  86      83.321  15.128 279.319  1.00 23.83           O
ATOM   3329  CB   GLN B  86      81.001  16.134 277.206  1.00 22.69           C
ATOM   3330  CG   GLN B  86      80.403  16.281 278.598  1.00 21.97           C
ATOM   3331  CD   GLN B  86      80.239  14.955 279.317  1.00 21.67           C
ATOM   3332  OE1  GLN B  86      79.974  13.942 278.685  1.00 22.19           O
ATOM   3333  NE2  GLN B  86      80.382  14.959 280.645  1.00 20.66           N
ATOM   3334  N    ARG B  87      82.920  13.678 277.647  1.00 25.73           N
ATOM   3335  CA   ARG B  87      83.158  12.503 278.478  1.00 26.25           C
ATOM   3336  C    ARG B  87      84.594  12.387 278.919  1.00 27.35           C
ATOM   3337  O    ARG B  87      84.922  11.586 279.787  1.00 29.66           O
ATOM   3338  CB   ARG B  87      82.804  11.226 277.726  1.00 26.45           C
ATOM   3339  CG   ARG B  87      81.351  11.142 277.288  1.00 25.98           C
ATOM   3340  CD   ARG B  87      81.145   9.973 276.342  1.00 25.37           C
ATOM   3341  NE   ARG B  87      79.748   9.834 275.944  1.00 25.29           N
ATOM   3342  CZ   ARG B  87      78.780   9.368 276.730  1.00 24.75           C
ATOM   3343  NH1  ARG B  87      79.018   8.972 277.974  1.00 24.62           N
ATOM   3344  NH2  ARG B  87      77.555   9.285 276.264  1.00 24.87           N
ATOM   3345  N    VAL B  88      85.472  13.153 278.302  1.00 26.99           N
ATOM   3346  CA   VAL B  88      86.884  13.057 278.623  1.00 25.09           C
ATOM   3347  C    VAL B  88      87.378  14.142 279.578  1.00 24.31           C
ATOM   3348  O    VAL B  88      88.484  14.016 280.101  1.00 25.87           O
ATOM   3349  CB   VAL B  88      87.665  13.027 277.305  1.00 25.18           C
ATOM   3350  CG1  VAL B  88      89.026  13.714 277.392  1.00 25.00           C
ATOM   3351  CG2  VAL B  88      87.760  11.578 276.872  1.00 24.84           C
ATOM   3352  N    ILE B  89      86.563  15.174 279.835  1.00 21.27           N
ATOM   3353  CA   ILE B  89      86.960  16.280 280.715  1.00 19.57           C
ATOM   3354  C    ILE B  89      87.410  15.788 282.104  1.00 19.99           C
ATOM   3355  O    ILE B  89      88.436  16.228 282.639  1.00 20.90           O
```

Appendix 2

```
ATOM   3356  CB   ILE B  89      85.816  17.293 280.889  1.00 18.40           C
ATOM   3357  CG1  ILE B  89      85.444  17.965 279.564  1.00 17.93           C
ATOM   3358  CG2  ILE B  89      86.208  18.379 281.871  1.00 18.48           C
ATOM   3359  CD1  ILE B  89      84.066  18.573 279.553  1.00 17.19           C
ATOM   3360  N    LYS B  90      86.656  14.879 282.696  1.00 20.11           N
ATOM   3361  CA   LYS B  90      87.047  14.330 283.989  1.00 21.33           C
ATOM   3362  C    LYS B  90      88.462  13.748 284.037  1.00 22.46           C
ATOM   3363  O    LYS B  90      89.106  13.855 285.080  1.00 22.29           O
ATOM   3364  CB   LYS B  90      86.064  13.273 284.481  1.00 21.76           C
ATOM   3365  CG   LYS B  90      85.772  12.116 283.547  1.00 21.55           C
ATOM   3366  CD   LYS B  90      84.736  11.196 284.183  1.00 22.49           C
ATOM   3367  CE   LYS B  90      83.316  11.769 284.146  1.00 22.33           C
ATOM   3368  NZ   LYS B  90      82.758  11.800 282.757  1.00 22.24           N
ATOM   3369  N    TYR B  91      88.928  13.130 282.943  1.00 22.90           N
ATOM   3370  CA   TYR B  91      90.286  12.580 282.897  1.00 24.24           C
ATOM   3371  C    TYR B  91      91.299  13.728 282.736  1.00 22.95           C
ATOM   3372  O    TYR B  91      92.342  13.740 283.378  1.00 22.74           O
ATOM   3373  CB   TYR B  91      90.447  11.494 281.809  1.00 26.15           C
ATOM   3374  CG   TYR B  91      89.348  10.489 281.871  1.00 30.92           C
ATOM   3375  CD1  TYR B  91      89.097   9.784 283.046  1.00 34.74           C
ATOM   3376  CD2  TYR B  91      88.496  10.289 280.797  1.00 33.89           C
ATOM   3377  CE1  TYR B  91      88.036   8.891 283.145  1.00 37.53           C
ATOM   3378  CE2  TYR B  91      87.434   9.400 280.880  1.00 35.97           C
ATOM   3379  CZ   TYR B  91      87.198   8.704 282.057  1.00 38.57           C
ATOM   3380  OH   TYR B  91      86.136   7.810 282.160  1.00 40.95           O
ATOM   3381  N    SER B  92      90.969  14.702 281.904  1.00 22.32           N
ATOM   3382  CA   SER B  92      91.813  15.882 281.726  1.00 21.55           C
ATOM   3383  C    SER B  92      92.018  16.607 283.019  1.00 20.73           C
ATOM   3384  O    SER B  92      93.117  16.982 283.366  1.00 19.67           O
ATOM   3385  CB   SER B  92      91.189  16.862 280.763  1.00 21.13           C
ATOM   3386  OG   SER B  92      91.848  18.095 280.929  1.00 21.24           O
ATOM   3387  N    ILE B  93      90.946  16.792 283.764  1.00 22.01           N
ATOM   3388  CA   ILE B  93      91.105  17.412 285.084  1.00 21.55           C
ATOM   3389  C    ILE B  93      92.016  16.562 285.977  1.00 19.70           C
ATOM   3390  O    ILE B  93      92.934  17.073 286.581  1.00 19.59           O
ATOM   3391  CB   ILE B  93      89.758  17.685 285.775  1.00 21.26           C
ATOM   3392  CG1  ILE B  93      88.936  18.676 284.955  1.00 21.28           C
ATOM   3393  CG2  ILE B  93      89.994  18.310 287.135  1.00 21.74           C
ATOM   3394  CD1  ILE B  93      87.507  18.836 285.428  1.00 20.44           C
ATOM   3395  N    ALA B  94      91.753  15.266 286.047  1.00 19.66           N
ATOM   3396  CA   ALA B  94      92.456  14.349 286.977  1.00 18.86           C
ATOM   3397  C    ALA B  94      93.945  14.284 286.675  1.00 18.53           C
ATOM   3398  O    ALA B  94      94.771  14.434 287.548  1.00 17.35           O
ATOM   3399  CB   ALA B  94      91.858  12.960 286.886  1.00 18.41           C
ATOM   3400  N    PHE B  95      94.281  14.080 285.423  1.00 19.32           N
ATOM   3401  CA   PHE B  95      95.671  13.954 285.054  1.00 21.25           C
ATOM   3402  C    PHE B  95      96.466  15.246 285.263  1.00 20.91           C
ATOM   3403  O    PHE B  95      97.628  15.216 285.640  1.00 20.64           O
ATOM   3404  CB   PHE B  95      95.764  13.410 283.635  1.00 22.30           C
ATOM   3405  CG   PHE B  95      95.320  11.983 283.538  1.00 24.92           C
ATOM   3406  CD1  PHE B  95      95.728  11.052 284.501  1.00 26.73           C
ATOM   3407  CD2  PHE B  95      94.505  11.554 282.501  1.00 26.58           C
ATOM   3408  CE1  PHE B  95      95.339   9.724 284.416  1.00 28.68           C
ATOM   3409  CE2  PHE B  95      94.107  10.230 282.404  1.00 27.61           C
```

Appendix 2

```
ATOM   3410  CZ   PHE B  95      94.516   9.312 283.363  1.00 28.29           C
ATOM   3411  N    TYR B  96      95.836  16.381 285.027  1.00 21.31           N
ATOM   3412  CA   TYR B  96      96.408  17.629 285.452  1.00 21.07           C
ATOM   3413  C    TYR B  96      96.644  17.554 286.954  1.00 20.64           C
ATOM   3414  O    TYR B  96      97.696  17.937 287.424  1.00 20.55           O
ATOM   3415  CB   TYR B  96      95.485  18.800 285.157  1.00 21.04           C
ATOM   3416  CG   TYR B  96      95.580  19.413 283.775  1.00 22.55           C
ATOM   3417  CD1  TYR B  96      96.804  19.610 283.135  1.00 23.47           C
ATOM   3418  CD2  TYR B  96      94.438  19.859 283.132  1.00 22.53           C
ATOM   3419  CE1  TYR B  96      96.867  20.194 281.872  1.00 23.72           C
ATOM   3420  CE2  TYR B  96      94.495  20.439 281.883  1.00 23.46           C
ATOM   3421  CZ   TYR B  96      95.703  20.620 281.258  1.00 23.18           C
ATOM   3422  OH   TYR B  96      95.713  21.216 280.023  1.00 21.61           O
ATOM   3423  N    ALA B  97      95.659  17.084 287.710  1.00 20.36           N
ATOM   3424  CA   ALA B  97      95.792  17.074 289.150  1.00 20.89           C
ATOM   3425  C    ALA B  97      97.007  16.242 289.571  1.00 21.29           C
ATOM   3426  O    ALA B  97      97.768  16.645 290.437  1.00 21.64           O
ATOM   3427  CB   ALA B  97      94.526  16.547 289.803  1.00 21.37           C
ATOM   3428  N    TYR B  98      97.193  15.099 288.915  1.00 21.80           N
ATOM   3429  CA   TYR B  98      98.278  14.192 289.233  1.00 21.66           C
ATOM   3430  C    TYR B  98      99.628  14.806 288.928  1.00 20.78           C
ATOM   3431  O    TYR B  98     100.593  14.583 289.639  1.00 20.23           O
ATOM   3432  CB   TYR B  98      98.082  12.865 288.499  1.00 21.51           C
ATOM   3433  CG   TYR B  98      96.740  12.249 288.801  1.00 21.08           C
ATOM   3434  CD1  TYR B  98      96.058  12.586 289.948  1.00 21.26           C
ATOM   3435  CD2  TYR B  98      96.169  11.311 287.962  1.00 20.78           C
ATOM   3436  CE1  TYR B  98      94.831  12.036 290.230  1.00 22.06           C
ATOM   3437  CE2  TYR B  98      94.924  10.757 288.241  1.00 20.92           C
ATOM   3438  CZ   TYR B  98      94.262  11.132 289.377  1.00 20.93           C
ATOM   3439  OH   TYR B  98      93.032  10.614 289.733  1.00 22.18           O
ATOM   3440  N    GLY B  99      99.669  15.619 287.895  1.00 21.78           N
ATOM   3441  CA   GLY B  99     100.889  16.336 287.529  1.00 22.91           C
ATOM   3442  C    GLY B  99     101.199  17.375 288.581  1.00 23.14           C
ATOM   3443  O    GLY B  99     102.353  17.501 289.040  1.00 24.02           O
ATOM   3444  N    LEU B 100     100.158  18.100 288.988  1.00 22.65           N
ATOM   3445  CA   LEU B 100     100.308  19.171 289.973  1.00 22.60           C
ATOM   3446  C    LEU B 100     100.812  18.637 291.319  1.00 22.56           C
ATOM   3447  O    LEU B 100     101.664  19.260 291.937  1.00 23.00           O
ATOM   3448  CB   LEU B 100      98.995  19.920 290.146  1.00 22.77           C
ATOM   3449  CG   LEU B 100      98.553  20.750 288.944  1.00 21.93           C
ATOM   3450  CD1  LEU B 100      97.105  21.080 289.106  1.00 22.36           C
ATOM   3451  CD2  LEU B 100      99.342  22.026 288.760  1.00 21.89           C
ATOM   3452  N    ALA B 101     100.338  17.471 291.744  1.00 21.91           N
ATOM   3453  CA   ALA B 101     100.841  16.883 292.981  1.00 22.69           C
ATOM   3454  C    ALA B 101     102.345  16.726 292.939  1.00 22.66           C
ATOM   3455  O    ALA B 101     103.011  17.017 293.925  1.00 22.29           O
ATOM   3456  CB   ALA B 101     100.210  15.535 293.263  1.00 23.21           C
ATOM   3457  N    SER B 102     102.880  16.281 291.809  1.00 22.26           N
ATOM   3458  CA   SER B 102     104.311  16.051 291.714  1.00 22.45           C
ATOM   3459  C    SER B 102     105.049  17.384 291.625  1.00 22.56           C
ATOM   3460  O    SER B 102     106.048  17.569 292.292  1.00 22.83           O
ATOM   3461  CB   SER B 102     104.650  15.135 290.540  1.00 22.92           C
ATOM   3462  OG   SER B 102     104.527  13.767 290.911  1.00 23.74           O
ATOM   3463  N    VAL B 103     104.537  18.337 290.852  1.00 22.80           N
```

Appendix 2

```
ATOM   3464  CA   VAL B 103     105.085  19.696 290.913  1.00 22.03           C
ATOM   3465  C    VAL B 103     105.277  20.152 292.362  1.00 22.38           C
ATOM   3466  O    VAL B 103     106.304  20.714 292.701  1.00 23.99           O
ATOM   3467  CB   VAL B 103     104.208  20.718 290.189  1.00 21.19           C
ATOM   3468  CG1  VAL B 103     104.702  22.124 290.454  1.00 21.07           C
ATOM   3469  CG2  VAL B 103     104.225  20.470 288.691  1.00 21.23           C
ATOM   3470  N    ALA B 104     104.306  19.906 293.223  1.00 22.01           N
ATOM   3471  CA   ALA B 104     104.448  20.309 294.621  1.00 22.40           C
ATOM   3472  C    ALA B 104     105.691  19.700 295.257  1.00 21.67           C
ATOM   3473  O    ALA B 104     106.349  20.330 296.048  1.00 22.37           O
ATOM   3474  CB   ALA B 104     103.205  19.952 295.426  1.00 21.63           C
ATOM   3475  N    LEU B 105     105.979  18.466 294.900  1.00 22.91           N
ATOM   3476  CA   LEU B 105     107.112  17.711 295.421  1.00 23.69           C
ATOM   3477  C    LEU B 105     108.444  18.245 294.872  1.00 23.72           C
ATOM   3478  O    LEU B 105     109.407  18.396 295.574  1.00 20.82           O
ATOM   3479  CB   LEU B 105     106.975  16.238 295.001  1.00 24.30           C
ATOM   3480  CG   LEU B 105     106.651  15.187 296.052  1.00 26.25           C
ATOM   3481  CD1  LEU B 105     106.960  13.799 295.514  1.00 25.59           C
ATOM   3482  CD2  LEU B 105     107.486  15.454 297.315  1.00 27.13           C
ATOM   3483  N    ILE B 106     108.479  18.503 293.580  1.00 25.64           N
ATOM   3484  CA   ILE B 106     109.653  19.040 292.942  1.00 26.62           C
ATOM   3485  C    ILE B 106     110.117  20.367 293.518  1.00 27.21           C
ATOM   3486  O    ILE B 106     111.294  20.488 293.825  1.00 27.13           O
ATOM   3487  CB   ILE B 106     109.394  19.242 291.450  1.00 27.08           C
ATOM   3488  CG1  ILE B 106     109.269  17.862 290.784  1.00 27.54           C
ATOM   3489  CG2  ILE B 106     110.494  20.116 290.819  1.00 25.98           C
ATOM   3490  CD1  ILE B 106     108.729  17.904 289.366  1.00 27.53           C
ATOM   3491  N    ASP B 107     109.215  21.351 293.639  1.00 27.55           N
ATOM   3492  CA   ASP B 107     109.611  22.730 293.957  1.00 28.02           C
ATOM   3493  C    ASP B 107     108.750  23.356 295.044  1.00 27.32           C
ATOM   3494  O    ASP B 107     107.620  23.733 294.805  1.00 25.89           O
ATOM   3495  CB   ASP B 107     109.566  23.609 292.695  1.00 29.07           C
ATOM   3496  CG   ASP B 107     110.171  25.022 292.912  1.00 30.99           C
ATOM   3497  OD1  ASP B 107     110.543  25.404 294.069  1.00 30.29           O
ATOM   3498  OD2  ASP B 107     110.263  25.754 291.889  1.00 30.89           O
ATOM   3499  N    PRO B 108     109.319  23.526 296.236  1.00 27.64           N
ATOM   3500  CA   PRO B 108     108.571  24.130 297.351  1.00 27.60           C
ATOM   3501  C    PRO B 108     108.025  25.526 297.052  1.00 26.68           C
ATOM   3502  O    PRO B 108     106.943  25.849 297.501  1.00 28.34           O
ATOM   3503  CB   PRO B 108     109.613  24.200 298.487  1.00 27.40           C
ATOM   3504  CG   PRO B 108     110.615  23.149 298.139  1.00 27.68           C
ATOM   3505  CD   PRO B 108     110.664  23.074 296.639  1.00 27.08           C
ATOM   3506  N    LYS B 109     108.766  26.336 296.306  1.00 26.92           N
ATOM   3507  CA   LYS B 109     108.347  27.692 295.973  1.00 26.47           C
ATOM   3508  C    LYS B 109     107.109  27.629 295.089  1.00 27.15           C
ATOM   3509  O    LYS B 109     106.376  28.607 294.964  1.00 28.86           O
ATOM   3510  CB   LYS B 109     109.486  28.478 295.299  1.00 25.48           C
ATOM   3511  N    LEU B 110     106.847  26.465 294.499  1.00 26.29           N
ATOM   3512  CA   LEU B 110     105.624  26.292 293.714  1.00 25.71           C
ATOM   3513  C    LEU B 110     104.531  25.489 294.433  1.00 24.05           C
ATOM   3514  O    LEU B 110     103.482  25.267 293.866  1.00 25.44           O
ATOM   3515  CB   LEU B 110     105.940  25.624 292.356  1.00 26.30           C
ATOM   3516  CG   LEU B 110     106.845  26.377 291.373  1.00 26.41           C
ATOM   3517  CD1  LEU B 110     107.135  25.534 290.142  1.00 26.68           C
```

Appendix 2

```
ATOM   3518  CD2 LEU B 110     106.214  27.691 290.962  1.00 26.69           C
ATOM   3519  N   ARG B 111     104.748  25.055 295.664  1.00 21.73           N
ATOM   3520  CA  ARG B 111     103.785  24.185 296.303  1.00 21.48           C
ATOM   3521  C   ARG B 111     102.420  24.867 296.534  1.00 21.56           C
ATOM   3522  O   ARG B 111     101.355  24.234 296.441  1.00 21.73           O
ATOM   3523  CB  ARG B 111     104.370  23.654 297.607  1.00 21.16           C
ATOM   3524  CG  ARG B 111     103.439  22.751 298.389  1.00 20.93           C
ATOM   3525  CD  ARG B 111     104.211  21.685 299.126  1.00 20.98           C
ATOM   3526  NE  ARG B 111     103.365  20.765 299.887  1.00 21.92           N
ATOM   3527  CZ  ARG B 111     103.834  19.732 300.596  1.00 22.35           C
ATOM   3528  NH1 ARG B 111     105.132  19.495 300.643  1.00 21.69           N
ATOM   3529  NH2 ARG B 111     103.011  18.930 301.270  1.00 22.62           N
ATOM   3530  N   ALA B 112     102.453  26.161 296.817  1.00 21.56           N
ATOM   3531  CA  ALA B 112     101.234  26.893 297.131  1.00 21.33           C
ATOM   3532  C   ALA B 112     100.390  27.031 295.866  1.00 20.92           C
ATOM   3533  O   ALA B 112      99.191  26.846 295.897  1.00 19.78           O
ATOM   3534  CB  ALA B 112     101.565  28.246 297.729  1.00 20.80           C
ATOM   3535  N   LEU B 113     101.041  27.331 294.751  1.00 20.97           N
ATOM   3536  CA  LEU B 113     100.373  27.374 293.463  1.00 21.22           C
ATOM   3537  C   LEU B 113      99.793  26.029 293.044  1.00 21.01           C
ATOM   3538  O   LEU B 113      98.661  25.963 292.652  1.00 22.51           O
ATOM   3539  CB  LEU B 113     101.334  27.850 292.382  1.00 22.11           C
ATOM   3540  CG  LEU B 113     100.738  27.893 290.972  1.00 22.82           C
ATOM   3541  CD1 LEU B 113      99.811  29.082 290.839  1.00 24.42           C
ATOM   3542  CD2 LEU B 113     101.803  27.971 289.902  1.00 23.23           C
ATOM   3543  N   ALA B 114     100.566  24.958 293.089  1.00 20.94           N
ATOM   3544  CA  ALA B 114     100.023  23.632 292.770  1.00 21.02           C
ATOM   3545  C   ALA B 114      98.793  23.337 293.590  1.00 20.91           C
ATOM   3546  O   ALA B 114      97.799  22.866 293.054  1.00 19.94           O
ATOM   3547  CB  ALA B 114     101.048  22.561 293.032  1.00 21.85           C
ATOM   3548  N   GLY B 115      98.883  23.600 294.898  1.00 21.14           N
ATOM   3549  CA  GLY B 115      97.752  23.467 295.821  1.00 20.49           C
ATOM   3550  C   GLY B 115      96.536  24.284 295.425  1.00 20.59           C
ATOM   3551  O   GLY B 115      95.398  23.814 295.489  1.00 19.59           O
ATOM   3552  N   HIS B 116      96.785  25.516 295.003  1.00 20.86           N
ATOM   3553  CA  HIS B 116      95.730  26.385 294.522  1.00 20.85           C
ATOM   3554  C   HIS B 116      95.067  25.861 293.229  1.00 20.37           C
ATOM   3555  O   HIS B 116      93.859  25.916 293.089  1.00 20.86           O
ATOM   3556  CB  HIS B 116      96.269  27.782 294.263  1.00 21.12           C
ATOM   3557  CG  HIS B 116      95.285  28.640 293.561  1.00 22.20           C
ATOM   3558  ND1 HIS B 116      95.396  28.949 292.223  1.00 22.59           N
ATOM   3559  CD2 HIS B 116      94.109  29.161 293.977  1.00 22.42           C
ATOM   3560  CE1 HIS B 116      94.352  29.671 291.856  1.00 22.59           C
ATOM   3561  NE2 HIS B 116      93.557  29.815 292.897  1.00 22.26           N
ATOM   3562  N   ASP B 117      95.871  25.391 292.286  1.00 19.21           N
ATOM   3563  CA  ASP B 117      95.365  24.717 291.122  1.00 20.03           C
ATOM   3564  C   ASP B 117      94.568  23.447 291.490  1.00 20.85           C
ATOM   3565  O   ASP B 117      93.597  23.107 290.804  1.00 21.84           O
ATOM   3566  CB  ASP B 117      96.508  24.359 290.150  1.00 19.87           C
ATOM   3567  CG  ASP B 117      97.089  25.578 289.428  1.00 20.25           C
ATOM   3568  OD1 ASP B 117      96.454  26.659 289.437  1.00 20.00           O
ATOM   3569  OD2 ASP B 117      98.179  25.449 288.815  1.00 21.28           O
ATOM   3570  N   LEU B 118      94.953  22.760 292.564  1.00 21.06           N
ATOM   3571  CA  LEU B 118      94.268  21.521 292.963  1.00 20.68           C
```

Appendix 2

```
ATOM   3572  C   LEU B 118      92.919  21.789 293.596  1.00 20.97           C
ATOM   3573  O   LEU B 118      91.981  21.023 293.396  1.00 20.13           O
ATOM   3574  CB  LEU B 118      95.138  20.669 293.882  1.00 19.96           C
ATOM   3575  CG  LEU B 118      96.225  19.902 293.121  1.00 19.58           C
ATOM   3576  CD1 LEU B 118      97.284  19.378 294.077  1.00 20.01           C
ATOM   3577  CD2 LEU B 118      95.626  18.765 292.329  1.00 19.39           C
ATOM   3578  N   ASP B 119      92.827  22.893 294.327  1.00 21.82           N
ATOM   3579  CA  ASP B 119      91.564  23.381 294.831  1.00 23.17           C
ATOM   3580  C   ASP B 119      90.605  23.485 293.629  1.00 23.57           C
ATOM   3581  O   ASP B 119      89.496  22.922 293.621  1.00 23.46           O
ATOM   3582  CB  ASP B 119      91.780  24.748 295.475  1.00 25.49           C
ATOM   3583  CG  ASP B 119      90.641  25.174 296.375  1.00 29.11           C
ATOM   3584  OD1 ASP B 119      89.605  24.460 296.469  1.00 33.02           O
ATOM   3585  OD2 ASP B 119      90.804  26.245 297.005  1.00 30.06           O
ATOM   3586  N   ILE B 120      91.062  24.186 292.599  1.00 22.34           N
ATOM   3587  CA  ILE B 120      90.256  24.452 291.414  1.00 21.34           C
ATOM   3588  C   ILE B 120      89.891  23.182 290.657  1.00 20.58           C
ATOM   3589  O   ILE B 120      88.762  23.031 290.230  1.00 19.98           O
ATOM   3590  CB  ILE B 120      90.977  25.451 290.514  1.00 21.56           C
ATOM   3591  CG1 ILE B 120      90.924  26.832 291.181  1.00 22.63           C
ATOM   3592  CG2 ILE B 120      90.349  25.482 289.131  1.00 22.16           C
ATOM   3593  CD1 ILE B 120      91.501  27.951 290.342  1.00 24.06           C
ATOM   3594  N   ALA B 121      90.844  22.266 290.514  1.00 20.29           N
ATOM   3595  CA  ALA B 121      90.588  20.961 289.906  1.00 19.14           C
ATOM   3596  C   ALA B 121      89.431  20.224 290.585  1.00 18.74           C
ATOM   3597  O   ALA B 121      88.601  19.641 289.930  1.00 17.79           O
ATOM   3598  CB  ALA B 121      91.837  20.096 289.948  1.00 18.21           C
ATOM   3599  N   VAL B 122      89.417  20.229 291.905  1.00 19.72           N
ATOM   3600  CA  VAL B 122      88.358  19.583 292.671  1.00 20.16           C
ATOM   3601  C   VAL B 122      87.017  20.306 292.431  1.00 20.45           C
ATOM   3602  O   VAL B 122      86.029  19.655 292.151  1.00 21.75           O
ATOM   3603  CB  VAL B 122      88.717  19.540 294.177  1.00 19.90           C
ATOM   3604  CG1 VAL B 122      87.526  19.111 295.012  1.00 20.74           C
ATOM   3605  CG2 VAL B 122      89.875  18.595 294.418  1.00 19.44           C
ATOM   3606  N   SER B 123      86.973  21.633 292.519  1.00 20.98           N
ATOM   3607  CA  SER B 123      85.725  22.355 292.209  1.00 22.95           C
ATOM   3608  C   SER B 123      85.207  22.077 290.804  1.00 22.67           C
ATOM   3609  O   SER B 123      84.016  21.909 290.627  1.00 23.24           O
ATOM   3610  CB  SER B 123      85.884  23.857 292.333  1.00 23.42           C
ATOM   3611  OG  SER B 123      86.157  24.181 293.665  1.00 27.60           O
ATOM   3612  N   LYS B 124      86.084  22.060 289.807  1.00 22.04           N
ATOM   3613  CA  LYS B 124      85.633  21.832 288.447  1.00 22.65           C
ATOM   3614  C   LYS B 124      85.137  20.409 288.280  1.00 23.40           C
ATOM   3615  O   LYS B 124      84.114  20.182 287.615  1.00 23.55           O
ATOM   3616  CB  LYS B 124      86.702  22.161 287.419  1.00 22.73           C
ATOM   3617  CG  LYS B 124      86.918  23.656 287.231  1.00 23.26           C
ATOM   3618  CD  LYS B 124      87.581  23.955 285.896  1.00 23.70           C
ATOM   3619  CE  LYS B 124      87.950  25.429 285.734  1.00 24.23           C
ATOM   3620  NZ  LYS B 124      86.753  26.287 285.870  1.00 24.38           N
ATOM   3621  N   MET B 125      85.831  19.467 288.924  1.00 22.75           N
ATOM   3622  CA  MET B 125      85.491  18.058 288.808  1.00 22.37           C
ATOM   3623  C   MET B 125      84.050  17.839 289.262  1.00 23.46           C
ATOM   3624  O   MET B 125      83.385  16.933 288.764  1.00 22.44           O
ATOM   3625  CB  MET B 125      86.430  17.214 289.667  1.00 21.73           C
```

Appendix 2

```
ATOM   3626  CG  MET B 125      86.369  15.714 289.452  1.00 20.94           C
ATOM   3627  SD  MET B 125      87.131  15.333 287.891  1.00 20.75           S
ATOM   3628  CE  MET B 125      87.470  13.589 288.067  1.00 22.51           C
ATOM   3629  N   LYS B 126      83.594  18.657 290.213  1.00 24.11           N
ATOM   3630  CA  LYS B 126      82.274  18.497 290.804  1.00 25.99           C
ATOM   3631  C   LYS B 126      81.129  19.109 289.993  1.00 26.78           C
ATOM   3632  O   LYS B 126      79.975  18.792 290.275  1.00 27.36           O
ATOM   3633  CB  LYS B 126      82.243  19.063 292.217  1.00 26.46           C
ATOM   3634  CG  LYS B 126      82.876  18.117 293.224  1.00 29.37           C
ATOM   3635  CD  LYS B 126      82.373  18.347 294.644  1.00 30.79           C
ATOM   3636  CE  LYS B 126      83.260  19.332 295.381  1.00 32.73           C
ATOM   3637  NZ  LYS B 126      82.479  20.077 296.412  1.00 35.26           N
ATOM   3638  N   CYS B 127      81.440  19.978 289.035  1.00 25.92           N
ATOM   3639  CA  CYS B 127      80.432  20.572 288.170  1.00 25.79           C
ATOM   3640  C   CYS B 127      79.735  19.508 287.331  1.00 26.75           C
ATOM   3641  O   CYS B 127      80.362  18.548 286.917  1.00 29.95           O
ATOM   3642  CB  CYS B 127      81.083  21.553 287.216  1.00 26.61           C
ATOM   3643  SG  CYS B 127      81.893  22.958 288.001  1.00 28.71           S
ATOM   3644  N   LYS B 128      78.449  19.696 287.056  1.00 25.03           N
ATOM   3645  CA  LYS B 128      77.685  18.775 286.224  1.00 25.15           C
ATOM   3646  C   LYS B 128      78.205  18.603 284.771  1.00 23.91           C
ATOM   3647  O   LYS B 128      78.089  17.538 284.187  1.00 24.86           O
ATOM   3648  CB  LYS B 128      76.212  19.202 286.211  1.00 26.31           C
ATOM   3649  CG  LYS B 128      75.304  18.261 285.452  1.00 27.45           C
ATOM   3650  CD  LYS B 128      73.841  18.542 285.746  1.00 29.00           C
ATOM   3651  CE  LYS B 128      72.973  17.320 285.441  1.00 29.63           C
ATOM   3652  NZ  LYS B 128      71.715  17.353 286.229  1.00 29.65           N
ATOM   3653  N   ARG B 129      78.757  19.635 284.171  1.00 22.77           N
ATOM   3654  CA  ARG B 129      79.346  19.484 282.842  1.00 23.04           C
ATOM   3655  C   ARG B 129      80.411  18.339 282.799  1.00 23.06           C
ATOM   3656  O   ARG B 129      80.611  17.692 281.773  1.00 21.83           O
ATOM   3657  CB  ARG B 129      79.939  20.839 282.413  1.00 24.50           C
ATOM   3658  CG  ARG B 129      80.756  20.856 281.126  1.00 24.91           C
ATOM   3659  CD  ARG B 129      79.948  20.292 279.992  1.00 23.91           C
ATOM   3660  NE  ARG B 129      80.681  20.286 278.744  1.00 24.10           N
ATOM   3661  CZ  ARG B 129      80.195  19.770 277.612  1.00 23.79           C
ATOM   3662  NH1 ARG B 129      78.984  19.211 277.571  1.00 23.34           N
ATOM   3663  NH2 ARG B 129      80.924  19.793 276.521  1.00 23.23           N
ATOM   3664  N   VAL B 130      81.062  18.083 283.939  1.00 23.50           N
ATOM   3665  CA  VAL B 130      82.060  17.008 284.073  1.00 22.19           C
ATOM   3666  C   VAL B 130      81.416  15.643 284.324  1.00 22.10           C
ATOM   3667  O   VAL B 130      81.701  14.692 283.599  1.00 21.80           O
ATOM   3668  CB  VAL B 130      83.087  17.342 285.179  1.00 21.19           C
ATOM   3669  CG1 VAL B 130      84.072  16.208 285.369  1.00 21.64           C
ATOM   3670  CG2 VAL B 130      83.826  18.612 284.826  1.00 20.81           C
ATOM   3671  N   TRP B 131      80.550  15.542 285.334  1.00 22.49           N
ATOM   3672  CA  TRP B 131      79.938  14.241 285.673  1.00 24.01           C
ATOM   3673  C   TRP B 131      78.601  13.933 284.977  1.00 25.89           C
ATOM   3674  O   TRP B 131      78.072  12.808 285.096  1.00 26.95           O
ATOM   3675  CB  TRP B 131      79.770  14.093 287.182  1.00 23.55           C
ATOM   3676  CG  TRP B 131      78.851  15.103 287.880  1.00 24.94           C
ATOM   3677  CD1 TRP B 131      79.249  16.210 288.603  1.00 25.06           C
ATOM   3678  CD2 TRP B 131      77.409  15.075 287.976  1.00 24.45           C
ATOM   3679  NE1 TRP B 131      78.148  16.867 289.128  1.00 23.91           N
```

Appendix 2

```
ATOM   3680  CE2 TRP B 131      77.014  16.197 288.771  1.00 23.58           C
ATOM   3681  CE3 TRP B 131      76.421  14.223 287.479  1.00 24.50           C
ATOM   3682  CZ2 TRP B 131      75.678  16.486 289.071  1.00 23.34           C
ATOM   3683  CZ3 TRP B 131      75.072  14.520 287.783  1.00 25.03           C
ATOM   3684  CH2 TRP B 131      74.726  15.647 288.573  1.00 23.69           C
ATOM   3685  N   GLY B 132      78.075  14.921 284.254  1.00 25.14           N
ATOM   3686  CA  GLY B 132      76.727  14.890 283.693  1.00 24.43           C
ATOM   3687  C   GLY B 132      76.397  13.782 282.732  1.00 24.34           C
ATOM   3688  O   GLY B 132      75.232  13.543 282.487  1.00 25.73           O
ATOM   3689  N   ASP B 133      77.404  13.117 282.174  1.00 24.87           N
ATOM   3690  CA  ASP B 133      77.171  11.979 281.286  1.00 24.97           C
ATOM   3691  C   ASP B 133      76.448  10.852 282.018  1.00 24.62           C
ATOM   3692  O   ASP B 133      75.647  10.146 281.428  1.00 24.91           O
ATOM   3693  CB  ASP B 133      78.475  11.450 280.658  1.00 25.44           C
ATOM   3694  CG  ASP B 133      79.597  11.235 281.684  1.00 27.59           C
ATOM   3695  OD1 ASP B 133      80.152  12.250 282.186  1.00 28.26           O
ATOM   3696  OD2 ASP B 133      79.959  10.058 281.970  1.00 29.70           O
ATOM   3697  N   TRP B 134      76.745  10.664 283.292  1.00 24.62           N
ATOM   3698  CA  TRP B 134      76.090   9.625 284.088  1.00 25.41           C
ATOM   3699  C   TRP B 134      74.508   9.697 284.021  1.00 28.06           C
ATOM   3700  O   TRP B 134      73.793   8.696 283.713  1.00 24.53           O
ATOM   3701  CB  TRP B 134      76.615   9.719 285.535  1.00 23.63           C
ATOM   3702  CG  TRP B 134      76.178   8.611 286.352  1.00 21.75           C
ATOM   3703  CD1 TRP B 134      75.240   8.646 287.309  1.00 21.84           C
ATOM   3704  CD2 TRP B 134      76.617   7.255 286.255  1.00 20.37           C
ATOM   3705  NE1 TRP B 134      75.055   7.387 287.839  1.00 21.50           N
ATOM   3706  CE2 TRP B 134      75.891   6.515 287.203  1.00 20.04           C
ATOM   3707  CE3 TRP B 134      77.565   6.601 285.471  1.00 19.94           C
ATOM   3708  CZ2 TRP B 134      76.080   5.156 287.398  1.00 19.93           C
ATOM   3709  CZ3 TRP B 134      77.745   5.246 285.644  1.00 20.21           C
ATOM   3710  CH2 TRP B 134      77.006   4.531 286.609  1.00 20.50           C
ATOM   3711  N   GLU B 135      73.981  10.898 284.262  1.00 30.07           N
ATOM   3712  CA  GLU B 135      72.537  11.146 284.182  1.00 32.05           C
ATOM   3713  C   GLU B 135      72.064  11.190 282.737  1.00 32.44           C
ATOM   3714  O   GLU B 135      71.060  10.570 282.425  1.00 32.12           O
ATOM   3715  CB  GLU B 135      72.188  12.438 284.917  1.00 33.53           C
ATOM   3716  CG  GLU B 135      70.733  12.843 284.919  1.00 34.50           C
ATOM   3717  CD  GLU B 135      70.511  14.178 285.605  1.00 36.42           C
ATOM   3718  OE1 GLU B 135      71.253  14.519 286.538  1.00 41.87           O
ATOM   3719  OE2 GLU B 135      69.572  14.894 285.233  1.00 39.72           O
ATOM   3720  N   GLU B 136      72.789  11.902 281.865  1.00 33.54           N
ATOM   3721  CA  GLU B 136      72.498  11.925 280.415  1.00 34.35           C
ATOM   3722  C   GLU B 136      72.303  10.517 279.851  1.00 34.04           C
ATOM   3723  O   GLU B 136      71.373  10.291 279.114  1.00 34.94           O
ATOM   3724  CB  GLU B 136      73.638  12.552 279.643  1.00 38.91           C
ATOM   3725  CG  GLU B 136      73.278  13.545 278.566  1.00 44.29           C
ATOM   3726  CD  GLU B 136      73.905  14.901 278.863  1.00 51.42           C
ATOM   3727  OE1 GLU B 136      73.303  15.662 279.656  1.00 60.24           O
ATOM   3728  OE2 GLU B 136      75.014  15.200 278.359  1.00 51.65           O
ATOM   3729  N   ASP B 137      73.183   9.574 280.189  1.00 34.08           N
ATOM   3730  CA  ASP B 137      73.108   8.204 279.666  1.00 33.84           C
ATOM   3731  C   ASP B 137      72.023   7.376 280.326  1.00 32.40           C
ATOM   3732  O   ASP B 137      71.818   6.229 279.944  1.00 34.67           O
ATOM   3733  CB  ASP B 137      74.442   7.463 279.849  1.00 36.50           C
```

Appendix 2

```
ATOM   3734  CG  ASP B 137      75.571   8.023 278.988  1.00 38.29           C
ATOM   3735  OD1 ASP B 137      75.301   8.895 278.124  1.00 41.29           O
ATOM   3736  OD2 ASP B 137      76.730   7.567 279.175  1.00 34.13           O
ATOM   3737  N   GLY B 138      71.348   7.943 281.324  1.00 31.87           N
ATOM   3738  CA  GLY B 138      70.202   7.301 281.978  1.00 30.29           C
ATOM   3739  C   GLY B 138      70.557   6.386 283.143  1.00 30.61           C
ATOM   3740  O   GLY B 138      69.714   5.633 283.599  1.00 31.53           O
ATOM   3741  N   PHE B 139      71.795   6.453 283.633  1.00 30.09           N
ATOM   3742  CA  PHE B 139      72.257   5.575 284.704  1.00 28.47           C
ATOM   3743  C   PHE B 139      71.955   6.029 286.124  1.00 27.92           C
ATOM   3744  O   PHE B 139      72.117   5.231 287.029  1.00 26.19           O
ATOM   3745  CB  PHE B 139      73.758   5.426 284.637  1.00 28.31           C
ATOM   3746  CG  PHE B 139      74.248   4.784 283.388  1.00 28.76           C
ATOM   3747  CD1 PHE B 139      73.703   3.595 282.946  1.00 27.85           C
ATOM   3748  CD2 PHE B 139      75.309   5.345 282.674  1.00 28.72           C
ATOM   3749  CE1 PHE B 139      74.186   2.990 281.801  1.00 28.20           C
ATOM   3750  CE2 PHE B 139      75.796   4.740 281.521  1.00 28.05           C
ATOM   3751  CZ  PHE B 139      75.234   3.555 281.090  1.00 28.17           C
ATOM   3752  N   GLY B 140      71.562   7.293 286.330  1.00 28.11           N
ATOM   3753  CA  GLY B 140      71.327   7.840 287.695  1.00 27.28           C
ATOM   3754  C   GLY B 140      71.423   9.357 287.774  1.00 25.75           C
ATOM   3755  O   GLY B 140      72.037   9.969 286.929  1.00 26.49           O
ATOM   3756  N   THR B 141      70.790   9.967 288.773  1.00 26.31           N
ATOM   3757  CA  THR B 141      70.879  11.424 289.021  1.00 25.65           C
ATOM   3758  C   THR B 141      72.049  11.788 289.944  1.00 26.92           C
ATOM   3759  O   THR B 141      72.430  12.970 289.993  1.00 26.87           O
ATOM   3760  CB  THR B 141      69.607  11.987 289.690  1.00 25.34           C
ATOM   3761  OG1 THR B 141      69.257  11.178 290.818  1.00 24.47           O
ATOM   3762  CG2 THR B 141      68.445  12.031 288.725  1.00 25.13           C
ATOM   3763  N   ASP B 142      72.592  10.784 290.666  1.00 27.57           N
ATOM   3764  CA  ASP B 142      73.727  10.947 291.609  1.00 27.01           C
ATOM   3765  C   ASP B 142      75.021  10.235 291.130  1.00 25.50           C
ATOM   3766  O   ASP B 142      75.081   9.002 291.073  1.00 24.72           O
ATOM   3767  CB  ASP B 142      73.331  10.413 292.996  1.00 28.20           C
ATOM   3768  CG  ASP B 142      74.272  10.903 294.122  1.00 31.70           C
ATOM   3769  OD1 ASP B 142      75.215  11.670 293.846  1.00 31.75           O
ATOM   3770  OD2 ASP B 142      74.074  10.527 295.308  1.00 35.46           O
ATOM   3771  N   PRO B 143      76.083  11.007 290.831  1.00 23.72           N
ATOM   3772  CA  PRO B 143      77.263  10.411 290.216  1.00 22.94           C
ATOM   3773  C   PRO B 143      78.187   9.615 291.124  1.00 23.42           C
ATOM   3774  O   PRO B 143      79.143   9.046 290.600  1.00 25.40           O
ATOM   3775  CB  PRO B 143      78.008  11.625 289.665  1.00 21.76           C
ATOM   3776  CG  PRO B 143      77.696  12.677 290.644  1.00 22.43           C
ATOM   3777  CD  PRO B 143      76.248  12.464 290.971  1.00 23.00           C
ATOM   3778  N   ILE B 144      77.943   9.560 292.438  1.00 24.34           N
ATOM   3779  CA  ILE B 144      78.855   8.838 293.367  1.00 25.29           C
ATOM   3780  C   ILE B 144      78.212   7.719 294.190  1.00 27.41           C
ATOM   3781  O   ILE B 144      78.914   6.816 294.641  1.00 27.96           O
ATOM   3782  CB  ILE B 144      79.592   9.786 294.360  1.00 24.59           C
ATOM   3783  CG1 ILE B 144      78.619  10.433 295.342  1.00 23.96           C
ATOM   3784  CG2 ILE B 144      80.383  10.853 293.612  1.00 24.56           C
ATOM   3785  CD1 ILE B 144      79.277  11.247 296.430  1.00 23.75           C
ATOM   3786  N   GLU B 145      76.897   7.809 294.403  1.00 29.89           N
ATOM   3787  CA  GLU B 145      76.119   6.854 295.206  1.00 30.74           C
```

Appendix 2

```
ATOM   3788  C   GLU B 145      76.470   5.397 294.901  1.00 28.79           C
ATOM   3789  O   GLU B 145      76.597   4.572 295.810  1.00 28.90           O
ATOM   3790  CB  GLU B 145      74.627   7.092 294.948  1.00 35.25           C
ATOM   3791  CG  GLU B 145      73.654   6.333 295.842  1.00 41.11           C
ATOM   3792  CD  GLU B 145      72.324   6.065 295.136  1.00 47.31           C
ATOM   3793  OE1 GLU B 145      71.785   7.012 294.513  1.00 52.42           O
ATOM   3794  OE2 GLU B 145      71.823   4.914 295.188  1.00 47.92           O
ATOM   3795  N   LYS B 146      76.621   5.077 293.623  1.00 27.24           N
ATOM   3796  CA  LYS B 146      76.921   3.707 293.219  1.00 26.55           C
ATOM   3797  C   LYS B 146      77.562   3.652 291.857  1.00 23.44           C
ATOM   3798  O   LYS B 146      77.219   4.419 290.977  1.00 21.47           O
ATOM   3799  CB  LYS B 146      75.651   2.837 293.221  1.00 28.51           C
ATOM   3800  CG  LYS B 146      74.618   3.140 292.134  1.00 30.28           C
ATOM   3801  CD  LYS B 146      73.459   2.140 292.250  1.00 33.55           C
ATOM   3802  CE  LYS B 146      72.147   2.641 291.663  1.00 33.91           C
ATOM   3803  NZ  LYS B 146      72.322   3.041 290.237  1.00 34.74           N
ATOM   3804  N   GLU B 147      78.483   2.718 291.682  1.00 22.24           N
ATOM   3805  CA  GLU B 147      79.071   2.506 290.375  1.00 22.74           C
ATOM   3806  C   GLU B 147      79.839   3.780 289.986  1.00 22.57           C
ATOM   3807  O   GLU B 147      80.408   4.476 290.856  1.00 23.03           O
ATOM   3808  CB  GLU B 147      77.967   2.141 289.341  1.00 22.83           C
ATOM   3809  CG  GLU B 147      77.057   0.983 289.779  1.00 23.02           C
ATOM   3810  CD  GLU B 147      75.759   0.826 288.965  1.00 23.00           C
ATOM   3811  OE1 GLU B 147      75.332   1.729 288.194  1.00 21.38           O
ATOM   3812  OE2 GLU B 147      75.151  -0.248 289.114  1.00 22.65           O
ATOM   3813  N   ASN B 148      79.830   4.098 288.699  1.00 21.23           N
ATOM   3814  CA  ASN B 148      80.544   5.246 288.166  1.00 20.57           C
ATOM   3815  C   ASN B 148      81.974   5.436 288.722  1.00 20.15           C
ATOM   3816  O   ASN B 148      82.367   6.556 289.006  1.00 19.12           O
ATOM   3817  CB  ASN B 148      79.716   6.525 288.356  1.00 19.39           C
ATOM   3818  CG  ASN B 148      80.115   7.614 287.379  1.00 18.42           C
ATOM   3819  OD1 ASN B 148      80.759   7.337 286.407  1.00 17.87           O
ATOM   3820  ND2 ASN B 148      79.731   8.844 287.642  1.00 18.38           N
ATOM   3821  N   ILE B 149      82.745   4.359 288.853  1.00 19.83           N
ATOM   3822  CA  ILE B 149      84.068   4.456 289.458  1.00 20.71           C
ATOM   3823  C   ILE B 149      85.082   5.249 288.612  1.00 20.97           C
ATOM   3824  O   ILE B 149      85.965   5.899 289.160  1.00 20.66           O
ATOM   3825  CB  ILE B 149      84.624   3.062 289.844  1.00 22.25           C
ATOM   3826  CG1 ILE B 149      85.769   3.188 290.853  1.00 22.57           C
ATOM   3827  CG2 ILE B 149      85.097   2.261 288.632  1.00 22.84           C
ATOM   3828  CD1 ILE B 149      85.378   3.915 292.129  1.00 22.12           C
ATOM   3829  N   MET B 150      84.949   5.209 287.290  1.00 21.91           N
ATOM   3830  CA  MET B 150      85.729   6.082 286.416  1.00 23.44           C
ATOM   3831  C   MET B 150      85.720   7.516 286.951  1.00 23.46           C
ATOM   3832  O   MET B 150      86.734   8.188 286.969  1.00 26.09           O
ATOM   3833  CB  MET B 150      85.194   6.061 284.959  1.00 25.64           C
ATOM   3834  CG  MET B 150      83.705   6.443 284.756  1.00 26.60           C
ATOM   3835  SD  MET B 150      83.023   6.132 283.063  1.00 29.75           S
ATOM   3836  CE  MET B 150      81.259   6.000 283.396  1.00 27.00           C
ATOM   3837  N   TYR B 151      84.572   8.000 287.394  1.00 21.81           N
ATOM   3838  CA  TYR B 151      84.497   9.383 287.793  1.00 19.60           C
ATOM   3839  C   TYR B 151      84.953   9.578 289.221  1.00 20.08           C
ATOM   3840  O   TYR B 151      85.863  10.350 289.500  1.00 20.26           O
ATOM   3841  CB  TYR B 151      83.092   9.912 287.618  1.00 18.35           C
```

Appendix 2

```
ATOM   3842  CG   TYR B 151      82.905  11.236 288.293  1.00 17.40           C
ATOM   3843  CD1  TYR B 151      83.513  12.375 287.812  1.00 16.73           C
ATOM   3844  CD2  TYR B 151      82.130  11.347 289.422  1.00 17.23           C
ATOM   3845  CE1  TYR B 151      83.337  13.594 288.440  1.00 16.36           C
ATOM   3846  CE2  TYR B 151      81.961  12.560 290.050  1.00 16.71           C
ATOM   3847  CZ   TYR B 151      82.570  13.670 289.558  1.00 16.10           C
ATOM   3848  OH   TYR B 151      82.385  14.857 290.210  1.00 16.20           O
ATOM   3849  N    LYS B 152      84.307   8.870 290.128  1.00 20.53           N
ATOM   3850  CA   LYS B 152      84.491   9.086 291.534  1.00 20.08           C
ATOM   3851  C    LYS B 152      85.775   8.471 292.053  1.00 20.84           C
ATOM   3852  O    LYS B 152      86.242   8.855 293.128  1.00 22.29           O
ATOM   3853  CB   LYS B 152      83.288   8.555 292.306  1.00 20.59           C
ATOM   3854  CG   LYS B 152      83.150   7.042 292.405  1.00 20.29           C
ATOM   3855  CD   LYS B 152      81.746   6.654 292.871  1.00 20.70           C
ATOM   3856  CE   LYS B 152      81.734   5.335 293.632  1.00 20.69           C
ATOM   3857  NZ   LYS B 152      80.459   4.607 293.467  1.00 20.80           N
ATOM   3858  N    GLY B 153      86.357   7.522 291.331  1.00 20.17           N
ATOM   3859  CA   GLY B 153      87.700   7.071 291.695  1.00 20.88           C
ATOM   3860  C    GLY B 153      88.738   8.201 291.572  1.00 21.21           C
ATOM   3861  O    GLY B 153      89.564   8.417 292.466  1.00 21.87           O
ATOM   3862  N    HIS B 154      88.700   8.913 290.448  1.00 21.44           N
ATOM   3863  CA   HIS B 154      89.553  10.079 290.237  1.00 21.74           C
ATOM   3864  C    HIS B 154      89.292  11.200 291.234  1.00 21.38           C
ATOM   3865  O    HIS B 154      90.223  11.858 291.682  1.00 22.21           O
ATOM   3866  CB   HIS B 154      89.376  10.620 288.826  1.00 21.35           C
ATOM   3867  CG   HIS B 154      90.018   9.776 287.787  1.00 21.33           C
ATOM   3868  ND1  HIS B 154      91.358   9.471 287.816  1.00 20.57           N
ATOM   3869  CD2  HIS B 154      89.512   9.190 286.679  1.00 20.64           C
ATOM   3870  CE1  HIS B 154      91.647   8.729 286.765  1.00 21.68           C
ATOM   3871  NE2  HIS B 154      90.542   8.542 286.062  1.00 20.58           N
ATOM   3872  N    LEU B 155      88.028  11.432 291.550  1.00 20.62           N
ATOM   3873  CA   LEU B 155      87.669  12.495 292.469  1.00 20.37           C
ATOM   3874  C    LEU B 155      88.198  12.170 293.843  1.00 19.72           C
ATOM   3875  O    LEU B 155      88.702  13.051 294.557  1.00 19.96           O
ATOM   3876  CB   LEU B 155      86.154  12.658 292.541  1.00 20.43           C
ATOM   3877  CG   LEU B 155      85.646  13.682 293.538  1.00 21.39           C
ATOM   3878  CD1  LEU B 155      86.081  15.081 293.155  1.00 22.14           C
ATOM   3879  CD2  LEU B 155      84.134  13.622 293.631  1.00 22.56           C
ATOM   3880  N    ASN B 156      88.087  10.910 294.232  1.00 18.36           N
ATOM   3881  CA   ASN B 156      88.582  10.524 295.562  1.00 18.08           C
ATOM   3882  C    ASN B 156      90.107  10.625 295.697  1.00 17.62           C
ATOM   3883  O    ASN B 156      90.629  10.981 296.768  1.00 17.62           O
ATOM   3884  CB   ASN B 156      88.114   9.128 295.947  1.00 17.89           C
ATOM   3885  CG   ASN B 156      87.981   8.974 297.426  1.00 17.87           C
ATOM   3886  OD1  ASN B 156      87.302   9.773 298.076  1.00 17.38           O
ATOM   3887  ND2  ASN B 156      88.652   7.961 297.985  1.00 17.59           N
ATOM   3888  N    LEU B 157      90.820  10.332 294.619  1.00 16.65           N
ATOM   3889  CA   LEU B 157      92.258  10.457 294.652  1.00 16.38           C
ATOM   3890  C    LEU B 157      92.603  11.959 294.698  1.00 16.35           C
ATOM   3891  O    LEU B 157      93.494  12.381 295.460  1.00 16.71           O
ATOM   3892  CB   LEU B 157      92.906   9.703 293.491  1.00 15.87           C
ATOM   3893  CG   LEU B 157      94.425   9.702 293.420  1.00 15.73           C
ATOM   3894  CD1  LEU B 157      95.036   9.241 294.708  1.00 15.75           C
ATOM   3895  CD2  LEU B 157      94.927   8.840 292.280  1.00 16.04           C
```

Appendix 2

```
ATOM   3896  N   MET B 158      91.862  12.766 293.959  1.00 16.45           N
ATOM   3897  CA  MET B 158      92.058  14.230 293.963  1.00 16.82           C
ATOM   3898  C   MET B 158      91.809  14.845 295.335  1.00 17.25           C
ATOM   3899  O   MET B 158      92.534  15.702 295.774  1.00 17.48           O
ATOM   3900  CB  MET B 158      91.168  14.898 292.922  1.00 17.00           C
ATOM   3901  CG  MET B 158      91.600  14.570 291.506  1.00 17.46           C
ATOM   3902  SD  MET B 158      90.423  15.034 290.236  1.00 17.96           S
ATOM   3903  CE  MET B 158      90.230  16.749 290.617  1.00 19.02           C
ATOM   3904  N   TYR B 159      90.798  14.388 296.037  1.00 18.64           N
ATOM   3905  CA  TYR B 159      90.544  14.931 297.347  1.00 20.06           C
ATOM   3906  C   TYR B 159      91.762  14.646 298.237  1.00 20.95           C
ATOM   3907  O   TYR B 159      92.180  15.478 299.046  1.00 19.91           O
ATOM   3908  CB  TYR B 159      89.320  14.258 297.975  1.00 21.37           C
ATOM   3909  CG  TYR B 159      87.918  14.709 297.592  1.00 21.40           C
ATOM   3910  CD1 TYR B 159      87.578  16.047 297.428  1.00 22.69           C
ATOM   3911  CD2 TYR B 159      86.903  13.774 297.516  1.00 22.10           C
ATOM   3912  CE1 TYR B 159      86.268  16.427 297.123  1.00 22.77           C
ATOM   3913  CE2 TYR B 159      85.604  14.127 297.252  1.00 22.56           C
ATOM   3914  CZ  TYR B 159      85.270  15.444 297.046  1.00 23.37           C
ATOM   3915  OH  TYR B 159      83.925  15.725 296.774  1.00 23.19           O
ATOM   3916  N   GLY B 160      92.312  13.438 298.097  1.00 23.13           N
ATOM   3917  CA  GLY B 160      93.467  13.012 298.893  1.00 22.37           C
ATOM   3918  C   GLY B 160      94.707  13.807 298.552  1.00 21.76           C
ATOM   3919  O   GLY B 160      95.412  14.313 299.433  1.00 21.83           O
ATOM   3920  N   LEU B 161      94.990  13.915 297.264  1.00 20.89           N
ATOM   3921  CA  LEU B 161      96.216  14.568 296.856  1.00 20.64           C
ATOM   3922  C   LEU B 161      96.152  16.037 297.255  1.00 20.50           C
ATOM   3923  O   LEU B 161      97.142  16.575 297.763  1.00 19.76           O
ATOM   3924  CB  LEU B 161      96.449  14.412 295.365  1.00 20.18           C
ATOM   3925  CG  LEU B 161      96.777  12.987 295.001  1.00 21.10           C
ATOM   3926  CD1 LEU B 161      96.901  12.932 293.506  1.00 22.43           C
ATOM   3927  CD2 LEU B 161      98.041  12.472 295.669  1.00 21.66           C
ATOM   3928  N   TYR B 162      94.986  16.666 297.044  1.00 19.30           N
ATOM   3929  CA  TYR B 162      94.784  18.078 297.418  1.00 18.71           C
ATOM   3930  C   TYR B 162      95.159  18.321 298.872  1.00 17.99           C
ATOM   3931  O   TYR B 162      95.694  19.365 299.238  1.00 17.75           O
ATOM   3932  CB  TYR B 162      93.327  18.507 297.223  1.00 18.67           C
ATOM   3933  CG  TYR B 162      92.975  19.796 297.951  1.00 18.87           C
ATOM   3934  CD1 TYR B 162      93.437  21.019 297.493  1.00 19.07           C
ATOM   3935  CD2 TYR B 162      92.212  19.787 299.111  1.00 18.09           C
ATOM   3936  CE1 TYR B 162      93.143  22.192 298.168  1.00 19.40           C
ATOM   3937  CE2 TYR B 162      91.902  20.955 299.771  1.00 17.96           C
ATOM   3938  CZ  TYR B 162      92.366  22.150 299.297  1.00 18.55           C
ATOM   3939  OH  TYR B 162      92.068  23.327 299.940  1.00 19.36           O
ATOM   3940  N   GLN B 163      94.827  17.357 299.711  1.00 17.89           N
ATOM   3941  CA  GLN B 163      95.006  17.531 301.124  1.00 17.02           C
ATOM   3942  C   GLN B 163      96.471  17.237 301.501  1.00 16.92           C
ATOM   3943  O   GLN B 163      97.055  17.962 302.298  1.00 16.99           O
ATOM   3944  CB  GLN B 163      93.999  16.705 301.923  1.00 16.03           C
ATOM   3945  CG  GLN B 163      94.173  16.985 303.394  1.00 15.74           C
ATOM   3946  CD  GLN B 163      93.187  16.325 304.283  1.00 15.42           C
ATOM   3947  OE1 GLN B 163      92.099  15.939 303.890  1.00 15.47           O
ATOM   3948  NE2 GLN B 163      93.581  16.185 305.527  1.00 16.13           N
ATOM   3949  N   LEU B 164      97.061  16.195 300.924  1.00 16.77           N
```

Appendix 2

```
ATOM   3950  CA   LEU B 164      98.512  16.009 301.033  1.00 16.71           C
ATOM   3951  C    LEU B 164      99.309  17.243 300.602  1.00 15.92           C
ATOM   3952  O    LEU B 164     100.304  17.554 301.196  1.00 15.73           O
ATOM   3953  CB   LEU B 164      98.970  14.811 300.193  1.00 17.23           C
ATOM   3954  CG   LEU B 164      98.657  13.441 300.799  1.00 18.02           C
ATOM   3955  CD1  LEU B 164      99.072  12.333 299.834  1.00 17.68           C
ATOM   3956  CD2  LEU B 164      99.357  13.324 302.157  1.00 17.46           C
ATOM   3957  N    VAL B 165      98.883  17.944 299.564  1.00 16.05           N
ATOM   3958  CA   VAL B 165      99.692  19.037 299.043  1.00 16.56           C
ATOM   3959  C    VAL B 165      99.631  20.265 299.967  1.00 17.13           C
ATOM   3960  O    VAL B 165     100.689  20.864 300.286  1.00 16.93           O
ATOM   3961  CB   VAL B 165      99.310  19.385 297.588  1.00 16.49           C
ATOM   3962  CG1  VAL B 165      99.749  20.788 297.224  1.00 17.24           C
ATOM   3963  CG2  VAL B 165      99.957  18.398 296.637  1.00 16.38           C
ATOM   3964  N    THR B 166      98.409  20.599 300.410  1.00 17.04           N
ATOM   3965  CA   THR B 166      98.093  21.890 301.051  1.00 16.79           C
ATOM   3966  C    THR B 166      97.938  21.842 302.559  1.00 16.87           C
ATOM   3967  O    THR B 166      98.029  22.872 303.228  1.00 16.00           O
ATOM   3968  CB   THR B 166      96.753  22.469 300.522  1.00 16.92           C
ATOM   3969  OG1  THR B 166      95.648  21.595 300.842  1.00 15.90           O
ATOM   3970  CG2  THR B 166      96.824  22.674 299.018  1.00 16.94           C
ATOM   3971  N    GLY B 167      97.637  20.659 303.082  1.00 17.39           N
ATOM   3972  CA   GLY B 167      97.229  20.517 304.473  1.00 17.53           C
ATOM   3973  C    GLY B 167      95.804  20.960 304.785  1.00 18.01           C
ATOM   3974  O    GLY B 167      95.393  20.883 305.943  1.00 18.00           O
ATOM   3975  N    SER B 168      95.049  21.429 303.789  1.00 17.95           N
ATOM   3976  CA   SER B 168      93.687  21.939 304.053  1.00 18.89           C
ATOM   3977  C    SER B 168      92.668  20.819 304.286  1.00 19.63           C
ATOM   3978  O    SER B 168      92.655  19.807 303.575  1.00 18.73           O
ATOM   3979  CB   SER B 168      93.193  22.858 302.922  1.00 18.36           C
ATOM   3980  OG   SER B 168      91.828  22.654 302.657  1.00 17.28           O
ATOM   3981  N    ARG B 169      91.787  21.056 305.251  1.00 20.74           N
ATOM   3982  CA   ARG B 169      90.778  20.088 305.652  1.00 22.40           C
ATOM   3983  C    ARG B 169      89.398  20.410 305.028  1.00 23.78           C
ATOM   3984  O    ARG B 169      88.377  19.864 305.415  1.00 24.04           O
ATOM   3985  CB   ARG B 169      90.803  19.992 307.182  1.00 23.18           C
ATOM   3986  CG   ARG B 169      92.221  19.538 307.603  1.00 24.56           C
ATOM   3987  CD   ARG B 169      92.546  19.488 309.077  1.00 25.12           C
ATOM   3988  NE   ARG B 169      91.339  19.411 309.877  1.00 27.56           N
ATOM   3989  CZ   ARG B 169      90.954  20.336 310.761  1.00 29.51           C
ATOM   3990  NH1  ARG B 169      91.704  21.426 310.981  1.00 29.49           N
ATOM   3991  NH2  ARG B 169      89.810  20.170 311.434  1.00 28.32           N
ATOM   3992  N    ARG B 170      89.416  21.238 303.986  1.00 25.03           N
ATOM   3993  CA   ARG B 170      88.223  21.779 303.331  1.00 26.07           C
ATOM   3994  C    ARG B 170      87.292  20.698 302.832  1.00 25.24           C
ATOM   3995  O    ARG B 170      86.088  20.791 303.010  1.00 25.23           O
ATOM   3996  CB   ARG B 170      88.670  22.622 302.139  1.00 28.82           C
ATOM   3997  CG   ARG B 170      87.649  23.563 301.522  1.00 32.10           C
ATOM   3998  CD   ARG B 170      88.387  24.643 300.720  1.00 35.78           C
ATOM   3999  NE   ARG B 170      87.917  24.718 299.336  1.00 38.43           N
ATOM   4000  CZ   ARG B 170      86.906  25.472 298.910  1.00 40.67           C
ATOM   4001  NH1  ARG B 170      86.230  26.264 299.745  1.00 40.24           N
ATOM   4002  NH2  ARG B 170      86.575  25.440 297.624  1.00 44.29           N
ATOM   4003  N    TYR B 171      87.872  19.678 302.206  1.00 24.54           N
```

Appendix 2

```
ATOM   4004  CA   TYR B 171      87.132  18.620 301.552  1.00 23.25           C
ATOM   4005  C    TYR B 171      87.138  17.330 302.363  1.00 21.52           C
ATOM   4006  O    TYR B 171      86.716  16.307 301.889  1.00 21.26           O
ATOM   4007  CB   TYR B 171      87.702  18.366 300.154  1.00 24.77           C
ATOM   4008  CG   TYR B 171      87.605  19.544 299.161  1.00 27.29           C
ATOM   4009  CD1  TYR B 171      86.365  20.060 298.750  1.00 28.46           C
ATOM   4010  CD2  TYR B 171      88.742  20.103 298.603  1.00 26.30           C
ATOM   4011  CE1  TYR B 171      86.282  21.105 297.825  1.00 28.61           C
ATOM   4012  CE2  TYR B 171      88.663  21.137 297.684  1.00 27.64           C
ATOM   4013  CZ   TYR B 171      87.436  21.647 297.297  1.00 29.02           C
ATOM   4014  OH   TYR B 171      87.381  22.698 296.383  1.00 29.11           O
ATOM   4015  N    GLU B 172      87.579  17.394 303.604  1.00 22.61           N
ATOM   4016  CA   GLU B 172      87.738  16.199 304.466  1.00 24.10           C
ATOM   4017  C    GLU B 172      86.435  15.391 304.643  1.00 22.90           C
ATOM   4018  O    GLU B 172      86.422  14.179 304.486  1.00 24.93           O
ATOM   4019  CB   GLU B 172      88.273  16.654 305.836  1.00 25.65           C
ATOM   4020  CG   GLU B 172      89.012  15.617 306.663  1.00 27.01           C
ATOM   4021  CD   GLU B 172      89.814  16.269 307.782  1.00 26.22           C
ATOM   4022  OE1  GLU B 172      91.067  16.175 307.753  1.00 23.34           O
ATOM   4023  OE2  GLU B 172      89.182  16.902 308.662  1.00 26.98           O
ATOM   4024  N    ALA B 173      85.336  16.064 304.934  1.00 22.54           N
ATOM   4025  CA   ALA B 173      84.019  15.395 305.057  1.00 22.53           C
ATOM   4026  C    ALA B 173      83.588  14.665 303.773  1.00 22.87           C
ATOM   4027  O    ALA B 173      83.182  13.500 303.806  1.00 21.44           O
ATOM   4028  CB   ALA B 173      82.953  16.398 305.466  1.00 20.95           C
ATOM   4029  N    GLU B 174      83.670  15.352 302.639  1.00 24.07           N
ATOM   4030  CA   GLU B 174      83.286  14.726 301.377  1.00 25.02           C
ATOM   4031  C    GLU B 174      84.230  13.547 301.074  1.00 24.36           C
ATOM   4032  O    GLU B 174      83.814  12.565 300.467  1.00 24.15           O
ATOM   4033  CB   GLU B 174      83.300  15.738 300.237  1.00 27.01           C
ATOM   4034  CG   GLU B 174      82.386  16.928 300.458  1.00 30.10           C
ATOM   4035  CD   GLU B 174      82.752  18.124 299.579  1.00 34.90           C
ATOM   4036  OE1  GLU B 174      83.084  17.929 298.371  1.00 32.82           O
ATOM   4037  OE2  GLU B 174      82.699  19.268 300.103  1.00 39.55           O
ATOM   4038  N    HIS B 175      85.484  13.654 301.520  1.00 22.06           N
ATOM   4039  CA   HIS B 175      86.517  12.684 301.220  1.00 20.90           C
ATOM   4040  C    HIS B 175      86.283  11.412 302.019  1.00 21.27           C
ATOM   4041  O    HIS B 175      86.432  10.308 301.498  1.00 20.62           O
ATOM   4042  CB   HIS B 175      87.885  13.307 301.535  1.00 20.37           C
ATOM   4043  CG   HIS B 175      89.062  12.464 301.147  1.00 20.18           C
ATOM   4044  ND1  HIS B 175      90.254  12.493 301.838  1.00 20.22           N
ATOM   4045  CD2  HIS B 175      89.237  11.581 300.141  1.00 20.05           C
ATOM   4046  CE1  HIS B 175      91.117  11.680 301.264  1.00 19.88           C
ATOM   4047  NE2  HIS B 175      90.520  11.099 300.243  1.00 19.87           N
ATOM   4048  N    ALA B 176      85.946  11.574 303.299  1.00 21.87           N
ATOM   4049  CA   ALA B 176      85.489  10.449 304.132  1.00 21.49           C
ATOM   4050  C    ALA B 176      84.229   9.784 303.577  1.00 21.48           C
ATOM   4051  O    ALA B 176      84.097   8.554 303.559  1.00 21.27           O
ATOM   4052  CB   ALA B 176      85.212  10.932 305.542  1.00 20.86           C
ATOM   4053  N    HIS B 177      83.299  10.621 303.146  1.00 22.35           N
ATOM   4054  CA   HIS B 177      82.053  10.162 302.556  1.00 23.68           C
ATOM   4055  C    HIS B 177      82.319   9.323 301.344  1.00 22.44           C
ATOM   4056  O    HIS B 177      81.899   8.181 301.273  1.00 22.05           O
ATOM   4057  CB   HIS B 177      81.164  11.342 302.157  1.00 24.43           C
```

Appendix 2

```
ATOM   4058  CG   HIS B 177      79.792  10.941 301.723  1.00 27.00           C
ATOM   4059  ND1  HIS B 177      78.817  10.518 302.612  1.00 29.21           N
ATOM   4060  CD2  HIS B 177      79.219  10.915 300.496  1.00 28.25           C
ATOM   4061  CE1  HIS B 177      77.711  10.234 301.945  1.00 29.17           C
ATOM   4062  NE2  HIS B 177      77.926  10.477 300.661  1.00 28.70           N
ATOM   4063  N    LEU B 178      83.035   9.899 300.391  1.00 23.38           N
ATOM   4064  CA   LEU B 178      83.305   9.221 299.145  1.00 23.25           C
ATOM   4065  C    LEU B 178      84.168   8.009 299.395  1.00 23.54           C
ATOM   4066  O    LEU B 178      83.893   6.949 298.832  1.00 26.69           O
ATOM   4067  CB   LEU B 178      83.947  10.144 298.131  1.00 23.24           C
ATOM   4068  CG   LEU B 178      84.208   9.470 296.772  1.00 25.30           C
ATOM   4069  CD1  LEU B 178      83.014   8.657 296.270  1.00 25.10           C
ATOM   4070  CD2  LEU B 178      84.601  10.502 295.711  1.00 25.13           C
ATOM   4071  N    THR B 179      85.188   8.148 300.249  1.00 22.41           N
ATOM   4072  CA   THR B 179      86.041   7.009 300.612  1.00 21.47           C
ATOM   4073  C    THR B 179      85.238   5.814 301.145  1.00 20.21           C
ATOM   4074  O    THR B 179      85.400   4.716 300.644  1.00 19.25           O
ATOM   4075  CB   THR B 179      87.186   7.405 301.583  1.00 20.90           C
ATOM   4076  OG1  THR B 179      88.083   8.275 300.901  1.00 20.13           O
ATOM   4077  CG2  THR B 179      87.976   6.165 302.080  1.00 20.24           C
ATOM   4078  N    ARG B 180      84.374   6.026 302.125  1.00 20.59           N
ATOM   4079  CA   ARG B 180      83.529   4.921 302.621  1.00 22.78           C
ATOM   4080  C    ARG B 180      82.517   4.332 301.625  1.00 23.10           C
ATOM   4081  O    ARG B 180      82.272   3.141 301.650  1.00 25.26           O
ATOM   4082  CB   ARG B 180      82.861   5.273 303.944  1.00 22.81           C
ATOM   4083  CG   ARG B 180      83.960   5.419 304.983  1.00 24.18           C
ATOM   4084  CD   ARG B 180      83.491   5.668 306.374  1.00 24.15           C
ATOM   4085  NE   ARG B 180      82.665   4.591 306.860  1.00 25.43           N
ATOM   4086  CZ   ARG B 180      83.071   3.448 307.407  1.00 25.70           C
ATOM   4087  NH1  ARG B 180      84.356   3.158 307.547  1.00 26.01           N
ATOM   4088  NH2  ARG B 180      82.145   2.578 307.826  1.00 26.47           N
ATOM   4089  N    ILE B 181      81.983   5.117 300.714  1.00 22.58           N
ATOM   4090  CA   ILE B 181      81.170   4.543 299.653  1.00 22.26           C
ATOM   4091  C    ILE B 181      81.978   3.512 298.844  1.00 22.87           C
ATOM   4092  O    ILE B 181      81.507   2.375 298.597  1.00 24.23           O
ATOM   4093  CB   ILE B 181      80.605   5.654 298.744  1.00 22.13           C
ATOM   4094  CG1  ILE B 181      79.429   6.329 299.448  1.00 21.71           C
ATOM   4095  CG2  ILE B 181      80.141   5.086 297.424  1.00 22.37           C
ATOM   4096  CD1  ILE B 181      79.068   7.677 298.857  1.00 22.65           C
ATOM   4097  N    ILE B 182      83.186   3.911 298.445  1.00 21.91           N
ATOM   4098  CA   ILE B 182      84.057   3.063 297.650  1.00 21.69           C
ATOM   4099  C    ILE B 182      84.423   1.807 298.410  1.00 22.59           C
ATOM   4100  O    ILE B 182      84.374   0.711 297.876  1.00 22.87           O
ATOM   4101  CB   ILE B 182      85.325   3.818 297.201  1.00 21.32           C
ATOM   4102  CG1  ILE B 182      84.974   4.789 296.091  1.00 20.56           C
ATOM   4103  CG2  ILE B 182      86.358   2.856 296.658  1.00 21.72           C
ATOM   4104  CD1  ILE B 182      85.962   5.888 295.876  1.00 21.00           C
ATOM   4105  N    HIS B 183      84.779   1.962 299.672  1.00 24.72           N
ATOM   4106  CA   HIS B 183      85.173   0.812 300.483  1.00 25.68           C
ATOM   4107  C    HIS B 183      83.994  -0.125 300.695  1.00 25.22           C
ATOM   4108  O    HIS B 183      84.176  -1.338 300.660  1.00 26.35           O
ATOM   4109  CB   HIS B 183      85.768   1.276 301.826  1.00 26.57           C
ATOM   4110  CG   HIS B 183      86.128   0.156 302.750  1.00 28.38           C
ATOM   4111  ND1  HIS B 183      87.285  -0.592 302.606  1.00 30.16           N
```

Appendix 2

```
ATOM   4112  CD2 HIS B 183      85.486  -0.342 303.835  1.00 29.29           C
ATOM   4113  CE1 HIS B 183      87.340  -1.500 303.560  1.00 29.62           C
ATOM   4114  NE2 HIS B 183      86.256  -1.376 304.313  1.00 30.45           N
ATOM   4115  N   ASP B 184      82.806   0.450 300.911  1.00 25.76           N
ATOM   4116  CA  ASP B 184      81.552  -0.303 301.168  1.00 27.22           C
ATOM   4117  C   ASP B 184      81.062  -1.065 299.963  1.00 27.16           C
ATOM   4118  O   ASP B 184      80.634  -2.223 300.079  1.00 25.79           O
ATOM   4119  CB  ASP B 184      80.388   0.625 301.565  1.00 27.10           C
ATOM   4120  CG  ASP B 184      80.428   1.035 303.000  1.00 28.06           C
ATOM   4121  OD1 ASP B 184      81.150   0.394 303.770  1.00 32.49           O
ATOM   4122  OD2 ASP B 184      79.742   2.003 303.365  1.00 29.27           O
ATOM   4123  N   GLU B 185      81.063  -0.371 298.827  1.00 27.70           N
ATOM   4124  CA  GLU B 185      80.673  -0.981 297.565  1.00 28.85           C
ATOM   4125  C   GLU B 185      81.573  -2.189 297.269  1.00 28.02           C
ATOM   4126  O   GLU B 185      81.074  -3.267 296.905  1.00 28.68           O
ATOM   4127  CB  GLU B 185      80.716   0.052 296.442  1.00 29.20           C
ATOM   4128  CG  GLU B 185      79.817  -0.276 295.269  1.00 29.50           C
ATOM   4129  CD  GLU B 185      79.728   0.853 294.252  1.00 30.04           C
ATOM   4130  OE1 GLU B 185      80.190   1.991 294.555  1.00 27.66           O
ATOM   4131  OE2 GLU B 185      79.168   0.594 293.153  1.00 30.67           O
ATOM   4132  N   ILE B 186      82.880  -2.017 297.476  1.00 26.67           N
ATOM   4133  CA  ILE B 186      83.839  -3.107 297.278  1.00 26.95           C
ATOM   4134  C   ILE B 186      83.454  -4.341 298.095  1.00 27.53           C
ATOM   4135  O   ILE B 186      83.409  -5.444 297.564  1.00 28.29           O
ATOM   4136  CB  ILE B 186      85.288  -2.688 297.647  1.00 25.38           C
ATOM   4137  CG1 ILE B 186      85.849  -1.718 296.618  1.00 24.69           C
ATOM   4138  CG2 ILE B 186      86.208  -3.895 297.725  1.00 24.51           C
ATOM   4139  CD1 ILE B 186      87.101  -1.007 297.074  1.00 24.82           C
ATOM   4140  N   ALA B 187      83.198  -4.139 299.385  1.00 28.60           N
ATOM   4141  CA  ALA B 187      82.851  -5.230 300.306  1.00 29.55           C
ATOM   4142  C   ALA B 187      81.562  -5.914 299.914  1.00 28.97           C
ATOM   4143  O   ALA B 187      81.415  -7.108 300.147  1.00 28.10           O
ATOM   4144  CB  ALA B 187      82.734  -4.719 301.742  1.00 29.27           C
ATOM   4145  N   ALA B 188      80.643  -5.149 299.321  1.00 29.76           N
ATOM   4146  CA  ALA B 188      79.318  -5.659 298.923  1.00 30.43           C
ATOM   4147  C   ALA B 188      79.245  -6.334 297.551  1.00 30.48           C
ATOM   4148  O   ALA B 188      78.284  -7.019 297.276  1.00 28.20           O
ATOM   4149  CB  ALA B 188      78.297  -4.538 298.986  1.00 29.97           C
ATOM   4150  N   ASN B 189      80.225  -6.109 296.678  1.00 31.94           N
ATOM   4151  CA  ASN B 189      80.224  -6.759 295.364  1.00 31.95           C
ATOM   4152  C   ASN B 189      80.872  -8.132 295.476  1.00 31.19           C
ATOM   4153  O   ASN B 189      81.739  -8.326 296.316  1.00 33.10           O
ATOM   4154  CB  ASN B 189      80.942  -5.891 294.315  1.00 31.99           C
ATOM   4155  CG  ASN B 189      80.169  -4.607 293.976  1.00 32.95           C
ATOM   4156  OD1 ASN B 189      78.993  -4.430 294.374  1.00 31.90           O
ATOM   4157  ND2 ASN B 189      80.828  -3.698 293.239  1.00 30.59           N
ATOM   4158  N   PRO B 190      80.445  -9.093 294.643  1.00 31.51           N
ATOM   4159  CA  PRO B 190      80.992 -10.471 294.686  1.00 31.40           C
ATOM   4160  C   PRO B 190      82.339 -10.660 293.969  1.00 30.62           C
ATOM   4161  O   PRO B 190      82.977 -11.713 294.097  1.00 30.49           O
ATOM   4162  CB  PRO B 190      79.900 -11.304 294.002  1.00 31.46           C
ATOM   4163  CG  PRO B 190      79.188 -10.341 293.099  1.00 31.47           C
ATOM   4164  CD  PRO B 190      79.298  -8.973 293.717  1.00 31.57           C
ATOM   4165  N   PHE B 191      82.747  -9.637 293.224  1.00 28.64           N
```

Appendix 2

```
ATOM   4166  CA  PHE B 191      84.064  -9.556 292.573  1.00 26.75           C
ATOM   4167  C   PHE B 191      84.809  -8.434 293.291  1.00 26.12           C
ATOM   4168  O   PHE B 191      84.182  -7.524 293.842  1.00 25.21           O
ATOM   4169  CB  PHE B 191      83.910  -9.208 291.075  1.00 25.49           C
ATOM   4170  CG  PHE B 191      82.909  -8.108 290.817  1.00 24.76           C
ATOM   4171  CD1 PHE B 191      81.569  -8.401 290.621  1.00 24.39           C
ATOM   4172  CD2 PHE B 191      83.288  -6.778 290.856  1.00 25.02           C
ATOM   4173  CE1 PHE B 191      80.637  -7.392 290.423  1.00 24.80           C
ATOM   4174  CE2 PHE B 191      82.359  -5.764 290.647  1.00 25.27           C
ATOM   4175  CZ  PHE B 191      81.029  -6.070 290.433  1.00 24.39           C
ATOM   4176  N   ALA B 192      86.133  -8.480 293.272  1.00 26.74           N
ATOM   4177  CA  ALA B 192      86.940  -7.425 293.906  1.00 28.63           C
ATOM   4178  C   ALA B 192      86.940  -6.153 293.054  1.00 27.92           C
ATOM   4179  O   ALA B 192      87.467  -6.152 291.947  1.00 27.94           O
ATOM   4180  CB  ALA B 192      88.371  -7.917 294.140  1.00 28.93           C
ATOM   4181  N   GLY B 193      86.336  -5.078 293.562  1.00 27.98           N
ATOM   4182  CA  GLY B 193      86.236  -3.817 292.814  1.00 26.81           C
ATOM   4183  C   GLY B 193      84.842  -3.246 292.567  1.00 26.43           C
ATOM   4184  O   GLY B 193      83.876  -3.643 293.180  1.00 26.13           O
ATOM   4185  N   ILE B 194      84.757  -2.284 291.653  1.00 26.78           N
ATOM   4186  CA  ILE B 194      83.547  -1.501 291.416  1.00 25.85           C
ATOM   4187  C   ILE B 194      83.387  -1.294 289.908  1.00 27.02           C
ATOM   4188  O   ILE B 194      84.388  -1.155 289.197  1.00 27.99           O
ATOM   4189  CB  ILE B 194      83.674  -0.125 292.082  1.00 25.96           C
ATOM   4190  CG1 ILE B 194      83.700  -0.276 293.584  1.00 26.16           C
ATOM   4191  CG2 ILE B 194      82.495   0.780 291.723  1.00 27.54           C
ATOM   4192  CD1 ILE B 194      83.858   1.036 294.328  1.00 26.96           C
ATOM   4193  N   VAL B 195      82.157  -1.250 289.402  1.00 26.91           N
ATOM   4194  CA  VAL B 195      81.974  -1.040 287.938  1.00 26.98           C
ATOM   4195  C   VAL B 195      81.987   0.445 287.539  1.00 26.04           C
ATOM   4196  O   VAL B 195      81.853   1.333 288.385  1.00 24.96           O
ATOM   4197  CB  VAL B 195      80.684  -1.720 287.403  1.00 24.98           C
ATOM   4198  CG1 VAL B 195      80.636  -3.183 287.837  1.00 23.94           C
ATOM   4199  CG2 VAL B 195      79.446  -0.970 287.856  1.00 24.58           C
ATOM   4200  N   CYS B 196      82.138   0.710 286.253  1.00 26.50           N
ATOM   4201  CA  CYS B 196      81.954   2.062 285.755  1.00 29.04           C
ATOM   4202  C   CYS B 196      80.473   2.195 285.393  1.00 28.45           C
ATOM   4203  O   CYS B 196      79.632   2.311 286.275  1.00 26.02           O
ATOM   4204  CB  CYS B 196      82.906   2.352 284.592  1.00 31.34           C
ATOM   4205  SG  CYS B 196      84.668   2.503 285.088  1.00 38.71           S
ATOM   4206  N   GLU B 197      80.132   2.145 284.107  1.00 30.83           N
ATOM   4207  CA  GLU B 197      78.727   1.947 283.695  1.00 30.07           C
ATOM   4208  C   GLU B 197      78.290   0.617 284.298  1.00 29.08           C
ATOM   4209  O   GLU B 197      79.139  -0.193 284.666  1.00 28.74           O
ATOM   4210  CB  GLU B 197      78.575   1.889 282.163  1.00 29.59           C
ATOM   4211  CG  GLU B 197      79.149   3.089 281.414  1.00 29.50           C
ATOM   4212  CD  GLU B 197      80.637   2.980 281.032  1.00 28.34           C
ATOM   4213  OE1 GLU B 197      81.284   1.930 281.255  1.00 26.20           O
ATOM   4214  OE2 GLU B 197      81.160   3.976 280.481  1.00 28.29           O
ATOM   4215  N   PRO B 198      76.976   0.378 284.402  1.00 30.09           N
ATOM   4216  CA  PRO B 198      76.527  -0.930 284.890  1.00 29.49           C
ATOM   4217  C   PRO B 198      77.006  -2.106 284.006  1.00 27.62           C
ATOM   4218  O   PRO B 198      76.940  -2.049 282.750  1.00 27.02           O
ATOM   4219  CB  PRO B 198      74.983  -0.810 284.882  1.00 30.36           C
```

Appendix 2

```
ATOM   4220  CG   PRO B 198      74.685   0.658 284.803  1.00 30.92           C
ATOM   4221  CD   PRO B 198      75.834   1.233 284.018  1.00 31.91           C
ATOM   4222  N    ASP B 199      77.491  -3.138 284.694  1.00 25.26           N
ATOM   4223  CA   ASP B 199      78.065  -4.348 284.096  1.00 25.35           C
ATOM   4224  C    ASP B 199      79.346  -4.196 283.255  1.00 23.09           C
ATOM   4225  O    ASP B 199      79.720  -5.121 282.555  1.00 20.99           O
ATOM   4226  CB   ASP B 199      77.040  -5.113 283.279  1.00 25.40           C
ATOM   4227  CG   ASP B 199      77.402  -6.567 283.169  1.00 27.70           C
ATOM   4228  OD1  ASP B 199      77.738  -7.133 284.234  1.00 29.91           O
ATOM   4229  OD2  ASP B 199      77.389  -7.136 282.048  1.00 30.18           O
ATOM   4230  N    ASN B 200      79.991  -3.036 283.349  1.00 22.70           N
ATOM   4231  CA   ASN B 200      81.274  -2.730 282.704  1.00 21.75           C
ATOM   4232  C    ASN B 200      82.347  -2.546 283.792  1.00 21.08           C
ATOM   4233  O    ASN B 200      82.331  -1.562 284.522  1.00 20.78           O
ATOM   4234  CB   ASN B 200      81.155  -1.423 281.919  1.00 21.27           C
ATOM   4235  CG   ASN B 200      80.606  -1.607 280.530  1.00 21.45           C
ATOM   4236  OD1  ASN B 200      80.302  -2.706 280.114  1.00 22.74           O
ATOM   4237  ND2  ASN B 200      80.487  -0.511 279.795  1.00 21.72           N
ATOM   4238  N    TYR B 201      83.252  -3.507 283.920  1.00 21.85           N
ATOM   4239  CA   TYR B 201      84.395  -3.415 284.864  1.00 22.03           C
ATOM   4240  C    TYR B 201      85.639  -3.068 284.086  1.00 21.91           C
ATOM   4241  O    TYR B 201      85.912  -3.744 283.101  1.00 22.02           O
ATOM   4242  CB   TYR B 201      84.644  -4.762 285.521  1.00 21.15           C
ATOM   4243  CG   TYR B 201      85.659  -4.790 286.630  1.00 21.11           C
ATOM   4244  CD1  TYR B 201      87.028  -4.887 286.365  1.00 21.31           C
ATOM   4245  CD2  TYR B 201      85.244  -4.802 287.965  1.00 20.99           C
ATOM   4246  CE1  TYR B 201      87.964  -4.958 287.406  1.00 21.24           C
ATOM   4247  CE2  TYR B 201      86.160  -4.871 289.000  1.00 21.86           C
ATOM   4248  CZ   TYR B 201      87.526  -4.950 288.723  1.00 21.88           C
ATOM   4249  OH   TYR B 201      88.409  -5.031 289.783  1.00 21.00           O
ATOM   4250  N    PHE B 202      86.392  -2.056 284.527  1.00 21.52           N
ATOM   4251  CA   PHE B 202      87.707  -1.757 283.925  1.00 21.19           C
ATOM   4252  C    PHE B 202      88.820  -1.745 284.985  1.00 21.50           C
ATOM   4253  O    PHE B 202      88.691  -1.060 286.007  1.00 21.05           O
ATOM   4254  CB   PHE B 202      87.677  -0.419 283.193  1.00 20.69           C
ATOM   4255  CG   PHE B 202      86.728  -0.375 282.036  1.00 20.59           C
ATOM   4256  CD1  PHE B 202      87.153  -0.712 280.756  1.00 20.71           C
ATOM   4257  CD2  PHE B 202      85.402   0.041 282.218  1.00 20.67           C
ATOM   4258  CE1  PHE B 202      86.279  -0.644 279.671  1.00 20.23           C
ATOM   4259  CE2  PHE B 202      84.528   0.110 281.141  1.00 20.33           C
ATOM   4260  CZ   PHE B 202      84.959  -0.245 279.876  1.00 20.22           C
ATOM   4261  N    VAL B 203      89.910  -2.486 284.744  1.00 22.01           N
ATOM   4262  CA   VAL B 203      90.978  -2.583 285.737  1.00 22.45           C
ATOM   4263  C    VAL B 203      91.613  -1.231 285.971  1.00 23.25           C
ATOM   4264  O    VAL B 203      91.978  -0.921 287.109  1.00 23.24           O
ATOM   4265  CB   VAL B 203      92.073  -3.647 285.409  1.00 23.42           C
ATOM   4266  CG1  VAL B 203      91.447  -5.026 285.320  1.00 23.75           C
ATOM   4267  CG2  VAL B 203      92.857  -3.338 284.136  1.00 22.07           C
ATOM   4268  N    GLN B 204      91.701  -0.410 284.917  1.00 23.65           N
ATOM   4269  CA   GLN B 204      92.430   0.850 285.010  1.00 23.45           C
ATOM   4270  C    GLN B 204      91.694   1.823 285.916  1.00 23.72           C
ATOM   4271  O    GLN B 204      92.311   2.581 286.626  1.00 27.04           O
ATOM   4272  CB   GLN B 204      92.732   1.466 283.617  1.00 23.17           C
ATOM   4273  CG   GLN B 204      91.534   1.993 282.831  1.00 23.38           C
```

Appendix 2

```
ATOM   4274  CD   GLN B 204      90.907   0.966 281.892  1.00 23.64           C
ATOM   4275  OE1  GLN B 204      90.748  -0.200 282.255  1.00 24.63           O
ATOM   4276  NE2  GLN B 204      90.544   1.396 280.686  1.00 21.77           N
ATOM   4277  N    CYS B 205      90.377   1.786 285.915  1.00 24.14           N
ATOM   4278  CA   CYS B 205      89.599   2.698 286.733  1.00 24.95           C
ATOM   4279  C    CYS B 205      89.580   2.239 288.163  1.00 23.88           C
ATOM   4280  O    CYS B 205      89.536   3.055 289.081  1.00 25.18           O
ATOM   4281  CB   CYS B 205      88.187   2.797 286.203  1.00 26.30           C
ATOM   4282  SG   CYS B 205      88.217   3.322 284.468  1.00 30.21           S
ATOM   4283  N    ASN B 206      89.622   0.934 288.359  1.00 21.39           N
ATOM   4284  CA   ASN B 206      89.738   0.421 289.694  1.00 19.93           C
ATOM   4285  C    ASN B 206      91.077   0.782 290.298  1.00 19.23           C
ATOM   4286  O    ASN B 206      91.167   1.033 291.501  1.00 17.64           O
ATOM   4287  CB   ASN B 206      89.485  -1.099 289.739  1.00 19.81           C
ATOM   4288  CG   ASN B 206      88.009  -1.428 289.820  1.00 19.95           C
ATOM   4289  OD1  ASN B 206      87.452  -1.607 290.907  1.00 19.79           O
ATOM   4290  ND2  ASN B 206      87.349  -1.442 288.677  1.00 20.26           N
ATOM   4291  N    SER B 207      92.120   0.851 289.472  1.00 19.85           N
ATOM   4292  CA   SER B 207      93.459   1.118 290.016  1.00 19.65           C
ATOM   4293  C    SER B 207      93.491   2.496 290.726  1.00 19.66           C
ATOM   4294  O    SER B 207      94.132   2.682 291.782  1.00 18.21           O
ATOM   4295  CB   SER B 207      94.499   1.027 288.933  1.00 18.94           C
ATOM   4296  OG   SER B 207      94.436   2.190 288.157  1.00 20.20           O
ATOM   4297  N    VAL B 208      92.732   3.425 290.154  1.00 19.74           N
ATOM   4298  CA   VAL B 208      92.635   4.763 290.674  1.00 19.42           C
ATOM   4299  C    VAL B 208      91.931   4.726 292.005  1.00 19.85           C
ATOM   4300  O    VAL B 208      92.401   5.308 292.991  1.00 20.73           O
ATOM   4301  CB   VAL B 208      91.862   5.674 289.722  1.00 19.75           C
ATOM   4302  CG1  VAL B 208      91.726   7.060 290.339  1.00 19.96           C
ATOM   4303  CG2  VAL B 208      92.537   5.747 288.351  1.00 19.45           C
ATOM   4304  N    ALA B 209      90.797   4.042 292.044  1.00 20.09           N
ATOM   4305  CA   ALA B 209      90.025   3.967 293.262  1.00 20.57           C
ATOM   4306  C    ALA B 209      90.835   3.354 294.409  1.00 20.38           C
ATOM   4307  O    ALA B 209      90.816   3.866 295.528  1.00 20.54           O
ATOM   4308  CB   ALA B 209      88.756   3.171 293.033  1.00 21.70           C
ATOM   4309  N    TYR B 210      91.534   2.253 294.144  1.00 20.50           N
ATOM   4310  CA   TYR B 210      92.399   1.646 295.174  1.00 20.27           C
ATOM   4311  C    TYR B 210      93.526   2.587 295.594  1.00 20.56           C
ATOM   4312  O    TYR B 210      93.750   2.791 296.782  1.00 21.06           O
ATOM   4313  CB   TYR B 210      92.915   0.278 294.749  1.00 20.11           C
ATOM   4314  CG   TYR B 210      91.824  -0.780 294.837  1.00 20.27           C
ATOM   4315  CD1  TYR B 210      91.581  -1.451 296.029  1.00 20.57           C
ATOM   4316  CD2  TYR B 210      91.028  -1.094 293.734  1.00 19.78           C
ATOM   4317  CE1  TYR B 210      90.579  -2.406 296.131  1.00 20.68           C
ATOM   4318  CE2  TYR B 210      90.027  -2.047 293.817  1.00 20.37           C
ATOM   4319  CZ   TYR B 210      89.791  -2.692 295.022  1.00 20.56           C
ATOM   4320  OH   TYR B 210      88.801  -3.642 295.122  1.00 19.44           O
ATOM   4321  N    LEU B 211      94.178   3.240 294.648  1.00 21.13           N
ATOM   4322  CA   LEU B 211      95.196   4.210 295.036  1.00 21.41           C
ATOM   4323  C    LEU B 211      94.574   5.257 295.990  1.00 21.72           C
ATOM   4324  O    LEU B 211      95.200   5.645 296.995  1.00 21.35           O
ATOM   4325  CB   LEU B 211      95.823   4.846 293.801  1.00 21.56           C
ATOM   4326  CG   LEU B 211      97.040   5.725 294.007  1.00 22.70           C
ATOM   4327  CD1  LEU B 211      98.131   5.025 294.811  1.00 22.57           C
```

Appendix 2

```
ATOM   4328  CD2 LEU B 211      97.554   6.138 292.639  1.00 23.20           C
ATOM   4329  N   SER B 212      93.327   5.672 295.719  1.00 21.47           N
ATOM   4330  CA  SER B 212      92.642   6.649 296.599  1.00 21.12           C
ATOM   4331  C   SER B 212      92.478   6.124 298.037  1.00 21.90           C
ATOM   4332  O   SER B 212      92.438   6.895 298.987  1.00 24.83           O
ATOM   4333  CB  SER B 212      91.282   7.023 296.048  1.00 20.94           C
ATOM   4334  OG  SER B 212      90.284   6.155 296.541  1.00 20.35           O
ATOM   4335  N   LEU B 213      92.410   4.816 298.211  1.00 21.25           N
ATOM   4336  CA  LEU B 213      92.336   4.256 299.548  1.00 21.91           C
ATOM   4337  C   LEU B 213      93.662   4.376 300.291  1.00 21.00           C
ATOM   4338  O   LEU B 213      93.691   4.674 301.498  1.00 17.83           O
ATOM   4339  CB  LEU B 213      91.860   2.795 299.489  1.00 23.11           C
ATOM   4340  CG  LEU B 213      90.448   2.600 298.882  1.00 22.64           C
ATOM   4341  CD1 LEU B 213      89.991   1.164 299.041  1.00 23.39           C
ATOM   4342  CD2 LEU B 213      89.432   3.527 299.525  1.00 22.62           C
ATOM   4343  N   TRP B 214      94.758   4.177 299.553  1.00 21.50           N
ATOM   4344  CA  TRP B 214      96.086   4.330 300.131  1.00 20.36           C
ATOM   4345  C   TRP B 214      96.258   5.754 300.625  1.00 20.20           C
ATOM   4346  O   TRP B 214      96.712   5.997 301.757  1.00 20.34           O
ATOM   4347  CB  TRP B 214      97.177   3.931 299.135  1.00 20.15           C
ATOM   4348  CG  TRP B 214      97.249   2.442 298.929  1.00 19.16           C
ATOM   4349  CD1 TRP B 214      96.313   1.670 298.336  1.00 19.43           C
ATOM   4350  CD2 TRP B 214      98.296   1.559 299.338  1.00 18.00           C
ATOM   4351  NE1 TRP B 214      96.708   0.370 298.320  1.00 18.81           N
ATOM   4352  CE2 TRP B 214      97.921   0.263 298.939  1.00 18.24           C
ATOM   4353  CE3 TRP B 214      99.530   1.739 299.979  1.00 18.16           C
ATOM   4354  CZ2 TRP B 214      98.736  -0.881 299.164  1.00 18.05           C
ATOM   4355  CZ3 TRP B 214     100.350   0.576 300.227  1.00 18.21           C
ATOM   4356  CH2 TRP B 214      99.934  -0.703 299.814  1.00 17.36           C
ATOM   4357  N   VAL B 215      95.827   6.711 299.822  1.00 20.01           N
ATOM   4358  CA  VAL B 215      95.993   8.126 300.223  1.00 19.88           C
ATOM   4359  C   VAL B 215      95.207   8.441 301.504  1.00 18.80           C
ATOM   4360  O   VAL B 215      95.723   9.023 302.443  1.00 18.71           O
ATOM   4361  CB  VAL B 215      95.603   9.088 299.074  1.00 20.10           C
ATOM   4362  CG1 VAL B 215      95.715  10.534 299.523  1.00 20.20           C
ATOM   4363  CG2 VAL B 215      96.468   8.826 297.847  1.00 19.65           C
ATOM   4364  N   TYR B 216      93.957   8.025 301.565  1.00 18.87           N
ATOM   4365  CA  TYR B 216      93.175   8.286 302.757  1.00 17.75           C
ATOM   4366  C   TYR B 216      93.891   7.680 303.955  1.00 17.77           C
ATOM   4367  O   TYR B 216      93.989   8.296 305.030  1.00 17.36           O
ATOM   4368  CB  TYR B 216      91.749   7.728 302.599  1.00 18.13           C
ATOM   4369  CG  TYR B 216      90.791   8.280 303.642  1.00 17.80           C
ATOM   4370  CD1 TYR B 216      90.069   9.427 303.402  1.00 17.81           C
ATOM   4371  CD2 TYR B 216      90.666   7.684 304.877  1.00 17.44           C
ATOM   4372  CE1 TYR B 216      89.236   9.967 304.353  1.00 17.95           C
ATOM   4373  CE2 TYR B 216      89.847   8.227 305.850  1.00 17.94           C
ATOM   4374  CZ  TYR B 216      89.127   9.373 305.584  1.00 17.65           C
ATOM   4375  OH  TYR B 216      88.278   9.902 306.531  1.00 16.25           O
ATOM   4376  N   ASP B 217      94.422   6.476 303.766  1.00 18.80           N
ATOM   4377  CA  ASP B 217      95.081   5.754 304.852  1.00 19.17           C
ATOM   4378  C   ASP B 217      96.254   6.558 305.404  1.00 19.49           C
ATOM   4379  O   ASP B 217      96.338   6.818 306.607  1.00 18.34           O
ATOM   4380  CB  ASP B 217      95.537   4.374 304.388  1.00 19.37           C
ATOM   4381  CG  ASP B 217      94.399   3.346 304.349  1.00 20.07           C
```

Appendix 2

```
ATOM   4382  OD1 ASP B 217      93.218   3.637 304.669  1.00 17.96           O
ATOM   4383  OD2 ASP B 217      94.726   2.202 303.996  1.00 21.61           O
ATOM   4384  N   ARG B 218      97.132   6.993 304.513  1.00 20.33           N
ATOM   4385  CA  ARG B 218      98.217   7.895 304.895  1.00 21.05           C
ATOM   4386  C   ARG B 218      97.724   9.115 305.661  1.00 19.71           C
ATOM   4387  O   ARG B 218      98.253   9.472 306.722  1.00 18.53           O
ATOM   4388  CB  ARG B 218      98.948   8.349 303.654  1.00 23.96           C
ATOM   4389  CG  ARG B 218      99.803   9.550 303.885  1.00 28.90           C
ATOM   4390  CD  ARG B 218     101.111   9.256 304.628  1.00 34.02           C
ATOM   4391  NE  ARG B 218     102.106  10.181 304.080  1.00 41.89           N
ATOM   4392  CZ  ARG B 218     102.211  11.475 304.384  1.00 44.54           C
ATOM   4393  NH1 ARG B 218     101.445  12.048 305.309  1.00 47.74           N
ATOM   4394  NH2 ARG B 218     103.124  12.198 303.767  1.00 47.83           N
ATOM   4395  N   LEU B 219      96.689   9.758 305.137  1.00 17.96           N
ATOM   4396  CA  LEU B 219      96.171  10.938 305.807  1.00 17.03           C
ATOM   4397  C   LEU B 219      95.552  10.686 307.181  1.00 16.93           C
ATOM   4398  O   LEU B 219      95.491  11.593 307.972  1.00 15.72           O
ATOM   4399  CB  LEU B 219      95.122  11.617 304.937  1.00 16.73           C
ATOM   4400  CG  LEU B 219      95.679  12.367 303.747  1.00 16.91           C
ATOM   4401  CD1 LEU B 219      94.560  12.817 302.837  1.00 16.72           C
ATOM   4402  CD2 LEU B 219      96.497  13.565 304.230  1.00 17.44           C
ATOM   4403  N   HIS B 220      95.017   9.494 307.446  1.00 18.12           N
ATOM   4404  CA  HIS B 220      94.140   9.320 308.643  1.00 18.00           C
ATOM   4405  C   HIS B 220      94.443   8.143 309.540  1.00 17.41           C
ATOM   4406  O   HIS B 220      93.783   7.997 310.572  1.00 15.64           O
ATOM   4407  CB  HIS B 220      92.680   9.265 308.222  1.00 18.06           C
ATOM   4408  CG  HIS B 220      92.154  10.578 307.740  1.00 18.80           C
ATOM   4409  ND1 HIS B 220      91.795  10.804 306.425  1.00 19.26           N
ATOM   4410  CD2 HIS B 220      91.931  11.739 308.398  1.00 18.62           C
ATOM   4411  CE1 HIS B 220      91.371  12.048 306.298  1.00 19.34           C
ATOM   4412  NE2 HIS B 220      91.440  12.634 307.481  1.00 19.02           N
ATOM   4413  N   GLY B 221      95.447   7.351 309.141  1.00 17.62           N
ATOM   4414  CA  GLY B 221      95.905   6.181 309.870  1.00 18.45           C
ATOM   4415  C   GLY B 221      95.043   4.937 309.723  1.00 19.51           C
ATOM   4416  O   GLY B 221      95.213   3.991 310.462  1.00 20.59           O
ATOM   4417  N   THR B 222      94.138   4.927 308.757  1.00 20.65           N
ATOM   4418  CA  THR B 222      93.193   3.829 308.560  1.00 21.67           C
ATOM   4419  C   THR B 222      93.769   2.695 307.735  1.00 23.50           C
ATOM   4420  O   THR B 222      94.900   2.783 307.292  1.00 26.85           O
ATOM   4421  CB  THR B 222      91.974   4.371 307.821  1.00 21.92           C
ATOM   4422  OG1 THR B 222      92.420   5.086 306.642  1.00 21.62           O
ATOM   4423  CG2 THR B 222      91.180   5.288 308.776  1.00 21.04           C
ATOM   4424  N   ASP B 223      92.983   1.641 307.516  1.00 25.93           N
ATOM   4425  CA  ASP B 223      93.436   0.447 306.798  1.00 27.90           C
ATOM   4426  C   ASP B 223      92.481   0.050 305.668  1.00 25.70           C
ATOM   4427  O   ASP B 223      92.283  -1.128 305.392  1.00 26.24           O
ATOM   4428  CB  ASP B 223      93.603  -0.725 307.789  1.00 31.93           C
ATOM   4429  CG  ASP B 223      94.528  -1.839 307.252  1.00 36.34           C
ATOM   4430  OD1 ASP B 223      95.241  -1.616 306.237  1.00 37.31           O
ATOM   4431  OD2 ASP B 223      94.543  -2.950 307.852  1.00 40.41           O
ATOM   4432  N   TYR B 224      91.910   1.036 304.995  1.00 24.09           N
ATOM   4433  CA  TYR B 224      91.056   0.776 303.842  1.00 23.47           C
ATOM   4434  C   TYR B 224      91.849   0.156 302.686  1.00 24.63           C
ATOM   4435  O   TYR B 224      91.281  -0.494 301.818  1.00 27.72           O
```

Appendix 2

```
ATOM   4436  CB   TYR B 224      90.418   2.070 303.337  1.00 22.45           C
ATOM   4437  CG   TYR B 224      89.486   2.742 304.306  1.00 21.32           C
ATOM   4438  CD1  TYR B 224      88.207   2.255 304.518  1.00 21.35           C
ATOM   4439  CD2  TYR B 224      89.870   3.871 305.009  1.00 21.06           C
ATOM   4440  CE1  TYR B 224      87.340   2.856 305.411  1.00 19.87           C
ATOM   4441  CE2  TYR B 224      89.002   4.489 305.894  1.00 20.79           C
ATOM   4442  CZ   TYR B 224      87.730   3.972 306.078  1.00 20.24           C
ATOM   4443  OH   TYR B 224      86.865   4.558 306.967  1.00 20.27           O
ATOM   4444  N    ARG B 225      93.155   0.383 302.648  1.00 25.27           N
ATOM   4445  CA   ARG B 225      94.020  -0.223 301.620  1.00 25.18           C
ATOM   4446  C    ARG B 225      94.174  -1.775 301.741  1.00 23.27           C
ATOM   4447  O    ARG B 225      94.700  -2.408 300.837  1.00 21.26           O
ATOM   4448  CB   ARG B 225      95.397   0.460 301.624  1.00 26.28           C
ATOM   4449  CG   ARG B 225      96.474  -0.306 302.375  1.00 28.08           C
ATOM   4450  CD   ARG B 225      97.638   0.591 302.758  1.00 28.79           C
ATOM   4451  NE   ARG B 225      97.379   1.051 304.098  1.00 30.47           N
ATOM   4452  CZ   ARG B 225      97.995   0.619 305.183  1.00 30.96           C
ATOM   4453  NH1  ARG B 225      98.980  -0.263 305.107  1.00 33.96           N
ATOM   4454  NH2  ARG B 225      97.642   1.105 306.353  1.00 31.39           N
ATOM   4455  N    ALA B 226      93.711  -2.353 302.857  1.00 21.76           N
ATOM   4456  CA   ALA B 226      93.699  -3.811 303.089  1.00 20.29           C
ATOM   4457  C    ALA B 226      92.938  -4.608 302.008  1.00 20.05           C
ATOM   4458  O    ALA B 226      93.230  -5.773 301.773  1.00 19.18           O
ATOM   4459  CB   ALA B 226      93.108  -4.104 304.467  1.00 19.21           C
ATOM   4460  N    ALA B 227      91.963  -3.968 301.365  1.00 20.09           N
ATOM   4461  CA   ALA B 227      91.247  -4.550 300.241  1.00 20.34           C
ATOM   4462  C    ALA B 227      92.091  -4.707 298.961  1.00 21.55           C
ATOM   4463  O    ALA B 227      91.682  -5.402 298.020  1.00 24.01           O
ATOM   4464  CB   ALA B 227      90.009  -3.727 299.940  1.00 20.30           C
ATOM   4465  N    THR B 228      93.259  -4.077 298.905  1.00 21.16           N
ATOM   4466  CA   THR B 228      94.105  -4.179 297.723  1.00 20.25           C
ATOM   4467  C    THR B 228      94.567  -5.595 297.429  1.00 21.13           C
ATOM   4468  O    THR B 228      94.595  -6.001 296.268  1.00 21.56           O
ATOM   4469  CB   THR B 228      95.287  -3.236 297.847  1.00 19.36           C
ATOM   4470  OG1  THR B 228      94.780  -1.975 298.289  1.00 19.67           O
ATOM   4471  CG2  THR B 228      96.025  -3.063 296.504  1.00 19.12           C
ATOM   4472  N    ARG B 229      94.894  -6.366 298.458  1.00 23.12           N
ATOM   4473  CA   ARG B 229      95.327  -7.747 298.229  1.00 25.30           C
ATOM   4474  C    ARG B 229      94.294  -8.556 297.414  1.00 23.72           C
ATOM   4475  O    ARG B 229      94.628  -9.119 296.366  1.00 21.84           O
ATOM   4476  CB   ARG B 229      95.672  -8.450 299.545  1.00 28.52           C
ATOM   4477  CG   ARG B 229      96.096  -9.924 299.419  1.00 32.86           C
ATOM   4478  CD   ARG B 229      97.179 -10.176 298.357  1.00 36.64           C
ATOM   4479  NE   ARG B 229      98.177  -9.090 298.282  1.00 40.49           N
ATOM   4480  CZ   ARG B 229      99.018  -8.881 297.259  1.00 44.08           C
ATOM   4481  NH1  ARG B 229      99.016  -9.685 296.190  1.00 44.18           N
ATOM   4482  NH2  ARG B 229      99.867  -7.848 297.303  1.00 43.21           N
ATOM   4483  N    ALA B 230      93.046  -8.598 297.877  1.00 22.33           N
ATOM   4484  CA   ALA B 230      92.004  -9.330 297.155  1.00 21.35           C
ATOM   4485  C    ALA B 230      91.879  -8.871 295.679  1.00 21.27           C
ATOM   4486  O    ALA B 230      91.759  -9.697 294.770  1.00 21.04           O
ATOM   4487  CB   ALA B 230      90.675  -9.194 297.880  1.00 20.56           C
ATOM   4488  N    TRP B 231      91.946  -7.558 295.456  1.00 21.03           N
ATOM   4489  CA   TRP B 231      91.827  -6.996 294.113  1.00 22.04           C
```

Appendix 2

```
ATOM   4490  C    TRP B 231      92.985   -7.397 293.237  1.00 22.08           C
ATOM   4491  O    TRP B 231      92.771   -7.706 292.075  1.00 22.60           O
ATOM   4492  CB   TRP B 231      91.684   -5.473 294.146  1.00 22.53           C
ATOM   4493  CG   TRP B 231      91.679   -4.805 292.794  1.00 22.86           C
ATOM   4494  CD1  TRP B 231      90.703   -4.868 291.857  1.00 23.77           C
ATOM   4495  CD2  TRP B 231      92.700   -3.954 292.246  1.00 22.62           C
ATOM   4496  NE1  TRP B 231      91.045   -4.112 290.750  1.00 22.42           N
ATOM   4497  CE2  TRP B 231      92.272   -3.553 290.964  1.00 22.22           C
ATOM   4498  CE3  TRP B 231      93.933   -3.504 292.712  1.00 22.33           C
ATOM   4499  CZ2  TRP B 231      93.028   -2.713 290.151  1.00 22.10           C
ATOM   4500  CZ3  TRP B 231      94.687   -2.667 291.902  1.00 22.35           C
ATOM   4501  CH2  TRP B 231      94.230   -2.280 290.638  1.00 22.52           C
ATOM   4502  N    LEU B 232      94.198   -7.423 293.782  1.00 21.94           N
ATOM   4503  CA   LEU B 232      95.344   -7.872 292.989  1.00 22.23           C
ATOM   4504  C    LEU B 232      95.291   -9.377 292.642  1.00 22.80           C
ATOM   4505  O    LEU B 232      95.572   -9.758 291.499  1.00 22.27           O
ATOM   4506  CB   LEU B 232      96.661   -7.502 293.669  1.00 21.99           C
ATOM   4507  CG   LEU B 232      96.906   -6.003 293.819  1.00 22.09           C
ATOM   4508  CD1  LEU B 232      97.964   -5.763 294.874  1.00 22.22           C
ATOM   4509  CD2  LEU B 232      97.307   -5.363 292.495  1.00 22.36           C
ATOM   4510  N    ASP B 233      94.923  -10.220 293.610  1.00 23.51           N
ATOM   4511  CA   ASP B 233      94.718  -11.665 293.349  1.00 23.79           C
ATOM   4512  C    ASP B 233      93.677  -11.838 292.244  1.00 23.86           C
ATOM   4513  O    ASP B 233      93.865  -12.652 291.344  1.00 22.65           O
ATOM   4514  CB   ASP B 233      94.306  -12.433 294.619  1.00 23.84           C
ATOM   4515  CG   ASP B 233      95.422  -12.464 295.689  1.00 25.21           C
ATOM   4516  OD1  ASP B 233      96.609  -12.312 295.346  1.00 23.81           O
ATOM   4517  OD2  ASP B 233      95.113  -12.634 296.891  1.00 27.82           O
ATOM   4518  N    PHE B 234      92.613  -11.032 292.292  1.00 24.83           N
ATOM   4519  CA   PHE B 234      91.522  -11.123 291.309  1.00 25.50           C
ATOM   4520  C    PHE B 234      91.936  -10.729 289.897  1.00 26.20           C
ATOM   4521  O    PHE B 234      91.771  -11.504 288.963  1.00 26.02           O
ATOM   4522  CB   PHE B 234      90.335  -10.256 291.720  1.00 25.49           C
ATOM   4523  CG   PHE B 234      89.240  -10.205 290.690  1.00 25.44           C
ATOM   4524  CD1  PHE B 234      88.627  -11.374 290.245  1.00 25.64           C
ATOM   4525  CD2  PHE B 234      88.802   -8.999 290.181  1.00 25.00           C
ATOM   4526  CE1  PHE B 234      87.609  -11.340 289.316  1.00 24.56           C
ATOM   4527  CE2  PHE B 234      87.788   -8.956 289.240  1.00 24.54           C
ATOM   4528  CZ   PHE B 234      87.187  -10.128 288.816  1.00 24.44           C
ATOM   4529  N    ILE B 235      92.463   -9.521 289.725  1.00 27.17           N
ATOM   4530  CA   ILE B 235      92.855   -9.096 288.387  1.00 27.87           C
ATOM   4531  C    ILE B 235      93.919  -10.005 287.801  1.00 27.45           C
ATOM   4532  O    ILE B 235      94.085  -10.050 286.610  1.00 29.16           O
ATOM   4533  CB   ILE B 235      93.308   -7.630 288.305  1.00 28.54           C
ATOM   4534  CG1  ILE B 235      94.678   -7.420 288.970  1.00 28.66           C
ATOM   4535  CG2  ILE B 235      92.246   -6.716 288.909  1.00 28.92           C
ATOM   4536  CD1  ILE B 235      95.093   -5.966 289.019  1.00 27.18           C
ATOM   4537  N    GLN B 236      94.605  -10.762 288.628  1.00 29.38           N
ATOM   4538  CA   GLN B 236      95.623  -11.672 288.131  1.00 30.87           C
ATOM   4539  C    GLN B 236      95.075  -12.998 287.608  1.00 31.91           C
ATOM   4540  O    GLN B 236      95.834  -13.770 287.061  1.00 31.40           O
ATOM   4541  CB   GLN B 236      96.649  -11.931 289.224  1.00 32.49           C
ATOM   4542  CG   GLN B 236      98.072  -12.072 288.724  1.00 34.45           C
ATOM   4543  CD   GLN B 236      99.108  -11.818 289.803  1.00 36.08           C
```

Appendix 2

```
ATOM   4544  OE1 GLN B 236      98.835 -11.174 290.824  1.00 36.66           O
ATOM   4545  NE2 GLN B 236     100.308 -12.318 289.576  1.00 36.53           N
ATOM   4546  N   LYS B 237      93.782 -13.271 287.776  1.00 35.63           N
ATOM   4547  CA  LYS B 237      93.148 -14.429 287.134  1.00 39.91           C
ATOM   4548  C   LYS B 237      92.102 -13.976 286.128  1.00 42.83           C
ATOM   4549  O   LYS B 237      91.120 -13.321 286.493  1.00 43.79           O
ATOM   4550  CB  LYS B 237      92.426 -15.322 288.135  1.00 42.81           C
ATOM   4551  CG  LYS B 237      92.861 -15.218 289.584  1.00 43.67           C
ATOM   4552  CD  LYS B 237      92.051 -16.200 290.422  1.00 44.98           C
ATOM   4553  CE  LYS B 237      92.431 -17.647 290.118  1.00 44.79           C
ATOM   4554  NZ  LYS B 237      91.357 -18.607 290.475  1.00 45.30           N
ATOM   4555  N   ASP B 238      92.292 -14.337 284.864  1.00 45.28           N
ATOM   4556  CA  ASP B 238      91.278 -14.077 283.819  1.00 46.15           C
ATOM   4557  C   ASP B 238      91.322 -12.673 283.250  1.00 43.02           C
ATOM   4558  O   ASP B 238      91.061 -12.512 282.051  1.00 45.23           O
ATOM   4559  CB  ASP B 238      89.837 -14.380 284.291  1.00 47.78           C
ATOM   4560  CG  ASP B 238      89.370 -15.770 283.902  1.00 48.44           C
ATOM   4561  OD1 ASP B 238      90.160 -16.743 283.997  1.00 45.87           O
ATOM   4562  OD2 ASP B 238      88.196 -15.877 283.501  1.00 49.30           O
ATOM   4563  N   LEU B 239      91.626 -11.667 284.082  1.00 37.21           N
ATOM   4564  CA  LEU B 239      91.773 -10.289 283.580  1.00 35.16           C
ATOM   4565  C   LEU B 239      93.134  -9.970 282.967  1.00 33.03           C
ATOM   4566  O   LEU B 239      93.255  -9.020 282.202  1.00 32.48           O
ATOM   4567  CB  LEU B 239      91.422  -9.253 284.652  1.00 34.46           C
ATOM   4568  CG  LEU B 239      89.960  -8.800 284.619  1.00 34.35           C
ATOM   4569  CD1 LEU B 239      89.036 -10.009 284.457  1.00 35.66           C
ATOM   4570  CD2 LEU B 239      89.596  -8.011 285.869  1.00 32.96           C
ATOM   4571  N   ILE B 240      94.145 -10.760 283.295  1.00 32.47           N
ATOM   4572  CA  ILE B 240      95.486 -10.547 282.763  1.00 32.76           C
ATOM   4573  C   ILE B 240      95.979 -11.768 281.989  1.00 31.01           C
ATOM   4574  O   ILE B 240      95.602 -12.874 282.318  1.00 32.75           O
ATOM   4575  CB  ILE B 240      96.484 -10.159 283.892  1.00 31.61           C
ATOM   4576  CG1 ILE B 240      97.686  -9.405 283.306  1.00 32.13           C
ATOM   4577  CG2 ILE B 240      96.933 -11.362 284.709  1.00 29.52           C
ATOM   4578  CD1 ILE B 240      98.589  -8.808 284.365  1.00 32.78           C
ATOM   4579  N   ASP B 241      96.777 -11.543 280.946  1.00 30.44           N
ATOM   4580  CA  ASP B 241      97.546 -12.600 280.284  1.00 31.27           C
ATOM   4581  C   ASP B 241      98.942 -12.503 280.837  1.00 32.56           C
ATOM   4582  O   ASP B 241      99.701 -11.608 280.435  1.00 31.77           O
ATOM   4583  CB  ASP B 241      97.616 -12.414 278.773  1.00 31.88           C
ATOM   4584  CG  ASP B 241      98.443 -13.498 278.074  1.00 33.14           C
ATOM   4585  OD1 ASP B 241      99.353 -14.114 278.703  1.00 38.18           O
ATOM   4586  OD2 ASP B 241      98.169 -13.743 276.879  1.00 30.27           O
ATOM   4587  N   PRO B 242      99.301 -13.430 281.746  1.00 34.61           N
ATOM   4588  CA  PRO B 242     100.553 -13.281 282.469  1.00 33.30           C
ATOM   4589  C   PRO B 242     101.792 -13.555 281.600  1.00 33.10           C
ATOM   4590  O   PRO B 242     102.808 -12.913 281.812  1.00 28.97           O
ATOM   4591  CB  PRO B 242     100.422 -14.279 283.619  1.00 34.69           C
ATOM   4592  CG  PRO B 242      99.286 -15.200 283.267  1.00 34.68           C
ATOM   4593  CD  PRO B 242      98.685 -14.755 281.971  1.00 35.62           C
ATOM   4594  N   GLU B 243     101.715 -14.469 280.625  1.00 36.25           N
ATOM   4595  CA  GLU B 243     102.838 -14.651 279.669  1.00 37.40           C
ATOM   4596  C   GLU B 243     103.175 -13.294 278.954  1.00 37.82           C
ATOM   4597  O   GLU B 243     104.357 -12.946 278.780  1.00 37.99           O
```

Appendix 2

```
ATOM   4598  CB  GLU B 243     102.568 -15.803 278.678  1.00 34.28           C
ATOM   4599  N   ARG B 244     102.153 -12.504 278.611  1.00 36.03           N
ATOM   4600  CA  ARG B 244     102.361 -11.290 277.800  1.00 35.70           C
ATOM   4601  C   ARG B 244     102.382  -9.977 278.613  1.00 35.18           C
ATOM   4602  O   ARG B 244     102.720  -8.906 278.091  1.00 31.05           O
ATOM   4603  CB  ARG B 244     101.352 -11.241 276.648  1.00 35.36           C
ATOM   4604  CG  ARG B 244     101.690 -12.224 275.519  1.00 36.92           C
ATOM   4605  CD  ARG B 244     100.707 -12.128 274.353  1.00 38.93           C
ATOM   4606  NE  ARG B 244      99.329 -12.308 274.831  1.00 40.95           N
ATOM   4607  CZ  ARG B 244      98.221 -12.220 274.088  1.00 41.37           C
ATOM   4608  NH1 ARG B 244      98.293 -11.976 272.772  1.00 40.88           N
ATOM   4609  NH2 ARG B 244      97.024 -12.399 274.678  1.00 39.64           N
ATOM   4610  N   GLY B 245     102.071 -10.075 279.901  1.00 34.12           N
ATOM   4611  CA  GLY B 245     102.131  -8.922 280.776  1.00 33.87           C
ATOM   4612  C   GLY B 245     101.112  -7.852 280.425  1.00 34.06           C
ATOM   4613  O   GLY B 245     101.385  -6.660 280.576  1.00 33.88           O
ATOM   4614  N   ALA B 246      99.926  -8.281 279.987  1.00 34.10           N
ATOM   4615  CA  ALA B 246      98.928  -7.370 279.434  1.00 32.04           C
ATOM   4616  C   ALA B 246      97.498  -7.692 279.865  1.00 29.90           C
ATOM   4617  O   ALA B 246      97.025  -8.812 279.675  1.00 30.54           O
ATOM   4618  CB  ALA B 246      99.030  -7.394 277.921  1.00 32.78           C
ATOM   4619  N   PHE B 247      96.802  -6.703 280.415  1.00 26.62           N
ATOM   4620  CA  PHE B 247      95.402  -6.881 280.811  1.00 25.16           C
ATOM   4621  C   PHE B 247      94.470  -6.883 279.604  1.00 25.34           C
ATOM   4622  O   PHE B 247      94.783  -6.261 278.568  1.00 24.43           O
ATOM   4623  CB  PHE B 247      94.962  -5.757 281.729  1.00 24.28           C
ATOM   4624  CG  PHE B 247      95.562  -5.815 283.089  1.00 24.36           C
ATOM   4625  CD1 PHE B 247      95.041  -6.664 284.049  1.00 25.73           C
ATOM   4626  CD2 PHE B 247      96.639  -5.008 283.427  1.00 24.07           C
ATOM   4627  CE1 PHE B 247      95.585  -6.713 285.333  1.00 25.77           C
ATOM   4628  CE2 PHE B 247      97.197  -5.058 284.695  1.00 24.54           C
ATOM   4629  CZ  PHE B 247      96.673  -5.909 285.651  1.00 25.44           C
ATOM   4630  N   TYR B 248      93.333  -7.573 279.733  1.00 25.13           N
ATOM   4631  CA  TYR B 248      92.273  -7.500 278.712  1.00 25.82           C
ATOM   4632  C   TYR B 248      91.402  -6.269 278.940  1.00 25.52           C
ATOM   4633  O   TYR B 248      91.360  -5.692 280.036  1.00 25.03           O
ATOM   4634  CB  TYR B 248      91.373  -8.753 278.700  1.00 25.59           C
ATOM   4635  CG  TYR B 248      92.082 -10.027 278.339  1.00 26.34           C
ATOM   4636  CD1 TYR B 248      92.765 -10.731 279.308  1.00 27.99           C
ATOM   4637  CD2 TYR B 248      92.049 -10.556 277.040  1.00 26.66           C
ATOM   4638  CE1 TYR B 248      93.421 -11.905 279.019  1.00 27.71           C
ATOM   4639  CE2 TYR B 248      92.724 -11.736 276.735  1.00 26.95           C
ATOM   4640  CZ  TYR B 248      93.399 -12.399 277.748  1.00 27.00           C
ATOM   4641  OH  TYR B 248      94.088 -13.550 277.568  1.00 26.52           O
ATOM   4642  N   LEU B 249      90.655  -5.934 277.899  1.00 25.85           N
ATOM   4643  CA  LEU B 249      89.906  -4.674 277.791  1.00 26.26           C
ATOM   4644  C   LEU B 249      88.928  -4.416 278.913  1.00 25.43           C
ATOM   4645  O   LEU B 249      88.909  -3.335 279.493  1.00 25.61           O
ATOM   4646  CB  LEU B 249      89.122  -4.691 276.492  1.00 27.03           C
ATOM   4647  CG  LEU B 249      88.722  -3.374 275.876  1.00 29.12           C
ATOM   4648  CD1 LEU B 249      89.950  -2.499 275.640  1.00 28.90           C
ATOM   4649  CD2 LEU B 249      87.982  -3.654 274.565  1.00 29.75           C
ATOM   4650  N   SER B 250      88.103  -5.406 279.215  1.00 24.39           N
ATOM   4651  CA  SER B 250      87.088  -5.228 280.246  1.00 23.91           C
```

Appendix 2

```
ATOM   4652  C   SER B 250      86.466  -6.545 280.639  1.00 24.71           C
ATOM   4653  O   SER B 250      86.628  -7.564 279.934  1.00 25.32           O
ATOM   4654  CB  SER B 250      85.973  -4.269 279.780  1.00 23.03           C
ATOM   4655  OG  SER B 250      85.355  -4.678 278.567  1.00 21.33           O
ATOM   4656  N   TYR B 251      85.742  -6.499 281.760  1.00 23.93           N
ATOM   4657  CA  TYR B 251      85.111  -7.663 282.361  1.00 23.92           C
ATOM   4658  C   TYR B 251      83.674  -7.285 282.650  1.00 22.79           C
ATOM   4659  O   TYR B 251      83.384  -6.116 282.907  1.00 20.77           O
ATOM   4660  CB  TYR B 251      85.865  -8.072 283.634  1.00 24.54           C
ATOM   4661  CG  TYR B 251      85.134  -9.026 284.584  1.00 26.47           C
ATOM   4662  CD1 TYR B 251      84.986 -10.383 284.288  1.00 25.92           C
ATOM   4663  CD2 TYR B 251      84.609  -8.564 285.801  1.00 27.69           C
ATOM   4664  CE1 TYR B 251      84.333 -11.240 285.167  1.00 25.83           C
ATOM   4665  CE2 TYR B 251      83.964  -9.420 286.686  1.00 26.64           C
ATOM   4666  CZ  TYR B 251      83.835 -10.751 286.368  1.00 26.25           C
ATOM   4667  OH  TYR B 251      83.198 -11.582 287.263  1.00 27.62           O
ATOM   4668  N   HIS B 252      82.780  -8.270 282.586  1.00 22.86           N
ATOM   4669  CA  HIS B 252      81.345  -8.003 282.617  1.00 22.08           C
ATOM   4670  C   HIS B 252      80.654  -9.046 283.457  1.00 23.98           C
ATOM   4671  O   HIS B 252      80.278 -10.102 282.944  1.00 24.30           O
ATOM   4672  CB  HIS B 252      80.828  -7.969 281.198  1.00 20.51           C
ATOM   4673  CG  HIS B 252      81.587  -7.016 280.349  1.00 19.82           C
ATOM   4674  ND1 HIS B 252      81.359  -5.657 280.373  1.00 19.52           N
ATOM   4675  CD2 HIS B 252      82.641  -7.206 279.529  1.00 19.45           C
ATOM   4676  CE1 HIS B 252      82.220  -5.053 279.581  1.00 18.75           C
ATOM   4677  NE2 HIS B 252      83.013  -5.971 279.064  1.00 19.22           N
ATOM   4678  N   PRO B 253      80.505  -8.758 284.762  1.00 25.84           N
ATOM   4679  CA  PRO B 253      80.113  -9.699 285.830  1.00 26.68           C
ATOM   4680  C   PRO B 253      78.826 -10.508 285.604  1.00 28.90           C
ATOM   4681  O   PRO B 253      78.857 -11.746 285.727  1.00 28.71           O
ATOM   4682  CB  PRO B 253      79.970  -8.805 287.057  1.00 26.47           C
ATOM   4683  CG  PRO B 253      80.810  -7.620 286.793  1.00 26.48           C
ATOM   4684  CD  PRO B 253      80.837  -7.427 285.300  1.00 26.56           C
ATOM   4685  N   GLU B 254      77.711  -9.837 285.306  1.00 31.22           N
ATOM   4686  CA  GLU B 254      76.455 -10.534 284.935  1.00 33.49           C
ATOM   4687  C   GLU B 254      76.800 -11.692 283.996  1.00 31.50           C
ATOM   4688  O   GLU B 254      76.585 -12.841 284.308  1.00 33.02           O
ATOM   4689  CB  GLU B 254      75.479  -9.540 284.260  1.00 35.66           C
ATOM   4690  CG  GLU B 254      74.300 -10.145 283.486  1.00 38.27           C
ATOM   4691  CD  GLU B 254      73.084 -10.435 284.357  1.00 40.88           C
ATOM   4692  OE1 GLU B 254      73.181 -10.192 285.587  1.00 39.18           O
ATOM   4693  OE2 GLU B 254      72.037 -10.895 283.805  1.00 42.26           O
ATOM   4694  N   SER B 255      77.373 -11.351 282.857  1.00 31.74           N
ATOM   4695  CA  SER B 255      77.776 -12.300 281.826  1.00 31.80           C
ATOM   4696  C   SER B 255      78.940 -13.240 282.238  1.00 32.25           C
ATOM   4697  O   SER B 255      79.016 -14.388 281.806  1.00 29.52           O
ATOM   4698  CB  SER B 255      78.194 -11.476 280.604  1.00 31.46           C
ATOM   4699  OG  SER B 255      78.940 -12.252 279.717  1.00 30.73           O
ATOM   4700  N   GLY B 256      79.849 -12.733 283.071  1.00 34.43           N
ATOM   4701  CA  GLY B 256      81.142 -13.391 283.355  1.00 34.21           C
ATOM   4702  C   GLY B 256      82.165 -13.209 282.240  1.00 33.37           C
ATOM   4703  O   GLY B 256      83.199 -13.867 282.219  1.00 36.40           O
ATOM   4704  N   ALA B 257      81.887 -12.312 281.304  1.00 32.29           N
ATOM   4705  CA  ALA B 257      82.669 -12.257 280.088  1.00 30.73           C
```

Appendix 2

```
ATOM   4706  C    ALA B 257      83.848  -11.331 280.271  1.00 30.08           C
ATOM   4707  O    ALA B 257      83.776  -10.318 280.991  1.00 27.27           O
ATOM   4708  CB   ALA B 257      81.821  -11.807 278.914  1.00 30.55           C
ATOM   4709  N    VAL B 258      84.937  -11.724 279.626  1.00 29.02           N
ATOM   4710  CA   VAL B 258      86.132  -10.934 279.558  1.00 30.02           C
ATOM   4711  C    VAL B 258      86.320  -10.732 278.082  1.00 30.29           C
ATOM   4712  O    VAL B 258      86.485  -11.713 277.369  1.00 33.10           O
ATOM   4713  CB   VAL B 258      87.338  -11.688 280.141  1.00 30.63           C
ATOM   4714  CG1  VAL B 258      88.538  -10.775 280.256  1.00 30.13           C
ATOM   4715  CG2  VAL B 258      87.004  -12.264 281.512  1.00 32.26           C
ATOM   4716  N    LYS B 259      86.239   -9.485 277.609  1.00 29.67           N
ATOM   4717  CA   LYS B 259      86.434   -9.201 276.189  1.00 29.17           C
ATOM   4718  C    LYS B 259      87.810   -9.694 275.793  1.00 29.56           C
ATOM   4719  O    LYS B 259      88.778   -9.315 276.395  1.00 31.03           O
ATOM   4720  CB   LYS B 259      86.351   -7.698 275.899  1.00 28.06           C
ATOM   4721  CG   LYS B 259      84.961   -7.155 275.977  1.00 27.31           C
ATOM   4722  CD   LYS B 259      84.810   -5.790 275.357  1.00 27.45           C
ATOM   4723  CE   LYS B 259      83.431   -5.248 275.697  1.00 28.91           C
ATOM   4724  NZ   LYS B 259      83.138   -3.980 274.994  1.00 31.75           N
ATOM   4725  N    PRO B 260      87.904  -10.519 274.760  1.00 30.21           N
ATOM   4726  CA   PRO B 260      89.144  -11.213 274.495  1.00 31.28           C
ATOM   4727  C    PRO B 260      90.252  -10.395 273.860  1.00 32.12           C
ATOM   4728  O    PRO B 260      91.151  -10.992 273.269  1.00 38.75           O
ATOM   4729  CB   PRO B 260      88.717  -12.284 273.506  1.00 32.19           C
ATOM   4730  CG   PRO B 260      87.622  -11.616 272.756  1.00 32.28           C
ATOM   4731  CD   PRO B 260      86.848  -10.926 273.829  1.00 31.43           C
ATOM   4732  N    TRP B 261      90.255   -9.076 273.969  1.00 27.81           N
ATOM   4733  CA   TRP B 261      91.394   -8.337 273.419  1.00 26.32           C
ATOM   4734  C    TRP B 261      92.239   -7.771 274.531  1.00 23.69           C
ATOM   4735  O    TRP B 261      91.717   -7.339 275.542  1.00 22.25           O
ATOM   4736  CB   TRP B 261      90.937   -7.213 272.501  1.00 26.40           C
ATOM   4737  CG   TRP B 261      90.204   -7.681 271.346  1.00 26.05           C
ATOM   4738  CD1  TRP B 261      90.728   -8.154 270.179  1.00 27.70           C
ATOM   4739  CD2  TRP B 261      88.790   -7.715 271.202  1.00 25.27           C
ATOM   4740  NE1  TRP B 261      89.714   -8.479 269.304  1.00 27.29           N
ATOM   4741  CE2  TRP B 261      88.512   -8.246 269.918  1.00 26.12           C
ATOM   4742  CE3  TRP B 261      87.728   -7.371 272.037  1.00 23.75           C
ATOM   4743  CZ2  TRP B 261      87.212   -8.418 269.441  1.00 25.13           C
ATOM   4744  CZ3  TRP B 261      86.446   -7.562 271.577  1.00 24.07           C
ATOM   4745  CH2  TRP B 261      86.196   -8.074 270.282  1.00 24.85           C
ATOM   4746  N    ILE B 262      93.550   -7.793 274.352  1.00 23.63           N
ATOM   4747  CA   ILE B 262      94.458   -7.130 275.306  1.00 23.83           C
ATOM   4748  C    ILE B 262      94.675   -5.659 274.920  1.00 22.54           C
ATOM   4749  O    ILE B 262      94.672   -5.315 273.737  1.00 20.70           O
ATOM   4750  CB   ILE B 262      95.803   -7.878 275.478  1.00 24.41           C
ATOM   4751  CG1  ILE B 262      96.606   -7.902 274.190  1.00 24.57           C
ATOM   4752  CG2  ILE B 262      95.540   -9.288 275.964  1.00 25.37           C
ATOM   4753  CD1  ILE B 262      98.021   -8.406 274.370  1.00 25.69           C
ATOM   4754  N    SER B 263      94.818   -4.793 275.928  1.00 23.27           N
ATOM   4755  CA   SER B 263      94.950   -3.344 275.694  1.00 24.11           C
ATOM   4756  C    SER B 263      96.165   -2.759 276.379  1.00 22.44           C
ATOM   4757  O    SER B 263      96.377   -2.986 277.571  1.00 23.63           O
ATOM   4758  CB   SER B 263      93.730   -2.592 276.203  1.00 25.24           C
ATOM   4759  OG   SER B 263      94.062   -1.212 276.366  1.00 25.80           O
```

Appendix 2

```
ATOM   4760  N    ALA B 264      96.926  -1.963 275.637  1.00 21.82           N
ATOM   4761  CA   ALA B 264      98.190  -1.394 276.123  1.00 20.32           C
ATOM   4762  C    ALA B 264      97.915  -0.178 276.967  1.00 20.75           C
ATOM   4763  O    ALA B 264      98.397  -0.082 278.099  1.00 21.48           O
ATOM   4764  CB   ALA B 264      99.091  -1.036 274.963  1.00 20.54           C
ATOM   4765  N    TYR B 265      97.100   0.738 276.455  1.00 21.36           N
ATOM   4766  CA   TYR B 265      96.787   1.942 277.222  1.00 22.38           C
ATOM   4767  C    TYR B 265      96.249   1.489 278.579  1.00 22.33           C
ATOM   4768  O    TYR B 265      96.627   2.050 279.621  1.00 22.81           O
ATOM   4769  CB   TYR B 265      95.844   2.943 276.468  1.00 22.58           C
ATOM   4770  CG   TYR B 265      94.411   2.987 276.955  1.00 22.83           C
ATOM   4771  CD1  TYR B 265      94.049   3.803 278.004  1.00 22.94           C
ATOM   4772  CD2  TYR B 265      93.420   2.193 276.359  1.00 23.99           C
ATOM   4773  CE1  TYR B 265      92.742   3.843 278.456  1.00 24.18           C
ATOM   4774  CE2  TYR B 265      92.103   2.208 276.808  1.00 23.72           C
ATOM   4775  CZ   TYR B 265      91.760   3.034 277.855  1.00 23.78           C
ATOM   4776  OH   TYR B 265      90.465   3.065 278.307  1.00 21.43           O
ATOM   4777  N    THR B 266      95.427   0.440 278.566  1.00 21.50           N
ATOM   4778  CA   THR B 266      94.824  -0.074 279.783  1.00 21.01           C
ATOM   4779  C    THR B 266      95.892  -0.645 280.718  1.00 21.53           C
ATOM   4780  O    THR B 266      95.925  -0.343 281.929  1.00 21.33           O
ATOM   4781  CB   THR B 266      93.784  -1.156 279.465  1.00 20.99           C
ATOM   4782  OG1  THR B 266      92.744  -0.598 278.651  1.00 20.64           O
ATOM   4783  CG2  THR B 266      93.199  -1.733 280.734  1.00 20.19           C
ATOM   4784  N    THR B 267      96.776  -1.460 280.156  1.00 21.63           N
ATOM   4785  CA   THR B 267      97.856  -2.036 280.939  1.00 21.37           C
ATOM   4786  C    THR B 267      98.817  -0.976 281.472  1.00 20.81           C
ATOM   4787  O    THR B 267      99.198  -1.013 282.622  1.00 19.43           O
ATOM   4788  CB   THR B 267      98.621  -3.091 280.125  1.00 21.09           C
ATOM   4789  OG1  THR B 267      97.724  -4.132 279.734  1.00 20.82           O
ATOM   4790  CG2  THR B 267      99.726  -3.708 280.950  1.00 21.15           C
ATOM   4791  N    ALA B 268      99.188  -0.021 280.632  1.00 22.74           N
ATOM   4792  CA   ALA B 268     100.188   1.024 281.003  1.00 22.94           C
ATOM   4793  C    ALA B 268      99.772   1.854 282.218  1.00 22.90           C
ATOM   4794  O    ALA B 268     100.565   2.055 283.149  1.00 24.30           O
ATOM   4795  CB   ALA B 268     100.463   1.945 279.814  1.00 22.65           C
ATOM   4796  N    TRP B 269      98.539   2.338 282.186  1.00 21.31           N
ATOM   4797  CA   TRP B 269      97.966   3.116 283.274  1.00 22.09           C
ATOM   4798  C    TRP B 269      97.874   2.232 284.518  1.00 21.52           C
ATOM   4799  O    TRP B 269      98.359   2.613 285.596  1.00 22.51           O
ATOM   4800  CB   TRP B 269      96.623   3.636 282.788  1.00 22.93           C
ATOM   4801  CG   TRP B 269      95.701   4.315 283.701  1.00 24.59           C
ATOM   4802  CD1  TRP B 269      95.813   4.472 285.024  1.00 26.64           C
ATOM   4803  CD2  TRP B 269      94.439   4.896 283.325  1.00 26.27           C
ATOM   4804  NE1  TRP B 269      94.711   5.131 285.517  1.00 27.43           N
ATOM   4805  CE2  TRP B 269      93.846   5.386 284.484  1.00 26.58           C
ATOM   4806  CE3  TRP B 269      93.749   5.034 282.103  1.00 26.02           C
ATOM   4807  CZ2  TRP B 269      92.591   6.016 284.473  1.00 26.27           C
ATOM   4808  CZ3  TRP B 269      92.504   5.638 282.101  1.00 24.87           C
ATOM   4809  CH2  TRP B 269      91.947   6.132 283.273  1.00 24.97           C
ATOM   4810  N    THR B 270      97.333   1.027 284.368  1.00 20.34           N
ATOM   4811  CA   THR B 270      97.119   0.166 285.522  1.00 20.29           C
ATOM   4812  C    THR B 270      98.448  -0.185 286.212  1.00 19.85           C
ATOM   4813  O    THR B 270      98.564  -0.079 287.434  1.00 18.72           O
```

Appendix 2

```
ATOM   4814  CB  THR B 270      96.345  -1.101 285.141  1.00 20.41           C
ATOM   4815  OG1 THR B 270      95.224  -0.741 284.334  1.00 20.70           O
ATOM   4816  CG2 THR B 270      95.856  -1.811 286.361  1.00 20.15           C
ATOM   4817  N   LEU B 271      99.457  -0.564 285.437  1.00 20.01           N
ATOM   4818  CA  LEU B 271     100.736  -0.912 286.036  1.00 20.54           C
ATOM   4819  C   LEU B 271     101.401   0.294 286.677  1.00 20.03           C
ATOM   4820  O   LEU B 271     102.107   0.143 287.631  1.00 19.98           O
ATOM   4821  CB  LEU B 271     101.685  -1.549 285.015  1.00 20.89           C
ATOM   4822  CG  LEU B 271     101.236  -2.869 284.383  1.00 20.83           C
ATOM   4823  CD1 LEU B 271     102.289  -3.329 283.419  1.00 20.70           C
ATOM   4824  CD2 LEU B 271     100.961  -3.965 285.390  1.00 22.04           C
ATOM   4825  N   ALA B 272     101.165   1.488 286.165  1.00 20.88           N
ATOM   4826  CA  ALA B 272     101.777   2.686 286.725  1.00 20.01           C
ATOM   4827  C   ALA B 272     101.225   2.928 288.087  1.00 21.09           C
ATOM   4828  O   ALA B 272     101.951   3.083 289.043  1.00 20.70           O
ATOM   4829  CB  ALA B 272     101.505   3.872 285.842  1.00 19.69           C
ATOM   4830  N   MET B 273      99.912   2.928 288.187  1.00 24.43           N
ATOM   4831  CA  MET B 273      99.247   3.184 289.476  1.00 25.04           C
ATOM   4832  C   MET B 273      99.491   2.076 290.485  1.00 23.23           C
ATOM   4833  O   MET B 273      99.573   2.328 291.677  1.00 24.31           O
ATOM   4834  CB  MET B 273      97.748   3.381 289.250  1.00 27.47           C
ATOM   4835  CG  MET B 273      97.477   4.613 288.400  1.00 30.03           C
ATOM   4836  SD  MET B 273      95.932   5.409 288.825  1.00 35.14           S
ATOM   4837  CE  MET B 273      96.346   7.079 288.310  1.00 35.83           C
ATOM   4838  N   VAL B 274      99.588   0.847 290.005  1.00 21.80           N
ATOM   4839  CA  VAL B 274      99.804  -0.295 290.872  1.00 22.06           C
ATOM   4840  C   VAL B 274     101.244  -0.330 291.374  1.00 21.17           C
ATOM   4841  O   VAL B 274     101.510  -0.837 292.462  1.00 19.66           O
ATOM   4842  CB  VAL B 274      99.449  -1.621 290.164  1.00 22.90           C
ATOM   4843  CG1 VAL B 274      99.992  -2.812 290.921  1.00 23.15           C
ATOM   4844  CG2 VAL B 274      97.947  -1.764 290.026  1.00 23.38           C
ATOM   4845  N   HIS B 275     102.170   0.217 290.591  1.00 21.62           N
ATOM   4846  CA  HIS B 275     103.543   0.353 291.042  1.00 21.56           C
ATOM   4847  C   HIS B 275     103.614   1.087 292.369  1.00 21.22           C
ATOM   4848  O   HIS B 275     104.497   0.789 293.172  1.00 22.26           O
ATOM   4849  CB  HIS B 275     104.407   1.055 290.027  1.00 22.55           C
ATOM   4850  CG  HIS B 275     105.867   0.904 290.306  1.00 25.06           C
ATOM   4851  ND1 HIS B 275     106.684   1.972 290.623  1.00 25.83           N
ATOM   4852  CD2 HIS B 275     106.646  -0.201 290.363  1.00 24.92           C
ATOM   4853  CE1 HIS B 275     107.910   1.532 290.832  1.00 25.91           C
ATOM   4854  NE2 HIS B 275     107.913   0.216 290.680  1.00 26.67           N
ATOM   4855  N   GLY B 276     102.664   1.994 292.619  1.00 19.91           N
ATOM   4856  CA  GLY B 276     102.613   2.732 293.864  1.00 19.32           C
ATOM   4857  C   GLY B 276     102.039   1.999 295.051  1.00 19.80           C
ATOM   4858  O   GLY B 276     102.087   2.507 296.170  1.00 20.24           O
ATOM   4859  N   MET B 277     101.435   0.839 294.825  1.00 19.98           N
ATOM   4860  CA  MET B 277     100.777   0.090 295.901  1.00 19.99           C
ATOM   4861  C   MET B 277     101.457  -1.271 296.111  1.00 19.81           C
ATOM   4862  O   MET B 277     101.654  -1.685 297.246  1.00 19.06           O
ATOM   4863  CB  MET B 277      99.279  -0.129 295.601  1.00 20.58           C
ATOM   4864  CG  MET B 277      98.411   1.129 295.478  1.00 21.03           C
ATOM   4865  SD  MET B 277      96.688   0.859 294.893  1.00 20.95           S
ATOM   4866  CE  MET B 277      97.015   0.372 293.207  1.00 20.79           C
ATOM   4867  N   ASP B 278     101.763  -1.966 295.013  1.00 20.79           N
```

Appendix 2

```
ATOM   4868  CA  ASP B 278     102.520  -3.232 295.021  1.00 21.64           C
ATOM   4869  C   ASP B 278     103.586  -3.200 293.931  1.00 21.01           C
ATOM   4870  O   ASP B 278     103.408  -3.781 292.866  1.00 19.58           O
ATOM   4871  CB  ASP B 278     101.592  -4.435 294.782  1.00 23.67           C
ATOM   4872  CG  ASP B 278     102.327  -5.793 294.856  1.00 24.35           C
ATOM   4873  OD1 ASP B 278     103.573  -5.821 294.852  1.00 25.82           O
ATOM   4874  OD2 ASP B 278     101.645  -6.841 294.911  1.00 25.48           O
ATOM   4875  N   PRO B 279     104.703  -2.528 294.205  1.00 21.49           N
ATOM   4876  CA  PRO B 279     105.776  -2.364 293.238  1.00 22.42           C
ATOM   4877  C   PRO B 279     106.134  -3.636 292.476  1.00 23.05           C
ATOM   4878  O   PRO B 279     106.325  -3.585 291.268  1.00 25.31           O
ATOM   4879  CB  PRO B 279     106.977  -1.933 294.105  1.00 21.80           C
ATOM   4880  CG  PRO B 279     106.423  -1.445 295.397  1.00 21.34           C
ATOM   4881  CD  PRO B 279     104.967  -1.798 295.463  1.00 21.65           C
ATOM   4882  N   ALA B 280     106.223  -4.760 293.178  1.00 23.35           N
ATOM   4883  CA  ALA B 280     106.692  -6.023 292.593  1.00 23.52           C
ATOM   4884  C   ALA B 280     105.750  -6.562 291.554  1.00 23.57           C
ATOM   4885  O   ALA B 280     106.197  -7.173 290.574  1.00 26.17           O
ATOM   4886  CB  ALA B 280     106.883  -7.077 293.677  1.00 23.89           C
ATOM   4887  N   PHE B 281     104.452  -6.375 291.781  1.00 21.67           N
ATOM   4888  CA  PHE B 281     103.443  -6.634 290.748  1.00 20.76           C
ATOM   4889  C   PHE B 281     103.814  -5.992 289.412  1.00 20.28           C
ATOM   4890  O   PHE B 281     103.899  -6.692 288.424  1.00 20.79           O
ATOM   4891  CB  PHE B 281     102.084  -6.124 291.221  1.00 21.42           C
ATOM   4892  CG  PHE B 281     100.911  -6.612 290.420  1.00 20.91           C
ATOM   4893  CD1 PHE B 281     100.596  -6.036 289.184  1.00 21.18           C
ATOM   4894  CD2 PHE B 281     100.080  -7.578 290.925  1.00 20.17           C
ATOM   4895  CE1 PHE B 281      99.501  -6.453 288.457  1.00 20.09           C
ATOM   4896  CE2 PHE B 281      98.978  -7.998 290.200  1.00 20.69           C
ATOM   4897  CZ  PHE B 281      98.691  -7.431 288.967  1.00 20.30           C
ATOM   4898  N   SER B 282     104.052  -4.678 289.370  1.00 20.40           N
ATOM   4899  CA  SER B 282     104.314  -4.000 288.092  1.00 21.16           C
ATOM   4900  C   SER B 282     105.703  -4.337 287.534  1.00 22.00           C
ATOM   4901  O   SER B 282     105.895  -4.396 286.333  1.00 21.63           O
ATOM   4902  CB  SER B 282     104.145  -2.476 288.210  1.00 21.19           C
ATOM   4903  OG  SER B 282     102.886  -2.100 288.762  1.00 21.15           O
ATOM   4904  N   GLU B 283     106.671  -4.554 288.416  1.00 23.61           N
ATOM   4905  CA  GLU B 283     108.019  -4.982 288.011  1.00 23.75           C
ATOM   4906  C   GLU B 283     108.021  -6.326 287.291  1.00 24.65           C
ATOM   4907  O   GLU B 283     108.775  -6.504 286.345  1.00 25.52           O
ATOM   4908  CB  GLU B 283     108.957  -5.011 289.234  1.00 22.42           C
ATOM   4909  CG  GLU B 283     109.364  -3.607 289.633  1.00 21.94           C
ATOM   4910  CD  GLU B 283     109.838  -3.435 291.076  1.00 22.15           C
ATOM   4911  OE1 GLU B 283     110.391  -4.389 291.726  1.00 21.04           O
ATOM   4912  OE2 GLU B 283     109.658  -2.277 291.536  1.00 20.72           O
ATOM   4913  N   ARG B 284     107.167  -7.248 287.735  1.00 25.94           N
ATOM   4914  CA  ARG B 284     107.050  -8.590 287.160  1.00 27.67           C
ATOM   4915  C   ARG B 284     106.535  -8.587 285.718  1.00 26.96           C
ATOM   4916  O   ARG B 284     107.034  -9.331 284.885  1.00 29.68           O
ATOM   4917  CB  ARG B 284     106.135  -9.454 288.052  1.00 32.16           C
ATOM   4918  CG  ARG B 284     105.977 -10.925 287.619  1.00 37.47           C
ATOM   4919  CD  ARG B 284     105.564 -11.875 288.764  1.00 39.15           C
ATOM   4920  NE  ARG B 284     104.246 -11.524 289.311  1.00 43.73           N
ATOM   4921  CZ  ARG B 284     104.013 -10.898 290.474  1.00 43.38           C
```

Appendix 2

```
ATOM   4922  NH1 ARG B 284     104.993 -10.531 291.281  1.00 44.03           N
ATOM   4923  NH2 ARG B 284     102.769 -10.631 290.834  1.00 42.20           N
ATOM   4924  N   TYR B 285     105.561  -7.741 285.405  1.00 24.62           N
ATOM   4925  CA  TYR B 285     104.976  -7.731 284.068  1.00 23.98           C
ATOM   4926  C   TYR B 285     105.499  -6.616 283.146  1.00 22.91           C
ATOM   4927  O   TYR B 285     105.243  -6.641 281.945  1.00 22.57           O
ATOM   4928  CB  TYR B 285     103.442  -7.620 284.160  1.00 24.83           C
ATOM   4929  CG  TYR B 285     102.751  -8.694 284.967  1.00 25.77           C
ATOM   4930  CD1 TYR B 285     102.666  -9.991 284.499  1.00 27.36           C
ATOM   4931  CD2 TYR B 285     102.166  -8.409 286.184  1.00 27.51           C
ATOM   4932  CE1 TYR B 285     102.037 -10.981 285.230  1.00 28.10           C
ATOM   4933  CE2 TYR B 285     101.523  -9.391 286.921  1.00 29.06           C
ATOM   4934  CZ  TYR B 285     101.464 -10.679 286.433  1.00 28.44           C
ATOM   4935  OH  TYR B 285     100.836 -11.668 287.138  1.00 28.72           O
ATOM   4936  N   TYR B 286     106.207  -5.635 283.684  1.00 22.67           N
ATOM   4937  CA  TYR B 286     106.690  -4.525 282.862  1.00 23.32           C
ATOM   4938  C   TYR B 286     107.507  -5.033 281.688  1.00 24.21           C
ATOM   4939  O   TYR B 286     107.184  -4.695 280.546  1.00 27.42           O
ATOM   4940  CB  TYR B 286     107.477  -3.498 283.692  1.00 22.95           C
ATOM   4941  CG  TYR B 286     107.947  -2.276 282.939  1.00 23.41           C
ATOM   4942  CD1 TYR B 286     107.070  -1.555 282.109  1.00 22.83           C
ATOM   4943  CD2 TYR B 286     109.258  -1.800 283.083  1.00 22.05           C
ATOM   4944  CE1 TYR B 286     107.479  -0.411 281.442  1.00 22.57           C
ATOM   4945  CE2 TYR B 286     109.681  -0.649 282.422  1.00 22.58           C
ATOM   4946  CZ  TYR B 286     108.792   0.049 281.612  1.00 23.68           C
ATOM   4947  OH  TYR B 286     109.221   1.180 280.924  1.00 24.98           O
ATOM   4948  N   PRO B 287     108.535  -5.869 281.929  1.00 24.46           N
ATOM   4949  CA  PRO B 287     109.296  -6.317 280.752  1.00 25.70           C
ATOM   4950  C   PRO B 287     108.439  -7.054 279.734  1.00 26.49           C
ATOM   4951  O   PRO B 287     108.654  -6.908 278.514  1.00 26.87           O
ATOM   4952  CB  PRO B 287     110.369  -7.238 281.350  1.00 25.47           C
ATOM   4953  CG  PRO B 287     110.519  -6.762 282.752  1.00 24.65           C
ATOM   4954  CD  PRO B 287     109.136  -6.371 283.174  1.00 24.50           C
ATOM   4955  N   ARG B 288     107.463  -7.823 280.216  1.00 26.86           N
ATOM   4956  CA  ARG B 288     106.601  -8.595 279.297  1.00 28.11           C
ATOM   4957  C   ARG B 288     105.719  -7.649 278.483  1.00 25.90           C
ATOM   4958  O   ARG B 288     105.605  -7.788 277.272  1.00 24.54           O
ATOM   4959  CB  ARG B 288     105.785  -9.641 280.067  1.00 30.22           C
ATOM   4960  CG  ARG B 288     106.688 -10.619 280.829  1.00 33.33           C
ATOM   4961  CD  ARG B 288     105.931 -11.758 281.504  1.00 36.80           C
ATOM   4962  NE  ARG B 288     106.656 -12.293 282.670  1.00 40.30           N
ATOM   4963  CZ  ARG B 288     106.115 -12.992 283.681  1.00 42.56           C
ATOM   4964  NH1 ARG B 288     104.816 -13.285 283.724  1.00 42.41           N
ATOM   4965  NH2 ARG B 288     106.888 -13.412 284.674  1.00 43.74           N
ATOM   4966  N   PHE B 289     105.136  -6.663 279.168  1.00 24.97           N
ATOM   4967  CA  PHE B 289     104.329  -5.629 278.544  1.00 24.55           C
ATOM   4968  C   PHE B 289     105.114  -4.953 277.412  1.00 25.89           C
ATOM   4969  O   PHE B 289     104.597  -4.769 276.307  1.00 23.95           O
ATOM   4970  CB  PHE B 289     103.891  -4.597 279.593  1.00 24.71           C
ATOM   4971  CG  PHE B 289     103.550  -3.265 279.015  1.00 24.73           C
ATOM   4972  CD1 PHE B 289     102.275  -3.000 278.559  1.00 26.05           C
ATOM   4973  CD2 PHE B 289     104.497  -2.286 278.913  1.00 25.95           C
ATOM   4974  CE1 PHE B 289     101.945  -1.776 278.024  1.00 25.96           C
ATOM   4975  CE2 PHE B 289     104.194  -1.051 278.350  1.00 27.25           C
```

Appendix 2

```
ATOM   4976  CZ   PHE B 289     102.915   -0.799 277.905  1.00 27.86           C
ATOM   4977  N    LYS B 290     106.368   -4.579 277.674  1.00 26.71           N
ATOM   4978  CA   LYS B 290     107.173   -3.960 276.620  1.00 27.27           C
ATOM   4979  C    LYS B 290     107.395   -4.892 275.398  1.00 27.79           C
ATOM   4980  O    LYS B 290     107.312   -4.462 274.242  1.00 27.71           O
ATOM   4981  CB   LYS B 290     108.498   -3.466 277.178  1.00 27.80           C
ATOM   4982  CG   LYS B 290     108.406   -2.129 277.895  1.00 28.87           C
ATOM   4983  CD   LYS B 290     109.547   -1.927 278.893  1.00 29.70           C
ATOM   4984  CE   LYS B 290     110.914   -1.996 278.241  1.00 31.54           C
ATOM   4985  NZ   LYS B 290     112.007   -1.844 279.232  1.00 31.35           N
ATOM   4986  N    GLN B 291     107.671   -6.166 275.624  1.00 29.27           N
ATOM   4987  CA   GLN B 291     107.903   -7.048 274.485  1.00 29.74           C
ATOM   4988  C    GLN B 291     106.614   -7.199 273.692  1.00 28.82           C
ATOM   4989  O    GLN B 291     106.613   -7.149 272.461  1.00 27.37           O
ATOM   4990  CB   GLN B 291     108.378   -8.396 274.960  1.00 32.38           C
ATOM   4991  CG   GLN B 291     108.859   -9.297 273.848  1.00 36.74           C
ATOM   4992  CD   GLN B 291     109.362  -10.599 274.407  1.00 41.43           C
ATOM   4993  OE1  GLN B 291     108.694  -11.220 275.238  1.00 45.17           O
ATOM   4994  NE2  GLN B 291     110.556  -11.007 273.992  1.00 43.52           N
ATOM   4995  N    THR B 292     105.505   -7.355 274.405  1.00 26.77           N
ATOM   4996  CA   THR B 292     104.218   -7.464 273.751  1.00 27.61           C
ATOM   4997  C    THR B 292     103.819   -6.260 272.876  1.00 27.21           C
ATOM   4998  O    THR B 292     103.394   -6.451 271.735  1.00 26.60           O
ATOM   4999  CB   THR B 292     103.115   -7.705 274.791  1.00 29.13           C
ATOM   5000  OG1  THR B 292     103.421   -8.892 275.525  1.00 31.33           O
ATOM   5001  CG2  THR B 292     101.762   -7.862 274.123  1.00 29.84           C
ATOM   5002  N    PHE B 293     103.939   -5.033 273.400  1.00 26.20           N
ATOM   5003  CA   PHE B 293     103.368   -3.852 272.728  1.00 26.52           C
ATOM   5004  C    PHE B 293     104.351   -2.859 272.112  1.00 27.31           C
ATOM   5005  O    PHE B 293     104.025   -2.224 271.123  1.00 28.35           O
ATOM   5006  CB   PHE B 293     102.486   -3.047 273.698  1.00 26.81           C
ATOM   5007  CG   PHE B 293     101.231   -3.757 274.140  1.00 26.23           C
ATOM   5008  CD1  PHE B 293     100.270   -4.144 273.218  1.00 26.49           C
ATOM   5009  CD2  PHE B 293     100.999   -4.003 275.477  1.00 26.18           C
ATOM   5010  CE1  PHE B 293      99.111   -4.786 273.617  1.00 26.50           C
ATOM   5011  CE2  PHE B 293      99.839   -4.638 275.892  1.00 27.87           C
ATOM   5012  CZ   PHE B 293      98.890   -5.039 274.958  1.00 26.86           C
ATOM   5013  N    VAL B 294     105.522   -2.677 272.702  1.00 27.62           N
ATOM   5014  CA   VAL B 294     106.374   -1.541 272.336  1.00 28.17           C
ATOM   5015  C    VAL B 294     107.238   -1.849 271.101  1.00 28.55           C
ATOM   5016  O    VAL B 294     107.881   -2.883 271.042  1.00 28.85           O
ATOM   5017  CB   VAL B 294     107.285   -1.130 273.514  1.00 28.60           C
ATOM   5018  CG1  VAL B 294     108.188    0.016 273.106  1.00 29.80           C
ATOM   5019  CG2  VAL B 294     106.459   -0.737 274.731  1.00 27.78           C
ATOM   5020  N    GLU B 295     107.208   -0.952 270.115  1.00 28.63           N
ATOM   5021  CA   GLU B 295     108.044   -1.023 268.928  1.00 27.53           C
ATOM   5022  C    GLU B 295     109.059    0.101 268.978  1.00 26.82           C
ATOM   5023  O    GLU B 295     108.698    1.281 268.943  1.00 25.38           O
ATOM   5024  CB   GLU B 295     107.230   -0.890 267.628  1.00 28.20           C
ATOM   5025  CG   GLU B 295     108.056   -1.252 266.383  1.00 28.54           C
ATOM   5026  CD   GLU B 295     107.755   -0.412 265.150  1.00 28.29           C
ATOM   5027  OE1  GLU B 295     106.697    0.249 265.127  1.00 26.89           O
ATOM   5028  OE2  GLU B 295     108.596   -0.409 264.209  1.00 28.57           O
ATOM   5029  N    VAL B 296     110.326   -0.291 269.061  1.00 26.65           N
```

Appendix 2

```
ATOM   5030  CA   VAL B 296     111.459   0.624 269.010  1.00 25.88           C
ATOM   5031  C    VAL B 296     111.768   0.802 267.554  1.00 24.85           C
ATOM   5032  O    VAL B 296     111.816  -0.183 266.850  1.00 26.52           O
ATOM   5033  CB   VAL B 296     112.691   0.033 269.739  1.00 25.59           C
ATOM   5034  CG1  VAL B 296     113.978   0.628 269.217  1.00 25.82           C
ATOM   5035  CG2  VAL B 296     112.576   0.270 271.242  1.00 25.53           C
ATOM   5036  N    TYR B 297     111.972   2.041 267.103  1.00 23.77           N
ATOM   5037  CA   TYR B 297     112.209   2.304 265.695  1.00 23.50           C
ATOM   5038  C    TYR B 297     113.228   3.431 265.475  1.00 24.00           C
ATOM   5039  O    TYR B 297     113.713   4.035 266.428  1.00 24.42           O
ATOM   5040  CB   TYR B 297     110.872   2.555 264.966  1.00 23.45           C
ATOM   5041  CG   TYR B 297     110.253   3.949 265.102  1.00 23.99           C
ATOM   5042  CD1  TYR B 297     110.532   4.965 264.176  1.00 23.02           C
ATOM   5043  CD2  TYR B 297     109.336   4.232 266.126  1.00 24.56           C
ATOM   5044  CE1  TYR B 297     109.936   6.216 264.283  1.00 23.37           C
ATOM   5045  CE2  TYR B 297     108.735   5.477 266.243  1.00 24.68           C
ATOM   5046  CZ   TYR B 297     109.036   6.477 265.328  1.00 24.95           C
ATOM   5047  OH   TYR B 297     108.418   7.721 265.476  1.00 24.57           O
ATOM   5048  N    ASP B 298     113.584   3.684 264.217  1.00 24.51           N
ATOM   5049  CA   ASP B 298     114.539   4.740 263.896  1.00 24.99           C
ATOM   5050  C    ASP B 298     115.855   4.530 264.642  1.00 24.95           C
ATOM   5051  O    ASP B 298     116.365   5.438 265.310  1.00 24.50           O
ATOM   5052  CB   ASP B 298     113.945   6.105 264.248  1.00 25.51           C
ATOM   5053  CG   ASP B 298     114.877   7.254 263.924  1.00 25.42           C
ATOM   5054  OD1  ASP B 298     115.630   7.158 262.938  1.00 23.37           O
ATOM   5055  OD2  ASP B 298     114.843   8.260 264.670  1.00 26.32           O
ATOM   5056  N    GLU B 299     116.385   3.315 264.517  1.00 25.66           N
ATOM   5057  CA   GLU B 299     117.672   2.940 265.092  1.00 25.22           C
ATOM   5058  C    GLU B 299     117.746   3.145 266.592  1.00 22.47           C
ATOM   5059  O    GLU B 299     118.780   3.520 267.108  1.00 21.48           O
ATOM   5060  CB   GLU B 299     118.814   3.730 264.439  1.00 27.43           C
ATOM   5061  CG   GLU B 299     118.806   3.730 262.925  1.00 29.56           C
ATOM   5062  CD   GLU B 299     120.085   4.324 262.364  1.00 31.95           C
ATOM   5063  OE1  GLU B 299     120.021   5.404 261.728  1.00 32.29           O
ATOM   5064  OE2  GLU B 299     121.159   3.720 262.589  1.00 33.54           O
ATOM   5065  N    GLY B 300     116.658   2.909 267.301  1.00 21.24           N
ATOM   5066  CA   GLY B 300     116.702   2.987 268.766  1.00 20.14           C
ATOM   5067  C    GLY B 300     116.445   4.358 269.361  1.00 19.31           C
ATOM   5068  O    GLY B 300     116.414   4.505 270.566  1.00 17.10           O
ATOM   5069  N    ARG B 301     116.257   5.361 268.520  1.00 20.72           N
ATOM   5070  CA   ARG B 301     115.996   6.717 269.004  1.00 22.78           C
ATOM   5071  C    ARG B 301     114.564   6.924 269.463  1.00 23.15           C
ATOM   5072  O    ARG B 301     114.344   7.742 270.340  1.00 23.06           O
ATOM   5073  CB   ARG B 301     116.327   7.763 267.933  1.00 23.80           C
ATOM   5074  CG   ARG B 301     117.804   8.128 267.858  1.00 24.73           C
ATOM   5075  CD   ARG B 301     118.030   9.160 266.764  1.00 26.47           C
ATOM   5076  NE   ARG B 301     117.756   8.604 265.422  1.00 28.18           N
ATOM   5077  CZ   ARG B 301     118.672   8.037 264.632  1.00 28.53           C
ATOM   5078  NH1  ARG B 301     119.945   7.959 265.019  1.00 27.99           N
ATOM   5079  NH2  ARG B 301     118.319   7.559 263.442  1.00 28.90           N
ATOM   5080  N    LYS B 302     113.607   6.196 268.866  1.00 23.94           N
ATOM   5081  CA   LYS B 302     112.167   6.386 269.149  1.00 24.09           C
ATOM   5082  C    LYS B 302     111.420   5.112 269.392  1.00 24.49           C
ATOM   5083  O    LYS B 302     111.875   4.032 269.047  1.00 24.11           O
```

Appendix 2

```
ATOM   5084  CB  LYS B 302     111.460   7.086 268.006  1.00 23.70           C
ATOM   5085  CG  LYS B 302     112.179   8.331 267.544  1.00 23.93           C
ATOM   5086  CD  LYS B 302     111.606   8.847 266.236  1.00 23.71           C
ATOM   5087  CE  LYS B 302     112.532   9.875 265.610  1.00 23.14           C
ATOM   5088  NZ  LYS B 302     111.719  11.025 265.210  1.00 23.11           N
ATOM   5089  N   ALA B 303     110.252   5.268 270.004  1.00 25.75           N
ATOM   5090  CA  ALA B 303     109.327   4.170 270.204  1.00 25.64           C
ATOM   5091  C   ALA B 303     107.887   4.650 270.077  1.00 25.70           C
ATOM   5092  O   ALA B 303     107.581   5.844 270.160  1.00 26.21           O
ATOM   5093  CB  ALA B 303     109.556   3.504 271.545  1.00 25.44           C
ATOM   5094  N   ARG B 304     107.014   3.661 269.985  1.00 25.87           N
ATOM   5095  CA  ARG B 304     105.709   3.755 269.383  1.00 25.66           C
ATOM   5096  C   ARG B 304     105.024   2.492 269.969  1.00 26.31           C
ATOM   5097  O   ARG B 304     105.640   1.415 269.995  1.00 23.95           O
ATOM   5098  CB  ARG B 304     105.979   3.650 267.887  1.00 27.01           C
ATOM   5099  CG  ARG B 304     104.830   3.577 266.934  1.00 28.34           C
ATOM   5100  CD  ARG B 304     105.236   3.991 265.511  1.00 28.55           C
ATOM   5101  NE  ARG B 304     105.996   2.987 264.755  1.00 27.56           N
ATOM   5102  CZ  ARG B 304     106.773   3.253 263.693  1.00 25.09           C
ATOM   5103  NH1 ARG B 304     106.944   4.486 263.273  1.00 23.48           N
ATOM   5104  NH2 ARG B 304     107.419   2.278 263.063  1.00 25.37           N
ATOM   5105  N   VAL B 305     103.814   2.624 270.525  1.00 25.42           N
ATOM   5106  CA  VAL B 305     103.181   1.503 271.222  1.00 24.23           C
ATOM   5107  C   VAL B 305     101.917   1.013 270.505  1.00 24.93           C
ATOM   5108  O   VAL B 305     101.016   1.806 270.175  1.00 25.94           O
ATOM   5109  CB  VAL B 305     102.856   1.845 272.678  1.00 24.99           C
ATOM   5110  CG1 VAL B 305     102.493   0.585 273.447  1.00 25.20           C
ATOM   5111  CG2 VAL B 305     104.053   2.501 273.348  1.00 26.52           C
ATOM   5112  N   ARG B 306     101.877  -0.292 270.231  1.00 23.85           N
ATOM   5113  CA  ARG B 306     100.689  -0.935 269.688  1.00 24.34           C
ATOM   5114  C   ARG B 306      99.596  -1.016 270.760  1.00 22.78           C
ATOM   5115  O   ARG B 306      99.903  -1.183 271.951  1.00 22.51           O
ATOM   5116  CB  ARG B 306     101.034  -2.327 269.203  1.00 25.95           C
ATOM   5117  CG  ARG B 306     102.048  -2.356 268.079  1.00 26.41           C
ATOM   5118  CD  ARG B 306     102.289  -3.799 267.696  1.00 28.01           C
ATOM   5119  NE  ARG B 306     103.079  -4.482 268.701  1.00 28.36           N
ATOM   5120  CZ  ARG B 306     104.405  -4.534 268.688  1.00 29.78           C
ATOM   5121  NH1 ARG B 306     105.089  -3.936 267.710  1.00 30.54           N
ATOM   5122  NH2 ARG B 306     105.056  -5.184 269.654  1.00 29.58           N
ATOM   5123  N   GLU B 307      98.331  -0.842 270.368  1.00 21.07           N
ATOM   5124  CA  GLU B 307      97.245  -0.810 271.375  1.00 21.46           C
ATOM   5125  C   GLU B 307      96.739  -2.210 271.717  1.00 19.61           C
ATOM   5126  O   GLU B 307      96.289  -2.434 272.812  1.00 16.81           O
ATOM   5127  CB  GLU B 307      96.108   0.153 270.973  1.00 21.79           C
ATOM   5128  CG  GLU B 307      94.770   0.005 271.724  1.00 22.45           C
ATOM   5129  CD  GLU B 307      94.823   0.081 273.248  1.00 24.43           C
ATOM   5130  OE1 GLU B 307      95.755   0.689 273.850  1.00 25.71           O
ATOM   5131  OE2 GLU B 307      93.897  -0.487 273.863  1.00 26.09           O
ATOM   5132  N   THR B 308      96.918  -3.148 270.793  1.00 21.08           N
ATOM   5133  CA  THR B 308      96.360  -4.514 270.902  1.00 22.50           C
ATOM   5134  C   THR B 308      97.161  -5.497 270.007  1.00 23.54           C
ATOM   5135  O   THR B 308      98.060  -5.074 269.293  1.00 23.17           O
ATOM   5136  CB  THR B 308      94.857  -4.497 270.524  1.00 21.16           C
ATOM   5137  OG1 THR B 308      94.260  -5.717 270.911  1.00 21.51           O
```

Appendix 2

```
ATOM   5138  CG2 THR B 308      94.650  -4.273 269.024  1.00 20.65           C
ATOM   5139  N   ALA B 309      96.779  -6.771 269.983  1.00 26.06           N
ATOM   5140  CA  ALA B 309      97.716  -7.855 269.665  1.00 26.70           C
ATOM   5141  C   ALA B 309      97.885  -8.364 268.220  1.00 30.37           C
ATOM   5142  O   ALA B 309      98.954  -8.917 267.899  1.00 35.89           O
ATOM   5143  CB  ALA B 309      97.410  -9.027 270.560  1.00 25.85           C
ATOM   5144  N   GLY B 310      96.888  -8.268 267.346  1.00 28.97           N
ATOM   5145  CA  GLY B 310      97.098  -8.852 266.005  1.00 28.15           C
ATOM   5146  C   GLY B 310      97.422  -7.821 264.949  1.00 27.64           C
ATOM   5147  O   GLY B 310      96.769  -7.770 263.918  1.00 28.27           O
ATOM   5148  N   THR B 311      98.404  -6.975 265.204  1.00 27.37           N
ATOM   5149  CA  THR B 311      98.542  -5.741 264.433  1.00 27.93           C
ATOM   5150  C   THR B 311      99.916  -5.131 264.596  1.00 29.61           C
ATOM   5151  O   THR B 311     100.522  -5.234 265.658  1.00 29.94           O
ATOM   5152  CB  THR B 311      97.484  -4.695 264.883  1.00 28.33           C
ATOM   5153  OG1 THR B 311      97.500  -3.557 264.019  1.00 27.57           O
ATOM   5154  CG2 THR B 311      97.752  -4.214 266.260  1.00 28.97           C
ATOM   5155  N   ASP B 312     100.407  -4.498 263.537  1.00 32.83           N
ATOM   5156  CA  ASP B 312     101.619  -3.689 263.606  1.00 33.12           C
ATOM   5157  C   ASP B 312     101.271  -2.189 263.663  1.00 33.58           C
ATOM   5158  O   ASP B 312     102.152  -1.343 263.558  1.00 35.08           O
ATOM   5159  CB  ASP B 312     102.493  -3.958 262.384  1.00 34.03           C
ATOM   5160  CG  ASP B 312     102.948  -5.410 262.279  1.00 35.16           C
ATOM   5161  OD1 ASP B 312     103.208  -6.076 263.300  1.00 33.92           O
ATOM   5162  OD2 ASP B 312     103.060  -5.881 261.137  1.00 37.21           O
ATOM   5163  N   ASP B 313      99.994  -1.847 263.800  1.00 32.18           N
ATOM   5164  CA  ASP B 313      99.594  -0.436 263.867  1.00 31.81           C
ATOM   5165  C   ASP B 313      99.791   0.081 265.301  1.00 30.83           C
ATOM   5166  O   ASP B 313      99.547  -0.630 266.268  1.00 33.27           O
ATOM   5167  CB  ASP B 313      98.134  -0.220 263.401  1.00 32.06           C
ATOM   5168  CG  ASP B 313      97.889  -0.655 261.930  1.00 32.06           C
ATOM   5169  OD1 ASP B 313      98.639  -0.230 261.022  1.00 31.48           O
ATOM   5170  OD2 ASP B 313      96.921  -1.409 261.683  1.00 30.97           O
ATOM   5171  N   ALA B 314     100.259   1.317 265.425  1.00 28.18           N
ATOM   5172  CA  ALA B 314     100.505   1.943 266.719  1.00 26.95           C
ATOM   5173  C   ALA B 314      99.358   2.868 267.080  1.00 24.86           C
ATOM   5174  O   ALA B 314      98.790   3.493 266.215  1.00 23.31           O
ATOM   5175  CB  ALA B 314     101.793   2.750 266.667  1.00 27.07           C
ATOM   5176  N   ASP B 315      99.044   2.964 268.367  1.00 24.35           N
ATOM   5177  CA  ASP B 315      98.063   3.919 268.861  1.00 24.66           C
ATOM   5178  C   ASP B 315      96.681   3.795 268.215  1.00 24.45           C
ATOM   5179  O   ASP B 315      96.040   4.799 267.898  1.00 24.35           O
ATOM   5180  CB  ASP B 315      98.637   5.331 268.728  1.00 24.67           C
ATOM   5181  CG  ASP B 315      99.788   5.559 269.688  1.00 26.02           C
ATOM   5182  OD1 ASP B 315      99.565   5.489 270.919  1.00 26.76           O
ATOM   5183  OD2 ASP B 315     100.925   5.780 269.218  1.00 28.99           O
ATOM   5184  N   GLY B 316      96.229   2.555 268.006  1.00 23.59           N
ATOM   5185  CA  GLY B 316      94.812   2.299 267.684  1.00 22.43           C
ATOM   5186  C   GLY B 316      93.918   2.517 268.881  1.00 21.89           C
ATOM   5187  O   GLY B 316      94.375   2.911 269.955  1.00 21.39           O
ATOM   5188  N   GLY B 317      92.633   2.259 268.709  1.00 23.24           N
ATOM   5189  CA  GLY B 317      91.670   2.431 269.796  1.00 23.50           C
ATOM   5190  C   GLY B 317      91.553   3.899 270.177  1.00 24.19           C
ATOM   5191  O   GLY B 317      91.455   4.749 269.294  1.00 21.99           O
```

Appendix 2

```
ATOM   5192  N   VAL B 318      91.596   4.201 271.480  1.00 24.03           N
ATOM   5193  CA  VAL B 318      91.546   5.596 271.937  1.00 25.23           C
ATOM   5194  C   VAL B 318      92.797   6.416 271.587  1.00 26.02           C
ATOM   5195  O   VAL B 318      92.811   7.629 271.742  1.00 27.31           O
ATOM   5196  CB  VAL B 318      91.249   5.687 273.451  1.00 25.91           C
ATOM   5197  CG1 VAL B 318      89.855   5.149 273.730  1.00 27.39           C
ATOM   5198  CG2 VAL B 318      92.263   4.899 274.285  1.00 26.13           C
ATOM   5199  N   GLY B 319      93.855   5.768 271.125  1.00 26.63           N
ATOM   5200  CA  GLY B 319      95.044   6.489 270.659  1.00 26.46           C
ATOM   5201  C   GLY B 319      95.918   6.955 271.795  1.00 26.95           C
ATOM   5202  O   GLY B 319      96.618   7.955 271.652  1.00 29.31           O
ATOM   5203  N   LEU B 320      95.897   6.232 272.914  1.00 25.95           N
ATOM   5204  CA  LEU B 320      96.598   6.678 274.122  1.00 27.41           C
ATOM   5205  C   LEU B 320      97.649   5.711 274.650  1.00 27.56           C
ATOM   5206  O   LEU B 320      98.234   5.948 275.701  1.00 29.17           O
ATOM   5207  CB  LEU B 320      95.582   6.987 275.233  1.00 26.93           C
ATOM   5208  CG  LEU B 320      94.604   8.110 274.907  1.00 27.32           C
ATOM   5209  CD1 LEU B 320      93.652   8.361 276.058  1.00 27.85           C
ATOM   5210  CD2 LEU B 320      95.353   9.390 274.557  1.00 28.49           C
ATOM   5211  N   ALA B 321      97.916   4.638 273.921  1.00 29.00           N
ATOM   5212  CA  ALA B 321      98.928   3.644 274.338  1.00 28.50           C
ATOM   5213  C   ALA B 321     100.308   4.248 274.560  1.00 27.08           C
ATOM   5214  O   ALA B 321     100.918   4.061 275.617  1.00 27.40           O
ATOM   5215  CB  ALA B 321      99.021   2.546 273.300  1.00 28.38           C
ATOM   5216  N   SER B 322     100.791   4.979 273.560  1.00 25.05           N
ATOM   5217  CA  SER B 322     102.096   5.622 273.652  1.00 23.63           C
ATOM   5218  C   SER B 322     102.119   6.665 274.776  1.00 24.03           C
ATOM   5219  O   SER B 322     103.040   6.653 275.608  1.00 22.94           O
ATOM   5220  CB  SER B 322     102.490   6.244 272.311  1.00 23.09           C
ATOM   5221  OG  SER B 322     102.596   5.259 271.284  1.00 21.33           O
ATOM   5222  N   ALA B 323     101.113   7.548 274.823  1.00 24.11           N
ATOM   5223  CA  ALA B 323     101.053   8.558 275.907  1.00 24.63           C
ATOM   5224  C   ALA B 323     101.082   7.965 277.336  1.00 24.30           C
ATOM   5225  O   ALA B 323     101.825   8.458 278.193  1.00 24.46           O
ATOM   5226  CB  ALA B 323      99.840   9.457 275.746  1.00 24.81           C
ATOM   5227  N   PHE B 324     100.278   6.926 277.595  1.00 23.79           N
ATOM   5228  CA  PHE B 324     100.258   6.259 278.921  1.00 23.01           C
ATOM   5229  C   PHE B 324     101.500   5.419 279.222  1.00 22.25           C
ATOM   5230  O   PHE B 324     101.924   5.294 280.349  1.00 23.58           O
ATOM   5231  CB  PHE B 324      99.041   5.364 279.051  1.00 23.11           C
ATOM   5232  CG  PHE B 324      97.832   6.074 279.532  1.00 23.44           C
ATOM   5233  CD1 PHE B 324      97.791   6.590 280.802  1.00 23.55           C
ATOM   5234  CD2 PHE B 324      96.738   6.218 278.732  1.00 23.54           C
ATOM   5235  CE1 PHE B 324      96.685   7.270 281.260  1.00 23.99           C
ATOM   5236  CE2 PHE B 324      95.622   6.899 279.182  1.00 23.58           C
ATOM   5237  CZ  PHE B 324      95.595   7.422 280.449  1.00 23.34           C
ATOM   5238  N   THR B 325     102.055   4.811 278.200  1.00 21.84           N
ATOM   5239  CA  THR B 325     103.347   4.161 278.313  1.00 22.17           C
ATOM   5240  C   THR B 325     104.483   5.131 278.692  1.00 20.61           C
ATOM   5241  O   THR B 325     105.364   4.791 279.478  1.00 20.23           O
ATOM   5242  CB  THR B 325     103.641   3.414 277.004  1.00 22.14           C
ATOM   5243  OG1 THR B 325     102.526   2.541 276.740  1.00 21.54           O
ATOM   5244  CG2 THR B 325     104.887   2.598 277.126  1.00 22.32           C
ATOM   5245  N   LEU B 326     104.441   6.344 278.181  1.00 20.03           N
```

Appendix 2

```
ATOM   5246  CA   LEU B 326     105.348   7.381 278.675  1.00 20.93           C
ATOM   5247  C    LEU B 326     105.283   7.546 280.195  1.00 20.95           C
ATOM   5248  O    LEU B 326     106.317   7.517 280.884  1.00 21.06           O
ATOM   5249  CB   LEU B 326     105.035   8.717 278.046  1.00 21.78           C
ATOM   5250  CG   LEU B 326     106.060   9.802 278.317  1.00 22.44           C
ATOM   5251  CD1  LEU B 326     107.371   9.391 277.671  1.00 22.91           C
ATOM   5252  CD2  LEU B 326     105.567  11.124 277.737  1.00 22.49           C
ATOM   5253  N    LEU B 327     104.075   7.736 280.715  1.00 20.89           N
ATOM   5254  CA   LEU B 327     103.886   7.785 282.161  1.00 20.46           C
ATOM   5255  C    LEU B 327     104.386   6.505 282.804  1.00 19.88           C
ATOM   5256  O    LEU B 327     105.087   6.565 283.782  1.00 19.07           O
ATOM   5257  CB   LEU B 327     102.432   8.018 282.490  1.00 21.87           C
ATOM   5258  CG   LEU B 327     101.972   7.770 283.917  1.00 22.47           C
ATOM   5259  CD1  LEU B 327     102.524   8.857 284.808  1.00 21.84           C
ATOM   5260  CD2  LEU B 327     100.438   7.788 283.904  1.00 23.46           C
ATOM   5261  N    LEU B 328     104.087   5.339 282.244  1.00 19.71           N
ATOM   5262  CA   LEU B 328     104.581   4.121 282.871  1.00 19.76           C
ATOM   5263  C    LEU B 328     106.113   4.098 282.944  1.00 19.94           C
ATOM   5264  O    LEU B 328     106.685   3.814 284.003  1.00 19.83           O
ATOM   5265  CB   LEU B 328     104.061   2.869 282.179  1.00 19.53           C
ATOM   5266  CG   LEU B 328     104.496   1.573 282.863  1.00 19.41           C
ATOM   5267  CD1  LEU B 328     104.001   1.510 284.292  1.00 19.70           C
ATOM   5268  CD2  LEU B 328     104.002   0.361 282.117  1.00 20.03           C
ATOM   5269  N    ALA B 329     106.782   4.398 281.838  1.00 20.58           N
ATOM   5270  CA   ALA B 329     108.273   4.513 281.849  1.00 21.26           C
ATOM   5271  C    ALA B 329     108.765   5.442 282.973  1.00 21.38           C
ATOM   5272  O    ALA B 329     109.706   5.124 283.692  1.00 22.01           O
ATOM   5273  CB   ALA B 329     108.787   5.026 280.513  1.00 20.82           C
ATOM   5274  N    ARG B 330     108.116   6.589 283.106  1.00 21.24           N
ATOM   5275  CA   ARG B 330     108.458   7.527 284.144  1.00 22.05           C
ATOM   5276  C    ARG B 330     108.345   6.876 285.516  1.00 22.53           C
ATOM   5277  O    ARG B 330     109.287   6.919 286.304  1.00 23.72           O
ATOM   5278  CB   ARG B 330     107.548   8.750 284.073  1.00 22.15           C
ATOM   5279  CG   ARG B 330     108.020   9.923 284.920  1.00 22.41           C
ATOM   5280  CD   ARG B 330     109.384  10.391 284.496  1.00 22.08           C
ATOM   5281  NE   ARG B 330     109.526  11.792 284.802  1.00 22.31           N
ATOM   5282  CZ   ARG B 330     110.194  12.285 285.833  1.00 22.32           C
ATOM   5283  NH1  ARG B 330     110.836  11.501 286.684  1.00 21.74           N
ATOM   5284  NH2  ARG B 330     110.237  13.593 285.983  1.00 22.64           N
ATOM   5285  N    GLU B 331     107.194   6.257 285.771  1.00 22.69           N
ATOM   5286  CA   GLU B 331     106.911   5.560 287.007  1.00 21.27           C
ATOM   5287  C    GLU B 331     107.918   4.481 287.244  1.00 21.12           C
ATOM   5288  O    GLU B 331     108.335   4.311 288.347  1.00 20.80           O
ATOM   5289  CB   GLU B 331     105.519   4.925 286.945  1.00 22.46           C
ATOM   5290  CG   GLU B 331     105.133   4.059 288.157  1.00 22.58           C
ATOM   5291  CD   GLU B 331     104.968   4.871 289.405  1.00 22.85           C
ATOM   5292  OE1  GLU B 331     104.426   6.002 289.313  1.00 22.16           O
ATOM   5293  OE2  GLU B 331     105.376   4.359 290.467  1.00 24.06           O
ATOM   5294  N    MET B 332     108.295   3.731 286.215  1.00 22.34           N
ATOM   5295  CA   MET B 332     109.227   2.600 286.401  1.00 23.12           C
ATOM   5296  C    MET B 332     110.701   2.962 286.408  1.00 22.19           C
ATOM   5297  O    MET B 332     111.530   2.088 286.574  1.00 20.98           O
ATOM   5298  CB   MET B 332     109.021   1.511 285.339  1.00 23.47           C
ATOM   5299  CG   MET B 332     107.613   0.954 285.287  1.00 24.65           C
```

Appendix 2

```
ATOM   5300  SD  MET B 332     106.988   0.365 286.861  1.00 24.60           S
ATOM   5301  CE  MET B 332     107.999  -1.084 287.115  1.00 26.36           C
ATOM   5302  N   GLY B 333     111.040   4.229 286.240  1.00 22.48           N
ATOM   5303  CA  GLY B 333     112.454   4.615 286.156  1.00 23.17           C
ATOM   5304  C   GLY B 333     113.144   4.378 284.810  1.00 23.12           C
ATOM   5305  O   GLY B 333     114.285   4.700 284.664  1.00 23.59           O
ATOM   5306  N   ASP B 334     112.441   3.875 283.813  1.00 24.59           N
ATOM   5307  CA  ASP B 334     113.029   3.536 282.524  1.00 25.12           C
ATOM   5308  C   ASP B 334     113.237   4.778 281.656  1.00 27.06           C
ATOM   5309  O   ASP B 334     112.361   5.136 280.852  1.00 26.91           O
ATOM   5310  CB  ASP B 334     112.054   2.600 281.845  1.00 26.65           C
ATOM   5311  CG  ASP B 334     112.572   1.990 280.585  1.00 26.83           C
ATOM   5312  OD1 ASP B 334     113.644   2.380 280.081  1.00 27.99           O
ATOM   5313  OD2 ASP B 334     111.859   1.080 280.110  1.00 26.99           O
ATOM   5314  N   GLN B 335     114.407   5.415 281.801  1.00 26.92           N
ATOM   5315  CA  GLN B 335     114.751   6.617 281.043  1.00 26.29           C
ATOM   5316  C   GLN B 335     114.874   6.386 279.566  1.00 26.07           C
ATOM   5317  O   GLN B 335     114.626   7.318 278.784  1.00 25.08           O
ATOM   5318  CB  GLN B 335     116.086   7.183 281.480  1.00 27.37           C
ATOM   5319  CG  GLN B 335     116.056   7.763 282.862  1.00 29.47           C
ATOM   5320  CD  GLN B 335     117.253   8.634 283.164  1.00 31.42           C
ATOM   5321  OE1 GLN B 335     117.935   9.152 282.266  1.00 31.26           O
ATOM   5322  NE2 GLN B 335     117.510   8.812 284.449  1.00 32.87           N
ATOM   5323  N   GLN B 336     115.317   5.189 279.174  1.00 25.23           N
ATOM   5324  CA  GLN B 336     115.576   4.923 277.749  1.00 25.17           C
ATOM   5325  C   GLN B 336     114.241   4.888 277.025  1.00 22.57           C
ATOM   5326  O   GLN B 336     114.064   5.569 276.029  1.00 22.21           O
ATOM   5327  CB  GLN B 336     116.391   3.626 277.498  1.00 26.53           C
ATOM   5328  CG  GLN B 336     116.379   3.184 276.026  1.00 28.12           C
ATOM   5329  CD  GLN B 336     117.436   2.140 275.649  1.00 30.26           C
ATOM   5330  OE1 GLN B 336     118.448   2.467 275.007  1.00 31.09           O
ATOM   5331  NE2 GLN B 336     117.191   0.878 276.008  1.00 29.93           N
ATOM   5332  N   LEU B 337     113.292   4.117 277.535  1.00 20.73           N
ATOM   5333  CA  LEU B 337     111.954   4.098 276.917  1.00 20.24           C
ATOM   5334  C   LEU B 337     111.230   5.447 277.051  1.00 19.20           C
ATOM   5335  O   LEU B 337     110.604   5.903 276.108  1.00 17.55           O
ATOM   5336  CB  LEU B 337     111.089   2.965 277.478  1.00 19.88           C
ATOM   5337  CG  LEU B 337     109.759   2.822 276.748  1.00 19.66           C
ATOM   5338  CD1 LEU B 337     109.938   2.620 275.253  1.00 19.28           C
ATOM   5339  CD2 LEU B 337     108.988   1.689 277.368  1.00 20.21           C
ATOM   5340  N   PHE B 338     111.348   6.103 278.196  1.00 19.10           N
ATOM   5341  CA  PHE B 338     110.837   7.459 278.276  1.00 20.70           C
ATOM   5342  C   PHE B 338     111.348   8.334 277.128  1.00 21.20           C
ATOM   5343  O   PHE B 338     110.563   8.955 276.430  1.00 22.00           O
ATOM   5344  CB  PHE B 338     111.177   8.090 279.602  1.00 21.31           C
ATOM   5345  CG  PHE B 338     110.606   9.466 279.786  1.00 21.87           C
ATOM   5346  CD1 PHE B 338     111.279  10.585 279.308  1.00 23.29           C
ATOM   5347  CD2 PHE B 338     109.422   9.650 280.471  1.00 21.64           C
ATOM   5348  CE1 PHE B 338     110.754  11.862 279.495  1.00 23.25           C
ATOM   5349  CE2 PHE B 338     108.911  10.913 280.676  1.00 21.66           C
ATOM   5350  CZ  PHE B 338     109.565  12.016 280.181  1.00 21.94           C
ATOM   5351  N   ASP B 339     112.655   8.373 276.915  1.00 22.24           N
ATOM   5352  CA  ASP B 339     113.236   9.262 275.891  1.00 22.69           C
ATOM   5353  C   ASP B 339     112.730   8.858 274.499  1.00 23.24           C
```

Appendix 2

```
ATOM   5354  O    ASP B 339     112.464   9.705 273.642  1.00 23.60           O
ATOM   5355  CB   ASP B 339     114.777   9.226 275.928  1.00 21.85           C
ATOM   5356  CG   ASP B 339     115.409  10.307 275.078  1.00 22.67           C
ATOM   5357  OD1  ASP B 339     115.355  11.498 275.468  1.00 23.80           O
ATOM   5358  OD2  ASP B 339     115.955   9.986 274.012  1.00 22.00           O
ATOM   5359  N    GLN B 340     112.591   7.559 274.277  1.00 23.24           N
ATOM   5360  CA   GLN B 340     112.194   7.075 272.957  1.00 23.81           C
ATOM   5361  C    GLN B 340     110.781   7.497 272.645  1.00 23.52           C
ATOM   5362  O    GLN B 340     110.516   8.060 271.575  1.00 23.20           O
ATOM   5363  CB   GLN B 340     112.326   5.551 272.877  1.00 23.94           C
ATOM   5364  CG   GLN B 340     113.779   5.101 272.908  1.00 23.26           C
ATOM   5365  CD   GLN B 340     113.932   3.635 273.202  1.00 22.52           C
ATOM   5366  OE1  GLN B 340     113.171   3.047 273.992  1.00 23.20           O
ATOM   5367  NE2  GLN B 340     114.905   3.022 272.551  1.00 20.82           N
ATOM   5368  N    LEU B 341     109.883   7.249 273.600  1.00 23.39           N
ATOM   5369  CA   LEU B 341     108.473   7.579 273.427  1.00 22.97           C
ATOM   5370  C    LEU B 341     108.330   9.073 273.231  1.00 23.16           C
ATOM   5371  O    LEU B 341     107.676   9.523 272.294  1.00 26.25           O
ATOM   5372  CB   LEU B 341     107.655   7.117 274.622  1.00 22.79           C
ATOM   5373  CG   LEU B 341     107.486   5.602 274.784  1.00 23.14           C
ATOM   5374  CD1  LEU B 341     107.030   5.249 276.196  1.00 22.52           C
ATOM   5375  CD2  LEU B 341     106.534   5.061 273.723  1.00 23.56           C
ATOM   5376  N    LEU B 342     108.981   9.853 274.077  1.00 22.50           N
ATOM   5377  CA   LEU B 342     108.882  11.311 273.963  1.00 22.14           C
ATOM   5378  C    LEU B 342     109.400  11.861 272.593  1.00 22.25           C
ATOM   5379  O    LEU B 342     108.872  12.856 272.080  1.00 21.76           O
ATOM   5380  CB   LEU B 342     109.575  11.989 275.152  1.00 21.28           C
ATOM   5381  CG   LEU B 342     109.211  13.459 275.363  1.00 21.63           C
ATOM   5382  CD1  LEU B 342     107.696  13.688 275.353  1.00 20.84           C
ATOM   5383  CD2  LEU B 342     109.840  13.987 276.654  1.00 21.77           C
ATOM   5384  N    ASN B 343     110.389  11.185 272.001  1.00 22.22           N
ATOM   5385  CA   ASN B 343     110.922  11.543 270.689  1.00 22.22           C
ATOM   5386  C    ASN B 343     109.954  11.261 269.563  1.00 22.64           C
ATOM   5387  O    ASN B 343     109.986  11.930 268.536  1.00 22.60           O
ATOM   5388  CB   ASN B 343     112.251  10.818 270.433  1.00 23.10           C
ATOM   5389  CG   ASN B 343     113.403  11.441 271.202  1.00 24.31           C
ATOM   5390  OD1  ASN B 343     113.249  12.521 271.795  1.00 26.78           O
ATOM   5391  ND2  ASN B 343     114.553  10.772 271.214  1.00 22.83           N
ATOM   5392  N    HIS B 344     109.110  10.248 269.751  1.00 23.21           N
ATOM   5393  CA   HIS B 344     108.037   9.956 268.826  1.00 22.71           C
ATOM   5394  C    HIS B 344     106.887  10.957 269.028  1.00 22.30           C
ATOM   5395  O    HIS B 344     106.287  11.415 268.049  1.00 22.86           O
ATOM   5396  CB   HIS B 344     107.548   8.506 269.053  1.00 24.34           C
ATOM   5397  CG   HIS B 344     106.242   8.176 268.389  1.00 24.54           C
ATOM   5398  ND1  HIS B 344     106.117   8.017 267.024  1.00 25.27           N
ATOM   5399  CD2  HIS B 344     105.010   7.962 268.907  1.00 24.26           C
ATOM   5400  CE1  HIS B 344     104.856   7.750 266.727  1.00 24.73           C
ATOM   5401  NE2  HIS B 344     104.166   7.697 267.853  1.00 25.06           N
ATOM   5402  N    LEU B 345     106.569  11.289 270.281  1.00 21.42           N
ATOM   5403  CA   LEU B 345     105.318  11.998 270.585  1.00 21.59           C
ATOM   5404  C    LEU B 345     105.380  13.528 270.447  1.00 21.69           C
ATOM   5405  O    LEU B 345     104.424  14.141 269.934  1.00 21.39           O
ATOM   5406  CB   LEU B 345     104.835  11.658 271.998  1.00 22.27           C
ATOM   5407  CG   LEU B 345     104.140  10.310 272.204  1.00 21.98           C
```

Appendix 2

```
ATOM   5408  CD1 LEU B 345     103.957  10.017 273.682  1.00 21.70           C
ATOM   5409  CD2 LEU B 345     102.811  10.285 271.500  1.00 21.76           C
ATOM   5410  N   GLU B 346     106.480  14.141 270.894  1.00 20.92           N
ATOM   5411  CA  GLU B 346     106.537  15.588 270.997  1.00 20.75           C
ATOM   5412  C   GLU B 346     106.865  16.336 269.710  1.00 21.43           C
ATOM   5413  O   GLU B 346     106.235  17.353 269.411  1.00 22.31           O
ATOM   5414  CB  GLU B 346     107.474  16.019 272.127  1.00 21.76           C
ATOM   5415  CG  GLU B 346     107.223  17.457 272.585  1.00 22.55           C
ATOM   5416  CD  GLU B 346     108.135  17.913 273.707  1.00 24.35           C
ATOM   5417  OE1 GLU B 346     109.374  17.845 273.539  1.00 26.74           O
ATOM   5418  OE2 GLU B 346     107.623  18.378 274.753  1.00 25.08           O
ATOM   5419  N   PRO B 347     107.856  15.880 268.942  1.00 22.21           N
ATOM   5420  CA  PRO B 347     108.210  16.770 267.825  1.00 22.49           C
ATOM   5421  C   PRO B 347     107.134  16.951 266.767  1.00 22.27           C
ATOM   5422  O   PRO B 347     106.942  18.069 266.309  1.00 23.54           O
ATOM   5423  CB  PRO B 347     109.479  16.129 267.239  1.00 22.30           C
ATOM   5424  CG  PRO B 347     110.093  15.433 268.412  1.00 22.81           C
ATOM   5425  CD  PRO B 347     108.903  14.872 269.175  1.00 23.23           C
ATOM   5426  N   PRO B 348     106.438  15.877 266.368  1.00 21.73           N
ATOM   5427  CA  PRO B 348     105.370  16.144 265.390  1.00 22.94           C
ATOM   5428  C   PRO B 348     104.216  16.993 265.966  1.00 23.28           C
ATOM   5429  O   PRO B 348     103.447  17.580 265.212  1.00 22.90           O
ATOM   5430  CB  PRO B 348     104.873  14.751 264.975  1.00 21.94           C
ATOM   5431  CG  PRO B 348     105.545  13.778 265.856  1.00 21.60           C
ATOM   5432  CD  PRO B 348     106.672  14.443 266.580  1.00 21.45           C
ATOM   5433  N   ALA B 349     104.113  17.073 267.286  1.00 22.42           N
ATOM   5434  CA  ALA B 349     103.139  17.947 267.881  1.00 22.37           C
ATOM   5435  C   ALA B 349     103.523  19.429 267.765  1.00 22.24           C
ATOM   5436  O   ALA B 349     102.704  20.309 268.076  1.00 21.97           O
ATOM   5437  CB  ALA B 349     102.912  17.547 269.326  1.00 22.99           C
ATOM   5438  N   LYS B 350     104.760  19.696 267.338  1.00 22.68           N
ATOM   5439  CA  LYS B 350     105.259  21.065 267.067  1.00 23.40           C
ATOM   5440  C   LYS B 350     104.993  22.011 268.244  1.00 23.14           C
ATOM   5441  O   LYS B 350     104.135  22.878 268.159  1.00 25.36           O
ATOM   5442  CB  LYS B 350     104.646  21.627 265.755  1.00 23.40           C
ATOM   5443  N   PRO B 351     105.696  21.818 269.365  1.00 21.93           N
ATOM   5444  CA  PRO B 351     105.520  22.736 270.477  1.00 21.41           C
ATOM   5445  C   PRO B 351     106.093  24.083 270.157  1.00 22.31           C
ATOM   5446  O   PRO B 351     107.045  24.167 269.397  1.00 22.03           O
ATOM   5447  CB  PRO B 351     106.381  22.117 271.586  1.00 20.99           C
ATOM   5448  CG  PRO B 351     107.381  21.310 270.874  1.00 20.57           C
ATOM   5449  CD  PRO B 351     106.667  20.759 269.683  1.00 21.10           C
ATOM   5450  N   SER B 352     105.558  25.136 270.751  1.00 24.48           N
ATOM   5451  CA  SER B 352     106.255  26.419 270.715  1.00 26.14           C
ATOM   5452  C   SER B 352     106.045  27.140 272.020  1.00 25.68           C
ATOM   5453  O   SER B 352     105.181  26.779 272.806  1.00 25.85           O
ATOM   5454  CB  SER B 352     105.771  27.280 269.549  1.00 27.67           C
ATOM   5455  OG  SER B 352     104.360  27.292 269.547  1.00 31.01           O
ATOM   5456  N   ILE B 353     106.848  28.172 272.235  1.00 25.87           N
ATOM   5457  CA  ILE B 353     106.753  28.964 273.424  1.00 25.39           C
ATOM   5458  C   ILE B 353     106.561  30.430 273.043  1.00 25.85           C
ATOM   5459  O   ILE B 353     107.490  31.104 272.560  1.00 27.16           O
ATOM   5460  CB  ILE B 353     107.951  28.674 274.350  1.00 25.23           C
ATOM   5461  CG1 ILE B 353     107.783  27.254 274.905  1.00 25.91           C
```

Appendix 2

```
ATOM   5462  CG2 ILE B 353     108.011  29.659 275.502  1.00 25.08           C
ATOM   5463  CD1 ILE B 353     108.944  26.741 275.717  1.00 26.49           C
ATOM   5464  N   VAL B 354     105.326  30.904 273.251  1.00 24.62           N
ATOM   5465  CA  VAL B 354     104.966  32.296 273.025  1.00 23.71           C
ATOM   5466  C   VAL B 354     104.603  32.968 274.343  1.00 22.37           C
ATOM   5467  O   VAL B 354     103.874  32.431 275.163  1.00 21.45           O
ATOM   5468  CB  VAL B 354     103.828  32.434 272.000  1.00 25.27           C
ATOM   5469  CG1 VAL B 354     103.508  33.921 271.719  1.00 25.87           C
ATOM   5470  CG2 VAL B 354     104.218  31.703 270.713  1.00 24.56           C
ATOM   5471  N   SER B 355     105.167  34.151 274.534  1.00 21.58           N
ATOM   5472  CA  SER B 355     105.055  34.898 275.765  1.00 21.37           C
ATOM   5473  C   SER B 355     105.246  34.044 277.013  1.00 20.31           C
ATOM   5474  O   SER B 355     104.554  34.228 278.001  1.00 20.33           O
ATOM   5475  CB  SER B 355     103.725  35.646 275.810  1.00 21.92           C
ATOM   5476  OG  SER B 355     103.804  36.719 276.730  1.00 22.83           O
ATOM   5477  N   ALA B 356     106.212  33.129 276.965  1.00 19.48           N
ATOM   5478  CA  ALA B 356     106.509  32.215 278.090  1.00 18.79           C
ATOM   5479  C   ALA B 356     105.406  31.174 278.428  1.00 18.11           C
ATOM   5480  O   ALA B 356     105.347  30.656 279.536  1.00 17.29           O
ATOM   5481  CB  ALA B 356     106.882  33.013 279.327  1.00 18.59           C
ATOM   5482  N   SER B 357     104.573  30.848 277.454  1.00 17.97           N
ATOM   5483  CA  SER B 357     103.533  29.875 277.648  1.00 18.42           C
ATOM   5484  C   SER B 357     103.673  28.802 276.585  1.00 18.24           C
ATOM   5485  O   SER B 357     103.963  29.107 275.450  1.00 17.83           O
ATOM   5486  CB  SER B 357     102.186  30.582 277.524  1.00 19.35           C
ATOM   5487  OG  SER B 357     101.253  30.074 278.442  1.00 19.96           O
ATOM   5488  N   LEU B 358     103.451  27.549 276.950  1.00 19.21           N
ATOM   5489  CA  LEU B 358     103.628  26.427 276.034  1.00 20.35           C
ATOM   5490  C   LEU B 358     102.364  26.060 275.287  1.00 20.83           C
ATOM   5491  O   LEU B 358     101.305  25.910 275.878  1.00 18.97           O
ATOM   5492  CB  LEU B 358     104.095  25.181 276.808  1.00 21.36           C
ATOM   5493  CG  LEU B 358     104.204  23.881 275.994  1.00 21.43           C
ATOM   5494  CD1 LEU B 358     105.274  23.954 274.924  1.00 21.78           C
ATOM   5495  CD2 LEU B 358     104.533  22.745 276.929  1.00 22.70           C
ATOM   5496  N   ARG B 359     102.515  25.854 273.990  1.00 22.98           N
ATOM   5497  CA  ARG B 359     101.424  25.410 273.131  1.00 25.62           C
ATOM   5498  C   ARG B 359     101.931  24.345 272.146  1.00 24.52           C
ATOM   5499  O   ARG B 359     103.089  24.330 271.759  1.00 22.38           O
ATOM   5500  CB  ARG B 359     100.883  26.599 272.344  1.00 28.51           C
ATOM   5501  CG  ARG B 359     101.999  27.247 271.518  1.00 33.20           C
ATOM   5502  CD  ARG B 359     101.535  28.335 270.568  1.00 35.45           C
ATOM   5503  NE  ARG B 359     101.004  29.465 271.319  1.00 38.14           N
ATOM   5504  CZ  ARG B 359     100.553  30.584 270.763  1.00 38.21           C
ATOM   5505  NH1 ARG B 359     100.598  30.725 269.441  1.00 38.22           N
ATOM   5506  NH2 ARG B 359     100.060  31.556 271.532  1.00 36.28           N
ATOM   5507  N   TYR B 360     101.032  23.465 271.751  1.00 25.35           N
ATOM   5508  CA  TYR B 360     101.270  22.510 270.684  1.00 25.76           C
ATOM   5509  C   TYR B 360     100.376  22.862 269.480  1.00 25.73           C
ATOM   5510  O   TYR B 360      99.187  23.076 269.636  1.00 25.79           O
ATOM   5511  CB  TYR B 360     100.954  21.101 271.211  1.00 24.53           C
ATOM   5512  CG  TYR B 360     101.961  20.602 272.228  1.00 23.60           C
ATOM   5513  CD1 TYR B 360     103.239  20.180 271.828  1.00 22.41           C
ATOM   5514  CD2 TYR B 360     101.639  20.536 273.594  1.00 23.77           C
ATOM   5515  CE1 TYR B 360     104.167  19.734 272.750  1.00 22.45           C
```

Appendix 2

```
ATOM   5516  CE2 TYR B 360     102.551  20.068 274.524  1.00 23.62           C
ATOM   5517  CZ  TYR B 360     103.825  19.670 274.109  1.00 23.99           C
ATOM   5518  OH  TYR B 360     104.746  19.211 275.047  1.00 22.96           O
ATOM   5519  N   GLU B 361     100.945  22.945 268.288  1.00 27.29           N
ATOM   5520  CA  GLU B 361     100.138  23.174 267.077  1.00 27.56           C
ATOM   5521  C   GLU B 361      99.387  21.883 266.630  1.00 27.84           C
ATOM   5522  O   GLU B 361      98.270  21.980 266.161  1.00 28.64           O
ATOM   5523  CB  GLU B 361     100.996  23.774 265.934  1.00 26.52           C
ATOM   5524  N   HIS B 362      99.976  20.693 266.781  1.00 27.78           N
ATOM   5525  CA  HIS B 362      99.326  19.437 266.351  1.00 29.11           C
ATOM   5526  C   HIS B 362      99.388  18.350 267.418  1.00 25.97           C
ATOM   5527  O   HIS B 362     100.109  17.390 267.247  1.00 25.07           O
ATOM   5528  CB  HIS B 362      99.984  18.854 265.083  1.00 33.25           C
ATOM   5529  CG  HIS B 362      99.940  19.762 263.894  1.00 42.58           C
ATOM   5530  ND1 HIS B 362      98.764  20.090 263.248  1.00 46.90           N
ATOM   5531  CD2 HIS B 362     100.932  20.408 263.222  1.00 46.52           C
ATOM   5532  CE1 HIS B 362      99.032  20.907 262.239  1.00 48.26           C
ATOM   5533  NE2 HIS B 362     100.339  21.108 262.197  1.00 47.27           N
ATOM   5534  N   PRO B 363      98.618  18.473 268.512  1.00 25.14           N
ATOM   5535  CA  PRO B 363      98.593  17.355 269.475  1.00 24.55           C
ATOM   5536  C   PRO B 363      98.168  16.054 268.802  1.00 24.87           C
ATOM   5537  O   PRO B 363      97.236  16.058 268.024  1.00 27.30           O
ATOM   5538  CB  PRO B 363      97.551  17.798 270.518  1.00 25.07           C
ATOM   5539  CG  PRO B 363      96.757  18.896 269.862  1.00 24.73           C
ATOM   5540  CD  PRO B 363      97.683  19.557 268.885  1.00 24.91           C
ATOM   5541  N   GLY B 364      98.861  14.953 269.059  1.00 25.42           N
ATOM   5542  CA  GLY B 364      98.559  13.695 268.379  1.00 24.67           C
ATOM   5543  C   GLY B 364      97.326  12.937 268.854  1.00 25.60           C
ATOM   5544  O   GLY B 364      96.974  11.921 268.279  1.00 26.62           O
ATOM   5545  N   SER B 365      96.654  13.420 269.899  1.00 26.82           N
ATOM   5546  CA  SER B 365      95.628  12.647 270.573  1.00 24.89           C
ATOM   5547  C   SER B 365      94.924  13.488 271.620  1.00 25.11           C
ATOM   5548  O   SER B 365      95.281  14.642 271.871  1.00 25.68           O
ATOM   5549  CB  SER B 365      96.275  11.447 271.287  1.00 24.74           C
ATOM   5550  OG  SER B 365      96.960  11.875 272.457  1.00 23.97           O
ATOM   5551  N   LEU B 366      93.949  12.869 272.267  1.00 25.76           N
ATOM   5552  CA  LEU B 366      93.258  13.472 273.397  1.00 25.33           C
ATOM   5553  C   LEU B 366      94.165  13.501 274.582  1.00 23.90           C
ATOM   5554  O   LEU B 366      95.076  12.691 274.668  1.00 25.52           O
ATOM   5555  CB  LEU B 366      92.042  12.641 273.759  1.00 26.22           C
ATOM   5556  CG  LEU B 366      91.015  12.561 272.637  1.00 27.41           C
ATOM   5557  CD1 LEU B 366      89.908  11.635 273.105  1.00 27.59           C
ATOM   5558  CD2 LEU B 366      90.488  13.953 272.258  1.00 27.46           C
ATOM   5559  N   LEU B 367      93.909  14.412 275.513  1.00 22.93           N
ATOM   5560  CA  LEU B 367      94.677  14.456 276.764  1.00 22.92           C
ATOM   5561  C   LEU B 367      96.177  14.716 276.531  1.00 22.10           C
ATOM   5562  O   LEU B 367      97.004  14.402 277.361  1.00 22.47           O
ATOM   5563  CB  LEU B 367      94.477  13.141 277.554  1.00 22.64           C
ATOM   5564  CG  LEU B 367      93.007  12.885 277.906  1.00 22.21           C
ATOM   5565  CD1 LEU B 367      92.857  11.647 278.755  1.00 21.92           C
ATOM   5566  CD2 LEU B 367      92.435  14.085 278.632  1.00 22.18           C
ATOM   5567  N   PHE B 368      96.513  15.311 275.402  1.00 21.86           N
ATOM   5568  CA  PHE B 368      97.890  15.403 274.980  1.00 21.70           C
ATOM   5569  C   PHE B 368      98.777  16.230 275.898  1.00 21.55           C
```

Appendix 2

```
ATOM   5570  O    PHE B 368      99.717  15.693 276.478  1.00 22.27           O
ATOM   5571  CB   PHE B 368      97.986  15.963 273.572  1.00 21.63           C
ATOM   5572  CG   PHE B 368      99.316  15.758 272.972  1.00 21.36           C
ATOM   5573  CD1  PHE B 368      99.653  14.522 272.461  1.00 21.56           C
ATOM   5574  CD2  PHE B 368     100.242  16.778 272.962  1.00 22.28           C
ATOM   5575  CE1  PHE B 368     100.908  14.293 271.924  1.00 23.15           C
ATOM   5576  CE2  PHE B 368     101.497  16.578 272.412  1.00 23.66           C
ATOM   5577  CZ   PHE B 368     101.834  15.324 271.888  1.00 23.98           C
ATOM   5578  N    ASP B 369      98.522  17.527 276.024  1.00 20.56           N
ATOM   5579  CA   ASP B 369      99.330  18.312 276.930  1.00 21.07           C
ATOM   5580  C    ASP B 369      99.204  17.811 278.381  1.00 23.15           C
ATOM   5581  O    ASP B 369     100.140  17.961 279.188  1.00 25.93           O
ATOM   5582  CB   ASP B 369      99.020  19.810 276.831  1.00 21.08           C
ATOM   5583  CG   ASP B 369      97.683  20.194 277.449  1.00 21.27           C
ATOM   5584  OD1  ASP B 369      96.688  20.182 276.700  1.00 19.30           O
ATOM   5585  OD2  ASP B 369      97.649  20.539 278.665  1.00 21.30           O
ATOM   5586  N    GLU B 370      98.067  17.202 278.708  1.00 23.43           N
ATOM   5587  CA   GLU B 370      97.837  16.684 280.049  1.00 23.02           C
ATOM   5588  C    GLU B 370      98.828  15.562 280.392  1.00 22.22           C
ATOM   5589  O    GLU B 370      99.461  15.591 281.449  1.00 22.09           O
ATOM   5590  CB   GLU B 370      96.385  16.199 280.211  1.00 22.90           C
ATOM   5591  CG   GLU B 370      95.321  17.291 280.219  1.00 22.52           C
ATOM   5592  CD   GLU B 370      94.653  17.532 278.861  1.00 23.88           C
ATOM   5593  OE1  GLU B 370      95.226  17.208 277.788  1.00 24.17           O
ATOM   5594  OE2  GLU B 370      93.531  18.087 278.854  1.00 23.50           O
ATOM   5595  N    LEU B 371      98.967  14.583 279.509  1.00 21.90           N
ATOM   5596  CA   LEU B 371      99.795  13.398 279.803  1.00 22.50           C
ATOM   5597  C    LEU B 371     101.281  13.677 279.653  1.00 22.57           C
ATOM   5598  O    LEU B 371     102.091  13.247 280.469  1.00 24.31           O
ATOM   5599  CB   LEU B 371      99.393  12.226 278.920  1.00 22.73           C
ATOM   5600  CG   LEU B 371      98.000  11.672 279.269  1.00 23.22           C
ATOM   5601  CD1  LEU B 371      97.435  10.865 278.107  1.00 23.92           C
ATOM   5602  CD2  LEU B 371      97.993  10.872 280.579  1.00 22.42           C
ATOM   5603  N    LEU B 372     101.639  14.436 278.633  1.00 21.82           N
ATOM   5604  CA   LEU B 372     103.018  14.895 278.506  1.00 21.57           C
ATOM   5605  C    LEU B 372     103.427  15.747 279.710  1.00 20.91           C
ATOM   5606  O    LEU B 372     104.513  15.578 280.232  1.00 20.69           O
ATOM   5607  CB   LEU B 372     103.238  15.636 277.181  1.00 21.05           C
ATOM   5608  CG   LEU B 372     103.668  14.750 276.015  1.00 20.34           C
ATOM   5609  CD1  LEU B 372     102.705  13.605 275.788  1.00 20.69           C
ATOM   5610  CD2  LEU B 372     103.817  15.563 274.742  1.00 20.87           C
ATOM   5611  N    PHE B 373     102.549  16.625 280.175  1.00 20.95           N
ATOM   5612  CA   PHE B 373     102.810  17.366 281.422  1.00 21.64           C
ATOM   5613  C    PHE B 373     103.096  16.417 282.573  1.00 21.68           C
ATOM   5614  O    PHE B 373     104.187  16.431 283.118  1.00 22.47           O
ATOM   5615  CB   PHE B 373     101.638  18.282 281.769  1.00 21.32           C
ATOM   5616  CG   PHE B 373     101.672  18.847 283.158  1.00 21.13           C
ATOM   5617  CD1  PHE B 373     102.787  19.474 283.644  1.00 22.54           C
ATOM   5618  CD2  PHE B 373     100.544  18.812 283.954  1.00 22.16           C
ATOM   5619  CE1  PHE B 373     102.807  20.020 284.909  1.00 21.81           C
ATOM   5620  CE2  PHE B 373     100.544  19.370 285.220  1.00 22.12           C
ATOM   5621  CZ   PHE B 373     101.682  19.979 285.692  1.00 21.83           C
ATOM   5622  N    LEU B 374     102.120  15.588 282.915  1.00 21.92           N
ATOM   5623  CA   LEU B 374     102.264  14.580 283.969  1.00 22.60           C
```

Appendix 2

```
ATOM   5624  C    LEU B 374     103.551  13.765 283.837  1.00 22.19           C
ATOM   5625  O    LEU B 374     104.377  13.767 284.756  1.00 21.50           O
ATOM   5626  CB   LEU B 374     101.051  13.628 283.925  1.00 23.90           C
ATOM   5627  CG   LEU B 374     101.026  12.449 284.875  1.00 22.57           C
ATOM   5628  CD1  LEU B 374     101.038  12.984 286.290  1.00 22.59           C
ATOM   5629  CD2  LEU B 374      99.791  11.606 284.610  1.00 22.56           C
ATOM   5630  N    ALA B 375     103.720  13.086 282.697  1.00 20.86           N
ATOM   5631  CA   ALA B 375     104.913  12.269 282.468  1.00 20.97           C
ATOM   5632  C    ALA B 375     106.231  13.048 282.696  1.00 21.18           C
ATOM   5633  O    ALA B 375     107.172  12.522 283.299  1.00 22.21           O
ATOM   5634  CB   ALA B 375     104.902  11.641 281.076  1.00 20.11           C
ATOM   5635  N    LYS B 376     106.303  14.289 282.236  1.00 20.31           N
ATOM   5636  CA   LYS B 376     107.529  15.072 282.449  1.00 20.63           C
ATOM   5637  C    LYS B 376     107.806  15.357 283.925  1.00 20.50           C
ATOM   5638  O    LYS B 376     108.959  15.402 284.319  1.00 21.94           O
ATOM   5639  CB   LYS B 376     107.512  16.396 281.683  1.00 20.46           C
ATOM   5640  CG   LYS B 376     107.587  16.265 280.170  1.00 21.01           C
ATOM   5641  CD   LYS B 376     107.442  17.613 279.484  1.00 21.05           C
ATOM   5642  CE   LYS B 376     107.659  17.516 277.981  1.00 21.53           C
ATOM   5643  NZ   LYS B 376     107.541  18.850 277.325  1.00 21.82           N
ATOM   5644  N    VAL B 377     106.775  15.531 284.744  1.00 20.21           N
ATOM   5645  CA   VAL B 377     106.997  15.825 286.169  1.00 20.28           C
ATOM   5646  C    VAL B 377     106.834  14.680 287.163  1.00 18.67           C
ATOM   5647  O    VAL B 377     107.177  14.837 288.290  1.00 18.94           O
ATOM   5648  CB   VAL B 377     106.065  16.945 286.686  1.00 20.74           C
ATOM   5649  CG1  VAL B 377     106.297  18.234 285.918  1.00 20.63           C
ATOM   5650  CG2  VAL B 377     104.606  16.510 286.660  1.00 21.19           C
ATOM   5651  N    HIS B 378     106.290  13.556 286.749  1.00 18.49           N
ATOM   5652  CA   HIS B 378     105.789  12.529 287.673  1.00 18.20           C
ATOM   5653  C    HIS B 378     106.870  12.017 288.592  1.00 17.29           C
ATOM   5654  O    HIS B 378     107.877  11.478 288.142  1.00 18.08           O
ATOM   5655  CB   HIS B 378     105.222  11.360 286.843  1.00 18.44           C
ATOM   5656  CG   HIS B 378     104.561  10.293 287.644  1.00 18.80           C
ATOM   5657  ND1  HIS B 378     103.521  10.548 288.515  1.00 18.85           N
ATOM   5658  CD2  HIS B 378     104.743   8.955 287.656  1.00 19.23           C
ATOM   5659  CE1  HIS B 378     103.120   9.414 289.060  1.00 18.78           C
ATOM   5660  NE2  HIS B 378     103.840   8.431 288.554  1.00 19.61           N
ATOM   5661  N    ALA B 379     106.649  12.160 289.881  1.00 16.34           N
ATOM   5662  CA   ALA B 379     107.587  11.682 290.865  1.00 16.33           C
ATOM   5663  C    ALA B 379     107.379  10.218 291.279  1.00 17.10           C
ATOM   5664  O    ALA B 379     108.071   9.731 292.170  1.00 17.33           O
ATOM   5665  CB   ALA B 379     107.479  12.566 292.096  1.00 16.71           C
ATOM   5666  N    GLY B 380     106.417   9.517 290.689  1.00 17.10           N
ATOM   5667  CA   GLY B 380     106.083   8.192 291.175  1.00 17.33           C
ATOM   5668  C    GLY B 380     104.971   8.279 292.203  1.00 17.83           C
ATOM   5669  O    GLY B 380     104.988   9.144 293.081  1.00 17.45           O
ATOM   5670  N    PHE B 381     103.993   7.384 292.075  1.00 19.07           N
ATOM   5671  CA   PHE B 381     102.831   7.355 292.973  1.00 20.50           C
ATOM   5672  C    PHE B 381     103.158   7.038 294.438  1.00 21.05           C
ATOM   5673  O    PHE B 381     102.543   7.609 295.354  1.00 20.21           O
ATOM   5674  CB   PHE B 381     101.742   6.410 292.427  1.00 20.86           C
ATOM   5675  CG   PHE B 381     101.067   6.954 291.203  1.00 20.31           C
ATOM   5676  CD1  PHE B 381     100.278   8.097 291.287  1.00 20.14           C
ATOM   5677  CD2  PHE B 381     101.278   6.384 289.969  1.00 20.11           C
```

Appendix 2

```
ATOM   5678  CE1 PHE B 381      99.681   8.627 290.158  1.00 19.57           C
ATOM   5679  CE2 PHE B 381     100.683   6.911 288.835  1.00 19.95           C
ATOM   5680  CZ  PHE B 381      99.889   8.036 288.928  1.00 19.71           C
ATOM   5681  N   GLY B 382     104.140   6.160 294.660  1.00 21.65           N
ATOM   5682  CA  GLY B 382     104.658   5.941 296.007  1.00 21.72           C
ATOM   5683  C   GLY B 382     105.105   7.238 296.657  1.00 22.48           C
ATOM   5684  O   GLY B 382     104.755   7.523 297.824  1.00 22.16           O
ATOM   5685  N   ALA B 383     105.888   8.017 295.904  1.00 22.58           N
ATOM   5686  CA  ALA B 383     106.417   9.298 296.383  1.00 23.78           C
ATOM   5687  C   ALA B 383     105.254  10.284 296.679  1.00 26.09           C
ATOM   5688  O   ALA B 383     105.265  11.016 297.712  1.00 24.77           O
ATOM   5689  CB  ALA B 383     107.387   9.888 295.356  1.00 23.58           C
ATOM   5690  N   LEU B 384     104.236  10.280 295.802  1.00 25.98           N
ATOM   5691  CA  LEU B 384     103.029  11.065 296.083  1.00 26.92           C
ATOM   5692  C   LEU B 384     102.406  10.662 297.416  1.00 27.60           C
ATOM   5693  O   LEU B 384     102.077  11.523 298.208  1.00 31.15           O
ATOM   5694  CB  LEU B 384     102.015  10.997 294.937  1.00 25.99           C
ATOM   5695  CG  LEU B 384     102.543  11.648 293.659  1.00 25.68           C
ATOM   5696  CD1 LEU B 384     101.492  11.573 292.575  1.00 26.61           C
ATOM   5697  CD2 LEU B 384     102.996  13.085 293.882  1.00 25.28           C
ATOM   5698  N   LEU B 385     102.279   9.367 297.676  1.00 28.76           N
ATOM   5699  CA  LEU B 385     101.779   8.867 298.963  1.00 29.05           C
ATOM   5700  C   LEU B 385     102.584   9.298 300.178  1.00 28.51           C
ATOM   5701  O   LEU B 385     102.019   9.518 301.246  1.00 25.72           O
ATOM   5702  CB  LEU B 385     101.819   7.348 298.988  1.00 31.97           C
ATOM   5703  CG  LEU B 385     100.686   6.515 298.441  1.00 34.35           C
ATOM   5704  CD1 LEU B 385     101.011   5.041 298.682  1.00 33.68           C
ATOM   5705  CD2 LEU B 385      99.374   6.911 299.112  1.00 36.31           C
ATOM   5706  N   ARG B 386     103.907   9.342 300.036  1.00 29.82           N
ATOM   5707  CA  ARG B 386     104.798   9.683 301.165  1.00 30.87           C
ATOM   5708  C   ARG B 386     105.139  11.156 301.154  1.00 28.94           C
ATOM   5709  O   ARG B 386     106.152  11.557 301.688  1.00 29.07           O
ATOM   5710  CB  ARG B 386     106.095   8.873 301.107  1.00 33.13           C
ATOM   5711  CG  ARG B 386     105.909   7.386 301.373  1.00 37.23           C
ATOM   5712  CD  ARG B 386     107.241   6.642 301.301  1.00 38.89           C
ATOM   5713  NE  ARG B 386     107.676   6.466 299.913  1.00 41.45           N
ATOM   5714  CZ  ARG B 386     107.168   5.558 299.069  1.00 42.12           C
ATOM   5715  NH1 ARG B 386     106.185   4.728 299.458  1.00 39.86           N
ATOM   5716  NH2 ARG B 386     107.645   5.483 297.824  1.00 41.28           N
ATOM   5717  N   MET B 387     104.299  11.967 300.532  1.00 27.51           N
ATOM   5718  CA  MET B 387     104.591  13.369 300.409  1.00 26.42           C
ATOM   5719  C   MET B 387     104.647  14.012 301.775  1.00 25.66           C
ATOM   5720  O   MET B 387     103.659  14.012 302.481  1.00 26.07           O
ATOM   5721  CB  MET B 387     103.527  14.079 299.580  1.00 26.01           C
ATOM   5722  CG  MET B 387     103.842  15.554 299.381  1.00 26.13           C
ATOM   5723  SD  MET B 387     102.522  16.517 298.637  1.00 25.59           S
ATOM   5724  CE  MET B 387     102.406  15.714 297.028  1.00 23.74           C
ATOM   5725  N   PRO B 388     105.786  14.609 302.132  1.00 26.19           N
ATOM   5726  CA  PRO B 388     105.900  15.303 303.403  1.00 26.84           C
ATOM   5727  C   PRO B 388     105.010  16.528 303.510  1.00 27.55           C
ATOM   5728  O   PRO B 388     104.731  17.161 302.511  1.00 25.32           O
ATOM   5729  CB  PRO B 388     107.363  15.752 303.439  1.00 26.70           C
ATOM   5730  CG  PRO B 388     108.055  14.921 302.417  1.00 27.89           C
ATOM   5731  CD  PRO B 388     107.033  14.684 301.357  1.00 27.44           C
```

Appendix 2

```
ATOM   5732  N    PRO B 389     104.595  16.878 304.732  1.00 30.36           N
ATOM   5733  CA   PRO B 389     103.807  18.086 304.996  1.00 33.04           C
ATOM   5734  C    PRO B 389     104.465  19.373 304.521  1.00 36.08           C
ATOM   5735  O    PRO B 389     105.699  19.439 304.454  1.00 35.11           O
ATOM   5736  CB   PRO B 389     103.699  18.122 306.532  1.00 32.66           C
ATOM   5737  CG   PRO B 389     103.940  16.725 306.975  1.00 31.44           C
ATOM   5738  CD   PRO B 389     104.846  16.100 305.956  1.00 30.02           C
ATOM   5739  N    PRO B 390     103.643  20.403 304.223  1.00 43.39           N
ATOM   5740  CA   PRO B 390     104.097  21.675 303.616  1.00 44.57           C
ATOM   5741  C    PRO B 390     105.256  22.366 304.341  1.00 44.02           C
ATOM   5742  O    PRO B 390     105.123  22.686 305.514  1.00 45.60           O
ATOM   5743  CB   PRO B 390     102.828  22.559 303.636  1.00 46.52           C
ATOM   5744  CG   PRO B 390     101.743  21.780 304.337  1.00 45.30           C
ATOM   5745  CD   PRO B 390     102.164  20.341 304.343  1.00 44.71           C
TER    5746       PRO B 390
ATOM   5747  N    GLU C  28      62.157  63.695 228.078  1.00 32.87           N
ATOM   5748  CA   GLU C  28      63.236  62.716 227.753  1.00 34.57           C
ATOM   5749  C    GLU C  28      63.542  61.831 228.991  1.00 39.18           C
ATOM   5750  O    GLU C  28      63.910  62.340 230.068  1.00 39.43           O
ATOM   5751  CB   GLU C  28      64.505  63.436 227.257  1.00 33.20           C
ATOM   5752  N    LEU C  29      63.381  60.513 228.837  1.00 39.41           N
ATOM   5753  CA   LEU C  29      63.652  59.547 229.922  1.00 37.87           C
ATOM   5754  C    LEU C  29      65.152  59.418 230.220  1.00 40.02           C
ATOM   5755  O    LEU C  29      65.913  58.842 229.419  1.00 38.69           O
ATOM   5756  CB   LEU C  29      63.071  58.169 229.576  1.00 35.20           C
ATOM   5757  CG   LEU C  29      63.078  57.060 230.637  1.00 34.86           C
ATOM   5758  CD1  LEU C  29      62.141  57.396 231.795  1.00 33.53           C
ATOM   5759  CD2  LEU C  29      62.673  55.734 229.993  1.00 33.90           C
ATOM   5760  N    PRO C  30      65.592  59.946 231.381  1.00 42.12           N
ATOM   5761  CA   PRO C  30      67.012  59.821 231.678  1.00 41.73           C
ATOM   5762  C    PRO C  30      67.461  58.363 231.764  1.00 41.21           C
ATOM   5763  O    PRO C  30      66.636  57.454 231.916  1.00 37.25           O
ATOM   5764  CB   PRO C  30      67.151  60.539 233.032  1.00 42.76           C
ATOM   5765  CG   PRO C  30      65.997  61.490 233.079  1.00 40.61           C
ATOM   5766  CD   PRO C  30      64.891  60.709 232.435  1.00 42.16           C
ATOM   5767  N    PRO C  31      68.771  58.136 231.649  1.00 42.74           N
ATOM   5768  CA   PRO C  31      69.214  56.748 231.540  1.00 41.92           C
ATOM   5769  C    PRO C  31      68.993  55.962 232.850  1.00 41.29           C
ATOM   5770  O    PRO C  31      69.364  56.444 233.932  1.00 39.62           O
ATOM   5771  CB   PRO C  31      70.717  56.877 231.198  1.00 43.35           C
ATOM   5772  CG   PRO C  31      70.981  58.348 230.972  1.00 42.73           C
ATOM   5773  CD   PRO C  31      69.897  59.089 231.690  1.00 41.27           C
ATOM   5774  N    GLY C  32      68.385  54.776 232.733  1.00 38.37           N
ATOM   5775  CA   GLY C  32      68.190  53.853 233.862  1.00 35.79           C
ATOM   5776  C    GLY C  32      66.853  53.991 234.596  1.00 34.44           C
ATOM   5777  O    GLY C  32      66.544  53.174 235.487  1.00 31.31           O
ATOM   5778  N    ARG C  33      66.082  55.018 234.211  1.00 31.93           N
ATOM   5779  CA   ARG C  33      64.803  55.364 234.829  1.00 32.98           C
ATOM   5780  C    ARG C  33      63.607  54.636 234.213  1.00 33.49           C
ATOM   5781  O    ARG C  33      63.623  54.259 233.034  1.00 32.24           O
ATOM   5782  CB   ARG C  33      64.546  56.875 234.725  1.00 32.95           C
ATOM   5783  CG   ARG C  33      65.379  57.726 235.670  1.00 34.16           C
ATOM   5784  CD   ARG C  33      64.768  57.799 237.065  1.00 34.13           C
ATOM   5785  NE   ARG C  33      63.523  58.546 237.014  1.00 35.01           N
```

Appendix 2

```
ATOM   5786  CZ   ARG C   33      63.447  59.877 237.024  1.00 36.04           C
ATOM   5787  NH1  ARG C   33      64.545  60.645 237.148  1.00 33.50           N
ATOM   5788  NH2  ARG C   33      62.251  60.447 236.938  1.00 36.86           N
ATOM   5789  N    LEU C   34      62.552  54.498 235.014  1.00 35.48           N
ATOM   5790  CA   LEU C   34      61.353  53.755 234.612  1.00 36.90           C
ATOM   5791  C    LEU C   34      60.375  54.704 233.969  1.00 34.83           C
ATOM   5792  O    LEU C   34      59.847  54.403 232.915  1.00 34.80           O
ATOM   5793  CB   LEU C   34      60.726  53.012 235.799  1.00 38.61           C
ATOM   5794  CG   LEU C   34      61.643  51.912 236.373  1.00 39.66           C
ATOM   5795  CD1  LEU C   34      61.068  51.339 237.658  1.00 40.48           C
ATOM   5796  CD2  LEU C   34      61.908  50.795 235.367  1.00 38.12           C
ATOM   5797  N    ALA C   35      60.175  55.871 234.572  1.00 35.28           N
ATOM   5798  CA   ALA C   35      59.422  56.943 233.913  1.00 34.41           C
ATOM   5799  C    ALA C   35      59.960  58.320 234.257  1.00 34.00           C
ATOM   5800  O    ALA C   35      60.770  58.479 235.157  1.00 32.53           O
ATOM   5801  CB   ALA C   35      57.959  56.851 234.262  1.00 34.90           C
ATOM   5802  N    THR C   36      59.507  59.320 233.515  1.00 35.32           N
ATOM   5803  CA   THR C   36      60.042  60.670 233.660  1.00 36.05           C
ATOM   5804  C    THR C   36      59.473  61.297 234.899  1.00 35.19           C
ATOM   5805  O    THR C   36      58.438  60.862 235.385  1.00 34.18           O
ATOM   5806  CB   THR C   36      59.651  61.578 232.475  1.00 37.00           C
ATOM   5807  OG1  THR C   36      58.213  61.696 232.412  1.00 39.29           O
ATOM   5808  CG2  THR C   36      60.208  61.032 231.156  1.00 35.66           C
ATOM   5809  N    THR C   37      60.143  62.338 235.392  1.00 35.29           N
ATOM   5810  CA   THR C   37      59.659  63.090 236.552  1.00 34.46           C
ATOM   5811  C    THR C   37      58.331  63.766 236.237  1.00 36.07           C
ATOM   5812  O    THR C   37      57.414  63.778 237.052  1.00 35.34           O
ATOM   5813  CB   THR C   37      60.713  64.112 237.023  1.00 34.04           C
ATOM   5814  OG1  THR C   37      61.779  63.400 237.672  1.00 35.58           O
ATOM   5815  CG2  THR C   37      60.143  65.114 238.013  1.00 33.09           C
ATOM   5816  N    GLU C   38      58.233  64.307 235.038  1.00 38.42           N
ATOM   5817  CA   GLU C   38      57.005  64.893 234.558  1.00 40.40           C
ATOM   5818  C    GLU C   38      55.820  63.935 234.688  1.00 39.29           C
ATOM   5819  O    GLU C   38      54.714  64.359 235.077  1.00 38.12           O
ATOM   5820  CB   GLU C   38      57.176  65.286 233.092  1.00 45.84           C
ATOM   5821  CG   GLU C   38      56.114  66.240 232.581  1.00 48.65           C
ATOM   5822  CD   GLU C   38      55.960  66.195 231.077  1.00 49.52           C
ATOM   5823  OE1  GLU C   38      56.038  67.266 230.464  1.00 50.31           O
ATOM   5824  OE2  GLU C   38      55.770  65.103 230.505  1.00 51.61           O
ATOM   5825  N    ASP C   39      56.044  62.660 234.352  1.00 37.10           N
ATOM   5826  CA   ASP C   39      54.985  61.639 234.482  1.00 36.73           C
ATOM   5827  C    ASP C   39      54.493  61.424 235.925  1.00 36.32           C
ATOM   5828  O    ASP C   39      53.293  61.207 236.130  1.00 37.76           O
ATOM   5829  CB   ASP C   39      55.428  60.290 233.916  1.00 35.67           C
ATOM   5830  CG   ASP C   39      55.227  60.182 232.428  1.00 35.75           C
ATOM   5831  OD1  ASP C   39      54.715  61.127 231.794  1.00 34.74           O
ATOM   5832  OD2  ASP C   39      55.593  59.125 231.886  1.00 36.16           O
ATOM   5833  N    TYR C   40      55.413  61.457 236.898  1.00 33.70           N
ATOM   5834  CA   TYR C   40      55.076  61.242 238.313  1.00 32.56           C
ATOM   5835  C    TYR C   40      54.302  62.429 238.880  1.00 32.40           C
ATOM   5836  O    TYR C   40      53.341  62.236 239.638  1.00 33.03           O
ATOM   5837  CB   TYR C   40      56.319  60.963 239.187  1.00 30.05           C
ATOM   5838  CG   TYR C   40      57.045  59.670 238.874  1.00 30.21           C
ATOM   5839  CD1  TYR C   40      56.372  58.445 238.868  1.00 30.45           C
```

Appendix 2

```
ATOM   5840  CD2 TYR C  40      58.415  59.660 238.583  1.00 29.47           C
ATOM   5841  CE1 TYR C  40      57.036  57.257 238.573  1.00 30.14           C
ATOM   5842  CE2 TYR C  40      59.074  58.476 238.279  1.00 29.35           C
ATOM   5843  CZ  TYR C  40      58.386  57.279 238.280  1.00 29.82           C
ATOM   5844  OH  TYR C  40      59.036  56.106 237.983  1.00 28.39           O
ATOM   5845  N   PHE C  41      54.692  63.647 238.513  1.00 31.50           N
ATOM   5846  CA  PHE C  41      53.954  64.842 238.995  1.00 33.44           C
ATOM   5847  C   PHE C  41      52.556  65.011 238.342  1.00 31.17           C
ATOM   5848  O   PHE C  41      51.686  65.653 238.902  1.00 33.06           O
ATOM   5849  CB  PHE C  41      54.807  66.124 238.876  1.00 31.52           C
ATOM   5850  CG  PHE C  41      55.900  66.232 239.916  1.00 33.10           C
ATOM   5851  CD1 PHE C  41      56.978  65.335 239.929  1.00 33.44           C
ATOM   5852  CD2 PHE C  41      55.869  67.229 240.891  1.00 32.17           C
ATOM   5853  CE1 PHE C  41      57.985  65.437 240.882  1.00 31.13           C
ATOM   5854  CE2 PHE C  41      56.877  67.328 241.839  1.00 30.86           C
ATOM   5855  CZ  PHE C  41      57.944  66.438 241.827  1.00 29.86           C
ATOM   5856  N   ALA C  42      52.356  64.393 237.188  1.00 30.97           N
ATOM   5857  CA  ALA C  42      51.066  64.394 236.480  1.00 31.96           C
ATOM   5858  C   ALA C  42      50.057  63.286 236.913  1.00 34.45           C
ATOM   5859  O   ALA C  42      48.857  63.425 236.654  1.00 40.83           O
ATOM   5860  CB  ALA C  42      51.309  64.307 234.963  1.00 29.21           C
ATOM   5861  N   GLN C  43      50.522  62.191 237.525  1.00 33.73           N
ATOM   5862  CA  GLN C  43      49.652  61.050 237.910  1.00 31.99           C
ATOM   5863  C   GLN C  43      48.292  61.487 238.435  1.00 32.00           C
ATOM   5864  O   GLN C  43      47.247  60.911 238.068  1.00 28.56           O
ATOM   5865  CB  GLN C  43      50.310  60.171 238.997  1.00 31.31           C
ATOM   5866  CG  GLN C  43      51.309  59.136 238.486  1.00 31.76           C
ATOM   5867  CD  GLN C  43      52.080  58.421 239.594  1.00 33.14           C
ATOM   5868  OE1 GLN C  43      52.044  57.196 239.688  1.00 35.34           O
ATOM   5869  NE2 GLN C  43      52.786  59.181 240.426  1.00 31.48           N
ATOM   5870  N   GLN C  44      48.326  62.490 239.310  1.00 31.73           N
ATOM   5871  CA  GLN C  44      47.131  62.956 239.985  1.00 34.39           C
ATOM   5872  C   GLN C  44      46.106  63.660 239.049  1.00 33.93           C
ATOM   5873  O   GLN C  44      44.890  63.452 239.157  1.00 31.97           O
ATOM   5874  CB  GLN C  44      47.537  63.867 241.138  1.00 35.54           C
ATOM   5875  CG  GLN C  44      46.353  64.351 241.951  1.00 39.10           C
ATOM   5876  CD  GLN C  44      46.705  64.751 243.368  1.00 41.14           C
ATOM   5877  OE1 GLN C  44      47.814  64.496 243.857  1.00 42.65           O
ATOM   5878  NE2 GLN C  44      45.753  65.392 244.038  1.00 40.19           N
ATOM   5879  N   ALA C  45      46.618  64.481 238.141  1.00 35.39           N
ATOM   5880  CA  ALA C  45      45.815  65.181 237.141  1.00 35.41           C
ATOM   5881  C   ALA C  45      45.272  64.195 236.103  1.00 36.49           C
ATOM   5882  O   ALA C  45      44.151  64.367 235.588  1.00 37.35           O
ATOM   5883  CB  ALA C  45      46.656  66.266 236.470  1.00 34.29           C
ATOM   5884  N   LYS C  46      46.067  63.168 235.808  1.00 34.92           N
ATOM   5885  CA  LYS C  46      45.649  62.095 234.905  1.00 37.17           C
ATOM   5886  C   LYS C  46      44.744  61.065 235.561  1.00 34.44           C
ATOM   5887  O   LYS C  46      44.232  60.196 234.874  1.00 33.83           O
ATOM   5888  CB  LYS C  46      46.870  61.381 234.291  1.00 41.28           C
ATOM   5889  CG  LYS C  46      47.494  62.171 233.148  1.00 46.04           C
ATOM   5890  CD  LYS C  46      48.736  61.506 232.591  1.00 49.93           C
ATOM   5891  CE  LYS C  46      49.321  62.361 231.479  1.00 52.88           C
ATOM   5892  NZ  LYS C  46      50.438  61.649 230.808  1.00 55.93           N
ATOM   5893  N   GLN C  47      44.539  61.155 236.871  1.00 33.53           N
```

Appendix 2

```
ATOM   5894  CA   GLN C  47      43.772  60.154 237.604  1.00 34.87           C
ATOM   5895  C    GLN C  47      44.297  58.713 237.390  1.00 34.19           C
ATOM   5896  O    GLN C  47      43.530  57.754 237.494  1.00 33.96           O
ATOM   5897  CB   GLN C  47      42.281  60.228 237.232  1.00 36.49           C
ATOM   5898  CG   GLN C  47      41.621  61.601 237.418  1.00 38.78           C
ATOM   5899  CD   GLN C  47      40.458  61.576 238.411  1.00 39.72           C
ATOM   5900  OE1  GLN C  47      39.515  60.788 238.275  1.00 36.91           O
ATOM   5901  NE2  GLN C  47      40.522  62.440 239.416  1.00 40.16           N
ATOM   5902  N    ALA C  48      45.586  58.562 237.096  1.00 32.96           N
ATOM   5903  CA   ALA C  48      46.181  57.232 236.907  1.00 34.99           C
ATOM   5904  C    ALA C  48      47.605  57.195 237.459  1.00 34.59           C
ATOM   5905  O    ALA C  48      48.306  58.187 237.375  1.00 36.17           O
ATOM   5906  CB   ALA C  48      46.180  56.841 235.426  1.00 33.62           C
ATOM   5907  N    VAL C  49      48.021  56.053 238.003  1.00 34.13           N
ATOM   5908  CA   VAL C  49      49.417  55.864 238.444  1.00 34.32           C
ATOM   5909  C    VAL C  49      50.257  55.371 237.267  1.00 34.02           C
ATOM   5910  O    VAL C  49      49.749  54.650 236.409  1.00 36.45           O
ATOM   5911  CB   VAL C  49      49.545  54.839 239.605  1.00 33.73           C
ATOM   5912  CG1  VAL C  49      48.588  55.164 240.736  1.00 33.82           C
ATOM   5913  CG2  VAL C  49      49.312  53.409 239.129  1.00 34.14           C
ATOM   5914  N    THR C  50      51.536  55.716 237.233  1.00 32.59           N
ATOM   5915  CA   THR C  50      52.431  55.196 236.178  1.00 34.19           C
ATOM   5916  C    THR C  50      52.534  53.654 236.158  1.00 33.10           C
ATOM   5917  O    THR C  50      52.342  53.004 237.181  1.00 28.51           O
ATOM   5918  CB   THR C  50      53.861  55.702 236.361  1.00 33.41           C
ATOM   5919  OG1  THR C  50      54.372  55.163 237.579  1.00 31.28           O
ATOM   5920  CG2  THR C  50      53.888  57.230 236.428  1.00 33.50           C
ATOM   5921  N    PRO C  51      52.826  53.068 234.980  1.00 34.40           N
ATOM   5922  CA   PRO C  51      53.089  51.625 234.914  1.00 34.18           C
ATOM   5923  C    PRO C  51      53.978  51.105 236.034  1.00 33.67           C
ATOM   5924  O    PRO C  51      53.663  50.076 236.622  1.00 35.70           O
ATOM   5925  CB   PRO C  51      53.788  51.479 233.560  1.00 32.79           C
ATOM   5926  CG   PRO C  51      53.128  52.521 232.715  1.00 32.12           C
ATOM   5927  CD   PRO C  51      52.618  53.618 233.627  1.00 32.12           C
ATOM   5928  N    ASP C  52      55.067  51.810 236.336  1.00 31.85           N
ATOM   5929  CA   ASP C  52      56.011  51.318 237.354  1.00 30.92           C
ATOM   5930  C    ASP C  52      55.478  51.398 238.795  1.00 28.47           C
ATOM   5931  O    ASP C  52      55.812  50.551 239.642  1.00 28.87           O
ATOM   5932  CB   ASP C  52      57.407  51.967 237.217  1.00 30.50           C
ATOM   5933  CG   ASP C  52      57.400  53.438 237.478  1.00 30.46           C
ATOM   5934  OD1  ASP C  52      56.795  54.176 236.648  1.00 30.13           O
ATOM   5935  OD2  ASP C  52      58.011  53.845 238.504  1.00 29.03           O
ATOM   5936  N    VAL C  53      54.643  52.390 239.065  1.00 26.15           N
ATOM   5937  CA   VAL C  53      53.948  52.467 240.349  1.00 25.94           C
ATOM   5938  C    VAL C  53      52.939  51.312 240.462  1.00 25.68           C
ATOM   5939  O    VAL C  53      52.835  50.688 241.527  1.00 26.23           O
ATOM   5940  CB   VAL C  53      53.300  53.855 240.585  1.00 25.10           C
ATOM   5941  CG1  VAL C  53      52.337  53.853 241.755  1.00 25.50           C
ATOM   5942  CG2  VAL C  53      54.381  54.883 240.849  1.00 25.58           C
ATOM   5943  N    MET C  54      52.232  51.007 239.378  1.00 24.18           N
ATOM   5944  CA   MET C  54      51.324  49.862 239.377  1.00 25.86           C
ATOM   5945  C    MET C  54      52.095  48.567 239.615  1.00 27.71           C
ATOM   5946  O    MET C  54      51.625  47.678 240.341  1.00 28.06           O
ATOM   5947  CB   MET C  54      50.539  49.737 238.066  1.00 25.37           C
```

Appendix 2

```
ATOM   5948  CG  MET C  54      49.482  48.629 238.057  1.00 25.03           C
ATOM   5949  SD  MET C  54      48.073  48.815 239.189  1.00 25.28           S
ATOM   5950  CE  MET C  54      47.116  50.031 238.287  1.00 25.11           C
ATOM   5951  N   ALA C  55      53.268  48.458 238.994  1.00 28.08           N
ATOM   5952  CA  ALA C  55      54.116  47.291 239.183  1.00 27.01           C
ATOM   5953  C   ALA C  55      54.558  47.202 240.628  1.00 26.62           C
ATOM   5954  O   ALA C  55      54.631  46.116 241.163  1.00 27.92           O
ATOM   5955  CB  ALA C  55      55.315  47.333 238.253  1.00 27.20           C
ATOM   5956  N   GLN C  56      54.829  48.325 241.287  1.00 25.93           N
ATOM   5957  CA  GLN C  56      55.164  48.251 242.727  1.00 25.36           C
ATOM   5958  C   GLN C  56      53.970  47.786 243.557  1.00 22.65           C
ATOM   5959  O   GLN C  56      54.120  46.982 244.486  1.00 20.42           O
ATOM   5960  CB  GLN C  56      55.669  49.598 243.250  1.00 27.56           C
ATOM   5961  CG  GLN C  56      55.712  49.735 244.769  1.00 28.45           C
ATOM   5962  CD  GLN C  56      57.017  49.246 245.385  1.00 29.25           C
ATOM   5963  OE1 GLN C  56      58.107  49.383 244.813  1.00 34.87           O
ATOM   5964  NE2 GLN C  56      56.921  48.746 246.578  1.00 28.49           N
ATOM   5965  N   LEU C  57      52.782  48.293 243.242  1.00 21.06           N
ATOM   5966  CA  LEU C  57      51.610  47.851 243.982  1.00 21.34           C
ATOM   5967  C   LEU C  57      51.361  46.347 243.713  1.00 22.77           C
ATOM   5968  O   LEU C  57      50.826  45.652 244.575  1.00 21.64           O
ATOM   5969  CB  LEU C  57      50.379  48.690 243.658  1.00 21.56           C
ATOM   5970  CG  LEU C  57      50.338  50.194 244.006  1.00 21.83           C
ATOM   5971  CD1 LEU C  57      49.193  50.931 243.324  1.00 21.58           C
ATOM   5972  CD2 LEU C  57      50.201  50.396 245.496  1.00 22.29           C
ATOM   5973  N   ALA C  58      51.769  45.853 242.533  1.00 23.06           N
ATOM   5974  CA  ALA C  58      51.727  44.416 242.238  1.00 24.87           C
ATOM   5975  C   ALA C  58      52.739  43.616 243.081  1.00 24.94           C
ATOM   5976  O   ALA C  58      52.392  42.554 243.588  1.00 22.89           O
ATOM   5977  CB  ALA C  58      51.944  44.131 240.747  1.00 26.15           C
ATOM   5978  N   TYR C  59      53.978  44.115 243.186  1.00 25.34           N
ATOM   5979  CA  TYR C  59      54.943  43.614 244.161  1.00 25.95           C
ATOM   5980  C   TYR C  59      54.288  43.546 245.546  1.00 25.74           C
ATOM   5981  O   TYR C  59      54.376  42.523 246.227  1.00 26.53           O
ATOM   5982  CB  TYR C  59      56.217  44.510 244.269  1.00 26.67           C
ATOM   5983  CG  TYR C  59      56.963  44.213 245.559  1.00 26.26           C
ATOM   5984  CD1 TYR C  59      57.495  42.938 245.782  1.00 26.16           C
ATOM   5985  CD2 TYR C  59      57.057  45.148 246.600  1.00 26.42           C
ATOM   5986  CE1 TYR C  59      58.129  42.606 246.981  1.00 26.40           C
ATOM   5987  CE2 TYR C  59      57.692  44.817 247.817  1.00 26.11           C
ATOM   5988  CZ  TYR C  59      58.220  43.535 248.005  1.00 26.34           C
ATOM   5989  OH  TYR C  59      58.868  43.129 249.177  1.00 27.33           O
ATOM   5990  N   MET C  60      53.631  44.637 245.946  1.00 25.24           N
ATOM   5991  CA  MET C  60      53.068  44.752 247.290  1.00 24.60           C
ATOM   5992  C   MET C  60      51.878  43.840 247.565  1.00 23.19           C
ATOM   5993  O   MET C  60      51.659  43.452 248.716  1.00 22.87           O
ATOM   5994  CB  MET C  60      52.680  46.204 247.586  1.00 25.69           C
ATOM   5995  CG  MET C  60      53.874  47.136 247.787  1.00 26.01           C
ATOM   5996  SD  MET C  60      53.399  48.867 247.625  1.00 27.96           S
ATOM   5997  CE  MET C  60      52.266  49.054 249.004  1.00 26.17           C
ATOM   5998  N   ASN C  61      51.149  43.478 246.508  1.00 21.62           N
ATOM   5999  CA  ASN C  61      49.866  42.779 246.616  1.00 20.66           C
ATOM   6000  C   ASN C  61      49.723  41.370 245.944  1.00 21.20           C
ATOM   6001  O   ASN C  61      48.747  40.661 246.237  1.00 19.64           O
```

Appendix 2

```
ATOM   6002  CB   ASN C  61      48.786  43.691 246.015  1.00 20.18           C
ATOM   6003  CG   ASN C  61      48.388  44.850 246.929  1.00 19.41           C
ATOM   6004  OD1  ASN C  61      47.596  44.674 247.837  1.00 19.58           O
ATOM   6005  ND2  ASN C  61      48.885  46.047 246.649  1.00 19.20           N
ATOM   6006  N    TYR C  62      50.638  40.968 245.042  1.00 22.06           N
ATOM   6007  CA   TYR C  62      50.316  39.898 244.049  1.00 22.27           C
ATOM   6008  C    TYR C  62      50.485  38.454 244.515  1.00 23.12           C
ATOM   6009  O    TYR C  62      49.532  37.665 244.454  1.00 23.75           O
ATOM   6010  CB   TYR C  62      51.068  40.085 242.713  1.00 22.22           C
ATOM   6011  CG   TYR C  62      50.416  39.333 241.564  1.00 23.25           C
ATOM   6012  CD1  TYR C  62      50.724  37.995 241.316  1.00 24.28           C
ATOM   6013  CD2  TYR C  62      49.477  39.948 240.750  1.00 23.00           C
ATOM   6014  CE1  TYR C  62      50.110  37.288 240.300  1.00 24.04           C
ATOM   6015  CE2  TYR C  62      48.865  39.254 239.726  1.00 24.70           C
ATOM   6016  CZ   TYR C  62      49.179  37.920 239.504  1.00 25.12           C
ATOM   6017  OH   TYR C  62      48.560  37.220 238.481  1.00 25.59           O
ATOM   6018  N    ILE C  63      51.696  38.094 244.938  1.00 22.55           N
ATOM   6019  CA   ILE C  63      52.016  36.697 245.159  1.00 21.59           C
ATOM   6020  C    ILE C  63      51.485  36.242 246.499  1.00 22.60           C
ATOM   6021  O    ILE C  63      51.745  36.877 247.503  1.00 23.70           O
ATOM   6022  CB   ILE C  63      53.544  36.419 245.067  1.00 20.34           C
ATOM   6023  CG1  ILE C  63      54.081  36.951 243.722  1.00 19.41           C
ATOM   6024  CG2  ILE C  63      53.825  34.930 245.287  1.00 19.33           C
ATOM   6025  CD1  ILE C  63      55.574  36.868 243.502  1.00 18.25           C
ATOM   6026  N    ASP C  64      50.760  35.129 246.503  1.00 23.87           N
ATOM   6027  CA   ASP C  64      50.305  34.503 247.733  1.00 25.56           C
ATOM   6028  C    ASP C  64      51.397  34.402 248.803  1.00 25.08           C
ATOM   6029  O    ASP C  64      52.546  34.126 248.492  1.00 23.65           O
ATOM   6030  CB   ASP C  64      49.827  33.070 247.467  1.00 27.40           C
ATOM   6031  CG   ASP C  64      48.493  32.991 246.773  1.00 27.84           C
ATOM   6032  OD1  ASP C  64      47.801  34.014 246.583  1.00 26.72           O
ATOM   6033  OD2  ASP C  64      48.152  31.836 246.437  1.00 31.01           O
ATOM   6034  N    PHE C  65      50.995  34.570 250.065  1.00 25.57           N
ATOM   6035  CA   PHE C  65      51.846  34.391 251.251  1.00 25.72           C
ATOM   6036  C    PHE C  65      53.043  35.327 251.421  1.00 25.06           C
ATOM   6037  O    PHE C  65      53.268  35.773 252.516  1.00 27.22           O
ATOM   6038  CB   PHE C  65      52.358  32.965 251.334  1.00 27.33           C
ATOM   6039  CG   PHE C  65      51.308  31.927 251.077  1.00 29.24           C
ATOM   6040  CD1  PHE C  65      50.123  31.924 251.813  1.00 29.33           C
ATOM   6041  CD2  PHE C  65      51.511  30.935 250.110  1.00 28.34           C
ATOM   6042  CE1  PHE C  65      49.164  30.963 251.579  1.00 29.66           C
ATOM   6043  CE2  PHE C  65      50.549  29.979 249.875  1.00 28.57           C
ATOM   6044  CZ   PHE C  65      49.371  29.995 250.607  1.00 29.23           C
ATOM   6045  N    ILE C  66      53.812  35.615 250.374  1.00 24.42           N
ATOM   6046  CA   ILE C  66      55.108  36.287 250.531  1.00 24.09           C
ATOM   6047  C    ILE C  66      55.140  37.780 250.202  1.00 23.06           C
ATOM   6048  O    ILE C  66      56.153  38.466 250.401  1.00 22.18           O
ATOM   6049  CB   ILE C  66      56.224  35.551 249.733  1.00 25.34           C
ATOM   6050  CG1  ILE C  66      55.961  35.559 248.236  1.00 26.02           C
ATOM   6051  CG2  ILE C  66      56.371  34.105 250.225  1.00 26.28           C
ATOM   6052  CD1  ILE C  66      57.199  35.200 247.423  1.00 26.81           C
ATOM   6053  N    SER C  67      54.044  38.280 249.652  1.00 22.61           N
ATOM   6054  CA   SER C  67      53.950  39.681 249.333  1.00 21.65           C
ATOM   6055  C    SER C  67      53.562  40.417 250.643  1.00 22.46           C
```

Appendix 2

```
ATOM   6056  O    SER C  67      52.936  39.835 251.534  1.00 21.98           O
ATOM   6057  CB   SER C  67      52.949  39.889 248.195  1.00 21.57           C
ATOM   6058  OG   SER C  67      51.637  39.481 248.551  1.00 20.70           O
ATOM   6059  N    PRO C  68      53.948  41.693 250.784  1.00 22.03           N
ATOM   6060  CA   PRO C  68      53.766  42.280 252.103  1.00 22.53           C
ATOM   6061  C    PRO C  68      52.301  42.498 252.541  1.00 22.79           C
ATOM   6062  O    PRO C  68      52.012  42.374 253.729  1.00 22.14           O
ATOM   6063  CB   PRO C  68      54.544  43.605 252.013  1.00 23.23           C
ATOM   6064  CG   PRO C  68      54.679  43.896 250.560  1.00 22.46           C
ATOM   6065  CD   PRO C  68      54.682  42.569 249.864  1.00 22.42           C
ATOM   6066  N    PHE C  69      51.399  42.781 251.602  1.00 22.57           N
ATOM   6067  CA   PHE C  69      49.993  43.023 251.941  1.00 23.22           C
ATOM   6068  C    PHE C  69      49.037  41.891 251.585  1.00 22.17           C
ATOM   6069  O    PHE C  69      47.852  42.109 251.364  1.00 23.33           O
ATOM   6070  CB   PHE C  69      49.547  44.355 251.349  1.00 24.42           C
ATOM   6071  CG   PHE C  69      50.317  45.501 251.901  1.00 25.60           C
ATOM   6072  CD1  PHE C  69      49.920  46.097 253.074  1.00 25.58           C
ATOM   6073  CD2  PHE C  69      51.508  45.902 251.305  1.00 26.54           C
ATOM   6074  CE1  PHE C  69      50.654  47.118 253.622  1.00 26.70           C
ATOM   6075  CE2  PHE C  69      52.248  46.929 251.846  1.00 26.76           C
ATOM   6076  CZ   PHE C  69      51.832  47.533 253.013  1.00 27.10           C
ATOM   6077  N    TYR C  70      49.555  40.675 251.612  1.00 21.06           N
ATOM   6078  CA   TYR C  70      48.751  39.495 251.395  1.00 20.98           C
ATOM   6079  C    TYR C  70      47.649  39.275 252.460  1.00 21.26           C
ATOM   6080  O    TYR C  70      46.526  38.877 252.136  1.00 22.37           O
ATOM   6081  CB   TYR C  70      49.674  38.267 251.333  1.00 21.43           C
ATOM   6082  CG   TYR C  70      48.919  36.966 251.253  1.00 21.21           C
ATOM   6083  CD1  TYR C  70      48.290  36.573 250.068  1.00 21.50           C
ATOM   6084  CD2  TYR C  70      48.806  36.151 252.359  1.00 21.32           C
ATOM   6085  CE1  TYR C  70      47.572  35.393 249.988  1.00 22.14           C
ATOM   6086  CE2  TYR C  70      48.097  34.968 252.299  1.00 23.30           C
ATOM   6087  CZ   TYR C  70      47.481  34.593 251.107  1.00 23.80           C
ATOM   6088  OH   TYR C  70      46.783  33.412 251.074  1.00 25.82           O
ATOM   6089  N    SER C  71      47.949  39.503 253.726  1.00 20.82           N
ATOM   6090  CA   SER C  71      47.011  39.127 254.766  1.00 21.38           C
ATOM   6091  C    SER C  71      47.243  39.929 256.017  1.00 22.78           C
ATOM   6092  O    SER C  71      48.356  40.359 256.274  1.00 23.68           O
ATOM   6093  CB   SER C  71      47.169  37.636 255.091  1.00 21.20           C
ATOM   6094  OG   SER C  71      47.034  37.375 256.476  1.00 19.83           O
ATOM   6095  N    ARG C  72      46.205  40.082 256.822  1.00 23.93           N
ATOM   6096  CA   ARG C  72      46.316  40.890 258.015  1.00 26.10           C
ATOM   6097  C    ARG C  72      46.873  40.187 259.267  1.00 25.56           C
ATOM   6098  O    ARG C  72      46.896  40.771 260.337  1.00 24.15           O
ATOM   6099  CB   ARG C  72      44.977  41.580 258.302  1.00 28.59           C
ATOM   6100  CG   ARG C  72      43.815  40.705 258.723  1.00 31.15           C
ATOM   6101  CD   ARG C  72      42.785  41.553 259.470  1.00 34.01           C
ATOM   6102  NE   ARG C  72      41.973  42.414 258.598  1.00 35.78           N
ATOM   6103  CZ   ARG C  72      40.634  42.404 258.578  1.00 39.94           C
ATOM   6104  NH1  ARG C  72      39.941  41.588 259.387  1.00 39.70           N
ATOM   6105  NH2  ARG C  72      39.964  43.219 257.760  1.00 40.03           N
ATOM   6106  N    GLY C  73      47.342  38.951 259.125  1.00 26.31           N
ATOM   6107  CA   GLY C  73      47.892  38.208 260.260  1.00 27.64           C
ATOM   6108  C    GLY C  73      49.335  38.601 260.529  1.00 28.04           C
ATOM   6109  O    GLY C  73      49.926  39.349 259.765  1.00 26.38           O
```

Appendix 2

```
ATOM   6110  N    CYS C  74      49.913  38.073 261.603  1.00 29.43           N
ATOM   6111  CA   CYS C  74      51.293  38.418 261.974  1.00 29.01           C
ATOM   6112  C    CYS C  74      52.314  37.541 261.246  1.00 28.41           C
ATOM   6113  O    CYS C  74      53.125  36.889 261.855  1.00 28.35           O
ATOM   6114  CB   CYS C  74      51.472  38.387 263.498  1.00 28.39           C
ATOM   6115  SG   CYS C  74      50.378  39.592 264.334  1.00 30.21           S
ATOM   6116  N    SER C  75      52.249  37.569 259.918  1.00 28.84           N
ATOM   6117  CA   SER C  75      53.237  36.959 259.041  1.00 27.73           C
ATOM   6118  C    SER C  75      54.076  38.080 258.431  1.00 26.24           C
ATOM   6119  O    SER C  75      53.534  39.032 257.892  1.00 24.01           O
ATOM   6120  CB   SER C  75      52.550  36.187 257.913  1.00 28.05           C
ATOM   6121  OG   SER C  75      53.515  35.535 257.095  1.00 30.05           O
ATOM   6122  N    PHE C  76      55.400  37.952 258.505  1.00 26.42           N
ATOM   6123  CA   PHE C  76      56.319  38.976 257.997  1.00 24.84           C
ATOM   6124  C    PHE C  76      57.317  38.416 256.993  1.00 25.36           C
ATOM   6125  O    PHE C  76      58.480  38.797 256.962  1.00 24.41           O
ATOM   6126  CB   PHE C  76      57.009  39.616 259.179  1.00 23.54           C
ATOM   6127  CG   PHE C  76      56.074  40.367 260.025  1.00 22.84           C
ATOM   6128  CD1  PHE C  76      55.361  39.727 261.007  1.00 22.28           C
ATOM   6129  CD2  PHE C  76      55.819  41.706 259.763  1.00 23.89           C
ATOM   6130  CE1  PHE C  76      54.443  40.416 261.769  1.00 22.22           C
ATOM   6131  CE2  PHE C  76      54.901  42.409 260.527  1.00 23.25           C
ATOM   6132  CZ   PHE C  76      54.216  41.760 261.528  1.00 22.24           C
ATOM   6133  N    GLU C  77      56.816  37.550 256.131  1.00 25.83           N
ATOM   6134  CA   GLU C  77      57.651  36.827 255.221  1.00 28.59           C
ATOM   6135  C    GLU C  77      58.271  37.789 254.239  1.00 27.02           C
ATOM   6136  O    GLU C  77      59.454  37.702 253.944  1.00 27.26           O
ATOM   6137  CB   GLU C  77      56.842  35.750 254.474  1.00 32.95           C
ATOM   6138  CG   GLU C  77      55.871  34.953 255.352  1.00 34.94           C
ATOM   6139  CD   GLU C  77      56.000  33.464 255.147  1.00 38.25           C
ATOM   6140  OE1  GLU C  77      55.583  32.697 256.041  1.00 41.39           O
ATOM   6141  OE2  GLU C  77      56.531  33.061 254.091  1.00 41.01           O
ATOM   6142  N    ALA C  78      57.464  38.712 253.730  1.00 27.74           N
ATOM   6143  CA   ALA C  78      57.942  39.710 252.777  1.00 26.34           C
ATOM   6144  C    ALA C  78      59.116  40.484 253.347  1.00 24.92           C
ATOM   6145  O    ALA C  78      59.976  40.900 252.618  1.00 25.13           O
ATOM   6146  CB   ALA C  78      56.834  40.668 252.416  1.00 26.41           C
ATOM   6147  N    TRP C  79      59.154  40.657 254.658  1.00 24.08           N
ATOM   6148  CA   TRP C  79      60.249  41.357 255.296  1.00 22.95           C
ATOM   6149  C    TRP C  79      61.474  40.484 255.537  1.00 23.59           C
ATOM   6150  O    TRP C  79      62.588  40.944 255.375  1.00 23.16           O
ATOM   6151  CB   TRP C  79      59.749  42.013 256.564  1.00 21.40           C
ATOM   6152  CG   TRP C  79      58.907  43.215 256.245  1.00 20.74           C
ATOM   6153  CD1  TRP C  79      59.345  44.484 256.050  1.00 20.29           C
ATOM   6154  CD2  TRP C  79      57.486  43.246 256.045  1.00 19.53           C
ATOM   6155  NE1  TRP C  79      58.286  45.308 255.771  1.00 20.14           N
ATOM   6156  CE2  TRP C  79      57.134  44.581 255.779  1.00 19.58           C
ATOM   6157  CE3  TRP C  79      56.477  42.277 256.092  1.00 18.14           C
ATOM   6158  CZ2  TRP C  79      55.812  44.977 255.550  1.00 19.47           C
ATOM   6159  CZ3  TRP C  79      55.173  42.662 255.868  1.00 17.74           C
ATOM   6160  CH2  TRP C  79      54.847  43.998 255.588  1.00 18.54           C
ATOM   6161  N    GLU C  80      61.264  39.224 255.881  1.00 25.84           N
ATOM   6162  CA   GLU C  80      62.348  38.237 255.964  1.00 27.90           C
ATOM   6163  C    GLU C  80      63.129  38.102 254.640  1.00 28.81           C
```

Appendix 2

```
ATOM   6164  O    GLU C  80      64.359  37.993 254.674  1.00 29.80           O
ATOM   6165  CB   GLU C  80      61.793  36.872 256.434  1.00 31.36           C
ATOM   6166  CG   GLU C  80      61.292  36.863 257.903  1.00 34.77           C
ATOM   6167  CD   GLU C  80      60.213  35.813 258.238  1.00 36.72           C
ATOM   6168  OE1  GLU C  80      60.024  34.829 257.472  1.00 38.51           O
ATOM   6169  OE2  GLU C  80      59.552  35.982 259.296  1.00 36.62           O
ATOM   6170  N    LEU C  81      62.442  38.141 253.483  1.00 28.29           N
ATOM   6171  CA   LEU C  81      63.109  37.970 252.168  1.00 28.32           C
ATOM   6172  C    LEU C  81      63.884  39.206 251.729  1.00 28.49           C
ATOM   6173  O    LEU C  81      64.880  39.112 251.004  1.00 29.23           O
ATOM   6174  CB   LEU C  81      62.103  37.615 251.072  1.00 29.48           C
ATOM   6175  CG   LEU C  81      61.344  36.286 251.184  1.00 29.28           C
ATOM   6176  CD1  LEU C  81      60.089  36.359 250.326  1.00 29.43           C
ATOM   6177  CD2  LEU C  81      62.203  35.095 250.798  1.00 28.11           C
ATOM   6178  N    LYS C  82      63.390  40.364 252.144  1.00 28.05           N
ATOM   6179  CA   LYS C  82      64.132  41.627 252.071  1.00 27.69           C
ATOM   6180  C    LYS C  82      65.288  41.782 253.074  1.00 26.90           C
ATOM   6181  O    LYS C  82      66.063  42.700 252.910  1.00 27.66           O
ATOM   6182  CB   LYS C  82      63.197  42.780 252.375  1.00 27.99           C
ATOM   6183  CG   LYS C  82      62.318  43.250 251.242  1.00 28.83           C
ATOM   6184  CD   LYS C  82      61.273  44.185 251.835  1.00 30.38           C
ATOM   6185  CE   LYS C  82      61.102  45.438 251.026  1.00 31.38           C
ATOM   6186  NZ   LYS C  82      59.975  46.198 251.592  1.00 32.19           N
ATOM   6187  N    HIS C  83      65.366  40.948 254.120  1.00 25.78           N
ATOM   6188  CA   HIS C  83      66.376  41.081 255.203  1.00 25.39           C
ATOM   6189  C    HIS C  83      66.212  42.369 256.021  1.00 23.11           C
ATOM   6190  O    HIS C  83      67.181  43.019 256.413  1.00 23.59           O
ATOM   6191  CB   HIS C  83      67.807  40.979 254.653  1.00 27.09           C
ATOM   6192  CG   HIS C  83      68.034  39.772 253.797  1.00 30.05           C
ATOM   6193  ND1  HIS C  83      68.059  38.489 254.311  1.00 29.01           N
ATOM   6194  CD2  HIS C  83      68.225  39.651 252.459  1.00 30.03           C
ATOM   6195  CE1  HIS C  83      68.262  37.630 253.332  1.00 28.72           C
ATOM   6196  NE2  HIS C  83      68.374  38.309 252.201  1.00 30.75           N
ATOM   6197  N    THR C  84      64.970  42.718 256.285  1.00 20.98           N
ATOM   6198  CA   THR C  84      64.637  43.910 257.014  1.00 20.21           C
ATOM   6199  C    THR C  84      64.949  43.761 258.503  1.00 20.27           C
ATOM   6200  O    THR C  84      64.407  42.894 259.165  1.00 20.27           O
ATOM   6201  CB   THR C  84      63.140  44.169 256.891  1.00 20.35           C
ATOM   6202  OG1  THR C  84      62.733  44.060 255.519  1.00 20.53           O
ATOM   6203  CG2  THR C  84      62.796  45.542 257.434  1.00 21.16           C
ATOM   6204  N    PRO C  85      65.822  44.608 259.055  1.00 20.57           N
ATOM   6205  CA   PRO C  85      66.025  44.461 260.493  1.00 20.30           C
ATOM   6206  C    PRO C  85      64.705  44.656 261.243  1.00 19.75           C
ATOM   6207  O    PRO C  85      63.896  45.499 260.846  1.00 18.04           O
ATOM   6208  CB   PRO C  85      67.004  45.598 260.836  1.00 20.49           C
ATOM   6209  CG   PRO C  85      67.674  45.939 259.565  1.00 20.67           C
ATOM   6210  CD   PRO C  85      66.690  45.640 258.466  1.00 20.99           C
ATOM   6211  N    GLN C  86      64.518  43.896 262.323  1.00 19.58           N
ATOM   6212  CA   GLN C  86      63.297  43.945 263.132  1.00 19.48           C
ATOM   6213  C    GLN C  86      62.911  45.378 263.525  1.00 20.28           C
ATOM   6214  O    GLN C  86      61.741  45.744 263.512  1.00 21.32           O
ATOM   6215  CB   GLN C  86      63.478  43.059 264.378  1.00 18.75           C
ATOM   6216  CG   GLN C  86      62.349  43.087 265.419  1.00 18.69           C
ATOM   6217  CD   GLN C  86      62.224  44.434 266.140  1.00 18.32           C
```

Appendix 2

```
ATOM   6218  OE1 GLN C  86      63.223  45.078 266.428  1.00 19.66           O
ATOM   6219  NE2 GLN C  86      61.006  44.868 266.400  1.00 17.48           N
ATOM   6220  N   ARG C  87      63.901  46.189 263.858  1.00 21.56           N
ATOM   6221  CA  ARG C  87      63.669  47.525 264.419  1.00 21.85           C
ATOM   6222  C   ARG C  87      63.134  48.502 263.411  1.00 23.25           C
ATOM   6223  O   ARG C  87      62.659  49.599 263.763  1.00 24.81           O
ATOM   6224  CB  ARG C  87      64.970  48.086 265.021  1.00 20.90           C
ATOM   6225  CG  ARG C  87      65.487  47.262 266.206  1.00 20.37           C
ATOM   6226  CD  ARG C  87      66.488  48.055 267.008  1.00 19.77           C
ATOM   6227  NE  ARG C  87      67.042  47.330 268.146  1.00 18.81           N
ATOM   6228  CZ  ARG C  87      66.728  47.538 269.419  1.00 19.05           C
ATOM   6229  NH1 ARG C  87      65.819  48.413 269.787  1.00 19.42           N
ATOM   6230  NH2 ARG C  87      67.333  46.853 270.357  1.00 20.05           N
ATOM   6231  N   VAL C  88      63.214  48.094 262.153  1.00 23.95           N
ATOM   6232  CA  VAL C  88      62.971  48.968 261.017  1.00 23.19           C
ATOM   6233  C   VAL C  88      61.599  48.660 260.366  1.00 23.57           C
ATOM   6234  O   VAL C  88      61.036  49.494 259.628  1.00 23.65           O
ATOM   6235  CB  VAL C  88      64.198  48.840 260.075  1.00 23.25           C
ATOM   6236  CG1 VAL C  88      63.842  48.917 258.600  1.00 24.66           C
ATOM   6237  CG2 VAL C  88      65.216  49.905 260.442  1.00 23.38           C
ATOM   6238  N   ILE C  89      61.042  47.485 260.684  1.00 22.88           N
ATOM   6239  CA  ILE C  89      59.769  47.056 260.114  1.00 22.91           C
ATOM   6240  C   ILE C  89      58.669  48.117 260.310  1.00 22.92           C
ATOM   6241  O   ILE C  89      57.877  48.370 259.404  1.00 23.94           O
ATOM   6242  CB  ILE C  89      59.324  45.680 260.675  1.00 21.87           C
ATOM   6243  CG1 ILE C  89      60.277  44.574 260.219  1.00 21.76           C
ATOM   6244  CG2 ILE C  89      57.942  45.337 260.181  1.00 21.66           C
ATOM   6245  CD1 ILE C  89      60.247  43.325 261.078  1.00 21.83           C
ATOM   6246  N   LYS C  90      58.632  48.749 261.476  1.00 22.84           N
ATOM   6247  CA  LYS C  90      57.591  49.726 261.754  1.00 22.72           C
ATOM   6248  C   LYS C  90      57.650  50.876 260.791  1.00 22.93           C
ATOM   6249  O   LYS C  90      56.606  51.383 260.394  1.00 22.31           O
ATOM   6250  CB  LYS C  90      57.638  50.229 263.208  1.00 23.12           C
ATOM   6251  CG  LYS C  90      58.939  50.852 263.662  1.00 23.47           C
ATOM   6252  CD  LYS C  90      58.866  51.325 265.115  1.00 23.99           C
ATOM   6253  CE  LYS C  90      58.871  50.197 266.146  1.00 24.06           C
ATOM   6254  NZ  LYS C  90      60.141  49.408 266.253  1.00 24.00           N
ATOM   6255  N   TYR C  91      58.860  51.282 260.408  1.00 23.47           N
ATOM   6256  CA  TYR C  91      59.013  52.396 259.481  1.00 25.32           C
ATOM   6257  C   TYR C  91      58.569  51.946 258.084  1.00 26.01           C
ATOM   6258  O   TYR C  91      57.864  52.679 257.367  1.00 25.88           O
ATOM   6259  CB  TYR C  91      60.451  52.904 259.484  1.00 27.02           C
ATOM   6260  CG  TYR C  91      60.897  53.272 260.867  1.00 29.68           C
ATOM   6261  CD1 TYR C  91      60.250  54.267 261.578  1.00 32.56           C
ATOM   6262  CD2 TYR C  91      61.927  52.612 261.479  1.00 30.51           C
ATOM   6263  CE1 TYR C  91      60.641  54.598 262.860  1.00 35.53           C
ATOM   6264  CE2 TYR C  91      62.312  52.922 262.764  1.00 32.14           C
ATOM   6265  CZ  TYR C  91      61.672  53.917 263.451  1.00 34.21           C
ATOM   6266  OH  TYR C  91      62.061  54.239 264.735  1.00 36.69           O
ATOM   6267  N   SER C  92      58.948  50.720 257.721  1.00 24.84           N
ATOM   6268  CA  SER C  92      58.572  50.142 256.422  1.00 24.50           C
ATOM   6269  C   SER C  92      57.049  50.136 256.208  1.00 23.62           C
ATOM   6270  O   SER C  92      56.531  50.615 255.186  1.00 21.83           O
ATOM   6271  CB  SER C  92      59.125  48.720 256.314  1.00 23.93           C
```

Appendix 2

```
ATOM   6272  OG  SER C  92      58.477  48.013 255.290  1.00 23.61           O
ATOM   6273  N   ILE C  93      56.346  49.606 257.196  1.00 22.84           N
ATOM   6274  CA  ILE C  93      54.899  49.551 257.149  1.00 22.80           C
ATOM   6275  C   ILE C  93      54.358  50.966 257.089  1.00 21.66           C
ATOM   6276  O   ILE C  93      53.488  51.282 256.279  1.00 24.20           O
ATOM   6277  CB  ILE C  93      54.313  48.785 258.361  1.00 23.30           C
ATOM   6278  CG1 ILE C  93      54.785  47.330 258.351  1.00 23.55           C
ATOM   6279  CG2 ILE C  93      52.784  48.775 258.349  1.00 23.44           C
ATOM   6280  CD1 ILE C  93      54.479  46.568 259.630  1.00 23.86           C
ATOM   6281  N   ALA C  94      54.884  51.826 257.920  1.00 21.18           N
ATOM   6282  CA  ALA C  94      54.348  53.170 257.997  1.00 22.60           C
ATOM   6283  C   ALA C  94      54.542  53.932 256.692  1.00 22.61           C
ATOM   6284  O   ALA C  94      53.621  54.602 256.250  1.00 23.93           O
ATOM   6285  CB  ALA C  94      54.953  53.937 259.167  1.00 22.68           C
ATOM   6286  N   PHE C  95      55.698  53.807 256.045  1.00 22.32           N
ATOM   6287  CA  PHE C  95      55.891  54.513 254.778  1.00 22.63           C
ATOM   6288  C   PHE C  95      55.113  53.937 253.586  1.00 21.78           C
ATOM   6289  O   PHE C  95      54.644  54.673 252.724  1.00 20.17           O
ATOM   6290  CB  PHE C  95      57.369  54.661 254.465  1.00 23.47           C
ATOM   6291  CG  PHE C  95      58.112  55.497 255.472  1.00 24.14           C
ATOM   6292  CD1 PHE C  95      57.668  56.747 255.802  1.00 24.91           C
ATOM   6293  CD2 PHE C  95      59.257  55.022 256.085  1.00 24.95           C
ATOM   6294  CE1 PHE C  95      58.345  57.518 256.731  1.00 27.03           C
ATOM   6295  CE2 PHE C  95      59.936  55.774 257.029  1.00 25.66           C
ATOM   6296  CZ  PHE C  95      59.481  57.022 257.361  1.00 26.44           C
ATOM   6297  N   TYR C  96      54.978  52.623 253.544  1.00 22.92           N
ATOM   6298  CA  TYR C  96      54.061  51.995 252.602  1.00 23.98           C
ATOM   6299  C   TYR C  96      52.686  52.613 252.786  1.00 24.10           C
ATOM   6300  O   TYR C  96      52.018  52.955 251.803  1.00 22.27           O
ATOM   6301  CB  TYR C  96      53.917  50.493 252.850  1.00 23.78           C
ATOM   6302  CG  TYR C  96      54.943  49.609 252.193  1.00 23.68           C
ATOM   6303  CD1 TYR C  96      55.292  49.785 250.867  1.00 25.05           C
ATOM   6304  CD2 TYR C  96      55.511  48.552 252.874  1.00 22.68           C
ATOM   6305  CE1 TYR C  96      56.213  48.953 250.248  1.00 24.63           C
ATOM   6306  CE2 TYR C  96      56.430  47.721 252.266  1.00 23.14           C
ATOM   6307  CZ  TYR C  96      56.773  47.927 250.952  1.00 23.80           C
ATOM   6308  OH  TYR C  96      57.678  47.124 250.323  1.00 24.10           O
ATOM   6309  N   ALA C  97      52.272  52.742 254.044  1.00 23.40           N
ATOM   6310  CA  ALA C  97      50.963  53.287 254.344  1.00 25.31           C
ATOM   6311  C   ALA C  97      50.785  54.738 253.909  1.00 25.98           C
ATOM   6312  O   ALA C  97      49.720  55.098 253.437  1.00 29.16           O
ATOM   6313  CB  ALA C  97      50.673  53.171 255.822  1.00 26.54           C
ATOM   6314  N   TYR C  98      51.815  55.561 254.061  1.00 26.29           N
ATOM   6315  CA  TYR C  98      51.741  56.972 253.643  1.00 26.60           C
ATOM   6316  C   TYR C  98      51.657  57.079 252.127  1.00 27.19           C
ATOM   6317  O   TYR C  98      50.970  57.948 251.582  1.00 28.32           O
ATOM   6318  CB  TYR C  98      52.941  57.781 254.199  1.00 25.77           C
ATOM   6319  CG  TYR C  98      53.087  57.695 255.727  1.00 24.10           C
ATOM   6320  CD1 TYR C  98      51.985  57.442 256.520  1.00 23.90           C
ATOM   6321  CD2 TYR C  98      54.320  57.887 256.364  1.00 23.65           C
ATOM   6322  CE1 TYR C  98      52.085  57.367 257.880  1.00 24.81           C
ATOM   6323  CE2 TYR C  98      54.432  57.811 257.742  1.00 23.19           C
ATOM   6324  CZ  TYR C  98      53.296  57.550 258.484  1.00 25.08           C
ATOM   6325  OH  TYR C  98      53.291  57.436 259.848  1.00 26.25           O
```

Appendix 2

```
ATOM   6326  N    GLY C  99      52.357  56.182 251.448  1.00 27.88           N
ATOM   6327  CA   GLY C  99      52.286  56.108 249.992  1.00 27.87           C
ATOM   6328  C    GLY C  99      50.916  55.646 249.551  1.00 26.86           C
ATOM   6329  O    GLY C  99      50.310  56.259 248.692  1.00 30.05           O
ATOM   6330  N    LEU C 100      50.425  54.575 250.156  1.00 24.57           N
ATOM   6331  CA   LEU C 100      49.121  54.043 249.828  1.00 23.42           C
ATOM   6332  C    LEU C 100      48.021  55.087 249.945  1.00 23.09           C
ATOM   6333  O    LEU C 100      47.016  55.027 249.217  1.00 22.56           O
ATOM   6334  CB   LEU C 100      48.780  52.868 250.738  1.00 22.84           C
ATOM   6335  CG   LEU C 100      49.511  51.561 250.433  1.00 22.60           C
ATOM   6336  CD1  LEU C 100      49.323  50.583 251.582  1.00 22.44           C
ATOM   6337  CD2  LEU C 100      49.030  50.955 249.140  1.00 22.92           C
ATOM   6338  N    ALA C 101      48.187  56.019 250.868  1.00 23.01           N
ATOM   6339  CA   ALA C 101      47.198  57.068 251.053  1.00 24.15           C
ATOM   6340  C    ALA C 101      47.109  57.969 249.811  1.00 25.14           C
ATOM   6341  O    ALA C 101      45.997  58.368 249.397  1.00 24.90           O
ATOM   6342  CB   ALA C 101      47.538  57.897 252.267  1.00 24.46           C
ATOM   6343  N    SER C 102      48.259  58.230 249.216  1.00 23.58           N
ATOM   6344  CA   SER C 102      48.280  59.159 248.056  1.00 24.90           C
ATOM   6345  C    SER C 102      47.737  58.432 246.824  1.00 25.32           C
ATOM   6346  O    SER C 102      47.014  59.005 246.008  1.00 24.71           O
ATOM   6347  CB   SER C 102      49.672  59.758 247.819  1.00 25.43           C
ATOM   6348  OG   SER C 102      49.945  60.762 248.807  1.00 26.31           O
ATOM   6349  N    VAL C 103      48.052  57.160 246.710  1.00 25.67           N
ATOM   6350  CA   VAL C 103      47.467  56.361 245.670  1.00 26.55           C
ATOM   6351  C    VAL C 103      45.950  56.462 245.726  1.00 26.93           C
ATOM   6352  O    VAL C 103      45.301  56.562 244.689  1.00 27.69           O
ATOM   6353  CB   VAL C 103      47.899  54.909 245.787  1.00 27.41           C
ATOM   6354  CG1  VAL C 103      47.123  54.036 244.808  1.00 28.79           C
ATOM   6355  CG2  VAL C 103      49.386  54.809 245.513  1.00 27.97           C
ATOM   6356  N    ALA C 104      45.371  56.444 246.919  1.00 26.89           N
ATOM   6357  CA   ALA C 104      43.913  56.593 247.022  1.00 27.23           C
ATOM   6358  C    ALA C 104      43.453  57.944 246.440  1.00 28.17           C
ATOM   6359  O    ALA C 104      42.416  58.033 245.823  1.00 28.10           O
ATOM   6360  CB   ALA C 104      43.474  56.457 248.464  1.00 26.86           C
ATOM   6361  N    LEU C 105      44.252  58.985 246.659  1.00 30.15           N
ATOM   6362  CA   LEU C 105      43.997  60.313 246.135  1.00 30.72           C
ATOM   6363  C    LEU C 105      44.192  60.375 244.634  1.00 31.24           C
ATOM   6364  O    LEU C 105      43.489  61.105 243.964  1.00 32.67           O
ATOM   6365  CB   LEU C 105      44.941  61.337 246.765  1.00 31.74           C
ATOM   6366  CG   LEU C 105      44.449  62.343 247.794  1.00 33.30           C
ATOM   6367  CD1  LEU C 105      45.428  63.520 247.846  1.00 33.14           C
ATOM   6368  CD2  LEU C 105      43.045  62.836 247.456  1.00 35.55           C
ATOM   6369  N    ILE C 106      45.147  59.617 244.111  1.00 31.47           N
ATOM   6370  CA   ILE C 106      45.458  59.633 242.684  1.00 31.12           C
ATOM   6371  C    ILE C 106      44.439  58.930 241.788  1.00 32.09           C
ATOM   6372  O    ILE C 106      43.941  59.536 240.858  1.00 35.55           O
ATOM   6373  CB   ILE C 106      46.848  59.041 242.422  1.00 31.46           C
ATOM   6374  CG1  ILE C 106      47.931  60.052 242.812  1.00 30.53           C
ATOM   6375  CG2  ILE C 106      46.997  58.629 240.956  1.00 33.04           C
ATOM   6376  CD1  ILE C 106      49.316  59.449 242.769  1.00 31.18           C
ATOM   6377  N    ASP C 107      44.173  57.653 242.032  1.00 32.68           N
ATOM   6378  CA   ASP C 107      43.339  56.847 241.140  1.00 34.16           C
ATOM   6379  C    ASP C 107      42.176  56.308 241.945  1.00 33.27           C
```

Appendix 2

```
ATOM   6380  O   ASP C 107      42.328  55.342 242.697  1.00 32.29           O
ATOM   6381  CB  ASP C 107      44.153  55.689 240.524  1.00 35.67           C
ATOM   6382  CG  ASP C 107      43.421  54.982 239.336  1.00 37.54           C
ATOM   6383  OD1 ASP C 107      42.155  55.013 239.278  1.00 36.51           O
ATOM   6384  OD2 ASP C 107      44.134  54.382 238.467  1.00 36.24           O
ATOM   6385  N   PRO C 108      41.012  56.936 241.806  1.00 32.38           N
ATOM   6386  CA  PRO C 108      39.865  56.526 242.596  1.00 31.98           C
ATOM   6387  C   PRO C 108      39.436  55.101 242.337  1.00 31.10           C
ATOM   6388  O   PRO C 108      38.749  54.518 243.176  1.00 30.26           O
ATOM   6389  CB  PRO C 108      38.764  57.503 242.155  1.00 32.83           C
ATOM   6390  CG  PRO C 108      39.496  58.723 241.695  1.00 33.04           C
ATOM   6391  CD  PRO C 108      40.744  58.175 241.048  1.00 34.28           C
ATOM   6392  N   LYS C 109      39.821  54.559 241.179  1.00 30.75           N
ATOM   6393  CA  LYS C 109      39.601  53.144 240.856  1.00 31.36           C
ATOM   6394  C   LYS C 109      40.481  52.230 241.766  1.00 30.41           C
ATOM   6395  O   LYS C 109      40.240  51.032 241.882  1.00 28.23           O
ATOM   6396  CB  LYS C 109      39.854  52.893 239.349  1.00 30.03           C
ATOM   6397  N   LEU C 110      41.471  52.834 242.426  1.00 30.24           N
ATOM   6398  CA  LEU C 110      42.409  52.143 243.296  1.00 29.91           C
ATOM   6399  C   LEU C 110      42.172  52.410 244.780  1.00 29.69           C
ATOM   6400  O   LEU C 110      42.843  51.832 245.625  1.00 32.29           O
ATOM   6401  CB  LEU C 110      43.830  52.590 242.945  1.00 29.82           C
ATOM   6402  CG  LEU C 110      44.334  52.120 241.589  1.00 29.06           C
ATOM   6403  CD1 LEU C 110      45.670  52.752 241.238  1.00 28.59           C
ATOM   6404  CD2 LEU C 110      44.450  50.600 241.607  1.00 29.31           C
ATOM   6405  N   ARG C 111      41.231  53.280 245.107  1.00 28.71           N
ATOM   6406  CA  ARG C 111      41.002  53.677 246.499  1.00 27.97           C
ATOM   6407  C   ARG C 111      40.509  52.510 247.375  1.00 26.31           C
ATOM   6408  O   ARG C 111      40.782  52.432 248.550  1.00 25.27           O
ATOM   6409  CB  ARG C 111      40.000  54.837 246.523  1.00 28.34           C
ATOM   6410  CG  ARG C 111      39.496  55.247 247.897  1.00 29.13           C
ATOM   6411  CD  ARG C 111      39.089  56.713 247.902  1.00 28.98           C
ATOM   6412  NE  ARG C 111      38.666  57.175 249.222  1.00 29.97           N
ATOM   6413  CZ  ARG C 111      38.621  58.455 249.596  1.00 29.69           C
ATOM   6414  NH1 ARG C 111      38.967  59.412 248.758  1.00 29.88           N
ATOM   6415  NH2 ARG C 111      38.239  58.785 250.818  1.00 29.10           N
ATOM   6416  N   ALA C 112      39.744  51.607 246.801  1.00 27.00           N
ATOM   6417  CA  ALA C 112      39.306  50.443 247.557  1.00 26.68           C
ATOM   6418  C   ALA C 112      40.531  49.561 247.920  1.00 25.63           C
ATOM   6419  O   ALA C 112      40.672  49.125 249.052  1.00 25.49           O
ATOM   6420  CB  ALA C 112      38.253  49.660 246.769  1.00 25.52           C
ATOM   6421  N   LEU C 113      41.402  49.328 246.949  1.00 24.49           N
ATOM   6422  CA  LEU C 113      42.633  48.615 247.157  1.00 24.26           C
ATOM   6423  C   LEU C 113      43.541  49.308 248.206  1.00 24.98           C
ATOM   6424  O   LEU C 113      43.972  48.684 249.184  1.00 24.53           O
ATOM   6425  CB  LEU C 113      43.358  48.495 245.828  1.00 24.79           C
ATOM   6426  CG  LEU C 113      44.637  47.666 245.906  1.00 27.48           C
ATOM   6427  CD1 LEU C 113      44.332  46.187 246.148  1.00 28.23           C
ATOM   6428  CD2 LEU C 113      45.485  47.838 244.654  1.00 28.03           C
ATOM   6429  N   ALA C 114      43.839  50.588 248.023  1.00 24.29           N
ATOM   6430  CA  ALA C 114      44.611  51.318 249.028  1.00 24.00           C
ATOM   6431  C   ALA C 114      44.003  51.110 250.401  1.00 24.52           C
ATOM   6432  O   ALA C 114      44.715  50.827 251.374  1.00 25.71           O
ATOM   6433  CB  ALA C 114      44.639  52.805 248.717  1.00 24.00           C
```

Appendix 2

```
ATOM   6434  N    GLY C 115      42.684  51.271 250.486  1.00 23.64           N
ATOM   6435  CA   GLY C 115      41.974  51.132 251.752  1.00 23.71           C
ATOM   6436  C    GLY C 115      42.164  49.748 252.330  1.00 23.78           C
ATOM   6437  O    GLY C 115      42.473  49.592 253.502  1.00 26.25           O
ATOM   6438  N    HIS C 116      41.992  48.731 251.496  1.00 22.71           N
ATOM   6439  CA   HIS C 116      42.247  47.373 251.919  1.00 22.21           C
ATOM   6440  C    HIS C 116      43.680  47.181 252.419  1.00 22.71           C
ATOM   6441  O    HIS C 116      43.893  46.627 253.490  1.00 23.66           O
ATOM   6442  CB   HIS C 116      42.010  46.428 250.775  1.00 22.05           C
ATOM   6443  CG   HIS C 116      42.430  45.027 251.067  1.00 22.18           C
ATOM   6444  ND1  HIS C 116      43.495  44.422 250.429  1.00 22.00           N
ATOM   6445  CD2  HIS C 116      41.933  44.112 251.925  1.00 21.18           C
ATOM   6446  CE1  HIS C 116      43.629  43.189 250.875  1.00 21.13           C
ATOM   6447  NE2  HIS C 116      42.698  42.981 251.787  1.00 21.64           N
ATOM   6448  N    ASP C 117      44.660  47.620 251.636  1.00 22.02           N
ATOM   6449  CA   ASP C 117      46.069  47.564 252.053  1.00 21.18           C
ATOM   6450  C    ASP C 117      46.341  48.310 253.374  1.00 23.10           C
ATOM   6451  O    ASP C 117      47.205  47.912 254.159  1.00 22.72           O
ATOM   6452  CB   ASP C 117      46.968  48.137 250.957  1.00 19.89           C
ATOM   6453  CG   ASP C 117      47.214  47.151 249.797  1.00 18.87           C
ATOM   6454  OD1  ASP C 117      46.813  45.956 249.884  1.00 17.66           O
ATOM   6455  OD2  ASP C 117      47.832  47.583 248.801  1.00 17.40           O
ATOM   6456  N    LEU C 118      45.607  49.391 253.621  1.00 24.34           N
ATOM   6457  CA   LEU C 118      45.839  50.193 254.810  1.00 24.15           C
ATOM   6458  C    LEU C 118      45.330  49.469 256.051  1.00 23.12           C
ATOM   6459  O    LEU C 118      45.962  49.495 257.099  1.00 21.98           O
ATOM   6460  CB   LEU C 118      45.160  51.557 254.672  1.00 25.41           C
ATOM   6461  CG   LEU C 118      45.977  52.594 253.900  1.00 26.31           C
ATOM   6462  CD1  LEU C 118      45.148  53.865 253.619  1.00 26.18           C
ATOM   6463  CD2  LEU C 118      47.264  52.920 254.654  1.00 25.88           C
ATOM   6464  N    ASP C 119      44.162  48.857 255.929  1.00 23.27           N
ATOM   6465  CA   ASP C 119      43.645  47.969 256.959  1.00 23.41           C
ATOM   6466  C    ASP C 119      44.705  46.919 257.332  1.00 22.31           C
ATOM   6467  O    ASP C 119      44.899  46.607 258.500  1.00 21.69           O
ATOM   6468  CB   ASP C 119      42.357  47.293 256.458  1.00 23.43           C
ATOM   6469  CG   ASP C 119      41.716  46.389 257.491  1.00 23.94           C
ATOM   6470  OD1  ASP C 119      41.883  46.579 258.714  1.00 25.05           O
ATOM   6471  OD2  ASP C 119      41.023  45.460 257.065  1.00 25.24           O
ATOM   6472  N    ILE C 120      45.410  46.392 256.348  1.00 22.05           N
ATOM   6473  CA   ILE C 120      46.427  45.387 256.641  1.00 23.45           C
ATOM   6474  C    ILE C 120      47.644  45.990 257.331  1.00 24.27           C
ATOM   6475  O    ILE C 120      48.250  45.366 258.220  1.00 25.87           O
ATOM   6476  CB   ILE C 120      46.846  44.620 255.381  1.00 23.71           C
ATOM   6477  CG1  ILE C 120      45.713  43.662 254.963  1.00 23.94           C
ATOM   6478  CG2  ILE C 120      48.108  43.814 255.641  1.00 23.93           C
ATOM   6479  CD1  ILE C 120      45.838  43.136 253.547  1.00 24.73           C
ATOM   6480  N    ALA C 121      47.992  47.207 256.929  1.00 23.60           N
ATOM   6481  CA   ALA C 121      49.116  47.909 257.502  1.00 22.26           C
ATOM   6482  C    ALA C 121      48.891  48.147 258.995  1.00 21.15           C
ATOM   6483  O    ALA C 121      49.768  47.883 259.828  1.00 20.92           O
ATOM   6484  CB   ALA C 121      49.322  49.226 256.766  1.00 22.97           C
ATOM   6485  N    VAL C 122      47.709  48.642 259.329  1.00 19.55           N
ATOM   6486  CA   VAL C 122      47.350  48.892 260.713  1.00 18.09           C
ATOM   6487  C    VAL C 122      47.440  47.546 261.426  1.00 18.88           C
```

Appendix 2

```
ATOM   6488  O    VAL C 122      48.004  47.475 262.504  1.00 19.06           O
ATOM   6489  CB   VAL C 122      45.965  49.564 260.796  1.00 17.09           C
ATOM   6490  CG1  VAL C 122      45.400  49.607 262.198  1.00 17.26           C
ATOM   6491  CG2  VAL C 122      46.046  50.972 260.247  1.00 16.98           C
ATOM   6492  N    SER C 123      46.957  46.462 260.820  1.00 19.75           N
ATOM   6493  CA   SER C 123      46.983  45.160 261.510  1.00 21.17           C
ATOM   6494  C    SER C 123      48.388  44.658 261.733  1.00 22.06           C
ATOM   6495  O    SER C 123      48.734  44.302 262.845  1.00 23.88           O
ATOM   6496  CB   SER C 123      46.197  44.091 260.777  1.00 21.14           C
ATOM   6497  OG   SER C 123      44.845  44.471 260.719  1.00 22.69           O
ATOM   6498  N    LYS C 124      49.220  44.657 260.702  1.00 21.75           N
ATOM   6499  CA   LYS C 124      50.587  44.188 260.891  1.00 21.46           C
ATOM   6500  C    LYS C 124      51.339  45.046 261.925  1.00 21.37           C
ATOM   6501  O    LYS C 124      52.139  44.547 262.717  1.00 21.09           O
ATOM   6502  CB   LYS C 124      51.314  44.156 259.560  1.00 21.09           C
ATOM   6503  CG   LYS C 124      50.747  43.108 258.627  1.00 21.57           C
ATOM   6504  CD   LYS C 124      51.781  42.666 257.613  1.00 22.63           C
ATOM   6505  CE   LYS C 124      51.338  41.510 256.723  1.00 22.76           C
ATOM   6506  NZ   LYS C 124      50.829  40.362 257.509  1.00 22.98           N
ATOM   6507  N    MET C 125      51.042  46.335 261.928  1.00 21.40           N
ATOM   6508  CA   MET C 125      51.725  47.302 262.784  1.00 21.61           C
ATOM   6509  C    MET C 125      51.495  47.001 264.257  1.00 21.96           C
ATOM   6510  O    MET C 125      52.335  47.294 265.068  1.00 20.65           O
ATOM   6511  CB   MET C 125      51.225  48.709 262.443  1.00 21.31           C
ATOM   6512  CG   MET C 125      52.036  49.848 263.011  1.00 21.90           C
ATOM   6513  SD   MET C 125      53.643  50.037 262.230  1.00 21.91           S
ATOM   6514  CE   MET C 125      54.170  51.573 262.937  1.00 19.90           C
ATOM   6515  N    LYS C 126      50.343  46.415 264.587  1.00 24.89           N
ATOM   6516  CA   LYS C 126      49.971  46.071 265.966  1.00 24.75           C
ATOM   6517  C    LYS C 126      50.613  44.753 266.422  1.00 24.45           C
ATOM   6518  O    LYS C 126      50.506  44.395 267.581  1.00 23.64           O
ATOM   6519  CB   LYS C 126      48.433  45.994 266.102  1.00 25.95           C
ATOM   6520  CG   LYS C 126      47.738  47.348 266.243  1.00 26.43           C
ATOM   6521  CD   LYS C 126      46.442  47.468 265.452  1.00 29.82           C
ATOM   6522  CE   LYS C 126      45.310  46.542 265.908  1.00 31.25           C
ATOM   6523  NZ   LYS C 126      44.678  46.996 267.167  1.00 32.23           N
ATOM   6524  N    CYS C 127      51.286  44.038 265.519  1.00 24.60           N
ATOM   6525  CA   CYS C 127      51.906  42.747 265.872  1.00 24.63           C
ATOM   6526  C    CYS C 127      53.143  42.900 266.734  1.00 23.50           C
ATOM   6527  O    CYS C 127      53.968  43.791 266.518  1.00 21.85           O
ATOM   6528  CB   CYS C 127      52.286  41.954 264.634  1.00 25.00           C
ATOM   6529  SG   CYS C 127      50.893  41.441 263.612  1.00 26.21           S
ATOM   6530  N    LYS C 128      53.285  41.993 267.690  1.00 22.55           N
ATOM   6531  CA   LYS C 128      54.400  42.062 268.590  1.00 22.68           C
ATOM   6532  C    LYS C 128      55.763  42.028 267.840  1.00 20.77           C
ATOM   6533  O    LYS C 128      56.687  42.741 268.187  1.00 20.57           O
ATOM   6534  CB   LYS C 128      54.273  40.994 269.667  1.00 24.70           C
ATOM   6535  CG   LYS C 128      55.524  40.848 270.525  1.00 28.08           C
ATOM   6536  CD   LYS C 128      55.216  40.831 272.010  1.00 30.21           C
ATOM   6537  CE   LYS C 128      56.458  40.494 272.800  1.00 31.17           C
ATOM   6538  NZ   LYS C 128      56.104  40.527 274.232  1.00 34.25           N
ATOM   6539  N    ARG C 129      55.888  41.268 266.779  1.00 19.96           N
ATOM   6540  CA   ARG C 129      57.127  41.308 265.986  1.00 20.24           C
ATOM   6541  C    ARG C 129      57.576  42.743 265.578  1.00 20.89           C
```

Appendix 2

```
ATOM   6542  O    ARG C 129      58.766  43.020 265.455  1.00 21.08           O
ATOM   6543  CB   ARG C 129      56.933  40.416 264.753  1.00 20.40           C
ATOM   6544  CG   ARG C 129      58.040  40.417 263.720  1.00 20.28           C
ATOM   6545  CD   ARG C 129      59.362  40.092 264.353  1.00 20.52           C
ATOM   6546  NE   ARG C 129      60.430  39.984 263.370  1.00 19.97           N
ATOM   6547  CZ   ARG C 129      61.701  39.786 263.694  1.00 18.55           C
ATOM   6548  NH1  ARG C 129      62.058  39.699 264.969  1.00 18.30           N
ATOM   6549  NH2  ARG C 129      62.613  39.685 262.745  1.00 17.66           N
ATOM   6550  N    VAL C 130      56.622  43.651 265.381  1.00 21.03           N
ATOM   6551  CA   VAL C 130      56.914  45.010 264.933  1.00 20.81           C
ATOM   6552  C    VAL C 130      57.323  45.939 266.091  1.00 20.42           C
ATOM   6553  O    VAL C 130      58.241  46.756 265.940  1.00 18.27           O
ATOM   6554  CB   VAL C 130      55.684  45.600 264.161  1.00 21.28           C
ATOM   6555  CG1  VAL C 130      55.816  47.093 263.900  1.00 21.08           C
ATOM   6556  CG2  VAL C 130      55.472  44.865 262.844  1.00 21.65           C
ATOM   6557  N    TRP C 131      56.600  45.841 267.217  1.00 21.44           N
ATOM   6558  CA   TRP C 131      56.776  46.760 268.367  1.00 20.34           C
ATOM   6559  C    TRP C 131      57.595  46.186 269.503  1.00 20.15           C
ATOM   6560  O    TRP C 131      58.020  46.932 270.396  1.00 20.24           O
ATOM   6561  CB   TRP C 131      55.431  47.252 268.915  1.00 20.03           C
ATOM   6562  CG   TRP C 131      54.489  46.181 269.484  1.00 20.14           C
ATOM   6563  CD1  TRP C 131      53.432  45.628 268.836  1.00 20.44           C
ATOM   6564  CD2  TRP C 131      54.484  45.608 270.809  1.00 18.88           C
ATOM   6565  NE1  TRP C 131      52.794  44.740 269.645  1.00 20.64           N
ATOM   6566  CE2  TRP C 131      53.413  44.712 270.866  1.00 19.81           C
ATOM   6567  CE3  TRP C 131      55.274  45.768 271.940  1.00 18.69           C
ATOM   6568  CZ2  TRP C 131      53.123  43.955 272.005  1.00 19.69           C
ATOM   6569  CZ3  TRP C 131      54.983  45.028 273.068  1.00 18.76           C
ATOM   6570  CH2  TRP C 131      53.922  44.134 273.093  1.00 19.10           C
ATOM   6571  N    GLY C 132      57.824  44.874 269.441  1.00 20.63           N
ATOM   6572  CA   GLY C 132      58.478  44.091 270.502  1.00 20.71           C
ATOM   6573  C    GLY C 132      59.804  44.581 271.040  1.00 20.28           C
ATOM   6574  O    GLY C 132      60.086  44.402 272.208  1.00 21.94           O
ATOM   6575  N    ASP C 133      60.622  45.205 270.212  1.00 20.34           N
ATOM   6576  CA   ASP C 133      61.840  45.839 270.708  1.00 21.08           C
ATOM   6577  C    ASP C 133      61.608  46.684 271.996  1.00 21.86           C
ATOM   6578  O    ASP C 133      62.468  46.718 272.903  1.00 23.01           O
ATOM   6579  CB   ASP C 133      62.489  46.690 269.609  1.00 21.50           C
ATOM   6580  CG   ASP C 133      61.551  47.782 269.052  1.00 21.72           C
ATOM   6581  OD1  ASP C 133      60.584  47.450 268.320  1.00 21.61           O
ATOM   6582  OD2  ASP C 133      61.790  48.969 269.338  1.00 20.65           O
ATOM   6583  N    TRP C 134      60.456  47.347 272.104  1.00 20.71           N
ATOM   6584  CA   TRP C 134      60.166  48.140 273.305  1.00 20.19           C
ATOM   6585  C    TRP C 134      60.316  47.286 274.564  1.00 21.58           C
ATOM   6586  O    TRP C 134      60.893  47.754 275.576  1.00 22.31           O
ATOM   6587  CB   TRP C 134      58.757  48.712 273.247  1.00 18.97           C
ATOM   6588  CG   TRP C 134      58.421  49.646 274.333  1.00 17.43           C
ATOM   6589  CD1  TRP C 134      57.541  49.445 275.374  1.00 17.09           C
ATOM   6590  CD2  TRP C 134      58.961  50.943 274.516  1.00 17.65           C
ATOM   6591  NE1  TRP C 134      57.503  50.556 276.196  1.00 16.15           N
ATOM   6592  CE2  TRP C 134      58.363  51.492 275.690  1.00 16.79           C
ATOM   6593  CE3  TRP C 134      59.914  51.701 273.820  1.00 17.20           C
ATOM   6594  CZ2  TRP C 134      58.686  52.752 276.167  1.00 16.44           C
ATOM   6595  CZ3  TRP C 134      60.223  52.959 274.300  1.00 16.85           C
```

Appendix 2

```
ATOM   6596  CH2 TRP C 134      59.614  53.467 275.472  1.00 16.59           C
ATOM   6597  N   GLU C 135      59.812  46.047 274.498  1.00 20.81           N
ATOM   6598  CA  GLU C 135      59.858  45.152 275.635  1.00 22.11           C
ATOM   6599  C   GLU C 135      61.202  44.452 275.758  1.00 21.73           C
ATOM   6600  O   GLU C 135      61.755  44.401 276.824  1.00 19.26           O
ATOM   6601  CB  GLU C 135      58.736  44.118 275.587  1.00 22.69           C
ATOM   6602  CG  GLU C 135      58.841  43.069 276.683  1.00 23.05           C
ATOM   6603  CD  GLU C 135      57.621  42.186 276.772  1.00 24.25           C
ATOM   6604  OE1 GLU C 135      56.568  42.526 276.224  1.00 28.61           O
ATOM   6605  OE2 GLU C 135      57.701  41.140 277.399  1.00 25.66           O
ATOM   6606  N   GLU C 136      61.713  43.902 274.676  1.00 24.19           N
ATOM   6607  CA  GLU C 136      63.031  43.292 274.731  1.00 27.05           C
ATOM   6608  C   GLU C 136      64.111  44.229 275.285  1.00 24.85           C
ATOM   6609  O   GLU C 136      64.948  43.776 276.020  1.00 24.87           O
ATOM   6610  CB  GLU C 136      63.450  42.758 273.367  1.00 32.27           C
ATOM   6611  CG  GLU C 136      63.271  41.256 273.223  1.00 37.98           C
ATOM   6612  CD  GLU C 136      62.713  40.876 271.866  1.00 44.94           C
ATOM   6613  OE1 GLU C 136      61.656  40.190 271.851  1.00 49.30           O
ATOM   6614  OE2 GLU C 136      63.308  41.284 270.826  1.00 46.36           O
ATOM   6615  N   ASP C 137      64.092  45.519 274.957  1.00 23.54           N
ATOM   6616  CA  ASP C 137      65.061  46.475 275.534  1.00 22.78           C
ATOM   6617  C   ASP C 137      64.782  46.782 277.003  1.00 21.20           C
ATOM   6618  O   ASP C 137      65.599  47.387 277.684  1.00 20.49           O
ATOM   6619  CB  ASP C 137      65.087  47.793 274.746  1.00 24.03           C
ATOM   6620  CG  ASP C 137      65.562  47.620 273.308  1.00 24.81           C
ATOM   6621  OD1 ASP C 137      66.083  46.525 272.965  1.00 27.90           O
ATOM   6622  OD2 ASP C 137      65.417  48.574 272.514  1.00 23.61           O
ATOM   6623  N   GLY C 138      63.621  46.373 277.495  1.00 20.77           N
ATOM   6624  CA  GLY C 138      63.318  46.470 278.926  1.00 19.52           C
ATOM   6625  C   GLY C 138      62.611  47.757 279.290  1.00 18.72           C
ATOM   6626  O   GLY C 138      62.552  48.086 280.447  1.00 18.36           O
ATOM   6627  N   PHE C 139      62.085  48.475 278.299  1.00 18.83           N
ATOM   6628  CA  PHE C 139      61.310  49.704 278.524  1.00 19.78           C
ATOM   6629  C   PHE C 139      59.816  49.497 278.908  1.00 19.68           C
ATOM   6630  O   PHE C 139      59.192  50.426 279.381  1.00 19.58           O
ATOM   6631  CB  PHE C 139      61.350  50.619 277.281  1.00 20.08           C
ATOM   6632  CG  PHE C 139      62.740  51.019 276.839  1.00 20.28           C
ATOM   6633  CD1 PHE C 139      63.638  51.587 277.727  1.00 20.66           C
ATOM   6634  CD2 PHE C 139      63.129  50.858 275.518  1.00 20.26           C
ATOM   6635  CE1 PHE C 139      64.900  51.966 277.313  1.00 20.21           C
ATOM   6636  CE2 PHE C 139      64.387  51.216 275.101  1.00 19.95           C
ATOM   6637  CZ  PHE C 139      65.267  51.794 276.000  1.00 20.29           C
ATOM   6638  N   GLY C 140      59.225  48.321 278.704  1.00 20.06           N
ATOM   6639  CA  GLY C 140      57.801  48.130 279.063  1.00 20.07           C
ATOM   6640  C   GLY C 140      57.106  46.982 278.356  1.00 21.10           C
ATOM   6641  O   GLY C 140      57.557  46.539 277.308  1.00 20.92           O
ATOM   6642  N   THR C 141      56.012  46.488 278.940  1.00 22.89           N
ATOM   6643  CA  THR C 141      55.233  45.390 278.354  1.00 23.34           C
ATOM   6644  C   THR C 141      54.204  45.883 277.369  1.00 23.50           C
ATOM   6645  O   THR C 141      53.798  45.109 276.520  1.00 24.35           O
ATOM   6646  CB  THR C 141      54.501  44.572 279.420  1.00 25.36           C
ATOM   6647  OG1 THR C 141      53.885  45.461 280.347  1.00 27.68           O
ATOM   6648  CG2 THR C 141      55.477  43.685 280.210  1.00 26.62           C
ATOM   6649  N   ASP C 142      53.797  47.155 277.470  1.00 23.25           N
```

Appendix 2

```
ATOM   6650  CA   ASP C 142      52.844  47.782 276.530  1.00 24.91           C
ATOM   6651  C    ASP C 142      53.527  48.876 275.654  1.00 24.66           C
ATOM   6652  O    ASP C 142      54.195  49.750 276.180  1.00 22.29           O
ATOM   6653  CB   ASP C 142      51.674  48.393 277.339  1.00 27.50           C
ATOM   6654  CG   ASP C 142      50.603  49.055 276.467  1.00 29.01           C
ATOM   6655  OD1  ASP C 142      50.929  49.959 275.678  1.00 30.19           O
ATOM   6656  OD2  ASP C 142      49.415  48.711 276.607  1.00 30.85           O
ATOM   6657  N    PRO C 143      53.331  48.844 274.308  1.00 25.27           N
ATOM   6658  CA   PRO C 143      53.983  49.795 273.364  1.00 25.14           C
ATOM   6659  C    PRO C 143      53.384  51.220 273.209  1.00 24.93           C
ATOM   6660  O    PRO C 143      54.023  52.072 272.591  1.00 26.43           O
ATOM   6661  CB   PRO C 143      53.855  49.080 272.022  1.00 24.88           C
ATOM   6662  CG   PRO C 143      52.600  48.303 272.147  1.00 24.28           C
ATOM   6663  CD   PRO C 143      52.460  47.892 273.594  1.00 24.27           C
ATOM   6664  N    ILE C 144      52.193  51.466 273.742  1.00 23.51           N
ATOM   6665  CA   ILE C 144      51.515  52.757 273.578  1.00 24.03           C
ATOM   6666  C    ILE C 144      51.279  53.536 274.894  1.00 24.75           C
ATOM   6667  O    ILE C 144      51.034  54.728 274.820  1.00 24.50           O
ATOM   6668  CB   ILE C 144      50.155  52.599 272.836  1.00 22.55           C
ATOM   6669  CG1  ILE C 144      49.107  51.955 273.744  1.00 22.09           C
ATOM   6670  CG2  ILE C 144      50.326  51.750 271.584  1.00 22.93           C
ATOM   6671  CD1  ILE C 144      47.724  51.912 273.149  1.00 22.61           C
ATOM   6672  N    GLU C 145      51.337  52.867 276.056  1.00 25.79           N
ATOM   6673  CA   GLU C 145      51.020  53.453 277.384  1.00 27.69           C
ATOM   6674  C    GLU C 145      51.732  54.762 277.642  1.00 26.26           C
ATOM   6675  O    GLU C 145      51.201  55.651 278.315  1.00 23.80           O
ATOM   6676  CB   GLU C 145      51.474  52.523 278.536  1.00 32.48           C
ATOM   6677  CG   GLU C 145      50.443  51.575 279.187  1.00 36.66           C
ATOM   6678  CD   GLU C 145      51.091  50.584 280.221  1.00 38.88           C
ATOM   6679  OE1  GLU C 145      50.350  50.033 281.089  1.00 37.68           O
ATOM   6680  OE2  GLU C 145      52.340  50.351 280.167  1.00 34.41           O
ATOM   6681  N    LYS C 146      52.957  54.847 277.138  1.00 25.50           N
ATOM   6682  CA   LYS C 146      53.972  55.720 277.712  1.00 26.62           C
ATOM   6683  C    LYS C 146      55.166  55.876 276.749  1.00 25.07           C
ATOM   6684  O    LYS C 146      55.812  54.895 276.396  1.00 23.44           O
ATOM   6685  CB   LYS C 146      54.453  55.079 279.020  1.00 27.41           C
ATOM   6686  CG   LYS C 146      55.067  56.045 279.980  1.00 30.61           C
ATOM   6687  CD   LYS C 146      55.606  55.397 281.267  1.00 32.31           C
ATOM   6688  CE   LYS C 146      56.586  56.365 281.937  1.00 33.72           C
ATOM   6689  NZ   LYS C 146      56.575  56.339 283.430  1.00 35.48           N
ATOM   6690  N    GLU C 147      55.475  57.091 276.321  1.00 23.26           N
ATOM   6691  CA   GLU C 147      56.711  57.288 275.578  1.00 22.58           C
ATOM   6692  C    GLU C 147      56.591  56.519 274.246  1.00 21.59           C
ATOM   6693  O    GLU C 147      55.481  56.379 273.711  1.00 21.73           O
ATOM   6694  CB   GLU C 147      57.937  56.837 276.439  1.00 22.09           C
ATOM   6695  CG   GLU C 147      58.069  57.611 277.750  1.00 22.38           C
ATOM   6696  CD   GLU C 147      59.006  57.002 278.802  1.00 23.60           C
ATOM   6697  OE1  GLU C 147      59.230  55.767 278.830  1.00 24.74           O
ATOM   6698  OE2  GLU C 147      59.517  57.780 279.650  1.00 24.15           O
ATOM   6699  N    ASN C 148      57.723  56.060 273.715  1.00 19.46           N
ATOM   6700  CA   ASN C 148      57.786  55.268 272.504  1.00 18.26           C
ATOM   6701  C    ASN C 148      57.040  55.931 271.372  1.00 19.30           C
ATOM   6702  O    ASN C 148      56.252  55.289 270.675  1.00 17.33           O
ATOM   6703  CB   ASN C 148      57.252  53.858 272.768  1.00 17.19           C
```

Appendix 2

```
ATOM   6704  CG   ASN C 148      57.576  52.866 271.654  1.00 16.00           C
ATOM   6705  OD1  ASN C 148      58.601  52.958 270.991  1.00 15.17           O
ATOM   6706  ND2  ASN C 148      56.701  51.887 271.475  1.00 15.79           N
ATOM   6707  N    ILE C 149      57.306  57.222 271.180  1.00 22.15           N
ATOM   6708  CA   ILE C 149      56.638  57.977 270.120  1.00 24.96           C
ATOM   6709  C    ILE C 149      57.078  57.535 268.729  1.00 27.46           C
ATOM   6710  O    ILE C 149      56.304  57.630 267.782  1.00 31.48           O
ATOM   6711  CB   ILE C 149      56.751  59.507 270.320  1.00 25.88           C
ATOM   6712  CG1  ILE C 149      55.642  60.229 269.551  1.00 26.27           C
ATOM   6713  CG2  ILE C 149      58.109  60.040 269.914  1.00 27.48           C
ATOM   6714  CD1  ILE C 149      54.218  59.926 270.028  1.00 25.09           C
ATOM   6715  N    MET C 150      58.290  57.009 268.593  1.00 28.99           N
ATOM   6716  CA   MET C 150      58.698  56.424 267.301  1.00 30.27           C
ATOM   6717  C    MET C 150      57.678  55.455 266.773  1.00 27.10           C
ATOM   6718  O    MET C 150      57.329  55.491 265.630  1.00 28.35           O
ATOM   6719  CB   MET C 150      60.033  55.689 267.392  1.00 35.04           C
ATOM   6720  CG   MET C 150      60.194  54.709 268.542  1.00 38.96           C
ATOM   6721  SD   MET C 150      61.926  54.222 268.727  1.00 46.45           S
ATOM   6722  CE   MET C 150      61.817  53.536 270.384  1.00 45.04           C
ATOM   6723  N    TYR C 151      57.203  54.570 267.614  1.00 24.29           N
ATOM   6724  CA   TYR C 151      56.257  53.582 267.153  1.00 22.39           C
ATOM   6725  C    TYR C 151      54.840  54.174 267.012  1.00 21.33           C
ATOM   6726  O    TYR C 151      54.228  54.124 265.948  1.00 19.26           O
ATOM   6727  CB   TYR C 151      56.227  52.431 268.137  1.00 20.25           C
ATOM   6728  CG   TYR C 151      55.105  51.477 267.882  1.00 18.52           C
ATOM   6729  CD1  TYR C 151      55.114  50.672 266.772  1.00 18.65           C
ATOM   6730  CD2  TYR C 151      54.046  51.387 268.747  1.00 17.78           C
ATOM   6731  CE1  TYR C 151      54.078  49.786 266.521  1.00 18.66           C
ATOM   6732  CE2  TYR C 151      53.011  50.519 268.520  1.00 18.25           C
ATOM   6733  CZ   TYR C 151      53.033  49.711 267.397  1.00 18.29           C
ATOM   6734  OH   TYR C 151      52.028  48.816 267.184  1.00 17.12           O
ATOM   6735  N    LYS C 152      54.348  54.730 268.107  1.00 20.91           N
ATOM   6736  CA   LYS C 152      52.944  55.057 268.238  1.00 21.07           C
ATOM   6737  C    LYS C 152      52.576  56.329 267.509  1.00 21.41           C
ATOM   6738  O    LYS C 152      51.423  56.527 267.223  1.00 23.67           O
ATOM   6739  CB   LYS C 152      52.521  55.106 269.711  1.00 21.24           C
ATOM   6740  CG   LYS C 152      52.874  56.363 270.491  1.00 21.25           C
ATOM   6741  CD   LYS C 152      52.770  56.015 271.969  1.00 22.25           C
ATOM   6742  CE   LYS C 152      52.746  57.215 272.891  1.00 22.53           C
ATOM   6743  NZ   LYS C 152      52.893  56.789 274.305  1.00 22.52           N
ATOM   6744  N    GLY C 153      53.540  57.172 267.171  1.00 21.27           N
ATOM   6745  CA   GLY C 153      53.257  58.288 266.280  1.00 20.87           C
ATOM   6746  C    GLY C 153      52.789  57.794 264.928  1.00 21.40           C
ATOM   6747  O    GLY C 153      51.745  58.212 264.400  1.00 20.93           O
ATOM   6748  N    HIS C 154      53.582  56.901 264.359  1.00 22.15           N
ATOM   6749  CA   HIS C 154      53.264  56.337 263.073  1.00 23.19           C
ATOM   6750  C    HIS C 154      51.894  55.620 263.158  1.00 23.32           C
ATOM   6751  O    HIS C 154      51.046  55.790 262.273  1.00 23.23           O
ATOM   6752  CB   HIS C 154      54.371  55.361 262.597  1.00 23.21           C
ATOM   6753  CG   HIS C 154      55.643  56.032 262.171  1.00 23.37           C
ATOM   6754  ND1  HIS C 154      55.785  56.678 260.964  1.00 22.45           N
ATOM   6755  CD2  HIS C 154      56.830  56.164 262.804  1.00 24.04           C
ATOM   6756  CE1  HIS C 154      57.002  57.172 260.870  1.00 22.24           C
ATOM   6757  NE2  HIS C 154      57.655  56.878 261.979  1.00 23.41           N
```

Appendix 2

```
ATOM   6758  N    LEU C 155      51.668  54.838 264.216  1.00 21.43           N
ATOM   6759  CA   LEU C 155      50.447  54.051 264.274  1.00 21.11           C
ATOM   6760  C    LEU C 155      49.254  54.998 264.288  1.00 22.58           C
ATOM   6761  O    LEU C 155      48.210  54.737 263.674  1.00 21.35           O
ATOM   6762  CB   LEU C 155      50.429  53.152 265.507  1.00 20.67           C
ATOM   6763  CG   LEU C 155      49.193  52.266 265.729  1.00 21.11           C
ATOM   6764  CD1  LEU C 155      48.997  51.287 264.589  1.00 21.17           C
ATOM   6765  CD2  LEU C 155      49.291  51.489 267.039  1.00 21.32           C
ATOM   6766  N    ASN C 156      49.412  56.117 264.993  1.00 23.26           N
ATOM   6767  CA   ASN C 156      48.317  57.045 265.111  1.00 22.91           C
ATOM   6768  C    ASN C 156      47.983  57.753 263.793  1.00 22.17           C
ATOM   6769  O    ASN C 156      46.817  58.028 263.474  1.00 22.20           O
ATOM   6770  CB   ASN C 156      48.606  58.066 266.175  1.00 22.33           C
ATOM   6771  CG   ASN C 156      47.345  58.648 266.724  1.00 22.05           C
ATOM   6772  OD1  ASN C 156      46.473  57.913 267.197  1.00 20.35           O
ATOM   6773  ND2  ASN C 156      47.213  59.962 266.630  1.00 22.46           N
ATOM   6774  N    LEU C 157      49.018  58.053 263.035  1.00 21.31           N
ATOM   6775  CA   LEU C 157      48.837  58.657 261.746  1.00 20.65           C
ATOM   6776  C    LEU C 157      48.216  57.605 260.831  1.00 20.29           C
ATOM   6777  O    LEU C 157      47.310  57.903 260.067  1.00 20.34           O
ATOM   6778  CB   LEU C 157      50.187  59.162 261.241  1.00 20.67           C
ATOM   6779  CG   LEU C 157      50.285  59.906 259.921  1.00 20.64           C
ATOM   6780  CD1  LEU C 157      49.368  61.110 259.887  1.00 20.06           C
ATOM   6781  CD2  LEU C 157      51.725  60.329 259.680  1.00 20.74           C
ATOM   6782  N    MET C 158      48.659  56.360 260.941  1.00 19.60           N
ATOM   6783  CA   MET C 158      48.109  55.319 260.089  1.00 19.40           C
ATOM   6784  C    MET C 158      46.636  55.095 260.371  1.00 19.95           C
ATOM   6785  O    MET C 158      45.866  54.858 259.462  1.00 20.97           O
ATOM   6786  CB   MET C 158      48.874  54.020 260.250  1.00 18.80           C
ATOM   6787  CG   MET C 158      50.250  54.082 259.639  1.00 19.18           C
ATOM   6788  SD   MET C 158      51.356  52.753 260.177  1.00 19.79           S
ATOM   6789  CE   MET C 158      50.362  51.334 259.665  1.00 18.78           C
ATOM   6790  N    TYR C 159      46.243  55.139 261.636  1.00 20.95           N
ATOM   6791  CA   TYR C 159      44.842  54.938 261.997  1.00 21.22           C
ATOM   6792  C    TYR C 159      43.949  55.971 261.299  1.00 22.23           C
ATOM   6793  O    TYR C 159      42.862  55.657 260.813  1.00 24.51           O
ATOM   6794  CB   TYR C 159      44.639  55.118 263.490  1.00 20.57           C
ATOM   6795  CG   TYR C 159      44.929  53.951 264.421  1.00 21.05           C
ATOM   6796  CD1  TYR C 159      44.645  52.621 264.080  1.00 20.40           C
ATOM   6797  CD2  TYR C 159      45.413  54.207 265.703  1.00 20.92           C
ATOM   6798  CE1  TYR C 159      44.860  51.596 264.986  1.00 20.31           C
ATOM   6799  CE2  TYR C 159      45.639  53.197 266.602  1.00 20.61           C
ATOM   6800  CZ   TYR C 159      45.360  51.896 266.262  1.00 20.87           C
ATOM   6801  OH   TYR C 159      45.604  50.929 267.234  1.00 20.22           O
ATOM   6802  N    GLY C 160      44.413  57.206 261.280  1.00 21.91           N
ATOM   6803  CA   GLY C 160      43.640  58.295 260.730  1.00 22.65           C
ATOM   6804  C    GLY C 160      43.580  58.256 259.223  1.00 22.55           C
ATOM   6805  O    GLY C 160      42.510  58.477 258.616  1.00 22.80           O
ATOM   6806  N    LEU C 161      44.725  57.985 258.610  1.00 21.88           N
ATOM   6807  CA   LEU C 161      44.783  57.884 257.178  1.00 22.38           C
ATOM   6808  C    LEU C 161      43.884  56.758 256.710  1.00 23.08           C
ATOM   6809  O    LEU C 161      43.171  56.919 255.712  1.00 24.96           O
ATOM   6810  CB   LEU C 161      46.206  57.658 256.690  1.00 23.21           C
ATOM   6811  CG   LEU C 161      47.183  58.828 256.845  1.00 25.21           C
```

Appendix 2

```
ATOM   6812  CD1 LEU C 161      48.594  58.406 256.435  1.00 26.11           C
ATOM   6813  CD2 LEU C 161      46.747  60.027 256.028  1.00 25.27           C
ATOM   6814  N   TYR C 162      43.911  55.623 257.415  1.00 22.01           N
ATOM   6815  CA  TYR C 162      43.039  54.509 257.069  1.00 21.28           C
ATOM   6816  C   TYR C 162      41.576  54.934 257.071  1.00 22.44           C
ATOM   6817  O   TYR C 162      40.814  54.556 256.180  1.00 22.73           O
ATOM   6818  CB  TYR C 162      43.198  53.355 258.039  1.00 20.18           C
ATOM   6819  CG  TYR C 162      42.090  52.357 257.918  1.00 18.54           C
ATOM   6820  CD1 TYR C 162      42.021  51.514 256.836  1.00 18.20           C
ATOM   6821  CD2 TYR C 162      41.090  52.292 258.866  1.00 18.19           C
ATOM   6822  CE1 TYR C 162      40.995  50.610 256.703  1.00 17.86           C
ATOM   6823  CE2 TYR C 162      40.065  51.392 258.754  1.00 18.14           C
ATOM   6824  CZ  TYR C 162      40.029  50.547 257.677  1.00 18.02           C
ATOM   6825  OH  TYR C 162      39.002  49.660 257.571  1.00 18.91           O
ATOM   6826  N   GLN C 163      41.188  55.701 258.085  1.00 23.11           N
ATOM   6827  CA  GLN C 163      39.802  56.186 258.206  1.00 25.21           C
ATOM   6828  C   GLN C 163      39.442  57.301 257.181  1.00 26.27           C
ATOM   6829  O   GLN C 163      38.273  57.463 256.849  1.00 27.12           O
ATOM   6830  CB  GLN C 163      39.521  56.662 259.650  1.00 24.30           C
ATOM   6831  CG  GLN C 163      38.051  56.931 259.957  1.00 23.74           C
ATOM   6832  CD  GLN C 163      37.740  56.964 261.462  1.00 23.67           C
ATOM   6833  OE1 GLN C 163      38.539  56.526 262.308  1.00 26.19           O
ATOM   6834  NE2 GLN C 163      36.584  57.507 261.798  1.00 21.66           N
ATOM   6835  N   LEU C 164      40.444  58.056 256.710  1.00 26.18           N
ATOM   6836  CA  LEU C 164      40.254  59.062 255.661  1.00 25.45           C
ATOM   6837  C   LEU C 164      40.034  58.380 254.311  1.00 24.88           C
ATOM   6838  O   LEU C 164      39.099  58.699 253.584  1.00 24.58           O
ATOM   6839  CB  LEU C 164      41.462  60.014 255.572  1.00 26.01           C
ATOM   6840  CG  LEU C 164      41.600  61.139 256.617  1.00 26.04           C
ATOM   6841  CD1 LEU C 164      42.927  61.853 256.447  1.00 26.66           C
ATOM   6842  CD2 LEU C 164      40.487  62.162 256.547  1.00 25.22           C
ATOM   6843  N   VAL C 165      40.888  57.428 253.984  1.00 25.02           N
ATOM   6844  CA  VAL C 165      40.689  56.635 252.783  1.00 25.37           C
ATOM   6845  C   VAL C 165      39.370  55.857 252.760  1.00 25.01           C
ATOM   6846  O   VAL C 165      38.670  55.877 251.759  1.00 22.72           O
ATOM   6847  CB  VAL C 165      41.852  55.675 252.569  1.00 25.71           C
ATOM   6848  CG1 VAL C 165      41.539  54.662 251.488  1.00 26.27           C
ATOM   6849  CG2 VAL C 165      43.082  56.482 252.197  1.00 27.15           C
ATOM   6850  N   THR C 166      39.041  55.177 253.849  1.00 24.89           N
ATOM   6851  CA  THR C 166      37.948  54.220 253.831  1.00 24.92           C
ATOM   6852  C   THR C 166      36.627  54.719 254.387  1.00 24.76           C
ATOM   6853  O   THR C 166      35.580  54.304 253.930  1.00 26.72           O
ATOM   6854  CB  THR C 166      38.312  52.945 254.614  1.00 25.53           C
ATOM   6855  OG1 THR C 166      38.535  53.253 256.000  1.00 26.48           O
ATOM   6856  CG2 THR C 166      39.543  52.302 254.023  1.00 25.93           C
ATOM   6857  N   GLY C 167      36.662  55.582 255.388  1.00 24.85           N
ATOM   6858  CA  GLY C 167      35.448  55.907 256.147  1.00 24.14           C
ATOM   6859  C   GLY C 167      35.023  54.802 257.104  1.00 23.77           C
ATOM   6860  O   GLY C 167      33.950  54.869 257.684  1.00 22.69           O
ATOM   6861  N   SER C 168      35.863  53.783 257.271  1.00 24.60           N
ATOM   6862  CA  SER C 168      35.623  52.708 258.244  1.00 24.57           C
ATOM   6863  C   SER C 168      35.955  53.217 259.651  1.00 25.68           C
ATOM   6864  O   SER C 168      36.897  53.985 259.832  1.00 24.88           O
ATOM   6865  CB  SER C 168      36.467  51.464 257.885  1.00 23.96           C
```

Appendix 2

```
ATOM   6866  OG   SER C 168      36.590  50.558 258.958  1.00 21.69           O
ATOM   6867  N    ARG C 169      35.175  52.778 260.639  1.00 29.57           N
ATOM   6868  CA   ARG C 169      35.361  53.165 262.064  1.00 32.35           C
ATOM   6869  C    ARG C 169      35.876  51.966 262.868  1.00 29.76           C
ATOM   6870  O    ARG C 169      35.807  51.932 264.073  1.00 28.77           O
ATOM   6871  CB   ARG C 169      34.044  53.734 262.643  1.00 37.56           C
ATOM   6872  CG   ARG C 169      33.342  54.671 261.653  1.00 43.00           C
ATOM   6873  CD   ARG C 169      32.735  55.906 262.280  1.00 49.01           C
ATOM   6874  NE   ARG C 169      31.519  55.606 263.020  1.00 58.32           N
ATOM   6875  CZ   ARG C 169      30.940  56.429 263.894  1.00 66.17           C
ATOM   6876  NH1  ARG C 169      31.469  57.617 264.157  1.00 68.26           N
ATOM   6877  NH2  ARG C 169      29.826  56.058 264.519  1.00 69.28           N
ATOM   6878  N    ARG C 170      36.452  51.017 262.147  1.00 29.41           N
ATOM   6879  CA   ARG C 170      36.978  49.783 262.676  1.00 30.68           C
ATOM   6880  C    ARG C 170      38.042  49.980 263.741  1.00 28.24           C
ATOM   6881  O    ARG C 170      38.120  49.192 264.662  1.00 26.77           O
ATOM   6882  CB   ARG C 170      37.562  49.014 261.485  1.00 34.61           C
ATOM   6883  CG   ARG C 170      38.158  47.648 261.749  1.00 38.10           C
ATOM   6884  CD   ARG C 170      38.496  46.998 260.403  1.00 41.12           C
ATOM   6885  NE   ARG C 170      39.546  45.995 260.537  1.00 42.64           N
ATOM   6886  CZ   ARG C 170      39.391  44.822 261.141  1.00 44.03           C
ATOM   6887  NH1  ARG C 170      38.221  44.476 261.670  1.00 42.77           N
ATOM   6888  NH2  ARG C 170      40.417  43.984 261.212  1.00 47.54           N
ATOM   6889  N    TYR C 171      38.873  51.011 263.583  1.00 25.98           N
ATOM   6890  CA   TYR C 171      39.930  51.305 264.533  1.00 24.31           C
ATOM   6891  C    TYR C 171      39.649  52.565 265.340  1.00 24.39           C
ATOM   6892  O    TYR C 171      40.467  52.985 266.137  1.00 24.48           O
ATOM   6893  CB   TYR C 171      41.264  51.450 263.796  1.00 23.28           C
ATOM   6894  CG   TYR C 171      41.689  50.196 263.032  1.00 23.27           C
ATOM   6895  CD1  TYR C 171      42.039  49.039 263.713  1.00 23.08           C
ATOM   6896  CD2  TYR C 171      41.761  50.174 261.648  1.00 22.46           C
ATOM   6897  CE1  TYR C 171      42.435  47.897 263.044  1.00 22.93           C
ATOM   6898  CE2  TYR C 171      42.160  49.036 260.970  1.00 23.03           C
ATOM   6899  CZ   TYR C 171      42.507  47.896 261.679  1.00 23.23           C
ATOM   6900  OH   TYR C 171      42.898  46.724 261.056  1.00 23.37           O
ATOM   6901  N    GLU C 172      38.488  53.171 265.139  1.00 25.31           N
ATOM   6902  CA   GLU C 172      38.201  54.496 265.709  1.00 25.80           C
ATOM   6903  C    GLU C 172      38.429  54.566 267.219  1.00 24.13           C
ATOM   6904  O    GLU C 172      38.998  55.514 267.713  1.00 25.43           O
ATOM   6905  CB   GLU C 172      36.759  54.922 265.376  1.00 26.88           C
ATOM   6906  CG   GLU C 172      36.401  56.349 265.779  1.00 27.53           C
ATOM   6907  CD   GLU C 172      35.047  56.778 265.211  1.00 28.81           C
ATOM   6908  OE1  GLU C 172      34.991  57.534 264.222  1.00 26.39           O
ATOM   6909  OE2  GLU C 172      34.008  56.343 265.738  1.00 35.62           O
ATOM   6910  N    ALA C 173      37.988  53.564 267.955  1.00 23.69           N
ATOM   6911  CA   ALA C 173      38.095  53.608 269.409  1.00 23.53           C
ATOM   6912  C    ALA C 173      39.566  53.644 269.824  1.00 24.75           C
ATOM   6913  O    ALA C 173      39.942  54.391 270.705  1.00 22.72           O
ATOM   6914  CB   ALA C 173      37.355  52.430 270.049  1.00 22.13           C
ATOM   6915  N    GLU C 174      40.392  52.842 269.150  1.00 27.79           N
ATOM   6916  CA   GLU C 174      41.841  52.779 269.406  1.00 27.21           C
ATOM   6917  C    GLU C 174      42.540  54.099 269.053  1.00 27.32           C
ATOM   6918  O    GLU C 174      43.412  54.592 269.790  1.00 27.69           O
ATOM   6919  CB   GLU C 174      42.455  51.637 268.587  1.00 27.21           C
```

Appendix 2

```
ATOM   6920  CG   GLU C 174      41.940  50.255 268.980  1.00 28.01           C
ATOM   6921  CD   GLU C 174      42.353  49.161 268.008  1.00 28.79           C
ATOM   6922  OE1  GLU C 174      43.281  49.370 267.207  1.00 30.64           O
ATOM   6923  OE2  GLU C 174      41.746  48.082 268.044  1.00 30.86           O
ATOM   6924  N    HIS C 175      42.142  54.649 267.914  1.00 26.32           N
ATOM   6925  CA   HIS C 175      42.624  55.939 267.422  1.00 27.75           C
ATOM   6926  C    HIS C 175      42.363  57.065 268.419  1.00 26.89           C
ATOM   6927  O    HIS C 175      43.208  57.959 268.593  1.00 26.82           O
ATOM   6928  CB   HIS C 175      41.903  56.247 266.102  1.00 28.83           C
ATOM   6929  CG   HIS C 175      42.462  57.405 265.344  1.00 27.91           C
ATOM   6930  ND1  HIS C 175      41.710  58.124 264.438  1.00 28.69           N
ATOM   6931  CD2  HIS C 175      43.692  57.961 265.341  1.00 29.39           C
ATOM   6932  CE1  HIS C 175      42.460  59.069 263.897  1.00 29.32           C
ATOM   6933  NE2  HIS C 175      43.669  58.993 264.428  1.00 30.35           N
ATOM   6934  N    ALA C 176      41.178  57.021 269.039  1.00 24.61           N
ATOM   6935  CA   ALA C 176      40.779  57.996 270.042  1.00 23.54           C
ATOM   6936  C    ALA C 176      41.569  57.780 271.314  1.00 21.87           C
ATOM   6937  O    ALA C 176      42.055  58.727 271.930  1.00 23.60           O
ATOM   6938  CB   ALA C 176      39.287  57.878 270.340  1.00 22.74           C
ATOM   6939  N    HIS C 177      41.680  56.530 271.722  1.00 20.83           N
ATOM   6940  CA   HIS C 177      42.453  56.184 272.923  1.00 21.52           C
ATOM   6941  C    HIS C 177      43.897  56.687 272.802  1.00 19.92           C
ATOM   6942  O    HIS C 177      44.322  57.445 273.635  1.00 18.96           O
ATOM   6943  CB   HIS C 177      42.413  54.672 273.193  1.00 21.59           C
ATOM   6944  CG   HIS C 177      43.204  54.263 274.381  1.00 23.20           C
ATOM   6945  ND1  HIS C 177      42.740  54.418 275.669  1.00 23.95           N
ATOM   6946  CD2  HIS C 177      44.444  53.732 274.485  1.00 23.58           C
ATOM   6947  CE1  HIS C 177      43.661  53.999 276.518  1.00 23.16           C
ATOM   6948  NE2  HIS C 177      44.702  53.579 275.824  1.00 24.16           N
ATOM   6949  N    LEU C 178      44.588  56.298 271.728  1.00 19.86           N
ATOM   6950  CA   LEU C 178      45.970  56.688 271.481  1.00 21.37           C
ATOM   6951  C    LEU C 178      46.132  58.188 271.317  1.00 22.63           C
ATOM   6952  O    LEU C 178      47.159  58.767 271.723  1.00 21.91           O
ATOM   6953  CB   LEU C 178      46.535  55.992 270.226  1.00 21.43           C
ATOM   6954  CG   LEU C 178      47.997  56.305 269.825  1.00 22.00           C
ATOM   6955  CD1  LEU C 178      48.998  56.176 270.953  1.00 22.05           C
ATOM   6956  CD2  LEU C 178      48.445  55.370 268.721  1.00 22.15           C
ATOM   6957  N    THR C 179      45.145  58.823 270.691  1.00 22.39           N
ATOM   6958  CA   THR C 179      45.282  60.235 270.434  1.00 23.34           C
ATOM   6959  C    THR C 179      45.296  61.013 271.753  1.00 24.30           C
ATOM   6960  O    THR C 179      46.099  61.935 271.934  1.00 25.16           O
ATOM   6961  CB   THR C 179      44.241  60.716 269.404  1.00 23.35           C
ATOM   6962  OG1  THR C 179      44.589  60.125 268.139  1.00 22.13           O
ATOM   6963  CG2  THR C 179      44.226  62.268 269.260  1.00 21.58           C
ATOM   6964  N    ARG C 180      44.454  60.615 272.694  1.00 24.90           N
ATOM   6965  CA   ARG C 180      44.325  61.363 273.926  1.00 25.69           C
ATOM   6966  C    ARG C 180      45.558  61.200 274.824  1.00 26.27           C
ATOM   6967  O    ARG C 180      45.922  62.095 275.605  1.00 26.37           O
ATOM   6968  CB   ARG C 180      43.075  60.909 274.665  1.00 26.42           C
ATOM   6969  CG   ARG C 180      41.802  61.209 273.936  1.00 27.27           C
ATOM   6970  CD   ARG C 180      40.628  61.224 274.898  1.00 29.06           C
ATOM   6971  NE   ARG C 180      39.388  61.396 274.167  1.00 30.57           N
ATOM   6972  CZ   ARG C 180      38.653  60.399 273.686  1.00 33.39           C
ATOM   6973  NH1  ARG C 180      38.979  59.112 273.864  1.00 35.00           N
```

Appendix 2

```
ATOM   6974  NH2 ARG C 180      37.563  60.692 273.032  1.00 34.03           N
ATOM   6975  N   ILE C 181      46.144  60.010 274.738  1.00 26.20           N
ATOM   6976  CA  ILE C 181      47.407  59.684 275.380  1.00 24.58           C
ATOM   6977  C   ILE C 181      48.464  60.614 274.871  1.00 23.08           C
ATOM   6978  O   ILE C 181      49.121  61.284 275.666  1.00 26.48           O
ATOM   6979  CB  ILE C 181      47.796  58.233 275.079  1.00 24.74           C
ATOM   6980  CG1 ILE C 181      46.966  57.315 275.970  1.00 24.07           C
ATOM   6981  CG2 ILE C 181      49.298  57.988 275.256  1.00 23.83           C
ATOM   6982  CD1 ILE C 181      47.275  55.871 275.697  1.00 25.55           C
ATOM   6983  N   ILE C 182      48.617  60.683 273.559  1.00 21.10           N
ATOM   6984  CA  ILE C 182      49.558  61.630 272.976  1.00 22.50           C
ATOM   6985  C   ILE C 182      49.326  63.069 273.476  1.00 23.26           C
ATOM   6986  O   ILE C 182      50.274  63.731 273.941  1.00 22.30           O
ATOM   6987  CB  ILE C 182      49.566  61.557 271.434  1.00 23.50           C
ATOM   6988  CG1 ILE C 182      50.178  60.209 270.988  1.00 23.56           C
ATOM   6989  CG2 ILE C 182      50.334  62.738 270.825  1.00 23.20           C
ATOM   6990  CD1 ILE C 182      49.924  59.878 269.519  1.00 24.80           C
ATOM   6991  N   HIS C 183      48.074  63.538 273.429  1.00 24.55           N
ATOM   6992  CA  HIS C 183      47.753  64.880 273.935  1.00 24.04           C
ATOM   6993  C   HIS C 183      48.157  65.034 275.398  1.00 22.80           C
ATOM   6994  O   HIS C 183      48.712  66.059 275.774  1.00 24.31           O
ATOM   6995  CB  HIS C 183      46.264  65.195 273.778  1.00 25.85           C
ATOM   6996  CG  HIS C 183      45.807  66.362 274.599  1.00 26.56           C
ATOM   6997  ND1 HIS C 183      45.788  67.653 274.112  1.00 27.03           N
ATOM   6998  CD2 HIS C 183      45.395  66.437 275.888  1.00 27.53           C
ATOM   6999  CE1 HIS C 183      45.375  68.469 275.064  1.00 28.09           C
ATOM   7000  NE2 HIS C 183      45.133  67.758 276.153  1.00 28.21           N
ATOM   7001  N   ASP C 184      47.880  64.018 276.210  1.00 22.19           N
ATOM   7002  CA  ASP C 184      48.173  64.071 277.643  1.00 23.30           C
ATOM   7003  C   ASP C 184      49.689  64.077 277.927  1.00 23.91           C
ATOM   7004  O   ASP C 184      50.133  64.766 278.847  1.00 21.08           O
ATOM   7005  CB  ASP C 184      47.527  62.902 278.398  1.00 23.48           C
ATOM   7006  CG  ASP C 184      46.055  63.129 278.727  1.00 25.32           C
ATOM   7007  OD1 ASP C 184      45.545  64.277 278.592  1.00 26.71           O
ATOM   7008  OD2 ASP C 184      45.408  62.133 279.149  1.00 24.74           O
ATOM   7009  N   GLU C 185      50.471  63.304 277.163  1.00 24.41           N
ATOM   7010  CA  GLU C 185      51.924  63.299 277.367  1.00 25.58           C
ATOM   7011  C   GLU C 185      52.583  64.623 276.964  1.00 25.39           C
ATOM   7012  O   GLU C 185      53.537  65.089 277.616  1.00 22.38           O
ATOM   7013  CB  GLU C 185      52.569  62.177 276.599  1.00 26.63           C
ATOM   7014  CG  GLU C 185      52.237  60.805 277.133  1.00 28.11           C
ATOM   7015  CD  GLU C 185      53.132  59.749 276.523  1.00 28.60           C
ATOM   7016  OE1 GLU C 185      52.672  59.032 275.594  1.00 27.14           O
ATOM   7017  OE2 GLU C 185      54.308  59.685 276.966  1.00 29.15           O
ATOM   7018  N   ILE C 186      52.065  65.220 275.879  1.00 25.79           N
ATOM   7019  CA  ILE C 186      52.579  66.501 275.395  1.00 23.93           C
ATOM   7020  C   ILE C 186      52.361  67.519 276.482  1.00 22.75           C
ATOM   7021  O   ILE C 186      53.315  68.155 276.932  1.00 23.75           O
ATOM   7022  CB  ILE C 186      51.873  66.961 274.122  1.00 23.72           C
ATOM   7023  CG1 ILE C 186      52.353  66.114 272.926  1.00 22.78           C
ATOM   7024  CG2 ILE C 186      52.122  68.452 273.900  1.00 23.52           C
ATOM   7025  CD1 ILE C 186      51.460  66.161 271.702  1.00 21.69           C
ATOM   7026  N   ALA C 187      51.109  67.611 276.921  1.00 21.35           N
ATOM   7027  CA  ALA C 187      50.675  68.499 278.026  1.00 20.83           C
```

Appendix 2

```
ATOM   7028  C    ALA C 187      51.446  68.358 279.351  1.00 19.99           C
ATOM   7029  O    ALA C 187      51.690  69.339 280.046  1.00 19.91           O
ATOM   7030  CB   ALA C 187      49.176  68.297 278.277  1.00 20.76           C
ATOM   7031  N    ALA C 188      51.813  67.133 279.696  1.00 19.95           N
ATOM   7032  CA   ALA C 188      52.510  66.835 280.967  1.00 20.00           C
ATOM   7033  C    ALA C 188      53.991  67.210 281.009  1.00 19.75           C
ATOM   7034  O    ALA C 188      54.547  67.319 282.097  1.00 20.56           O
ATOM   7035  CB   ALA C 188      52.385  65.355 281.277  1.00 19.95           C
ATOM   7036  N    ASN C 189      54.601  67.371 279.831  1.00 19.52           N
ATOM   7037  CA   ASN C 189      56.021  67.597 279.642  1.00 19.24           C
ATOM   7038  C    ASN C 189      56.304  69.088 279.545  1.00 20.00           C
ATOM   7039  O    ASN C 189      55.560  69.812 278.895  1.00 19.55           O
ATOM   7040  CB   ASN C 189      56.512  66.948 278.323  1.00 19.02           C
ATOM   7041  CG   ASN C 189      56.658  65.412 278.400  1.00 18.45           C
ATOM   7042  OD1  ASN C 189      56.889  64.833 279.442  1.00 18.38           O
ATOM   7043  ND2  ASN C 189      56.571  64.776 277.272  1.00 18.29           N
ATOM   7044  N    PRO C 190      57.409  69.530 280.155  1.00 21.09           N
ATOM   7045  CA   PRO C 190      57.899  70.912 280.142  1.00 21.33           C
ATOM   7046  C    PRO C 190      58.608  71.318 278.851  1.00 21.66           C
ATOM   7047  O    PRO C 190      58.778  72.508 278.594  1.00 23.41           O
ATOM   7048  CB   PRO C 190      58.903  70.928 281.301  1.00 21.53           C
ATOM   7049  CG   PRO C 190      59.443  69.532 281.341  1.00 21.84           C
ATOM   7050  CD   PRO C 190      58.354  68.611 280.840  1.00 21.04           C
ATOM   7051  N    PHE C 191      59.051  70.341 278.071  1.00 21.49           N
ATOM   7052  CA   PHE C 191      59.522  70.567 276.700  1.00 21.43           C
ATOM   7053  C    PHE C 191      58.343  70.173 275.828  1.00 22.24           C
ATOM   7054  O    PHE C 191      57.520  69.378 276.248  1.00 24.59           O
ATOM   7055  CB   PHE C 191      60.756  69.702 276.374  1.00 20.64           C
ATOM   7056  CG   PHE C 191      60.564  68.253 276.685  1.00 20.10           C
ATOM   7057  CD1  PHE C 191      59.974  67.403 275.767  1.00 20.66           C
ATOM   7058  CD2  PHE C 191      60.904  67.749 277.916  1.00 20.73           C
ATOM   7059  CE1  PHE C 191      59.744  66.066 276.063  1.00 20.28           C
ATOM   7060  CE2  PHE C 191      60.682  66.407 278.221  1.00 20.89           C
ATOM   7061  CZ   PHE C 191      60.103  65.568 277.292  1.00 20.33           C
ATOM   7062  N    ALA C 192      58.241  70.737 274.633  1.00 23.15           N
ATOM   7063  CA   ALA C 192      57.096  70.458 273.754  1.00 24.08           C
ATOM   7064  C    ALA C 192      57.312  69.157 272.964  1.00 23.68           C
ATOM   7065  O    ALA C 192      58.176  69.103 272.081  1.00 23.34           O
ATOM   7066  CB   ALA C 192      56.843  71.626 272.788  1.00 23.64           C
ATOM   7067  N    GLY C 193      56.517  68.131 273.273  1.00 22.61           N
ATOM   7068  CA   GLY C 193      56.568  66.864 272.558  1.00 21.82           C
ATOM   7069  C    GLY C 193      56.727  65.674 273.482  1.00 22.40           C
ATOM   7070  O    GLY C 193      56.434  65.769 274.657  1.00 22.21           O
ATOM   7071  N    ILE C 194      57.188  64.549 272.925  1.00 23.43           N
ATOM   7072  CA   ILE C 194      57.301  63.273 273.616  1.00 23.52           C
ATOM   7073  C    ILE C 194      58.604  62.573 273.253  1.00 23.65           C
ATOM   7074  O    ILE C 194      59.044  62.612 272.117  1.00 25.09           O
ATOM   7075  CB   ILE C 194      56.142  62.339 273.219  1.00 23.80           C
ATOM   7076  CG1  ILE C 194      54.812  62.938 273.631  1.00 23.96           C
ATOM   7077  CG2  ILE C 194      56.251  60.984 273.910  1.00 24.55           C
ATOM   7078  CD1  ILE C 194      53.604  62.397 272.890  1.00 23.70           C
ATOM   7079  N    VAL C 195      59.188  61.879 274.213  1.00 25.05           N
ATOM   7080  CA   VAL C 195      60.397  61.054 273.971  1.00 24.94           C
ATOM   7081  C    VAL C 195      60.133  59.699 273.295  1.00 25.08           C
```

Appendix 2

```
ATOM   7082  O    VAL C 195      59.031  59.160 273.360  1.00 24.98           O
ATOM   7083  CB   VAL C 195      61.158  60.777 275.278  1.00 22.91           C
ATOM   7084  CG1  VAL C 195      61.493  62.086 275.962  1.00 22.12           C
ATOM   7085  CG2  VAL C 195      60.355  59.855 276.190  1.00 22.75           C
ATOM   7086  N    CYS C 196      61.162  59.153 272.659  1.00 26.42           N
ATOM   7087  CA   CYS C 196      61.090  57.797 272.139  1.00 28.30           C
ATOM   7088  C    CYS C 196      61.436  56.831 273.280  1.00 28.94           C
ATOM   7089  O    CYS C 196      60.581  56.476 274.097  1.00 25.88           O
ATOM   7090  CB   CYS C 196      61.990  57.636 270.909  1.00 29.46           C
ATOM   7091  SG   CYS C 196      61.324  58.484 269.433  1.00 33.96           S
ATOM   7092  N    GLU C 197      62.687  56.417 273.355  1.00 32.38           N
ATOM   7093  CA   GLU C 197      63.198  55.717 274.549  1.00 34.28           C
ATOM   7094  C    GLU C 197      63.227  56.801 275.649  1.00 33.90           C
ATOM   7095  O    GLU C 197      63.152  57.998 275.352  1.00 33.92           O
ATOM   7096  CB   GLU C 197      64.607  55.122 274.263  1.00 36.33           C
ATOM   7097  CG   GLU C 197      64.654  53.991 273.202  1.00 36.39           C
ATOM   7098  CD   GLU C 197      64.896  54.411 271.732  1.00 37.63           C
ATOM   7099  OE1  GLU C 197      65.024  55.623 271.390  1.00 34.93           O
ATOM   7100  OE2  GLU C 197      64.963  53.477 270.886  1.00 40.80           O
ATOM   7101  N    PRO C 198      63.301  56.406 276.916  1.00 34.81           N
ATOM   7102  CA   PRO C 198      63.358  57.476 277.935  1.00 35.63           C
ATOM   7103  C    PRO C 198      64.585  58.398 277.779  1.00 35.57           C
ATOM   7104  O    PRO C 198      65.693  57.916 277.579  1.00 38.34           O
ATOM   7105  CB   PRO C 198      63.408  56.714 279.266  1.00 35.37           C
ATOM   7106  CG   PRO C 198      63.028  55.289 278.965  1.00 35.97           C
ATOM   7107  CD   PRO C 198      62.985  55.079 277.474  1.00 35.80           C
ATOM   7108  N    ASP C 199      64.372  59.708 277.848  1.00 34.27           N
ATOM   7109  CA   ASP C 199      65.449  60.712 277.675  1.00 33.47           C
ATOM   7110  C    ASP C 199      65.998  60.861 276.233  1.00 31.67           C
ATOM   7111  O    ASP C 199      66.995  61.553 276.012  1.00 30.75           O
ATOM   7112  CB   ASP C 199      66.621  60.456 278.638  1.00 32.32           C
ATOM   7113  CG   ASP C 199      67.440  61.708 278.898  1.00 33.07           C
ATOM   7114  OD1  ASP C 199      66.810  62.743 279.143  1.00 37.20           O
ATOM   7115  OD2  ASP C 199      68.695  61.692 278.845  1.00 34.24           O
ATOM   7116  N    ASN C 200      65.365  60.217 275.261  1.00 29.79           N
ATOM   7117  CA   ASN C 200      65.747  60.381 273.862  1.00 27.85           C
ATOM   7118  C    ASN C 200      64.639  61.101 273.137  1.00 26.72           C
ATOM   7119  O    ASN C 200      63.541  60.552 272.980  1.00 27.07           O
ATOM   7120  CB   ASN C 200      65.960  59.026 273.203  1.00 27.27           C
ATOM   7121  CG   ASN C 200      67.340  58.480 273.423  1.00 28.44           C
ATOM   7122  OD1  ASN C 200      68.187  59.109 274.062  1.00 30.90           O
ATOM   7123  ND2  ASN C 200      67.584  57.288 272.892  1.00 29.03           N
ATOM   7124  N    TYR C 201      64.924  62.322 272.693  1.00 25.54           N
ATOM   7125  CA   TYR C 201      63.957  63.138 271.959  1.00 23.97           C
ATOM   7126  C    TYR C 201      64.390  63.337 270.511  1.00 23.51           C
ATOM   7127  O    TYR C 201      65.456  63.843 270.253  1.00 25.30           O
ATOM   7128  CB   TYR C 201      63.780  64.475 272.682  1.00 22.82           C
ATOM   7129  CG   TYR C 201      62.735  65.382 272.103  1.00 21.83           C
ATOM   7130  CD1  TYR C 201      62.984  66.109 270.954  1.00 21.61           C
ATOM   7131  CD2  TYR C 201      61.507  65.520 272.701  1.00 21.90           C
ATOM   7132  CE1  TYR C 201      62.037  66.952 270.422  1.00 22.02           C
ATOM   7133  CE2  TYR C 201      60.534  66.354 272.170  1.00 21.95           C
ATOM   7134  CZ   TYR C 201      60.812  67.069 271.028  1.00 22.58           C
ATOM   7135  OH   TYR C 201      59.873  67.922 270.490  1.00 23.65           O
```

Appendix 2

```
ATOM   7136  N    PHE C 202      63.555  62.938 269.567  1.00 24.63           N
ATOM   7137  CA   PHE C 202      63.863  63.075 268.138  1.00 26.47           C
ATOM   7138  C    PHE C 202      62.785  63.938 267.454  1.00 26.92           C
ATOM   7139  O    PHE C 202      61.596  63.637 267.560  1.00 29.68           O
ATOM   7140  CB   PHE C 202      63.885  61.690 267.479  1.00 27.28           C
ATOM   7141  CG   PHE C 202      65.013  60.814 267.928  1.00 27.78           C
ATOM   7142  CD1  PHE C 202      64.888  60.043 269.055  1.00 28.94           C
ATOM   7143  CD2  PHE C 202      66.202  60.772 267.217  1.00 30.42           C
ATOM   7144  CE1  PHE C 202      65.924  59.240 269.473  1.00 30.43           C
ATOM   7145  CE2  PHE C 202      67.255  59.970 267.626  1.00 30.83           C
ATOM   7146  CZ   PHE C 202      67.111  59.198 268.758  1.00 31.17           C
ATOM   7147  N    VAL C 203      63.180  64.991 266.745  1.00 25.51           N
ATOM   7148  CA   VAL C 203      62.196  65.889 266.146  1.00 25.57           C
ATOM   7149  C    VAL C 203      61.409  65.190 265.053  1.00 25.68           C
ATOM   7150  O    VAL C 203      60.220  65.464 264.868  1.00 26.81           O
ATOM   7151  CB   VAL C 203      62.816  67.200 265.574  1.00 26.48           C
ATOM   7152  CG1  VAL C 203      63.528  67.989 266.657  1.00 26.71           C
ATOM   7153  CG2  VAL C 203      63.787  66.917 264.450  1.00 26.32           C
ATOM   7154  N    GLN C 204      62.057  64.283 264.332  1.00 25.04           N
ATOM   7155  CA   GLN C 204      61.395  63.604 263.226  1.00 25.12           C
ATOM   7156  C    GLN C 204      60.242  62.747 263.695  1.00 24.87           C
ATOM   7157  O    GLN C 204      59.241  62.635 262.992  1.00 25.27           O
ATOM   7158  CB   GLN C 204      62.379  62.784 262.360  1.00 25.33           C
ATOM   7159  CG   GLN C 204      63.001  61.543 262.986  1.00 25.08           C
ATOM   7160  CD   GLN C 204      64.332  61.812 263.655  1.00 24.78           C
ATOM   7161  OE1  GLN C 204      64.460  62.726 264.469  1.00 25.66           O
ATOM   7162  NE2  GLN C 204      65.334  61.014 263.314  1.00 25.23           N
ATOM   7163  N    CYS C 205      60.393  62.139 264.867  1.00 25.87           N
ATOM   7164  CA   CYS C 205      59.393  61.210 265.395  1.00 26.90           C
ATOM   7165  C    CYS C 205      58.226  62.007 265.946  1.00 27.05           C
ATOM   7166  O    CYS C 205      57.070  61.595 265.801  1.00 25.66           O
ATOM   7167  CB   CYS C 205      59.977  60.324 266.493  1.00 28.07           C
ATOM   7168  SG   CYS C 205      61.275  59.177 265.952  1.00 33.91           S
ATOM   7169  N    ASN C 206      58.529  63.147 266.581  1.00 26.36           N
ATOM   7170  CA   ASN C 206      57.471  64.064 267.034  1.00 25.96           C
ATOM   7171  C    ASN C 206      56.664  64.635 265.878  1.00 25.17           C
ATOM   7172  O    ASN C 206      55.455  64.671 265.943  1.00 24.10           O
ATOM   7173  CB   ASN C 206      58.030  65.186 267.893  1.00 26.13           C
ATOM   7174  CG   ASN C 206      58.276  64.742 269.320  1.00 27.88           C
ATOM   7175  OD1  ASN C 206      57.401  64.851 270.150  1.00 28.72           O
ATOM   7176  ND2  ASN C 206      59.454  64.211 269.599  1.00 28.42           N
ATOM   7177  N    SER C 207      57.327  65.021 264.797  1.00 24.85           N
ATOM   7178  CA   SER C 207      56.618  65.546 263.654  1.00 25.54           C
ATOM   7179  C    SER C 207      55.487  64.615 263.205  1.00 27.12           C
ATOM   7180  O    SER C 207      54.408  65.089 262.794  1.00 27.03           O
ATOM   7181  CB   SER C 207      57.577  65.812 262.492  1.00 26.28           C
ATOM   7182  OG   SER C 207      57.941  64.638 261.813  1.00 26.99           O
ATOM   7183  N    VAL C 208      55.719  63.305 263.295  1.00 26.00           N
ATOM   7184  CA   VAL C 208      54.689  62.340 262.932  1.00 25.84           C
ATOM   7185  C    VAL C 208      53.504  62.395 263.889  1.00 23.72           C
ATOM   7186  O    VAL C 208      52.355  62.376 263.474  1.00 22.08           O
ATOM   7187  CB   VAL C 208      55.215  60.894 262.928  1.00 27.41           C
ATOM   7188  CG1  VAL C 208      54.075  59.938 262.602  1.00 26.66           C
ATOM   7189  CG2  VAL C 208      56.371  60.719 261.932  1.00 28.23           C
```

Appendix 2

```
ATOM   7190  N    ALA C 209      53.796  62.422 265.175  1.00 23.51           N
ATOM   7191  CA   ALA C 209      52.753  62.421 266.184  1.00 23.24           C
ATOM   7192  C    ALA C 209      51.920  63.698 266.036  1.00 23.52           C
ATOM   7193  O    ALA C 209      50.689  63.674 266.067  1.00 23.92           O
ATOM   7194  CB   ALA C 209      53.370  62.324 267.569  1.00 22.88           C
ATOM   7195  N    TYR C 210      52.600  64.813 265.847  1.00 23.24           N
ATOM   7196  CA   TYR C 210      51.899  66.061 265.588  1.00 23.78           C
ATOM   7197  C    TYR C 210      51.027  65.968 264.294  1.00 23.51           C
ATOM   7198  O    TYR C 210      49.882  66.384 264.296  1.00 24.02           O
ATOM   7199  CB   TYR C 210      52.875  67.265 265.603  1.00 22.71           C
ATOM   7200  CG   TYR C 210      53.242  67.688 267.016  1.00 22.96           C
ATOM   7201  CD1  TYR C 210      52.487  68.633 267.697  1.00 23.32           C
ATOM   7202  CD2  TYR C 210      54.321  67.109 267.691  1.00 23.76           C
ATOM   7203  CE1  TYR C 210      52.797  69.011 269.004  1.00 23.37           C
ATOM   7204  CE2  TYR C 210      54.638  67.461 269.012  1.00 23.64           C
ATOM   7205  CZ   TYR C 210      53.879  68.415 269.661  1.00 23.64           C
ATOM   7206  OH   TYR C 210      54.185  68.780 270.951  1.00 22.92           O
ATOM   7207  N    LEU C 211      51.517  65.390 263.211  1.00 22.70           N
ATOM   7208  CA   LEU C 211      50.677  65.312 262.024  1.00 22.65           C
ATOM   7209  C    LEU C 211      49.430  64.442 262.287  1.00 22.92           C
ATOM   7210  O    LEU C 211      48.341  64.697 261.742  1.00 22.30           O
ATOM   7211  CB   LEU C 211      51.482  64.805 260.844  1.00 23.34           C
ATOM   7212  CG   LEU C 211      50.765  64.818 259.494  1.00 24.85           C
ATOM   7213  CD1  LEU C 211      50.342  66.229 259.119  1.00 24.98           C
ATOM   7214  CD2  LEU C 211      51.635  64.191 258.396  1.00 24.70           C
ATOM   7215  N    SER C 212      49.570  63.457 263.173  1.00 21.97           N
ATOM   7216  CA   SER C 212      48.464  62.562 263.467  1.00 22.39           C
ATOM   7217  C    SER C 212      47.380  63.299 264.248  1.00 23.11           C
ATOM   7218  O    SER C 212      46.229  62.864 264.261  1.00 24.16           O
ATOM   7219  CB   SER C 212      48.935  61.322 264.252  1.00 21.85           C
ATOM   7220  OG   SER C 212      49.189  61.638 265.607  1.00 20.49           O
ATOM   7221  N    LEU C 213      47.763  64.377 264.928  1.00 22.16           N
ATOM   7222  CA   LEU C 213      46.821  65.205 265.640  1.00 22.34           C
ATOM   7223  C    LEU C 213      45.983  66.015 264.654  1.00 22.66           C
ATOM   7224  O    LEU C 213      44.767  66.194 264.850  1.00 20.43           O
ATOM   7225  CB   LEU C 213      47.552  66.146 266.602  1.00 22.99           C
ATOM   7226  CG   LEU C 213      48.218  65.488 267.818  1.00 23.58           C
ATOM   7227  CD1  LEU C 213      48.760  66.515 268.796  1.00 22.69           C
ATOM   7228  CD2  LEU C 213      47.221  64.579 268.535  1.00 24.83           C
ATOM   7229  N    TRP C 214      46.632  66.494 263.590  1.00 22.66           N
ATOM   7230  CA   TRP C 214      45.913  67.238 262.553  1.00 22.44           C
ATOM   7231  C    TRP C 214      44.930  66.295 261.896  1.00 22.58           C
ATOM   7232  O    TRP C 214      43.801  66.677 261.601  1.00 21.33           O
ATOM   7233  CB   TRP C 214      46.853  67.853 261.520  1.00 21.04           C
ATOM   7234  CG   TRP C 214      47.615  69.025 262.058  1.00 19.87           C
ATOM   7235  CD1  TRP C 214      48.551  69.001 263.045  1.00 20.04           C
ATOM   7236  CD2  TRP C 214      47.531  70.372 261.625  1.00 19.38           C
ATOM   7237  NE1  TRP C 214      49.055  70.245 263.253  1.00 19.54           N
ATOM   7238  CE2  TRP C 214      48.436  71.116 262.400  1.00 19.54           C
ATOM   7239  CE3  TRP C 214      46.757  71.043 260.668  1.00 19.84           C
ATOM   7240  CZ2  TRP C 214      48.580  72.500 262.259  1.00 18.87           C
ATOM   7241  CZ3  TRP C 214      46.932  72.428 260.518  1.00 18.81           C
ATOM   7242  CH2  TRP C 214      47.835  73.124 261.305  1.00 18.11           C
ATOM   7243  N    VAL C 215      45.343  65.046 261.704  1.00 23.47           N
```

Appendix 2

```
ATOM   7244  CA   VAL C 215      44.452  64.090 261.013  1.00 23.77           C
ATOM   7245  C    VAL C 215      43.235  63.755 261.890  1.00 22.45           C
ATOM   7246  O    VAL C 215      42.109  63.714 261.398  1.00 21.49           O
ATOM   7247  CB   VAL C 215      45.183  62.830 260.530  1.00 22.57           C
ATOM   7248  CG1  VAL C 215      44.174  61.835 260.001  1.00 23.47           C
ATOM   7249  CG2  VAL C 215      46.177  63.184 259.448  1.00 21.98           C
ATOM   7250  N    TYR C 216      43.466  63.539 263.177  1.00 21.78           N
ATOM   7251  CA   TYR C 216      42.363  63.295 264.096  1.00 22.71           C
ATOM   7252  C    TYR C 216      41.341  64.469 264.125  1.00 24.04           C
ATOM   7253  O    TYR C 216      40.138  64.272 263.882  1.00 23.15           O
ATOM   7254  CB   TYR C 216      42.868  63.035 265.500  1.00 21.90           C
ATOM   7255  CG   TYR C 216      41.778  62.542 266.408  1.00 22.03           C
ATOM   7256  CD1  TYR C 216      41.512  61.195 266.513  1.00 22.57           C
ATOM   7257  CD2  TYR C 216      41.007  63.421 267.143  1.00 21.75           C
ATOM   7258  CE1  TYR C 216      40.520  60.717 267.349  1.00 23.42           C
ATOM   7259  CE2  TYR C 216      40.019  62.969 267.978  1.00 22.63           C
ATOM   7260  CZ   TYR C 216      39.779  61.611 268.076  1.00 24.15           C
ATOM   7261  OH   TYR C 216      38.789  61.125 268.883  1.00 24.77           O
ATOM   7262  N    ASP C 217      41.822  65.671 264.447  1.00 25.27           N
ATOM   7263  CA   ASP C 217      41.017  66.895 264.360  1.00 25.59           C
ATOM   7264  C    ASP C 217      40.149  66.949 263.088  1.00 26.98           C
ATOM   7265  O    ASP C 217      38.944  67.224 263.145  1.00 26.18           O
ATOM   7266  CB   ASP C 217      41.926  68.117 264.380  1.00 25.10           C
ATOM   7267  CG   ASP C 217      42.523  68.375 265.731  1.00 24.60           C
ATOM   7268  OD1  ASP C 217      42.207  67.681 266.716  1.00 22.14           O
ATOM   7269  OD2  ASP C 217      43.302  69.323 265.799  1.00 25.37           O
ATOM   7270  N    ARG C 218      40.763  66.656 261.952  1.00 28.05           N
ATOM   7271  CA   ARG C 218      40.047  66.660 260.693  1.00 30.31           C
ATOM   7272  C    ARG C 218      38.862  65.684 260.684  1.00 29.73           C
ATOM   7273  O    ARG C 218      37.787  66.006 260.183  1.00 30.80           O
ATOM   7274  CB   ARG C 218      41.015  66.357 259.566  1.00 32.74           C
ATOM   7275  CG   ARG C 218      40.370  65.956 258.266  1.00 37.15           C
ATOM   7276  CD   ARG C 218      39.769  67.120 257.491  1.00 39.82           C
ATOM   7277  NE   ARG C 218      39.719  66.704 256.082  1.00 44.62           N
ATOM   7278  CZ   ARG C 218      38.805  65.896 255.531  1.00 40.82           C
ATOM   7279  NH1  ARG C 218      37.776  65.416 256.228  1.00 38.83           N
ATOM   7280  NH2  ARG C 218      38.925  65.578 254.252  1.00 40.24           N
ATOM   7281  N    LEU C 219      39.053  64.507 261.257  1.00 28.62           N
ATOM   7282  CA   LEU C 219      37.997  63.510 261.314  1.00 27.59           C
ATOM   7283  C    LEU C 219      36.887  63.804 262.314  1.00 27.20           C
ATOM   7284  O    LEU C 219      35.761  63.425 262.071  1.00 27.16           O
ATOM   7285  CB   LEU C 219      38.584  62.150 261.653  1.00 28.18           C
ATOM   7286  CG   LEU C 219      39.327  61.430 260.531  1.00 29.36           C
ATOM   7287  CD1  LEU C 219      40.238  60.392 261.151  1.00 30.49           C
ATOM   7288  CD2  LEU C 219      38.372  60.778 259.546  1.00 27.78           C
ATOM   7289  N    HIS C 220      37.194  64.433 263.444  1.00 27.51           N
ATOM   7290  CA   HIS C 220      36.206  64.573 264.529  1.00 27.34           C
ATOM   7291  C    HIS C 220      35.893  66.003 264.971  1.00 26.08           C
ATOM   7292  O    HIS C 220      35.129  66.191 265.919  1.00 22.63           O
ATOM   7293  CB   HIS C 220      36.665  63.783 265.738  1.00 28.35           C
ATOM   7294  CG   HIS C 220      36.782  62.320 265.476  1.00 29.90           C
ATOM   7295  ND1  HIS C 220      37.990  61.701 265.221  1.00 31.16           N
ATOM   7296  CD2  HIS C 220      35.841  61.353 265.419  1.00 29.41           C
ATOM   7297  CE1  HIS C 220      37.783  60.418 264.990  1.00 31.17           C
```

Appendix 2

```
ATOM   7298  NE2 HIS C 220      36.488  60.183 265.106  1.00 31.52           N
ATOM   7299  N   GLY C 221      36.492  66.987 264.293  1.00 25.87           N
ATOM   7300  CA  GLY C 221      36.257  68.419 264.557  1.00 26.37           C
ATOM   7301  C   GLY C 221      36.948  68.993 265.795  1.00 26.91           C
ATOM   7302  O   GLY C 221      36.618  70.098 266.229  1.00 26.67           O
ATOM   7303  N   THR C 222      37.898  68.243 266.362  1.00 25.62           N
ATOM   7304  CA  THR C 222      38.585  68.632 267.592  1.00 24.12           C
ATOM   7305  C   THR C 222      39.729  69.606 267.307  1.00 23.00           C
ATOM   7306  O   THR C 222      39.962  69.987 266.154  1.00 21.19           O
ATOM   7307  CB  THR C 222      39.104  67.379 268.326  1.00 24.72           C
ATOM   7308  OG1 THR C 222      39.770  66.507 267.396  1.00 24.65           O
ATOM   7309  CG2 THR C 222      37.934  66.622 268.959  1.00 24.51           C
ATOM   7310  N   ASP C 223      40.418  70.028 268.365  1.00 23.74           N
ATOM   7311  CA  ASP C 223      41.484  71.018 268.253  1.00 25.03           C
ATOM   7312  C   ASP C 223      42.783  70.529 268.939  1.00 23.86           C
ATOM   7313  O   ASP C 223      43.512  71.309 269.568  1.00 24.08           O
ATOM   7314  CB  ASP C 223      40.985  72.350 268.819  1.00 27.33           C
ATOM   7315  CG  ASP C 223      41.883  73.534 268.451  1.00 30.66           C
ATOM   7316  OD1 ASP C 223      42.208  73.741 267.267  1.00 32.62           O
ATOM   7317  OD2 ASP C 223      42.275  74.278 269.368  1.00 33.96           O
ATOM   7318  N   TYR C 224      43.077  69.234 268.801  1.00 21.86           N
ATOM   7319  CA  TYR C 224      44.320  68.675 269.330  1.00 22.23           C
ATOM   7320  C   TYR C 224      45.551  69.278 268.667  1.00 21.48           C
ATOM   7321  O   TYR C 224      46.601  69.332 269.260  1.00 20.40           O
ATOM   7322  CB  TYR C 224      44.365  67.160 269.132  1.00 23.13           C
ATOM   7323  CG  TYR C 224      43.421  66.459 270.034  1.00 23.83           C
ATOM   7324  CD1 TYR C 224      43.691  66.382 271.402  1.00 24.31           C
ATOM   7325  CD2 TYR C 224      42.241  65.898 269.555  1.00 23.14           C
ATOM   7326  CE1 TYR C 224      42.816  65.759 272.276  1.00 24.84           C
ATOM   7327  CE2 TYR C 224      41.353  65.274 270.428  1.00 24.41           C
ATOM   7328  CZ  TYR C 224      41.642  65.209 271.794  1.00 24.75           C
ATOM   7329  OH  TYR C 224      40.789  64.585 272.697  1.00 24.46           O
ATOM   7330  N   ARG C 225      45.394  69.722 267.430  1.00 21.69           N
ATOM   7331  CA  ARG C 225      46.473  70.277 266.654  1.00 22.20           C
ATOM   7332  C   ARG C 225      47.002  71.583 267.231  1.00 21.18           C
ATOM   7333  O   ARG C 225      48.057  72.030 266.831  1.00 19.85           O
ATOM   7334  CB  ARG C 225      46.032  70.473 265.182  1.00 23.51           C
ATOM   7335  CG  ARG C 225      45.520  71.851 264.794  1.00 25.60           C
ATOM   7336  CD  ARG C 225      44.565  71.835 263.595  1.00 27.80           C
ATOM   7337  NE  ARG C 225      43.193  71.864 264.092  1.00 31.06           N
ATOM   7338  CZ  ARG C 225      42.268  72.761 263.780  1.00 33.72           C
ATOM   7339  NH1 ARG C 225      42.504  73.717 262.897  1.00 37.97           N
ATOM   7340  NH2 ARG C 225      41.072  72.680 264.341  1.00 35.23           N
ATOM   7341  N   ALA C 226      46.266  72.202 268.150  1.00 20.89           N
ATOM   7342  CA  ALA C 226      46.662  73.496 268.706  1.00 20.19           C
ATOM   7343  C   ALA C 226      47.952  73.383 269.512  1.00 20.69           C
ATOM   7344  O   ALA C 226      48.572  74.382 269.843  1.00 20.72           O
ATOM   7345  CB  ALA C 226      45.565  74.024 269.583  1.00 19.48           C
ATOM   7346  N   ALA C 227      48.339  72.158 269.841  1.00 20.84           N
ATOM   7347  CA  ALA C 227      49.640  71.877 270.450  1.00 21.58           C
ATOM   7348  C   ALA C 227      50.821  72.237 269.514  1.00 22.66           C
ATOM   7349  O   ALA C 227      51.945  72.544 269.984  1.00 23.96           O
ATOM   7350  CB  ALA C 227      49.705  70.414 270.847  1.00 20.65           C
ATOM   7351  N   THR C 228      50.535  72.222 268.208  1.00 22.08           N
```

Appendix 2

```
ATOM   7352  CA   THR C 228      51.516  72.380 267.153  1.00 22.14           C
ATOM   7353  C    THR C 228      52.325  73.643 267.233  1.00 21.49           C
ATOM   7354  O    THR C 228      53.516  73.591 266.995  1.00 21.08           O
ATOM   7355  CB   THR C 228      50.874  72.327 265.762  1.00 23.67           C
ATOM   7356  OG1  THR C 228      50.068  71.145 265.656  1.00 25.52           O
ATOM   7357  CG2  THR C 228      51.953  72.315 264.673  1.00 24.86           C
ATOM   7358  N    ARG C 229      51.701  74.759 267.578  1.00 21.91           N
ATOM   7359  CA   ARG C 229      52.415  76.052 267.641  1.00 23.09           C
ATOM   7360  C    ARG C 229      53.550  76.121 268.726  1.00 21.84           C
ATOM   7361  O    ARG C 229      54.642  76.668 268.503  1.00 19.94           O
ATOM   7362  CB   ARG C 229      51.393  77.198 267.803  1.00 24.36           C
ATOM   7363  CG   ARG C 229      52.003  78.559 268.078  1.00 26.69           C
ATOM   7364  CD   ARG C 229      53.001  78.948 266.995  1.00 28.92           C
ATOM   7365  NE   ARG C 229      53.868  80.066 267.391  1.00 31.94           N
ATOM   7366  CZ   ARG C 229      53.496  81.352 267.501  1.00 32.05           C
ATOM   7367  NH1  ARG C 229      52.249  81.778 267.278  1.00 31.64           N
ATOM   7368  NH2  ARG C 229      54.408  82.232 267.864  1.00 33.45           N
ATOM   7369  N    ALA C 230      53.280  75.544 269.891  1.00 21.33           N
ATOM   7370  CA   ALA C 230      54.277  75.486 270.956  1.00 20.66           C
ATOM   7371  C    ALA C 230      55.476  74.633 270.493  1.00 20.42           C
ATOM   7372  O    ALA C 230      56.626  74.974 270.742  1.00 21.10           O
ATOM   7373  CB   ALA C 230      53.655  74.948 272.254  1.00 18.88           C
ATOM   7374  N    TRP C 231      55.184  73.560 269.771  1.00 20.23           N
ATOM   7375  CA   TRP C 231      56.194  72.605 269.339  1.00 20.71           C
ATOM   7376  C    TRP C 231      57.110  73.191 268.270  1.00 21.34           C
ATOM   7377  O    TRP C 231      58.308  72.970 268.304  1.00 21.44           O
ATOM   7378  CB   TRP C 231      55.508  71.329 268.829  1.00 20.56           C
ATOM   7379  CG   TRP C 231      56.432  70.333 268.327  1.00 20.04           C
ATOM   7380  CD1  TRP C 231      57.314  69.608 269.050  1.00 20.23           C
ATOM   7381  CD2  TRP C 231      56.596  69.936 266.963  1.00 20.76           C
ATOM   7382  NE1  TRP C 231      58.039  68.776 268.223  1.00 20.11           N
ATOM   7383  CE2  TRP C 231      57.614  68.956 266.933  1.00 20.07           C
ATOM   7384  CE3  TRP C 231      55.981  70.316 265.754  1.00 20.13           C
ATOM   7385  CZ2  TRP C 231      58.027  68.347 265.753  1.00 19.31           C
ATOM   7386  CZ3  TRP C 231      56.393  69.709 264.583  1.00 19.32           C
ATOM   7387  CH2  TRP C 231      57.418  68.743 264.589  1.00 19.47           C
ATOM   7388  N    LEU C 232      56.543  73.952 267.339  1.00 21.73           N
ATOM   7389  CA   LEU C 232      57.308  74.575 266.280  1.00 21.97           C
ATOM   7390  C    LEU C 232      58.171  75.729 266.798  1.00 23.26           C
ATOM   7391  O    LEU C 232      59.197  76.045 266.182  1.00 23.80           O
ATOM   7392  CB   LEU C 232      56.386  75.098 265.170  1.00 21.86           C
ATOM   7393  CG   LEU C 232      55.547  74.109 264.359  1.00 22.06           C
ATOM   7394  CD1  LEU C 232      54.719  74.887 263.347  1.00 22.03           C
ATOM   7395  CD2  LEU C 232      56.398  73.056 263.656  1.00 22.17           C
ATOM   7396  N    ASP C 233      57.746  76.385 267.881  1.00 23.76           N
ATOM   7397  CA   ASP C 233      58.572  77.434 268.519  1.00 24.68           C
ATOM   7398  C    ASP C 233      59.722  76.781 269.260  1.00 23.94           C
ATOM   7399  O    ASP C 233      60.840  77.304 269.298  1.00 22.06           O
ATOM   7400  CB   ASP C 233      57.763  78.289 269.523  1.00 25.83           C
ATOM   7401  CG   ASP C 233      56.710  79.169 268.848  1.00 26.80           C
ATOM   7402  OD1  ASP C 233      56.678  79.264 267.599  1.00 27.37           O
ATOM   7403  OD2  ASP C 233      55.898  79.765 269.573  1.00 27.66           O
ATOM   7404  N    PHE C 234      59.422  75.625 269.854  1.00 24.10           N
ATOM   7405  CA   PHE C 234      60.384  74.920 270.683  1.00 24.87           C
```

Appendix 2

```
ATOM   7406  C   PHE C 234      61.532  74.310 269.873  1.00 22.81           C
ATOM   7407  O   PHE C 234      62.677  74.374 270.289  1.00 22.13           O
ATOM   7408  CB  PHE C 234      59.689  73.842 271.515  1.00 26.04           C
ATOM   7409  CG  PHE C 234      60.650  72.891 272.181  1.00 28.18           C
ATOM   7410  CD1 PHE C 234      61.462  73.329 273.225  1.00 29.38           C
ATOM   7411  CD2 PHE C 234      60.767  71.575 271.746  1.00 28.07           C
ATOM   7412  CE1 PHE C 234      62.348  72.467 273.841  1.00 29.51           C
ATOM   7413  CE2 PHE C 234      61.653  70.705 272.359  1.00 29.46           C
ATOM   7414  CZ  PHE C 234      62.441  71.149 273.409  1.00 30.29           C
ATOM   7415  N   ILE C 235      61.215  73.724 268.727  1.00 22.00           N
ATOM   7416  CA  ILE C 235      62.230  73.070 267.900  1.00 22.45           C
ATOM   7417  C   ILE C 235      63.082  74.092 267.152  1.00 23.58           C
ATOM   7418  O   ILE C 235      64.216  73.793 266.813  1.00 22.71           O
ATOM   7419  CB  ILE C 235      61.641  72.030 266.892  1.00 20.77           C
ATOM   7420  CG1 ILE C 235      60.946  72.733 265.723  1.00 20.98           C
ATOM   7421  CG2 ILE C 235      60.742  71.023 267.603  1.00 19.67           C
ATOM   7422  CD1 ILE C 235      60.035  71.847 264.900  1.00 21.60           C
ATOM   7423  N   GLN C 236      62.533  75.279 266.883  1.00 25.89           N
ATOM   7424  CA  GLN C 236      63.326  76.377 266.309  1.00 28.73           C
ATOM   7425  C   GLN C 236      64.285  77.042 267.268  1.00 29.01           C
ATOM   7426  O   GLN C 236      65.196  77.693 266.826  1.00 27.99           O
ATOM   7427  CB  GLN C 236      62.437  77.469 265.741  1.00 30.30           C
ATOM   7428  CG  GLN C 236      62.099  77.270 264.289  1.00 31.75           C
ATOM   7429  CD  GLN C 236      61.104  78.297 263.819  1.00 32.71           C
ATOM   7430  OE1 GLN C 236      61.372  79.092 262.902  1.00 35.86           O
ATOM   7431  NE2 GLN C 236      59.953  78.313 264.467  1.00 31.78           N
ATOM   7432  N   LYS C 237      64.041  76.938 268.568  1.00 33.47           N
ATOM   7433  CA  LYS C 237      64.862  77.627 269.564  1.00 37.83           C
ATOM   7434  C   LYS C 237      65.698  76.537 270.165  1.00 40.71           C
ATOM   7435  O   LYS C 237      65.228  75.788 271.023  1.00 48.31           O
ATOM   7436  CB  LYS C 237      64.001  78.333 270.638  1.00 36.81           C
ATOM   7437  N   ASP C 238      66.913  76.387 269.658  1.00 42.92           N
ATOM   7438  CA  ASP C 238      67.895  75.518 270.295  1.00 43.96           C
ATOM   7439  C   ASP C 238      67.979  74.047 269.773  1.00 40.84           C
ATOM   7440  O   ASP C 238      68.979  73.392 270.028  1.00 40.82           O
ATOM   7441  CB  ASP C 238      67.675  75.570 271.825  1.00 45.75           C
ATOM   7442  CG  ASP C 238      68.905  75.252 272.596  1.00 45.27           C
ATOM   7443  OD1 ASP C 238      69.119  74.055 272.877  1.00 43.34           O
ATOM   7444  OD2 ASP C 238      69.637  76.204 272.932  1.00 44.81           O
ATOM   7445  N   LEU C 239      66.979  73.527 269.051  1.00 37.65           N
ATOM   7446  CA  LEU C 239      67.108  72.185 268.399  1.00 36.42           C
ATOM   7447  C   LEU C 239      67.392  72.214 266.900  1.00 34.96           C
ATOM   7448  O   LEU C 239      67.561  71.156 266.288  1.00 33.00           O
ATOM   7449  CB  LEU C 239      65.860  71.319 268.590  1.00 37.89           C
ATOM   7450  CG  LEU C 239      65.973  70.219 269.632  1.00 38.93           C
ATOM   7451  CD1 LEU C 239      65.864  70.857 271.002  1.00 42.32           C
ATOM   7452  CD2 LEU C 239      64.909  69.153 269.450  1.00 38.14           C
ATOM   7453  N   ILE C 240      67.405  73.409 266.311  1.00 34.51           N
ATOM   7454  CA  ILE C 240      67.737  73.594 264.899  1.00 34.60           C
ATOM   7455  C   ILE C 240      68.823  74.638 264.763  1.00 32.60           C
ATOM   7456  O   ILE C 240      68.876  75.532 265.575  1.00 36.44           O
ATOM   7457  CB  ILE C 240      66.493  74.050 264.105  1.00 35.11           C
ATOM   7458  CG1 ILE C 240      66.627  73.690 262.627  1.00 35.10           C
ATOM   7459  CG2 ILE C 240      66.233  75.540 264.289  1.00 34.97           C
```

Appendix 2

```
ATOM   7460  CD1 ILE C 240      65.490  74.223 261.786  1.00 36.54           C
ATOM   7461  N   ASP C 241      69.681  74.521 263.751  1.00 33.88           N
ATOM   7462  CA  ASP C 241      70.636  75.598 263.374  1.00 35.46           C
ATOM   7463  C   ASP C 241      70.037  76.402 262.237  1.00 34.61           C
ATOM   7464  O   ASP C 241      70.095  75.971 261.089  1.00 35.21           O
ATOM   7465  CB  ASP C 241      72.011  75.046 262.949  1.00 34.67           C
ATOM   7466  CG  ASP C 241      72.959  76.133 262.427  1.00 35.69           C
ATOM   7467  OD1 ASP C 241      72.569  77.327 262.235  1.00 36.31           O
ATOM   7468  OD2 ASP C 241      74.124  75.773 262.189  1.00 34.00           O
ATOM   7469  N   PRO C 242      69.500  77.596 262.542  1.00 36.99           N
ATOM   7470  CA  PRO C 242      68.701  78.307 261.550  1.00 37.37           C
ATOM   7471  C   PRO C 242      69.476  78.849 260.359  1.00 37.45           C
ATOM   7472  O   PRO C 242      68.868  79.054 259.314  1.00 39.17           O
ATOM   7473  CB  PRO C 242      68.083  79.455 262.341  1.00 36.93           C
ATOM   7474  CG  PRO C 242      68.535  79.288 263.749  1.00 37.10           C
ATOM   7475  CD  PRO C 242      69.739  78.431 263.726  1.00 37.19           C
ATOM   7476  N   GLU C 243      70.782  79.089 260.500  1.00 38.44           N
ATOM   7477  CA  GLU C 243      71.570  79.589 259.363  1.00 38.49           C
ATOM   7478  C   GLU C 243      71.691  78.472 258.308  1.00 38.50           C
ATOM   7479  O   GLU C 243      71.583  78.743 257.119  1.00 39.54           O
ATOM   7480  CB  GLU C 243      72.946  80.153 259.794  1.00 36.58           C
ATOM   7481  N   ARG C 244      71.861  77.218 258.744  1.00 38.13           N
ATOM   7482  CA  ARG C 244      72.030  76.084 257.820  1.00 35.57           C
ATOM   7483  C   ARG C 244      70.717  75.297 257.579  1.00 33.75           C
ATOM   7484  O   ARG C 244      70.632  74.429 256.708  1.00 32.24           O
ATOM   7485  CB  ARG C 244      73.156  75.176 258.308  1.00 37.75           C
ATOM   7486  CG  ARG C 244      74.548  75.773 258.080  1.00 40.64           C
ATOM   7487  CD  ARG C 244      75.695  74.926 258.645  1.00 40.71           C
ATOM   7488  NE  ARG C 244      75.569  74.683 260.087  1.00 42.85           N
ATOM   7489  CZ  ARG C 244      76.196  73.711 260.775  1.00 43.69           C
ATOM   7490  NH1 ARG C 244      77.027  72.850 260.179  1.00 39.52           N
ATOM   7491  NH2 ARG C 244      75.975  73.584 262.087  1.00 42.76           N
ATOM   7492  N   GLY C 245      69.674  75.622 258.321  1.00 30.67           N
ATOM   7493  CA  GLY C 245      68.374  75.067 258.027  1.00 29.64           C
ATOM   7494  C   GLY C 245      68.324  73.588 258.310  1.00 28.87           C
ATOM   7495  O   GLY C 245      67.725  72.814 257.548  1.00 26.82           O
ATOM   7496  N   ALA C 246      68.937  73.200 259.426  1.00 28.99           N
ATOM   7497  CA  ALA C 246      69.119  71.798 259.739  1.00 28.85           C
ATOM   7498  C   ALA C 246      69.001  71.480 261.234  1.00 30.25           C
ATOM   7499  O   ALA C 246      69.580  72.163 262.081  1.00 27.41           O
ATOM   7500  CB  ALA C 246      70.460  71.360 259.217  1.00 29.07           C
ATOM   7501  N   PHE C 247      68.274  70.408 261.549  1.00 31.47           N
ATOM   7502  CA  PHE C 247      68.057  70.031 262.950  1.00 30.78           C
ATOM   7503  C   PHE C 247      69.235  69.250 263.437  1.00 29.07           C
ATOM   7504  O   PHE C 247      69.799  68.505 262.664  1.00 28.65           O
ATOM   7505  CB  PHE C 247      66.790  69.182 263.096  1.00 29.89           C
ATOM   7506  CG  PHE C 247      65.530  69.942 262.822  1.00 28.25           C
ATOM   7507  CD1 PHE C 247      64.982  70.749 263.786  1.00 27.77           C
ATOM   7508  CD2 PHE C 247      64.908  69.850 261.598  1.00 28.96           C
ATOM   7509  CE1 PHE C 247      63.838  71.464 263.539  1.00 28.69           C
ATOM   7510  CE2 PHE C 247      63.755  70.562 261.339  1.00 29.39           C
ATOM   7511  CZ  PHE C 247      63.222  71.374 262.309  1.00 29.50           C
ATOM   7512  N   TYR C 248      69.595  69.420 264.708  1.00 30.01           N
ATOM   7513  CA  TYR C 248      70.589  68.543 265.347  1.00 31.37           C
```

Appendix 2

```
ATOM   7514  C    TYR C 248      69.937  67.198 265.545  1.00 30.97           C
ATOM   7515  O    TYR C 248      68.709  67.073 265.451  1.00 33.17           O
ATOM   7516  CB   TYR C 248      71.114  69.095 266.689  1.00 32.47           C
ATOM   7517  CG   TYR C 248      71.823  70.423 266.533  1.00 34.21           C
ATOM   7518  CD1  TYR C 248      73.154  70.490 266.126  1.00 36.54           C
ATOM   7519  CD2  TYR C 248      71.154  71.604 266.748  1.00 35.26           C
ATOM   7520  CE1  TYR C 248      73.791  71.710 265.948  1.00 36.76           C
ATOM   7521  CE2  TYR C 248      71.775  72.821 266.574  1.00 37.06           C
ATOM   7522  CZ   TYR C 248      73.088  72.873 266.175  1.00 37.13           C
ATOM   7523  OH   TYR C 248      73.675  74.109 266.024  1.00 39.48           O
ATOM   7524  N    LEU C 249      70.783  66.214 265.832  1.00 29.72           N
ATOM   7525  CA   LEU C 249      70.482  64.783 265.744  1.00 27.34           C
ATOM   7526  C    LEU C 249      69.405  64.345 266.711  1.00 27.01           C
ATOM   7527  O    LEU C 249      68.517  63.588 266.346  1.00 29.31           O
ATOM   7528  CB   LEU C 249      71.768  64.014 266.045  1.00 26.89           C
ATOM   7529  CG   LEU C 249      71.942  62.535 265.739  1.00 26.97           C
ATOM   7530  CD1  LEU C 249      71.555  62.216 264.298  1.00 27.00           C
ATOM   7531  CD2  LEU C 249      73.393  62.149 266.009  1.00 26.46           C
ATOM   7532  N    SER C 250      69.494  64.823 267.941  1.00 25.03           N
ATOM   7533  CA   SER C 250      68.558  64.455 268.985  1.00 25.67           C
ATOM   7534  C    SER C 250      68.740  65.352 270.207  1.00 26.20           C
ATOM   7535  O    SER C 250      69.775  66.026 270.347  1.00 25.96           O
ATOM   7536  CB   SER C 250      68.767  62.994 269.419  1.00 26.12           C
ATOM   7537  OG   SER C 250      70.048  62.781 270.015  1.00 26.12           O
ATOM   7538  N    TYR C 251      67.756  65.315 271.100  1.00 25.08           N
ATOM   7539  CA   TYR C 251      67.785  66.089 272.329  1.00 26.93           C
ATOM   7540  C    TYR C 251      67.505  65.168 273.509  1.00 27.18           C
ATOM   7541  O    TYR C 251      66.865  64.130 273.327  1.00 26.60           O
ATOM   7542  CB   TYR C 251      66.755  67.207 272.211  1.00 28.08           C
ATOM   7543  CG   TYR C 251      66.348  67.881 273.495  1.00 29.01           C
ATOM   7544  CD1  TYR C 251      67.234  68.693 274.189  1.00 30.30           C
ATOM   7545  CD2  TYR C 251      65.051  67.732 274.005  1.00 29.14           C
ATOM   7546  CE1  TYR C 251      66.845  69.327 275.360  1.00 30.70           C
ATOM   7547  CE2  TYR C 251      64.658  68.357 275.177  1.00 28.91           C
ATOM   7548  CZ   TYR C 251      65.553  69.154 275.838  1.00 29.41           C
ATOM   7549  OH   TYR C 251      65.169  69.784 276.974  1.00 30.31           O
ATOM   7550  N    HIS C 252      67.995  65.524 274.699  1.00 26.46           N
ATOM   7551  CA   HIS C 252      67.984  64.595 275.808  1.00 28.09           C
ATOM   7552  C    HIS C 252      67.657  65.257 277.137  1.00 31.44           C
ATOM   7553  O    HIS C 252      68.566  65.539 277.924  1.00 32.76           O
ATOM   7554  CB   HIS C 252      69.318  63.889 275.874  1.00 28.10           C
ATOM   7555  CG   HIS C 252      69.680  63.239 274.591  1.00 30.14           C
ATOM   7556  ND1  HIS C 252      69.309  61.947 274.280  1.00 32.07           N
ATOM   7557  CD2  HIS C 252      70.292  63.733 273.489  1.00 31.44           C
ATOM   7558  CE1  HIS C 252      69.711  61.659 273.054  1.00 31.75           C
ATOM   7559  NE2  HIS C 252      70.311  62.727 272.552  1.00 31.54           N
ATOM   7560  N    PRO C 253      66.345  65.459 277.410  1.00 32.71           N
ATOM   7561  CA   PRO C 253      65.779  66.296 278.480  1.00 30.73           C
ATOM   7562  C    PRO C 253      66.385  66.172 279.869  1.00 30.01           C
ATOM   7563  O    PRO C 253      66.500  67.178 280.546  1.00 29.78           O
ATOM   7564  CB   PRO C 253      64.303  65.892 278.533  1.00 32.08           C
ATOM   7565  CG   PRO C 253      64.118  64.799 277.541  1.00 33.32           C
ATOM   7566  CD   PRO C 253      65.286  64.809 276.617  1.00 32.61           C
ATOM   7567  N    GLU C 254      66.777  64.993 280.326  1.00 31.04           N
```

Appendix 2

```
ATOM   7568  CA  GLU C 254      67.341  64.947 281.680  1.00 34.08           C
ATOM   7569  C   GLU C 254      68.703  65.652 281.779  1.00 32.07           C
ATOM   7570  O   GLU C 254      68.972  66.290 282.772  1.00 33.07           O
ATOM   7571  CB  GLU C 254      67.417  63.532 282.280  1.00 37.24           C
ATOM   7572  CG  GLU C 254      67.286  63.565 283.817  1.00 42.43           C
ATOM   7573  CD  GLU C 254      68.289  62.684 284.560  1.00 46.44           C
ATOM   7574  OE1 GLU C 254      68.584  61.573 284.055  1.00 53.69           O
ATOM   7575  OE2 GLU C 254      68.770  63.086 285.658  1.00 42.92           O
ATOM   7576  N   SER C 255      69.540  65.536 280.754  1.00 31.33           N
ATOM   7577  CA  SER C 255      70.819  66.262 280.663  1.00 30.63           C
ATOM   7578  C   SER C 255      70.653  67.665 280.074  1.00 31.62           C
ATOM   7579  O   SER C 255      71.341  68.581 280.469  1.00 32.78           O
ATOM   7580  CB  SER C 255      71.817  65.485 279.782  1.00 29.96           C
ATOM   7581  OG  SER C 255      71.160  64.849 278.690  1.00 28.96           O
ATOM   7582  N   GLY C 256      69.754  67.834 279.108  1.00 31.69           N
ATOM   7583  CA  GLY C 256      69.683  69.084 278.342  1.00 31.03           C
ATOM   7584  C   GLY C 256      70.586  69.027 277.117  1.00 30.38           C
ATOM   7585  O   GLY C 256      70.612  69.948 276.295  1.00 28.60           O
ATOM   7586  N   ALA C 257      71.310  67.921 276.982  1.00 28.67           N
ATOM   7587  CA  ALA C 257      72.206  67.750 275.868  1.00 28.14           C
ATOM   7588  C   ALA C 257      71.451  67.731 274.542  1.00 27.15           C
ATOM   7589  O   ALA C 257      70.350  67.181 274.449  1.00 27.37           O
ATOM   7590  CB  ALA C 257      73.001  66.463 276.033  1.00 28.26           C
ATOM   7591  N   VAL C 258      72.063  68.347 273.534  1.00 25.93           N
ATOM   7592  CA  VAL C 258      71.653  68.236 272.155  1.00 25.34           C
ATOM   7593  C   VAL C 258      72.881  67.698 271.493  1.00 27.24           C
ATOM   7594  O   VAL C 258      73.907  68.335 271.530  1.00 31.07           O
ATOM   7595  CB  VAL C 258      71.348  69.612 271.563  1.00 25.19           C
ATOM   7596  CG1 VAL C 258      71.092  69.540 270.068  1.00 25.81           C
ATOM   7597  CG2 VAL C 258      70.165  70.236 272.271  1.00 25.46           C
ATOM   7598  N   LYS C 259      72.811  66.507 270.922  1.00 28.12           N
ATOM   7599  CA  LYS C 259      73.958  65.967 270.222  1.00 27.45           C
ATOM   7600  C   LYS C 259      74.443  66.979 269.184  1.00 28.62           C
ATOM   7601  O   LYS C 259      73.664  67.502 268.419  1.00 31.48           O
ATOM   7602  CB  LYS C 259      73.636  64.606 269.592  1.00 26.04           C
ATOM   7603  CG  LYS C 259      73.647  63.493 270.632  1.00 25.07           C
ATOM   7604  CD  LYS C 259      73.345  62.130 270.037  1.00 25.19           C
ATOM   7605  CE  LYS C 259      73.091  61.105 271.129  1.00 24.89           C
ATOM   7606  NZ  LYS C 259      72.853  59.754 270.571  1.00 25.13           N
ATOM   7607  N   PRO C 260      75.745  67.261 269.160  1.00 29.90           N
ATOM   7608  CA  PRO C 260      76.235  68.403 268.402  1.00 30.89           C
ATOM   7609  C   PRO C 260      76.326  68.245 266.879  1.00 30.98           C
ATOM   7610  O   PRO C 260      76.724  69.181 266.183  1.00 33.69           O
ATOM   7611  CB  PRO C 260      77.603  68.661 269.028  1.00 30.97           C
ATOM   7612  CG  PRO C 260      78.043  67.315 269.475  1.00 31.51           C
ATOM   7613  CD  PRO C 260      76.808  66.612 269.936  1.00 29.67           C
ATOM   7614  N   TRP C 261      75.896  67.121 266.346  1.00 30.93           N
ATOM   7615  CA  TRP C 261      75.901  66.954 264.896  1.00 31.08           C
ATOM   7616  C   TRP C 261      74.583  67.300 264.267  1.00 28.56           C
ATOM   7617  O   TRP C 261      73.538  67.036 264.848  1.00 28.05           O
ATOM   7618  CB  TRP C 261      76.251  65.515 264.556  1.00 31.63           C
ATOM   7619  CG  TRP C 261      77.553  65.157 265.128  1.00 32.66           C
ATOM   7620  CD1 TRP C 261      78.772  65.499 264.635  1.00 34.79           C
ATOM   7621  CD2 TRP C 261      77.788  64.429 266.329  1.00 32.91           C
```

Appendix 2

```
ATOM   7622  NE1 TRP C 261      79.755  65.005 265.436  1.00 37.31           N
ATOM   7623  CE2 TRP C 261      79.182  64.345 266.492  1.00 35.31           C
ATOM   7624  CE3 TRP C 261      76.959  63.822 267.270  1.00 32.25           C
ATOM   7625  CZ2 TRP C 261      79.774  63.677 267.561  1.00 33.81           C
ATOM   7626  CZ3 TRP C 261      77.537  63.178 268.335  1.00 33.40           C
ATOM   7627  CH2 TRP C 261      78.941  63.106 268.474  1.00 34.10           C
ATOM   7628  N   ILE C 262      74.636  67.860 263.064  1.00 27.36           N
ATOM   7629  CA  ILE C 262      73.430  68.080 262.289  1.00 28.64           C
ATOM   7630  C   ILE C 262      73.162  66.917 261.339  1.00 29.05           C
ATOM   7631  O   ILE C 262      74.084  66.202 260.930  1.00 30.05           O
ATOM   7632  CB  ILE C 262      73.443  69.420 261.532  1.00 30.35           C
ATOM   7633  CG1 ILE C 262      74.527  69.469 260.463  1.00 29.97           C
ATOM   7634  CG2 ILE C 262      73.650  70.564 262.511  1.00 31.39           C
ATOM   7635  CD1 ILE C 262      74.379  70.671 259.552  1.00 29.78           C
ATOM   7636  N   SER C 263      71.889  66.723 260.997  1.00 27.89           N
ATOM   7637  CA  SER C 263      71.483  65.519 260.298  1.00 28.10           C
ATOM   7638  C   SER C 263      70.555  65.787 259.100  1.00 29.14           C
ATOM   7639  O   SER C 263      69.467  66.352 259.232  1.00 30.03           O
ATOM   7640  CB  SER C 263      70.839  64.544 261.279  1.00 27.25           C
ATOM   7641  OG  SER C 263      70.112  63.545 260.588  1.00 26.99           O
ATOM   7642  N   ALA C 264      70.986  65.350 257.927  1.00 29.43           N
ATOM   7643  CA  ALA C 264      70.213  65.577 256.724  1.00 30.80           C
ATOM   7644  C   ALA C 264      68.897  64.765 256.684  1.00 30.22           C
ATOM   7645  O   ALA C 264      67.829  65.322 256.378  1.00 28.61           O
ATOM   7646  CB  ALA C 264      71.067  65.275 255.505  1.00 31.78           C
ATOM   7647  N   TYR C 265      68.967  63.467 256.985  1.00 27.21           N
ATOM   7648  CA  TYR C 265      67.765  62.628 256.880  1.00 26.97           C
ATOM   7649  C   TYR C 265      66.735  63.071 257.914  1.00 24.82           C
ATOM   7650  O   TYR C 265      65.563  63.165 257.614  1.00 23.82           O
ATOM   7651  CB  TYR C 265      68.073  61.104 256.988  1.00 26.80           C
ATOM   7652  CG  TYR C 265      67.833  60.477 258.345  1.00 24.70           C
ATOM   7653  CD1 TYR C 265      68.842  60.436 259.300  1.00 24.19           C
ATOM   7654  CD2 TYR C 265      66.588  59.933 258.664  1.00 23.74           C
ATOM   7655  CE1 TYR C 265      68.617  59.872 260.547  1.00 24.83           C
ATOM   7656  CE2 TYR C 265      66.341  59.379 259.908  1.00 23.79           C
ATOM   7657  CZ  TYR C 265      67.354  59.342 260.840  1.00 24.63           C
ATOM   7658  OH  TYR C 265      67.106  58.780 262.051  1.00 24.01           O
ATOM   7659  N   THR C 266      67.205  63.350 259.119  1.00 24.74           N
ATOM   7660  CA  THR C 266      66.373  63.872 260.189  1.00 24.59           C
ATOM   7661  C   THR C 266      65.702  65.172 259.735  1.00 25.19           C
ATOM   7662  O   THR C 266      64.527  65.403 260.018  1.00 27.37           O
ATOM   7663  CB  THR C 266      67.196  64.152 261.475  1.00 24.29           C
ATOM   7664  OG1 THR C 266      67.738  62.929 261.982  1.00 23.11           O
ATOM   7665  CG2 THR C 266      66.304  64.779 262.563  1.00 25.73           C
ATOM   7666  N   THR C 267      66.433  66.025 259.040  1.00 24.72           N
ATOM   7667  CA  THR C 267      65.853  67.300 258.639  1.00 26.29           C
ATOM   7668  C   THR C 267      64.863  67.122 257.446  1.00 26.93           C
ATOM   7669  O   THR C 267      63.771  67.714 257.428  1.00 25.47           O
ATOM   7670  CB  THR C 267      66.943  68.372 258.346  1.00 25.69           C
ATOM   7671  OG1 THR C 267      67.738  68.632 259.528  1.00 23.09           O
ATOM   7672  CG2 THR C 267      66.263  69.653 257.927  1.00 25.91           C
ATOM   7673  N   ALA C 268      65.237  66.295 256.472  1.00 27.07           N
ATOM   7674  CA  ALA C 268      64.389  66.083 255.312  1.00 26.42           C
ATOM   7675  C   ALA C 268      63.050  65.523 255.750  1.00 28.11           C
```

Appendix 2

```
ATOM   7676  O    ALA C 268      62.007  66.021 255.329  1.00 29.89           O
ATOM   7677  CB   ALA C 268      65.050  65.164 254.302  1.00 25.21           C
ATOM   7678  N    TRP C 269      63.074  64.505 256.607  1.00 28.26           N
ATOM   7679  CA   TRP C 269      61.834  63.900 257.120  1.00 28.36           C
ATOM   7680  C    TRP C 269      61.024  64.944 257.923  1.00 27.60           C
ATOM   7681  O    TRP C 269      59.844  65.175 257.652  1.00 25.96           O
ATOM   7682  CB   TRP C 269      62.192  62.660 257.930  1.00 29.97           C
ATOM   7683  CG   TRP C 269      61.112  61.942 258.693  1.00 32.85           C
ATOM   7684  CD1  TRP C 269      59.824  62.329 258.892  1.00 32.67           C
ATOM   7685  CD2  TRP C 269      61.281  60.703 259.420  1.00 35.72           C
ATOM   7686  NE1  TRP C 269      59.174  61.417 259.678  1.00 37.80           N
ATOM   7687  CE2  TRP C 269      60.042  60.405 260.022  1.00 38.11           C
ATOM   7688  CE3  TRP C 269      62.363  59.817 259.613  1.00 34.34           C
ATOM   7689  CZ2  TRP C 269      59.846  59.251 260.828  1.00 36.59           C
ATOM   7690  CZ3  TRP C 269      62.170  58.670 260.408  1.00 35.59           C
ATOM   7691  CH2  TRP C 269      60.919  58.402 261.008  1.00 36.43           C
ATOM   7692  N    THR C 270      61.664  65.630 258.856  1.00 25.86           N
ATOM   7693  CA   THR C 270      60.962  66.640 259.607  1.00 25.80           C
ATOM   7694  C    THR C 270      60.341  67.778 258.768  1.00 25.84           C
ATOM   7695  O    THR C 270      59.223  68.174 259.038  1.00 24.59           O
ATOM   7696  CB   THR C 270      61.872  67.213 260.681  1.00 26.53           C
ATOM   7697  OG1  THR C 270      62.267  66.139 261.542  1.00 26.48           O
ATOM   7698  CG2  THR C 270      61.144  68.331 261.483  1.00 26.07           C
ATOM   7699  N    LEU C 271      61.028  68.292 257.753  1.00 25.26           N
ATOM   7700  CA   LEU C 271      60.483  69.434 257.012  1.00 25.70           C
ATOM   7701  C    LEU C 271      59.339  68.995 256.135  1.00 25.62           C
ATOM   7702  O    LEU C 271      58.359  69.721 255.934  1.00 24.75           O
ATOM   7703  CB   LEU C 271      61.553  70.117 256.152  1.00 25.73           C
ATOM   7704  CG   LEU C 271      62.627  70.823 256.982  1.00 26.91           C
ATOM   7705  CD1  LEU C 271      63.737  71.337 256.066  1.00 27.82           C
ATOM   7706  CD2  LEU C 271      62.039  71.953 257.816  1.00 26.43           C
ATOM   7707  N    ALA C 272      59.486  67.801 255.590  1.00 26.25           N
ATOM   7708  CA   ALA C 272      58.484  67.241 254.733  1.00 26.62           C
ATOM   7709  C    ALA C 272      57.130  67.191 255.438  1.00 27.19           C
ATOM   7710  O    ALA C 272      56.102  67.562 254.851  1.00 26.42           O
ATOM   7711  CB   ALA C 272      58.903  65.853 254.335  1.00 28.82           C
ATOM   7712  N    MET C 273      57.139  66.744 256.689  1.00 26.49           N
ATOM   7713  CA   MET C 273      55.907  66.604 257.460  1.00 29.46           C
ATOM   7714  C    MET C 273      55.376  67.943 257.938  1.00 29.55           C
ATOM   7715  O    MET C 273      54.177  68.243 257.770  1.00 29.08           O
ATOM   7716  CB   MET C 273      56.098  65.640 258.630  1.00 31.82           C
ATOM   7717  CG   MET C 273      56.354  64.219 258.148  1.00 35.16           C
ATOM   7718  SD   MET C 273      55.582  63.013 259.203  1.00 42.07           S
ATOM   7719  CE   MET C 273      55.592  61.538 258.194  1.00 43.13           C
ATOM   7720  N    VAL C 274      56.270  68.757 258.493  1.00 27.73           N
ATOM   7721  CA   VAL C 274      55.917  70.106 258.934  1.00 26.51           C
ATOM   7722  C    VAL C 274      55.235  70.911 257.827  1.00 26.21           C
ATOM   7723  O    VAL C 274      54.279  71.629 258.100  1.00 25.84           O
ATOM   7724  CB   VAL C 274      57.139  70.869 259.511  1.00 25.29           C
ATOM   7725  CG1  VAL C 274      56.850  72.369 259.593  1.00 25.63           C
ATOM   7726  CG2  VAL C 274      57.504  70.312 260.890  1.00 23.72           C
ATOM   7727  N    HIS C 275      55.686  70.757 256.586  1.00 27.04           N
ATOM   7728  CA   HIS C 275      55.120  71.503 255.457  1.00 28.52           C
ATOM   7729  C    HIS C 275      53.601  71.337 255.327  1.00 28.24           C
```

Appendix 2

```
ATOM   7730  O    HIS C 275      52.903  72.228 254.806  1.00 29.52           O
ATOM   7731  CB   HIS C 275      55.799  71.101 254.142  1.00 29.27           C
ATOM   7732  CG   HIS C 275      55.432  71.968 252.981  1.00 31.35           C
ATOM   7733  ND1  HIS C 275      54.730  71.501 251.891  1.00 33.70           N
ATOM   7734  CD2  HIS C 275      55.672  73.278 252.738  1.00 33.88           C
ATOM   7735  CE1  HIS C 275      54.559  72.482 251.022  1.00 33.58           C
ATOM   7736  NE2  HIS C 275      55.129  73.570 251.509  1.00 34.62           N
ATOM   7737  N    GLY C 276      53.091  70.197 255.776  1.00 26.61           N
ATOM   7738  CA   GLY C 276      51.651  69.972 255.791  1.00 26.82           C
ATOM   7739  C    GLY C 276      50.915  70.619 256.956  1.00 26.57           C
ATOM   7740  O    GLY C 276      49.687  70.648 256.963  1.00 25.69           O
ATOM   7741  N    MET C 277      51.655  71.103 257.957  1.00 27.71           N
ATOM   7742  CA   MET C 277      51.077  71.677 259.176  1.00 28.27           C
ATOM   7743  C    MET C 277      51.280  73.194 259.202  1.00 27.97           C
ATOM   7744  O    MET C 277      50.330  73.949 259.426  1.00 28.35           O
ATOM   7745  CB   MET C 277      51.692  71.025 260.425  1.00 28.16           C
ATOM   7746  CG   MET C 277      51.240  69.577 260.661  1.00 28.97           C
ATOM   7747  SD   MET C 277      51.822  68.805 262.201  1.00 28.89           S
ATOM   7748  CE   MET C 277      53.544  68.527 261.807  1.00 26.37           C
ATOM   7749  N    ASP C 278      52.524  73.612 258.991  1.00 26.63           N
ATOM   7750  CA   ASP C 278      52.886  75.006 258.822  1.00 27.09           C
ATOM   7751  C    ASP C 278      53.754  75.082 257.565  1.00 26.93           C
ATOM   7752  O    ASP C 278      54.962  74.977 257.651  1.00 28.12           O
ATOM   7753  CB   ASP C 278      53.645  75.484 260.055  1.00 27.89           C
ATOM   7754  CG   ASP C 278      54.104  76.938 259.968  1.00 28.60           C
ATOM   7755  OD1  ASP C 278      54.038  77.541 258.865  1.00 28.28           O
ATOM   7756  OD2  ASP C 278      54.556  77.463 261.034  1.00 28.36           O
ATOM   7757  N    PRO C 279      53.137  75.267 256.385  1.00 26.60           N
ATOM   7758  CA   PRO C 279      53.891  75.254 255.127  1.00 27.06           C
ATOM   7759  C    PRO C 279      54.987  76.319 255.049  1.00 28.33           C
ATOM   7760  O    PRO C 279      56.009  76.137 254.348  1.00 28.74           O
ATOM   7761  CB   PRO C 279      52.816  75.525 254.055  1.00 26.64           C
ATOM   7762  CG   PRO C 279      51.496  75.323 254.728  1.00 25.89           C
ATOM   7763  CD   PRO C 279      51.711  75.592 256.179  1.00 26.46           C
ATOM   7764  N    ALA C 280      54.768  77.431 255.740  1.00 28.39           N
ATOM   7765  CA   ALA C 280      55.706  78.539 255.660  1.00 29.75           C
ATOM   7766  C    ALA C 280      57.040  78.133 256.286  1.00 28.13           C
ATOM   7767  O    ALA C 280      58.090  78.461 255.755  1.00 29.70           O
ATOM   7768  CB   ALA C 280      55.131  79.807 256.316  1.00 28.65           C
ATOM   7769  N    PHE C 281      56.980  77.424 257.408  1.00 27.24           N
ATOM   7770  CA   PHE C 281      58.169  77.014 258.182  1.00 27.58           C
ATOM   7771  C    PHE C 281      59.165  76.189 257.345  1.00 27.63           C
ATOM   7772  O    PHE C 281      60.352  76.494 257.317  1.00 27.17           O
ATOM   7773  CB   PHE C 281      57.663  76.243 259.395  1.00 28.28           C
ATOM   7774  CG   PHE C 281      58.725  75.631 260.278  1.00 29.26           C
ATOM   7775  CD1  PHE C 281      59.505  74.566 259.851  1.00 28.67           C
ATOM   7776  CD2  PHE C 281      58.850  76.048 261.601  1.00 28.35           C
ATOM   7777  CE1  PHE C 281      60.437  73.995 260.702  1.00 29.51           C
ATOM   7778  CE2  PHE C 281      59.769  75.467 262.447  1.00 28.35           C
ATOM   7779  CZ   PHE C 281      60.565  74.442 262.005  1.00 27.92           C
ATOM   7780  N    SER C 282      58.681  75.166 256.649  1.00 27.97           N
ATOM   7781  CA   SER C 282      59.542  74.358 255.771  1.00 29.86           C
ATOM   7782  C    SER C 282      60.061  75.155 254.560  1.00 31.99           C
ATOM   7783  O    SER C 282      61.214  74.988 254.117  1.00 32.48           O
```

Appendix 2

```
ATOM   7784  CB   SER C 282      58.803  73.098 255.298  1.00 29.95           C
ATOM   7785  OG   SER C 282      58.420  72.264 256.394  1.00 27.63           O
ATOM   7786  N    GLU C 283      59.197  76.020 254.031  1.00 31.67           N
ATOM   7787  CA   GLU C 283      59.573  76.929 252.961  1.00 30.50           C
ATOM   7788  C    GLU C 283      60.724  77.841 253.399  1.00 28.72           C
ATOM   7789  O    GLU C 283      61.629  78.140 252.611  1.00 28.47           O
ATOM   7790  CB   GLU C 283      58.354  77.752 252.522  1.00 30.94           C
ATOM   7791  CG   GLU C 283      57.512  77.097 251.433  1.00 30.71           C
ATOM   7792  CD   GLU C 283      56.044  77.510 251.457  1.00 30.97           C
ATOM   7793  OE1  GLU C 283      55.692  78.666 251.834  1.00 32.31           O
ATOM   7794  OE2  GLU C 283      55.232  76.646 251.081  1.00 30.94           O
ATOM   7795  N    ARG C 284      60.697  78.237 254.670  1.00 27.42           N
ATOM   7796  CA  AARG C 284      61.703  79.131 255.206  0.50 25.95           C
ATOM   7797  CA  BARG C 284      61.701  79.134 255.243  0.50 26.22           C
ATOM   7798  C    ARG C 284      63.069  78.479 255.216  1.00 25.61           C
ATOM   7799  O    ARG C 284      64.021  79.077 254.771  1.00 25.31           O
ATOM   7800  CB  AARG C 284      61.335  79.550 256.615  0.50 25.85           C
ATOM   7801  CB  BARG C 284      61.341  79.518 256.688  0.50 26.54           C
ATOM   7802  CG  AARG C 284      62.327  80.516 257.236  0.50 26.52           C
ATOM   7803  CG  BARG C 284      61.719  80.952 257.062  0.50 27.70           C
ATOM   7804  CD  AARG C 284      62.252  80.437 258.747  0.50 26.95           C
ATOM   7805  CD  BARG C 284      62.084  81.164 258.540  0.50 28.03           C
ATOM   7806  NE  AARG C 284      63.419  81.041 259.372  0.50 26.68           N
ATOM   7807  NE  BARG C 284      61.307  80.363 259.498  0.50 27.85           N
ATOM   7808  CZ  AARG C 284      63.407  82.225 259.955  0.50 24.89           C
ATOM   7809  CZ  BARG C 284      60.054  80.623 259.850  0.50 27.61           C
ATOM   7810  NH1 AARG C 284      62.290  82.935 260.001  0.50 24.09           N
ATOM   7811  NH1 BARG C 284      59.441  79.845 260.727  0.50 26.58           N
ATOM   7812  NH2 AARG C 284      64.514  82.683 260.488  0.50 24.19           N
ATOM   7813  NH2 BARG C 284      59.412  81.661 259.318  0.50 28.15           N
ATOM   7814  N    TYR C 285      63.146  77.238 255.718  1.00 26.79           N
ATOM   7815  CA   TYR C 285      64.427  76.516 255.878  1.00 26.48           C
ATOM   7816  C    TYR C 285      64.904  75.759 254.651  1.00 25.97           C
ATOM   7817  O    TYR C 285      66.088  75.543 254.523  1.00 24.63           O
ATOM   7818  CB   TYR C 285      64.404  75.583 257.109  1.00 27.01           C
ATOM   7819  CG   TYR C 285      64.247  76.361 258.395  1.00 27.29           C
ATOM   7820  CD1  TYR C 285      65.211  77.279 258.782  1.00 27.73           C
ATOM   7821  CD2  TYR C 285      63.112  76.235 259.185  1.00 28.38           C
ATOM   7822  CE1  TYR C 285      65.063  78.042 259.918  1.00 27.28           C
ATOM   7823  CE2  TYR C 285      62.956  76.993 260.332  1.00 28.65           C
ATOM   7824  CZ   TYR C 285      63.947  77.896 260.686  1.00 27.57           C
ATOM   7825  OH   TYR C 285      63.832  78.650 261.816  1.00 26.90           O
ATOM   7826  N    TYR C 286      64.002  75.417 253.736  1.00 26.99           N
ATOM   7827  CA   TYR C 286      64.331  74.545 252.609  1.00 29.74           C
ATOM   7828  C    TYR C 286      65.489  74.978 251.690  1.00 32.30           C
ATOM   7829  O    TYR C 286      66.232  74.118 251.217  1.00 33.85           O
ATOM   7830  CB   TYR C 286      63.070  74.271 251.778  1.00 31.77           C
ATOM   7831  CG   TYR C 286      63.231  73.274 250.623  1.00 31.53           C
ATOM   7832  CD1  TYR C 286      63.751  72.012 250.841  1.00 29.13           C
ATOM   7833  CD2  TYR C 286      62.818  73.605 249.313  1.00 31.41           C
ATOM   7834  CE1  TYR C 286      63.896  71.105 249.791  1.00 30.47           C
ATOM   7835  CE2  TYR C 286      62.952  72.703 248.249  1.00 31.41           C
ATOM   7836  CZ   TYR C 286      63.489  71.440 248.488  1.00 31.58           C
ATOM   7837  OH   TYR C 286      63.638  70.518 247.450  1.00 30.05           O
```

Appendix 2

```
ATOM   7838  N   PRO C 287      65.637  76.286 251.400  1.00 35.00           N
ATOM   7839  CA  PRO C 287      66.825  76.651 250.617  1.00 35.20           C
ATOM   7840  C   PRO C 287      68.143  76.525 251.363  1.00 34.99           C
ATOM   7841  O   PRO C 287      69.133  76.141 250.758  1.00 35.18           O
ATOM   7842  CB  PRO C 287      66.555  78.119 250.223  1.00 35.14           C
ATOM   7843  CG  PRO C 287      65.078  78.211 250.178  1.00 35.46           C
ATOM   7844  CD  PRO C 287      64.620  77.358 251.342  1.00 36.07           C
ATOM   7845  N   ARG C 288      68.165  76.880 252.644  1.00 38.39           N
ATOM   7846  CA  ARG C 288      69.389  76.788 253.453  1.00 39.70           C
ATOM   7847  C   ARG C 288      69.764  75.320 253.660  1.00 38.22           C
ATOM   7848  O   ARG C 288      70.942  74.942 253.536  1.00 38.42           O
ATOM   7849  CB  ARG C 288      69.222  77.536 254.787  1.00 44.57           C
ATOM   7850  CG  ARG C 288      69.341  79.064 254.663  1.00 49.64           C
ATOM   7851  CD  ARG C 288      68.819  79.821 255.894  1.00 56.54           C
ATOM   7852  NE  ARG C 288      67.563  80.560 255.635  1.00 67.66           N
ATOM   7853  CZ  ARG C 288      66.721  81.046 256.565  1.00 70.13           C
ATOM   7854  NH1 ARG C 288      66.955  80.891 257.866  1.00 69.47           N
ATOM   7855  NH2 ARG C 288      65.618  81.694 256.185  1.00 69.43           N
ATOM   7856  N   PHE C 289      68.751  74.486 253.925  1.00 36.20           N
ATOM   7857  CA  PHE C 289      68.924  73.028 253.962  1.00 33.45           C
ATOM   7858  C   PHE C 289      69.567  72.454 252.686  1.00 32.20           C
ATOM   7859  O   PHE C 289      70.419  71.581 252.768  1.00 31.35           O
ATOM   7860  CB  PHE C 289      67.593  72.327 254.202  1.00 32.26           C
ATOM   7861  CG  PHE C 289      67.600  70.855 253.835  1.00 32.31           C
ATOM   7862  CD1 PHE C 289      67.974  69.893 254.761  1.00 33.04           C
ATOM   7863  CD2 PHE C 289      67.240  70.438 252.568  1.00 31.51           C
ATOM   7864  CE1 PHE C 289      67.978  68.546 254.437  1.00 32.16           C
ATOM   7865  CE2 PHE C 289      67.244  69.100 252.233  1.00 32.16           C
ATOM   7866  CZ  PHE C 289      67.611  68.147 253.170  1.00 32.43           C
ATOM   7867  N   LYS C 290      69.134  72.912 251.516  1.00 31.34           N
ATOM   7868  CA  LYS C 290      69.674  72.396 250.254  1.00 31.57           C
ATOM   7869  C   LYS C 290      71.138  72.801 250.070  1.00 31.49           C
ATOM   7870  O   LYS C 290      71.959  71.984 249.649  1.00 30.77           O
ATOM   7871  CB  LYS C 290      68.839  72.843 249.056  1.00 32.89           C
ATOM   7872  CG  LYS C 290      67.477  72.157 248.936  1.00 34.32           C
ATOM   7873  CD  LYS C 290      66.508  72.960 248.066  1.00 37.34           C
ATOM   7874  CE  LYS C 290      66.825  72.834 246.577  1.00 39.40           C
ATOM   7875  NZ  LYS C 290      66.076  73.809 245.745  1.00 39.32           N
ATOM   7876  N   GLN C 291      71.461  74.041 250.424  1.00 32.10           N
ATOM   7877  CA  GLN C 291      72.837  74.527 250.412  1.00 33.90           C
ATOM   7878  C   GLN C 291      73.693  73.689 251.362  1.00 31.29           C
ATOM   7879  O   GLN C 291      74.757  73.224 250.987  1.00 30.18           O
ATOM   7880  CB  GLN C 291      72.882  76.019 250.800  1.00 37.84           C
ATOM   7881  CG  GLN C 291      74.158  76.747 250.385  1.00 42.42           C
ATOM   7882  CD  GLN C 291      74.370  78.069 251.134  1.00 46.82           C
ATOM   7883  OE1 GLN C 291      73.560  78.464 251.990  1.00 51.67           O
ATOM   7884  NE2 GLN C 291      75.468  78.759 250.815  1.00 45.04           N
ATOM   7885  N   THR C 292      73.201  73.465 252.578  1.00 31.45           N
ATOM   7886  CA  THR C 292      73.968  72.752 253.624  1.00 31.21           C
ATOM   7887  C   THR C 292      74.355  71.291 253.303  1.00 30.87           C
ATOM   7888  O   THR C 292      75.463  70.861 253.659  1.00 30.36           O
ATOM   7889  CB  THR C 292      73.208  72.769 254.978  1.00 31.17           C
ATOM   7890  OG1 THR C 292      72.931  74.118 255.344  1.00 32.31           O
ATOM   7891  CG2 THR C 292      74.026  72.136 256.106  1.00 31.30           C
```

Appendix 2

```
ATOM   7892  N   PHE C 293      73.468  70.535 252.648  1.00 30.01           N
ATOM   7893  CA  PHE C 293      73.629  69.058 252.512  1.00 29.52           C
ATOM   7894  C   PHE C 293      73.676  68.495 251.080  1.00 29.95           C
ATOM   7895  O   PHE C 293      74.199  67.404 250.859  1.00 30.10           O
ATOM   7896  CB  PHE C 293      72.470  68.329 253.224  1.00 28.94           C
ATOM   7897  CG  PHE C 293      72.434  68.490 254.737  1.00 27.46           C
ATOM   7898  CD1 PHE C 293      73.468  68.032 255.540  1.00 26.40           C
ATOM   7899  CD2 PHE C 293      71.332  69.048 255.357  1.00 26.61           C
ATOM   7900  CE1 PHE C 293      73.406  68.155 256.915  1.00 24.91           C
ATOM   7901  CE2 PHE C 293      71.265  69.160 256.742  1.00 25.52           C
ATOM   7902  CZ  PHE C 293      72.299  68.707 257.515  1.00 24.38           C
ATOM   7903  N   VAL C 294      73.098  69.205 250.113  1.00 31.05           N
ATOM   7904  CA  VAL C 294      72.935  68.653 248.767  1.00 30.63           C
ATOM   7905  C   VAL C 294      74.163  68.885 247.875  1.00 29.99           C
ATOM   7906  O   VAL C 294      74.679  69.990 247.807  1.00 28.42           O
ATOM   7907  CB  VAL C 294      71.674  69.231 248.085  1.00 31.45           C
ATOM   7908  CG1 VAL C 294      71.468  68.620 246.691  1.00 30.81           C
ATOM   7909  CG2 VAL C 294      70.447  68.987 248.966  1.00 31.32           C
ATOM   7910  N   GLU C 295      74.634  67.819 247.228  1.00 30.46           N
ATOM   7911  CA  GLU C 295      75.682  67.907 246.219  1.00 32.27           C
ATOM   7912  C   GLU C 295      75.079  67.604 244.860  1.00 32.71           C
ATOM   7913  O   GLU C 295      74.535  66.509 244.657  1.00 34.43           O
ATOM   7914  CB  GLU C 295      76.807  66.902 246.492  1.00 33.03           C
ATOM   7915  CG  GLU C 295      78.040  67.121 245.611  1.00 33.20           C
ATOM   7916  CD  GLU C 295      78.964  65.912 245.538  1.00 34.46           C
ATOM   7917  OE1 GLU C 295      78.831  64.991 246.372  1.00 32.20           O
ATOM   7918  OE2 GLU C 295      79.830  65.884 244.632  1.00 38.30           O
ATOM   7919  N   VAL C 296      75.167  68.566 243.943  1.00 30.56           N
ATOM   7920  CA  VAL C 296      74.723  68.371 242.578  1.00 30.50           C
ATOM   7921  C   VAL C 296      75.973  67.948 241.846  1.00 31.62           C
ATOM   7922  O   VAL C 296      77.044  68.533 242.053  1.00 34.02           O
ATOM   7923  CB  VAL C 296      74.124  69.671 241.967  1.00 31.60           C
ATOM   7924  CG1 VAL C 296      73.933  69.553 240.452  1.00 31.53           C
ATOM   7925  CG2 VAL C 296      72.795  70.031 242.642  1.00 31.06           C
ATOM   7926  N   TYR C 297      75.865  66.916 241.019  1.00 30.42           N
ATOM   7927  CA  TYR C 297      77.014  66.463 240.261  1.00 30.33           C
ATOM   7928  C   TYR C 297      76.571  65.979 238.878  1.00 31.42           C
ATOM   7929  O   TYR C 297      75.372  65.993 238.557  1.00 29.73           O
ATOM   7930  CB  TYR C 297      77.775  65.387 241.057  1.00 30.67           C
ATOM   7931  CG  TYR C 297      77.069  64.032 241.174  1.00 31.92           C
ATOM   7932  CD1 TYR C 297      75.989  63.854 242.037  1.00 30.96           C
ATOM   7933  CD2 TYR C 297      77.494  62.926 240.413  1.00 31.45           C
ATOM   7934  CE1 TYR C 297      75.359  62.628 242.143  1.00 32.28           C
ATOM   7935  CE2 TYR C 297      76.862  61.692 240.498  1.00 30.35           C
ATOM   7936  CZ  TYR C 297      75.797  61.540 241.366  1.00 33.37           C
ATOM   7937  OH  TYR C 297      75.151  60.312 241.467  1.00 34.76           O
ATOM   7938  N   ASP C 298      77.543  65.565 238.064  1.00 32.47           N
ATOM   7939  CA  ASP C 298      77.284  65.061 236.713  1.00 33.47           C
ATOM   7940  C   ASP C 298      76.589  66.149 235.880  1.00 34.68           C
ATOM   7941  O   ASP C 298      75.552  65.921 235.224  1.00 37.06           O
ATOM   7942  CB  ASP C 298      76.471  63.753 236.797  1.00 34.10           C
ATOM   7943  CG  ASP C 298      76.354  63.029 235.465  1.00 34.15           C
ATOM   7944  OD1 ASP C 298      77.365  62.903 234.738  1.00 33.86           O
ATOM   7945  OD2 ASP C 298      75.231  62.572 235.159  1.00 35.10           O
```

Appendix 2

```
ATOM   7946  N    GLU C 299      77.163  67.347 235.936  1.00 35.92           N
ATOM   7947  CA   GLU C 299      76.704  68.485 235.131  1.00 36.88           C
ATOM   7948  C    GLU C 299      75.211  68.746 235.348  1.00 34.13           C
ATOM   7949  O    GLU C 299      74.458  68.939 234.408  1.00 34.69           O
ATOM   7950  CB   GLU C 299      77.007  68.248 233.631  1.00 37.19           C
ATOM   7951  CG   GLU C 299      78.472  67.975 233.307  1.00 38.45           C
ATOM   7952  CD   GLU C 299      78.684  67.485 231.877  1.00 40.38           C
ATOM   7953  OE1  GLU C 299      79.091  68.299 231.020  1.00 38.50           O
ATOM   7954  OE2  GLU C 299      78.428  66.289 231.601  1.00 41.89           O
ATOM   7955  N    GLY C 300      74.785  68.712 236.597  1.00 33.95           N
ATOM   7956  CA   GLY C 300      73.399  69.038 236.943  1.00 32.83           C
ATOM   7957  C    GLY C 300      72.387  67.914 236.815  1.00 30.93           C
ATOM   7958  O    GLY C 300      71.257  68.057 237.275  1.00 27.66           O
ATOM   7959  N    ARG C 301      72.767  66.796 236.200  1.00 32.01           N
ATOM   7960  CA   ARG C 301      71.817  65.668 236.028  1.00 32.75           C
ATOM   7961  C    ARG C 301      71.450  64.960 237.346  1.00 32.05           C
ATOM   7962  O    ARG C 301      70.355  64.389 237.461  1.00 30.14           O
ATOM   7963  CB   ARG C 301      72.328  64.637 234.995  1.00 34.14           C
ATOM   7964  CG   ARG C 301      72.445  65.226 233.588  1.00 35.40           C
ATOM   7965  CD   ARG C 301      72.721  64.204 232.473  1.00 34.99           C
ATOM   7966  NE   ARG C 301      74.095  63.704 232.449  1.00 33.20           N
ATOM   7967  CZ   ARG C 301      75.157  64.419 232.113  1.00 32.68           C
ATOM   7968  NH1  ARG C 301      75.038  65.688 231.772  1.00 33.85           N
ATOM   7969  NH2  ARG C 301      76.357  63.867 232.140  1.00 32.53           N
ATOM   7970  N    LYS C 302      72.352  65.017 238.334  1.00 32.17           N
ATOM   7971  CA   LYS C 302      72.225  64.219 239.547  1.00 31.23           C
ATOM   7972  C    LYS C 302      72.534  64.977 240.828  1.00 31.77           C
ATOM   7973  O    LYS C 302      73.265  65.985 240.847  1.00 30.69           O
ATOM   7974  CB   LYS C 302      73.144  62.997 239.477  1.00 33.15           C
ATOM   7975  CG   LYS C 302      72.726  61.970 238.448  1.00 34.95           C
ATOM   7976  CD   LYS C 302      73.778  60.902 238.181  1.00 35.11           C
ATOM   7977  CE   LYS C 302      73.265  59.989 237.081  1.00 35.44           C
ATOM   7978  NZ   LYS C 302      74.291  59.087 236.535  1.00 35.66           N
ATOM   7979  N    ALA C 303      71.971  64.446 241.910  1.00 30.58           N
ATOM   7980  CA   ALA C 303      72.219  64.950 243.239  1.00 30.12           C
ATOM   7981  C    ALA C 303      72.376  63.784 244.233  1.00 30.38           C
ATOM   7982  O    ALA C 303      71.819  62.691 244.037  1.00 31.67           O
ATOM   7983  CB   ALA C 303      71.090  65.876 243.658  1.00 28.99           C
ATOM   7984  N    ARG C 304      73.147  64.034 245.287  1.00 28.65           N
ATOM   7985  CA   ARG C 304      73.287  63.111 246.409  1.00 28.38           C
ATOM   7986  C    ARG C 304      73.503  63.940 247.668  1.00 28.47           C
ATOM   7987  O    ARG C 304      73.970  65.074 247.586  1.00 28.87           O
ATOM   7988  CB   ARG C 304      74.451  62.152 246.181  1.00 28.47           C
ATOM   7989  CG   ARG C 304      75.829  62.821 246.092  1.00 27.95           C
ATOM   7990  CD   ARG C 304      76.874  61.795 245.670  1.00 28.31           C
ATOM   7991  NE   ARG C 304      78.076  62.441 245.152  1.00 28.82           N
ATOM   7992  CZ   ARG C 304      78.779  62.032 244.097  1.00 28.51           C
ATOM   7993  NH1  ARG C 304      79.827  62.725 243.722  1.00 30.31           N
ATOM   7994  NH2  ARG C 304      78.443  60.967 243.393  1.00 28.50           N
ATOM   7995  N    VAL C 305      73.166  63.381 248.828  1.00 29.79           N
ATOM   7996  CA   VAL C 305      73.002  64.194 250.055  1.00 29.83           C
ATOM   7997  C    VAL C 305      73.905  63.744 251.204  1.00 28.37           C
ATOM   7998  O    VAL C 305      73.837  62.619 251.665  1.00 27.11           O
ATOM   7999  CB   VAL C 305      71.528  64.177 250.496  1.00 29.87           C
```

Appendix 2

```
ATOM   8000  CG1 VAL C 305      71.258  65.155 251.642  1.00 29.74           C
ATOM   8001  CG2 VAL C 305      70.647  64.472 249.293  1.00 28.92           C
ATOM   8002  N   ARG C 306      74.763  64.654 251.638  1.00 30.04           N
ATOM   8003  CA  ARG C 306      75.643  64.443 252.783  1.00 30.51           C
ATOM   8004  C   ARG C 306      74.766  64.270 254.030  1.00 29.65           C
ATOM   8005  O   ARG C 306      73.773  64.970 254.183  1.00 29.88           O
ATOM   8006  CB  ARG C 306      76.582  65.656 252.938  1.00 31.05           C
ATOM   8007  CG  ARG C 306      77.590  65.850 251.801  1.00 31.95           C
ATOM   8008  CD  ARG C 306      78.517  67.052 252.040  1.00 32.87           C
ATOM   8009  NE  ARG C 306      77.741  68.290 252.004  1.00 34.04           N
ATOM   8010  CZ  ARG C 306      77.419  68.973 250.899  1.00 32.90           C
ATOM   8011  NH1 ARG C 306      77.848  68.589 249.699  1.00 32.79           N
ATOM   8012  NH2 ARG C 306      76.667  70.062 250.998  1.00 31.98           N
ATOM   8013  N   GLU C 307      75.086  63.326 254.903  1.00 29.02           N
ATOM   8014  CA  GLU C 307      74.216  63.101 256.071  1.00 27.70           C
ATOM   8015  C   GLU C 307      74.488  64.112 257.200  1.00 27.03           C
ATOM   8016  O   GLU C 307      73.592  64.423 257.985  1.00 26.44           O
ATOM   8017  CB  GLU C 307      74.308  61.651 256.548  1.00 26.94           C
ATOM   8018  CG  GLU C 307      73.931  61.413 258.006  1.00 28.27           C
ATOM   8019  CD  GLU C 307      72.489  61.789 258.380  1.00 28.04           C
ATOM   8020  OE1 GLU C 307      71.601  61.886 257.497  1.00 28.36           O
ATOM   8021  OE2 GLU C 307      72.252  61.977 259.592  1.00 25.58           O
ATOM   8022  N   THR C 308      75.701  64.657 257.252  1.00 26.64           N
ATOM   8023  CA  THR C 308      76.091  65.561 258.335  1.00 25.81           C
ATOM   8024  C   THR C 308      77.061  66.644 257.839  1.00 27.95           C
ATOM   8025  O   THR C 308      77.390  66.675 256.660  1.00 27.13           O
ATOM   8026  CB  THR C 308      76.690  64.771 259.494  1.00 24.04           C
ATOM   8027  OG1 THR C 308      76.841  65.631 260.603  1.00 23.90           O
ATOM   8028  CG2 THR C 308      78.038  64.190 259.126  1.00 24.01           C
ATOM   8029  N   ALA C 309      77.514  67.521 258.741  1.00 30.79           N
ATOM   8030  CA  ALA C 309      78.212  68.761 258.362  1.00 32.23           C
ATOM   8031  C   ALA C 309      79.690  68.672 257.970  1.00 35.26           C
ATOM   8032  O   ALA C 309      80.140  69.466 257.138  1.00 44.04           O
ATOM   8033  CB  ALA C 309      78.070  69.784 259.465  1.00 31.27           C
ATOM   8034  N   GLY C 310      80.487  67.798 258.563  1.00 31.81           N
ATOM   8035  CA  GLY C 310      81.950  67.976 258.364  1.00 30.99           C
ATOM   8036  C   GLY C 310      82.622  66.980 257.439  1.00 29.65           C
ATOM   8037  O   GLY C 310      83.647  66.438 257.773  1.00 27.51           O
ATOM   8038  N   THR C 311      82.043  66.732 256.273  1.00 29.74           N
ATOM   8039  CA  THR C 311      82.461  65.603 255.447  1.00 28.09           C
ATOM   8040  C   THR C 311      82.017  65.900 254.048  1.00 29.75           C
ATOM   8041  O   THR C 311      81.138  66.745 253.859  1.00 31.92           O
ATOM   8042  CB  THR C 311      81.815  64.266 255.903  1.00 26.88           C
ATOM   8043  OG1 THR C 311      82.240  63.188 255.055  1.00 24.72           O
ATOM   8044  CG2 THR C 311      80.268  64.336 255.880  1.00 26.78           C
ATOM   8045  N   ASP C 312      82.646  65.222 253.085  1.00 30.31           N
ATOM   8046  CA  ASP C 312      82.268  65.257 251.667  1.00 30.53           C
ATOM   8047  C   ASP C 312      81.461  64.006 251.330  1.00 31.42           C
ATOM   8048  O   ASP C 312      80.970  63.878 250.207  1.00 30.87           O
ATOM   8049  CB  ASP C 312      83.509  65.240 250.739  1.00 30.85           C
ATOM   8050  CG  ASP C 312      84.358  66.517 250.803  1.00 31.61           C
ATOM   8051  OD1 ASP C 312      83.896  67.556 251.343  1.00 30.98           O
ATOM   8052  OD2 ASP C 312      85.508  66.456 250.288  1.00 29.13           O
ATOM   8053  N   ASP C 313      81.346  63.061 252.265  1.00 32.22           N
```

Appendix 2

```
ATOM   8054  CA   ASP C 313      80.691  61.779 251.955  1.00 32.53           C
ATOM   8055  C    ASP C 313      79.167  61.890 251.928  1.00 31.23           C
ATOM   8056  O    ASP C 313      78.558  62.658 252.678  1.00 31.69           O
ATOM   8057  CB   ASP C 313      81.105  60.688 252.947  1.00 34.65           C
ATOM   8058  CG   ASP C 313      82.617  60.449 252.969  1.00 35.72           C
ATOM   8059  OD1  ASP C 313      83.178  60.085 251.914  1.00 35.47           O
ATOM   8060  OD2  ASP C 313      83.231  60.623 254.050  1.00 35.01           O
ATOM   8061  N    ALA C 314      78.568  61.093 251.057  1.00 30.48           N
ATOM   8062  CA   ALA C 314      77.130  61.036 250.883  1.00 30.18           C
ATOM   8063  C    ALA C 314      76.556  59.890 251.682  1.00 29.37           C
ATOM   8064  O    ALA C 314      77.190  58.847 251.834  1.00 29.77           O
ATOM   8065  CB   ALA C 314      76.780  60.850 249.407  1.00 30.37           C
ATOM   8066  N    ASP C 315      75.338  60.091 252.176  1.00 28.53           N
ATOM   8067  CA   ASP C 315      74.541  59.026 252.753  1.00 27.50           C
ATOM   8068  C    ASP C 315      75.235  58.215 253.856  1.00 25.88           C
ATOM   8069  O    ASP C 315      75.056  57.038 253.973  1.00 25.44           O
ATOM   8070  CB   ASP C 315      74.041  58.128 251.629  1.00 28.63           C
ATOM   8071  CG   ASP C 315      72.862  58.745 250.862  1.00 30.30           C
ATOM   8072  OD1  ASP C 315      71.819  59.015 251.505  1.00 30.90           O
ATOM   8073  OD2  ASP C 315      72.962  58.912 249.618  1.00 31.15           O
ATOM   8074  N    GLY C 316      75.992  58.867 254.710  1.00 26.75           N
ATOM   8075  CA   GLY C 316      76.436  58.203 255.926  1.00 27.38           C
ATOM   8076  C    GLY C 316      75.311  57.961 256.917  1.00 26.73           C
ATOM   8077  O    GLY C 316      74.132  58.088 256.584  1.00 29.17           O
ATOM   8078  N    GLY C 317      75.674  57.587 258.135  1.00 25.64           N
ATOM   8079  CA   GLY C 317      74.696  57.390 259.181  1.00 25.96           C
ATOM   8080  C    GLY C 317      73.818  56.218 258.832  1.00 24.87           C
ATOM   8081  O    GLY C 317      74.329  55.161 258.481  1.00 24.50           O
ATOM   8082  N    VAL C 318      72.504  56.408 258.901  1.00 24.06           N
ATOM   8083  CA   VAL C 318      71.571  55.364 258.487  1.00 24.46           C
ATOM   8084  C    VAL C 318      71.422  55.260 256.961  1.00 25.22           C
ATOM   8085  O    VAL C 318      70.740  54.384 256.479  1.00 23.21           O
ATOM   8086  CB   VAL C 318      70.199  55.554 259.131  1.00 24.85           C
ATOM   8087  CG1  VAL C 318      70.307  55.410 260.635  1.00 24.77           C
ATOM   8088  CG2  VAL C 318      69.609  56.929 258.773  1.00 26.84           C
ATOM   8089  N    GLY C 319      72.054  56.152 256.196  1.00 28.12           N
ATOM   8090  CA   GLY C 319      72.034  56.060 254.708  1.00 29.13           C
ATOM   8091  C    GLY C 319      70.701  56.402 254.031  1.00 29.10           C
ATOM   8092  O    GLY C 319      70.403  55.943 252.928  1.00 28.79           O
ATOM   8093  N    LEU C 320      69.903  57.230 254.683  1.00 28.56           N
ATOM   8094  CA   LEU C 320      68.615  57.597 254.139  1.00 28.59           C
ATOM   8095  C    LEU C 320      68.486  59.094 253.822  1.00 27.78           C
ATOM   8096  O    LEU C 320      67.380  59.587 253.645  1.00 27.97           O
ATOM   8097  CB   LEU C 320      67.522  57.148 255.096  1.00 28.63           C
ATOM   8098  CG   LEU C 320      67.544  55.662 255.459  1.00 30.32           C
ATOM   8099  CD1  LEU C 320      66.394  55.383 256.395  1.00 29.99           C
ATOM   8100  CD2  LEU C 320      67.444  54.759 254.228  1.00 31.64           C
ATOM   8101  N    ALA C 321      69.600  59.811 253.715  1.00 26.41           N
ATOM   8102  CA   ALA C 321      69.537  61.248 253.437  1.00 27.01           C
ATOM   8103  C    ALA C 321      68.971  61.507 252.038  1.00 27.19           C
ATOM   8104  O    ALA C 321      68.018  62.274 251.865  1.00 26.91           O
ATOM   8105  CB   ALA C 321      70.909  61.908 253.578  1.00 26.36           C
ATOM   8106  N    SER C 322      69.555  60.867 251.034  1.00 25.33           N
ATOM   8107  CA   SER C 322      69.073  61.065 249.695  1.00 24.64           C
```

Appendix 2

```
ATOM   8108  C    SER C 322      67.593  60.628 249.628  1.00 25.32           C
ATOM   8109  O    SER C 322      66.737  61.401 249.201  1.00 25.95           O
ATOM   8110  CB   SER C 322      69.952  60.329 248.676  1.00 24.72           C
ATOM   8111  OG   SER C 322      71.272  60.875 248.611  1.00 23.52           O
ATOM   8112  N    ALA C 323      67.280  59.422 250.083  1.00 23.64           N
ATOM   8113  CA   ALA C 323      65.913  58.945 249.979  1.00 24.14           C
ATOM   8114  C    ALA C 323      64.859  59.909 250.614  1.00 24.30           C
ATOM   8115  O    ALA C 323      63.811  60.169 250.023  1.00 23.22           O
ATOM   8116  CB   ALA C 323      65.801  57.534 250.561  1.00 23.69           C
ATOM   8117  N    PHE C 324      65.146  60.439 251.800  1.00 24.64           N
ATOM   8118  CA   PHE C 324      64.201  61.292 252.482  1.00 24.96           C
ATOM   8119  C    PHE C 324      64.197  62.662 251.830  1.00 26.19           C
ATOM   8120  O    PHE C 324      63.177  63.360 251.835  1.00 27.80           O
ATOM   8121  CB   PHE C 324      64.520  61.427 253.961  1.00 25.33           C
ATOM   8122  CG   PHE C 324      63.916  60.354 254.809  1.00 27.17           C
ATOM   8123  CD1  PHE C 324      62.551  60.266 254.955  1.00 27.82           C
ATOM   8124  CD2  PHE C 324      64.711  59.461 255.511  1.00 28.12           C
ATOM   8125  CE1  PHE C 324      61.975  59.279 255.744  1.00 27.83           C
ATOM   8126  CE2  PHE C 324      64.142  58.488 256.320  1.00 28.23           C
ATOM   8127  CZ   PHE C 324      62.767  58.396 256.430  1.00 27.90           C
ATOM   8128  N    THR C 325      65.322  63.058 251.253  1.00 26.86           N
ATOM   8129  CA   THR C 325      65.361  64.312 250.523  1.00 26.39           C
ATOM   8130  C    THR C 325      64.536  64.209 249.239  1.00 26.12           C
ATOM   8131  O    THR C 325      63.898  65.166 248.865  1.00 27.71           O
ATOM   8132  CB   THR C 325      66.798  64.806 250.298  1.00 26.30           C
ATOM   8133  OG1  THR C 325      67.439  65.013 251.566  1.00 26.22           O
ATOM   8134  CG2  THR C 325      66.777  66.123 249.602  1.00 27.31           C
ATOM   8135  N    LEU C 326      64.494  63.036 248.613  1.00 27.05           N
ATOM   8136  CA   LEU C 326      63.531  62.755 247.525  1.00 27.50           C
ATOM   8137  C    LEU C 326      62.075  62.977 247.965  1.00 26.70           C
ATOM   8138  O    LEU C 326      61.294  63.571 247.243  1.00 27.27           O
ATOM   8139  CB   LEU C 326      63.680  61.321 247.009  1.00 28.65           C
ATOM   8140  CG   LEU C 326      62.951  60.956 245.715  1.00 29.00           C
ATOM   8141  CD1  LEU C 326      63.664  61.516 244.500  1.00 30.92           C
ATOM   8142  CD2  LEU C 326      62.838  59.456 245.558  1.00 29.40           C
ATOM   8143  N    LEU C 327      61.713  62.517 249.148  1.00 25.61           N
ATOM   8144  CA   LEU C 327      60.382  62.788 249.665  1.00 25.69           C
ATOM   8145  C    LEU C 327      60.154  64.285 249.866  1.00 26.25           C
ATOM   8146  O    LEU C 327      59.125  64.811 249.437  1.00 26.13           O
ATOM   8147  CB   LEU C 327      60.147  62.039 250.972  1.00 26.27           C
ATOM   8148  CG   LEU C 327      58.818  62.187 251.728  1.00 26.44           C
ATOM   8149  CD1  LEU C 327      57.611  61.919 250.845  1.00 26.53           C
ATOM   8150  CD2  LEU C 327      58.819  61.241 252.934  1.00 26.66           C
ATOM   8151  N    LEU C 328      61.106  64.968 250.505  1.00 26.04           N
ATOM   8152  CA   LEU C 328      60.952  66.387 250.812  1.00 25.04           C
ATOM   8153  C    LEU C 328      60.791  67.175 249.517  1.00 26.01           C
ATOM   8154  O    LEU C 328      59.873  67.991 249.370  1.00 26.53           O
ATOM   8155  CB   LEU C 328      62.150  66.922 251.590  1.00 23.79           C
ATOM   8156  CG   LEU C 328      62.187  68.445 251.822  1.00 22.74           C
ATOM   8157  CD1  LEU C 328      60.994  68.904 252.645  1.00 23.46           C
ATOM   8158  CD2  LEU C 328      63.447  68.869 252.541  1.00 22.00           C
ATOM   8159  N    ALA C 329      61.673  66.897 248.564  1.00 27.08           N
ATOM   8160  CA   ALA C 329      61.595  67.521 247.238  1.00 27.56           C
ATOM   8161  C    ALA C 329      60.203  67.377 246.625  1.00 27.95           C
```

Appendix 2

```
ATOM   8162  O    ALA C 329      59.723  68.276 245.962  1.00 28.60           O
ATOM   8163  CB   ALA C 329      62.621  66.914 246.311  1.00 26.79           C
ATOM   8164  N    ARG C 330      59.584  66.226 246.829  1.00 28.21           N
ATOM   8165  CA   ARG C 330      58.280  65.970 246.286  1.00 28.93           C
ATOM   8166  C    ARG C 330      57.263  66.782 247.062  1.00 27.85           C
ATOM   8167  O    ARG C 330      56.411  67.429 246.466  1.00 31.45           O
ATOM   8168  CB   ARG C 330      57.961  64.480 246.346  1.00 30.78           C
ATOM   8169  CG   ARG C 330      56.613  64.108 245.750  1.00 31.96           C
ATOM   8170  CD   ARG C 330      56.666  64.098 244.233  1.00 32.12           C
ATOM   8171  NE   ARG C 330      55.642  63.222 243.660  1.00 32.99           N
ATOM   8172  CZ   ARG C 330      54.447  63.629 243.242  1.00 32.67           C
ATOM   8173  NH1  ARG C 330      54.106  64.908 243.320  1.00 33.05           N
ATOM   8174  NH2  ARG C 330      53.595  62.750 242.737  1.00 32.19           N
ATOM   8175  N    GLU C 331      57.363  66.763 248.381  1.00 26.50           N
ATOM   8176  CA   GLU C 331      56.501  67.564 249.221  1.00 25.87           C
ATOM   8177  C    GLU C 331      56.574  69.035 248.827  1.00 25.84           C
ATOM   8178  O    GLU C 331      55.597  69.754 248.984  1.00 24.82           O
ATOM   8179  CB   GLU C 331      56.919  67.431 250.687  1.00 26.47           C
ATOM   8180  CG   GLU C 331      56.181  68.366 251.650  1.00 26.66           C
ATOM   8181  CD   GLU C 331      54.688  68.074 251.731  1.00 27.39           C
ATOM   8182  OE1  GLU C 331      54.320  66.889 251.896  1.00 24.70           O
ATOM   8183  OE2  GLU C 331      53.881  69.036 251.639  1.00 29.95           O
ATOM   8184  N    MET C 332      57.730  69.493 248.338  1.00 25.08           N
ATOM   8185  CA   MET C 332      57.908  70.923 248.071  1.00 25.68           C
ATOM   8186  C    MET C 332      57.644  71.340 246.620  1.00 24.88           C
ATOM   8187  O    MET C 332      57.782  72.510 246.293  1.00 25.21           O
ATOM   8188  CB   MET C 332      59.322  71.379 248.472  1.00 26.79           C
ATOM   8189  CG   MET C 332      59.710  71.104 249.911  1.00 26.79           C
ATOM   8190  SD   MET C 332      58.601  71.838 251.131  1.00 29.30           S
ATOM   8191  CE   MET C 332      59.281  73.504 251.263  1.00 30.64           C
ATOM   8192  N    GLY C 333      57.256  70.410 245.757  1.00 24.33           N
ATOM   8193  CA   GLY C 333      57.099  70.696 244.342  1.00 25.47           C
ATOM   8194  C    GLY C 333      58.391  71.092 243.625  1.00 27.81           C
ATOM   8195  O    GLY C 333      58.340  71.849 242.672  1.00 27.15           O
ATOM   8196  N    ASP C 334      59.543  70.593 244.098  1.00 29.58           N
ATOM   8197  CA   ASP C 334      60.872  70.851 243.504  1.00 29.67           C
ATOM   8198  C    ASP C 334      61.205  69.692 242.537  1.00 30.85           C
ATOM   8199  O    ASP C 334      61.850  68.712 242.925  1.00 31.69           O
ATOM   8200  CB   ASP C 334      61.923  70.972 244.646  1.00 28.86           C
ATOM   8201  CG   ASP C 334      63.345  71.425 244.176  1.00 28.07           C
ATOM   8202  OD1  ASP C 334      63.688  71.339 242.970  1.00 27.42           O
ATOM   8203  OD2  ASP C 334      64.133  71.865 245.064  1.00 26.50           O
ATOM   8204  N    GLN C 335      60.764  69.809 241.286  1.00 31.03           N
ATOM   8205  CA   GLN C 335      61.004  68.763 240.259  1.00 31.87           C
ATOM   8206  C    GLN C 335      62.464  68.616 239.826  1.00 32.00           C
ATOM   8207  O    GLN C 335      62.883  67.514 239.470  1.00 31.34           O
ATOM   8208  CB   GLN C 335      60.154  69.019 239.009  1.00 32.74           C
ATOM   8209  CG   GLN C 335      58.658  69.142 239.304  1.00 34.60           C
ATOM   8210  CD   GLN C 335      57.778  69.134 238.057  1.00 35.42           C
ATOM   8211  OE1  GLN C 335      58.152  68.582 237.007  1.00 37.21           O
ATOM   8212  NE2  GLN C 335      56.594  69.728 238.173  1.00 31.63           N
ATOM   8213  N    GLN C 336      63.227  69.716 239.823  1.00 31.89           N
ATOM   8214  CA   GLN C 336      64.637  69.654 239.429  1.00 31.71           C
ATOM   8215  C    GLN C 336      65.339  68.666 240.331  1.00 30.22           C
```

Appendix 2

```
ATOM   8216  O    GLN C 336      65.988  67.737 239.852  1.00 30.61           O
ATOM   8217  CB   GLN C 336      65.344  71.032 239.471  1.00 32.58           C
ATOM   8218  CG   GLN C 336      66.721  71.055 238.764  1.00 34.00           C
ATOM   8219  CD   GLN C 336      67.306  72.472 238.545  1.00 34.79           C
ATOM   8220  OE1  GLN C 336      67.923  72.761 237.515  1.00 33.29           O
ATOM   8221  NE2  GLN C 336      67.122  73.350 239.527  1.00 35.66           N
ATOM   8222  N    LEU C 337      65.181  68.849 241.637  1.00 28.08           N
ATOM   8223  CA   LEU C 337      65.921  68.050 242.592  1.00 28.18           C
ATOM   8224  C    LEU C 337      65.385  66.591 242.680  1.00 28.77           C
ATOM   8225  O    LEU C 337      66.149  65.639 242.696  1.00 26.65           O
ATOM   8226  CB   LEU C 337      65.894  68.734 243.950  1.00 27.17           C
ATOM   8227  CG   LEU C 337      66.688  68.005 245.017  1.00 27.15           C
ATOM   8228  CD1  LEU C 337      68.082  67.655 244.545  1.00 26.53           C
ATOM   8229  CD2  LEU C 337      66.759  68.863 246.257  1.00 28.50           C
ATOM   8230  N    PHE C 338      64.069  66.434 242.718  1.00 29.31           N
ATOM   8231  CA   PHE C 338      63.459  65.121 242.627  1.00 29.16           C
ATOM   8232  C    PHE C 338      64.073  64.323 241.468  1.00 29.84           C
ATOM   8233  O    PHE C 338      64.466  63.155 241.654  1.00 30.98           O
ATOM   8234  CB   PHE C 338      61.943  65.233 242.447  1.00 27.82           C
ATOM   8235  CG   PHE C 338      61.250  63.910 242.374  1.00 27.08           C
ATOM   8236  CD1  PHE C 338      61.285  63.158 241.205  1.00 26.61           C
ATOM   8237  CD2  PHE C 338      60.597  63.407 243.470  1.00 27.38           C
ATOM   8238  CE1  PHE C 338      60.688  61.934 241.117  1.00 26.11           C
ATOM   8239  CE2  PHE C 338      59.988  62.178 243.403  1.00 28.58           C
ATOM   8240  CZ   PHE C 338      60.038  61.439 242.216  1.00 29.01           C
ATOM   8241  N    ASP C 339      64.163  64.944 240.290  1.00 28.36           N
ATOM   8242  CA   ASP C 339      64.761  64.278 239.089  1.00 27.63           C
ATOM   8243  C    ASP C 339      66.247  63.918 239.326  1.00 27.25           C
ATOM   8244  O    ASP C 339      66.695  62.798 239.032  1.00 24.80           O
ATOM   8245  CB   ASP C 339      64.622  65.165 237.835  1.00 25.31           C
ATOM   8246  CG   ASP C 339      64.817  64.390 236.534  1.00 24.89           C
ATOM   8247  OD1  ASP C 339      63.938  63.581 236.174  1.00 25.45           O
ATOM   8248  OD2  ASP C 339      65.828  64.611 235.842  1.00 22.84           O
ATOM   8249  N    GLN C 340      66.986  64.885 239.873  1.00 29.61           N
ATOM   8250  CA   GLN C 340      68.416  64.724 240.202  1.00 29.67           C
ATOM   8251  C    GLN C 340      68.632  63.554 241.170  1.00 27.67           C
ATOM   8252  O    GLN C 340      69.468  62.668 240.944  1.00 26.31           O
ATOM   8253  CB   GLN C 340      68.980  66.029 240.806  1.00 30.18           C
ATOM   8254  CG   GLN C 340      69.167  67.165 239.803  1.00 31.77           C
ATOM   8255  CD   GLN C 340      69.557  68.501 240.447  1.00 33.38           C
ATOM   8256  OE1  GLN C 340      69.011  68.903 241.482  1.00 33.36           O
ATOM   8257  NE2  GLN C 340      70.508  69.196 239.826  1.00 34.15           N
ATOM   8258  N    LEU C 341      67.846  63.548 242.234  1.00 26.72           N
ATOM   8259  CA   LEU C 341      67.993  62.538 243.257  1.00 27.25           C
ATOM   8260  C    LEU C 341      67.582  61.205 242.713  1.00 26.83           C
ATOM   8261  O    LEU C 341      68.321  60.241 242.855  1.00 29.00           O
ATOM   8262  CB   LEU C 341      67.176  62.867 244.489  1.00 27.48           C
ATOM   8263  CG   LEU C 341      67.668  64.064 245.315  1.00 27.11           C
ATOM   8264  CD1  LEU C 341      66.653  64.429 246.391  1.00 27.89           C
ATOM   8265  CD2  LEU C 341      68.986  63.756 245.971  1.00 27.87           C
ATOM   8266  N    LEU C 342      66.441  61.135 242.047  1.00 26.18           N
ATOM   8267  CA   LEU C 342      65.993  59.832 241.562  1.00 26.32           C
ATOM   8268  C    LEU C 342      67.020  59.211 240.592  1.00 28.37           C
ATOM   8269  O    LEU C 342      67.210  57.993 240.598  1.00 30.57           O
```

Appendix 2

```
ATOM   8270  CB   LEU C 342      64.613  59.910 240.924  1.00 25.19           C
ATOM   8271  CG   LEU C 342      63.866  58.573 240.816  1.00 25.02           C
ATOM   8272  CD1  LEU C 342      63.854  57.769 242.114  1.00 24.72           C
ATOM   8273  CD2  LEU C 342      62.438  58.839 240.391  1.00 24.76           C
ATOM   8274  N    ASN C 343      67.680  60.051 239.790  1.00 28.79           N
ATOM   8275  CA   ASN C 343      68.742  59.626 238.861  1.00 28.96           C
ATOM   8276  C    ASN C 343      70.012  59.082 239.561  1.00 29.12           C
ATOM   8277  O    ASN C 343      70.723  58.234 239.023  1.00 25.89           O
ATOM   8278  CB   ASN C 343      69.117  60.802 237.935  1.00 29.17           C
ATOM   8279  CG   ASN C 343      68.084  61.047 236.838  1.00 28.71           C
ATOM   8280  OD1  ASN C 343      67.207  60.233 236.594  1.00 31.58           O
ATOM   8281  ND2  ASN C 343      68.201  62.162 236.169  1.00 26.91           N
ATOM   8282  N    HIS C 344      70.300  59.606 240.753  1.00 31.73           N
ATOM   8283  CA   HIS C 344      71.361  59.062 241.607  1.00 31.06           C
ATOM   8284  C    HIS C 344      70.933  57.685 242.136  1.00 31.41           C
ATOM   8285  O    HIS C 344      71.703  56.722 242.087  1.00 28.47           O
ATOM   8286  CB   HIS C 344      71.642  60.023 242.768  1.00 30.70           C
ATOM   8287  CG   HIS C 344      72.562  59.465 243.816  1.00 33.86           C
ATOM   8288  ND1  HIS C 344      73.801  58.933 243.522  1.00 34.67           N
ATOM   8289  CD2  HIS C 344      72.428  59.368 245.160  1.00 34.08           C
ATOM   8290  CE1  HIS C 344      74.386  58.528 244.635  1.00 32.82           C
ATOM   8291  NE2  HIS C 344      73.573  58.778 245.643  1.00 33.77           N
ATOM   8292  N    LEU C 345      69.676  57.615 242.594  1.00 31.77           N
ATOM   8293  CA   LEU C 345      69.157  56.503 243.379  1.00 31.74           C
ATOM   8294  C    LEU C 345      68.635  55.291 242.605  1.00 29.97           C
ATOM   8295  O    LEU C 345      68.925  54.166 242.991  1.00 29.76           O
ATOM   8296  CB   LEU C 345      68.022  56.999 244.262  1.00 34.36           C
ATOM   8297  CG   LEU C 345      68.390  57.936 245.395  1.00 36.28           C
ATOM   8298  CD1  LEU C 345      67.106  58.499 245.995  1.00 37.48           C
ATOM   8299  CD2  LEU C 345      69.222  57.201 246.433  1.00 35.52           C
ATOM   8300  N    GLU C 346      67.865  55.495 241.541  1.00 29.62           N
ATOM   8301  CA   GLU C 346      67.199  54.346 240.881  1.00 30.57           C
ATOM   8302  C    GLU C 346      68.120  53.468 240.022  1.00 28.82           C
ATOM   8303  O    GLU C 346      68.304  52.310 240.333  1.00 30.77           O
ATOM   8304  CB   GLU C 346      65.935  54.763 240.101  1.00 31.48           C
ATOM   8305  CG   GLU C 346      64.883  53.673 240.098  1.00 33.22           C
ATOM   8306  CD   GLU C 346      63.575  54.099 239.490  1.00 33.93           C
ATOM   8307  OE1  GLU C 346      63.600  54.850 238.512  1.00 35.71           O
ATOM   8308  OE2  GLU C 346      62.518  53.658 239.976  1.00 32.99           O
ATOM   8309  N    PRO C 347      68.734  54.018 238.969  1.00 27.54           N
ATOM   8310  CA   PRO C 347      69.555  53.198 238.055  1.00 26.86           C
ATOM   8311  C    PRO C 347      70.560  52.256 238.728  1.00 27.63           C
ATOM   8312  O    PRO C 347      70.616  51.083 238.385  1.00 27.92           O
ATOM   8313  CB   PRO C 347      70.296  54.240 237.214  1.00 26.78           C
ATOM   8314  CG   PRO C 347      69.419  55.436 237.262  1.00 27.57           C
ATOM   8315  CD   PRO C 347      68.793  55.446 238.628  1.00 27.10           C
ATOM   8316  N    PRO C 348      71.359  52.749 239.685  1.00 28.59           N
ATOM   8317  CA   PRO C 348      72.241  51.747 240.293  1.00 28.30           C
ATOM   8318  C    PRO C 348      71.509  50.560 240.925  1.00 28.36           C
ATOM   8319  O    PRO C 348      72.102  49.491 241.058  1.00 30.57           O
ATOM   8320  CB   PRO C 348      72.990  52.516 241.394  1.00 27.19           C
ATOM   8321  CG   PRO C 348      72.571  53.941 241.281  1.00 28.72           C
ATOM   8322  CD   PRO C 348      71.374  54.039 240.398  1.00 27.91           C
ATOM   8323  N    ALA C 349      70.255  50.743 241.345  1.00 27.92           N
```

Appendix 2

```
ATOM   8324  CA   ALA C 349      69.525  49.677 242.038  1.00 27.62           C
ATOM   8325  C    ALA C 349      68.999  48.598 241.073  1.00 28.01           C
ATOM   8326  O    ALA C 349      68.501  47.555 241.517  1.00 28.40           O
ATOM   8327  CB   ALA C 349      68.400  50.263 242.876  1.00 27.69           C
ATOM   8328  N    LYS C 350      69.132  48.873 239.768  1.00 26.95           N
ATOM   8329  CA   LYS C 350      68.890  47.926 238.666  1.00 25.54           C
ATOM   8330  C    LYS C 350      67.464  47.405 238.801  1.00 24.50           C
ATOM   8331  O    LYS C 350      67.253  46.260 239.142  1.00 22.82           O
ATOM   8332  CB   LYS C 350      69.985  46.831 238.580  1.00 23.13           C
ATOM   8333  N    PRO C 351      66.473  48.291 238.575  1.00 26.71           N
ATOM   8334  CA   PRO C 351      65.073  47.901 238.595  1.00 26.63           C
ATOM   8335  C    PRO C 351      64.745  47.043 237.398  1.00 27.39           C
ATOM   8336  O    PRO C 351      65.388  47.178 236.367  1.00 26.02           O
ATOM   8337  CB   PRO C 351      64.325  49.231 238.504  1.00 26.63           C
ATOM   8338  CG   PRO C 351      65.260  50.159 237.854  1.00 27.17           C
ATOM   8339  CD   PRO C 351      66.630  49.727 238.276  1.00 28.00           C
ATOM   8340  N    SER C 352      63.774  46.151 237.552  1.00 29.26           N
ATOM   8341  CA   SER C 352      63.225  45.390 236.420  1.00 31.24           C
ATOM   8342  C    SER C 352      61.772  45.025 236.715  1.00 31.75           C
ATOM   8343  O    SER C 352      61.400  44.765 237.871  1.00 34.02           O
ATOM   8344  CB   SER C 352      64.039  44.118 236.123  1.00 31.05           C
ATOM   8345  OG   SER C 352      64.020  43.217 237.219  1.00 30.82           O
ATOM   8346  N    ILE C 353      60.959  45.019 235.667  1.00 29.81           N
ATOM   8347  CA   ILE C 353      59.570  44.690 235.788  1.00 28.80           C
ATOM   8348  C    ILE C 353      59.429  43.266 235.240  1.00 29.58           C
ATOM   8349  O    ILE C 353      59.715  43.017 234.079  1.00 30.78           O
ATOM   8350  CB   ILE C 353      58.699  45.743 235.059  1.00 28.14           C
ATOM   8351  CG1  ILE C 353      59.160  47.142 235.482  1.00 27.62           C
ATOM   8352  CG2  ILE C 353      57.210  45.513 235.347  1.00 28.30           C
ATOM   8353  CD1  ILE C 353      58.090  48.209 235.652  1.00 27.36           C
ATOM   8354  N    VAL C 354      59.046  42.323 236.097  1.00 30.18           N
ATOM   8355  CA   VAL C 354      58.798  40.948 235.663  1.00 30.70           C
ATOM   8356  C    VAL C 354      57.354  40.559 235.951  1.00 29.59           C
ATOM   8357  O    VAL C 354      56.884  40.696 237.069  1.00 31.43           O
ATOM   8358  CB   VAL C 354      59.764  39.942 236.328  1.00 31.69           C
ATOM   8359  CG1  VAL C 354      59.410  38.505 235.943  1.00 30.79           C
ATOM   8360  CG2  VAL C 354      61.202  40.262 235.926  1.00 32.53           C
ATOM   8361  N    SER C 355      56.651  40.086 234.931  1.00 28.49           N
ATOM   8362  CA   SER C 355      55.281  39.657 235.094  1.00 28.29           C
ATOM   8363  C    SER C 355      54.438  40.766 235.755  1.00 27.37           C
ATOM   8364  O    SER C 355      53.693  40.500 236.701  1.00 26.83           O
ATOM   8365  CB   SER C 355      55.270  38.363 235.911  1.00 28.17           C
ATOM   8366  OG   SER C 355      54.024  37.713 235.842  1.00 29.13           O
ATOM   8367  N    ALA C 356      54.578  41.996 235.222  1.00 27.24           N
ATOM   8368  CA   ALA C 356      53.941  43.262 235.716  1.00 25.73           C
ATOM   8369  C    ALA C 356      54.254  43.603 237.183  1.00 26.05           C
ATOM   8370  O    ALA C 356      53.517  44.328 237.838  1.00 25.61           O
ATOM   8371  CB   ALA C 356      52.429  43.260 235.474  1.00 24.43           C
ATOM   8372  N    SER C 357      55.354  43.081 237.700  1.00 27.40           N
ATOM   8373  CA   SER C 357      55.707  43.281 239.109  1.00 27.56           C
ATOM   8374  C    SER C 357      57.104  43.844 239.152  1.00 27.12           C
ATOM   8375  O    SER C 357      58.015  43.295 238.531  1.00 26.97           O
ATOM   8376  CB   SER C 357      55.650  41.953 239.866  1.00 27.85           C
ATOM   8377  OG   SER C 357      55.507  42.160 241.254  1.00 28.40           O
```

Appendix 2

```
ATOM   8378  N    LEU C 358      57.266  44.935 239.896  1.00 28.43           N
ATOM   8379  CA   LEU C 358      58.562  45.637 240.004  1.00 29.09           C
ATOM   8380  C    LEU C 358      59.474  45.030 241.060  1.00 28.80           C
ATOM   8381  O    LEU C 358      59.015  44.649 242.109  1.00 28.37           O
ATOM   8382  CB   LEU C 358      58.314  47.110 240.361  1.00 27.75           C
ATOM   8383  CG   LEU C 358      59.539  47.931 240.751  1.00 27.66           C
ATOM   8384  CD1  LEU C 358      60.416  48.201 239.537  1.00 27.31           C
ATOM   8385  CD2  LEU C 358      59.123  49.228 241.418  1.00 27.86           C
ATOM   8386  N    ARG C 359      60.772  44.997 240.785  1.00 32.22           N
ATOM   8387  CA   ARG C 359      61.801  44.589 241.763  1.00 35.00           C
ATOM   8388  C    ARG C 359      63.076  45.431 241.549  1.00 35.05           C
ATOM   8389  O    ARG C 359      63.267  46.005 240.476  1.00 34.87           O
ATOM   8390  CB   ARG C 359      62.136  43.099 241.606  1.00 37.66           C
ATOM   8391  CG   ARG C 359      62.549  42.774 240.170  1.00 43.89           C
ATOM   8392  CD   ARG C 359      63.065  41.365 239.946  1.00 47.85           C
ATOM   8393  NE   ARG C 359      61.964  40.420 239.775  1.00 50.95           N
ATOM   8394  CZ   ARG C 359      62.058  39.256 239.138  1.00 52.51           C
ATOM   8395  NH1  ARG C 359      63.202  38.876 238.576  1.00 53.64           N
ATOM   8396  NH2  ARG C 359      60.995  38.473 239.048  1.00 51.33           N
ATOM   8397  N    TYR C 360      63.930  45.496 242.573  1.00 35.20           N
ATOM   8398  CA   TYR C 360      65.245  46.152 242.492  1.00 36.09           C
ATOM   8399  C    TYR C 360      66.365  45.133 242.818  1.00 36.49           C
ATOM   8400  O    TYR C 360      66.385  44.551 243.903  1.00 38.20           O
ATOM   8401  CB   TYR C 360      65.324  47.352 243.455  1.00 34.91           C
ATOM   8402  CG   TYR C 360      64.475  48.550 243.057  1.00 34.13           C
ATOM   8403  CD1  TYR C 360      64.875  49.428 242.055  1.00 33.32           C
ATOM   8404  CD2  TYR C 360      63.269  48.808 243.698  1.00 34.87           C
ATOM   8405  CE1  TYR C 360      64.083  50.519 241.697  1.00 32.85           C
ATOM   8406  CE2  TYR C 360      62.472  49.885 243.338  1.00 33.34           C
ATOM   8407  CZ   TYR C 360      62.879  50.739 242.347  1.00 31.98           C
ATOM   8408  OH   TYR C 360      62.060  51.796 242.036  1.00 31.81           O
ATOM   8409  N    GLU C 361      67.289  44.929 241.894  1.00 34.82           N
ATOM   8410  CA   GLU C 361      68.359  43.961 242.069  1.00 35.83           C
ATOM   8411  C    GLU C 361      69.328  44.398 243.200  1.00 34.31           C
ATOM   8412  O    GLU C 361      69.768  43.564 243.974  1.00 31.80           O
ATOM   8413  CB   GLU C 361      69.102  43.708 240.734  1.00 38.74           C
ATOM   8414  CG   GLU C 361      69.461  42.237 240.459  1.00 43.40           C
ATOM   8415  CD   GLU C 361      70.738  42.057 239.595  1.00 48.28           C
ATOM   8416  OE1  GLU C 361      70.788  42.593 238.457  1.00 49.35           O
ATOM   8417  OE2  GLU C 361      71.705  41.377 240.046  1.00 46.44           O
ATOM   8418  N    HIS C 362      69.626  45.695 243.310  1.00 33.94           N
ATOM   8419  CA   HIS C 362      70.590  46.198 244.296  1.00 34.69           C
ATOM   8420  C    HIS C 362      70.107  47.455 245.036  1.00 33.12           C
ATOM   8421  O    HIS C 362      70.698  48.541 244.887  1.00 31.86           O
ATOM   8422  CB   HIS C 362      71.957  46.465 243.646  1.00 37.61           C
ATOM   8423  CG   HIS C 362      72.576  45.248 243.027  1.00 43.79           C
ATOM   8424  ND1  HIS C 362      73.011  44.167 243.772  1.00 45.77           N
ATOM   8425  CD2  HIS C 362      72.824  44.934 241.732  1.00 45.45           C
ATOM   8426  CE1  HIS C 362      73.496  43.240 242.963  1.00 44.73           C
ATOM   8427  NE2  HIS C 362      73.395  43.679 241.720  1.00 45.91           N
ATOM   8428  N    PRO C 363      69.058  47.306 245.877  1.00 31.19           N
ATOM   8429  CA   PRO C 363      68.543  48.434 246.652  1.00 30.02           C
ATOM   8430  C    PRO C 363      69.657  48.998 247.524  1.00 32.04           C
ATOM   8431  O    PRO C 363      70.353  49.235 248.213  1.00 33.53           O
```

Appendix 2

```
ATOM   8432  CB   PRO C 363      67.445  47.804 247.507  1.00 29.23           C
ATOM   8433  CG   PRO C 363      67.874  46.390 247.680  1.00 29.20           C
ATOM   8434  CD   PRO C 363      68.510  46.025 246.365  1.00 30.93           C
ATOM   8435  N    GLY C 364      69.831  50.317 247.477  1.00 31.39           N
ATOM   8436  CA   GLY C 364      71.041  50.954 247.980  1.00 31.57           C
ATOM   8437  C    GLY C 364      71.021  51.279 249.449  1.00 32.34           C
ATOM   8438  O    GLY C 364      71.985  51.809 249.973  1.00 32.74           O
ATOM   8439  N    SER C 365      69.905  50.984 250.110  1.00 34.01           N
ATOM   8440  CA   SER C 365      69.724  51.282 251.516  1.00 30.88           C
ATOM   8441  C    SER C 365      68.576  50.459 252.091  1.00 28.39           C
ATOM   8442  O    SER C 365      67.901  49.722 251.387  1.00 27.00           O
ATOM   8443  CB   SER C 365      69.398  52.750 251.659  1.00 31.89           C
ATOM   8444  OG   SER C 365      68.205  53.024 250.956  1.00 34.31           O
ATOM   8445  N    LEU C 366      68.359  50.596 253.388  1.00 28.65           N
ATOM   8446  CA   LEU C 366      67.137  50.109 254.007  1.00 28.70           C
ATOM   8447  C    LEU C 366      65.952  50.955 253.520  1.00 28.49           C
ATOM   8448  O    LEU C 366      66.103  52.085 253.018  1.00 27.36           O
ATOM   8449  CB   LEU C 366      67.247  50.177 255.533  1.00 28.92           C
ATOM   8450  CG   LEU C 366      68.375  49.323 256.145  1.00 30.35           C
ATOM   8451  CD1  LEU C 366      68.542  49.596 257.632  1.00 28.47           C
ATOM   8452  CD2  LEU C 366      68.143  47.832 255.872  1.00 30.87           C
ATOM   8453  N    LEU C 367      64.765  50.405 253.663  1.00 28.85           N
ATOM   8454  CA   LEU C 367      63.547  51.146 253.330  1.00 31.38           C
ATOM   8455  C    LEU C 367      63.508  51.606 251.860  1.00 30.77           C
ATOM   8456  O    LEU C 367      62.800  52.567 251.528  1.00 32.92           O
ATOM   8457  CB   LEU C 367      63.364  52.370 254.266  1.00 30.82           C
ATOM   8458  CG   LEU C 367      63.228  52.102 255.778  1.00 31.55           C
ATOM   8459  CD1  LEU C 367      63.179  53.383 256.617  1.00 29.74           C
ATOM   8460  CD2  LEU C 367      61.995  51.251 256.040  1.00 32.09           C
ATOM   8461  N    PHE C 368      64.228  50.914 250.984  1.00 27.48           N
ATOM   8462  CA   PHE C 368      64.453  51.433 249.651  1.00 26.12           C
ATOM   8463  C    PHE C 368      63.177  51.471 248.803  1.00 26.69           C
ATOM   8464  O    PHE C 368      62.745  52.561 248.354  1.00 26.21           O
ATOM   8465  CB   PHE C 368      65.542  50.659 248.931  1.00 25.34           C
ATOM   8466  CG   PHE C 368      65.977  51.308 247.643  1.00 25.60           C
ATOM   8467  CD1  PHE C 368      66.875  52.386 247.658  1.00 25.04           C
ATOM   8468  CD2  PHE C 368      65.492  50.851 246.417  1.00 24.79           C
ATOM   8469  CE1  PHE C 368      67.282  52.975 246.484  1.00 24.56           C
ATOM   8470  CE2  PHE C 368      65.904  51.434 245.231  1.00 25.55           C
ATOM   8471  CZ   PHE C 368      66.789  52.504 245.263  1.00 25.69           C
ATOM   8472  N    ASP C 369      62.558  50.309 248.570  1.00 27.13           N
ATOM   8473  CA   ASP C 369      61.369  50.303 247.713  1.00 26.48           C
ATOM   8474  C    ASP C 369      60.263  51.118 248.384  1.00 27.55           C
ATOM   8475  O    ASP C 369      59.551  51.853 247.708  1.00 28.63           O
ATOM   8476  CB   ASP C 369      60.923  48.895 247.279  1.00 25.62           C
ATOM   8477  CG   ASP C 369      60.193  48.147 248.349  1.00 26.29           C
ATOM   8478  OD1  ASP C 369      60.890  47.432 249.108  1.00 25.76           O
ATOM   8479  OD2  ASP C 369      58.929  48.247 248.409  1.00 25.73           O
ATOM   8480  N    GLU C 370      60.167  51.031 249.709  1.00 28.05           N
ATOM   8481  CA   GLU C 370      59.252  51.890 250.479  1.00 29.25           C
ATOM   8482  C    GLU C 370      59.375  53.413 250.176  1.00 28.83           C
ATOM   8483  O    GLU C 370      58.364  54.075 249.930  1.00 29.64           O
ATOM   8484  CB   GLU C 370      59.425  51.645 251.983  1.00 28.87           C
ATOM   8485  CG   GLU C 370      59.095  50.228 252.418  1.00 30.07           C
```

Appendix 2

```
ATOM   8486  CD   GLU C 370      60.297  49.266 252.542  1.00 30.71           C
ATOM   8487  OE1  GLU C 370      61.323  49.392 251.822  1.00 30.23           O
ATOM   8488  OE2  GLU C 370      60.189  48.344 253.382  1.00 27.74           O
ATOM   8489  N    LEU C 371      60.587  53.968 250.192  1.00 27.79           N
ATOM   8490  CA   LEU C 371      60.745  55.436 250.084  1.00 28.60           C
ATOM   8491  C    LEU C 371      60.655  55.963 248.654  1.00 29.39           C
ATOM   8492  O    LEU C 371      60.099  57.041 248.413  1.00 31.92           O
ATOM   8493  CB   LEU C 371      62.050  55.914 250.717  1.00 27.98           C
ATOM   8494  CG   LEU C 371      62.071  55.815 252.242  1.00 28.98           C
ATOM   8495  CD1  LEU C 371      63.425  56.259 252.773  1.00 28.94           C
ATOM   8496  CD2  LEU C 371      60.939  56.637 252.869  1.00 29.41           C
ATOM   8497  N    LEU C 372      61.216  55.224 247.708  1.00 28.32           N
ATOM   8498  CA   LEU C 372      60.994  55.532 246.303  1.00 26.19           C
ATOM   8499  C    LEU C 372      59.488  55.510 245.945  1.00 25.20           C
ATOM   8500  O    LEU C 372      59.007  56.393 245.244  1.00 24.59           O
ATOM   8501  CB   LEU C 372      61.791  54.579 245.427  1.00 25.14           C
ATOM   8502  CG   LEU C 372      63.118  55.203 245.002  1.00 25.83           C
ATOM   8503  CD1  LEU C 372      64.065  55.430 246.183  1.00 25.09           C
ATOM   8504  CD2  LEU C 372      63.753  54.345 243.908  1.00 25.75           C
ATOM   8505  N    PHE C 373      58.761  54.527 246.463  1.00 24.43           N
ATOM   8506  CA   PHE C 373      57.338  54.352 246.177  1.00 25.12           C
ATOM   8507  C    PHE C 373      56.549  55.528 246.675  1.00 24.44           C
ATOM   8508  O    PHE C 373      55.755  56.112 245.959  1.00 22.59           O
ATOM   8509  CB   PHE C 373      56.806  53.095 246.861  1.00 25.52           C
ATOM   8510  CG   PHE C 373      55.296  53.042 246.999  1.00 25.97           C
ATOM   8511  CD1  PHE C 373      54.489  53.033 245.897  1.00 25.99           C
ATOM   8512  CD2  PHE C 373      54.703  52.947 248.248  1.00 26.79           C
ATOM   8513  CE1  PHE C 373      53.119  52.959 246.020  1.00 27.05           C
ATOM   8514  CE2  PHE C 373      53.338  52.846 248.386  1.00 27.50           C
ATOM   8515  CZ   PHE C 373      52.540  52.855 247.266  1.00 27.90           C
ATOM   8516  N    LEU C 374      56.782  55.830 247.933  1.00 24.79           N
ATOM   8517  CA   LEU C 374      56.212  56.977 248.574  1.00 25.06           C
ATOM   8518  C    LEU C 374      56.501  58.286 247.804  1.00 25.03           C
ATOM   8519  O    LEU C 374      55.572  59.052 247.495  1.00 26.30           O
ATOM   8520  CB   LEU C 374      56.756  57.046 250.008  1.00 24.99           C
ATOM   8521  CG   LEU C 374      56.397  58.323 250.766  1.00 25.28           C
ATOM   8522  CD1  LEU C 374      54.869  58.377 250.890  1.00 25.34           C
ATOM   8523  CD2  LEU C 374      57.123  58.386 252.105  1.00 24.33           C
ATOM   8524  N    ALA C 375      57.770  58.553 247.512  1.00 23.69           N
ATOM   8525  CA   ALA C 375      58.127  59.785 246.819  1.00 24.12           C
ATOM   8526  C    ALA C 375      57.532  59.864 245.396  1.00 25.57           C
ATOM   8527  O    ALA C 375      57.124  60.949 244.940  1.00 26.19           O
ATOM   8528  CB   ALA C 375      59.615  59.945 246.772  1.00 23.25           C
ATOM   8529  N    LYS C 376      57.441  58.719 244.718  1.00 25.47           N
ATOM   8530  CA   LYS C 376      56.853  58.677 243.381  1.00 25.86           C
ATOM   8531  C    LYS C 376      55.375  59.095 243.362  1.00 26.64           C
ATOM   8532  O    LYS C 376      54.907  59.754 242.411  1.00 27.64           O
ATOM   8533  CB   LYS C 376      57.034  57.301 242.735  1.00 26.47           C
ATOM   8534  CG   LYS C 376      58.433  57.082 242.170  1.00 26.62           C
ATOM   8535  CD   LYS C 376      58.665  55.643 241.742  1.00 27.07           C
ATOM   8536  CE   LYS C 376      60.013  55.489 241.052  1.00 27.13           C
ATOM   8537  NZ   LYS C 376      60.183  54.135 240.444  1.00 27.76           N
ATOM   8538  N    VAL C 377      54.652  58.761 244.417  1.00 25.88           N
ATOM   8539  CA   VAL C 377      53.197  59.005 244.444  1.00 25.47           C
```

Appendix 2

```
ATOM   8540  C    VAL C 377      52.755  60.171 245.323  1.00 25.26           C
ATOM   8541  O    VAL C 377      51.634  60.630 245.202  1.00 24.12           O
ATOM   8542  CB   VAL C 377      52.426  57.759 244.934  1.00 24.46           C
ATOM   8543  CG1  VAL C 377      52.625  56.585 243.981  1.00 23.36           C
ATOM   8544  CG2  VAL C 377      52.811  57.419 246.375  1.00 24.22           C
ATOM   8545  N    HIS C 378      53.643  60.636 246.195  1.00 25.75           N
ATOM   8546  CA   HIS C 378      53.259  61.466 247.328  1.00 24.93           C
ATOM   8547  C    HIS C 378      52.478  62.674 246.871  1.00 24.90           C
ATOM   8548  O    HIS C 378      52.944  63.419 246.008  1.00 25.50           O
ATOM   8549  CB   HIS C 378      54.511  61.891 248.106  1.00 25.07           C
ATOM   8550  CG   HIS C 378      54.221  62.691 249.335  1.00 25.90           C
ATOM   8551  ND1  HIS C 378      53.420  62.222 250.362  1.00 26.43           N
ATOM   8552  CD2  HIS C 378      54.647  63.920 249.714  1.00 24.98           C
ATOM   8553  CE1  HIS C 378      53.359  63.140 251.312  1.00 25.88           C
ATOM   8554  NE2  HIS C 378      54.103  64.172 250.949  1.00 25.58           N
ATOM   8555  N    ALA C 379      51.300  62.874 247.456  1.00 25.49           N
ATOM   8556  CA   ALA C 379      50.415  63.991 247.077  1.00 27.42           C
ATOM   8557  C    ALA C 379      50.613  65.303 247.867  1.00 29.74           C
ATOM   8558  O    ALA C 379      50.044  66.330 247.515  1.00 29.61           O
ATOM   8559  CB   ALA C 379      48.969  63.555 247.188  1.00 27.89           C
ATOM   8560  N    GLY C 380      51.435  65.275 248.913  1.00 31.36           N
ATOM   8561  CA   GLY C 380      51.527  66.379 249.855  1.00 29.12           C
ATOM   8562  C    GLY C 380      50.770  65.969 251.090  1.00 29.42           C
ATOM   8563  O    GLY C 380      49.671  65.411 250.995  1.00 32.98           O
ATOM   8564  N    PHE C 381      51.361  66.211 252.253  1.00 27.86           N
ATOM   8565  CA   PHE C 381      50.735  65.839 253.504  1.00 27.50           C
ATOM   8566  C    PHE C 381      49.491  66.685 253.738  1.00 28.07           C
ATOM   8567  O    PHE C 381      48.517  66.202 254.296  1.00 26.92           O
ATOM   8568  CB   PHE C 381      51.738  65.932 254.665  1.00 27.54           C
ATOM   8569  CG   PHE C 381      52.703  64.774 254.697  1.00 27.25           C
ATOM   8570  CD1  PHE C 381      52.251  63.481 255.035  1.00 26.95           C
ATOM   8571  CD2  PHE C 381      54.029  64.937 254.335  1.00 26.31           C
ATOM   8572  CE1  PHE C 381      53.114  62.390 255.026  1.00 24.88           C
ATOM   8573  CE2  PHE C 381      54.886  63.853 254.330  1.00 25.76           C
ATOM   8574  CZ   PHE C 381      54.426  62.579 254.676  1.00 25.77           C
ATOM   8575  N    GLY C 382      49.528  67.939 253.289  1.00 29.07           N
ATOM   8576  CA   GLY C 382      48.380  68.831 253.382  1.00 28.50           C
ATOM   8577  C    GLY C 382      47.238  68.268 252.582  1.00 28.56           C
ATOM   8578  O    GLY C 382      46.094  68.232 253.034  1.00 27.47           O
ATOM   8579  N    ALA C 383      47.543  67.815 251.375  1.00 30.76           N
ATOM   8580  CA   ALA C 383      46.508  67.222 250.534  1.00 31.31           C
ATOM   8581  C    ALA C 383      45.925  65.970 251.192  1.00 31.85           C
ATOM   8582  O    ALA C 383      44.715  65.762 251.182  1.00 31.66           O
ATOM   8583  CB   ALA C 383      47.051  66.898 249.164  1.00 31.10           C
ATOM   8584  N    LEU C 384      46.771  65.149 251.799  1.00 32.07           N
ATOM   8585  CA   LEU C 384      46.240  63.985 252.499  1.00 32.45           C
ATOM   8586  C    LEU C 384      45.240  64.411 253.586  1.00 33.03           C
ATOM   8587  O    LEU C 384      44.217  63.742 253.789  1.00 32.05           O
ATOM   8588  CB   LEU C 384      47.365  63.126 253.055  1.00 32.86           C
ATOM   8589  CG   LEU C 384      48.262  62.467 251.998  1.00 35.08           C
ATOM   8590  CD1  LEU C 384      49.494  61.816 252.629  1.00 36.25           C
ATOM   8591  CD2  LEU C 384      47.465  61.451 251.175  1.00 35.90           C
ATOM   8592  N    LEU C 385      45.509  65.547 254.240  1.00 33.89           N
ATOM   8593  CA   LEU C 385      44.614  66.088 255.291  1.00 35.42           C
```

Appendix 2

```
ATOM   8594  C    LEU C 385      43.241  66.494 254.786  1.00 33.09           C
ATOM   8595  O    LEU C 385      42.266  66.354 255.488  1.00 30.87           O
ATOM   8596  CB   LEU C 385      45.227  67.318 255.971  1.00 37.22           C
ATOM   8597  CG   LEU C 385      46.143  67.092 257.155  1.00 40.03           C
ATOM   8598  CD1  LEU C 385      47.046  68.301 257.384  1.00 40.24           C
ATOM   8599  CD2  LEU C 385      45.272  66.818 258.374  1.00 42.30           C
ATOM   8600  N    ARG C 386      43.191  67.040 253.580  1.00 35.38           N
ATOM   8601  CA   ARG C 386      41.940  67.502 252.981  1.00 34.98           C
ATOM   8602  C    ARG C 386      41.391  66.463 252.011  1.00 32.64           C
ATOM   8603  O    ARG C 386      40.613  66.778 251.125  1.00 31.36           O
ATOM   8604  CB   ARG C 386      42.179  68.831 252.270  1.00 35.68           C
ATOM   8605  CG   ARG C 386      42.708  69.906 253.209  1.00 38.13           C
ATOM   8606  CD   ARG C 386      42.858  71.235 252.492  1.00 39.03           C
ATOM   8607  NE   ARG C 386      44.023  71.205 251.622  1.00 38.75           N
ATOM   8608  CZ   ARG C 386      45.264  71.443 252.029  1.00 40.57           C
ATOM   8609  NH1  ARG C 386      45.508  71.732 253.314  1.00 39.95           N
ATOM   8610  NH2  ARG C 386      46.266  71.376 251.147  1.00 39.57           N
ATOM   8611  N    MET C 387      41.778  65.212 252.194  1.00 32.80           N
ATOM   8612  CA   MET C 387      41.300  64.161 251.322  1.00 35.13           C
ATOM   8613  C    MET C 387      39.768  64.133 251.295  1.00 36.25           C
ATOM   8614  O    MET C 387      39.136  64.030 252.349  1.00 33.40           O
ATOM   8615  CB   MET C 387      41.824  62.793 251.777  1.00 35.21           C
ATOM   8616  CG   MET C 387      41.392  61.651 250.865  1.00 36.09           C
ATOM   8617  SD   MET C 387      41.870  60.035 251.462  1.00 37.36           S
ATOM   8618  CE   MET C 387      43.668  60.193 251.420  1.00 33.98           C
ATOM   8619  N    PRO C 388      39.165  64.209 250.089  1.00 39.79           N
ATOM   8620  CA   PRO C 388      37.694  64.059 250.037  1.00 41.77           C
ATOM   8621  C    PRO C 388      37.200  62.719 250.636  1.00 40.25           C
ATOM   8622  O    PRO C 388      37.933  61.732 250.599  1.00 38.33           O
ATOM   8623  CB   PRO C 388      37.363  64.150 248.537  1.00 40.06           C
ATOM   8624  CG   PRO C 388      38.672  64.180 247.812  1.00 41.13           C
ATOM   8625  CD   PRO C 388      39.719  64.635 248.790  1.00 40.36           C
ATOM   8626  N    PRO C 389      35.979  62.703 251.209  1.00 38.45           N
ATOM   8627  CA   PRO C 389      35.438  61.467 251.775  1.00 37.05           C
ATOM   8628  C    PRO C 389      35.089  60.473 250.685  1.00 37.50           C
ATOM   8629  O    PRO C 389      34.916  60.876 249.558  1.00 39.10           O
ATOM   8630  CB   PRO C 389      34.174  61.931 252.515  1.00 37.52           C
ATOM   8631  CG   PRO C 389      34.319  63.409 252.688  1.00 37.26           C
ATOM   8632  CD   PRO C 389      35.141  63.879 251.527  1.00 37.77           C
ATOM   8633  N    PRO C 390      34.993  59.176 251.010  1.00 39.17           N
ATOM   8634  CA   PRO C 390      34.810  58.145 249.958  1.00 39.97           C
ATOM   8635  C    PRO C 390      33.510  58.247 249.129  1.00 38.04           C
ATOM   8636  O    PRO C 390      32.436  58.445 249.682  1.00 34.93           O
ATOM   8637  CB   PRO C 390      34.862  56.825 250.741  1.00 40.83           C
ATOM   8638  CG   PRO C 390      34.655  57.201 252.186  1.00 40.70           C
ATOM   8639  CD   PRO C 390      35.184  58.589 252.347  1.00 38.27           C
TER    8640       PRO C 390
ATOM   8641  N    GLU D  28     105.004  67.696 262.899  1.00 33.03           N
ATOM   8642  CA   GLU D  28     105.510  66.476 262.152  1.00 34.01           C
ATOM   8643  C    GLU D  28     104.586  65.267 262.404  1.00 36.71           C
ATOM   8644  O    GLU D  28     104.639  64.643 263.485  1.00 33.37           O
ATOM   8645  CB   GLU D  28     106.950  66.121 262.548  1.00 31.76           C
ATOM   8646  N    LEU D  29     103.727  64.960 261.419  1.00 39.14           N
ATOM   8647  CA   LEU D  29     102.727  63.881 261.555  1.00 40.01           C
```

Appendix 2

```
ATOM   8648  C   LEU D  29     103.283  62.483 261.159  1.00 40.32           C
ATOM   8649  O   LEU D  29     103.494  62.199 259.977  1.00 40.01           O
ATOM   8650  CB  LEU D  29     101.448  64.203 260.760  1.00 37.77           C
ATOM   8651  CG  LEU D  29     100.222  63.276 260.953  1.00 37.79           C
ATOM   8652  CD1 LEU D  29      99.681  63.303 262.382  1.00 36.96           C
ATOM   8653  CD2 LEU D  29      99.105  63.603 259.965  1.00 35.49           C
ATOM   8654  N   PRO D  30     103.496  61.597 262.153  1.00 39.03           N
ATOM   8655  CA  PRO D  30     104.003  60.273 261.798  1.00 38.54           C
ATOM   8656  C   PRO D  30     103.074  59.574 260.829  1.00 39.85           C
ATOM   8657  O   PRO D  30     101.852  59.776 260.871  1.00 41.00           O
ATOM   8658  CB  PRO D  30     104.045  59.532 263.139  1.00 38.23           C
ATOM   8659  CG  PRO D  30     104.108  60.601 264.180  1.00 37.71           C
ATOM   8660  CD  PRO D  30     103.316  61.745 263.612  1.00 38.94           C
ATOM   8661  N   PRO D  31     103.635  58.750 259.948  1.00 40.38           N
ATOM   8662  CA  PRO D  31     102.743  58.176 258.937  1.00 38.36           C
ATOM   8663  C   PRO D  31     101.702  57.302 259.610  1.00 35.89           C
ATOM   8664  O   PRO D  31     102.017  56.644 260.612  1.00 35.03           O
ATOM   8665  CB  PRO D  31     103.683  57.341 258.057  1.00 39.52           C
ATOM   8666  CG  PRO D  31     104.883  57.044 258.925  1.00 40.79           C
ATOM   8667  CD  PRO D  31     104.985  58.153 259.945  1.00 40.57           C
ATOM   8668  N   GLY D  32     100.482  57.322 259.073  1.00 32.51           N
ATOM   8669  CA  GLY D  32      99.376  56.482 259.551  1.00 31.74           C
ATOM   8670  C   GLY D  32      98.581  57.030 260.741  1.00 31.32           C
ATOM   8671  O   GLY D  32      97.562  56.435 261.154  1.00 30.94           O
ATOM   8672  N   ARG D  33      99.050  58.154 261.289  1.00 28.58           N
ATOM   8673  CA  ARG D  33      98.512  58.724 262.509  1.00 26.79           C
ATOM   8674  C   ARG D  33      97.476  59.782 262.166  1.00 27.78           C
ATOM   8675  O   ARG D  33      97.631  60.505 261.192  1.00 28.10           O
ATOM   8676  CB  ARG D  33      99.634  59.351 263.342  1.00 24.82           C
ATOM   8677  CG  ARG D  33     100.437  58.379 264.192  1.00 23.47           C
ATOM   8678  CD  ARG D  33      99.793  58.027 265.528  1.00 22.54           C
ATOM   8679  NE  ARG D  33      99.610  59.188 266.392  1.00 22.96           N
ATOM   8680  CZ  ARG D  33     100.524  59.698 267.233  1.00 23.33           C
ATOM   8681  NH1 ARG D  33     101.758  59.170 267.365  1.00 22.40           N
ATOM   8682  NH2 ARG D  33     100.205  60.777 267.953  1.00 22.80           N
ATOM   8683  N   LEU D  34      96.426  59.890 262.974  1.00 28.69           N
ATOM   8684  CA  LEU D  34      95.349  60.848 262.680  1.00 28.10           C
ATOM   8685  C   LEU D  34      95.720  62.220 263.170  1.00 26.88           C
ATOM   8686  O   LEU D  34      95.252  63.225 262.627  1.00 25.59           O
ATOM   8687  CB  LEU D  34      94.041  60.430 263.351  1.00 28.52           C
ATOM   8688  CG  LEU D  34      93.603  59.033 262.940  1.00 30.17           C
ATOM   8689  CD1 LEU D  34      92.278  58.690 263.595  1.00 31.29           C
ATOM   8690  CD2 LEU D  34      93.530  58.944 261.421  1.00 30.05           C
ATOM   8691  N   ALA D  35      96.548  62.253 264.212  1.00 25.72           N
ATOM   8692  CA  ALA D  35      96.975  63.506 264.805  1.00 25.42           C
ATOM   8693  C   ALA D  35      98.227  63.345 265.660  1.00 24.77           C
ATOM   8694  O   ALA D  35      98.639  62.222 265.983  1.00 25.02           O
ATOM   8695  CB  ALA D  35      95.840  64.118 265.618  1.00 25.08           C
ATOM   8696  N   THR D  36      98.825  64.484 265.997  1.00 24.19           N
ATOM   8697  CA  THR D  36     100.096  64.523 266.697  1.00 24.65           C
ATOM   8698  C   THR D  36      99.808  64.388 268.150  1.00 24.55           C
ATOM   8699  O   THR D  36      98.752  64.775 268.639  1.00 24.90           O
ATOM   8700  CB  THR D  36     100.872  65.862 266.529  1.00 25.20           C
ATOM   8701  OG1 THR D  36     100.089  66.968 267.032  1.00 26.10           O
```

Appendix 2

```
ATOM   8702  CG2 THR D  36     101.251  66.099 265.075  1.00 24.68           C
ATOM   8703  N   THR D  37     100.789  63.856 268.835  1.00 25.14           N
ATOM   8704  CA  THR D  37     100.774  63.774 270.264  1.00 25.35           C
ATOM   8705  C   THR D  37     100.600  65.138 270.900  1.00 27.74           C
ATOM   8706  O   THR D  37      99.811  65.280 271.854  1.00 30.50           O
ATOM   8707  CB  THR D  37     102.067  63.111 270.704  1.00 24.51           C
ATOM   8708  OG1 THR D  37     102.050  61.765 270.209  1.00 22.91           O
ATOM   8709  CG2 THR D  37     102.227  63.151 272.230  1.00 24.88           C
ATOM   8710  N   GLU D  38     101.325  66.130 270.369  1.00 30.15           N
ATOM   8711  CA  GLU D  38     101.240  67.533 270.817  1.00 30.81           C
ATOM   8712  C   GLU D  38      99.773  67.985 270.857  1.00 30.46           C
ATOM   8713  O   GLU D  38      99.340  68.630 271.812  1.00 29.79           O
ATOM   8714  CB  GLU D  38     102.080  68.423 269.881  1.00 33.48           C
ATOM   8715  CG  GLU D  38     101.943  69.935 270.095  1.00 37.61           C
ATOM   8716  CD  GLU D  38     102.934  70.786 269.283  1.00 39.80           C
ATOM   8717  OE1 GLU D  38     104.128  70.447 269.180  1.00 41.91           O
ATOM   8718  OE2 GLU D  38     102.523  71.826 268.748  1.00 43.54           O
ATOM   8719  N   ASP D  39      99.009  67.620 269.830  1.00 28.38           N
ATOM   8720  CA  ASP D  39      97.600  67.951 269.806  1.00 29.43           C
ATOM   8721  C   ASP D  39      96.793  67.235 270.882  1.00 28.52           C
ATOM   8722  O   ASP D  39      95.921  67.859 271.498  1.00 29.12           O
ATOM   8723  CB  ASP D  39      96.992  67.672 268.429  1.00 30.86           C
ATOM   8724  CG  ASP D  39      97.421  68.696 267.380  1.00 32.89           C
ATOM   8725  OD1 ASP D  39      97.952  69.787 267.750  1.00 31.51           O
ATOM   8726  OD2 ASP D  39      97.210  68.400 266.182  1.00 31.37           O
ATOM   8727  N   TYR D  40      97.059  65.944 271.120  1.00 26.68           N
ATOM   8728  CA  TYR D  40      96.308  65.219 272.152  1.00 25.68           C
ATOM   8729  C   TYR D  40      96.550  65.873 273.502  1.00 26.35           C
ATOM   8730  O   TYR D  40      95.614  66.126 274.249  1.00 25.81           O
ATOM   8731  CB  TYR D  40      96.610  63.705 272.183  1.00 25.03           C
ATOM   8732  CG  TYR D  40      96.186  62.986 270.900  1.00 24.51           C
ATOM   8733  CD1 TYR D  40      94.873  63.077 270.432  1.00 24.52           C
ATOM   8734  CD2 TYR D  40      97.098  62.253 270.140  1.00 23.23           C
ATOM   8735  CE1 TYR D  40      94.483  62.466 269.254  1.00 23.51           C
ATOM   8736  CE2 TYR D  40      96.708  61.632 268.964  1.00 23.90           C
ATOM   8737  CZ  TYR D  40      95.397  61.754 268.536  1.00 23.78           C
ATOM   8738  OH  TYR D  40      94.991  61.161 267.393  1.00 24.21           O
ATOM   8739  N   PHE D  41      97.797  66.222 273.780  1.00 26.83           N
ATOM   8740  CA  PHE D  41      98.139  66.777 275.083  1.00 26.92           C
ATOM   8741  C   PHE D  41      97.698  68.217 275.255  1.00 27.83           C
ATOM   8742  O   PHE D  41      97.632  68.714 276.359  1.00 29.69           O
ATOM   8743  CB  PHE D  41      99.646  66.637 275.327  1.00 26.55           C
ATOM   8744  CG  PHE D  41     100.040  65.274 275.830  1.00 24.95           C
ATOM   8745  CD1 PHE D  41     100.006  64.176 274.985  1.00 23.19           C
ATOM   8746  CD2 PHE D  41     100.436  65.091 277.156  1.00 24.34           C
ATOM   8747  CE1 PHE D  41     100.348  62.916 275.445  1.00 22.21           C
ATOM   8748  CE2 PHE D  41     100.778  63.830 277.619  1.00 24.26           C
ATOM   8749  CZ  PHE D  41     100.724  62.737 276.760  1.00 22.80           C
ATOM   8750  N   ALA D  42      97.382  68.901 274.174  1.00 29.29           N
ATOM   8751  CA  ALA D  42      97.003  70.303 274.283  1.00 30.61           C
ATOM   8752  C   ALA D  42      95.490  70.484 274.271  1.00 31.64           C
ATOM   8753  O   ALA D  42      94.987  71.620 274.344  1.00 32.48           O
ATOM   8754  CB  ALA D  42      97.632  71.080 273.132  1.00 31.30           C
ATOM   8755  N   GLN D  43      94.753  69.377 274.150  1.00 30.51           N
```

Appendix 2

```
ATOM   8756  CA  GLN D  43      93.299  69.443 273.992  1.00 29.62           C
ATOM   8757  C   GLN D  43      92.681  70.257 275.082  1.00 28.65           C
ATOM   8758  O   GLN D  43      91.761  71.024 274.861  1.00 30.53           O
ATOM   8759  CB  GLN D  43      92.664  68.046 273.996  1.00 28.37           C
ATOM   8760  CG  GLN D  43      92.653  67.391 272.622  1.00 27.05           C
ATOM   8761  CD  GLN D  43      92.232  65.946 272.675  1.00 26.09           C
ATOM   8762  OE1 GLN D  43      91.132  65.584 272.245  1.00 26.09           O
ATOM   8763  NE2 GLN D  43      93.095  65.111 273.217  1.00 24.98           N
ATOM   8764  N   GLN D  44      93.202  70.090 276.272  1.00 29.23           N
ATOM   8765  CA  GLN D  44      92.622  70.730 277.412  1.00 29.97           C
ATOM   8766  C   GLN D  44      92.909  72.240 277.461  1.00 31.14           C
ATOM   8767  O   GLN D  44      92.013  73.033 277.733  1.00 30.92           O
ATOM   8768  CB  GLN D  44      93.101  70.024 278.650  1.00 29.90           C
ATOM   8769  CG  GLN D  44      92.251  70.328 279.841  1.00 31.63           C
ATOM   8770  CD  GLN D  44      92.554  69.408 280.979  1.00 32.71           C
ATOM   8771  OE1 GLN D  44      93.062  68.286 280.794  1.00 32.99           O
ATOM   8772  NE2 GLN D  44      92.257  69.877 282.179  1.00 33.35           N
ATOM   8773  N   ALA D  45      94.142  72.635 277.172  1.00 32.37           N
ATOM   8774  CA  ALA D  45      94.470  74.059 276.975  1.00 32.90           C
ATOM   8775  C   ALA D  45      93.614  74.747 275.852  1.00 34.16           C
ATOM   8776  O   ALA D  45      93.193  75.906 275.993  1.00 32.88           O
ATOM   8777  CB  ALA D  45      95.965  74.207 276.689  1.00 31.14           C
ATOM   8778  N   LYS D  46      93.361  74.037 274.756  1.00 33.89           N
ATOM   8779  CA  LYS D  46      92.536  74.572 273.669  1.00 36.98           C
ATOM   8780  C   LYS D  46      91.029  74.445 273.922  1.00 35.06           C
ATOM   8781  O   LYS D  46      90.227  74.949 273.156  1.00 35.04           O
ATOM   8782  CB  LYS D  46      92.889  73.895 272.326  1.00 41.49           C
ATOM   8783  CG  LYS D  46      94.249  74.300 271.757  1.00 45.51           C
ATOM   8784  CD  LYS D  46      94.515  73.713 270.368  1.00 49.56           C
ATOM   8785  CE  LYS D  46      95.999  73.789 269.986  1.00 53.13           C
ATOM   8786  NZ  LYS D  46      96.589  72.438 269.678  1.00 52.01           N
ATOM   8787  N   GLN D  47      90.634  73.761 274.983  1.00 34.57           N
ATOM   8788  CA  GLN D  47      89.216  73.609 275.293  1.00 34.42           C
ATOM   8789  C   GLN D  47      88.441  73.054 274.115  1.00 33.49           C
ATOM   8790  O   GLN D  47      87.327  73.499 273.804  1.00 33.00           O
ATOM   8791  CB  GLN D  47      88.607  74.920 275.789  1.00 34.93           C
ATOM   8792  CG  GLN D  47      89.192  75.358 277.128  1.00 36.93           C
ATOM   8793  CD  GLN D  47      88.134  75.909 278.073  1.00 39.35           C
ATOM   8794  OE1 GLN D  47      87.530  76.962 277.801  1.00 38.39           O
ATOM   8795  NE2 GLN D  47      87.886  75.192 279.187  1.00 37.80           N
ATOM   8796  N   ALA D  48      89.036  72.048 273.479  1.00 31.71           N
ATOM   8797  CA  ALA D  48      88.448  71.444 272.291  1.00 30.75           C
ATOM   8798  C   ALA D  48      89.133  70.126 271.954  1.00 29.30           C
ATOM   8799  O   ALA D  48      90.354  70.078 271.788  1.00 30.77           O
ATOM   8800  CB  ALA D  48      88.549  72.410 271.115  1.00 29.58           C
ATOM   8801  N   VAL D  49      88.352  69.060 271.846  1.00 27.43           N
ATOM   8802  CA  VAL D  49      88.893  67.761 271.456  1.00 26.79           C
ATOM   8803  C   VAL D  49      89.405  67.827 270.038  1.00 27.45           C
ATOM   8804  O   VAL D  49      88.953  68.671 269.263  1.00 27.90           O
ATOM   8805  CB  VAL D  49      87.845  66.634 271.549  1.00 25.78           C
ATOM   8806  CG1 VAL D  49      87.326  66.539 272.967  1.00 26.34           C
ATOM   8807  CG2 VAL D  49      86.690  66.839 270.578  1.00 25.44           C
ATOM   8808  N   THR D  50      90.337  66.949 269.676  1.00 27.11           N
ATOM   8809  CA  THR D  50      90.795  66.922 268.283  1.00 27.74           C
```

Appendix 2

```
ATOM  8810  C    THR  D  50   89.643  66.471  267.376  1.00  28.61   C
ATOM  8811  O    THR  D  50   88.646  65.937  267.862  1.00  27.05   O
ATOM  8812  CB   THR  D  50   91.976  65.967  268.078  1.00  27.11   C
ATOM  8813  OG1  THR  D  50   91.591  64.641  268.456  1.00  26.32   O
ATOM  8814  CG2  THR  D  50   93.160  66.406  268.900  1.00  26.55   C
ATOM  8815  N    PRO  D  51   89.764  66.709  266.061  1.00  31.21   N
ATOM  8816  CA   PRO  D  51   88.727  66.220  265.127  1.00  30.31   C
ATOM  8817  C    PRO  D  51   88.562  64.717  265.140  1.00  28.30   C
ATOM  8818  O    PRO  D  51   87.451  64.240  264.949  1.00  29.44   O
ATOM  8819  CB   PRO  D  51   89.230  66.694  263.747  1.00  30.45   C
ATOM  8820  CG   PRO  D  51   90.045  67.927  264.046  1.00  30.11   C
ATOM  8821  CD   PRO  D  51   90.700  67.649  265.396  1.00  31.60   C
ATOM  8822  N    ASP  D  52   89.635  63.975  265.368  1.00  27.40   N
ATOM  8823  CA   ASP  D  52   89.533  62.497  265.374  1.00  28.56   C
ATOM  8824  C    ASP  D  52   88.837  61.946  266.651  1.00  27.21   C
ATOM  8825  O    ASP  D  52   88.137  60.932  266.619  1.00  26.51   O
ATOM  8826  CB   ASP  D  52   90.894  61.805  265.105  1.00  29.12   C
ATOM  8827  CG   ASP  D  52   91.942  62.062  266.198  1.00  30.87   C
ATOM  8828  OD1  ASP  D  52   92.246  63.232  266.535  1.00  33.87   O
ATOM  8829  OD2  ASP  D  52   92.500  61.081  266.707  1.00  31.67   O
ATOM  8830  N    VAL  D  53   89.006  62.636  267.759  1.00  25.52   N
ATOM  8831  CA   VAL  D  53   88.309  62.285  268.971  1.00  25.42   C
ATOM  8832  C    VAL  D  53   86.822  62.588  268.819  1.00  26.53   C
ATOM  8833  O    VAL  D  53   85.977  61.787  269.205  1.00  26.84   O
ATOM  8834  CB   VAL  D  53   88.903  63.054  270.152  1.00  24.85   C
ATOM  8835  CG1  VAL  D  53   87.985  63.008  271.363  1.00  25.18   C
ATOM  8836  CG2  VAL  D  53   90.270  62.501  270.466  1.00  23.52   C
ATOM  8837  N    MET  D  54   86.504  63.752  268.263  1.00  27.14   N
ATOM  8838  CA   MET  D  54   85.128  64.075  267.909  1.00  26.17   C
ATOM  8839  C    MET  D  54   84.534  63.011  267.000  1.00  23.97   C
ATOM  8840  O    MET  D  54   83.366  62.687  267.113  1.00  24.40   O
ATOM  8841  CB   MET  D  54   85.045  65.431  267.187  1.00  28.07   C
ATOM  8842  CG   MET  D  54   83.625  65.949  266.948  1.00  29.50   C
ATOM  8843  SD   MET  D  54   82.708  66.304  268.474  1.00  34.72   S
ATOM  8844  CE   MET  D  54   81.534  67.476  267.777  1.00  42.35   C
ATOM  8845  N    ALA  D  55   85.317  62.491  266.070  1.00  21.93   N
ATOM  8846  CA   ALA  D  55   84.800  61.498  265.136  1.00  21.52   C
ATOM  8847  C    ALA  D  55   84.601  60.147  265.833  1.00  21.48   C
ATOM  8848  O    ALA  D  55   83.829  59.314  265.381  1.00  21.77   O
ATOM  8849  CB   ALA  D  55   85.722  61.364  263.924  1.00  21.00   C
ATOM  8850  N    GLN  D  56   85.306  59.939  266.933  1.00  21.42   N
ATOM  8851  CA   GLN  D  56   85.116  58.757  267.756  1.00  21.76   C
ATOM  8852  C    GLN  D  56   83.810  58.902  268.555  1.00  21.23   C
ATOM  8853  O    GLN  D  56   83.040  57.944  268.677  1.00  20.12   O
ATOM  8854  CB   GLN  D  56   86.330  58.563  268.673  1.00  21.82   C
ATOM  8855  CG   GLN  D  56   86.162  57.593  269.835  1.00  22.88   C
ATOM  8856  CD   GLN  D  56   85.973  56.140  269.409  1.00  24.23   C
ATOM  8857  OE1  GLN  D  56   86.438  55.721  268.333  1.00  26.80   O
ATOM  8858  NE2  GLN  D  56   85.295  55.349  270.266  1.00  23.87   N
ATOM  8859  N    LEU  D  57   83.563  60.098  269.076  1.00  20.95   N
ATOM  8860  CA   LEU  D  57   82.312  60.390  269.786  1.00  22.35   C
ATOM  8861  C    LEU  D  57   81.103  60.265  268.879  1.00  22.06   C
ATOM  8862  O    LEU  D  57   80.013  59.967  269.356  1.00  20.71   O
ATOM  8863  CB   LEU  D  57   82.340  61.790  270.406  1.00  23.52   C
```

Appendix 2

```
ATOM   8864  CG   LEU D  57      83.344  62.046 271.535  1.00 23.76           C
ATOM   8865  CD1  LEU D  57      83.439  63.544 271.762  1.00 25.56           C
ATOM   8866  CD2  LEU D  57      82.923  61.335 272.810  1.00 23.52           C
ATOM   8867  N    ALA D  58      81.320  60.493 267.581  1.00 22.28           N
ATOM   8868  CA   ALA D  58      80.321  60.219 266.541  1.00 23.46           C
ATOM   8869  C    ALA D  58      80.037  58.721 266.344  1.00 23.57           C
ATOM   8870  O    ALA D  58      78.886  58.314 266.352  1.00 25.73           O
ATOM   8871  CB   ALA D  58      80.731  60.861 265.208  1.00 22.97           C
ATOM   8872  N    TYR D  59      81.068  57.904 266.131  1.00 23.88           N
ATOM   8873  CA   TYR D  59      80.876  56.450 266.138  1.00 22.86           C
ATOM   8874  C    TYR D  59      80.041  56.112 267.372  1.00 21.22           C
ATOM   8875  O    TYR D  59      79.035  55.456 267.281  1.00 20.77           O
ATOM   8876  CB   TYR D  59      82.219  55.686 266.162  1.00 22.62           C
ATOM   8877  CG   TYR D  59      82.057  54.285 266.680  1.00 22.57           C
ATOM   8878  CD1  TYR D  59      81.427  53.314 265.915  1.00 23.41           C
ATOM   8879  CD2  TYR D  59      82.493  53.933 267.945  1.00 23.11           C
ATOM   8880  CE1  TYR D  59      81.244  52.025 266.391  1.00 23.03           C
ATOM   8881  CE2  TYR D  59      82.308  52.650 268.431  1.00 23.52           C
ATOM   8882  CZ   TYR D  59      81.673  51.704 267.646  1.00 23.92           C
ATOM   8883  OH   TYR D  59      81.455  50.426 268.134  1.00 27.41           O
ATOM   8884  N    MET D  60      80.441  56.633 268.516  1.00 21.39           N
ATOM   8885  CA   MET D  60      79.776  56.308 269.789  1.00 21.93           C
ATOM   8886  C    MET D  60      78.279  56.721 269.840  1.00 21.96           C
ATOM   8887  O    MET D  60      77.477  56.006 270.457  1.00 22.57           O
ATOM   8888  CB   MET D  60      80.555  56.905 270.984  1.00 20.30           C
ATOM   8889  CG   MET D  60      81.888  56.231 271.284  1.00 20.39           C
ATOM   8890  SD   MET D  60      83.081  57.185 272.280  1.00 21.82           S
ATOM   8891  CE   MET D  60      82.323  57.132 273.888  1.00 21.33           C
ATOM   8892  N    ASN D  61      77.908  57.812 269.152  1.00 20.95           N
ATOM   8893  CA   ASN D  61      76.608  58.466 269.360  1.00 20.89           C
ATOM   8894  C    ASN D  61      75.710  58.668 268.139  1.00 21.65           C
ATOM   8895  O    ASN D  61      74.532  59.050 268.307  1.00 21.52           O
ATOM   8896  CB   ASN D  61      76.815  59.865 269.973  1.00 20.79           C
ATOM   8897  CG   ASN D  61      77.077  59.846 271.475  1.00 20.32           C
ATOM   8898  OD1  ASN D  61      76.156  59.775 272.285  1.00 20.19           O
ATOM   8899  ND2  ASN D  61      78.330  59.997 271.847  1.00 20.33           N
ATOM   8900  N    TYR D  62      76.222  58.452 266.928  1.00 21.76           N
ATOM   8901  CA   TYR D  62      75.520  58.957 265.740  1.00 21.86           C
ATOM   8902  C    TYR D  62      74.379  58.081 265.277  1.00 22.03           C
ATOM   8903  O    TYR D  62      73.226  58.513 265.262  1.00 22.00           O
ATOM   8904  CB   TYR D  62      76.469  59.224 264.554  1.00 22.25           C
ATOM   8905  CG   TYR D  62      75.853  60.179 263.554  1.00 22.98           C
ATOM   8906  CD1  TYR D  62      76.062  61.551 263.648  1.00 23.95           C
ATOM   8907  CD2  TYR D  62      75.027  59.709 262.540  1.00 23.26           C
ATOM   8908  CE1  TYR D  62      75.451  62.432 262.741  1.00 26.00           C
ATOM   8909  CE2  TYR D  62      74.401  60.562 261.646  1.00 24.28           C
ATOM   8910  CZ   TYR D  62      74.600  61.920 261.742  1.00 25.14           C
ATOM   8911  OH   TYR D  62      73.988  62.740 260.837  1.00 23.08           O
ATOM   8912  N    ILE D  63      74.719  56.873 264.847  1.00 22.29           N
ATOM   8913  CA   ILE D  63      73.794  56.028 264.127  1.00 22.00           C
ATOM   8914  C    ILE D  63      72.755  55.423 265.073  1.00 23.19           C
ATOM   8915  O    ILE D  63      73.075  54.986 266.182  1.00 23.27           O
ATOM   8916  CB   ILE D  63      74.559  54.931 263.363  1.00 22.63           C
ATOM   8917  CG1  ILE D  63      75.638  55.606 262.477  1.00 22.55           C
```

Appendix 2

```
ATOM   8918  CG2  ILE D  63      73.600  54.020 262.567  1.00 21.13           C
ATOM   8919  CD1  ILE D  63      76.527  54.667 261.671  1.00 21.88           C
ATOM   8920  N    ASP D  64      71.498  55.442 264.635  1.00 24.80           N
ATOM   8921  CA   ASP D  64      70.396  54.939 265.427  1.00 25.57           C
ATOM   8922  C    ASP D  64      70.582  53.452 265.690  1.00 24.39           C
ATOM   8923  O    ASP D  64      71.058  52.709 264.841  1.00 23.66           O
ATOM   8924  CB   ASP D  64      69.042  55.165 264.703  1.00 28.60           C
ATOM   8925  CG   ASP D  64      68.627  56.639 264.653  1.00 30.97           C
ATOM   8926  OD1  ASP D  64      68.920  57.402 265.594  1.00 35.11           O
ATOM   8927  OD2  ASP D  64      68.002  57.042 263.670  1.00 32.49           O
ATOM   8928  N    PHE D  65      70.181  53.020 266.876  1.00 24.56           N
ATOM   8929  CA   PHE D  65      70.147  51.598 267.248  1.00 23.93           C
ATOM   8930  C    PHE D  65      71.502  50.954 267.481  1.00 23.44           C
ATOM   8931  O    PHE D  65      71.643  50.231 268.448  1.00 22.90           O
ATOM   8932  CB   PHE D  65      69.372  50.783 266.213  1.00 23.96           C
ATOM   8933  CG   PHE D  65      68.045  51.372 265.881  1.00 24.00           C
ATOM   8934  CD1  PHE D  65      67.148  51.688 266.902  1.00 23.96           C
ATOM   8935  CD2  PHE D  65      67.698  51.647 264.562  1.00 23.70           C
ATOM   8936  CE1  PHE D  65      65.919  52.259 266.617  1.00 24.47           C
ATOM   8937  CE2  PHE D  65      66.474  52.215 264.264  1.00 24.69           C
ATOM   8938  CZ   PHE D  65      65.575  52.522 265.297  1.00 25.11           C
ATOM   8939  N    ILE D  66      72.479  51.199 266.601  1.00 22.52           N
ATOM   8940  CA   ILE D  66      73.701  50.423 266.607  1.00 22.39           C
ATOM   8941  C    ILE D  66      74.875  51.111 267.289  1.00 24.07           C
ATOM   8942  O    ILE D  66      75.869  50.458 267.618  1.00 23.88           O
ATOM   8943  CB   ILE D  66      74.105  49.939 265.194  1.00 23.18           C
ATOM   8944  CG1  ILE D  66      74.486  51.085 264.256  1.00 22.87           C
ATOM   8945  CG2  ILE D  66      72.991  49.071 264.550  1.00 23.65           C
ATOM   8946  CD1  ILE D  66      74.907  50.597 262.867  1.00 22.29           C
ATOM   8947  N    SER D  67      74.784  52.416 267.522  1.00 23.62           N
ATOM   8948  CA   SER D  67      75.873  53.082 268.168  1.00 22.60           C
ATOM   8949  C    SER D  67      75.777  52.660 269.625  1.00 22.32           C
ATOM   8950  O    SER D  67      74.705  52.419 270.105  1.00 20.82           O
ATOM   8951  CB   SER D  67      75.779  54.590 267.961  1.00 23.07           C
ATOM   8952  OG   SER D  67      74.658  55.132 268.604  1.00 24.67           O
ATOM   8953  N    PRO D  68      76.912  52.537 270.317  1.00 23.60           N
ATOM   8954  CA   PRO D  68      76.881  52.018 271.671  1.00 23.79           C
ATOM   8955  C    PRO D  68      76.158  52.883 272.655  1.00 24.42           C
ATOM   8956  O    PRO D  68      75.629  52.355 273.617  1.00 24.87           O
ATOM   8957  CB   PRO D  68      78.369  51.920 272.065  1.00 23.47           C
ATOM   8958  CG   PRO D  68      79.126  52.686 271.070  1.00 23.12           C
ATOM   8959  CD   PRO D  68      78.288  52.745 269.828  1.00 23.94           C
ATOM   8960  N    PHE D  69      76.161  54.197 272.451  1.00 25.97           N
ATOM   8961  CA   PHE D  69      75.533  55.127 273.418  1.00 26.87           C
ATOM   8962  C    PHE D  69      74.273  55.765 272.874  1.00 27.32           C
ATOM   8963  O    PHE D  69      74.001  56.978 273.084  1.00 27.19           O
ATOM   8964  CB   PHE D  69      76.541  56.169 273.914  1.00 27.56           C
ATOM   8965  CG   PHE D  69      77.615  55.559 274.750  1.00 28.33           C
ATOM   8966  CD1  PHE D  69      77.435  55.391 276.093  1.00 29.92           C
ATOM   8967  CD2  PHE D  69      78.750  55.045 274.163  1.00 29.24           C
ATOM   8968  CE1  PHE D  69      78.391  54.753 276.859  1.00 30.81           C
ATOM   8969  CE2  PHE D  69      79.719  54.420 274.918  1.00 30.26           C
ATOM   8970  CZ   PHE D  69      79.541  54.263 276.269  1.00 29.47           C
ATOM   8971  N    TYR D  70      73.486  54.909 272.214  1.00 26.56           N
```

Appendix 2

```
ATOM   8972  CA   TYR D  70      72.234  55.299 271.598  1.00 25.10           C
ATOM   8973  C    TYR D  70      71.110  55.360 272.610  1.00 24.04           C
ATOM   8974  O    TYR D  70      70.326  56.285 272.593  1.00 24.16           O
ATOM   8975  CB   TYR D  70      71.852  54.343 270.458  1.00 25.58           C
ATOM   8976  CG   TYR D  70      70.489  54.670 269.912  1.00 25.08           C
ATOM   8977  CD1  TYR D  70      70.278  55.858 269.212  1.00 25.37           C
ATOM   8978  CD2  TYR D  70      69.402  53.830 270.157  1.00 24.89           C
ATOM   8979  CE1  TYR D  70      69.028  56.192 268.737  1.00 26.48           C
ATOM   8980  CE2  TYR D  70      68.146  54.156 269.699  1.00 26.14           C
ATOM   8981  CZ   TYR D  70      67.965  55.336 268.989  1.00 26.94           C
ATOM   8982  OH   TYR D  70      66.722  55.653 268.541  1.00 29.57           O
ATOM   8983  N    SER D  71      70.995  54.361 273.470  1.00 25.00           N
ATOM   8984  CA   SER D  71      69.874  54.328 274.415  1.00 24.95           C
ATOM   8985  C    SER D  71      70.248  53.647 275.682  1.00 24.13           C
ATOM   8986  O    SER D  71      71.168  52.848 275.706  1.00 23.44           O
ATOM   8987  CB   SER D  71      68.696  53.579 273.818  1.00 26.16           C
ATOM   8988  OG   SER D  71      68.499  52.338 274.450  1.00 26.56           O
ATOM   8989  N    ARG D  72      69.505  53.937 276.739  1.00 25.31           N
ATOM   8990  CA   ARG D  72      69.792  53.317 278.025  1.00 26.35           C
ATOM   8991  C    ARG D  72      69.158  51.941 278.176  1.00 24.65           C
ATOM   8992  O    ARG D  72      69.275  51.296 279.209  1.00 26.85           O
ATOM   8993  CB   ARG D  72      69.441  54.237 279.195  1.00 29.38           C
ATOM   8994  CG   ARG D  72      68.055  54.851 279.194  1.00 33.11           C
ATOM   8995  CD   ARG D  72      67.728  55.450 280.567  1.00 35.47           C
ATOM   8996  NE   ARG D  72      68.188  56.833 280.760  1.00 36.95           N
ATOM   8997  CZ   ARG D  72      67.529  57.763 281.483  1.00 43.14           C
ATOM   8998  NH1  ARG D  72      68.007  58.998 281.633  1.00 43.88           N
ATOM   8999  NH2  ARG D  72      66.368  57.489 282.073  1.00 45.82           N
ATOM   9000  N    GLY D  73      68.537  51.460 277.124  1.00 23.73           N
ATOM   9001  CA   GLY D  73      67.994  50.135 277.124  1.00 24.63           C
ATOM   9002  C    GLY D  73      69.043  49.042 277.143  1.00 25.92           C
ATOM   9003  O    GLY D  73      70.225  49.251 276.802  1.00 25.25           O
ATOM   9004  N    CYS D  74      68.583  47.855 277.520  1.00 27.63           N
ATOM   9005  CA   CYS D  74      69.424  46.667 277.581  1.00 29.66           C
ATOM   9006  C    CYS D  74      69.597  46.061 276.183  1.00 28.69           C
ATOM   9007  O    CYS D  74      69.173  44.959 275.919  1.00 29.56           O
ATOM   9008  CB   CYS D  74      68.832  45.671 278.599  1.00 29.76           C
ATOM   9009  SG   CYS D  74      69.080  46.177 280.347  1.00 30.75           S
ATOM   9010  N    SER D  75      70.246  46.812 275.304  1.00 28.20           N
ATOM   9011  CA   SER D  75      70.483  46.423 273.928  1.00 28.34           C
ATOM   9012  C    SER D  75      71.987  46.595 273.658  1.00 28.32           C
ATOM   9013  O    SER D  75      72.555  47.658 273.974  1.00 26.09           O
ATOM   9014  CB   SER D  75      69.659  47.332 273.020  1.00 30.10           C
ATOM   9015  OG   SER D  75      70.268  47.467 271.754  1.00 37.23           O
ATOM   9016  N    PHE D  76      72.619  45.565 273.071  1.00 27.79           N
ATOM   9017  CA   PHE D  76      74.089  45.489 272.943  1.00 27.00           C
ATOM   9018  C    PHE D  76      74.624  45.248 271.533  1.00 27.25           C
ATOM   9019  O    PHE D  76      75.709  44.708 271.345  1.00 26.33           O
ATOM   9020  CB   PHE D  76      74.633  44.472 273.948  1.00 26.35           C
ATOM   9021  CG   PHE D  76      74.397  44.889 275.356  1.00 26.78           C
ATOM   9022  CD1  PHE D  76      75.263  45.777 275.978  1.00 26.46           C
ATOM   9023  CD2  PHE D  76      73.257  44.475 276.045  1.00 27.23           C
ATOM   9024  CE1  PHE D  76      75.015  46.221 277.274  1.00 26.28           C
ATOM   9025  CE2  PHE D  76      73.005  44.916 277.349  1.00 26.56           C
```

Appendix 2

```
ATOM   9026  CZ   PHE D  76      73.889  45.785 277.960  1.00 26.14           C
ATOM   9027  N    GLU D  77      73.898  45.764 270.554  1.00 28.79           N
ATOM   9028  CA   GLU D  77      74.216  45.555 269.141  1.00 29.39           C
ATOM   9029  C    GLU D  77      75.543  46.182 268.750  1.00 28.60           C
ATOM   9030  O    GLU D  77      76.247  45.637 267.910  1.00 29.90           O
ATOM   9031  CB   GLU D  77      73.083  46.072 268.243  1.00 31.88           C
ATOM   9032  CG   GLU D  77      71.700  45.843 268.873  1.00 35.80           C
ATOM   9033  CD   GLU D  77      70.550  45.788 267.882  1.00 39.10           C
ATOM   9034  OE1  GLU D  77      69.434  45.412 268.318  1.00 42.21           O
ATOM   9035  OE2  GLU D  77      70.747  46.125 266.689  1.00 37.81           O
ATOM   9036  N    ALA D  78      75.908  47.305 269.368  1.00 27.72           N
ATOM   9037  CA   ALA D  78      77.190  47.942 269.067  1.00 26.63           C
ATOM   9038  C    ALA D  78      78.307  46.962 269.317  1.00 26.51           C
ATOM   9039  O    ALA D  78      79.281  46.952 268.593  1.00 27.02           O
ATOM   9040  CB   ALA D  78      77.408  49.192 269.909  1.00 26.40           C
ATOM   9041  N    TRP D  79      78.143  46.126 270.339  1.00 26.56           N
ATOM   9042  CA   TRP D  79      79.191  45.216 270.770  1.00 26.42           C
ATOM   9043  C    TRP D  79      79.157  43.942 269.961  1.00 27.18           C
ATOM   9044  O    TRP D  79      80.195  43.366 269.699  1.00 29.89           O
ATOM   9045  CB   TRP D  79      79.068  44.932 272.269  1.00 25.81           C
ATOM   9046  CG   TRP D  79      79.429  46.129 273.140  1.00 24.47           C
ATOM   9047  CD1  TRP D  79      80.630  46.359 273.732  1.00 25.71           C
ATOM   9048  CD2  TRP D  79      78.591  47.230 273.501  1.00 23.70           C
ATOM   9049  NE1  TRP D  79      80.604  47.537 274.432  1.00 25.40           N
ATOM   9050  CE2  TRP D  79      79.358  48.092 274.313  1.00 24.90           C
ATOM   9051  CE3  TRP D  79      77.268  47.573 273.226  1.00 23.40           C
ATOM   9052  CZ2  TRP D  79      78.843  49.294 274.853  1.00 23.83           C
ATOM   9053  CZ3  TRP D  79      76.761  48.772 273.754  1.00 23.44           C
ATOM   9054  CH2  TRP D  79      77.555  49.612 274.562  1.00 23.03           C
ATOM   9055  N    GLU D  80      77.965  43.523 269.550  1.00 29.68           N
ATOM   9056  CA   GLU D  80      77.777  42.348 268.685  1.00 29.80           C
ATOM   9057  C    GLU D  80      78.512  42.543 267.385  1.00 27.77           C
ATOM   9058  O    GLU D  80      79.278  41.685 266.987  1.00 28.09           O
ATOM   9059  CB   GLU D  80      76.273  42.064 268.409  1.00 31.35           C
ATOM   9060  CG   GLU D  80      75.546  41.332 269.546  1.00 34.91           C
ATOM   9061  CD   GLU D  80      74.014  41.617 269.685  1.00 38.26           C
ATOM   9062  OE1  GLU D  80      73.370  42.169 268.758  1.00 40.00           O
ATOM   9063  OE2  GLU D  80      73.431  41.272 270.750  1.00 36.96           O
ATOM   9064  N    LEU D  81      78.311  43.690 266.746  1.00 27.60           N
ATOM   9065  CA   LEU D  81      78.974  43.998 265.470  1.00 27.61           C
ATOM   9066  C    LEU D  81      80.495  44.050 265.538  1.00 26.68           C
ATOM   9067  O    LEU D  81      81.146  43.803 264.538  1.00 25.46           O
ATOM   9068  CB   LEU D  81      78.501  45.331 264.922  1.00 28.44           C
ATOM   9069  CG   LEU D  81      77.039  45.364 264.493  1.00 30.29           C
ATOM   9070  CD1  LEU D  81      76.641  46.833 264.397  1.00 31.40           C
ATOM   9071  CD2  LEU D  81      76.754  44.607 263.195  1.00 30.02           C
ATOM   9072  N    LYS D  82      81.032  44.424 266.701  1.00 26.43           N
ATOM   9073  CA   LYS D  82      82.464  44.349 267.008  1.00 27.47           C
ATOM   9074  C    LYS D  82      82.937  43.010 267.594  1.00 28.50           C
ATOM   9075  O    LYS D  82      84.113  42.874 267.924  1.00 26.33           O
ATOM   9076  CB   LYS D  82      82.782  45.378 268.061  1.00 29.52           C
ATOM   9077  CG   LYS D  82      83.218  46.695 267.494  1.00 29.97           C
ATOM   9078  CD   LYS D  82      83.028  47.797 268.522  1.00 30.75           C
ATOM   9079  CE   LYS D  82      83.742  47.541 269.838  1.00 29.84           C
```

Appendix 2

```
ATOM   9080  NZ  LYS D  82      83.688  48.801 270.633  1.00 30.16           N
ATOM   9081  N   HIS D  83      82.013  42.052 267.753  1.00 28.91           N
ATOM   9082  CA  HIS D  83      82.291  40.726 268.282  1.00 27.54           C
ATOM   9083  C   HIS D  83      82.917  40.755 269.674  1.00 26.56           C
ATOM   9084  O   HIS D  83      83.789  39.941 269.965  1.00 27.09           O
ATOM   9085  CB  HIS D  83      83.164  39.947 267.306  1.00 29.44           C
ATOM   9086  CG  HIS D  83      82.675  39.999 265.884  1.00 33.25           C
ATOM   9087  ND1 HIS D  83      81.605  39.250 265.432  1.00 32.84           N
ATOM   9088  CD2 HIS D  83      83.111  40.720 264.815  1.00 35.31           C
ATOM   9089  CE1 HIS D  83      81.401  39.506 264.150  1.00 34.23           C
ATOM   9090  NE2 HIS D  83      82.299  40.395 263.753  1.00 36.48           N
ATOM   9091  N   THR D  84      82.459  41.662 270.545  1.00 24.69           N
ATOM   9092  CA  THR D  84      82.989  41.742 271.910  1.00 24.18           C
ATOM   9093  C   THR D  84      82.571  40.460 272.654  1.00 23.82           C
ATOM   9094  O   THR D  84      81.404  40.098 272.675  1.00 24.55           O
ATOM   9095  CB  THR D  84      82.481  42.985 272.718  1.00 25.01           C
ATOM   9096  OG1 THR D  84      82.783  44.233 272.068  1.00 24.11           O
ATOM   9097  CG2 THR D  84      83.130  43.022 274.093  1.00 25.76           C
ATOM   9098  N   PRO D  85      83.529  39.735 273.228  1.00 22.73           N
ATOM   9099  CA  PRO D  85      83.078  38.620 274.049  1.00 21.55           C
ATOM   9100  C   PRO D  85      82.287  39.154 275.230  1.00 21.52           C
ATOM   9101  O   PRO D  85      82.590  40.231 275.719  1.00 21.87           O
ATOM   9102  CB  PRO D  85      84.387  37.968 274.535  1.00 21.01           C
ATOM   9103  CG  PRO D  85      85.464  38.478 273.654  1.00 20.78           C
ATOM   9104  CD  PRO D  85      84.992  39.758 273.036  1.00 21.94           C
ATOM   9105  N   GLN D  86      81.299  38.390 275.691  1.00 21.78           N
ATOM   9106  CA  GLN D  86      80.428  38.782 276.802  1.00 21.22           C
ATOM   9107  C   GLN D  86      81.183  39.270 278.046  1.00 21.21           C
ATOM   9108  O   GLN D  86      80.852  40.328 278.609  1.00 19.47           O
ATOM   9109  CB  GLN D  86      79.525  37.603 277.175  1.00 22.01           C
ATOM   9110  CG  GLN D  86      78.520  37.883 278.300  1.00 22.03           C
ATOM   9111  CD  GLN D  86      79.146  37.839 279.682  1.00 21.72           C
ATOM   9112  OE1 GLN D  86      80.058  37.066 279.921  1.00 21.92           O
ATOM   9113  NE2 GLN D  86      78.640  38.659 280.602  1.00 21.54           N
ATOM   9114  N   ARG D  87      82.206  38.510 278.447  1.00 22.29           N
ATOM   9115  CA  ARG D  87      82.978  38.779 279.678  1.00 21.93           C
ATOM   9116  C   ARG D  87      83.685  40.119 279.705  1.00 22.25           C
ATOM   9117  O   ARG D  87      84.076  40.578 280.766  1.00 23.30           O
ATOM   9118  CB  ARG D  87      84.042  37.701 279.901  1.00 22.08           C
ATOM   9119  CG  ARG D  87      83.464  36.361 280.273  1.00 22.76           C
ATOM   9120  CD  ARG D  87      84.522  35.309 280.532  1.00 23.16           C
ATOM   9121  NE  ARG D  87      83.914  34.002 280.797  1.00 23.69           N
ATOM   9122  CZ  ARG D  87      83.389  33.619 281.957  1.00 22.22           C
ATOM   9123  NH1 ARG D  87      83.369  34.394 283.009  1.00 21.13           N
ATOM   9124  NH2 ARG D  87      82.901  32.410 282.065  1.00 23.92           N
ATOM   9125  N   VAL D  88      83.853  40.736 278.548  1.00 22.68           N
ATOM   9126  CA  VAL D  88      84.623  41.952 278.434  1.00 23.82           C
ATOM   9127  C   VAL D  88      83.773  43.225 278.267  1.00 24.65           C
ATOM   9128  O   VAL D  88      84.270  44.340 278.420  1.00 25.74           O
ATOM   9129  CB  VAL D  88      85.644  41.738 277.295  1.00 25.51           C
ATOM   9130  CG1 VAL D  88      85.897  43.003 276.478  1.00 25.67           C
ATOM   9131  CG2 VAL D  88      86.925  41.145 277.904  1.00 25.02           C
ATOM   9132  N   ILE D  89      82.476  43.050 278.015  1.00 24.74           N
ATOM   9133  CA  ILE D  89      81.559  44.154 277.785  1.00 22.99           C
```

Appendix 2

```
ATOM   9134  C    ILE D  89      81.609  45.135 278.920  1.00 21.93           C
ATOM   9135  O    ILE D  89      81.550  46.350 278.702  1.00 22.38           O
ATOM   9136  CB   ILE D  89      80.105  43.670 277.637  1.00 23.42           C
ATOM   9137  CG1  ILE D  89      79.933  42.827 276.390  1.00 22.29           C
ATOM   9138  CG2  ILE D  89      79.166  44.854 277.492  1.00 24.62           C
ATOM   9139  CD1  ILE D  89      78.721  41.949 276.450  1.00 22.98           C
ATOM   9140  N    LYS D  90      81.715  44.618 280.132  1.00 21.17           N
ATOM   9141  CA   LYS D  90      81.826  45.478 281.305  1.00 20.81           C
ATOM   9142  C    LYS D  90      83.044  46.412 281.281  1.00 21.33           C
ATOM   9143  O    LYS D  90      82.937  47.555 281.741  1.00 21.12           O
ATOM   9144  CB   LYS D  90      81.800  44.654 282.601  1.00 20.58           C
ATOM   9145  CG   LYS D  90      82.961  43.697 282.832  1.00 19.75           C
ATOM   9146  CD   LYS D  90      82.784  42.962 284.153  1.00 19.76           C
ATOM   9147  CE   LYS D  90      81.643  41.942 284.141  1.00 20.21           C
ATOM   9148  NZ   LYS D  90      81.885  40.798 283.191  1.00 20.26           N
ATOM   9149  N    TYR D  91      84.175  45.958 280.740  1.00 21.20           N
ATOM   9150  CA   TYR D  91      85.375  46.780 280.729  1.00 22.48           C
ATOM   9151  C    TYR D  91      85.263  47.811 279.622  1.00 21.28           C
ATOM   9152  O    TYR D  91      85.664  48.964 279.795  1.00 21.01           O
ATOM   9153  CB   TYR D  91      86.635  45.923 280.559  1.00 26.00           C
ATOM   9154  CG   TYR D  91      86.735  44.828 281.595  1.00 29.07           C
ATOM   9155  CD1  TYR D  91      86.793  45.137 282.949  1.00 32.22           C
ATOM   9156  CD2  TYR D  91      86.737  43.493 281.231  1.00 30.08           C
ATOM   9157  CE1  TYR D  91      86.859  44.137 283.910  1.00 36.18           C
ATOM   9158  CE2  TYR D  91      86.802  42.486 282.185  1.00 32.83           C
ATOM   9159  CZ   TYR D  91      86.863  42.810 283.516  1.00 34.81           C
ATOM   9160  OH   TYR D  91      86.910  41.822 284.464  1.00 37.43           O
ATOM   9161  N    SER D  92      84.692  47.400 278.491  1.00 20.64           N
ATOM   9162  CA   SER D  92      84.438  48.303 277.362  1.00 20.10           C
ATOM   9163  C    SER D  92      83.623  49.515 277.790  1.00 20.06           C
ATOM   9164  O    SER D  92      84.000  50.662 277.567  1.00 19.87           O
ATOM   9165  CB   SER D  92      83.690  47.575 276.254  1.00 19.16           C
ATOM   9166  OG   SER D  92      83.066  48.500 275.381  1.00 19.03           O
ATOM   9167  N    ILE D  93      82.506  49.232 278.441  1.00 21.02           N
ATOM   9168  CA   ILE D  93      81.607  50.272 278.908  1.00 20.86           C
ATOM   9169  C    ILE D  93      82.342  51.151 279.868  1.00 21.50           C
ATOM   9170  O    ILE D  93      82.295  52.372 279.738  1.00 25.75           O
ATOM   9171  CB   ILE D  93      80.355  49.691 279.600  1.00 20.25           C
ATOM   9172  CG1  ILE D  93      79.490  48.977 278.566  1.00 19.52           C
ATOM   9173  CG2  ILE D  93      79.559  50.802 280.272  1.00 20.65           C
ATOM   9174  CD1  ILE D  93      78.361  48.164 279.157  1.00 19.69           C
ATOM   9175  N    ALA D  94      83.026  50.540 280.827  1.00 20.79           N
ATOM   9176  CA   ALA D  94      83.784  51.285 281.807  1.00 20.80           C
ATOM   9177  C    ALA D  94      84.849  52.163 281.139  1.00 21.97           C
ATOM   9178  O    ALA D  94      84.881  53.371 281.380  1.00 22.45           O
ATOM   9179  CB   ALA D  94      84.425  50.341 282.807  1.00 20.79           C
ATOM   9180  N    PHE D  95      85.711  51.606 280.293  1.00 21.51           N
ATOM   9181  CA   PHE D  95      86.721  52.485 279.680  1.00 23.31           C
ATOM   9182  C    PHE D  95      86.119  53.614 278.776  1.00 24.27           C
ATOM   9183  O    PHE D  95      86.603  54.746 278.793  1.00 23.35           O
ATOM   9184  CB   PHE D  95      87.843  51.680 279.012  1.00 22.87           C
ATOM   9185  CG   PHE D  95      88.567  50.790 279.981  1.00 23.58           C
ATOM   9186  CD1  PHE D  95      89.164  51.327 281.115  1.00 24.94           C
ATOM   9187  CD2  PHE D  95      88.620  49.428 279.792  1.00 23.42           C
```

Appendix 2

```
ATOM   9188  CE1 PHE D  95      89.809  50.520 282.030  1.00 25.58           C
ATOM   9189  CE2 PHE D  95      89.236  48.607 280.708  1.00 23.78           C
ATOM   9190  CZ  PHE D  95      89.836  49.144 281.829  1.00 25.00           C
ATOM   9191  N   TYR D  96      85.035  53.336 278.052  1.00 23.93           N
ATOM   9192  CA  TYR D  96      84.308  54.423 277.419  1.00 24.30           C
ATOM   9193  C   TYR D  96      83.913  55.460 278.490  1.00 25.62           C
ATOM   9194  O   TYR D  96      84.056  56.657 278.282  1.00 26.76           O
ATOM   9195  CB  TYR D  96      83.035  53.937 276.737  1.00 23.62           C
ATOM   9196  CG  TYR D  96      83.179  53.294 275.392  1.00 22.43           C
ATOM   9197  CD1 TYR D  96      83.930  53.878 274.387  1.00 22.58           C
ATOM   9198  CD2 TYR D  96      82.471  52.141 275.093  1.00 22.62           C
ATOM   9199  CE1 TYR D  96      84.034  53.283 273.134  1.00 23.64           C
ATOM   9200  CE2 TYR D  96      82.550  51.544 273.844  1.00 23.33           C
ATOM   9201  CZ  TYR D  96      83.338  52.107 272.865  1.00 23.73           C
ATOM   9202  OH  TYR D  96      83.414  51.496 271.635  1.00 23.78           O
ATOM   9203  N   ALA D  97      83.408  55.001 279.630  1.00 24.76           N
ATOM   9204  CA  ALA D  97      82.967  55.926 280.665  1.00 24.39           C
ATOM   9205  C   ALA D  97      84.110  56.814 281.179  1.00 23.95           C
ATOM   9206  O   ALA D  97      83.936  58.035 281.275  1.00 24.75           O
ATOM   9207  CB  ALA D  97      82.276  55.190 281.819  1.00 23.86           C
ATOM   9208  N   TYR D  98      85.275  56.238 281.490  1.00 23.02           N
ATOM   9209  CA  TYR D  98      86.385  57.066 281.992  1.00 21.50           C
ATOM   9210  C   TYR D  98      86.861  58.050 280.936  1.00 21.10           C
ATOM   9211  O   TYR D  98      87.233  59.168 281.273  1.00 22.62           O
ATOM   9212  CB  TYR D  98      87.564  56.239 282.534  1.00 20.74           C
ATOM   9213  CG  TYR D  98      87.141  55.135 283.454  1.00 19.99           C
ATOM   9214  CD1 TYR D  98      86.047  55.295 284.263  1.00 19.93           C
ATOM   9215  CD2 TYR D  98      87.831  53.921 283.500  1.00 19.90           C
ATOM   9216  CE1 TYR D  98      85.633  54.288 285.104  1.00 21.44           C
ATOM   9217  CE2 TYR D  98      87.422  52.892 284.338  1.00 20.28           C
ATOM   9218  CZ  TYR D  98      86.312  53.084 285.148  1.00 21.04           C
ATOM   9219  OH  TYR D  98      85.824  52.109 286.014  1.00 20.62           O
ATOM   9220  N   GLY D  99      86.839  57.664 279.666  1.00 20.51           N
ATOM   9221  CA  GLY D  99      87.198  58.607 278.594  1.00 20.80           C
ATOM   9222  C   GLY D  99      86.258  59.808 278.517  1.00 20.29           C
ATOM   9223  O   GLY D  99      86.665  60.963 278.481  1.00 18.43           O
ATOM   9224  N   LEU D 100      84.972  59.498 278.499  1.00 21.47           N
ATOM   9225  CA  LEU D 100      83.912  60.493 278.494  1.00 21.25           C
ATOM   9226  C   LEU D 100      84.075  61.510 279.635  1.00 21.21           C
ATOM   9227  O   LEU D 100      83.915  62.708 279.406  1.00 22.47           O
ATOM   9228  CB  LEU D 100      82.555  59.789 278.577  1.00 20.98           C
ATOM   9229  CG  LEU D 100      82.155  59.153 277.259  1.00 21.22           C
ATOM   9230  CD1 LEU D 100      81.152  58.021 277.420  1.00 21.10           C
ATOM   9231  CD2 LEU D 100      81.584  60.247 276.365  1.00 22.44           C
ATOM   9232  N   ALA D 101      84.409  61.046 280.833  1.00 19.99           N
ATOM   9233  CA  ALA D 101      84.657  61.947 281.945  1.00 21.04           C
ATOM   9234  C   ALA D 101      85.757  62.969 281.623  1.00 23.10           C
ATOM   9235  O   ALA D 101      85.643  64.138 282.034  1.00 23.22           O
ATOM   9236  CB  ALA D 101      84.993  61.183 283.222  1.00 20.73           C
ATOM   9237  N   SER D 102      86.795  62.563 280.888  1.00 23.90           N
ATOM   9238  CA  SER D 102      87.860  63.509 280.539  1.00 25.70           C
ATOM   9239  C   SER D 102      87.392  64.457 279.445  1.00 26.99           C
ATOM   9240  O   SER D 102      87.693  65.637 279.491  1.00 29.58           O
ATOM   9241  CB  SER D 102      89.173  62.804 280.143  1.00 26.40           C
```

Appendix 2

```
ATOM   9242  OG  SER D 102      89.767  62.119 281.251  1.00 27.23           O
ATOM   9243  N   VAL D 103      86.635  63.962 278.477  1.00 28.13           N
ATOM   9244  CA  VAL D 103      85.973  64.838 277.490  1.00 28.44           C
ATOM   9245  C   VAL D 103      85.161  65.949 278.154  1.00 29.33           C
ATOM   9246  O   VAL D 103      85.083  67.074 277.646  1.00 29.14           O
ATOM   9247  CB  VAL D 103      85.100  64.014 276.520  1.00 29.48           C
ATOM   9248  CG1 VAL D 103      84.159  64.888 275.703  1.00 29.18           C
ATOM   9249  CG2 VAL D 103      85.999  63.234 275.569  1.00 30.60           C
ATOM   9250  N   ALA D 104      84.571  65.648 279.303  1.00 30.29           N
ATOM   9251  CA  ALA D 104      83.827  66.658 280.059  1.00 29.96           C
ATOM   9252  C   ALA D 104      84.715  67.771 280.586  1.00 28.80           C
ATOM   9253  O   ALA D 104      84.315  68.909 280.595  1.00 29.72           O
ATOM   9254  CB  ALA D 104      83.061  66.009 281.201  1.00 29.74           C
ATOM   9255  N   LEU D 105      85.903  67.440 281.061  1.00 30.85           N
ATOM   9256  CA  LEU D 105      86.883  68.464 281.438  1.00 31.98           C
ATOM   9257  C   LEU D 105      87.396  69.245 280.223  1.00 30.41           C
ATOM   9258  O   LEU D 105      87.439  70.444 280.254  1.00 30.42           O
ATOM   9259  CB  LEU D 105      88.070  67.840 282.149  1.00 32.97           C
ATOM   9260  CG  LEU D 105      88.043  67.701 283.662  1.00 35.76           C
ATOM   9261  CD1 LEU D 105      89.449  67.317 284.110  1.00 37.11           C
ATOM   9262  CD2 LEU D 105      87.634  69.001 284.339  1.00 36.05           C
ATOM   9263  N   ILE D 106      87.768  68.550 279.160  1.00 30.29           N
ATOM   9264  CA  ILE D 106      88.318  69.175 277.955  1.00 31.26           C
ATOM   9265  C   ILE D 106      87.465  70.267 277.302  1.00 32.22           C
ATOM   9266  O   ILE D 106      88.009  71.272 276.880  1.00 33.31           O
ATOM   9267  CB  ILE D 106      88.602  68.124 276.869  1.00 32.00           C
ATOM   9268  CG1 ILE D 106      89.781  67.245 277.275  1.00 32.19           C
ATOM   9269  CG2 ILE D 106      88.917  68.787 275.529  1.00 33.93           C
ATOM   9270  CD1 ILE D 106      90.021  66.093 276.320  1.00 31.87           C
ATOM   9271  N   ASP D 107      86.154  70.072 277.180  1.00 32.87           N
ATOM   9272  CA  ASP D 107      85.303  71.025 276.440  1.00 32.91           C
ATOM   9273  C   ASP D 107      83.963  71.248 277.141  1.00 31.81           C
ATOM   9274  O   ASP D 107      83.071  70.397 277.109  1.00 33.29           O
ATOM   9275  CB  ASP D 107      85.079  70.496 275.017  1.00 34.89           C
ATOM   9276  CG  ASP D 107      84.356  71.483 274.111  1.00 37.60           C
ATOM   9277  OD1 ASP D 107      83.825  72.527 274.580  1.00 38.71           O
ATOM   9278  OD2 ASP D 107      84.321  71.188 272.897  1.00 39.39           O
ATOM   9279  N   PRO D 108      83.789  72.407 277.760  1.00 31.67           N
ATOM   9280  CA  PRO D 108      82.519  72.633 278.469  1.00 31.72           C
ATOM   9281  C   PRO D 108      81.277  72.488 277.573  1.00 32.72           C
ATOM   9282  O   PRO D 108      80.207  72.103 278.069  1.00 34.61           O
ATOM   9283  CB  PRO D 108      82.635  74.086 278.974  1.00 30.22           C
ATOM   9284  CG  PRO D 108      84.086  74.413 278.889  1.00 30.33           C
ATOM   9285  CD  PRO D 108      84.682  73.575 277.804  1.00 30.44           C
ATOM   9286  N   LYS D 109      81.413  72.823 276.283  1.00 32.04           N
ATOM   9287  CA  LYS D 109      80.296  72.764 275.335  1.00 31.63           C
ATOM   9288  C   LYS D 109      79.936  71.293 275.053  1.00 32.52           C
ATOM   9289  O   LYS D 109      78.900  71.010 274.460  1.00 33.47           O
ATOM   9290  CB  LYS D 109      80.606  73.558 274.039  1.00 29.14           C
ATOM   9291  N   LEU D 110      80.777  70.359 275.513  1.00 32.93           N
ATOM   9292  CA  LEU D 110      80.512  68.915 275.377  1.00 31.70           C
ATOM   9293  C   LEU D 110      80.146  68.157 276.667  1.00 30.17           C
ATOM   9294  O   LEU D 110      79.866  66.968 276.622  1.00 30.18           O
ATOM   9295  CB  LEU D 110      81.725  68.250 274.735  1.00 31.53           C
```

Appendix 2

```
ATOM   9296  CG   LEU D 110      81.958  68.616 273.273  1.00 31.29           C
ATOM   9297  CD1  LEU D 110      83.127  67.822 272.731  1.00 31.12           C
ATOM   9298  CD2  LEU D 110      80.719  68.314 272.459  1.00 31.92           C
ATOM   9299  N    ARG D 111      80.149  68.836 277.803  1.00 27.83           N
ATOM   9300  CA   ARG D 111      79.907  68.199 279.082  1.00 26.95           C
ATOM   9301  C    ARG D 111      78.499  67.588 279.240  1.00 26.78           C
ATOM   9302  O    ARG D 111      78.336  66.584 279.915  1.00 27.11           O
ATOM   9303  CB   ARG D 111      80.165  69.233 280.185  1.00 26.25           C
ATOM   9304  CG   ARG D 111      79.976  68.726 281.605  1.00 25.68           C
ATOM   9305  CD   ARG D 111      80.698  69.617 282.608  1.00 25.34           C
ATOM   9306  NE   ARG D 111      80.651  69.077 283.961  1.00 26.04           N
ATOM   9307  CZ   ARG D 111      81.386  69.521 284.972  1.00 26.90           C
ATOM   9308  NH1  ARG D 111      82.213  70.519 284.773  1.00 27.90           N
ATOM   9309  NH2  ARG D 111      81.285  68.984 286.187  1.00 26.44           N
ATOM   9310  N    ALA D 112      77.475  68.204 278.659  1.00 27.04           N
ATOM   9311  CA   ALA D 112      76.117  67.672 278.786  1.00 27.37           C
ATOM   9312  C    ALA D 112      76.007  66.393 277.973  1.00 28.30           C
ATOM   9313  O    ALA D 112      75.416  65.413 278.451  1.00 27.05           O
ATOM   9314  CB   ALA D 112      75.072  68.679 278.331  1.00 27.49           C
ATOM   9315  N    LEU D 113      76.581  66.393 276.760  1.00 27.61           N
ATOM   9316  CA   LEU D 113      76.652  65.160 275.972  1.00 28.27           C
ATOM   9317  C    LEU D 113      77.370  64.038 276.730  1.00 28.38           C
ATOM   9318  O    LEU D 113      76.850  62.906 276.862  1.00 29.21           O
ATOM   9319  CB   LEU D 113      77.345  65.361 274.623  1.00 28.40           C
ATOM   9320  CG   LEU D 113      77.420  64.045 273.802  1.00 29.13           C
ATOM   9321  CD1  LEU D 113      76.030  63.611 273.346  1.00 28.27           C
ATOM   9322  CD2  LEU D 113      78.365  64.121 272.600  1.00 29.26           C
ATOM   9323  N    ALA D 114      78.574  64.341 277.197  1.00 26.94           N
ATOM   9324  CA   ALA D 114      79.314  63.416 278.049  1.00 25.59           C
ATOM   9325  C    ALA D 114      78.445  62.928 279.231  1.00 25.07           C
ATOM   9326  O    ALA D 114      78.438  61.739 279.548  1.00 24.29           O
ATOM   9327  CB   ALA D 114      80.596  64.071 278.542  1.00 25.16           C
ATOM   9328  N    GLY D 115      77.699  63.830 279.865  1.00 24.56           N
ATOM   9329  CA   GLY D 115      76.772  63.431 280.928  1.00 25.08           C
ATOM   9330  C    GLY D 115      75.728  62.387 280.510  1.00 24.19           C
ATOM   9331  O    GLY D 115      75.526  61.352 281.178  1.00 24.84           O
ATOM   9332  N    HIS D 116      75.081  62.676 279.395  1.00 23.02           N
ATOM   9333  CA   HIS D 116      74.075  61.805 278.788  1.00 22.38           C
ATOM   9334  C    HIS D 116      74.695  60.455 278.438  1.00 21.29           C
ATOM   9335  O    HIS D 116      74.100  59.415 278.739  1.00 21.42           O
ATOM   9336  CB   HIS D 116      73.433  62.487 277.542  1.00 21.88           C
ATOM   9337  CG   HIS D 116      72.670  61.552 276.657  1.00 22.17           C
ATOM   9338  ND1  HIS D 116      71.424  61.065 276.990  1.00 22.64           N
ATOM   9339  CD2  HIS D 116      72.985  61.002 275.458  1.00 21.95           C
ATOM   9340  CE1  HIS D 116      71.005  60.252 276.037  1.00 22.89           C
ATOM   9341  NE2  HIS D 116      71.932  60.197 275.096  1.00 22.92           N
ATOM   9342  N    ASP D 117      75.869  60.458 277.813  1.00 19.82           N
ATOM   9343  CA   ASP D 117      76.555  59.201 277.530  1.00 20.13           C
ATOM   9344  C    ASP D 117      76.845  58.389 278.798  1.00 20.46           C
ATOM   9345  O    ASP D 117      76.651  57.153 278.817  1.00 20.87           O
ATOM   9346  CB   ASP D 117      77.844  59.434 276.741  1.00 20.69           C
ATOM   9347  CG   ASP D 117      77.587  59.722 275.268  1.00 21.06           C
ATOM   9348  OD1  ASP D 117      76.399  59.790 274.866  1.00 20.92           O
ATOM   9349  OD2  ASP D 117      78.580  59.873 274.509  1.00 21.86           O
```

Appendix 2

```
ATOM   9350  N    LEU D 118      77.279  59.068 279.861  1.00 20.61           N
ATOM   9351  CA   LEU D 118      77.545  58.398 281.142  1.00 20.58           C
ATOM   9352  C    LEU D 118      76.271  57.855 281.772  1.00 21.53           C
ATOM   9353  O    LEU D 118      76.279  56.802 282.393  1.00 22.11           O
ATOM   9354  CB   LEU D 118      78.233  59.349 282.113  1.00 20.77           C
ATOM   9355  CG   LEU D 118      79.708  59.553 281.749  1.00 21.49           C
ATOM   9356  CD1  LEU D 118      80.269  60.853 282.315  1.00 22.18           C
ATOM   9357  CD2  LEU D 118      80.572  58.364 282.163  1.00 21.40           C
ATOM   9358  N    ASP D 119      75.171  58.579 281.618  1.00 21.31           N
ATOM   9359  CA   ASP D 119      73.884  58.083 282.066  1.00 21.56           C
ATOM   9360  C    ASP D 119      73.657  56.712 281.405  1.00 22.09           C
ATOM   9361  O    ASP D 119      73.454  55.682 282.064  1.00 21.57           O
ATOM   9362  CB   ASP D 119      72.829  59.106 281.670  1.00 22.08           C
ATOM   9363  CG   ASP D 119      71.433  58.738 282.104  1.00 24.40           C
ATOM   9364  OD1  ASP D 119      71.192  58.309 283.247  1.00 24.04           O
ATOM   9365  OD2  ASP D 119      70.541  58.925 281.258  1.00 28.49           O
ATOM   9366  N    ILE D 120      73.764  56.698 280.084  1.00 20.98           N
ATOM   9367  CA   ILE D 120      73.576  55.495 279.334  1.00 20.29           C
ATOM   9368  C    ILE D 120      74.584  54.406 279.783  1.00 20.46           C
ATOM   9369  O    ILE D 120      74.259  53.216 279.851  1.00 19.03           O
ATOM   9370  CB   ILE D 120      73.696  55.824 277.842  1.00 20.73           C
ATOM   9371  CG1  ILE D 120      72.380  56.444 277.348  1.00 20.96           C
ATOM   9372  CG2  ILE D 120      74.028  54.582 277.043  1.00 21.48           C
ATOM   9373  CD1  ILE D 120      72.470  57.015 275.947  1.00 21.05           C
ATOM   9374  N    ALA D 121      75.802  54.821 280.117  1.00 19.66           N
ATOM   9375  CA   ALA D 121      76.838  53.858 280.381  1.00 19.15           C
ATOM   9376  C    ALA D 121      76.526  53.096 281.647  1.00 18.38           C
ATOM   9377  O    ALA D 121      76.720  51.895 281.721  1.00 17.88           O
ATOM   9378  CB   ALA D 121      78.190  54.539 280.466  1.00 19.41           C
ATOM   9379  N    VAL D 122      76.061  53.811 282.653  1.00 18.99           N
ATOM   9380  CA   VAL D 122      75.697  53.212 283.933  1.00 19.47           C
ATOM   9381  C    VAL D 122      74.486  52.292 283.725  1.00 20.94           C
ATOM   9382  O    VAL D 122      74.450  51.201 284.299  1.00 22.43           O
ATOM   9383  CB   VAL D 122      75.350  54.293 284.984  1.00 19.03           C
ATOM   9384  CG1  VAL D 122      74.655  53.700 286.195  1.00 19.34           C
ATOM   9385  CG2  VAL D 122      76.578  55.073 285.390  1.00 18.71           C
ATOM   9386  N    SER D 123      73.512  52.712 282.911  1.00 21.56           N
ATOM   9387  CA   SER D 123      72.309  51.907 282.731  1.00 23.74           C
ATOM   9388  C    SER D 123      72.607  50.606 282.043  1.00 23.37           C
ATOM   9389  O    SER D 123      72.115  49.573 282.466  1.00 23.71           O
ATOM   9390  CB   SER D 123      71.266  52.634 281.938  1.00 25.19           C
ATOM   9391  OG   SER D 123      71.136  53.884 282.527  1.00 29.90           O
ATOM   9392  N    LYS D 124      73.406  50.662 280.993  1.00 22.74           N
ATOM   9393  CA   LYS D 124      73.840  49.461 280.318  1.00 23.35           C
ATOM   9394  C    LYS D 124      74.663  48.589 281.235  1.00 24.23           C
ATOM   9395  O    LYS D 124      74.558  47.364 281.166  1.00 25.54           O
ATOM   9396  CB   LYS D 124      74.620  49.792 279.044  1.00 23.52           C
ATOM   9397  CG   LYS D 124      73.702  50.204 277.912  1.00 24.33           C
ATOM   9398  CD   LYS D 124      74.409  50.317 276.584  1.00 24.82           C
ATOM   9399  CE   LYS D 124      73.506  50.939 275.546  1.00 26.13           C
ATOM   9400  NZ   LYS D 124      72.141  50.342 275.557  1.00 27.26           N
ATOM   9401  N    MET D 125      75.463  49.200 282.105  1.00 24.69           N
ATOM   9402  CA   MET D 125      76.326  48.420 283.011  1.00 25.49           C
ATOM   9403  C    MET D 125      75.495  47.509 283.934  1.00 25.26           C
```

Appendix 2

```
ATOM   9404  O   MET D 125      75.873  46.369 284.248  1.00 23.46           O
ATOM   9405  CB  MET D 125      77.191  49.354 283.844  1.00 24.82           C
ATOM   9406  CG  MET D 125      78.332  48.660 284.580  1.00 24.83           C
ATOM   9407  SD  MET D 125      79.693  48.141 283.522  1.00 23.09           S
ATOM   9408  CE  MET D 125      80.927  47.791 284.744  1.00 23.77           C
ATOM   9409  N   LYS D 126      74.350  48.037 284.344  1.00 25.98           N
ATOM   9410  CA  LYS D 126      73.423  47.333 285.212  1.00 25.48           C
ATOM   9411  C   LYS D 126      72.720  46.161 284.506  1.00 25.75           C
ATOM   9412  O   LYS D 126      72.257  45.265 285.187  1.00 24.29           O
ATOM   9413  CB  LYS D 126      72.410  48.328 285.809  1.00 25.12           C
ATOM   9414  CG  LYS D 126      72.808  48.863 287.188  1.00 25.49           C
ATOM   9415  CD  LYS D 126      72.795  50.379 287.340  1.00 25.49           C
ATOM   9416  CE  LYS D 126      71.420  51.006 287.232  1.00 25.54           C
ATOM   9417  NZ  LYS D 126      70.527  50.553 288.319  1.00 26.32           N
ATOM   9418  N   CYS D 127      72.678  46.137 283.168  1.00 25.17           N
ATOM   9419  CA  CYS D 127      71.981  45.045 282.438  1.00 26.07           C
ATOM   9420  C   CYS D 127      72.612  43.665 282.648  1.00 25.57           C
ATOM   9421  O   CYS D 127      73.825  43.536 282.784  1.00 25.09           O
ATOM   9422  CB  CYS D 127      71.961  45.303 280.938  1.00 26.10           C
ATOM   9423  SG  CYS D 127      71.047  46.769 280.447  1.00 27.22           S
ATOM   9424  N   LYS D 128      71.780  42.634 282.622  1.00 24.47           N
ATOM   9425  CA  LYS D 128      72.216  41.303 282.980  1.00 25.16           C
ATOM   9426  C   LYS D 128      73.209  40.714 281.966  1.00 23.71           C
ATOM   9427  O   LYS D 128      74.037  39.899 282.309  1.00 21.91           O
ATOM   9428  CB  LYS D 128      71.002  40.378 283.184  1.00 27.25           C
ATOM   9429  CG  LYS D 128      71.370  38.905 283.367  1.00 29.85           C
ATOM   9430  CD  LYS D 128      70.367  38.121 284.179  1.00 31.23           C
ATOM   9431  CE  LYS D 128      70.827  36.678 284.303  1.00 32.09           C
ATOM   9432  NZ  LYS D 128      69.946  35.891 285.210  1.00 32.77           N
ATOM   9433  N   ARG D 129      73.134  41.138 280.719  1.00 23.79           N
ATOM   9434  CA  ARG D 129      74.060  40.658 279.696  1.00 23.19           C
ATOM   9435  C   ARG D 129      75.467  40.997 280.117  1.00 22.63           C
ATOM   9436  O   ARG D 129      76.435  40.290 279.822  1.00 23.90           O
ATOM   9437  CB  ARG D 129      73.702  41.319 278.360  1.00 23.88           C
ATOM   9438  CG  ARG D 129      74.595  41.028 277.173  1.00 23.82           C
ATOM   9439  CD  ARG D 129      74.851  39.551 276.918  1.00 23.94           C
ATOM   9440  NE  ARG D 129      75.765  39.434 275.783  1.00 25.32           N
ATOM   9441  CZ  ARG D 129      76.293  38.296 275.332  1.00 25.51           C
ATOM   9442  NH1 ARG D 129      76.009  37.131 275.904  1.00 25.28           N
ATOM   9443  NH2 ARG D 129      77.122  38.336 274.299  1.00 25.58           N
ATOM   9444  N   VAL D 130      75.572  42.086 280.848  1.00 22.88           N
ATOM   9445  CA  VAL D 130      76.854  42.614 281.249  1.00 23.09           C
ATOM   9446  C   VAL D 130      77.392  41.836 282.433  1.00 23.55           C
ATOM   9447  O   VAL D 130      78.509  41.328 282.367  1.00 25.97           O
ATOM   9448  CB  VAL D 130      76.716  44.117 281.549  1.00 22.95           C
ATOM   9449  CG1 VAL D 130      77.967  44.680 282.204  1.00 23.17           C
ATOM   9450  CG2 VAL D 130      76.347  44.866 280.259  1.00 23.27           C
ATOM   9451  N   TRP D 131      76.606  41.730 283.503  1.00 23.31           N
ATOM   9452  CA  TRP D 131      77.058  41.054 284.715  1.00 24.33           C
ATOM   9453  C   TRP D 131      76.745  39.530 284.792  1.00 24.24           C
ATOM   9454  O   TRP D 131      77.260  38.830 285.666  1.00 25.11           O
ATOM   9455  CB  TRP D 131      76.514  41.774 285.954  1.00 24.31           C
ATOM   9456  CG  TRP D 131      74.983  41.823 286.084  1.00 25.31           C
ATOM   9457  CD1 TRP D 131      74.178  42.873 285.760  1.00 25.50           C
```

Appendix 2

```
ATOM   9458  CD2 TRP D 131      74.116  40.814 286.631  1.00 24.52           C
ATOM   9459  NE1 TRP D 131      72.874  42.574 286.045  1.00 25.68           N
ATOM   9460  CE2 TRP D 131      72.803  41.324 286.589  1.00 24.65           C
ATOM   9461  CE3 TRP D 131      74.321  39.533 287.153  1.00 24.46           C
ATOM   9462  CZ2 TRP D 131      71.684  40.588 287.026  1.00 24.42           C
ATOM   9463  CZ3 TRP D 131      73.197  38.795 287.604  1.00 24.02           C
ATOM   9464  CH2 TRP D 131      71.904  39.333 287.533  1.00 23.60           C
ATOM   9465  N   GLY D 132      75.918  39.040 283.879  1.00 23.77           N
ATOM   9466  CA  GLY D 132      75.391  37.675 283.905  1.00 23.87           C
ATOM   9467  C   GLY D 132      76.385  36.546 284.091  1.00 23.57           C
ATOM   9468  O   GLY D 132      76.034  35.550 284.720  1.00 24.21           O
ATOM   9469  N   ASP D 133      77.605  36.687 283.558  1.00 21.96           N
ATOM   9470  CA  ASP D 133      78.648  35.691 283.754  1.00 22.20           C
ATOM   9471  C   ASP D 133      78.777  35.287 285.209  1.00 22.39           C
ATOM   9472  O   ASP D 133      78.995  34.121 285.503  1.00 22.73           O
ATOM   9473  CB  ASP D 133      80.011  36.176 283.245  1.00 24.05           C
ATOM   9474  CG  ASP D 133      80.510  37.428 283.960  1.00 23.58           C
ATOM   9475  OD1 ASP D 133      80.130  38.537 283.521  1.00 23.96           O
ATOM   9476  OD2 ASP D 133      81.276  37.302 284.946  1.00 23.92           O
ATOM   9477  N   TRP D 134      78.610  36.238 286.122  1.00 22.21           N
ATOM   9478  CA  TRP D 134      78.690  35.950 287.546  1.00 22.70           C
ATOM   9479  C   TRP D 134      77.779  34.813 287.986  1.00 23.63           C
ATOM   9480  O   TRP D 134      78.195  33.939 288.754  1.00 24.82           O
ATOM   9481  CB  TRP D 134      78.355  37.203 288.357  1.00 22.16           C
ATOM   9482  CG  TRP D 134      78.523  37.018 289.874  1.00 21.85           C
ATOM   9483  CD1 TRP D 134      77.521  36.919 290.819  1.00 21.59           C
ATOM   9484  CD2 TRP D 134      79.754  36.913 290.594  1.00 20.65           C
ATOM   9485  NE1 TRP D 134      78.059  36.761 292.093  1.00 21.22           N
ATOM   9486  CE2 TRP D 134      79.424  36.764 291.977  1.00 20.64           C
ATOM   9487  CE3 TRP D 134      81.100  36.936 290.216  1.00 19.80           C
ATOM   9488  CZ2 TRP D 134      80.392  36.636 292.972  1.00 19.61           C
ATOM   9489  CZ3 TRP D 134      82.074  36.809 291.210  1.00 19.86           C
ATOM   9490  CH2 TRP D 134      81.713  36.666 292.569  1.00 20.05           C
ATOM   9491  N   GLU D 135      76.539  34.844 287.510  1.00 24.48           N
ATOM   9492  CA  GLU D 135      75.546  33.830 287.842  1.00 26.46           C
ATOM   9493  C   GLU D 135      75.750  32.569 287.028  1.00 25.61           C
ATOM   9494  O   GLU D 135      75.667  31.460 287.551  1.00 24.54           O
ATOM   9495  CB  GLU D 135      74.136  34.363 287.568  1.00 28.71           C
ATOM   9496  CG  GLU D 135      73.019  33.445 288.059  1.00 29.45           C
ATOM   9497  CD  GLU D 135      71.649  33.955 287.692  1.00 29.27           C
ATOM   9498  OE1 GLU D 135      71.301  35.094 288.024  1.00 29.21           O
ATOM   9499  OE2 GLU D 135      70.919  33.209 287.054  1.00 31.80           O
ATOM   9500  N   GLU D 136      76.011  32.758 285.742  1.00 25.30           N
ATOM   9501  CA  GLU D 136      76.263  31.664 284.841  1.00 26.15           C
ATOM   9502  C   GLU D 136      77.398  30.753 285.329  1.00 23.40           C
ATOM   9503  O   GLU D 136      77.355  29.555 285.093  1.00 21.21           O
ATOM   9504  CB  GLU D 136      76.586  32.233 283.473  1.00 29.75           C
ATOM   9505  CG  GLU D 136      76.285  31.311 282.306  1.00 34.41           C
ATOM   9506  CD  GLU D 136      76.184  32.106 281.010  1.00 38.70           C
ATOM   9507  OE1 GLU D 136      75.389  33.080 281.000  1.00 37.75           O
ATOM   9508  OE2 GLU D 136      76.891  31.769 280.014  1.00 41.56           O
ATOM   9509  N   ASP D 137      78.393  31.333 286.008  1.00 22.43           N
ATOM   9510  CA  ASP D 137      79.592  30.609 286.478  1.00 22.96           C
ATOM   9511  C   ASP D 137      79.371  29.899 287.819  1.00 22.80           C
```

Appendix 2

```
ATOM   9512  O    ASP D 137      80.221  29.144 288.268  1.00 21.12           O
ATOM   9513  CB   ASP D 137      80.813  31.556 286.585  1.00 23.44           C
ATOM   9514  CG   ASP D 137      81.392  31.967 285.210  1.00 24.58           C
ATOM   9515  OD1  ASP D 137      81.021  31.399 284.162  1.00 25.16           O
ATOM   9516  OD2  ASP D 137      82.239  32.881 285.156  1.00 25.84           O
ATOM   9517  N    GLY D 138      78.224  30.148 288.448  1.00 23.85           N
ATOM   9518  CA   GLY D 138      77.836  29.487 289.701  1.00 22.93           C
ATOM   9519  C    GLY D 138      78.108  30.316 290.953  1.00 22.74           C
ATOM   9520  O    GLY D 138      77.982  29.821 292.043  1.00 23.86           O
ATOM   9521  N    PHE D 139      78.454  31.586 290.826  1.00 22.05           N
ATOM   9522  CA   PHE D 139      78.894  32.330 292.001  1.00 22.43           C
ATOM   9523  C    PHE D 139      77.817  33.113 292.778  1.00 22.63           C
ATOM   9524  O    PHE D 139      78.101  33.640 293.846  1.00 23.37           O
ATOM   9525  CB   PHE D 139      79.988  33.319 291.617  1.00 22.13           C
ATOM   9526  CG   PHE D 139      81.218  32.699 291.005  1.00 21.65           C
ATOM   9527  CD1  PHE D 139      81.867  31.636 291.612  1.00 21.86           C
ATOM   9528  CD2  PHE D 139      81.784  33.253 289.849  1.00 21.82           C
ATOM   9529  CE1  PHE D 139      83.044  31.116 291.070  1.00 22.16           C
ATOM   9530  CE2  PHE D 139      82.950  32.733 289.297  1.00 22.13           C
ATOM   9531  CZ   PHE D 139      83.584  31.662 289.914  1.00 22.06           C
ATOM   9532  N    GLY D 140      76.608  33.231 292.256  1.00 22.35           N
ATOM   9533  CA   GLY D 140      75.570  33.967 292.961  1.00 22.45           C
ATOM   9534  C    GLY D 140      74.612  34.636 292.010  1.00 22.75           C
ATOM   9535  O    GLY D 140      74.958  34.874 290.862  1.00 23.30           O
ATOM   9536  N    THR D 141      73.401  34.919 292.487  1.00 22.45           N
ATOM   9537  CA   THR D 141      72.371  35.537 291.657  1.00 21.91           C
ATOM   9538  C    THR D 141      72.459  37.058 291.684  1.00 21.87           C
ATOM   9539  O    THR D 141      71.835  37.717 290.871  1.00 20.62           O
ATOM   9540  CB   THR D 141      70.928  35.099 292.058  1.00 22.59           C
ATOM   9541  OG1  THR D 141      70.491  35.789 293.240  1.00 22.15           O
ATOM   9542  CG2  THR D 141      70.824  33.588 292.257  1.00 22.47           C
ATOM   9543  N    ASP D 142      73.253  37.603 292.607  1.00 23.63           N
ATOM   9544  CA   ASP D 142      73.399  39.052 292.798  1.00 24.63           C
ATOM   9545  C    ASP D 142      74.861  39.498 292.511  1.00 23.54           C
ATOM   9546  O    ASP D 142      75.787  39.096 293.197  1.00 22.38           O
ATOM   9547  CB   ASP D 142      72.985  39.403 294.240  1.00 25.99           C
ATOM   9548  CG   ASP D 142      73.038  40.898 294.535  1.00 27.81           C
ATOM   9549  OD1  ASP D 142      73.952  41.580 294.056  1.00 28.48           O
ATOM   9550  OD2  ASP D 142      72.172  41.390 295.289  1.00 31.98           O
ATOM   9551  N    PRO D 143      75.066  40.364 291.517  1.00 23.08           N
ATOM   9552  CA   PRO D 143      76.442  40.670 291.142  1.00 23.78           C
ATOM   9553  C    PRO D 143      77.183  41.630 292.096  1.00 24.33           C
ATOM   9554  O    PRO D 143      78.387  41.803 291.962  1.00 25.32           O
ATOM   9555  CB   PRO D 143      76.263  41.318 289.769  1.00 23.30           C
ATOM   9556  CG   PRO D 143      74.988  42.091 289.941  1.00 23.73           C
ATOM   9557  CD   PRO D 143      74.104  41.172 290.746  1.00 23.42           C
ATOM   9558  N    ILE D 144      76.485  42.275 293.023  1.00 25.24           N
ATOM   9559  CA   ILE D 144      77.137  43.231 293.924  1.00 26.03           C
ATOM   9560  C    ILE D 144      77.242  42.757 295.385  1.00 27.19           C
ATOM   9561  O    ILE D 144      78.143  43.170 296.105  1.00 28.14           O
ATOM   9562  CB   ILE D 144      76.466  44.638 293.848  1.00 26.04           C
ATOM   9563  CG1  ILE D 144      75.081  44.656 294.526  1.00 24.59           C
ATOM   9564  CG2  ILE D 144      76.395  45.128 292.397  1.00 24.36           C
ATOM   9565  CD1  ILE D 144      74.582  46.068 294.761  1.00 24.85           C
```

Appendix 2

```
ATOM   9566  N    GLU D 145      76.333  41.883 295.810  1.00 29.63           N
ATOM   9567  CA   GLU D 145      76.254  41.427 297.207  1.00 31.52           C
ATOM   9568  C    GLU D 145      77.637  41.166 297.791  1.00 28.98           C
ATOM   9569  O    GLU D 145      77.941  41.599 298.882  1.00 28.38           O
ATOM   9570  CB   GLU D 145      75.365  40.170 297.284  1.00 35.43           C
ATOM   9571  CG   GLU D 145      75.159  39.541 298.659  1.00 37.69           C
ATOM   9572  CD   GLU D 145      74.502  38.170 298.561  1.00 40.40           C
ATOM   9573  OE1  GLU D 145      73.517  38.044 297.800  1.00 38.68           O
ATOM   9574  OE2  GLU D 145      74.976  37.220 299.239  1.00 41.72           O
ATOM   9575  N    LYS D 146      78.485  40.467 297.059  1.00 30.44           N
ATOM   9576  CA   LYS D 146      79.848  40.207 297.547  1.00 31.35           C
ATOM   9577  C    LYS D 146      80.815  39.840 296.451  1.00 29.05           C
ATOM   9578  O    LYS D 146      80.421  39.356 295.407  1.00 27.19           O
ATOM   9579  CB   LYS D 146      79.864  39.092 298.591  1.00 32.81           C
ATOM   9580  CG   LYS D 146      79.253  37.782 298.113  1.00 35.70           C
ATOM   9581  CD   LYS D 146      79.562  36.624 299.060  1.00 37.74           C
ATOM   9582  CE   LYS D 146      78.586  35.462 298.867  1.00 39.27           C
ATOM   9583  NZ   LYS D 146      78.564  34.949 297.461  1.00 39.20           N
ATOM   9584  N    GLU D 147      82.097  40.069 296.722  1.00 29.48           N
ATOM   9585  CA   GLU D 147      83.171  39.704 295.807  1.00 27.06           C
ATOM   9586  C    GLU D 147      82.871  40.390 294.474  1.00 24.53           C
ATOM   9587  O    GLU D 147      82.289  41.457 294.457  1.00 23.24           O
ATOM   9588  CB   GLU D 147      83.263  38.174 295.700  1.00 27.51           C
ATOM   9589  CG   GLU D 147      83.186  37.449 297.051  1.00 28.41           C
ATOM   9590  CD   GLU D 147      82.973  35.926 296.981  1.00 29.04           C
ATOM   9591  OE1  GLU D 147      82.457  35.379 295.980  1.00 29.81           O
ATOM   9592  OE2  GLU D 147      83.322  35.255 297.965  1.00 28.81           O
ATOM   9593  N    ASN D 148      83.275  39.791 293.370  1.00 23.82           N
ATOM   9594  CA   ASN D 148      83.035  40.352 292.045  1.00 24.13           C
ATOM   9595  C    ASN D 148      83.503  41.805 291.898  1.00 25.59           C
ATOM   9596  O    ASN D 148      82.835  42.616 291.231  1.00 24.77           O
ATOM   9597  CB   ASN D 148      81.554  40.242 291.689  1.00 22.54           C
ATOM   9598  CG   ASN D 148      81.290  40.321 290.196  1.00 22.36           C
ATOM   9599  OD1  ASN D 148      82.165  40.052 289.359  1.00 22.24           O
ATOM   9600  ND2  ASN D 148      80.055  40.658 289.849  1.00 22.16           N
ATOM   9601  N    ILE D 149      84.648  42.136 292.500  1.00 25.92           N
ATOM   9602  CA   ILE D 149      85.102  43.535 292.460  1.00 25.45           C
ATOM   9603  C    ILE D 149      85.384  43.983 291.020  1.00 25.00           C
ATOM   9604  O    ILE D 149      85.277  45.173 290.713  1.00 24.05           O
ATOM   9605  CB   ILE D 149      86.302  43.827 293.399  1.00 24.46           C
ATOM   9606  CG1  ILE D 149      86.392  45.324 293.738  1.00 25.07           C
ATOM   9607  CG2  ILE D 149      87.602  43.381 292.786  1.00 24.17           C
ATOM   9608  CD1  ILE D 149      85.131  45.919 294.355  1.00 25.08           C
ATOM   9609  N    MET D 150      85.712  43.027 290.145  1.00 25.00           N
ATOM   9610  CA   MET D 150      85.896  43.322 288.732  1.00 25.31           C
ATOM   9611  C    MET D 150      84.692  44.036 288.180  1.00 24.72           C
ATOM   9612  O    MET D 150      84.854  45.015 287.491  1.00 26.57           O
ATOM   9613  CB   MET D 150      86.142  42.066 287.889  1.00 27.58           C
ATOM   9614  CG   MET D 150      85.193  40.891 288.105  1.00 28.00           C
ATOM   9615  SD   MET D 150      85.642  39.492 287.040  1.00 30.45           S
ATOM   9616  CE   MET D 150      84.540  38.227 287.701  1.00 30.66           C
ATOM   9617  N    TYR D 151      83.486  43.569 288.477  1.00 23.25           N
ATOM   9618  CA   TYR D 151      82.304  44.281 288.000  1.00 22.72           C
ATOM   9619  C    TYR D 151      82.017  45.541 288.822  1.00 23.53           C
```

Appendix 2

```
ATOM   9620  O    TYR D 151      81.928  46.653 288.300  1.00 24.08           O
ATOM   9621  CB   TYR D 151      81.092  43.378 288.037  1.00 21.48           C
ATOM   9622  CG   TYR D 151      79.784  44.055 287.708  1.00 20.59           C
ATOM   9623  CD1  TYR D 151      79.561  44.662 286.476  1.00 20.75           C
ATOM   9624  CD2  TYR D 151      78.752  44.074 288.628  1.00 20.56           C
ATOM   9625  CE1  TYR D 151      78.338  45.267 286.177  1.00 19.88           C
ATOM   9626  CE2  TYR D 151      77.532  44.669 288.335  1.00 20.17           C
ATOM   9627  CZ   TYR D 151      77.332  45.264 287.124  1.00 19.81           C
ATOM   9628  OH   TYR D 151      76.099  45.811 286.988  1.00 20.29           O
ATOM   9629  N    LYS D 152      81.849  45.358 290.115  1.00 23.42           N
ATOM   9630  CA   LYS D 152      81.271  46.407 290.916  1.00 23.83           C
ATOM   9631  C    LYS D 152      82.261  47.534 291.234  1.00 23.37           C
ATOM   9632  O    LYS D 152      81.852  48.641 291.574  1.00 23.61           O
ATOM   9633  CB   LYS D 152      80.608  45.827 292.167  1.00 23.00           C
ATOM   9634  CG   LYS D 152      81.559  45.375 293.236  1.00 22.33           C
ATOM   9635  CD   LYS D 152      80.832  44.489 294.225  1.00 21.71           C
ATOM   9636  CE   LYS D 152      81.594  44.384 295.534  1.00 20.97           C
ATOM   9637  NZ   LYS D 152      81.165  43.141 296.217  1.00 21.60           N
ATOM   9638  N    GLY D 153      83.550  47.270 291.109  1.00 23.14           N
ATOM   9639  CA   GLY D 153      84.521  48.345 291.216  1.00 22.59           C
ATOM   9640  C    GLY D 153      84.209  49.355 290.135  1.00 22.79           C
ATOM   9641  O    GLY D 153      84.004  50.552 290.412  1.00 24.53           O
ATOM   9642  N    HIS D 154      84.146  48.859 288.901  1.00 22.13           N
ATOM   9643  CA   HIS D 154      83.874  49.706 287.741  1.00 22.82           C
ATOM   9644  C    HIS D 154      82.549  50.451 287.878  1.00 23.11           C
ATOM   9645  O    HIS D 154      82.477  51.656 287.643  1.00 23.14           O
ATOM   9646  CB   HIS D 154      83.924  48.896 286.434  1.00 22.57           C
ATOM   9647  CG   HIS D 154      85.319  48.549 286.002  1.00 21.76           C
ATOM   9648  ND1  HIS D 154      86.229  49.504 285.612  1.00 21.29           N
ATOM   9649  CD2  HIS D 154      85.971  47.364 285.939  1.00 20.84           C
ATOM   9650  CE1  HIS D 154      87.375  48.919 285.313  1.00 21.28           C
ATOM   9651  NE2  HIS D 154      87.243  47.621 285.500  1.00 20.30           N
ATOM   9652  N    LEU D 155      81.511  49.754 288.308  1.00 23.03           N
ATOM   9653  CA   LEU D 155      80.194  50.392 288.421  1.00 23.41           C
ATOM   9654  C    LEU D 155      80.216  51.554 289.424  1.00 23.82           C
ATOM   9655  O    LEU D 155      79.627  52.621 289.191  1.00 22.52           O
ATOM   9656  CB   LEU D 155      79.148  49.365 288.841  1.00 22.17           C
ATOM   9657  CG   LEU D 155      77.740  49.883 289.063  1.00 23.30           C
ATOM   9658  CD1  LEU D 155      77.185  50.505 287.789  1.00 23.94           C
ATOM   9659  CD2  LEU D 155      76.839  48.743 289.533  1.00 24.35           C
ATOM   9660  N    ASN D 156      80.906  51.337 290.539  1.00 23.76           N
ATOM   9661  CA   ASN D 156      80.924  52.316 291.591  1.00 24.59           C
ATOM   9662  C    ASN D 156      81.662  53.593 291.151  1.00 24.89           C
ATOM   9663  O    ASN D 156      81.211  54.710 291.429  1.00 25.26           O
ATOM   9664  CB   ASN D 156      81.543  51.716 292.848  1.00 25.63           C
ATOM   9665  CG   ASN D 156      81.127  52.453 294.092  1.00 26.45           C
ATOM   9666  OD1  ASN D 156      79.927  52.631 294.337  1.00 27.17           O
ATOM   9667  ND2  ASN D 156      82.103  52.912 294.876  1.00 25.07           N
ATOM   9668  N    LEU D 157      82.772  53.427 290.436  1.00 23.70           N
ATOM   9669  CA   LEU D 157      83.483  54.568 289.877  1.00 24.07           C
ATOM   9670  C    LEU D 157      82.648  55.306 288.803  1.00 24.28           C
ATOM   9671  O    LEU D 157      82.687  56.541 288.697  1.00 25.13           O
ATOM   9672  CB   LEU D 157      84.813  54.074 289.311  1.00 25.48           C
ATOM   9673  CG   LEU D 157      85.857  55.047 288.773  1.00 26.62           C
```

Appendix 2

```
ATOM   9674  CD1 LEU D 157      86.139  56.201 289.713  1.00 28.20           C
ATOM   9675  CD2 LEU D 157      87.152  54.298 288.510  1.00 27.36           C
ATOM   9676  N   MET D 158      81.885  54.551 288.016  1.00 22.78           N
ATOM   9677  CA  MET D 158      81.028  55.127 286.992  1.00 21.60           C
ATOM   9678  C   MET D 158      79.926  55.942 287.665  1.00 21.95           C
ATOM   9679  O   MET D 158      79.623  57.066 287.264  1.00 21.82           O
ATOM   9680  CB  MET D 158      80.432  54.029 286.104  1.00 20.70           C
ATOM   9681  CG  MET D 158      81.460  53.347 285.206  1.00 20.50           C
ATOM   9682  SD  MET D 158      80.934  51.793 284.442  1.00 19.95           S
ATOM   9683  CE  MET D 158      79.437  52.380 283.669  1.00 20.55           C
ATOM   9684  N   TYR D 159      79.335  55.388 288.707  1.00 22.66           N
ATOM   9685  CA  TYR D 159      78.327  56.121 289.471  1.00 22.99           C
ATOM   9686  C   TYR D 159      78.844  57.493 289.887  1.00 22.25           C
ATOM   9687  O   TYR D 159      78.118  58.487 289.831  1.00 22.21           O
ATOM   9688  CB  TYR D 159      77.965  55.373 290.754  1.00 23.00           C
ATOM   9689  CG  TYR D 159      76.978  54.251 290.661  1.00 21.76           C
ATOM   9690  CD1 TYR D 159      75.960  54.247 289.741  1.00 22.25           C
ATOM   9691  CD2 TYR D 159      77.044  53.204 291.558  1.00 22.80           C
ATOM   9692  CE1 TYR D 159      75.012  53.221 289.718  1.00 22.32           C
ATOM   9693  CE2 TYR D 159      76.117  52.178 291.552  1.00 22.88           C
ATOM   9694  CZ  TYR D 159      75.090  52.191 290.642  1.00 22.17           C
ATOM   9695  OH  TYR D 159      74.177  51.160 290.640  1.00 22.01           O
ATOM   9696  N   GLY D 160      80.081  57.538 290.338  1.00 21.85           N
ATOM   9697  CA  GLY D 160      80.637  58.785 290.847  1.00 22.33           C
ATOM   9698  C   GLY D 160      81.010  59.781 289.762  1.00 21.85           C
ATOM   9699  O   GLY D 160      80.736  60.987 289.868  1.00 21.28           O
ATOM   9700  N   LEU D 161      81.649  59.281 288.721  1.00 21.39           N
ATOM   9701  CA  LEU D 161      82.060  60.140 287.634  1.00 22.37           C
ATOM   9702  C   LEU D 161      80.819  60.722 286.992  1.00 23.20           C
ATOM   9703  O   LEU D 161      80.793  61.897 286.654  1.00 23.80           O
ATOM   9704  CB  LEU D 161      82.911  59.375 286.599  1.00 22.39           C
ATOM   9705  CG  LEU D 161      84.315  58.941 287.060  1.00 22.07           C
ATOM   9706  CD1 LEU D 161      84.901  57.949 286.074  1.00 22.93           C
ATOM   9707  CD2 LEU D 161      85.264  60.118 287.244  1.00 21.63           C
ATOM   9708  N   TYR D 162      79.774  59.914 286.846  1.00 24.76           N
ATOM   9709  CA  TYR D 162      78.541  60.424 286.272  1.00 26.33           C
ATOM   9710  C   TYR D 162      78.068  61.637 287.088  1.00 28.52           C
ATOM   9711  O   TYR D 162      77.659  62.663 286.519  1.00 30.79           O
ATOM   9712  CB  TYR D 162      77.452  59.339 286.214  1.00 26.62           C
ATOM   9713  CG  TYR D 162      76.067  59.917 286.038  1.00 25.84           C
ATOM   9714  CD1 TYR D 162      75.621  60.307 284.793  1.00 25.53           C
ATOM   9715  CD2 TYR D 162      75.237  60.128 287.121  1.00 25.51           C
ATOM   9716  CE1 TYR D 162      74.373  60.862 284.618  1.00 24.59           C
ATOM   9717  CE2 TYR D 162      73.995  60.702 286.959  1.00 26.26           C
ATOM   9718  CZ  TYR D 162      73.568  61.055 285.695  1.00 25.21           C
ATOM   9719  OH  TYR D 162      72.338  61.627 285.511  1.00 25.93           O
ATOM   9720  N   GLN D 163      78.130  61.515 288.415  1.00 28.56           N
ATOM   9721  CA  GLN D 163      77.642  62.547 289.321  1.00 29.78           C
ATOM   9722  C   GLN D 163      78.593  63.741 289.370  1.00 30.75           C
ATOM   9723  O   GLN D 163      78.138  64.890 289.483  1.00 33.36           O
ATOM   9724  CB  GLN D 163      77.427  61.972 290.720  1.00 30.85           C
ATOM   9725  CG  GLN D 163      76.744  62.923 291.680  1.00 32.14           C
ATOM   9726  CD  GLN D 163      76.100  62.234 292.870  1.00 36.12           C
ATOM   9727  OE1 GLN D 163      75.829  61.017 292.860  1.00 40.82           O
```

Appendix 2

```
ATOM   9728  NE2 GLN D 163     75.829  63.022 293.912  1.00 36.81           N
ATOM   9729  N   LEU D 164     79.901  63.488 289.284  1.00 28.40           N
ATOM   9730  CA  LEU D 164     80.860  64.586 289.137  1.00 26.97           C
ATOM   9731  C   LEU D 164     80.593  65.396 287.882  1.00 26.64           C
ATOM   9732  O   LEU D 164     80.580  66.627 287.937  1.00 27.27           O
ATOM   9733  CB  LEU D 164     82.310  64.089 289.121  1.00 26.66           C
ATOM   9734  CG  LEU D 164     82.883  63.738 290.490  1.00 26.41           C
ATOM   9735  CD1 LEU D 164     84.306  63.239 290.341  1.00 26.07           C
ATOM   9736  CD2 LEU D 164     82.812  64.939 291.430  1.00 26.80           C
ATOM   9737  N   VAL D 165     80.348  64.721 286.764  1.00 25.62           N
ATOM   9738  CA  VAL D 165     80.110  65.438 285.513  1.00 26.92           C
ATOM   9739  C   VAL D 165     78.791  66.235 285.484  1.00 27.29           C
ATOM   9740  O   VAL D 165     78.765  67.409 285.137  1.00 28.46           O
ATOM   9741  CB  VAL D 165     80.138  64.490 284.312  1.00 27.57           C
ATOM   9742  CG1 VAL D 165     79.730  65.229 283.039  1.00 28.01           C
ATOM   9743  CG2 VAL D 165     81.525  63.877 284.149  1.00 27.08           C
ATOM   9744  N   THR D 166     77.710  65.593 285.865  1.00 26.43           N
ATOM   9745  CA  THR D 166     76.388  66.137 285.654  1.00 26.40           C
ATOM   9746  C   THR D 166     75.824  66.906 286.842  1.00 26.73           C
ATOM   9747  O   THR D 166     74.898  67.697 286.688  1.00 26.80           O
ATOM   9748  CB  THR D 166     75.402  64.985 285.395  1.00 25.75           C
ATOM   9749  OG1 THR D 166     75.349  64.129 286.550  1.00 26.07           O
ATOM   9750  CG2 THR D 166     75.838  64.191 284.186  1.00 25.70           C
ATOM   9751  N   GLY D 167     76.323  66.613 288.035  1.00 27.26           N
ATOM   9752  CA  GLY D 167     75.714  67.114 289.258  1.00 26.02           C
ATOM   9753  C   GLY D 167     74.380  66.482 289.537  1.00 25.65           C
ATOM   9754  O   GLY D 167     73.651  66.985 290.360  1.00 26.05           O
ATOM   9755  N   SER D 168     74.065  65.364 288.883  1.00 26.67           N
ATOM   9756  CA  SER D 168     72.780  64.684 289.091  1.00 28.00           C
ATOM   9757  C   SER D 168     72.820  63.592 290.163  1.00 29.62           C
ATOM   9758  O   SER D 168     73.730  62.776 290.186  1.00 30.00           O
ATOM   9759  CB  SER D 168     72.258  64.063 287.799  1.00 27.93           C
ATOM   9760  OG  SER D 168     71.424  62.962 288.107  1.00 28.37           O
ATOM   9761  N   ARG D 169     71.781  63.574 291.000  1.00 31.92           N
ATOM   9762  CA  ARG D 169     71.662  62.678 292.150  1.00 34.69           C
ATOM   9763  C   ARG D 169     70.866  61.398 291.782  1.00 32.27           C
ATOM   9764  O   ARG D 169     70.573  60.567 292.626  1.00 29.26           O
ATOM   9765  CB  ARG D 169     71.017  63.435 293.353  1.00 40.84           C
ATOM   9766  CG  ARG D 169     71.585  64.853 293.594  1.00 46.88           C
ATOM   9767  CD  ARG D 169     71.775  65.262 295.053  1.00 52.71           C
ATOM   9768  NE  ARG D 169     70.514  65.591 295.726  1.00 67.07           N
ATOM   9769  CZ  ARG D 169     70.368  65.822 297.041  1.00 74.78           C
ATOM   9770  NH1 ARG D 169     71.411  65.763 297.869  1.00 77.89           N
ATOM   9771  NH2 ARG D 169     69.162  66.108 297.541  1.00 73.67           N
ATOM   9772  N   ARG D 170     70.534  61.260 290.503  1.00 30.12           N
ATOM   9773  CA  ARG D 170     69.884  60.076 289.959  1.00 30.34           C
ATOM   9774  C   ARG D 170     70.318  58.703 290.500  1.00 30.57           C
ATOM   9775  O   ARG D 170     69.477  57.857 290.750  1.00 31.85           O
ATOM   9776  CB  ARG D 170     70.140  60.069 288.467  1.00 31.33           C
ATOM   9777  CG  ARG D 170     69.451  58.969 287.719  1.00 31.99           C
ATOM   9778  CD  ARG D 170     69.459  59.271 286.235  1.00 33.70           C
ATOM   9779  NE  ARG D 170     69.035  58.086 285.503  1.00 35.37           N
ATOM   9780  CZ  ARG D 170     67.774  57.759 285.275  1.00 35.22           C
ATOM   9781  NH1 ARG D 170     66.783  58.538 285.689  1.00 36.12           N
```

Appendix 2

```
ATOM   9782  NH2 ARG D 170      67.510  56.642 284.625  1.00 36.54           N
ATOM   9783  N   TYR D 171      71.618  58.461 290.629  1.00 30.33           N
ATOM   9784  CA  TYR D 171      72.102  57.139 291.058  1.00 29.79           C
ATOM   9785  C   TYR D 171      72.629  57.164 292.463  1.00 28.99           C
ATOM   9786  O   TYR D 171      73.156  56.166 292.912  1.00 31.91           O
ATOM   9787  CB  TYR D 171      73.198  56.597 290.121  1.00 28.84           C
ATOM   9788  CG  TYR D 171      72.716  56.417 288.700  1.00 28.52           C
ATOM   9789  CD1 TYR D 171      71.841  55.331 288.369  1.00 29.00           C
ATOM   9790  CD2 TYR D 171      73.093  57.305 287.697  1.00 28.15           C
ATOM   9791  CE1 TYR D 171      71.362  55.227 287.068  1.00 28.76           C
ATOM   9792  CE2 TYR D 171      72.632  57.155 286.389  1.00 28.50           C
ATOM   9793  CZ  TYR D 171      71.771  56.116 286.079  1.00 28.84           C
ATOM   9794  OH  TYR D 171      71.312  55.971 284.798  1.00 28.31           O
ATOM   9795  N   GLU D 172      72.470  58.295 293.151  1.00 29.27           N
ATOM   9796  CA  GLU D 172      73.049  58.528 294.483  1.00 27.88           C
ATOM   9797  C   GLU D 172      72.751  57.405 295.483  1.00 29.18           C
ATOM   9798  O   GLU D 172      73.659  56.908 296.145  1.00 29.19           O
ATOM   9799  CB  GLU D 172      72.552  59.863 295.042  1.00 27.67           C
ATOM   9800  CG  GLU D 172      73.360  60.351 296.231  1.00 28.23           C
ATOM   9801  CD  GLU D 172      73.109  61.816 296.543  1.00 27.99           C
ATOM   9802  OE1 GLU D 172      73.870  62.675 296.055  1.00 26.10           O
ATOM   9803  OE2 GLU D 172      72.131  62.115 297.266  1.00 32.43           O
ATOM   9804  N   ALA D 173      71.484  56.994 295.575  1.00 29.22           N
ATOM   9805  CA  ALA D 173      71.085  55.955 296.530  1.00 28.35           C
ATOM   9806  C   ALA D 173      71.893  54.675 296.292  1.00 28.68           C
ATOM   9807  O   ALA D 173      72.406  54.062 297.231  1.00 28.22           O
ATOM   9808  CB  ALA D 173      69.583  55.674 296.445  1.00 25.81           C
ATOM   9809  N   GLU D 174      71.998  54.290 295.026  1.00 28.93           N
ATOM   9810  CA  GLU D 174      72.652  53.051 294.626  1.00 28.94           C
ATOM   9811  C   GLU D 174      74.163  53.188 294.863  1.00 29.73           C
ATOM   9812  O   GLU D 174      74.841  52.249 295.306  1.00 27.78           O
ATOM   9813  CB  GLU D 174      72.365  52.782 293.136  1.00 30.19           C
ATOM   9814  CG  GLU D 174      70.885  52.674 292.787  1.00 31.06           C
ATOM   9815  CD  GLU D 174      70.605  52.560 291.293  1.00 33.00           C
ATOM   9816  OE1 GLU D 174      71.526  52.260 290.496  1.00 31.45           O
ATOM   9817  OE2 GLU D 174      69.426  52.743 290.916  1.00 34.54           O
ATOM   9818  N   HIS D 175      74.667  54.385 294.553  1.00 28.59           N
ATOM   9819  CA  HIS D 175      76.055  54.747 294.781  1.00 28.32           C
ATOM   9820  C   HIS D 175      76.456  54.582 296.225  1.00 26.39           C
ATOM   9821  O   HIS D 175      77.459  53.986 296.511  1.00 27.64           O
ATOM   9822  CB  HIS D 175      76.279  56.198 294.370  1.00 28.26           C
ATOM   9823  CG  HIS D 175      77.714  56.572 294.243  1.00 27.80           C
ATOM   9824  ND1 HIS D 175      78.125  57.877 294.115  1.00 27.59           N
ATOM   9825  CD2 HIS D 175      78.832  55.820 294.220  1.00 27.79           C
ATOM   9826  CE1 HIS D 175      79.437  57.916 294.016  1.00 26.47           C
ATOM   9827  NE2 HIS D 175      79.891  56.682 294.069  1.00 28.23           N
ATOM   9828  N   ALA D 176      75.672  55.134 297.130  1.00 26.79           N
ATOM   9829  CA  ALA D 176      75.967  55.032 298.560  1.00 28.44           C
ATOM   9830  C   ALA D 176      75.913  53.573 298.990  1.00 28.29           C
ATOM   9831  O   ALA D 176      76.793  53.105 299.708  1.00 30.11           O
ATOM   9832  CB  ALA D 176      74.981  55.867 299.387  1.00 27.75           C
ATOM   9833  N   HIS D 177      74.888  52.865 298.524  1.00 26.89           N
ATOM   9834  CA  HIS D 177      74.683  51.467 298.882  1.00 26.47           C
ATOM   9835  C   HIS D 177      75.925  50.656 298.547  1.00 25.98           C
```

Appendix 2

```
ATOM   9836  O    HIS D 177      76.488  49.981 299.417  1.00 26.97           O
ATOM   9837  CB   HIS D 177      73.450  50.897 298.170  1.00 25.85           C
ATOM   9838  CG   HIS D 177      73.221  49.448 298.438  1.00 26.46           C
ATOM   9839  ND1  HIS D 177      72.641  48.990 299.600  1.00 27.66           N
ATOM   9840  CD2  HIS D 177      73.497  48.349 297.697  1.00 26.85           C
ATOM   9841  CE1  HIS D 177      72.569  47.672 299.567  1.00 27.07           C
ATOM   9842  NE2  HIS D 177      73.087  47.258 298.426  1.00 27.32           N
ATOM   9843  N    LEU D 178      76.350  50.753 297.290  1.00 24.04           N
ATOM   9844  CA   LEU D 178      77.506  50.028 296.797  1.00 23.56           C
ATOM   9845  C    LEU D 178      78.811  50.470 297.463  1.00 23.39           C
ATOM   9846  O    LEU D 178      79.640  49.631 297.855  1.00 20.51           O
ATOM   9847  CB   LEU D 178      77.632  50.238 295.297  1.00 23.12           C
ATOM   9848  CG   LEU D 178      78.733  49.448 294.611  1.00 22.58           C
ATOM   9849  CD1  LEU D 178      78.727  48.013 295.092  1.00 22.07           C
ATOM   9850  CD2  LEU D 178      78.528  49.516 293.095  1.00 22.70           C
ATOM   9851  N    THR D 179      78.968  51.790 297.602  1.00 23.05           N
ATOM   9852  CA   THR D 179      80.145  52.344 298.262  1.00 23.31           C
ATOM   9853  C    THR D 179      80.257  51.711 299.647  1.00 23.87           C
ATOM   9854  O    THR D 179      81.322  51.262 300.031  1.00 23.96           O
ATOM   9855  CB   THR D 179      80.104  53.884 298.313  1.00 22.07           C
ATOM   9856  OG1  THR D 179      80.383  54.401 297.012  1.00 19.73           O
ATOM   9857  CG2  THR D 179      81.149  54.396 299.259  1.00 22.86           C
ATOM   9858  N    ARG D 180      79.135  51.618 300.347  1.00 25.55           N
ATOM   9859  CA   ARG D 180      79.071  50.954 301.656  1.00 28.80           C
ATOM   9860  C    ARG D 180      79.327  49.449 301.595  1.00 26.95           C
ATOM   9861  O    ARG D 180      79.838  48.894 302.549  1.00 25.14           O
ATOM   9862  CB   ARG D 180      77.717  51.243 302.360  1.00 33.53           C
ATOM   9863  CG   ARG D 180      77.716  52.500 303.246  1.00 39.49           C
ATOM   9864  CD   ARG D 180      76.380  53.266 303.286  1.00 45.09           C
ATOM   9865  NE   ARG D 180      75.207  52.388 303.126  1.00 51.16           N
ATOM   9866  CZ   ARG D 180      74.036  52.743 302.580  1.00 51.78           C
ATOM   9867  NH1  ARG D 180      73.818  53.979 302.128  1.00 50.23           N
ATOM   9868  NH2  ARG D 180      73.068  51.838 302.474  1.00 51.70           N
ATOM   9869  N    ILE D 181      78.964  48.779 300.504  1.00 27.18           N
ATOM   9870  CA   ILE D 181      79.263  47.349 300.385  1.00 29.03           C
ATOM   9871  C    ILE D 181      80.769  47.108 300.247  1.00 30.08           C
ATOM   9872  O    ILE D 181      81.322  46.159 300.834  1.00 28.75           O
ATOM   9873  CB   ILE D 181      78.523  46.667 299.212  1.00 29.91           C
ATOM   9874  CG1  ILE D 181      77.058  46.462 299.563  1.00 30.03           C
ATOM   9875  CG2  ILE D 181      79.091  45.268 298.920  1.00 30.08           C
ATOM   9876  CD1  ILE D 181      76.260  45.867 298.422  1.00 31.63           C
ATOM   9877  N    ILE D 182      81.408  47.971 299.459  1.00 29.56           N
ATOM   9878  CA   ILE D 182      82.832  47.901 299.225  1.00 28.72           C
ATOM   9879  C    ILE D 182      83.620  48.264 300.482  1.00 28.97           C
ATOM   9880  O    ILE D 182      84.609  47.617 300.763  1.00 31.96           O
ATOM   9881  CB   ILE D 182      83.242  48.817 298.057  1.00 28.11           C
ATOM   9882  CG1  ILE D 182      82.651  48.289 296.754  1.00 26.86           C
ATOM   9883  CG2  ILE D 182      84.762  48.927 297.972  1.00 28.58           C
ATOM   9884  CD1  ILE D 182      82.759  49.261 295.601  1.00 26.79           C
ATOM   9885  N    HIS D 183      83.204  49.298 301.208  1.00 28.79           N
ATOM   9886  CA   HIS D 183      83.754  49.612 302.535  1.00 30.06           C
ATOM   9887  C    HIS D 183      83.616  48.442 303.520  1.00 28.92           C
ATOM   9888  O    HIS D 183      84.564  48.080 304.193  1.00 30.93           O
ATOM   9889  CB   HIS D 183      83.046  50.855 303.106  1.00 33.58           C
```

Appendix 2

```
ATOM   9890  CG  HIS D 183      83.183  51.035 304.594  1.00 35.84           C
ATOM   9891  ND1 HIS D 183      84.280  51.636 305.177  1.00 37.51           N
ATOM   9892  CD2 HIS D 183      82.333  50.747 305.609  1.00 37.41           C
ATOM   9893  CE1 HIS D 183      84.117  51.672 306.491  1.00 39.95           C
ATOM   9894  NE2 HIS D 183      82.939  51.144 306.780  1.00 39.21           N
ATOM   9895  N   ASP D 184      82.438  47.847 303.614  1.00 27.49           N
ATOM   9896  CA  ASP D 184      82.225  46.788 304.604  1.00 27.32           C
ATOM   9897  C   ASP D 184      83.091  45.564 304.280  1.00 25.71           C
ATOM   9898  O   ASP D 184      83.640  44.913 305.169  1.00 25.30           O
ATOM   9899  CB  ASP D 184      80.731  46.388 304.702  1.00 27.31           C
ATOM   9900  CG  ASP D 184      79.832  47.508 305.255  1.00 26.68           C
ATOM   9901  OD1 ASP D 184      80.337  48.565 305.675  1.00 25.63           O
ATOM   9902  OD2 ASP D 184      78.598  47.323 305.264  1.00 26.16           O
ATOM   9903  N   GLU D 185      83.221  45.269 303.001  1.00 24.42           N
ATOM   9904  CA  GLU D 185      83.893  44.062 302.582  1.00 25.17           C
ATOM   9905  C   GLU D 185      85.409  44.167 302.773  1.00 25.29           C
ATOM   9906  O   GLU D 185      86.049  43.192 303.203  1.00 24.22           O
ATOM   9907  CB  GLU D 185      83.529  43.741 301.136  1.00 26.24           C
ATOM   9908  CG  GLU D 185      83.743  42.301 300.738  1.00 27.43           C
ATOM   9909  CD  GLU D 185      83.165  41.977 299.370  1.00 31.27           C
ATOM   9910  OE1 GLU D 185      82.478  42.873 298.773  1.00 29.28           O
ATOM   9911  OE2 GLU D 185      83.414  40.816 298.901  1.00 30.54           O
ATOM   9912  N   ILE D 186      85.971  45.343 302.463  1.00 25.36           N
ATOM   9913  CA  ILE D 186      87.366  45.661 302.797  1.00 25.62           C
ATOM   9914  C   ILE D 186      87.588  45.536 304.314  1.00 25.90           C
ATOM   9915  O   ILE D 186      88.482  44.813 304.793  1.00 25.09           O
ATOM   9916  CB  ILE D 186      87.772  47.076 302.321  1.00 25.25           C
ATOM   9917  CG1 ILE D 186      87.843  47.148 300.780  1.00 25.06           C
ATOM   9918  CG2 ILE D 186      89.119  47.466 302.914  1.00 24.74           C
ATOM   9919  CD1 ILE D 186      87.720  48.556 300.190  1.00 24.76           C
ATOM   9920  N   ALA D 187      86.716  46.193 305.059  1.00 25.74           N
ATOM   9921  CA  ALA D 187      86.786  46.160 306.517  1.00 27.08           C
ATOM   9922  C   ALA D 187      86.812  44.745 307.062  1.00 25.85           C
ATOM   9923  O   ALA D 187      87.337  44.533 308.139  1.00 27.50           O
ATOM   9924  CB  ALA D 187      85.617  46.940 307.131  1.00 27.36           C
ATOM   9925  N   ALA D 188      86.250  43.796 306.318  1.00 25.72           N
ATOM   9926  CA  ALA D 188      86.051  42.409 306.788  1.00 25.94           C
ATOM   9927  C   ALA D 188      87.164  41.452 306.392  1.00 25.62           C
ATOM   9928  O   ALA D 188      87.392  40.484 307.075  1.00 27.64           O
ATOM   9929  CB  ALA D 188      84.693  41.859 306.305  1.00 24.28           C
ATOM   9930  N   ASN D 189      87.848  41.728 305.295  1.00 27.03           N
ATOM   9931  CA  ASN D 189      88.867  40.828 304.751  1.00 26.99           C
ATOM   9932  C   ASN D 189      90.239  40.930 305.469  1.00 26.15           C
ATOM   9933  O   ASN D 189      90.666  42.027 305.757  1.00 25.21           O
ATOM   9934  CB  ASN D 189      89.020  41.156 303.251  1.00 26.95           C
ATOM   9935  CG  ASN D 189      87.947  40.485 302.383  1.00 26.54           C
ATOM   9936  OD1 ASN D 189      87.488  39.388 302.680  1.00 28.11           O
ATOM   9937  ND2 ASN D 189      87.597  41.113 301.285  1.00 26.21           N
ATOM   9938  N   PRO D 190      90.923  39.791 305.768  1.00 27.63           N
ATOM   9939  CA  PRO D 190      92.303  39.788 306.380  1.00 28.35           C
ATOM   9940  C   PRO D 190      93.413  40.403 305.506  1.00 31.10           C
ATOM   9941  O   PRO D 190      94.346  41.046 306.024  1.00 33.84           O
ATOM   9942  CB  PRO D 190      92.625  38.304 306.602  1.00 26.79           C
ATOM   9943  CG  PRO D 190      91.370  37.558 306.379  1.00 26.97           C
```

Appendix 2

```
ATOM   9944  CD  PRO D 190      90.333  38.442 305.729  1.00 27.42           C
ATOM   9945  N   PHE D 191      93.332  40.151 304.202  1.00 29.79           N
ATOM   9946  CA  PHE D 191      94.143  40.853 303.210  1.00 28.81           C
ATOM   9947  C   PHE D 191      93.471  42.193 302.946  1.00 28.24           C
ATOM   9948  O   PHE D 191      92.294  42.356 303.250  1.00 29.57           O
ATOM   9949  CB  PHE D 191      94.199  40.057 301.906  1.00 28.53           C
ATOM   9950  CG  PHE D 191      92.857  39.577 301.446  1.00 27.66           C
ATOM   9951  CD1 PHE D 191      92.326  38.394 301.938  1.00 28.21           C
ATOM   9952  CD2 PHE D 191      92.115  40.325 300.548  1.00 27.84           C
ATOM   9953  CE1 PHE D 191      91.072  37.962 301.532  1.00 30.22           C
ATOM   9954  CE2 PHE D 191      90.863  39.903 300.128  1.00 28.59           C
ATOM   9955  CZ  PHE D 191      90.336  38.717 300.619  1.00 29.77           C
ATOM   9956  N   ALA D 192      94.200  43.135 302.359  1.00 26.37           N
ATOM   9957  CA  ALA D 192      93.636  44.442 302.059  1.00 26.24           C
ATOM   9958  C   ALA D 192      92.948  44.439 300.678  1.00 26.45           C
ATOM   9959  O   ALA D 192      93.617  44.377 299.636  1.00 26.81           O
ATOM   9960  CB  ALA D 192      94.731  45.509 302.129  1.00 25.94           C
ATOM   9961  N   GLY D 193      91.612  44.479 300.662  1.00 25.81           N
ATOM   9962  CA  GLY D 193      90.865  44.639 299.398  1.00 23.43           C
ATOM   9963  C   GLY D 193      89.791  43.597 299.216  1.00 22.59           C
ATOM   9964  O   GLY D 193      89.279  43.075 300.178  1.00 21.51           O
ATOM   9965  N   ILE D 194      89.450  43.286 297.968  1.00 22.35           N
ATOM   9966  CA  ILE D 194      88.311  42.435 297.673  1.00 21.99           C
ATOM   9967  C   ILE D 194      88.648  41.546 296.510  1.00 23.47           C
ATOM   9968  O   ILE D 194      89.326  41.974 295.589  1.00 26.92           O
ATOM   9969  CB  ILE D 194      87.071  43.281 297.295  1.00 21.76           C
ATOM   9970  CG1 ILE D 194      86.827  44.361 298.350  1.00 22.15           C
ATOM   9971  CG2 ILE D 194      85.839  42.401 297.126  1.00 21.79           C
ATOM   9972  CD1 ILE D 194      85.598  45.220 298.157  1.00 22.96           C
ATOM   9973  N   VAL D 195      88.145  40.320 296.520  1.00 24.09           N
ATOM   9974  CA  VAL D 195      88.422  39.380 295.429  1.00 24.31           C
ATOM   9975  C   VAL D 195      87.504  39.622 294.204  1.00 26.72           C
ATOM   9976  O   VAL D 195      86.456  40.303 294.312  1.00 26.21           O
ATOM   9977  CB  VAL D 195      88.280  37.930 295.917  1.00 22.77           C
ATOM   9978  CG1 VAL D 195      89.249  37.634 297.062  1.00 21.84           C
ATOM   9979  CG2 VAL D 195      86.852  37.668 296.354  1.00 23.16           C
ATOM   9980  N   CYS D 196      87.895  39.079 293.042  1.00 27.86           N
ATOM   9981  CA  CYS D 196      87.019  39.083 291.860  1.00 28.72           C
ATOM   9982  C   CYS D 196      86.163  37.824 291.949  1.00 28.39           C
ATOM   9983  O   CYS D 196      85.189  37.788 292.690  1.00 28.56           O
ATOM   9984  CB  CYS D 196      87.817  39.189 290.561  1.00 29.11           C
ATOM   9985  SG  CYS D 196      88.674  40.790 290.272  1.00 32.60           S
ATOM   9986  N   GLU D 197      86.534  36.767 291.249  1.00 31.41           N
ATOM   9987  CA  GLU D 197      86.000  35.422 291.567  1.00 31.17           C
ATOM   9988  C   GLU D 197      86.455  35.022 292.973  1.00 31.45           C
ATOM   9989  O   GLU D 197      87.389  35.621 293.528  1.00 34.20           O
ATOM   9990  CB  GLU D 197      86.473  34.379 290.553  1.00 31.50           C
ATOM   9991  CG  GLU D 197      85.969  34.620 289.127  1.00 31.33           C
ATOM   9992  CD  GLU D 197      86.864  35.544 288.300  1.00 31.79           C
ATOM   9993  OE1 GLU D 197      87.913  36.026 288.821  1.00 27.83           O
ATOM   9994  OE2 GLU D 197      86.510  35.764 287.105  1.00 33.46           O
ATOM   9995  N   PRO D 198      85.784  34.043 293.579  1.00 29.71           N
ATOM   9996  CA  PRO D 198      86.232  33.682 294.919  1.00 29.22           C
ATOM   9997  C   PRO D 198      87.642  33.127 294.885  1.00 29.33           C
```

Appendix 2

```
ATOM   9998  O    PRO D 198      87.995  32.408 293.945  1.00 32.89           O
ATOM   9999  CB   PRO D 198      85.223  32.619 295.379  1.00 29.28           C
ATOM  10000  CG   PRO D 198      84.231  32.462 294.276  1.00 30.25           C
ATOM  10001  CD   PRO D 198      84.427  33.571 293.289  1.00 30.25           C
ATOM  10002  N    ASP D 199      88.428  33.468 295.893  1.00 28.14           N
ATOM  10003  CA   ASP D 199      89.867  33.144 295.971  1.00 28.10           C
ATOM  10004  C    ASP D 199      90.750  33.682 294.819  1.00 26.93           C
ATOM  10005  O    ASP D 199      91.837  33.173 294.573  1.00 25.98           O
ATOM  10006  CB   ASP D 199      90.127  31.643 296.175  1.00 27.65           C
ATOM  10007  CG   ASP D 199      91.428  31.401 296.920  1.00 28.95           C
ATOM  10008  OD1  ASP D 199      91.635  32.156 297.879  1.00 29.68           O
ATOM  10009  OD2  ASP D 199      92.269  30.523 296.564  1.00 31.62           O
ATOM  10010  N    ASN D 200      90.292  34.727 294.144  1.00 26.96           N
ATOM  10011  CA   ASN D 200      91.060  35.375 293.083  1.00 27.15           C
ATOM  10012  C    ASN D 200      91.225  36.854 293.397  1.00 26.65           C
ATOM  10013  O    ASN D 200      90.273  37.601 293.259  1.00 28.62           O
ATOM  10014  CB   ASN D 200      90.331  35.236 291.743  1.00 27.45           C
ATOM  10015  CG   ASN D 200      90.554  33.889 291.090  1.00 27.49           C
ATOM  10016  OD1  ASN D 200      91.277  33.068 291.611  1.00 27.71           O
ATOM  10017  ND2  ASN D 200      89.947  33.670 289.930  1.00 28.10           N
ATOM  10018  N    TYR D 201      92.416  37.275 293.813  1.00 24.98           N
ATOM  10019  CA   TYR D 201      92.674  38.683 294.077  1.00 24.12           C
ATOM  10020  C    TYR D 201      93.479  39.282 292.928  1.00 24.28           C
ATOM  10021  O    TYR D 201      94.543  38.757 292.591  1.00 22.44           O
ATOM  10022  CB   TYR D 201      93.455  38.822 295.385  1.00 24.78           C
ATOM  10023  CG   TYR D 201      93.658  40.244 295.855  1.00 24.80           C
ATOM  10024  CD1  TYR D 201      94.719  41.024 295.377  1.00 24.16           C
ATOM  10025  CD2  TYR D 201      92.794  40.810 296.772  1.00 25.23           C
ATOM  10026  CE1  TYR D 201      94.913  42.310 295.810  1.00 24.14           C
ATOM  10027  CE2  TYR D 201      92.977  42.111 297.208  1.00 26.20           C
ATOM  10028  CZ   TYR D 201      94.041  42.851 296.730  1.00 26.11           C
ATOM  10029  OH   TYR D 201      94.195  44.142 297.187  1.00 27.96           O
ATOM  10030  N    PHE D 202      92.985  40.384 292.347  1.00 24.46           N
ATOM  10031  CA   PHE D 202      93.690  41.106 291.279  1.00 23.78           C
ATOM  10032  C    PHE D 202      93.950  42.578 291.666  1.00 23.89           C
ATOM  10033  O    PHE D 202      93.016  43.330 291.919  1.00 24.74           O
ATOM  10034  CB   PHE D 202      92.869  41.064 289.987  1.00 24.08           C
ATOM  10035  CG   PHE D 202      92.730  39.688 289.367  1.00 23.63           C
ATOM  10036  CD1  PHE D 202      93.685  39.215 288.462  1.00 23.22           C
ATOM  10037  CD2  PHE D 202      91.608  38.889 289.640  1.00 23.26           C
ATOM  10038  CE1  PHE D 202      93.573  37.949 287.880  1.00 23.31           C
ATOM  10039  CE2  PHE D 202      91.478  37.629 289.053  1.00 23.71           C
ATOM  10040  CZ   PHE D 202      92.468  37.151 288.178  1.00 23.65           C
ATOM  10041  N    VAL D 203      95.204  43.016 291.682  1.00 23.63           N
ATOM  10042  CA   VAL D 203      95.499  44.381 292.127  1.00 24.13           C
ATOM  10043  C    VAL D 203      94.870  45.425 291.248  1.00 23.97           C
ATOM  10044  O    VAL D 203      94.521  46.498 291.728  1.00 25.78           O
ATOM  10045  CB   VAL D 203      97.011  44.687 292.228  1.00 25.37           C
ATOM  10046  CG1  VAL D 203      97.680  43.717 293.178  1.00 27.57           C
ATOM  10047  CG2  VAL D 203      97.688  44.610 290.879  1.00 25.60           C
ATOM  10048  N    GLN D 204      94.738  45.135 289.960  1.00 24.03           N
ATOM  10049  CA   GLN D 204      94.188  46.125 289.032  1.00 23.95           C
ATOM  10050  C    GLN D 204      92.700  46.374 289.301  1.00 23.46           C
ATOM  10051  O    GLN D 204      92.256  47.526 289.323  1.00 22.53           O
```

Appendix 2

```
ATOM  10052  CB   GLN D 204      94.481  45.792 287.544  1.00 22.92           C
ATOM  10053  CG   GLN D 204      93.807  44.573 286.937  1.00 22.75           C
ATOM  10054  CD   GLN D 204      94.499  43.285 287.289  1.00 21.41           C
ATOM  10055  OE1  GLN D 204      95.055  43.175 288.356  1.00 22.86           O
ATOM  10056  NE2  GLN D 204      94.457  42.305 286.401  1.00 20.20           N
ATOM  10057  N    CYS D 205      91.957  45.307 289.561  1.00 22.44           N
ATOM  10058  CA   CYS D 205      90.543  45.451 289.856  1.00 23.76           C
ATOM  10059  C    CYS D 205      90.293  46.212 291.141  1.00 23.53           C
ATOM  10060  O    CYS D 205      89.332  46.988 291.221  1.00 22.96           O
ATOM  10061  CB   CYS D 205      89.888  44.093 289.917  1.00 25.21           C
ATOM  10062  SG   CYS D 205      90.241  43.167 288.410  1.00 30.50           S
ATOM  10063  N    ASN D 206      91.171  46.001 292.124  1.00 22.81           N
ATOM  10064  CA   ASN D 206      91.087  46.696 293.378  1.00 23.17           C
ATOM  10065  C    ASN D 206      91.381  48.180 293.213  1.00 24.09           C
ATOM  10066  O    ASN D 206      90.729  49.032 293.834  1.00 23.36           O
ATOM  10067  CB   ASN D 206      92.053  46.093 294.394  1.00 23.76           C
ATOM  10068  CG   ASN D 206      91.454  44.923 295.137  1.00 24.21           C
ATOM  10069  OD1  ASN D 206      90.883  45.078 296.209  1.00 25.68           O
ATOM  10070  ND2  ASN D 206      91.563  43.751 294.570  1.00 24.77           N
ATOM  10071  N    SER D 207      92.362  48.501 292.376  1.00 24.96           N
ATOM  10072  CA   SER D 207      92.721  49.919 292.160  1.00 25.59           C
ATOM  10073  C    SER D 207      91.491  50.719 291.739  1.00 25.50           C
ATOM  10074  O    SER D 207      91.330  51.872 292.138  1.00 29.30           O
ATOM  10075  CB   SER D 207      93.858  50.073 291.129  1.00 25.22           C
ATOM  10076  OG   SER D 207      93.434  49.844 289.791  1.00 25.10           O
ATOM  10077  N    VAL D 208      90.621  50.089 290.951  1.00 25.04           N
ATOM  10078  CA   VAL D 208      89.374  50.692 290.517  1.00 24.47           C
ATOM  10079  C    VAL D 208      88.485  50.939 291.716  1.00 24.03           C
ATOM  10080  O    VAL D 208      87.993  52.054 291.897  1.00 21.90           O
ATOM  10081  CB   VAL D 208      88.600  49.808 289.535  1.00 24.89           C
ATOM  10082  CG1  VAL D 208      87.370  50.549 289.053  1.00 24.77           C
ATOM  10083  CG2  VAL D 208      89.472  49.421 288.345  1.00 25.07           C
ATOM  10084  N    ALA D 209      88.304  49.906 292.540  1.00 23.86           N
ATOM  10085  CA   ALA D 209      87.472  50.033 293.736  1.00 24.07           C
ATOM  10086  C    ALA D 209      87.949  51.162 294.625  1.00 24.07           C
ATOM  10087  O    ALA D 209      87.149  52.041 294.999  1.00 25.65           O
ATOM  10088  CB   ALA D 209      87.421  48.730 294.514  1.00 24.83           C
ATOM  10089  N    TYR D 210      89.240  51.178 294.949  1.00 22.83           N
ATOM  10090  CA   TYR D 210      89.757  52.224 295.863  1.00 22.13           C
ATOM  10091  C    TYR D 210      89.590  53.582 295.227  1.00 21.47           C
ATOM  10092  O    TYR D 210      89.246  54.548 295.913  1.00 22.25           O
ATOM  10093  CB   TYR D 210      91.215  51.990 296.283  1.00 21.55           C
ATOM  10094  CG   TYR D 210      91.331  50.890 297.304  1.00 22.08           C
ATOM  10095  CD1  TYR D 210      91.318  51.174 298.681  1.00 22.77           C
ATOM  10096  CD2  TYR D 210      91.419  49.563 296.917  1.00 21.53           C
ATOM  10097  CE1  TYR D 210      91.394  50.165 299.623  1.00 21.12           C
ATOM  10098  CE2  TYR D 210      91.492  48.556 297.858  1.00 21.24           C
ATOM  10099  CZ   TYR D 210      91.467  48.856 299.194  1.00 20.97           C
ATOM  10100  OH   TYR D 210      91.546  47.833 300.112  1.00 21.22           O
ATOM  10101  N    LEU D 211      89.819  53.671 293.925  1.00 20.24           N
ATOM  10102  CA   LEU D 211      89.606  54.935 293.252  1.00 20.95           C
ATOM  10103  C    LEU D 211      88.095  55.399 293.337  1.00 21.77           C
ATOM  10104  O    LEU D 211      87.803  56.601 293.469  1.00 21.21           O
ATOM  10105  CB   LEU D 211      90.107  54.833 291.820  1.00 21.57           C
```

Appendix 2

```
ATOM  10106  CG   LEU D 211    90.141  56.145 291.039  1.00 22.44           C
ATOM  10107  CD1  LEU D 211    91.099  57.127 291.673  1.00 22.77           C
ATOM  10108  CD2  LEU D 211    90.513  55.901 289.586  1.00 22.93           C
ATOM  10109  N    SER D 212    87.152  54.453 293.298  1.00 21.22           N
ATOM  10110  CA   SER D 212    85.737  54.786 293.467  1.00 20.99           C
ATOM  10111  C    SER D 212    85.532  55.430 294.832  1.00 21.10           C
ATOM  10112  O    SER D 212    84.726  56.348 294.959  1.00 20.29           O
ATOM  10113  CB   SER D 212    84.779  53.572 293.251  1.00 20.83           C
ATOM  10114  OG   SER D 212    84.911  52.532 294.219  1.00 20.44           O
ATOM  10115  N    LEU D 213    86.291  54.975 295.829  1.00 21.94           N
ATOM  10116  CA   LEU D 213    86.192  55.514 297.185  1.00 22.46           C
ATOM  10117  C    LEU D 213    86.633  56.974 297.254  1.00 23.81           C
ATOM  10118  O    LEU D 213    85.966  57.788 297.885  1.00 26.85           O
ATOM  10119  CB   LEU D 213    86.963  54.662 298.188  1.00 21.79           C
ATOM  10120  CG   LEU D 213    86.491  53.194 298.281  1.00 22.29           C
ATOM  10121  CD1  LEU D 213    87.265  52.405 299.326  1.00 22.44           C
ATOM  10122  CD2  LEU D 213    85.002  53.080 298.573  1.00 22.56           C
ATOM  10123  N    TRP D 214    87.701  57.331 296.560  1.00 23.81           N
ATOM  10124  CA   TRP D 214    88.135  58.711 296.553  1.00 23.19           C
ATOM  10125  C    TRP D 214    87.068  59.563 295.887  1.00 23.50           C
ATOM  10126  O    TRP D 214    86.741  60.628 296.369  1.00 26.22           O
ATOM  10127  CB   TRP D 214    89.470  58.849 295.825  1.00 23.40           C
ATOM  10128  CG   TRP D 214    90.641  58.333 296.615  1.00 23.64           C
ATOM  10129  CD1  TRP D 214    90.877  57.045 296.998  1.00 24.04           C
ATOM  10130  CD2  TRP D 214    91.749  59.098 297.083  1.00 24.63           C
ATOM  10131  NE1  TRP D 214    92.056  56.962 297.694  1.00 24.70           N
ATOM  10132  CE2  TRP D 214    92.613  58.212 297.760  1.00 25.53           C
ATOM  10133  CE3  TRP D 214    92.100  60.466 297.001  1.00 24.12           C
ATOM  10134  CZ2  TRP D 214    93.800  58.649 298.369  1.00 25.49           C
ATOM  10135  CZ3  TRP D 214    93.272  60.896 297.596  1.00 22.81           C
ATOM  10136  CH2  TRP D 214    94.116  59.995 298.260  1.00 23.81           C
ATOM  10137  N    VAL D 215    86.494  59.092 294.788  1.00 23.38           N
ATOM  10138  CA   VAL D 215    85.437  59.855 294.118  1.00 22.45           C
ATOM  10139  C    VAL D 215    84.215  60.079 295.017  1.00 22.56           C
ATOM  10140  O    VAL D 215    93.708  61.178 295.085  1.00 21.12           O
ATOM  10141  CB   VAL D 215    85.012  59.213 292.792  1.00 21.98           C
ATOM  10142  CG1  VAL D 215    83.733  59.857 292.279  1.00 23.56           C
ATOM  10143  CG2  VAL D 215    86.101  59.375 291.751  1.00 21.49           C
ATOM  10144  N    TYR D 216    83.757  59.044 295.716  1.00 24.37           N
ATOM  10145  CA   TYR D 216    82.615  59.194 296.620  1.00 24.44           C
ATOM  10146  C    TYR D 216    82.941  60.258 297.660  1.00 25.81           C
ATOM  10147  O    TYR D 216    82.112  61.134 297.918  1.00 23.60           O
ATOM  10148  CB   TYR D 216    82.228  57.870 297.295  1.00 23.71           C
ATOM  10149  CG   TYR D 216    80.952  57.970 298.092  1.00 23.25           C
ATOM  10150  CD1  TYR D 216    80.952  58.422 299.404  1.00 24.31           C
ATOM  10151  CD2  TYR D 216    79.739  57.627 297.533  1.00 23.94           C
ATOM  10152  CE1  TYR D 216    79.768  58.524 300.137  1.00 24.07           C
ATOM  10153  CE2  TYR D 216    78.569  57.709 298.251  1.00 23.88           C
ATOM  10154  CZ   TYR D 216    78.591  58.163 299.548  1.00 24.69           C
ATOM  10155  OH   TYR D 216    77.413  58.253 300.230  1.00 27.31           O
ATOM  10156  N    ASP D 217    84.159  60.199 298.224  1.00 27.50           N
ATOM  10157  CA   ASP D 217    84.610  61.165 299.260  1.00 28.07           C
ATOM  10158  C    ASP D 217    84.560  62.620 298.815  1.00 28.49           C
ATOM  10159  O    ASP D 217    84.185  63.512 299.572  1.00 29.86           O
```

Appendix 2

```
ATOM  10160  CB   ASP D 217      86.035  60.853 299.689  1.00 28.41           C
ATOM  10161  CG   ASP D 217      86.119  59.684 300.624  1.00 28.82           C
ATOM  10162  OD1  ASP D 217      85.083  59.083 300.987  1.00 29.95           O
ATOM  10163  OD2  ASP D 217      87.249  59.371 301.014  1.00 29.32           O
ATOM  10164  N    ARG D 218      84.964  62.852 297.581  1.00 28.62           N
ATOM  10165  CA   ARG D 218      84.902  64.179 297.000  1.00 29.64           C
ATOM  10166  C    ARG D 218      83.466  64.670 296.888  1.00 29.27           C
ATOM  10167  O    ARG D 218      83.211  65.862 297.006  1.00 30.59           O
ATOM  10168  CB   ARG D 218      85.583  64.157 295.627  1.00 31.30           C
ATOM  10169  CG   ARG D 218      85.161  65.241 294.682  1.00 34.31           C
ATOM  10170  CD   ARG D 218      85.531  66.646 295.146  1.00 36.11           C
ATOM  10171  NE   ARG D 218      85.838  67.421 293.947  1.00 39.63           N
ATOM  10172  CZ   ARG D 218      84.962  68.071 293.188  1.00 39.46           C
ATOM  10173  NH1  ARG D 218      83.671  68.139 293.499  1.00 40.20           N
ATOM  10174  NH2  ARG D 218      85.401  68.677 292.102  1.00 41.31           N
ATOM  10175  N    LEU D 219      82.522  63.765 296.637  1.00 27.20           N
ATOM  10176  CA   LEU D 219      81.121  64.174 296.489  1.00 25.40           C
ATOM  10177  C    LEU D 219      80.438  64.461 297.830  1.00 24.56           C
ATOM  10178  O    LEU D 219      79.598  65.329 297.904  1.00 24.00           O
ATOM  10179  CB   LEU D 219      80.330  63.113 295.709  1.00 24.45           C
ATOM  10180  CG   LEU D 219      80.643  63.085 294.209  1.00 23.53           C
ATOM  10181  CD1  LEU D 219      80.294  61.725 293.649  1.00 23.35           C
ATOM  10182  CD2  LEU D 219      79.930  64.192 293.441  1.00 22.86           C
ATOM  10183  N    HIS D 220      80.824  63.743 298.882  1.00 24.23           N
ATOM  10184  CA   HIS D 220      80.083  63.739 300.133  1.00 24.25           C
ATOM  10185  C    HIS D 220      80.890  64.125 301.372  1.00 25.10           C
ATOM  10186  O    HIS D 220      80.347  64.152 302.465  1.00 24.87           O
ATOM  10187  CB   HIS D 220      79.414  62.376 300.304  1.00 24.63           C
ATOM  10188  CG   HIS D 220      78.390  62.101 299.245  1.00 26.81           C
ATOM  10189  ND1  HIS D 220      78.569  61.163 298.250  1.00 26.66           N
ATOM  10190  CD2  HIS D 220      77.199  62.700 298.988  1.00 27.37           C
ATOM  10191  CE1  HIS D 220      77.522  61.178 297.443  1.00 27.80           C
ATOM  10192  NE2  HIS D 220      76.677  62.103 297.870  1.00 27.05           N
ATOM  10193  N    GLY D 221      82.164  64.470 301.198  1.00 26.52           N
ATOM  10194  CA   GLY D 221      83.023  64.855 302.312  1.00 27.37           C
ATOM  10195  C    GLY D 221      83.294  63.729 303.299  1.00 28.68           C
ATOM  10196  O    GLY D 221      83.598  63.981 304.458  1.00 30.88           O
ATOM  10197  N    THR D 222      83.205  62.484 302.846  1.00 29.82           N
ATOM  10198  CA   THR D 222      83.453  61.318 303.711  1.00 29.50           C
ATOM  10199  C    THR D 222      84.955  60.970 303.764  1.00 30.45           C
ATOM  10200  O    THR D 222      85.789  61.644 303.143  1.00 29.81           O
ATOM  10201  CB   THR D 222      82.617  60.098 303.224  1.00 28.30           C
ATOM  10202  OG1  THR D 222      82.741  59.964 301.809  1.00 28.05           O
ATOM  10203  CG2  THR D 222      81.147  60.299 303.539  1.00 26.66           C
ATOM  10204  N    ASP D 223      85.296  59.923 304.514  1.00 31.96           N
ATOM  10205  CA   ASP D 223      86.664  59.422 304.535  1.00 32.78           C
ATOM  10206  C    ASP D 223      86.723  57.936 304.275  1.00 30.87           C
ATOM  10207  O    ASP D 223      87.337  57.188 305.016  1.00 32.25           O
ATOM  10208  CB   ASP D 223      87.340  59.750 305.873  1.00 35.62           C
ATOM  10209  CG   ASP D 223      88.864  59.820 305.757  1.00 36.35           C
ATOM  10210  OD1  ASP D 223      89.419  59.576 304.658  1.00 35.73           O
ATOM  10211  OD2  ASP D 223      89.504  60.142 306.768  1.00 36.45           O
ATOM  10212  N    TYR D 224      86.082  57.494 303.211  1.00 30.64           N
ATOM  10213  CA   TYR D 224      86.213  56.090 302.828  1.00 30.76           C
```

Appendix 2

```
ATOM  10214  C    TYR D 224    87.614  55.827 302.270  1.00 30.04        C
ATOM  10215  O    TYR D 224    88.131  54.713 302.329  1.00 32.94        O
ATOM  10216  CB   TYR D 224    85.157  55.704 301.801  1.00 29.91        C
ATOM  10217  CG   TYR D 224    83.749  55.629 302.348  1.00 29.83        C
ATOM  10218  CD1  TYR D 224    83.396  54.658 303.273  1.00 30.28        C
ATOM  10219  CD2  TYR D 224    82.759  56.501 301.919  1.00 30.21        C
ATOM  10220  CE1  TYR D 224    82.112  54.559 303.764  1.00 29.01        C
ATOM  10221  CE2  TYR D 224    81.465  56.402 302.410  1.00 29.58        C
ATOM  10222  CZ   TYR D 224    81.157  55.436 303.340  1.00 29.03        C
ATOM  10223  OH   TYR D 224    79.881  55.323 303.841  1.00 28.85        O
ATOM  10224  N    ARG D 225    88.242  56.866 301.755  1.00 29.48        N
ATOM  10225  CA   ARG D 225    89.547  56.714 301.146  1.00 29.10        C
ATOM  10226  C    ARG D 225    90.637  56.317 302.164  1.00 28.75        C
ATOM  10227  O    ARG D 225    91.695  55.830 301.774  1.00 26.29        O
ATOM  10228  CB   ARG D 225    89.891  57.959 300.316  1.00 28.44        C
ATOM  10229  CG   ARG D 225    90.720  59.007 300.990  1.00 29.35        C
ATOM  10230  CD   ARG D 225    90.478  60.372 300.387  1.00 30.55        C
ATOM  10231  NE   ARG D 225    89.451  61.015 301.185  1.00 33.81        N
ATOM  10232  CZ   ARG D 225    89.633  62.042 302.006  1.00 34.90        C
ATOM  10233  NH1  ARG D 225    90.815  62.611 302.143  1.00 35.10        N
ATOM  10234  NH2  ARG D 225    88.597  62.508 302.691  1.00 37.86        N
ATOM  10235  N    ALA D 226    90.340  56.467 303.462  1.00 30.69        N
ATOM  10236  CA   ALA D 226    91.308  56.172 304.566  1.00 30.03        C
ATOM  10237  C    ALA D 226    91.865  54.768 304.497  1.00 28.17        C
ATOM  10238  O    ALA D 226    92.961  54.509 304.967  1.00 27.00        O
ATOM  10239  CB   ALA D 226    90.661  56.392 305.940  1.00 29.32        C
ATOM  10240  N    ALA D 227    91.099  53.865 303.897  1.00 29.17        N
ATOM  10241  CA   ALA D 227    91.540  52.475 303.706  1.00 29.74        C
ATOM  10242  C    ALA D 227    92.646  52.303 302.644  1.00 29.00        C
ATOM  10243  O    ALA D 227    93.199  51.211 302.510  1.00 29.21        O
ATOM  10244  CB   ALA D 227    90.345  51.586 303.367  1.00 28.84        C
ATOM  10245  N    THR D 228    92.960  53.363 301.905  1.00 28.95        N
ATOM  10246  CA   THR D 228    93.907  53.273 300.804  1.00 31.21        C
ATOM  10247  C    THR D 228    95.347  52.983 301.271  1.00 33.10        C
ATOM  10248  O    THR D 228    96.073  52.200 300.625  1.00 33.19        O
ATOM  10249  CB   THR D 228    93.878  54.543 299.938  1.00 30.92        C
ATOM  10250  OG1  THR D 228    92.546  54.761 299.465  1.00 31.60        O
ATOM  10251  CG2  THR D 228    94.799  54.417 298.737  1.00 30.82        C
ATOM  10252  N    ARG D 229    95.759  53.592 302.384  1.00 33.54        N
ATOM  10253  CA   ARG D 229    97.135  53.414 302.874  1.00 33.64        C
ATOM  10254  C    ARG D 229    97.416  51.913 303.125  1.00 29.83        C
ATOM  10255  O    ARG D 229    98.377  51.351 302.608  1.00 28.49        O
ATOM  10256  CB   ARG D 229    97.369  54.282 304.128  1.00 36.97        C
ATOM  10257  CG   ARG D 229    98.691  54.066 304.858  1.00 40.08        C
ATOM  10258  CD   ARG D 229    99.895  54.120 303.921  1.00 43.80        C
ATOM  10259  NE   ARG D 229    99.769  55.200 302.931  1.00 48.63        N
ATOM  10260  CZ   ARG D 229   100.275  55.176 301.695  1.00 49.78        C
ATOM  10261  NH1  ARG D 229   100.966  54.122 301.264  1.00 49.56        N
ATOM  10262  NH2  ARG D 229   100.075  56.212 300.880  1.00 48.28        N
ATOM  10263  N    ALA D 230    96.545  51.266 303.882  1.00 27.29        N
ATOM  10264  CA   ALA D 230    96.642  49.823 304.097  1.00 26.70        C
ATOM  10265  C    ALA D 230    96.791  49.024 302.781  1.00 26.18        C
ATOM  10266  O    ALA D 230    97.653  48.141 302.666  1.00 26.83        O
ATOM  10267  CB   ALA D 230    95.428  49.333 304.872  1.00 25.64        C
```

Appendix 2

```
ATOM  10268  N    TRP D 231      95.956  49.338 301.804  1.00 23.98           N
ATOM  10269  CA   TRP D 231      96.001  48.652 300.552  1.00 23.89           C
ATOM  10270  C    TRP D 231      97.346  48.834 299.851  1.00 25.34           C
ATOM  10271  O    TRP D 231      97.933  47.869 299.338  1.00 25.83           O
ATOM  10272  CB   TRP D 231      94.887  49.146 299.647  1.00 23.05           C
ATOM  10273  CG   TRP D 231      94.882  48.486 298.317  1.00 21.83           C
ATOM  10274  CD1  TRP D 231      94.674  47.183 298.075  1.00 21.79           C
ATOM  10275  CD2  TRP D 231      95.111  49.103 297.044  1.00 21.77           C
ATOM  10276  NE1  TRP D 231      94.761  46.925 296.727  1.00 21.73           N
ATOM  10277  CE2  TRP D 231      95.021  48.093 296.071  1.00 21.14           C
ATOM  10278  CE3  TRP D 231      95.364  50.417 296.633  1.00 22.00           C
ATOM  10279  CZ2  TRP D 231      95.169  48.341 294.716  1.00 21.16           C
ATOM  10280  CZ3  TRP D 231      95.522  50.667 295.281  1.00 21.97           C
ATOM  10281  CH2  TRP D 231      95.427  49.623 294.335  1.00 21.64           C
ATOM  10282  N    LEU D 232      97.832  50.066 299.807  1.00 25.46           N
ATOM  10283  CA   LEU D 232      99.077  50.336 299.106  1.00 24.59           C
ATOM  10284  C    LEU D 232     100.267  49.664 299.785  1.00 25.30           C
ATOM  10285  O    LEU D 232     101.203  49.244 299.119  1.00 24.37           O
ATOM  10286  CB   LEU D 232      99.319  51.823 299.024  1.00 24.08           C
ATOM  10287  CG   LEU D 232      98.337  52.573 298.138  1.00 25.06           C
ATOM  10288  CD1  LEU D 232      98.435  54.076 298.404  1.00 25.54           C
ATOM  10289  CD2  LEU D 232      98.565  52.254 296.669  1.00 24.86           C
ATOM  10290  N    ASP D 233     100.245  49.606 301.114  1.00 26.61           N
ATOM  10291  CA   ASP D 233     101.289  48.920 301.876  1.00 26.37           C
ATOM  10292  C    ASP D 233     101.196  47.437 301.546  1.00 26.36           C
ATOM  10293  O    ASP D 233     102.199  46.784 301.269  1.00 25.97           O
ATOM  10294  CB   ASP D 233     101.129  49.153 303.395  1.00 25.95           C
ATOM  10295  CG   ASP D 233     101.480  50.589 303.829  1.00 27.56           C
ATOM  10296  OD1  ASP D 233     102.228  51.304 303.141  1.00 27.95           O
ATOM  10297  OD2  ASP D 233     101.012  51.024 304.893  1.00 31.01           O
ATOM  10298  N    PHE D 234      99.975  46.922 301.537  1.00 26.71           N
ATOM  10299  CA   PHE D 234      99.753  45.504 301.287  1.00 27.98           C
ATOM  10300  C    PHE D 234     100.236  45.031 299.903  1.00 27.59           C
ATOM  10301  O    PHE D 234     100.912  44.001 299.797  1.00 28.27           O
ATOM  10302  CB   PHE D 234      98.277  45.132 301.484  1.00 28.82           C
ATOM  10303  CG   PHE D 234      97.986  43.703 301.141  1.00 30.66           C
ATOM  10304  CD1  PHE D 234      98.398  42.686 301.976  1.00 31.75           C
ATOM  10305  CD2  PHE D 234      97.357  43.374 299.967  1.00 31.11           C
ATOM  10306  CE1  PHE D 234      98.188  41.365 301.650  1.00 32.03           C
ATOM  10307  CE2  PHE D 234      97.133  42.056 299.641  1.00 32.68           C
ATOM  10308  CZ   PHE D 234      97.554  41.048 300.486  1.00 31.83           C
ATOM  10309  N    ILE D 235      99.908  45.775 298.853  1.00 27.22           N
ATOM  10310  CA   ILE D 235     100.282  45.353 297.502  1.00 28.87           C
ATOM  10311  C    ILE D 235     101.783  45.435 297.264  1.00 29.42           C
ATOM  10312  O    ILE D 235     102.317  44.954 296.298  1.00 27.90           O
ATOM  10313  CB   ILE D 235      99.526  46.111 296.400  1.00 27.90           C
ATOM  10314  CG1  ILE D 235      99.886  47.592 296.423  1.00 28.42           C
ATOM  10315  CG2  ILE D 235      98.024  45.907 296.547  1.00 27.61           C
ATOM  10316  CD1  ILE D 235      99.357  48.348 295.227  1.00 29.39           C
ATOM  10317  N    GLN D 236     102.450  46.190 298.167  1.00 31.22           N
ATOM  10318  CA   GLN D 236     103.880  46.437 298.072  1.00 31.21           C
ATOM  10319  C    GLN D 236     104.688  45.369 298.814  1.00 32.07           C
ATOM  10320  O    GLN D 236     105.843  45.205 298.512  1.00 29.62           O
ATOM  10321  CB   GLN D 236     104.194  47.826 298.622  1.00 31.24           C
```

Appendix 2

```
ATOM  10322  CG   GLN D 236     105.114  48.646 297.758  1.00 31.30           C
ATOM  10323  CD   GLN D 236     105.150  50.100 298.162  1.00 31.54           C
ATOM  10324  OE1  GLN D 236     104.215  50.624 298.781  1.00 32.18           O
ATOM  10325  NE2  GLN D 236     106.216  50.778 297.781  1.00 32.72           N
ATOM  10326  N    LYS D 237     104.093  44.678 299.793  1.00 35.69           N
ATOM  10327  CA   LYS D 237     104.669  43.440 300.346  1.00 38.49           C
ATOM  10328  C    LYS D 237     104.071  42.285 299.557  1.00 42.04           C
ATOM  10329  O    LYS D 237     102.886  41.979 299.720  1.00 53.11           O
ATOM  10330  CB   LYS D 237     104.357  43.270 301.853  1.00 35.87           C
ATOM  10331  N    ASP D 238     104.861  41.679 298.673  1.00 43.08           N
ATOM  10332  CA   ASP D 238     104.549  40.342 298.102  1.00 45.30           C
ATOM  10333  C    ASP D 238     103.790  40.282 296.772  1.00 41.15           C
ATOM  10334  O    ASP D 238     104.001  39.352 296.008  1.00 42.85           O
ATOM  10335  CB   ASP D 238     103.834  39.434 299.120  1.00 50.61           C
ATOM  10336  CG   ASP D 238     104.773  38.448 299.782  1.00 52.59           C
ATOM  10337  OD1  ASP D 238     105.566  38.863 300.656  1.00 54.43           O
ATOM  10338  OD2  ASP D 238     104.706  37.253 299.426  1.00 53.10           O
ATOM  10339  N    LEU D 239     102.915  41.239 296.489  1.00 36.09           N
ATOM  10340  CA   LEU D 239     102.313  41.325 295.157  1.00 31.89           C
ATOM  10341  C    LEU D 239     103.171  42.051 294.139  1.00 28.66           C
ATOM  10342  O    LEU D 239     102.918  41.956 292.948  1.00 27.53           O
ATOM  10343  CB   LEU D 239     100.942  41.993 295.210  1.00 33.41           C
ATOM  10344  CG   LEU D 239      99.873  41.172 295.923  1.00 35.03           C
ATOM  10345  CD1  LEU D 239      98.494  41.772 295.747  1.00 35.70           C
ATOM  10346  CD2  LEU D 239      99.869  39.758 295.398  1.00 35.89           C
ATOM  10347  N    ILE D 240     104.189  42.778 294.584  1.00 27.18           N
ATOM  10348  CA   ILE D 240     105.062  43.486 293.642  1.00 25.71           C
ATOM  10349  C    ILE D 240     106.451  42.891 293.662  1.00 22.63           C
ATOM  10350  O    ILE D 240     106.876  42.371 294.669  1.00 22.45           O
ATOM  10351  CB   ILE D 240     105.098  44.997 293.940  1.00 25.94           C
ATOM  10352  CG1  ILE D 240     105.385  45.791 292.672  1.00 27.30           C
ATOM  10353  CG2  ILE D 240     106.109  45.328 295.015  1.00 25.26           C
ATOM  10354  CD1  ILE D 240     105.341  47.295 292.900  1.00 27.69           C
ATOM  10355  N    ASP D 241     107.107  42.896 292.513  1.00 22.55           N
ATOM  10356  CA   ASP D 241     108.556  42.705 292.432  1.00 22.33           C
ATOM  10357  C    ASP D 241     109.172  44.110 292.359  1.00 22.54           C
ATOM  10358  O    ASP D 241     109.192  44.733 291.305  1.00 21.08           O
ATOM  10359  CB   ASP D 241     108.916  41.893 291.211  1.00 21.84           C
ATOM  10360  CG   ASP D 241     110.412  41.767 291.011  1.00 23.60           C
ATOM  10361  OD1  ASP D 241     111.214  42.412 291.729  1.00 24.76           O
ATOM  10362  OD2  ASP D 241     110.796  41.046 290.084  1.00 23.35           O
ATOM  10363  N    PRO D 242     109.656  44.620 293.496  1.00 23.72           N
ATOM  10364  CA   PRO D 242     110.051  46.043 293.570  1.00 24.36           C
ATOM  10365  C    PRO D 242     111.267  46.387 292.683  1.00 23.83           C
ATOM  10366  O    PRO D 242     111.308  47.473 292.114  1.00 23.38           O
ATOM  10367  CB   PRO D 242     110.341  46.253 295.070  1.00 23.67           C
ATOM  10368  CG   PRO D 242     110.811  44.905 295.530  1.00 24.21           C
ATOM  10369  CD   PRO D 242     110.065  43.869 294.699  1.00 23.89           C
ATOM  10370  N    GLU D 243     112.197  45.447 292.527  1.00 23.00           N
ATOM  10371  CA   GLU D 243     113.307  45.613 291.595  1.00 23.96           C
ATOM  10372  C    GLU D 243     112.832  45.854 290.160  1.00 24.07           C
ATOM  10373  O    GLU D 243     113.447  46.617 289.443  1.00 23.68           O
ATOM  10374  CB   GLU D 243     114.313  44.436 291.669  1.00 24.04           C
ATOM  10375  N    ARG D 244     111.730  45.243 289.742  1.00 25.63           N
```

Appendix 2

```
ATOM  10376  CA   ARG D 244    111.318  45.324 288.337  1.00 25.75           C
ATOM  10377  C    ARG D 244    110.123  46.302 288.106  1.00 25.38           C
ATOM  10378  O    ARG D 244    109.769  46.634 286.961  1.00 22.44           O
ATOM  10379  CB   ARG D 244    111.081  43.911 287.778  1.00 28.04           C
ATOM  10380  CG   ARG D 244    112.363  43.197 287.322  1.00 29.97           C
ATOM  10381  CD   ARG D 244    112.141  41.760 286.820  1.00 34.39           C
ATOM  10382  NE   ARG D 244    111.469  40.889 287.812  1.00 40.29           N
ATOM  10383  CZ   ARG D 244    111.073  39.613 287.612  1.00 44.80           C
ATOM  10384  NH1  ARG D 244    111.281  38.997 286.438  1.00 45.45           N
ATOM  10385  NH2  ARG D 244    110.449  38.937 288.601  1.00 43.15           N
ATOM  10386  N    GLY D 245    109.550  46.812 289.194  1.00 24.94           N
ATOM  10387  CA   GLY D 245    108.419  47.744 289.095  1.00 25.65           C
ATOM  10388  C    GLY D 245    107.198  47.118 288.449  1.00 25.56           C
ATOM  10389  O    GLY D 245    106.495  47.773 287.684  1.00 27.57           O
ATOM  10390  N    ALA D 246    106.948  45.851 288.768  1.00 24.33           N
ATOM  10391  CA   ALA D 246    105.898  45.076 288.121  1.00 23.28           C
ATOM  10392  C    ALA D 246    105.134  44.238 289.147  1.00 23.46           C
ATOM  10393  O    ALA D 246    105.740  43.693 290.076  1.00 23.69           O
ATOM  10394  CB   ALA D 246    106.494  44.185 287.050  1.00 22.78           C
ATOM  10395  N    PHE D 247    103.809  44.169 288.997  1.00 22.83           N
ATOM  10396  CA   PHE D 247    102.988  43.341 289.878  1.00 23.40           C
ATOM  10397  C    PHE D 247    102.891  41.906 289.384  1.00 23.26           C
ATOM  10398  O    PHE D 247    103.030  41.622 288.201  1.00 22.45           O
ATOM  10399  CB   PHE D 247    101.583  43.891 290.003  1.00 23.62           C
ATOM  10400  CG   PHE D 247    101.506  45.166 290.748  1.00 23.94           C
ATOM  10401  CD1  PHE D 247    101.657  45.186 292.122  1.00 26.22           C
ATOM  10402  CD2  PHE D 247    101.261  46.356 290.084  1.00 24.94           C
ATOM  10403  CE1  PHE D 247    101.593  46.385 292.827  1.00 26.99           C
ATOM  10404  CE2  PHE D 247    101.173  47.562 290.783  1.00 25.29           C
ATOM  10405  CZ   PHE D 247    101.351  47.580 292.151  1.00 25.77           C
ATOM  10406  N    TYR D 248    102.644  41.002 290.317  1.00 23.56           N
ATOM  10407  CA   TYR D 248    102.416  39.625 289.965  1.00 24.77           C
ATOM  10408  C    TYR D 248    100.990  39.462 289.482  1.00 24.60           C
ATOM  10409  O    TYR D 248    100.112  40.245 289.844  1.00 24.72           O
ATOM  10410  CB   TYR D 248    102.728  38.696 291.143  1.00 25.72           C
ATOM  10411  CG   TYR D 248    104.215  38.559 291.353  1.00 25.92           C
ATOM  10412  CD1  TYR D 248    104.995  37.868 290.433  1.00 25.88           C
ATOM  10413  CD2  TYR D 248    104.847  39.155 292.442  1.00 26.32           C
ATOM  10414  CE1  TYR D 248    106.357  37.738 290.605  1.00 26.29           C
ATOM  10415  CE2  TYR D 248    106.215  39.032 292.624  1.00 26.45           C
ATOM  10416  CZ   TYR D 248    106.959  38.328 291.701  1.00 26.31           C
ATOM  10417  OH   TYR D 248    108.310  38.221 291.857  1.00 27.83           O
ATOM  10418  N    LEU D 249    100.786  38.436 288.660  1.00 23.89           N
ATOM  10419  CA   LEU D 249     99.531  38.213 287.972  1.00 23.40           C
ATOM  10420  C    LEU D 249     98.350  38.279 288.902  1.00 21.89           C
ATOM  10421  O    LEU D 249     97.396  38.993 288.642  1.00 22.66           O
ATOM  10422  CB   LEU D 249     99.544  36.845 287.275  1.00 24.05           C
ATOM  10423  CG   LEU D 249     98.515  36.624 286.164  1.00 24.14           C
ATOM  10424  CD1  LEU D 249     98.679  37.665 285.061  1.00 23.63           C
ATOM  10425  CD2  LEU D 249     98.626  35.205 285.601  1.00 24.79           C
ATOM  10426  N    SER D 250     98.409  37.513 289.978  1.00 21.11           N
ATOM  10427  CA   SER D 250     97.263  37.366 290.875  1.00 20.96           C
ATOM  10428  C    SER D 250     97.653  36.702 292.194  1.00 21.38           C
ATOM  10429  O    SER D 250     98.691  36.068 292.288  1.00 21.26           O
```

Appendix 2

```
ATOM  10430  CB   SER D 250      96.137  36.559 290.210  1.00 19.70           C
ATOM  10431  OG   SER D 250      96.532  35.222 289.944  1.00 19.86           O
ATOM  10432  N    TYR D 251      96.781  36.854 293.184  1.00 22.51           N
ATOM  10433  CA   TYR D 251      96.984  36.370 294.539  1.00 24.68           C
ATOM  10434  C    TYR D 251      95.765  35.571 294.947  1.00 23.44           C
ATOM  10435  O    TYR D 251      94.650  35.847 294.491  1.00 22.24           O
ATOM  10436  CB   TYR D 251      97.235  37.568 295.479  1.00 26.08           C
ATOM  10437  CG   TYR D 251      97.075  37.333 296.982  1.00 28.07           C
ATOM  10438  CD1  TYR D 251      97.947  36.499 297.692  1.00 28.14           C
ATOM  10439  CD2  TYR D 251      96.061  37.991 297.705  1.00 29.50           C
ATOM  10440  CE1  TYR D 251      97.796  36.311 299.063  1.00 28.49           C
ATOM  10441  CE2  TYR D 251      95.897  37.797 299.066  1.00 28.59           C
ATOM  10442  CZ   TYR D 251      96.764  36.972 299.738  1.00 29.41           C
ATOM  10443  OH   TYR D 251      96.569  36.814 301.082  1.00 30.21           O
ATOM  10444  N    HIS D 252      95.985  34.581 295.805  1.00 23.71           N
ATOM  10445  CA   HIS D 252      94.955  33.588 296.124  1.00 23.97           C
ATOM  10446  C    HIS D 252      94.915  33.253 297.617  1.00 24.22           C
ATOM  10447  O    HIS D 252      95.624  32.373 298.083  1.00 24.99           O
ATOM  10448  CB   HIS D 252      95.147  32.368 295.244  1.00 22.88           C
ATOM  10449  CG   HIS D 252      95.202  32.721 293.805  1.00 22.81           C
ATOM  10450  ND1  HIS D 252      94.067  32.919 293.051  1.00 23.11           N
ATOM  10451  CD2  HIS D 252      96.248  33.016 293.003  1.00 22.94           C
ATOM  10452  CE1  HIS D 252      94.411  33.294 291.832  1.00 22.76           C
ATOM  10453  NE2  HIS D 252      95.729  33.360 291.778  1.00 23.58           N
ATOM  10454  N    PRO D 253      94.096  33.994 298.367  1.00 24.14           N
ATOM  10455  CA   PRO D 253      94.054  33.977 299.821  1.00 24.77           C
ATOM  10456  C    PRO D 253      93.973  32.612 300.492  1.00 24.76           C
ATOM  10457  O    PRO D 253      94.748  32.321 301.394  1.00 24.10           O
ATOM  10458  CB   PRO D 253      92.794  34.790 300.117  1.00 25.35           C
ATOM  10459  CG   PRO D 253      92.732  35.799 299.023  1.00 24.61           C
ATOM  10460  CD   PRO D 253      93.377  35.162 297.820  1.00 24.37           C
ATOM  10461  N    GLU D 254      93.037  31.777 300.076  1.00 26.42           N
ATOM  10462  CA   GLU D 254      92.877  30.473 300.718  1.00 28.64           C
ATOM  10463  C    GLU D 254      94.223  29.712 300.711  1.00 26.14           C
ATOM  10464  O    GLU D 254      94.684  29.313 301.737  1.00 25.62           O
ATOM  10465  CB   GLU D 254      91.709  29.692 300.083  1.00 31.15           C
ATOM  10466  CG   GLU D 254      91.590  28.213 300.476  1.00 34.57           C
ATOM  10467  CD   GLU D 254      90.731  27.955 301.702  1.00 37.74           C
ATOM  10468  OE1  GLU D 254      90.124  28.919 302.230  1.00 34.23           O
ATOM  10469  OE2  GLU D 254      90.674  26.758 302.126  1.00 43.28           O
ATOM  10470  N    SER D 255      94.849  29.555 299.555  1.00 27.34           N
ATOM  10471  CA   SER D 255      96.202  28.965 299.436  1.00 26.87           C
ATOM  10472  C    SER D 255      97.342  29.893 299.878  1.00 26.75           C
ATOM  10473  O    SER D 255      98.408  29.441 300.252  1.00 27.11           O
ATOM  10474  CB   SER D 255      96.460  28.598 297.979  1.00 26.62           C
ATOM  10475  OG   SER D 255      95.875  29.575 297.146  1.00 27.51           O
ATOM  10476  N    GLY D 256      97.132  31.191 299.803  1.00 26.36           N
ATOM  10477  CA   GLY D 256      98.205  32.138 299.984  1.00 26.19           C
ATOM  10478  C    GLY D 256      99.096  32.248 298.754  1.00 27.12           C
ATOM  10479  O    GLY D 256     100.067  32.971 298.787  1.00 29.95           O
ATOM  10480  N    ALA D 257      98.780  31.564 297.661  1.00 25.63           N
ATOM  10481  CA   ALA D 257      99.648  31.583 296.482  1.00 24.70           C
ATOM  10482  C    ALA D 257      99.640  32.904 295.767  1.00 23.97           C
ATOM  10483  O    ALA D 257      98.584  33.517 295.617  1.00 24.27           O
```

Appendix 2

```
ATOM  10484  CB   ALA D 257      99.237  30.503 295.492  1.00 24.67           C
ATOM  10485  N    VAL D 258     100.817  33.325 295.301  1.00 23.48           N
ATOM  10486  CA   VAL D 258     100.927  34.425 294.356  1.00 22.98           C
ATOM  10487  C    VAL D 258     101.438  33.794 293.110  1.00 21.91           C
ATOM  10488  O    VAL D 258     102.455  33.121 293.158  1.00 20.26           O
ATOM  10489  CB   VAL D 258     101.934  35.497 294.788  1.00 23.83           C
ATOM  10490  CG1  VAL D 258     101.683  36.772 294.015  1.00 24.00           C
ATOM  10491  CG2  VAL D 258     101.811  35.779 296.272  1.00 25.08           C
ATOM  10492  N    LYS D 259     100.722  33.968 292.003  1.00 21.95           N
ATOM  10493  CA   LYS D 259     101.182  33.414 290.739  1.00 22.23           C
ATOM  10494  C    LYS D 259     102.502  34.026 290.317  1.00 23.56           C
ATOM  10495  O    LYS D 259     102.615  35.238 290.157  1.00 25.52           O
ATOM  10496  CB   LYS D 259     100.171  33.617 289.643  1.00 22.02           C
ATOM  10497  CG   LYS D 259      98.958  32.754 289.831  1.00 21.60           C
ATOM  10498  CD   LYS D 259      98.124  32.765 288.578  1.00 21.00           C
ATOM  10499  CE   LYS D 259      96.808  32.057 288.855  1.00 20.36           C
ATOM  10500  NZ   LYS D 259      96.041  31.875 287.608  1.00 20.02           N
ATOM  10501  N    PRO D 260     103.509  33.180 290.098  1.00 25.15           N
ATOM  10502  CA   PRO D 260     104.888  33.614 289.900  1.00 25.15           C
ATOM  10503  C    PRO D 260     105.220  34.287 288.559  1.00 25.25           C
ATOM  10504  O    PRO D 260     106.375  34.357 288.191  1.00 27.95           O
ATOM  10505  CB   PRO D 260     105.653  32.306 290.031  1.00 24.92           C
ATOM  10506  CG   PRO D 260     104.725  31.317 289.447  1.00 25.60           C
ATOM  10507  CD   PRO D 260     103.374  31.723 289.938  1.00 25.13           C
ATOM  10508  N    TRP D 261     104.237  34.779 287.832  1.00 24.61           N
ATOM  10509  CA   TRP D 261     104.512  35.546 286.625  1.00 23.94           C
ATOM  10510  C    TRP D 261     104.128  37.017 286.860  1.00 22.68           C
ATOM  10511  O    TRP D 261     103.102  37.309 287.492  1.00 22.77           O
ATOM  10512  CB   TRP D 261     103.738  34.944 285.447  1.00 23.81           C
ATOM  10513  CG   TRP D 261     104.075  33.520 285.233  1.00 23.87           C
ATOM  10514  CD1  TRP D 261     105.132  33.037 284.540  1.00 23.56           C
ATOM  10515  CD2  TRP D 261     103.368  32.380 285.739  1.00 24.18           C
ATOM  10516  NE1  TRP D 261     105.132  31.667 284.574  1.00 23.72           N
ATOM  10517  CE2  TRP D 261     104.058  31.234 285.297  1.00 23.38           C
ATOM  10518  CE3  TRP D 261     102.200  32.216 286.490  1.00 23.87           C
ATOM  10519  CZ2  TRP D 261     103.639  29.944 285.595  1.00 22.74           C
ATOM  10520  CZ3  TRP D 261     101.780  30.933 286.789  1.00 24.00           C
ATOM  10521  CH2  TRP D 261     102.512  29.805 286.348  1.00 23.20           C
ATOM  10522  N    ILE D 262     104.964  37.927 286.376  1.00 21.58           N
ATOM  10523  CA   ILE D 262     104.659  39.341 286.433  1.00 21.30           C
ATOM  10524  C    ILE D 262     103.974  39.769 285.141  1.00 20.79           C
ATOM  10525  O    ILE D 262     104.209  39.200 284.077  1.00 18.75           O
ATOM  10526  CB   ILE D 262     105.899  40.202 286.727  1.00 22.52           C
ATOM  10527  CG1  ILE D 262     106.966  40.033 285.653  1.00 23.60           C
ATOM  10528  CG2  ILE D 262     106.488  39.858 288.087  1.00 22.18           C
ATOM  10529  CD1  ILE D 262     108.009  41.125 285.719  1.00 24.15           C
ATOM  10530  N    SER D 263     103.079  40.748 285.257  1.00 21.42           N
ATOM  10531  CA   SER D 263     102.231  41.155 284.130  1.00 21.77           C
ATOM  10532  C    SER D 263     102.327  42.654 283.835  1.00 21.17           C
ATOM  10533  O    SER D 263     102.087  43.488 284.701  1.00 20.15           O
ATOM  10534  CB   SER D 263     100.776  40.780 284.392  1.00 21.75           C
ATOM  10535  OG   SER D 263      99.922  41.556 283.577  1.00 21.46           O
ATOM  10536  N    ALA D 264     102.649  42.972 282.590  1.00 21.33           N
ATOM  10537  CA   ALA D 264     102.733  44.354 282.151  1.00 21.98           C
```

Appendix 2

```
ATOM  10538  C    ALA D 264     101.367  45.055 282.158  1.00 21.68           C
ATOM  10539  O    ALA D 264     101.246  46.172 282.655  1.00 20.97           O
ATOM  10540  CB   ALA D 264     103.339  44.405 280.754  1.00 22.62           C
ATOM  10541  N    TYR D 265     100.334  44.408 281.626  1.00 22.13           N
ATOM  10542  CA   TYR D 265      99.023  45.078 281.538  1.00 23.22           C
ATOM  10543  C    TYR D 265      98.435  45.292 282.938  1.00 21.26           C
ATOM  10544  O    TYR D 265      97.989  46.363 283.273  1.00 21.13           O
ATOM  10545  CB   TYR D 265      98.070  44.330 280.586  1.00 23.93           C
ATOM  10546  CG   TYR D 265      97.037  43.520 281.280  1.00 24.99           C
ATOM  10547  CD1  TYR D 265      95.895  44.127 281.735  1.00 25.95           C
ATOM  10548  CD2  TYR D 265      97.198  42.154 281.481  1.00 26.16           C
ATOM  10549  CE1  TYR D 265      94.903  43.412 282.386  1.00 27.43           C
ATOM  10550  CE2  TYR D 265      96.216  41.414 282.132  1.00 27.96           C
ATOM  10551  CZ   TYR D 265      95.063  42.055 282.588  1.00 28.09           C
ATOM  10552  OH   TYR D 265      94.044  41.394 283.241  1.00 25.81           O
ATOM  10553  N    THR D 266      98.489  44.274 283.768  1.00 21.94           N
ATOM  10554  CA   THR D 266      98.105  44.398 285.188  1.00 21.81           C
ATOM  10555  C    THR D 266      98.750  45.630 285.854  1.00 21.79           C
ATOM  10556  O    THR D 266      98.082  46.442 286.515  1.00 19.39           O
ATOM  10557  CB   THR D 266      98.501  43.112 285.948  1.00 21.27           C
ATOM  10558  OG1  THR D 266      97.783  42.000 285.407  1.00 21.10           O
ATOM  10559  CG2  THR D 266      98.184  43.229 287.403  1.00 21.96           C
ATOM  10560  N    THR D 267     100.064  45.745 285.649  1.00 22.70           N
ATOM  10561  CA   THR D 267     100.880  46.815 286.213  1.00 22.48           C
ATOM  10562  C    THR D 267     100.579  48.172 285.562  1.00 21.73           C
ATOM  10563  O    THR D 267     100.548  49.168 286.236  1.00 20.48           O
ATOM  10564  CB   THR D 267     102.381  46.459 286.068  1.00 22.96           C
ATOM  10565  OG1  THR D 267     102.575  45.131 286.548  1.00 22.60           O
ATOM  10566  CG2  THR D 267     103.301  47.434 286.854  1.00 23.27           C
ATOM  10567  N    ALA D 268     100.337  48.216 284.262  1.00 22.79           N
ATOM  10568  CA   ALA D 268     100.150  49.520 283.595  1.00 23.68           C
ATOM  10569  C    ALA D 268      98.853  50.164 284.015  1.00 23.86           C
ATOM  10570  O    ALA D 268      98.796  51.373 284.241  1.00 24.95           O
ATOM  10571  CB   ALA D 268     100.202  49.378 282.075  1.00 23.52           C
ATOM  10572  N    TRP D 269      97.813  49.348 284.118  1.00 23.11           N
ATOM  10573  CA   TRP D 269      96.501  49.806 284.575  1.00 23.74           C
ATOM  10574  C    TRP D 269      96.592  50.230 286.036  1.00 23.02           C
ATOM  10575  O    TRP D 269      96.099  51.308 286.425  1.00 22.88           O
ATOM  10576  CB   TRP D 269      95.509  48.658 284.351  1.00 25.27           C
ATOM  10577  CG   TRP D 269      94.159  48.725 284.932  1.00 26.81           C
ATOM  10578  CD1  TRP D 269      93.666  49.636 285.819  1.00 28.33           C
ATOM  10579  CD2  TRP D 269      93.115  47.764 284.717  1.00 29.39           C
ATOM  10580  NE1  TRP D 269      92.376  49.316 286.160  1.00 30.26           N
ATOM  10581  CE2  TRP D 269      92.008  48.167 285.502  1.00 30.48           C
ATOM  10582  CE3  TRP D 269      93.006  46.590 283.933  1.00 30.25           C
ATOM  10583  CZ2  TRP D 269      90.791  47.438 285.531  1.00 29.54           C
ATOM  10584  CZ3  TRP D 269      91.793  45.860 283.962  1.00 28.52           C
ATOM  10585  CH2  TRP D 269      90.706  46.304 284.756  1.00 29.78           C
ATOM  10586  N    THR D 270      97.233  49.394 286.854  1.00 22.20           N
ATOM  10587  CA   THR D 270      97.259  49.638 288.300  1.00 21.53           C
ATOM  10588  C    THR D 270      97.941  50.941 288.618  1.00 20.98           C
ATOM  10589  O    THR D 270      97.374  51.768 289.305  1.00 20.80           O
ATOM  10590  CB   THR D 270      97.945  48.492 289.031  1.00 21.85           C
ATOM  10591  OG1  THR D 270      97.203  47.300 288.783  1.00 22.22           O
```

Appendix 2

```
ATOM  10592  CG2 THR D 270      97.982  48.724 290.492  1.00 22.23           C
ATOM  10593  N   LEU D 271      99.145  51.124 288.074  1.00 20.32           N
ATOM  10594  CA  LEU D 271      99.929  52.331 288.275  1.00 19.46           C
ATOM  10595  C   LEU D 271      99.237  53.565 287.725  1.00 20.33           C
ATOM  10596  O   LEU D 271      99.312  54.623 288.309  1.00 21.07           O
ATOM  10597  CB  LEU D 271     101.288  52.189 287.609  1.00 18.41           C
ATOM  10598  CG  LEU D 271     102.215  51.154 288.202  1.00 18.02           C
ATOM  10599  CD1 LEU D 271     103.534  51.196 287.480  1.00 18.23           C
ATOM  10600  CD2 LEU D 271     102.429  51.382 289.679  1.00 18.69           C
ATOM  10601  N   ALA D 272      98.594  53.429 286.577  1.00 21.08           N
ATOM  10602  CA  ALA D 272      97.791  54.502 286.028  1.00 21.53           C
ATOM  10603  C   ALA D 272      96.801  54.992 287.068  1.00 23.08           C
ATOM  10604  O   ALA D 272      96.771  56.176 287.403  1.00 23.32           O
ATOM  10605  CB  ALA D 272      97.054  54.020 284.808  1.00 21.29           C
ATOM  10606  N   MET D 273      96.001  54.077 287.599  1.00 24.70           N
ATOM  10607  CA  MET D 273      95.009  54.458 288.603  1.00 25.31           C
ATOM  10608  C   MET D 273      95.642  54.851 289.905  1.00 23.30           C
ATOM  10609  O   MET D 273      95.235  55.814 290.503  1.00 23.66           O
ATOM  10610  CB  MET D 273      94.001  53.344 288.845  1.00 27.38           C
ATOM  10611  CG  MET D 273      93.206  53.047 287.590  1.00 30.76           C
ATOM  10612  SD  MET D 273      91.490  52.667 287.884  1.00 33.21           S
ATOM  10613  CE  MET D 273      90.877  52.744 286.207  1.00 34.43           C
ATOM  10614  N   VAL D 274      96.633  54.117 290.365  1.00 22.95           N
ATOM  10615  CA  VAL D 274      97.223  54.465 291.656  1.00 23.42           C
ATOM  10616  C   VAL D 274      97.799  55.884 291.610  1.00 23.37           C
ATOM  10617  O   VAL D 274      97.759  56.613 292.599  1.00 22.45           O
ATOM  10618  CB  VAL D 274      98.297  53.460 292.105  1.00 22.16           C
ATOM  10619  CG1 VAL D 274      98.999  53.954 293.338  1.00 21.70           C
ATOM  10620  CG2 VAL D 274      97.673  52.112 292.408  1.00 22.72           C
ATOM  10621  N   HIS D 275      98.310  56.277 290.449  1.00 22.88           N
ATOM  10622  CA  HIS D 275      98.842  57.621 290.280  1.00 23.18           C
ATOM  10623  C   HIS D 275      97.848  58.698 290.674  1.00 22.93           C
ATOM  10624  O   HIS D 275      98.238  59.753 291.163  1.00 24.21           O
ATOM  10625  CB  HIS D 275      99.288  57.850 288.851  1.00 22.77           C
ATOM  10626  CG  HIS D 275     100.071  59.089 288.681  1.00 23.20           C
ATOM  10627  ND1 HIS D 275      99.596  60.176 287.986  1.00 23.69           N
ATOM  10628  CD2 HIS D 275     101.295  59.436 289.140  1.00 24.21           C
ATOM  10629  CE1 HIS D 275     100.509  61.132 287.993  1.00 23.38           C
ATOM  10630  NE2 HIS D 275     101.545  60.713 288.696  1.00 23.70           N
ATOM  10631  N   GLY D 276      96.570  58.428 290.454  1.00 22.66           N
ATOM  10632  CA  GLY D 276      95.505  59.339 290.859  1.00 23.17           C
ATOM  10633  C   GLY D 276      95.317  59.466 292.365  1.00 23.51           C
ATOM  10634  O   GLY D 276      94.773  60.454 292.840  1.00 25.09           O
ATOM  10635  N   MET D 277      95.748  58.469 293.118  1.00 23.90           N
ATOM  10636  CA  MET D 277      95.585  58.462 294.576  1.00 24.43           C
ATOM  10637  C   MET D 277      96.872  58.716 295.374  1.00 23.67           C
ATOM  10638  O   MET D 277      96.850  59.309 296.446  1.00 23.58           O
ATOM  10639  CB  MET D 277      94.971  57.135 294.992  1.00 24.69           C
ATOM  10640  CG  MET D 277      93.571  56.919 294.434  1.00 24.56           C
ATOM  10641  SD  MET D 277      92.951  55.276 294.808  1.00 25.13           S
ATOM  10642  CE  MET D 277      93.883  54.308 293.630  1.00 25.31           C
ATOM  10643  N   ASP D 278      97.984  58.287 294.826  1.00 23.43           N
ATOM  10644  CA  ASP D 278      99.266  58.447 295.456  1.00 23.54           C
ATOM  10645  C   ASP D 278     100.265  58.510 294.306  1.00 22.68           C
```

Appendix 2

```
ATOM  10646  O   ASP D 278     100.896  57.526 293.939  1.00 21.09           O
ATOM  10647  CB  ASP D 278      99.502  57.258 296.366  1.00 24.88           C
ATOM  10648  CG  ASP D 278     100.832  57.289 297.064  1.00 25.14           C
ATOM  10649  OD1 ASP D 278     101.756  58.042 296.667  1.00 25.01           O
ATOM  10650  OD2 ASP D 278     100.934  56.508 298.031  1.00 26.55           O
ATOM  10651  N   PRO D 279     100.369  59.681 293.703  1.00 21.98           N
ATOM  10652  CA  PRO D 279     101.232  59.867 292.563  1.00 22.18           C
ATOM  10653  C   PRO D 279     102.672  59.436 292.807  1.00 22.60           C
ATOM  10654  O   PRO D 279     103.342  58.982 291.875  1.00 23.01           O
ATOM  10655  CB  PRO D 279     101.184  61.396 292.317  1.00 22.44           C
ATOM  10656  CG  PRO D 279     100.403  61.993 293.442  1.00 21.76           C
ATOM  10657  CD  PRO D 279      99.604  60.892 294.051  1.00 22.02           C
ATOM  10658  N   ALA D 280     103.164  59.609 294.024  1.00 22.26           N
ATOM  10659  CA  ALA D 280     104.552  59.244 294.316  1.00 23.40           C
ATOM  10660  C   ALA D 280     104.805  57.720 294.180  1.00 23.62           C
ATOM  10661  O   ALA D 280     105.925  57.287 293.839  1.00 23.43           O
ATOM  10662  CB  ALA D 280     104.956  59.738 295.700  1.00 22.93           C
ATOM  10663  N   PHE D 281     103.767  56.928 294.427  1.00 23.44           N
ATOM  10664  CA  PHE D 281     103.871  55.473 294.400  1.00 24.49           C
ATOM  10665  C   PHE D 281     104.154  55.034 292.985  1.00 26.13           C
ATOM  10666  O   PHE D 281     105.091  54.266 292.746  1.00 26.07           O
ATOM  10667  CB  PHE D 281     102.564  54.867 294.904  1.00 24.70           C
ATOM  10668  CG  PHE D 281     102.514  53.361 294.893  1.00 24.02           C
ATOM  10669  CD1 PHE D 281     102.393  52.658 293.707  1.00 23.52           C
ATOM  10670  CD2 PHE D 281     102.504  52.649 296.084  1.00 23.41           C
ATOM  10671  CE1 PHE D 281     102.307  51.279 293.703  1.00 22.58           C
ATOM  10672  CE2 PHE D 281     102.421  51.277 296.079  1.00 22.39           C
ATOM  10673  CZ  PHE D 281     102.314  50.593 294.888  1.00 22.26           C
ATOM  10674  N   SER D 282     103.333  55.525 292.051  1.00 27.57           N
ATOM  10675  CA  SER D 282     103.531  55.281 290.615  1.00 27.34           C
ATOM  10676  C   SER D 282     104.749  55.990 290.045  1.00 26.99           C
ATOM  10677  O   SER D 282     105.360  55.490 289.113  1.00 25.21           O
ATOM  10678  CB  SER D 282     102.302  55.702 289.825  1.00 27.55           C
ATOM  10679  OG  SER D 282     101.172  54.975 290.270  1.00 30.03           O
ATOM  10680  N   GLU D 283     105.095  57.157 290.583  1.00 28.75           N
ATOM  10681  CA  GLU D 283     106.314  57.861 290.141  1.00 32.02           C
ATOM  10682  C   GLU D 283     107.569  57.012 290.436  1.00 32.86           C
ATOM  10683  O   GLU D 283     108.472  56.895 289.585  1.00 33.32           O
ATOM  10684  CB  GLU D 283     106.421  59.290 290.739  1.00 32.13           C
ATOM  10685  CG  GLU D 283     105.704  60.388 289.923  1.00 32.64           C
ATOM  10686  CD  GLU D 283     105.174  61.533 290.789  1.00 34.23           C
ATOM  10687  OE1 GLU D 283     105.892  61.974 291.720  1.00 33.88           O
ATOM  10688  OE2 GLU D 283     104.035  61.999 290.550  1.00 33.35           O
ATOM  10689  N   ARG D 284     107.581  56.403 291.625  1.00 31.70           N
ATOM  10690  CA  ARG D 284     108.664  55.513 292.066  1.00 31.25           C
ATOM  10691  C   ARG D 284     108.938  54.276 291.174  1.00 28.28           C
ATOM  10692  O   ARG D 284     110.106  53.959 290.944  1.00 27.37           O
ATOM  10693  CB  ARG D 284     108.396  55.059 293.509  1.00 34.56           C
ATOM  10694  CG  ARG D 284     109.018  53.719 293.858  1.00 39.47           C
ATOM  10695  CD  ARG D 284     108.757  53.306 295.302  1.00 42.89           C
ATOM  10696  NE  ARG D 284     109.736  53.895 296.215  1.00 43.92           N
ATOM  10697  CZ  ARG D 284     109.440  54.575 297.320  1.00 45.71           C
ATOM  10698  NH1 ARG D 284     108.165  54.772 297.684  1.00 48.32           N
ATOM  10699  NH2 ARG D 284     110.436  55.060 298.069  1.00 43.82           N
```

Appendix 2

```
ATOM  10700  N    TYR D 285     107.886  53.581 290.704  1.00 24.83      N
ATOM  10701  CA   TYR D 285     108.032  52.310 289.954  1.00 23.01      C
ATOM  10702  C    TYR D 285     107.977  52.440 288.462  1.00 21.04      C
ATOM  10703  O    TYR D 285     108.309  51.510 287.740  1.00 20.55      O
ATOM  10704  CB   TYR D 285     106.947  51.297 290.344  1.00 23.70      C
ATOM  10705  CG   TYR D 285     107.010  50.900 291.770  1.00 24.12      C
ATOM  10706  CD1  TYR D 285     108.093  50.198 292.252  1.00 24.74      C
ATOM  10707  CD2  TYR D 285     105.992  51.236 292.647  1.00 25.27      C
ATOM  10708  CE1  TYR D 285     108.183  49.848 293.581  1.00 24.82      C
ATOM  10709  CE2  TYR D 285     106.064  50.891 293.979  1.00 26.30      C
ATOM  10710  CZ   TYR D 285     107.169  50.194 294.440  1.00 26.53      C
ATOM  10711  OH   TYR D 285     107.235  49.834 295.766  1.00 27.06      O
ATOM  10712  N    TYR D 286     107.520  53.580 287.990  1.00 21.55      N
ATOM  10713  CA   TYR D 286     107.286  53.776 286.562  1.00 20.67      C
ATOM  10714  C    TYR D 286     108.569  53.569 285.755  1.00 20.95      C
ATOM  10715  O    TYR D 286     108.528  52.905 284.725  1.00 23.90      O
ATOM  10716  CB   TYR D 286     106.652  55.161 286.310  1.00 19.29      C
ATOM  10717  CG   TYR D 286     106.379  55.478 284.872  1.00 18.25      C
ATOM  10718  CD1  TYR D 286     105.615  54.613 284.104  1.00 17.48      C
ATOM  10719  CD2  TYR D 286     106.863  56.654 284.272  1.00 16.96      C
ATOM  10720  CE1  TYR D 286     105.343  54.878 282.784  1.00 16.92      C
ATOM  10721  CE2  TYR D 286     106.592  56.926 282.941  1.00 16.57      C
ATOM  10722  CZ   TYR D 286     105.820  56.036 282.208  1.00 16.92      C
ATOM  10723  OH   TYR D 286     105.520  56.230 280.875  1.00 17.34      O
ATOM  10724  N    PRO D 287     109.713  54.114 286.214  1.00 20.52      N
ATOM  10725  CA   PRO D 287     110.911  53.945 285.374  1.00 20.90      C
ATOM  10726  C    PRO D 287     111.308  52.497 285.172  1.00 20.97      C
ATOM  10727  O    PRO D 287     111.744  52.119 284.058  1.00 20.52      O
ATOM  10728  CB   PRO D 287     111.996  54.696 286.139  1.00 20.48      C
ATOM  10729  CG   PRO D 287     111.247  55.724 286.930  1.00 20.97      C
ATOM  10730  CD   PRO D 287     109.964  55.042 287.332  1.00 20.92      C
ATOM  10731  N    ARG D 288     111.125  51.705 286.235  1.00 20.10      N
ATOM  10732  CA   ARG D 288     111.507  50.297 286.249  1.00 19.87      C
ATOM  10733  C    ARG D 288     110.525  49.514 285.433  1.00 20.32      C
ATOM  10734  O    ARG D 288     110.908  48.663 284.636  1.00 21.43      O
ATOM  10735  CB   ARG D 288     111.545  49.753 287.678  1.00 20.22      C
ATOM  10736  CG   ARG D 288     112.595  50.392 288.580  1.00 20.23      C
ATOM  10737  CD   ARG D 288     112.370  50.013 290.028  1.00 21.06      C
ATOM  10738  NE   ARG D 288     112.431  51.176 290.912  1.00 22.37      N
ATOM  10739  CZ   ARG D 288     112.158  51.158 292.209  1.00 22.61      C
ATOM  10740  NH1  ARG D 288     111.804  50.039 292.818  1.00 23.69      N
ATOM  10741  NH2  ARG D 288     112.245  52.277 292.910  1.00 23.20      N
ATOM  10742  N    PHE D 289     109.246  49.822 285.599  1.00 20.89      N
ATOM  10743  CA   PHE D 289     108.228  49.194 284.781  1.00 21.07      C
ATOM  10744  C    PHE D 289     108.638  49.304 283.329  1.00 21.58      C
ATOM  10745  O    PHE D 289     108.647  48.301 282.617  1.00 22.56      O
ATOM  10746  CB   PHE D 289     106.861  49.848 284.988  1.00 21.30      C
ATOM  10747  CG   PHE D 289     105.911  49.603 283.860  1.00 20.98      C
ATOM  10748  CD1  PHE D 289     105.170  48.441 283.810  1.00 20.37      C
ATOM  10749  CD2  PHE D 289     105.782  50.536 282.829  1.00 21.27      C
ATOM  10750  CE1  PHE D 289     104.303  48.212 282.767  1.00 20.92      C
ATOM  10751  CE2  PHE D 289     104.924  50.314 281.766  1.00 21.47      C
ATOM  10752  CZ   PHE D 289     104.180  49.145 281.735  1.00 21.87      C
ATOM  10753  N    LYS D 290     108.970  50.523 282.895  1.00 21.73      N
```

Appendix 2

```
ATOM  10754  CA   LYS D 290     109.501  50.732 281.535  1.00 22.96           C
ATOM  10755  C    LYS D 290     110.772  49.899 281.217  1.00 22.09           C
ATOM  10756  O    LYS D 290     110.785  49.282 280.167  1.00 19.92           O
ATOM  10757  CB   LYS D 290     109.734  52.225 281.233  1.00 24.29           C
ATOM  10758  CG   LYS D 290     108.450  53.016 280.984  1.00 25.51           C
ATOM  10759  CD   LYS D 290     108.668  54.516 281.175  1.00 27.62           C
ATOM  10760  CE   LYS D 290     109.628  55.071 280.127  1.00 29.44           C
ATOM  10761  NZ   LYS D 290     109.939  56.504 280.370  1.00 29.40           N
ATOM  10762  N    GLN D 291     111.806  49.880 282.097  1.00 21.40           N
ATOM  10763  CA   GLN D 291     113.018  49.070 281.819  1.00 22.28           C
ATOM  10764  C    GLN D 291     112.577  47.629 281.643  1.00 21.84           C
ATOM  10765  O    GLN D 291     113.016  46.969 280.740  1.00 22.16           O
ATOM  10766  CB   GLN D 291     114.159  49.178 282.884  1.00 21.01           C
ATOM  10767  N    THR D 292     111.666  47.157 282.486  1.00 22.48           N
ATOM  10768  CA   THR D 292     111.268  45.758 282.445  1.00 21.97           C
ATOM  10769  C    THR D 292     110.514  45.380 281.201  1.00 21.97           C
ATOM  10770  O    THR D 292     110.846  44.404 280.572  1.00 23.50           O
ATOM  10771  CB   THR D 292     110.380  45.382 283.630  1.00 21.97           C
ATOM  10772  OG1  THR D 292     111.025  45.761 284.842  1.00 20.11           O
ATOM  10773  CG2  THR D 292     110.099  43.865 283.643  1.00 22.76           C
ATOM  10774  N    PHE D 293     109.497  46.134 280.826  1.00 22.07           N
ATOM  10775  CA   PHE D 293     108.550  45.627 279.823  1.00 21.53           C
ATOM  10776  C    PHE D 293     108.603  46.277 278.442  1.00 19.89           C
ATOM  10777  O    PHE D 293     108.159  45.674 277.494  1.00 20.12           O
ATOM  10778  CB   PHE D 293     107.119  45.754 280.362  1.00 21.51           C
ATOM  10779  CG   PHE D 293     106.790  44.806 281.465  1.00 22.57           C
ATOM  10780  CD1  PHE D 293     106.991  43.443 281.325  1.00 22.50           C
ATOM  10781  CD2  PHE D 293     106.204  45.270 282.633  1.00 23.49           C
ATOM  10782  CE1  PHE D 293     106.644  42.569 282.341  1.00 22.17           C
ATOM  10783  CE2  PHE D 293     105.842  44.401 283.646  1.00 21.98           C
ATOM  10784  CZ   PHE D 293     106.076  43.050 283.502  1.00 22.33           C
ATOM  10785  N    VAL D 294     109.092  47.505 278.327  1.00 19.29           N
ATOM  10786  CA   VAL D 294     108.943  48.269 277.079  1.00 20.01           C
ATOM  10787  C    VAL D 294     110.119  48.148 276.131  1.00 20.42           C
ATOM  10788  O    VAL D 294     111.207  48.435 276.513  1.00 18.74           O
ATOM  10789  CB   VAL D 294     108.742  49.770 277.366  1.00 20.54           C
ATOM  10790  CG1  VAL D 294     108.756  50.589 276.065  1.00 20.00           C
ATOM  10791  CG2  VAL D 294     107.443  49.973 278.146  1.00 20.19           C
ATOM  10792  N    GLU D 295     109.854  47.761 274.880  1.00 23.39           N
ATOM  10793  CA   GLU D 295     110.830  47.723 273.785  1.00 23.37           C
ATOM  10794  C    GLU D 295     110.539  48.874 272.838  1.00 23.78           C
ATOM  10795  O    GLU D 295     109.514  48.888 272.161  1.00 23.25           O
ATOM  10796  CB   GLU D 295     110.720  46.400 273.001  1.00 24.46           C
ATOM  10797  CG   GLU D 295     111.741  46.221 271.887  1.00 25.34           C
ATOM  10798  CD   GLU D 295     111.373  45.131 270.888  1.00 27.84           C
ATOM  10799  OE1  GLU D 295     110.622  44.196 271.215  1.00 27.40           O
ATOM  10800  OE2  GLU D 295     111.836  45.218 269.728  1.00 32.46           O
ATOM  10801  N    VAL D 296     111.434  49.855 272.833  1.00 24.91           N
ATOM  10802  CA   VAL D 296     111.510  50.871 271.792  1.00 24.72           C
ATOM  10803  C    VAL D 296     112.152  50.225 270.582  1.00 25.46           C
ATOM  10804  O    VAL D 296     113.049  49.380 270.720  1.00 26.94           O
ATOM  10805  CB   VAL D 296     112.351  52.072 272.278  1.00 25.17           C
ATOM  10806  CG1  VAL D 296     112.710  53.036 271.152  1.00 24.63           C
ATOM  10807  CG2  VAL D 296     111.587  52.807 273.371  1.00 25.42           C
```

Appendix 2

```
ATOM  10808  N    TYR D 297     111.694  50.600 269.394  1.00 25.24           N
ATOM  10809  CA   TYR D 297     112.234  50.026 268.165  1.00 24.59           C
ATOM  10810  C    TYR D 297     112.018  50.988 266.996  1.00 26.92           C
ATOM  10811  O    TYR D 297     111.439  52.079 267.180  1.00 27.24           O
ATOM  10812  CB   TYR D 297     111.625  48.637 267.902  1.00 23.25           C
ATOM  10813  CG   TYR D 297     110.175  48.638 267.462  1.00 23.19           C
ATOM  10814  CD1  TYR D 297     109.134  48.653 268.393  1.00 22.40           C
ATOM  10815  CD2  TYR D 297     109.843  48.630 266.111  1.00 22.52           C
ATOM  10816  CE1  TYR D 297     107.812  48.648 267.988  1.00 21.53           C
ATOM  10817  CE2  TYR D 297     108.531  48.645 265.702  1.00 22.06           C
ATOM  10818  CZ   TYR D 297     107.523  48.634 266.646  1.00 21.51           C
ATOM  10819  OH   TYR D 297     106.235  48.657 266.215  1.00 20.00           O
ATOM  10820  N    ASP D 298     112.502  50.604 265.810  1.00 29.23           N
ATOM  10821  CA   ASP D 298     112.406  51.462 264.622  1.00 30.32           C
ATOM  10822  C    ASP D 298     113.061  52.825 264.920  1.00 29.28           C
ATOM  10823  O    ASP D 298     112.445  53.890 264.736  1.00 28.22           O
ATOM  10824  CB   ASP D 298     110.939  51.618 264.207  1.00 31.85           C
ATOM  10825  CG   ASP D 298     110.768  52.299 262.873  1.00 34.42           C
ATOM  10826  OD1  ASP D 298     111.488  51.929 261.927  1.00 37.25           O
ATOM  10827  OD2  ASP D 298     109.897  53.199 262.768  1.00 35.86           O
ATOM  10828  N    GLU D 299     114.298  52.767 265.425  1.00 28.01           N
ATOM  10829  CA   GLU D 299     115.131  53.947 265.589  1.00 27.47           C
ATOM  10830  C    GLU D 299     114.457  54.921 266.544  1.00 25.99           C
ATOM  10831  O    GLU D 299     114.574  56.130 266.404  1.00 25.58           O
ATOM  10832  CB   GLU D 299     115.425  54.606 264.210  1.00 29.43           C
ATOM  10833  CG   GLU D 299     115.921  53.610 263.145  1.00 32.54           C
ATOM  10834  CD   GLU D 299     116.606  54.240 261.923  1.00 35.18           C
ATOM  10835  OE1  GLU D 299     117.831  54.036 261.745  1.00 36.93           O
ATOM  10836  OE2  GLU D 299     115.936  54.910 261.110  1.00 36.42           O
ATOM  10837  N    GLY D 300     113.724  54.405 267.517  1.00 25.33           N
ATOM  10838  CA   GLY D 300     113.156  55.280 268.568  1.00 24.98           C
ATOM  10839  C    GLY D 300     111.815  55.954 268.284  1.00 23.97           C
ATOM  10840  O    GLY D 300     111.322  56.714 269.111  1.00 20.13           O
ATOM  10841  N    ARG D 301     111.227  55.657 267.126  1.00 24.44           N
ATOM  10842  CA   ARG D 301     109.895  56.157 266.763  1.00 25.67           C
ATOM  10843  C    ARG D 301     108.701  55.364 267.310  1.00 24.99           C
ATOM  10844  O    ARG D 301     107.577  55.873 267.287  1.00 24.98           O
ATOM  10845  CB   ARG D 301     109.740  56.164 265.247  1.00 26.67           C
ATOM  10846  CG   ARG D 301     110.370  57.357 264.564  1.00 27.50           C
ATOM  10847  CD   ARG D 301     110.377  57.116 263.070  1.00 27.91           C
ATOM  10848  NE   ARG D 301     111.278  56.028 262.681  1.00 28.80           N
ATOM  10849  CZ   ARG D 301     112.386  56.194 261.951  1.00 30.13           C
ATOM  10850  NH1  ARG D 301     112.735  57.402 261.521  1.00 28.79           N
ATOM  10851  NH2  ARG D 301     113.149  55.143 261.635  1.00 29.89           N
ATOM  10852  N    LYS D 302     108.932  54.117 267.734  1.00 24.15           N
ATOM  10853  CA   LYS D 302     107.858  53.205 268.124  1.00 22.86           C
ATOM  10854  C    LYS D 302     108.250  52.411 269.328  1.00 22.96           C
ATOM  10855  O    LYS D 302     109.446  52.229 269.616  1.00 21.48           O
ATOM  10856  CB   LYS D 302     107.524  52.214 267.020  1.00 23.27           C
ATOM  10857  CG   LYS D 302     107.162  52.897 265.726  1.00 25.41           C
ATOM  10858  CD   LYS D 302     106.714  51.974 264.597  1.00 26.20           C
ATOM  10859  CE   LYS D 302     106.187  52.847 263.464  1.00 27.28           C
ATOM  10860  NZ   LYS D 302     106.651  52.402 262.129  1.00 29.15           N
ATOM  10861  N    ALA D 303     107.219  51.928 270.019  1.00 22.57           N
```

Appendix 2

```
ATOM  10862  CA   ALA D 303     107.399  51.023 271.119  1.00 23.25           C
ATOM  10863  C    ALA D 303     106.261  50.020 271.183  1.00 25.09           C
ATOM  10864  O    ALA D 303     105.133  50.287 270.715  1.00 23.65           O
ATOM  10865  CB   ALA D 303     107.491  51.795 272.412  1.00 23.11           C
ATOM  10866  N    ARG D 304     106.574  48.868 271.779  1.00 26.14           N
ATOM  10867  CA   ARG D 304     105.594  47.813 272.061  1.00 25.94           C
ATOM  10868  C    ARG D 304     105.975  47.148 273.373  1.00 25.07           C
ATOM  10869  O    ARG D 304     107.132  47.221 273.776  1.00 24.45           O
ATOM  10870  CB   ARG D 304     105.571  46.802 270.912  1.00 27.52           C
ATOM  10871  CG   ARG D 304     106.904  46.100 270.682  1.00 27.82           C
ATOM  10872  CD   ARG D 304     106.914  45.299 269.405  1.00 28.18           C
ATOM  10873  NE   ARG D 304     108.281  44.850 269.146  1.00 30.84           N
ATOM  10874  CZ   ARG D 304     108.871  44.838 267.956  1.00 29.99           C
ATOM  10875  NH1  ARG D 304     110.118  44.435 267.855  1.00 29.91           N
ATOM  10876  NH2  ARG D 304     108.235  45.249 266.873  1.00 30.99           N
ATOM  10877  N    VAL D 305     105.022  46.501 274.040  1.00 25.43           N
ATOM  10878  CA   VAL D 305     105.215  46.083 275.435  1.00 25.74           C
ATOM  10879  C    VAL D 305     105.064  44.598 275.621  1.00 25.18           C
ATOM  10880  O    VAL D 305     104.090  44.017 275.179  1.00 28.46           O
ATOM  10881  CB   VAL D 305     104.219  46.792 276.360  1.00 27.08           C
ATOM  10882  CG1  VAL D 305     104.565  46.571 277.827  1.00 26.91           C
ATOM  10883  CG2  VAL D 305     104.226  48.281 276.055  1.00 27.60           C
ATOM  10884  N    ARG D 306     106.050  43.995 276.269  1.00 24.50           N
ATOM  10885  CA   ARG D 306     106.036  42.579 276.595  1.00 24.21           C
ATOM  10886  C    ARG D 306     105.076  42.375 277.762  1.00 22.82           C
ATOM  10887  O    ARG D 306     104.978  43.226 278.629  1.00 20.87           O
ATOM  10888  CB   ARG D 306     107.434  42.117 276.999  1.00 24.15           C
ATOM  10889  CG   ARG D 306     108.474  42.253 275.903  1.00 25.13           C
ATOM  10890  CD   ARG D 306     109.808  41.654 276.339  1.00 25.40           C
ATOM  10891  NE   ARG D 306     110.454  42.592 277.245  1.00 26.36           N
ATOM  10892  CZ   ARG D 306     111.197  43.631 276.860  1.00 24.58           C
ATOM  10893  NH1  ARG D 306     111.422  43.865 275.573  1.00 24.97           N
ATOM  10894  NH2  ARG D 306     111.696  44.448 277.769  1.00 22.94           N
ATOM  10895  N    GLU D 307     104.369  41.255 277.781  1.00 22.33           N
ATOM  10896  CA   GLU D 307     103.354  41.042 278.818  1.00 24.10           C
ATOM  10897  C    GLU D 307     103.956  40.389 280.071  1.00 23.17           C
ATOM  10898  O    GLU D 307     103.383  40.464 281.138  1.00 21.40           O
ATOM  10899  CB   GLU D 307     102.164  40.229 278.271  1.00 23.88           C
ATOM  10900  CG   GLU D 307     101.250  39.612 279.324  1.00 25.23           C
ATOM  10901  CD   GLU D 307     100.569  40.621 280.231  1.00 27.09           C
ATOM  10902  OE1  GLU D 307     100.428  41.809 279.815  1.00 28.65           O
ATOM  10903  OE2  GLU D 307     100.178  40.214 281.366  1.00 26.38           O
ATOM  10904  N    THR D 308     105.113  39.759 279.930  1.00 24.15           N
ATOM  10905  CA   THR D 308     105.725  39.056 281.049  1.00 25.97           C
ATOM  10906  C    THR D 308     107.243  38.948 280.846  1.00 28.29           C
ATOM  10907  O    THR D 308     107.801  39.637 279.987  1.00 29.89           O
ATOM  10908  CB   THR D 308     105.010  37.701 281.287  1.00 24.87           C
ATOM  10909  OG1  THR D 308     105.267  37.250 282.610  1.00 24.73           O
ATOM  10910  CG2  THR D 308     105.446  36.667 280.297  1.00 24.70           C
ATOM  10911  N    ALA D 309     107.913  38.103 281.622  1.00 30.96           N
ATOM  10912  CA   ALA D 309     109.352  38.224 281.799  1.00 30.41           C
ATOM  10913  C    ALA D 309     110.216  37.254 281.000  1.00 33.70           C
ATOM  10914  O    ALA D 309     111.389  37.544 280.700  1.00 38.57           O
ATOM  10915  CB   ALA D 309     109.686  38.116 283.273  1.00 29.62           C
```

Appendix 2

```
ATOM  10916  N    GLY D 310   109.724  36.091 280.641  1.00 32.85           N
ATOM  10917  CA   GLY D 310   110.700  35.159 280.037  1.00 31.24           C
ATOM  10918  C    GLY D 310   110.699  35.163 278.530  1.00 28.79           C
ATOM  10919  O    GLY D 310   110.701  34.090 277.938  1.00 29.82           O
ATOM  10920  N    THR D 311   110.665  36.339 277.898  1.00 26.59           N
ATOM  10921  CA   THR D 311   110.260  36.388 276.494  1.00 24.99           C
ATOM  10922  C    THR D 311   110.599  37.678 275.819  1.00 26.58           C
ATOM  10923  O    THR D 311   110.780  38.681 276.471  1.00 28.24           O
ATOM  10924  CB   THR D 311   108.728  36.175 276.354  1.00 24.37           C
ATOM  10925  OG1  THR D 311   108.371  35.994 274.984  1.00 24.44           O
ATOM  10926  CG2  THR D 311   107.913  37.355 276.909  1.00 23.56           C
ATOM  10927  N    ASP D 312   110.645  37.644 274.496  1.00 28.41           N
ATOM  10928  CA   ASP D 312   110.758  38.839 273.670  1.00 29.33           C
ATOM  10929  C    ASP D 312   109.478  39.160 272.941  1.00 29.19           C
ATOM  10930  O    ASP D 312   109.430  40.166 272.227  1.00 28.05           O
ATOM  10931  CB   ASP D 312   111.826  38.637 272.587  1.00 30.29           C
ATOM  10932  CG   ASP D 312   113.138  38.280 273.163  1.00 32.07           C
ATOM  10933  OD1  ASP D 312   113.433  38.841 274.236  1.00 31.72           O
ATOM  10934  OD2  ASP D 312   113.844  37.424 272.572  1.00 35.39           O
ATOM  10935  N    ASP D 313   108.467  38.295 273.051  1.00 29.11           N
ATOM  10936  CA   ASP D 313   107.169  38.542 272.390  1.00 27.74           C
ATOM  10937  C    ASP D 313   106.418  39.741 272.986  1.00 27.49           C
ATOM  10938  O    ASP D 313   106.435  39.984 274.216  1.00 26.36           O
ATOM  10939  CB   ASP D 313   106.287  37.318 272.498  1.00 27.52           C
ATOM  10940  CG   ASP D 313   106.897  36.120 271.846  1.00 29.64           C
ATOM  10941  OD1  ASP D 313   107.445  36.256 270.722  1.00 30.22           O
ATOM  10942  OD2  ASP D 313   106.825  35.035 272.459  1.00 30.80           O
ATOM  10943  N    ALA D 314   105.758  40.499 272.117  1.00 27.57           N
ATOM  10944  CA   ALA D 314   104.956  41.646 272.575  1.00 28.24           C
ATOM  10945  C    ALA D 314   103.506  41.248 272.765  1.00 27.47           C
ATOM  10946  O    ALA D 314   102.956  40.489 271.991  1.00 25.57           O
ATOM  10947  CB   ALA D 314   105.053  42.833 271.609  1.00 27.78           C
ATOM  10948  N    ASP D 315   102.892  41.784 273.808  1.00 28.19           N
ATOM  10949  CA   ASP D 315   101.454  41.774 273.912  1.00 27.84           C
ATOM  10950  C    ASP D 315   100.910  40.366 273.938  1.00 25.59           C
ATOM  10951  O    ASP D 315    99.977  40.057 273.232  1.00 25.12           O
ATOM  10952  CB   ASP D 315   100.832  42.589 272.756  1.00 28.82           C
ATOM  10953  CG   ASP D 315   100.960  44.093 272.960  1.00 29.61           C
ATOM  10954  OD1  ASP D 315   100.384  44.627 273.936  1.00 32.71           O
ATOM  10955  OD2  ASP D 315   101.608  44.749 272.129  1.00 29.02           O
ATOM  10956  N    GLY D 316   101.496  39.509 274.760  1.00 25.41           N
ATOM  10957  CA   GLY D 316   100.949  38.165 274.959  1.00 25.23           C
ATOM  10958  C    GLY D 316    99.814  38.177 275.980  1.00 24.26           C
ATOM  10959  O    GLY D 316    99.304  39.229 276.359  1.00 23.49           O
ATOM  10960  N    GLY D 317    99.433  37.002 276.448  1.00 23.96           N
ATOM  10961  CA   GLY D 317    98.389  36.910 277.432  1.00 25.07           C
ATOM  10962  C    GLY D 317    97.125  37.482 276.825  1.00 26.21           C
ATOM  10963  O    GLY D 317    96.741  37.065 275.726  1.00 25.72           O
ATOM  10964  N    VAL D 318    96.503  38.457 277.512  1.00 25.12           N
ATOM  10965  CA   VAL D 318    95.287  39.091 277.007  1.00 24.24           C
ATOM  10966  C    VAL D 318    95.554  40.040 275.865  1.00 22.82           C
ATOM  10967  O    VAL D 318    94.628  40.498 275.228  1.00 23.06           O
ATOM  10968  CB   VAL D 318    94.500  39.854 278.104  1.00 25.63           C
ATOM  10969  CG1  VAL D 318    94.042  38.890 279.173  1.00 26.54           C
```

Appendix 2

```
ATOM  10970  CG2 VAL D 318      95.315  40.973 278.744  1.00 26.33           C
ATOM  10971  N   GLY D 319      96.812  40.366 275.617  1.00 22.81           N
ATOM  10972  CA  GLY D 319      97.176  41.229 274.489  1.00 22.92           C
ATOM  10973  C   GLY D 319      96.913  42.715 274.705  1.00 23.12           C
ATOM  10974  O   GLY D 319      96.815  43.464 273.746  1.00 23.52           O
ATOM  10975  N   LEU D 320      96.859  43.151 275.955  1.00 23.12           N
ATOM  10976  CA  LEU D 320      96.541  44.534 276.256  1.00 25.41           C
ATOM  10977  C   LEU D 320      97.688  45.332 276.906  1.00 25.11           C
ATOM  10978  O   LEU D 320      97.445  46.382 277.496  1.00 24.14           O
ATOM  10979  CB  LEU D 320      95.307  44.562 277.173  1.00 26.35           C
ATOM  10980  CG  LEU D 320      94.081  43.905 276.541  1.00 28.00           C
ATOM  10981  CD1 LEU D 320      92.899  43.820 277.510  1.00 28.50           C
ATOM  10982  CD2 LEU D 320      93.692  44.643 275.261  1.00 28.51           C
ATOM  10983  N   ALA D 321      98.923  44.839 276.810  1.00 25.36           N
ATOM  10984  CA  ALA D 321     100.058  45.477 277.493  1.00 24.14           C
ATOM  10985  C   ALA D 321     100.327  46.846 276.890  1.00 24.84           C
ATOM  10986  O   ALA D 321     100.445  47.863 277.616  1.00 23.00           O
ATOM  10987  CB  ALA D 321     101.297  44.629 277.387  1.00 23.40           C
ATOM  10988  N   SER D 322     100.400  46.878 275.560  1.00 22.81           N
ATOM  10989  CA  SER D 322     100.726  48.108 274.894  1.00 23.37           C
ATOM  10990  C   SER D 322      99.615  49.143 275.059  1.00 23.91           C
ATOM  10991  O   SER D 322      99.883  50.327 275.338  1.00 24.06           O
ATOM  10992  CB  SER D 322     101.057  47.851 273.425  1.00 24.24           C
ATOM  10993  OG  SER D 322     102.314  47.207 273.314  1.00 23.76           O
ATOM  10994  N   ALA D 323      98.375  48.692 274.917  1.00 23.79           N
ATOM  10995  CA  ALA D 323      97.222  49.563 275.111  1.00 24.65           C
ATOM  10996  C   ALA D 323      97.159  50.212 276.497  1.00 24.83           C
ATOM  10997  O   ALA D 323      96.923  51.416 276.603  1.00 25.75           O
ATOM  10998  CB  ALA D 323      95.932  48.809 274.822  1.00 25.33           C
ATOM  10999  N   PHE D 324      97.365  49.445 277.566  1.00 26.47           N
ATOM  11000  CA  PHE D 324      97.227  50.016 278.920  1.00 25.68           C
ATOM  11001  C   PHE D 324      98.399  50.879 279.196  1.00 25.32           C
ATOM  11002  O   PHE D 324      98.263  51.904 279.826  1.00 27.73           O
ATOM  11003  CB  PHE D 324      97.076  48.956 279.985  1.00 26.50           C
ATOM  11004  CG  PHE D 324      95.659  48.495 280.165  1.00 28.04           C
ATOM  11005  CD1 PHE D 324      94.741  49.290 280.834  1.00 29.80           C
ATOM  11006  CD2 PHE D 324      95.228  47.272 279.651  1.00 29.48           C
ATOM  11007  CE1 PHE D 324      93.414  48.884 280.992  1.00 30.30           C
ATOM  11008  CE2 PHE D 324      93.915  46.845 279.824  1.00 29.61           C
ATOM  11009  CZ  PHE D 324      93.005  47.655 280.491  1.00 30.26           C
ATOM  11010  N   THR D 325      99.549  50.502 278.658  1.00 25.90           N
ATOM  11011  CA  THR D 325     100.761  51.285 278.841  1.00 25.14           C
ATOM  11012  C   THR D 325     100.600  52.651 278.199  1.00 24.49           C
ATOM  11013  O   THR D 325     101.016  53.649 278.777  1.00 23.73           O
ATOM  11014  CB  THR D 325     101.999  50.555 278.281  1.00 25.16           C
ATOM  11015  OG1 THR D 325     102.153  49.310 278.954  1.00 25.09           O
ATOM  11016  CG2 THR D 325     103.239  51.351 278.545  1.00 25.27           C
ATOM  11017  N   LEU D 326     100.002  52.687 277.009  1.00 24.05           N
ATOM  11018  CA  LEU D 326      99.597  53.958 276.387  1.00 25.63           C
ATOM  11019  C   LEU D 326      98.811  54.859 277.347  1.00 25.95           C
ATOM  11020  O   LEU D 326      99.068  56.053 277.419  1.00 27.51           O
ATOM  11021  CB  LEU D 326      98.753  53.720 275.124  1.00 25.90           C
ATOM  11022  CG  LEU D 326      98.358  54.973 274.337  1.00 26.25           C
ATOM  11023  CD1 LEU D 326      99.571  55.627 273.717  1.00 27.37           C
```

Appendix 2

```
ATOM  11024  CD2  LEU D 326    97.327  54.685  273.257  1.00  25.31         C
ATOM  11025  N    LEU D 327    97.850  54.281  278.070  1.00  26.08         N
ATOM  11026  CA   LEU D 327    97.100  55.016  279.095  1.00  24.92         C
ATOM  11027  C    LEU D 327    98.011  55.469  280.230  1.00  24.14         C
ATOM  11028  O    LEU D 327    97.881  56.589  280.724  1.00  23.01         O
ATOM  11029  CB   LEU D 327    95.971  54.163  279.676  1.00  24.77         C
ATOM  11030  CG   LEU D 327    95.260  54.664  280.939  1.00  24.82         C
ATOM  11031  CD1  LEU D 327    94.384  55.868  280.658  1.00  23.99         C
ATOM  11032  CD2  LEU D 327    94.408  53.538  281.498  1.00  26.71         C
ATOM  11033  N    LEU D 328    98.926  54.600  280.642  1.00  22.90         N
ATOM  11034  CA   LEU D 328    99.821  54.952  281.723  1.00  22.50         C
ATOM  11035  C    LEU D 328   100.706  56.109  281.289  1.00  22.88         C
ATOM  11036  O    LEU D 328   100.900  57.056  282.051  1.00  22.98         O
ATOM  11037  CB   LEU D 328   100.639  53.744  282.159  1.00  21.45         C
ATOM  11038  CG   LEU D 328   101.720  53.977  283.187  1.00  20.09         C
ATOM  11039  CD1  LEU D 328   101.073  54.375  284.483  1.00  20.85         C
ATOM  11040  CD2  LEU D 328   102.533  52.712  283.368  1.00  20.21         C
ATOM  11041  N    ALA D 329   101.196  56.075  280.054  1.00  24.00         N
ATOM  11042  CA   ALA D 329   102.000  57.198  279.556  1.00  25.47         C
ATOM  11043  C    ALA D 329   101.236  58.508  279.660  1.00  25.36         C
ATOM  11044  O    ALA D 329   101.790  59.515  280.108  1.00  28.36         O
ATOM  11045  CB   ALA D 329   102.459  56.978  278.129  1.00  26.27         C
ATOM  11046  N    ARG D 330    99.970  58.497  279.283  1.00  23.46         N
ATOM  11047  CA   ARG D 330    99.164  59.710  279.347  1.00  23.06         C
ATOM  11048  C    ARG D 330    99.021  60.189  280.782  1.00  22.86         C
ATOM  11049  O    ARG D 330    99.259  61.385  281.093  1.00  23.68         O
ATOM  11050  CB   ARG D 330    97.769  59.458  278.753  1.00  23.40         C
ATOM  11051  CG   ARG D 330    96.978  60.726  278.476  1.00  21.69         C
ATOM  11052  CD   ARG D 330    97.548  61.527  277.327  1.00  21.34         C
ATOM  11053  NE   ARG D 330    96.450  62.273  276.732  1.00  21.37         N
ATOM  11054  CZ   ARG D 330    96.035  63.471  277.134  1.00  21.66         C
ATOM  11055  NH1  ARG D 330    96.661  64.145  278.108  1.00  21.36         N
ATOM  11056  NH2  ARG D 330    94.978  64.000  276.547  1.00  21.33         N
ATOM  11057  N    GLU D 331    98.633  59.261  281.659  1.00  22.68         N
ATOM  11058  CA   GLU D 331    98.534  59.541  283.094  1.00  22.16         C
ATOM  11059  C    GLU D 331    99.813  60.119  283.611  1.00  23.18         C
ATOM  11060  O    GLU D 331    99.777  61.079  284.329  1.00  24.13         O
ATOM  11061  CB   GLU D 331    98.251  58.290  283.878  1.00  22.17         C
ATOM  11062  CG   GLU D 331    98.179  58.490  285.381  1.00  22.75         C
ATOM  11063  CD   GLU D 331    97.043  59.387  285.817  1.00  22.45         C
ATOM  11064  OE1  GLU D 331    95.935  59.306  285.245  1.00  23.38         O
ATOM  11065  OE2  GLU D 331    97.263  60.183  286.734  1.00  21.89         O
ATOM  11066  N    MET D 332   100.944  59.541  283.220  1.00  25.22         N
ATOM  11067  CA   MET D 332   102.243  59.947  283.738  1.00  25.68         C
ATOM  11068  C    MET D 332   102.856  61.121  282.975  1.00  26.51         C
ATOM  11069  O    MET D 332   103.934  61.573  283.325  1.00  24.73         O
ATOM  11070  CB   MET D 332   103.197  58.747  283.710  1.00  27.48         C
ATOM  11071  CG   MET D 332   102.716  57.531  284.514  1.00  27.49         C
ATOM  11072  SD   MET D 332   102.502  57.871  286.257  1.00  27.15         S
ATOM  11073  CE   MET D 332   104.178  58.331  286.683  1.00  27.47         C
ATOM  11074  N    GLY D 333   102.169  61.629  281.947  1.00  29.12         N
ATOM  11075  CA   GLY D 333   102.675  62.766  281.130  1.00  28.31         C
ATOM  11076  C    GLY D 333   103.933  62.466  280.297  1.00  28.30         C
ATOM  11077  O    GLY D 333   104.688  63.368  279.986  1.00  30.26         O
```

Appendix 2

```
ATOM  11078  N    ASP D 334     104.155  61.198 279.948  1.00 26.16           N
ATOM  11079  CA   ASP D 334     105.293  60.735 279.145  1.00 23.99           C
ATOM  11080  C    ASP D 334     104.928  60.797 277.652  1.00 23.64           C
ATOM  11081  O    ASP D 334     104.522  59.801 277.043  1.00 24.55           O
ATOM  11082  CB   ASP D 334     105.590  59.297 279.578  1.00 24.25           C
ATOM  11083  CG   ASP D 334     106.929  58.783 279.108  1.00 25.19           C
ATOM  11084  OD1  ASP D 334     107.509  59.275 278.120  1.00 27.57           O
ATOM  11085  OD2  ASP D 334     107.404  57.837 279.753  1.00 25.51           O
ATOM  11086  N    GLN D 335     105.031  61.991 277.082  1.00 23.76           N
ATOM  11087  CA   GLN D 335     104.756  62.239 275.661  1.00 23.45           C
ATOM  11088  C    GLN D 335     105.560  61.400 274.683  1.00 22.43           C
ATOM  11089  O    GLN D 335     105.047  61.025 273.639  1.00 23.82           O
ATOM  11090  CB   GLN D 335     104.989  63.709 275.318  1.00 23.46           C
ATOM  11091  CG   GLN D 335     103.939  64.647 275.869  1.00 24.61           C
ATOM  11092  CD   GLN D 335     103.895  65.972 275.124  1.00 25.54           C
ATOM  11093  OE1  GLN D 335     104.187  66.045 273.926  1.00 28.49           O
ATOM  11094  NE2  GLN D 335     103.512  67.012 275.817  1.00 24.15           N
ATOM  11095  N    GLN D 336     106.810  61.123 274.999  1.00 22.90           N
ATOM  11096  CA   GLN D 336     107.678  60.366 274.092  1.00 24.01           C
ATOM  11097  C    GLN D 336     107.171  58.936 273.954  1.00 22.61           C
ATOM  11098  O    GLN D 336     106.926  58.452 272.871  1.00 20.79           O
ATOM  11099  CB   GLN D 336     109.131  60.376 274.592  1.00 25.93           C
ATOM  11100  CG   GLN D 336     110.034  59.427 273.815  1.00 29.36           C
ATOM  11101  CD   GLN D 336     111.510  59.576 274.153  1.00 32.66           C
ATOM  11102  OE1  GLN D 336     112.296  59.934 273.289  1.00 36.77           O
ATOM  11103  NE2  GLN D 336     111.894  59.304 275.407  1.00 32.23           N
ATOM  11104  N    LEU D 337     106.996  58.265 275.077  1.00 23.58           N
ATOM  11105  CA   LEU D 337     106.447  56.918 275.061  1.00 24.06           C
ATOM  11106  C    LEU D 337     105.005  56.880 274.502  1.00 23.75           C
ATOM  11107  O    LEU D 337     104.625  55.951 273.790  1.00 22.23           O
ATOM  11108  CB   LEU D 337     106.492  56.334 276.458  1.00 24.08           C
ATOM  11109  CG   LEU D 337     106.052  54.874 276.540  1.00 24.99           C
ATOM  11110  CD1  LEU D 337     106.958  53.939 275.740  1.00 24.88           C
ATOM  11111  CD2  LEU D 337     105.991  54.466 278.007  1.00 25.49           C
ATOM  11112  N    PHE D 338     104.210  57.886 274.819  1.00 23.00           N
ATOM  11113  CA   PHE D 338     102.865  57.942 274.291  1.00 24.36           C
ATOM  11114  C    PHE D 338     102.933  57.880 272.767  1.00 25.06           C
ATOM  11115  O    PHE D 338     102.265  57.048 272.111  1.00 24.32           O
ATOM  11116  CB   PHE D 338     102.178  59.246 274.731  1.00 24.83           C
ATOM  11117  CG   PHE D 338     100.774  59.385 274.240  1.00 23.92           C
ATOM  11118  CD1  PHE D 338     100.518  59.791 272.938  1.00 24.99           C
ATOM  11119  CD2  PHE D 338      99.710  59.094 275.073  1.00 24.88           C
ATOM  11120  CE1  PHE D 338      99.224  59.895 272.465  1.00 25.48           C
ATOM  11121  CE2  PHE D 338      98.413  59.204 274.616  1.00 25.91           C
ATOM  11122  CZ   PHE D 338      98.167  59.599 273.310  1.00 25.34           C
ATOM  11123  N    ASP D 339     103.740  58.787 272.213  1.00 24.64           N
ATOM  11124  CA   ASP D 339     103.947  58.845 270.770  1.00 23.54           C
ATOM  11125  C    ASP D 339     104.444  57.524 270.173  1.00 23.16           C
ATOM  11126  O    ASP D 339     103.979  57.119 269.121  1.00 24.15           O
ATOM  11127  CB   ASP D 339     104.934  59.947 270.387  1.00 22.47           C
ATOM  11128  CG   ASP D 339     104.809  60.317 268.944  1.00 22.91           C
ATOM  11129  OD1  ASP D 339     103.710  60.787 268.550  1.00 23.63           O
ATOM  11130  OD2  ASP D 339     105.763  60.088 268.193  1.00 21.10           O
ATOM  11131  N    GLN D 340     105.391  56.871 270.833  1.00 22.49           N
```

Appendix 2

```
ATOM  11132  CA   GLN D 340   105.965  55.620  270.312  1.00  23.20   C
ATOM  11133  C    GLN D 340   104.954  54.474  270.259  1.00  21.71   C
ATOM  11134  O    GLN D 340   104.817  53.777  269.253  1.00  18.80   O
ATOM  11135  CB   GLN D 340   107.154  55.213  271.177  1.00  24.88   C
ATOM  11136  CG   GLN D 340   108.330  56.176  271.073  1.00  26.21   C
ATOM  11137  CD   GLN D 340   109.383  55.969  272.153  1.00  26.78   C
ATOM  11138  OE1  GLN D 340   109.078  55.663  273.321  1.00  28.69   O
ATOM  11139  NE2  GLN D 340   110.633  56.140  271.765  1.00  26.08   N
ATOM  11140  N    LEU D 341   104.229  54.319  271.359  1.00  22.88   N
ATOM  11141  CA   LEU D 341   103.181  53.305  271.474  1.00  24.21   C
ATOM  11142  C    LEU D 341   102.105  53.536  270.445  1.00  25.68   C
ATOM  11143  O    LEU D 341   101.656  52.585  269.793  1.00  26.66   O
ATOM  11144  CB   LEU D 341   102.548  53.322  272.862  1.00  23.79   C
ATOM  11145  CG   LEU D 341   103.472  52.819  273.966  1.00  23.95   C
ATOM  11146  CD1  LEU D 341   102.820  53.001  275.325  1.00  23.08   C
ATOM  11147  CD2  LEU D 341   103.882  51.363  273.721  1.00  24.44   C
ATOM  11148  N    LEU D 342   101.691  54.793  270.293  1.00  26.49   N
ATOM  11149  CA   LEU D 342   100.588  55.085  269.393  1.00  27.27   C
ATOM  11150  C    LEU D 342   100.995  54.846  267.933  1.00  25.56   C
ATOM  11151  O    LEU D 342   100.164  54.413  267.163  1.00  25.55   O
ATOM  11152  CB   LEU D 342    99.987  56.488  269.643  1.00  29.10   C
ATOM  11153  CG   LEU D 342    98.626  56.831  268.989  1.00  29.50   C
ATOM  11154  CD1  LEU D 342    97.549  55.807  269.287  1.00  28.78   C
ATOM  11155  CD2  LEU D 342    98.133  58.213  269.414  1.00  30.89   C
ATOM  11156  N    ASN D 343   102.260  55.068  267.577  1.00  25.69   N
ATOM  11157  CA   ASN D 343   102.792  54.702  266.228  1.00  25.91   C
ATOM  11158  C    ASN D 343   102.909  53.217  265.994  1.00  24.66   C
ATOM  11159  O    ASN D 343   102.928  52.768  264.854  1.00  25.18   O
ATOM  11160  CB   ASN D 343   104.175  55.303  265.973  1.00  26.45   C
ATOM  11161  CG   ASN D 343   104.158  56.803  265.985  1.00  27.02   C
ATOM  11162  OD1  ASN D 343   103.128  57.414  265.758  1.00  29.74   O
ATOM  11163  ND2  ASN D 343   105.271  57.397  266.306  1.00  27.15   N
ATOM  11164  N    HIS D 344   103.044  52.458  267.070  1.00  24.50   N
ATOM  11165  CA   HIS D 344   102.921  51.007  266.983  1.00  24.40   C
ATOM  11166  C    HIS D 344   101.463  50.562  266.778  1.00  22.90   C
ATOM  11167  O    HIS D 344   101.172  49.660  266.001  1.00  21.39   O
ATOM  11168  CB   HIS D 344   103.450  50.392  268.267  1.00  25.60   C
ATOM  11169  CG   HIS D 344   103.228  48.917  268.367  1.00  27.03   C
ATOM  11170  ND1  HIS D 344   103.946  48.007  267.619  1.00  26.52   N
ATOM  11171  CD2  HIS D 344   102.369  48.191  269.128  1.00  27.91   C
ATOM  11172  CE1  HIS D 344   103.549  46.783  267.918  1.00  27.65   C
ATOM  11173  NE2  HIS D 344   102.588  46.866  268.826  1.00  29.73   N
ATOM  11174  N    LEU D 345   100.553  51.207  267.501  1.00  23.19   N
ATOM  11175  CA   LEU D 345    99.167  50.738  267.630  1.00  23.30   C
ATOM  11176  C    LEU D 345    98.191  51.233  266.564  1.00  22.77   C
ATOM  11177  O    LEU D 345    97.408  50.455  266.035  1.00  24.22   O
ATOM  11178  CB   LEU D 345    98.639  51.110  269.013  1.00  23.26   C
ATOM  11179  CG   LEU D 345    99.177  50.334  270.219  1.00  22.53   C
ATOM  11180  CD1  LEU D 345    98.729  50.999  271.512  1.00  22.12   C
ATOM  11181  CD2  LEU D 345    98.733  48.870  270.198  1.00  22.31   C
ATOM  11182  N    GLU D 346    98.228  52.513  266.241  1.00  22.48   N
ATOM  11183  CA   GLU D 346    97.223  53.052  265.359  1.00  23.55   C
ATOM  11184  C    GLU D 346    97.419  52.707  263.886  1.00  23.40   C
ATOM  11185  O    GLU D 346    96.482  52.226  263.246  1.00  22.25   O
```

Appendix 2

```
ATOM  11186  CB   GLU D 346      97.102  54.546 265.547  1.00 25.40           C
ATOM  11187  CG   GLU D 346      95.860  55.128 264.924  1.00 27.12           C
ATOM  11188  CD   GLU D 346      95.458  56.412 265.611  1.00 29.40           C
ATOM  11189  OE1  GLU D 346      96.266  57.368 265.575  1.00 32.79           O
ATOM  11190  OE2  GLU D 346      94.355  56.460 266.198  1.00 28.38           O
ATOM  11191  N    PRO D 347      98.621  52.964 263.328  1.00 24.08           N
ATOM  11192  CA   PRO D 347      98.758  52.723 261.872  1.00 24.01           C
ATOM  11193  C    PRO D 347      98.276  51.375 261.338  1.00 23.88           C
ATOM  11194  O    PRO D 347      97.462  51.356 260.419  1.00 23.76           O
ATOM  11195  CB   PRO D 347     100.265  52.927 261.614  1.00 23.60           C
ATOM  11196  CG   PRO D 347     100.658  53.946 262.627  1.00 24.05           C
ATOM  11197  CD   PRO D 347      99.756  53.760 263.845  1.00 23.82           C
ATOM  11198  N    PRO D 348      98.773  50.253 261.894  1.00 23.78           N
ATOM  11199  CA   PRO D 348      98.323  48.962 261.350  1.00 23.64           C
ATOM  11200  C    PRO D 348      96.829  48.651 261.577  1.00 23.43           C
ATOM  11201  O    PRO D 348      96.297  47.722 260.962  1.00 23.07           O
ATOM  11202  CB   PRO D 348      99.185  47.954 262.116  1.00 23.43           C
ATOM  11203  CG   PRO D 348      99.429  48.629 263.427  1.00 23.47           C
ATOM  11204  CD   PRO D 348      99.637  50.073 263.077  1.00 22.84           C
ATOM  11205  N    ALA D 349      96.165  49.387 262.462  1.00 22.94           N
ATOM  11206  CA   ALA D 349      94.736  49.183 262.659  1.00 24.04           C
ATOM  11207  C    ALA D 349      93.895  49.849 261.560  1.00 24.70           C
ATOM  11208  O    ALA D 349      92.685  49.651 261.516  1.00 28.47           O
ATOM  11209  CB   ALA D 349      94.308  49.646 264.048  1.00 23.48           C
ATOM  11210  N    LYS D 350      94.538  50.616 260.686  1.00 24.96           N
ATOM  11211  CA   LYS D 350      93.915  51.235 259.509  1.00 25.34           C
ATOM  11212  C    LYS D 350      92.640  52.032 259.911  1.00 26.30           C
ATOM  11213  O    LYS D 350      91.503  51.639 259.624  1.00 25.71           O
ATOM  11214  CB   LYS D 350      93.691  50.195 258.402  1.00 24.47           C
ATOM  11215  N    PRO D 351      92.841  53.162 260.610  1.00 27.04           N
ATOM  11216  CA   PRO D 351      91.744  54.054 260.911  1.00 26.47           C
ATOM  11217  C    PRO D 351      91.272  54.719 259.634  1.00 27.92           C
ATOM  11218  O    PRO D 351      92.072  54.899 258.723  1.00 26.13           O
ATOM  11219  CB   PRO D 351      92.395  55.107 261.796  1.00 26.08           C
ATOM  11220  CG   PRO D 351      93.787  55.181 261.313  1.00 25.54           C
ATOM  11221  CD   PRO D 351      94.142  53.775 260.951  1.00 26.56           C
ATOM  11222  N    SER D 352      89.978  55.044 259.572  1.00 31.11           N
ATOM  11223  CA   SER D 352      89.386  55.863 258.496  1.00 33.13           C
ATOM  11224  C    SER D 352      88.148  56.621 259.008  1.00 34.10           C
ATOM  11225  O    SER D 352      87.326  56.070 259.752  1.00 35.62           O
ATOM  11226  CB   SER D 352      89.008  55.013 257.283  1.00 33.06           C
ATOM  11227  OG   SER D 352      87.973  54.107 257.594  1.00 34.48           O
ATOM  11228  N    ILE D 353      88.029  57.883 258.610  1.00 31.60           N
ATOM  11229  CA   ILE D 353      86.877  58.668 258.937  1.00 28.76           C
ATOM  11230  C    ILE D 353      85.983  58.724 257.715  1.00 27.30           C
ATOM  11231  O    ILE D 353      86.392  59.225 256.696  1.00 25.80           O
ATOM  11232  CB   ILE D 353      87.297  60.078 259.368  1.00 30.75           C
ATOM  11233  CG1  ILE D 353      88.130  59.993 260.649  1.00 31.38           C
ATOM  11234  CG2  ILE D 353      86.081  60.971 259.610  1.00 30.41           C
ATOM  11235  CD1  ILE D 353      89.110  61.121 260.793  1.00 31.16           C
ATOM  11236  N    VAL D 354      84.767  58.181 257.838  1.00 27.33           N
ATOM  11237  CA   VAL D 354      83.711  58.278 256.825  1.00 25.19           C
ATOM  11238  C    VAL D 354      82.463  58.929 257.448  1.00 24.90           C
ATOM  11239  O    VAL D 354      81.963  58.474 258.470  1.00 26.22           O
```

Appendix 2

```
ATOM  11240  CB   VAL D 354      83.341  56.874 256.285  1.00 24.78           C
ATOM  11241  CG1  VAL D 354      82.165  56.932 255.297  1.00 24.21           C
ATOM  11242  CG2  VAL D 354      84.559  56.206 255.667  1.00 24.09           C
ATOM  11243  N    SER D 355      81.950  59.975 256.810  1.00 24.76           N
ATOM  11244  CA   SER D 355      80.810  60.736 257.307  1.00 24.40           C
ATOM  11245  C    SER D 355      81.049  61.237 258.738  1.00 24.92           C
ATOM  11246  O    SER D 355      80.167  61.176 259.624  1.00 24.57           O
ATOM  11247  CB   SER D 355      79.533  59.918 257.214  1.00 24.80           C
ATOM  11248  OG   SER D 355      78.414  60.795 257.192  1.00 26.88           O
ATOM  11249  N    ALA D 356      82.269  61.726 258.948  1.00 24.58           N
ATOM  11250  CA   ALA D 356      82.684  62.373 260.208  1.00 25.08           C
ATOM  11251  C    ALA D 356      82.674  61.428 261.405  1.00 24.51           C
ATOM  11252  O    ALA D 356      82.733  61.868 262.558  1.00 22.76           O
ATOM  11253  CB   ALA D 356      81.848  63.627 260.488  1.00 24.33           C
ATOM  11254  N    SER D 357      82.616  60.126 261.109  1.00 25.06           N
ATOM  11255  CA   SER D 357      82.651  59.079 262.120  1.00 24.67           C
ATOM  11256  C    SER D 357      83.906  58.205 261.916  1.00 21.73           C
ATOM  11257  O    SER D 357      84.230  57.839 260.786  1.00 18.79           O
ATOM  11258  CB   SER D 357      81.374  58.242 262.001  1.00 26.66           C
ATOM  11259  OG   SER D 357      81.239  57.306 263.069  1.00 32.23           O
ATOM  11260  N    LEU D 358      84.589  57.888 263.016  1.00 21.21           N
ATOM  11261  CA   LEU D 358      85.808  57.046 263.029  1.00 21.50           C
ATOM  11262  C    LEU D 358      85.579  55.530 263.141  1.00 22.90           C
ATOM  11263  O    LEU D 358      84.823  55.077 264.010  1.00 22.57           O
ATOM  11264  CB   LEU D 358      86.706  57.472 264.192  1.00 20.85           C
ATOM  11265  CG   LEU D 358      88.008  56.684 264.430  1.00 20.83           C
ATOM  11266  CD1  LEU D 358      88.974  56.795 263.263  1.00 20.46           C
ATOM  11267  CD2  LEU D 358      88.683  57.161 265.712  1.00 20.62           C
ATOM  11268  N    ARG D 359      86.265  54.772 262.275  1.00 23.93           N
ATOM  11269  CA  AARG D 359      86.275  53.300 262.354  0.50 25.59           C
ATOM  11270  CA  BARG D 359      86.256  53.307 262.262  0.50 25.62           C
ATOM  11271  C    ARG D 359      87.706  52.796 262.172  1.00 27.70           C
ATOM  11272  O    ARG D 359      88.570  53.484 261.621  1.00 31.04           O
ATOM  11273  CB  AARG D 359      85.399  52.639 261.282  0.50 25.79           C
ATOM  11274  CB  BARG D 359      85.465  52.811 261.041  0.50 25.88           C
ATOM  11275  CG  AARG D 359      83.911  52.955 261.315  0.50 25.51           C
ATOM  11276  CG  BARG D 359      85.823  53.534 259.731  0.50 25.54           C
ATOM  11277  CD  AARG D 359      83.102  51.959 262.127  0.50 25.02           C
ATOM  11278  CD  BARG D 359      85.034  53.068 258.513  0.50 24.50           C
ATOM  11279  NE  AARG D 359      81.678  52.264 262.002  0.50 24.84           N
ATOM  11280  NE  BARG D 359      83.605  53.350 258.652  0.50 23.57           N
ATOM  11281  CZ  AARG D 359      81.150  53.477 262.181  0.50 23.69           C
ATOM  11282  CZ  BARG D 359      82.738  53.263 257.654  0.50 21.65           C
ATOM  11283  NH1 AARG D 359      81.927  54.516 262.489  0.50 23.14           N
ATOM  11284  NH1 BARG D 359      83.170  52.937 256.454  0.50 21.28           N
ATOM  11285  NH2 AARG D 359      79.846  53.649 262.043  0.50 22.59           N
ATOM  11286  NH2 BARG D 359      81.456  53.511 257.855  0.50 20.55           N
ATOM  11287  N    TYR D 360      87.971  51.601 262.672  1.00 27.47           N
ATOM  11288  CA   TYR D 360      89.250  50.961 262.469  1.00 28.33           C
ATOM  11289  C    TYR D 360      88.970  49.658 261.745  1.00 30.39           C
ATOM  11290  O    TYR D 360      88.154  48.886 262.204  1.00 32.43           O
ATOM  11291  CB   TYR D 360      89.900  50.644 263.804  1.00 28.77           C
ATOM  11292  CG   TYR D 360      90.467  51.835 264.487  1.00 28.17           C
ATOM  11293  CD1  TYR D 360      91.755  52.267 264.205  1.00 28.86           C
```

Appendix 2

```
ATOM  11294  CD2 TYR D 360      89.737  52.526 265.437  1.00 28.06           C
ATOM  11295  CE1 TYR D 360      92.289  53.378 264.838  1.00 28.33           C
ATOM  11296  CE2 TYR D 360      90.266  53.630 266.079  1.00 28.41           C
ATOM  11297  CZ  TYR D 360      91.532  54.061 265.758  1.00 28.30           C
ATOM  11298  OH  TYR D 360      92.050  55.159 266.378  1.00 29.54           O
ATOM  11299  N   GLU D 361      89.649  49.401 260.636  1.00 33.22           N
ATOM  11300  CA  GLU D 361      89.437  48.173 259.876  1.00 36.53           C
ATOM  11301  C   GLU D 361      90.164  46.951 260.472  1.00 32.56           C
ATOM  11302  O   GLU D 361      89.785  45.855 260.193  1.00 30.83           O
ATOM  11303  CB  GLU D 361      89.871  48.390 258.414  1.00 42.67           C
ATOM  11304  CG  GLU D 361      89.352  47.355 257.413  1.00 48.23           C
ATOM  11305  CD  GLU D 361      90.330  47.090 256.265  1.00 55.22           C
ATOM  11306  OE1 GLU D 361      91.208  47.952 256.029  1.00 59.23           O
ATOM  11307  OE2 GLU D 361      90.233  46.021 255.597  1.00 57.96           O
ATOM  11308  N   HIS D 362      91.219  47.147 261.260  1.00 33.36           N
ATOM  11309  CA  HIS D 362      92.011  46.052 261.835  1.00 32.08           C
ATOM  11310  C   HIS D 362      92.343  46.310 263.291  1.00 29.46           C
ATOM  11311  O   HIS D 362      93.510  46.398 263.652  1.00 30.17           O
ATOM  11312  CB  HIS D 362      93.319  45.864 261.070  1.00 34.19           C
ATOM  11313  CG  HIS D 362      93.132  45.287 259.710  1.00 42.08           C
ATOM  11314  ND1 HIS D 362      93.013  43.930 259.493  1.00 48.57           N
ATOM  11315  CD2 HIS D 362      93.025  45.877 258.492  1.00 44.92           C
ATOM  11316  CE1 HIS D 362      92.841  43.711 258.198  1.00 49.56           C
ATOM  11317  NE2 HIS D 362      92.845  44.875 257.569  1.00 45.94           N
ATOM  11318  N   PRO D 363      91.325  46.427 264.153  1.00 28.34           N
ATOM  11319  CA  PRO D 363      91.700  46.538 265.562  1.00 28.12           C
ATOM  11320  C   PRO D 363      92.623  45.373 265.941  1.00 27.75           C
ATOM  11321  O   PRO D 363      92.358  44.245 265.557  1.00 27.14           O
ATOM  11322  CB  PRO D 363      90.350  46.467 266.298  1.00 26.66           C
ATOM  11323  CG  PRO D 363      89.413  45.837 265.343  1.00 27.18           C
ATOM  11324  CD  PRO D 363      89.866  46.297 263.984  1.00 28.24           C
ATOM  11325  N   GLY D 364      93.703  45.647 266.657  1.00 28.86           N
ATOM  11326  CA  GLY D 364      94.730  44.611 266.925  1.00 30.51           C
ATOM  11327  C   GLY D 364      94.606  43.934 268.278  1.00 30.96           C
ATOM  11328  O   GLY D 364      95.480  43.171 268.709  1.00 31.46           O
ATOM  11329  N   SER D 365      93.502  44.212 268.956  1.00 31.27           N
ATOM  11330  CA  SER D 365      93.270  43.694 270.301  1.00 28.98           C
ATOM  11331  C   SER D 365      91.823  43.923 270.680  1.00 26.88           C
ATOM  11332  O   SER D 365      91.096  44.644 270.012  1.00 26.51           O
ATOM  11333  CB  SER D 365      94.151  44.451 271.308  1.00 28.75           C
ATOM  11334  OG  SER D 365      93.587  45.721 271.641  1.00 26.42           O
ATOM  11335  N   LEU D 366      91.423  43.337 271.788  1.00 26.70           N
ATOM  11336  CA  LEU D 366      90.135  43.645 272.377  1.00 26.96           C
ATOM  11337  C   LEU D 366      90.234  45.061 272.943  1.00 26.81           C
ATOM  11338  O   LEU D 366      91.345  45.568 273.165  1.00 25.04           O
ATOM  11339  CB  LEU D 366      89.823  42.667 273.508  1.00 26.77           C
ATOM  11340  CG  LEU D 366      89.685  41.180 273.198  1.00 27.70           C
ATOM  11341  CD1 LEU D 366      89.582  40.436 274.513  1.00 27.86           C
ATOM  11342  CD2 LEU D 366      88.468  40.860 272.323  1.00 28.42           C
ATOM  11343  N   LEU D 367      89.077  45.676 273.193  1.00 26.03           N
ATOM  11344  CA  LEU D 367      89.003  46.987 273.815  1.00 25.93           C
ATOM  11345  C   LEU D 367      89.795  48.043 273.046  1.00 27.08           C
ATOM  11346  O   LEU D 367      90.278  49.019 273.643  1.00 29.32           O
ATOM  11347  CB  LEU D 367      89.479  46.934 275.263  1.00 25.47           C
```

Appendix 2

```
ATOM  11348  CG   LEU D 367      88.684  45.994 276.168  1.00 26.43           C
ATOM  11349  CD1  LEU D 367      89.324  45.905 277.537  1.00 26.59           C
ATOM  11350  CD2  LEU D 367      87.261  46.479 276.343  1.00 27.60           C
ATOM  11351  N    PHE D 368      89.884  47.875 271.726  1.00 26.21           N
ATOM  11352  CA   PHE D 368      90.812  48.673 270.918  1.00 26.39           C
ATOM  11353  C    PHE D 368      90.375  50.124 270.811  1.00 25.57           C
ATOM  11354  O    PHE D 368      91.098  51.014 271.295  1.00 25.18           O
ATOM  11355  CB   PHE D 368      91.045  48.078 269.513  1.00 26.37           C
ATOM  11356  CG   PHE D 368      92.186  48.734 268.767  1.00 26.36           C
ATOM  11357  CD1  PHE D 368      93.502  48.434 269.080  1.00 26.15           C
ATOM  11358  CD2  PHE D 368      91.941  49.668 267.770  1.00 26.37           C
ATOM  11359  CE1  PHE D 368      94.538  49.043 268.417  1.00 26.29           C
ATOM  11360  CE2  PHE D 368      92.983  50.294 267.102  1.00 25.65           C
ATOM  11361  CZ   PHE D 368      94.279  49.973 267.418  1.00 26.30           C
ATOM  11362  N    ASP D 369      89.218  50.380 270.203  1.00 24.39           N
ATOM  11363  CA   ASP D 369      88.781  51.770 270.105  1.00 25.15           C
ATOM  11364  C    ASP D 369      88.542  52.406 271.488  1.00 26.12           C
ATOM  11365  O    ASP D 369      88.764  53.626 271.660  1.00 24.97           O
ATOM  11366  CB   ASP D 369      87.577  51.947 269.192  1.00 24.75           C
ATOM  11367  CG   ASP D 369      86.330  51.377 269.772  1.00 26.38           C
ATOM  11368  OD1  ASP D 369      86.183  50.134 269.766  1.00 27.47           O
ATOM  11369  OD2  ASP D 369      85.485  52.176 270.222  1.00 28.29           O
ATOM  11370  N    GLU D 370      88.133  51.587 272.467  1.00 26.81           N
ATOM  11371  CA   GLU D 370      87.853  52.079 273.837  1.00 26.93           C
ATOM  11372  C    GLU D 370      89.106  52.672 274.451  1.00 26.51           C
ATOM  11373  O    GLU D 370      89.082  53.806 274.935  1.00 27.15           O
ATOM  11374  CB   GLU D 370      87.334  50.967 274.768  1.00 26.78           C
ATOM  11375  CG   GLU D 370      85.923  50.452 274.486  1.00 26.10           C
ATOM  11376  CD   GLU D 370      85.852  49.276 273.494  1.00 25.96           C
ATOM  11377  OE1  GLU D 370      86.843  49.005 272.774  1.00 22.81           O
ATOM  11378  OE2  GLU D 370      84.765  48.643 273.406  1.00 25.56           O
ATOM  11379  N    LEU D 371      90.202  51.915 274.405  1.00 25.53           N
ATOM  11380  CA   LEU D 371      91.472  52.348 275.022  1.00 24.30           C
ATOM  11381  C    LEU D 371      92.220  53.446 274.273  1.00 23.97           C
ATOM  11382  O    LEU D 371      92.836  54.333 274.891  1.00 23.51           O
ATOM  11383  CB   LEU D 371      92.382  51.153 275.260  1.00 24.09           C
ATOM  11384  CG   LEU D 371      91.813  50.296 276.415  1.00 24.81           C
ATOM  11385  CD1  LEU D 371      92.400  48.901 276.444  1.00 24.75           C
ATOM  11386  CD2  LEU D 371      91.980  50.955 277.773  1.00 25.00           C
ATOM  11387  N    LEU D 372      92.172  53.419 272.950  1.00 24.12           N
ATOM  11388  CA   LEU D 372      92.801  54.489 272.191  1.00 23.69           C
ATOM  11389  C    LEU D 372      92.078  55.799 272.448  1.00 24.49           C
ATOM  11390  O    LEU D 372      92.696  56.824 272.647  1.00 25.32           O
ATOM  11391  CB   LEU D 372      92.840  54.161 270.715  1.00 23.53           C
ATOM  11392  CG   LEU D 372      94.201  53.599 270.315  1.00 23.70           C
ATOM  11393  CD1  LEU D 372      94.443  52.218 270.919  1.00 23.49           C
ATOM  11394  CD2  LEU D 372      94.304  53.599 268.803  1.00 23.21           C
ATOM  11395  N    PHE D 373      90.756  55.738 272.482  1.00 26.12           N
ATOM  11396  CA   PHE D 373      89.921  56.879 272.844  1.00 25.04           C
ATOM  11397  C    PHE D 373      90.273  57.435 274.230  1.00 25.11           C
ATOM  11398  O    PHE D 373      90.473  58.641 274.392  1.00 24.05           O
ATOM  11399  CB   PHE D 373      88.445  56.474 272.794  1.00 23.98           C
ATOM  11400  CG   PHE D 373      87.539  57.447 273.459  1.00 23.28           C
ATOM  11401  CD1  PHE D 373      87.491  58.763 273.033  1.00 23.25           C
```

Appendix 2

```
ATOM  11402  CD2  PHE  D  373     86.743  57.061  274.515  1.00  23.69           C
ATOM  11403  CE1  PHE  D  373     86.662  59.683  273.650  1.00  22.70           C
ATOM  11404  CE2  PHE  D  373     85.906  57.972  275.136  1.00  23.71           C
ATOM  11405  CZ   PHE  D  373     85.866  59.291  274.701  1.00  22.94           C
ATOM  11406  N    LEU  D  374     90.333  56.546  275.213  1.00  25.30           N
ATOM  11407  CA   LEU  D  374     90.653  56.907  276.580  1.00  26.50           C
ATOM  11408  C    LEU  D  374     92.024  57.562  276.656  1.00  26.15           C
ATOM  11409  O    LEU  D  374     92.185  58.633  277.231  1.00  26.79           O
ATOM  11410  CB   LEU  D  374     90.637  55.640  277.457  1.00  28.67           C
ATOM  11411  CG   LEU  D  374     90.991  55.792  278.942  1.00  29.62           C
ATOM  11412  CD1  LEU  D  374     90.259  56.932  279.645  1.00  29.01           C
ATOM  11413  CD2  LEU  D  374     90.719  54.482  279.652  1.00  30.14           C
ATOM  11414  N    ALA  D  375     93.019  56.920  276.066  1.00  24.54           N
ATOM  11415  CA   ALA  D  375     94.367  57.461  276.128  1.00  24.59           C
ATOM  11416  C    ALA  D  375     94.474  58.838  275.468  1.00  25.32           C
ATOM  11417  O    ALA  D  375     95.153  59.732  275.977  1.00  25.20           O
ATOM  11418  CB   ALA  D  375     95.335  56.508  275.470  1.00  24.46           C
ATOM  11419  N    LYS  D  376     93.824  58.995  274.317  1.00  24.60           N
ATOM  11420  CA   LYS  D  376     93.821  60.261  273.624  1.00  23.47           C
ATOM  11421  C    LYS  D  376     93.304  61.404  274.520  1.00  23.40           C
ATOM  11422  O    LYS  D  376     93.977  62.439  274.646  1.00  22.94           O
ATOM  11423  CB   LYS  D  376     93.049  60.130  272.320  1.00  23.64           C
ATOM  11424  CG   LYS  D  376     93.850  59.316  271.300  1.00  23.91           C
ATOM  11425  CD   LYS  D  376     93.145  59.162  269.970  1.00  22.76           C
ATOM  11426  CE   LYS  D  376     94.019  58.422  268.989  1.00  22.20           C
ATOM  11427  NZ   LYS  D  376     93.243  58.254  267.725  1.00  22.97           N
ATOM  11428  N    VAL  D  377     92.187  61.184  275.222  1.00  22.11           N
ATOM  11429  CA   VAL  D  377     91.560  62.255  276.014  1.00  21.08           C
ATOM  11430  C    VAL  D  377     91.981  62.345  277.463  1.00  21.31           C
ATOM  11431  O    VAL  D  377     91.707  63.339  278.111  1.00  23.32           O
ATOM  11432  CB   VAL  D  377     90.028  62.160  276.009  1.00  21.27           C
ATOM  11433  CG1  VAL  D  377     89.504  62.204  274.573  1.00  21.90           C
ATOM  11434  CG2  VAL  D  377     89.541  60.913  276.761  1.00  21.23           C
ATOM  11435  N    HIS  D  378     92.642  61.328  277.984  1.00  21.64           N
ATOM  11436  CA   HIS  D  378     92.752  61.176  279.434  1.00  21.53           C
ATOM  11437  C    HIS  D  378     93.388  62.371  280.133  1.00  21.53           C
ATOM  11438  O    HIS  D  378     94.582  62.640  279.960  1.00  22.25           O
ATOM  11439  CB   HIS  D  378     93.538  59.931  279.751  1.00  21.98           C
ATOM  11440  CG   HIS  D  378     93.606  59.632  281.193  1.00  21.90           C
ATOM  11441  ND1  HIS  D  378     92.502  59.255  281.915  1.00  23.85           N
ATOM  11442  CD2  HIS  D  378     94.645  59.623  282.051  1.00  23.20           C
ATOM  11443  CE1  HIS  D  378     92.852  59.044  283.171  1.00  24.26           C
ATOM  11444  NE2  HIS  D  378     94.147  59.283  283.284  1.00  24.46           N
ATOM  11445  N    ALA  D  379     92.603  63.083  280.938  1.00  20.78           N
ATOM  11446  CA   ALA  D  379     93.112  64.274  281.637  1.00  21.31           C
ATOM  11447  C    ALA  D  379     93.819  63.958  282.985  1.00  20.66           C
ATOM  11448  O    ALA  D  379     94.229  64.872  283.720  1.00  20.04           O
ATOM  11449  CB   ALA  D  379     91.976  65.291  281.849  1.00  21.23           C
ATOM  11450  N    GLY  D  380     93.920  62.682  283.325  1.00  19.72           N
ATOM  11451  CA   GLY  D  380     94.475  62.289  284.602  1.00  20.30           C
ATOM  11452  C    GLY  D  380     93.419  61.967  285.651  1.00  20.63           C
ATOM  11453  O    GLY  D  380     92.428  62.696  285.828  1.00  20.75           O
ATOM  11454  N    PHE  D  381     93.657  60.887  286.378  1.00  21.12           N
ATOM  11455  CA   PHE  D  381     92.712  60.436  287.367  1.00  22.18           C
```

Appendix 2

```
ATOM  11456  C    PHE D 381      92.592  61.402 288.520  1.00 22.68           C
ATOM  11457  O    PHE D 381      91.532  61.510 289.102  1.00 22.49           O
ATOM  11458  CB   PHE D 381      93.061  59.013 287.818  1.00 23.44           C
ATOM  11459  CG   PHE D 381      92.659  57.969 286.810  1.00 23.48           C
ATOM  11460  CD1  PHE D 381      91.313  57.778 286.499  1.00 23.55           C
ATOM  11461  CD2  PHE D 381      93.599  57.215 286.151  1.00 23.42           C
ATOM  11462  CE1  PHE D 381      90.924  56.856 285.533  1.00 24.21           C
ATOM  11463  CE2  PHE D 381      93.209  56.280 285.202  1.00 24.17           C
ATOM  11464  CZ   PHE D 381      91.874  56.102 284.884  1.00 23.44           C
ATOM  11465  N    GLY D 382      93.665  62.135 288.816  1.00 24.42           N
ATOM  11466  CA   GLY D 382      93.609  63.215 289.790  1.00 25.51           C
ATOM  11467  C    GLY D 382      92.732  64.376 289.326  1.00 26.77           C
ATOM  11468  O    GLY D 382      91.976  64.967 290.108  1.00 27.17           O
ATOM  11469  N    ALA D 383      92.838  64.728 288.052  1.00 26.70           N
ATOM  11470  CA   ALA D 383      92.038  65.814 287.539  1.00 26.36           C
ATOM  11471  C    ALA D 383      90.547  65.413 287.567  1.00 27.63           C
ATOM  11472  O    ALA D 383      89.692  66.224 287.904  1.00 27.26           O
ATOM  11473  CB   ALA D 383      92.490  66.198 286.141  1.00 24.64           C
ATOM  11474  N    LEU D 384      90.229  64.167 287.225  1.00 28.38           N
ATOM  11475  CA   LEU D 384      88.841  63.742 287.268  1.00 29.57           C
ATOM  11476  C    LEU D 384      88.317  63.854 288.690  1.00 33.07           C
ATOM  11477  O    LEU D 384      87.206  64.315 288.925  1.00 34.91           O
ATOM  11478  CB   LEU D 384      88.697  62.320 286.777  1.00 29.66           C
ATOM  11479  CG   LEU D 384      89.043  62.066 285.311  1.00 30.28           C
ATOM  11480  CD1  LEU D 384      88.873  60.572 285.029  1.00 30.46           C
ATOM  11481  CD2  LEU D 384      88.212  62.909 284.350  1.00 29.53           C
ATOM  11482  N    LEU D 385      89.133  63.442 289.649  1.00 35.96           N
ATOM  11483  CA   LEU D 385      88.819  63.657 291.066  1.00 36.72           C
ATOM  11484  C    LEU D 385      88.452  65.090 291.421  1.00 35.53           C
ATOM  11485  O    LEU D 385      87.505  65.316 292.175  1.00 37.72           O
ATOM  11486  CB   LEU D 385      90.010  63.219 291.929  1.00 38.37           C
ATOM  11487  CG   LEU D 385      89.756  61.918 292.672  1.00 39.36           C
ATOM  11488  CD1  LEU D 385      91.054  61.168 292.957  1.00 39.93           C
ATOM  11489  CD2  LEU D 385      88.970  62.229 293.943  1.00 39.76           C
ATOM  11490  N    ARG D 386      89.214  66.046 290.900  1.00 35.10           N
ATOM  11491  CA   ARG D 386      89.041  67.455 291.238  1.00 37.20           C
ATOM  11492  C    ARG D 386      88.207  68.216 290.214  1.00 36.53           C
ATOM  11493  O    ARG D 386      88.388  69.415 290.009  1.00 38.26           O
ATOM  11494  CB   ARG D 386      90.411  68.118 291.367  1.00 39.12           C
ATOM  11495  CG   ARG D 386      91.238  67.593 292.533  1.00 41.46           C
ATOM  11496  CD   ARG D 386      92.594  68.301 292.629  1.00 40.60           C
ATOM  11497  NE   ARG D 386      93.525  67.764 291.648  1.00 39.10           N
ATOM  11498  CZ   ARG D 386      94.193  66.617 291.793  1.00 40.52           C
ATOM  11499  NH1  ARG D 386      94.053  65.881 292.902  1.00 37.71           N
ATOM  11500  NH2  ARG D 386      95.007  66.200 290.817  1.00 40.48           N
ATOM  11501  N    MET D 387      87.282  67.528 289.574  1.00 35.34           N
ATOM  11502  CA   MET D 387      86.520  68.135 288.501  1.00 35.47           C
ATOM  11503  C    MET D 387      85.625  69.261 289.025  1.00 35.20           C
ATOM  11504  O    MET D 387      84.790  69.030 289.898  1.00 32.54           O
ATOM  11505  CB   MET D 387      85.663  67.066 287.818  1.00 35.78           C
ATOM  11506  CG   MET D 387      84.939  67.550 286.579  1.00 36.60           C
ATOM  11507  SD   MET D 387      83.892  66.268 285.877  1.00 38.84           S
ATOM  11508  CE   MET D 387      85.083  65.031 285.356  1.00 35.32           C
ATOM  11509  N    PRO D 388      85.771  70.477 288.481  1.00 36.40           N
```

Appendix 2

```
ATOM  11510  CA   PRO D 388      84.879  71.561 288.934  1.00 37.93           C
ATOM  11511  C    PRO D 388      83.397  71.242 288.722  1.00 36.58           C
ATOM  11512  O    PRO D 388      83.051  70.519 287.790  1.00 33.45           O
ATOM  11513  CB   PRO D 388      85.281  72.767 288.068  1.00 37.94           C
ATOM  11514  CG   PRO D 388      86.515  72.359 287.324  1.00 38.78           C
ATOM  11515  CD   PRO D 388      86.611  70.870 287.340  1.00 37.40           C
ATOM  11516  N    PRO D 389      82.521  71.788 289.577  1.00 38.50           N
ATOM  11517  CA   PRO D 389      81.089  71.540 289.388  1.00 39.23           C
ATOM  11518  C    PRO D 389      80.591  72.042 288.029  1.00 41.31           C
ATOM  11519  O    PRO D 389      81.246  72.879 287.400  1.00 40.88           O
ATOM  11520  CB   PRO D 389      80.429  72.317 290.538  1.00 38.73           C
ATOM  11521  CG   PRO D 389      81.505  72.585 291.535  1.00 38.45           C
ATOM  11522  CD   PRO D 389      82.798  72.615 290.765  1.00 38.78           C
ATOM  11523  N    PRO D 390      79.441  71.524 287.561  1.00 46.90           N
ATOM  11524  CA   PRO D 390      78.906  71.905 286.222  1.00 49.60           C
ATOM  11525  C    PRO D 390      78.759  73.422 285.979  1.00 47.05           C
ATOM  11526  O    PRO D 390      78.122  74.113 286.782  1.00 44.42           O
ATOM  11527  CB   PRO D 390      77.530  71.200 286.174  1.00 49.57           C
ATOM  11528  CG   PRO D 390      77.266  70.692 287.572  1.00 48.48           C
ATOM  11529  CD   PRO D 390      78.603  70.505 288.222  1.00 45.91           C
TER   11530       PRO D 390
ATOM  11531  N    GLU E  28      53.402   9.952 217.024  1.00 40.09           N
ATOM  11532  CA   GLU E  28      54.797  10.531 217.040  1.00 43.89           C
ATOM  11533  C    GLU E  28      55.142  11.096 218.439  1.00 47.14           C
ATOM  11534  O    GLU E  28      54.434  11.984 218.955  1.00 41.69           O
ATOM  11535  CB   GLU E  28      54.969  11.614 215.958  1.00 40.31           C
ATOM  11536  N    LEU E  29      56.217  10.567 219.040  1.00 51.06           N
ATOM  11537  CA   LEU E  29      56.637  10.921 220.416  1.00 52.54           C
ATOM  11538  C    LEU E  29      57.526  12.166 220.429  1.00 51.06           C
ATOM  11539  O    LEU E  29      58.713  12.048 220.082  1.00 49.51           O
ATOM  11540  CB   LEU E  29      57.419   9.767 221.060  1.00 53.40           C
ATOM  11541  CG   LEU E  29      57.806  10.009 222.531  1.00 57.49           C
ATOM  11542  CD1  LEU E  29      56.594   9.805 223.443  1.00 56.19           C
ATOM  11543  CD2  LEU E  29      58.989   9.146 222.978  1.00 55.62           C
ATOM  11544  N    PRO E  30      56.981  13.345 220.864  1.00 50.14           N
ATOM  11545  CA   PRO E  30      57.809  14.557 220.737  1.00 47.04           C
ATOM  11546  C    PRO E  30      59.112  14.393 221.510  1.00 46.88           C
ATOM  11547  O    PRO E  30      59.239  13.480 222.319  1.00 44.29           O
ATOM  11548  CB   PRO E  30      56.913  15.684 221.312  1.00 46.97           C
ATOM  11549  CG   PRO E  30      55.526  15.123 221.372  1.00 46.34           C
ATOM  11550  CD   PRO E  30      55.699  13.635 221.554  1.00 48.32           C
ATOM  11551  N    PRO E  31      60.098  15.253 221.239  1.00 49.45           N
ATOM  11552  CA   PRO E  31      61.431  15.024 221.841  1.00 48.77           C
ATOM  11553  C    PRO E  31      61.490  15.296 223.359  1.00 45.73           C
ATOM  11554  O    PRO E  31      61.094  16.372 223.797  1.00 44.19           O
ATOM  11555  CB   PRO E  31      62.339  15.999 221.071  1.00 49.78           C
ATOM  11556  CG   PRO E  31      61.414  17.052 220.499  1.00 50.51           C
ATOM  11557  CD   PRO E  31      60.008  16.513 220.470  1.00 48.27           C
ATOM  11558  N    GLY E  32      61.982  14.332 224.138  1.00 43.18           N
ATOM  11559  CA   GLY E  32      62.147  14.498 225.591  1.00 42.06           C
ATOM  11560  C    GLY E  32      60.927  14.102 226.417  1.00 42.62           C
ATOM  11561  O    GLY E  32      60.928  14.220 227.651  1.00 42.21           O
ATOM  11562  N    ARG E  33      59.883  13.632 225.741  1.00 40.03           N
ATOM  11563  CA   ARG E  33      58.654  13.209 226.407  1.00 40.17           C
```

Appendix 2

```
ATOM  11564  C    ARG E  33      58.696  11.714 226.730  1.00 40.06           C
ATOM  11565  O    ARG E  33      59.446  10.955 226.134  1.00 42.93           O
ATOM  11566  CB   ARG E  33      57.452  13.477 225.501  1.00 38.84           C
ATOM  11567  CG   ARG E  33      57.079  14.942 225.329  1.00 38.08           C
ATOM  11568  CD   ARG E  33      56.081  15.361 226.391  1.00 36.80           C
ATOM  11569  NE   ARG E  33      54.870  14.550 226.322  1.00 34.84           N
ATOM  11570  CZ   ARG E  33      53.797  14.847 225.593  1.00 34.45           C
ATOM  11571  NH1  ARG E  33      53.746  15.963 224.859  1.00 32.33           N
ATOM  11572  NH2  ARG E  33      52.748  14.025 225.609  1.00 33.89           N
ATOM  11573  N    LEU E  34      57.853  11.285 227.645  1.00 39.08           N
ATOM  11574  CA   LEU E  34      57.797   9.883 228.011  1.00 40.96           C
ATOM  11575  C    LEU E  34      56.679   9.146 227.282  1.00 42.67           C
ATOM  11576  O    LEU E  34      56.770   7.938 227.075  1.00 41.29           O
ATOM  11577  CB   LEU E  34      57.613   9.763 229.520  1.00 40.51           C
ATOM  11578  CG   LEU E  34      58.760  10.454 230.268  1.00 40.73           C
ATOM  11579  CD1  LEU E  34      58.379  10.765 231.703  1.00 40.69           C
ATOM  11580  CD2  LEU E  34      60.019   9.597 230.195  1.00 40.67           C
ATOM  11581  N    ALA E  35      55.624   9.870 226.906  1.00 41.99           N
ATOM  11582  CA   ALA E  35      54.509   9.273 226.179  1.00 43.10           C
ATOM  11583  C    ALA E  35      53.713  10.327 225.397  1.00 43.44           C
ATOM  11584  O    ALA E  35      53.866  11.534 225.609  1.00 44.78           O
ATOM  11585  CB   ALA E  35      53.609   8.499 227.131  1.00 42.73           C
ATOM  11586  N    THR E  36      52.881   9.850 224.478  1.00 40.03           N
ATOM  11587  CA   THR E  36      52.167  10.715 223.543  1.00 37.75           C
ATOM  11588  C    THR E  36      50.882  11.224 224.163  1.00 36.05           C
ATOM  11589  O    THR E  36      50.289  10.538 224.996  1.00 37.39           O
ATOM  11590  CB   THR E  36      51.761   9.922 222.291  1.00 36.72           C
ATOM  11591  OG1  THR E  36      50.827   8.898 222.665  1.00 34.24           O
ATOM  11592  CG2  THR E  36      52.984   9.300 221.629  1.00 36.17           C
ATOM  11593  N    THR E  37      50.420  12.394 223.744  1.00 33.43           N
ATOM  11594  CA   THR E  37      49.127  12.871 224.218  1.00 33.81           C
ATOM  11595  C    THR E  37      48.022  11.841 223.923  1.00 36.69           C
ATOM  11596  O    THR E  37      47.148  11.626 224.752  1.00 39.33           O
ATOM  11597  CB   THR E  37      48.771  14.235 223.610  1.00 33.70           C
ATOM  11598  OG1  THR E  37      49.795  15.177 223.938  1.00 32.55           O
ATOM  11599  CG2  THR E  37      47.426  14.749 224.126  1.00 33.48           C
ATOM  11600  N    GLU E  38      48.077  11.191 222.754  1.00 40.68           N
ATOM  11601  CA   GLU E  38      47.145  10.098 222.420  1.00 41.04           C
ATOM  11602  C    GLU E  38      47.170   9.016 223.529  1.00 41.19           C
ATOM  11603  O    GLU E  38      46.121   8.602 224.049  1.00 35.41           O
ATOM  11604  CB   GLU E  38      47.461   9.492 221.029  1.00 40.28           C
ATOM  11605  N    ASP E  39      48.375   8.588 223.910  1.00 42.76           N
ATOM  11606  CA   ASP E  39      48.516   7.571 224.958  1.00 43.62           C
ATOM  11607  C    ASP E  39      47.792   7.996 226.246  1.00 42.71           C
ATOM  11608  O    ASP E  39      47.021   7.212 226.793  1.00 42.35           O
ATOM  11609  CB   ASP E  39      49.997   7.205 225.214  1.00 43.43           C
ATOM  11610  CG   ASP E  39      50.573   6.239 224.148  1.00 43.94           C
ATOM  11611  OD1  ASP E  39      49.786   5.675 223.347  1.00 40.55           O
ATOM  11612  OD2  ASP E  39      51.814   6.044 224.112  1.00 42.74           O
ATOM  11613  N    TYR E  40      47.989   9.242 226.693  1.00 40.52           N
ATOM  11614  CA   TYR E  40      47.406   9.691 227.976  1.00 37.30           C
ATOM  11615  C    TYR E  40      45.891   9.729 227.921  1.00 35.66           C
ATOM  11616  O    TYR E  40      45.215   9.382 228.895  1.00 32.91           O
ATOM  11617  CB   TYR E  40      47.949  11.073 228.421  1.00 35.12           C
```

Appendix 2

```
ATOM  11618  CG   TYR E  40     49.409  11.067 228.783  1.00 31.99           C
ATOM  11619  CD1  TYR E  40     49.917  10.155 229.701  1.00 32.20           C
ATOM  11620  CD2  TYR E  40     50.289  11.959 228.199  1.00 31.70           C
ATOM  11621  CE1  TYR E  40     51.279  10.122 230.008  1.00 33.19           C
ATOM  11622  CE2  TYR E  40     51.656  11.943 228.500  1.00 32.81           C
ATOM  11623  CZ   TYR E  40     52.153  11.029 229.406  1.00 32.43           C
ATOM  11624  OH   TYR E  40     53.503  11.023 229.699  1.00 31.14           O
ATOM  11625  N    PHE E  41     45.376  10.170 226.771  1.00 37.56           N
ATOM  11626  CA   PHE E  41     43.925  10.354 226.557  1.00 35.85           C
ATOM  11627  C    PHE E  41     43.196   9.002 226.313  1.00 34.07           C
ATOM  11628  O    PHE E  41     42.018   8.836 226.626  1.00 29.32           O
ATOM  11629  CB   PHE E  41     43.694  11.362 225.417  1.00 34.19           C
ATOM  11630  CG   PHE E  41     43.718  12.814 225.858  1.00 35.43           C
ATOM  11631  CD1  PHE E  41     44.919  13.476 226.112  1.00 34.55           C
ATOM  11632  CD2  PHE E  41     42.527  13.539 225.989  1.00 34.11           C
ATOM  11633  CE1  PHE E  41     44.929  14.816 226.491  1.00 33.06           C
ATOM  11634  CE2  PHE E  41     42.539  14.872 226.376  1.00 33.60           C
ATOM  11635  CZ   PHE E  41     43.743  15.509 226.625  1.00 33.02           C
ATOM  11636  N    ALA E  42     43.920   8.034 225.769  1.00 36.90           N
ATOM  11637  CA   ALA E  42     43.380   6.695 225.587  1.00 40.70           C
ATOM  11638  C    ALA E  42     43.336   5.907 226.907  1.00 42.16           C
ATOM  11639  O    ALA E  42     42.474   5.047 227.067  1.00 47.58           O
ATOM  11640  CB   ALA E  42     44.192   5.936 224.540  1.00 42.14           C
ATOM  11641  N    GLN E  43     44.251   6.209 227.832  1.00 39.76           N
ATOM  11642  CA   GLN E  43     44.406   5.475 229.100  1.00 40.80           C
ATOM  11643  C    GLN E  43     43.126   4.873 229.672  1.00 41.37           C
ATOM  11644  O    GLN E  43     43.082   3.702 230.063  1.00 38.33           O
ATOM  11645  CB   GLN E  43     45.016   6.387 230.169  1.00 41.77           C
ATOM  11646  CG   GLN E  43     46.527   6.478 230.146  1.00 42.80           C
ATOM  11647  CD   GLN E  43     47.080   7.249 231.331  1.00 46.33           C
ATOM  11648  OE1  GLN E  43     47.953   6.760 232.064  1.00 45.69           O
ATOM  11649  NE2  GLN E  43     46.573   8.460 231.529  1.00 46.22           N
ATOM  11650  N    GLN E  44     42.087   5.688 229.744  1.00 45.23           N
ATOM  11651  CA   GLN E  44     40.848   5.241 230.348  1.00 47.98           C
ATOM  11652  C    GLN E  44     40.209   4.131 229.527  1.00 45.63           C
ATOM  11653  O    GLN E  44     39.898   3.066 230.063  1.00 45.94           O
ATOM  11654  CB   GLN E  44     39.888   6.411 230.523  1.00 50.64           C
ATOM  11655  CG   GLN E  44     38.492   5.982 230.949  1.00 52.32           C
ATOM  11656  CD   GLN E  44     37.798   7.017 231.797  1.00 52.44           C
ATOM  11657  OE1  GLN E  44     38.174   8.199 231.823  1.00 53.80           O
ATOM  11658  NE2  GLN E  44     36.777   6.578 232.506  1.00 52.16           N
ATOM  11659  N    ALA E  45     40.034   4.388 228.233  1.00 45.78           N
ATOM  11660  CA   ALA E  45     39.470   3.405 227.298  1.00 43.99           C
ATOM  11661  C    ALA E  45     40.294   2.107 227.252  1.00 42.99           C
ATOM  11662  O    ALA E  45     39.728   1.017 227.263  1.00 44.46           O
ATOM  11663  CB   ALA E  45     39.329   4.013 225.906  1.00 41.72           C
ATOM  11664  N    LYS E  46     41.621   2.210 227.223  1.00 42.81           N
ATOM  11665  CA   LYS E  46     42.472   1.014 227.362  1.00 42.87           C
ATOM  11666  C    LYS E  46     42.417   0.328 228.745  1.00 43.49           C
ATOM  11667  O    LYS E  46     42.912  -0.788 228.896  1.00 44.94           O
ATOM  11668  CB   LYS E  46     43.933   1.338 227.042  1.00 43.81           C
ATOM  11669  CG   LYS E  46     44.226   1.630 225.581  1.00 45.11           C
ATOM  11670  CD   LYS E  46     45.722   1.555 225.286  1.00 44.98           C
ATOM  11671  CE   LYS E  46     46.123   2.539 224.192  1.00 46.96           C
```

Appendix 2

```
ATOM  11672  NZ   LYS E  46      47.580   2.861 224.233  1.00 47.38           N
ATOM  11673  N    GLN E  47      41.867   0.989 229.762  1.00 44.11           N
ATOM  11674  CA   GLN E  47      41.772   0.386 231.101  1.00 46.48           C
ATOM  11675  C    GLN E  47      43.152   0.091 231.742  1.00 46.73           C
ATOM  11676  O    GLN E  47      43.313  -0.823 232.563  1.00 45.98           O
ATOM  11677  CB   GLN E  47      40.925  -0.894 231.045  1.00 46.08           C
ATOM  11678  CG   GLN E  47      39.490  -0.646 230.635  1.00 44.43           C
ATOM  11679  CD   GLN E  47      38.616  -0.433 231.839  1.00 44.49           C
ATOM  11680  OE1  GLN E  47      38.038  -1.390 232.353  1.00 47.07           O
ATOM  11681  NE2  GLN E  47      38.541   0.806 232.326  1.00 41.55           N
ATOM  11682  N    ALA E  48      44.142   0.887 231.361  1.00 45.64           N
ATOM  11683  CA   ALA E  48      45.485   0.757 231.896  1.00 43.07           C
ATOM  11684  C    ALA E  48      46.156   2.130 231.878  1.00 38.56           C
ATOM  11685  O    ALA E  48      45.937   2.942 230.965  1.00 36.66           O
ATOM  11686  CB   ALA E  48      46.285  -0.250 231.073  1.00 42.28           C
ATOM  11687  N    VAL E  49      46.969   2.389 232.886  1.00 34.59           N
ATOM  11688  CA   VAL E  49      47.747   3.619 232.893  1.00 34.50           C
ATOM  11689  C    VAL E  49      49.016   3.394 232.070  1.00 34.36           C
ATOM  11690  O    VAL E  49      49.499   2.266 231.964  1.00 33.19           O
ATOM  11691  CB   VAL E  49      48.091   4.111 234.324  1.00 32.12           C
ATOM  11692  CG1  VAL E  49      46.827   4.275 235.142  1.00 31.28           C
ATOM  11693  CG2  VAL E  49      49.080   3.178 235.022  1.00 32.42           C
ATOM  11694  N    THR E  50      49.551   4.476 231.507  1.00 33.83           N
ATOM  11695  CA   THR E  50      50.803   4.410 230.775  1.00 34.18           C
ATOM  11696  C    THR E  50      51.943   3.961 231.666  1.00 34.49           C
ATOM  11697  O    THR E  50      51.892   4.118 232.896  1.00 32.82           O
ATOM  11698  CB   THR E  50      51.216   5.782 230.203  1.00 35.80           C
ATOM  11699  OG1  THR E  50      51.302   6.753 231.251  1.00 32.96           O
ATOM  11700  CG2  THR E  50      50.224   6.249 229.163  1.00 36.53           C
ATOM  11701  N    PRO E  51      52.998   3.422 231.050  1.00 35.45           N
ATOM  11702  CA   PRO E  51      54.113   3.030 231.926  1.00 36.27           C
ATOM  11703  C    PRO E  51      54.677   4.180 232.808  1.00 36.60           C
ATOM  11704  O    PRO E  51      55.114   3.916 233.923  1.00 38.04           O
ATOM  11705  CB   PRO E  51      55.170   2.490 230.937  1.00 34.96           C
ATOM  11706  CG   PRO E  51      54.389   2.076 229.732  1.00 34.01           C
ATOM  11707  CD   PRO E  51      53.189   2.985 229.652  1.00 32.82           C
ATOM  11708  N    ASP E  52      54.666   5.432 232.340  1.00 36.79           N
ATOM  11709  CA   ASP E  52      55.281   6.513 233.133  1.00 35.80           C
ATOM  11710  C    ASP E  52      54.450   6.847 234.372  1.00 34.44           C
ATOM  11711  O    ASP E  52      55.000   7.033 235.467  1.00 34.06           O
ATOM  11712  CB   ASP E  52      55.607   7.779 232.307  1.00 36.09           C
ATOM  11713  CG   ASP E  52      54.409   8.331 231.532  1.00 38.01           C
ATOM  11714  OD1  ASP E  52      53.802   7.565 230.755  1.00 41.14           O
ATOM  11715  OD2  ASP E  52      54.102   9.540 231.664  1.00 35.71           O
ATOM  11716  N    VAL E  53      53.135   6.895 234.192  1.00 32.35           N
ATOM  11717  CA   VAL E  53      52.194   7.113 235.284  1.00 31.07           C
ATOM  11718  C    VAL E  53      52.367   6.040 236.337  1.00 31.02           C
ATOM  11719  O    VAL E  53      52.342   6.349 237.506  1.00 34.71           O
ATOM  11720  CB   VAL E  53      50.716   7.134 234.786  1.00 29.72           C
ATOM  11721  CG1  VAL E  53      49.710   6.992 235.933  1.00 28.29           C
ATOM  11722  CG2  VAL E  53      50.442   8.404 233.996  1.00 29.21           C
ATOM  11723  N    MET E  54      52.527   4.787 235.924  1.00 32.35           N
ATOM  11724  CA   MET E  54      52.826   3.684 236.853  1.00 33.73           C
ATOM  11725  C    MET E  54      54.135   3.918 237.616  1.00 31.60           C
```

Appendix 2

```
ATOM  11726  O    MET E  54      54.244   3.619 238.788  1.00 29.27           O
ATOM  11727  CB   MET E  54      52.930   2.347 236.095  1.00 36.94           C
ATOM  11728  CG   MET E  54      53.085   1.103 236.982  1.00 38.44           C
ATOM  11729  SD   MET E  54      51.633   0.777 238.005  1.00 42.18           S
ATOM  11730  CE   MET E  54      51.791  -1.009 238.153  1.00 49.44           C
ATOM  11731  N    ALA E  55      55.136   4.442 236.936  1.00 31.96           N
ATOM  11732  CA   ALA E  55      56.399   4.726 237.579  1.00 31.64           C
ATOM  11733  C    ALA E  55      56.230   5.880 238.568  1.00 29.79           C
ATOM  11734  O    ALA E  55      56.946   5.944 239.557  1.00 29.08           O
ATOM  11735  CB   ALA E  55      57.485   5.012 236.538  1.00 31.12           C
ATOM  11736  N    GLN E  56      55.275   6.769 238.303  1.00 29.56           N
ATOM  11737  CA   GLN E  56      54.938   7.863 239.223  1.00 29.86           C
ATOM  11738  C    GLN E  56      54.273   7.294 240.460  1.00 29.21           C
ATOM  11739  O    GLN E  56      54.554   7.735 241.594  1.00 27.64           O
ATOM  11740  CB   GLN E  56      53.980   8.865 238.568  1.00 30.87           C
ATOM  11741  CG   GLN E  56      53.395   9.906 239.528  1.00 32.17           C
ATOM  11742  CD   GLN E  56      54.397  10.995 239.907  1.00 32.43           C
ATOM  11743  OE1  GLN E  56      55.085  11.533 239.056  1.00 36.78           O
ATOM  11744  NE2  GLN E  56      54.446  11.343 241.164  1.00 30.95           N
ATOM  11745  N    LEU E  57      53.375   6.331 240.231  1.00 27.30           N
ATOM  11746  CA   LEU E  57      52.715   5.630 241.333  1.00 26.96           C
ATOM  11747  C    LEU E  57      53.708   4.856 242.183  1.00 24.78           C
ATOM  11748  O    LEU E  57      53.508   4.731 243.388  1.00 25.90           O
ATOM  11749  CB   LEU E  57      51.599   4.707 240.837  1.00 28.01           C
ATOM  11750  CG   LEU E  57      50.316   5.406 240.350  1.00 29.50           C
ATOM  11751  CD1  LEU E  57      49.449   4.407 239.605  1.00 30.27           C
ATOM  11752  CD2  LEU E  57      49.518   6.013 241.489  1.00 29.56           C
ATOM  11753  N    ALA E  58      54.770   4.349 241.565  1.00 22.80           N
ATOM  11754  CA   ALA E  58      55.824   3.674 242.296  1.00 23.50           C
ATOM  11755  C    ALA E  58      56.593   4.684 243.189  1.00 23.73           C
ATOM  11756  O    ALA E  58      56.727   4.457 244.389  1.00 22.43           O
ATOM  11757  CB   ALA E  58      56.766   2.955 241.338  1.00 23.65           C
ATOM  11758  N    TYR E  59      57.054   5.797 242.616  1.00 23.37           N
ATOM  11759  CA   TYR E  59      57.556   6.891 243.418  1.00 24.81           C
ATOM  11760  C    TYR E  59      56.613   7.192 244.586  1.00 25.19           C
ATOM  11761  O    TYR E  59      57.034   7.315 245.733  1.00 24.73           O
ATOM  11762  CB   TYR E  59      57.755   8.186 242.601  1.00 26.22           C
ATOM  11763  CG   TYR E  59      57.874   9.410 243.530  1.00 26.59           C
ATOM  11764  CD1  TYR E  59      59.007   9.587 244.350  1.00 26.41           C
ATOM  11765  CD2  TYR E  59      56.837  10.332 243.632  1.00 25.92           C
ATOM  11766  CE1  TYR E  59      59.106  10.662 245.215  1.00 27.43           C
ATOM  11767  CE2  TYR E  59      56.924  11.417 244.482  1.00 28.05           C
ATOM  11768  CZ   TYR E  59      58.052  11.587 245.276  1.00 29.73           C
ATOM  11769  OH   TYR E  59      58.104  12.668 246.135  1.00 31.97           O
ATOM  11770  N    MET E  60      55.334   7.331 244.301  1.00 26.79           N
ATOM  11771  CA   MET E  60      54.403   7.640 245.365  1.00 28.32           C
ATOM  11772  C    MET E  60      54.330   6.578 246.469  1.00 28.54           C
ATOM  11773  O    MET E  60      54.063   6.911 247.613  1.00 30.94           O
ATOM  11774  CB   MET E  60      53.028   7.949 244.779  1.00 29.71           C
ATOM  11775  CG   MET E  60      52.989   9.328 244.133  1.00 31.29           C
ATOM  11776  SD   MET E  60      51.629   9.500 242.986  1.00 31.22           S
ATOM  11777  CE   MET E  60      50.268   9.523 244.137  1.00 34.20           C
ATOM  11778  N    ASN E  61      54.608   5.318 246.149  1.00 29.32           N
ATOM  11779  CA   ASN E  61      54.316   4.192 247.060  1.00 29.03           C
```

Appendix 2

```
ATOM  11780  C    ASN E  61      55.456   3.222 247.431  1.00 28.63           C
ATOM  11781  O    ASN E  61      55.282   2.456 248.388  1.00 27.69           O
ATOM  11782  CB   ASN E  61      53.190   3.341 246.440  1.00 30.18           C
ATOM  11783  CG   ASN E  61      51.800   3.919 246.672  1.00 29.88           C
ATOM  11784  OD1  ASN E  61      51.165   3.646 247.689  1.00 30.25           O
ATOM  11785  ND2  ASN E  61      51.303   4.675 245.708  1.00 29.45           N
ATOM  11786  N    TYR E  62      56.587   3.222 246.697  1.00 28.10           N
ATOM  11787  CA   TYR E  62      57.535   2.093 246.767  1.00 27.24           C
ATOM  11788  C    TYR E  62      58.411   2.074 248.035  1.00 27.23           C
ATOM  11789  O    TYR E  62      58.413   1.119 248.813  1.00 27.52           O
ATOM  11790  CB   TYR E  62      58.429   2.005 245.504  1.00 27.41           C
ATOM  11791  CG   TYR E  62      58.988   0.602 245.311  1.00 27.77           C
ATOM  11792  CD1  TYR E  62      60.063   0.148 246.076  1.00 28.06           C
ATOM  11793  CD2  TYR E  62      58.410  -0.290 244.409  1.00 27.16           C
ATOM  11794  CE1  TYR E  62      60.551  -1.143 245.950  1.00 28.12           C
ATOM  11795  CE2  TYR E  62      58.894  -1.578 244.266  1.00 27.43           C
ATOM  11796  CZ   TYR E  62      59.962  -2.002 245.044  1.00 29.10           C
ATOM  11797  OH   TYR E  62      60.453  -3.287 244.915  1.00 31.57           O
ATOM  11798  N    ILE E  63      59.174   3.128 248.228  1.00 29.07           N
ATOM  11799  CA   ILE E  63      60.232   3.095 249.215  1.00 29.38           C
ATOM  11800  C    ILE E  63      59.710   3.364 250.635  1.00 30.47           C
ATOM  11801  O    ILE E  63      58.934   4.301 250.877  1.00 30.23           O
ATOM  11802  CB   ILE E  63      61.329   4.112 248.892  1.00 28.53           C
ATOM  11803  CG1  ILE E  63      61.837   3.930 247.462  1.00 28.17           C
ATOM  11804  CG2  ILE E  63      62.470   3.951 249.888  1.00 28.19           C
ATOM  11805  CD1  ILE E  63      62.750   5.053 246.990  1.00 27.92           C
ATOM  11806  N    ASP E  64      60.160   2.530 251.567  1.00 30.47           N
ATOM  11807  CA   ASP E  64      59.743   2.638 252.946  1.00 32.09           C
ATOM  11808  C    ASP E  64      60.144   3.998 253.508  1.00 32.83           C
ATOM  11809  O    ASP E  64      61.212   4.545 253.171  1.00 32.81           O
ATOM  11810  CB   ASP E  64      60.348   1.515 253.812  1.00 32.62           C
ATOM  11811  CG   ASP E  64      59.886   0.124 253.399  1.00 33.57           C
ATOM  11812  OD1  ASP E  64      58.708  -0.081 253.055  1.00 39.37           O
ATOM  11813  OD2  ASP E  64      60.716  -0.787 253.408  1.00 33.91           O
ATOM  11814  N    PHE E  65      59.267   4.535 254.361  1.00 31.61           N
ATOM  11815  CA   PHE E  65      59.515   5.746 255.156  1.00 28.39           C
ATOM  11816  C    PHE E  65      59.523   7.037 254.351  1.00 27.32           C
ATOM  11817  O    PHE E  65      58.847   7.962 254.736  1.00 25.94           O
ATOM  11818  CB   PHE E  65      60.802   5.599 255.959  1.00 28.07           C
ATOM  11819  CG   PHE E  65      60.916   4.271 256.677  1.00 28.89           C
ATOM  11820  CD1  PHE E  65      59.885   3.814 257.498  1.00 28.05           C
ATOM  11821  CD2  PHE E  65      62.051   3.470 256.538  1.00 29.30           C
ATOM  11822  CE1  PHE E  65      59.983   2.598 258.163  1.00 27.37           C
ATOM  11823  CE2  PHE E  65      62.149   2.245 257.203  1.00 29.82           C
ATOM  11824  CZ   PHE E  65      61.111   1.810 258.024  1.00 28.33           C
ATOM  11825  N    ILE E  66      60.258   7.101 253.239  1.00 27.71           N
ATOM  11826  CA   ILE E  66      60.410   8.359 252.475  1.00 27.65           C
ATOM  11827  C    ILE E  66      59.431   8.561 251.305  1.00 28.89           C
ATOM  11828  O    ILE E  66      59.333   9.661 250.768  1.00 29.03           O
ATOM  11829  CB   ILE E  66      61.844   8.530 251.948  1.00 27.18           C
ATOM  11830  CG1  ILE E  66      62.129   7.615 250.743  1.00 27.08           C
ATOM  11831  CG2  ILE E  66      62.840   8.257 253.069  1.00 27.45           C
ATOM  11832  CD1  ILE E  66      63.490   7.863 250.100  1.00 26.90           C
ATOM  11833  N    SER E  67      58.720   7.519 250.882  1.00 30.03           N
```

Appendix 2

```
ATOM  11834  CA   SER E  67      57.662   7.726 249.890  1.00 29.27           C
ATOM  11835  C    SER E  67      56.470   8.451 250.557  1.00 28.63           C
ATOM  11836  O    SER E  67      56.164   8.246 251.733  1.00 25.47           O
ATOM  11837  CB   SER E  67      57.249   6.414 249.204  1.00 29.05           C
ATOM  11838  OG   SER E  67      56.614   5.512 250.087  1.00 28.79           O
ATOM  11839  N    PRO E  68      55.815   9.334 249.807  1.00 29.20           N
ATOM  11840  CA   PRO E  68      54.818  10.180 250.439  1.00 29.74           C
ATOM  11841  C    PRO E  68      53.589   9.412 250.911  1.00 32.16           C
ATOM  11842  O    PRO E  68      52.953   9.841 251.862  1.00 34.11           O
ATOM  11843  CB   PRO E  68      54.453  11.179 249.336  1.00 27.99           C
ATOM  11844  CG   PRO E  68      54.763  10.478 248.070  1.00 27.77           C
ATOM  11845  CD   PRO E  68      55.958   9.622 248.369  1.00 28.82           C
ATOM  11846  N    PHE E  69      53.259   8.294 250.270  1.00 33.25           N
ATOM  11847  CA   PHE E  69      52.074   7.516 250.646  1.00 34.45           C
ATOM  11848  C    PHE E  69      52.436   6.165 251.310  1.00 33.66           C
ATOM  11849  O    PHE E  69      51.770   5.131 251.108  1.00 33.75           O
ATOM  11850  CB   PHE E  69      51.157   7.349 249.418  1.00 35.18           C
ATOM  11851  CG   PHE E  69      50.478   8.624 249.002  1.00 35.14           C
ATOM  11852  CD1  PHE E  69      49.270   8.993 249.569  1.00 34.71           C
ATOM  11853  CD2  PHE E  69      51.057   9.463 248.063  1.00 34.81           C
ATOM  11854  CE1  PHE E  69      48.653  10.161 249.202  1.00 34.40           C
ATOM  11855  CE2  PHE E  69      50.440  10.636 247.682  1.00 33.59           C
ATOM  11856  CZ   PHE E  69      49.241  10.987 248.257  1.00 35.57           C
ATOM  11857  N    TYR E  70      53.478   6.203 252.135  1.00 31.19           N
ATOM  11858  CA   TYR E  70      54.004   5.011 252.765  1.00 29.69           C
ATOM  11859  C    TYR E  70      53.135   4.669 253.971  1.00 28.77           C
ATOM  11860  O    TYR E  70      52.877   3.483 254.218  1.00 28.80           O
ATOM  11861  CB   TYR E  70      55.490   5.180 253.168  1.00 29.80           C
ATOM  11862  CG   TYR E  70      55.956   4.140 254.156  1.00 29.99           C
ATOM  11863  CD1  TYR E  70      56.329   2.861 253.730  1.00 31.25           C
ATOM  11864  CD2  TYR E  70      55.984   4.410 255.516  1.00 30.61           C
ATOM  11865  CE1  TYR E  70      56.725   1.876 254.637  1.00 32.39           C
ATOM  11866  CE2  TYR E  70      56.389   3.435 256.435  1.00 33.63           C
ATOM  11867  CZ   TYR E  70      56.759   2.164 255.990  1.00 34.17           C
ATOM  11868  OH   TYR E  70      57.157   1.184 256.891  1.00 36.80           O
ATOM  11869  N    SER E  71      52.686   5.684 254.718  1.00 27.92           N
ATOM  11870  CA   SER E  71      51.874   5.431 255.926  1.00 27.47           C
ATOM  11871  C    SER E  71      50.929   6.566 256.256  1.00 27.73           C
ATOM  11872  O    SER E  71      51.015   7.660 255.684  1.00 26.50           O
ATOM  11873  CB   SER E  71      52.754   5.164 257.147  1.00 27.79           C
ATOM  11874  OG   SER E  71      52.873   6.316 257.950  1.00 27.25           O
ATOM  11875  N    ARG E  72      50.020   6.312 257.192  1.00 28.18           N
ATOM  11876  CA   ARG E  72      49.053   7.327 257.510  1.00 29.69           C
ATOM  11877  C    ARG E  72      49.484   8.177 258.692  1.00 28.85           C
ATOM  11878  O    ARG E  72      48.727   9.018 259.140  1.00 28.79           O
ATOM  11879  CB   ARG E  72      47.627   6.759 257.632  1.00 32.93           C
ATOM  11880  CG   ARG E  72      47.362   5.596 258.585  1.00 36.79           C
ATOM  11881  CD   ARG E  72      45.847   5.461 258.899  1.00 38.67           C
ATOM  11882  NE   ARG E  72      45.100   4.639 257.928  1.00 40.74           N
ATOM  11883  CZ   ARG E  72      44.374   3.550 258.229  1.00 44.65           C
ATOM  11884  NH1  ARG E  72      43.750   2.866 257.263  1.00 42.93           N
ATOM  11885  NH2  ARG E  72      44.253   3.123 259.492  1.00 43.92           N
ATOM  11886  N    GLY E  73      50.729   8.009 259.142  1.00 29.25           N
ATOM  11887  CA   GLY E  73      51.251   8.754 260.290  1.00 28.75           C
```

Appendix 2

```
ATOM  11888  C    GLY E  73      51.554  10.189 259.959  1.00 29.33           C
ATOM  11889  O    GLY E  73      51.560  10.585 258.790  1.00 29.64           O
ATOM  11890  N    CYS E  74      51.814  10.985 260.985  1.00 30.70           N
ATOM  11891  CA   CYS E  74      52.202  12.387 260.765  1.00 31.67           C
ATOM  11892  C    CYS E  74      53.702  12.492 260.512  1.00 31.19           C
ATOM  11893  O    CYS E  74      54.455  12.988 261.329  1.00 33.60           O
ATOM  11894  CB   CYS E  74      51.708  13.285 261.906  1.00 30.93           C
ATOM  11895  SG   CYS E  74      49.887  13.382 261.906  1.00 31.61           S
ATOM  11896  N    SER E  75      54.078  12.016 259.330  1.00 31.51           N
ATOM  11897  CA   SER E  75      55.440  11.861 258.867  1.00 31.15           C
ATOM  11898  C    SER E  75      55.507  12.522 257.501  1.00 30.21           C
ATOM  11899  O    SER E  75      54.739  12.159 256.627  1.00 30.50           O
ATOM  11900  CB   SER E  75      55.731  10.367 258.705  1.00 31.67           C
ATOM  11901  OG   SER E  75      56.854  10.172 257.860  1.00 36.23           O
ATOM  11902  N    PHE E  76      56.411  13.477 257.300  1.00 30.72           N
ATOM  11903  CA   PHE E  76      56.406  14.284 256.069  1.00 30.45           C
ATOM  11904  C    PHE E  76      57.748  14.322 255.322  1.00 31.56           C
ATOM  11905  O    PHE E  76      58.015  15.213 254.523  1.00 33.94           O
ATOM  11906  CB   PHE E  76      55.838  15.655 256.389  1.00 28.89           C
ATOM  11907  CG   PHE E  76      54.383  15.601 256.667  1.00 28.74           C
ATOM  11908  CD1  PHE E  76      53.484  15.544 255.630  1.00 28.73           C
ATOM  11909  CD2  PHE E  76      53.909  15.510 257.963  1.00 30.38           C
ATOM  11910  CE1  PHE E  76      52.131  15.452 255.868  1.00 28.33           C
ATOM  11911  CE2  PHE E  76      52.552  15.416 258.217  1.00 29.36           C
ATOM  11912  CZ   PHE E  76      51.664  15.391 257.161  1.00 29.42           C
ATOM  11913  N    GLU E  77      58.539  13.287 255.551  1.00 31.18           N
ATOM  11914  CA   GLU E  77      59.864  13.108 254.965  1.00 32.47           C
ATOM  11915  C    GLU E  77      59.884  13.354 253.459  1.00 32.02           C
ATOM  11916  O    GLU E  77      60.733  14.078 252.948  1.00 32.39           O
ATOM  11917  CB   GLU E  77      60.381  11.675 255.236  1.00 34.19           C
ATOM  11918  CG   GLU E  77      59.815  10.984 256.492  1.00 35.90           C
ATOM  11919  CD   GLU E  77      60.691  11.161 257.695  1.00 37.69           C
ATOM  11920  OE1  GLU E  77      60.253  11.781 258.709  1.00 39.50           O
ATOM  11921  OE2  GLU E  77      61.831  10.661 257.599  1.00 39.58           O
ATOM  11922  N    ALA E  78      58.949  12.743 252.742  1.00 32.34           N
ATOM  11923  CA   ALA E  78      58.947  12.822 251.278  1.00 31.08           C
ATOM  11924  C    ALA E  78      58.850  14.272 250.805  1.00 31.36           C
ATOM  11925  O    ALA E  78      59.385  14.633 249.743  1.00 31.24           O
ATOM  11926  CB   ALA E  78      57.812  11.995 250.692  1.00 30.39           C
ATOM  11927  N    TRP E  79      58.162  15.082 251.605  1.00 29.62           N
ATOM  11928  CA   TRP E  79      58.012  16.497 251.343  1.00 29.07           C
ATOM  11929  C    TRP E  79      59.267  17.303 251.741  1.00 28.16           C
ATOM  11930  O    TRP E  79      59.628  18.254 251.071  1.00 27.31           O
ATOM  11931  CB   TRP E  79      56.718  17.028 252.020  1.00 27.30           C
ATOM  11932  CG   TRP E  79      55.463  16.563 251.334  1.00 25.70           C
ATOM  11933  CD1  TRP E  79      54.814  17.193 250.322  1.00 26.57           C
ATOM  11934  CD2  TRP E  79      54.718  15.369 251.591  1.00 25.01           C
ATOM  11935  NE1  TRP E  79      53.708  16.476 249.935  1.00 24.17           N
ATOM  11936  CE2  TRP E  79      53.629  15.353 250.702  1.00 24.15           C
ATOM  11937  CE3  TRP E  79      54.867  14.302 252.483  1.00 25.80           C
ATOM  11938  CZ2  TRP E  79      52.693  14.327 250.689  1.00 24.61           C
ATOM  11939  CZ3  TRP E  79      53.922  13.264 252.459  1.00 24.39           C
ATOM  11940  CH2  TRP E  79      52.856  13.294 251.584  1.00 24.39           C
ATOM  11941  N    GLU E  80      59.919  16.930 252.828  1.00 31.35           N
```

Appendix 2

```
ATOM  11942  CA   GLU E  80      61.223  17.517 253.197  1.00 33.80           C
ATOM  11943  C    GLU E  80      62.278  17.306 252.088  1.00 32.71           C
ATOM  11944  O    GLU E  80      63.000  18.224 251.744  1.00 34.07           O
ATOM  11945  CB   GLU E  80      61.723  16.916 254.527  1.00 36.57           C
ATOM  11946  CG   GLU E  80      61.067  17.528 255.774  1.00 41.19           C
ATOM  11947  CD   GLU E  80      60.916  16.575 256.976  1.00 41.13           C
ATOM  11948  OE1  GLU E  80      61.611  15.519 257.021  1.00 41.99           O
ATOM  11949  OE2  GLU E  80      60.096  16.913 257.379  1.00 36.09           O
ATOM  11950  N    LEU E  81      62.344  16.105 251.521  1.00 32.07           N
ATOM  11951  CA   LEU E  81      63.273  15.806 250.420  1.00 34.62           C
ATOM  11952  C    LEU E  81      63.015  16.603 249.117  1.00 34.94           C
ATOM  11953  O    LEU E  81      63.950  16.869 248.358  1.00 34.64           O
ATOM  11954  CB   LEU E  81      63.257  14.301 250.119  1.00 34.90           C
ATOM  11955  CG   LEU E  81      63.765  13.413 251.265  1.00 36.27           C
ATOM  11956  CD1  LEU E  81      63.498  11.952 250.940  1.00 37.41           C
ATOM  11957  CD2  LEU E  81      65.248  13.641 251.552  1.00 35.53           C
ATOM  11958  N    LYS E  82      61.749  16.955 248.873  1.00 33.79           N
ATOM  11959  CA   LYS E  82      61.337  17.833 247.764  1.00 33.82           C
ATOM  11960  C    LYS E  82      61.441  19.340 248.083  1.00 31.97           C
ATOM  11961  O    LYS E  82      61.317  20.178 247.190  1.00 29.33           O
ATOM  11962  CB   LYS E  82      59.892  17.507 247.355  1.00 35.10           C
ATOM  11963  CG   LYS E  82      59.801  16.479 246.240  1.00 36.11           C
ATOM  11964  CD   LYS E  82      58.475  15.747 246.231  1.00 37.35           C
ATOM  11965  CE   LYS E  82      57.278  16.685 246.189  1.00 38.36           C
ATOM  11966  NZ   LYS E  82      56.077  16.002 245.630  1.00 38.79           N
ATOM  11967  N    HIS E  83      61.677  19.662 249.353  1.00 31.35           N
ATOM  11968  CA   HIS E  83      61.706  21.035 249.845  1.00 31.38           C
ATOM  11969  C    HIS E  83      60.370  21.725 249.564  1.00 30.91           C
ATOM  11970  O    HIS E  83      60.340  22.857 249.101  1.00 31.39           O
ATOM  11971  CB   HIS E  83      62.901  21.830 249.267  1.00 33.11           C
ATOM  11972  CG   HIS E  83      64.190  21.061 249.236  1.00 35.26           C
ATOM  11973  ND1  HIS E  83      65.077  21.046 250.295  1.00 36.44           N
ATOM  11974  CD2  HIS E  83      64.728  20.262 248.280  1.00 35.13           C
ATOM  11975  CE1  HIS E  83      66.109  20.278 249.989  1.00 37.02           C
ATOM  11976  NE2  HIS E  83      65.914  19.780 248.778  1.00 37.16           N
ATOM  11977  N    THR E  84      59.269  21.031 249.857  1.00 30.53           N
ATOM  11978  CA   THR E  84      57.941  21.622 249.793  1.00 29.56           C
ATOM  11979  C    THR E  84      57.728  22.583 250.954  1.00 28.34           C
ATOM  11980  O    THR E  84      57.740  22.174 252.098  1.00 25.49           O
ATOM  11981  CB   THR E  84      56.860  20.554 249.933  1.00 30.57           C
ATOM  11982  OG1  THR E  84      57.068  19.524 248.978  1.00 31.47           O
ATOM  11983  CG2  THR E  84      55.503  21.159 249.701  1.00 32.91           C
ATOM  11984  N    PRO E  85      57.522  23.868 250.668  1.00 29.68           N
ATOM  11985  CA   PRO E  85      57.249  24.806 251.758  1.00 30.60           C
ATOM  11986  C    PRO E  85      56.075  24.356 252.596  1.00 31.49           C
ATOM  11987  O    PRO E  85      55.143  23.746 252.050  1.00 33.46           O
ATOM  11988  CB   PRO E  85      56.899  26.103 251.018  1.00 30.39           C
ATOM  11989  CG   PRO E  85      57.720  26.023 249.777  1.00 30.19           C
ATOM  11990  CD   PRO E  85      57.728  24.566 249.388  1.00 30.42           C
ATOM  11991  N    GLN E  86      56.092  24.660 253.896  1.00 30.24           N
ATOM  11992  CA   GLN E  86      55.007  24.197 254.757  1.00 29.22           C
ATOM  11993  C    GLN E  86      53.639  24.567 254.198  1.00 27.22           C
ATOM  11994  O    GLN E  86      52.755  23.737 254.203  1.00 29.00           O
ATOM  11995  CB   GLN E  86      55.121  24.703 256.194  1.00 28.95           C
```

Appendix 2

```
ATOM  11996  CG   GLN E  86      54.012  24.145 257.098  1.00 29.53           C
ATOM  11997  CD   GLN E  86      52.680  24.901 256.999  1.00 30.00           C
ATOM  11998  OE1  GLN E  86      52.659  26.097 256.757  1.00 31.59           O
ATOM  11999  NE2  GLN E  86      51.565  24.198 257.202  1.00 29.45           N
ATOM  12000  N    ARG E  87      53.459  25.791 253.727  1.00 25.42           N
ATOM  12001  CA   ARG E  87      52.125  26.250 253.300  1.00 26.49           C
ATOM  12002  C    ARG E  87      51.542  25.478 252.095  1.00 26.20           C
ATOM  12003  O    ARG E  87      50.334  25.370 251.930  1.00 26.15           O
ATOM  12004  CB   ARG E  87      52.144  27.746 252.971  1.00 25.97           C
ATOM  12005  CG   ARG E  87      52.446  28.611 254.163  1.00 26.51           C
ATOM  12006  CD   ARG E  87      52.708  30.041 253.746  1.00 27.35           C
ATOM  12007  NE   ARG E  87      53.042  30.903 254.879  1.00 27.34           N
ATOM  12008  CZ   ARG E  87      52.187  31.277 255.827  1.00 27.67           C
ATOM  12009  NH1  ARG E  87      50.929  30.857 255.832  1.00 29.02           N
ATOM  12010  NH2  ARG E  87      52.590  32.078 256.794  1.00 27.68           N
ATOM  12011  N    VAL E  88      52.414  24.920 251.284  1.00 25.55           N
ATOM  12012  CA   VAL E  88      52.018  24.292 250.045  1.00 26.22           C
ATOM  12013  C    VAL E  88      51.724  22.784 250.211  1.00 26.70           C
ATOM  12014  O    VAL E  88      51.166  22.169 249.306  1.00 27.55           O
ATOM  12015  CB   VAL E  88      53.115  24.601 248.987  1.00 27.47           C
ATOM  12016  CG1  VAL E  88      53.263  23.524 247.921  1.00 27.70           C
ATOM  12017  CG2  VAL E  88      52.846  25.975 248.369  1.00 27.65           C
ATOM  12018  N    ILE E  89      52.043  22.207 251.369  1.00 25.44           N
ATOM  12019  CA   ILE E  89      51.880  20.772 251.594  1.00 24.94           C
ATOM  12020  C    ILE E  89      50.438  20.350 251.370  1.00 25.87           C
ATOM  12021  O    ILE E  89      50.176  19.336 250.745  1.00 26.36           O
ATOM  12022  CB   ILE E  89      52.350  20.334 253.016  1.00 24.65           C
ATOM  12023  CG1  ILE E  89      53.851  20.642 253.215  1.00 25.15           C
ATOM  12024  CG2  ILE E  89      52.128  18.837 253.226  1.00 24.21           C
ATOM  12025  CD1  ILE E  89      54.444  20.243 254.554  1.00 25.26           C
ATOM  12026  N    LYS E  90      49.495  21.118 251.897  1.00 27.78           N
ATOM  12027  CA   LYS E  90      48.077  20.760 251.799  1.00 27.74           C
ATOM  12028  C    LYS E  90      47.643  20.632 250.337  1.00 28.22           C
ATOM  12029  O    LYS E  90      46.844  19.749 250.003  1.00 26.97           O
ATOM  12030  CB   LYS E  90      47.180  21.782 252.552  1.00 27.37           C
ATOM  12031  CG   LYS E  90      47.281  23.225 252.061  1.00 26.94           C
ATOM  12032  CD   LYS E  90      46.381  24.180 252.829  1.00 26.88           C
ATOM  12033  CE   LYS E  90      46.757  24.371 254.296  1.00 27.50           C
ATOM  12034  NZ   LYS E  90      48.040  25.093 254.569  1.00 28.06           N
ATOM  12035  N    TYR E  91      48.174  21.509 249.473  1.00 29.31           N
ATOM  12036  CA   TYR E  91      47.809  21.498 248.049  1.00 28.67           C
ATOM  12037  C    TYR E  91      48.412  20.258 247.400  1.00 28.27           C
ATOM  12038  O    TYR E  91      47.775  19.596 246.596  1.00 32.51           O
ATOM  12039  CB   TYR E  91      48.215  22.796 247.326  1.00 28.65           C
ATOM  12040  CG   TYR E  91      47.713  24.019 248.037  1.00 30.82           C
ATOM  12041  CD1  TYR E  91      46.353  24.210 248.257  1.00 33.27           C
ATOM  12042  CD2  TYR E  91      48.594  24.954 248.553  1.00 32.22           C
ATOM  12043  CE1  TYR E  91      45.888  25.308 248.964  1.00 34.43           C
ATOM  12044  CE2  TYR E  91      48.143  26.052 249.258  1.00 33.08           C
ATOM  12045  CZ   TYR E  91      46.792  26.234 249.465  1.00 33.93           C
ATOM  12046  OH   TYR E  91      46.354  27.335 250.178  1.00 33.21           O
ATOM  12047  N    SER E  92      49.628  19.923 247.782  1.00 27.48           N
ATOM  12048  CA   SER E  92      50.296  18.740 247.263  1.00 26.34           C
ATOM  12049  C    SER E  92      49.509  17.458 247.594  1.00 27.42           C
```

Appendix 2

```
ATOM  12050  O    SER E  92      49.360  16.573 246.760  1.00 26.51           O
ATOM  12051  CB   SER E  92      51.715  18.665 247.802  1.00 24.35           C
ATOM  12052  OG   SER E  92      52.139  17.334 247.801  1.00 24.96           O
ATOM  12053  N    ILE E  93      48.969  17.373 248.798  1.00 29.88           N
ATOM  12054  CA   ILE E  93      48.218  16.181 249.182  1.00 30.92           C
ATOM  12055  C    ILE E  93      46.888  16.169 248.427  1.00 33.34           C
ATOM  12056  O    ILE E  93      46.456  15.104 247.963  1.00 38.03           O
ATOM  12057  CB   ILE E  93      47.989  16.077 250.709  1.00 30.14           C
ATOM  12058  CG1  ILE E  93      49.329  16.107 251.449  1.00 30.14           C
ATOM  12059  CG2  ILE E  93      47.242  14.793 251.084  1.00 28.55           C
ATOM  12060  CD1  ILE E  93      49.178  16.401 252.924  1.00 30.30           C
ATOM  12061  N    ALA E  94      46.239  17.325 248.277  1.00 32.42           N
ATOM  12062  CA   ALA E  94      44.943  17.353 247.565  1.00 31.95           C
ATOM  12063  C    ALA E  94      45.110  16.945 246.095  1.00 31.11           C
ATOM  12064  O    ALA E  94      44.360  16.089 245.587  1.00 28.17           O
ATOM  12065  CB   ALA E  94      44.281  18.718 247.682  1.00 32.36           C
ATOM  12066  N    PHE E  95      46.111  17.530 245.436  1.00 30.35           N
ATOM  12067  CA   PHE E  95      46.344  17.247 244.035  1.00 31.17           C
ATOM  12068  C    PHE E  95      46.750  15.808 243.759  1.00 29.84           C
ATOM  12069  O    PHE E  95      46.190  15.197 242.835  1.00 30.02           O
ATOM  12070  CB   PHE E  95      47.297  18.261 243.416  1.00 33.21           C
ATOM  12071  CG   PHE E  95      46.697  19.630 243.319  1.00 37.03           C
ATOM  12072  CD1  PHE E  95      45.403  19.798 242.829  1.00 40.86           C
ATOM  12073  CD2  PHE E  95      47.391  20.734 243.735  1.00 38.86           C
ATOM  12074  CE1  PHE E  95      44.823  21.048 242.762  1.00 43.54           C
ATOM  12075  CE2  PHE E  95      46.824  21.986 243.673  1.00 41.22           C
ATOM  12076  CZ   PHE E  95      45.543  22.149 243.187  1.00 43.74           C
ATOM  12077  N    TYR E  96      47.652  15.248 244.568  1.00 27.59           N
ATOM  12078  CA   TYR E  96      47.886  13.793 244.543  1.00 26.14           C
ATOM  12079  C    TYR E  96      46.565  13.030 244.578  1.00 26.53           C
ATOM  12080  O    TYR E  96      46.295  12.188 243.691  1.00 25.91           O
ATOM  12081  CB   TYR E  96      48.773  13.322 245.702  1.00 25.30           C
ATOM  12082  CG   TYR E  96      50.264  13.471 245.463  1.00 25.45           C
ATOM  12083  CD1  TYR E  96      50.838  13.112 244.235  1.00 26.41           C
ATOM  12084  CD2  TYR E  96      51.107  13.930 246.467  1.00 24.98           C
ATOM  12085  CE1  TYR E  96      52.200  13.247 244.020  1.00 26.95           C
ATOM  12086  CE2  TYR E  96      52.474  14.057 246.260  1.00 25.03           C
ATOM  12087  CZ   TYR E  96      53.002  13.704 245.041  1.00 26.07           C
ATOM  12088  OH   TYR E  96      54.321  13.828 244.800  1.00 27.70           O
ATOM  12089  N    ALA E  97      45.728  13.369 245.569  1.00 25.70           N
ATOM  12090  CA   ALA E  97      44.453  12.696 245.767  1.00 24.61           C
ATOM  12091  C    ALA E  97      43.493  12.847 244.564  1.00 25.86           C
ATOM  12092  O    ALA E  97      42.859  11.873 244.161  1.00 24.97           O
ATOM  12093  CB   ALA E  97      43.799  13.153 247.050  1.00 23.59           C
ATOM  12094  N    TYR E  98      43.386  14.033 243.973  1.00 27.07           N
ATOM  12095  CA   TYR E  98      42.502  14.154 242.801  1.00 29.08           C
ATOM  12096  C    TYR E  98      42.952  13.172 241.707  1.00 30.85           C
ATOM  12097  O    TYR E  98      42.131  12.411 241.169  1.00 30.98           O
ATOM  12098  CB   TYR E  98      42.378  15.611 242.311  1.00 27.79           C
ATOM  12099  CG   TYR E  98      41.947  16.534 243.429  1.00 27.97           C
ATOM  12100  CD1  TYR E  98      41.244  16.029 244.538  1.00 27.62           C
ATOM  12101  CD2  TYR E  98      42.254  17.907 243.416  1.00 28.29           C
ATOM  12102  CE1  TYR E  98      40.870  16.845 245.582  1.00 26.82           C
ATOM  12103  CE2  TYR E  98      41.880  18.731 244.483  1.00 27.02           C
```

Appendix 2

```
ATOM  12104  CZ   TYR E  98    41.187  18.177  245.548  1.00  26.95           C
ATOM  12105  OH   TYR E  98    40.764  18.920  246.604  1.00  29.22           O
ATOM  12106  N    GLY E  99    44.259  13.150  241.439  1.00  32.42           N
ATOM  12107  CA   GLY E  99    44.855  12.203  240.492  1.00  32.36           C
ATOM  12108  C    GLY E  99    44.535  10.756  240.823  1.00  33.01           C
ATOM  12109  O    GLY E  99    44.122   9.987  239.953  1.00  33.40           O
ATOM  12110  N    LEU E 100    44.704  10.389  242.090  1.00  33.93           N
ATOM  12111  CA   LEU E 100    44.421   9.024  242.534  1.00  33.54           C
ATOM  12112  C    LEU E 100    42.947   8.631  242.299  1.00  33.35           C
ATOM  12113  O    LEU E 100    42.661   7.470  242.024  1.00  31.48           O
ATOM  12114  CB   LEU E 100    44.813   8.838  244.004  1.00  33.56           C
ATOM  12115  CG   LEU E 100    46.325   8.875  244.275  1.00  34.68           C
ATOM  12116  CD1  LEU E 100    46.633   9.286  245.696  1.00  34.62           C
ATOM  12117  CD2  LEU E 100    46.972   7.530  243.998  1.00  35.31           C
ATOM  12118  N    ALA E 101    42.032   9.598  242.403  1.00  32.56           N
ATOM  12119  CA   ALA E 101    40.625   9.380  242.057  1.00  32.91           C
ATOM  12120  C    ALA E 101    40.452   8.999  240.578  1.00  33.33           C
ATOM  12121  O    ALA E 101    39.711   8.068  240.260  1.00  31.33           O
ATOM  12122  CB   ALA E 101    39.777  10.601  242.389  1.00  32.87           C
ATOM  12123  N    SER E 102    41.141   9.687  239.677  1.00  33.32           N
ATOM  12124  CA   SER E 102    41.053   9.308  238.279  1.00  35.73           C
ATOM  12125  C    SER E 102    41.710   7.943  238.022  1.00  35.53           C
ATOM  12126  O    SER E 102    41.266   7.182  237.168  1.00  34.46           O
ATOM  12127  CB   SER E 102    41.631  10.385  237.379  1.00  37.65           C
ATOM  12128  OG   SER E 102    40.812  11.543  237.409  1.00  43.65           O
ATOM  12129  N    VAL E 103    42.751   7.616  238.773  1.00  36.25           N
ATOM  12130  CA   VAL E 103    43.371   6.300  238.628  1.00  35.34           C
ATOM  12131  C    VAL E 103    42.371   5.203  238.998  1.00  34.46           C
ATOM  12132  O    VAL E 103    42.351   4.151  238.361  1.00  37.83           O
ATOM  12133  CB   VAL E 103    44.674   6.160  239.445  1.00  34.98           C
ATOM  12134  CG1  VAL E 103    45.234   4.750  239.325  1.00  34.51           C
ATOM  12135  CG2  VAL E 103    45.713   7.170  238.971  1.00  36.45           C
ATOM  12136  N    ALA E 104    41.515   5.458  239.980  1.00  31.76           N
ATOM  12137  CA   ALA E 104    40.434   4.532  240.278  1.00  33.56           C
ATOM  12138  C    ALA E 104    39.517   4.258  239.073  1.00  33.57           C
ATOM  12139  O    ALA E 104    39.142   3.122  238.843  1.00  34.70           O
ATOM  12140  CB   ALA E 104    39.621   5.036  241.453  1.00  36.08           C
ATOM  12141  N    LEU E 105    39.160   5.290  238.312  1.00  35.09           N
ATOM  12142  CA   LEU E 105    38.408   5.108  237.052  1.00  35.74           C
ATOM  12143  C    LEU E 105    39.207   4.387  235.969  1.00  36.20           C
ATOM  12144  O    LEU E 105    38.673   3.518  235.303  1.00  37.73           O
ATOM  12145  CB   LEU E 105    37.942   6.447  236.471  1.00  35.12           C
ATOM  12146  CG   LEU E 105    36.843   7.155  237.249  1.00  36.85           C
ATOM  12147  CD1  LEU E 105    36.463   8.479  236.577  1.00  36.30           C
ATOM  12148  CD2  LEU E 105    35.639   6.230  237.417  1.00  34.93           C
ATOM  12149  N    ILE E 106    40.472   4.748  235.788  1.00  36.45           N
ATOM  12150  CA   ILE E 106    41.244   4.236  234.664  1.00  38.82           C
ATOM  12151  C    ILE E 106    41.427   2.717  234.669  1.00  39.22           C
ATOM  12152  O    ILE E 106    41.067   2.067  233.695  1.00  40.37           O
ATOM  12153  CB   ILE E 106    42.616   4.934  234.542  1.00  41.60           C
ATOM  12154  CG1  ILE E 106    42.412   6.397  234.112  1.00  41.98           C
ATOM  12155  CG2  ILE E 106    43.501   4.213  233.521  1.00  42.74           C
ATOM  12156  CD1  ILE E 106    43.680   7.211  234.013  1.00  41.81           C
ATOM  12157  N    ASP E 107    41.991   2.167  235.747  1.00  41.02           N
```

Appendix 2

```
ATOM  12158  CA   ASP E 107    42.314   0.720 235.855  1.00 39.67           C
ATOM  12159  C    ASP E 107    41.654   0.205 237.131  1.00 38.04           C
ATOM  12160  O    ASP E 107    42.072   0.561 238.223  1.00 40.05           O
ATOM  12161  CB   ASP E 107    43.856   0.516 235.893  1.00 39.05           C
ATOM  12162  CG   ASP E 107    44.302  -0.958 235.896  1.00 39.37           C
ATOM  12163  OD1  ASP E 107    43.476  -1.904 235.839  1.00 40.76           O
ATOM  12164  OD2  ASP E 107    45.533  -1.161 235.951  1.00 39.74           O
ATOM  12165  N    PRO E 108    40.615  -0.625 237.002  1.00 37.96           N
ATOM  12166  CA   PRO E 108    40.010  -1.213 238.203  1.00 37.61           C
ATOM  12167  C    PRO E 108    40.929  -2.185 238.952  1.00 35.93           C
ATOM  12168  O    PRO E 108    40.686  -2.471 240.117  1.00 34.39           O
ATOM  12169  CB   PRO E 108    38.779  -1.957 237.654  1.00 38.21           C
ATOM  12170  CG   PRO E 108    38.555  -1.390 236.295  1.00 37.77           C
ATOM  12171  CD   PRO E 108    39.910  -1.033 235.777  1.00 37.33           C
ATOM  12172  N    LYS E 109    41.967  -2.691 238.291  1.00 37.51           N
ATOM  12173  CA   LYS E 109    42.979  -3.503 238.973  1.00 38.96           C
ATOM  12174  C    LYS E 109    43.717  -2.639 240.031  1.00 36.66           C
ATOM  12175  O    LYS E 109    44.151  -3.151 241.056  1.00 36.25           O
ATOM  12176  CB   LYS E 109    43.948  -4.160 237.961  1.00 38.04           C
ATOM  12177  N    LEU E 110    43.806  -1.331 239.798  1.00 36.35           N
ATOM  12178  CA   LEU E 110    44.431  -0.396 240.751  1.00 37.25           C
ATOM  12179  C    LEU E 110    43.478   0.406 241.650  1.00 36.94           C
ATOM  12180  O    LEU E 110    43.944   1.212 242.459  1.00 35.06           O
ATOM  12181  CB   LEU E 110    45.324   0.594 239.996  1.00 38.23           C
ATOM  12182  CG   LEU E 110    46.538  -0.010 239.283  1.00 38.77           C
ATOM  12183  CD1  LEU E 110    47.206   1.021 238.385  1.00 38.18           C
ATOM  12184  CD2  LEU E 110    47.520  -0.550 240.316  1.00 39.46           C
ATOM  12185  N    ARG E 111    42.166   0.196 241.515  1.00 36.64           N
ATOM  12186  CA   ARG E 111    41.165   0.922 242.320  1.00 37.06           C
ATOM  12187  C    ARG E 111    41.399   0.811 243.845  1.00 34.76           C
ATOM  12188  O    ARG E 111    41.234   1.779 244.581  1.00 37.25           O
ATOM  12189  CB   ARG E 111    39.736   0.453 241.971  1.00 37.99           C
ATOM  12190  CG   ARG E 111    38.634   1.140 242.790  1.00 38.40           C
ATOM  12191  CD   ARG E 111    37.344   1.321 241.995  1.00 38.02           C
ATOM  12192  NE   ARG E 111    36.309   2.053 242.734  1.00 37.05           N
ATOM  12193  CZ   ARG E 111    35.158   2.484 242.204  1.00 34.45           C
ATOM  12194  NH1  ARG E 111    34.880   2.272 240.932  1.00 33.18           N
ATOM  12195  NH2  ARG E 111    34.282   3.146 242.945  1.00 33.53           N
ATOM  12196  N    ALA E 112    41.768  -0.369 244.314  1.00 33.22           N
ATOM  12197  CA   ALA E 112    42.054  -0.577 245.734  1.00 33.37           C
ATOM  12198  C    ALA E 112    43.320   0.186 246.196  1.00 34.03           C
ATOM  12199  O    ALA E 112    43.302   0.821 247.233  1.00 32.42           O
ATOM  12200  CB   ALA E 112    42.174  -2.074 246.034  1.00 33.61           C
ATOM  12201  N    LEU E 113    44.403   0.120 245.418  1.00 34.89           N
ATOM  12202  CA   LEU E 113    45.586   0.935 245.676  1.00 36.06           C
ATOM  12203  C    LEU E 113    45.216   2.410 245.797  1.00 35.65           C
ATOM  12204  O    LEU E 113    45.512   3.064 246.789  1.00 38.42           O
ATOM  12205  CB   LEU E 113    46.618   0.777 244.559  1.00 37.82           C
ATOM  12206  CG   LEU E 113    47.997   1.375 244.820  1.00 40.09           C
ATOM  12207  CD1  LEU E 113    48.695   0.642 245.957  1.00 41.21           C
ATOM  12208  CD2  LEU E 113    48.847   1.300 243.566  1.00 42.63           C
ATOM  12209  N    ALA E 114    44.561   2.935 244.784  1.00 34.36           N
ATOM  12210  CA   ALA E 114    44.099   4.309 244.831  1.00 34.24           C
ATOM  12211  C    ALA E 114    43.396   4.630 246.137  1.00 31.77           C
```

Appendix 2

```
ATOM  12212  O    ALA E 114      43.646   5.683 246.727  1.00 29.68           O
ATOM  12213  CB   ALA E 114      43.162   4.584 243.658  1.00 35.52           C
ATOM  12214  N    GLY E 115      42.516   3.716 246.566  1.00 31.67           N
ATOM  12215  CA   GLY E 115      41.718   3.881 247.788  1.00 31.87           C
ATOM  12216  C    GLY E 115      42.573   3.982 249.023  1.00 32.76           C
ATOM  12217  O    GLY E 115      42.420   4.899 249.854  1.00 36.47           O
ATOM  12218  N    HIS E 116      43.496   3.035 249.142  1.00 31.89           N
ATOM  12219  CA   HIS E 116      44.496   3.031 250.206  1.00 31.13           C
ATOM  12220  C    HIS E 116      45.314   4.321 250.261  1.00 30.82           C
ATOM  12221  O    HIS E 116      45.565   4.824 251.359  1.00 33.01           O
ATOM  12222  CB   HIS E 116      45.429   1.835 250.042  1.00 30.69           C
ATOM  12223  CG   HIS E 116      46.596   1.862 250.963  1.00 31.15           C
ATOM  12224  ND1  HIS E 116      47.866   2.186 250.538  1.00 30.73           N
ATOM  12225  CD2  HIS E 116      46.688   1.624 252.291  1.00 30.73           C
ATOM  12226  CE1  HIS E 116      48.694   2.133 251.565  1.00 29.74           C
ATOM  12227  NE2  HIS E 116      48.003   1.802 252.639  1.00 29.15           N
ATOM  12228  N    ASP E 117      45.725   4.854 249.105  1.00 28.00           N
ATOM  12229  CA   ASP E 117      46.528   6.091 249.085  1.00 28.87           C
ATOM  12230  C    ASP E 117      45.672   7.266 249.534  1.00 29.64           C
ATOM  12231  O    ASP E 117      46.129   8.142 250.281  1.00 25.92           O
ATOM  12232  CB   ASP E 117      47.169   6.384 247.702  1.00 27.70           C
ATOM  12233  CG   ASP E 117      48.288   5.400 247.348  1.00 27.87           C
ATOM  12234  OD1  ASP E 117      48.873   4.793 248.274  1.00 27.50           O
ATOM  12235  OD2  ASP E 117      48.568   5.199 246.147  1.00 26.29           O
ATOM  12236  N    LEU E 118      44.427   7.273 249.068  1.00 31.00           N
ATOM  12237  CA   LEU E 118      43.496   8.318 249.445  1.00 31.64           C
ATOM  12238  C    LEU E 118      43.256   8.268 250.959  1.00 30.81           C
ATOM  12239  O    LEU E 118      43.145   9.312 251.618  1.00 30.55           O
ATOM  12240  CB   LEU E 118      42.175   8.181 248.661  1.00 33.84           C
ATOM  12241  CG   LEU E 118      42.076   8.798 247.247  1.00 33.00           C
ATOM  12242  CD1  LEU E 118      40.802   8.344 246.543  1.00 32.93           C
ATOM  12243  CD2  LEU E 118      42.125  10.312 247.301  1.00 32.19           C
ATOM  12244  N    ASP E 119      43.186   7.061 251.511  1.00 30.80           N
ATOM  12245  CA   ASP E 119      43.062   6.900 252.963  1.00 32.30           C
ATOM  12246  C    ASP E 119      44.202   7.649 253.656  1.00 33.48           C
ATOM  12247  O    ASP E 119      43.983   8.461 254.571  1.00 35.63           O
ATOM  12248  CB   ASP E 119      43.149   5.427 253.330  1.00 32.65           C
ATOM  12249  CG   ASP E 119      42.810   5.159 254.759  1.00 32.66           C
ATOM  12250  OD1  ASP E 119      42.549   6.069 255.565  1.00 35.19           O
ATOM  12251  OD2  ASP E 119      42.776   3.983 255.081  1.00 35.70           O
ATOM  12252  N    ILE E 120      45.420   7.372 253.196  1.00 31.30           N
ATOM  12253  CA   ILE E 120      46.611   8.023 253.722  1.00 29.68           C
ATOM  12254  C    ILE E 120      46.574   9.526 253.508  1.00 27.67           C
ATOM  12255  O    ILE E 120      46.929  10.282 254.401  1.00 28.10           O
ATOM  12256  CB   ILE E 120      47.875   7.415 253.096  1.00 29.06           C
ATOM  12257  CG1  ILE E 120      48.096   6.017 253.688  1.00 28.99           C
ATOM  12258  CG2  ILE E 120      49.082   8.331 253.291  1.00 28.78           C
ATOM  12259  CD1  ILE E 120      49.122   5.187 252.948  1.00 29.79           C
ATOM  12260  N    ALA E 121      46.132   9.946 252.333  1.00 26.97           N
ATOM  12261  CA   ALA E 121      46.074  11.362 251.997  1.00 27.39           C
ATOM  12262  C    ALA E 121      45.216  12.130 253.001  1.00 29.45           C
ATOM  12263  O    ALA E 121      45.597  13.205 253.460  1.00 29.73           O
ATOM  12264  CB   ALA E 121      45.528  11.543 250.594  1.00 27.04           C
ATOM  12265  N    VAL E 122      44.057  11.562 253.334  1.00 30.26           N
```

Appendix 2

```
ATOM  12266  CA   VAL E 122   43.134  12.174  254.262  1.00  29.67    C
ATOM  12267  C    VAL E 122   43.772  12.258  255.640  1.00  29.09    C
ATOM  12268  O    VAL E 122   43.729  13.321  256.270  1.00  29.29    O
ATOM  12269  CB   VAL E 122   41.803  11.382  254.295  1.00  32.17    C
ATOM  12270  CG1  VAL E 122   40.885  11.812  255.450  1.00  30.60    C
ATOM  12271  CG2  VAL E 122   41.088  11.514  252.950  1.00  32.75    C
ATOM  12272  N    SER E 123   44.365  11.157  256.115  1.00  28.94    N
ATOM  12273  CA   SER E 123   45.034  11.156  257.449  1.00  28.41    C
ATOM  12274  C    SER E 123   46.137  12.167  257.515  1.00  27.70    C
ATOM  12275  O    SER E 123   46.281  12.838  258.513  1.00  28.28    O
ATOM  12276  CB   SER E 123   45.681   9.820  257.786  1.00  28.40    C
ATOM  12277  OG   SER E 123   44.767   8.779  257.580  1.00  31.67    O
ATOM  12278  N    LYS E 124   46.936  12.246  256.459  1.00  27.29    N
ATOM  12279  CA   LYS E 124   48.057  13.152  256.455  1.00  28.43    C
ATOM  12280  C    LYS E 124   47.539  14.575  256.366  1.00  28.33    C
ATOM  12281  O    LYS E 124   48.095  15.495  256.986  1.00  29.34    O
ATOM  12282  CB   LYS E 124   49.045  12.824  255.330  1.00  28.20    C
ATOM  12283  CG   LYS E 124   50.076  11.757  255.707  1.00  27.42    C
ATOM  12284  CD   LYS E 124   51.127  11.644  254.606  1.00  28.67    C
ATOM  12285  CE   LYS E 124   52.217  10.585  254.816  1.00  28.02    C
ATOM  12286  NZ   LYS E 124   52.645  10.406  256.217  1.00  28.52    N
ATOM  12287  N    MET E 125   46.441  14.742  255.648  1.00  26.75    N
ATOM  12288  CA   MET E 125   45.867  16.063  255.452  1.00  28.00    C
ATOM  12289  C    MET E 125   45.477  16.670  256.785  1.00  28.80    C
ATOM  12290  O    MET E 125   45.627  17.888  256.975  1.00  27.32    O
ATOM  12291  CB   MET E 125   44.633  15.988  254.537  1.00  28.25    C
ATOM  12292  CG   MET E 125   44.059  17.332  254.145  1.00  28.09    C
ATOM  12293  SD   MET E 125   45.174  18.153  253.011  1.00  27.34    S
ATOM  12294  CE   MET E 125   44.094  19.439  252.410  1.00  28.53    C
ATOM  12295  N    LYS E 126   44.974  15.803  257.677  1.00  29.35    N
ATOM  12296  CA   LYS E 126   44.556  16.167  259.037  1.00  30.14    C
ATOM  12297  C    LYS E 126   45.691  16.466  260.056  1.00  29.78    C
ATOM  12298  O    LYS E 126   45.439  17.076  261.095  1.00  29.30    O
ATOM  12299  CB   LYS E 126   43.634  15.081  259.582  1.00  30.86    C
ATOM  12300  CG   LYS E 126   42.219  15.221  259.038  1.00  33.51    C
ATOM  12301  CD   LYS E 126   41.364  13.975  259.200  1.00  34.54    C
ATOM  12302  CE   LYS E 126   41.580  13.315  260.553  1.00  35.88    C
ATOM  12303  NZ   LYS E 126   40.546  12.289  260.836  1.00  36.43    N
ATOM  12304  N    CYS E 127   46.929  16.073  259.752  1.00  29.60    N
ATOM  12305  CA   CYS E 127   48.095  16.385  260.617  1.00  28.45    C
ATOM  12306  C    CYS E 127   48.349  17.883  260.786  1.00  27.63    C
ATOM  12307  O    CYS E 127   48.129  18.666  259.864  1.00  27.56    O
ATOM  12308  CB   CYS E 127   49.352  15.756  260.035  1.00  28.44    C
ATOM  12309  SG   CYS E 127   49.308  13.962  260.008  1.00  28.91    S
ATOM  12310  N    LYS E 128   48.851  18.266  261.951  1.00  27.83    N
ATOM  12311  CA   LYS E 128   49.065  19.678  262.279  1.00  29.98    C
ATOM  12312  C    LYS E 128   50.146  20.359  261.420  1.00  27.61    C
ATOM  12313  O    LYS E 128   50.090  21.534  261.144  1.00  27.85    O
ATOM  12314  CB   LYS E 128   49.391  19.837  263.775  1.00  31.69    C
ATOM  12315  CG   LYS E 128   49.632  21.282  264.161  1.00  32.89    C
ATOM  12316  CD   LYS E 128   49.335  21.570  265.614  1.00  33.72    C
ATOM  12317  CE   LYS E 128   50.075  22.838  266.018  1.00  35.64    C
ATOM  12318  NZ   LYS E 128   49.347  23.624  267.033  1.00  35.59    N
ATOM  12319  N    ARG E 129   51.114  19.600  260.976  1.00  26.30    N
```

Appendix 2

```
ATOM  12320  CA   ARG E 129      52.132  20.123 260.099  1.00 26.16           C
ATOM  12321  C    ARG E 129      51.559  20.697 258.790  1.00 28.05           C
ATOM  12322  O    ARG E 129      52.149  21.604 258.177  1.00 30.54           O
ATOM  12323  CB   ARG E 129      53.135  19.000 259.818  1.00 24.94           C
ATOM  12324  CG   ARG E 129      54.208  19.322 258.807  1.00 24.32           C
ATOM  12325  CD   ARG E 129      54.891  20.661 259.029  1.00 22.92           C
ATOM  12326  NE   ARG E 129      55.941  20.787 258.033  1.00 23.40           N
ATOM  12327  CZ   ARG E 129      56.889  21.721 258.005  1.00 22.06           C
ATOM  12328  NH1  ARG E 129      56.958  22.691 258.902  1.00 21.37           N
ATOM  12329  NH2  ARG E 129      57.765  21.677 257.032  1.00 22.25           N
ATOM  12330  N    VAL E 130      50.423  20.155 258.370  1.00 28.08           N
ATOM  12331  CA   VAL E 130      49.746  20.563 257.144  1.00 27.83           C
ATOM  12332  C    VAL E 130      48.860  21.805 257.369  1.00 27.84           C
ATOM  12333  O    VAL E 130      48.917  22.782 256.598  1.00 26.36           O
ATOM  12334  CB   VAL E 130      48.879  19.383 256.617  1.00 28.19           C
ATOM  12335  CG1  VAL E 130      48.049  19.793 255.417  1.00 27.94           C
ATOM  12336  CG2  VAL E 130      49.746  18.169 256.300  1.00 27.98           C
ATOM  12337  N    TRP E 131      48.028  21.758 258.409  1.00 27.97           N
ATOM  12338  CA   TRP E 131      47.105  22.865 258.678  1.00 29.90           C
ATOM  12339  C    TRP E 131      47.674  23.947 259.582  1.00 29.53           C
ATOM  12340  O    TRP E 131      47.122  25.040 259.662  1.00 30.66           O
ATOM  12341  CB   TRP E 131      45.758  22.361 259.218  1.00 32.25           C
ATOM  12342  CG   TRP E 131      45.749  21.517 260.498  1.00 32.80           C
ATOM  12343  CD1  TRP E 131      45.671  20.131 260.594  1.00 33.62           C
ATOM  12344  CD2  TRP E 131      45.740  22.000 261.831  1.00 33.09           C
ATOM  12345  NE1  TRP E 131      45.651  19.737 261.909  1.00 32.02           N
ATOM  12346  CE2  TRP E 131      45.688  20.860 262.695  1.00 34.77           C
ATOM  12347  CE3  TRP E 131      45.796  23.279 262.394  1.00 33.29           C
ATOM  12348  CZ2  TRP E 131      45.684  20.977 264.091  1.00 34.60           C
ATOM  12349  CZ3  TRP E 131      45.800  23.394 263.787  1.00 34.36           C
ATOM  12350  CH2  TRP E 131      45.740  22.246 264.617  1.00 34.46           C
ATOM  12351  N    GLY E 132      48.813  23.660 260.210  1.00 29.99           N
ATOM  12352  CA   GLY E 132      49.341  24.456 261.328  1.00 27.89           C
ATOM  12353  C    GLY E 132      49.568  25.930 261.091  1.00 27.23           C
ATOM  12354  O    GLY E 132      49.599  26.699 262.048  1.00 27.59           O
ATOM  12355  N    ASP E 133      49.735  26.327 259.828  1.00 27.78           N
ATOM  12356  CA   ASP E 133      49.917  27.744 259.467  1.00 28.47           C
ATOM  12357  C    ASP E 133      48.785  28.595 260.048  1.00 29.18           C
ATOM  12358  O    ASP E 133      49.003  29.725 260.481  1.00 29.36           O
ATOM  12359  CB   ASP E 133      50.053  27.966 257.936  1.00 27.61           C
ATOM  12360  CG   ASP E 133      49.006  27.206 257.128  1.00 29.31           C
ATOM  12361  OD1  ASP E 133      49.083  25.942 257.071  1.00 30.44           O
ATOM  12362  OD2  ASP E 133      48.113  27.866 256.534  1.00 27.84           O
ATOM  12363  N    TRP E 134      47.586  28.026 260.080  1.00 30.23           N
ATOM  12364  CA   TRP E 134      46.413  28.734 260.544  1.00 30.97           C
ATOM  12365  C    TRP E 134      46.601  29.279 261.962  1.00 30.16           C
ATOM  12366  O    TRP E 134      46.414  30.468 262.218  1.00 31.22           O
ATOM  12367  CB   TRP E 134      45.200  27.798 260.449  1.00 32.16           C
ATOM  12368  CG   TRP E 134      43.921  28.480 260.702  1.00 31.74           C
ATOM  12369  CD1  TRP E 134      43.119  28.345 261.793  1.00 32.41           C
ATOM  12370  CD2  TRP E 134      43.295  29.436 259.852  1.00 32.52           C
ATOM  12371  NE1  TRP E 134      42.009  29.156 261.673  1.00 33.24           N
ATOM  12372  CE2  TRP E 134      42.093  29.835 260.485  1.00 33.59           C
ATOM  12373  CE3  TRP E 134      43.625  29.985 258.603  1.00 31.96           C
```

Appendix 2

```
ATOM  12374  CZ2  TRP E 134    41.231  30.771 259.922  1.00 33.81           C
ATOM  12375  CZ3  TRP E 134    42.780  30.903 258.041  1.00 32.74           C
ATOM  12376  CH2  TRP E 134    41.585  31.293 258.699  1.00 35.48           C
ATOM  12377  N    GLU E 135    47.014  28.416 262.873  1.00 31.03           N
ATOM  12378  CA   GLU E 135    47.238  28.810 264.262  1.00 32.68           C
ATOM  12379  C    GLU E 135    48.443  29.735 264.424  1.00 33.60           C
ATOM  12380  O    GLU E 135    48.385  30.711 265.184  1.00 32.41           O
ATOM  12381  CB   GLU E 135    47.426  27.563 265.118  1.00 34.04           C
ATOM  12382  CG   GLU E 135    47.149  27.760 266.595  1.00 35.42           C
ATOM  12383  CD   GLU E 135    47.730  26.640 267.431  1.00 34.08           C
ATOM  12384  OE1  GLU E 135    47.335  25.466 267.249  1.00 33.21           O
ATOM  12385  OE2  GLU E 135    48.586  26.957 268.262  1.00 31.57           O
ATOM  12386  N    GLU E 136    49.516  29.412 263.705  1.00 33.93           N
ATOM  12387  CA   GLU E 136    50.755  30.176 263.746  1.00 36.66           C
ATOM  12388  C    GLU E 136    50.621  31.609 263.203  1.00 34.27           C
ATOM  12389  O    GLU E 136    51.300  32.503 263.664  1.00 34.10           O
ATOM  12390  CB   GLU E 136    51.836  29.413 262.981  1.00 42.20           C
ATOM  12391  CG   GLU E 136    53.248  29.944 263.180  1.00 47.49           C
ATOM  12392  CD   GLU E 136    54.319  28.949 262.755  1.00 51.44           C
ATOM  12393  OE1  GLU E 136    53.981  27.957 262.066  1.00 50.85           O
ATOM  12394  OE2  GLU E 136    55.500  29.164 263.121  1.00 53.19           O
ATOM  12395  N    ASP E 137    49.732  31.830 262.242  1.00 34.09           N
ATOM  12396  CA   ASP E 137    49.501  33.173 261.670  1.00 33.41           C
ATOM  12397  C    ASP E 137    48.602  34.007 262.573  1.00 31.29           C
ATOM  12398  O    ASP E 137    48.457  35.213 262.368  1.00 29.50           O
ATOM  12399  CB   ASP E 137    48.862  33.070 260.269  1.00 33.22           C
ATOM  12400  CG   ASP E 137    49.808  32.499 259.223  1.00 33.26           C
ATOM  12401  OD1  ASP E 137    51.032  32.423 259.481  1.00 32.39           O
ATOM  12402  OD2  ASP E 137    49.327  32.141 258.129  1.00 32.97           O
ATOM  12403  N    GLY E 138    47.988  33.330 263.540  1.00 30.72           N
ATOM  12404  CA   GLY E 138    47.221  33.956 264.602  1.00 31.16           C
ATOM  12405  C    GLY E 138    45.736  33.757 264.424  1.00 31.88           C
ATOM  12406  O    GLY E 138    44.955  34.305 265.178  1.00 30.57           O
ATOM  12407  N    PHE E 139    45.337  32.962 263.432  1.00 33.58           N
ATOM  12408  CA   PHE E 139    43.926  32.935 262.997  1.00 33.81           C
ATOM  12409  C    PHE E 139    42.970  32.069 263.820  1.00 33.28           C
ATOM  12410  O    PHE E 139    41.759  32.203 263.653  1.00 32.18           O
ATOM  12411  CB   PHE E 139    43.815  32.535 261.517  1.00 32.17           C
ATOM  12412  CG   PHE E 139    44.492  33.486 260.578  1.00 31.78           C
ATOM  12413  CD1  PHE E 139    44.232  34.849 260.641  1.00 31.23           C
ATOM  12414  CD2  PHE E 139    45.366  33.015 259.599  1.00 33.57           C
ATOM  12415  CE1  PHE E 139    44.852  35.731 259.776  1.00 32.53           C
ATOM  12416  CE2  PHE E 139    45.990  33.893 258.712  1.00 34.03           C
ATOM  12417  CZ   PHE E 139    45.734  35.257 258.809  1.00 34.11           C
ATOM  12418  N    GLY E 140    43.506  31.204 264.689  1.00 34.24           N
ATOM  12419  CA   GLY E 140    42.691  30.291 265.513  1.00 34.13           C
ATOM  12420  C    GLY E 140    43.343  28.931 265.723  1.00 33.33           C
ATOM  12421  O    GLY E 140    44.347  28.617 265.103  1.00 32.50           O
ATOM  12422  N    THR E 141    42.772  28.119 266.605  1.00 33.67           N
ATOM  12423  CA   THR E 141    43.363  26.821 266.967  1.00 33.73           C
ATOM  12424  C    THR E 141    42.672  25.654 266.293  1.00 33.23           C
ATOM  12425  O    THR E 141    43.185  24.531 266.290  1.00 31.78           O
ATOM  12426  CB   THR E 141    43.348  26.606 268.485  1.00 33.69           C
ATOM  12427  OG1  THR E 141    42.042  26.913 268.993  1.00 32.46           O
```

Appendix 2

```
ATOM  12428  CG2 THR E 141      44.406  27.504 269.149  1.00 33.18           C
ATOM  12429  N   ASP E 142      41.516  25.936 265.704  1.00 34.89           N
ATOM  12430  CA  ASP E 142      40.763  24.949 264.960  1.00 37.03           C
ATOM  12431  C   ASP E 142      40.756  25.395 263.509  1.00 36.24           C
ATOM  12432  O   ASP E 142      40.256  26.475 263.191  1.00 34.15           O
ATOM  12433  CB  ASP E 142      39.345  24.809 265.500  1.00 38.65           C
ATOM  12434  CG  ASP E 142      38.631  23.590 264.954  1.00 42.17           C
ATOM  12435  OD1 ASP E 142      38.782  23.279 263.758  1.00 44.76           O
ATOM  12436  OD2 ASP E 142      37.899  22.938 265.716  1.00 44.46           O
ATOM  12437  N   PRO E 143      41.320  24.560 262.626  1.00 35.24           N
ATOM  12438  CA  PRO E 143      41.440  24.868 261.197  1.00 35.47           C
ATOM  12439  C   PRO E 143      40.141  24.801 260.388  1.00 35.63           C
ATOM  12440  O   PRO E 143      40.114  25.264 259.256  1.00 34.68           O
ATOM  12441  CB  PRO E 143      42.380  23.779 260.701  1.00 35.81           C
ATOM  12442  CG  PRO E 143      42.056  22.620 261.589  1.00 36.18           C
ATOM  12443  CD  PRO E 143      41.896  23.241 262.949  1.00 34.29           C
ATOM  12444  N   ILE E 144      39.087  24.206 260.937  1.00 37.90           N
ATOM  12445  CA  ILE E 144      37.822  24.074 260.204  1.00 38.38           C
ATOM  12446  C   ILE E 144      36.636  24.850 260.805  1.00 41.13           C
ATOM  12447  O   ILE E 144      35.603  24.948 260.153  1.00 46.01           O
ATOM  12448  CB  ILE E 144      37.430  22.577 259.981  1.00 35.84           C
ATOM  12449  CG1 ILE E 144      37.042  21.875 261.282  1.00 33.54           C
ATOM  12450  CG2 ILE E 144      38.567  21.816 259.307  1.00 35.52           C
ATOM  12451  CD1 ILE E 144      36.443  20.511 261.055  1.00 33.44           C
ATOM  12452  N   GLU E 145      36.773  25.400 262.016  1.00 42.31           N
ATOM  12453  CA  GLU E 145      35.643  26.052 262.711  1.00 43.08           C
ATOM  12454  C   GLU E 145      35.033  27.196 261.874  1.00 41.72           C
ATOM  12455  O   GLU E 145      33.815  27.285 261.712  1.00 40.86           O
ATOM  12456  CB  GLU E 145      36.104  26.581 264.082  1.00 45.89           C
ATOM  12457  CG  GLU E 145      34.999  27.025 265.046  1.00 47.68           C
ATOM  12458  CD  GLU E 145      35.416  28.211 265.932  1.00 49.01           C
ATOM  12459  OE1 GLU E 145      36.583  28.267 266.371  1.00 46.53           O
ATOM  12460  OE2 GLU E 145      34.577  29.100 266.198  1.00 47.62           O
ATOM  12461  N   LYS E 146      35.893  28.047 261.333  1.00 39.71           N
ATOM  12462  CA  LYS E 146      35.502  29.265 260.647  1.00 37.06           C
ATOM  12463  C   LYS E 146      36.521  29.485 259.534  1.00 38.38           C
ATOM  12464  O   LYS E 146      37.707  29.185 259.694  1.00 38.24           O
ATOM  12465  CB  LYS E 146      35.505  30.467 261.632  1.00 31.66           C
ATOM  12466  N   GLU E 147      36.077  30.019 258.409  1.00 39.20           N
ATOM  12467  CA  GLU E 147      37.001  30.569 257.413  1.00 40.00           C
ATOM  12468  C   GLU E 147      37.912  29.463 256.842  1.00 40.14           C
ATOM  12469  O   GLU E 147      37.500  28.301 256.770  1.00 41.27           O
ATOM  12470  CB  GLU E 147      37.802  31.735 258.030  1.00 42.45           C
ATOM  12471  CG  GLU E 147      37.009  32.656 258.970  1.00 44.68           C
ATOM  12472  CD  GLU E 147      37.797  33.876 259.429  1.00 48.67           C
ATOM  12473  OE1 GLU E 147      38.805  33.714 260.155  1.00 48.76           O
ATOM  12474  OE2 GLU E 147      37.408  35.009 259.062  1.00 50.30           O
ATOM  12475  N   ASN E 148      39.122  29.823 256.401  1.00 38.98           N
ATOM  12476  CA  ASN E 148      40.159  28.848 256.011  1.00 35.05           C
ATOM  12477  C   ASN E 148      39.652  27.820 255.031  1.00 33.44           C
ATOM  12478  O   ASN E 148      39.926  26.636 255.160  1.00 31.82           O
ATOM  12479  CB  ASN E 148      40.742  28.138 257.244  1.00 35.56           C
ATOM  12480  CG  ASN E 148      42.085  27.444 256.964  1.00 35.18           C
ATOM  12481  OD1 ASN E 148      42.830  27.847 256.073  1.00 34.13           O
```

Appendix 2

```
ATOM  12482  ND2  ASN  E  148    42.397  26.398  257.745  1.00  33.48    N
ATOM  12483  N    ILE  E  149    38.922  28.280  254.027  1.00  33.45    N
ATOM  12484  CA   ILE  E  149    38.403  27.374  252.996  1.00  32.68    C
ATOM  12485  C    ILE  E  149    39.514  26.744  252.098  1.00  32.59    C
ATOM  12486  O    ILE  E  149    39.285  25.742  251.430  1.00  36.55    O
ATOM  12487  CB   ILE  E  149    37.320  28.092  252.161  1.00  30.46    C
ATOM  12488  CG1  ILE  E  149    36.392  27.085  251.485  1.00  31.41    C
ATOM  12489  CG2  ILE  E  149    37.968  29.036  251.156  1.00  30.63    C
ATOM  12490  CD1  ILE  E  149    35.635  26.162  252.409  1.00  30.36    C
ATOM  12491  N    MET  E  150    40.705  27.324  252.078  1.00  31.99    N
ATOM  12492  CA   MET  E  150    41.834  26.733  251.344  1.00  32.88    C
ATOM  12493  C    MET  E  150    42.284  25.386  251.884  1.00  30.98    C
ATOM  12494  O    MET  E  150    42.812  24.585  251.154  1.00  31.19    O
ATOM  12495  CB   MET  E  150    43.045  27.667  251.367  1.00  36.84    C
ATOM  12496  CG   MET  E  150    43.568  28.036  252.755  1.00  38.74    C
ATOM  12497  SD   MET  E  150    44.796  29.374  252.666  1.00  47.65    S
ATOM  12498  CE   MET  E  150    44.636  30.074  254.315  1.00  46.76    C
ATOM  12499  N    TYR  E  151    42.158  25.170  253.183  1.00  29.44    N
ATOM  12500  CA   TYR  E  151    42.474  23.884  253.747  1.00  27.13    C
ATOM  12501  C    TYR  E  151    41.231  22.949  253.703  1.00  28.06    C
ATOM  12502  O    TYR  E  151    41.305  21.813  253.259  1.00  24.40    O
ATOM  12503  CB   TYR  E  151    42.952  24.056  255.182  1.00  25.78    C
ATOM  12504  CG   TYR  E  151    43.105  22.749  255.904  1.00  25.29    C
ATOM  12505  CD1  TYR  E  151    44.151  21.898  255.602  1.00  24.56    C
ATOM  12506  CD2  TYR  E  151    42.176  22.339  256.867  1.00  25.89    C
ATOM  12507  CE1  TYR  E  151    44.289  20.675  256.237  1.00  25.77    C
ATOM  12508  CE2  TYR  E  151    42.305  21.106  257.516  1.00  26.24    C
ATOM  12509  CZ   TYR  E  151    43.374  20.282  257.201  1.00  26.14    C
ATOM  12510  OH   TYR  E  151    43.536  19.064  257.828  1.00  27.01    O
ATOM  12511  N    LYS  E  152    40.089  23.435  254.167  1.00  29.27    N
ATOM  12512  CA   LYS  E  152    38.958  22.551  254.406  1.00  30.94    C
ATOM  12513  C    LYS  E  152    38.125  22.316  253.154  1.00  29.18    C
ATOM  12514  O    LYS  E  152    37.426  21.331  253.064  1.00  30.78    O
ATOM  12515  CB   LYS  E  152    38.098  23.064  255.571  1.00  34.90    C
ATOM  12516  CG   LYS  E  152    37.300  24.342  255.321  1.00  36.22    C
ATOM  12517  CD   LYS  E  152    36.620  24.801  256.604  1.00  38.57    C
ATOM  12518  CE   LYS  E  152    35.627  25.923  256.351  1.00  40.38    C
ATOM  12519  NZ   LYS  E  152    35.360  26.688  257.591  1.00  41.73    N
ATOM  12520  N    GLY  E  153    38.206  23.203  252.178  1.00  29.14    N
ATOM  12521  CA   GLY  E  153    37.656  22.917  250.853  1.00  28.04    C
ATOM  12522  C    GLY  E  153    38.194  21.581  250.403  1.00  28.00    C
ATOM  12523  O    GLY  E  153    37.440  20.614  250.233  1.00  28.30    O
ATOM  12524  N    HIS  E  154    39.516  21.513  250.286  1.00  27.76    N
ATOM  12525  CA   HIS  E  154    40.189  20.303  249.823  1.00  28.15    C
ATOM  12526  C    HIS  E  154    39.892  19.106  250.706  1.00  28.89    C
ATOM  12527  O    HIS  E  154    39.645  17.994  250.216  1.00  29.12    O
ATOM  12528  CB   HIS  E  154    41.689  20.517  249.759  1.00  27.64    C
ATOM  12529  CG   HIS  E  154    42.091  21.519  248.739  1.00  27.75    C
ATOM  12530  ND1  HIS  E  154    42.095  21.241  247.393  1.00  28.61    N
ATOM  12531  CD2  HIS  E  154    42.493  22.800  248.860  1.00  28.29    C
ATOM  12532  CE1  HIS  E  154    42.484  22.309  246.726  1.00  29.35    C
ATOM  12533  NE2  HIS  E  154    42.736  23.271  247.594  1.00  29.69    N
ATOM  12534  N    LEU  E  155    39.909  19.330  252.010  1.00  28.53    N
ATOM  12535  CA   LEU  E  155    39.754  18.221  252.925  1.00  29.67    C
```

Appendix 2

```
ATOM  12536  C    LEU E 155     38.372  17.654 252.671  1.00 30.27           C
ATOM  12537  O    LEU E 155     38.187  16.440 252.623  1.00 31.65           O
ATOM  12538  CB   LEU E 155     39.959  18.649 254.396  1.00 28.22           C
ATOM  12539  CG   LEU E 155     39.644  17.587 255.449  1.00 27.91           C
ATOM  12540  CD1  LEU E 155     40.527  16.384 255.220  1.00 28.19           C
ATOM  12541  CD2  LEU E 155     39.803  18.081 256.889  1.00 28.35           C
ATOM  12542  N    ASN E 156     37.402  18.534 252.466  1.00 30.96           N
ATOM  12543  CA   ASN E 156     36.039  18.069 252.304  1.00 31.82           C
ATOM  12544  C    ASN E 156     35.833  17.349 250.979  1.00 31.77           C
ATOM  12545  O    ASN E 156     35.037  16.423 250.891  1.00 31.92           O
ATOM  12546  CB   ASN E 156     35.031  19.207 252.477  1.00 32.10           C
ATOM  12547  CG   ASN E 156     33.651  18.691 252.853  1.00 31.65           C
ATOM  12548  OD1  ASN E 156     33.512  17.887 253.771  1.00 30.37           O
ATOM  12549  ND2  ASN E 156     32.630  19.143 252.140  1.00 32.41           N
ATOM  12550  N    LEU E 157     36.566  17.781 249.955  1.00 32.96           N
ATOM  12551  CA   LEU E 157     36.537  17.132 248.657  1.00 30.52           C
ATOM  12552  C    LEU E 157     37.263  15.792 248.741  1.00 31.46           C
ATOM  12553  O    LEU E 157     36.851  14.807 248.124  1.00 32.19           O
ATOM  12554  CB   LEU E 157     37.195  18.027 247.620  1.00 30.32           C
ATOM  12555  CG   LEU E 157     37.231  17.514 246.171  1.00 30.72           C
ATOM  12556  CD1  LEU E 157     35.851  17.032 245.724  1.00 30.77           C
ATOM  12557  CD2  LEU E 157     37.788  18.589 245.238  1.00 29.05           C
ATOM  12558  N    MET E 158     38.339  15.745 249.516  1.00 29.94           N
ATOM  12559  CA   MET E 158     39.087  14.513 249.659  1.00 29.09           C
ATOM  12560  C    MET E 158     38.243  13.475 250.406  1.00 30.19           C
ATOM  12561  O    MET E 158     38.235  12.289 250.037  1.00 29.99           O
ATOM  12562  CB   MET E 158     40.417  14.765 250.359  1.00 28.44           C
ATOM  12563  CG   MET E 158     41.410  15.576 249.537  1.00 28.71           C
ATOM  12564  SD   MET E 158     42.814  16.145 250.531  1.00 28.17           S
ATOM  12565  CE   MET E 158     43.304  14.566 251.222  1.00 28.86           C
ATOM  12566  N    TYR E 159     37.522  13.924 251.435  1.00 30.15           N
ATOM  12567  CA   TYR E 159     36.634  13.042 252.183  1.00 31.58           C
ATOM  12568  C    TYR E 159     35.699  12.320 251.212  1.00 32.34           C
ATOM  12569  O    TYR E 159     35.589  11.102 251.221  1.00 33.69           O
ATOM  12570  CB   TYR E 159     35.795  13.839 253.178  1.00 32.18           C
ATOM  12571  CG   TYR E 159     36.417  14.156 254.540  1.00 33.63           C
ATOM  12572  CD1  TYR E 159     37.181  13.212 255.239  1.00 32.88           C
ATOM  12573  CD2  TYR E 159     36.160  15.383 255.170  1.00 33.96           C
ATOM  12574  CE1  TYR E 159     37.694  13.498 256.490  1.00 32.77           C
ATOM  12575  CE2  TYR E 159     36.655  15.667 256.433  1.00 33.32           C
ATOM  12576  CZ   TYR E 159     37.427  14.725 257.088  1.00 34.19           C
ATOM  12577  OH   TYR E 159     37.920  15.004 258.354  1.00 35.62           O
ATOM  12578  N    GLY E 160     35.052  13.092 250.351  1.00 32.77           N
ATOM  12579  CA   GLY E 160     34.105  12.554 249.410  1.00 32.31           C
ATOM  12580  C    GLY E 160     34.716  11.644 248.373  1.00 31.28           C
ATOM  12581  O    GLY E 160     34.183  10.564 248.076  1.00 29.94           O
ATOM  12582  N    LEU E 161     35.829  12.068 247.804  1.00 31.83           N
ATOM  12583  CA   LEU E 161     36.482  11.238 246.787  1.00 33.91           C
ATOM  12584  C    LEU E 161     36.942   9.911 247.394  1.00 33.71           C
ATOM  12585  O    LEU E 161     36.736   8.860 246.791  1.00 35.25           O
ATOM  12586  CB   LEU E 161     37.632  11.979 246.103  1.00 35.06           C
ATOM  12587  CG   LEU E 161     37.196  13.241 245.349  1.00 35.33           C
ATOM  12588  CD1  LEU E 161     38.387  14.117 244.989  1.00 36.28           C
ATOM  12589  CD2  LEU E 161     36.381  12.889 244.116  1.00 36.08           C
```

Appendix 2

```
ATOM  12590  N    TYR E 162      37.512   9.946 248.599  1.00 32.94           N
ATOM  12591  CA   TYR E 162      37.841   8.705 249.304  1.00 31.61           C
ATOM  12592  C    TYR E 162      36.645   7.719 249.399  1.00 34.17           C
ATOM  12593  O    TYR E 162      36.813   6.493 249.255  1.00 31.41           O
ATOM  12594  CB   TYR E 162      38.425   8.983 250.705  1.00 30.07           C
ATOM  12595  CG   TYR E 162      38.531   7.708 251.524  1.00 30.10           C
ATOM  12596  CD1  TYR E 162      39.504   6.753 251.227  1.00 30.42           C
ATOM  12597  CD2  TYR E 162      37.617   7.425 252.546  1.00 28.41           C
ATOM  12598  CE1  TYR E 162      39.575   5.564 251.938  1.00 31.74           C
ATOM  12599  CE2  TYR E 162      37.683   6.246 253.273  1.00 28.92           C
ATOM  12600  CZ   TYR E 162      38.659   5.322 252.964  1.00 31.86           C
ATOM  12601  OH   TYR E 162      38.748   4.155 253.667  1.00 33.57           O
ATOM  12602  N    GLN E 163      35.448   8.246 249.649  1.00 35.50           N
ATOM  12603  CA   GLN E 163      34.281   7.399 249.864  1.00 37.97           C
ATOM  12604  C    GLN E 163      33.776   6.814 248.551  1.00 37.40           C
ATOM  12605  O    GLN E 163      33.371   5.662 248.508  1.00 38.89           O
ATOM  12606  CB   GLN E 163      33.167   8.194 250.549  1.00 41.95           C
ATOM  12607  CG   GLN E 163      31.989   7.361 251.041  1.00 42.72           C
ATOM  12608  CD   GLN E 163      31.294   7.958 252.263  1.00 44.85           C
ATOM  12609  OE1  GLN E 163      31.667   9.025 252.785  1.00 49.86           O
ATOM  12610  NE2  GLN E 163      30.270   7.265 252.724  1.00 46.37           N
ATOM  12611  N    LEU E 164      33.798   7.615 247.490  1.00 35.53           N
ATOM  12612  CA   LEU E 164      33.369   7.176 246.162  1.00 33.70           C
ATOM  12613  C    LEU E 164      34.260   6.055 245.644  1.00 35.29           C
ATOM  12614  O    LEU E 164      33.774   5.023 245.167  1.00 34.27           O
ATOM  12615  CB   LEU E 164      33.423   8.345 245.170  1.00 33.65           C
ATOM  12616  CG   LEU E 164      32.382   9.465 245.363  1.00 33.83           C
ATOM  12617  CD1  LEU E 164      32.681  10.677 244.496  1.00 32.06           C
ATOM  12618  CD2  LEU E 164      30.978   8.926 245.085  1.00 34.70           C
ATOM  12619  N    VAL E 165      35.569   6.258 245.744  1.00 34.37           N
ATOM  12620  CA   VAL E 165      36.529   5.252 245.306  1.00 33.18           C
ATOM  12621  C    VAL E 165      36.327   3.913 246.047  1.00 32.48           C
ATOM  12622  O    VAL E 165      36.259   2.853 245.417  1.00 31.91           O
ATOM  12623  CB   VAL E 165      37.983   5.772 245.476  1.00 32.90           C
ATOM  12624  CG1  VAL E 165      38.988   4.634 245.415  1.00 32.92           C
ATOM  12625  CG2  VAL E 165      38.298   6.826 244.415  1.00 32.92           C
ATOM  12626  N    THR E 166      36.206   3.986 247.372  1.00 31.13           N
ATOM  12627  CA   THR E 166      36.323   2.824 248.251  1.00 30.28           C
ATOM  12628  C    THR E 166      34.999   2.243 248.747  1.00 30.40           C
ATOM  12629  O    THR E 166      34.937   1.055 249.034  1.00 29.35           O
ATOM  12630  CB   THR E 166      37.174   3.153 249.525  1.00 31.67           C
ATOM  12631  OG1  THR E 166      36.562   4.214 250.296  1.00 30.31           O
ATOM  12632  CG2  THR E 166      38.636   3.526 249.148  1.00 30.72           C
ATOM  12633  N    GLY E 167      33.968   3.078 248.894  1.00 31.91           N
ATOM  12634  CA   GLY E 167      32.729   2.688 249.582  1.00 33.32           C
ATOM  12635  C    GLY E 167      32.854   2.686 251.109  1.00 35.49           C
ATOM  12636  O    GLY E 167      31.857   2.512 251.816  1.00 34.05           O
ATOM  12637  N    SER E 168      34.072   2.890 251.623  1.00 36.31           N
ATOM  12638  CA   SER E 168      34.313   2.901 253.064  1.00 37.56           C
ATOM  12639  C    SER E 168      33.662   4.129 253.691  1.00 37.87           C
ATOM  12640  O    SER E 168      33.730   5.224 253.125  1.00 37.54           O
ATOM  12641  CB   SER E 168      35.820   2.858 253.358  1.00 37.77           C
ATOM  12642  OG   SER E 168      36.146   3.445 254.602  1.00 37.03           O
ATOM  12643  N    ARG E 169      33.018   3.919 254.844  1.00 39.35           N
```

Appendix 2

```
ATOM  12644  CA   ARG E 169    32.357   4.985 255.624  1.00 40.72           C
ATOM  12645  C    ARG E 169    33.229   5.402 256.826  1.00 37.84           C
ATOM  12646  O    ARG E 169    32.755   6.014 257.764  1.00 35.47           O
ATOM  12647  CB   ARG E 169    30.948   4.541 256.096  1.00 43.72           C
ATOM  12648  CG   ARG E 169    30.209   3.630 255.111  1.00 47.14           C
ATOM  12649  CD   ARG E 169    28.698   3.818 255.088  1.00 49.51           C
ATOM  12650  NE   ARG E 169    27.997   3.161 256.194  1.00 55.00           N
ATOM  12651  CZ   ARG E 169    26.773   3.490 256.635  1.00 57.49           C
ATOM  12652  NH1  ARG E 169    26.227   2.833 257.658  1.00 54.49           N
ATOM  12653  NH2  ARG E 169    26.086   4.484 256.077  1.00 57.37           N
ATOM  12654  N    ARG E 170    34.515   5.082 256.759  1.00 38.36           N
ATOM  12655  CA   ARG E 170    35.494   5.401 257.797  1.00 39.69           C
ATOM  12656  C    ARG E 170    35.509   6.876 258.167  1.00 38.47           C
ATOM  12657  O    ARG E 170    35.604   7.208 259.338  1.00 38.81           O
ATOM  12658  CB   ARG E 170    36.888   4.974 257.308  1.00 43.97           C
ATOM  12659  CG   ARG E 170    38.062   5.328 258.210  1.00 45.93           C
ATOM  12660  CD   ARG E 170    39.355   4.669 257.721  1.00 46.40           C
ATOM  12661  NE   ARG E 170    40.522   5.457 258.136  1.00 49.01           N
ATOM  12662  CZ   ARG E 170    41.047   5.478 259.370  1.00 46.26           C
ATOM  12663  NH1  ARG E 170    40.545   4.725 260.341  1.00 44.77           N
ATOM  12664  NH2  ARG E 170    42.099   6.251 259.635  1.00 45.49           N
ATOM  12665  N    TYR E 171    35.417   7.756 257.176  1.00 36.92           N
ATOM  12666  CA   TYR E 171    35.450   9.195 257.444  1.00 37.22           C
ATOM  12667  C    TYR E 171    34.074   9.843 257.353  1.00 39.45           C
ATOM  12668  O    TYR E 171    33.971  11.073 257.360  1.00 39.79           O
ATOM  12669  CB   TYR E 171    36.404   9.910 256.468  1.00 34.52           C
ATOM  12670  CG   TYR E 171    37.831   9.452 256.581  1.00 32.05           C
ATOM  12671  CD1  TYR E 171    38.617   9.838 257.653  1.00 32.03           C
ATOM  12672  CD2  TYR E 171    38.387   8.616 255.628  1.00 31.49           C
ATOM  12673  CE1  TYR E 171    39.921   9.408 257.775  1.00 32.53           C
ATOM  12674  CE2  TYR E 171    39.696   8.186 255.724  1.00 32.23           C
ATOM  12675  CZ   TYR E 171    40.459   8.583 256.805  1.00 33.41           C
ATOM  12676  OH   TYR E 171    41.762   8.170 256.921  1.00 32.84           O
ATOM  12677  N    GLU E 172    33.026   9.024 257.284  1.00 41.06           N
ATOM  12678  CA   GLU E 172    31.687   9.524 256.963  1.00 41.81           C
ATOM  12679  C    GLU E 172    31.137  10.502 258.029  1.00 39.91           C
ATOM  12680  O    GLU E 172    30.457  11.470 257.694  1.00 39.58           O
ATOM  12681  CB   GLU E 172    30.712   8.359 256.728  1.00 43.44           C
ATOM  12682  CG   GLU E 172    29.521   8.746 255.856  1.00 44.36           C
ATOM  12683  CD   GLU E 172    28.489   7.647 255.722  1.00 41.62           C
ATOM  12684  OE1  GLU E 172    28.279   7.139 254.601  1.00 37.54           O
ATOM  12685  OE2  GLU E 172    27.884   7.299 256.745  1.00 43.95           O
ATOM  12686  N    ALA E 173    31.453  10.257 259.298  1.00 37.96           N
ATOM  12687  CA   ALA E 173    31.069  11.163 260.372  1.00 36.03           C
ATOM  12688  C    ALA E 173    31.684  12.563 260.197  1.00 35.87           C
ATOM  12689  O    ALA E 173    30.974  13.563 260.247  1.00 34.72           O
ATOM  12690  CB   ALA E 173    31.449  10.576 261.719  1.00 34.50           C
ATOM  12691  N    GLU E 174    32.990  12.632 259.962  1.00 36.40           N
ATOM  12692  CA   GLU E 174    33.694  13.935 259.876  1.00 36.72           C
ATOM  12693  C    GLU E 174    33.322  14.700 258.604  1.00 33.56           C
ATOM  12694  O    GLU E 174    33.387  15.920 258.531  1.00 31.17           O
ATOM  12695  CB   GLU E 174    35.211  13.730 259.865  1.00 39.43           C
ATOM  12696  CG   GLU E 174    35.760  12.903 261.009  1.00 41.68           C
ATOM  12697  CD   GLU E 174    37.121  12.309 260.701  1.00 45.36           C
```

Appendix 2

```
ATOM  12698  OE1 GLU E 174    37.860  12.880 259.846  1.00 46.37           O
ATOM  12699  OE2 GLU E 174    37.456  11.277 261.335  1.00 45.43           O
ATOM  12700  N   HIS E 175    32.974  13.935 257.590  1.00 33.40           N
ATOM  12701  CA  HIS E 175    32.606  14.445 256.288  1.00 32.10           C
ATOM  12702  C   HIS E 175    31.294  15.225 256.373  1.00 30.10           C
ATOM  12703  O   HIS E 175    31.178  16.314 255.828  1.00 26.68           O
ATOM  12704  CB  HIS E 175    32.463  13.241 255.339  1.00 30.77           C
ATOM  12705  CG  HIS E 175    32.289  13.624 253.917  1.00 31.29           C
ATOM  12706  ND1 HIS E 175    31.838  12.743 252.963  1.00 33.81           N
ATOM  12707  CD2 HIS E 175    32.499  14.800 253.282  1.00 31.31           C
ATOM  12708  CE1 HIS E 175    31.795  13.358 251.792  1.00 33.47           C
ATOM  12709  NE2 HIS E 175    32.185  14.609 251.962  1.00 31.98           N
ATOM  12710  N   ALA E 176    30.309  14.624 257.044  1.00 29.42           N
ATOM  12711  CA  ALA E 176    29.009  15.241 257.254  1.00 30.41           C
ATOM  12712  C   ALA E 176    29.140  16.491 258.130  1.00 31.22           C
ATOM  12713  O   ALA E 176    28.530  17.524 257.846  1.00 29.46           O
ATOM  12714  CB  ALA E 176    28.038  14.247 257.881  1.00 28.57           C
ATOM  12715  N   HIS E 177    29.944  16.394 259.185  1.00 32.21           N
ATOM  12716  CA  HIS E 177    30.235  17.554 260.031  1.00 34.49           C
ATOM  12717  C   HIS E 177    30.789  18.749 259.196  1.00 35.64           C
ATOM  12718  O   HIS E 177    30.309  19.891 259.314  1.00 40.75           O
ATOM  12719  CB  HIS E 177    31.198  17.149 261.158  1.00 34.32           C
ATOM  12720  CG  HIS E 177    31.552  18.265 262.088  1.00 36.71           C
ATOM  12721  ND1 HIS E 177    30.661  18.785 263.004  1.00 39.88           N
ATOM  12722  CD2 HIS E 177    32.703  18.957 262.252  1.00 38.64           C
ATOM  12723  CE1 HIS E 177    31.244  19.753 263.686  1.00 39.51           C
ATOM  12724  NE2 HIS E 177    32.484  19.876 263.249  1.00 39.35           N
ATOM  12725  N   LEU E 178    31.764  18.473 258.334  1.00 32.11           N
ATOM  12726  CA  LEU E 178    32.486  19.517 257.638  1.00 30.50           C
ATOM  12727  C   LEU E 178    31.624  20.079 256.538  1.00 31.57           C
ATOM  12728  O   LEU E 178    31.577  21.297 256.340  1.00 33.08           O
ATOM  12729  CB  LEU E 178    33.792  18.978 257.055  1.00 28.71           C
ATOM  12730  CG  LEU E 178    34.732  19.958 256.341  1.00 26.77           C
ATOM  12731  CD1 LEU E 178    34.854  21.257 257.104  1.00 25.77           C
ATOM  12732  CD2 LEU E 178    36.106  19.330 256.109  1.00 25.61           C
ATOM  12733  N   THR E 179    30.943  19.193 255.819  1.00 31.07           N
ATOM  12734  CA  THR E 179    29.967  19.618 254.840  1.00 31.27           C
ATOM  12735  C   THR E 179    28.929  20.557 255.488  1.00 32.74           C
ATOM  12736  O   THR E 179    28.619  21.618 254.924  1.00 32.37           O
ATOM  12737  CB  THR E 179    29.276  18.406 254.197  1.00 31.29           C
ATOM  12738  OG1 THR E 179    30.265  17.566 253.601  1.00 29.15           O
ATOM  12739  CG2 THR E 179    28.296  18.840 253.120  1.00 30.86           C
ATOM  12740  N   ARG E 180    28.433  20.194 256.681  1.00 33.91           N
ATOM  12741  CA  ARG E 180    27.427  21.011 257.386  1.00 34.62           C
ATOM  12742  C   ARG E 180    28.014  22.377 257.778  1.00 35.53           C
ATOM  12743  O   ARG E 180    27.326  23.397 257.671  1.00 35.39           O
ATOM  12744  CB  ARG E 180    26.810  20.274 258.594  1.00 34.45           C
ATOM  12745  N   ILE E 181    29.284  22.408 258.183  1.00 35.83           N
ATOM  12746  CA  ILE E 181    29.961  23.678 258.471  1.00 36.06           C
ATOM  12747  C   ILE E 181    29.973  24.566 257.227  1.00 35.67           C
ATOM  12748  O   ILE E 181    29.646  25.746 257.294  1.00 35.62           O
ATOM  12749  CB  ILE E 181    31.408  23.456 258.990  1.00 38.34           C
ATOM  12750  CG1 ILE E 181    31.368  22.966 260.443  1.00 38.45           C
ATOM  12751  CG2 ILE E 181    32.252  24.733 258.875  1.00 37.78           C
```

Appendix 2

```
ATOM  12752  CD1 ILE E 181      32.727  22.782 261.092  1.00 39.96           C
ATOM  12753  N   ILE E 182      30.345  23.987 256.093  1.00 35.86           N
ATOM  12754  CA  ILE E 182      30.491  24.743 254.852  1.00 36.43           C
ATOM  12755  C   ILE E 182      29.131  25.290 254.381  1.00 38.76           C
ATOM  12756  O   ILE E 182      29.018  26.463 253.980  1.00 37.78           O
ATOM  12757  CB  ILE E 182      31.186  23.875 253.759  1.00 36.55           C
ATOM  12758  CG1 ILE E 182      32.637  23.596 254.150  1.00 36.39           C
ATOM  12759  CG2 ILE E 182      31.165  24.545 252.385  1.00 36.02           C
ATOM  12760  CD1 ILE E 182      33.357  22.672 253.191  1.00 37.28           C
ATOM  12761  N   HIS E 183      28.102  24.441 254.417  1.00 40.76           N
ATOM  12762  CA  HIS E 183      26.763  24.877 254.040  1.00 41.29           C
ATOM  12763  C   HIS E 183      26.365  26.015 254.987  1.00 38.80           C
ATOM  12764  O   HIS E 183      25.979  27.071 254.522  1.00 38.44           O
ATOM  12765  CB  HIS E 183      25.768  23.696 254.050  1.00 43.33           C
ATOM  12766  CG  HIS E 183      24.321  24.104 254.113  1.00 46.24           C
ATOM  12767  ND1 HIS E 183      23.580  24.420 252.992  1.00 47.42           N
ATOM  12768  CD2 HIS E 183      23.477  24.242 255.170  1.00 46.99           C
ATOM  12769  CE1 HIS E 183      22.350  24.748 253.357  1.00 47.00           C
ATOM  12770  NE2 HIS E 183      22.263  24.649 254.673  1.00 44.87           N
ATOM  12771  N   ASP E 184      26.537  25.827 256.299  1.00 39.01           N
ATOM  12772  CA  ASP E 184      26.173  26.874 257.306  1.00 41.24           C
ATOM  12773  C   ASP E 184      26.983  28.162 257.223  1.00 41.49           C
ATOM  12774  O   ASP E 184      26.472  29.215 257.590  1.00 44.25           O
ATOM  12775  CB  ASP E 184      26.271  26.355 258.756  1.00 38.24           C
ATOM  12776  CG  ASP E 184      25.173  25.363 259.104  1.00 39.29           C
ATOM  12777  OD1 ASP E 184      24.161  25.266 258.347  1.00 40.72           O
ATOM  12778  OD2 ASP E 184      25.329  24.671 260.132  1.00 35.04           O
ATOM  12779  N   GLU E 185      28.235  28.087 256.768  1.00 40.76           N
ATOM  12780  CA  GLU E 185      29.028  29.296 256.632  1.00 41.12           C
ATOM  12781  C   GLU E 185      28.598  30.129 255.419  1.00 41.85           C
ATOM  12782  O   GLU E 185      28.521  31.367 255.502  1.00 38.97           O
ATOM  12783  CB  GLU E 185      30.528  29.003 256.587  1.00 42.07           C
ATOM  12784  CG  GLU E 185      31.334  30.175 257.146  1.00 43.02           C
ATOM  12785  CD  GLU E 185      32.840  29.959 257.183  1.00 43.66           C
ATOM  12786  OE1 GLU E 185      33.294  28.791 257.161  1.00 44.57           O
ATOM  12787  OE2 GLU E 185      33.577  30.973 257.234  1.00 42.11           O
ATOM  12788  N   ILE E 186      28.271  29.460 254.311  1.00 40.88           N
ATOM  12789  CA  ILE E 186      27.809  30.166 253.106  1.00 42.72           C
ATOM  12790  C   ILE E 186      26.462  30.866 253.355  1.00 42.98           C
ATOM  12791  O   ILE E 186      26.271  32.038 252.975  1.00 42.08           O
ATOM  12792  CB  ILE E 186      27.688  29.208 251.900  1.00 42.87           C
ATOM  12793  CG1 ILE E 186      29.086  28.744 251.468  1.00 42.07           C
ATOM  12794  CG2 ILE E 186      26.934  29.869 250.740  1.00 41.39           C
ATOM  12795  CD1 ILE E 186      29.058  27.602 250.476  1.00 43.05           C
ATOM  12796  N   ALA E 187      25.548  30.148 254.005  1.00 39.50           N
ATOM  12797  CA  ALA E 187      24.234  30.685 254.317  1.00 40.87           C
ATOM  12798  C   ALA E 187      24.346  31.995 255.073  1.00 39.03           C
ATOM  12799  O   ALA E 187      23.602  32.923 254.801  1.00 38.93           O
ATOM  12800  CB  ALA E 187      23.416  29.680 255.131  1.00 42.31           C
ATOM  12801  N   ALA E 188      25.289  32.056 256.007  1.00 38.02           N
ATOM  12802  CA  ALA E 188      25.450  33.211 256.885  1.00 39.27           C
ATOM  12803  C   ALA E 188      26.144  34.423 256.240  1.00 38.97           C
ATOM  12804  O   ALA E 188      26.145  35.495 256.819  1.00 36.60           O
ATOM  12805  CB  ALA E 188      26.202  32.790 258.143  1.00 38.42           C
```

Appendix 2

```
ATOM  12806  N    ASN E 189      26.728  34.257 255.054  1.00 41.58           N
ATOM  12807  CA   ASN E 189      27.568  35.306 254.470  1.00 43.28           C
ATOM  12808  C    ASN E 189      26.834  36.124 253.423  1.00 44.08           C
ATOM  12809  O    ASN E 189      26.181  35.542 252.557  1.00 42.87           O
ATOM  12810  CB   ASN E 189      28.825  34.712 253.816  1.00 41.20           C
ATOM  12811  CG   ASN E 189      29.923  34.395 254.809  1.00 40.15           C
ATOM  12812  OD1  ASN E 189      29.985  34.939 255.910  1.00 39.52           O
ATOM  12813  ND2  ASN E 189      30.825  33.529 254.399  1.00 40.54           N
ATOM  12814  N    PRO E 190      26.969  37.472 253.478  1.00 46.47           N
ATOM  12815  CA   PRO E 190      26.382  38.374 252.470  1.00 46.58           C
ATOM  12816  C    PRO E 190      26.875  38.047 251.063  1.00 47.92           C
ATOM  12817  O    PRO E 190      26.084  37.909 250.140  1.00 53.16           O
ATOM  12818  CB   PRO E 190      26.866  39.763 252.902  1.00 46.58           C
ATOM  12819  CG   PRO E 190      27.984  39.532 253.867  1.00 44.37           C
ATOM  12820  CD   PRO E 190      27.720  38.214 254.512  1.00 44.76           C
ATOM  12821  N    PHE E 191      28.184  37.917 250.913  1.00 48.12           N
ATOM  12822  CA   PHE E 191      28.780  37.362 249.689  1.00 47.47           C
ATOM  12823  C    PHE E 191      28.607  35.825 249.630  1.00 45.84           C
ATOM  12824  O    PHE E 191      28.605  35.125 250.661  1.00 39.22           O
ATOM  12825  CB   PHE E 191      30.273  37.704 249.628  1.00 45.72           C
ATOM  12826  CG   PHE E 191      31.037  37.251 250.843  1.00 46.32           C
ATOM  12827  CD1  PHE E 191      31.517  35.947 250.939  1.00 46.18           C
ATOM  12828  CD2  PHE E 191      31.233  38.110 251.913  1.00 46.79           C
ATOM  12829  CE1  PHE E 191      32.195  35.520 252.068  1.00 45.74           C
ATOM  12830  CE2  PHE E 191      31.899  37.685 253.051  1.00 47.27           C
ATOM  12831  CZ   PHE E 191      32.388  36.392 253.125  1.00 47.12           C
ATOM  12832  N    ALA E 192      28.493  35.306 248.411  1.00 46.29           N
ATOM  12833  CA   ALA E 192      28.333  33.864 248.194  1.00 47.94           C
ATOM  12834  C    ALA E 192      29.688  33.159 248.277  1.00 48.72           C
ATOM  12835  O    ALA E 192      30.510  33.273 247.362  1.00 49.66           O
ATOM  12836  CB   ALA E 192      27.681  33.604 246.841  1.00 47.13           C
ATOM  12837  N    GLY E 193      29.926  32.446 249.376  1.00 46.97           N
ATOM  12838  CA   GLY E 193      31.187  31.730 249.561  1.00 44.28           C
ATOM  12839  C    GLY E 193      31.698  31.734 250.984  1.00 44.81           C
ATOM  12840  O    GLY E 193      30.938  31.892 251.942  1.00 48.72           O
ATOM  12841  N    ILE E 194      33.003  31.549 251.116  1.00 43.90           N
ATOM  12842  CA   ILE E 194      33.674  31.443 252.413  1.00 42.02           C
ATOM  12843  C    ILE E 194      35.080  31.938 252.170  1.00 41.88           C
ATOM  12844  O    ILE E 194      35.671  31.614 251.135  1.00 44.81           O
ATOM  12845  CB   ILE E 194      33.781  29.978 252.886  1.00 43.06           C
ATOM  12846  CG1  ILE E 194      32.389  29.362 253.104  1.00 43.72           C
ATOM  12847  CG2  ILE E 194      34.631  29.878 254.148  1.00 44.31           C
ATOM  12848  CD1  ILE E 194      32.415  27.879 253.411  1.00 42.51           C
ATOM  12849  N    VAL E 195      35.637  32.682 253.113  1.00 39.83           N
ATOM  12850  CA   VAL E 195      36.974  33.250 252.921  1.00 39.07           C
ATOM  12851  C    VAL E 195      38.088  32.218 253.210  1.00 40.48           C
ATOM  12852  O    VAL E 195      37.832  31.112 253.730  1.00 38.12           O
ATOM  12853  CB   VAL E 195      37.163  34.517 253.791  1.00 38.76           C
ATOM  12854  CG1  VAL E 195      36.093  35.553 253.473  1.00 37.87           C
ATOM  12855  CG2  VAL E 195      37.145  34.180 255.279  1.00 38.35           C
ATOM  12856  N    CYS E 196      39.325  32.575 252.866  1.00 41.74           N
ATOM  12857  CA   CYS E 196      40.488  31.768 253.245  1.00 41.99           C
ATOM  12858  C    CYS E 196      40.975  32.401 254.545  1.00 41.28           C
ATOM  12859  O    CYS E 196      40.497  32.069 255.632  1.00 38.29           O
```

Appendix 2

```
ATOM  12860  CB   CYS E 196      41.572  31.753 252.143  1.00 40.59           C
ATOM  12861  SG   CYS E 196      41.249  30.668 250.717  1.00 42.34           S
ATOM  12862  N    GLU E 197      41.906  33.338 254.425  1.00 42.61           N
ATOM  12863  CA   GLU E 197      42.270  34.215 255.529  1.00 42.98           C
ATOM  12864  C    GLU E 197      41.085  35.167 255.790  1.00 42.64           C
ATOM  12865  O    GLU E 197      40.279  35.426 254.890  1.00 43.13           O
ATOM  12866  CB   GLU E 197      43.557  35.009 255.184  1.00 42.30           C
ATOM  12867  CG   GLU E 197      44.866  34.197 255.193  1.00 38.27           C
ATOM  12868  CD   GLU E 197      45.209  33.486 253.884  1.00 36.15           C
ATOM  12869  OE1  GLU E 197      44.630  33.799 252.810  1.00 34.25           O
ATOM  12870  OE2  GLU E 197      46.109  32.614 253.929  1.00 35.36           O
ATOM  12871  N    PRO E 198      40.957  35.676 257.016  1.00 41.58           N
ATOM  12872  CA   PRO E 198      39.885  36.659 257.209  1.00 42.88           C
ATOM  12873  C    PRO E 198      40.033  37.819 256.211  1.00 41.39           C
ATOM  12874  O    PRO E 198      41.128  38.366 256.002  1.00 42.83           O
ATOM  12875  CB   PRO E 198      40.061  37.140 258.665  1.00 45.40           C
ATOM  12876  CG   PRO E 198      41.130  36.282 259.281  1.00 46.61           C
ATOM  12877  CD   PRO E 198      41.866  35.566 258.168  1.00 45.04           C
ATOM  12878  N    ASP E 199      38.938  38.146 255.559  1.00 38.16           N
ATOM  12879  CA   ASP E 199      38.927  39.175 254.517  1.00 38.65           C
ATOM  12880  C    ASP E 199      39.631  38.842 253.192  1.00 37.32           C
ATOM  12881  O    ASP E 199      39.787  39.723 252.344  1.00 35.86           O
ATOM  12882  CB   ASP E 199      39.460  40.514 255.031  1.00 36.59           C
ATOM  12883  CG   ASP E 199      38.773  41.656 254.383  1.00 35.33           C
ATOM  12884  OD1  ASP E 199      37.551  41.495 254.243  1.00 37.03           O
ATOM  12885  OD2  ASP E 199      39.416  42.662 253.987  1.00 35.75           O
ATOM  12886  N    ASN E 200      40.033  37.594 252.999  1.00 36.62           N
ATOM  12887  CA   ASN E 200      40.583  37.173 251.717  1.00 36.25           C
ATOM  12888  C    ASN E 200      39.661  36.173 251.047  1.00 36.27           C
ATOM  12889  O    ASN E 200      39.467  35.074 251.554  1.00 38.31           O
ATOM  12890  CB   ASN E 200      41.958  36.535 251.915  1.00 36.47           C
ATOM  12891  CG   ASN E 200      43.080  37.554 252.031  1.00 35.80           C
ATOM  12892  OD1  ASN E 200      42.883  38.767 251.867  1.00 32.89           O
ATOM  12893  ND2  ASN E 200      44.285  37.051 252.288  1.00 36.45           N
ATOM  12894  N    TYR E 201      39.094  36.562 249.910  1.00 35.86           N
ATOM  12895  CA   TYR E 201      38.259  35.675 249.118  1.00 34.92           C
ATOM  12896  C    TYR E 201      38.974  35.348 247.819  1.00 34.72           C
ATOM  12897  O    TYR E 201      39.401  36.243 247.094  1.00 33.99           O
ATOM  12898  CB   TYR E 201      36.931  36.357 248.810  1.00 35.47           C
ATOM  12899  CG   TYR E 201      35.876  35.478 248.151  1.00 37.42           C
ATOM  12900  CD1  TYR E 201      35.922  35.186 246.781  1.00 35.13           C
ATOM  12901  CD2  TYR E 201      34.804  34.973 248.896  1.00 37.20           C
ATOM  12902  CE1  TYR E 201      34.945  34.414 246.183  1.00 35.36           C
ATOM  12903  CE2  TYR E 201      33.816  34.205 248.301  1.00 36.94           C
ATOM  12904  CZ   TYR E 201      33.885  33.920 246.942  1.00 36.73           C
ATOM  12905  OH   TYR E 201      32.896  33.130 246.354  1.00 32.96           O
ATOM  12906  N    PHE E 202      39.071  34.059 247.521  1.00 35.84           N
ATOM  12907  CA   PHE E 202      39.703  33.566 246.306  1.00 36.42           C
ATOM  12908  C    PHE E 202      38.716  32.661 245.558  1.00 35.89           C
ATOM  12909  O    PHE E 202      38.104  31.784 246.178  1.00 35.88           O
ATOM  12910  CB   PHE E 202      40.936  32.722 246.682  1.00 37.39           C
ATOM  12911  CG   PHE E 202      42.090  33.509 247.244  1.00 35.94           C
ATOM  12912  CD1  PHE E 202      43.041  34.065 246.404  1.00 34.92           C
ATOM  12913  CD2  PHE E 202      42.247  33.646 248.629  1.00 36.09           C
```

Appendix 2

```
ATOM  12914  CE1  PHE E 202     44.108  34.780  246.928  1.00 36.37           C
ATOM  12915  CE2  PHE E 202     43.314  34.347  249.159  1.00 35.47           C
ATOM  12916  CZ   PHE E 202     44.246  34.918  248.312  1.00 36.78           C
ATOM  12917  N    VAL E 203     38.589  32.821  244.239  1.00 35.87           N
ATOM  12918  CA   VAL E 203     37.612  32.014  243.497  1.00 36.84           C
ATOM  12919  C    VAL E 203     38.008  30.544  243.397  1.00 35.67           C
ATOM  12920  O    VAL E 203     37.144  29.659  243.445  1.00 34.43           O
ATOM  12921  CB   VAL E 203     37.289  32.571  242.090  1.00 39.23           C
ATOM  12922  CG1  VAL E 203     36.707  33.961  242.205  1.00 42.96           C
ATOM  12923  CG2  VAL E 203     38.510  32.605  241.190  1.00 39.96           C
ATOM  12924  N    GLN E 204     39.306  30.291  243.253  1.00 34.50           N
ATOM  12925  CA   GLN E 204     39.799  28.933  243.082  1.00 33.55           C
ATOM  12926  C    GLN E 204     39.569  28.069  244.326  1.00 33.53           C
ATOM  12927  O    GLN E 204     39.122  26.937  244.212  1.00 37.04           O
ATOM  12928  CB   GLN E 204     41.278  28.917  242.644  1.00 33.83           C
ATOM  12929  CG   GLN E 204     42.332  29.358  243.678  1.00 34.06           C
ATOM  12930  CD   GLN E 204     42.535  30.862  243.696  1.00 31.86           C
ATOM  12931  OE1  GLN E 204     41.576  31.621  243.537  1.00 30.25           O
ATOM  12932  NE2  GLN E 204     43.783  31.295  243.842  1.00 30.03           N
ATOM  12933  N    CYS E 205     39.838  28.586  245.512  1.00 33.87           N
ATOM  12934  CA   CYS E 205     39.552  27.823  246.744  1.00 35.70           C
ATOM  12935  C    CYS E 205     38.050  27.609  247.001  1.00 35.68           C
ATOM  12936  O    CYS E 205     37.649  26.617  247.622  1.00 37.34           O
ATOM  12937  CB   CYS E 205     40.180  28.509  247.951  1.00 36.27           C
ATOM  12938  SG   CYS E 205     41.890  29.001  247.649  1.00 35.60           S
ATOM  12939  N    ASN E 206     37.223  28.534  246.529  1.00 33.43           N
ATOM  12940  CA   ASN E 206     35.786  28.324  246.587  1.00 33.23           C
ATOM  12941  C    ASN E 206     35.310  27.220  245.643  1.00 32.44           C
ATOM  12942  O    ASN E 206     34.453  26.416  246.010  1.00 30.74           O
ATOM  12943  CB   ASN E 206     35.036  29.634  246.339  1.00 33.98           C
ATOM  12944  CG   ASN E 206     34.893  30.460  247.610  1.00 35.26           C
ATOM  12945  OD1  ASN E 206     33.849  30.407  248.271  1.00 37.64           O
ATOM  12946  ND2  ASN E 206     35.961  31.185  247.993  1.00 33.65           N
ATOM  12947  N    SER E 207     35.881  27.162  244.445  1.00 31.90           N
ATOM  12948  CA   SER E 207     35.533  26.116  243.508  1.00 33.11           C
ATOM  12949  C    SER E 207     35.643  24.725  244.138  1.00 32.71           C
ATOM  12950  O    SER E 207     34.802  23.866  243.882  1.00 34.80           O
ATOM  12951  CB   SER E 207     36.397  26.200  242.256  1.00 34.98           C
ATOM  12952  OG   SER E 207     37.747  25.943  242.563  1.00 37.56           O
ATOM  12953  N    VAL E 208     36.651  24.509  244.981  1.00 30.99           N
ATOM  12954  CA   VAL E 208     36.836  23.210  245.621  1.00 29.48           C
ATOM  12955  C    VAL E 208     35.727  22.934  246.633  1.00 29.43           C
ATOM  12956  O    VAL E 208     35.248  21.812  246.760  1.00 29.68           O
ATOM  12957  CB   VAL E 208     38.179  23.114  246.350  1.00 29.52           C
ATOM  12958  CG1  VAL E 208     38.333  21.745  246.978  1.00 29.68           C
ATOM  12959  CG2  VAL E 208     39.345  23.376  245.407  1.00 30.86           C
ATOM  12960  N    ALA E 209     35.340  23.957  247.377  1.00 28.65           N
ATOM  12961  CA   ALA E 209     34.298  23.807  249.381  1.00 28.67           C
ATOM  12962  C    ALA E 209     32.978  23.394  247.747  1.00 27.81           C
ATOM  12963  O    ALA E 209     32.347  22.424  248.155  1.00 27.48           O
ATOM  12964  CB   ALA E 209     34.118  25.120  249.136  1.00 29.35           C
ATOM  12965  N    TYR E 210     32.566  24.152  246.749  1.00 28.95           N
ATOM  12966  CA   TYR E 210     31.302  23.906  246.082  1.00 30.48           C
ATOM  12967  C    TYR E 210     31.312  22.523  245.432  1.00 30.70           C
```

Appendix 2

```
ATOM  12968  O    TYR E 210      30.378  21.729 245.624  1.00 30.32           O
ATOM  12969  CB   TYR E 210      30.990  25.028 245.080  1.00 32.22           C
ATOM  12970  CG   TYR E 210      30.427  26.278 245.760  1.00 33.42           C
ATOM  12971  CD1  TYR E 210      29.073  26.399 246.039  1.00 34.99           C
ATOM  12972  CD2  TYR E 210      31.244  27.316 246.130  1.00 34.99           C
ATOM  12973  CE1  TYR E 210      28.559  27.525 246.644  1.00 34.59           C
ATOM  12974  CE2  TYR E 210      30.737  28.443 246.750  1.00 36.45           C
ATOM  12975  CZ   TYR E 210      29.396  28.544 247.002  1.00 36.01           C
ATOM  12976  OH   TYR E 210      28.902  29.680 247.619  1.00 37.99           O
ATOM  12977  N    LEU E 211      32.390  22.210 244.725  1.00 28.74           N
ATOM  12978  CA   LEU E 211      32.533  20.896 244.126  1.00 27.54           C
ATOM  12979  C    LEU E 211      32.461  19.747 245.177  1.00 28.02           C
ATOM  12980  O    LEU E 211      31.998  18.620 244.869  1.00 25.91           O
ATOM  12981  CB   LEU E 211      33.838  20.847 243.354  1.00 27.12           C
ATOM  12982  CG   LEU E 211      34.112  19.513 242.692  1.00 27.50           C
ATOM  12983  CD1  LEU E 211      32.968  19.218 241.745  1.00 28.58           C
ATOM  12984  CD2  LEU E 211      35.443  19.540 241.974  1.00 27.23           C
ATOM  12985  N    SER E 212      32.897  20.034 246.409  1.00 26.84           N
ATOM  12986  CA   SER E 212      32.783  19.050 247.497  1.00 27.63           C
ATOM  12987  C    SER E 212      31.315  18.863 247.922  1.00 28.78           C
ATOM  12988  O    SER E 212      30.909  17.787 248.346  1.00 27.43           O
ATOM  12989  CB   SER E 212      33.695  19.399 248.690  1.00 26.15           C
ATOM  12990  OG   SER E 212      33.180  20.442 249.468  1.00 25.12           O
ATOM  12991  N    LEU E 213      30.509  19.904 247.769  1.00 30.67           N
ATOM  12992  CA   LEU E 213      29.086  19.781 248.055  1.00 32.82           C
ATOM  12993  C    LEU E 213      28.419  18.845 247.026  1.00 34.95           C
ATOM  12994  O    LEU E 213      27.571  18.012 247.396  1.00 32.40           O
ATOM  12995  CB   LEU E 213      28.417  21.163 248.098  1.00 32.03           C
ATOM  12996  CG   LEU E 213      29.075  22.137 249.090  1.00 31.39           C
ATOM  12997  CD1  LEU E 213      28.388  23.497 249.096  1.00 31.21           C
ATOM  12998  CD2  LEU E 213      29.101  21.536 250.492  1.00 31.95           C
ATOM  12999  N    TRP E 214      28.841  18.958 245.757  1.00 36.16           N
ATOM  13000  CA   TRP E 214      28.337  18.091 244.685  1.00 34.91           C
ATOM  13001  C    TRP E 214      28.698  16.667 244.993  1.00 35.07           C
ATOM  13002  O    TRP E 214      27.921  15.763 244.715  1.00 34.89           O
ATOM  13003  CB   TRP E 214      28.870  18.489 243.292  1.00 34.81           C
ATOM  13004  CG   TRP E 214      28.215  19.740 242.729  1.00 35.20           C
ATOM  13005  CD1  TRP E 214      28.348  21.017 243.205  1.00 34.77           C
ATOM  13006  CD2  TRP E 214      27.316  19.822 241.613  1.00 35.10           C
ATOM  13007  NE1  TRP E 214      27.602  21.887 242.457  1.00 35.31           N
ATOM  13008  CE2  TRP E 214      26.954  21.190 241.471  1.00 36.08           C
ATOM  13009  CE3  TRP E 214      26.767  18.877 240.727  1.00 34.37           C
ATOM  13010  CZ2  TRP E 214      26.068  21.644 240.461  1.00 36.03           C
ATOM  13011  CZ3  TRP E 214      25.892  19.329 239.718  1.00 33.67           C
ATOM  13012  CH2  TRP E 214      25.554  20.703 239.597  1.00 34.00           C
ATOM  13013  N    VAL E 215      29.863  16.464 245.603  1.00 37.09           N
ATOM  13014  CA   VAL E 215      30.313  15.099 245.913  1.00 36.97           C
ATOM  13015  C    VAL E 215      29.586  14.477 247.122  1.00 35.04           C
ATOM  13016  O    VAL E 215      29.398  13.261 247.170  1.00 33.78           O
ATOM  13017  CB   VAL E 215      31.854  15.033 246.058  1.00 37.22           C
ATOM  13018  CG1  VAL E 215      32.305  13.702 246.649  1.00 36.81           C
ATOM  13019  CG2  VAL E 215      32.498  15.244 244.690  1.00 36.73           C
ATOM  13020  N    TYR E 216      29.171  15.301 248.080  1.00 34.99           N
ATOM  13021  CA   TYR E 216      28.386  14.811 249.216  1.00 34.71           C
```

Appendix 2

```
ATOM  13022  C    TYR E 216      26.982  14.479 248.700  1.00 34.90           C
ATOM  13023  O    TYR E 216      26.432  13.427 249.035  1.00 36.42           O
ATOM  13024  CB   TYR E 216      28.363  15.846 250.361  1.00 36.03           C
ATOM  13025  CG   TYR E 216      27.781  15.349 251.677  1.00 36.44           C
ATOM  13026  CD1  TYR E 216      28.595  14.828 252.673  1.00 37.64           C
ATOM  13027  CD2  TYR E 216      26.424  15.419 251.921  1.00 36.86           C
ATOM  13028  CE1  TYR E 216      28.069  14.372 253.860  1.00 38.55           C
ATOM  13029  CE2  TYR E 216      25.881  14.960 253.097  1.00 37.77           C
ATOM  13030  CZ   TYR E 216      26.705  14.434 254.064  1.00 39.31           C
ATOM  13031  OH   TYR E 216      26.152  13.988 255.238  1.00 38.49           O
ATOM  13032  N    ASP E 217      26.429  15.333 247.836  1.00 33.76           N
ATOM  13033  CA   ASP E 217      25.085  15.088 247.271  1.00 34.52           C
ATOM  13034  C    ASP E 217      24.959  13.787 246.487  1.00 35.35           C
ATOM  13035  O    ASP E 217      23.964  13.065 246.612  1.00 36.93           O
ATOM  13036  CB   ASP E 217      24.604  16.279 246.434  1.00 32.16           C
ATOM  13037  CG   ASP E 217      24.275  17.481 247.304  1.00 33.22           C
ATOM  13038  OD1  ASP E 217      24.189  17.284 248.536  1.00 32.29           O
ATOM  13039  OD2  ASP E 217      24.094  18.609 246.785  1.00 33.23           O
ATOM  13040  N    ARG E 218      25.970  13.478 245.697  1.00 35.79           N
ATOM  13041  CA   ARG E 218      26.002  12.204 244.997  1.00 37.97           C
ATOM  13042  C    ARG E 218      26.104  11.006 245.984  1.00 39.64           C
ATOM  13043  O    ARG E 218      25.605   9.910 245.702  1.00 36.46           O
ATOM  13044  CB   ARG E 218      27.148  12.221 243.988  1.00 38.17           C
ATOM  13045  CG   ARG E 218      27.681  10.859 243.607  1.00 40.17           C
ATOM  13046  CD   ARG E 218      26.807  10.095 242.610  1.00 39.46           C
ATOM  13047  NE   ARG E 218      27.714   9.184 241.917  1.00 39.02           N
ATOM  13048  CZ   ARG E 218      27.876   7.888 242.161  1.00 38.23           C
ATOM  13049  NH1  ARG E 218      27.149   7.219 243.051  1.00 39.41           N
ATOM  13050  NH2  ARG E 218      28.771   7.238 241.459  1.00 38.94           N
ATOM  13051  N    LEU E 219      26.730  11.230 247.142  1.00 40.82           N
ATOM  13052  CA   LEU E 219      26.939  10.164 248.142  1.00 40.90           C
ATOM  13053  C    LEU E 219      25.738   9.923 249.063  1.00 40.99           C
ATOM  13054  O    LEU E 219      25.583   8.825 249.600  1.00 39.23           O
ATOM  13055  CB   LEU E 219      28.188  10.452 248.997  1.00 38.75           C
ATOM  13056  CG   LEU E 219      29.550  10.057 248.399  1.00 38.76           C
ATOM  13057  CD1  LEU E 219      30.726  10.675 249.169  1.00 39.27           C
ATOM  13058  CD2  LEU E 219      29.694   8.544 248.345  1.00 37.19           C
ATOM  13059  N    HIS E 220      24.916  10.951 249.263  1.00 42.70           N
ATOM  13060  CA   HIS E 220      23.805  10.881 250.226  1.00 43.58           C
ATOM  13061  C    HIS E 220      22.463  11.425 249.705  1.00 40.89           C
ATOM  13062  O    HIS E 220      21.521  11.556 250.474  1.00 38.30           O
ATOM  13063  CB   HIS E 220      24.187  11.620 251.515  1.00 45.37           C
ATOM  13064  CG   HIS E 220      25.349  11.015 252.236  1.00 48.33           C
ATOM  13065  ND1  HIS E 220      26.612  11.568 252.211  1.00 48.92           N
ATOM  13066  CD2  HIS E 220      25.437   9.909 253.009  1.00 49.83           C
ATOM  13067  CE1  HIS E 220      27.426  10.831 252.942  1.00 50.17           C
ATOM  13068  NE2  HIS E 220      26.738   9.819 253.437  1.00 49.56           N
ATOM  13069  N    GLY E 221      22.379  11.735 248.412  1.00 40.95           N
ATOM  13070  CA   GLY E 221      21.114  12.149 247.783  1.00 39.42           C
ATOM  13071  C    GLY E 221      20.591  13.486 248.265  1.00 38.09           C
ATOM  13072  O    GLY E 221      19.400  13.756 248.156  1.00 34.92           O
ATOM  13073  N    THR E 222      21.494  14.324 248.777  1.00 37.94           N
ATOM  13074  CA   THR E 222      21.139  15.587 249.416  1.00 38.61           C
ATOM  13075  C    THR E 222      21.189  16.722 248.410  1.00 39.83           C
```

Appendix 2

```
ATOM  13076  O    THR E 222      21.367  16.467 247.217  1.00 36.98           O
ATOM  13077  CB   THR E 222      22.086  15.882 250.592  1.00 38.60           C
ATOM  13078  OG1  THR E 222      23.435  15.578 250.212  1.00 37.28           O
ATOM  13079  CG2  THR E 222      21.698  15.044 251.785  1.00 38.08           C
ATOM  13080  N    ASP E 223      21.024  17.967 248.877  1.00 44.07           N
ATOM  13081  CA   ASP E 223      20.961  19.122 247.963  1.00 48.29           C
ATOM  13082  C    ASP E 223      21.757  20.350 248.426  1.00 48.36           C
ATOM  13083  O    ASP E 223      21.333  21.490 248.179  1.00 49.25           O
ATOM  13084  CB   ASP E 223      19.486  19.504 247.675  1.00 47.88           C
ATOM  13085  CG   ASP E 223      19.319  20.287 246.370  1.00 48.84           C
ATOM  13086  OD1  ASP E 223      20.049  20.018 245.385  1.00 51.61           O
ATOM  13087  OD2  ASP E 223      18.450  21.184 246.327  1.00 50.03           O
ATOM  13088  N    TYR E 224      22.920  20.121 249.050  1.00 45.92           N
ATOM  13089  CA   TYR E 224      23.867  21.216 249.396  1.00 42.95           C
ATOM  13090  C    TYR E 224      24.380  21.993 248.169  1.00 41.71           C
ATOM  13091  O    TYR E 224      24.749  23.164 248.265  1.00 36.58           O
ATOM  13092  CB   TYR E 224      25.065  20.663 250.171  1.00 42.17           C
ATOM  13093  CG   TYR E 224      24.725  20.153 251.564  1.00 41.94           C
ATOM  13094  CD1  TYR E 224      24.341  21.032 252.575  1.00 41.65           C
ATOM  13095  CD2  TYR E 224      24.778  18.794 251.868  1.00 41.23           C
ATOM  13096  CE1  TYR E 224      24.016  20.578 253.844  1.00 40.66           C
ATOM  13097  CE2  TYR E 224      24.466  18.330 253.141  1.00 40.33           C
ATOM  13098  CZ   TYR E 224      24.089  19.224 254.125  1.00 39.12           C
ATOM  13099  OH   TYR E 224      23.783  18.760 255.375  1.00 35.96           O
ATOM  13100  N    ARG E 225      24.373  21.321 247.019  1.00 45.08           N
ATOM  13101  CA   ARG E 225      24.843  21.892 245.762  1.00 46.53           C
ATOM  13102  C    ARG E 225      23.901  22.959 245.241  1.00 44.48           C
ATOM  13103  O    ARG E 225      24.269  23.698 244.343  1.00 40.73           O
ATOM  13104  CB   ARG E 225      25.090  20.789 244.710  1.00 50.46           C
ATOM  13105  CG   ARG E 225      23.975  20.502 243.714  1.00 53.52           C
ATOM  13106  CD   ARG E 225      24.136  19.116 243.085  1.00 58.28           C
ATOM  13107  NE   ARG E 225      23.069  18.199 243.517  1.00 63.42           N
ATOM  13108  CZ   ARG E 225      22.000  17.863 242.789  1.00 65.40           C
ATOM  13109  NH1  ARG E 225      21.829  18.329 241.552  1.00 68.30           N
ATOM  13110  NH2  ARG E 225      21.089  17.043 243.297  1.00 64.73           N
ATOM  13111  N    ALA E 226      22.690  23.017 245.809  1.00 45.67           N
ATOM  13112  CA   ALA E 226      21.716  24.107 245.580  1.00 42.16           C
ATOM  13113  C    ALA E 226      22.318  25.518 245.611  1.00 42.61           C
ATOM  13114  O    ALA E 226      21.914  26.395 244.852  1.00 43.45           O
ATOM  13115  CB   ALA E 226      20.625  24.020 246.621  1.00 40.73           C
ATOM  13116  N    ALA E 227      23.291  25.737 246.488  1.00 42.52           N
ATOM  13117  CA   ALA E 227      23.887  27.065 246.644  1.00 41.77           C
ATOM  13118  C    ALA E 227      24.784  27.471 245.470  1.00 40.00           C
ATOM  13119  O    ALA E 227      25.155  28.638 245.338  1.00 39.21           O
ATOM  13120  CB   ALA E 227      24.657  27.139 247.956  1.00 41.08           C
ATOM  13121  N    THR E 228      25.109  26.512 244.612  1.00 39.44           N
ATOM  13122  CA   THR E 228      26.008  26.746 243.490  1.00 40.04           C
ATOM  13123  C    THR E 228      25.535  27.834 242.510  1.00 42.17           C
ATOM  13124  O    THR E 228      26.356  28.612 241.999  1.00 41.57           O
ATOM  13125  CB   THR E 228      26.248  25.442 242.705  1.00 38.35           C
ATOM  13126  OG1  THR E 228      26.654  24.408 243.607  1.00 34.38           O
ATOM  13127  CG2  THR E 228      27.314  25.641 241.638  1.00 39.23           C
ATOM  13128  N    ARG E 229      24.233  27.903 242.246  1.00 44.30           N
ATOM  13129  CA   ARG E 229      23.741  28.894 241.283  1.00 47.24           C
```

Appendix 2

```
ATOM  13130  C    ARG E 229    24.078  30.334 241.704  1.00 42.09           C
ATOM  13131  O    ARG E 229    24.603  31.087 240.902  1.00 38.64           O
ATOM  13132  CB   ARG E 229    22.239  28.718 241.006  1.00 52.19           C
ATOM  13133  CG   ARG E 229    21.676  29.566 239.859  1.00 58.94           C
ATOM  13134  CD   ARG E 229    22.590  29.685 238.632  1.00 63.33           C
ATOM  13135  NE   ARG E 229    23.098  28.393 238.147  1.00 69.24           N
ATOM  13136  CZ   ARG E 229    23.940  28.240 237.118  1.00 69.61           C
ATOM  13137  NH1  ARG E 229    24.380  29.295 236.436  1.00 69.91           N
ATOM  13138  NH2  ARG E 229    24.344  27.023 236.760  1.00 65.39           N
ATOM  13139  N    ALA E 230    23.815  30.703 242.958  1.00 39.03           N
ATOM  13140  CA   ALA E 230    24.128  32.054 243.427  1.00 38.05           C
ATOM  13141  C    ALA E 230    25.631  32.326 243.448  1.00 38.95           C
ATOM  13142  O    ALA E 230    26.053  33.460 243.206  1.00 37.68           O
ATOM  13143  CB   ALA E 230    23.539  32.314 244.809  1.00 37.42           C
ATOM  13144  N    TRP E 231    26.436  31.302 243.746  1.00 38.83           N
ATOM  13145  CA   TRP E 231    27.891  31.465 243.727  1.00 38.84           C
ATOM  13146  C    TRP E 231    28.276  31.815 242.322  1.00 37.16           C
ATOM  13147  O    TRP E 231    29.037  32.742 242.108  1.00 37.35           O
ATOM  13148  CB   TRP E 231    28.644  30.198 244.195  1.00 41.20           C
ATOM  13149  CG   TRP E 231    30.190  30.292 244.109  1.00 42.23           C
ATOM  13150  CD1  TRP E 231    30.999  31.143 244.812  1.00 44.06           C
ATOM  13151  CD2  TRP E 231    31.076  29.508 243.277  1.00 41.39           C
ATOM  13152  NE1  TRP E 231    32.322  30.949 244.466  1.00 42.96           N
ATOM  13153  CE2  TRP E 231    32.396  29.949 243.535  1.00 43.02           C
ATOM  13154  CE3  TRP E 231    30.880  28.482 242.340  1.00 41.40           C
ATOM  13155  CZ2  TRP E 231    33.512  29.395 242.893  1.00 43.68           C
ATOM  13156  CZ3  TRP E 231    31.993  27.934 241.694  1.00 40.75           C
ATOM  13157  CH2  TRP E 231    33.289  28.392 241.978  1.00 42.57           C
ATOM  13158  N    LEU E 232    27.732  31.077 241.361  1.00 39.92           N
ATOM  13159  CA   LEU E 232    28.098  31.262 239.952  1.00 41.62           C
ATOM  13160  C    LEU E 232    27.667  32.632 239.402  1.00 40.28           C
ATOM  13161  O    LEU E 232    28.398  33.220 238.590  1.00 38.31           O
ATOM  13162  CB   LEU E 232    27.533  30.128 239.088  1.00 43.98           C
ATOM  13163  CG   LEU E 232    28.122  28.716 239.272  1.00 45.11           C
ATOM  13164  CD1  LEU E 232    27.214  27.687 238.597  1.00 46.30           C
ATOM  13165  CD2  LEU E 232    29.541  28.606 238.733  1.00 42.89           C
ATOM  13166  N    ASP E 233    26.504  33.135 239.839  1.00 39.12           N
ATOM  13167  CA   ASP E 233    26.050  34.478 239.441  1.00 40.54           C
ATOM  13168  C    ASP E 233    26.953  35.526 240.081  1.00 41.42           C
ATOM  13169  O    ASP E 233    27.286  36.532 239.450  1.00 42.27           O
ATOM  13170  CB   ASP E 233    24.591  34.768 239.859  1.00 42.23           C
ATOM  13171  CG   ASP E 233    23.566  33.812 239.231  1.00 43.72           C
ATOM  13172  OD1  ASP E 233    23.679  33.502 238.022  1.00 43.37           O
ATOM  13173  OD2  ASP E 233    22.629  33.379 239.964  1.00 46.40           O
ATOM  13174  N    PHE E 234    27.361  35.286 241.333  1.00 42.74           N
ATOM  13175  CA   PHE E 234    28.220  36.225 242.077  1.00 44.15           C
ATOM  13176  C    PHE E 234    29.569  36.455 241.405  1.00 42.42           C
ATOM  13177  O    PHE E 234    29.947  37.596 241.156  1.00 43.76           O
ATOM  13178  CB   PHE E 234    28.433  35.761 243.533  1.00 46.22           C
ATOM  13179  CG   PHE E 234    29.415  36.612 244.314  1.00 51.45           C
ATOM  13180  CD1  PHE E 234    29.269  38.005 244.374  1.00 53.70           C
ATOM  13181  CD2  PHE E 234    30.492  36.027 244.990  1.00 50.45           C
ATOM  13182  CE1  PHE E 234    30.175  38.785 245.079  1.00 52.82           C
ATOM  13183  CE2  PHE E 234    31.393  36.808 245.698  1.00 49.96           C
```

Appendix 2

```
ATOM  13184  CZ   PHE E 234      31.231  38.184 245.747  1.00 50.96           C
ATOM  13185  N    ILE E 235      30.283  35.376 241.098  1.00 43.05           N
ATOM  13186  CA   ILE E 235      31.642  35.494 240.553  1.00 45.19           C
ATOM  13187  C    ILE E 235      31.667  36.042 239.126  1.00 47.11           C
ATOM  13188  O    ILE E 235      32.737  36.313 238.599  1.00 51.94           O
ATOM  13189  CB   ILE E 235      32.440  34.167 240.634  1.00 43.46           C
ATOM  13190  CG1  ILE E 235      31.944  33.141 239.608  1.00 44.35           C
ATOM  13191  CG2  ILE E 235      32.381  33.599 242.052  1.00 43.55           C
ATOM  13192  CD1  ILE E 235      32.741  31.851 239.603  1.00 44.23           C
ATOM  13193  N    GLN E 236      30.497  36.203 238.511  1.00 50.14           N
ATOM  13194  CA   GLN E 236      30.374  36.915 237.229  1.00 51.51           C
ATOM  13195  C    GLN E 236      30.065  38.402 237.364  1.00 51.83           C
ATOM  13196  O    GLN E 236      30.215  39.125 236.395  1.00 52.67           O
ATOM  13197  CB   GLN E 236      29.334  36.238 236.319  1.00 52.07           C
ATOM  13198  CG   GLN E 236      29.968  35.262 235.330  1.00 52.77           C
ATOM  13199  CD   GLN E 236      28.999  34.257 234.746  1.00 53.01           C
ATOM  13200  OE1  GLN E 236      29.060  33.946 233.560  1.00 53.56           O
ATOM  13201  NE2  GLN E 236      28.115  33.722 235.583  1.00 53.79           N
ATOM  13202  N    LYS E 237      29.627  38.846 238.544  1.00 55.40           N
ATOM  13203  CA   LYS E 237      29.433  40.270 238.826  1.00 57.22           C
ATOM  13204  C    LYS E 237      30.629  40.759 239.624  1.00 58.71           C
ATOM  13205  O    LYS E 237      30.639  40.684 240.860  1.00 62.46           O
ATOM  13206  CB   LYS E 237      28.119  40.518 239.597  1.00 55.37           C
ATOM  13207  N    ASP E 238      31.649  41.216 238.901  1.00 60.90           N
ATOM  13208  CA   ASP E 238      32.793  41.976 239.463  1.00 65.65           C
ATOM  13209  C    ASP E 238      34.109  41.205 239.612  1.00 64.30           C
ATOM  13210  O    ASP E 238      35.190  41.805 239.539  1.00 56.56           O
ATOM  13211  CB   ASP E 238      32.454  42.682 240.803  1.00 67.15           C
ATOM  13212  CG   ASP E 238      32.526  44.193 240.702  1.00 66.08           C
ATOM  13213  OD1  ASP E 238      33.537  44.686 240.148  1.00 67.98           O
ATOM  13214  OD2  ASP E 238      31.584  44.876 241.177  1.00 58.42           O
ATOM  13215  N    LEU E 239      34.024  39.892 239.812  1.00 63.73           N
ATOM  13216  CA   LEU E 239      35.231  39.084 240.011  1.00 61.29           C
ATOM  13217  C    LEU E 239      35.784  38.492 238.727  1.00 57.37           C
ATOM  13218  O    LEU E 239      36.755  37.732 238.767  1.00 53.85           O
ATOM  13219  CB   LEU E 239      34.974  37.972 241.022  1.00 63.41           C
ATOM  13220  CG   LEU E 239      34.970  38.519 242.445  1.00 65.48           C
ATOM  13221  CD1  LEU E 239      33.742  39.402 242.702  1.00 65.75           C
ATOM  13222  CD2  LEU E 239      35.052  37.364 243.426  1.00 65.50           C
ATOM  13223  N    ILE E 240      35.179  38.846 237.592  1.00 56.40           N
ATOM  13224  CA   ILE E 240      35.665  38.396 236.291  1.00 52.76           C
ATOM  13225  C    ILE E 240      35.670  39.490 235.217  1.00 49.82           C
ATOM  13226  O    ILE E 240      34.883  40.441 235.264  1.00 50.86           O
ATOM  13227  CB   ILE E 240      34.842  37.189 235.798  1.00 54.38           C
ATOM  13228  CG1  ILE E 240      35.651  36.376 234.775  1.00 55.09           C
ATOM  13229  CG2  ILE E 240      33.480  37.635 235.257  1.00 54.51           C
ATOM  13230  CD1  ILE E 240      34.982  35.086 234.355  1.00 57.43           C
ATOM  13231  N    ASP E 241      36.589  39.331 234.269  1.00 48.17           N
ATOM  13232  CA   ASP E 241      36.619  40.090 233.024  1.00 47.58           C
ATOM  13233  C    ASP E 241      36.074  39.164 231.924  1.00 49.20           C
ATOM  13234  O    ASP E 241      36.778  38.264 231.461  1.00 47.43           O
ATOM  13235  CB   ASP E 241      38.050  40.514 232.715  1.00 43.39           C
ATOM  13236  CG   ASP E 241      38.142  41.506 231.590  1.00 42.78           C
ATOM  13237  OD1  ASP E 241      37.271  41.529 230.690  1.00 43.06           O
```

Appendix 2

```
ATOM  13238  OD2 ASP E 241     39.115  42.274 231.612  1.00 40.38           O
ATOM  13239  N   PRO E 242     34.813  39.374 231.499  1.00 51.10           N
ATOM  13240  CA  PRO E 242     34.254  38.376 230.586  1.00 50.28           C
ATOM  13241  C   PRO E 242     34.796  38.499 229.158  1.00 49.94           C
ATOM  13242  O   PRO E 242     34.819  37.506 228.436  1.00 48.05           O
ATOM  13243  CB  PRO E 242     32.738  38.631 230.654  1.00 49.75           C
ATOM  13244  CG  PRO E 242     32.541  39.792 231.591  1.00 50.34           C
ATOM  13245  CD  PRO E 242     33.868  40.478 231.727  1.00 50.42           C
ATOM  13246  N   GLU E 243     35.237  39.696 228.769  1.00 50.47           N
ATOM  13247  CA  GLU E 243     35.936  39.880 227.497  1.00 53.74           C
ATOM  13248  C   GLU E 243     37.234  39.044 227.488  1.00 53.78           C
ATOM  13249  O   GLU E 243     37.429  38.214 226.596  1.00 52.64           O
ATOM  13250  CB  GLU E 243     36.221  41.374 227.219  1.00 53.16           C
ATOM  13251  N   ARG E 244     38.090  39.226 228.501  1.00 53.34           N
ATOM  13252  CA  ARG E 244     39.379  38.490 228.589  1.00 50.30           C
ATOM  13253  C   ARG E 244     39.241  37.055 229.159  1.00 47.73           C
ATOM  13254  O   ARG E 244     40.183  36.261 229.093  1.00 42.15           O
ATOM  13255  CB  ARG E 244     40.423  39.319 229.355  1.00 51.31           C
ATOM  13256  CG  ARG E 244     40.813  40.601 228.616  1.00 54.62           C
ATOM  13257  CD  ARG E 244     41.943  41.389 229.268  1.00 58.90           C
ATOM  13258  NE  ARG E 244     41.480  42.191 230.409  1.00 63.05           N
ATOM  13259  CZ  ARG E 244     42.260  42.713 231.364  1.00 61.96           C
ATOM  13260  NH1 ARG E 244     43.581  42.541 231.361  1.00 61.83           N
ATOM  13261  NH2 ARG E 244     41.704  43.409 232.353  1.00 63.28           N
ATOM  13262  N   GLY E 245     38.054  36.721 229.675  1.00 46.11           N
ATOM  13263  CA  GLY E 245     37.752  35.366 230.138  1.00 46.29           C
ATOM  13264  C   GLY E 245     38.659  34.941 231.280  1.00 47.05           C
ATOM  13265  O   GLY E 245     39.229  33.846 231.257  1.00 48.60           O
ATOM  13266  N   ALA E 246     38.757  35.816 232.285  1.00 43.41           N
ATOM  13267  CA  ALA E 246     39.796  35.771 233.289  1.00 39.20           C
ATOM  13268  C   ALA E 246     39.319  36.319 234.623  1.00 37.75           C
ATOM  13269  O   ALA E 246     38.724  37.392 234.685  1.00 35.97           O
ATOM  13270  CB  ALA E 246     40.973  36.590 232.812  1.00 39.97           C
ATOM  13271  N   PHE E 247     39.627  35.602 235.697  1.00 35.47           N
ATOM  13272  CA  PHE E 247     39.240  36.033 237.020  1.00 35.71           C
ATOM  13273  C   PHE E 247     40.257  36.988 237.638  1.00 35.89           C
ATOM  13274  O   PHE E 247     41.463  36.868 237.418  1.00 35.75           O
ATOM  13275  CB  PHE E 247     39.090  34.831 237.931  1.00 36.08           C
ATOM  13276  CG  PHE E 247     37.833  34.069 237.715  1.00 36.21           C
ATOM  13277  CD1 PHE E 247     36.619  34.600 238.107  1.00 35.47           C
ATOM  13278  CD2 PHE E 247     37.864  32.801 237.151  1.00 37.13           C
ATOM  13279  CE1 PHE E 247     35.448  33.891 237.937  1.00 35.26           C
ATOM  13280  CE2 PHE E 247     36.695  32.082 236.979  1.00 36.58           C
ATOM  13281  CZ  PHE E 247     35.487  32.628 237.374  1.00 36.16           C
ATOM  13282  N   TYR E 248     39.758  37.922 238.441  1.00 35.90           N
ATOM  13283  CA  TYR E 248     40.624  38.796 239.207  1.00 35.56           C
ATOM  13284  C   TYR E 248     41.173  37.995 240.373  1.00 34.75           C
ATOM  13285  O   TYR E 248     40.571  36.997 240.800  1.00 33.17           O
ATOM  13286  CB  TYR E 248     39.894  40.074 239.654  1.00 35.96           C
ATOM  13287  CG  TYR E 248     39.633  41.016 238.491  1.00 36.99           C
ATOM  13288  CD1 TYR E 248     40.675  41.765 237.931  1.00 36.81           C
ATOM  13289  CD2 TYR E 248     38.364  41.130 237.922  1.00 35.93           C
ATOM  13290  CE1 TYR E 248     40.457  42.614 236.859  1.00 36.55           C
ATOM  13291  CE2 TYR E 248     38.146  41.971 236.838  1.00 37.72           C
```

Appendix 2

```
ATOM  13292  CZ   TYR E 248      39.198  42.714 236.315  1.00 37.35           C
ATOM  13293  OH   TYR E 248      38.994  43.547 235.238  1.00 38.42           O
ATOM  13294  N    LEU E 249      42.327  38.449 240.860  1.00 34.11           N
ATOM  13295  CA   LEU E 249      43.172  37.723 241.812  1.00 33.42           C
ATOM  13296  C    LEU E 249      42.492  37.395 243.145  1.00 31.93           C
ATOM  13297  O    LEU E 249      42.579  36.261 243.630  1.00 31.10           O
ATOM  13298  CB   LEU E 249      44.422  38.559 242.065  1.00 35.23           C
ATOM  13299  CG   LEU E 249      45.587  37.972 242.841  1.00 35.81           C
ATOM  13300  CD1  LEU E 249      46.106  36.726 242.141  1.00 35.23           C
ATOM  13301  CD2  LEU E 249      46.648  39.065 242.956  1.00 36.42           C
ATOM  13302  N    SER E 250      41.801  38.380 243.716  1.00 31.41           N
ATOM  13303  CA   SER E 250      41.125  38.196 245.005  1.00 30.07           C
ATOM  13304  C    SER E 250      40.081  39.259 245.284  1.00 27.98           C
ATOM  13305  O    SER E 250      40.117  40.345 244.713  1.00 27.73           O
ATOM  13306  CB   SER E 250      42.151  38.169 246.142  1.00 29.28           C
ATOM  13307  OG   SER E 250      43.147  39.145 245.926  1.00 29.28           O
ATOM  13308  N    TYR E 251      39.160  38.932 246.182  1.00 27.14           N
ATOM  13309  CA   TYR E 251      38.116  39.866 246.625  1.00 27.95           C
ATOM  13310  C    TYR E 251      38.201  39.990 248.150  1.00 27.36           C
ATOM  13311  O    TYR E 251      38.579  39.046 248.834  1.00 26.44           O
ATOM  13312  CB   TYR E 251      36.714  39.404 246.139  1.00 28.50           C
ATOM  13313  CG   TYR E 251      35.514  40.105 246.799  1.00 29.44           C
ATOM  13314  CD1  TYR E 251      35.254  41.466 246.582  1.00 29.10           C
ATOM  13315  CD2  TYR E 251      34.641  39.403 247.629  1.00 29.45           C
ATOM  13316  CE1  TYR E 251      34.176  42.100 247.186  1.00 30.07           C
ATOM  13317  CE2  TYR E 251      33.555  40.031 248.234  1.00 30.28           C
ATOM  13318  CZ   TYR E 251      33.320  41.378 248.012  1.00 30.79           C
ATOM  13319  OH   TYR E 251      32.241  42.006 248.619  1.00 29.81           O
ATOM  13320  N    HIS E 252      37.864  41.167 248.669  1.00 29.42           N
ATOM  13321  CA   HIS E 252      38.122  41.511 250.060  1.00 29.97           C
ATOM  13322  C    HIS E 252      36.895  42.191 250.657  1.00 31.89           C
ATOM  13323  O    HIS E 252      36.820  43.405 250.670  1.00 32.92           O
ATOM  13324  CB   HIS E 252      39.382  42.371 250.107  1.00 29.86           C
ATOM  13325  CG   HIS E 252      40.556  41.705 249.461  1.00 29.73           C
ATOM  13326  ND1  HIS E 252      41.341  40.776 250.116  1.00 30.44           N
ATOM  13327  CD2  HIS E 252      41.032  41.766 248.196  1.00 31.55           C
ATOM  13328  CE1  HIS E 252      42.261  40.308 249.290  1.00 30.14           C
ATOM  13329  NE2  HIS E 252      42.097  40.892 248.118  1.00 31.50           N
ATOM  13330  N    PRO E 253      35.913  41.386 251.127  1.00 36.86           N
ATOM  13331  CA   PRO E 253      34.541  41.753 251.554  1.00 38.27           C
ATOM  13332  C    PRO E 253      34.356  43.013 252.399  1.00 39.63           C
ATOM  13333  O    PRO E 253      33.480  43.827 252.080  1.00 40.27           O
ATOM  13334  CB   PRO E 253      34.084  40.535 252.394  1.00 37.88           C
ATOM  13335  CG   PRO E 253      35.213  39.564 252.387  1.00 37.99           C
ATOM  13336  CD   PRO E 253      36.080  39.924 251.213  1.00 37.59           C
ATOM  13337  N    GLU E 254      35.142  43.146 253.455  1.00 40.22           N
ATOM  13338  CA   GLU E 254      35.042  44.290 254.350  1.00 41.08           C
ATOM  13339  C    GLU E 254      35.359  45.578 253.558  1.00 40.52           C
ATOM  13340  O    GLU E 254      34.581  46.516 253.561  1.00 40.10           O
ATOM  13341  CB   GLU E 254      35.964  44.084 255.565  1.00 42.49           C
ATOM  13342  CG   GLU E 254      35.438  44.637 256.893  1.00 44.96           C
ATOM  13343  CD   GLU E 254      36.241  45.815 257.419  1.00 48.19           C
ATOM  13344  OE1  GLU E 254      37.446  45.924 257.091  1.00 51.31           O
ATOM  13345  OE2  GLU E 254      35.675  46.630 258.182  1.00 49.82           O
```

Appendix 2

```
ATOM  13346  N   SER E 255      36.474  45.580 252.834  1.00 41.32           N
ATOM  13347  CA  SER E 255      36.856  46.689 251.946  1.00 40.98           C
ATOM  13348  C   SER E 255      35.893  46.827 250.756  1.00 40.39           C
ATOM  13349  O   SER E 255      35.669  47.920 250.243  1.00 37.71           O
ATOM  13350  CB  SER E 255      38.278  46.458 251.388  1.00 40.52           C
ATOM  13351  OG  SER E 255      38.911  45.319 251.975  1.00 41.59           O
ATOM  13352  N   GLY E 256      35.363  45.700 250.294  1.00 39.58           N
ATOM  13353  CA  GLY E 256      34.605  45.647 249.048  1.00 38.78           C
ATOM  13354  C   GLY E 256      35.507  45.509 247.831  1.00 37.56           C
ATOM  13355  O   GLY E 256      35.014  45.336 246.727  1.00 36.64           O
ATOM  13356  N   ALA E 257      36.826  45.527 248.044  1.00 37.85           N
ATOM  13357  CA  ALA E 257      37.815  45.764 246.982  1.00 36.14           C
ATOM  13358  C   ALA E 257      38.157  44.495 246.237  1.00 35.26           C
ATOM  13359  O   ALA E 257      38.252  43.436 246.855  1.00 35.66           O
ATOM  13360  CB  ALA E 257      39.088  46.354 247.567  1.00 36.62           C
ATOM  13361  N   VAL E 258      38.333  44.622 244.916  1.00 32.84           N
ATOM  13362  CA  VAL E 258      38.828  43.556 244.052  1.00 31.36           C
ATOM  13363  C   VAL E 258      40.218  43.985 243.629  1.00 30.11           C
ATOM  13364  O   VAL E 258      40.433  45.153 243.335  1.00 29.47           O
ATOM  13365  CB  VAL E 258      37.948  43.403 242.790  1.00 32.65           C
ATOM  13366  CG1 VAL E 258      38.380  42.215 241.931  1.00 31.32           C
ATOM  13367  CG2 VAL E 258      36.482  43.284 243.173  1.00 33.38           C
ATOM  13368  N   LYS E 259      41.171  43.062 243.633  1.00 30.69           N
ATOM  13369  CA  LYS E 259      42.521  43.389 243.177  1.00 31.02           C
ATOM  13370  C   LYS E 259      42.532  43.477 241.652  1.00 35.07           C
ATOM  13371  O   LYS E 259      42.082  42.543 240.964  1.00 36.61           O
ATOM  13372  CB  LYS E 259      43.535  42.366 243.663  1.00 29.49           C
ATOM  13373  CG  LYS E 259      43.819  42.491 245.151  1.00 29.24           C
ATOM  13374  CD  LYS E 259      45.064  41.739 245.575  1.00 28.14           C
ATOM  13375  CE  LYS E 259      45.252  41.791 247.085  1.00 28.53           C
ATOM  13376  NZ  LYS E 259      45.872  40.565 247.673  1.00 28.79           N
ATOM  13377  N   PRO E 260      43.068  44.586 241.107  1.00 36.30           N
ATOM  13378  CA  PRO E 260      42.973  44.875 239.670  1.00 37.04           C
ATOM  13379  C   PRO E 260      43.981  44.114 238.779  1.00 37.08           C
ATOM  13380  O   PRO E 260      44.488  44.680 237.811  1.00 40.52           O
ATOM  13381  CB  PRO E 260      43.257  46.384 239.620  1.00 35.66           C
ATOM  13382  CG  PRO E 260      44.288  46.558 240.686  1.00 36.39           C
ATOM  13383  CD  PRO E 260      43.841  45.632 241.806  1.00 36.11           C
ATOM  13384  N   TRP E 261      44.291  42.865 239.107  1.00 35.28           N
ATOM  13385  CA  TRP E 261      45.117  42.039 238.231  1.00 33.48           C
ATOM  13386  C   TRP E 261      44.387  40.756 238.016  1.00 31.61           C
ATOM  13387  O   TRP E 261      43.798  40.204 238.945  1.00 31.67           O
ATOM  13388  CB  TRP E 261      46.489  41.757 238.828  1.00 33.45           C
ATOM  13389  CG  TRP E 261      47.266  42.978 239.050  1.00 33.37           C
ATOM  13390  CD1 TRP E 261      47.985  43.657 238.129  1.00 35.00           C
ATOM  13391  CD2 TRP E 261      47.384  43.697 240.274  1.00 32.83           C
ATOM  13392  NE1 TRP E 261      48.572  44.759 238.708  1.00 36.63           N
ATOM  13393  CE2 TRP E 261      48.206  44.808 240.027  1.00 34.76           C
ATOM  13394  CE3 TRP E 261      46.881  43.503 241.563  1.00 33.32           C
ATOM  13395  CZ2 TRP E 261      48.542  45.725 241.022  1.00 33.81           C
ATOM  13396  CZ3 TRP E 261      47.211  44.418 242.557  1.00 32.46           C
ATOM  13397  CH2 TRP E 261      48.034  45.512 242.276  1.00 33.36           C
ATOM  13398  N   ILE E 262      44.406  40.293 236.780  1.00 30.60           N
ATOM  13399  CA  ILE E 262      43.802  39.018 236.444  1.00 30.56           C
```

Appendix 2

```
ATOM  13400  C    ILE E 262      44.857  37.931 236.548  1.00 28.93           C
ATOM  13401  O    ILE E 262      46.063  38.214 236.433  1.00 25.58           O
ATOM  13402  CB   ILE E 262      43.153  39.009 235.038  1.00 31.28           C
ATOM  13403  CG1  ILE E 262      44.092  39.598 233.970  1.00 31.25           C
ATOM  13404  CG2  ILE E 262      41.803  39.724 235.077  1.00 31.83           C
ATOM  13405  CD1  ILE E 262      43.530  39.503 232.572  1.00 32.93           C
ATOM  13406  N    SER E 263      44.394  36.698 236.746  1.00 28.60           N
ATOM  13407  CA   SER E 263      45.295  35.599 237.060  1.00 32.18           C
ATOM  13408  C    SER E 263      44.972  34.321 236.274  1.00 32.82           C
ATOM  13409  O    SER E 263      43.865  33.782 236.359  1.00 33.35           O
ATOM  13410  CB   SER E 263      45.265  35.349 238.571  1.00 33.56           C
ATOM  13411  OG   SER E 263      45.928  34.161 238.936  1.00 35.52           O
ATOM  13412  N    ALA E 264      45.957  33.838 235.524  1.00 32.06           N
ATOM  13413  CA   ALA E 264      45.800  32.600 234.758  1.00 32.74           C
ATOM  13414  C    ALA E 264      45.648  31.345 235.636  1.00 34.01           C
ATOM  13415  O    ALA E 264      44.757  30.511 235.389  1.00 33.22           O
ATOM  13416  CB   ALA E 264      46.964  32.419 233.786  1.00 31.75           C
ATOM  13417  N    TYR E 265      46.519  31.185 236.636  1.00 33.36           N
ATOM  13418  CA   TYR E 265      46.509  29.948 237.412  1.00 32.65           C
ATOM  13419  C    TYR E 265      45.244  29.996 238.214  1.00 31.47           C
ATOM  13420  O    TYR E 265      44.629  28.971 238.455  1.00 31.16           O
ATOM  13421  CB   TYR E 265      47.745  29.758 238.317  1.00 33.61           C
ATOM  13422  CG   TYR E 265      47.550  30.167 239.766  1.00 32.60           C
ATOM  13423  CD1  TYR E 265      47.721  31.491 240.172  1.00 34.92           C
ATOM  13424  CD2  TYR E 265      47.185  29.240 240.727  1.00 33.66           C
ATOM  13425  CE1  TYR E 265      47.535  31.881 241.510  1.00 35.26           C
ATOM  13426  CE2  TYR E 265      47.007  29.611 242.066  1.00 35.95           C
ATOM  13427  CZ   TYR E 265      47.186  30.935 242.447  1.00 34.60           C
ATOM  13428  OH   TYR E 265      46.984  31.306 243.744  1.00 35.13           O
ATOM  13429  N    THR E 266      44.842  31.199 238.612  1.00 31.60           N
ATOM  13430  CA   THR E 266      43.593  31.344 239.343  1.00 31.13           C
ATOM  13431  C    THR E 266      42.431  30.930 238.442  1.00 31.60           C
ATOM  13432  O    THR E 266      41.526  30.205 238.854  1.00 28.17           O
ATOM  13433  CB   THR E 266      43.390  32.773 239.808  1.00 29.91           C
ATOM  13434  OG1  THR E 266      44.564  33.193 240.513  1.00 32.15           O
ATOM  13435  CG2  THR E 266      42.157  32.871 240.713  1.00 29.07           C
ATOM  13436  N    THR E 267      42.504  31.362 237.190  1.00 34.21           N
ATOM  13437  CA   THR E 267      41.442  31.118 236.240  1.00 35.46           C
ATOM  13438  C    THR E 267      41.478  29.673 235.733  1.00 35.34           C
ATOM  13439  O    THR E 267      40.436  29.050 235.602  1.00 35.11           O
ATOM  13440  CB   THR E 267      41.510  32.133 235.081  1.00 35.46           C
ATOM  13441  OG1  THR E 267      41.469  33.466 235.608  1.00 34.04           O
ATOM  13442  CG2  THR E 267      40.354  31.943 234.159  1.00 36.81           C
ATOM  13443  N    ALA E 268      42.663  29.128 235.479  1.00 34.14           N
ATOM  13444  CA   ALA E 268      42.750  27.762 234.967  1.00 33.70           C
ATOM  13445  C    ALA E 268      42.166  26.740 235.948  1.00 34.29           C
ATOM  13446  O    ALA E 268      41.371  25.875 235.577  1.00 35.51           O
ATOM  13447  CB   ALA E 268      44.187  27.408 234.626  1.00 34.39           C
ATOM  13448  N    TRP E 269      42.589  26.840 237.196  1.00 33.80           N
ATOM  13449  CA   TRP E 269      42.074  26.021 238.268  1.00 34.54           C
ATOM  13450  C    TRP E 269      40.539  26.168 238.318  1.00 35.83           C
ATOM  13451  O    TRP E 269      39.815  25.162 238.222  1.00 39.23           O
ATOM  13452  CB   TRP E 269      42.751  26.485 239.565  1.00 35.74           C
ATOM  13453  CG   TRP E 269      42.407  25.789 240.866  1.00 37.12           C
```

Appendix 2

```
ATOM  13454  CD1  TRP  E  269      41.334   24.977  241.128  1.00  37.58           C
ATOM  13455  CD2  TRP  E  269      43.135   25.907  242.108  1.00  38.35           C
ATOM  13456  NE1  TRP  E  269      41.365   24.568  242.439  1.00  39.20           N
ATOM  13457  CE2  TRP  E  269      42.457   25.127  243.065  1.00  39.31           C
ATOM  13458  CE3  TRP  E  269      44.308   26.586  242.497  1.00  40.46           C
ATOM  13459  CZ2  TRP  E  269      42.904   25.016  244.404  1.00  38.14           C
ATOM  13460  CZ3  TRP  E  269      44.761   26.462  243.837  1.00  39.33           C
ATOM  13461  CH2  TRP  E  269      44.055   25.685  244.764  1.00  38.39           C
ATOM  13462  N    THR  E  270      40.039   27.404  238.414  1.00  32.32           N
ATOM  13463  CA   THR  E  270      38.629   27.624  238.694  1.00  30.70           C
ATOM  13464  C    THR  E  270      37.775   27.033  237.565  1.00  32.88           C
ATOM  13465  O    THR  E  270      36.779   26.327  237.800  1.00  32.07           O
ATOM  13466  CB   THR  E  270      38.323   29.122  238.915  1.00  29.60           C
ATOM  13467  OG1  THR  E  270      39.093   29.608  240.016  1.00  27.90           O
ATOM  13468  CG2  THR  E  270      36.859   29.340  239.243  1.00  29.91           C
ATOM  13469  N    LEU  E  271      38.203   27.282  236.336  1.00  35.42           N
ATOM  13470  CA   LEU  E  271      37.436   26.876  235.174  1.00  36.21           C
ATOM  13471  C    LEU  E  271      37.384   25.355  235.093  1.00  36.08           C
ATOM  13472  O    LEU  E  271      36.334   24.777  234.824  1.00  37.84           O
ATOM  13473  CB   LEU  E  271      38.015   27.493  233.891  1.00  36.20           C
ATOM  13474  CG   LEU  E  271      37.838   29.002  233.700  1.00  36.29           C
ATOM  13475  CD1  LEU  E  271      38.389   29.468  232.356  1.00  37.13           C
ATOM  13476  CD2  LEU  E  271      36.384   29.416  233.822  1.00  36.97           C
ATOM  13477  N    ALA  E  272      38.509   24.716  235.375  1.00  37.37           N
ATOM  13478  CA   ALA  E  272      38.589   23.253  235.383  1.00  36.75           C
ATOM  13479  C    ALA  E  272      37.569   22.658  236.333  1.00  35.54           C
ATOM  13480  O    ALA  E  272      36.886   21.721  235.980  1.00  36.81           O
ATOM  13481  CB   ALA  E  272      39.991   22.785  235.758  1.00  36.39           C
ATOM  13482  N    MET  E  273      37.459   23.204  237.533  1.00  34.78           N
ATOM  13483  CA   MET  E  273      36.534   22.649  238.509  1.00  34.97           C
ATOM  13484  C    MET  E  273      35.113   23.041  238.230  1.00  33.14           C
ATOM  13485  O    MET  E  273      34.208   22.218  238.403  1.00  31.84           O
ATOM  13486  CB   MET  E  273      36.892   23.102  239.904  1.00  37.94           C
ATOM  13487  CG   MET  E  273      38.231   22.569  240.322  1.00  39.28           C
ATOM  13488  SD   MET  E  273      38.343   22.289  242.076  1.00  39.73           S
ATOM  13489  CE   MET  E  273      39.832   21.285  242.094  1.00  40.54           C
ATOM  13490  N    VAL  E  274      34.914   24.294  237.814  1.00  31.90           N
ATOM  13491  CA   VAL  E  274      33.576   24.754  237.381  1.00  31.69           C
ATOM  13492  C    VAL  E  274      33.032   23.880  236.223  1.00  30.46           C
ATOM  13493  O    VAL  E  274      31.854   23.538  236.201  1.00  27.42           O
ATOM  13494  CB   VAL  E  274      33.561   26.259  237.024  1.00  30.25           C
ATOM  13495  CG1  VAL  E  274      32.268   26.652  236.341  1.00  30.09           C
ATOM  13496  CG2  VAL  E  274      33.732   27.094  238.282  1.00  30.40           C
ATOM  13497  N    HIS  E  275      33.903   23.473  235.308  1.00  30.20           N
ATOM  13498  CA   HIS  E  275      33.505   22.518  234.277  1.00  30.57           C
ATOM  13499  C    HIS  E  275      32.766   21.299  234.826  1.00  28.87           C
ATOM  13500  O    HIS  E  275      31.855   20.788  234.188  1.00  27.62           O
ATOM  13501  CB   HIS  E  275      34.700   22.052  233.437  1.00  30.94           C
ATOM  13502  CG   HIS  E  275      34.293   21.443  232.131  1.00  31.59           C
ATOM  13503  ND1  HIS  E  275      34.214   20.081  231.935  1.00  30.63           N
ATOM  13504  CD2  HIS  E  275      33.864   22.015  230.984  1.00  31.06           C
ATOM  13505  CE1  HIS  E  275      33.795   19.842  230.711  1.00  30.49           C
ATOM  13506  NE2  HIS  E  275      33.572   20.999  230.115  1.00  31.62           N
ATOM  13507  N    GLY  E  276      33.142   20.848  236.016  1.00  31.12           N
```

Appendix 2

```
ATOM  13508  CA   GLY E 276      32.491  19.683 236.647  1.00 30.77           C
ATOM  13509  C    GLY E 276      31.105  19.913 237.222  1.00 30.89           C
ATOM  13510  O    GLY E 276      30.442  18.953 237.589  1.00 30.61           O
ATOM  13511  N    MET E 277      30.678  21.178 237.328  1.00 33.54           N
ATOM  13512  CA   MET E 277      29.374  21.553 237.922  1.00 34.89           C
ATOM  13513  C    MET E 277      28.448  22.201 236.904  1.00 36.37           C
ATOM  13514  O    MET E 277      27.227  21.992 236.917  1.00 37.46           O
ATOM  13515  CB   MET E 277      29.584  22.515 239.107  1.00 35.69           C
ATOM  13516  CG   MET E 277      30.277  21.859 240.302  1.00 36.79           C
ATOM  13517  SD   MET E 277      30.754  22.972 241.636  1.00 39.48           S
ATOM  13518  CE   MET E 277      32.177  23.819 240.944  1.00 36.51           C
ATOM  13519  N    ASP E 278      29.054  23.004 236.040  1.00 36.67           N
ATOM  13520  CA   ASP E 278      28.368  23.735 235.024  1.00 38.15           C
ATOM  13521  C    ASP E 278      29.289  23.727 233.807  1.00 40.72           C
ATOM  13522  O    ASP E 278      30.090  24.642 233.605  1.00 41.29           O
ATOM  13523  CB   ASP E 278      28.118  25.151 235.536  1.00 39.04           C
ATOM  13524  CG   ASP E 278      27.201  25.956 234.634  1.00 38.89           C
ATOM  13525  OD1  ASP E 278      27.165  25.736 233.400  1.00 39.81           O
ATOM  13526  OD2  ASP E 278      26.519  26.831 235.177  1.00 39.40           O
ATOM  13527  N    PRO E 279      29.210  22.664 232.999  1.00 44.14           N
ATOM  13528  CA   PRO E 279      30.147  22.595 231.877  1.00 44.40           C
ATOM  13529  C    PRO E 279      30.015  23.788 230.947  1.00 42.65           C
ATOM  13530  O    PRO E 279      31.019  24.262 230.425  1.00 43.73           O
ATOM  13531  CB   PRO E 279      29.753  21.297 231.162  1.00 44.31           C
ATOM  13532  CG   PRO E 279      29.093  20.464 232.216  1.00 45.28           C
ATOM  13533  CD   PRO E 279      28.410  21.432 233.141  1.00 45.30           C
ATOM  13534  N    ALA E 280      28.787  24.264 230.757  1.00 41.95           N
ATOM  13535  CA   ALA E 280      28.506  25.382 229.833  1.00 43.09           C
ATOM  13536  C    ALA E 280      29.256  26.660 230.234  1.00 42.17           C
ATOM  13537  O    ALA E 280      29.789  27.366 229.372  1.00 41.07           O
ATOM  13538  CB   ALA E 280      26.992  25.640 229.738  1.00 41.52           C
ATOM  13539  N    PHE E 281      29.307  26.921 231.546  1.00 39.82           N
ATOM  13540  CA   PHE E 281      30.023  28.069 232.122  1.00 37.02           C
ATOM  13541  C    PHE E 281      31.479  28.144 231.685  1.00 36.71           C
ATOM  13542  O    PHE E 281      31.976  29.206 231.287  1.00 35.78           O
ATOM  13543  CB   PHE E 281      29.965  28.004 233.658  1.00 35.22           C
ATOM  13544  CG   PHE E 281      30.638  29.159 234.350  1.00 34.46           C
ATOM  13545  CD1  PHE E 281      32.031  29.293 234.356  1.00 36.14           C
ATOM  13546  CD2  PHE E 281      29.897  30.106 235.014  1.00 34.12           C
ATOM  13547  CE1  PHE E 281      32.657  30.349 235.009  1.00 33.81           C
ATOM  13548  CE2  PHE E 281      30.519  31.164 235.670  1.00 34.42           C
ATOM  13549  CZ   PHE E 281      31.897  31.282 235.668  1.00 34.00           C
ATOM  13550  N    SER E 282      32.166  27.015 231.792  1.00 36.65           N
ATOM  13551  CA   SER E 282      33.596  26.967 231.513  1.00 37.05           C
ATOM  13552  C    SER E 282      33.824  27.000 230.002  1.00 36.82           C
ATOM  13553  O    SER E 282      34.775  27.629 229.531  1.00 34.26           O
ATOM  13554  CB   SER E 282      34.243  25.716 232.157  1.00 37.87           C
ATOM  13555  OG   SER E 282      34.175  25.716 233.590  1.00 32.83           O
ATOM  13556  N    GLU E 283      32.929  26.339 229.254  1.00 41.21           N
ATOM  13557  CA   GLU E 283      32.944  26.347 227.766  1.00 40.67           C
ATOM  13558  C    GLU E 283      32.863  27.775 227.191  1.00 38.73           C
ATOM  13559  O    GLU E 283      33.565  28.101 226.241  1.00 37.15           O
ATOM  13560  CB   GLU E 283      31.842  25.442 227.192  1.00 39.58           C
ATOM  13561  CG   GLU E 283      32.127  23.943 227.338  1.00 42.43           C
```

Appendix 2

```
ATOM  13562  CD   GLU E 283      30.859  23.054 227.346  1.00 44.99           C
ATOM  13563  OE1  GLU E 283      29.876  23.346 226.621  1.00 42.66           O
ATOM  13564  OE2  GLU E 283      30.836  22.039 228.086  1.00 47.48           O
ATOM  13565  N    ARG E 284      32.053  28.625 227.808  1.00 39.96           N
ATOM  13566  CA   ARG E 284      31.929  30.035 227.411  1.00 42.96           C
ATOM  13567  C    ARG E 284      33.273  30.790 227.485  1.00 40.24           C
ATOM  13568  O    ARG E 284      33.687  31.447 226.521  1.00 35.75           O
ATOM  13569  CB   ARG E 284      30.861  30.717 228.285  1.00 48.54           C
ATOM  13570  CG   ARG E 284      30.565  32.179 227.939  1.00 57.25           C
ATOM  13571  CD   ARG E 284      29.168  32.680 228.375  1.00 62.42           C
ATOM  13572  NE   ARG E 284      28.967  32.757 229.836  1.00 65.01           N
ATOM  13573  CZ   ARG E 284      28.291  31.873 230.588  1.00 64.16           C
ATOM  13574  NH1  ARG E 284      27.713  30.796 230.059  1.00 63.21           N
ATOM  13575  NH2  ARG E 284      28.195  32.063 231.901  1.00 61.31           N
ATOM  13576  N    TYR E 285      33.967  30.668 228.617  1.00 39.54           N
ATOM  13577  CA   TYR E 285      35.188  31.459 228.857  1.00 38.58           C
ATOM  13578  C    TYR E 285      36.512  30.852 228.387  1.00 38.44           C
ATOM  13579  O    TYR E 285      37.489  31.583 228.209  1.00 38.61           O
ATOM  13580  CB   TYR E 285      35.317  31.794 230.336  1.00 37.26           C
ATOM  13581  CG   TYR E 285      34.165  32.593 230.865  1.00 35.16           C
ATOM  13582  CD1  TYR E 285      33.953  33.899 230.444  1.00 35.24           C
ATOM  13583  CD2  TYR E 285      33.288  32.046 231.786  1.00 34.80           C
ATOM  13584  CE1  TYR E 285      32.886  34.638 230.918  1.00 35.07           C
ATOM  13585  CE2  TYR E 285      32.225  32.775 232.273  1.00 36.23           C
ATOM  13586  CZ   TYR E 285      32.028  34.069 231.827  1.00 35.66           C
ATOM  13587  OH   TYR E 285      30.975  34.780 232.309  1.00 34.89           O
ATOM  13588  N    TYR E 286      36.560  29.539 228.206  1.00 38.59           N
ATOM  13589  CA   TYR E 286      37.811  28.862 227.851  1.00 39.69           C
ATOM  13590  C    TYR E 286      38.501  29.478 226.628  1.00 38.92           C
ATOM  13591  O    TYR E 286      39.703  29.751 226.684  1.00 38.02           O
ATOM  13592  CB   TYR E 286      37.562  27.362 227.640  1.00 40.32           C
ATOM  13593  CG   TYR E 286      38.792  26.523 227.352  1.00 40.17           C
ATOM  13594  CD1  TYR E 286      39.910  26.586 228.172  1.00 40.71           C
ATOM  13595  CD2  TYR E 286      38.811  25.616 226.295  1.00 40.33           C
ATOM  13596  CE1  TYR E 286      41.030  25.797 227.924  1.00 42.19           C
ATOM  13597  CE2  TYR E 286      39.923  24.824 226.035  1.00 41.87           C
ATOM  13598  CZ   TYR E 286      41.034  24.909 226.857  1.00 41.59           C
ATOM  13599  OH   TYR E 286      42.134  24.117 226.628  1.00 38.64           O
ATOM  13600  N    PRO E 287      37.745  29.714 225.531  1.00 40.55           N
ATOM  13601  CA   PRO E 287      38.355  30.281 224.316  1.00 40.35           C
ATOM  13602  C    PRO E 287      38.999  31.611 224.574  1.00 40.10           C
ATOM  13603  O    PRO E 287      40.098  31.864 224.083  1.00 39.83           O
ATOM  13604  CB   PRO E 287      37.165  30.455 223.367  1.00 40.07           C
ATOM  13605  CG   PRO E 287      36.193  29.420 223.810  1.00 40.86           C
ATOM  13606  CD   PRO E 287      36.319  29.394 225.309  1.00 41.61           C
ATOM  13607  N    ARG E 288      38.307  32.433 225.360  1.00 42.38           N
ATOM  13608  CA   ARG E 288      38.752  33.781 225.722  1.00 44.88           C
ATOM  13609  C    ARG E 288      39.879  33.795 226.756  1.00 44.79           C
ATOM  13610  O    ARG E 288      40.706  34.721 226.775  1.00 45.01           O
ATOM  13611  CB   ARG E 288      37.548  34.596 226.220  1.00 49.10           C
ATOM  13612  CG   ARG E 288      36.601  35.007 225.094  1.00 51.31           C
ATOM  13613  CD   ARG E 288      35.414  35.815 225.596  1.00 53.88           C
ATOM  13614  NE   ARG E 288      34.240  34.979 225.848  1.00 55.12           N
ATOM  13615  CZ   ARG E 288      33.049  35.444 226.221  1.00 55.03           C
```

Appendix 2

```
ATOM  13616  NH1  ARG E 288    32.858  36.742  226.421  1.00  57.48    N
ATOM  13617  NH2  ARG E 288    32.044  34.606  226.409  1.00  53.93    N
ATOM  13618  N    PHE E 289    39.910  32.776  227.616  1.00  43.44    N
ATOM  13619  CA   PHE E 289    41.028  32.591  228.538  1.00  42.85    C
ATOM  13620  C    PHE E 289    42.310  32.308  227.755  1.00  41.27    C
ATOM  13621  O    PHE E 289    43.386  32.756  228.148  1.00  40.00    O
ATOM  13622  CB   PHE E 289    40.726  31.476  229.552  1.00  43.56    C
ATOM  13623  CG   PHE E 289    41.949  30.819  230.145  1.00  43.34    C
ATOM  13624  CD1  PHE E 289    42.487  29.674  229.570  1.00  44.66    C
ATOM  13625  CD2  PHE E 289    42.544  31.316  231.288  1.00  43.92    C
ATOM  13626  CE1  PHE E 289    43.604  29.053  230.112  1.00  42.99    C
ATOM  13627  CE2  PHE E 289    43.664  30.699  231.825  1.00  44.18    C
ATOM  13628  CZ   PHE E 289    44.195  29.563  231.235  1.00  41.68    C
ATOM  13629  N    LYS E 290    42.199  31.581  226.645  1.00  39.70    N
ATOM  13630  CA   LYS E 290    43.382  31.258  225.844  1.00  39.76    C
ATOM  13631  C    LYS E 290    43.903  32.480  225.089  1.00  38.30    C
ATOM  13632  O    LYS E 290    45.096  32.769  225.130  1.00  41.13    O
ATOM  13633  CB   LYS E 290    43.113  30.103  224.874  1.00  41.07    C
ATOM  13634  CG   LYS E 290    43.063  28.731  225.542  1.00  43.35    C
ATOM  13635  CD   LYS E 290    42.370  27.659  224.682  1.00  45.77    C
ATOM  13636  CE   LYS E 290    42.984  27.544  223.280  1.00  46.92    C
ATOM  13637  NZ   LYS E 290    42.522  26.362  222.503  1.00  44.75    N
ATOM  13638  N    GLN E 291    43.030  33.210  224.403  1.00  37.36    N
ATOM  13639  CA   GLN E 291    43.480  34.436  223.722  1.00  36.39    C
ATOM  13640  C    GLN E 291    44.329  35.247  224.730  1.00  35.16    C
ATOM  13641  O    GLN E 291    45.449  35.665  224.422  1.00  32.26    O
ATOM  13642  CB   GLN E 291    42.294  35.255  223.158  1.00  33.81    C
ATOM  13643  N    THR E 292    43.819  35.388  225.955  1.00  34.58    N
ATOM  13644  CA   THR E 292    44.427  36.289  226.918  1.00  36.16    C
ATOM  13645  C    THR E 292    45.774  35.822  227.456  1.00  36.30    C
ATOM  13646  O    THR E 292    46.683  36.626  227.599  1.00  37.40    O
ATOM  13647  CB   THR E 292    43.514  36.548  228.127  1.00  36.29    C
ATOM  13648  OG1  THR E 292    42.277  37.126  227.703  1.00  37.54    O
ATOM  13649  CG2  THR E 292    44.190  37.517  229.072  1.00  37.13    C
ATOM  13650  N    PHE E 293    45.900  34.543  227.792  1.00  36.01    N
ATOM  13651  CA   PHE E 293    47.063  34.095  228.566  1.00  35.73    C
ATOM  13652  C    PHE E 293    48.038  33.235  227.778  1.00  35.20    C
ATOM  13653  O    PHE E 293    49.239  33.289  228.047  1.00  36.17    O
ATOM  13654  CB   PHE E 293    46.636  33.361  229.868  1.00  35.23    C
ATOM  13655  CG   PHE E 293    45.929  34.251  230.874  1.00  33.87    C
ATOM  13656  CD1  PHE E 293    46.524  35.426  231.332  1.00  34.13    C
ATOM  13657  CD2  PHE E 293    44.668  33.919  231.346  1.00  33.72    C
ATOM  13658  CE1  PHE E 293    45.870  36.252  232.226  1.00  33.85    C
ATOM  13659  CE2  PHE E 293    44.004  34.732  232.241  1.00  34.93    C
ATOM  13660  CZ   PHE E 293    44.610  35.905  232.686  1.00  35.54    C
ATOM  13661  N    VAL E 294    47.550  32.457  226.813  1.00  33.68    N
ATOM  13662  CA   VAL E 294    48.378  31.395  226.223  1.00  33.55    C
ATOM  13663  C    VAL E 294    49.275  31.880  225.077  1.00  32.87    C
ATOM  13664  O    VAL E 294    48.824  32.534  224.176  1.00  31.16    O
ATOM  13665  CB   VAL E 294    47.523  30.210  225.747  1.00  33.68    C
ATOM  13666  CG1  VAL E 294    48.410  29.135  225.133  1.00  33.63    C
ATOM  13667  CG2  VAL E 294    46.720  29.631  226.911  1.00  34.43    C
ATOM  13668  N    GLU E 295    50.562  31.571  225.155  1.00  36.34    N
ATOM  13669  CA   GLU E 295    51.504  31.895  224.107  1.00  37.31    C
```

Appendix 2

```
ATOM  13670  C    GLU E 295      51.916  30.588 223.498  1.00 39.86           C
ATOM  13671  O    GLU E 295      52.615  29.777 224.102  1.00 40.15           O
ATOM  13672  CB   GLU E 295      52.738  32.602 224.640  1.00 39.75           C
ATOM  13673  CG   GLU E 295      53.677  33.052 223.538  1.00 41.59           C
ATOM  13674  CD   GLU E 295      55.028  33.515 224.039  1.00 44.69           C
ATOM  13675  OE1  GLU E 295      55.174  33.796 225.250  1.00 47.48           O
ATOM  13676  OE2  GLU E 295      55.954  33.600 223.205  1.00 45.70           O
ATOM  13677  N    VAL E 296      51.443  30.378 222.267  1.00 41.52           N
ATOM  13678  CA   VAL E 296      51.942  29.314 221.437  1.00 39.83           C
ATOM  13679  C    VAL E 296      53.317  29.775 220.931  1.00 37.56           C
ATOM  13680  O    VAL E 296      53.517  30.959 220.679  1.00 36.76           O
ATOM  13681  CB   VAL E 296      50.925  29.013 220.316  1.00 39.06           C
ATOM  13682  CG1  VAL E 296      51.538  28.118 219.250  1.00 38.81           C
ATOM  13683  CG2  VAL E 296      49.674  28.372 220.920  1.00 37.27           C
ATOM  13684  N    TYR E 297      54.277  28.861 220.863  1.00 36.15           N
ATOM  13685  CA   TYR E 297      55.578  29.171 220.275  1.00 37.65           C
ATOM  13686  C    TYR E 297      56.229  27.913 219.674  1.00 39.28           C
ATOM  13687  O    TYR E 297      55.613  26.837 219.657  1.00 38.59           O
ATOM  13688  CB   TYR E 297      56.495  29.849 221.309  1.00 37.81           C
ATOM  13689  CG   TYR E 297      57.110  28.919 222.359  1.00 37.53           C
ATOM  13690  CD1  TYR E 297      56.343  28.416 223.427  1.00 36.89           C
ATOM  13691  CD2  TYR E 297      58.463  28.560 222.293  1.00 36.05           C
ATOM  13692  CE1  TYR E 297      56.912  27.580 224.387  1.00 35.81           C
ATOM  13693  CE2  TYR E 297      59.028  27.715 223.234  1.00 35.01           C
ATOM  13694  CZ   TYR E 297      58.253  27.234 224.278  1.00 34.54           C
ATOM  13695  OH   TYR E 297      58.821  26.410 225.206  1.00 32.21           O
ATOM  13696  N    ASP E 298      57.465  28.058 219.194  1.00 39.53           N
ATOM  13697  CA   ASP E 298      58.190  26.960 218.537  1.00 40.46           C
ATOM  13698  C    ASP E 298      57.313  26.311 217.480  1.00 40.40           C
ATOM  13699  O    ASP E 298      57.097  25.094 217.501  1.00 40.84           O
ATOM  13700  CB   ASP E 298      58.665  25.910 219.565  1.00 39.90           C
ATOM  13701  CG   ASP E 298      59.572  24.843 218.949  1.00 38.30           C
ATOM  13702  OD1  ASP E 298      60.333  25.156 218.007  1.00 35.78           O
ATOM  13703  OD2  ASP E 298      59.515  23.680 219.402  1.00 40.01           O
ATOM  13704  N    GLU E 299      56.772  27.152 216.599  1.00 41.42           N
ATOM  13705  CA   GLU E 299      56.039  26.712 215.409  1.00 41.22           C
ATOM  13706  C    GLU E 299      54.905  25.776 215.788  1.00 38.91           C
ATOM  13707  O    GLU E 299      54.721  24.715 215.182  1.00 38.21           O
ATOM  13708  CB   GLU E 299      57.000  26.031 214.412  1.00 43.21           C
ATOM  13709  CG   GLU E 299      58.210  26.883 214.027  1.00 44.68           C
ATOM  13710  CD   GLU E 299      59.273  26.118 213.247  1.00 47.46           C
ATOM  13711  OE1  GLU E 299      60.277  26.746 212.846  1.00 48.41           O
ATOM  13712  OE2  GLU E 299      59.119  24.898 213.031  1.00 47.25           O
ATOM  13713  N    GLY E 300      54.171  26.155 216.825  1.00 37.92           N
ATOM  13714  CA   GLY E 300      53.033  25.358 217.292  1.00 37.48           C
ATOM  13715  C    GLY E 300      53.311  24.080 218.081  1.00 36.41           C
ATOM  13716  O    GLY E 300      52.371  23.433 218.550  1.00 31.74           O
ATOM  13717  N    ARG E 301      54.578  23.695 218.233  1.00 38.78           N
ATOM  13718  CA   ARG E 301      54.906  22.477 219.002  1.00 41.09           C
ATOM  13719  C    ARG E 301      54.791  22.670 220.517  1.00 40.85           C
ATOM  13720  O    ARG E 301      54.667  21.682 221.233  1.00 44.25           O
ATOM  13721  CB   ARG E 301      56.314  21.972 218.687  1.00 41.70           C
ATOM  13722  CG   ARG E 301      56.397  21.048 217.480  1.00 40.87           C
ATOM  13723  CD   ARG E 301      57.836  20.876 217.001  1.00 41.19           C
```

Appendix 2

```
ATOM  13724  NE   ARG E 301     58.480  22.177 216.810  1.00 41.83           N
ATOM  13725  CZ   ARG E 301     59.262  22.504 215.780  1.00 41.90           C
ATOM  13726  NH1  ARG E 301     59.551  21.622 214.829  1.00 40.49           N
ATOM  13727  NH2  ARG E 301     59.768  23.734 215.706  1.00 40.87           N
ATOM  13728  N    LYS E 302     54.841  23.919 220.995  1.00 38.22           N
ATOM  13729  CA   LYS E 302     54.882  24.206 222.426  1.00 37.42           C
ATOM  13730  C    LYS E 302     54.000  25.376 222.822  1.00 38.02           C
ATOM  13731  O    LYS E 302     53.664  26.211 221.982  1.00 40.28           O
ATOM  13732  CB   LYS E 302     56.315  24.510 222.859  1.00 36.02           C
ATOM  13733  CG   LYS E 302     57.243  23.336 222.679  1.00 35.43           C
ATOM  13734  CD   LYS E 302     58.666  23.629 223.096  1.00 35.66           C
ATOM  13735  CE   LYS E 302     59.504  22.380 222.868  1.00 36.30           C
ATOM  13736  NZ   LYS E 302     60.903  22.744 222.560  1.00 37.00           N
ATOM  13737  N    ALA E 303     53.656  25.430 224.115  1.00 35.94           N
ATOM  13738  CA   ALA E 303     52.389  26.534 224.699  1.00 34.19           C
ATOM  13739  C    ALA E 303     53.328  26.885 226.142  1.00 35.92           C
ATOM  13740  O    ALA E 303     53.627  26.012 226.971  1.00 33.29           O
ATOM  13741  CB   ALA E 303     51.408  26.214 224.673  1.00 32.94           C
ATOM  13742  N    ARG E 304     53.345  28.180 226.430  1.00 36.30           N
ATOM  13743  CA   ARG E 304     53.564  28.661 227.782  1.00 36.35           C
ATOM  13744  C    ARG E 304     52.554  29.753 228.136  1.00 35.55           C
ATOM  13745  O    ARG E 304     52.162  30.547 227.288  1.00 34.89           O
ATOM  13746  CB   ARG E 304     54.979  29.177 227.919  1.00 37.39           C
ATOM  13747  CG   ARG E 304     55.413  30.045 226.767  1.00 37.88           C
ATOM  13748  CD   ARG E 304     56.775  30.604 227.058  1.00 40.09           C
ATOM  13749  NE   ARG E 304     57.156  31.542 226.009  1.00 42.78           N
ATOM  13750  CZ   ARG E 304     58.151  31.365 225.142  1.00 41.41           C
ATOM  13751  NH1  ARG E 304     58.380  32.291 224.229  1.00 42.73           N
ATOM  13752  NH2  ARG E 304     58.916  30.286 225.177  1.00 40.30           N
ATOM  13753  N    VAL E 305     52.156  29.786 229.404  1.00 35.07           N
ATOM  13754  CA   VAL E 305     51.056  30.622 229.867  1.00 34.77           C
ATOM  13755  C    VAL E 305     51.549  31.800 230.696  1.00 33.98           C
ATOM  13756  O    VAL E 305     52.302  31.622 231.654  1.00 37.54           O
ATOM  13757  CB   VAL E 305     50.083  29.767 230.692  1.00 33.85           C
ATOM  13758  CG1  VAL E 305     48.814  30.537 231.033  1.00 34.07           C
ATOM  13759  CG2  VAL E 305     49.743  28.510 229.917  1.00 34.36           C
ATOM  13760  N    ARG E 306     51.146  33.000 230.314  1.00 33.43           N
ATOM  13761  CA   ARG E 306     51.382  34.183 231.134  1.00 35.23           C
ATOM  13762  C    ARG E 306     50.362  34.211 232.281  1.00 35.38           C
ATOM  13763  O    ARG E 306     49.211  33.813 232.116  1.00 32.62           O
ATOM  13764  CB   ARG E 306     51.247  35.463 230.307  1.00 36.96           C
ATOM  13765  CG   ARG E 306     52.199  35.580 229.120  1.00 37.92           C
ATOM  13766  CD   ARG E 306     51.915  36.851 228.339  1.00 38.36           C
ATOM  13767  NE   ARG E 306     50.619  36.756 227.676  1.00 40.23           N
ATOM  13768  CZ   ARG E 306     50.426  36.303 226.440  1.00 40.79           C
ATOM  13769  NH1  ARG E 306     51.448  35.918 225.689  1.00 44.00           N
ATOM  13770  NH2  ARG E 306     49.198  36.231 225.949  1.00 39.33           N
ATOM  13771  N    GLU E 307     50.799  34.719 233.434  1.00 36.34           N
ATOM  13772  CA   GLU E 307     50.031  34.679 234.691  1.00 34.45           C
ATOM  13773  C    GLU E 307     49.104  35.894 234.896  1.00 35.13           C
ATOM  13774  O    GLU E 307     48.016  35.749 235.477  1.00 32.79           O
ATOM  13775  CB   GLU E 307     51.006  34.481 235.871  1.00 32.89           C
ATOM  13776  CG   GLU E 307     50.497  34.879 237.242  1.00 31.54           C
ATOM  13777  CD   GLU E 307     49.244  34.143 237.668  1.00 32.29           C
```

Appendix 2

```
ATOM  13778  OE1 GLU E 307      49.036  32.995 237.197  1.00 29.16           O
ATOM  13779  OE2 GLU E 307      48.481  34.727 238.492  1.00 32.19           O
ATOM  13780  N   THR E 308      49.531  37.066 234.415  1.00 36.76           N
ATOM  13781  CA  THR E 308      48.722  38.289 234.463  1.00 38.21           C
ATOM  13782  C   THR E 308      48.854  39.091 233.156  1.00 40.25           C
ATOM  13783  O   THR E 308      49.500  38.642 232.216  1.00 36.12           O
ATOM  13784  CB  THR E 308      49.105  39.180 235.669  1.00 40.29           C
ATOM  13785  OG1 THR E 308      48.173  40.269 235.775  1.00 47.44           O
ATOM  13786  CG2 THR E 308      50.517  39.742 235.522  1.00 39.26           C
ATOM  13787  N   ALA E 309      48.297  40.306 233.145  1.00 44.55           N
ATOM  13788  CA  ALA E 309      47.956  41.019 231.916  1.00 44.29           C
ATOM  13789  C   ALA E 309      49.072  41.809 231.254  1.00 45.45           C
ATOM  13790  O   ALA E 309      49.305  41.642 230.069  1.00 52.41           O
ATOM  13791  CB  ALA E 309      46.766  41.939 232.170  1.00 44.94           C
ATOM  13792  N   GLY E 310      49.745  42.700 231.963  1.00 45.01           N
ATOM  13793  CA  GLY E 310      50.584  43.694 231.266  1.00 45.26           C
ATOM  13794  C   GLY E 310      51.986  43.224 230.891  1.00 45.17           C
ATOM  13795  O   GLY E 310      52.951  43.975 231.062  1.00 48.20           O
ATOM  13796  N   THR E 311      52.114  42.007 230.360  1.00 42.46           N
ATOM  13797  CA  THR E 311      53.429  41.356 230.276  1.00 41.32           C
ATOM  13798  C   THR E 311      53.544  40.287 229.189  1.00 40.31           C
ATOM  13799  O   THR E 311      52.551  39.709 228.776  1.00 38.51           O
ATOM  13800  CB  THR E 311      53.789  40.705 231.628  1.00 41.54           C
ATOM  13801  OG1 THR E 311      55.147  40.256 231.605  1.00 42.05           O
ATOM  13802  CG2 THR E 311      52.860  39.531 231.934  1.00 39.97           C
ATOM  13803  N   ASP E 312      54.776  40.048 228.730  1.00 41.74           N
ATOM  13804  CA  ASP E 312      55.105  38.961 227.784  1.00 39.58           C
ATOM  13805  C   ASP E 312      55.792  37.808 228.523  1.00 37.39           C
ATOM  13806  O   ASP E 312      56.080  36.784 227.914  1.00 33.16           O
ATOM  13807  CB  ASP E 312      56.036  39.469 226.653  1.00 39.21           C
ATOM  13808  CG  ASP E 312      55.373  40.525 225.759  1.00 40.29           C
ATOM  13809  OD1 ASP E 312      54.246  40.280 225.273  1.00 41.64           O
ATOM  13810  OD2 ASP E 312      55.971  41.603 225.535  1.00 39.01           O
ATOM  13811  N   ASP E 313      56.083  37.993 229.821  1.00 38.44           N
ATOM  13812  CA  ASP E 313      56.762  36.967 230.652  1.00 36.14           C
ATOM  13813  C   ASP E 313      55.818  35.826 230.978  1.00 34.81           C
ATOM  13814  O   ASP E 313      54.658  36.066 231.328  1.00 33.23           O
ATOM  13815  CB  ASP E 313      57.263  37.548 231.977  1.00 36.34           C
ATOM  13816  CG  ASP E 313      58.448  38.486 231.809  1.00 39.18           C
ATOM  13817  OD1 ASP E 313      59.359  38.189 230.995  1.00 40.46           O
ATOM  13818  OD2 ASP E 313      58.479  39.518 232.517  1.00 37.84           O
ATOM  13819  N   ALA E 314      56.321  34.593 230.871  1.00 34.36           N
ATOM  13820  CA  ALA E 314      55.537  33.393 231.199  1.00 34.99           C
ATOM  13821  C   ALA E 314      55.721  32.903 232.654  1.00 35.71           C
ATOM  13822  O   ALA E 314      56.801  33.022 233.258  1.00 35.26           O
ATOM  13823  CB  ALA E 314      55.868  32.268 230.233  1.00 34.69           C
ATOM  13824  N   ASP E 315      54.653  32.340 233.213  1.00 35.33           N
ATOM  13825  CA  ASP E 315      54.700  31.733 234.555  1.00 32.90           C
ATOM  13826  C   ASP E 315      55.238  32.647 235.696  1.00 31.42           C
ATOM  13827  O   ASP E 315      56.051  32.225 236.521  1.00 30.32           O
ATOM  13828  CB  ASP E 315      55.469  30.399 234.484  1.00 33.17           C
ATOM  13829  CG  ASP E 315      54.694  29.308 233.714  1.00 34.90           C
ATOM  13830  OD1 ASP E 315      53.508  29.033 234.084  1.00 32.77           O
ATOM  13831  OD2 ASP E 315      55.275  28.739 232.742  1.00 32.89           O
```

Appendix 2

```
ATOM  13832  N    GLY E 316    54.757  33.887 235.766  1.00 30.12    N
ATOM  13833  CA   GLY E 316    55.079  34.742 236.889  1.00 29.86    C
ATOM  13834  C    GLY E 316    54.295  34.298 238.104  1.00 31.68    C
ATOM  13835  O    GLY E 316    53.685  33.216 238.135  1.00 35.30    O
ATOM  13836  N    GLY E 317    54.284  35.147 239.112  1.00 33.50    N
ATOM  13837  CA   GLY E 317    53.493  34.901 240.312  1.00 34.82    C
ATOM  13838  C    GLY E 317    53.991  33.695 241.075  1.00 33.93    C
ATOM  13839  O    GLY E 317    55.172  33.591 241.392  1.00 34.80    O
ATOM  13840  N    VAL E 318    53.080  32.774 241.346  1.00 33.17    N
ATOM  13841  CA   VAL E 318    53.440  31.485 241.909  1.00 32.52    C
ATOM  13842  C    VAL E 318    54.112  30.541 240.878  1.00 31.28    C
ATOM  13843  O    VAL E 318    54.590  29.483 241.236  1.00 32.50    O
ATOM  13844  CB   VAL E 318    52.205  30.805 242.556  1.00 32.84    C
ATOM  13845  CG1  VAL E 318    51.726  31.597 243.774  1.00 31.71    C
ATOM  13846  CG2  VAL E 318    51.065  30.640 241.564  1.00 31.80    C
ATOM  13847  N    GLY E 319    54.150  30.928 239.609  1.00 31.32    N
ATOM  13848  CA   GLY E 319    54.694  30.095 238.546  1.00 30.40    C
ATOM  13849  C    GLY E 319    53.932  28.805 238.292  1.00 31.92    C
ATOM  13850  O    GLY E 319    54.547  27.795 237.931  1.00 32.04    O
ATOM  13851  N    LEU E 320    52.606  28.836 238.468  1.00 32.13    N
ATOM  13852  CA   LEU E 320    51.762  27.659 238.265  1.00 33.70    C
ATOM  13853  C    LEU E 320    50.743  27.779 237.111  1.00 33.93    C
ATOM  13854  O    LEU E 320    49.943  26.865 236.895  1.00 32.81    O
ATOM  13855  CB   LEU E 320    51.024  27.336 239.559  1.00 34.75    C
ATOM  13856  CG   LEU E 320    51.919  27.079 240.767  1.00 37.67    C
ATOM  13857  CD1  LEU E 320    51.078  26.949 242.030  1.00 39.79    C
ATOM  13858  CD2  LEU E 320    52.747  25.826 240.551  1.00 38.87    C
ATOM  13859  N    ALA E 321    50.773  28.882 236.365  1.00 34.31    N
ATOM  13860  CA   ALA E 321    49.798  29.092 235.282  1.00 35.22    C
ATOM  13861  C    ALA E 321    49.810  27.936 234.312  1.00 34.06    C
ATOM  13862  O    ALA E 321    48.778  27.283 234.112  1.00 33.48    O
ATOM  13863  CB   ALA E 321    50.062  30.382 234.523  1.00 34.38    C
ATOM  13864  N    SER E 322    50.980  27.689 233.735  1.00 32.49    N
ATOM  13865  CA   SER E 322    51.136  26.637 232.750  1.00 34.03    C
ATOM  13866  C    SER E 322    50.671  25.276 233.260  1.00 35.48    C
ATOM  13867  O    SER E 322    49.928  24.568 232.555  1.00 36.96    O
ATOM  13868  CB   SER E 322    52.579  26.561 232.269  1.00 33.98    C
ATOM  13869  OG   SER E 322    52.963  27.805 231.720  1.00 33.82    O
ATOM  13870  N    ALA E 323    51.076  24.922 234.478  1.00 34.59    N
ATOM  13871  CA   ALA E 323    50.740  23.599 235.017  1.00 34.68    C
ATOM  13872  C    ALA E 323    49.251  23.435 235.328  1.00 34.14    C
ATOM  13873  O    ALA E 323    48.720  22.328 235.247  1.00 33.41    O
ATOM  13874  CB   ALA E 323    51.570  23.301 236.256  1.00 34.53    C
ATOM  13875  N    PHE E 324    48.593  24.526 235.726  1.00 34.68    N
ATOM  13876  CA   PHE E 324    47.161  24.515 235.976  1.00 34.11    C
ATOM  13877  C    PHE E 324    46.375  24.548 234.664  1.00 34.90    C
ATOM  13878  O    PHE E 324    45.260  24.008 234.589  1.00 32.88    O
ATOM  13879  CB   PHE E 324    46.750  25.667 236.895  1.00 34.51    C
ATOM  13880  CG   PHE E 324    46.806  25.315 238.356  1.00 34.72    C
ATOM  13881  CD1  PHE E 324    45.883  24.419 238.905  1.00 35.64    C
ATOM  13882  CD2  PHE E 324    47.763  25.860 239.182  1.00 33.90    C
ATOM  13883  CE1  PHE E 324    45.938  24.083 240.262  1.00 37.35    C
ATOM  13884  CE2  PHE E 324    47.821  25.530 240.535  1.00 34.07    C
ATOM  13885  CZ   PHE E 324    46.914  24.643 241.078  1.00 34.64    C
```

Appendix 2

```
ATOM  13886  N    THR E 325      46.976  25.143 233.629  1.00 33.16           N
ATOM  13887  CA   THR E 325      46.390  25.167 232.300  1.00 32.55           C
ATOM  13888  C    THR E 325      46.475  23.766 231.661  1.00 31.60           C
ATOM  13889  O    THR E 325      45.578  23.311 230.952  1.00 32.88           O
ATOM  13890  CB   THR E 325      47.115  26.200 231.410  1.00 34.06           C
ATOM  13891  OG1  THR E 325      47.368  27.395 232.154  1.00 32.88           O
ATOM  13892  CG2  THR E 325      46.278  26.557 230.197  1.00 34.09           C
ATOM  13893  N    LEU E 326      47.564  23.077 231.914  1.00 29.59           N
ATOM  13894  CA   LEU E 326      47.669  21.704 231.489  1.00 30.21           C
ATOM  13895  C    LEU E 326      46.507  20.884 232.078  1.00 32.58           C
ATOM  13896  O    LEU E 326      45.931  20.034 231.416  1.00 32.49           O
ATOM  13897  CB   LEU E 326      49.021  21.150 231.916  1.00 29.58           C
ATOM  13898  CG   LEU E 326      49.337  19.773 231.382  1.00 31.60           C
ATOM  13899  CD1  LEU E 326      49.700  19.856 229.905  1.00 33.53           C
ATOM  13900  CD2  LEU E 326      50.470  19.124 232.165  1.00 31.68           C
ATOM  13901  N    LEU E 327      46.154  21.153 233.328  1.00 34.58           N
ATOM  13902  CA   LEU E 327      45.011  20.501 233.950  1.00 36.11           C
ATOM  13903  C    LEU E 327      43.723  20.922 233.216  1.00 36.76           C
ATOM  13904  O    LEU E 327      42.858  20.093 232.935  1.00 36.91           O
ATOM  13905  CB   LEU E 327      44.946  20.830 235.455  1.00 35.75           C
ATOM  13906  CG   LEU E 327      43.676  20.404 236.195  1.00 36.83           C
ATOM  13907  CD1  LEU E 327      43.481  18.899 236.119  1.00 37.36           C
ATOM  13908  CD2  LEU E 327      43.719  20.833 237.657  1.00 38.73           C
ATOM  13909  N    LEU E 328      43.603  22.206 232.899  1.00 34.95           N
ATOM  13910  CA   LEU E 328      42.402  22.688 232.251  1.00 34.17           C
ATOM  13911  C    LEU E 328      42.208  21.975 230.933  1.00 34.24           C
ATOM  13912  O    LEU E 328      41.119  21.423 230.670  1.00 34.78           O
ATOM  13913  CB   LEU E 328      42.471  24.183 231.992  1.00 33.35           C
ATOM  13914  CG   LEU E 328      41.180  24.829 231.508  1.00 33.08           C
ATOM  13915  CD1  LEU E 328      40.045  24.599 232.492  1.00 32.91           C
ATOM  13916  CD2  LEU E 328      41.399  26.329 231.311  1.00 33.31           C
ATOM  13917  N    ALA E 329      43.266  21.975 230.118  1.00 31.63           N
ATOM  13918  CA   ALA E 329      43.176  21.422 228.779  1.00 29.57           C
ATOM  13919  C    ALA E 329      42.677  19.988 228.863  1.00 31.58           C
ATOM  13920  O    ALA E 329      41.835  19.574 228.063  1.00 33.58           O
ATOM  13921  CB   ALA E 329      44.499  21.506 228.060  1.00 28.57           C
ATOM  13922  N    ARG E 330      43.151  19.235 229.855  1.00 32.56           N
ATOM  13923  CA   ARG E 330      42.655  17.880 230.061  1.00 31.27           C
ATOM  13924  C    ARG E 330      41.148  17.912 230.351  1.00 32.46           C
ATOM  13925  O    ARG E 330      40.350  17.248 229.670  1.00 35.23           O
ATOM  13926  CB   ARG E 330      43.407  17.205 231.192  1.00 30.57           C
ATOM  13927  CG   ARG E 330      43.208  15.699 231.259  1.00 30.92           C
ATOM  13928  CD   ARG E 330      43.946  14.923 230.172  1.00 30.36           C
ATOM  13929  NE   ARG E 330      44.161  13.576 230.660  1.00 31.25           N
ATOM  13930  CZ   ARG E 330      43.437  12.502 230.341  1.00 33.10           C
ATOM  13931  NH1  ARG E 330      42.460  12.569 229.451  1.00 33.63           N
ATOM  13932  NH2  ARG E 330      43.719  11.332 230.908  1.00 33.94           N
ATOM  13933  N    GLU E 331      40.749  18.716 231.329  1.00 32.75           N
ATOM  13934  CA   GLU E 331      39.344  18.791 231.694  1.00 33.25           C
ATOM  13935  C    GLU E 331      38.506  19.106 230.452  1.00 34.81           C
ATOM  13936  O    GLU E 331      37.521  18.421 230.206  1.00 32.75           O
ATOM  13937  CB   GLU E 331      39.119  19.817 232.804  1.00 32.80           C
ATOM  13938  CG   GLU E 331      37.658  20.121 233.116  1.00 32.37           C
ATOM  13939  CD   GLU E 331      36.954  19.069 233.945  1.00 30.91           C
```

Appendix 2

```
ATOM  13940  OE1 GLU E 331      37.586  18.437 234.814  1.00 29.90           O
ATOM  13941  OE2 GLU E 331      35.729  18.909 233.746  1.00 30.78           O
ATOM  13942  N   MET E 332      38.921  20.107 229.663  1.00 36.05           N
ATOM  13943  CA  MET E 332      38.175  20.510 228.448  1.00 36.33           C
ATOM  13944  C   MET E 332      38.359  19.591 227.202  1.00 38.08           C
ATOM  13945  O   MET E 332      37.736  19.844 226.157  1.00 35.87           O
ATOM  13946  CB  MET E 332      38.519  21.951 228.041  1.00 34.92           C
ATOM  13947  CG  MET E 332      38.353  23.008 229.111  1.00 35.97           C
ATOM  13948  SD  MET E 332      36.788  23.029 230.001  1.00 37.23           S
ATOM  13949  CE  MET E 332      35.848  24.249 229.110  1.00 39.31           C
ATOM  13950  N   GLY E 333      39.205  18.555 227.307  1.00 38.13           N
ATOM  13951  CA  GLY E 333      39.468  17.610 226.208  1.00 36.98           C
ATOM  13952  C   GLY E 333      40.099  18.259 224.987  1.00 36.35           C
ATOM  13953  O   GLY E 333      39.694  17.989 223.860  1.00 38.42           O
ATOM  13954  N   ASP E 334      41.087  19.112 225.235  1.00 36.20           N
ATOM  13955  CA  ASP E 334      41.756  19.940 224.230  1.00 35.75           C
ATOM  13956  C   ASP E 334      43.158  19.370 224.063  1.00 38.48           C
ATOM  13957  O   ASP E 334      44.095  19.794 224.750  1.00 41.38           O
ATOM  13958  CB  ASP E 334      41.807  21.410 224.721  1.00 33.95           C
ATOM  13959  CG  ASP E 334      42.600  22.349 223.790  1.00 33.36           C
ATOM  13960  OD1 ASP E 334      43.332  21.881 222.889  1.00 33.40           O
ATOM  13961  OD2 ASP E 334      42.486  23.587 223.969  1.00 31.18           O
ATOM  13962  N   GLN E 335      43.299  18.409 223.151  1.00 38.39           N
ATOM  13963  CA  GLN E 335      44.527  17.637 223.034  1.00 38.08           C
ATOM  13964  C   GLN E 335      45.709  18.431 222.512  1.00 38.35           C
ATOM  13965  O   GLN E 335      46.854  18.157 222.889  1.00 36.61           O
ATOM  13966  CB  GLN E 335      44.294  16.411 222.164  1.00 37.67           C
ATOM  13967  CG  GLN E 335      43.336  15.457 222.834  1.00 38.27           C
ATOM  13968  CD  GLN E 335      43.271  14.093 222.178  1.00 37.95           C
ATOM  13969  OE1 GLN E 335      44.281  13.509 221.791  1.00 38.04           O
ATOM  13970  NE2 GLN E 335      42.072  13.571 222.075  1.00 37.47           N
ATOM  13971  N   GLN E 336      45.438  19.404 221.649  1.00 40.33           N
ATOM  13972  CA  GLN E 336      46.508  20.240 221.084  1.00 42.60           C
ATOM  13973  C   GLN E 336      47.230  21.018 222.192  1.00 41.36           C
ATOM  13974  O   GLN E 336      48.453  20.966 222.292  1.00 43.94           O
ATOM  13975  CB  GLN E 336      45.978  21.209 220.005  1.00 42.50           C
ATOM  13976  CG  GLN E 336      47.068  22.068 219.367  1.00 44.88           C
ATOM  13977  CD  GLN E 336      46.617  22.794 218.100  1.00 48.70           C
ATOM  13978  OE1 GLN E 336      47.210  22.631 217.020  1.00 47.64           O
ATOM  13979  NE2 GLN E 336      45.565  23.601 218.222  1.00 49.24           N
ATOM  13980  N   LEU E 337      46.478  21.720 223.030  1.00 39.25           N
ATOM  13981  CA  LEU E 337      47.091  22.571 224.046  1.00 39.40           C
ATOM  13982  C   LEU E 337      47.751  21.743 225.152  1.00 37.99           C
ATOM  13983  O   LEU E 337      48.804  22.111 225.630  1.00 39.12           O
ATOM  13984  CB  LEU E 337      46.076  23.551 224.625  1.00 39.61           C
ATOM  13985  CG  LEU E 337      46.613  24.445 225.735  1.00 39.42           C
ATOM  13986  CD1 LEU E 337      47.707  25.357 225.196  1.00 38.43           C
ATOM  13987  CD2 LEU E 337      45.472  25.231 226.364  1.00 38.54           C
ATOM  13988  N   PHE E 338      47.147  20.625 225.538  1.00 36.40           N
ATOM  13989  CA  PHE E 338      47.803  19.673 226.431  1.00 34.83           C
ATOM  13990  C   PHE E 338      49.160  19.269 225.893  1.00 33.67           C
ATOM  13991  O   PHE E 338      50.124  19.229 226.638  1.00 32.76           O
ATOM  13992  CB  PHE E 338      46.952  18.423 226.609  1.00 35.97           C
ATOM  13993  CG  PHE E 338      47.507  17.431 227.595  1.00 35.33           C
```

Appendix 2

```
ATOM  13994  CD1 PHE E 338      48.436  16.486 227.203  1.00 34.32           C
ATOM  13995  CD2 PHE E 338      47.063  17.421 228.915  1.00 37.59           C
ATOM  13996  CE1 PHE E 338      48.930  15.564 228.106  1.00 35.44           C
ATOM  13997  CE2 PHE E 338      47.568  16.507 229.833  1.00 35.90           C
ATOM  13998  CZ  PHE E 338      48.502  15.577 229.424  1.00 35.37           C
ATOM  13999  N   ASP E 339      49.244  18.971 224.600  1.00 34.77           N
ATOM  14000  CA  ASP E 339      50.523  18.524 224.019  1.00 34.65           C
ATOM  14001  C   ASP E 339      51.573  19.648 224.029  1.00 34.42           C
ATOM  14002  O   ASP E 339      52.721  19.438 224.407  1.00 32.95           O
ATOM  14003  CB  ASP E 339      50.332  17.983 222.600  1.00 33.64           C
ATOM  14004  CG  ASP E 339      51.516  17.182 222.129  1.00 32.79           C
ATOM  14005  OD1 ASP E 339      51.726  16.079 222.641  1.00 33.95           O
ATOM  14006  OD2 ASP E 339      52.251  17.651 221.260  1.00 33.87           O
ATOM  14007  N   GLN E 340      51.148  20.844 223.640  1.00 35.41           N
ATOM  14008  CA  GLN E 340      52.012  22.030 223.628  1.00 37.12           C
ATOM  14009  C   GLN E 340      52.562  22.359 225.029  1.00 34.28           C
ATOM  14010  O   GLN E 340      53.762  22.537 225.203  1.00 32.67           O
ATOM  14011  CB  GLN E 340      51.229  23.236 223.063  1.00 38.94           C
ATOM  14012  CG  GLN E 340      50.766  23.051 221.617  1.00 41.61           C
ATOM  14013  CD  GLN E 340      49.726  24.077 221.175  1.00 42.62           C
ATOM  14014  OE1 GLN E 340      48.675  24.246 221.802  1.00 42.12           O
ATOM  14015  NE2 GLN E 340      50.016  24.760 220.078  1.00 42.31           N
ATOM  14016  N   LEU E 341      51.660  22.446 226.002  1.00 32.55           N
ATOM  14017  CA  LEU E 341      51.994  22.713 227.392  1.00 32.77           C
ATOM  14018  C   LEU E 341      52.934  21.666 227.965  1.00 33.19           C
ATOM  14019  O   LEU E 341      53.930  22.006 228.591  1.00 36.00           O
ATOM  14020  CB  LEU E 341      50.719  22.739 228.239  1.00 32.29           C
ATOM  14021  CG  LEU E 341      49.858  23.983 228.080  1.00 32.73           C
ATOM  14022  CD1 LEU E 341      48.541  23.867 228.831  1.00 32.27           C
ATOM  14023  CD2 LEU E 341      50.638  25.194 228.569  1.00 35.13           C
ATOM  14024  N   LEU E 342      52.621  20.392 227.755  1.00 32.58           N
ATOM  14025  CA  LEU E 342      53.451  19.321 228.289  1.00 31.50           C
ATOM  14026  C   LEU E 342      54.830  19.303 227.642  1.00 29.74           C
ATOM  14027  O   LEU E 342      55.797  18.918 228.275  1.00 29.48           O
ATOM  14028  CB  LEU E 342      52.771  17.969 228.132  1.00 32.94           C
ATOM  14029  CG  LEU E 342      53.399  16.792 228.880  1.00 36.04           C
ATOM  14030  CD1 LEU E 342      53.560  17.075 230.375  1.00 37.58           C
ATOM  14031  CD2 LEU E 342      52.568  15.525 228.690  1.00 36.10           C
ATOM  14032  N   ASN E 343      54.917  19.724 226.389  1.00 29.11           N
ATOM  14033  CA  ASN E 343      56.205  19.891 225.716  1.00 29.76           C
ATOM  14034  C   ASN E 343      57.014  21.067 226.244  1.00 30.22           C
ATOM  14035  O   ASN E 343      58.246  21.037 226.202  1.00 31.22           O
ATOM  14036  CB  ASN E 343      56.017  20.064 224.201  1.00 30.58           C
ATOM  14037  CG  ASN E 343      55.704  18.766 223.502  1.00 29.83           C
ATOM  14038  OD1 ASN E 343      56.107  17.683 223.949  1.00 30.16           O
ATOM  14039  ND2 ASN E 343      54.981  18.863 222.398  1.00 28.53           N
ATOM  14040  N   HIS E 344      56.340  22.109 226.717  1.00 29.98           N
ATOM  14041  CA  HIS E 344      57.032  23.191 227.393  1.00 31.34           C
ATOM  14042  C   HIS E 344      57.498  22.754 228.775  1.00 32.11           C
ATOM  14043  O   HIS E 344      58.622  23.053 229.181  1.00 33.67           O
ATOM  14044  CB  HIS E 344      56.113  24.390 227.535  1.00 33.22           C
ATOM  14045  CG  HIS E 344      56.670  25.471 228.398  1.00 34.16           C
ATOM  14046  ND1 HIS E 344      57.820  26.162 228.073  1.00 34.61           N
ATOM  14047  CD2 HIS E 344      56.245  25.973 229.584  1.00 34.67           C
```

Appendix 2

```
ATOM  14048  CE1 HIS E 344    58.072  27.057 229.014  1.00 34.63           C
ATOM  14049  NE2 HIS E 344    57.132  26.961 229.944  1.00 35.97           N
ATOM  14050  N   LEU E 345    56.627  22.042 229.492  1.00 32.32           N
ATOM  14051  CA  LEU E 345    56.820  21.746 230.925  1.00 31.07           C
ATOM  14052  C   LEU E 345    57.731  20.549 231.257  1.00 32.01           C
ATOM  14053  O   LEU E 345    58.560  20.659 232.148  1.00 32.15           O
ATOM  14054  CB  LEU E 345    55.464  21.497 231.578  1.00 30.94           C
ATOM  14055  CG  LEU E 345    54.485  22.660 231.770  1.00 30.67           C
ATOM  14056  CD1 LEU E 345    53.160  22.208 232.375  1.00 29.43           C
ATOM  14057  CD2 LEU E 345    55.112  23.728 232.643  1.00 31.44           C
ATOM  14058  N   GLU E 346    57.582  19.421 230.551  1.00 33.09           N
ATOM  14059  CA  GLU E 346    58.244  18.160 230.943  1.00 32.34           C
ATOM  14060  C   GLU E 346    59.728  18.029 230.578  1.00 33.78           C
ATOM  14061  O   GLU E 346    60.543  17.715 231.443  1.00 36.72           O
ATOM  14062  CB  GLU E 346    57.475  16.921 230.443  1.00 32.16           C
ATOM  14063  CG  GLU E 346    57.607  15.777 231.437  1.00 34.79           C
ATOM  14064  CD  GLU E 346    56.967  14.449 231.035  1.00 35.93           C
ATOM  14065  OE1 GLU E 346    56.647  14.241 229.846  1.00 36.83           O
ATOM  14066  OE2 GLU E 346    56.816  13.589 231.940  1.00 33.96           O
ATOM  14067  N   PRO E 347    60.094  18.260 229.310  1.00 33.11           N
ATOM  14068  CA  PRO E 347    61.494  17.991 228.951  1.00 34.01           C
ATOM  14069  C   PRO E 347    62.570  18.748 229.748  1.00 33.63           C
ATOM  14070  O   PRO E 347    63.545  18.131 230.148  1.00 31.08           O
ATOM  14071  CB  PRO E 347    61.551  18.323 227.441  1.00 34.69           C
ATOM  14072  CG  PRO E 347    60.135  18.143 226.959  1.00 34.31           C
ATOM  14073  CD  PRO E 347    59.281  18.608 228.127  1.00 34.20           C
ATOM  14074  N   PRO E 348    62.395  20.057 229.995  1.00 35.39           N
ATOM  14075  CA  PRO E 348    63.429  20.773 230.762  1.00 36.23           C
ATOM  14076  C   PRO E 348    63.546  20.271 232.197  1.00 36.72           C
ATOM  14077  O   PRO E 348    64.598  20.432 232.828  1.00 37.36           O
ATOM  14078  CB  PRO E 348    62.953  22.237 230.749  1.00 36.86           C
ATOM  14079  CG  PRO E 348    61.879  22.316 229.713  1.00 36.59           C
ATOM  14080  CD  PRO E 348    61.276  20.942 229.628  1.00 36.62           C
ATOM  14081  N   ALA E 349    62.484  19.646 232.699  1.00 36.50           N
ATOM  14082  CA  ALA E 349    62.531  18.977 234.008  1.00 36.37           C
ATOM  14083  C   ALA E 349    63.365  17.681 234.041  1.00 36.51           C
ATOM  14084  O   ALA E 349    63.632  17.148 235.117  1.00 34.41           O
ATOM  14085  CB  ALA E 349    61.122  18.721 234.518  1.00 36.31           C
ATOM  14086  N   LYS E 350    63.762  17.183 232.868  1.00 38.38           N
ATOM  14087  CA  LYS E 350    64.738  16.092 232.734  1.00 37.06           C
ATOM  14088  C   LYS E 350    64.259  14.852 233.533  1.00 35.74           C
ATOM  14089  O   LYS E 350    64.879  14.445 234.513  1.00 36.65           O
ATOM  14090  CB  LYS E 350    66.163  16.576 233.107  1.00 33.28           C
ATOM  14091  N   PRO E 351    63.140  14.250 233.100  1.00 34.66           N
ATOM  14092  CA  PRO E 351    62.598  13.084 233.790  1.00 34.92           C
ATOM  14093  C   PRO E 351    63.423  11.866 233.518  1.00 34.36           C
ATOM  14094  O   PRO E 351    63.864  11.719 232.405  1.00 34.73           O
ATOM  14095  CB  PRO E 351    61.230  12.876 233.134  1.00 35.31           C
ATOM  14096  CG  PRO E 351    61.347  13.482 231.771  1.00 35.24           C
ATOM  14097  CD  PRO E 351    62.427  14.533 231.840  1.00 35.61           C
ATOM  14098  N   SER E 352    63.624  11.011 234.522  1.00 35.86           N
ATOM  14099  CA  SER E 352    64.166   9.666 234.323  1.00 34.98           C
ATOM  14100  C   SER E 352    63.434   8.636 235.182  1.00 34.70           C
ATOM  14101  O   SER E 352    62.797   8.957 236.191  1.00 34.21           O
```

Appendix 2

```
ATOM  14102  CB   SER E 352      65.665    9.614  234.623  1.00  35.97           C
ATOM  14103  OG   SER E 352      65.915   10.040  235.941  1.00  35.59           O
ATOM  14104  N    ILE E 353      63.557    7.387  234.757  1.00  34.36           N
ATOM  14105  CA   ILE E 353      62.911    6.257  235.393  1.00  31.42           C
ATOM  14106  C    ILE E 353      63.999    5.296  235.853  1.00  28.07           C
ATOM  14107  O    ILE E 353      64.716    4.708  235.034  1.00  26.52           O
ATOM  14108  CB   ILE E 353      61.932    5.588  234.414  1.00  31.41           C
ATOM  14109  CG1  ILE E 353      60.780    6.555  234.132  1.00  33.51           C
ATOM  14110  CG2  ILE E 353      61.423    4.276  234.985  1.00  30.60           C
ATOM  14111  CD1  ILE E 353      59.872    6.113  233.008  1.00  35.74           C
ATOM  14112  N    VAL E 354      64.130    5.178  237.168  1.00  25.78           N
ATOM  14113  CA   VAL E 354      65.179    4.387  237.788  1.00  25.60           C
ATOM  14114  C    VAL E 354      64.462    3.373  238.625  1.00  25.85           C
ATOM  14115  O    VAL E 354      63.609    3.742  239.412  1.00  28.18           O
ATOM  14116  CB   VAL E 354      66.104    5.222  238.707  1.00  24.79           C
ATOM  14117  CG1  VAL E 354      67.074    4.307  239.453  1.00  24.86           C
ATOM  14118  CG2  VAL E 354      66.877    6.265  237.908  1.00  24.05           C
ATOM  14119  N    SER E 355      64.808    2.102  238.443  1.00  26.29           N
ATOM  14120  CA   SER E 355      64.197    0.995  239.160  1.00  25.76           C
ATOM  14121  C    SER E 355      62.692    1.096  239.104  1.00  26.03           C
ATOM  14122  O    SER E 355      62.011    0.917  240.124  1.00  26.03           O
ATOM  14123  CB   SER E 355      64.685    0.958  240.598  1.00  25.44           C
ATOM  14124  OG   SER E 355      64.484   -0.336  241.129  1.00  26.57           O
ATOM  14125  N    ALA E 356      62.190    1.399  237.896  1.00  26.53           N
ATOM  14126  CA   ALA E 356      60.748    1.481  237.588  1.00  25.44           C
ATOM  14127  C    ALA E 356      60.021    2.571  238.348  1.00  27.00           C
ATOM  14128  O    ALA E 356      58.798    2.485  238.552  1.00  27.66           O
ATOM  14129  CB   ALA E 356      60.065    0.141  237.832  1.00  24.93           C
ATOM  14130  N    SER E 357      60.764    3.592  238.768  1.00  28.32           N
ATOM  14131  CA   SER E 357      60.183    4.703  239.523  1.00  30.29           C
ATOM  14132  C    SER E 357      60.615    6.004  238.876  1.00  31.47           C
ATOM  14133  O    SER E 357      61.755    6.138  238.439  1.00  29.85           O
ATOM  14134  CB   SER E 357      60.599    4.654  241.003  1.00  30.08           C
ATOM  14135  OG   SER E 357      59.813    5.560  241.752  1.00  29.84           O
ATOM  14136  N    LEU E 358      59.680    6.943  238.799  1.00  33.07           N
ATOM  14137  CA   LEU E 358      59.862    8.186  238.059  1.00  31.71           C
ATOM  14138  C    LEU E 358      60.384    9.330  238.917  1.00  34.27           C
ATOM  14139  O    LEU E 358      59.755    9.700  239.913  1.00  33.67           O
ATOM  14140  CB   LEU E 358      58.521    8.618  237.479  1.00  29.67           C
ATOM  14141  CG   LEU E 358      58.580    9.926  236.682  1.00  28.56           C
ATOM  14142  CD1  LEU E 358      59.467    9.752  235.456  1.00  29.61           C
ATOM  14143  CD2  LEU E 358      57.195   10.417  236.306  1.00  27.32           C
ATOM  14144  N    ARG E 359      61.500    9.920  238.489  1.00  38.60           N
ATOM  14145  CA   ARG E 359      62.036   11.154  239.081  1.00  41.88           C
ATOM  14146  C    ARG E 359      62.108   12.268  238.041  1.00  40.39           C
ATOM  14147  O    ARG E 359      62.217   11.997  236.833  1.00  38.83           O
ATOM  14148  CB   ARG E 359      63.478   10.939  239.600  1.00  49.03           C
ATOM  14149  CG   ARG E 359      63.653   10.066  240.841  1.00  54.03           C
ATOM  14150  CD   ARG E 359      62.795   10.508  242.036  1.00  55.99           C
ATOM  14151  NE   ARG E 359      62.746    9.460  243.063  1.00  62.29           N
ATOM  14152  CZ   ARG E 359      62.073    8.302  242.976  1.00  60.73           C
ATOM  14153  NH1  ARG E 359      61.341    7.998  241.906  1.00  65.17           N
ATOM  14154  NH2  ARG E 359      62.128    7.434  243.982  1.00  57.72           N
ATOM  14155  N    TYR E 360      62.075   13.510  238.518  1.00  35.09           N
```

Appendix 2

```
ATOM  14156  CA   TYR E 360      62.444  14.662 237.713  1.00 34.45           C
ATOM  14157  C    TYR E 360      63.703  15.300 238.287  1.00 36.47           C
ATOM  14158  O    TYR E 360      63.709  15.709 239.450  1.00 37.40           O
ATOM  14159  CB   TYR E 360      61.302  15.691 237.692  1.00 33.94           C
ATOM  14160  CG   TYR E 360      60.125  15.246 236.869  1.00 33.71           C
ATOM  14161  CD1  TYR E 360      60.089  15.463 235.492  1.00 32.21           C
ATOM  14162  CD2  TYR E 360      59.059  14.568 237.455  1.00 33.18           C
ATOM  14163  CE1  TYR E 360      59.020  15.034 234.732  1.00 32.53           C
ATOM  14164  CE2  TYR E 360      57.981  14.134 236.696  1.00 32.95           C
ATOM  14165  CZ   TYR E 360      57.962  14.371 235.339  1.00 32.61           C
ATOM  14166  OH   TYR E 360      56.886  13.936 234.587  1.00 33.76           O
ATOM  14167  N    GLU E 361      64.759  15.409 237.483  1.00 37.43           N
ATOM  14168  CA   GLU E 361      66.000  16.065 237.920  1.00 39.53           C
ATOM  14169  C    GLU E 361      65.907  17.613 238.144  1.00 37.42           C
ATOM  14170  O    GLU E 361      66.441  18.114 239.126  1.00 36.33           O
ATOM  14171  CB   GLU E 361      67.137  15.715 236.950  1.00 45.17           C
ATOM  14172  CG   GLU E 361      68.539  16.023 237.470  1.00 51.29           C
ATOM  14173  CD   GLU E 361      69.550  16.300 236.361  1.00 55.75           C
ATOM  14174  OE1  GLU E 361      69.505  15.620 235.304  1.00 56.42           O
ATOM  14175  OE2  GLU E 361      70.398  17.202 236.559  1.00 60.74           O
ATOM  14176  N    HIS E 362      65.257  18.365 237.257  1.00 36.63           N
ATOM  14177  CA   HIS E 362      65.072  19.824 237.455  1.00 39.18           C
ATOM  14178  C    HIS E 362      63.576  20.236 237.448  1.00 36.09           C
ATOM  14179  O    HIS E 362      63.108  20.831 236.491  1.00 34.28           O
ATOM  14180  CB   HIS E 362      65.819  20.675 236.384  1.00 43.30           C
ATOM  14181  CG   HIS E 362      67.270  20.319 236.178  1.00 51.80           C
ATOM  14182  ND1  HIS E 362      68.245  20.540 237.133  1.00 54.71           N
ATOM  14183  CD2  HIS E 362      67.919  19.813 235.095  1.00 54.42           C
ATOM  14184  CE1  HIS E 362      69.422  20.163 236.659  1.00 53.33           C
ATOM  14185  NE2  HIS E 362      69.252  19.721 235.424  1.00 55.00           N
ATOM  14186  N    PRO E 363      62.819  19.952 238.526  1.00 36.42           N
ATOM  14187  CA   PRO E 363      61.391  20.344 238.487  1.00 35.94           C
ATOM  14188  C    PRO E 363      61.222  21.856 238.339  1.00 36.53           C
ATOM  14189  O    PRO E 363      61.919  22.608 239.006  1.00 31.94           O
ATOM  14190  CB   PRO E 363      60.838  19.850 239.827  1.00 34.22           C
ATOM  14191  CG   PRO E 363      62.028  19.660 240.700  1.00 34.34           C
ATOM  14192  CD   PRO E 363      63.203  19.366 239.821  1.00 34.80           C
ATOM  14193  N    GLY E 364      60.319  22.286 237.457  1.00 37.01           N
ATOM  14194  CA   GLY E 364      60.228  23.704 237.068  1.00 37.19           C
ATOM  14195  C    GLY E 364      59.523  24.670 238.017  1.00 38.37           C
ATOM  14196  O    GLY E 364      59.661  25.891 237.882  1.00 37.62           O
ATOM  14197  N    SER E 365      58.771  24.131 238.975  1.00 38.93           N
ATOM  14198  CA   SER E 365      57.942  24.934 239.871  1.00 38.92           C
ATOM  14199  C    SER E 365      57.606  24.117 241.100  1.00 40.37           C
ATOM  14200  O    SER E 365      57.996  22.958 241.203  1.00 41.29           O
ATOM  14201  CB   SER E 365      56.631  25.322 239.178  1.00 39.90           C
ATOM  14202  OG   SER E 365      55.811  24.179 238.945  1.00 40.76           O
ATOM  14203  N    LEU E 366      56.858  24.713 242.021  1.00 40.59           N
ATOM  14204  CA   LEU E 366      56.272  23.952 243.114  1.00 41.32           C
ATOM  14205  C    LEU E 366      55.169  23.025 242.568  1.00 39.41           C
ATOM  14206  O    LEU E 366      54.699  23.192 241.426  1.00 35.07           O
ATOM  14207  CB   LEU E 366      55.719  24.900 244.172  1.00 43.02           C
ATOM  14208  CG   LEU E 366      56.772  25.831 244.785  1.00 44.13           C
ATOM  14209  CD1  LEU E 366      56.103  26.922 245.618  1.00 42.99           C
```

Appendix 2

```
ATOM  14210  CD2 LEU E 366    57.774 25.006 245.599 1.00 45.96           C
ATOM  14211  N   LEU E 367    54.794 22.026 243.363 1.00 37.03           N
ATOM  14212  CA  LEU E 367    53.694 21.122 242.995 1.00 38.32           C
ATOM  14213  C   LEU E 367    53.863 20.396 241.634 1.00 36.28           C
ATOM  14214  O   LEU E 367    52.891 19.910 241.061 1.00 34.70           O
ATOM  14215  CB  LEU E 367    52.361 21.898 243.013 1.00 37.74           C
ATOM  14216  CG  LEU E 367    51.931 22.425 244.381 1.00 39.92           C
ATOM  14217  CD1 LEU E 367    50.795 23.433 244.241 1.00 40.60           C
ATOM  14218  CD2 LEU E 367    51.511 21.271 245.291 1.00 40.39           C
ATOM  14219  N   PHE E 368    55.097 20.296 241.147 1.00 34.84           N
ATOM  14220  CA  PHE E 368    55.360 19.892 239.763 1.00 33.51           C
ATOM  14221  C   PHE E 368    54.996 18.454 239.482 1.00 32.29           C
ATOM  14222  O   PHE E 368    54.159 18.201 238.647 1.00 37.86           O
ATOM  14223  CB  PHE E 368    56.828 20.124 239.409 1.00 34.39           C
ATOM  14224  CG  PHE E 368    57.144 19.966 237.941 1.00 34.14           C
ATOM  14225  CD1 PHE E 368    56.854 20.987 237.036 1.00 32.90           C
ATOM  14226  CD2 PHE E 368    57.770 18.810 237.470 1.00 33.44           C
ATOM  14227  CE1 PHE E 368    57.163 20.850 235.689 1.00 32.57           C
ATOM  14228  CE2 PHE E 368    58.087 18.671 236.123 1.00 33.36           C
ATOM  14229  CZ  PHE E 368    57.780 19.693 235.233 1.00 33.10           C
ATOM  14230  N   ASP E 369    55.604 17.502 240.164 1.00 31.62           N
ATOM  14231  CA  ASP E 369    55.269 16.114 239.910 1.00 32.85           C
ATOM  14232  C   ASP E 369    53.786 15.798 240.241 1.00 34.34           C
ATOM  14233  O   ASP E 369    53.205 14.868 239.643 1.00 38.30           O
ATOM  14234  CB  ASP E 369    56.261 15.157 240.603 1.00 32.40           C
ATOM  14235  CG  ASP E 369    56.014 15.019 242.063 1.00 32.73           C
ATOM  14236  OD1 ASP E 369    55.143 14.200 242.446 1.00 30.32           O
ATOM  14237  OD2 ASP E 369    56.708 15.727 242.827 1.00 36.12           O
ATOM  14238  N   GLU E 370    53.187 16.592 241.142 1.00 32.89           N
ATOM  14239  CA  GLU E 370    51.771 16.483 241.521 1.00 31.20           C
ATOM  14240  C   GLU E 370    50.846 16.915 240.410 1.00 32.34           C
ATOM  14241  O   GLU E 370    49.902 16.203 240.091 1.00 36.61           O
ATOM  14242  CB  GLU E 370    51.453 17.334 242.760 1.00 32.80           C
ATOM  14243  CG  GLU E 370    52.066 16.867 244.087 1.00 32.52           C
ATOM  14244  CD  GLU E 370    53.398 17.543 244.438 1.00 33.13           C
ATOM  14245  OE1 GLU E 370    54.120 18.001 243.519 1.00 33.79           O
ATOM  14246  OE2 GLU E 370    53.734 17.621 245.641 1.00 32.20           O
ATOM  14247  N   LEU E 371    51.101 18.073 239.800 1.00 31.60           N
ATOM  14248  CA  LEU E 371    50.209 18.577 238.763 1.00 30.39           C
ATOM  14249  C   LEU E 371    50.352 17.794 237.448 1.00 31.23           C
ATOM  14250  O   LEU E 371    49.352 17.432 236.814 1.00 32.35           O
ATOM  14251  CB  LEU E 371    50.390 20.086 238.559 1.00 30.85           C
ATOM  14252  CG  LEU E 371    49.877 20.939 239.740 1.00 31.41           C
ATOM  14253  CD1 LEU E 371    50.270 22.406 239.632 1.00 30.17           C
ATOM  14254  CD2 LEU E 371    48.364 20.818 239.895 1.00 31.17           C
ATOM  14255  N   LEU E 372    51.570 17.507 237.027 1.00 30.49           N
ATOM  14256  CA  LEU E 372    51.717 16.669 235.841 1.00 30.95           C
ATOM  14257  C   LEU E 372    51.128 15.287 236.088 1.00 30.75           C
ATOM  14258  O   LEU E 372    50.596 14.704 235.177 1.00 31.08           O
ATOM  14259  CB  LEU E 372    53.177 16.527 235.405 1.00 32.37           C
ATOM  14260  CG  LEU E 372    53.710 17.596 234.461 1.00 33.04           C
ATOM  14261  CD1 LEU E 372    53.606 18.980 235.098 1.00 33.78           C
ATOM  14262  CD2 LEU E 372    55.146 17.260 234.074 1.00 33.10           C
ATOM  14263  N   PHE E 373    51.222 14.748 237.304 1.00 32.36           N
```

Appendix 2

```
ATOM  14264  CA   PHE E 373      50.554  13.476 237.595  1.00 32.48           C
ATOM  14265  C    PHE E 373      49.068  13.644 237.397  1.00 34.21           C
ATOM  14266  O    PHE E 373      48.434  12.841 236.741  1.00 33.85           O
ATOM  14267  CB   PHE E 373      50.805  13.019 239.023  1.00 32.90           C
ATOM  14268  CG   PHE E 373      49.919  11.880 239.474  1.00 31.31           C
ATOM  14269  CD1  PHE E 373      49.915  10.675 238.797  1.00 33.51           C
ATOM  14270  CD2  PHE E 373      49.127  12.006 240.590  1.00 31.01           C
ATOM  14271  CE1  PHE E 373      49.125   9.625 239.224  1.00 32.88           C
ATOM  14272  CE2  PHE E 373      48.326  10.968 241.020  1.00 31.51           C
ATOM  14273  CZ   PHE E 373      48.325   9.777 240.335  1.00 32.02           C
ATOM  14274  N    LEU E 374      48.524  14.709 237.969  1.00 36.56           N
ATOM  14275  CA   LEU E 374      47.091  14.976 237.877  1.00 38.16           C
ATOM  14276  C    LEU E 374      46.613  15.103 236.421  1.00 34.99           C
ATOM  14277  O    LEU E 374      45.608  14.495 236.027  1.00 36.04           O
ATOM  14278  CB   LEU E 374      46.737  16.248 238.668  1.00 38.54           C
ATOM  14279  CG   LEU E 374      45.266  16.639 238.646  1.00 37.95           C
ATOM  14280  CD1  LEU E 374      44.426  15.447 239.070  1.00 38.40           C
ATOM  14281  CD2  LEU E 374      45.027  17.847 239.539  1.00 37.34           C
ATOM  14282  N    ALA E 375      47.342  15.879 235.632  1.00 31.30           N
ATOM  14283  CA   ALA E 375      46.921  16.190 234.278  1.00 30.56           C
ATOM  14284  C    ALA E 375      47.012  14.958 233.353  1.00 31.62           C
ATOM  14285  O    ALA E 375      46.143  14.727 232.485  1.00 31.66           O
ATOM  14286  CB   ALA E 375      47.746  17.342 233.741  1.00 30.51           C
ATOM  14287  N    LYS E 376      48.050  14.154 233.547  1.00 30.40           N
ATOM  14288  CA   LYS E 376      48.189  12.929 232.780  1.00 29.86           C
ATOM  14289  C    LYS E 376      47.026  11.959 232.990  1.00 30.26           C
ATOM  14290  O    LYS E 376      46.593  11.304 232.031  1.00 30.11           O
ATOM  14291  CB   LYS E 376      49.521  12.255 233.082  1.00 30.08           C
ATOM  14292  CG   LYS E 376      50.705  13.003 232.491  1.00 29.22           C
ATOM  14293  CD   LYS E 376      52.015  12.339 232.865  1.00 28.89           C
ATOM  14294  CE   LYS E 376      53.208  13.095 232.305  1.00 29.30           C
ATOM  14295  NZ   LYS E 376      54.461  12.300 232.454  1.00 30.54           N
ATOM  14296  N    VAL E 377      46.499  11.880 234.211  1.00 29.31           N
ATOM  14297  CA   VAL E 377      45.371  10.983 234.478  1.00 30.03           C
ATOM  14298  C    VAL E 377      43.980  11.630 234.557  1.00 31.48           C
ATOM  14299  O    VAL E 377      43.003  10.903 234.579  1.00 33.03           O
ATOM  14300  CB   VAL E 377      45.578  10.164 235.770  1.00 30.51           C
ATOM  14301  CG1  VAL E 377      46.875   9.378 235.687  1.00 31.08           C
ATOM  14302  CG2  VAL E 377      45.553  11.058 237.024  1.00 29.94           C
ATOM  14303  N    HIS E 378      43.862  12.954 234.615  1.00 31.63           N
ATOM  14304  CA   HIS E 378      42.550  13.567 234.910  1.00 33.33           C
ATOM  14305  C    HIS E 378      41.407  13.073 233.990  1.00 34.86           C
ATOM  14306  O    HIS E 378      41.415  13.320 232.782  1.00 36.73           O
ATOM  14307  CB   HIS E 378      42.632  15.110 234.888  1.00 32.86           C
ATOM  14308  CG   HIS E 378      41.400  15.795 235.409  1.00 32.68           C
ATOM  14309  ND1  HIS E 378      40.764  15.410 236.572  1.00 33.06           N
ATOM  14310  CD2  HIS E 378      40.704  16.859 234.936  1.00 31.44           C
ATOM  14311  CE1  HIS E 378      39.718  16.194 236.780  1.00 31.37           C
ATOM  14312  NE2  HIS E 378      39.661  17.080 235.802  1.00 31.19           N
ATOM  14313  N    ALA E 379      40.421  12.385 234.573  1.00 34.49           N
ATOM  14314  CA   ALA E 379      39.262  11.896 233.804  1.00 33.43           C
ATOM  14315  C    ALA E 379      38.090  12.868 233.783  1.00 33.04           C
ATOM  14316  O    ALA E 379      36.977  12.467 233.485  1.00 35.17           O
ATOM  14317  CB   ALA E 379      38.780  10.568 234.362  1.00 33.06           C
```

Appendix 2

```
ATOM  14318  N    GLY E 380      38.314  14.131 234.108  1.00 31.12           N
ATOM  14319  CA   GLY E 380      37.213  15.090 234.189  1.00 29.74           C
ATOM  14320  C    GLY E 380      36.537  15.067 235.549  1.00 27.85           C
ATOM  14321  O    GLY E 380      36.344  13.999 236.151  1.00 25.45           O
ATOM  14322  N    PHE E 381      36.206  16.258 236.038  1.00 26.90           N
ATOM  14323  CA   PHE E 381      35.594  16.389 237.349  1.00 28.27           C
ATOM  14324  C    PHE E 381      34.182  15.861 237.321  1.00 28.11           C
ATOM  14325  O    PHE E 381      33.756  15.238 238.305  1.00 28.88           O
ATOM  14326  CB   PHE E 381      35.685  17.836 237.896  1.00 28.45           C
ATOM  14327  CG   PHE E 381      37.049  18.163 238.475  1.00 27.59           C
ATOM  14328  CD1  PHE E 381      37.491  17.535 239.643  1.00 27.44           C
ATOM  14329  CD2  PHE E 381      37.905  19.034 237.827  1.00 28.07           C
ATOM  14330  CE1  PHE E 381      38.751  17.786 240.169  1.00 27.64           C
ATOM  14331  CE2  PHE E 381      39.171  19.296 238.337  1.00 29.25           C
ATOM  14332  CZ   PHE E 381      39.598  18.667 239.512  1.00 28.78           C
ATOM  14333  N    GLY E 382      33.487  16.070 236.190  1.00 28.04           N
ATOM  14334  CA   GLY E 382      32.163  15.488 235.958  1.00 26.81           C
ATOM  14335  C    GLY E 382      32.185  13.972 236.092  1.00 28.00           C
ATOM  14336  O    GLY E 382      31.335  13.400 236.775  1.00 28.06           O
ATOM  14337  N    ALA E 383      33.178  13.322 235.472  1.00 28.35           N
ATOM  14338  CA   ALA E 383      33.355  11.866 235.584  1.00 28.33           C
ATOM  14339  C    ALA E 383      33.654  11.365 236.998  1.00 30.67           C
ATOM  14340  O    ALA E 383      33.181  10.304 237.399  1.00 34.90           O
ATOM  14341  CB   ALA E 383      34.447  11.395 234.641  1.00 27.46           C
ATOM  14342  N    LEU E 384      34.479  12.092 237.742  1.00 34.23           N
ATOM  14343  CA   LEU E 384      34.788  11.706 239.127  1.00 34.53           C
ATOM  14344  C    LEU E 384      33.517  11.780 239.943  1.00 35.83           C
ATOM  14345  O    LEU E 384      33.219  10.885 240.735  1.00 34.07           O
ATOM  14346  CB   LEU E 384      35.835  12.632 239.746  1.00 33.66           C
ATOM  14347  CG   LEU E 384      37.279  12.594 239.253  1.00 31.97           C
ATOM  14348  CD1  LEU E 384      38.071  13.582 240.087  1.00 31.60           C
ATOM  14349  CD2  LEU E 384      37.881  11.200 239.327  1.00 31.01           C
ATOM  14350  N    LEU E 385      32.771  12.861 239.723  1.00 37.71           N
ATOM  14351  CA   LEU E 385      31.471  13.052 240.352  1.00 40.27           C
ATOM  14352  C    LEU E 385      30.483  11.907 240.073  1.00 40.82           C
ATOM  14353  O    LEU E 385      29.769  11.464 240.967  1.00 38.64           O
ATOM  14354  CB   LEU E 385      30.887  14.369 239.876  1.00 42.15           C
ATOM  14355  CG   LEU E 385      29.681  14.907 240.632  1.00 45.33           C
ATOM  14356  CD1  LEU E 385      30.014  15.273 242.071  1.00 46.32           C
ATOM  14357  CD2  LEU E 385      29.164  16.128 239.892  1.00 47.49           C
ATOM  14358  N    ARG E 386      30.472  11.408 238.841  1.00 42.62           N
ATOM  14359  CA   ARG E 386      29.525  10.362 238.433  1.00 44.23           C
ATOM  14360  C    ARG E 386      30.146   8.964 238.480  1.00 44.06           C
ATOM  14361  O    ARG E 386      29.716   8.075 237.754  1.00 42.12           O
ATOM  14362  CB   ARG E 386      28.998  10.667 237.020  1.00 45.52           C
ATOM  14363  CG   ARG E 386      28.262  12.003 236.929  1.00 48.38           C
ATOM  14364  CD   ARG E 386      27.696  12.260 235.539  1.00 51.52           C
ATOM  14365  NE   ARG E 386      28.746  12.365 234.518  1.00 52.06           N
ATOM  14366  CZ   ARG E 386      29.322  13.498 234.120  1.00 51.32           C
ATOM  14367  NH1  ARG E 386      28.968  14.667 234.658  1.00 51.87           N
ATOM  14368  NH2  ARG E 386      30.270  13.462 233.185  1.00 48.72           N
ATOM  14369  N    MET E 387      31.134   8.776 239.360  1.00 46.49           N
ATOM  14370  CA   MET E 387      31.977   7.563 239.381  1.00 45.28           C
ATOM  14371  C    MET E 387      31.172   6.303 239.707  1.00 44.98           C
```

Appendix 2

```
ATOM   14372  O    MET E 387      30.368   6.314 240.620  1.00 42.64           O
ATOM   14373  CB   MET E 387      33.099   7.725 240.413  1.00 42.75           C
ATOM   14374  CG   MET E 387      33.857   6.439 240.748  1.00 41.97           C
ATOM   14375  SD   MET E 387      35.298   6.634 241.834  1.00 38.33           S
ATOM   14376  CE   MET E 387      36.241   7.871 240.957  1.00 36.93           C
ATOM   14377  N    PRO E 388      31.380   5.211 238.959  1.00 47.17           N
ATOM   14378  CA   PRO E 388      30.676   3.961 239.324  1.00 47.19           C
ATOM   14379  C    PRO E 388      31.048   3.484 240.733  1.00 44.73           C
ATOM   14380  O    PRO E 388      32.136   3.771 241.176  1.00 42.88           O
ATOM   14381  CB   PRO E 388      31.164   2.968 238.270  1.00 47.38           C
ATOM   14382  CG   PRO E 388      31.532   3.825 237.089  1.00 47.96           C
ATOM   14383  CD   PRO E 388      32.023   5.133 237.634  1.00 46.01           C
ATOM   14384  N    PRO E 389      30.139   2.795 241.447  1.00 46.44           N
ATOM   14385  CA   PRO E 389      30.510   2.253 242.773  1.00 47.10           C
ATOM   14386  C    PRO E 389      31.420   1.025 242.656  1.00 50.42           C
ATOM   14387  O    PRO E 389      31.548   0.472 241.567  1.00 50.32           O
ATOM   14388  CB   PRO E 389      29.162   1.880 243.400  1.00 47.37           C
ATOM   14389  CG   PRO E 389      28.132   2.599 242.590  1.00 46.96           C
ATOM   14390  CD   PRO E 389      28.689   2.703 241.202  1.00 45.69           C
ATOM   14391  N    PRO E 390      32.062   0.601 243.760  1.00 53.08           N
ATOM   14392  CA   PRO E 390      33.114  -0.437 243.662  1.00 54.01           C
ATOM   14393  C    PRO E 390      32.707  -1.709 242.866  1.00 51.87           C
ATOM   14394  O    PRO E 390      32.612  -2.813 243.417  1.00 51.31           O
ATOM   14395  CB   PRO E 390      33.472  -0.732 245.135  1.00 54.68           C
ATOM   14396  CG   PRO E 390      32.550   0.098 245.980  1.00 55.45           C
ATOM   14397  CD   PRO E 390      31.958   1.170 245.114  1.00 53.79           C
TER    14398       PRO E 390
HETATM 14399  ZN   ZN  A1001      57.611  -3.136 258.385  1.00 90.74          ZN
HETATM 14400  ZN   ZN  B1001      85.930   3.226 283.158  1.00 73.81          ZN
HETATM 14401  ZN   ZN  C1001      62.538  57.828 267.376  1.00 86.51          ZN
HETATM 14402  ZN   ZN  D1001      89.498  40.968 287.877  1.00 88.69          ZN
HETATM 14403  ZN   ZN  E1001      43.211  30.447 249.115  1.00 83.63          ZN
HETATM 14404  O    HOH W    1     53.541  35.759 233.848  1.00 44.86           O
HETATM 14405  O    HOH W    2     63.130   0.804 234.905  1.00 51.69           O
HETATM 14406  O    HOH W    3     55.313  12.623 228.604  1.00 51.64           O
HETATM 14407  O    HOH W    4     64.753   6.971 231.980  1.00 32.83           O
HETATM 14408  O    HOH W    5     65.644  -0.269 233.528  1.00 48.29           O
HETATM 14409  O    HOH W    6     42.057  19.569 220.885  1.00 38.52           O
HETATM 14410  O    HOH W    7     56.789  41.680 229.307  1.00 35.09           O
HETATM 14411  O    HOH W    8     51.509   0.324 232.806  1.00 40.63           O
HETATM 14412  O    HOH W   10     85.867 -16.700 247.682  1.00 41.24           O
HETATM 14413  O    HOH W   11    106.680  61.480 266.345  1.00 34.05           O
HETATM 14414  O    HOH W   12     80.472   3.833 264.731  1.00 30.13           O
HETATM 14415  O    HOH W   14     64.667   2.730 265.157  1.00 35.26           O
HETATM 14416  O    HOH W   15     72.896 -15.574 262.357  1.00 38.08           O
HETATM 14417  O    HOH W   16     62.025 -15.321 270.753  1.00 25.02           O
HETATM 14418  O    HOH W   17     51.134 -11.179 279.859  1.00 32.25           O
HETATM 14419  O    HOH W   18     60.726  -0.461 249.671  1.00 35.71           O
HETATM 14420  O    HOH W   19     68.259 -22.989 258.805  1.00 38.91           O
HETATM 14421  O    HOH W   20     57.319  -5.031 239.988  1.00 44.47           O
HETATM 14422  O    HOH W   21     72.300  -4.162 248.653  1.00 33.26           O
HETATM 14423  O    HOH W   22     74.451  -3.203 250.255  1.00 29.18           O
HETATM 14424  O    HOH W   23     78.898  -1.861 248.532  1.00 34.04           O
HETATM 14425  O    HOH W   24    102.046  13.212 268.824  1.00 28.29           O
```

Appendix 2

```
HETATM14426  O  HOH W  25   97.273  -0.101 267.673 1.00 30.35           O
HETATM14427  O  HOH W  26  104.352  39.217 275.822 1.00 32.66           O
HETATM14428  O  HOH W  27   66.430  -2.212 241.106 1.00 37.47           O
HETATM14429  O  HOH W  28   95.581   3.192 272.351 1.00 37.30           O
HETATM14430  O  HOH W  29   99.046  41.860 277.388 1.00 29.27           O
HETATM14431  O  HOH W  31   71.469  59.329 256.110 1.00 33.14           O
HETATM14432  O  HOH W  33   61.767   0.453 243.055 1.00 38.93           O
HETATM14433  O  HOH W  34  102.154  35.301 279.108 1.00 37.22           O
HETATM14434  O  HOH W  35   77.499  60.801 260.014 1.00 43.26           O
HETATM14435  O  HOH W  36  110.660  17.956 275.587 1.00 37.64           O
HETATM14436  O  HOH W  37   61.680  56.541 237.488 1.00 41.21           O
HETATM14437  O  HOH W  38   96.585  59.648 266.048 1.00 41.63           O
HETATM14438  O  HOH W  39  104.705  18.834 277.779 1.00 39.62           O
HETATM14439  O  HOH W  40   91.351  56.353 268.182 1.00 32.26           O
HETATM14440  O  HOH W  41   54.543  13.060 235.199 1.00 41.59           O
HETATM14441  O  HOH W  42  116.248  22.417 276.981 1.00 31.84           O
HETATM14442  O  HOH W  43  117.412  20.001 278.558 1.00 29.15           O
HETATM14443  O  HOH W  44   97.979  66.753 264.603 1.00 38.57           O
HETATM14444  O  HOH W  45  110.936   8.814 287.274 1.00 29.69           O
HETATM14445  O  HOH W  46   97.093  63.979 280.948 1.00 41.67           O
HETATM14446  O  HOH W  47   96.869  30.857 279.887 1.00 34.48           O
HETATM14447  O  HOH W  48   80.213  48.829 266.950 1.00 33.79           O
HETATM14448  O  HOH W  49   97.354  38.716 280.239 1.00 29.34           O
HETATM14449  O  HOH W  50   71.989  58.704 260.343 1.00 32.66           O
HETATM14450  O  HOH W  52   77.110  41.366 273.291 1.00 29.14           O
HETATM14451  O  HOH W  53   57.276  19.080 255.445 1.00 39.70           O
HETATM14452  O  HOH W  55   64.684  47.387 254.720 1.00 28.77           O
HETATM14453  O  HOH W  56   86.536  44.011 272.315 1.00 25.85           O
HETATM14454  O  HOH W  57   56.473  21.535 245.842 1.00 32.84           O
HETATM14455  O  HOH W  58   81.426  16.609 273.609 1.00 30.37           O
HETATM14456  O  HOH W  59   67.601  10.482 261.395 1.00 31.57           O
HETATM14457  O  HOH W  60   58.586  25.827 254.761 1.00 37.38           O
HETATM14458  O  HOH W  61   83.743  14.387 281.745 1.00 28.57           O
HETATM14459  O  HOH W  62   59.702  47.652 264.272 1.00 29.35           O
HETATM14460  O  HOH W  63   80.718  41.968 280.786 1.00 25.09           O
HETATM14461  O  HOH W  64   50.090  22.895 254.051 1.00 29.94           O
HETATM14462  O  HOH W  65  102.592  12.962 289.173 1.00 31.47           O
HETATM14463  O  HOH W  68  103.571  28.892 294.715 1.00 29.79           O
HETATM14464  O  HOH W  69   38.405  52.150 244.256 1.00 42.90           O
HETATM14465  O  HOH W  70   77.856  71.214 277.510 1.00 36.57           O
HETATM14466  O  HOH W  71   80.228  11.023 285.782 1.00 26.91           O
HETATM14467  O  HOH W  72   92.311  23.588 306.791 1.00 31.79           O
HETATM14468  O  HOH W  73   92.378   9.680 298.858 1.00 29.04           O
HETATM14469  O  HOH W  74   45.701  60.484 263.130 1.00 30.44           O
HETATM14470  O  HOH W  75   82.503  56.593 293.225 1.00 29.12           O
HETATM14471  O  HOH W  76   32.655  15.886 249.364 1.00 38.22           O
HETATM14472  O  HOH W  77   84.735   0.424 308.096 1.00 19.99           O
HETATM14473  O  HOH W  78   89.964  -3.474 282.010 1.00 34.28           O
HETATM14474  O  HOH W  79   65.920  65.386 266.730 1.00 43.04           O
HETATM14475  O  HOH W  80   88.831   6.078 285.048 1.00 33.82           O
HETATM14476  O  HOH W  82  103.320  11.037 267.386 1.00 28.04           O
HETATM14477  O  HOH W  84   99.384   8.162 272.263 1.00 21.57           O
HETATM14478  O  HOH W  85   97.811  46.522 273.366 1.00 24.82           O
HETATM14479  O  HOH W  86  105.975   5.192 292.827 1.00 35.23           O
```

Appendix 2

```
HETATM14480  O  HOH W  87   96.060  62.518 287.654  1.00 28.77           O
HETATM14481  O  HOH W  88   51.405  69.566 251.871  1.00 40.32           O
HETATM14482  O  HOH W  89   51.371  45.846 237.201  1.00 35.95           O
HETATM14483  O  HOH W  90   90.318  -8.293 266.089  1.00 38.00           O
HETATM14484  O  HOH W  91   60.005  51.009 269.152  1.00 34.04           O
HETATM14485  O  HOH W  92   45.612  26.990 256.210  1.00 36.02           O
HETATM14486  O  HOH W  94   96.078  47.092 271.460  1.00 21.43           O
HETATM14487  O  HOH W  95   96.550  46.568 268.961  1.00 31.72           O
HETATM14488  O  HOH W  96   97.248  42.393 271.231  1.00 32.05           O
HETATM14489  O  HOH W  97   93.266  41.443 272.893  1.00 25.40           O
HETATM14490  O  HOH W  98   99.126  31.540 278.066  1.00 30.25           O
HETATM14491  O  HOH W  99   96.075  37.289 281.967  1.00 33.43           O
HETATM14492  O  HOH W 100   71.288  58.190 262.907  1.00 27.74           O
HETATM14493  O  HOH W 102   54.206  28.241 257.420  1.00 30.38           O
HETATM14494  O  HOH W 103   62.927  49.980 271.888  1.00 19.60           O
HETATM14495  O  HOH W 104   85.948 -20.187 248.191  1.00 36.96           O
HETATM14496  O  HOH W 105   84.325 -24.378 253.361  1.00 38.79           O
HETATM14497  O  HOH W 107   97.112  41.293 290.510  1.00 44.55           O
HETATM14498  O  HOH W 108   96.279  40.065 286.394  1.00 27.80           O
HETATM14499  O  HOH W 109   67.935  62.091 264.282  1.00 30.23           O
HETATM14500  O  HOH W 110  108.611  33.405 275.178  1.00 26.76           O
HETATM14501  O  HOH W 111   56.260  42.275 232.728  1.00 40.94           O
HETATM14502  O  HOH W 112  101.501  44.438 269.800  1.00 27.10           O
HETATM14503  O  HOH W 114   61.182  61.557 270.244  1.00 34.27           O
HETATM14504  O  HOH W 115   53.400  -6.112 259.051  1.00 35.19           O
HETATM14505  O  HOH W 116   85.138  -0.110 286.547  1.00 32.80           O
HETATM14506  O  HOH W 117   90.160  41.208 293.120  1.00 28.32           O
HETATM14507  O  HOH W 118   38.440  31.879 249.932  1.00 51.18           O
HETATM14508  O  HOH W 119  118.517   9.748 280.127  1.00 30.42           O
HETATM14509  O  HOH W 120  114.180   0.814 277.611  1.00 34.68           O
HETATM14510  O  HOH W 121  111.096  -6.088 277.861  1.00 32.86           O
HETATM14511  O  HOH W 122   77.633   3.831 270.918  1.00 34.38           O
HETATM14512  O  HOH W 123   73.349   9.316 271.663  1.00 37.22           O
HETATM14513  O  HOH W 124   51.100  -4.376 277.243  1.00 45.54           O
HETATM14514  O  HOH W 125   58.512  -4.370 251.583  1.00 40.67           O
HETATM14515  O  HOH W 126   48.100 -22.187 262.011  1.00 36.33           O
HETATM14516  O  HOH W 127   74.361 -26.263 247.503  1.00 42.12           O
HETATM14517  O  HOH W 128   82.341   8.013 251.182  1.00 55.23           O
HETATM14518  O  HOH W 129  100.703  23.261 276.378  1.00 35.03           O
HETATM14519  O  HOH W 130   83.606   9.777 281.261  1.00 37.50           O
HETATM14520  O  HOH W 131   96.056  16.560 306.620  1.00 31.99           O
HETATM14521  O  HOH W 132   80.112  -1.757 291.407  1.00 43.06           O
HETATM14522  O  HOH W 133   90.243  -1.008 278.854  1.00 31.84           O
HETATM14523  O  HOH W 134   92.360  -7.676 300.595  1.00 39.66           O
HETATM14524  O  HOH W 135  107.795  -5.496 270.667  1.00 34.75           O
HETATM14525  O  HOH W 136   91.848   1.729 273.100  1.00 34.60           O
HETATM14526  O  HOH W 137  116.023   7.700 272.662  1.00 29.48           O
HETATM14527  O  HOH W 138   93.112  10.332 270.880  1.00 32.34           O
HETATM14528  O  HOH W 139   57.956  58.382 231.291  1.00 37.21           O
HETATM14529  O  HOH W 140   54.442  52.553 276.447  1.00 41.01           O
HETATM14530  O  HOH W 141   46.452  51.466 269.793  1.00 38.95           O
HETATM14531  O  HOH W 142   44.020  74.937 266.210  1.00 53.43           O
HETATM14532  O  HOH W 143   50.710  75.563 270.910  1.00 32.60           O
HETATM14533  O  HOH W 144   56.518  79.353 260.695  1.00 48.56           O
```

Appendix 2

```
HETATM14534  O    HOH W 145      69.323  56.945 250.684  1.00 35.12           O
HETATM14535  O    HOH W 146      92.168  70.660 270.106  1.00 36.66           O
HETATM14536  O    HOH W 147      80.102  34.530 279.609  1.00 27.43           O
HETATM14537  O    HOH W 148      78.396  66.755 291.423  1.00 35.25           O
HETATM14538  O    HOH W 149      69.835  55.797 292.925  1.00 37.43           O
HETATM14539  O    HOH W 150      85.283  62.662 306.417  1.00 36.65           O
HETATM14540  O    HOH W 151     113.073  53.561 282.242  1.00 32.31           O
HETATM14541  O    HOH W 152      86.280  54.053 266.250  1.00 26.41           O
HETATM14542  O    HOH W 153      48.463  27.046 252.588  1.00 36.48           O
HETATM14543  O    HOH W 154      26.939   5.346 253.354  1.00 33.74           O
HETATM14544  O    HOH W 155      39.644  14.189 230.814  1.00 40.09           O
HETATM14545  O    HOH W 156      62.451   2.878 243.635  1.00 37.54           O
HETATM14546  O    HOH W 157     100.165  34.104 277.280  1.00 34.24           O
CONECT  369  783
CONECT  783  369
CONECT 3229 3643
CONECT 3643 3229
CONECT 6115 6529
CONECT 6529 6115
CONECT 9009 9423
CONECT 9423 9009
CONECT1189512309
CONECT1230911895
MASTER      649    0    5   99   36    0    0  614541    5   10  145
END
```

Appendix 3

```
>INV.0156
MMRFTLKTTAIVSAAALLAGFGPPPRAAELPPGRLATTEDYFAQQAKQAVTPDVMAQLAYMNYIDF
ISPFYSRGCSFEAWELKHVPQRVIKYSIAFYAYGLASVALIDPKLRALAGHDLDIAVSLMKCKRVW
GDWEEDGFGTDPIEKENIMYSGHLNLMYGLYQLVTGSRRYEAEHAHLTRIIWDEIAANPFAGIVCE
PDNYFVQCNSVAYLSLWVYDRLHGTDYRAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFDQLLNHLEPPAKPSIVSAILRYEHPGSLLFDELLFFAKVHAGFGALLRMPPPAAKLA
GK
>INV.0157
MMRFTLKTTAIVSAAALLAGFGPPPRAAELPPGRLATTEDYFAQQAKQAVTPDVMAQLAYMNYIDF
ISPFYSRGCSFEAWELKHVPQRVIKYSIAFYAYGLASVALIDPKLRALAGHDLDIAVSLMKCKRVW
GDWEEDGFGTDPIEKENIMYSGHLNLMYGLYQLVTGSRRYEAEHAHLTRIIWDEIAANPFAGIVCE
PDNYFVQCNSVAYLSLWVYDRLHGTDYRAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFDQLLNHLEPPAKPSIVSAILRYEHPGSLLFDELLFFAKVHAGFYALLRMPPPAAKLA
GK
>INV.0158
MMRFTLKTTAIVSAAALLAGFGPPPRAAELPPGRLATTEDYFAQQAKQAVTPDVMAQLAYMNYIDF
ISPFYSRGCSFEAWELKHVPQRVIKYSIAFYAYGLASVALIDPKLRALAGHDLDIAVSLMKCKRVW
GDWEEDGFGTDPIEKENIMYSGHLNLMYGLYQLVTGSRRYEAEHAHLTRIIWDEIAANPFAGIVCE
PDNYFVQCNSVAYLSLWVYDRLHGTDYRAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFQQLLNHLEPPAKPSIVSAILRYEHPGSLLFDELLFFAKVHAGFYALLRMPPPAAKLA
GK
>INV.0159
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDMLHGTDYTAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSAILFYEHPMSLLFMELLFFAKVHAGFYALLRMPPPAAKLA
GK
>INV.0160
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDMLHGTDYTAATRAWLDFIQKDLIDPERGAFYLSYHPESGAVKPWIS
AYTTAWTLAFVHGMDPAFSERYYPRFKQTFVEVYDEGRKARVWETAGTDDADGGVGLASLFTLLLA
REMGDQQLFHWLLNHLEPPAKPSIVSASLYYEHPMSLLFMELLFFAKVHAGFYALLRMPPPAAKLA
GK
>INV.0161
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDVLHGTDYTAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSASLYYEHPMSLLFMELLFFAKVHAGFYALLRMPPPAAKLA
GK
>INV.0162
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDMLHGTDYTAATRAWLDFIQKDLIDPERGAFYLSYHPESGAVKPWIS
AYTTAWTLAFVHGMDPAFSERYYPRFKQTFVEVYDEGRKARVWETAGTDDADGGVGLASLFTLLLA
```

Appendix 3

```
REMGDQQLFHWLLNHLEPPAKPSIVSAILFYEHPMSLLFMELLFFAKVHAGFYALLRMPPPAAKLA
GK
>INV.0163
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDQLHGTDYRAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSAILFYEHPMSLLFMELLFFAKVHAGFYALLRMPPPAAKLA
GK
>INV.0164
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDVLHGTDYTAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSAILFYEHPMSLLFMELLFFAKVHAGFGALLRMPPPAAKLA
GK
>INV.0165
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDQLHGTDYTAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSAILFYEHPMSLLFMELLFFAKVHAGFYALLRMPPPAAKLA
GK
>INV.0166
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDVLHGTDYTAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSAILFYEHPMSLLFMELLFLAKVHAGFYALLRMPPPAAKLA
GK
>INV.0167
MMRFTLKTTAIVSAAALLAGFGPPPRAAELPPGLLATTEDYFAQYAKQAVTPDVMAQLAYMNYIDF
ISPFYSRGCSFEAWWLMHVPQRVIKYSIAFYAYGLASVALIWPKLRALAGHDLDIAVSLMKCKWVW
GDWEEDGFGTVPIEKYNIMYAGHLNLMYGLYMLVTGSRRYEAEHAHLTRIIWDEIAAHPFAGIVCE
PDNYFVQCNSVAYLSLWVYDMLHGTDYTAATRAWLDFIQKDLIDPERGAFYLSYHPESGAVKPWIS
AYTTAWTLAFVHGMDPAFSERYYPRFKQTFVEVYDEGRKARVRETAGTDDADGGVGLASLFTLLLA
REMGDQQLFHWLLNHLEPPAKPSIVSASLYYEHPMSLLFMELLFFAKVHAGFYALLRMPPPAAKLA
GK
>INV.0168
MMRFTLKTTAIVSAAALLAGFGPPPRAAEQPLGRLATTERYFKQQNLQTVTPDVMAQLAYMNYIDF
ISPFYSRGCSFEAWELRHMPQRVIKYSIAFYAYGLASVALIDPNLRALAGHDLDIAVSQMLCKRVW
GDWEEDGFGTQPIQQENIMYKGHLNLMYGLYQLVTTSRRYEQEHAKLTRIIYQEIMKNPFAGIVCE
PDNYFVQCNSVAYLSLWVYDRLHGTNYRMTLRNWLRFIQRDLIDPNRGAFYLSYHPESGAVKPWIS
AYTTAWTLAMVHGMDPAFSRRYYPRFVRTFVEVYDNGRKARVRETWGTDDANGGVGLASAFTLLLA
REMGDQQLFRQLLRHLEPPARPQIVSARLRYENPQSLLFDELLFLAKVHTGFENLLRMPPPAAKLA
GK
>INV.0169
MMRFTLKTTAIVSAAALLAGFGPPPRAAEQPQGRLATTEQYFKQQNLQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTQPIERENIMYKGHLNLMYGLYQLVTTSRRYEQEHAKLTRIIYDEIMKNPFAGIVCE
```

Appendix 3

```
PDNYFVQCNSVAYLSLWVYDRLHGTNYRMALRNWLDFIQKDLIDPNRGAFYLSYHPESGAVKPWIS
AYTTAWTLAYVHGMDPAFSRRYYPRFVRTFVEVYDNGRKARVRETWGTDDANGGVGLASAFTLLLA
REMGDQQLFRQLLRHLEPPARPTIVSARLRYENPQSLLFDELLFLAKVHTGFENLLRMPPPAAKLA
GK
>INV.0170
MMRFTLKTTAIVSAAALLAGFGPPPRAAEQPTGRLATTEQYFKQQNKQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTDPIERENIMYKGHLNLMYGLYQLVTTSRRYEQEHAKLTRIIYREIMKNPFAGIVCE
PDNYFVQCNSVAYLSLWVYDRLHGTNYRMALRNWLDFIQKDLIDPNRGAFYLSYHPESGAVKPWIS
AYTTAWTLAYVHGMDPAFSRRYYPRFVRTFVEVYDNGRKARVRETWGTDDANGGVGLASAFTLLLA
REMGDQQLFRQLLNHLEPPARPLIVSARLRYENPQSLLFDELLFLAKVHTGFENLLRMPPPAAKLA
GK
>INV.0171
MMRFTLKTTAIVSAAALLAGFGPPPRAAEQPNGRLATTEQYFKQQNKQTVTPDVMAQLAYMNYIDF
ISPFYSRGCSFEAWRLRHTPQRVIKYSIAFYAYGLASVALIDPNLRALAGHDLDIAVSQMLCKRVW
GDWEEDGFGTRPIERENIMYKGHLNLMYGLYQLVTTSRRYENEHAYLTRIIYQEIVKNPFAGIVCE
PDNYFVQCNSVAYLSLWVYDRLHGTNYRMALRRWLRFIQRDLIDPNRGAFYLSYHPESGAVKPWIS
AYTTAWTLAMVHGMDPAFSRRYYPRFVRTFVEVYDNGRKARVRETWGTDDANGGVGLASAFTLLLA
REMGDQQLFRQLLNHLEPPARPTIVSARLRYENPQSLLFDELLFLAKVHTGFENLLRMPPPAAKLA
GK
>INV.0172
MMRFTLKTTAIVSAAALLAGFGPPPRAAEQPLGRLATTEQYFKQQNKQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTRPIEQENIMYKGHLNLMYGLYQLVTTSRRYEQEHAYLTRIIYREIMKNPFAGIVCE
PDNYFVQCNSVAYLSLWVYDRLHGTNYRMALRNWLDFIQKDLIDPNRGAFYLSYHPESGAVKPWIS
AYTTAWTLAYVHGMDPAFSRRYYPRFVRTFVEVYDNGRKARVRETWGTDDANGGVGLASAFTLLLA
REMGDQQLFRQLLRHLEPPARPTIVSARLRYENPQSLLFDELLFLAKVHTGFENLLRMPPPAAKLA
GK
>INV.0173
MMRFTLKTTAIVSAAALLAGFGPPPRAAEQPQGRLATTEQYFQQQNKQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTQPIERENIMYKGHLNLMYGLYQLVTTSRRYEQEHAKLTRIIYREIMKNPFAGIVCE
PDNYFVQCNSVAYLSLWVYDRLHGTNYRMTLRRWLRFIQRDLIDPERGAFYLSYHPESGAVKPWIS
AYTTAWTLAMVHGMDPAFSRRYYPRFVRTFVEVYDNGRKARVRETWGTDDANGGVGLASAFTLLLA
REMGDQQLFRQLLRHLEPPARPQIVSARLRYENPQSLLFDELLFLAKVHTGFENLLRMPPPAAKLA
GK
>INV.0174
MMRFTLKTTAIVSAAALLAGFGPPPRAAEQPQGRLATTERYFKQQNLQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTDPIERENIMYKGHLNLMYGLYQLVTTSRRYEQEHAKLTRIIYDEIMKNPFAGIVCE
PDNYFVQCNSVAYLSLWVYDRLHGTNYRMALRNWLQFIQRDLIDPQRGAFYLSYHPESGAVKPWIS
AYTTAWTLAYVHGMDPAFSRRYYPRFVRTFVEVYDNGRKARVRETAGTDDANGGVGLASAFTLLLA
REMGDQQLFRQLLRHLEPPARPTIVSARLRYENPQSLLFDELLFLAKVHTGFENLLRMPPPAAKLA
GK
>INV.0175
MMRFTLKTTAIVSAAALLAGFGPPPRAAEQPQGRLATTEQYFKQQNLQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTQPIERENIMYKGHLNLMYGLYQLVTTSRRYEQEHAKLTRIIYQEIMKNPFAGIVCE
PDNYFVQCNSVAYLSLWVYDRLHGTNYRMALRNWLDFIQKDLIDPNRGAFYLSYHPESGAVKPWIS
AYTTAWTLAMVHGMDPAFSRRYYPRFVRTFVEVYDNGRKARVRETWGTDDANGGVGLASAFTLLLA
REMGDQQLFRQLLRHLEPPARPTIVSARLRYENPQSLLFDELLFLAKVHTGFENLLRMPPPAAKLA
GK
>INV.0176
```

Appendix 3

```
MMRFTLKTTAIVSAAALLAGFGPPPRAAEQPQGRLATTEQYFKQQNKQTVTPDVMAQLAYMNYIDF
ISPFYSRGCSFEAWRLRHMPQRVIKYSIAFYAYGLASVALIDPNLRALAGHDLDIAVSQMLCKRVW
GDWEEDGFGTQPIEQENIMYKGHLNLMYGLYQLVTTSRRYEQEHAKLTRIIYREIVKNPFAGIVCE
PDNYFVQCNSVAYLSLWVYDRLHGTNYRMTLRNWLRFIQRDLIDPNRGAFYLSYHPESGAVKPWIS
AYTTAWTLAYVHGMDPAFSRRYYPRFVRTFVEVYDNGRKARVRETWGTDDANGGVGLASAFTLLLA
REMGDQQLFRQLLRHLEPPARPTIVSARLFYENPQSLLFDELLFLAKVHTGFENLLRMPPPAAKLA
GK
>INV.0177
MMRFTLKTTAIVSAAALLAGFGPPPRAAEQPQGLLATTYMYFMQLAWQAVTPDVMAMLAYMNYIDF
ISPFYSRGCSFEAWRLRHVPQRVIKYSIAFYAYGLASVALIWPNLRALAGHDLDIAVSLMLCPVVW
GDWEEDGFGTVPIKFYNIMYAGHLNLMYGLYMLVTTSTRYRQEFQKLTWIIYWWIMLHPFAGIVCE
PDNYFVQCNSVAYLSLWVYDVLHGMNFVMALRMWLRFIQFDLIHPEWGAFYLSYHPESGAVKPWIS
AYTTAWTLAFVHGMKPAFSRKYYPRFVRTFVEVYNNGQKARVWETWGTTDANGGVGLASLFALLLA
REMGDMQLFTWLLRHLEPPARPTIVSATLFYINPQSLLFSELLFFAKVHTGFENLLKMPPPAAKLA
GK
>INV.0178
MMRFTLKTTAIVSAAALLAGFGPPPRAAEQPQGLLATTYKYFMQLAWQAVTPDVMAMLAYMNYIDF
ISPFYSRGCSFEAWRLRHVPQRVIKYSIAFYAYGLASVALIWPNLRALAGHDLDIAVSLMLCKVVW
GDWEEDGFGTVPIYWYNIMYAGHLNLMYGLYMLVTTSYRYRQEFQKLTQIIYQMIMKHPFAGIVCE
PDNYFVQCNSVAYLSLWVYDQLHGMRYVMALRNWLKFIQMDLIHPEWGAFFLSYHPESGAVKPWIS
AYTTAWTLAFVHGMDPAFSRQYYPRFVRTFVEVYNNGQKARVRETWGTTDANGGVGLASLFALLLA
REMGDMQLFTWLLRHLEPPARPVIVSATLFYINPQSLLFSELLFFAKVHTGFENLLKMPPPAAKLA
GK
>INV.0179
MMRFTLKTTAIVSAAALLAGFGPPPRAAEQPQGLLATTYMYFMQYAWQTVTPDVMAMLAFMNYIDF
ISPFYSRGCSFEAWRLRHVPQRVIKYSIAFYAYGLASVALIDPNLRALAGHDLDIAVSLMLCKVVW
GDWEEDGFGTVPIQRYNIMYAGHLNLMYGLYMLVTTSTRYRQEFAKLTWIIYWEIMKHPFAGIVCE
PDNYFVQCNSVAYLSLWVYDVLHGTNFTMALRMWLRFIQFDLINPNWGAFYLSYHPESGAVKPWIS
AYTTAWTLAFVHGMDPAFSRKYYPRFVRTFVEVYNNGQKARVWETWGTTDANGGVGLASLFALLLA
REMGDMQLFAWLLRHLEPPARPTIVSATLYYINPQSLLFAELLFFAKVHTGFENLLKMPPPAAKLA
GK
>INV.0180
MMRFTLKTTAIVSAAALLAGFGPPPRAAEQPQGLLATTEQYFKQLAKQAVTPDVMAMLAFMNYIDF
ISPFYSRGCSFEAWKLRHVPQRVIKYSIAFYAYGLASVALIWPNLRALAGHDLDIAVSLMLCKVVW
GDWEEDGFGTVPIKFYNIMYAGHLNLMYGFYMLVTTSTRYNEFQKLTWIIYWEIMKHPFAGIVCE
PDNYFVQCNSVAYLSLWVYDVLHGMNFTMALRMWLRFIQFDLIHPEWGAFYLSYHPESGAVKPWIS
AYTTAWTLAFVHGMDPAFSRKYYPRFVRTFVEVYNNGQKARVWETWGTTDANGGVGLASLFALLLA
REMGDMQLFTWLLRHLEPPARPVIVSATLFYINPQSLLFAELLFFAKVHTGFENLLKMPPPAAKLA
GK
>INV.0181
MMRFTLKTTAIVSAAALLAGFGPPPRAAEQPQGLLATTEQYFKQYQKQAVTPDVMAMLAFMNYIDF
ISPFYSRGCSFEAWRLMHVPQRVIKYSIAFYAYGLASVALIWPNLRALAGHDLDIAVSLMLCKVVW
GDWEEDGFGTVPIYWYNIMYAGHLNLMYGLYMLVTTSTRYRQEHQKLTWIIYWWIMLHPFAGIVCE
PDNYFVQCNSVAYLSLWVYDVLHGMNFTMALRMWLRFIQFDLIHPEWGAFYLSYHPESGAVKPWIS
AYTTAWTLAMVHGMDPAFSRKYYPRFVRTFVEVYNNGQKARVRETWGTTDANGGVGLASLFALLLA
REMGDMQLFTWLLRHLEPPARPVIVSATLFYINPQSLLFSELLFWAKVHTGWEMLLKMPPPAAKLA
GK
>INV.0182
MMRFTLKTTAIVSAAALLAGFGPPPRAAEQPQGLLATTERYFKQYQLQTVTPDVMAMLAFMNYIDF
ISPFYSRGCSFEAWRLRHVPQRVIKYSIAFYAYGLASVALIWPNLRALAGHDLDIAVSLMLCKVVW
GDWEEDGFGTVPIYWYNIMYAGHLNLMYGLYMLVTTSTRYRNEFAKLTRIIYRMIMKHPFAGIVCE
PDNYFVQCNSVAYLSLWVYDVLHGTNFTMALRNWLDFIQRDLINPNWGAFYLSYHPESGAVKPWIS
AYTTAWTLAFVHGMKPAFSRKYYPRFVRTFVEVYNNGQKARVWETWGTTDANGGVGLASLFALLLA
```

REMGDMQLFTWLLRHLEPPARPTIVSAILFYINPQSLLFAELLFFAKVHTGFENLLKMPPPAAKLA
GK
>INV.0183
MMRFTLKTTAIVSAAALLAGFGPPPRAAEQPQGLLATTEQYFKQYAKQTVTPDVMAMLAFMNYIDF
ISPFYSRGCSFEAWRLRHVPQRVIKYSIAFYAYGLASVALIDPNLRALAGHDLDIAVSLMLCKVVW
GDWEEDGFGTVPIERYNIMYAGHLNLMYGLYMLVTTSTRYRQEFAKLTWIIYWWIMLHPFAGIVCE
PDNYFVQCNSVAYLSLWVYDVLHGMNFVMALRMWLRFIQRDLIHPEWGAFFLSYHPESGAVKPWIS
AYTTAWTLAFVHGMKPAFSRKYYPRFVRTFVEVYNNGQKARVRETWGTTDANGGVGLASLFALLLA
REMGDMQLFTWLLRHLEPPARPTIVSATLFYINPQSLLFAELLFFAKVHTGFENLLKMPPPAAKLA
GK
>INV.0184
MMRFTLKTTAIVSAAALLAGFGPPPRAAEQPQGLLATTYRYFMQLAWQTVTPDVMAMLAFMNYIDF
ISPFYSRGCSFEAWRLRHVPQRVIKYSIAFYAYGLASVALIDPNLRALAGHDLDIAVSLMLCKVVW
GDWEEDGFGTVPIKFYNIMYAGHLNLMYGLYMLVTTSTRYRQEFAYLTLIIYWEIMKHPFAGIVCE
PDNYFVQCNSVAYLSLWVYDVLHGTNFTMALRRWLRFIQWDLINPNWGAFYLSYHPESGAVKPWIS
AYTTAWTLAFVHGMDPAFSRKYYPRFVRTFVEFYNNGQKARVRETWGTTDANGGVGLASLFALLLA
REMGDMQLFTYLLRHLEPPARPTIVSATLFYINPQSLLFAELLFFAKVHTGFENLLKMPPPAAKLA
GK
>INV.0185
MMRFTLKTTAIVSAAALLAGFGPPPRAAEQPQGLLATTEMYFKQYALQTVTPDVMAMLAFMNYIDF
ISPFYSRGCSFEAWRLRHVPQRVIKYSIAFYAYGLASVALIDPNLRALAGHDLDIAVSLMLCKVVW
GDWEEDGFGTVPIKFYNIMYAGHLNLMYGLYMLVTTSYRYRQEFQKLTWIIYWEIMKHPFAGIVCE
PDNYFVQCNSVAYLSLWVYDVLHGMNFTMALRMWLRFIQFDLIHPEWGAFYLSYHPESGAVKPWIS
AYTTAWTLAFVHGMDPAFSRKYYPRFVRTFVEVYNNGQKARVRETWGTTDANGGVGLASLFALLLA
REMGDMQLFAWLLRHLEPPARPVIVSAILFYINPQSLLFAELLFFAKVHTGFEMLLKMPPPAAKLA
GK
>INV.0186
MMRFTLKTTAIVSAAALLAGFGPPPRAAETPEGLLGTTEEYFKLYERNRVHDSVMAALAWLNYIDF
IAPFYSRGCSFEAFRLWGIPQRVKKYLIAFLAYALASIALIDPDLRALAGHDLDIAIAQMLCPEIW
GDWKEDGFGEVPIKFYNIMYAAHLAAMYALYMMVTTSYRYRERLEKLIEILEKLWKWHPFGGVVCE
PDNYFVQCAAVMHWAWRLFDWLHGTRKDMAKRDYRRFIRDGLINEDKGSFYLSYHPESGAVKPWLS
AYATAWALAFHHGMFPEFAREFYPRFKDTFVEVTNNGKKARVWETIGTTDADGGVGLAALFALLLA
REMGDKELFTWLLRYLEPPARPIIVSAILFFINPLSLLFPALLLWAWVHTGHENLEKMPPPAAKLA
GK
>INV.0187
MMRFTLKTTAIVSAAALLAGFGPPPRAAETPEELMATTEEYFKEYERNRVTPWVMYLLAWWNYIDF
IAEFYSRGCSFEYFWLMGVPQRVVKYALAFAAYGLASVALIWPALRALAGHDLDIAIALMLCPFVW
GDWTEDGFGTVPIKWGNIMYAAHLLAMYALYMLVTTSYRYRERMEKLWKIMMELFRRHPFGGVTCE
PDNYFVQCAAVMFFAWKLFDALHGTNGDRAMELYFKFIEDGLIWPDWGAFFLSYHPESGAVKPWVS
AYATAWALAFHHGMWPEFARKYYPRFVRTFVEVTNGGKKARVRETWGTTDPNGGVGLASLFALLLA
REMGDKDLFAWLLRYLEPPARPITVSAIGFYINPLSLLFHHLLFWAFVHTGHEMLIRMPPPAAKLA
GK
>INV.0188
MMRFTLKTTAIVSAAALLAGFGPPPRAAEDPDGLLGTTEEYFKLYEWNRVHDSVMAMLAWLNYIDF
IAAFYSRGCSFEYWWIMGVPQRVVKYSIAFLAYGLASVALIWPNLRALAGHDLDIAIALMLCPYVW
GDWKEDGFGEDPIEWGNIMYAAHLLAMYALYMFVTTSERYRERMEELWRRMILLFRWHPFAGVFCE
PDNYFVQCVAVMAFAWKLFDGLHGTNGDYFSGNIRDFIKDGLINEDKGAFYLSYHPESGAVKPWLS
AYTTAWALAFFHGLDPSFAREFYPRFKNTFVEVFNGGDKARVRETIGTTDPNGGVGLASLFALLLA
REMGDKDLFRWLLRYLEPPANPIIVSATLYFINPLSLLFHELLFFAWVHTGFLNLILMPPPAAKLA
GK
>INV.0189
MMRFTLKTTAIVSAAALLAGFGPPPRAAETPEELLGTVEEFFKEYEENRVHDSVMAAIAWWNYIDF
IALFYSRGCSFEYFRLMGVPQRVKKYALAFAAYALASIALIWPNLRALAGHDLDIAIALMLCPEVW
GDWKEDGFGEVPIEWGNIMYSAHLAAMYALYMLVTDSDRYRERAKELGERHMEEFRRHPVGGAPCE

Appendix 3

```
PDNYFVQCQAVMHMAWKLFDFLFGWNWDRSSGDWLRFIQDGLINPDKGSFYLSYHRESGAVKPWLS
AYATAWALAIIHGMDPAFARQYAPRFWRTFGEVFNGGDKARVWETIGTTDANGGVGLASLFALVLA
RELGYKEWFGWLLRFLEPPARPIIVSAILFFINPLSLLFHHLLAWAWVHTGWLMLILMPPPAAKLA
GK
>INV.0190
MMRFTLKTTAIVSAAALLAGFGPPPRAAEDPDGLLATTEEYFKEYERNEVTPDVMAALAWFNYIDF
IALFYSRGCSFEWFWLMGVPQRVVKYALAFAAYGLASVALIWPNLRALAGHDLDIAIALMLCPYVW
GDWTEDGFGTVPIERYNIMYSAHLLAMYGLYELVTTSERYRERREELRERHIELWRRHPFGGVMCE
PDNYFVQCAAVMWMAWKIADVLDGENRDYFNGRDREFIEDGLIHEEWGAFYLSYHPESGAVKPWIS
AYTTAWALAVFHGMDPSFARKYYPRFVETFVVVFNGGDKARVRETWGTTDPNGGVGLASLFALVLA
REMGDKDLFAWLLRFLEPPARPIIVSAILYYIGPLSLLFPMLLFWAKVHTGWENLLKMPPPAAKLA
GK
>INV.0191
MMRFTLKTTAIVSAAALLAGFGPPPRAAETPEELLGTTDEFFKLYEENRVHDSVMALLAWWNYIDF
IALFYSRGCSFEYHWLMGVPQRVVKYALAFAAYALASIALIWPNLRALAGHDLDIAIALMLCPFVW
GDWKEDGFGEVPIEWGNIMYSAHLLAMYGLYMLVTTSYRYRERFEELWRRHQELWQRHPFGGVTCE
PDNFFVQCAAVMWFAWKIWDVLHGGNGDHFDRRDREFIEDGLIDPDRGAFYLSYHPESGAVKPWLS
AYTTAWALAFFHGLDPSFARKYYPRFVRTFVEVTNNGKKARVWETIGTTDPNGGVGLASLFALLLA
REMGDKNLFAWLLRYLEPPARPIIVSATLYFIGPLSLLFHFLLGFAWVHTGFENLLKMPPPAAKLA
GK
>INV.0192
MMRFTLKTTAIVSAAALLAGFGPPPRAAETPEGLLGRTEEFFREYRRNRVHDSVMAAIAWLNYIDF
IAAFYSRGCSFEFWWLQGVPQRVVKYSIAFLAYALASIALIWPNLRALAGHDLDIAIALMLCPFVW
GDWKEDGFGEVPYEWGNIMWAAHALAMYALYMLVTDSERYRERMEELWRRMMELAKRHPVGGVFCE
PDNFFVQCMAVMYFAWALFDELHGTNGDMAMGDFFRFILDGLIDPDRGSFYLSYHRESGAVKPWLS
AYTTAWALAFIHGMWPELARKYYPRFVRTFVEVTNGGRKARVWETIGTTDPDGGVGLAALFALLLA
REMGDMDLFRWLLRYLEPPANPIIVSAILFYDGPLSLLFWELLLFAKVHTGFENLRRMPPPAAKLA
GK
>INV.0193
MMRFTLKTTAIVSAAALLAGFGPPPRAAETPEGRLATTEEFFKEREKNRVTPAVMALLAWWNYIDF
IAEFYSRGCSFEYFWLMGVPQRVVKYALAFAAYALASIAIIWPNLRALAGHDLDIAIALMLCPFVW
GDWKEDGFGEHPLEWGNIMYAAHLLAMYALYMMVTTSDRYRDRAELLRDWVERLIRRHPFGGITCE
PDNYFVQCAAVAYMALKFMDWLHGENKDYSSGNWLEFIRDGLIDPSRGSFYLSYHPESGAVKPWLS
AYATAWALAVIHGMDPSFAREFYPRFVRTFVEVFNGGKKARVWETIGTTDADGGVGLAALFALVLA
REMGDKDLFAWLERYLVEPARPIIVSAILFFINPLSLLFHHLWGWAAVHTGFEQLRRMPPPAAKLA
GK
>INV.0194
MMRFTLKTTAIVSAAALLAGFGPPPRAAETPEELLSTTEEEFKELERNRVSPAVMAMLAWWNYIDF
IAPFYSRGCSFEAWWLWGVPQRVVKYSIAFMAYALASIAIIWPALRALAGHDLDIAIALMLCPYVW
GDWKEDGFGTVPIEWGNIMYAAHLALMYGLYMMVTTSYRYRERFEELARRLYELIMRHPFGGVFCE
PDNYFVQCAAVMYMALKAFDWLHGTNYDLAMGDWLRFIQDGLIHPEWGAFFLSYHPESGAVKPWIS
AYTTAWALAIIHGLWPLFARWYYPRFVETFVEFFNNGDKARVWETWGTTDPNGGVGLAALFALVLA
REMGDKDLFTFLRRYLEPPARPIIVSAILFFINPLSLLFHDLLAWAWVHTGWEQILKMPPPAAKLA
GK
>INV.0195
MMRFTLKTTAIVSAAALLAGFGPPPRAAELPPGRLATTEDYFAAQAKQAVTPDIMAQLAYLNYIDF
ISPFYSRGCSFEAWELKHTPQRVIKYSLAFLGYGLAAVALIDPKLRALAGHDLDIAISKMKCKRVW
GDWEEDGFGTDPIEKENIMYSAHLALLYGLYQLVTGSRRYEAEFAHLIRIHHDEIAANPFAGVVCE
PDNYFVQCAAVMYMALWVYDRLHGTDYRASTRAWLDFIQKDLIDPERGAFYLSYHPESGAVKPWIS
AYTTAWALAVIHGMDPAFAERYYPRFKQTFVEVYDEGRKARVRETAGTDDADGGVGLASLFALVLA
REMGDQQLFDQLLNHLEPPAKPSIVSASLRYEHPGSLLFDELLFWAKVHAGWGALLRMPPPAAKLA
GK
>INV.0196
```

Appendix 3

```
MMRFTLKTTAIVSAAALLAGFGPPPRAAELPPGRLATTEDYFAEQAKQAVTPDVMAQLAYHNYIDF
ISPFYSRGCSFEAWELKHTPQRVIKYSIAFMAYGLAAVALIDPKLRALAGHDLDIAISKMKCKRVW
GDWEEDGFGTDPIEKENIMYAAHLAAMYGLYQLVTGSRRYEAEFAHLIRILHDEIAANPFAGVVCE
PDNYFVQCAAVMFFALWVYDRLHGTDYRASTRAWLDFIQKDLIDPERGAFYLSYHPESGAVKPWIS
AYTTAWALAFIHGMDPAFAERYYPRWKQTFVEVYDEGRKARVRETAGTDDADGGVGLASLFGLLLA
REMGDQQLFDQLLNHLEPPAKPSIVSASLRYEHPGSLLFDELLFWAKVHAGHGALLRMPPPAAKLA
GK
>INV.0197
MMRFTLKTTAIVSAAALLAGFGPPPRAAELPPGRLATTEDYFAEQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYAAHLAAMYGLYQLVTGSRRYEAEFAHLIRILHDEIAANPFAGVVCE
PDNYFVQCAAVMYFALWIYDRLHGTDYRAATRAWLDFIQKDLIDPERGAFYLSYHPESGAVKPWIS
AYTTAWALAFIHGMDPAFAERYYPRFKQTFVEVYDEGRKARVRETAGTDDADGGVGLAALFALLLA
REMGDQQLFDQLLNHLEPPAKPSIVSASLRYEHPGSLLFDELLFWAKVHAGHGALLRMPPPAAKLA
GK
>INV.0198
MMRFTLKTTAIVSAAALLAGFGPPPRAAELPPGRLATTEDYFAEQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYAAHLLAMYALYQLVTGSRRYEAEMAHLARIMHDEIAANPFAGVVCE
PDNYFVQCAAVMFFALWLYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASLFALLLA
REMGDQQLFDQLLNHLEPPAKPSIVSASLRYEHPGSLLFDELLFFAKVHAGFGALLRMPPPAAKLA
GK
>INV.0199
MMRFTLKTTAIVSAAALLAGFGPPPRAAELPPGRLATTEDYFAEQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYSAHLAAMYGLYQLVTGSRRYEAEFAHLIRIHHDEIAANPFAGVVCE
PDNYFVQCAAVMYFALWIYDRLHGTDYRASTRAWLDFIQKDLIDPERGAFYLSYHPESGAVKPWIS
AYATAWALAFIHGMDPAFAERYYPRFKQTFVEVYDEGRKARVRETAGTDDADGGVGLAALFALLLA
REMGDQQLFDQLLNHLEPPAKPSIVSASLRYEHPGSLLFDELLFWAKVHAGHGALLRMPPPAAKLA
GK
>INV.0200
MMRFTLKTTAIVSAAALLAGFGPPPRAAELPPGRLATTEDYFAEQAKQAVTPDVMAQLAYLNYIDF
ISPFYSRGCSFEAWELKHTPQRVIKYSIAFLAYGLAAVALIDPKLRALAGHDLDIAISKAKCKRVW
GDWEEDGFGTDPIEKENIMYSAHLALMYGLYQLVTGSRRYEAEFAHLIRIHHDEIAANPFAGVVCE
PDNYFVQCAAVMYMALWVYDRLHGTDYRASTRAWLDFIQKDLIDPERGAFYLSYHPESGAVKPWIS
AYATAWALAIIHGMDPAFAERYYPRFKQTFVEVYDEGRKARVRETAGTDDADGGVGLAALFALVLA
REMGDQQLFDQLLNHLEPPAKPSIVSASLRYEHPGSLLFDELLFWAKVHAGWGALLRMPPPAAKLA
GK
>INV.0201
MMRFTLKTTAIVSAAALLAGFGPPPRAAELPPGRLATTEDYFAEQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYAAHLAAMYGLYQLVTGSRRYEAEFAHLIRILHDEIAANPFAGVVCE
PDNFFVQCAAVMFFALWVYDRLHGTDYRAFTRAFLDFIQKDLIDPERGAFYLSYHPESGAVKPWIS
AYATAWALAFFHGMDPAFAERYYPRFKQTFVEVYDEGRKARVRETAGTDDADGGVGLAALFALLLA
REMGDQQLFDQLLNHLEPPAKPSIVSASLRYEHPGSLLFDELLFWAKVHAGHGALLRMPPPAAKLA
GK
>INV.0202
MMRFTLKTTAIVSAAALLAGFGPPPRAAELPPGRLATTEDYFAEQAKQAVTPDVMAQLAYLNYIDF
ISPFYSRGCSFEAWELKHTPQRVIKYSIAFLAYALAAVALIDPKLRALAGHDLDIAISKAKCKRVW
GDWEEDGFGTDPIEKENIMYSAHLAAMYGLYQLVTGSRRYEAEFAHLIRIHHDEIAANPFAGVVCE
PDNYFVQCAAVMYFALWIYDRLHGTDYRAATRAWLDFIQKDLIDPERGAFYLSYHPESGAVKPWIS
AYTTAWALAFIHGMDPAFAERYYPRFKQTFVEVYDEGRKARVRETAGTDDADGGVGLASLFALLLA
```

Appendix 3

```
REMGDQQLFDQLLNHLEPPAKPSIVSASLRYEHPGSLLFDELLFWAKVHAGHGALLRMPPPAAKLA
GK
>INV.0203
MMRFTLKTTAIVSAAALLAGFGPPPRAAELPPGRLATTEDYFAEQAKQAVTPDVMAQLAYHNYIDF
ISPFYSRGCSFEAWELKHTPQRVIKYSIAFMAYGLAAVALIDPKLRALAGHDLDIAISKMKCKRVW
GDWEEDGFGTDPIEKENIMYAAHLAAMYGLYQLVTGSRRYEAEFAHLIRILHDEIAANPFAGVVCE
PDNFFVQCAAVMFFALWIYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASLFALLLA
REMGDQQLFDQLLNHLEPPAKPSIVSASLRYEHPGSLLFDELLFFAKVHAGFGALLRMPPPAAKLA
GK
>INV.0204
MMRFTLKTTAIVSAAALLAGFGPPPRAAELPPGRLATTEDYFAEQAKQAVTPAVMAQLAYWNYIDF
IAPFYSRGCSFEAWELKHTPQRVIKYSLAFQGYALAAIALIWPKLRALAGHDLDIAISLMKCKRVW
GDWEEDGFGTDPIEKENIMYAAHLAALYALYQMVTGSRRYEAELRHLIRILHDEIAANPFAGVVCE
PDNYFVQCAAVMFFALWAYDRLHGTDYRAFTRAYKDFIQKDLIDPERGAFYLSYHPESGAVKPWIS
AYATAWALAFHHGMDPAFAERFYPRFKQTFVEVYDEGRKARVRETAGTDDADGGVGLAALFALLLA
REMGDQQLFDQLANHLVPPAKPSIVSARLRYEHPGSLLFDDLLAFAWVHAGFEALLRMPPPAAKLA
GK
>INV.0205
MMRFTLKTTAIVSAAALLAGFGPPPRAAELPPGRLATTEDFFAEQAKQAVTPAVMAQLAYLNYIDF
IAPFYSRGCSFEAWELKHTPQRVIKYSLAFLGYALAAVALIWPKLRALAGHDLDIVISLMKCKRVW
GDWEEDGFGTDPIEKENIMYSAHLAALYGLYQLVTGSRRYEAEFEHLIRIHHDEIAANPFAGVVCE
PDNYFVQCAAVMFFALWIYDRLHGTDYRAFTRAYRDFIQKDLIDPERGAFYLSYHPESGAVKPWIS
AYATAWALAFHHGMDPAFAERYYPRWKQTFVEVYDEGRKARVRETAGTDDADGGVGLASLFGLLLA
REMGDQQLFDQLANHLVPPAKPSIVSARLRYEHPGSLLFDDLLFWAWVHAGHEALLRMPPPAAKLA
GK
>INV.0206
MMRFTLKTTAIVSAAALLAGFGPPPRAAELPPGRLATTEDYFAEQAKQAVTPAVMAQLAYLNYIDF
IAPFYSRGCSFEAWELKHTPQRVIKYSLAFLAYALAAVALIWPKLRALAGHDLDIAISLMKCKRVW
GDWEEDGFGTDPIEKENIMYAAHLAAMYGLYQLVTGSRRYEAEHRHLTRILHDEIAANPFAGVVCE
PDNYFVQCAAVMFFALWIYDRLHGTDYRAFTRAYRDFIQKDLIDPERGAFYLSYHPESGAVKPWIS
AYTTAWALAFHHGMDPAFAERYYPRFKQTFVEVYDEGRKARVRETAGTDDADGGVGLASLFALVLA
REMGDQQLFDQLANHLVPPAKPSIVSAILRYEHPGSLLFDDLLFWAWVHAGHEALLRMPPPAAKLA
GK
>INV.0207
MMRFTLKTTAIVSAAALLAGFGPPPRAAELPPGRLATTEDFFAEQAKQAVTPAVMAGLAYWNYIDF
IAPFYSRGCSFEAWELKHTPQRVIKYSIAFMAYALAAIALIWPKLRALAGHDLDIAISLMKCKRVW
GDWEEDGFGTDPIEKENIMYSAHLAAMYALYQLVTGSRRYEAELRHLIRIHHDEIAANPFAGVVCE
PDNFFVQCAAVMYFALWLYDRLHGTDYRAFTRAFRDFIQKDLIDPERGAFYLSYHPESGAVKPWIS
AYATAWALAFHHGMDPAFAERYYPRFKQTFVEVYDEGRKARVRETAGTDDADGGVGLAALFALVLA
REMGDQQLFDQLANHLVPPAKPSIVSARLRYEHPGSLLFDDLLMWAWVHAGHEALLRMPPPAAKLA
GK
>INV.0208
MMRFTLKTTAIVSAAALLAGFGPPPRAAELPPGRLATTEDFFAEQAKQAVTPAVMAQLAYLNYIDF
IAPFYSRGCSFEAWELKHTPQRVIKYSLAFLAYGLAAVALIWPKLRALAGHDLDIAISLMKCKRVW
GDWEEDGFGTDPIEKENIMYAAHLAAMYGLYQLVTGSRRYEAEFEHLIRILHDEIAANPFAGVVCE
PDNYFVQCAAVMFFALWIYDRLHGTDYRAFTRAYRDFIQKDLIDPERGAFYLSYHPESGAVKPWIS
AYTTAWALAFHHGMDPAFAERYYPRFKQTFVEVYDEGRKARVRETAGTDDADGGVGLAALFALVLA
REMGDQQLFDQLANHLVPPAKPSIVSAELRYEHPGSLLFDDLLFWAWVHAGHEALLRMPPPAAKLA
GK
>INV.0209
MMRFTLKTTAIVSAAALLAGFGPPPRAAELPPGRLATTEDFFAEQAKQAVTPAVMAQIAYWNYIDF
IAPFYSRGCSFEAWELKHTPQRVIKYSLAFQAYALAAIALIWPKLRALAGHDLDIAISLMKCKRVW
GDWEEDGFGTDPIEKENIMYAAHLAAMYGLYQLVTGSRRYEAEFEHLIRILHDEIAANPFAGVVCE
```

Appendix 3

```
PDNYFVQCAAVMYFALWVYDRLHGTDYRAFTRAYRDFIQKDLIDPERGAFYLSYHPESGAVKPWIS
AYATAWALAFHHGMDPAFAERYYPRFKQTFVEVYDEGRKARVRETAGTDDADGGVGLASLFALLLA
REMGDQQLFDQLANHLVPPAKPSIVSAILRYEHPGSLLFDDLLAFAWVHAGFEALLRMPPPAAKLA
GK
>INV.0210
MMRFTLKTTAIVSAAALLAGFGPPPRAAELPPGRLATTEDYFAEQAKQAVTPDVMAQLAYLNYIDF
IAPFYSRGCSFEAWELKHTPQRVIKYSLAFLAYALAAVALIWPKLRALAGHDLDIAISLMKCKRVW
GDWEEDGFGTDPIEKENIMYAAHLAAMYALYQMVTGSRRYEAELRHLIRILHDEIAANPFAGVVCE
PDNFFVQCAAVMFFALWAYDRLHGTDYRASTRAWLDFIQKDLIDPERGAFYLSYHPESGAVKPWIS
AYMTAWALAFIHGMDPAFAERYYPRFKQTFVEVYDEGRKARVRETAGTDDADGGVGLASLFALLLA
REMGDQQLFDQLANHLVPPAKPSIVSAILRYEHPGSLLFDDLLFFAFVHAGFEALLRMPPPAAKLA
GK
>INV.0211
MMRFTLKTTAIVSAAALLAGFGPPPRAAELPPGRLATTEDFFAEQAKQAVTPAVMAQLAYLNYIDF
IAPFYSRGCSFEAWELKHTPQRVIKYSLAFLGYALAAVALIWPKLRALAGHDLDIAISLMKCKRVW
GDWEEDGFGTDPIEKENIMYSAHLLLLYALYQMVTGSRRYEAEMEHLARIHHDEIAANPFAGVVCE
PDNFFVQCAAVMFMALWAYDRLHGTDYRAFTRAFRDFIQKDLIDPERGAFYLSYHPESGAVKPWIS
AYTTAWALAIFHGMDPAFAERYYPRFKQTFVEVYDEGRKARVRETAGTDDADGGVGLAALFALVLA
REMGDQQLFDQLANHLVPPAKPSIVSAILRYEHPGSLLFDDLLFWAWVHAGWEALLRMPPPAAKLA
GK
>INV.0212
MMRFTLKTTAIVSAAALLAGFGPPPRAAELPPGRLATTEDYFAEQAKQAVTPAVMAQLAYLNYIDF
IAPFYSRGCSFEAWELKHTPQRVIKYSLAFLAYGLAAVALIWPKLRALAGHDLDIAISLMKCKRVW
GDWEEDGFGTDPIEKENIMYAAHLALMYGLYQLVTGSRRYEAEFEHLIRILHDEIAANPFAGVVCE
PDNFFVQCAAVMFMALWVYDRLHGTDYRAFTRAFRDFIQKDLIDPERGAFYLSYHPESGAVKPWIS
AYATAWALAVFHGMDPAFAERYYPRFKQTFVEVYDEGRKARVRETAGTDDADGGVGLASLFALVLA
REMGDQQLFDQLANHLVPPAKPSIVSARLRYEHPGSLLFDDLLFWAWVHAGWEALLRMPPPAAKLA
GK
>INV.0213
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0214
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0215
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMAYGLASVALIDPKLRALACHDLDIAISKMKCKRVW
GDWEEDGFGTDPIEKENIMYKAHLALMYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0216
```

Appendix 3

```
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSLAFMGYGLASVALIDPKLRALAGHDLDIAISKMKCKRVW
GDWEEDGFGTDPIEKENIMYKAHLALLYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0217
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLASVALIDPKLRALAGHDLDIAISKMKCKRVW
GDWEEDGFGTDPIEKENIMYKAHLALLYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0218
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0219
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0220
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMGYGLASVALIDPKLRALAGHDLDIAISKMKCKRVW
GDWEEDGFGTDPIEKENIMYKAHLALLYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0221
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNAVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0222
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
```

Appendix 3

```
REMGDQQLFDQLLNHLEPPAKPSIVSASLRYEHPGSLLFDELLFLAKVHAGFGALLRMPPPAAKLA
GK
>INV.0223
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLASVALIDPKLRALAGHDLDIAISKMKCKRVW
GDWEEDGFGTDPIEKENIMYKAHLALLYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0224
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMGYGLASVALIDPKLRALAGHDLDIAISKMKCKRVW
GDWEEDGFGTDPIEKENIMYKAHLALLYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0225
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0226
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLMNHLEPPAKPSIVSASLRYEHPGSLLFDELLFLAKVHAGFGALLRMPPPAAKLA
GK
>INV.0227
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLASVALIDPKLRALAGHDLDIAISKMKCKRVW
GDWEEDGFGTDPIEKENIMYKAHLALLYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0228
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0229
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
```

Appendix 3

```
PDNYFVQCNSVAYLALWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0230
MMRFTLKTTAIVSAAALLAGFGPPPRAAELPPGRLATTEDYFAQQAKQAVTPDVMAQLAYHNYIDF
ISPFYSRGCSFEAWELKHTPQRVIKYSIAFMAYGLASVALIDPKLRALAGHDLDIAISKMKCKRVW
GDWEEDGFGTDPIEKENIMYKAHLALMYGLYQLVTGSRRYEAEHAHLIRIIHDEIAANPFAGIVCE
PDNYFVQCNSVAYLALWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0245
MMRFTLKTTAIVSAAALLAGFGPPPRAAEVPAGRLATTEEYFAQEARQSVTPDVMAALAFLNYIDF
IAPFYSRGCSFEAWELLHTPQRVIKYSIAFLAYGLASVALIDPSLRALAGHDLDIAISKMLCPKVW
GDWKEDGFGTDPIERENIMYKGHLNLMYALYEMVTDSRRYEEKHRLLTRIILEEIERNPFGGIVCE
PDNYFVQCNSVAYLSLAAYDVLHGTNYRRALEEWLKFIEKGLIDPDKGAFYLSYHPESGAVKPWIS
AYATAWALAFIHGLLPEFARKYYPRFKRTFVEVYNKGEKARVRETEGTDDADGGVGLASAFALLLA
REMGDKDLFERLLRHLEPPAEPEIVSAALRYRKPESLLFHELLFLAKVHTGFGALLRMPPPAAKLA
GK
>INV.0246
MMRFTLKTTAIVSAAALLAGFGPPPRAAEVPAGRLATTEEYFAQEARQSVTPDVMAELAFLNYIDF
IAPFYSRGCSFEAWELLHTPQRVIKYSIAFLAYALASVALIDPSLRALAGHDLDIAISKMLCPKVW
GDWREDGFGTDPIERENIMYKGHLNLMYGLYELVTDSRRYEEKHKLLTKIIAEEIERNPFGGIVCE
PDNYFVQCNSVAYLSLAVYDALHGTNYRRALEEWLKFIEKGLIDPDRGAFYLSYHPESGAVKPWLS
AYTTAWALAFIHGLLPEFARKYYPRFKRTFVEVYNKGEKARVRETVGTDDANGGVGLASAFALLLA
REMGDKDLFERLLRHLEPPAEPEIVSASLRYRKPESLLFHELLFLAKVHTGFGALLKMPPPAAKLA
GK
>INV.0247
MMRFTLKTTAIVSAAALLAGFGPPPRAAEVPAGRLATTEEYFAQKARQSVSPDVMAELAFLNYIDF
IAPFYSRGCSFEAWELLHTPQRVIKYSLAFLAYGLASVALIDPSLRALAGHDLDIAISKMLCKKVW
GDWEEDGFGTDPIKRENIMYKGHLNLMYALYAMVTDSTRYKEKHKLLTEIIYEEIERNPFGGIVCE
PDNYFVQCNSVAYLSLAAYDALHGTNYRRALERWLEFIQKGLIDPDDGAFYLSYHPESGAVKPWIS
AYTTAWALAFIHGLLPEFARQYYPRFKRTFVEVYNDGEKARVRETKGTDDANGGVGLASAFALLLA
REMGDKDLFERLLRHLEPPAEPEIVSASLRYRKPESLLFHELLFLAKVHTGFGALLRMPPPAAKLA
GK
>INV.0248
MMRFTLKTTAIVSAAALLAGFGPPPRAAEVPAGRLATTEEYFAQKARQAVTPDVMAELAFLNYIDF
IAPFYSRGCSFEAWELLHTPQRVIKYSLAFLAYGLASVALIDPKLRALAGHDLDIAISKMLCPKVW
GDWKEDGFGTDPIKRENIMYKGHLNAMYGLYELVTDSRRYEEKHRLLTKIIYEEIERNPFGGIVCE
PDNYFVQCNSVAYLSLVLYDALHGTNYRRAVEEWLKFIEKGLIDPDRGAFYLSYHPESGAVKPWIS
AYATAWALAFIHGMDPSFARKYYPRFKRTFVEVYNDGEKARVRETAGTDDANGGVGLASAFALLLA
REMGDKELFARLLRHLEPPAEPEIVSASLRYRKPESLLFHELLFLAKVHTGFGALVRMPPPAAKLA
GK
>INV.0249
MMRFTLKTTAIVSAAALLAGFGPPPRAAEVPAGRLATTEEYFAQEAKQAVTPDVMAELAFLNYIDF
IAPFYSRGCSFEAWELLHTPQRVIKYSIAFYAYGLASVALIDPKLRALAGHDLDIAISKMLCPKVW
GDWKEDGFGTDPIERENIMYKGHLNLMYGLYELVTDSRRYEEKHRLLTRIIYEEIERNPFGGIVCE
PDNYFVQCNSVAYASLVVYDVLHGTNYRKALEEWLKFIQKGLIDPDDGAFYLSYHPESGAVKPWLS
AYATAWALAFIHGMLPEFARKYYPRFKRTFVEVYNKGEKARVRETKGTDDANGGVGLASAFALLLA
REMGDKDLFERLLRHLEPPAEPEIVSAALRYRKPESLLFNALLFLAKVHTGFGALFRMPPPAAKLA
GK
>INV.0250
```

Appendix 3

```
MMRFTLKTTAIVSAAALLAGFGPPPRAAEVPAGRLATTEEYFAQEARQSVTPDVMAALAFLNYIDF
IAPFYSRGCSFEAWELLHTPQRVIKYSIAFLAYGLASVALIDPSLRALAGHDLDIAISKMLCPKVW
GDWKEDGFGTDPIARENIMYKGHLNLMYALYALVTDSTRYKEKHKLLTEIIAEEIERNPFGGIVCE
PDNYFVQCNSVAYASLVAYDVLHGTNYRRALRSWLEFIEKGLIDPDRGSFYLSYHPESGAVKPWLS
AYTTAWALAFIHGMLPEFARRYYPRFKRTFVEVYNKGEKARVRETVGTDDANGGVGLASAFALLLA
REMGDKDLFERLLRHLEPPAEPTIVSASLRYKKPESLLFHELLFLAKVHTGFGALFKMPPPAAKLA
GK
>INV.0251
MMRFTLKTTAIVSAAALLAGFGPPPRAAEVPAGRLATTEEYFAQEARQSVTPDVMAELAFLNYIDF
IAPFYSRGCSFEAWELLHTPQRVIKYSIAFLAYGLASVALIDPKLRALAGHDLDIAISKMLCPKVW
GDWKEDGFGTDPIKRENIMYKGHLNLMYALYALVTDSRRYEEKHRLLTRIIYEEIERNPFGGIVCE
PDNYFVQCNSVAYASLVAYDVLHGTNYRRALEEWLKFIQKGLIDPSRGAFYLSYHPESGAVKPWIS
AYTTAWALAFIHGMLPEFARQYYPRFKRTFVEVYNDGEKARVRETEGTDDANGGVGLASAFALLLA
REMGDKELFERLLRHLEPPAEPEIVSASLRYRRPESLLFHELLFLAKVHTGFGALFKMPPPAAKLA
GK
>INV.0252
MMRFTLKTTAIVSAAALLAGFGPPPRAAEVPAGRLATTEEYFAQKARQSVTPDVMAALAFLNYIDF
IAPFYSRGCSFEAWELLHTPQRVIKYSIAFLAYALASVALIDPSLRALAGHDLDIAISKMLCPRVW
GDWKEDGFGTDPIKRENIMYKGHLNLMYGLYELVTDSRRYEEKHKLLTKIIYEEIERNPFGGIVCE
PDNYFVQCNSVAYLSLAVYDALHGTDYRRALESWLEFIEKGLIDPSKGSFYLSYHPESGAVKPWLS
AYATAWALAFIHGLLPEFARKYYPRFKRTFVEVYNKGEKARVRETVGTDDANGGVGLASAFALLLA
REMGDKDLFERLLRHLEPPAKPKIVSASLRYEEPESLLFHELLFLAKVHTGFGALLRMPPPAAKLA
GK
>INV.0253
MMRFTLKTTAIVSAAALLAGFGPPPRAAEVPAGRLATTEDYFAQEARQSVTPDVMAELAFLNYIDF
IAPFYSRGCSFEAWELLHTPQRVIKYSIAFYAYALASVALIDPKLRALAGHDLDIAISKMLCPKVW
GDWKEDGFGTDPIKRENIMYKGHLNLMYGLYELVTDSRRYEEKHRLLTEIIYEEIERNPFGGIVCE
PDNYFVQCNSVAYASLVVYDVLHGTNYRKALERWLKFIEQGLIDPDRGSFYLSYHPESGAVKPWLS
AYTTAWALAFIHGMDPDFARKYYPRFKRTFVEVYNKGEKARVRETVGTDDANGGVGLASAFALLLA
REMGDKDLFERLLRHLEPPAEPEIVSASLRYRRPESLLFNALLFLAKVHTGFGALFKMPPPAAKLA
GK
>INV.0254
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDELLFLAKVHAGFGALLRMPPPAAKLA
GK
>INV.0255
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0256
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAFIHGMDPAFAERYYPRFKQTFVEVYDEGRKARVRETAGTDDADGGVGLAAAFALLLA
```

Appendix 3

```
REMGDQQLFDQLLNHLEPPAKPSIVSASLRYEHPGSLLFDELLFLAKVHAGFGALLRMPPPAAKLA
GK
>INV.0257
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDELLFLAKVHAGFGALLRMPPPAAKLA
GK
>INV.0258
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDELLFLAKVHAGFGALLRMPPPAAKLA
GK
>INV.0259
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLAAVALIDPKLRALAGHDLDIAISKLKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0260
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0261
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0262
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0263
MMRFTLKTTAIVSAAALLAGFGPPPRAAELPPGRLATTEDYFAQQAKQAVSPDVMAQLAYLNYIDF
IAPFYSRGCSFEAWELKHTPQRVIKYSLAFLAYGLAAVALIDPKLRALAGHDLDIAISKMKCKRVW
GDWEEDGFGTDPIEKENIMYKGHLNLMYALYQMVTGSRRYEAEHAHLTRIIHDEIAANPFAGIVCE
```

Appendix 3

```
PDNYFVQCNSVAYLSLWAYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDALLFLAKVHAGFGALLRMPPPAAKLA
GK
>INV.0264
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSLAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDELLFLAKVHAGFGALLRMPPPAAKLA
GK
>INV.0265
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSIAFLAYGLAAVALIDPKLRALAGHDLDIAISKMKCKRVW
GDWEEDGFGTDPIEKENIMYKGHLNLMYALYQMVTGSRRYEAEHAHLTRIIHDEIAANPFAGIVCE
PDNYFVQCNSVAYLSLWAYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDALLFLAKVHAGFGALLRMPPPAAKLA
GK
>INV.0266
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSIAFLAYALAAVALIDPKLRALAGHDLDIAISKMKCKRVW
GDWEEDGFGTDPIEKENIMYKGHLNLMYALYQMVTGSRRYEAEHAHLTRIIHDEIAANPFAGIVCE
PDNYFVQCNSVAYLSLWAYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDELLFLAKVHAGFGALLRMPPPAAKLA
GK
>INV.0267
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSLAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDALLFLAKVHAGFGALLRMPPPAAKLA
GK
>INV.0268
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSIAFLAYGLAAVALIDPKLRALAGHDLDIAISKMKCKRVW
GDWEEDGFGTDPIEKENIMYKGHLNLMYALYQMVTGSRRYEAEHAHLTRIIHDEIAANPFAGIVCE
PDNYFVQCNSVAYLSLWAYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDELLFLAKVHAGFGALLRMPPPAAKLA
GK
>INV.0269
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSLAFLAYGLAAVALIDPKLRALAGHDLDIAISKMKCKRVW
GDWEEDGFGTDPIEKENIMYKGHLNLMYALYQMVTGSRRYEAEHAHLTRIIHDEIAANPFAGIVCE
PDNYFVQCNSVAYLSLWAYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0270
```

Appendix 3

```
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSLAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAFIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0271
MMRFTLKTTAIVSAAALLAGFGPPPRAAELPPGRLATTEDYFAQQAKQAVTPDVMAQLAYLNYIDF
IAPFYSRGCSFEAWELKHTPQRVIKYSLAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAFIHGMDPAFAERYYPRFKQTFVEVYDEGRKARVRETAGTDDADGGVGLAAAFALLLA
REMGDQQLFDQLLNHLEPPAKPSIVSASLRYEHPGSLLFDALLFLAKVHAGFGALLRMPPPAAKLA
GK
>INV.0272
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGSFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0273
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0274
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALRMPPPAAKLA
GK
>INV.0275
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0276
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSIAFLAYALAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
```

Appendix 3

```
REMGDQQLFDQLLNHLEPPAKPSIVSASLRYEHPGSLLFDELLFLAKVHAGFGALLRMPPPAAKLA
GK
>INV.0277
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLAAVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0278
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLAAVALIDPKLRALAGHDLDIAISKLKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYTTAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0279
MMRFTLKTTAIVSAAALLAGFGPPPRAAELPPGRLATTEDYFAQQAKQAVTPDVMAQLAYLNYIDF
ISPFYSRGCSFEAWELKHTPQRVIKYSLAFLGYGLAAVALIDPKLRALAGHDLDIAISKLKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRASTRAWLDFIQKDLIDPERGAFYLSYHPESGAVKPWIS
AYATAWALAMIHGMDPAFAERYYPRFKQTFVEVYDEGRKARVRETAGTDDADGGVGLASAFALLLA
REMGDQQLFDQLLNHLEPPAKPSIVSASLRYEHPGSLLFDELLFLAKVHAGFGALLRMPPPAAKLA
GK
>INV.0280
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCPRVW
GDWEEDGFGTDPIKRENIMYKGHLNLMYGLYQLVTGSRRYEQEHALLTEIIYEEIARNPFAGIVCE
PDNYFVQCNSVAYLSLWVYDRLHGTNYAAATREWLDFIQKGLIDPSRGAFYLSYHPESGAVKPWIS
AYTTAWTLAMVHGMDPAFSRQYYPRFKRTFVEVYDEGKKARVRETAGTDDADGGVGLASAFTLLLA
REMGDKELFDQLLNHLEPPAEPSIVSASLRYKKPGSLLFDELLFLAKVHAGFGALLRMPPPAAKLA
GK
>INV.0281
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCPRVW
GDWEEDGFGTDPIKRENIMYKGHLNLMYGLYQLVTGSRRYEQEHALLTQIIYEEIARNPFAGIVCE
PDNYFVQCNSVAYLSLWVYDRLHGTNYAAATERWLDFIQKGLIDPDRGAFYLSYHPESGAVKPWIS
AYTTAWTLAMVHGMDPSFSRKYYPRFKRTFVEVYDDGKKARVRETAGTDDADGGVGLASAFTLLLA
REMGDKDLFDQLLNHLEPPAEPSIVSASLRYRRPGSLLFDELLFLAKVHAGFGALLRMPPPAAKLA
GK
>INV.0282
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCPRVW
GDWEEDGFGTDPIERENIMYKGHLNLMYGLYQLVTGSRRYEQEHALLTQIIYEEIARNPFAGIVCE
PDNYFVQCNSVAYLSLWVYDRLHGTNYAAATRRWLDFIQKGLIDPSRGAFYLSYHPESGAVKPWIS
AYTTAWTLAMVHGMDPSFSRQYYPRFKRTFVEVYDKGKKARVRETAGTDDADGGVGLASAFTLLLA
REMGDKELFDQLLNHLEPPAEPSIVSASLRYKKPGSLLFDELLFLAKVHAGFGALLRMPPPAAKLA
GK
>INV.0283
MMRFTLKTTAIVSAAALLAGFGPPPRAAELPPGRLATTDDYFAQQARQSVTPDVMAQLAYMNYIDF
ISPFYSRGCSFEAWELKHTPQRVIKYSIAFYAYGLASVALIDPSLRALAGHDLDIAVSKMKCPRVW
GDWEEDGFGTDPIERENIMYKGHLNLMYGLYQLVTGSRRYEQEHALLTQIIYEEIARNPFAGIVCE
```

Appendix 3

```
PDNYFVQCNSVAYLSLWVYDRLHGTNYAAATREWLDFIQKGLIDPSRGAFYLSYHPESGAVKPWIS
AYTTAWTLAMVHGMDPAFSREYYPRFKRTFVEVYDKGKKARVRETAGTDDADGGVGLASAFTLLLA
REMGDKELFDQLLNHLEPPAEPSIVSASLRYKKPGSLLFDELLFLAKVHAGFGALLRMPPPAAKLA
GK
>INV.0284
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCPRVW
GDWEEDGFGTDPIERENIMYKGHLNLMYGLYQLVTGSRRYEQEHALLTQIIYEEIARNPFAGIVCE
PDNYFVQCNSVAYLSLWVYDRLHGTNYAAATREWLDFIQKGLIDPSRGAFYLSYHPESGAVKPWIS
AYTTAWTLAMVHGMDPSFSRKYYPRFKRTFVEVYDDGRKARVRETAGTDDADGGVGLASAFTLLLA
REMGDKDLFDQLLNHLEPPAEPSIVSASLRYEKPGSLLFDELLFLAKVHAGFGALLRMPPPAAKLA
GK
>INV.0285
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCPKVW
GDWEEDGFGTDPIKRENIMYKGHLNLMYGLYQLVTGSRRYEQEHALLTEIIYKEIARNPFAGIVCE
PDNYFVQCNSVAYLSLWVYDRLHGTNYAAATREWLDFIQKGLIDPSRGAFYLSYHPESGAVKPWIS
AYTTAWTLAMVHGMDPSFSREYYPRFKRTFVEVYDKGKKARVRETAGTDDADGGVGLASAFTLLLA
REMGDKELFDQLLNHLEPPAEPSIVSASLRYEKPGSLLFDELLFLAKVHAGFGALLRMPPPAAKLA
GK
>INV.0286
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCKKVW
GDWEEDGFGTDPIKRENIMYKGHLNLMYGLYQLVTGSRRYEQEHALLTQIIYEEIARNPFAGIVCE
PDNYFVQCNSVAYLSLWVYDRLHGTNYAAATRRWLDFIQKGLIDPSRGAFYLSYHPESGAVKPWIS
AYTTAWTLAMVHGMDPAFSRQYYPRFKRTFVEVYDKGKKARVRETAGTDDADGGVGLASAFTLLLA
REMGDKDLFDQLLNHLEPPAEPSIVSASLRYKKPGSLLFDELLFLAKVHAGFGALLRMPPPAAKLA
GK
>INV.0287
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPSLRALAGHDLDIAVSKMKCKRVW
GDWEEDGFGTDPIKRENIMYKGHLNLMYGLYQLVTGSRRYEEEHALLTEIIYEEIARNPFAGIVCE
PDNYFVQCNSVAYLSLWVYDRLHGTNYAAATREWLDFIQKGLIDPDRGAFYLSYHPESGAVKPWIS
AYTTAWTLAMVHGMDPDFSKEYYPRFKRTFVEVYDDGKKARVRETAGTDDADGGVGLASAFTLLLA
REMGDKDLFDQLLNHLEPPAEPSIVSASLRYKKPGSLLFDELLFLAKVHAGFGALLKMPPPAAKLA
GK
>INV.0288
MMRFTLKTTAIVSAAALLAGFGPPPRAAELPPGRLATTEDYFAQQARQSVTPDVMAQLAYMNYIDF
ISPFYSRGCSFEAWELKHTPQRVIKYSIAFYAYGLASVALIDPKLRALAGHDLDIAVSKMKCPRVW
GDWEEDGFGTDPIKRENIMYKGHLNLMYGLYQLVTGSRRYEQEHALLTQIIYEEIARNPFAGIVCE
PDNYFVQCNSVAYLSLWVYDRLHGTNYAAATREWLDFIQKGLIDPSRGAFYLSYHPESGAVKPWIS
AYTTAWTLAMVHGMDPEFSRQYYPRFKKTFVEVYDKGKKARVRETAGTDDADGGVGLASAFTLLLA
REMGDKELFDQLLNHLEPPAKPSIVSASLRYEEPGSLLFDELLFLAKVHAGFGALLRMPPPAAKLA
GK
>INV.0289
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAMIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0290
```

Appendix 3

```
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0291
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLLLA
REMGDQQLFDQLLNHLEPPAKPSIVSASLRYEHPGSLLFDELLFLAKVHAGWGALLRMPPPAAKLA
GK
>INV.0292
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASIALIDPKLRALVGHDLDIAISKMKCKRVW
GDWEEDGFGTDPIEKENIMYKGHLNLMYGLYQLVTGSRRYEAEHAHLTRIIHDEIAANPWAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLWLA
REMGDQQLFDQLLNHLEPPAKPSIVSASLRYEHPGSLLFDELLFLAKVHAGWGALLRMPPPAAKLA
GK
>INV.0293
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASIALIDPKLRALVGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLLLA
REMGDQQLFDQLLNHLEPPAKPSIVSASLRYEHPGSLLFDELLFLAKVHAGWGALLRMPPPAAKLA
GK
>INV.0294
MMRFTLKTTAIVSAAALLAGFGPPPRAAELPPGRLATTEDYFAQQAKQAVTPDVMAQLAYMNYIDF
ISPFYSRGCSFEAWELKHTPQRVWKYSIAFYAYGLASIALIDPKLRALVGHDLDIAISKMKCKRVW
GDWEEDGFGTDPIEKENIMYKGHLNLMYGLYQLVTGSRRYEAEHAHLTRIIHDEIAANPWAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLWLA
REMGDQQLFDQLLNHLEPPAKPSIVSASLRYEHPGSLLFDELLFLAKVHAGWGALLRMPPPAAKLA
GK
>INV.0295
MMRFTLKTTAIVSAAALLAGFGPPPRAAELPPGRLATTEDYFAQQAKQAVTPDVMAQLAYMNYIDF
ISPFYSRGCSFEAWELKHTPQRVWKYSIAFYAYGLASIALIDPKLRALVGHDLDIAISKMKCKRVW
GDWEEDGFGTDPIEKENIMYKGHLNLMYGLYQLVTGSRRYEAEHAHLTRIIHDEIAANPWAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLWLA
REMGDQQLFDQLLNHLEPPAKPSIVSASLRYEHPGSLLFDELLFLAKVHLGWGAWLRMPPPAAKLA
GK
>INV.0296
MMRFTLKTTAIVSAAALLAGFGPPPRAAELPPGRLATTEDYFAQQAKQAVTPDVMAQLAYMNYIDF
ISPFYSRGCSFEAYELKHTPQRVWKYSIAFYAYGLASIALIDPKLRALVGHDLDIAISKMKCKRVW
GDWEEDGFGTDPIEKENIMYKGHLNLMYGLYQLVTGSRRYEAEHAHLTRIIHDEIAANPWAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLWLA
```

Appendix 3

```
REMGDQQLFDQLLNHLEPPAKPSIVSASLRYEHPGSLLFDELLFLAKVHAGWGAWLRMPPAAKLA
GK
>INV.0297
MMRFTLKTTAIVSAAALLAGFGPPPRAAELPPGRLATTEDYFAQQAKQAVTPDVMAQLAYMNYIDF
ISPFYSRGCSFEAYELKHTPQRVWKYSIAFYAYGLASIALIDPKLRALVGHDLDIAISKMKCKRVW
GDWEEDGFGTDPIEKENIMYKGHLNLMYGLYQLVTGSRRYEAEHAHLTRIIHDEIAANPWAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLWLA
REMGDQQLFDQLLNHLEPPAKPSIVSASLRYEHPGSLLFDELLFLAKVHAGWGALLRMPPPAAKLA
GK
>INV.0298
MMRFTLKTTAIVSAAALLAGFGPPPRAAELPPGRLATTEDYFAQQAKQAVTPDVMAQLAYMNYIDF
ISPFYSRGCSFEAWELKHVPQRMIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAFTLLLA
REMGDQQLFDQLLNHLEPPAKPSIVSASLRYEHPVDMGMGHDALLFLAKVHAGFGALLRMPPPAAK
LAGK
>INV.0299
MMRFTLKTTAIVSAAALLAGFGPPPRAAELPPGRLATTEDYFAQQAKQAVTPDVMAQLAYMNYIDS
ISPFYSRGCSFEAWELKHVPQRQIKLSIALYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGMGGASAWTLLLA
REMGDQQLFDQLLNHLEPPAKPSIVSASLRYEHPHDMFFDHSGLLFLAKVHAGFGALLRMPPPAAK
LAGK
>INV.0300
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPFDAWMDFSGLLFLAKVHAGFGALLRMPPPAAK
LAGK
>INV.0301
MMRFTLKTTAIVSAAALLAGFGPPPRAAELPPGRLATTEDYFAQQAKQAVTPDVMAQLAYMNYIDF
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGMGAASAFTLLLA
REMGDQQLFDQLLNHLEPPAKPSIVSASLRYEHPHDMWMNFSGLLFLAKVHAGFGALLRMPPPAAK
LAGK
>INV.0302
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIALYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMFADFSGMLFLAKVHAGFGALLRMPPPAAK
LAGK
>INV.0303
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
```

Appendix 3

```
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMMADFSGLLFLAKVHAGFGALLRMPPPAAK
LAGK
>INV.0304
MMRFTLKTTAIVSAAALLAGFGPPPRAAELPPGRLATTEDYFAQQAKQAVTPDVMAQLAYMNYIDS
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMLADFSGLLFLAKVHAGFGALLRMPPPAAK
LAGK
>INV.0305
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPHDMLADFSGMLFLAKVHAGFGALLRMPPPAAK
LAGK
>INV.0306
MMRFTLKTTAIVSAAALLAGFGPPPRAAELPPGRLATTEDYFAQQAKQAVTPDVMAQLAYMNYIDS
ISPFYSRGCSFEAWELKHVPQRVIKLSIAIYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGSASAWTLLLA
REMGDQQLFDQLLNHLEPPAKPSIVSASLRYEHPVDMYGHDALLFLAKVHAGFGALLRMPPPAAK
LAGK
>INV.0307
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPVDMLANHSGLLFLAKVHAGFGALLRMPPPAAK
LAGK
>INV.0308
MMRFTLKTTAIVSAAALLAGFGPPPRAAELPPGRLATTEDYFAQQAKQAVTPDVMAQLAYMNYIDF
ISPFYSRGCSFEAWELKHVPQRYIKYSIANYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGSASAWTLLLA
REMGDQQLFDQLLNHLEPPAKPSIVSASLRYEHPTDSHSGHDAMLFLAKVHAGFGALLRMPPPAAK
LAGK
>INV.0310
MMRFTLKTTAIVSAAALLAGFGPPPRAAELPPGRLATTEDYFAQQAKQAVTPDVMAQLAYMNYIDH
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMFGDHSGLLFLAKVHAGFGALLRMPPPAAK
LAGK
>INV.0311
```

Appendix 3

```
MMRFTLKTTAIVSAAALLAGFGPPPRAAELPPGRLATTEDYFAQQAKQAVTPDVMAQLAYMNYIDH
ISPFYSRGCSFEAWELKHVFQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAFTLLLA
REMGDQQLFDQLLNHLEPPAKPSIVSASLRYEHPVDMFGGFDALLFLAKVHAGFGALLRMPPPAAK
LAGK
>INV.0312
MMRFTLKTTAIVSAAALLAGFGPPPRAAELPPGRLATTEDYFAQQAKQAVTPDVMAQLAYMNYIDF
ISPFYSRGCSFEAWELKHVFQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGGASAFTLLLA
REMGDQQLFDQLLNHLEPPAKPSIVSASLRYEHPVDMLWGHDALLFLAKVHAGFGALLRMPPPAAK
LAGK
>INV.0313
MMRFTLKTTAIVSAAALLAGFGPPPRAAELPPGRLATTEDYFAQQAKQAVTPDVMAQLAYMNYIDH
ISPFYSRGCSFEAWELKHVFQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMLMDFSGLLFLAKVHAGFGALLRMPPPAAK
LAGK
>INV.0314
MMRFTLKTTAIVSAAALLAGFGPPPRAAELPPGRLATTEDYFAQQAKQAVTPDVMAQLAYMNYIDF
ISPFYSRGCSFEAWELKHVFQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAFTLLLA
REMGDQQLFDQLLNHLEPPAKPSIVSASLRYEHPHDMMFDFSGLLFLAKVHAGFGALLRMPPPAAK
LAGK
>INV.0315
MMRFTLKTTAIVSAAALLAGFGPPPRAAELPPGRLATTEDYFAQQAKQAVTPDVMAQLAYMNYIDF
ISPFYSRGCSFEAWELKHVFQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPFPSLYSFDALLFLAKVHAGFGALLRMPPPAAK
LAGK
>INV.0316
MMRFTLKTTAIVSAAALLAGFGPPPRAAELPPGRLATTEDYFAQQAKQAVTPDVMAQLAYMNYIDS
ISPFYSRGCSFEAWELKHVFQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPDDSWADFSGLLFLAKVHAGFGALLRMPPPAAK
LAGK
>INV.0317
MMRFTLKTTAIVSAAALLAGFGPPPRAAELPPGRLATTEDYFAQQAKQAVTPDVMAQLAYMNYIDH
ISPFYSRGCSFEAWELKHVFQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
```

Appendix 3

```
REMGDQQLFDQLLNHLEPPAKPSIVSASLRYEHPDDMFADHSGLLFLAKVHAGFGALLRMPPPAAK
LAGK
>INV.0318
MMRFTLKTTAIVSAAALLAGFGPPPRAAELPPGRLATTEDYFAQQAKQAVTPDVMAQLAYMNYIDF
ISPFYSRGCSFEAWELKHVPQRHIKYSIAIYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAWTLLLA
REMGDQQLFDQLLNHLEPPAKPSIVSASLRYEHPIDTGFGFDALLFLAKVHAGFGALLRMPPPAAK
LAGK
>INV.0319
MMRFTLKTTAIVSAAALLAGFGPPPRAAELPPGRLATTEDYFAQQAKQAVTPDVMAQLAYMNYIDF
ISPFYSRGCSFEAWELKHVPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGGASAFTLLLA
REMGDQQLFDQLLNHLEPPAKPSIVSASLRYEHPDMLHGHDALLFLAKVHAGFGALLRMPPPAAK
LAGK
>INV.0320
MMRFTLKTTAIVSAAALLAGFGPPPRAAELPPGRLATTEDYFAQQAKQAVTPDVMAQLAYMNYIDY
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGMGAASAFTLLLA
REMGDQQLFDQLLNHLEPPAKPSIVSASLRYEHPIDHGFGHDALLFLAKVHAGFGALLRMPPPAAK
LAGK
>INV.0321
MMRFTLKTTAIVSAAALLAGFGPPPRAAELPPGRLATTEDYFAQQAKQAVTPDVMAQLAYMNYIDH
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPDMFADFSGLLFLAKVHAGFGALLRMPPPAAK
LAGK
>INV.0322
MMRFTLKTTAIVSAAALLAGFGPPPRAAELPPGRLATTEDYFAQQAKQAVTPDVMAQLAYMNYIDH
ISPFYSRGCSFEAWELKHVPQRAIKHSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPDMFADFSGLLFLAKVHAGFGALLRMPPPAAK
LAGK
>INV.0323
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPDMHANHSGLLFLAKVHAGFGALLRMPPPAAK
LAGK
>INV.0324
MMRFTLKTTAIVSAAALLAGFGPPPRAAELPPGRLATTEDYFAQQAKQAVTPDVMAQLAYMNYIDY
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
```

Appendix 3

```
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPSDTFSGHDAMLFLAKVHAGFGALLRMPPPAAK
LAGK
>INV.0325
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPFPAWTNHSGMLFLAKVHAGFGALLRMPPPAAK
LAGK
>INV.0326
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPDMLASFDGMLFLAKVHAGFGALLRMPPPAAK
LAGK
>INV.0327
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPDMLAGFDALLFLAKVHAGFGALLRMPPPAAK
LAGK
>INV.0328
MMRFTLKTTAIVSAAALLAGFGPPPRAAELPPGRLATTEDYFAQQAKQAVTPDVMAQLAYMNYIDY
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPDMMASFDGLLFLAKVHAGFGALLRMPPPAAK
LAGK
>INV.0329
MMRFTLKTTAIVSAAALLAGFGPPPRAAELPPGRLATTEDYFAQQAKQAVTPDVMAQLAYMNYIDS
ISPFYSRGCSFEAWELKHVPQRVIKLMIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPDDSYHGHDALLFLAKVHAGFGALLRMPPPAAK
LAGK
>INV.0330
MMRFTLKTTAIVSAAALLAGFGPPPRAAELPPGRLATTEDYFAQQAKQAVTPDVMAQLAYMNYIDF
ISPFYSRGCSFEAWELKHVPQRHIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPVDMMASHDGMLFLAKVHAGFGALLRMPPPAAK
LAGK
>INV.0331
```

Appendix 3

```
MMRFTLKTTAIVSAAALLAGFGPPPRAAELPPGRLATTEDYFAQQAKQAVTPDVMAQLAYMNYIDH
ISPFYSRGCSFEAWELKHVPQRHIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGSGHASAFTLLLA
REMGDQQLFDQLLNHLEPPAKPSIVSASLRYEHPVADGFGHDALLFLAKVHAGFGALLRMPPPAAK
LAGK
>INV.0332
MMRFTLKTTAIVSAAALLAGFGPPPRAAELPPGRLATTEDYFAQQAKQAVTPDVMAQLAYMNYIDF
ISPFYSRGCSFEAWELKHVPQRWIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPLPMFGGFDALLFLAKVHAGFGALLRMPPPAAK
LAGK
>INV.0333
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPFPAWASFDGLLFLAKVHAGFGALLRMPPPAAK
LAGK
>INV.0334
MMRFTLKTTAIVSAAALLAGFGPPPRAAELPPGRLATTEDYFAQQAKQAVTPDVMAQLAYMNYIDH
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMFASFDGLLFLAKVHAGFGALLRMPPPAAK
LAGK
>INV.0335
MMRFTLKTTAIVSAAALLAGFGPPPRAAELPPGRLATTEDYFAQQAKQAVTPDVMAQLAYMNYIDH
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMRASFDGLLFLAKVHAGFGALLRMPPPAAK
LAGK
>INV.0336
MMRFTLKTTAIVSAAALLAGFGPPPRAAELPPGRLATTEDYFAQQAKQAVTPDVMAQLAYMNYIDH
ISPFYSRGCSFEAWELKHVPQRAIKHSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMFASFDGLLFLAKVHAGFGALLRMPPPAAK
LAGK
>INV.0337
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
```

REMGDQQLFDQLLNHLEPPAKPSIVSASLRYEHPHDMMASHDGMLFLAKVHAGFGALLRMPPPAAK
LAGK
>INV.0338
MMRFTLKTTAIVSAAALLAGFGPPPRAAELPPGRLATTEDYFAQQAKQAVTPDVMAQLAYMNYIDY
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMFASFDGLLFLAKVHAGFGALLRMPPPAAK
LAGK
>INV.0339
MMRFTLKTTAIVSAAALLAGFGPPPRAAELPPGRLATTEDYFAQQAKQAVTPDVMAQLAYMNYIDY
ISPFYSRGCSFEAWELKHVPQRAIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPHDMLMSFDGLLFLAKVHAGFGALLRMPPPAAK
LAGK
>INV.0340
MMRFTLKTTAIVSAAALLAGFGPPPRAAELPPGRLATTEDYFAQQAKQAVTPDVMAQLAYMNYIDF
ISPFYSRGCSFEAWELKHVPQRWIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPDYRSYSHDGLLFLAKVHAGFGALLRMPPPAAK
LAGK
>INV.0341
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAFTLLLA
REMGDQQLFDQLLNHLEPPAKPSIVSASLRYEHPHDMFMDHGLLFLAKVHAGFGALLRMPPPAAK
LAGK
>INV.0342
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPQNMWMGFDALLFLAKVHAGFGALLRMPPPAAK
LAGK
>INV.0343
MMRFTLKTTAIVSAAALLAGFGPPPRAAELPPGRLATTEDYFAQQAKQAVTPDVMAQLAYMNYIDH
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPDDMLASHDGLLFLAKVHAGFGALLRMPPPAAK
LAGK
>INV.0344
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIALYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE

Appendix 3

```
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAFTLLLA
REMGDQQLFDQLLNHLEPPAKPSIVSASLRYEHPLDHGFGHDALLFLAKVHAGFGALLRMPPPAAK
LAGK
>INV.0345
MMRFTLKTTAIVSAAALLAGFGPPPRAAELPPGRLATTEDYFAQQAKQAVTPDVMAQLAYMNYIDF
ISPFYSRGCSFEAWELKHVPQRAIKFSIAIYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAWTLLLA
REMGDQQLFDQLLNHLEPPAKPSIVSASLRYEHPQDMFFGFDALLFLAKVHAGFGALLRMPPPAAK
LAGK
>INV.0346
MMRFTLKTTAIVSAAALLAGFGPPPRAAELPPGRLATTEDYFAQQAKQAVTPDVMAQLAYMNYIDS
ISPFYSRGCSFEAWELKHVPQRIIKFSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPVIWLFSFDALLFLAKVHAGFGALLRMPPPAAK
LAGK
>INV.0347
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPVDMLAGHDAMLFLAKVHAGFGALLRMPPPAAK
LAGK
>INV.0348
MMRFTLKTTAIVSAAALLAGFGPPPRAAELPPGRLATTEDYFAQQAKQAVTPDVMAQLAYMNYIDF
ISPFYSRGCSFEAWELKHVPQRAIKASIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPQDMWASHDGMLFLAKVHAGFGALLRMPPPAAK
LAGK
>INV.0349
MMRFTLKTTAIVSAAALLAGFGPPPRAAELPPGRLATTEDYFAQQAKQAVTPDVMAQLAYMNYIDF
ISPFYSRGCSFEAWELKHVPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPHPENRGHDALLFLAKVHAGFGALLRMPPPAAK
LAGK
>INV.0350
MMRFTLKTTAIVSAAALLAGFGPPPRAAELPPGRLATTEDYFAQQAKQAVTPDVMAQLAYMNYIDF
ISPFYSRGCSFEAWELKHIPQRIIKLMIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPVDDNHGHDALLFLAKVHAGFGALLRMPPPAAK
LAGK
>INV.0351
```

Appendix 3

```
MMRFTLKTTAIVSAAALLAGFGPPPRAAELPPGRLATTEDYFAQQAKQAVTPDVMAQLAYMNYIDF
ISPFYSRGCSFEAWELKHVPQRAIKISIALYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPVDMFASHDGMLFLAKVHAGFGALLRMPPPAAK
LAGK
>INV.0352
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHPHDMLAGFDALLFLAKVHAGFGALLRMPPPAAK
LAGK
>INV.0353
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPQDMFAPHDGLLFLAKVHAGFGALLRMPPPAAK
LAGK
>INV.0354
MMRFTLKTTAIVSAAALLAGFGPPPRAAELPPGRLATTEDYFAQQAKQAVTPDVMAQLAYMNYIDY
ISPFYSRGCSFEAWELKHVPQRVIKFMIAIYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGGASAWTLLLA
REMGDQQLFDQLLNHLEPPAKPSIVSASLRYEHPHDEGFGHDALLFLAKVHAGFGALLRMPPPAAK
LAGK
>INV.0355
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGLASAFTLLLA
REMGDQQLFDQLLNHLEPPAKPSIVSASLRYEHPLGGVGGTFSGLLFLAKVHAGFGALLRMPPPAA
KLAGK
>INV.0356
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGLASAFTLLLA
REMGDQQLFDQLLNHLEPPAKPSIVSASLRYEHPHAGLWGNFSGLLFLAKVHAGFGALLRMPPPAA
KLAGK
>INV.0357
MMRFTLKTTAIVSAAALLAGFGPPPRAAELPPGRLATTEDYFAQQAKQAVTPDVMAQLAYMNYIDF
ISPFYSRGCSFEAWELKHVPQRVIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGLASAFTLLLA
```

Appendix 3

```
REMGDQQLFDQLLNHLEPPAKPSIVSASLRYEHPLGGRGGDFSGLLFLAKVHAGFGALLRMPPPAA
KLAGK
>INV.0358
MMRFTLKTTAIVSAAALLAGFGPPPRAAELPPGRLATTEDYFAQQAKQAVTPDVMAQLAYMNYIDS
ISPFYSRGCSFEAWELKHVPQRVIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGLASAFTLLLA
REMGDQQLFDQLLNHLEPPAKPSIVSASLRYEHPYRGGMGDFSGLLFLAKVHAGFGALLRMPPPAA
KLAGK
>INV.0359
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGLASAFTLLLA
REMGDQQLFDQLLNHLEPPAKPSIVSASLRYEHPVGGDGGNHSGLLFLAKVHAGFGALLRMPPPAA
KLAGK
>INV.0360
MMRFTLKTTAIVSAAALLAGFGPPPRAAELPPGRLATTEDYFAQQAKQAVTPDVMAQLAYMNYIDS
ISPFYSRGCSFEAWELKHVPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGLASAFTLLLA
REMGDQQLFDQLLNHLEPPAKPSIVSASLRYEHPSGGNMGNHSGLLFLAKVHAGFGALLRMPPPAA
KLAGK
>INV.0361
MMRFTLKTTAIVSAAALLAGFGPPPRAAELPPGRLATTEDYFAQQAKQAVTPDVMAQLAYMNYIDF
ISPFYSRGCSFEAWELKHVPQRVIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPTDGRFHDHSGLLFLAKVHAGFGALLRMPPPAA
KLAGK
>INV.0362
MMRFTLKTTAIVSAAALLAGFGPPPRAAELPPGRLATTEDYFAQQAKQAVTPDVMAQLAYMNYIDS
ISPFYSRGCSFEAWELKHVPQRVIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGLASAFTLLLA
REMGDQQLFDQLLNHLEPPAKPSIVSASLRYEHPLGGVGGFDALLFLAKVHAGFGALLRMPPPAA
KLAGK
>INV.0363
MMRFTLKTTAIVSAAALLAGFGPPPRAAELPPGRLATTEDYFAQQAKQAVTPDVMAQLAYMNYIDF
ISPFYSRGCSFEAWELKHVPQRAIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGHASAFTLLLA
REMGDQQLFDQLLNHLEPPAKPSIVSASLRYEHPTQGLGGSHDGLLFLAKVHAGFGALLRMPPPAA
KLAGK
>INV.0364
MMRFTLKTTAIVSAAALLAGFGPPPRAAELPPGRLATTEDYFAQQAKQAVTPDVMAQLAYMNYIDF
ISPFYSRGCSFEAWELKHVPQRQIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
```

Appendix 3

```
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGTASAFTLLLA
REMGDQQLFDQLLNHLEPPAKPSIVSASLRYEHPTRGRHGSHDGLLFLAKVHAGFGALLRMPPPAA
KLAGK
>INV.0365
MMRFTLKTTAIVSAAALLAGFGPPPRAAELPPGRLATTEDYFAQQAKQAVTPDVMAQLAYMNYIDS
ISPFYSRGCSFEAWELKHVPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPIGGLFFGFDALLFLAKVHAGFGALLRMPPPAA
KLAGK
>INV.0366
MMRFTLKTTAIVSAAALLAGFGPPPRAAELPPGRLATTEDYFAQQAKQAVTPDVMAQLAYMNYIDS
ISPFYSRGCSFEAWELKHVPQRVIKLSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGLASAFTLLLA
REMGDQQLFDQLLNHLEPPAKPSIVSASLRYEHPLGGEMGSHDGLLFLAKVHAGFGALLRMPPPAA
KLAGK
>INV.0367
MMRFTLKTTAIVSAAALLAGFGPPPRAAELPPGRLATTEDYFAQQAKQAVTPDVMAQLAYMNYIDH
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGTASAFTLLLA
REMGDQQLFDQLLNHLEPPAKPSIVSASLRYEHGYFGTFGSHDGLLFLAKVHAGFGALLRMPPPAA
KLAGK
>INV.0368
MMRFTLKTTAIVSAAALLAGFGPPPRAAELPPGRLATTEDYFAQQAKQAVTPDVMAQLAYMNYIDF
ISPFYSRGCSFEAWELKHVPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGAASAFTLLLA
REMGDQQLFDQLLNHLEPPAKPSIVSASLRYEHPTGGTGFPHDGLLFLAKVHAGFGALLRMPPPAA
KLAGK
>INV.0369
MMRFTLKTTAIVSAAALLAGFGPPPRAAELPPGRLATTEDYFAQQAKQAVTPDVMAQLAYMNLHDF
HAPFYSRGCSFEAWELKHTPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0370
MMRFTLKTTAIVSAAALLAGFGPPPRAAELPPGRLATTEDYFAQQAKQAVTPDVMAQLAYMNFHVF
QAPFYSRGCSFEAWELKHTPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0371
```

Appendix 3

```
MMRFTLKTTAIVSAAALLAGFGPPPRAAELPPGRLATTEDYFAQQAKQAVTPDVMAQLAYMNFHMF
KAPFYSRGCSFEAWELKHTPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0372
MMRFTLKTTAIVSAAALLAGFGPPPRAAELPPGRLATTEDYFAQQAKQAVTPDVMAQLAYMNGGM
GKAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0373
MMRFTLKTTAIVSAAALLAGFGPPPRAAELPPGRLATTEDYFAQQAKQAVTPDVMAQLAYMDNAGY
SKAPFYSRGCSFEAWEDKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0374
MMRFTLKTTAIVSAAALLAGFGPPPRAAELPPGRLATTEDYFAQQAKQAVTPDVMAQLAYMDHAGH
SKAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0375
MMRFTLKTTAIVSAAALLAGFGPPPRAAELPPGRLATTEDYFAQQAKQAVTPDVMAQLAYMDMAGL
YYAPFYSRGCSFEAWEQKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGAGLASAFTLLL
AREMGDQQLFDQLLNHLEPPAKPSIVSASLRYEHPGSLLFDELLFLAKVHAGFGALLRMPPPAAKL
AGK
>INV.0376
MMRFTLKTTAIVSAAALLAGFGPPPRAAELPPGRLATTEDYFAQQAKQAVTPDVMAQLAYMNGGGW
YRAPFYSRGCSFEAWEEKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGIGLASAFTLLL
AREMGDQQLFDQLLNHLEPPAKPSIVSASLRYEHPGSLLFDELLFLAKVHAGFGALLRMPPPAAKL
AGK
>INV.0377
MMRFTLKTTAIVSAAALLAGFGPPPRAAELPPGRLATTEDYFAQQAKQAVTPDVMAQLAYMNMAGY
GRSPFYSRGCSFEAWEEKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
```

Appendix 3

```
AREMGDQQLFDQLLNHLEPPAKPSIVSASLRYEHPGSLLFDELLFLAKVHAGFGALLRMPPPAAKL
AGK
>INV.0378
MMRFTLKTTAIVSAAALLAGFGPPPRAAELPPGRLATTEDYFAQQAKQAVTPDVMAQLAYMNNAGF
GRAPFYSRGCSFEAWEAKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGSGLASAFTLLL
AREMGDQQLFDQLLNHLEPPAKPSIVSASLRYEHPGSLLFDELLFLAKVHAGFGALLRMPPPAAKL
AGK
>INV.0379
MMRFTLKTTAIVSAAALLAGFGPPPRAAELPPGRLATTEDYFAQQAKQAVTPDVMAQLAYMNNAGW
YYAPFYSRGCSFEAWEEKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGIGLASAFTLLL
AREMGDQQLFDQLLNHLEPPAKPSIVSASLRYEHPGSLLFDELLFLAKVHAGFGALLRMPPPAAKL
AGK
>INV.0380
MMRFTLKTTAIVSAAALLAGFGPPPRAAELPPGRLATTEDYFAQQAKQAVTPDVMAQLAYMNNAGI
GLAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGSGLASAFTLLL
AREMGDQQLFDQLLNHLEPPAKPSIVSASLRYEHPGSLLFDELLFLAKVHAGFGALLRMPPPAAKL
AGK
>INV.0381
MMRFTLKTTAIVSAAALLAGFGPPPRAAELPPGRLATTEDYFAQQAKQAVTPDVMAQLAYMNNAGI
SRAPFYSRGCSFEAWEEKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0382
MMRFTLKTTAIVSAAALLAGFGPPPRAAELPPGRLATTEDYFAQQAKQAVTPDVMAQLAYMNGGGW
SRAPFYSRGCSFEAWEEKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGDGLASAFTLLL
AREMGDQQLFDQLLNHLEPPAKPSIVSASLRYEHPGSLLFDELLFLAKVHAGFGALLRMPPPAAKL
AGK
>INV.0383
MMRFTLKTTAIVSAAALLAGFGPPPRAAELPPGRLATTEDYFAQQAKQAVTPDVMAQLAYMDNAGM
SKAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0384
MMRFTLKTTAIVSAAALLAGFGPPPRAAELPPGRLATTEDYFAQQAKQAVTPDVMAQLAYMTHAGQ
YEAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
```

Appendix 3

```
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGSGLASAFTLLL
AREMGDQQLFDQLLNHLEPPAKPSIVSASLRYEHPGSLLFDELLFLAKVHAGFGALLRMPPPAAKL
AGK
>INV.0385
MMRFTLKTTAIVSAAALLAGFGPPPRAAELPPGRLATTEDYFAQQAKQAVTPDVMAQLAYMNFAGL
SKAPFYSRGCSFEAWELKHTPQRVIKYSIAFYAYGLASVALIDPKLRALAGHDLDIAVSKMKCCRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGAGLASAFTLLL
AREMGDQQLFDQLLNHLEPPAKPSIVSASLRYEHPGSLLFDELLFLAKVHAGFGALLRMPPPAAKL
AGK
>INV.0386
MMRFTLKTTAIVSAAALLAGFGPPPRAAELPPGRLATTEDYFAQQAKQAVTPDVMAQLAYMNMAGM
YYAPFYSRGCSFEAWEQKHTPQRVIKYSIAFYAYGLASVALIDPKLRALAGHDLDIAVSKMKCCRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0387
MMRFTLKTTAIVSAAALLAGFGPPPRAAELPPGRLATTEDYFAQQAKQAVTPDVMAQLAYMGNAGQ
TEAPFYSRGCSFEAWENKHTPQRVIKYSIAFYAYGLASVALIDPKLRALAGHDLDIAVSKMKCCRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0388
MMRFTLKTTAIVSAAALLAGFGPPPRAAELPPGRLATTEDYFAQQAKQAVTPDVMAQLAYMNNAGQ
SKAPFYSRGCSFEAWELKHTPQRVIKYSIAFYAYGLASVALIDPKLRALAGHDLDIAVSKMKCCRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0389
MMRFTLKTTAIVSAAALLAGFGPPPRAAELPPGRLATTEDYFAQQAKQAVTPDVMAQLAYMNSSSF
LWAPFYSRGCSFEAWEMKHTPQRVIKYSIAFYAYGLASVALIDPKLRALAGHDLDIAVSKMKCCRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0390
MMRFTLKTTAIVSAAALLAGFGPPPRAAELPPGRLATTEDYFAQQAKQAVTPDVMAQLAYMNNAGE
SRAPFYSRGCSFEAWEEKHTPQRVIKYSIAFYAYGLASVALIDPKLRALAGHDLDIAVSKMKCCRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0391
```

Appendix 3

```
MMRFTLKTTAIVSAAALLAGFGPPPRAAELPPGRLATTEDYFAQQAKQAVTPDVMAQLAYMDMAGM
TQAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0392
MMRFTLKTTAIVSAAALLAGFGPPPRAAELPPGRLATTEDYFAQQAKQAVTPDVMAQLAYMNNGGI
QQAPFYSRGCSFEAWEQKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGLGLASAFTLLL
AREMGDQQLFDQLLNHLEPPAKPSIVSASLRYEHPGSLLFDELLFLAKVHAGFGALLRMPPPAAKL
AGK
>INV.0393
MMRFTLKTTAIVSAAALLAGFGPPPRAAELPPGRLATTEDYFAQQAKQAVTPDVMAQLAYMNFAGM
TKAPFYSRGCSFEAWELKHTPQRVIKYSIAFYAYGLASVALIDPKLRALAGHDLDIAVSKMKCKRV
WGDWEEDGFGTDPIEKENIMYKGHLNLMYGLYQLVTGSRRYEAEHAHLTRIIHDEIAANPFAGIVC
EPDNYFVQCNSVAYLSLWVYDRLHGTDYRAATRAWLDFIQKDLIDPERGAFYLSYHPESGAVKPWI
SAYTTAWTLAMVHGMDPAFSERYYPRFKQTFVEVYDEGRKARVRETAGTDDADGGVGLASAFTLLL
AREMGDQQLFDQLLNHLEPPAKPSIVSASLRYEHPGSLLFDELLFLAKVHAGFGALLRMPPPAAKL
AGK
>INV.0394
MMRFTLKTTAIVSAAALLAGFGPPPRAAELPPGRLATTEDYFAQQAKQAVTPDVMAQLAYMNGDAM
TETAPFYSRGCSFEAWEQKHTPQRMIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGPGLASAFTLL
LAREMGDQQLFDQLLNHLEPPAKPSIVSASLRYEHPGSLLFDELLFLAKVHAGFGALLRMPPPAAK
LAGK
>INV.0395
MMRFTLKTTAIVSAAALLAGFGPPPRAAELPPGRLATTEDYFAQQAKQAVTPDVMAQLAYMNADSH
TDTSPFYSRGCSFEAWELKHTPQRMIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGPGLASAFTLL
LAREMGDQQLFDQLLNHLEPPAKPSIVSASLRYEHPGSLLFDELLFLAKVHAGFGALLRMPPPAAK
LAGK
>INV.0396
MMRFTLKTTAIVSAAALLAGFGPPPRAAELPPGRLATTEDYFAQQAKQAVTPDVMAQLAYMNGDSW
LYFPPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0397
MMRFTLKTTAIVSAAALLAGFGPPPRAAELPPGRLATTEDYFAQQAKQAVTPDVMAQLAYMNSSSW
VYWGPFYSRGCSFEAWELKHTPQRIIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGPGLASAFTLL
```

Appendix 3

```
LAREMGDQQLFDQLLNHLEPPAKPSIVSASLRYEHPGSLLFDELLFLAKVHAGFGALLRMPPPAAK
LAGK
>INV.0398
MMRFTLKTTAIVSAAALLAGFGPPPRAAELPPGRLATTEDYFAQQAKQAVTPDVMAQLAYMNADSL
TGGAPFYSRGCSFEAWEAKHTPQRMIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0399
MMRFTLKTTAIVSAAALLAGFGPPPRAAELPPGRLATTEDYFAQQAKQAVTPDVMAQLAYMNGDSY
LYWAPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0400
MMRFTLKTTAIVSAAALLAGFGPPPRAAELPPGRLATTEDYFAQQAKQAVTPDVMAQLAYMNGDSF
LYFAPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0401
MMRFTLKTTAIVSAAALLAGFGPPPRAAELPPGRLATTEDYFAQQAKQAVTPDVMAQLAYMNGDAF
VYFAPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0402
MMRFTLKTTAIVSAAALLAGFGPPPRAAELPPGRLATTEDYFAQQAKQAVTPDVMAQLAYMNGDSW
LYFAPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0403
MMRFTLKTTAIVSAAALLAGFGPPPRAAELPPGRLATTEDYFAQQAKQAVTPDVMAQLAYMAAGRM
RGDAPFYSRGCSFEAWENKHTPQRMIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGIGLASAFTLL
LAREMGDQQLFDQLLNHLEPPAKPSIVSASLRYEHPGSLLFDELLFLAKVHAGFGALLRMPPPAAK
LAGK
>INV.0404
MMRFTLKTTAIVSAAALLAGFGPPPRAAELPPGRLATTEDYFAQQAKQAVTPDVMAQLAYMNGDSF
QYWAPFYSRGCSFEAWEIKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
```

Appendix 3

```
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0405
MMRFTLKTTAIVSAAALLAGFGPPPRAAELPPGRLATTEDYFAQQAKQAVTPDVMAQLAYMNGDSF
VYTAPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0406
MMRFTLKTTAIVSAAALLAGFGPPPRAAELPPGRLATTEDYFAQQAKQAVTPDVMAQLAYMNADTH
TGGAPFYSRGCSFEAWEAKHTPQRMIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0407
MMRFTLKTTAIVSAAALLAGFGPPPRAAELPPGRLATTEDYFAQQAKQAVTPDVMAQLAYMNGDAF
LYWAPFYSRGCSFEAWELKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0408
MMRFTLKTTAIVSAAALLAGFGPPPRAAELPPGRLATTEDYFAQQAKQAVTPDVMAQLAYMNGDSW
KYTAPFYSRGCSFEAWEMKHTPQRVIKYSIAFYAYGLASVALIDPKLRALAGHDLDIAVSKMKCKR
VWGDWEEDGFGTDPIEKENIMYKGHLNLMYGLYQLVTGSRRYEAEHAHLTRIIHDEIAANPFAGIV
CEPDNYFVQCNSVAYLSLWVYDRLHGTDYRAATRAWLDFIQKDLIDPERGAFYLSYHPESGAVKPW
ISAYTTAWTLAMVHGMDPAFSERYYPRFKQTFVEVYDEGRKARVRETAGTDDADGGSGLASAFTLL
LAREMGDQQLFDQLLNHLEPPAKPSIVSASLRYEHPGSLLFDELLFLAKVHAGFGALLRMPPPAAK
LAGK
>INV.0409
MMRFTLKTTAIVSAAALLAGFGPPPRAAELPPGRLATTEDYFAQQAKQAVTPDVMAQLAYMNYHDF
HSPFYSRGCSFEAWELKHTPQRVIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0410
MMRFTLKTTAIVSAAALLAGFGPPPRAAELPPGRLATTEDYFAQQAKQAVTPDVMAQLAYMNYIDY
ISPFYSRGCSFEAWELKHTPQRMIKFSIAFYAFGLASVALIDPKLRALAGHDLDIAVSKMKCKRVW
GDWEEDGFGTDPIEKENIMYKGLLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGLASAGTLLLA
REMGDQQLFDQLLNHLEPPAKPSIVSASLRYEHPGSLLFDELLFLAKVHAGFGALLRMPPPAAKLA
GK
>INV.0411
```

Appendix 3

```
MMRFTLKTTAIVSAAALLAGFGPPPRAAELPPGRLATTEDYFAQQAKQAVTPDVMAQLAYMNYIDF
ISPFYSRGCSFEAWELKHTPQRYIKYSIAFYAFGLASVALIDPKLRALAGHDLDIAVSKMKCKRVW
GDWEEDGFGTDPIEKENIMYKGFLNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAFTLAMVHGMDPAFSERYYPRFKQTFVEVYDEGRKARVRETAGTDDADGGLGWASAFTLLLA
REMGDQQLFDQLLNHLEPPAKPSIVSASLRYEHPGSYHFDELLFLAKVHAGFGALLRMPPPAAKLA
GK
>INV.0412
MMRFTLKTTAIVSAAALLAGFGPPPRAAELPPGRLATTEDYFAQQAKQAVTPDVMAQLAYMNYIDH
ISPFYSRGCSFEAWELKHTPQRWIKHSIAFYAFGLASVALIDPKLRALAGHDLDIAVSKMKCKRVW
GDWEEDGFGTDPIEKENIMYKGELNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGWASAFTLLLA
REMGDQQLFDQLLNHLEPPAKPSIVSASLRYEHPGSGHFDELLFLAKVHAGFGALLRMPPPAAKLA
GK
>INV.0413
MMRFTLKTTAIVSAAALLAGFGPPPRAAELPPGRLATTEDYFAQQAKQAVTPDVMAQLAYMNYIDF
ISPFYSRGCSFEAWELKHTPQRMIKYSIAIYAWGLASVALIDPKLRALAGHDLDIAVSKMKCKRVW
GDWEEDGFGTDPIEKENIMYKGALNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGLASAWTLLLA
REMGDQQLFDQLLNHLEPPAKPSIVSASLRYEHPGSLLFDELLFLAKVHAGFGALLRMPPPAAKLA
GK
>INV.0414
MMRFTLKTTAIVSAAALLAGFGPPPRAAELPPGRLATTEDYFAQQAKQAVTPDVMAQLAYMNYIDY
ISPFYSRGCSFEAWELKHTPQRMIKFSIAFYAYGLASVALIDPKLRALAGHDLDIAVSKMKCKRVW
GDWEEDGFGTDPIEKENIMYKGHLNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGPGLASAFTLLLA
REMGDQQLFDQLLNHLEPPAKPSIVSASLRYEHPGSLLFDELLFLAKVHAGFGALLRMPPPAAKLA
GK
>INV.0415
MMRFTLKTTAIVSAAALLAGFGPPPRAAELPPGRLATTEDYFAQQAKQAVTPDVMAQLAYMNYIDF
ISPFYSRGCSFEAWELKHTPQRYIKFSIAFYAFGLASVALIDPKLRALAGHDLDIAVSKMKCKRVW
GDWEEDGFGTDPIEKENIMYKGLLNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAHTLAMVHGMDPAFSERYYPRFKQTFVEVYDEGRKARVRETAGTDDADGGLGWASAGTLLLA
REMGDQQLFDQLLNHLEPPAKPSIVSASLRYEHPGSYHFDELLFLAKVHAGFGALLRMPPPAAKLA
GK
>INV.0416
MMRFTLKTTAIVSAAALLAGFGPPPRAAELPPGRLATTEDYFAQQAKQAVTPDVMAQLAYMNYIDF
ISPFYSRGCSFEAWELKHTPQRFIKYSIAFYAWGLASVALIDPKLRALAGHDLDIAVSKMKCKRVW
GDWEEDGFGTDPIEKENIMYKGMLNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGTASAFTLLLA
REMGDQQLFDQLLNHLEPPAKPSIVSASLRYEHPGSYWFDELLFLAKVHAGFGALLRMPPPAAKLA
GK
>INV.0417
MMRFTLKTTAIVSAAALLAGFGPPPRAAELPPGRLATTEDYFAQQAKQAVTPDVMAQLAYMNYIDF
ISPFYSRGCSFEAWELKHTPQRMIKLSIAFYAYGLASVALIDPKLRALAGHDLDIAVSKMKCKRVW
GDWEEDGFGTDPIEKENIMYKGHLNLMYGLYQLVTGSRRYEAHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGLGLASAFTLLLA
```

Appendix 3

```
REMGDQQLFDQLLNHLEPPAKPSIVSASLRYEHPGSLLFDELLFLAKVHAGFGALLRMPFPAAKLA
GK
>INV.0418
MMRFTLKTTAIVSAAALLAGFGPPPRAAELPPGRLATTEDYFAQQAKQAVTPDVMAQLAYMNYIDF
ISPFYSRGCSFEAWELKHVPQRAIKYSIAFYAYGLASVALIDPKLRALAGHDLDIAVSKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPESGAVKPWIS
AYTTAWTLAMVHGMDPAFSERYYPRFKQTFVEVYDEGRKARVRETAGTDDADGGTGSASAFTLLLA
REMGDQQLFDQLLNHLEPPAKPSIVSASLRYEHPWDMLASHDGLLFLAKVHAGFGALLRMPPPAAK
LAGK
>INV.0510
MMRFTLKTTAIVSAAALLAGFGPPPRAAELPPGRLATTEDYFAQQAKQAVTPDVMAQLAYMNYWDF
SSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPGTGGWFSASSFALLL
AREMGDQQLFDQLLNHLEPPAKPSIVSASLRYEHPLSLLFDELLFLAKVHAGFGALLRMPPPAAKL
AGK
>INV.0511
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDGPVDGFFGAAMFALLL
AREMGDQQLFDQLLNHLEPPAKPSIVSAMLRYEHPLGLLFDELLFLAKVHAGFGALLRMPPPAAKL
AGK
>INV.0512
MMRFTLKTTAIVSAAALLAGFGPPPRAAELPPGRLATTEDYFAQQAKQAVTPDVMAQLAYMNYEDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKARVRETAGTTDGGGGHHFSAAAFALLL
AREMGDQQLFDQLLNHLEPPAKPSIVSARLRYEHPLSLLFDELLFLAKVHAGFGALLRMPPPAAKL
AGK
>INV.0513
MMRFTLKTTAIVSAAALLAGFGPPPRAAELPPGRLATTEDYFAQQAKQAVTPDVMAQLAYMNYHDF
HSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDDSSGGFSASSFALLL
AREMGDQQLFDQLLNHLEPPAKPSIVSAMLRYEHPLSLLFDELLFLAKVHAGFGALLRMPPPAAKL
AGK
>INV.0514
MMRFTLKTTAIVSAAALLAGFGPPPRAAELPPGRLATTEDYFAQQAKQAVTPDVMAQLAYMNYHDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDQTEGLGHAAAFALLL
AREMGDQQLFDQLLNHLEPPAKPSIVSAMLRYEHPLSLLFDELLFLAKVHAGFGALLRMPPPAAKL
AGK
>INV.0515
MMRFTLKTTAIVSAAALLAGFGPPPRAAELPPGRLATTEDYFAQQAKQAVTPDVMAQLAYMNYHDH
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
```

Appendix 3

```
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDASGGGAWLAAAFALLL
AREMGDQQLFDQLLNHLEPPAKPSIVSAMLRYEHPLSLLFDELLFLAKVHAGFGALLRMPPPAAKL
AGK
>INV.0516
MMRFTLKTTAIVSAAALLAGFGPPPRAAELPPGRLATTEDYFAQQAKQAVTPDVMAQLAYMNYTDF
SSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAGGDSIFSASAMALLL
AREMGDQQLFDQLLNHLEPPAKPSIVSAMLRYEHPLSLLFDELLFLAKVHAGFGALLRMPPPAAKL
AGK
>INV.0517
MMRFTLKTTAIVSAAALLAGFGPPPRAAELPPGRLATTEDYFAQQAKQAVTPDVMAQLAYMNYVDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAHGNVWGDAAAFALLL
AREMGDQQLFDQLLNHLEPPAKPSIVSAMLEYEHPLSLLFDELLFLAKVHAGFGALLRMPPPAAKL
AGK
>INV.0518
MMRFTLKTTAIVSAAALLAGFGPPPRAAELPPGRLATTEDYFAQQAKQAVTPDVMAQLAYMNYHDH
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPSNFTYIDGSGFALLL
AREMGDQQLFDQLLNHLEPPAKPSIVSASLRYEHPGSGLFDELLFLAKVHAGFGALLRMPPPAAKL
AGK
>INV.0519
MMRFTLKTTAIVSAAALLAGFGPPPRAAELPPGRLATTEDYFAQQAKQAVTPDVMAQLAYMNYHDH
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKARVRETAGTTDAGQYTEWLAAAFALLL
AREMGDQQLFDQLLNHLEPPAKPSIVSASLRYEHPLSALFDELLFLAKVHAGFGALLRMPPPAAKL
AGK
>INV.0520
MMRFTLKTTAIVSAAALLAGFGPPPRAAELPPGRLATTEDYFAQQAKQAVTPDVMAQLAYMNYSDH
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAGGDVTGHAAAFALLL
AREMGDQQLFDQLLNHLEPPAKPSIVSASLRYEHPLSLLFDELLFLAKVHAGFGALLRMPPPAAKL
AGK
>INV.0521
MMRFTLKTTAIVSAAALLAGFGPPPRAAELPPGRLATTEDYFAQQAKQAVTPDVMAQLAYMNYHDH
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDADDSGFGNAAAFALLL
AREMGDQQLFDQLLNHLEPPAKPSIVSASLRYEHPLSLLFDELLFLAKVHAGFGALLRMPPPAAKL
AGK
>INV.0522
```

Appendix 3

```
MMRFTLKTTAIVSAAALLAGFGPPPRAAELPPGRLATTEDYFAQQAKQAVTPDVMAQLAFMNYIDH
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDATGGTLFDPAAFALLL
AREMGDQQLFDQLLNHLEPPAKPSIVSAALYYEHPLSLLFDELLFLAKVHAGFGALLRMPPPAAKL
AGK
>INV.0523
MMRFTLKTTAIVSAAALLAGFGPPPRAAELPPGRLATTEDYFAQQAKQAVTPDVMAQLATMNYADF
YAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAQSLGGWSASSFALLL
AREMGDQQLFDQLLNHLEPPAKPSIVSAALIYEHPLSLLFDELLFLAKVHAGFGALLRMPPPAAKL
AGK
>INV.0524
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAGGGGSFDAAAFALLL
AREMGDQQLFDQLLNHLEPPAKPSIVSASLRYEHPLSDLFDELLFLAKVHAGFGALLRMPPPAAKL
AGK
>INV.0525
MMRFTLKTTAIVSAAALLAGFGPPPRAAELPPGRLATTEDYFAQQAKQAVTPDVMAQLAYMNYTDH
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGSGVGHAAAFALLL
AREMGDQQLFDQLLNHLEPPAKPSIVSAMLRYEHPLSLLFDELLFLAKVHAGFGALLRMPPPAAKL
AGK
>INV.0526
MMRFTLKTTAIVSAAALLAGFGPPPRAAELPPGRLATTEDYFAQQAKQAVTPDVMAQLAYMNYSDF
YAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDEWGGAGFNASAFALLL
AREMGDQQLFDQLLNHLEPPAKPSIVSAMLRYEHPLSLLFDELLFLAKVHAGFGALLRMPPPAAKL
AGK
>INV.0527
MMRFTLKTTAIVSAAALLAGFGPPPRAAELPPGRLATTEDYFAQQAKQAVTPDVMAQLAYMNYWDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDDSTGDGGFSASAFALL
LAREMGDQQLFDQLLNHLEPPAKPSIVSASLRYEHPLSALFDELLFLAKVHAGFGALLRMPPPAAK
LAGK
>INV.0528
MMRFTLKTTAIVSAAALLAGFGPPPRAAELPPGRLATTEDYFAQQAKQAVTPDVMAQLAYMNYTDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPSNGEHGFDASAFALL
```

Appendix 3

```
LAREMGDQQLFDQLLNHLEPPAKPSIVSASLRYEHPLSLLFDELLFLAKVHAGFGALLRMPPPAAK
LAGK
>INV.0529
MMRFTLKTTAIVSAAALLAGFGPPPRAAELPPGRLATTEDYFAQQAKQAVTPDVMAQLAYMNYDDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAGGTDGHASAAAMALL
LAREMGDQQLFDQLLNHLEPPAKPSIVSARLRYEHPLSLLFDELLFLAKVHAGFGALLRMPPPAAK
LAGK
>INV.0530
MMRFTLKTTAIVSAAALLAGFGPPPRAAELPPGRLATTEDYFAQQAKQAVTPDVMAQLAYMNYDDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDDSERGHEFSASAFALL
LAREMGDQQLFDQLLNHLEPPAKPSIVSASLRYEHPLSHLFDELLFLAKVHAGFGALLRMPPPAAK
LAGK
>INV.0531
MMRFTLKTTAIVSAAALLAGFGPPPRAAELPPGRLATTEDYFAQQAKQAVTPDVMAQLAYMNYEDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAGYDHGGFTAAAFALL
LAREMGDQQLFDQLLNHLEPPAKPSIVSASLRYEHPLGGLFDELLFLAKVHAGFGALLRMPPPAAK
LAGK
>INV.0532
MMRFTLKTTAIVSAAALLAGFGPPPRAAELPPGRLATTEDYFAQQAKQAVTPDVMAQLAYMNYHDH
YAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAFEPGSYGNAAGFALL
LAREMGDQQLFDQLLNHLEPPAKPSIVSAMLRYEHPLSLLFDELLFLAKVHAGFGALLRMPPPAAK
LAGK
>INV.0533
MMRFTLKTTAIVSAAALLAGFGPPPRAAELPPGRLATTEDYFAQQAKQAVTPDVMAQLAYMNYHDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAHNFPTPFSSSAHTLL
LAREMGDQQLFDQLLNHLEPPAKPSIVSASLRYEHPLSGLFDELLFLAKVHAGFGALLRMPPPAAK
LAGK
>INV.0534
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAMTLAFIHGMDPAFSERYYPRFKQTFVEVYDEGRKARVRETAGTDDPGDDMGFAAAAMMALL
LAREMGDQQLFDQLLNHLEPPAKPSIVSASLRYEHPLGNNFDELLFLAKVHAGFGALLRMPPPAAK
LAGK
>INV.0535
MMRFTLKTTAIVSAAALLAGFGPPPRAAELPPGRLATTEDYFAQQAKQAVTPDVMAQLAYMNYSDH
YSPFYSRGCSFEAWELKHVPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
```

Appendix 3

```
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAQNDSSGFSAAAFALL
LAREMGDQQLFDQLLNHLEPPAKPSIVSAALRYEHPLSGLFDELLFLAKVHAGFGALLRMPPPAAK
LAGK
>INV.0536
MMRFTLKTTAIVSAAALLAGFGPPPRAAELPPGRLATTEDYFAQQAKQAVTPDVMAQLAYMNYIDH
YSPFYSRGCSFEAWELKHVPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDGGRDMGWFSAAAFALL
LAREMGDQQLFDQLLNHLEPPAKPSIVSASLRYEHPLSGCFDELLFLAKVHAGFGALLRMPPPAAK
LAGK
>INV.0537
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDGTLPDHAFSASAFALL
LAREMGDQQLFDQLLNHLEPPAKPSIVSASLRYEHPLSLLFDELLFLAKVHAGFGALLRMPPPAAK
LAGK
>INV.0538
MMRFTLKTTAIVSAAALLAGFGPPPRAAELPPGRLATTEDYFAQQAKQAVTPDVMAQLAYMNYWDH
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDASYGIGGFDASAFALL
LAREMGDQQLFDQLLNHLEPPAKPSIVSASLRYEHPLSGLFDELLFLAKVHAGFGALLRMPPPAAK
LAGK
>INV.0539
MMRFTLKTTAIVSAAALLAGFGPPPRAAELPPGRLATTEDYFAQQAKQAVTPDVMAQLAYMNYTDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDDSQGGNASGFALLLA
REMGDQQLFDQLLNHLEPPAKPSIVSASLRYEHPLSLLFDELLFLAKVHAGFGALLRMPPPAAKLA
GK
>INV.0540
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDADHDGPLAAAFALLLA
REMGDQQLFDQLLNHLEPPAKPSIVSASLRYEHPLSLLFDELLFLAKVHAGFGALLRMPPPAAKLA
GK
>INV.0541
MMRFTLKTTAIVSAAALLAGFGPPPRAAELPPGRLATTEDYFAQQAKQAVTPDVMAQLAYMNYHDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAGWAGGPAAGFALLLA
REMGDQQLFDQLLNHLEPPAKPSIVSASLRYEHPLSLLFDELLFLAKVHAGFGALLRMPPPAAKLA
GK
>INV.0542
```

Appendix 3

```
MMRFTLKTTAIVSAAALLAGFGPPPRAAELPPGRLATTEDYFAQQAKQAVTPDVMAQLAYMNYHDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKAAVRETAGTTDTDSDGLGSASAFALLL
AREMGDQQLFDQLLNHLEPPAKPSIVSASLRYEHPLSLLFDELLFLAKVHAGFGALLRMPPPAAKL
AGK
>INV.0543
MMRFTLKTTAIVSAAALLAGFGPPPRAAELPPGRLATTEDYFAQQAKQAVTPDVMAQLAAMNYSDS
HSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDASSDTNFLAAAHALLL
AREMGDQQLFDQLLNHLEPPAKPSIVSASLRYEHPLSLLFDELLFLAKVHAGFGALLRMPPPAAKL
AGK
>INV.0544
MMRFTLKTTAIVSAAALLAGFGPPPRAAELPPGRLATTEDYFAQQAKQAVTPDVMAQLAYMNYEDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDSSRGHGSASAFALLL
AREMGDQQLFDQLLNHLEPPAKPSIVSAELRYEHPLSLLFDELLFLAKVHAGFGALLRMPPPAAKL
AGK
>INV.0545
MMRFTLKTTAIVSAAALLAGFGPPPRAAELPPGRLATTEDYFAQQAKQAVTPDVMAQLAYMNYVDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDATGGPPFDAAAFALLL
AREMGDQQLFDQLLNHLEPPAKPSIVSAMLRYEHPLSILFDELLFLAKVHAGFGALLRMPPPAAKL
AGK
>INV.0546
MMRFTLKTTAIVSAAALLAGFGPPPRAAELPPGRLATTEDYFAQQAKQAVTPDVMAQLAYMNYSDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAESHGLGHAAAFALLL
AREMGDQQLFDQLLNHLEPPAKPSIVSAELRYEHPLSLLFDELLFLAKVHAGFGALLRMPPPAAKL
AGK
>INV.0547
MMRFTLKTTAIVSAAALLAGFGPPPRAAELPPGRLATTEDYFAQQAKQAVTPDVMAQLAYMNYHDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTTDDVGLGIGSAAAFALLL
AREMGDQQLFDQLLNHLEPPAKPSIVSASLRYEHPLSLLFDELLFLAKVHAGFGALLRMPPPAAKL
AGK
>INV.0548
MMRFTLKTTAIVSAAALLAGFGPPPRAAELPPGRLATTEDYFAQQAKQAVTPDVMAQLAYMNYEDS
HSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAGGGGFGLAAAFALLL
```

Appendix 3

```
AREMGDQQLFDQLLNHLEPPAKPSIVSASLRYEHPLSLLFDELLFLAKVHAGFGALLRMPPPAAKL
AGK
>INV.0549
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPGGPEGFDAAAFALLL
AREMGDQQLFDQLLNHLEPPAKPSIVSASLRYEHPLSLLFDELLFLAKVHAGFGALLRMPPPAAKL
AGK
>INV.0550
MMRFTLKTTAIVSAAALLAGFGPPPRAAELPPGRLATTEDYFAQQAKQAVTPDVMAQLAYMNYHDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDATGGRYLMAAAFALLL
AREMGDQQLFDQLLNHLEPPAKPSIVSAMLRYEHPLGYLFDELLFLAKVHAGFGALLRMPPPAAKL
AGK
>INV.0551
MMRFTLKTTAIVSAAALLAGFGPPPRAAELPPGRLATTEDYFAQQAKQAVTPDVMAQLAYMNYEDM
HSPFYSRGCSFEAWELKHTHQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAHFDGYFAAAAFALLL
AREMGDQQLFDQLLNHLEPPAKPSIVSASLRYEHPLSYLFDELLFLAKVHAGFGALLRMPPPAAKL
AGK
>INV.0552
MMRFTLKTTAIVSAAALLAGFGPPPRAAELPPGRLATTEDYFAQQAKQAVTPDVMAQLAYMNYVDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAWSGGPGHASAFALLL
AREMGDQQLFDQLLNHLEPPAKPSIVSAMLRYEHPLSLLFDELLFLAKVHAGFGALLRMPPPAAKL
AGK
>INV.0553
MMRFTLKTTAIVSAAALLAGFGPPPRAAELPPGRLATTEDYFAQQAKQAVTPDVMAQLAAMNYSDH
YAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAVNPDGWNAAAFALLL
AREMGDQQLFDQLLNHLEPPAKPSIVSASLRYEHPLSLLFDELLFLAKVHAGFGALLRMPPPAAKL
AGK
>INV.0554
MMRFTLKTTAIVSAAALLAGFGPPPRAAELPPGRLATTEDYFAQQAKQAVTPDVMAQLAYMNYLDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDANGGDHFDAAAFALLL
AREMGDQQLFDQLLNHLEPPAKPSIVSASLRYEHPLSLLFDELLFLAKVHAGFGALLRMPPPAAKL
AGK
>INV.0555
MMRFTLKTTAIVSAAALLAGFGPPPRAAELPPGRLATTEDYFAQQAKQAVTPDVMAQLAYMNYHDH
HSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
```

```
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDDGSGVGHAAAFALLL
AREMGDQQLFDQLLNHLEPPAKPSIVSASLRYEHPLSLLFDELLFLAKVHAGFGALLRMPPPAAKL
AGK
>INV.0556
MMRFTLKTTAIVSAAALLAGFGPPPRAAELPPGRLATTEDYFAQQAKQAVTPDVMAQLAYMNYVDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKAAVRETAGTTDTDSPTAFLAAAHALLL
AREMGDQQLFDQLLNHLEPPAKPSIVSAMLRYEHPLSLLFDELLFLAKVHAGFGALLRMPPPAAKL
AGK
>INV.0557
MMRFTLKTTAIVSAAALLAGFGPPPRAAELPPGRLATTEDYFAQQAKQAVTPDVMAQLAYMNYHDH
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDSSRNTLFPASAFALLL
AREMGDQQLFDQLLNHLEPPAKPSIVSASLRYEHPLGALFDELLFLAKVHAGFGALLRMPPPAAKL
AGK
>INV.0558
MMRFTLKTTAIVSAAALLAGFGPPPRAAELPPGRLATTEDYFAQQAKQAVTPDVMAQLAYMNYIDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAGVTFGWNAAAFALLL
AREMGDQQLFDQLLNHLEPPAKPSIVSASLRYEHPLSLLFDELLFLAKVHAGFGALLRMPPPAAKL
AGK
>INV.0559
MMRFTLKTTAIVSAAALLAGFGPPPRAAELPPGRLATTEDYFAQQAKQAVTPDVMAQLAYMNYWDF
ISPFYSRGCSFEAWELKHTHQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPSIGGFFSAAAFALLL
AREMGDQQLFDQLLNHLEPPAKPSIVSASLRYEHPLSYLFDELLFLAKVHAGFGALLRMPPPAAKL
AGK
>INV.0560
MMRFTLKTTAIVSAAALLAGFGPPPRAAELPPGRLATTEDYFAQQAKQAVTPDVMAQLAYMNYVDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDGGGDGAFLAAAMALLL
AREMGDQQLFDQLLNHLEPPAKPSIVSAMLRYEHPLSLLFDELLFLAKVHAGFGALLRMPPPAAKL
AGK
>INV.0561
MMRFTLKTTAIVSAAALLAGFGPPPRAAELPPGRLATTEDYFAQQAKQAVTPDVMAQLAYMNYIDF
YSPFYSRGCSFEAWELKHTHQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDQGPIGYSAAAFALLL
AREMGDQQLFDQLLNHLEPPAKPSIVSASLRYEHPLSYLFDELLFLAKVHAGFGALLRMPPPAAKL
AGK
>INV.0562
```

Appendix 3

```
MMRFTLKTTAIVSAAALLAGFGPPPRAAELPPGRLATTEDYFAQQAKQAVTPDVMAQLAYMNYHDH
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDALTGDFGNAAAFALLL
AREMGDQQLFDQLLNHLEPPAKPSIVSAMLRYEHPLSLLFDELLFLAKVHAGFGALLRMPPPAAKL
AGK
>INV.0563
MMRFTLKTTAIVSAAALLAGFGPPPRAAELPPGRLATTEDYFAQQAKQAVTPDVMAQLAYMNYHDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPGGDGELWDAAAFALL
LAREMGDQQLFDQLLNHLEPPAKPSIVSASLRYEHPLSALFDELLFLAKVHAGFGALLRMPPPAAK
LAGK
>INV.0564
MMRFTLKTTAIVSAAALLAGFGPPPRAAELPPGRLATTEDYFAQQAKQAVTPDVMAQLAYMNYADF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDPTSGTGVFSAAAFALL
LAREMGDQQLFDQLLNHLEPPAKPSIVSAMLRYEHPLSALFDELLFLAKVHAGFGALLRMPPPAAK
LAGK
>INV.0565
MMRFTLKTTAIVSAAALLAGFGPPPRAAELPPGRLATTEDYFAQQAKQAVTPDVMAQLAYMNYHDF
ISPFYSRGCSFEAWELKHVPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDGDHSQKGFSAAAFALL
LAREMGDQQLFDQLLNHLEPPAKPSIVSASLRYEHPLSGLFDELLFLAKVHAGFGALLRMPPPAAK
LAGK
>INV.0566
MMRFTLKTTAIVSAAALLAGFGPPPRAAELPPGRLATTEDYFAQQAKQAVTPDVMAQLAYMNYWDH
IAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYVTAWTLAFIHGMDPAFSERYYPRFKQTFVEVYDEGRKARVRETAGTTDAGGDGWHGTGAEFALL
LAREMGDQQLFDQLLNHLEPPAKPSIVSASLRYEHPLSYLFDELLFLAKVHAGFGALLRMPPPAAK
LAGK
>INV.0567
MMRFTLKTTAIVSAAALLAGFGPPPRAAELPPGRLATTEDYFAQQAKQAVTPDVMAQLAYMNYVDF
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKAAVRETAGTTDTDTAHNAFSASAHALL
LAREMGDQQLFDQLLNHLEPPAKPSIVSAMLRYEHPLSALFDELLFLAKVHAGFGALLRMPPPAAK
LAGK
>INV.0568
MMRFTLKTTAIVSAAALLAGFGPPPRAAELPPGRLATTEDYFAQQAKQAVTPDVMAQLAYMNYVDH
YSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVVVYDEGRKATVRETAGTDDDSNGGTVGHAAAFALL
```

Appendix 3

```
LAREMGDQQLFDQLLNHLEPPAKPSIVSAMLRYEHPLSLLFDELLFLAKVHAGFGALLRMPPPAAK
LAGK
>INV.0569
MMRFTLKTTAIVSAAALLAGFGPPPRAAELPPGRLATTEDYFAQQAKQAVTPDVMAQLAAMNYVDF
YAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAVPFGNVWLPAAFALL
LAREMGDQQLFDQLLNHLEPPAKPSIVSAMLFYEHPLSLLFDELLFLAKVHAGFGALLRMPPPAAK
LAGK
>INV.0570
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDPSQDEPGFSASAMALL
LAREMGDQQLFDQLLNHLEPPAKPSIVSASLRYEHPLSALFDELLFLAKVHAGFGALLRMPPPAAK
LAGK
>INV.0571
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDAYPYLLGFSAAAFALL
LAREMGDQQLFDQLLNHLEPPAKPTIVSAALFYEHPLSLLFDELLFLAKVHAGFGALLRMPPPAAK
LAGK
>INV.0572
MMRFTLKTTAIVSAAALLAGFGPPPRAAELPPGRLATTEDYFAQQAKQAVTPDVMAQLAYMNYADF
YAPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTTDAQTLYKYGNAAGFALL
LAREMGDQQLFDQLLNHLEPPAKPSIVSAMLIYEHPLSYLFDELLFLAKVHAGFGALLRMPPPAAK
LAGK
>INV.0573
MMRFTLKTTAIVSAAALLAGFGPPPRAAELPPGRLATTEDYFAQQAKQAVTPDVMAQLAYMNYHDH
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDANDTGFGSASSFALLL
AREMGDQQLFDQLLNHLEPPAKPSIVSASLRYEHPLSLLFDELLFLAKVHAGFGALLRMPPPAAKL
AGK
>INV.0574
MMRFTLKTTAIVSAAALLAGFGPPPRAAELPPGRLATTEDYFAQQAKQAVTPDVMAQLAWWNYIDF
ISPFYSRGCSFEWWELKHTPQRVWKYSIAFWAYGLASVALIDPKLRALAGHDLDIAISKMKCKRWW
GDWEEDGFGTDPIEKENIMYKGHLNLMWGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0575
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAFGLASVALIDPKLRALAGHDLDIAISKMKCKRVW
GDWEEDGFGTDPIEKENIMYKGHLNAMYGLYQLVTGSRRYEAEHAHLTRIIHDEIAANPFAGIVCE
```

Appendix 3

```
PDNYFIQCNSVAYFSLWIYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0576
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAFLSLWVYDRLHGTDYRAATRAFFDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0577
MMRFTLKTTAIVSAAALLAGFGPPPRAAELPPGRLATTEDYFAQQAKQAVTPDVMAQLAFMNYIDF
ISPFYSRGCSFEAWELKHTPQRVIKYSIAFFAYGLASVALIDPKLRALAGHDLDIAISKMKCKRVW
GDWEEDGFGTDPIEKENIMYKGHLNMMYGLYQLVTGSRRYEAEHAHLTRIIHDEIAANPFAGIVCE
PDNYFIQCNSVAFLSLFIYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGWASLFTLLLA
REMGDQQLFDQLLNHLEPPAKPSIVSASLRYEHPGSLLFDELLFLAKVHAGFGALLRMPPPAAKLA
GK
>INV.0578
MMRFTLKTTAIVSAAALLAGFGPPPRAAELPPGRLATTEDYFAQQAKQAVTPDVMAQLAWLNYIDF
ISPFYSRGCSFEAWELKHTPQRVIKYSIAFLAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLFVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASLFTLLLA
REMGDQQLFDQLLNHLEPPAKPSIVSASLRYEHPGSLLFDELLFFAKVHAGFGALLRMPPPAAKLA
GK
>INV.0579
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFFAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAFFSLWVYDRLHGTDYRAATRAFFDFIQKDLIDPERGAFYLSYHPESGAVKPWIS
AYTTAWTLAFIHGMDPAFSERYYPRFKQTFVEVYDEGRKARVRETAGTDDADGGVGLASLFTLLLA
REMGDQQLFDQLLNHLEPPAKPSIVSASLRYEHPGSLLFDELLFFAKVHAGFGALLRMPPPAAKLA
GK
>INV.0580
MMRFTLKTTAIVSAAALLAGFGPPPRAAELPPGRLATTEDYFAQLAKQAVTPDVMAQLAYMNYIDF
ISPFYSRGCSFEAWELNHTPKRVIKYSIAFYAYGLASVALIDPKLRALAGHDLDIAISKMKCPRVW
GEWKEDGFGEDPIEKENIMYKGHLALMYGLYQLVTGSRRYEAEHAHLTRIIHDEIEANPFAGIVCE
PDNYFIQCNAVAFLALWVYDRLHGTDYRRSTEAWLDFIQDGLIDPERGAFYLSYHPESGAVKPWIS
AYTTAWTLAFIHGMDPAFSERYYPRFKQTFVEVYDNGNKARVRETAGTDDADGGVGWASAFTLLLA
REMGDQELFDWLLNHLEPPAKPSIVSASLRYEHPGSLLFDALLFLAKVHTGFGALLRMPPPAAKLA
GK
>INV.0581
MMRFTLKTTAIVSAAALLAGFGPPPRAAELPPGRLATTEDYFAQQAKQAVTPDVMAQLAEMNYIDF
ISPFYSRGCSFEAWELKHTPKRVIKYSIAFFAYGLAAVALIDPKLRALAGHDLDIAISKMKCKRVW
GEWEEDGFGTDPIERKNIMYKGHLNLMYGLYQLVTGSRRYEAEHAHLTRIIHDEIARNPFAGIVCE
PDNYFIQCNAVAFLSLFVYDRLHGTNYRAATRAWLDFIQKDLIDPDRGAFYLSYHPESGAVKPWIS
AYTTAWALAFIHGMDPAFSERYYPRFKQTFVEVYDEGRKARVRETAGTDDADGGVGLASAFALLLA
REMGDQQLFDQLLNHLEPPAKPSIVSARLRYEHPGSLLFEELLFLAKVHAGFGALLRMPPPAAKLA
GK
>INV.0582
```

Appendix 3

```
MMRFTLKTTAIVSAAALLAGFGPPPRAAELPPGRLATTEDYFAQQAKQAVTPDVMAQLAEMNYIDF
ISPFYSRGCSFEAWELKHVPKRVIKYSIAFFAYGLASVALIDPKLRALAGHDLDIAISKMKCKRVW
GEWEEDGFGTDPIERKNIMYKGHLNLMYGLYQLVTGSRRYEAEHRHLTRIIHDEIAANPFGGIVCE
PDNYFIQCNSVAFLSLWVFDRLHGTDFRASTRAFFDFIQDGLIDPERGAFYLSYHPESGAVKPWIS
AYTTAWTLAFIHGMDPAFSERYYPRFKQTFVEVYDNGNKARVRETAGTDDADGGVGLASAFALLLA
REMGDKQLFDWLLNHLEPPANPSIVSARLRYENPGSLLFEELLFLAKVHAGFGALLRMPPPAAKLA
GK
>INV.0583
MMRFTLKTTAIVSAAALLAGFGPPPRAAELPPGRLATTEDYFAQQAKQAVTPDVMAQLAFHNYIDF
ISPFYSRGCSFEAWELKHVPQRVIRYSIAFMAFGLASVALIDPRLRALAGHDLDIAISKMKCKRVW
GDWEEDGFGTDPIEKENIMYKGHLNMMYGLYQLVTGSRRYEAEHAHLTRIIHDEIAANPFAGIVCE
PDNYFIQCNSVAFLSLWIYDRLHGTDYREATRAWLDFIQKDLIDPDRGAFYLSYHPESGAVKPWIS
AYTTAWTLAFIHGMDPAFSERYYPRFKQTFVEVFDEGRKARVRETAGTDDPDGGVGLASAFALLLA
REMGDQQLFDQLLNYLEPPAKPSIVSASLRYEHPGSLLFDELLFLAKVHAGFGALLRMPPPAAKLA
GK
>INV.0584
MMRFTLKTTAIVSAAALLAGFGPPPRAAELPPGRLATTEDYFQQQNKQAVTPDVMAQLAYMNYIDF
ISPFYSRGCSFEAWELNHTPQRVIKYSIAFYAYGLASVAIIDPKLRALAGHDLDIAISQMLCKRVW
GDWEEDGFGTDPREWGNIMYKGHLNLMYGLYQLVTGSRRYENEHAELTRRIHDEIAANPFGGITCE
PDNYFIQCNAVAYFSLWVYDRLHGTDYRAATRAWLDFIQDGLIDPERGAFYLSYHPESGAVKPWIS
AYTTAWTLAFIHGMDPAFSERYYPRFKQTFVEVYDEGRKARVRETAGTDDADGGVGWASLFTLLLA
REMGDQQLFDQLLNHLEPPANPSIVSASLRYVNPLSLLFDELLFLAKVHTGFGALLRMPPPAAKLA
GK
>INV.0585
MMRFTLKTTAIVSAAALLAGFGPPPRAAELPPGRLATTEDYFAQQAKQAVTPDVMAQLAYMNYIDF
ISPFYSRGCSFEAWELKHTPQRVIKFSIAFYAFGLASVALIDPKLRALAGHDLDIAISKMKCKRVW
GDWEEDGFGTDPIEKENIMYKGFLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0586
MMRFTLKTTAIVSAAALLAGFGPPPRAAELPPGRLATTEDYFAQQAKQAVTPDVMAQLAYMNYHDF
RSPFYSRGCSFEAWEEKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0587
MMRFTLKTTAIVSAAALLAGFGPPPRAAELPPGRLATTEDYFAQQAKQAVTPDVMAQLAYMNYHDF
RSPFYSRGCSFEAWEDKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.0588
MMRFTLKTTAIVSAAALLAGFGPPPRAAELPPGRLATTEDYFAQQAKQAVTPDVMAQLAYMNYHDF
TSPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
```

Appendix 3

```
REMGDQQLFDQLLNHLEPPAKPSIVSASLRYEHPGSLLFDELLFLAKVHAGFGALLRMPPPAAKLA
GK
>INV.0589
MMRFTLKTTAIVSAAALLAGFGPPPRAAELPPGRLATTEDYFAQQAKQAVTPDVLAQLAYMNLIDH
ISPFYTEGCQFTAWELKHTPQEMIKHSIAFYAYGLASVALIDPKLRKLAGHDLEIAVSKMKCKRVW
GDWERRGFGTDPIEKENIEYKGHLNLMYGLYQLVTGSRKYEAEHAHLTRIIHDEIAANPFAGIVCE
PDHYFVQCNSVAYLSLWVYDRLHGTDYRAATRAWLDFIQKDLIDPERGAFYLSYHPRSGGVKPWIS
AYTTAWTLAMVHGMDPAFSERYYPRFKQTFVEVYDEGRKARVRETAGTDYADGGVGLASAFTLLLA
REMGDQQLFDQLLNHLEPPAKPSIVANSLRYEHPGSLLFDELLFLAKVHAGFGALLRMPPPAAKLA
GK
>INV.0590
MMRFTLKTTAIVSAAALLAGFGPPPRAAELPPGRLATTEDYFAQQAKQAVTPDVEAQLAYMNFIDF
ISPFYTEGCAFEAWELKHTPQRMIKYSIAFYAYGLASVALIDPKLRKIAGHDLDIAVSKMKCKRVW
GDWEEDGFGTDPIEKENIAYKGHLNLMYGLYQLVTGSRKYEAEHAHLTRIIHDEIAANPFAGIVCE
PDHYFVQCNSVAYLSLWVYDRLHGTDYRAATRAWLDFIQKDLIDPERGAFYLSYHPSGGVFRWIS
AYTTAWTLAMVHGMDPAFSERYYPRFKQTFVEVYDEGRKARVRETAGTDYADGGVGLASAFTLLLA
REMGDQQLFDQLLNHLEPPAKPSIVANSLRYEHPGSLLFDELLFLAKVHAGFGALLRMPPPAAKLA
GK
>INV.0591
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFVQCNSVAYLSLWVYDRLHGTDYRAATRAWLDFIQKDLIDPERGAFYLSYHPRSGGVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.ds_0001
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKACVRETAGTDDCDGGVGLASAFTLLLA
REMGDQQLFDQLLNHLEPPAKPSIVSASLRYEHPGSLLFDELLFLAKVHAGFGALLRMPPPAAKLA
GK
>INV.ds_0003
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLCLMYGLYQLVTGSRRYEAEHAHLTRIIHDEIAANPFAGIVCE
PDNYFIQCNSVAYLCLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.ds_0008
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFCGIVCE
PDNYFIQCNSVAYLSLWVYDRLHGTDYRAATRAWLDCIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.ds_0010
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPCEKENIMYCGHLNLMYGLYQLVTGSRRYEAEHAHLTRIIHDEIAANPFAGIVCE
```

Appendix 3

```
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASAFTLLLA
REMGDQQLFDQLLNHLEPPAKPSIVSASLRYEHPGSLLFDELLFLAKVHAGFGALLRMPPPAAKLA
GK
>INV.ds_0011
MMRFTLKTTAIVSAAALLAGFGPPPRAAELPPGRLATTEDYFAQQAKQAVTPDVMAQLAYMNYIDF
ISPFYSRGCSFEAWELKHTPQRVIKYSIAFYAYGLASVALIDPKLRALAGHDLDIAISKMKCKRVW
GDWEEDGFGTDPIEKENIMYKGHLNLMYGLYQLVTGSRRYEAEHAHLTRIIHDEIAANPFAGIVCE
PDNYFIQCNSVAYLSLWVYDRLHGTDYRAATRAWLDFIQKDLIDPERGAFYLSYHPESGAVKPWIS
AYTTAWTLAFIHGMDPAFSERYYPRFKQTFVEVYDEGRKARVRETAGTDDADGGVGLASCFTLLLA
REMGDQQLFDQLLNHLEPPAKPSIVSASLRYEHPGSLLFDECLFLAKVHAGFGALLRMPPPAAKLA
GK
```

SEQUENCE LISTING (462 sequences)

SEQ ID NO: 1 - protein, 398 aa, Artificial Sequence [sequence omitted]

SEQ ID NO: 2 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 3 - protein, 27 aa, Castellaniella defragrans
MRFTLKTTAIVSAAALLAGFGPPPRAA

SEQ ID NO: 4 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 5 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 6 - protein, 10 aa, Artificial Sequence
  Description of Artificial Sequence: Synthetic peptide
GSLEHHHHHH

SEQ ID NO: 7 - protein, 397 aa, Castellaniella defragrans
MRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 8 - protein, 376 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLE

SEQ ID NO: 9 - protein, 404 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKHHHHHH

SEQ ID NO: 10 - protein, 6 aa, Artificial Sequence
  Description of Artificial Sequence: Synthetic 6xHis tag
HHHHHH

SEQ ID NO: 11 - protein, 361 aa, Artificial Sequence
  Description of Artificial Sequence: Synthetic polypeptide
LPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPP

SEQ ID NO: 12 - protein, 388 aa, Artificial Sequence
  Description of Artificial Sequence: Synthetic polypeptide
MMRFTLKTTAIVSAAALLAGFGPPPRAATEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRGSLEHHHHHH

SEQ ID NO: 13 - protein, 369 aa, Artificial Sequence
  Description of Artificial Sequence: Synthetic polypeptide
MMRFTLKTTAIVSAAALLAGFGPPPRAASPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 14 - protein, 358 aa, Artificial Sequence
  Description of Artificial Sequence: Synthetic polypeptide
MMRFTLKTTAIVSAAALLAGFGPPPRAASPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRGSLEHHHHHH

SEQ ID NO: 15 - DNA, 31 bp, Artificial Sequence
  Description of Artificial Sequence: Synthetic oligonucleotide
ctcttcttaactttaagaaggagatatacat

SEQ ID NO: 16 - DNA, 56 bp, Artificial Sequence
  Description of Artificial Sequence: Synthetic oligonucleotide
ctcgagcatcatcatcatcatcactgagatccggctgctaacaaagcccggaagag

SEQ ID NO: 17 - DNA, 22 bp, Artificial Sequence
  Description of Artificial Sequence: Synthetic primer
gtatatctccttcttaaagtta

SEQ ID NO: 18 - DNA, 23 bp, Artificial Sequence
  Description of Artificial Sequence: Synthetic primer
tgagatccggctgctaacaaagc

SEQ ID NO: 19 - DNA, 20 bp, Artificial Sequence
  Description of Artificial Sequence: Synthetic primer
ataggcgccagcaaccgcac

SEQ ID NO: 20 - DNA, 20 bp, Artificial Sequence
  Description of Artificial Sequence: Synthetic primer
gcagcagccaactcagcttc

SEQ ID NO: 21 - DNA, 20 bp, Artificial Sequence
  Description of Artificial Sequence: Synthetic primer
ataggcgccagcaaccgcac

SEQ ID NO: 22 - DNA, 20 bp, Artificial Sequence
  Description of Artificial Sequence: Synthetic primer
gcagcagccaactcagcttc

SEQ ID NO: 23 - DNA, 26 bp, Artificial Sequence
  Description of Artificial Sequence: Synthetic primer
ttgtttaactttaagaaggagattac

SEQ ID NO: 24 - DNA, 22 bp, Artificial Sequence
  Description of Artificial Sequence: Synthetic primer
ggctttgttagcagccggatct

SEQ ID NO: 25 - DNA, 37 bp, Artificial Sequence
  Description of Artificial Sequence: Synthetic primer
acatttcatttttgagactgcaatatctaagtcgtgg

SEQ ID NO: 26 - DNA, 39 bp, Artificial Sequence
  Description of Artificial Sequence: Synthetic primer
agagttgcattgtacaaaatagttgtctggttcacaaac

SEQ ID NO: 27 - DNA, 39 bp, Artificial Sequence
  Description of Artificial Sequence: Synthetic primer
atccattccatgaatcatagctaacgtccaagcggttgt

SEQ ID NO: 28 - DNA, 40 bp, Artificial Sequence
  Description of Artificial Sequence: Synthetic primer
gatccattccatgcacgaaagctaacgtccaagcggttgt

SEQ ID NO: 29 - DNA, 39 bp, Artificial Sequence
  Description of Artificial Sequence: Synthetic primer
atccattccatgaatgaaagctaacgtccaagcggttgt

SEQ ID NO: 30 - DNA, 40 bp, Artificial Sequence
  Description of Artificial Sequence: Synthetic primer
atccattccatgcacgaaagctaacgtccaagcggttgta

SEQ ID NO: 31 - DNA, 40 bp, Artificial Sequence
  Description of Artificial Sequence: Synthetic primer
gatccattccatgaatcatagctaacgtccaagcggttgt

SEQ ID NO: 32 - DNA, 39 bp, Artificial Sequence
  Description of Artificial Sequence: Synthetic primer
taataaaagtgtgaataaagaggctaaacccacaccacc

SEQ ID NO: 33 - DNA, 42 bp, Artificial Sequence
  Description of Artificial Sequence: Synthetic primer
  modified_base (16)..(16): a, c, t, g, unknown or other
  modified_base (20)..(20): a, c, t, g, unknown or other
gcctgggtgttcgtangtangaggctagcagaaacgatgctt

SEQ ID NO: 34 - DNA, 37 bp, Artificial Sequence
  Description of Artificial Sequence: Synthetic primer
gtaacagagcaccccatccggcatgtactttggcaag

SEQ ID NO: 35 - DNA, 37 bp, Artificial Sequence
  Description of Artificial Sequence: Synthetic primer
acatttcatttttgaaattgcaatatctaagtcgtgg

SEQ ID NO: 36 - DNA, 40 bp, Artificial Sequence
  Description of Artificial Sequence: Synthetic primer
cagagttgcattgaataaaatagttgtctggttcacaaac

SEQ ID NO: 37 - DNA, 41 bp, Artificial Sequence
  Description of Artificial Sequence: Synthetic primer
ttagatattgcagtctcaaaaatgaaatgtaaacgtgtatg

SEQ ID NO: 38 - DNA, 38 bp, Artificial Sequence
  Description of Artificial Sequence: Synthetic primer
gacaactattttgtacaatgcaactctgtggcctattt

SEQ ID NO: 39 - DNA, 41 bp, Artificial Sequence
  Description of Artificial Sequence: Synthetic primer
tggacgttagctatgattcatggaatggatcctgccttttc

SEQ ID NO: 40 - DNA, 41 bp, Artificial Sequence
  Description of Artificial Sequence: Synthetic primer
tggacgttagctttcgtgcatggaatggatcctgccttttc

SEQ ID NO: 41 - DNA, 41 bp, Artificial Sequence
  Description of Artificial Sequence: Synthetic primer
tggacgttagctttcattcatggaatggatcctgccttttc

SEQ ID NO: 42 - DNA, 41 bp, Artificial Sequence
  Description of Artificial Sequence: Synthetic primer
gcttggacgttagctttcgtgcatggaatggatcctgcctt

SEQ ID NO: 43 - DNA, 38 bp, Artificial Sequence
  Description of Artificial Sequence: Synthetic primer
acgttagctatgattcatggaatggatcctgccttttc

SEQ ID NO: 44 - DNA, 43 bp, Artificial Sequence
  Description of Artificial Sequence: Synthetic primer
gtgggtttagcctctttattcacacttttattagcccgcgaaa

SEQ ID NO: 45 - DNA, 38 bp, Artificial Sequence
  Description of Artificial Sequence: Synthetic primer
gtttctgctagcctctactacgaacacccaggcagcct

SEQ ID NO: 46 - DNA, 38 bp, Artificial Sequence
  Description of Artificial Sequence: Synthetic primer
caaagtacatgccggatggggtgctctgttacgtatgc

SEQ ID NO: 47 - DNA, 41 bp, Artificial Sequence
  Description of Artificial Sequence: Synthetic primer
ttagatattgcaatttcaaaaatgaaatgtaaacgtgtatg

SEQ ID NO: 48 - DNA, 38 bp, Artificial Sequence
  Description of Artificial Sequence: Synthetic primer
gacaactattttattcaatgcaactctgtggcctattt

SEQ ID NO: 49 - DNA, 1227 bp, Artificial Sequence; identical to SEQ ID NO: 2
  Description of Artificial Sequence: Synthetic polynucleotide

SEQ ID NO: 50 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatttcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatgattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggcagcctcgagcatcatcatcatcatcactga

SEQ ID NO: 51 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatttcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggcagcctcgagcatcatcatcatcatcactga

SEQ ID NO: 52 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatctcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagcttttattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctttgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggcagcctcgagcatcatcatcatcatcactga

SEQ ID NO: 53 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctttattcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 54 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctctactacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 55 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggcagcctcgagcatcatcatcatcatcactga

SEQ ID NO: 56 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatttcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggcagcctcgagcatcatcatcatcatcactga

SEQ ID NO: 57 - DNA, 1227 bp, Artificial Sequence; identical to SEQ ID NO: 50
  Description of Artificial Sequence: Synthetic polynucleotide

SEQ ID NO: 58 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatttcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggcagcctcgagcatcatcatcatcatcactga

SEQ ID NO: 59 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctttatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggcagcctcgagcatcatcatcatcatcactga

SEQ ID NO: 60 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatgattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctttattcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 61 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 62 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatgattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 63 - DNA, 1227 bp, Artificial Sequence; identical to SEQ ID NO: 53
  Description of Artificial Sequence: Synthetic polynucleotide

SEQ ID NO: 64 - DNA, 1227 bp, Artificial Sequence; identical to SEQ ID NO: 54
  Description of Artificial Sequence: Synthetic polynucleotide

SEQ ID NO: 65 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 66 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatttcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 67 - DNA, 1227 bp, Artificial Sequence
  Description of Artificial Sequence: Synthetic polynucleotide
atgatgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 68 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 69 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctctgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 70 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttattcaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 71 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 72 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatgattcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 73 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 74 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcgtgctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 75 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctctgttcacacttttattagcccgcgaaatgggagatcaacaactctttgaccaactgctgaatcatttagaaccccctgccaaaccaagcatcgtttctgctagcctccgctacgaacacccaggcgggctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 76 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcactttatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 77 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgctcttggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 78 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgctctgggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 79 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgctttgggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 80 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcgtggtgttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 81 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctattatagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 82 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatctgagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 83 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttgtgttagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 84 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaatggccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttgtgttagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 85 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcactttatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctttcgtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttttattagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaaggttccctcgagcaccaccaccaccaccactga

SEQ ID NO: 86 - DNA, 1149 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcaatctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaattgccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctctgttcacacttttattagcccgcgaaatgggagatcaacaactctttgaccaactgctgaatcatttagaaccccctgccaaaccaagcatcgtttctgctagcctccgctacgaacacccaggcggtctcttattcgacgaactgttatttcttgccaaagtacatgccggatttggtgctctgttacgtatgccccctcctgccgccaaattagcgggcaaaggttccctcgagcaccaccaccaccaccactga

SEQ ID NO: 87 - protein, 362 aa, Artificial Sequence
  Description of Artificial Sequence: Synthetic polypeptide
LPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPP

SEQ ID NO: 88 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAMIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 89 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 90 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFLAKVHAGWGALLRMPPPAAKLAGKGSLEHHHHHH

SEQ ID NO: 91 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 92 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLYYEHPGSLLFDELLFLAKVHAGFGALLRMPPPAAKLAGKGSLEHHHHHH

SEQ ID NO: 93 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 94 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 95 - protein, 408 aa, Artificial Sequence; identical to SEQ ID NO: 88
  Description of Artificial Sequence: Synthetic polypeptide

SEQ ID NO: 96 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 97 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGWGALLRMPPPAAKLAGKGSLEHHHHHH

SEQ ID NO: 98 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMIHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 99 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 100 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 101 - protein, 408 aa, Artificial Sequence; identical to SEQ ID NO: 91
  Description of Artificial Sequence: Synthetic polypeptide

SEQ ID NO: 102 - protein, 408 aa, Artificial Sequence; identical to SEQ ID NO: 92
  Description of Artificial Sequence: Synthetic polypeptide

SEQ ID NO: 103 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGWGALLRMPPPAAKLAGKGSLEHHHHHH

SEQ ID NO: 104 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 105 - protein, 408 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 106 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 107 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 108 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 109 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 110 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGWGALLRMPPPAAKLAGKGSLEHHHHHH

SEQ ID NO: 111 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGVLLFDELLFLAKVHAGFGALLRMPPPAAKLAGKGSLEHHHHHH

SEQ ID NO: 112 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASLFTLLLAREMGDQQLFDQLLNHLEPPAKPSIVSASLRYEHPGGLLFDELLFLAKVHAGFGALLRMPPPAAKLAGKGSLEHHHHHH

SEQ ID NO: 113 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIALYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 114 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYALGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGKGSLEHHHHHH

SEQ ID NO: 115 - protein, 382 aa, Artificial Sequence; identical to SEQ ID NO: 114
  Description of Artificial Sequence: Synthetic polypeptide

SEQ ID NO: 116 - protein, 382 aa, Artificial Sequence; identical to SEQ ID NO: 114
  Description of Artificial Sequence: Synthetic polypeptide

SEQ ID NO: 117 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGVVLFDELLFLAKVHAGFGALLRMPPPAAKLAGKGSLEHHHHHH

SEQ ID NO: 118 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYYSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGWGALLRMPPPAAKLAGKGSLEHHHHHH

SEQ ID NO: 119 - protein, 382 aa, Artificial Sequence; identical to SEQ ID NO: 110
  Description of Artificial Sequence: Synthetic polypeptide

SEQ ID NO: 120 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLVLAREMGDQQLFDQLLNHLEPPAKPSIVSASLRYEHPGSLLFDELLFLAKVHAGWGALLRMPPPAAKLAGKGSLEHHHHHH

SEQ ID NO: 121 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEMAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLVLAREMGDQQLFDQLLNHLEPPAKPSIVSASLRYEHPGSLLFDELLFLAKVHAGWGALLRMPPPAAKLAGKGSLEHHHHHH

SEQ ID NO: 122 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIALYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGWGALLRMPPPAAKLAGKGSLEHHHHHH

SEQ ID NO: 123 - protein, 382 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASLFTLLLAREMGDQQLFDQLLNHLEPPAKPSIVSASLRYEHPGGLLFDELLFLAKVHAGFGALLRMPPPAAKLAGKGSLEHHHHHH

SEQ ID NO: 124 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSLMKCKRVWGDWEEDGFGTDPIEKENIMYSGHLNLMYGLYQLVTGSRRYEAEHAHLTRIIWDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFDQLLNHLEPPAKPSIVSAILRYEHPGSLLFDELLFFAKVHAGFGALLRMPPPAAKLAGK

SEQ ID NO: 125 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSLMKCKRVWGDWEEDGFGTDPIEKENIMYSGHLNLMYGLYQLVTGSRRYEAEHAHLTRIIWDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFDQLLNHLEPPAKPSIVSAILRYEHPGSLLFDELLFFAKVHAGFYALLRMPPPAAKLAGK

SEQ ID NO: 126 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSLMKCKRVWGDWEEDGFGTDPIEKENIMYSGHLNLMYGLYQLVTGSRRYEAEHAHLTRIIWDEIAANPFAGIVCEPDNYFVQCNSVAYLSLWVYDRLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFQQLLNHLEPPAKPSIVSAILRYEHPGSLLFDELLFFAKVHAGFYALLRMPPPAAKLAGK

SEQ ID NO: 127 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDMLHGTDYTAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSAILFYEHPMSLLFMELLFFAKVHAGFYALLRMPPPAAKLAGK

SEQ ID NO: 128 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDMLHGTDYTAATRAWLDFIQKDLIDPERGAFYLSYHPESGAVKPWISAYTTAWTLAFVHGMDPAFSERYYPRFKQTFVEVYDEGRKARVWETAGTDDADGGVGLASLFTLLLAREMGDQQLFHWLLNHLEPPAKPSIVSASLYYEHPMSLLFMELLFFAKVHAGFYALLRMPPPAAKLAGK

SEQ ID NO: 129 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDVLHGTDYTAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSASLYYEHPMSLLFMELLFFAKVHAGFYALLRMPPPAAKLAGK

SEQ ID NO: 130 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDMLHGTDYTAATRAWLDFIQKDLIDPERGAFYLSYHPESGAVKPWISAYTTAWTLAFVHGMDPAFSERYYPRFKQTFVEVYDEGRKARVWETAGTDDADGGVGLASLFTLLLAREMGDQQLFHWLLNHLEPPAKPSIVSAILFYEHPMSLLFMELLFFAKVHAGFYALLRMPPPAAKLAGK

SEQ ID NO: 131 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDQLHGTDYRAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSAILFYEHPMSLLFMELLFFAKVHAGFYALLRMPPPAAKLAGK

SEQ ID NO: 132 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDVLHGTDYTAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSAILFYEHPMSLLFMELLFFAKVHAGFGALLRMPPPAAKLAGK

SEQ ID NO: 133 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDQLHGTDYTAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSAILFYEHPMSLLFMELLFFAKVHAGFYALLRMPPPAAKLAGK

SEQ ID NO: 134 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDVLHGTDYTAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSAILFYEHPMSLLFMELLFLAKVHAGFYALLRMPPPAAKLAGK

SEQ ID NO: 135 - protein, 398 aa, Artificial Sequence
  Description of Artificial Sequence: Synthetic polypeptide
MMRFTLKTTAIVSAAALLAGFGPPPRAAELPPGLLATTEDYFAQYAKQAVTPDVMAQLAYMNYIDFISPFYSRGCSFEAWWLMHVPQRVIKYSIAFYAYGLASVALIWPKLRALAGHDLDIAVSLMKCKWVWGDWEEDGFGTVPIEKYNIMYAGHLNLMYGLYMLVTGSRRYEAEHAHLTRIIWDEIAAHPFAGIVCEPDNYFVQCNSVAYLSLWVYDMLHGTDYTAATRAWLDFIQKDLIDPERGAFYLSYHPESGAVKPWISAYTTAWTLAFVHGMDPAFSERYYPRFKQTFVEVYDEGRKARVRETAGTDDADGGVGLASLFTLLLAREMGDQQLFHWLLNHLEPPAKPSIVSASLYYEHPMSLLFMELLFFAKVHAGFYALLRMPPPAAKLAGK

SEQ ID NO: 136 - protein, 398 aa, Artificial Sequence
  Description of Artificial Sequence: Synthetic polypeptide
MMRFTLKTTAIVSAAALLAGFGPPPRAAEQPLGRLATTERYFKQQNLQTVTPDVMAQLAYMNYIDFISPFYSRGCSFEAWELRHMPQRVIKYSIAFYAYGLASVALIDPNLRALAGHDLDIAVSQMLCKRVWGDWEEDGFGTQPIQQENIMYKGHLNLMYGLYQLVTTSRRYEQEHAKLTRIIYQEIMKNPFAGIVCEPDNYFVQCNSVAYLSLWVYDRLHGTNYRMTLRNWLRFIQRDLIDPNRGAFYLSYHPESGAVKPWISAYTTAWTLAMVHGMDPAFSRRYYPRFVRTFVEVYDNGRKARVRETWGTDDANGGVGLASAFTLLLAREMGDQQLFRQLLRHLEPPARPQIVSARLRYENPQSLLFDELLFLAKVHTGFENLLRMPPPAAKLAGK

SEQ ID NO: 137 - protein, 398 aa, Artificial Sequence
  Description of Artificial Sequence: Synthetic polypeptide
MMRFTLKTTAIVSAAALLAGFGPPPRAAEQPQGRLATTEQYFKQQNLQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTQPIERENIMYKGHLNLMYGLYQLVTTSRRYEQEHAKLTRIIYDEIMKNPFAGIVCEPDNYFVQCNSVAYLSLWVYDRLHGTNYRMALRNWLDFIQKDLIDPNRGAFYLSYHPESGAVKPWISAYTTAWTLAYVHGMDPAFSRRYYPRFVRTFVEVYDNGRKARVRETWGTDDANGGVGLASAFTLLLAREMGDQQLFRQLLRHLEPPARPTIVSARLRYENPQSLLFDELLFLAKVHTGFENLLRMPPPAAKLAGK

SEQ ID NO: 138 - protein, 398 aa, Artificial Sequence
  Description of Artificial Sequence: Synthetic polypeptide
MMRFTLKTTAIVSAAALLAGFGPPPRAAEQPTGRLATTEQYFKQQNKQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTDPIERENIMYKGHLNLMYGLYQLVTTSRRYEQEHAKLTRIIYREIMKNPFAGIVCEPDNYFVQCNSVAYLSLWVYDRLHGTNYRMALRNWLDFIQKDLIDPNRGAFYLSYHPESGAVKPWISAYTTAWTLAYVHGMDPAFSRRYYPRFVRTFVEVYDNGRKARVRETWGTDDANGGVGLASAFTLLLAREMGDQQLFRQLLNHLEPPARPLIVSARLRYENPQSLLFDELLFLAKVHTGFENLLRMPPPAAKLAGK

SEQ ID NO: 139 - protein, 398 aa, Artificial Sequence
  Description of Artificial Sequence: Synthetic polypeptide
MMRFTLKTTAIVSAAALLAGFGPPPRAAEQPNGRLATTEQYFKQQNKQTVTPDVMAQLAYMNYIDFISPFYSRGCSFEAWRLRHTPQRVIKYSIAFYAYGLASVALIDPNLRALAGHDLDIAVSQMLCKRVWGDWEEDGFGTRPIERENIMYKGHLNLMYGLYQLVTTSRRYENEHAYLTRIIYQEIVKNPFAGIVCEPDNYFVQCNSVAYLSLWVYDRLHGTNYRMALRRWLRFIQRDLIDPNRGAFYLSYHPESGAVKPWISAYTTAWTLAMVHGMDPAFSRRYYPRFVRTFVEVYDNGRKARVRETWGTDDANGGVGLASAFTLLLAREMGDQQLFRQLLNHLEPPARPTIVSARLRYENPQSLLFDELLFLAKVHTGFENLLRMPPPAAKLAGK

SEQ ID NO: 140 - protein, 398 aa, Artificial Sequence
  Description of Artificial Sequence: Synthetic polypeptide
MMRFTLKTTAIVSAAALLAGFGPPPRAAEQPLGRLATTEQYFKQQNKQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTRPIEQENIMYKGHLNLMYGLYQLVTTSRRYEQEHAYLTRIIYREIMKNPFAGIVCEPDNYFVQCNSVAYLSLWVYDRLHGTNYRMALRNWLDFIQKDLIDPNRGAFYLSYHPESGAVKPWISAYTTAWTLAYVHGMDPAFSRRYYPRFVRTFVEVYDNGRKARVRETWGTDDANGGVGLASAFTLLLAREMGDQQLFRQLLRHLEPPARPTIVSARLRYENPQSLLFDELLFLAKVHTGFENLLRMPPPAAKLAGK

SEQ ID NO: 141 - protein, 398 aa, Artificial Sequence
  Description of Artificial Sequence: Synthetic polypeptide
MMRFTLKTTAIVSAAALLAGFGPPPRAAEQPQGRLATTEQYFQQQNKQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTQPIERENIMYKGHLNLMYGLYQLVTTSRRYEQEHAKLTRIIYREIMKNPFAGIVCEPDNYFVQCNSVAYLSLWVYDRLHGTNYRMTLRRWLRFIQRDLIDPERGAFYLSYHPESGAVKPWISAYTTAWTLAMVHGMDPAFSRRYYPRFVRTFVEVYDNGRKARVRETWGTDDANGGVGLASAFTLLLAREMGDQQLFRQLLRHLEPPARPQIVSARLRYENPQSLLFDELLFLAKVHTGFENLLRMPPPAAKLAGK

SEQ ID NO: 142 - protein, 398 aa, Artificial Sequence
  Description of Artificial Sequence: Synthetic polypeptide
MMRFTLKTTAIVSAAALLAGFGPPPRAAEQPQGRLATTERYFKQQNLQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTDPIERENIMYKGHLNLMYGLYQLVTTSRRYEQEHAKLTRIIYDEIMKNPFAGIVCEPDNYFVQCNSVAYLSLWVYDRLHGTNYRMALRNWLQFIQRDLIDPQRGAFYLSYHPESGAVKPWISAYTTAWTLAYVHGMDPAFSRRYYPRFVRTFVEVYDNGRKARVRETAGTDDANGGVGLASAFTLLLAREMGDQQLFRQLLRHLEPPARPTIVSARLRYENPQSLLFDELLFLAKVHTGFENLLRMPPPAAKLAGK

SEQ ID NO: 143 - protein, 398 aa, Artificial Sequence
  Description of Artificial Sequence: Synthetic polypeptide
MMRFTLKTTAIVSAAALLAGFGPPPRAAEQPQGRLATTEQYFKQQNLQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTQPIERENIMYKGHLNLMYGLYQLVTTSRRYEQEHAKLTRIIYQEIMKNPFAGIVCEPDNYFVQCNSVAYLSLWVYDRLHGTNYRMALRNWLDFIQKDLIDPNRGAFYLSYHPESGAVKPWISAYTTAWTLAMVHGMDPAFSRRYYPRFVRTFVEVYDNGRKARVRETWGTDDANGGVGLASAFTLLLAREMGDQQLFRQLLRHLEPPARPTIVSARLRYENPQSLLFDELLFLAKVHTGFENLLRMPPPAAKLAGK

SEQ ID NO: 144 - protein, 398 aa, Artificial Sequence
  Description of Artificial Sequence: Synthetic polypeptide
MMRFTLKTTAIVSAAALLAGFGPPPRAAEQPQGRLATTEQYFKQQNKQTVTPDVMAQLAYMNYIDFISPFYSRGCSFEAWRLRHMPQRVIKYSIAFYAYGLASVALIDPNLRALAGHDLDIAVSQMLCKRVWGDWEEDGFGTQPIEQENIMYKGHLNLMYGLYQLVTTSRRYEQEHAKLTRIIYREIVKNPFAGIVCEPDNYFVQCNSVAYLSLWVYDRLHGTNYRMTLRNWLRFIQRDLIDPNRGAFYLSYHPESGAVKPWISAYTTAWTLAYVHGMDPAFSRRYYPRFVRTFVEVYDNGRKARVRETWGTDDANGGVGLASAFTLLLAREMGDQQLFRQLLRHLEPPARPTIVSARLRYENPQSLLFDELLFLAKVHTGFENLLRMPPPAAKLAGK

SEQ ID NO: 145 - protein, 398 aa, Artificial Sequence
  Description of Artificial Sequence: Synthetic polypeptide
MMRFTLKTTAIVSAAALLAGFGPPPRAAEQPQGLLATTYMYFMQLAWQAVTPDVMAMLAYMNYIDFISPFYSRGCSFEAWRLRHVPQRVIKYSIAFYAYGLASVALIWPNLRALAGHDLDIAVSLMLCPVVWGDWEEDGFGTVPIKFYNIMYAGHLNLMYGLYMLVTTSTRYRQEFQKLTWIIYWWIMLHPFAGIVCEPDNYFVQCNSVAYLSLWVYDVLHGMNFVMALRMWLRFIQFDLIHPEWGAFYLSYHPESGAVKPWISAYTTAWTLAFVHGMKPAFSRKYYPRFVRTFVEVYNNGQKARVWETWGTTDANGGVGLASLFALLLAREMGDMQLFTWLLRHLEPPARPTIVSATLFYINPQSLLFSELLFFAKVHTGFENLLKMPPPAAKLAGK

SEQ ID NO: 146 - protein, 398 aa, Artificial Sequence
  Description of Artificial Sequence: Synthetic polypeptide
MMRFTLKTTAIVSAAALLAGFGPPPRAAEQPQGLLATTYKYFMQLAWQAVTPDVMAMLAYMNYIDFISPFYSRGCSFEAWRLRHVPQRVIKYSIAFYAYGLASVALIWPNLRALAGHDLDIAVSLMLCKVVWGDWEEDGFGTVPIYWYNIMYAGHLNLMYGLYMLVTTSYRYRQEFQKLTQIIYQMIMKHPFAGIVCEPDNYFVQCNSVAYLSLWVYDQLHGMRYVMALRNWLKFIQMDLIHPEWGAFFLSYHPESGAVKPWISAYTTAWTLAFVHGMDPAFSRQYYPRFVRTFVEVYNNGQKARVRETWGTTDANGGVGLASLFALLLAREMGDMQLFTWLLRHLEPPARPVIVSATLFYINPQSLLFSELLFFAKVHTGFENLLKMPPPAAKLAGK

SEQ ID NO: 147 - protein, 398 aa, Artificial Sequence
  Description of Artificial Sequence: Synthetic polypeptide
MMRFTLKTTAIVSAAALLAGFGPPPRAAEQPQGLLATTYMYFMQYAWQTVTPDVMAMLAFMNYIDFISPFYSRGCSFEAWRLRHVPQRVIKYSIAFYAYGLASVALIDPNLRALAGHDLDIAVSLMLCKVVWGDWEEDGFGTVPIQRYNIMYAGHLNLMYGLYMLVTTSTRYRQEFAKLTWIIYWEIMKHPFAGIVCEPDNYFVQCNSVAYLSLWVYDVLHGTNFTMALRMWLRFIQFDLINPNWGAFYLSYHPESGAVKPWISAYTTAWTLAFVHGMDPAFSRKYYPRFVRTFVEVYNNGQKARVWETWGTTDANGGVGLASLFALLLAREMGDMQLFAWLLRHLEPPARPTIVSATLYYINPQSLLFAELLFFAKVHTGFENLLKMPPPAAKLAGK

SEQ ID NO: 148 - protein, 398 aa, Artificial Sequence
  Description of Artificial Sequence: Synthetic polypeptide
MMRFTLKTTAIVSAAALLAGFGPPPRAAEQPQGLLATTEQYFKQLAKQAVTPDVMAMLAFMNYIDFISPFYSRGCSFEAWKLRHVPQRVIKYSIAFYAYGLASVALIWPNLRALAGHDLDIAVSLMLCKVVWGDWEEDGFGTVPIKFYNIMYAGHLNLMYGFYMLVTTSTRYRNEFQKLTWIIYWEIMKHPFAGIVCEPDNYFVQCNSVAYLSLWVYDVLHGMNFTMALRMWLRFIQFDLIHPEWGAFYLSYHPESGAVKPWISAYTTAWTLAFVHGMDPAFSRKYYPRFVRTFVEVYNNGQKARVWETWGTTDANGGVGLASLFALLLAREMGDMQLFTWLLRHLEPPARPVIVSATLFYINPQSLLFAELLFFAKVHTGFENLLKMPPPAAKLAGK

SEQ ID NO: 149 - protein, 398 aa, Artificial Sequence
  Description of Artificial Sequence: Synthetic polypeptide
MMRFTLKTTAIVSAAALLAGFGPPPRAAEQPQGLLATTEQYFKQYQKQAVTPDVMAMLAFMNYIDFISPFYSRGCSFEAWRLMHVPQRVIKYSIAFYAYGLASVALIWPNLRALAGHDLDIAVSLMLCKVVWGDWEEDGFGTVPIYWYNIMYAGHLNLMYGLYMLVTTSTRYRQEHQKLTWIIYWWIMLHPFAGIVCEPDNYFVQCNSVAYLSLWVYDVLHGMNFTMALRMWLRFIQFDLIHPEWGAFYLSYHPESGAVKPWISAYTTAWTLAMVHGMDPAFSRKYYPRFVRTFVEVYNNGQKARVRETWGTTDANGGVGLASLFALLLAREMGDMQLFTWLLRHLEPPARPVIVSATLFYINPQSLLFSELLFWAKVHTGWEMLLKMPPPAAKLAGK

SEQ ID NO: 150 - protein, 398 aa, Artificial Sequence
  Description of Artificial Sequence: Synthetic polypeptide
MMRFTLKTTAIVSAAALLAGFGPPPRAAEQPQGLLATTERYFKQYQLQTVTPDVMAMLAFMNYIDFISPFYSRGCSFEAWRLRHVPQRVIKYSIAFYAYGLASVALIWPNLRALAGHDLDIAVSLMLCKVVWGDWEEDGFGTVPIYWYNIMYAGHLNLMYGLYMLVTTSTRYRNEFAKLTRIIYRMIMKHPFAGIVCEPDNYFVQCNSVAYLSLWVYDVLHGTNFTMALRNWLDFIQRDLINPNWGAFYLSYHPESGAVKPWISAYTTAWTLAFVHGMKPAFSRKYYPRFVRTFVEVYNNGQKARVWETWGTTDANGGVGLASLFALLLAREMGDMQLFTWLLRHLEPPARPTIVSAILFYINPQSLLFAELLFFAKVHTGFENLLKMPPPAAKLAGK

SEQ ID NO: 151 - protein, 398 aa, Artificial Sequence
  Description of Artificial Sequence: Synthetic polypeptide
MMRFTLKTTAIVSAAALLAGFGPPPRAAEQPQGLLATTEQYFKQYAKQTVTPDVMAMLAFMNYIDFISPFYSRGCSFEAWRLRHVPQRVIKYSIAFYAYGLASVALIDPNLRALAGHDLDIAVSLMLCKVVWGDWEEDGFGTVPIERYNIMYAGHLNLMYGLYMLVTTSTRYRQEFAKLTWIIYWWIMLHPFAGIVCEPDNYFVQCNSVAYLSLWVYDVLHGMNFVMALRMWLRFIQRDLIHPEWGAFFLSYHPESGAVKPWISAYTTAWTLAFVHGMKPAFSRKYYPRFVRTFVEVYNNGQKARVRETWGTTDANGGVGLASLFALLLAREMGDMQLFTWLLRHLEPPARPTIVSATLFYINPQSLLFAELLFFAKVHTGFENLLKMPPPAAKLAGK

SEQ ID NO: 152 - protein, 398 aa, Artificial Sequence
  Description of Artificial Sequence: Synthetic polypeptide
MMRFTLKTTAIVSAAALLAGFGPPPRAAEQPQGLLATTYRYFMQLAWQTVTPDVMAMLAFMNYIDFISPFYSRGCSFEAWRLRHVPQRVIKYSIAFYAYGLASVALIDPNLRALAGHDLDIAVSLMLCKVVWGDWEEDGFGTVPIKFYNIMYAGHLNLMYGLYMLVTTSTRYRQEFAYLTLIIYWEIMKHPFAGIVCEPDNYFVQCNSVAYLSLWVYDVLHGTNFTMALRRWLRFIQWDLINPNWGAFYLSYHPESGAVKPWISAYTTAWTLAFVHGMDPAFSRKYYPRFVRTFVEFYNNGQKARVRETWGTTDANGGVGLASLFALLLAREMGDMQLFTYLLRHLEPPARPTIVSATLFYINPQSLLFAELLFFAKVHTGFENLLKMPPPAAKLAGK

SEQ ID NO: 153 - protein, 398 aa, Artificial Sequence
  Description of Artificial Sequence: Synthetic polypeptide
MMRFTLKTTAIVSAAALLAGFGPPPRAAEQPQGLLATTEMYFKQYALQTVTPDVMAMLAFMNYIDFISPFYSRGCSFEAWRLRHVPQRVIKYSIAFYAYGLASVALIDPNLRALAGHDLDIAVSLMLCKVVWGDWEEDGFGTVPIKFYNIMYAGHLNLMYGLYMLVTTSYRYRQEFQKLTWIIYWEIMKHPFAGIVCEPDNYFVQCNSVAYLSLWVYDVLHGMNFTMALRMWLRFIQFDLIHPEWGAFYLSYHPESGAVKPWISAYTTAWTLAFVHGMDPAFSRKYYPRFVRTFVEVYNNGQKARVRETWGTTDANGGVGLASLFALLLAREMGDMQLFAWLLRHLEPPARPVIVSAILFYINPQSLLFAELLFFAKVHTGFEMLLKMPPPAAKLAGK

SEQ ID NO: 154 - protein, 398 aa, Artificial Sequence
  Description of Artificial Sequence: Synthetic polypeptide
MMRFTLKTTAIVSAAALLAGFGPPPRAAETPEGLLGTTEEYFKLYERNRVHDSVMAALAWLNYIDFIAPFYSRGCSFEAFRLWGIPQRVKKYLIAFLAYALASIALIDPDLRALAGHDLDIAIAQMLCPEIWGDWKEDGFGEVPIKFYNIMYAAHLAAMYALYMMVTTSYRYRERLEKLIEILEKLWKWHPFGGVVCEPDNYFVQCAAVMHWAWRLFDWLHGTRKDMAKRDYRRFIRDGLINEDKGSFYLSYHPESGAVKPWLSAYATAWALAFHHGMFPEFAREFYPRFKDTFVEVTNNGKKARVWETIGTTDADGGVGLAALFALLLAREMGDKELFTWLLRYLEPPARPIIVSAILFFINPLSLLFPALLLWAWVHTGHENLEKMPPPAAKLAGK

SEQ ID NO: 155 - protein, 398 aa, Artificial Sequence
  Description of Artificial Sequence: Synthetic polypeptide
MMRFTLKTTAIVSAAALLAGFGPPPRAAETPEELMATTEEYFKEYERNRVTPWVMYLLAWWNYIDFIAEFYSRGCSFEYFWLMGVPQRVVKYALAFAAYGLASVALIWPALRALAGHDLDIAIALMLCPFVWGDWTEDGFGTVPIKWGNIMYAAHLLAMYALYMLVTTSYRYRERMEKLWKIMMELFRRHPFGGVTCEPDNYFVQCAAVMFFAWKLFDALHGTNGDRAMELYFKFIEDGLIWPDWGAFFLSYHPESGAVKPWVSAYATAWALAFHHGMWPEFARKYYPRFVRTFVEVTNGGKKARVRETWGTTDPNGGVGLASLFALLLAREMGDKDLFAWLLRYLEPPARPITVSAIGFYINPLSLLFHHLLFWAFVHTGHEMLIRMPPPAAKLAGK

SEQ ID NO: 156 - protein, 398 aa, Artificial Sequence
  Description of Artificial Sequence: Synthetic polypeptide
MMRFTLKTTAIVSAAALLAGFGPPPRAAEDPDGLLGTTEEYFKLYEWNRVHDSVMAMLAWLNYIDFIAAFYSRGCSFEYWWIMGVPQRVVKYSIAFLAYGLASVALIWPNLRALAGHDLDIAIALMLCPYVWGDWKEDGFGEDPIEWGNIMYAAHLLAMYALYMFVTTSERYRERMEELWRRMILLFRWHPFAGVFCEPDNYFVQCVAVMAFAWKLFDGLHGTNGDYFSGNIRDFIKDGLINEDKGAFYLSYHPESGAVKPWLSAYTTAWALAFFHGLDPSFAREFYPRFKNTFVEVFNGGDKARVRETIGTTDPNGGVGLASLFALLLAREMGDKDLFRWLLRYLEPPANPIIVSATLYFINPLSLLFHELLFFAWVHTGFLNLILMPPPAAKLAGK

SEQ ID NO: 157 - protein, 398 aa, Artificial Sequence
  Description of Artificial Sequence: Synthetic polypeptide
MMRFTLKTTAIVSAAALLAGFGPPPRAAETPEELLGTVEEFFKEYEENRVHDSVMAAIAWWNYIDFIALFYSRGCSFEYFRLMGVPQRVKKYALAFAAYALASIALIWPNLRALAGHDLDIAIALMLCPEVWGDWKEDGFGEVPIEWGNIMYSAHLAAMYALYMLVTDSDRYRERAKELGERHMEEFRRHPVGGAPCEPDNYFVQCQAVMHMAWKLFDFLFGWNWDRSSGDWLRFIQDGLINPDKGSFYLSYHRESGAVKPWLSAYATAWALAIIHGMDPAFARQYAPRFWRTFGEVFNGGDKARVWETIGTTDANGGVGLASLFALVLARELGYKEWFGWLLRFLEPPARPIIVSAILFFINPLSLLFHHLLAWAWVHTGWLMLILMPPPAAKLAGK

SEQ ID NO: 158 - protein, 398 aa, Artificial Sequence
  Description of Artificial Sequence: Synthetic polypeptide
MMRFTLKTTAIVSAAALLAGFGPPPRAAEDPDGLLATTEEYFKEYERNEVTPDVMAALAWFNYIDFIALFYSRGCSFEWFWLMGVPQRVVKYALAFAAYGLASVALIWPNLRALAGHDLDIAIALMLCPYVWGDWTEDGFGTVPIERYNIMYSAHLLAMYGLYELVTTSERYRERREELRERHIELWRRHPFGGVMCEPDNYFVQCAAVMWMAWKIADVLDGENRDYFNGRDREFIEDGLIHEEWGAFYLSYHPESGAVKPWISAYTTAWALAVFHGMDPSFARKYYPRFVETFVVVFNGGDKARVRETWGTTDPNGGVGLASLFALVLAREMGDKDLFAWLLRFLEPPARPIIVSAILYYIGPLSLLFPMLLFWAKVHTGWENLLKMPPPAAKLAGK

SEQ ID NO: 159 - protein, 398 aa, Artificial Sequence
  Description of Artificial Sequence: Synthetic polypeptide
MMRFTLKTTAIVSAAALLAGFGPPPRAAETPEELLGTTDEFFKLYEENRVHDSVMALLAWWNYIDFIALFYSRGCSFEYHWLMGVPQRVVKYALAFAAYALASIALIWPNLRALAGHDLDIAIALMLCPFVWGDWKEDGFGEVPIEWGNIMYSAHLLAMYGLYMLVTTSYRYRERFEELWRRHQELWQRHPFGGVTCEPDNFFVQCAAVMWFAWKIWDVLHGGNGDHFDRRDREFIEDGLIDPDRGAFYLSYHPESGAVKPWLSAYTTAWALAFFHGLDPSFARKYYPRFVRTFVEVTNNGKKARVWETIGTTDPNGGVGLASLFALLLAREMGDKNLFAWLLRYLEPPARPIIVSATLYFIGPLSLLFHFLLGFAWVHTGFENLLKMPPPAAKLAGK

SEQ ID NO: 160 - protein, 398 aa, Artificial Sequence
  Description of Artificial Sequence: Synthetic polypeptide
MMRFTLKTTAIVSAAALLAGFGPPPRAAETPEGLLGRTEEFFREYRRNRVHDSVMAAIAWLNYIDFIAAFYSRGCSFEFWWLQGVPQRVVKYSIAFLAYALASIALIWPNLRALAGHDLDIAIALMLCPFVWGDWKEDGFGEVPYEWGNIMWAAHALAMYALYMLVTDSERYRERMEELWRRMMELAKRHPVGGVFCEPDNFFVQCMAVMYFAWALFDELHGTNGDMAMGDFFRFILDGLIDPDRGSFYLSYHRESGAVKPWLSAYTTAWALAFIHGMWPELARKYYPRFVRTFVEVTNGGRKARVWETIGTTDPDGGVGLAALFALLLAREMGDMDLFRWLLRYLEPPANPIIVSAILFYDGPLSLLFWELLLFAKVHTGFENLRRMPPPAAKLAGK

SEQ ID NO: 161 - protein, 398 aa, Artificial Sequence
  Description of Artificial Sequence: Synthetic polypeptide
MMRFTLKTTAIVSAAALLAGFGPPPRAAETPEGRLATTEEFFKEREKNRVTPAVMALLAWWNYIDFIAEFYSRGCSFEYFWLMGVPQRVVKYALAFAAYALASIAIIWPNLRALAGHDLDIAIALMLCPFVWGDWKEDGFGEHPLEWGNIMYAAHLLAMYALYMMVTTSDRYRDRAELLRDWVERLIRRHPFGGITCEPDNYFVQCAAVAYMALKFMDWLHGENKDYSSGNWLEFIRDGLIDPSRGSFYLSYHPESGAVKPWLSAYATAWALAVIHGMDPSFAREFYPRFVRTFVEVFNGGKKARVWETIGTTDADGGVGLAALFALVLAREMGDKDLFAWLERYLVEPARPIIVSAILFFINPLSLLFHHLWGWAAVHTGFEQLRRMPPPAAKLAGK

SEQ ID NO: 162 - protein, 398 aa, Artificial Sequence
  Description of Artificial Sequence: Synthetic polypeptide
MMRFTLKTTAIVSAAALLAGFGPPPRAAETPEELLSTTEEEFKELERNRVSPAVMAMLAWWNYIDFIAPFYSRGCSFEAWWLWGVPQRVVKYSIAFMAYALASIAIIWPALRALAGHDLDIAIALMLCPYVWGDWKEDGFGTVPIEWGNIMYAAHLALMYGLYMMVTTSYRYRERFEELARRLYELIMRHPFGGVFCEPDNYFVQCAAVMYMALKAFDWLHGTNYDLAMGDWLRFIQDGLIHPEWGAFFLSYHPESGAVKPWISAYTTAWALAIIHGLWPLFARWYYPRFVETFVEFFNNGDKARVWETWGTTDPNGGVGLAALFALVLAREMGDKDLFTFLRRYLEPPARPIIVSAILFFINPLSLLFHDLLAWAWVHTGWEQILKMPPPAAKLAGK

SEQ ID NO: 163 - protein, 398 aa, Artificial Sequence
  Description of Artificial Sequence: Synthetic polypeptide
MMRFTLKTTAIVSAAALLAGFGPPPRAAELPPGRLATTEDYFAAQAKQAVTPDIMAQLAYLNYIDFISPFYSRGCSFEAWELKHTPQRVIKYSLAFLGYGLAAVALIDPKLRALAGHDLDIAISKMKCKRVWGDWEEDGFGTDPIEKENIMYSAHLALLYGLYQLVTGSRRYEAEFAHLIRIHHDEIAANPFAGVVCEPDNYFVQCAAVMYMALWVYDRLHGTDYRASTRAWLDFIQKDLIDPERGAFYLSYHPESGAVKPWISAYTTAWALAVIHGMDPAFAERYYPRFKQTFVEVYDEGRKARVRETAGTDDADGGVGLASLFALVLAREMGDQQLFDQLLNHLEPPAKPSIVSASLRYEHPGSLLFDELLFWAKVHAGWGALLRMPPPAAKLAGK

SEQ ID NO: 164 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYHNYIDFISPFYSRGCSFEAWELKHTPQRVIKYSIAFMAYGLAAVALIDPKLRALAGHDLDIAISKMKCKRVWGDWEEDGFGTDPIEKENIMYAAHLAAMYGLYQLVTGSRRYEAEFAHLIRILHDEIAANPFAGVVCEPDNYFVQCAAVMFFALWVYDRLHGTDYRASTRAWLDFIQKDLIDPERGAFYLSYHPESGAVKPWISAYTTAWALAFIHGMDPAFAERYYPRWKQTFVEVYDEGRKARVRETAGTDDADGGVGLASLFGLLLAREMGDQQLFDQLLNHLEPPAKPSIVSASLRYEHPGSLLFDELLFWAKVHAGHGALLRMPPPAAKLAGK

SEQ ID NO: 165 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYAAHLAAMYGLYQLVTGSRRYEAEFAHLIRILHDEIAANPFAGVVCEPDNYFVQCAAVMYFALWIYDRLHGTDYRAATRAWLDFIQKDLIDPERGAFYLSYHPESGAVKPWISAYTTAWALAFIHGMDPAFAERYYPRFKQTFVEVYDEGRKARVRETAGTDDADGGVGLAALFALLLAREMGDQQLFDQLLNHLEPPAKPSIVSASLRYEHPGSLLFDELLFWAKVHAGHGALLRMPPPAAKLAGK

SEQ ID NO: 166 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYAAHLLAMYALYQLVTGSRRYEAEMAHLARIMHDEIAANPFAGVVCEPDNYFVQCAAVMFFALWLYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASLFALLLAREMGDQQLFDQLLNHLEPPAKPSIVSASLRYEHPGSLLFDELLFFAKVHAGFGALLRMPPPAAKLAGK

SEQ ID NO: 167 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYSAHLAAMYGLYQLVTGSRRYEAEFAHLIRIHHDEIAANPFAGVVCEPDNYFVQCAAVMYFALWIYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLAALFALLLAREMGDQQLFDQLLNHLEPPAKPSIVSASLRYEHPGSLLFDELLFWAKVHAGHGALLRMPPPAAKLAGK

SEQ ID NO: 168 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFISPFYSRGCSFEAWELKHTPQRVIKYSLAFLAYGLAAVALIDPKLRALAGHDLDIAISKAKCKRVWGDWEEDGFGTDPIEKENIMYSAHLALMYGLYQLVTGSRRYEAEFAHLIRIHHDEIAANPFAGVVCEPDNYFVQCAAVMYMALWVYDRLHGTDYRASTRAWLDFIQKDLIDPERGAFYLSYHPESGAVKPWISAYATAWALAIIHGMDPAFAERYYPRFKQTFVEVYDEGRKARVRETAGTDDADGGVGLAALFALVLAREMGDQQLFDQLLNHLEPPAKPSIVSASLRYEHPGSLLFDELLFWAKVHAGWGALLRMPPPAAKLAGK

SEQ ID NO: 169 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYAAHLAAMYGLYQLVTGSRRYEAEFAHLIRILHDEIAANPFAGVVCEPDNFFVQCAAVMFFALWVYDRLHGTDYRAFTRAFLDFIQKDLIDPERGAFYLSYHPESGAVKPWISAYATAWALAFFHGMDPAFAERYYPRFKQTFVEVYDEGRKARVRETAGTDDADGGVGLAALFALLLAREMGDQQLFDQLLNHLEPPAKPSIVSASLRYEHPGSLLFDELLFWAKVHAGHGALLRMPPPAAKLAGK

SEQ ID NO: 170 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFISPFYSRGCSFEAWELKHTPQRVIKYSIAFLAYALAAVALIDPKLRALAGHDLDIAISKAKCKRVWGDWEEDGFGTDPIEKENIMYSAHLAAMYGLYQLVTGSRRYEAEFAHLIRIHHDEIAANPFAGVVCEPDNYFVQCAAVMYFALWIYDRLHGTDYRAATRAWLDFIQKDLIDPERGAFYLSYHPESGAVKPWISAYTTAWALAFIHGMDPAFAERYYPRFKQTFVEVYDEGRKARVRETAGTDDADGGVGLASLFALLLAREMGDQQLFDQLLNHLEPPAKPSIVSASLRYEHPGSLLFDELLFWAKVHAGHGALLRMPPPAAKLAGK

SEQ ID NO: 171 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYHNYIDFISPFYSRGCSFEAWELKHTPQRVIKYSIAFMAYGLAAVALIDPKLRALAGHDLDIAISKMKCKRVWGDWEEDGFGTDPIEKENIMYAAHLAAMYGLYQLVTGSRRYEAEFAHLIRILHDEIAANPFAGVVCEPDNFFVQCAAVMFFALWIYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASLFALLLAREMGDQQLFDQLLNHLEPPAKPSIVSASLRYEHPGSLLFDELLFFAKVHAGFGALLRMPPPAAKLAGK

SEQ ID NO: 172 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPAVMAQLAYWNYIDFIAPFYSRGCSFEAWELKHTPQRVIKYSLAFQGYALAAIALIWPKLRALAGHDLDIAISLMKCKRVWGDWEEDGFGTDPIEKENIMYAAHLAALYALYQMVTGSRRYEAELRHLIRILHDEIAANPFAGVVCEPDNYFVQCAAVMFFALWAYDRLHGTDYRAFTRAYKDFIQKDLIDPERGAFYLSYHPESGAVKPWISAYATAWALAFHHGMDPAFAERFYPRFKQTFVEVYDEGRKARVRETAGTDDADGGVGLAALFALLLAREMGDQQLFDQLANHLVPPAKPSIVSARLRYEHPGSLLFDDLLAFAWVHAGFEALLRMPPPAAKLAGK

SEQ ID NO: 173 - protein, 398 aa, Artificial Sequence
  Description of Artificial Sequence: Synthetic polypeptide
MMRFTLKTTAIVSAAALLAGFGPPPRAAELPPGRLATTEDFFAEQAKQAVTPAVMAQLAYLNYIDFIAPFYSRGCSFEAWELKHTPQRVIKYSLAFLGYALAAVALIWPKLRALAGHDLDIVISLMKCKRVWGDWEEDGFGTDPIEKENIMYSAHLAALYGLYQLVTGSRRYEAEFEHLIRIHHDEIAANPFAGVVCEPDNYFVQCAAVMFFALWIYDRLHGTDYRAFTRAYRDFIQKDLIDPERGAFYLSYHPESGAVKPWISAYATAWALAFHHGMDPAFAERYYPRWKQTFVEVYDEGRKARVRETAGTDDADGGVGLASLFGLLLAREMGDQQLFDQLANHLVPPAKPSIVSARLRYEHPGSLLFDDLLFWAWVHAGHEALLRMPPPAAKLAGK

SEQ ID NO: 174 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPAVMAQLAYLNYIDFIAPFYSRGCSFEAWELKHTPQRVIKYSLAFLAYALAAVALIWPKLRALAGHDLDIAISLMKCKRVWGDWEEDGFGTDPIEKENIMYAAHLAAMYGLYQLVTGSRRYEAEHRHLTRILHDEIAANPFAGVVCEPDNYFVQCAAVMFFALWIYDRLHGTDYRAFTRAYRDFIQKDLIDPERGAFYLSYHPESGAVKPWISAYTTAWALAFHHGMDPAFAERYYPRFKQTFVEVYDEGRKARVRETAGTDDADGGVGLASLFALVLAREMGDQQLFDQLANHLVPPAKPSIVSAILRYEHPGSLLFDDLLFWAWVHAGHEALLRMPPPAAKLAGK

SEQ ID NO: 175 - protein, 398 aa, Artificial Sequence
  Description of Artificial Sequence: Synthetic polypeptide
MMRFTLKTTAIVSAAALLAGFGPPPRAAELPPGRLATTEDFFAEQAKQAVTPAVMAGLAYWNYIDFIAPFYSRGCSFEAWELKHTPQRVIKYSIAFMAYALAAIALIWPKLRALAGHDLDIAISLMKCKRVWGDWEEDGFGTDPIEKENIMYSAHLAAMYALYQLVTGSRRYEAELRHLIRIHHDEIAANPFAGVVCEPDNFFVQCAAVMYFALWLYDRLHGTDYRAFTRAFRDFIQKDLIDPERGAFYLSYHPESGAVKPWISAYATAWALAFHHGMDPAFAERYYPRFKQTFVEVYDEGRKARVRETAGTDDADGGVGLAALFALVLAREMGDQQLFDQLANHLVPPAKPSIVSARLRYEHPGSLLFDDLLMWAWVHAGHEALLRMPPPAAKLAGK

SEQ ID NO: 176 - protein, 398 aa, Artificial Sequence
  Description of Artificial Sequence: Synthetic polypeptide
MMRFTLKTTAIVSAAALLAGFGPPPRAAELPPGRLATTEDFFAEQAKQAVTPAVMAQLAYLNYIDFIAPFYSRGCSFEAWELKHTPQRVIKYSLAFLAYGLAAVALIWPKLRALAGHDLDIAISLMKCKRVWGDWEEDGFGTDPIEKENIMYAAHLAAMYGLYQLVTGSRRYEAEFEHLIRILHDEIAANPFAGVVCEPDNYFVQCAAVMFFALWIYDRLHGTDYRAFTRAYRDFIQKDLIDPERGAFYLSYHPESGAVKPWISAYTTAWALAFHHGMDPAFAERYYPRFKQTFVEVYDEGRKARVRETAGTDDADGGVGLAALFALVLAREMGDQQLFDQLANHLVPPAKPSIVSAELRYEHPGSLLFDDLLFWAWVHAGHEALLRMPPPAAKLAGK

SEQ ID NO: 177 - protein, 398 aa, Artificial Sequence
  Description of Artificial Sequence: Synthetic polypeptide
MMRFTLKTTAIVSAAALLAGFGPPPRAAELPPGRLATTEDFFAEQAKQAVTPAVMAQIAYWNYIDFIAPFYSRGCSFEAWELKHTPQRVIKYSLAFQAYALAAIALIWPKLRALAGHDLDIAISLMKCKRVWGDWEEDGFGTDPIEKENIMYAAHLAAMYGLYQLVTGSRRYEAEFEHLIRILHDEIAANPFAGVVCEPDNYFVQCAAVMYFALWVYDRLHGTDYRAFTRAYRDFIQKDLIDPERGAFYLSYHPESGAVKPWISAYATAWALAFHHGMDPAFAERYYPRFKQTFVEVYDEGRKARVRETAGTDDADGGVGLASLFALLLAREMGDQQLFDQLANHLVPPAKPSIVSAILRYEHPGSLLFDDLLAFAWVHAGFEALLRMPPPAAKLAGK

SEQ ID NO: 178 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPDVMAQLAYLNYIDFIAPFYSRGCSFEAWELKHTPQRVIKYSLAFLAYALAAVALIWPKLRALAGHDLDIAISLMKCKRVWGDWEEDGFGTDPIEKENIMYAAHLAAMYALYQMVTGSRRYEAELRHLIRILHDEIAANPFAGVVCEPDNFFVQCAAVMFFALWAYDRLHGTDYRASTRAWLDFIQKDLIDPERGAFYLSYHPESGAVKPWISAYMTAWALAFIHGMDPAFAERYYPRFKQTFVEVYDEGRKARVRETAGTDDADGGVGLASLFALLLAREMGDQQLFDQLANHLVPPAKPSIVSAILRYEHPGSLLFDDLLFFAFVHAGFEALLRMPPPAAKLAGK

SEQ ID NO: 179 - protein, 398 aa, Artificial Sequence
  Description of Artificial Sequence: Synthetic polypeptide
MMRFTLKTTAIVSAAALLAGFGPPPRAAELPPGRLATTEDFFAEQAKQAVTPAVMAQLAYLNYIDFIAPFYSRGCSFEAWELKHTPQRVIKYSLAFLGYALAAVALIWPKLRALAGHDLDIAISLMKCKRVWGDWEEDGFGTDPIEKENIMYSAHLLLLYALYQMVTGSRRYEAEMEHLARIHHDEIAANPFAGVVCEPDNFFVQCAAVMFMALWAYDRLHGTDYRAFTRAFRDFIQKDLIDPERGAFYLSYHPESGAVKPWISAYTTAWALAIFHGMDPAFAERYYPRFKQTFVEVYDEGRKARVRETAGTDDADGGVGLAALFALVLAREMGDQQLFDQLANHLVPPAKPSIVSAILRYEHPGSLLFDDLLFWAWVHAGWEALLRMPPPAAKLAGK

SEQ ID NO: 180 - protein, 398 aa, Artificial Sequence
  Description of Artificial Sequence: Synthetic polypeptide
MMRFTLKTTAIVSAAALLAGFGPPPRAAELPPGRLATTEDYFAEQAKQAVTPAVMAQLAYLNYIDFIAPFYSRGCSFEAWELKHTPQRVIKYSLAFLAYGLAAVALIWPKLRALAGHDLDIAISLMKCKRVWGDWEEDGFGTDPIEKENIMYAAHLALMYGLYQLVTGSRRYEAEFEHLIRILHDEIAANPFAGVVCEPDNFFVQCAAVMFMALWVYDRLHGTDYRAFTRAFRDFIQKDLIDPERGAFYLSYHPESGAVKPWISAYATAWALAVFHGMDPAFAERYYPRFKQTFVEVYDEGRKARVRETAGTDDADGGVGLASLFALVLAREMGDQQLFDQLANHLVPPAKPSIVSARLRYEHPGSLLFDDLLFWAWVHAGWEALLRMPPPAAKLAGK

SEQ ID NO: 181 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 182 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 183 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 184 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSLAFMGYGLASVALIDPKLRALAGHDLDIAISKMKCKRVWGDWEEDGFGTDPIEKENIMYKAHLALLYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 185 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLASVALIDPKLRALAGHDLDIAISKMKCKRVWGDWEEDGFGTDPIEKENIMYKAHLALLYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 186 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 187 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 188 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMGYGLASVALIDPKLRALAGHDLDIAISKMKCKRVWGDWEEDGFGTDPIEKENIMYKAHLALLYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 189 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNAVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 190 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 191 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLASVALIDPKLRALAGHDLDIAISKMKCKRVWGDWEEDGFGTDPIEKENIMYKAHLALLYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 192 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMGYGLASVALIDPKLRALAGHDLDIAISKMKCKRVWGDWEEDGFGTDPIEKENIMYKAHLALLYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 193 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 194 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLMNHLEPPAKPSIVSASLRYEHPGSLLFDELLFLAKVHAGFGALLRMPPPAAKLAGK

SEQ ID NO: 195 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLASVALIDPKLRALAGHDLDIAISKMKCKRVWGDWEEDGFGTDPIEKENIMYKAHLALLYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 196 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSLAFMAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 197 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 198 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYHNYIDFISPFYSRGCSFEAWELKHTPQRVIKYSIAFMAYGLASVALIDPKLRALAGHDLDIAISKMKCKRVWGDWEEDGFGTDPIEKENIMYKAHLALMYGLYQLVTGSRRYEAEHAHLIRIIHDEIAANPFAGIVCEPDNYFVQCNSVAYLALWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 199 - protein, 398 aa, Artificial Sequence
  Description of Artificial Sequence: Synthetic polypeptide
MMRFTLKTTAIVSAAALLAGFGPPPRAAEVPAGRLATTEEYFAQEARQSVTPDVMAALAFLNYIDFIAPFYSRGCSFEAWELLHTPQRVIKYSIAFLAYGLASVALIDPSLRALAGHDLDIAISKMLCPKVWGDWKEDGFGTDPIERENIMYKGHLNLMYALYEMVTDSRRYEEKHRLLTRIILEEIERNPFGGIVCEPDNYFVQCNSVAYLSLAAYDVLHGTNYRRALEEWLKFIEKGLIDPDKGAFYLSYHPESGAVKPWISAYATAWALAFIHGLLPEFARKYYPRFKRTFVEVYNKGEKARVRETEGTDDADGGVGLASAFALLLAREMGDKDLFERLLRHLEPPAEPEIVSAALRYRKPESLLFHELLFLAKVHTGFGALLRMPPPAAKLAGK

SEQ ID NO: 200 - protein, 398 aa, Artificial Sequence
  Description of Artificial Sequence: Synthetic polypeptide
MMRFTLKTTAIVSAAALLAGFGPPPRAAEVPAGRLATTEEYFAQEARQSVTPDVMAELAFLNYIDFIAPFYSRGCSFEAWELLHTPQRVIKYSIAFLAYALASVALIDPSLRALAGHDLDIAISKMLCPKVWGDWREDGFGTDPIERENIMYKGHLNLMYGLYELVTDSRRYEEKHKLLTKIIAEEIERNPFGGIVCEPDNYFVQCNSVAYLSLAVYDALHGTNYRRALEEWLKFIEKGLIDPDRGAFYLSYHPESGAVKPWLSAYTTAWALAFIHGLLPEFARKYYPRFKRTFVEVYNKGEKARVRETVGTDDANGGVGLASAFALLLAREMGDKDLFERLLRHLEPPAEPEIVSASLRYRKPESLLFHELLFLAKVHTGFGALLKMPPPAAKLAGK

SEQ ID NO: 201 - protein, 398 aa, Artificial Sequence
  Description of Artificial Sequence: Synthetic polypeptide
MMRFTLKTTAIVSAAALLAGFGPPPRAAEVPAGRLATTEEYFAQKARQSVSPDVMAELAFLNYIDFIAPFYSRGCSFEAWELLHTPQRVIKYSLAFLAYGLASVALIDPSLRALAGHDLDIAISKMLCKKVWGDWEEDGFGTDPIKRENIMYKGHLNLMYALYAMVTDSTRYKEKHKLLTEIIYEEIERNPFGGIVCEPDNYFVQCNSVAYLSLAAYDALHGTNYRRALERWLEFIQKGLIDPDDGAFYLSYHPESGAVKPWISAYTTAWALAFIHGLLPEFARQYYPRFKRTFVEVYNDGEKARVRETKGTDDANGGVGLASAFALLLAREMGDKDLFERLLRHLEPPAEPEIVSASLRYRKPESLLFHELLFLAKVHTGFGALLRMPPPAAKLAGK

SEQ ID NO: 202 - protein, 398 aa, Artificial Sequence
  Description of Artificial Sequence: Synthetic polypeptide
MMRFTLKTTAIVSAAALLAGFGPPPRAAEVPAGRLATTEEYFAQKARQAVTPDVMAELAFLNYIDFIAPFYSRGCSFEAWELLHTPQRVIKYSLAFLAYGLASVALIDPKLRALAGHDLDIAISKMLCPKVWGDWKEDGFGTDPIKRENIMYKGHLNAMYGLYELVTDSRRYEEKHRLLTKIIYEEIERNPFGGIVCEPDNYFVQCNSVAYLSLVLYDALHGTNYRRAVEEWLKFIEKGLIDPDRGAFYLSYHPESGAVKPWISAYATAWALAFIHGMDPSFARKYYPRFKRTFVEVYNDGEKARVRETAGTDDANGGVGLASAFALLLAREMGDKELFARLLRHLEPPAEPEIVSASLRYRKPESLLFHELLFLAKVHTGFGALVRMPPPAAKLAGK

SEQ ID NO: 203 - protein, 398 aa, Artificial Sequence
  Description of Artificial Sequence: Synthetic polypeptide
MMRFTLKTTAIVSAAALLAGFGPPPRAAEVPAGRLATTEEYFAQEAKQAVTPDVMAELAFLNYIDFIAPFYSRGCSFEAWELLHTPQRVIKYSIAFYAYGLASVALIDPKLRALAGHDLDIAISKMLCPKVWGDWKEDGFGTDPIERENIMYKGHLNLMYGLYELVTDSRRYEEKHRLLTRIIYEEIERNPFGGIVCEPDNYFVQCNSVAYASLVVYDVLHGTNYRKALEEWLKFIQKGLIDPDDGAFYLSYHPESGAVKPWLSAYATAWALAFIHGMLPEFARKYYPRFKRTFVEVYNKGEKARVRETKGTDDANGGVGLASAFALLLAREMGDKDLFERLLRHLEPPAEPEIVSAALRYRKPESLLFNALLFLAKVHTGFGALFRMPPPAAKLAGK

SEQ ID NO: 204 - protein, 398 aa, Artificial Sequence
  Description of Artificial Sequence: Synthetic polypeptide
MMRFTLKTTAIVSAAALLAGFGPPPRAAEVPAGRLATTEEYFAQEARQSVTPDVMAALAFLNYIDFIAPFYSRGCSFEAWELLHTPQRVIKYSIAFLAYGLASVALIDPSLRALAGHDLDIAISKMLCPKVWGDWKEDGFGTDPIARENIMYKGHLNLMYALYALVTDSTRYKEKHKLLTEIIAEEIERNPFGGIVCEPDNYFVQCNSVAYASLVAYDVLHGTNYRRALRSWLEFIEKGLIDPDRGSFYLSYHPESGAVKPWLSAYTTAWALAFIHGMLPEFARRYYPRFKRTFVEVYNKGEKARVRETVGTDDANGGVGLASAFALLLAREMGDKDLFERLLRHLEPPAEPTIVSASLRYKKPESLLFHELLFLAKVHTGFGALFKMPPPAAKLAGK

SEQ ID NO: 205 - protein, 398 aa, Artificial Sequence
  Description of Artificial Sequence: Synthetic polypeptide
MMRFTLKTTAIVSAAALLAGFGPPPRAAEVPAGRLATTEEYFAQEARQSVTPDVMAELAFLNYIDFIAPFYSRGCSFEAWELLHTPQRVIKYSIAFLAYGLASVALIDPKLRALAGHDLDIAISKMLCPKVWGDWKEDGFGTDPIKRENIMYKGHLNLMYALYALVTDSRRYEEKHRLLTRIIYEEIERNPFGGIVCEPDNYFVQCNSVAYASLVAYDVLHGTNYRRALEEWLKFIQKGLIDPSRGAFYLSYHPESGAVKPWISAYTTAWALAFIHGMLPEFARQYYPRFKRTFVEVYNDGEKARVRETEGTDDANGGVGLASAFALLLAREMGDKELFERLLRHLEPPAEPEIVSASLRYRRPESLLFHELLFLAKVHTGFGALFKMPPPAAKLAGK

SEQ ID NO: 206 - protein, 398 aa, Artificial Sequence
  Description of Artificial Sequence: Synthetic polypeptide
MMRFTLKTTAIVSAAALLAGFGPPPRAAEVPAGRLATTEEYFAQKARQSVTPDVMAALAFLNYIDFIAPFYSRGCSFEAWELLHTPQRVIKYSIAFLAYALASVALIDPSLRALAGHDLDIAISKMLCPRVWGDWKEDGFGTDPIKRENIMYKGHLNLMYGLYELVTDSRRYEEKHKLLTKIIYEEIERNPFGGIVCEPDNYFVQCNSVAYLSLAVYDALHGTDYRRALESWLEFIEKGLIDPSKGSFYLSYHPESGAVKPWLSAYATAWALAFIHGLLPEFARKYYPRFKRTFVEVYNKGEKARVRETVGTDDANGGVGLASAFALLLAREMGDKDLFERLLRHLEPPAKPKIVSASLRYEEPESLLFHELLFLAKVHTGFGALLRMPPPAAKLAGK

SEQ ID NO: 207 - protein, 398 aa, Artificial Sequence
  Description of Artificial Sequence: Synthetic polypeptide
MMRFTLKTTAIVSAAALLAGFGPPPRAAEVPAGRLATTEDYFAQEARQSVTPDVMAELAFLNYIDFIAPFYSRGCSFEAWELLHTPQRVIKYSIAFYAYALASVALIDPKLRALAGHDLDIAISKMLCPKVWGDWKEDGFGTDPIKRENIMYKGHLNLMYGLYELVTDSRRYEEKHRLLTEIIYEEIERNPFGGIVCEPDNYFVQCNSVAYASLVVYDVLHGTNYRKALERWLKFIEQGLIDPDRGSFYLSYHPESGAVKPWLSAYTTAWALAFIHGMDPDFARKYYPRFKRTFVEVYNKGEKARVRETVGTDDANGGVGLASAFALLLAREMGDKDLFERLLRHLEPPAEPEIVSASLRYRRPESLLFNALLFLAKVHTGFGALFKMPPPAAKLAGK

SEQ ID NO: 208 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 209 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 210 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 211 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 212 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 213 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLAAVALIDPKLRALAGHDLDIAISKLKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 214 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 215 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 216 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 217 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVSPDVMAQLAYLNYIDFIAPFYSRGCSFEAWELKHTPQRVIKYSLAFLAYGLAAVALIDPKLRALAGHDLDIAISKMKCKRVWGDWEEDGFGTDPIEKENIMYKGHLNLMYALYQMVTGSRRYEAEHAHLTRIIHDEIAANPFAGIVCEPDNYFVQCNSVAYLSLWAYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDALLFLAKVHAGFGALLRMPPPAAKLAGK

SEQ ID NO: 218 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSLAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 219 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSIAFLAYGLAAVALIDPKLRALAGHDLDIAISKMKCKRVWGDWEEDGFGTDPIEKENIMYKGHLNLMYALYQMVTGSRRYEAEHAHLTRIIHDEIAANPFAGIVCEPDNYFVQCNSVAYLSLWAYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDALLFLAKVHAGFGALLRMPPPAAKLAGK

SEQ ID NO: 220 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSIAFLAYALAAVALIDPKLRALAGHDLDIAISKMKCKRVWGDWEEDGFGTDPIEKENIMYKGHLNLMYALYQMVTGSRRYEAEHAHLTRIIHDEIAANPFAGIVCEPDNYFVQCNSVAYLSLWAYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 221 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSLAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDALLFLAKVHAGFGALLRMPPPAAKLAGK

SEQ ID NO: 222 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSIAFLAYGLAAVALIDPKLRALAGHDLDIAISKMKCKRVWGDWEEDGFGTDPIEKENIMYKGHLNLMYALYQMVTGSRRYEAEHAHLTRIIHDEIAANPFAGIVCEPDNYFVQCNSVAYLSLWAYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDELLFLAKVHAGFGALLRMPPPAAKLAGK

SEQ ID NO: 223 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSLAFLAYGLAAVALIDPKLRALAGHDLDIAISKMKCKRVWGDWEEDGFGTDPIEKENIMYKGHLNLMYALYQMVTGSRRYEAEHAHLTRIIHDEIAANPFAGIVCEPDNYFVQCNSVAYLSLWAYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 224 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSLAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAFIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 225 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFIAPFYSRGCSFEAWELKHTPQRVIKYSLAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAFIHGMDPAFAERYYPRFKQTFVEVYDEGRKARVRETAGTDDADGGVGLAAAFALLLAREMGDQQLFDQLLNHLEPPAKPSIVSASLRYEHPGSLLFDALLFLAKVHAGFGALLRMPPPAAKLAGK

SEQ ID NO: 226 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGSFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 227 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 228 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 229 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 230 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSIAFLAYALAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 231 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLAAVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 232 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLAAVALIDPKLRALAGHDLDIAISKLKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYTTAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 233 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYLNYIDFISPFYSRGCSFEAWELKHTPQRVIKYSLAFLGYGLAAVALIDPKLRALAGHDLDIAISKLKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRASTRAWLDFIQKDLIDPERGAFYLSYHPESGAVKPWISAYATAWALAMIHGMDPAFAERYYPRFKQTFVEVYDEGRKARVRETAGTDDADGGVGLASAFALLLAREMGDQQLFDQLLNHLEPPAKPSIVSASLRYEHPGSLLFDELLFLAKVHAGFGALLRMPPPAAKLAGK

SEQ ID NO: 234 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCPRVWGDWEEDGFGTDPIKRENIMYKGHLNLMYGLYQLVTGSRRYEQEHALLTEIIYEEIARNPFAGIVCEPDNYFVQCNSVAYLSLWVYDRLHGTNYAAATREWLDFIQKGLIDPSRGAFYLSYHPESGAVKPWISAYTTAWTLAMVHGMDPAFSRQYYPRFKRTFVEVYDEGKKARVRETAGTDDADGGVGLASAFTLLLAREMGDKELFDQLLNHLEPPAEPSIVSASLRYKKPGSLLFDELLFLAKVHAGFGALLRMPPPAAKLAGK

SEQ ID NO: 235 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCPRVWGDWEEDGFGTDPIKRENIMYKGHLNLMYGLYQLVTGSRRYEQEHALLTQIIYEEIARNPFAGIVCEPDNYFVQCNSVAYLSLWVYDRLHGTNYAAATERWLDFIQKGLIDPDRGAFYLSYHPESGAVKPWISAYTTAWTLAMVHGMDPSFSRKYYPRFKRTFVEVYDDGKKARVRETAGTDDADGGVGLASAFTLLLAREMGDKDLFDQLLNHLEPPAEPSIVSASLRYRRPGSLLFDELLFLAKVHAGFGALLRMPPPAAKLAGK

SEQ ID NO: 236 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCPRVWGDWEEDGFGTDPIERENIMYKGHLNLMYGLYQLVTGSRRYEQEHALLTQIIYEEIARNPFAGIVCEPDNYFVQCNSVAYLSLWVYDRLHGTNYAAATRRWLDFIQKGLIDPSRGAFYLSYHPESGAVKPWISAYTTAWTLAMVHGMDPSFSRQYYPRFKRTFVEVYDKGKKARVRETAGTDDADGGVGLASAFTLLLAREMGDKELFDQLLNHLEPPAEPSIVSASLRYKKPGSLLFDELLFLAKVHAGFGALLRMPPPAAKLAGK

SEQ ID NO: 237 - protein, 398 aa, Artificial Sequence
  Description of Artificial Sequence: Synthetic polypeptide
MMRFTLKTTAIVSAAALLAGFGPPPRAAELPPGRLATTDDYFAQQARQSVTPDVMAQLAYMNYIDFISPFYSRGCSFEAWELKHTPQRVIKYSIAFYAYGLASVALIDPSLRALAGHDLDIAVSKMKCPRVWGDWEEDGFGTDPIERENIMYKGHLNLMYGLYQLVTGSRRYEQEHALLTQIIYEEIARNPFAGIVCEPDNYFVQCNSVAYLSLWVYDRLHGTNYAAATREWLDFIQKGLIDPSRGAFYLSYHPESGAVKPWISAYTTAWTLAMVHGMDPAFSREYYPRFKRTFVEVYDKGKKARVRETAGTDDADGGVGLASAFTLLLAREMGDKELFDQLLNHLEPPAEPSIVSASLRYKKPGSLLFDELLFLAKVHAGFGALLRMPPPAAKLAGK

SEQ ID NO: 238 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCPRVWGDWEEDGFGTDPIERENIMYKGHLNLMYGLYQLVTGSRRYEQEHALLTQIIYEEIARNPFAGIVCEPDNYFVQCNSVAYLSLWVYDRLHGTNYAAATREWLDFIQKGLIDPSRGAFYLSYHPESGAVKPWISAYTTAWTLAMVHGMDPSFSRKYYPRFKRTFVEVYDDGRKARVRETAGTDDADGGVGLASAFTLLLAREMGDKDLFDQLLNHLEPPAEPSIVSASLRYEKPGSLLFDELLFLAKVHAGFGALLRMPPPAAKLAGK

SEQ ID NO: 239 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCPKVWGDWEEDGFGTDPIKRENIMYKGHLNLMYGLYQLVTGSRRYEQEHALLTEIIYKEIARNPFAGIVCEPDNYFVQCNSVAYLSLWVYDRLHGTNYAAATREWLDFIQKGLIDPSRGAFYLSYHPESGAVKPWISAYTTAWTLAMVHGMDPSFSREYYPRFKRTFVEVYDKGKKARVRETAGTDDADGGVGLASAFTLLLAREMGDKELFDQLLNHLEPPAEPSIVSASLRYEKPGSLLFDELLFLAKVHAGFGALLRMPPPAAKLAGK

SEQ ID NO: 240 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCKKVWGDWEEDGFGTDPIKRENIMYKGHLNLMYGLYQLVTGSRRYEQEHALLTQIIYEEIARNPFAGIVCEPDNYFVQCNSVAYLSLWVYDRLHGTNYAAATRRWLDFIQKGLIDPSRGAFYLSYHPESGAVKPWISAYTTAWTLAMVHGMDPAFSRQYYPRFKRTFVEVYDKGKKARVRETAGTDDADGGVGLASAFTLLLAREMGDKDLFDQLLNHLEPPAEPSIVSASLRYKKPGSLLFDELLFLAKVHAGFGALLRMPPPAAKLAGK

SEQ ID NO: 241 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPSLRALAGHDLDIAVSKMKCKRVWGDWEEDGFGTDPIKRENIMYKGHLNLMYGLYQLVTGSRRYEEEHALLTEIIYEEIARNPFAGIVCEPDNYFVQCNSVAYLSLWVYDRLHGTNYAAATREWLDFIQKGLIDPDRGAFYLSYHPESGAVKPWISAYTTAWTLAMVHGMDPDFSKEYYPRFKRTFVEVYDDGKKARVRETAGTDDADGGVGLASAFTLLLAREMGDKDLFDQLLNHLEPPAEPSIVSASLRYKKPGSLLFDELLFLAKVHAGFGALLKMPPPAAKLAGK

SEQ ID NO: 242 - protein, 398 aa, Artificial Sequence
  Description of Artificial Sequence: Synthetic polypeptide
MMRFTLKTTAIVSAAALLAGFGPPPRAAELPPGRLATTEDYFAQQARQSVTPDVMAQLAYMNYIDFISPFYSRGCSFEAWELKHTPQRVIKYSIAFYAYGLASVALIDPKLRALAGHDLDIAVSKMKCPRVWGDWEEDGFGTDPIKRENIMYKGHLNLMYGLYQLVTGSRRYEQEHALLTQIIYEEIARNPFAGIVCEPDNYFVQCNSVAYLSLWVYDRLHGTNYAAATREWLDFIQKGLIDPSRGAFYLSYHPESGAVKPWISAYTTAWTLAMVHGMDPEFSRQYYPRFKKTFVEVYDKGKKARVRETAGTDDADGGVGLASAFTLLLAREMGDKELFDQLLNHLEPPAKPSIVSASLRYEEPGSLLFDELLFLAKVHAGFGALLRMPPPAAKLAGK

SEQ ID NO: 243 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAMIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 244 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 245 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFLAKVHAGWGALLRMPPPAAKLAGK

SEQ ID NO: 246 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASIALIDPKLRALVGHDLDIAISKMKCKRVWGDWEEDGFGTDPIEKENIMYKGHLNLMYGLYQLVTGSRRYEAEHAHLTRIIHDEIAANPWAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLWLAREMGDQQLFDQLLNHLEPPAKPSIVSASLRYEHPGSLLFDELLFLAKVHAGWGALLRMPPPAAKLAGK

SEQ ID NO: 247 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASIALIDPKLRALVGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFLAKVHAGWGALLRMPPPAAKLAGK

SEQ ID NO: 248 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVWKYSIAFYAYGLASIALIDPKLRALVGHDLDIAISKMKCKRVWGDWEEDGFGTDPIEKENIMYKGHLNLMYGLYQLVTGSRRYEAEHAHLTRIIHDEIAANPWAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLWLAREMGDQQLFDQLLNHLEPPAKPSIVSASLRYEHPGSLLFDELLFLAKVHAGWGALLRMPPPAAKLAGK

SEQ ID NO: 249 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVWKYSIAFYAYGLASIALIDPKLRALVGHDLDIAISKMKCKRVWGDWEEDGFGTDPIEKENIMYKGHLNLMYGLYQLVTGSRRYEAEHAHLTRIIHDEIAANPWAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLWLAREMGDQQLFDQLLNHLEPPAKPSIVSASLRYEHPGSLLFDELLFLAKVHLGWGAWLRMPPPAAKLAGK

SEQ ID NO: 250 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAYELKHTPQRVWKYSIAFYAYGLASIALIDPKLRALVGHDLDIAISKMKCKRVWGDWEEDGFGTDPIEKENIMYKGHLNLMYGLYQLVTGSRRYEAEHAHLTRIIHDEIAANPWAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLWLAREMGDQQLFDQLLNHLEPPAKPSIVSASLRYEHPGSLLFDELLFLAKVHAGWGAWLRMPPPAAKLAGK

SEQ ID NO: 251 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAYELKHTPQRVWKYSIAFYAYGLASIALIDPKLRALVGHDLDIAISKMKCKRVWGDWEEDGFGTDPIEKENIMYKGHLNLMYGLYQLVTGSRRYEAEHAHLTRIIHDEIAANPWAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLWLAREMGDQQLFDQLLNHLEPPAKPSIVSASLRYEHPGSLLFDELLFLAKVHAGWGALLRMPPPAAKLAGK

SEQ ID NO: 252 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRMIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAFTLLLAREMGDQQLFDQLLNHLEPPAKPSIVSASLRYEHPVDMGMGHDALLFLAKVHAGFGALLRMPPPAAKLAGK

SEQ ID NO: 253 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRQIKLSIALYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGMGGASAWTLLLAREMGDQQLFDQLLNHLEPPAKPSIVSASLRYEHPHDMFFDHSGLLFLAKVHAGFGALLRMPPPAAKLAGK

SEQ ID NO: 254 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPFDAWMDFSGLLFLAKVHAGFGALLRMPPPAAKLAGK

SEQ ID NO: 255 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGMGAASAFTLLLAREMGDQQLFDQLLNHLEPPAKPSIVSASLRYEHPHDMWMNFSGLLFLAKVHAGFGALLRMPPPAAKLAGK

SEQ ID NO: 256 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIALYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMFADFSGMLFLAKVHAGFGALLRMPPPAAKLAGK

SEQ ID NO: 257 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMMADFSGLLFLAKVHAGFGALLRMPPPAAKLAGK

SEQ ID NO: 258 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMLADFSGLLFLAKVHAGFGALLRMPPPAAKLAGK

SEQ ID NO: 259 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPHDMLADFSGMLFLAKVHAGFGALLRMPPPAAKLAGK

SEQ ID NO: 260 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKLSIAIYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGSASAWTLLLAREMGDQQLFDQLLNHLEPPAKPSIVSASLRYEHPVDMYHGHDALLFLAKVHAGFGALLRMPPPAAKLAGK

SEQ ID NO: 261 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPVDMLANHSGLLFLAKVHAGFGALLRMPPPAAKLAGK

SEQ ID NO: 262 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRYIKYSIANYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGSASAWTLLLAREMGDQQLFDQLLNHLEPPAKPSIVSASLRYEHPTDSHSGHDAMLFLAKVHAGFGALLRMPPPAAKLAGK

SEQ ID NO: 263 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMFGDHSGLLFLAKVHAGFGALLRMPPPAAKLAGK

SEQ ID NO: 264 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAFTLLLAREMGDQQLFDQLLNHLEPPAKPSIVSASLRYEHPVDMFGGFDALLFLAKVHAGFGALLRMPPPAAKLAGK

SEQ ID NO: 265 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGGASAFTLLLAREMGDQQLFDQLLNHLEPPAKPSIVSASLRYEHPVDMLWGHDALLFLAKVHAGFGALLRMPPPAAKLAGK

SEQ ID NO: 266 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMLMDFSGLLFLAKVHAGFGALLRMPPPAAKLAGK

SEQ ID NO: 267 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAFTLLLAREMGDQQLFDQLLNHLEPPAKPSIVSASLRYEHPHDMMFDFSGLLFLAKVHAGFGALLRMPPPAAKLAGK

SEQ ID NO: 268 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPFPSLYSFDALLFLAKVHAGFGALLRMPPPAAKLAGK

SEQ ID NO: 269 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPDDSWADFSGLLFLAKVHAGFGALLRMPPPAAKLAGK

SEQ ID NO: 270 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPDDMFADHSGLLFLAKVHAGFGALLRMPPPAAKLAGK

SEQ ID NO: 271 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRHIKYSIAIYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAWTLLLAREMGDQQLFDQLLNHLEPPAKPSIVSASLRYEHPIDTGFGFDALLFLAKVHAGFGALLRMPPPAAKLAGK

SEQ ID NO: 272 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGGASAFTLLLAREMGDQQLFDQLLNHLEPPAKPSIVSASLRYEHPHDMLHGHDALLFLAKVHAGFGALLRMPPPAAKLAGK

SEQ ID NO: 273 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGMGAASAFTLLLAREMGDQQLFDQLLNHLEPPAKPSIVSASLRYEHPIDHGFGHDALLFLAKVHAGFGALLRMPPPAAKLAGK

SEQ ID NO: 274 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMFADFSGLLFLAKVHAGFGALLRMPPPAAKLAGK

SEQ ID NO: 275 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKHSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPHDMFADFSGLLFLAKVHAGFGALLRMPPPAAKLAGK

SEQ ID NO: 276 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMHANHSGLLFLAKVHAGFGALLRMPPPAAKLAGK

SEQ ID NO: 277 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPSDTFSGHDAMLFLAKVHAGFGALLRMPPPAAKLAGK

SEQ ID NO: 278 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPFPAWTNHSGMLFLAKVHAGFGALLRMPPPAAKLAGK

SEQ ID NO: 279 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPHDMLASFDGMLFLAKVHAGFGALLRMPPPAAKLAGK

SEQ ID NO: 280 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMLAGFDALLFLAKVHAGFGALLRMPPPAAKLAGK

SEQ ID NO: 281 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMMASFDGLLFLAKVHAGFGALLRMPPPAAKLAGK

SEQ ID NO: 282 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKLMIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPDDSYHGHDALLFLAKVHAGFGALLRMPPPAAKLAGK

SEQ ID NO: 283 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRHIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPVDMMASHDGMLFLAKVHAGFGALLRMPPPAAKLAGK

SEQ ID NO: 284 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRHIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGHASAFTLLLAREMGDQQLFDQLLNHLEPPAKPSIVSASLRYEHPVADGFGHDALLFLAKVHAGFGALLRMPPPAAKLAGK

SEQ ID NO: 285 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRWIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPLPMFGGFDALLFLAKVHAGFGALLRMPPPAAKLAGK

SEQ ID NO: 286 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPFPAWASFDGLLFLAKVHAGFGALLRMPPPAAKLAGK

SEQ ID NO: 287 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMFASFDGLLFLAKVHAGFGALLRMPPPAAKLAGK

SEQ ID NO: 288 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMRASFDGLLFLAKVHAGFGALLRMPPPAAKLAGK

SEQ ID NO: 289 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKHSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMFASFDGLLFLAKVHAGFGALLRMPPPAAKLAGK

SEQ ID NO: 290 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMMASHDGMLFLAKVHAGFGALLRMPPPAAKLAGK

SEQ ID NO: 291 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMFASFDGLLFLAKVHAGFGALLRMPPPAAKLAGK

SEQ ID NO: 292 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHVPQRAIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPHDMLMSFDGLLFLAKVHAGFGALLRMPPPAAKLAGK

SEQ ID NO: 293 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRWIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPDYRSYSHDGLLFLAKVHAGFGALLRMPPPAAKLAGK

SEQ ID NO: 294 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAFTLLLAREMGDQQLFDQLLNHLEPPAKPSIVSASLRYEHPHDMFMDHDGLLFLAKVHAGFGALLRMPPPAAKLAGK

SEQ ID NO: 295 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPQNMWMGFDALLFLAKVHAGFGALLRMPPPAAKLAGK

SEQ ID NO: 296 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPDDMLASHDGLLFLAKVHAGFGALLRMPPPAAKLAGK

SEQ ID NO: 297 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIALYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAFTLLLAREMGDQQLFDQLLNHLEPPAKPSIVSASLRYEHPLDHGFGHDALLFLAKVHAGFGALLRMPPPAAKLAGK

SEQ ID NO: 298 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKFSIAIYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAWTLLLAREMGDQQLFDQLLNHLEPPAKPSIVSASLRYEHPQDMFFGFDALLFLAKVHAGFGALLRMPPPAAKLAGK

SEQ ID NO: 299 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRIIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPVIWLFSFDALLFLAKVHAGFGALLRMPPPAAKLAGK

SEQ ID NO: 300 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPVDMLAGHDAMLFLAKVHAGFGALLRMPPPAAKLAGK

SEQ ID NO: 301 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKASIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPQDMWASHDGMLFLAKVHAGFGALLRMPPPAAKLAGK

SEQ ID NO: 302 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPHPENRGHDALLFLAKVHAGFGALLRMPPPAAKLAGK

SEQ ID NO: 303 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHIPQRIIKLMIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPVDDNHGHDALLFLAKVHAGFGALLRMPPPAAKLAGK

SEQ ID NO: 304 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKISIALYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPVDMFASHDGMLFLAKVHAGFGALLRMPPPAAKLAGK

SEQ ID NO: 305 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHPHDMLAGFDALLFLAKVHAGFGALLRMPPPAAKLAGK

SEQ ID NO: 306 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPQDMFAPHDGLLFLAKVHAGFGALLRMPPPAAKLAGK

SEQ ID NO: 307 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHVPQRVIKFMIAIYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGGASAWTLLLAREMGDQQLFDQLLNHLEPPAKPSIVSASLRYEHPHDEGFGHDALLFLAKVHAGFGALLRMPPPAAKLAGK

SEQ ID NO: 308 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAFTLLLAREMGDQQLFDQLLNHLEPPAKPSIVSASLRYEHPLGGVGGTFSGLLFLAKVHAGFGALLRMPPPAAKLAGK

SEQ ID NO: 309 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPHAGLWGNFSGLLFLAKVHAGFGALLRMPPPAAKLAGK

SEQ ID NO: 310 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAFTLLLAREMGDQQLFDQLLNHLEPPAKPSIVSASLRYEHPLGGRGGDFSGLLFLAKVHAGFGALLRMPPPAAKLAGK

SEQ ID NO: 311 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPYRGGMGDFSGLLFLAKVHAGFGALLRMPPPAAKLAGK

SEQ ID NO: 312 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAFTLLLAREMGDQQLFDQLLNHLEPPAKPSIVSASLRYEHPVGGDGGNHSGLLFLAKVHAGFGALLRMPPPAAKLAGK

SEQ ID NO: 313 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPSGGNMGNHSGLLFLAKVHAGFGALLRMPPPAAKLAGK

SEQ ID NO: 314 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPTDGRFHDHSGLLFLAKVHAGFGALLRMPPPAAKLAGK

SEQ ID NO: 315 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAFTLLLAREMGDQQLFDQLLNHLEPPAKPSIVSASLRYEHPLGGVGGGFDALLFLAKVHAGFGALLRMPPPAAKLAGK

SEQ ID NO: 316 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGHASAFTLLLAREMGDQQLFDQLLNHLEPPAKPSIVSASLRYEHPTQGLGGSHDGLLFLAKVHAGFGALLRMPPPAAKLAGK

SEQ ID NO: 317 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRQIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGTASAFTLLLAREMGDQQLFDQLLNHLEPPAKPSIVSASLRYEHPTRGRHGSHDGLLFLAKVHAGFGALLRMPPPAAKLAGK

SEQ ID NO: 318 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPIGGLFFGFDALLFLAKVHAGFGALLRMPPPAAKLAGK

SEQ ID NO: 319 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDSISPFYSRGCSFEAWELKHVPQRVIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPLGGEMGSHDGLLFLAKVHAGFGALLRMPPPAAKLAGK

SEQ ID NO: 320 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGTASAFTLLLAREMGDQQLFDQLLNHLEPPAKPSIVSASLRYEHGYFGTFGSHDGLLFLAKVHAGFGALLRMPPPAAKLAGK

SEQ ID NO: 321 - protein, 401 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGAASAFTLLLAREMGDQQLFDQLLNHLEPPAKPSIVSASLRYEHPTGGTGFPHDGLLFLAKVHAGFGALLRMPPPAAKLAGK

SEQ ID NO: 322 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNLHDFHAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 323 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNFHVFQAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 324 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNFHMFKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 325 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNGGMGKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 326 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMDNAGYSKAPFYSRGCSFEAWEDKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 327 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMDHAGHSKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 328 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMDMAGLYYAPFYSRGCSFEAWEQKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGAGLASAFTLLLAREMGDQQLFDQLLNHLEPPAKPSIVSASLRYEHPGSLLFDELLFLAKVHAGFGALLRMPPPAAKLAGK

SEQ ID NO: 329 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGGGWYRAPFYSRGCSFEAWEEKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGIGLASAFTLLLAREMGDQQLFDQLLNHLEPPAKPSIVSASLRYEHPGSLLFDELLFLAKVHAGFGALLRMPPPAAKLAGK

SEQ ID NO: 330 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNMAGYGRSPFYSRGCSFEAWEEKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 331 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNAGFGRAPFYSRGCSFEAWEAKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 332 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNAGWYYAPFYSRGCSFEAWEEKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGIGLASAFTLLLAREMGDQQLFDQLLNHLEPPAKPSIVSASLRYEHPGSLLFDELLFLAKVHAGFGALLRMPPPAAKLAGK

SEQ ID NO: 333 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNAGIGLAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 334 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNAGISRAPFYSRGCSFEAWEEKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 335 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGGGWSRAPFYSRGCSFEAWEEKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGDGLASAFTLLLAREMGDQQLFDQLLNHLEPPAKPSIVSASLRYEHPGSLLFDELLFLAKVHAGFGALLRMPPPAAKLAGK

SEQ ID NO: 336 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMDNAGMSKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 337 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMTHAGQYEAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 338 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNFAGLSKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGAGLASAFTLLLAREMGDQQLFDQLLNHLEPPAKPSIVSASLRYEHPGSLLFDELLFLAKVHAGFGALLRMPPPAAKLAGK

SEQ ID NO: 339 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNMAGMYYAPFYSRGCSFEAWEQKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 340 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMGNAGQTEAPFYSRGCSFEAWENKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 341 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNAGQSKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 342 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNSSSFLWAPFYSRGCSFEAWEMKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 343 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNAGESRAPFYSRGCSFEAWEEKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 344 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMDMAGMTQAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 345 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNNGGIQQAPFYSRGCSFEAWEQKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAFTLLLAREMGDQQLFDQLLNHLEPPAKPSIVSASLRYEHPGSLLFDELLFLAKVHAGFGALLRMPPPAAKLAGK

SEQ ID NO: 346 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNFAGMTKAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 347 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDAMTETAPFYSRGCSFEAWEQKHTPQRMIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPGSLLFDELLFLAKVHAGFGALLRMPPPAAKLAGK

SEQ ID NO: 348 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNADSHTDTSPFYSRGCSFEAWELKHTPQRMIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPGSLLFDELLFLAKVHAGFGALLRMPPPAAKLAGK

SEQ ID NO: 349 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSWLYFPPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 350 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNSSSWVYWGPFYSRGCSFEAWELKHTPQRIIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPGSLLFDELLFLAKVHAGFGALLRMPPPAAKLAGK

SEQ ID NO: 351 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNADSLTGGAPFYSRGCSFEAWEAKHTPQRMIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 352 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSYLYWAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 353 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSFLYFAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 354 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDAFVYFAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 355 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSWLYFAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 356 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMAAGRMRGDAPFYSRGCSFEAWENKHTPQRMIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGIGLASAFTLLLAREMGDQQLFDQLLNHLEPPAKPSIVSASLRYEHPGSLLFDELLFLAKVHAGFGALLRMPPPAAKLAGK

SEQ ID NO: 357 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSFQYWAPFYSRGCSFEAWEIKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 358 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSFVYTAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 359 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNADTHTGGAPFYSRGCSFEAWEAKHTPQRMIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 360 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDAFLYWAPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 361 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNGDSWKYTAPFYSRGCSFEAWEMKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGSGLASAFTLLLAREMGDQQLFDQLLNHLEPPAKPSIVSASLRYEHPGSLLFDELLFLAKVHAGFGALLRMPPPAAKLAGK

SEQ ID NO: 362 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFHSPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 363 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHTPQRMIKFSIAFYAFGLASVALIDPKLRALAGHDLDIAVSKMKCKRVWGDWEEDGFGTDPIEKENIMYKGLLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAGTLLLAREMGDQQLFDQLLNHLEPPAKPSIVSASLRYEHPGSLLFDELLFLAKVHAGFGALLRMPPPAAKLAGK

SEQ ID NO: 364 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRYIKYSIAFYAFGLASVALIDPKLRALAGHDLDIAVSKMKCKRVWGDWEEDGFGTDPIEKENIMYKGFLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAFTLAMVHGMDPAFSERYYPRFKQTFVEVYDEGRKARVRETAGTDDADGGLGWASAFTLLLAREMGDQQLFDQLLNHLEPPAKPSIVSASLRYEHPGSYHFDELLFLAKVHAGFGALLRMPPPAAKLAGK

SEQ ID NO: 365 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHISPFYSRGCSFEAWELKHTPQRWIKHSIAFYAFGLASVALIDPKLRALAGHDLDIAVSKMKCKRVWGDWEEDGFGTDPIEKENIMYKGELNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGWASAFTLLLAREMGDQQLFDQLLNHLEPPAKPSIVSASLRYEHPGSGHFDELLFLAKVHAGFGALLRMPPPAAKLAGK

SEQ ID NO: 366 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRMIKYSIAIYAWGLASVALIDPKLRALAGHDLDIAVSKMKCKRVWGDWEEDGFGTDPIEKENIMYKGALNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAWTLLLAREMGDQQLFDQLLNHLEPPAKPSIVSASLRYEHPGSLLFDELLFLAKVHAGFGALLRMPPPAAKLAGK

SEQ ID NO: 367 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDYISPFYSRGCSFEAWELKHTPQRMIKFSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGPGLASAFTLLLAREMGDQQLFDQLLNHLEPPAKPSIVSASLRYEHPGSLLFDELLFLAKVHAGFGALLRMPPPAAKLAGK

SEQ ID NO: 368 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRYIKFSIAFYAFGLASVALIDPKLRALAGHDLDIAVSKMKCKRVWGDWEEDGFGTDPIEKENIMYKGLLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAHTLAMVHGMDPAFSERYYPRFKQTFVEVYDEGRKARVRETAGTDDADGGLGWASAGTLLLAREMGDQQLFDQLLNHLEPPAKPSIVSASLRYEHPGSYHFDELLFLAKVHAGFGALLRMPPPAAKLAGK

SEQ ID NO: 369 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRFIKYSIAFYAWGLASVALIDPKLRALAGHDLDIAVSKMKCKRVWGDWEEDGFGTDPIEKENIMYKGMLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGTASAFTLLLAREMGDQQLFDQLLNHLEPPAKPSIVSASLRYEHPGSYWFDELLFLAKVHAGFGALLRMPPPAAKLAGK

SEQ ID NO: 370 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRMIKLSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGLGLASAFTLLLAREMGDQQLFDQLLNHLEPPAKPSIVSASLRYEHPGSLLFDELLFLAKVHAGFGALLRMPPPAAKLAGK

SEQ ID NO: 371 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHVPQRAIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGTGSASAFTLLLAREMGDQQLFDQLLNHLEPPAKPSIVSASLRYEHPWDMLASHDGLLFLAKVHAGFGALLRMPPPAAKLAGK

SEQ ID NO: 372 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYWDFSSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPGTGGWFSASSFALLLAREMGDQQLFDQLLNHLEPPAKPSIVSASLRYEHPLSLLFDELLFLAKVHAGFGALLRMPPPAAKLAGK

SEQ ID NO: 373 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDGPVDGFFGAAMFALLLAREMGDQQLFDQLLNHLEPPAKPSIVSAMLRYEHPLGLLFDELLFLAKVHAGFGALLRMPPPAAKLAGK

SEQ ID NO: 374 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYEDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKARVRETAGTTDGGGGHHFSAAAFALLLAREMGDQQLFDQLLNHLEPPAKPSIVSARLRYEHPLSLLFDELLFLAKVHAGFGALLRMPPPAAKLAGK

SEQ ID NO: 375 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFHSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDDSSGGFSASSFALLLAREMGDQQLFDQLLNHLEPPAKPSIVSAMLRYEHPLSLLFDELLFLAKVHAGFGALLRMPPPAAKLAGK

SEQ ID NO: 376 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDQTEGLGHAAAFALLLAREMGDQQLFDQLLNHLEPPAKPSIVSAMLRYEHPLSLLFDELLFLAKVHAGFGALLRMPPPAAKLAGK

SEQ ID NO: 377 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDASGGGAWLAAAFALLLAREMGDQQLFDQLLNHLEPPAKPSIVSAMLRYEHPLSLLFDELLFLAKVHAGFGALLRMPPPAAKLAGK

SEQ ID NO: 378 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYTDFSSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAGGDSIFSASAMALLLAREMGDQQLFDQLLNHLEPPAKPSIVSAMLRYEHPLSLLFDELLFLAKVHAGFGALLRMPPPAAKLAGK

SEQ ID NO: 379 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAHGNVWGDAAAFALLLAREMGDQQLFDQLLNHLEPPAKPSIVSAMLEYEHPLSLLFDELLFLAKVHAGFGALLRMPPPAAKLAGK

SEQ ID NO: 380 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPSNFTYIDGSGFALLLAREMGDQQLFDQLLNHLEPPAKPSIVSASLRYEHPGSGLFDELLFLAKVHAGFGALLRMPPPAAKLAGK

SEQ ID NO: 381 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKARVRETAGTTDAGQYTEWLAAAFALLLAREMGDQQLFDQLLNHLEPPAKPSIVSASLRYEHPLSALFDELLFLAKVHAGFGALLRMPPPAAKLAGK

SEQ ID NO: 382 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYSDHYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAGGDVTGHAAAFALLLAREMGDQQLFDQLLNHLEPPAKPSIVSASLRYEHPLSLLFDELLFLAKVHAGFGALLRMPPPAAKLAGK

SEQ ID NO: 383 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDADDSGFGNAAAFALLLAREMGDQQLFDQLLNHLEPPAKPSIVSASLRYEHPLSLLFDELLFLAKVHAGFGALLRMPPPAAKLAGK

SEQ ID NO: 384 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAFMNYIDHISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDATGGTLFDPAAFALLLAREMGDQQLFDQLLNHLEPPAKPSIVSAALYYEHPLSLLFDELLFLAKVHAGFGALLRMPPPAAKLAGK

SEQ ID NO: 385 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLATMNYADFYAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAQSLGGWSASSFALLLAREMGDQQLFDQLLNHLEPPAKPSIVSAALIYEHPLSLLFDELLFLAKVHAGFGALLRMPPPAAKLAGK

SEQ ID NO: 386 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAGGGGSFDAAAFALLLAREMGDQQLFDQLLNHLEPPAKPSIVSASLRYEHPLSDLFDELLFLAKVHAGFGALLRMPPPAAKLAGK

SEQ ID NO: 387 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYTDHYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGSGVGHAAAFALLLAREMGDQQLFDQLLNHLEPPAKPSIVSAMLRYEHPLSLLFDELLFLAKVHAGFGALLRMPPPAAKLAGK

SEQ ID NO: 388 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYSDFYAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDEWGGAGFNASAFALLLAREMGDQQLFDQLLNHLEPPAKPSIVSAMLRYEHPLSLLFDELLFLAKVHAGFGALLRMPPPAAKLAGK

SEQ ID NO: 389 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYWDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDDSTGDGGFSASAFALLLAREMGDQQLFDQLLNHLEPPAKPSIVSASLRYEHPLSALFDELLFLAKVHAGFGALLRMPPPAAKLAGK

SEQ ID NO: 390 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYTDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPSNGEHGFDASAFALLLAREMGDQQLFDQLLNHLEPPAKPSIVSASLRYEHPLSLLFDELLFLAKVHAGFGALLRMPPPAAKLAGK

SEQ ID NO: 391 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYDDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAGGTDGHASAAAMALLLAREMGDQQLFDQLLNHLEPPAKPSIVSARLRYEHPLSLLFDELLFLAKVHAGFGALLRMPPPAAKLAGK

SEQ ID NO: 392 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYDDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDDSERGHEFSASAFALLLAREMGDQQLFDQLLNHLEPPAKPSIVSASLRYEHPLSHLFDELLFLAKVHAGFGALLRMPPPAAKLAGK

SEQ ID NO: 393 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYEDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAGYDHGGFTAAAFALLLAREMGDQQLFDQLLNHLEPPAKPSIVSASLRYEHPLGGLFDELLFLAKVHAGFGALLRMPPPAAKLAGK

SEQ ID NO: 394 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHYAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAFEPGSYGNAAGFALLLAREMGDQQLFDQLLNHLEPPAKPSIVSAMLRYEHPLSLLFDELLFLAKVHAGFGALLRMPPPAAKLAGK

SEQ ID NO: 395 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAHNFPTPFSSSAHTLLLAREMGDQQLFDQLLNHLEPPAKPSIVSASLRYEHPLSGLFDELLFLAKVHAGFGALLRMPPPAAKLAGK

SEQ ID NO: 396 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAMTLAFIHGMDPAFSERYYPRFKQTFVEVYDEGRKARVRETAGTDDPGDDMGFAAAAMMALLLAREMGDQQLFDQLLNHLEPPAKPSIVSASLRYEHPLGNNFDELLFLAKVHAGFGALLRMPPPAAKLAGK

SEQ ID NO: 397 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYSDHYSPFYSRGCSFEAWELKHVPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAQNDSSGFSAAAFALLLAREMGDQQLFDQLLNHLEPPAKPSIVSAALRYEHPLSGLFDELLFLAKVHAGFGALLRMPPPAAKLAGK

SEQ ID NO: 398 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDHYSPFYSRGCSFEAWELKHVPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDGGRDMGWFSAAAFALLLAREMGDQQLFDQLLNHLEPPAKPSIVSASLRYEHPLSGCFDELLFLAKVHAGFGALLRMPPPAAKLAGK

SEQ ID NO: 399 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDGTLPDHAFSASAFALLLAREMGDQQLFDQLLNHLEPPAKPSIVSASLRYEHPLSLLFDELLFLAKVHAGFGALLRMPPPAAKLAGK

SEQ ID NO: 400 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYWDHYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDASYGIGGFDASAFALLLAREMGDQQLFDQLLNHLEPPAKPSIVSASLRYEHPLSGLFDELLFLAKVHAGFGALLRMPPPAAKLAGK

SEQ ID NO: 401 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYTDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDDSQGGNASGFALLLAREMGDQQLFDQLLNHLEPPAKPSIVSASLRYEHPLSLLFDELLFLAKVHAGFGALLRMPPPAAKLAGK

SEQ ID NO: 402 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDADHDGPLAAAFALLLAREMGDQQLFDQLLNHLEPPAKPSIVSASLRYEHPLSLLFDELLFLAKVHAGFGALLRMPPPAAKLAGK

SEQ ID NO: 403 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAGWAGGPAAGFALLLAREMGDQQLFDQLLNHLEPPAKPSIVSASLRYEHPLSLLFDELLFLAKVHAGFGALLRMPPPAAKLAGK

SEQ ID NO: 404 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKAAVRETAGTTDTDSDGLGSASAFALLLAREMGDQQLFDQLLNHLEPPAKPSIVSASLRYEHPLSLLFDELLFLAKVHAGFGALLRMPPPAAKLAGK

SEQ ID NO: 405 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAAMNYSDSHSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDASSDTNFLAAAHALLLAREMGDQQLFDQLLNHLEPPAKPSIVSASLRYEHPLSLLFDELLFLAKVHAGFGALLRMPPPAAKLAGK

SEQ ID NO: 406 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYEDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDSSRGHGSASAFALLLAREMGDQQLFDQLLNHLEPPAKPSIVSAELRYEHPLSLLFDELLFLAKVHAGFGALLRMPPPAAKLAGK

SEQ ID NO: 407 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDATGGPPFDAAAFALLLAREMGDQQLFDQLLNHLEPPAKPSIVSAMLRYEHPLSILFDELLFLAKVHAGFGALLRMPPPAAKLAGK

SEQ ID NO: 408 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYSDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAESHGLGHAAAFALLLAREMGDQQLFDQLLNHLEPPAKPSIVSAELRYEHPLSLLFDELLFLAKVHAGFGALLRMPPPAAKLAGK

SEQ ID NO: 409 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTTDDVGLGIGSAAAFALLLAREMGDQQLFDQLLNHLEPPAKPSIVSASLRYEHPLSLLFDELLFLAKVHAGFGALLRMPPPAAKLAGK

SEQ ID NO: 410 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYEDSHSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAGGGGFGLAAAFALLLAREMGDQQLFDQLLNHLEPPAKPSIVSASLRYEHPLSLLFDELLFLAKVHAGFGALLRMPPPAAKLAGK

SEQ ID NO: 411 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPGGPEGFDAAAFALLLAREMGDQQLFDQLLNHLEPPAKPSIVSASLRYEHPLSLLFDELLFLAKVHAGFGALLRMPPPAAKLAGK

SEQ ID NO: 412 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDATGGRYLMAAAFALLLAREMGDQQLFDQLLNHLEPPAKPSIVSAMLRYEHPLGYLFDELLFLAKVHAGFGALLRMPPPAAKLAGK

SEQ ID NO: 413 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYEDMHSPFYSRGCSFEAWELKHTHQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAHFDGYFAAAAFALLLAREMGDQQLFDQLLNHLEPPAKPSIVSASLRYEHPLSYLFDELLFLAKVHAGFGALLRMPPPAAKLAGK

SEQ ID NO: 414 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAWSGGPGHASAFALLLAREMGDQQLFDQLLNHLEPPAKPSIVSAMLRYEHPLSLLFDELLFLAKVHAGFGALLRMPPPAAKLAGK

SEQ ID NO: 415 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAAMNYSDHYAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAVNPDGWNAAAFALLLAREMGDQQLFDQLLNHLEPPAKPSIVSASLRYEHPLSLLFDELLFLAKVHAGFGALLRMPPPAAKLAGK

SEQ ID NO: 416 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYLDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDANGGDHFDAAAFALLLAREMGDQQLFDQLLNHLEPPAKPSIVSASLRYEHPLSLLFDELLFLAKVHAGFGALLRMPPPAAKLAGK

SEQ ID NO: 417 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHHSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDDGSGVGHAAAFALLLAREMGDQQLFDQLLNHLEPPAKPSIVSASLRYEHPLSLLFDELLFLAKVHAGFGALLRMPPPAAKLAGK

SEQ ID NO: 418 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKAAVRETAGTTDTDSPTAFLAAAHALLLAREMGDQQLFDQLLNHLEPPAKPSIVSAMLRYEHPLSLLFDELLFLAKVHAGFGALLRMPPPAAKLAGK

SEQ ID NO: 419 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDSSRNTLFPASAFALLLAREMGDQQLFDQLLNHLEPPAKPSIVSASLRYEHPLGALFDELLFLAKVHAGFGALLRMPPPAAKLAGK

SEQ ID NO: 420 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAGVTFGWNAAAFALLLAREMGDQQLFDQLLNHLEPPAKPSIVSASLRYEHPLSLLFDELLFLAKVHAGFGALLRMPPPAAKLAGK

SEQ ID NO: 421 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYWDFISPFYSRGCSFEAWELKHTHQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPSIGGFFSAAAFALLLAREMGDQQLFDQLLNHLEPPAKPSIVSASLRYEHPLSYLFDELLFLAKVHAGFGALLRMPPPAAKLAGK

SEQ ID NO: 422 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDGGGDGAFLAAAMALLLAREMGDQQLFDQLLNHLEPPAKPSIVSAMLRYEHPLSLLFDELLFLAKVHAGFGALLRMPPPAAKLAGK

SEQ ID NO: 423 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFYSPFYSRGCSFEAWELKHTHQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDQGPIGYSAAAFALLLAREMGDQQLFDQLLNHLEPPAKPSIVSASLRYEHPLSYLFDELLFLAKVHAGFGALLRMPPPAAKLAGK

SEQ ID NO: 424 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDALTGDFGNAAAFALLLAREMGDQQLFDQLLNHLEPPAKPSIVSAMLRYEHPLSLLFDELLFLAKVHAGFGALLRMPPPAAKLAGK

SEQ ID NO: 425 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPGGDGELWDAAAFALLLAREMGDQQLFDQLLNHLEPPAKPSIVSASLRYEHPLSALFDELLFLAKVHAGFGALLRMPPPAAKLAGK

SEQ ID NO: 426 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYADFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDPTSGTGVFSAAAFALLLAREMGDQQLFDQLLNHLEPPAKPSIVSAMLRYEHPLSALFDELLFLAKVHAGFGALLRMPPPAAKLAGK

SEQ ID NO: 427 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFISPFYSRGCSFEAWELKHVPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDGDHSQKGFSAAAFALLLAREMGDQQLFDQLLNHLEPPAKPSIVSASLRYEHPLSGLFDELLFLAKVHAGFGALLRMPPPAAKLAGK

SEQ ID NO: 428 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYWDHIAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYVTAWTLAFIHGMDPAFSERYYPRFKQTFVEVYDEGRKARVRETAGTTDAGGDGWHGTGAEFALLLAREMGDQQLFDQLLNHLEPPAKPSIVSASLRYEHPLSYLFDELLFLAKVHAGFGALLRMPPPAAKLAGK

SEQ ID NO: 429 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDFYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKAAVRETAGTTDTDTAHNAFSASAHALLLAREMGDQQLFDQLLNHLEPPAKPSIVSAMLRYEHPLSALFDELLFLAKVHAGFGALLRMPPPAAKLAGK

SEQ ID NO: 430 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYVDHYSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVVVYDEGRKATVRETAGTDDDSNGGTVGHAAAFALLLAREMGDQQLFDQLLNHLEPPAKPSIVSAMLRYEHPLSLLFDELLFLAKVHAGFGALLRMPPPAAKLAGK

SEQ ID NO: 431 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAAMNYVDFYAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAVPFGNVWLPAAFALLLAREMGDQQLFDQLLNHLEPPAKPSIVSAMLFYEHPLSLLFDELLFLAKVHAGFGALLRMPPPAAKLAGK

SEQ ID NO: 432 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDPSQDEPGFSASAMALLLAREMGDQQLFDQLLNHLEPPAKPSIVSASLRYEHPLSALFDELLFLAKVHAGFGALLRMPPPAAKLAGK

SEQ ID NO: 433 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDAYPYLLGFSAAAFALLLAREMGDQQLFDQLLNHLEPPAKPTIVSAALFYEHPLSLLFDELLFLAKVHAGFGALLRMPPPAAKLAGK

SEQ ID NO: 434 - protein, 400 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYADFYAPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTTDAQTLYKYGNAAGFALLLAREMGDQQLFDQLLNHLEPPAKPSIVSAMLIYEHPLSYLFDELLFLAKVHAGFGALLRMPPPAAKLAGK

SEQ ID NO: 435 - protein, 399 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDHISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDANDTGFGSASSFALLLAREMGDQQLFDQLLNHLEPPAKPSIVSASLRYEHPLSLLFDELLFLAKVHAGFGALLRMPPPAAKLAGK

SEQ ID NO: 436 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAWWNYIDFISPFYSRGCSFEWWELKHTPQRVWKYSIAFWAYGLASVALIDPKLRALAGHDLDIAISKMKCKRWWGDWEEDGFGTDPIEKENIMYKGHLNLMWGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 437 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAFGLASVALIDPKLRALAGHDLDIAISKMKCKRVWGDWEEDGFGTDPIEKENIMYKGHLNAMYGLYQLVTGSRRYEAEHAHLTRIIHDEIAANPFAGIVCEPDNYFIQCNSVAYFSLWIYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 438 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAFLSLWVYDRLHGTDYRAATRAFFDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 439 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAFMNYIDFISPFYSRGCSFEAWELKHTPQRVIKYSIAFFAYGLASVALIDPKLRALAGHDLDIAISKMKCKRVWGDWEEDGFGTDPIEKENIMYKGHLNMMYGLYQLVTGSRRYEAEHAHLTRIIHDEIAANPFAGIVCEPDNYFIQCNSVAFLSLFIYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGWASLFTLLLAREMGDQQLFDQLLNHLEPPAKPSIVSASLRYEHPGSLLFDELLFLAKVHAGFGALLRMPPPAAKLAGK

SEQ ID NO: 440 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAWLNYIDFISPFYSRGCSFEAWELKHTPQRVIKYSIAFLAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLFVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFFAKVHAGFGALLRMPPPAAKLAGK

SEQ ID NO: 441 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFFAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAFFSLWVYDRLHGTDYRAATRAFFDFIQKDLIDPERGAFYLSYHPESGAVKPWISAYTTAWTLAFIHGMDPAFSERYYPRFKQTFVEVYDEGRKARVRETAGTDDADGGVGLASLFTLLLAREMGDQQLFDQLLNHLEPPAKPSIVSASLRYEHPGSLLFDELLFFAKVHAGFGALLRMPPPAAKLAGK

SEQ ID NO: 442 - protein, 398 aa, Artificial Sequence
  Description of Artificial Sequence: Synthetic polypeptide
MMRFTLKTTAIVSAAALLAGFGPPPRAAELPPGRLATTEDYFAQLAKQAVTPDVMAQLAYMNYIDFISPFYSRGCSFEAWELNHTPKRVIKYSIAFYAYGLASVALIDPKLRALAGHDLDIAISKMKCPRVWGEWKEDGFGEDPIEKENIMYKGHLALMYGLYQLVTGSRRYEAEHAHLTRIIHDEIEANPFAGIVCEPDNYFIQCNAVAFLALWVYDRLHGTDYRRSTEAWLDFIQDGLIDPERGAFYLSYHPESGAVKPWISAYTTAWTLAFIHGMDPAFSERYYPRFKQTFVEVYDNGNKARVRETAGTDDADGGVGWASAFTLLLAREMGDQELFDWLLNHLEPPAKPSIVSASLRYEHPGSLLFDALLFLAKVHTGFGALLRMPPPAAKLAGK

SEQ ID NO: 443 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAEMNYIDFISPFYSRGCSFEAWELKHTPKRVIKYSIAFFAYGLAAVALIDPKLRALAGHDLDIAISKMKCKRVWGEWEEDGFGTDPIERKNIMYKGHLNLMYGLYQLVTGSRRYEAEHAHLTRIIHDEIARNPFAGIVCEPDNYFIQCNAVAFLSLFVYDRLHGTNYRAATRAWLDFIQKDLIDPDRGAFYLSYHPESGAVKPWISAYTTAWALAFIHGMDPAFSERYYPRFKQTFVEVYDEGRKARVRETAGTDDADGGVGLASAFALLLAREMGDQQLFDQLLNHLEPPAKPSIVSARLRYEHPGSLLFEELLFLAKVHAGFGALLRMPPPAAKLAGK

SEQ ID NO: 444 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAEMNYIDFISPFYSRGCSFEAWELKHVPKRVIKYSIAFFAYGLASVALIDPKLRALAGHDLDIAISKMKCKRVWGEWEEDGFGTDPIERKNIMYKGHLNLMYGLYQLVTGSRRYEAEHRHLTRIIHDEIAANPFGGIVCEPDNYFIQCNSVAFLSLWVFDRLHGTDFRASTRAFFDFIQDGLIDPERGAFYLSYHPESGAVKPWISAYTTAWTLAFIHGMDPAFSERYYPRFKQTFVEVYDNGNKARVRETAGTDDADGGVGLASAFALLLAREMGDKQLFDWLLNHLEPPANPSIVSARLRYENPGSLLFEELLFLAKVHAGFGALLRMPPPAAKLAGK

SEQ ID NO: 445 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAFHNYIDFISPFYSRGCSFEAWELKHVPQRVIRYSIAFMAFGLASVALIDPRLRALAGHDLDIAISKMKCKRVWGDWEEDGFGTDPIEKENIMYKGHLNMMYGLYQLVTGSRRYEAEHAHLTRIIHDEIAANPFAGIVCEPDNYFIQCNSVAFLSLWIYDRLHGTDYREATRAWLDFIQKDLIDPDRGAFYLSYHPESGAVKPWISAYTTAWTLAFIHGMDPAFSERYYPRFKQTFVEVFDEGRKARVRETAGTDDPDGGVGLASAFALLLAREMGDQQLFDQLLNYLEPPAKPSIVSASLRYEHPGSLLFDELLFLAKVHAGFGALLRMPPPAAKLAGK

SEQ ID NO: 446 - protein, 398 aa, Artificial Sequence
  Description of Artificial Sequence: Synthetic polypeptide
MMRFTLKTTAIVSAAALLAGFGPPPRAAELPPGRLATTEDYFQQQNKQAVTPDVMAQLAYMNYIDFISPFYSRGCSFEAWELNHTPQRVIKYSIAFYAYGLASVAIIDPKLRALAGHDLDIAISQMLCKRVWGDWEEDGFGTDPREWGNIMYKGHLNLMYGLYQLVTGSRRYENEHAELTRRIHDEIAANPFGGITCEPDNYFIQCNAVAYFSLWVYDRLHGTDYRAATRAWLDFIQDGLIDPERGAFYLSYHPESGAVKPWISAYTTAWTLAFIHGMDPAFSERYYPRFKQTFVEVYDEGRKARVRETAGTDDADGGVGWASLFTLLLAREMGDQQLFDQLLNHLEPPANPSIVSASLRYVNPLSLLFDELLFLAKVHTGFGALLRMPPPAAKLAGK

SEQ ID NO: 447 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKFSIAFYAFGLASVALIDPKLRALAGHDLDIAISKMKCKRVWGDWEEDGFGTDPIEKENIMYKGFLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 448 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFRSPFYSRGCSFEAWEEKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 449 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFRSPFYSRGCSFEAWEDKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 450 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYHDFTSPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 451 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVLAQLAYMNLIDHISPFYTEGCQFTAWELKHTPQEMIKHSIAFYAYGLASVALIDPKLRKLAGHDLEIAVSKMKCKRVWGDWERRGFGTDPIEKENIEYKGHLNLMYGLYQLVTGSRKYEAEHAHLTRIIHDEIAANPFAGIVCEPDHYFVQCNSVAYLSLWVYDRLHGTDYRAATRAWLDFIQKDLIDPERGAFYLSYHPRSGGVKPWISAYTTAWTLAMVHGMDPAFSERYYPRFKQTFVEVYDEGRKARVRETAGTDYADGGVGLASAFTLLLAREMGDQQLFDQLLNHLEPPAKPSIVANSLRYEHPGSLLFDELLFLAKVHAGFGALLRMPPPAAKLAGK

SEQ ID NO: 452 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVEAQLAYMNFIDFISPFYTEGCAFEAWELKHTPQRMIKYSIAFYAYGLASVALIDPKLRKIAGHDLDIAVSKMKCKRVWGDWEEDGFGTDPIEKENIAYKGHLNLMYGLYQLVTGSRKYEAEHAHLTRIIHDEIAANPFAGIVCEPDHYFVQCNSVAYLSLWVYDRLHGTDYRAATRAWLDFIQKDLIDPERGAFYLSYHPHSGGVFRWISAYTTAWTLAMVHGMDPAFSERYYPRFKQTFVEVYDEGRKARVRETAGTDYADGGVGLASAFTLLLAREMGDQQLFDQLLNHLEPPAKPSIVANSLRYEHPGSLLFDELLFLAKVHAGFGALLRMPPPAAKLAGK

SEQ ID NO: 453 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFVQCNSVAYLSLWVYDRLHGTDYRAATRAWLDFIQKDLIDPERGAFYLSYHPRSGGVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 454 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKACVRETAGTDDCDGGVGLASAFTLLLAREMGDQQLFDQLLNHLEPPAKPSIVSASLRYEHPGSLLFDELLFLAKVHAGFGALLRMPPPAAKLAGK

SEQ ID NO: 455 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLCLMYGLYQLVTGSRRYEAEHAHLTRIIHDEIAANPFAGIVCEPDNYFIQCNSVAYLCLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 456 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFCGIVCEPDNYFIQCNSVAYLSLWVYDRLHGTDYRAATRAWLDCIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 457 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPCEKENIMYCGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASAFTLLLAREMGDQQLFDQLLNHLEPPAKPSIVSASLRYEHPGSLLFDELLFLAKVHAGFGALLRMPPPAAKLAGK

SEQ ID NO: 458 - protein, 398 aa, Artificial Sequence
  Description of Artificial Sequence: Synthetic polypeptide
MMRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAISKMKCKRVWGDWEEDGFGTDPIEKENIMYKGHLNLMYGLYQLVTGSRRYEAEHAHLTRIIHDEIAANPFAGIVCEPDNYFIQCNSVAYLSLWVYDRLHGTDYRAATRAWLDFIQKDLIDPERGAFYLSYHPESGAVKPWISAYTTAWTLAFIHGMDPAFSERYYPRFKQTFVEVYDEGRKARVRETAGTDDADGGVGLASCFTLLLAREMGDQQLFDQLLNHLEPPAKPSIVSASLRYEHPGSLLFDECLFLAKVHAGFGALLRMPPPAAKLAGK

SEQ ID NO: 459 - DNA, 1119 bp, Artificial Sequence
  Description of Artificial Sequence: Synthetic polynucleotide
atggcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaatggccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttgtgttagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaatga

SEQ ID NO: 460 - protein, 372 aa, Artificial Sequence
  Description of Artificial Sequence: Synthetic polypeptide
MAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEMAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLVLAREMGDQQLFDQLLNHLEPPAKPSIVSASLRYEHPGSLLFDELLFLAKVHAGWGALLRMPPPAAKLAGK

SEQ ID NO: 461 - DNA, 1194 bp, Artificial Sequence
  Description of Artificial Sequence: Synthetic polynucleotide
atgcgtttcacattaaagaccaccgcgattgtttctgccgccgcgttattagcgggttttggaccaccacctcgtgcagcagaattacctcccggccgccttgccacaaccgaagattatttcgcacaacaagcaaaacaagctgtaaccccggatgttatggctcaactcgcgtacatgaactatattgatttcattagccccttttattcacgtggatgttcattcgaagcatgggaattgaaacacactccgcagcgcgtgattaaatactccattgcattctatgcttatggcttggcatctgtagcattaatcgaccctaaactgcgcgcgctcgccggccacgacttagatattgcagtctcaaaaatgaaatgtaaacgtgtatggggagattgggaagaagatggttttggtacagatccgattgaaaaagaaaacattatgtataaaggacatctgaaccttatgtatggtctctatcaacttgttactggatcgcgccgttacgaagctgaacacgctcacctcacccgtattatccacgacgaaatggccgccaacccattcgccggaatcgtttgtgaaccagacaactattttgtacaatgcaactctgtggcctatttaagcctttgggtctacgatcgtttacatggaactgactaccgtgccgcaactcgtgcctggctggattttattcaaaaagatctgattgaccccgaacgtggagctttctatttgtcctatcatcccgaatctggtgccgtcaaaccttggatcagcgcatatacaaccgcttggacgttagctatggtgcatggaatggatcctgccttttcagaacgttattatcctcgttttaaacaaacgttcgtcgaagtctatgatgaaggccgtaaagcccgcgtacgcgaaactgccggaaccgacgacgccgatggtggtgtgggtttagcctctgcgttcacacttgtgttagcccgcgaaatgggagatcaacaactctttgaccaactgctgaatcatttagaaccccctgccaaaccaagcatcgtttctgctagcctccgctacgaacacccaggcagcctcttattcgacgaactgttatttcttgccaaagtacatgccggatggggtgctctgttacgtatgccccctcctgccgccaaattagcgggcaaatga

SEQ ID NO: 462 - protein, 397 aa, Artificial Sequence
  Description of Artificial Sequence: Synthetic polypeptide
MRFTLKTTAIVSAAALLAGFGPPPRAAELPPGRLATTEDYFAQQAKQAVTPDVMAQLAYMNYIDFISPFYSRGCSFEAWELKHTPQRVIKYSIAFYAYGLASVALIDPKLRALAGHDLDIAVSKMKCKRVWGDWEEDGFGTDPIEKENIMYKGHLNLMYGLYQLVTGSRRYEAEHAHLTRIIHDEMAANPFAGIVCEPDNYFVQCNSVAYLSLWVYDRLHGTDYRAATRAWLDFIQKDLIDPERGAFYLSYHPESGAVKPWISAYTTAWTLAMVHGMDPAFSERYYPRFKQTFVEVYDEGRKARVRETAGTDDADGGVGLASAFTLVLAREMGDQQLFDQLLNHLEPPAKPSIVSASLRYEHPGSLLFDELLFLAKVHAGWGALLRMPPPAAKLAGK

We claim:

1. A polypeptide comprising the amino acid sequence of SEQ ID NO:462, wherein SEQ ID NO:462 is a triple mutant of SEQ ID NO:1 carrying the following three mutations: F382W, L328V, and I187M; or a signal-peptide-less version thereof (SEQ ID NO:460).

2. The polypeptide of claim 1 consisting of the amino acid sequence of SEQ ID NO:460 or SEQ ID NO:462.

3. A polynucleotide comprising a nucleic acid sequence encoding the polypeptide of claim 1.

4. The polynucleotide of claim 3 comprising SEQ ID NO:459 or SEQ ID NO:461.

5. The polynucleotide of claim 3, further comprising a promoter operably linked to the nucleic acid sequence encoding the polypeptide of claim 1.

6. A host cell transformed or transduced with the polynucleotide of claim 3.

7. The host cell of claim 6, wherein the host cell is a bacterium.

8. A composition comprising the polypeptide of claim 1 and 3-buten-2-ol, 3-methyl-3-buten-2-d, or both.

9. A method for producing 1,3-butadiene by the dehydration of 3-buten-2-ol to 1,3-butadiene in the presence of the polypeptide of claim 1.

10. A method for producing 1,3-butadiene by the dehydration of 3-buten-2-ol to 1,3-butadiene in the presence of the polypeptide of claim 2.

11. A method for producing isoprene by the dehydration of 3-methyl-3-buten-2-ol to isoprene in the presence of the polypeptide of claim 1.

12. A method for producing isoprene by the dehydration of 3-methyl-3-buten-2-ol to isoprene in the presence of the polypeptide of claim 2.

* * * * *